United States Patent 12,606,847 (ENGINEERED VIRAL CAPSID POLYPEPTIDES AND USES THEREOF) - sequence listing, part 4

SEQ ID NO: 67460 - protein, 28 aa, Artificial Sequence
  Description of Artificial Sequence: Synthetic peptide
AENEIACTNPVATEQYGEASENLQRTGR

SEQ ID NO: 67461 - protein, 31 aa, Artificial Sequence
  Description of Artificial Sequence: Synthetic polypeptide
AEEEIACTNPVATEQYGCVATNLQDRGANQI

SEQ ID NO: 67462 - protein, 32 aa, Artificial Sequence
  Description of Artificial Sequence: Synthetic polypeptide
DEEEIATTNPVAYEQYGSVATNLQDDQMGDNH

SEQ ID NO: 67463 - protein, 31 aa, Artificial Sequence
  Description of Artificial Sequence: Synthetic polypeptide
DEEEIATTNPVAYEQYGSVATNLQDDGGGEH

SEQ ID NO: 67464 - protein, 30 aa, Artificial Sequence
  Description of Artificial Sequence: Synthetic polypeptide
AEEEIACTNPVATEQYGCVATNLQDTGNQP

SEQ ID NO: 67465 - protein, 28 aa, Artificial Sequence
  Description of Artificial Sequence: Synthetic peptide
AENEIACTNPVATEQYGEASENLQRGGP

SEQ ID NO: 67466 - protein, 28 aa, Artificial Sequence
  Description of Artificial Sequence: Synthetic peptide
AENEIACTNPVATEQYGEMSENLQVGGR

SEQ ID NO: 67467 - protein, 32 aa, Artificial Sequence
  Description of Artificial Sequence: Synthetic polypeptide
DEEEIATTNPVAYEQYGSVATNLQDAPGGNVN

SEQ ID NO: 67468 - protein, 32 aa, Artificial Sequence
  Description of Artificial Sequence: Synthetic polypeptide
DEEEIATTNPVAYEQYGSVATNLQDAGGNENN

SEQ ID NO: 67469 - protein, 30 aa, Artificial Sequence
  Description of Artificial Sequence: Synthetic polypeptide
DEECISTTNPVATEAYGCVNTNALQYGSNQ

SEQ ID NO: 67470 - protein, 30 aa, Artificial Sequence
  Description of Artificial Sequence: Synthetic polypeptide
CEEEIATTNPVAYEQYGSVAITNLQRTPEE

SEQ ID NO: 67471 - protein, 29 aa, Artificial Sequence
  Description of Artificial Sequence: Synthetic peptide
AENEIACTNPVATEQYGEMSENLQRGGVR

SEQ ID NO: 67472 - protein, 32 aa, Artificial Sequence
  Description of Artificial Sequence: Synthetic polypeptide
DEEEIATTNPVAYEQYGSVATNLQDADGNDNN

SEQ ID NO: 67473 - protein, 29 aa, Artificial Sequence
  Description of Artificial Sequence: Synthetic peptide
AENEIACTNPVATEQYGEASENLQRVGGR

SEQ ID NO: 67474 - protein, 31 aa, Artificial Sequence
  Description of Artificial Sequence: Synthetic polypeptide
DEEEIATTNPVAYEQYGSVATNLQDDSDGQH

SEQ ID NO: 67475 - protein, 28 aa, Artificial Sequence
  Description of Artificial Sequence: Synthetic peptide
AENEIACTNPVATEQYGEASENLQRGEL

SEQ ID NO: 67476 - protein, 29 aa, Artificial Sequence
  Description of Artificial Sequence: Synthetic peptide
AENEIACTNPVATEQYGEASENLQRWGGR

SEQ ID NO: 67477 - protein, 33 aa, Artificial Sequence
  Description of Artificial Sequence: Synthetic polypeptide
DEECIRTVNPVATEQYGSGVCSTGAPLQFGNRL

SEQ ID NO: 67478 - protein, 34 aa, Artificial Sequence
  Description of Artificial Sequence: Synthetic polypeptide
AEEEIRTTNPVATEQYGSVSTVNLQENNEGGNQA

SEQ ID NO: 67479 - protein, 33 aa, Artificial Sequence
  Description of Artificial Sequence: Synthetic polypeptide
AEEEIRTTNPVATEQYGSVSTVNLQEINAEGGV

SEQ ID NO: 67480 - protein, 32 aa, Artificial Sequence
  Description of Artificial Sequence: Synthetic polypeptide
CEEEIRTTNPVAYEAYGCSVSTNELQRPSGSQ

SEQ ID NO: 67481 - protein, 28 aa, Artificial Sequence
  Description of Artificial Sequence: Synthetic peptide
AENEIACTNPVATEQYGEASENLQRAGR

SEQ ID NO: 67482 - protein, 31 aa, Artificial Sequence
  Description of Artificial Sequence: Synthetic polypeptide
CEEEIATTNPVAYEQYGSVATNLETGDNDRG

SEQ ID NO: 67483 - protein, 31 aa, Artificial Sequence
  Description of Artificial Sequence: Synthetic polypeptide
DEAEIRTTNPVATEQYGCVCSTEHQTFGSNQ

SEQ ID NO: 67484 - protein, 32 aa, Artificial Sequence
  Description of Artificial Sequence: Synthetic polypeptide
DEECIRTTNPVAYEQYGQSVSANDLLQRGITM

SEQ ID NO: 67485 - protein, 28 aa, Artificial Sequence
  Description of Artificial Sequence: Synthetic peptide
AENEIASVNPVATEQYGEASDNLQSGNR

SEQ ID NO: 67486 - protein, 32 aa, Artificial Sequence
  Description of Artificial Sequence: Synthetic polypeptide
DEECIRTTNPVAYEQYGQTVSCTANVSQRGNN

SEQ ID NO: 67487 - protein, 31 aa, Artificial Sequence
  Description of Artificial Sequence: Synthetic polypeptide
DEECIRTTNPVAYEQYGQVCTINLVQGGNTV

SEQ ID NO: 67488 - protein, 29 aa, Artificial Sequence
  Description of Artificial Sequence: Synthetic peptide
DEECIRTTNPVAYEQYGQVSAIAVQRDNN

SEQ ID NO: 67489 - protein, 32 aa, Artificial Sequence
  Description of Artificial Sequence: Synthetic polypeptide
DEDEIRTTNPVAYEQYGTVSTNLNQGEGDNDT

SEQ ID NO: 67490 - protein, 32 aa, Artificial Sequence
  Description of Artificial Sequence: Synthetic polypeptide
DEDEIRTTNPVAYEQYGTVSTNLNQNGEGDNH

SEQ ID NO: 67491 - protein, 31 aa, Artificial Sequence
  Description of Artificial Sequence: Synthetic polypeptide
DDENIRTTNPVATEQYGAVSVNNGQRGVGNL

SEQ ID NO: 67492 - protein, 31 aa, Artificial Sequence
  Description of Artificial Sequence: Synthetic polypeptide
DEDEIRTTNPVAYEQYGTVSTAMQRGGNDDG

SEQ ID NO: 67493 - protein, 31 aa, Artificial Sequence
  Description of Artificial Sequence: Synthetic polypeptide
DDENIRTTNPVATEQYGAVSVNGQRGQGNLG

SEQ ID NO: 67494 - protein, 32 aa, Artificial Sequence
  Description of Artificial Sequence: Synthetic polypeptide
DEECIRTTNPVAYEQYGQVSTGNMVQRGGNNN

SEQ ID NO: 67495 - protein, 31 aa, Artificial Sequence
  Description of Artificial Sequence: Synthetic polypeptide
DEAEIRTTNPVAYEQWGSICSTNLEHRPNER

SEQ ID NO: 67496 - protein, 31 aa, Artificial Sequence
  Description of Artificial Sequence: Synthetic polypeptide
DDENIRTTNPVATEQYGAVSVNGGQRGVGNE

SEQ ID NO: 67497 - protein, 31 aa, Artificial Sequence
  Description of Artificial Sequence: Synthetic polypeptide
DEECIRTTNPVAYEQYGQVSTIAVQDRGNAN

SEQ ID NO: 67498 - protein, 32 aa, Artificial Sequence
  Description of Artificial Sequence: Synthetic polypeptide
DEEEIRTTNPVATEFYGMVSTDNMQGNGGNID

SEQ ID NO: 67499 - protein, 32 aa, Artificial Sequence
  Description of Artificial Sequence: Synthetic polypeptide
DEECIRTTNPVAYEQYGQVSTINVQRGDNHNM

SEQ ID NO: 67500 - protein, 30 aa, Artificial Sequence
  Description of Artificial Sequence: Synthetic polypeptide
DDENIRTTNPVATEQYGAVSTNHQVRNPEL

SEQ ID NO: 67501 - protein, 31 aa, Artificial Sequence
  Description of Artificial Sequence: Synthetic polypeptide
DEEEIRTTNPVATEEYGCISTNEQRFSSNFF

SEQ ID NO: 67502 - protein, 28 aa, Artificial Sequence
  Description of Artificial Sequence: Synthetic peptide
AENEIACTNPVATEQYGEASENLQRCDR

SEQ ID NO: 67503 - protein, 28 aa, Artificial Sequence
  Description of Artificial Sequence: Synthetic peptide
AENEIACTNPVATEQYGEASENLQRCGR

SEQ ID NO: 67504 - protein, 31 aa, Artificial Sequence
  Description of Artificial Sequence: Synthetic polypeptide
DEDEIRTTNPVAYEQYGTVSTNLNGDGDNDT

SEQ ID NO: 67505 - protein, 32 aa, Artificial Sequence
  Description of Artificial Sequence: Synthetic polypeptide
DEECIRTTNPVAYEQYGTASTANLPQYGGNQR

SEQ ID NO: 67506 - protein, 32 aa, Artificial Sequence
  Description of Artificial Sequence: Synthetic polypeptide
DEAEIRTTNPVATEQYGSVSTDNNNDNRDGDQ

SEQ ID NO: 67507 - protein, 28 aa, Artificial Sequence
  Description of Artificial Sequence: Synthetic peptide
AENEIASTNPVCTEQYGVVSENLQSGNQ

SEQ ID NO: 67508 - protein, 29 aa, Artificial Sequence
  Description of Artificial Sequence: Synthetic peptide
AENEIACTNPVATEQYGEASENLQQRGGR

SEQ ID NO: 67509 - protein, 33 aa, Artificial Sequence
  Description of Artificial Sequence: Synthetic polypeptide
DEAEIRTTNPVATEQYGCVSTDTLIQNGGNERF

SEQ ID NO: 67510 - protein, 30 aa, Artificial Sequence
  Description of Artificial Sequence: Synthetic polypeptide
DEEEIRATNPVTTEQYGSVSTNNATEIGTE

SEQ ID NO: 67511 - protein, 30 aa, Artificial Sequence
  Description of Artificial Sequence: Synthetic polypeptide
DEEEIRATNPVTTEQYGSVSTNNAEQGTTT

SEQ ID NO: 67512 - protein, 28 aa, Artificial Sequence
  Description of Artificial Sequence: Synthetic peptide
AENEIACTNPVATEQYGEASYNLQRGGV

SEQ ID NO: 67513 - protein, 32 aa, Artificial Sequence
  Description of Artificial Sequence: Synthetic polypeptide
DEDEIRTTNPVAYEQYGTVSTNLQNGEGQNNH

SEQ ID NO: 67514 - protein, 34 aa, Artificial Sequence
  Description of Artificial Sequence: Synthetic polypeptide
AEEEIRTTNPVATEQYGSVSTVNLQGNQQGNQTN

SEQ ID NO: 67515 - protein, 32 aa, Artificial Sequence
  Description of Artificial Sequence: Synthetic polypeptide
DEDEIRTTNPVAYEQYGTVSTNLQGGTGNNET

SEQ ID NO: 67516 - protein, 32 aa, Artificial Sequence
  Description of Artificial Sequence: Synthetic polypeptide
DEAEIRTTNPVAYEQWGNVSTNLQGQDNGNER

SEQ ID NO: 67517 - protein, 31 aa, Artificial Sequence
  Description of Artificial Sequence: Synthetic polypeptide
DEECIRTTNPVAYEQYGKTVSTNASTDGTNR

SEQ ID NO: 67518 - protein, 34 aa, Artificial Sequence
  Description of Artificial Sequence: Synthetic polypeptide
AEEEIRTTNPVATEQYGSVSTVNLQENNQGTNDG

SEQ ID NO: 67519 - protein, 32 aa, Artificial Sequence
  Description of Artificial Sequence: Synthetic polypeptide
DEECIRTTNPVAYEQYGKVSTGNVSQRGENNN

SEQ ID NO: 67520 - protein, 34 aa, Artificial Sequence
  Description of Artificial Sequence: Synthetic polypeptide
AEEEIRTTNPVATEQYGSVSTVNLQENNQGNQQN

SEQ ID NO: 67521 - protein, 29 aa, Artificial Sequence
  Description of Artificial Sequence: Synthetic peptide
DEECIACTNPVAYEQYGSVANMNDQRGNL

SEQ ID NO: 67522 - protein, 32 aa, Artificial Sequence
  Description of Artificial Sequence: Synthetic polypeptide
DEDEIRTTNPVAYEQYGTVSTNLQADGGNGNK

SEQ ID NO: 67523 - protein, 29 aa, Artificial Sequence
  Description of Artificial Sequence: Synthetic peptide
AENEIASTNPVATEQYGEQASENLQRGGR

SEQ ID NO: 67524 - protein, 28 aa, Artificial Sequence
  Description of Artificial Sequence: Synthetic peptide
DEECIACTNPVAYEQYGSVAMNDQDGND

SEQ ID NO: 67525 - protein, 32 aa, Artificial Sequence
  Description of Artificial Sequence: Synthetic polypeptide
DDETIRTTNPVATEQYGAVSTNGGQRGNGNGN

SEQ ID NO: 67526 - protein, 29 aa, Artificial Sequence
  Description of Artificial Sequence: Synthetic peptide
AENEIACTNPVATEQYGEASENLQRAGGR

SEQ ID NO: 67527 - protein, 32 aa, Artificial Sequence
  Description of Artificial Sequence: Synthetic polypeptide
DEEEIGTTNPVAYEEYGSTVSCTNELQIGGNQ

SEQ ID NO: 67528 - protein, 29 aa, Artificial Sequence
  Description of Artificial Sequence: Synthetic peptide
AENEIASTNPVATEQYGNASENLQSRGGR

SEQ ID NO: 67529 - protein, 33 aa, Artificial Sequence
  Description of Artificial Sequence: Synthetic polypeptide
DEEEIRATNPVATEQYGSVSANNQGEAGSNSRD

SEQ ID NO: 67530 - protein, 28 aa, Artificial Sequence
  Description of Artificial Sequence: Synthetic peptide
AENEIASTNPVATEQYGVASENLQSGNQ

SEQ ID NO: 67531 - protein, 29 aa, Artificial Sequence
  Description of Artificial Sequence: Synthetic peptide
AENEIACTNPVATEQYGEASYNLQSRGGR

SEQ ID NO: 67532 - protein, 31 aa, Artificial Sequence
  Description of Artificial Sequence: Synthetic polypeptide
DEEEIRATNPVATEQYGSVSANQDEAGGNSN

SEQ ID NO: 67533 - protein, 29 aa, Artificial Sequence
  Description of Artificial Sequence: Synthetic peptide
AENEIACTNPVATEQYGCSSSNLQRGGRA

SEQ ID NO: 67534 - protein, 28 aa, Artificial Sequence
  Description of Artificial Sequence: Synthetic peptide
AENEIACTNPVATEQYGEASENLQRWGR

SEQ ID NO: 67535 - protein, 29 aa, Artificial Sequence
  Description of Artificial Sequence: Synthetic peptide
AENEIACTNPVATEQYGEASENLQRGGRE

SEQ ID NO: 67536 - protein, 28 aa, Artificial Sequence
  Description of Artificial Sequence: Synthetic peptide
AENEIACTNPVATEQYGEATENLQRGGR

SEQ ID NO: 67537 - protein, 28 aa, Artificial Sequence
  Description of Artificial Sequence: Synthetic peptide
AENEIACTNPVATEQWGEVSENLQREGR

SEQ ID NO: 67538 - protein, 32 aa, Artificial Sequence
  Description of Artificial Sequence: Synthetic polypeptide
AEEEIRTTNPVATEQYGSVSTVNLNQEEEQGQ

SEQ ID NO: 67539 - protein, 29 aa, Artificial Sequence
  Description of Artificial Sequence: Synthetic peptide
AENEIACTNPVATEQYGEASENLQREGGR

SEQ ID NO: 67540 - protein, 30 aa, Artificial Sequence
  Description of Artificial Sequence: Synthetic polypeptide
DEDEIRTTNPVAYEQYGNVSTADGGNHGNR

SEQ ID NO: 67541 - protein, 31 aa, Artificial Sequence
  Description of Artificial Sequence: Synthetic polypeptide
DDEEVASTNPVATEQYGSVATNTIQSRVGNR

SEQ ID NO: 67542 - protein, 28 aa, Artificial Sequence
  Description of Artificial Sequence: Synthetic peptide
AENEIACTNPVATEQYGEASENLQREGR

SEQ ID NO: 67543 - protein, 29 aa, Artificial Sequence
  Description of Artificial Sequence: Synthetic peptide
AENEIACTNPVATEQYGEASENLQREGVR

SEQ ID NO: 67544 - protein, 31 aa, Artificial Sequence
  Description of Artificial Sequence: Synthetic polypeptide
DEAEIRTTNPVATEQYGCVCSTELQYFPNDA

SEQ ID NO: 67545 - protein, 32 aa, Artificial Sequence
  Description of Artificial Sequence: Synthetic polypeptide
DDEEIVTTNPVATEQYGSVSMTNVQNLGQNEF

SEQ ID NO: 67546 - protein, 29 aa, Artificial Sequence
  Description of Artificial Sequence: Synthetic peptide
AENEIACTNPVATEQYGEASENLQRFGGR

SEQ ID NO: 67547 - protein, 32 aa, Artificial Sequence
  Description of Artificial Sequence: Synthetic polypeptide
DEECIRTTNPVCTEQWGSVPSCTNGSQSGGNR

SEQ ID NO: 67548 - protein, 29 aa, Artificial Sequence
  Description of Artificial Sequence: Synthetic peptide
AENEIACTNPVATEQYGEASENLQRFGQR

SEQ ID NO: 67549 - protein, 34 aa, Artificial Sequence
  Description of Artificial Sequence: Synthetic polypeptide
DEECIRTTNPVCTEQYGSTVSCTGNALSQSGTNR

SEQ ID NO: 67550 - protein, 34 aa, Artificial Sequence
  Description of Artificial Sequence: Synthetic polypeptide
AEEEIRTTNPVATEQYGSVSTVNLNQENGNQNQN

SEQ ID NO: 67551 - protein, 28 aa, Artificial Sequence
  Description of Artificial Sequence: Synthetic peptide
AENEIACTNPVATEQYGEASENLQRFGR

SEQ ID NO: 67552 - protein, 31 aa, Artificial Sequence
  Description of Artificial Sequence: Synthetic polypeptide
DEEEIRATNPVATEQYGSVSSVNQDTGSNNG

SEQ ID NO: 67553 - protein, 32 aa, Artificial Sequence
  Description of Artificial Sequence: Synthetic polypeptide
DEEEIRTTNPVATEGYGSVCFTNLTNGGSNAA

SEQ ID NO: 67554 - protein, 33 aa, Artificial Sequence
  Description of Artificial Sequence: Synthetic polypeptide
DEECIRTTNPVSTEQYGSVVSCTNLSNSGGNNR

SEQ ID NO: 67555 - protein, 32 aa, Artificial Sequence
  Description of Artificial Sequence: Synthetic polypeptide
DEEEIATTNPVAYEQYGSVATNPDQGDGNSRM

SEQ ID NO: 67556 - protein, 28 aa, Artificial Sequence
  Description of Artificial Sequence: Synthetic peptide
AENEIACTNPVATEQYGEASENLQRFSR

SEQ ID NO: 67557 - protein, 29 aa, Artificial Sequence
  Description of Artificial Sequence: Synthetic peptide
AENEIACTNPVATEQYGEASENLQRGAGR

SEQ ID NO: 67558 - protein, 28 aa, Artificial Sequence
  Description of Artificial Sequence: Synthetic peptide
AENEIACTNPVATEQYGEATINLQRGGR

SEQ ID NO: 67559 - protein, 34 aa, Artificial Sequence
  Description of Artificial Sequence: Synthetic polypeptide
DEAEECIRTTNPVATEQYGSVCSVTGNDLFNGNP

SEQ ID NO: 67560 - protein, 32 aa, Artificial Sequence
  Description of Artificial Sequence: Synthetic polypeptide
DEAEIRTTNPVATEQYGCVSNTNHQSFGSNQS

SEQ ID NO: 67561 - protein, 29 aa, Artificial Sequence
  Description of Artificial Sequence: Synthetic peptide
AENEIACTNPVATEQYGEASENLQRGDGR

SEQ ID NO: 67562 - protein, 29 aa, Artificial Sequence
  Description of Artificial Sequence: Synthetic peptide
AENEIACTNPVATEQYGEASENLQRGEDR

SEQ ID NO: 67563 - protein, 29 aa, Artificial Sequence
  Description of Artificial Sequence: Synthetic peptide
AENEIACTNPVATEQYGEASENLQRGEGR

SEQ ID NO: 67564 - protein, 31 aa, Artificial Sequence
  Description of Artificial Sequence: Synthetic polypeptide
DEECIRTTNPVCYEQYGSVPSCTNLSQSVSR

SEQ ID NO: 67565 - protein, 30 aa, Artificial Sequence
  Description of Artificial Sequence: Synthetic polypeptide
DEEEIATTNPVSTEQYGSVSCALPNRGMTV

SEQ ID NO: 67566 - protein, 33 aa, Artificial Sequence
  Description of Artificial Sequence: Synthetic polypeptide
AEEEIRTTNPVATEQYGSVSTVNLNQNEDTNEG

SEQ ID NO: 67567 - protein, 29 aa, Artificial Sequence
  Description of Artificial Sequence: Synthetic peptide
DDENIRTTNPVATEAYGQVTTNLQGGSTD

SEQ ID NO: 67568 - protein, 30 aa, Artificial Sequence
  Description of Artificial Sequence: Synthetic polypeptide
DEAEIRTTNPVAYEQWGSISHNLDERPENR

SEQ ID NO: 67569 - protein, 28 aa, Artificial Sequence
  Description of Artificial Sequence: Synthetic peptide
AENEIASVNPVCTEQYGVVSENLQRGNQ

SEQ ID NO: 67570 - protein, 31 aa, Artificial Sequence
  Description of Artificial Sequence: Synthetic polypeptide
DEDEIRTTNPVAYEQYGTVATNLQGNGPNDT

SEQ ID NO: 67571 - protein, 29 aa, Artificial Sequence
  Description of Artificial Sequence: Synthetic peptide
AENEIACTNPVATEQYGEASENLQRCGVR

SEQ ID NO: 67572 - protein, 31 aa, Artificial Sequence
  Description of Artificial Sequence: Synthetic polypeptide
DEDEIRTTNPVAYEQYGTVATNLGMNDGDNR

SEQ ID NO: 67573 - protein, 29 aa, Artificial Sequence
  Description of Artificial Sequence: Synthetic peptide
AENEIACTNPVATEQYGEASENLQRDGGR

SEQ ID NO: 67574 - protein, 28 aa, Artificial Sequence
  Description of Artificial Sequence: Synthetic peptide
AENEIACTNPVATEQYGEASENLQRDGR

SEQ ID NO: 67575 - protein, 28 aa, Artificial Sequence
  Description of Artificial Sequence: Synthetic peptide
AENEIACTNPVATEQYGEASENLQRDYR

SEQ ID NO: 67576 - protein, 29 aa, Artificial Sequence
  Description of Artificial Sequence: Synthetic peptide
DEEEIRCTNPVATEQYGSVSEILMAAEDA

SEQ ID NO: 67577 - protein, 31 aa, Artificial Sequence
  Description of Artificial Sequence: Synthetic polypeptide
DEAEIRTTNPVAYEQWGSISRTNDERGPNSR

SEQ ID NO: 67578 - protein, 31 aa, Artificial Sequence
  Description of Artificial Sequence: Synthetic polypeptide
DEECIACTNPVATEPYDYSVSSNLQRGDNER

SEQ ID NO: 67579 - protein, 30 aa, Artificial Sequence
  Description of Artificial Sequence: Synthetic polypeptide
DEDEIRTTNPVAYEQYGTVATGLQEGNGMS

SEQ ID NO: 67580 - protein, 34 aa, Artificial Sequence
  Description of Artificial Sequence: Synthetic polypeptide
AEEEIRTTNPVATEQYGSVSTVNLNQNQQGTNIT

SEQ ID NO: 67581 - protein, 28 aa, Artificial Sequence
  Description of Artificial Sequence: Synthetic peptide
AENEIACTNPVATEQYGEASENLQREER

SEQ ID NO: 67582 - protein, 34 aa, Artificial Sequence
  Description of Artificial Sequence: Synthetic polypeptide
AEEEIRTTNPVATEQYGSVSTVNLNQQIGNNDTE

SEQ ID NO: 67583 - protein, 32 aa, Artificial Sequence
  Description of Artificial Sequence: Synthetic polypeptide
DEEEIRTTNPVATEGYGQSVCSTELQNFISNQ

SEQ ID NO: 67584 - protein, 33 aa, Artificial Sequence
  Description of Artificial Sequence: Synthetic polypeptide
AEEEIRTTNPVATEQYGSVSTVNLNQQEDTNGT

SEQ ID NO: 67585 - protein, 28 aa, Artificial Sequence
  Description of Artificial Sequence: Synthetic peptide
DEECIACTNPVATAQWGSVAMNDQRGNE

SEQ ID NO: 67586 - protein, 31 aa, Artificial Sequence
  Description of Artificial Sequence: Synthetic polypeptide
DEEEIHTTNPVATCQYGSVSDTQGHERGNQS

SEQ ID NO: 67587 - protein, 32 aa, Artificial Sequence
  Description of Artificial Sequence: Synthetic polypeptide
DEDEIRTTNPVAYEQWGSVSTTNLDGNAGNAR

SEQ ID NO: 67588 - protein, 31 aa, Artificial Sequence
  Description of Artificial Sequence: Synthetic polypeptide
DEECIRTTNPVAYEQYSEEVTTNLQDGGNGR

SEQ ID NO: 67589 - protein, 31 aa, Artificial Sequence
  Description of Artificial Sequence: Synthetic polypeptide
DEECIRTTNPVAYEQYSEEVTTNLQGDGNNR

SEQ ID NO: 67590 - protein, 30 aa, Artificial Sequence
  Description of Artificial Sequence: Synthetic polypeptide
DEECIRTTNPVAYEQYSEEVTTNLQGGGNS

SEQ ID NO: 67591 - protein, 31 aa, Artificial Sequence
  Description of Artificial Sequence: Synthetic polypeptide
DEECIRTTNPVAYEQYSEEVTTNLQGQGNDR

SEQ ID NO: 67592 - protein, 31 aa, Artificial Sequence
  Description of Artificial Sequence: Synthetic polypeptide
DEECIRTTNPVAYEQYSEEVTTNLQQHGDNR

SEQ ID NO: 67593 - protein, 30 aa, Artificial Sequence
  Description of Artificial Sequence: Synthetic polypeptide
DEEEIRATNPVTTEQYGSVATNNNQQGIQT

SEQ ID NO: 67594 - protein, 30 aa, Artificial Sequence
  Description of Artificial Sequence: Synthetic polypeptide
DEDEIRTTNPVAYEQYGTVATGLGMEGDNR

SEQ ID NO: 67595 - protein, 31 aa, Artificial Sequence
  Description of Artificial Sequence: Synthetic polypeptide
DEEEIRATNPVATEQYGSVSVVNQDTGSNNT

SEQ ID NO: 67596 - protein, 33 aa, Artificial Sequence
  Description of Artificial Sequence: Synthetic polypeptide
DEEEIRATNPVATEQYGSVSVVTNNQDQGSNLD

SEQ ID NO: 67597 - protein, 32 aa, Artificial Sequence
  Description of Artificial Sequence: Synthetic polypeptide
DEEEIRATNPVATEQYGSVSVVTNQDTGSNNL

SEQ ID NO: 67598 - protein, 28 aa, Artificial Sequence
  Description of Artificial Sequence: Synthetic peptide
AEEEIACTNPVATEQYGEASEVLQHGGR

SEQ ID NO: 67599 - protein, 31 aa, Artificial Sequence
  Description of Artificial Sequence: Synthetic polypeptide
DEAEIRTTNPCATEQWGEVSTNLQHNGDNGA

SEQ ID NO: 67600 - protein, 31 aa, Artificial Sequence
  Description of Artificial Sequence: Synthetic polypeptide
DEEEIRATNPVATEQYGYVVPTNHEARGSNF

SEQ ID NO: 67601 - protein, 31 aa, Artificial Sequence
  Description of Artificial Sequence: Synthetic polypeptide
DEAEIRTTNPCATENYGEVSTNLQHQGNNEE

SEQ ID NO: 67602 - protein, 31 aa, Artificial Sequence
  Description of Artificial Sequence: Synthetic polypeptide
DEAEIRTTNPCATENYGEVSTNLQHDQGNEA

SEQ ID NO: 67603 - protein, 31 aa, Artificial Sequence
  Description of Artificial Sequence: Synthetic polypeptide
DEEEIATTNPVAYEQYGSTVWTNLSQGTVNV

SEQ ID NO: 67604 - protein, 33 aa, Artificial Sequence
  Description of Artificial Sequence: Synthetic polypeptide
DEDEIRTTNPVATEQYGSVVTGNDNEQRDGDAR

SEQ ID NO: 67605 - protein, 31 aa, Artificial Sequence
  Description of Artificial Sequence: Synthetic polypeptide
CEEEIRTTNPVATEQYGSVSVDFNGGQEDNI

SEQ ID NO: 67606 - protein, 33 aa, Artificial Sequence
  Description of Artificial Sequence: Synthetic polypeptide
CEEEIRTTNPVATEQYGSVSWTDNQQDRNANDD

SEQ ID NO: 67607 - protein, 29 aa, Artificial Sequence
  Description of Artificial Sequence: Synthetic peptide
AENEIACTNPVATEQYGEASENLQRMGGR

SEQ ID NO: 67608 - protein, 32 aa, Artificial Sequence
  Description of Artificial Sequence: Synthetic polypeptide
DEAEIRTTNPVATEQYGCVCSWENLNRFGSNQ

SEQ ID NO: 67609 - protein, 33 aa, Artificial Sequence
  Description of Artificial Sequence: Synthetic polypeptide
DEDEIRTTNPVATEQYGSVVSTMNLGDEHGNEP

SEQ ID NO: 67610 - protein, 28 aa, Artificial Sequence
  Description of Artificial Sequence: Synthetic peptide
AENEIACTNPVATEQYGEASENLQRLGR

SEQ ID NO: 67611 - protein, 32 aa, Artificial Sequence
  Description of Artificial Sequence: Synthetic polypeptide
DEEEIATTNPVAYEQYGSTVSTNMLSQGVTNW

SEQ ID NO: 67612 - protein, 28 aa, Artificial Sequence
  Description of Artificial Sequence: Synthetic peptide
AENEIACTNPVATEQYGEASENLQRMGR

SEQ ID NO: 67613 - protein, 32 aa, Artificial Sequence
  Description of Artificial Sequence: Synthetic polypeptide
DEEEIATTNPVAYEQYGSTVSTNLSQATVNSE

SEQ ID NO: 67614 - protein, 29 aa, Artificial Sequence
  Description of Artificial Sequence: Synthetic peptide
AENEIACTNPVATEQYGCSCSSNLQRGGA

SEQ ID NO: 67615 - protein, 32 aa, Artificial Sequence
  Description of Artificial Sequence: Synthetic polypeptide
DEEEIATTNPVAYEQYGSTVSTNLGGTGGNNW

SEQ ID NO: 67616 - protein, 31 aa, Artificial Sequence
  Description of Artificial Sequence: Synthetic polypeptide
DEEEIATTNPVAYEQYGSTVSTNAHSQGGQP

SEQ ID NO: 67617 - protein, 29 aa, Artificial Sequence
  Description of Artificial Sequence: Synthetic peptide
AENEIACTNPVATEQYGEAYSENLQRGGR

SEQ ID NO: 67618 - protein, 33 aa, Artificial Sequence
  Description of Artificial Sequence: Synthetic polypeptide
DEEEIRTTNPVATEGYGSVSGQTNQQNNGGNGQ

SEQ ID NO: 67619 - protein, 32 aa, Artificial Sequence
  Description of Artificial Sequence: Synthetic polypeptide
DEEEIRTTNPVATEEYGCVCSSELQRFGSNQA

SEQ ID NO: 67620 - protein, 32 aa, Artificial Sequence
  Description of Artificial Sequence: Synthetic polypeptide
DEEEIATTNPVAYEQYGSTVSINLSQGTGNNW

SEQ ID NO: 67621 - protein, 31 aa, Artificial Sequence
  Description of Artificial Sequence: Synthetic polypeptide
DEAEIRTTNPVAYEQWGSVSTDNHGAQNGNS

SEQ ID NO: 67622 - protein, 33 aa, Artificial Sequence
  Description of Artificial Sequence: Synthetic polypeptide
DEEEIRTTNPVATEGYGSVSGTNLNSNIGGQNT

SEQ ID NO: 67623 - protein, 28 aa, Artificial Sequence
  Description of Artificial Sequence: Synthetic peptide
AENEIACTNPVATEQYGCISSNLQNGGR

SEQ ID NO: 67624 - protein, 33 aa, Artificial Sequence
  Description of Artificial Sequence: Synthetic polypeptide
AEEEIRTTNPVATEQYGSVSTVGNNGEQGGNTQ

SEQ ID NO: 67625 - protein, 28 aa, Artificial Sequence
  Description of Artificial Sequence: Synthetic peptide
ACNEIACTNPVATEQYGEASENLQRGGR

SEQ ID NO: 67626 - protein, 30 aa, Artificial Sequence
  Description of Artificial Sequence: Synthetic polypeptide
DEEEIATTNPVAYEQYGSVAAANDQIADNR

SEQ ID NO: 67627 - protein, 30 aa, Artificial Sequence
  Description of Artificial Sequence: Synthetic polypeptide
CEEEIRTTNPVATEQYGSVSVDFGGQEVNI

SEQ ID NO: 67628 - protein, 32 aa, Artificial Sequence
  Description of Artificial Sequence: Synthetic polypeptide
DEEEIATTNPVAYEQYGSVAATNLQRPGEPLH

SEQ ID NO: 67629 - protein, 28 aa, Artificial Sequence
  Description of Artificial Sequence: Synthetic peptide
AENEIACTNPVATEQYGEASENLQRPGR

SEQ ID NO: 67630 - protein, 33 aa, Artificial Sequence
  Description of Artificial Sequence: Synthetic polypeptide
AEEEIRTTNPVATEQYGSVSTVGNNQQGNPNVD

SEQ ID NO: 67631 - protein, 31 aa, Artificial Sequence
  Description of Artificial Sequence: Synthetic polypeptide
DEEEIRATNPVATESYGSVCTNAIGQAEGER

SEQ ID NO: 67632 - protein, 32 aa, Artificial Sequence
  Description of Artificial Sequence: Synthetic polypeptide
DEECISTTNPVATEGYGSVCNTNALQRSGSNQ

SEQ ID NO: 67633 - protein, 31 aa, Artificial Sequence
  Description of Artificial Sequence: Synthetic polypeptide
DEECISTTNPVATEGYGSVCNTNPLQRGSDQ

SEQ ID NO: 67634 - protein, 29 aa, Artificial Sequence
  Description of Artificial Sequence: Synthetic peptide
AENEIACTNPVATEQYGEASENLQRGVGR

SEQ ID NO: 67635 - protein, 29 aa, Artificial Sequence
  Description of Artificial Sequence: Synthetic peptide
AENEIACTNPVATEQYGEASENLQRHGGR

SEQ ID NO: 67636 - protein, 31 aa, Artificial Sequence
  Description of Artificial Sequence: Synthetic polypeptide
DEDEIRTTNPVATEQYGVVSTMLEQRPTQDM

SEQ ID NO: 67637 - protein, 28 aa, Artificial Sequence
  Description of Artificial Sequence: Synthetic peptide
AENEIACTNPVATEQYGEASENLQRHGR

SEQ ID NO: 67638 - protein, 31 aa, Artificial Sequence
  Description of Artificial Sequence: Synthetic polypeptide
DDEEISTTNPVATEQYGCVCSTNLQGIGSEQ

SEQ ID NO: 67639 - protein, 28 aa, Artificial Sequence
  Description of Artificial Sequence: Synthetic peptide
AENEIATTNPVATEPYGEASENLQRGGH

SEQ ID NO: 67640 - protein, 28 aa, Artificial Sequence
  Description of Artificial Sequence: Synthetic peptide
AENEIATTNPVATEQYGDVSECLQREEL

SEQ ID NO: 67641 - protein, 29 aa, Artificial Sequence
  Description of Artificial Sequence: Synthetic peptide
AENEIACTNPVATEQYGEASENLQRIGGR

SEQ ID NO: 67642 - protein, 28 aa, Artificial Sequence
  Description of Artificial Sequence: Synthetic peptide
AENEIACTNPVATEQYGEASENLQRIGR

SEQ ID NO: 67643 - protein, 33 aa, Artificial Sequence
  Description of Artificial Sequence: Synthetic polypeptide
CEEEIRTTNPVATEQYGSVSTSNEGQGGGNNGD

SEQ ID NO: 67644 - protein, 28 aa, Artificial Sequence
  Description of Artificial Sequence: Synthetic peptide
AENEIACTNPVATEQYGEAYENLQRGAR

SEQ ID NO: 67645 - protein, 32 aa, Artificial Sequence
  Description of Artificial Sequence: Synthetic polypeptide
CEEEIRTTNPVATEQYGSVSTVNTVQAATNET

SEQ ID NO: 67646 - protein, 28 aa, Artificial Sequence
  Description of Artificial Sequence: Synthetic peptide
AENEIACTNPVATEQYGEAYENLQRGGR

SEQ ID NO: 67647 - protein, 29 aa, Artificial Sequence
  Description of Artificial Sequence: Synthetic peptide
AENEIACTNPVATEQYGEASENLQRKGGR

SEQ ID NO: 67648 - protein, 31 aa, Artificial Sequence
  Description of Artificial Sequence: Synthetic polypeptide
DEEEIATTNPVAYEQYGSVAANLQVPDGSRN

SEQ ID NO: 67649 - protein, 33 aa, Artificial Sequence
  Description of Artificial Sequence: Synthetic polypeptide
DEEEIRATNPVATERYGCTVSCTNLSQGGGNRC

SEQ ID NO: 67650 - protein, 28 aa, Artificial Sequence
  Description of Artificial Sequence: Synthetic peptide
AENEIACTNPVATEQYGEASENLQRKGR

SEQ ID NO: 67651 - protein, 29 aa, Artificial Sequence
  Description of Artificial Sequence: Synthetic peptide
AENEIACTNPVATEQYGEASENLQRLGGR

SEQ ID NO: 67652 - protein, 29 aa, Artificial Sequence
  Description of Artificial Sequence: Synthetic peptide
AENEIACTNPVATEQYGCEASENLQRGGR

SEQ ID NO: 67653 - protein, 28 aa, Artificial Sequence
  Description of Artificial Sequence: Synthetic peptide
AENEIACTNPVATEQYGEAYENLQRGPR

SEQ ID NO: 67654 - protein, 33 aa, Artificial Sequence
  Description of Artificial Sequence: Synthetic polypeptide
CEEEIRTTNPVATEQYGSVSTQNGQERNANFDG

SEQ ID NO: 67655 - protein, 32 aa, Artificial Sequence
  Description of Artificial Sequence: Synthetic polypeptide
DEDEIRTTNPVAYEQWGTVSTNLNQGDGNMQR

SEQ ID NO: 67656 - protein, 32 aa, Artificial Sequence
  Description of Artificial Sequence: Synthetic polypeptide
DEDEIRTTNPVATEQYGSVSVTTNTQGQEGEQ

SEQ ID NO: 67657 - protein, 32 aa, Artificial Sequence
  Description of Artificial Sequence: Synthetic polypeptide
DEDEIRTTNPVATEQYGSVSVSTNTQQNEGLQ

SEQ ID NO: 67658 - protein, 33 aa, Artificial Sequence
  Description of Artificial Sequence: Synthetic polypeptide
DEAEIRTTNPCATECYGSVSTGNLQGDVGGNRD

SEQ ID NO: 67659 - protein, 32 aa, Artificial Sequence
  Description of Artificial Sequence: Synthetic polypeptide
DEAEIRTTNPVAYEQWGSVSTNLEQGNGDNNM

SEQ ID NO: 67660 - protein, 31 aa, Artificial Sequence
  Description of Artificial Sequence: Synthetic polypeptide
AEEEIRTTNPVATEQYGSVSTVEQQQTNNNQ

SEQ ID NO: 67661 - protein, 28 aa, Artificial Sequence
  Description of Artificial Sequence: Synthetic peptide
AENEIACTNPVATEQYGECSENLQQGGR

SEQ ID NO: 67662 - protein, 30 aa, Artificial Sequence
  Description of Artificial Sequence: Synthetic polypeptide
AENEIATTNPVATEQYGEASEDNLVQRGGR

SEQ ID NO: 67663 - protein, 31 aa, Artificial Sequence
  Description of Artificial Sequence: Synthetic polypeptide
DEAEIRTTNPVAYEQWGSVSTNLGDGTGNAN

SEQ ID NO: 67664 - protein, 28 aa, Artificial Sequence
  Description of Artificial Sequence: Synthetic peptide
AENEIATTNPVATEQYGEASENLNRGGV

SEQ ID NO: 67665 - protein, 34 aa, Artificial Sequence
  Description of Artificial Sequence: Synthetic polypeptide
AEEEIRTTNPVATEQYGSVSTVENLQQNNIGNNT

SEQ ID NO: 67666 - protein, 31 aa, Artificial Sequence
  Description of Artificial Sequence: Synthetic polypeptide
DEEEIKTTNPVATEQYGCVCSSELQNFGSNQ

SEQ ID NO: 67667 - protein, 28 aa, Artificial Sequence
  Description of Artificial Sequence: Synthetic peptide
AENEIACTNPVATEQYGEASENLQRNGR

SEQ ID NO: 67668 - protein, 29 aa, Artificial Sequence
  Description of Artificial Sequence: Synthetic peptide
AENEIATTNPVATEQYGEASENLQAAGDR

SEQ ID NO: 67669 - protein, 29 aa, Artificial Sequence
  Description of Artificial Sequence: Synthetic peptide
DEAEIACTNPVATEQYGCVATNLTRDGDL

SEQ ID NO: 67670 - protein, 33 aa, Artificial Sequence
  Description of Artificial Sequence: Synthetic polypeptide
DEAEIRTTNPCATECYGSVSTNPGLQDAGGNAR

SEQ ID NO: 67671 - protein, 31 aa, Artificial Sequence
  Description of Artificial Sequence: Synthetic polypeptide
DEAEIRTTNPVAYEQWGSVSTNLGQGEGMSG

SEQ ID NO: 67672 - protein, 32 aa, Artificial Sequence
  Description of Artificial Sequence: Synthetic polypeptide
DEAEIRTTNPVAYEQWGSVSTNLGQGSGGDMR

SEQ ID NO: 67673 - protein, 28 aa, Artificial Sequence
  Description of Artificial Sequence: Synthetic peptide
AANEIACTNPVATEQYGEASGNLQRGGR

SEQ ID NO: 67674 - protein, 33 aa, Artificial Sequence
  Description of Artificial Sequence: Synthetic polypeptide
CEEEIRTTNPVATEQYGSVVNTNGQERGNANFD

SEQ ID NO: 67675 - protein, 29 aa, Artificial Sequence
  Description of Artificial Sequence: Synthetic peptide
AENEIACTNPVATEQYGEASENLQRPGER

SEQ ID NO: 67676 - protein, 33 aa, Artificial Sequence
  Description of Artificial Sequence: Synthetic polypeptide
AEEEIRTTNPVATEQYGSVSTVENLNQGNINNG

SEQ ID NO: 67677 - protein, 28 aa, Artificial Sequence
  Description of Artificial Sequence: Synthetic peptide
AENEIACTNPVATEQYGEESENLQMGGR

SEQ ID NO: 67678 - protein, 31 aa, Artificial Sequence
  Description of Artificial Sequence: Synthetic polypeptide
DEAEIRTTNPVAYEQWGSVSTNLNENGDNNM

SEQ ID NO: 67679 - protein, 29 aa, Artificial Sequence
  Description of Artificial Sequence: Synthetic peptide
AENEIACTNPVATEQYGECSENLQRVGGR

SEQ ID NO: 67680 - protein, 31 aa, Artificial Sequence
  Description of Artificial Sequence: Synthetic polypeptide
DEDEIRTTNPVAYEQWGTVSTNLQGEDGNDT

SEQ ID NO: 67681 - protein, 28 aa, Artificial Sequence
  Description of Artificial Sequence: Synthetic peptide
AANEIACTNPVATEQYGEASENLQRGGR

SEQ ID NO: 67682 - protein, 33 aa, Artificial Sequence
  Description of Artificial Sequence: Synthetic polypeptide
DEEEIRATNPVATEQYGVVSTTVNQLQQGTGNG

SEQ ID NO: 67683 - protein, 32 aa, Artificial Sequence
  Description of Artificial Sequence: Synthetic polypeptide
DEEEIRTTNPVATEEYGCVCSTYLQGFGSNQT

SEQ ID NO: 67684 - protein, 32 aa, Artificial Sequence
  Description of Artificial Sequence: Synthetic polypeptide
DEAEIRTTNPVAYEQWGSVSTNLGQGNAGNAN

SEQ ID NO: 67685 - protein, 32 aa, Artificial Sequence
  Description of Artificial Sequence: Synthetic polypeptide
DEDEIRTTNPVATEQYGSVSVTTNTNQQEGTQ

SEQ ID NO: 67686 - protein, 28 aa, Artificial Sequence
  Description of Artificial Sequence: Synthetic peptide
AENEIATTNPVATEQYGEASECLQHGGR

SEQ ID NO: 67687 - protein, 32 aa, Artificial Sequence
  Description of Artificial Sequence: Synthetic polypeptide
DEAEIRTTNPVAYEQWGSVSTNLDQGQGDMGR

SEQ ID NO: 67688 - protein, 34 aa, Artificial Sequence
  Description of Artificial Sequence: Synthetic polypeptide
CEEEIRTTNPVATEQWGSANSTNLNQRPGSNTRE

SEQ ID NO: 67689 - protein, 34 aa, Artificial Sequence
  Description of Artificial Sequence: Synthetic polypeptide
DEEEIKTTNPVATEAYGSVSTGNALSQRGGEQRM

SEQ ID NO: 67690 - protein, 28 aa, Artificial Sequence
  Description of Artificial Sequence: Synthetic peptide
AENEIATTNPVATEQYGDVSENLQHEEL

SEQ ID NO: 67691 - protein, 31 aa, Artificial Sequence
  Description of Artificial Sequence: Synthetic polypeptide
DEDEIRTTNPVAYEQWGTVSTNLQGNAGNEG

SEQ ID NO: 67692 - protein, 32 aa, Artificial Sequence
  Description of Artificial Sequence: Synthetic polypeptide
DEAEIRTTNPVAYEQWGSVSTENLSQQGDMDR

SEQ ID NO: 67693 - protein, 31 aa, Artificial Sequence
  Description of Artificial Sequence: Synthetic polypeptide
CEEEIRTTNPVATEPYGSVSVNLVESTGHNQ

SEQ ID NO: 67694 - protein, 31 aa, Artificial Sequence
  Description of Artificial Sequence: Synthetic polypeptide
DEDEIRTTNPVAYEQWGTVSTNLQGGEHNDT

SEQ ID NO: 67695 - protein, 31 aa, Artificial Sequence
  Description of Artificial Sequence: Synthetic polypeptide
DEAEIRTTNPCATEEYGSVSTGNGQHGGDND

SEQ ID NO: 67696 - protein, 32 aa, Artificial Sequence
  Description of Artificial Sequence: Synthetic polypeptide
AEEEIRTTNPVATEQYGSVSTVVNVNQGNENQ

SEQ ID NO: 67697 - protein, 29 aa, Artificial Sequence
  Description of Artificial Sequence: Synthetic peptide
AENEIACTNPVATEQYGEASENLQRPGGR

SEQ ID NO: 67698 - protein, 30 aa, Artificial Sequence
  Description of Artificial Sequence: Synthetic polypeptide
DEAEIACTNPVATEQYGAVATNLQDGPTRE

SEQ ID NO: 67699 - protein, 31 aa, Artificial Sequence
  Description of Artificial Sequence: Synthetic polypeptide
DEEEIKTTNPVATEHYGSVGSTLNDQYNSND

SEQ ID NO: 67700 - protein, 33 aa, Artificial Sequence
  Description of Artificial Sequence: Synthetic polypeptide
DEEEIRATNPVATEQYGVVSTTTNLQQEGTGNF

SEQ ID NO: 67701 - protein, 32 aa, Artificial Sequence
  Description of Artificial Sequence: Synthetic polypeptide
DEAEIRTTNPVAYEQWGSVSTNAGQGEDTGNR

SEQ ID NO: 67702 - protein, 30 aa, Artificial Sequence
  Description of Artificial Sequence: Synthetic polypeptide
DEAEIRTTNPVAYEQWGSVSTNANGGNLGM

SEQ ID NO: 67703 - protein, 28 aa, Artificial Sequence
  Description of Artificial Sequence: Synthetic peptide
AENEIATTNPVATEQYGEAPENLQHGER

SEQ ID NO: 67704 - protein, 29 aa, Artificial Sequence
  Description of Artificial Sequence: Synthetic peptide
AENEIACTNPVATEQYGEASENLQRNGGR

SEQ ID NO: 67705 - protein, 32 aa, Artificial Sequence
  Description of Artificial Sequence: Synthetic polypeptide
DEEEIRTTNPVATEEYGCVCSTELQRFGSQQS

SEQ ID NO: 67706 - protein, 32 aa, Artificial Sequence
  Description of Artificial Sequence: Synthetic polypeptide
DEEEIKTTNPVATEIYGSVSNINLEQAGNQVS

SEQ ID NO: 67707 - protein, 28 aa, Artificial Sequence
  Description of Artificial Sequence: Synthetic peptide
AEDEICATNPVATEQYGVASENLQRGEG

SEQ ID NO: 67708 - protein, 31 aa, Artificial Sequence
  Description of Artificial Sequence: Synthetic polypeptide
DEEEIRTTNPVATEEYGCVCSTELQYGSEQT

SEQ ID NO: 67709 - protein, 28 aa, Artificial Sequence
  Description of Artificial Sequence: Synthetic peptide
AENEIACTNPVATEQYGECSENLQKGGR

SEQ ID NO: 67710 - protein, 28 aa, Artificial Sequence
  Description of Artificial Sequence: Synthetic peptide
AENEIATTNPVATEQYGEAPENLQHGGR

SEQ ID NO: 67711 - protein, 29 aa, Artificial Sequence
  Description of Artificial Sequence: Synthetic peptide
AENEIATTNPVATEQYGEASAENLQRGGL

SEQ ID NO: 67712 - protein, 32 aa, Artificial Sequence
  Description of Artificial Sequence: Synthetic polypeptide
DEAEIRTTNPVAYEQWGSVSTNGGGQERNGNM

SEQ ID NO: 67713 - protein, 33 aa, Artificial Sequence
  Description of Artificial Sequence: Synthetic polypeptide
DEAAIRTTNPVAYEPYGSVSTNELSQRAGGNRP

SEQ ID NO: 67714 - protein, 31 aa, Artificial Sequence
  Description of Artificial Sequence: Synthetic polypeptide
DEAEIRTTNPVAYEQWGSVSTNAGQGEGAGR

SEQ ID NO: 67715 - protein, 31 aa, Artificial Sequence
  Description of Artificial Sequence: Synthetic polypeptide
DEAEIRTTNPVATEQYGCVSTEHQNFGSNAA

SEQ ID NO: 67716 - protein, 32 aa, Artificial Sequence
  Description of Artificial Sequence: Synthetic polypeptide
DEEEIATTNPVAYEQYGSVAATPLQNRDGNQM

SEQ ID NO: 67717 - protein, 32 aa, Artificial Sequence
  Description of Artificial Sequence: Synthetic polypeptide
DEEEIRATNPVATETYGSVSTDNEQEGGNGNG

SEQ ID NO: 67718 - protein, 33 aa, Artificial Sequence
  Description of Artificial Sequence: Synthetic polypeptide
DEEEIRCTNPVATEQYGSVHSVEDQDQRGTNSR

SEQ ID NO: 67719 - protein, 33 aa, Artificial Sequence
  Description of Artificial Sequence: Synthetic polypeptide
CEEEIRTTNPCATEQYGTSVQSTNDLQQTENRT

SEQ ID NO: 67720 - protein, 29 aa, Artificial Sequence
  Description of Artificial Sequence: Synthetic peptide
AENEIACTNPVATEQYGEASENLQRGGRQ

SEQ ID NO: 67721 - protein, 33 aa, Artificial Sequence
  Description of Artificial Sequence: Synthetic polypeptide
DEEEIRCTNPVATEQYGSVHSVDVQDSRGSNSR

SEQ ID NO: 67722 - protein, 29 aa, Artificial Sequence
  Description of Artificial Sequence: Synthetic peptide
AENEIACTNPVATEQYGEASENLQRGGRT

SEQ ID NO: 67723 - protein, 33 aa, Artificial Sequence
  Description of Artificial Sequence: Synthetic polypeptide
DEEEIRCTNPVATEQYGSVHSVDQRDQRGSNSR

SEQ ID NO: 67724 - protein, 29 aa, Artificial Sequence
  Description of Artificial Sequence: Synthetic peptide
AENEIACTNPVATEQYGEASENLQRGGRV

SEQ ID NO: 67725 - protein, 29 aa, Artificial Sequence
  Description of Artificial Sequence: Synthetic peptide
AENEIACTNPVATEQYGEASENLQRGGRY

SEQ ID NO: 67726 - protein, 28 aa, Artificial Sequence
  Description of Artificial Sequence: Synthetic peptide
AENEIACTNPVATEQYGEASENLQRGGS

SEQ ID NO: 67727 - protein, 28 aa, Artificial Sequence
  Description of Artificial Sequence: Synthetic peptide
AENEIACTNPVATEQYGEKSENLQWGGR

SEQ ID NO: 67728 - protein, 28 aa, Artificial Sequence
  Description of Artificial Sequence: Synthetic peptide
AENEIACTNPVATEQYGEISENLQRNGR

SEQ ID NO: 67729 - protein, 29 aa, Artificial Sequence
  Description of Artificial Sequence: Synthetic peptide
AENEIACTNPVATEQYGCASENLQRGGGR

SEQ ID NO: 67730 - protein, 33 aa, Artificial Sequence
  Description of Artificial Sequence: Synthetic polypeptide
AEEEIRTTNPVATEQYGSVSTVNEQNEQGNQNN

SEQ ID NO: 67731 - protein, 29 aa, Artificial Sequence
  Description of Artificial Sequence: Synthetic peptide
AENEIACTNPVATEQYGEASENLQRGGSR

SEQ ID NO: 67732 - protein, 28 aa, Artificial Sequence
  Description of Artificial Sequence: Synthetic peptide
AENEIATTNPVATECYGEVSENLQHGEL

SEQ ID NO: 67733 - protein, 28 aa, Artificial Sequence
  Description of Artificial Sequence: Synthetic peptide
AENEIACTNPVATEQYGEASENLQRGGT

SEQ ID NO: 67734 - protein, 29 aa, Artificial Sequence
  Description of Artificial Sequence: Synthetic peptide
AENEIACTNPVATEQYGCASENLSQRGGR

SEQ ID NO: 67735 - protein, 32 aa, Artificial Sequence
  Description of Artificial Sequence: Synthetic polypeptide
AEEEIRTTNPVATEQYGSVSTVLQQQQTTNNE

SEQ ID NO: 67736 - protein, 28 aa, Artificial Sequence
  Description of Artificial Sequence: Synthetic peptide
AENEIACTNPVATEQYGEISEDLQRGGR

SEQ ID NO: 67737 - protein, 30 aa, Artificial Sequence
  Description of Artificial Sequence: Synthetic polypeptide
DEAEIRTTNPVATEQYGCVSEMLFRGIEDE

SEQ ID NO: 67738 - protein, 30 aa, Artificial Sequence
  Description of Artificial Sequence: Synthetic polypeptide
DEAAIRTTNPVATEQYGCFSTELIIGSNRL

SEQ ID NO: 67739 - protein, 29 aa, Artificial Sequence
  Description of Artificial Sequence: Synthetic peptide
AENEIACTNPVATEQYGEASENLQRGGTR

SEQ ID NO: 67740 - protein, 28 aa, Artificial Sequence
  Description of Artificial Sequence: Synthetic peptide
AENEIACTNPVATEQYGEASENLQRGGV

SEQ ID NO: 67741 - protein, 32 aa, Artificial Sequence
  Description of Artificial Sequence: Synthetic polypeptide
AEEEIRTTNPVATEQYGSVSTVLQQQQTNEND

SEQ ID NO: 67742 - protein, 31 aa, Artificial Sequence
  Description of Artificial Sequence: Synthetic polypeptide
DEAEIACTNPVATEPYGSVATNLQGAEMGNR

SEQ ID NO: 67743 - protein, 30 aa, Artificial Sequence
  Description of Artificial Sequence: Synthetic polypeptide
DEEEIATTNPVAYEQYGSVATADQREDNDS

SEQ ID NO: 67744 - protein, 29 aa, Artificial Sequence
  Description of Artificial Sequence: Synthetic peptide
AENEIACTNPVATEQYGCASENLQRGGRL

SEQ ID NO: 67745 - protein, 29 aa, Artificial Sequence
  Description of Artificial Sequence: Synthetic peptide
AENEIACTNPVATEQYGEASENLQRGGVR

SEQ ID NO: 67746 - protein, 28 aa, Artificial Sequence
  Description of Artificial Sequence: Synthetic peptide
AENEIACTNPVATEQYGEMSEDLQRGGR

SEQ ID NO: 67747 - protein, 31 aa, Artificial Sequence
  Description of Artificial Sequence: Synthetic polypeptide
DEAEIRTTNPVAYEQWGSVSENLQNQGDNNM

SEQ ID NO: 67748 - protein, 30 aa, Artificial Sequence
  Description of Artificial Sequence: Synthetic polypeptide
DEEEIATTNPVAYEQYGSVATNDTQNGPMD

SEQ ID NO: 67749 - protein, 29 aa, Artificial Sequence
  Description of Artificial Sequence: Synthetic peptide
AENEIACTNPVATEQYGEASENLQRGGRG

SEQ ID NO: 67750 - protein, 30 aa, Artificial Sequence
  Description of Artificial Sequence: Synthetic polypeptide
AEEEIACTNPVATEQYGCVATNLQQGNPEE

SEQ ID NO: 67751 - protein, 32 aa, Artificial Sequence
  Description of Artificial Sequence: Synthetic polypeptide
DEEEIRATNPVAYEQYGSVATNLQGAPDGSRN

SEQ ID NO: 67752 - protein, 28 aa, Artificial Sequence
  Description of Artificial Sequence: Synthetic peptide
AENEIACTNPVATEQYGEASENLQRTAR

SEQ ID NO: 67753 - protein, 28 aa, Artificial Sequence
  Description of Artificial Sequence: Synthetic peptide
AENEIATTNPVATECYGDVSENLQHGEL

SEQ ID NO: 67754 - protein, 28 aa, Artificial Sequence
  Description of Artificial Sequence: Synthetic peptide
AENEIACTNPVATEQYGEMSENLQHGGR

SEQ ID NO: 67755 - protein, 29 aa, Artificial Sequence
  Description of Artificial Sequence: Synthetic peptide
DEAEIRTTNPVAYEQWGSVQTALIREMNA

SEQ ID NO: 67756 - protein, 31 aa, Artificial Sequence
  Description of Artificial Sequence: Synthetic polypeptide
DEDEIRTTNPVAYEQWGVVSTNLQANGDNDL

SEQ ID NO: 67757 - protein, 28 aa, Artificial Sequence
  Description of Artificial Sequence: Synthetic peptide
AENEIACTNPVATEQYGEAWENLQRGGR

SEQ ID NO: 67758 - protein, 30 aa, Artificial Sequence
  Description of Artificial Sequence: Synthetic polypeptide
DEECISTTNPVATEGYGCVCNTNALQRGEQ

SEQ ID NO: 67759 - protein, 33 aa, Artificial Sequence
  Description of Artificial Sequence: Synthetic polypeptide
AEEEIRTTNPVATEQYGSVSTVNGEQQEGNGNN

SEQ ID NO: 67760 - protein, 33 aa, Artificial Sequence
  Description of Artificial Sequence: Synthetic polypeptide
AEEEIRTTNPVATEQYGSVSTVNEQQEEGGNNN

SEQ ID NO: 67761 - protein, 30 aa, Artificial Sequence
  Description of Artificial Sequence: Synthetic polypeptide
AENEIATTNPVATECYGEASEINLQREGNR

SEQ ID NO: 67762 - protein, 30 aa, Artificial Sequence
  Description of Artificial Sequence: Synthetic polypeptide
DEAEIRTTNPVAYEQWGSVQTGLIREMNDR

SEQ ID NO: 67763 - protein, 33 aa, Artificial Sequence
  Description of Artificial Sequence: Synthetic polypeptide
AEEEIRTTNPVATEQYGSVSTVNGEQGNEQGNT

SEQ ID NO: 67764 - protein, 31 aa, Artificial Sequence
  Description of Artificial Sequence: Synthetic polypeptide
DEAEIRTTNPVAYEQWGSVSENLQLNGDNGM

SEQ ID NO: 67765 - protein, 31 aa, Artificial Sequence
  Description of Artificial Sequence: Synthetic polypeptide
DEDEIRTTNPVAYEQWGVVSTNLQAGEGNNA

SEQ ID NO: 67766 - protein, 33 aa, Artificial Sequence
  Description of Artificial Sequence: Synthetic polypeptide
AEEEIRTTNPVATEQYGSVSTVNGENQETGNTD

SEQ ID NO: 67767 - protein, 28 aa, Artificial Sequence
  Description of Artificial Sequence: Synthetic peptide
AENEIATTNPVATECYGEASENLQRGEL

SEQ ID NO: 67768 - protein, 33 aa, Artificial Sequence
  Description of Artificial Sequence: Synthetic polypeptide
DEEEIRTTNPVATEGYGSVGSTMNLDQGEGGGN

SEQ ID NO: 67769 - protein, 29 aa, Artificial Sequence
  Description of Artificial Sequence: Synthetic peptide
AENEIACTNPVATEQYGEASENLQRGGRL

SEQ ID NO: 67770 - protein, 29 aa, Artificial Sequence
  Description of Artificial Sequence: Synthetic peptide
AENEIACTNPVATEQYGEAWENLQRGNGR

SEQ ID NO: 67771 - protein, 28 aa, Artificial Sequence
  Description of Artificial Sequence: Synthetic peptide
AENEIATTNPVATECYGEASENLQRGGL

SEQ ID NO: 67772 - protein, 29 aa, Artificial Sequence
  Description of Artificial Sequence: Synthetic peptide
AENEIACTNPVATEQYGEASENLQRGGRM

SEQ ID NO: 67773 - protein, 29 aa, Artificial Sequence
  Description of Artificial Sequence: Synthetic peptide
AENEIACTNPVATEQYGEASENLQRGGRP

SEQ ID NO: 67774 - protein, 30 aa, Artificial Sequence
  Description of Artificial Sequence: Synthetic polypeptide
AEEEIACTNPVATEQYGCVATNLQRQNDSL

SEQ ID NO: 67775 - protein, 32 aa, Artificial Sequence
  Description of Artificial Sequence: Synthetic polypeptide
DEEEIRATNPVATETYGSVSTDLQEGGNGNGQ

SEQ ID NO: 67776 - protein, 32 aa, Artificial Sequence
  Description of Artificial Sequence: Synthetic polypeptide
DEEEIRCTNPVATEQYGSVHSVDQDRQGDNSR

SEQ ID NO: 67777 - protein, 31 aa, Artificial Sequence
  Description of Artificial Sequence: Synthetic polypeptide
DEEEIATTNPVAYEQYGSVASNLQDADGNNE

SEQ ID NO: 67778 - protein, 29 aa, Artificial Sequence
  Description of Artificial Sequence: Synthetic peptide
AENEIACTNPVATEQYGEASENLQRGIGR

SEQ ID NO: 67779 - protein, 28 aa, Artificial Sequence
  Description of Artificial Sequence: Synthetic peptide
AENEIACTNPVATEQYGEASENLQRGIL

SEQ ID NO: 67780 - protein, 33 aa, Artificial Sequence
  Description of Artificial Sequence: Synthetic polypeptide
DEEEIRATNPVATEQYGVVSTTNNLQQQGGNTF

SEQ ID NO: 67781 - protein, 32 aa, Artificial Sequence
  Description of Artificial Sequence: Synthetic polypeptide
DEEEIRTTNPVATEEYGSVCFTNLTHGGSNQG

SEQ ID NO: 67782 - protein, 29 aa, Artificial Sequence
  Description of Artificial Sequence: Synthetic peptide
AENEIACTNPVATEQYGEASENLQRGKGR

SEQ ID NO: 67783 - protein, 29 aa, Artificial Sequence
  Description of Artificial Sequence: Synthetic peptide
AENEIACTNPVATEQYGEASENLQRQGGR

SEQ ID NO: 67784 - protein, 32 aa, Artificial Sequence
  Description of Artificial Sequence: Synthetic polypeptide
CEEEIRTTNPVATEQYGSVSTLINTQRFTTHN

SEQ ID NO: 67785 - protein, 32 aa, Artificial Sequence
  Description of Artificial Sequence: Synthetic polypeptide
DEAEIRTTNPCATEYYGSVSTNLQGNDGQNDD

SEQ ID NO: 67786 - protein, 31 aa, Artificial Sequence
  Description of Artificial Sequence: Synthetic polypeptide
DEAEIRTTNPCATEYWGSVSTNLQANGDNDD

SEQ ID NO: 67787 - protein, 30 aa, Artificial Sequence
  Description of Artificial Sequence: Synthetic polypeptide
DEAAIRTTNPVATEQYGSFSNTNHIIGSNQ

SEQ ID NO: 67788 - protein, 29 aa, Artificial Sequence
  Description of Artificial Sequence: Synthetic peptide
AENEIACTNPVATEQYGEASENLQRGLGR

SEQ ID NO: 67789 - protein, 30 aa, Artificial Sequence
  Description of Artificial Sequence: Synthetic polypeptide
DEAEIRTTNPVAYEQWGSVSNNGQNDGNPD

SEQ ID NO: 67790 - protein, 28 aa, Artificial Sequence
  Description of Artificial Sequence: Synthetic peptide
AENEIACTNPVATEQYGEASENLQRGGY

SEQ ID NO: 67791 - protein, 33 aa, Artificial Sequence
  Description of Artificial Sequence: Synthetic polypeptide
DEAEIRTTNPCATEQYGSVSTNLNQGDMGGNEK

SEQ ID NO: 67792 - protein, 29 aa, Artificial Sequence
  Description of Artificial Sequence: Synthetic peptide
AENEIACTNPVATEQYGEASENLQRGMGR

SEQ ID NO: 67793 - protein, 32 aa, Artificial Sequence
  Description of Artificial Sequence: Synthetic polypeptide
DEEEIRTTNPVATEAYGVVPACTNGSQNEGNR

SEQ ID NO: 67794 - protein, 29 aa, Artificial Sequence
  Description of Artificial Sequence: Synthetic peptide
AENEIACTNPVATEQYGEASENLQRGPGR

SEQ ID NO: 67795 - protein, 32 aa, Artificial Sequence
  Description of Artificial Sequence: Synthetic polypeptide
DEAEIRTTNPCATEQYGSVSTNLNGDAGGNND

SEQ ID NO: 67796 - protein, 29 aa, Artificial Sequence
  Description of Artificial Sequence: Synthetic peptide
AENEIACTNPVATEQYGEASENLQRGQDR

SEQ ID NO: 67797 - protein, 29 aa, Artificial Sequence
  Description of Artificial Sequence: Synthetic peptide
AENEIACTNPVATEQYGEASENLQRGQGR

SEQ ID NO: 67798 - protein, 29 aa, Artificial Sequence
  Description of Artificial Sequence: Synthetic peptide
AENEIACTNPVATEQYGEASENLQRGRER

SEQ ID NO: 67799 - protein, 33 aa, Artificial Sequence
  Description of Artificial Sequence: Synthetic polypeptide
DEAEIRTTNPCATEQYGSVSTGNGLNSGQGNER

SEQ ID NO: 67800 - protein, 32 aa, Artificial Sequence
  Description of Artificial Sequence: Synthetic polypeptide
DEAEIRTTNPCATEQYGSVSTGNDGQQGEERN

SEQ ID NO: 67801 - protein, 31 aa, Artificial Sequence
  Description of Artificial Sequence: Synthetic polypeptide
DEEEIATTNPVAYEQYGSVAGTNLQDDPDNH

SEQ ID NO: 67802 - protein, 29 aa, Artificial Sequence
  Description of Artificial Sequence: Synthetic peptide
AENEIACTNPVATEQYGEASENLQRGTGR

SEQ ID NO: 67803 - protein, 32 aa, Artificial Sequence
  Description of Artificial Sequence: Synthetic polypeptide
CEEEIRTTNPVATEQYGSVSTMVINDRGQSRA

SEQ ID NO: 67804 - protein, 33 aa, Artificial Sequence
  Description of Artificial Sequence: Synthetic polypeptide
DEAEIRTTNPCATEQYGSVSTNLNQGDHGGGRD

SEQ ID NO: 67805 - protein, 33 aa, Artificial Sequence
  Description of Artificial Sequence: Synthetic polypeptide
CEEEIRTTNPVATEQYGSVSSTDNGQERNDNFD

SEQ ID NO: 67806 - protein, 31 aa, Artificial Sequence
  Description of Artificial Sequence: Synthetic polypeptide
DEEEIRATNPVAYEQWGFVSITNDHQGGNQR

SEQ ID NO: 67807 - protein, 28 aa, Artificial Sequence
  Description of Artificial Sequence: Synthetic peptide
AENEIACTNPVATEQYGEASENLQRQGR

SEQ ID NO: 67808 - protein, 32 aa, Artificial Sequence
  Description of Artificial Sequence: Synthetic polypeptide
DEAEIRTTNPVATEQYGCVCSTNHQNFGSNQE

SEQ ID NO: 67809 - protein, 33 aa, Artificial Sequence
  Description of Artificial Sequence: Synthetic polypeptide
DEAEIRTTNPVATEQYGCVCSTNLQERFGSDQD

SEQ ID NO: 67810 - protein, 33 aa, Artificial Sequence
  Description of Artificial Sequence: Synthetic polypeptide
DEEEIHTTNPVAYEAYGSTVSCLGNNLSQRGNR

SEQ ID NO: 67811 - protein, 28 aa, Artificial Sequence
  Description of Artificial Sequence: Synthetic peptide
AENEIACTNPVATEQYGEASENLQRGGW

SEQ ID NO: 67812 - protein, 30 aa, Artificial Sequence
  Description of Artificial Sequence: Synthetic polypeptide
DEAAIRTTNPVATEQYGCFSTGNLINGSNQ

SEQ ID NO: 67813 - protein, 32 aa, Artificial Sequence
  Description of Artificial Sequence: Synthetic polypeptide
DEEEIRATNPVATEQYGVVNMTNLFQGGGNNV

SEQ ID NO: 67814 - protein, 31 aa, Artificial Sequence
  Description of Artificial Sequence: Synthetic polypeptide
DEEEIRATNPVATEQYGVVSMTNGFEGGGNS

SEQ ID NO: 67815 - protein, 31 aa, Artificial Sequence
  Description of Artificial Sequence: Synthetic polypeptide
DEEEIRATNPVATEQYGVVSMTNGFQGGGGQ

SEQ ID NO: 67816 - protein, 33 aa, Artificial Sequence
  Description of Artificial Sequence: Synthetic polypeptide
AEEEIRTTNPVATEQYGSVSTVLQQQIGNTNET

SEQ ID NO: 67817 - protein, 33 aa, Artificial Sequence
  Description of Artificial Sequence: Synthetic polypeptide
DEEEIRATNPVATEQYGVVSMTNLFQGGDGNDT

SEQ ID NO: 67818 - protein, 29 aa, Artificial Sequence
  Description of Artificial Sequence: Synthetic peptide
AENEIACTNPVATEQYGEAWSENLQRGGR

SEQ ID NO: 67819 - protein, 33 aa, Artificial Sequence
  Description of Artificial Sequence: Synthetic polypeptide
DEEEIRATNPVATEQYGVVSTTNLLQGNGNNNF

SEQ ID NO: 67820 - protein, 32 aa, Artificial Sequence
  Description of Artificial Sequence: Synthetic polypeptide
DEEEIRTTNPVATEEYGSVCFTNLTRGGSDQS

SEQ ID NO: 67821 - protein, 33 aa, Artificial Sequence
  Description of Artificial Sequence: Synthetic polypeptide
DEEEIRATNPVATEQYGVVSTTNLLQLGGNQGN

SEQ ID NO: 67822 - protein, 31 aa, Artificial Sequence
  Description of Artificial Sequence: Synthetic polypeptide
DEEEIRTTNPVATEEYGSVSYTQLQMTTFSF

SEQ ID NO: 67823 - protein, 28 aa, Artificial Sequence
  Description of Artificial Sequence: Synthetic peptide
AENEIACTNPVATEQYGEASENLQRSGR

SEQ ID NO: 67824 - protein, 28 aa, Artificial Sequence
  Description of Artificial Sequence: Synthetic peptide
AEEEIACTNPVATEQYGEASENCQREGR

SEQ ID NO: 67825 - protein, 33 aa, Artificial Sequence
  Description of Artificial Sequence: Synthetic polypeptide
AEEEIRTTNPVATEQYGSVSTVVNQQQTTGNIA

SEQ ID NO: 67826 - protein, 29 aa, Artificial Sequence
  Description of Artificial Sequence: Synthetic peptide
AENEIACTNPVATEQYGEASENLQRSGGR

SEQ ID NO: 67827 - protein, 29 aa, Artificial Sequence
  Description of Artificial Sequence: Synthetic peptide
AENEIACTNPVATEQYGEASENLQRRGGR

SEQ ID NO: 67828 - protein, 31 aa, Artificial Sequence
  Description of Artificial Sequence: Synthetic polypeptide
DEEEIRCTNPVATEQYGSVCSSEEDRGSNTQ

SEQ ID NO: 67829 - protein, 29 aa, Artificial Sequence
  Description of Artificial Sequence: Synthetic peptide
AENEIACTNPVATEQYGEASENLQRQGTR

SEQ ID NO: 67830 - protein, 32 aa, Artificial Sequence
  Description of Artificial Sequence: Synthetic polypeptide
DEEEIKTTNPAATEQYGSVPTDNLQMGGNGDD

SEQ ID NO: 67831 - protein, 32 aa, Artificial Sequence
  Description of Artificial Sequence: Synthetic polypeptide
DEEEIRCTNPVATEQYGSASTTNGNMRNGMGR

SEQ ID NO: 67832 - protein, 31 aa, Artificial Sequence
  Description of Artificial Sequence: Synthetic polypeptide
DEAEIRTTNPVATEQYGCVSANSENRGEDNQ

SEQ ID NO: 67833 - protein, 31 aa, Artificial Sequence
  Description of Artificial Sequence: Synthetic polypeptide
DEEEIKTTNPVATEQYGCVCSTNHQNSNSNQ

SEQ ID NO: 67834 - protein, 33 aa, Artificial Sequence
  Description of Artificial Sequence: Synthetic polypeptide
AEEEIRTTNPVATEQYGSVSTVLQQQGNNNGTD

SEQ ID NO: 67835 - protein, 31 aa, Artificial Sequence
  Description of Artificial Sequence: Synthetic polypeptide
DEAEIRTTNPVATEQYGCVSTELQYFPSNQS

SEQ ID NO: 67836 - protein, 31 aa, Artificial Sequence
  Description of Artificial Sequence: Synthetic polypeptide
DEDEIRTTNPVAYEQYGTVATNLQNGGGNNH

SEQ ID NO: 67837 - protein, 34 aa, Artificial Sequence
  Description of Artificial Sequence: Synthetic polypeptide
DEEEIGTTNPVATEQYGSVGFTPLQERMGQNNRV

SEQ ID NO: 67838 - protein, 28 aa, Artificial Sequence
  Description of Artificial Sequence: Synthetic peptide
AENEIACTNPVATEQYGEASENLQGGGR

SEQ ID NO: 67839 - protein, 28 aa, Artificial Sequence
  Description of Artificial Sequence: Synthetic peptide
AENEIACTNPVATEQYGEASTNLQHGGL

SEQ ID NO: 67840 - protein, 31 aa, Artificial Sequence
  Description of Artificial Sequence: Synthetic polypeptide
DEAEIRTTNPVAYEEYGEVVSTNLQHGGDND

SEQ ID NO: 67841 - protein, 28 aa, Artificial Sequence
  Description of Artificial Sequence: Synthetic peptide
AENEIACTNPVATEQYGEASWNKQRGGR

SEQ ID NO: 67842 - protein, 29 aa, Artificial Sequence
  Description of Artificial Sequence: Synthetic peptide
AENEIACTNPVATEQYGEASENLQGRGGR

SEQ ID NO: 67843 - protein, 30 aa, Artificial Sequence
  Description of Artificial Sequence: Synthetic polypeptide
CEEEIATTNPVAYEQYGSVATNLQQGDIDQ

SEQ ID NO: 67844 - protein, 32 aa, Artificial Sequence
  Description of Artificial Sequence: Synthetic polypeptide
DEEEIATTNPVAYEQYGSVSCTPNDSTPPGNR

SEQ ID NO: 67845 - protein, 33 aa, Artificial Sequence
  Description of Artificial Sequence: Synthetic polypeptide
DEEEIATTNPVAYEQYGSVSCTNLQGTPTNNRR

SEQ ID NO: 67846 - protein, 31 aa, Artificial Sequence
  Description of Artificial Sequence: Synthetic polypeptide
DEAEIRTTNPVATEQYGSVSTPDMQHSENNQ

SEQ ID NO: 67847 - protein, 32 aa, Artificial Sequence
  Description of Artificial Sequence: Synthetic polypeptide
DEAEIRTTNPVATEQYGSVSTPLQRSTIDEMQ

SEQ ID NO: 67848 - protein, 29 aa, Artificial Sequence
  Description of Artificial Sequence: Synthetic peptide
DEAEIRTTNPNATEEYGSVATNHGTGNDA

SEQ ID NO: 67849 - protein, 32 aa, Artificial Sequence
  Description of Artificial Sequence: Synthetic polypeptide
DEEEIRCTNPVATEQYGEASTTNLNMRNGMGR

SEQ ID NO: 67850 - protein, 34 aa, Artificial Sequence
  Description of Artificial Sequence: Synthetic polypeptide
AEEEIRTTNPVATEQYGSVSTVNLQQIGNTNQTT

SEQ ID NO: 67851 - protein, 30 aa, Artificial Sequence
  Description of Artificial Sequence: Synthetic polypeptide
DEEEIRCTNPVATEQYGEVSEPAGNRNGNV

SEQ ID NO: 67852 - protein, 29 aa, Artificial Sequence
  Description of Artificial Sequence: Synthetic peptide
AEECISTTNPVATEQYGCVSSNDQHGSNQ

SEQ ID NO: 67853 - protein, 34 aa, Artificial Sequence
  Description of Artificial Sequence: Synthetic polypeptide
DEEEIGTTNPVATEQYGSVCSTNSLNQVRFGSEF

SEQ ID NO: 67854 - protein, 33 aa, Artificial Sequence
  Description of Artificial Sequence: Synthetic polypeptide
DEEEIGTTNPVATEQYGSVCSTPDHQERMGSNL

SEQ ID NO: 67855 - protein, 29 aa, Artificial Sequence
  Description of Artificial Sequence: Synthetic peptide
AENEIACTNPVATEQYGESASENLQMGGR

SEQ ID NO: 67856 - protein, 31 aa, Artificial Sequence
  Description of Artificial Sequence: Synthetic polypeptide
DEAEIRTTNPVAYEEYGEVVSTNLQGNGNTE

SEQ ID NO: 67857 - protein, 34 aa, Artificial Sequence
  Description of Artificial Sequence: Synthetic polypeptide
AEEEIRTTNPVATEQYGSVSTVNLQQIGNNQNTE

SEQ ID NO: 67858 - protein, 34 aa, Artificial Sequence
  Description of Artificial Sequence: Synthetic polypeptide
AEEEIRTTNPVATEQYGSVSTVNLQQQENGNIQN

SEQ ID NO: 67859 - protein, 33 aa, Artificial Sequence
  Description of Artificial Sequence: Synthetic polypeptide
DEAEIRTTNPVAYEQDGSVSTNELSQQRPGGNA

SEQ ID NO: 67860 - protein, 30 aa, Artificial Sequence
  Description of Artificial Sequence: Synthetic polypeptide
DEDEIRTTNPVAYEWWGVVSTNLQGNGDNA

SEQ ID NO: 67861 - protein, 31 aa, Artificial Sequence
  Description of Artificial Sequence: Synthetic polypeptide
DEAEIRTTNPVAYEEYGTVSTNLQHGGGNDD

SEQ ID NO: 67862 - protein, 29 aa, Artificial Sequence
  Description of Artificial Sequence: Synthetic peptide
DEAEIRTTNPNATEEYGSVATNHGNNGNA

SEQ ID NO: 67863 - protein, 30 aa, Artificial Sequence
  Description of Artificial Sequence: Synthetic polypeptide
DEEEIRCTNPIATEQYGTISEENIQQQGNR

SEQ ID NO: 67864 - protein, 32 aa, Artificial Sequence
  Description of Artificial Sequence: Synthetic polypeptide
DEAEIRTTNPVATEQYGSVSTNLDSYMFENEQ

SEQ ID NO: 67865 - protein, 29 aa, Artificial Sequence
  Description of Artificial Sequence: Synthetic peptide
DEEEIRCTNPISTEPYGTVSMENLMRGNH

SEQ ID NO: 67866 - protein, 28 aa, Artificial Sequence
  Description of Artificial Sequence: Synthetic peptide
AENEIACTNPVATEKYGEASWNLQRGGR

SEQ ID NO: 67867 - protein, 31 aa, Artificial Sequence
  Description of Artificial Sequence: Synthetic polypeptide
DEECIATTNPVAYECYGSVVNCTNELQRGNM

SEQ ID NO: 67868 - protein, 32 aa, Artificial Sequence
  Description of Artificial Sequence: Synthetic polypeptide
DEAEIRTTNPVAYEQDGSVSTNLSQQRPGGSS

SEQ ID NO: 67869 - protein, 28 aa, Artificial Sequence
  Description of Artificial Sequence: Synthetic peptide
AENEIACTNPVATEQYGEASENLQFGGR

SEQ ID NO: 67870 - protein, 31 aa, Artificial Sequence
  Description of Artificial Sequence: Synthetic polypeptide
DEDEIRTTNPVAYESWGSVSTNLQLDGDMGR

SEQ ID NO: 67871 - protein, 31 aa, Artificial Sequence
  Description of Artificial Sequence: Synthetic polypeptide
DEEEIATTNPVAYEQYGSVSTGNGGQAGGAA

SEQ ID NO: 67872 - protein, 31 aa, Artificial Sequence
  Description of Artificial Sequence: Synthetic polypeptide
DEAEIRTTNPVAYEEYGEVVSTNLQHGGGND

SEQ ID NO: 67873 - protein, 32 aa, Artificial Sequence
  Description of Artificial Sequence: Synthetic polypeptide
DEEEIATTNPVAYEQYGSVSTGNDGQGGQPRG

SEQ ID NO: 67874 - protein, 31 aa, Artificial Sequence
  Description of Artificial Sequence: Synthetic polypeptide
DEDEIRTTNPVAYESWGSVSTNLQLGDDGRD

SEQ ID NO: 67875 - protein, 31 aa, Artificial Sequence
  Description of Artificial Sequence: Synthetic polypeptide
DEDEIRTTNPVAYEQWGSVSTNLNGGPNLDA

SEQ ID NO: 67876 - protein, 31 aa, Artificial Sequence
  Description of Artificial Sequence: Synthetic polypeptide
DEDEIRTTNPVCTEQYGAVSTEDLQCGGENA

SEQ ID NO: 67877 - protein, 33 aa, Artificial Sequence
  Description of Artificial Sequence: Synthetic polypeptide
DEEEIGTTNPVATEQYGSVCSTNDLQEHMGSEL

SEQ ID NO: 67878 - protein, 28 aa, Artificial Sequence
  Description of Artificial Sequence: Synthetic peptide
AENEIACTNPVATEQYGEASENLQFGMR

SEQ ID NO: 67879 - protein, 32 aa, Artificial Sequence
  Description of Artificial Sequence: Synthetic polypeptide
DEEEIATTNPVAYEQYGVSVSANGPLQREMGR

SEQ ID NO: 67880 - protein, 33 aa, Artificial Sequence
  Description of Artificial Sequence: Synthetic polypeptide
AEEEIRTTNPVATEQYGSVSTVTNNLNSNGNEG

SEQ ID NO: 67881 - protein, 31 aa, Artificial Sequence
  Description of Artificial Sequence: Synthetic polypeptide
AEEQIRTTNPVATEQYGSVSTQNLSNLLQNT

SEQ ID NO: 67882 - protein, 32 aa, Artificial Sequence
  Description of Artificial Sequence: Synthetic polypeptide
AEEEIRTTNPVATEQYGSVSTVNNINDEEGND

SEQ ID NO: 67883 - protein, 32 aa, Artificial Sequence
  Description of Artificial Sequence: Synthetic polypeptide
DEDEIRTTNPVAYEQWGSVSTNMQQPDNGNER

SEQ ID NO: 67884 - protein, 29 aa, Artificial Sequence
  Description of Artificial Sequence: Synthetic peptide
AENEIACTNPVATEQYGEQPSENLQRGGR

SEQ ID NO: 67885 - protein, 30 aa, Artificial Sequence
  Description of Artificial Sequence: Synthetic polypeptide
DEEEIRCTNPIATEQWGSVSENEPMRGENG

SEQ ID NO: 67886 - protein, 31 aa, Artificial Sequence
  Description of Artificial Sequence: Synthetic polypeptide
DEAEIRTTNPVAYEEWGSVSTNLQTGGDNDD

SEQ ID NO: 67887 - protein, 32 aa, Artificial Sequence
  Description of Artificial Sequence: Synthetic polypeptide
DEDEIRTTNPVAYEQWGSVSTNLQAGEDGNAI

SEQ ID NO: 67888 - protein, 32 aa, Artificial Sequence
  Description of Artificial Sequence: Synthetic polypeptide
AEEEIRTTNPVATEQYGSVSTVNLQNEDEDEG

SEQ ID NO: 67889 - protein, 30 aa, Artificial Sequence
  Description of Artificial Sequence: Synthetic polypeptide
DEAEIRTTNPVATEQYGSVSSTTMHIRSEH

SEQ ID NO: 67890 - protein, 31 aa, Artificial Sequence
  Description of Artificial Sequence: Synthetic polypeptide
DEDEIRTTNPVAYERYGTVSTNLQEGGDNGA

SEQ ID NO: 67891 - protein, 31 aa, Artificial Sequence
  Description of Artificial Sequence: Synthetic polypeptide
DEECIRTTNPVAYEQYGCVCSTENPQYGSNQ

SEQ ID NO: 67892 - protein, 28 aa, Artificial Sequence
  Description of Artificial Sequence: Synthetic peptide
AENEIACTNPVATEQYGDASENEQRGGR

SEQ ID NO: 67893 - protein, 28 aa, Artificial Sequence
  Description of Artificial Sequence: Synthetic peptide
AENEIACTNPVATEKYGEASENLQRGGR

SEQ ID NO: 67894 - protein, 30 aa, Artificial Sequence
  Description of Artificial Sequence: Synthetic polypeptide
DEAEIRTTNPVATEQYGCVSTNMQPTQESP

SEQ ID NO: 67895 - protein, 31 aa, Artificial Sequence
  Description of Artificial Sequence: Synthetic polypeptide
DEAEIRTTNPVAYEEWGSVSTNLQLGGDNGQ

SEQ ID NO: 67896 - protein, 33 aa, Artificial Sequence
  Description of Artificial Sequence: Synthetic polypeptide
DEAEIRTTNPTATEQYGSVSTGNDADQNRGGNT

SEQ ID NO: 67897 - protein, 29 aa, Artificial Sequence
  Description of Artificial Sequence: Synthetic peptide
AENEIACTNPVATEQYGESSSNLQRGSDR

SEQ ID NO: 67898 - protein, 35 aa, Artificial Sequence
  Description of Artificial Sequence: Synthetic polypeptide
DEEEIGTTNPVATEQYGSVSCTNELSQERHGGNNL

SEQ ID NO: 67899 - protein, 31 aa, Artificial Sequence
  Description of Artificial Sequence: Synthetic polypeptide
DEEEIATTNPVAYESYGSVSTNMHSQQGNNS

SEQ ID NO: 67900 - protein, 32 aa, Artificial Sequence
  Description of Artificial Sequence: Synthetic polypeptide
DEDEIRTTNPVAYEQWGSVSTNLNAGQEGNAQ

SEQ ID NO: 67901 - protein, 34 aa, Artificial Sequence
  Description of Artificial Sequence: Synthetic polypeptide
AEEEIRTTNPVATEQYGSVSTVNLQNNQNGNQID

SEQ ID NO: 67902 - protein, 28 aa, Artificial Sequence
  Description of Artificial Sequence: Synthetic peptide
AENEIACTNPVATEQYGEASENLQHGER

SEQ ID NO: 67903 - protein, 34 aa, Artificial Sequence
  Description of Artificial Sequence: Synthetic polypeptide
AEEEIRTTNPVATEQYGSVSTVNLQNQEGNTQGE

SEQ ID NO: 67904 - protein, 30 aa, Artificial Sequence
  Description of Artificial Sequence: Synthetic polypeptide
AEECISTTNPVATEQYGCVSWNTQRGSNQS

SEQ ID NO: 67905 - protein, 31 aa, Artificial Sequence
  Description of Artificial Sequence: Synthetic polypeptide
DEDEIRTTNPVAYESWGSVSTNLQLGDNGDP

SEQ ID NO: 67906 - protein, 31 aa, Artificial Sequence
  Description of Artificial Sequence: Synthetic polypeptide
DEDEIRTTNPVAYEQWGSVSTNLNGGDGNDA

SEQ ID NO: 67907 - protein, 32 aa, Artificial Sequence
  Description of Artificial Sequence: Synthetic polypeptide
DEEEIATTNPVAYEQYGSVSCQNMLQGTPTNR

SEQ ID NO: 67908 - protein, 31 aa, Artificial Sequence
  Description of Artificial Sequence: Synthetic polypeptide
DEDEIRTTNPVAYERYGTVSTNLQEGMGNAG

SEQ ID NO: 67909 - protein, 31 aa, Artificial Sequence
  Description of Artificial Sequence: Synthetic polypeptide
DEEEIATTNPVAYEWYGSVSTVAEGQRGENY

SEQ ID NO: 67910 - protein, 31 aa, Artificial Sequence
  Description of Artificial Sequence: Synthetic polypeptide
DEEEIRATNPVATEQYGSVCAANNLQEAGQE

SEQ ID NO: 67911 - protein, 32 aa, Artificial Sequence
  Description of Artificial Sequence: Synthetic polypeptide
DEDEIRTTNPVAYEQWGSVSTNLQRDGDMGQE

SEQ ID NO: 67912 - protein, 31 aa, Artificial Sequence
  Description of Artificial Sequence: Synthetic polypeptide
DEDEIRTTNPVAYEQWGSVSTNLNMGEGNAS

SEQ ID NO: 67913 - protein, 28 aa, Artificial Sequence
  Description of Artificial Sequence: Synthetic peptide
AENEIACTNPVATEQYGERSESLQRGGR

SEQ ID NO: 67914 - protein, 32 aa, Artificial Sequence
  Description of Artificial Sequence: Synthetic polypeptide
DEEAIRTTNPVAYEQYGCVSTINVQRIGDNQV

SEQ ID NO: 67915 - protein, 28 aa, Artificial Sequence
  Description of Artificial Sequence: Synthetic peptide
AENEIACTNPVATEQYGEASENLQDGGR

SEQ ID NO: 67916 - protein, 33 aa, Artificial Sequence
  Description of Artificial Sequence: Synthetic polypeptide
DEEEIKTTNPVATEQYGSVSTGMQLQEAMGNGM

SEQ ID NO: 67917 - protein, 31 aa, Artificial Sequence
  Description of Artificial Sequence: Synthetic polypeptide
DEAEIRTTNPVATEQYGSSSVYDLQRTNEQL

SEQ ID NO: 67918 - protein, 34 aa, Artificial Sequence
  Description of Artificial Sequence: Synthetic polypeptide
AEEEIRTTNPVATEQYGSVSTVNLQQGANENEDT

SEQ ID NO: 67919 - protein, 30 aa, Artificial Sequence
  Description of Artificial Sequence: Synthetic polypeptide
DEDEIRTTNPVAYESYGEVSTTLQDGGMNQ

SEQ ID NO: 67920 - protein, 33 aa, Artificial Sequence
  Description of Artificial Sequence: Synthetic polypeptide
DEEEIATTNPVAYEQYGSVPSCTGNLQFGENNQ

SEQ ID NO: 67921 - protein, 32 aa, Artificial Sequence
  Description of Artificial Sequence: Synthetic polypeptide
DEEEIRATNPVATEQYGSVCAANNLQEAEGNN

SEQ ID NO: 67922 - protein, 31 aa, Artificial Sequence
  Description of Artificial Sequence: Synthetic polypeptide
DEEEIRCTNPIATEQWGSVSENEPQDRGENG

SEQ ID NO: 67923 - protein, 33 aa, Artificial Sequence
  Description of Artificial Sequence: Synthetic polypeptide
DEEEIRCTNPVATEQYGCVSMTNDFQGFGSNNR

SEQ ID NO: 67924 - protein, 31 aa, Artificial Sequence
  Description of Artificial Sequence: Synthetic polypeptide
DEEEIRCTNPVATEQYGSVSSEPAGNRNGNV

SEQ ID NO: 67925 - protein, 32 aa, Artificial Sequence
  Description of Artificial Sequence: Synthetic polypeptide
DEEEIRCTNPVATEQYGSVSGNGQDEGGQNEL

SEQ ID NO: 67926 - protein, 33 aa, Artificial Sequence
  Description of Artificial Sequence: Synthetic polypeptide
DEEEIGTTNPVATEQYGSVCSTNDHQERFGSDL

SEQ ID NO: 67927 - protein, 31 aa, Artificial Sequence
  Description of Artificial Sequence: Synthetic polypeptide
DEAEIRTTNPVAYEHYGEVSTNLQIGGGNNE

SEQ ID NO: 67928 - protein, 31 aa, Artificial Sequence
  Description of Artificial Sequence: Synthetic polypeptide
DEAEIRTTNPVAYEHYGEVSTNLQIGGNGEV

SEQ ID NO: 67929 - protein, 32 aa, Artificial Sequence
  Description of Artificial Sequence: Synthetic polypeptide
DEEEIATTNPVAYEQYGVSHSQNDDLQRGDRR

SEQ ID NO: 67930 - protein, 28 aa, Artificial Sequence
  Description of Artificial Sequence: Synthetic peptide
AENEIACTNPVSTEQYGTASENLQRGGR

SEQ ID NO: 67931 - protein, 32 aa, Artificial Sequence
  Description of Artificial Sequence: Synthetic polypeptide
DEEEIATTNPVAYEQYGTVSWTELDNRGMNGR

SEQ ID NO: 67932 - protein, 33 aa, Artificial Sequence
  Description of Artificial Sequence: Synthetic polypeptide
DEEEIRCTNPIATEQYGSVSSTTPALNRGMNPR

SEQ ID NO: 67933 - protein, 28 aa, Artificial Sequence
  Description of Artificial Sequence: Synthetic peptide
AENEIACTNPVSTEQYGTASMNLQRGGR

SEQ ID NO: 67934 - protein, 31 aa, Artificial Sequence
  Description of Artificial Sequence: Synthetic polypeptide
DEEEIATTNPVAYEQYGTVSTTNGDNGQNER

SEQ ID NO: 67935 - protein, 34 aa, Artificial Sequence
  Description of Artificial Sequence: Synthetic polypeptide
AEEEIRTTNPVATEQYGSVSTVNLQSGNNNTEAG

SEQ ID NO: 67936 - protein, 31 aa, Artificial Sequence
  Description of Artificial Sequence: Synthetic polypeptide
DEEEIATTNPVAYEQYGTVSTQNGDNQGNER

SEQ ID NO: 67937 - protein, 31 aa, Artificial Sequence
  Description of Artificial Sequence: Synthetic polypeptide
DEEEIATTNPVAYEQYGTVSTNLQDQGGDSH

SEQ ID NO: 67938 - protein, 32 aa, Artificial Sequence
  Description of Artificial Sequence: Synthetic polypeptide
DEEEIATTNPVAYEQYGTVSTGNLQGNQGNNM

SEQ ID NO: 67939 - protein, 29 aa, Artificial Sequence
  Description of Artificial Sequence: Synthetic peptide
AENEIACTNPVATEQYGEASENLQDRGGR

SEQ ID NO: 67940 - protein, 31 aa, Artificial Sequence
  Description of Artificial Sequence: Synthetic polypeptide
DEEEIRATNPVATEQYGSVSANNDDAGSNSD

SEQ ID NO: 67941 - protein, 31 aa, Artificial Sequence
  Description of Artificial Sequence: Synthetic polypeptide
DEEEIATTNPVAYESYGKVSCTNDSQRGNQS

SEQ ID NO: 67942 - protein, 28 aa, Artificial Sequence
  Description of Artificial Sequence: Synthetic peptide
AENEIACTNPVATEQYGEASENLQEGGR

SEQ ID NO: 67943 - protein, 28 aa, Artificial Sequence
  Description of Artificial Sequence: Synthetic peptide
AENEIACTNPVATEMYGEASENLQRGGR

SEQ ID NO: 67944 - protein, 32 aa, Artificial Sequence
  Description of Artificial Sequence: Synthetic polypeptide
DEDEIRTTNPVAYESWGSVSTNLQGDPGDNQR

SEQ ID NO: 67945 - protein, 32 aa, Artificial Sequence
  Description of Artificial Sequence: Synthetic polypeptide
DEEEIATTNPVAYEQYGTVSTNLQVGGGNDGE

SEQ ID NO: 67946 - protein, 31 aa, Artificial Sequence
  Description of Artificial Sequence: Synthetic polypeptide
DEAEIRTTNPVATEQYGSVSQDNSTRNEDRQ

SEQ ID NO: 67947 - protein, 28 aa, Artificial Sequence
  Description of Artificial Sequence: Synthetic peptide
AENEIACTNPVATEQYGEASENLQAGGR

SEQ ID NO: 67948 - protein, 30 aa, Artificial Sequence
  Description of Artificial Sequence: Synthetic polypeptide
DDGEIRTTNPVATEQYGSVSTALLETGMQQ

SEQ ID NO: 67949 - protein, 31 aa, Artificial Sequence
  Description of Artificial Sequence: Synthetic polypeptide
DEAEIRTTNPVAYEHWGSVSTNLQGNDGNAG

SEQ ID NO: 67950 - protein, 31 aa, Artificial Sequence
  Description of Artificial Sequence: Synthetic polypeptide
DEEEIATTNPVAYESYGSVSTNSSQMGGNQS

SEQ ID NO: 67951 - protein, 28 aa, Artificial Sequence
  Description of Artificial Sequence: Synthetic peptide
AENEIACTNPVATEPYGEASENLQRGGR

SEQ ID NO: 67952 - protein, 28 aa, Artificial Sequence
  Description of Artificial Sequence: Synthetic peptide
AENEIACTNPVSTEQYGIVSCNLQSGTR

SEQ ID NO: 67953 - protein, 32 aa, Artificial Sequence
  Description of Artificial Sequence: Synthetic polypeptide
DEEEIATTNPVAYESYGSVSVTNHSQRGGNQM

SEQ ID NO: 67954 - protein, 34 aa, Artificial Sequence
  Description of Artificial Sequence: Synthetic polypeptide
AEEEIRTTNPVATEQYGSVSTVNLQTGNGEGGTE

SEQ ID NO: 67955 - protein, 30 aa, Artificial Sequence
  Description of Artificial Sequence: Synthetic polypeptide
DEECIRTTNPVAYEQWGQVSTINVQDGDNN

SEQ ID NO: 67956 - protein, 33 aa, Artificial Sequence
  Description of Artificial Sequence: Synthetic polypeptide
AEEEVRTTNPVATEQYGSVTSTENHDQRIGSNQ

SEQ ID NO: 67957 - protein, 33 aa, Artificial Sequence
  Description of Artificial Sequence: Synthetic polypeptide
DEEEIATTNPVAYESYGSVSYTNLSQRTGGNTS

SEQ ID NO: 67958 - protein, 28 aa, Artificial Sequence
  Description of Artificial Sequence: Synthetic peptide
DEAEIRTTNPNATEEYGSVATNHGAGTD

SEQ ID NO: 67959 - protein, 28 aa, Artificial Sequence
  Description of Artificial Sequence: Synthetic peptide
AENEIACTNPVSTEQYGEASENLQRGGR

SEQ ID NO: 67960 - protein, 32 aa, Artificial Sequence
  Description of Artificial Sequence: Synthetic polypeptide
DEEEIATTNPVAYESYGSVSTNISQNRGGNQS

SEQ ID NO: 67961 - protein, 30 aa, Artificial Sequence
  Description of Artificial Sequence: Synthetic polypeptide
DEECIRTTNPVAYEQWGSVSFIEILRGNTR

SEQ ID NO: 67962 - protein, 34 aa, Artificial Sequence
  Description of Artificial Sequence: Synthetic polypeptide
AEEEVRTTNPVATEQYGSVCSTGNALDQRIGSNQ

SEQ ID NO: 67963 - protein, 32 aa, Artificial Sequence
  Description of Artificial Sequence: Synthetic polypeptide
DEEEIATTNPVAYESYGSVPTNMLSQRGGNQS

SEQ ID NO: 67964 - protein, 30 aa, Artificial Sequence
  Description of Artificial Sequence: Synthetic polypeptide
DDGEIRTTNPVATEQYGSVSTNLLELTMQQ

SEQ ID NO: 67965 - protein, 32 aa, Artificial Sequence
  Description of Artificial Sequence: Synthetic polypeptide
AEEEVRTTNPVATEQYGSVCSTENHDQGIGNQ

SEQ ID NO: 67966 - protein, 32 aa, Artificial Sequence
  Description of Artificial Sequence: Synthetic polypeptide
DEEEIATTNPVAYESYGSTVSTNSSQRTGNQP

SEQ ID NO: 67967 - protein, 34 aa, Artificial Sequence
  Description of Artificial Sequence: Synthetic polypeptide
AEEEIRTTNPVATEQYGSVSTVNLQSGTVNTNEA

SEQ ID NO: 67968 - protein, 30 aa, Artificial Sequence
  Description of Artificial Sequence: Synthetic polypeptide
DEEEIATTNPVAYEQYGTVATNGDGNGNER

SEQ ID NO: 67969 - protein, 33 aa, Artificial Sequence
  Description of Artificial Sequence: Synthetic polypeptide
DEEEIATTNPVAYESYGSVVSYTNLSQRGGNQK

SEQ ID NO: 67970 - protein, 28 aa, Artificial Sequence
  Description of Artificial Sequence: Synthetic peptide
AENEIAGTNPVATEQYGEASANEQRGGR

SEQ ID NO: 67971 - protein, 28 aa, Artificial Sequence
  Description of Artificial Sequence: Synthetic peptide
AENEIACTNPVATELYGEASENLQRGGR

SEQ ID NO: 67972 - protein, 33 aa, Artificial Sequence
  Description of Artificial Sequence: Synthetic polypeptide
DEDEIRTTNPVAYEQWGSVSTNLQGNAGENNQR

SEQ ID NO: 67973 - protein, 31 aa, Artificial Sequence
  Description of Artificial Sequence: Synthetic polypeptide
DEDEIRTTNPVAYESWGSVATNLQGDGDNER

SEQ ID NO: 67974 - protein, 32 aa, Artificial Sequence
  Description of Artificial Sequence: Synthetic polypeptide
DEEEIRCTNPIATEQYGSVSATNLEDHEGEDR

SEQ ID NO: 67975 - protein, 32 aa, Artificial Sequence
  Description of Artificial Sequence: Synthetic polypeptide
DEDEIRTTNPVAYEQWGSVSTNLQGNAGGDAR

SEQ ID NO: 67976 - protein, 32 aa, Artificial Sequence
  Description of Artificial Sequence: Synthetic polypeptide
CEEEIRTTNPVATEQYGCVCSNTNHQHGSNQM

SEQ ID NO: 67977 - protein, 32 aa, Artificial Sequence
  Description of Artificial Sequence: Synthetic polypeptide
DEEEIKTTNPVATEQYGSVSTGNSGFQVTGEF

SEQ ID NO: 67978 - protein, 31 aa, Artificial Sequence
  Description of Artificial Sequence: Synthetic polypeptide
DEDEIRTTNPVAYESWGEVSTNLQGDGDNDR

SEQ ID NO: 67979 - protein, 30 aa, Artificial Sequence
  Description of Artificial Sequence: Synthetic polypeptide
AENEIACTNPVATEQYGESCSSNLQRGGRS

SEQ ID NO: 67980 - protein, 31 aa, Artificial Sequence
  Description of Artificial Sequence: Synthetic polypeptide
DEEEIRCTNPIATEQYGSVSAEDLMREGNDL

SEQ ID NO: 67981 - protein, 32 aa, Artificial Sequence
  Description of Artificial Sequence: Synthetic polypeptide
DEEEIATTNPVAYEQYGSVSTNPGNQQGGNHQ

SEQ ID NO: 67982 - protein, 30 aa, Artificial Sequence
  Description of Artificial Sequence: Synthetic polypeptide
DEAEIRTTNPVATCHYGCVSTNLQYTSNQG

SEQ ID NO: 67983 - protein, 33 aa, Artificial Sequence
  Description of Artificial Sequence: Synthetic polypeptide
DEEEIGTTNPVATEQYGSVCSTADLQENMGSNL

SEQ ID NO: 67984 - protein, 31 aa, Artificial Sequence
  Description of Artificial Sequence: Synthetic polypeptide
DEEEIATTNPVAYEQYGSVSTNNMQGEGDQG

SEQ ID NO: 67985 - protein, 34 aa, Artificial Sequence
  Description of Artificial Sequence: Synthetic polypeptide
AEEEIRTTNPVATEQYGSVSTVNLQQQIGNNDTN

SEQ ID NO: 67986 - protein, 31 aa, Artificial Sequence
  Description of Artificial Sequence: Synthetic polypeptide
DEEEIRCTNPIATEQYGSTVWAENLMPKGNR

SEQ ID NO: 67987 - protein, 31 aa, Artificial Sequence
  Description of Artificial Sequence: Synthetic polypeptide
DEEEIATTNPVAYEQYGSVSTNMQGEGGDQE

SEQ ID NO: 67988 - protein, 31 aa, Artificial Sequence
  Description of Artificial Sequence: Synthetic polypeptide
DEEEIRCTNPIATEQYGTVSMEDLQQRNGNH

SEQ ID NO: 67989 - protein, 30 aa, Artificial Sequence
  Description of Artificial Sequence: Synthetic polypeptide
DEAEIRTTNPVAYEEYGVVSTNMQGGGDND

SEQ ID NO: 67990 - protein, 32 aa, Artificial Sequence
  Description of Artificial Sequence: Synthetic polypeptide
DEEEIGTTNPVATEQYGCVSTNNLQNFGSEQP

SEQ ID NO: 67991 - protein, 32 aa, Artificial Sequence
  Description of Artificial Sequence: Synthetic polypeptide
DEEEIGTTNPVATEQYGCVSWEDLQERMGSNQ

SEQ ID NO: 67992 - protein, 31 aa, Artificial Sequence
  Description of Artificial Sequence: Synthetic polypeptide
DEAEIRTTNPVAYEKWGSVSNNLQHGGDNDR

SEQ ID NO: 67993 - protein, 33 aa, Artificial Sequence
  Description of Artificial Sequence: Synthetic polypeptide
DEEEIRCTNPIATEQYGSVSSTEPNLPNRNGNV

SEQ ID NO: 67994 - protein, 29 aa, Artificial Sequence
  Description of Artificial Sequence: Synthetic peptide
AENEIACTNPVATEQYGEASENLQERGGR

SEQ ID NO: 67995 - protein, 32 aa, Artificial Sequence
  Description of Artificial Sequence: Synthetic polypeptide
DEEEIRCTNPVATEQYGSVSGNIQDEGGQNDI

SEQ ID NO: 67996 - protein, 33 aa, Artificial Sequence
  Description of Artificial Sequence: Synthetic polypeptide
DEEEIKTTNPVATEQYGSVSTGGQLQEEMGNLL

SEQ ID NO: 67997 - protein, 28 aa, Artificial Sequence
  Description of Artificial Sequence: Synthetic peptide
AENEIAGTNPVATEQYGEASEILQRGGR

SEQ ID NO: 67998 - protein, 31 aa, Artificial Sequence
  Description of Artificial Sequence: Synthetic polypeptide
DEEEIRCTNPVATEQYGCVSMTNDNQGFGDQ

SEQ ID NO: 67999 - protein, 29 aa, Artificial Sequence
  Description of Artificial Sequence: Synthetic peptide
AENEIACTNPVATEQYGEASENLQARGGR

SEQ ID NO: 68000 - protein, 34 aa, Artificial Sequence
  Description of Artificial Sequence: Synthetic polypeptide
AEEEIRTTNPVATEQYGSVSTVNLVQTGNNNNNE

SEQ ID NO: 68001 - protein, 28 aa, Artificial Sequence
  Description of Artificial Sequence: Synthetic peptide
DDNEIACTNPVATEGYGEASENLQRGGR

SEQ ID NO: 68002 - protein, 32 aa, Artificial Sequence
  Description of Artificial Sequence: Synthetic polypeptide
DEEEIATTNPVAYEQYGVSVSANDLGQDGMGR

SEQ ID NO: 68003 - protein, 28 aa, Artificial Sequence
  Description of Artificial Sequence: Synthetic peptide
AENEIACTNPVATEQFGEASENLQRGGR

SEQ ID NO: 68004 - protein, 28 aa, Artificial Sequence
  Description of Artificial Sequence: Synthetic peptide
AENEIACTNPVATEQYGESSEVLQRGTR

SEQ ID NO: 68005 - protein, 29 aa, Artificial Sequence
  Description of Artificial Sequence: Synthetic peptide
DEDEIRTTNPVAYEWWGVVSTNLQGGEDS

SEQ ID NO: 68006 - protein, 28 aa, Artificial Sequence
  Description of Artificial Sequence: Synthetic peptide
AENEIAGTNPVATEQYGEASENLQNGGR

SEQ ID NO: 68007 - protein, 28 aa, Artificial Sequence
  Description of Artificial Sequence: Synthetic peptide
AENEIAGTNPVATEQYGEASENLQWGGR

SEQ ID NO: 68008 - protein, 29 aa, Artificial Sequence
  Description of Artificial Sequence: Synthetic peptide
DEEEIRCTNPIATEQYGSVSEILMNAENA

SEQ ID NO: 68009 - protein, 32 aa, Artificial Sequence
  Description of Artificial Sequence: Synthetic polypeptide
DEEEIATTNPVAYEQYGSVVSTNLQNGGGDLH

SEQ ID NO: 68010 - protein, 32 aa, Artificial Sequence
  Description of Artificial Sequence: Synthetic polypeptide
DEEEIATTNPVAYEQYGSVVACTNLQGTPTNR

SEQ ID NO: 68011 - protein, 32 aa, Artificial Sequence
  Description of Artificial Sequence: Synthetic polypeptide
DEEEIRCTNPIATEQYGSVSATNLMDHEGEDR

SEQ ID NO: 68012 - protein, 31 aa, Artificial Sequence
  Description of Artificial Sequence: Synthetic polypeptide
AEEQIRTTNPVATEQYGSVSTTNQLSNELNL

SEQ ID NO: 68013 - protein, 32 aa, Artificial Sequence
  Description of Artificial Sequence: Synthetic polypeptide
DEDEIRTTNPVAYEQWGSVSTNPNQGNAGNAR

SEQ ID NO: 68014 - protein, 33 aa, Artificial Sequence
  Description of Artificial Sequence: Synthetic polypeptide
DEEEIRCTNPIATEQYGSVSSTTPNLPNRNGNV

SEQ ID NO: 68015 - protein, 31 aa, Artificial Sequence
  Description of Artificial Sequence: Synthetic polypeptide
DEDEIRTTNPVAYEQWGSVSTNLNAGGGDNA

SEQ ID NO: 68016 - protein, 31 aa, Artificial Sequence
  Description of Artificial Sequence: Synthetic polypeptide
DEECIRTTNPVAYEQWGSVATNNLQDGGVNS

SEQ ID NO: 68017 - protein, 29 aa, Artificial Sequence
  Description of Artificial Sequence: Synthetic peptide
AENEIACTNPVATEQYGDASENLQNRGGR

SEQ ID NO: 68018 - protein, 31 aa, Artificial Sequence
  Description of Artificial Sequence: Synthetic polypeptide
DEDEIRTTNPVAYEQWGSVSTNLNPGSNGNA

SEQ ID NO: 68019 - protein, 31 aa, Artificial Sequence
  Description of Artificial Sequence: Synthetic polypeptide
DEECIRTTNPVAYEQYGCVSTIDVQRIGDNQ

SEQ ID NO: 68020 - protein, 33 aa, Artificial Sequence
  Description of Artificial Sequence: Synthetic polypeptide
DEEEIRTTNPVATEGYGMSGSTNLQTVGEGENE

SEQ ID NO: 68021 - protein, 31 aa, Artificial Sequence
  Description of Artificial Sequence: Synthetic polypeptide
DEDEIRTTNPVAYEQWGSVSTTNDGGTGNNR

SEQ ID NO: 68022 - protein, 32 aa, Artificial Sequence
  Description of Artificial Sequence: Synthetic polypeptide
DEECIRTTNPVAYEQYGCVSTINLVQRFDNQQ

SEQ ID NO: 68023 - protein, 29 aa, Artificial Sequence
  Description of Artificial Sequence: Synthetic peptide
DEAEIRTTNPVACEQYGSCMTNNLETENQ

SEQ ID NO: 68024 - protein, 32 aa, Artificial Sequence
  Description of Artificial Sequence: Synthetic polypeptide
DEDEIRTTNPVAYEQYGTVSTTNTQGDNGNVR

SEQ ID NO: 68025 - protein, 31 aa, Artificial Sequence
  Description of Artificial Sequence: Synthetic polypeptide
DEAEIRTTNPVAYEQWGEVSTNLQLGEDNED

SEQ ID NO: 68026 - protein, 33 aa, Artificial Sequence
  Description of Artificial Sequence: Synthetic polypeptide
DEEEIRTTNPVATEGYGIVVSTVNLQARNINIG

SEQ ID NO: 68027 - protein, 28 aa, Artificial Sequence
  Description of Artificial Sequence: Synthetic peptide
AENEIASTNPVATEQYGEASETLQRGDR

SEQ ID NO: 68028 - protein, 33 aa, Artificial Sequence
  Description of Artificial Sequence: Synthetic polypeptide
DEEAIRTTNPVAYEQYGSVPSCTNEVSQTTGNR

SEQ ID NO: 68029 - protein, 31 aa, Artificial Sequence
  Description of Artificial Sequence: Synthetic polypeptide
AEEQIRTTNPVATEQYGSVSTTNLSDELQNL

SEQ ID NO: 68030 - protein, 31 aa, Artificial Sequence
  Description of Artificial Sequence: Synthetic polypeptide
DEECIRTTNPVAYEQWGSVATNNEQLGVNDR

SEQ ID NO: 68031 - protein, 34 aa, Artificial Sequence
  Description of Artificial Sequence: Synthetic polypeptide
DEEEIGTTNPVATEQYGSVSWTDNSLYERGDERD

SEQ ID NO: 68032 - protein, 32 aa, Artificial Sequence
  Description of Artificial Sequence: Synthetic polypeptide
DEDEIRTTNPVAYEQYGTVSTTNLGMEGGDNR

SEQ ID NO: 68033 - protein, 34 aa, Artificial Sequence
  Description of Artificial Sequence: Synthetic polypeptide
DEEEIRTTNPVATECYGSVSTEPCLPQRNGMNPV

SEQ ID NO: 68034 - protein, 31 aa, Artificial Sequence
  Description of Artificial Sequence: Synthetic polypeptide
CEEEIRTTNPVATEQYGSVETNNDMRDGEGV

SEQ ID NO: 68035 - protein, 31 aa, Artificial Sequence
  Description of Artificial Sequence: Synthetic polypeptide
DEEEIKTTNPVATEQYGYVSTNLIPNQNNQP

SEQ ID NO: 68036 - protein, 32 aa, Artificial Sequence
  Description of Artificial Sequence: Synthetic polypeptide
DEECIRTTNPVAYEQWGSVATNNLQNDGVNER

SEQ ID NO: 68037 - protein, 28 aa, Artificial Sequence
  Description of Artificial Sequence: Synthetic peptide
AENEIASTNPVATEQYGEASENLQSGNQ

SEQ ID NO: 68038 - protein, 31 aa, Artificial Sequence
  Description of Artificial Sequence: Synthetic polypeptide
DEECIRTTNPVAYEQYGCVCSTGNDQGFGNQ

SEQ ID NO: 68039 - protein, 31 aa, Artificial Sequence
  Description of Artificial Sequence: Synthetic polypeptide
DEAEIRTTNPVAYEQWGEVSTNLQDGQGNAE

SEQ ID NO: 68040 - protein, 30 aa, Artificial Sequence
  Description of Artificial Sequence: Synthetic polypeptide
DEEEIATTNPVGTEQYGSVSWNEGGNRGDP

SEQ ID NO: 68041 - protein, 33 aa, Artificial Sequence
  Description of Artificial Sequence: Synthetic polypeptide
DEEEIRATNPVATEQYGSVCSTNPLQEAENADP

SEQ ID NO: 68042 - protein, 31 aa, Artificial Sequence
  Description of Artificial Sequence: Synthetic polypeptide
DEAEIRTTNPVAYEQWGEVSTNLQGDLGNED

SEQ ID NO: 68043 - protein, 32 aa, Artificial Sequence
  Description of Artificial Sequence: Synthetic polypeptide
AEEQIRTTNPVATEQYGSVSTNLSLQLNNATD

SEQ ID NO: 68044 - protein, 33 aa, Artificial Sequence
  Description of Artificial Sequence: Synthetic polypeptide
CEEEIRTTNPVATEQYGSVCSTNLNQNFGSDDE

SEQ ID NO: 68045 - protein, 30 aa, Artificial Sequence
  Description of Artificial Sequence: Synthetic polypeptide
DEEEIRCTNPVATEQYGCVSWNHDRISNNA

SEQ ID NO: 68046 - protein, 31 aa, Artificial Sequence
  Description of Artificial Sequence: Synthetic polypeptide
DEEEIRATNPVATEQYGSVCVNQDDEGSNSR

SEQ ID NO: 68047 - protein, 28 aa, Artificial Sequence
  Description of Artificial Sequence: Synthetic peptide
AENEIACTNPVATEPYGEASEDLQRGNR

SEQ ID NO: 68048 - protein, 31 aa, Artificial Sequence
  Description of Artificial Sequence: Synthetic polypeptide
DEECIRTTNPVAYEQYGCVSTGEDQRFGNQS

SEQ ID NO: 68049 - protein, 33 aa, Artificial Sequence
  Description of Artificial Sequence: Synthetic polypeptide
DEEEIRCTNPVATEQYGSVSSTPNGMMRNGNPV

SEQ ID NO: 68050 - protein, 28 aa, Artificial Sequence
  Description of Artificial Sequence: Synthetic peptide
AENEIACTNPVATEGYGNASENLQRGGR

SEQ ID NO: 68051 - protein, 31 aa, Artificial Sequence
  Description of Artificial Sequence: Synthetic polypeptide
DEAEIRTTNPVAYEQWGEVSTNLQGGGGNED

SEQ ID NO: 68052 - protein, 32 aa, Artificial Sequence
  Description of Artificial Sequence: Synthetic polypeptide
CEEEIRTTNPVATEQYGSVCSWGNLQNFGSEQ

SEQ ID NO: 68053 - protein, 32 aa, Artificial Sequence
  Description of Artificial Sequence: Synthetic polypeptide
DEEAIRTTNPVAYEQYGSVQACTNEQSQTGNR

SEQ ID NO: 68054 - protein, 30 aa, Artificial Sequence
  Description of Artificial Sequence: Synthetic polypeptide
DEECIRTTNPVAYEQYGCVSTGNDQHGSDQ

SEQ ID NO: 68055 - protein, 28 aa, Artificial Sequence
  Description of Artificial Sequence: Synthetic peptide
AENEIACTNPVATEQYGEASENLQNGRR

SEQ ID NO: 68056 - protein, 28 aa, Artificial Sequence
  Description of Artificial Sequence: Synthetic peptide
AENEIACTNPVATEQYGEMSSNLQRGGI

SEQ ID NO: 68057 - protein, 32 aa, Artificial Sequence
  Description of Artificial Sequence: Synthetic polypeptide
CEEEIRTTNPVATEQYGSVFYNLQNAGAEENV

SEQ ID NO: 68058 - protein, 29 aa, Artificial Sequence
  Description of Artificial Sequence: Synthetic peptide
AENEIACTNPVATEQYGEASENLQNRGGR

SEQ ID NO: 68059 - protein, 32 aa, Artificial Sequence
  Description of Artificial Sequence: Synthetic polypeptide
DEEEIRCTNPVATEQYGSVSGNGQDEGGQENT

SEQ ID NO: 68060 - protein, 32 aa, Artificial Sequence
  Description of Artificial Sequence: Synthetic polypeptide
AEEQIRTTNPVATEQYGSVSTTNLGSELGNQL

SEQ ID NO: 68061 - protein, 30 aa, Artificial Sequence
  Description of Artificial Sequence: Synthetic polypeptide
DDETIRTTNPVATEQYGAVSTNHQQRVQAT

SEQ ID NO: 68062 - protein, 31 aa, Artificial Sequence
  Description of Artificial Sequence: Synthetic polypeptide
DDETIRTTNPVATEQYGAVSTNHQQRVNILL

SEQ ID NO: 68063 - protein, 33 aa, Artificial Sequence
  Description of Artificial Sequence: Synthetic polypeptide
DEEEIRATNPVATEQYGSVSAANNQDEAGSNVR

SEQ ID NO: 68064 - protein, 31 aa, Artificial Sequence
  Description of Artificial Sequence: Synthetic polypeptide
DEEEIRCTNPVATEQYGCVSWNHDRFGSDNA

SEQ ID NO: 68065 - protein, 32 aa, Artificial Sequence
  Description of Artificial Sequence: Synthetic polypeptide
DEECIRTTNPVAYEQWGSVACTNNLHQDGDNR

SEQ ID NO: 68066 - protein, 31 aa, Artificial Sequence
  Description of Artificial Sequence: Synthetic polypeptide
DEDEIRTTNPVAYEQYGTVSTNNQGEHGDAR

SEQ ID NO: 68067 - protein, 28 aa, Artificial Sequence
  Description of Artificial Sequence: Synthetic peptide
AENEIACTNPVGTEQYGEMSSNLQRGGR

SEQ ID NO: 68068 - protein, 28 aa, Artificial Sequence
  Description of Artificial Sequence: Synthetic peptide
AENEIACTNPVGTEQYGEASSNLQRGGR

SEQ ID NO: 68069 - protein, 30 aa, Artificial Sequence
  Description of Artificial Sequence: Synthetic polypeptide
DEEEIRCTNPIATEQYGSVWSADWAEPGNR

SEQ ID NO: 68070 - protein, 33 aa, Artificial Sequence
  Description of Artificial Sequence: Synthetic polypeptide
DEEEIRCTNPIATEQYGSVSTEPALPNMRGNPR

SEQ ID NO: 68071 - protein, 30 aa, Artificial Sequence
  Description of Artificial Sequence: Synthetic polypeptide
DEAEIRTTNPVAFEEYGSISTNLDERPNFL

SEQ ID NO: 68072 - protein, 33 aa, Artificial Sequence
  Description of Artificial Sequence: Synthetic polypeptide
AEEEIRTTNPVATEQYGSVSTVVGNGEQGGNTD

SEQ ID NO: 68073 - protein, 32 aa, Artificial Sequence
  Description of Artificial Sequence: Synthetic polypeptide
DEEEIRATNPVATEQYGSVSANGDEAGSNSRN

SEQ ID NO: 68074 - protein, 34 aa, Artificial Sequence
  Description of Artificial Sequence: Synthetic polypeptide
AEEEIRTTNPVATEQYGSVSTVNNLQSGNVNTAG

SEQ ID NO: 68075 - protein, 31 aa, Artificial Sequence
  Description of Artificial Sequence: Synthetic polypeptide
DEECIRTTNPVAYEQYGCVVSCTNGQFGGNQ

SEQ ID NO: 68076 - protein, 28 aa, Artificial Sequence
  Description of Artificial Sequence: Synthetic peptide
AENEIACTNPVATEQYGESSENLQRSGR

SEQ ID NO: 68077 - protein, 32 aa, Artificial Sequence
  Description of Artificial Sequence: Synthetic polypeptide
DEEEIRTTNPVATEEWGSTVACWNLSQQGGNR

SEQ ID NO: 68078 - protein, 28 aa, Artificial Sequence
  Description of Artificial Sequence: Synthetic peptide
AENEIACTNPVATEQYGENSENDQRGGR

SEQ ID NO: 68079 - protein, 32 aa, Artificial Sequence
  Description of Artificial Sequence: Synthetic polypeptide
DEECIRTTNPVAYEQYGCVSTQNAVSQRGGNN

SEQ ID NO: 68080 - protein, 32 aa, Artificial Sequence
  Description of Artificial Sequence: Synthetic polypeptide
DEECIRTTNPVAYEQYGCVSTPNVQRFGSNQG

SEQ ID NO: 68081 - protein, 31 aa, Artificial Sequence
  Description of Artificial Sequence: Synthetic polypeptide
DEAEIRTTNPVAYEQWGEVSTNLQPGGDNDK

SEQ ID NO: 68082 - protein, 32 aa, Artificial Sequence
  Description of Artificial Sequence: Synthetic polypeptide
AEEQIRTTNPVATEQYGSVSTVNLDMNLGNTD

SEQ ID NO: 68083 - protein, 28 aa, Artificial Sequence
  Description of Artificial Sequence: Synthetic peptide
AENEIASTNPVATEQYGEASSNLQRGDI

SEQ ID NO: 68084 - protein, 32 aa, Artificial Sequence
  Description of Artificial Sequence: Synthetic polypeptide
DEDEIRTTNPVAYEQWGSVSTNLNQGADGDAR

SEQ ID NO: 68085 - protein, 31 aa, Artificial Sequence
  Description of Artificial Sequence: Synthetic polypeptide
DEAEIRTTNPVAYEQWGEVSTNLQTGGNDEN

SEQ ID NO: 68086 - protein, 31 aa, Artificial Sequence
  Description of Artificial Sequence: Synthetic polypeptide
DEEEIATTNPVAYERYGSVSTGDLNQGGMDR

SEQ ID NO: 68087 - protein, 28 aa, Artificial Sequence
  Description of Artificial Sequence: Synthetic peptide
AENEIACTNPVATEQYGEASWNLQQGGR

SEQ ID NO: 68088 - protein, 34 aa, Artificial Sequence
  Description of Artificial Sequence: Synthetic polypeptide
AEEEIRTTNPVATEQYGSVSTVNNLQQQIGENQN

SEQ ID NO: 68089 - protein, 34 aa, Artificial Sequence
  Description of Artificial Sequence: Synthetic polypeptide
AEEEIRTTNPVATEQYGSVSTVNLQLQIGNEQGE

SEQ ID NO: 68090 - protein, 31 aa, Artificial Sequence
  Description of Artificial Sequence: Synthetic polypeptide
DEECIRTTNPVAYEQYGCVSTINVQRFGSQQ

SEQ ID NO: 68091 - protein, 31 aa, Artificial Sequence
  Description of Artificial Sequence: Synthetic polypeptide
DEDEIRTTNPVAYEQYGTVSTSLGQGEGNMS

SEQ ID NO: 68092 - protein, 31 aa, Artificial Sequence
  Description of Artificial Sequence: Synthetic polypeptide
DDETIRTTNPVATEQYGAVSTNVHQQRVNLT

SEQ ID NO: 68093 - protein, 30 aa, Artificial Sequence
  Description of Artificial Sequence: Synthetic polypeptide
DEEEIRATNPVTTEQYGSVSTNNNTEIGTD

SEQ ID NO: 68094 - protein, 28 aa, Artificial Sequence
  Description of Artificial Sequence: Synthetic peptide
AENEIACTNPVATEQYGEASENLQPGGR

SEQ ID NO: 68095 - protein, 28 aa, Artificial Sequence
  Description of Artificial Sequence: Synthetic peptide
AENEIACTNPVATEQYGEASENLQQGGR

SEQ ID NO: 68096 - protein, 30 aa, Artificial Sequence
  Description of Artificial Sequence: Synthetic polypeptide
DEECIRTTNPVAYEQYGCVSTINVQTIINQ

SEQ ID NO: 68097 - protein, 32 aa, Artificial Sequence
  Description of Artificial Sequence: Synthetic polypeptide
AEEEIRTTNPVATEQYGSVSTVVGQENGNNNQ

SEQ ID NO: 68098 - protein, 30 aa, Artificial Sequence
  Description of Artificial Sequence: Synthetic polypeptide
DEECIRTTNPVAYEQYGCVSTNHSQFGGSM

SEQ ID NO: 68099 - protein, 30 aa, Artificial Sequence
  Description of Artificial Sequence: Synthetic polypeptide
DEEEIRATNPVTTEQYGSVSTNNTTNIGTD

SEQ ID NO: 68100 - protein, 28 aa, Artificial Sequence
  Description of Artificial Sequence: Synthetic peptide
DDNEIATTNPVATECYGDVANCLQRGQR

SEQ ID NO: 68101 - protein, 28 aa, Artificial Sequence
  Description of Artificial Sequence: Synthetic peptide
AENEIACTNPVATEQYGEASENLQNGGR

SEQ ID NO: 68102 - protein, 28 aa, Artificial Sequence
  Description of Artificial Sequence: Synthetic peptide
AENEIACTNPVATEQYGEASENLKRGGR

SEQ ID NO: 68103 - protein, 31 aa, Artificial Sequence
  Description of Artificial Sequence: Synthetic polypeptide
DEECIRTTNPVAYEQYGCVCSTNHSQFEGND

SEQ ID NO: 68104 - protein, 31 aa, Artificial Sequence
  Description of Artificial Sequence: Synthetic polypeptide
DEEEIRCTNPIATECWGSVSCNEPQREGENR

SEQ ID NO: 68105 - protein, 32 aa, Artificial Sequence
  Description of Artificial Sequence: Synthetic polypeptide
CEEEIRTTNPVATEQYGCVCSNTNLQHNSNQG

SEQ ID NO: 68106 - protein, 32 aa, Artificial Sequence
  Description of Artificial Sequence: Synthetic polypeptide
DEAEIRTTNPVATEQYGCVSTNLNGEHGNNSE

SEQ ID NO: 68107 - protein, 29 aa, Artificial Sequence
  Description of Artificial Sequence: Synthetic peptide
AENEIACTNPVATEQYGEASENLQIRGGR

SEQ ID NO: 68108 - protein, 28 aa, Artificial Sequence
  Description of Artificial Sequence: Synthetic peptide
AENEIACTNPVATENYGEASENLQRGGR

SEQ ID NO: 68109 - protein, 33 aa, Artificial Sequence
  Description of Artificial Sequence: Synthetic polypeptide
DEEEIGTTNPVATEQYGSVSTNQLGQEQMQNEL

SEQ ID NO: 68110 - protein, 30 aa, Artificial Sequence
  Description of Artificial Sequence: Synthetic polypeptide
AEEAICTTNPVATEQYGCVSSNHQRGSNQS

SEQ ID NO: 68111 - protein, 31 aa, Artificial Sequence
  Description of Artificial Sequence: Synthetic polypeptide
DEDEIRTTNPVAYERWGSVSTNLQAQGGNDT

SEQ ID NO: 68112 - protein, 33 aa, Artificial Sequence
  Description of Artificial Sequence: Synthetic polypeptide
DEEEIGTTNPVATEQYGSVSTPNQGDERMGNQL

SEQ ID NO: 68113 - protein, 28 aa, Artificial Sequence
  Description of Artificial Sequence: Synthetic peptide
AENEIACTNPVATEQYGEASENLQKGGR

SEQ ID NO: 68114 - protein, 28 aa, Artificial Sequence
  Description of Artificial Sequence: Synthetic peptide
AENEIACTNPVATEIYGEASENLQRGGR

SEQ ID NO: 68115 - protein, 29 aa, Artificial Sequence
  Description of Artificial Sequence: Synthetic peptide
AENEIACTNPVATEQYGEASENLQKRGGR

SEQ ID NO: 68116 - protein, 28 aa, Artificial Sequence
  Description of Artificial Sequence: Synthetic peptide
AENEIAPTNPCSTEQYGEVSENLQRGGR

SEQ ID NO: 68117 - protein, 32 aa, Artificial Sequence
  Description of Artificial Sequence: Synthetic polypeptide
CEEEIRTTNPVATEQYGSVASTALQGNGEFTD

SEQ ID NO: 68118 - protein, 34 aa, Artificial Sequence
  Description of Artificial Sequence: Synthetic polypeptide
DEEEIGTTNPVATEQYGSVSTPNQLGQEQMGNNL

SEQ ID NO: 68119 - protein, 28 aa, Artificial Sequence
  Description of Artificial Sequence: Synthetic peptide
AENEIAPTNPVASEQYGEASENLQRGGR

SEQ ID NO: 68120 - protein, 31 aa, Artificial Sequence
  Description of Artificial Sequence: Synthetic polypeptide
AEEQIRTTNPVATEQYGSVSTNLSELLNQTS

SEQ ID NO: 68121 - protein, 29 aa, Artificial Sequence
  Description of Artificial Sequence: Synthetic peptide
DEAEIRTTNPVACEQYGSCCTNLETENQS

SEQ ID NO: 68122 - protein, 31 aa, Artificial Sequence
  Description of Artificial Sequence: Synthetic polypeptide
DEEEIRTTNPVATEFYGQSTSTFNLPTGQFD

SEQ ID NO: 68123 - protein, 28 aa, Artificial Sequence
  Description of Artificial Sequence: Synthetic peptide
AENEIACTNPVATEQYGEASENLLRGAR

SEQ ID NO: 68124 - protein, 28 aa, Artificial Sequence
  Description of Artificial Sequence: Synthetic peptide
AENEIACTNPVATEQYGEASENLQIGGR

SEQ ID NO: 68125 - protein, 30 aa, Artificial Sequence
  Description of Artificial Sequence: Synthetic polypeptide
DEEEIATTNPVCTEHWGSVSMPNLGDRGNL

SEQ ID NO: 68126 - protein, 28 aa, Artificial Sequence
  Description of Artificial Sequence: Synthetic peptide
AENEIACTNPVATEQYGEASENLQSGGR

SEQ ID NO: 68127 - protein, 33 aa, Artificial Sequence
  Description of Artificial Sequence: Synthetic polypeptide
DEEEIRATNPVATEQYGSVCATNLQPDNQEGRA

SEQ ID NO: 68128 - protein, 28 aa, Artificial Sequence
  Description of Artificial Sequence: Synthetic peptide
AENEIACTNPVATEQYGEASENLQHGGR

SEQ ID NO: 68129 - protein, 30 aa, Artificial Sequence
  Description of Artificial Sequence: Synthetic polypeptide
DEAEIRTTNPVAYEQWGCVSTNSNGGNTDR

SEQ ID NO: 68130 - protein, 32 aa, Artificial Sequence
  Description of Artificial Sequence: Synthetic polypeptide
DEEAIRTTNPVAYERYGSVSCTNIQRPGGPNE

SEQ ID NO: 68131 - protein, 32 aa, Artificial Sequence
  Description of Artificial Sequence: Synthetic polypeptide
DEEEIATTNPVCTEHYGSVSMPNGLQDRDGNL

SEQ ID NO: 68132 - protein, 31 aa, Artificial Sequence
  Description of Artificial Sequence: Synthetic polypeptide
DEEEIATTNPVCTEPYGSVSNPNLQQGGNDL

SEQ ID NO: 68133 - protein, 28 aa, Artificial Sequence
  Description of Artificial Sequence: Synthetic peptide
AENEIAPTNPCATEQYGEASENLQRGTR

SEQ ID NO: 68134 - protein, 30 aa, Artificial Sequence
  Description of Artificial Sequence: Synthetic polypeptide
DEAEIRTTNPVAYEQWGCVSTTNGQSGNTD

SEQ ID NO: 68135 - protein, 31 aa, Artificial Sequence
  Description of Artificial Sequence: Synthetic polypeptide
DEEEIATTNPVAYERWGEVSTNLQLGEDNGR

SEQ ID NO: 68136 - protein, 28 aa, Artificial Sequence
  Description of Artificial Sequence: Synthetic peptide
AENEIACTNPVSSEQYGEVSCNLQRGTR

SEQ ID NO: 68137 - protein, 31 aa, Artificial Sequence
  Description of Artificial Sequence: Synthetic polypeptide
DEECIRTTNPVAYEQWGESVSIDNHQRDDNR

SEQ ID NO: 68138 - protein, 28 aa, Artificial Sequence
  Description of Artificial Sequence: Synthetic peptide
AENEIACTNPVATEQYGEASENLQHGTR

SEQ ID NO: 68139 - protein, 31 aa, Artificial Sequence
  Description of Artificial Sequence: Synthetic polypeptide
CEEEIRTTNPVATEQYGSISPTTVIQERQGR

SEQ ID NO: 68140 - protein, 29 aa, Artificial Sequence
  Description of Artificial Sequence: Synthetic peptide
DEEEIRCTNPIATECYGATVSENLMPGNI

SEQ ID NO: 68141 - protein, 29 aa, Artificial Sequence
  Description of Artificial Sequence: Synthetic peptide
AENEIACTNPVATEQYGEASENLQCRGGR

SEQ ID NO: 68142 - protein, 29 aa, Artificial Sequence
  Description of Artificial Sequence: Synthetic peptide
AENEIACTNPVATEQYGEQASENLQRGGR

SEQ ID NO: 68143 - protein, 34 aa, Artificial Sequence
  Description of Artificial Sequence: Synthetic polypeptide
DEEEIGTTNPVATEQYGSVSPTENQLQERMGAEL

SEQ ID NO: 68144 - protein, 31 aa, Artificial Sequence
  Description of Artificial Sequence: Synthetic polypeptide
DEECIRTTNPVAYEQWGESASINLQGEGDNR

SEQ ID NO: 68145 - protein, 28 aa, Artificial Sequence
  Description of Artificial Sequence: Synthetic peptide
AENEIACTNPVATEQYGETAENLQRGGR

SEQ ID NO: 68146 - protein, 32 aa, Artificial Sequence
  Description of Artificial Sequence: Synthetic polypeptide
DEDEIRTTNPVAYEQWGSVSTNLQGAGGGDAR

SEQ ID NO: 68147 - protein, 29 aa, Artificial Sequence
  Description of Artificial Sequence: Synthetic peptide
AENEIACTNPVATEQYGESSENLGQRGGR

SEQ ID NO: 68148 - protein, 28 aa, Artificial Sequence
  Description of Artificial Sequence: Synthetic peptide
AENEIASTNPVATEQYGEASDNLQSGGR

SEQ ID NO: 68149 - protein, 28 aa, Artificial Sequence
  Description of Artificial Sequence: Synthetic peptide
AENEIACTNPVATEQYGEASENLQCGGR

SEQ ID NO: 68150 - protein, 30 aa, Artificial Sequence
  Description of Artificial Sequence: Synthetic polypeptide
DEEEIATTNPVAYERWGSVSTNLQGDGMDG

SEQ ID NO: 68151 - protein, 30 aa, Artificial Sequence
  Description of Artificial Sequence: Synthetic polypeptide
DDETIRTTNPVATEQYGSVSTGDEGGGNTG

SEQ ID NO: 68152 - protein, 31 aa, Artificial Sequence
  Description of Artificial Sequence: Synthetic polypeptide
DEDEIRTTNPVAYEQWGSVATNLQGNAGNAA

SEQ ID NO: 68153 - protein, 31 aa, Artificial Sequence
  Description of Artificial Sequence: Synthetic polypeptide
DEEEIRCTNPVATEQYGSVSSNHNDHGSNTQ

SEQ ID NO: 68154 - protein, 32 aa, Artificial Sequence
  Description of Artificial Sequence: Synthetic polypeptide
DEEEIRCTNPVATEQYGSVSSTPAGMMRGMNV

SEQ ID NO: 68155 - protein, 28 aa, Artificial Sequence
  Description of Artificial Sequence: Synthetic peptide
AENEIACTNPVATEQYGENSWNLQRGGA

SEQ ID NO: 68156 - protein, 31 aa, Artificial Sequence
  Description of Artificial Sequence: Synthetic polypeptide
AEEQICTTNPVATEQYGSVSTMNSNQNGNSE

SEQ ID NO: 68157 - protein, 29 aa, Artificial Sequence
  Description of Artificial Sequence: Synthetic peptide
DEEEIATTNPVCYETYGSVANPNLQDGNL

SEQ ID NO: 68158 - protein, 29 aa, Artificial Sequence
  Description of Artificial Sequence: Synthetic peptide
AENEIASTNPVATEQYGEASENLQCRGGR

SEQ ID NO: 68159 - protein, 28 aa, Artificial Sequence
  Description of Artificial Sequence: Synthetic peptide
AENEIACTNPVATEQYGEASENLQMGGR

SEQ ID NO: 68160 - protein, 29 aa, Artificial Sequence
  Description of Artificial Sequence: Synthetic peptide
AENEIACTNPVATEQYGEASENLQRYGGR

SEQ ID NO: 68161 - protein, 31 aa, Artificial Sequence
  Description of Artificial Sequence: Synthetic polypeptide
DEEEIRCTNPISTEQYGTVSEENLQQRNGNH

SEQ ID NO: 68162 - protein, 32 aa, Artificial Sequence
  Description of Artificial Sequence: Synthetic polypeptide
DEEEIATTNPVAYERYGSVSTGNDLQGGGADR

SEQ ID NO: 68163 - protein, 29 aa, Artificial Sequence
  Description of Artificial Sequence: Synthetic peptide
AENEIACTNPVATEQYGEASWNLQERGGR

SEQ ID NO: 68164 - protein, 32 aa, Artificial Sequence
  Description of Artificial Sequence: Synthetic polypeptide
DEDEIRTTNPVAYEQWGSVSTNLNQNDGNENE

SEQ ID NO: 68165 - protein, 28 aa, Artificial Sequence
  Description of Artificial Sequence: Synthetic peptide
AENEIACTNPVATEQYGEASENLQRYGR

SEQ ID NO: 68166 - protein, 28 aa, Artificial Sequence
  Description of Artificial Sequence: Synthetic peptide
AENEIACTNPVATEQYGEASENLQLGGR

SEQ ID NO: 68167 - protein, 28 aa, Artificial Sequence
  Description of Artificial Sequence: Synthetic peptide
AENEIACTNPVATEQWGEASENLQRGGR

SEQ ID NO: 68168 - protein, 30 aa, Artificial Sequence
  Description of Artificial Sequence: Synthetic polypeptide
AEECIRTTNPVATEQYGCVCSTNPQFGSDQ

SEQ ID NO: 68169 - protein, 32 aa, Artificial Sequence
  Description of Artificial Sequence: Synthetic polypeptide
CEEEIRTTNPVATEQYGSVCSAFPAQRGPNEQ

SEQ ID NO: 68170 - protein, 31 aa, Artificial Sequence
  Description of Artificial Sequence: Synthetic polypeptide
DEAEIRTTNPVATEQYGCVSTNDHQNFGSEQ

SEQ ID NO: 68171 - protein, 28 aa, Artificial Sequence
  Description of Artificial Sequence: Synthetic peptide
AENEIAQTNPVATEQYGEASENCQRGGR

SEQ ID NO: 68172 - protein, 31 aa, Artificial Sequence
  Description of Artificial Sequence: Synthetic polypeptide
AEDEIRTTNPVAYEQWGSVSTNLQGQGEGNQ

SEQ ID NO: 68173 - protein, 31 aa, Artificial Sequence
  Description of Artificial Sequence: Synthetic polypeptide
DEDEIRTTNPVAYESWGVVSTNLQLNGDNGR

SEQ ID NO: 68174 - protein, 28 aa, Artificial Sequence
  Description of Artificial Sequence: Synthetic peptide
AENEIASTNPVATEQYGEAAENLQRGGR

SEQ ID NO: 68175 - protein, 28 aa, Artificial Sequence
  Description of Artificial Sequence: Synthetic peptide
AENEIACTNPVATEHYGEASENLQRGGR

SEQ ID NO: 68176 - protein, 31 aa, Artificial Sequence
  Description of Artificial Sequence: Synthetic polypeptide
DEAEIRTTNPVATDQYGSVNMQLQTRGENDM

SEQ ID NO: 68177 - protein, 31 aa, Artificial Sequence
  Description of Artificial Sequence: Synthetic polypeptide
DDETIRTTNPVATEQYGDVSTNHEQVRVNLG

SEQ ID NO: 68178 - protein, 33 aa, Artificial Sequence
  Description of Artificial Sequence: Synthetic polypeptide
AEEEIRTTNPVATEQYGSVSTVNNNNQEIGNDQ

SEQ ID NO: 68179 - protein, 33 aa, Artificial Sequence
  Description of Artificial Sequence: Synthetic polypeptide
AEEEIRTTNPVATEQYGSVSTVNNLQEEGEQGQ

SEQ ID NO: 68180 - protein, 28 aa, Artificial Sequence
  Description of Artificial Sequence: Synthetic peptide
AENEIASTNPVATEQYGEASENLQSGGR

SEQ ID NO: 68181 - protein, 28 aa, Artificial Sequence
  Description of Artificial Sequence: Synthetic peptide
AENEIACTNPVATEHYGEASNNLQRGGR

SEQ ID NO: 68182 - protein, 29 aa, Artificial Sequence
  Description of Artificial Sequence: Synthetic peptide
AENEIACTNPVATEQYGEASENLQMRGGR

SEQ ID NO: 68183 - protein, 28 aa, Artificial Sequence
  Description of Artificial Sequence: Synthetic peptide
DESEIATTNPVGTEQYGSMASTGNHGNI

SEQ ID NO: 68184 - protein, 34 aa, Artificial Sequence
  Description of Artificial Sequence: Synthetic polypeptide
AEEEIRTTNPVATEQYGSVSTVVNLQQNDEGEAE

SEQ ID NO: 68185 - protein, 29 aa, Artificial Sequence
  Description of Artificial Sequence: Synthetic peptide
QENEIVTTNPVATEQYGTVSTDCLEHENL

SEQ ID NO: 68186 - protein, 33 aa, Artificial Sequence
  Description of Artificial Sequence: Synthetic polypeptide
AEEEIRTTNPVATEQYGSVSVTNQQQTQAGTII

SEQ ID NO: 68187 - protein, 34 aa, Artificial Sequence
  Description of Artificial Sequence: Synthetic polypeptide
DEEEIATTNPVATEQYGSVCAANNLDQEAGENGR

SEQ ID NO: 68188 - protein, 29 aa, Artificial Sequence
  Description of Artificial Sequence: Synthetic peptide
DESEIATTNPVGTEQYGSMATSAGNRGNI

SEQ ID NO: 68189 - protein, 32 aa, Artificial Sequence
  Description of Artificial Sequence: Synthetic polypeptide
DEEEIKTTNPVATEQYGCVCSTEHQNSGSNQG

SEQ ID NO: 68190 - protein, 33 aa, Artificial Sequence
  Description of Artificial Sequence: Synthetic polypeptide
DESEIATTNPVAYEQYGSVAITANLQDQGNDRL

SEQ ID NO: 68191 - protein, 32 aa, Artificial Sequence
  Description of Artificial Sequence: Synthetic polypeptide
DEAEIRTTNPVATEQYGSVSPTNGEGNNEEDN

SEQ ID NO: 68192 - protein, 28 aa, Artificial Sequence
  Description of Artificial Sequence: Synthetic peptide
QENEIRTTNPCSTEPYGIVSCNIQQGTR

SEQ ID NO: 68193 - protein, 33 aa, Artificial Sequence
  Description of Artificial Sequence: Synthetic polypeptide
DEPEIRTTNPVATEQYGSVSPTVDWLENGNFQE

SEQ ID NO: 68194 - protein, 33 aa, Artificial Sequence
  Description of Artificial Sequence: Synthetic polypeptide
CEEEIRTTNPVATEQYGCVCSMTELQGSGSNDS

SEQ ID NO: 68195 - protein, 34 aa, Artificial Sequence
  Description of Artificial Sequence: Synthetic polypeptide
DEAEIRTTNPVATEQYGSVSENDNLQQIGDNNQQ

SEQ ID NO: 68196 - protein, 32 aa, Artificial Sequence
  Description of Artificial Sequence: Synthetic polypeptide
DEEEIRTTNPVATEQYGSISWTWLESYGEETN

SEQ ID NO: 68197 - protein, 34 aa, Artificial Sequence
  Description of Artificial Sequence: Synthetic polypeptide
DEAEIRTTNPVATEQYGSVSTAPDQHRSGQNVEN

SEQ ID NO: 68198 - protein, 32 aa, Artificial Sequence
  Description of Artificial Sequence: Synthetic polypeptide
DEEEIATTNPVATEQYGSVCAAMNDQDMPGNN

SEQ ID NO: 68199 - protein, 34 aa, Artificial Sequence
  Description of Artificial Sequence: Synthetic polypeptide
DECEICTTNPVATEQYGSVSTTNLLNQQNGNEED

SEQ ID NO: 68200 - protein, 31 aa, Artificial Sequence
  Description of Artificial Sequence: Synthetic polypeptide
DEEEINTTNPVAYEAYGKVSCTNLTNAGGNA

SEQ ID NO: 68201 - protein, 33 aa, Artificial Sequence
  Description of Artificial Sequence: Synthetic polypeptide
DEEEINTTNPVAWEQYGSVSTDNSLFTVRVGEF

SEQ ID NO: 68202 - protein, 30 aa, Artificial Sequence
  Description of Artificial Sequence: Synthetic polypeptide
QEQEIATTNPVATEQYGSVSATDLEHGEDL

SEQ ID NO: 68203 - protein, 30 aa, Artificial Sequence
  Description of Artificial Sequence: Synthetic polypeptide
DESEIATTNPVAYDHYGSVSTNLQNHDNMK

SEQ ID NO: 68204 - protein, 31 aa, Artificial Sequence
  Description of Artificial Sequence: Synthetic polypeptide
DEEEIKTTNPVATEQYGTVESMNYTMGGQNC

SEQ ID NO: 68205 - protein, 33 aa, Artificial Sequence
  Description of Artificial Sequence: Synthetic polypeptide
DECEICTTNPVATEQYGSVSTTNLLNQQNGEET

SEQ ID NO: 68206 - protein, 35 aa, Artificial Sequence
  Description of Artificial Sequence: Synthetic polypeptide
DEEEIRTTNPVATEQYGSVESTPNGLEPSGEELRS

SEQ ID NO: 68207 - protein, 32 aa, Artificial Sequence
  Description of Artificial Sequence: Synthetic polypeptide
DEPEIRTTNPVATEQYGSVSVTYNTINNNDPY

SEQ ID NO: 68208 - protein, 33 aa, Artificial Sequence
  Description of Artificial Sequence: Synthetic polypeptide
QEEEIRTTNPVATEQYGSVSSTTPAGPNRGMNV

SEQ ID NO: 68209 - protein, 33 aa, Artificial Sequence
  Description of Artificial Sequence: Synthetic polypeptide
DEEEIRTTNPVATEQYGSVSTYGLDNDTIENEM

SEQ ID NO: 68210 - protein, 31 aa, Artificial Sequence
  Description of Artificial Sequence: Synthetic polypeptide
DEEEIRTTNPVATEQYGSVETNMSVNSEDEI

SEQ ID NO: 68211 - protein, 33 aa, Artificial Sequence
  Description of Artificial Sequence: Synthetic polypeptide
DEEEIRTTNPVATEQYGSVSTYGMGNTGFENEF

SEQ ID NO: 68212 - protein, 34 aa, Artificial Sequence
  Description of Artificial Sequence: Synthetic polypeptide
DEEEIRTTNPVATEQYGSLSPTNIGLQDFGQLFE

SEQ ID NO: 68213 - protein, 33 aa, Artificial Sequence
  Description of Artificial Sequence: Synthetic polypeptide
DEPEIRTTNPVATEQYGSVSVTNNGQINNNDNE

SEQ ID NO: 68214 - protein, 34 aa, Artificial Sequence
  Description of Artificial Sequence: Synthetic polypeptide
DECEICTTNPVATEQYGSVSTTNLGNQVNGNEEQ

SEQ ID NO: 68215 - protein, 33 aa, Artificial Sequence
  Description of Artificial Sequence: Synthetic polypeptide
DEEEIRTTNPVATEQYGSVSTYGMGNTGQEDIG

SEQ ID NO: 68216 - protein, 35 aa, Artificial Sequence
  Description of Artificial Sequence: Synthetic polypeptide
DEPEIRTTNPVATEQYGSVSWIPNLEQNRTGNENG

SEQ ID NO: 68217 - protein, 34 aa, Artificial Sequence
  Description of Artificial Sequence: Synthetic polypeptide
DEEEIRTTNPVATEQYGSVEPTNMLDERNVNVSI

SEQ ID NO: 68218 - protein, 33 aa, Artificial Sequence
  Description of Artificial Sequence: Synthetic polypeptide
QEEEIRTTNPVATEQYGSVSSTTAGPNRGMNPV

SEQ ID NO: 68219 - protein, 30 aa, Artificial Sequence
  Description of Artificial Sequence: Synthetic polypeptide
DEPEIGCTNPVATEQYGSVVSTEMQHVIQR

SEQ ID NO: 68220 - protein, 32 aa, Artificial Sequence
  Description of Artificial Sequence: Synthetic polypeptide
QEEEIRTTNPVATEQYGSVSTTPAGNMRNENV

SEQ ID NO: 68221 - protein, 33 aa, Artificial Sequence
  Description of Artificial Sequence: Synthetic polypeptide
DEPEIRTTNPVATEQYGSVVPSIMNLQATGTMG

SEQ ID NO: 68222 - protein, 33 aa, Artificial Sequence
  Description of Artificial Sequence: Synthetic polypeptide
DEEEIRTTNPVATEQYGSVETNQEVVRTLNFDN

SEQ ID NO: 68223 - protein, 31 aa, Artificial Sequence
  Description of Artificial Sequence: Synthetic polypeptide
DESEIATTNPVSSEQYGSVSCINEPQREGTR

SEQ ID NO: 68224 - protein, 31 aa, Artificial Sequence
  Description of Artificial Sequence: Synthetic polypeptide
QEEEIRTTNPVATEQYGSVGTNTMDNGGGEG

SEQ ID NO: 68225 - protein, 34 aa, Artificial Sequence
  Description of Artificial Sequence: Synthetic polypeptide
DEEEIRTTNPVATEQYGSVETNQEQVRELVNVDN

SEQ ID NO: 68226 - protein, 34 aa, Artificial Sequence
  Description of Artificial Sequence: Synthetic polypeptide
DECEICTTNPVATEQYGSVSTTNLNEQQGTNQTD

SEQ ID NO: 68227 - protein, 34 aa, Artificial Sequence
  Description of Artificial Sequence: Synthetic polypeptide
DEEEIRTTNPVATEQYGSVSTYGMGGQEFGGNNQ

SEQ ID NO: 68228 - protein, 33 aa, Artificial Sequence
  Description of Artificial Sequence: Synthetic polypeptide
DEPEIRTTNPVATEQYGSVSWQSNLGMRAGEEG

SEQ ID NO: 68229 - protein, 34 aa, Artificial Sequence
  Description of Artificial Sequence: Synthetic polypeptide
DEEEIRTTNPVATEQYGSVEPTNLGEPVIGNTSS

SEQ ID NO: 68230 - protein, 28 aa, Artificial Sequence
  Description of Artificial Sequence: Synthetic peptide
QENEIATVNPVATEQYGDVSECLQHENL

SEQ ID NO: 68231 - protein, 33 aa, Artificial Sequence
  Description of Artificial Sequence: Synthetic polypeptide
AEEEIRTTNPVATEQYGSVSVTNQQQQEATNNT

SEQ ID NO: 68232 - protein, 33 aa, Artificial Sequence
  Description of Artificial Sequence: Synthetic polypeptide
DEAEIRTTNPVATEQYGSVSCVQSLQDRSGEKN

SEQ ID NO: 68233 - protein, 35 aa, Artificial Sequence
  Description of Artificial Sequence: Synthetic polypeptide
QEEEIRTTNPVATEQYGSVSSTPNLIQNANGNNGQ

SEQ ID NO: 68234 - protein, 34 aa, Artificial Sequence
  Description of Artificial Sequence: Synthetic polypeptide
DEAEIRTTNPVATEQYGSVSPTVTLERQGDNSQT

SEQ ID NO: 68235 - protein, 31 aa, Artificial Sequence
  Description of Artificial Sequence: Synthetic polypeptide
DEAEIRTTNPVATEQYGSVSDAPLQGDQTIG

SEQ ID NO: 68236 - protein, 33 aa, Artificial Sequence
  Description of Artificial Sequence: Synthetic polypeptide
QEEEIRTTNPVATEQYGSVSSTTAGNMRNGNPV

SEQ ID NO: 68237 - protein, 33 aa, Artificial Sequence
  Description of Artificial Sequence: Synthetic polypeptide
DEEEIRTTNPVATEQYGSVSTYGMGNETGQDNE

SEQ ID NO: 68238 - protein, 33 aa, Artificial Sequence
  Description of Artificial Sequence: Synthetic polypeptide
DEAEIRTTNPVATEQYGSVSPTNGESGNNDEEG

SEQ ID NO: 68239 - protein, 34 aa, Artificial Sequence
  Description of Artificial Sequence: Synthetic polypeptide
DEEEIATTNPVATEQYGSVCAANPLQEAGDNQRN

SEQ ID NO: 68240 - protein, 32 aa, Artificial Sequence
  Description of Artificial Sequence: Synthetic polypeptide
CEEEIRTTNPVATEPYGKISTNEESQNRVGND

SEQ ID NO: 68241 - protein, 33 aa, Artificial Sequence
  Description of Artificial Sequence: Synthetic polypeptide
DEEEIKTTNPVAYEHWGSVSCTGNLSQQRGNQP

SEQ ID NO: 68242 - protein, 34 aa, Artificial Sequence
  Description of Artificial Sequence: Synthetic polypeptide
AEEEIRTTNPVATEQYGSVSTVVNNLQIGTEQGA

SEQ ID NO: 68243 - protein, 32 aa, Artificial Sequence
  Description of Artificial Sequence: Synthetic polypeptide
CEEEIRTTNPVATEQYGCVCSTELQNSGSEQN

SEQ ID NO: 68244 - protein, 32 aa, Artificial Sequence
  Description of Artificial Sequence: Synthetic polypeptide
DEAEIRTTNPVATEQYGSVSPTNLEVIESHEQ

SEQ ID NO: 68245 - protein, 30 aa, Artificial Sequence
  Description of Artificial Sequence: Synthetic polypeptide
QEQEIATTNPVATEQYGSVSACDLQSGTDL

SEQ ID NO: 68246 - protein, 30 aa, Artificial Sequence
  Description of Artificial Sequence: Synthetic polypeptide
DESEIATTNPVGTEQYGSMSTSAGNRGMNI

SEQ ID NO: 68247 - protein, 33 aa, Artificial Sequence
  Description of Artificial Sequence: Synthetic polypeptide
QEEEIRTTNPVATEQYGSVSTCPAGPNMRGNPV

SEQ ID NO: 68248 - protein, 28 aa, Artificial Sequence
  Description of Artificial Sequence: Synthetic peptide
QENEIRPTNPCSTEPYGIVSCNLQQGTR

SEQ ID NO: 68249 - protein, 31 aa, Artificial Sequence
  Description of Artificial Sequence: Synthetic polypeptide
DEEEIATTNPVATEQYGSVCAANNPQRAEPD

SEQ ID NO: 68250 - protein, 34 aa, Artificial Sequence
  Description of Artificial Sequence: Synthetic polypeptide
AEEEIRTTNPVATEQYGSVSVTTNGGNQQGNQDE

SEQ ID NO: 68251 - protein, 33 aa, Artificial Sequence
  Description of Artificial Sequence: Synthetic polypeptide
CEEEIRTTNPVATEQYGCVCSTELQERFFSNDS

SEQ ID NO: 68252 - protein, 33 aa, Artificial Sequence
  Description of Artificial Sequence: Synthetic polypeptide
DEEEIRTTNPVATEQYGSVEPTNTELRTNNQIQ

SEQ ID NO: 68253 - protein, 35 aa, Artificial Sequence
  Description of Artificial Sequence: Synthetic polypeptide
AEEEIRTTNPVATEQYGSVSVTNNQLQAGNGTNVN

SEQ ID NO: 68254 - protein, 33 aa, Artificial Sequence
  Description of Artificial Sequence: Synthetic polypeptide
DEPEIRTTNPVATEQYGSVSTLLGMQEGTYEQV

SEQ ID NO: 68255 - protein, 33 aa, Artificial Sequence
  Description of Artificial Sequence: Synthetic polypeptide
DEEEIRTTNPVATEQYGSISVMMLPQREVNEIN

SEQ ID NO: 68256 - protein, 34 aa, Artificial Sequence
  Description of Artificial Sequence: Synthetic polypeptide
DECEICTTNPVATEQYGSVSTNLQLLQQGTNSTE

SEQ ID NO: 68257 - protein, 32 aa, Artificial Sequence
  Description of Artificial Sequence: Synthetic polypeptide
DEEEIRTTNPVATEQYGSISVWLMERNVNVIT

SEQ ID NO: 68258 - protein, 28 aa, Artificial Sequence
  Description of Artificial Sequence: Synthetic peptide
QENEIRPTNPCATEQYGDVSCILQSGDA

SEQ ID NO: 68259 - protein, 30 aa, Artificial Sequence
  Description of Artificial Sequence: Synthetic polypeptide
QEQEIATTNPVATEQYGSVSATDLEHGEDI

SEQ ID NO: 68260 - protein, 32 aa, Artificial Sequence
  Description of Artificial Sequence: Synthetic polypeptide
DESEIATTNPVAYEQYGSVAITDNLQQGNDPL

SEQ ID NO: 68261 - protein, 32 aa, Artificial Sequence
  Description of Artificial Sequence: Synthetic polypeptide
DEPEIGTTNPVATEQYGSVSVTNAGMEGGNTG

SEQ ID NO: 68262 - protein, 33 aa, Artificial Sequence
  Description of Artificial Sequence: Synthetic polypeptide
DEPEIGTTNPVATEQYGSVSNTNQDQEEMGNLD

SEQ ID NO: 68263 - protein, 32 aa, Artificial Sequence
  Description of Artificial Sequence: Synthetic polypeptide
CEEEIRTTNPVATEQYGCVCSTELQRFQSDQE

SEQ ID NO: 68264 - protein, 34 aa, Artificial Sequence
  Description of Artificial Sequence: Synthetic polypeptide
CEEEIRTTNPVATEQYGCVCSNTNLQHFGSNNQG

SEQ ID NO: 68265 - protein, 33 aa, Artificial Sequence
  Description of Artificial Sequence: Synthetic polypeptide
DECEICTTNPVATEQYGSVSTTTNLLNQVNGEE

SEQ ID NO: 68266 - protein, 33 aa, Artificial Sequence
  Description of Artificial Sequence: Synthetic polypeptide
DECEICTTNPVATEQYGSVSTTNLNMEQGNQTE

SEQ ID NO: 68267 - protein, 31 aa, Artificial Sequence
  Description of Artificial Sequence: Synthetic polypeptide
DESEIATTNPVGTEQYGSVSTTAGNMRGMNI

SEQ ID NO: 68268 - protein, 33 aa, Artificial Sequence
  Description of Artificial Sequence: Synthetic polypeptide
DEEEIRTTNPVATEQYGSVETNMDQDRMSEDEI

SEQ ID NO: 68269 - protein, 33 aa, Artificial Sequence
  Description of Artificial Sequence: Synthetic polypeptide
DEEEIATTNPVATEQYGSVCAANPLQEADNDRF

SEQ ID NO: 68270 - protein, 32 aa, Artificial Sequence
  Description of Artificial Sequence: Synthetic polypeptide
DEAEIRTTNPVATEQYGSVSPTPGETGDNEDD

SEQ ID NO: 68271 - protein, 31 aa, Artificial Sequence
  Description of Artificial Sequence: Synthetic polypeptide
DESEIATTNPVGTEQYGSVSTSAGNMRGMNI

SEQ ID NO: 68272 - protein, 35 aa, Artificial Sequence
  Description of Artificial Sequence: Synthetic polypeptide
DEEEINTTNPVATEQYGSTVSCTNELSQESNGGNY

SEQ ID NO: 68273 - protein, 33 aa, Artificial Sequence
  Description of Artificial Sequence: Synthetic polypeptide
DEEEIRTTNPVATEQYGSVSTYDTEQAVQNSVN

SEQ ID NO: 68274 - protein, 33 aa, Artificial Sequence
  Description of Artificial Sequence: Synthetic polypeptide
CEEEIRTTNPVATEQYGAVSTNNEGQGGGENGD

SEQ ID NO: 68275 - protein, 31 aa, Artificial Sequence
  Description of Artificial Sequence: Synthetic polypeptide
QENEIRATNPVATECYGVVSTNLEMREGEND

SEQ ID NO: 68276 - protein, 33 aa, Artificial Sequence
  Description of Artificial Sequence: Synthetic polypeptide
DEEEIKTTNPVAYEAYGCAVSCTNLSQRGGNLS

SEQ ID NO: 68277 - protein, 33 aa, Artificial Sequence
  Description of Artificial Sequence: Synthetic polypeptide
QEEEIRTTNPVATEQYGSVSSTTPAGQRNENPV

SEQ ID NO: 68278 - protein, 28 aa, Artificial Sequence
  Description of Artificial Sequence: Synthetic peptide
QENEIRPTNPCASEQYGIVSCNLQAGTA

SEQ ID NO: 68279 - protein, 31 aa, Artificial Sequence
  Description of Artificial Sequence: Synthetic polypeptide
DEPEIGTTNPVATEQYGSVTTDNAGMEGGNT

SEQ ID NO: 68280 - protein, 32 aa, Artificial Sequence
  Description of Artificial Sequence: Synthetic polypeptide
DEEEIATTNPVATEQYGSVCAANNLGEAGENE

SEQ ID NO: 68281 - protein, 31 aa, Artificial Sequence
  Description of Artificial Sequence: Synthetic polypeptide
DEEEIRTTNPVATEQYGSVESNIGPTVEERV

SEQ ID NO: 68282 - protein, 30 aa, Artificial Sequence
  Description of Artificial Sequence: Synthetic polypeptide
DESEIATTNPVAYDPHYGSVSTNDQRTGDM

SEQ ID NO: 68283 - protein, 34 aa, Artificial Sequence
  Description of Artificial Sequence: Synthetic polypeptide
DEEEIKTTNPVATEQYGSTVQWCTNHSQRTSGNS

SEQ ID NO: 68284 - protein, 34 aa, Artificial Sequence
  Description of Artificial Sequence: Synthetic polypeptide
DEEEIKTTNPVATEQYGSVAPCTNDSQRTSGNQS

SEQ ID NO: 68285 - protein, 34 aa, Artificial Sequence
  Description of Artificial Sequence: Synthetic polypeptide
QEEEIRTTNPVATEQYGSVSTMNGLEGEGGENTI

SEQ ID NO: 68286 - protein, 33 aa, Artificial Sequence
  Description of Artificial Sequence: Synthetic polypeptide
DEEEIRTTNPVATEQYGSIVGTNEDLGGNEEDQ

SEQ ID NO: 68287 - protein, 33 aa, Artificial Sequence
  Description of Artificial Sequence: Synthetic polypeptide
DEAEIRTTNPVATEQYGSVSPTDNLTQTSSEDM

SEQ ID NO: 68288 - protein, 33 aa, Artificial Sequence
  Description of Artificial Sequence: Synthetic polypeptide
DEEEIKTTNPVATEQYGSVCCCTNDSQKTSGNS

SEQ ID NO: 68289 - protein, 32 aa, Artificial Sequence
  Description of Artificial Sequence: Synthetic polypeptide
CEEEIRTTNPVATEQYGCVCSTALQHFGSEQA

SEQ ID NO: 68290 - protein, 32 aa, Artificial Sequence
  Description of Artificial Sequence: Synthetic polypeptide
DEPEIRTTNPVATEQYGSVSMMNQAREVNEFV

SEQ ID NO: 68291 - protein, 33 aa, Artificial Sequence
  Description of Artificial Sequence: Synthetic polypeptide
CEEEIRTTNPVATEQYGCVCSMTNLQGFGSDAS

SEQ ID NO: 68292 - protein, 31 aa, Artificial Sequence
  Description of Artificial Sequence: Synthetic polypeptide
DEPEIRTTNPVATDQYGTVSTNGLGEGGGEQ

SEQ ID NO: 68293 - protein, 28 aa, Artificial Sequence
  Description of Artificial Sequence: Synthetic peptide
QEQEIATTNPVATECYGDVSTCLQHEEL

SEQ ID NO: 68294 - protein, 32 aa, Artificial Sequence
  Description of Artificial Sequence: Synthetic polypeptide
DEEEIRTTNPVATEQYGSIVVSNGIDIGEVER

SEQ ID NO: 68295 - protein, 33 aa, Artificial Sequence
  Description of Artificial Sequence: Synthetic polypeptide
QEEEIRTTNPVATEQYGSVSTNAGNTGEGTNGD

SEQ ID NO: 68296 - protein, 33 aa, Artificial Sequence
  Description of Artificial Sequence: Synthetic polypeptide
DEAEIRTTNPVATEQYGSVSTEGDLQQSSSQER

SEQ ID NO: 68297 - protein, 33 aa, Artificial Sequence
  Description of Artificial Sequence: Synthetic polypeptide
DEPEIRTTNPVATEQYGSVSMMNLARINVNENT

SEQ ID NO: 68298 - protein, 28 aa, Artificial Sequence
  Description of Artificial Sequence: Synthetic peptide
QEQEIATTNPCSTEQYGIVSTDLQSGTL

SEQ ID NO: 68299 - protein, 33 aa, Artificial Sequence
  Description of Artificial Sequence: Synthetic polypeptide
DEEEIRTTNPVATEQYGSIVVSFNVHQGIINEM

SEQ ID NO: 68300 - protein, 28 aa, Artificial Sequence
  Description of Artificial Sequence: Synthetic peptide
QENEIRTTNPVATEQYGEVSEICQAEEA

SEQ ID NO: 68301 - protein, 34 aa, Artificial Sequence
  Description of Artificial Sequence: Synthetic polypeptide
DEPEIRTTNPVATEQYGSVSDPTQLEQIGIVNDN

SEQ ID NO: 68302 - protein, 34 aa, Artificial Sequence
  Description of Artificial Sequence: Synthetic polypeptide
DEEEIKTTNPVATEQYGSVQCCTNDSQRTSGNES

SEQ ID NO: 68303 - protein, 33 aa, Artificial Sequence
  Description of Artificial Sequence: Synthetic polypeptide
AEEEIRTTNPVATEQYGSVSVTNSNNTESGNNT

SEQ ID NO: 68304 - protein, 32 aa, Artificial Sequence
  Description of Artificial Sequence: Synthetic polypeptide
QEEEIRTTNPVATEQYGSVSNDQNEGGNGNGQ

SEQ ID NO: 68305 - protein, 33 aa, Artificial Sequence
  Description of Artificial Sequence: Synthetic polypeptide
DEPEIRTTNPVATEQYGSVSMMNGARNEVNERV

SEQ ID NO: 68306 - protein, 32 aa, Artificial Sequence
  Description of Artificial Sequence: Synthetic polypeptide
DEEEIRTTNPVATEQYGSVEPWSNMEQRILTD

SEQ ID NO: 68307 - protein, 33 aa, Artificial Sequence
  Description of Artificial Sequence: Synthetic polypeptide
QEEEIRTTNPVATEQYGSVSNEDNGQGEGGNQG

SEQ ID NO: 68308 - protein, 33 aa, Artificial Sequence
  Description of Artificial Sequence: Synthetic polypeptide
DEEEIRTTNPVATEQYGSIVCSTEHQNFGSEQF

SEQ ID NO: 68309 - protein, 34 aa, Artificial Sequence
  Description of Artificial Sequence: Synthetic polypeptide
AEEEIRTTNPVATEQYGSVSTVVNLQQQEEEAGN

SEQ ID NO: 68310 - protein, 28 aa, Artificial Sequence
  Description of Artificial Sequence: Synthetic peptide
QENEIRTTNPVATESYGDVSECLQHEEL

SEQ ID NO: 68311 - protein, 29 aa, Artificial Sequence
  Description of Artificial Sequence: Synthetic peptide
QEQEIAPTNPCASEQYGSVSACNLQSGTR

SEQ ID NO: 68312 - protein, 31 aa, Artificial Sequence
  Description of Artificial Sequence: Synthetic polypeptide
QEEEIRTTNPVATEQYGSVSPTACQMHEMEV

SEQ ID NO: 68313 - protein, 34 aa, Artificial Sequence
  Description of Artificial Sequence: Synthetic polypeptide
AEEEIRTTNPVATEQYGSVSVTSNLGANNQGNDG

SEQ ID NO: 68314 - protein, 33 aa, Artificial Sequence
  Description of Artificial Sequence: Synthetic polypeptide
DECEICTTNPVATEQYGSVSTTNQQQEQQGAND

SEQ ID NO: 68315 - protein, 34 aa, Artificial Sequence
  Description of Artificial Sequence: Synthetic polypeptide
DEEEIRTTNPVATEQYGSVETMNLVINIGPADNI

SEQ ID NO: 68316 - protein, 33 aa, Artificial Sequence
  Description of Artificial Sequence: Synthetic polypeptide
CEEEIRTTNPVATEQYGCVCSNTELQHFGSNQM

SEQ ID NO: 68317 - protein, 29 aa, Artificial Sequence
  Description of Artificial Sequence: Synthetic peptide
QEQEIAPTNPCASEQYGSVSATNLQSGTL

SEQ ID NO: 68318 - protein, 32 aa, Artificial Sequence
  Description of Artificial Sequence: Synthetic polypeptide
QEEEIRTTNPVATEQYGSVSPTACNMRNGMEV

SEQ ID NO: 68319 - protein, 31 aa, Artificial Sequence
  Description of Artificial Sequence: Synthetic polypeptide
DESEIATTNPVAYEQWGISTVPSTNLQDVNM

SEQ ID NO: 68320 - protein, 32 aa, Artificial Sequence
  Description of Artificial Sequence: Synthetic polypeptide
QEEEIRTTNPVATEQYGSVSTLTWNTRFGTHN

SEQ ID NO: 68321 - protein, 35 aa, Artificial Sequence
  Description of Artificial Sequence: Synthetic polypeptide
AEEEIRTTNPVATEQYGSVSTVVNLQQGNNGEQGQ

SEQ ID NO: 68322 - protein, 31 aa, Artificial Sequence
  Description of Artificial Sequence: Synthetic polypeptide
DEEEIATTNPVATEQYGSVCAANGDQMDNNN

SEQ ID NO: 68323 - protein, 29 aa, Artificial Sequence
  Description of Artificial Sequence: Synthetic peptide
QEQEIATTNPVATECYGSVSATCLQHEEL

SEQ ID NO: 68324 - protein, 28 aa, Artificial Sequence
  Description of Artificial Sequence: Synthetic peptide
QENEIRTTNPVATEPYGDISECLQHGEL

SEQ ID NO: 68325 - protein, 31 aa, Artificial Sequence
  Description of Artificial Sequence: Synthetic polypeptide
QEEEIRTTNPVATEQYGSVSPTACNMREMEV

SEQ ID NO: 68326 - protein, 34 aa, Artificial Sequence
  Description of Artificial Sequence: Synthetic polypeptide
AEEEIRTTNPVATEQYGSVSVTNQQQTQIGTIND

SEQ ID NO: 68327 - protein, 35 aa, Artificial Sequence
  Description of Artificial Sequence: Synthetic polypeptide
AEEEIRTTNPVATEQYGSVSTVVNLQQENAEAGNE

SEQ ID NO: 68328 - protein, 30 aa, Artificial Sequence
  Description of Artificial Sequence: Synthetic polypeptide
DESEIATTNPVAYEQYGSVATGLTRPFNTE

SEQ ID NO: 68329 - protein, 36 aa, Artificial Sequence
  Description of Artificial Sequence: Synthetic polypeptide
DEEEIKTTNPVATEQYGSTVPSTLNALSQSEGGNQR

SEQ ID NO: 68330 - protein, 34 aa, Artificial Sequence
  Description of Artificial Sequence: Synthetic polypeptide
DEEEIRTTNPVATEQYGSVSTYNEATEGNIVDPN

SEQ ID NO: 68331 - protein, 34 aa, Artificial Sequence
  Description of Artificial Sequence: Synthetic polypeptide
DEAEIRTTNPVATEQYGSVSNLTNHNTGDEDNRM

SEQ ID NO: 68332 - protein, 34 aa, Artificial Sequence
  Description of Artificial Sequence: Synthetic polypeptide
DEEEIKTTNPVSTEAYGQSVSCTNLSPRPGGNNR

SEQ ID NO: 68333 - protein, 30 aa, Artificial Sequence
  Description of Artificial Sequence: Synthetic polypeptide
QEQEIAPTNPVATEQYGSVSTDLQDSEGEL

SEQ ID NO: 68334 - protein, 29 aa, Artificial Sequence
  Description of Artificial Sequence: Synthetic peptide
QEQEIAPTNPCSTEQYGIVSTNLQSEGER

SEQ ID NO: 68335 - protein, 35 aa, Artificial Sequence
  Description of Artificial Sequence: Synthetic polypeptide
AEEEIRTTNPVATEQYGSVSVTNQLQGNLGINTNT

SEQ ID NO: 68336 - protein, 34 aa, Artificial Sequence
  Description of Artificial Sequence: Synthetic polypeptide
DEAEIRTTNPVATEQYGSVSNTNNLLQSFGSDQE

SEQ ID NO: 68337 - protein, 34 aa, Artificial Sequence
  Description of Artificial Sequence: Synthetic polypeptide
QEEEIRTTNPVATEQYGSVSGTNNGQNIGGNGGT

SEQ ID NO: 68338 - protein, 33 aa, Artificial Sequence
  Description of Artificial Sequence: Synthetic polypeptide
DEEEIATTNPVATEQYGSVCAANNLQESDGERN

SEQ ID NO: 68339 - protein, 32 aa, Artificial Sequence
  Description of Artificial Sequence: Synthetic polypeptide
DEEEINTTNPVATAQYGSVSTNSLFTVRVSEF

SEQ ID NO: 68340 - protein, 34 aa, Artificial Sequence
  Description of Artificial Sequence: Synthetic polypeptide
DEEEIATTNPVATEQYGSVCAANNLQEHGENQRE

SEQ ID NO: 68341 - protein, 34 aa, Artificial Sequence
  Description of Artificial Sequence: Synthetic polypeptide
DEEEINTTNPVATEAYGSVSTDNSLFTVRSGNEF

SEQ ID NO: 68342 - protein, 33 aa, Artificial Sequence
  Description of Artificial Sequence: Synthetic polypeptide
DEAEIRTTNPVATEQYGSVSTDLNNGNEDNTFE

SEQ ID NO: 68343 - protein, 32 aa, Artificial Sequence
  Description of Artificial Sequence: Synthetic polypeptide
DEEEINTTNPVATEAYGSVSTNSEFTVRINEF

SEQ ID NO: 68344 - protein, 31 aa, Artificial Sequence
  Description of Artificial Sequence: Synthetic polypeptide
DESEIATTNPVAYEPWGISVSTNLSQSGNMT

SEQ ID NO: 68345 - protein, 35 aa, Artificial Sequence
  Description of Artificial Sequence: Synthetic polypeptide
DEEEIRTTNPVATEQYGSVSTWNINQVDTGDNIQQ

SEQ ID NO: 68346 - protein, 34 aa, Artificial Sequence
  Description of Artificial Sequence: Synthetic polypeptide
DEEEIRTTNPVATEQYGSVEPTTNLQVQTDMNLE

SEQ ID NO: 68347 - protein, 30 aa, Artificial Sequence
  Description of Artificial Sequence: Synthetic polypeptide
QEQEIAPTNPVATEQYGIVSTNLQDSEGEL

SEQ ID NO: 68348 - protein, 29 aa, Artificial Sequence
  Description of Artificial Sequence: Synthetic peptide
QEQEIAPTNPCSTEQYGSVSCNLQDSGTR

SEQ ID NO: 68349 - protein, 32 aa, Artificial Sequence
  Description of Artificial Sequence: Synthetic polypeptide
DEEEINTTNPVATEAYGSVSTNSLFTVRSHEF

SEQ ID NO: 68350 - protein, 31 aa, Artificial Sequence
  Description of Artificial Sequence: Synthetic polypeptide
DESEIATTNPVAYDPHYGSVSTNLQRDNDMK

SEQ ID NO: 68351 - protein, 33 aa, Artificial Sequence
  Description of Artificial Sequence: Synthetic polypeptide
DEEEIATTNPVATEQYGSVCAANNLQEHGEDRQ

SEQ ID NO: 68352 - protein, 34 aa, Artificial Sequence
  Description of Artificial Sequence: Synthetic polypeptide
QEEEIRTTNPVATEQYGSVSGTNNGQQGGGNGGT

SEQ ID NO: 68353 - protein, 33 aa, Artificial Sequence
  Description of Artificial Sequence: Synthetic polypeptide
DEEEIRTTNPVATEQYGSIVSTEDTDDRSDNMN

SEQ ID NO: 68354 - protein, 31 aa, Artificial Sequence
  Description of Artificial Sequence: Synthetic polypeptide
DESEIATTNPVCTEQWGSVSDNLPQDSEGNQ

SEQ ID NO: 68355 - protein, 30 aa, Artificial Sequence
  Description of Artificial Sequence: Synthetic polypeptide
QEQEIAPTNPVSTEQYGIVSTNLQDSEGER

SEQ ID NO: 68356 - protein, 32 aa, Artificial Sequence
  Description of Artificial Sequence: Synthetic polypeptide
DEEEIATTNPVATEQYGSVCAANNLTQDSDNH

SEQ ID NO: 68357 - protein, 33 aa, Artificial Sequence
  Description of Artificial Sequence: Synthetic polypeptide
QEEEIRTTNPVATEQYGSVSGSNNIQDGGNQEA

SEQ ID NO: 68358 - protein, 34 aa, Artificial Sequence
  Description of Artificial Sequence: Synthetic polypeptide
QEEEIRTTNPVATEQYGSVSITDNGQTGGGNNQT

SEQ ID NO: 68359 - protein, 31 aa, Artificial Sequence
  Description of Artificial Sequence: Synthetic polypeptide
DEEEIRTTNPVATEQYGSIVSVEPLDPQEEI

SEQ ID NO: 68360 - protein, 34 aa, Artificial Sequence
  Description of Artificial Sequence: Synthetic polypeptide
DEEEIKTTNVVATEQYGSVSTGNLMRDGVSNPFP

SEQ ID NO: 68361 - protein, 33 aa, Artificial Sequence
  Description of Artificial Sequence: Synthetic polypeptide
DEAEIRTTNPVATEQYGSVSNLTNHNTGDENNE

SEQ ID NO: 68362 - protein, 34 aa, Artificial Sequence
  Description of Artificial Sequence: Synthetic polypeptide
QEEEIRTTNPVATEQYGSVSGTVNLNIGPGNNDD

SEQ ID NO: 68363 - protein, 33 aa, Artificial Sequence
  Description of Artificial Sequence: Synthetic polypeptide
AEEEIRTTNPVATEQYGSVSVTNSSNQNANAND

SEQ ID NO: 68364 - protein, 32 aa, Artificial Sequence
  Description of Artificial Sequence: Synthetic polypeptide
CEEEIRTTNPVATEQYGCVCSNTELQGNSDQD

SEQ ID NO: 68365 - protein, 34 aa, Artificial Sequence
  Description of Artificial Sequence: Synthetic polypeptide
DEAEIRTTNPVATEQYGSVSNLTNHNTGDENQRD

SEQ ID NO: 68366 - protein, 33 aa, Artificial Sequence
  Description of Artificial Sequence: Synthetic polypeptide
AEEEIRTTNPVATEQYGSVSVTNSQQQATNNTE

SEQ ID NO: 68367 - protein, 33 aa, Artificial Sequence
  Description of Artificial Sequence: Synthetic polypeptide
DEEEIKTTNPVATEQYGSVQPCTNDSQMTVGNS

SEQ ID NO: 68368 - protein, 32 aa, Artificial Sequence
  Description of Artificial Sequence: Synthetic polypeptide
DEEEIRTTNPVATEQYGSIYPTNLETEAESRQ

SEQ ID NO: 68369 - protein, 33 aa, Artificial Sequence
  Description of Artificial Sequence: Synthetic polypeptide
DEEEIKTTNPVATEQYGSVQPCQNLSGRTSGNS

SEQ ID NO: 68370 - protein, 33 aa, Artificial Sequence
  Description of Artificial Sequence: Synthetic polypeptide
AEEEIRTTNPVATEQYGSVSVTNSQQEATNNNT

SEQ ID NO: 68371 - protein, 32 aa, Artificial Sequence
  Description of Artificial Sequence: Synthetic polypeptide
AEEEIRTTNPVATEQYGSVSVTNQANDEANEG

SEQ ID NO: 68372 - protein, 28 aa, Artificial Sequence
  Description of Artificial Sequence: Synthetic peptide
QEQEIAPTNPCSSEQYGIVSTNLQSGER

SEQ ID NO: 68373 - protein, 30 aa, Artificial Sequence
  Description of Artificial Sequence: Synthetic polypeptide
DESEIATTNPVCTETYGSVANPNLQDGNTL

SEQ ID NO: 68374 - protein, 33 aa, Artificial Sequence
  Description of Artificial Sequence: Synthetic polypeptide
AEEEIRTTNPVATEQYGSVSVTNSNNTESGVNI

SEQ ID NO: 68375 - protein, 33 aa, Artificial Sequence
  Description of Artificial Sequence: Synthetic polypeptide
DEEEIRTTNPVATEQYGSVSTWMGEVRTFDNQF

SEQ ID NO: 68376 - protein, 33 aa, Artificial Sequence
  Description of Artificial Sequence: Synthetic polypeptide
QEEEIRTTNPVATEQYGSVSGDNGQGEGGNQGD

SEQ ID NO: 68377 - protein, 32 aa, Artificial Sequence
  Description of Artificial Sequence: Synthetic polypeptide
QENEIRTTNPVATEQYGAIVSTFLECRQGQYR

SEQ ID NO: 68378 - protein, 30 aa, Artificial Sequence
  Description of Artificial Sequence: Synthetic polypeptide
DESEIATTNPVCTEQYGVVSCNEPQSEGNG

SEQ ID NO: 68379 - protein, 33 aa, Artificial Sequence
  Description of Artificial Sequence: Synthetic polypeptide
QEEEIRTTNPVATEQYGSVSGNNDQAGEGGGNE

SEQ ID NO: 68380 - protein, 30 aa, Artificial Sequence
  Description of Artificial Sequence: Synthetic polypeptide
QEQEIAPTNPVSTEQYGSVSCNLQDSEGTR

SEQ ID NO: 68381 - protein, 33 aa, Artificial Sequence
  Description of Artificial Sequence: Synthetic polypeptide
DEEEIATTNPVATEQYGSVCAANNLPQEHGNDQ

SEQ ID NO: 68382 - protein, 33 aa, Artificial Sequence
  Description of Artificial Sequence: Synthetic polypeptide
DEEEIRTTNPVATEQYGSVEQNNLQLQIDENVA

SEQ ID NO: 68383 - protein, 33 aa, Artificial Sequence
  Description of Artificial Sequence: Synthetic polypeptide
DECEICTTNPVATEQYGSVSTTNQQQEQQGNDE

SEQ ID NO: 68384 - protein, 30 aa, Artificial Sequence
  Description of Artificial Sequence: Synthetic polypeptide
DESEIATTNPVAYEQYGSVAASLQREAGTP

SEQ ID NO: 68385 - protein, 32 aa, Artificial Sequence
  Description of Artificial Sequence: Synthetic polypeptide
DEAEIRTTNPVATEQYGSVSTLDLHYPGDEDG

SEQ ID NO: 68386 - protein, 34 aa, Artificial Sequence
  Description of Artificial Sequence: Synthetic polypeptide
AEEEIRTTNPVATEQYGSVSVTNQNQQQGNNTEE

SEQ ID NO: 68387 - protein, 35 aa, Artificial Sequence
  Description of Artificial Sequence: Synthetic polypeptide
DEEEIKTTNPVAYEQYGISVASTNELSQERAVGNL

SEQ ID NO: 68388 - protein, 34 aa, Artificial Sequence
  Description of Artificial Sequence: Synthetic polypeptide
AEEEIRTTNPVATEQYGSVSVTTNDQQGNGNNQD

SEQ ID NO: 68389 - protein, 33 aa, Artificial Sequence
  Description of Artificial Sequence: Synthetic polypeptide
DEEEIKTTNPVAYEQYGKVSYTNWSQQTGGNPR

SEQ ID NO: 68390 - protein, 32 aa, Artificial Sequence
  Description of Artificial Sequence: Synthetic polypeptide
QEEEIRTTNPVATEQYGSVSSEAGPNRNGNPV

SEQ ID NO: 68391 - protein, 33 aa, Artificial Sequence
  Description of Artificial Sequence: Synthetic polypeptide
DEAEIRTTNPVATEQYGSVSTLDLDATSGEENQ

SEQ ID NO: 68392 - protein, 33 aa, Artificial Sequence
  Description of Artificial Sequence: Synthetic polypeptide
DEPEIRTTNPVATEQYGSVISTGNTGQGEGGGG

SEQ ID NO: 68393 - protein, 29 aa, Artificial Sequence
  Description of Artificial Sequence: Synthetic peptide
QEEEIRTTNPVATEQYGSVPEVCQMHEEV

SEQ ID NO: 68394 - protein, 29 aa, Artificial Sequence
  Description of Artificial Sequence: Synthetic peptide
QENEIVTTNPVATECYGTVSTDCLQHENL

SEQ ID NO: 68395 - protein, 32 aa, Artificial Sequence
  Description of Artificial Sequence: Synthetic polypeptide
DEAEIRTTNPVATEQYGSVSPTNDHQDNSEDS

SEQ ID NO: 68396 - protein, 30 aa, Artificial Sequence
  Description of Artificial Sequence: Synthetic polypeptide
QENEIRTTNPVATECYGDVSTCLQRNEEPL

SEQ ID NO: 68397 - protein, 33 aa, Artificial Sequence
  Description of Artificial Sequence: Synthetic polypeptide
DECEICTTNPVATEQYGSVSTTNQQQQQQGNLT

SEQ ID NO: 68398 - protein, 33 aa, Artificial Sequence
  Description of Artificial Sequence: Synthetic polypeptide
DEEEIRTTNPVATEQYGSVSTYLGDVRNEVIQF

SEQ ID NO: 68399 - protein, 33 aa, Artificial Sequence
  Description of Artificial Sequence: Synthetic polypeptide
DEPEIRTTNPVATEQYGSVISTGNTGQGEGGQE

SEQ ID NO: 68400 - protein, 35 aa, Artificial Sequence
  Description of Artificial Sequence: Synthetic polypeptide
AEEEIRTTNPVATEQYGSVSTVVNLQVGTTENSED

SEQ ID NO: 68401 - protein, 32 aa, Artificial Sequence
  Description of Artificial Sequence: Synthetic polypeptide
DECEICTTNPVATEQYGSVSTTALEDQEGEDG

SEQ ID NO: 68402 - protein, 33 aa, Artificial Sequence
  Description of Artificial Sequence: Synthetic polypeptide
DEEEIATTNPVATEQYGSVCAANNLQEAGENIF

SEQ ID NO: 68403 - protein, 30 aa, Artificial Sequence
  Description of Artificial Sequence: Synthetic polypeptide
QENEIRTTNPVSTEQYGIVSCDLQQQNGNH

SEQ ID NO: 68404 - protein, 30 aa, Artificial Sequence
  Description of Artificial Sequence: Synthetic polypeptide
QEEEIRTTNPVATEQYGSVPTVCQMHEMEV

SEQ ID NO: 68405 - protein, 34 aa, Artificial Sequence
  Description of Artificial Sequence: Synthetic polypeptide
AEEEIRTTNPVATEQYGSVSVTTNDQQGNGNNQE

SEQ ID NO: 68406 - protein, 33 aa, Artificial Sequence
  Description of Artificial Sequence: Synthetic polypeptide
DEPEIRTTNPVATEQYGSCVSYTGNTHARNNLQ

SEQ ID NO: 68407 - protein, 30 aa, Artificial Sequence
  Description of Artificial Sequence: Synthetic polypeptide
QENEIRTTNPVATECYGDVSENLQDHEENG

SEQ ID NO: 68408 - protein, 32 aa, Artificial Sequence
  Description of Artificial Sequence: Synthetic polypeptide
DEEEIATTNPVATEQYGSVCAANNLQEAGEID

SEQ ID NO: 68409 - protein, 34 aa, Artificial Sequence
  Description of Artificial Sequence: Synthetic polypeptide
DEPEIRTTNPVATEQYGSVSPAGNLEQPGMVNVD

SEQ ID NO: 68410 - protein, 34 aa, Artificial Sequence
  Description of Artificial Sequence: Synthetic polypeptide
AEEEIRTTNPVATEQYGSVSVTTNDQQGNNNDEQ

SEQ ID NO: 68411 - protein, 28 aa, Artificial Sequence
  Description of Artificial Sequence: Synthetic peptide
QENEIRTTNPIATECYGSVSECLMHENL

SEQ ID NO: 68412 - protein, 28 aa, Artificial Sequence
  Description of Artificial Sequence: Synthetic peptide
QEQEIATTNPVATEQYGEVSEDLQHEEK

SEQ ID NO: 68413 - protein, 33 aa, Artificial Sequence
  Description of Artificial Sequence: Synthetic polypeptide
QEEEIRTTNPVATEQYGSVSSTCAGNMRNGNPV

SEQ ID NO: 68414 - protein, 32 aa, Artificial Sequence
  Description of Artificial Sequence: Synthetic polypeptide
DEEEIATTNPVATEQYGSVCAANNLQDSDDNN

SEQ ID NO: 68415 - protein, 29 aa, Artificial Sequence
  Description of Artificial Sequence: Synthetic peptide
DESEIATTNPVGTEGYGVMSASTLQHGNI

SEQ ID NO: 68416 - protein, 30 aa, Artificial Sequence
  Description of Artificial Sequence: Synthetic polypeptide
DESEIATTNPVAYEQYGSVAASLQRENNTE

SEQ ID NO: 68417 - protein, 33 aa, Artificial Sequence
  Description of Artificial Sequence: Synthetic polypeptide
AEEEIRTTNPVATEQYGSVSVTNNQLQVTEQGE

SEQ ID NO: 68418 - protein, 29 aa, Artificial Sequence
  Description of Artificial Sequence: Synthetic peptide
DESEIATTNPVGTEGYGVMSASTLNRGNI

SEQ ID NO: 68419 - protein, 33 aa, Artificial Sequence
  Description of Artificial Sequence: Synthetic polypeptide
DEEEIKTTNPVAYEHYGSVSTGNLSQQIGGNTP

SEQ ID NO: 68420 - protein, 33 aa, Artificial Sequence
  Description of Artificial Sequence: Synthetic polypeptide
DEEEIRTTNPVATEQYGSVSTVYLNHHSGIEFD

SEQ ID NO: 68421 - protein, 31 aa, Artificial Sequence
  Description of Artificial Sequence: Synthetic polypeptide
QENEIRTTNPVATECWGSVSEINLQDREGEL

SEQ ID NO: 68422 - protein, 33 aa, Artificial Sequence
  Description of Artificial Sequence: Synthetic polypeptide
DEAEIRTTNPVATEQYGSVSTLDLTPNGDEDQR

SEQ ID NO: 68423 - protein, 32 aa, Artificial Sequence
  Description of Artificial Sequence: Synthetic polypeptide
DEAEIRTTNPVATEQYGSVSFDLNNGNENNFI

SEQ ID NO: 68424 - protein, 32 aa, Artificial Sequence
  Description of Artificial Sequence: Synthetic polypeptide
DEAEIRTTNPVATEQYGSVSTLDLTPGDEDGF

SEQ ID NO: 68425 - protein, 28 aa, Artificial Sequence
  Description of Artificial Sequence: Synthetic peptide
QENEIRTTNPVATECYGDVSECIQHGEL

SEQ ID NO: 68426 - protein, 31 aa, Artificial Sequence
  Description of Artificial Sequence: Synthetic polypeptide
DEAEIRTTNPVATEQYGSVSFLDQLGGGEEQ

SEQ ID NO: 68427 - protein, 33 aa, Artificial Sequence
  Description of Artificial Sequence: Synthetic polypeptide
DEEEIKTTNPVAYEHYGSVSTGNLSQQRVTNQP

SEQ ID NO: 68428 - protein, 32 aa, Artificial Sequence
  Description of Artificial Sequence: Synthetic polypeptide
DEEEIATTNPVATEQYGSVCAANNLQEAEENV

SEQ ID NO: 68429 - protein, 34 aa, Artificial Sequence
  Description of Artificial Sequence: Synthetic polypeptide
AEEEIRTTNPVATEQYGSVSVTTNDQQGNGTNDQ

SEQ ID NO: 68430 - protein, 28 aa, Artificial Sequence
  Description of Artificial Sequence: Synthetic peptide
QEQEIATTNPVATEQYGDVSEDLQHEEL

SEQ ID NO: 68431 - protein, 32 aa, Artificial Sequence
  Description of Artificial Sequence: Synthetic polypeptide
DEAEIRTTNPVATEQYGSVSSQINEFRINMID

SEQ ID NO: 68432 - protein, 30 aa, Artificial Sequence
  Description of Artificial Sequence: Synthetic polypeptide
QENEIRTTNPVATECYGSVSEICEPQHGNG

SEQ ID NO: 68433 - protein, 35 aa, Artificial Sequence
  Description of Artificial Sequence: Synthetic polypeptide
DEEEIRTTNPVATEQYGSVETNLMDQDRIGSEDEI

SEQ ID NO: 68434 - protein, 32 aa, Artificial Sequence
  Description of Artificial Sequence: Synthetic polypeptide
QEEEIRTTNPVATEQYGSVSTEPAGNMRNENV

SEQ ID NO: 68435 - protein, 35 aa, Artificial Sequence
  Description of Artificial Sequence: Synthetic polypeptide
AEEEIRTTNPVATEQYGSVSVTSNLQQGNNGTNVN

SEQ ID NO: 68436 - protein, 32 aa, Artificial Sequence
  Description of Artificial Sequence: Synthetic polypeptide
DEEEIATTNPVATEQYGSVCAANNLQEAPEGN

SEQ ID NO: 68437 - protein, 33 aa, Artificial Sequence
  Description of Artificial Sequence: Synthetic polypeptide
AEEEIRTTNPVATEQYGSVSVTNNQQEATNNDT

SEQ ID NO: 68438 - protein, 35 aa, Artificial Sequence
  Description of Artificial Sequence: Synthetic polypeptide
AEEEIRTTNPVATEQYGSVSTVVNLQQQEGEEGNT

SEQ ID NO: 68439 - protein, 28 aa, Artificial Sequence
  Description of Artificial Sequence: Synthetic peptide
QEQEIATTNPVATECYGSVSTCLEHEEL

SEQ ID NO: 68440 - protein, 32 aa, Artificial Sequence
  Description of Artificial Sequence: Synthetic polypeptide
DESEIATTNPVAYEQWGSVSTNLQGQDMGNEE

SEQ ID NO: 68441 - protein, 31 aa, Artificial Sequence
  Description of Artificial Sequence: Synthetic polypeptide
QEEEIRTTNPVATEQYGSVSPTVCQMHEMEV

SEQ ID NO: 68442 - protein, 32 aa, Artificial Sequence
  Description of Artificial Sequence: Synthetic polypeptide
DESEIATTNPVAYEQYGSVAITENLTDGNDRL

SEQ ID NO: 68443 - protein, 32 aa, Artificial Sequence
  Description of Artificial Sequence: Synthetic polypeptide
DEEEIRTTNPVATEQYGSIYTNEMQNIVNNIE

SEQ ID NO: 68444 - protein, 33 aa, Artificial Sequence
  Description of Artificial Sequence: Synthetic polypeptide
QEEEIRTTNPVATEQYGSVSTGNADNGTGGNDG

SEQ ID NO: 68445 - protein, 33 aa, Artificial Sequence
  Description of Artificial Sequence: Synthetic polypeptide
QEEEIRTTNPVATEQYGSVSTGNGDDEGGEENI

SEQ ID NO: 68446 - protein, 32 aa, Artificial Sequence
  Description of Artificial Sequence: Synthetic polypeptide
DEPEIRTTNPVATEQYGSVSMVPLARNVEERN

SEQ ID NO: 68447 - protein, 33 aa, Artificial Sequence
  Description of Artificial Sequence: Synthetic polypeptide
DEEEIRTTNPVATEQYGSIYSTWPDSMRATNRN

SEQ ID NO: 68448 - protein, 34 aa, Artificial Sequence
  Description of Artificial Sequence: Synthetic polypeptide
DEPEIRTTNPVATEQYGSVSMPTQLQIRPIVNDN

SEQ ID NO: 68449 - protein, 33 aa, Artificial Sequence
  Description of Artificial Sequence: Synthetic polypeptide
DEEEIRTTNPVATEQYGSMSTPAGPNMRNGMNV

SEQ ID NO: 68450 - protein, 33 aa, Artificial Sequence
  Description of Artificial Sequence: Synthetic polypeptide
QEEEIRTTNPVATEQYGSVSTGNGDDEGGEENT

SEQ ID NO: 68451 - protein, 33 aa, Artificial Sequence
  Description of Artificial Sequence: Synthetic polypeptide
QEEEIRTTNPVATEQYGSVSCLSTPQRNGTQRF

SEQ ID NO: 68452 - protein, 33 aa, Artificial Sequence
  Description of Artificial Sequence: Synthetic polypeptide
AEEEIRTTNPVATEQYGSVSVTNQQQTQGTIST

SEQ ID NO: 68453 - protein, 31 aa, Artificial Sequence
  Description of Artificial Sequence: Synthetic polypeptide
DESEIATTNPVAYEQWGSVATNLQSGGENEE

SEQ ID NO: 68454 - protein, 32 aa, Artificial Sequence
  Description of Artificial Sequence: Synthetic polypeptide
DEAEIRTTNPVATEQYGSVSLTNHNTGDEVGG

SEQ ID NO: 68455 - protein, 31 aa, Artificial Sequence
  Description of Artificial Sequence: Synthetic polypeptide
QENEIRTTNPVATECYGSVSEINLQREEEEL

SEQ ID NO: 68456 - protein, 33 aa, Artificial Sequence
  Description of Artificial Sequence: Synthetic polypeptide
AEEEIRTTNPVATEQYGSVSVTNQQQTQGTIGN

SEQ ID NO: 68457 - protein, 32 aa, Artificial Sequence
  Description of Artificial Sequence: Synthetic polypeptide
DEPEIRTTNPVATEQYGSVITTNNGQGEGGQG

SEQ ID NO: 68458 - protein, 34 aa, Artificial Sequence
  Description of Artificial Sequence: Synthetic polypeptide
AEEEIRTTNPVATEQYGSVSVTNNQNQQQGNTES

SEQ ID NO: 68459 - protein, 33 aa, Artificial Sequence
  Description of Artificial Sequence: Synthetic polypeptide
DECEICTTNPVATEQYGSVSTTNQQQQEQQGNL

SEQ ID NO: 68460 - protein, 34 aa, Artificial Sequence
  Description of Artificial Sequence: Synthetic polypeptide
DEEEIATTNPVATEQYGSVCAANNLQEAGENMRN

SEQ ID NO: 68461 - protein, 32 aa, Artificial Sequence
  Description of Artificial Sequence: Synthetic polypeptide
CEEEIRTTNPVATEQYGCVCSTEEQHFGSNQS

SEQ ID NO: 68462 - protein, 32 aa, Artificial Sequence
  Description of Artificial Sequence: Synthetic polypeptide
DEPEIRTTNPVATEQYGETTSETNQQRGDGDI

SEQ ID NO: 68463 - protein, 35 aa, Artificial Sequence
  Description of Artificial Sequence: Synthetic polypeptide
DEEEIRTTNPVATEQYGSVSTWNLTETDGGLNFEG

SEQ ID NO: 68464 - protein, 32 aa, Artificial Sequence
  Description of Artificial Sequence: Synthetic polypeptide
DEEEIRTTNPVATEQYGSMATPAGPNMRNGNV

SEQ ID NO: 68465 - protein, 30 aa, Artificial Sequence
  Description of Artificial Sequence: Synthetic polypeptide
DESEIATTNPVGTEGWGSVACNLQREGENI

SEQ ID NO: 68466 - protein, 36 aa, Artificial Sequence
  Description of Artificial Sequence: Synthetic polypeptide
DEEEINTTNPVATEQYGISVVPSCTNELQRTGGNMQ

SEQ ID NO: 68467 - protein, 33 aa, Artificial Sequence
  Description of Artificial Sequence: Synthetic polypeptide
DEEEIATTNPVATEQYGSVCAANNLQEAGENVH

SEQ ID NO: 68468 - protein, 33 aa, Artificial Sequence
  Description of Artificial Sequence: Synthetic polypeptide
DEEEIATTNPVATEQYGSVCAANNLQEAGETRH

SEQ ID NO: 68469 - protein, 32 aa, Artificial Sequence
  Description of Artificial Sequence: Synthetic polypeptide
DEPEIRTTNPVATEQYGSVSMMPMAQNVNERI

SEQ ID NO: 68470 - protein, 33 aa, Artificial Sequence
  Description of Artificial Sequence: Synthetic polypeptide
DEEEIATTNPVATEQYGSVCAANNLQEAGTARA

SEQ ID NO: 68471 - protein, 33 aa, Artificial Sequence
  Description of Artificial Sequence: Synthetic polypeptide
DEEEIRTTNPVATEQYGSVSTWDMTQESTQNTA

SEQ ID NO: 68472 - protein, 34 aa, Artificial Sequence
  Description of Artificial Sequence: Synthetic polypeptide
QEEEIRTTNPVATEQYGSVSAGMGNNLQGGDENQ

SEQ ID NO: 68473 - protein, 35 aa, Artificial Sequence
  Description of Artificial Sequence: Synthetic polypeptide
DEAEIRTTNPVATEQYGSVSGTSNVAQMRPGIERA

SEQ ID NO: 68474 - protein, 34 aa, Artificial Sequence
  Description of Artificial Sequence: Synthetic polypeptide
DEPEIRTTNPVATEQYGSVSNTNDMQTHPGNNQE

SEQ ID NO: 68475 - protein, 31 aa, Artificial Sequence
  Description of Artificial Sequence: Synthetic polypeptide
DEEEIRTTNPVATEQYGSMATPAGPQHNGDV

SEQ ID NO: 68476 - protein, 32 aa, Artificial Sequence
  Description of Artificial Sequence: Synthetic polypeptide
DEAEIRTTNPVATEQYGSVSSQNLTFINMIDS

SEQ ID NO: 68477 - protein, 32 aa, Artificial Sequence
  Description of Artificial Sequence: Synthetic polypeptide
DEEEIATTNPVATEQYGSVCAANNLQEAIDAR

SEQ ID NO: 68478 - protein, 31 aa, Artificial Sequence
  Description of Artificial Sequence: Synthetic polypeptide
DEAEIRTTNPVATEQYGSVSSQPLTERNMDD

SEQ ID NO: 68479 - protein, 33 aa, Artificial Sequence
  Description of Artificial Sequence: Synthetic polypeptide
DEEEIKTTNPVATEQYGKSTTCSTNPQRQNDND

SEQ ID NO: 68480 - protein, 33 aa, Artificial Sequence
  Description of Artificial Sequence: Synthetic polypeptide
DECEICTTNPVATEQYGSVSTTNQQQEQQGNQF

SEQ ID NO: 68481 - protein, 31 aa, Artificial Sequence
  Description of Artificial Sequence: Synthetic polypeptide
DEEEIRTTNPVATEQYGSITTQDLNTGEGQE

SEQ ID NO: 68482 - protein, 34 aa, Artificial Sequence
  Description of Artificial Sequence: Synthetic polypeptide
DEEEIKTTNPVAYEAYGSVSTMNMLSQQRGGNQP

SEQ ID NO: 68483 - protein, 33 aa, Artificial Sequence
  Description of Artificial Sequence: Synthetic polypeptide
DEEEIATTNPVATEQYGSVATNGTDRPGPNDQV

SEQ ID NO: 68484 - protein, 33 aa, Artificial Sequence
  Description of Artificial Sequence: Synthetic polypeptide
DEEEIRTTNPVATEQYGSVETPLSLEQQGMLMQ

SEQ ID NO: 68485 - protein, 34 aa, Artificial Sequence
  Description of Artificial Sequence: Synthetic polypeptide
DEEEIRTTNPVATEQYGSVSTNLELSQVPFQVPA

SEQ ID NO: 68486 - protein, 34 aa, Artificial Sequence
  Description of Artificial Sequence: Synthetic polypeptide
DEEEIRTTNPVATEQYGSVSTNLELSQVPFFVVQ

SEQ ID NO: 68487 - protein, 34 aa, Artificial Sequence
  Description of Artificial Sequence: Synthetic polypeptide
DEEEIRTTNPVATEQYGSVGSGNDGQEGGNNQGE

SEQ ID NO: 68488 - protein, 30 aa, Artificial Sequence
  Description of Artificial Sequence: Synthetic polypeptide
DENEIRTTNPVATEQYGTVSEIIQQANENA

SEQ ID NO: 68489 - protein, 33 aa, Artificial Sequence
  Description of Artificial Sequence: Synthetic polypeptide
DEEEIRTTNPVATEQYGSVGSGNIQQEQENEEQ

SEQ ID NO: 68490 - protein, 34 aa, Artificial Sequence
  Description of Artificial Sequence: Synthetic polypeptide
AEEEIRTTNPVATEQYGSVSVTVTNGQQGNNNQD

SEQ ID NO: 68491 - protein, 33 aa, Artificial Sequence
  Description of Artificial Sequence: Synthetic polypeptide
DEEEIRTTNPVATEQYGSVGSGNNDNGGGNGQT

SEQ ID NO: 68492 - protein, 36 aa, Artificial Sequence
  Description of Artificial Sequence: Synthetic polypeptide
DEEEIRTTNPVATEQYGSVGSGTMNLGQEGGGGNEI

SEQ ID NO: 68493 - protein, 35 aa, Artificial Sequence
  Description of Artificial Sequence: Synthetic polypeptide
DEEEIRTTNPVATEQYGSVGSGTNDLGEDGGNEEI

SEQ ID NO: 68494 - protein, 32 aa, Artificial Sequence
  Description of Artificial Sequence: Synthetic polypeptide
DEEEIRTTNPVATEQYGSVGSGMGGQNNMGEG

SEQ ID NO: 68495 - protein, 30 aa, Artificial Sequence
  Description of Artificial Sequence: Synthetic polypeptide
DENEIRTTNPVATEQYGTVSEIEMQAAENA

SEQ ID NO: 68496 - protein, 33 aa, Artificial Sequence
  Description of Artificial Sequence: Synthetic polypeptide
DEEEIRTTNPVATEQYGSCWTFVLQNRGGDQHI

SEQ ID NO: 68497 - protein, 35 aa, Artificial Sequence
  Description of Artificial Sequence: Synthetic polypeptide
AEEEIRTTNPVATEQYGSVSVTVTNLQGGNLQNGE

SEQ ID NO: 68498 - protein, 33 aa, Artificial Sequence
  Description of Artificial Sequence: Synthetic polypeptide
DESEIRTTNPVATEAWGSVSVTNNLQGDEGENG

SEQ ID NO: 68499 - protein, 34 aa, Artificial Sequence
  Description of Artificial Sequence: Synthetic polypeptide
DEEEIRTTNPVATEQYGSVGSNDNLIGEDGGNGG

SEQ ID NO: 68500 - protein, 33 aa, Artificial Sequence
  Description of Artificial Sequence: Synthetic polypeptide
DEEEIRTTNPVATEQYGSVGSNGNGQGENENEI

SEQ ID NO: 68501 - protein, 28 aa, Artificial Sequence
  Description of Artificial Sequence: Synthetic peptide
QESEIATTNPVATEGYGSVATTLEHGDL

SEQ ID NO: 68502 - protein, 33 aa, Artificial Sequence
  Description of Artificial Sequence: Synthetic polypeptide
DEEEIRTTNPVATEQYGSVSVTTGLEGRTVQVT

SEQ ID NO: 68503 - protein, 33 aa, Artificial Sequence
  Description of Artificial Sequence: Synthetic polypeptide
DEEEIRTTNPVATEQYGSVGSNLNIFNGGNEGT

SEQ ID NO: 68504 - protein, 28 aa, Artificial Sequence
  Description of Artificial Sequence: Synthetic peptide
QESEIATTNPVATEGYGVVATTLQHGDL

SEQ ID NO: 68505 - protein, 34 aa, Artificial Sequence
  Description of Artificial Sequence: Synthetic polypeptide
AEEEIRTTNPVATEQYGSVSVTVTNLEAGNEEQM

SEQ ID NO: 68506 - protein, 28 aa, Artificial Sequence
  Description of Artificial Sequence: Synthetic peptide
QESEIATTNPVATEGYGVVSSDLQHGEI

SEQ ID NO: 68507 - protein, 32 aa, Artificial Sequence
  Description of Artificial Sequence: Synthetic polypeptide
QEEEIRCTNPAATEQYGSVSIENMLMREGNAT

SEQ ID NO: 68508 - protein, 33 aa, Artificial Sequence
  Description of Artificial Sequence: Synthetic polypeptide
DEEEIRTTNPVATEQYGSVGSGMGGQNNGDNGD

SEQ ID NO: 68509 - protein, 33 aa, Artificial Sequence
  Description of Artificial Sequence: Synthetic polypeptide
DEEEIRTTNPVATEQYGSVGSDDNGQDEQENEG

SEQ ID NO: 68510 - protein, 32 aa, Artificial Sequence
  Description of Artificial Sequence: Synthetic polypeptide
DEEEIRTTNPVATEQYGSCYTSILELQSGQET

SEQ ID NO: 68511 - protein, 33 aa, Artificial Sequence
  Description of Artificial Sequence: Synthetic polypeptide
DEEEIRATNPVATEQYGSVCAANNLQEHGEERN

SEQ ID NO: 68512 - protein, 33 aa, Artificial Sequence
  Description of Artificial Sequence: Synthetic polypeptide
DESEIRTTNPVATDSYGSVSTDNGLGQRTINGE

SEQ ID NO: 68513 - protein, 33 aa, Artificial Sequence
  Description of Artificial Sequence: Synthetic polypeptide
DEEEIRTTNPVATEQYGSVGSDNALYSGPTIQE

SEQ ID NO: 68514 - protein, 33 aa, Artificial Sequence
  Description of Artificial Sequence: Synthetic polypeptide
DEEEIRTTNPVATEQYGSVGSDNNTQGEGGGGQ

SEQ ID NO: 68515 - protein, 32 aa, Artificial Sequence
  Description of Artificial Sequence: Synthetic polypeptide
DEEEIRATNPVATEQYGSVCAANNLQESDGDS

SEQ ID NO: 68516 - protein, 33 aa, Artificial Sequence
  Description of Artificial Sequence: Synthetic polypeptide
DEEEIATTNPVATEQYGSVAGTNPQNNGENNQD

SEQ ID NO: 68517 - protein, 33 aa, Artificial Sequence
  Description of Artificial Sequence: Synthetic polypeptide
DEEEIRATNPVATEQYGSVCAANNLQESDGNDN

SEQ ID NO: 68518 - protein, 33 aa, Artificial Sequence
  Description of Artificial Sequence: Synthetic polypeptide
DECEICTVNPVATEQYGSVSTVNLQGQEEGNNE

SEQ ID NO: 68519 - protein, 33 aa, Artificial Sequence
  Description of Artificial Sequence: Synthetic polypeptide
DENEIRTTNPVATEQYGTVSTMPAIQNQQNGNV

SEQ ID NO: 68520 - protein, 30 aa, Artificial Sequence
  Description of Artificial Sequence: Synthetic polypeptide
QESEIATTNPVATECYGSVSENEPQHEGNL

SEQ ID NO: 68521 - protein, 32 aa, Artificial Sequence
  Description of Artificial Sequence: Synthetic polypeptide
DESEIRTTNPVATDSYGSVSTNGLQLDTNEMD

SEQ ID NO: 68522 - protein, 30 aa, Artificial Sequence
  Description of Artificial Sequence: Synthetic polypeptide
QESEIATTNPVATECYGSVSENLPQHEGEL

SEQ ID NO: 68523 - protein, 34 aa, Artificial Sequence
  Description of Artificial Sequence: Synthetic polypeptide
AEEEIRTTNPVATEQYGSVSTVVNDQQGVEEINT

SEQ ID NO: 68524 - protein, 32 aa, Artificial Sequence
  Description of Artificial Sequence: Synthetic polypeptide
DESEIRTTNPVATDSYGSVSTNGQRETGGGDE

SEQ ID NO: 68525 - protein, 31 aa, Artificial Sequence
  Description of Artificial Sequence: Synthetic polypeptide
CEDEIATTNPVAYEQYGSVATNLQRNPEGMG

SEQ ID NO: 68526 - protein, 31 aa, Artificial Sequence
  Description of Artificial Sequence: Synthetic polypeptide
CEDEIATTNPVAYEQYGSVATNLQDDGGTNH

SEQ ID NO: 68527 - protein, 32 aa, Artificial Sequence
  Description of Artificial Sequence: Synthetic polypeptide
DENEIRTTNPVATEQYGTVSMEAIQNQQNGNV

SEQ ID NO: 68528 - protein, 33 aa, Artificial Sequence
  Description of Artificial Sequence: Synthetic polypeptide
DESEIRTTNPVATDSYGSVSTNNGLQRMTNEMN

SEQ ID NO: 68529 - protein, 33 aa, Artificial Sequence
  Description of Artificial Sequence: Synthetic polypeptide
DENEIRTTNPVATEQYGTVSTMEAIQNQQNGNV

SEQ ID NO: 68530 - protein, 33 aa, Artificial Sequence
  Description of Artificial Sequence: Synthetic polypeptide
DEEEIRTTNPVATEQYGSVGSNMNGFNGGNEGQ

SEQ ID NO: 68531 - protein, 34 aa, Artificial Sequence
  Description of Artificial Sequence: Synthetic polypeptide
DEEEIRTTNPVATEQYGSVGSNMNLDINGGGNED

SEQ ID NO: 68532 - protein, 34 aa, Artificial Sequence
  Description of Artificial Sequence: Synthetic polypeptide
DEEEIRTTNPVATEQYGSVGSNMNLFNGGGNEDE

SEQ ID NO: 68533 - protein, 35 aa, Artificial Sequence
  Description of Artificial Sequence: Synthetic polypeptide
DEEEIRTTNPVATEQYGSVSVTVNLEEEDQTENST

SEQ ID NO: 68534 - protein, 34 aa, Artificial Sequence
  Description of Artificial Sequence: Synthetic polypeptide
DENEIRTTNPVATEQYGSVYSTTMNNNQIGNNFQ

SEQ ID NO: 68535 - protein, 34 aa, Artificial Sequence
  Description of Artificial Sequence: Synthetic polypeptide
DENEIRTTNPVATEQYGSVYSTTMNNNQIGEERQ

SEQ ID NO: 68536 - protein, 32 aa, Artificial Sequence
  Description of Artificial Sequence: Synthetic polypeptide
DECEIRTTNPVATECYGSVSTGNDDTQGGQQE

SEQ ID NO: 68537 - protein, 34 aa, Artificial Sequence
  Description of Artificial Sequence: Synthetic polypeptide
DECEIRTTNPVATECYGSVSTQGNEQGNPGGNNR

SEQ ID NO: 68538 - protein, 29 aa, Artificial Sequence
  Description of Artificial Sequence: Synthetic peptide
QESEIATTNPVATEQYGVVSTDLEHGDDI

SEQ ID NO: 68539 - protein, 34 aa, Artificial Sequence
  Description of Artificial Sequence: Synthetic polypeptide
DEEEIRTTNPVATEQYGSCVGDFLNNNQFTQGNR

SEQ ID NO: 68540 - protein, 29 aa, Artificial Sequence
  Description of Artificial Sequence: Synthetic peptide
QESEIATTNPVATEQYGVVSTDLEHGEDI

SEQ ID NO: 68541 - protein, 33 aa, Artificial Sequence
  Description of Artificial Sequence: Synthetic polypeptide
DEEEIRATNPVATEQYGSVCATNDEADDNGNNR

SEQ ID NO: 68542 - protein, 31 aa, Artificial Sequence
  Description of Artificial Sequence: Synthetic polypeptide
DENEIRTTNPVATEQYGSVYVPDLDERSGET

SEQ ID NO: 68543 - protein, 32 aa, Artificial Sequence
  Description of Artificial Sequence: Synthetic polypeptide
DENEIRTTNPVATEQYGSVYPAEDLTRGDERI

SEQ ID NO: 68544 - protein, 35 aa, Artificial Sequence
  Description of Artificial Sequence: Synthetic polypeptide
DEEEIRTTNPVATEQYGSVGSNTMNLFNSGNNEGD

SEQ ID NO: 68545 - protein, 33 aa, Artificial Sequence
  Description of Artificial Sequence: Synthetic polypeptide
DEEEIATTNPVATEQYGSVAATANLQDNDNNTV

SEQ ID NO: 68546 - protein, 32 aa, Artificial Sequence
  Description of Artificial Sequence: Synthetic polypeptide
DEEEIATTNPVATEQYGSVAATANLDSNNNGE

SEQ ID NO: 68547 - protein, 33 aa, Artificial Sequence
  Description of Artificial Sequence: Synthetic polypeptide
DEEEIRTTNPVATEQYGSCVDSHCNWDRLMDNI

SEQ ID NO: 68548 - protein, 32 aa, Artificial Sequence
  Description of Artificial Sequence: Synthetic polypeptide
DEEEIATTNPVATEQYGSVAATANDNNAGENN

SEQ ID NO: 68549 - protein, 31 aa, Artificial Sequence
  Description of Artificial Sequence: Synthetic polypeptide
DEEEIRTTNPVATEQYGSCVDGVLEGLSDRN

SEQ ID NO: 68550 - protein, 34 aa, Artificial Sequence
  Description of Artificial Sequence: Synthetic polypeptide
DEEEIRTTNPVATEQYGSCVCSENLENRGDVQVQ

SEQ ID NO: 68551 - protein, 32 aa, Artificial Sequence
  Description of Artificial Sequence: Synthetic polypeptide
DENEIRTTNPVATEQYGSVYANMGQESGQESR

SEQ ID NO: 68552 - protein, 33 aa, Artificial Sequence
  Description of Artificial Sequence: Synthetic polypeptide
DEEEIATTNPVATEQYGSVAANPGQDSGDNNRM

SEQ ID NO: 68553 - protein, 31 aa, Artificial Sequence
  Description of Artificial Sequence: Synthetic polypeptide
QESEIATTNPVAYHHYGSVSTNELSQRVGNM

SEQ ID NO: 68554 - protein, 33 aa, Artificial Sequence
  Description of Artificial Sequence: Synthetic polypeptide
DECEIRTTNPVATECYGAVSTGNGQERDGDNEN

SEQ ID NO: 68555 - protein, 34 aa, Artificial Sequence
  Description of Artificial Sequence: Synthetic polypeptide
DEEEIRTTNPVATEQYGSVSVTVELTQETLEDRQ

SEQ ID NO: 68556 - protein, 33 aa, Artificial Sequence
  Description of Artificial Sequence: Synthetic polypeptide
DEEEIRTTNPVATEQYGSVGSNTMGFGGGNEDI

SEQ ID NO: 68557 - protein, 35 aa, Artificial Sequence
  Description of Artificial Sequence: Synthetic polypeptide
AEEEIRTTNPVATEQYGSVSVTVVNLQQGVEGNNL

SEQ ID NO: 68558 - protein, 33 aa, Artificial Sequence
  Description of Artificial Sequence: Synthetic polypeptide
DEEEIATTNPVATEQYGSVAATPNPDQNQGGNQ

SEQ ID NO: 68559 - protein, 35 aa, Artificial Sequence
  Description of Artificial Sequence: Synthetic polypeptide
DEEEIRTTNPVATEQYGSVGSNMNLFQNGGGNEET

SEQ ID NO: 68560 - protein, 34 aa, Artificial Sequence
  Description of Artificial Sequence: Synthetic polypeptide
DEEEIRTTNPVATEQYGSVGSNMNLNIAEGGNIG

SEQ ID NO: 68561 - protein, 34 aa, Artificial Sequence
  Description of Artificial Sequence: Synthetic polypeptide
AEEEIRTTNPVATEQYGSVSVTVVNLQQSEENNL

SEQ ID NO: 68562 - protein, 33 aa, Artificial Sequence
  Description of Artificial Sequence: Synthetic polypeptide
DEEEIRTTNPVATEQYGSVSVTTLAIRIMDVDQ

SEQ ID NO: 68563 - protein, 33 aa, Artificial Sequence
  Description of Artificial Sequence: Synthetic polypeptide
DEEEIRTTNPVATEQYGSVGSNNMQQEQENGEG

SEQ ID NO: 68564 - protein, 34 aa, Artificial Sequence
  Description of Artificial Sequence: Synthetic polypeptide
DEEEIRTTNPVATEQYGSVGSNNQNLGFNGGNEQ

SEQ ID NO: 68565 - protein, 33 aa, Artificial Sequence
  Description of Artificial Sequence: Synthetic polypeptide
DEEEIATTNPVATEQYGSVAATNPLTNNGENNE

SEQ ID NO: 68566 - protein, 34 aa, Artificial Sequence
  Description of Artificial Sequence: Synthetic polypeptide
DEEEIRTTNPVATEQYGSVGSNQNLQQDEQENEG

SEQ ID NO: 68567 - protein, 34 aa, Artificial Sequence
  Description of Artificial Sequence: Synthetic polypeptide
DEEEIATTNPVATEQYGSVAATNLQTAPGGEPRN

SEQ ID NO: 68568 - protein, 28 aa, Artificial Sequence
  Description of Artificial Sequence: Synthetic peptide
QESEIATTNPVATEGYGVVSSTLQHGEI

SEQ ID NO: 68569 - protein, 32 aa, Artificial Sequence
  Description of Artificial Sequence: Synthetic polypeptide
DEEEIATTNPVATEQYGSVAATNETDNGPQNP

SEQ ID NO: 68570 - protein, 35 aa, Artificial Sequence
  Description of Artificial Sequence: Synthetic polypeptide
DEEEIRTTNPVATEQYGSVGSNTDNGQTFEGENED

SEQ ID NO: 68571 - protein, 34 aa, Artificial Sequence
  Description of Artificial Sequence: Synthetic polypeptide
DEEEIRTTNPVATEQYGSVGSNTDNMDNGIGGND

SEQ ID NO: 68572 - protein, 32 aa, Artificial Sequence
  Description of Artificial Sequence: Synthetic polypeptide
DEAEIRTTNPVATEQYGSSPSWNDMQEGNEDP

SEQ ID NO: 68573 - protein, 33 aa, Artificial Sequence
  Description of Artificial Sequence: Synthetic polypeptide
DEEEIRTTNPVATEQYGSVSVTTMLGTGVETES

SEQ ID NO: 68574 - protein, 35 aa, Artificial Sequence
  Description of Artificial Sequence: Synthetic polypeptide
DEEEIRTTNPVATEQYGSVSVTTNLNEEWNGSNQE

SEQ ID NO: 68575 - protein, 30 aa, Artificial Sequence
  Description of Artificial Sequence: Synthetic polypeptide
DENEIRTTNPVATEQYGTISMDIQQQNGNH

SEQ ID NO: 68576 - protein, 33 aa, Artificial Sequence
  Description of Artificial Sequence: Synthetic polypeptide
DEEEIRTTNPVATEQYGSCVSTIALNESTQNDE

SEQ ID NO: 68577 - protein, 32 aa, Artificial Sequence
  Description of Artificial Sequence: Synthetic polypeptide
DEEEIATTNPVATEQYGSVAATGNLPESDENQ

SEQ ID NO: 68578 - protein, 32 aa, Artificial Sequence
  Description of Artificial Sequence: Synthetic polypeptide
AEEEIRTTNPVATEQYGSVSVTVNSNTESNNT

SEQ ID NO: 68579 - protein, 34 aa, Artificial Sequence
  Description of Artificial Sequence: Synthetic polypeptide
DENEIRTTNPVATEQYGSVWSVLPNLQHRDTFDR

SEQ ID NO: 68580 - protein, 32 aa, Artificial Sequence
  Description of Artificial Sequence: Synthetic polypeptide
DESEIRTTNPVATDSYGSVISTNGQQGTGNGD

SEQ ID NO: 68581 - protein, 31 aa, Artificial Sequence
  Description of Artificial Sequence: Synthetic polypeptide
DESEIRTTNPVATDQYGSVSETELVGSNFNY

SEQ ID NO: 68582 - protein, 32 aa, Artificial Sequence
  Description of Artificial Sequence: Synthetic polypeptide
DEEEIRTTNPVATEQYGSFSNNYQPQGLHLQQ

SEQ ID NO: 68583 - protein, 33 aa, Artificial Sequence
  Description of Artificial Sequence: Synthetic polypeptide
AEEEIRTTNPVATEQYGSVSVTVNLNSNANNQT

SEQ ID NO: 68584 - protein, 32 aa, Artificial Sequence
  Description of Artificial Sequence: Synthetic polypeptide
DEAEIRTTNPVATEQYGSVASAYNVRDRGGPT

SEQ ID NO: 68585 - protein, 31 aa, Artificial Sequence
  Description of Artificial Sequence: Synthetic polypeptide
DEEEIATTNPVATEQYGSVAMNLNEAPAENN

SEQ ID NO: 68586 - protein, 32 aa, Artificial Sequence
  Description of Artificial Sequence: Synthetic polypeptide
DECEICTVNPVATEQYGSVSTTALQQQGNQDE

SEQ ID NO: 68587 - protein, 34 aa, Artificial Sequence
  Description of Artificial Sequence: Synthetic polypeptide
DEEEIRTTNPVATEQYGSVGPTFNGQEGMIQNDN

SEQ ID NO: 68588 - protein, 32 aa, Artificial Sequence
  Description of Artificial Sequence: Synthetic polypeptide
DEEEIATTNPVATEQYGSVAMNLNEAGENGEE

SEQ ID NO: 68589 - protein, 32 aa, Artificial Sequence
  Description of Artificial Sequence: Synthetic polypeptide
DEEEIRTTNPVATEQYGSFSGTMYSGDRGDSF

SEQ ID NO: 68590 - protein, 33 aa, Artificial Sequence
  Description of Artificial Sequence: Synthetic polypeptide
DEEEIRTTNPVATEQYGSVGPTGEVRMGLNPED

SEQ ID NO: 68591 - protein, 31 aa, Artificial Sequence
  Description of Artificial Sequence: Synthetic polypeptide
DEAEIRTTNPVATEQYGSVCAVTGDLEGENE

SEQ ID NO: 68592 - protein, 32 aa, Artificial Sequence
  Description of Artificial Sequence: Synthetic polypeptide
DEEEIRTTNPVATEQYGSVGPTMWEQSGVMLF

SEQ ID NO: 68593 - protein, 35 aa, Artificial Sequence
  Description of Artificial Sequence: Synthetic polypeptide
DEAEIRTTNPVATEQYGSTSMTENNLSQRIGDNQE

SEQ ID NO: 68594 - protein, 32 aa, Artificial Sequence
  Description of Artificial Sequence: Synthetic polypeptide
DEEEIATTNPVATEQYGSVAMNGLDTNPGENH

SEQ ID NO: 68595 - protein, 30 aa, Artificial Sequence
  Description of Artificial Sequence: Synthetic polypeptide
DESEIRTTNPVATCHYGCVSTNLQYFTSEA

SEQ ID NO: 68596 - protein, 31 aa, Artificial Sequence
  Description of Artificial Sequence: Synthetic polypeptide
DESEIRTTNPVATCHYGSVCSTNLQFFTSDQ

SEQ ID NO: 68597 - protein, 32 aa, Artificial Sequence
  Description of Artificial Sequence: Synthetic polypeptide
DEEEIATTNPVATEQYGSVAMNDQDQGGDNQN

SEQ ID NO: 68598 - protein, 34 aa, Artificial Sequence
  Description of Artificial Sequence: Synthetic polypeptide
DEEEIRTTNPVATEQYGSVSVTNLPNNVGVDPDP

SEQ ID NO: 68599 - protein, 30 aa, Artificial Sequence
  Description of Artificial Sequence: Synthetic polypeptide
DEEEIATTNPVATEQYGSVAMNDAEAQNTE

SEQ ID NO: 68600 - protein, 31 aa, Artificial Sequence
  Description of Artificial Sequence: Synthetic polypeptide
DENEIRTTNPVCTEGYGSCSMPNLNQEGGNL

SEQ ID NO: 68601 - protein, 32 aa, Artificial Sequence
  Description of Artificial Sequence: Synthetic polypeptide
DENEIRTTNPVAYERYGKVQSVQNLQSGGPNR

SEQ ID NO: 68602 - protein, 28 aa, Artificial Sequence
  Description of Artificial Sequence: Synthetic peptide
QESEIASTNPVSTEQYGIVSCNLQHGTI

SEQ ID NO: 68603 - protein, 35 aa, Artificial Sequence
  Description of Artificial Sequence: Synthetic polypeptide
AEEEIRTTNPVATEQYGSVSVTVNLQSGSETGNTV

SEQ ID NO: 68604 - protein, 32 aa, Artificial Sequence
  Description of Artificial Sequence: Synthetic polypeptide
DEAEIRTTNPVATEQYGSVCETPNLPEGEEAQ

SEQ ID NO: 68605 - protein, 34 aa, Artificial Sequence
  Description of Artificial Sequence: Synthetic polypeptide
AEEEIRTTNPVATEQYGSVSVTVNLNQQVETNNL

SEQ ID NO: 68606 - protein, 32 aa, Artificial Sequence
  Description of Artificial Sequence: Synthetic polypeptide
QEEEIRPTNPVATEQYGIVSSTNLPNSGMNPV

SEQ ID NO: 68607 - protein, 32 aa, Artificial Sequence
  Description of Artificial Sequence: Synthetic polypeptide
DEAEIRTTNPVATEQYGSVCRWDTLQRLENSW

SEQ ID NO: 68608 - protein, 31 aa, Artificial Sequence
  Description of Artificial Sequence: Synthetic polypeptide
DECEICTVNPVATEQYGSVSTALQQQENQEN

SEQ ID NO: 68609 - protein, 31 aa, Artificial Sequence
  Description of Artificial Sequence: Synthetic polypeptide
DEEEIRTTNPVATEQYGSFVCTPQDANNQQI

SEQ ID NO: 68610 - protein, 34 aa, Artificial Sequence
  Description of Artificial Sequence: Synthetic polypeptide
AEEEIRTTNPVATEQYGSVSVTVNDQQGNGTDET

SEQ ID NO: 68611 - protein, 32 aa, Artificial Sequence
  Description of Artificial Sequence: Synthetic polypeptide
DEEEIATTNPVATEQYGSVANNLEDDGGNEEQ

SEQ ID NO: 68612 - protein, 34 aa, Artificial Sequence
  Description of Artificial Sequence: Synthetic polypeptide
AEEEIRTTNPVATEQYGSVSVTVNLEQGVTTNNE

SEQ ID NO: 68613 - protein, 32 aa, Artificial Sequence
  Description of Artificial Sequence: Synthetic polypeptide
DEEEIATTNPVATEQYGSVAMNLTQDNGDTEM

SEQ ID NO: 68614 - protein, 32 aa, Artificial Sequence
  Description of Artificial Sequence: Synthetic polypeptide
DEEEIATTNPVATEQYGSVAMNLQTENPTVPL

SEQ ID NO: 68615 - protein, 33 aa, Artificial Sequence
  Description of Artificial Sequence: Synthetic polypeptide
DEEEIATTNPVATEQYGSVAMNLQEAEGGNEEN

SEQ ID NO: 68616 - protein, 31 aa, Artificial Sequence
  Description of Artificial Sequence: Synthetic polypeptide
DENEIRTTNPVSTEPYGSISMEDIQQQRGNR

SEQ ID NO: 68617 - protein, 31 aa, Artificial Sequence
  Description of Artificial Sequence: Synthetic polypeptide
DENEIRTTNPVSTEPYGNVAMETIQQRNGNR

SEQ ID NO: 68618 - protein, 33 aa, Artificial Sequence
  Description of Artificial Sequence: Synthetic polypeptide
DEEEIRTTNPVATEQYGSVGPEMWLQEREAQNS

SEQ ID NO: 68619 - protein, 32 aa, Artificial Sequence
  Description of Artificial Sequence: Synthetic polypeptide
DEEEIATTNPVATEQYGSVAMNLQEAPAENNT

SEQ ID NO: 68620 - protein, 34 aa, Artificial Sequence
  Description of Artificial Sequence: Synthetic polypeptide
DEEEIRTTNPVATEQYGSVSVTNGLLAQQEEEEM

SEQ ID NO: 68621 - protein, 30 aa, Artificial Sequence
  Description of Artificial Sequence: Synthetic polypeptide
DENEIRTTNPVSTEPYGIVSCDLQQQNGNH

SEQ ID NO: 68622 - protein, 32 aa, Artificial Sequence
  Description of Artificial Sequence: Synthetic polypeptide
DEEEIATTNPVATEQYGSVAMNLQEANENGTE

SEQ ID NO: 68623 - protein, 28 aa, Artificial Sequence
  Description of Artificial Sequence: Synthetic peptide
DENEIRTTNPVSTEPYGEISMDIQQGNH

SEQ ID NO: 68624 - protein, 34 aa, Artificial Sequence
  Description of Artificial Sequence: Synthetic polypeptide
DEEEIRTTNPVATEQYGSVSVTNIHHDNRLSERI

SEQ ID NO: 68625 - protein, 35 aa, Artificial Sequence
  Description of Artificial Sequence: Synthetic polypeptide
DEEEIRTTNPVATEQYGSVSVTNILHEDRLEPERG

SEQ ID NO: 68626 - protein, 34 aa, Artificial Sequence
  Description of Artificial Sequence: Synthetic polypeptide
AEEEIRTTNPVATEQYGSVSVTVNLNENNGNNQQ

SEQ ID NO: 68627 - protein, 33 aa, Artificial Sequence
  Description of Artificial Sequence: Synthetic polypeptide
DENEIRTTNPVAYEQYGSISCTNTSQRSGGMNM

SEQ ID NO: 68628 - protein, 33 aa, Artificial Sequence
  Description of Artificial Sequence: Synthetic polypeptide
DENEIRTTNPVAYEQYGKTVSTNELSQLGGGRK

SEQ ID NO: 68629 - protein, 28 aa, Artificial Sequence
  Description of Artificial Sequence: Synthetic peptide
QESEIASVNPVGTEQYGVVSSNLQSGNI

SEQ ID NO: 68630 - protein, 35 aa, Artificial Sequence
  Description of Artificial Sequence: Synthetic polypeptide
AEEEIRTTNPVATEQYGSVSVTVNNLEQGTEGTNG

SEQ ID NO: 68631 - protein, 32 aa, Artificial Sequence
  Description of Artificial Sequence: Synthetic polypeptide
DECEICTVNPVATEQYGSVSTTNLNEEGNDTT

SEQ ID NO: 68632 - protein, 30 aa, Artificial Sequence
  Description of Artificial Sequence: Synthetic polypeptide
CEDEIRTTNPVATEQYGMTSTNGQGGGGDE

SEQ ID NO: 68633 - protein, 31 aa, Artificial Sequence
  Description of Artificial Sequence: Synthetic polypeptide
DESEIRTTNPVATCHYGSVSTNLQHFTSDQS

SEQ ID NO: 68634 - protein, 32 aa, Artificial Sequence
  Description of Artificial Sequence: Synthetic polypeptide
DECEICTVNPVATEQYGSVSTTNNLEEGNQTT

SEQ ID NO: 68635 - protein, 31 aa, Artificial Sequence
  Description of Artificial Sequence: Synthetic polypeptide
DESEIRTTNPVATDAYGSVADTNGQGTGNGD

SEQ ID NO: 68636 - protein, 33 aa, Artificial Sequence
  Description of Artificial Sequence: Synthetic polypeptide
DECEICTVNPVATEQYGSVSTTNNLQFEEGNDD

SEQ ID NO: 68637 - protein, 35 aa, Artificial Sequence
  Description of Artificial Sequence: Synthetic polypeptide
AEEEIRTTNPVATEQYGSVSVTVNNLQSNEQGNNE

SEQ ID NO: 68638 - protein, 32 aa, Artificial Sequence
  Description of Artificial Sequence: Synthetic polypeptide
DEEEIRATNPVATEQYGSVCAANLQDSGSDEN

SEQ ID NO: 68639 - protein, 32 aa, Artificial Sequence
  Description of Artificial Sequence: Synthetic polypeptide
DECEICTVNPVATEQYGSVSTTNLEEQGTNTT

SEQ ID NO: 68640 - protein, 34 aa, Artificial Sequence
  Description of Artificial Sequence: Synthetic polypeptide
DEEEIRTTNPVATEQYGSVGQPTNLQPELGAPTD

SEQ ID NO: 68641 - protein, 31 aa, Artificial Sequence
  Description of Artificial Sequence: Synthetic polypeptide
DESEIRTTNPVATDAYGSVNSINGQGTGNGD

SEQ ID NO: 68642 - protein, 33 aa, Artificial Sequence
  Description of Artificial Sequence: Synthetic polypeptide
DEEEIRTTNPVATEQYGSVSVTPNEQLTLVFQE

SEQ ID NO: 68643 - protein, 31 aa, Artificial Sequence
  Description of Artificial Sequence: Synthetic polypeptide
DESEIRTTNPVATDQYGDVSTNGGEEGEGND

SEQ ID NO: 68644 - protein, 31 aa, Artificial Sequence
  Description of Artificial Sequence: Synthetic polypeptide
DENEIRTTNPVATEQYGVVSSVLLQFPENGD

SEQ ID NO: 68645 - protein, 34 aa, Artificial Sequence
  Description of Artificial Sequence: Synthetic polypeptide
AEEEIRTTNPVATEQYGSVSVTVNNQQQQGNTED

SEQ ID NO: 68646 - protein, 32 aa, Artificial Sequence
  Description of Artificial Sequence: Synthetic polypeptide
DENEIRTTNPVATEQYGVVSSVLLQDRPENDT

SEQ ID NO: 68647 - protein, 30 aa, Artificial Sequence
  Description of Artificial Sequence: Synthetic polypeptide
DENEIRTTNPVATEQYGVVSSVLLLFPENI

SEQ ID NO: 68648 - protein, 28 aa, Artificial Sequence
  Description of Artificial Sequence: Synthetic peptide
QEEEIRCTNPIATEQYGSAPENCQHEER

SEQ ID NO: 68649 - protein, 31 aa, Artificial Sequence
  Description of Artificial Sequence: Synthetic polypeptide
DENEIRTTNPVATEQYGVVSSVELLRPENDI

SEQ ID NO: 68650 - protein, 35 aa, Artificial Sequence
  Description of Artificial Sequence: Synthetic polypeptide
AEEEIRTTNPVATEQYGSVSVTVNNLQTGNGTTTE

SEQ ID NO: 68651 - protein, 30 aa, Artificial Sequence
  Description of Artificial Sequence: Synthetic polypeptide
DENEIRTTNPVATEQYGVVSSVLLQTPEVD

SEQ ID NO: 68652 - protein, 33 aa, Artificial Sequence
  Description of Artificial Sequence: Synthetic polypeptide
DENEIRTTNPVATEQYGVVSTEVLDHRGEMNQS

SEQ ID NO: 68653 - protein, 32 aa, Artificial Sequence
  Description of Artificial Sequence: Synthetic polypeptide
DECEICTVNPVATEQYGSVSTTNLEEEGNNTD

SEQ ID NO: 68654 - protein, 33 aa, Artificial Sequence
  Description of Artificial Sequence: Synthetic polypeptide
DENEIRTTNPVAYEQYGISVSINQSQGAGGNYR

SEQ ID NO: 68655 - protein, 34 aa, Artificial Sequence
  Description of Artificial Sequence: Synthetic polypeptide
DEEEIRTTNPVATEQYGSVSVTNLQNSPELSEVT

SEQ ID NO: 68656 - protein, 32 aa, Artificial Sequence
  Description of Artificial Sequence: Synthetic polypeptide
DENEIRTTNPVAYEAYGSVSCNGNLSQRGTTQ

SEQ ID NO: 68657 - protein, 28 aa, Artificial Sequence
  Description of Artificial Sequence: Synthetic peptide
QESEIATTNPVATECWGSVSCNEQREEL

SEQ ID NO: 68658 - protein, 34 aa, Artificial Sequence
  Description of Artificial Sequence: Synthetic polypeptide
DEEEIRTTNPVATEQYGSVGPTPNENQRQNVEVM

SEQ ID NO: 68659 - protein, 32 aa, Artificial Sequence
  Description of Artificial Sequence: Synthetic polypeptide
DENEIRTTNPVAYEAWGSVSNLNLSQRGGGNQ

SEQ ID NO: 68660 - protein, 34 aa, Artificial Sequence
  Description of Artificial Sequence: Synthetic polypeptide
DEEEIRTTNPVATEQYGSVGPTTNEQMQMGNIIQ

SEQ ID NO: 68661 - protein, 32 aa, Artificial Sequence
  Description of Artificial Sequence: Synthetic polypeptide
DENEIRTTNPVAVEQYGSCSITNLEVELLNPR

SEQ ID NO: 68662 - protein, 31 aa, Artificial Sequence
  Description of Artificial Sequence: Synthetic polypeptide
DENEIRTTNPVATWSYGSVSTNLEEHRTVPN

SEQ ID NO: 68663 - protein, 34 aa, Artificial Sequence
  Description of Artificial Sequence: Synthetic polypeptide
DEEEIRATNPVATEQYGSVCAADNNLQDSDGNDR

SEQ ID NO: 68664 - protein, 31 aa, Artificial Sequence
  Description of Artificial Sequence: Synthetic polypeptide
DENEIRTTNPVATWHYGSVSTNLEEHRQTED

SEQ ID NO: 68665 - protein, 30 aa, Artificial Sequence
  Description of Artificial Sequence: Synthetic polypeptide
DENEIRTTNPVATWHYGSVCTNQEQVRTED

SEQ ID NO: 68666 - protein, 31 aa, Artificial Sequence
  Description of Artificial Sequence: Synthetic polypeptide
DENEIRTTNPVATETYGSVSINNAQEVGTPI

SEQ ID NO: 68667 - protein, 35 aa, Artificial Sequence
  Description of Artificial Sequence: Synthetic polypeptide
DEEEIRTTNPVATEQYGSVSVTNPLMDDRNENVEE

SEQ ID NO: 68668 - protein, 33 aa, Artificial Sequence
  Description of Artificial Sequence: Synthetic polypeptide
DEEEIRTTNPVATEQYGSVSVTNQIHENEPEYH

SEQ ID NO: 68669 - protein, 34 aa, Artificial Sequence
  Description of Artificial Sequence: Synthetic polypeptide
DEEEIRTTNPVATEQYGSVGPTTNLARQNVNLVM

SEQ ID NO: 68670 - protein, 31 aa, Artificial Sequence
  Description of Artificial Sequence: Synthetic polypeptide
DENEIRTTNPVATEQYGVVWPTNNQSEGTDF

SEQ ID NO: 68671 - protein, 34 aa, Artificial Sequence
  Description of Artificial Sequence: Synthetic polypeptide
AEEEIRTTNPVATEQYGSVSVTVNNGNQNGNNND

SEQ ID NO: 68672 - protein, 33 aa, Artificial Sequence
  Description of Artificial Sequence: Synthetic polypeptide
DEEEIRTTNPVATEQYGSVSVTPADNMRELNEM

SEQ ID NO: 68673 - protein, 33 aa, Artificial Sequence
  Description of Artificial Sequence: Synthetic polypeptide
CEEEIRTTNPVATEQYGQCVCSTNHQNGSNNQS

SEQ ID NO: 68674 - protein, 32 aa, Artificial Sequence
  Description of Artificial Sequence: Synthetic polypeptide
DEEEIRTTNPVATEQYGSVSVTPLDLETDEVV

SEQ ID NO: 68675 - protein, 34 aa, Artificial Sequence
  Description of Artificial Sequence: Synthetic polypeptide
DEEEIATTNPVATEQYGSVAGTPNPLDNQGGNDQ

SEQ ID NO: 68676 - protein, 34 aa, Artificial Sequence
  Description of Artificial Sequence: Synthetic polypeptide
DENEIRTTNPVATEQYGSVWSTLNHQDGGNEDIQ

SEQ ID NO: 68677 - protein, 33 aa, Artificial Sequence
  Description of Artificial Sequence: Synthetic polypeptide
DENEIRTTNPVATEQYGSVVSTNLAEINESDQS

SEQ ID NO: 68678 - protein, 33 aa, Artificial Sequence
  Description of Artificial Sequence: Synthetic polypeptide
DENEIRTTNPVATEQYGSVVSDTDTLQRESQQD

SEQ ID NO: 68679 - protein, 28 aa, Artificial Sequence
  Description of Artificial Sequence: Synthetic peptide
QESEIRSTNPVGTEQYGVMASNLQRGDI

SEQ ID NO: 68680 - protein, 34 aa, Artificial Sequence
  Description of Artificial Sequence: Synthetic polypeptide
DEEEIRTTNPVATEQYGSVGSTNNQTQTEGGGQQ

SEQ ID NO: 68681 - protein, 34 aa, Artificial Sequence
  Description of Artificial Sequence: Synthetic polypeptide
DEEEIRTTNPVATEQYGSVGSTNNTQGTEGGGQD

SEQ ID NO: 68682 - protein, 28 aa, Artificial Sequence
  Description of Artificial Sequence: Synthetic peptide
DEEEIATTNPVATEQYGSAPEVCQHEEK

SEQ ID NO: 68683 - protein, 34 aa, Artificial Sequence
  Description of Artificial Sequence: Synthetic polypeptide
AEEEIRTTNPVATEQYGSVTTTNLQQNQENGNTT

SEQ ID NO: 68684 - protein, 34 aa, Artificial Sequence
  Description of Artificial Sequence: Synthetic polypeptide
DEEEIRATNPVATEQYGVVSTTNNLLQGGGNEFG

SEQ ID NO: 68685 - protein, 34 aa, Artificial Sequence
  Description of Artificial Sequence: Synthetic polypeptide
DEEEIRATNPVATEQYGVVSTTNNLLQGGNNQQD

SEQ ID NO: 68686 - protein, 32 aa, Artificial Sequence
  Description of Artificial Sequence: Synthetic polypeptide
DENEIRTTNPVATEQYGSVSTNMEQVESEDQN

SEQ ID NO: 68687 - protein, 29 aa, Artificial Sequence
  Description of Artificial Sequence: Synthetic peptide
DEEEIATTNPVATEQYGSAPEDCQHEGEK

SEQ ID NO: 68688 - protein, 32 aa, Artificial Sequence
  Description of Artificial Sequence: Synthetic polypeptide
DECTICTTNPVATEQWGSVSTNDTLQQGSNTM

SEQ ID NO: 68689 - protein, 31 aa, Artificial Sequence
  Description of Artificial Sequence: Synthetic polypeptide
DEEEIATTNPVATEQYGSAPATVLQHEGEDK

SEQ ID NO: 68690 - protein, 32 aa, Artificial Sequence
  Description of Artificial Sequence: Synthetic polypeptide
DENEIRTTNPVATEQYGSVSTNMEQEFSEDKN

SEQ ID NO: 68691 - protein, 30 aa, Artificial Sequence
  Description of Artificial Sequence: Synthetic polypeptide
DEEEIATTNPVATEQYGSAPAEVLQHEGEL

SEQ ID NO: 68692 - protein, 29 aa, Artificial Sequence
  Description of Artificial Sequence: Synthetic peptide
DEEEIATTNPVATEQYGSAPAEVCQHGEL

SEQ ID NO: 68693 - protein, 33 aa, Artificial Sequence
  Description of Artificial Sequence: Synthetic polypeptide
AEEEIRTTNPVATEQYGSVTTTNNLQNQENNTT

SEQ ID NO: 68694 - protein, 31 aa, Artificial Sequence
  Description of Artificial Sequence: Synthetic polypeptide
DESEIRTTNPVATECWGNVSCINIQDREGNG

SEQ ID NO: 68695 - protein, 33 aa, Artificial Sequence
  Description of Artificial Sequence: Synthetic polypeptide
CEEEIRTTNPVATEQYGSVSTMVANDRSGQSRA

SEQ ID NO: 68696 - protein, 31 aa, Artificial Sequence
  Description of Artificial Sequence: Synthetic polypeptide
DESEIRTTNPVATECWGNVSCINIQSREGNG

SEQ ID NO: 68697 - protein, 33 aa, Artificial Sequence
  Description of Artificial Sequence: Synthetic polypeptide
DEEEIRTTNPVATEQYGSVGSTVELTDDQGEEQ

SEQ ID NO: 68698 - protein, 28 aa, Artificial Sequence
  Description of Artificial Sequence: Synthetic peptide
QESEIRSTNPVGTEQYGVMASTLQRGDI

SEQ ID NO: 68699 - protein, 34 aa, Artificial Sequence
  Description of Artificial Sequence: Synthetic polypeptide
DEEEIRATNPVATEQYGVVSTTNNLLQQGGNQFG

SEQ ID NO: 68700 - protein, 32 aa, Artificial Sequence
  Description of Artificial Sequence: Synthetic polypeptide
DESEIRTTNPVATECWGSASCINEPQDREGNR

SEQ ID NO: 68701 - protein, 34 aa, Artificial Sequence
  Description of Artificial Sequence: Synthetic polypeptide
CEEEIRTTNPVATEQYGSVSSTGDLGQRNQNEQG

SEQ ID NO: 68702 - protein, 34 aa, Artificial Sequence
  Description of Artificial Sequence: Synthetic polypeptide
CEEEIRTTNPVATEQYGSVSSTGDLGQRNANEGD

SEQ ID NO: 68703 - protein, 31 aa, Artificial Sequence
  Description of Artificial Sequence: Synthetic polypeptide
DEEEIATTNPVATEQYGSCAAGNNLDMDNER

SEQ ID NO: 68704 - protein, 35 aa, Artificial Sequence
  Description of Artificial Sequence: Synthetic polypeptide
AEEEIRTTNPVATEQYGSVSVVTTNLQSGNNQNGI

SEQ ID NO: 68705 - protein, 33 aa, Artificial Sequence
  Description of Artificial Sequence: Synthetic polypeptide
DECEISTTNPVATEQYGSVSWTEQHQQERMGNS

SEQ ID NO: 68706 - protein, 32 aa, Artificial Sequence
  Description of Artificial Sequence: Synthetic polypeptide
DEEEIRTTNPVATEQYGSVSWLGSDEQRQVIV

SEQ ID NO: 68707 - protein, 32 aa, Artificial Sequence
  Description of Artificial Sequence: Synthetic polypeptide
DENEIRTTNPVATEQYGSVSTTIGNMRAGDPA

SEQ ID NO: 68708 - protein, 31 aa, Artificial Sequence
  Description of Artificial Sequence: Synthetic polypeptide
DECEIYTTNPVATEQYGTVDSGTNLKYSGET

SEQ ID NO: 68709 - protein, 31 aa, Artificial Sequence
  Description of Artificial Sequence: Synthetic polypeptide
AEEEIRTTNPVATEQYGSVTNNNLLENVNGI

SEQ ID NO: 68710 - protein, 34 aa, Artificial Sequence
  Description of Artificial Sequence: Synthetic polypeptide
DEEEIRTTNPVATEQYGSVSWLYLTNLESTQNDD

SEQ ID NO: 68711 - protein, 32 aa, Artificial Sequence
  Description of Artificial Sequence: Synthetic polypeptide
DENEIRTTNPVATEQYGSVSTTDMLENGGGEV

SEQ ID NO: 68712 - protein, 30 aa, Artificial Sequence
  Description of Artificial Sequence: Synthetic polypeptide
DEEEIATTNPVATEQYGSAPTDLEDHEGEK

SEQ ID NO: 68713 - protein, 33 aa, Artificial Sequence
  Description of Artificial Sequence: Synthetic polypeptide
DENEIRTTNPVATEQYGSVSTPGDLQEGGDDQF

SEQ ID NO: 68714 - protein, 34 aa, Artificial Sequence
  Description of Artificial Sequence: Synthetic polypeptide
DEEEIRATNPVATEQYGTVVSNTNLQSDVGGNGE

SEQ ID NO: 68715 - protein, 30 aa, Artificial Sequence
  Description of Artificial Sequence: Synthetic polypeptide
DEEEIATTNPVATEQYGSASTDCEHEGEDK

SEQ ID NO: 68716 - protein, 28 aa, Artificial Sequence
  Description of Artificial Sequence: Synthetic peptide
QESEIRSTNPVGTEGYGVVASTLQRGDI

SEQ ID NO: 68717 - protein, 34 aa, Artificial Sequence
  Description of Artificial Sequence: Synthetic polypeptide
CEEEIRTTNPVATEQYGSVSPTNLEQRTFDEQDL

SEQ ID NO: 68718 - protein, 30 aa, Artificial Sequence
  Description of Artificial Sequence: Synthetic polypeptide
DEEEIATTNPVATEQYGSASEDCQHEGEDK

SEQ ID NO: 68719 - protein, 32 aa, Artificial Sequence
  Description of Artificial Sequence: Synthetic polypeptide
DEEEIATTNPVATEQYGSASATDLQDHEGEDL

SEQ ID NO: 68720 - protein, 31 aa, Artificial Sequence
  Description of Artificial Sequence: Synthetic polypeptide
DEEEIATTNPVATEQYGSASATDLEHEGEDL

SEQ ID NO: 68721 - protein, 34 aa, Artificial Sequence
  Description of Artificial Sequence: Synthetic polypeptide
DENEIRTTNPVATEQYGSVSTNNGMQNEGIDDRN

SEQ ID NO: 68722 - protein, 33 aa, Artificial Sequence
  Description of Artificial Sequence: Synthetic polypeptide
DENEIRTTNPVATEQYGSVSTNNDTQESGQIDG

SEQ ID NO: 68723 - protein, 33 aa, Artificial Sequence
  Description of Artificial Sequence: Synthetic polypeptide
DENEIRTTNPVATEQYGSVSTNYMVEFGGNNVE

SEQ ID NO: 68724 - protein, 34 aa, Artificial Sequence
  Description of Artificial Sequence: Synthetic polypeptide
DEEEIRATNPVATEQYGVVSTTNNQLQQQGTGNF

SEQ ID NO: 68725 - protein, 35 aa, Artificial Sequence
  Description of Artificial Sequence: Synthetic polypeptide
DEEEIRTTNPVATEQYGSVGSTVNGFGQENIGNEG

SEQ ID NO: 68726 - protein, 30 aa, Artificial Sequence
  Description of Artificial Sequence: Synthetic polypeptide
QESEIRTTNPCSTECWGIVSCNLQDRGENR

SEQ ID NO: 68727 - protein, 34 aa, Artificial Sequence
  Description of Artificial Sequence: Synthetic polypeptide
DEEEIRTTNPVATEQYGSVGSVTNGMGQSEQNQN

SEQ ID NO: 68728 - protein, 35 aa, Artificial Sequence
  Description of Artificial Sequence: Synthetic polypeptide
DEEEIRTTNPVATEQYGSVSTNGMEDQEGGGNENT

SEQ ID NO: 68729 - protein, 31 aa, Artificial Sequence
  Description of Artificial Sequence: Synthetic polypeptide
QEEEICTTNPTAYEQYGSVATNLQHRDGDGA

SEQ ID NO: 68730 - protein, 30 aa, Artificial Sequence
  Description of Artificial Sequence: Synthetic polypeptide
DECTICTTNPVATEQYGVVTTNPQQGGNND

SEQ ID NO: 68731 - protein, 32 aa, Artificial Sequence
  Description of Artificial Sequence: Synthetic polypeptide
QEEEICTTNPTATEQYGSVATNLQHAAGNGAL

SEQ ID NO: 68732 - protein, 28 aa, Artificial Sequence
  Description of Artificial Sequence: Synthetic peptide
QEEEIATVNPVCTEQYGVVSECLQHENQ

SEQ ID NO: 68733 - protein, 28 aa, Artificial Sequence
  Description of Artificial Sequence: Synthetic peptide
QEEEIATVNPVCTEQYGVVSECLQHENL

SEQ ID NO: 68734 - protein, 34 aa, Artificial Sequence
  Description of Artificial Sequence: Synthetic polypeptide
DEEEIRTTNPVATEQYGSVSTNGLLVQPQEIEEG

SEQ ID NO: 68735 - protein, 31 aa, Artificial Sequence
  Description of Artificial Sequence: Synthetic polypeptide
DEDAEIATTNPVATEQWGSVATNLQQNNDLH

SEQ ID NO: 68736 - protein, 30 aa, Artificial Sequence
  Description of Artificial Sequence: Synthetic polypeptide
QESEIRTTNPVATECWGSVSCCEPQREGNL

SEQ ID NO: 68737 - protein, 28 aa, Artificial Sequence
  Description of Artificial Sequence: Synthetic peptide
QEEEIATVNPVCTECYGVVSDCLQHGNQ

SEQ ID NO: 68738 - protein, 32 aa, Artificial Sequence
  Description of Artificial Sequence: Synthetic polypeptide
AEEEIRTTNPVATEQYGSVVNTNDDGGVNNTT

SEQ ID NO: 68739 - protein, 32 aa, Artificial Sequence
  Description of Artificial Sequence: Synthetic polypeptide
DENEIRTTNPVATEQYGSVSTMDEQEEGQDDN

SEQ ID NO: 68740 - protein, 32 aa, Artificial Sequence
  Description of Artificial Sequence: Synthetic polypeptide
AEEEIRTTNPVATEQYGSVVNTNDETGVNNQT

SEQ ID NO: 68741 - protein, 31 aa, Artificial Sequence
  Description of Artificial Sequence: Synthetic polypeptide
AEEEIRTTNPVATEQYGSVVNTNDNTNNDNT

SEQ ID NO: 68742 - protein, 33 aa, Artificial Sequence
  Description of Artificial Sequence: Synthetic polypeptide
AEEEIRTTNPVATEQYGSVVNTNDQSGVNNQTE

SEQ ID NO: 68743 - protein, 31 aa, Artificial Sequence
  Description of Artificial Sequence: Synthetic polypeptide
AEEEIRTTNPVATEQYGSVVNTNDSGVNNET

SEQ ID NO: 68744 - protein, 34 aa, Artificial Sequence
  Description of Artificial Sequence: Synthetic polypeptide
DENEIRTTNPVATEQYGSVSTLPNLQHRDTFDGE

SEQ ID NO: 68745 - protein, 32 aa, Artificial Sequence
  Description of Artificial Sequence: Synthetic polypeptide
AEEEIRTTNPVATEQYGSVVNTNDTQGVNNTT

SEQ ID NO: 68746 - protein, 32 aa, Artificial Sequence
  Description of Artificial Sequence: Synthetic polypeptide
AEEEIRTTNPVATEQYGSVVNTNNDTGVNNAT

SEQ ID NO: 68747 - protein, 33 aa, Artificial Sequence
  Description of Artificial Sequence: Synthetic polypeptide
AEEEIRTTNPVATEQYGSVVESQNLQREDFQPC

SEQ ID NO: 68748 - protein, 35 aa, Artificial Sequence
  Description of Artificial Sequence: Synthetic polypeptide
DEEEIRTTNPVATEQYGSVGSVTNGMGQSEQGNIP

SEQ ID NO: 68749 - protein, 33 aa, Artificial Sequence
  Description of Artificial Sequence: Synthetic polypeptide
DEEEIRTTNPVATEQYGSVSTNGPMADGSDQGM

SEQ ID NO: 68750 - protein, 35 aa, Artificial Sequence
  Description of Artificial Sequence: Synthetic polypeptide
DEEEIRTTNPVATEQYGSVGSVTNGMGQGGEQNDF

SEQ ID NO: 68751 - protein, 35 aa, Artificial Sequence
  Description of Artificial Sequence: Synthetic polypeptide
DEEEIRTTNPVATEQYGSVGSTVNGMGQNQEGGNG

SEQ ID NO: 68752 - protein, 33 aa, Artificial Sequence
  Description of Artificial Sequence: Synthetic polypeptide
AEEEIRTTNPVATEQYGSVTTVTNLQQNQENNQ

SEQ ID NO: 68753 - protein, 31 aa, Artificial Sequence
  Description of Artificial Sequence: Synthetic polypeptide
DECTICTTNPVATEQYGCVSTTNPQTGGNDE

SEQ ID NO: 68754 - protein, 33 aa, Artificial Sequence
  Description of Artificial Sequence: Synthetic polypeptide
DEEEIRTTNPVATEQYGSVSTNGTDVTDFSNQT

SEQ ID NO: 68755 - protein, 29 aa, Artificial Sequence
  Description of Artificial Sequence: Synthetic peptide
QESEIRTTNPVASEQWGIVSCNEQDSGNG

SEQ ID NO: 68756 - protein, 31 aa, Artificial Sequence
  Description of Artificial Sequence: Synthetic polypeptide
DECTICTTNPVATEQYGSVTVTNLEIIGTNL

SEQ ID NO: 68757 - protein, 31 aa, Artificial Sequence
  Description of Artificial Sequence: Synthetic polypeptide
DECTICTTNPVATEQYGSVTVTNNLINIGNL

SEQ ID NO: 68758 - protein, 31 aa, Artificial Sequence
  Description of Artificial Sequence: Synthetic polypeptide
DECTICTTNPVATEQYGSVTVTTNLNIGNLD

SEQ ID NO: 68759 - protein, 34 aa, Artificial Sequence
  Description of Artificial Sequence: Synthetic polypeptide
DEEEIRATNPVATEQYGVVSTTNQLLQQGNGTNF

SEQ ID NO: 68760 - protein, 33 aa, Artificial Sequence
  Description of Artificial Sequence: Synthetic polypeptide
AEEEIRTTNPVATEQYGSVTVTNNNQLGNNQQE

SEQ ID NO: 68761 - protein, 31 aa, Artificial Sequence
  Description of Artificial Sequence: Synthetic polypeptide
AEEEIRTTNPVATEQYGSVTVTNQNSEAGIE

SEQ ID NO: 68762 - protein, 34 aa, Artificial Sequence
  Description of Artificial Sequence: Synthetic polypeptide
CEEEIRTTNPVATEQYGSVTSTNDDKEYGENSRS

SEQ ID NO: 68763 - protein, 34 aa, Artificial Sequence
  Description of Artificial Sequence: Synthetic polypeptide
DENEIRTTNPVATEQYGSVSTNEEESQEGGQSRS

SEQ ID NO: 68764 - protein, 32 aa, Artificial Sequence
  Description of Artificial Sequence: Synthetic polypeptide
AEEEIRTTNPVATEQYGSVTVTNQQGVTNNSE

SEQ ID NO: 68765 - protein, 33 aa, Artificial Sequence
  Description of Artificial Sequence: Synthetic polypeptide
AEEEIRTTNPVATEQYGSVTVTNQQQQNGTNNS

SEQ ID NO: 68766 - protein, 34 aa, Artificial Sequence
  Description of Artificial Sequence: Synthetic polypeptide
DEEEIRATNPVATEQYGVVSTTNQQLQSGIGTNF

SEQ ID NO: 68767 - protein, 32 aa, Artificial Sequence
  Description of Artificial Sequence: Synthetic polypeptide
QEEEICTTNPVATEQYGSVATNLIERIDNTEM

SEQ ID NO: 68768 - protein, 32 aa, Artificial Sequence
  Description of Artificial Sequence: Synthetic polypeptide
AEEEIRTTNPVATEQYGSVTVTVELQGQTTND

SEQ ID NO: 68769 - protein, 33 aa, Artificial Sequence
  Description of Artificial Sequence: Synthetic polypeptide
CEEEIRTTNPVATEQYGSVVITNGQERNANFDI

SEQ ID NO: 68770 - protein, 34 aa, Artificial Sequence
  Description of Artificial Sequence: Synthetic polypeptide
AEEEIRTTNPVATEQYGSVTVTVTNGNLQQGTNI

SEQ ID NO: 68771 - protein, 34 aa, Artificial Sequence
  Description of Artificial Sequence: Synthetic polypeptide
QEEEICTTNPVATEQYGSVASATNLSDRGGGNDQ

SEQ ID NO: 68772 - protein, 31 aa, Artificial Sequence
  Description of Artificial Sequence: Synthetic polypeptide
DEEEIATTNPVATEQYGSCAAGNNLDMEMNR

SEQ ID NO: 68773 - protein, 31 aa, Artificial Sequence
  Description of Artificial Sequence: Synthetic polypeptide
DEEEIATTNPVATEQYGSCAAGNNLDMGDMR

SEQ ID NO: 68774 - protein, 33 aa, Artificial Sequence
  Description of Artificial Sequence: Synthetic polypeptide
DEEEIRTTNPVATEQYGSVSWINLQVEIVDAEN

SEQ ID NO: 68775 - protein, 33 aa, Artificial Sequence
  Description of Artificial Sequence: Synthetic polypeptide
DENEIRTTNPVATEQYGSVSTTWNQDGPIEDRG

SEQ ID NO: 68776 - protein, 32 aa, Artificial Sequence
  Description of Artificial Sequence: Synthetic polypeptide
DENEIRTTNPVATEQYGSVSVVLERSGPEDGQ

SEQ ID NO: 68777 - protein, 33 aa, Artificial Sequence
  Description of Artificial Sequence: Synthetic polypeptide
DEEEIRTTNPVATEQYGSVSWASLERIGDIMFQ

SEQ ID NO: 68778 - protein, 35 aa, Artificial Sequence
  Description of Artificial Sequence: Synthetic polypeptide
AEEEIRTTNPVATEQYGSVSVVTNLNQQGNLQNGI

SEQ ID NO: 68779 - protein, 34 aa, Artificial Sequence
  Description of Artificial Sequence: Synthetic polypeptide
DEEEIRTTNPVATEQYGSVGSPTSLVEQQLVLER

SEQ ID NO: 68780 - protein, 31 aa, Artificial Sequence
  Description of Artificial Sequence: Synthetic polypeptide
DEEEIRATNPVATEQYGSVSANNHDAPSGEF

SEQ ID NO: 68781 - protein, 34 aa, Artificial Sequence
  Description of Artificial Sequence: Synthetic polypeptide
DEEEIRTTNPVATEQYGSVGSPTTLLEQQLFLER

SEQ ID NO: 68782 - protein, 34 aa, Artificial Sequence
  Description of Artificial Sequence: Synthetic polypeptide
DEEEIRTTNPVATEQYGSVSWDNDLDEKQSDNQS

SEQ ID NO: 68783 - protein, 35 aa, Artificial Sequence
  Description of Artificial Sequence: Synthetic polypeptide
AEEEIRTTNPVATEQYGSVSVVTNLQNQQGTNTDE

SEQ ID NO: 68784 - protein, 32 aa, Artificial Sequence
  Description of Artificial Sequence: Synthetic polypeptide
DENEIRTTNPVATEQYGSVSVTMETQEGQIGV

SEQ ID NO: 68785 - protein, 33 aa, Artificial Sequence
  Description of Artificial Sequence: Synthetic polypeptide
DEEEIRATNPVATEQYGSVSAGNQDEAGSNSRE

SEQ ID NO: 68786 - protein, 32 aa, Artificial Sequence
  Description of Artificial Sequence: Synthetic polypeptide
DECEIRTTNPVATEQYGVVATGNGQDAGGNTV

SEQ ID NO: 68787 - protein, 33 aa, Artificial Sequence
  Description of Artificial Sequence: Synthetic polypeptide
DENEIRTTNPVATEQYGSVSVTLEVQDIGEDRI

SEQ ID NO: 68788 - protein, 32 aa, Artificial Sequence
  Description of Artificial Sequence: Synthetic polypeptide
DEEEIRATNPVATEQYGSVSANPDEAGSNSNE

SEQ ID NO: 68789 - protein, 32 aa, Artificial Sequence
  Description of Artificial Sequence: Synthetic polypeptide
DECEIRTTNPVATEQYGVVATGNNGQDAGDNV

SEQ ID NO: 68790 - protein, 31 aa, Artificial Sequence
  Description of Artificial Sequence: Synthetic polypeptide
DEEEIRATNPVATEQYGSVSANQDEAPSNSF

SEQ ID NO: 68791 - protein, 28 aa, Artificial Sequence
  Description of Artificial Sequence: Synthetic peptide
QESEIRCTNPIATEGYGVVASNLQHGDR

SEQ ID NO: 68792 - protein, 32 aa, Artificial Sequence
  Description of Artificial Sequence: Synthetic polypeptide
DECEIRTTNPVATEQYGVVSITGKLQRPTYDD

SEQ ID NO: 68793 - protein, 34 aa, Artificial Sequence
  Description of Artificial Sequence: Synthetic polypeptide
DEEEIRTTNPVATEQYGSVGSTDDIQETGDNSGE

SEQ ID NO: 68794 - protein, 35 aa, Artificial Sequence
  Description of Artificial Sequence: Synthetic polypeptide
AEEEIRTTNPVATEQYGSVSVVTNNLQGGNLQNGI

SEQ ID NO: 68795 - protein, 32 aa, Artificial Sequence
  Description of Artificial Sequence: Synthetic polypeptide
DECEIRTTNPVAYEGWGSVSTSNGQQDNGNNR

SEQ ID NO: 68796 - protein, 33 aa, Artificial Sequence
  Description of Artificial Sequence: Synthetic polypeptide
DEEEIRTTNPVATEQYGSVGSSNTNDGNNINVP

SEQ ID NO: 68797 - protein, 33 aa, Artificial Sequence
  Description of Artificial Sequence: Synthetic polypeptide
DEEEIRATNPVATEQYGSVSAANGQDEAGSNSN

SEQ ID NO: 68798 - protein, 32 aa, Artificial Sequence
  Description of Artificial Sequence: Synthetic polypeptide
AEEEIRTTNPVATEQYGSVSVVTNDNTNDNDT

SEQ ID NO: 68799 - protein, 28 aa, Artificial Sequence
  Description of Artificial Sequence: Synthetic peptide
QESEIRCTNPIATEGYGSVAENLMHGNI

SEQ ID NO: 68800 - protein, 34 aa, Artificial Sequence
  Description of Artificial Sequence: Synthetic polypeptide
DEEEIRTTNPVATEQYGSVSVTYNSLDPISQENI

SEQ ID NO: 68801 - protein, 32 aa, Artificial Sequence
  Description of Artificial Sequence: Synthetic polypeptide
DEEEIATTNPVATEQYGSVAAAPNEQTAGSER

SEQ ID NO: 68802 - protein, 33 aa, Artificial Sequence
  Description of Artificial Sequence: Synthetic polypeptide
DEEEIRTTNPVATEQYGSVSVTYSEETGFENQD

SEQ ID NO: 68803 - protein, 34 aa, Artificial Sequence
  Description of Artificial Sequence: Synthetic polypeptide
DEEEIRTTNPVATEQYGSVSVTYTGLIETGNLEL

SEQ ID NO: 68804 - protein, 33 aa, Artificial Sequence
  Description of Artificial Sequence: Synthetic polypeptide
DEEEIATTNPVATEQYGSVAAANNLQEAGNSHN

SEQ ID NO: 68805 - protein, 31 aa, Artificial Sequence
  Description of Artificial Sequence: Synthetic polypeptide
DEEEIATTNPVATEQYGSVAAANGLDDPGED

SEQ ID NO: 68806 - protein, 34 aa, Artificial Sequence
  Description of Artificial Sequence: Synthetic polypeptide
DEEEIRATNPVATEQYGSVCATNPLQEHDGNQHQ

SEQ ID NO: 68807 - protein, 28 aa, Artificial Sequence
  Description of Artificial Sequence: Synthetic peptide
QESEIATTNPVGTEGYGVVSTDLQHGDI

SEQ ID NO: 68808 - protein, 33 aa, Artificial Sequence
  Description of Artificial Sequence: Synthetic polypeptide
DENEIRTTNPVATEQYGSVTSTNDPQETENHET

SEQ ID NO: 68809 - protein, 32 aa, Artificial Sequence
  Description of Artificial Sequence: Synthetic polypeptide
DECEIRTTNPVATEQYGSVATGPGQDAGGNEV

SEQ ID NO: 68810 - protein, 32 aa, Artificial Sequence
  Description of Artificial Sequence: Synthetic polypeptide
DECEIRTTNPVATEQYGSVATGPGQDAGGNVQ

SEQ ID NO: 68811 - protein, 33 aa, Artificial Sequence
  Description of Artificial Sequence: Synthetic polypeptide
DENEIRTTNPVATEQYGSVTSTDNNQEGTLDPQ

SEQ ID NO: 68812 - protein, 33 aa, Artificial Sequence
  Description of Artificial Sequence: Synthetic polypeptide
DEEEIRTTNPVATEQYGSVSVVPNELQTTQQLE

SEQ ID NO: 68813 - protein, 35 aa, Artificial Sequence
  Description of Artificial Sequence: Synthetic polypeptide
DEEEIRATNPVATEQYGSVCSGVNDQHDRQGSNSR

SEQ ID NO: 68814 - protein, 33 aa, Artificial Sequence
  Description of Artificial Sequence: Synthetic polypeptide
AEEEIRTTNPVATEQYGSVSVVNNNLQQNQNQN

SEQ ID NO: 68815 - protein, 35 aa, Artificial Sequence
  Description of Artificial Sequence: Synthetic polypeptide
DEEEIRTTNPVATEQYGSVGSNTQNLDFNGGNEQG

SEQ ID NO: 68816 - protein, 28 aa, Artificial Sequence
  Description of Artificial Sequence: Synthetic peptide
QESEIATTNPVGTEQYGVVSTDLEHGDI

SEQ ID NO: 68817 - protein, 31 aa, Artificial Sequence
  Description of Artificial Sequence: Synthetic polypeptide
QEEEICTTNPVATESYGSVATNLQGNPNQDM

SEQ ID NO: 68818 - protein, 32 aa, Artificial Sequence
  Description of Artificial Sequence: Synthetic polypeptide
DECEIRTTNPVATEQYGSVNSNWTDERGNQDM

SEQ ID NO: 68819 - protein, 32 aa, Artificial Sequence
  Description of Artificial Sequence: Synthetic polypeptide
DEEEIRTTNPVATEQYGSVSVYDEQTEGGQHI

SEQ ID NO: 68820 - protein, 33 aa, Artificial Sequence
  Description of Artificial Sequence: Synthetic polypeptide
DEEEIRTTNPVATEQYGSVSVYNDLTEYGMEQN

SEQ ID NO: 68821 - protein, 28 aa, Artificial Sequence
  Description of Artificial Sequence: Synthetic peptide
QESEIRCTNPIATEGYGVVSENLMHGDR

SEQ ID NO: 68822 - protein, 33 aa, Artificial Sequence
  Description of Artificial Sequence: Synthetic polypeptide
DEAEIRTTNPVATEQYGSVCSAGMLDERGENQD

SEQ ID NO: 68823 - protein, 32 aa, Artificial Sequence
  Description of Artificial Sequence: Synthetic polypeptide
DECEIRTTNPVAYEQWGCVSTNLQGEDGNNGS

SEQ ID NO: 68824 - protein, 31 aa, Artificial Sequence
  Description of Artificial Sequence: Synthetic polypeptide
DECEIRTTNPVAYEQWGEVSTNLNLGGNDMG

SEQ ID NO: 68825 - protein, 33 aa, Artificial Sequence
  Description of Artificial Sequence: Synthetic polypeptide
DEEEIRATNPVATEQYGSVSTVNQDNTEGSNNQ

SEQ ID NO: 68826 - protein, 34 aa, Artificial Sequence
  Description of Artificial Sequence: Synthetic polypeptide
DEEEIRATNPVATEQYGSVSTVNQNDQAGSNQDN

SEQ ID NO: 68827 - protein, 35 aa, Artificial Sequence
  Description of Artificial Sequence: Synthetic polypeptide
DEEEIRATNPVATEQYGSVSTVSNLQNSEIGSNNE

SEQ ID NO: 68828 - protein, 33 aa, Artificial Sequence
  Description of Artificial Sequence: Synthetic polypeptide
DEEEIRTTNPVATEQYGSVSWDYNPQNFSENMQ

SEQ ID NO: 68829 - protein, 31 aa, Artificial Sequence
  Description of Artificial Sequence: Synthetic polypeptide
DENEIRTTNPVATEQYGSVSVPDMIQENENH

SEQ ID NO: 68830 - protein, 36 aa, Artificial Sequence
  Description of Artificial Sequence: Synthetic polypeptide
DEEEIRTTNPVATEQYGSVGSTMNLDQQIIGGNGEN

SEQ ID NO: 68831 - protein, 31 aa, Artificial Sequence
  Description of Artificial Sequence: Synthetic polypeptide
DECEIRTTNPVAYEQYGVCSTGLQRDPMNDN

SEQ ID NO: 68832 - protein, 35 aa, Artificial Sequence
  Description of Artificial Sequence: Synthetic polypeptide
AEEEIRTTNPVATEQYGSVSVVTNQLQQGNNQNGI

SEQ ID NO: 68833 - protein, 33 aa, Artificial Sequence
  Description of Artificial Sequence: Synthetic polypeptide
AEEEIRTTNPVATEQYGSVSVVTNQQQIQTNVT

SEQ ID NO: 68834 - protein, 34 aa, Artificial Sequence
  Description of Artificial Sequence: Synthetic polypeptide
DEEEIRTTNPVATEQYGSVGSTMNGTGGGQNDIS

SEQ ID NO: 68835 - protein, 31 aa, Artificial Sequence
  Description of Artificial Sequence: Synthetic polypeptide
DECEIRTTNPVAYEQYGVCSTGLQRPDNDDN

SEQ ID NO: 68836 - protein, 34 aa, Artificial Sequence
  Description of Artificial Sequence: Synthetic polypeptide
CEEEIRTTNPVATEQYGSVNTVNGLDQQEGENGD

SEQ ID NO: 68837 - protein, 33 aa, Artificial Sequence
  Description of Artificial Sequence: Synthetic polypeptide
DENEIRTTNPVATEQYGSVSTWPLNQLDGSEEQ

SEQ ID NO: 68838 - protein, 32 aa, Artificial Sequence
  Description of Artificial Sequence: Synthetic polypeptide
DENEIRTTNPVATEQYGSVSTVENFPNSEDRF

SEQ ID NO: 68839 - protein, 31 aa, Artificial Sequence
  Description of Artificial Sequence: Synthetic polypeptide
DECEIRTTNPVAYEQYGVCSTVLQRPENGDA

SEQ ID NO: 68840 - protein, 35 aa, Artificial Sequence
  Description of Artificial Sequence: Synthetic polypeptide
AEEEIRTTNPVATEQYGSVSVVTTNLQAGNLQNGI

SEQ ID NO: 68841 - protein, 32 aa, Artificial Sequence
  Description of Artificial Sequence: Synthetic polypeptide
DEEEIRATNPVATEQYGSVSVVNNQDQGSTST

SEQ ID NO: 68842 - protein, 35 aa, Artificial Sequence
  Description of Artificial Sequence: Synthetic polypeptide
AEEEIRTTNPVATEQYGSVSVVTTNLQNGNLQNGD

SEQ ID NO: 68843 - protein, 35 aa, Artificial Sequence
  Description of Artificial Sequence: Synthetic polypeptide
AEEEIRTTNPVATEQYGSVSVVTTNLQQGNLQNGI

SEQ ID NO: 68844 - protein, 31 aa, Artificial Sequence
  Description of Artificial Sequence: Synthetic polypeptide
DEEEIATTNPVATEQYGSCAAGNNLDREDHR

SEQ ID NO: 68845 - protein, 33 aa, Artificial Sequence
  Description of Artificial Sequence: Synthetic polypeptide
DENEIRTTNPVATEQYGSVSVPDLDQEAEENRD

SEQ ID NO: 68846 - protein, 34 aa, Artificial Sequence
  Description of Artificial Sequence: Synthetic polypeptide
DEEEIRATNPVATEQYGSVSTVNNQDNQQGSNLA

SEQ ID NO: 68847 - protein, 34 aa, Artificial Sequence
  Description of Artificial Sequence: Synthetic polypeptide
DEEEIRTTNPVATEQYGSVSTNKHSQETDMEIIR

SEQ ID NO: 68848 - protein, 34 aa, Artificial Sequence
  Description of Artificial Sequence: Synthetic polypeptide
DENEIRTTNPVATEQYGSVSVSFNLEQRVENNIE

SEQ ID NO: 68849 - protein, 34 aa, Artificial Sequence
  Description of Artificial Sequence: Synthetic polypeptide
DEEEIRTTNPVATEQYGSVGSTGGQSTGGGNGDT

SEQ ID NO: 68850 - protein, 31 aa, Artificial Sequence
  Description of Artificial Sequence: Synthetic polypeptide
DECEIRTTNPVAYEQWGSVSTGGLDNGDNAE

SEQ ID NO: 68851 - protein, 28 aa, Artificial Sequence
  Description of Artificial Sequence: Synthetic peptide
QESEIRCTNPIATEGYGVVSSNLMHGDR

SEQ ID NO: 68852 - protein, 28 aa, Artificial Sequence
  Description of Artificial Sequence: Synthetic peptide
QESEIRCTNPVATEGYGVMASNLQHGDR

SEQ ID NO: 68853 - protein, 31 aa, Artificial Sequence
  Description of Artificial Sequence: Synthetic polypeptide
DEEEIRTTNPVATEQYGSVSWDNPDVSEDDM

SEQ ID NO: 68854 - protein, 28 aa, Artificial Sequence
  Description of Artificial Sequence: Synthetic peptide
QESEIRCTNPVATEGYGVMASTLQHGDR

SEQ ID NO: 68855 - protein, 34 aa, Artificial Sequence
  Description of Artificial Sequence: Synthetic polypeptide
AEEEIRTTNPVATEQYGSVSTVVDNGNQGGNNTT

SEQ ID NO: 68856 - protein, 28 aa, Artificial Sequence
  Description of Artificial Sequence: Synthetic peptide
QESEIRCTNPVATEQYGVMSSTLQHGDI

SEQ ID NO: 68857 - protein, 33 aa, Artificial Sequence
  Description of Artificial Sequence: Synthetic polypeptide
DEEEIRATNPVATEQYGSVSSTTNLQQDETFGG

SEQ ID NO: 68858 - protein, 34 aa, Artificial Sequence
  Description of Artificial Sequence: Synthetic polypeptide
AEEEIRTTNPVATEQYGSVSVVTNNNQDQGNNVD

SEQ ID NO: 68859 - protein, 32 aa, Artificial Sequence
  Description of Artificial Sequence: Synthetic polypeptide
DENEIRTTNPVATEQYGSVSVTDMIQIENEHQ

SEQ ID NO: 68860 - protein, 32 aa, Artificial Sequence
  Description of Artificial Sequence: Synthetic polypeptide
DEEEIATTNPVATEQYGSCSATENLEADNMNS

SEQ ID NO: 68861 - protein, 31 aa, Artificial Sequence
  Description of Artificial Sequence: Synthetic polypeptide
QESEIRPTNPCATECWGSVSCINLQREGENR

SEQ ID NO: 68862 - protein, 32 aa, Artificial Sequence
  Description of Artificial Sequence: Synthetic polypeptide
DEEEIATTNPVATEQYGSCSATEGLEADNGNH

SEQ ID NO: 68863 - protein, 32 aa, Artificial Sequence
  Description of Artificial Sequence: Synthetic polypeptide
DEEEIRATNPVATEQYGSVSTGFGTGGDEGNI

SEQ ID NO: 68864 - protein, 33 aa, Artificial Sequence
  Description of Artificial Sequence: Synthetic polypeptide
DEEEIRTTNPVATEQYGSVSWDNPQVSSDNDDM

SEQ ID NO: 68865 - protein, 34 aa, Artificial Sequence
  Description of Artificial Sequence: Synthetic polypeptide
DEEEIRATNPVATEQYGSVSTGLIGQQGGGNNQD

SEQ ID NO: 68866 - protein, 33 aa, Artificial Sequence
  Description of Artificial Sequence: Synthetic polypeptide
AEEEIRTTNPVATEQYGSVSTVTVNQQGNNEND

SEQ ID NO: 68867 - protein, 33 aa, Artificial Sequence
  Description of Artificial Sequence: Synthetic polypeptide
DEEEIRATNPVATEQYGSVSTQDITGQDEGNIG

SEQ ID NO: 68868 - protein, 35 aa, Artificial Sequence
  Description of Artificial Sequence: Synthetic polypeptide
DEEEIRTTNPVATEQYGSVGSTMNGGQTGGGGNED

SEQ ID NO: 68869 - protein, 35 aa, Artificial Sequence
  Description of Artificial Sequence: Synthetic polypeptide
DEEEIRATNPVATEQYGSVSTVNLQNNQQGSNLAE

SEQ ID NO: 68870 - protein, 34 aa, Artificial Sequence
  Description of Artificial Sequence: Synthetic polypeptide
AEEEIRTTNPVATEQYGSVSVVTNNNNQQGSNEE

SEQ ID NO: 68871 - protein, 30 aa, Artificial Sequence
  Description of Artificial Sequence: Synthetic polypeptide
DECEICTVNPVATEQYGSVSTALQQNQEEQ

SEQ ID NO: 68872 - protein, 34 aa, Artificial Sequence
  Description of Artificial Sequence: Synthetic polypeptide
DEEEIRTTNPVATEQYGSVSVTMDLDSEGNEVVD

SEQ ID NO: 68873 - protein, 31 aa, Artificial Sequence
  Description of Artificial Sequence: Synthetic polypeptide
DECEICTVNPVATEQYGSVSTALQQNDQGED

SEQ ID NO: 68874 - protein, 28 aa, Artificial Sequence
  Description of Artificial Sequence: Synthetic peptide
QESEIAPTNPCSSEQYGIVSCNLQSGNR

SEQ ID NO: 68875 - protein, 31 aa, Artificial Sequence
  Description of Artificial Sequence: Synthetic polypeptide
DENEVASTNPVATEQYGEVSANTLQSRVGQR

SEQ ID NO: 68876 - protein, 34 aa, Artificial Sequence
  Description of Artificial Sequence: Synthetic polypeptide
DEEEIRTTNPVATEQYGSIIYTPNLQIRENVEAG

SEQ ID NO: 68877 - protein, 28 aa, Artificial Sequence
  Description of Artificial Sequence: Synthetic peptide
QESEIAPTNPCSTEQYGIVSSNLQHGTR

SEQ ID NO: 68878 - protein, 29 aa, Artificial Sequence
  Description of Artificial Sequence: Synthetic peptide
DESEIRCTNPVATECWGEVSCINEQRGGG

SEQ ID NO: 68879 - protein, 29 aa, Artificial Sequence
  Description of Artificial Sequence: Synthetic peptide
DESEIRCTNPVATECWGEVSEINEQRGGG

SEQ ID NO: 68880 - protein, 28 aa, Artificial Sequence
  Description of Artificial Sequence: Synthetic peptide
QEEEIRTTNPVATEQYGEASEVEQHEEK

SEQ ID NO: 68881 - protein, 28 aa, Artificial Sequence
  Description of Artificial Sequence: Synthetic peptide
QEEEIRTTNPVATEQYGEASEVCQHEEK

SEQ ID NO: 68882 - protein, 28 aa, Artificial Sequence
  Description of Artificial Sequence: Synthetic peptide
QEEEIRTTNPVATEQYGEASEVCMREEK

SEQ ID NO: 68883 - protein, 31 aa, Artificial Sequence
  Description of Artificial Sequence: Synthetic polypeptide
CEECICTTNPVATEQYGSVSWNEGQQSGGNS

SEQ ID NO: 68884 - protein, 31 aa, Artificial Sequence
  Description of Artificial Sequence: Synthetic polypeptide
DESEIRCTNPVATECWGSVSCINLQDREGGG

SEQ ID NO: 68885 - protein, 28 aa, Artificial Sequence
  Description of Artificial Sequence: Synthetic peptide
QESEIAPTNPCSTEQYGIVSSNLQSGTR

SEQ ID NO: 68886 - protein, 28 aa, Artificial Sequence
  Description of Artificial Sequence: Synthetic peptide
QESEIAPTNPVGTEQYGVVSCNLQSGTI

SEQ ID NO: 68887 - protein, 31 aa, Artificial Sequence
  Description of Artificial Sequence: Synthetic polypeptide
DESEIRCTNPVATECWGSVSCNEPQDREGNG

SEQ ID NO: 68888 - protein, 34 aa, Artificial Sequence
  Description of Artificial Sequence: Synthetic polypeptide
DEEEIRTTNPVATEQYGSVFGSIGVNQGQGEGNT

SEQ ID NO: 68889 - protein, 31 aa, Artificial Sequence
  Description of Artificial Sequence: Synthetic polypeptide
DESEIRCTNPVATECWGSVSEINLPMRGENG

SEQ ID NO: 68890 - protein, 34 aa, Artificial Sequence
  Description of Artificial Sequence: Synthetic polypeptide
DEEEIRTTNPVATEQYGSVFGSINVNGQGEGNGQ

SEQ ID NO: 68891 - protein, 34 aa, Artificial Sequence
  Description of Artificial Sequence: Synthetic polypeptide
DEEEIRTTNPVATEQYGSVFGSINVNGQGGTNGD

SEQ ID NO: 68892 - protein, 31 aa, Artificial Sequence
  Description of Artificial Sequence: Synthetic polypeptide
DESEIRCTNPVATECWGSVSENEPQDREGNG

SEQ ID NO: 68893 - protein, 33 aa, Artificial Sequence
  Description of Artificial Sequence: Synthetic polypeptide
DEEEIRTTNPVATEQYGSVSVLTLGDEGGEQGR

SEQ ID NO: 68894 - protein, 32 aa, Artificial Sequence
  Description of Artificial Sequence: Synthetic polypeptide
DESEIRCTNPVATECWGSVSCNEPQDREGENR

SEQ ID NO: 68895 - protein, 33 aa, Artificial Sequence
  Description of Artificial Sequence: Synthetic polypeptide
DEEEIRTTNPVATEQYGSVSVLTMLQTNVETWS

SEQ ID NO: 68896 - protein, 33 aa, Artificial Sequence
  Description of Artificial Sequence: Synthetic polypeptide
DEEEIRTTNPVATEQYGSVSVLEELQLHVENQT

SEQ ID NO: 68897 - protein, 35 aa, Artificial Sequence
  Description of Artificial Sequence: Synthetic polypeptide
DEEEIRTTNPVATEQYGSILSSTNLQMRISVEENF

SEQ ID NO: 68898 - protein, 32 aa, Artificial Sequence
  Description of Artificial Sequence: Synthetic polypeptide
CEEEIRTTNPVATEQYGCVCSTNHQNGSETQS

SEQ ID NO: 68899 - protein, 33 aa, Artificial Sequence
  Description of Artificial Sequence: Synthetic polypeptide
CEEEIRTTNPVATEQYGCVCSTNLQHFGSETQN

SEQ ID NO: 68900 - protein, 33 aa, Artificial Sequence
  Description of Artificial Sequence: Synthetic polypeptide
DEEEIRTTNPVATEQYGSVFGDINVNGQGEGNI

SEQ ID NO: 68901 - protein, 32 aa, Artificial Sequence
  Description of Artificial Sequence: Synthetic polypeptide
DESEICTVNPVATEQYGSVSCTNELSTETGNH

SEQ ID NO: 68902 - protein, 28 aa, Artificial Sequence
  Description of Artificial Sequence: Synthetic peptide
QESEIACTNPVGTEQYGEASSNLQRGDI

SEQ ID NO: 68903 - protein, 33 aa, Artificial Sequence
  Description of Artificial Sequence: Synthetic polypeptide
CEEEIRTTNPVATEQYGCVCSTNLQNFFSENQA

SEQ ID NO: 68904 - protein, 32 aa, Artificial Sequence
  Description of Artificial Sequence: Synthetic polypeptide
DESEICTVNPVATEQYGSVVSCTNLSTEGNNH

SEQ ID NO: 68905 - protein, 31 aa, Artificial Sequence
  Description of Artificial Sequence: Synthetic polypeptide
DESEICTVNPVAYEQYGSVSCTNELSTSGNH

SEQ ID NO: 68906 - protein, 35 aa, Artificial Sequence
  Description of Artificial Sequence: Synthetic polypeptide
AEEEIRTTNPVATEQYGSVSVTTNNLQQGTEGTNG

SEQ ID NO: 68907 - protein, 32 aa, Artificial Sequence
  Description of Artificial Sequence: Synthetic polypeptide
DEAEIRTTNPVATEQYGSVNSVLDNGNQGDNQ

SEQ ID NO: 68908 - protein, 29 aa, Artificial Sequence
  Description of Artificial Sequence: Synthetic peptide
QEEEIRTTNPVATEQYGEVSEVCQHAEEA

SEQ ID NO: 68909 - protein, 33 aa, Artificial Sequence
  Description of Artificial Sequence: Synthetic polypeptide
CEEEIRTTNPVATEQYGCVCSTNLQNFGSEQQS

SEQ ID NO: 68910 - protein, 33 aa, Artificial Sequence
  Description of Artificial Sequence: Synthetic polypeptide
DESEIKTTNPVATEQYGSVQPCTNLSQGTSGNS

SEQ ID NO: 68911 - protein, 31 aa, Artificial Sequence
  Description of Artificial Sequence: Synthetic polypeptide
DESEIRCTNPIATECYGSVSEINLPMREGNG

SEQ ID NO: 68912 - protein, 28 aa, Artificial Sequence
  Description of Artificial Sequence: Synthetic peptide
QEEEIRTTNPVATEQYGEVPEVEQAEDK

SEQ ID NO: 68913 - protein, 28 aa, Artificial Sequence
  Description of Artificial Sequence: Synthetic peptide
QEEEIRTTNPVATEQYGEVPEVCQHEEK

SEQ ID NO: 68914 - protein, 34 aa, Artificial Sequence
  Description of Artificial Sequence: Synthetic polypeptide
DEEEIRTTNPVATEQYGSVSVENGLQRQMPELQY

SEQ ID NO: 68915 - protein, 33 aa, Artificial Sequence
  Description of Artificial Sequence: Synthetic polypeptide
DEAEIRTTNPVATEQYGSVNTMNELQGSIEDRN

SEQ ID NO: 68916 - protein, 37 aa, Artificial Sequence
  Description of Artificial Sequence: Synthetic polypeptide
DEEEIRTTNPVATEQYGSIMASTGNELQMRDGVNGRY

SEQ ID NO: 68917 - protein, 32 aa, Artificial Sequence
  Description of Artificial Sequence: Synthetic polypeptide
DEAEIRTTNPVATEQYGSVNSVSNDQIEGEQN

SEQ ID NO: 68918 - protein, 28 aa, Artificial Sequence
  Description of Artificial Sequence: Synthetic peptide
QESEIACTNPVGTEQYGVASSNLQRGDI

SEQ ID NO: 68919 - protein, 33 aa, Artificial Sequence
  Description of Artificial Sequence: Synthetic polypeptide
DEAEIRTTNPVATEQYGSVNSESLDQQGENEEQ

SEQ ID NO: 68920 - protein, 28 aa, Artificial Sequence
  Description of Artificial Sequence: Synthetic peptide
QESEIAPTNPVSSEQYGIVSNNLQSGTR

SEQ ID NO: 68921 - protein, 31 aa, Artificial Sequence
  Description of Artificial Sequence: Synthetic polypeptide
DEAEIRTTNPVATEQYGSVNNVNDSQQLGEQ

SEQ ID NO: 68922 - protein, 32 aa, Artificial Sequence
  Description of Artificial Sequence: Synthetic polypeptide
DEEEIRTTNPVATEQYGSICTTLNLVAEMNFD

SEQ ID NO: 68923 - protein, 30 aa, Artificial Sequence
  Description of Artificial Sequence: Synthetic polypeptide
DENEIVTTNPVATEQYGDVSTDCLVEHGEL

SEQ ID NO: 68924 - protein, 31 aa, Artificial Sequence
  Description of Artificial Sequence: Synthetic polypeptide
DENEIVTTNPVATEQYGDVSTDCLVEHEGNL

SEQ ID NO: 68925 - protein, 33 aa, Artificial Sequence
  Description of Artificial Sequence: Synthetic polypeptide
DEEEIATTNPVATEQYGSVCAAANGLENMEGNR

SEQ ID NO: 68926 - protein, 33 aa, Artificial Sequence
  Description of Artificial Sequence: Synthetic polypeptide
DEEEIATTNPVATEQYGSVCAAANDLQDSDGNH

SEQ ID NO: 68927 - protein, 33 aa, Artificial Sequence
  Description of Artificial Sequence: Synthetic polypeptide
DEEEIRTTNPVATEQYGSVFSTEAQLTEENNQQ

SEQ ID NO: 68928 - protein, 29 aa, Artificial Sequence
  Description of Artificial Sequence: Synthetic peptide
DENEIVTTNPVATEQYGDVSECLVEHGEL

SEQ ID NO: 68929 - protein, 31 aa, Artificial Sequence
  Description of Artificial Sequence: Synthetic polypeptide
DEEEIATTNPVATEQYGSVCAAAGLDTRGDD

SEQ ID NO: 68930 - protein, 32 aa, Artificial Sequence
  Description of Artificial Sequence: Synthetic polypeptide
DESEIRPTNPVATEQWGSVSCINEQDREGENG

SEQ ID NO: 68931 - protein, 31 aa, Artificial Sequence
  Description of Artificial Sequence: Synthetic polypeptide
DENEIVTTNPVATEQYGEASTDGPVQREGND

SEQ ID NO: 68932 - protein, 35 aa, Artificial Sequence
  Description of Artificial Sequence: Synthetic polypeptide
DEEEIRTTNPVATEQYGSVSVNMMQITRQDVNERN

SEQ ID NO: 68933 - protein, 34 aa, Artificial Sequence
  Description of Artificial Sequence: Synthetic polypeptide
DEAEIRTTNPVATEQYGSVISTTNDLNQNPSNQE

SEQ ID NO: 68934 - protein, 32 aa, Artificial Sequence
  Description of Artificial Sequence: Synthetic polypeptide
DEEEIATTNPVATEQYGSVATQSLDQTAGGEF

SEQ ID NO: 68935 - protein, 31 aa, Artificial Sequence
  Description of Artificial Sequence: Synthetic polypeptide
DEEEIATTNPVATEQYGSVATPTITQDDGEG

SEQ ID NO: 68936 - protein, 33 aa, Artificial Sequence
  Description of Artificial Sequence: Synthetic polypeptide
DEEEIATTNPVATEQYGSVATPPNLDGNPDNRN

SEQ ID NO: 68937 - protein, 30 aa, Artificial Sequence
  Description of Artificial Sequence: Synthetic polypeptide
DESEIRSTNPVATECWGVVSCINEQDRGNQ

SEQ ID NO: 68938 - protein, 34 aa, Artificial Sequence
  Description of Artificial Sequence: Synthetic polypeptide
DEEEIRTTNPVATEQYGSVSVNYDSNRAGSNEDL

SEQ ID NO: 68939 - protein, 30 aa, Artificial Sequence
  Description of Artificial Sequence: Synthetic polypeptide
DESEIRSTNPVATECWGVVSDINEQDRGNQ

SEQ ID NO: 68940 - protein, 33 aa, Artificial Sequence
  Description of Artificial Sequence: Synthetic polypeptide
DEEEIATTNPVATEQYGSVATPNPEQDIGNPEP

SEQ ID NO: 68941 - protein, 31 aa, Artificial Sequence
  Description of Artificial Sequence: Synthetic polypeptide
DESEIRSTNPVATEGYGNVSNTIPQSRVGNG

SEQ ID NO: 68942 - protein, 35 aa, Artificial Sequence
  Description of Artificial Sequence: Synthetic polypeptide
DEAEIRTTNPVATEQYGSVISVTHDLQTGGNEQRD

SEQ ID NO: 68943 - protein, 31 aa, Artificial Sequence
  Description of Artificial Sequence: Synthetic polypeptide
DECEICTTNPVATEQYGVVSTALTQGNPNTD

SEQ ID NO: 68944 - protein, 31 aa, Artificial Sequence
  Description of Artificial Sequence: Synthetic polypeptide
DECEICTTNPVATEQYGVVSTALQNNPNNED

SEQ ID NO: 68945 - protein, 32 aa, Artificial Sequence
  Description of Artificial Sequence: Synthetic polypeptide
DENEIVTTNPVATEQYGEVSATDGPVQREGND

SEQ ID NO: 68946 - protein, 28 aa, Artificial Sequence
  Description of Artificial Sequence: Synthetic peptide
QESEIASTNPCSTEQYGIVSSNLQHGTR

SEQ ID NO: 68947 - protein, 34 aa, Artificial Sequence
  Description of Artificial Sequence: Synthetic polypeptide
DEEEIRTTNPVATEQYGSVFGSTNVNAGGNGQND

SEQ ID NO: 68948 - protein, 32 aa, Artificial Sequence
  Description of Artificial Sequence: Synthetic polypeptide
DEAEIRTTNPVATEQYGSVNNTYLERESNQVI

SEQ ID NO: 68949 - protein, 31 aa, Artificial Sequence
  Description of Artificial Sequence: Synthetic polypeptide
CEECICTTNPVATEQYGSVSWNEGQDRGGDS

SEQ ID NO: 68950 - protein, 34 aa, Artificial Sequence
  Description of Artificial Sequence: Synthetic polypeptide
DEEEIRTTNPVATEQYGSVFGTNDQIEETGGNET

SEQ ID NO: 68951 - protein, 31 aa, Artificial Sequence
  Description of Artificial Sequence: Synthetic polypeptide
CEECICTTNPVATEQYGSVSWNEGQDQGNGS

SEQ ID NO: 68952 - protein, 31 aa, Artificial Sequence
  Description of Artificial Sequence: Synthetic polypeptide
DESEIRCTNPVATEQWGSASENEPQDREGNG

SEQ ID NO: 68953 - protein, 31 aa, Artificial Sequence
  Description of Artificial Sequence: Synthetic polypeptide
CEECICTTNPVATEQYGSVSWNEGERDGNDS

SEQ ID NO: 68954 - protein, 33 aa, Artificial Sequence
  Description of Artificial Sequence: Synthetic polypeptide
DEEEIRTTNPVATEQYGSVSVMQGADELGNPRT

SEQ ID NO: 68955 - protein, 32 aa, Artificial Sequence
  Description of Artificial Sequence: Synthetic polypeptide
DEEEIRTTNPVATEQYGSVSVNDASETGSLQK

SEQ ID NO: 68956 - protein, 30 aa, Artificial Sequence
  Description of Artificial Sequence: Synthetic polypeptide
DESEIRCTNPVATEQYGNVANTIMSRVGQR

SEQ ID NO: 68957 - protein, 29 aa, Artificial Sequence
  Description of Artificial Sequence: Synthetic peptide
DENEIVTTNPVATEQYGTVSEIPEFEGND

SEQ ID NO: 68958 - protein, 34 aa, Artificial Sequence
  Description of Artificial Sequence: Synthetic polypeptide
DEEEIATTNPVATEQYGSVCAADNGLQDQDGNNR

SEQ ID NO: 68959 - protein, 34 aa, Artificial Sequence
  Description of Artificial Sequence: Synthetic polypeptide
DEEEIATTNPVATEQYGSVCAADNGLQDMDGNNR

SEQ ID NO: 68960 - protein, 34 aa, Artificial Sequence
  Description of Artificial Sequence: Synthetic polypeptide
DEEEIRTTNPVATEQYGSVFLTNMLIQAGEVEIL

SEQ ID NO: 68961 - protein, 30 aa, Artificial Sequence
  Description of Artificial Sequence: Synthetic polypeptide
DENEIVTTNPVATEQYGTVSEDGPEFEGNR

SEQ ID NO: 68962 - protein, 31 aa, Artificial Sequence
  Description of Artificial Sequence: Synthetic polypeptide
DENEIVTTNPVATEQYGTVCSTDGLQFEGGD

SEQ ID NO: 68963 - protein, 28 aa, Artificial Sequence
  Description of Artificial Sequence: Synthetic peptide
QESEIASTNPVATEGYGSVASTLQHGDI

SEQ ID NO: 68964 - protein, 31 aa, Artificial Sequence
  Description of Artificial Sequence: Synthetic polypeptide
DECEICTTNPVATEQYGVVSTALLQGNPNED

SEQ ID NO: 68965 - protein, 34 aa, Artificial Sequence
  Description of Artificial Sequence: Synthetic polypeptide
DEEEIRTTNPVATEQYGSIFCLPNMLSQHDGNNR

SEQ ID NO: 68966 - protein, 31 aa, Artificial Sequence
  Description of Artificial Sequence: Synthetic polypeptide
DECEICTTNPVATEQYGVVSTALQGNIPNDE

SEQ ID NO: 68967 - protein, 34 aa, Artificial Sequence
  Description of Artificial Sequence: Synthetic polypeptide
DEEEIRTTNPVATEQYGSVFGDINLNQNGGNVNT

SEQ ID NO: 68968 - protein, 33 aa, Artificial Sequence
  Description of Artificial Sequence: Synthetic polypeptide
DEEEIRTTNPVATEQYGSIPPELPNMLQIQNRT

SEQ ID NO: 68969 - protein, 34 aa, Artificial Sequence
  Description of Artificial Sequence: Synthetic polypeptide
DEEEIRTTNPVATEQYGSVFGDINLNQGNGNGNP

SEQ ID NO: 68970 - protein, 31 aa, Artificial Sequence
  Description of Artificial Sequence: Synthetic polypeptide
DENVIGTTNPVATEQWGCVSTDDLQRFGSNQ

SEQ ID NO: 68971 - protein, 29 aa, Artificial Sequence
  Description of Artificial Sequence: Synthetic peptide
QEQEIATTNPVGTEQYGSVASTLQDHGEL

SEQ ID NO: 68972 - protein, 28 aa, Artificial Sequence
  Description of Artificial Sequence: Synthetic peptide
QEQEIATTNPVSSEQYGIVSCDLQSGTR

SEQ ID NO: 68973 - protein, 32 aa, Artificial Sequence
  Description of Artificial Sequence: Synthetic polypeptide
DEPEIATTNPVATEQYGSVSSNVLNEVGNTEF

SEQ ID NO: 68974 - protein, 35 aa, Artificial Sequence
  Description of Artificial Sequence: Synthetic polypeptide
AEEEIRTTNPVATEQYGSVSVTTNLNQGNLGINNN

SEQ ID NO: 68975 - protein, 34 aa, Artificial Sequence
  Description of Artificial Sequence: Synthetic polypeptide
DEEEIRTTNPVATEQYGSVETTNMDQDRGSEAEI

SEQ ID NO: 68976 - protein, 29 aa, Artificial Sequence
  Description of Artificial Sequence: Synthetic peptide
QEQEIATTNPVSSEQYGSVSACDLQSGTR

SEQ ID NO: 68977 - protein, 31 aa, Artificial Sequence
  Description of Artificial Sequence: Synthetic polypeptide
DEPEIATTNPVATEQYGSVSSNNMEVGNEEF

SEQ ID NO: 68978 - protein, 35 aa, Artificial Sequence
  Description of Artificial Sequence: Synthetic polypeptide
AEEEIRTTNPVATEQYGSVSVTTNLNQLQNGNNNM

SEQ ID NO: 68979 - protein, 34 aa, Artificial Sequence
  Description of Artificial Sequence: Synthetic polypeptide
DEEEIRTTNPVATEQYGSVSTYNTMIQLGTFGEV

SEQ ID NO: 68980 - protein, 33 aa, Artificial Sequence
  Description of Artificial Sequence: Synthetic polypeptide
DEAEIRTTNPVATEQYGSVQTLNMLQMFGSEDE

SEQ ID NO: 68981 - protein, 31 aa, Artificial Sequence
  Description of Artificial Sequence: Synthetic polypeptide
DEPEIATTNPVATEQYGSVSSNLMNEVGPTH

SEQ ID NO: 68982 - protein, 35 aa, Artificial Sequence
  Description of Artificial Sequence: Synthetic polypeptide
AEEEIRTTNPVATEQYGSVSVTTNLQLQQGTNVNE

SEQ ID NO: 68983 - protein, 31 aa, Artificial Sequence
  Description of Artificial Sequence: Synthetic polypeptide
DESEICTTNPVATDQYGSVVSQNSQNGDNTS

SEQ ID NO: 68984 - protein, 35 aa, Artificial Sequence
  Description of Artificial Sequence: Synthetic polypeptide
AEEEIRTTNPVATEQYGSVSVTTNLQNQQQGTNVE

SEQ ID NO: 68985 - protein, 35 aa, Artificial Sequence
  Description of Artificial Sequence: Synthetic polypeptide
AEEEIRTTNPVATEQYGSVSTVVNLEQGNNQGNVT

SEQ ID NO: 68986 - protein, 34 aa, Artificial Sequence
  Description of Artificial Sequence: Synthetic polypeptide
DEEEIRTTNPVATEQYGSVSTYTLSMQYLVNPEG

SEQ ID NO: 68987 - protein, 34 aa, Artificial Sequence
  Description of Artificial Sequence: Synthetic polypeptide
DEEEIRTTNPVATEQYGSVSTYTNLNETPVNLEI

SEQ ID NO: 68988 - protein, 33 aa, Artificial Sequence
  Description of Artificial Sequence: Synthetic polypeptide
DESEICTTNPVATECYGSVSTGGNLGQSGGNDI

SEQ ID NO: 68989 - protein, 33 aa, Artificial Sequence
  Description of Artificial Sequence: Synthetic polypeptide
DESEICTTNPVATECYGSVSTGLNDDQRQGNTM

SEQ ID NO: 68990 - protein, 35 aa, Artificial Sequence
  Description of Artificial Sequence: Synthetic polypeptide
AEEEIRTTNPVATEQYGSVSVTTNLQQGDEGNNTE

SEQ ID NO: 68991 - protein, 30 aa, Artificial Sequence
  Description of Artificial Sequence: Synthetic polypeptide
QEQEIATTNPVSTEQYGSVSATDLEDHGER

SEQ ID NO: 68992 - protein, 32 aa, Artificial Sequence
  Description of Artificial Sequence: Synthetic polypeptide
DEEEIRTTNPVATEQYGSISSLMPMLQIDNWA

SEQ ID NO: 68993 - protein, 31 aa, Artificial Sequence
  Description of Artificial Sequence: Synthetic polypeptide
DEAEIRTTNPVATEQYGSVQWTTLESEDNQY

SEQ ID NO: 68994 - protein, 29 aa, Artificial Sequence
  Description of Artificial Sequence: Synthetic peptide
QEQEIATTNPVATEQYGVVSTDLEHGEDI

SEQ ID NO: 68995 - protein, 34 aa, Artificial Sequence
  Description of Artificial Sequence: Synthetic polypeptide
QEEEIRTTNPVATEQYGSVGSTNGGQTGGGNGEG

SEQ ID NO: 68996 - protein, 34 aa, Artificial Sequence
  Description of Artificial Sequence: Synthetic polypeptide
QEEEIRTTNPVATEQYGSVGSTDLIQGGEGNEDE

SEQ ID NO: 68997 - protein, 33 aa, Artificial Sequence
  Description of Artificial Sequence: Synthetic polypeptide
DEAEIRTTNPVATEQYGSVSCTQNLNDRSIEDN

SEQ ID NO: 68998 - protein, 34 aa, Artificial Sequence
  Description of Artificial Sequence: Synthetic polypeptide
QEEEIRTTNPVATEQYGSVGSTDLGQGGGEENED

SEQ ID NO: 68999 - protein, 29 aa, Artificial Sequence
  Description of Artificial Sequence: Synthetic peptide
QEQEIATTNPVATEQYGSVSEDLQDHEEL

SEQ ID NO: 69000 - protein, 30 aa, Artificial Sequence
  Description of Artificial Sequence: Synthetic polypeptide
QEQEIATTNPVATEQYGSVSEDLQDHEGEL

SEQ ID NO: 69001 - protein, 33 aa, Artificial Sequence
  Description of Artificial Sequence: Synthetic polypeptide
DEAEIRTTNPVATEQYGSVSCTNGGQEGSKQFK

SEQ ID NO: 69002 - protein, 31 aa, Artificial Sequence
  Description of Artificial Sequence: Synthetic polypeptide
DESEIATTNPVSTEQYGSVSANDIQDHEGER

SEQ ID NO: 69003 - protein, 32 aa, Artificial Sequence
  Description of Artificial Sequence: Synthetic polypeptide
DESEIATTNPVSTEQYGSVSANDLQDHEGEDR

SEQ ID NO: 69004 - protein, 33 aa, Artificial Sequence
  Description of Artificial Sequence: Synthetic polypeptide
DEEEIRTTNPVATEQYGSVETTGMQPEDGQLDR

SEQ ID NO: 69005 - protein, 35 aa, Artificial Sequence
  Description of Artificial Sequence: Synthetic polypeptide
AEEEIRTTNPVATEQYGSVSVTTNLGQNIGTNNEV

SEQ ID NO: 69006 - protein, 30 aa, Artificial Sequence
  Description of Artificial Sequence: Synthetic polypeptide
QEQEIATTNPVATEQYGSVSTDLEDHGEDL

SEQ ID NO: 69007 - protein, 31 aa, Artificial Sequence
  Description of Artificial Sequence: Synthetic polypeptide
DEAEIRTTNPVATEQYGSVSCSESLQMTEDI

SEQ ID NO: 69008 - protein, 32 aa, Artificial Sequence
  Description of Artificial Sequence: Synthetic polypeptide
DEPEIATTNPVAYEQWGSVSTNLQGDAGNNEE

SEQ ID NO: 69009 - protein, 30 aa, Artificial Sequence
  Description of Artificial Sequence: Synthetic polypeptide
QEQEIATTNPVATEQYGSVSTDLQDHEEEL

SEQ ID NO: 69010 - protein, 31 aa, Artificial Sequence
  Description of Artificial Sequence: Synthetic polypeptide
DEPEIATTNPVAYEQWGSVSTNLQEGGGGDA

SEQ ID NO: 69011 - protein, 34 aa, Artificial Sequence
  Description of Artificial Sequence: Synthetic polypeptide
DEEEIRTTNPVATEQYGSVETTILNQERVGIDID

SEQ ID NO: 69012 - protein, 30 aa, Artificial Sequence
  Description of Artificial Sequence: Synthetic polypeptide
DESEIATVNPVATEQYGVVSDNEQDSEGNQ

SEQ ID NO: 69013 - protein, 30 aa, Artificial Sequence
  Description of Artificial Sequence: Synthetic polypeptide
DEPEIATTNPVATWQYGMVSTTQEQETVNR

SEQ ID NO: 69014 - protein, 29 aa, Artificial Sequence
  Description of Artificial Sequence: Synthetic peptide
DESEIATVNPVCTEQWGVVSDNEQREGNQ

SEQ ID NO: 69015 - protein, 33 aa, Artificial Sequence
  Description of Artificial Sequence: Synthetic polypeptide
DEEEIRTTNPVATEQYGSISSTPNLEPEMTETR

SEQ ID NO: 69016 - protein, 33 aa, Artificial Sequence
  Description of Artificial Sequence: Synthetic polypeptide
DESEICTTNPVATEHYGSVSTTNGGQDTGGNPR

SEQ ID NO: 69017 - protein, 30 aa, Artificial Sequence
  Description of Artificial Sequence: Synthetic polypeptide
DESEIRSTNPVATEGYGSVACTLQDRGEDG

SEQ ID NO: 69018 - protein, 35 aa, Artificial Sequence
  Description of Artificial Sequence: Synthetic polypeptide
AEEEIRTTNPVATEQYGSVSVTTNLQQNDEGNNET

SEQ ID NO: 69019 - protein, 34 aa, Artificial Sequence
  Description of Artificial Sequence: Synthetic polypeptide
DEEEIRTTNPVATEQYGSVSVANLENRIPENNQG

SEQ ID NO: 69020 - protein, 32 aa, Artificial Sequence
  Description of Artificial Sequence: Synthetic polypeptide
DESEICTTNPVATEPYGSVSTGGNAGQSGNDI

SEQ ID NO: 69021 - protein, 28 aa, Artificial Sequence
  Description of Artificial Sequence: Synthetic peptide
QESEIACTNPVATEQYGEASETLQHGGR

SEQ ID NO: 69022 - protein, 28 aa, Artificial Sequence
  Description of Artificial Sequence: Synthetic peptide
QESEIACTNPVATEQYGVAAENLQHGDR

SEQ ID NO: 69023 - protein, 35 aa, Artificial Sequence
  Description of Artificial Sequence: Synthetic polypeptide
AEEEIRTTNPVATEQYGSVSVTTNNLNQLGNAEGN

SEQ ID NO: 69024 - protein, 33 aa, Artificial Sequence
  Description of Artificial Sequence: Synthetic polypeptide
DESEICTTNPVATEPYGSVSTGNGLDQSGGNEI

SEQ ID NO: 69025 - protein, 33 aa, Artificial Sequence
  Description of Artificial Sequence: Synthetic polypeptide
CEEEIRTTNPVATEQYGCVCSTGNLQNFGSEQF

SEQ ID NO: 69026 - protein, 34 aa, Artificial Sequence
  Description of Artificial Sequence: Synthetic polypeptide
DEEEIRTTNPVATEQYGSVSVDNLPTRFGIEVDS

SEQ ID NO: 69027 - protein, 32 aa, Artificial Sequence
  Description of Artificial Sequence: Synthetic polypeptide
DESEICTTNPVATEPYGSVSTPNGPQDSGGNI

SEQ ID NO: 69028 - protein, 33 aa, Artificial Sequence
  Description of Artificial Sequence: Synthetic polypeptide
QEEEIRTTNPVATEQYGQVSTMTNGQEGGENII

SEQ ID NO: 69029 - protein, 32 aa, Artificial Sequence
  Description of Artificial Sequence: Synthetic polypeptide
CEEEIRTTNPVATEQYGCVCSTGELQNGSEAN

SEQ ID NO: 69030 - protein, 31 aa, Artificial Sequence
  Description of Artificial Sequence: Synthetic polypeptide
DESEICTTNPVATEPYGVVSTGDNHQGGNTI

SEQ ID NO: 69031 - protein, 35 aa, Artificial Sequence
  Description of Artificial Sequence: Synthetic polypeptide
AEEEIRTTNPVATEQYGSVSVTTNNLNQQGNNANN

SEQ ID NO: 69032 - protein, 35 aa, Artificial Sequence
  Description of Artificial Sequence: Synthetic polypeptide
AEEEIRTTNPVATEQYGSVSVTTNNLQLQAGNNNE

SEQ ID NO: 69033 - protein, 34 aa, Artificial Sequence
  Description of Artificial Sequence: Synthetic polypeptide
DEEEIRTTNPVATEQYGSVFGDINLDQGNGNNGN

SEQ ID NO: 69034 - protein, 33 aa, Artificial Sequence
  Description of Artificial Sequence: Synthetic polypeptide
DESEICTTNPVATEQYGCVSTNLNGDAGGGNGR

SEQ ID NO: 69035 - protein, 34 aa, Artificial Sequence
  Description of Artificial Sequence: Synthetic polypeptide
DEEEIRTTNPVATEQYGSVFGDINLEQGGNGNGN

SEQ ID NO: 69036 - protein, 34 aa, Artificial Sequence
  Description of Artificial Sequence: Synthetic polypeptide
DEEEIRTTNPVATEQYGSVFGDINLNQGGEGNGE

SEQ ID NO: 69037 - protein, 34 aa, Artificial Sequence
  Description of Artificial Sequence: Synthetic polypeptide
DEEEIRTTNPVATEQYGSVFGDINLNQGGGNNNQ

SEQ ID NO: 69038 - protein, 34 aa, Artificial Sequence
  Description of Artificial Sequence: Synthetic polypeptide
CEEEIRTTNPVATEQYGCVCSTNDLQEHFGSNQA

SEQ ID NO: 69039 - protein, 33 aa, Artificial Sequence
  Description of Artificial Sequence: Synthetic polypeptide
CEEEIRTTNPVATEQYGCVCSTNHNQSFGSNDE

SEQ ID NO: 69040 - protein, 28 aa, Artificial Sequence
  Description of Artificial Sequence: Synthetic peptide
QESEIACTNPVATEQYGVVASTLMRGDI

SEQ ID NO: 69041 - protein, 32 aa, Artificial Sequence
  Description of Artificial Sequence: Synthetic polypeptide
DESEICTTNPVATEPYGSVSTGENDQDSGGNA

SEQ ID NO: 69042 - protein, 33 aa, Artificial Sequence
  Description of Artificial Sequence: Synthetic polypeptide
DEEEIRTTNPVATEQYGSVFENSLIQVAELERQ

SEQ ID NO: 69043 - protein, 34 aa, Artificial Sequence
  Description of Artificial Sequence: Synthetic polypeptide
AEEEIRTTNPVATEQYGSVSVTTNNGNQQGNNQD

SEQ ID NO: 69044 - protein, 33 aa, Artificial Sequence
  Description of Artificial Sequence: Synthetic polypeptide
DEEEIRTTNPVATEQYGSVEVNNDLEETPLNER

SEQ ID NO: 69045 - protein, 33 aa, Artificial Sequence
  Description of Artificial Sequence: Synthetic polypeptide
DEEEIRATNPVATEQWGCVYSMTNDFQGGGNQR

SEQ ID NO: 69046 - protein, 34 aa, Artificial Sequence
  Description of Artificial Sequence: Synthetic polypeptide
DEEEIRTTNPVATEQYGSVEVPNDLGGMEGGNER

SEQ ID NO: 69047 - protein, 35 aa, Artificial Sequence
  Description of Artificial Sequence: Synthetic polypeptide
AEEEIRTTNPVATEQYGSVSVTTNLQQNQEGNNVE

SEQ ID NO: 69048 - protein, 31 aa, Artificial Sequence
  Description of Artificial Sequence: Synthetic polypeptide
DESEICTTNPVATEPWGSVSTGDNHQEGNTI

SEQ ID NO: 69049 - protein, 33 aa, Artificial Sequence
  Description of Artificial Sequence: Synthetic polypeptide
DECEICTTNPVATEQYGSVSTVNLLNQQNGEEG

SEQ ID NO: 69050 - protein, 33 aa, Artificial Sequence
  Description of Artificial Sequence: Synthetic polypeptide
DEEEIRTTNPVATEQYGSVEVTMPLDDEGMVER

SEQ ID NO: 69051 - protein, 34 aa, Artificial Sequence
  Description of Artificial Sequence: Synthetic polypeptide
DECEICTTNPVATEQYGSVSTVNLNEQQGNNETD

SEQ ID NO: 69052 - protein, 35 aa, Artificial Sequence
  Description of Artificial Sequence: Synthetic polypeptide
AEEEIRTTNPVATEQYGSVSVTTNLQQQQGTNDEE

SEQ ID NO: 69053 - protein, 35 aa, Artificial Sequence
  Description of Artificial Sequence: Synthetic polypeptide
AEEEIRTTNPVATEQYGSVSVTTNLQQQQQGTNED

SEQ ID NO: 69054 - protein, 34 aa, Artificial Sequence
  Description of Artificial Sequence: Synthetic polypeptide
DECEICTTNPVATEQYGSVSTVNLNGNQQGNNTD

SEQ ID NO: 69055 - protein, 28 aa, Artificial Sequence
  Description of Artificial Sequence: Synthetic peptide
QESEIACTNPVATEGYGEMSENLQRGDI

SEQ ID NO: 69056 - protein, 30 aa, Artificial Sequence
  Description of Artificial Sequence: Synthetic polypeptide
DEPEIATTNPVATDQYGMVSVALVRTGNDI

SEQ ID NO: 69057 - protein, 31 aa, Artificial Sequence
  Description of Artificial Sequence: Synthetic polypeptide
DEEEIRTTNPVATEQYGSVSVDADYTFSQVR

SEQ ID NO: 69058 - protein, 31 aa, Artificial Sequence
  Description of Artificial Sequence: Synthetic polypeptide
QEEEIRTTNPVATEQYGSCSPEHEQVQGTNH

SEQ ID NO: 69059 - protein, 33 aa, Artificial Sequence
  Description of Artificial Sequence: Synthetic polypeptide
DESEICTTNPVATEPYGSVSTDNGLQDSQGNDI

SEQ ID NO: 69060 - protein, 33 aa, Artificial Sequence
  Description of Artificial Sequence: Synthetic polypeptide
DESEICTTNPVATEPYGSVSTDNNGLQDSGNEI

SEQ ID NO: 69061 - protein, 33 aa, Artificial Sequence
  Description of Artificial Sequence: Synthetic polypeptide
DEEEIATTNPVATEQYGSVCAADNNLADDDGNR

SEQ ID NO: 69062 - protein, 34 aa, Artificial Sequence
  Description of Artificial Sequence: Synthetic polypeptide
DEEEIRTTNPVATEQYGSVFCTDNGGQHRNGKDD

SEQ ID NO: 69063 - protein, 33 aa, Artificial Sequence
  Description of Artificial Sequence: Synthetic polypeptide
DEEEIATTNPVATEQYGSVCAADNHLQDSDGSR

SEQ ID NO: 69064 - protein, 28 aa, Artificial Sequence
  Description of Artificial Sequence: Synthetic peptide
QESEIACTNPVATEQYGEAAENLQRGDI

SEQ ID NO: 69065 - protein, 34 aa, Artificial Sequence
  Description of Artificial Sequence: Synthetic polypeptide
AEEEIRTTNPVATEQYGSVSVTTNLQQNDNGEDT

SEQ ID NO: 69066 - protein, 33 aa, Artificial Sequence
  Description of Artificial Sequence: Synthetic polypeptide
QEEEIRTTNPVATEQYGSVGTDNGDNQNEGGNG

SEQ ID NO: 69067 - protein, 32 aa, Artificial Sequence
  Description of Artificial Sequence: Synthetic polypeptide
DEAEIRTTNPVATEQYGSVISTDNEFGESNEH

SEQ ID NO: 69068 - protein, 34 aa, Artificial Sequence
  Description of Artificial Sequence: Synthetic polypeptide
DEAEIRTTNPVATEQYGSVISPTNDLNNNGSNQE

SEQ ID NO: 69069 - protein, 33 aa, Artificial Sequence
  Description of Artificial Sequence: Synthetic polypeptide
DEEEIRTTNPVATEQYGSVGGMGNLDEGQNITA

SEQ ID NO: 69070 - protein, 36 aa, Artificial Sequence
  Description of Artificial Sequence: Synthetic polypeptide
DEEEIRTTNPVATEQYGSVSVSTNNLQAGTNSTNQD

SEQ ID NO: 69071 - protein, 30 aa, Artificial Sequence
  Description of Artificial Sequence: Synthetic polypeptide
QEEEIRTTNPVATECYGSVSEALNMRNEEL

SEQ ID NO: 69072 - protein, 30 aa, Artificial Sequence
  Description of Artificial Sequence: Synthetic polypeptide
QEEEIRTTNPVATECYGSVSEAGNMRNENL

SEQ ID NO: 69073 - protein, 33 aa, Artificial Sequence
  Description of Artificial Sequence: Synthetic polypeptide
QEEEIRTTNPVATECYGSVSCINEPQDREGENG

SEQ ID NO: 69074 - protein, 33 aa, Artificial Sequence
  Description of Artificial Sequence: Synthetic polypeptide
DEAEIRTTNPVATEQYGSVCSTNSHERTGSEDQ

SEQ ID NO: 69075 - protein, 34 aa, Artificial Sequence
  Description of Artificial Sequence: Synthetic polypeptide
AEEEIRTTNPVATEQYGSVSVTTNQQQLQTNNND

SEQ ID NO: 69076 - protein, 29 aa, Artificial Sequence
  Description of Artificial Sequence: Synthetic peptide
DESEIRTTNPQATSHYGSVWTTNQERTNN

SEQ ID NO: 69077 - protein, 36 aa, Artificial Sequence
  Description of Artificial Sequence: Synthetic polypeptide
DEEEIRTTNPVATEQYGSVSVSTNNLQQGNNNNIID

SEQ ID NO: 69078 - protein, 34 aa, Artificial Sequence
  Description of Artificial Sequence: Synthetic polypeptide
AEEEIRTTNPVATEQYGSVSVTTNQQNQQGTNNS

SEQ ID NO: 69079 - protein, 34 aa, Artificial Sequence
  Description of Artificial Sequence: Synthetic polypeptide
AEEEIRTTNPVATEQYGSVSVTTNQQQQGNNQTQ

SEQ ID NO: 69080 - protein, 36 aa, Artificial Sequence
  Description of Artificial Sequence: Synthetic polypeptide
DEEEIRTTNPVATEQYGSVSVSTNNLQQGNNNNQNE

SEQ ID NO: 69081 - protein, 34 aa, Artificial Sequence
  Description of Artificial Sequence: Synthetic polypeptide
AEEEIRTTNPVATEQYGSVSVTTNQQQQQGTNTE

SEQ ID NO: 69082 - protein, 34 aa, Artificial Sequence
  Description of Artificial Sequence: Synthetic polypeptide
AEEEIRTTNPVATEQYGSVSVTTNQQQQQNGNND

SEQ ID NO: 69083 - protein, 34 aa, Artificial Sequence
  Description of Artificial Sequence: Synthetic polypeptide
AEEEIRTTNPVATEQYGSVSVTTNTGNQLGNEEV

SEQ ID NO: 69084 - protein, 28 aa, Artificial Sequence
  Description of Artificial Sequence: Synthetic peptide
QEEEIRTTNPIATEQYGEAPEVCQHENR

SEQ ID NO: 69085 - protein, 36 aa, Artificial Sequence
  Description of Artificial Sequence: Synthetic polypeptide
DEEEIRTTNPVATEQYGSVSVSTTNLQAGNNNNGVD

SEQ ID NO: 69086 - protein, 34 aa, Artificial Sequence
  Description of Artificial Sequence: Synthetic polypeptide
AEEEIRTTNPVATEQYGSVSVTTQLGQGTQIGNG

SEQ ID NO: 69087 - protein, 36 aa, Artificial Sequence
  Description of Artificial Sequence: Synthetic polypeptide
DEEEIRTTNPVATEQYGSVSVSTTNLQAGTNANNID

SEQ ID NO: 69088 - protein, 34 aa, Artificial Sequence
  Description of Artificial Sequence: Synthetic polypeptide
AEEEIRTTNPVATEQYGSVSVTTTNLQEGTVEDE

SEQ ID NO: 69089 - protein, 34 aa, Artificial Sequence
  Description of Artificial Sequence: Synthetic polypeptide
AEEEIRTTNPVATEQYGSVSVTTNQQQQGNNTED

SEQ ID NO: 69090 - protein, 34 aa, Artificial Sequence
  Description of Artificial Sequence: Synthetic polypeptide
DEEEIRTTNPVATEQYGSVSTNLGNSQVPFQVDN

SEQ ID NO: 69091 - protein, 31 aa, Artificial Sequence
  Description of Artificial Sequence: Synthetic polypeptide
DESEIRTTNPIAYEQYGSVSCINISDRGGND

SEQ ID NO: 69092 - protein, 31 aa, Artificial Sequence
  Description of Artificial Sequence: Synthetic polypeptide
QEEEIRTTNPVATECYGSVSTEAGNMRNENV

SEQ ID NO: 69093 - protein, 33 aa, Artificial Sequence
  Description of Artificial Sequence: Synthetic polypeptide
DEEEIRTTNPVATEQYGSVGDTNNIGQGEGGEG

SEQ ID NO: 69094 - protein, 35 aa, Artificial Sequence
  Description of Artificial Sequence: Synthetic polypeptide
DEAEIRTTNPVATEQYGSVCSTSNLGDGNQGNEGR

SEQ ID NO: 69095 - protein, 34 aa, Artificial Sequence
  Description of Artificial Sequence: Synthetic polypeptide
DEEEIRTTNPVATEQYGSVGDTNTDGQENIGNET

SEQ ID NO: 69096 - protein, 34 aa, Artificial Sequence
  Description of Artificial Sequence: Synthetic polypeptide
DEEEIRTTNPVATEQYGSGMPTEENLQRVGVELF

SEQ ID NO: 69097 - protein, 29 aa, Artificial Sequence
  Description of Artificial Sequence: Synthetic peptide
DENEIRTTNPVSTEPYGTMSSETLQQGNH

SEQ ID NO: 69098 - protein, 33 aa, Artificial Sequence
  Description of Artificial Sequence: Synthetic polypeptide
DEEEIRTTNPVATEQYGSVGDTTDGQGTGNENI

SEQ ID NO: 69099 - protein, 34 aa, Artificial Sequence
  Description of Artificial Sequence: Synthetic polypeptide
DEEEIRTTNPVATEQYGSVGDTTDNGQEEGGNNS

SEQ ID NO: 69100 - protein, 32 aa, Artificial Sequence
  Description of Artificial Sequence: Synthetic polypeptide
DEEEIATTNPVATEQYGSVATNDQDAGDEPGT

SEQ ID NO: 69101 - protein, 34 aa, Artificial Sequence
  Description of Artificial Sequence: Synthetic polypeptide
DEEEIRTTNPVATEQYGSVGDTVNNFQNEGGNGG

SEQ ID NO: 69102 - protein, 31 aa, Artificial Sequence
  Description of Artificial Sequence: Synthetic polypeptide
QEEEIRTTNPVATECYGSVSTEAGNMRNENL

SEQ ID NO: 69103 - protein, 31 aa, Artificial Sequence
  Description of Artificial Sequence: Synthetic polypeptide
QEEEIRTTNPVATEFYGSVPDIPLTQIEGPR

SEQ ID NO: 69104 - protein, 36 aa, Artificial Sequence
  Description of Artificial Sequence: Synthetic polypeptide
DEEEIRTTNPVATEQYGSVSVSTNNLQAGNNNNDIN

SEQ ID NO: 69105 - protein, 33 aa, Artificial Sequence
  Description of Artificial Sequence: Synthetic polypeptide
DEEEIATTNPVATEQYGSVATNALTETRGGEEN

SEQ ID NO: 69106 - protein, 33 aa, Artificial Sequence
  Description of Artificial Sequence: Synthetic polypeptide
DEEEIRTTNPVATEQYGSVGENLDFGRNQEDQQ

SEQ ID NO: 69107 - protein, 31 aa, Artificial Sequence
  Description of Artificial Sequence: Synthetic polypeptide
DECEICTTNPVATTQYGVVSTSLQLGGNTDE

SEQ ID NO: 69108 - protein, 31 aa, Artificial Sequence
  Description of Artificial Sequence: Synthetic polypeptide
DECEICTTNPVATTQYGVVSTTALQQGNNEE

SEQ ID NO: 69109 - protein, 34 aa, Artificial Sequence
  Description of Artificial Sequence: Synthetic polypeptide
DEEEIRTTNPVATEQYGSVGEPTENLVQDQNLQT

SEQ ID NO: 69110 - protein, 34 aa, Artificial Sequence
  Description of Artificial Sequence: Synthetic polypeptide
AEEEIRTTNPVATEQYGSVSVTTNQQGNLQGNND

SEQ ID NO: 69111 - protein, 33 aa, Artificial Sequence
  Description of Artificial Sequence: Synthetic polypeptide
QEEEIRTTNPVATECYGSVSTPCGPQMRGMNPL

SEQ ID NO: 69112 - protein, 29 aa, Artificial Sequence
  Description of Artificial Sequence: Synthetic peptide
DENEIRTTNPVSTEPYGTMSSEDLQQGNH

SEQ ID NO: 69113 - protein, 32 aa, Artificial Sequence
  Description of Artificial Sequence: Synthetic polypeptide
DECEICTTNPVATTQYGVVSTNTNLQAGNTDT

SEQ ID NO: 69114 - protein, 33 aa, Artificial Sequence
  Description of Artificial Sequence: Synthetic polypeptide
QEEEIRTTNPCATEQYGSVSTCPALPNMRGNPV

SEQ ID NO: 69115 - protein, 33 aa, Artificial Sequence
  Description of Artificial Sequence: Synthetic polypeptide
DEEEIRTTNPVATEQYGSVGGTGEVVMGLNPRD

SEQ ID NO: 69116 - protein, 35 aa, Artificial Sequence
  Description of Artificial Sequence: Synthetic polypeptide
DEEEIRTTNPVATEQYGSVSVSVNNLQQGNNNQIQ

SEQ ID NO: 69117 - protein, 29 aa, Artificial Sequence
  Description of Artificial Sequence: Synthetic peptide
DENEIRTTNPVSTEPYGTISENIQQRGGH

SEQ ID NO: 69118 - protein, 29 aa, Artificial Sequence
  Description of Artificial Sequence: Synthetic peptide
DENEIRTTNPVSTEPYGTISENIQQQGNH

SEQ ID NO: 69119 - protein, 28 aa, Artificial Sequence
  Description of Artificial Sequence: Synthetic peptide
QESEIASTNPVGTEQYGEAASNLQRGGR

SEQ ID NO: 69120 - protein, 31 aa, Artificial Sequence
  Description of Artificial Sequence: Synthetic polypeptide
DESEIRTTNPVATAHWGSVSTNLNQGTDNDM

SEQ ID NO: 69121 - protein, 29 aa, Artificial Sequence
  Description of Artificial Sequence: Synthetic peptide
QEEEIRSTNPVATEGYGSVSSAGQHGMDV

SEQ ID NO: 69122 - protein, 32 aa, Artificial Sequence
  Description of Artificial Sequence: Synthetic polypeptide
DEEEIRTTNPVATEQYGSVGNDGQNVGNGGNQ

SEQ ID NO: 69123 - protein, 34 aa, Artificial Sequence
  Description of Artificial Sequence: Synthetic polypeptide
AEEEIRTTNPVATEQYGSVSVTVNDQAGNTNNAE

SEQ ID NO: 69124 - protein, 32 aa, Artificial Sequence
  Description of Artificial Sequence: Synthetic polypeptide
DEAEIRTTNPVATEQYGSVCSMVDQIRGGQDE

SEQ ID NO: 69125 - protein, 28 aa, Artificial Sequence
  Description of Artificial Sequence: Synthetic peptide
QESEIASTNPVGTEQYGEAASTLQRGDR

SEQ ID NO: 69126 - protein, 32 aa, Artificial Sequence
  Description of Artificial Sequence: Synthetic polypeptide
DEEEIATTNPVATEQYGSVATGNDNDSENDRE

SEQ ID NO: 69127 - protein, 28 aa, Artificial Sequence
  Description of Artificial Sequence: Synthetic peptide
QESEIASTNPVGTEQYGEAASTLQRGGR

SEQ ID NO: 69128 - protein, 33 aa, Artificial Sequence
  Description of Artificial Sequence: Synthetic polypeptide
DEEEIRTTNPVATEQYGSVGNNDNGQSGGNQGE

SEQ ID NO: 69129 - protein, 28 aa, Artificial Sequence
  Description of Artificial Sequence: Synthetic peptide
QESEIASTNPVGTEQYGEASSNLQRGDI

SEQ ID NO: 69130 - protein, 34 aa, Artificial Sequence
  Description of Artificial Sequence: Synthetic polypeptide
DEEEIRTTNPVATEQYGSVGNNGNLQQGEQENEQ

SEQ ID NO: 69131 - protein, 31 aa, Artificial Sequence
  Description of Artificial Sequence: Synthetic polypeptide
DEEEIRTTNPVATEQYGSVSVTLDPTEVVVV

SEQ ID NO: 69132 - protein, 33 aa, Artificial Sequence
  Description of Artificial Sequence: Synthetic polypeptide
DEEEIRTTNPVATEQYGSVSVTLLDNPEVGLVV

SEQ ID NO: 69133 - protein, 34 aa, Artificial Sequence
  Description of Artificial Sequence: Synthetic polypeptide
DEEEIRTTNPVATEQYGSVSVTLMTEHFGNEERY

SEQ ID NO: 69134 - protein, 34 aa, Artificial Sequence
  Description of Artificial Sequence: Synthetic polypeptide
DEEEIRTTNPVATEQYGSVSVTLMTEKFGNNNRY

SEQ ID NO: 69135 - protein, 28 aa, Artificial Sequence
  Description of Artificial Sequence: Synthetic peptide
QESEIASTNPVGTEQYGIVSSTLQSGTR

SEQ ID NO: 69136 - protein, 35 aa, Artificial Sequence
  Description of Artificial Sequence: Synthetic polypeptide
DEEEIRTTNPVATEQYGSVSVTLNMTEAFGNNNRE

SEQ ID NO: 69137 - protein, 32 aa, Artificial Sequence
  Description of Artificial Sequence: Synthetic polypeptide
DEEEIRATNPVATEQYGMVSMTDGFQGGDNNE

SEQ ID NO: 69138 - protein, 33 aa, Artificial Sequence
  Description of Artificial Sequence: Synthetic polypeptide
DEEEIRTTNPVATEQYGSFVSTGNVIQWHDAEL

SEQ ID NO: 69139 - protein, 33 aa, Artificial Sequence
  Description of Artificial Sequence: Synthetic polypeptide
DEEEIRTTNPVATEQYGSVGLNLPHGDNTQLDQ

SEQ ID NO: 69140 - protein, 29 aa, Artificial Sequence
  Description of Artificial Sequence: Synthetic peptide
DENEIRTTNPVSTEPYGTISMDLQQHGNH

SEQ ID NO: 69141 - protein, 28 aa, Artificial Sequence
  Description of Artificial Sequence: Synthetic peptide
QESEIASTNPVGTEGYGVVASTLQHGNR

SEQ ID NO: 69142 - protein, 34 aa, Artificial Sequence
  Description of Artificial Sequence: Synthetic polypeptide
DEEEIRTTNPVATEQYGSFWTVNPLFDREGENVE

SEQ ID NO: 69143 - protein, 32 aa, Artificial Sequence
  Description of Artificial Sequence: Synthetic polypeptide
DEAEIRTTNPVATEQYGSVCSTEHQYFGSEQL

SEQ ID NO: 69144 - protein, 33 aa, Artificial Sequence
  Description of Artificial Sequence: Synthetic polypeptide
DEAEIRTTNPVATEQYGSVCSTDGPQHPGDNAE

SEQ ID NO: 69145 - protein, 33 aa, Artificial Sequence
  Description of Artificial Sequence: Synthetic polypeptide
DEEEIRTTNPVATEQYGSVSVTAVSETGELNQD

SEQ ID NO: 69146 - protein, 34 aa, Artificial Sequence
  Description of Artificial Sequence: Synthetic polypeptide
DEEEIRATNPVATEQYGDVSMTNLFQGGGGDNDQ

SEQ ID NO: 69147 - protein, 34 aa, Artificial Sequence
  Description of Artificial Sequence: Synthetic polypeptide
DEEEIRTTNPVATEQYGSVGGTNDGQTGGGNENT

SEQ ID NO: 69148 - protein, 34 aa, Artificial Sequence
  Description of Artificial Sequence: Synthetic polypeptide
DEEEIRATNPVATEQYGDVSNTNNLQSDVGGNGG

SEQ ID NO: 69149 - protein, 33 aa, Artificial Sequence
  Description of Artificial Sequence: Synthetic polypeptide
DEEEIATTNPVATEQYGSVATNALDQTAPGEDF

SEQ ID NO: 69150 - protein, 29 aa, Artificial Sequence
  Description of Artificial Sequence: Synthetic peptide
DENEIRTTNPVSTEPYGTISMNIQQQGNH

SEQ ID NO: 69151 - protein, 31 aa, Artificial Sequence
  Description of Artificial Sequence: Synthetic polypeptide
DEEEIRATNPVATEQYGDVVMTNGFQGGGTT

SEQ ID NO: 69152 - protein, 32 aa, Artificial Sequence
  Description of Artificial Sequence: Synthetic polypeptide
DEEEIRATNPVATEQYGDVVMTNGFQTGGNTS

SEQ ID NO: 69153 - protein, 34 aa, Artificial Sequence
  Description of Artificial Sequence: Synthetic polypeptide
DEEEIRTTNPVATEQYGSVGGTNNGLGENQGGEG

SEQ ID NO: 69154 - protein, 32 aa, Artificial Sequence
  Description of Artificial Sequence: Synthetic polypeptide
DEEEIRTTNPVATEQYGSVGGWNLEVRMEELQ

SEQ ID NO: 69155 - protein, 31 aa, Artificial Sequence
  Description of Artificial Sequence: Synthetic polypeptide
DESEIRTTNPVASECWGSVSCINEQREGENG

SEQ ID NO: 69156 - protein, 33 aa, Artificial Sequence
  Description of Artificial Sequence: Synthetic polypeptide
DEEEIRATNPVATEQYGDVVMTNLFQGGGENEG

SEQ ID NO: 69157 - protein, 32 aa, Artificial Sequence
  Description of Artificial Sequence: Synthetic polypeptide
DEEEIRTTNPVATEQYGSVSVTGHPRLLVEDT

SEQ ID NO: 69158 - protein, 29 aa, Artificial Sequence
  Description of Artificial Sequence: Synthetic peptide
DENEIRTTNPVSTEPYGTISMDLQQQGNH

SEQ ID NO: 69159 - protein, 31 aa, Artificial Sequence
  Description of Artificial Sequence: Synthetic polypeptide
DESEIRTTNPVATAHWGSVSTNDGQRDTNNM

SEQ ID NO: 69160 - protein, 34 aa, Artificial Sequence
  Description of Artificial Sequence: Synthetic polypeptide
AEEEIRTTNPVATEQYGSVSVTVNDQAGNNNAED

SEQ ID NO: 69161 - protein, 36 aa, Artificial Sequence
  Description of Artificial Sequence: Synthetic polypeptide
DEEEIRTTNPVATEQYGSFVSTNEDEQQRGNDEEGE

SEQ ID NO: 69162 - protein, 33 aa, Artificial Sequence
  Description of Artificial Sequence: Synthetic polypeptide
QEEEIRTTNPVATEQYGSVSTTPAGNMRNGMNV

SEQ ID NO: 69163 - protein, 33 aa, Artificial Sequence
  Description of Artificial Sequence: Synthetic polypeptide
DEAEIRTTNPVATEQYGSVCSTVNDPQEGFEFL

SEQ ID NO: 69164 - protein, 34 aa, Artificial Sequence
  Description of Artificial Sequence: Synthetic polypeptide
DEEEIRATNPVATEQYGCVCSVNDQMDRQGSNSR

SEQ ID NO: 69165 - protein, 34 aa, Artificial Sequence
  Description of Artificial Sequence: Synthetic polypeptide
DEEEIRTTNPVATEQYGSVGDTNNEQEDGGNNGQ

SEQ ID NO: 69166 - protein, 32 aa, Artificial Sequence
  Description of Artificial Sequence: Synthetic polypeptide
DEEEIRTTNPVATEQYGSVSVQDDTEQQQASI

SEQ ID NO: 69167 - protein, 29 aa, Artificial Sequence
  Description of Artificial Sequence: Synthetic peptide
DENEIRTVNPVCTEQYGVVSEIEQNSGNQ

SEQ ID NO: 69168 - protein, 28 aa, Artificial Sequence
  Description of Artificial Sequence: Synthetic peptide
DESEIRSTNPVATEQWGDMASTLQHGDA

SEQ ID NO: 69169 - protein, 29 aa, Artificial Sequence
  Description of Artificial Sequence: Synthetic peptide
DENEIRTVNPVATEQYGVVSEIEQNSGDQ

SEQ ID NO: 69170 - protein, 28 aa, Artificial Sequence
  Description of Artificial Sequence: Synthetic peptide
DESEIRSTNPVATEQWGDMSSTLQHGDA

SEQ ID NO: 69171 - protein, 32 aa, Artificial Sequence
  Description of Artificial Sequence: Synthetic polypeptide
DESEIRSTNPVATEQWGSVSCINEPQREGENG

SEQ ID NO: 69172 - protein, 30 aa, Artificial Sequence
  Description of Artificial Sequence: Synthetic polypeptide
DENEIRTVNPVATEQYGDVSEILMNSAGNQ

SEQ ID NO: 69173 - protein, 32 aa, Artificial Sequence
  Description of Artificial Sequence: Synthetic polypeptide
DESEIRSTNPVATEQYGNVAANPTIQMRVGNR

SEQ ID NO: 69174 - protein, 30 aa, Artificial Sequence
  Description of Artificial Sequence: Synthetic polypeptide
DENEIRTVNPVATEQYGDVSEILMNAAGNQ

SEQ ID NO: 69175 - protein, 31 aa, Artificial Sequence
  Description of Artificial Sequence: Synthetic polypeptide
DENEIRTVNPVSTEQYGTVSDENLQQQNGNH

SEQ ID NO: 69176 - protein, 30 aa, Artificial Sequence
  Description of Artificial Sequence: Synthetic polypeptide
DENEIRTVNPVATEQYGDVSEILMNAAGNA

SEQ ID NO: 69177 - protein, 33 aa, Artificial Sequence
  Description of Artificial Sequence: Synthetic polypeptide
DEEEIRATNPVATEQWGNTTTSTNELTQGNGNR

SEQ ID NO: 69178 - protein, 29 aa, Artificial Sequence
  Description of Artificial Sequence: Synthetic peptide
DENEIRTVNPVATEQWGDVSENLQNSEDA

SEQ ID NO: 69179 - protein, 31 aa, Artificial Sequence
  Description of Artificial Sequence: Synthetic polypeptide
DEEEIRATNPVATEQWGSVATDPQNGLDNSW

SEQ ID NO: 69180 - protein, 32 aa, Artificial Sequence
  Description of Artificial Sequence: Synthetic polypeptide
DEAEIRTTNPVATEQYGSVHTNLNNMRDEEQN

SEQ ID NO: 69181 - protein, 30 aa, Artificial Sequence
  Description of Artificial Sequence: Synthetic polypeptide
DENEIRTTNPVSTEQYGVVSMEDIQQNGNH

SEQ ID NO: 69182 - protein, 30 aa, Artificial Sequence
  Description of Artificial Sequence: Synthetic polypeptide
DENEIRTTNPVSTEQYGTVSMEDIQQNGNH

SEQ ID NO: 69183 - protein, 30 aa, Artificial Sequence
  Description of Artificial Sequence: Synthetic polypeptide
DESEIRSTNPVATEQYGNVSNTIQSRVEDR

SEQ ID NO: 69184 - protein, 32 aa, Artificial Sequence
  Description of Artificial Sequence: Synthetic polypeptide
DESEIRSTNPVATEQYGSVSTPAGPNMRGNPI

SEQ ID NO: 69185 - protein, 33 aa, Artificial Sequence
  Description of Artificial Sequence: Synthetic polypeptide
DEEEIRTTNPVATEQYGSGWSLPNMLQRDEEII

SEQ ID NO: 69186 - protein, 29 aa, Artificial Sequence
  Description of Artificial Sequence: Synthetic peptide
DENEIRTVNPVATEQWGVVSENLQNSEDA

SEQ ID NO: 69187 - protein, 32 aa, Artificial Sequence
  Description of Artificial Sequence: Synthetic polypeptide
CEEAIRTTNPVATEQYGNVSMTENPQREPNAK

SEQ ID NO: 69188 - protein, 32 aa, Artificial Sequence
  Description of Artificial Sequence: Synthetic polypeptide
DEEEIRTTNPVATEQYGSVFVVDNDHQRQDSI

SEQ ID NO: 69189 - protein, 33 aa, Artificial Sequence
  Description of Artificial Sequence: Synthetic polypeptide
DEEEIRTTNPVATEQYGSVFVVDNDHQRNDNDI

SEQ ID NO: 69190 - protein, 34 aa, Artificial Sequence
  Description of Artificial Sequence: Synthetic polypeptide
DEEEIATTNPVATEQYGSVATNNLQDDPGDEGRN

SEQ ID NO: 69191 - protein, 32 aa, Artificial Sequence
  Description of Artificial Sequence: Synthetic polypeptide
DEEEIRTTNPVATEQYGSVSVPNEHHQTVEES

SEQ ID NO: 69192 - protein, 28 aa, Artificial Sequence
  Description of Artificial Sequence: Synthetic peptide
DENEIVTTNPVATECYGDVSECLQHEEL

SEQ ID NO: 69193 - protein, 33 aa, Artificial Sequence
  Description of Artificial Sequence: Synthetic polypeptide
DEEEIATTNPVATEQYGSVATNLTDRPGPSDQN

SEQ ID NO: 69194 - protein, 31 aa, Artificial Sequence
  Description of Artificial Sequence: Synthetic polypeptide
DENEIVCTNPVATEQYGTVSAEDNPVQFGNR

SEQ ID NO: 69195 - protein, 34 aa, Artificial Sequence
  Description of Artificial Sequence: Synthetic polypeptide
DEEEIRTTNPVATEQYGSVFTTDNTQRENEEHQS

SEQ ID NO: 69196 - protein, 33 aa, Artificial Sequence
  Description of Artificial Sequence: Synthetic polypeptide
DEEEIATTNPVATEQYGSVATNLTDNPGPNDQD

SEQ ID NO: 69197 - protein, 33 aa, Artificial Sequence
  Description of Artificial Sequence: Synthetic polypeptide
DEEEIATTNPVATEQYGSVATNLTADQGDNNDI

SEQ ID NO: 69198 - protein, 33 aa, Artificial Sequence
  Description of Artificial Sequence: Synthetic polypeptide
DEEEIATTNPVATEQYGSVATNLQTDPGGEPVN

SEQ ID NO: 69199 - protein, 31 aa, Artificial Sequence
  Description of Artificial Sequence: Synthetic polypeptide
DESEIRSTNPVATEGYGSVSCTEQDREGENG

SEQ ID NO: 69200 - protein, 34 aa, Artificial Sequence
  Description of Artificial Sequence: Synthetic polypeptide
DEEEIRTTNPVATEQYGSVSVPNSLEDRNENFEN

SEQ ID NO: 69201 - protein, 32 aa, Artificial Sequence
  Description of Artificial Sequence: Synthetic polypeptide
DEEEIRTTNPVATEQYGSVFVGDNDHQQVNID

SEQ ID NO: 69202 - protein, 33 aa, Artificial Sequence
  Description of Artificial Sequence: Synthetic polypeptide
DEEEIATTNPVATEQYGSVATNLQPADSDNSDM

SEQ ID NO: 69203 - protein, 29 aa, Artificial Sequence
  Description of Artificial Sequence: Synthetic peptide
QESEIASTNPVATEQYGSMSSTLQRNGDI

SEQ ID NO: 69204 - protein, 30 aa, Artificial Sequence
  Description of Artificial Sequence: Synthetic polypeptide
QESEIASTNPVATEQYGSMSTTLQMRNGDV

SEQ ID NO: 69205 - protein, 31 aa, Artificial Sequence
  Description of Artificial Sequence: Synthetic polypeptide
DEEEIRTTNPVATEQYGSVSVPPGQTDADLD

SEQ ID NO: 69206 - protein, 33 aa, Artificial Sequence
  Description of Artificial Sequence: Synthetic polypeptide
DEEEIRTTNPVATEQYGSVFVTNLMERAMPEIQ

SEQ ID NO: 69207 - protein, 31 aa, Artificial Sequence
  Description of Artificial Sequence: Synthetic polypeptide
DENEIRTVNPVSTEQYGTVSMENLQQQNGNH

SEQ ID NO: 69208 - protein, 31 aa, Artificial Sequence
  Description of Artificial Sequence: Synthetic polypeptide
DEEEIRTTNPVATEQYGSVSVPSDERMSDGF

SEQ ID NO: 69209 - protein, 32 aa, Artificial Sequence
  Description of Artificial Sequence: Synthetic polypeptide
DEEEIRTTNPVATEQYGSVFVVDNDHQRDDSI

SEQ ID NO: 69210 - protein, 31 aa, Artificial Sequence
  Description of Artificial Sequence: Synthetic polypeptide
DEEEIRTTNPVATEQYGSVSVPSGVQTDPDD

SEQ ID NO: 69211 - protein, 33 aa, Artificial Sequence
  Description of Artificial Sequence: Synthetic polypeptide
QEEEIRTTNPVATEQYGAVVPSTGNLETLGQFR

SEQ ID NO: 69212 - protein, 32 aa, Artificial Sequence
  Description of Artificial Sequence: Synthetic polypeptide
DEEEIATTNPVATEQYGSVATNPQQDDQNNEM

SEQ ID NO: 69213 - protein, 32 aa, Artificial Sequence
  Description of Artificial Sequence: Synthetic polypeptide
DESEIRSTNPVATEQYGSVSTPAGPQMRGDPI

SEQ ID NO: 69214 - protein, 30 aa, Artificial Sequence
  Description of Artificial Sequence: Synthetic polypeptide
DENEIRTTNPVSTEPYGVVSMDLQQQQGNH

SEQ ID NO: 69215 - protein, 32 aa, Artificial Sequence
  Description of Artificial Sequence: Synthetic polypeptide
DEEEIRTTNPVATEQYGSVSVSNNLESYDTID

SEQ ID NO: 69216 - protein, 34 aa, Artificial Sequence
  Description of Artificial Sequence: Synthetic polypeptide
AEEEIRTTNPVATEQYGSVSVTTNNQQQGTNQTQ

SEQ ID NO: 69217 - protein, 29 aa, Artificial Sequence
  Description of Artificial Sequence: Synthetic peptide
CEDVIATTNPVATAQWGSVSTGDLQNGNH

SEQ ID NO: 69218 - protein, 33 aa, Artificial Sequence
  Description of Artificial Sequence: Synthetic polypeptide
DEEEIRTTNPVATEQYGSGVSPMPLQPGVEEAQ

SEQ ID NO: 69219 - protein, 32 aa, Artificial Sequence
  Description of Artificial Sequence: Synthetic polypeptide
QEEEIRTTNPVATEPYGSVSTNELDPQGTFPE

SEQ ID NO: 69220 - protein, 33 aa, Artificial Sequence
  Description of Artificial Sequence: Synthetic polypeptide
DEEEIRATNPVATEQYGCVAATNLDNGMPGNRQ

SEQ ID NO: 69221 - protein, 32 aa, Artificial Sequence
  Description of Artificial Sequence: Synthetic polypeptide
DEEEIRATNPVATEQYGCVAATNLDNMPGGNH

SEQ ID NO: 69222 - protein, 31 aa, Artificial Sequence
  Description of Artificial Sequence: Synthetic polypeptide
DECEICTTNPVATTQYGVVSTALQQGTEGND

SEQ ID NO: 69223 - protein, 32 aa, Artificial Sequence
  Description of Artificial Sequence: Synthetic polypeptide
DEEEIRTTNPVATEQYGSVGDGNGDDENIGNG

SEQ ID NO: 69224 - protein, 28 aa, Artificial Sequence
  Description of Artificial Sequence: Synthetic peptide
DESEIRTTNGVAYCQYGSVSTTNVAGEQ

SEQ ID NO: 69225 - protein, 30 aa, Artificial Sequence
  Description of Artificial Sequence: Synthetic polypeptide
DECEICTTNPVATTQYGVVSTALQSGTTDS

SEQ ID NO: 69226 - protein, 31 aa, Artificial Sequence
  Description of Artificial Sequence: Synthetic polypeptide
DECEICTTNPVATTQYGVVSTDLQAGTNTDN

SEQ ID NO: 69227 - protein, 33 aa, Artificial Sequence
  Description of Artificial Sequence: Synthetic polypeptide
DEEEIRATNPVATEQYGCVAITNGEQAGMGNSR

SEQ ID NO: 69228 - protein, 32 aa, Artificial Sequence
  Description of Artificial Sequence: Synthetic polypeptide
DECEICTTNPVATTQYGVVSTENLQAGNNTDM

SEQ ID NO: 69229 - protein, 33 aa, Artificial Sequence
  Description of Artificial Sequence: Synthetic polypeptide
DEEEIRTTNPVATEQYGSVGDTNDDQENINGQG

SEQ ID NO: 69230 - protein, 31 aa, Artificial Sequence
  Description of Artificial Sequence: Synthetic polypeptide
DEAEIRTTNPVATEQYGSVCTDVLQETEEAQ

SEQ ID NO: 69231 - protein, 32 aa, Artificial Sequence
  Description of Artificial Sequence: Synthetic polypeptide
DEEEIRATNPVATEQYGCVAITNNLEQGEENT

SEQ ID NO: 69232 - protein, 32 aa, Artificial Sequence
  Description of Artificial Sequence: Synthetic polypeptide
DEEEIRATNPVATEQYGCVAMTNLEQGNQNEH

SEQ ID NO: 69233 - protein, 32 aa, Artificial Sequence
  Description of Artificial Sequence: Synthetic polypeptide
DECEICTTNPVATTQYGVVSTNANLQAGNTEE

SEQ ID NO: 69234 - protein, 31 aa, Artificial Sequence
  Description of Artificial Sequence: Synthetic polypeptide
DEAEIRTTNPVATEQYGSVCSWELANFNSNQ

SEQ ID NO: 69235 - protein, 32 aa, Artificial Sequence
  Description of Artificial Sequence: Synthetic polypeptide
DEEEIRATNPVATEQYGCVAINNLEQTGEEGR

SEQ ID NO: 69236 - protein, 33 aa, Artificial Sequence
  Description of Artificial Sequence: Synthetic polypeptide
DEEEIRTTNPVATEQYGSVSVSNLNQEYQSEDI

SEQ ID NO: 69237 - protein, 33 aa, Artificial Sequence
  Description of Artificial Sequence: Synthetic polypeptide
DEEEIRTTNPVATEQYGSVSVSNLNDNNMSNDI

SEQ ID NO: 69238 - protein, 32 aa, Artificial Sequence
  Description of Artificial Sequence: Synthetic polypeptide
DEEEIATTNPVATEQYGSVATNLETEPNGETK

SEQ ID NO: 69239 - protein, 28 aa, Artificial Sequence
  Description of Artificial Sequence: Synthetic peptide
QEEEIRTTNPVATEQYGAAAAVWQHGPK

SEQ ID NO: 69240 - protein, 28 aa, Artificial Sequence
  Description of Artificial Sequence: Synthetic peptide
QEEEIRTTNPVATEQYGAAAAVWQHGEK

SEQ ID NO: 69241 - protein, 28 aa, Artificial Sequence
  Description of Artificial Sequence: Synthetic peptide
QEEEIRTTNPVATEQYGAAAAVCQHGEK

SEQ ID NO: 69242 - protein, 31 aa, Artificial Sequence
  Description of Artificial Sequence: Synthetic polypeptide
DESEIRSTNPVCTEQWGVVSDNLPQREGENG

SEQ ID NO: 69243 - protein, 33 aa, Artificial Sequence
  Description of Artificial Sequence: Synthetic polypeptide
DEEEIRATNPVATEQWGSVSVANNQDAGSNSRM

SEQ ID NO: 69244 - protein, 29 aa, Artificial Sequence
  Description of Artificial Sequence: Synthetic peptide
DESEIRSTNPVGTECYGSVASITLQHGDI

SEQ ID NO: 69245 - protein, 30 aa, Artificial Sequence
  Description of Artificial Sequence: Synthetic polypeptide
DESEIRSTNPVGTECYGSVSSITLQHEGNI

SEQ ID NO: 69246 - protein, 34 aa, Artificial Sequence
  Description of Artificial Sequence: Synthetic polypeptide
AEEEIRTTNPVATEQYGSVSVTTNNQNQQQGNQD

SEQ ID NO: 69247 - protein, 28 aa, Artificial Sequence
  Description of Artificial Sequence: Synthetic peptide
DESEIRSTNPVGTECYGVVASTLQHGDI

SEQ ID NO: 69248 - protein, 32 aa, Artificial Sequence
  Description of Artificial Sequence: Synthetic polypeptide
QEEEIRTTNPVATEQWGSVSCINEPQDREGEG

SEQ ID NO: 69249 - protein, 29 aa, Artificial Sequence
  Description of Artificial Sequence: Synthetic peptide
DESEIRSTNPVGTEGYGVVSSTLQRNGDV

SEQ ID NO: 69250 - protein, 31 aa, Artificial Sequence
  Description of Artificial Sequence: Synthetic polypeptide
DESEIRSTNPVSTEGYGNVATNTIQSRNGNR

SEQ ID NO: 69251 - protein, 31 aa, Artificial Sequence
  Description of Artificial Sequence: Synthetic polypeptide
DEEEIATTNPVATEQYGSVATNLNDNPMEGE

SEQ ID NO: 69252 - protein, 33 aa, Artificial Sequence
  Description of Artificial Sequence: Synthetic polypeptide
DEEEIRTTNPVATEQYGSVSVSNLLHNPGSELF

SEQ ID NO: 69253 - protein, 33 aa, Artificial Sequence
  Description of Artificial Sequence: Synthetic polypeptide
DEEEIRTTNPVATEQYGSVGCTTNLQQEQMELL

SEQ ID NO: 69254 - protein, 34 aa, Artificial Sequence
  Description of Artificial Sequence: Synthetic polypeptide
DEEEIRTTNPVATEQYGSVSTNLLYPQENELEVD

SEQ ID NO: 69255 - protein, 33 aa, Artificial Sequence
  Description of Artificial Sequence: Synthetic polypeptide
DEEEIRTTNPVATEQYGSVGDDGNNEQDEGNQG

SEQ ID NO: 69256 - protein, 32 aa, Artificial Sequence
  Description of Artificial Sequence: Synthetic polypeptide
DESEIRSTNPVSTEQYGNVATNTGQSRNGNPR

SEQ ID NO: 69257 - protein, 32 aa, Artificial Sequence
  Description of Artificial Sequence: Synthetic polypeptide
DESEIRSTNPVSTEQYGNVATNTIQSRNGNPR

SEQ ID NO: 69258 - protein, 33 aa, Artificial Sequence
  Description of Artificial Sequence: Synthetic polypeptide
DEEEIRTTNPVATEQYGSVGDDTMNDGQGNGQG

SEQ ID NO: 69259 - protein, 33 aa, Artificial Sequence
  Description of Artificial Sequence: Synthetic polypeptide
DEEEIRTTNPVATEQYGSVSVSNLNDENESEDI

SEQ ID NO: 69260 - protein, 30 aa, Artificial Sequence
  Description of Artificial Sequence: Synthetic polypeptide
DESEIRSTNPVCTEQWGVVSDINLQDSGNQ

SEQ ID NO: 69261 - protein, 33 aa, Artificial Sequence
  Description of Artificial Sequence: Synthetic polypeptide
DEPEIRTTNPVATEQYGSYVSTPNEVVRDINNN

SEQ ID NO: 69262 - protein, 28 aa, Artificial Sequence
  Description of Artificial Sequence: Synthetic peptide
QENEIAPTNPVASEQYGIVSENLQSGTL

SEQ ID NO: 69263 - protein, 34 aa, Artificial Sequence
  Description of Artificial Sequence: Synthetic polypeptide
DEEEIRTTNPVATEQYGSVEPTNDLTAIDVNLRI

SEQ ID NO: 69264 - protein, 33 aa, Artificial Sequence
  Description of Artificial Sequence: Synthetic polypeptide
DEEEIATTNPVATETYGCVSTGNGLQGNGGDNH

SEQ ID NO: 69265 - protein, 34 aa, Artificial Sequence
  Description of Artificial Sequence: Synthetic polypeptide
DEEEIRTTNPVATEQYGSVCSTNAHQERFMSDQA

SEQ ID NO: 69266 - protein, 32 aa, Artificial Sequence
  Description of Artificial Sequence: Synthetic polypeptide
DEQEIATTNPVAYEQYGSVATNLQERGGDDEA

SEQ ID NO: 69267 - protein, 30 aa, Artificial Sequence
  Description of Artificial Sequence: Synthetic polypeptide
DEQEIATTNPVAYEQYGSVATNLQGVDPML

SEQ ID NO: 69268 - protein, 31 aa, Artificial Sequence
  Description of Artificial Sequence: Synthetic polypeptide
DEQEIATTNPVATEQYGSVSATDLEDHVGEL

SEQ ID NO: 69269 - protein, 32 aa, Artificial Sequence
  Description of Artificial Sequence: Synthetic polypeptide
DEQEIATTNPVATEQYGSVSATDLEDHVGEDR

SEQ ID NO: 69270 - protein, 30 aa, Artificial Sequence
  Description of Artificial Sequence: Synthetic polypeptide
DEEEIATTNPVCTETYGSVANPNDQDGNQM

SEQ ID NO: 69271 - protein, 30 aa, Artificial Sequence
  Description of Artificial Sequence: Synthetic polypeptide
DEEEIATTNPVCTETYGSVANPNLQDEGGM

SEQ ID NO: 69272 - protein, 28 aa, Artificial Sequence
  Description of Artificial Sequence: Synthetic peptide
QEGEIASTNPCCTEQYGIVSDNLQSGTR

SEQ ID NO: 69273 - protein, 31 aa, Artificial Sequence
  Description of Artificial Sequence: Synthetic polypeptide
DEEEIATTNPVCTETYGSVANPNLQDGNQDM

SEQ ID NO: 69274 - protein, 31 aa, Artificial Sequence
  Description of Artificial Sequence: Synthetic polypeptide
DEEEIATTNPVCTETYGSVANPNLTQDNGNL

SEQ ID NO: 69275 - protein, 32 aa, Artificial Sequence
  Description of Artificial Sequence: Synthetic polypeptide
DEQEIATTNPVATEQYGSVSATDLEDHRGEDL

SEQ ID NO: 69276 - protein, 33 aa, Artificial Sequence
  Description of Artificial Sequence: Synthetic polypeptide
DEEEIATTNPVATESYGSSVPTGMNLQDQIGER

SEQ ID NO: 69277 - protein, 33 aa, Artificial Sequence
  Description of Artificial Sequence: Synthetic polypeptide
DEEEIATTNPVATESYGISVPTTMNLQDQIGNN

SEQ ID NO: 69278 - protein, 33 aa, Artificial Sequence
  Description of Artificial Sequence: Synthetic polypeptide
DEEEIRTTNPVATEQYGSVSTTMNQNINFLENQ

SEQ ID NO: 69279 - protein, 32 aa, Artificial Sequence
  Description of Artificial Sequence: Synthetic polypeptide
DEEEIATTNPVGTEQYGSVSWNEGQGQRGDFP

SEQ ID NO: 69280 - protein, 32 aa, Artificial Sequence
  Description of Artificial Sequence: Synthetic polypeptide
DEEEIATTNPVGTEQYGSVSWNELDGREGGAP

SEQ ID NO: 69281 - protein, 32 aa, Artificial Sequence
  Description of Artificial Sequence: Synthetic polypeptide
DEEEIATTNPVGTEQYGSVSWNELDNRNGDQP

SEQ ID NO: 69282 - protein, 32 aa, Artificial Sequence
  Description of Artificial Sequence: Synthetic polypeptide
DEEEIATTNPVGTEQYGSVSWNELDRQGMGPE

SEQ ID NO: 69283 - protein, 30 aa, Artificial Sequence
  Description of Artificial Sequence: Synthetic polypeptide
DEAEIRTTNPVAYEEWGSVATNLNHGGDND

SEQ ID NO: 69284 - protein, 33 aa, Artificial Sequence
  Description of Artificial Sequence: Synthetic polypeptide
DEEEIATTNPVATESWGSVSTNLNQGDAGGNQP

SEQ ID NO: 69285 - protein, 33 aa, Artificial Sequence
  Description of Artificial Sequence: Synthetic polypeptide
DEEEIRTTNPVATEQYGSVSTTMQGVEQDGTEI

SEQ ID NO: 69286 - protein, 32 aa, Artificial Sequence
  Description of Artificial Sequence: Synthetic polypeptide
DEQEIATTNPVAYEQYGSVSTGPNDNQDGDKR

SEQ ID NO: 69287 - protein, 31 aa, Artificial Sequence
  Description of Artificial Sequence: Synthetic polypeptide
DEEEIATTNPVCTEQYGCVAFNLQGMEGNTS

SEQ ID NO: 69288 - protein, 30 aa, Artificial Sequence
  Description of Artificial Sequence: Synthetic polypeptide
DEEEIATTNPVCTECYGVVSNDEDLQSGNI

SEQ ID NO: 69289 - protein, 31 aa, Artificial Sequence
  Description of Artificial Sequence: Synthetic polypeptide
DEAEIRTTNPVAYEEWGSVSNNLQHGGDNGD

SEQ ID NO: 69290 - protein, 32 aa, Artificial Sequence
  Description of Artificial Sequence: Synthetic polypeptide
DEAEIRTTNPVAYEEWGSVSTNLQLGGDNDDP

SEQ ID NO: 69291 - protein, 31 aa, Artificial Sequence
  Description of Artificial Sequence: Synthetic polypeptide
DEQEIATTNPVAYEQWGSVSTNLQGNSNGDS

SEQ ID NO: 69292 - protein, 28 aa, Artificial Sequence
  Description of Artificial Sequence: Synthetic peptide
QEGEIASTNPVSSEQYGIVSCNLQSGTR

SEQ ID NO: 69293 - protein, 28 aa, Artificial Sequence
  Description of Artificial Sequence: Synthetic peptide
QEGEIASTNPVSSEQYGIVSCNLQSGNQ

SEQ ID NO: 69294 - protein, 31 aa, Artificial Sequence
  Description of Artificial Sequence: Synthetic polypeptide
DEQEIATTNPVAYEQWGSVSTNLQNSGGDDD

SEQ ID NO: 69295 - protein, 31 aa, Artificial Sequence
  Description of Artificial Sequence: Synthetic polypeptide
DEEEIATTNPVAYETWGEVSTNLQGGGDNGH

SEQ ID NO: 69296 - protein, 32 aa, Artificial Sequence
  Description of Artificial Sequence: Synthetic polypeptide
DEQEIATTNPVAYEQWGSVTTNLQGNMGDNER

SEQ ID NO: 69297 - protein, 30 aa, Artificial Sequence
  Description of Artificial Sequence: Synthetic polypeptide
DEQEIATTNPVAYEQWGVVSTGNGQDGNEP

SEQ ID NO: 69298 - protein, 30 aa, Artificial Sequence
  Description of Artificial Sequence: Synthetic polypeptide
DEQEIATTNPVAYEQYGCVAATNLQAPPRQ

SEQ ID NO: 69299 - protein, 34 aa, Artificial Sequence
  Description of Artificial Sequence: Synthetic polypeptide
DEQEIATTNPVAYEQYGQSVSTNDLLQRAGMGER

SEQ ID NO: 69300 - protein, 31 aa, Artificial Sequence
  Description of Artificial Sequence: Synthetic polypeptide
DEQEIATTNPVAYEQYGSVAAANDQDRGNDD

SEQ ID NO: 69301 - protein, 31 aa, Artificial Sequence
  Description of Artificial Sequence: Synthetic polypeptide
DEAEIRTTNPVAYEEYGSIPSTNLSERTVNE

SEQ ID NO: 69302 - protein, 35 aa, Artificial Sequence
  Description of Artificial Sequence: Synthetic polypeptide
DEEEIRTTNPVATEQYGSVCSTNDLDTTSGGANHE

SEQ ID NO: 69303 - protein, 30 aa, Artificial Sequence
  Description of Artificial Sequence: Synthetic polypeptide
DEQEIATTNPVAYEQYGSVAATNDDRQNDM

SEQ ID NO: 69304 - protein, 32 aa, Artificial Sequence
  Description of Artificial Sequence: Synthetic polypeptide
CEEEIATTNPVATEQYGSVCAANLQDSDNDRF

SEQ ID NO: 69305 - protein, 31 aa, Artificial Sequence
  Description of Artificial Sequence: Synthetic polypeptide
DEQEIATTNPVAYEQYGSVAATNDTAGMNRS

SEQ ID NO: 69306 - protein, 31 aa, Artificial Sequence
  Description of Artificial Sequence: Synthetic polypeptide
DEQEIATTNPVAYEQYGSVAATNDTAGNTRF

SEQ ID NO: 69307 - protein, 31 aa, Artificial Sequence
  Description of Artificial Sequence: Synthetic polypeptide
DEQEIATTNPVAYEQYGSVAATNDTDAGNRS

SEQ ID NO: 69308 - protein, 28 aa, Artificial Sequence
  Description of Artificial Sequence: Synthetic peptide
QENEIATTNPVATECYGDVSECLQHEER

SEQ ID NO: 69309 - protein, 28 aa, Artificial Sequence
  Description of Artificial Sequence: Synthetic peptide
QEGEIASTNPCSSEQYGIVSCNLQSGNR

SEQ ID NO: 69310 - protein, 31 aa, Artificial Sequence
  Description of Artificial Sequence: Synthetic polypeptide
DEQEIATTNPVAYEQYGSVANNNLQDAGNDE

SEQ ID NO: 69311 - protein, 32 aa, Artificial Sequence
  Description of Artificial Sequence: Synthetic polypeptide
DEEEIATTNPVATEVYGSVSPPNPFEIMGENR

SEQ ID NO: 69312 - protein, 32 aa, Artificial Sequence
  Description of Artificial Sequence: Synthetic polypeptide
DEQEIATTNPVATEQYGSVSATDLEDLRGEDL

SEQ ID NO: 69313 - protein, 32 aa, Artificial Sequence
  Description of Artificial Sequence: Synthetic polypeptide
DEAEIRTTNPVAYEEWGSVSTNLQNGGDNGDK

SEQ ID NO: 69314 - protein, 33 aa, Artificial Sequence
  Description of Artificial Sequence: Synthetic polypeptide
DEEEIATTNPVATETYGSVSTDNSLFTVRHNEF

SEQ ID NO: 69315 - protein, 28 aa, Artificial Sequence
  Description of Artificial Sequence: Synthetic peptide
QEGEIASTNPCSSEQYGSVSQNLQSGTR

SEQ ID NO: 69316 - protein, 31 aa, Artificial Sequence
  Description of Artificial Sequence: Synthetic polypeptide
DEQEIATTNPVAYEQWGSVSTNLNQNDSNEN

SEQ ID NO: 69317 - protein, 30 aa, Artificial Sequence
  Description of Artificial Sequence: Synthetic polypeptide
DEEEIATTNPVSTEQWGSVTFNLQEGMGQT

SEQ ID NO: 69318 - protein, 31 aa, Artificial Sequence
  Description of Artificial Sequence: Synthetic polypeptide
DEQEIATTNPVAYEQYGTVSTGNLPQDDNDV

SEQ ID NO: 69319 - protein, 31 aa, Artificial Sequence
  Description of Artificial Sequence: Synthetic polypeptide
DEQEIATTNPVAYERWGSVSTNLQEGQGNGE

SEQ ID NO: 69320 - protein, 31 aa, Artificial Sequence
  Description of Artificial Sequence: Synthetic polypeptide
DEEEIATVNPVATEQYGSVATGLQNQMNNQE

SEQ ID NO: 69321 - protein, 28 aa, Artificial Sequence
  Description of Artificial Sequence: Synthetic peptide
QEGEIAPTNPVSTEQYGEASENLQSGTR

SEQ ID NO: 69322 - protein, 31 aa, Artificial Sequence
  Description of Artificial Sequence: Synthetic polypeptide
DEEEIATVNPVATEQYGSVATGLQSNNNHGE

SEQ ID NO: 69323 - protein, 34 aa, Artificial Sequence
  Description of Artificial Sequence: Synthetic polypeptide
DEEEIRTTNPVATEQYGSVSTTNGLHDEISVENT

SEQ ID NO: 69324 - protein, 32 aa, Artificial Sequence
  Description of Artificial Sequence: Synthetic polypeptide
DEEEIATVNPVATEQYGSVATGLQSRANAQEN

SEQ ID NO: 69325 - protein, 32 aa, Artificial Sequence
  Description of Artificial Sequence: Synthetic polypeptide
DEEEIATVNPVATEQYGSVATGLQSRANQPES

SEQ ID NO: 69326 - protein, 31 aa, Artificial Sequence
  Description of Artificial Sequence: Synthetic polypeptide
DEQEIATTNPVAYERWGSVSTNLQGADNDTR

SEQ ID NO: 69327 - protein, 28 aa, Artificial Sequence
  Description of Artificial Sequence: Synthetic peptide
QEGEIAPTNPVSTEQYGEASCNLQSGTR

SEQ ID NO: 69328 - protein, 28 aa, Artificial Sequence
  Description of Artificial Sequence: Synthetic peptide
QEGEIAPTNPVSTEQYGEASCNLQSGGR

SEQ ID NO: 69329 - protein, 32 aa, Artificial Sequence
  Description of Artificial Sequence: Synthetic polypeptide
DEEEIATVNPVATEQYGSVATGLQSRNNQTED

SEQ ID NO: 69330 - protein, 31 aa, Artificial Sequence
  Description of Artificial Sequence: Synthetic polypeptide
DEEEIATVNPVATEQYGSVATGLQSRNQMEH

SEQ ID NO: 69331 - protein, 33 aa, Artificial Sequence
  Description of Artificial Sequence: Synthetic polypeptide
DEEEIATVNPVATEQYGSVSSTPALQMSNGMNQ

SEQ ID NO: 69332 - protein, 34 aa, Artificial Sequence
  Description of Artificial Sequence: Synthetic polypeptide
DEEEIATVNPVATEQYGSVSSTTPALQMRNGMNQ

SEQ ID NO: 69333 - protein, 31 aa, Artificial Sequence
  Description of Artificial Sequence: Synthetic polypeptide
DEEEIATVNPVAYEQYGSVVSCTRLSQRVQE

SEQ ID NO: 69334 - protein, 29 aa, Artificial Sequence
  Description of Artificial Sequence: Synthetic peptide
DEEEIATVNPVCTEPYGTVSMENIQSGNH

SEQ ID NO: 69335 - protein, 31 aa, Artificial Sequence
  Description of Artificial Sequence: Synthetic polypeptide
DEEEIATVNPVCTEQYGSVSSDPNGQSNGNV

SEQ ID NO: 69336 - protein, 31 aa, Artificial Sequence
  Description of Artificial Sequence: Synthetic polypeptide
DEQEIATTNPVATEQYGSVSATDLEDHEGQL

SEQ ID NO: 69337 - protein, 32 aa, Artificial Sequence
  Description of Artificial Sequence: Synthetic polypeptide
DEEEIATVNPVCTEQYGSVSTTALQSNGMNPQ

SEQ ID NO: 69338 - protein, 35 aa, Artificial Sequence
  Description of Artificial Sequence: Synthetic polypeptide
DEEEIATTNPVATEQYGSVVSCTLELPVRTGGNNR

SEQ ID NO: 69339 - protein, 31 aa, Artificial Sequence
  Description of Artificial Sequence: Synthetic polypeptide
DEEEIATVNPVCTEQYGVVSTDALQSGMNPQ

SEQ ID NO: 69340 - protein, 31 aa, Artificial Sequence
  Description of Artificial Sequence: Synthetic polypeptide
DEEEIATVNPVCTEQYGVVSTDNLVEFEGND

SEQ ID NO: 69341 - protein, 31 aa, Artificial Sequence
  Description of Artificial Sequence: Synthetic polypeptide
DEEEIATVNPVCTEQYGVVSTTALQSGMNPQ

SEQ ID NO: 69342 - protein, 29 aa, Artificial Sequence
  Description of Artificial Sequence: Synthetic peptide
DEQEIATTNPVAYERWGEVSTNPQHEGNM

SEQ ID NO: 69343 - protein, 35 aa, Artificial Sequence
  Description of Artificial Sequence: Synthetic polypeptide
DEEEIRTTNPVATEQYGSVSTTNDPEQVGSNNDFD

SEQ ID NO: 69344 - protein, 31 aa, Artificial Sequence
  Description of Artificial Sequence: Synthetic polypeptide
DEQEIATTNPVATEQYGSVSATDLEDHGEDL

SEQ ID NO: 69345 - protein, 28 aa, Artificial Sequence
  Description of Artificial Sequence: Synthetic peptide
QENEIATTNPVATECYGDVSECLQHGEL

SEQ ID NO: 69346 - protein, 28 aa, Artificial Sequence
  Description of Artificial Sequence: Synthetic peptide
QENEIATTNPVATECYGDVSECLQHENF

SEQ ID NO: 69347 - protein, 28 aa, Artificial Sequence
  Description of Artificial Sequence: Synthetic peptide
QENEIATTNPVATECYGDVSECLQHENL

SEQ ID NO: 69348 - protein, 30 aa, Artificial Sequence
  Description of Artificial Sequence: Synthetic polypeptide
QEGEIAPTNPVSTEQYGTVSCNLQQSNGNR

SEQ ID NO: 69349 - protein, 33 aa, Artificial Sequence
  Description of Artificial Sequence: Synthetic polypeptide
DEEEIRTTNPVATEQYGSVSTTNALEEEMEPLD

SEQ ID NO: 69350 - protein, 34 aa, Artificial Sequence
  Description of Artificial Sequence: Synthetic polypeptide
DEEEIATTNPVSTEQYGSVSSTTPNLPNMSGMNR

SEQ ID NO: 69351 - protein, 34 aa, Artificial Sequence
  Description of Artificial Sequence: Synthetic polypeptide
DEEEIATTNPVSTEQYGSVSTFNVEHQFGGNERM

SEQ ID NO: 69352 - protein, 33 aa, Artificial Sequence
  Description of Artificial Sequence: Synthetic polypeptide
DEEEIRTTNPVATEQYGSVSTTNALEGEFEELD

SEQ ID NO: 69353 - protein, 30 aa, Artificial Sequence
  Description of Artificial Sequence: Synthetic polypeptide
QEGEIAPTNPVSTEQYGTVSCNLQQQNGNR

SEQ ID NO: 69354 - protein, 30 aa, Artificial Sequence
  Description of Artificial Sequence: Synthetic polypeptide
QEGEIAPTNPVSTEQYGIVSTNLQDSEGER

SEQ ID NO: 69355 - protein, 34 aa, Artificial Sequence
  Description of Artificial Sequence: Synthetic polypeptide
DEEEIRTTNPVATEQYGSVSTTNALEPEGEELLD

SEQ ID NO: 69356 - protein, 33 aa, Artificial Sequence
  Description of Artificial Sequence: Synthetic polypeptide
DEEEIATTNPVATEQYGTVVSTTNGQDANNNQR

SEQ ID NO: 69357 - protein, 34 aa, Artificial Sequence
  Description of Artificial Sequence: Synthetic polypeptide
DEEEIATTNPVATERYGKTVSCTNALPQFGGNGR

SEQ ID NO: 69358 - protein, 34 aa, Artificial Sequence
  Description of Artificial Sequence: Synthetic polypeptide
DEEEIRTTNPVATEQYGSVSTTNALESEGEEDLD

SEQ ID NO: 69359 - protein, 34 aa, Artificial Sequence
  Description of Artificial Sequence: Synthetic polypeptide
DEEEIRTTNPVATEQYGSVSTTNAQEPEEGEELD

SEQ ID NO: 69360 - protein, 32 aa, Artificial Sequence
  Description of Artificial Sequence: Synthetic polypeptide
DEEEIATTNPVATEQYGTVSTTNHGNTGNGNV

SEQ ID NO: 69361 - protein, 32 aa, Artificial Sequence
  Description of Artificial Sequence: Synthetic polypeptide
DEAEIRTTNPVAYECYGSVSTGNGNTQHGNAD

SEQ ID NO: 69362 - protein, 28 aa, Artificial Sequence
  Description of Artificial Sequence: Synthetic peptide
QEGEIAPTNPVSTEQYGIVSCNLQSGTI

SEQ ID NO: 69363 - protein, 32 aa, Artificial Sequence
  Description of Artificial Sequence: Synthetic polypeptide
DEAEIRTTNPVAYECWGVVSTNLQGNEGDNNR

SEQ ID NO: 69364 - protein, 28 aa, Artificial Sequence
  Description of Artificial Sequence: Synthetic peptide
QENEIATTNPVATECYGDVSECLQHGEH

SEQ ID NO: 69365 - protein, 28 aa, Artificial Sequence
  Description of Artificial Sequence: Synthetic peptide
QEGEIAPTNPVSTEQYGIVSCCLQSGTR

SEQ ID NO: 69366 - protein, 28 aa, Artificial Sequence
  Description of Artificial Sequence: Synthetic peptide
QEGEIAPTNPVSTEQYGIVSCCLQHGTR

SEQ ID NO: 69367 - protein, 28 aa, Artificial Sequence
  Description of Artificial Sequence: Synthetic peptide
QENEIATTNPVATECYGDVSECLQHGEI

SEQ ID NO: 69368 - protein, 32 aa, Artificial Sequence
  Description of Artificial Sequence: Synthetic polypeptide
DEQEIATTNPVAYEQYGVVVSTGNHQDAGNHR

SEQ ID NO: 69369 - protein, 32 aa, Artificial Sequence
  Description of Artificial Sequence: Synthetic polypeptide
DEEEIATTNPVATEQYGTPSTGNPLQPDNENN

SEQ ID NO: 69370 - protein, 30 aa, Artificial Sequence
  Description of Artificial Sequence: Synthetic polypeptide
DEAEIRTTNPVAYEEWGEVATNLQGGGDND

SEQ ID NO: 69371 - protein, 33 aa, Artificial Sequence
  Description of Artificial Sequence: Synthetic polypeptide
DEEEIRTTNPVATEQYGSVCSTLNLEGEEQIIS

SEQ ID NO: 69372 - protein, 28 aa, Artificial Sequence
  Description of Artificial Sequence: Synthetic peptide
QEGEIASTNPVSTEQYGIVSCNLQHGTI

SEQ ID NO: 69373 - protein, 31 aa, Artificial Sequence
  Description of Artificial Sequence: Synthetic polypeptide
DEEEIATTNPVAYESWGVVSTNLQLGEDNGH

SEQ ID NO: 69374 - protein, 33 aa, Artificial Sequence
  Description of Artificial Sequence: Synthetic polypeptide
DEEEIRTTNPVATEQYGSVCSTGLIEADFDQND

SEQ ID NO: 69375 - protein, 31 aa, Artificial Sequence
  Description of Artificial Sequence: Synthetic polypeptide
DEAEIRTTNPVAYEPYGVVSCTVLSQRPGGD

SEQ ID NO: 69376 - protein, 32 aa, Artificial Sequence
  Description of Artificial Sequence: Synthetic polypeptide
DEEEIRTTNPVATEQYGSVCSTGLIEDSIDQD

SEQ ID NO: 69377 - protein, 34 aa, Artificial Sequence
  Description of Artificial Sequence: Synthetic polypeptide
DEEEIRTTNPVATEQYGSVSTPLLQANSDQNEHI

SEQ ID NO: 69378 - protein, 30 aa, Artificial Sequence
  Description of Artificial Sequence: Synthetic polypeptide
DEQEIATTNPVATEQYGVVSTDLEDHEGEL

SEQ ID NO: 69379 - protein, 34 aa, Artificial Sequence
  Description of Artificial Sequence: Synthetic polypeptide
DEEEIRTTNPVATEQYGSVSTPLGQNVGMGEGET

SEQ ID NO: 69380 - protein, 33 aa, Artificial Sequence
  Description of Artificial Sequence: Synthetic polypeptide
DEEEIRTTNPVATEQYGSVSTPLGLIETGQLEW

SEQ ID NO: 69381 - protein, 33 aa, Artificial Sequence
  Description of Artificial Sequence: Synthetic polypeptide
DEEEIRTTNPVATEQYGSVSTPLAFHYDSIQNS

SEQ ID NO: 69382 - protein, 31 aa, Artificial Sequence
  Description of Artificial Sequence: Synthetic polypeptide
DEAEIRTTNPVAYEPYGSVNCTNISQRVNKV

SEQ ID NO: 69383 - protein, 33 aa, Artificial Sequence
  Description of Artificial Sequence: Synthetic polypeptide
DEEEIRTTNPVATEQYGSVSTPLADHIDSIQRS

SEQ ID NO: 69384 - protein, 33 aa, Artificial Sequence
  Description of Artificial Sequence: Synthetic polypeptide
DEEEIRTTNPVATEQYGSVSTPIGPNMANENPA

SEQ ID NO: 69385 - protein, 35 aa, Artificial Sequence
  Description of Artificial Sequence: Synthetic polypeptide
DEEEIRTTNPVATEQYGSVCSTGNDHQNFGSNNQL

SEQ ID NO: 69386 - protein, 32 aa, Artificial Sequence
  Description of Artificial Sequence: Synthetic polypeptide
DEEEIATTNPVAYEQYGSVWTNAVSQVTDSNR

SEQ ID NO: 69387 - protein, 32 aa, Artificial Sequence
  Description of Artificial Sequence: Synthetic polypeptide
DEEEIRTTNPVATEQYGSVSTPHGEDGQFSEG

SEQ ID NO: 69388 - protein, 32 aa, Artificial Sequence
  Description of Artificial Sequence: Synthetic polypeptide
DEQEIATTNPVATETWGSVSTNLNQQSGGDNH

SEQ ID NO: 69389 - protein, 33 aa, Artificial Sequence
  Description of Artificial Sequence: Synthetic polypeptide
DEEEIATTNPVAYEQYGTSVSATNDLGQRDIAM

SEQ ID NO: 69390 - protein, 33 aa, Artificial Sequence
  Description of Artificial Sequence: Synthetic polypeptide
DEEEIRTTNPVATEQYGSVSTPGLTANSDQNEH

SEQ ID NO: 69391 - protein, 31 aa, Artificial Sequence
  Description of Artificial Sequence: Synthetic polypeptide
DEAEIRTTNPVAYEKWGSVATNLQAGGDNTN

SEQ ID NO: 69392 - protein, 31 aa, Artificial Sequence
  Description of Artificial Sequence: Synthetic polypeptide
DEAEIRTTNPVAYEKWGEVSTNLQIGGDNED

SEQ ID NO: 69393 - protein, 30 aa, Artificial Sequence
  Description of Artificial Sequence: Synthetic polypeptide
DEEEIATTNPVAYEGWGSVSTNLNGGMDGA

SEQ ID NO: 69394 - protein, 32 aa, Artificial Sequence
  Description of Artificial Sequence: Synthetic polypeptide
DEEEIATTNPVAYEQYGTVATNLQGEDQGNTE

SEQ ID NO: 69395 - protein, 32 aa, Artificial Sequence
  Description of Artificial Sequence: Synthetic polypeptide
DEQEIATTNPVATEWYGCVSTNLQLGGDNGEP

SEQ ID NO: 69396 - protein, 33 aa, Artificial Sequence
  Description of Artificial Sequence: Synthetic polypeptide
DEEEIATTNPVAYEQYGTVSTGNGGLDRGGNAD

SEQ ID NO: 69397 - protein, 33 aa, Artificial Sequence
  Description of Artificial Sequence: Synthetic polypeptide
DEEEIRTTNPVATEQYGSVCSTGLDTYTGVEEN

SEQ ID NO: 69398 - protein, 34 aa, Artificial Sequence
  Description of Artificial Sequence: Synthetic polypeptide
DEEEIATTNPVAYEQYGSVSVSVNELSQRVGNIK

SEQ ID NO: 69399 - protein, 34 aa, Artificial Sequence
  Description of Artificial Sequence: Synthetic polypeptide
DEEEIATTNPVAYEHYGSVSTPNELSQQRGGNQT

SEQ ID NO: 69400 - protein, 30 aa, Artificial Sequence
  Description of Artificial Sequence: Synthetic polypeptide
DEQEIATTNPVATEQYGVVSATDLEDHGEL

SEQ ID NO: 69401 - protein, 30 aa, Artificial Sequence
  Description of Artificial Sequence: Synthetic polypeptide
DEQEIATTNPVATEQYGTVSATGPEFEGND

SEQ ID NO: 69402 - protein, 30 aa, Artificial Sequence
  Description of Artificial Sequence: Synthetic polypeptide
DEQEIATTNPVATEQYGTVSATGPEHEGND

SEQ ID NO: 69403 - protein, 29 aa, Artificial Sequence
  Description of Artificial Sequence: Synthetic peptide
QEGEIATTNPCSSEQYGIVSTNLQSEGTR

SEQ ID NO: 69404 - protein, 29 aa, Artificial Sequence
  Description of Artificial Sequence: Synthetic peptide
DEQEIATTNPVATEQYGVMSSTLQHEGDL

SEQ ID NO: 69405 - protein, 28 aa, Artificial Sequence
  Description of Artificial Sequence: Synthetic peptide
QEGEIATTNPCSSEQYGIVSCNLQSGTR

SEQ ID NO: 69406 - protein, 34 aa, Artificial Sequence
  Description of Artificial Sequence: Synthetic polypeptide
DEEEIRTTNPVATEQYGSVCSTGEDLQNFGSEQA

SEQ ID NO: 69407 - protein, 31 aa, Artificial Sequence
  Description of Artificial Sequence: Synthetic polypeptide
DEQEIATTNPVATEQYGSVSATDLEHEGEDL

SEQ ID NO: 69408 - protein, 33 aa, Artificial Sequence
  Description of Artificial Sequence: Synthetic polypeptide
DEEEIRTTNPVATEQYGSVCSTGEDNQNFGSEQ

SEQ ID NO: 69409 - protein, 30 aa, Artificial Sequence
  Description of Artificial Sequence: Synthetic polypeptide
DEQEIATTNPVATEQYGVMSTDLQHEGEDL

SEQ ID NO: 69410 - protein, 30 aa, Artificial Sequence
  Description of Artificial Sequence: Synthetic polypeptide
DEQEIATTNPVATEQYGSVSATDLEHEEEL

SEQ ID NO: 69411 - protein, 34 aa, Artificial Sequence
  Description of Artificial Sequence: Synthetic polypeptide
DEEEIRTTNPVATEQYGSVSTTLQLLQQNSTNNE

SEQ ID NO: 69412 - protein, 32 aa, Artificial Sequence
  Description of Artificial Sequence: Synthetic polypeptide
DEEEIATTNPVAYEEYGVVSTGNLQLGEDNGQ

SEQ ID NO: 69413 - protein, 29 aa, Artificial Sequence
  Description of Artificial Sequence: Synthetic peptide
QEGEIATTNPCSSEQYGIVSCNLQSEGNR

SEQ ID NO: 69414 - protein, 32 aa, Artificial Sequence
  Description of Artificial Sequence: Synthetic polypeptide
DEQEIATTNPVATEQYGVSVHTNSTRIENQRP

SEQ ID NO: 69415 - protein, 32 aa, Artificial Sequence
  Description of Artificial Sequence: Synthetic polypeptide
DEEEIATTNPVAYEQYGSVSTGNNDRNGTPEE

SEQ ID NO: 69416 - protein, 29 aa, Artificial Sequence
  Description of Artificial Sequence: Synthetic peptide
QEGEIATTNPCSSEQYGIVSCNLQQSGNR

SEQ ID NO: 69417 - protein, 28 aa, Artificial Sequence
  Description of Artificial Sequence: Synthetic peptide
QEGEIATTNPCSSEQYGIVSCNLQQGTR

SEQ ID NO: 69418 - protein, 33 aa, Artificial Sequence
  Description of Artificial Sequence: Synthetic polypeptide
DEEEIRTTNPVATEQYGSVCSTGEHQYSGSDQP

SEQ ID NO: 69419 - protein, 34 aa, Artificial Sequence
  Description of Artificial Sequence: Synthetic polypeptide
DEEEIRTTNPVATEQYGSVCSTGELAEFFGSNQP

SEQ ID NO: 69420 - protein, 28 aa, Artificial Sequence
  Description of Artificial Sequence: Synthetic peptide
QEGEIATTNPCSSEQYGIVSCNIQQGNR

SEQ ID NO: 69421 - protein, 30 aa, Artificial Sequence
  Description of Artificial Sequence: Synthetic polypeptide
DEQEIATTNPVATEQYGVVSADDLEDSGNQ

SEQ ID NO: 69422 - protein, 34 aa, Artificial Sequence
  Description of Artificial Sequence: Synthetic polypeptide
DEEEIRTTNPVATEQYGSVSTPLNLVENGETELN

SEQ ID NO: 69423 - protein, 34 aa, Artificial Sequence
  Description of Artificial Sequence: Synthetic polypeptide
DEEEIATTNPVAYEQYGSVSTIDNSLFTVRGNEF

SEQ ID NO: 69424 - protein, 34 aa, Artificial Sequence
  Description of Artificial Sequence: Synthetic polypeptide
DEEEIRTTNPVATEQYGSVCSTGELQYFNSNFQS

SEQ ID NO: 69425 - protein, 32 aa, Artificial Sequence
  Description of Artificial Sequence: Synthetic polypeptide
DEEEIATTNPVAYEQYGSVSTDNSLFTVRNEF

SEQ ID NO: 69426 - protein, 34 aa, Artificial Sequence
  Description of Artificial Sequence: Synthetic polypeptide
DEEEIRTTNPVATEQYGSVSTPGDLQPHVNDDLF

SEQ ID NO: 69427 - protein, 31 aa, Artificial Sequence
  Description of Artificial Sequence: Synthetic polypeptide
DEQEIATTNPVATEQYGSVSATDLEDVEGEL

SEQ ID NO: 69428 - protein, 32 aa, Artificial Sequence
  Description of Artificial Sequence: Synthetic polypeptide
DEEEIATTNPVAYEEYGEVVSTGNGQDAGNHR

SEQ ID NO: 69429 - protein, 34 aa, Artificial Sequence
  Description of Artificial Sequence: Synthetic polypeptide
DEEEIRTTNPVATEQYGSVSTPAGPNMRNGMNPI

SEQ ID NO: 69430 - protein, 32 aa, Artificial Sequence
  Description of Artificial Sequence: Synthetic polypeptide
DEQEIATTNPVATEQYGSVSATDLEDREGEDL

SEQ ID NO: 69431 - protein, 32 aa, Artificial Sequence
  Description of Artificial Sequence: Synthetic polypeptide
DEQEIATTNPVATEQYGSVSATDLEDQEGEFE

SEQ ID NO: 69432 - protein, 34 aa, Artificial Sequence
  Description of Artificial Sequence: Synthetic polypeptide
DEEEIRTTNPVATEQYGSVSTPAGPNDRNGMNPV

SEQ ID NO: 69433 - protein, 34 aa, Artificial Sequence
  Description of Artificial Sequence: Synthetic polypeptide
DEEEIRTTNPVATEQYGSVSTTMLQQVQVNELNV

SEQ ID NO: 69434 - protein, 32 aa, Artificial Sequence
  Description of Artificial Sequence: Synthetic polypeptide
DEQEIATTNPVATEQYGSVSATDLEDQEGEDL

SEQ ID NO: 69435 - protein, 31 aa, Artificial Sequence
  Description of Artificial Sequence: Synthetic polypeptide
QEGEIATTNPCASEQYGSVSCNLQDSEGENR

SEQ ID NO: 69436 - protein, 32 aa, Artificial Sequence
  Description of Artificial Sequence: Synthetic polypeptide
QEGEIATTNPCASEQYGSVSCNLPQDREGENR

SEQ ID NO: 69437 - protein, 31 aa, Artificial Sequence
  Description of Artificial Sequence: Synthetic polypeptide
DEQEIATTNPVAYEAWGVVSTNLQLGEDNGR

SEQ ID NO: 69438 - protein, 31 aa, Artificial Sequence
  Description of Artificial Sequence: Synthetic polypeptide
DEQEIATTNPVAYEEYGVVSTNLQLGEDDGR

SEQ ID NO: 69439 - protein, 30 aa, Artificial Sequence
  Description of Artificial Sequence: Synthetic polypeptide
DEQEIATTNPVAYEHWGSVSTNLQGGMDGS

SEQ ID NO: 69440 - protein, 32 aa, Artificial Sequence
  Description of Artificial Sequence: Synthetic polypeptide
DEQEIATTNPVATEQYGSVSATDLEDREGGDL

SEQ ID NO: 69441 - protein, 33 aa, Artificial Sequence
  Description of Artificial Sequence: Synthetic polypeptide
DEEEIRTTNPVATEQYGSVCSTGVLDPVNVEEN

SEQ ID NO: 69442 - protein, 31 aa, Artificial Sequence
  Description of Artificial Sequence: Synthetic polypeptide
DEQEIATTNPVAYEQWGSVATNLQSGGENDP

SEQ ID NO: 69443 - protein, 34 aa, Artificial Sequence
  Description of Artificial Sequence: Synthetic polypeptide
DEEEIRTTNPVATEQYGSVCSTGVLDTRQVEENS

SEQ ID NO: 69444 - protein, 34 aa, Artificial Sequence
  Description of Artificial Sequence: Synthetic polypeptide
DEEEIRTTNPVATEQYGSVCSTGVLILTTGSENQ

SEQ ID NO: 69445 - protein, 31 aa, Artificial Sequence
  Description of Artificial Sequence: Synthetic polypeptide
DEEEIATTNPVAYERYGSVSTGNMDGGGDSR

SEQ ID NO: 69446 - protein, 33 aa, Artificial Sequence
  Description of Artificial Sequence: Synthetic polypeptide
DEAEIRTTNPVAYEGWGSVSTNLQRGEDGNNTN

SEQ ID NO: 69447 - protein, 32 aa, Artificial Sequence
  Description of Artificial Sequence: Synthetic polypeptide
DEAEIRTTNPVAYEGWGSVSTNLQHDGGNNTN

SEQ ID NO: 69448 - protein, 30 aa, Artificial Sequence
  Description of Artificial Sequence: Synthetic polypeptide
DEAEIRTTNPVAYEEYGVVSTNNQHGGDQD

SEQ ID NO: 69449 - protein, 28 aa, Artificial Sequence
  Description of Artificial Sequence: Synthetic peptide
QEGEIASVNPVCTEQYGVVSDNLQSGNQ

SEQ ID NO: 69450 - protein, 32 aa, Artificial Sequence
  Description of Artificial Sequence: Synthetic polypeptide
DEEEIRTTNPVATEQYGSVCSTLHENFNSEQS

SEQ ID NO: 69451 - protein, 35 aa, Artificial Sequence
  Description of Artificial Sequence: Synthetic polypeptide
DEEEIRTTNPVATEQYGSVSTTMNGFQTGGGNNEQ

SEQ ID NO: 69452 - protein, 31 aa, Artificial Sequence
  Description of Artificial Sequence: Synthetic polypeptide
DEEEIATTNPVAYESWGSVSTNLQMEGGMDG

SEQ ID NO: 69453 - protein, 34 aa, Artificial Sequence
  Description of Artificial Sequence: Synthetic polypeptide
DEEEIRTTNPVATEQYGSVCSTGVLDTQEEEENA

SEQ ID NO: 69454 - protein, 30 aa, Artificial Sequence
  Description of Artificial Sequence: Synthetic polypeptide
DEEEIATVNPVSTEQYGTVSMDLQQQNGNQ

SEQ ID NO: 69455 - protein, 34 aa, Artificial Sequence
  Description of Artificial Sequence: Synthetic polypeptide
DEEEIRTTNPVATEQYGSVSTTMIILPRPGELEP

SEQ ID NO: 69456 - protein, 28 aa, Artificial Sequence
  Description of Artificial Sequence: Synthetic peptide
QEGEIATTNPCATEQYGDVSCNLMSGTA

SEQ ID NO: 69457 - protein, 35 aa, Artificial Sequence
  Description of Artificial Sequence: Synthetic polypeptide
DEEEIRTTNPVATEQYGSVSTPDVLTQVRFENVLD

SEQ ID NO: 69458 - protein, 28 aa, Artificial Sequence
  Description of Artificial Sequence: Synthetic peptide
QEEEIATVNPVATEQYGEVPEVLQSENK

SEQ ID NO: 69459 - protein, 33 aa, Artificial Sequence
  Description of Artificial Sequence: Synthetic polypeptide
DEEEIRTTNPVATEQYGSVSTPDPNPASVQGDF

SEQ ID NO: 69460 - protein, 34 aa, Artificial Sequence
  Description of Artificial Sequence: Synthetic polypeptide
DEEEIRTTNPVATEQYGSVCSTGNLIDLGMEIED

SEQ ID NO: 69461 - protein, 32 aa, Artificial Sequence
  Description of Artificial Sequence: Synthetic polypeptide
DEEEIATTNPVAYEEWGVVSTNLQLGDEDNGR

SEQ ID NO: 69462 - protein, 34 aa, Artificial Sequence
  Description of Artificial Sequence: Synthetic polypeptide
DEEEIRTTNPVATEQYGSVSTPDLQPRSSIDMDV

SEQ ID NO: 69463 - protein, 33 aa, Artificial Sequence
  Description of Artificial Sequence: Synthetic polypeptide
DEEEIATTNPVAYEQYGVSVPSANGLLQDGMGR

SEQ ID NO: 69464 - protein, 31 aa, Artificial Sequence
  Description of Artificial Sequence: Synthetic polypeptide
QEGEIATTNPCATEQYGSVSCINLQDSGENG

SEQ ID NO: 69465 - protein, 32 aa, Artificial Sequence
  Description of Artificial Sequence: Synthetic polypeptide
AEEEIRTTNPVATEQYGSVSVDNVNQENEENE

SEQ ID NO: 69466 - protein, 30 aa, Artificial Sequence
  Description of Artificial Sequence: Synthetic polypeptide
QEGEIATTNPCATEQYGIVSCNLQSGMTPR

SEQ ID NO: 69467 - protein, 33 aa, Artificial Sequence
  Description of Artificial Sequence: Synthetic polypeptide
DEEEIRTTNPVATEQYGSVSTPDLQESMEEDFP

SEQ ID NO: 69468 - protein, 32 aa, Artificial Sequence
  Description of Artificial Sequence: Synthetic polypeptide
DEEEIATTNPVAYERWGSVSTNLQAGEGNNTN

SEQ ID NO: 69469 - protein, 33 aa, Artificial Sequence
  Description of Artificial Sequence: Synthetic polypeptide
DEEEIATTNPVAYEQYGVSVSANGPLQRAGMGT

SEQ ID NO: 69470 - protein, 31 aa, Artificial Sequence
  Description of Artificial Sequence: Synthetic polypeptide
DEQEIATTNPVATEQYGSVSATDLEDSGEDL

SEQ ID NO: 69471 - protein, 32 aa, Artificial Sequence
  Description of Artificial Sequence: Synthetic polypeptide
DEQEIATTNPVATEQYGSVSATDLEDRVGQDL

SEQ ID NO: 69472 - protein, 28 aa, Artificial Sequence
  Description of Artificial Sequence: Synthetic peptide
QEGEIATTNPCATEQYGIVSCNLQSEEL

SEQ ID NO: 69473 - protein, 32 aa, Artificial Sequence
  Description of Artificial Sequence: Synthetic polypeptide
DEQEIATTNPVATEQYGSVSATDLEDRVGEDL

SEQ ID NO: 69474 - protein, 30 aa, Artificial Sequence
  Description of Artificial Sequence: Synthetic polypeptide
DEEEIATTNPVAYECWGSVATNLQGGMDGE

SEQ ID NO: 69475 - protein, 32 aa, Artificial Sequence
  Description of Artificial Sequence: Synthetic polypeptide
DEEEIATTNPVAYECWGSVATNLQGDVGGNNR

SEQ ID NO: 69476 - protein, 31 aa, Artificial Sequence
  Description of Artificial Sequence: Synthetic polypeptide
DEEEIATTNPVAYERWGEVSTNLQHDQGNEE

SEQ ID NO: 69477 - protein, 30 aa, Artificial Sequence
  Description of Artificial Sequence: Synthetic polypeptide
QEGEIATTNPCATEQYGIVSCNLNMRGNPV

SEQ ID NO: 69478 - protein, 30 aa, Artificial Sequence
  Description of Artificial Sequence: Synthetic polypeptide
QEGEIATTNPCATEQYGIVSCALQRGMTPR

SEQ ID NO: 69479 - protein, 32 aa, Artificial Sequence
  Description of Artificial Sequence: Synthetic polypeptide
DEQEIATTNPVATEQYGSVSATDLEDREGQDL

SEQ ID NO: 69480 - protein, 34 aa, Artificial Sequence
  Description of Artificial Sequence: Synthetic polypeptide
DEEEIRTTNPVATEQYGSVSTPAGPNMRNGMNPV

SEQ ID NO: 69481 - protein, 33 aa, Artificial Sequence
  Description of Artificial Sequence: Synthetic polypeptide
DEEEIATTNPVAYEQYGVVVSTGNGDQDAGNHR

SEQ ID NO: 69482 - protein, 29 aa, Artificial Sequence
  Description of Artificial Sequence: Synthetic peptide
QEGEIATTNPCSSEQYGTVSCNLQSEGNR

SEQ ID NO: 69483 - protein, 32 aa, Artificial Sequence
  Description of Artificial Sequence: Synthetic polypeptide
DEQEIATTNPVATEQYGSVSATDLEDHEGNKL

SEQ ID NO: 69484 - protein, 32 aa, Artificial Sequence
  Description of Artificial Sequence: Synthetic polypeptide
DEQEIATTNPVATEQYGSVSATDLEDHEGNDQ

SEQ ID NO: 69485 - protein, 30 aa, Artificial Sequence
  Description of Artificial Sequence: Synthetic polypeptide
DEAEISTTNPVATEQYGCVCSWNLANNSNQ

SEQ ID NO: 69486 - protein, 34 aa, Artificial Sequence
  Description of Artificial Sequence: Synthetic polypeptide
DEAEIRTTNPVATEQYGSYWSTLDTNLERINQRD

SEQ ID NO: 69487 - protein, 33 aa, Artificial Sequence
  Description of Artificial Sequence: Synthetic polypeptide
DEEEIATTNPVATEQYGSVSSTPTGPNMRNGNV

SEQ ID NO: 69488 - protein, 33 aa, Artificial Sequence
  Description of Artificial Sequence: Synthetic polypeptide
AEEEIRTTNPVATEQYGSVSVNNVLGNNQGNAN

SEQ ID NO: 69489 - protein, 34 aa, Artificial Sequence
  Description of Artificial Sequence: Synthetic polypeptide
DEEEICTTNPVATECYGSVSTGNNLGQENGNNGA

SEQ ID NO: 69490 - protein, 33 aa, Artificial Sequence
  Description of Artificial Sequence: Synthetic polypeptide
DEEEIRTTNPVATEQYGSVAITNLQATIVESEE

SEQ ID NO: 69491 - protein, 28 aa, Artificial Sequence
  Description of Artificial Sequence: Synthetic peptide
QEGEIAPTNPVATECYGDVSECLQSGER

SEQ ID NO: 69492 - protein, 34 aa, Artificial Sequence
  Description of Artificial Sequence: Synthetic polypeptide
DEEEIRTTNPVATEQYGSVSTTNNGGQQGEQESE

SEQ ID NO: 69493 - protein, 29 aa, Artificial Sequence
  Description of Artificial Sequence: Synthetic peptide
QEGEIAPTNPVASEQYGTVSTNLEFEGND

SEQ ID NO: 69494 - protein, 34 aa, Artificial Sequence
  Description of Artificial Sequence: Synthetic polypeptide
DEEEIRTTNPVATEQYGSVSTTNNGGQQGEQEVE

SEQ ID NO: 69495 - protein, 33 aa, Artificial Sequence
  Description of Artificial Sequence: Synthetic polypeptide
DEEEICTTNPVATECYGSVSTGNQGNQGEGNND

SEQ ID NO: 69496 - protein, 32 aa, Artificial Sequence
  Description of Artificial Sequence: Synthetic polypeptide
AEEEIRTTNPVATEQYGSVSVNTNDNNTNDNT

SEQ ID NO: 69497 - protein, 28 aa, Artificial Sequence
  Description of Artificial Sequence: Synthetic peptide
QEGEIAPTNPVASEQYGEASCNLQSGGR

SEQ ID NO: 69498 - protein, 34 aa, Artificial Sequence
  Description of Artificial Sequence: Synthetic polypeptide
DEEEIRTTNPVATEQYGSVSTTNNINRSGEEELD

SEQ ID NO: 69499 - protein, 34 aa, Artificial Sequence
  Description of Artificial Sequence: Synthetic polypeptide
DEEEIATTNPVATEQYGSVSSTDPAGQMRNGMNV

SEQ ID NO: 69500 - protein, 28 aa, Artificial Sequence
  Description of Artificial Sequence: Synthetic peptide
QEGEIAPTNPVASEQYGDVSCNEQSGTR

SEQ ID NO: 69501 - protein, 35 aa, Artificial Sequence
  Description of Artificial Sequence: Synthetic polypeptide
DEEEIRTTNPVATEQYGSVSTTNNLGGQEQGTTVN

SEQ ID NO: 69502 - protein, 28 aa, Artificial Sequence
  Description of Artificial Sequence: Synthetic peptide
QEGEIAPTNPVASEQYGDVSCNEQAGTR

SEQ ID NO: 69503 - protein, 34 aa, Artificial Sequence
  Description of Artificial Sequence: Synthetic polypeptide
DEEEIRTTNPVATEQYGSVSTNPPMADFGSDQRG

SEQ ID NO: 69504 - protein, 36 aa, Artificial Sequence
  Description of Artificial Sequence: Synthetic polypeptide
DEEEIATTNPVATEQYGSVSQTVNQLGQGRQGQNLP

SEQ ID NO: 69505 - protein, 34 aa, Artificial Sequence
  Description of Artificial Sequence: Synthetic polypeptide
DEEEIRTTNPVATEQYGSVSTTNNLGGTEQGEQV

SEQ ID NO: 69506 - protein, 32 aa, Artificial Sequence
  Description of Artificial Sequence: Synthetic polypeptide
DEQEINTTNPVATEQYGSVVLTPTNDQKGDNT

SEQ ID NO: 69507 - protein, 34 aa, Artificial Sequence
  Description of Artificial Sequence: Synthetic polypeptide
DEEEIRTTNPVATEQYGSVAGTVNNLDIFGNEFE

SEQ ID NO: 69508 - protein, 33 aa, Artificial Sequence
  Description of Artificial Sequence: Synthetic polypeptide
DEEEICTTNPVATECYGSVSTGNMNDAQGGNTS

SEQ ID NO: 69509 - protein, 28 aa, Artificial Sequence
  Description of Artificial Sequence: Synthetic peptide
QEGEIAPTNPVATEQYGIVSCCLQHETR

SEQ ID NO: 69510 - protein, 33 aa, Artificial Sequence
  Description of Artificial Sequence: Synthetic polypeptide
DEEEICTTNPVATECYGSVSTGNGQGGMGNTND

SEQ ID NO: 69511 - protein, 34 aa, Artificial Sequence
  Description of Artificial Sequence: Synthetic polypeptide
DEEEICTTNPVATECYGSVSTGNGQGGHGNNRND

SEQ ID NO: 69512 - protein, 28 aa, Artificial Sequence
  Description of Artificial Sequence: Synthetic peptide
QENEIATTNPVATECYGDVSENLMHGEL

SEQ ID NO: 69513 - protein, 34 aa, Artificial Sequence
  Description of Artificial Sequence: Synthetic polypeptide
DEEEICTTNPVATECYGSVSTGNEGNQGGHGNER

SEQ ID NO: 69514 - protein, 28 aa, Artificial Sequence
  Description of Artificial Sequence: Synthetic peptide
QENEIATTNPVATECYGDVSENLQHEEL

SEQ ID NO: 69515 - protein, 29 aa, Artificial Sequence
  Description of Artificial Sequence: Synthetic peptide
DEQEIATVNPVATEQYGVVSDNLEDSGEL

SEQ ID NO: 69516 - protein, 30 aa, Artificial Sequence
  Description of Artificial Sequence: Synthetic polypeptide
DEQEIATVNPVCTEQYGVVSADNLQDSGNQ

SEQ ID NO: 69517 - protein, 28 aa, Artificial Sequence
  Description of Artificial Sequence: Synthetic peptide
QEGEIAPTNPVSSECYGIVSCNLQSGNR

SEQ ID NO: 69518 - protein, 28 aa, Artificial Sequence
  Description of Artificial Sequence: Synthetic peptide
QENEIATTNPVATECYGDVSENLQHEEQ

SEQ ID NO: 69519 - protein, 35 aa, Artificial Sequence
  Description of Artificial Sequence: Synthetic polypeptide
DEEEIRTTNPVATEQYGSVSTTNMDVQELGGNEQE

SEQ ID NO: 69520 - protein, 32 aa, Artificial Sequence
  Description of Artificial Sequence: Synthetic polypeptide
DEQEICTTNPAATEQYGSVVPTNLQMGGNGDT

SEQ ID NO: 69521 - protein, 32 aa, Artificial Sequence
  Description of Artificial Sequence: Synthetic polypeptide
DEQEICTTNPCATEQYGTVPTNELQHDGQNGR

SEQ ID NO: 69522 - protein, 32 aa, Artificial Sequence
  Description of Artificial Sequence: Synthetic polypeptide
DEEEIRTTNPVATEQYGSVANTEALAGPGETE

SEQ ID NO: 69523 - protein, 31 aa, Artificial Sequence
  Description of Artificial Sequence: Synthetic polypeptide
DEQEIATTNPVATEQYGSVSATDIEDHEGQR

SEQ ID NO: 69524 - protein, 35 aa, Artificial Sequence
  Description of Artificial Sequence: Synthetic polypeptide
DEEEIRTTNPVATEQYGSVSTTNMMPQERGEEEVD

SEQ ID NO: 69525 - protein, 28 aa, Artificial Sequence
  Description of Artificial Sequence: Synthetic peptide
QEGEIAPTNPVGTEQYGIVSCNLQSGTI

SEQ ID NO: 69526 - protein, 34 aa, Artificial Sequence
  Description of Artificial Sequence: Synthetic polypeptide
DEEEIRTTNPVATEQYGSVSTTNMMWQEEGEELD

SEQ ID NO: 69527 - protein, 30 aa, Artificial Sequence
  Description of Artificial Sequence: Synthetic polypeptide
DEQEICTTNPVAYEQWGAVATNLQDGGNDT

SEQ ID NO: 69528 - protein, 33 aa, Artificial Sequence
  Description of Artificial Sequence: Synthetic polypeptide
AEEEIRTTNPVATEQYGSVSVNNNLGGNQGNNQ

SEQ ID NO: 69529 - protein, 33 aa, Artificial Sequence
  Description of Artificial Sequence: Synthetic polypeptide
AEEEIRTTNPVATEQYGSVSVNNQLGGNQGNDT

SEQ ID NO: 69530 - protein, 33 aa, Artificial Sequence
  Description of Artificial Sequence: Synthetic polypeptide
DEEEICTTNPVATECYGSVSTGNGNQGGGGDND

SEQ ID NO: 69531 - protein, 35 aa, Artificial Sequence
  Description of Artificial Sequence: Synthetic polypeptide
DEEEIRTTNPVATEQYGSVSTTNMMWQERTGEEED

SEQ ID NO: 69532 - protein, 33 aa, Artificial Sequence
  Description of Artificial Sequence: Synthetic polypeptide
DEEEICTTNPVATECYGSVSTGNGNQGGTTNND

SEQ ID NO: 69533 - protein, 35 aa, Artificial Sequence
  Description of Artificial Sequence: Synthetic polypeptide
DEEEIRTTNPVATEQYGSVSTTNMMWQPRGEEEGQ

SEQ ID NO: 69534 - protein, 32 aa, Artificial Sequence
  Description of Artificial Sequence: Synthetic polypeptide
DEQEIATTNPVATEQYGSVSATDLECHEGEDR

SEQ ID NO: 69535 - protein, 34 aa, Artificial Sequence
  Description of Artificial Sequence: Synthetic polypeptide
DEEEICTTNPVATECYGSVSTGNGQGGHGGDMNR

SEQ ID NO: 69536 - protein, 28 aa, Artificial Sequence
  Description of Artificial Sequence: Synthetic peptide
QENEIATTNPVATECYGDVSENLQSEEL

SEQ ID NO: 69537 - protein, 33 aa, Artificial Sequence
  Description of Artificial Sequence: Synthetic polypeptide
DEEEICTTNPVATECYGSVSTGNEGNQGGGNVD

SEQ ID NO: 69538 - protein, 28 aa, Artificial Sequence
  Description of Artificial Sequence: Synthetic peptide
QEGEIAPTNPVASECYGIVSCNLQSGTR

SEQ ID NO: 69539 - protein, 31 aa, Artificial Sequence
  Description of Artificial Sequence: Synthetic polypeptide
DEEEIATTNPVATEQYGSVSMSGNLNGVDID

SEQ ID NO: 69540 - protein, 33 aa, Artificial Sequence
  Description of Artificial Sequence: Synthetic polypeptide
DEEEIRTTNPVATEQYGSVAENTKNLINNEENE

SEQ ID NO: 69541 - protein, 31 aa, Artificial Sequence
  Description of Artificial Sequence: Synthetic polypeptide
DEQEIATTNPVATEQYGSVSATCLEDHGEDL

SEQ ID NO: 69542 - protein, 32 aa, Artificial Sequence
  Description of Artificial Sequence: Synthetic polypeptide
DEEEIATTNPVATEQYGSVSCPAGPNRNGMNV

SEQ ID NO: 69543 - protein, 33 aa, Artificial Sequence
  Description of Artificial Sequence: Synthetic polypeptide
DEEEIRTTNPVATEQYGSVAEMILEQPRQGEIE

SEQ ID NO: 69544 - protein, 36 aa, Artificial Sequence
  Description of Artificial Sequence: Synthetic polypeptide
DEEEIRTTNPVATEQYGSVSTTNQQLQQGNNNQNEE

SEQ ID NO: 69545 - protein, 32 aa, Artificial Sequence
  Description of Artificial Sequence: Synthetic polypeptide
DEEEIATTNPVATEQYGSVSATVLEDHEGEDL

SEQ ID NO: 69546 - protein, 34 aa, Artificial Sequence
  Description of Artificial Sequence: Synthetic polypeptide
DEEEIRTTNPVATEQYGSVSTNNTTQFESTQNFA

SEQ ID NO: 69547 - protein, 31 aa, Artificial Sequence
  Description of Artificial Sequence: Synthetic polypeptide
DEQEIATTNPVATEQYGSVSASTLQDHGEDL

SEQ ID NO: 69548 - protein, 34 aa, Artificial Sequence
  Description of Artificial Sequence: Synthetic polypeptide
DEEEIRTTNPVATEQYGSVCSTNNQNPAAEPGDN

SEQ ID NO: 69549 - protein, 33 aa, Artificial Sequence
  Description of Artificial Sequence: Synthetic polypeptide
DEQEIRTTNPVATECYGSVSSANLSQMTGVNYA

SEQ ID NO: 69550 - protein, 35 aa, Artificial Sequence
  Description of Artificial Sequence: Synthetic polypeptide
DEEEIRTTNPVATEQYGSVSTNNTNQAGDGPEERI

SEQ ID NO: 69551 - protein, 31 aa, Artificial Sequence
  Description of Artificial Sequence: Synthetic polypeptide
DEQEIATTNPVATEQYGSVSASDLQDHGEDL

SEQ ID NO: 69552 - protein, 32 aa, Artificial Sequence
  Description of Artificial Sequence: Synthetic polypeptide
DEQEIATTNPVATEQYGSVSANDLQDHVGEDL

SEQ ID NO: 69553 - protein, 34 aa, Artificial Sequence
  Description of Artificial Sequence: Synthetic polypeptide
DEEEIRTTNPVATEQYGSVCSTNPELQEHDDTAK

SEQ ID NO: 69554 - protein, 35 aa, Artificial Sequence
  Description of Artificial Sequence: Synthetic polypeptide
DEEEIRTTNPVATEQYGSVCSTNPEPQQEHGNEAQ

SEQ ID NO: 69555 - protein, 36 aa, Artificial Sequence
  Description of Artificial Sequence: Synthetic polypeptide
DEEEIRTTNPVATEQYGSVCSTNPLPQEHAGMDNSD

SEQ ID NO: 69556 - protein, 36 aa, Artificial Sequence
  Description of Artificial Sequence: Synthetic polypeptide
DEEEIATTNPVATEQYGSVSATTNVNQTRKGDNNRG

SEQ ID NO: 69557 - protein, 33 aa, Artificial Sequence
  Description of Artificial Sequence: Synthetic polypeptide
DEEEIATTNPVATEQYGSVSATPALEDHEGNDV

SEQ ID NO: 69558 - protein, 32 aa, Artificial Sequence
  Description of Artificial Sequence: Synthetic polypeptide
DEEEIRTTNPVATEQYGSVADTPNGMNGGGYQ

SEQ ID NO: 69559 - protein, 32 aa, Artificial Sequence
  Description of Artificial Sequence: Synthetic polypeptide
DEEEIATTNPVATEQYGSVSATDLNDHEGEDL

SEQ ID NO: 69560 - protein, 28 aa, Artificial Sequence
  Description of Artificial Sequence: Synthetic peptide
QENEIATTNPVATECYGDVSRCLQHEER

SEQ ID NO: 69561 - protein, 33 aa, Artificial Sequence
  Description of Artificial Sequence: Synthetic polypeptide
DEEEIRTTNPVATEQYGSVSTTNQQVTESQAIG

SEQ ID NO: 69562 - protein, 34 aa, Artificial Sequence
  Description of Artificial Sequence: Synthetic polypeptide
DEEEIRTTNPVATEQYGSVSTTNRLEAEEGEELD

SEQ ID NO: 69563 - protein, 35 aa, Artificial Sequence
  Description of Artificial Sequence: Synthetic polypeptide
DEEEIATTNPVATEQYGSVSCTLNLPVATGGNNRT

SEQ ID NO: 69564 - protein, 30 aa, Artificial Sequence
  Description of Artificial Sequence: Synthetic polypeptide
DEQEIATTNPVATEQYGSVSATCLEHEEEL

SEQ ID NO: 69565 - protein, 34 aa, Artificial Sequence
  Description of Artificial Sequence: Synthetic polypeptide
DEEEIATTNPVATEQYGSVSCTLNLPVPTGGNNM

SEQ ID NO: 69566 - protein, 29 aa, Artificial Sequence
  Description of Artificial Sequence: Synthetic peptide
DEEEIATTNPVATEQYGSVSEDCEHEEEL

SEQ ID NO: 69567 - protein, 33 aa, Artificial Sequence
  Description of Artificial Sequence: Synthetic polypeptide
DEEEIRTTNPVATEQYGSVAGNDGEQGGQGNNI

SEQ ID NO: 69568 - protein, 34 aa, Artificial Sequence
  Description of Artificial Sequence: Synthetic polypeptide
DEEEIATTNPVATEQYGSVSKTEDLNQQRQGGEK

SEQ ID NO: 69569 - protein, 32 aa, Artificial Sequence
  Description of Artificial Sequence: Synthetic polypeptide
DEEEIATTNPVATEQYGSVSHGDLLRDIQVRM

SEQ ID NO: 69570 - protein, 31 aa, Artificial Sequence
  Description of Artificial Sequence: Synthetic polypeptide
DEQEIRCTNPIATEQYGSVSATDLEHEGEDR

SEQ ID NO: 69571 - protein, 31 aa, Artificial Sequence
  Description of Artificial Sequence: Synthetic polypeptide
DEQEIRCTNPIATEQYGSVSATDLMHEGEDR

SEQ ID NO: 69572 - protein, 30 aa, Artificial Sequence
  Description of Artificial Sequence: Synthetic polypeptide
DEQEIRCTNPIATEQYGSVSENLMHEGEDL

SEQ ID NO: 69573 - protein, 33 aa, Artificial Sequence
  Description of Artificial Sequence: Synthetic polypeptide
DEEEIRTTNPVATEQYGSVAETNQLVEDQILDN

SEQ ID NO: 69574 - protein, 31 aa, Artificial Sequence
  Description of Artificial Sequence: Synthetic polypeptide
DEQEIRCTNPVATEQYGSVSAENLMHEGEDL

SEQ ID NO: 69575 - protein, 34 aa, Artificial Sequence
  Description of Artificial Sequence: Synthetic polypeptide
DEEEIRTTNPVATEQYGSVSTNPLPEVNFEQLFQ

SEQ ID NO: 69576 - protein, 34 aa, Artificial Sequence
  Description of Artificial Sequence: Synthetic polypeptide
DEEEICTTNPVATECYGSVSTTGNLGQENGNNGD

SEQ ID NO: 69577 - protein, 34 aa, Artificial Sequence
  Description of Artificial Sequence: Synthetic polypeptide
DEEEIRTTNPVATEQYGSVSTTNPLDFDGGFEEM

SEQ ID NO: 69578 - protein, 31 aa, Artificial Sequence
  Description of Artificial Sequence: Synthetic polypeptide
DEQEIQTTNPVATEQYGSVSTDLEDHEGEDL

SEQ ID NO: 69579 - protein, 28 aa, Artificial Sequence
  Description of Artificial Sequence: Synthetic peptide
QEGEIAPTNPISTEQYGIVSENLQSGTR

SEQ ID NO: 69580 - protein, 33 aa, Artificial Sequence
  Description of Artificial Sequence: Synthetic polypeptide
DEEEIRTTNPVATEQYGSVSTTNPLEEEVEELD

SEQ ID NO: 69581 - protein, 32 aa, Artificial Sequence
  Description of Artificial Sequence: Synthetic polypeptide
DEQEIRCTNPVATEQYGSVSATDLEDHEGNDL

SEQ ID NO: 69582 - protein, 35 aa, Artificial Sequence
  Description of Artificial Sequence: Synthetic polypeptide
DEEEIRTTNPVATEQYGSVSTTNQLLQGNQSNNVE

SEQ ID NO: 69583 - protein, 32 aa, Artificial Sequence
  Description of Artificial Sequence: Synthetic polypeptide
CEEEIATTNPVAYEQYGSVCTDNLPQQGGNDA

SEQ ID NO: 69584 - protein, 28 aa, Artificial Sequence
  Description of Artificial Sequence: Synthetic peptide
QEGEIAPTNPISTEQYGIVSCNLQPGTR

SEQ ID NO: 69585 - protein, 31 aa, Artificial Sequence
  Description of Artificial Sequence: Synthetic polypeptide
CEEEIATTNPVATEQWGSVSQGNPQGGDNID

SEQ ID NO: 69586 - protein, 32 aa, Artificial Sequence
  Description of Artificial Sequence: Synthetic polypeptide
DEEEIATTNPVATEQYGSVSGGNGNSGEGNAM

SEQ ID NO: 69587 - protein, 35 aa, Artificial Sequence
  Description of Artificial Sequence: Synthetic polypeptide
DEEEIRTTNPVATEQYGSVCSTNMLVQFVNENSIT

SEQ ID NO: 69588 - protein, 35 aa, Artificial Sequence
  Description of Artificial Sequence: Synthetic polypeptide
DEEEIRTTNPVATEQYGSVCSTNNELQEHDDNTAG

SEQ ID NO: 69589 - protein, 28 aa, Artificial Sequence
  Description of Artificial Sequence: Synthetic peptide
QEGEIAPTNPISSEQYGIVSCNLQSGNR

SEQ ID NO: 69590 - protein, 31 aa, Artificial Sequence
  Description of Artificial Sequence: Synthetic polypeptide
DEQEIATTNPVATEQYGSVSATCLEHEGEDL

SEQ ID NO: 69591 - protein, 28 aa, Artificial Sequence
  Description of Artificial Sequence: Synthetic peptide
QEGEIAPTNPISTEQYGIVSCNLQSGTR

SEQ ID NO: 69592 - protein, 32 aa, Artificial Sequence
  Description of Artificial Sequence: Synthetic polypeptide
DEEEICTTNPVATECYGSVSTGNDTGGDGGPR

SEQ ID NO: 69593 - protein, 30 aa, Artificial Sequence
  Description of Artificial Sequence: Synthetic polypeptide
DEQEIATVNPVATEQYGVVSATDLESEGNQ

SEQ ID NO: 69594 - protein, 33 aa, Artificial Sequence
  Description of Artificial Sequence: Synthetic polypeptide
DEEEICTTNPVATECYGSVSTGNAQNGVGENDA

SEQ ID NO: 69595 - protein, 32 aa, Artificial Sequence
  Description of Artificial Sequence: Synthetic polypeptide
DEEEIATTNPVATEQYGSVSTTDLNDHEGEDL

SEQ ID NO: 69596 - protein, 33 aa, Artificial Sequence
  Description of Artificial Sequence: Synthetic polypeptide
DEEEIATTNPVATEQYGSVSTTDGNDRNGMNPV

SEQ ID NO: 69597 - protein, 32 aa, Artificial Sequence
  Description of Artificial Sequence: Synthetic polypeptide
DEEEIATTNPVATEQYGSVSTTDGNDREGEDV

SEQ ID NO: 69598 - protein, 33 aa, Artificial Sequence
  Description of Artificial Sequence: Synthetic polypeptide
DEEEIRTTNPVATEQYGSVASTNQMERQLEVLI

SEQ ID NO: 69599 - protein, 30 aa, Artificial Sequence
  Description of Artificial Sequence: Synthetic polypeptide
DEQEIATTNPVSSEQYGSVSATNLEHGTDL

SEQ ID NO: 69600 - protein, 30 aa, Artificial Sequence
  Description of Artificial Sequence: Synthetic polypeptide
DEAEISTTNPVATEQYGCVCSSNLAYGSDQ

SEQ ID NO: 69601 - protein, 34 aa, Artificial Sequence
  Description of Artificial Sequence: Synthetic polypeptide
DEEEIATTNPVATEQYGSVSTPLPQPEAEGENNH

SEQ ID NO: 69602 - protein, 32 aa, Artificial Sequence
  Description of Artificial Sequence: Synthetic polypeptide
DEEEIATTNPVATEQYGSVSTPAGPNMSGMNV

SEQ ID NO: 69603 - protein, 31 aa, Artificial Sequence
  Description of Artificial Sequence: Synthetic polypeptide
DEAEIRTTNPVAYEAWGCVSTNLNGAGENDR

SEQ ID NO: 69604 - protein, 32 aa, Artificial Sequence
  Description of Artificial Sequence: Synthetic polypeptide
DEAEIRTTNPVAYDQYGSVNCTPLSQRGGNDG

SEQ ID NO: 69605 - protein, 32 aa, Artificial Sequence
  Description of Artificial Sequence: Synthetic polypeptide
DEQEIATTNPVATEQYGSVSATDLEDHEGENL

SEQ ID NO: 69606 - protein, 32 aa, Artificial Sequence
  Description of Artificial Sequence: Synthetic polypeptide
DEEEICTTNPMATETYGSVPTNDHQHRGQNTE

SEQ ID NO: 69607 - protein, 31 aa, Artificial Sequence
  Description of Artificial Sequence: Synthetic polypeptide
DEEEICTTNPMATETYGSVPTNDPQHAGDFR

SEQ ID NO: 69608 - protein, 33 aa, Artificial Sequence
  Description of Artificial Sequence: Synthetic polypeptide
DEEEIATTNPVATEQYGSVSTPAGNMHNGMNPL

SEQ ID NO: 69609 - protein, 32 aa, Artificial Sequence
  Description of Artificial Sequence: Synthetic polypeptide
DEEEIATTNPVATEQYGSVSTNNHQENDMIDN

SEQ ID NO: 69610 - protein, 31 aa, Artificial Sequence
  Description of Artificial Sequence: Synthetic polypeptide
DEQEIATTNPVATEQYGSVSATDLEDHEGEL

SEQ ID NO: 69611 - protein, 32 aa, Artificial Sequence
  Description of Artificial Sequence: Synthetic polypeptide
DEEEICTTNPMATETYGSVPTNDPQHRGEIFR

SEQ ID NO: 69612 - protein, 31 aa, Artificial Sequence
  Description of Artificial Sequence: Synthetic polypeptide
DEEEICTTNPMATETYGSVPTNDPQHRSNGK

SEQ ID NO: 69613 - protein, 28 aa, Artificial Sequence
  Description of Artificial Sequence: Synthetic peptide
QENEIATTNPVATECYGDVSECLQSEER

SEQ ID NO: 69614 - protein, 31 aa, Artificial Sequence
  Description of Artificial Sequence: Synthetic polypeptide
DEQEIATTNPVSSEQYGSVSTNLEDHEGEDR

SEQ ID NO: 69615 - protein, 31 aa, Artificial Sequence
  Description of Artificial Sequence: Synthetic polypeptide
DEAEIRTTNPVAWEQYGSICSTNLENPSNQS

SEQ ID NO: 69616 - protein, 33 aa, Artificial Sequence
  Description of Artificial Sequence: Synthetic polypeptide
DEEEICTTNPMAYEAYGSVPTNALSQHRGGNNR

SEQ ID NO: 69617 - protein, 33 aa, Artificial Sequence
  Description of Artificial Sequence: Synthetic polypeptide
DEEEIATTNPVATEQYGSVSTEPAGPNMRGNPL

SEQ ID NO: 69618 - protein, 32 aa, Artificial Sequence
  Description of Artificial Sequence: Synthetic polypeptide
DEEEIATTNPVATEQYGSVSTTDLNDHEGEPL

SEQ ID NO: 69619 - protein, 33 aa, Artificial Sequence
  Description of Artificial Sequence: Synthetic polypeptide
AEEEIRTTNPVATEQYGSVSTVVNQQQQETNNN

SEQ ID NO: 69620 - protein, 34 aa, Artificial Sequence
  Description of Artificial Sequence: Synthetic polypeptide
DEEEICTTNPMATEQYGSVPIAMNLQQHRPGNIR

SEQ ID NO: 69621 - protein, 28 aa, Artificial Sequence
  Description of Artificial Sequence: Synthetic peptide
QENEIATTNPVATECYGDVSECLQREQL

SEQ ID NO: 69622 - protein, 32 aa, Artificial Sequence
  Description of Artificial Sequence: Synthetic polypeptide
DEQEIATTNPVATEQYGSVSATDLEDHEGNDL

SEQ ID NO: 69623 - protein, 31 aa, Artificial Sequence
  Description of Artificial Sequence: Synthetic polypeptide
DEEEICSTNPVATEQYGSVSTTMSQIQANYG

SEQ ID NO: 69624 - protein, 32 aa, Artificial Sequence
  Description of Artificial Sequence: Synthetic polypeptide
DEEEICTTNPAATEQYGSVPTVVVVHRNGNGR

SEQ ID NO: 69625 - protein, 29 aa, Artificial Sequence
  Description of Artificial Sequence: Synthetic peptide
DEQEIATTNPVCTEQYGSVSDDLEHEGEL

SEQ ID NO: 69626 - protein, 29 aa, Artificial Sequence
  Description of Artificial Sequence: Synthetic peptide
DEQEIATTNPVCTEQYGSVSDDLESEGEL

SEQ ID NO: 69627 - protein, 31 aa, Artificial Sequence
  Description of Artificial Sequence: Synthetic polypeptide
DEAEIRTTNPVAYEAWGVVTTNLQHDGDNGR

SEQ ID NO: 69628 - protein, 30 aa, Artificial Sequence
  Description of Artificial Sequence: Synthetic polypeptide
DEQEIATTNPVCTEQYGSVSTDLEHEGEDL

SEQ ID NO: 69629 - protein, 35 aa, Artificial Sequence
  Description of Artificial Sequence: Synthetic polypeptide
DEEEIRTTNPVATEQYGSVSTTNLGIERVLMPSRQ

SEQ ID NO: 69630 - protein, 31 aa, Artificial Sequence
  Description of Artificial Sequence: Synthetic polypeptide
DEAEIRTTNPVAYEAWGEVSTNLQHDQGNES

SEQ ID NO: 69631 - protein, 33 aa, Artificial Sequence
  Description of Artificial Sequence: Synthetic polypeptide
DEEEIRTTNPVATEQYGSVASVMNNGQRPEMVE

SEQ ID NO: 69632 - protein, 31 aa, Artificial Sequence
  Description of Artificial Sequence: Synthetic polypeptide
DEAEIRTTNPVAYEAWGEVSTNLQDGDNQEH

SEQ ID NO: 69633 - protein, 31 aa, Artificial Sequence
  Description of Artificial Sequence: Synthetic polypeptide
DEAEIRTTNPVAVEQYGSISWNLETEGNNQN

SEQ ID NO: 69634 - protein, 34 aa, Artificial Sequence
  Description of Artificial Sequence: Synthetic polypeptide
DEEEIRTTNPVATEQYGSVASVAGLEREVVNSRA

SEQ ID NO: 69635 - protein, 34 aa, Artificial Sequence
  Description of Artificial Sequence: Synthetic polypeptide
DEEEIRTTNPVATEQYGSVASTTQGGGQNGGNGD

SEQ ID NO: 69636 - protein, 30 aa, Artificial Sequence
  Description of Artificial Sequence: Synthetic polypeptide
DEQEIATTNPVGTEQYGSVATTLQDHGEDL

SEQ ID NO: 69637 - protein, 33 aa, Artificial Sequence
  Description of Artificial Sequence: Synthetic polypeptide
DEEEIATTNPVATEQYGSVSTTPALEDHEGNDV

SEQ ID NO: 69638 - protein, 33 aa, Artificial Sequence
  Description of Artificial Sequence: Synthetic polypeptide
DEEEIATTNPVATEQYGSVSTTPAGPNMRGNPL

SEQ ID NO: 69639 - protein, 28 aa, Artificial Sequence
  Description of Artificial Sequence: Synthetic peptide
QEGEIAPTNPVSTECYGDVSENLQSGTR

SEQ ID NO: 69640 - protein, 34 aa, Artificial Sequence
  Description of Artificial Sequence: Synthetic polypeptide
DEEEIRTTNPVATEQYGSVSTNTHAERDPPLERF

SEQ ID NO: 69641 - protein, 33 aa, Artificial Sequence
  Description of Artificial Sequence: Synthetic polypeptide
DEEEIATTNPVATEQYGSVSTTNQNQGNTENDQ

SEQ ID NO: 69642 - protein, 28 aa, Artificial Sequence
  Description of Artificial Sequence: Synthetic peptide
QENEIATTNPVATECYGDVSECLQREEL

SEQ ID NO: 69643 - protein, 28 aa, Artificial Sequence
  Description of Artificial Sequence: Synthetic peptide
QENEIATTNPVATECYGDVSECLQREGL

SEQ ID NO: 69644 - protein, 34 aa, Artificial Sequence
  Description of Artificial Sequence: Synthetic polypeptide
AEEEIRTTNPVATEQYGSVSTVVNQQQQGTNNNQ

SEQ ID NO: 69645 - protein, 32 aa, Artificial Sequence
  Description of Artificial Sequence: Synthetic polypeptide
DEQEIATTNPVATEQYGSVSATDLEDHEGERL

SEQ ID NO: 69646 - protein, 30 aa, Artificial Sequence
  Description of Artificial Sequence: Synthetic polypeptide
DEQEIATTNPVCTEQYGVVSTDLEHEGNDL

SEQ ID NO: 69647 - protein, 31 aa, Artificial Sequence
  Description of Artificial Sequence: Synthetic polypeptide
DEAEIRTTNPVAVEQYGSCSTPMLERQENQQ

SEQ ID NO: 69648 - protein, 33 aa, Artificial Sequence
  Description of Artificial Sequence: Synthetic polypeptide
DEEEIATTNPVATEQYGSVSTEALPNRNGMEPV

SEQ ID NO: 69649 - protein, 33 aa, Artificial Sequence
  Description of Artificial Sequence: Synthetic polypeptide
DEEEICTTNPMAYEQYGSVPCTNALSQTSGNNR

SEQ ID NO: 69650 - protein, 31 aa, Artificial Sequence
  Description of Artificial Sequence: Synthetic polypeptide
DEQEIATTNPVATEQYGSVSATDLEDHEGED

SEQ ID NO: 69651 - protein, 32 aa, Artificial Sequence
  Description of Artificial Sequence: Synthetic polypeptide
DEEEIRTTNPVATEQYGSVAQTNDSEERNIIE

SEQ ID NO: 69652 - protein, 35 aa, Artificial Sequence
  Description of Artificial Sequence: Synthetic polypeptide
DEEEIRTTNPVATEQYGSVSTTNLQQVEVGPMIQD

SEQ ID NO: 69653 - protein, 35 aa, Artificial Sequence
  Description of Artificial Sequence: Synthetic polypeptide
DEEEIRTTNPVATEQYGSVSTTNLQQVEVGVLEAD

SEQ ID NO: 69654 - protein, 32 aa, Artificial Sequence
  Description of Artificial Sequence: Synthetic polypeptide
DEQEIATTNPVATEQYGSVSATDLEDHEGDNL

SEQ ID NO: 69655 - protein, 33 aa, Artificial Sequence
  Description of Artificial Sequence: Synthetic polypeptide
DEAEIRTTNPVATEQYGVYTISTNELQRGQEDI

SEQ ID NO: 69656 - protein, 32 aa, Artificial Sequence
  Description of Artificial Sequence: Synthetic polypeptide
DEEEIRTTNPVATEQYGSVSTNSHTESTSQDM

SEQ ID NO: 69657 - protein, 32 aa, Artificial Sequence
  Description of Artificial Sequence: Synthetic polypeptide
DEAEIRTTNPVATEQYGVVSTELQENFPSNDA

SEQ ID NO: 69658 - protein, 31 aa, Artificial Sequence
  Description of Artificial Sequence: Synthetic polypeptide
DEAEIRTTNPVATEQYGVVSNTELQNFPSDQ

SEQ ID NO: 69659 - protein, 32 aa, Artificial Sequence
  Description of Artificial Sequence: Synthetic polypeptide
DEAEIRTTNPVATEQYGVVCSTTELQHFPSNQ

SEQ ID NO: 69660 - protein, 32 aa, Artificial Sequence
  Description of Artificial Sequence: Synthetic polypeptide
DEEEIRTTNPVATEQYGSVAPWQGLQRQQEFE

SEQ ID NO: 69661 - protein, 28 aa, Artificial Sequence
  Description of Artificial Sequence: Synthetic peptide
QENEIATTNPVATECYGDVSEGLQHENL

SEQ ID NO: 69662 - protein, 34 aa, Artificial Sequence
  Description of Artificial Sequence: Synthetic polypeptide
DEEEIRTTNPVATEQYGSVAPTNPLFPTGENEQL

SEQ ID NO: 69663 - protein, 28 aa, Artificial Sequence
  Description of Artificial Sequence: Synthetic peptide
QEGEIAPTNPVSSEQYGEVSCNLQSGGR

SEQ ID NO: 69664 - protein, 32 aa, Artificial Sequence
  Description of Artificial Sequence: Synthetic polypeptide
DEAEISTTNPVATEQYGCVCSTNLMYFGSNQG

SEQ ID NO: 69665 - protein, 32 aa, Artificial Sequence
  Description of Artificial Sequence: Synthetic polypeptide
DEAEISTTNPVATEQYGCVCSTPLQNFGSNQA

SEQ ID NO: 69666 - protein, 32 aa, Artificial Sequence
  Description of Artificial Sequence: Synthetic polypeptide
DEEEICTTNPVATECYGSVSTGGNTGADGMNS

SEQ ID NO: 69667 - protein, 28 aa, Artificial Sequence
  Description of Artificial Sequence: Synthetic peptide
QEGEIAPTNPVSSEQYGDVSENLQSGTR

SEQ ID NO: 69668 - protein, 29 aa, Artificial Sequence
  Description of Artificial Sequence: Synthetic peptide
DEQEIATVNPVATEQYGCVATNLADPGEH

SEQ ID NO: 69669 - protein, 33 aa, Artificial Sequence
  Description of Artificial Sequence: Synthetic polypeptide
DEAEIRTTNPVATEQYGVVCSMTELQRFPSNQS

SEQ ID NO: 69670 - protein, 30 aa, Artificial Sequence
  Description of Artificial Sequence: Synthetic polypeptide
DEEEIRTTNPVATEQYGSVAPDIQNQDLVE

SEQ ID NO: 69671 - protein, 28 aa, Artificial Sequence
  Description of Artificial Sequence: Synthetic peptide
QEGEIAPTNPVSSEQYGDVSCNLQSGER

SEQ ID NO: 69672 - protein, 35 aa, Artificial Sequence
  Description of Artificial Sequence: Synthetic polypeptide
DEEEIRTTNPVATEQYGSVSTTNLVQVEVGMLIAD

SEQ ID NO: 69673 - protein, 30 aa, Artificial Sequence
  Description of Artificial Sequence: Synthetic polypeptide
DEQEIATVNPVATEQYGVVSADDLQDSGNQ

SEQ ID NO: 69674 - protein, 28 aa, Artificial Sequence
  Description of Artificial Sequence: Synthetic peptide
QEGEIAPTNPVSSEQYGEVSCNLQSGTR

SEQ ID NO: 69675 - protein, 34 aa, Artificial Sequence
  Description of Artificial Sequence: Synthetic polypeptide
DEEEIRTTNPVATEQYGSVSTTNLDQSHVVDPEL

SEQ ID NO: 69676 - protein, 28 aa, Artificial Sequence
  Description of Artificial Sequence: Synthetic peptide
QENEIATTNPVATECYGDVSEDLQHGEL

SEQ ID NO: 69677 - protein, 34 aa, Artificial Sequence
  Description of Artificial Sequence: Synthetic polypeptide
DEEEIRTTNPVATEQYGSVASPIGVLQQDVNERG

SEQ ID NO: 69678 - protein, 34 aa, Artificial Sequence
  Description of Artificial Sequence: Synthetic polypeptide
DEEEICTTNPMAYEQYGSVPTNMLSQVRTGGSNR

SEQ ID NO: 69679 - protein, 33 aa, Artificial Sequence
  Description of Artificial Sequence: Synthetic polypeptide
DEEEIATTNPVATEQYGSVSTCPAGPNRNGMNV

SEQ ID NO: 69680 - protein, 33 aa, Artificial Sequence
  Description of Artificial Sequence: Synthetic polypeptide
DEEEICTTNPTAYEEYGSVPTNLSQSRTGGSNR

SEQ ID NO: 69681 - protein, 28 aa, Artificial Sequence
  Description of Artificial Sequence: Synthetic peptide
QEGEIAPTNPVSSEQYGVVSCNLQSGTR

SEQ ID NO: 69682 - protein, 32 aa, Artificial Sequence
  Description of Artificial Sequence: Synthetic polypeptide
DEEEICTTNPTAYEQYGSVATNLQGAGGNGMQ

SEQ ID NO: 69683 - protein, 28 aa, Artificial Sequence
  Description of Artificial Sequence: Synthetic peptide
QEGEIAPTNPVSSEQYGTVSMNIQQGNR

SEQ ID NO: 69684 - protein, 28 aa, Artificial Sequence
  Description of Artificial Sequence: Synthetic peptide
QEGEIAPTNPVSSEQYGNVSCNLQSGTR

SEQ ID NO: 69685 - protein, 32 aa, Artificial Sequence
  Description of Artificial Sequence: Synthetic polypeptide
DEQEIATTNPVATEQYGSVSATDLEDHEGEDR

SEQ ID NO: 69686 - protein, 28 aa, Artificial Sequence
  Description of Artificial Sequence: Synthetic peptide
QEGEIAPTNPVSSEQYGIVSNNLQSGTR

SEQ ID NO: 69687 - protein, 28 aa, Artificial Sequence
  Description of Artificial Sequence: Synthetic peptide
QEGEIAPTNPVSSEQYGIVSENLQSGTR

SEQ ID NO: 69688 - protein, 28 aa, Artificial Sequence
  Description of Artificial Sequence: Synthetic peptide
QEGEIAPTNPVSSEQYGIVSCNLQSGTR

SEQ ID NO: 69689 - protein, 32 aa, Artificial Sequence
  Description of Artificial Sequence: Synthetic polypeptide
DEAEIRTTNPVATETWGCVSTNLQGDLGGNGS

SEQ ID NO: 69690 - protein, 30 aa, Artificial Sequence
  Description of Artificial Sequence: Synthetic polypeptide
DEAEIRTTNPVATFHYGSVSTLDLTRTEDM

SEQ ID NO: 69691 - protein, 32 aa, Artificial Sequence
  Description of Artificial Sequence: Synthetic polypeptide
DEAEIRTTNPVATEYYGVVSTNLQGNGGDMGD

SEQ ID NO: 69692 - protein, 30 aa, Artificial Sequence
  Description of Artificial Sequence: Synthetic polypeptide
DEQEIATTNPVSTEQYGIVSATNLEDHGEL

SEQ ID NO: 69693 - protein, 28 aa, Artificial Sequence
  Description of Artificial Sequence: Synthetic peptide
QEGEIAPTNPVSSEQYGIVSCNLQSGGR

SEQ ID NO: 69694 - protein, 34 aa, Artificial Sequence
  Description of Artificial Sequence: Synthetic polypeptide
DEEEIATTNPVATEQYGSVSSTTPALPNMRGMNV

SEQ ID NO: 69695 - protein, 33 aa, Artificial Sequence
  Description of Artificial Sequence: Synthetic polypeptide
DEEEIRTTNPVATEQYGSVASPTDLLERNQEQE

SEQ ID NO: 69696 - protein, 31 aa, Artificial Sequence
  Description of Artificial Sequence: Synthetic polypeptide
DEQEIATTNPVSTEQYGNVSANDLQDREGQL

SEQ ID NO: 69697 - protein, 35 aa, Artificial Sequence
  Description of Artificial Sequence: Synthetic polypeptide
DEEEIRTTNPVATEQYGSVASPSFNGQERGMQIRD

SEQ ID NO: 69698 - protein, 34 aa, Artificial Sequence
  Description of Artificial Sequence: Synthetic polypeptide
DEEEICTTNPVATEAYGSVSTTNGLGQENGNNMG

SEQ ID NO: 69699 - protein, 28 aa, Artificial Sequence
  Description of Artificial Sequence: Synthetic peptide
QEGEIAPTNPVSSEQYGIVSCNLQQGTR

SEQ ID NO: 69700 - protein, 31 aa, Artificial Sequence
  Description of Artificial Sequence: Synthetic polypeptide
DEQEIATTNPVSTEQYGSVSATNLEDHEGEL

SEQ ID NO: 69701 - protein, 31 aa, Artificial Sequence
  Description of Artificial Sequence: Synthetic polypeptide
DEAEISTTNPVATEQYGCVCSTNLAYGSDTT

SEQ ID NO: 69702 - protein, 34 aa, Artificial Sequence
  Description of Artificial Sequence: Synthetic polypeptide
DEEEIATTNPVATEQYGSVSSTTPNLPNMSGMNV

SEQ ID NO: 69703 - protein, 32 aa, Artificial Sequence
  Description of Artificial Sequence: Synthetic polypeptide
DEQEIATTNPVATEQYGSVSANDLEDREGQDL

SEQ ID NO: 69704 - protein, 29 aa, Artificial Sequence
  Description of Artificial Sequence: Synthetic peptide
QEGEIATTNPCSSEQYGTVSTNLESEGNR

SEQ ID NO: 69705 - protein, 33 aa, Artificial Sequence
  Description of Artificial Sequence: Synthetic polypeptide
DEEEIRTTNPVATEQYGSVCSTETQEHSGSEQS

SEQ ID NO: 69706 - protein, 34 aa, Artificial Sequence
  Description of Artificial Sequence: Synthetic polypeptide
DEEEIRTTNPVATEQYGSVSTPQGAQTRQVNPEV

SEQ ID NO: 69707 - protein, 32 aa, Artificial Sequence
  Description of Artificial Sequence: Synthetic polypeptide
DEEEIRTTNPVATEQYGSVSTPQAHSDSIQRS

SEQ ID NO: 69708 - protein, 35 aa, Artificial Sequence
  Description of Artificial Sequence: Synthetic polypeptide
DEEEIRTTNPVATEQYGSVCSNTENLQGFGSETQT

SEQ ID NO: 69709 - protein, 35 aa, Artificial Sequence
  Description of Artificial Sequence: Synthetic polypeptide
DEEEIRTTNPVATEQYGSVCSNTGELQHFGSNNQG

SEQ ID NO: 69710 - protein, 32 aa, Artificial Sequence
  Description of Artificial Sequence: Synthetic polypeptide
DEEEIRTTNPVATEQYGSVCSNTGLEVAEPDQ

SEQ ID NO: 69711 - protein, 31 aa, Artificial Sequence
  Description of Artificial Sequence: Synthetic polypeptide
DEAEIRTTNPVAYEQWGVVSTNLNGDHGNEK

SEQ ID NO: 69712 - protein, 32 aa, Artificial Sequence
  Description of Artificial Sequence: Synthetic polypeptide
DEAEIRTTNPVAYEQWGVVSTNLQGDAGNGEH

SEQ ID NO: 69713 - protein, 32 aa, Artificial Sequence
  Description of Artificial Sequence: Synthetic polypeptide
DEAEIRTTNPVAYEQWGVVSTNLQGNTGDNNM

SEQ ID NO: 69714 - protein, 29 aa, Artificial Sequence
  Description of Artificial Sequence: Synthetic peptide
QEMEIATTNPVATECYGTVSECLVQHGNL

SEQ ID NO: 69715 - protein, 31 aa, Artificial Sequence
  Description of Artificial Sequence: Synthetic polypeptide
DEAEIRTTNPVAYEQWGVVSVTVLSQRPGPD

SEQ ID NO: 69716 - protein, 35 aa, Artificial Sequence
  Description of Artificial Sequence: Synthetic polypeptide
DEEEIRTTNPVATEQYGSVCSNTMNDLEVGFNVEI

SEQ ID NO: 69717 - protein, 29 aa, Artificial Sequence
  Description of Artificial Sequence: Synthetic peptide
QEMEIATTNPCSSEQYGIVSTNLQSEGTR

SEQ ID NO: 69718 - protein, 34 aa, Artificial Sequence
  Description of Artificial Sequence: Synthetic polypeptide
DEEEIRTTNPVATEQYGSVCSNTNHNQHFNSNQS

SEQ ID NO: 69719 - protein, 28 aa, Artificial Sequence
  Description of Artificial Sequence: Synthetic peptide
QENEIASTNPVGTEQYGEMSENLQHGGR

SEQ ID NO: 69720 - protein, 32 aa, Artificial Sequence
  Description of Artificial Sequence: Synthetic polypeptide
DEQEIATTNPVATEQYGSVSATLLEDHEGNDL

SEQ ID NO: 69721 - protein, 29 aa, Artificial Sequence
  Description of Artificial Sequence: Synthetic peptide
QEMEIASTNPVATEQYGVVSASTLQFGNI

SEQ ID NO: 69722 - protein, 29 aa, Artificial Sequence
  Description of Artificial Sequence: Synthetic peptide
QEMEIASTNPVATEQYGTVSASTLQFGNI

SEQ ID NO: 69723 - protein, 32 aa, Artificial Sequence
  Description of Artificial Sequence: Synthetic polypeptide
DEQEIATTNPVATEQYGSVSDTDLEDHEGENL

SEQ ID NO: 69724 - protein, 33 aa, Artificial Sequence
  Description of Artificial Sequence: Synthetic polypeptide
DEEEIRTTNPVATEQYGSVCNPNLQNMLMVQRD

SEQ ID NO: 69725 - protein, 31 aa, Artificial Sequence
  Description of Artificial Sequence: Synthetic polypeptide
DEEEIATTNPVAYEQWGSYWSTINELQDHNN

SEQ ID NO: 69726 - protein, 32 aa, Artificial Sequence
  Description of Artificial Sequence: Synthetic polypeptide
DEEEIRTTNPVATEQYGSVCNGFNDYGMGDTR

SEQ ID NO: 69727 - protein, 28 aa, Artificial Sequence
  Description of Artificial Sequence: Synthetic peptide
QENEIATTNPCATEQYGIVSCNLQSEEL

SEQ ID NO: 69728 - protein, 31 aa, Artificial Sequence
  Description of Artificial Sequence: Synthetic polypeptide
DEQEIATTNPVATEQYGSVSATILEDHAGDA

SEQ ID NO: 69729 - protein, 35 aa, Artificial Sequence
  Description of Artificial Sequence: Synthetic polypeptide
DEEEIRTTNPVATEQYGSVCSNTENDLQNFGSDQT

SEQ ID NO: 69730 - protein, 31 aa, Artificial Sequence
  Description of Artificial Sequence: Synthetic polypeptide
DEQEIATTNPVATEQYGSVSCDLEDHEGNDL

SEQ ID NO: 69731 - protein, 33 aa, Artificial Sequence
  Description of Artificial Sequence: Synthetic polypeptide
DEEEIRTTNPVATEQYGSVSTPTLAQNNVDVAI

SEQ ID NO: 69732 - protein, 34 aa, Artificial Sequence
  Description of Artificial Sequence: Synthetic polypeptide
DEEEIRTTNPVATEQYGSVSTPTLSGTEGENQAA

SEQ ID NO: 69733 - protein, 33 aa, Artificial Sequence
  Description of Artificial Sequence: Synthetic polypeptide
DEEEIRTTNPVATEQYGSVCSNNLGQVTITELE

SEQ ID NO: 69734 - protein, 34 aa, Artificial Sequence
  Description of Artificial Sequence: Synthetic polypeptide
DEEEIRTTNPVATEQYGSVCSNNLIMPRIENEEE

SEQ ID NO: 69735 - protein, 33 aa, Artificial Sequence
  Description of Artificial Sequence: Synthetic polypeptide
DEEEIRTTNPVATEQYGSVCNTFNHYGRETQRE

SEQ ID NO: 69736 - protein, 34 aa, Artificial Sequence
  Description of Artificial Sequence: Synthetic polypeptide
DEEEIRTTNPVATEQYGSVCNTFNHLYGRESTQR

SEQ ID NO: 69737 - protein, 34 aa, Artificial Sequence
  Description of Artificial Sequence: Synthetic polypeptide
AEEEIRTTNPVATEQYGSVSTVVNTQQEGEAGNE

SEQ ID NO: 69738 - protein, 33 aa, Artificial Sequence
  Description of Artificial Sequence: Synthetic polypeptide
DEEEIRTTNPVATEQYGSVSTPVDNQEQSNFGG

SEQ ID NO: 69739 - protein, 32 aa, Artificial Sequence
  Description of Artificial Sequence: Synthetic polypeptide
DEEEIATTNPVAYEQWGVVSTNLNQGDIGDHR

SEQ ID NO: 69740 - protein, 34 aa, Artificial Sequence
  Description of Artificial Sequence: Synthetic polypeptide
DEEEIRTTNPVATEQYGSVSTPVDDQTEEEGNFQ

SEQ ID NO: 69741 - protein, 28 aa, Artificial Sequence
  Description of Artificial Sequence: Synthetic peptide
QEMEIVSTNPVATEGYGTVSTGPQHGND

SEQ ID NO: 69742 - protein, 28 aa, Artificial Sequence
  Description of Artificial Sequence: Synthetic peptide
QEMEIVSTNPVATEGYGTVSSGLQHGND

SEQ ID NO: 69743 - protein, 34 aa, Artificial Sequence
  Description of Artificial Sequence: Synthetic polypeptide
DEEEIRTTNPVATEQYGSVSTPTNNQEVFGLEQA

SEQ ID NO: 69744 - protein, 29 aa, Artificial Sequence
  Description of Artificial Sequence: Synthetic peptide
DEQEIATTNPVATEQYGSVSEDLEHEEDK

SEQ ID NO: 69745 - protein, 34 aa, Artificial Sequence
  Description of Artificial Sequence: Synthetic polypeptide
DEEEIRTTNPVATEQYGSVCSNTEELANFGSNQG

SEQ ID NO: 69746 - protein, 34 aa, Artificial Sequence
  Description of Artificial Sequence: Synthetic polypeptide
DEEEIRTTNPVATEQYGSVCSNTEELQSFGSDQG

SEQ ID NO: 69747 - protein, 29 aa, Artificial Sequence
  Description of Artificial Sequence: Synthetic peptide
QEMEIATTNPVSSEQYGTVSATGLQFGTR

SEQ ID NO: 69748 - protein, 34 aa, Artificial Sequence
  Description of Artificial Sequence: Synthetic polypeptide
DEEEIRTTNPVATEQYGSVCSNTEHQERFGSDQS

SEQ ID NO: 69749 - protein, 33 aa, Artificial Sequence
  Description of Artificial Sequence: Synthetic polypeptide
DEEEIRTTNPVATEQYGSVCSNTEHQHFNSNQA

SEQ ID NO: 69750 - protein, 33 aa, Artificial Sequence
  Description of Artificial Sequence: Synthetic polypeptide
DEEEIRTTNPVATEQYGSVCNTFNDHYGGGGTR

SEQ ID NO: 69751 - protein, 34 aa, Artificial Sequence
  Description of Artificial Sequence: Synthetic polypeptide
DEEEIRTTNPVATEQYGSVSTPTLSQTEGEVPQW

SEQ ID NO: 69752 - protein, 31 aa, Artificial Sequence
  Description of Artificial Sequence: Synthetic polypeptide
DEAEIRTTNPVAYEQWGSVSNDNGQNAMGND

SEQ ID NO: 69753 - protein, 29 aa, Artificial Sequence
  Description of Artificial Sequence: Synthetic peptide
QEMEIATTNPVATEQYGTVSTGPEFEGND

SEQ ID NO: 69754 - protein, 33 aa, Artificial Sequence
  Description of Artificial Sequence: Synthetic polypeptide
DEEEIRTTNPVATEQYGSVSTPTLSPTSENPQA

SEQ ID NO: 69755 - protein, 30 aa, Artificial Sequence
  Description of Artificial Sequence: Synthetic polypeptide
QEMEIATTNPVATEQYGTVCSTTLEFEGNI

SEQ ID NO: 69756 - protein, 33 aa, Artificial Sequence
  Description of Artificial Sequence: Synthetic polypeptide
DEEEIRTTNPVATEQYGSVCNTFDLYGRYETQR

SEQ ID NO: 69757 - protein, 33 aa, Artificial Sequence
  Description of Artificial Sequence: Synthetic polypeptide
QEMEIRTTNPVATEQYGSVSSTIEHQLGGQNYR

SEQ ID NO: 69758 - protein, 29 aa, Artificial Sequence
  Description of Artificial Sequence: Synthetic peptide
QEMEIVSTNPVATEQYGVVSTGLVEHGND

SEQ ID NO: 69759 - protein, 34 aa, Artificial Sequence
  Description of Artificial Sequence: Synthetic polypeptide
DEEEIRTTNPVATEQYGSVSTQSVGQTDGGNDTG

SEQ ID NO: 69760 - protein, 33 aa, Artificial Sequence
  Description of Artificial Sequence: Synthetic polypeptide
DEQEIATTNPVATEQYGSVSATIDLEDREGNDG

SEQ ID NO: 69761 - protein, 33 aa, Artificial Sequence
  Description of Artificial Sequence: Synthetic polypeptide
DEEEIRTTNPVATEQYGSVSTSDCIQHLNEDFA

SEQ ID NO: 69762 - protein, 32 aa, Artificial Sequence
  Description of Artificial Sequence: Synthetic polypeptide
DEEEIATTNPVAYEQWGSVSTNLQPGGGQDDP

SEQ ID NO: 69763 - protein, 32 aa, Artificial Sequence
  Description of Artificial Sequence: Synthetic polypeptide
DEQEIATTNPVATEQYGSVSTIDLEDREGEDG

SEQ ID NO: 69764 - protein, 32 aa, Artificial Sequence
  Description of Artificial Sequence: Synthetic polypeptide
DEQEIATTNPVATEQYGSVSATIDLEDHEGNL

SEQ ID NO: 69765 - protein, 32 aa, Artificial Sequence
  Description of Artificial Sequence: Synthetic polypeptide
DEEEIRTTNPVATEQYGSVSTSDPQTPSMDQD

SEQ ID NO: 69766 - protein, 31 aa, Artificial Sequence
  Description of Artificial Sequence: Synthetic polypeptide
DEEEIATTNPVAYEQYGSVATNLADTPDGTN

SEQ ID NO: 69767 - protein, 32 aa, Artificial Sequence
  Description of Artificial Sequence: Synthetic polypeptide
DEEEIATTNPVAYEQYGSVATNLAGNPMEGNP

SEQ ID NO: 69768 - protein, 33 aa, Artificial Sequence
  Description of Artificial Sequence: Synthetic polypeptide
DEEEIATTNPVAYEQYGSVATNLDQRPGEETLM

SEQ ID NO: 69769 - protein, 31 aa, Artificial Sequence
  Description of Artificial Sequence: Synthetic polypeptide
DEQEIATTNPVATEQYGSVSATHLEHEGEDL

SEQ ID NO: 69770 - protein, 32 aa, Artificial Sequence
  Description of Artificial Sequence: Synthetic polypeptide
DEQEIATTNPVATEQYGSVSTIDLPQDHEGEG

SEQ ID NO: 69771 - protein, 33 aa, Artificial Sequence
  Description of Artificial Sequence: Synthetic polypeptide
DEQEIATTNPVATEQYGSVSTNLNMNGDGNGNK

SEQ ID NO: 69772 - protein, 34 aa, Artificial Sequence
  Description of Artificial Sequence: Synthetic polypeptide
DEEEIRTTNPVATEQYGSVCSPTNLDETRVEDHG

SEQ ID NO: 69773 - protein, 32 aa, Artificial Sequence
  Description of Artificial Sequence: Synthetic polypeptide
DEEEIATTNPVAYEQYGSVATNLQAAGDQTEN

SEQ ID NO: 69774 - protein, 33 aa, Artificial Sequence
  Description of Artificial Sequence: Synthetic polypeptide
DEEEIATTNPVAYEQYGSVATNLQAAGEGNGQD

SEQ ID NO: 69775 - protein, 34 aa, Artificial Sequence
  Description of Artificial Sequence: Synthetic polypeptide
DEEEIRTTNPVATEQYGSVCSPTNLEERNDDQES

SEQ ID NO: 69776 - protein, 31 aa, Artificial Sequence
  Description of Artificial Sequence: Synthetic polypeptide
DEEEIATTNPVAYEQYGSVATNLQANPVEDA

SEQ ID NO: 69777 - protein, 33 aa, Artificial Sequence
  Description of Artificial Sequence: Synthetic polypeptide
DEEEIATTNPVAYEQWGSVSTNLQGNDAGNTEE

SEQ ID NO: 69778 - protein, 33 aa, Artificial Sequence
  Description of Artificial Sequence: Synthetic polypeptide
DEEEIATTNPVAYEQYGSVATNLQATPDGNDPN

SEQ ID NO: 69779 - protein, 33 aa, Artificial Sequence
  Description of Artificial Sequence: Synthetic polypeptide
DEEEIRTTNPVATEQYGSVCSPTNLELEDDQEG

SEQ ID NO: 69780 - protein, 32 aa, Artificial Sequence
  Description of Artificial Sequence: Synthetic polypeptide
DEEEIATTNPVAYEQWGSVSTNLQDGQGGAIK

SEQ ID NO: 69781 - protein, 32 aa, Artificial Sequence
  Description of Artificial Sequence: Synthetic polypeptide
DEEEIATTNPVAYEQYGSVATNLQDAEPNNDD

SEQ ID NO: 69782 - protein, 28 aa, Artificial Sequence
  Description of Artificial Sequence: Synthetic peptide
QENEIATTNPVASEQYGIVSECLQSGTL

SEQ ID NO: 69783 - protein, 32 aa, Artificial Sequence
  Description of Artificial Sequence: Synthetic polypeptide
DEEEIATTNPVAYEQWGSVSTNLNQNSGGDGD

SEQ ID NO: 69784 - protein, 31 aa, Artificial Sequence
  Description of Artificial Sequence: Synthetic polypeptide
DEQEIATTNPVATEQYGSVSTDLEDSEGEDL

SEQ ID NO: 69785 - protein, 31 aa, Artificial Sequence
  Description of Artificial Sequence: Synthetic polypeptide
DEQEIATTNPVATEQYGSVSTDLEDHNGEDL

SEQ ID NO: 69786 - protein, 32 aa, Artificial Sequence
  Description of Artificial Sequence: Synthetic polypeptide
DEQEIATTNPVATEQYGSVSTDLEDHEGENDL

SEQ ID NO: 69787 - protein, 36 aa, Artificial Sequence
  Description of Artificial Sequence: Synthetic polypeptide
DEEEIRTTNPVATEQYGSVCSPTEDNLDRQGDNNQK

SEQ ID NO: 69788 - protein, 32 aa, Artificial Sequence
  Description of Artificial Sequence: Synthetic polypeptide
DEQEIATTNPVATEQYGSVSETDLEQHEGEDL

SEQ ID NO: 69789 - protein, 32 aa, Artificial Sequence
  Description of Artificial Sequence: Synthetic polypeptide
DEEEIATTNPVAYEQWGSVVSTGNGQDAGNHN

SEQ ID NO: 69790 - protein, 33 aa, Artificial Sequence
  Description of Artificial Sequence: Synthetic polypeptide
DEEEIRTTNPVATEQYGSVSTQTSVGMGGGNGQ

SEQ ID NO: 69791 - protein, 33 aa, Artificial Sequence
  Description of Artificial Sequence: Synthetic polypeptide
DEEEIRTTNPVATEQYGSVSTPNNNIGQTEQTE

SEQ ID NO: 69792 - protein, 31 aa, Artificial Sequence
  Description of Artificial Sequence: Synthetic polypeptide
DEEEIATTNPVAYEQWGSVTTQLNQGNGNSG

SEQ ID NO: 69793 - protein, 34 aa, Artificial Sequence
  Description of Artificial Sequence: Synthetic polypeptide
DEEEIATTNPVAYEQYGSVATGNLQATPDGNARN

SEQ ID NO: 69794 - protein, 33 aa, Artificial Sequence
  Description of Artificial Sequence: Synthetic polypeptide
AEEEIRTTNPVATEQYGSVSTVVNQQQQTENTN

SEQ ID NO: 69795 - protein, 32 aa, Artificial Sequence
  Description of Artificial Sequence: Synthetic polypeptide
DEQEIATTNPVATEQYGSVSKTDLEDHTGENH

SEQ ID NO: 69796 - protein, 32 aa, Artificial Sequence
  Description of Artificial Sequence: Synthetic polypeptide
DEQEIATTNPVATEQYGSVSKTDLEQHQGEDM

SEQ ID NO: 69797 - protein, 33 aa, Artificial Sequence
  Description of Artificial Sequence: Synthetic polypeptide
DEEEIATTNPVAYEQWGSVSTTNNLQGDVGNAD

SEQ ID NO: 69798 - protein, 31 aa, Artificial Sequence
  Description of Artificial Sequence: Synthetic polypeptide
DEEEIATTNPVAYEQWGSVSTTNGQAGDAGV

SEQ ID NO: 69799 - protein, 34 aa, Artificial Sequence
  Description of Artificial Sequence: Synthetic polypeptide
DEEEIRTTNPVATEQYGSVSTQTGLSDNGGGNNG

SEQ ID NO: 69800 - protein, 31 aa, Artificial Sequence
  Description of Artificial Sequence: Synthetic polypeptide
DEEEIATTNPVAYEQWGSVSTTNGGQMGDAV

SEQ ID NO: 69801 - protein, 32 aa, Artificial Sequence
  Description of Artificial Sequence: Synthetic polypeptide
DEQEIATTNPVATEQYGSVSRTDLERHEGEDL

SEQ ID NO: 69802 - protein, 31 aa, Artificial Sequence
  Description of Artificial Sequence: Synthetic polypeptide
DEEEIATTNPVAYEQWGSVSTTNDGQGMGSS

SEQ ID NO: 69803 - protein, 32 aa, Artificial Sequence
  Description of Artificial Sequence: Synthetic polypeptide
DEAEIRTTNPVAYEQYGISVSTNQSGDGGNYM

SEQ ID NO: 69804 - protein, 32 aa, Artificial Sequence
  Description of Artificial Sequence: Synthetic polypeptide
DEEEIATTNPVAYEQWGSVSTTNDAGEGGNQR

SEQ ID NO: 69805 - protein, 32 aa, Artificial Sequence
  Description of Artificial Sequence: Synthetic polypeptide
DEEEIATTNPVAYEQWGSVSTQLNQGNDGNSG

SEQ ID NO: 69806 - protein, 30 aa, Artificial Sequence
  Description of Artificial Sequence: Synthetic polypeptide
DEQEIATTNPVATEQYGSVSTDIEDHNGEL

SEQ ID NO: 69807 - protein, 31 aa, Artificial Sequence
  Description of Artificial Sequence: Synthetic polypeptide
DEQEIATTNPVATEQYGSVSTDIQEQHNGEL

SEQ ID NO: 69808 - protein, 31 aa, Artificial Sequence
  Description of Artificial Sequence: Synthetic polypeptide
DEQEIATTNPVATEQYGSVSTDIQQQHNGEL

SEQ ID NO: 69809 - protein, 31 aa, Artificial Sequence
  Description of Artificial Sequence: Synthetic polypeptide
DEQEIATTNPVATEQYGSVSTDLEDHEGEDL

SEQ ID NO: 69810 - protein, 33 aa, Artificial Sequence
  Description of Artificial Sequence: Synthetic polypeptide
DEEEIRTTNPVATEQYGSVSTSAPIREAEDNQD

SEQ ID NO: 69811 - protein, 33 aa, Artificial Sequence
  Description of Artificial Sequence: Synthetic polypeptide
DEEEIATTNPVAYEQYGSVATNGTQTRNNDERG

SEQ ID NO: 69812 - protein, 30 aa, Artificial Sequence
  Description of Artificial Sequence: Synthetic polypeptide
DEEEIATTNPVAYEQWGSVSTTNGDAGDAV

SEQ ID NO: 69813 - protein, 31 aa, Artificial Sequence
  Description of Artificial Sequence: Synthetic polypeptide
DEAEIRTTNPVAYEQWGSVSNNDGQNMGGND

SEQ ID NO: 69814 - protein, 30 aa, Artificial Sequence
  Description of Artificial Sequence: Synthetic polypeptide
DEAEIRTTNPVAYEQWGSVSNNGDNAGQND

SEQ ID NO: 69815 - protein, 31 aa, Artificial Sequence
  Description of Artificial Sequence: Synthetic polypeptide
DEAEIRTTNPVAYEQWGSVSNNGGQDAGNED

SEQ ID NO: 69816 - protein, 32 aa, Artificial Sequence
  Description of Artificial Sequence: Synthetic polypeptide
DEAEIRTTNPVAYEQWGSVSTNLQLNGDQDEA

SEQ ID NO: 69817 - protein, 32 aa, Artificial Sequence
  Description of Artificial Sequence: Synthetic polypeptide
DEAEIRTTNPVAYEQWGSVSTNLQMNGDGDEQ

SEQ ID NO: 69818 - protein, 32 aa, Artificial Sequence
  Description of Artificial Sequence: Synthetic polypeptide
DEAEIRTTNPVAYEQWGSVSTNLQNDGGGDEA

SEQ ID NO: 69819 - protein, 33 aa, Artificial Sequence
  Description of Artificial Sequence: Synthetic polypeptide
DEAEIRTTNPVAYEQWGSVSTNAGMQGEGNTNR

SEQ ID NO: 69820 - protein, 28 aa, Artificial Sequence
  Description of Artificial Sequence: Synthetic peptide
QENEIACTNPVATEQYGEVSECLQHGEL

SEQ ID NO: 69821 - protein, 28 aa, Artificial Sequence
  Description of Artificial Sequence: Synthetic peptide
QENEIACTNPVATEQYGEVSECLQHEGR

SEQ ID NO: 69822 - protein, 29 aa, Artificial Sequence
  Description of Artificial Sequence: Synthetic peptide
QENEIAPTNPVSTEQYGTVSMNIQQQGNR

SEQ ID NO: 69823 - protein, 32 aa, Artificial Sequence
  Description of Artificial Sequence: Synthetic polypeptide
DEAEIRTTNPVAYEQWGSVSTNLQNGDHQQES

SEQ ID NO: 69824 - protein, 32 aa, Artificial Sequence
  Description of Artificial Sequence: Synthetic polypeptide
DEAEIRTTNPVAYEQWGSVSTNLQQGDMGDAN

SEQ ID NO: 69825 - protein, 34 aa, Artificial Sequence
  Description of Artificial Sequence: Synthetic polypeptide
AEEEIRTTNPVATEQYGSVSTVVSNGNQGGNNTV

SEQ ID NO: 69826 - protein, 33 aa, Artificial Sequence
  Description of Artificial Sequence: Synthetic polypeptide
DEAEIRTTNPVAYEQWGSVSTNLQQGTGGNNAN

SEQ ID NO: 69827 - protein, 32 aa, Artificial Sequence
  Description of Artificial Sequence: Synthetic polypeptide
DEAEIRTTNPVAYEQWGSVSTENAGMQGENNR

SEQ ID NO: 69828 - protein, 28 aa, Artificial Sequence
  Description of Artificial Sequence: Synthetic peptide
QENEIACTNPVATEQYGEASENLQREGL

SEQ ID NO: 69829 - protein, 32 aa, Artificial Sequence
  Description of Artificial Sequence: Synthetic polypeptide
DEAEIRTTNPVAYEQWGSVSTNLQTNMGGDEA

SEQ ID NO: 69830 - protein, 33 aa, Artificial Sequence
  Description of Artificial Sequence: Synthetic polypeptide
DEAEIRTTNPVAYEQWGSVSTNMNGEQEGENDR

SEQ ID NO: 69831 - protein, 33 aa, Artificial Sequence
  Description of Artificial Sequence: Synthetic polypeptide
DEAEIRTTNPVAYEQWGSVSTNNPLGEDMGNAR

SEQ ID NO: 69832 - protein, 28 aa, Artificial Sequence
  Description of Artificial Sequence: Synthetic peptide
QENEIACTNPVATEQYGEASENCQRGEK

SEQ ID NO: 69833 - protein, 28 aa, Artificial Sequence
  Description of Artificial Sequence: Synthetic peptide
QENEIACTNPVATEQYGEASENCQHGER

SEQ ID NO: 69834 - protein, 34 aa, Artificial Sequence
  Description of Artificial Sequence: Synthetic polypeptide
DEEEIRTTNPVATEQYGSVCSCTNDNQHFGSDFA

SEQ ID NO: 69835 - protein, 31 aa, Artificial Sequence
  Description of Artificial Sequence: Synthetic polypeptide
DEAEIRTTNPVAYEQWGSVSTNPPQDGIEGP

SEQ ID NO: 69836 - protein, 28 aa, Artificial Sequence
  Description of Artificial Sequence: Synthetic peptide
QENEIACTNPVATEQYGEAPEVLQRGGR

SEQ ID NO: 69837 - protein, 28 aa, Artificial Sequence
  Description of Artificial Sequence: Synthetic peptide
QENEIACTNPVATEQYGEAPEVLQRGER

SEQ ID NO: 69838 - protein, 32 aa, Artificial Sequence
  Description of Artificial Sequence: Synthetic polypeptide
DEAEIRTTNPVAYEQWGSVSTNPQQGEDGNAN

SEQ ID NO: 69839 - protein, 28 aa, Artificial Sequence
  Description of Artificial Sequence: Synthetic peptide
QENEIAPTNPVSSEQYGTVSMNIQQGNR

SEQ ID NO: 69840 - protein, 28 aa, Artificial Sequence
  Description of Artificial Sequence: Synthetic peptide
QENEIAPTNPVSSEQYGIVSCNLQSGTR

SEQ ID NO: 69841 - protein, 28 aa, Artificial Sequence
  Description of Artificial Sequence: Synthetic peptide
QENEIACTNPVATEQYGVAAENLQHGDR

SEQ ID NO: 69842 - protein, 33 aa, Artificial Sequence
  Description of Artificial Sequence: Synthetic polypeptide
DEEEIRTTNPVATEQYGSVSTQNDNTLELEEFN

SEQ ID NO: 69843 - protein, 31 aa, Artificial Sequence
  Description of Artificial Sequence: Synthetic polypeptide
DEAEIRTTNPVAYEQWGSVSTNLNGDLNGGA

SEQ ID NO: 69844 - protein, 32 aa, Artificial Sequence
  Description of Artificial Sequence: Synthetic polypeptide
DEAEIRTTNPVAYEQWGSVSTNLNGDTGMDRG

SEQ ID NO: 69845 - protein, 28 aa, Artificial Sequence
  Description of Artificial Sequence: Synthetic peptide
QENEIAPTNPVASEQYGIVSCCLQSGTR

SEQ ID NO: 69846 - protein, 33 aa, Artificial Sequence
  Description of Artificial Sequence: Synthetic polypeptide
AEEEIRTTNPVATEQYGSVSTVVNVNQQNEENE

SEQ ID NO: 69847 - protein, 28 aa, Artificial Sequence
  Description of Artificial Sequence: Synthetic peptide
QENEIAPTNPCSTEQYGIVSCNLQSGTR

SEQ ID NO: 69848 - protein, 32 aa, Artificial Sequence
  Description of Artificial Sequence: Synthetic polypeptide
DEAEIRTTNPVAYEQWGSVSTNLNGEHGNESE

SEQ ID NO: 69849 - protein, 32 aa, Artificial Sequence
  Description of Artificial Sequence: Synthetic polypeptide
DEAEIRTTNPVAYEQWGSVSTNLNGEHGQNSP

SEQ ID NO: 69850 - protein, 32 aa, Artificial Sequence
  Description of Artificial Sequence: Synthetic polypeptide
DEAEIRTTNPVAYEQWGSVSTNLNMDGGMNND

SEQ ID NO: 69851 - protein, 32 aa, Artificial Sequence
  Description of Artificial Sequence: Synthetic polypeptide
DEAEIRTTNPVAYEQWGSVSTNLNGDHGNEKE

SEQ ID NO: 69852 - protein, 28 aa, Artificial Sequence
  Description of Artificial Sequence: Synthetic peptide
QENEIAPTNPCSSEQYGEVSENLQRGGR

SEQ ID NO: 69853 - protein, 32 aa, Artificial Sequence
  Description of Artificial Sequence: Synthetic polypeptide
DEEEIRTTNPVATEQYGSVCPTSLPQVMLVPI

SEQ ID NO: 69854 - protein, 33 aa, Artificial Sequence
  Description of Artificial Sequence: Synthetic polypeptide
DEEEIRTTNPVATEQYGSVSTQMPGIGGNGGTT

SEQ ID NO: 69855 - protein, 33 aa, Artificial Sequence
  Description of Artificial Sequence: Synthetic polypeptide
DEEEIRTTNPVATEQYGSVSTQNGMGQGEDEEG

SEQ ID NO: 69856 - protein, 28 aa, Artificial Sequence
  Description of Artificial Sequence: Synthetic peptide
QENEIAPTNPCASEQYGIVSENLQSGTR

SEQ ID NO: 69857 - protein, 33 aa, Artificial Sequence
  Description of Artificial Sequence: Synthetic polypeptide
DEAEIRTTNPVAYEQWGSVSTNLQGGPNGNGAN

SEQ ID NO: 69858 - protein, 28 aa, Artificial Sequence
  Description of Artificial Sequence: Synthetic peptide
QENEIACTNPVSTEQYGEASENLQSGGR

SEQ ID NO: 69859 - protein, 32 aa, Artificial Sequence
  Description of Artificial Sequence: Synthetic polypeptide
DEAEIRTTNPVAYEQWGSVSTNLQGMQGGDTN

SEQ ID NO: 69860 - protein, 28 aa, Artificial Sequence
  Description of Artificial Sequence: Synthetic peptide
QENEIACTNPVSSEQYGEVSCNLQSGGR

SEQ ID NO: 69861 - protein, 34 aa, Artificial Sequence
  Description of Artificial Sequence: Synthetic polypeptide
AEEEIRTTNPVATEQYGSVSTVVNVNQIGTENQE

SEQ ID NO: 69862 - protein, 31 aa, Artificial Sequence
  Description of Artificial Sequence: Synthetic polypeptide
DEAEIRTTNPVAYEQWGSVSTNLEGNHDNNM

SEQ ID NO: 69863 - protein, 34 aa, Artificial Sequence
  Description of Artificial Sequence: Synthetic polypeptide
DEEEIRTTNPVATEQYGSVCQTNLVILNGMQNNQ

SEQ ID NO: 69864 - protein, 34 aa, Artificial Sequence
  Description of Artificial Sequence: Synthetic polypeptide
DEEEIRTTNPVATEQYGSVCQTNLVINTGLQNLQ

SEQ ID NO: 69865 - protein, 32 aa, Artificial Sequence
  Description of Artificial Sequence: Synthetic polypeptide
DEEEIRTTNPVATEQYGSVCPDNNLERIQQQD

SEQ ID NO: 69866 - protein, 32 aa, Artificial Sequence
  Description of Artificial Sequence: Synthetic polypeptide
DEAEIRTTNPVAYEQWGSVSTNLQGQGGDGTK

SEQ ID NO: 69867 - protein, 32 aa, Artificial Sequence
  Description of Artificial Sequence: Synthetic polypeptide
DEAEIRTTNPVAYEQWGSVSTNLNQNGDGDTA

SEQ ID NO: 69868 - protein, 28 aa, Artificial Sequence
  Description of Artificial Sequence: Synthetic peptide
QENEIACTNPVATEQYGDVSENLMHGEL

SEQ ID NO: 69869 - protein, 28 aa, Artificial Sequence
  Description of Artificial Sequence: Synthetic peptide
QENEIACTNPVATEQYGDVSECLQHGGL

SEQ ID NO: 69870 - protein, 28 aa, Artificial Sequence
  Description of Artificial Sequence: Synthetic peptide
QENEIACTNPVATEQYGDVSECLQHGEL

SEQ ID NO: 69871 - protein, 32 aa, Artificial Sequence
  Description of Artificial Sequence: Synthetic polypeptide
DEEEIRTTNPVATEQYGSVCSHTNEFVMWPEG

SEQ ID NO: 69872 - protein, 28 aa, Artificial Sequence
  Description of Artificial Sequence: Synthetic peptide
QENEIASTNPVATEGYGEASETLQRGDR

SEQ ID NO: 69873 - protein, 32 aa, Artificial Sequence
  Description of Artificial Sequence: Synthetic polypeptide
DEEEIATTNPVAYEQYGQSVSQNDLGQPDITR

SEQ ID NO: 69874 - protein, 32 aa, Artificial Sequence
  Description of Artificial Sequence: Synthetic polypeptide
DEQEIATTNPVATEQYGSVSATNLEDHEGEDL

SEQ ID NO: 69875 - protein, 33 aa, Artificial Sequence
  Description of Artificial Sequence: Synthetic polypeptide
DEEEIRTTNPVATEQYGSVCSIVNMETTTGNQQ

SEQ ID NO: 69876 - protein, 28 aa, Artificial Sequence
  Description of Artificial Sequence: Synthetic peptide
QENEIASTNPVATEGYGEASETLQRGGR

SEQ ID NO: 69877 - protein, 28 aa, Artificial Sequence
  Description of Artificial Sequence: Synthetic peptide
QENEIASTNPVATEGYGEMSENLQRGGI

SEQ ID NO: 69878 - protein, 34 aa, Artificial Sequence
  Description of Artificial Sequence: Synthetic polypeptide
DEEEIATTNPVAYEQYGQSTSTNDLDQDRGIGDR

SEQ ID NO: 69879 - protein, 32 aa, Artificial Sequence
  Description of Artificial Sequence: Synthetic polypeptide
DEQEIATTNPVATEQYGSVSATTLEDHEGNDL

SEQ ID NO: 69880 - protein, 35 aa, Artificial Sequence
  Description of Artificial Sequence: Synthetic polypeptide
DEEEIRTTNPVATEQYGSVCSLTLELPQRNEEPNE

SEQ ID NO: 69881 - protein, 32 aa, Artificial Sequence
  Description of Artificial Sequence: Synthetic polypeptide
DEEEIRTTNPVATEQYGSVCSLVMSEQENNNG

SEQ ID NO: 69882 - protein, 33 aa, Artificial Sequence
  Description of Artificial Sequence: Synthetic polypeptide
DEEEIATTNPVAYEQYGSVAATNLQMSGEDERG

SEQ ID NO: 69883 - protein, 34 aa, Artificial Sequence
  Description of Artificial Sequence: Synthetic polypeptide
DEEEIRTTNPVATEQYGSVCSMAGTTGQHGENDN

SEQ ID NO: 69884 - protein, 31 aa, Artificial Sequence
  Description of Artificial Sequence: Synthetic polypeptide
DEAEIRTTNPVAYEQWGSVSNNLQGGQDGGH

SEQ ID NO: 69885 - protein, 31 aa, Artificial Sequence
  Description of Artificial Sequence: Synthetic polypeptide
DEAEIRTTNPVAYEQWGTVSTNIQDGGNGNK

SEQ ID NO: 69886 - protein, 33 aa, Artificial Sequence
  Description of Artificial Sequence: Synthetic polypeptide
DEEEIRTTNPVATEQYGSVSTQGVGMGGQNGGL

SEQ ID NO: 69887 - protein, 31 aa, Artificial Sequence
  Description of Artificial Sequence: Synthetic polypeptide
DEAEIRTTNPVAYEQWGSVSNNGQNAGGNDE

SEQ ID NO: 69888 - protein, 34 aa, Artificial Sequence
  Description of Artificial Sequence: Synthetic polypeptide
DEEEIRTTNPVATEQYGSVCSMTELQHFNSNTQL

SEQ ID NO: 69889 - protein, 36 aa, Artificial Sequence
  Description of Artificial Sequence: Synthetic polypeptide
DEEEIRTTNPVATEQYGSVCSMTGNHQERFGSENQS

SEQ ID NO: 69890 - protein, 31 aa, Artificial Sequence
  Description of Artificial Sequence: Synthetic polypeptide
DEAEIRTTNPVAYEQWGSVSNNGGQNAGNHD

SEQ ID NO: 69891 - protein, 31 aa, Artificial Sequence
  Description of Artificial Sequence: Synthetic polypeptide
DEAEIRTTNPVAYEQWGTVSTNLQSNDGGEA

SEQ ID NO: 69892 - protein, 34 aa, Artificial Sequence
  Description of Artificial Sequence: Synthetic polypeptide
DEEEIRTTNPVATEQYGSVSTQGGGQNVEGGNED

SEQ ID NO: 69893 - protein, 31 aa, Artificial Sequence
  Description of Artificial Sequence: Synthetic polypeptide
DEQEIATTNPVATEQYGSVSATVLEDHGEDK

SEQ ID NO: 69894 - protein, 31 aa, Artificial Sequence
  Description of Artificial Sequence: Synthetic polypeptide
DEQEIATTNPVATEQYGSVSATVLEDHGEDL

SEQ ID NO: 69895 - protein, 32 aa, Artificial Sequence
  Description of Artificial Sequence: Synthetic polypeptide
DEEEIATTNPVAYEQYGSVAGTNLQIDGDDLH

SEQ ID NO: 69896 - protein, 34 aa, Artificial Sequence
  Description of Artificial Sequence: Synthetic polypeptide
DEEEIRTTNPVATEQYGSVCSPTNLERNDDEQSS

SEQ ID NO: 69897 - protein, 33 aa, Artificial Sequence
  Description of Artificial Sequence: Synthetic polypeptide
DEEEIATTNPVAYEQYGQSVSTNDLMQDGIGDE

SEQ ID NO: 69898 - protein, 31 aa, Artificial Sequence
  Description of Artificial Sequence: Synthetic polypeptide
DEEEIATTNPVAYEQYGSVAATNLQANPTEH

SEQ ID NO: 69899 - protein, 28 aa, Artificial Sequence
  Description of Artificial Sequence: Synthetic peptide
QENEIACTNPVATEQYGDVSECLQHEGR

SEQ ID NO: 69900 - protein, 28 aa, Artificial Sequence
  Description of Artificial Sequence: Synthetic peptide
QENEIACTNPVATEQYGDVSECLQHEER

SEQ ID NO: 69901 - protein, 34 aa, Artificial Sequence
  Description of Artificial Sequence: Synthetic polypeptide
DEEEIRTTNPVATEQYGSVCNTGNLIERFGSEQS

SEQ ID NO: 69902 - protein, 28 aa, Artificial Sequence
  Description of Artificial Sequence: Synthetic peptide
QENEIACTNPVATEGYGEMSENLQRGGI

SEQ ID NO: 69903 - protein, 28 aa, Artificial Sequence
  Description of Artificial Sequence: Synthetic peptide
QENEIACTNPVATEGYGEMAENLQRGGR

SEQ ID NO: 69904 - protein, 28 aa, Artificial Sequence
  Description of Artificial Sequence: Synthetic peptide
QENEIACTNPVATEGYGEMAENLQRGDR

SEQ ID NO: 69905 - protein, 28 aa, Artificial Sequence
  Description of Artificial Sequence: Synthetic peptide
QENEIACTNPVATEGYGEASETLQRGGR

SEQ ID NO: 69906 - protein, 30 aa, Artificial Sequence
  Description of Artificial Sequence: Synthetic polypeptide
DEAEIRTTNPVAYEQWGSVSNQNGGNAGND

SEQ ID NO: 69907 - protein, 28 aa, Artificial Sequence
  Description of Artificial Sequence: Synthetic peptide
QENEIACTNPVATECYGSVSECLQHEER

SEQ ID NO: 69908 - protein, 28 aa, Artificial Sequence
  Description of Artificial Sequence: Synthetic peptide
QENEIACTNPVATECYGSVSECLMHGER

SEQ ID NO: 69909 - protein, 32 aa, Artificial Sequence
  Description of Artificial Sequence: Synthetic polypeptide
DEQEIATTNPVATEQYGSVSATNLEVHEGEDL

SEQ ID NO: 69910 - protein, 32 aa, Artificial Sequence
  Description of Artificial Sequence: Synthetic polypeptide
DEAEIRTTNPVAYEQWGSVTTNLQGGTDGNAN

SEQ ID NO: 69911 - protein, 31 aa, Artificial Sequence
  Description of Artificial Sequence: Synthetic polypeptide
DEAEIRTTNPVAYEQWGSVSTTNGDNAGNDI

SEQ ID NO: 69912 - protein, 33 aa, Artificial Sequence
  Description of Artificial Sequence: Synthetic polypeptide
DEAEIRTTNPVAYEQWGSVSTTNNLQHDQGNAD

SEQ ID NO: 69913 - protein, 31 aa, Artificial Sequence
  Description of Artificial Sequence: Synthetic polypeptide
DEAEIRTTNPVAYEQWGSVSNPNGQNMGGND

SEQ ID NO: 69914 - protein, 34 aa, Artificial Sequence
  Description of Artificial Sequence: Synthetic polypeptide
DEEEIRTTNPVATEQYGSVCNTFNVDGGRGGTDR

SEQ ID NO: 69915 - protein, 32 aa, Artificial Sequence
  Description of Artificial Sequence: Synthetic polypeptide
DEAEIRTTNPVAYEQWGSVSNPNGQNAGNDDR

SEQ ID NO: 69916 - protein, 32 aa, Artificial Sequence
  Description of Artificial Sequence: Synthetic polypeptide
DEQEIATTNPVATEQYGSVSATNLEDHEGTDL

SEQ ID NO: 69917 - protein, 33 aa, Artificial Sequence
  Description of Artificial Sequence: Synthetic polypeptide
DEAEIRTTNPVAYEQWGSVSTVNGLSQGEGNEE

SEQ ID NO: 69918 - protein, 32 aa, Artificial Sequence
  Description of Artificial Sequence: Synthetic polypeptide
DEAEIRTTNPVAYEQWGSVTTDGLGQGGGNTR

SEQ ID NO: 69919 - protein, 33 aa, Artificial Sequence
  Description of Artificial Sequence: Synthetic polypeptide
DEEEIRTTNPVATEQYGSVCNTFNNDYGGGDTR

SEQ ID NO: 69920 - protein, 30 aa, Artificial Sequence
  Description of Artificial Sequence: Synthetic polypeptide
DEAEIRTTNPVAYEQWGSVTTNHGEDGNVG

SEQ ID NO: 69921 - protein, 32 aa, Artificial Sequence
  Description of Artificial Sequence: Synthetic polypeptide
DEQEIATTNPVATEQYGSVSATNLEDHEGEDQ

SEQ ID NO: 69922 - protein, 32 aa, Artificial Sequence
  Description of Artificial Sequence: Synthetic polypeptide
DEEEIATTNPVAYEQYGSVAATNDQRQDNNEA

SEQ ID NO: 69923 - protein, 33 aa, Artificial Sequence
  Description of Artificial Sequence: Synthetic polypeptide
DEAEIRTTNPVAYEQWGSVSTTNLQQGDLGNAN

SEQ ID NO: 69924 - protein, 31 aa, Artificial Sequence
  Description of Artificial Sequence: Synthetic polypeptide
DEQEIATTNPVATEQYGSVSATDLEHNGEDL

SEQ ID NO: 69925 - protein, 32 aa, Artificial Sequence
  Description of Artificial Sequence: Synthetic polypeptide
DEEEIATTNPVAYEQWGSVSTNLNQGEGMGDA

SEQ ID NO: 69926 - protein, 32 aa, Artificial Sequence
  Description of Artificial Sequence: Synthetic polypeptide
DEEEIATTNPVAYEQWGSVSTNLNGEDMGGDR

SEQ ID NO: 69927 - protein, 32 aa, Artificial Sequence
  Description of Artificial Sequence: Synthetic polypeptide
DEEEIRTTNPVATEQYGSVSTTDQQVELAEFA

SEQ ID NO: 69928 - protein, 31 aa, Artificial Sequence
  Description of Artificial Sequence: Synthetic polypeptide
DEAEIRTTNPVCTEGYGSVSMPTLQEVGNNL

SEQ ID NO: 69929 - protein, 35 aa, Artificial Sequence
  Description of Artificial Sequence: Synthetic polypeptide
DEEEIRTTNPVATEQYGSVSTTDTLGPDRMENNRE

SEQ ID NO: 69930 - protein, 30 aa, Artificial Sequence
  Description of Artificial Sequence: Synthetic polypeptide
DEAEIRTTNPVCTEGYGSVSMPTMQEGGNL

SEQ ID NO: 69931 - protein, 35 aa, Artificial Sequence
  Description of Artificial Sequence: Synthetic polypeptide
DEEEIRTTNPVATEQYGSVSTTEGTLQTRVVNMNI

SEQ ID NO: 69932 - protein, 33 aa, Artificial Sequence
  Description of Artificial Sequence: Synthetic polypeptide
DEEEIRTTNPVATEQYGSVSTTEHQNTQEQESE

SEQ ID NO: 69933 - protein, 33 aa, Artificial Sequence
  Description of Artificial Sequence: Synthetic polypeptide
DEEEIRTTNPVATEQYGSVCAAGNPQRNEMNDN

SEQ ID NO: 69934 - protein, 31 aa, Artificial Sequence
  Description of Artificial Sequence: Synthetic polypeptide
DEAEIRTTNPVAYEQWGEVSTNLQLGGDDDS

SEQ ID NO: 69935 - protein, 32 aa, Artificial Sequence
  Description of Artificial Sequence: Synthetic polypeptide
DEAEIRTTNPVAYEQWGEVSTNLQLGEGQNDE

SEQ ID NO: 69936 - protein, 35 aa, Artificial Sequence
  Description of Artificial Sequence: Synthetic polypeptide
DEEEIRTTNPVATEQYGSVCAADNPLADRDGNDRH

SEQ ID NO: 69937 - protein, 28 aa, Artificial Sequence
  Description of Artificial Sequence: Synthetic peptide
QEGEIATTNPVATEQYGEVPENCQHGTK

SEQ ID NO: 69938 - protein, 35 aa, Artificial Sequence
  Description of Artificial Sequence: Synthetic polypeptide
DEEEIRTTNPVATEQYGSVSTPNFVQAMNDINERG

SEQ ID NO: 69939 - protein, 33 aa, Artificial Sequence
  Description of Artificial Sequence: Synthetic polypeptide
DEEEIRTTNPVATEQYGSVCAAANNDQDDPGNN

SEQ ID NO: 69940 - protein, 32 aa, Artificial Sequence
  Description of Artificial Sequence: Synthetic polypeptide
DEEEIATTNPVAYEQWGSESETETLQRGNSEG

SEQ ID NO: 69941 - protein, 32 aa, Artificial Sequence
  Description of Artificial Sequence: Synthetic polypeptide
DEAEIRTTNPVAYEQWGEVSTNLQIGGGNNAE

SEQ ID NO: 69942 - protein, 34 aa, Artificial Sequence
  Description of Artificial Sequence: Synthetic polypeptide
DEEEIATTNPVAYEQWGSCPSTDNLSQRPGGNRG

SEQ ID NO: 69943 - protein, 31 aa, Artificial Sequence
  Description of Artificial Sequence: Synthetic polypeptide
DEAEIRTTNPVAYEQWGEVSTNLQIGGGDEA

SEQ ID NO: 69944 - protein, 32 aa, Artificial Sequence
  Description of Artificial Sequence: Synthetic polypeptide
DEAEIRTTNPVAYEQWGEVSTNLQGGTGDNAN

SEQ ID NO: 69945 - protein, 28 aa, Artificial Sequence
  Description of Artificial Sequence: Synthetic peptide
QEGEIATTNPVATEQYGEAPENCQHGER

SEQ ID NO: 69946 - protein, 28 aa, Artificial Sequence
  Description of Artificial Sequence: Synthetic peptide
QEGEIATTNPVATEQYGDVSECLQSEEL

SEQ ID NO: 69947 - protein, 33 aa, Artificial Sequence
  Description of Artificial Sequence: Synthetic polypeptide
DEEEIRTTNPVATEQYGSVSTPNEQPPLEELGY

SEQ ID NO: 69948 - protein, 31 aa, Artificial Sequence
  Description of Artificial Sequence: Synthetic polypeptide
DEEEIRTTNPVATEQYGSVSTTGEIVPEHLN

SEQ ID NO: 69949 - protein, 32 aa, Artificial Sequence
  Description of Artificial Sequence: Synthetic polypeptide
DEQEIATTNPVATEQYGSVSWTDLEDQEGKDL

SEQ ID NO: 69950 - protein, 32 aa, Artificial Sequence
  Description of Artificial Sequence: Synthetic polypeptide
DEEEIRTTNPVATEQYGSVCAANNGDQDQDNN

SEQ ID NO: 69951 - protein, 32 aa, Artificial Sequence
  Description of Artificial Sequence: Synthetic polypeptide
DEEEIRTTNPVATEQYGSVCAANNLTEHGEDH

SEQ ID NO: 69952 - protein, 33 aa, Artificial Sequence
  Description of Artificial Sequence: Synthetic polypeptide
DEEEIRTTNPVATEQYGSVCAANNNDQDPDGNN

SEQ ID NO: 69953 - protein, 31 aa, Artificial Sequence
  Description of Artificial Sequence: Synthetic polypeptide
DEAEIRTTNPVCTEGYGSVSMPNLWPEGSNL

SEQ ID NO: 69954 - protein, 30 aa, Artificial Sequence
  Description of Artificial Sequence: Synthetic polypeptide
DEAEIRTTNPVAYEQWGNVSTPDQDHGGNA

SEQ ID NO: 69955 - protein, 33 aa, Artificial Sequence
  Description of Artificial Sequence: Synthetic polypeptide
DEEEIRTTNPVATEQYGSVSTTDDGFGQTENQT

SEQ ID NO: 69956 - protein, 32 aa, Artificial Sequence
  Description of Artificial Sequence: Synthetic polypeptide
DEEEIRTTNPVATEQYGSVSTTDEIVPGSHFN

SEQ ID NO: 69957 - protein, 28 aa, Artificial Sequence
  Description of Artificial Sequence: Synthetic peptide
QEGEIATTNPVSTEQYGDVSENLQSEEL

SEQ ID NO: 69958 - protein, 28 aa, Artificial Sequence
  Description of Artificial Sequence: Synthetic peptide
QEGEIATTNPVSTEQYGDVSCCLQSGEL

SEQ ID NO: 69959 - protein, 33 aa, Artificial Sequence
  Description of Artificial Sequence: Synthetic polypeptide
DEEEIRTTNPVATEQYGSVCSTELENFGSDTQS

SEQ ID NO: 69960 - protein, 28 aa, Artificial Sequence
  Description of Artificial Sequence: Synthetic peptide
QEGEIATTNPVSTEQYGDVSCCLQHGEL

SEQ ID NO: 69961 - protein, 32 aa, Artificial Sequence
  Description of Artificial Sequence: Synthetic polypeptide
DEAEIRTTNPVAYEQWGNVSTNLQGQAGGNNA

SEQ ID NO: 69962 - protein, 28 aa, Artificial Sequence
  Description of Artificial Sequence: Synthetic peptide
QEGEIATTNPVSTECYGDVSECLQHGER

SEQ ID NO: 69963 - protein, 30 aa, Artificial Sequence
  Description of Artificial Sequence: Synthetic polypeptide
QENEIATTNPVATECYGDVCSTCLQFEGNL

SEQ ID NO: 69964 - protein, 31 aa, Artificial Sequence
  Description of Artificial Sequence: Synthetic polypeptide
DEAEIRTTNPVAYQQYGCVSTGNDERNGNPS

SEQ ID NO: 69965 - protein, 33 aa, Artificial Sequence
  Description of Artificial Sequence: Synthetic polypeptide
DEEEIRTTNPVATEQYGSVSTTGINDTNENGGI

SEQ ID NO: 69966 - protein, 30 aa, Artificial Sequence
  Description of Artificial Sequence: Synthetic polypeptide
QENEIATTNPVATECYGDVCSTCLQHEGNL

SEQ ID NO: 69967 - protein, 33 aa, Artificial Sequence
  Description of Artificial Sequence: Synthetic polypeptide
AEEEIRTTNPVATEQYGSVSTVVNQQQQNNNNQ

SEQ ID NO: 69968 - protein, 31 aa, Artificial Sequence
  Description of Artificial Sequence: Synthetic polypeptide
CEEEIATTNPVAYEQYGSVATNLQQGDDSLM

SEQ ID NO: 69969 - protein, 31 aa, Artificial Sequence
  Description of Artificial Sequence: Synthetic polypeptide
DEAEIRTTNPVAYQQYGCVSTNLEGDGNNAP

SEQ ID NO: 69970 - protein, 35 aa, Artificial Sequence
  Description of Artificial Sequence: Synthetic polypeptide
DEEEIRTTNPVATEQYGSVSTPNKTSQETPMGSRN

SEQ ID NO: 69971 - protein, 32 aa, Artificial Sequence
  Description of Artificial Sequence: Synthetic polypeptide
DEEEIRTTNPVATEQYGSVCAAPLQDHGQDQE

SEQ ID NO: 69972 - protein, 30 aa, Artificial Sequence
  Description of Artificial Sequence: Synthetic polypeptide
DEEEIRTTNPVATEQYGSVCAANPPEAEAD

SEQ ID NO: 69973 - protein, 32 aa, Artificial Sequence
  Description of Artificial Sequence: Synthetic polypeptide
DEAEIRTTNPVCTEGYGSVSEMPNLQHEGSNL

SEQ ID NO: 69974 - protein, 30 aa, Artificial Sequence
  Description of Artificial Sequence: Synthetic polypeptide
DEAEIRTTNPVCTEGYGSVSMPDLQEGGQL

SEQ ID NO: 69975 - protein, 33 aa, Artificial Sequence
  Description of Artificial Sequence: Synthetic polypeptide
DEEEIRTTNPVATEQYGSVCAANPLQEHDNQAQ

SEQ ID NO: 69976 - protein, 35 aa, Artificial Sequence
  Description of Artificial Sequence: Synthetic polypeptide
DEEEIRTTNPVATEQYGSVSTTDNGQQETGGGNIS

SEQ ID NO: 69977 - protein, 32 aa, Artificial Sequence
  Description of Artificial Sequence: Synthetic polypeptide
DEEEIRTTNPVATEQYGSVCAANNPQEAENND

SEQ ID NO: 69978 - protein, 28 aa, Artificial Sequence
  Description of Artificial Sequence: Synthetic peptide
QEGEIATTNPVSSEQYGIVSCNLQSETR

SEQ ID NO: 69979 - protein, 28 aa, Artificial Sequence
  Description of Artificial Sequence: Synthetic peptide
QEGEIATTNPVSTEQYGDVSENLQSETL

SEQ ID NO: 69980 - protein, 32 aa, Artificial Sequence
  Description of Artificial Sequence: Synthetic polypeptide
DEQEIATTNPVATEQYGSVSATDLIDHEGERL

SEQ ID NO: 69981 - protein, 34 aa, Artificial Sequence
  Description of Artificial Sequence: Synthetic polypeptide
DEEEIRTTNPVATEQYGSVSTPNDTIGMGNEQNE

SEQ ID NO: 69982 - protein, 33 aa, Artificial Sequence
  Description of Artificial Sequence: Synthetic polypeptide
DEEEIRTTNPVATEQYGSVATTVNLGAGTEGTE

SEQ ID NO: 69983 - protein, 32 aa, Artificial Sequence
  Description of Artificial Sequence: Synthetic polypeptide
DEQEIATTNPVATEQYGSVSATDLETQEGEIL

SEQ ID NO: 69984 - protein, 34 aa, Artificial Sequence
  Description of Artificial Sequence: Synthetic polypeptide
DEEEIRTTNPVATEQYGSVATTQNGNQEIGNNQN

SEQ ID NO: 69985 - protein, 31 aa, Artificial Sequence
  Description of Artificial Sequence: Synthetic polypeptide
DEAEIRYTNPVATEQYGDVSVNQDDRTSNSR

SEQ ID NO: 69986 - protein, 32 aa, Artificial Sequence
  Description of Artificial Sequence: Synthetic polypeptide
DEAEIRTTNPVAYEQWGCVSTNLQGEHGNNNS

SEQ ID NO: 69987 - protein, 34 aa, Artificial Sequence
  Description of Artificial Sequence: Synthetic polypeptide
DEEEIRTTNPVATEQYGSVCSTENPQEGFGSDQE

SEQ ID NO: 69988 - protein, 34 aa, Artificial Sequence
  Description of Artificial Sequence: Synthetic polypeptide
DEEEIRTTNPVATEQYGSVCSTENPQEHFNSNQE

SEQ ID NO: 69989 - protein, 29 aa, Artificial Sequence
  Description of Artificial Sequence: Synthetic peptide
QENEIATTNPVATECYGDVSECIQRVGER

SEQ ID NO: 69990 - protein, 29 aa, Artificial Sequence
  Description of Artificial Sequence: Synthetic peptide
QENEIATTNPVATECYGDVSECIQRVGQR

SEQ ID NO: 69991 - protein, 32 aa, Artificial Sequence
  Description of Artificial Sequence: Synthetic polypeptide
DEAEIRTTNPVAYEQWGCVSTNAGLQGEDANR

SEQ ID NO: 69992 - protein, 32 aa, Artificial Sequence
  Description of Artificial Sequence: Synthetic polypeptide
DEQEIATTNPVATEQYGSVSATDLESHEGENL

SEQ ID NO: 69993 - protein, 32 aa, Artificial Sequence
  Description of Artificial Sequence: Synthetic polypeptide
DEQEIATTNPVATEQYGSVSATDLERHEGEDL

SEQ ID NO: 69994 - protein, 28 aa, Artificial Sequence
  Description of Artificial Sequence: Synthetic peptide
QEGEIATTNPCSTEQWGIVSCNLQSGTR

SEQ ID NO: 69995 - protein, 34 aa, Artificial Sequence
  Description of Artificial Sequence: Synthetic polypeptide
DEEEIATTNPVAYEPYGISVSTVNLSQDRETNNR

SEQ ID NO: 69996 - protein, 32 aa, Artificial Sequence
  Description of Artificial Sequence: Synthetic polypeptide
DEQEIATTNPVATEQYGSVSATDLEQHGGEDG

SEQ ID NO: 69997 - protein, 34 aa, Artificial Sequence
  Description of Artificial Sequence: Synthetic polypeptide
DEEEIRTTNPVATEQYGSVATTNGNQEIGTNNQA

SEQ ID NO: 69998 - protein, 32 aa, Artificial Sequence
  Description of Artificial Sequence: Synthetic polypeptide
DEQEIATTNPVATEQYGSVSATDLEQHEGEDL

SEQ ID NO: 69999 - protein, 31 aa, Artificial Sequence
  Description of Artificial Sequence: Synthetic polypeptide
DEEEIATTNPVAYEPYGISLSTATCSQRGMR

SEQ ID NO: 70000 - protein, 32 aa, Artificial Sequence
  Description of Artificial Sequence: Synthetic polypeptide
DEQEIATTNPVATEQYGSVSATDLEQHEGEDH

SEQ ID NO: 70001 - protein, 34 aa, Artificial Sequence
  Description of Artificial Sequence: Synthetic polypeptide
DEEEIRTTNPVATEQYGSVSTTLNGMGQGENEGE

SEQ ID NO: 70002 - protein, 34 aa, Artificial Sequence
  Description of Artificial Sequence: Synthetic polypeptide
DEEEIRTTNPVATEQYGSVSTTLPQNVGMEEQTT

SEQ ID NO: 70003 - protein, 32 aa, Artificial Sequence
  Description of Artificial Sequence: Synthetic polypeptide
DEEEIRTTNPVATEQYGSVATPWQGDSGQIEI

SEQ ID NO: 70004 - protein, 32 aa, Artificial Sequence
  Description of Artificial Sequence: Synthetic polypeptide
DEEEIATTNPVAYEPWGSVCFTNLSTRAGNDR

SEQ ID NO: 70005 - protein, 28 aa, Artificial Sequence
  Description of Artificial Sequence: Synthetic peptide
QEGEIATTNPCSTEQYGDVSCNLQSGTL

SEQ ID NO: 70006 - protein, 33 aa, Artificial Sequence
  Description of Artificial Sequence: Synthetic polypeptide
DEAEIRTTNSVAYDQYGSVPSCTGNLSQRGGDR

SEQ ID NO: 70007 - protein, 28 aa, Artificial Sequence
  Description of Artificial Sequence: Synthetic peptide
QEGEIATTNPCSTEQYGIISCNLQSGTR

SEQ ID NO: 70008 - protein, 34 aa, Artificial Sequence
  Description of Artificial Sequence: Synthetic polypeptide
DEEEIRTTNPVATEQYGSVSTTINQNPLNGLENQ

SEQ ID NO: 70009 - protein, 28 aa, Artificial Sequence
  Description of Artificial Sequence: Synthetic peptide
QEGEIATTNPVATECYGDVSECLQSGEL

SEQ ID NO: 70010 - protein, 28 aa, Artificial Sequence
  Description of Artificial Sequence: Synthetic peptide
QEGEIATTNPVATECYGDVSECLQHGEL

SEQ ID NO: 70011 - protein, 28 aa, Artificial Sequence
  Description of Artificial Sequence: Synthetic peptide
QEGEIATTNPVASEQYGIVSENCQSETR

SEQ ID NO: 70012 - protein, 28 aa, Artificial Sequence
  Description of Artificial Sequence: Synthetic peptide
QEGEIATTNPVASEQYGIVSCNCQSETR

SEQ ID NO: 70013 - protein, 35 aa, Artificial Sequence
  Description of Artificial Sequence: Synthetic polypeptide
DEEEIRTTNPVATEQYGSVSTPNDHTQHAGNFQVG

SEQ ID NO: 70014 - protein, 32 aa, Artificial Sequence
  Description of Artificial Sequence: Synthetic polypeptide
DEAEIRTTNPVSTEQYGSVSWNELDNRAGDAP

SEQ ID NO: 70015 - protein, 28 aa, Artificial Sequence
  Description of Artificial Sequence: Synthetic peptide
QEGEIATTNPVASEQYGEVPENLQHGTK

SEQ ID NO: 70016 - protein, 33 aa, Artificial Sequence
  Description of Artificial Sequence: Synthetic polypeptide
DEEEIRTTNPVATEQYGSVAVTDWNQEVGENSE

SEQ ID NO: 70017 - protein, 28 aa, Artificial Sequence
  Description of Artificial Sequence: Synthetic peptide
QEGEIATTNPVASEQYGDVSCCLQHEER

SEQ ID NO: 70018 - protein, 34 aa, Artificial Sequence
  Description of Artificial Sequence: Synthetic polypeptide
DEEEIRTTNPVATEQYGSVSTPMNLEENGEEEEN

SEQ ID NO: 70019 - protein, 29 aa, Artificial Sequence
  Description of Artificial Sequence: Synthetic peptide
QEGEIATTNPCSTEQYGSVSTDLEDHGTR

SEQ ID NO: 70020 - protein, 28 aa, Artificial Sequence
  Description of Artificial Sequence: Synthetic peptide
QENEIATTNPVATECYGDVSCNLQSEEL

SEQ ID NO: 70021 - protein, 33 aa, Artificial Sequence
  Description of Artificial Sequence: Synthetic polypeptide
DEEEIRTTNPVATEQYGSVSTPLTQATSDQEEH

SEQ ID NO: 70022 - protein, 33 aa, Artificial Sequence
  Description of Artificial Sequence: Synthetic polypeptide
DEEEIRTTNPVATEQYGSVSTTGTGQTGGQGGE

SEQ ID NO: 70023 - protein, 35 aa, Artificial Sequence
  Description of Artificial Sequence: Synthetic polypeptide
AEEEIRTTNPVATEQYGSVSTVVVNNLQQGNNIND

SEQ ID NO: 70024 - protein, 34 aa, Artificial Sequence
  Description of Artificial Sequence: Synthetic polypeptide
DEEEIRTTNPVATEQYGSVSTTIAGPNDRNGMNV

SEQ ID NO: 70025 - protein, 34 aa, Artificial Sequence
  Description of Artificial Sequence: Synthetic polypeptide
DEEEIRTTNPVATEQYGSVSTTIAGPNMRNGMNV

SEQ ID NO: 70026 - protein, 32 aa, Artificial Sequence
  Description of Artificial Sequence: Synthetic polypeptide
DEEEIATTNPVAYEQWGCVSTNNQHNDTGNAR

SEQ ID NO: 70027 - protein, 35 aa, Artificial Sequence
  Description of Artificial Sequence: Synthetic polypeptide
DEEEIRTTNPVATEQYGSVSTTIAGPQMRNGMNPV

SEQ ID NO: 70028 - protein, 28 aa, Artificial Sequence
  Description of Artificial Sequence: Synthetic peptide
QEGEIATTNPCSTEQYGIVSTDLQSGTL

SEQ ID NO: 70029 - protein, 29 aa, Artificial Sequence
  Description of Artificial Sequence: Synthetic peptide
QEGEIATTNPCSTEQYGIVSCNLQSGTPR

SEQ ID NO: 70030 - protein, 29 aa, Artificial Sequence
  Description of Artificial Sequence: Synthetic peptide
QEGEIATTNPCSTEQYGIVSANLQPGTYR

SEQ ID NO: 70031 - protein, 34 aa, Artificial Sequence
  Description of Artificial Sequence: Synthetic polypeptide
DEEEIRTTNPVATEQYGSVSTTINALEEIGEELD

SEQ ID NO: 70032 - protein, 30 aa, Artificial Sequence
  Description of Artificial Sequence: Synthetic polypeptide
DEAEIRTTNPVAYEQWGEVATNMERGNEDM

SEQ ID NO: 70033 - protein, 32 aa, Artificial Sequence
  Description of Artificial Sequence: Synthetic polypeptide
DEQEIATTNPVATEQYGSVSATDLHDHRGEDL

SEQ ID NO: 70034 - protein, 34 aa, Artificial Sequence
  Description of Artificial Sequence: Synthetic polypeptide
DEEEIRTTNPVATEQYGSVSTTAGPNMRNGMTPR

SEQ ID NO: 70035 - protein, 31 aa, Artificial Sequence
  Description of Artificial Sequence: Synthetic polypeptide
CEEEIATTNPVATEQYGSVCSTNPQQEHDTM

SEQ ID NO: 70036 - protein, 31 aa, Artificial Sequence
  Description of Artificial Sequence: Synthetic polypeptide
DEAEIRTTNPVAYERYGTVSTNDQGEHGNDE

SEQ ID NO: 70037 - protein, 32 aa, Artificial Sequence
  Description of Artificial Sequence: Synthetic polypeptide
DEAEIRTTNPVAYEQWGSVCSTNDGNQGGNVS

SEQ ID NO: 70038 - protein, 32 aa, Artificial Sequence
  Description of Artificial Sequence: Synthetic polypeptide
DEEEIRTTNPVATEQYGSVCSSEHNQNGSEQS

SEQ ID NO: 70039 - protein, 34 aa, Artificial Sequence
  Description of Artificial Sequence: Synthetic polypeptide
DEEEIRTTNPVATEQYGSVCATNPQDQRDDNAAA

SEQ ID NO: 70040 - protein, 33 aa, Artificial Sequence
  Description of Artificial Sequence: Synthetic polypeptide
DEEEIRTTNPVATEQYGSVCSSELQEYFGSEQY

SEQ ID NO: 70041 - protein, 32 aa, Artificial Sequence
  Description of Artificial Sequence: Synthetic polypeptide
DEEEIRTTNPVATEQYGSVCSSGEHQNFGSEL

SEQ ID NO: 70042 - protein, 33 aa, Artificial Sequence
  Description of Artificial Sequence: Synthetic polypeptide
DEEEIATTNPVAYEQWGSVSTGNLAGEGGDNNR

SEQ ID NO: 70043 - protein, 34 aa, Artificial Sequence
  Description of Artificial Sequence: Synthetic polypeptide
DEEEIRTTNPVATEQYGSVCATNPLQDANPNAEM

SEQ ID NO: 70044 - protein, 31 aa, Artificial Sequence
  Description of Artificial Sequence: Synthetic polypeptide
DEEEIATTNPVAYEQWGSVSTGGGQLGGNAD

SEQ ID NO: 70045 - protein, 32 aa, Artificial Sequence
  Description of Artificial Sequence: Synthetic polypeptide
DEEEIATTNPVAYEQYGSVATNLQVPGDETLH

SEQ ID NO: 70046 - protein, 31 aa, Artificial Sequence
  Description of Artificial Sequence: Synthetic polypeptide
QEGEIRTTNPVATEQWGSVSCINEQDREGTG

SEQ ID NO: 70047 - protein, 30 aa, Artificial Sequence
  Description of Artificial Sequence: Synthetic polypeptide
QEGEIRTTNPVATECYGIVSCINLPQSGTG

SEQ ID NO: 70048 - protein, 32 aa, Artificial Sequence
  Description of Artificial Sequence: Synthetic polypeptide
DEEEIATTNPVAYEQYGSVATNLTDNPENDRE

SEQ ID NO: 70049 - protein, 32 aa, Artificial Sequence
  Description of Artificial Sequence: Synthetic polypeptide
DEAEIRTTNPVAYEQWGSVCSTDNDQGDVNDR

SEQ ID NO: 70050 - protein, 33 aa, Artificial Sequence
  Description of Artificial Sequence: Synthetic polypeptide
DEEEIATTNPVAYEQWGSVSKTNDLQQQRSGGK

SEQ ID NO: 70051 - protein, 33 aa, Artificial Sequence
  Description of Artificial Sequence: Synthetic polypeptide
DEEEIATTNPVAYEQWGSVSKTNDLQQQRLGEE

SEQ ID NO: 70052 - protein, 34 aa, Artificial Sequence
  Description of Artificial Sequence: Synthetic polypeptide
DEEEIRTTNPVATEQYGSVSTPNLLSVGTGQGQT

SEQ ID NO: 70053 - protein, 33 aa, Artificial Sequence
  Description of Artificial Sequence: Synthetic polypeptide
DEEEIATTNPVAYEQWGSVSKTNDLEDQRNGEK

SEQ ID NO: 70054 - protein, 32 aa, Artificial Sequence
  Description of Artificial Sequence: Synthetic polypeptide
DEEEIRTTNPVATEQYGSVSTSNQFMPMEDIG

SEQ ID NO: 70055 - protein, 32 aa, Artificial Sequence
  Description of Artificial Sequence: Synthetic polypeptide
DEQEIATTNPVATEQYGSVSATDLWDQEGEDL

SEQ ID NO: 70056 - protein, 33 aa, Artificial Sequence
  Description of Artificial Sequence: Synthetic polypeptide
DEEEIRTTNPVATEQYGSVCATNNLENAEMDRN

SEQ ID NO: 70057 - protein, 32 aa, Artificial Sequence
  Description of Artificial Sequence: Synthetic polypeptide
DEQEIATTNPVATEQYGSVSATDLWDHEGNDL

SEQ ID NO: 70058 - protein, 33 aa, Artificial Sequence
  Description of Artificial Sequence: Synthetic polypeptide
DEEEIATTNPVAYEQWGSVSKTDEQLQEREGNM

SEQ ID NO: 70059 - protein, 32 aa, Artificial Sequence
  Description of Artificial Sequence: Synthetic polypeptide
DEAEIRTTNPVAYEQYGTVSTNLQVGGGDDGK

SEQ ID NO: 70060 - protein, 32 aa, Artificial Sequence
  Description of Artificial Sequence: Synthetic polypeptide
DEAEIRTTNPVAYEQWGSVCSTNDGNQGQGNV

SEQ ID NO: 70061 - protein, 33 aa, Artificial Sequence
  Description of Artificial Sequence: Synthetic polypeptide
DEEEIATTNPVAYEQWGSVSTNLNGDAGGGNRR

SEQ ID NO: 70062 - protein, 33 aa, Artificial Sequence
  Description of Artificial Sequence: Synthetic polypeptide
DEEEIATTNPVAYEQYGSVATNLQPADEGNHND

SEQ ID NO: 70063 - protein, 32 aa, Artificial Sequence
  Description of Artificial Sequence: Synthetic polypeptide
DEAEIRTTNPVAYEQWGSVCSTNDQGEGDNGG

SEQ ID NO: 70064 - protein, 32 aa, Artificial Sequence
  Description of Artificial Sequence: Synthetic polypeptide
DEEEIATTNPVAYEQWGSVSTNLNGEDAGNEE

SEQ ID NO: 70065 - protein, 32 aa, Artificial Sequence
  Description of Artificial Sequence: Synthetic polypeptide
DEEEIATTNPVAYEQYGSVATNLQDRPQDETA

SEQ ID NO: 70066 - protein, 33 aa, Artificial Sequence
  Description of Artificial Sequence: Synthetic polypeptide
DEEEIATTNPVAYEQYGSVATNLQDTPDGEENN

SEQ ID NO: 70067 - protein, 28 aa, Artificial Sequence
  Description of Artificial Sequence: Synthetic peptide
QENEIATTNPVASEQYGIVSENLQSETL

SEQ ID NO: 70068 - protein, 33 aa, Artificial Sequence
  Description of Artificial Sequence: Synthetic polypeptide
DEEEIATTNPVAYEQYGSVATNLQENSGEDTRG

SEQ ID NO: 70069 - protein, 32 aa, Artificial Sequence
  Description of Artificial Sequence: Synthetic polypeptide
DEEEIATTNPVAYEQWGSVSTNLNGDGMGNTH

SEQ ID NO: 70070 - protein, 30 aa, Artificial Sequence
  Description of Artificial Sequence: Synthetic polypeptide
CEEEIATTNPVATESYGSVANMNLAGGDQR

SEQ ID NO: 70071 - protein, 30 aa, Artificial Sequence
  Description of Artificial Sequence: Synthetic polypeptide
CEEEIATTNPVATESYGSVAITNDAGGDQR

SEQ ID NO: 70072 - protein, 29 aa, Artificial Sequence
  Description of Artificial Sequence: Synthetic peptide
CEEEIATTNPVATESYGCIATNDQRNDNF

SEQ ID NO: 70073 - protein, 29 aa, Artificial Sequence
  Description of Artificial Sequence: Synthetic peptide
CEEEIATTNPVATESYGCIATNDQRDNED

SEQ ID NO: 70074 - protein, 32 aa, Artificial Sequence
  Description of Artificial Sequence: Synthetic polypeptide
DEAEIRTTNPVAYEQYGSIACTQALTRTPGNR

SEQ ID NO: 70075 - protein, 32 aa, Artificial Sequence
  Description of Artificial Sequence: Synthetic polypeptide
DEEEIATTNPVAYEQYGSVATNMTQTGNGDEH

SEQ ID NO: 70076 - protein, 33 aa, Artificial Sequence
  Description of Artificial Sequence: Synthetic polypeptide
DEEEIRTTNPVATEQYGSVCEATGLERMLIERP

SEQ ID NO: 70077 - protein, 31 aa, Artificial Sequence
  Description of Artificial Sequence: Synthetic polypeptide
DEAEIRTTNPVAYEQYGSICSTELEHPSNRS

SEQ ID NO: 70078 - protein, 32 aa, Artificial Sequence
  Description of Artificial Sequence: Synthetic polypeptide
DEAEIRTTNPVAYEQYGSICSTNLEENPSNRS

SEQ ID NO: 70079 - protein, 32 aa, Artificial Sequence
  Description of Artificial Sequence: Synthetic polypeptide
DEAEIRTTNPVAYEQYGSICSTNLENFPSNRM

SEQ ID NO: 70080 - protein, 32 aa, Artificial Sequence
  Description of Artificial Sequence: Synthetic polypeptide
DEEEIATTNPVAYEQYGSVATNLQGAPMENNH

SEQ ID NO: 70081 - protein, 33 aa, Artificial Sequence
  Description of Artificial Sequence: Synthetic polypeptide
DEEEIATTNPVAYEQWGSVSTNLNGDAMGGNNR

SEQ ID NO: 70082 - protein, 32 aa, Artificial Sequence
  Description of Artificial Sequence: Synthetic polypeptide
DEEEIATTNPVAYEQWGSVSTNLNGDAMGDER

SEQ ID NO: 70083 - protein, 32 aa, Artificial Sequence
  Description of Artificial Sequence: Synthetic polypeptide
DEEEIATTNPVAYEQYGSVATNLQGAPPGSDN

SEQ ID NO: 70084 - protein, 32 aa, Artificial Sequence
  Description of Artificial Sequence: Synthetic polypeptide
DEEEIATTNPVAYEQYGSVATNLQGTPDGMDN

SEQ ID NO: 70085 - protein, 33 aa, Artificial Sequence
  Description of Artificial Sequence: Synthetic polypeptide
DEEEIATTNPVAYEQYGSVATNLQGTPDGMDRW

SEQ ID NO: 70086 - protein, 30 aa, Artificial Sequence
  Description of Artificial Sequence: Synthetic polypeptide
DEAEIRTTNPVAYEQYGSISTNHENPSNQS

SEQ ID NO: 70087 - protein, 32 aa, Artificial Sequence
  Description of Artificial Sequence: Synthetic polypeptide
DEEEIRTTNPVATEQYGSVCSPWNLEGEPEFI

SEQ ID NO: 70088 - protein, 32 aa, Artificial Sequence
  Description of Artificial Sequence: Synthetic polypeptide
QEGETRTTNPVATEQYGSVSTGDDGDQRIGNG

SEQ ID NO: 70089 - protein, 33 aa, Artificial Sequence
  Description of Artificial Sequence: Synthetic polypeptide
DEAEIRTTNPVAYEQYGTVSTTNQQGNAGENRQ

SEQ ID NO: 70090 - protein, 32 aa, Artificial Sequence
  Description of Artificial Sequence: Synthetic polypeptide
DEEEIATTNPVAYEQYGSVATNPTQTGNGEEE

SEQ ID NO: 70091 - protein, 32 aa, Artificial Sequence
  Description of Artificial Sequence: Synthetic polypeptide
DEAEIRTTNPVAYEQYGTVSWTELDNRQGMNT

SEQ ID NO: 70092 - protein, 36 aa, Artificial Sequence
  Description of Artificial Sequence: Synthetic polypeptide
DEEEIRTTNPVATEQYGSVSTSTNNLQQGNNNNQED

SEQ ID NO: 70093 - protein, 32 aa, Artificial Sequence
  Description of Artificial Sequence: Synthetic polypeptide
DEAEIRTTNPVAYERWGSVSTGNDQQEQGNDR

SEQ ID NO: 70094 - protein, 32 aa, Artificial Sequence
  Description of Artificial Sequence: Synthetic polypeptide
DEAEIRTTNPVAYERWGSVSTNDQGEHGNDRM

SEQ ID NO: 70095 - protein, 32 aa, Artificial Sequence
  Description of Artificial Sequence: Synthetic polypeptide
DEQEIATTNPVATEQYGSVSTTDNLDDEGEDL

SEQ ID NO: 70096 - protein, 32 aa, Artificial Sequence
  Description of Artificial Sequence: Synthetic polypeptide
DEQEIATTNPVATEQYGSVSATDLQDHVGEDL

SEQ ID NO: 70097 - protein, 28 aa, Artificial Sequence
  Description of Artificial Sequence: Synthetic peptide
QEGEINTTNPCSSEQYGIVSCNLQSGTR

SEQ ID NO: 70098 - protein, 33 aa, Artificial Sequence
  Description of Artificial Sequence: Synthetic polypeptide
DEEEIRTTNPVATEQYGSVSTSVADQTGSQQSP

SEQ ID NO: 70099 - protein, 31 aa, Artificial Sequence
  Description of Artificial Sequence: Synthetic polypeptide
DEAEIRTTNPVAYEQWGSISHNDLERPENDR

SEQ ID NO: 70100 - protein, 29 aa, Artificial Sequence
  Description of Artificial Sequence: Synthetic peptide
DEAEIRTTNPVAYEQWGSISHNDEHHPNR

SEQ ID NO: 70101 - protein, 30 aa, Artificial Sequence
  Description of Artificial Sequence: Synthetic polypeptide
QEGEIATTNPVSTEQYGSVSATDLEDHGER

SEQ ID NO: 70102 - protein, 33 aa, Artificial Sequence
  Description of Artificial Sequence: Synthetic polypeptide
DEEEIRTTNPVATEQYGSVCSTEHQESFGSELD

SEQ ID NO: 70103 - protein, 32 aa, Artificial Sequence
  Description of Artificial Sequence: Synthetic polypeptide
DEEEIATTNPVAYEQWGSVSENLQQGGGENQP

SEQ ID NO: 70104 - protein, 33 aa, Artificial Sequence
  Description of Artificial Sequence: Synthetic polypeptide
DEEEIRTTNPVATEQYGSVCSTEHQEYFGSQQP

SEQ ID NO: 70105 - protein, 33 aa, Artificial Sequence
  Description of Artificial Sequence: Synthetic polypeptide
DEEEIRTTNPVATEQYGSVCSTEHQGFGSDTAA

SEQ ID NO: 70106 - protein, 32 aa, Artificial Sequence
  Description of Artificial Sequence: Synthetic polypeptide
QEGEIATTNPVSTEQYGIVSTNLPQMRNGTPR

SEQ ID NO: 70107 - protein, 33 aa, Artificial Sequence
  Description of Artificial Sequence: Synthetic polypeptide
DEEEIRTTNPVATEQYGSVCSTEHQNFISNTQL

SEQ ID NO: 70108 - protein, 32 aa, Artificial Sequence
  Description of Artificial Sequence: Synthetic polypeptide
DEQEIATTNPVATEQYGSVSATDLQDHEGGDL

SEQ ID NO: 70109 - protein, 32 aa, Artificial Sequence
  Description of Artificial Sequence: Synthetic polypeptide
DEQEIATTNPVATEQYGSVSATDLQDHEGEDL

SEQ ID NO: 70110 - protein, 29 aa, Artificial Sequence
  Description of Artificial Sequence: Synthetic peptide
QEGEIATTNPVSTEQYGIVSATNLEHGEL

SEQ ID NO: 70111 - protein, 33 aa, Artificial Sequence
  Description of Artificial Sequence: Synthetic polypeptide
DEEEIRTTNPVATEQYGSVSTTADAETNDNVRQ

SEQ ID NO: 70112 - protein, 32 aa, Artificial Sequence
  Description of Artificial Sequence: Synthetic polypeptide
DEQEIATTNPVATEQYGSVSATDLQDHEGEDH

SEQ ID NO: 70113 - protein, 33 aa, Artificial Sequence
  Description of Artificial Sequence: Synthetic polypeptide
DEEEIRTTNPVATEQYGSVSTTAEPMMANGMNA

SEQ ID NO: 70114 - protein, 32 aa, Artificial Sequence
  Description of Artificial Sequence: Synthetic polypeptide
DEQEIATTNPVATEQYGSVSATDLQDHEGEDG

SEQ ID NO: 70115 - protein, 29 aa, Artificial Sequence
  Description of Artificial Sequence: Synthetic peptide
QEGEIATTNPVSTEQYGIVSACNLQSGTL

SEQ ID NO: 70116 - protein, 32 aa, Artificial Sequence
  Description of Artificial Sequence: Synthetic polypeptide
DEQEIATTNPVATEQYGSVSATDLQDHNGEDH

SEQ ID NO: 70117 - protein, 31 aa, Artificial Sequence
  Description of Artificial Sequence: Synthetic polypeptide
DEQEIATTNPVATEQYGSVSATGLEDHEGEL

SEQ ID NO: 70118 - protein, 32 aa, Artificial Sequence
  Description of Artificial Sequence: Synthetic polypeptide
DEQEIATTNPVATEQYGSVSTTDLEDHNGNDV

SEQ ID NO: 70119 - protein, 32 aa, Artificial Sequence
  Description of Artificial Sequence: Synthetic polypeptide
DEQEIATTNPVATEQYGSVSTTDLEDHEGNDV

SEQ ID NO: 70120 - protein, 28 aa, Artificial Sequence
  Description of Artificial Sequence: Synthetic peptide
QEGEIRTTNPCSSEQYGIVSCALQSGTR

SEQ ID NO: 70121 - protein, 32 aa, Artificial Sequence
  Description of Artificial Sequence: Synthetic polypeptide
QEGEIRTTNPCATEQYGSVSTCALPNMRGNPV

SEQ ID NO: 70122 - protein, 33 aa, Artificial Sequence
  Description of Artificial Sequence: Synthetic polypeptide
DEEEIRTTNPVATEQYGSVCSTDDEQVVMMFRE

SEQ ID NO: 70123 - protein, 34 aa, Artificial Sequence
  Description of Artificial Sequence: Synthetic polypeptide
DEEEIRTTNPVATEQYGSVCSTDLQPDAGMGDQH

SEQ ID NO: 70124 - protein, 31 aa, Artificial Sequence
  Description of Artificial Sequence: Synthetic polypeptide
DEAEIRTTNPVAYEQYGVVATREHSQRPGND

SEQ ID NO: 70125 - protein, 35 aa, Artificial Sequence
  Description of Artificial Sequence: Synthetic polypeptide
DEEEIRTTNPVATEQYGSVSTSNVGIQGEGNGDTE

SEQ ID NO: 70126 - protein, 29 aa, Artificial Sequence
  Description of Artificial Sequence: Synthetic peptide
QEGEIRTTNPCASEQYGIVSCINLQSGTG

SEQ ID NO: 70127 - protein, 31 aa, Artificial Sequence
  Description of Artificial Sequence: Synthetic polypeptide
DEAEIRTTNPVAYEQYGVVSTRELSQPPGED

SEQ ID NO: 70128 - protein, 28 aa, Artificial Sequence
  Description of Artificial Sequence: Synthetic peptide
QENEIATTNPVATECWGSVSCNEQREEL

SEQ ID NO: 70129 - protein, 35 aa, Artificial Sequence
  Description of Artificial Sequence: Synthetic polypeptide
DEEEIRTTNPVATEQYGSVCATNELIERMGENDNQ

SEQ ID NO: 70130 - protein, 28 aa, Artificial Sequence
  Description of Artificial Sequence: Synthetic peptide
QENEIATTNPVATECYGAVSECLQHGEL

SEQ ID NO: 70131 - protein, 34 aa, Artificial Sequence
  Description of Artificial Sequence: Synthetic polypeptide
DEEEIRTTNPVATEQYGSVCSTEEHERFGSENQA

SEQ ID NO: 70132 - protein, 28 aa, Artificial Sequence
  Description of Artificial Sequence: Synthetic peptide
QEGEIRPTNPVSTEQYGTISMNIQQGTR

SEQ ID NO: 70133 - protein, 28 aa, Artificial Sequence
  Description of Artificial Sequence: Synthetic peptide
QEGEIRPTNPVSSEQYGDVSCNEQSGDR

SEQ ID NO: 70134 - protein, 34 aa, Artificial Sequence
  Description of Artificial Sequence: Synthetic polypeptide
DEEEIRTTNPVATEQYGSVSTSTDDQGQEGGNDD

SEQ ID NO: 70135 - protein, 31 aa, Artificial Sequence
  Description of Artificial Sequence: Synthetic polypeptide
QEGEIRPTNPVATEQYGIVSTNLPNSGMNPV

SEQ ID NO: 70136 - protein, 30 aa, Artificial Sequence
  Description of Artificial Sequence: Synthetic polypeptide
QEGEIRPTNPVASEQWGSVSCNEQDREGTR

SEQ ID NO: 70137 - protein, 28 aa, Artificial Sequence
  Description of Artificial Sequence: Synthetic peptide
QEGEIRPTNPCSTEQYGTISMNLQQGTR

SEQ ID NO: 70138 - protein, 33 aa, Artificial Sequence
  Description of Artificial Sequence: Synthetic polypeptide
DEEEIRTTNPVATEQYGSVCSTEDQEYFGSEQA

SEQ ID NO: 70139 - protein, 33 aa, Artificial Sequence
  Description of Artificial Sequence: Synthetic polypeptide
DEAEIRTTNPVAYEQWGSTSPTENDSQRDGNRG

SEQ ID NO: 70140 - protein, 33 aa, Artificial Sequence
  Description of Artificial Sequence: Synthetic polypeptide
DEEEIRTTNPVATEQYGSVCATDLQDAGMGDLH

SEQ ID NO: 70141 - protein, 31 aa, Artificial Sequence
  Description of Artificial Sequence: Synthetic polypeptide
DEAEIRTTNPVAYEQWGSISRTPNDERNNAR

SEQ ID NO: 70142 - protein, 34 aa, Artificial Sequence
  Description of Artificial Sequence: Synthetic polypeptide
DEEEIRTTNPVATEQYGSVCSTEEDHQNGSNTQP

SEQ ID NO: 70143 - protein, 29 aa, Artificial Sequence
  Description of Artificial Sequence: Synthetic peptide
QEGEIRPTNPCASEQYGSVSCPNLNSGTR

SEQ ID NO: 70144 - protein, 28 aa, Artificial Sequence
  Description of Artificial Sequence: Synthetic peptide
QEGEIRPTNPVSSEQYGIVSCNEQSGDR

SEQ ID NO: 70145 - protein, 33 aa, Artificial Sequence
  Description of Artificial Sequence: Synthetic polypeptide
QEEEIRTTNPVATEQYGSVSTTPAGPNRNGMNV

SEQ ID NO: 70146 - protein, 32 aa, Artificial Sequence
  Description of Artificial Sequence: Synthetic polypeptide
DEQEIATTNPVATEQYGSVSANDLEDHEGEDR

SEQ ID NO: 70147 - protein, 32 aa, Artificial Sequence
  Description of Artificial Sequence: Synthetic polypeptide
DEEEIATTNPVATEQYGSVSATDLEDHEGEDL

SEQ ID NO: 70148 - protein, 33 aa, Artificial Sequence
  Description of Artificial Sequence: Synthetic polypeptide
DEAEIRTTNPVATEQYGSVSVPNLTMEGSNEIS

SEQ ID NO: 70149 - protein, 33 aa, Artificial Sequence
  Description of Artificial Sequence: Synthetic polypeptide
DEEEIGTTNPVATEQYGCVCSTEELQRFNSNAD

SEQ ID NO: 70150 - protein, 31 aa, Artificial Sequence
  Description of Artificial Sequence: Synthetic polypeptide
DEQEIATTNPVATEQYGCVATNLQAPDNPDE

SEQ ID NO: 70151 - protein, 31 aa, Artificial Sequence
  Description of Artificial Sequence: Synthetic polypeptide
DEQEIATTNPVATEQYGCVAATNNQDSGNDN

SEQ ID NO: 70152 - protein, 32 aa, Artificial Sequence
  Description of Artificial Sequence: Synthetic polypeptide
DEQEIATTNPVATEQYGCVAATNLQDRQPNEI

SEQ ID NO: 70153 - protein, 32 aa, Artificial Sequence
  Description of Artificial Sequence: Synthetic polypeptide
DEAEIRTTNPVATEQYGSVSVENLFGNMNEIS

SEQ ID NO: 70154 - protein, 33 aa, Artificial Sequence
  Description of Artificial Sequence: Synthetic polypeptide
DEEEIATTNPVATEQYGSVCAGTNLQDDPNNAQ

SEQ ID NO: 70155 - protein, 30 aa, Artificial Sequence
  Description of Artificial Sequence: Synthetic polypeptide
DESEIATTNPVATECWGSVSCNEQDREGQG

SEQ ID NO: 70156 - protein, 29 aa, Artificial Sequence
  Description of Artificial Sequence: Synthetic peptide
DESEIATTNPVATECWGSVSCNEQREEEL

SEQ ID NO: 70157 - protein, 31 aa, Artificial Sequence
  Description of Artificial Sequence: Synthetic polypeptide
CEEEIACTNPVATEQYGCVATNLQRENAGEN

SEQ ID NO: 70158 - protein, 32 aa, Artificial Sequence
  Description of Artificial Sequence: Synthetic polypeptide
DEQEIATTNPVATEQYGCVAATNLQADPGNHN

SEQ ID NO: 70159 - protein, 30 aa, Artificial Sequence
  Description of Artificial Sequence: Synthetic polypeptide
DESEIATTNPVATECWGSVSCNLQDHEGEL

SEQ ID NO: 70160 - protein, 33 aa, Artificial Sequence
  Description of Artificial Sequence: Synthetic polypeptide
DEAEIRTTNPVATEQYGSVSVDNTSQQDGNQEI

SEQ ID NO: 70161 - protein, 33 aa, Artificial Sequence
  Description of Artificial Sequence: Synthetic polypeptide
DEEEIATTNPVATEQYGSVCAGTENLEAEAGNQ

SEQ ID NO: 70162 - protein, 33 aa, Artificial Sequence
  Description of Artificial Sequence: Synthetic polypeptide
CEEEIQTTNPVAYEHYGSVPSQTNLSQEVGNRR

SEQ ID NO: 70163 - protein, 34 aa, Artificial Sequence
  Description of Artificial Sequence: Synthetic polypeptide
AEEEIRTTNPVATEQYGSVSVTENGTNQNGNNND

SEQ ID NO: 70164 - protein, 31 aa, Artificial Sequence
  Description of Artificial Sequence: Synthetic polypeptide
DESEIATTNPVATECWGSVSEINEQREGENG

SEQ ID NO: 70165 - protein, 34 aa, Artificial Sequence
  Description of Artificial Sequence: Synthetic polypeptide
AEEEIRTTNPVATEQYGSVSVTENNGNQNGNNQV

SEQ ID NO: 70166 - protein, 32 aa, Artificial Sequence
  Description of Artificial Sequence: Synthetic polypeptide
DESEIATTNPVATECYGSVATNLQAAEDGERE

SEQ ID NO: 70167 - protein, 28 aa, Artificial Sequence
  Description of Artificial Sequence: Synthetic peptide
QEFEIATTNPVATECYGDVSTCLQHEEL

SEQ ID NO: 70168 - protein, 35 aa, Artificial Sequence
  Description of Artificial Sequence: Synthetic polypeptide
DEEEIRTTNPVATEQYGSTCSMTENLSQRIGSDQT

SEQ ID NO: 70169 - protein, 32 aa, Artificial Sequence
  Description of Artificial Sequence: Synthetic polypeptide
DESEIATTNPVATECYGSVSACIDLQDREGNG

SEQ ID NO: 70170 - protein, 29 aa, Artificial Sequence
  Description of Artificial Sequence: Synthetic peptide
QENEIATTNPVATEQYGDVCSEGLQHENL

SEQ ID NO: 70171 - protein, 31 aa, Artificial Sequence
  Description of Artificial Sequence: Synthetic polypeptide
DESEIATTNPVATECWGSVSCINLQDREGEL

SEQ ID NO: 70172 - protein, 32 aa, Artificial Sequence
  Description of Artificial Sequence: Synthetic polypeptide
DEAEIRTTNPVATEQYGSVSVQNDLFGNMTEP

SEQ ID NO: 70173 - protein, 28 aa, Artificial Sequence
  Description of Artificial Sequence: Synthetic peptide
QEGEIACTNPCASEQYGIVSENLQSGTR

SEQ ID NO: 70174 - protein, 33 aa, Artificial Sequence
  Description of Artificial Sequence: Synthetic polypeptide
DEAEIRTTNPVATEQYGSVSVQNLDFGSNMTEI

SEQ ID NO: 70175 - protein, 30 aa, Artificial Sequence
  Description of Artificial Sequence: Synthetic polypeptide
QEGEIACTNPVATEHYGVVSTNLQDGNENY

SEQ ID NO: 70176 - protein, 32 aa, Artificial Sequence
  Description of Artificial Sequence: Synthetic polypeptide
DEEEIGTTNPVATEQYGCVCSSNHQNFGSNQS

SEQ ID NO: 70177 - protein, 28 aa, Artificial Sequence
  Description of Artificial Sequence: Synthetic peptide
QEGEIACTNPISTEQYGIVSENLQSGTR

SEQ ID NO: 70178 - protein, 28 aa, Artificial Sequence
  Description of Artificial Sequence: Synthetic peptide
QEGEIACTNPISTEQYGIVSCNLQSGTR

SEQ ID NO: 70179 - protein, 28 aa, Artificial Sequence
  Description of Artificial Sequence: Synthetic peptide
QENEIATTNPVATEGYGVVASTLQHGDL

SEQ ID NO: 70180 - protein, 28 aa, Artificial Sequence
  Description of Artificial Sequence: Synthetic peptide
QEGEIACTNPISSEQYGSVSENLMSGNR

SEQ ID NO: 70181 - protein, 28 aa, Artificial Sequence
  Description of Artificial Sequence: Synthetic peptide
QEGEIACTNPCSTEQYGIVSCNLQSGTR

SEQ ID NO: 70182 - protein, 28 aa, Artificial Sequence
  Description of Artificial Sequence: Synthetic peptide
QENEIATTNPVATEGYGVVASTLQHGEL

SEQ ID NO: 70183 - protein, 30 aa, Artificial Sequence
  Description of Artificial Sequence: Synthetic polypeptide
DEQEIATTNPVATEQYGDVSTDLEDHAGEL

SEQ ID NO: 70184 - protein, 31 aa, Artificial Sequence
  Description of Artificial Sequence: Synthetic polypeptide
DEQEIATTNPVATEQYGDVSATDLQDHGEDL

SEQ ID NO: 70185 - protein, 32 aa, Artificial Sequence
  Description of Artificial Sequence: Synthetic polypeptide
AEEEIRTTNPVATEQYGSVSVTEGNNNQDNGI

SEQ ID NO: 70186 - protein, 33 aa, Artificial Sequence
  Description of Artificial Sequence: Synthetic polypeptide
DEEEIRTTNPVATEQYGSVDSTPTQDDDGIMEL

SEQ ID NO: 70187 - protein, 28 aa, Artificial Sequence
  Description of Artificial Sequence: Synthetic peptide
QEGEIACTNPCSTEQYGIVSCNLMSGNR

SEQ ID NO: 70188 - protein, 33 aa, Artificial Sequence
  Description of Artificial Sequence: Synthetic polypeptide
DEAEIRTTNPVATEQYGSVSVSFNNLEQIVNQI

SEQ ID NO: 70189 - protein, 31 aa, Artificial Sequence
  Description of Artificial Sequence: Synthetic polypeptide
DESEIATTNPVATECWGSVSCINEPQREGNG

SEQ ID NO: 70190 - protein, 33 aa, Artificial Sequence
  Description of Artificial Sequence: Synthetic polypeptide
DEAEIRTTNPVATEQYGSVSVSFNLQEVQNDIM

SEQ ID NO: 70191 - protein, 28 aa, Artificial Sequence
  Description of Artificial Sequence: Synthetic peptide
QEGEIACTNPCSTEQYGIASCNLQRGGR

SEQ ID NO: 70192 - protein, 35 aa, Artificial Sequence
  Description of Artificial Sequence: Synthetic polypeptide
DEAEIRTTNPVATEQYGSVSVQNLLSQSRGSDQRD

SEQ ID NO: 70193 - protein, 28 aa, Artificial Sequence
  Description of Artificial Sequence: Synthetic peptide
QEGEIACTNPCSSEQYGIVSCNLQRGTR

SEQ ID NO: 70194 - protein, 28 aa, Artificial Sequence
  Description of Artificial Sequence: Synthetic peptide
QEGEIACTNPCSSEQYGIVSCNLQRGGR

SEQ ID NO: 70195 - protein, 31 aa, Artificial Sequence
  Description of Artificial Sequence: Synthetic polypeptide
DESEIATTNPVATECWGSVSCINEQDRGENG

SEQ ID NO: 70196 - protein, 31 aa, Artificial Sequence
  Description of Artificial Sequence: Synthetic polypeptide
DESEIATTNPVATECWGSVSCINEQDRGENK

SEQ ID NO: 70197 - protein, 31 aa, Artificial Sequence
  Description of Artificial Sequence: Synthetic polypeptide
DESEIATTNPVATECWGSVSCINEQREGENG

SEQ ID NO: 70198 - protein, 33 aa, Artificial Sequence
  Description of Artificial Sequence: Synthetic polypeptide
DESEIATTNPVATECWGSVSCINLPQDREGENR

SEQ ID NO: 70199 - protein, 31 aa, Artificial Sequence
  Description of Artificial Sequence: Synthetic polypeptide
DEQEIATTNPVATEQYGDVSATCLQHEGEDL

SEQ ID NO: 70200 - protein, 35 aa, Artificial Sequence
  Description of Artificial Sequence: Synthetic polypeptide
AEEEIRTTNPVATEQYGSVSVSVTTNLQQGSTNQN

SEQ ID NO: 70201 - protein, 35 aa, Artificial Sequence
  Description of Artificial Sequence: Synthetic polypeptide
DEEEIRTTNPVATEQYGSTCSMTENDSQNIGSNRN

SEQ ID NO: 70202 - protein, 33 aa, Artificial Sequence
  Description of Artificial Sequence: Synthetic polypeptide
DEAEIRTTNPVATEQYGSVSTYGLPQSNGEDTM

SEQ ID NO: 70203 - protein, 31 aa, Artificial Sequence
  Description of Artificial Sequence: Synthetic polypeptide
DEQEIATTNPVATEQWGSVSTGQQHGDNQDQ

SEQ ID NO: 70204 - protein, 33 aa, Artificial Sequence
  Description of Artificial Sequence: Synthetic polypeptide
AEEEIRTTNPVATEQYGSVSVTNGQQEATNNTT

SEQ ID NO: 70205 - protein, 31 aa, Artificial Sequence
  Description of Artificial Sequence: Synthetic polypeptide
CEEEIACTNPVATEQYGCVATNLQDGEPDRE

SEQ ID NO: 70206 - protein, 35 aa, Artificial Sequence
  Description of Artificial Sequence: Synthetic polypeptide
DEEEIRTTNPVATEQYGSTCAMTENGLEARDGDNR

SEQ ID NO: 70207 - protein, 34 aa, Artificial Sequence
  Description of Artificial Sequence: Synthetic polypeptide
DEEEIGTTNPVATEQYGCVCSTNDHQERFGSNLA

SEQ ID NO: 70208 - protein, 28 aa, Artificial Sequence
  Description of Artificial Sequence: Synthetic peptide
QENEIATTNPVATEQYGDVSECLQHEEA

SEQ ID NO: 70209 - protein, 32 aa, Artificial Sequence
  Description of Artificial Sequence: Synthetic polypeptide
DEEEIGTTNPVATEQYGCVCSTNDQNFGSDQS

SEQ ID NO: 70210 - protein, 32 aa, Artificial Sequence
  Description of Artificial Sequence: Synthetic polypeptide
DEEEIRTTNPVATEQYGSTAMKENLEARDSDR

SEQ ID NO: 70211 - protein, 28 aa, Artificial Sequence
  Description of Artificial Sequence: Synthetic peptide
QENEIATTNPVATEQYGDVSECLQHEEK

SEQ ID NO: 70212 - protein, 32 aa, Artificial Sequence
  Description of Artificial Sequence: Synthetic polypeptide
DEEEIGTTNPVATEQYGCVCSTNHQNFLSNQT

SEQ ID NO: 70213 - protein, 32 aa, Artificial Sequence
  Description of Artificial Sequence: Synthetic polypeptide
DEEEIGTTNPVATEQYGCVCSTNHQSSGSEQI

SEQ ID NO: 70214 - protein, 32 aa, Artificial Sequence
  Description of Artificial Sequence: Synthetic polypeptide
DEEEIGTTNPVATEQYGCVCSTNTQNSGSEQA

SEQ ID NO: 70215 - protein, 31 aa, Artificial Sequence
  Description of Artificial Sequence: Synthetic polypeptide
DESEIATTNPVATEGYGSVSCITEQSRVGQR

SEQ ID NO: 70216 - protein, 32 aa, Artificial Sequence
  Description of Artificial Sequence: Synthetic polypeptide
DEEEIGTTNPVATEQYGCVCSTPLQFFGSDQS

SEQ ID NO: 70217 - protein, 28 aa, Artificial Sequence
  Description of Artificial Sequence: Synthetic peptide
QENEIATTNPVATEQYGDVSECLQHEEL

SEQ ID NO: 70218 - protein, 28 aa, Artificial Sequence
  Description of Artificial Sequence: Synthetic peptide
QENEIATTNPVATEQYGDVSECLQHETL

SEQ ID NO: 70219 - protein, 31 aa, Artificial Sequence
  Description of Artificial Sequence: Synthetic polypeptide
DESEIATTNPVATEGYGSVSNITEQSRVGQR

SEQ ID NO: 70220 - protein, 28 aa, Artificial Sequence
  Description of Artificial Sequence: Synthetic peptide
QENEIATTNPVATEQYGDVSECLQSEEQ

SEQ ID NO: 70221 - protein, 34 aa, Artificial Sequence
  Description of Artificial Sequence: Synthetic polypeptide
AEEEIRTTNPVATEQYGSVSVTNLLGNNIGTNPT

SEQ ID NO: 70222 - protein, 28 aa, Artificial Sequence
  Description of Artificial Sequence: Synthetic peptide
QENEIATTNPVATEQYGDVSECLQSETL

SEQ ID NO: 70223 - protein, 29 aa, Artificial Sequence
  Description of Artificial Sequence: Synthetic peptide
QENEIATTNPVATEQYGDVSECLVQHGED

SEQ ID NO: 70224 - protein, 35 aa, Artificial Sequence
  Description of Artificial Sequence: Synthetic polypeptide
AEEEIRTTNPVATEQYGSVSVTNLNQGNLGINTNE

SEQ ID NO: 70225 - protein, 33 aa, Artificial Sequence
  Description of Artificial Sequence: Synthetic polypeptide
DEEEIATTNPVATEQYGSVCAATNPLQDSGPDQ

SEQ ID NO: 70226 - protein, 30 aa, Artificial Sequence
  Description of Artificial Sequence: Synthetic polypeptide
QEEIIATTNPVATEQYGCVAATNDQDGNSD

SEQ ID NO: 70227 - protein, 32 aa, Artificial Sequence
  Description of Artificial Sequence: Synthetic polypeptide
DESEIATTNPVATEGYGSVSCINEQSREGEQR

SEQ ID NO: 70228 - protein, 32 aa, Artificial Sequence
  Description of Artificial Sequence: Synthetic polypeptide
DESEIATTNPVATEGYGSVSCINEQDREGEQR

SEQ ID NO: 70229 - protein, 34 aa, Artificial Sequence
  Description of Artificial Sequence: Synthetic polypeptide
DEAEIRTTNPVATEQYGSVSTTNNDGNHGGDNVR

SEQ ID NO: 70230 - protein, 34 aa, Artificial Sequence
  Description of Artificial Sequence: Synthetic polypeptide
DEEEIRTTNPVATEQYGSVDSTPTQDDDGINVVL

SEQ ID NO: 70231 - protein, 34 aa, Artificial Sequence
  Description of Artificial Sequence: Synthetic polypeptide
DEEEIRTTNPVATEQYGSVDSTPTQPDNDGINIL

SEQ ID NO: 70232 - protein, 31 aa, Artificial Sequence
  Description of Artificial Sequence: Synthetic polypeptide
DECEIATTNPVAYEHWGSVSTNLQIGGDNNQ

SEQ ID NO: 70233 - protein, 33 aa, Artificial Sequence
  Description of Artificial Sequence: Synthetic polypeptide
DEEEIRTTNPVATEQYGSTCSMTEELNQNIGEQ

SEQ ID NO: 70234 - protein, 31 aa, Artificial Sequence
  Description of Artificial Sequence: Synthetic polypeptide
QEEVICTTNPVAYEQYGSVSNNDQRGPNESL

SEQ ID NO: 70235 - protein, 31 aa, Artificial Sequence
  Description of Artificial Sequence: Synthetic polypeptide
QEEVICTTNPVAYEQYGSVSANNQQRGPNES

SEQ ID NO: 70236 - protein, 32 aa, Artificial Sequence
  Description of Artificial Sequence: Synthetic polypeptide
DEAEIRTTNPVATEQYGSVSTWILVTDTIVER

SEQ ID NO: 70237 - protein, 29 aa, Artificial Sequence
  Description of Artificial Sequence: Synthetic peptide
QENEIATTNPVATEQYGDVSAECLQHGEL

SEQ ID NO: 70238 - protein, 33 aa, Artificial Sequence
  Description of Artificial Sequence: Synthetic polypeptide
DEEEIGTTNPVATEQYGCVCSTGELQYFGSNQP

SEQ ID NO: 70239 - protein, 29 aa, Artificial Sequence
  Description of Artificial Sequence: Synthetic peptide
QEEVICTTNPVAYEQWGSVSMNSQSGDNS

SEQ ID NO: 70240 - protein, 31 aa, Artificial Sequence
  Description of Artificial Sequence: Synthetic polypeptide
DECEIATTNPVAYEKWGSVSTNLQDDGNNQH

SEQ ID NO: 70241 - protein, 30 aa, Artificial Sequence
  Description of Artificial Sequence: Synthetic polypeptide
DECEIATTNPVAYEHWGSVSTNLNDGNNSH

SEQ ID NO: 70242 - protein, 32 aa, Artificial Sequence
  Description of Artificial Sequence: Synthetic polypeptide
DESEIATTNPVATECYGSVSCINEQDREGENG

SEQ ID NO: 70243 - protein, 32 aa, Artificial Sequence
  Description of Artificial Sequence: Synthetic polypeptide
DECEIATTNPVAYEQWGCVSTNLQRGDGNNNS

SEQ ID NO: 70244 - protein, 33 aa, Artificial Sequence
  Description of Artificial Sequence: Synthetic polypeptide
AEEEIRTTNPVATEQYGSVSVTNAEQGVTTNNI

SEQ ID NO: 70245 - protein, 33 aa, Artificial Sequence
  Description of Artificial Sequence: Synthetic polypeptide
DEAEIRTTNPVATEQYGSVSTTVALEMEGNDDN

SEQ ID NO: 70246 - protein, 33 aa, Artificial Sequence
  Description of Artificial Sequence: Synthetic polypeptide
DEEEIRTTNPVATEQYGSVDTDNMNEEGGNENI

SEQ ID NO: 70247 - protein, 34 aa, Artificial Sequence
  Description of Artificial Sequence: Synthetic polypeptide
DEEEIRTTNPVATEQYGSVDTDNMNLQVENEGEG

SEQ ID NO: 70248 - protein, 32 aa, Artificial Sequence
  Description of Artificial Sequence: Synthetic polypeptide
DESEIATTNPVATEGYGSVAANDLQSRVGEDR

SEQ ID NO: 70249 - protein, 34 aa, Artificial Sequence
  Description of Artificial Sequence: Synthetic polypeptide
DEEEIRTTNPVATEQYGSVDTGTDNGQTGGGNEI

SEQ ID NO: 70250 - protein, 32 aa, Artificial Sequence
  Description of Artificial Sequence: Synthetic polypeptide
QEEIIRTTNPVATEQYGCVSTNLGQQGFPEAE

SEQ ID NO: 70251 - protein, 31 aa, Artificial Sequence
  Description of Artificial Sequence: Synthetic polypeptide
QEEIIRTTNPVATEQYGCVSTNGQTFPENEN

SEQ ID NO: 70252 - protein, 32 aa, Artificial Sequence
  Description of Artificial Sequence: Synthetic polypeptide
DESEIATTNPVATEGYGSVSCINEQDREGENG

SEQ ID NO: 70253 - protein, 30 aa, Artificial Sequence
  Description of Artificial Sequence: Synthetic polypeptide
QENEIATTNPVATEQYGDVSATDLQHEGEL

SEQ ID NO: 70254 - protein, 31 aa, Artificial Sequence
  Description of Artificial Sequence: Synthetic polypeptide
DESEIATTNPVATECYGSVSENEPQHEGENL

SEQ ID NO: 70255 - protein, 31 aa, Artificial Sequence
  Description of Artificial Sequence: Synthetic polypeptide
DESEIATTNPVATECWGSVSCCLPQDRGENL

SEQ ID NO: 70256 - protein, 28 aa, Artificial Sequence
  Description of Artificial Sequence: Synthetic peptide
QEGEIACTNPVSSEQYGIVSCNLQSGTR

SEQ ID NO: 70257 - protein, 33 aa, Artificial Sequence
  Description of Artificial Sequence: Synthetic polypeptide
DEEEIGTTNPVATEQYGCVCSSNDHQERMGSNQ

SEQ ID NO: 70258 - protein, 29 aa, Artificial Sequence
  Description of Artificial Sequence: Synthetic peptide
QEGEIAPTNPCATEQYGIVSSCNLQSGTR

SEQ ID NO: 70259 - protein, 30 aa, Artificial Sequence
  Description of Artificial Sequence: Synthetic polypeptide
QEGEIAPTNPCATEQYGIVSSCNLPQRGTR

SEQ ID NO: 70260 - protein, 28 aa, Artificial Sequence
  Description of Artificial Sequence: Synthetic peptide
QEGEIAPTNPCATEQYGIVSENLMSGTR

SEQ ID NO: 70261 - protein, 28 aa, Artificial Sequence
  Description of Artificial Sequence: Synthetic peptide
QEGEIAPTNPCATEQYGIVSCNWQSGTR

SEQ ID NO: 70262 - protein, 32 aa, Artificial Sequence
  Description of Artificial Sequence: Synthetic polypeptide
DEEEIGTTNPCATEQYGCVCPTNLQERGSDTQ

SEQ ID NO: 70263 - protein, 29 aa, Artificial Sequence
  Description of Artificial Sequence: Synthetic peptide
QEGEIAPTNPCATEQYGIVSCNLQSGNPV

SEQ ID NO: 70264 - protein, 28 aa, Artificial Sequence
  Description of Artificial Sequence: Synthetic peptide
QEGEIAPTNPCATEQYGIVSANWQSGTR

SEQ ID NO: 70265 - protein, 34 aa, Artificial Sequence
  Description of Artificial Sequence: Synthetic polypeptide
DEEEIGTTNPCATEQYGSTPSMTENLSQRIGERT

SEQ ID NO: 70266 - protein, 30 aa, Artificial Sequence
  Description of Artificial Sequence: Synthetic polypeptide
DEQEIATTNPVATEQYGSASTDLEHEGGDL

SEQ ID NO: 70267 - protein, 28 aa, Artificial Sequence
  Description of Artificial Sequence: Synthetic peptide
QEGEIAPTNPCATEQYGIVSANWQSGPR

SEQ ID NO: 70268 - protein, 30 aa, Artificial Sequence
  Description of Artificial Sequence: Synthetic polypeptide
DEQEIATTNPVATEQYGSASTDLEDHEGEK

SEQ ID NO: 70269 - protein, 33 aa, Artificial Sequence
  Description of Artificial Sequence: Synthetic polypeptide
AEEEIRTTNPVATEQYGSVSVSVNQQQGTGNIQ

SEQ ID NO: 70270 - protein, 33 aa, Artificial Sequence
  Description of Artificial Sequence: Synthetic polypeptide
DEAEIRTTNPVATEQYGSVSYDMLQMAGEVNFQ

SEQ ID NO: 70271 - protein, 30 aa, Artificial Sequence
  Description of Artificial Sequence: Synthetic polypeptide
DESEIASVNPVCTEQYGSVSDNLPQDSGNG

SEQ ID NO: 70272 - protein, 29 aa, Artificial Sequence
  Description of Artificial Sequence: Synthetic peptide
DESEIASVNPVCTEQYGVVSDNLQSVGNQ

SEQ ID NO: 70273 - protein, 31 aa, Artificial Sequence
  Description of Artificial Sequence: Synthetic polypeptide
DESEIATTNPCATEQWGEVSTNLQGDLGNND

SEQ ID NO: 70274 - protein, 32 aa, Artificial Sequence
  Description of Artificial Sequence: Synthetic polypeptide
DEAEIRTTNPVATEQYGSVSWTWNNHSGGEFE

SEQ ID NO: 70275 - protein, 29 aa, Artificial Sequence
  Description of Artificial Sequence: Synthetic peptide
QEGEIAPTNPCASEQYGSVSTCNGQSGTR

SEQ ID NO: 70276 - protein, 35 aa, Artificial Sequence
  Description of Artificial Sequence: Synthetic polypeptide
AEEEIRTTNPVATEQYGSVSVSVSTNLQQGSNNQS

SEQ ID NO: 70277 - protein, 29 aa, Artificial Sequence
  Description of Artificial Sequence: Synthetic peptide
DESEIATTNPVATECWGDVSCCLQRGEEL

SEQ ID NO: 70278 - protein, 35 aa, Artificial Sequence
  Description of Artificial Sequence: Synthetic polypeptide
DEEEIGTTNPVATEAYGSVPSCTNELSQERQGGNL

SEQ ID NO: 70279 - protein, 34 aa, Artificial Sequence
  Description of Artificial Sequence: Synthetic polypeptide
DEEEIRTTNPVATEQYGSVDSPANLLQRQFSEQD

SEQ ID NO: 70280 - protein, 28 aa, Artificial Sequence
  Description of Artificial Sequence: Synthetic peptide
QEGEIAPTNPCASEQYGSVSCNGQSGTR

SEQ ID NO: 70281 - protein, 34 aa, Artificial Sequence
  Description of Artificial Sequence: Synthetic polypeptide
AEEEIRTTNPVATEQYGSVSVSTNNNQQGTNGTD

SEQ ID NO: 70282 - protein, 32 aa, Artificial Sequence
  Description of Artificial Sequence: Synthetic polypeptide
DECEIATTNPVATENYGSVSTGNGPAGNDNQR

SEQ ID NO: 70283 - protein, 33 aa, Artificial Sequence
  Description of Artificial Sequence: Synthetic polypeptide
DEEEIRTTNPVATEQYGSVDPTTNLQTVQPAET

SEQ ID NO: 70284 - protein, 33 aa, Artificial Sequence
  Description of Artificial Sequence: Synthetic polypeptide
DEEEIRTTNPVATEQYGSVDPTNQHQERDQIEL

SEQ ID NO: 70285 - protein, 33 aa, Artificial Sequence
  Description of Artificial Sequence: Synthetic polypeptide
DEEEIRTTNPVATEQYGSVSTVLPNQNQEDEDQ

SEQ ID NO: 70286 - protein, 32 aa, Artificial Sequence
  Description of Artificial Sequence: Synthetic polypeptide
DECEIATTNPCAYEQWGSVSTNLQGDRGNDDD

SEQ ID NO: 70287 - protein, 31 aa, Artificial Sequence
  Description of Artificial Sequence: Synthetic polypeptide
DESEIASTNPVATEQWGSVSDNEPQREGENQ

SEQ ID NO: 70288 - protein, 30 aa, Artificial Sequence
  Description of Artificial Sequence: Synthetic polypeptide
DESEIASTNPVATEQYGEASNTLQSRVGGR

SEQ ID NO: 70289 - protein, 30 aa, Artificial Sequence
  Description of Artificial Sequence: Synthetic polypeptide
DESEIASTNPVATEQYGSVSATDLEHGEDI

SEQ ID NO: 70290 - protein, 30 aa, Artificial Sequence
  Description of Artificial Sequence: Synthetic polypeptide
DESEIASTNPVATEQYGSVSATDLEHGEDL

SEQ ID NO: 70291 - protein, 29 aa, Artificial Sequence
  Description of Artificial Sequence: Synthetic peptide
DESEIASTNPVATEQYGVMSTDLQHEGDI

SEQ ID NO: 70292 - protein, 29 aa, Artificial Sequence
  Description of Artificial Sequence: Synthetic peptide
QENEIATTNPVATECYGTVSTDCLQHENL

SEQ ID NO: 70293 - protein, 29 aa, Artificial Sequence
  Description of Artificial Sequence: Synthetic peptide
DESEIASTNPVATEQYGVMSTDLQHEGEI

SEQ ID NO: 70294 - protein, 28 aa, Artificial Sequence
  Description of Artificial Sequence: Synthetic peptide
DESEIASTNPVATEQYGVMSTTLEHGDI

SEQ ID NO: 70295 - protein, 32 aa, Artificial Sequence
  Description of Artificial Sequence: Synthetic polypeptide
DECEIATTNPVATEAYGSTVSCTNLSMYGGNT

SEQ ID NO: 70296 - protein, 29 aa, Artificial Sequence
  Description of Artificial Sequence: Synthetic peptide
QEGEIAPTNPCASEQYGSVSACNLQSGTR

SEQ ID NO: 70297 - protein, 30 aa, Artificial Sequence
  Description of Artificial Sequence: Synthetic polypeptide
DESEIASTNPVCTECYGSVSDNLPQDSGNG

SEQ ID NO: 70298 - protein, 31 aa, Artificial Sequence
  Description of Artificial Sequence: Synthetic polypeptide
DEEEIGPTNPEATEQYGSVSTESLYQVRQEF

SEQ ID NO: 70299 - protein, 33 aa, Artificial Sequence
  Description of Artificial Sequence: Synthetic polypeptide
DEEEIRTTNPVATEQYGSVDNPTNLNNFVNELI

SEQ ID NO: 70300 - protein, 33 aa, Artificial Sequence
  Description of Artificial Sequence: Synthetic polypeptide
DEEEIRTTNPVATEQYGSVDNPTTLTRNFVNDI

SEQ ID NO: 70301 - protein, 28 aa, Artificial Sequence
  Description of Artificial Sequence: Synthetic peptide
DESEIASTNPVGTEGYGVVASTLQRGQI

SEQ ID NO: 70302 - protein, 33 aa, Artificial Sequence
  Description of Artificial Sequence: Synthetic polypeptide
DEEEIRTTNPVATEQYGSVSTVLQDNIASDIPG

SEQ ID NO: 70303 - protein, 32 aa, Artificial Sequence
  Description of Artificial Sequence: Synthetic polypeptide
DEAEIRTTNPVATEQYGSVTSTNDPQETEEIT

SEQ ID NO: 70304 - protein, 34 aa, Artificial Sequence
  Description of Artificial Sequence: Synthetic polypeptide
AEEEIRTTNPVATEQYGSVSVSTNNNNQQGNGTD

SEQ ID NO: 70305 - protein, 32 aa, Artificial Sequence
  Description of Artificial Sequence: Synthetic polypeptide
DEAEIRTTNPVATEQYGSVTGGTNNGNSGENS

SEQ ID NO: 70306 - protein, 31 aa, Artificial Sequence
  Description of Artificial Sequence: Synthetic polypeptide
DEAEIRTTNPVATEQYGSVSYNYNTFSIERA

SEQ ID NO: 70307 - protein, 28 aa, Artificial Sequence
  Description of Artificial Sequence: Synthetic peptide
DESEIASTNPVGTEQYGSMASTGQHGNI

SEQ ID NO: 70308 - protein, 31 aa, Artificial Sequence
  Description of Artificial Sequence: Synthetic polypeptide
DECEIATTNPVATENWGSVSTNPNAGNDNQR

SEQ ID NO: 70309 - protein, 28 aa, Artificial Sequence
  Description of Artificial Sequence: Synthetic peptide
DESEIASTNPVGTEGYGVMASTLQRGQR

SEQ ID NO: 70310 - protein, 34 aa, Artificial Sequence
  Description of Artificial Sequence: Synthetic polypeptide
AEEEIRTTNPVATEQYGSVSVSVTNLQGNLQNGI

SEQ ID NO: 70311 - protein, 29 aa, Artificial Sequence
  Description of Artificial Sequence: Synthetic peptide
QEGEIAPTNPCASEQYGIVSTNLQDSGTR

SEQ ID NO: 70312 - protein, 31 aa, Artificial Sequence
  Description of Artificial Sequence: Synthetic polypeptide
DEQEIATTNPVATEQYGSASATVLQHEGEDL

SEQ ID NO: 70313 - protein, 33 aa, Artificial Sequence
  Description of Artificial Sequence: Synthetic polypeptide
DEAEIRTTNPVATEQYGSVSVTNLNTRSQDSDQ

SEQ ID NO: 70314 - protein, 34 aa, Artificial Sequence
  Description of Artificial Sequence: Synthetic polypeptide
DEEEIRTTNPVATEQYGSVSTVNGFGQENDNEGF

SEQ ID NO: 70315 - protein, 35 aa, Artificial Sequence
  Description of Artificial Sequence: Synthetic polypeptide
DEEEIRTTNPVATEQYGSVSTVNGFGQENQGNGGG

SEQ ID NO: 70316 - protein, 31 aa, Artificial Sequence
  Description of Artificial Sequence: Synthetic polypeptide
DECEIATTNPVATEQYGSVSWNENMTDGNTQ

SEQ ID NO: 70317 - protein, 34 aa, Artificial Sequence
  Description of Artificial Sequence: Synthetic polypeptide
DEEEIRTTNPVATEQYGSVDSSMDEQERGEEGRM

SEQ ID NO: 70318 - protein, 33 aa, Artificial Sequence
  Description of Artificial Sequence: Synthetic polypeptide
DECEIATTNPVATEQYGSVSWNEQMDRGGNHTQ

SEQ ID NO: 70319 - protein, 33 aa, Artificial Sequence
  Description of Artificial Sequence: Synthetic polypeptide
AEEEIRTTNPVATEQYGSVSTVVNQNQQQTNNE

SEQ ID NO: 70320 - protein, 30 aa, Artificial Sequence
  Description of Artificial Sequence: Synthetic polypeptide
DEQEIATTNPVATEQYGIVSTDLEDHEGEL

SEQ ID NO: 70321 - protein, 33 aa, Artificial Sequence
  Description of Artificial Sequence: Synthetic polypeptide
DEEEIRTTNPVATEQYGSTSMTENHSQTIENNE

SEQ ID NO: 70322 - protein, 34 aa, Artificial Sequence
  Description of Artificial Sequence: Synthetic polypeptide
DEEEIRTTNPVATEQYGSTSMTENDNQNIGSNQM

SEQ ID NO: 70323 - protein, 31 aa, Artificial Sequence
  Description of Artificial Sequence: Synthetic polypeptide
DECEIATTNPVATEQYGSVSWNEQMQDGGTQ

SEQ ID NO: 70324 - protein, 33 aa, Artificial Sequence
  Description of Artificial Sequence: Synthetic polypeptide
DEAEIRTTNPVATEQYGSVSVTNTLDTSGQDIE

SEQ ID NO: 70325 - protein, 28 aa, Artificial Sequence
  Description of Artificial Sequence: Synthetic peptide
QENEIATTNPVATEGYGDVSECLQHGEL

SEQ ID NO: 70326 - protein, 33 aa, Artificial Sequence
  Description of Artificial Sequence: Synthetic polypeptide
DEQEIATTNPVATEQYGEVVSTVLGQGGDGNRM

SEQ ID NO: 70327 - protein, 31 aa, Artificial Sequence
  Description of Artificial Sequence: Synthetic polypeptide
DEQEIATTNPVATEQYGEVSTNPQNGGDMQA

SEQ ID NO: 70328 - protein, 33 aa, Artificial Sequence
  Description of Artificial Sequence: Synthetic polypeptide
DEEEIRTTNPVATEQYGSVDSSMMDEQERGELN

SEQ ID NO: 70329 - protein, 31 aa, Artificial Sequence
  Description of Artificial Sequence: Synthetic polypeptide
DEQEIATTNPVATEQYGEVSTNPQNGDTGQA

SEQ ID NO: 70330 - protein, 32 aa, Artificial Sequence
  Description of Artificial Sequence: Synthetic polypeptide
DEQEIATTNPVATEQYGEVSTNLNMDGGGNND

SEQ ID NO: 70331 - protein, 34 aa, Artificial Sequence
  Description of Artificial Sequence: Synthetic polypeptide
DEEEIRTTNPVATEQYGSVDSTDGDQEEGGNVGE

SEQ ID NO: 70332 - protein, 31 aa, Artificial Sequence
  Description of Artificial Sequence: Synthetic polypeptide
DESEIATTNPVATECWGSASEINLQREGENG

SEQ ID NO: 70333 - protein, 28 aa, Artificial Sequence
  Description of Artificial Sequence: Synthetic peptide
QEGEIAPTNPCASECYGIVSCNLQSGNR

SEQ ID NO: 70334 - protein, 33 aa, Artificial Sequence
  Description of Artificial Sequence: Synthetic polypeptide
DEEEIRTTNPVATEQYGSVDSTEEHQSFGSEQV

SEQ ID NO: 70335 - protein, 28 aa, Artificial Sequence
  Description of Artificial Sequence: Synthetic peptide
QEGEIAPTNPCASECWGIVSCNLQRGNR

SEQ ID NO: 70336 - protein, 32 aa, Artificial Sequence
  Description of Artificial Sequence: Synthetic polypeptide
DECEIATTNPVATETWGTVSTNLQGDVGDNNR

SEQ ID NO: 70337 - protein, 28 aa, Artificial Sequence
  Description of Artificial Sequence: Synthetic peptide
QENEIATTNPVATEGYGDVSECLQREEL

SEQ ID NO: 70338 - protein, 35 aa, Artificial Sequence
  Description of Artificial Sequence: Synthetic polypeptide
AEEEIRTTNPVATEQYGSVSVTNLQQGNEGTNNVN

SEQ ID NO: 70339 - protein, 34 aa, Artificial Sequence
  Description of Artificial Sequence: Synthetic polypeptide
DEAEIRTTNPVATEQYGSVSVTNVHQNSGTENQN

SEQ ID NO: 70340 - protein, 28 aa, Artificial Sequence
  Description of Artificial Sequence: Synthetic peptide
QEGEIAPTNPCASEQYGDVSCNLQSGTR

SEQ ID NO: 70341 - protein, 35 aa, Artificial Sequence
  Description of Artificial Sequence: Synthetic polypeptide
DEEEIRTTNPVATEQYGSVDSPLMNLLQRQGEETT

SEQ ID NO: 70342 - protein, 28 aa, Artificial Sequence
  Description of Artificial Sequence: Synthetic peptide
QEGEIAPTNPCASEQYGIVSENLQSGTR

SEQ ID NO: 70343 - protein, 28 aa, Artificial Sequence
  Description of Artificial Sequence: Synthetic peptide
QEGEIAPTNPCASEQYGIVSCNLQSGTR

SEQ ID NO: 70344 - protein, 31 aa, Artificial Sequence
  Description of Artificial Sequence: Synthetic polypeptide
DEQEIATTNPVATEQYGSASATVLQHEGEDK

SEQ ID NO: 70345 - protein, 32 aa, Artificial Sequence
  Description of Artificial Sequence: Synthetic polypeptide
DECEIATTNPVATEQWGVVSTNLQGDAGNNEH

SEQ ID NO: 70346 - protein, 35 aa, Artificial Sequence
  Description of Artificial Sequence: Synthetic polypeptide
AEEEIRTTNPVATEQYGSVSVSVTNNLQQGSTNVE

SEQ ID NO: 70347 - protein, 35 aa, Artificial Sequence
  Description of Artificial Sequence: Synthetic polypeptide
DEEEIRTTNPVATEQYGSVDSPSNELQRQGEEETT

SEQ ID NO: 70348 - protein, 33 aa, Artificial Sequence
  Description of Artificial Sequence: Synthetic polypeptide
DECEIATTNPVATEQYGSTVSCTNALSMTGNNT

SEQ ID NO: 70349 - protein, 33 aa, Artificial Sequence
  Description of Artificial Sequence: Synthetic polypeptide
DEAEIRTTNPVATEQYGSVSWNMEQRSGQETGI

SEQ ID NO: 70350 - protein, 29 aa, Artificial Sequence
  Description of Artificial Sequence: Synthetic peptide
QEGEIAPTNPCASEQYGIVSCNLQSGNPR

SEQ ID NO: 70351 - protein, 31 aa, Artificial Sequence
  Description of Artificial Sequence: Synthetic polypeptide
DEAEIRTTNPVATEQYGSVSWNKHQEDDMQE

SEQ ID NO: 70352 - protein, 32 aa, Artificial Sequence
  Description of Artificial Sequence: Synthetic polypeptide
DEAEIRTTNPVATEQYGSVSVTPDILFDSIER

SEQ ID NO: 70353 - protein, 32 aa, Artificial Sequence
  Description of Artificial Sequence: Synthetic polypeptide
DECEIATTNPVATEQYGSVATTLGDDEGGNNR

SEQ ID NO: 70354 - protein, 34 aa, Artificial Sequence
  Description of Artificial Sequence: Synthetic polypeptide
DEEEIRTTNPVATEQYGSTSMTEWLSQTTIENQR

SEQ ID NO: 70355 - protein, 32 aa, Artificial Sequence
  Description of Artificial Sequence: Synthetic polypeptide
DECEIATTNPVATEQYGSVSTTNHGNDTGNNV

SEQ ID NO: 70356 - protein, 34 aa, Artificial Sequence
  Description of Artificial Sequence: Synthetic polypeptide
DEEEIRTTNPVATEQYGSVDSPTVLMQQMLTPRQ

SEQ ID NO: 70357 - protein, 31 aa, Artificial Sequence
  Description of Artificial Sequence: Synthetic polypeptide
DEAEIRTTNPVATEQYGSVSWDMQHISENNQ

SEQ ID NO: 70358 - protein, 28 aa, Artificial Sequence
  Description of Artificial Sequence: Synthetic peptide
QENEIATTNPVATEDYGDVSENLQHEEL

SEQ ID NO: 70359 - protein, 30 aa, Artificial Sequence
  Description of Artificial Sequence: Synthetic polypeptide
DEQEIATTNPVATEQYGSASAEVLQHEGEL

SEQ ID NO: 70360 - protein, 31 aa, Artificial Sequence
  Description of Artificial Sequence: Synthetic polypeptide
DEAEIRTTNPVATEQYGSVSVVNLENPHLDF

SEQ ID NO: 70361 - protein, 31 aa, Artificial Sequence
  Description of Artificial Sequence: Synthetic polypeptide
DEAEIRTTNPVATEQYGSVSVTVMEGMEDRN

SEQ ID NO: 70362 - protein, 33 aa, Artificial Sequence
  Description of Artificial Sequence: Synthetic polypeptide
DEEEIRTTNPVATEQYGSVSTVLVNGGEGQTTI

SEQ ID NO: 70363 - protein, 33 aa, Artificial Sequence
  Description of Artificial Sequence: Synthetic polypeptide
DEEEIRTTNPVATEQYGSVSTVLVNGSGQTFTG

SEQ ID NO: 70364 - protein, 28 aa, Artificial Sequence
  Description of Artificial Sequence: Synthetic peptide
QEGEIAPTNPCASEQYGEASCNLQRGTR

SEQ ID NO: 70365 - protein, 31 aa, Artificial Sequence
  Description of Artificial Sequence: Synthetic polypeptide
DECEIATTNPVATEQYGSVSTDLEDHEGEDL

SEQ ID NO: 70366 - protein, 31 aa, Artificial Sequence
  Description of Artificial Sequence: Synthetic polypeptide
DESEIASTNPVATEQWGSVSDNEPQREGENG

SEQ ID NO: 70367 - protein, 32 aa, Artificial Sequence
  Description of Artificial Sequence: Synthetic polypeptide
QEEGIRTTNPVATEQYGSVSTNGLGEGQEDEG

SEQ ID NO: 70368 - protein, 30 aa, Artificial Sequence
  Description of Artificial Sequence: Synthetic polypeptide
DEQEIATTNPVATEPYGTVSTDIEDQNGNL

SEQ ID NO: 70369 - protein, 33 aa, Artificial Sequence
  Description of Artificial Sequence: Synthetic polypeptide
DEEEIRTTNPVATEQYGSVENTNMQLVNSEDEI

SEQ ID NO: 70370 - protein, 32 aa, Artificial Sequence
  Description of Artificial Sequence: Synthetic polypeptide
DESEIATTNPVATEQYGSVAATDLQDHEGEDR

SEQ ID NO: 70371 - protein, 31 aa, Artificial Sequence
  Description of Artificial Sequence: Synthetic polypeptide
DEQEIASTNPVATEQYGSVSATNLEDSGEDQ

SEQ ID NO: 70372 - protein, 31 aa, Artificial Sequence
  Description of Artificial Sequence: Synthetic polypeptide
DEQEIASTNPVATEQYGSVSATDLQDHGEDQ

SEQ ID NO: 70373 - protein, 30 aa, Artificial Sequence
  Description of Artificial Sequence: Synthetic polypeptide
DECEIATTNPVAYEQYGVCSTIDQREGNDN

SEQ ID NO: 70374 - protein, 31 aa, Artificial Sequence
  Description of Artificial Sequence: Synthetic polypeptide
DESEIATTNPVATEQYGSVATNLAEPNNEMN

SEQ ID NO: 70375 - protein, 30 aa, Artificial Sequence
  Description of Artificial Sequence: Synthetic polypeptide
DECEIATTNPVAYEQYGVCSTILQRDNGDN

SEQ ID NO: 70376 - protein, 32 aa, Artificial Sequence
  Description of Artificial Sequence: Synthetic polypeptide
DEQEIASTNPVATEQYGSVSADNLQDHEGNDQ

SEQ ID NO: 70377 - protein, 32 aa, Artificial Sequence
  Description of Artificial Sequence: Synthetic polypeptide
DECEIATTNPVAYEQYGVVSTNLQGDAGNGEH

SEQ ID NO: 70378 - protein, 31 aa, Artificial Sequence
  Description of Artificial Sequence: Synthetic polypeptide
CEEEIACTNPVATEQWGSVATNLQRNANMEM

SEQ ID NO: 70379 - protein, 30 aa, Artificial Sequence
  Description of Artificial Sequence: Synthetic polypeptide
DEQEIASTNPVATEQYGSVSADDLQDHGEQ

SEQ ID NO: 70380 - protein, 33 aa, Artificial Sequence
  Description of Artificial Sequence: Synthetic polypeptide
QEEEIRTTNPVAYEAYGSVSCTDNELQRGGSQV

SEQ ID NO: 70381 - protein, 32 aa, Artificial Sequence
  Description of Artificial Sequence: Synthetic polypeptide
DESEIATTNPVATEQYGSVGSTRSSNQDGNAK

SEQ ID NO: 70382 - protein, 29 aa, Artificial Sequence
  Description of Artificial Sequence: Synthetic peptide
DEQEIASTNPVATEGYGSVSSTLQDHGEI

SEQ ID NO: 70383 - protein, 29 aa, Artificial Sequence
  Description of Artificial Sequence: Synthetic peptide
DEQEIASTNPVATEGYGSVASTLQDHGEI

SEQ ID NO: 70384 - protein, 31 aa, Artificial Sequence
  Description of Artificial Sequence: Synthetic polypeptide
DECEIATTNPVAYERWGSVSTNLQDEGNNQH

SEQ ID NO: 70385 - protein, 29 aa, Artificial Sequence
  Description of Artificial Sequence: Synthetic peptide
DEQEIAPTNPVSSEQYGSVSATNLEHGTL

SEQ ID NO: 70386 - protein, 33 aa, Artificial Sequence
  Description of Artificial Sequence: Synthetic polypeptide
DEEEIRTTNPVATEQYGSVEPGINVSQDIEENR

SEQ ID NO: 70387 - protein, 35 aa, Artificial Sequence
  Description of Artificial Sequence: Synthetic polypeptide
AEEEIRTTNPVATEQYGSVSVTNNNLQQGNLGINN

SEQ ID NO: 70388 - protein, 32 aa, Artificial Sequence
  Description of Artificial Sequence: Synthetic polypeptide
DECEIATTNPVAYERYGSVSTNNGQGMGGNER

SEQ ID NO: 70389 - protein, 31 aa, Artificial Sequence
  Description of Artificial Sequence: Synthetic polypeptide
DEEEIRTTNPVATEQYGSVEPMNGEQVTVQQ

SEQ ID NO: 70390 - protein, 31 aa, Artificial Sequence
  Description of Artificial Sequence: Synthetic polypeptide
DECEIATTNPVAYERYGSVSTNQGGGPNGNR

SEQ ID NO: 70391 - protein, 30 aa, Artificial Sequence
  Description of Artificial Sequence: Synthetic polypeptide
DECEIATTNPVAYESWGSVATNLQSGGDNH

SEQ ID NO: 70392 - protein, 32 aa, Artificial Sequence
  Description of Artificial Sequence: Synthetic polypeptide
DEEEIRTTNPVATEQYGSNYVMGNVDDERDER

SEQ ID NO: 70393 - protein, 29 aa, Artificial Sequence
  Description of Artificial Sequence: Synthetic peptide
DEQEIASTNPVATEQYGVMSTDLQHEGEL

SEQ ID NO: 70394 - protein, 32 aa, Artificial Sequence
  Description of Artificial Sequence: Synthetic polypeptide
DESEIATTNPVATEQYGSVAATANLEMNGLNL

SEQ ID NO: 70395 - protein, 32 aa, Artificial Sequence
  Description of Artificial Sequence: Synthetic polypeptide
DESEIATTNPVATEQYGSTVSCFNLSMEGGNT

SEQ ID NO: 70396 - protein, 36 aa, Artificial Sequence
  Description of Artificial Sequence: Synthetic polypeptide
DEEEIRTTNPVATEQYGSVSTVTENLQQLIGTNVTT

SEQ ID NO: 70397 - protein, 35 aa, Artificial Sequence
  Description of Artificial Sequence: Synthetic polypeptide
AEEEIRTTNPVATEQYGSVSVTNNLQQGTEGGNDE

SEQ ID NO: 70398 - protein, 33 aa, Artificial Sequence
  Description of Artificial Sequence: Synthetic polypeptide
DEEEIRTTNPVATEQYGSQSTTNLVQEPMLTFD

SEQ ID NO: 70399 - protein, 34 aa, Artificial Sequence
  Description of Artificial Sequence: Synthetic polypeptide
DEEEIGTTNPVAYEQYGKVSTNELSQERTGTNNL

SEQ ID NO: 70400 - protein, 32 aa, Artificial Sequence
  Description of Artificial Sequence: Synthetic polypeptide
DESEIATTNPVATEQYGNVSANGIVQSREGND

SEQ ID NO: 70401 - protein, 35 aa, Artificial Sequence
  Description of Artificial Sequence: Synthetic polypeptide
AEEEIRTTNPVATEQYGSVSVTNNLQQGTEGTNVG

SEQ ID NO: 70402 - protein, 30 aa, Artificial Sequence
  Description of Artificial Sequence: Synthetic polypeptide
AENEIACTNPVATEQYGEASENLQRPGGAR

SEQ ID NO: 70403 - protein, 35 aa, Artificial Sequence
  Description of Artificial Sequence: Synthetic polypeptide
DEEEIRTTNPVATEQYGSVSTVTNNGIQESGNTTE

SEQ ID NO: 70404 - protein, 31 aa, Artificial Sequence
  Description of Artificial Sequence: Synthetic polypeptide
DEQEIATTNPIATEQYGSVSATDLMDRGEDL

SEQ ID NO: 70405 - protein, 28 aa, Artificial Sequence
  Description of Artificial Sequence: Synthetic peptide
DEQEIATTNPCSTEQYGIVSTDLESGTL

SEQ ID NO: 70406 - protein, 32 aa, Artificial Sequence
  Description of Artificial Sequence: Synthetic polypeptide
DEEEIHTTNPVATCHYGSVSTTEEAVQSEGNR

SEQ ID NO: 70407 - protein, 34 aa, Artificial Sequence
  Description of Artificial Sequence: Synthetic polypeptide
QEEEIRTTNPVATEQYGVVSTGDGNLQDQGGNDD

SEQ ID NO: 70408 - protein, 35 aa, Artificial Sequence
  Description of Artificial Sequence: Synthetic polypeptide
AEEEIRTTNPVATEQYGSVSVTNNLQQQNGTNNSE

SEQ ID NO: 70409 - protein, 35 aa, Artificial Sequence
  Description of Artificial Sequence: Synthetic polypeptide
AEEEIRTTNPVATEQYGSVSVTNNLQQQNIGTNSQ

SEQ ID NO: 70410 - protein, 29 aa, Artificial Sequence
  Description of Artificial Sequence: Synthetic peptide
DEQEIATTNPCATEQYGIVSTDLEHEGEL

SEQ ID NO: 70411 - protein, 33 aa, Artificial Sequence
  Description of Artificial Sequence: Synthetic polypeptide
DEEEIRTTNPVATEQYGSQCSCWNLEQVGPMEE

SEQ ID NO: 70412 - protein, 30 aa, Artificial Sequence
  Description of Artificial Sequence: Synthetic polypeptide
DEQEIATTNPCASEQYGSVSATDLQSGTDL

SEQ ID NO: 70413 - protein, 32 aa, Artificial Sequence
  Description of Artificial Sequence: Synthetic polypeptide
DEAEIRTTNPVATEQYGSVSTLTLSFPNYSES

SEQ ID NO: 70414 - protein, 34 aa, Artificial Sequence
  Description of Artificial Sequence: Synthetic polypeptide
AEEEIRTTNPVATEQYGSVSVTNNNDQAGNQNQQ

SEQ ID NO: 70415 - protein, 30 aa, Artificial Sequence
  Description of Artificial Sequence: Synthetic polypeptide
DEQEIASVNPVATEQYGVVSATNLEDSGNQ

SEQ ID NO: 70416 - protein, 32 aa, Artificial Sequence
  Description of Artificial Sequence: Synthetic polypeptide
DESEIATTNPVATEQYGSTVACTNLSMYNGNT

SEQ ID NO: 70417 - protein, 32 aa, Artificial Sequence
  Description of Artificial Sequence: Synthetic polypeptide
QEEEIRTTNPVGTEQWGSVSTANELGERGDFA

SEQ ID NO: 70418 - protein, 29 aa, Artificial Sequence
  Description of Artificial Sequence: Synthetic peptide
DEQEIASTNPVCTEQYGSVSDNLESEGEL

SEQ ID NO: 70419 - protein, 32 aa, Artificial Sequence
  Description of Artificial Sequence: Synthetic polypeptide
DEEEIHTTNPVATEQYGSVSTYLASDMGMEQM

SEQ ID NO: 70420 - protein, 31 aa, Artificial Sequence
  Description of Artificial Sequence: Synthetic polypeptide
DEQEIATTNPCATEQYGSVSATDLQDHGEDL

SEQ ID NO: 70421 - protein, 31 aa, Artificial Sequence
  Description of Artificial Sequence: Synthetic polypeptide
DEEEIGTTNPVATETYGSVSQLNAVPTTNRE

SEQ ID NO: 70422 - protein, 30 aa, Artificial Sequence
  Description of Artificial Sequence: Synthetic polypeptide
DEQEIAPTNPVATEQYGSVSTDLEDSEGEL

SEQ ID NO: 70423 - protein, 32 aa, Artificial Sequence
  Description of Artificial Sequence: Synthetic polypeptide
CEEEIRTTNPCAYEQYGEVYSDAENLQWGNRE

SEQ ID NO: 70424 - protein, 29 aa, Artificial Sequence
  Description of Artificial Sequence: Synthetic peptide
DEQEIACTNPVATEQYGEASTDLEDRGEL

SEQ ID NO: 70425 - protein, 34 aa, Artificial Sequence
  Description of Artificial Sequence: Synthetic polypeptide
DEAEIRTTNPVATEQYGSVSTLNWEDAQSGEERQ

SEQ ID NO: 70426 - protein, 32 aa, Artificial Sequence
  Description of Artificial Sequence: Synthetic polypeptide
DEEEIKTTNPVATDQYGSVDITSALQIGNYGE

SEQ ID NO: 70427 - protein, 34 aa, Artificial Sequence
  Description of Artificial Sequence: Synthetic polypeptide
DEQEAEIRTTNPVAYEQWGSVSTNLQHDGGNTNS

SEQ ID NO: 70428 - protein, 33 aa, Artificial Sequence
  Description of Artificial Sequence: Synthetic polypeptide
DEQEAEIATTNPVAYEQWGSVSTNLQHDGGDTR

SEQ ID NO: 70429 - protein, 33 aa, Artificial Sequence
  Description of Artificial Sequence: Synthetic polypeptide
DEEEIKTTNPVATEAYGISTVSTYLSQGTGGNA

SEQ ID NO: 70430 - protein, 32 aa, Artificial Sequence
  Description of Artificial Sequence: Synthetic polypeptide
DEEEIKTTNPVATEGWGVSVASQNDQMGGNRQ

SEQ ID NO: 70431 - protein, 34 aa, Artificial Sequence
  Description of Artificial Sequence: Synthetic polypeptide
DEEEIKTTNPVATEHYGSVSTGNALSQQSGGNQP

SEQ ID NO: 70432 - protein, 35 aa, Artificial Sequence
  Description of Artificial Sequence: Synthetic polypeptide
DEEEIKTTNPVATEHYGSVVSCTLNLSQQRGGNQP

SEQ ID NO: 70433 - protein, 34 aa, Artificial Sequence
  Description of Artificial Sequence: Synthetic polypeptide
AEEEIRTTNPVATEQYGSVSVTNNNNQQDEGNQE

SEQ ID NO: 70434 - protein, 34 aa, Artificial Sequence
  Description of Artificial Sequence: Synthetic polypeptide
CEEEIRTTNPVATEAYGSVSACHNLSQRTGGANM

SEQ ID NO: 70435 - protein, 33 aa, Artificial Sequence
  Description of Artificial Sequence: Synthetic polypeptide
DEEEIKTTNPVATEPYGSVQPCTRLSQRTSGNS

SEQ ID NO: 70436 - protein, 31 aa, Artificial Sequence
  Description of Artificial Sequence: Synthetic polypeptide
DESEIATTNPVATEQYGTVSANGIVQFEGND

SEQ ID NO: 70437 - protein, 33 aa, Artificial Sequence
  Description of Artificial Sequence: Synthetic polypeptide
DEEEIKTTNPVATEQWGSVQPCTNISQRTSGNS

SEQ ID NO: 70438 - protein, 35 aa, Artificial Sequence
  Description of Artificial Sequence: Synthetic polypeptide
DEEEIRTTNPVATEQYGSVEPTMMLQERNGNLDII

SEQ ID NO: 70439 - protein, 31 aa, Artificial Sequence
  Description of Artificial Sequence: Synthetic polypeptide
DEPEIYTTNPVATEQYGSVSTDLLMYVGEVE

SEQ ID NO: 70440 - protein, 30 aa, Artificial Sequence
  Description of Artificial Sequence: Synthetic polypeptide
DEPEISTTNPVATEQYGSVSSNNAEVENEF

SEQ ID NO: 70441 - protein, 29 aa, Artificial Sequence
  Description of Artificial Sequence: Synthetic peptide
DESEIATTNPVATEQYGVMATDLQHEGDL

SEQ ID NO: 70442 - protein, 33 aa, Artificial Sequence
  Description of Artificial Sequence: Synthetic polypeptide
DEPEIRTTNPVAYEQYGVVQSCTNISQRGGMNS

SEQ ID NO: 70443 - protein, 30 aa, Artificial Sequence
  Description of Artificial Sequence: Synthetic polypeptide
DESEIATTNPVATEQYGVVATDLQHEGDDL

SEQ ID NO: 70444 - protein, 34 aa, Artificial Sequence
  Description of Artificial Sequence: Synthetic polypeptide
AEEEIRTTNPVATEQYGSVSVTNNNQLTQGTNVA

SEQ ID NO: 70445 - protein, 32 aa, Artificial Sequence
  Description of Artificial Sequence: Synthetic polypeptide
DEPEIRTTNPVATEQYGVVSSVILQTRPENDM

SEQ ID NO: 70446 - protein, 34 aa, Artificial Sequence
  Description of Artificial Sequence: Synthetic polypeptide
DEEEIRTTNPVATEQYGSVEPTNAPPQNEGELRD

SEQ ID NO: 70447 - protein, 30 aa, Artificial Sequence
  Description of Artificial Sequence: Synthetic polypeptide
DEQEIACTNPVATEQYGEVSAEDLQREGEL

SEQ ID NO: 70448 - protein, 34 aa, Artificial Sequence
  Description of Artificial Sequence: Synthetic polypeptide
AEEEIRTTNPVATEQYGSVSVTNNNNQETGTNSA

SEQ ID NO: 70449 - protein, 33 aa, Artificial Sequence
  Description of Artificial Sequence: Synthetic polypeptide
DEEEIRTTNPVATEQYGSVEPTIGLEQTGQPLD

SEQ ID NO: 70450 - protein, 30 aa, Artificial Sequence
  Description of Artificial Sequence: Synthetic polypeptide
DEQEIACTNPVATEQYGEVSATDLQHEGGL

SEQ ID NO: 70451 - protein, 29 aa, Artificial Sequence
  Description of Artificial Sequence: Synthetic peptide
DEQEIAPTNPCATEQYGIVSTDLQDHGTL

SEQ ID NO: 70452 - protein, 31 aa, Artificial Sequence
  Description of Artificial Sequence: Synthetic polypeptide
DEEEIKTTNPAATEQYGSVPGNLIMGGNGDT

SEQ ID NO: 70453 - protein, 33 aa, Artificial Sequence
  Description of Artificial Sequence: Synthetic polypeptide
DEEEIKTTNPAATEQYGSVPTDNLQSGGGNGDT

SEQ ID NO: 70454 - protein, 33 aa, Artificial Sequence
  Description of Artificial Sequence: Synthetic polypeptide
DECEIATVNPVATEQYGSVSWTEDLDEQGGNHR

SEQ ID NO: 70455 - protein, 33 aa, Artificial Sequence
  Description of Artificial Sequence: Synthetic polypeptide
DEEEIKTTNPAATEQYGSVPTGNLQMGGGNGDT

SEQ ID NO: 70456 - protein, 32 aa, Artificial Sequence
  Description of Artificial Sequence: Synthetic polypeptide
DEEEIRTTNPVATEQYGSVEPNFNLQTQVDFV

SEQ ID NO: 70457 - protein, 31 aa, Artificial Sequence
  Description of Artificial Sequence: Synthetic polypeptide
DEQEIACTNPVATEQYGSVSENLQDHEGEDL

SEQ ID NO: 70458 - protein, 32 aa, Artificial Sequence
  Description of Artificial Sequence: Synthetic polypeptide
DESEIATTNPVATEQYGSVSATDLEDHEGNDL

SEQ ID NO: 70459 - protein, 32 aa, Artificial Sequence
  Description of Artificial Sequence: Synthetic polypeptide
DEEEIKTTNPAATEQYGSVPTNLIMGGGNGGT

SEQ ID NO: 70460 - protein, 30 aa, Artificial Sequence
  Description of Artificial Sequence: Synthetic polypeptide
DEQEIACTNPVATEQYGSVSAEDLMHGNDL

SEQ ID NO: 70461 - protein, 33 aa, Artificial Sequence
  Description of Artificial Sequence: Synthetic polypeptide
DEEEIATTNPVATEQYGSVCAATANDQDPGDNN

SEQ ID NO: 70462 - protein, 32 aa, Artificial Sequence
  Description of Artificial Sequence: Synthetic polypeptide
DESEIATTNPVATEQYGSVSANDLEDHEGEDR

SEQ ID NO: 70463 - protein, 30 aa, Artificial Sequence
  Description of Artificial Sequence: Synthetic polypeptide
DEQEIACTNPVATEQYGSASTNLEHEGGDL

SEQ ID NO: 70464 - protein, 33 aa, Artificial Sequence
  Description of Artificial Sequence: Synthetic polypeptide
DEEEIATTNPVATEQYGSVCAATANDQDMDGNN

SEQ ID NO: 70465 - protein, 28 aa, Artificial Sequence
  Description of Artificial Sequence: Synthetic peptide
QENEIATTNPVCTEQYGVVSDCLQSGEL

SEQ ID NO: 70466 - protein, 32 aa, Artificial Sequence
  Description of Artificial Sequence: Synthetic polypeptide
DESEIATTNPVATEQYGSVSATNLEDHEGEDL

SEQ ID NO: 70467 - protein, 31 aa, Artificial Sequence
  Description of Artificial Sequence: Synthetic polypeptide
DEQEIACTNPVATEQYGEVSENLQDHEGGDR

SEQ ID NO: 70468 - protein, 33 aa, Artificial Sequence
  Description of Artificial Sequence: Synthetic polypeptide
DESEIATTNPVATEQYGSVSCINEPQDREGENG

SEQ ID NO: 70469 - protein, 34 aa, Artificial Sequence
  Description of Artificial Sequence: Synthetic polypeptide
AEEEIRTTNPVATEQYGSVSVTNNNNNQQGSNSD

SEQ ID NO: 70470 - protein, 32 aa, Artificial Sequence
  Description of Artificial Sequence: Synthetic polypeptide
DEEEIATTNPVATEQYGSVCAATANDQDDDNN

SEQ ID NO: 70471 - protein, 32 aa, Artificial Sequence
  Description of Artificial Sequence: Synthetic polypeptide
DESEIATTNPVATEQYGSVSTTNHGNTGNGNV

SEQ ID NO: 70472 - protein, 32 aa, Artificial Sequence
  Description of Artificial Sequence: Synthetic polypeptide
DESEIATTNPVATEQYGSVSTTPAGNMRGMNI

SEQ ID NO: 70473 - protein, 31 aa, Artificial Sequence
  Description of Artificial Sequence: Synthetic polypeptide
DEQEIACTNPVATEQYGEVSATDLQREGEDL

SEQ ID NO: 70474 - protein, 34 aa, Artificial Sequence
  Description of Artificial Sequence: Synthetic polypeptide
DEEEIRTTNPVATEQYGSVEPTIGLEQRTGQPED

SEQ ID NO: 70475 - protein, 32 aa, Artificial Sequence
  Description of Artificial Sequence: Synthetic polypeptide
DEEEIRTTNPVATEQYGSVEPPPLDTQIDDPR

SEQ ID NO: 70476 - protein, 33 aa, Artificial Sequence
  Description of Artificial Sequence: Synthetic polypeptide
DEEEIGTTNPVATERYGKTVQSQNLSQNGGQNR

SEQ ID NO: 70477 - protein, 28 aa, Artificial Sequence
  Description of Artificial Sequence: Synthetic peptide
QENEIATTNPVATEQYGVVSECLQSEEL

SEQ ID NO: 70478 - protein, 32 aa, Artificial Sequence
  Description of Artificial Sequence: Synthetic polypeptide
DECEIATTNPVAYEQYGTVSTNLQGDVGNGES

SEQ ID NO: 70479 - protein, 32 aa, Artificial Sequence
  Description of Artificial Sequence: Synthetic polypeptide
DECEIATTNPVAYEQWGSVSTNLQNGEHNDGQ

SEQ ID NO: 70480 - protein, 30 aa, Artificial Sequence
  Description of Artificial Sequence: Synthetic polypeptide
DEQEIATTNPVATEGYGSVSTDLEDHEGEL

SEQ ID NO: 70481 - protein, 31 aa, Artificial Sequence
  Description of Artificial Sequence: Synthetic polypeptide
DEQEIATTNPVATEGYGSVSATTLQSHEGEL

SEQ ID NO: 70482 - protein, 32 aa, Artificial Sequence
  Description of Artificial Sequence: Synthetic polypeptide
QEEGIRTTNPAATEQYGSVSTNGQEGGGEGNG

SEQ ID NO: 70483 - protein, 31 aa, Artificial Sequence
  Description of Artificial Sequence: Synthetic polypeptide
DEQEIATTNPVATEGYGSVSATDLQSHEGEL

SEQ ID NO: 70484 - protein, 33 aa, Artificial Sequence
  Description of Artificial Sequence: Synthetic polypeptide
DECEIATTNPVAYEQWGSVSTTNLGQSGENDER

SEQ ID NO: 70485 - protein, 32 aa, Artificial Sequence
  Description of Artificial Sequence: Synthetic polypeptide
DEEEIRTTNPVATEQYGSVEATILAQETQQVD

SEQ ID NO: 70486 - protein, 32 aa, Artificial Sequence
  Description of Artificial Sequence: Synthetic polypeptide
DEEEIRTTNPVATEQYGSSSTNEHQGSDTDEI

SEQ ID NO: 70487 - protein, 28 aa, Artificial Sequence
  Description of Artificial Sequence: Synthetic peptide
QENEIATTNPVATEQYGEASENLQHEGL

SEQ ID NO: 70488 - protein, 29 aa, Artificial Sequence
  Description of Artificial Sequence: Synthetic peptide
DEQEIATTNPVATEGYGSVATDLEHEGEL

SEQ ID NO: 70489 - protein, 32 aa, Artificial Sequence
  Description of Artificial Sequence: Synthetic polypeptide
DESEIATTNPVATEQWGSVSCINEPQDREGNG

SEQ ID NO: 70490 - protein, 35 aa, Artificial Sequence
  Description of Artificial Sequence: Synthetic polypeptide
AEEEIRTTNPVATEQYGSVSVTNNLGQGNIGTNPT

SEQ ID NO: 70491 - protein, 32 aa, Artificial Sequence
  Description of Artificial Sequence: Synthetic polypeptide
DEEEIRTTNPVATEQYGSVECTDVPLQETMEQ

SEQ ID NO: 70492 - protein, 32 aa, Artificial Sequence
  Description of Artificial Sequence: Synthetic polypeptide
DEQEIATTNPVATECYGSVSTIDLEDREGNDG

SEQ ID NO: 70493 - protein, 31 aa, Artificial Sequence
  Description of Artificial Sequence: Synthetic polypeptide
DECEIATTNPVAYEQWGVVSTNLQGDAGNES

SEQ ID NO: 70494 - protein, 34 aa, Artificial Sequence
  Description of Artificial Sequence: Synthetic polypeptide
DEEEIRTTNPVATEQYGSVSTVNQQLQETEEEQD

SEQ ID NO: 70495 - protein, 35 aa, Artificial Sequence
  Description of Artificial Sequence: Synthetic polypeptide
AEEEIRTTNPVATEQYGSVSVTNNLLQGNNGTNVN

SEQ ID NO: 70496 - protein, 33 aa, Artificial Sequence
  Description of Artificial Sequence: Synthetic polypeptide
DEEEIRTTNPVATEQYGSVEEATQEQRGVVELN

SEQ ID NO: 70497 - protein, 35 aa, Artificial Sequence
  Description of Artificial Sequence: Synthetic polypeptide
AEEEIRTTNPVATEQYGSVSVTNNLLQQGENQNTE

SEQ ID NO: 70498 - protein, 31 aa, Artificial Sequence
  Description of Artificial Sequence: Synthetic polypeptide
DEEEIRTTNPVATEQYGSVEENGVDIGETDN

SEQ ID NO: 70499 - protein, 35 aa, Artificial Sequence
  Description of Artificial Sequence: Synthetic polypeptide
AEEEIRTTNPVATEQYGSVSVTNNLLQQGNGTNVD

SEQ ID NO: 70500 - protein, 35 aa, Artificial Sequence
  Description of Artificial Sequence: Synthetic polypeptide
AEEEIRTTNPVATEQYGSVSVTNNLLQQNGTNNVN

SEQ ID NO: 70501 - protein, 34 aa, Artificial Sequence
  Description of Artificial Sequence: Synthetic polypeptide
DEEEIRTTNPVATEQYGSVSTVNQQLQGTDEEIS

SEQ ID NO: 70502 - protein, 33 aa, Artificial Sequence
  Description of Artificial Sequence: Synthetic polypeptide
DEEEIATTNPVATEQYGSVCAATNDQDLPGPNN

SEQ ID NO: 70503 - protein, 32 aa, Artificial Sequence
  Description of Artificial Sequence: Synthetic polypeptide
DEEEIGTTNPVATEQYGCVSTNDHQEHMGSEL

SEQ ID NO: 70504 - protein, 31 aa, Artificial Sequence
  Description of Artificial Sequence: Synthetic polypeptide
DECEIATTNPVAYEQWGSVSTNLQGEHQNPQ

SEQ ID NO: 70505 - protein, 30 aa, Artificial Sequence
  Description of Artificial Sequence: Synthetic polypeptide
QENEIATTNPVATEQYGDVSTCLQDHEGEL

SEQ ID NO: 70506 - protein, 32 aa, Artificial Sequence
  Description of Artificial Sequence: Synthetic polypeptide
DEQEIATTNPVATEPYGSVCATNLTDRGGNEM

SEQ ID NO: 70507 - protein, 28 aa, Artificial Sequence
  Description of Artificial Sequence: Synthetic peptide
QENEIATTNPVATEQYGDVSEILQHEDL

SEQ ID NO: 70508 - protein, 34 aa, Artificial Sequence
  Description of Artificial Sequence: Synthetic polypeptide
AEEEIRTTNPVATEQYGSVSVTNLQQGVTEQGEQ

SEQ ID NO: 70509 - protein, 33 aa, Artificial Sequence
  Description of Artificial Sequence: Synthetic polypeptide
QEEGIRTTNPVATEQYGSVSTNGLENGLGNEGE

SEQ ID NO: 70510 - protein, 28 aa, Artificial Sequence
  Description of Artificial Sequence: Synthetic peptide
QENEIATTNPVATEQYGDVSEILQHEEA

SEQ ID NO: 70511 - protein, 28 aa, Artificial Sequence
  Description of Artificial Sequence: Synthetic peptide
QENEIATTNPVATEQYGDVSEILQHEEL

SEQ ID NO: 70512 - protein, 31 aa, Artificial Sequence
  Description of Artificial Sequence: Synthetic polypeptide
DECEIATTNPVAYEQWGSVSENLQGDAGNEE

SEQ ID NO: 70513 - protein, 35 aa, Artificial Sequence
  Description of Artificial Sequence: Synthetic polypeptide
AEEEIRTTNPVATEQYGSVSVTNNDLGNQNGTNNQ

SEQ ID NO: 70514 - protein, 32 aa, Artificial Sequence
  Description of Artificial Sequence: Synthetic polypeptide
QEEGIRTTNPVATEQYGSVSTNGLEGGEGGQG

SEQ ID NO: 70515 - protein, 28 aa, Artificial Sequence
  Description of Artificial Sequence: Synthetic peptide
QENEIATTNPVATEQYGDVSEKLQHEEL

SEQ ID NO: 70516 - protein, 31 aa, Artificial Sequence
  Description of Artificial Sequence: Synthetic polypeptide
DESEIATTNPVATEQWGEVSENEPQDRGENG

SEQ ID NO: 70517 - protein, 35 aa, Artificial Sequence
  Description of Artificial Sequence: Synthetic polypeptide
DEEEIRTTNPVATEQYGSVEEPWPNLQERVGVENW

SEQ ID NO: 70518 - protein, 32 aa, Artificial Sequence
  Description of Artificial Sequence: Synthetic polypeptide
DEQEIATTNPVATEIYGVVSTNLQHDDQGGNQ

SEQ ID NO: 70519 - protein, 32 aa, Artificial Sequence
  Description of Artificial Sequence: Synthetic polypeptide
DESEIATTNPVATEQWGSASEINEPQDREGNR

SEQ ID NO: 70520 - protein, 31 aa, Artificial Sequence
  Description of Artificial Sequence: Synthetic polypeptide
DECEIATTNPVAYEQWGSVSTGDGLGRGNAD

SEQ ID NO: 70521 - protein, 30 aa, Artificial Sequence
  Description of Artificial Sequence: Synthetic polypeptide
DESEIATTNPVATEQWGSVPEVEQREGENG

SEQ ID NO: 70522 - protein, 33 aa, Artificial Sequence
  Description of Artificial Sequence: Synthetic polypeptide
DEAEIRTTNPVATEQYGSVSTPNDQIEGSEEHS

SEQ ID NO: 70523 - protein, 32 aa, Artificial Sequence
  Description of Artificial Sequence: Synthetic polypeptide
QEEGIRTTNPVATEQYGSVSTGGLENGGEGNG

SEQ ID NO: 70524 - protein, 31 aa, Artificial Sequence
  Description of Artificial Sequence: Synthetic polypeptide
QEEGIRTTNPVATEQYGSVSTGGGDQNGQQG

SEQ ID NO: 70525 - protein, 28 aa, Artificial Sequence
  Description of Artificial Sequence: Synthetic peptide
QENEIATTNPVATEQYGDVSEVLQHEEK

SEQ ID NO: 70526 - protein, 28 aa, Artificial Sequence
  Description of Artificial Sequence: Synthetic peptide
QENEIATTNPVATEQYGDVSEVLQHEEL

SEQ ID NO: 70527 - protein, 33 aa, Artificial Sequence
  Description of Artificial Sequence: Synthetic polypeptide
DECEIATTNPVAYEQWGSVSTNLNGDAQGGNSR

SEQ ID NO: 70528 - protein, 32 aa, Artificial Sequence
  Description of Artificial Sequence: Synthetic polypeptide
DECEIATTNPVAYEQWGSVSTNLNGEEGNNDR

SEQ ID NO: 70529 - protein, 28 aa, Artificial Sequence
  Description of Artificial Sequence: Synthetic peptide
QENEIATTNPVATEQYGDVSLCLQHEEL

SEQ ID NO: 70530 - protein, 34 aa, Artificial Sequence
  Description of Artificial Sequence: Synthetic polypeptide
DEAEIRTTNPVATEQYGSVSTPNGMQNEGIEDRG

SEQ ID NO: 70531 - protein, 35 aa, Artificial Sequence
  Description of Artificial Sequence: Synthetic polypeptide
AEEEIRTTNPVATEQYGSVSVTNNLNQGNLGINTG

SEQ ID NO: 70532 - protein, 34 aa, Artificial Sequence
  Description of Artificial Sequence: Synthetic polypeptide
DEEEIRTTNPVATEQYGSVEETPNGLGRGEDPQS

SEQ ID NO: 70533 - protein, 28 aa, Artificial Sequence
  Description of Artificial Sequence: Synthetic peptide
QENEIATTNPVATEQYGEVSECLQHEEL

SEQ ID NO: 70534 - protein, 30 aa, Artificial Sequence
  Description of Artificial Sequence: Synthetic polypeptide
QENEIATTNPVATEQYGSVSTDLQDHEEEL

SEQ ID NO: 70535 - protein, 32 aa, Artificial Sequence
  Description of Artificial Sequence: Synthetic polypeptide
DESEIATTNPVATEQWGSVSCINEPQREGENG

SEQ ID NO: 70536 - protein, 33 aa, Artificial Sequence
  Description of Artificial Sequence: Synthetic polypeptide
DESEIATTNPVATEQWGSVSCINLPQDREGENG

SEQ ID NO: 70537 - protein, 35 aa, Artificial Sequence
  Description of Artificial Sequence: Synthetic polypeptide
DEEEIGTTNPVATEQYGSVSPTENQLQERMDNELQ

SEQ ID NO: 70538 - protein, 35 aa, Artificial Sequence
  Description of Artificial Sequence: Synthetic polypeptide
DEEEIGTTNPVATEQYGSVSPTNQLIQERMQNVLE

SEQ ID NO: 70539 - protein, 34 aa, Artificial Sequence
  Description of Artificial Sequence: Synthetic polypeptide
DEEEIGTTNPVATEQYGSVSPTNQLIQPVMQNVL

SEQ ID NO: 70540 - protein, 31 aa, Artificial Sequence
  Description of Artificial Sequence: Synthetic polypeptide
QENEIATTNPVATEQYGSVSTDLQDHEGEDL

SEQ ID NO: 70541 - protein, 35 aa, Artificial Sequence
  Description of Artificial Sequence: Synthetic polypeptide
DEEEIRTTNPVATEQYGSVSTVNVLDPEVGQTGGT

SEQ ID NO: 70542 - protein, 32 aa, Artificial Sequence
  Description of Artificial Sequence: Synthetic polypeptide
DESEIATTNPVATEQWGSVSEINEPQDREGNG

SEQ ID NO: 70543 - protein, 34 aa, Artificial Sequence
  Description of Artificial Sequence: Synthetic polypeptide
DEEEIRTTNPVATEQYGSVELANLQGPRQLEAER

SEQ ID NO: 70544 - protein, 31 aa, Artificial Sequence
  Description of Artificial Sequence: Synthetic polypeptide
DEQEIATTNPVASEQYGSVSTNLEDHEGEDL

SEQ ID NO: 70545 - protein, 32 aa, Artificial Sequence
  Description of Artificial Sequence: Synthetic polypeptide
DECEIATTNPVAYEQYGSVSTTNNGNSGENDR

SEQ ID NO: 70546 - protein, 32 aa, Artificial Sequence
  Description of Artificial Sequence: Synthetic polypeptide
DESEIATTNPVATEQWGSVSEINEPQDRGENG

SEQ ID NO: 70547 - protein, 33 aa, Artificial Sequence
  Description of Artificial Sequence: Synthetic polypeptide
DESEIATTNPVATEQWGSVSTIDLPQDREGENG

SEQ ID NO: 70548 - protein, 28 aa, Artificial Sequence
  Description of Artificial Sequence: Synthetic peptide
QENEIATTNPVATEQYGVVSDCLQSEEL

SEQ ID NO: 70549 - protein, 31 aa, Artificial Sequence
  Description of Artificial Sequence: Synthetic polypeptide
DEEEIRTTNPVATEQYGSVELNIEGTVEERV

SEQ ID NO: 70550 - protein, 32 aa, Artificial Sequence
  Description of Artificial Sequence: Synthetic polypeptide
DESEIATTNPVATEQYGCVSTNLNGDAGGNQG

SEQ ID NO: 70551 - protein, 30 aa, Artificial Sequence
  Description of Artificial Sequence: Synthetic polypeptide
QEEEISTTNPVAWEQYGMCVSTVPLQGMNQ

SEQ ID NO: 70552 - protein, 35 aa, Artificial Sequence
  Description of Artificial Sequence: Synthetic polypeptide
AEEEIRTTNPVATEQYGSVSVTNNLQQGEQQNEEE

SEQ ID NO: 70553 - protein, 32 aa, Artificial Sequence
  Description of Artificial Sequence: Synthetic polypeptide
DESEIATTNPVATEQYGCVSTNLNGEAGGSNG

SEQ ID NO: 70554 - protein, 31 aa, Artificial Sequence
  Description of Artificial Sequence: Synthetic polypeptide
DEQEIATTNPVASEQYGSVSATNLEHEGTDL

SEQ ID NO: 70555 - protein, 33 aa, Artificial Sequence
  Description of Artificial Sequence: Synthetic polypeptide
DEEEIGTTNPVATEQYGYCVDSETPETQQGNPR

SEQ ID NO: 70556 - protein, 33 aa, Artificial Sequence
  Description of Artificial Sequence: Synthetic polypeptide
DEEEIRTTNPVATEQYGSVELPPNHEVRDNDRQ

SEQ ID NO: 70557 - protein, 32 aa, Artificial Sequence
  Description of Artificial Sequence: Synthetic polypeptide
DECEIATTNPVAYEQYGTVSTNLQGDPGNGNA

SEQ ID NO: 70558 - protein, 28 aa, Artificial Sequence
  Description of Artificial Sequence: Synthetic peptide
QENEIATTNPVATEQYGVVSDCLQHEEQ

SEQ ID NO: 70559 - protein, 33 aa, Artificial Sequence
  Description of Artificial Sequence: Synthetic polypeptide
CEEEIRATNPVATEQYGSVSTGNPLGQHDENGT

SEQ ID NO: 70560 - protein, 31 aa, Artificial Sequence
  Description of Artificial Sequence: Synthetic polypeptide
DECEIATTNPVAYEQYGSVSTNPGNDQGNHQ

SEQ ID NO: 70561 - protein, 29 aa, Artificial Sequence
  Description of Artificial Sequence: Synthetic peptide
QEEEIVTTNPVATEQYGTASTGPQFEEND

SEQ ID NO: 70562 - protein, 33 aa, Artificial Sequence
  Description of Artificial Sequence: Synthetic polypeptide
DEEEIRTTNPVATEQYGSVEFSDNQQPVNEMVD

SEQ ID NO: 70563 - protein, 28 aa, Artificial Sequence
  Description of Artificial Sequence: Synthetic peptide
QENEIATTNPVATEQYGEVSECLQHEGL

SEQ ID NO: 70564 - protein, 34 aa, Artificial Sequence
  Description of Artificial Sequence: Synthetic polypeptide
DEEEIRTTNPVATEQYGSVSTVNQQLQQNEEEDE

SEQ ID NO: 70565 - protein, 35 aa, Artificial Sequence
  Description of Artificial Sequence: Synthetic polypeptide
AEEEIRTTNPVATEQYGSVSVTNNLQGNLGINDTG

SEQ ID NO: 70566 - protein, 31 aa, Artificial Sequence
  Description of Artificial Sequence: Synthetic polypeptide
DEQEIATTNPVATECYGSVSCIDLEDREGNG

SEQ ID NO: 70567 - protein, 28 aa, Artificial Sequence
  Description of Artificial Sequence: Synthetic peptide
QENEIATTNPVATEQYGIVSECLQSETL

SEQ ID NO: 70568 - protein, 34 aa, Artificial Sequence
  Description of Artificial Sequence: Synthetic polypeptide
AEEEIRTTNPVATEQYGSVSTVVNNQQGNPNEDE

SEQ ID NO: 70569 - protein, 29 aa, Artificial Sequence
  Description of Artificial Sequence: Synthetic peptide
QENEIATTNPVATEQYGSVSEALQHEMEL

SEQ ID NO: 70570 - protein, 29 aa, Artificial Sequence
  Description of Artificial Sequence: Synthetic peptide
QENEIATTNPVATEQYGSVSEALQHEMEV

SEQ ID NO: 70571 - protein, 31 aa, Artificial Sequence
  Description of Artificial Sequence: Synthetic polypeptide
DEQEIATTNPVATEAYGSVSTNLNGEMNNEQ

SEQ ID NO: 70572 - protein, 32 aa, Artificial Sequence
  Description of Artificial Sequence: Synthetic polypeptide
DEEEIRTTNPVATEQYGSSCSENYDDRLNEDE

SEQ ID NO: 70573 - protein, 32 aa, Artificial Sequence
  Description of Artificial Sequence: Synthetic polypeptide
DESEIATTNPVATEQWGSVSCINEPQDRGENG

SEQ ID NO: 70574 - protein, 34 aa, Artificial Sequence
  Description of Artificial Sequence: Synthetic polypeptide
DEEEIRTTNPVATEQYGSVSTVNQQQQQNDEEED

SEQ ID NO: 70575 - protein, 29 aa, Artificial Sequence
  Description of Artificial Sequence: Synthetic peptide
QENEIATTNPVATEQYGSVSEDLQDHEEL

SEQ ID NO: 70576 - protein, 30 aa, Artificial Sequence
  Description of Artificial Sequence: Synthetic polypeptide
QENEIATTNPVATEQYGSVSEDLQHEGEDL

SEQ ID NO: 70577 - protein, 33 aa, Artificial Sequence
  Description of Artificial Sequence: Synthetic polypeptide
DEAEIRTTNPVATEQYGSVSTNDHQDNSQEDNT

SEQ ID NO: 70578 - protein, 31 aa, Artificial Sequence
  Description of Artificial Sequence: Synthetic polypeptide
QENEIATTNPVATEQYGSVSTCLQDHEGEDL

SEQ ID NO: 70579 - protein, 32 aa, Artificial Sequence
  Description of Artificial Sequence: Synthetic polypeptide
DECEIATTNPVAYEQYGSVSTGNDGGDRGNAD

SEQ ID NO: 70580 - protein, 34 aa, Artificial Sequence
  Description of Artificial Sequence: Synthetic polypeptide
DEEEIRTTNPVATEQYGSVSTVNVDDGEGQNEQT

SEQ ID NO: 70581 - protein, 34 aa, Artificial Sequence
  Description of Artificial Sequence: Synthetic polypeptide
DEEEIRTTNPVATEQYGSVSTVNVDGSGNGQNQD

SEQ ID NO: 70582 - protein, 34 aa, Artificial Sequence
  Description of Artificial Sequence: Synthetic polypeptide
DEEEIGTTNPVATEQYGSVCSTNDPQEGMGSNLS

SEQ ID NO: 70583 - protein, 28 aa, Artificial Sequence
  Description of Artificial Sequence: Synthetic peptide
QEEEVATTNPVATEQYGEAPETCQRGER

SEQ ID NO: 70584 - protein, 32 aa, Artificial Sequence
  Description of Artificial Sequence: Synthetic polypeptide
DECEIATTNPVAYEQYGSVSTGNGDERNGNAD

SEQ ID NO: 70585 - protein, 34 aa, Artificial Sequence
  Description of Artificial Sequence: Synthetic polypeptide
DEEEIRTTNPVATEQYGSVSTVNVGVFGQGNGQD

SEQ ID NO: 70586 - protein, 34 aa, Artificial Sequence
  Description of Artificial Sequence: Synthetic polypeptide
DEEEIGTTNPVATEQYGSVCSTNDHQENMGSNQA

SEQ ID NO: 70587 - protein, 30 aa, Artificial Sequence
  Description of Artificial Sequence: Synthetic polypeptide
DEQEIRTTNPVATEQWGDVSTDLEDHAGEA

SEQ ID NO: 70588 - protein, 29 aa, Artificial Sequence
  Description of Artificial Sequence: Synthetic peptide
DESEIASTNPVATEGYGVVSATDLQHGEI

SEQ ID NO: 70589 - protein, 34 aa, Artificial Sequence
  Description of Artificial Sequence: Synthetic polypeptide
DEEEIRTTNPVATEQYGSVSTVLNNQLQNEDEQE

SEQ ID NO: 70590 - protein, 33 aa, Artificial Sequence
  Description of Artificial Sequence: Synthetic polypeptide
DEEEIRTTNPVATEQYGSVCSVLVDYERNGNDQ

SEQ ID NO: 70591 - protein, 33 aa, Artificial Sequence
  Description of Artificial Sequence: Synthetic polypeptide
DEEEIRTTNPVATEQYGSVCSVNLQAQEMAPLD

SEQ ID NO: 70592 - protein, 33 aa, Artificial Sequence
  Description of Artificial Sequence: Synthetic polypeptide
DEEEIATTNPVATEQYGSVCSTNDQQEADDTRQ

SEQ ID NO: 70593 - protein, 34 aa, Artificial Sequence
  Description of Artificial Sequence: Synthetic polypeptide
DEEEIATTNPVATEQYGSVCSTNDQNEAMDGTRE

SEQ ID NO: 70594 - protein, 32 aa, Artificial Sequence
  Description of Artificial Sequence: Synthetic polypeptide
DEEEIRTTNPVATEQYGSVCSVSGLDTREQDL

SEQ ID NO: 70595 - protein, 33 aa, Artificial Sequence
  Description of Artificial Sequence: Synthetic polypeptide
DEEEIATTNPVATEQYGSVCSTNDEADGRNGDA

SEQ ID NO: 70596 - protein, 33 aa, Artificial Sequence
  Description of Artificial Sequence: Synthetic polypeptide
DEEEIATTNPVATEQYGSVCSTNDADEGQNGDA

SEQ ID NO: 70597 - protein, 28 aa, Artificial Sequence
  Description of Artificial Sequence: Synthetic peptide
QENEIATTNPVATECYGEASECLQRGEL

SEQ ID NO: 70598 - protein, 35 aa, Artificial Sequence
  Description of Artificial Sequence: Synthetic polypeptide
DEEEIRTTNPVATEQYGSVSTTQGQLQQGSTNNTE

SEQ ID NO: 70599 - protein, 33 aa, Artificial Sequence
  Description of Artificial Sequence: Synthetic polypeptide
DEEEIRTTNPVATEQYGSVCSVTEQQVGLEQLV

SEQ ID NO: 70600 - protein, 33 aa, Artificial Sequence
  Description of Artificial Sequence: Synthetic polypeptide
DEEEIATTNPVATEQYGSVCSTDLQPDNQNAQP

SEQ ID NO: 70601 - protein, 32 aa, Artificial Sequence
  Description of Artificial Sequence: Synthetic polypeptide
DEQEIRTTNPVATEQYGSVSATRLEDHEGEDL

SEQ ID NO: 70602 - protein, 28 aa, Artificial Sequence
  Description of Artificial Sequence: Synthetic peptide
CEEEIASVNPVCTEQYGVVSWNLQSNNQ

SEQ ID NO: 70603 - protein, 31 aa, Artificial Sequence
  Description of Artificial Sequence: Synthetic polypeptide
DEQEIATTNPVATEQYGSVSADDLQDHEGEL

SEQ ID NO: 70604 - protein, 32 aa, Artificial Sequence
  Description of Artificial Sequence: Synthetic polypeptide
DEEEIRTTNPVATEQYGSVCSWEELQNNSEQS

SEQ ID NO: 70605 - protein, 33 aa, Artificial Sequence
  Description of Artificial Sequence: Synthetic polypeptide
DEEEIRTTNPVATEQYGSVCSWEHQEGFGSNQM

SEQ ID NO: 70606 - protein, 36 aa, Artificial Sequence
  Description of Artificial Sequence: Synthetic polypeptide
DEEEIRTTNPVATEQYGSVSTTQNLLQGNNQQGNDE

SEQ ID NO: 70607 - protein, 33 aa, Artificial Sequence
  Description of Artificial Sequence: Synthetic polypeptide
DEEEIRTTNPVATEQYGSVCSWEHQEYFGSNQS

SEQ ID NO: 70608 - protein, 32 aa, Artificial Sequence
  Description of Artificial Sequence: Synthetic polypeptide
DEEEIRTTNPVATEQYGSVCSWEHQYFGSEQI

SEQ ID NO: 70609 - protein, 32 aa, Artificial Sequence
  Description of Artificial Sequence: Synthetic polypeptide
DEQEIRTTNPVATEQYGSVSCIDEEDREGENL

SEQ ID NO: 70610 - protein, 34 aa, Artificial Sequence
  Description of Artificial Sequence: Synthetic polypeptide
DEEEIRTTNPVATEQYGSVSTNNEAPQVRSSDQS

SEQ ID NO: 70611 - protein, 36 aa, Artificial Sequence
  Description of Artificial Sequence: Synthetic polypeptide
DEEEIRTTNPVATEQYGSVSTTQNLQAGNQQGTVTE

SEQ ID NO: 70612 - protein, 32 aa, Artificial Sequence
  Description of Artificial Sequence: Synthetic polypeptide
DEQEIRTTNPVATEQYGSVSCIDLEDHEGENL

SEQ ID NO: 70613 - protein, 34 aa, Artificial Sequence
  Description of Artificial Sequence: Synthetic polypeptide
DEEEIRTTNPVATEQYGSVCSVDNNLEQRPEEII

SEQ ID NO: 70614 - protein, 28 aa, Artificial Sequence
  Description of Artificial Sequence: Synthetic peptide
CEEEIASVNPVCTETYGVVSDNLQSGNE

SEQ ID NO: 70615 - protein, 32 aa, Artificial Sequence
  Description of Artificial Sequence: Synthetic polypeptide
DEQEIRTTNPVATEQYGSVSATDLNDHEGEDV

SEQ ID NO: 70616 - protein, 33 aa, Artificial Sequence
  Description of Artificial Sequence: Synthetic polypeptide
DEEEIRTTNPVATEQYGSVSTNNIEHHENVNEG

SEQ ID NO: 70617 - protein, 35 aa, Artificial Sequence
  Description of Artificial Sequence: Synthetic polypeptide
DEEEIATTNPVATEQYGSVCSTNPLQEDAGEGANE

SEQ ID NO: 70618 - protein, 34 aa, Artificial Sequence
  Description of Artificial Sequence: Synthetic polypeptide
DEEEIATTNPVATEQYGSVCSTNPLQDAQAEGDP

SEQ ID NO: 70619 - protein, 32 aa, Artificial Sequence
  Description of Artificial Sequence: Synthetic polypeptide
DEQEIRTTNPVATEQYGSVSATDLEDHEGEDG

SEQ ID NO: 70620 - protein, 32 aa, Artificial Sequence
  Description of Artificial Sequence: Synthetic polypeptide
DEQEIRTTNPVATEQYGSVSATDLEDHEGEDL

SEQ ID NO: 70621 - protein, 32 aa, Artificial Sequence
  Description of Artificial Sequence: Synthetic polypeptide
DEQEIRTTNPVATEQYGSVSATDLEDHEGEDV

SEQ ID NO: 70622 - protein, 33 aa, Artificial Sequence
  Description of Artificial Sequence: Synthetic polypeptide
DEEEIATTNPVATEQYGSVCSTNPLNDGEEGAP

SEQ ID NO: 70623 - protein, 32 aa, Artificial Sequence
  Description of Artificial Sequence: Synthetic polypeptide
DEQEIRTTNPVATEQYGSVSATDLEDHEGEPL

SEQ ID NO: 70624 - protein, 33 aa, Artificial Sequence
  Description of Artificial Sequence: Synthetic polypeptide
DEEEIRTTNPVATEQYGSVCSTYLEVMVENLSM

SEQ ID NO: 70625 - protein, 32 aa, Artificial Sequence
  Description of Artificial Sequence: Synthetic polypeptide
DEEEICTTNPVATEQYGCVSTGDQNGHGGNES

SEQ ID NO: 70626 - protein, 31 aa, Artificial Sequence
  Description of Artificial Sequence: Synthetic polypeptide
DEQEIATTNPVATEQYGSVSAENLMHEGEDL

SEQ ID NO: 70627 - protein, 32 aa, Artificial Sequence
  Description of Artificial Sequence: Synthetic polypeptide
DEQEIRTTNPVATEQYGSVSATDLEDHEGSDL

SEQ ID NO: 70628 - protein, 33 aa, Artificial Sequence
  Description of Artificial Sequence: Synthetic polypeptide
DEEEIRTTNPVATEQYGSVCSWENHQNFNSQQS

SEQ ID NO: 70629 - protein, 33 aa, Artificial Sequence
  Description of Artificial Sequence: Synthetic polypeptide
DEEEICTTNPVATEQYGEVSTGGEQGGHGNGER

SEQ ID NO: 70630 - protein, 34 aa, Artificial Sequence
  Description of Artificial Sequence: Synthetic polypeptide
DEEEIRTTNPVATEQYGSVSTTPDGNMRNGMNPV

SEQ ID NO: 70631 - protein, 31 aa, Artificial Sequence
  Description of Artificial Sequence: Synthetic polypeptide
DEQEIATTNPVATEQYGSVSAEDLQDHGEDL

SEQ ID NO: 70632 - protein, 32 aa, Artificial Sequence
  Description of Artificial Sequence: Synthetic polypeptide
DEQEIRTTNPVATEQYGSVSATDLEWHEGEDL

SEQ ID NO: 70633 - protein, 34 aa, Artificial Sequence
  Description of Artificial Sequence: Synthetic polypeptide
DEEEIRTTNPVATEQYGSVSTTPLQVPRQMQEQN

SEQ ID NO: 70634 - protein, 30 aa, Artificial Sequence
  Description of Artificial Sequence: Synthetic polypeptide
DEQEIATTNPVATEQYGSVSAEDLEHEGEL

SEQ ID NO: 70635 - protein, 32 aa, Artificial Sequence
  Description of Artificial Sequence: Synthetic polypeptide
DEQEIATTNPVATEQYGSVSAEDLEDREGGDR

SEQ ID NO: 70636 - protein, 33 aa, Artificial Sequence
  Description of Artificial Sequence: Synthetic polypeptide
DEEEICTTNPVATEQYGEVSTGNGNQQNGENMT

SEQ ID NO: 70637 - protein, 33 aa, Artificial Sequence
  Description of Artificial Sequence: Synthetic polypeptide
DEEEICTTNPVATEQYGEVSTGNNLGEGDGNTA

SEQ ID NO: 70638 - protein, 32 aa, Artificial Sequence
  Description of Artificial Sequence: Synthetic polypeptide
DEQEIRTTNPVATEQYGSVSATDLGDHEGEDL

SEQ ID NO: 70639 - protein, 33 aa, Artificial Sequence
  Description of Artificial Sequence: Synthetic polypeptide
DEEEICTTNPVATEQYGEVSTGPGNQQQGNGMT

SEQ ID NO: 70640 - protein, 34 aa, Artificial Sequence
  Description of Artificial Sequence: Synthetic polypeptide
DEEEIRTTNPVATEQYGSVCSTYVLQETADGSQQ

SEQ ID NO: 70641 - protein, 33 aa, Artificial Sequence
  Description of Artificial Sequence: Synthetic polypeptide
DEEEIRTTNPVATEQYGSVSTTPDGNDRNGEDV

SEQ ID NO: 70642 - protein, 35 aa, Artificial Sequence
  Description of Artificial Sequence: Synthetic polypeptide
DEEEIATTNPVATEQYGSVCSTNPLQEDAGENTGE

SEQ ID NO: 70643 - protein, 28 aa, Artificial Sequence
  Description of Artificial Sequence: Synthetic peptide
QENEIATTNPVATECYGEVSECLQHEER

SEQ ID NO: 70644 - protein, 32 aa, Artificial Sequence
  Description of Artificial Sequence: Synthetic polypeptide
DEEEIRTTNPVATEQYGSVCSWGEDQNFNSNQ

SEQ ID NO: 70645 - protein, 33 aa, Artificial Sequence
  Description of Artificial Sequence: Synthetic polypeptide
DEQEIRTTNPVATEQYGSVSSTTAGNMHEGNDL

SEQ ID NO: 70646 - protein, 33 aa, Artificial Sequence
  Description of Artificial Sequence: Synthetic polypeptide
DEQEIRTTNPVATEQYGSVSSTTALEDHEGNDL

SEQ ID NO: 70647 - protein, 33 aa, Artificial Sequence
  Description of Artificial Sequence: Synthetic polypeptide
DEQEIRTTNPVATEQYGSVSSTTALEMHEGNDL

SEQ ID NO: 70648 - protein, 32 aa, Artificial Sequence
  Description of Artificial Sequence: Synthetic polypeptide
DEEEIRTTNPVATEQYGSVSTNMPEHASDDEE

SEQ ID NO: 70649 - protein, 28 aa, Artificial Sequence
  Description of Artificial Sequence: Synthetic peptide
CEEEIASVNPDCTEQYGVVSDNLQSGNQ

SEQ ID NO: 70650 - protein, 31 aa, Artificial Sequence
  Description of Artificial Sequence: Synthetic polypeptide
DEQEIATTNPVATEQYGSVSACDLQDHGEDL

SEQ ID NO: 70651 - protein, 32 aa, Artificial Sequence
  Description of Artificial Sequence: Synthetic polypeptide
DEQEIRTTNPVATEQYGSVSTDINQEGSDEEC

SEQ ID NO: 70652 - protein, 34 aa, Artificial Sequence
  Description of Artificial Sequence: Synthetic polypeptide
DEEEIRTTNPVATEQYGSVSTTQQLLQGNQEQNQ

SEQ ID NO: 70653 - protein, 31 aa, Artificial Sequence
  Description of Artificial Sequence: Synthetic polypeptide
DEQEIRTTNPVATEQYGSVSTIEENAEEDDA

SEQ ID NO: 70654 - protein, 31 aa, Artificial Sequence
  Description of Artificial Sequence: Synthetic polypeptide
DEQEIRTTNPVATEQYGSVSTILEDAEEEDA

SEQ ID NO: 70655 - protein, 32 aa, Artificial Sequence
  Description of Artificial Sequence: Synthetic polypeptide
DEQEIATTNPVATEQYGSVSACDLEDREGNDG

SEQ ID NO: 70656 - protein, 34 aa, Artificial Sequence
  Description of Artificial Sequence: Synthetic polypeptide
DEEEICTTNPVATEQYGSVSTGGLNQGGHGDNEE

SEQ ID NO: 70657 - protein, 32 aa, Artificial Sequence
  Description of Artificial Sequence: Synthetic polypeptide
DEQEIRTTNPVATEQYGSVSTLNNNFNENNDQ

SEQ ID NO: 70658 - protein, 33 aa, Artificial Sequence
  Description of Artificial Sequence: Synthetic polypeptide
DEQEIRTTNPVATEQYGSVSTNDNLEFPGEDQN

SEQ ID NO: 70659 - protein, 33 aa, Artificial Sequence
  Description of Artificial Sequence: Synthetic polypeptide
DEQEIRTTNPVATEQYGSVSTNLEVSSMFNLVM

SEQ ID NO: 70660 - protein, 28 aa, Artificial Sequence
  Description of Artificial Sequence: Synthetic peptide
QEGEIAPTNPCSSEQYGIVSTNLQSGTR

SEQ ID NO: 70661 - protein, 34 aa, Artificial Sequence
  Description of Artificial Sequence: Synthetic polypeptide
DEQEIRTTNPVATEQYGSVSTTNLEQNLVNSDSD

SEQ ID NO: 70662 - protein, 34 aa, Artificial Sequence
  Description of Artificial Sequence: Synthetic polypeptide
DEEEIRTTNPVATEQYGSVCTLSNLQAVGDLVLD

SEQ ID NO: 70663 - protein, 34 aa, Artificial Sequence
  Description of Artificial Sequence: Synthetic polypeptide
DEEEICTTNPVATEQYGSVSTGGLPQGNHGENGQ

SEQ ID NO: 70664 - protein, 33 aa, Artificial Sequence
  Description of Artificial Sequence: Synthetic polypeptide
DEQEIRTTNPVATEQYGSVSVDNNQEEGSENGK

SEQ ID NO: 70665 - protein, 33 aa, Artificial Sequence
  Description of Artificial Sequence: Synthetic polypeptide
DEQEIRTTNPVATEQYGSVSVMALAQEGVQNEF

SEQ ID NO: 70666 - protein, 33 aa, Artificial Sequence
  Description of Artificial Sequence: Synthetic polypeptide
DEEEIATTNPVATEQYGSVCATPNLQNQGDQGM

SEQ ID NO: 70667 - protein, 31 aa, Artificial Sequence
  Description of Artificial Sequence: Synthetic polypeptide
DEEEIATTNPVATEQYGSVCATPLQADEDDQ

SEQ ID NO: 70668 - protein, 33 aa, Artificial Sequence
  Description of Artificial Sequence: Synthetic polypeptide
DEEEIATTNPVATEQYGSVCSANAEGQDHDNDR

SEQ ID NO: 70669 - protein, 33 aa, Artificial Sequence
  Description of Artificial Sequence: Synthetic polypeptide
DEEEIATTNPVATEQYGSVCSANNPAQEHGNDQ

SEQ ID NO: 70670 - protein, 33 aa, Artificial Sequence
  Description of Artificial Sequence: Synthetic polypeptide
DEEEIATTNPVATEQYGSVCSAPNLNIEHGNDQ

SEQ ID NO: 70671 - protein, 33 aa, Artificial Sequence
  Description of Artificial Sequence: Synthetic polypeptide
DEQEIRTTNPVATEQYGSVSPWNLEEDNIGDND

SEQ ID NO: 70672 - protein, 33 aa, Artificial Sequence
  Description of Artificial Sequence: Synthetic polypeptide
DEEEIRTTNPVATEQYGSVCSWGEHQFFGSNQY

SEQ ID NO: 70673 - protein, 31 aa, Artificial Sequence
  Description of Artificial Sequence: Synthetic polypeptide
DEQEIATTNPVATEQYGSVSADDLEDHGNDL

SEQ ID NO: 70674 - protein, 29 aa, Artificial Sequence
  Description of Artificial Sequence: Synthetic peptide
CEEEIASVNPVCTEQYGVVSSNLQSGNQM

SEQ ID NO: 70675 - protein, 32 aa, Artificial Sequence
  Description of Artificial Sequence: Synthetic polypeptide
DEQEIRTTNPVATEQYGSVSEVNNTSEDGNQD

SEQ ID NO: 70676 - protein, 33 aa, Artificial Sequence
  Description of Artificial Sequence: Synthetic polypeptide
DEEEIRTTNPVATEQYGSVCSWGELQNFGSEQA

SEQ ID NO: 70677 - protein, 28 aa, Artificial Sequence
  Description of Artificial Sequence: Synthetic peptide
QENEIATTNPVATECYGEVSECLQREGL

SEQ ID NO: 70678 - protein, 33 aa, Artificial Sequence
  Description of Artificial Sequence: Synthetic polypeptide
DEEEIRTTNPVATEQYGSVCSWGNHQNFNSNQN

SEQ ID NO: 70679 - protein, 32 aa, Artificial Sequence
  Description of Artificial Sequence: Synthetic polypeptide
DEQEIATTNPVATEQYGSVSACIDLEDREGNG

SEQ ID NO: 70680 - protein, 34 aa, Artificial Sequence
  Description of Artificial Sequence: Synthetic polypeptide
DEQEIRTTNPVATEQYGSVSLTNLEVTEGVNLEA

SEQ ID NO: 70681 - protein, 28 aa, Artificial Sequence
  Description of Artificial Sequence: Synthetic peptide
QEGEIAPTNPCSSEQYGTVSTNLEFGNR

SEQ ID NO: 70682 - protein, 28 aa, Artificial Sequence
  Description of Artificial Sequence: Synthetic peptide
CEEEIASVNPVCTEQYGVVSDNLQSENQ

SEQ ID NO: 70683 - protein, 34 aa, Artificial Sequence
  Description of Artificial Sequence: Synthetic polypeptide
DEEEIRTTNPVATEQYGSVCSWENLQENFNSNQS

SEQ ID NO: 70684 - protein, 28 aa, Artificial Sequence
  Description of Artificial Sequence: Synthetic peptide
CEEEIASVNPVCTEQYGVVSDNLQGGPQ

SEQ ID NO: 70685 - protein, 31 aa, Artificial Sequence
  Description of Artificial Sequence: Synthetic polypeptide
DEQEIRTTNPVATEQYGSVSPDLENIENSQG

SEQ ID NO: 70686 - protein, 28 aa, Artificial Sequence
  Description of Artificial Sequence: Synthetic peptide
CEEEIASVNPVCTEQYGVVSDNLLSGNQ

SEQ ID NO: 70687 - protein, 32 aa, Artificial Sequence
  Description of Artificial Sequence: Synthetic polypeptide
DEQEIRTTNPVATEQYGSVSPTNDEQESQEQN

SEQ ID NO: 70688 - protein, 29 aa, Artificial Sequence
  Description of Artificial Sequence: Synthetic peptide
CEEEIASVNPVCTEQYGVVSCNLQSMGNQ

SEQ ID NO: 70689 - protein, 32 aa, Artificial Sequence
  Description of Artificial Sequence: Synthetic polypeptide
DEEEICTTNPVATEQYGSVQTTNHNRSIVTRT

SEQ ID NO: 70690 - protein, 31 aa, Artificial Sequence
  Description of Artificial Sequence: Synthetic polypeptide
DEEEIATTNPVATEQYGSVCSMNNDDSENDE

SEQ ID NO: 70691 - protein, 34 aa, Artificial Sequence
  Description of Artificial Sequence: Synthetic polypeptide
DEQEIRTTNPVATEQYGSVSPTNLDFRGVEEEHQ

SEQ ID NO: 70692 - protein, 31 aa, Artificial Sequence
  Description of Artificial Sequence: Synthetic polypeptide
DEEEIATTNPVATEQYGSVCSMNNDDSDEND

SEQ ID NO: 70693 - protein, 28 aa, Artificial Sequence
  Description of Artificial Sequence: Synthetic peptide
QEGEIAPTNPCSSEQYGSVSCNLQSGTR

SEQ ID NO: 70694 - protein, 34 aa, Artificial Sequence
  Description of Artificial Sequence: Synthetic polypeptide
AEEEIRTTNPVATEQYGSVSVSTNDNQQQGTNLG

SEQ ID NO: 70695 - protein, 34 aa, Artificial Sequence
  Description of Artificial Sequence: Synthetic polypeptide
DEEEIATTNPVATEQYGSVCSKTNDDNQQRNGEK

SEQ ID NO: 70696 - protein, 33 aa, Artificial Sequence
  Description of Artificial Sequence: Synthetic polypeptide
DEEEICTTNPVATEQYGSVQPCTNDSQVTSGNS

SEQ ID NO: 70697 - protein, 35 aa, Artificial Sequence
  Description of Artificial Sequence: Synthetic polypeptide
DEEEIATTNPVATEQYGSVCSTNPLQEDAGEPDRE

SEQ ID NO: 70698 - protein, 33 aa, Artificial Sequence
  Description of Artificial Sequence: Synthetic polypeptide
DEEEIATTNPVATEQYGSVCSTNPLQQDALEDP

SEQ ID NO: 70699 - protein, 35 aa, Artificial Sequence
  Description of Artificial Sequence: Synthetic polypeptide
DEEEIRTTNPVATEQYGSVSTTPAIPNMQNGMNPV

SEQ ID NO: 70700 - protein, 33 aa, Artificial Sequence
  Description of Artificial Sequence: Synthetic polypeptide
DEEEIRTTNPVATEQYGSVSTTNVINVTGEELD

SEQ ID NO: 70701 - protein, 31 aa, Artificial Sequence
  Description of Artificial Sequence: Synthetic polypeptide
DEQEIRTTNPVATEQYGDVSATDLENHEGDA

SEQ ID NO: 70702 - protein, 31 aa, Artificial Sequence
  Description of Artificial Sequence: Synthetic polypeptide
DEQEIRTTNPVATEQYGDVSATDLENHEGDL

SEQ ID NO: 70703 - protein, 31 aa, Artificial Sequence
  Description of Artificial Sequence: Synthetic polypeptide
DEQEIRTTNPVATEQYGDVSATDLENHEGEL

SEQ ID NO: 70704 - protein, 34 aa, Artificial Sequence
  Description of Artificial Sequence: Synthetic polypeptide
DEEEIRTTNPVATEQYGSVSTTNVLQEVIMELDS

SEQ ID NO: 70705 - protein, 28 aa, Artificial Sequence
  Description of Artificial Sequence: Synthetic peptide
QENEIATTNPVATECYGDVSTCLQAEEL

SEQ ID NO: 70706 - protein, 33 aa, Artificial Sequence
  Description of Artificial Sequence: Synthetic polypeptide
DEEEIATTNPVATEQYGSVCTNLEEAEGGDNAE

SEQ ID NO: 70707 - protein, 31 aa, Artificial Sequence
  Description of Artificial Sequence: Synthetic polypeptide
DEQEIATTNPVATEQYGSVSAEVLQHEGEDL

SEQ ID NO: 70708 - protein, 28 aa, Artificial Sequence
  Description of Artificial Sequence: Synthetic peptide
QENEIATTNPVATECYGDVSTCLQHEEL

SEQ ID NO: 70709 - protein, 35 aa, Artificial Sequence
  Description of Artificial Sequence: Synthetic polypeptide
DEEEIRTTNPVATEQYGSVSTTPAEPQMRNGMNPV

SEQ ID NO: 70710 - protein, 34 aa, Artificial Sequence
  Description of Artificial Sequence: Synthetic polypeptide
DEEEIRTTNPVATEQYGSVSTTPAGMMRNGMNPV

SEQ ID NO: 70711 - protein, 28 aa, Artificial Sequence
  Description of Artificial Sequence: Synthetic peptide
QEGEIAPTNPCSTEQYGVVSDNLQSGTR

SEQ ID NO: 70712 - protein, 34 aa, Artificial Sequence
  Description of Artificial Sequence: Synthetic polypeptide
DEEEIRTTNPVATEQYGSVCSTTDAGPNMRNGNV

SEQ ID NO: 70713 - protein, 34 aa, Artificial Sequence
  Description of Artificial Sequence: Synthetic polypeptide
DEEEIRTTNPVATEQYGSVCSTTDAGVNREGMND

SEQ ID NO: 70714 - protein, 28 aa, Artificial Sequence
  Description of Artificial Sequence: Synthetic peptide
QEGEIAPTNPCSTEQYGVVSDNLQSGNQ

SEQ ID NO: 70715 - protein, 34 aa, Artificial Sequence
  Description of Artificial Sequence: Synthetic polypeptide
DEEEICTTNPVATEHYGSVSTGNGLQQNDHGNGN

SEQ ID NO: 70716 - protein, 32 aa, Artificial Sequence
  Description of Artificial Sequence: Synthetic polypeptide
DEQEIRTTNPVATEQYGSCSTNTSQQHEGETK

SEQ ID NO: 70717 - protein, 33 aa, Artificial Sequence
  Description of Artificial Sequence: Synthetic polypeptide
DEEEIRTTNPVATEQYGSVCSTTDGPVNFNGND

SEQ ID NO: 70718 - protein, 33 aa, Artificial Sequence
  Description of Artificial Sequence: Synthetic polypeptide
DEEEIRTTNPVATEQYGSVCSTTDGPVNFNGNV

SEQ ID NO: 70719 - protein, 28 aa, Artificial Sequence
  Description of Artificial Sequence: Synthetic peptide
QEGEIAPTNPCSTEQYGVVSCNLQSGTR

SEQ ID NO: 70720 - protein, 32 aa, Artificial Sequence
  Description of Artificial Sequence: Synthetic polypeptide
DEQEIRTTNPVATEQYGSISATDIEQHNGNDH

SEQ ID NO: 70721 - protein, 28 aa, Artificial Sequence
  Description of Artificial Sequence: Synthetic peptide
QEGEIAPTNPCSTEQYGVVSCNLQSGNQ

SEQ ID NO: 70722 - protein, 35 aa, Artificial Sequence
  Description of Artificial Sequence: Synthetic polypeptide
AEEEIRTTNPVATEQYGSVSVNTNNLQAGNGTNNV

SEQ ID NO: 70723 - protein, 31 aa, Artificial Sequence
  Description of Artificial Sequence: Synthetic polypeptide
DEQEIRTTNPVATEQYGDVSATDLENHAGDA

SEQ ID NO: 70724 - protein, 32 aa, Artificial Sequence
  Description of Artificial Sequence: Synthetic polypeptide
DEQEIRTTNPVATEQYGCVSTNLLLEDIENSQ

SEQ ID NO: 70725 - protein, 34 aa, Artificial Sequence
  Description of Artificial Sequence: Synthetic polypeptide
DEEEIRTTNPVATEQYGSVSTTNTQNQETDETIR

SEQ ID NO: 70726 - protein, 31 aa, Artificial Sequence
  Description of Artificial Sequence: Synthetic polypeptide
DEQEIRTTNPVATEQYGCVSTNGNQAPVFPT

SEQ ID NO: 70727 - protein, 35 aa, Artificial Sequence
  Description of Artificial Sequence: Synthetic polypeptide
DEEEIRTTNPVATEQYGSVSTTNTDNQERLINVNE

SEQ ID NO: 70728 - protein, 34 aa, Artificial Sequence
  Description of Artificial Sequence: Synthetic polypeptide
DEEEIRTTNPVATEQYGSVSTTNTDNQETLLNNE

SEQ ID NO: 70729 - protein, 36 aa, Artificial Sequence
  Description of Artificial Sequence: Synthetic polypeptide
DEEEIRTTNPVATEQYGSVSTTNTLVTTRVGQNAEQ

SEQ ID NO: 70730 - protein, 31 aa, Artificial Sequence
  Description of Artificial Sequence: Synthetic polypeptide
DEEEIATTNPVATEQYGSVSATDCEHEGEDL

SEQ ID NO: 70731 - protein, 30 aa, Artificial Sequence
  Description of Artificial Sequence: Synthetic polypeptide
DEQEIRTTNPVATEQWGDVSTDLEDHAGEL

SEQ ID NO: 70732 - protein, 32 aa, Artificial Sequence
  Description of Artificial Sequence: Synthetic polypeptide
DEEEIATTNPVATEQYGSVSATAGNDREGEPL

SEQ ID NO: 70733 - protein, 30 aa, Artificial Sequence
  Description of Artificial Sequence: Synthetic polypeptide
DEQEIRTTNPVATEQWGDVSTDLMDAAGEA

SEQ ID NO: 70734 - protein, 30 aa, Artificial Sequence
  Description of Artificial Sequence: Synthetic polypeptide
DEQEIRTTNPVATEQWGDVSTDLMDHAGEA

SEQ ID NO: 70735 - protein, 32 aa, Artificial Sequence
  Description of Artificial Sequence: Synthetic polypeptide
DEQEIRTTNPVATEQWGSVSCIDEQDREGENL

SEQ ID NO: 70736 - protein, 33 aa, Artificial Sequence
  Description of Artificial Sequence: Synthetic polypeptide
DEQEIRTTNPVATEQWGSVSCINEPQDREGENG

SEQ ID NO: 70737 - protein, 34 aa, Artificial Sequence
  Description of Artificial Sequence: Synthetic polypeptide
DEEEIATTNPVATEQYGSVSAGNLDQDRPGGEQP

SEQ ID NO: 70738 - protein, 30 aa, Artificial Sequence
  Description of Artificial Sequence: Synthetic polypeptide
DEQEIATTNPVATEQYGSVSAEVCQHEGEL

SEQ ID NO: 70739 - protein, 32 aa, Artificial Sequence
  Description of Artificial Sequence: Synthetic polypeptide
DEEEIATTNPVATEQYGSVSAEDLEDREGEDL

SEQ ID NO: 70740 - protein, 31 aa, Artificial Sequence
  Description of Artificial Sequence: Synthetic polypeptide
DEEEIATTNPVATEQYGSVSADDLEDSGEDL

SEQ ID NO: 70741 - protein, 31 aa, Artificial Sequence
  Description of Artificial Sequence: Synthetic polypeptide
DEEEIATTNPVATEQYGSVPTVLEDHEGEDL

SEQ ID NO: 70742 - protein, 30 aa, Artificial Sequence
  Description of Artificial Sequence: Synthetic polypeptide
DEEEIATTNPVATEQYGSVPTVLEDHEEEL

SEQ ID NO: 70743 - protein, 31 aa, Artificial Sequence
  Description of Artificial Sequence: Synthetic polypeptide
DEEEIATTNPVATEQYGSVPTDLEDHEGEDL

SEQ ID NO: 70744 - protein, 29 aa, Artificial Sequence
  Description of Artificial Sequence: Synthetic peptide
DEEEIATTNPVATEQYGSVPEVCQHEEEK

SEQ ID NO: 70745 - protein, 29 aa, Artificial Sequence
  Description of Artificial Sequence: Synthetic peptide
DEEEIATTNPVATEQYGSVPEDCQHEEEL

SEQ ID NO: 70746 - protein, 29 aa, Artificial Sequence
  Description of Artificial Sequence: Synthetic peptide
DEEEIATTNPVATEQYGSVPEDCQHEEEK

SEQ ID NO: 70747 - protein, 31 aa, Artificial Sequence
  Description of Artificial Sequence: Synthetic polypeptide
DEQEIRTTNPVATEQYGCVSANESQEGEDEG

SEQ ID NO: 70748 - protein, 33 aa, Artificial Sequence
  Description of Artificial Sequence: Synthetic polypeptide
DEEEIRTTNPVATEQYGSVCSTPHQENSGSDQP

SEQ ID NO: 70749 - protein, 31 aa, Artificial Sequence
  Description of Artificial Sequence: Synthetic polypeptide
DEQEIRTTNPVATEQYGCVSDANLQEQFEIQ

SEQ ID NO: 70750 - protein, 33 aa, Artificial Sequence
  Description of Artificial Sequence: Synthetic polypeptide
DEEEIATTNPVATEQYGSVPCWDNHGGQRGKNE

SEQ ID NO: 70751 - protein, 34 aa, Artificial Sequence
  Description of Artificial Sequence: Synthetic polypeptide
DEEEIRTTNPVATEQYGSVSTTNTNQLNMEVNEF

SEQ ID NO: 70752 - protein, 34 aa, Artificial Sequence
  Description of Artificial Sequence: Synthetic polypeptide
DEEEIRTTNPVATEQYGSVACTLNTDREGENNDQ

SEQ ID NO: 70753 - protein, 34 aa, Artificial Sequence
  Description of Artificial Sequence: Synthetic polypeptide
DEEEIRTTNPVATEQYGSVSTTPAGNMRNGMNPV

SEQ ID NO: 70754 - protein, 35 aa, Artificial Sequence
  Description of Artificial Sequence: Synthetic polypeptide
DEEEIRTTNPVATEQYGSVSTTPAGPLMRNGMNPV

SEQ ID NO: 70755 - protein, 32 aa, Artificial Sequence
  Description of Artificial Sequence: Synthetic polypeptide
DEQEIRTTNPVATEQYGSVSACNLEDHEGEEG

SEQ ID NO: 70756 - protein, 35 aa, Artificial Sequence
  Description of Artificial Sequence: Synthetic polypeptide
DEEEIRTTNPVATEQYGSVSTTPAGPNMRNGMNPR

SEQ ID NO: 70757 - protein, 34 aa, Artificial Sequence
  Description of Artificial Sequence: Synthetic polypeptide
DEEEIRTTNPVATEQYGSVCSTTPAGPNMRNGNV

SEQ ID NO: 70758 - protein, 32 aa, Artificial Sequence
  Description of Artificial Sequence: Synthetic polypeptide
DEQEIRTTNPVATEQYGSVSAEDLEDHEGNDL

SEQ ID NO: 70759 - protein, 28 aa, Artificial Sequence
  Description of Artificial Sequence: Synthetic peptide
QEGEIAPTNPCSTEQYGIVACNLQRGTR

SEQ ID NO: 70760 - protein, 29 aa, Artificial Sequence
  Description of Artificial Sequence: Synthetic peptide
CEEEIASVNPVGTEQYGVVSDNLQSGNSL

SEQ ID NO: 70761 - protein, 29 aa, Artificial Sequence
  Description of Artificial Sequence: Synthetic peptide
CEEEIASVNPVGTEQYGVVSDNLQSGNMT

SEQ ID NO: 70762 - protein, 32 aa, Artificial Sequence
  Description of Artificial Sequence: Synthetic polypeptide
DEQEIRTTNPVATEQYGSVSATDEQDHEGEDG

SEQ ID NO: 70763 - protein, 32 aa, Artificial Sequence
  Description of Artificial Sequence: Synthetic polypeptide
DEQEIRTTNPVATEQYGSVSATDEQDHEGEDL

SEQ ID NO: 70764 - protein, 34 aa, Artificial Sequence
  Description of Artificial Sequence: Synthetic polypeptide
DEEEIRTTNPVATEQYGSVSTTPAGPNMRNGMNV

SEQ ID NO: 70765 - protein, 34 aa, Artificial Sequence
  Description of Artificial Sequence: Synthetic polypeptide
DEEEIRTTNPVATEQYGSVSTNNLGQLIPFVDQG

SEQ ID NO: 70766 - protein, 33 aa, Artificial Sequence
  Description of Artificial Sequence: Synthetic polypeptide
DEQEIRTTNPVATEQYGSVSACINLEDHEGENG

SEQ ID NO: 70767 - protein, 32 aa, Artificial Sequence
  Description of Artificial Sequence: Synthetic polypeptide
AEEEIRTTNPVATEQYGSVSVSNNNDEVGTNQ

SEQ ID NO: 70768 - protein, 34 aa, Artificial Sequence
  Description of Artificial Sequence: Synthetic polypeptide
DEEEIRTTNPVATEQYGSVSTTPAGPNMRNGNPV

SEQ ID NO: 70769 - protein, 32 aa, Artificial Sequence
  Description of Artificial Sequence: Synthetic polypeptide
DEQEIRTTNPVATEQYGSVSATDGEDREGEPL

SEQ ID NO: 70770 - protein, 32 aa, Artificial Sequence
  Description of Artificial Sequence: Synthetic polypeptide
DEQEIRTTNPVATEQYGSVSATDGEMREGEDV

SEQ ID NO: 70771 - protein, 33 aa, Artificial Sequence
  Description of Artificial Sequence: Synthetic polypeptide
DEEEIRTTNPVATEQYGSVSTTPAGPNMSGMNV

SEQ ID NO: 70772 - protein, 34 aa, Artificial Sequence
  Description of Artificial Sequence: Synthetic polypeptide
DEEEIRTTNPVATEQYGSVSTNNLEVRSVPIMDI

SEQ ID NO: 70773 - protein, 34 aa, Artificial Sequence
  Description of Artificial Sequence: Synthetic polypeptide
DEEEIRTTNPVATEQYGSVSTTPAGPNRNGMNPL

SEQ ID NO: 70774 - protein, 33 aa, Artificial Sequence
  Description of Artificial Sequence: Synthetic polypeptide
DEEEIATTNPVATEQYGSVCSTNQQDAGEGMDD

SEQ ID NO: 70775 - protein, 32 aa, Artificial Sequence
  Description of Artificial Sequence: Synthetic polypeptide
DEQEIRTTNPVATEQYGSVSATDLEAHEGEDL

SEQ ID NO: 70776 - protein, 32 aa, Artificial Sequence
  Description of Artificial Sequence: Synthetic polypeptide
DEQEIRTTNPVATEQYGSVSATDLEDGEGEDL

SEQ ID NO: 70777 - protein, 28 aa, Artificial Sequence
  Description of Artificial Sequence: Synthetic peptide
QEGEIAPTNPCSTEQYGDVSCNLQHGER

SEQ ID NO: 70778 - protein, 32 aa, Artificial Sequence
  Description of Artificial Sequence: Synthetic polypeptide
DEQEIRTTNPVATEQYGSVSATDLEDHAGEDL

SEQ ID NO: 70779 - protein, 32 aa, Artificial Sequence
  Description of Artificial Sequence: Synthetic polypeptide
DEQEIATTNPVATEQYGSVSAENLQDHEGEDL

SEQ ID NO: 70780 - protein, 34 aa, Artificial Sequence
  Description of Artificial Sequence: Synthetic polypeptide
DEEEICTTNPVATEQYGSVSTGGNLQDHQGGGMG

SEQ ID NO: 70781 - protein, 31 aa, Artificial Sequence
  Description of Artificial Sequence: Synthetic polypeptide
DEQEIRTTNPVATEQYGSVSACDLEDHEGEG

SEQ ID NO: 70782 - protein, 32 aa, Artificial Sequence
  Description of Artificial Sequence: Synthetic polypeptide
DEQEIRTTNPVATEQYGSVEWDNVQRGSEQVH

SEQ ID NO: 70783 - protein, 29 aa, Artificial Sequence
  Description of Artificial Sequence: Synthetic peptide
QEGEIAPTNPCSTEQYGSVSCNLQDSGTR

SEQ ID NO: 70784 - protein, 28 aa, Artificial Sequence
  Description of Artificial Sequence: Synthetic peptide
QEGEIAPTNPCSTEQYGSVSCNLMSGTR

SEQ ID NO: 70785 - protein, 31 aa, Artificial Sequence
  Description of Artificial Sequence: Synthetic polypeptide
DEQEIRTTNPVATEQYGSISATDLEDHEGEL

SEQ ID NO: 70786 - protein, 32 aa, Artificial Sequence
  Description of Artificial Sequence: Synthetic polypeptide
DEQEIRTTNPVATEQYGSISATDLQDHEGEDL

SEQ ID NO: 70787 - protein, 32 aa, Artificial Sequence
  Description of Artificial Sequence: Synthetic polypeptide
DEQEIRTTNPVATEQYGSISATDLQDHNGEDL

SEQ ID NO: 70788 - protein, 32 aa, Artificial Sequence
  Description of Artificial Sequence: Synthetic polypeptide
DEQEIRTTNPVATEQYGSISATDLQEDHEGEL

SEQ ID NO: 70789 - protein, 35 aa, Artificial Sequence
  Description of Artificial Sequence: Synthetic polypeptide
DEEEIRTTNPVATEQYGSVACPTLNLQNEGENGDQ

SEQ ID NO: 70790 - protein, 28 aa, Artificial Sequence
  Description of Artificial Sequence: Synthetic peptide
QEGEIAPTNPCSTEQYGIVSENLQHGTR

SEQ ID NO: 70791 - protein, 33 aa, Artificial Sequence
  Description of Artificial Sequence: Synthetic polypeptide
DEEEIRTTNPVATEQYGSVSTTPAGPNHNGMNL

SEQ ID NO: 70792 - protein, 28 aa, Artificial Sequence
  Description of Artificial Sequence: Synthetic peptide
QEGEIAPTNPCSTEQYGIVSCNLQSGTR

SEQ ID NO: 70793 - protein, 32 aa, Artificial Sequence
  Description of Artificial Sequence: Synthetic polypeptide
DEEEIATTNPVATEQYGSVCSVADNDNAGEND

SEQ ID NO: 70794 - protein, 33 aa, Artificial Sequence
  Description of Artificial Sequence: Synthetic polypeptide
DEQEIRTTNPVATEQYGSVQSTTVLQNGSDEDT

SEQ ID NO: 70795 - protein, 34 aa, Artificial Sequence
  Description of Artificial Sequence: Synthetic polypeptide
DEEEIRTTNPVATEQYGSVSTTPAGPNMANGMNV

SEQ ID NO: 70796 - protein, 34 aa, Artificial Sequence
  Description of Artificial Sequence: Synthetic polypeptide
DEEEIRTTNPVATEQYGSVSTTPAGPNMHNGNPV

SEQ ID NO: 70797 - protein, 34 aa, Artificial Sequence
  Description of Artificial Sequence: Synthetic polypeptide
DEEEIRTTNPVATEQYGSVSTTPAGPNMRNGGPR

SEQ ID NO: 70798 - protein, 33 aa, Artificial Sequence
  Description of Artificial Sequence: Synthetic polypeptide
DEQEIRTTNPVATEQYGSSCSTNTQQREGEDKN

SEQ ID NO: 70799 - protein, 33 aa, Artificial Sequence
  Description of Artificial Sequence: Synthetic polypeptide
DEEEICTTNPVATENYGSVSTTNDPNQMGNGNH

SEQ ID NO: 70800 - protein, 32 aa, Artificial Sequence
  Description of Artificial Sequence: Synthetic polypeptide
DEAEISTTNPVATESYGEVSMTENLDQARMNF

SEQ ID NO: 70801 - protein, 32 aa, Artificial Sequence
  Description of Artificial Sequence: Synthetic polypeptide
DEQEIRTTNPVATEQYGSSSTNTQQHEQEGTN

SEQ ID NO: 70802 - protein, 28 aa, Artificial Sequence
  Description of Artificial Sequence: Synthetic peptide
QEGEIAPTNPCSTEQYGIVSCNLQHGTR

SEQ ID NO: 70803 - protein, 32 aa, Artificial Sequence
  Description of Artificial Sequence: Synthetic polypeptide
DEQEIRTTNPVATEQYGSSSTNTSQQIEGETT

SEQ ID NO: 70804 - protein, 31 aa, Artificial Sequence
  Description of Artificial Sequence: Synthetic polypeptide
DEQEIRTTNPVATEQYGSSSTVTQQHEGETG

SEQ ID NO: 70805 - protein, 33 aa, Artificial Sequence
  Description of Artificial Sequence: Synthetic polypeptide
DEQEIRTTNPVATEQYGSVDSTNLEQSEDEIDT

SEQ ID NO: 70806 - protein, 31 aa, Artificial Sequence
  Description of Artificial Sequence: Synthetic polypeptide
DEQEIRTTNPVATEQYGSVEWDNLQEDEQEF

SEQ ID NO: 70807 - protein, 34 aa, Artificial Sequence
  Description of Artificial Sequence: Synthetic polypeptide
DEEEIRTTNPVATEQYGSVSTTPAGPNMHEGNPV

SEQ ID NO: 70808 - protein, 32 aa, Artificial Sequence
  Description of Artificial Sequence: Synthetic polypeptide
DECEIATTNPCATEQYGSVSTNLQGDLDNGDD

SEQ ID NO: 70809 - protein, 32 aa, Artificial Sequence
  Description of Artificial Sequence: Synthetic polypeptide
DEQEIRTTNPVATEQYGSVSVPELQMEGESQN

SEQ ID NO: 70810 - protein, 30 aa, Artificial Sequence
  Description of Artificial Sequence: Synthetic polypeptide
CEEEIACTNPVATEQYGSVATNNQEAEGPD

SEQ ID NO: 70811 - protein, 31 aa, Artificial Sequence
  Description of Artificial Sequence: Synthetic polypeptide
DEQTICTTNPVATEQWGSVSTDQLQLGNNDQ

SEQ ID NO: 70812 - protein, 31 aa, Artificial Sequence
  Description of Artificial Sequence: Synthetic polypeptide
DEQEIATTNPVATEQYGSMSATDLQHEGEDL

SEQ ID NO: 70813 - protein, 32 aa, Artificial Sequence
  Description of Artificial Sequence: Synthetic polypeptide
DEEEIRTTNPVATEQYGSVCTVELETGGQSHE

SEQ ID NO: 70814 - protein, 33 aa, Artificial Sequence
  Description of Artificial Sequence: Synthetic polypeptide
DEEEIRTTNPVATEQYGSVSTVELPDVNAVENG

SEQ ID NO: 70815 - protein, 31 aa, Artificial Sequence
  Description of Artificial Sequence: Synthetic polypeptide
DEQTICTTNPVATEQWGSVSTDQLQLGNNQT

SEQ ID NO: 70816 - protein, 31 aa, Artificial Sequence
  Description of Artificial Sequence: Synthetic polypeptide
DEQTICTTNPVATEQWGSVSTTDQLQLGNQG

SEQ ID NO: 70817 - protein, 33 aa, Artificial Sequence
  Description of Artificial Sequence: Synthetic polypeptide
DEEEICTTNPVAYEQYGSVSCTNSESQSRGGPI

SEQ ID NO: 70818 - protein, 33 aa, Artificial Sequence
  Description of Artificial Sequence: Synthetic polypeptide
DEEEICTTNPVAYEQYGSVSCTNSLSQDQGGEF

SEQ ID NO: 70819 - protein, 31 aa, Artificial Sequence
  Description of Artificial Sequence: Synthetic polypeptide
DEAVEIASTNPVAYEQYGSVATNLQVGDNDQ

SEQ ID NO: 70820 - protein, 30 aa, Artificial Sequence
  Description of Artificial Sequence: Synthetic polypeptide
DEQTICTTNPVATEQYGVVETNPQIGTNET

SEQ ID NO: 70821 - protein, 30 aa, Artificial Sequence
  Description of Artificial Sequence: Synthetic polypeptide
DEQTICTTNPVATEQYGVVETNPQQIGNNT

SEQ ID NO: 70822 - protein, 31 aa, Artificial Sequence
  Description of Artificial Sequence: Synthetic polypeptide
DEQTIRGTNPVATEQYGSVSIDNGQGGGNDG

SEQ ID NO: 70823 - protein, 31 aa, Artificial Sequence
  Description of Artificial Sequence: Synthetic polypeptide
DEEEIRTTNPVATEQYGSVCTYPEMTGGQSE

SEQ ID NO: 70824 - protein, 35 aa, Artificial Sequence
  Description of Artificial Sequence: Synthetic polypeptide
DEEEIRTTNPVATEQYGSVCVCKNTLCQARNLNER

SEQ ID NO: 70825 - protein, 30 aa, Artificial Sequence
  Description of Artificial Sequence: Synthetic polypeptide
DEAVIATTNPVATEQYGCVCETNPQYGSNQ

SEQ ID NO: 70826 - protein, 31 aa, Artificial Sequence
  Description of Artificial Sequence: Synthetic polypeptide
DEREICTVNPVATEGYGSVSTNLGFEGGNGT

SEQ ID NO: 70827 - protein, 32 aa, Artificial Sequence
  Description of Artificial Sequence: Synthetic polypeptide
DEREICTVNPVATEQYGSVSTNLEVHQTGVVE

SEQ ID NO: 70828 - protein, 35 aa, Artificial Sequence
  Description of Artificial Sequence: Synthetic polypeptide
DEEEIRTTNPVATEQYGSVCVPTNELQQRGQMEDF

SEQ ID NO: 70829 - protein, 33 aa, Artificial Sequence
  Description of Artificial Sequence: Synthetic polypeptide
DEREIRTTNPVATEQYGSVSTDDQNRVEEQQRD

SEQ ID NO: 70830 - protein, 34 aa, Artificial Sequence
  Description of Artificial Sequence: Synthetic polypeptide
DEREIRTTNPVATEQYGSVSTNKHSQEGPMFDRV

SEQ ID NO: 70831 - protein, 30 aa, Artificial Sequence
  Description of Artificial Sequence: Synthetic polypeptide
DEAVIGTTNPVATEQWGCVSTEALQYGSNQ

SEQ ID NO: 70832 - protein, 33 aa, Artificial Sequence
  Description of Artificial Sequence: Synthetic polypeptide
DEEEIRTTNPVATEQYGSVSTVELTDIDQGEGQ

SEQ ID NO: 70833 - protein, 33 aa, Artificial Sequence
  Description of Artificial Sequence: Synthetic polypeptide
DEEEIRTTNPVATEQYGSVSTVELTQENSEDEQ

SEQ ID NO: 70834 - protein, 33 aa, Artificial Sequence
  Description of Artificial Sequence: Synthetic polypeptide
DEEEIRTTNPVATEQYGSVCTTSNVEQRMLVEN

SEQ ID NO: 70835 - protein, 30 aa, Artificial Sequence
  Description of Artificial Sequence: Synthetic polypeptide
DEQQIRCTNPVATEQYGCVSTLYELRGQNT

SEQ ID NO: 70836 - protein, 30 aa, Artificial Sequence
  Description of Artificial Sequence: Synthetic polypeptide
DEQNICTTNPVATEQYGCVETNPQQGTNNG

SEQ ID NO: 70837 - protein, 30 aa, Artificial Sequence
  Description of Artificial Sequence: Synthetic polypeptide
DEQNICTTNPVATEQYGCVETNPNQQGNNG

SEQ ID NO: 70838 - protein, 32 aa, Artificial Sequence
  Description of Artificial Sequence: Synthetic polypeptide
DEQEIVTTNPVATEQYGSVSATDGLEDHEGNL

SEQ ID NO: 70839 - protein, 35 aa, Artificial Sequence
  Description of Artificial Sequence: Synthetic polypeptide
DEEEIRTTNPVATEQYGSVCTPTNVESLQGENVRQ

SEQ ID NO: 70840 - protein, 28 aa, Artificial Sequence
  Description of Artificial Sequence: Synthetic peptide
QEGEIAPTNPCSSEQYGIVSCNLQSGNR

SEQ ID NO: 70841 - protein, 30 aa, Artificial Sequence
  Description of Artificial Sequence: Synthetic polypeptide
DEASIRTTNPCAYEQWGSVSFNLDDSGENR

SEQ ID NO: 70842 - protein, 33 aa, Artificial Sequence
  Description of Artificial Sequence: Synthetic polypeptide
DEEEIRTTNPVATEQYGSVSTVDHQPMVNDDFF

SEQ ID NO: 70843 - protein, 29 aa, Artificial Sequence
  Description of Artificial Sequence: Synthetic peptide
QENEIATTNPVATECYGSVSTCLQDHEEL

SEQ ID NO: 70844 - protein, 33 aa, Artificial Sequence
  Description of Artificial Sequence: Synthetic polypeptide
DEEEIATTNPVATEQYGSVCANLQEAEIGNEND

SEQ ID NO: 70845 - protein, 31 aa, Artificial Sequence
  Description of Artificial Sequence: Synthetic polypeptide
DEASIRTTNPLATEQFGSVCSFNLQSGQQDR

SEQ ID NO: 70846 - protein, 33 aa, Artificial Sequence
  Description of Artificial Sequence: Synthetic polypeptide
DEEEIATTNPVATEQYGSVCANDNLQDDLGNQM

SEQ ID NO: 70847 - protein, 29 aa, Artificial Sequence
  Description of Artificial Sequence: Synthetic peptide
QENEIATTNPVATECYGSVSTCLQHEEEL

SEQ ID NO: 70848 - protein, 32 aa, Artificial Sequence
  Description of Artificial Sequence: Synthetic polypeptide
DEEEIRTTNPVATEQYGSVSTVDMVIVGSQEE

SEQ ID NO: 70849 - protein, 31 aa, Artificial Sequence
  Description of Artificial Sequence: Synthetic polypeptide
DEAVIGTTNPVATEQWGSVSTDLLQYFGSNQ

SEQ ID NO: 70850 - protein, 35 aa, Artificial Sequence
  Description of Artificial Sequence: Synthetic polypeptide
DEEEIRTTNPVATEQYGSTVHCTGNELQREGGEMQ

SEQ ID NO: 70851 - protein, 33 aa, Artificial Sequence
  Description of Artificial Sequence: Synthetic polypeptide
DEEEIRTTNPVATEQYGSVCTSLQQPEGELLSL

SEQ ID NO: 70852 - protein, 32 aa, Artificial Sequence
  Description of Artificial Sequence: Synthetic polypeptide
DEEEIRTTNPVATEQYGSVCTSLQQTEELLIL

SEQ ID NO: 70853 - protein, 32 aa, Artificial Sequence
  Description of Artificial Sequence: Synthetic polypeptide
DEEEIRTTNPVATEQYGSVCTSTQQTTELLRL

SEQ ID NO: 70854 - protein, 31 aa, Artificial Sequence
  Description of Artificial Sequence: Synthetic polypeptide
DEQEVASTNPVATEGYGSVSATDLQDRVGER

SEQ ID NO: 70855 - protein, 31 aa, Artificial Sequence
  Description of Artificial Sequence: Synthetic polypeptide
DEQEVASTNPVATEGYGSVSATDLQDRVGQR

SEQ ID NO: 70856 - protein, 31 aa, Artificial Sequence
  Description of Artificial Sequence: Synthetic polypeptide
DEQEVATTNPVATEQYGSVSATDIQDHEGQR

SEQ ID NO: 70857 - protein, 34 aa, Artificial Sequence
  Description of Artificial Sequence: Synthetic polypeptide
DEEEICTTNPVAYEQYGSVPSCTNSLSQVRGGHF

SEQ ID NO: 70858 - protein, 29 aa, Artificial Sequence
  Description of Artificial Sequence: Synthetic peptide
DEQEIATTNPVATEQYGSMSSTLEHGEDL

SEQ ID NO: 70859 - protein, 33 aa, Artificial Sequence
  Description of Artificial Sequence: Synthetic polypeptide
DEEEIRTTNPVATEQYGSVCTTNDDELRETEQR

SEQ ID NO: 70860 - protein, 34 aa, Artificial Sequence
  Description of Artificial Sequence: Synthetic polypeptide
DEEEIRTTNPVATEQYGSVSTVDWHQDNGQNDDN

SEQ ID NO: 70861 - protein, 31 aa, Artificial Sequence
  Description of Artificial Sequence: Synthetic polypeptide
DEQEVATTNPVATEQYGSVSATDIQDHVGQR

SEQ ID NO: 70862 - protein, 33 aa, Artificial Sequence
  Description of Artificial Sequence: Synthetic polypeptide
DEEEIRTTNPVATEQYGSVSTVDPNPASVQNDV

SEQ ID NO: 70863 - protein, 34 aa, Artificial Sequence
  Description of Artificial Sequence: Synthetic polypeptide
DEAEIRTTNPVATEQYGSVVWTDNDQGGVGNNDR

SEQ ID NO: 70864 - protein, 32 aa, Artificial Sequence
  Description of Artificial Sequence: Synthetic polypeptide
DEREIWTVNPVATEQYGSVSTNLEFWQQGVVE

SEQ ID NO: 70865 - protein, 35 aa, Artificial Sequence
  Description of Artificial Sequence: Synthetic polypeptide
DEEEIRTTNPVATEQYGSVCWPTGNLELGNMEDRD

SEQ ID NO: 70866 - protein, 28 aa, Artificial Sequence
  Description of Artificial Sequence: Synthetic peptide
QEGEIAPTNPCSSEQYGEVSENLQRGGR

SEQ ID NO: 70867 - protein, 30 aa, Artificial Sequence
  Description of Artificial Sequence: Synthetic polypeptide
DEAVIRTTNPVATEQYGCVYTNPQTEINNQ

SEQ ID NO: 70868 - protein, 30 aa, Artificial Sequence
  Description of Artificial Sequence: Synthetic polypeptide
DESEIACTNPVATEQYGEASETLQSRVGGR

SEQ ID NO: 70869 - protein, 30 aa, Artificial Sequence
  Description of Artificial Sequence: Synthetic polypeptide
DESEIACTNPVATEQYGNVAETLQSRVGQR

SEQ ID NO: 70870 - protein, 33 aa, Artificial Sequence
  Description of Artificial Sequence: Synthetic polypeptide
DEEEICTTNPVAYYAWYGSVSATNLEQDLGNSR

SEQ ID NO: 70871 - protein, 28 aa, Artificial Sequence
  Description of Artificial Sequence: Synthetic peptide
QENEIATTNPVATECYGTVSEDLQHENL

SEQ ID NO: 70872 - protein, 28 aa, Artificial Sequence
  Description of Artificial Sequence: Synthetic peptide
QEGEIAPTNPCSSEQYGEVSCNLQRGTR

SEQ ID NO: 70873 - protein, 28 aa, Artificial Sequence
  Description of Artificial Sequence: Synthetic peptide
QEGEIAPTNPCSSEQYGEVSCNLQRGGR

SEQ ID NO: 70874 - protein, 34 aa, Artificial Sequence
  Description of Artificial Sequence: Synthetic polypeptide
DEEEICTTNPVSTEQYGQVVSTNALSPRTGGNNR

SEQ ID NO: 70875 - protein, 30 aa, Artificial Sequence
  Description of Artificial Sequence: Synthetic polypeptide
DESEIACTNPVSTEQYGNVAAENIQRVGNR

SEQ ID NO: 70876 - protein, 33 aa, Artificial Sequence
  Description of Artificial Sequence: Synthetic polypeptide
DEEEIATTNPVATEQYGSVCAMNPLQEMGNQDS

SEQ ID NO: 70877 - protein, 30 aa, Artificial Sequence
  Description of Artificial Sequence: Synthetic polypeptide
DESEIAPTNPCASEQYGSVSCINLPQSGTR

SEQ ID NO: 70878 - protein, 28 aa, Artificial Sequence
  Description of Artificial Sequence: Synthetic peptide
DESEIAPTNPCSSEQYGIVANNLQRGTR

SEQ ID NO: 70879 - protein, 28 aa, Artificial Sequence
  Description of Artificial Sequence: Synthetic peptide
DESEIAPTNPCSTEQYGIVSCTIQRGTR

SEQ ID NO: 70880 - protein, 32 aa, Artificial Sequence
  Description of Artificial Sequence: Synthetic polypeptide
DEAVIRTTNPVATEQYGSVSTDLEFNYGQNQI

SEQ ID NO: 70881 - protein, 29 aa, Artificial Sequence
  Description of Artificial Sequence: Synthetic peptide
DESEIAPTNPVSTEQYGIVAANTIQRGTR

SEQ ID NO: 70882 - protein, 30 aa, Artificial Sequence
  Description of Artificial Sequence: Synthetic polypeptide
DEAVIRTTNPVAYEAYGSVATYLSQPGGNQ

SEQ ID NO: 70883 - protein, 34 aa, Artificial Sequence
  Description of Artificial Sequence: Synthetic polypeptide
DEEEIRTTNPVATEQYGSVSTVLNNQLLQEEDEE

SEQ ID NO: 70884 - protein, 30 aa, Artificial Sequence
  Description of Artificial Sequence: Synthetic polypeptide
DESEIASTNPIATEGYGSVAANTIQRVGNR

SEQ ID NO: 70885 - protein, 28 aa, Artificial Sequence
  Description of Artificial Sequence: Synthetic peptide
DESEIASTNPVATEGYGDVSSTLQHGDA

SEQ ID NO: 70886 - protein, 31 aa, Artificial Sequence
  Description of Artificial Sequence: Synthetic polypeptide
DEAVISTTNPVATEQYGSVSTNEGMTYGENT

SEQ ID NO: 70887 - protein, 32 aa, Artificial Sequence
  Description of Artificial Sequence: Synthetic polypeptide
DEAVISTTNPVATEQYGSVSTNLDMTYFGNTT

SEQ ID NO: 70888 - protein, 30 aa, Artificial Sequence
  Description of Artificial Sequence: Synthetic polypeptide
DESEIASTNPVATEGYGSVSASTLPNRGNV

SEQ ID NO: 70889 - protein, 32 aa, Artificial Sequence
  Description of Artificial Sequence: Synthetic polypeptide
DEEEIRTTNPVATEQYGSVDETTLQSEDEIQF

SEQ ID NO: 70890 - protein, 30 aa, Artificial Sequence
  Description of Artificial Sequence: Synthetic polypeptide
DEAVIRTTNPVATEQYGCVNTNHQTIDNAP

SEQ ID NO: 70891 - protein, 28 aa, Artificial Sequence
  Description of Artificial Sequence: Synthetic peptide
QENEIATTNPVATECYGTVSECLQHGEL

SEQ ID NO: 70892 - protein, 31 aa, Artificial Sequence
  Description of Artificial Sequence: Synthetic polypeptide
DEAVIRTTNPVATEQYGCVETNPQYSGSNQS

SEQ ID NO: 70893 - protein, 30 aa, Artificial Sequence
  Description of Artificial Sequence: Synthetic polypeptide
DERSIRTTNPVAVEQYGSVNTNPEERGEAT

SEQ ID NO: 70894 - protein, 33 aa, Artificial Sequence
  Description of Artificial Sequence: Synthetic polypeptide
DEEEIRTTNPVATEQYGSVSTVEPGNDTHPENQ

SEQ ID NO: 70895 - protein, 34 aa, Artificial Sequence
  Description of Artificial Sequence: Synthetic polypeptide
DEEEIRTTNPVATEQYGSVSTVEPLNDTHSGNNQ

SEQ ID NO: 70896 - protein, 30 aa, Artificial Sequence
  Description of Artificial Sequence: Synthetic polypeptide
DESCIRCTNPVATEQYGCVSTLHELRGNTQ

SEQ ID NO: 70897 - protein, 33 aa, Artificial Sequence
  Description of Artificial Sequence: Synthetic polypeptide
DEEEIRTTNPVATEQYGSVCYENLDFGRNQEDQ

SEQ ID NO: 70898 - protein, 34 aa, Artificial Sequence
  Description of Artificial Sequence: Synthetic polypeptide
DEAEIRTTNPVATEQYGSVVSAAANLGQEYTGNL

SEQ ID NO: 70899 - protein, 31 aa, Artificial Sequence
  Description of Artificial Sequence: Synthetic polypeptide
DESCIRCTNPVATEQYGSVSWDNMSERFGNQ

SEQ ID NO: 70900 - protein, 32 aa, Artificial Sequence
  Description of Artificial Sequence: Synthetic polypeptide
DEAVIRTTNPVATEQYGCVACTNEPSQRGGPR

SEQ ID NO: 70901 - protein, 30 aa, Artificial Sequence
  Description of Artificial Sequence: Synthetic polypeptide
DESCIRCTNPVATEQYGSVSWENFTRGQLI

SEQ ID NO: 70902 - protein, 32 aa, Artificial Sequence
  Description of Artificial Sequence: Synthetic polypeptide
DEEEIRTTNPVATEQYGSVDCINEQETQNENN

SEQ ID NO: 70903 - protein, 34 aa, Artificial Sequence
  Description of Artificial Sequence: Synthetic polypeptide
DEEEIRTTNPVATEQYGSVSTVGNFTGQEEINGG

SEQ ID NO: 70904 - protein, 32 aa, Artificial Sequence
  Description of Artificial Sequence: Synthetic polypeptide
DEEEIRTTNPVATEQYGSVSTVELTTDSEEKQ

SEQ ID NO: 70905 - protein, 30 aa, Artificial Sequence
  Description of Artificial Sequence: Synthetic polypeptide
DESCIRCTNPVATEQYGSVSWNMFETIGNQ

SEQ ID NO: 70906 - protein, 34 aa, Artificial Sequence
  Description of Artificial Sequence: Synthetic polypeptide
DEEEIRTTNPVATEQYGSVSTVGPYNASQITERD

SEQ ID NO: 70907 - protein, 32 aa, Artificial Sequence
  Description of Artificial Sequence: Synthetic polypeptide
DESCIRTTNPVATEQYGSTVACTNQSQETGNN

SEQ ID NO: 70908 - protein, 33 aa, Artificial Sequence
  Description of Artificial Sequence: Synthetic polypeptide
DESCIRTTNPVATEQYGSTVSCTNQSQQETGND

SEQ ID NO: 70909 - protein, 29 aa, Artificial Sequence
  Description of Artificial Sequence: Synthetic peptide
DESDIRTTNPVATKHYGSVWQTNQERTNN

SEQ ID NO: 70910 - protein, 30 aa, Artificial Sequence
  Description of Artificial Sequence: Synthetic polypeptide
DEAVIRTTNPVATEQYGCVENSEPQRGTDR

SEQ ID NO: 70911 - protein, 30 aa, Artificial Sequence
  Description of Artificial Sequence: Synthetic polypeptide
DEAVIRTTNPVATEQYGCVENTNPQVGEVE

SEQ ID NO: 70912 - protein, 33 aa, Artificial Sequence
  Description of Artificial Sequence: Synthetic polypeptide
DEEEIRTTNPVATEQYGSVSTVGVNGGGGQTEQ

SEQ ID NO: 70913 - protein, 28 aa, Artificial Sequence
  Description of Artificial Sequence: Synthetic peptide
QENEIATTNPVATECYGTVSECLQHENL

SEQ ID NO: 70914 - protein, 34 aa, Artificial Sequence
  Description of Artificial Sequence: Synthetic polypeptide
DEEEIRTTNPVATEQYGSVDEPANLLNQRQGETD

SEQ ID NO: 70915 - protein, 34 aa, Artificial Sequence
  Description of Artificial Sequence: Synthetic polypeptide
DEEEIRTTNPVATEQYGSVDEPFNLQQQRQGETD

SEQ ID NO: 70916 - protein, 31 aa, Artificial Sequence
  Description of Artificial Sequence: Synthetic polypeptide
DEAVIRTTNPVATEQYGCVETNPQNIGSNQA

SEQ ID NO: 70917 - protein, 30 aa, Artificial Sequence
  Description of Artificial Sequence: Synthetic polypeptide
DESCIRTTNPVATEQWGCVATNNLQLDENQ

SEQ ID NO: 70918 - protein, 32 aa, Artificial Sequence
  Description of Artificial Sequence: Synthetic polypeptide
DEQEIVTTNPVATEQYGSVSATDGLEDHEGND

SEQ ID NO: 70919 - protein, 29 aa, Artificial Sequence
  Description of Artificial Sequence: Synthetic peptide
DEAPIATTNPVATEPYSEEMSTNLQNGNT

SEQ ID NO: 70920 - protein, 28 aa, Artificial Sequence
  Description of Artificial Sequence: Synthetic peptide
QENEIATTNPVATECYGSVSPCLQHEEL

SEQ ID NO: 70921 - protein, 31 aa, Artificial Sequence
  Description of Artificial Sequence: Synthetic polypeptide
DEAEIRTTNPVATEQYGSVWVTVLDENNEIM

SEQ ID NO: 70922 - protein, 28 aa, Artificial Sequence
  Description of Artificial Sequence: Synthetic peptide
QENEIATTNPVATECYGIVSCNLQSEEL

SEQ ID NO: 70923 - protein, 36 aa, Artificial Sequence
  Description of Artificial Sequence: Synthetic polypeptide
DEEEIRTTNPVATEQYGSVSTTTNLGANNQNGTNPV

SEQ ID NO: 70924 - protein, 35 aa, Artificial Sequence
  Description of Artificial Sequence: Synthetic polypeptide
DEEEIRTTNPVATEQYGSVSTTTNLGGQEQGTIVT

SEQ ID NO: 70925 - protein, 32 aa, Artificial Sequence
  Description of Artificial Sequence: Synthetic polypeptide
DEEEICTTNPVATEWWGSVSTGNDNQNGGDGR

SEQ ID NO: 70926 - protein, 34 aa, Artificial Sequence
  Description of Artificial Sequence: Synthetic polypeptide
DEEEIATTNPVATEQYGSVCATNPLQDPMENTRQ

SEQ ID NO: 70927 - protein, 35 aa, Artificial Sequence
  Description of Artificial Sequence: Synthetic polypeptide
DEEEIRTTNPVATEQYGSVSTTTNPLPRQGEVETL

SEQ ID NO: 70928 - protein, 33 aa, Artificial Sequence
  Description of Artificial Sequence: Synthetic polypeptide
DEEEIATTNPVATEQYGSVCATNPLQDPEEGFP

SEQ ID NO: 70929 - protein, 35 aa, Artificial Sequence
  Description of Artificial Sequence: Synthetic polypeptide
DEEEIRTTNPVATEQYGSVSTTTNQQGTEQGTTNE

SEQ ID NO: 70930 - protein, 29 aa, Artificial Sequence
  Description of Artificial Sequence: Synthetic peptide
QENEIATTNPVATECYGNVSECIQRVGER

SEQ ID NO: 70931 - protein, 34 aa, Artificial Sequence
  Description of Artificial Sequence: Synthetic polypeptide
DEEEIRTTNPVATEQYGSVSTTVAEGQRGEILVT

SEQ ID NO: 70932 - protein, 34 aa, Artificial Sequence
  Description of Artificial Sequence: Synthetic polypeptide
DEEEIRTTNPVATEQYGSVSTTVGPNMRNGMNPV

SEQ ID NO: 70933 - protein, 34 aa, Artificial Sequence
  Description of Artificial Sequence: Synthetic polypeptide
DEEEIATTNPVATEQYGSVCATNPLQDAGENGMP

SEQ ID NO: 70934 - protein, 32 aa, Artificial Sequence
  Description of Artificial Sequence: Synthetic polypeptide
DEQEIRTTNPVATEQYGSVSYTWLEQQESQEQ

SEQ ID NO: 70935 - protein, 32 aa, Artificial Sequence
  Description of Artificial Sequence: Synthetic polypeptide
DEAEIRTTNPVATEQYGSVWVTEEMEEGNERF

SEQ ID NO: 70936 - protein, 33 aa, Artificial Sequence
  Description of Artificial Sequence: Synthetic polypeptide
DEQEIATTNPVATEQYGSVCATNPLQEHDNQRQ

SEQ ID NO: 70937 - protein, 33 aa, Artificial Sequence
  Description of Artificial Sequence: Synthetic polypeptide
DEEEIRTTNPVATEQYGSVSTTVLDQLEVVPEL

SEQ ID NO: 70938 - protein, 31 aa, Artificial Sequence
  Description of Artificial Sequence: Synthetic polypeptide
DEAEIRTTNPVATEQYGSVWVSVLDRGEDDM

SEQ ID NO: 70939 - protein, 32 aa, Artificial Sequence
  Description of Artificial Sequence: Synthetic polypeptide
DEQEIRTTNPVATEQYGSVTVTPNDQEGEDQG

SEQ ID NO: 70940 - protein, 34 aa, Artificial Sequence
  Description of Artificial Sequence: Synthetic polypeptide
DEAEIRTTNPVATEQYGSVWSTPLGERSHNEDRN

SEQ ID NO: 70941 - protein, 32 aa, Artificial Sequence
  Description of Artificial Sequence: Synthetic polypeptide
DEQEIRTTNPVATEQYGSVTVTPNDQEYGEQI

SEQ ID NO: 70942 - protein, 28 aa, Artificial Sequence
  Description of Artificial Sequence: Synthetic peptide
QENEIATTNPVATECYGSVSEALQHEEL

SEQ ID NO: 70943 - protein, 32 aa, Artificial Sequence
  Description of Artificial Sequence: Synthetic polypeptide
DEQEIATTNPVATEQYGSVCAATNDQTVPGNN

SEQ ID NO: 70944 - protein, 31 aa, Artificial Sequence
  Description of Artificial Sequence: Synthetic polypeptide
DEAEIRTTNPVATEQYGSVWVTVLDEQIEDM

SEQ ID NO: 70945 - protein, 32 aa, Artificial Sequence
  Description of Artificial Sequence: Synthetic polypeptide
DEAEIRTTNPVATEQYGSVWVTVLDERQGEDL

SEQ ID NO: 70946 - protein, 32 aa, Artificial Sequence
  Description of Artificial Sequence: Synthetic polypeptide
DEAEIRTTNPVATEQYGSVWVTVLDSRGEEDM

SEQ ID NO: 70947 - protein, 32 aa, Artificial Sequence
  Description of Artificial Sequence: Synthetic polypeptide
DEEEIRTTNPVATEQYGSVSTTTGPQTMETQQ

SEQ ID NO: 70948 - protein, 33 aa, Artificial Sequence
  Description of Artificial Sequence: Synthetic polypeptide
DEEEICTTNPVATEQYGSVSTGLNGNHGENNGS

SEQ ID NO: 70949 - protein, 35 aa, Artificial Sequence
  Description of Artificial Sequence: Synthetic polypeptide
DEEEICTTNPVATEQYGSVSTGNGLQNSGGRNDGD

SEQ ID NO: 70950 - protein, 33 aa, Artificial Sequence
  Description of Artificial Sequence: Synthetic polypeptide
DEEEICTTNPVATEQYGSVSTGPDNQGGHGNAE

SEQ ID NO: 70951 - protein, 33 aa, Artificial Sequence
  Description of Artificial Sequence: Synthetic polypeptide
DEEEICTTNPVATEQYGSVSTGPNQGNHGENGQ

SEQ ID NO: 70952 - protein, 32 aa, Artificial Sequence
  Description of Artificial Sequence: Synthetic polypeptide
DEEEIATTNPVATEQYGSVCATNPQNQDPENA

SEQ ID NO: 70953 - protein, 33 aa, Artificial Sequence
  Description of Artificial Sequence: Synthetic polypeptide
DEEEICTTNPVATEQYGSVSTNNGGDAGNGNPL

SEQ ID NO: 70954 - protein, 32 aa, Artificial Sequence
  Description of Artificial Sequence: Synthetic polypeptide
DEEEICTTNPVATEQYGSVSYNFPQAHQESRE

SEQ ID NO: 70955 - protein, 32 aa, Artificial Sequence
  Description of Artificial Sequence: Synthetic polypeptide
CEEEIACTNPVATEQYGSVATNLQNPGENAGE

SEQ ID NO: 70956 - protein, 33 aa, Artificial Sequence
  Description of Artificial Sequence: Synthetic polypeptide
DEEEICTTNPVATEQYGVVSTGGLQGGHGNGEQ

SEQ ID NO: 70957 - protein, 28 aa, Artificial Sequence
  Description of Artificial Sequence: Synthetic peptide
QEGEIAPTNPCSSEQYGIVSDNLQSGNR

SEQ ID NO: 70958 - protein, 34 aa, Artificial Sequence
  Description of Artificial Sequence: Synthetic polypeptide
DEEEICTTNPVATEQYGVVSTGGNLQDHQGGNMP

SEQ ID NO: 70959 - protein, 32 aa, Artificial Sequence
  Description of Artificial Sequence: Synthetic polypeptide
DEEEICTTNPVAYEQWGSVATNLQGDAGNEEE

SEQ ID NO: 70960 - protein, 32 aa, Artificial Sequence
  Description of Artificial Sequence: Synthetic polypeptide
CEEEIACTNPVATEQYGSVATNLQNIGNGPLE

SEQ ID NO: 70961 - protein, 32 aa, Artificial Sequence
  Description of Artificial Sequence: Synthetic polypeptide
DEAEIRTTNPVATEQYGSVWVTVSLDRGSEDM

SEQ ID NO: 70962 - protein, 33 aa, Artificial Sequence
  Description of Artificial Sequence: Synthetic polypeptide
DEEEIATTNPVATEQYGSVCATNPLQPDNQNDN

SEQ ID NO: 70963 - protein, 34 aa, Artificial Sequence
  Description of Artificial Sequence: Synthetic polypeptide
DEQEIRTTNPVATEQYGSVSYTNLETQEGLEDDP

SEQ ID NO: 70964 - protein, 34 aa, Artificial Sequence
  Description of Artificial Sequence: Synthetic polypeptide
DEEEIATTNPVATEQYGSVCATNPLQEHDENQRN

SEQ ID NO: 70965 - protein, 32 aa, Artificial Sequence
  Description of Artificial Sequence: Synthetic polypeptide
DEAEIRTTNPVATEQYGSVWVTVNLDRTFEDM

SEQ ID NO: 70966 - protein, 32 aa, Artificial Sequence
  Description of Artificial Sequence: Synthetic polypeptide
DEEEIRTTNPVATEQYGSVSTTSVDDGGEGGQ

SEQ ID NO: 70967 - protein, 33 aa, Artificial Sequence
  Description of Artificial Sequence: Synthetic polypeptide
DEEEIRTTNPVATEQYGSVSTTSVGDGGGNQGT

SEQ ID NO: 70968 - protein, 31 aa, Artificial Sequence
  Description of Artificial Sequence: Synthetic polypeptide
DEAEIRTTNPVATEQYGSVWVTVLNDRLEDA

SEQ ID NO: 70969 - protein, 33 aa, Artificial Sequence
  Description of Artificial Sequence: Synthetic polypeptide
DEEEIATTNPVATEQYGSVCATNPLQDQGGDEH

SEQ ID NO: 70970 - protein, 33 aa, Artificial Sequence
  Description of Artificial Sequence: Synthetic polypeptide
DEEEIATTNPVATEQYGSVCATNPLQDQGDQEN

SEQ ID NO: 70971 - protein, 36 aa, Artificial Sequence
  Description of Artificial Sequence: Synthetic polypeptide
DEEEIRTTNPVATEQYGSVSTTTENLLQQIGTNNTV

SEQ ID NO: 70972 - protein, 31 aa, Artificial Sequence
  Description of Artificial Sequence: Synthetic polypeptide
CEEEIACTNPVATEQYGSVATNLQHNNDNLP

SEQ ID NO: 70973 - protein, 28 aa, Artificial Sequence
  Description of Artificial Sequence: Synthetic peptide
QENEIATTNPVATECYGSVSECLMHENL

SEQ ID NO: 70974 - protein, 33 aa, Artificial Sequence
  Description of Artificial Sequence: Synthetic polypeptide
DEEEIATTNPVATEQYGSVCATNNLNMDGNDTL

SEQ ID NO: 70975 - protein, 33 aa, Artificial Sequence
  Description of Artificial Sequence: Synthetic polypeptide
AEEEIRTTNPVATEQYGSVSTVVNQQQATENNE

SEQ ID NO: 70976 - protein, 36 aa, Artificial Sequence
  Description of Artificial Sequence: Synthetic polypeptide
DEEEIRTTNPVATEQYGSTVPSTDSALSQSPGGNQR

SEQ ID NO: 70977 - protein, 37 aa, Artificial Sequence
  Description of Artificial Sequence: Synthetic polypeptide
DEEEIRTTNPVATEQYGSTVPSTDNALSQYRAGGNQQ

SEQ ID NO: 70978 - protein, 30 aa, Artificial Sequence
  Description of Artificial Sequence: Synthetic polypeptide
CEEEIACTNPVATEQYGSVATNLQAAEAEH

SEQ ID NO: 70979 - protein, 36 aa, Artificial Sequence
  Description of Artificial Sequence: Synthetic polypeptide
DEEEIRTTNPVATEQYGSTVPSTDNALSQSYGGNQE

SEQ ID NO: 70980 - protein, 31 aa, Artificial Sequence
  Description of Artificial Sequence: Synthetic polypeptide
CEEEIACTNPVATEQYGSVATNDQDSGNDQL

SEQ ID NO: 70981 - protein, 36 aa, Artificial Sequence
  Description of Artificial Sequence: Synthetic polypeptide
DEEEIRTTNPVATEQYGSTVPSTDNALSQSEGTNQS

SEQ ID NO: 70982 - protein, 32 aa, Artificial Sequence
  Description of Artificial Sequence: Synthetic polypeptide
DEAEISTVNPVATEQYGSVCSTNLAEFGSNNQ

SEQ ID NO: 70983 - protein, 29 aa, Artificial Sequence
  Description of Artificial Sequence: Synthetic peptide
CEEEIACTNPVATEQYGSVATALIGNGMD

SEQ ID NO: 70984 - protein, 31 aa, Artificial Sequence
  Description of Artificial Sequence: Synthetic polypeptide
DEQEIRTTNPVATEQYGYSVPSTFEQATLPP

SEQ ID NO: 70985 - protein, 34 aa, Artificial Sequence
  Description of Artificial Sequence: Synthetic polypeptide
DEQEIRTTNPVATEQYGYTISDTNEMLQEGNERT

SEQ ID NO: 70986 - protein, 38 aa, Artificial Sequence
  Description of Artificial Sequence: Synthetic polypeptide
DEEEIRTTNPVATEQYGSTVPSTDNALSQQRPGGNQRG

SEQ ID NO: 70987 - protein, 31 aa, Artificial Sequence
  Description of Artificial Sequence: Synthetic polypeptide
CEEEIACTNPVATEQYGSVATNLQAEDDTGN

SEQ ID NO: 70988 - protein, 33 aa, Artificial Sequence
  Description of Artificial Sequence: Synthetic polypeptide
DEEEIATTNPVATEQYGSVCATDLQPDDQGNQE

SEQ ID NO: 70989 - protein, 29 aa, Artificial Sequence
  Description of Artificial Sequence: Synthetic peptide
QENEIATTNPVATECYGSVSEDLQHEGEL

SEQ ID NO: 70990 - protein, 34 aa, Artificial Sequence
  Description of Artificial Sequence: Synthetic polypeptide
DEQEIRTTNPVATEQYGYTISTNEALQLEGNERD

SEQ ID NO: 70991 - protein, 30 aa, Artificial Sequence
  Description of Artificial Sequence: Synthetic polypeptide
DEQEIRTTNPVATYHYGSVSALNLTEGTDM

SEQ ID NO: 70992 - protein, 34 aa, Artificial Sequence
  Description of Artificial Sequence: Synthetic polypeptide
DEEEIRTTNPVATEQYGSVSTNLTMANPMSNQQD

SEQ ID NO: 70993 - protein, 34 aa, Artificial Sequence
  Description of Artificial Sequence: Synthetic polypeptide
DEEEIRTTNPVATEQYGSTVPSCTPELSFSPNTR

SEQ ID NO: 70994 - protein, 32 aa, Artificial Sequence
  Description of Artificial Sequence: Synthetic polypeptide
DEQEIRTTNPVAYEQWGSVSTNLNGDGGDSND

SEQ ID NO: 70995 - protein, 37 aa, Artificial Sequence
  Description of Artificial Sequence: Synthetic polypeptide
DEEEIRTTNPVATEQYGSTVPSATPNALSQSEGGNQR

SEQ ID NO: 70996 - protein, 30 aa, Artificial Sequence
  Description of Artificial Sequence: Synthetic polypeptide
DEQEIRTTNPVSTEPYGSVSMDIQQQNGNH

SEQ ID NO: 70997 - protein, 33 aa, Artificial Sequence
  Description of Artificial Sequence: Synthetic polypeptide
DEEEIATTNPVATEQYGSVCAPTNLPQDNEENG

SEQ ID NO: 70998 - protein, 34 aa, Artificial Sequence
  Description of Artificial Sequence: Synthetic polypeptide
DEEEIRTTNPVATEQYGSVSTNLSQSASESVEEI

SEQ ID NO: 70999 - protein, 36 aa, Artificial Sequence
  Description of Artificial Sequence: Synthetic polypeptide
DEEEIRTTNPVATEQYGSTVPHTQNALSQSEGGNQR

SEQ ID NO: 71000 - protein, 31 aa, Artificial Sequence
  Description of Artificial Sequence: Synthetic polypeptide
CEEEIACTNPVATEQYGSVANNLERDNDTRA

SEQ ID NO: 71001 - protein, 36 aa, Artificial Sequence
  Description of Artificial Sequence: Synthetic polypeptide
DEEEIRTTNPVATEQYGSVSTTQQNLQQGNNQQNDE

SEQ ID NO: 71002 - protein, 33 aa, Artificial Sequence
  Description of Artificial Sequence: Synthetic polypeptide
DEEEIRTTNPVATEQYGSVSTTYGTDEGGGNEE

SEQ ID NO: 71003 - protein, 33 aa, Artificial Sequence
  Description of Artificial Sequence: Synthetic polypeptide
DEQEIRTTNPVATEQYGTVSATEDLQQDQNGNH

SEQ ID NO: 71004 - protein, 28 aa, Artificial Sequence
  Description of Artificial Sequence: Synthetic peptide
QENEIATTNPVATECYGSVSECLMREEL

SEQ ID NO: 71005 - protein, 32 aa, Artificial Sequence
  Description of Artificial Sequence: Synthetic polypeptide
CEEEIACTNPVATEQYGSVATNLQEAPGNPEE

SEQ ID NO: 71006 - protein, 33 aa, Artificial Sequence
  Description of Artificial Sequence: Synthetic polypeptide
DEEEIATTNPVATEQYGSVCATNNDEFDDGNHR

SEQ ID NO: 71007 - protein, 28 aa, Artificial Sequence
  Description of Artificial Sequence: Synthetic peptide
QENEIATTNPVATECYGSVSECLQHEDL

SEQ ID NO: 71008 - protein, 33 aa, Artificial Sequence
  Description of Artificial Sequence: Synthetic polypeptide
DEQEIRTTNPVATEQYGSVYPTDNLERENPQST

SEQ ID NO: 71009 - protein, 34 aa, Artificial Sequence
  Description of Artificial Sequence: Synthetic polypeptide
DEEEIRTTNPVATEQYGSVSTTVMLGLSGGNGNT

SEQ ID NO: 71010 - protein, 28 aa, Artificial Sequence
  Description of Artificial Sequence: Synthetic peptide
QENEIATTNPVATECYGSVSECLQHEEL

SEQ ID NO: 71011 - protein, 36 aa, Artificial Sequence
  Description of Artificial Sequence: Synthetic polypeptide
DEEEIRTTNPVATEQYGSTVPSWDNALSQTPGGNQR

SEQ ID NO: 71012 - protein, 29 aa, Artificial Sequence
  Description of Artificial Sequence: Synthetic peptide
QENEIATTNPVATECYGSVSECLQHEGEL

SEQ ID NO: 71013 - protein, 31 aa, Artificial Sequence
  Description of Artificial Sequence: Synthetic polypeptide
CEEEICTTNPVATEQYGSVAYKNDPNKGNRQ

SEQ ID NO: 71014 - protein, 28 aa, Artificial Sequence
  Description of Artificial Sequence: Synthetic peptide
QENEIATTNPVATECYGSVSECLQHEWL

SEQ ID NO: 71015 - protein, 33 aa, Artificial Sequence
  Description of Artificial Sequence: Synthetic polypeptide
DEQEIATTNPVATEQYGSVAATANLQDQGGNHE

SEQ ID NO: 71016 - protein, 33 aa, Artificial Sequence
  Description of Artificial Sequence: Synthetic polypeptide
DEEEIATTNPVATEQYGSVCATNLEAAEGDNEE

SEQ ID NO: 71017 - protein, 33 aa, Artificial Sequence
  Description of Artificial Sequence: Synthetic polypeptide
DEEEIATTNPVATEQYGSVCATNLAPDSQDGTV

SEQ ID NO: 71018 - protein, 33 aa, Artificial Sequence
  Description of Artificial Sequence: Synthetic polypeptide
AEEEIRTTNPVATEQYGSVSTVVNQQNQDTNNE

SEQ ID NO: 71019 - protein, 34 aa, Artificial Sequence
  Description of Artificial Sequence: Synthetic polypeptide
DEEEIATTNPVATEQYGSVCATNLAPDSMDGNRQ

SEQ ID NO: 71020 - protein, 32 aa, Artificial Sequence
  Description of Artificial Sequence: Synthetic polypeptide
DEEEICTTNPVAYEQWGSVSTNLQNPGGDAGD

SEQ ID NO: 71021 - protein, 31 aa, Artificial Sequence
  Description of Artificial Sequence: Synthetic polypeptide
CEEEIACTNPVATEQYGSVATNLQAIEPNFD

SEQ ID NO: 71022 - protein, 32 aa, Artificial Sequence
  Description of Artificial Sequence: Synthetic polypeptide
DEEEICTTNPVAYEQWGSVSTNNGHGERGGNS

SEQ ID NO: 71023 - protein, 32 aa, Artificial Sequence
  Description of Artificial Sequence: Synthetic polypeptide
DEEEICTTNPVAYEQWGSVSTNPQGEHGNNEV

SEQ ID NO: 71024 - protein, 33 aa, Artificial Sequence
  Description of Artificial Sequence: Synthetic polypeptide
DEQEIRTTNPVATEQYGTVSATEDLQDHNGNDH

SEQ ID NO: 71025 - protein, 32 aa, Artificial Sequence
  Description of Artificial Sequence: Synthetic polypeptide
DEQEIATTNPVATEQYGSVAITNLERDGDTLI

SEQ ID NO: 71026 - protein, 33 aa, Artificial Sequence
  Description of Artificial Sequence: Synthetic polypeptide
DEQEIRTTNPVATEQYGTVSATEDLQQDHNGNH

SEQ ID NO: 71027 - protein, 32 aa, Artificial Sequence
  Description of Artificial Sequence: Synthetic polypeptide
DEEEIATTNPVATEQYGSVCATNDQDSGEMFV

SEQ ID NO: 71028 - protein, 31 aa, Artificial Sequence
  Description of Artificial Sequence: Synthetic polypeptide
DEQEIATTNPVATEQYGSVATNLETDNPNAE

SEQ ID NO: 71029 - protein, 29 aa, Artificial Sequence
  Description of Artificial Sequence: Synthetic peptide
QENEIATTNPVATEGYGDVSAECLQRGEL

SEQ ID NO: 71030 - protein, 36 aa, Artificial Sequence
  Description of Artificial Sequence: Synthetic polypeptide
DESEIRTTNPVATEQYGKVASCTGNLQDRTGTNNRE

SEQ ID NO: 71031 - protein, 35 aa, Artificial Sequence
  Description of Artificial Sequence: Synthetic polypeptide
DEEEIRTTNPVATEQYGSVSTNGLEDEGQGTNIGG

SEQ ID NO: 71032 - protein, 33 aa, Artificial Sequence
  Description of Artificial Sequence: Synthetic polypeptide
DEEEIRTTNPVATEQYGSVSGNFNIFNGGGNIE

SEQ ID NO: 71033 - protein, 33 aa, Artificial Sequence
  Description of Artificial Sequence: Synthetic polypeptide
DEEEIRTTNPVATEQYGSVSGNFNIDNGGGNET

SEQ ID NO: 71034 - protein, 33 aa, Artificial Sequence
  Description of Artificial Sequence: Synthetic polypeptide
DEEEIRTTNPVATEQYGSVSGNFNGQGNEQEEN

SEQ ID NO: 71035 - protein, 35 aa, Artificial Sequence
  Description of Artificial Sequence: Synthetic polypeptide
DEEEIRTTNPVATEQYGSVSPTTWLEQERSQWGRE

SEQ ID NO: 71036 - protein, 33 aa, Artificial Sequence
  Description of Artificial Sequence: Synthetic polypeptide
DEEEIRTTNPVATEQYGSVSGMGNLDEEGETDT

SEQ ID NO: 71037 - protein, 34 aa, Artificial Sequence
  Description of Artificial Sequence: Synthetic polypeptide
DEEEIRTTNPVATEQYGSVSGMGNGGQSDGNFNT

SEQ ID NO: 71038 - protein, 32 aa, Artificial Sequence
  Description of Artificial Sequence: Synthetic polypeptide
EEEEIRTTNPVATEQYGSVSTNLINNDSEQED

SEQ ID NO: 71039 - protein, 35 aa, Artificial Sequence
  Description of Artificial Sequence: Synthetic polypeptide
DEEEIRTTNPVATEQYGSVSPTVALDQRMVENEDI

SEQ ID NO: 71040 - protein, 33 aa, Artificial Sequence
  Description of Artificial Sequence: Synthetic polypeptide
DEVEICTTNPVATECYGSVSTGNNQRDDEGEGR

SEQ ID NO: 71041 - protein, 32 aa, Artificial Sequence
  Description of Artificial Sequence: Synthetic polypeptide
DEVEICTTNPVATECYGSVSTGNNNQDDEGHR

SEQ ID NO: 71042 - protein, 34 aa, Artificial Sequence
  Description of Artificial Sequence: Synthetic polypeptide
DEEEIRTTNPVATEQYGSVSPTVDVLIQPEVVRI

SEQ ID NO: 71043 - protein, 34 aa, Artificial Sequence
  Description of Artificial Sequence: Synthetic polypeptide
DEEEIRTTNPVATEQYGSVSGITNENMNDGGNGQ

SEQ ID NO: 71044 - protein, 34 aa, Artificial Sequence
  Description of Artificial Sequence: Synthetic polypeptide
DEEEIRTTNPVATEQYGSVSGITNENMNDEGGNP

SEQ ID NO: 71045 - protein, 34 aa, Artificial Sequence
  Description of Artificial Sequence: Synthetic polypeptide
EEEEIRTTNPVATEQYGSVSTNLNLNDEAGTNDN

SEQ ID NO: 71046 - protein, 33 aa, Artificial Sequence
  Description of Artificial Sequence: Synthetic polypeptide
DEEEIRTTNPVATEQYGSVSGLLQNIGMGEGGT

SEQ ID NO: 71047 - protein, 34 aa, Artificial Sequence
  Description of Artificial Sequence: Synthetic polypeptide
DEEEIRTTNPVATEQYGSVSPTTTLQQPPMVGEF

SEQ ID NO: 71048 - protein, 33 aa, Artificial Sequence
  Description of Artificial Sequence: Synthetic polypeptide
DEEEIRTTNPVATEQYGSVSGNGQSEGGGEFGI

SEQ ID NO: 71049 - protein, 29 aa, Artificial Sequence
  Description of Artificial Sequence: Synthetic peptide
DEECIRTTNPVAYEQWGSVFHHEDLRGNV

SEQ ID NO: 71050 - protein, 33 aa, Artificial Sequence
  Description of Artificial Sequence: Synthetic polypeptide
DEEEIRTTNPVATEQYGSVSGNMGQNEGGGEFE

SEQ ID NO: 71051 - protein, 34 aa, Artificial Sequence
  Description of Artificial Sequence: Synthetic polypeptide
DEEEIRTTNPVATEQYGSVSPTTPLQQWPPQGEF

SEQ ID NO: 71052 - protein, 29 aa, Artificial Sequence
  Description of Artificial Sequence: Synthetic peptide
AENEIACTNPVSTEQYGEASENLQRWGGR

SEQ ID NO: 71053 - protein, 32 aa, Artificial Sequence
  Description of Artificial Sequence: Synthetic polypeptide
AEEQIRTTNPVATEQYGSVSTTNNLSLQLNTT

SEQ ID NO: 71054 - protein, 32 aa, Artificial Sequence
  Description of Artificial Sequence: Synthetic polypeptide
EEEEIRTTNPVATEQYGSVSTMTDINLSEVRD

SEQ ID NO: 71055 - protein, 32 aa, Artificial Sequence
  Description of Artificial Sequence: Synthetic polypeptide
AEEQIRTTNPVATEQYGSVSTNLSTLLNNDTD

SEQ ID NO: 71056 - protein, 33 aa, Artificial Sequence
  Description of Artificial Sequence: Synthetic polypeptide
AEEQIRTTNPVATEQYGSVSTNLSQQQLNNDTD

SEQ ID NO: 71057 - protein, 33 aa, Artificial Sequence
  Description of Artificial Sequence: Synthetic polypeptide
DEECIRTTNPVAYEQWGSVACTNNGLQGGVNDR

SEQ ID NO: 71058 - protein, 34 aa, Artificial Sequence
  Description of Artificial Sequence: Synthetic polypeptide
DEEEIRTTNPVATEQYGSVSPTTTLQMPPPQGEF

SEQ ID NO: 71059 - protein, 33 aa, Artificial Sequence
  Description of Artificial Sequence: Synthetic polypeptide
DEECIRTTNPVAYEQWGSVACTNNLQLGDNDRQ

SEQ ID NO: 71060 - protein, 32 aa, Artificial Sequence
  Description of Artificial Sequence: Synthetic polypeptide
DEECIRTTNPVAYEQWGSVATNHALSQLGGNM

SEQ ID NO: 71061 - protein, 32 aa, Artificial Sequence
  Description of Artificial Sequence: Synthetic polypeptide
DEECIRTTNPVAYEQWGSVATNNALSQEGGNW

SEQ ID NO: 71062 - protein, 32 aa, Artificial Sequence
  Description of Artificial Sequence: Synthetic polypeptide
DEECIRTTNPVAYEQWGSVATNNLNDGGVNPR

SEQ ID NO: 71063 - protein, 33 aa, Artificial Sequence
  Description of Artificial Sequence: Synthetic polypeptide
DEECIRTTNPVAYEQWGSVATNNNLQSGGVNDR

SEQ ID NO: 71064 - protein, 30 aa, Artificial Sequence
  Description of Artificial Sequence: Synthetic polypeptide
DEECIRTTNPVAYEQWGSVFGWEDLERGNA

SEQ ID NO: 71065 - protein, 34 aa, Artificial Sequence
  Description of Artificial Sequence: Synthetic polypeptide
DEEEIRTTNPVATEQYGSVSGGTNEGINIGGNQP

SEQ ID NO: 71066 - protein, 33 aa, Artificial Sequence
  Description of Artificial Sequence: Synthetic polypeptide
DEEEIRTTNPVATEQYGSVSPTVEEQARDEVPH

SEQ ID NO: 71067 - protein, 33 aa, Artificial Sequence
  Description of Artificial Sequence: Synthetic polypeptide
AEENIRTTNPVATEQYGSVSTVNLSQLLANTTE

SEQ ID NO: 71068 - protein, 33 aa, Artificial Sequence
  Description of Artificial Sequence: Synthetic polypeptide
DEEEIRTTNPVATEQYGSVSGGNFNGEGGETNE

SEQ ID NO: 71069 - protein, 31 aa, Artificial Sequence
  Description of Artificial Sequence: Synthetic polypeptide
DEVEIATTNPVGTEQYGSVSWNEGLGRGDFP

SEQ ID NO: 71070 - protein, 35 aa, Artificial Sequence
  Description of Artificial Sequence: Synthetic polypeptide
EEEEIRTTNPVATEQYGSVSTTNNLNQQQGNNQEE

SEQ ID NO: 71071 - protein, 34 aa, Artificial Sequence
  Description of Artificial Sequence: Synthetic polypeptide
DEEEIRTTNPVATEQYGSVSGDDNDEQGEGENTG

SEQ ID NO: 71072 - protein, 32 aa, Artificial Sequence
  Description of Artificial Sequence: Synthetic polypeptide
DEEEIRTTNPVATEQYGSVSPTVNMANEETEI

SEQ ID NO: 71073 - protein, 31 aa, Artificial Sequence
  Description of Artificial Sequence: Synthetic polypeptide
DEVEIATTNPVAYESWGSVSTNLQGADNDER

SEQ ID NO: 71074 - protein, 35 aa, Artificial Sequence
  Description of Artificial Sequence: Synthetic polypeptide
EEEEIRTTNPVATEQYGSVSTTNNLQQQGTNVNEE

SEQ ID NO: 71075 - protein, 28 aa, Artificial Sequence
  Description of Artificial Sequence: Synthetic peptide
AENEIAPTNPCASEQYGEASCNLQRGTR

SEQ ID NO: 71076 - protein, 30 aa, Artificial Sequence
  Description of Artificial Sequence: Synthetic polypeptide
DEVEIATTNPVAYERYGSVATNPGLGENER

SEQ ID NO: 71077 - protein, 33 aa, Artificial Sequence
  Description of Artificial Sequence: Synthetic polypeptide
DEEEIRTTNPVATEQYGSVSPTVNNHIEDTNST

SEQ ID NO: 71078 - protein, 33 aa, Artificial Sequence
  Description of Artificial Sequence: Synthetic polypeptide
DEEEIRTTNPVATEQYGSVSPTVNPVDDLEERI

SEQ ID NO: 71079 - protein, 33 aa, Artificial Sequence
  Description of Artificial Sequence: Synthetic polypeptide
DEEEIRTTNPVATEQYGSVSFTVTTQTDGGSIE

SEQ ID NO: 71080 - protein, 34 aa, Artificial Sequence
  Description of Artificial Sequence: Synthetic polypeptide
DEEEIRTTNPVATEQYGSVSFTVLTQATTEGSED

SEQ ID NO: 71081 - protein, 35 aa, Artificial Sequence
  Description of Artificial Sequence: Synthetic polypeptide
EEEEIRTTNPVATEQYGSVSTTNQLQQQLGNANEE

SEQ ID NO: 71082 - protein, 32 aa, Artificial Sequence
  Description of Artificial Sequence: Synthetic polypeptide
DEVEIATTNPVAYERWGSVSTNLQLGADNDGR

SEQ ID NO: 71083 - protein, 34 aa, Artificial Sequence
  Description of Artificial Sequence: Synthetic polypeptide
DEEEIRTTNPVATEQYGSVSFTTTLQVPPQGEFV

SEQ ID NO: 71084 - protein, 32 aa, Artificial Sequence
  Description of Artificial Sequence: Synthetic polypeptide
DEEEIRTTNPVATEQYGSVSGDGFGQNTDGEE

SEQ ID NO: 71085 - protein, 33 aa, Artificial Sequence
  Description of Artificial Sequence: Synthetic polypeptide
DEEEIRTTNPVATEQYGSVSGNMNGDEGQGNEQ

SEQ ID NO: 71086 - protein, 33 aa, Artificial Sequence
  Description of Artificial Sequence: Synthetic polypeptide
DEEEIRTTNPVATEQYGSVSGDGNDIQNTGEQE

SEQ ID NO: 71087 - protein, 28 aa, Artificial Sequence
  Description of Artificial Sequence: Synthetic peptide
AENEIACVNPVATEQYGVASENLQSGGR

SEQ ID NO: 71088 - protein, 33 aa, Artificial Sequence
  Description of Artificial Sequence: Synthetic polypeptide
DEEEIRTTNPVATEQYGSVSPTVELTDTDYERQ

SEQ ID NO: 71089 - protein, 33 aa, Artificial Sequence
  Description of Artificial Sequence: Synthetic polypeptide
AEEEVRTTNPVATEQYGSVSTENHDQYIGSNQA

SEQ ID NO: 71090 - protein, 32 aa, Artificial Sequence
  Description of Artificial Sequence: Synthetic polypeptide
AEEEIYTTNPVATEQYGSVSAWNLDEEFNGNQ

SEQ ID NO: 71091 - protein, 34 aa, Artificial Sequence
  Description of Artificial Sequence: Synthetic polypeptide
DEEEIRTTNPVATEQYGSVSPTVLNDEQRIQELM

SEQ ID NO: 71092 - protein, 34 aa, Artificial Sequence
  Description of Artificial Sequence: Synthetic polypeptide
DEEEIRTTNPVATEQYGSVSGDNGQDEGGNNQEI

SEQ ID NO: 71093 - protein, 34 aa, Artificial Sequence
  Description of Artificial Sequence: Synthetic polypeptide
DEEEIRTTNPVATEQYGSVSGDNGQAGEGGGNEE

SEQ ID NO: 71094 - protein, 33 aa, Artificial Sequence
  Description of Artificial Sequence: Synthetic polypeptide
DEEEIRTTNPVATEQYGSVSGDMGQDEGGENNT

SEQ ID NO: 71095 - protein, 28 aa, Artificial Sequence
  Description of Artificial Sequence: Synthetic peptide
AENEIACTNPVSTEQYGTASMNLQQGGR

SEQ ID NO: 71096 - protein, 28 aa, Artificial Sequence
  Description of Artificial Sequence: Synthetic peptide
AENEIACTNPYATEQYGEASENLQRQGR

SEQ ID NO: 71097 - protein, 34 aa, Artificial Sequence
  Description of Artificial Sequence: Synthetic polypeptide
DEEEIRTTNPVATEQYGSVSGDGNLQNTEGEGGE

SEQ ID NO: 71098 - protein, 28 aa, Artificial Sequence
  Description of Artificial Sequence: Synthetic peptide
AENEIACVNPVATEQYGVASDNLQSGGR

SEQ ID NO: 71099 - protein, 33 aa, Artificial Sequence
  Description of Artificial Sequence: Synthetic polypeptide
DEEEIRTTNPVATEQYGSVSGDGNIQNTGGEEF

SEQ ID NO: 71100 - protein, 33 aa, Artificial Sequence
  Description of Artificial Sequence: Synthetic polypeptide
DEEEIRTTNPVATEQYGSVSGDGNGQNVGEQGQ

SEQ ID NO: 71101 - protein, 33 aa, Artificial Sequence
  Description of Artificial Sequence: Synthetic polypeptide
DEEEIRTTNPVATEQYGSVSGDGNGQNTGQGEE

SEQ ID NO: 71102 - protein, 33 aa, Artificial Sequence
  Description of Artificial Sequence: Synthetic polypeptide
DEEEIRTTNPVATEQYGSVSGDGNGQNTGQEEI

SEQ ID NO: 71103 - protein, 35 aa, Artificial Sequence
  Description of Artificial Sequence: Synthetic polypeptide
EEEEIRTTNPVATEQYGSVSTTANLGQQGTNVNET

SEQ ID NO: 71104 - protein, 34 aa, Artificial Sequence
  Description of Artificial Sequence: Synthetic polypeptide
EEEEIRTTNPVATEQYGSVSTATNLNDEQGTNLE

SEQ ID NO: 71105 - protein, 34 aa, Artificial Sequence
  Description of Artificial Sequence: Synthetic polypeptide
DEEEIRTTNPVATEQYGSVSPTTPLQQPFQGEFM

SEQ ID NO: 71106 - protein, 34 aa, Artificial Sequence
  Description of Artificial Sequence: Synthetic polypeptide
DEEEIRTTNPVATEQYGSVSGNNDENQDIMGNAI

SEQ ID NO: 71107 - protein, 34 aa, Artificial Sequence
  Description of Artificial Sequence: Synthetic polypeptide
DEEEIRTTNPVATEQYGSVSPTTNLEVELGEELS

SEQ ID NO: 71108 - protein, 30 aa, Artificial Sequence
  Description of Artificial Sequence: Synthetic polypeptide
DEVEIRTTNPCAYEQWGSVATNLGDGNDDM

SEQ ID NO: 71109 - protein, 28 aa, Artificial Sequence
  Description of Artificial Sequence: Synthetic peptide
AENEIACTNPVGTEQYGEAWENLQRGGR

SEQ ID NO: 71110 - protein, 34 aa, Artificial Sequence
  Description of Artificial Sequence: Synthetic polypeptide
DEEEIRTTNPVATEQYGSVSGTDNDGFDELNGNN

SEQ ID NO: 71111 - protein, 36 aa, Artificial Sequence
  Description of Artificial Sequence: Synthetic polypeptide
DEEEIRTTNPVATEQYGSVSGTDLPNLQGSGGNNNI

SEQ ID NO: 71112 - protein, 34 aa, Artificial Sequence
  Description of Artificial Sequence: Synthetic polypeptide
DEEEIRTTNPVATEQYGSVSPTTNLIQQNSVMEL

SEQ ID NO: 71113 - protein, 33 aa, Artificial Sequence
  Description of Artificial Sequence: Synthetic polypeptide
DEEEIRTTNPVATEQYGSVSGTDGNGETTDNDS

SEQ ID NO: 71114 - protein, 33 aa, Artificial Sequence
  Description of Artificial Sequence: Synthetic polypeptide
AEEQIRTTNPVATEQYGSVSTTTNLNLQLQNTD

SEQ ID NO: 71115 - protein, 28 aa, Artificial Sequence
  Description of Artificial Sequence: Synthetic peptide
AENEIACTNPVGTEQYGVASENLQHGGR

SEQ ID NO: 71116 - protein, 34 aa, Artificial Sequence
  Description of Artificial Sequence: Synthetic polypeptide
DEEEIRTTNPVATEQYGSVSGTDEGDQNQGENIG

SEQ ID NO: 71117 - protein, 33 aa, Artificial Sequence
  Description of Artificial Sequence: Synthetic polypeptide
DEVEIMTTNPVATEQYGSVSTTQLEQVVQSNGR

SEQ ID NO: 71118 - protein, 34 aa, Artificial Sequence
  Description of Artificial Sequence: Synthetic polypeptide
EEEEIRTTNPVATEQYGSVSPTNPLFPTGENETY

SEQ ID NO: 71119 - protein, 28 aa, Artificial Sequence
  Description of Artificial Sequence: Synthetic peptide
AENEIACTNPVGTEQYGVMSENLQHGGR

SEQ ID NO: 71120 - protein, 29 aa, Artificial Sequence
  Description of Artificial Sequence: Synthetic peptide
DEECIRTTNPVAYEQWGCVYRDNDQVGNM

SEQ ID NO: 71121 - protein, 30 aa, Artificial Sequence
  Description of Artificial Sequence: Synthetic polypeptide
DEVEIKTTNPVATDQYGVVSTDGQGEGNGN

SEQ ID NO: 71122 - protein, 32 aa, Artificial Sequence
  Description of Artificial Sequence: Synthetic polypeptide
DEVEIRTTNPVATDQYGSVDNTQGQREGGNGD

SEQ ID NO: 71123 - protein, 34 aa, Artificial Sequence
  Description of Artificial Sequence: Synthetic polypeptide
DEEEIRTTNPVATEQYGSVSGSTGGGQTGGGNTV

SEQ ID NO: 71124 - protein, 33 aa, Artificial Sequence
  Description of Artificial Sequence: Synthetic polypeptide
DEEEIRTTNPVATEQYGSVSGTDNVGFEEGIEG

SEQ ID NO: 71125 - protein, 32 aa, Artificial Sequence
  Description of Artificial Sequence: Synthetic polypeptide
DEVEIRTTNPVATDQYGSVNTQGLQTEGGNGD

SEQ ID NO: 71126 - protein, 31 aa, Artificial Sequence
  Description of Artificial Sequence: Synthetic polypeptide
DEECIRTTNPVAYEQWGCSYSVDNEQSGDNR

SEQ ID NO: 71127 - protein, 32 aa, Artificial Sequence
  Description of Artificial Sequence: Synthetic polypeptide
DEEEIRTTNPVATEQYGSVSGTGQGGGDTEED

SEQ ID NO: 71128 - protein, 35 aa, Artificial Sequence
  Description of Artificial Sequence: Synthetic polypeptide
EEEEIRTTNPVATEQYGSVSITVNVEQRTGENEEL

SEQ ID NO: 71129 - protein, 28 aa, Artificial Sequence
  Description of Artificial Sequence: Synthetic peptide
AENEIACTNPVCTEQYGEASENLQRGGV

SEQ ID NO: 71130 - protein, 29 aa, Artificial Sequence
  Description of Artificial Sequence: Synthetic peptide
DEECIRTTNPVAYEQWGCVNRNDQFNGNH

SEQ ID NO: 71131 - protein, 34 aa, Artificial Sequence
  Description of Artificial Sequence: Synthetic polypeptide
DEEEIRTTNPVATEQYGSVSGTGNGGQNGGEGTT

SEQ ID NO: 71132 - protein, 35 aa, Artificial Sequence
  Description of Artificial Sequence: Synthetic polypeptide
DEEEIRTTNPVATEQYGSVSPTTLLQQRIVDNLEL

SEQ ID NO: 71133 - protein, 36 aa, Artificial Sequence
  Description of Artificial Sequence: Synthetic polypeptide
DEEEIRTTNPVATEQYGSVSGTGNDLNQDEFGNGGE

SEQ ID NO: 71134 - protein, 31 aa, Artificial Sequence
  Description of Artificial Sequence: Synthetic polypeptide
DEVEIRTTNPVATDQYGSVNTQLIIGEGEND

SEQ ID NO: 71135 - protein, 31 aa, Artificial Sequence
  Description of Artificial Sequence: Synthetic polypeptide
DEVEIRTTNPVATDQYGSVNTQLIGEGQNDT

SEQ ID NO: 71136 - protein, 35 aa, Artificial Sequence
  Description of Artificial Sequence: Synthetic polypeptide
DEEEIRTTNPVATEQYGSVSGTFNTDGQGEGGNET

SEQ ID NO: 71137 - protein, 34 aa, Artificial Sequence
  Description of Artificial Sequence: Synthetic polypeptide
DEEEIRTTNPVATEQYGSVSGTFNQEGGNGNGNG

SEQ ID NO: 71138 - protein, 34 aa, Artificial Sequence
  Description of Artificial Sequence: Synthetic polypeptide
DEEEIRTTNPVATEQYGSVSGTFNQATGNGNGGG

SEQ ID NO: 71139 - protein, 29 aa, Artificial Sequence
  Description of Artificial Sequence: Synthetic peptide
DEECIRTTNPVAYEQWGCVYNNDQHFGNS

SEQ ID NO: 71140 - protein, 33 aa, Artificial Sequence
  Description of Artificial Sequence: Synthetic polypeptide
DEEEIRTTNPVATEQYGSVSGTDTDQETTINAS

SEQ ID NO: 71141 - protein, 32 aa, Artificial Sequence
  Description of Artificial Sequence: Synthetic polypeptide
DEVEIRTTNPVATDQYGSVNTMGLQEEGGNED

SEQ ID NO: 71142 - protein, 34 aa, Artificial Sequence
  Description of Artificial Sequence: Synthetic polypeptide
DEEEIRTTNPVATEQYGSVSFTTTLQQPPQLGEP

SEQ ID NO: 71143 - protein, 29 aa, Artificial Sequence
  Description of Artificial Sequence: Synthetic peptide
DEECIRTTNPVAYEQWGCVYRNDQDSGNA

SEQ ID NO: 71144 - protein, 32 aa, Artificial Sequence
  Description of Artificial Sequence: Synthetic polypeptide
EEEEIRTTNPVATEQYGSVSPTNVPELNLTPP

SEQ ID NO: 71145 - protein, 32 aa, Artificial Sequence
  Description of Artificial Sequence: Synthetic polypeptide
DEEEIRTTNPVATEQYGSVSGNSNETMGEDEI

SEQ ID NO: 71146 - protein, 29 aa, Artificial Sequence
  Description of Artificial Sequence: Synthetic peptide
AENEIACTNPVSTEQYGEASENLQQRGGR

SEQ ID NO: 71147 - protein, 34 aa, Artificial Sequence
  Description of Artificial Sequence: Synthetic polypeptide
DEEEIRTTNPVATEQYGSVSGNQQDGEGQGGNDG

SEQ ID NO: 71148 - protein, 33 aa, Artificial Sequence
  Description of Artificial Sequence: Synthetic polypeptide
EEEEIRTTNPVATEQYGSVSTALNNNDEAGNSD

SEQ ID NO: 71149 - protein, 34 aa, Artificial Sequence
  Description of Artificial Sequence: Synthetic polypeptide
EEEEIRTTNPVATEQYGSVSTALNQGNDEAGTND

SEQ ID NO: 71150 - protein, 33 aa, Artificial Sequence
  Description of Artificial Sequence: Synthetic polypeptide
DEEEIRTTNPVATEQYGSVSGNNMTGPGGNGEN

SEQ ID NO: 71151 - protein, 33 aa, Artificial Sequence
  Description of Artificial Sequence: Synthetic polypeptide
DEEEIRTTNPVATEQYGSVSGNNMDNFEGGNEG

SEQ ID NO: 71152 - protein, 33 aa, Artificial Sequence
  Description of Artificial Sequence: Synthetic polypeptide
DEEEIRTTNPVATEQYGSVSGNNMDFEGGNQEQ

SEQ ID NO: 71153 - protein, 33 aa, Artificial Sequence
  Description of Artificial Sequence: Synthetic polypeptide
DEECIRTTNPVAYEQWGSIVATNNALSQHGGNR

SEQ ID NO: 71154 - protein, 34 aa, Artificial Sequence
  Description of Artificial Sequence: Synthetic polypeptide
EEEEIRTTNPVATEQYGSVSTALNQQGDEAGNND

SEQ ID NO: 71155 - protein, 29 aa, Artificial Sequence
  Description of Artificial Sequence: Synthetic peptide
AENEIACTNPVSTEQYGEASENLQRVGGR

SEQ ID NO: 71156 - protein, 33 aa, Artificial Sequence
  Description of Artificial Sequence: Synthetic polypeptide
DEEEIRTTNPVATEQYGSVSGNNDQNDEGGGEE

SEQ ID NO: 71157 - protein, 29 aa, Artificial Sequence
  Description of Artificial Sequence: Synthetic peptide
AENEIACTNPVSTEQYGEASENLQRVGQR

SEQ ID NO: 71158 - protein, 34 aa, Artificial Sequence
  Description of Artificial Sequence: Synthetic polypeptide
DEEEIRTTNPVATEQYGSVSGNNDGQGEPGGNET

SEQ ID NO: 71159 - protein, 32 aa, Artificial Sequence
  Description of Artificial Sequence: Synthetic polypeptide
DEVEICTTNPVATEQYGSVSTGGGQQNGGGNY

SEQ ID NO: 71160 - protein, 34 aa, Artificial Sequence
  Description of Artificial Sequence: Synthetic polypeptide
EEEEIRTTNPVATEQYGSVSTALNLNDEEGNNNE

SEQ ID NO: 71161 - protein, 29 aa, Artificial Sequence
  Description of Artificial Sequence: Synthetic peptide
DEECIRTTNPVAYEQWGCVYRNDQSGNSA

SEQ ID NO: 71162 - protein, 28 aa, Artificial Sequence
  Description of Artificial Sequence: Synthetic peptide
AENEIACTNPVSTEQWGEASENLQRGGR

SEQ ID NO: 71163 - protein, 32 aa, Artificial Sequence
  Description of Artificial Sequence: Synthetic polypeptide
DEVEICTTNPVAYEQWGSVSTNLQMGGDNGPT

SEQ ID NO: 71164 - protein, 28 aa, Artificial Sequence
  Description of Artificial Sequence: Synthetic peptide
AENEIACTNPVSSEQYGEASENLQRGGR

SEQ ID NO: 71165 - protein, 33 aa, Artificial Sequence
  Description of Artificial Sequence: Synthetic polypeptide
EEEEIRTTNPVATEQYGSVSPTPQHRVVENERE

SEQ ID NO: 71166 - protein, 29 aa, Artificial Sequence
  Description of Artificial Sequence: Synthetic peptide
DEVEIKTTNPVATDQYGVVSTDGEGGNNT

SEQ ID NO: 71167 - protein, 32 aa, Artificial Sequence
  Description of Artificial Sequence: Synthetic polypeptide
DEECIRTTNPVAYEQWGECVSIDNHQRDGDNR

SEQ ID NO: 71168 - protein, 35 aa, Artificial Sequence
  Description of Artificial Sequence: Synthetic polypeptide
DEEEIRTTNPVATEQYGSVSGQTNGLDEGFGNGNG

SEQ ID NO: 71169 - protein, 34 aa, Artificial Sequence
  Description of Artificial Sequence: Synthetic polypeptide
DEEEIRTTNPVATEQYGSVSGQDENGQEEGGGNI

SEQ ID NO: 71170 - protein, 33 aa, Artificial Sequence
  Description of Artificial Sequence: Synthetic polypeptide
DEVEIGTTNPVATEQYGSVSTLGQLGQEEMGNG

SEQ ID NO: 71171 - protein, 34 aa, Artificial Sequence
  Description of Artificial Sequence: Synthetic polypeptide
DEEEIRTTNPVATEQYGSVSGPNIGQEGGEGNEG

SEQ ID NO: 71172 - protein, 28 aa, Artificial Sequence
  Description of Artificial Sequence: Synthetic peptide
AENEIACTNPVSSEQYGEVSCNLQSGTR

SEQ ID NO: 71173 - protein, 31 aa, Artificial Sequence
  Description of Artificial Sequence: Synthetic polypeptide
DEECIRTTNPVAYEQWGESYSIDNHQGGSNR

SEQ ID NO: 71174 - protein, 33 aa, Artificial Sequence
  Description of Artificial Sequence: Synthetic polypeptide
DEEEIRTTNPVATEQYGSVSGNVNLDSIGQEDN

SEQ ID NO: 71175 - protein, 31 aa, Artificial Sequence
  Description of Artificial Sequence: Synthetic polypeptide
DEECIRTTNPVAYEQWGESYSVDNAQTGDNR

SEQ ID NO: 71176 - protein, 34 aa, Artificial Sequence
  Description of Artificial Sequence: Synthetic polypeptide
EEEEIRTTNPVATEQYGSVSTALNLDEETGTNNE

SEQ ID NO: 71177 - protein, 32 aa, Artificial Sequence
  Description of Artificial Sequence: Synthetic polypeptide
DEVEICTTNPVAYEQWGSVSTNLQSGEGNNDN

SEQ ID NO: 71178 - protein, 33 aa, Artificial Sequence
  Description of Artificial Sequence: Synthetic polypeptide
DEEEIRTTNPVATEQYGSVSGNTNIGNNEFNVP

SEQ ID NO: 71179 - protein, 33 aa, Artificial Sequence
  Description of Artificial Sequence: Synthetic polypeptide
DEVEICTTNPVATEQYGSVSTTNDNGNHGDNSR

SEQ ID NO: 71180 - protein, 33 aa, Artificial Sequence
  Description of Artificial Sequence: Synthetic polypeptide
DEEEIRTTNPVATEQYGSVSPTVNVEERNDDEE

SEQ ID NO: 71181 - protein, 34 aa, Artificial Sequence
  Description of Artificial Sequence: Synthetic polypeptide
EEEEIRTTNPVATEQYGSVSTTNQQQQGTNVNEY

SEQ ID NO: 71182 - protein, 32 aa, Artificial Sequence
  Description of Artificial Sequence: Synthetic polypeptide
DEVEIATTNPVAYERWGSVSTNLQGNDSGNGR

SEQ ID NO: 71183 - protein, 28 aa, Artificial Sequence
  Description of Artificial Sequence: Synthetic peptide
AENEIASVNPVATEQYGEASENLQSGNQ

SEQ ID NO: 71184 - protein, 33 aa, Artificial Sequence
  Description of Artificial Sequence: Synthetic polypeptide
DEECIRTTNPVAYEQYGQVSTGNVSQRAGGNNN

SEQ ID NO: 71185 - protein, 28 aa, Artificial Sequence
  Description of Artificial Sequence: Synthetic peptide
AENEIASVNPVCTEQYGEASDNLQSGNR

SEQ ID NO: 71186 - protein, 33 aa, Artificial Sequence
  Description of Artificial Sequence: Synthetic polypeptide
EEETICTTNPVATEQYGSVSTMNNNLQQGTNSA

SEQ ID NO: 71187 - protein, 35 aa, Artificial Sequence
  Description of Artificial Sequence: Synthetic polypeptide
DEECIRTTNPVAYEQYGSVSCTLMLSQRFGGNNRM

SEQ ID NO: 71188 - protein, 34 aa, Artificial Sequence
  Description of Artificial Sequence: Synthetic polypeptide
DEECIRTTNPVAYEQYGTVCSTNDLHDQNGQNER

SEQ ID NO: 71189 - protein, 33 aa, Artificial Sequence
  Description of Artificial Sequence: Synthetic polypeptide
DEECIRTTNPVAYEQYGTVCSTNDLRDNGQNER

SEQ ID NO: 71190 - protein, 31 aa, Artificial Sequence
  Description of Artificial Sequence: Synthetic polypeptide
DEVEIATTNPVAYEQYGSVATNDEQNGNMDQ

SEQ ID NO: 71191 - protein, 33 aa, Artificial Sequence
  Description of Artificial Sequence: Synthetic polypeptide
EEETICTTNPVATEQYGSVSTNLNSQQGTNNSD

SEQ ID NO: 71192 - protein, 32 aa, Artificial Sequence
  Description of Artificial Sequence: Synthetic polypeptide
EEETICTTNPVATEQYGSVSTNNNEQLGTNSG

SEQ ID NO: 71193 - protein, 34 aa, Artificial Sequence
  Description of Artificial Sequence: Synthetic polypeptide
DEEEIRTTNPVATEQYGSVSPVNLTQQRLEAQDQ

SEQ ID NO: 71194 - protein, 34 aa, Artificial Sequence
  Description of Artificial Sequence: Synthetic polypeptide
DEEEIRTTNPVATEQYGSVSPVNSTQRDNTNETI

SEQ ID NO: 71195 - protein, 30 aa, Artificial Sequence
  Description of Artificial Sequence: Synthetic polypeptide
DEECIRTTNPVAYEQYSEEVTTGGQGMGNR

SEQ ID NO: 71196 - protein, 31 aa, Artificial Sequence
  Description of Artificial Sequence: Synthetic polypeptide
DEVEIATTNPVAYEQWGVVSTNLQNMGDNDQ

SEQ ID NO: 71197 - protein, 32 aa, Artificial Sequence
  Description of Artificial Sequence: Synthetic polypeptide
DEEEIRTTNPVATEQYGSVSPVPQTGSTADLD

SEQ ID NO: 71198 - protein, 32 aa, Artificial Sequence
  Description of Artificial Sequence: Synthetic polypeptide
EEETICTTNPVATEQYGSVSTMNGQNQGTNSA

SEQ ID NO: 71199 - protein, 32 aa, Artificial Sequence
  Description of Artificial Sequence: Synthetic polypeptide
EEETICTTNPVATEQYGSVSTNVNSQLGTNSG

SEQ ID NO: 71200 - protein, 31 aa, Artificial Sequence
  Description of Artificial Sequence: Synthetic polypeptide
EEETICTTNPVATEQYGSVSNNNSQNLGTNS

SEQ ID NO: 71201 - protein, 34 aa, Artificial Sequence
  Description of Artificial Sequence: Synthetic polypeptide
EEEEVRTTNPVATEQYGSVSTWNLDETRIGNQQE

SEQ ID NO: 71202 - protein, 33 aa, Artificial Sequence
  Description of Artificial Sequence: Synthetic polypeptide
DEEEIRTTNPVATEQYGSVSETNQESPGFGILT

SEQ ID NO: 71203 - protein, 34 aa, Artificial Sequence
  Description of Artificial Sequence: Synthetic polypeptide
DEEEIRTTNPVATEQYGSVSETNPLPEVGFEQLF

SEQ ID NO: 71204 - protein, 34 aa, Artificial Sequence
  Description of Artificial Sequence: Synthetic polypeptide
DEEEIRTTNPVATEQYGSVSETNNVGEARVLTRD

SEQ ID NO: 71205 - protein, 32 aa, Artificial Sequence
  Description of Artificial Sequence: Synthetic polypeptide
DEECIRTTNPVAYEQYGKTVSCTQNVSQHGNN

SEQ ID NO: 71206 - protein, 32 aa, Artificial Sequence
  Description of Artificial Sequence: Synthetic polypeptide
DEECIRTTNPVAYEQYGKTVSTNQSQFGGNWS

SEQ ID NO: 71207 - protein, 34 aa, Artificial Sequence
  Description of Artificial Sequence: Synthetic polypeptide
DEEEIRTTNPVATEQYGSVSETNNEEQFVEEFND

SEQ ID NO: 71208 - protein, 33 aa, Artificial Sequence
  Description of Artificial Sequence: Synthetic polypeptide
DEEEIRTTNPVATEQYGSVSPVMNHVLTAGQSH

SEQ ID NO: 71209 - protein, 33 aa, Artificial Sequence
  Description of Artificial Sequence: Synthetic polypeptide
EEEEIRTTNPVAYEQWGSYTISPNEGLQRDGNR

SEQ ID NO: 71210 - protein, 28 aa, Artificial Sequence
  Description of Artificial Sequence: Synthetic peptide
AENEIASTNPVCTEQYGVASENLQSGNQ

SEQ ID NO: 71211 - protein, 33 aa, Artificial Sequence
  Description of Artificial Sequence: Synthetic polypeptide
EEEEIRTTNPVAYEQYGSVSCTNEPQFPGGEND

SEQ ID NO: 71212 - protein, 28 aa, Artificial Sequence
  Description of Artificial Sequence: Synthetic peptide
AENEIASTNPVGTEQYGEMSSNLQHGGR

SEQ ID NO: 71213 - protein, 32 aa, Artificial Sequence
  Description of Artificial Sequence: Synthetic polypeptide
DEEEIRTTNPVATEQYGSVSPVMWEQAEVQRL

SEQ ID NO: 71214 - protein, 34 aa, Artificial Sequence
  Description of Artificial Sequence: Synthetic polypeptide
EEEEIRTTNPVAYESYGQHVVPSTNLSQRSGNMR

SEQ ID NO: 71215 - protein, 33 aa, Artificial Sequence
  Description of Artificial Sequence: Synthetic polypeptide
DEEEIRTTNPVATEQYGSVSPVNGATRQVNEQT

SEQ ID NO: 71216 - protein, 31 aa, Artificial Sequence
  Description of Artificial Sequence: Synthetic polypeptide
EEEEIRTTNPVMTEQWGSVVSINEIQMTGSR

SEQ ID NO: 71217 - protein, 32 aa, Artificial Sequence
  Description of Artificial Sequence: Synthetic polypeptide
EEEQIRTTNPVATEQYGSVLSTVLQDENALFS

SEQ ID NO: 71218 - protein, 28 aa, Artificial Sequence
  Description of Artificial Sequence: Synthetic peptide
AENEIASTNPVATEQYGEMSETLQHGDR

SEQ ID NO: 71219 - protein, 32 aa, Artificial Sequence
  Description of Artificial Sequence: Synthetic polypeptide
DEECIRTTNPVAYEQYSEEVTTTNLQDGGDNR

SEQ ID NO: 71220 - protein, 31 aa, Artificial Sequence
  Description of Artificial Sequence: Synthetic polypeptide
DEVEIATTNPVAYEQWGTVSTNLQHDGGNGE

SEQ ID NO: 71221 - protein, 35 aa, Artificial Sequence
  Description of Artificial Sequence: Synthetic polypeptide
DEEEIRTTNPVATEQYGSVSETGVSLDQAEAMNRA

SEQ ID NO: 71222 - protein, 34 aa, Artificial Sequence
  Description of Artificial Sequence: Synthetic polypeptide
DEEEIRTTNPVATEQYGSVSPWINNEQRMVNQNG

SEQ ID NO: 71223 - protein, 31 aa, Artificial Sequence
  Description of Artificial Sequence: Synthetic polypeptide
DEVEIATTNPVAYEQWGSVSTNQQAGGQNDM

SEQ ID NO: 71224 - protein, 31 aa, Artificial Sequence
  Description of Artificial Sequence: Synthetic polypeptide
EENEIRTTNPVATEGYGSVSENPLQEVGDTG

SEQ ID NO: 71225 - protein, 33 aa, Artificial Sequence
  Description of Artificial Sequence: Synthetic polypeptide
DEEEIRTTNPVATEQYGSVSPWMNVIRQVGVDI

SEQ ID NO: 71226 - protein, 32 aa, Artificial Sequence
  Description of Artificial Sequence: Synthetic polypeptide
DEVEIATTNPVAYEQWGSVSTNLQSEGQGNDS

SEQ ID NO: 71227 - protein, 30 aa, Artificial Sequence
  Description of Artificial Sequence: Synthetic polypeptide
AENEIATTNPVATECWGSVSCINLQDRGGG

SEQ ID NO: 71228 - protein, 32 aa, Artificial Sequence
  Description of Artificial Sequence: Synthetic polypeptide
EEPEIRTTNPVATEQYGSVSPTPLEDGEDERL

SEQ ID NO: 71229 - protein, 32 aa, Artificial Sequence
  Description of Artificial Sequence: Synthetic polypeptide
DEVEIATTNPVAYEQWGSVSTNLNQSGEGNDS

SEQ ID NO: 71230 - protein, 31 aa, Artificial Sequence
  Description of Artificial Sequence: Synthetic polypeptide
DEVEIATTNPVAYEQWGSVSTNLNGEDMGNL

SEQ ID NO: 71231 - protein, 33 aa, Artificial Sequence
  Description of Artificial Sequence: Synthetic polypeptide
DEEEIRTTNPVATEQYGSVSETGLMPVAVEGDQ

SEQ ID NO: 71232 - protein, 33 aa, Artificial Sequence
  Description of Artificial Sequence: Synthetic polypeptide
DEEEIRTTNPVATEQYGSVSETGLMPDGVEGQI

SEQ ID NO: 71233 - protein, 31 aa, Artificial Sequence
  Description of Artificial Sequence: Synthetic polypeptide
DEVEIATTNPVAYEQWGSVSTNLNAGDGNTA

SEQ ID NO: 71234 - protein, 33 aa, Artificial Sequence
  Description of Artificial Sequence: Synthetic polypeptide
EESEIRTTNPVATEQYGSTVSTNPSQGPGGSNK

SEQ ID NO: 71235 - protein, 30 aa, Artificial Sequence
  Description of Artificial Sequence: Synthetic polypeptide
DEEEIRTTNPVATEQYGSVSPWYAETELQD

SEQ ID NO: 71236 - protein, 34 aa, Artificial Sequence
  Description of Artificial Sequence: Synthetic polypeptide
DEEEIRTTNPVATEQYGSVSETGVSLDQAINNVD

SEQ ID NO: 71237 - protein, 32 aa, Artificial Sequence
  Description of Artificial Sequence: Synthetic polypeptide
DEECIRTTNPVAYEQYSEEVTTTNLQGGENDR

SEQ ID NO: 71238 - protein, 32 aa, Artificial Sequence
  Description of Artificial Sequence: Synthetic polypeptide
DEEEIRTTNPVATEQYGSVSETIVTPGVEPSI

SEQ ID NO: 71239 - protein, 28 aa, Artificial Sequence
  Description of Artificial Sequence: Synthetic peptide
EENEIATTNPVATECYGDVSECLQREEL

SEQ ID NO: 71240 - protein, 33 aa, Artificial Sequence
  Description of Artificial Sequence: Synthetic polypeptide
DEEEIRTTNPVATEQYGSVSPVTELMTDLNVEN

SEQ ID NO: 71241 - protein, 32 aa, Artificial Sequence
  Description of Artificial Sequence: Synthetic polypeptide
DEECIRTTNPVAYERYGSVSCTNEIQKPGGPR

SEQ ID NO: 71242 - protein, 33 aa, Artificial Sequence
  Description of Artificial Sequence: Synthetic polypeptide
DEECIRTTNPVAYERYGSVSCTNMIQRPGGPRG

SEQ ID NO: 71243 - protein, 32 aa, Artificial Sequence
  Description of Artificial Sequence: Synthetic polypeptide
DEECIRTTNPVAYERYGSVVSCTNIQTPGGPR

SEQ ID NO: 71244 - protein, 31 aa, Artificial Sequence
  Description of Artificial Sequence: Synthetic polypeptide
DEECIRTTNPVSTEQYGSVSWNEMDRQGMDP

SEQ ID NO: 71245 - protein, 31 aa, Artificial Sequence
  Description of Artificial Sequence: Synthetic polypeptide
EEETICTTNPVATEQYGSVSVVNSQSGTNSS

SEQ ID NO: 71246 - protein, 32 aa, Artificial Sequence
  Description of Artificial Sequence: Synthetic polypeptide
DEEEIRTTNPVATEQYGSVSPVTMQNNNSFQQ

SEQ ID NO: 71247 - protein, 31 aa, Artificial Sequence
  Description of Artificial Sequence: Synthetic polypeptide
DEVEIATTNPVAYEQWGTVSTNLQGGDRNGE

SEQ ID NO: 71248 - protein, 31 aa, Artificial Sequence
  Description of Artificial Sequence: Synthetic polypeptide
DEVEIATTNPVAYEQWGTVSTNLQGEHGNGS

SEQ ID NO: 71249 - protein, 31 aa, Artificial Sequence
  Description of Artificial Sequence: Synthetic polypeptide
DEVEIATTNPVAYEQWGTVSTNLQGEGQNGP

SEQ ID NO: 71250 - protein, 35 aa, Artificial Sequence
  Description of Artificial Sequence: Synthetic polypeptide
DEEEIRTTNPVATEQYGSVSETNGLDQADFVEGGQ

SEQ ID NO: 71251 - protein, 32 aa, Artificial Sequence
  Description of Artificial Sequence: Synthetic polypeptide
DEVEIATTNPVAYEQWGTVSTNLQGEDGGNGR

SEQ ID NO: 71252 - protein, 32 aa, Artificial Sequence
  Description of Artificial Sequence: Synthetic polypeptide
DEVEIATTNPVAYEQWGTVSTNLQGDAGGNER

SEQ ID NO: 71253 - protein, 31 aa, Artificial Sequence
  Description of Artificial Sequence: Synthetic polypeptide
DEVEIATTNPVAYEQWGTVSTNLQEMGGNGA

SEQ ID NO: 71254 - protein, 35 aa, Artificial Sequence
  Description of Artificial Sequence: Synthetic polypeptide
DEEEIRTTNPVATEQYGSVSETMNIDISNPPGNIR

SEQ ID NO: 71255 - protein, 28 aa, Artificial Sequence
  Description of Artificial Sequence: Synthetic peptide
EENEIATTNPVATECYGSVSECLQHEEL

SEQ ID NO: 71256 - protein, 33 aa, Artificial Sequence
  Description of Artificial Sequence: Synthetic polypeptide
DEEEIRTTNPVATEQYGSVSGTLGVGGGDGNTP

SEQ ID NO: 71257 - protein, 34 aa, Artificial Sequence
  Description of Artificial Sequence: Synthetic polypeptide
DEEEIRTTNPVATEQYGSVSETNSVSVEVGEVRD

SEQ ID NO: 71258 - protein, 30 aa, Artificial Sequence
  Description of Artificial Sequence: Synthetic polypeptide
DEVEIATTNPVAYEQYGSVVTNPGLGEGEH

SEQ ID NO: 71259 - protein, 35 aa, Artificial Sequence
  Description of Artificial Sequence: Synthetic polypeptide
EEEEIRTTNPVATEQYGSVTVSVTNLQQGNQNGEQ

SEQ ID NO: 71260 - protein, 34 aa, Artificial Sequence
  Description of Artificial Sequence: Synthetic polypeptide
EEEEIRTTNPVATEQYGSVTVTNLLQGNQNGNET

SEQ ID NO: 71261 - protein, 31 aa, Artificial Sequence
  Description of Artificial Sequence: Synthetic polypeptide
DEVEIATTNPVAYEQYGTVVTNLQGTGGNDE

SEQ ID NO: 71262 - protein, 32 aa, Artificial Sequence
  Description of Artificial Sequence: Synthetic polypeptide
EEEEIRTTNPVATEQYGSVVATDLQNGEFTEG

SEQ ID NO: 71263 - protein, 28 aa, Artificial Sequence
  Description of Artificial Sequence: Synthetic peptide
AENEIAPTNPCASEQYGIVSCNLQSGGR

SEQ ID NO: 71264 - protein, 32 aa, Artificial Sequence
  Description of Artificial Sequence: Synthetic polypeptide
EEEEIRTTNPVATEQYGSVVTALQENGEFGEA

SEQ ID NO: 71265 - protein, 32 aa, Artificial Sequence
  Description of Artificial Sequence: Synthetic polypeptide
EEEEIRTTNPVATEQYGSVVTALQENGGGFEE

SEQ ID NO: 71266 - protein, 32 aa, Artificial Sequence
  Description of Artificial Sequence: Synthetic polypeptide
DEVEIATTNPVAYEQYGTVSTNLQMEGGNNGA

SEQ ID NO: 71267 - protein, 32 aa, Artificial Sequence
  Description of Artificial Sequence: Synthetic polypeptide
DEECIRTTNPVAYEQYGCVCSTGNDQHGSNQN

SEQ ID NO: 71268 - protein, 32 aa, Artificial Sequence
  Description of Artificial Sequence: Synthetic polypeptide
EEEEIRTTNPVATEQYGSVVTGLQAGGGGFEE

SEQ ID NO: 71269 - protein, 34 aa, Artificial Sequence
  Description of Artificial Sequence: Synthetic polypeptide
DEEEIRTTNPVATEQYGSVSPTYHLEESDENVRI

SEQ ID NO: 71270 - protein, 32 aa, Artificial Sequence
  Description of Artificial Sequence: Synthetic polypeptide
DEEEIRTTNPVATEQYGSVSFMDLQMEITQDN

SEQ ID NO: 71271 - protein, 28 aa, Artificial Sequence
  Description of Artificial Sequence: Synthetic peptide
AENEIAPTNPCSSEQYGEVSENLQRGGR

SEQ ID NO: 71272 - protein, 32 aa, Artificial Sequence
  Description of Artificial Sequence: Synthetic polypeptide
DEVEIATTNPVAYEQYGTVSTNLQHEDGGNQG

SEQ ID NO: 71273 - protein, 28 aa, Artificial Sequence
  Description of Artificial Sequence: Synthetic peptide
AENEIAPTNPCSSEQYGIVSCNLQRGGR

SEQ ID NO: 71274 - protein, 33 aa, Artificial Sequence
  Description of Artificial Sequence: Synthetic polypeptide
DEEEIRTTNPVATEQYGSVSFPTHVQQPSEVNN

SEQ ID NO: 71275 - protein, 31 aa, Artificial Sequence
  Description of Artificial Sequence: Synthetic polypeptide
DEECIRTTNPVAYEQYGCVCSTMNPQNGSQQ

SEQ ID NO: 71276 - protein, 34 aa, Artificial Sequence
  Description of Artificial Sequence: Synthetic polypeptide
EEEEIRTTNPVATEQYGSVTVSTTNLLQGNQQGE

SEQ ID NO: 71277 - protein, 35 aa, Artificial Sequence
  Description of Artificial Sequence: Synthetic polypeptide
DEDEIRTTNPVATEQYGVVSTVSTTNLQAGSTNSE

SEQ ID NO: 71278 - protein, 32 aa, Artificial Sequence
  Description of Artificial Sequence: Synthetic polypeptide
DEVEIATTNPVAYERWGSVSTNLQGNDEGNSR

SEQ ID NO: 71279 - protein, 35 aa, Artificial Sequence
  Description of Artificial Sequence: Synthetic polypeptide
EEEEIRTTNPVATEQYGSVSTTSNLNQQQGENGEG

SEQ ID NO: 71280 - protein, 31 aa, Artificial Sequence
  Description of Artificial Sequence: Synthetic polypeptide
DEVEIATTNPVAYERWGSVSTNLQEGGNMDH

SEQ ID NO: 71281 - protein, 31 aa, Artificial Sequence
  Description of Artificial Sequence: Synthetic polypeptide
DEVEIATTNPVAYERWGSVSTNLQEGGGNAG

SEQ ID NO: 71282 - protein, 35 aa, Artificial Sequence
  Description of Artificial Sequence: Synthetic polypeptide
EEEEIRTTNPVATEQYGSVSTTTNLQQGTNVNEYG

SEQ ID NO: 71283 - protein, 33 aa, Artificial Sequence
  Description of Artificial Sequence: Synthetic polypeptide
EEEEIRTTNPVATEQYGSVSTVEMQRIAENEDP

SEQ ID NO: 71284 - protein, 34 aa, Artificial Sequence
  Description of Artificial Sequence: Synthetic polypeptide
DEDEIRTTNPVATEQYGVVSTVSTTNLQAGTTTS

SEQ ID NO: 71285 - protein, 34 aa, Artificial Sequence
  Description of Artificial Sequence: Synthetic polypeptide
EEEEIRTTNPVATEQYGSVSTVVLAQRWAENYDI

SEQ ID NO: 71286 - protein, 34 aa, Artificial Sequence
  Description of Artificial Sequence: Synthetic polypeptide
DEEEIRTTNPVATEQYGSVSFTNDIGQTSINNQS

SEQ ID NO: 71287 - protein, 34 aa, Artificial Sequence
  Description of Artificial Sequence: Synthetic polypeptide
DEEEIRTTNPVATEQYGSVSPTVVLDARMVENEA

SEQ ID NO: 71288 - protein, 33 aa, Artificial Sequence
  Description of Artificial Sequence: Synthetic polypeptide
EEEEIRTTNPVATEQYGSVSTYNLINEDVIGTQ

SEQ ID NO: 71289 - protein, 33 aa, Artificial Sequence
  Description of Artificial Sequence: Synthetic polypeptide
EEEEIRTTNPVATEQYGSVSVTELDVEVEINRE

SEQ ID NO: 71290 - protein, 34 aa, Artificial Sequence
  Description of Artificial Sequence: Synthetic polypeptide
DEEEIRTTNPVATEQYGSVSPTVVLDQHMVENED

SEQ ID NO: 71291 - protein, 33 aa, Artificial Sequence
  Description of Artificial Sequence: Synthetic polypeptide
EEEEIRTTNPVATEQYGSVTSTTLLQGNQNGTE

SEQ ID NO: 71292 - protein, 32 aa, Artificial Sequence
  Description of Artificial Sequence: Synthetic polypeptide
EEEEIRTTNPVATEQYGSVTSTTQLQQNEQGE

SEQ ID NO: 71293 - protein, 34 aa, Artificial Sequence
  Description of Artificial Sequence: Synthetic polypeptide
EEEEIRTTNPVATEQYGSVTVSTNLLQGNQTGEE

SEQ ID NO: 71294 - protein, 32 aa, Artificial Sequence
  Description of Artificial Sequence: Synthetic polypeptide
DEECIRTTNPVAYEQYGCVVSTANQSQFGGNH

SEQ ID NO: 71295 - protein, 32 aa, Artificial Sequence
  Description of Artificial Sequence: Synthetic polypeptide
DEECIRTTNPVAYEQYGCVCSTMNTQRGSQQS

SEQ ID NO: 71296 - protein, 33 aa, Artificial Sequence
  Description of Artificial Sequence: Synthetic polypeptide
DEVEIATTNPVAYEQYGTVSTNLQGEHGGNGGR

SEQ ID NO: 71297 - protein, 34 aa, Artificial Sequence
  Description of Artificial Sequence: Synthetic polypeptide
EEEEIRTTNPVATESYGSVSNTVNLEHRVGTFQR

SEQ ID NO: 71298 - protein, 31 aa, Artificial Sequence
  Description of Artificial Sequence: Synthetic polypeptide
DEVEIATTNPVAYEQYGSVVTNPGNHGENGR

SEQ ID NO: 71299 - protein, 33 aa, Artificial Sequence
  Description of Artificial Sequence: Synthetic polypeptide
EEEEIRTTNPVATESYGSVSWTVLEEHRTGFQR

SEQ ID NO: 71300 - protein, 35 aa, Artificial Sequence
  Description of Artificial Sequence: Synthetic polypeptide
DEEEIRTTNPVATEQYGSVSETSWILDQTRGEDDN

SEQ ID NO: 71301 - protein, 33 aa, Artificial Sequence
  Description of Artificial Sequence: Synthetic polypeptide
DEEEIRTTNPVATEQYGSVSPVGVNQQLVGGIT

SEQ ID NO: 71302 - protein, 32 aa, Artificial Sequence
  Description of Artificial Sequence: Synthetic polypeptide
DEECIRTTNPVAYEQYGCVSTINVQTIGDNQS

SEQ ID NO: 71303 - protein, 34 aa, Artificial Sequence
  Description of Artificial Sequence: Synthetic polypeptide
DEEEIRTTNPVATEQYGSVSETPYMVQGTLENRL

SEQ ID NO: 71304 - protein, 31 aa, Artificial Sequence
  Description of Artificial Sequence: Synthetic polypeptide
DEVEIATTNPVAYEQYGSVVTNPGLGENHSR

SEQ ID NO: 71305 - protein, 34 aa, Artificial Sequence
  Description of Artificial Sequence: Synthetic polypeptide
DEEEIRTTNPVATEQYGSVSETPNWVIQGLENPL

SEQ ID NO: 71306 - protein, 30 aa, Artificial Sequence
  Description of Artificial Sequence: Synthetic polypeptide
DEVEIATTNPVAYEQYGSVVTNPGLGENGP

SEQ ID NO: 71307 - protein, 34 aa, Artificial Sequence
  Description of Artificial Sequence: Synthetic polypeptide
DEEEIRTTNPVATEQYGSVSETPNMVHQGTLENV

SEQ ID NO: 71308 - protein, 30 aa, Artificial Sequence
  Description of Artificial Sequence: Synthetic polypeptide
DEVEIATTNPVAYEQYGSVVTNPGLGENGH

SEQ ID NO: 71309 - protein, 34 aa, Artificial Sequence
  Description of Artificial Sequence: Synthetic polypeptide
DEEEIRTTNPVATEQYGSVSPVLPSQMRVVNEQT

SEQ ID NO: 71310 - protein, 33 aa, Artificial Sequence
  Description of Artificial Sequence: Synthetic polypeptide
DEECIRTTNPVAYEQYGCVTSTGNHQRFGSNQG

SEQ ID NO: 71311 - protein, 31 aa, Artificial Sequence
  Description of Artificial Sequence: Synthetic polypeptide
DEVEIATTNPVAYEQYGSVVTNPGLGENDRG

SEQ ID NO: 71312 - protein, 34 aa, Artificial Sequence
  Description of Artificial Sequence: Synthetic polypeptide
DEEEIRTTNPVATEQYGSVSPVFNGQMRVVNEQT

SEQ ID NO: 71313 - protein, 32 aa, Artificial Sequence
  Description of Artificial Sequence: Synthetic polypeptide
DEVEIATTNPVAYEQYGTVSTNLQGEQGGNGS

SEQ ID NO: 71314 - protein, 34 aa, Artificial Sequence
  Description of Artificial Sequence: Synthetic polypeptide
DEEEIRTTNPVATEQYGSVSETWNDGETSGNLFQ

SEQ ID NO: 71315 - protein, 30 aa, Artificial Sequence
  Description of Artificial Sequence: Synthetic polypeptide
DEECIRTTNPVAYEQYGCVSTINVENIGSQ

SEQ ID NO: 71316 - protein, 34 aa, Artificial Sequence
  Description of Artificial Sequence: Synthetic polypeptide
EEEEIRTTNPVATEQYGSVYPTPNLQPRMDAERA

SEQ ID NO: 71317 - protein, 31 aa, Artificial Sequence
  Description of Artificial Sequence: Synthetic polypeptide
DEVEIATTNPVAYEQYGTVSTNLQGDHGGEE

SEQ ID NO: 71318 - protein, 35 aa, Artificial Sequence
  Description of Artificial Sequence: Synthetic polypeptide
DEEEIRTTNPVATEQYGSVSPTYNLGQSRNEEITQ

SEQ ID NO: 71319 - protein, 36 aa, Artificial Sequence
  Description of Artificial Sequence: Synthetic polypeptide
DEEEIRTTNPVATEQYGSVSPTYNLVQVIGALEQND

SEQ ID NO: 71320 - protein, 31 aa, Artificial Sequence
  Description of Artificial Sequence: Synthetic polypeptide
DEVEIATTNPVAYEQYGTVSTNLNQGDENNE

SEQ ID NO: 71321 - protein, 33 aa, Artificial Sequence
  Description of Artificial Sequence: Synthetic polypeptide
DEEEIRTTNPVATEQYGSVSEWPNQQRTVELFQ

SEQ ID NO: 71322 - protein, 34 aa, Artificial Sequence
  Description of Artificial Sequence: Synthetic polypeptide
DEEEIRTTNPVATEQYGSVSEWPNQQIDRVELRQ

SEQ ID NO: 71323 - protein, 32 aa, Artificial Sequence
  Description of Artificial Sequence: Synthetic polypeptide
DEVEIATTNPVAYEQYGTVSTNLNDEHGGNGR

SEQ ID NO: 71324 - protein, 33 aa, Artificial Sequence
  Description of Artificial Sequence: Synthetic polypeptide
DEEEIRTTNPVATEQYGSVSEWDEQQDRVELRQ

SEQ ID NO: 71325 - protein, 33 aa, Artificial Sequence
  Description of Artificial Sequence: Synthetic polypeptide
DEEEIRTTNPVATEQYGSVSPVEEQTRVVNEQT

SEQ ID NO: 71326 - protein, 30 aa, Artificial Sequence
  Description of Artificial Sequence: Synthetic polypeptide
DEVEIATTNPVAYEQYGTVATNPGNSGENR

SEQ ID NO: 71327 - protein, 31 aa, Artificial Sequence
  Description of Artificial Sequence: Synthetic polypeptide
DEEEIRTTNPVATEQYGSVSEVPPGQATDDD

SEQ ID NO: 71328 - protein, 31 aa, Artificial Sequence
  Description of Artificial Sequence: Synthetic polypeptide
DEECIRTTNPVAYEQYGCVSTGNHNQNGSQQ

SEQ ID NO: 71329 - protein, 33 aa, Artificial Sequence
  Description of Artificial Sequence: Synthetic polypeptide
DEEEIRTTNPVATEQYGSVSEVNGMEPNEVLRD

SEQ ID NO: 71330 - protein, 35 aa, Artificial Sequence
  Description of Artificial Sequence: Synthetic polypeptide
DEEEIRTTNPVATEQYGSVSPVENLVQPVGEENNT

SEQ ID NO: 71331 - protein, 34 aa, Artificial Sequence
  Description of Artificial Sequence: Synthetic polypeptide
DEEEIRTTNPVATEQYGSVSPVEVLQRMVENEDL

SEQ ID NO: 71332 - protein, 33 aa, Artificial Sequence
  Description of Artificial Sequence: Synthetic polypeptide
DEEEIRTTNPVATEQYGSVSPYGLHQDTQNSEL

SEQ ID NO: 71333 - protein, 32 aa, Artificial Sequence
  Description of Artificial Sequence: Synthetic polypeptide
DEECIRTTNPVAYEQWGCSYSDNDLDQRGQRR

SEQ ID NO: 71334 - protein, 34 aa, Artificial Sequence
  Description of Artificial Sequence: Synthetic polypeptide
EEEEIRTTNPVATEQYGSVSIPVTLAQRAENYRI

SEQ ID NO: 71335 - protein, 33 aa, Artificial Sequence
  Description of Artificial Sequence: Synthetic polypeptide
DEDEIRTTNPVATTAYGSVSTTNLQQGTTTNDT

SEQ ID NO: 71336 - protein, 29 aa, Artificial Sequence
  Description of Artificial Sequence: Synthetic peptide
AENEIACTNPVATQQYGEASENLEQRGGR

SEQ ID NO: 71337 - protein, 28 aa, Artificial Sequence
  Description of Artificial Sequence: Synthetic peptide
AENEIACTNPVATQQYGEASENLERGGR

SEQ ID NO: 71338 - protein, 32 aa, Artificial Sequence
  Description of Artificial Sequence: Synthetic polypeptide
DEVEIRTTNPVATEQYGEVSENNLQKSSNIQG

SEQ ID NO: 71339 - protein, 32 aa, Artificial Sequence
  Description of Artificial Sequence: Synthetic polypeptide
DTTEIRTTNPVATEQYGVVNTTVNLQAGDNQS

SEQ ID NO: 71340 - protein, 32 aa, Artificial Sequence
  Description of Artificial Sequence: Synthetic polypeptide
DTTEIRTTNPVATEQYGVVNTTVNLQAGNEQS

SEQ ID NO: 71341 - protein, 33 aa, Artificial Sequence
  Description of Artificial Sequence: Synthetic polypeptide
DEEEIRTTNPVATEQYGSVSIENQDEIVNGEPR

SEQ ID NO: 71342 - protein, 34 aa, Artificial Sequence
  Description of Artificial Sequence: Synthetic polypeptide
DEEEIRTTNPVATEQYGSVSPTNPLFPTGEFEPL

SEQ ID NO: 71343 - protein, 32 aa, Artificial Sequence
  Description of Artificial Sequence: Synthetic polypeptide
DTTEIRTTNPVATEQYGVVNVTVNLQAGENQD

SEQ ID NO: 71344 - protein, 34 aa, Artificial Sequence
  Description of Artificial Sequence: Synthetic polypeptide
DEEEIRTTNPVATEQYGSVSPTNPLPPTGEAEGL

SEQ ID NO: 71345 - protein, 32 aa, Artificial Sequence
  Description of Artificial Sequence: Synthetic polypeptide
DTTEIRTTNPVATEQYGVVSNSTVLQAGNTQE

SEQ ID NO: 71346 - protein, 31 aa, Artificial Sequence
  Description of Artificial Sequence: Synthetic polypeptide
DEECIRTTNPVATEQYGCVCSTMEPQFGSDQ

SEQ ID NO: 71347 - protein, 32 aa, Artificial Sequence
  Description of Artificial Sequence: Synthetic polypeptide
DEECIRTTNPVATEQYGCVCSTNDQYFGSEQS

SEQ ID NO: 71348 - protein, 33 aa, Artificial Sequence
  Description of Artificial Sequence: Synthetic polypeptide
DEECIRTTNPVATEQYGCVCSTNLNDNFGGNQS

SEQ ID NO: 71349 - protein, 34 aa, Artificial Sequence
  Description of Artificial Sequence: Synthetic polypeptide
DEEEIRTTNPVATEQYGSVSPTNPLFVTGEHETL

SEQ ID NO: 71350 - protein, 32 aa, Artificial Sequence
  Description of Artificial Sequence: Synthetic polypeptide
DTTEIRTTNPVATEQYGVVNTSTQLQAGTNLQ

SEQ ID NO: 71351 - protein, 34 aa, Artificial Sequence
  Description of Artificial Sequence: Synthetic polypeptide
DEEEIRTTNPVATEQYGSVSPTNNSGVNIGQVRI

SEQ ID NO: 71352 - protein, 32 aa, Artificial Sequence
  Description of Artificial Sequence: Synthetic polypeptide
DTTEIRTTNPVATEQYGSVSVTNTEQLQGMEA

SEQ ID NO: 71353 - protein, 33 aa, Artificial Sequence
  Description of Artificial Sequence: Synthetic polypeptide
DEECIRTTNPVATEQYGCVCSTENPQFFGSNNQ

SEQ ID NO: 71354 - protein, 31 aa, Artificial Sequence
  Description of Artificial Sequence: Synthetic polypeptide
DEVEIRTTNPVATEQYGSIGTYENLLEMPNS

SEQ ID NO: 71355 - protein, 32 aa, Artificial Sequence
  Description of Artificial Sequence: Synthetic polypeptide
DTTEIRTTNPVATEQYGSVSTTNTEQLGMEAG

SEQ ID NO: 71356 - protein, 33 aa, Artificial Sequence
  Description of Artificial Sequence: Synthetic polypeptide
DTTEIRTTNPVATEQYGSVSTTNTEQLGNMEAG

SEQ ID NO: 71357 - protein, 28 aa, Artificial Sequence
  Description of Artificial Sequence: Synthetic peptide
AENEIACTNPVATIQYGEASENLQSGGR

SEQ ID NO: 71358 - protein, 34 aa, Artificial Sequence
  Description of Artificial Sequence: Synthetic polypeptide
DTTEIRTTNPVATEQYGSVSTTNTQLQLGGNMTA

SEQ ID NO: 71359 - protein, 32 aa, Artificial Sequence
  Description of Artificial Sequence: Synthetic polypeptide
DEEEIRTTNPVATEQYGSVSILGTLQSNEEQN

SEQ ID NO: 71360 - protein, 35 aa, Artificial Sequence
  Description of Artificial Sequence: Synthetic polypeptide
DEVEIRTTNPVATEQYGKVPSCTGNLQTTGTNNRE

SEQ ID NO: 71361 - protein, 34 aa, Artificial Sequence
  Description of Artificial Sequence: Synthetic polypeptide
DEDEIRTTNPVATTQYGSVSTNLQNLQQGTNNDD

SEQ ID NO: 71362 - protein, 32 aa, Artificial Sequence
  Description of Artificial Sequence: Synthetic polypeptide
DTTEIRTTNPVATEQYGSVSTTNTQQQLGMEA

SEQ ID NO: 71363 - protein, 33 aa, Artificial Sequence
  Description of Artificial Sequence: Synthetic polypeptide
DEDEIRTTNPVATTAYGSVSTTNLQYGTNNAED

SEQ ID NO: 71364 - protein, 28 aa, Artificial Sequence
  Description of Artificial Sequence: Synthetic peptide
AENEIACTNPVATMQYGEASENIQRGGR

SEQ ID NO: 71365 - protein, 33 aa, Artificial Sequence
  Description of Artificial Sequence: Synthetic polypeptide
DTTEIRTTNPVATEQYGSVSTTTNTNQQLGNMA

SEQ ID NO: 71366 - protein, 32 aa, Artificial Sequence
  Description of Artificial Sequence: Synthetic polypeptide
DTTEIRTTNPVATEQYGSVSTTVNTEQLGMEA

SEQ ID NO: 71367 - protein, 28 aa, Artificial Sequence
  Description of Artificial Sequence: Synthetic peptide
AENEIACTNPVATMQYGEASENLQTGGR

SEQ ID NO: 71368 - protein, 33 aa, Artificial Sequence
  Description of Artificial Sequence: Synthetic polypeptide
DTTEIRTTNPVATEQYGVVSNSTVNLQAGTNQS

SEQ ID NO: 71369 - protein, 32 aa, Artificial Sequence
  Description of Artificial Sequence: Synthetic polypeptide
DTTEIRTTNPVATEQYGVVSSTVLQAGTNAQS

SEQ ID NO: 71370 - protein, 33 aa, Artificial Sequence
  Description of Artificial Sequence: Synthetic polypeptide
DTTEIRTTNPVATEQYGVVSSTVNLQAGNNEQS

SEQ ID NO: 71371 - protein, 33 aa, Artificial Sequence
  Description of Artificial Sequence: Synthetic polypeptide
DEDEIRTTNPVATTAYGSVSTNLQYGSTTENDD

SEQ ID NO: 71372 - protein, 32 aa, Artificial Sequence
  Description of Artificial Sequence: Synthetic polypeptide
EDEEICTTNPVATEQYGVVSTTNLQQDGDNSG

SEQ ID NO: 71373 - protein, 28 aa, Artificial Sequence
  Description of Artificial Sequence: Synthetic peptide
AENEIACTNPVATYQYGEASENKQRGGR

SEQ ID NO: 71374 - protein, 32 aa, Artificial Sequence
  Description of Artificial Sequence: Synthetic polypeptide
DEEEIRTTNPVATEQYGSVSHIYDQGQDMFRQ

SEQ ID NO: 71375 - protein, 28 aa, Artificial Sequence
  Description of Artificial Sequence: Synthetic peptide
AENEIACTNPVATYQYGEASENLQREGR

SEQ ID NO: 71376 - protein, 28 aa, Artificial Sequence
  Description of Artificial Sequence: Synthetic peptide
AENEIACTNPVAVEQYGEACENLQRGGR

SEQ ID NO: 71377 - protein, 33 aa, Artificial Sequence
  Description of Artificial Sequence: Synthetic polypeptide
DEDEIRTTNPVATQQYGCVSCTNALSERGGNNP

SEQ ID NO: 71378 - protein, 32 aa, Artificial Sequence
  Description of Artificial Sequence: Synthetic polypeptide
DEEEIRTTNPVATEQYGSVSGVTLPEMNGEFD

SEQ ID NO: 71379 - protein, 32 aa, Artificial Sequence
  Description of Artificial Sequence: Synthetic polypeptide
EDEEICTTNPVATEQYGVVSTTNQLQDGDNSE

SEQ ID NO: 71380 - protein, 33 aa, Artificial Sequence
  Description of Artificial Sequence: Synthetic polypeptide
DEEEIRTTNPVATEQYGSVSGVTLLPEMGGEFG

SEQ ID NO: 71381 - protein, 32 aa, Artificial Sequence
  Description of Artificial Sequence: Synthetic polypeptide
DEEEIRTTNPVATEQYGSVSGVTLDPENGDEF

SEQ ID NO: 71382 - protein, 33 aa, Artificial Sequence
  Description of Artificial Sequence: Synthetic polypeptide
DEEEIRTTNPVATEQYGSVSGVTDLPENGGEFT

SEQ ID NO: 71383 - protein, 33 aa, Artificial Sequence
  Description of Artificial Sequence: Synthetic polypeptide
DEEEIRTTNPVATEQYGSVSGVNVTGQELNNGG

SEQ ID NO: 71384 - protein, 33 aa, Artificial Sequence
  Description of Artificial Sequence: Synthetic polypeptide
DEEEIRTTNPVATEQYGSVSGVNTVVGMGGQNI

SEQ ID NO: 71385 - protein, 34 aa, Artificial Sequence
  Description of Artificial Sequence: Synthetic polypeptide
DEEEIRTTNPVATEQYGSVSGVNTTVGMGGQNER

SEQ ID NO: 71386 - protein, 33 aa, Artificial Sequence
  Description of Artificial Sequence: Synthetic polypeptide
DEEEIRTTNPVATEQYGSVSGVNTTVGFGGNGE

SEQ ID NO: 71387 - protein, 32 aa, Artificial Sequence
  Description of Artificial Sequence: Synthetic polypeptide
EDEEICTTNPVATEQYGVVSTTNLQQDGDNNS

SEQ ID NO: 71388 - protein, 34 aa, Artificial Sequence
  Description of Artificial Sequence: Synthetic polypeptide
DEEEIRTTNPVATEQYGSVSIMPNHDQQINNNRD

SEQ ID NO: 71389 - protein, 33 aa, Artificial Sequence
  Description of Artificial Sequence: Synthetic polypeptide
DEEEIRTTNPVATEQYGSVSPTNTPVQLNMEVE

SEQ ID NO: 71390 - protein, 32 aa, Artificial Sequence
  Description of Artificial Sequence: Synthetic polypeptide
DEDEIRTTNPVATTAYGSVSTNLQEATTNVEE

SEQ ID NO: 71391 - protein, 33 aa, Artificial Sequence
  Description of Artificial Sequence: Synthetic polypeptide
DTTEIRTTNPVATEQYGVVSSVTVNLQAGNQQS

SEQ ID NO: 71392 - protein, 33 aa, Artificial Sequence
  Description of Artificial Sequence: Synthetic polypeptide
DTTEIRTTNPVATEQYGVVSTVTGVNLQAGNQS

SEQ ID NO: 71393 - protein, 32 aa, Artificial Sequence
  Description of Artificial Sequence: Synthetic polypeptide
DTTEIRTTNPVATEQYGVVTNSTTQLQAGTNQ

SEQ ID NO: 71394 - protein, 34 aa, Artificial Sequence
  Description of Artificial Sequence: Synthetic polypeptide
DEDEIRTTNPVATTAYGSVSTNLQQGTTTTNTER

SEQ ID NO: 71395 - protein, 33 aa, Artificial Sequence
  Description of Artificial Sequence: Synthetic polypeptide
DEDEIRTTNPVATTAYGSVSTNLQQGSNTTNTE

SEQ ID NO: 71396 - protein, 33 aa, Artificial Sequence
  Description of Artificial Sequence: Synthetic polypeptide
DEEEIRTTNPVATEQYGSVSPTNSHEELGAEED

SEQ ID NO: 71397 - protein, 33 aa, Artificial Sequence
  Description of Artificial Sequence: Synthetic polypeptide
DEDEIRTTNPVATTAYGSVSTNLQQGATTENTG

SEQ ID NO: 71398 - protein, 32 aa, Artificial Sequence
  Description of Artificial Sequence: Synthetic polypeptide
DEDEIRTTNPVATTAYGSVSTNLQGTTTNAEE

SEQ ID NO: 71399 - protein, 30 aa, Artificial Sequence
  Description of Artificial Sequence: Synthetic polypeptide
EACEIRTTNPVATEQYGEVSTNLPGMQGGP

SEQ ID NO: 71400 - protein, 31 aa, Artificial Sequence
  Description of Artificial Sequence: Synthetic polypeptide
EAEEIATTNPVAYEQYGSVATNLQERGDGEM

SEQ ID NO: 71401 - protein, 34 aa, Artificial Sequence
  Description of Artificial Sequence: Synthetic polypeptide
DEEEIRTTNPVATEQYGSVSPTNSVSVQGEVLRD

SEQ ID NO: 71402 - protein, 30 aa, Artificial Sequence
  Description of Artificial Sequence: Synthetic polypeptide
EDEEICTTNPVATEQWGTVSTNLNTEQGNE

SEQ ID NO: 71403 - protein, 31 aa, Artificial Sequence
  Description of Artificial Sequence: Synthetic polypeptide
EDEEICTTNPVATEQWGTVSTNLQNEQGNET

SEQ ID NO: 71404 - protein, 30 aa, Artificial Sequence
  Description of Artificial Sequence: Synthetic polypeptide
EDEEICTTNPVATEQWGTVSTNLQNQQGTE

SEQ ID NO: 71405 - protein, 33 aa, Artificial Sequence
  Description of Artificial Sequence: Synthetic polypeptide
DEEEIRTTNPVATEQYGSVSPTNTNQDNMEVVE

SEQ ID NO: 71406 - protein, 29 aa, Artificial Sequence
  Description of Artificial Sequence: Synthetic peptide
AENEIACTNPVATSQYGEASENLQRGIGR

SEQ ID NO: 71407 - protein, 33 aa, Artificial Sequence
  Description of Artificial Sequence: Synthetic polypeptide
DEECIRTTNPVATEQYGCVCSTENHQRFGSDDA

SEQ ID NO: 71408 - protein, 33 aa, Artificial Sequence
  Description of Artificial Sequence: Synthetic polypeptide
DEECIRTTNPVATEQYGCVCSTELQNFGSNTQA

SEQ ID NO: 71409 - protein, 33 aa, Artificial Sequence
  Description of Artificial Sequence: Synthetic polypeptide
DEEEIRTTNPVATEQYGSVSPTNNQNDQMEEPG

SEQ ID NO: 71410 - protein, 31 aa, Artificial Sequence
  Description of Artificial Sequence: Synthetic polypeptide
DEECIRTTNPVATEQWGSWATNNLQLDENQE

SEQ ID NO: 71411 - protein, 33 aa, Artificial Sequence
  Description of Artificial Sequence: Synthetic polypeptide
DEEEIRTTNPVATEQYGSVSPTNNLEEEAEELD

SEQ ID NO: 71412 - protein, 31 aa, Artificial Sequence
  Description of Artificial Sequence: Synthetic polypeptide
DEECIRTTNPVATEQWGSWATNNLQLDVNLQ

SEQ ID NO: 71413 - protein, 34 aa, Artificial Sequence
  Description of Artificial Sequence: Synthetic polypeptide
DEEEIRTTNPVATEQYGSVSPTNNLELELGEELM

SEQ ID NO: 71414 - protein, 34 aa, Artificial Sequence
  Description of Artificial Sequence: Synthetic polypeptide
DEEEIRTTNPVATEQYGSVSPTNNLEMELGEEMD

SEQ ID NO: 71415 - protein, 33 aa, Artificial Sequence
  Description of Artificial Sequence: Synthetic polypeptide
DTEEIRTTNPVATTQYGSVSTSNGTQQGNNNTD

SEQ ID NO: 71416 - protein, 33 aa, Artificial Sequence
  Description of Artificial Sequence: Synthetic polypeptide
DTEEIRTTNPVATTQYGSVSTTNGNNQNGNNDT

SEQ ID NO: 71417 - protein, 33 aa, Artificial Sequence
  Description of Artificial Sequence: Synthetic polypeptide
DEVEIRTTNPVATEQYGSVGSNQNEGQGGNNDN

SEQ ID NO: 71418 - protein, 33 aa, Artificial Sequence
  Description of Artificial Sequence: Synthetic polypeptide
DEEEIRTTNPVATEQYGSVSIQNLELIMGEGQA

SEQ ID NO: 71419 - protein, 33 aa, Artificial Sequence
  Description of Artificial Sequence: Synthetic polypeptide
DTEEIRTTNPVATTQYGSVSTTNGTNQNGNNND

SEQ ID NO: 71420 - protein, 33 aa, Artificial Sequence
  Description of Artificial Sequence: Synthetic polypeptide
DTEEIRTTNPVATTQYGSVSTTNGTNQNGTNND

SEQ ID NO: 71421 - protein, 34 aa, Artificial Sequence
  Description of Artificial Sequence: Synthetic polypeptide
DEEEIRTTNPVATEQYGSVSPTNNLEVELGAEED

SEQ ID NO: 71422 - protein, 33 aa, Artificial Sequence
  Description of Artificial Sequence: Synthetic polypeptide
DEEEIRTTNPVATEQYGSVSIQNDELDGNENQA

SEQ ID NO: 71423 - protein, 34 aa, Artificial Sequence
  Description of Artificial Sequence: Synthetic polypeptide
DEEEIRTTNPVATEQYGSVSPTNNLGEELGAEMD

SEQ ID NO: 71424 - protein, 33 aa, Artificial Sequence
  Description of Artificial Sequence: Synthetic polypeptide
DTEEIRTTNPVATTQYGSVSTTNGTQNGNNNDN

SEQ ID NO: 71425 - protein, 33 aa, Artificial Sequence
  Description of Artificial Sequence: Synthetic polypeptide
DEECIRTTNPVATEQWGSVYNTVTLMQREGNHE

SEQ ID NO: 71426 - protein, 33 aa, Artificial Sequence
  Description of Artificial Sequence: Synthetic polypeptide
DEECIRTTNPVATEQYGCVCSMTNHQHFGSNQS

SEQ ID NO: 71427 - protein, 33 aa, Artificial Sequence
  Description of Artificial Sequence: Synthetic polypeptide
DEVEIRTTNPVATEQYGSVGSPNNLEQRSLEDE

SEQ ID NO: 71428 - protein, 33 aa, Artificial Sequence
  Description of Artificial Sequence: Synthetic polypeptide
DEDEIRTTNPVATTQYGSVSTTQLQQGTNNNTD

SEQ ID NO: 71429 - protein, 34 aa, Artificial Sequence
  Description of Artificial Sequence: Synthetic polypeptide
DEEEIRTTNPVATEQYGSVSITMNGNGNGGGENA

SEQ ID NO: 71430 - protein, 33 aa, Artificial Sequence
  Description of Artificial Sequence: Synthetic polypeptide
DEVEIRTTNPVATEQYGSVNVTNMLEMVELNRV

SEQ ID NO: 71431 - protein, 31 aa, Artificial Sequence
  Description of Artificial Sequence: Synthetic polypeptide
DEDEIRTTNPVATTQYGVVSTDNNEEGTNNQ

SEQ ID NO: 71432 - protein, 34 aa, Artificial Sequence
  Description of Artificial Sequence: Synthetic polypeptide
DEEEIRTTNPVATEQYGSVSITLNLQQQMLFEMD

SEQ ID NO: 71433 - protein, 35 aa, Artificial Sequence
  Description of Artificial Sequence: Synthetic polypeptide
DEEEIRTTNPVATEQYGSVSPTNMMMQESGEEENS

SEQ ID NO: 71434 - protein, 28 aa, Artificial Sequence
  Description of Artificial Sequence: Synthetic peptide
AENEIACTNPVATERYGEASENLQRIVR

SEQ ID NO: 71435 - protein, 35 aa, Artificial Sequence
  Description of Artificial Sequence: Synthetic polypeptide
DEEEIRTTNPVATEQYGSVSPTNMMMQLSGEENVE

SEQ ID NO: 71436 - protein, 33 aa, Artificial Sequence
  Description of Artificial Sequence: Synthetic polypeptide
DEDEIRTTNPVATTQYGSVSTTTQLQQGTNVTD

SEQ ID NO: 71437 - protein, 32 aa, Artificial Sequence
  Description of Artificial Sequence: Synthetic polypeptide
DEECIRTTNPVATEQWGSVACTNNSSQLGGNQ

SEQ ID NO: 71438 - protein, 31 aa, Artificial Sequence
  Description of Artificial Sequence: Synthetic polypeptide
DEECIRTTNPVATEQWGSVATNNLELYDVNE

SEQ ID NO: 71439 - protein, 34 aa, Artificial Sequence
  Description of Artificial Sequence: Synthetic polypeptide
DEDEIRTTNPVATTQYGSVSTTTNQLQQGTNNTD

SEQ ID NO: 71440 - protein, 29 aa, Artificial Sequence
  Description of Artificial Sequence: Synthetic peptide
AENEIACTNPVATETYGEASENLQRGGER

SEQ ID NO: 71441 - protein, 33 aa, Artificial Sequence
  Description of Artificial Sequence: Synthetic polypeptide
DEECIRTTNPVATEQWGSVVAYTNNQSQLGGNR

SEQ ID NO: 71442 - protein, 32 aa, Artificial Sequence
  Description of Artificial Sequence: Synthetic polypeptide
DEVEIRTTNPVATEQYGSVIMTNNGQMEGGQQ

SEQ ID NO: 71443 - protein, 33 aa, Artificial Sequence
  Description of Artificial Sequence: Synthetic polypeptide
DEDEIRTTNPVATTQYGSVSTTQLQQGTTNTDT

SEQ ID NO: 71444 - protein, 28 aa, Artificial Sequence
  Description of Artificial Sequence: Synthetic peptide
AENEIACTNPVATETYGEASENLVRGGR

SEQ ID NO: 71445 - protein, 29 aa, Artificial Sequence
  Description of Artificial Sequence: Synthetic peptide
AENEIACTNPVAVEQYGEASENLQRGGRP

SEQ ID NO: 71446 - protein, 34 aa, Artificial Sequence
  Description of Artificial Sequence: Synthetic polypeptide
DEEEIRTTNPVATEQYGSVSIPNLQPRFAVEEED

SEQ ID NO: 71447 - protein, 34 aa, Artificial Sequence
  Description of Artificial Sequence: Synthetic polypeptide
DEDEIRTTNPVATTQYGSVSTTNQNLQTGNNNDQ

SEQ ID NO: 71448 - protein, 29 aa, Artificial Sequence
  Description of Artificial Sequence: Synthetic peptide
DTNEIATTNPCAYEPYGSVSANLQRDNES

SEQ ID NO: 71449 - protein, 31 aa, Artificial Sequence
  Description of Artificial Sequence: Synthetic polypeptide
DTNEIRATNPVATEQYGCVVSTNLENYGTQR

SEQ ID NO: 71450 - protein, 31 aa, Artificial Sequence
  Description of Artificial Sequence: Synthetic polypeptide
DEECIRTTNPVATEQYGCVCSSEPQEFGSNQ

SEQ ID NO: 71451 - protein, 33 aa, Artificial Sequence
  Description of Artificial Sequence: Synthetic polypeptide
DTNEIRATNPVAYEQYGSVVSCTNLSQNVGTNR

SEQ ID NO: 71452 - protein, 31 aa, Artificial Sequence
  Description of Artificial Sequence: Synthetic polypeptide
DEECIRTTNPVATEQYGCVCSTADQFFNSDQ

SEQ ID NO: 71453 - protein, 34 aa, Artificial Sequence
  Description of Artificial Sequence: Synthetic polypeptide
DEVEIRTTNPVATEQYGSVATNNAAQRAGTNHTN

SEQ ID NO: 71454 - protein, 32 aa, Artificial Sequence
  Description of Artificial Sequence: Synthetic polypeptide
DTQEIRTTNPCAYEHYGSVSCINLSQREGNNR

SEQ ID NO: 71455 - protein, 29 aa, Artificial Sequence
  Description of Artificial Sequence: Synthetic peptide
AENEIACTNPVATGQYGEASENLQRQGGR

SEQ ID NO: 71456 - protein, 32 aa, Artificial Sequence
  Description of Artificial Sequence: Synthetic polypeptide
DEECIRTTNPVATEQYGCVCSTEEHQNGSNQE

SEQ ID NO: 71457 - protein, 32 aa, Artificial Sequence
  Description of Artificial Sequence: Synthetic polypeptide
DEECIRTTNPVATEQYGCVCSTEELENFGSNQ

SEQ ID NO: 71458 - protein, 31 aa, Artificial Sequence
  Description of Artificial Sequence: Synthetic polypeptide
DEECIRTTNPVATEQYGCVCSTEELNFGDQS

SEQ ID NO: 71459 - protein, 28 aa, Artificial Sequence
  Description of Artificial Sequence: Synthetic peptide
AENEIACTNPVATHQYGEASENKQRGGR

SEQ ID NO: 71460 - protein, 31 aa, Artificial Sequence
  Description of Artificial Sequence: Synthetic polypeptide
DEECIRTTNPVATEQYGCVCSTEELRGSEQS

SEQ ID NO: 71461 - protein, 28 aa, Artificial Sequence
  Description of Artificial Sequence: Synthetic peptide
AENEIACTNPVATHQYGEASENLQEGGR

SEQ ID NO: 71462 - protein, 28 aa, Artificial Sequence
  Description of Artificial Sequence: Synthetic peptide
AENEIACTNPVATHQYGEASENLQRAGR

SEQ ID NO: 71463 - protein, 34 aa, Artificial Sequence
  Description of Artificial Sequence: Synthetic polypeptide
DEEEIRTTNPVATEQYGSVSPTNNMQRQMEEPVP

SEQ ID NO: 71464 - protein, 33 aa, Artificial Sequence
  Description of Artificial Sequence: Synthetic polypeptide
DEECIRTTNPVATEQYGCVCSMTNLQNFGSEQS

SEQ ID NO: 71465 - protein, 28 aa, Artificial Sequence
  Description of Artificial Sequence: Synthetic peptide
AENEIACTNPVATEYYGEASENLQVGGR

SEQ ID NO: 71466 - protein, 31 aa, Artificial Sequence
  Description of Artificial Sequence: Synthetic polypeptide
AEMEIACTNPVATEQYGEACSEDNLQREGNR

SEQ ID NO: 71467 - protein, 33 aa, Artificial Sequence
  Description of Artificial Sequence: Synthetic polypeptide
DEEEIRTTNPVATEQYGSVSINQNEDEGGENQD

SEQ ID NO: 71468 - protein, 34 aa, Artificial Sequence
  Description of Artificial Sequence: Synthetic polypeptide
DEDEIRTTNPVATTQYGSVSTTNQNLNQQGENDE

SEQ ID NO: 71469 - protein, 29 aa, Artificial Sequence
  Description of Artificial Sequence: Synthetic peptide
AEMEIACTNPVATEQYGTASTGLVQFGGR

SEQ ID NO: 71470 - protein, 33 aa, Artificial Sequence
  Description of Artificial Sequence: Synthetic polypeptide
DEEEIRTTNPVATEQYGSVSPTNNLVPNMIEFD

SEQ ID NO: 71471 - protein, 34 aa, Artificial Sequence
  Description of Artificial Sequence: Synthetic polypeptide
DEEEIRTTNPVATEQYGSVSPTNNLWEDLGAEED

SEQ ID NO: 71472 - protein, 30 aa, Artificial Sequence
  Description of Artificial Sequence: Synthetic polypeptide
DTEEIRYTNPVATEQYGCKVHTNLENGTQI

SEQ ID NO: 71473 - protein, 33 aa, Artificial Sequence
  Description of Artificial Sequence: Synthetic polypeptide
DEEEIRTTNPVATEQYGSVSPTNNMEEFGEELD

SEQ ID NO: 71474 - protein, 33 aa, Artificial Sequence
  Description of Artificial Sequence: Synthetic polypeptide
DEVEIRTTNPVATEQYGSVGNTNGQGENGNVDE

SEQ ID NO: 71475 - protein, 29 aa, Artificial Sequence
  Description of Artificial Sequence: Synthetic peptide
AEMEIACTNPVATEQYGEVSEGPQREGGR

SEQ ID NO: 71476 - protein, 32 aa, Artificial Sequence
  Description of Artificial Sequence: Synthetic polypeptide
DTEEIRYTNPVATEQYGMSTPSITNLINGTRI

SEQ ID NO: 71477 - protein, 30 aa, Artificial Sequence
  Description of Artificial Sequence: Synthetic polypeptide
AEMEIACTNPVATEQYGEVSATGPQREGGR

SEQ ID NO: 71478 - protein, 33 aa, Artificial Sequence
  Description of Artificial Sequence: Synthetic polypeptide
DEEEIRTTNPVATEQYGSVSPTNNMGELGEELS

SEQ ID NO: 71479 - protein, 33 aa, Artificial Sequence
  Description of Artificial Sequence: Synthetic polypeptide
DTEEIRYTNPVATEQYGSKVCSTHNLENGSTQR

SEQ ID NO: 71480 - protein, 28 aa, Artificial Sequence
  Description of Artificial Sequence: Synthetic peptide
AENEIACTNPVATEVYGEASENLQMGGR

SEQ ID NO: 71481 - protein, 28 aa, Artificial Sequence
  Description of Artificial Sequence: Synthetic peptide
AEMEIACTNPVATEQYGEASENPERGGR

SEQ ID NO: 71482 - protein, 33 aa, Artificial Sequence
  Description of Artificial Sequence: Synthetic polypeptide
DEVEIRTTNPVATEQYGSVCSPEDLERNGQEND

SEQ ID NO: 71483 - protein, 28 aa, Artificial Sequence
  Description of Artificial Sequence: Synthetic peptide
AENEIACTNPVAVEQYGEASENLQRLGR

SEQ ID NO: 71484 - protein, 34 aa, Artificial Sequence
  Description of Artificial Sequence: Synthetic polypeptide
DEEEIRTTNPVATEQYGSVSPTNWITTVQLVERY

SEQ ID NO: 71485 - protein, 33 aa, Artificial Sequence
  Description of Artificial Sequence: Synthetic polypeptide
DEEEIRTTNPVATEQYGSVSGVNMTGMGGGNGG

SEQ ID NO: 71486 - protein, 34 aa, Artificial Sequence
  Description of Artificial Sequence: Synthetic polypeptide
EEEEIRTTNPVATEQYGSVAVTTNLNQQGENNQT

SEQ ID NO: 71487 - protein, 33 aa, Artificial Sequence
  Description of Artificial Sequence: Synthetic polypeptide
DEECIRTTNPVATESTYGSVSTLNLERFEGQDQ

SEQ ID NO: 71488 - protein, 32 aa, Artificial Sequence
  Description of Artificial Sequence: Synthetic polypeptide
DEVEIRTTNPVATECYGSVSTGNGNTNDEGHR

SEQ ID NO: 71489 - protein, 34 aa, Artificial Sequence
  Description of Artificial Sequence: Synthetic polypeptide
DEEEIRTTNPVATEQYGSVSPTSNIDFRSLENDM

SEQ ID NO: 71490 - protein, 33 aa, Artificial Sequence
  Description of Artificial Sequence: Synthetic polypeptide
DEEEIRTTNPVATEQYGSVSPTSNLMVSIEDFN

SEQ ID NO: 71491 - protein, 31 aa, Artificial Sequence
  Description of Artificial Sequence: Synthetic polypeptide
DEECIRTTNPVAWEQYGQASTINVQGFGMNN

SEQ ID NO: 71492 - protein, 30 aa, Artificial Sequence
  Description of Artificial Sequence: Synthetic polypeptide
DEECIRTTNPVAWEQYGQCCTNNVQGGNNI

SEQ ID NO: 71493 - protein, 29 aa, Artificial Sequence
  Description of Artificial Sequence: Synthetic peptide
AEGEIACTNPVATEQYGEASENLQQGGGR

SEQ ID NO: 71494 - protein, 31 aa, Artificial Sequence
  Description of Artificial Sequence: Synthetic polypeptide
DEECIRTTNPVAWEQYGQVCTVNLVIGGNNV

SEQ ID NO: 71495 - protein, 30 aa, Artificial Sequence
  Description of Artificial Sequence: Synthetic polypeptide
DEECIRTTNPVAWEQYGVVCTIEDGQMGNN

SEQ ID NO: 71496 - protein, 33 aa, Artificial Sequence
  Description of Artificial Sequence: Synthetic polypeptide
DEVEIRTTNPVATECYGSVSTGNGNPQDDEGHR

SEQ ID NO: 71497 - protein, 31 aa, Artificial Sequence
  Description of Artificial Sequence: Synthetic polypeptide
DEECIRTTNPVAWEQYGVVCTIEDGQRGNTH

SEQ ID NO: 71498 - protein, 31 aa, Artificial Sequence
  Description of Artificial Sequence: Synthetic polypeptide
DEECIRTTNPVAWEQYGVVCTIEDGQRMGNK

SEQ ID NO: 71499 - protein, 32 aa, Artificial Sequence
  Description of Artificial Sequence: Synthetic polypeptide
DEVEIRTTNPVATECYGSVSTGNANQDDEGHG

SEQ ID NO: 71500 - protein, 31 aa, Artificial Sequence
  Description of Artificial Sequence: Synthetic polypeptide
DEECIRTTNPVAWEQYGVVCTIEQGQRGNNS

SEQ ID NO: 71501 - protein, 33 aa, Artificial Sequence
  Description of Artificial Sequence: Synthetic polypeptide
DEECIRTTNPVATERYGSVVCTNISQRPGGPYR

SEQ ID NO: 71502 - protein, 34 aa, Artificial Sequence
  Description of Artificial Sequence: Synthetic polypeptide
DEEEIRTTNPVATEQYGSVSPTSNYLEIEIVNID

SEQ ID NO: 71503 - protein, 34 aa, Artificial Sequence
  Description of Artificial Sequence: Synthetic polypeptide
DEECIRTTNPVATERYGSVPSCTNEIQTRPGGDR

SEQ ID NO: 71504 - protein, 34 aa, Artificial Sequence
  Description of Artificial Sequence: Synthetic polypeptide
DEECIRTTNPVATERYGSVPSCTNEGQRPGGPRR

SEQ ID NO: 71505 - protein, 33 aa, Artificial Sequence
  Description of Artificial Sequence: Synthetic polypeptide
EEEEIRTTNPVATEQYGSVATQALQQNGNEQEE

SEQ ID NO: 71506 - protein, 28 aa, Artificial Sequence
  Description of Artificial Sequence: Synthetic peptide
AENEIACTNPVAYEQYGEASENLQRVGR

SEQ ID NO: 71507 - protein, 28 aa, Artificial Sequence
  Description of Artificial Sequence: Synthetic peptide
AEGEIAPTNPCSSEQYGIVSCNLQRGGR

SEQ ID NO: 71508 - protein, 33 aa, Artificial Sequence
  Description of Artificial Sequence: Synthetic polypeptide
EEEEIRTTNPVATEQYGSVATTALQQGNENFEE

SEQ ID NO: 71509 - protein, 34 aa, Artificial Sequence
  Description of Artificial Sequence: Synthetic polypeptide
EEEEIRTTNPVATEQYGSVATTANLQQQNNDERE

SEQ ID NO: 71510 - protein, 34 aa, Artificial Sequence
  Description of Artificial Sequence: Synthetic polypeptide
DEEEIRTTNPVATEQYGSVSPTRNNLEEPGEELD

SEQ ID NO: 71511 - protein, 28 aa, Artificial Sequence
  Description of Artificial Sequence: Synthetic peptide
AEGEIAPTNPCASEQYGIVSENLQSGTR

SEQ ID NO: 71512 - protein, 28 aa, Artificial Sequence
  Description of Artificial Sequence: Synthetic peptide
AEGEIAPTNPCASEQYGIVSCNLQSGGR

SEQ ID NO: 71513 - protein, 35 aa, Artificial Sequence
  Description of Artificial Sequence: Synthetic polypeptide
EEEEIRTTNPVATEQYGSVATTNAQLQQGNNDEQR

SEQ ID NO: 71514 - protein, 32 aa, Artificial Sequence
  Description of Artificial Sequence: Synthetic polypeptide
EEEEIRTTNPVATEQYGSVATTQALQANNDED

SEQ ID NO: 71515 - protein, 31 aa, Artificial Sequence
  Description of Artificial Sequence: Synthetic polypeptide
DEVEIRTTNPVATECYGSVSTGNNQQDDEHG

SEQ ID NO: 71516 - protein, 33 aa, Artificial Sequence
  Description of Artificial Sequence: Synthetic polypeptide
DEVEIRTTNPVATECYGSVSTGNNNQDEGHDRP

SEQ ID NO: 71517 - protein, 32 aa, Artificial Sequence
  Description of Artificial Sequence: Synthetic polypeptide
DEVEIRTTNPVATECYGSVSTGNNMQDEHGGQ

SEQ ID NO: 71518 - protein, 28 aa, Artificial Sequence
  Description of Artificial Sequence: Synthetic peptide
AEGEIAPTNPCASEQYGEASCNLQRGTR

SEQ ID NO: 71519 - protein, 32 aa, Artificial Sequence
  Description of Artificial Sequence: Synthetic polypeptide
DEECIRTTNPVATERYGKVSCTNEIQTPGGPR

SEQ ID NO: 71520 - protein, 34 aa, Artificial Sequence
  Description of Artificial Sequence: Synthetic polypeptide
DEECIRTTNPVATERYGSVPSCTNEIQRPGGGDR

SEQ ID NO: 71521 - protein, 31 aa, Artificial Sequence
  Description of Artificial Sequence: Synthetic polypeptide
EEEEIRTTNPVATEQYGSVATQALQNNDEDE

SEQ ID NO: 71522 - protein, 35 aa, Artificial Sequence
  Description of Artificial Sequence: Synthetic polypeptide
DEEEIRTTNPVATEQYGSVSGTNGQQGEGGGNSGT

SEQ ID NO: 71523 - protein, 32 aa, Artificial Sequence
  Description of Artificial Sequence: Synthetic polypeptide
DEVEIRTTNPVATECYGSVSTGDGGQQNGGNY

SEQ ID NO: 71524 - protein, 33 aa, Artificial Sequence
  Description of Artificial Sequence: Synthetic polypeptide
EEEEIRTTNPVATEQYGSVSEANLQINLIEVRD

SEQ ID NO: 71525 - protein, 32 aa, Artificial Sequence
  Description of Artificial Sequence: Synthetic polypeptide
DEECIRTTNPVAYEPYGQVSTINVSQRGGNNN

SEQ ID NO: 71526 - protein, 33 aa, Artificial Sequence
  Description of Artificial Sequence: Synthetic polypeptide
DEEEIRTTNPVATEQYGSVSGTMTNQETTMNNS

SEQ ID NO: 71527 - protein, 35 aa, Artificial Sequence
  Description of Artificial Sequence: Synthetic polypeptide
DEEEIRTTNPVATEQYGSVSPTTDTLEPRDGMNEM

SEQ ID NO: 71528 - protein, 32 aa, Artificial Sequence
  Description of Artificial Sequence: Synthetic polypeptide
EEEEIRTTNPVATEQYGSVSESLIGNLIEVRD

SEQ ID NO: 71529 - protein, 34 aa, Artificial Sequence
  Description of Artificial Sequence: Synthetic polypeptide
DEEEIRTTNPVATEQYGSVSGTMNNDQGEGGGEQ

SEQ ID NO: 71530 - protein, 35 aa, Artificial Sequence
  Description of Artificial Sequence: Synthetic polypeptide
DEEEIRTTNPVATEQYGSVSGTMNGQQGEGQGNQG

SEQ ID NO: 71531 - protein, 35 aa, Artificial Sequence
  Description of Artificial Sequence: Synthetic polypeptide
DEEEIRTTNPVATEQYGSVSGTMNGETQGEGGNGQ

SEQ ID NO: 71532 - protein, 32 aa, Artificial Sequence
  Description of Artificial Sequence: Synthetic polypeptide
EEEEIRTTNPVATEQYGSVSETNLINLIEVGD

SEQ ID NO: 71533 - protein, 34 aa, Artificial Sequence
  Description of Artificial Sequence: Synthetic polypeptide
DEEEIRTTNPVATEQYGSVSPTTGDQRQGEEGTM

SEQ ID NO: 71534 - protein, 33 aa, Artificial Sequence
  Description of Artificial Sequence: Synthetic polypeptide
DEEEIRTTNPVATEQYGSVSGTMGQAGEGGGEE

SEQ ID NO: 71535 - protein, 33 aa, Artificial Sequence
  Description of Artificial Sequence: Synthetic polypeptide
DEEEIRTTNPVATEQYGSVSPTTILPENSENEM

SEQ ID NO: 71536 - protein, 35 aa, Artificial Sequence
  Description of Artificial Sequence: Synthetic polypeptide
DEEEIRTTNPVATEQYGSVSGTLNPNNQDNGNNEN

SEQ ID NO: 71537 - protein, 31 aa, Artificial Sequence
  Description of Artificial Sequence: Synthetic polypeptide
EEEEIRTTNPVATEQYGSVSGQVLQENALFY

SEQ ID NO: 71538 - protein, 34 aa, Artificial Sequence
  Description of Artificial Sequence: Synthetic polypeptide
DEEEIRTTNPVATEQYGSVSGTLNIMNGGQNGEG

SEQ ID NO: 71539 - protein, 36 aa, Artificial Sequence
  Description of Artificial Sequence: Synthetic polypeptide
DEEEIRTTNPVATEQYGSVSPTTDMLQPRPGMNIEG

SEQ ID NO: 71540 - protein, 28 aa, Artificial Sequence
  Description of Artificial Sequence: Synthetic peptide
AEGEIACTNPCSTEQYGIVSCNLQSGTR

SEQ ID NO: 71541 - protein, 35 aa, Artificial Sequence
  Description of Artificial Sequence: Synthetic polypeptide
DEEEIRTTNPVATEQYGSVSGTNDGQQGEGEGNDT

SEQ ID NO: 71542 - protein, 34 aa, Artificial Sequence
  Description of Artificial Sequence: Synthetic polypeptide
DEEEIRTTNPVATEQYGSVSGTNDIGQGEGTGID

SEQ ID NO: 71543 - protein, 32 aa, Artificial Sequence
  Description of Artificial Sequence: Synthetic polypeptide
DEECIRTTNPVAYEAYRWEVSTNALSQIGGNR

SEQ ID NO: 71544 - protein, 32 aa, Artificial Sequence
  Description of Artificial Sequence: Synthetic polypeptide
EEEEIRTTNPVATEQYGSVILPPEQRPGNLEI

SEQ ID NO: 71545 - protein, 32 aa, Artificial Sequence
  Description of Artificial Sequence: Synthetic polypeptide
DEECIRTTNPVAYECYGISVSTENTQEAMNRS

SEQ ID NO: 71546 - protein, 33 aa, Artificial Sequence
  Description of Artificial Sequence: Synthetic polypeptide
EEEEIRTTNPVATEQYGSVISTNLINGLSEVED

SEQ ID NO: 71547 - protein, 36 aa, Artificial Sequence
  Description of Artificial Sequence: Synthetic polypeptide
DEEEIRTTNPVATEQYGSVSPTSVLEQERTSQNGRE

SEQ ID NO: 71548 - protein, 33 aa, Artificial Sequence
  Description of Artificial Sequence: Synthetic polypeptide
DEVEIRTTNPVATECYGSVATGNLGQDMGNNEV

SEQ ID NO: 71549 - protein, 34 aa, Artificial Sequence
  Description of Artificial Sequence: Synthetic polypeptide
EEEEIRTTNPVATEQYGSVNTVNNLGQAGENNDG

SEQ ID NO: 71550 - protein, 34 aa, Artificial Sequence
  Description of Artificial Sequence: Synthetic polypeptide
EEEEIRTTNPVATEQYGSVNTVNNLGQGEGENND

SEQ ID NO: 71551 - protein, 32 aa, Artificial Sequence
  Description of Artificial Sequence: Synthetic polypeptide
EEEEIRTTNPVATEQYGSVPSLNSSGSTGGNE

SEQ ID NO: 71552 - protein, 36 aa, Artificial Sequence
  Description of Artificial Sequence: Synthetic polypeptide
DEEEIRTTNPVATEQYGSVSGTNDLPQNENGTNGQG

SEQ ID NO: 71553 - protein, 34 aa, Artificial Sequence
  Description of Artificial Sequence: Synthetic polypeptide
DEEEIRTTNPVATEQYGSVSGTNDLGDEGDEEEI

SEQ ID NO: 71554 - protein, 35 aa, Artificial Sequence
  Description of Artificial Sequence: Synthetic polypeptide
DEEEIRTTNPVATEQYGSVSPTSWLEQELSQNQRE

SEQ ID NO: 71555 - protein, 28 aa, Artificial Sequence
  Description of Artificial Sequence: Synthetic peptide
AENEIACTNPVCTEQYGEASENLQEGGR

SEQ ID NO: 71556 - protein, 29 aa, Artificial Sequence
  Description of Artificial Sequence: Synthetic peptide
AEEVIRTTNPVATEQYGMVSSNNFGSGMM

SEQ ID NO: 71557 - protein, 34 aa, Artificial Sequence
  Description of Artificial Sequence: Synthetic polypeptide
DEEEIRTTNPVATEQYGSVSGTNDIGQVGEGGDD

SEQ ID NO: 71558 - protein, 32 aa, Artificial Sequence
  Description of Artificial Sequence: Synthetic polypeptide
DEECIRTTNPVAYEHYGSTPSQNLSQFVGNSR

SEQ ID NO: 71559 - protein, 34 aa, Artificial Sequence
  Description of Artificial Sequence: Synthetic polypeptide
DEEEIRTTNPVATEQYGSVSPTTLDTIQQNSNPE

SEQ ID NO: 71560 - protein, 32 aa, Artificial Sequence
  Description of Artificial Sequence: Synthetic polypeptide
EEEEIRTTNPVATEQYGSVATQALQGNNQFEE

SEQ ID NO: 71561 - protein, 33 aa, Artificial Sequence
  Description of Artificial Sequence: Synthetic polypeptide
DEECIRTTNPVATEQYSACVCSTNLQIFGSNQQ

SEQ ID NO: 71562 - protein, 32 aa, Artificial Sequence
  Description of Artificial Sequence: Synthetic polypeptide
EEAEIRTTNPVAYEQWGSVSTNLNGNEGENDR

SEQ ID NO: 71563 - protein, 32 aa, Artificial Sequence
  Description of Artificial Sequence: Synthetic polypeptide
EEAEIRTTNPVAYEQWGSVSTNLQGDHGNEDT

SEQ ID NO: 71564 - protein, 32 aa, Artificial Sequence
  Description of Artificial Sequence: Synthetic polypeptide
EECEIATTNPVATEQYGSVSTTNQGNSGENDR

SEQ ID NO: 71565 - protein, 28 aa, Artificial Sequence
  Description of Artificial Sequence: Synthetic peptide
AENEIACTNPVAWEQYGEAVENLQRGGR

SEQ ID NO: 71566 - protein, 32 aa, Artificial Sequence
  Description of Artificial Sequence: Synthetic polypeptide
EECEIATTNPVAYEQYGTVSTDNDLQGDNGNR

SEQ ID NO: 71567 - protein, 32 aa, Artificial Sequence
  Description of Artificial Sequence: Synthetic polypeptide
DEVEIRTTNPVATEQYGCVCSTELQHFGSEQN

SEQ ID NO: 71568 - protein, 32 aa, Artificial Sequence
  Description of Artificial Sequence: Synthetic polypeptide
DEDEIRTTNPVATESWGSVSTTLQDGGGMNQS

SEQ ID NO: 71569 - protein, 28 aa, Artificial Sequence
  Description of Artificial Sequence: Synthetic peptide
EEEEIASVNPVCTEQYGVVSDNLLSGNQ

SEQ ID NO: 71570 - protein, 28 aa, Artificial Sequence
  Description of Artificial Sequence: Synthetic peptide
EEEEIASVNPVCTEQYGVVSDNLQSQNQ

SEQ ID NO: 71571 - protein, 28 aa, Artificial Sequence
  Description of Artificial Sequence: Synthetic peptide
EEEEIASVNPVCTEQYGVVSDNLTSGNQ

SEQ ID NO: 71572 - protein, 28 aa, Artificial Sequence
  Description of Artificial Sequence: Synthetic peptide
EEEEIASVNPVCTEQYGVVSDQLQSGNQ

SEQ ID NO: 71573 - protein, 28 aa, Artificial Sequence
  Description of Artificial Sequence: Synthetic peptide
EEEEIASVNPVCYEQYGVVSDNLQSGNQ

SEQ ID NO: 71574 - protein, 35 aa, Artificial Sequence
  Description of Artificial Sequence: Synthetic polypeptide
DEEEIRTTNPVATEQYGSVSGTNVIQFEGGGNDEP

SEQ ID NO: 71575 - protein, 33 aa, Artificial Sequence
  Description of Artificial Sequence: Synthetic polypeptide
EEEEIATTNPVATEQYGSVVPSTNAISQIGGMR

SEQ ID NO: 71576 - protein, 31 aa, Artificial Sequence
  Description of Artificial Sequence: Synthetic polypeptide
EEEEIATTNPVAYEAYGSVSTNEISQKGGMR

SEQ ID NO: 71577 - protein, 28 aa, Artificial Sequence
  Description of Artificial Sequence: Synthetic peptide
AENEIACTNPVAWEQYGEASENLQRTGR

SEQ ID NO: 71578 - protein, 33 aa, Artificial Sequence
  Description of Artificial Sequence: Synthetic polypeptide
DEEEIRTTNPVATEQYGSVSPTPMLLQNLEEGL

SEQ ID NO: 71579 - protein, 33 aa, Artificial Sequence
  Description of Artificial Sequence: Synthetic polypeptide
DEDEIRTTNPVATESYGSVSTTGLQGNGGMNQQ

SEQ ID NO: 71580 - protein, 35 aa, Artificial Sequence
  Description of Artificial Sequence: Synthetic polypeptide
DEECIRTTNPVATEQYGISVPSCTNELAREGGNPQ

SEQ ID NO: 71581 - protein, 32 aa, Artificial Sequence
  Description of Artificial Sequence: Synthetic polypeptide
EDEEICTTNPVATEQYGVVSTTQNLQDGDNGS

SEQ ID NO: 71582 - protein, 34 aa, Artificial Sequence
  Description of Artificial Sequence: Synthetic polypeptide
DEEEIRTTNPVATEQYGSVSPTNWLADTEDNSEE

SEQ ID NO: 71583 - protein, 33 aa, Artificial Sequence
  Description of Artificial Sequence: Synthetic polypeptide
DEEEIRTTNPVATEQYGSVSGVNGQGEGGEEED

SEQ ID NO: 71584 - protein, 33 aa, Artificial Sequence
  Description of Artificial Sequence: Synthetic polypeptide
DEEEIRTTNPVATEQYGSVSGVNGQGEDGGEEG

SEQ ID NO: 71585 - protein, 32 aa, Artificial Sequence
  Description of Artificial Sequence: Synthetic polypeptide
EDEEICTTNPVATEQYGVVSTVNLQLGQNNDD

SEQ ID NO: 71586 - protein, 33 aa, Artificial Sequence
  Description of Artificial Sequence: Synthetic polypeptide
DEEEIRTTNPVATEQYGSVSGVNDTGGEGGNEG

SEQ ID NO: 71587 - protein, 33 aa, Artificial Sequence
  Description of Artificial Sequence: Synthetic polypeptide
DEEEIRTTNPVATEQYGSVSGVNDGQGEGGEEI

SEQ ID NO: 71588 - protein, 32 aa, Artificial Sequence
  Description of Artificial Sequence: Synthetic polypeptide
EDEEICTTNPVATTQYGSVSTNLQQYGNNEEE

SEQ ID NO: 71589 - protein, 28 aa, Artificial Sequence
  Description of Artificial Sequence: Synthetic peptide
AENEIACTNPVAVEQYGEASENLQWGGR

SEQ ID NO: 71590 - protein, 34 aa, Artificial Sequence
  Description of Artificial Sequence: Synthetic polypeptide
DEEEIRTTNPVATEQYGSVSGTVNVDNGGGQNGN

SEQ ID NO: 71591 - protein, 30 aa, Artificial Sequence
  Description of Artificial Sequence: Synthetic polypeptide
EDETICTTNPVATEQWGTVSTNLQEQGDNE

SEQ ID NO: 71592 - protein, 28 aa, Artificial Sequence
  Description of Artificial Sequence: Synthetic peptide
AENEIACTNPVAVEQYGEASENQQRGGR

SEQ ID NO: 71593 - protein, 33 aa, Artificial Sequence
  Description of Artificial Sequence: Synthetic polypeptide
DEVEIRTTNPVATEQYGCVSTGNGLGDAGQQER

SEQ ID NO: 71594 - protein, 35 aa, Artificial Sequence
  Description of Artificial Sequence: Synthetic polypeptide
DEEEIRTTNPVATEQYGSVSPTPDLIEQRQGVGEL

SEQ ID NO: 71595 - protein, 36 aa, Artificial Sequence
  Description of Artificial Sequence: Synthetic polypeptide
DEECIRTTNPVATEQYGISVPSCTGNELQREGGNMP

SEQ ID NO: 71596 - protein, 34 aa, Artificial Sequence
  Description of Artificial Sequence: Synthetic polypeptide
DEEEIRTTNPVATEQYGSVSGTTNDGETGEGNGS

SEQ ID NO: 71597 - protein, 29 aa, Artificial Sequence
  Description of Artificial Sequence: Synthetic peptide
AENEIACTNPVAYEQYGEASENLQRGGQR

SEQ ID NO: 71598 - protein, 33 aa, Artificial Sequence
  Description of Artificial Sequence: Synthetic polypeptide
DEDEIRTTNPVATEQYGVVTVSTTTNLQAGTTS

SEQ ID NO: 71599 - protein, 33 aa, Artificial Sequence
  Description of Artificial Sequence: Synthetic polypeptide
DEVEIRTTNPVATEQYGASVSTTIPQNRENQMV

SEQ ID NO: 71600 - protein, 33 aa, Artificial Sequence
  Description of Artificial Sequence: Synthetic polypeptide
DEEEIRTTNPVATEQYGSVSPTQLDESEEDNGQ

SEQ ID NO: 71601 - protein, 33 aa, Artificial Sequence
  Description of Artificial Sequence: Synthetic polypeptide
DEECIRTTNPVATEQYGSVYCTENDGGQRGKAF

SEQ ID NO: 71602 - protein, 30 aa, Artificial Sequence
  Description of Artificial Sequence: Synthetic polypeptide
AEHEIACTNPVATEQYGEASENLQRGGMRT

SEQ ID NO: 71603 - protein, 33 aa, Artificial Sequence
  Description of Artificial Sequence: Synthetic polypeptide
DEVEIRTTNPVATEGWGSVSTGNGNQQDREGHR

SEQ ID NO: 71604 - protein, 32 aa, Artificial Sequence
  Description of Artificial Sequence: Synthetic polypeptide
EEEEIRTTNPVATEQYGSTSTLQQGNQNGTEE

SEQ ID NO: 71605 - protein, 33 aa, Artificial Sequence
  Description of Artificial Sequence: Synthetic polypeptide
EEEEIRTTNPVATEQYGSTSTNLLQGNQQGTEE

SEQ ID NO: 71606 - protein, 33 aa, Artificial Sequence
  Description of Artificial Sequence: Synthetic polypeptide
EEEEIRTTNPVATEQYGSTSTTQLQAGNQNGTE

SEQ ID NO: 71607 - protein, 32 aa, Artificial Sequence
  Description of Artificial Sequence: Synthetic polypeptide
DEVEIRTTNPVATEFYGDVSTDLQQGGGNEQG

SEQ ID NO: 71608 - protein, 32 aa, Artificial Sequence
  Description of Artificial Sequence: Synthetic polypeptide
EEEEIRTTNPVATEQYGSVATALEQGNNQFEE

SEQ ID NO: 71609 - protein, 32 aa, Artificial Sequence
  Description of Artificial Sequence: Synthetic polypeptide
DEECIRTTNPVATEQYSACVCSTELQNGSNQS

SEQ ID NO: 71610 - protein, 28 aa, Artificial Sequence
  Description of Artificial Sequence: Synthetic peptide
AEGEIASVNPVCTEQYGVVSDNLQSGNQ

SEQ ID NO: 71611 - protein, 28 aa, Artificial Sequence
  Description of Artificial Sequence: Synthetic peptide
AEGEIAPTNPVSTEQYGEASENLQSGTR

SEQ ID NO: 71612 - protein, 32 aa, Artificial Sequence
  Description of Artificial Sequence: Synthetic polypeptide
DEECIRTTNPVATEQYSACVCSTGNLQNGSDQ

SEQ ID NO: 71613 - protein, 28 aa, Artificial Sequence
  Description of Artificial Sequence: Synthetic peptide
AEGEIAPTNPVASEQYGEASCNLQSGGR

SEQ ID NO: 71614 - protein, 34 aa, Artificial Sequence
  Description of Artificial Sequence: Synthetic polypeptide
DEVEIRTTNPVATECYGSVSTNPGLGQTNGGGNQ

SEQ ID NO: 71615 - protein, 31 aa, Artificial Sequence
  Description of Artificial Sequence: Synthetic polypeptide
DEECIRTTNPVATEQYGSVVHWDTEQQGNHG

SEQ ID NO: 71616 - protein, 33 aa, Artificial Sequence
  Description of Artificial Sequence: Synthetic polypeptide
DEDEIRTTNPVATEQYGVVTVSSTNLQAGSTTS

SEQ ID NO: 71617 - protein, 33 aa, Artificial Sequence
  Description of Artificial Sequence: Synthetic polypeptide
EEEEIRTTNPVATEQYGCVCSTELQENFGSNQV

SEQ ID NO: 71618 - protein, 33 aa, Artificial Sequence
  Description of Artificial Sequence: Synthetic polypeptide
EEEEIRTTNPVATEHYGSVVPSLNLQQTGGNNE

SEQ ID NO: 71619 - protein, 34 aa, Artificial Sequence
  Description of Artificial Sequence: Synthetic polypeptide
DEEEIRTTNPVATEQYGSVSPTPNMPVRLEFGLY

SEQ ID NO: 71620 - protein, 34 aa, Artificial Sequence
  Description of Artificial Sequence: Synthetic polypeptide
DEEEIRTTNPVATEQYGSVSPTPNQMQQTPVNES

SEQ ID NO: 71621 - protein, 28 aa, Artificial Sequence
  Description of Artificial Sequence: Synthetic peptide
EEEEIGSVNPVCTEQYGVVAVNLQSGNN

SEQ ID NO: 71622 - protein, 28 aa, Artificial Sequence
  Description of Artificial Sequence: Synthetic peptide
EEEEIGSVNPVCTEQYGVVSNNLQSGTQ

SEQ ID NO: 71623 - protein, 29 aa, Artificial Sequence
  Description of Artificial Sequence: Synthetic peptide
EEEEIGSVNPVCTEQYGVVSVNLQSGNDQ

SEQ ID NO: 71624 - protein, 29 aa, Artificial Sequence
  Description of Artificial Sequence: Synthetic peptide
EEEEIGSVNPVCTEQYGVVSVNLQSGNTE

SEQ ID NO: 71625 - protein, 33 aa, Artificial Sequence
  Description of Artificial Sequence: Synthetic polypeptide
DEECIRTTNPVATEQYGSASAKGDNQDQRKGMR

SEQ ID NO: 71626 - protein, 34 aa, Artificial Sequence
  Description of Artificial Sequence: Synthetic polypeptide
DEEEIRTTNPVATEQYGSVSPTPNWLQTEDQSEE

SEQ ID NO: 71627 - protein, 32 aa, Artificial Sequence
  Description of Artificial Sequence: Synthetic polypeptide
DEEEIRTTNPVATEQYGSVSPTPPMQQIMDEN

SEQ ID NO: 71628 - protein, 32 aa, Artificial Sequence
  Description of Artificial Sequence: Synthetic polypeptide
DEVEIRTTNPVATENYGSVSTGNGNQQMDGGS

SEQ ID NO: 71629 - protein, 36 aa, Artificial Sequence
  Description of Artificial Sequence: Synthetic polypeptide
DEEEIRTTNPVATEQYGSVSGTNNGLGEDQEGGNTT

SEQ ID NO: 71630 - protein, 34 aa, Artificial Sequence
  Description of Artificial Sequence: Synthetic polypeptide
DEEEIRTTNPVATEQYGSVSPTPTVNQRNMNSEN

SEQ ID NO: 71631 - protein, 33 aa, Artificial Sequence
  Description of Artificial Sequence: Synthetic polypeptide
EEEEIRTTNPVATEAYGVVSTTNLQTQQGNDQD

SEQ ID NO: 71632 - protein, 33 aa, Artificial Sequence
  Description of Artificial Sequence: Synthetic polypeptide
DEVEIRTTNPVATENYGSVSTGNEGNQQMNGNS

SEQ ID NO: 71633 - protein, 34 aa, Artificial Sequence
  Description of Artificial Sequence: Synthetic polypeptide
DEEEIRTTNPVATEQYGSVSPTQAAENQRSQDER

SEQ ID NO: 71634 - protein, 32 aa, Artificial Sequence
  Description of Artificial Sequence: Synthetic polypeptide
EEEEIRTTNPVATEQYGCVCSTEHQNFGSNQM

SEQ ID NO: 71635 - protein, 34 aa, Artificial Sequence
  Description of Artificial Sequence: Synthetic polypeptide
DEEEIRTTNPVATEQYGSVSPTNMDQDEMPESRE

SEQ ID NO: 71636 - protein, 34 aa, Artificial Sequence
  Description of Artificial Sequence: Synthetic polypeptide
DEEEIRTTNPVATEQYGSVSPYLEATEGNMVDRN

SEQ ID NO: 71637 - protein, 33 aa, Artificial Sequence
  Description of Artificial Sequence: Synthetic polypeptide
DEEEIRTTNPVATEQYGSVSPYNDLHDGIFEEY

SEQ ID NO: 71638 - protein, 28 aa, Artificial Sequence
  Description of Artificial Sequence: Synthetic peptide
HEEEIASVNPVCFEQYGVVSDNLQSGNQ

SEQ ID NO: 71639 - protein, 29 aa, Artificial Sequence
  Description of Artificial Sequence: Synthetic peptide
HEEEIASVNPVCTEQYGVVSDGNLQSGNQ

SEQ ID NO: 71640 - protein, 29 aa, Artificial Sequence
  Description of Artificial Sequence: Synthetic peptide
HEEEIASVNPVCTEQYGVVSDHNLQSGNQ

SEQ ID NO: 71641 - protein, 28 aa, Artificial Sequence
  Description of Artificial Sequence: Synthetic peptide
HEEEIASVNPVCTWQYGVVSDNLQSGNQ

SEQ ID NO: 71642 - protein, 30 aa, Artificial Sequence
  Description of Artificial Sequence: Synthetic polypeptide
AENEICATNPVATEQYGSVASENLQSGVGE

SEQ ID NO: 71643 - protein, 30 aa, Artificial Sequence
  Description of Artificial Sequence: Synthetic polypeptide
AENEICATNPVATEQYGSVATSENLQQGGE

SEQ ID NO: 71644 - protein, 31 aa, Artificial Sequence
  Description of Artificial Sequence: Synthetic polypeptide
GQEEIATTNPVAYEQWGTVSTNLQGEDGQNR

SEQ ID NO: 71645 - protein, 32 aa, Artificial Sequence
  Description of Artificial Sequence: Synthetic polypeptide
DEEEIRTTNPVATEQYGSVSSNLVTVTEAQVA

SEQ ID NO: 71646 - protein, 33 aa, Artificial Sequence
  Description of Artificial Sequence: Synthetic polypeptide
HEEEIRTTNPVATEQYGCVSCNLHQGRNANFNV

SEQ ID NO: 71647 - protein, 30 aa, Artificial Sequence
  Description of Artificial Sequence: Synthetic polypeptide
DEVEIATTNPVATDQYGVVSTDGQGEGNTE

SEQ ID NO: 71648 - protein, 32 aa, Artificial Sequence
  Description of Artificial Sequence: Synthetic polypeptide
DEEEIRTTNPVATEQYGSVSSNNQEPVEQMIE

SEQ ID NO: 71649 - protein, 29 aa, Artificial Sequence
  Description of Artificial Sequence: Synthetic peptide
DEVEIATTNPVATDQYGVVSTDGEGGNDT

SEQ ID NO: 71650 - protein, 31 aa, Artificial Sequence
  Description of Artificial Sequence: Synthetic polypeptide
AENEICATNPVATEQYGSVAVSENLQRGEGE

SEQ ID NO: 71651 - protein, 32 aa, Artificial Sequence
  Description of Artificial Sequence: Synthetic polypeptide
HEEEIRTTNPVATEQYGSVSETQSDQINENLY

SEQ ID NO: 71652 - protein, 29 aa, Artificial Sequence
  Description of Artificial Sequence: Synthetic peptide
AENEICATNPVATEQYGSVAVENLQMGGD

SEQ ID NO: 71653 - protein, 33 aa, Artificial Sequence
  Description of Artificial Sequence: Synthetic polypeptide
DEDEIRTTNPVATEQYGSVCVTDNGNGAGDNNR

SEQ ID NO: 71654 - protein, 30 aa, Artificial Sequence
  Description of Artificial Sequence: Synthetic polypeptide
DEVEIATTNPVATDQYGVVSTTDGQGGNNQ

SEQ ID NO: 71655 - protein, 31 aa, Artificial Sequence
  Description of Artificial Sequence: Synthetic polypeptide
DEVEIATTNPVATEAWGNVSTNLQGNDNDGR

SEQ ID NO: 71656 - protein, 33 aa, Artificial Sequence
  Description of Artificial Sequence: Synthetic polypeptide
DEDEIRTTNPVATEQYGSVQTVANLNIRTTNNA

SEQ ID NO: 71657 - protein, 31 aa, Artificial Sequence
  Description of Artificial Sequence: Synthetic polypeptide
GEEEIACTNPVAYEQYGSVVPTANMQFPGNR

SEQ ID NO: 71658 - protein, 28 aa, Artificial Sequence
  Description of Artificial Sequence: Synthetic peptide
GEEEIASVNPVCYEQYGVVSDNLQSGNQ

SEQ ID NO: 71659 - protein, 34 aa, Artificial Sequence
  Description of Artificial Sequence: Synthetic polypeptide
DEDEIRTTNPVATEQYGSVQTTQANLQIGTTNNE

SEQ ID NO: 71660 - protein, 32 aa, Artificial Sequence
  Description of Artificial Sequence: Synthetic polypeptide
DEDEIRTTNPVATEQYGSVQTTQALIRTTNNA

SEQ ID NO: 71661 - protein, 33 aa, Artificial Sequence
  Description of Artificial Sequence: Synthetic polypeptide
GEEEIRSTNPVATEQYGSVSDTEALQQEGENDI

SEQ ID NO: 71662 - protein, 31 aa, Artificial Sequence
  Description of Artificial Sequence: Synthetic polypeptide
GEEEIRTTNPVATEQWGSTSTNLPITAQNDA

SEQ ID NO: 71663 - protein, 33 aa, Artificial Sequence
  Description of Artificial Sequence: Synthetic polypeptide
GEEEIRTTNPVATEQYGAVVEPTENAYQCEGNR

SEQ ID NO: 71664 - protein, 33 aa, Artificial Sequence
  Description of Artificial Sequence: Synthetic polypeptide
AEEEIRTTNPVATESYGSVVTVTNLNQGEDGNQ

SEQ ID NO: 71665 - protein, 34 aa, Artificial Sequence
  Description of Artificial Sequence: Synthetic polypeptide
GEEEIRTTNPVATEQYGSVNSPTGNVHQERDMIR

SEQ ID NO: 71666 - protein, 32 aa, Artificial Sequence
  Description of Artificial Sequence: Synthetic polypeptide
DEDEIRTTNPVATEQYGSVQTQALLQISTNNE

SEQ ID NO: 71667 - protein, 32 aa, Artificial Sequence
  Description of Artificial Sequence: Synthetic polypeptide
DEDEIRTTNPVATEQYGSVQTAQLNIRTTNNT

SEQ ID NO: 71668 - protein, 34 aa, Artificial Sequence
  Description of Artificial Sequence: Synthetic polypeptide
DEEEIRTTNPVATEQYGSVSCTVNGPQTFGMQFQ

SEQ ID NO: 71669 - protein, 34 aa, Artificial Sequence
  Description of Artificial Sequence: Synthetic polypeptide
GEQEIRTTNPVATEQYGCVCSFTSNSLTQDGNRY

SEQ ID NO: 71670 - protein, 34 aa, Artificial Sequence
  Description of Artificial Sequence: Synthetic polypeptide
DEEEIRTTNPVATEQYGSVSCTVELNQETSEDRQ

SEQ ID NO: 71671 - protein, 33 aa, Artificial Sequence
  Description of Artificial Sequence: Synthetic polypeptide
DEEEIRTTNPVATEQYGSVSSNTNGGNNINVPE

SEQ ID NO: 71672 - protein, 34 aa, Artificial Sequence
  Description of Artificial Sequence: Synthetic polypeptide
AEEEIRTTNPVATESYGSVSTVTNLQNQGNDGGE

SEQ ID NO: 71673 - protein, 33 aa, Artificial Sequence
  Description of Artificial Sequence: Synthetic polypeptide
AEEEIRTTNPVATESYGSVSTVTNLNQGNDEGG

SEQ ID NO: 71674 - protein, 28 aa, Artificial Sequence
  Description of Artificial Sequence: Synthetic peptide
AENEICATNPVATEQYGTTSENLQAGGN

SEQ ID NO: 71675 - protein, 28 aa, Artificial Sequence
  Description of Artificial Sequence: Synthetic peptide
AENEICATNPVATEQYGVNSENLQDGGT

SEQ ID NO: 71676 - protein, 33 aa, Artificial Sequence
  Description of Artificial Sequence: Synthetic polypeptide
AEEEIRTTNPVATESYGSVSNTNLGNQQGTDQD

SEQ ID NO: 71677 - protein, 33 aa, Artificial Sequence
  Description of Artificial Sequence: Synthetic polypeptide
HEEEIRTTNPVAYEQYGSVSIAENFLQQEGNVQ

SEQ ID NO: 71678 - protein, 33 aa, Artificial Sequence
  Description of Artificial Sequence: Synthetic polypeptide
DEEEIRTTNPVATEQYGSVSSNYDVQWDTGTSP

SEQ ID NO: 71679 - protein, 29 aa, Artificial Sequence
  Description of Artificial Sequence: Synthetic peptide
AENEICATNPVATEQYGVVASENLQAGEI

SEQ ID NO: 71680 - protein, 31 aa, Artificial Sequence
  Description of Artificial Sequence: Synthetic polypeptide
DEVEIATTNPVATDQWGVVSTALQGGGDNGR

SEQ ID NO: 71681 - protein, 31 aa, Artificial Sequence
  Description of Artificial Sequence: Synthetic polypeptide
DEVEIATTNPVATDQWGEVSTADDQRNGDNR

SEQ ID NO: 71682 - protein, 30 aa, Artificial Sequence
  Description of Artificial Sequence: Synthetic polypeptide
DEVEIATTNPVATDQWGEVSTADDQRGQER

SEQ ID NO: 71683 - protein, 31 aa, Artificial Sequence
  Description of Artificial Sequence: Synthetic polypeptide
DEDEIRTTNPVATEQYGSVCAANPQGGPDQH

SEQ ID NO: 71684 - protein, 33 aa, Artificial Sequence
  Description of Artificial Sequence: Synthetic polypeptide
HEGEIRCTNPVATEQYGSVCSTLNDLQRSINFM

SEQ ID NO: 71685 - protein, 34 aa, Artificial Sequence
  Description of Artificial Sequence: Synthetic polypeptide
DEEEIRTTNPVATEQYGSVSCTNGVGERFGSQQD

SEQ ID NO: 71686 - protein, 32 aa, Artificial Sequence
  Description of Artificial Sequence: Synthetic polypeptide
HEGEIRCTNPVATEQYGSVSTNDLQFNQNEYG

SEQ ID NO: 71687 - protein, 33 aa, Artificial Sequence
  Description of Artificial Sequence: Synthetic polypeptide
DEEEIRTTNPVATEQYGSVSSPNNLELEQVPEE

SEQ ID NO: 71688 - protein, 32 aa, Artificial Sequence
  Description of Artificial Sequence: Synthetic polypeptide
HEGEIRTTNPVATEQYGSVSTEDLQENQNPYN

SEQ ID NO: 71689 - protein, 30 aa, Artificial Sequence
  Description of Artificial Sequence: Synthetic polypeptide
DEVEIATTNPVATDQWGEVSTADDQRGNDA

SEQ ID NO: 71690 - protein, 32 aa, Artificial Sequence
  Description of Artificial Sequence: Synthetic polypeptide
AEEEIRTTNPVATESYGSVSNTNLLNNQGDQD

SEQ ID NO: 71691 - protein, 33 aa, Artificial Sequence
  Description of Artificial Sequence: Synthetic polypeptide
DEEEIRTTNPVATEQYGSVSSNLGPQVSQEFMM

SEQ ID NO: 71692 - protein, 33 aa, Artificial Sequence
  Description of Artificial Sequence: Synthetic polypeptide
AEEEIRTTNPVATESYGSVSNTNLLQAGTDQST

SEQ ID NO: 71693 - protein, 32 aa, Artificial Sequence
  Description of Artificial Sequence: Synthetic polypeptide
AEEEIRTTNPVATESYGSVSNTNLNGNGEDQT

SEQ ID NO: 71694 - protein, 30 aa, Artificial Sequence
  Description of Artificial Sequence: Synthetic polypeptide
AENEICATNPVATEQYGTVASENLQRGTDT

SEQ ID NO: 71695 - protein, 30 aa, Artificial Sequence
  Description of Artificial Sequence: Synthetic polypeptide
AENEICATNPVATEQYGTVATSENLQRGEN

SEQ ID NO: 71696 - protein, 31 aa, Artificial Sequence
  Description of Artificial Sequence: Synthetic polypeptide
AEEEIRTTNPVATESYGSVSTVSTGVETGNQ

SEQ ID NO: 71697 - protein, 32 aa, Artificial Sequence
  Description of Artificial Sequence: Synthetic polypeptide
DEVEIATTNPVATDQYGEVSTADDDQREGNER

SEQ ID NO: 71698 - protein, 29 aa, Artificial Sequence
  Description of Artificial Sequence: Synthetic peptide
AENEICATNPVATEQYGVASENLQEGTER

SEQ ID NO: 71699 - protein, 34 aa, Artificial Sequence
  Description of Artificial Sequence: Synthetic polypeptide
DEEEIRTTNPVATEQYGSVSSNTQPEMQGGGNNG

SEQ ID NO: 71700 - protein, 33 aa, Artificial Sequence
  Description of Artificial Sequence: Synthetic polypeptide
AEEEIRTTNPVATESYGSVSTVNNQQQQGNGNT

SEQ ID NO: 71701 - protein, 34 aa, Artificial Sequence
  Description of Artificial Sequence: Synthetic polypeptide
AEEEIRTTNPVATESYGSVSTTQNLQNNQGTDQR

SEQ ID NO: 71702 - protein, 28 aa, Artificial Sequence
  Description of Artificial Sequence: Synthetic peptide
AENEICATNPVATEQYGVASENLQNGTT

SEQ ID NO: 71703 - protein, 28 aa, Artificial Sequence
  Description of Artificial Sequence: Synthetic peptide
AENEICATNPVATEQYGVASENLQQGEQ

SEQ ID NO: 71704 - protein, 33 aa, Artificial Sequence
  Description of Artificial Sequence: Synthetic polypeptide
AEEEIRTTNPVATESYGSVSTTNNLNNGTDQRT

SEQ ID NO: 71705 - protein, 28 aa, Artificial Sequence
  Description of Artificial Sequence: Synthetic peptide
AENEICATNPVATEQYGVASENLQTGGD

SEQ ID NO: 71706 - protein, 33 aa, Artificial Sequence
  Description of Artificial Sequence: Synthetic polypeptide
AEEEIRTTNPVATESYGSVSTNNLQQNTNGEED

SEQ ID NO: 71707 - protein, 31 aa, Artificial Sequence
  Description of Artificial Sequence: Synthetic polypeptide
DEECISTTNPVAYEQWGESYSVDNNQRGDNR

SEQ ID NO: 71708 - protein, 33 aa, Artificial Sequence
  Description of Artificial Sequence: Synthetic polypeptide
AEEEIRTTNPVATESYGSVSNTNLQLQQGTDQS

SEQ ID NO: 71709 - protein, 28 aa, Artificial Sequence
  Description of Artificial Sequence: Synthetic peptide
AENEICATNPVATEQYGVASNNLQQGGE

SEQ ID NO: 71710 - protein, 30 aa, Artificial Sequence
  Description of Artificial Sequence: Synthetic polypeptide
AENEICATNPVATEQYGSVASENLQLGGTE

SEQ ID NO: 71711 - protein, 32 aa, Artificial Sequence
  Description of Artificial Sequence: Synthetic polypeptide
DEVEIATTNPVATEAWGSVSTNLQLGEDTDSR

SEQ ID NO: 71712 - protein, 32 aa, Artificial Sequence
  Description of Artificial Sequence: Synthetic polypeptide
DEVEIATTNPVATEAWGSVSTNLQLGGDNGEE

SEQ ID NO: 71713 - protein, 33 aa, Artificial Sequence
  Description of Artificial Sequence: Synthetic polypeptide
DEDEIRTTNPVATEQYGSVSTNDLTQELFEDGD

SEQ ID NO: 71714 - protein, 32 aa, Artificial Sequence
  Description of Artificial Sequence: Synthetic polypeptide
DEECISTTNPVATEYYGCVCNTNGLQRGSNQA

SEQ ID NO: 71715 - protein, 32 aa, Artificial Sequence
  Description of Artificial Sequence: Synthetic polypeptide
FEEEIRTTNPVATESYGSVSNTVNLHFTGGQN

SEQ ID NO: 71716 - protein, 28 aa, Artificial Sequence
  Description of Artificial Sequence: Synthetic peptide
AENEICATNPVATEQYGATSENLQEGGP

SEQ ID NO: 71717 - protein, 33 aa, Artificial Sequence
  Description of Artificial Sequence: Synthetic polypeptide
DEEEIRTTNPVATEQYGSVSDNGLLAQQEDEES

SEQ ID NO: 71718 - protein, 33 aa, Artificial Sequence
  Description of Artificial Sequence: Synthetic polypeptide
DEEEIRTTNPVATEQYGSVSDMDMIQRIQNDGV

SEQ ID NO: 71719 - protein, 33 aa, Artificial Sequence
  Description of Artificial Sequence: Synthetic polypeptide
DEEEIRTTNPVATEQYGSVSDMDMIQRIDGDGI

SEQ ID NO: 71720 - protein, 33 aa, Artificial Sequence
  Description of Artificial Sequence: Synthetic polypeptide
DEEEIRTTNPVATEQYGSVSDMDDGQRIQGDGI

SEQ ID NO: 71721 - protein, 31 aa, Artificial Sequence
  Description of Artificial Sequence: Synthetic polypeptide
FEEEISTTNPVATEQYGEVSSNNLQDYFDIR

SEQ ID NO: 71722 - protein, 28 aa, Artificial Sequence
  Description of Artificial Sequence: Synthetic peptide
AENEICATNPVATEQYGESSENLQEGGV

SEQ ID NO: 71723 - protein, 31 aa, Artificial Sequence
  Description of Artificial Sequence: Synthetic polypeptide
DEEEIRTTNPVATEQYGSVSDLEMELVVVQD

SEQ ID NO: 71724 - protein, 29 aa, Artificial Sequence
  Description of Artificial Sequence: Synthetic peptide
AEEEIRTTNPVAYEHWGCFSINDMQRGNS

SEQ ID NO: 71725 - protein, 30 aa, Artificial Sequence
  Description of Artificial Sequence: Synthetic polypeptide
AEEEIRTTNPVAYEHWGCFSINDLQDGHNR

SEQ ID NO: 71726 - protein, 31 aa, Artificial Sequence
  Description of Artificial Sequence: Synthetic polypeptide
FEEGITTTNPVATEQYGSVSLMVNDQRGEES

SEQ ID NO: 71727 - protein, 32 aa, Artificial Sequence
  Description of Artificial Sequence: Synthetic polypeptide
DEEEIRTTNPVATEQYGSVSSMDPTVQAEINQ

SEQ ID NO: 71728 - protein, 35 aa, Artificial Sequence
  Description of Artificial Sequence: Synthetic polypeptide
DEDEIRTTNPVATEQYGSVSTQGNLQAGNNNNEQS

SEQ ID NO: 71729 - protein, 33 aa, Artificial Sequence
  Description of Artificial Sequence: Synthetic polypeptide
DEEEIRTTNPVATEQYGSVSDGVNGQGEEGGEG

SEQ ID NO: 71730 - protein, 32 aa, Artificial Sequence
  Description of Artificial Sequence: Synthetic polypeptide
DEVEIATTNPVATECYGSVSTNLQLGGDQGEG

SEQ ID NO: 71731 - protein, 31 aa, Artificial Sequence
  Description of Artificial Sequence: Synthetic polypeptide
DEVEIATTNPVATECYGSVVTNPGNLGENMR

SEQ ID NO: 71732 - protein, 31 aa, Artificial Sequence
  Description of Artificial Sequence: Synthetic polypeptide
DEVEIATTNPVATEHYGSVVTNPGDLGENNR

SEQ ID NO: 71733 - protein, 28 aa, Artificial Sequence
  Description of Artificial Sequence: Synthetic peptide
AENEIATTNPVSTEQYGTASENLQQGGH

SEQ ID NO: 71734 - protein, 31 aa, Artificial Sequence
  Description of Artificial Sequence: Synthetic polypeptide
DEVEIATTNPVATEHYGEVSTNLQGQDDDSR

SEQ ID NO: 71735 - protein, 28 aa, Artificial Sequence
  Description of Artificial Sequence: Synthetic peptide
AENEIAVTNPVATEQYGEASENAQRGGN

SEQ ID NO: 71736 - protein, 32 aa, Artificial Sequence
  Description of Artificial Sequence: Synthetic polypeptide
DEEEIRTTNPVATEQYGSVSDNNTASINVLVQ

SEQ ID NO: 71737 - protein, 34 aa, Artificial Sequence
  Description of Artificial Sequence: Synthetic polypeptide
DEEEIRTTNPVATEQYGSVSDNNQNVEMGGNGEE

SEQ ID NO: 71738 - protein, 32 aa, Artificial Sequence
  Description of Artificial Sequence: Synthetic polypeptide
DEVEIATTNPVATEEYGSVSTNLQLGGDDGEE

SEQ ID NO: 71739 - protein, 32 aa, Artificial Sequence
  Description of Artificial Sequence: Synthetic polypeptide
FEEEIRTTNPVATEQYGVVGTLTNDQNEGGNI

SEQ ID NO: 71740 - protein, 28 aa, Artificial Sequence
  Description of Artificial Sequence: Synthetic peptide
AENEIAVTNPVATEQYGEASENLQNGGQ

SEQ ID NO: 71741 - protein, 33 aa, Artificial Sequence
  Description of Artificial Sequence: Synthetic polypeptide
DEDEIRTTNPVATEQYGSVSTQNLEGNNNNEDQ

SEQ ID NO: 71742 - protein, 32 aa, Artificial Sequence
  Description of Artificial Sequence: Synthetic polypeptide
FEEEIRTTNPVATEQYGVVNTQVGNGQGGNNG

SEQ ID NO: 71743 - protein, 34 aa, Artificial Sequence
  Description of Artificial Sequence: Synthetic polypeptide
DEDEIRTTNPVATEQYGSVSTQNLEAGNNNNEDT

SEQ ID NO: 71744 - protein, 29 aa, Artificial Sequence
  Description of Artificial Sequence: Synthetic peptide
AENEIAVTNPVATEQYGEASENLQRGGAD

SEQ ID NO: 71745 - protein, 33 aa, Artificial Sequence
  Description of Artificial Sequence: Synthetic polypeptide
DEVEIATTNPVATECYGVVSTNLQGNDSGGNAR

SEQ ID NO: 71746 - protein, 31 aa, Artificial Sequence
  Description of Artificial Sequence: Synthetic polypeptide
FEEEIRTTNPVATEQYGVVSTGDEGGNGENT

SEQ ID NO: 71747 - protein, 30 aa, Artificial Sequence
  Description of Artificial Sequence: Synthetic polypeptide
DEVEIATTNPVATECYGSVVTNPGLGENAH

SEQ ID NO: 71748 - protein, 29 aa, Artificial Sequence
  Description of Artificial Sequence: Synthetic peptide
AENEICATNPVATEQYGVVASENLQAGVD

SEQ ID NO: 71749 - protein, 29 aa, Artificial Sequence
  Description of Artificial Sequence: Synthetic peptide
AENEICATNPVATEQYGEVTSELLQRGGG

SEQ ID NO: 71750 - protein, 33 aa, Artificial Sequence
  Description of Artificial Sequence: Synthetic polypeptide
DEEEIRTTNPVATEQYGSVSDGTGGGNEGENII

SEQ ID NO: 71751 - protein, 31 aa, Artificial Sequence
  Description of Artificial Sequence: Synthetic polypeptide
FEETIRTTNPVATEQYGSVSSNQEDYGMEFR

SEQ ID NO: 71752 - protein, 32 aa, Artificial Sequence
  Description of Artificial Sequence: Synthetic polypeptide
AEEEIRTTNPVAYEEYGCIPSINLSQRGGNNR

SEQ ID NO: 71753 - protein, 31 aa, Artificial Sequence
  Description of Artificial Sequence: Synthetic polypeptide
DEVEIATTNPVATECYGEVSTNLQGEDTDSR

SEQ ID NO: 71754 - protein, 33 aa, Artificial Sequence
  Description of Artificial Sequence: Synthetic polypeptide
DEEEIRTTNPVATEQYGSVSDDTNMTMEGGGEG

SEQ ID NO: 71755 - protein, 32 aa, Artificial Sequence
  Description of Artificial Sequence: Synthetic polypeptide
FEETIRTTNPVATEQYGSVSTNLEDYQGMEFS

SEQ ID NO: 71756 - protein, 32 aa, Artificial Sequence
  Description of Artificial Sequence: Synthetic polypeptide
FEETIRTTNPVATEQYGSVSVTNLEDYSMEFR

SEQ ID NO: 71757 - protein, 33 aa, Artificial Sequence
  Description of Artificial Sequence: Synthetic polypeptide
DEEEIRTTNPVATEQYGSVSDDPNMTMEIGGNG

SEQ ID NO: 71758 - protein, 30 aa, Artificial Sequence
  Description of Artificial Sequence: Synthetic polypeptide
AENEICATNPVATEQYGSVAEENLQRGEGD

SEQ ID NO: 71759 - protein, 33 aa, Artificial Sequence
  Description of Artificial Sequence: Synthetic polypeptide
DEEEIRTTNPVATEQYGSVSDDNNVEIGGNGEI

SEQ ID NO: 71760 - protein, 33 aa, Artificial Sequence
  Description of Artificial Sequence: Synthetic polypeptide
DEEEIRTTNPVATEQYGSVSDDNMTMEIGNNGD

SEQ ID NO: 71761 - protein, 32 aa, Artificial Sequence
  Description of Artificial Sequence: Synthetic polypeptide
AEEEIRTTNPVAYEAYGQCISINMLSQRGGNR

SEQ ID NO: 71762 - protein, 33 aa, Artificial Sequence
  Description of Artificial Sequence: Synthetic polypeptide
DEEEIRTTNPVATEQYGSVSDDGTGGGNEGNIG

SEQ ID NO: 71763 - protein, 33 aa, Artificial Sequence
  Description of Artificial Sequence: Synthetic polypeptide
DEEEIRTTNPVATEQYGSVSDDGMNQTGEGNDG

SEQ ID NO: 71764 - protein, 32 aa, Artificial Sequence
  Description of Artificial Sequence: Synthetic polypeptide
DEDEIRTTNPVATEQYGSVSDSMNGVPRMSNT

SEQ ID NO: 71765 - protein, 29 aa, Artificial Sequence
  Description of Artificial Sequence: Synthetic peptide
AENEICATNPVATEQYGSVANENLQDGGT

SEQ ID NO: 71766 - protein, 33 aa, Artificial Sequence
  Description of Artificial Sequence: Synthetic polypeptide
DEEEIRTTNPVATEQYGSVSDDVTGLGEGEGGE

SEQ ID NO: 71767 - protein, 31 aa, Artificial Sequence
  Description of Artificial Sequence: Synthetic polypeptide
FEEGITTTNPVATEQYGSVSLMVNSQRGEAG

SEQ ID NO: 71768 - protein, 34 aa, Artificial Sequence
  Description of Artificial Sequence: Synthetic polypeptide
DEEEIRTTNPVATEQYGSVSDDVTGLGEQGGDGE

SEQ ID NO: 71769 - protein, 32 aa, Artificial Sequence
  Description of Artificial Sequence: Synthetic polypeptide
AEEEIRTTNPVAYEEYGCVIPSCINLQNGGNR

SEQ ID NO: 71770 - protein, 34 aa, Artificial Sequence
  Description of Artificial Sequence: Synthetic polypeptide
DEEEIRTTNPVATEQYGSVSSMEAIPNQRNGNPH

SEQ ID NO: 71771 - protein, 34 aa, Artificial Sequence
  Description of Artificial Sequence: Synthetic polypeptide
DEEEIRTTNPVATEQYGSVSDGNFDQEDIGNDGE

SEQ ID NO: 71772 - protein, 29 aa, Artificial Sequence
  Description of Artificial Sequence: Synthetic peptide
AENEICATNPVATEQYGNVASENLQDGGN

SEQ ID NO: 71773 - protein, 29 aa, Artificial Sequence
  Description of Artificial Sequence: Synthetic peptide
AENEICATNPVATEQYGNVASENLQGGGT

SEQ ID NO: 71774 - protein, 34 aa, Artificial Sequence
  Description of Artificial Sequence: Synthetic polypeptide
DEEEIRTTNPVATEQYGSVSDGLDEVGQSNGNGA

SEQ ID NO: 71775 - protein, 34 aa, Artificial Sequence
  Description of Artificial Sequence: Synthetic polypeptide
DEEEIRTTNPVATEQYGSVSDGITNMEFGNIGNP

SEQ ID NO: 71776 - protein, 34 aa, Artificial Sequence
  Description of Artificial Sequence: Synthetic polypeptide
DEEEIRTTNPVATEQYGSVSDGITNEMNDGNGGI

SEQ ID NO: 71777 - protein, 34 aa, Artificial Sequence
  Description of Artificial Sequence: Synthetic polypeptide
DEEEIRTTNPVATEQYGSVSDGITNEMNDEQGNE

SEQ ID NO: 71778 - protein, 34 aa, Artificial Sequence
  Description of Artificial Sequence: Synthetic polypeptide
DEEEIRTTNPVATEQYGSVSDGITNEINGNGNGQ

SEQ ID NO: 71779 - protein, 34 aa, Artificial Sequence
  Description of Artificial Sequence: Synthetic polypeptide
DEEEIRTTNPVATEQYGSVSDGITNEINGGNGGN

SEQ ID NO: 71780 - protein, 29 aa, Artificial Sequence
  Description of Artificial Sequence: Synthetic peptide
AENEICATNPVATEQYGNVASENLQSGED

SEQ ID NO: 71781 - protein, 31 aa, Artificial Sequence
  Description of Artificial Sequence: Synthetic polypeptide
FEEGITTTNPVATEQYGSVSLPVNSQRGEGS

SEQ ID NO: 71782 - protein, 33 aa, Artificial Sequence
  Description of Artificial Sequence: Synthetic polypeptide
DEEEIRTTNPVATEQYGSVSDETFTDGNVGNGQ

SEQ ID NO: 71783 - protein, 32 aa, Artificial Sequence
  Description of Artificial Sequence: Synthetic polypeptide
DEVEIATTNPVATECYGSVSTNLNQGADQDGR

SEQ ID NO: 71784 - protein, 30 aa, Artificial Sequence
  Description of Artificial Sequence: Synthetic polypeptide
AENEICATNPVATEQYGNVATSENLQQGER

SEQ ID NO: 71785 - protein, 33 aa, Artificial Sequence
  Description of Artificial Sequence: Synthetic polypeptide
DEEEIRTTNPVATEQYGSVSDDVTGLGNGGEGE

SEQ ID NO: 71786 - protein, 33 aa, Artificial Sequence
  Description of Artificial Sequence: Synthetic polypeptide
HEGEIRTTNPVATEQYGSVSTLNDLQGNANFEN

SEQ ID NO: 71787 - protein, 33 aa, Artificial Sequence
  Description of Artificial Sequence: Synthetic polypeptide
DEEEIRTTNPVATEQYGSVSCTNGPETFGVKQF

SEQ ID NO: 71788 - protein, 30 aa, Artificial Sequence
  Description of Artificial Sequence: Synthetic polypeptide
AENEICATNPVATEQYGVVASENLQDGGNS

SEQ ID NO: 71789 - protein, 30 aa, Artificial Sequence
  Description of Artificial Sequence: Synthetic polypeptide
DEECISTVNPVATEYYGSVCSWNLENGSNQ

SEQ ID NO: 71790 - protein, 32 aa, Artificial Sequence
  Description of Artificial Sequence: Synthetic polypeptide
AEEEIRTTNPVATEQYGVVVTTNSNQQGNGNQ

SEQ ID NO: 71791 - protein, 28 aa, Artificial Sequence
  Description of Artificial Sequence: Synthetic peptide
AENEIMCTNPVATEQYGEASENEQRGGI

SEQ ID NO: 71792 - protein, 28 aa, Artificial Sequence
  Description of Artificial Sequence: Synthetic peptide
LMEEIASVNPVCTEQYGVVSDNLQSGNQ

SEQ ID NO: 71793 - protein, 32 aa, Artificial Sequence
  Description of Artificial Sequence: Synthetic polypeptide
DEEEIRTTNPVATEQYGSVSCAILTPGVEPMI

SEQ ID NO: 71794 - protein, 29 aa, Artificial Sequence
  Description of Artificial Sequence: Synthetic peptide
AENEIMCTNPVATEQYGEASENLQRGAGA

SEQ ID NO: 71795 - protein, 30 aa, Artificial Sequence
  Description of Artificial Sequence: Synthetic polypeptide
AENEIRCTNPVATECYGEASENLQDRGEGR

SEQ ID NO: 71796 - protein, 33 aa, Artificial Sequence
  Description of Artificial Sequence: Synthetic polypeptide
AEEEIRTTNPVATEQYGVVVTTNLQQQEGGNQG

SEQ ID NO: 71797 - protein, 31 aa, Artificial Sequence
  Description of Artificial Sequence: Synthetic polypeptide
DEEEIRTTNPVATEQYGSVSAWLENMESEDQ

SEQ ID NO: 71798 - protein, 33 aa, Artificial Sequence
  Description of Artificial Sequence: Synthetic polypeptide
DEEEIRTTNPVATEQYGSVSAVPTVQPEGEDRM

SEQ ID NO: 71799 - protein, 32 aa, Artificial Sequence
  Description of Artificial Sequence: Synthetic polypeptide
MEEAIRTTNPVAYEQYGCVSTINVQRIGDNYQ

SEQ ID NO: 71800 - protein, 30 aa, Artificial Sequence
  Description of Artificial Sequence: Synthetic polypeptide
MEEEIACTNPVATEQYGCVAGTGLQDHGNQ

SEQ ID NO: 71801 - protein, 29 aa, Artificial Sequence
  Description of Artificial Sequence: Synthetic peptide
MEEEIACTNPVATEQYGCVATALQNNSER

SEQ ID NO: 71802 - protein, 28 aa, Artificial Sequence
  Description of Artificial Sequence: Synthetic peptide
MEEEIASVNPVCTEGYGVVSDNLQSGNQ

SEQ ID NO: 71803 - protein, 28 aa, Artificial Sequence
  Description of Artificial Sequence: Synthetic peptide
MEEEIASVNPVCTEQYGCVSDALQSGNQ

SEQ ID NO: 71804 - protein, 30 aa, Artificial Sequence
  Description of Artificial Sequence: Synthetic polypeptide
DEECISTVNPVATEWYGSVCSWNLERGSDQ

SEQ ID NO: 71805 - protein, 29 aa, Artificial Sequence
  Description of Artificial Sequence: Synthetic peptide
AENEIRCTNPVATEPYGEISENLQQRGGH

SEQ ID NO: 71806 - protein, 34 aa, Artificial Sequence
  Description of Artificial Sequence: Synthetic polypeptide
DEEEIRTTNPVATEQYGSVSCEEQLENRGGENIE

SEQ ID NO: 71807 - protein, 31 aa, Artificial Sequence
  Description of Artificial Sequence: Synthetic polypeptide
DEECISTVNPVATEGYGSVCSWNLERGSNNQ

SEQ ID NO: 71808 - protein, 30 aa, Artificial Sequence
  Description of Artificial Sequence: Synthetic polypeptide
LEEEIASVNPVSTEQYGSVVSVNTLQQGNQ

SEQ ID NO: 71809 - protein, 34 aa, Artificial Sequence
  Description of Artificial Sequence: Synthetic polypeptide
DEEEIRTTNPVATEQYGSVSSTEPAGNMRNGMNV

SEQ ID NO: 71810 - protein, 34 aa, Artificial Sequence
  Description of Artificial Sequence: Synthetic polypeptide
DEEEIRTTNPVATEQYGSVSSTEPAGNRNGMNPV

SEQ ID NO: 71811 - protein, 33 aa, Artificial Sequence
  Description of Artificial Sequence: Synthetic polypeptide
AEEEIRTTNPVATEQYGVVVVSTTNNQQQGNGL

SEQ ID NO: 71812 - protein, 34 aa, Artificial Sequence
  Description of Artificial Sequence: Synthetic polypeptide
AEEEIRTTNPVATEQYGVVVVSTTNLQNGNNAAE

SEQ ID NO: 71813 - protein, 34 aa, Artificial Sequence
  Description of Artificial Sequence: Synthetic polypeptide
AEEEIRTTNPVATEQYGVVVVSTTNLNQNGNNAQ

SEQ ID NO: 71814 - protein, 33 aa, Artificial Sequence
  Description of Artificial Sequence: Synthetic polypeptide
AEEEIRTTNPVATEQYGVVVVSTTLQQGNEAGV

SEQ ID NO: 71815 - protein, 32 aa, Artificial Sequence
  Description of Artificial Sequence: Synthetic polypeptide
AEEEIRTTNPVATEQYGVVVVSTTLQEGEDGV

SEQ ID NO: 71816 - protein, 34 aa, Artificial Sequence
  Description of Artificial Sequence: Synthetic polypeptide
AEEEIRTTNPVATEQYGVVVVSSTNLQNGNNQAE

SEQ ID NO: 71817 - protein, 31 aa, Artificial Sequence
  Description of Artificial Sequence: Synthetic polypeptide
DETSIRTTNPLAYEQWGSVSCCNLSQSGNNR

SEQ ID NO: 71818 - protein, 31 aa, Artificial Sequence
  Description of Artificial Sequence: Synthetic polypeptide
DETSIRTTNPLAYEQFGSVSCINLSQSVGNR

SEQ ID NO: 71819 - protein, 34 aa, Artificial Sequence
  Description of Artificial Sequence: Synthetic polypeptide
DEEEIRTTNPVATEQYGSVSSTEPAGPNRGMNPV

SEQ ID NO: 71820 - protein, 30 aa, Artificial Sequence
  Description of Artificial Sequence: Synthetic polypeptide
DEECISTVNPVATEGYGSVCSWNLAYGSNQ

SEQ ID NO: 71821 - protein, 32 aa, Artificial Sequence
  Description of Artificial Sequence: Synthetic polypeptide
DEEEIRTTNPVATEQYGSVSCHLNEVMLEENE

SEQ ID NO: 71822 - protein, 34 aa, Artificial Sequence
  Description of Artificial Sequence: Synthetic polypeptide
DEEEIRTTNPVATEQYGSVSSTEPAGPNRNGMNV

SEQ ID NO: 71823 - protein, 28 aa, Artificial Sequence
  Description of Artificial Sequence: Synthetic peptide
LENEIATTNPVATECYGDVSECLQHEER

SEQ ID NO: 71824 - protein, 29 aa, Artificial Sequence
  Description of Artificial Sequence: Synthetic peptide
LEEEIASVNPVCTEQYGVVSDVNLQSGNQ

SEQ ID NO: 71825 - protein, 29 aa, Artificial Sequence
  Description of Artificial Sequence: Synthetic peptide
MEEEIASVNPVCTEQYGCVSWNLQSGNQG

SEQ ID NO: 71826 - protein, 34 aa, Artificial Sequence
  Description of Artificial Sequence: Synthetic polypeptide
DEEEIRTTNPVATEQYGSVSATVNGEGETGGGNG

SEQ ID NO: 71827 - protein, 31 aa, Artificial Sequence
  Description of Artificial Sequence: Synthetic polypeptide
MEEEIATTNPVATEQYGCVSVTHGQEGDGNP

SEQ ID NO: 71828 - protein, 32 aa, Artificial Sequence
  Description of Artificial Sequence: Synthetic polypeptide
DEDEIRTTNPVATEQYGMTSDTNGGQGGGNDE

SEQ ID NO: 71829 - protein, 30 aa, Artificial Sequence
  Description of Artificial Sequence: Synthetic polypeptide
AENEIRCTNPVATEQYGETSEDLQRKGPYR

SEQ ID NO: 71830 - protein, 29 aa, Artificial Sequence
  Description of Artificial Sequence: Synthetic peptide
AENEIRCTNPVATEQYGEVSEILQNREGA

SEQ ID NO: 71831 - protein, 29 aa, Artificial Sequence
  Description of Artificial Sequence: Synthetic peptide
AENEIRCTNPVATEQYGEVSENEQNREGA

SEQ ID NO: 71832 - protein, 33 aa, Artificial Sequence
  Description of Artificial Sequence: Synthetic polypeptide
DEEEIRTTNPVATEQYGSVSATNSTVIDLNENF

SEQ ID NO: 71833 - protein, 32 aa, Artificial Sequence
  Description of Artificial Sequence: Synthetic polypeptide
MEEEIATTNPVATEQYGNVSVTGMDDQGNGNR

SEQ ID NO: 71834 - protein, 31 aa, Artificial Sequence
  Description of Artificial Sequence: Synthetic polypeptide
DEECLRTTNPCAYEQYGCVSWNLQRFGSNQS

SEQ ID NO: 71835 - protein, 31 aa, Artificial Sequence
  Description of Artificial Sequence: Synthetic polypeptide
DEECLRTTNPCAYEQYGCVTSTNLQNFGSNQ

SEQ ID NO: 71836 - protein, 32 aa, Artificial Sequence
  Description of Artificial Sequence: Synthetic polypeptide
MEEEIATTNPVATEQYGNVSVTMDQGNGQNQR

SEQ ID NO: 71837 - protein, 30 aa, Artificial Sequence
  Description of Artificial Sequence: Synthetic polypeptide
AENEIRCTNPVATEQYGSASENEQDREGGG

SEQ ID NO: 71838 - protein, 34 aa, Artificial Sequence
  Description of Artificial Sequence: Synthetic polypeptide
AEEEIRTTNPVATEQYGVVSVTTTNLQQNNGTNY

SEQ ID NO: 71839 - protein, 30 aa, Artificial Sequence
  Description of Artificial Sequence: Synthetic polypeptide
AENEIRCTNPVATEQYGSASENGNMRGGPR

SEQ ID NO: 71840 - protein, 32 aa, Artificial Sequence
  Description of Artificial Sequence: Synthetic polypeptide
AENEIRCTNPVATEQYGSASENLPQMRGMGPR

SEQ ID NO: 71841 - protein, 33 aa, Artificial Sequence
  Description of Artificial Sequence: Synthetic polypeptide
DEEEIRTTNPVATEQYGSVSSTGQGGQGQGEEG

SEQ ID NO: 71842 - protein, 31 aa, Artificial Sequence
  Description of Artificial Sequence: Synthetic polypeptide
DEDEIRTTNPVATEQYGMTSTGNGQGGDTED

SEQ ID NO: 71843 - protein, 35 aa, Artificial Sequence
  Description of Artificial Sequence: Synthetic polypeptide
DEEEIRTTNPVATEQYGSVSSTEPNGPNMRNGNPV

SEQ ID NO: 71844 - protein, 31 aa, Artificial Sequence
  Description of Artificial Sequence: Synthetic polypeptide
MEEEIATTNPVATEQYGCVSVTEDQGFGSNA

SEQ ID NO: 71845 - protein, 33 aa, Artificial Sequence
  Description of Artificial Sequence: Synthetic polypeptide
DEEEIRTTNPVATEQYGSVSSTGGGQGEGGEQG

SEQ ID NO: 71846 - protein, 29 aa, Artificial Sequence
  Description of Artificial Sequence: Synthetic peptide
MEEEIASVNPVCTEQYGVVPSDNLQSGNQ

SEQ ID NO: 71847 - protein, 29 aa, Artificial Sequence
  Description of Artificial Sequence: Synthetic peptide
MEEEIASVNPVCTEQYGVVSAMNLQSGNQ

SEQ ID NO: 71848 - protein, 28 aa, Artificial Sequence
  Description of Artificial Sequence: Synthetic peptide
MEEEIASVNPVCTEQYGVVSCNLQSGQQ

SEQ ID NO: 71849 - protein, 35 aa, Artificial Sequence
  Description of Artificial Sequence: Synthetic polypeptide
DEEEIRTTNPVATEQYGSVSATTPAGPQRNGMNPV

SEQ ID NO: 71850 - protein, 35 aa, Artificial Sequence
  Description of Artificial Sequence: Synthetic polypeptide
DEEEIRTTNPVATEQYGSVSATTPAGPQRNGMNPI

SEQ ID NO: 71851 - protein, 28 aa, Artificial Sequence
  Description of Artificial Sequence: Synthetic peptide
MEEEIASVNPVCTEQYGVVSDNIQSGNQ

SEQ ID NO: 71852 - protein, 29 aa, Artificial Sequence
  Description of Artificial Sequence: Synthetic peptide
MEEEIASVNPVCTEQYGVVSDNLQSHGNQ

SEQ ID NO: 71853 - protein, 30 aa, Artificial Sequence
  Description of Artificial Sequence: Synthetic polypeptide
AENEIRCTNPVATEQYGEASEDLQRKGPYR

SEQ ID NO: 71854 - protein, 29 aa, Artificial Sequence
  Description of Artificial Sequence: Synthetic peptide
MEEEIASVNPVCTEQYGVVSDNLWQSGNQ

SEQ ID NO: 71855 - protein, 28 aa, Artificial Sequence
  Description of Artificial Sequence: Synthetic peptide
MEEEIASVNPVCTEQYGVVSSNLQSGQQ

SEQ ID NO: 71856 - protein, 28 aa, Artificial Sequence
  Description of Artificial Sequence: Synthetic peptide
MEEEIASVNPVCTEQYGVVSWNTQSGNQ

SEQ ID NO: 71857 - protein, 30 aa, Artificial Sequence
  Description of Artificial Sequence: Synthetic polypeptide
DETSIRTTNPLATEQFGSVSCENPEGAGNR

SEQ ID NO: 71858 - protein, 32 aa, Artificial Sequence
  Description of Artificial Sequence: Synthetic polypeptide
MEEEIATTNPVATEQYGCVAATHLQMDGNPRN

SEQ ID NO: 71859 - protein, 31 aa, Artificial Sequence
  Description of Artificial Sequence: Synthetic polypeptide
MEEEIATTNPVATEQYGCVAATHLQMDGSNN

SEQ ID NO: 71860 - protein, 31 aa, Artificial Sequence
  Description of Artificial Sequence: Synthetic polypeptide
MEEEIATTNPVATEQYGCVAATHLQMMAENR

SEQ ID NO: 71861 - protein, 33 aa, Artificial Sequence
  Description of Artificial Sequence: Synthetic polypeptide
DEEEIRTTNPVATEQYGSVSSTGGQGGGQEEGT

SEQ ID NO: 71862 - protein, 33 aa, Artificial Sequence
  Description of Artificial Sequence: Synthetic polypeptide
DEDEIRTTNPVATEQYGSVSTQNLFGNNNDEDT

SEQ ID NO: 71863 - protein, 28 aa, Artificial Sequence
  Description of Artificial Sequence: Synthetic peptide
LEEEIASVNPVCTEQYGVVSDNLSSGNQ

SEQ ID NO: 71864 - protein, 33 aa, Artificial Sequence
  Description of Artificial Sequence: Synthetic polypeptide
AEEEIRTTNPVATEQYGVVVVSTTQLQQGENGV

SEQ ID NO: 71865 - protein, 31 aa, Artificial Sequence
  Description of Artificial Sequence: Synthetic polypeptide
IEEEIRTTNPVATEQYGSCMTDLEIRNEDRD

SEQ ID NO: 71866 - protein, 34 aa, Artificial Sequence
  Description of Artificial Sequence: Synthetic polypeptide
DEEEIRTTNPVATEQYGSVSCTNDIMDFGENQPD

SEQ ID NO: 71867 - protein, 35 aa, Artificial Sequence
  Description of Artificial Sequence: Synthetic polypeptide
DEEEIRTTNPVATEQYGSVSSSTPNGIQTGGGNNG

SEQ ID NO: 71868 - protein, 28 aa, Artificial Sequence
  Description of Artificial Sequence: Synthetic peptide
DEVAIATTNPVATIQYGMTSTAPQVGTR

SEQ ID NO: 71869 - protein, 33 aa, Artificial Sequence
  Description of Artificial Sequence: Synthetic polypeptide
IEEEIRTTNPVATEQYGSVSPTENTVERLAGSN

SEQ ID NO: 71870 - protein, 28 aa, Artificial Sequence
  Description of Artificial Sequence: Synthetic peptide
AENEICCTNPVATEQYGETSENLQIGGF

SEQ ID NO: 71871 - protein, 29 aa, Artificial Sequence
  Description of Artificial Sequence: Synthetic peptide
AENEICCTNPVATEQYGETSENLQRGDGQ

SEQ ID NO: 71872 - protein, 29 aa, Artificial Sequence
  Description of Artificial Sequence: Synthetic peptide
IENCIACTNPVATEQYGETSENLQRGEGR

SEQ ID NO: 71873 - protein, 30 aa, Artificial Sequence
  Description of Artificial Sequence: Synthetic polypeptide
IENEIACTNPVATEQYGEASPENLQRGDGR

SEQ ID NO: 71874 - protein, 29 aa, Artificial Sequence
  Description of Artificial Sequence: Synthetic peptide
IENEIACTNPVATEQYGETSENLQGGGRE

SEQ ID NO: 71875 - protein, 35 aa, Artificial Sequence
  Description of Artificial Sequence: Synthetic polypeptide
DEEEIRTTNPVATEQYGSVSSTCINEPNDRNGMNV

SEQ ID NO: 71876 - protein, 30 aa, Artificial Sequence
  Description of Artificial Sequence: Synthetic polypeptide
IENEICCTNPVATEQYGEASEENLQRIGGR

SEQ ID NO: 71877 - protein, 33 aa, Artificial Sequence
  Description of Artificial Sequence: Synthetic polypeptide
DEEEIRTTNPVATEQYGSVSCTINTPVGVEPQI

SEQ ID NO: 71878 - protein, 32 aa, Artificial Sequence
  Description of Artificial Sequence: Synthetic polypeptide
DETTIRTTNPVATEQYGSVADTNLIGGGNGQE

SEQ ID NO: 71879 - protein, 36 aa, Artificial Sequence
  Description of Artificial Sequence: Synthetic polypeptide
DEEEIRTTNPVATEQYGSVSSTCPNGPQMRNGENPV

SEQ ID NO: 71880 - protein, 31 aa, Artificial Sequence
  Description of Artificial Sequence: Synthetic polypeptide
DEVEIATTNPCATECYGSVSTNLQGADGDDT

SEQ ID NO: 71881 - protein, 34 aa, Artificial Sequence
  Description of Artificial Sequence: Synthetic polypeptide
DEEEIRTTNPVATEQYGSVSSTDDEGQEGGNDGT

SEQ ID NO: 71882 - protein, 32 aa, Artificial Sequence
  Description of Artificial Sequence: Synthetic polypeptide
DEVEIATTNPCATECYGSVSTNLQGDSGGGMR

SEQ ID NO: 71883 - protein, 32 aa, Artificial Sequence
  Description of Artificial Sequence: Synthetic polypeptide
DEVEIATTNPCATEIYGSVSTGNLQGADGDDR

SEQ ID NO: 71884 - protein, 30 aa, Artificial Sequence
  Description of Artificial Sequence: Synthetic polypeptide
AENEICATNPVATEQYGVVASENLQDGTGR

SEQ ID NO: 71885 - protein, 31 aa, Artificial Sequence
  Description of Artificial Sequence: Synthetic polypeptide
HEGEIRTTNPVATEQYGSVSTNDMQENQIFY

SEQ ID NO: 71886 - protein, 30 aa, Artificial Sequence
  Description of Artificial Sequence: Synthetic polypeptide
AENEICATNPVATEQYGVVASENLQNGAER

SEQ ID NO: 71887 - protein, 33 aa, Artificial Sequence
  Description of Artificial Sequence: Synthetic polypeptide
DEEEIRTTNPVATEQYGSVSCTNGGQTFPTQFH

SEQ ID NO: 71888 - protein, 34 aa, Artificial Sequence
  Description of Artificial Sequence: Synthetic polypeptide
DEEEIRTTNPVATEQYGSVSSPTVNEQDVGEVIT

SEQ ID NO: 71889 - protein, 30 aa, Artificial Sequence
  Description of Artificial Sequence: Synthetic polypeptide
AENEICATNPVATEQYGVVASENLQRGTEN

SEQ ID NO: 71890 - protein, 29 aa, Artificial Sequence
  Description of Artificial Sequence: Synthetic peptide
AENEICATNPVATEQYGVVASSNLQDGGP

SEQ ID NO: 71891 - protein, 33 aa, Artificial Sequence
  Description of Artificial Sequence: Synthetic polypeptide
DEDEIRTTNPVATEQYGSVAVTDNGNGADGNNR

SEQ ID NO: 71892 - protein, 30 aa, Artificial Sequence
  Description of Artificial Sequence: Synthetic polypeptide
AENEICATNPVATEQYGVVASTENLQDGGT

SEQ ID NO: 71893 - protein, 30 aa, Artificial Sequence
  Description of Artificial Sequence: Synthetic polypeptide
DEVEIATTNPVATCQYGCVCSTALQNISNQ

SEQ ID NO: 71894 - protein, 30 aa, Artificial Sequence
  Description of Artificial Sequence: Synthetic polypeptide
AENEICATNPVATEQYGVVASVENLQRGTT

SEQ ID NO: 71895 - protein, 30 aa, Artificial Sequence
  Description of Artificial Sequence: Synthetic polypeptide
DEVEIATTNPVATAQWGTVSEGALGQRGNS

SEQ ID NO: 71896 - protein, 32 aa, Artificial Sequence
  Description of Artificial Sequence: Synthetic polypeptide
HTNEIRTTNPLATERYGQSVSMTNMLQREGNE

SEQ ID NO: 71897 - protein, 28 aa, Artificial Sequence
  Description of Artificial Sequence: Synthetic peptide
IEEEIASVNPVCTEQYGVVSDNLQSGPQ

SEQ ID NO: 71898 - protein, 32 aa, Artificial Sequence
  Description of Artificial Sequence: Synthetic polypeptide
DEVEIATTNPCATEVYGSVSTNLQGGADGDDR

SEQ ID NO: 71899 - protein, 32 aa, Artificial Sequence
  Description of Artificial Sequence: Synthetic polypeptide
IEEEIATTNPVATEQYGSVATNLTNPGENAEE

SEQ ID NO: 71900 - protein, 34 aa, Artificial Sequence
  Description of Artificial Sequence: Synthetic polypeptide
DEEEIRTTNPVATEQYGSVSSTEPAGNMHNGNPV

SEQ ID NO: 71901 - protein, 34 aa, Artificial Sequence
  Description of Artificial Sequence: Synthetic polypeptide
DEEEIRTTNPVATEQYGSVSSTDGDQGQEGGNND

SEQ ID NO: 71902 - protein, 31 aa, Artificial Sequence
  Description of Artificial Sequence: Synthetic polypeptide
INEEIRTTNPVATEQYGDVSTTGGQDEGGNG

SEQ ID NO: 71903 - protein, 33 aa, Artificial Sequence
  Description of Artificial Sequence: Synthetic polypeptide
AEEEIRTTNPVATEQYGVVVVTSTNNNQQGNGS

SEQ ID NO: 71904 - protein, 35 aa, Artificial Sequence
  Description of Artificial Sequence: Synthetic polypeptide
DEEEIRTTNPVATEQYGSVSSTEAGPNMRNGMNPR

SEQ ID NO: 71905 - protein, 33 aa, Artificial Sequence
  Description of Artificial Sequence: Synthetic polypeptide
AEEEIRTTNPVATEQYGVVVVTNLQQGTEGTNG

SEQ ID NO: 71906 - protein, 32 aa, Artificial Sequence
  Description of Artificial Sequence: Synthetic polypeptide
DEEEIRTTNPVATEQYGSVSCPQMWASGLQRE

SEQ ID NO: 71907 - protein, 33 aa, Artificial Sequence
  Description of Artificial Sequence: Synthetic polypeptide
AEEEIRTTNPVATEQYGVVVVTNLQQEEQGNQG

SEQ ID NO: 71908 - protein, 33 aa, Artificial Sequence
  Description of Artificial Sequence: Synthetic polypeptide
KEENIRTTNPVATEAYGQVSTTANLQREGGNGD

SEQ ID NO: 71909 - protein, 35 aa, Artificial Sequence
  Description of Artificial Sequence: Synthetic polypeptide
DEEEIRTTNPVATEQYGSVSSTEAGPNQRNGMNPH

SEQ ID NO: 71910 - protein, 35 aa, Artificial Sequence
  Description of Artificial Sequence: Synthetic polypeptide
DEEEIRTTNPVATEQYGSVSSTEAGPNQRNGMNPV

SEQ ID NO: 71911 - protein, 31 aa, Artificial Sequence
  Description of Artificial Sequence: Synthetic polypeptide
DEEEIRTTNPVATEQYGSVSCPNVHGPYEAT

SEQ ID NO: 71912 - protein, 35 aa, Artificial Sequence
  Description of Artificial Sequence: Synthetic polypeptide
DEEEIRTTNPVATEQYGSVSSTEAGPQQRNGMNPV

SEQ ID NO: 71913 - protein, 33 aa, Artificial Sequence
  Description of Artificial Sequence: Synthetic polypeptide
DEEEIRTTNPVATEQYGSVSCPALPNMSNGNPV

SEQ ID NO: 71914 - protein, 34 aa, Artificial Sequence
  Description of Artificial Sequence: Synthetic polypeptide
DEEEIRTTNPVATEQYGSVSSTEALPNRNGMEPV

SEQ ID NO: 71915 - protein, 33 aa, Artificial Sequence
  Description of Artificial Sequence: Synthetic polypeptide
DEEEIRTTNPVATEQYGSVSCPAGPNMSNGNPV

SEQ ID NO: 71916 - protein, 31 aa, Artificial Sequence
  Description of Artificial Sequence: Synthetic polypeptide
DEEEIRTTNPVATEQYGSVSCNNEVILEEAE

SEQ ID NO: 71917 - protein, 29 aa, Artificial Sequence
  Description of Artificial Sequence: Synthetic peptide
LEECIETVNPVATEWYGSVSDNLEMGNQQ

SEQ ID NO: 71918 - protein, 33 aa, Artificial Sequence
  Description of Artificial Sequence: Synthetic polypeptide
AEEEIRTTNPVATEQYGVVVVTTNLQQEEGNQG

SEQ ID NO: 71919 - protein, 33 aa, Artificial Sequence
  Description of Artificial Sequence: Synthetic polypeptide
DETTIRTTNPVATEQYGQYSVSIGNGQRGDNED

SEQ ID NO: 71920 - protein, 31 aa, Artificial Sequence
  Description of Artificial Sequence: Synthetic polypeptide
DETTIRGTNPVATEQYGSVSIDNGQGGGNEG

SEQ ID NO: 71921 - protein, 32 aa, Artificial Sequence
  Description of Artificial Sequence: Synthetic polypeptide
DEEEIRTTNPVATEQYGSVSCSSELEQMTEDI

SEQ ID NO: 71922 - protein, 31 aa, Artificial Sequence
  Description of Artificial Sequence: Synthetic polypeptide
DETTIRTTNPVATEQYGDVVNETVVQAGNRE

SEQ ID NO: 71923 - protein, 30 aa, Artificial Sequence
  Description of Artificial Sequence: Synthetic polypeptide
DETTIRTTNPVATEQYGDVVETVVEAGENR

SEQ ID NO: 71924 - protein, 32 aa, Artificial Sequence
  Description of Artificial Sequence: Synthetic polypeptide
INEEIRTTNPVATEQYGSVVVITNGQDEGGNG

SEQ ID NO: 71925 - protein, 32 aa, Artificial Sequence
  Description of Artificial Sequence: Synthetic polypeptide
AEEEIRTTNPVATEQYGVVVVTTNSNQGGNTE

SEQ ID NO: 71926 - protein, 32 aa, Artificial Sequence
  Description of Artificial Sequence: Synthetic polypeptide
AEEEIRTTNPVATEQYGVVVVTTNSNQGGNQQ

SEQ ID NO: 71927 - protein, 31 aa, Artificial Sequence
  Description of Artificial Sequence: Synthetic polypeptide
INEEIRTTNPVATEQYGVVVTDNGQGGGNGG

SEQ ID NO: 71928 - protein, 32 aa, Artificial Sequence
  Description of Artificial Sequence: Synthetic polypeptide
DETTIRTTNPVATEQYGCVETNGPDQRGFNGD

SEQ ID NO: 71929 - protein, 30 aa, Artificial Sequence
  Description of Artificial Sequence: Synthetic polypeptide
KEECIRTTNPVAWEQYGQVCTINVQGGNNN

SEQ ID NO: 71930 - protein, 32 aa, Artificial Sequence
  Description of Artificial Sequence: Synthetic polypeptide
AEEEIRTTNPVATEQYGVVVVTTNSNQGGNQD

SEQ ID NO: 71931 - protein, 28 aa, Artificial Sequence
  Description of Artificial Sequence: Synthetic peptide
KEEEIASVNPVCTEQYGVVSDNLQGGHG

SEQ ID NO: 71932 - protein, 35 aa, Artificial Sequence
  Description of Artificial Sequence: Synthetic polypeptide
DEEEIRTTNPVATEQYGSVSSTDNMDQGGGTTNNT

SEQ ID NO: 71933 - protein, 32 aa, Artificial Sequence
  Description of Artificial Sequence: Synthetic polypeptide
DEDEIRTTNPVATEQYGSINWPPNEMQRGERQ

SEQ ID NO: 71934 - protein, 32 aa, Artificial Sequence
  Description of Artificial Sequence: Synthetic polypeptide
DEEEIRTTNPVATEQYGSVSCSVLEQMTQEDI

SEQ ID NO: 71935 - protein, 33 aa, Artificial Sequence
  Description of Artificial Sequence: Synthetic polypeptide
DEEEIRTTNPVATEQYGSVSSTDNVGFEEFNGG

SEQ ID NO: 71936 - protein, 34 aa, Artificial Sequence
  Description of Artificial Sequence: Synthetic polypeptide
DEDEIRTTNPVATEQYGSCVNIDTNLFQMINNPR

SEQ ID NO: 71937 - protein, 30 aa, Artificial Sequence
  Description of Artificial Sequence: Synthetic polypeptide
DEECISTVNPVATEEYGCVSWGNLERGSNQ

SEQ ID NO: 71938 - protein, 33 aa, Artificial Sequence
  Description of Artificial Sequence: Synthetic polypeptide
EESEIRTTNPVATEQYGSVVSCTNPQGPVGNNK

SEQ ID NO: 71939 - protein, 31 aa, Artificial Sequence
  Description of Artificial Sequence: Synthetic polypeptide
FEEEIRTTNPVATEQYGSVVMTNVAEPLPER

SEQ ID NO: 71940 - protein, 33 aa, Artificial Sequence
  Description of Artificial Sequence: Synthetic polypeptide
DEDEIRTTNPVATEQYGSVSTQNNLFGNNNNED

SEQ ID NO: 71941 - protein, 32 aa, Artificial Sequence
  Description of Artificial Sequence: Synthetic polypeptide
DEVEIATTNPVATEVYGVVSTNLNQGADGDMR

SEQ ID NO: 71942 - protein, 33 aa, Artificial Sequence
  Description of Artificial Sequence: Synthetic polypeptide
FEEEIRTTNPVATEQYGDVSSTNGMEQDEGGNG

SEQ ID NO: 71943 - protein, 32 aa, Artificial Sequence
  Description of Artificial Sequence: Synthetic polypeptide
FEEEIRTTNPVATEQYGDVSTTDEGQTGGGNG

SEQ ID NO: 71944 - protein, 31 aa, Artificial Sequence
  Description of Artificial Sequence: Synthetic polypeptide
DEVEIATTNPVATEVYGTVSTNLQGADDDSR

SEQ ID NO: 71945 - protein, 34 aa, Artificial Sequence
  Description of Artificial Sequence: Synthetic polypeptide
DEEEIRTTNPVATEQYGSVSENAGLQRMMLIEAP

SEQ ID NO: 71946 - protein, 32 aa, Artificial Sequence
  Description of Artificial Sequence: Synthetic polypeptide
DEVEIATTNPVATETWGEVSTNLQRGGDNGDM

SEQ ID NO: 71947 - protein, 34 aa, Artificial Sequence
  Description of Artificial Sequence: Synthetic polypeptide
DEEEIRTTNPVATEQYGSVSENEHLQLVEENSLI

SEQ ID NO: 71948 - protein, 34 aa, Artificial Sequence
  Description of Artificial Sequence: Synthetic polypeptide
DEEEIRTTNPVATEQYGSVSEMNQLQPEAGITPL

SEQ ID NO: 71949 - protein, 32 aa, Artificial Sequence
  Description of Artificial Sequence: Synthetic polypeptide
FEEEIRTTNPVATEQYGNVGTDTNDGQEGGNI

SEQ ID NO: 71950 - protein, 34 aa, Artificial Sequence
  Description of Artificial Sequence: Synthetic polypeptide
DEEEIRTTNPVATEQYGSVSEMNLQMLMVSLNGQ

SEQ ID NO: 71951 - protein, 35 aa, Artificial Sequence
  Description of Artificial Sequence: Synthetic polypeptide
DEEEIRTTNPVATEQYGSVSQTMDLEEQRDGVGLA

SEQ ID NO: 71952 - protein, 31 aa, Artificial Sequence
  Description of Artificial Sequence: Synthetic polypeptide
DEVEIATTNPVATEQYGSVVTNPGLGENHDP

SEQ ID NO: 71953 - protein, 32 aa, Artificial Sequence
  Description of Artificial Sequence: Synthetic polypeptide
DEECISTTNPVATEGYGSVCNTNALQNGSNQA

SEQ ID NO: 71954 - protein, 34 aa, Artificial Sequence
  Description of Artificial Sequence: Synthetic polypeptide
DEEEIRTTNPVATEQYGSVSELTMDQELNGVLRS

SEQ ID NO: 71955 - protein, 33 aa, Artificial Sequence
  Description of Artificial Sequence: Synthetic polypeptide
FEEEIRTTNPVATEQYGEVSTDLIQGEGGEINI

SEQ ID NO: 71956 - protein, 31 aa, Artificial Sequence
  Description of Artificial Sequence: Synthetic polypeptide
DEVEIATTNPVATEWWGSVSTNLQLGGDQGE

SEQ ID NO: 71957 - protein, 33 aa, Artificial Sequence
  Description of Artificial Sequence: Synthetic polypeptide
FEEEIRTTNPVATEQYGDVISTVNLNGGNGNQE

SEQ ID NO: 71958 - protein, 32 aa, Artificial Sequence
  Description of Artificial Sequence: Synthetic polypeptide
FEEEIRTTNPVATEQYGDVGTDNGDQEGGNGG

SEQ ID NO: 71959 - protein, 33 aa, Artificial Sequence
  Description of Artificial Sequence: Synthetic polypeptide
FEEEIRTTNPVATEGYGSVSTMNLNIVEGINGG

SEQ ID NO: 71960 - protein, 33 aa, Artificial Sequence
  Description of Artificial Sequence: Synthetic polypeptide
FEEEIRTTNPVATEGYGSVSTQNAGQSEGGGNN

SEQ ID NO: 71961 - protein, 31 aa, Artificial Sequence
  Description of Artificial Sequence: Synthetic polypeptide
DEVEIATTNPVATIGYGMVSTPALQGFGGNR

SEQ ID NO: 71962 - protein, 35 aa, Artificial Sequence
  Description of Artificial Sequence: Synthetic polypeptide
DEEEIRTTNPVATEQYGSVSQTDLLQVREMFEQNI

SEQ ID NO: 71963 - protein, 32 aa, Artificial Sequence
  Description of Artificial Sequence: Synthetic polypeptide
DEVEIATTNPVATEWYGTVSTNLQLGGDNGQT

SEQ ID NO: 71964 - protein, 31 aa, Artificial Sequence
  Description of Artificial Sequence: Synthetic polypeptide
DEVEIATTNPVATEWYGSVSTNMQLGGDDGE

SEQ ID NO: 71965 - protein, 32 aa, Artificial Sequence
  Description of Artificial Sequence: Synthetic polypeptide
DEVEIATTNPVATEWYGSVSTNLQLGGDPGEH

SEQ ID NO: 71966 - protein, 32 aa, Artificial Sequence
  Description of Artificial Sequence: Synthetic polypeptide
DEVEIATTNPVATEWYGSVSTNLQLGGDDGKQ

SEQ ID NO: 71967 - protein, 32 aa, Artificial Sequence
  Description of Artificial Sequence: Synthetic polypeptide
DEVEIATTNPVATEWYGSVSTNLQLGEDQGET

SEQ ID NO: 71968 - protein, 35 aa, Artificial Sequence
  Description of Artificial Sequence: Synthetic polypeptide
DEEEIRTTNPVATEQYGSVSQTGNLLQHQNVEPLE

SEQ ID NO: 71969 - protein, 32 aa, Artificial Sequence
  Description of Artificial Sequence: Synthetic polypeptide
DEVEIATTNPVATEWYGCVSTNLQLGGDNGNN

SEQ ID NO: 71970 - protein, 32 aa, Artificial Sequence
  Description of Artificial Sequence: Synthetic polypeptide
FEEEIRTTNPVATEQYGAVVSTDTGLGGGNTN

SEQ ID NO: 71971 - protein, 32 aa, Artificial Sequence
  Description of Artificial Sequence: Synthetic polypeptide
FEEEIRTTNPVATEQYGCVCSTELQGFGSEQM

SEQ ID NO: 71972 - protein, 33 aa, Artificial Sequence
  Description of Artificial Sequence: Synthetic polypeptide
FEEEIRTTNPVATEQYGCVCSTENLNQNGSETQ

SEQ ID NO: 71973 - protein, 35 aa, Artificial Sequence
  Description of Artificial Sequence: Synthetic polypeptide
DEEEIRTTNPVATEQYGSVSQTGNLSQQVNEEPLT

SEQ ID NO: 71974 - protein, 34 aa, Artificial Sequence
  Description of Artificial Sequence: Synthetic polypeptide
DEVEIATTNPVATEQYGSVSTTNNQNHDGDNGRH

SEQ ID NO: 71975 - protein, 34 aa, Artificial Sequence
  Description of Artificial Sequence: Synthetic polypeptide
DEVEIATTNPVATEQYGSVSTTNGNMQNDGDNVR

SEQ ID NO: 71976 - protein, 31 aa, Artificial Sequence
  Description of Artificial Sequence: Synthetic polypeptide
DEDEIRTTNPVATEQYGVMTSTQNGQGGDDE

SEQ ID NO: 71977 - protein, 34 aa, Artificial Sequence
  Description of Artificial Sequence: Synthetic polypeptide
FEEEIRTTNPVATEQYGSVASTLNQDQGEDGGNI

SEQ ID NO: 71978 - protein, 33 aa, Artificial Sequence
  Description of Artificial Sequence: Synthetic polypeptide
FEEEIRTTNPVATEQYGSVINTDNDGEGQGGNQ

SEQ ID NO: 71979 - protein, 33 aa, Artificial Sequence
  Description of Artificial Sequence: Synthetic polypeptide
FEEEIRTTNPVATEQYGSVISMDNLQNLNNEQE

SEQ ID NO: 71980 - protein, 34 aa, Artificial Sequence
  Description of Artificial Sequence: Synthetic polypeptide
FEEEIRTTNPVATEQYGSVISNMGNLINGQGGNT

SEQ ID NO: 71981 - protein, 31 aa, Artificial Sequence
  Description of Artificial Sequence: Synthetic polypeptide
AENEIATTNPVATEQYGEACSEDGLVQRGNR

SEQ ID NO: 71982 - protein, 33 aa, Artificial Sequence
  Description of Artificial Sequence: Synthetic polypeptide
DEEEIRTTNPVATEQYGSVSEENLQNTQPDPIE

SEQ ID NO: 71983 - protein, 33 aa, Artificial Sequence
  Description of Artificial Sequence: Synthetic polypeptide
FEEEIRTTNPVATEQYGSVISTDNGQSDGGEFG

SEQ ID NO: 71984 - protein, 34 aa, Artificial Sequence
  Description of Artificial Sequence: Synthetic polypeptide
FEEEIRTTNPVATEQYGSVISTGDLGQREQGGEG

SEQ ID NO: 71985 - protein, 32 aa, Artificial Sequence
  Description of Artificial Sequence: Synthetic polypeptide
DEEEIRTTNPVATEQYGSVSEELQEHDEDEDN

SEQ ID NO: 71986 - protein, 34 aa, Artificial Sequence
  Description of Artificial Sequence: Synthetic polypeptide
FEEEIRTTNPVATEQYGSVISTMNIGQEGGGNEE

SEQ ID NO: 71987 - protein, 34 aa, Artificial Sequence
  Description of Artificial Sequence: Synthetic polypeptide
FEEEIRTTNPVATEQYGSVISTNLDIGNEGQTGN

SEQ ID NO: 71988 - protein, 33 aa, Artificial Sequence
  Description of Artificial Sequence: Synthetic polypeptide
FEEEIRTTNPVATEQYGSVITDNDNEGQGGNEI

SEQ ID NO: 71989 - protein, 30 aa, Artificial Sequence
  Description of Artificial Sequence: Synthetic polypeptide
AENEIATTNPVATEQYGEASAENLQRGGDL

SEQ ID NO: 71990 - protein, 33 aa, Artificial Sequence
  Description of Artificial Sequence: Synthetic polypeptide
FEEEIRTTNPVATEQYGSVNDNSGLEQGGGGNG

SEQ ID NO: 71991 - protein, 33 aa, Artificial Sequence
  Description of Artificial Sequence: Synthetic polypeptide
DEEEIRTTNPVATEQYGSVSEDGLGQVFILNPV

SEQ ID NO: 71992 - protein, 28 aa, Artificial Sequence
  Description of Artificial Sequence: Synthetic peptide
AENEIATTNPVATEQYGEASECLQREGL

SEQ ID NO: 71993 - protein, 34 aa, Artificial Sequence
  Description of Artificial Sequence: Synthetic polypeptide
DEEEIRTTNPVATEQYGSVSEFNTHGQYRGGAQE

SEQ ID NO: 71994 - protein, 31 aa, Artificial Sequence
  Description of Artificial Sequence: Synthetic polypeptide
DEVEIATTNPVATIQYGMVSTAAMQRGGNQY

SEQ ID NO: 71995 - protein, 35 aa, Artificial Sequence
  Description of Artificial Sequence: Synthetic polypeptide
DEDEIRTTNPVATEQYGSVSVVTNLQAGNNNNEDD

SEQ ID NO: 71996 - protein, 34 aa, Artificial Sequence
  Description of Artificial Sequence: Synthetic polypeptide
FEEEIRTTNPVATEQYGSVILTNMLQQMGEEERT

SEQ ID NO: 71997 - protein, 34 aa, Artificial Sequence
  Description of Artificial Sequence: Synthetic polypeptide
FEEEIRTTNPVATEQYGSVASTNNDDQEEGGGNI

SEQ ID NO: 71998 - protein, 34 aa, Artificial Sequence
  Description of Artificial Sequence: Synthetic polypeptide
DEDEIRTTNPVATEQYGTVTVSVTNLQQGNDEED

SEQ ID NO: 71999 - protein, 29 aa, Artificial Sequence
  Description of Artificial Sequence: Synthetic peptide
AENEIATTNPVATEQYGDASEIEQRAGGR

SEQ ID NO: 72000 - protein, 30 aa, Artificial Sequence
  Description of Artificial Sequence: Synthetic polypeptide
AENEIATTNPVATEQYGDASENLQNRAGGA

SEQ ID NO: 72001 - protein, 32 aa, Artificial Sequence
  Description of Artificial Sequence: Synthetic polypeptide
DEEEIRTTNPVATEQYGSVSELGLMPGVEFDD

SEQ ID NO: 72002 - protein, 29 aa, Artificial Sequence
  Description of Artificial Sequence: Synthetic peptide
AENEIATTNPVATEQYGDASENLQRAEGA

SEQ ID NO: 72003 - protein, 32 aa, Artificial Sequence
  Description of Artificial Sequence: Synthetic polypeptide
FEEEIRTTNPVATEQYGSVGNDQNEQGNGNGQ

SEQ ID NO: 72004 - protein, 33 aa, Artificial Sequence
  Description of Artificial Sequence: Synthetic polypeptide
FEEEIRTTNPVATEQYGSVGNTNGQGEGNVGEF

SEQ ID NO: 72005 - protein, 35 aa, Artificial Sequence
  Description of Artificial Sequence: Synthetic polypeptide
DEEEIRTTNPVATEQYGSVSEIQNLQPRFAVEGRG

SEQ ID NO: 72006 - protein, 34 aa, Artificial Sequence
  Description of Artificial Sequence: Synthetic polypeptide
DEEEIRTTNPVATEQYGSVSQTNIGLRFGQLAFE

SEQ ID NO: 72007 - protein, 34 aa, Artificial Sequence
  Description of Artificial Sequence: Synthetic polypeptide
DEEEIRTTNPVATEQYGSVSEIPGLAMRIVNERI

SEQ ID NO: 72008 - protein, 32 aa, Artificial Sequence
  Description of Artificial Sequence: Synthetic polypeptide
FEEEIRTTNPVATEQYGSVGSGNVNVNGGNGQ

SEQ ID NO: 72009 - protein, 32 aa, Artificial Sequence
  Description of Artificial Sequence: Synthetic polypeptide
FEEEIRTTNPVATEQYGSVGTLGQEGGGNEGN

SEQ ID NO: 72010 - protein, 31 aa, Artificial Sequence
  Description of Artificial Sequence: Synthetic polypeptide
DEEEIRTTNPVATEQYGSVSEGNQPTPEEWF

SEQ ID NO: 72011 - protein, 35 aa, Artificial Sequence
  Description of Artificial Sequence: Synthetic polypeptide
DEEEIRTTNPVATEQYGSVSQTNLLQQRIVDELDL

SEQ ID NO: 72012 - protein, 29 aa, Artificial Sequence
  Description of Artificial Sequence: Synthetic peptide
AENEIATTNPVATEQYGDVSEIEQRAGGA

SEQ ID NO: 72013 - protein, 31 aa, Artificial Sequence
  Description of Artificial Sequence: Synthetic polypeptide
DEECISTTNPVATEGYGCVNTNAHQRFGSNQ

SEQ ID NO: 72014 - protein, 31 aa, Artificial Sequence
  Description of Artificial Sequence: Synthetic polypeptide
DEVEIATTNPVATIQYGMVSTAAPQRQGNQQ

SEQ ID NO: 72015 - protein, 33 aa, Artificial Sequence
  Description of Artificial Sequence: Synthetic polypeptide
FEEEIRTTNPVATEGYGSVSGTNGGQTGGGGNN

SEQ ID NO: 72016 - protein, 34 aa, Artificial Sequence
  Description of Artificial Sequence: Synthetic polypeptide
DEEEIRTTNPVATEQYGSVSEPMTGPEQDENERQ

SEQ ID NO: 72017 - protein, 31 aa, Artificial Sequence
  Description of Artificial Sequence: Synthetic polypeptide
DEVEIATTNPVAYEEWGAVSTNLQLGEDNGR

SEQ ID NO: 72018 - protein, 33 aa, Artificial Sequence
  Description of Artificial Sequence: Synthetic polypeptide
DEEEIRTTNPVATEQYGSVSEPHLQENNGDQLI

SEQ ID NO: 72019 - protein, 34 aa, Artificial Sequence
  Description of Artificial Sequence: Synthetic polypeptide
DEDEIRTTNPVATEQYGVVSTTGNLGDITGQNNR

SEQ ID NO: 72020 - protein, 34 aa, Artificial Sequence
  Description of Artificial Sequence: Synthetic polypeptide
DEEEIRTTNPVATEQYGSVSEPGNGLEARIVETR

SEQ ID NO: 72021 - protein, 33 aa, Artificial Sequence
  Description of Artificial Sequence: Synthetic polypeptide
DEEEIRTTNPVATEQYGSVSQPANMQRQLEEWS

SEQ ID NO: 72022 - protein, 31 aa, Artificial Sequence
  Description of Artificial Sequence: Synthetic polypeptide
DEECISTTNPVATEEYGCVCNTNGLQRGSDQ

SEQ ID NO: 72023 - protein, 31 aa, Artificial Sequence
  Description of Artificial Sequence: Synthetic polypeptide
ENEEISTTNPVATTQYGCVSTNPMRDGDNDR

SEQ ID NO: 72024 - protein, 31 aa, Artificial Sequence
  Description of Artificial Sequence: Synthetic polypeptide
ENEEISTTNPVATTQYGSVSTNPMMNGDNDR

SEQ ID NO: 72025 - protein, 35 aa, Artificial Sequence
  Description of Artificial Sequence: Synthetic polypeptide
DEEEIRTTNPVATEQYGSVSENTNLIVDVGENLGE

SEQ ID NO: 72026 - protein, 34 aa, Artificial Sequence
  Description of Artificial Sequence: Synthetic polypeptide
DEEEIRTTNPVATEQYGSVSENTNLILVTENQGE

SEQ ID NO: 72027 - protein, 31 aa, Artificial Sequence
  Description of Artificial Sequence: Synthetic polypeptide
ENEEISTTNPVATTQYGSVSTNPMNGGQNDR

SEQ ID NO: 72028 - protein, 32 aa, Artificial Sequence
  Description of Artificial Sequence: Synthetic polypeptide
DEEEIRTTNPVATEQYGSVSQPNEQQVMLEVV

SEQ ID NO: 72029 - protein, 33 aa, Artificial Sequence
  Description of Artificial Sequence: Synthetic polypeptide
DEEEIRTTNPVATEQYGSVSENSTQVLMVSLRQ

SEQ ID NO: 72030 - protein, 33 aa, Artificial Sequence
  Description of Artificial Sequence: Synthetic polypeptide
DEDEIRTTNPVATEQYGVVSTSVTNLQAGTESG

SEQ ID NO: 72031 - protein, 34 aa, Artificial Sequence
  Description of Artificial Sequence: Synthetic polypeptide
DEEEIRTTNPVATEQYGSVSEPNQNQNRQGMPDQ

SEQ ID NO: 72032 - protein, 33 aa, Artificial Sequence
  Description of Artificial Sequence: Synthetic polypeptide
DEEEIRTTNPVATEQYGSVSENSLQSLDVSLGQ

SEQ ID NO: 72033 - protein, 31 aa, Artificial Sequence
  Description of Artificial Sequence: Synthetic polypeptide
ENEEIRTTNPVATEQYGVVSPNTQEQQFPNR

SEQ ID NO: 72034 - protein, 32 aa, Artificial Sequence
  Description of Artificial Sequence: Synthetic polypeptide
DEEEIRTTNPVATEQYGSVSQNIQESTQFDTN

SEQ ID NO: 72035 - protein, 34 aa, Artificial Sequence
  Description of Artificial Sequence: Synthetic polypeptide
DEEEIRTTNPVATEQYGSVSPYNEATEGNSIDRN

SEQ ID NO: 72036 - protein, 32 aa, Artificial Sequence
  Description of Artificial Sequence: Synthetic polypeptide
EESEIRTTNPVAYEQYGSTVSCTNPQGPSGNK

SEQ ID NO: 72037 - protein, 30 aa, Artificial Sequence
  Description of Artificial Sequence: Synthetic polypeptide
DEVEIATTNPVAYEQWGSVATNPGNDGDNR

SEQ ID NO: 72038 - protein, 33 aa, Artificial Sequence
  Description of Artificial Sequence: Synthetic polypeptide
DEEEIRTTNPVATEQYGSVSESVNDGQPHGSEQ

SEQ ID NO: 72039 - protein, 33 aa, Artificial Sequence
  Description of Artificial Sequence: Synthetic polypeptide
DEEEIRTTNPVATEQYGSVSPYSNQPDDQNEND

SEQ ID NO: 72040 - protein, 35 aa, Artificial Sequence
  Description of Artificial Sequence: Synthetic polypeptide
DEEEIRTTNPVATEQYGSVSESQVNLEQRGEMLEM

SEQ ID NO: 72041 - protein, 31 aa, Artificial Sequence
  Description of Artificial Sequence: Synthetic polypeptide
DEVEIATTNPVAYEQWGSVATNLQEGGENEP

SEQ ID NO: 72042 - protein, 34 aa, Artificial Sequence
  Description of Artificial Sequence: Synthetic polypeptide
DEEEIRTTNPVATEQYGSVSESPEQDRIGSNMQE

SEQ ID NO: 72043 - protein, 33 aa, Artificial Sequence
  Description of Artificial Sequence: Synthetic polypeptide
DEEEIRTTNPVATEQYGSVSESNLEEAIIPNLE

SEQ ID NO: 72044 - protein, 30 aa, Artificial Sequence
  Description of Artificial Sequence: Synthetic polypeptide
DEVEIATTNPVAYEPYGSVSAANDDRGNES

SEQ ID NO: 72045 - protein, 32 aa, Artificial Sequence
  Description of Artificial Sequence: Synthetic polypeptide
DEEEIRTTNPVATEQYGSVSESEGGQPDGEQS

SEQ ID NO: 72046 - protein, 32 aa, Artificial Sequence
  Description of Artificial Sequence: Synthetic polypeptide
DEVEIATTNPVAYEHWGSVSTNLQGQDSGNNR

SEQ ID NO: 72047 - protein, 32 aa, Artificial Sequence
  Description of Artificial Sequence: Synthetic polypeptide
DEVEIATTNPVAYEHWGSVSTNLQGNDDGNHR

SEQ ID NO: 72048 - protein, 31 aa, Artificial Sequence
  Description of Artificial Sequence: Synthetic polypeptide
DEVEIATTNPVAYEHWGSVATNLQGEDSGNR

SEQ ID NO: 72049 - protein, 33 aa, Artificial Sequence
  Description of Artificial Sequence: Synthetic polypeptide
DEEEIRTTNPVATEQYGSVSQNIENRSGDEDTN

SEQ ID NO: 72050 - protein, 32 aa, Artificial Sequence
  Description of Artificial Sequence: Synthetic polypeptide
ENEEIATTNPVAYEQYGVVVSTNLQGDHGPNR

SEQ ID NO: 72051 - protein, 34 aa, Artificial Sequence
  Description of Artificial Sequence: Synthetic polypeptide
DEEEIRTTNPVATEQYGSVSECNVMVETSQMENR

SEQ ID NO: 72052 - protein, 34 aa, Artificial Sequence
  Description of Artificial Sequence: Synthetic polypeptide
DEEEIRTTNPVATEQYGSVSENSLQMLMVSLNQT

SEQ ID NO: 72053 - protein, 32 aa, Artificial Sequence
  Description of Artificial Sequence: Synthetic polypeptide
DEEEIRTTNPVATEQYGSVSQPPDGILQLMEN

SEQ ID NO: 72054 - protein, 32 aa, Artificial Sequence
  Description of Artificial Sequence: Synthetic polypeptide
FEEEIRCTNPAATEQYGSVSIENMLMRGNGQN

SEQ ID NO: 72055 - protein, 32 aa, Artificial Sequence
  Description of Artificial Sequence: Synthetic polypeptide
FEEEIRTTNPEATERYGSVISTNLEEHDSNRQ

SEQ ID NO: 72056 - protein, 30 aa, Artificial Sequence
  Description of Artificial Sequence: Synthetic polypeptide
DEVEIATTNPVATLQYGMVSTAAPQLGNQQ

SEQ ID NO: 72057 - protein, 31 aa, Artificial Sequence
  Description of Artificial Sequence: Synthetic polypeptide
FEEEIRTTNPVATDQYGSVTNGQEGNGQGEG

SEQ ID NO: 72058 - protein, 28 aa, Artificial Sequence
  Description of Artificial Sequence: Synthetic peptide
AENEIATTNPVATECYGEVSECLQHEER

SEQ ID NO: 72059 - protein, 34 aa, Artificial Sequence
  Description of Artificial Sequence: Synthetic polypeptide
FEEEIRTTNPVATEAYGSVSTGTNLQGTGGNEDI

SEQ ID NO: 72060 - protein, 33 aa, Artificial Sequence
  Description of Artificial Sequence: Synthetic polypeptide
DEEEIRTTNPVATEQYGSVSENLQQEFMVSLGQ

SEQ ID NO: 72061 - protein, 32 aa, Artificial Sequence
  Description of Artificial Sequence: Synthetic polypeptide
FEEEIRTTNPVATEFYGSVSGNGQQGGGNNDG

SEQ ID NO: 72062 - protein, 33 aa, Artificial Sequence
  Description of Artificial Sequence: Synthetic polypeptide
DEEEIRTTNPVATEQYGSVSQPVNLQQVMLELA

SEQ ID NO: 72063 - protein, 28 aa, Artificial Sequence
  Description of Artificial Sequence: Synthetic peptide
AENEIATTNPVATECYGEVSENLQHEEL

SEQ ID NO: 72064 - protein, 33 aa, Artificial Sequence
  Description of Artificial Sequence: Synthetic polypeptide
FEEEIRTTNPVATEFYGSVSTMNNGQQVGGNDE

SEQ ID NO: 72065 - protein, 33 aa, Artificial Sequence
  Description of Artificial Sequence: Synthetic polypeptide
DEEEIRTTNPVATEQYGSVSENLQMLMVSLEAS

SEQ ID NO: 72066 - protein, 33 aa, Artificial Sequence
  Description of Artificial Sequence: Synthetic polypeptide
FEEEIRTTNPVATEGYGDVSTQNLQEMGVQDRW

SEQ ID NO: 72067 - protein, 33 aa, Artificial Sequence
  Description of Artificial Sequence: Synthetic polypeptide
DEEEIRTTNPVATEQYGSVSQSNMLFRNEEEVE

SEQ ID NO: 72068 - protein, 32 aa, Artificial Sequence
  Description of Artificial Sequence: Synthetic polypeptide
FEEEIRTTNPVATEGYGSVSGNGEQGEGGGNG

SEQ ID NO: 72069 - protein, 30 aa, Artificial Sequence
  Description of Artificial Sequence: Synthetic polypeptide
DEVEIATTNPVATLQYGMVSTAPQAPGNQQ

SEQ ID NO: 72070 - protein, 32 aa, Artificial Sequence
  Description of Artificial Sequence: Synthetic polypeptide
FEDEIRTTNPVATEQYGSVDTNLQIGGGQGGI

SEQ ID NO: 72071 - protein, 28 aa, Artificial Sequence
  Description of Artificial Sequence: Synthetic peptide
AENEIATTNPVATECYGEASENLQREGL

SEQ ID NO: 72072 - protein, 32 aa, Artificial Sequence
  Description of Artificial Sequence: Synthetic polypeptide
DEECISTTNPVATEGYGCVCNTNGLQRFGSNA

SEQ ID NO: 72073 - protein, 31 aa, Artificial Sequence
  Description of Artificial Sequence: Synthetic polypeptide
FEDEIRTTNPVATEQYGSVSNDNENGNGNGT

SEQ ID NO: 72074 - protein, 34 aa, Artificial Sequence
  Description of Artificial Sequence: Synthetic polypeptide
DEEEIRTTNPVATEQYGSVSQPQNLQQVIMLERD

SEQ ID NO: 72075 - protein, 34 aa, Artificial Sequence
  Description of Artificial Sequence: Synthetic polypeptide
FEDEIRTTNPVATEQYGSVSTNGLEEQNIGGGNG

SEQ ID NO: 72076 - protein, 33 aa, Artificial Sequence
  Description of Artificial Sequence: Synthetic polypeptide
FEDEIRTTNPVATEQYGSVSTNPAEQGNIGNSG

SEQ ID NO: 72077 - protein, 28 aa, Artificial Sequence
  Description of Artificial Sequence: Synthetic peptide
FEEEIASVNPVCDEQYGVVSDNLQSGNQ

SEQ ID NO: 72078 - protein, 29 aa, Artificial Sequence
  Description of Artificial Sequence: Synthetic peptide
FEEEIASVNPVCTEQYGVVSDNLQSGNDQ

SEQ ID NO: 72079 - protein, 28 aa, Artificial Sequence
  Description of Artificial Sequence: Synthetic peptide
AENEIATTNPVATECYGDASENLQHEER

SEQ ID NO: 72080 - protein, 29 aa, Artificial Sequence
  Description of Artificial Sequence: Synthetic peptide
FEEEIASVNPVCTEQYGVVSWNLQESGNQ

SEQ ID NO: 72081 - protein, 28 aa, Artificial Sequence
  Description of Artificial Sequence: Synthetic peptide
AENEIATTNPVATECYGDASENLQHEGR

SEQ ID NO: 72082 - protein, 28 aa, Artificial Sequence
  Description of Artificial Sequence: Synthetic peptide
FEEEIGSVNPVSTEQYGVVSVNLHQGNQ

SEQ ID NO: 72083 - protein, 29 aa, Artificial Sequence
  Description of Artificial Sequence: Synthetic peptide
FEEEIGSVNPVSTEQYGVVSVNLQQGPNY

SEQ ID NO: 72084 - protein, 28 aa, Artificial Sequence
  Description of Artificial Sequence: Synthetic peptide
AENEIATTNPVATECYGDVSECLQHGEL

SEQ ID NO: 72085 - protein, 29 aa, Artificial Sequence
  Description of Artificial Sequence: Synthetic peptide
FEEEIGSVNPVSTEQYGVVSVNTLQQGNG

SEQ ID NO: 72086 - protein, 30 aa, Artificial Sequence
  Description of Artificial Sequence: Synthetic polypeptide
AENEIATTNPVATECYGEASEINLQREGGR

SEQ ID NO: 72087 - protein, 30 aa, Artificial Sequence
  Description of Artificial Sequence: Synthetic polypeptide
AENEIATTNPVATECYGEASENLPQDRGGR

SEQ ID NO: 72088 - protein, 28 aa, Artificial Sequence
  Description of Artificial Sequence: Synthetic peptide
AENEIATTNPVATECYGEASENLQHGEL

SEQ ID NO: 72089 - protein, 34 aa, Artificial Sequence
  Description of Artificial Sequence: Synthetic polypeptide
DEEEIRTTNPVATEQYGSVSECNLQLLMVSLERQ

SEQ ID NO: 72090 - protein, 30 aa, Artificial Sequence
  Description of Artificial Sequence: Synthetic polypeptide
AENEIATTNPVATEQYGEASEDGLVQRGGR

SEQ ID NO: 72091 - protein, 34 aa, Artificial Sequence
  Description of Artificial Sequence: Synthetic polypeptide
DEEEIRTTNPVATEQYGSVSEAVLVQERGEDTDM

SEQ ID NO: 72092 - protein, 35 aa, Artificial Sequence
  Description of Artificial Sequence: Synthetic polypeptide
FEEEIRTTNPVATEQYGSVSTDTNGLQGQGGNGGE

SEQ ID NO: 72093 - protein, 34 aa, Artificial Sequence
  Description of Artificial Sequence: Synthetic polypeptide
FEEEIRTTNPVATEQYGSVSTGDNGQRFQENDGI

SEQ ID NO: 72094 - protein, 33 aa, Artificial Sequence
  Description of Artificial Sequence: Synthetic polypeptide
FEEEIRTTNPVATEQYGSVSTGGDQGGNGNEIQ

SEQ ID NO: 72095 - protein, 33 aa, Artificial Sequence
  Description of Artificial Sequence: Synthetic polypeptide
FEEEIRTTNPVATEQYGSVSTGGDQGGNGVNED

SEQ ID NO: 72096 - protein, 34 aa, Artificial Sequence
  Description of Artificial Sequence: Synthetic polypeptide
DEEEIRTTNPVATEQYGSVSSDNFQQGEGGEENP

SEQ ID NO: 72097 - protein, 34 aa, Artificial Sequence
  Description of Artificial Sequence: Synthetic polypeptide
DEEEIRTTNPVATEQYGSVSDTEGDLQQSGSQEE

SEQ ID NO: 72098 - protein, 31 aa, Artificial Sequence
  Description of Artificial Sequence: Synthetic polypeptide
DEVEIATTNPVATEIYGTVSTNLQGQDNGSV

SEQ ID NO: 72099 - protein, 33 aa, Artificial Sequence
  Description of Artificial Sequence: Synthetic polypeptide
FEEEIRTTNPVATEQYGSVSTGGQGQGMGENGF

SEQ ID NO: 72100 - protein, 34 aa, Artificial Sequence
  Description of Artificial Sequence: Synthetic polypeptide
DEDEIRTTNPVATEQYGSVSTTNLTQQNQEGTQE

SEQ ID NO: 72101 - protein, 33 aa, Artificial Sequence
  Description of Artificial Sequence: Synthetic polypeptide
FEEEIRTTNPVATEQYGSVSTGLELIGGGNQTG

SEQ ID NO: 72102 - protein, 34 aa, Artificial Sequence
  Description of Artificial Sequence: Synthetic polypeptide
FEEEIRTTNPVATEQYGSVSTGLIGQQEGGNNQD

SEQ ID NO: 72103 - protein, 32 aa, Artificial Sequence
  Description of Artificial Sequence: Synthetic polypeptide
DEVEIATTNPVATEIYGTVSTNLNQGADGDSR

SEQ ID NO: 72104 - protein, 33 aa, Artificial Sequence
  Description of Artificial Sequence: Synthetic polypeptide
FEEEIRTTNPVATEQYGSVSTGMGQSTGGEGNE

SEQ ID NO: 72105 - protein, 33 aa, Artificial Sequence
  Description of Artificial Sequence: Synthetic polypeptide
FEEEIRTTNPVATEQYGSVSTGNGDDEGGEGNG

SEQ ID NO: 72106 - protein, 32 aa, Artificial Sequence
  Description of Artificial Sequence: Synthetic polypeptide
DEVEIATTNPVATEIYGSVSTNLQGQDQNGSM

SEQ ID NO: 72107 - protein, 33 aa, Artificial Sequence
  Description of Artificial Sequence: Synthetic polypeptide
FEEEIRTTNPVATEQYGSVSTDQGLNGQEGGGE

SEQ ID NO: 72108 - protein, 33 aa, Artificial Sequence
  Description of Artificial Sequence: Synthetic polypeptide
FEEEIRTTNPVATEQYGSVSTGNVNVNGVNGQE

SEQ ID NO: 72109 - protein, 34 aa, Artificial Sequence
  Description of Artificial Sequence: Synthetic polypeptide
FEEEIRTTNPVATEQYGSVSTDNGQQDNGENEFT

SEQ ID NO: 72110 - protein, 31 aa, Artificial Sequence
  Description of Artificial Sequence: Synthetic polypeptide
DEVEIATTNPVATEQWGEVSTNLNGDHNGRE

SEQ ID NO: 72111 - protein, 33 aa, Artificial Sequence
  Description of Artificial Sequence: Synthetic polypeptide
DEEEIRTTNPVATEQYGSVSDTNGTGGGGETGT

SEQ ID NO: 72112 - protein, 32 aa, Artificial Sequence
  Description of Artificial Sequence: Synthetic polypeptide
FEEEIRTTNPVATEQYGSVSPTNMQQTQMTEE

SEQ ID NO: 72113 - protein, 35 aa, Artificial Sequence
  Description of Artificial Sequence: Synthetic polypeptide
DEEEIRTTNPVATEQYGSVSSCINEPQDREGMNPV

SEQ ID NO: 72114 - protein, 30 aa, Artificial Sequence
  Description of Artificial Sequence: Synthetic polypeptide
AENEIATTNPVATEQYGTASTGLVEREGND

SEQ ID NO: 72115 - protein, 33 aa, Artificial Sequence
  Description of Artificial Sequence: Synthetic polypeptide
DEEEIRTTNPVATEQYGSVSSDDLDQNTGEGGN

SEQ ID NO: 72116 - protein, 34 aa, Artificial Sequence
  Description of Artificial Sequence: Synthetic polypeptide
FEEEIRTTNPVATEQYGSVSSNTNGDQGQGGNNL

SEQ ID NO: 72117 - protein, 33 aa, Artificial Sequence
  Description of Artificial Sequence: Synthetic polypeptide
FEEEIRTTNPVATEQYGSVSSTDGQGQEEGGNT

SEQ ID NO: 72118 - protein, 33 aa, Artificial Sequence
  Description of Artificial Sequence: Synthetic polypeptide
DEEEIRTTNPVATEQYGSVSSDDNNVIAGNEGT

SEQ ID NO: 72119 - protein, 35 aa, Artificial Sequence
  Description of Artificial Sequence: Synthetic polypeptide
FEEEIRTTNPVATEQYGSVSSTDNGLQGQGGNGEE

SEQ ID NO: 72120 - protein, 34 aa, Artificial Sequence
  Description of Artificial Sequence: Synthetic polypeptide
FEEEIRTTNPVATEQYGSVSSTLGLQDEGGNNGD

SEQ ID NO: 72121 - protein, 34 aa, Artificial Sequence
  Description of Artificial Sequence: Synthetic polypeptide
DEEEIRTTNPVATEQYGSVSDTGMTGLGEGGGNE

SEQ ID NO: 72122 - protein, 34 aa, Artificial Sequence
  Description of Artificial Sequence: Synthetic polypeptide
FEEEIRTTNPVATEQYGSVSTDGDLEQRNQGEGD

SEQ ID NO: 72123 - protein, 30 aa, Artificial Sequence
  Description of Artificial Sequence: Synthetic polypeptide
DEVEIATTNPVATEQWGEVSTNLNGDINGE

SEQ ID NO: 72124 - protein, 34 aa, Artificial Sequence
  Description of Artificial Sequence: Synthetic polypeptide
FEEEIRTTNPVATEQYGSVSTDNGLELEEGTNSV

SEQ ID NO: 72125 - protein, 34 aa, Artificial Sequence
  Description of Artificial Sequence: Synthetic polypeptide
FEEEIRTTNPVATEQYGSVSTDNGLELEGGNFGD

SEQ ID NO: 72126 - protein, 34 aa, Artificial Sequence
  Description of Artificial Sequence: Synthetic polypeptide
DEEEIRTTNPVATEQYGSVSDTENGVQMQQGVEN

SEQ ID NO: 72127 - protein, 33 aa, Artificial Sequence
  Description of Artificial Sequence: Synthetic polypeptide
DEVEIATTNPVATEQYGCVCSTNDLGDHGNNER

SEQ ID NO: 72128 - protein, 31 aa, Artificial Sequence
  Description of Artificial Sequence: Synthetic polypeptide
DEVEIATTNPVATEIYGSVSTNLQGQDDDSD

SEQ ID NO: 72129 - protein, 35 aa, Artificial Sequence
  Description of Artificial Sequence: Synthetic polypeptide
FEEEIRTTNPVATEQYGSVSTMGNLDQEGGGNDNI

SEQ ID NO: 72130 - protein, 33 aa, Artificial Sequence
  Description of Artificial Sequence: Synthetic polypeptide
FEEEIRTTNPVATEQYGSVSTVMLEISEGEGNI

SEQ ID NO: 72131 - protein, 33 aa, Artificial Sequence
  Description of Artificial Sequence: Synthetic polypeptide
FEEEIRTTNPVATEQYGSVSTVNGFGQENIGGE

SEQ ID NO: 72132 - protein, 34 aa, Artificial Sequence
  Description of Artificial Sequence: Synthetic polypeptide
FEEEIRTTNPVATEQYGSVSTVNGFGQENIGNIN

SEQ ID NO: 72133 - protein, 32 aa, Artificial Sequence
  Description of Artificial Sequence: Synthetic polypeptide
DEVEIATTNPVATEIYGSVSTNLNQGQDNGSS

SEQ ID NO: 72134 - protein, 32 aa, Artificial Sequence
  Description of Artificial Sequence: Synthetic polypeptide
DEVEIATTNPVATEIYGSVSTGNLQGADQDGR

SEQ ID NO: 72135 - protein, 32 aa, Artificial Sequence
  Description of Artificial Sequence: Synthetic polypeptide
DEEEIRTTNPVATEQYGSVSSFLTDVGEEIVE

SEQ ID NO: 72136 - protein, 33 aa, Artificial Sequence
  Description of Artificial Sequence: Synthetic polypeptide
DEEEIRTTNPVATEQYGSVSSFLTLDVGVEIRD

SEQ ID NO: 72137 - protein, 35 aa, Artificial Sequence
  Description of Artificial Sequence: Synthetic polypeptide
DEDEIRTTNPVATEQYGSVSTQNNLQFGNNNNNDQ

SEQ ID NO: 72138 - protein, 32 aa, Artificial Sequence
  Description of Artificial Sequence: Synthetic polypeptide
FEEEIRTTNPVATEQYGSVTGVNGQEEGGGNG

SEQ ID NO: 72139 - protein, 33 aa, Artificial Sequence
  Description of Artificial Sequence: Synthetic polypeptide
FEEEIRTTNPVATEQYGSVTMTNGGGQEDGNTG

SEQ ID NO: 72140 - protein, 28 aa, Artificial Sequence
  Description of Artificial Sequence: Synthetic peptide
AENEIATTNPVSTEQYGEASENLQQGGH

SEQ ID NO: 72141 - protein, 34 aa, Artificial Sequence
  Description of Artificial Sequence: Synthetic polypeptide
FEEEIRTTNPVATEQYGSVTSTVNTLGMGGNNGD

SEQ ID NO: 72142 - protein, 33 aa, Artificial Sequence
  Description of Artificial Sequence: Synthetic polypeptide
FEEEIRTTNPVATEQYGSVTVTDNGQGEGGNQG

SEQ ID NO: 72143 - protein, 31 aa, Artificial Sequence
  Description of Artificial Sequence: Synthetic polypeptide
DEVEIATTNPVATEIWGSVSTNLQGQDDNGS

SEQ ID NO: 72144 - protein, 32 aa, Artificial Sequence
  Description of Artificial Sequence: Synthetic polypeptide
DEVEIATTNPVATEIWGSVSTNLQGNGPNGNM

SEQ ID NO: 72145 - protein, 28 aa, Artificial Sequence
  Description of Artificial Sequence: Synthetic peptide
AENEIATTNPVSTEPYGEASENLQRGGH

SEQ ID NO: 72146 - protein, 32 aa, Artificial Sequence
  Description of Artificial Sequence: Synthetic polypeptide
DEVEIATTNPVATEIYGSVSTNLQGQDDDGTD

SEQ ID NO: 72147 - protein, 33 aa, Artificial Sequence
  Description of Artificial Sequence: Synthetic polypeptide
DEEEIRTTNPVATEQYGSVSSEPAGNMRAGMNV

SEQ ID NO: 72148 - protein, 34 aa, Artificial Sequence
  Description of Artificial Sequence: Synthetic polypeptide
FEEEIRTTNPVATEQYGSVSTTMNGQGQTGNGNE

SEQ ID NO: 72149 - protein, 33 aa, Artificial Sequence
  Description of Artificial Sequence: Synthetic polypeptide
DEEEIRTTNPVATEQYGSVSSEAGPNRNGMNPV

SEQ ID NO: 72150 - protein, 34 aa, Artificial Sequence
  Description of Artificial Sequence: Synthetic polypeptide
FEEEIRTTNPVATEQYGSVSTMNLDQETGGMGEQ

SEQ ID NO: 72151 - protein, 34 aa, Artificial Sequence
  Description of Artificial Sequence: Synthetic polypeptide
FEEEIRTTNPVATEQYGSVSTMNQGGQNGGGNVT

SEQ ID NO: 72152 - protein, 34 aa, Artificial Sequence
  Description of Artificial Sequence: Synthetic polypeptide
FEEEIRTTNPVATEQYGSVSTMNQGGQNGGNNGQ

SEQ ID NO: 72153 - protein, 34 aa, Artificial Sequence
  Description of Artificial Sequence: Synthetic polypeptide
FEEEIRTTNPVATEQYGSVSTMNQGGQNGGQNEG

SEQ ID NO: 72154 - protein, 33 aa, Artificial Sequence
  Description of Artificial Sequence: Synthetic polypeptide
FEEEIRTTNPVATEQYGSVSTMNTGQDQGEFGI

SEQ ID NO: 72155 - protein, 31 aa, Artificial Sequence
  Description of Artificial Sequence: Synthetic polypeptide
AEEEISTTNPVATEEYGCSCSWNHQRGSNQS

SEQ ID NO: 72156 - protein, 33 aa, Artificial Sequence
  Description of Artificial Sequence: Synthetic polypeptide
FEEEIRTTNPVATEQYGSVSTQNEGQQGGEGEV

SEQ ID NO: 72157 - protein, 32 aa, Artificial Sequence
  Description of Artificial Sequence: Synthetic polypeptide
DEEEIRTTNPVATEQYGSVSSENDISVVSENE

SEQ ID NO: 72158 - protein, 33 aa, Artificial Sequence
  Description of Artificial Sequence: Synthetic polypeptide
FEEEIRTTNPVATEQYGSVSTTGNEQGNGEGQG

SEQ ID NO: 72159 - protein, 33 aa, Artificial Sequence
  Description of Artificial Sequence: Synthetic polypeptide
FEEEIRTTNPVATEQYGSVSTTLLVGGGDINDT

SEQ ID NO: 72160 - protein, 35 aa, Artificial Sequence
  Description of Artificial Sequence: Synthetic polypeptide
FEEEIRTTNPVATEQYGSVSTTLNGLGQEGENVGT

SEQ ID NO: 72161 - protein, 35 aa, Artificial Sequence
  Description of Artificial Sequence: Synthetic polypeptide
FEEEIRTTNPVATEQYGSVSTTLNGLQTGGNNDDE

SEQ ID NO: 72162 - protein, 34 aa, Artificial Sequence
  Description of Artificial Sequence: Synthetic polypeptide
FEEEIRTTNPVATEQYGSVSTTLNGQGQGGNEEE

SEQ ID NO: 72163 - protein, 33 aa, Artificial Sequence
  Description of Artificial Sequence: Synthetic polypeptide
DEEEIRTTNPVATEQYGSVSDQDLIQRIQDEFD

SEQ ID NO: 72164 - protein, 34 aa, Artificial Sequence
  Description of Artificial Sequence: Synthetic polypeptide
FEEEIRTTNPVATEQYGSVSTTNLQGENGVPEDD

SEQ ID NO: 72165 - protein, 34 aa, Artificial Sequence
  Description of Artificial Sequence: Synthetic polypeptide
DEEEIRTTNPVATEQYGSVSDPLGLQRQNVTTNP

SEQ ID NO: 72166 - protein, 32 aa, Artificial Sequence
  Description of Artificial Sequence: Synthetic polypeptide
FEEEIRTTNPVATEQYGSVSNVSLQEQVTTNL

SEQ ID NO: 72167 - protein, 33 aa, Artificial Sequence
  Description of Artificial Sequence: Synthetic polypeptide
DEVEIATTNPVATEQYGCVCSTNDQGIDGNNER

SEQ ID NO: 72168 - protein, 34 aa, Artificial Sequence
  Description of Artificial Sequence: Synthetic polypeptide
DEEEIRTTNPVATEQYGSVSDTYNDERIGESVQD

SEQ ID NO: 72169 - protein, 32 aa, Artificial Sequence
  Description of Artificial Sequence: Synthetic polypeptide
FEEEIRTTNPVATEQYGSVPLNMLERQLNTVG

SEQ ID NO: 72170 - protein, 33 aa, Artificial Sequence
  Description of Artificial Sequence: Synthetic polypeptide
FEEEIRTTNPVATEQYGSVPVTPELTQVGPFPR

SEQ ID NO: 72171 - protein, 32 aa, Artificial Sequence
  Description of Artificial Sequence: Synthetic polypeptide
FEEEIRTTNPVATEQYGSVSAGNGEDEFGNGG

SEQ ID NO: 72172 - protein, 34 aa, Artificial Sequence
  Description of Artificial Sequence: Synthetic polypeptide
DEEEIRTTNPVATEQYGSVSQTPTSLQPTGEMQL

SEQ ID NO: 72173 - protein, 33 aa, Artificial Sequence
  Description of Artificial Sequence: Synthetic polypeptide
FEEEIRTTNPVATEQYGSVSDEMNIQDGGNEGI

SEQ ID NO: 72174 - protein, 31 aa, Artificial Sequence
  Description of Artificial Sequence: Synthetic polypeptide
DEVEIATTNPVATEQYGSVSANNDRNGTPEE

SEQ ID NO: 72175 - protein, 33 aa, Artificial Sequence
  Description of Artificial Sequence: Synthetic polypeptide
FEEEIRTTNPVATEQYGSVSDGNFNEQEGGGNG

SEQ ID NO: 72176 - protein, 35 aa, Artificial Sequence
  Description of Artificial Sequence: Synthetic polypeptide
DEEEIRTTNPVATEQYGSVSQTTNDQPTFGENGEN

SEQ ID NO: 72177 - protein, 35 aa, Artificial Sequence
  Description of Artificial Sequence: Synthetic polypeptide
DEEEIRTTNPVATEQYGSVSDTVNDQNIGLGNEQQ

SEQ ID NO: 72178 - protein, 30 aa, Artificial Sequence
  Description of Artificial Sequence: Synthetic polypeptide
AENEIATTNPVATEQYGEASEPALQRGMGR

SEQ ID NO: 72179 - protein, 33 aa, Artificial Sequence
  Description of Artificial Sequence: Synthetic polypeptide
DEDEIRTTNPVATEQYGSVSTTNTQEQEGTEQG

SEQ ID NO: 72180 - protein, 33 aa, Artificial Sequence
  Description of Artificial Sequence: Synthetic polypeptide
DEDEIRTTNPVATEQYGSVSTTNTNQQQEGTTQ

SEQ ID NO: 72181 - protein, 33 aa, Artificial Sequence
  Description of Artificial Sequence: Synthetic polypeptide
FEEEIRTTNPVATEQYGSVSFTTLEQRTFTEDL

SEQ ID NO: 72182 - protein, 32 aa, Artificial Sequence
  Description of Artificial Sequence: Synthetic polypeptide
DEVEIATTNPVATEQYGSVATPNSLFQVAGEF

SEQ ID NO: 72183 - protein, 34 aa, Artificial Sequence
  Description of Artificial Sequence: Synthetic polypeptide
DEEEIRTTNPVATEQYGSVSQTPNGLERSVFVTQ

SEQ ID NO: 72184 - protein, 32 aa, Artificial Sequence
  Description of Artificial Sequence: Synthetic polypeptide
DEVEIATTNPVATEQYGSVATNNDVRNGTPRE

SEQ ID NO: 72185 - protein, 32 aa, Artificial Sequence
  Description of Artificial Sequence: Synthetic polypeptide
DEEEIRTTNPVATEQYGSVSDVGMDTNGGGGG

SEQ ID NO: 72186 - protein, 33 aa, Artificial Sequence
  Description of Artificial Sequence: Synthetic polypeptide
DEEEIRTTNPVATEQYGSVSDVGMGLNGGGGNE

SEQ ID NO: 72187 - protein, 32 aa, Artificial Sequence
  Description of Artificial Sequence: Synthetic polypeptide
FEEEIRTTNPVATEQYGSVNGTNMTNEGGGNG

SEQ ID NO: 72188 - protein, 29 aa, Artificial Sequence
  Description of Artificial Sequence: Synthetic peptide
AENEIATTNPVATEQYGEASEGLVQFGGR

SEQ ID NO: 72189 - protein, 29 aa, Artificial Sequence
  Description of Artificial Sequence: Synthetic peptide
AENEIATTNPVATEQYGEASENLQAAGDA

SEQ ID NO: 72190 - protein, 35 aa, Artificial Sequence
  Description of Artificial Sequence: Synthetic polypeptide
DEDEIRTTNPVATEQYGSVSTVTNLQAGNNQNEDE

SEQ ID NO: 72191 - protein, 35 aa, Artificial Sequence
  Description of Artificial Sequence: Synthetic polypeptide
DEDEIRTTNPVATEQYGSVSTVTNLQAGNNNEETD

SEQ ID NO: 72192 - protein, 28 aa, Artificial Sequence
  Description of Artificial Sequence: Synthetic peptide
AENEIATTNPVATEQYGEASENLQHEEK

SEQ ID NO: 72193 - protein, 34 aa, Artificial Sequence
  Description of Artificial Sequence: Synthetic polypeptide
DEEEIRTTNPVATEQYGSVSDYNLQVNFSENMQD

SEQ ID NO: 72194 - protein, 33 aa, Artificial Sequence
  Description of Artificial Sequence: Synthetic polypeptide
FEEEIRTTNPVATEQYGSVNSDNDGEGQGGNID

SEQ ID NO: 72195 - protein, 34 aa, Artificial Sequence
  Description of Artificial Sequence: Synthetic polypeptide
FEEEIRTTNPVATEQYGSVNSDTGNNGQGEGNEQ

SEQ ID NO: 72196 - protein, 29 aa, Artificial Sequence
  Description of Artificial Sequence: Synthetic peptide
AENEIATTNPVATEQYGEASENLQRAEGA

SEQ ID NO: 72197 - protein, 33 aa, Artificial Sequence
  Description of Artificial Sequence: Synthetic polypeptide
DEEEIRTTNPVATEQYGSVSDVTLGLNEGGTGQ

SEQ ID NO: 72198 - protein, 33 aa, Artificial Sequence
  Description of Artificial Sequence: Synthetic polypeptide
DEEEIRTTNPVATEQYGSVSDVTLGLGNGETGD

SEQ ID NO: 72199 - protein, 33 aa, Artificial Sequence
  Description of Artificial Sequence: Synthetic polypeptide
DEEEIRTTNPVATEQYGSVSDVTLGLENEGGTT

SEQ ID NO: 72200 - protein, 33 aa, Artificial Sequence
  Description of Artificial Sequence: Synthetic polypeptide
FEEEIRTTNPVATEQYGSVNSGTDQGQEEGGNQ

SEQ ID NO: 72201 - protein, 35 aa, Artificial Sequence
  Description of Artificial Sequence: Synthetic polypeptide
DEEEIRTTNPVATEQYGSVSQTNSAVQREIVNVDV

SEQ ID NO: 72202 - protein, 29 aa, Artificial Sequence
  Description of Artificial Sequence: Synthetic peptide
AENEIATTNPVATEQYGEASENPVEFGNR

SEQ ID NO: 72203 - protein, 33 aa, Artificial Sequence
  Description of Artificial Sequence: Synthetic polypeptide
FEEEIRTTNPVATEQYGSVSNTNVNMVGGNGQE

SEQ ID NO: 72204 - protein, 35 aa, Artificial Sequence
  Description of Artificial Sequence: Synthetic polypeptide
DEEEIRTTNPVATEQYGSVSDTTNDGQGQEGGGND

SEQ ID NO: 72205 - protein, 33 aa, Artificial Sequence
  Description of Artificial Sequence: Synthetic polypeptide
DEDEIRTTNPVATEQYGSVSTTNTNQQEGELQQ

SEQ ID NO: 72206 - protein, 33 aa, Artificial Sequence
  Description of Artificial Sequence: Synthetic polypeptide
FEEEIRTTNPVATEQYGSVSITGLGNGGNGNIN

SEQ ID NO: 72207 - protein, 34 aa, Artificial Sequence
  Description of Artificial Sequence: Synthetic polypeptide
FEEEIRTTNPVATEQYGSVSITNNQGQEGGNGGT

SEQ ID NO: 72208 - protein, 30 aa, Artificial Sequence
  Description of Artificial Sequence: Synthetic polypeptide
AENEIATTNPVATEQYGSASTDLEREGEDL

SEQ ID NO: 72209 - protein, 32 aa, Artificial Sequence
  Description of Artificial Sequence: Synthetic polypeptide
FEEEIRTTNPVATEQYGSVSLPLQRLTIDDLI

SEQ ID NO: 72210 - protein, 31 aa, Artificial Sequence
  Description of Artificial Sequence: Synthetic polypeptide
DEVEIATTNPVATEQYGEVSTNLNGDTNGEE

SEQ ID NO: 72211 - protein, 31 aa, Artificial Sequence
  Description of Artificial Sequence: Synthetic polypeptide
DEVEIATTNPVATEQYGEVSTNLNGDIQDRE

SEQ ID NO: 72212 - protein, 34 aa, Artificial Sequence
  Description of Artificial Sequence: Synthetic polypeptide
DEEEIRTTNPVATEQYGSVSSATPALNDHEGNPL

SEQ ID NO: 72213 - protein, 34 aa, Artificial Sequence
  Description of Artificial Sequence: Synthetic polypeptide
DEEEIRTTNPVATEQYGSVSSATPALNMHEGNPL

SEQ ID NO: 72214 - protein, 34 aa, Artificial Sequence
  Description of Artificial Sequence: Synthetic polypeptide
FEEEIRTTNPVATEQYGSVSNMNGLQTGGGNNEQ

SEQ ID NO: 72215 - protein, 31 aa, Artificial Sequence
  Description of Artificial Sequence: Synthetic polypeptide
DEVEIATTNPVATEQYGEVSTNLNGDINGGS

SEQ ID NO: 72216 - protein, 34 aa, Artificial Sequence
  Description of Artificial Sequence: Synthetic polypeptide
FEEEIRTTNPVATEQYGSVSNMNLDQSEGGNDGQ

SEQ ID NO: 72217 - protein, 33 aa, Artificial Sequence
  Description of Artificial Sequence: Synthetic polypeptide
FEEEIRTTNPVATEQYGSVSNNLSQPMIEVNSI

SEQ ID NO: 72218 - protein, 32 aa, Artificial Sequence
  Description of Artificial Sequence: Synthetic polypeptide
FEEEIRTTNPVATEQYGSVSNNVNVVGGNGQE

SEQ ID NO: 72219 - protein, 34 aa, Artificial Sequence
  Description of Artificial Sequence: Synthetic polypeptide
FEEEIRTTNPVATEQYGSVSNTDNDQQGEGGNNT

SEQ ID NO: 72220 - protein, 33 aa, Artificial Sequence
  Description of Artificial Sequence: Synthetic polypeptide
FEEEIRTTNPVATEQYGSVSNTDNMNIIGGGNE

SEQ ID NO: 72221 - protein, 33 aa, Artificial Sequence
  Description of Artificial Sequence: Synthetic polypeptide
FEEEIRTTNPVATEQYGSVSINNDQNGEGQGNE

SEQ ID NO: 72222 - protein, 33 aa, Artificial Sequence
  Description of Artificial Sequence: Synthetic polypeptide
DEDEIRTTNPVATEQYGSVSTTNTNQQQEGEQQ

SEQ ID NO: 72223 - protein, 30 aa, Artificial Sequence
  Description of Artificial Sequence: Synthetic polypeptide
AENEIATTNPVATEQYGSASAEDLEDRGGR

SEQ ID NO: 72224 - protein, 31 aa, Artificial Sequence
  Description of Artificial Sequence: Synthetic polypeptide
AENEIATTNPVATEQYGEVSSEPALPNRGNR

SEQ ID NO: 72225 - protein, 31 aa, Artificial Sequence
  Description of Artificial Sequence: Synthetic polypeptide
DEECISTTNPVATEQYGCVCSTNDQFFGSEQ

SEQ ID NO: 72226 - protein, 34 aa, Artificial Sequence
  Description of Artificial Sequence: Synthetic polypeptide
DEEEIRTTNPVATEQYGSVSDTTDLSDENGGNGS

SEQ ID NO: 72227 - protein, 33 aa, Artificial Sequence
  Description of Artificial Sequence: Synthetic polypeptide
FEEEIRTTNPVATEQYGSVSGTDNVNVNGGNGQ

SEQ ID NO: 72228 - protein, 34 aa, Artificial Sequence
  Description of Artificial Sequence: Synthetic polypeptide
FEEEIRTTNPVATEQYGSVSGTGENDQGNGGENI

SEQ ID NO: 72229 - protein, 31 aa, Artificial Sequence
  Description of Artificial Sequence: Synthetic polypeptide
AEEEISTTNPVATEQYGCVCSVTELQGGDQM

SEQ ID NO: 72230 - protein, 35 aa, Artificial Sequence
  Description of Artificial Sequence: Synthetic polypeptide
DEEEIRTTNPVATEQYGSVSDTQNDDEQTIGGNEG

SEQ ID NO: 72231 - protein, 33 aa, Artificial Sequence
  Description of Artificial Sequence: Synthetic polypeptide
FEEEIRTTNPVATEQYGSVSGTGVNVNGGNGQE

SEQ ID NO: 72232 - protein, 34 aa, Artificial Sequence
  Description of Artificial Sequence: Synthetic polypeptide
FEEEIRTTNPVATEQYGSVSGTNADQQGEGGNNT

SEQ ID NO: 72233 - protein, 34 aa, Artificial Sequence
  Description of Artificial Sequence: Synthetic polypeptide
FEEEIRTTNPVATEQYGSVSGTNNDEQNEGGNGG

SEQ ID NO: 72234 - protein, 34 aa, Artificial Sequence
  Description of Artificial Sequence: Synthetic polypeptide
FEEEIRTTNPVATEQYGSVSGTNNMQGEMGNGEG

SEQ ID NO: 72235 - protein, 28 aa, Artificial Sequence
  Description of Artificial Sequence: Synthetic peptide
AENEIATTNPVATEQYGEVSECLQHEGL

SEQ ID NO: 72236 - protein, 33 aa, Artificial Sequence
  Description of Artificial Sequence: Synthetic polypeptide
DEEEIRTTNPVATEQYGSVSSATALNDHEGEPL

SEQ ID NO: 72237 - protein, 31 aa, Artificial Sequence
  Description of Artificial Sequence: Synthetic polypeptide
FEEEIRTTNPVATEQYGSVSIDNGNGNDEDE

SEQ ID NO: 72238 - protein, 33 aa, Artificial Sequence
  Description of Artificial Sequence: Synthetic polypeptide
AEEEISTTNPVATEQYGCVCSTNLQNFGSENQA

SEQ ID NO: 72239 - protein, 33 aa, Artificial Sequence
  Description of Artificial Sequence: Synthetic polypeptide
DEEEIRTTNPVATEQYGSVSSATDGEMREGEDV

SEQ ID NO: 72240 - protein, 30 aa, Artificial Sequence
  Description of Artificial Sequence: Synthetic polypeptide
AENEIATTNPVATEQYGSASAEDLEDRGER

SEQ ID NO: 72241 - protein, 32 aa, Artificial Sequence
  Description of Artificial Sequence: Synthetic polypeptide
DEECLRTTNPIAYEAYGEVSTGNLSQRGGNNR

SEQ ID NO: 72242 - protein, 34 aa, Artificial Sequence
  Description of Artificial Sequence: Synthetic polypeptide
DEECIRTTNPVATEIYGVTVTCTNELSQRTGGNR

SEQ ID NO: 72243 - protein, 32 aa, Artificial Sequence
  Description of Artificial Sequence: Synthetic polypeptide
DEECIRTTNPVATEIYGQVWTTNLERFGSNQE

SEQ ID NO: 72244 - protein, 29 aa, Artificial Sequence
  Description of Artificial Sequence: Synthetic peptide
AENEIACTNPVATEQYGEASEPNLQRGGV

SEQ ID NO: 72245 - protein, 30 aa, Artificial Sequence
  Description of Artificial Sequence: Synthetic polypeptide
DQGEIRTTNPVATYCYGSVSTLNLTEGTDM

SEQ ID NO: 72246 - protein, 32 aa, Artificial Sequence
  Description of Artificial Sequence: Synthetic polypeptide
DQHEIRTTNPVATEQYGSVATANLNQSINHGN

SEQ ID NO: 72247 - protein, 30 aa, Artificial Sequence
  Description of Artificial Sequence: Synthetic polypeptide
AENEIACTNPVATEQYGEASEQNLQRSGGR

SEQ ID NO: 72248 - protein, 30 aa, Artificial Sequence
  Description of Artificial Sequence: Synthetic polypeptide
DGEEIATTNPVAYEQWGSVTSTLDGQTGTR

SEQ ID NO: 72249 - protein, 28 aa, Artificial Sequence
  Description of Artificial Sequence: Synthetic peptide
AENEIACTNPVATEQYGEARENLQKGGR

SEQ ID NO: 72250 - protein, 29 aa, Artificial Sequence
  Description of Artificial Sequence: Synthetic peptide
AENEIACTNPVATEQYGEAREPNLQRGGR

SEQ ID NO: 72251 - protein, 33 aa, Artificial Sequence
  Description of Artificial Sequence: Synthetic polypeptide
DQSEIATTNPVATEAYGSVSTGNLSQEVVGNNR

SEQ ID NO: 72252 - protein, 29 aa, Artificial Sequence
  Description of Artificial Sequence: Synthetic peptide
DGEEIATTNPVAYEQWGSVTHTLDQRDTR

SEQ ID NO: 72253 - protein, 29 aa, Artificial Sequence
  Description of Artificial Sequence: Synthetic peptide
DEEAIRTTNPDATEGYGSCSTPLARNEDN

SEQ ID NO: 72254 - protein, 30 aa, Artificial Sequence
  Description of Artificial Sequence: Synthetic polypeptide
DEEAIRTTNPDAYEGYGSCSTNLARVQNHF

SEQ ID NO: 72255 - protein, 34 aa, Artificial Sequence
  Description of Artificial Sequence: Synthetic polypeptide
DEEEIRTTNPVATEQYGSVSNTFNQDIGNGNLFG

SEQ ID NO: 72256 - protein, 34 aa, Artificial Sequence
  Description of Artificial Sequence: Synthetic polypeptide
DEEEIRTTNPVATEQYGSVSPSDLEQTQIGNPEL

SEQ ID NO: 72257 - protein, 31 aa, Artificial Sequence
  Description of Artificial Sequence: Synthetic polypeptide
DEEAIRTTNPMATEGYGSVCATDNLQPNNHA

SEQ ID NO: 72258 - protein, 34 aa, Artificial Sequence
  Description of Artificial Sequence: Synthetic polypeptide
DEEEIRTTNPVATEQYGSVSPQTTNQQPAQGEFM

SEQ ID NO: 72259 - protein, 34 aa, Artificial Sequence
  Description of Artificial Sequence: Synthetic polypeptide
DEEEIRTTNPVATEQYGSVSPQPNDSQISGENPI

SEQ ID NO: 72260 - protein, 33 aa, Artificial Sequence
  Description of Artificial Sequence: Synthetic polypeptide
DEEAIGTTNPVATEQYGSVASNMNLQQGQNNDH

SEQ ID NO: 72261 - protein, 35 aa, Artificial Sequence
  Description of Artificial Sequence: Synthetic polypeptide
DEEEIRTTNPVATEQYGSVSNTGNMTMEGEQGGNE

SEQ ID NO: 72262 - protein, 29 aa, Artificial Sequence
  Description of Artificial Sequence: Synthetic peptide
AENEIACTNPVATEQYGEASENNQRGGYR

SEQ ID NO: 72263 - protein, 35 aa, Artificial Sequence
  Description of Artificial Sequence: Synthetic polypeptide
DEEEIRTTNPVATEQYGSVSNTMLNLEERGEELFM

SEQ ID NO: 72264 - protein, 32 aa, Artificial Sequence
  Description of Artificial Sequence: Synthetic polypeptide
DGEEIRTTNPVATEQWGSVTSTLLLQGEGITD

SEQ ID NO: 72265 - protein, 31 aa, Artificial Sequence
  Description of Artificial Sequence: Synthetic polypeptide
DEDEIRTTNPVAYEQWGSVSHPLDDRQMNNR

SEQ ID NO: 72266 - protein, 30 aa, Artificial Sequence
  Description of Artificial Sequence: Synthetic polypeptide
AENEIACTNPVATEQYGEASENPLQRGGPR

SEQ ID NO: 72267 - protein, 29 aa, Artificial Sequence
  Description of Artificial Sequence: Synthetic peptide
AENEIACTNPVATEQYGEASENPQREGND

SEQ ID NO: 72268 - protein, 31 aa, Artificial Sequence
  Description of Artificial Sequence: Synthetic polypeptide
DEDEIRTTNPVAYEQWGSVSGNLQGDHQGGS

SEQ ID NO: 72269 - protein, 29 aa, Artificial Sequence
  Description of Artificial Sequence: Synthetic peptide
AENEIACTNPVATEQYGEASENPVQFGNR

SEQ ID NO: 72270 - protein, 28 aa, Artificial Sequence
  Description of Artificial Sequence: Synthetic peptide
AENEIACTNPVATEQYGEASENRQRGGP

SEQ ID NO: 72271 - protein, 32 aa, Artificial Sequence
  Description of Artificial Sequence: Synthetic polypeptide
DQEEIRTTNPVAYEQYGSVASMNNLSIGNEDW

SEQ ID NO: 72272 - protein, 33 aa, Artificial Sequence
  Description of Artificial Sequence: Synthetic polypeptide
DQEEIRTTNPVAYEQYGSVPFCTNPSQRPGTNH

SEQ ID NO: 72273 - protein, 34 aa, Artificial Sequence
  Description of Artificial Sequence: Synthetic polypeptide
DQEEIRTTNPVAYEQYGSVVPFCTNPSQRNGTNR

SEQ ID NO: 72274 - protein, 28 aa, Artificial Sequence
  Description of Artificial Sequence: Synthetic peptide
AENEIACTNPVATEQYGEASENSQRKGR

SEQ ID NO: 72275 - protein, 30 aa, Artificial Sequence
  Description of Artificial Sequence: Synthetic polypeptide
AENEIACTNPVATEQYGEASENVLQRGGRS

SEQ ID NO: 72276 - protein, 29 aa, Artificial Sequence
  Description of Artificial Sequence: Synthetic peptide
AENEIACTNPVATEQYGEASENWLQRGGS

SEQ ID NO: 72277 - protein, 32 aa, Artificial Sequence
  Description of Artificial Sequence: Synthetic polypeptide
DEEAIRTTNPMATEGYGSVIATDNLQPGENHA

SEQ ID NO: 72278 - protein, 30 aa, Artificial Sequence
  Description of Artificial Sequence: Synthetic polypeptide
DGEEIATTNPVAYEQWGSVTHTEDQRGTER

SEQ ID NO: 72279 - protein, 34 aa, Artificial Sequence
  Description of Artificial Sequence: Synthetic polypeptide
DQSEIATTNPVATEQYGSVVQSTGNLSQPVVGNR

SEQ ID NO: 72280 - protein, 34 aa, Artificial Sequence
  Description of Artificial Sequence: Synthetic polypeptide
DQSEICTTNPVATEQYGSVSYTGNLSQPVVGNNR

SEQ ID NO: 72281 - protein, 28 aa, Artificial Sequence
  Description of Artificial Sequence: Synthetic peptide
AENEIACTNPVATEQYGEASETLQHGDR

SEQ ID NO: 72282 - protein, 34 aa, Artificial Sequence
  Description of Artificial Sequence: Synthetic polypeptide
DQSEIRTTNPVATEQYGKVSCTGNLQRTGTNNQE

SEQ ID NO: 72283 - protein, 33 aa, Artificial Sequence
  Description of Artificial Sequence: Synthetic polypeptide
DQSEIRTTNPVATEQYGKVSTGNLSQPVVGNNP

SEQ ID NO: 72284 - protein, 34 aa, Artificial Sequence
  Description of Artificial Sequence: Synthetic polypeptide
DEEEIRTTNPVATEQYGSVSNTDTGQQDIGGNED

SEQ ID NO: 72285 - protein, 35 aa, Artificial Sequence
  Description of Artificial Sequence: Synthetic polypeptide
DEEEIRTTNPVATEQYGSVSNTDTGLQSEGNGDQE

SEQ ID NO: 72286 - protein, 34 aa, Artificial Sequence
  Description of Artificial Sequence: Synthetic polypeptide
DEEEIRTTNPVATEQYGSVSNTDTGLFGEGGNND

SEQ ID NO: 72287 - protein, 30 aa, Artificial Sequence
  Description of Artificial Sequence: Synthetic polypeptide
DGEDLRTTNPVATEQWGSVTSTALQGEGTD

SEQ ID NO: 72288 - protein, 33 aa, Artificial Sequence
  Description of Artificial Sequence: Synthetic polypeptide
DQSEIRTTNPVATEQYGSTVSCTLNSSQETGND

SEQ ID NO: 72289 - protein, 35 aa, Artificial Sequence
  Description of Artificial Sequence: Synthetic polypeptide
DQSEIRTTNPVATEQYGSVPSTGNMLSQPVVGNRK

SEQ ID NO: 72290 - protein, 33 aa, Artificial Sequence
  Description of Artificial Sequence: Synthetic polypeptide
DQSEIRTTNPVATEQYGSVSTGNHSTPVVGNNR

SEQ ID NO: 72291 - protein, 33 aa, Artificial Sequence
  Description of Artificial Sequence: Synthetic polypeptide
DEEEIRTTNPVATEQYGSVSNTDPVNVAGNDGT

SEQ ID NO: 72292 - protein, 29 aa, Artificial Sequence
  Description of Artificial Sequence: Synthetic peptide
AENEIACTNPVATEQYGEASETLQRVGGR

SEQ ID NO: 72293 - protein, 33 aa, Artificial Sequence
  Description of Artificial Sequence: Synthetic polypeptide
DEEEIRTTNPVATEQYGSVSNTDNVEFEFGGEI

SEQ ID NO: 72294 - protein, 33 aa, Artificial Sequence
  Description of Artificial Sequence: Synthetic polypeptide
DEEEIRTTNPVATEQYGSVSNTDNVEFDEFGIE

SEQ ID NO: 72295 - protein, 29 aa, Artificial Sequence
  Description of Artificial Sequence: Synthetic peptide
DEYVIATTNPVATETVGSVSSDTQQIGNR

SEQ ID NO: 72296 - protein, 32 aa, Artificial Sequence
  Description of Artificial Sequence: Synthetic polypeptide
DEEEIRTTNPVATEQYGSVSNTEHTFFNSNQP

SEQ ID NO: 72297 - protein, 34 aa, Artificial Sequence
  Description of Artificial Sequence: Synthetic polypeptide
DEEEIRTTNPVATEQYGSVSNTMNGTNNEFGQNG

SEQ ID NO: 72298 - protein, 30 aa, Artificial Sequence
  Description of Artificial Sequence: Synthetic polypeptide
AENEIACTNPVATEQYGEASERNLQNRGGR

SEQ ID NO: 72299 - protein, 28 aa, Artificial Sequence
  Description of Artificial Sequence: Synthetic peptide
AENEIACTNPVATEQYGEASERLQRGGS

SEQ ID NO: 72300 - protein, 35 aa, Artificial Sequence
  Description of Artificial Sequence: Synthetic polypeptide
DEEEIRTTNPVATEQYGSVSNTETDLQPRIVNEFD

SEQ ID NO: 72301 - protein, 34 aa, Artificial Sequence
  Description of Artificial Sequence: Synthetic polypeptide
DQSEIRTTNPIATEQYGSVSCTGNLSQPVVGNNR

SEQ ID NO: 72302 - protein, 34 aa, Artificial Sequence
  Description of Artificial Sequence: Synthetic polypeptide
DQSEIRTTNPVATEAYGCSVSTGNLSQPLVGNNR

SEQ ID NO: 72303 - protein, 34 aa, Artificial Sequence
  Description of Artificial Sequence: Synthetic polypeptide
DEEEIRTTNPVATEQYGSVSNTENMNGETGGNGT

SEQ ID NO: 72304 - protein, 34 aa, Artificial Sequence
  Description of Artificial Sequence: Synthetic polypeptide
DQSEIRTTNPVATEAYGSVASTGNLSQPQVGNNR

SEQ ID NO: 72305 - protein, 33 aa, Artificial Sequence
  Description of Artificial Sequence: Synthetic polypeptide
DQSEIRTTNPVATEAYGSVFTGNLSQLVVGNNR

SEQ ID NO: 72306 - protein, 33 aa, Artificial Sequence
  Description of Artificial Sequence: Synthetic polypeptide
DQSEIRTTNPVATEAYGSVSEGNLSQPHVGNNR

SEQ ID NO: 72307 - protein, 33 aa, Artificial Sequence
  Description of Artificial Sequence: Synthetic polypeptide
DQSEIRTTNPVATEAYGSVSTGNASQTVVGNNR

SEQ ID NO: 72308 - protein, 34 aa, Artificial Sequence
  Description of Artificial Sequence: Synthetic polypeptide
DQSEIRTTNPVATEAYGSVSTGNELSQFVVGNNR

SEQ ID NO: 72309 - protein, 33 aa, Artificial Sequence
  Description of Artificial Sequence: Synthetic polypeptide
DQSEIRTTNPVATEAYGSVSTGNLSAVVVGNNR

SEQ ID NO: 72310 - protein, 30 aa, Artificial Sequence
  Description of Artificial Sequence: Synthetic polypeptide
DEEAIRTTNPVATEAYGKGSTNEQPPSNFN

SEQ ID NO: 72311 - protein, 35 aa, Artificial Sequence
  Description of Artificial Sequence: Synthetic polypeptide
DEEEIRTTNPVATEQYGSVSNTENFGQSEGGENEG

SEQ ID NO: 72312 - protein, 33 aa, Artificial Sequence
  Description of Artificial Sequence: Synthetic polypeptide
DQSEIRTTNPVATEAYGSVSTGNLSEPMVGNNR

SEQ ID NO: 72313 - protein, 33 aa, Artificial Sequence
  Description of Artificial Sequence: Synthetic polypeptide
DQSEIRTTNPVATEAYGSVSTGNLSQPVVGNNI

SEQ ID NO: 72314 - protein, 33 aa, Artificial Sequence
  Description of Artificial Sequence: Synthetic polypeptide
DQSEIRTTNPVATEAYGSVSTGNQSQPAVGNNR

SEQ ID NO: 72315 - protein, 33 aa, Artificial Sequence
  Description of Artificial Sequence: Synthetic polypeptide
DEEEIRTTNPVATEQYGSVSPSEVLQLMVENED

SEQ ID NO: 72316 - protein, 31 aa, Artificial Sequence
  Description of Artificial Sequence: Synthetic polypeptide
DEEAICTVNPVATEAYGSVSTDTNLESGNQV

SEQ ID NO: 72317 - protein, 32 aa, Artificial Sequence
  Description of Artificial Sequence: Synthetic polypeptide
DEEAICTVNPVATEAYGSVSTDTNELQENGNQ

SEQ ID NO: 72318 - protein, 32 aa, Artificial Sequence
  Description of Artificial Sequence: Synthetic polypeptide
DQEEIRTTNPVAYDPYGSVSTNGVSQNGGNNR

SEQ ID NO: 72319 - protein, 29 aa, Artificial Sequence
  Description of Artificial Sequence: Synthetic peptide
AENEIACTNPVATEQYGEASENLQTFGGR

SEQ ID NO: 72320 - protein, 31 aa, Artificial Sequence
  Description of Artificial Sequence: Synthetic polypeptide
DEDEIRTTNPVAYEQWGSVSTGDAGAQGGNA

SEQ ID NO: 72321 - protein, 31 aa, Artificial Sequence
  Description of Artificial Sequence: Synthetic polypeptide
DQEEIRTTNPVATHQYGSVSTDGVQEGEEHK

SEQ ID NO: 72322 - protein, 29 aa, Artificial Sequence
  Description of Artificial Sequence: Synthetic peptide
AENEIACTNPVATEQYGEASEDLQREGGR

SEQ ID NO: 72323 - protein, 29 aa, Artificial Sequence
  Description of Artificial Sequence: Synthetic peptide
AENEIACTNPVATEQYGEASEDLQREGER

SEQ ID NO: 72324 - protein, 33 aa, Artificial Sequence
  Description of Artificial Sequence: Synthetic polypeptide
DEEAEIRTTNPVAYEQWGCVSTNLNGNAGENER

SEQ ID NO: 72325 - protein, 29 aa, Artificial Sequence
  Description of Artificial Sequence: Synthetic peptide
AENEIACTNPVATEQYGEASEDLNQRGGR

SEQ ID NO: 72326 - protein, 32 aa, Artificial Sequence
  Description of Artificial Sequence: Synthetic polypeptide
DEEAEIRTTNPVAYEQWGEVSTNLNGDHGNEQ

SEQ ID NO: 72327 - protein, 33 aa, Artificial Sequence
  Description of Artificial Sequence: Synthetic polypeptide
DQEEIRTTNPVATHQYGSVSTNGDQNFGSNNQS

SEQ ID NO: 72328 - protein, 29 aa, Artificial Sequence
  Description of Artificial Sequence: Synthetic peptide
AENEIACTNPVATEQYGEASEDLDQRGGR

SEQ ID NO: 72329 - protein, 29 aa, Artificial Sequence
  Description of Artificial Sequence: Synthetic peptide
AENEIACTNPVATEQYGEASECNLQQGGR

SEQ ID NO: 72330 - protein, 28 aa, Artificial Sequence
  Description of Artificial Sequence: Synthetic peptide
AENEIACTNPVATEQYGEASECLQRGGL

SEQ ID NO: 72331 - protein, 28 aa, Artificial Sequence
  Description of Artificial Sequence: Synthetic peptide
AENEIACTNPVATEQYGEASECLQRGEL

SEQ ID NO: 72332 - protein, 28 aa, Artificial Sequence
  Description of Artificial Sequence: Synthetic peptide
AENEIACTNPVATEQYGEASEAPQRGGR

SEQ ID NO: 72333 - protein, 30 aa, Artificial Sequence
  Description of Artificial Sequence: Synthetic polypeptide
AENEIACTNPVATEQYGEASEANPLQRGGR

SEQ ID NO: 72334 - protein, 29 aa, Artificial Sequence
  Description of Artificial Sequence: Synthetic peptide
AENEIACTNPVATEQYGEASEDLQRGMGR

SEQ ID NO: 72335 - protein, 35 aa, Artificial Sequence
  Description of Artificial Sequence: Synthetic polypeptide
DEEEIRTTNPVATEQYGSVSNTNILVISRPSENVE

SEQ ID NO: 72336 - protein, 33 aa, Artificial Sequence
  Description of Artificial Sequence: Synthetic polypeptide
DEEAEIRTTNPVAYECYGSVSTPNQGGNQGNDR

SEQ ID NO: 72337 - protein, 34 aa, Artificial Sequence
  Description of Artificial Sequence: Synthetic polypeptide
DEEEIRTTNPVATEQYGSVSPNTLNVSIGINQEE

SEQ ID NO: 72338 - protein, 30 aa, Artificial Sequence
  Description of Artificial Sequence: Synthetic polypeptide
AENEIACTNPVATEQYGEASEENLQRKGGR

SEQ ID NO: 72339 - protein, 33 aa, Artificial Sequence
  Description of Artificial Sequence: Synthetic polypeptide
DQEEIRTTNPVATEQYGSVSTPDLQESMEEDRA

SEQ ID NO: 72340 - protein, 31 aa, Artificial Sequence
  Description of Artificial Sequence: Synthetic polypeptide
AENEIACTNPVATEQYGEASEENLQQRNGNR

SEQ ID NO: 72341 - protein, 34 aa, Artificial Sequence
  Description of Artificial Sequence: Synthetic polypeptide
DQEEIRTTNPVATEQYGTCNVFSTINDLQGGQNE

SEQ ID NO: 72342 - protein, 30 aa, Artificial Sequence
  Description of Artificial Sequence: Synthetic polypeptide
AENEIACTNPVATEQYGEASEENLQQRGGR

SEQ ID NO: 72343 - protein, 32 aa, Artificial Sequence
  Description of Artificial Sequence: Synthetic polypeptide
DQEEIRTTNPVATHAYGKVSTNEVSQNGGNNR

SEQ ID NO: 72344 - protein, 32 aa, Artificial Sequence
  Description of Artificial Sequence: Synthetic polypeptide
DEEAEIATTNPVAYEQWGVVSTNLQHNGPNDK

SEQ ID NO: 72345 - protein, 29 aa, Artificial Sequence
  Description of Artificial Sequence: Synthetic peptide
AENEIACTNPVATEQYGEASENLQSRGGT

SEQ ID NO: 72346 - protein, 28 aa, Artificial Sequence
  Description of Artificial Sequence: Synthetic peptide
AENEIACTNPVATEQYGEASEELQVGGR

SEQ ID NO: 72347 - protein, 29 aa, Artificial Sequence
  Description of Artificial Sequence: Synthetic peptide
AENEIACTNPVATEQYGEASEELQRSGGR

SEQ ID NO: 72348 - protein, 28 aa, Artificial Sequence
  Description of Artificial Sequence: Synthetic peptide
AENEIACTNPVATEQYGEASEELQRGGY

SEQ ID NO: 72349 - protein, 28 aa, Artificial Sequence
  Description of Artificial Sequence: Synthetic peptide
AENEIACTNPVATEQYGEASEEEQRGGR

SEQ ID NO: 72350 - protein, 28 aa, Artificial Sequence
  Description of Artificial Sequence: Synthetic peptide
AENEIACTNPVATEQYGEASEDWQRGGR

SEQ ID NO: 72351 - protein, 31 aa, Artificial Sequence
  Description of Artificial Sequence: Synthetic polypeptide
DGEEIRTTNPVATYQWGSVTSTLLQNGEGTH

SEQ ID NO: 72352 - protein, 29 aa, Artificial Sequence
  Description of Artificial Sequence: Synthetic peptide
AENEIACTNPVATEQYGEASENLQSRHGR

SEQ ID NO: 72353 - protein, 28 aa, Artificial Sequence
  Description of Artificial Sequence: Synthetic peptide
AENEIACTNPVATEQYGEASENLQSSGR

SEQ ID NO: 72354 - protein, 31 aa, Artificial Sequence
  Description of Artificial Sequence: Synthetic polypeptide
DEEAIRTTNPVATEIYGCVCQTNLQYGSDQS

SEQ ID NO: 72355 - protein, 30 aa, Artificial Sequence
  Description of Artificial Sequence: Synthetic polypeptide
AENEIACTNPVATEQYGEASEANLQRGQGR

SEQ ID NO: 72356 - protein, 31 aa, Artificial Sequence
  Description of Artificial Sequence: Synthetic polypeptide
DQEEIRTTNPVATHQYGSVSTNGVENGTHTS

SEQ ID NO: 72357 - protein, 33 aa, Artificial Sequence
  Description of Artificial Sequence: Synthetic polypeptide
DEEEIRTTNPVATEQYGSVSNTNDNNDTGEFGF

SEQ ID NO: 72358 - protein, 32 aa, Artificial Sequence
  Description of Artificial Sequence: Synthetic polypeptide
DEEAICTVNPVATEAYGSVSTDNLQENEGNQE

SEQ ID NO: 72359 - protein, 30 aa, Artificial Sequence
  Description of Artificial Sequence: Synthetic polypeptide
AENEIACTNPVATEQYGEASENLTQRVGGR

SEQ ID NO: 72360 - protein, 33 aa, Artificial Sequence
  Description of Artificial Sequence: Synthetic polypeptide
DEEEIRTTNPVATEQYGSVSPPLMEIQAEVQRL

SEQ ID NO: 72361 - protein, 31 aa, Artificial Sequence
  Description of Artificial Sequence: Synthetic polypeptide
DQEEIRTTNPVATHQYGVVSTNGTDENGTHR

SEQ ID NO: 72362 - protein, 30 aa, Artificial Sequence
  Description of Artificial Sequence: Synthetic polypeptide
DEDEIRTTNPVAYEQWGSVSTAMQGGDGGS

SEQ ID NO: 72363 - protein, 32 aa, Artificial Sequence
  Description of Artificial Sequence: Synthetic polypeptide
DEEAICTVNPVATEAYGSVSTDNNLQENGNNQ

SEQ ID NO: 72364 - protein, 31 aa, Artificial Sequence
  Description of Artificial Sequence: Synthetic polypeptide
DEDEIRTTNPVAYEQWGSVSTADGGGHGNNR

SEQ ID NO: 72365 - protein, 31 aa, Artificial Sequence
  Description of Artificial Sequence: Synthetic polypeptide
DEDEIRTTNPVAYEQWGSVSNDNHQNDGGMR

SEQ ID NO: 72366 - protein, 29 aa, Artificial Sequence
  Description of Artificial Sequence: Synthetic peptide
AENEIACTNPVATEQYGEASAENLQRGGD

SEQ ID NO: 72367 - protein, 32 aa, Artificial Sequence
  Description of Artificial Sequence: Synthetic polypeptide
DEEAICTVNPVATEAYGSVSTDNQLQENNGNQ

SEQ ID NO: 72368 - protein, 30 aa, Artificial Sequence
  Description of Artificial Sequence: Synthetic polypeptide
AENEIACTNPVATEQYGEASAENLQRGEDR

SEQ ID NO: 72369 - protein, 30 aa, Artificial Sequence
  Description of Artificial Sequence: Synthetic polypeptide
AENEIACTNPVATEQYGEASAENLQDRGGR

SEQ ID NO: 72370 - protein, 34 aa, Artificial Sequence
  Description of Artificial Sequence: Synthetic polypeptide
DEEEIRTTNPVATEQYGSVSNTMNTNEEFGVNEQ

SEQ ID NO: 72371 - protein, 30 aa, Artificial Sequence
  Description of Artificial Sequence: Synthetic polypeptide
AENEIACTNPVATEQYGEASENLYQRGEGR

SEQ ID NO: 72372 - protein, 31 aa, Artificial Sequence
  Description of Artificial Sequence: Synthetic polypeptide
DEEAICTVNPVATEAYGSVSTDNLESGGNNV

SEQ ID NO: 72373 - protein, 32 aa, Artificial Sequence
  Description of Artificial Sequence: Synthetic polypeptide
DQEEIRTTNPVATHQYGSVSTNGVEMNGDTHR

SEQ ID NO: 72374 - protein, 30 aa, Artificial Sequence
  Description of Artificial Sequence: Synthetic polypeptide
AENEIACTNPVATEQYGEASENLSQRGLGR

SEQ ID NO: 72375 - protein, 33 aa, Artificial Sequence
  Description of Artificial Sequence: Synthetic polypeptide
DEEEIRTTNPVATEQYGSVSNTNDPQQVVEEDH

SEQ ID NO: 72376 - protein, 31 aa, Artificial Sequence
  Description of Artificial Sequence: Synthetic polypeptide
DEDEIRTTNPVAYEQWGSVSTDGMQRGGDGQ

SEQ ID NO: 72377 - protein, 29 aa, Artificial Sequence
  Description of Artificial Sequence: Synthetic peptide
AENEIACTNPVATEQYGEASDEPLQRGGR

SEQ ID NO: 72378 - protein, 30 aa, Artificial Sequence
  Description of Artificial Sequence: Synthetic polypeptide
AENEIACTNPVATEQYGEASDENLQRGEGR

SEQ ID NO: 72379 - protein, 30 aa, Artificial Sequence
  Description of Artificial Sequence: Synthetic polypeptide
AENEIACTNPVATEQYGEASCNLQDRGEGR

SEQ ID NO: 72380 - protein, 32 aa, Artificial Sequence
  Description of Artificial Sequence: Synthetic polypeptide
DEEAICTTNPMATETYGSVPTNDLQHRGQNEE

SEQ ID NO: 72381 - protein, 31 aa, Artificial Sequence
  Description of Artificial Sequence: Synthetic polypeptide
AENEIACTNPVATEQYGEASENLSQRGGGNR

SEQ ID NO: 72382 - protein, 31 aa, Artificial Sequence
  Description of Artificial Sequence: Synthetic polypeptide
DEDEIRTTNPVAYEQWGSVSTDGMDQRGDGH

SEQ ID NO: 72383 - protein, 32 aa, Artificial Sequence
  Description of Artificial Sequence: Synthetic polypeptide
DGEEIRTTNPVATEQWGSVTTTALLQRGTQEM

SEQ ID NO: 72384 - protein, 30 aa, Artificial Sequence
  Description of Artificial Sequence: Synthetic polypeptide
AENEIACTNPVATEQYGEASENLSQRGGKR

SEQ ID NO: 72385 - protein, 33 aa, Artificial Sequence
  Description of Artificial Sequence: Synthetic polypeptide
DQEEIRTTNPVATHQYGSVSTNGVTQEGGNHKM

SEQ ID NO: 72386 - protein, 33 aa, Artificial Sequence
  Description of Artificial Sequence: Synthetic polypeptide
DQEEIRTTNPVATHQYGSVSTNGVTQNGGINHS

SEQ ID NO: 72387 - protein, 30 aa, Artificial Sequence
  Description of Artificial Sequence: Synthetic polypeptide
AENEIACTNPVATEQYGEASATGLVQRGGR

SEQ ID NO: 72388 - protein, 30 aa, Artificial Sequence
  Description of Artificial Sequence: Synthetic polypeptide
AENEIACTNPVATEQYGEASENLSQRGGRH

SEQ ID NO: 72389 - protein, 30 aa, Artificial Sequence
  Description of Artificial Sequence: Synthetic polypeptide
DEEAICTVNPVATEAYGSVSNDNLESGNVE

SEQ ID NO: 72390 - protein, 31 aa, Artificial Sequence
  Description of Artificial Sequence: Synthetic polypeptide
DEEAICTVNPVATEAYGSVSTDNLEDNGNQD

SEQ ID NO: 72391 - protein, 34 aa, Artificial Sequence
  Description of Artificial Sequence: Synthetic polypeptide
DEEEIRTTNPVATEQYGSVSNTNDPQQVLEEMRS

SEQ ID NO: 72392 - protein, 34 aa, Artificial Sequence
  Description of Artificial Sequence: Synthetic polypeptide
DEEEIRTTNPVATEQYGSVSNTDNMTQIEQINQT

SEQ ID NO: 72393 - protein, 32 aa, Artificial Sequence
  Description of Artificial Sequence: Synthetic polypeptide
DEEAIRTTNPVATEIYGQVATTNGDHQIGDNR

SEQ ID NO: 72394 - protein, 33 aa, Artificial Sequence
  Description of Artificial Sequence: Synthetic polypeptide
DEEEIRTTNPVATEQYGSVSPSNLQSDMEVQEY

SEQ ID NO: 72395 - protein, 31 aa, Artificial Sequence
  Description of Artificial Sequence: Synthetic polypeptide
DEEAIRTTNPVATEQYGCVSTEHQHFGSDQG

SEQ ID NO: 72396 - protein, 31 aa, Artificial Sequence
  Description of Artificial Sequence: Synthetic polypeptide
DEEEIRTTNPVATEQYGSVSNNSNETMQEDE

SEQ ID NO: 72397 - protein, 30 aa, Artificial Sequence
  Description of Artificial Sequence: Synthetic polypeptide
DSEDIATTNPVATEQYGCVATNHQRESNSE

SEQ ID NO: 72398 - protein, 30 aa, Artificial Sequence
  Description of Artificial Sequence: Synthetic polypeptide
AENEIACTNPVATEQYGEANSEENLQRGGR

SEQ ID NO: 72399 - protein, 35 aa, Artificial Sequence
  Description of Artificial Sequence: Synthetic polypeptide
DEEEIRTTNPVATEQYGSVSNNNNLQNRLGEVLDI

SEQ ID NO: 72400 - protein, 30 aa, Artificial Sequence
  Description of Artificial Sequence: Synthetic polypeptide
AENEIACTNPVATEQYGEAMSENLQRGCGR

SEQ ID NO: 72401 - protein, 30 aa, Artificial Sequence
  Description of Artificial Sequence: Synthetic polypeptide
AENEIACTNPVATEQYGEAMLETNLQRGGR

SEQ ID NO: 72402 - protein, 29 aa, Artificial Sequence
  Description of Artificial Sequence: Synthetic peptide
AENEIACTNPVATEQYGEAMENLQRGGNA

SEQ ID NO: 72403 - protein, 30 aa, Artificial Sequence
  Description of Artificial Sequence: Synthetic polypeptide
AENEIACTNPVATEQYGEALSEVNLQRGGR

SEQ ID NO: 72404 - protein, 29 aa, Artificial Sequence
  Description of Artificial Sequence: Synthetic peptide
AENEIACTNPVATEQYGEALENLQRNGGR

SEQ ID NO: 72405 - protein, 30 aa, Artificial Sequence
  Description of Artificial Sequence: Synthetic polypeptide
AENEIACTNPVATEQYGEAKSEFNLQRGGR

SEQ ID NO: 72406 - protein, 34 aa, Artificial Sequence
  Description of Artificial Sequence: Synthetic polypeptide
DEEEIRTTNPVATEQYGSVSNNNEMDQNEGENIV

SEQ ID NO: 72407 - protein, 33 aa, Artificial Sequence
  Description of Artificial Sequence: Synthetic polypeptide
DSEEIASTNPVATEAYGSVVSCTNLQARTGGQR

SEQ ID NO: 72408 - protein, 31 aa, Artificial Sequence
  Description of Artificial Sequence: Synthetic polypeptide
DSEEIASTNPVAYEQYGSISCTNSSQRGGNN

SEQ ID NO: 72409 - protein, 31 aa, Artificial Sequence
  Description of Artificial Sequence: Synthetic polypeptide
DSEEIATTNPVATEAWGQSVCTNELGKGGNR

SEQ ID NO: 72410 - protein, 32 aa, Artificial Sequence
  Description of Artificial Sequence: Synthetic polypeptide
DEEAIRTTNPVATEQYGCVSTAECEQFGNNPK

SEQ ID NO: 72411 - protein, 32 aa, Artificial Sequence
  Description of Artificial Sequence: Synthetic polypeptide
DEEEIRTTNPVATEQYGSVSNNLSVVSVIMDI

SEQ ID NO: 72412 - protein, 29 aa, Artificial Sequence
  Description of Artificial Sequence: Synthetic peptide
DSEDIATTNPVATEQYGCVATNHQRDSED

SEQ ID NO: 72413 - protein, 28 aa, Artificial Sequence
  Description of Artificial Sequence: Synthetic peptide
DSEDIATTNPVATEQYGCVATNHQAPEL

SEQ ID NO: 72414 - protein, 33 aa, Artificial Sequence
  Description of Artificial Sequence: Synthetic polypeptide
DEEEIRTTNPVATEQYGSVSPTDIQIEMLNDNM

SEQ ID NO: 72415 - protein, 28 aa, Artificial Sequence
  Description of Artificial Sequence: Synthetic peptide
AENEIACTNPVATEQYGEAPENLQHGGR

SEQ ID NO: 72416 - protein, 33 aa, Artificial Sequence
  Description of Artificial Sequence: Synthetic polypeptide
DEEEIRTTNPVATEQYGSVSPTDIQISSMENNM

SEQ ID NO: 72417 - protein, 33 aa, Artificial Sequence
  Description of Artificial Sequence: Synthetic polypeptide
DEEAIRTTNPVATEQYGCVCSTELQNFGSQNQS

SEQ ID NO: 72418 - protein, 30 aa, Artificial Sequence
  Description of Artificial Sequence: Synthetic polypeptide
AENEIACTNPVATEQYGEASQENLQRGGYR

SEQ ID NO: 72419 - protein, 30 aa, Artificial Sequence
  Description of Artificial Sequence: Synthetic polypeptide
AENEIACTNPVATEQYGEASQENLQRKGGR

SEQ ID NO: 72420 - protein, 34 aa, Artificial Sequence
  Description of Artificial Sequence: Synthetic polypeptide
DEEAIRTTNPVATEQYGCVCSTGNDHQRFGSNQG

SEQ ID NO: 72421 - protein, 32 aa, Artificial Sequence
  Description of Artificial Sequence: Synthetic polypeptide
DEEAIRTTNPVATEQYGCVCSTGNHQNFGSEQ

SEQ ID NO: 72422 - protein, 33 aa, Artificial Sequence
  Description of Artificial Sequence: Synthetic polypeptide
DEEAIRTTNPVATEQYGCVCSTNHQHFGSENQG

SEQ ID NO: 72423 - protein, 30 aa, Artificial Sequence
  Description of Artificial Sequence: Synthetic polypeptide
AENEIACTNPVATEQYGEASSENLNQRGGR

SEQ ID NO: 72424 - protein, 29 aa, Artificial Sequence
  Description of Artificial Sequence: Synthetic peptide
AENEIACTNPVATEQYGEANSENLQRGGI

SEQ ID NO: 72425 - protein, 30 aa, Artificial Sequence
  Description of Artificial Sequence: Synthetic polypeptide
AENEIACTNPVATEQYGEASSENLQRGGPR

SEQ ID NO: 72426 - protein, 30 aa, Artificial Sequence
  Description of Artificial Sequence: Synthetic polypeptide
AENEIACTNPVATEQYGEANSENLQRGGAR

SEQ ID NO: 72427 - protein, 31 aa, Artificial Sequence
  Description of Artificial Sequence: Synthetic polypeptide
DEYEIRTTNPVATEQYGSVSSDLESFEENPQ

SEQ ID NO: 72428 - protein, 29 aa, Artificial Sequence
  Description of Artificial Sequence: Synthetic peptide
AENEIACTNPVATEQYGEANSENLQFGGR

SEQ ID NO: 72429 - protein, 29 aa, Artificial Sequence
  Description of Artificial Sequence: Synthetic peptide
DSEDIATTNPVATEQYGCVATNHQDLVNL

SEQ ID NO: 72430 - protein, 32 aa, Artificial Sequence
  Description of Artificial Sequence: Synthetic polypeptide
DEEEIRTTNPVATEQYGSVSNPNLEGMDEQVL

SEQ ID NO: 72431 - protein, 30 aa, Artificial Sequence
  Description of Artificial Sequence: Synthetic polypeptide
AENEIACTNPVATEQYGEAISENLQSRGGR

SEQ ID NO: 72432 - protein, 29 aa, Artificial Sequence
  Description of Artificial Sequence: Synthetic peptide
AENEIACTNPVATEQYGEAISENLQRGGS

SEQ ID NO: 72433 - protein, 31 aa, Artificial Sequence
  Description of Artificial Sequence: Synthetic polypeptide
AENEIACTNPVATEQYGEACSTDNLQREGGR

SEQ ID NO: 72434 - protein, 33 aa, Artificial Sequence
  Description of Artificial Sequence: Synthetic polypeptide
DEEEIRTTNPVATEQYGSVSPTDMENRGSTQEM

SEQ ID NO: 72435 - protein, 30 aa, Artificial Sequence
  Description of Artificial Sequence: Synthetic polypeptide
AENEIACTNPVATEQYGEACSFENLQRGGR

SEQ ID NO: 72436 - protein, 29 aa, Artificial Sequence
  Description of Artificial Sequence: Synthetic peptide
AENEIACTNPVATEQYGEACSENLQIGGR

SEQ ID NO: 72437 - protein, 29 aa, Artificial Sequence
  Description of Artificial Sequence: Synthetic peptide
AENEIACTNPVATEQYGEACSENLQFGGR

SEQ ID NO: 72438 - protein, 29 aa, Artificial Sequence
  Description of Artificial Sequence: Synthetic peptide
AENEIACTNPVATEQYGEACSENHQRGDR

SEQ ID NO: 72439 - protein, 30 aa, Artificial Sequence
  Description of Artificial Sequence: Synthetic polypeptide
AENEIACTNPVATEQYGEACSENALQRGGR

SEQ ID NO: 72440 - protein, 32 aa, Artificial Sequence
  Description of Artificial Sequence: Synthetic polypeptide
DEEEIRTTNPVATEQYGSVSPTDMYNRETQEI

SEQ ID NO: 72441 - protein, 28 aa, Artificial Sequence
  Description of Artificial Sequence: Synthetic peptide
AENEIACTNPVATEQYGEACENLQRVGR

SEQ ID NO: 72442 - protein, 35 aa, Artificial Sequence
  Description of Artificial Sequence: Synthetic polypeptide
DEEEIRTTNPVATEQYGSVSPTDNLEQQRIVDEEL

SEQ ID NO: 72443 - protein, 29 aa, Artificial Sequence
  Description of Artificial Sequence: Synthetic peptide
AENEIACTNPVATEQYGEACENLQRGGTR

SEQ ID NO: 72444 - protein, 33 aa, Artificial Sequence
  Description of Artificial Sequence: Synthetic polypeptide
DSEEIRCTNPVATEQYGCVCSTNLQERFGSQQA

SEQ ID NO: 72445 - protein, 30 aa, Artificial Sequence
  Description of Artificial Sequence: Synthetic polypeptide
AENEIACTNPVATEQYGEAASQENLQRGGR

SEQ ID NO: 72446 - protein, 35 aa, Artificial Sequence
  Description of Artificial Sequence: Synthetic polypeptide
DEEAIRTTNPVATEQYGSVSTENDLQAEVSMDNRF

SEQ ID NO: 72447 - protein, 34 aa, Artificial Sequence
  Description of Artificial Sequence: Synthetic polypeptide
DEEAIRTTNPVATEQYGSVSTNDLTQAVVMDERI

SEQ ID NO: 72448 - protein, 31 aa, Artificial Sequence
  Description of Artificial Sequence: Synthetic polypeptide
DSEEICTTNPVAYEPYGSVINTNLSQQVTNR

SEQ ID NO: 72449 - protein, 30 aa, Artificial Sequence
  Description of Artificial Sequence: Synthetic polypeptide
AENEIACTNPVATEQYGEAISENLQRNGGR

SEQ ID NO: 72450 - protein, 29 aa, Artificial Sequence
  Description of Artificial Sequence: Synthetic peptide
AENEIACTNPVATEQYGEAESENLQEGGR

SEQ ID NO: 72451 - protein, 29 aa, Artificial Sequence
  Description of Artificial Sequence: Synthetic peptide
AENEIACTNPVATEQYGEAFENLQRGKGR

SEQ ID NO: 72452 - protein, 29 aa, Artificial Sequence
  Description of Artificial Sequence: Synthetic peptide
AENEIACTNPVATEQYGEAIENLQRGGRP

SEQ ID NO: 72453 - protein, 29 aa, Artificial Sequence
  Description of Artificial Sequence: Synthetic peptide
AENEIACTNPVATEQYGEAHSENMQRGGR

SEQ ID NO: 72454 - protein, 30 aa, Artificial Sequence
  Description of Artificial Sequence: Synthetic polypeptide
AENEIACTNPVATEQYGEAHSENLQDRGGR

SEQ ID NO: 72455 - protein, 29 aa, Artificial Sequence
  Description of Artificial Sequence: Synthetic peptide
AENEIACTNPVATEQYGEAHENLQRGSGR

SEQ ID NO: 72456 - protein, 29 aa, Artificial Sequence
  Description of Artificial Sequence: Synthetic peptide
AENEIACTNPVATEQYGEAHENLHQRGGR

SEQ ID NO: 72457 - protein, 30 aa, Artificial Sequence
  Description of Artificial Sequence: Synthetic polypeptide
AENEIACTNPVATEQYGEAGSENLQRGGPR

SEQ ID NO: 72458 - protein, 29 aa, Artificial Sequence
  Description of Artificial Sequence: Synthetic peptide
AENEIACTNPVATEQYGEAGSENLQHGGR

SEQ ID NO: 72459 - protein, 28 aa, Artificial Sequence
  Description of Artificial Sequence: Synthetic peptide
AENEIACTNPVATEQYGEASSNPQRGQQ

SEQ ID NO: 72460 - protein, 30 aa, Artificial Sequence
  Description of Artificial Sequence: Synthetic polypeptide
AENEIACTNPVATEQYGEAGSEKNLQRGGR

SEQ ID NO: 72461 - protein, 31 aa, Artificial Sequence
  Description of Artificial Sequence: Synthetic polypeptide
DSEEIATTNPVAYTQYGSVSCTNPSDRGGNM

SEQ ID NO: 72462 - protein, 32 aa, Artificial Sequence
  Description of Artificial Sequence: Synthetic polypeptide
DSEEIATTNPVAYTQYGSVSCTNPSMRGGNRY

SEQ ID NO: 72463 - protein, 31 aa, Artificial Sequence
  Description of Artificial Sequence: Synthetic polypeptide
DSEEIATTNPVAYTQYGSVSCTNPSNLGGNR

SEQ ID NO: 72464 - protein, 29 aa, Artificial Sequence
  Description of Artificial Sequence: Synthetic peptide
AENEIACTNPVATEQYGEAFSENLSRGGR

SEQ ID NO: 72465 - protein, 31 aa, Artificial Sequence
  Description of Artificial Sequence: Synthetic polypeptide
AENEIACTNPVATEQYGEASSTENLQRGGPR

SEQ ID NO: 72466 - protein, 32 aa, Artificial Sequence
  Description of Artificial Sequence: Synthetic polypeptide
DEEAIRTTNPVATEQYGSVCSTEDQNFGSEQL

SEQ ID NO: 72467 - protein, 32 aa, Artificial Sequence
  Description of Artificial Sequence: Synthetic polypeptide
AENEIACTNPVATEQYGEASSTENLQRNGMNR

SEQ ID NO: 72468 - protein, 29 aa, Artificial Sequence
  Description of Artificial Sequence: Synthetic peptide
AENEIACTNPVATEQYGEASEGLQREGGR

SEQ ID NO: 72469 - protein, 31 aa, Artificial Sequence
  Description of Artificial Sequence: Synthetic polypeptide
DEEEIRTTNPVATEQYGSVSNPNTIPNMVEE

SEQ ID NO: 72470 - protein, 30 aa, Artificial Sequence
  Description of Artificial Sequence: Synthetic polypeptide
AENEIACTNPVATEQYGEASPENLQRGGRD

SEQ ID NO: 72471 - protein, 32 aa, Artificial Sequence
  Description of Artificial Sequence: Synthetic polypeptide
DEEEIRTTNPVATEQYGSVSPSYLHGNGMEQE

SEQ ID NO: 72472 - protein, 30 aa, Artificial Sequence
  Description of Artificial Sequence: Synthetic polypeptide
AENEIACTNPVATEQYGEASGENLQRGGIR

SEQ ID NO: 72473 - protein, 29 aa, Artificial Sequence
  Description of Artificial Sequence: Synthetic peptide
AENEIACTNPVATEQYGEASGNLQGGGAR

SEQ ID NO: 72474 - protein, 34 aa, Artificial Sequence
  Description of Artificial Sequence: Synthetic polypeptide
DEEEIRTTNPVATEQYGSVSNTDNDTNEMGSNIG

SEQ ID NO: 72475 - protein, 33 aa, Artificial Sequence
  Description of Artificial Sequence: Synthetic polypeptide
DEEEIRTTNPVATEQYGSVSNTDNDNENEGEGI

SEQ ID NO: 72476 - protein, 32 aa, Artificial Sequence
  Description of Artificial Sequence: Synthetic polypeptide
DEEAIRTTNPVATEQWGCVCGTNNLQHFGSVR

SEQ ID NO: 72477 - protein, 33 aa, Artificial Sequence
  Description of Artificial Sequence: Synthetic polypeptide
DEEEIRTTNPVATEQYGSVSPTAILMDTIMNQQ

SEQ ID NO: 72478 - protein, 29 aa, Artificial Sequence
  Description of Artificial Sequence: Synthetic peptide
AENEIACTNPVATEQYGEAQSENLQRGGD

SEQ ID NO: 72479 - protein, 29 aa, Artificial Sequence
  Description of Artificial Sequence: Synthetic peptide
AENEIACTNPVATEQYGEAQENVLQRGGR

SEQ ID NO: 72480 - protein, 33 aa, Artificial Sequence
  Description of Artificial Sequence: Synthetic polypeptide
DEEEIRTTNPVATEQYGSVSPTALITRTQVFDT

SEQ ID NO: 72481 - protein, 32 aa, Artificial Sequence
  Description of Artificial Sequence: Synthetic polypeptide
DSAEIRTTNPVATEQWGSTVPSCTLLQSGGTR

SEQ ID NO: 72482 - protein, 28 aa, Artificial Sequence
  Description of Artificial Sequence: Synthetic peptide
AENEIACTNPVATEQYGEAQEKLQRGGR

SEQ ID NO: 72483 - protein, 35 aa, Artificial Sequence
  Description of Artificial Sequence: Synthetic polypeptide
DEEEIRTTNPVATEQYGSVSNTDGQDVRFGGNNNS

SEQ ID NO: 72484 - protein, 30 aa, Artificial Sequence
  Description of Artificial Sequence: Synthetic polypeptide
AENEIACTNPVATEQYGEASHENLQRGGLR

SEQ ID NO: 72485 - protein, 34 aa, Artificial Sequence
  Description of Artificial Sequence: Synthetic polypeptide
DEEEIRTTNPVATEQYGSVSNTDEQGQGNEGNTG

SEQ ID NO: 72486 - protein, 34 aa, Artificial Sequence
  Description of Artificial Sequence: Synthetic polypeptide
DEEEIRTTNPVATEQYGSVSNTDNMDQEGQTTEQ

SEQ ID NO: 72487 - protein, 30 aa, Artificial Sequence
  Description of Artificial Sequence: Synthetic polypeptide
AENEIACTNPVATEQYGEAPSENLQRMGGR

SEQ ID NO: 72488 - protein, 35 aa, Artificial Sequence
  Description of Artificial Sequence: Synthetic polypeptide
DEEEIRTTNPVATEQYGSVSNTDNMDQIGGGTTND

SEQ ID NO: 72489 - protein, 35 aa, Artificial Sequence
  Description of Artificial Sequence: Synthetic polypeptide
DEEEIRTTNPVATEQYGSVSNTDNMGQTNEGENNG

SEQ ID NO: 72490 - protein, 33 aa, Artificial Sequence
  Description of Artificial Sequence: Synthetic polypeptide
DQSEIRTTNPVAYEQYGSVNTGNLSQPVTVGNR

SEQ ID NO: 72491 - protein, 30 aa, Artificial Sequence
  Description of Artificial Sequence: Synthetic polypeptide
DEYVIATTNPVATEQVGSVSSDFDQIGENR

SEQ ID NO: 72492 - protein, 32 aa, Artificial Sequence
  Description of Artificial Sequence: Synthetic polypeptide
DEEAIRTTNPVATEQFYDYCVSEALQRGDNFE

SEQ ID NO: 72493 - protein, 31 aa, Artificial Sequence
  Description of Artificial Sequence: Synthetic polypeptide
DEEAIRTTNPVATEQWGCVATNNLQLDVNQQ

SEQ ID NO: 72494 - protein, 34 aa, Artificial Sequence
  Description of Artificial Sequence: Synthetic polypeptide
DEEEIRTTNPVATEQYGSVSNTDNMNIIQGNDDD

SEQ ID NO: 72495 - protein, 32 aa, Artificial Sequence
  Description of Artificial Sequence: Synthetic polypeptide
DEEAIRTTNPVATEQWGCVCATGNLQGGSNQA

SEQ ID NO: 72496 - protein, 34 aa, Artificial Sequence
  Description of Artificial Sequence: Synthetic polypeptide
DQSEIRTTNPVAYEQYGSVVSLTGNLSQEGVTNR

SEQ ID NO: 72497 - protein, 33 aa, Artificial Sequence
  Description of Artificial Sequence: Synthetic polypeptide
DQSEIRTTNPVAYEQYGSVVSTGNLSQPGVTNP

SEQ ID NO: 72498 - protein, 29 aa, Artificial Sequence
  Description of Artificial Sequence: Synthetic peptide
AENEIACTNPVATEQYGEASEWNLQNGGR

SEQ ID NO: 72499 - protein, 34 aa, Artificial Sequence
  Description of Artificial Sequence: Synthetic polypeptide
DEEEIRTTNPVATEQYGSVSNTDNMNIIGGNEDG

SEQ ID NO: 72500 - protein, 34 aa, Artificial Sequence
  Description of Artificial Sequence: Synthetic polypeptide
DEEEIRTTNPVATEQYGSVSNTDNMNIIGGNDQI

SEQ ID NO: 72501 - protein, 29 aa, Artificial Sequence
  Description of Artificial Sequence: Synthetic peptide
AENEIACTNPVATEQYGEASFENKQRGGR

SEQ ID NO: 72502 - protein, 34 aa, Artificial Sequence
  Description of Artificial Sequence: Synthetic polypeptide
DQSEIRTTNPVAYEQYGSVVSTGNLSQPVVGNRA

SEQ ID NO: 72503 - protein, 33 aa, Artificial Sequence
  Description of Artificial Sequence: Synthetic polypeptide
DEEEIRTTNPVATEQYGSVSPSPTNQMLLMEVD

SEQ ID NO: 72504 - protein, 32 aa, Artificial Sequence
  Description of Artificial Sequence: Synthetic polypeptide
DEEAIRTTNPVATEQWGCVCGTNEHQHFGSNR

SEQ ID NO: 72505 - protein, 30 aa, Artificial Sequence
  Description of Artificial Sequence: Synthetic polypeptide
AENEIACTNPVATEQYGEASFENLQRHGGR

SEQ ID NO: 72506 - protein, 31 aa, Artificial Sequence
  Description of Artificial Sequence: Synthetic polypeptide
DSDEIRTTNPVATEQYGWTSTLNLQEGGDSV

SEQ ID NO: 72507 - protein, 33 aa, Artificial Sequence
  Description of Artificial Sequence: Synthetic polypeptide
DEEEIRTTNPVATEQYGSVSNTDAPQNTGSQQY

SEQ ID NO: 72508 - protein, 34 aa, Artificial Sequence
  Description of Artificial Sequence: Synthetic polypeptide
DEEEIRTTNPVATEQYGSVSNTANNEEGIENNEI

SEQ ID NO: 72509 - protein, 34 aa, Artificial Sequence
  Description of Artificial Sequence: Synthetic polypeptide
DEEEIRTTNPVATEQYGSVSPTASLVQQMNVNVE

SEQ ID NO: 72510 - protein, 29 aa, Artificial Sequence
  Description of Artificial Sequence: Synthetic peptide
AENEIACTNPVATEQYGEASIENLQRGGQ

SEQ ID NO: 72511 - protein, 30 aa, Artificial Sequence
  Description of Artificial Sequence: Synthetic polypeptide
AENEIACTNPVATEQYGEASLELNLQRGGR

SEQ ID NO: 72512 - protein, 31 aa, Artificial Sequence
  Description of Artificial Sequence: Synthetic polypeptide
AENEIACTNPVATEQYGEASMENLQQRNGNR

SEQ ID NO: 72513 - protein, 33 aa, Artificial Sequence
  Description of Artificial Sequence: Synthetic polypeptide
DEEEIRTTNPVATEQYGSVSPTDAMANRETNEI

SEQ ID NO: 72514 - protein, 34 aa, Artificial Sequence
  Description of Artificial Sequence: Synthetic polypeptide
DEEEIRTTNPVATEQYGSVSNQNPQQIEQGNGEE

SEQ ID NO: 72515 - protein, 34 aa, Artificial Sequence
  Description of Artificial Sequence: Synthetic polypeptide
DEEEIRTTNPVATEQYGSVSNQNPGQINGGGNDE

SEQ ID NO: 72516 - protein, 30 aa, Artificial Sequence
  Description of Artificial Sequence: Synthetic polypeptide
AENEIACTNPVATEQYGEASNENLQRGGYR

SEQ ID NO: 72517 - protein, 33 aa, Artificial Sequence
  Description of Artificial Sequence: Synthetic polypeptide
DEEEIRTTNPVATEQYGSVSNPTNQEVQVLEAA

SEQ ID NO: 72518 - protein, 33 aa, Artificial Sequence
  Description of Artificial Sequence: Synthetic polypeptide
DEEEIRTTNPVATEQYGSVSNPTNQEVMGLEEA

SEQ ID NO: 72519 - protein, 33 aa, Artificial Sequence
  Description of Artificial Sequence: Synthetic polypeptide
DEEEIRTTNPVATEQYGSVSNPTNQEVANLEQA

SEQ ID NO: 72520 - protein, 36 aa, Artificial Sequence
  Description of Artificial Sequence: Synthetic polypeptide
DEEEIRTTNPVATEQYGSVSNPTGGNLQSEFGNGGI

SEQ ID NO: 72521 - protein, 31 aa, Artificial Sequence
  Description of Artificial Sequence: Synthetic polypeptide
DEEEIRTTNPVATEQYGSVSNPSTINMVEQE

SEQ ID NO: 72522 - protein, 28 aa, Artificial Sequence
  Description of Artificial Sequence: Synthetic peptide
AENEIACTNPVATEQYGEASNTIQRGGR

SEQ ID NO: 72523 - protein, 34 aa, Artificial Sequence
  Description of Artificial Sequence: Synthetic polypeptide
DEEEIRTTNPVATEQYGSVSNPPNQNQERGFEEM

SEQ ID NO: 72524 - protein, 33 aa, Artificial Sequence
  Description of Artificial Sequence: Synthetic polypeptide
DSCEIRTTNPVAYEPYGQSVISTNLSQRVTNRP

SEQ ID NO: 72525 - protein, 32 aa, Artificial Sequence
  Description of Artificial Sequence: Synthetic polypeptide
DEEAIRTTNPVATEQWGSVCGTNELQHFGSEQ

SEQ ID NO: 72526 - protein, 36 aa, Artificial Sequence
  Description of Artificial Sequence: Synthetic polypeptide
DEEEIRTTNPVATEQYGSVSPTANQGQMRVGGNEIL

SEQ ID NO: 72527 - protein, 31 aa, Artificial Sequence
  Description of Artificial Sequence: Synthetic polypeptide
DSAEIRTTNPVAYEQYGSIPSTNLSERTVDR

SEQ ID NO: 72528 - protein, 32 aa, Artificial Sequence
  Description of Artificial Sequence: Synthetic polypeptide
DEEAIRTTNPVATEQWGSVGTNNLQHFGSDQS

SEQ ID NO: 72529 - protein, 30 aa, Artificial Sequence
  Description of Artificial Sequence: Synthetic polypeptide
AENEIACTNPVATEQYGEAPSENLQRGGTR

SEQ ID NO: 72530 - protein, 29 aa, Artificial Sequence
  Description of Artificial Sequence: Synthetic peptide
AENEIACTNPVATEQYGEAPSENLPRGGR

SEQ ID NO: 72531 - protein, 31 aa, Artificial Sequence
  Description of Artificial Sequence: Synthetic polypeptide
DEDEIRTTNPVAYEQWGSVSENQQHGGAENA

SEQ ID NO: 72532 - protein, 33 aa, Artificial Sequence
  Description of Artificial Sequence: Synthetic polypeptide
DEEEIRTTNPVATEQYGSVSPTANAQNVAEIDI

SEQ ID NO: 72533 - protein, 35 aa, Artificial Sequence
  Description of Artificial Sequence: Synthetic polypeptide
DEEEIRTTNPVATEQYGSVSNSSNGVEQVGPINRV

SEQ ID NO: 72534 - protein, 33 aa, Artificial Sequence
  Description of Artificial Sequence: Synthetic polypeptide
DSAEIRTTNPVATEQYGSVVSTNMLSQTGTMYT

SEQ ID NO: 72535 - protein, 34 aa, Artificial Sequence
  Description of Artificial Sequence: Synthetic polypeptide
DEEEIRTTNPVATEQYGSVSNSNNLQRVQEDFGI

SEQ ID NO: 72536 - protein, 34 aa, Artificial Sequence
  Description of Artificial Sequence: Synthetic polypeptide
DEYEIRTTNPVATEQYGSVSWTYNDLEQNSEDNI

SEQ ID NO: 72537 - protein, 32 aa, Artificial Sequence
  Description of Artificial Sequence: Synthetic polypeptide
DEEAIRTTNPVATEQYDYCVTSIVELQRGDNE

SEQ ID NO: 72538 - protein, 34 aa, Artificial Sequence
  Description of Artificial Sequence: Synthetic polypeptide
DEEAIRTTNPVATEQYGAQFIYSTNLQAGETSNR

SEQ ID NO: 72539 - protein, 30 aa, Artificial Sequence
  Description of Artificial Sequence: Synthetic polypeptide
DSAEIRTTNPVAYEQWGCCPSTVLQHGGNR

SEQ ID NO: 72540 - protein, 33 aa, Artificial Sequence
  Description of Artificial Sequence: Synthetic polypeptide
DEYEIRTTNPVATEQYGSVSVVELQRTSQNDDQ

SEQ ID NO: 72541 - protein, 30 aa, Artificial Sequence
  Description of Artificial Sequence: Synthetic polypeptide
DSAEIRTTNPVAYEQYGCCSTVEQSQHGNR

SEQ ID NO: 72542 - protein, 34 aa, Artificial Sequence
  Description of Artificial Sequence: Synthetic polypeptide
DEEEIRTTNPVATEQYGSVSNSNLQMVNGMVLMD

SEQ ID NO: 72543 - protein, 33 aa, Artificial Sequence
  Description of Artificial Sequence: Synthetic polypeptide
DEEEIRTTNPVATEQYGSVSNSNGNAFQTASIR

SEQ ID NO: 72544 - protein, 32 aa, Artificial Sequence
  Description of Artificial Sequence: Synthetic polypeptide
DEEAIRTTNPVATEQYGSVSVLQLQDMTRNSG

SEQ ID NO: 72545 - protein, 29 aa, Artificial Sequence
  Description of Artificial Sequence: Synthetic peptide
AENEIACTNPVATEQYGEASEHLDQRGGR

SEQ ID NO: 72546 - protein, 29 aa, Artificial Sequence
  Description of Artificial Sequence: Synthetic peptide
AENEIACTNPVATEQYGEASEILQRGGDR

SEQ ID NO: 72547 - protein, 28 aa, Artificial Sequence
  Description of Artificial Sequence: Synthetic peptide
AENEIACTNPVATEQYGEASENLQRFGT

SEQ ID NO: 72548 - protein, 28 aa, Artificial Sequence
  Description of Artificial Sequence: Synthetic peptide
AENEIACTNPVATEQYGEASENLQRFGL

SEQ ID NO: 72549 - protein, 28 aa, Artificial Sequence
  Description of Artificial Sequence: Synthetic peptide
AENEIACTNPVATEQYGEASENLQREGL

SEQ ID NO: 72550 - protein, 33 aa, Artificial Sequence
  Description of Artificial Sequence: Synthetic polypeptide
DEDEIRTTNPVAYEQYGQSVSCQNELDQNGGSR

SEQ ID NO: 72551 - protein, 32 aa, Artificial Sequence
  Description of Artificial Sequence: Synthetic polypeptide
DNEEISTTNPVATTQYGSVSVNPEVVRVGNRG

SEQ ID NO: 72552 - protein, 33 aa, Artificial Sequence
  Description of Artificial Sequence: Synthetic polypeptide
DEEEIRTTNPVATEQYGSVSPDNLSESQSEVEP

SEQ ID NO: 72553 - protein, 33 aa, Artificial Sequence
  Description of Artificial Sequence: Synthetic polypeptide
DEDEIRTTNPVAYEQYGEVTSCTNLQRTGGDSI

SEQ ID NO: 72554 - protein, 32 aa, Artificial Sequence
  Description of Artificial Sequence: Synthetic polypeptide
DNEEISTTNPVATWQYGSVSLTVNNVRTGNVN

SEQ ID NO: 72555 - protein, 30 aa, Artificial Sequence
  Description of Artificial Sequence: Synthetic polypeptide
AENEIACTNPVATEQYGEASENLQREGEGR

SEQ ID NO: 72556 - protein, 32 aa, Artificial Sequence
  Description of Artificial Sequence: Synthetic polypeptide
DEEEIRTTNPVATEQYGSVSPDNLENIVELIM

SEQ ID NO: 72557 - protein, 30 aa, Artificial Sequence
  Description of Artificial Sequence: Synthetic polypeptide
DEDEIRTTNPVAYEQYGTVATGNDQGANTT

SEQ ID NO: 72558 - protein, 32 aa, Artificial Sequence
  Description of Artificial Sequence: Synthetic polypeptide
DEEEIRTTNPVATEQYGSVSPMPNHELMQNDI

SEQ ID NO: 72559 - protein, 34 aa, Artificial Sequence
  Description of Artificial Sequence: Synthetic polypeptide
DEDEIRTTNPVAYEQWGSVSTTNGLQGNAGENAR

SEQ ID NO: 72560 - protein, 33 aa, Artificial Sequence
  Description of Artificial Sequence: Synthetic polypeptide
DEDEIRTTNPVAYEQWGSVSTTNGDQQDNGNER

SEQ ID NO: 72561 - protein, 33 aa, Artificial Sequence
  Description of Artificial Sequence: Synthetic polypeptide
DEEEIRTTNPVATEQYGSVSPMPLQSDGVEELQ

SEQ ID NO: 72562 - protein, 32 aa, Artificial Sequence
  Description of Artificial Sequence: Synthetic polypeptide
DEDEIRTTNPVAYEQYGETSCTNLSQRGGDTS

SEQ ID NO: 72563 - protein, 29 aa, Artificial Sequence
  Description of Artificial Sequence: Synthetic peptide
AENEIACTNPVATEQYGEASENLQRGCGF

SEQ ID NO: 72564 - protein, 34 aa, Artificial Sequence
  Description of Artificial Sequence: Synthetic polypeptide
DEDEIRTTNPVAYEQWGSVSTTNLQGDITGGNNR

SEQ ID NO: 72565 - protein, 32 aa, Artificial Sequence
  Description of Artificial Sequence: Synthetic polypeptide
DNEEIRTTNPVATEQYGSVSTNNDNQMVQEPQ

SEQ ID NO: 72566 - protein, 30 aa, Artificial Sequence
  Description of Artificial Sequence: Synthetic polypeptide
DEDEIRTTNPVAYEQWGSVTTNLQGDSQGK

SEQ ID NO: 72567 - protein, 31 aa, Artificial Sequence
  Description of Artificial Sequence: Synthetic polypeptide
DEDEIRTTNPVAYEQWGSVTTGGNMGEGNSR

SEQ ID NO: 72568 - protein, 33 aa, Artificial Sequence
  Description of Artificial Sequence: Synthetic polypeptide
DNEEIRTTNPVATEQYGSVSVTASLDRGEEDHD

SEQ ID NO: 72569 - protein, 31 aa, Artificial Sequence
  Description of Artificial Sequence: Synthetic polypeptide
DLEEISTTNPVATTQYGSVSTPNQVMRDGTV

SEQ ID NO: 72570 - protein, 34 aa, Artificial Sequence
  Description of Artificial Sequence: Synthetic polypeptide
DEEEIRTTNPVATEQYGSVSPEMNELTTRGVEMN

SEQ ID NO: 72571 - protein, 32 aa, Artificial Sequence
  Description of Artificial Sequence: Synthetic polypeptide
DNEEIRYTNPVATEQYGCVVSTNNLENFGTQR

SEQ ID NO: 72572 - protein, 30 aa, Artificial Sequence
  Description of Artificial Sequence: Synthetic polypeptide
AENEIACTNPVATEQYGEASENLQRGGGRS

SEQ ID NO: 72573 - protein, 29 aa, Artificial Sequence
  Description of Artificial Sequence: Synthetic peptide
AENEIACTNPVATEQYGEASENLQRGGFE

SEQ ID NO: 72574 - protein, 33 aa, Artificial Sequence
  Description of Artificial Sequence: Synthetic polypeptide
DEEEIRTTNPVATEQYGSVSPEGDPQQSGNQEE

SEQ ID NO: 72575 - protein, 33 aa, Artificial Sequence
  Description of Artificial Sequence: Synthetic polypeptide
DEDEIRTTNPVAYEQWGSVSTVNQGQQDNGNVR

SEQ ID NO: 72576 - protein, 30 aa, Artificial Sequence
  Description of Artificial Sequence: Synthetic polypeptide
DEDEIRTTNPVAYEQWGSVSTVLQGDSQQG

SEQ ID NO: 72577 - protein, 32 aa, Artificial Sequence
  Description of Artificial Sequence: Synthetic polypeptide
DEEEIRTTNPVATEQYGSVSPEEMVHQRLESQ

SEQ ID NO: 72578 - protein, 30 aa, Artificial Sequence
  Description of Artificial Sequence: Synthetic polypeptide
AENEIACTNPVATEQYGEASENLQRGFGRV

SEQ ID NO: 72579 - protein, 34 aa, Artificial Sequence
  Description of Artificial Sequence: Synthetic polypeptide
DEDEIRTTNPVAYEQWGSVSTTNLQQDGPNEGRE

SEQ ID NO: 72580 - protein, 32 aa, Artificial Sequence
  Description of Artificial Sequence: Synthetic polypeptide
DEDEIRTTNPVAYEQWGSVSTTNGDGVQGENR

SEQ ID NO: 72581 - protein, 31 aa, Artificial Sequence
  Description of Artificial Sequence: Synthetic polypeptide
DEDEIRTTNPVAYEQWGSVSTTNGDGNGEDR

SEQ ID NO: 72582 - protein, 32 aa, Artificial Sequence
  Description of Artificial Sequence: Synthetic polypeptide
DEDEIRTTNPVAYEQWGSVSTTNGDGNDGNNR

SEQ ID NO: 72583 - protein, 34 aa, Artificial Sequence
  Description of Artificial Sequence: Synthetic polypeptide
DEEEIRTTNPVATEQYGSVSPMVNLTVRGLVEQE

SEQ ID NO: 72584 - protein, 30 aa, Artificial Sequence
  Description of Artificial Sequence: Synthetic polypeptide
AENEIACTNPVATEQYGEASENLQNRAGGR

SEQ ID NO: 72585 - protein, 32 aa, Artificial Sequence
  Description of Artificial Sequence: Synthetic polypeptide
DEDEIRTTNPVAYEQWGSVSTTNDGNEGNNRR

SEQ ID NO: 72586 - protein, 29 aa, Artificial Sequence
  Description of Artificial Sequence: Synthetic peptide
AENEIACTNPVATEQYGEASENLQNKGGR

SEQ ID NO: 72587 - protein, 30 aa, Artificial Sequence
  Description of Artificial Sequence: Synthetic polypeptide
DQAEICTTNPVATEQYGSFSTHMEQRGEDN

SEQ ID NO: 72588 - protein, 31 aa, Artificial Sequence
  Description of Artificial Sequence: Synthetic polypeptide
DQAEIRTTNPVATEGYGCCSVTALQHGNIRV

SEQ ID NO: 72589 - protein, 31 aa, Artificial Sequence
  Description of Artificial Sequence: Synthetic polypeptide
DQAEIRTTNPVATEGYGCCSWTVLQHGNNDR

SEQ ID NO: 72590 - protein, 31 aa, Artificial Sequence
  Description of Artificial Sequence: Synthetic polypeptide
DQAEIRTTNPVATEGYGLCCSTVLQTHGNDR

SEQ ID NO: 72591 - protein, 33 aa, Artificial Sequence
  Description of Artificial Sequence: Synthetic polypeptide
DEDEIRTTNPVAYEQWGSVSTTNAIQGGGNANR

SEQ ID NO: 72592 - protein, 29 aa, Artificial Sequence
  Description of Artificial Sequence: Synthetic peptide
AENEIACTNPVATEQYGEASENLQNGGLR

SEQ ID NO: 72593 - protein, 30 aa, Artificial Sequence
  Description of Artificial Sequence: Synthetic polypeptide
AENEIACTNPVATEQYGEASENLQMRGGPR

SEQ ID NO: 72594 - protein, 31 aa, Artificial Sequence
  Description of Artificial Sequence: Synthetic polypeptide
DQAEIRTTNPVATEQYGCCCSTELQHSGSNV

SEQ ID NO: 72595 - protein, 29 aa, Artificial Sequence
  Description of Artificial Sequence: Synthetic peptide
AENEIACTNPVATEQYGEASENLQLRGGF

SEQ ID NO: 72596 - protein, 34 aa, Artificial Sequence
  Description of Artificial Sequence: Synthetic polypeptide
DEEEIRTTNPVATEQYGSVSPANELDGLRGQDED

SEQ ID NO: 72597 - protein, 28 aa, Artificial Sequence
  Description of Artificial Sequence: Synthetic peptide
AENEIACTNPVATEQYGEASENLQLQGR

SEQ ID NO: 72598 - protein, 33 aa, Artificial Sequence
  Description of Artificial Sequence: Synthetic polypeptide
DEEEIRTTNPVATEQYGSVSPNGNDELEQVSEE

SEQ ID NO: 72599 - protein, 31 aa, Artificial Sequence
  Description of Artificial Sequence: Synthetic polypeptide
DEDEIRTTNPVAYEQYGTVSTTNDQGANETT

SEQ ID NO: 72600 - protein, 29 aa, Artificial Sequence
  Description of Artificial Sequence: Synthetic peptide
AENEIACTNPVATEQYGEASENLQRGGPM

SEQ ID NO: 72601 - protein, 29 aa, Artificial Sequence
  Description of Artificial Sequence: Synthetic peptide
AENEIACTNPVATEQYGEASENLQPGGQR

SEQ ID NO: 72602 - protein, 32 aa, Artificial Sequence
  Description of Artificial Sequence: Synthetic polypeptide
DEDEIRTTNPVAYEQWGSVSTTNDGNQGNNDR

SEQ ID NO: 72603 - protein, 30 aa, Artificial Sequence
  Description of Artificial Sequence: Synthetic polypeptide
AENEIACTNPVATEQYGEASENLQRAGGRQ

SEQ ID NO: 72604 - protein, 30 aa, Artificial Sequence
  Description of Artificial Sequence: Synthetic polypeptide
AENEIACTNPVATEQYGEASENLQQRNGGR

SEQ ID NO: 72605 - protein, 30 aa, Artificial Sequence
  Description of Artificial Sequence: Synthetic polypeptide
AENEIACTNPVATEQYGEASENLQQRGGRE

SEQ ID NO: 72606 - protein, 32 aa, Artificial Sequence
  Description of Artificial Sequence: Synthetic polypeptide
DEDEIRTTNPVAYEQWGSVSTTNGDGFQGDNR

SEQ ID NO: 72607 - protein, 29 aa, Artificial Sequence
  Description of Artificial Sequence: Synthetic peptide
AENEIACTNPVATEQYGEASENLQQRGGH

SEQ ID NO: 72608 - protein, 28 aa, Artificial Sequence
  Description of Artificial Sequence: Synthetic peptide
AENEIACTNPVATEQYGEASENLQRWGT

SEQ ID NO: 72609 - protein, 35 aa, Artificial Sequence
  Description of Artificial Sequence: Synthetic polypeptide
DEEEIRTTNPVATEQYGSVSPNANNLEQRGVSQLQ

SEQ ID NO: 72610 - protein, 29 aa, Artificial Sequence
  Description of Artificial Sequence: Synthetic peptide
AENEIACTNPVATEQYGEASENLQQQGGR

SEQ ID NO: 72611 - protein, 32 aa, Artificial Sequence
  Description of Artificial Sequence: Synthetic polypeptide
DEEEIRTTNPVATEQYGSVSPAVGLEMTNVVG

SEQ ID NO: 72612 - protein, 31 aa, Artificial Sequence
  Description of Artificial Sequence: Synthetic polypeptide
DEDEIRTTNPVAYEQYGTVSTNNDGQGQNTT

SEQ ID NO: 72613 - protein, 28 aa, Artificial Sequence
  Description of Artificial Sequence: Synthetic peptide
AENEIACTNPVATEQYGEASENLQQNGR

SEQ ID NO: 72614 - protein, 32 aa, Artificial Sequence
  Description of Artificial Sequence: Synthetic polypeptide
DEEEIRTTNPVATEQYGSVSPNANQELEQVEE

SEQ ID NO: 72615 - protein, 31 aa, Artificial Sequence
  Description of Artificial Sequence: Synthetic polypeptide
DEDEIRTTNPVAYEQWGSVSTTNGDGFNESR

SEQ ID NO: 72616 - protein, 31 aa, Artificial Sequence
  Description of Artificial Sequence: Synthetic polypeptide
DEDEIRTTNPVAYEQYGTVSTSLGGEQGNDS

SEQ ID NO: 72617 - protein, 28 aa, Artificial Sequence
  Description of Artificial Sequence: Synthetic peptide
DQAEIACTNPVATEQWGCCSTALQHGNQ

SEQ ID NO: 72618 - protein, 33 aa, Artificial Sequence
  Description of Artificial Sequence: Synthetic polypeptide
DEEEIRTTNPVATEQYGSVSPAQNLQVPIMQLT

SEQ ID NO: 72619 - protein, 33 aa, Artificial Sequence
  Description of Artificial Sequence: Synthetic polypeptide
DEDEIRTTNPVAYEQWGSVTTNLQQGNAGENAR

SEQ ID NO: 72620 - protein, 34 aa, Artificial Sequence
  Description of Artificial Sequence: Synthetic polypeptide
DEEEIRTTNPVATEQYGSVSPENNLQQQGEILDI

SEQ ID NO: 72621 - protein, 33 aa, Artificial Sequence
  Description of Artificial Sequence: Synthetic polypeptide
DNEEIRTTNPVATEQYGSVSDTWAEQRSQNQKV

SEQ ID NO: 72622 - protein, 29 aa, Artificial Sequence
  Description of Artificial Sequence: Synthetic peptide
AENEIACTNPVATEQYGEASENLQRIQGR

SEQ ID NO: 72623 - protein, 34 aa, Artificial Sequence
  Description of Artificial Sequence: Synthetic polypeptide
DEEEIRTTNPVATEQYGSVSPIMSDEQRQGPEQR

SEQ ID NO: 72624 - protein, 33 aa, Artificial Sequence
  Description of Artificial Sequence: Synthetic polypeptide
DEEEIRTTNPVATEQYGSVSPIMNLPNIGDPES

SEQ ID NO: 72625 - protein, 30 aa, Artificial Sequence
  Description of Artificial Sequence: Synthetic polypeptide
AENEIACTNPVATEQYGEASENLQRGTGRK

SEQ ID NO: 72626 - protein, 33 aa, Artificial Sequence
  Description of Artificial Sequence: Synthetic polypeptide
DEEEIRTTNPVATEQYGSVSPILNLTSVGEEDK

SEQ ID NO: 72627 - protein, 33 aa, Artificial Sequence
  Description of Artificial Sequence: Synthetic polypeptide
DEEEIRTTNPVATEQYGSVSPILNLTNSVGEED

SEQ ID NO: 72628 - protein, 33 aa, Artificial Sequence
  Description of Artificial Sequence: Synthetic polypeptide
DEEEIRTTNPVATEQYGSVSPILNLISVGEEDD

SEQ ID NO: 72629 - protein, 29 aa, Artificial Sequence
  Description of Artificial Sequence: Synthetic peptide
AENEIACTNPVATEQYGEASENLQRGRGI

SEQ ID NO: 72630 - protein, 33 aa, Artificial Sequence
  Description of Artificial Sequence: Synthetic polypeptide
DEEEIRTTNPVATEQYGSVSPIGNLTIENNDIN

SEQ ID NO: 72631 - protein, 34 aa, Artificial Sequence
  Description of Artificial Sequence: Synthetic polypeptide
DEEEIRTTNPVATEQYGSVSPLANLQLSEGFEEM

SEQ ID NO: 72632 - protein, 29 aa, Artificial Sequence
  Description of Artificial Sequence: Synthetic peptide
AENEIACTNPVATEQYGEASENLQRGKGF

SEQ ID NO: 72633 - protein, 35 aa, Artificial Sequence
  Description of Artificial Sequence: Synthetic polypeptide
DEEEIRTTNPVATEQYGSVSPIENLDQPWGPLVND

SEQ ID NO: 72634 - protein, 34 aa, Artificial Sequence
  Description of Artificial Sequence: Synthetic polypeptide
DEEEIRTTNPVATEQYGSVSPLDNWSENFQEGVR

SEQ ID NO: 72635 - protein, 32 aa, Artificial Sequence
  Description of Artificial Sequence: Synthetic polypeptide
DEEEIRTTNPVATEQYGSVSPLDVLDENNNYE

SEQ ID NO: 72636 - protein, 33 aa, Artificial Sequence
  Description of Artificial Sequence: Synthetic polypeptide
DEEEIRTTNPVATEQYGSVSPLENEERMGGQEQ

SEQ ID NO: 72637 - protein, 32 aa, Artificial Sequence
  Description of Artificial Sequence: Synthetic polypeptide
DEEEIRTTNPVATEQYGSVSPIMSLEEAGDES

SEQ ID NO: 72638 - protein, 32 aa, Artificial Sequence
  Description of Artificial Sequence: Synthetic polypeptide
DEDEIRTTNPVAYEQWGTVSTNLGSNEGGENR

SEQ ID NO: 72639 - protein, 33 aa, Artificial Sequence
  Description of Artificial Sequence: Synthetic polypeptide
DEEEIRTTNPVATEQYGSVSPIMSMLEENGDRE

SEQ ID NO: 72640 - protein, 33 aa, Artificial Sequence
  Description of Artificial Sequence: Synthetic polypeptide
DEEEIRTTNPVATEQYGSVSPINHHDERNENID

SEQ ID NO: 72641 - protein, 32 aa, Artificial Sequence
  Description of Artificial Sequence: Synthetic polypeptide
DEDEIRTTNPVAYEQWGTVSTNLQGEAGNDGP

SEQ ID NO: 72642 - protein, 32 aa, Artificial Sequence
  Description of Artificial Sequence: Synthetic polypeptide
DEDEIRTTNPVAYEQWGTVSTNLQGEAGNEHN

SEQ ID NO: 72643 - protein, 33 aa, Artificial Sequence
  Description of Artificial Sequence: Synthetic polypeptide
DEEEIRTTNPVATEQYGSVSPISNELVIPLLRI

SEQ ID NO: 72644 - protein, 33 aa, Artificial Sequence
  Description of Artificial Sequence: Synthetic polypeptide
DEDEIRTTNPVAYEQWGTVSTNLQGDTGGNSRG

SEQ ID NO: 72645 - protein, 30 aa, Artificial Sequence
  Description of Artificial Sequence: Synthetic polypeptide
AENEIACTNPVATEQYGEASENLQRNGGVR

SEQ ID NO: 72646 - protein, 34 aa, Artificial Sequence
  Description of Artificial Sequence: Synthetic polypeptide
DEEEIRTTNPVATEQYGSVSPISNLQIIELNTGN

SEQ ID NO: 72647 - protein, 31 aa, Artificial Sequence
  Description of Artificial Sequence: Synthetic polypeptide
DEDEIRTTNPVAYEQWGTVSTSLQGEGNNDS

SEQ ID NO: 72648 - protein, 33 aa, Artificial Sequence
  Description of Artificial Sequence: Synthetic polypeptide
DEDEIRTTNPVAYEQWGTVSTTGGNEQRDGNRQ

SEQ ID NO: 72649 - protein, 29 aa, Artificial Sequence
  Description of Artificial Sequence: Synthetic peptide
AENEIACTNPVATEQYGEASENLQRNGGH

SEQ ID NO: 72650 - protein, 29 aa, Artificial Sequence
  Description of Artificial Sequence: Synthetic peptide
AENEIACTNPVATEQYGEASENLQRNGGG

SEQ ID NO: 72651 - protein, 34 aa, Artificial Sequence
  Description of Artificial Sequence: Synthetic polypeptide
DEEEIRTTNPVATEQYGSVSPINLLTQRIVDEDL

SEQ ID NO: 72652 - protein, 30 aa, Artificial Sequence
  Description of Artificial Sequence: Synthetic polypeptide
AENEIACTNPVATEQYGEASENLQRMGGIR

SEQ ID NO: 72653 - protein, 34 aa, Artificial Sequence
  Description of Artificial Sequence: Synthetic polypeptide
DEEEIRTTNPVATEQYGSVSPINLEIAQILNQIP

SEQ ID NO: 72654 - protein, 34 aa, Artificial Sequence
  Description of Artificial Sequence: Synthetic polypeptide
DEEEIRTTNPVATEQYGSVSPINLDQPRNPEVQD

SEQ ID NO: 72655 - protein, 30 aa, Artificial Sequence
  Description of Artificial Sequence: Synthetic polypeptide
AENEIACTNPVATEQYGEASENLQRLGGRF

SEQ ID NO: 72656 - protein, 33 aa, Artificial Sequence
  Description of Artificial Sequence: Synthetic polypeptide
DEEEIRTTNPVATEQYGSVSPINALEESGEELD

SEQ ID NO: 72657 - protein, 29 aa, Artificial Sequence
  Description of Artificial Sequence: Synthetic peptide
AENEIACTNPVATEQYGEASENLQSGEGR

SEQ ID NO: 72658 - protein, 30 aa, Artificial Sequence
  Description of Artificial Sequence: Synthetic polypeptide
DEDEIRTTNPVAYEQWGTVSTNDQGNANTT

SEQ ID NO: 72659 - protein, 32 aa, Artificial Sequence
  Description of Artificial Sequence: Synthetic polypeptide
DEEEIRTTNPVATEQYGSVSPLLVLESQEIRS

SEQ ID NO: 72660 - protein, 33 aa, Artificial Sequence
  Description of Artificial Sequence: Synthetic polypeptide
DEEEIRTTNPVATEQYGSVSPFVDWLENGNLQE

SEQ ID NO: 72661 - protein, 31 aa, Artificial Sequence
  Description of Artificial Sequence: Synthetic polypeptide
DEDEIRTTNPVAYEQWGVVSTNLNAGSDGNA

SEQ ID NO: 72662 - protein, 32 aa, Artificial Sequence
  Description of Artificial Sequence: Synthetic polypeptide
DEDEIRTTNPVAYEQWGVVSTNLQGDAGGSRG

SEQ ID NO: 72663 - protein, 31 aa, Artificial Sequence
  Description of Artificial Sequence: Synthetic polypeptide
DEDEIRTTNPVAYEQWGVVSTNLQGEHNGDA

SEQ ID NO: 72664 - protein, 32 aa, Artificial Sequence
  Description of Artificial Sequence: Synthetic polypeptide
DNEEIRTTNPVATEQFGSVSTFNMDQGQSNFP

SEQ ID NO: 72665 - protein, 29 aa, Artificial Sequence
  Description of Artificial Sequence: Synthetic peptide
AENEIACTNPVATEQYGEASENLQRTGGN

SEQ ID NO: 72666 - protein, 33 aa, Artificial Sequence
  Description of Artificial Sequence: Synthetic polypeptide
DNEEIRTTNPVATEQYGCEVSTNDNQEDGNSGF

SEQ ID NO: 72667 - protein, 32 aa, Artificial Sequence
  Description of Artificial Sequence: Synthetic polypeptide
DNEEIRTTNPVATEQYGQSCYSYPDPQRGNDS

SEQ ID NO: 72668 - protein, 33 aa, Artificial Sequence
  Description of Artificial Sequence: Synthetic polypeptide
DNEEIRTTNPVATEQYGQTVTSTMNLQKGGQSL

SEQ ID NO: 72669 - protein, 32 aa, Artificial Sequence
  Description of Artificial Sequence: Synthetic polypeptide
DNEEIRTTNPVATEQYGSCTSPEGLWQRQTNK

SEQ ID NO: 72670 - protein, 34 aa, Artificial Sequence
  Description of Artificial Sequence: Synthetic polypeptide
DEEEIRTTNPVATEQYGSVSPETDLQFQIENETI

SEQ ID NO: 72671 - protein, 34 aa, Artificial Sequence
  Description of Artificial Sequence: Synthetic polypeptide
DEEEIRTTNPVATEQYGSVSPESNLEEAIGPERG

SEQ ID NO: 72672 - protein, 29 aa, Artificial Sequence
  Description of Artificial Sequence: Synthetic peptide
DMEEICSTNPVAYEPYGSSATNDQRGNDQ

SEQ ID NO: 72673 - protein, 29 aa, Artificial Sequence
  Description of Artificial Sequence: Synthetic peptide
DMEEIATTNPVATEQYGSVYCSLEDEYNN

SEQ ID NO: 72674 - protein, 34 aa, Artificial Sequence
  Description of Artificial Sequence: Synthetic polypeptide
DNEEIRTTNPVATEQYGSVSDTTWLEQRSQNQKG

SEQ ID NO: 72675 - protein, 35 aa, Artificial Sequence
  Description of Artificial Sequence: Synthetic polypeptide
DEEEIRTTNPVATEQYGSVSPGHWLIQRQGDNNEE

SEQ ID NO: 72676 - protein, 32 aa, Artificial Sequence
  Description of Artificial Sequence: Synthetic polypeptide
DEEEIRTTNPVATEQYGSVSPIANLISVFEED

SEQ ID NO: 72677 - protein, 32 aa, Artificial Sequence
  Description of Artificial Sequence: Synthetic polypeptide
DNEEIRCTNPVATEQYGSVSPTNLETRNEQQS

SEQ ID NO: 72678 - protein, 29 aa, Artificial Sequence
  Description of Artificial Sequence: Synthetic peptide
AENEIACTNPVATEQYGEASENLQRGGSK

SEQ ID NO: 72679 - protein, 32 aa, Artificial Sequence
  Description of Artificial Sequence: Synthetic polypeptide
DMEEIGTTNPVATEQYGSVSTMLLQERMEVQE

SEQ ID NO: 72680 - protein, 32 aa, Artificial Sequence
  Description of Artificial Sequence: Synthetic polypeptide
DEDEIRTTNPVAYEQWGTVATNLQGDAGNSRG

SEQ ID NO: 72681 - protein, 32 aa, Artificial Sequence
  Description of Artificial Sequence: Synthetic polypeptide
DEEEIRTTNPVATEQYGSVSPLMNEIERNPVD

SEQ ID NO: 72682 - protein, 33 aa, Artificial Sequence
  Description of Artificial Sequence: Synthetic polypeptide
DEEEIRTTNPVATEQYGSVSPLMNSIRQEGVDV

SEQ ID NO: 72683 - protein, 34 aa, Artificial Sequence
  Description of Artificial Sequence: Synthetic polypeptide
DEEEIRTTNPVATEQYGSVSPHNLQSNMNLEPQV

SEQ ID NO: 72684 - protein, 29 aa, Artificial Sequence
  Description of Artificial Sequence: Synthetic peptide
AENEIACTNPVATEQYGEASENLQRGGWK

SEQ ID NO: 72685 - protein, 32 aa, Artificial Sequence
  Description of Artificial Sequence: Synthetic polypeptide
DMEEIGTTNPVATEQYGSVSMNLLQERMFSQE

SEQ ID NO: 72686 - protein, 32 aa, Artificial Sequence
  Description of Artificial Sequence: Synthetic polypeptide
DEEEIRTTNPVATEQYGSVSPLMNSIRQMVDI

SEQ ID NO: 72687 - protein, 34 aa, Artificial Sequence
  Description of Artificial Sequence: Synthetic polypeptide
DEEEIRTTNPVATEQYGSVSPGTTLQQPMQGEIM

SEQ ID NO: 72688 - protein, 32 aa, Artificial Sequence
  Description of Artificial Sequence: Synthetic polypeptide
DNEEIATTNPVAATQYGSVSTNNGPMRGNSRQ

SEQ ID NO: 72689 - protein, 29 aa, Artificial Sequence
  Description of Artificial Sequence: Synthetic peptide
AENEIACTNPVATEQYGEASENLQRGGTD

SEQ ID NO: 72690 - protein, 34 aa, Artificial Sequence
  Description of Artificial Sequence: Synthetic polypeptide
DMEEIGTTNPVATEQYGCVVSTTNLLQERMGNQE

SEQ ID NO: 72691 - protein, 34 aa, Artificial Sequence
  Description of Artificial Sequence: Synthetic polypeptide
DEEEIRTTNPVATEQYGSVSPLNNMQDRLENFLM

SEQ ID NO: 72692 - protein, 30 aa, Artificial Sequence
  Description of Artificial Sequence: Synthetic polypeptide
DNEEIATTNPVATTQYGSVSTNNGPMAHSR

SEQ ID NO: 72693 - protein, 34 aa, Artificial Sequence
  Description of Artificial Sequence: Synthetic polypeptide
DEEEIRTTNPVATEQYGSVSPGNLLQQRIVDEEL

SEQ ID NO: 72694 - protein, 35 aa, Artificial Sequence
  Description of Artificial Sequence: Synthetic polypeptide
DEEEIRTTNPVATEQYGSVSPGINEQERNSQNGRE

SEQ ID NO: 72695 - protein, 31 aa, Artificial Sequence
  Description of Artificial Sequence: Synthetic polypeptide
DQAEIRTTNPVATEQYGCCSNTPLQHGSNQS

SEQ ID NO: 72696 - protein, 29 aa, Artificial Sequence
  Description of Artificial Sequence: Synthetic peptide
AENEIACTNPVATEQYGEASENLQIGGRV

SEQ ID NO: 72697 - protein, 32 aa, Artificial Sequence
  Description of Artificial Sequence: Synthetic polypeptide
DEEEIRTTNPVATEQYGSVSPAMGLTVTNEVT

SEQ ID NO: 72698 - protein, 31 aa, Artificial Sequence
  Description of Artificial Sequence: Synthetic polypeptide
DQEEIATTNPVAYMQYGSVSTGGVQNGNHRP

SEQ ID NO: 72699 - protein, 30 aa, Artificial Sequence
  Description of Artificial Sequence: Synthetic polypeptide
AENEIACTNPVATEQYGEASENLEQRNGGR

SEQ ID NO: 72700 - protein, 30 aa, Artificial Sequence
  Description of Artificial Sequence: Synthetic polypeptide
AENEIACTNPVATEQYGEASENLEQRIGGR

SEQ ID NO: 72701 - protein, 29 aa, Artificial Sequence
  Description of Artificial Sequence: Synthetic peptide
AENEIACTNPVATEQYGEASENLEQRGGV

SEQ ID NO: 72702 - protein, 34 aa, Artificial Sequence
  Description of Artificial Sequence: Synthetic polypeptide
DEEEIRTTNPVATEQYGSVSPNNILETTGETERD

SEQ ID NO: 72703 - protein, 32 aa, Artificial Sequence
  Description of Artificial Sequence: Synthetic polypeptide
DQEEIGTTNPVATLQYGSVSTVNETQGSNFRV

SEQ ID NO: 72704 - protein, 32 aa, Artificial Sequence
  Description of Artificial Sequence: Synthetic polypeptide
DEDEIRTTNPVAYEQWGSVSTNDIQGEGNANG

SEQ ID NO: 72705 - protein, 34 aa, Artificial Sequence
  Description of Artificial Sequence: Synthetic polypeptide
DEEEIRTTNPVATEQYGSVSPNNISEQTRGDMPD

SEQ ID NO: 72706 - protein, 30 aa, Artificial Sequence
  Description of Artificial Sequence: Synthetic polypeptide
AENEIACTNPVATEQYGEASENLEQNRGGR

SEQ ID NO: 72707 - protein, 29 aa, Artificial Sequence
  Description of Artificial Sequence: Synthetic peptide
AENEIACTNPVATEQYGEASENLDRHGGR

SEQ ID NO: 72708 - protein, 29 aa, Artificial Sequence
  Description of Artificial Sequence: Synthetic peptide
AENEIACTNPVATEQYGEASENLDQYGGR

SEQ ID NO: 72709 - protein, 29 aa, Artificial Sequence
  Description of Artificial Sequence: Synthetic peptide
AENEIACTNPVATEQYGEASENLDKRGGR

SEQ ID NO: 72710 - protein, 33 aa, Artificial Sequence
  Description of Artificial Sequence: Synthetic polypeptide
DEEEIRTTNPVATEQYGSVSNTPGETMRLIERE

SEQ ID NO: 72711 - protein, 28 aa, Artificial Sequence
  Description of Artificial Sequence: Synthetic peptide
AENEIACTNPVATEQYGEASENLDGGGR

SEQ ID NO: 72712 - protein, 34 aa, Artificial Sequence
  Description of Artificial Sequence: Synthetic polypeptide
DEEEIRTTNPVATEQYGSVSNTPDDPQTIIGNQE

SEQ ID NO: 72713 - protein, 31 aa, Artificial Sequence
  Description of Artificial Sequence: Synthetic polypeptide
DQEEIATTNPVAYMQYGSVATTNGVQNGNHR

SEQ ID NO: 72714 - protein, 28 aa, Artificial Sequence
  Description of Artificial Sequence: Synthetic peptide
AENEIACTNPVATEQYGEASENIQQGGR

SEQ ID NO: 72715 - protein, 35 aa, Artificial Sequence
  Description of Artificial Sequence: Synthetic polypeptide
DEEEIRTTNPVATEQYGSVSPNNILEQTRISDGRD

SEQ ID NO: 72716 - protein, 34 aa, Artificial Sequence
  Description of Artificial Sequence: Synthetic polypeptide
DEEEIRTTNPVATEQYGSVSNTQLLGSGGNNGNT

SEQ ID NO: 72717 - protein, 33 aa, Artificial Sequence
  Description of Artificial Sequence: Synthetic polypeptide
DQDEIRTTNPVATEAYGSVSCGNLSQPDVGNNR

SEQ ID NO: 72718 - protein, 32 aa, Artificial Sequence
  Description of Artificial Sequence: Synthetic polypeptide
DEDEIRTTNPVAYEQWGSVSTNLNAGDHGNTM

SEQ ID NO: 72719 - protein, 30 aa, Artificial Sequence
  Description of Artificial Sequence: Synthetic polypeptide
AENEIACTNPVATEQYGEASENLIQRLGGR

SEQ ID NO: 72720 - protein, 28 aa, Artificial Sequence
  Description of Artificial Sequence: Synthetic peptide
AENEIACTNPVATEQYGEASENLIIGGR

SEQ ID NO: 72721 - protein, 31 aa, Artificial Sequence
  Description of Artificial Sequence: Synthetic polypeptide
DEDEIRTTNPVAYEQWGSVSTNLNAGDDGTA

SEQ ID NO: 72722 - protein, 29 aa, Artificial Sequence
  Description of Artificial Sequence: Synthetic peptide
AENEIACTNPVATEQYGEASENLGRGGSR

SEQ ID NO: 72723 - protein, 32 aa, Artificial Sequence
  Description of Artificial Sequence: Synthetic polypeptide
DEDEIRTTNPVAYEQWGSVSTNLNAGDAGQNA

SEQ ID NO: 72724 - protein, 32 aa, Artificial Sequence
  Description of Artificial Sequence: Synthetic polypeptide
DEDEIRTTNPVAYEQWGSVSTNLNAGAGQNDA

SEQ ID NO: 72725 - protein, 33 aa, Artificial Sequence
  Description of Artificial Sequence: Synthetic polypeptide
DEDEIRTTNPVAYEQWGSVSTNGQQQDNGQNVR

SEQ ID NO: 72726 - protein, 34 aa, Artificial Sequence
  Description of Artificial Sequence: Synthetic polypeptide
DEEEIRTTNPVATEQYGSVSPNNIHEQTREDIRD

SEQ ID NO: 72727 - protein, 35 aa, Artificial Sequence
  Description of Artificial Sequence: Synthetic polypeptide
DEEEIRTTNPVATEQYGSVSPNNILEQTREEDDRD

SEQ ID NO: 72728 - protein, 29 aa, Artificial Sequence
  Description of Artificial Sequence: Synthetic peptide
AENEIACTNPVATEQYGEASENLGRGGKR

SEQ ID NO: 72729 - protein, 35 aa, Artificial Sequence
  Description of Artificial Sequence: Synthetic polypeptide
DEEEIRTTNPVATEQYGSVSNTQNIGQQNNGNGDD

SEQ ID NO: 72730 - protein, 32 aa, Artificial Sequence
  Description of Artificial Sequence: Synthetic polypeptide
DQEEIATTNPVATTQYGSVSTTNGDGPNGNHR

SEQ ID NO: 72731 - protein, 29 aa, Artificial Sequence
  Description of Artificial Sequence: Synthetic peptide
AENEIACTNPVATEQYGEASENLGQFGGR

SEQ ID NO: 72732 - protein, 33 aa, Artificial Sequence
  Description of Artificial Sequence: Synthetic polypeptide
DEDEIRTTNPVAYEQWGSVSTNDTQQNDNGNER

SEQ ID NO: 72733 - protein, 33 aa, Artificial Sequence
  Description of Artificial Sequence: Synthetic polypeptide
DEDEISTTNPVATEPYGSVIATMNLIQRNNNRL

SEQ ID NO: 72734 - protein, 34 aa, Artificial Sequence
  Description of Artificial Sequence: Synthetic polypeptide
DEEEIRTTNPVATEQYGSVSPNNLIQLEGEVTEE

SEQ ID NO: 72735 - protein, 29 aa, Artificial Sequence
  Description of Artificial Sequence: Synthetic peptide
AENEIACTNPVATEQYGEASENHQRGGKR

SEQ ID NO: 72736 - protein, 34 aa, Artificial Sequence
  Description of Artificial Sequence: Synthetic polypeptide
DEEEIRTTNPVATEQYGSVSNTNLVVQPQMVEEW

SEQ ID NO: 72737 - protein, 30 aa, Artificial Sequence
  Description of Artificial Sequence: Synthetic polypeptide
DEDVIRTTNPVATEQYGCVELTNPFGGTND

SEQ ID NO: 72738 - protein, 29 aa, Artificial Sequence
  Description of Artificial Sequence: Synthetic peptide
AENEIACTNPVATEQYGEASENAQRGGQR

SEQ ID NO: 72739 - protein, 29 aa, Artificial Sequence
  Description of Artificial Sequence: Synthetic peptide
AENEIACTNPVATEQYGEASELNLQYGGR

SEQ ID NO: 72740 - protein, 30 aa, Artificial Sequence
  Description of Artificial Sequence: Synthetic polypeptide
AENEIACTNPVATEQYGEASELNLQRGGMR

SEQ ID NO: 72741 - protein, 31 aa, Artificial Sequence
  Description of Artificial Sequence: Synthetic polypeptide
DEEEIRTTNPVATEQYGSVSPNNTAEEDEHD

SEQ ID NO: 72742 - protein, 28 aa, Artificial Sequence
  Description of Artificial Sequence: Synthetic peptide
AENEIACTNPVATEQYGEASELLQRAGR

SEQ ID NO: 72743 - protein, 30 aa, Artificial Sequence
  Description of Artificial Sequence: Synthetic polypeptide
AENEIACTNPVATEQYGEASEKNLQVRGGR

SEQ ID NO: 72744 - protein, 30 aa, Artificial Sequence
  Description of Artificial Sequence: Synthetic polypeptide
AENEIACTNPVATEQYGEASEKNLQRGGYR

SEQ ID NO: 72745 - protein, 32 aa, Artificial Sequence
  Description of Artificial Sequence: Synthetic polypeptide
DEEEIRTTNPVATEQYGSVSPNNTDTIEDNQN

SEQ ID NO: 72746 - protein, 29 aa, Artificial Sequence
  Description of Artificial Sequence: Synthetic peptide
AENEIACTNPVATEQYGEASEKNLQRGGD

SEQ ID NO: 72747 - protein, 30 aa, Artificial Sequence
  Description of Artificial Sequence: Synthetic polypeptide
AENEIACTNPVATEQYGEASEKNLQRFGGR

SEQ ID NO: 72748 - protein, 29 aa, Artificial Sequence
  Description of Artificial Sequence: Synthetic peptide
AENEIACTNPVATEQYGEASEINEQRGGR

SEQ ID NO: 72749 - protein, 33 aa, Artificial Sequence
  Description of Artificial Sequence: Synthetic polypeptide
DEDEIRTTNPVAYEQWGSVSTGNGNGQDRGPNS

SEQ ID NO: 72750 - protein, 33 aa, Artificial Sequence
  Description of Artificial Sequence: Synthetic polypeptide
DEEEIRTTNPVATEQYGSVSPNNYLENLEGVEE

SEQ ID NO: 72751 - protein, 34 aa, Artificial Sequence
  Description of Artificial Sequence: Synthetic polypeptide
DEEEIRTTNPVATEQYGSVSNTNMTMEGEEGGNG

SEQ ID NO: 72752 - protein, 28 aa, Artificial Sequence
  Description of Artificial Sequence: Synthetic peptide
DEDQIACTNPVATEQWGSVAMNDQPGNL

SEQ ID NO: 72753 - protein, 28 aa, Artificial Sequence
  Description of Artificial Sequence: Synthetic peptide
AENEIACTNPVATEQYGEASENCQRGEK

SEQ ID NO: 72754 - protein, 28 aa, Artificial Sequence
  Description of Artificial Sequence: Synthetic peptide
AENEIACTNPVATEQYGEASENCQRGGK

SEQ ID NO: 72755 - protein, 32 aa, Artificial Sequence
  Description of Artificial Sequence: Synthetic polypeptide
DEDEIRTTNPVAYEQWGSVSTNAQQGGPNANQ

SEQ ID NO: 72756 - protein, 28 aa, Artificial Sequence
  Description of Artificial Sequence: Synthetic peptide
AENEIACTNPVATEQYGEASENGQRKGR

SEQ ID NO: 72757 - protein, 29 aa, Artificial Sequence
  Description of Artificial Sequence: Synthetic peptide
AENEIACTNPVATEQYGEASENGQRGGLR

SEQ ID NO: 72758 - protein, 34 aa, Artificial Sequence
  Description of Artificial Sequence: Synthetic polypeptide
DQEEIRTTNPVATDQYGSVSTENGEQNTNGNGRV

SEQ ID NO: 72759 - protein, 28 aa, Artificial Sequence
  Description of Artificial Sequence: Synthetic peptide
AENEIACTNPVATEQYGEASENETRGGR

SEQ ID NO: 72760 - protein, 28 aa, Artificial Sequence
  Description of Artificial Sequence: Synthetic peptide
AENEIACTNPVATEQYGEASENEQTGGR

SEQ ID NO: 72761 - protein, 28 aa, Artificial Sequence
  Description of Artificial Sequence: Synthetic peptide
AENEIACTNPVATEQYGEASENEQRGGG

SEQ ID NO: 72762 - protein, 29 aa, Artificial Sequence
  Description of Artificial Sequence: Synthetic peptide
AENEIACTNPVATEQYGEASENELQRGGF

SEQ ID NO: 72763 - protein, 32 aa, Artificial Sequence
  Description of Artificial Sequence: Synthetic polypeptide
DEDEIRTTNPVAYEQWGSVSTNANQGSGNANI

SEQ ID NO: 72764 - protein, 30 aa, Artificial Sequence
  Description of Artificial Sequence: Synthetic polypeptide
AENEIACTNPVATEQYGEASENELLQRGGR

SEQ ID NO: 72765 - protein, 29 aa, Artificial Sequence
  Description of Artificial Sequence: Synthetic peptide
AENEIACTNPVATEQYGEASENDQRGMGR

SEQ ID NO: 72766 - protein, 28 aa, Artificial Sequence
  Description of Artificial Sequence: Synthetic peptide
AENEIACTNPVATEQYGEASENCQWGGR

SEQ ID NO: 72767 - protein, 30 aa, Artificial Sequence
  Description of Artificial Sequence: Synthetic polypeptide
DEDVEIATTNPVAYEPYGSVATNLQDPNDN

SEQ ID NO: 72768 - protein, 31 aa, Artificial Sequence
  Description of Artificial Sequence: Synthetic polypeptide
DEDVIATTNPVATEQWGSVAATNNEQPGVNR

SEQ ID NO: 72769 - protein, 30 aa, Artificial Sequence
  Description of Artificial Sequence: Synthetic polypeptide
DEDVIATTNPVATEQYGCVAATNDQMGNSL

SEQ ID NO: 72770 - protein, 31 aa, Artificial Sequence
  Description of Artificial Sequence: Synthetic polypeptide
DEDEIRTTNPVAYEQWGSVSTNAEGGGNANI

SEQ ID NO: 72771 - protein, 28 aa, Artificial Sequence
  Description of Artificial Sequence: Synthetic peptide
AENEIACTNPVATEQYGEASEILQRGGA

SEQ ID NO: 72772 - protein, 32 aa, Artificial Sequence
  Description of Artificial Sequence: Synthetic polypeptide
DGEEIRTTNPVAYEQYGSVSCTLDLQAEPANY

SEQ ID NO: 72773 - protein, 30 aa, Artificial Sequence
  Description of Artificial Sequence: Synthetic polypeptide
AENEIACTNPVATEQYGEASENLKQRGGRD

SEQ ID NO: 72774 - protein, 32 aa, Artificial Sequence
  Description of Artificial Sequence: Synthetic polypeptide
DEDEIRTTNPVAYEQWGSVSTNLQLGDSQDGK

SEQ ID NO: 72775 - protein, 29 aa, Artificial Sequence
  Description of Artificial Sequence: Synthetic peptide
AENEIACTNPVATEQYGEASENLQHDGGR

SEQ ID NO: 72776 - protein, 32 aa, Artificial Sequence
  Description of Artificial Sequence: Synthetic polypeptide
DEDEIRTTNPVAYEQWGSVSTNLQGNDHQNGE

SEQ ID NO: 72777 - protein, 31 aa, Artificial Sequence
  Description of Artificial Sequence: Synthetic polypeptide
DEDEIRTTNPVAYESWGCVSTNLQLGGDNGA

SEQ ID NO: 72778 - protein, 30 aa, Artificial Sequence
  Description of Artificial Sequence: Synthetic polypeptide
DQAEIRTTNPVATEQYGCCSTVLEQIGDYQ

SEQ ID NO: 72779 - protein, 30 aa, Artificial Sequence
  Description of Artificial Sequence: Synthetic polypeptide
DQAEIRTTNPVATEQYGCCSTVLETIGSNQ

SEQ ID NO: 72780 - protein, 31 aa, Artificial Sequence
  Description of Artificial Sequence: Synthetic polypeptide
DQAEIRTTNPVATEQYGCCSTVLQEIQNDRV

SEQ ID NO: 72781 - protein, 32 aa, Artificial Sequence
  Description of Artificial Sequence: Synthetic polypeptide
DEDEIRTTNPVAYEQWGSVSTNLQGNDGQEGS

SEQ ID NO: 72782 - protein, 30 aa, Artificial Sequence
  Description of Artificial Sequence: Synthetic polypeptide
DQAEIRTTNPVATEQYGCCSTVLQGGQSKQ

SEQ ID NO: 72783 - protein, 29 aa, Artificial Sequence
  Description of Artificial Sequence: Synthetic peptide
AENEIACTNPVATEQYGEASENLQFGDMR

SEQ ID NO: 72784 - protein, 29 aa, Artificial Sequence
  Description of Artificial Sequence: Synthetic peptide
AENEIACTNPVATEQYGEASENLQFEGGR

SEQ ID NO: 72785 - protein, 34 aa, Artificial Sequence
  Description of Artificial Sequence: Synthetic polypeptide
DEEEIRTTNPVATEQYGSVSNVNNLQRVAEDQGI

SEQ ID NO: 72786 - protein, 33 aa, Artificial Sequence
  Description of Artificial Sequence: Synthetic polypeptide
DEEEIRTTNPVATEQYGSVSNVNMTAGELNEGG

SEQ ID NO: 72787 - protein, 33 aa, Artificial Sequence
  Description of Artificial Sequence: Synthetic polypeptide
DEEEIRTTNPVATEQYGSVSNVNLLESNGEQES

SEQ ID NO: 72788 - protein, 29 aa, Artificial Sequence
  Description of Artificial Sequence: Synthetic peptide
AENEIACTNPVATEQYGEASENLQERNGR

SEQ ID NO: 72789 - protein, 30 aa, Artificial Sequence
  Description of Artificial Sequence: Synthetic polypeptide
DEDEIRTTNPVAYESWGCVATNLQLGDNGH

SEQ ID NO: 72790 - protein, 32 aa, Artificial Sequence
  Description of Artificial Sequence: Synthetic polypeptide
DEEEIRTTNPVATEQYGSVSNVILGVGGGEIG

SEQ ID NO: 72791 - protein, 30 aa, Artificial Sequence
  Description of Artificial Sequence: Synthetic polypeptide
DQAEIRTTNPVATEQYGCCSTVFLEIGSNI

SEQ ID NO: 72792 - protein, 28 aa, Artificial Sequence
  Description of Artificial Sequence: Synthetic peptide
AENEIACTNPVATEQYGEASENLQHEGR

SEQ ID NO: 72793 - protein, 30 aa, Artificial Sequence
  Description of Artificial Sequence: Synthetic polypeptide
DQAEIRTTNPVATEQYGCCSTAPQHFGSNQ

SEQ ID NO: 72794 - protein, 32 aa, Artificial Sequence
  Description of Artificial Sequence: Synthetic polypeptide
DGQEECIATTNPVATEQWGSVSTNLDTSGNQQ

SEQ ID NO: 72795 - protein, 30 aa, Artificial Sequence
  Description of Artificial Sequence: Synthetic polypeptide
DQAEIRTTNPVATEQYGCCSTEHQEHFGNQ

SEQ ID NO: 72796 - protein, 28 aa, Artificial Sequence
  Description of Artificial Sequence: Synthetic peptide
AENEIACTNPVATEQYGEASENLQIGGE

SEQ ID NO: 72797 - protein, 34 aa, Artificial Sequence
  Description of Artificial Sequence: Synthetic polypeptide
DEEEIRTTNPVATEQYGSVSPNLGLSQVPNFVNA

SEQ ID NO: 72798 - protein, 28 aa, Artificial Sequence
  Description of Artificial Sequence: Synthetic peptide
AENEIACTNPVATEQYGEASENLQSGGQ

SEQ ID NO: 72799 - protein, 28 aa, Artificial Sequence
  Description of Artificial Sequence: Synthetic peptide
AENEIACTNPVATEQYGEASENLQHGGQ

SEQ ID NO: 72800 - protein, 28 aa, Artificial Sequence
  Description of Artificial Sequence: Synthetic peptide
AENEIACTNPVATEQYGEASENLQHGGL

SEQ ID NO: 72801 - protein, 33 aa, Artificial Sequence
  Description of Artificial Sequence: Synthetic polypeptide
DEEEIRTTNPVATEQYGSVSPAEWLQTLQNLDT

SEQ ID NO: 72802 - protein, 28 aa, Artificial Sequence
  Description of Artificial Sequence: Synthetic peptide
AENEIACTNPVATEQYGEASENLQHGGK

SEQ ID NO: 72803 - protein, 32 aa, Artificial Sequence
  Description of Artificial Sequence: Synthetic polypeptide
DEDEIRTTNPVAYEQWGSVSTNPNGNGMGNDR

SEQ ID NO: 72804 - protein, 29 aa, Artificial Sequence
  Description of Artificial Sequence: Synthetic peptide
AENEIACTNPVATEQYGEASENLQHGGDR

SEQ ID NO: 72805 - protein, 31 aa, Artificial Sequence
  Description of Artificial Sequence: Synthetic polypeptide
DEDEIRTTNPVAYERYGEVSTNLQHEQGGEQ

SEQ ID NO: 72806 - protein, 31 aa, Artificial Sequence
  Description of Artificial Sequence: Synthetic polypeptide
DEDEIRTTNPVAYEQWGSVSTNMNAGDSGNA

SEQ ID NO: 72807 - protein, 33 aa, Artificial Sequence
  Description of Artificial Sequence: Synthetic polypeptide
DEDEIRTTNPVAYEQWGSVSTNLQNQNGPNENE

SEQ ID NO: 72808 - protein, 28 aa, Artificial Sequence
  Description of Artificial Sequence: Synthetic peptide
AENEIACTNPVATEQYGEASENLQHEER

SEQ ID NO: 72809 - protein, 32 aa, Artificial Sequence
  Description of Artificial Sequence: Synthetic polypeptide
DEDEIRTTNPVAYEQWGSVSTNLNAGDLGNGA

SEQ ID NO: 72810 - protein, 33 aa, Artificial Sequence
  Description of Artificial Sequence: Synthetic polypeptide
DEEEIRTTNPVATEQYGSVSNVGNFTGQENNGG

SEQ ID NO: 72811 - protein, 31 aa, Artificial Sequence
  Description of Artificial Sequence: Synthetic polypeptide
DEDEIRTTNPVAYESWGSVATNLQLGDNGTD

SEQ ID NO: 72812 - protein, 30 aa, Artificial Sequence
  Description of Artificial Sequence: Synthetic polypeptide
DEDEIRTTNPVAYEWWGVVSTNLQGGGDAD

SEQ ID NO: 72813 - protein, 31 aa, Artificial Sequence
  Description of Artificial Sequence: Synthetic polypeptide
DEDEIRTTNPVAYEWWGVVSTNLQGGGDDAR

SEQ ID NO: 72814 - protein, 30 aa, Artificial Sequence
  Description of Artificial Sequence: Synthetic polypeptide
DEDEIRTTNPVAYEWWGVVSTNLQGGGGDA

SEQ ID NO: 72815 - protein, 29 aa, Artificial Sequence
  Description of Artificial Sequence: Synthetic peptide
DEDEIRTTNPVAYEWWGVVSTNLQGQDDA

SEQ ID NO: 72816 - protein, 30 aa, Artificial Sequence
  Description of Artificial Sequence: Synthetic polypeptide
AENEIACTNPVATEQYGEASENLNQERGGR

SEQ ID NO: 72817 - protein, 28 aa, Artificial Sequence
  Description of Artificial Sequence: Synthetic peptide
AENEIACTNPVATEQYGEASENLMAGGR

SEQ ID NO: 72818 - protein, 31 aa, Artificial Sequence
  Description of Artificial Sequence: Synthetic polypeptide
DEDEIRTTNPVAYEQWGSVSTNLNGDSQDGS

SEQ ID NO: 72819 - protein, 31 aa, Artificial Sequence
  Description of Artificial Sequence: Synthetic polypeptide
DEDEIRTTNPVAYEQWGSVSTNLNAGSGGDA

SEQ ID NO: 72820 - protein, 32 aa, Artificial Sequence
  Description of Artificial Sequence: Synthetic polypeptide
DEDEIRTTNPVAYEQWGSVSTNLNAGGNGNAD

SEQ ID NO: 72821 - protein, 30 aa, Artificial Sequence
  Description of Artificial Sequence: Synthetic polypeptide
AENEIACTNPVATEQYGEASENLLQRGGIR

SEQ ID NO: 72822 - protein, 31 aa, Artificial Sequence
  Description of Artificial Sequence: Synthetic polypeptide
DQAEIRTTNPVAYEQYGVCSTVDLQDHDGNR

SEQ ID NO: 72823 - protein, 32 aa, Artificial Sequence
  Description of Artificial Sequence: Synthetic polypeptide
DEDEIRTTNPVAYEQWGSVSTNLNAGDTGDAR

SEQ ID NO: 72824 - protein, 29 aa, Artificial Sequence
  Description of Artificial Sequence: Synthetic peptide
AENEIACTNPVATEQYGEASENLQSGPGR

SEQ ID NO: 72825 - protein, 30 aa, Artificial Sequence
  Description of Artificial Sequence: Synthetic polypeptide
AENEIACTNPVATEQYGEASENLQSRGGAR

SEQ ID NO: 72826 - protein, 32 aa, Artificial Sequence
  Description of Artificial Sequence: Synthetic polypeptide
DEDEIRTTNPVAYEQWGSVSTNLNAGDQGNAM

SEQ ID NO: 72827 - protein, 30 aa, Artificial Sequence
  Description of Artificial Sequence: Synthetic polypeptide
AENEIACTNPVATEQYGEASENLPQDRGGR

SEQ ID NO: 72828 - protein, 33 aa, Artificial Sequence
  Description of Artificial Sequence: Synthetic polypeptide
DEEEIRTTNPVATEQYGSVSNVELTDDQGEINQ

SEQ ID NO: 72829 - protein, 30 aa, Artificial Sequence
  Description of Artificial Sequence: Synthetic polypeptide
AENEIACTNPVATEQYGEASENLPQRGMGR

SEQ ID NO: 72830 - protein, 34 aa, Artificial Sequence
  Description of Artificial Sequence: Synthetic polypeptide
DQAEIRTTNPVATEQYGEVVPSTGNLSQPVVGNR

SEQ ID NO: 72831 - protein, 33 aa, Artificial Sequence
  Description of Artificial Sequence: Synthetic polypeptide
DEDEIRTTNPVAYEQWGSVSTNLQGNAGENDAN

SEQ ID NO: 72832 - protein, 30 aa, Artificial Sequence
  Description of Artificial Sequence: Synthetic polypeptide
AENEIACTNPVATEQYGEASENLQDRGEGR

SEQ ID NO: 72833 - protein, 32 aa, Artificial Sequence
  Description of Artificial Sequence: Synthetic polypeptide
DEDEIRTTNPVAYEQWGSVSTNLQGDPHNGQD

SEQ ID NO: 72834 - protein, 33 aa, Artificial Sequence
  Description of Artificial Sequence: Synthetic polypeptide
DEDEIRTTNPVAYEQWGSVSTNLQAGEHGNDAD

SEQ ID NO: 72835 - protein, 29 aa, Artificial Sequence
  Description of Artificial Sequence: Synthetic peptide
AENEIACTNPVATEQYGEASENLQDGGRN

SEQ ID NO: 72836 - protein, 34 aa, Artificial Sequence
  Description of Artificial Sequence: Synthetic polypeptide
DEEEIRTTNPVATEQYGSVSNTWMGMQQGPSENS

SEQ ID NO: 72837 - protein, 32 aa, Artificial Sequence
  Description of Artificial Sequence: Synthetic polypeptide
DQAEIRTTNPVATEQYGCTCSCTVELQSGGNR

SEQ ID NO: 72838 - protein, 34 aa, Artificial Sequence
  Description of Artificial Sequence: Synthetic polypeptide
DEEEIRTTNPVATEQYGSVSNTWLGMQQPPLENS

SEQ ID NO: 72839 - protein, 32 aa, Artificial Sequence
  Description of Artificial Sequence: Synthetic polypeptide
DEDEIRTTNPVAYEQWGSVSTNLNQNGDSQGK

SEQ ID NO: 72840 - protein, 28 aa, Artificial Sequence
  Description of Artificial Sequence: Synthetic peptide
AENEIACTNPVATEQYGEASENLQCEGR

SEQ ID NO: 72841 - protein, 30 aa, Artificial Sequence
  Description of Artificial Sequence: Synthetic polypeptide
DEDEIRTTNPVAYESWGVVSTNLQGGGDAD

SEQ ID NO: 72842 - protein, 34 aa, Artificial Sequence
  Description of Artificial Sequence: Synthetic polypeptide
DEDEIRTTNPVAYEQWGSVSTNLNQGNAGENASR

SEQ ID NO: 72843 - protein, 31 aa, Artificial Sequence
  Description of Artificial Sequence: Synthetic polypeptide
DEDEIRTTNPVAYESYGEVSTNNQIGGENEA

SEQ ID NO: 72844 - protein, 30 aa, Artificial Sequence
  Description of Artificial Sequence: Synthetic polypeptide
DEDEIRTTNPVAYEWWGVVSTNLQGDGDAN

SEQ ID NO: 72845 - protein, 32 aa, Artificial Sequence
  Description of Artificial Sequence: Synthetic polypeptide
DEDEIRTTNPVAYEQWGSVSTNLNMDGGDNNS

SEQ ID NO: 72846 - protein, 32 aa, Artificial Sequence
  Description of Artificial Sequence: Synthetic polypeptide
DEDEIRTTNPVAYEQWGSVSTNLNGGSGGNTA

SEQ ID NO: 72847 - protein, 32 aa, Artificial Sequence
  Description of Artificial Sequence: Synthetic polypeptide
DEECIRTTNPVATEIYGVQVTTDLQRFGSNQI

SEQ ID NO: 72848 - protein, 33 aa, Artificial Sequence
  Description of Artificial Sequence: Synthetic polypeptide
DSEEIRCTNPVAYEQYGSTVSTNLSQARNGGTE

SEQ ID NO: 72849 - protein, 29 aa, Artificial Sequence
  Description of Artificial Sequence: Synthetic peptide
AENEIACTNPVATEQYGEAASENLQFGGR

SEQ ID NO: 72850 - protein, 30 aa, Artificial Sequence
  Description of Artificial Sequence: Synthetic polypeptide
DEECIETVNPVATEWYGSVISDNLEMIGNI

SEQ ID NO: 72851 - protein, 30 aa, Artificial Sequence
  Description of Artificial Sequence: Synthetic polypeptide
DEECIETVNPVATEWYGSVSDNLERVGTMC

SEQ ID NO: 72852 - protein, 33 aa, Artificial Sequence
  Description of Artificial Sequence: Synthetic polypeptide
DEEEIRTTNPVATEQYGSVSPTNILEELLEELD

SEQ ID NO: 72853 - protein, 30 aa, Artificial Sequence
  Description of Artificial Sequence: Synthetic polypeptide
DEECIETVNPVATEWYGSVSLDPNLERGTT

SEQ ID NO: 72854 - protein, 29 aa, Artificial Sequence
  Description of Artificial Sequence: Synthetic peptide
DEECIETVNPVAYEWYGSVSDNLEMIGNQ

SEQ ID NO: 72855 - protein, 28 aa, Artificial Sequence
  Description of Artificial Sequence: Synthetic peptide
AENEIACTNPVATDQYGEASENYQRGGR

SEQ ID NO: 72856 - protein, 31 aa, Artificial Sequence
  Description of Artificial Sequence: Synthetic polypeptide
DTEEICTTNPVATTQYGSVSTNPNDNGNNVE

SEQ ID NO: 72857 - protein, 31 aa, Artificial Sequence
  Description of Artificial Sequence: Synthetic polypeptide
DTEEIRATNPVATEQWGCSYHSDNLQNGDDR

SEQ ID NO: 72858 - protein, 29 aa, Artificial Sequence
  Description of Artificial Sequence: Synthetic peptide
AENEIACTNPVATAQYGEASENLQRAGGR

SEQ ID NO: 72859 - protein, 28 aa, Artificial Sequence
  Description of Artificial Sequence: Synthetic peptide
AENEIACTNPVASEQYGEASENLQRGGM

SEQ ID NO: 72860 - protein, 29 aa, Artificial Sequence
  Description of Artificial Sequence: Synthetic peptide
AENEIACTNPVAMEQYGEASENLQRSGGR

SEQ ID NO: 72861 - protein, 28 aa, Artificial Sequence
  Description of Artificial Sequence: Synthetic peptide
AENEIACTNPVAMEQYGEASENFQRGGR

SEQ ID NO: 72862 - protein, 29 aa, Artificial Sequence
  Description of Artificial Sequence: Synthetic peptide
AENEIACTNPVATEQYGEYASENLQRGGS

SEQ ID NO: 72863 - protein, 30 aa, Artificial Sequence
  Description of Artificial Sequence: Synthetic polypeptide
DEDEIRTTNPVAYEPWGVVSTNLQGGGDAD

SEQ ID NO: 72864 - protein, 30 aa, Artificial Sequence
  Description of Artificial Sequence: Synthetic polypeptide
AENEIACTNPVATEQYGEYASEINLQRGGR

SEQ ID NO: 72865 - protein, 31 aa, Artificial Sequence
  Description of Artificial Sequence: Synthetic polypeptide
DTEEICTTNPVATTQYGSVSTNPNDGGTNVE

SEQ ID NO: 72866 - protein, 31 aa, Artificial Sequence
  Description of Artificial Sequence: Synthetic polypeptide
DTEEICTTNPVATTQYGSVSTNPNDGGNTEQ

SEQ ID NO: 72867 - protein, 31 aa, Artificial Sequence
  Description of Artificial Sequence: Synthetic polypeptide
DTEEICTTNPVATTQYGSVSTNPNDEGGNNP

SEQ ID NO: 72868 - protein, 30 aa, Artificial Sequence
  Description of Artificial Sequence: Synthetic polypeptide
AENEIACTNPVATEQYGEWASENLAQRGGR

SEQ ID NO: 72869 - protein, 32 aa, Artificial Sequence
  Description of Artificial Sequence: Synthetic polypeptide
DTEEICTTNPVATTQYGSVSTNPAEQGGNNNG

SEQ ID NO: 72870 - protein, 30 aa, Artificial Sequence
  Description of Artificial Sequence: Synthetic polypeptide
AENEIACTNPVATEQYGEWASENLQRGGGR

SEQ ID NO: 72871 - protein, 32 aa, Artificial Sequence
  Description of Artificial Sequence: Synthetic polypeptide
DTEEICTTNPVATTQYGSVSTNPATQGGNNNE

SEQ ID NO: 72872 - protein, 29 aa, Artificial Sequence
  Description of Artificial Sequence: Synthetic peptide
AENEIACTNPVATEAYGEASHENLQRGGR

SEQ ID NO: 72873 - protein, 34 aa, Artificial Sequence
  Description of Artificial Sequence: Synthetic polypeptide
DEEEIRTTNPVATEQYGSVSLTNNQAERSTEVVL

SEQ ID NO: 72874 - protein, 29 aa, Artificial Sequence
  Description of Artificial Sequence: Synthetic peptide
AENEIACTNPVATEAYGEASENLQRQGGR

SEQ ID NO: 72875 - protein, 35 aa, Artificial Sequence
  Description of Artificial Sequence: Synthetic polypeptide
DEEEIRTTNPVATEQYGSVSLTNNGLLEPQLIVNP

SEQ ID NO: 72876 - protein, 30 aa, Artificial Sequence
  Description of Artificial Sequence: Synthetic polypeptide
AENEIACTNPVATEQYGEWSENLQRGGTRE

SEQ ID NO: 72877 - protein, 31 aa, Artificial Sequence
  Description of Artificial Sequence: Synthetic polypeptide
DEECIATVNPVATEWYGCVAHDNLQERGDNR

SEQ ID NO: 72878 - protein, 31 aa, Artificial Sequence
  Description of Artificial Sequence: Synthetic polypeptide
DEECIATVNPVATEWYGCVSHDNNLQEDGNR

SEQ ID NO: 72879 - protein, 28 aa, Artificial Sequence
  Description of Artificial Sequence: Synthetic peptide
AENEIACTNPVATEAYGEASENLQRGGG

SEQ ID NO: 72880 - protein, 31 aa, Artificial Sequence
  Description of Artificial Sequence: Synthetic polypeptide
DEECIATVNPVAYEAYGSVVSDNALSERGNR

SEQ ID NO: 72881 - protein, 30 aa, Artificial Sequence
  Description of Artificial Sequence: Synthetic polypeptide
DEECIATVNPVAYEHWGSVSDNLSERGGNR

SEQ ID NO: 72882 - protein, 29 aa, Artificial Sequence
  Description of Artificial Sequence: Synthetic peptide
AENEIACTNPVATEAYGEASENLEQRGGR

SEQ ID NO: 72883 - protein, 29 aa, Artificial Sequence
  Description of Artificial Sequence: Synthetic peptide
AENEIACTNPVAIEQYGEASENLQRGEGR

SEQ ID NO: 72884 - protein, 28 aa, Artificial Sequence
  Description of Artificial Sequence: Synthetic peptide
AENEIACTNPVAFEQYGEASENLQRGGD

SEQ ID NO: 72885 - protein, 28 aa, Artificial Sequence
  Description of Artificial Sequence: Synthetic peptide
AENEIACTNPVACEQYGEASENLQRNGR

SEQ ID NO: 72886 - protein, 28 aa, Artificial Sequence
  Description of Artificial Sequence: Synthetic peptide
AENEIACTNPVACEQYGEASENLQPGGR

SEQ ID NO: 72887 - protein, 28 aa, Artificial Sequence
  Description of Artificial Sequence: Synthetic peptide
AENEIACTNPIATEQYGEASENLQRGGH

SEQ ID NO: 72888 - protein, 34 aa, Artificial Sequence
  Description of Artificial Sequence: Synthetic polypeptide
DTEEIRATNPVATEQYGSVSTTNNLQAGNGQQFD

SEQ ID NO: 72889 - protein, 34 aa, Artificial Sequence
  Description of Artificial Sequence: Synthetic polypeptide
DTEEIRATNPVATEQYGSVSTTNNLQQAGNGEQF

SEQ ID NO: 72890 - protein, 34 aa, Artificial Sequence
  Description of Artificial Sequence: Synthetic polypeptide
DEEEIRTTNPVATEQYGSVSLTANLQVTESEAIG

SEQ ID NO: 72891 - protein, 34 aa, Artificial Sequence
  Description of Artificial Sequence: Synthetic polypeptide
DTEEIRATNPVATEQYGSVSTTNNQLQAGNGQFG

SEQ ID NO: 72892 - protein, 34 aa, Artificial Sequence
  Description of Artificial Sequence: Synthetic polypeptide
DTEEIRATNPVATEQYGSVSTTNNQLQAGNGQNA

SEQ ID NO: 72893 - protein, 31 aa, Artificial Sequence
  Description of Artificial Sequence: Synthetic polypeptide
DEDEIRTTNPVAYEGWGSVSTGLQGNGDNVN

SEQ ID NO: 72894 - protein, 34 aa, Artificial Sequence
  Description of Artificial Sequence: Synthetic polypeptide
DTEEIRATNPVATEQYGSVSTTQNLQQAGNGDQE

SEQ ID NO: 72895 - protein, 30 aa, Artificial Sequence
  Description of Artificial Sequence: Synthetic polypeptide
DEDEIRTTNPVAYEGWGSVATNLQGDGGVN

SEQ ID NO: 72896 - protein, 31 aa, Artificial Sequence
  Description of Artificial Sequence: Synthetic polypeptide
DEEEIRTTNPVATEQYGSVSLPMHERQLMPI

SEQ ID NO: 72897 - protein, 28 aa, Artificial Sequence
  Description of Artificial Sequence: Synthetic peptide
AENEIACTNPCSTEQYGIVSCNLQSGTR

SEQ ID NO: 72898 - protein, 28 aa, Artificial Sequence
  Description of Artificial Sequence: Synthetic peptide
AENEIACTNPCSSEQYGIVSCNLQRGGR

SEQ ID NO: 72899 - protein, 28 aa, Artificial Sequence
  Description of Artificial Sequence: Synthetic peptide
AENEIACTNPCSSEQYGEVSCNLQRGTR

SEQ ID NO: 72900 - protein, 31 aa, Artificial Sequence
  Description of Artificial Sequence: Synthetic polypeptide
DEDEIRTTNPVAYEGWGSTVTTNLQGNGNVN

SEQ ID NO: 72901 - protein, 30 aa, Artificial Sequence
  Description of Artificial Sequence: Synthetic polypeptide
DEDEIRTTNPVAYEGWGEVTTNLQGGENEN

SEQ ID NO: 72902 - protein, 33 aa, Artificial Sequence
  Description of Artificial Sequence: Synthetic polypeptide
DTEEIRATNPVATEQYGSVSTNTTNQQQGNNNE

SEQ ID NO: 72903 - protein, 30 aa, Artificial Sequence
  Description of Artificial Sequence: Synthetic polypeptide
DEDEIRTTNPVAYEQWGCTSTNLQGEGDTS

SEQ ID NO: 72904 - protein, 32 aa, Artificial Sequence
  Description of Artificial Sequence: Synthetic polypeptide
DEDEIRTTNPVAYEHYGEVSTTNLQGEDGNAI

SEQ ID NO: 72905 - protein, 29 aa, Artificial Sequence
  Description of Artificial Sequence: Synthetic peptide
AENEIACTNPVATEQYGFASENGQRGAGR

SEQ ID NO: 72906 - protein, 28 aa, Artificial Sequence
  Description of Artificial Sequence: Synthetic peptide
AENEIACTNPVACEQYGEASENLDRGGR

SEQ ID NO: 72907 - protein, 34 aa, Artificial Sequence
  Description of Artificial Sequence: Synthetic polypeptide
DEEEIRTTNPVATEQYGSVSLTNLEVVRIMPEHL

SEQ ID NO: 72908 - protein, 30 aa, Artificial Sequence
  Description of Artificial Sequence: Synthetic polypeptide
AENEIACTNPVATEQYGEYASFENLQRGGR

SEQ ID NO: 72909 - protein, 29 aa, Artificial Sequence
  Description of Artificial Sequence: Synthetic peptide
AENEIACTNPTATEQYGEAKSENLQRGGR

SEQ ID NO: 72910 - protein, 28 aa, Artificial Sequence
  Description of Artificial Sequence: Synthetic peptide
AENEIACTNPSATEQYGEASENLQRGGV

SEQ ID NO: 72911 - protein, 30 aa, Artificial Sequence
  Description of Artificial Sequence: Synthetic polypeptide
AENEIACTNPVATEQYGEYCSENLQRGSGR

SEQ ID NO: 72912 - protein, 29 aa, Artificial Sequence
  Description of Artificial Sequence: Synthetic peptide
AENEIACTNPVATEQYGEYCSSNLQYGGR

SEQ ID NO: 72913 - protein, 28 aa, Artificial Sequence
  Description of Artificial Sequence: Synthetic peptide
AENEIACTNPNATEQYGEASENLQREGR

SEQ ID NO: 72914 - protein, 33 aa, Artificial Sequence
  Description of Artificial Sequence: Synthetic polypeptide
DEEEIRTTNPVATEQYGSVSPTNLDIELEDQIE

SEQ ID NO: 72915 - protein, 33 aa, Artificial Sequence
  Description of Artificial Sequence: Synthetic polypeptide
DTEEIRATNPVATEQYGSVSTNTNDQQGENQNG

SEQ ID NO: 72916 - protein, 33 aa, Artificial Sequence
  Description of Artificial Sequence: Synthetic polypeptide
DTEEIRATNPVATEQYGSVSTNTNMTQEQGNNE

SEQ ID NO: 72917 - protein, 33 aa, Artificial Sequence
  Description of Artificial Sequence: Synthetic polypeptide
DTEEIRATNPVATEQYGSVSTNTNNDQQGENNE

SEQ ID NO: 72918 - protein, 35 aa, Artificial Sequence
  Description of Artificial Sequence: Synthetic polypeptide
DEEEIRTTNPVATEQYGSVSLTMQLQDEVPELNRL

SEQ ID NO: 72919 - protein, 32 aa, Artificial Sequence
  Description of Artificial Sequence: Synthetic polypeptide
DEDEIRTTNPVAYEHYGSVPFQNLSQSQGNAR

SEQ ID NO: 72920 - protein, 33 aa, Artificial Sequence
  Description of Artificial Sequence: Synthetic polypeptide
DTEEIRATNPVATEQYGSVSTNTNNQQQGTNNE

SEQ ID NO: 72921 - protein, 32 aa, Artificial Sequence
  Description of Artificial Sequence: Synthetic polypeptide
DEECIRCTNPVATEAYGSTVSCNEFSQRGGNL

SEQ ID NO: 72922 - protein, 30 aa, Artificial Sequence
  Description of Artificial Sequence: Synthetic polypeptide
AENEIACTNPVATEQYGEWASECNLQRGGR

SEQ ID NO: 72923 - protein, 29 aa, Artificial Sequence
  Description of Artificial Sequence: Synthetic peptide
AENEIACTNPVATEAYGEASINLQRGGGR

SEQ ID NO: 72924 - protein, 30 aa, Artificial Sequence
  Description of Artificial Sequence: Synthetic polypeptide
AENEIACTNPVATEQYGEVTSENLQRGGIE

SEQ ID NO: 72925 - protein, 31 aa, Artificial Sequence
  Description of Artificial Sequence: Synthetic polypeptide
DTEAEIATTNPVAYEPYGVVASATNLQEGNQ

SEQ ID NO: 72926 - protein, 32 aa, Artificial Sequence
  Description of Artificial Sequence: Synthetic polypeptide
DEDEIRTTNPVAYEQWGEVSTPNGNQGDGNMR

SEQ ID NO: 72927 - protein, 32 aa, Artificial Sequence
  Description of Artificial Sequence: Synthetic polypeptide
DEDEIRTTNPVAYEQWGEVSTNLQLNGGNDMH

SEQ ID NO: 72928 - protein, 33 aa, Artificial Sequence
  Description of Artificial Sequence: Synthetic polypeptide
DEEEIRTTNPVATEQYGSVSLYNLDVRIMPEQT

SEQ ID NO: 72929 - protein, 33 aa, Artificial Sequence
  Description of Artificial Sequence: Synthetic polypeptide
DEEEIRTTNPVATEQYGSVSPTNDNEEEGEELD

SEQ ID NO: 72930 - protein, 32 aa, Artificial Sequence
  Description of Artificial Sequence: Synthetic polypeptide
DEDEIRTTNPVAYEQWGEVSTNLNQGDVNMER

SEQ ID NO: 72931 - protein, 33 aa, Artificial Sequence
  Description of Artificial Sequence: Synthetic polypeptide
DEEEIRTTNPVATEQYGSVSLVPNGLQTTIQLV

SEQ ID NO: 72932 - protein, 32 aa, Artificial Sequence
  Description of Artificial Sequence: Synthetic polypeptide
DEDEIRTTNPVAYEQWGEVSTNLNQGDGNMGK

SEQ ID NO: 72933 - protein, 36 aa, Artificial Sequence
  Description of Artificial Sequence: Synthetic polypeptide
DEEEIRTTNPVATEQYGSVSPTNDVLASQQGDNNEE

SEQ ID NO: 72934 - protein, 32 aa, Artificial Sequence
  Description of Artificial Sequence: Synthetic polypeptide
DEEEIRTTNPVATEQYGSVSLVPGGLQTPTQD

SEQ ID NO: 72935 - protein, 32 aa, Artificial Sequence
  Description of Artificial Sequence: Synthetic polypeptide
DTEAEIATTNPVAYEQYGSVATNLQNGDNNSM

SEQ ID NO: 72936 - protein, 31 aa, Artificial Sequence
  Description of Artificial Sequence: Synthetic polypeptide
DEECIATVNPVATEAYGKVSDNLSERGGNNR

SEQ ID NO: 72937 - protein, 32 aa, Artificial Sequence
  Description of Artificial Sequence: Synthetic polypeptide
DTEAEIATTNPVAYEQYGSVATNLQNGDNSDD

SEQ ID NO: 72938 - protein, 34 aa, Artificial Sequence
  Description of Artificial Sequence: Synthetic polypeptide
DEEEIRTTNPVATEQYGSVSLTWLLQNVDPNLNT

SEQ ID NO: 72939 - protein, 31 aa, Artificial Sequence
  Description of Artificial Sequence: Synthetic polypeptide
DEDEIRTTNPVAYEQWGEVSTNLNGEHGNEQ

SEQ ID NO: 72940 - protein, 34 aa, Artificial Sequence
  Description of Artificial Sequence: Synthetic polypeptide
DEEEIRTTNPVATEQYGSVSMDDLTQMGGGENID

SEQ ID NO: 72941 - protein, 33 aa, Artificial Sequence
  Description of Artificial Sequence: Synthetic polypeptide
DEEEIRTTNPVATEQYGSVSLTVTMENGNAILL

SEQ ID NO: 72942 - protein, 32 aa, Artificial Sequence
  Description of Artificial Sequence: Synthetic polypeptide
DEDEIRTTNPVAYEQWGEVSTTNLNQGDGNMK

SEQ ID NO: 72943 - protein, 29 aa, Artificial Sequence
  Description of Artificial Sequence: Synthetic peptide
AENEIACTNPVATEQYGETSENLQLGGER

SEQ ID NO: 72944 - protein, 34 aa, Artificial Sequence
  Description of Artificial Sequence: Synthetic polypeptide
DEEEIRTTNPVATEQYGSVSPTNALEVEIGEELD

SEQ ID NO: 72945 - protein, 29 aa, Artificial Sequence
  Description of Artificial Sequence: Synthetic peptide
AENEIACTNPVATEQYGETASENLQAGGR

SEQ ID NO: 72946 - protein, 29 aa, Artificial Sequence
  Description of Artificial Sequence: Synthetic peptide
DTAEIATTNPCAYEPYGSVSANLQRDNNH

SEQ ID NO: 72947 - protein, 30 aa, Artificial Sequence
  Description of Artificial Sequence: Synthetic polypeptide
AENEIACTNPVATEQYGETASENLQNRGGR

SEQ ID NO: 72948 - protein, 29 aa, Artificial Sequence
  Description of Artificial Sequence: Synthetic peptide
AENEIACTNPVATEQYGETASENLQRGGI

SEQ ID NO: 72949 - protein, 34 aa, Artificial Sequence
  Description of Artificial Sequence: Synthetic polypeptide
DEEEIRTTNPVATEQYGSVSMENLDDPGNSEQID

SEQ ID NO: 72950 - protein, 28 aa, Artificial Sequence
  Description of Artificial Sequence: Synthetic peptide
AENEIACTNPVATEFYGEASENLQRVGR

SEQ ID NO: 72951 - protein, 29 aa, Artificial Sequence
  Description of Artificial Sequence: Synthetic peptide
AENEIACTNPVATEFYGEASENLQGRGGR

SEQ ID NO: 72952 - protein, 28 aa, Artificial Sequence
  Description of Artificial Sequence: Synthetic peptide
AENEIACTNPVATEFYGEAPENLQRGGR

SEQ ID NO: 72953 - protein, 29 aa, Artificial Sequence
  Description of Artificial Sequence: Synthetic peptide
AENEIACTNPVATEQYGETASENLQRGPI

SEQ ID NO: 72954 - protein, 28 aa, Artificial Sequence
  Description of Artificial Sequence: Synthetic peptide
AENEIACTNPVATEEYGEASENLQRGGC

SEQ ID NO: 72955 - protein, 28 aa, Artificial Sequence
  Description of Artificial Sequence: Synthetic peptide
AENEIACTNPVATEEWGEASENLQRGGR

SEQ ID NO: 72956 - protein, 29 aa, Artificial Sequence
  Description of Artificial Sequence: Synthetic peptide
AENEIACTNPVATECYGEVSEINEQRGGR

SEQ ID NO: 72957 - protein, 32 aa, Artificial Sequence
  Description of Artificial Sequence: Synthetic polypeptide
DEDEIRTTNPVAYEQWGNVSTNLQGQDQGNNA

SEQ ID NO: 72958 - protein, 31 aa, Artificial Sequence
  Description of Artificial Sequence: Synthetic polypeptide
DEECIATTNPVAYEQYSEEVTTNLQQGGENR

SEQ ID NO: 72959 - protein, 33 aa, Artificial Sequence
  Description of Artificial Sequence: Synthetic polypeptide
DEDEIRTTNPVAYEQWGEVSVTNLNQGDGNMDR

SEQ ID NO: 72960 - protein, 34 aa, Artificial Sequence
  Description of Artificial Sequence: Synthetic polypeptide
DEEEIRTTNPVATEQYGSVSLNWLLQQVDVNLDG

SEQ ID NO: 72961 - protein, 31 aa, Artificial Sequence
  Description of Artificial Sequence: Synthetic polypeptide
DEDEIRTTNPVAYEQWGEVSTNLNDGDGGMR

SEQ ID NO: 72962 - protein, 31 aa, Artificial Sequence
  Description of Artificial Sequence: Synthetic polypeptide
DTEAEIATTNPVAYEQYGSVATNLQNPADRN

SEQ ID NO: 72963 - protein, 28 aa, Artificial Sequence
  Description of Artificial Sequence: Synthetic peptide
AENEIACTNPVATEQYGEVSECLQHGEL

SEQ ID NO: 72964 - protein, 34 aa, Artificial Sequence
  Description of Artificial Sequence: Synthetic polypeptide
DEEEIRTTNPVATEQYGSVSPTNGVIMTNGALRS

SEQ ID NO: 72965 - protein, 28 aa, Artificial Sequence
  Description of Artificial Sequence: Synthetic peptide
AENEIACTNPVATECYGEASENEQRGGR

SEQ ID NO: 72966 - protein, 30 aa, Artificial Sequence
  Description of Artificial Sequence: Synthetic polypeptide
DEDEIRTTNPVAYEQWGETSTNLQSGDMSD

SEQ ID NO: 72967 - protein, 28 aa, Artificial Sequence
  Description of Artificial Sequence: Synthetic peptide
AENEIACTNPVATECWGSASENLQRGGG

SEQ ID NO: 72968 - protein, 35 aa, Artificial Sequence
  Description of Artificial Sequence: Synthetic polypeptide
DEEEIRTTNPVATEQYGSVSLTPNGEHRENVEVRA

SEQ ID NO: 72969 - protein, 35 aa, Artificial Sequence
  Description of Artificial Sequence: Synthetic polypeptide
DEEEIRTTNPVATEQYGSVSLTPNGDQQRGLVELI

SEQ ID NO: 72970 - protein, 29 aa, Artificial Sequence
  Description of Artificial Sequence: Synthetic peptide
AENEIACTNPVATECWGSASCNEQREGNR

SEQ ID NO: 72971 - protein, 30 aa, Artificial Sequence
  Description of Artificial Sequence: Synthetic polypeptide
DEDEIRTTNPVAYEQWGETSTNDQRGMDSD

SEQ ID NO: 72972 - protein, 31 aa, Artificial Sequence
  Description of Artificial Sequence: Synthetic polypeptide
DTEEIATTNPVATTQWGSVATNGGQDNGNHR

SEQ ID NO: 72973 - protein, 30 aa, Artificial Sequence
  Description of Artificial Sequence: Synthetic polypeptide
AENEIACTNPVATEQYGEVSEDNLQFEGGR

SEQ ID NO: 72974 - protein, 32 aa, Artificial Sequence
  Description of Artificial Sequence: Synthetic polypeptide
DTEEIATTNPVATTQYGSVSTDGDHQNGGNHR

SEQ ID NO: 72975 - protein, 31 aa, Artificial Sequence
  Description of Artificial Sequence: Synthetic polypeptide
DTEEIATTNPVATTQYGTVSTPNGDGNGNHR

SEQ ID NO: 72976 - protein, 31 aa, Artificial Sequence
  Description of Artificial Sequence: Synthetic polypeptide
DTEEIATTNPVAYMQYGSVSTNGVQNDGNHN

SEQ ID NO: 72977 - protein, 30 aa, Artificial Sequence
  Description of Artificial Sequence: Synthetic polypeptide
AENEIACTNPVATEQYGEVSSEPALNRGNR

SEQ ID NO: 72978 - protein, 30 aa, Artificial Sequence
  Description of Artificial Sequence: Synthetic polypeptide
AENEIACTNPVATEQYGEVSCINEQREGGR

SEQ ID NO: 72979 - protein, 31 aa, Artificial Sequence
  Description of Artificial Sequence: Synthetic polypeptide
DEDEIRTTNPVAYEQWGEVSTNLNAGDMGNA

SEQ ID NO: 72980 - protein, 30 aa, Artificial Sequence
  Description of Artificial Sequence: Synthetic polypeptide
AENEIACTNPVATEQYGEVSAENLQDHGGR

SEQ ID NO: 72981 - protein, 29 aa, Artificial Sequence
  Description of Artificial Sequence: Synthetic peptide
AENEIACTNPVATECYGEASENLQRKGGR

SEQ ID NO: 72982 - protein, 31 aa, Artificial Sequence
  Description of Artificial Sequence: Synthetic polypeptide
DTEAEIATTNPVAYEQYGSVATNLQNRHDDD

SEQ ID NO: 72983 - protein, 33 aa, Artificial Sequence
  Description of Artificial Sequence: Synthetic polypeptide
DEEEIRTTNPVATEQYGSVSLTVNMEHGESILL

SEQ ID NO: 72984 - protein, 29 aa, Artificial Sequence
  Description of Artificial Sequence: Synthetic peptide
AENEIACTNPVATEQYGETSNENLQRGGI

SEQ ID NO: 72985 - protein, 31 aa, Artificial Sequence
  Description of Artificial Sequence: Synthetic polypeptide
DTEAEIATTNPVAYEQYGSVATNLQNSGDSM

SEQ ID NO: 72986 - protein, 32 aa, Artificial Sequence
  Description of Artificial Sequence: Synthetic polypeptide
DTEAEIATTNPVAYEQYGSVATNLQRPGETLH

SEQ ID NO: 72987 - protein, 34 aa, Artificial Sequence
  Description of Artificial Sequence: Synthetic polypeptide
DEEEIRTTNPVATEQYGSVSLTTLQVTESSNAID

SEQ ID NO: 72988 - protein, 31 aa, Artificial Sequence
  Description of Artificial Sequence: Synthetic polypeptide
AENEIACTNPVATEQYGEVAESENFLQRGGR

SEQ ID NO: 72989 - protein, 34 aa, Artificial Sequence
  Description of Artificial Sequence: Synthetic polypeptide
DEEEIRTTNPVATEQYGSVSLTSSLVRENLTIAD

SEQ ID NO: 72990 - protein, 34 aa, Artificial Sequence
  Description of Artificial Sequence: Synthetic polypeptide
DEEEIRTTNPVATEQYGSVSLTSSLQPVFLGIMD

SEQ ID NO: 72991 - protein, 34 aa, Artificial Sequence
  Description of Artificial Sequence: Synthetic polypeptide
DEEEIRTTNPVATEQYGSVSLTSSLERENLSIQD

SEQ ID NO: 72992 - protein, 31 aa, Artificial Sequence
  Description of Artificial Sequence: Synthetic polypeptide
AENEIACTNPVATEQYGEVASENLQRMGEGR

SEQ ID NO: 72993 - protein, 30 aa, Artificial Sequence
  Description of Artificial Sequence: Synthetic polypeptide
AENEIACTNPVATEQYGEVASENLSQRGGQ

SEQ ID NO: 72994 - protein, 31 aa, Artificial Sequence
  Description of Artificial Sequence: Synthetic polypeptide
DTEEIACTNPVATEQYGCVATNLQERNNDPQ

SEQ ID NO: 72995 - protein, 30 aa, Artificial Sequence
  Description of Artificial Sequence: Synthetic polypeptide
AENEIACTNPVATEQYGEVCSEDNLQFGGR

SEQ ID NO: 72996 - protein, 35 aa, Artificial Sequence
  Description of Artificial Sequence: Synthetic polypeptide
DEEEIRTTNPVATEQYGSVSPTNGNLQQRIVDEAE

SEQ ID NO: 72997 - protein, 32 aa, Artificial Sequence
  Description of Artificial Sequence: Synthetic polypeptide
DEECIATVNPVATEAYGSVSCDNMLERGGNNR

SEQ ID NO: 72998 - protein, 29 aa, Artificial Sequence
  Description of Artificial Sequence: Synthetic peptide
AENEIACTNPCATEQYGEASENLQSRGGR

SEQ ID NO: 72999 - protein, 29 aa, Artificial Sequence
  Description of Artificial Sequence: Synthetic peptide
AENEIACTNPCATEQYGEASENLQRPGGR

SEQ ID NO: 73000 - protein, 28 aa, Artificial Sequence
  Description of Artificial Sequence: Synthetic peptide
AENEIACTNPCATEQYGEASENLQRGGG

SEQ ID NO: 73001 - protein, 31 aa, Artificial Sequence
  Description of Artificial Sequence: Synthetic polypeptide
DEDEIRTTNPVAYEAYGSTVSTGNPTMVGNA

SEQ ID NO: 73002 - protein, 35 aa, Artificial Sequence
  Description of Artificial Sequence: Synthetic polypeptide
DEEEIRTTNPVATEQYGSVSITNMNGTGQGGNQGE

SEQ ID NO: 73003 - protein, 31 aa, Artificial Sequence
  Description of Artificial Sequence: Synthetic polypeptide
DTEEIRTTNPCATEHWGSVYFNDSQQRGENR

SEQ ID NO: 73004 - protein, 31 aa, Artificial Sequence
  Description of Artificial Sequence: Synthetic polypeptide
DTEEIRTTNPCATEHWGSVYFNDSQRGEGNR

SEQ ID NO: 73005 - protein, 32 aa, Artificial Sequence
  Description of Artificial Sequence: Synthetic polypeptide
DTEEIRTTNPCATEHWGSVYFNELDQRDGNDR

SEQ ID NO: 73006 - protein, 34 aa, Artificial Sequence
  Description of Artificial Sequence: Synthetic polypeptide
DEVEIRTTNPVATEQYGSVSNTVNGLEGGNGNID

SEQ ID NO: 73007 - protein, 30 aa, Artificial Sequence
  Description of Artificial Sequence: Synthetic polypeptide
DTEEIRTTNPCATEHWGSVYFNEQRDENDR

SEQ ID NO: 73008 - protein, 31 aa, Artificial Sequence
  Description of Artificial Sequence: Synthetic polypeptide
DTEEIRTTNPCATEHWGSVYFNLQDREENDR

SEQ ID NO: 73009 - protein, 31 aa, Artificial Sequence
  Description of Artificial Sequence: Synthetic polypeptide
DTEEIRTTNPCATEHYGCVCSWNLQRFNSDQ

SEQ ID NO: 73010 - protein, 31 aa, Artificial Sequence
  Description of Artificial Sequence: Synthetic polypeptide
DTEEIRTTNPCATEHYGCVCSWNLQRNSNQA

SEQ ID NO: 73011 - protein, 33 aa, Artificial Sequence
  Description of Artificial Sequence: Synthetic polypeptide
DEVEIRTTNPVATEQYGSVSNTNDEPTGQGNIG

SEQ ID NO: 73012 - protein, 31 aa, Artificial Sequence
  Description of Artificial Sequence: Synthetic polypeptide
DEDEIRTTNPVAYEAWGEVSTNLQLDGDNQE

SEQ ID NO: 73013 - protein, 33 aa, Artificial Sequence
  Description of Artificial Sequence: Synthetic polypeptide
DEVEIRTTNPVATEQYGSVSNNNIGQETGGNND

SEQ ID NO: 73014 - protein, 28 aa, Artificial Sequence
  Description of Artificial Sequence: Synthetic peptide
AEMEIVCTNPVATEQYGEASENPERGGR

SEQ ID NO: 73015 - protein, 28 aa, Artificial Sequence
  Description of Artificial Sequence: Synthetic peptide
AENEIACTNPVATEQYGVASETLQHGDR

SEQ ID NO: 73016 - protein, 31 aa, Artificial Sequence
  Description of Artificial Sequence: Synthetic polypeptide
DEDEIRTTNPVAYEAYGSVSNNELSPRGGSP

SEQ ID NO: 73017 - protein, 29 aa, Artificial Sequence
  Description of Artificial Sequence: Synthetic peptide
AENEIACTNPVATEQYGVEASENLARGGR

SEQ ID NO: 73018 - protein, 29 aa, Artificial Sequence
  Description of Artificial Sequence: Synthetic peptide
AENAIACTNPVATEQYGEASENLQIRGGR

SEQ ID NO: 73019 - protein, 32 aa, Artificial Sequence
  Description of Artificial Sequence: Synthetic polypeptide
DEECIRTTNPVACEQYGVVCTIEDGQRGNQNR

SEQ ID NO: 73020 - protein, 31 aa, Artificial Sequence
  Description of Artificial Sequence: Synthetic polypeptide
DEDEIRTTNPVAYECWGEVSTNLQLGGNDMQ

SEQ ID NO: 73021 - protein, 35 aa, Artificial Sequence
  Description of Artificial Sequence: Synthetic polypeptide
DEEEIRTTNPVATEQYGSVSITSNLSQQQNEEPLE

SEQ ID NO: 73022 - protein, 29 aa, Artificial Sequence
  Description of Artificial Sequence: Synthetic peptide
AENAIACTNPVATEQYGTEASENLQRGGR

SEQ ID NO: 73023 - protein, 29 aa, Artificial Sequence
  Description of Artificial Sequence: Synthetic peptide
AENAIACTNPVATEQYGEASENLQRVGGR

SEQ ID NO: 73024 - protein, 30 aa, Artificial Sequence
  Description of Artificial Sequence: Synthetic polypeptide
AENEIACTNPVATEQYGTEASELNLQRGGR

SEQ ID NO: 73025 - protein, 29 aa, Artificial Sequence
  Description of Artificial Sequence: Synthetic peptide
AENEIACTNPVATEQYGTEASENLQRGGP

SEQ ID NO: 73026 - protein, 33 aa, Artificial Sequence
  Description of Artificial Sequence: Synthetic polypeptide
DTEEIRTTNPCATEAYGSVSTVTNLQRTEENTD

SEQ ID NO: 73027 - protein, 30 aa, Artificial Sequence
  Description of Artificial Sequence: Synthetic polypeptide
AENEIACTNPVATEQYGTEASENLQRVGGR

SEQ ID NO: 73028 - protein, 33 aa, Artificial Sequence
  Description of Artificial Sequence: Synthetic polypeptide
DTEEIRTTNPCATEAYGSVSTVTNNLQREENQD

SEQ ID NO: 73029 - protein, 33 aa, Artificial Sequence
  Description of Artificial Sequence: Synthetic polypeptide
DTEEIRTTNPCATEAYGSVSTVTNNLQREENTQ

SEQ ID NO: 73030 - protein, 33 aa, Artificial Sequence
  Description of Artificial Sequence: Synthetic polypeptide
DTEEIRTTNPCATEAYGSVSTVTNNLQRTENED

SEQ ID NO: 73031 - protein, 33 aa, Artificial Sequence
  Description of Artificial Sequence: Synthetic polypeptide
DEVEIRTTNPVATEQYGSVSSDNLTEMGENNIQ

SEQ ID NO: 73032 - protein, 29 aa, Artificial Sequence
  Description of Artificial Sequence: Synthetic peptide
AENAIACTNPVATEQYGEASENLQRGGDR

SEQ ID NO: 73033 - protein, 31 aa, Artificial Sequence
  Description of Artificial Sequence: Synthetic polypeptide
DEECIRTTNPSATEQYGCVISTGNLAHFHNA

SEQ ID NO: 73034 - protein, 32 aa, Artificial Sequence
  Description of Artificial Sequence: Synthetic polypeptide
DEECIRTTNPVACEQYGQVSTGGDVQRGGNNH

SEQ ID NO: 73035 - protein, 28 aa, Artificial Sequence
  Description of Artificial Sequence: Synthetic peptide
AENAIACTNPVATEQYGEASENLQKGGR

SEQ ID NO: 73036 - protein, 31 aa, Artificial Sequence
  Description of Artificial Sequence: Synthetic polypeptide
DEECIRTTNPCATEQWGSVIGVNLTDESGNR

SEQ ID NO: 73037 - protein, 32 aa, Artificial Sequence
  Description of Artificial Sequence: Synthetic polypeptide
DEVEIRTTNPVATEQYGSVSMNEDQMVGEDDI

SEQ ID NO: 73038 - protein, 31 aa, Artificial Sequence
  Description of Artificial Sequence: Synthetic polypeptide
DTEEIRTTNPQATEHYGSVSFNLLQREETDD

SEQ ID NO: 73039 - protein, 33 aa, Artificial Sequence
  Description of Artificial Sequence: Synthetic polypeptide
DTEEIRTTNPVATEQYGEVSCINHSGRTGGENR

SEQ ID NO: 73040 - protein, 33 aa, Artificial Sequence
  Description of Artificial Sequence: Synthetic polypeptide
DEVEIRTTNPVATEQYGSVSIDNDTTGQGGNQD

SEQ ID NO: 73041 - protein, 34 aa, Artificial Sequence
  Description of Artificial Sequence: Synthetic polypeptide
DTEEIRTTNPVATEQYGSVCPTNMLDERGGDNSE

SEQ ID NO: 73042 - protein, 32 aa, Artificial Sequence
  Description of Artificial Sequence: Synthetic polypeptide
DTEEIRTTNPVATEQYGSVSNKPTDRAGNGSN

SEQ ID NO: 73043 - protein, 33 aa, Artificial Sequence
  Description of Artificial Sequence: Synthetic polypeptide
DEVEIRTTNPVATEQYGSVSGTNNMNGEGGNGQ

SEQ ID NO: 73044 - protein, 33 aa, Artificial Sequence
  Description of Artificial Sequence: Synthetic polypeptide
DEVEIRTTNPVATEQYGSVSGTNNMNDVGNDGE

SEQ ID NO: 73045 - protein, 32 aa, Artificial Sequence
  Description of Artificial Sequence: Synthetic polypeptide
AEMEIRTTNPVATEQYGSVSNTNLERDSTQGE

SEQ ID NO: 73046 - protein, 33 aa, Artificial Sequence
  Description of Artificial Sequence: Synthetic polypeptide
DEVEIRTTNPVATEQYGSVSGTNNMNDVGGGND

SEQ ID NO: 73047 - protein, 34 aa, Artificial Sequence
  Description of Artificial Sequence: Synthetic polypeptide
DEEEIRTTNPVATEQYGSVSITNLFGEFTGEGGE

SEQ ID NO: 73048 - protein, 34 aa, Artificial Sequence
  Description of Artificial Sequence: Synthetic polypeptide
DEEEIRTTNPVATEQYGSVSITNLETQSDVEEPV

SEQ ID NO: 73049 - protein, 34 aa, Artificial Sequence
  Description of Artificial Sequence: Synthetic polypeptide
DEVEIRTTNPVATEQYGSVSGTNEGQQEGGGNGG

SEQ ID NO: 73050 - protein, 32 aa, Artificial Sequence
  Description of Artificial Sequence: Synthetic polypeptide
DEDEIRTTNPVATTQYGVVSTNNNLEEGTNNQ

SEQ ID NO: 73051 - protein, 34 aa, Artificial Sequence
  Description of Artificial Sequence: Synthetic polypeptide
DEEEIRTTNPVATEQYGSVSITNLDPVIGGGGQE

SEQ ID NO: 73052 - protein, 30 aa, Artificial Sequence
  Description of Artificial Sequence: Synthetic polypeptide
DEECIRTTNPVATEIYGCVGTELQNFGSDQ

SEQ ID NO: 73053 - protein, 31 aa, Artificial Sequence
  Description of Artificial Sequence: Synthetic polypeptide
DEECIRTTNPVATEIYGCVQTELQNFGSNQS

SEQ ID NO: 73054 - protein, 32 aa, Artificial Sequence
  Description of Artificial Sequence: Synthetic polypeptide
DEDEIRTTNPVATTQYGVVSTTNLEEGTNNNA

SEQ ID NO: 73055 - protein, 32 aa, Artificial Sequence
  Description of Artificial Sequence: Synthetic polypeptide
DTEEIRTTNPQATEHYGSVSFMNLEQPRNNQN

SEQ ID NO: 73056 - protein, 32 aa, Artificial Sequence
  Description of Artificial Sequence: Synthetic polypeptide
DEDEIRTTNPVATTQYGVVSTTNLENGNNEEQ

SEQ ID NO: 73057 - protein, 31 aa, Artificial Sequence
  Description of Artificial Sequence: Synthetic polypeptide
DEECIRTTNPVATEIYGCVCGTELQNSGSNQ

SEQ ID NO: 73058 - protein, 31 aa, Artificial Sequence
  Description of Artificial Sequence: Synthetic polypeptide
DTEEIRTTNPQATEHYGSVSFNLQREESFGE

SEQ ID NO: 73059 - protein, 32 aa, Artificial Sequence
  Description of Artificial Sequence: Synthetic polypeptide
DTEEIRTTNPQATEHYGSVSFNLQSSEENQRE

SEQ ID NO: 73060 - protein, 31 aa, Artificial Sequence
  Description of Artificial Sequence: Synthetic polypeptide
DTEEIRTTNPQATEHYGSVSFNLQWSEENQE

SEQ ID NO: 73061 - protein, 31 aa, Artificial Sequence
  Description of Artificial Sequence: Synthetic polypeptide
DTEEIRTTNPQAYEHYGSVTSFNLQREENQE

SEQ ID NO: 73062 - protein, 30 aa, Artificial Sequence
  Description of Artificial Sequence: Synthetic polypeptide
DTEEIRTTNPSATETYGSVSVVNAQAENVI

SEQ ID NO: 73063 - protein, 33 aa, Artificial Sequence
  Description of Artificial Sequence: Synthetic polypeptide
DEDEIRTTNPVAVEQYGSVISTNGGERGNGNGG

SEQ ID NO: 73064 - protein, 31 aa, Artificial Sequence
  Description of Artificial Sequence: Synthetic polypeptide
DTEEIRTTNPVATEQWGSVTVTLLQQGTTED

SEQ ID NO: 73065 - protein, 31 aa, Artificial Sequence
  Description of Artificial Sequence: Synthetic polypeptide
DTEEIRTTNPVATEQWGSVTVTTLLQNEGTE

SEQ ID NO: 73066 - protein, 31 aa, Artificial Sequence
  Description of Artificial Sequence: Synthetic polypeptide
DTEEIRTTNPVATEQWGSVTVTTLLQQGTEF

SEQ ID NO: 73067 - protein, 31 aa, Artificial Sequence
  Description of Artificial Sequence: Synthetic polypeptide
DEECIRTTNPVATEIYGCVCFTELQNGSNQS

SEQ ID NO: 73068 - protein, 32 aa, Artificial Sequence
  Description of Artificial Sequence: Synthetic polypeptide
DTEEIRTTNPVATEQWGSVTVVTNLNLQEGTE

SEQ ID NO: 73069 - protein, 32 aa, Artificial Sequence
  Description of Artificial Sequence: Synthetic polypeptide
DTEEIRTTNPVATEQWGSVVTVTNLLQQGTET

SEQ ID NO: 73070 - protein, 31 aa, Artificial Sequence
  Description of Artificial Sequence: Synthetic polypeptide
DTEEIRTTNPVATEQWGVVTVSTLLQQGETE

SEQ ID NO: 73071 - protein, 32 aa, Artificial Sequence
  Description of Artificial Sequence: Synthetic polypeptide
DTEEIRTTNPVATEQWGVVTVTNLLEQQGNTE

SEQ ID NO: 73072 - protein, 29 aa, Artificial Sequence
  Description of Artificial Sequence: Synthetic peptide
AENEIACTNPVATEQYGVEAVENLQRGGR

SEQ ID NO: 73073 - protein, 30 aa, Artificial Sequence
  Description of Artificial Sequence: Synthetic polypeptide
DTEEIRTTNPVATEQWGVVVTVTQLQQGTE

SEQ ID NO: 73074 - protein, 34 aa, Artificial Sequence
  Description of Artificial Sequence: Synthetic polypeptide
DEEEIRTTNPVATEQYGSVSMETNLENTQVDPIE

SEQ ID NO: 73075 - protein, 32 aa, Artificial Sequence
  Description of Artificial Sequence: Synthetic polypeptide
DTEEIRTTNPCATEAYGSVSTVANLQGEENDT

SEQ ID NO: 73076 - protein, 31 aa, Artificial Sequence
  Description of Artificial Sequence: Synthetic polypeptide
DEDEIRTTNPVAYECWGSVATNLQGDGDNVN

SEQ ID NO: 73077 - protein, 35 aa, Artificial Sequence
  Description of Artificial Sequence: Synthetic polypeptide
DEEEIRTTNPVATEQYGSVSPTNLLQQRIVDEVDI

SEQ ID NO: 73078 - protein, 30 aa, Artificial Sequence
  Description of Artificial Sequence: Synthetic polypeptide
DEDEIRTTNPVAYECWGVVSTNLQGGGDDA

SEQ ID NO: 73079 - protein, 33 aa, Artificial Sequence
  Description of Artificial Sequence: Synthetic polypeptide
DTEEIRATNPVATEQYGSVVVTTNLQQGNEGTD

SEQ ID NO: 73080 - protein, 30 aa, Artificial Sequence
  Description of Artificial Sequence: Synthetic polypeptide
DEDEIRTTNPVAYECWGVVSTNLQGDGDTA

SEQ ID NO: 73081 - protein, 30 aa, Artificial Sequence
  Description of Artificial Sequence: Synthetic polypeptide
DEDEIRTTNPVAYECWGVVSTNLQAGGDAE

SEQ ID NO: 73082 - protein, 30 aa, Artificial Sequence
  Description of Artificial Sequence: Synthetic polypeptide
AENEIACTNPVATEQYGNASANNLQSRGGR

SEQ ID NO: 73083 - protein, 33 aa, Artificial Sequence
  Description of Artificial Sequence: Synthetic polypeptide
DEECIRCTNPVATEQYGSVSWNEGEQDRQGGTR

SEQ ID NO: 73084 - protein, 33 aa, Artificial Sequence
  Description of Artificial Sequence: Synthetic polypeptide
DEECIRCTNPVATEQYGSVSWNEGEQERNGSNT

SEQ ID NO: 73085 - protein, 34 aa, Artificial Sequence
  Description of Artificial Sequence: Synthetic polypeptide
DEECIRCTNPVATEQYGSVSWNEGEQERQGDNRD

SEQ ID NO: 73086 - protein, 33 aa, Artificial Sequence
  Description of Artificial Sequence: Synthetic polypeptide
DEEEIRTTNPVATEQYGSVSLLELQTSNENMQP

SEQ ID NO: 73087 - protein, 33 aa, Artificial Sequence
  Description of Artificial Sequence: Synthetic polypeptide
DEECIRCTNPVATEQYGSVSWNEGEQERQGNQM

SEQ ID NO: 73088 - protein, 34 aa, Artificial Sequence
  Description of Artificial Sequence: Synthetic polypeptide
DEVEIRTTNPVATEQYGSVSTLNNINQATSGNVD

SEQ ID NO: 73089 - protein, 34 aa, Artificial Sequence
  Description of Artificial Sequence: Synthetic polypeptide
DEEEIRTTNPVATEQYGSVSLINEQFRTMVIERI

SEQ ID NO: 73090 - protein, 30 aa, Artificial Sequence
  Description of Artificial Sequence: Synthetic polypeptide
AENEIACTNPVATEQYGQEAASENLQRGGR

SEQ ID NO: 73091 - protein, 29 aa, Artificial Sequence
  Description of Artificial Sequence: Synthetic peptide
AENEIACTNPVATEQYGSASAEDLERGER

SEQ ID NO: 73092 - protein, 31 aa, Artificial Sequence
  Description of Artificial Sequence: Synthetic polypeptide
DEECIRCTNPVATEQYGSVCSWNNQNFGSEL

SEQ ID NO: 73093 - protein, 33 aa, Artificial Sequence
  Description of Artificial Sequence: Synthetic polypeptide
DEEEIRTTNPVATEQYGSVSLGLEQHQMEVERE

SEQ ID NO: 73094 - protein, 32 aa, Artificial Sequence
  Description of Artificial Sequence: Synthetic polypeptide
DEDEIRTTNPVAYECYGSVSTPNQGGNQGNGR

SEQ ID NO: 73095 - protein, 29 aa, Artificial Sequence
  Description of Artificial Sequence: Synthetic peptide
DEECIRCTNPVATEQYGSQSWPVFEGGNE

SEQ ID NO: 73096 - protein, 29 aa, Artificial Sequence
  Description of Artificial Sequence: Synthetic peptide
AENEIACTNPCATEQYGEASENLQRGAGR

SEQ ID NO: 73097 - protein, 28 aa, Artificial Sequence
  Description of Artificial Sequence: Synthetic peptide
AENEIACTNPCATEHYGEASENLQRGGR

SEQ ID NO: 73098 - protein, 29 aa, Artificial Sequence
  Description of Artificial Sequence: Synthetic peptide
AENEIACTNPAATEQYGEASENLQKRGGR

SEQ ID NO: 73099 - protein, 31 aa, Artificial Sequence
  Description of Artificial Sequence: Synthetic polypeptide
DEECIRCTNPVATEQYGCVCSWNNQYGSNQA

SEQ ID NO: 73100 - protein, 35 aa, Artificial Sequence
  Description of Artificial Sequence: Synthetic polypeptide
DEEEIRTTNPVATEQYGSVSPTNLLLIQEDPSNLI

SEQ ID NO: 73101 - protein, 32 aa, Artificial Sequence
  Description of Artificial Sequence: Synthetic polypeptide
DEECIRCTNPVATEQYGCVSNWNHQRFGSNQS

SEQ ID NO: 73102 - protein, 29 aa, Artificial Sequence
  Description of Artificial Sequence: Synthetic peptide
AENEIACTNPVATEQYGNAAAENLQRGGR

SEQ ID NO: 73103 - protein, 28 aa, Artificial Sequence
  Description of Artificial Sequence: Synthetic peptide
AENEIACTNAVATEQYGEASENLQYGGR

SEQ ID NO: 73104 - protein, 32 aa, Artificial Sequence
  Description of Artificial Sequence: Synthetic polypeptide
DEDEIRTTNPVAYEEWGSVATNLQRDGQNGDM

SEQ ID NO: 73105 - protein, 32 aa, Artificial Sequence
  Description of Artificial Sequence: Synthetic polypeptide
DEECIRCTNPVATEQYGCVSWNDQERFGSNQS

SEQ ID NO: 73106 - protein, 28 aa, Artificial Sequence
  Description of Artificial Sequence: Synthetic peptide
AENEIACTNAVATEQYGEASENLQRGGV

SEQ ID NO: 73107 - protein, 28 aa, Artificial Sequence
  Description of Artificial Sequence: Synthetic peptide
AENEIACTNAVATEQYGEASENLQHGGR

SEQ ID NO: 73108 - protein, 28 aa, Artificial Sequence
  Description of Artificial Sequence: Synthetic peptide
AENEIACTNAVATEPYGEASENLQRGGR

SEQ ID NO: 73109 - protein, 33 aa, Artificial Sequence
  Description of Artificial Sequence: Synthetic polypeptide
DTEEIRATNPVATEQYGSVVVSTTNLQNGTTDD

SEQ ID NO: 73110 - protein, 33 aa, Artificial Sequence
  Description of Artificial Sequence: Synthetic polypeptide
DTEEIRATNPVATEQYGSVVVSVTNLQNGTEEN

SEQ ID NO: 73111 - protein, 32 aa, Artificial Sequence
  Description of Artificial Sequence: Synthetic polypeptide
DEECIRCTNPVATEQYGSVCSWAHQRFGSNQS

SEQ ID NO: 73112 - protein, 33 aa, Artificial Sequence
  Description of Artificial Sequence: Synthetic polypeptide
DEEEIRTTNPVATEQYGSVSITTSVGMGGGNGG

SEQ ID NO: 73113 - protein, 32 aa, Artificial Sequence
  Description of Artificial Sequence: Synthetic polypeptide
DEECIRCTNPVATEQYGSVSWNEGEQNRNGDL

SEQ ID NO: 73114 - protein, 30 aa, Artificial Sequence
  Description of Artificial Sequence: Synthetic polypeptide
AENEIACTNPVATEQYGSASAENLQDRGGL

SEQ ID NO: 73115 - protein, 29 aa, Artificial Sequence
  Description of Artificial Sequence: Synthetic peptide
AENEIACTNPVATEQYGSVSTDLEDHGEL

SEQ ID NO: 73116 - protein, 28 aa, Artificial Sequence
  Description of Artificial Sequence: Synthetic peptide
AENCIACTNPVATEQYGEASENLQVGGR

SEQ ID NO: 73117 - protein, 33 aa, Artificial Sequence
  Description of Artificial Sequence: Synthetic polypeptide
DEEEIRTTNPVATEQYGSVSIVNGTGGNGDNET

SEQ ID NO: 73118 - protein, 34 aa, Artificial Sequence
  Description of Artificial Sequence: Synthetic polypeptide
DEVEIRTTNPVATEQYGSVSTDTGLGQNEGQGNI

SEQ ID NO: 73119 - protein, 33 aa, Artificial Sequence
  Description of Artificial Sequence: Synthetic polypeptide
DEEEIRTTNPVATEQYGSVSIVNGITGGNGNDD

SEQ ID NO: 73120 - protein, 29 aa, Artificial Sequence
  Description of Artificial Sequence: Synthetic peptide
AENCIACTNPVATEQYGEASENLQRGGVR

SEQ ID NO: 73121 - protein, 32 aa, Artificial Sequence
  Description of Artificial Sequence: Synthetic polypeptide
DTEEIRSTNPVAYEQWGSNVSTNLQGNMGDTR

SEQ ID NO: 73122 - protein, 34 aa, Artificial Sequence
  Description of Artificial Sequence: Synthetic polypeptide
DEVEIRTTNPVATEQYGSVSTDNGEQEGGNGNGQ

SEQ ID NO: 73123 - protein, 35 aa, Artificial Sequence
  Description of Artificial Sequence: Synthetic polypeptide
DEEEIRTTNPVATEQYGSVSITVNMQNIGLGNEQI

SEQ ID NO: 73124 - protein, 28 aa, Artificial Sequence
  Description of Artificial Sequence: Synthetic peptide
AENEIACTNPVATEQYGTASENIQRGGH

SEQ ID NO: 73125 - protein, 28 aa, Artificial Sequence
  Description of Artificial Sequence: Synthetic peptide
AENEIACTNPVATEQYGTASENLQQGGH

SEQ ID NO: 73126 - protein, 35 aa, Artificial Sequence
  Description of Artificial Sequence: Synthetic polypeptide
DEEEIRTTNPVATEQYGSVSITVNFTGQAEGGGNI

SEQ ID NO: 73127 - protein, 29 aa, Artificial Sequence
  Description of Artificial Sequence: Synthetic peptide
AENEIACTNPVATEQYGTASENLQRGGGQ

SEQ ID NO: 73128 - protein, 34 aa, Artificial Sequence
  Description of Artificial Sequence: Synthetic polypeptide
DEEEIRTTNPVATEQYGSVSITVGPNAVGFQDGN

SEQ ID NO: 73129 - protein, 33 aa, Artificial Sequence
  Description of Artificial Sequence: Synthetic polypeptide
DEEEIRTTNPVATEQYGSVSITVEGDGGGENEG

SEQ ID NO: 73130 - protein, 28 aa, Artificial Sequence
  Description of Artificial Sequence: Synthetic peptide
AENCIACTNPVATEQYGELSENLQRGGE

SEQ ID NO: 73131 - protein, 32 aa, Artificial Sequence
  Description of Artificial Sequence: Synthetic polypeptide
DEECIRCTNPVATEQYGSVSWNEGEQTGGGNL

SEQ ID NO: 73132 - protein, 29 aa, Artificial Sequence
  Description of Artificial Sequence: Synthetic peptide
AENCIACTNPVATEQYGEMSENLQRGGRG

SEQ ID NO: 73133 - protein, 33 aa, Artificial Sequence
  Description of Artificial Sequence: Synthetic polypeptide
DEVEIRTTNPVATEQYGSVSTGDDQNIGGENIN

SEQ ID NO: 73134 - protein, 35 aa, Artificial Sequence
  Description of Artificial Sequence: Synthetic polypeptide
DEEEIRTTNPVATEQYGSVSPTNLPLLLREGEAPL

SEQ ID NO: 73135 - protein, 34 aa, Artificial Sequence
  Description of Artificial Sequence: Synthetic polypeptide
DEEEIRTTNPVATEQYGSVSLEMELQMRINDTED

SEQ ID NO: 73136 - protein, 33 aa, Artificial Sequence
  Description of Artificial Sequence: Synthetic polypeptide
DEVEIRTTNPVATEQYGSVSTGGQTGGNGNEDQ

SEQ ID NO: 73137 - protein, 31 aa, Artificial Sequence
  Description of Artificial Sequence: Synthetic polypeptide
AENEIACTNPVATEQYGSASENLQMRGMGPR

SEQ ID NO: 73138 - protein, 32 aa, Artificial Sequence
  Description of Artificial Sequence: Synthetic polypeptide
DEEEIRTTNPVATEQYGSVSLDNTERVEVMYD

SEQ ID NO: 73139 - protein, 33 aa, Artificial Sequence
  Description of Artificial Sequence: Synthetic polypeptide
DEEEIRTTNPVATEQYGSVSLDELQEGCGEEFQ

SEQ ID NO: 73140 - protein, 30 aa, Artificial Sequence
  Description of Artificial Sequence: Synthetic polypeptide
AENEIACTNPVATEQYGSASTDLEREGGDR

SEQ ID NO: 73141 - protein, 31 aa, Artificial Sequence
  Description of Artificial Sequence: Synthetic polypeptide
DEEEIRTTNPVATEQYGSVSLAWMIRDVDVD

SEQ ID NO: 73142 - protein, 32 aa, Artificial Sequence
  Description of Artificial Sequence: Synthetic polypeptide
DTEEIRCTNPVATEQYGCVCSTNNLENIGTQR

SEQ ID NO: 73143 - protein, 31 aa, Artificial Sequence
  Description of Artificial Sequence: Synthetic polypeptide
DTEEIRCTNPVATEQYGCVVSTYNLENGTQQ

SEQ ID NO: 73144 - protein, 28 aa, Artificial Sequence
  Description of Artificial Sequence: Synthetic peptide
AENDIACTNPVATEQYGEASENLQPGGR

SEQ ID NO: 73145 - protein, 33 aa, Artificial Sequence
  Description of Artificial Sequence: Synthetic polypeptide
DEVEIRTTNPVATEQYGSVSTGGDHQGDQGGNS

SEQ ID NO: 73146 - protein, 30 aa, Artificial Sequence
  Description of Artificial Sequence: Synthetic polypeptide
DTEEIRCTNPVAYEQWGCSYQSDNLQNGTR

SEQ ID NO: 73147 - protein, 34 aa, Artificial Sequence
  Description of Artificial Sequence: Synthetic polypeptide
DTEEIRPTNPVAYEQYGSVVYSCTNLSQNVGTNR

SEQ ID NO: 73148 - protein, 31 aa, Artificial Sequence
  Description of Artificial Sequence: Synthetic polypeptide
DEECIRCTNPVAYEQYGSVSVNQSDGGGNNR

SEQ ID NO: 73149 - protein, 32 aa, Artificial Sequence
  Description of Artificial Sequence: Synthetic polypeptide
DEECIRCTNPVAYEQYGSVVSCINEFQRGGNL

SEQ ID NO: 73150 - protein, 32 aa, Artificial Sequence
  Description of Artificial Sequence: Synthetic polypeptide
AENEIACTNPVATEQYGEASSTTPNLPQRGNR

SEQ ID NO: 73151 - protein, 28 aa, Artificial Sequence
  Description of Artificial Sequence: Synthetic peptide
DTAEIACTNPVATEQWGCCSTVLQHGNH

SEQ ID NO: 73152 - protein, 33 aa, Artificial Sequence
  Description of Artificial Sequence: Synthetic polypeptide
DEEEIRTTNPVATEQYGSVSMFNLQMDSVEMLQ

SEQ ID NO: 73153 - protein, 32 aa, Artificial Sequence
  Description of Artificial Sequence: Synthetic polypeptide
DEEEIRTTNPVATEQYGSVSPTGWVEINVNTD

SEQ ID NO: 73154 - protein, 33 aa, Artificial Sequence
  Description of Artificial Sequence: Synthetic polypeptide
DEEEIRTTNPVATEQYGSVSPTHANAELMQKMW

SEQ ID NO: 73155 - protein, 29 aa, Artificial Sequence
  Description of Artificial Sequence: Synthetic peptide
AENEIACTNPVATEQYGEAWHENLQRGGR

SEQ ID NO: 73156 - protein, 32 aa, Artificial Sequence
  Description of Artificial Sequence: Synthetic polypeptide
DEEEIRTTNPVATEQYGSVSNGLDVRQVIMDI

SEQ ID NO: 73157 - protein, 35 aa, Artificial Sequence
  Description of Artificial Sequence: Synthetic polypeptide
DEEEIRTTNPVATEQYGSVSPTHLIQQRIVDENDL

SEQ ID NO: 73158 - protein, 30 aa, Artificial Sequence
  Description of Artificial Sequence: Synthetic polypeptide
AENEIACTNPVATEQYGEAWSENLQRGGRV

SEQ ID NO: 73159 - protein, 30 aa, Artificial Sequence
  Description of Artificial Sequence: Synthetic polypeptide
AENEIACTNPVATEQYGCSCSWENLQRGGQ

SEQ ID NO: 73160 - protein, 30 aa, Artificial Sequence
  Description of Artificial Sequence: Synthetic polypeptide
AENEIACTNPVATEQYGEAWSENLQRGGSR

SEQ ID NO: 73161 - protein, 35 aa, Artificial Sequence
  Description of Artificial Sequence: Synthetic polypeptide
DSEEIRTTNPVATEQYGETVSCTNLSERNGGNERM

SEQ ID NO: 73162 - protein, 35 aa, Artificial Sequence
  Description of Artificial Sequence: Synthetic polypeptide
DSEEIRTTNPVATEQYGETVSCTNLSQREGGQERA

SEQ ID NO: 73163 - protein, 33 aa, Artificial Sequence
  Description of Artificial Sequence: Synthetic polypeptide
DEEEIRTTNPVATEQYGSVSNGDIGQAEGNTNI

SEQ ID NO: 73164 - protein, 34 aa, Artificial Sequence
  Description of Artificial Sequence: Synthetic polypeptide
DEEEIRTTNPVATEQYGSVSNFTGDEGQGGNNLD

SEQ ID NO: 73165 - protein, 34 aa, Artificial Sequence
  Description of Artificial Sequence: Synthetic polypeptide
DEEEIRTTNPVATEQYGSVSNFPNGLQIEQENGQ

SEQ ID NO: 73166 - protein, 33 aa, Artificial Sequence
  Description of Artificial Sequence: Synthetic polypeptide
DEEEIRTTNPVATEQYGSVSPTIAEQLMVNGLD

SEQ ID NO: 73167 - protein, 31 aa, Artificial Sequence
  Description of Artificial Sequence: Synthetic polypeptide
DSEEIRTTNPVATEQYGCVSTDLENIIDNTE

SEQ ID NO: 73168 - protein, 33 aa, Artificial Sequence
  Description of Artificial Sequence: Synthetic polypeptide
DSEEIRTTNPVATEQWGSVYSCQNLSQMTGGNE

SEQ ID NO: 73169 - protein, 33 aa, Artificial Sequence
  Description of Artificial Sequence: Synthetic polypeptide
DSEEIRTTNPVATEQWGSVPSCTLELQRTVTNP

SEQ ID NO: 73170 - protein, 32 aa, Artificial Sequence
  Description of Artificial Sequence: Synthetic polypeptide
DEVELRTTNPVATEQYGSVSSVNGTQQEGNSV

SEQ ID NO: 73171 - protein, 33 aa, Artificial Sequence
  Description of Artificial Sequence: Synthetic polypeptide
DSEEIRTTNPVATECYGSVMCDGNLSQSGGNNR

SEQ ID NO: 73172 - protein, 33 aa, Artificial Sequence
  Description of Artificial Sequence: Synthetic polypeptide
DSEEIRTTNPVATECYGSVNCTGNALQSGGNNH

SEQ ID NO: 73173 - protein, 33 aa, Artificial Sequence
  Description of Artificial Sequence: Synthetic polypeptide
DSEEIRTTNPVATECYGVVNCTGNLAQSGGNNR

SEQ ID NO: 73174 - protein, 32 aa, Artificial Sequence
  Description of Artificial Sequence: Synthetic polypeptide
DEEEIRTTNPVATEQYGSVSNLNELYESAEEN

SEQ ID NO: 73175 - protein, 33 aa, Artificial Sequence
  Description of Artificial Sequence: Synthetic polypeptide
DEEEIRTTNPVATEQYGSVSNLLLGEEAATIRQ

SEQ ID NO: 73176 - protein, 33 aa, Artificial Sequence
  Description of Artificial Sequence: Synthetic polypeptide
DEEEIRTTNPVATEQYGSVSNLGIQNTVENQFT

SEQ ID NO: 73177 - protein, 29 aa, Artificial Sequence
  Description of Artificial Sequence: Synthetic peptide
AENEIACTNPVATEQYGEAVSERLQRGGE

SEQ ID NO: 73178 - protein, 31 aa, Artificial Sequence
  Description of Artificial Sequence: Synthetic polypeptide
DEVVIGTTNPVATEQFGTVSTGDFGQRGNDR

SEQ ID NO: 73179 - protein, 35 aa, Artificial Sequence
  Description of Artificial Sequence: Synthetic polypeptide
DEEEIRTTNPVATEQYGSVSPTGNINQMLNGENTD

SEQ ID NO: 73180 - protein, 34 aa, Artificial Sequence
  Description of Artificial Sequence: Synthetic polypeptide
DEEEIRTTNPVATEQYGSVSNHALQQDVGLLNHW

SEQ ID NO: 73181 - protein, 33 aa, Artificial Sequence
  Description of Artificial Sequence: Synthetic polypeptide
DEEEIRTTNPVATEQYGSVSNGVNGQGEGGEGE

SEQ ID NO: 73182 - protein, 29 aa, Artificial Sequence
  Description of Artificial Sequence: Synthetic peptide
AENEIACTNPVATEQYGEAWAENLQRGGR

SEQ ID NO: 73183 - protein, 35 aa, Artificial Sequence
  Description of Artificial Sequence: Synthetic polypeptide
DEEEIRTTNPVATEQYGSVSPTGNMMQQERIFPNE

SEQ ID NO: 73184 - protein, 35 aa, Artificial Sequence
  Description of Artificial Sequence: Synthetic polypeptide
DEEEIRTTNPVATEQYGSVSPTGNPLFPTGENETL

SEQ ID NO: 73185 - protein, 36 aa, Artificial Sequence
  Description of Artificial Sequence: Synthetic polypeptide
DEEEIRTTNPVATEQYGSVSPTGNSLQQERSIFVNE

SEQ ID NO: 73186 - protein, 35 aa, Artificial Sequence
  Description of Artificial Sequence: Synthetic polypeptide
DSEEIRTTNPVATEQYGSTVSCTGNELQEEGGNMQ

SEQ ID NO: 73187 - protein, 33 aa, Artificial Sequence
  Description of Artificial Sequence: Synthetic polypeptide
DEVEIRTTNPVAYEQYGTVSTTNTLGQNGEDNP

SEQ ID NO: 73188 - protein, 33 aa, Artificial Sequence
  Description of Artificial Sequence: Synthetic polypeptide
DEEEIRTTNPVATEQYGSVSPTILQEVFLEQMP

SEQ ID NO: 73189 - protein, 33 aa, Artificial Sequence
  Description of Artificial Sequence: Synthetic polypeptide
DSEEIRTTNPVATEQYGSVCSPTNLERNDDTES

SEQ ID NO: 73190 - protein, 32 aa, Artificial Sequence
  Description of Artificial Sequence: Synthetic polypeptide
DSEEIRTTNPVAYEQWGTVVYSTNLSQMTGNE

SEQ ID NO: 73191 - protein, 30 aa, Artificial Sequence
  Description of Artificial Sequence: Synthetic polypeptide
AENEIACTNPVATEQYGEFASENLQARGGR

SEQ ID NO: 73192 - protein, 30 aa, Artificial Sequence
  Description of Artificial Sequence: Synthetic polypeptide
AENEIACTNPVATEQYGEFASENLQRGGRA

SEQ ID NO: 73193 - protein, 32 aa, Artificial Sequence
  Description of Artificial Sequence: Synthetic polypeptide
DSEEIRTTNPVAYEQYGEVSCINHDQRVGEPR

SEQ ID NO: 73194 - protein, 28 aa, Artificial Sequence
  Description of Artificial Sequence: Synthetic peptide
AENEIACTNPVATEQYGEFSWNLQGGGQ

SEQ ID NO: 73195 - protein, 33 aa, Artificial Sequence
  Description of Artificial Sequence: Synthetic polypeptide
DEEEIRTTNPVATEQYGSVSNDNDQDEGQGGEE

SEQ ID NO: 73196 - protein, 33 aa, Artificial Sequence
  Description of Artificial Sequence: Synthetic polypeptide
DEEEIRTTNPVATEQYGSVSPTLLDENRDEVGT

SEQ ID NO: 73197 - protein, 32 aa, Artificial Sequence
  Description of Artificial Sequence: Synthetic polypeptide
DEVEIRTTNPVATEQYGVVDTDLQRGPEGGDN

SEQ ID NO: 73198 - protein, 35 aa, Artificial Sequence
  Description of Artificial Sequence: Synthetic polypeptide
DEEEIRTTNPVATEQYGSVSPTLLIQAISGDNETT

SEQ ID NO: 73199 - protein, 35 aa, Artificial Sequence
  Description of Artificial Sequence: Synthetic polypeptide
DEEEIRTTNPVATEQYGSVSPTLLIQANSGFNELT

SEQ ID NO: 73200 - protein, 34 aa, Artificial Sequence
  Description of Artificial Sequence: Synthetic polypeptide
DSEEIRTTNPVAYEQYGVSVPSCTNPSQDNGTNR

SEQ ID NO: 73201 - protein, 34 aa, Artificial Sequence
  Description of Artificial Sequence: Synthetic polypeptide
DEEEIRTTNPVATEQYGSVSPTLLLIQEDDLNEI

SEQ ID NO: 73202 - protein, 34 aa, Artificial Sequence
  Description of Artificial Sequence: Synthetic polypeptide
DEEEIRTTNPVATEQYGSVSNDDNMDQGGGQTNE

SEQ ID NO: 73203 - protein, 34 aa, Artificial Sequence
  Description of Artificial Sequence: Synthetic polypeptide
DEEEIRTTNPVATEQYGSVSPTLLLIQEDLNELI

SEQ ID NO: 73204 - protein, 34 aa, Artificial Sequence
  Description of Artificial Sequence: Synthetic polypeptide
DEEEIRTTNPVATEQYGSVSNDDDQLEQEGGNST

SEQ ID NO: 73205 - protein, 32 aa, Artificial Sequence
  Description of Artificial Sequence: Synthetic polypeptide
DSEEIRTTNPVAYEQWGSVPSTPFSQRTGTSR

SEQ ID NO: 73206 - protein, 33 aa, Artificial Sequence
  Description of Artificial Sequence: Synthetic polypeptide
DSEEIRTTNPVATECYGQTVNCTGNLQSGGNNR

SEQ ID NO: 73207 - protein, 36 aa, Artificial Sequence
  Description of Artificial Sequence: Synthetic polypeptide
DEEEIRTTNPVATEQYGSVSPTLEVLDQQRGLENEN

SEQ ID NO: 73208 - protein, 34 aa, Artificial Sequence
  Description of Artificial Sequence: Synthetic polypeptide
DEEEIRTTNPVATEQYGSVSNDNLMEMGQGENEQ

SEQ ID NO: 73209 - protein, 33 aa, Artificial Sequence
  Description of Artificial Sequence: Synthetic polypeptide
DSEEIRTTNPVATEQYGSVPSCTNEHQEPTVGR

SEQ ID NO: 73210 - protein, 28 aa, Artificial Sequence
  Description of Artificial Sequence: Synthetic peptide
AENEIACTNPVATEQYGEAYENLQRGGT

SEQ ID NO: 73211 - protein, 29 aa, Artificial Sequence
  Description of Artificial Sequence: Synthetic peptide
AENEIACTNPVATEQYGEAYENLQRPGGR

SEQ ID NO: 73212 - protein, 32 aa, Artificial Sequence
  Description of Artificial Sequence: Synthetic polypeptide
DSEEIRTTNPVATEQYGSVSPTNLSEEEESDN

SEQ ID NO: 73213 - protein, 29 aa, Artificial Sequence
  Description of Artificial Sequence: Synthetic peptide
AENEIACTNPVATEQYGEAYSENLQRGGN

SEQ ID NO: 73214 - protein, 33 aa, Artificial Sequence
  Description of Artificial Sequence: Synthetic polypeptide
DEEEIRTTNPVATEQYGSVSNDPNIMTNGGNNQ

SEQ ID NO: 73215 - protein, 32 aa, Artificial Sequence
  Description of Artificial Sequence: Synthetic polypeptide
DEEEIRTTNPVATEQYGSVSNDPDFEQGENGF

SEQ ID NO: 73216 - protein, 29 aa, Artificial Sequence
  Description of Artificial Sequence: Synthetic peptide
AENEIACTNPVATEQYGEAYSENLQRKGR

SEQ ID NO: 73217 - protein, 30 aa, Artificial Sequence
  Description of Artificial Sequence: Synthetic polypeptide
AENEIACTNPVATEQYGECARSENLQRGGR

SEQ ID NO: 73218 - protein, 30 aa, Artificial Sequence
  Description of Artificial Sequence: Synthetic polypeptide
AENEIACTNPVATEQYGECASENLQRGQGR

SEQ ID NO: 73219 - protein, 32 aa, Artificial Sequence
  Description of Artificial Sequence: Synthetic polypeptide
DSEEIRTTNPVAYEHWGSTVYSTNLSQMTGNE

SEQ ID NO: 73220 - protein, 34 aa, Artificial Sequence
  Description of Artificial Sequence: Synthetic polypeptide
DSEEIRTTNPVAYEPYGCSVISTNMLSNRGTNRD

SEQ ID NO: 73221 - protein, 33 aa, Artificial Sequence
  Description of Artificial Sequence: Synthetic polypeptide
DSEEIRTTNPVAYEPYGQSVISTNALSQRVTNG

SEQ ID NO: 73222 - protein, 32 aa, Artificial Sequence
  Description of Artificial Sequence: Synthetic polypeptide
DSEEIRTTNPVAYEPYGSVIANSNLSQRVTNR

SEQ ID NO: 73223 - protein, 32 aa, Artificial Sequence
  Description of Artificial Sequence: Synthetic polypeptide
DSEEIRTTNPVAYEPYGSVSCTNQSQRSQSRS

SEQ ID NO: 73224 - protein, 33 aa, Artificial Sequence
  Description of Artificial Sequence: Synthetic polypeptide
DSEEIRTTNPVAYEPYGVSVISTNLSQRVTNSN

SEQ ID NO: 73225 - protein, 34 aa, Artificial Sequence
  Description of Artificial Sequence: Synthetic polypeptide
DEEEIRTTNPVATEQYGSVSNLTFTMDQNEGGNA

SEQ ID NO: 73226 - protein, 32 aa, Artificial Sequence
  Description of Artificial Sequence: Synthetic polypeptide
DEEEIRTTNPVATEQYGSVSNMAPLIQGSEVD

SEQ ID NO: 73227 - protein, 34 aa, Artificial Sequence
  Description of Artificial Sequence: Synthetic polypeptide
DEEEIRTTNPVATEQYGSVSPTFNQQQVGEIMDI

SEQ ID NO: 73228 - protein, 32 aa, Artificial Sequence
  Description of Artificial Sequence: Synthetic polypeptide
DEEEIRTTNPVATEQYGSVSPTEMANREDTEI

SEQ ID NO: 73229 - protein, 29 aa, Artificial Sequence
  Description of Artificial Sequence: Synthetic peptide
AENEIACTNPVATEQYGDASENLQNRGGA

SEQ ID NO: 73230 - protein, 34 aa, Artificial Sequence
  Description of Artificial Sequence: Synthetic polypeptide
DEEEIRTTNPVATEQYGSVSNMQTGNLDEFGAGG

SEQ ID NO: 73231 - protein, 35 aa, Artificial Sequence
  Description of Artificial Sequence: Synthetic polypeptide
DEEEIRTTNPVATEQYGSVSNMQTDNLDIFGNGEG

SEQ ID NO: 73232 - protein, 33 aa, Artificial Sequence
  Description of Artificial Sequence: Synthetic polypeptide
DEEEIRTTNPVATEQYGSVSNMQSLPQQLVLNI

SEQ ID NO: 73233 - protein, 30 aa, Artificial Sequence
  Description of Artificial Sequence: Synthetic polypeptide
AENEIACTNPVATEQYGDASENLQNRAGGR

SEQ ID NO: 73234 - protein, 31 aa, Artificial Sequence
  Description of Artificial Sequence: Synthetic polypeptide
DEEAIRTTNPVAYEQYGCVSTINVQRIFDMQ

SEQ ID NO: 73235 - protein, 31 aa, Artificial Sequence
  Description of Artificial Sequence: Synthetic polypeptide
DEEAIRTTNPVAYEQYGCVSTNDCEIFGENE

SEQ ID NO: 73236 - protein, 30 aa, Artificial Sequence
  Description of Artificial Sequence: Synthetic polypeptide
AENEIACTNPVATEQYGEASTENLQRGGEA

SEQ ID NO: 73237 - protein, 33 aa, Artificial Sequence
  Description of Artificial Sequence: Synthetic polypeptide
DEEEIRTTNPVATEQYGSVSNMNNLDIGGQEDI

SEQ ID NO: 73238 - protein, 34 aa, Artificial Sequence
  Description of Artificial Sequence: Synthetic polypeptide
DEEEIRTTNPVATEQYGSVSNMNLVNTDGGENGD

SEQ ID NO: 73239 - protein, 34 aa, Artificial Sequence
  Description of Artificial Sequence: Synthetic polypeptide
DEEEIRTTNPVATEQYGSVSNMNLVNIEGGENGT

SEQ ID NO: 73240 - protein, 28 aa, Artificial Sequence
  Description of Artificial Sequence: Synthetic peptide
AENEIACTNPVATEQYGDASENLQHEGR

SEQ ID NO: 73241 - protein, 35 aa, Artificial Sequence
  Description of Artificial Sequence: Synthetic polypeptide
DEEEIRTTNPVATEQYGSVSPTENEGERQGEPMRD

SEQ ID NO: 73242 - protein, 32 aa, Artificial Sequence
  Description of Artificial Sequence: Synthetic polypeptide
DSEEIRSTNPVATEQYGSTISCTNGSQRGGSN

SEQ ID NO: 73243 - protein, 33 aa, Artificial Sequence
  Description of Artificial Sequence: Synthetic polypeptide
DEEEIRTTNPVATEQYGSVSNMTLGGQGQNNDD

SEQ ID NO: 73244 - protein, 29 aa, Artificial Sequence
  Description of Artificial Sequence: Synthetic peptide
AENEIACTNPVATEQYGDASENLMRAGGR

SEQ ID NO: 73245 - protein, 29 aa, Artificial Sequence
  Description of Artificial Sequence: Synthetic peptide
AENEIACTNPVATEQYGDASENLQRAGGA

SEQ ID NO: 73246 - protein, 29 aa, Artificial Sequence
  Description of Artificial Sequence: Synthetic peptide
AENEIACTNPVATEQYGDVSEILMRAGDR

SEQ ID NO: 73247 - protein, 29 aa, Artificial Sequence
  Description of Artificial Sequence: Synthetic peptide
AENEIACTNPVATEQYGEAASENLKRGGR

SEQ ID NO: 73248 - protein, 33 aa, Artificial Sequence
  Description of Artificial Sequence: Synthetic polypeptide
DEYEIGTTNPVATEQYGSVSTTNAGMEQGGNTG

SEQ ID NO: 73249 - protein, 32 aa, Artificial Sequence
  Description of Artificial Sequence: Synthetic polypeptide
DEYEIGTTNPVATEQYGSVSTTNAGMEGGNTG

SEQ ID NO: 73250 - protein, 34 aa, Artificial Sequence
  Description of Artificial Sequence: Synthetic polypeptide
DSEEIRSTNPVATEAYGSVSCDNLSQARTGGQNR

SEQ ID NO: 73251 - protein, 33 aa, Artificial Sequence
  Description of Artificial Sequence: Synthetic polypeptide
DSEEIRSTNPVATEAYGSVSCTNFSQARTGGVR

SEQ ID NO: 73252 - protein, 30 aa, Artificial Sequence
  Description of Artificial Sequence: Synthetic polypeptide
AENEIACTNPVATEQYGDVSENLQNAAGGR

SEQ ID NO: 73253 - protein, 34 aa, Artificial Sequence
  Description of Artificial Sequence: Synthetic polypeptide
DEEEIRTTNPVATEQYGSVSNNENLESIGQENQL

SEQ ID NO: 73254 - protein, 36 aa, Artificial Sequence
  Description of Artificial Sequence: Synthetic polypeptide
DEEEIRTTNPVATEQYGSVSPTDSVLFQERIDENRQ

SEQ ID NO: 73255 - protein, 33 aa, Artificial Sequence
  Description of Artificial Sequence: Synthetic polypeptide
DEEEIRTTNPVATEQYGSVSNNELDDIENVVVT

SEQ ID NO: 73256 - protein, 32 aa, Artificial Sequence
  Description of Artificial Sequence: Synthetic polypeptide
DEYEIGTTNPVATEQYGSVSTTNAGMEGGNDG

SEQ ID NO: 73257 - protein, 31 aa, Artificial Sequence
  Description of Artificial Sequence: Synthetic polypeptide
DEEEIRTTNPVATEQYGSVSNNDSDIDVDEF

SEQ ID NO: 73258 - protein, 33 aa, Artificial Sequence
  Description of Artificial Sequence: Synthetic polypeptide
DEEEIRTTNPVATEQYGSVSPTDTLEDRTESIE

SEQ ID NO: 73259 - protein, 31 aa, Artificial Sequence
  Description of Artificial Sequence: Synthetic polypeptide
DSEEIRSTNPVATEQWGSISCTNHSERVGNN

SEQ ID NO: 73260 - protein, 34 aa, Artificial Sequence
  Description of Artificial Sequence: Synthetic polypeptide
DEEEIRTTNPVATEQYGSVSNNDLEMGQEGETEG

SEQ ID NO: 73261 - protein, 34 aa, Artificial Sequence
  Description of Artificial Sequence: Synthetic polypeptide
DEEEIRTTNPVATEQYGSVSNNDEMQGQEGEENA

SEQ ID NO: 73262 - protein, 35 aa, Artificial Sequence
  Description of Artificial Sequence: Synthetic polypeptide
DEEEIRTTNPVATEQYGSVSPTELSLQPRGHLLDI

SEQ ID NO: 73263 - protein, 34 aa, Artificial Sequence
  Description of Artificial Sequence: Synthetic polypeptide
DEEEIRTTNPVATEQYGSVSPTLLLIQEDPNPEE

SEQ ID NO: 73264 - protein, 33 aa, Artificial Sequence
  Description of Artificial Sequence: Synthetic polypeptide
DSEEIRSTNPVATEQYGSVCSTNLQENFGSQQS

SEQ ID NO: 73265 - protein, 28 aa, Artificial Sequence
  Description of Artificial Sequence: Synthetic peptide
AENEIACTNPVATEQYGDASECLQREER

SEQ ID NO: 73266 - protein, 34 aa, Artificial Sequence
  Description of Artificial Sequence: Synthetic polypeptide
DEEEIRTTNPVATEQYGSVSPTEVLQRMQEIEPT

SEQ ID NO: 73267 - protein, 34 aa, Artificial Sequence
  Description of Artificial Sequence: Synthetic polypeptide
DEEEIRTTNPVATEQYGSVSPTEVNQRMVENEDA

SEQ ID NO: 73268 - protein, 34 aa, Artificial Sequence
  Description of Artificial Sequence: Synthetic polypeptide
DEEEIRTTNPVATEQYGSVSPTFNGQNVGEIVDI

SEQ ID NO: 73269 - protein, 35 aa, Artificial Sequence
  Description of Artificial Sequence: Synthetic polypeptide
DEEEIRTTNPVATEQYGSVSNMNDLEQGEGGENNA

SEQ ID NO: 73270 - protein, 32 aa, Artificial Sequence
  Description of Artificial Sequence: Synthetic polypeptide
DSEEIRTTNPTAYEHYGSVSCIANLSQAEGNR

SEQ ID NO: 73271 - protein, 32 aa, Artificial Sequence
  Description of Artificial Sequence: Synthetic polypeptide
DSEEIRTTNPTAYEHYGSVSCINNLSQREGSR

SEQ ID NO: 73272 - protein, 28 aa, Artificial Sequence
  Description of Artificial Sequence: Synthetic peptide
AENEIACTNPVATEQYGCSSWELQRGGQ

SEQ ID NO: 73273 - protein, 33 aa, Artificial Sequence
  Description of Artificial Sequence: Synthetic polypeptide
DSEEIRTTNPVATEAWGSTVYSVTNLSQMTGNE

SEQ ID NO: 73274 - protein, 35 aa, Artificial Sequence
  Description of Artificial Sequence: Synthetic polypeptide
DEEEIRTTNPVATEQYGSVSNMENLNQDTGGENGD

SEQ ID NO: 73275 - protein, 35 aa, Artificial Sequence
  Description of Artificial Sequence: Synthetic polypeptide
DEEEIRTTNPVATEQYGSVSNMDTGLQNEGGENGD

SEQ ID NO: 73276 - protein, 30 aa, Artificial Sequence
  Description of Artificial Sequence: Synthetic polypeptide
AENEIACTNPVATEQYGEASYQNLQRGGGR

SEQ ID NO: 73277 - protein, 29 aa, Artificial Sequence
  Description of Artificial Sequence: Synthetic peptide
AENEIACTNPVATEQYGEATENLQRGGNM

SEQ ID NO: 73278 - protein, 35 aa, Artificial Sequence
  Description of Artificial Sequence: Synthetic polypeptide
DEEEIRTTNPVATEQYGSVSPTFNMETQRDPQNDM

SEQ ID NO: 73279 - protein, 28 aa, Artificial Sequence
  Description of Artificial Sequence: Synthetic peptide
AENEIACTNPVATEQYGEATENLQVGGR

SEQ ID NO: 73280 - protein, 34 aa, Artificial Sequence
  Description of Artificial Sequence: Synthetic polypeptide
DEEEIRTTNPVATEQYGSVSNMDFNEGQGGNVNG

SEQ ID NO: 73281 - protein, 30 aa, Artificial Sequence
  Description of Artificial Sequence: Synthetic polypeptide
AENEIACTNPVATEQYGCSTSWNLQRGSEQ

SEQ ID NO: 73282 - protein, 34 aa, Artificial Sequence
  Description of Artificial Sequence: Synthetic polypeptide
DEYEIGTTNPVATEQYGSVSNTQNDLQEEMGNLN

SEQ ID NO: 73283 - protein, 34 aa, Artificial Sequence
  Description of Artificial Sequence: Synthetic polypeptide
DSEEIRTTNPLAYEPYGCSVISTNALSQRGTNRD

SEQ ID NO: 73284 - protein, 30 aa, Artificial Sequence
  Description of Artificial Sequence: Synthetic polypeptide
DSEEIRTTNPIAYEAYGSVACTNHGRGGNA

SEQ ID NO: 73285 - protein, 28 aa, Artificial Sequence
  Description of Artificial Sequence: Synthetic peptide
AENEIACTNPVATEQYGCYSWNLQSGGQ

SEQ ID NO: 73286 - protein, 28 aa, Artificial Sequence
  Description of Artificial Sequence: Synthetic peptide
AENEIACTNPVATEQYGEASTNLEHGGL

SEQ ID NO: 73287 - protein, 35 aa, Artificial Sequence
  Description of Artificial Sequence: Synthetic polypeptide
DEEEIRTTNPVATEQYGSVSPTENEQMLVGVNFVV

SEQ ID NO: 73288 - protein, 34 aa, Artificial Sequence
  Description of Artificial Sequence: Synthetic polypeptide
DEEEIRTTNPVATEQYGSVSPTENEWERAMPETR

SEQ ID NO: 73289 - protein, 31 aa, Artificial Sequence
  Description of Artificial Sequence: Synthetic polypeptide
DEYEIGTTNPVATEQYGSVITNAGMEGGNGG

SEQ ID NO: 73290 - protein, 33 aa, Artificial Sequence
  Description of Artificial Sequence: Synthetic polypeptide
DSEEIRSTNPVATEQYGSVVSYTNLSQNTGGTQ

SEQ ID NO: 73291 - protein, 31 aa, Artificial Sequence
  Description of Artificial Sequence: Synthetic polypeptide
DSEEIRSTNPVAYEAYGSIPSCTNSSQRGNN

SEQ ID NO: 73292 - protein, 34 aa, Artificial Sequence
  Description of Artificial Sequence: Synthetic polypeptide
DEEEIRTTNPVATEQYGSVSPTENLFERQDEPSD

SEQ ID NO: 73293 - protein, 33 aa, Artificial Sequence
  Description of Artificial Sequence: Synthetic polypeptide
DSEEIRSTNPVAYEPYGQSVISTNLSQRVTNRN

SEQ ID NO: 73294 - protein, 34 aa, Artificial Sequence
  Description of Artificial Sequence: Synthetic polypeptide
DSEEIRSTNPVAYEPYGSVPSTNLSQARNGTQNR

SEQ ID NO: 73295 - protein, 31 aa, Artificial Sequence
  Description of Artificial Sequence: Synthetic polypeptide
DSEEIRSTNPVAYEQYGSISCTNHTQTGGNN

SEQ ID NO: 73296 - protein, 32 aa, Artificial Sequence
  Description of Artificial Sequence: Synthetic polypeptide
DSEEIRSTNPVAYEQYGSISTNMHSQRTGGNN

SEQ ID NO: 73297 - protein, 33 aa, Artificial Sequence
  Description of Artificial Sequence: Synthetic polypeptide
DEEEIRTTNPVATEQYGSVSPTENPTQEMVADE

SEQ ID NO: 73298 - protein, 29 aa, Artificial Sequence
  Description of Artificial Sequence: Synthetic peptide
AENEIACTNPVATEQYGCYCSWELQRGGR

SEQ ID NO: 73299 - protein, 31 aa, Artificial Sequence
  Description of Artificial Sequence: Synthetic polypeptide
DSEEIRTTNPCAYEPYGSVINTNLSQRVTNL

SEQ ID NO: 73300 - protein, 35 aa, Artificial Sequence
  Description of Artificial Sequence: Synthetic polypeptide
DEEEIRTTNPVATEQYGSVSNMNGGNLQEEFGNGI

SEQ ID NO: 73301 - protein, 36 aa, Artificial Sequence
  Description of Artificial Sequence: Synthetic polypeptide
DEEEIRTTNPVATEQYGSVSNCTNNLQARVDEDEGN

SEQ ID NO: 73302 - protein, 34 aa, Artificial Sequence
  Description of Artificial Sequence: Synthetic polypeptide
DEEEIRTTNPVATEQYGSVSPTLLLIQEDPSNEE

SEQ ID NO: 73303 - protein, 34 aa, Artificial Sequence
  Description of Artificial Sequence: Synthetic polypeptide
DEEEIRTTNPVATEQYGSVSNCNLLIRVGEEFGI

SEQ ID NO: 73304 - protein, 30 aa, Artificial Sequence
  Description of Artificial Sequence: Synthetic polypeptide
DSEEIRTTNPVSTEQWGMVSTPPLNREVQR

SEQ ID NO: 73305 - protein, 30 aa, Artificial Sequence
  Description of Artificial Sequence: Synthetic polypeptide
DSEEIRTTNPVSTEQWGQMCSTNLQREVQI

SEQ ID NO: 73306 - protein, 28 aa, Artificial Sequence
  Description of Artificial Sequence: Synthetic peptide
AENEIACTNPVATEQFGEASENLQRGGW

SEQ ID NO: 73307 - protein, 30 aa, Artificial Sequence
  Description of Artificial Sequence: Synthetic polypeptide
AENEIACTNPVATEQYGESCSSNLQRFGDQ

SEQ ID NO: 73308 - protein, 33 aa, Artificial Sequence
  Description of Artificial Sequence: Synthetic polypeptide
DSEEIRTVNPVATEQYGSTVSCTRLSQRTVGPE

SEQ ID NO: 73309 - protein, 28 aa, Artificial Sequence
  Description of Artificial Sequence: Synthetic peptide
AENEIACTNPVATEQFGEASENLQRGGN

SEQ ID NO: 73310 - protein, 28 aa, Artificial Sequence
  Description of Artificial Sequence: Synthetic peptide
AENEIACTNPVATEQFGEASENKQRGGR

SEQ ID NO: 73311 - protein, 29 aa, Artificial Sequence
  Description of Artificial Sequence: Synthetic peptide
AENEIACTNPVATEPYGVASANLQRGGQR

SEQ ID NO: 73312 - protein, 29 aa, Artificial Sequence
  Description of Artificial Sequence: Synthetic peptide
AENEIACTNPVATEQYGESSEDLQRGGRD

SEQ ID NO: 73313 - protein, 33 aa, Artificial Sequence
  Description of Artificial Sequence: Synthetic polypeptide
DSEEISTTNPVATTQYGSVPSCTNPSMRTGGNR

SEQ ID NO: 73314 - protein, 29 aa, Artificial Sequence
  Description of Artificial Sequence: Synthetic peptide
AENEIACTNPVATEPYGEASMDLQQRGNR

SEQ ID NO: 73315 - protein, 34 aa, Artificial Sequence
  Description of Artificial Sequence: Synthetic polypeptide
DEEEIRTTNPVATEQYGSVSPTMNLMQHNVVPEA

SEQ ID NO: 73316 - protein, 34 aa, Artificial Sequence
  Description of Artificial Sequence: Synthetic polypeptide
DSEEISTTNPVAYEPYGCSVISTNELSQRGTNRD

SEQ ID NO: 73317 - protein, 33 aa, Artificial Sequence
  Description of Artificial Sequence: Synthetic polypeptide
DSEEISTTNPVAYEQYGSVVSCTNSHQESGGNR

SEQ ID NO: 73318 - protein, 28 aa, Artificial Sequence
  Description of Artificial Sequence: Synthetic peptide
AENEIACTNPVATEPYGEASENLQRGGH

SEQ ID NO: 73319 - protein, 34 aa, Artificial Sequence
  Description of Artificial Sequence: Synthetic polypeptide
DEVEIRTTNPVATEQYGSVSTQNLQFNEGQGGQG

SEQ ID NO: 73320 - protein, 33 aa, Artificial Sequence
  Description of Artificial Sequence: Synthetic polypeptide
DEDEIRTTNPVAYEQWGSVATNLQGNAGENHAR

SEQ ID NO: 73321 - protein, 33 aa, Artificial Sequence
  Description of Artificial Sequence: Synthetic polypeptide
DSEEIRTTNPVSTEQWGKVPSCTNLSQDRGGVR

SEQ ID NO: 73322 - protein, 32 aa, Artificial Sequence
  Description of Artificial Sequence: Synthetic polypeptide
DEVEIRTTNPVATEQYGSVSTTAGNGNQGQGE

SEQ ID NO: 73323 - protein, 32 aa, Artificial Sequence
  Description of Artificial Sequence: Synthetic polypeptide
DEEEIRTTNPVATEQYGSVSMSFGGQVENEEG

SEQ ID NO: 73324 - protein, 33 aa, Artificial Sequence
  Description of Artificial Sequence: Synthetic polypeptide
DEVEIRTTNPVATEQYGSVSTTGDDEQGGEGND

SEQ ID NO: 73325 - protein, 32 aa, Artificial Sequence
  Description of Artificial Sequence: Synthetic polypeptide
DEEEIRTTNPVATEQYGSVSMPSLQQTLMEIE

SEQ ID NO: 73326 - protein, 28 aa, Artificial Sequence
  Description of Artificial Sequence: Synthetic peptide
AENEIACTNPVATEQWGDASENEQRGGR

SEQ ID NO: 73327 - protein, 33 aa, Artificial Sequence
  Description of Artificial Sequence: Synthetic polypeptide
DEEEIRTTNPVATEQYGSVSMPNNMQDRLEEFL

SEQ ID NO: 73328 - protein, 32 aa, Artificial Sequence
  Description of Artificial Sequence: Synthetic polypeptide
DEVEIRTTNPVATEQYGSVSTTANMNNGGGEG

SEQ ID NO: 73329 - protein, 33 aa, Artificial Sequence
  Description of Artificial Sequence: Synthetic polypeptide
DEVEIRTTNPVATEQYGSVSTTANGMGNQGNQD

SEQ ID NO: 73330 - protein, 29 aa, Artificial Sequence
  Description of Artificial Sequence: Synthetic peptide
AENEIACTNPVATEQYGESCSSNHQRGGQ

SEQ ID NO: 73331 - protein, 33 aa, Artificial Sequence
  Description of Artificial Sequence: Synthetic polypeptide
DEEEIRTTNPVATEQYGSVSPTMNETVRVVEQE

SEQ ID NO: 73332 - protein, 33 aa, Artificial Sequence
  Description of Artificial Sequence: Synthetic polypeptide
DEEEIRTTNPVATEQYGSVSMPNLQQTMMEIEA

SEQ ID NO: 73333 - protein, 32 aa, Artificial Sequence
  Description of Artificial Sequence: Synthetic polypeptide
DEECIATTNPVAYECYGSVPNVTNELSQRGNM

SEQ ID NO: 73334 - protein, 34 aa, Artificial Sequence
  Description of Artificial Sequence: Synthetic polypeptide
DEEEIRTTNPVATEQYGSVSPTMNFSQPEGPEDF

SEQ ID NO: 73335 - protein, 33 aa, Artificial Sequence
  Description of Artificial Sequence: Synthetic polypeptide
DEVEIRTTNPVATEQYGSVSTTANGMENGGNQT

SEQ ID NO: 73336 - protein, 30 aa, Artificial Sequence
  Description of Artificial Sequence: Synthetic polypeptide
DSEEIRTTNPVGYEQWGMVSHNDLQDRGVS

SEQ ID NO: 73337 - protein, 34 aa, Artificial Sequence
  Description of Artificial Sequence: Synthetic polypeptide
DEEEIRTTNPVATEQYGSVSPTMNLDPRVVVEEL

SEQ ID NO: 73338 - protein, 31 aa, Artificial Sequence
  Description of Artificial Sequence: Synthetic polypeptide
AENEIACTNPVATEQYGESCSSNLQERGSGR

SEQ ID NO: 73339 - protein, 30 aa, Artificial Sequence
  Description of Artificial Sequence: Synthetic polypeptide
AENEIACTNPVATEQYGEQASENLQRGTGR

SEQ ID NO: 73340 - protein, 31 aa, Artificial Sequence
  Description of Artificial Sequence: Synthetic polypeptide
DSEEISTTNPVAYTQYGSVSCTNPTRTVNNR

SEQ ID NO: 73341 - protein, 28 aa, Artificial Sequence
  Description of Artificial Sequence: Synthetic peptide
AENEIACTNPVATENYGEAIENLQRGGR

SEQ ID NO: 73342 - protein, 34 aa, Artificial Sequence
  Description of Artificial Sequence: Synthetic polypeptide
DEVEIRTTNPVATEQYGSVSTPGQGQPNGGGNTR

SEQ ID NO: 73343 - protein, 34 aa, Artificial Sequence
  Description of Artificial Sequence: Synthetic polypeptide
DEEEIRTTNPVATEQYGSVSPTNAEQEVLNNDAD

SEQ ID NO: 73344 - protein, 34 aa, Artificial Sequence
  Description of Artificial Sequence: Synthetic polypeptide
DEEEIRTTNPVATEQYGSVSPTNAIQRMQLVEQY

SEQ ID NO: 73345 - protein, 34 aa, Artificial Sequence
  Description of Artificial Sequence: Synthetic polypeptide
DEEEIRTTNPVATEQYGSVSPTNAIVREQLVERY

SEQ ID NO: 73346 - protein, 33 aa, Artificial Sequence
  Description of Artificial Sequence: Synthetic polypeptide
DEEEIRTTNPVATEQYGSVSPTNALEEEVEQLD

SEQ ID NO: 73347 - protein, 28 aa, Artificial Sequence
  Description of Artificial Sequence: Synthetic peptide
AENEIACTNPVATEGYGEASETLQRGGR

SEQ ID NO: 73348 - protein, 29 aa, Artificial Sequence
  Description of Artificial Sequence: Synthetic peptide
AENEIACTNPVATEGYGEASENLQSRGGR

SEQ ID NO: 73349 - protein, 30 aa, Artificial Sequence
  Description of Artificial Sequence: Synthetic polypeptide
DEEEIRTTNPVATEQYGSVSMIQIEVQAEE

SEQ ID NO: 73350 - protein, 28 aa, Artificial Sequence
  Description of Artificial Sequence: Synthetic peptide
AENEIACTNPVATEGYGEASENLQRGDI

SEQ ID NO: 73351 - protein, 32 aa, Artificial Sequence
  Description of Artificial Sequence: Synthetic polypeptide
DSSEIRTTNPVAYEQWGSVYSTGNLSQMTGNE

SEQ ID NO: 73352 - protein, 28 aa, Artificial Sequence
  Description of Artificial Sequence: Synthetic peptide
AENEIACTNPVATEGYGEASENLQRAGR

SEQ ID NO: 73353 - protein, 33 aa, Artificial Sequence
  Description of Artificial Sequence: Synthetic polypeptide
DEEEIRTTNPVATEQYGSVSPTNALEEVSEELD

SEQ ID NO: 73354 - protein, 28 aa, Artificial Sequence
  Description of Artificial Sequence: Synthetic peptide
AENEIACTNPVATEGYGEASENIQRGGR

SEQ ID NO: 73355 - protein, 29 aa, Artificial Sequence
  Description of Artificial Sequence: Synthetic peptide
DSTDIATTNPVATEQYGCVATNGQRVNDL

SEQ ID NO: 73356 - protein, 28 aa, Artificial Sequence
  Description of Artificial Sequence: Synthetic peptide
AENEIACTNPVATEGYGEASECLQRGGR

SEQ ID NO: 73357 - protein, 32 aa, Artificial Sequence
  Description of Artificial Sequence: Synthetic polypeptide
DEECIATTNPVAYEQWGSVATNNLQDGGVNGR

SEQ ID NO: 73358 - protein, 28 aa, Artificial Sequence
  Description of Artificial Sequence: Synthetic peptide
AENEIACTNPVATEPYGEASENLQQGGR

SEQ ID NO: 73359 - protein, 35 aa, Artificial Sequence
  Description of Artificial Sequence: Synthetic polypeptide
DEEEIRTTNPVATEQYGSVSPTMNTVIIRNGVDRS

SEQ ID NO: 73360 - protein, 33 aa, Artificial Sequence
  Description of Artificial Sequence: Synthetic polypeptide
DSGEIRTTNPVAYEQYGSTVSTGNMLSQTGMRF

SEQ ID NO: 73361 - protein, 28 aa, Artificial Sequence
  Description of Artificial Sequence: Synthetic peptide
AENEIACTNPVATEMYGEASENVQRGGR

SEQ ID NO: 73362 - protein, 28 aa, Artificial Sequence
  Description of Artificial Sequence: Synthetic peptide
AENEIACTNPVATEMYGEASENRQRGGR

SEQ ID NO: 73363 - protein, 33 aa, Artificial Sequence
  Description of Artificial Sequence: Synthetic polypeptide
DEEEIRTTNPVATEQYGSVSMNLMNTIEVDNGI

SEQ ID NO: 73364 - protein, 28 aa, Artificial Sequence
  Description of Artificial Sequence: Synthetic peptide
AENEIACTNPVATEQYGESSSNLQNGGA

SEQ ID NO: 73365 - protein, 33 aa, Artificial Sequence
  Description of Artificial Sequence: Synthetic polypeptide
DSGEIRTTNPVATEHYGSVVSTNMLSQTGGMYR

SEQ ID NO: 73366 - protein, 28 aa, Artificial Sequence
  Description of Artificial Sequence: Synthetic peptide
AENEIACTNPVATELYGEASENLQNGGR

SEQ ID NO: 73367 - protein, 34 aa, Artificial Sequence
  Description of Artificial Sequence: Synthetic polypeptide
DSGEIRTTNPVATEQYGKVVSTNMLSQTGTMNRF

SEQ ID NO: 73368 - protein, 29 aa, Artificial Sequence
  Description of Artificial Sequence: Synthetic peptide
AENEIACTNPVATEKYGEASENLVQRGGR

SEQ ID NO: 73369 - protein, 29 aa, Artificial Sequence
  Description of Artificial Sequence: Synthetic peptide
AENEIACTNPVATEKYGEASENLQRGGRP

SEQ ID NO: 73370 - protein, 28 aa, Artificial Sequence
  Description of Artificial Sequence: Synthetic peptide
AENEIACTNPVATEKYGEAQENLQRGGR

SEQ ID NO: 73371 - protein, 29 aa, Artificial Sequence
  Description of Artificial Sequence: Synthetic peptide
AENEIACTNPVATEKYGEAISENLQRGGR

SEQ ID NO: 73372 - protein, 29 aa, Artificial Sequence
  Description of Artificial Sequence: Synthetic peptide
AENEIACTNPVATEKYGEADSENLQRGGR

SEQ ID NO: 73373 - protein, 33 aa, Artificial Sequence
  Description of Artificial Sequence: Synthetic polypeptide
DEEEIRTTNPVATEQYGSVSMNILQWTMSSDQG

SEQ ID NO: 73374 - protein, 34 aa, Artificial Sequence
  Description of Artificial Sequence: Synthetic polypeptide
DEEEIRTTNPVATEQYGSVSPTMNMQQQRIPADF

SEQ ID NO: 73375 - protein, 33 aa, Artificial Sequence
  Description of Artificial Sequence: Synthetic polypeptide
DSGEIRTTNPVAYEQYGISVSTNMLSQLTGGMR

SEQ ID NO: 73376 - protein, 29 aa, Artificial Sequence
  Description of Artificial Sequence: Synthetic peptide
DSNEIATTNPVGTEQWGMVSINNLQGGER

SEQ ID NO: 73377 - protein, 34 aa, Artificial Sequence
  Description of Artificial Sequence: Synthetic polypeptide
DEEEIRTTNPVATEQYGSVSPTNALEILEGEELD

SEQ ID NO: 73378 - protein, 30 aa, Artificial Sequence
  Description of Artificial Sequence: Synthetic polypeptide
AENEIACTNPVATEQWGEASCNLQREGENR

SEQ ID NO: 73379 - protein, 34 aa, Artificial Sequence
  Description of Artificial Sequence: Synthetic polypeptide
DEECIATTNPVATEQYGSVSCTLNLPVDTGGNNR

SEQ ID NO: 73380 - protein, 29 aa, Artificial Sequence
  Description of Artificial Sequence: Synthetic peptide
AENEIACTNPVATEQYGCASSNLQRGGQF

SEQ ID NO: 73381 - protein, 29 aa, Artificial Sequence
  Description of Artificial Sequence: Synthetic peptide
AENEIACTNPVATEQYGCASSNLQHGGRG

SEQ ID NO: 73382 - protein, 34 aa, Artificial Sequence
  Description of Artificial Sequence: Synthetic polypeptide
DEVEIRTTNPVATEQYGSVTSTVNLGDNEGNNTV

SEQ ID NO: 73383 - protein, 35 aa, Artificial Sequence
  Description of Artificial Sequence: Synthetic polypeptide
DEEEIRTTNPVATEQYGSVSMTPNGLERSVFVDRS

SEQ ID NO: 73384 - protein, 30 aa, Artificial Sequence
  Description of Artificial Sequence: Synthetic polypeptide
AENEIACTNPVATEQYGELASENLQRGGYR

SEQ ID NO: 73385 - protein, 30 aa, Artificial Sequence
  Description of Artificial Sequence: Synthetic polypeptide
AENEIACTNPVATEQYGELASENLQRGPGR

SEQ ID NO: 73386 - protein, 36 aa, Artificial Sequence
  Description of Artificial Sequence: Synthetic polypeptide
DEEEIRTTNPVATEQYGSVSMTNPLHTMRLGLDVRM

SEQ ID NO: 73387 - protein, 30 aa, Artificial Sequence
  Description of Artificial Sequence: Synthetic polypeptide
AENEIACTNPVATEQYGEMASENLQRAGGR

SEQ ID NO: 73388 - protein, 32 aa, Artificial Sequence
  Description of Artificial Sequence: Synthetic polypeptide
DSEEIRTTNPVGTEQWGMVCSGTNDGQDRGVR

SEQ ID NO: 73389 - protein, 33 aa, Artificial Sequence
  Description of Artificial Sequence: Synthetic polypeptide
DEEEIRTTNPVATEQYGSVSPTLNVYIPGPEAD

SEQ ID NO: 73390 - protein, 32 aa, Artificial Sequence
  Description of Artificial Sequence: Synthetic polypeptide
DSEEIRTTNPVGTEQWGMVSHNDLDQDRGDVR

SEQ ID NO: 73391 - protein, 33 aa, Artificial Sequence
  Description of Artificial Sequence: Synthetic polypeptide
DEVEIRTTNPVATEQYGSVSTVTANGMGNGGNT

SEQ ID NO: 73392 - protein, 30 aa, Artificial Sequence
  Description of Artificial Sequence: Synthetic polypeptide
AENEIACTNPVATEQYGCACSENLQRFGGR

SEQ ID NO: 73393 - protein, 30 aa, Artificial Sequence
  Description of Artificial Sequence: Synthetic polypeptide
AENEIACTNPVATEQYGAASNENLQRGGYR

SEQ ID NO: 73394 - protein, 31 aa, Artificial Sequence
  Description of Artificial Sequence: Synthetic polypeptide
DSEEIRTTNPVGTEQWGMVSTVLQRQGDVQE

SEQ ID NO: 73395 - protein, 29 aa, Artificial Sequence
  Description of Artificial Sequence: Synthetic peptide
AENEIACTNPVATEQYGCASWALQRGSGR

SEQ ID NO: 73396 - protein, 34 aa, Artificial Sequence
  Description of Artificial Sequence: Synthetic polypeptide
DEEEIRTTNPVATEQYGSVSMTNLGVAVDPEQRE

SEQ ID NO: 73397 - protein, 34 aa, Artificial Sequence
  Description of Artificial Sequence: Synthetic polypeptide
DEEEIRTTNPVATEQYGSVSPTLNLGLVIVNTAD

SEQ ID NO: 73398 - protein, 33 aa, Artificial Sequence
  Description of Artificial Sequence: Synthetic polypeptide
DEDEIRTTNPVAYEQWGSVCSTDNDGHQGGNRQ

SEQ ID NO: 73399 - protein, 29 aa, Artificial Sequence
  Description of Artificial Sequence: Synthetic peptide
AENEIACTNPVATEQYGEGASENKQRGGR

SEQ ID NO: 73400 - protein, 29 aa, Artificial Sequence
  Description of Artificial Sequence: Synthetic peptide
AENEIACTNPVATEQYGCEASENTQRGGR

SEQ ID NO: 73401 - protein, 29 aa, Artificial Sequence
  Description of Artificial Sequence: Synthetic peptide
AENEIACTNPVATEQYGEGASENLQHGGR

SEQ ID NO: 73402 - protein, 30 aa, Artificial Sequence
  Description of Artificial Sequence: Synthetic polypeptide
AENEIACTNPVATEQYGEGASENLQRGGRT

SEQ ID NO: 73403 - protein, 33 aa, Artificial Sequence
  Description of Artificial Sequence: Synthetic polypeptide
DEVEIRTTNPVATEQYGSVYTATDLSQRDDERI

SEQ ID NO: 73404 - protein, 31 aa, Artificial Sequence
  Description of Artificial Sequence: Synthetic polypeptide
DSEEIRTTNPVGTEQWGCVCSTELQRFGSVA

SEQ ID NO: 73405 - protein, 29 aa, Artificial Sequence
  Description of Artificial Sequence: Synthetic peptide
AENEIACTNPVATEQYGEHASENLERGGR

SEQ ID NO: 73406 - protein, 30 aa, Artificial Sequence
  Description of Artificial Sequence: Synthetic polypeptide
AENEIACTNPVATEQYGEIASENLQERGGR

SEQ ID NO: 73407 - protein, 29 aa, Artificial Sequence
  Description of Artificial Sequence: Synthetic peptide
AENEIACTNPVATEQYGCATSWNLQRGQQ

SEQ ID NO: 73408 - protein, 31 aa, Artificial Sequence
  Description of Artificial Sequence: Synthetic polypeptide
DSEEIRTTNPVGTEQWGCVCSTNLQAFGSVQ

SEQ ID NO: 73409 - protein, 28 aa, Artificial Sequence
  Description of Artificial Sequence: Synthetic peptide
AENEIACTNPVATEQYGCASWNLQRIGQ

SEQ ID NO: 73410 - protein, 32 aa, Artificial Sequence
  Description of Artificial Sequence: Synthetic polypeptide
DSEEIRTTNPVGTEQWGCVCSTNLQHFGSVRS

SEQ ID NO: 73411 - protein, 29 aa, Artificial Sequence
  Description of Artificial Sequence: Synthetic peptide
AENEIACTNPVATEQYGCASWNLQRGDQS

SEQ ID NO: 73412 - protein, 32 aa, Artificial Sequence
  Description of Artificial Sequence: Synthetic polypeptide
DSEEIRTTNPVGTEQWGCVCSTNLQRFGSDQA

SEQ ID NO: 73413 - protein, 32 aa, Artificial Sequence
  Description of Artificial Sequence: Synthetic polypeptide
DEVEIRTTNPVATEQYGSVVMHNGTVDRENQR

SEQ ID NO: 73414 - protein, 33 aa, Artificial Sequence
  Description of Artificial Sequence: Synthetic polypeptide
DEEEIRTTNPVATEQYGSVSMTWPSQTIGSDQQ

SEQ ID NO: 73415 - protein, 32 aa, Artificial Sequence
  Description of Artificial Sequence: Synthetic polypeptide
DEECIATTNPVATTEQFGSIVCSGNLQDRVNK

SEQ ID NO: 73416 - protein, 30 aa, Artificial Sequence
  Description of Artificial Sequence: Synthetic polypeptide
DEECEATTNPIAYEQWGEVSTNLQHAGNDR

SEQ ID NO: 73417 - protein, 32 aa, Artificial Sequence
  Description of Artificial Sequence: Synthetic polypeptide
DSEEIRTTNPVGTEQWGMVSWTNDGQQDRGVR

SEQ ID NO: 73418 - protein, 29 aa, Artificial Sequence
  Description of Artificial Sequence: Synthetic peptide
AENEIACTNPVATEQWGETSENLQRGAGR

SEQ ID NO: 73419 - protein, 30 aa, Artificial Sequence
  Description of Artificial Sequence: Synthetic polypeptide
DSEEIRTTNPVGTEQWGTVSTNLQHDDDED

SEQ ID NO: 73420 - protein, 33 aa, Artificial Sequence
  Description of Artificial Sequence: Synthetic polypeptide
DEVEIRTTNPVATEQYGSVSTTTANGMGNGNID

SEQ ID NO: 73421 - protein, 30 aa, Artificial Sequence
  Description of Artificial Sequence: Synthetic polypeptide
DSEEIRTTNPVGTEQWGTVSTNLQHDDMDE

SEQ ID NO: 73422 - protein, 32 aa, Artificial Sequence
  Description of Artificial Sequence: Synthetic polypeptide
DEEEIRTTNPVATEQYGSVSPTMDMANRETEI

SEQ ID NO: 73423 - protein, 30 aa, Artificial Sequence
  Description of Artificial Sequence: Synthetic polypeptide
AENEIACTNPVATEQYGENASENLNQRGGR

SEQ ID NO: 73424 - protein, 30 aa, Artificial Sequence
  Description of Artificial Sequence: Synthetic polypeptide
AENEIACTNPVATEQYGENASENLQRGGRY

SEQ ID NO: 73425 - protein, 32 aa, Artificial Sequence
  Description of Artificial Sequence: Synthetic polypeptide
DSEEIRTTNPVGTEQWGTVSTNLQHGDGMQRN

SEQ ID NO: 73426 - protein, 29 aa, Artificial Sequence
  Description of Artificial Sequence: Synthetic peptide
AENEIACTNPVATEQWGEASENLQRKGGR

SEQ ID NO: 73427 - protein, 30 aa, Artificial Sequence
  Description of Artificial Sequence: Synthetic polypeptide
DSEEIRTTNPVGTEQWGTVSTNLQNHDDMH

SEQ ID NO: 73428 - protein, 34 aa, Artificial Sequence
  Description of Artificial Sequence: Synthetic polypeptide
DEVEIRTTNPVATEQYGSVSTTNGNNDNHGDNER

SEQ ID NO: 73429 - protein, 29 aa, Artificial Sequence
  Description of Artificial Sequence: Synthetic peptide
AENEIACTNPVATEQWGEASENLQRAGGR

SEQ ID NO: 73430 - protein, 34 aa, Artificial Sequence
  Description of Artificial Sequence: Synthetic polypeptide
DEVEIRTTNPVATEQYGSVSTTNGNGNHSGDNDR

SEQ ID NO: 73431 - protein, 33 aa, Artificial Sequence
  Description of Artificial Sequence: Synthetic polypeptide
DEEEIRTTNPVATEQYGSVSMSNQIRLDVNENG

SEQ ID NO: 73432 - protein, 34 aa, Artificial Sequence
  Description of Artificial Sequence: Synthetic polypeptide
DEEEIRTTNPVATEQYGSVSPTMLLIQGREVLDD

SEQ ID NO: 73433 - protein, 34 aa, Artificial Sequence
  Description of Artificial Sequence: Synthetic polypeptide
DEVEIRTTNPVATEQYGSVSTTTANGMGNQGGNT

SEQ ID NO: 73434 - protein, 31 aa, Artificial Sequence
  Description of Artificial Sequence: Synthetic polypeptide
DEECEATTNPIAYEQWGEVSTNLQREGMNER

SEQ ID NO: 73435 - protein, 30 aa, Artificial Sequence
  Description of Artificial Sequence: Synthetic polypeptide
DEECIACTNPVAYEQYGQVSAINVQRDGNN

SEQ ID NO: 73436 - protein, 29 aa, Artificial Sequence
  Description of Artificial Sequence: Synthetic peptide
DEECIACTNPVAYEQYGEVSTINVQVDNN

SEQ ID NO: 73437 - protein, 33 aa, Artificial Sequence
  Description of Artificial Sequence: Synthetic polypeptide
DSEEIRTTNPVGTEQWGMVSWTNDLQDRGDVGR

SEQ ID NO: 73438 - protein, 33 aa, Artificial Sequence
  Description of Artificial Sequence: Synthetic polypeptide
DEECEIATTNPVAYEQWGSVSTNLQGQDAGNEE

SEQ ID NO: 73439 - protein, 28 aa, Artificial Sequence
  Description of Artificial Sequence: Synthetic peptide
AENEIACTNPVATEQYGEMSETLQHGDR

SEQ ID NO: 73440 - protein, 33 aa, Artificial Sequence
  Description of Artificial Sequence: Synthetic polypeptide
DSEEIRTTNPVGTEQWGMVVSCTNLSQRTGGVR

SEQ ID NO: 73441 - protein, 32 aa, Artificial Sequence
  Description of Artificial Sequence: Synthetic polypeptide
DSEEIRTTNPVGTEQWGMVVSTINLQRQGDVI

SEQ ID NO: 73442 - protein, 28 aa, Artificial Sequence
  Description of Artificial Sequence: Synthetic peptide
AENEIACTNPVATEQYGEMSETLQHGGR

SEQ ID NO: 73443 - protein, 31 aa, Artificial Sequence
  Description of Artificial Sequence: Synthetic polypeptide
DSEEIRTTNPVGTEQWGQCVSTNLQNFGSVQ

SEQ ID NO: 73444 - protein, 31 aa, Artificial Sequence
  Description of Artificial Sequence: Synthetic polypeptide
DEECIACTNPVATEPYNYNVSANLQRGDNMR

SEQ ID NO: 73445 - protein, 30 aa, Artificial Sequence
  Description of Artificial Sequence: Synthetic polypeptide
DSEEIRTTNPVGTEQWGTASTNLQHDDMRN

SEQ ID NO: 73446 - protein, 30 aa, Artificial Sequence
  Description of Artificial Sequence: Synthetic polypeptide
DSEEIRTTNPVGTEQWGTASTNLQHDGMHG

SEQ ID NO: 73447 - protein, 34 aa, Artificial Sequence
  Description of Artificial Sequence: Synthetic polypeptide
DEEEIRTTNPVATEQYGSVSPTLTNQLNMEVNEP

SEQ ID NO: 73448 - protein, 28 aa, Artificial Sequence
  Description of Artificial Sequence: Synthetic peptide
AENEIACTNPVATEQWGEVSENLQREGA

SEQ ID NO: 73449 - protein, 35 aa, Artificial Sequence
  Description of Artificial Sequence: Synthetic polypeptide
DEEEIRTTNPVATEQYGSVSPTLVLIQALSGNEPQ

SEQ ID NO: 73450 - protein, 34 aa, Artificial Sequence
  Description of Artificial Sequence: Synthetic polypeptide
DEEEIRTTNPVATEQYGSVSMTGNAGLRFGQLIE

SEQ ID NO: 73451 - protein, 30 aa, Artificial Sequence
  Description of Artificial Sequence: Synthetic polypeptide
DEECIACTNPVAYEQWDYSPSQNLQRGDNR

SEQ ID NO: 73452 - protein, 35 aa, Artificial Sequence
  Description of Artificial Sequence: Synthetic polypeptide
DEEEIRTTNPVATEQYGSVSPTLVLQANSGTNELT

SEQ ID NO: 73453 - protein, 30 aa, Artificial Sequence
  Description of Artificial Sequence: Synthetic polypeptide
MEEEIETTNPVATEQYGSVNTMQTQVGYDA

SEQ ID NO: 73454 - protein, 33 aa, Artificial Sequence
  Description of Artificial Sequence: Synthetic polypeptide
DEEEIRTTNPVATEQYGSVSSTHLWTSREFLEG

SEQ ID NO: 73455 - protein, 30 aa, Artificial Sequence
  Description of Artificial Sequence: Synthetic polypeptide
AENEIRCTNPVATEQYGSASSTPAGQRGGV

SEQ ID NO: 73456 - protein, 28 aa, Artificial Sequence
  Description of Artificial Sequence: Synthetic peptide
QEEEIASTNPCCSEQYGVVSDNLQSGNQ

SEQ ID NO: 73457 - protein, 31 aa, Artificial Sequence
  Description of Artificial Sequence: Synthetic polypeptide
DESEIRTTNPVATEQYGCVETWTLQRPEDHS

SEQ ID NO: 73458 - protein, 28 aa, Artificial Sequence
  Description of Artificial Sequence: Synthetic peptide
QEEEIASTNPCSSEQYGIVSCNLQSGTR

SEQ ID NO: 73459 - protein, 32 aa, Artificial Sequence
  Description of Artificial Sequence: Synthetic polypeptide
DEDEIATTNPVAYEQYGSVAGTNLPETGDNDR

SEQ ID NO: 73460 - protein, 33 aa, Artificial Sequence
  Description of Artificial Sequence: Synthetic polypeptide
DESEIRTTNPVATEQYGCVCSTGNLQNFNSNQS

SEQ ID NO: 73461 - protein, 28 aa, Artificial Sequence
  Description of Artificial Sequence: Synthetic peptide
QEEEIASTNPIATEQYGSVSETLMHGDI

SEQ ID NO: 73462 - protein, 33 aa, Artificial Sequence
  Description of Artificial Sequence: Synthetic polypeptide
AEEEIRTTNPVATEQYGSVVTVTVNLGNDTGNG

SEQ ID NO: 73463 - protein, 32 aa, Artificial Sequence
  Description of Artificial Sequence: Synthetic polypeptide
DEEEIRTTNPVATEQYGSVSTEPNTREDESID

SEQ ID NO: 73464 - protein, 32 aa, Artificial Sequence
  Description of Artificial Sequence: Synthetic polypeptide
DESEIRTTNPVATEQYGCVCSTELQNFNSEQS

SEQ ID NO: 73465 - protein, 35 aa, Artificial Sequence
  Description of Artificial Sequence: Synthetic polypeptide
DEEEIRTTNPVATEQYGSVSTETDLQPREVNEIFF

SEQ ID NO: 73466 - protein, 35 aa, Artificial Sequence
  Description of Artificial Sequence: Synthetic polypeptide
DEEEIRTTNPVATEQYGSVSTETGLQQRQNNNVED

SEQ ID NO: 73467 - protein, 32 aa, Artificial Sequence
  Description of Artificial Sequence: Synthetic polypeptide
DEEEIATTNPVATEPYGCVSTTLDLAARLSNR

SEQ ID NO: 73468 - protein, 28 aa, Artificial Sequence
  Description of Artificial Sequence: Synthetic peptide
QEEEIASTNPVATEQYGSMASTLMHGDI

SEQ ID NO: 73469 - protein, 30 aa, Artificial Sequence
  Description of Artificial Sequence: Synthetic polypeptide
DEDEIATTNPVAYEQYGSVAATNDTTEGND

SEQ ID NO: 73470 - protein, 31 aa, Artificial Sequence
  Description of Artificial Sequence: Synthetic polypeptide
DEEEIRTTNPVATEQYGSVMTDHFTDSQNEG

SEQ ID NO: 73471 - protein, 33 aa, Artificial Sequence
  Description of Artificial Sequence: Synthetic polypeptide
DEEEIRTTNPVATEQYGSVSTEPAGPNHNGMNL

SEQ ID NO: 73472 - protein, 32 aa, Artificial Sequence
  Description of Artificial Sequence: Synthetic polypeptide
DESEIRTTNPVATEQYGCVTATLDLQRGSESQ

SEQ ID NO: 73473 - protein, 34 aa, Artificial Sequence
  Description of Artificial Sequence: Synthetic polypeptide
DEEEIRTTNPVATEQYGSVSTENVQSQQGEEIVT

SEQ ID NO: 73474 - protein, 33 aa, Artificial Sequence
  Description of Artificial Sequence: Synthetic polypeptide
DEEEIRTTNPVATEQYGSVNATDMQRNDSNQFQ

SEQ ID NO: 73475 - protein, 33 aa, Artificial Sequence
  Description of Artificial Sequence: Synthetic polypeptide
DEDEIATTNPVAYEQYGSVANTALQNRDGNTRM

SEQ ID NO: 73476 - protein, 31 aa, Artificial Sequence
  Description of Artificial Sequence: Synthetic polypeptide
QEEEIAPTNPCATEQYGIVSTCPNLNSGMNR

SEQ ID NO: 73477 - protein, 28 aa, Artificial Sequence
  Description of Artificial Sequence: Synthetic peptide
QEEEIAPTNPCCSEQYGVVSCNLQSGTR

SEQ ID NO: 73478 - protein, 28 aa, Artificial Sequence
  Description of Artificial Sequence: Synthetic peptide
QEEEIAPTNPCCTEQYGVVSDNLQSGTQ

SEQ ID NO: 73479 - protein, 29 aa, Artificial Sequence
  Description of Artificial Sequence: Synthetic peptide
DEDEIATTNPVAYEQYGSVANNDTQGNPL

SEQ ID NO: 73480 - protein, 35 aa, Artificial Sequence
  Description of Artificial Sequence: Synthetic polypeptide
DEEEIATTNPVATEHYGSVSCTMNALSQQRGGNQP

SEQ ID NO: 73481 - protein, 33 aa, Artificial Sequence
  Description of Artificial Sequence: Synthetic polypeptide
DEEEIATTNPVATEIYGSVATGNLMQGEGNNEQ

SEQ ID NO: 73482 - protein, 32 aa, Artificial Sequence
  Description of Artificial Sequence: Synthetic polypeptide
DEEEIATTNPVATEIYGVVSTNLNGEEGNNEQ

SEQ ID NO: 73483 - protein, 28 aa, Artificial Sequence
  Description of Artificial Sequence: Synthetic peptide
QEEEIAPTNPCSSEQYGIVSCNLQSGTR

SEQ ID NO: 73484 - protein, 32 aa, Artificial Sequence
  Description of Artificial Sequence: Synthetic polypeptide
DEDEIATTNPVAYEQYGSVAITNLQVGDNPDG

SEQ ID NO: 73485 - protein, 30 aa, Artificial Sequence
  Description of Artificial Sequence: Synthetic polypeptide
QEEEIAPTNPCSTEQYGIVSCPNLQSGMNR

SEQ ID NO: 73486 - protein, 33 aa, Artificial Sequence
  Description of Artificial Sequence: Synthetic polypeptide
DEEEIATTNPVATENYGSVSTGGQDRGGSNGED

SEQ ID NO: 73487 - protein, 31 aa, Artificial Sequence
  Description of Artificial Sequence: Synthetic polypeptide
QEEEIAPTNPCSTEQYGIVSTCPNLQSGMNR

SEQ ID NO: 73488 - protein, 34 aa, Artificial Sequence
  Description of Artificial Sequence: Synthetic polypeptide
AEEEIRTTNPVATEQYGSVVTVVSTNQQTGTNQE

SEQ ID NO: 73489 - protein, 33 aa, Artificial Sequence
  Description of Artificial Sequence: Synthetic polypeptide
DEEEIRTTNPVATEQYGSVSTEYDLNFTQNEEL

SEQ ID NO: 73490 - protein, 30 aa, Artificial Sequence
  Description of Artificial Sequence: Synthetic polypeptide
DEDEIATTNPVAYEQYGSVAATNDTRQGPD

SEQ ID NO: 73491 - protein, 28 aa, Artificial Sequence
  Description of Artificial Sequence: Synthetic peptide
QEEEIASTNPVATEQYGVVPEVLQHGEK

SEQ ID NO: 73492 - protein, 28 aa, Artificial Sequence
  Description of Artificial Sequence: Synthetic peptide
QEEEIASTNPVATEQYGVVPEVLQHGEQ

SEQ ID NO: 73493 - protein, 34 aa, Artificial Sequence
  Description of Artificial Sequence: Synthetic polypeptide
DEEEIRTTNPVATEQYGSVMSGMFNLDQEGVEGI

SEQ ID NO: 73494 - protein, 31 aa, Artificial Sequence
  Description of Artificial Sequence: Synthetic polypeptide
DEDEIATTNPVAYEQYGSVAATNDQPGVNTD

SEQ ID NO: 73495 - protein, 32 aa, Artificial Sequence
  Description of Artificial Sequence: Synthetic polypeptide
DEEEIATTNPVATEPYGSVSTNLDGEGGSGST

SEQ ID NO: 73496 - protein, 34 aa, Artificial Sequence
  Description of Artificial Sequence: Synthetic polypeptide
DEEEIRTTNPVATEQYGSVMSGMFNDEQEGVNID

SEQ ID NO: 73497 - protein, 31 aa, Artificial Sequence
  Description of Artificial Sequence: Synthetic polypeptide
DEDEIATTNPVAYEQYGSVAATNDGQPQGND

SEQ ID NO: 73498 - protein, 30 aa, Artificial Sequence
  Description of Artificial Sequence: Synthetic polypeptide
DEDEIATTNPVAYEQYGSVAATNDDPGNDM

SEQ ID NO: 73499 - protein, 31 aa, Artificial Sequence
  Description of Artificial Sequence: Synthetic polypeptide
DEDEIATTNPVAYEQYGSVAATANLMMPGNN

SEQ ID NO: 73500 - protein, 33 aa, Artificial Sequence
  Description of Artificial Sequence: Synthetic polypeptide
DEEEIRTTNPVATEQYGSVSTFNGLIETAEELW

SEQ ID NO: 73501 - protein, 28 aa, Artificial Sequence
  Description of Artificial Sequence: Synthetic peptide
QEEEIASTNPVGTEGYGVVSSNLQHGDQ

SEQ ID NO: 73502 - protein, 28 aa, Artificial Sequence
  Description of Artificial Sequence: Synthetic peptide
QEEEIASTNPVGTEQYGVMASNLQHGNQ

SEQ ID NO: 73503 - protein, 28 aa, Artificial Sequence
  Description of Artificial Sequence: Synthetic peptide
QEEEIASTNPVGTEQYGVMASTLQHGNQ

SEQ ID NO: 73504 - protein, 30 aa, Artificial Sequence
  Description of Artificial Sequence: Synthetic polypeptide
DEDEIATTNPVAYEQYGSVAASLQRESNDS

SEQ ID NO: 73505 - protein, 33 aa, Artificial Sequence
  Description of Artificial Sequence: Synthetic polypeptide
DESEIRTTNPVATEQWGSVSHINEPQDREGENG

SEQ ID NO: 73506 - protein, 28 aa, Artificial Sequence
  Description of Artificial Sequence: Synthetic peptide
QEEEIASTNPVGTEQYGVVSDTLQHGDQ

SEQ ID NO: 73507 - protein, 29 aa, Artificial Sequence
  Description of Artificial Sequence: Synthetic peptide
DEDEIATTNPVAYEQYGSVAANNDTDGNF

SEQ ID NO: 73508 - protein, 33 aa, Artificial Sequence
  Description of Artificial Sequence: Synthetic polypeptide
DEEEIRTTNPVATEQYGSVMSGMFNNDNQEVNI

SEQ ID NO: 73509 - protein, 32 aa, Artificial Sequence
  Description of Artificial Sequence: Synthetic polypeptide
DEEEIATTNPVATEGYGSVCSGTNLRDGGQLL

SEQ ID NO: 73510 - protein, 33 aa, Artificial Sequence
  Description of Artificial Sequence: Synthetic polypeptide
DEEEIRTTNPVATEQYGSVMSGMFNNDQEEINI

SEQ ID NO: 73511 - protein, 34 aa, Artificial Sequence
  Description of Artificial Sequence: Synthetic polypeptide
AEEEIRTTNPVATEQYGSVVTVTTNLQNGNTNAQ

SEQ ID NO: 73512 - protein, 33 aa, Artificial Sequence
  Description of Artificial Sequence: Synthetic polypeptide
DEEEIRTTNPVATEQYGSVMSNVDVDQRGSIEA

SEQ ID NO: 73513 - protein, 33 aa, Artificial Sequence
  Description of Artificial Sequence: Synthetic polypeptide
DEEEIRTTNPVATEQYGSVMSNTPDQLVQENID

SEQ ID NO: 73514 - protein, 34 aa, Artificial Sequence
  Description of Artificial Sequence: Synthetic polypeptide
DEEEIRTTNPVATEQYGSVMSNTDNEGQEEDNIG

SEQ ID NO: 73515 - protein, 29 aa, Artificial Sequence
  Description of Artificial Sequence: Synthetic peptide
DEDEIATTNPVAYEQYGSVAATNDTAPND

SEQ ID NO: 73516 - protein, 33 aa, Artificial Sequence
  Description of Artificial Sequence: Synthetic polypeptide
DEEEIRTTNPVATEQYGSVSTFGFGDNEGGNDI

SEQ ID NO: 73517 - protein, 28 aa, Artificial Sequence
  Description of Artificial Sequence: Synthetic peptide
QEEEIASTNPVCTEQYGEASDNLQSGEK

SEQ ID NO: 73518 - protein, 28 aa, Artificial Sequence
  Description of Artificial Sequence: Synthetic peptide
QEEEIASTNPVCTEQYGVAPDNLQSGNK

SEQ ID NO: 73519 - protein, 28 aa, Artificial Sequence
  Description of Artificial Sequence: Synthetic peptide
QEEEIASTNPVCTEQYGVAPDNLQSGNQ

SEQ ID NO: 73520 - protein, 30 aa, Artificial Sequence
  Description of Artificial Sequence: Synthetic polypeptide
DEDEIATTNPVAYEQYGSVAATNDTAGNHN

SEQ ID NO: 73521 - protein, 30 aa, Artificial Sequence
  Description of Artificial Sequence: Synthetic polypeptide
DEDEIATTNPVAYEQYGSVAATNDTAGNFF

SEQ ID NO: 73522 - protein, 28 aa, Artificial Sequence
  Description of Artificial Sequence: Synthetic peptide
QEEEIASTNPVCTEQYGVASDNLQHENQ

SEQ ID NO: 73523 - protein, 28 aa, Artificial Sequence
  Description of Artificial Sequence: Synthetic peptide
QEEEIASTNPVCTEQYGVMASNLQHGNQ

SEQ ID NO: 73524 - protein, 33 aa, Artificial Sequence
  Description of Artificial Sequence: Synthetic polypeptide
DEEEIRTTNPVATEQYGSVSTFLNVEEEENSSF

SEQ ID NO: 73525 - protein, 33 aa, Artificial Sequence
  Description of Artificial Sequence: Synthetic polypeptide
DEEEIRTTNPVATEQYGSVMSGMFNNDQEEVNT

SEQ ID NO: 73526 - protein, 33 aa, Artificial Sequence
  Description of Artificial Sequence: Synthetic polypeptide
DEEEIRTTNPVATEQYGSVSTFLNVEREEEQTS

SEQ ID NO: 73527 - protein, 33 aa, Artificial Sequence
  Description of Artificial Sequence: Synthetic polypeptide
AEEEIRTTNPVATEQYGSVVTVTTNLQEVTNNS

SEQ ID NO: 73528 - protein, 31 aa, Artificial Sequence
  Description of Artificial Sequence: Synthetic polypeptide
QEEEIACTNPVATESYGSVATNLQRDQNDTA

SEQ ID NO: 73529 - protein, 30 aa, Artificial Sequence
  Description of Artificial Sequence: Synthetic polypeptide
QEEEIACTNPVATESYGCVATNLQEAGNDF

SEQ ID NO: 73530 - protein, 32 aa, Artificial Sequence
  Description of Artificial Sequence: Synthetic polypeptide
DEEEIRTTNPVATEQYGSVNCIVTEQRTVNDN

SEQ ID NO: 73531 - protein, 32 aa, Artificial Sequence
  Description of Artificial Sequence: Synthetic polypeptide
QEEEIACTNPVATEQYGSVAATANLQDAGMNN

SEQ ID NO: 73532 - protein, 33 aa, Artificial Sequence
  Description of Artificial Sequence: Synthetic polypeptide
QEEEIACTNPVATEQYGSVAGTNLQEAGENTRE

SEQ ID NO: 73533 - protein, 32 aa, Artificial Sequence
  Description of Artificial Sequence: Synthetic polypeptide
QEEEIACTNPVATEQYGSVASATNLTAAEENR

SEQ ID NO: 73534 - protein, 30 aa, Artificial Sequence
  Description of Artificial Sequence: Synthetic polypeptide
DESEIRTTNPVATEQYGNVSETEMNRAEDA

SEQ ID NO: 73535 - protein, 30 aa, Artificial Sequence
  Description of Artificial Sequence: Synthetic polypeptide
QEEEIACTNPVATEQYGSVATNHQAEDGED

SEQ ID NO: 73536 - protein, 32 aa, Artificial Sequence
  Description of Artificial Sequence: Synthetic polypeptide
DEDEIATTNPVAYEQYGSVATNLADDPGDNRH

SEQ ID NO: 73537 - protein, 31 aa, Artificial Sequence
  Description of Artificial Sequence: Synthetic polypeptide
DEDEIATTNPVAYEQYGSVATNLADDGDNNH

SEQ ID NO: 73538 - protein, 34 aa, Artificial Sequence
  Description of Artificial Sequence: Synthetic polypeptide
DEEEIRTTNPVATEQYGSVNGDTDNNQQGGGGNE

SEQ ID NO: 73539 - protein, 30 aa, Artificial Sequence
  Description of Artificial Sequence: Synthetic polypeptide
QEEEIACTNPVATEQYGSVATNLQAAPQGE

SEQ ID NO: 73540 - protein, 34 aa, Artificial Sequence
  Description of Artificial Sequence: Synthetic polypeptide
DEEEIRTTNPVATEQYGSVNGDGNLQGEGNNNEG

SEQ ID NO: 73541 - protein, 30 aa, Artificial Sequence
  Description of Artificial Sequence: Synthetic polypeptide
QEEEIACTNPVATEQYGSVATNLQATEHDH

SEQ ID NO: 73542 - protein, 32 aa, Artificial Sequence
  Description of Artificial Sequence: Synthetic polypeptide
QEEEIACTNPVATEQYGSVATNLQDAGDNNDD

SEQ ID NO: 73543 - protein, 31 aa, Artificial Sequence
  Description of Artificial Sequence: Synthetic polypeptide
QEEEIACTNPVATEQYGSVATNLQDDQNDFA

SEQ ID NO: 73544 - protein, 35 aa, Artificial Sequence
  Description of Artificial Sequence: Synthetic polypeptide
DESEIRTTNPVATEQYGKVVCSTGNALQGTGNNRE

SEQ ID NO: 73545 - protein, 31 aa, Artificial Sequence
  Description of Artificial Sequence: Synthetic polypeptide
QEEEIACTNPVATEQYGSVATNLQDQMNDKA

SEQ ID NO: 73546 - protein, 31 aa, Artificial Sequence
  Description of Artificial Sequence: Synthetic polypeptide
QEEEIACTNPVATEQYGSCSTHLQPDQGDRE

SEQ ID NO: 73547 - protein, 32 aa, Artificial Sequence
  Description of Artificial Sequence: Synthetic polypeptide
QEEEIACTNPVATEQYGSVATNLQDRPGDIES

SEQ ID NO: 73548 - protein, 28 aa, Artificial Sequence
  Description of Artificial Sequence: Synthetic peptide
QEEEIACTNPVATEQYGEASENCQREEK

SEQ ID NO: 73549 - protein, 28 aa, Artificial Sequence
  Description of Artificial Sequence: Synthetic peptide
QEEEIACTNPVATEQYGEAPENLMRGEK

SEQ ID NO: 73550 - protein, 28 aa, Artificial Sequence
  Description of Artificial Sequence: Synthetic peptide
QEEEIACTNPVATEQYGCVATNLTDVDQ

SEQ ID NO: 73551 - protein, 31 aa, Artificial Sequence
  Description of Artificial Sequence: Synthetic polypeptide
QEEEIACTNPVATEQYGCVATNLTQDGDNDA

SEQ ID NO: 73552 - protein, 30 aa, Artificial Sequence
  Description of Artificial Sequence: Synthetic polypeptide
DEDEIATTNPVAYEQYGSVATNLETDQNDF

SEQ ID NO: 73553 - protein, 31 aa, Artificial Sequence
  Description of Artificial Sequence: Synthetic polypeptide
QEEEIACTNPVATEQYGCVSTNLQDTGDIES

SEQ ID NO: 73554 - protein, 30 aa, Artificial Sequence
  Description of Artificial Sequence: Synthetic polypeptide
QEEEIACTNPVATEQYGCVSTNLQEEEDTM

SEQ ID NO: 73555 - protein, 32 aa, Artificial Sequence
  Description of Artificial Sequence: Synthetic polypeptide
DEEEIRTTNPVATEQYGSVNGMNLDNIGDEIE

SEQ ID NO: 73556 - protein, 32 aa, Artificial Sequence
  Description of Artificial Sequence: Synthetic polypeptide
DEDEIATTNPVAYEQYGSVATNLEQNRHGETN

SEQ ID NO: 73557 - protein, 32 aa, Artificial Sequence
  Description of Artificial Sequence: Synthetic polypeptide
DEEEIRTTNPVATEQYGSVNGMNLDGNIGEDI

SEQ ID NO: 73558 - protein, 34 aa, Artificial Sequence
  Description of Artificial Sequence: Synthetic polypeptide
AEEEIRTTNPVATEQYGSVVVSTNNNQLQGENGD

SEQ ID NO: 73559 - protein, 33 aa, Artificial Sequence
  Description of Artificial Sequence: Synthetic polypeptide
DEEEIRTTNPVATEQYGSVNGMNELGDNSGERD

SEQ ID NO: 73560 - protein, 31 aa, Artificial Sequence
  Description of Artificial Sequence: Synthetic polypeptide
DEEEIRTTNPVATEQYGSVNGMNDDSGDTVG

SEQ ID NO: 73561 - protein, 35 aa, Artificial Sequence
  Description of Artificial Sequence: Synthetic polypeptide
AEEEIRTTNPVATEQYGSVVVSTNNNLQQGTANVD

SEQ ID NO: 73562 - protein, 32 aa, Artificial Sequence
  Description of Artificial Sequence: Synthetic polypeptide
DEDEIATTNPVAYEQYGSVATNLDQGTGNNDQ

SEQ ID NO: 73563 - protein, 28 aa, Artificial Sequence
  Description of Artificial Sequence: Synthetic peptide
QEEEIACTNPVATEQYGEAPENLMHENR

SEQ ID NO: 73564 - protein, 30 aa, Artificial Sequence
  Description of Artificial Sequence: Synthetic polypeptide
DESEIRTTNPVATEQYGNVSNTEMNRAEDA

SEQ ID NO: 73565 - protein, 28 aa, Artificial Sequence
  Description of Artificial Sequence: Synthetic peptide
QEEEIACTNPVATEQYGEASENCQHEER

SEQ ID NO: 73566 - protein, 32 aa, Artificial Sequence
  Description of Artificial Sequence: Synthetic polypeptide
DESEIRTTNPVATEQWGSVSENEPQDREEENA

SEQ ID NO: 73567 - protein, 32 aa, Artificial Sequence
  Description of Artificial Sequence: Synthetic polypeptide
AEEEIRTTNPVATEQYGSVVVSNNILNTNNAN

SEQ ID NO: 73568 - protein, 30 aa, Artificial Sequence
  Description of Artificial Sequence: Synthetic polypeptide
DEDEIATTNPVAYEQYGSVATNGQDSNGDM

SEQ ID NO: 73569 - protein, 32 aa, Artificial Sequence
  Description of Artificial Sequence: Synthetic polypeptide
AEEEIRTTNPVATEQYGSVVVNTNDDGGVENT

SEQ ID NO: 73570 - protein, 30 aa, Artificial Sequence
  Description of Artificial Sequence: Synthetic polypeptide
QEEEIACTNPVATEQYGSVATNLQSAPSIE

SEQ ID NO: 73571 - protein, 35 aa, Artificial Sequence
  Description of Artificial Sequence: Synthetic polypeptide
DESEIRTTNPVATEQYGKVPSCTMNLQRTGTNNAL

SEQ ID NO: 73572 - protein, 31 aa, Artificial Sequence
  Description of Artificial Sequence: Synthetic polypeptide
QEEEIACTNPVATEQYGSVATNLQSHNNDTA

SEQ ID NO: 73573 - protein, 35 aa, Artificial Sequence
  Description of Artificial Sequence: Synthetic polypeptide
DESEIRTTNPVATEQYGKVPSCTGPLQRTGTNNRG

SEQ ID NO: 73574 - protein, 35 aa, Artificial Sequence
  Description of Artificial Sequence: Synthetic polypeptide
DESEIRTTNPVATEQYGKVPSCTGNLQRTGGNNWS

SEQ ID NO: 73575 - protein, 35 aa, Artificial Sequence
  Description of Artificial Sequence: Synthetic polypeptide
DESEIRTTNPVATEQYGKVPSCTGNLQRTATNNRD

SEQ ID NO: 73576 - protein, 29 aa, Artificial Sequence
  Description of Artificial Sequence: Synthetic peptide
QEEEIACTNPVATEQYGSVATNLTDVDMD

SEQ ID NO: 73577 - protein, 31 aa, Artificial Sequence
  Description of Artificial Sequence: Synthetic polypeptide
DEDEIATTNPVAYEQYGSVATALQRDSNGSD

SEQ ID NO: 73578 - protein, 31 aa, Artificial Sequence
  Description of Artificial Sequence: Synthetic polypeptide
QEEEIACTNPVATEQYGSVATTNLQHGDEAD

SEQ ID NO: 73579 - protein, 36 aa, Artificial Sequence
  Description of Artificial Sequence: Synthetic polypeptide
DESEIRTTNPVATEQYGKVPSCTGNLFQRTGENNRS

SEQ ID NO: 73580 - protein, 28 aa, Artificial Sequence
  Description of Artificial Sequence: Synthetic peptide
QEEEIACTNPVATEQYGSVPEVCQHEER

SEQ ID NO: 73581 - protein, 32 aa, Artificial Sequence
  Description of Artificial Sequence: Synthetic polypeptide
QESEIRTTNPVATECWGSVSCINLPQDRGENL

SEQ ID NO: 73582 - protein, 33 aa, Artificial Sequence
  Description of Artificial Sequence: Synthetic polypeptide
DESEIRTTNPVATEQYGKTVSCTNQSQETGNNS

SEQ ID NO: 73583 - protein, 28 aa, Artificial Sequence
  Description of Artificial Sequence: Synthetic peptide
DEEEIATTNPVATEGYGEAPEVIQREQR

SEQ ID NO: 73584 - protein, 35 aa, Artificial Sequence
  Description of Artificial Sequence: Synthetic polypeptide
DESEIRTTNPVATEQYGKVPSCTMNLQRTVTNNRQ

SEQ ID NO: 73585 - protein, 33 aa, Artificial Sequence
  Description of Artificial Sequence: Synthetic polypeptide
DEEEIRTTNPVATEQYGSVNETLDYLQETQNQQ

SEQ ID NO: 73586 - protein, 36 aa, Artificial Sequence
  Description of Artificial Sequence: Synthetic polypeptide
DESEIRTTNPVATEQYGKVPSCTVNELQRTGTNNRS

SEQ ID NO: 73587 - protein, 32 aa, Artificial Sequence
  Description of Artificial Sequence: Synthetic polypeptide
QEEEIACTNPVATEQYGSVATNLQRDQMGDTM

SEQ ID NO: 73588 - protein, 32 aa, Artificial Sequence
  Description of Artificial Sequence: Synthetic polypeptide
QEEEIACTNPVATEQYGSVATNLQEAEDGNED

SEQ ID NO: 73589 - protein, 31 aa, Artificial Sequence
  Description of Artificial Sequence: Synthetic polypeptide
QEEEIACTNPVATEQYGSVATNLQEAEDTER

SEQ ID NO: 73590 - protein, 31 aa, Artificial Sequence
  Description of Artificial Sequence: Synthetic polypeptide
DEDEIATTNPVAYEQYGSVATNDTQDNGNVS

SEQ ID NO: 73591 - protein, 31 aa, Artificial Sequence
  Description of Artificial Sequence: Synthetic polypeptide
QEEEIACTNPVATEQYGSVATNLQGEEPTRE

SEQ ID NO: 73592 - protein, 32 aa, Artificial Sequence
  Description of Artificial Sequence: Synthetic polypeptide
AEEEIRTTNPVATEQYGSVVVNTNQSGVDNGT

SEQ ID NO: 73593 - protein, 30 aa, Artificial Sequence
  Description of Artificial Sequence: Synthetic polypeptide
DEDEIATTNPVAYEQYGSVATNDQRDATAN

SEQ ID NO: 73594 - protein, 34 aa, Artificial Sequence
  Description of Artificial Sequence: Synthetic polypeptide
DEEEIRTTNPVATEQYGSVNDTTDLNQQGEGGNT

SEQ ID NO: 73595 - protein, 33 aa, Artificial Sequence
  Description of Artificial Sequence: Synthetic polypeptide
DEEEIATTNPVATECYGSVSTVNQGMGPNGGNR

SEQ ID NO: 73596 - protein, 31 aa, Artificial Sequence
  Description of Artificial Sequence: Synthetic polypeptide
DEEEIATTNPVATECYGTVSTNLNGEDNNEQ

SEQ ID NO: 73597 - protein, 30 aa, Artificial Sequence
  Description of Artificial Sequence: Synthetic polypeptide
DEDEIATTNPVAYEQYGSVATNDQANGTEH

SEQ ID NO: 73598 - protein, 32 aa, Artificial Sequence
  Description of Artificial Sequence: Synthetic polypeptide
QEEEIACTNPVATEQYGSVATNLQMQGGNDTL

SEQ ID NO: 73599 - protein, 35 aa, Artificial Sequence
  Description of Artificial Sequence: Synthetic polypeptide
DESEIRTTNPVATEQYGKVSCTGNNLQRTGTNNLE

SEQ ID NO: 73600 - protein, 34 aa, Artificial Sequence
  Description of Artificial Sequence: Synthetic polypeptide
DESEIRTTNPVATEQYGKVSCCGNLQFTGTNNRE

SEQ ID NO: 73601 - protein, 31 aa, Artificial Sequence
  Description of Artificial Sequence: Synthetic polypeptide
AEEEIRTTNPVATEQYGSVVVNTNDTGVDNT

SEQ ID NO: 73602 - protein, 34 aa, Artificial Sequence
  Description of Artificial Sequence: Synthetic polypeptide
DEEEIRTTNPVATEQYGSVNDDTMNLINGNGNGP

SEQ ID NO: 73603 - protein, 35 aa, Artificial Sequence
  Description of Artificial Sequence: Synthetic polypeptide
DESEIRTTNPVATEQYGKVPSYTGNTQRTGTNNRE

SEQ ID NO: 73604 - protein, 31 aa, Artificial Sequence
  Description of Artificial Sequence: Synthetic polypeptide
DEDEIATTNPVAYEQYGSVAANLQVGDNTPM

SEQ ID NO: 73605 - protein, 28 aa, Artificial Sequence
  Description of Artificial Sequence: Synthetic peptide
QEEEIASVNGVCTEQYGVVSDNLQSGNQ

SEQ ID NO: 73606 - protein, 32 aa, Artificial Sequence
  Description of Artificial Sequence: Synthetic polypeptide
DEEEIRTTNPVATEQYGSVMSDMEGQEEDNIG

SEQ ID NO: 73607 - protein, 28 aa, Artificial Sequence
  Description of Artificial Sequence: Synthetic peptide
QEEEIATTNPVATECYGSVPCNCQHEEG

SEQ ID NO: 73608 - protein, 28 aa, Artificial Sequence
  Description of Artificial Sequence: Synthetic peptide
QEEEIATTNPVATECYGSVPCNCQHEEK

SEQ ID NO: 73609 - protein, 28 aa, Artificial Sequence
  Description of Artificial Sequence: Synthetic peptide
QEEEIATTNPVATECYGSVPENEQHEEK

SEQ ID NO: 73610 - protein, 31 aa, Artificial Sequence
  Description of Artificial Sequence: Synthetic polypeptide
DEDEIATTNPVAYEQWGTVSTNLQGEHGNEG

SEQ ID NO: 73611 - protein, 33 aa, Artificial Sequence
  Description of Artificial Sequence: Synthetic polypeptide
DEEEIRTTNPVATEQYGSVMGQNMGQENGNGEG

SEQ ID NO: 73612 - protein, 33 aa, Artificial Sequence
  Description of Artificial Sequence: Synthetic polypeptide
QEEEIATTNPVATECYGSVSTPCLPQMRGMNPL

SEQ ID NO: 73613 - protein, 28 aa, Artificial Sequence
  Description of Artificial Sequence: Synthetic peptide
QEEEIATTNPVATECYGVVSECLQHEEL

SEQ ID NO: 73614 - protein, 34 aa, Artificial Sequence
  Description of Artificial Sequence: Synthetic polypeptide
DEEEIRTTNPVATEQYGSVSTGLQQNVGMGEFTT

SEQ ID NO: 73615 - protein, 33 aa, Artificial Sequence
  Description of Artificial Sequence: Synthetic polypeptide
AEEEIRTTNPVATEQYGSVVTVTNLNSNQGNQD

SEQ ID NO: 73616 - protein, 34 aa, Artificial Sequence
  Description of Artificial Sequence: Synthetic polypeptide
AEEEIRTTNPVATEQYGSVVTVTNLNQEEGTNTG

SEQ ID NO: 73617 - protein, 34 aa, Artificial Sequence
  Description of Artificial Sequence: Synthetic polypeptide
AEEEIRTTNPVATEQYGSVVTVTNLGGQEQGNND

SEQ ID NO: 73618 - protein, 34 aa, Artificial Sequence
  Description of Artificial Sequence: Synthetic polypeptide
AEEEIRTTNPVATEQYGSVVTVTNGNLQQGTNID

SEQ ID NO: 73619 - protein, 33 aa, Artificial Sequence
  Description of Artificial Sequence: Synthetic polypeptide
AEEEIRTTNPVATEQYGSVVTVTNGNLNQGNIA

SEQ ID NO: 73620 - protein, 33 aa, Artificial Sequence
  Description of Artificial Sequence: Synthetic polypeptide
AEEEIRTTNPVATEQYGSVVTVTNGGNLQGTNI

SEQ ID NO: 73621 - protein, 34 aa, Artificial Sequence
  Description of Artificial Sequence: Synthetic polypeptide
AEEEIRTTNPVATEQYGSVVTVTDNGNLQQGNNI

SEQ ID NO: 73622 - protein, 28 aa, Artificial Sequence
  Description of Artificial Sequence: Synthetic peptide
QEEEIATTNPVATECYGEVSECLQHEEL

SEQ ID NO: 73623 - protein, 33 aa, Artificial Sequence
  Description of Artificial Sequence: Synthetic polypeptide
DESEIRTTNPVATEIWGSVSEINELQDREGENG

SEQ ID NO: 73624 - protein, 33 aa, Artificial Sequence
  Description of Artificial Sequence: Synthetic polypeptide
DEEEIRTTNPVATEQYGSVSTGLEVELASEIRE

SEQ ID NO: 73625 - protein, 35 aa, Artificial Sequence
  Description of Artificial Sequence: Synthetic polypeptide
DESEIRTTNPVATEPYGQVVSTNELSQYRHGGNNR

SEQ ID NO: 73626 - protein, 34 aa, Artificial Sequence
  Description of Artificial Sequence: Synthetic polypeptide
DEEEIRTTNPVATEQYGSVSTGGQSDQNEGGNQG

SEQ ID NO: 73627 - protein, 28 aa, Artificial Sequence
  Description of Artificial Sequence: Synthetic peptide
QEEEIATTNPVASEQYGIVSEVCQHETR

SEQ ID NO: 73628 - protein, 34 aa, Artificial Sequence
  Description of Artificial Sequence: Synthetic polypeptide
DEEEIRTTNPVATEQYGSVSTGGTGQNVGGGNQG

SEQ ID NO: 73629 - protein, 31 aa, Artificial Sequence
  Description of Artificial Sequence: Synthetic polypeptide
DEDEIATTNPVAYEQYGCVAGTNLQRADQRE

SEQ ID NO: 73630 - protein, 33 aa, Artificial Sequence
  Description of Artificial Sequence: Synthetic polypeptide
DEEEIRTTNPVATEQYGSVMGTDFNNQNEGGEI

SEQ ID NO: 73631 - protein, 32 aa, Artificial Sequence
  Description of Artificial Sequence: Synthetic polypeptide
DESEIRTTNPVATEPYGSISCENIPQQRNGNH

SEQ ID NO: 73632 - protein, 32 aa, Artificial Sequence
  Description of Artificial Sequence: Synthetic polypeptide
DESEIRTTNPVATEPYGSISCENEPQQRNGNH

SEQ ID NO: 73633 - protein, 28 aa, Artificial Sequence
  Description of Artificial Sequence: Synthetic peptide
QEEEIATTNPVASEQYGIVSEVCQSETR

SEQ ID NO: 73634 - protein, 32 aa, Artificial Sequence
  Description of Artificial Sequence: Synthetic polypeptide
DESEIRTTNPVATEPYGSISCENEPQQREGNH

SEQ ID NO: 73635 - protein, 28 aa, Artificial Sequence
  Description of Artificial Sequence: Synthetic peptide
QEEEIATTNPVATECYGDVSECLQHEEL

SEQ ID NO: 73636 - protein, 28 aa, Artificial Sequence
  Description of Artificial Sequence: Synthetic peptide
QEEEIATTNPVATECYGDVSECLQSEEL

SEQ ID NO: 73637 - protein, 32 aa, Artificial Sequence
  Description of Artificial Sequence: Synthetic polypeptide
DESEIRTTNPVATEPYGSISCENEPQDREGNH

SEQ ID NO: 73638 - protein, 34 aa, Artificial Sequence
  Description of Artificial Sequence: Synthetic polypeptide
DEEEIRTTNPVATEQYGSVSTGLEMTMEFGNGGE

SEQ ID NO: 73639 - protein, 34 aa, Artificial Sequence
  Description of Artificial Sequence: Synthetic polypeptide
AEEEIRTTNPVATEQYGSVVTVTNLQSNENGNND

SEQ ID NO: 73640 - protein, 34 aa, Artificial Sequence
  Description of Artificial Sequence: Synthetic polypeptide
AEEEIRTTNPVATEQYGSVVTVTNLQQNNGINDE

SEQ ID NO: 73641 - protein, 33 aa, Artificial Sequence
  Description of Artificial Sequence: Synthetic polypeptide
DESEIRTTNPVATEPWGSVSVINELQIREGENG

SEQ ID NO: 73642 - protein, 34 aa, Artificial Sequence
  Description of Artificial Sequence: Synthetic polypeptide
DEEEIRTTNPVATEQYGSVMGTDNNMQEGNGGFE

SEQ ID NO: 73643 - protein, 30 aa, Artificial Sequence
  Description of Artificial Sequence: Synthetic polypeptide
QEEEIATTNPVATEPYGNVATNLARGPESL

SEQ ID NO: 73644 - protein, 33 aa, Artificial Sequence
  Description of Artificial Sequence: Synthetic polypeptide
DEEEIRTTNPVATEQYGSVMGNLDSGGEFNEMT

SEQ ID NO: 73645 - protein, 31 aa, Artificial Sequence
  Description of Artificial Sequence: Synthetic polypeptide
DEDEIATTNPVAYEQWGSVSTNDGNEGGNTR

SEQ ID NO: 73646 - protein, 32 aa, Artificial Sequence
  Description of Artificial Sequence: Synthetic polypeptide
DEDEIATTNPVAYEQWGSVSTGLTQGGMGGNR

SEQ ID NO: 73647 - protein, 34 aa, Artificial Sequence
  Description of Artificial Sequence: Synthetic polypeptide
DEEEIRTTNPVATEQYGSVSTGNFPQTSENNELY

SEQ ID NO: 73648 - protein, 30 aa, Artificial Sequence
  Description of Artificial Sequence: Synthetic polypeptide
QEEEIATTNPVATEQYGCVAATNLTDGDDL

SEQ ID NO: 73649 - protein, 32 aa, Artificial Sequence
  Description of Artificial Sequence: Synthetic polypeptide
DEDEIATTNPVAYEQWGSVSTALQPQQGNNDR

SEQ ID NO: 73650 - protein, 34 aa, Artificial Sequence
  Description of Artificial Sequence: Synthetic polypeptide
DEEEIRTTNPVATEQYGSVSTGNGGGDGEGNEQQ

SEQ ID NO: 73651 - protein, 31 aa, Artificial Sequence
  Description of Artificial Sequence: Synthetic polypeptide
QEEEIATTNPVATEQYGCVAGTALTQDGERH

SEQ ID NO: 73652 - protein, 30 aa, Artificial Sequence
  Description of Artificial Sequence: Synthetic polypeptide
QEEEIATTNPVATEQYGCVAGTMLQHDHNP

SEQ ID NO: 73653 - protein, 32 aa, Artificial Sequence
  Description of Artificial Sequence: Synthetic polypeptide
QEEEIATTNPVATEQYGCVATNLQRMNPNEHQ

SEQ ID NO: 73654 - protein, 33 aa, Artificial Sequence
  Description of Artificial Sequence: Synthetic polypeptide
AEEEIRTTNPVATEQYGSVVTVNQQSNEEGNNT

SEQ ID NO: 73655 - protein, 31 aa, Artificial Sequence
  Description of Artificial Sequence: Synthetic polypeptide
QEEEIATTNPVATEQYGCVATNLTNNGDNPF

SEQ ID NO: 73656 - protein, 33 aa, Artificial Sequence
  Description of Artificial Sequence: Synthetic polypeptide
DEEEIRTTNPVATEQYGSVMGFGNGQEDGEGNI

SEQ ID NO: 73657 - protein, 31 aa, Artificial Sequence
  Description of Artificial Sequence: Synthetic polypeptide
QEEEIATTNPVATEQYGCVSGTMGLQHDDNP

SEQ ID NO: 73658 - protein, 33 aa, Artificial Sequence
  Description of Artificial Sequence: Synthetic polypeptide
AEEEIRTTNPVATEQYGSVVTVNNQSNEQGNNL

SEQ ID NO: 73659 - protein, 33 aa, Artificial Sequence
  Description of Artificial Sequence: Synthetic polypeptide
DEEEIRTTNPVATEQYGSVSTGNGHQEIDMILY

SEQ ID NO: 73660 - protein, 32 aa, Artificial Sequence
  Description of Artificial Sequence: Synthetic polypeptide
QEEEIATTNPVATEQYGCVAATNLQEAGNPDF

SEQ ID NO: 73661 - protein, 35 aa, Artificial Sequence
  Description of Artificial Sequence: Synthetic polypeptide
DESEIRTTNPVATEHYGKVPSCTGNLQRTGNNNRS

SEQ ID NO: 73662 - protein, 33 aa, Artificial Sequence
  Description of Artificial Sequence: Synthetic polypeptide
QEEEIATTNPVATEQYGCVAATNLQEAGENGRE

SEQ ID NO: 73663 - protein, 31 aa, Artificial Sequence
  Description of Artificial Sequence: Synthetic polypeptide
QEEEIATTNPVATEQYGCVAATNLAEAGNDN

SEQ ID NO: 73664 - protein, 30 aa, Artificial Sequence
  Description of Artificial Sequence: Synthetic polypeptide
QEEEIATTNPVATEPYGVVSANLDRDGPEE

SEQ ID NO: 73665 - protein, 30 aa, Artificial Sequence
  Description of Artificial Sequence: Synthetic polypeptide
QEEEIATTNPVATEQWGAVATNLQRNPDVS

SEQ ID NO: 73666 - protein, 32 aa, Artificial Sequence
  Description of Artificial Sequence: Synthetic polypeptide
DESEIRTTNPVATEGYGVVSSINLPQDRGEDI

SEQ ID NO: 73667 - protein, 32 aa, Artificial Sequence
  Description of Artificial Sequence: Synthetic polypeptide
DESEIRTTNPVATEGYGNVSNITEPQSRVGNG

SEQ ID NO: 73668 - protein, 35 aa, Artificial Sequence
  Description of Artificial Sequence: Synthetic polypeptide
DEEEIRTTNPVATEQYGSVMGMTNELQGNNGNEGQ

SEQ ID NO: 73669 - protein, 32 aa, Artificial Sequence
  Description of Artificial Sequence: Synthetic polypeptide
DESEIRTTNPVATEGYGNVSCINEQSRVGEQR

SEQ ID NO: 73670 - protein, 31 aa, Artificial Sequence
  Description of Artificial Sequence: Synthetic polypeptide
QEEEIATTNPVATEQWGSVATALPERPGDNT

SEQ ID NO: 73671 - protein, 31 aa, Artificial Sequence
  Description of Artificial Sequence: Synthetic polypeptide
QEEEIATTNPVATEQWGSVATNLDQVNDNPV

SEQ ID NO: 73672 - protein, 33 aa, Artificial Sequence
  Description of Artificial Sequence: Synthetic polypeptide
DEEEIRTTNPVATEQYGSVSTGLTFNDEGGGEQ

SEQ ID NO: 73673 - protein, 33 aa, Artificial Sequence
  Description of Artificial Sequence: Synthetic polypeptide
QEEEIATTNPVATEQWGSVSTPNPDQRNGNPGM

SEQ ID NO: 73674 - protein, 32 aa, Artificial Sequence
  Description of Artificial Sequence: Synthetic polypeptide
DEDEIATTNPVAYEQWGSVSTNLQGNAGENAM

SEQ ID NO: 73675 - protein, 32 aa, Artificial Sequence
  Description of Artificial Sequence: Synthetic polypeptide
DEDEIATTNPVAYEQWGSVSTNLQGDAGNNEQ

SEQ ID NO: 73676 - protein, 34 aa, Artificial Sequence
  Description of Artificial Sequence: Synthetic polypeptide
DEEEIRTTNPVATEQYGSVSTGMGQTGNNGNEDQ

SEQ ID NO: 73677 - protein, 33 aa, Artificial Sequence
  Description of Artificial Sequence: Synthetic polypeptide
DEEEIRTTNPVATEQYGSVSTGMNTDGGEGEQE

SEQ ID NO: 73678 - protein, 31 aa, Artificial Sequence
  Description of Artificial Sequence: Synthetic polypeptide
QEEEIATTNPVATEQYGCVAATANLQDGVDM

SEQ ID NO: 73679 - protein, 31 aa, Artificial Sequence
  Description of Artificial Sequence: Synthetic polypeptide
DEDEIATTNPVAYEQWGSVSTNLNAGEDGNA

SEQ ID NO: 73680 - protein, 30 aa, Artificial Sequence
  Description of Artificial Sequence: Synthetic polypeptide
QEEEIACTNPVATEQYGCVATNLTDGDNQY

SEQ ID NO: 73681 - protein, 28 aa, Artificial Sequence
  Description of Artificial Sequence: Synthetic peptide
QEEEIATTNPVASEQYGEVSEVCQHETR

SEQ ID NO: 73682 - protein, 30 aa, Artificial Sequence
  Description of Artificial Sequence: Synthetic polypeptide
DEDEIATTNPVAYEQYGCVATNLQGVNEDD

SEQ ID NO: 73683 - protein, 28 aa, Artificial Sequence
  Description of Artificial Sequence: Synthetic peptide
QEEEIASVNPVCSEQYGIVSDNLQSGNQ

SEQ ID NO: 73684 - protein, 28 aa, Artificial Sequence
  Description of Artificial Sequence: Synthetic peptide
QEEEIASVNPVCSEQYGVVSDNLQSGNQ

SEQ ID NO: 73685 - protein, 32 aa, Artificial Sequence
  Description of Artificial Sequence: Synthetic polypeptide
DEEEIRTTNPVATEQYGSVMNTFNGGGFGITV

SEQ ID NO: 73686 - protein, 32 aa, Artificial Sequence
  Description of Artificial Sequence: Synthetic polypeptide
DESEIRTTNPVATEQWGSVSCINEPQDREENG

SEQ ID NO: 73687 - protein, 28 aa, Artificial Sequence
  Description of Artificial Sequence: Synthetic peptide
QEEEIASVNPVCTEGYGVVSDNLQSGNQ

SEQ ID NO: 73688 - protein, 28 aa, Artificial Sequence
  Description of Artificial Sequence: Synthetic peptide
QEEEIASVNPVCTEQYGEASDNLQSGNK

SEQ ID NO: 73689 - protein, 28 aa, Artificial Sequence
  Description of Artificial Sequence: Synthetic peptide
QEEEIASVNPVCTEQYGVVASNLQHGNQ

SEQ ID NO: 73690 - protein, 32 aa, Artificial Sequence
  Description of Artificial Sequence: Synthetic polypeptide
DESEIRTTNPVATEQWGSVSCINEPMDRGENG

SEQ ID NO: 73691 - protein, 28 aa, Artificial Sequence
  Description of Artificial Sequence: Synthetic peptide
QEEEIASVNPVCTEQYGVVPDNLQSGNQ

SEQ ID NO: 73692 - protein, 28 aa, Artificial Sequence
  Description of Artificial Sequence: Synthetic peptide
QEEEIASVNPVCTEQYGVVPENLQSGNQ

SEQ ID NO: 73693 - protein, 28 aa, Artificial Sequence
  Description of Artificial Sequence: Synthetic peptide
QEEEIASVNPVCTEQYGVVSDCLQHGNL

SEQ ID NO: 73694 - protein, 32 aa, Artificial Sequence
  Description of Artificial Sequence: Synthetic polypeptide
DESEIRTTNPVATEQWGSVSCIDEQDREGENL

SEQ ID NO: 73695 - protein, 28 aa, Artificial Sequence
  Description of Artificial Sequence: Synthetic peptide
QEEEIASVNPVCTEQYGVVSDCLQSGNQ

SEQ ID NO: 73696 - protein, 28 aa, Artificial Sequence
  Description of Artificial Sequence: Synthetic peptide
QEEEIASVNPVCTEQYGVVSDNLQHENQ

SEQ ID NO: 73697 - protein, 28 aa, Artificial Sequence
  Description of Artificial Sequence: Synthetic peptide
QEEEIASVNPVCTEQYGVVSDNLQSGDQ

SEQ ID NO: 73698 - protein, 28 aa, Artificial Sequence
  Description of Artificial Sequence: Synthetic peptide
QEEEIASVNPVCSEQYGIVSCNLQSGTR

SEQ ID NO: 73699 - protein, 28 aa, Artificial Sequence
  Description of Artificial Sequence: Synthetic peptide
QEEEIASVNPVCTEQYGVVSDNLQSGEQ

SEQ ID NO: 73700 - protein, 33 aa, Artificial Sequence
  Description of Artificial Sequence: Synthetic polypeptide
DESEIRTTNPVATEQWGSVSCINEPQDREGENG

SEQ ID NO: 73701 - protein, 28 aa, Artificial Sequence
  Description of Artificial Sequence: Synthetic peptide
QEEEIASVNPVCCEQYGVVSDNLQSGNQ

SEQ ID NO: 73702 - protein, 33 aa, Artificial Sequence
  Description of Artificial Sequence: Synthetic polypeptide
DESEIRTTNPVATEQWGSVSEINEPQDREGENG

SEQ ID NO: 73703 - protein, 29 aa, Artificial Sequence
  Description of Artificial Sequence: Synthetic peptide
CEDEIACTNPVATEQYGETSENLQRGGEM

SEQ ID NO: 73704 - protein, 33 aa, Artificial Sequence
  Description of Artificial Sequence: Synthetic polypeptide
DESEIRTTNPVATEQWGSVSDINEPQDREGENG

SEQ ID NO: 73705 - protein, 31 aa, Artificial Sequence
  Description of Artificial Sequence: Synthetic polypeptide
DEEEIRTTNPVATEQYGSVMSDDHFTDSQNE

SEQ ID NO: 73706 - protein, 28 aa, Artificial Sequence
  Description of Artificial Sequence: Synthetic peptide
QEEEIASVNPCCTEQYGVVSDNLQSGNQ

SEQ ID NO: 73707 - protein, 32 aa, Artificial Sequence
  Description of Artificial Sequence: Synthetic polypeptide
DEEEIRTTNPVATEQYGSVMSDDEGQEDDNID

SEQ ID NO: 73708 - protein, 33 aa, Artificial Sequence
  Description of Artificial Sequence: Synthetic polypeptide
DEEEIATTNPVATEPYGSVVSTGNQSQRVQSRS

SEQ ID NO: 73709 - protein, 33 aa, Artificial Sequence
  Description of Artificial Sequence: Synthetic polypeptide
DESEIRTTNPVATEQWGSVSCINEVQDREGENG

SEQ ID NO: 73710 - protein, 28 aa, Artificial Sequence
  Description of Artificial Sequence: Synthetic peptide
QEEEIASVNPCSSEQYGVVSCNLQSGNR

SEQ ID NO: 73711 - protein, 33 aa, Artificial Sequence
  Description of Artificial Sequence: Synthetic polypeptide
DEEEIRTTNPVATEQYGSVMQPINLQPELGLTN

SEQ ID NO: 73712 - protein, 33 aa, Artificial Sequence
  Description of Artificial Sequence: Synthetic polypeptide
DESEIRTTNPVATEQWGSVSCINEPQMREGENV

SEQ ID NO: 73713 - protein, 33 aa, Artificial Sequence
  Description of Artificial Sequence: Synthetic polypeptide
DESEIRTTNPVATEQWGSVSCINEPQMREGENG

SEQ ID NO: 73714 - protein, 33 aa, Artificial Sequence
  Description of Artificial Sequence: Synthetic polypeptide
DESEIRTTNPVATEQWGSVSCINEPQDREGENL

SEQ ID NO: 73715 - protein, 34 aa, Artificial Sequence
  Description of Artificial Sequence: Synthetic polypeptide
DEEEIRTTNPVATEQYGSVMPTTGMLGERGINES

SEQ ID NO: 73716 - protein, 35 aa, Artificial Sequence
  Description of Artificial Sequence: Synthetic polypeptide
DEEEIRTTNPVATEQYGSVSTFNLNQSNMNLNPQV

SEQ ID NO: 73717 - protein, 28 aa, Artificial Sequence
  Description of Artificial Sequence: Synthetic peptide
QEEEIASVNPVCSEQYGIVSCNLQSGNQ

SEQ ID NO: 73718 - protein, 28 aa, Artificial Sequence
  Description of Artificial Sequence: Synthetic peptide
QEEEIATTNPVASEQYGEVSEVCQHEER

SEQ ID NO: 73719 - protein, 28 aa, Artificial Sequence
  Description of Artificial Sequence: Synthetic peptide
QEEEIASVNPVCTEQYGVVSDNLQSGTQ

SEQ ID NO: 73720 - protein, 28 aa, Artificial Sequence
  Description of Artificial Sequence: Synthetic peptide
QEEEIASVNPVCTEQYGVVSDTLQSGNQ

SEQ ID NO: 73721 - protein, 33 aa, Artificial Sequence
  Description of Artificial Sequence: Synthetic polypeptide
DEEEIRTTNPVATEQYGSVSTGALYQHDSDQED

SEQ ID NO: 73722 - protein, 33 aa, Artificial Sequence
  Description of Artificial Sequence: Synthetic polypeptide
DEEEIRTTNPVATEQYGSVMGTNIDGNQGEGGN

SEQ ID NO: 73723 - protein, 33 aa, Artificial Sequence
  Description of Artificial Sequence: Synthetic polypeptide
DEEEIRTTNPVATEQYGSVMGTNFEQEEGGAEG

SEQ ID NO: 73724 - protein, 34 aa, Artificial Sequence
  Description of Artificial Sequence: Synthetic polypeptide
DEEEIRTTNPVATEQYGSVMGTNENLEGEGGGNI

SEQ ID NO: 73725 - protein, 34 aa, Artificial Sequence
  Description of Artificial Sequence: Synthetic polypeptide
DEEEIRTTNPVATEQYGSVSTGDGQTDGNGQEDQ

SEQ ID NO: 73726 - protein, 28 aa, Artificial Sequence
  Description of Artificial Sequence: Synthetic peptide
DESEIRTTNPVATEQWGDMSSTLQHEDA

SEQ ID NO: 73727 - protein, 33 aa, Artificial Sequence
  Description of Artificial Sequence: Synthetic polypeptide
DEEEIRTTNPVATEQYGSVSTGEGDGGNEGNIG

SEQ ID NO: 73728 - protein, 28 aa, Artificial Sequence
  Description of Artificial Sequence: Synthetic peptide
QEEEIATTNPCSTEQYGIASCNLQSETR

SEQ ID NO: 73729 - protein, 28 aa, Artificial Sequence
  Description of Artificial Sequence: Synthetic peptide
QEEEIATTNPIATECYGSVSENLMHEEL

SEQ ID NO: 73730 - protein, 31 aa, Artificial Sequence
  Description of Artificial Sequence: Synthetic polypeptide
DEDEIATTNPVAYEQYGNVATNLQNDGNQSL

SEQ ID NO: 73731 - protein, 33 aa, Artificial Sequence
  Description of Artificial Sequence: Synthetic polypeptide
DEEEIRTTNPVATEQYGSVMGTGTQGTGGNGNE

SEQ ID NO: 73732 - protein, 34 aa, Artificial Sequence
  Description of Artificial Sequence: Synthetic polypeptide
DEEEIRTTNPVATEQYGSVMGTGSNNQNIGGNVV

SEQ ID NO: 73733 - protein, 28 aa, Artificial Sequence
  Description of Artificial Sequence: Synthetic peptide
QEEEIATTNPVASEQYGEVPENCQHGEK

SEQ ID NO: 73734 - protein, 34 aa, Artificial Sequence
  Description of Artificial Sequence: Synthetic polypeptide
DEEEIRTTNPVATEQYGSVMGTGNIQEGGGGNNE

SEQ ID NO: 73735 - protein, 34 aa, Artificial Sequence
  Description of Artificial Sequence: Synthetic polypeptide
DEEEIRTTNPVATEQYGSVSTGGLGDEEGGGNEE

SEQ ID NO: 73736 - protein, 28 aa, Artificial Sequence
  Description of Artificial Sequence: Synthetic peptide
QEEEIATTNPCASEQYGIVSCNCQSGTK

SEQ ID NO: 73737 - protein, 28 aa, Artificial Sequence
  Description of Artificial Sequence: Synthetic peptide
QEEEIASVNPVCTEQYGVVSDTLQSGNI

SEQ ID NO: 73738 - protein, 28 aa, Artificial Sequence
  Description of Artificial Sequence: Synthetic peptide
QEEEIATTNPCASEQYGIVSCNCQHGTK

SEQ ID NO: 73739 - protein, 31 aa, Artificial Sequence
  Description of Artificial Sequence: Synthetic polypeptide
DEDEIATTNPVAYEQYGSNVATNLQSNEGDN

SEQ ID NO: 73740 - protein, 33 aa, Artificial Sequence
  Description of Artificial Sequence: Synthetic polypeptide
DESEIRTTNPVATEQWGSVSACINLEDREGENG

SEQ ID NO: 73741 - protein, 34 aa, Artificial Sequence
  Description of Artificial Sequence: Synthetic polypeptide
DEEEIRTTNPVATEQYGSVMGTVNFGQGEQGENV

SEQ ID NO: 73742 - protein, 28 aa, Artificial Sequence
  Description of Artificial Sequence: Synthetic peptide
QEEEIASVNPVCTEQYGVVSENLQHENL

SEQ ID NO: 73743 - protein, 28 aa, Artificial Sequence
  Description of Artificial Sequence: Synthetic peptide
QEEEIASVNPVCTEQYGVVSEVLQHGNQ

SEQ ID NO: 73744 - protein, 33 aa, Artificial Sequence
  Description of Artificial Sequence: Synthetic polypeptide
DESEIRTTNPVATEQWGSVSACINEQDREGENG

SEQ ID NO: 73745 - protein, 32 aa, Artificial Sequence
  Description of Artificial Sequence: Synthetic polypeptide
DESEIRTTNPVATEQWGSVSACDEQDREGNDG

SEQ ID NO: 73746 - protein, 33 aa, Artificial Sequence
  Description of Artificial Sequence: Synthetic polypeptide
DESEIRTTNPVATEQWGSVCSATINPPEREGNG

SEQ ID NO: 73747 - protein, 34 aa, Artificial Sequence
  Description of Artificial Sequence: Synthetic polypeptide
DEEEIRTTNPVATEQYGSVSTFNQEANGNGNGNG

SEQ ID NO: 73748 - protein, 28 aa, Artificial Sequence
  Description of Artificial Sequence: Synthetic peptide
QEEEIASVNPVGTEQYGVVSDTLQHGNQ

SEQ ID NO: 73749 - protein, 28 aa, Artificial Sequence
  Description of Artificial Sequence: Synthetic peptide
QEEEIASVNPVSSEQYGVVSCNLQSGNQ

SEQ ID NO: 73750 - protein, 28 aa, Artificial Sequence
  Description of Artificial Sequence: Synthetic peptide
QEEEIATTNPCASEQYGEVPCNCQHGER

SEQ ID NO: 73751 - protein, 33 aa, Artificial Sequence
  Description of Artificial Sequence: Synthetic polypeptide
DESEIRTTNPVATEQWGESTVSTNMLSGRGGTE

SEQ ID NO: 73752 - protein, 28 aa, Artificial Sequence
  Description of Artificial Sequence: Synthetic peptide
QEEEIATTNPCASEQYGEVPENCQHGER

SEQ ID NO: 73753 - protein, 28 aa, Artificial Sequence
  Description of Artificial Sequence: Synthetic peptide
QEEEIATTNPCASEQYGEVSCNCQHGEK

SEQ ID NO: 73754 - protein, 28 aa, Artificial Sequence
  Description of Artificial Sequence: Synthetic peptide
QEEEIATTNPCASEQYGEVSCNCQHGTK

SEQ ID NO: 73755 - protein, 32 aa, Artificial Sequence
  Description of Artificial Sequence: Synthetic polypeptide
DEDEIATTNPVAYEQYGSCATNLQDSMGDNRH

SEQ ID NO: 73756 - protein, 32 aa, Artificial Sequence
  Description of Artificial Sequence: Synthetic polypeptide
DESEIRTTNPVATEGWGSVSNINEQDREGENG

SEQ ID NO: 73757 - protein, 31 aa, Artificial Sequence
  Description of Artificial Sequence: Synthetic polypeptide
DEDEIATTNPVAYEQYGSVATNLETGDNMAE

SEQ ID NO: 73758 - protein, 34 aa, Artificial Sequence
  Description of Artificial Sequence: Synthetic polypeptide
DEEEIRTTNPVATEQYGSVNGTGNGDNQQEGGNG

SEQ ID NO: 73759 - protein, 34 aa, Artificial Sequence
  Description of Artificial Sequence: Synthetic polypeptide
DEEEIRTTNPVATEQYGSVNSDDQNLDENGNIDE

SEQ ID NO: 73760 - protein, 32 aa, Artificial Sequence
  Description of Artificial Sequence: Synthetic polypeptide
DESEIRTTNPVATEQYGWTVSCTNQSTETGND

SEQ ID NO: 73761 - protein, 33 aa, Artificial Sequence
  Description of Artificial Sequence: Synthetic polypeptide
DESEIRTTNPVATEQYGWTVSCTNEQSQETGNM

SEQ ID NO: 73762 - protein, 29 aa, Artificial Sequence
  Description of Artificial Sequence: Synthetic peptide
QDNEIATTNPVATEGYGNVSANCLQRGEL

SEQ ID NO: 73763 - protein, 33 aa, Artificial Sequence
  Description of Artificial Sequence: Synthetic polypeptide
DEEEIRTTNPVATEQYGSVSTDTGMDEGGEGNG

SEQ ID NO: 73764 - protein, 34 aa, Artificial Sequence
  Description of Artificial Sequence: Synthetic polypeptide
DEEEIRTTNPVATEQYGSVSTDTGMQEVGEDNEG

SEQ ID NO: 73765 - protein, 34 aa, Artificial Sequence
  Description of Artificial Sequence: Synthetic polypeptide
DEEEIRTTNPVATEQYGSVNSDEEFTEGGNVGNR

SEQ ID NO: 73766 - protein, 33 aa, Artificial Sequence
  Description of Artificial Sequence: Synthetic polypeptide
DEEEIRTTNPVATEQYGSVNSAVNQEQVTVNDD

SEQ ID NO: 73767 - protein, 33 aa, Artificial Sequence
  Description of Artificial Sequence: Synthetic polypeptide
DEEEIRTTNPVATEQYGSVSTDTLDSNFINSEE

SEQ ID NO: 73768 - protein, 33 aa, Artificial Sequence
  Description of Artificial Sequence: Synthetic polypeptide
DEEEIRTTNPVATEQYGSVNQVTDVDERMGNVP

SEQ ID NO: 73769 - protein, 32 aa, Artificial Sequence
  Description of Artificial Sequence: Synthetic polypeptide
DEEEIRTTNPVATEQYGSVSTDTLMDSTQDIE

SEQ ID NO: 73770 - protein, 31 aa, Artificial Sequence
  Description of Artificial Sequence: Synthetic polypeptide
DEEEIATTNPTATEQYGSVPTWDLADRGDKE

SEQ ID NO: 73771 - protein, 30 aa, Artificial Sequence
  Description of Artificial Sequence: Synthetic polypeptide
QEAEIACTNPVATEQYGSVATNLQAAPNPE

SEQ ID NO: 73772 - protein, 32 aa, Artificial Sequence
  Description of Artificial Sequence: Synthetic polypeptide
DEEEIRTTNPVATEQYGSVSTDTQQDLTEVVD

SEQ ID NO: 73773 - protein, 32 aa, Artificial Sequence
  Description of Artificial Sequence: Synthetic polypeptide
DEEEIRTTNPVATEQYGSVSTDTLDESVQDIE

SEQ ID NO: 73774 - protein, 32 aa, Artificial Sequence
  Description of Artificial Sequence: Synthetic polypeptide
DEDEIATTNPVAYEQYGSVVAANLQRGPNIQP

SEQ ID NO: 73775 - protein, 32 aa, Artificial Sequence
  Description of Artificial Sequence: Synthetic polypeptide
DEEEIRTTNPVATEQYGSVSTDSDVYVREDTE

SEQ ID NO: 73776 - protein, 34 aa, Artificial Sequence
  Description of Artificial Sequence: Synthetic polypeptide
DEEEIRTTNPVATEQYGSVNSDGNMTQEGGGNIG

SEQ ID NO: 73777 - protein, 31 aa, Artificial Sequence
  Description of Artificial Sequence: Synthetic polypeptide
DEEEIATTNPMATEQYGSVPTVQDHQQGSMR

SEQ ID NO: 73778 - protein, 33 aa, Artificial Sequence
  Description of Artificial Sequence: Synthetic polypeptide
DESEIRTTNPVATESYGKVQSTDNLTATVGENR

SEQ ID NO: 73779 - protein, 36 aa, Artificial Sequence
  Description of Artificial Sequence: Synthetic polypeptide
DEEEIRTTNPVATEQYGSVNSDTNFNLQEGSGENEQ

SEQ ID NO: 73780 - protein, 34 aa, Artificial Sequence
  Description of Artificial Sequence: Synthetic polypeptide
DEEEIRTTNPVATEQYGSVNSDTNFGQNDEDNED

SEQ ID NO: 73781 - protein, 33 aa, Artificial Sequence
  Description of Artificial Sequence: Synthetic polypeptide
DESEIRTTNPVATESYGEVQSCTDNLTAVGENR

SEQ ID NO: 73782 - protein, 35 aa, Artificial Sequence
  Description of Artificial Sequence: Synthetic polypeptide
DEEEIRTTNPVATEQYGSVNSDTGDNGQGEGGNEV

SEQ ID NO: 73783 - protein, 34 aa, Artificial Sequence
  Description of Artificial Sequence: Synthetic polypeptide
DEEEIRTTNPVATEQYGSVSTDPYLTQDGSQIEP

SEQ ID NO: 73784 - protein, 34 aa, Artificial Sequence
  Description of Artificial Sequence: Synthetic polypeptide
DEEEIRTTNPVATEQYGSVNSDQNLFEFNGGNIQ

SEQ ID NO: 73785 - protein, 33 aa, Artificial Sequence
  Description of Artificial Sequence: Synthetic polypeptide
DEEEIRTTNPVATEQYGSVNSDNNMNVGIGNEE

SEQ ID NO: 73786 - protein, 34 aa, Artificial Sequence
  Description of Artificial Sequence: Synthetic polypeptide
DEEEIRTTNPVATEQYGSVNSDNMNIQSGGNEQI

SEQ ID NO: 73787 - protein, 34 aa, Artificial Sequence
  Description of Artificial Sequence: Synthetic polypeptide
DESEIRTTNPVATERYGSTVASTGNAHPQFGGNR

SEQ ID NO: 73788 - protein, 33 aa, Artificial Sequence
  Description of Artificial Sequence: Synthetic polypeptide
DESEIRTTNPVATERYGKVQSTDNLTAVGENRI

SEQ ID NO: 73789 - protein, 33 aa, Artificial Sequence
  Description of Artificial Sequence: Synthetic polypeptide
DEEEIRTTNPVATEQYGSVNSDGQNFENGENIG

SEQ ID NO: 73790 - protein, 31 aa, Artificial Sequence
  Description of Artificial Sequence: Synthetic polypeptide
DESEIRTTNPVATERWGSVVDNLDERGPLRS

SEQ ID NO: 73791 - protein, 34 aa, Artificial Sequence
  Description of Artificial Sequence: Synthetic polypeptide
DEEEIRTTNPVATEQYGSVNSDGNNQGEFGGNGQ

SEQ ID NO: 73792 - protein, 32 aa, Artificial Sequence
  Description of Artificial Sequence: Synthetic polypeptide
DEEEIRTTNPVATEQYGSVNPTTVEQANGEEI

SEQ ID NO: 73793 - protein, 32 aa, Artificial Sequence
  Description of Artificial Sequence: Synthetic polypeptide
DEDEIATTNPVAYEQYGSVSATANLQDTTGEE

SEQ ID NO: 73794 - protein, 33 aa, Artificial Sequence
  Description of Artificial Sequence: Synthetic polypeptide
DEEEIRTTNPVATEQYGSVSTDVGPQVGPMSQD

SEQ ID NO: 73795 - protein, 32 aa, Artificial Sequence
  Description of Artificial Sequence: Synthetic polypeptide
DEEEIRTTNPVATEQYGSVNPTLLIEAGEPVI

SEQ ID NO: 73796 - protein, 31 aa, Artificial Sequence
  Description of Artificial Sequence: Synthetic polypeptide
QEAEIRTTNPVAYEQYGSIACTNLTRTPGNE

SEQ ID NO: 73797 - protein, 34 aa, Artificial Sequence
  Description of Artificial Sequence: Synthetic polypeptide
DEEEIRTTNPVATEQYGSVSTDYLTNWRETQNDG

SEQ ID NO: 73798 - protein, 28 aa, Artificial Sequence
  Description of Artificial Sequence: Synthetic peptide
QEAVICCTNPVAYEQWGSVSMNEQRGNS

SEQ ID NO: 73799 - protein, 33 aa, Artificial Sequence
  Description of Artificial Sequence: Synthetic polypeptide
DEEEIRTTNPVATEQYGSVNNTNPNEGGEEERQ

SEQ ID NO: 73800 - protein, 34 aa, Artificial Sequence
  Description of Artificial Sequence: Synthetic polypeptide
DEEEIRTTNPVATEQYGSVSTDYLTWGESTQNDD

SEQ ID NO: 73801 - protein, 34 aa, Artificial Sequence
  Description of Artificial Sequence: Synthetic polypeptide
DEEEIRTTNPVATEQYGSVSTEAGPNMRNGMNPV

SEQ ID NO: 73802 - protein, 34 aa, Artificial Sequence
  Description of Artificial Sequence: Synthetic polypeptide
DEEEIRTTNPVATEQYGSVSTEAGPQQQNGMNPV

SEQ ID NO: 73803 - protein, 31 aa, Artificial Sequence
  Description of Artificial Sequence: Synthetic polypeptide
DEDEIATTNPVAYEQYGSVSAGNLDDNNMGR

SEQ ID NO: 73804 - protein, 31 aa, Artificial Sequence
  Description of Artificial Sequence: Synthetic polypeptide
DEEEIATTNPVATEAWGQSVATNELGKGGNA

SEQ ID NO: 73805 - protein, 32 aa, Artificial Sequence
  Description of Artificial Sequence: Synthetic polypeptide
DEEEIATTNPVATEAWGSVSTNLNHGEGNNEQ

SEQ ID NO: 73806 - protein, 31 aa, Artificial Sequence
  Description of Artificial Sequence: Synthetic polypeptide
DESEIRTTNPVATEQYGSVYDTNDMEGMGLD

SEQ ID NO: 73807 - protein, 33 aa, Artificial Sequence
  Description of Artificial Sequence: Synthetic polypeptide
DEEEIRTTNPVATEQYGSVNNTNDNGFSENDRS

SEQ ID NO: 73808 - protein, 32 aa, Artificial Sequence
  Description of Artificial Sequence: Synthetic polypeptide
DEEEIATTNPVATEAYGISTVSTYLSQPGGGA

SEQ ID NO: 73809 - protein, 32 aa, Artificial Sequence
  Description of Artificial Sequence: Synthetic polypeptide
DESEIRTTNPVATEQYGSVYDANDLEGMGNDG

SEQ ID NO: 73810 - protein, 33 aa, Artificial Sequence
  Description of Artificial Sequence: Synthetic polypeptide
DESEIRTTNPVATEQYGSVVNTDLQRGPEGGDN

SEQ ID NO: 73811 - protein, 32 aa, Artificial Sequence
  Description of Artificial Sequence: Synthetic polypeptide
DEEEIRTTNPVATEQYGSVSTDYDTAVEEKRN

SEQ ID NO: 73812 - protein, 35 aa, Artificial Sequence
  Description of Artificial Sequence: Synthetic polypeptide
DEDEIATTNPVAYEQYGVSVPSATNDLDQRGNQRE

SEQ ID NO: 73813 - protein, 33 aa, Artificial Sequence
  Description of Artificial Sequence: Synthetic polypeptide
DEEEIRTTNPVATEQYGSVSTDYDQQAVEEKRI

SEQ ID NO: 73814 - protein, 31 aa, Artificial Sequence
  Description of Artificial Sequence: Synthetic polypeptide
DEDEIATTNPVAYEQYGSVSANLDTGDNTPM

SEQ ID NO: 73815 - protein, 34 aa, Artificial Sequence
  Description of Artificial Sequence: Synthetic polypeptide
DEEEIRTTNPVATEQYGSVSTDVILQTNLMNQQF

SEQ ID NO: 73816 - protein, 32 aa, Artificial Sequence
  Description of Artificial Sequence: Synthetic polypeptide
DEEEIRTTNPVATEQYGSVSTDVIQTSLMDQQ

SEQ ID NO: 73817 - protein, 31 aa, Artificial Sequence
  Description of Artificial Sequence: Synthetic polypeptide
DESEIRTTNPVATEQYGVVDTDLQSGPEGGD

SEQ ID NO: 73818 - protein, 34 aa, Artificial Sequence
  Description of Artificial Sequence: Synthetic polypeptide
DEEEIRTTNPVATEQYGSVSTDVLLQVRESSQQG

SEQ ID NO: 73819 - protein, 32 aa, Artificial Sequence
  Description of Artificial Sequence: Synthetic polypeptide
DESEIRTTNPVATEQYGVVDTDLQRGPEEGDV

SEQ ID NO: 73820 - protein, 32 aa, Artificial Sequence
  Description of Artificial Sequence: Synthetic polypeptide
DESEIRTTNPVATEQYGVVDTDLQRGEEGGDQ

SEQ ID NO: 73821 - protein, 34 aa, Artificial Sequence
  Description of Artificial Sequence: Synthetic polypeptide
DEEEIRTTNPVATEQYGSVSTDVLPQVRTSSQDA

SEQ ID NO: 73822 - protein, 33 aa, Artificial Sequence
  Description of Artificial Sequence: Synthetic polypeptide
DEEEIRTTNPVATEQYGSVNNVMTNDQEEGEIE

SEQ ID NO: 73823 - protein, 31 aa, Artificial Sequence
  Description of Artificial Sequence: Synthetic polypeptide
DEEEIRTTNPVATEQYGSVNNTVDEREETGD

SEQ ID NO: 73824 - protein, 33 aa, Artificial Sequence
  Description of Artificial Sequence: Synthetic polypeptide
DEEEIRTTNPVATEQYGSVSTDVPPQVRSSSQD

SEQ ID NO: 73825 - protein, 31 aa, Artificial Sequence
  Description of Artificial Sequence: Synthetic polypeptide
DEEEIRTTNPVATEQYGSVNNTTQDDDGQEN

SEQ ID NO: 73826 - protein, 33 aa, Artificial Sequence
  Description of Artificial Sequence: Synthetic polypeptide
DEEEIRTTNPVATEQYGSVNNTTNLYGNTGTED

SEQ ID NO: 73827 - protein, 33 aa, Artificial Sequence
  Description of Artificial Sequence: Synthetic polypeptide
DEEEIRTTNPVATEQYGSVNNTTNLYGNIGTTE

SEQ ID NO: 73828 - protein, 31 aa, Artificial Sequence
  Description of Artificial Sequence: Synthetic polypeptide
QEAEIATTNPVAYEPYGVVASATNLQEGNPR

SEQ ID NO: 73829 - protein, 30 aa, Artificial Sequence
  Description of Artificial Sequence: Synthetic polypeptide
QEAEIATTNPVAYEQYGSVATNLEVDGNQD

SEQ ID NO: 73830 - protein, 30 aa, Artificial Sequence
  Description of Artificial Sequence: Synthetic polypeptide
DEEEIRTTNPVATEQYGSVNNTTDEGEFDE

SEQ ID NO: 73831 - protein, 31 aa, Artificial Sequence
  Description of Artificial Sequence: Synthetic polypeptide
DEEEIRTTNPVATEQYGSVNSELDREDEIDA

SEQ ID NO: 73832 - protein, 33 aa, Artificial Sequence
  Description of Artificial Sequence: Synthetic polypeptide
DEDEIATTNPVAYEQYGVSVSATNDLDQRPMER

SEQ ID NO: 73833 - protein, 34 aa, Artificial Sequence
  Description of Artificial Sequence: Synthetic polypeptide
DEEEIRTTNPVATEQYGSVSTDNVQVPQNAEIVD

SEQ ID NO: 73834 - protein, 32 aa, Artificial Sequence
  Description of Artificial Sequence: Synthetic polypeptide
QAEEIATTNPVATEQYGSVATNLQEAEGGNND

SEQ ID NO: 73835 - protein, 31 aa, Artificial Sequence
  Description of Artificial Sequence: Synthetic polypeptide
DEDEICTTNPTAYEQYGSVATNLQHANGNDM

SEQ ID NO: 73836 - protein, 33 aa, Artificial Sequence
  Description of Artificial Sequence: Synthetic polypeptide
DESEIRTTNPVATQQYGQCVSCTNLSDRGGNNP

SEQ ID NO: 73837 - protein, 32 aa, Artificial Sequence
  Description of Artificial Sequence: Synthetic polypeptide
DEEEIRTTNPVATEQYGSVNSMFNENQSETDG

SEQ ID NO: 73838 - protein, 30 aa, Artificial Sequence
  Description of Artificial Sequence: Synthetic polypeptide
DESEIRTTNPVATQHYGEVSTNDGQGNTNM

SEQ ID NO: 73839 - protein, 29 aa, Artificial Sequence
  Description of Artificial Sequence: Synthetic peptide
DEDEICCTNGVAYYQYGSVATNLQRGDQM

SEQ ID NO: 73840 - protein, 31 aa, Artificial Sequence
  Description of Artificial Sequence: Synthetic polypeptide
DEDEIATVNPVATEQYGSVATNLAAPGNNDH

SEQ ID NO: 73841 - protein, 30 aa, Artificial Sequence
  Description of Artificial Sequence: Synthetic polypeptide
DEDEIATVNPVATEQYGCVATNLEMGNEHG

SEQ ID NO: 73842 - protein, 33 aa, Artificial Sequence
  Description of Artificial Sequence: Synthetic polypeptide
AEEEIRTTNPVATEQYGSVVVSVTNNQEQEEND

SEQ ID NO: 73843 - protein, 34 aa, Artificial Sequence
  Description of Artificial Sequence: Synthetic polypeptide
DEEEIRTTNPVATEQYGSVNSITNFGMGNEEGQG

SEQ ID NO: 73844 - protein, 34 aa, Artificial Sequence
  Description of Artificial Sequence: Synthetic polypeptide
DEEEIRTTNPVATEQYGSVNSITNFGMGGQGNIE

SEQ ID NO: 73845 - protein, 34 aa, Artificial Sequence
  Description of Artificial Sequence: Synthetic polypeptide
DEEEIRTTNPVATEQYGSVNSIPLQDNGMGENED

SEQ ID NO: 73846 - protein, 30 aa, Artificial Sequence
  Description of Artificial Sequence: Synthetic polypeptide
DEDEIATVNPVATEQYGCVATNLAAMGNEH

SEQ ID NO: 73847 - protein, 33 aa, Artificial Sequence
  Description of Artificial Sequence: Synthetic polypeptide
DEEEIRTTNPVATEQYGSVNSIPDQDNGMENEN

SEQ ID NO: 73848 - protein, 31 aa, Artificial Sequence
  Description of Artificial Sequence: Synthetic polypeptide
DEEEIRTTNPVATEQYGSVNSIPDNRVEDEL

SEQ ID NO: 73849 - protein, 33 aa, Artificial Sequence
  Description of Artificial Sequence: Synthetic polypeptide
DEEEIRTTNPVATEQYGSVNSNNDDEQDEGGEE

SEQ ID NO: 73850 - protein, 30 aa, Artificial Sequence
  Description of Artificial Sequence: Synthetic polypeptide
DESEIRTTNPVATQHWGEVSTNLQHTNGMQ

SEQ ID NO: 73851 - protein, 34 aa, Artificial Sequence
  Description of Artificial Sequence: Synthetic polypeptide
DEEEIRTTNPVATEQYGSVNSNNNIQQTGGTNIQ

SEQ ID NO: 73852 - protein, 34 aa, Artificial Sequence
  Description of Artificial Sequence: Synthetic polypeptide
DEEEIRTTNPVATEQYGSVNSNPVSDDQRGENED

SEQ ID NO: 73853 - protein, 30 aa, Artificial Sequence
  Description of Artificial Sequence: Synthetic polypeptide
QAEEIATTNPVATEQYGCVATNLQADDPQR

SEQ ID NO: 73854 - protein, 30 aa, Artificial Sequence
  Description of Artificial Sequence: Synthetic polypeptide
QAEEIATTNPVATEQYGCVATNLQADGPGS

SEQ ID NO: 73855 - protein, 32 aa, Artificial Sequence
  Description of Artificial Sequence: Synthetic polypeptide
DEEEIATTNPCATEQYGSVPTNEIDHRGGNGS

SEQ ID NO: 73856 - protein, 31 aa, Artificial Sequence
  Description of Artificial Sequence: Synthetic polypeptide
QAEEIATTNPVATEQYGCVATNLQADGPNND

SEQ ID NO: 73857 - protein, 28 aa, Artificial Sequence
  Description of Artificial Sequence: Synthetic peptide
ATNEIACTNPVATEQYGEASENLQLGGR

SEQ ID NO: 73858 - protein, 31 aa, Artificial Sequence
  Description of Artificial Sequence: Synthetic polypeptide
DEDEICTTNPVAYEQYGSVATNLQHPDNDSG

SEQ ID NO: 73859 - protein, 33 aa, Artificial Sequence
  Description of Artificial Sequence: Synthetic polypeptide
DEEEIRTTNPVATEQYGSVNSPENEDERGGEID

SEQ ID NO: 73860 - protein, 33 aa, Artificial Sequence
  Description of Artificial Sequence: Synthetic polypeptide
DEEEIATTNPCSTEQYGSVSSTTPNLPNSGMNR

SEQ ID NO: 73861 - protein, 31 aa, Artificial Sequence
  Description of Artificial Sequence: Synthetic polypeptide
CAEEIACTNPVATEQYGCVATNLQARGGEGR

SEQ ID NO: 73862 - protein, 30 aa, Artificial Sequence
  Description of Artificial Sequence: Synthetic polypeptide
CAEEIACTNPVATEQYGSTVATNLQNGTEH

SEQ ID NO: 73863 - protein, 32 aa, Artificial Sequence
  Description of Artificial Sequence: Synthetic polypeptide
DEDEICTTNPVAYEQWGEVSTNLNQNGDGNMR

SEQ ID NO: 73864 - protein, 33 aa, Artificial Sequence
  Description of Artificial Sequence: Synthetic polypeptide
AEEEIRTTNPVATEQYGSVVVSVTNNQQQIEND

SEQ ID NO: 73865 - protein, 33 aa, Artificial Sequence
  Description of Artificial Sequence: Synthetic polypeptide
AEEEIRTTNPVATEQYGSVVVSVTNNQGQENGD

SEQ ID NO: 73866 - protein, 34 aa, Artificial Sequence
  Description of Artificial Sequence: Synthetic polypeptide
DEEEIRTTNPVATEQYGSVNSNTDNMNIIGGGNG

SEQ ID NO: 73867 - protein, 33 aa, Artificial Sequence
  Description of Artificial Sequence: Synthetic polypeptide
DEEEIRTTNPVATEQYGSVNSNQVNMTGSGNND

SEQ ID NO: 73868 - protein, 31 aa, Artificial Sequence
  Description of Artificial Sequence: Synthetic polypeptide
QAEEIATTNPVATEQYGSVATNLQDPEDTRE

SEQ ID NO: 73869 - protein, 32 aa, Artificial Sequence
  Description of Artificial Sequence: Synthetic polypeptide
DEEEIATTNPVATEAYGKVPSCTANLSQKGES

SEQ ID NO: 73870 - protein, 34 aa, Artificial Sequence
  Description of Artificial Sequence: Synthetic polypeptide
DESEIRTTNPVATMHYGSVSTGNLSQRTVGNNMF

SEQ ID NO: 73871 - protein, 34 aa, Artificial Sequence
  Description of Artificial Sequence: Synthetic polypeptide
DEEEIRTTNPVATEQYGSVNSHTVEQEPGEEERE

SEQ ID NO: 73872 - protein, 31 aa, Artificial Sequence
  Description of Artificial Sequence: Synthetic polypeptide
DEEEIATTNPMATEQWGSVYCTDNDQGGNHA

SEQ ID NO: 73873 - protein, 35 aa, Artificial Sequence
  Description of Artificial Sequence: Synthetic polypeptide
DEEEIRTTNPVATEQYGSVNSGMTNLDQNDVNEDL

SEQ ID NO: 73874 - protein, 34 aa, Artificial Sequence
  Description of Artificial Sequence: Synthetic polypeptide
DEEEIRTTNPVATEQYGSVNSGMTNDQNDVNEDD

SEQ ID NO: 73875 - protein, 34 aa, Artificial Sequence
  Description of Artificial Sequence: Synthetic polypeptide
DEEEIRTTNPVATEQYGSVNSGMTELQNDVENED

SEQ ID NO: 73876 - protein, 34 aa, Artificial Sequence
  Description of Artificial Sequence: Synthetic polypeptide
DEEEIRTTNPVATEQYGSVNSFVSDDQRGEFERQ

SEQ ID NO: 73877 - protein, 33 aa, Artificial Sequence
  Description of Artificial Sequence: Synthetic polypeptide
DEEEIRTTNPVATEQYGSVNSEVYDDRGEENHT

SEQ ID NO: 73878 - protein, 34 aa, Artificial Sequence
  Description of Artificial Sequence: Synthetic polypeptide
DEEEIRTTNPVATEQYGSVNSETNNEDQGNMMEE

SEQ ID NO: 73879 - protein, 35 aa, Artificial Sequence
  Description of Artificial Sequence: Synthetic polypeptide
DEEEIRTTNPVATEQYGSVNSETNLDQGNMDQNEG

SEQ ID NO: 73880 - protein, 34 aa, Artificial Sequence
  Description of Artificial Sequence: Synthetic polypeptide
DEEEIRTTNPVATEQYGSVNSETNLDNSNMTEEC

SEQ ID NO: 73881 - protein, 34 aa, Artificial Sequence
  Description of Artificial Sequence: Synthetic polypeptide
DEEEIRTTNPVATEQYGSVNSETNEFDQRDEEID

SEQ ID NO: 73882 - protein, 33 aa, Artificial Sequence
  Description of Artificial Sequence: Synthetic polypeptide
DEEEIATTNPMATEQYGSVPETVLQQHRQGVGR

SEQ ID NO: 73883 - protein, 33 aa, Artificial Sequence
  Description of Artificial Sequence: Synthetic polypeptide
DEEEIRTTNPVATEQYGSVNSESLDQQGSSEEQ

SEQ ID NO: 73884 - protein, 34 aa, Artificial Sequence
  Description of Artificial Sequence: Synthetic polypeptide
DEEEIRTTNPVATEQYGSVSTDNVNSFQGGEIVD

SEQ ID NO: 73885 - protein, 34 aa, Artificial Sequence
  Description of Artificial Sequence: Synthetic polypeptide
DEEEIRTTNPVATEQYGSVSTDNVQNFQNIEIVD

SEQ ID NO: 73886 - protein, 33 aa, Artificial Sequence
  Description of Artificial Sequence: Synthetic polypeptide
DEEEIRTTNPVATEQYGSVNSENYDDSRGEEHT

SEQ ID NO: 73887 - protein, 32 aa, Artificial Sequence
  Description of Artificial Sequence: Synthetic polypeptide
DEEEIATTNPMATEQWGSVPTVNLGDHNGNGR

SEQ ID NO: 73888 - protein, 29 aa, Artificial Sequence
  Description of Artificial Sequence: Synthetic peptide
DEDEIATTNPVSTEQWGSVAMNLQQGGQT

SEQ ID NO: 73889 - protein, 33 aa, Artificial Sequence
  Description of Artificial Sequence: Synthetic polypeptide
DEEEIRTTNPVATEQYGSVSTDNSDNYTEDNQQ

SEQ ID NO: 73890 - protein, 34 aa, Artificial Sequence
  Description of Artificial Sequence: Synthetic polypeptide
DEEEIRTTNPVATEQYGSVNSGQNLENIGGNIGT

SEQ ID NO: 73891 - protein, 29 aa, Artificial Sequence
  Description of Artificial Sequence: Synthetic peptide
DEDEIATTNPVSTEQWGSVAMNLQGPGQN

SEQ ID NO: 73892 - protein, 30 aa, Artificial Sequence
  Description of Artificial Sequence: Synthetic polypeptide
QAEEIATTNPVAYEQYGSVATNLQDGGGDP

SEQ ID NO: 73893 - protein, 34 aa, Artificial Sequence
  Description of Artificial Sequence: Synthetic polypeptide
AEEEIRTTNPVATEQYGSVVVSVTNNNQQEDENR

SEQ ID NO: 73894 - protein, 31 aa, Artificial Sequence
  Description of Artificial Sequence: Synthetic polypeptide
QAEEIATTNPVAYEQYGSVATNLQDGPNGDA

SEQ ID NO: 73895 - protein, 31 aa, Artificial Sequence
  Description of Artificial Sequence: Synthetic polypeptide
QAEEIATTNPVAYEQYGSVATNLQDSGNAEM

SEQ ID NO: 73896 - protein, 32 aa, Artificial Sequence
  Description of Artificial Sequence: Synthetic polypeptide
QAEEIATTNPVAYEQYGSVATNLQERPGNAEM

SEQ ID NO: 73897 - protein, 31 aa, Artificial Sequence
  Description of Artificial Sequence: Synthetic polypeptide
DEEEIATTNPIATECYGSCSTGNDDRTGDNA

SEQ ID NO: 73898 - protein, 33 aa, Artificial Sequence
  Description of Artificial Sequence: Synthetic polypeptide
DEEEIRTTNPVATEQYGSVNSGTNFGMGGEDDG

SEQ ID NO: 73899 - protein, 30 aa, Artificial Sequence
  Description of Artificial Sequence: Synthetic polypeptide
QAEEIATTNPVAYEQYGSVATNLQRNPEGM

SEQ ID NO: 73900 - protein, 30 aa, Artificial Sequence
  Description of Artificial Sequence: Synthetic polypeptide
QAEEIATTNPVAYEQYGSVATNLQSGSDVQ

SEQ ID NO: 73901 - protein, 30 aa, Artificial Sequence
  Description of Artificial Sequence: Synthetic polypeptide
DESEIRTTNPVATKHYGSVWTTNQESRTNN

SEQ ID NO: 73902 - protein, 29 aa, Artificial Sequence
  Description of Artificial Sequence: Synthetic peptide
DESEIRTTNPVATKHYGKVTTNQERSTNN

SEQ ID NO: 73903 - protein, 33 aa, Artificial Sequence
  Description of Artificial Sequence: Synthetic polypeptide
DEEEIRTTNPVATEQYGSVNSGQNMEINTGNIT

SEQ ID NO: 73904 - protein, 35 aa, Artificial Sequence
  Description of Artificial Sequence: Synthetic polypeptide
DEEEIRTTNPVATEQYGSVNSGQNLQEDNGGENID

SEQ ID NO: 73905 - protein, 34 aa, Artificial Sequence
  Description of Artificial Sequence: Synthetic polypeptide
DEEEIRTTNPVATEQYGSVNSGQNLGENGGGNIE

SEQ ID NO: 73906 - protein, 34 aa, Artificial Sequence
  Description of Artificial Sequence: Synthetic polypeptide
DEEEIRTTNPVATEQYGSVSTDNNLVETESTQRM

SEQ ID NO: 73907 - protein, 31 aa, Artificial Sequence
  Description of Artificial Sequence: Synthetic polypeptide
DESEIRTTNPVATEQYGSVTTWDLQEPEDHS

SEQ ID NO: 73908 - protein, 33 aa, Artificial Sequence
  Description of Artificial Sequence: Synthetic polypeptide
DESEIRTTNPVATEQYGSVSTYNDLEQNSEDGI

SEQ ID NO: 73909 - protein, 33 aa, Artificial Sequence
  Description of Artificial Sequence: Synthetic polypeptide
DEEEIATTNPVATEAYGKVPSCTDNLSQKTGER

SEQ ID NO: 73910 - protein, 30 aa, Artificial Sequence
  Description of Artificial Sequence: Synthetic polypeptide
QEEEIACTNPVATEQYGCVATNLQAEANPD

SEQ ID NO: 73911 - protein, 31 aa, Artificial Sequence
  Description of Artificial Sequence: Synthetic polypeptide
QEEEIACTNPVATEQYGCVATNLQAEDENRE

SEQ ID NO: 73912 - protein, 30 aa, Artificial Sequence
  Description of Artificial Sequence: Synthetic polypeptide
QEEEIACTNPVATEQYGCVATNLQAEDNNA

SEQ ID NO: 73913 - protein, 31 aa, Artificial Sequence
  Description of Artificial Sequence: Synthetic polypeptide
QEEEIACTNPVATEQYGCVATNLQAEMGNEH

SEQ ID NO: 73914 - protein, 32 aa, Artificial Sequence
  Description of Artificial Sequence: Synthetic polypeptide
DEDEIATTNPVAYEQYGSVATNLQQGQGTNND

SEQ ID NO: 73915 - protein, 36 aa, Artificial Sequence
  Description of Artificial Sequence: Synthetic polypeptide
DEEEIRTTNPVATEQYGSVSTENDLTQVEVGVNFES

SEQ ID NO: 73916 - protein, 30 aa, Artificial Sequence
  Description of Artificial Sequence: Synthetic polypeptide
DEDEIATTNPVAYEQYGSVATNLQGVDQHN

SEQ ID NO: 73917 - protein, 33 aa, Artificial Sequence
  Description of Artificial Sequence: Synthetic polypeptide
QEEEIACTNPVATEQYGCVATNLQARAGENDRH

SEQ ID NO: 73918 - protein, 31 aa, Artificial Sequence
  Description of Artificial Sequence: Synthetic polypeptide
QEEEIACTNPVATEQYGCVATNLQARQNDAA

SEQ ID NO: 73919 - protein, 33 aa, Artificial Sequence
  Description of Artificial Sequence: Synthetic polypeptide
DEDEIATTNPVAYEQYGSVATNLQGTPDGNLRN

SEQ ID NO: 73920 - protein, 31 aa, Artificial Sequence
  Description of Artificial Sequence: Synthetic polypeptide
QEEEIACTNPVATEQYGCVATNLQAVGDNEN

SEQ ID NO: 73921 - protein, 32 aa, Artificial Sequence
  Description of Artificial Sequence: Synthetic polypeptide
DEDEIATTNPVAYEQYGSVATNLQGTDGPDRH

SEQ ID NO: 73922 - protein, 30 aa, Artificial Sequence
  Description of Artificial Sequence: Synthetic polypeptide
QEEEIACTNPVATEQYGCVATNLQDAGIEN

SEQ ID NO: 73923 - protein, 30 aa, Artificial Sequence
  Description of Artificial Sequence: Synthetic polypeptide
QEEEIACTNPVATEQYGCVATNLQDLNDTA

SEQ ID NO: 73924 - protein, 29 aa, Artificial Sequence
  Description of Artificial Sequence: Synthetic peptide
QEEEIACTNPVATEQYGCVATNLQDPPQD

SEQ ID NO: 73925 - protein, 31 aa, Artificial Sequence
  Description of Artificial Sequence: Synthetic polypeptide
DEEEIRTTNPVATEQYGSVNMMVDERGEEFI

SEQ ID NO: 73926 - protein, 32 aa, Artificial Sequence
  Description of Artificial Sequence: Synthetic polypeptide
DEDEIATTNPVAYEQYGSVATNLQERGGPEAM

SEQ ID NO: 73927 - protein, 32 aa, Artificial Sequence
  Description of Artificial Sequence: Synthetic polypeptide
DESEIRTTNPVATEQYGSTVSCCNQSGETGNI

SEQ ID NO: 73928 - protein, 33 aa, Artificial Sequence
  Description of Artificial Sequence: Synthetic polypeptide
DESEIRTTNPVATEQYGSTVSCSNEQSQETGNI

SEQ ID NO: 73929 - protein, 31 aa, Artificial Sequence
  Description of Artificial Sequence: Synthetic polypeptide
DEDEIATTNPVAYEQYGSVATNLQVSDGDVH

SEQ ID NO: 73930 - protein, 34 aa, Artificial Sequence
  Description of Artificial Sequence: Synthetic polypeptide
DESEIRTTNPVATEQYGSVCSCINPVQDREGENG

SEQ ID NO: 73931 - protein, 34 aa, Artificial Sequence
  Description of Artificial Sequence: Synthetic polypeptide
AEEEIRTTNPVATEQYGSVVVSTTNNNQQGQNGD

SEQ ID NO: 73932 - protein, 33 aa, Artificial Sequence
  Description of Artificial Sequence: Synthetic polypeptide
DEEEIRTTNPVATEQYGSVNNANDDQAGQIERQ

SEQ ID NO: 73933 - protein, 34 aa, Artificial Sequence
  Description of Artificial Sequence: Synthetic polypeptide
DEEEIRTTNPVATEQYGSVNNAGNLTQTGGGNIF

SEQ ID NO: 73934 - protein, 30 aa, Artificial Sequence
  Description of Artificial Sequence: Synthetic polypeptide
QEEEIACTNPVATEPYGSVATNLQTRNPEN

SEQ ID NO: 73935 - protein, 30 aa, Artificial Sequence
  Description of Artificial Sequence: Synthetic polypeptide
QEEEIACTNPVATEPYGSVSTNLNRQPESL

SEQ ID NO: 73936 - protein, 32 aa, Artificial Sequence
  Description of Artificial Sequence: Synthetic polypeptide
DEDEIATTNPVAYEQYGSVATNLQTANPVGER

SEQ ID NO: 73937 - protein, 34 aa, Artificial Sequence
  Description of Artificial Sequence: Synthetic polypeptide
DESEIRTTNPVATEQYGSVCSCINEVQDREGENG

SEQ ID NO: 73938 - protein, 32 aa, Artificial Sequence
  Description of Artificial Sequence: Synthetic polypeptide
DEDEIATTNPVAYEQYGSVATNLQRPGDEMLH

SEQ ID NO: 73939 - protein, 35 aa, Artificial Sequence
  Description of Artificial Sequence: Synthetic polypeptide
DEEEIRTTNPVATEQYGSVNMSTNGIGQEDGNQGD

SEQ ID NO: 73940 - protein, 35 aa, Artificial Sequence
  Description of Artificial Sequence: Synthetic polypeptide
DEEEIRTTNPVATEQYGSVSTEMMGLEERMGNPPQ

SEQ ID NO: 73941 - protein, 34 aa, Artificial Sequence
  Description of Artificial Sequence: Synthetic polypeptide
DESEIRTTNPVATEQYGSTVVSCTNQSQETGNDG

SEQ ID NO: 73942 - protein, 30 aa, Artificial Sequence
  Description of Artificial Sequence: Synthetic polypeptide
QEEEIACTNPVATEQYGCVAGTGLQHGDNQ

SEQ ID NO: 73943 - protein, 33 aa, Artificial Sequence
  Description of Artificial Sequence: Synthetic polypeptide
DESEIRTTNPVATEQYGSTVSCTIQSQETGNND

SEQ ID NO: 73944 - protein, 30 aa, Artificial Sequence
  Description of Artificial Sequence: Synthetic polypeptide
QEEEIACTNPVATEQYGCVATNLPERDDNQ

SEQ ID NO: 73945 - protein, 34 aa, Artificial Sequence
  Description of Artificial Sequence: Synthetic polypeptide
AEEEIRTTNPVATEQYGSVVVSTTNNNQQGTNGD

SEQ ID NO: 73946 - protein, 31 aa, Artificial Sequence
  Description of Artificial Sequence: Synthetic polypeptide
QEEEIACTNPVATEQYGCVATNLQDRGIGEH

SEQ ID NO: 73947 - protein, 31 aa, Artificial Sequence
  Description of Artificial Sequence: Synthetic polypeptide
DEDEIATTNPVAYEQYGSVATNLQDTGDEEH

SEQ ID NO: 73948 - protein, 33 aa, Artificial Sequence
  Description of Artificial Sequence: Synthetic polypeptide
DEEEIRTTNPVATEQYGSVNGTNELDENSGEDI

SEQ ID NO: 73949 - protein, 34 aa, Artificial Sequence
  Description of Artificial Sequence: Synthetic polypeptide
DEEEIRTTNPVATEQYGSVSTENGLEIDGQMIDE

SEQ ID NO: 73950 - protein, 34 aa, Artificial Sequence
  Description of Artificial Sequence: Synthetic polypeptide
DEEEIRTTNPVATEQYGSVNGTNELDDASGEDRD

SEQ ID NO: 73951 - protein, 32 aa, Artificial Sequence
  Description of Artificial Sequence: Synthetic polypeptide
DEDEIATTNPVAYEQYGSVATNLQDAGPNANV

SEQ ID NO: 73952 - protein, 29 aa, Artificial Sequence
  Description of Artificial Sequence: Synthetic peptide
DEEEIATTNPVATECYGSVSECGPQHEEL

SEQ ID NO: 73953 - protein, 32 aa, Artificial Sequence
  Description of Artificial Sequence: Synthetic polypeptide
DEDEIATTNPVAYEQYGSVATNLPARQGDNED

SEQ ID NO: 73954 - protein, 29 aa, Artificial Sequence
  Description of Artificial Sequence: Synthetic peptide
DEDEIATTNPVAYEQYGSVATNLETSQDE

SEQ ID NO: 73955 - protein, 30 aa, Artificial Sequence
  Description of Artificial Sequence: Synthetic polypeptide
DEDEIATTNPVAYEQYGSVATNLETQDNDV

SEQ ID NO: 73956 - protein, 31 aa, Artificial Sequence
  Description of Artificial Sequence: Synthetic polypeptide
DEEEIRTTNPVATEQYGSVNGTLDDQGFSIG

SEQ ID NO: 73957 - protein, 32 aa, Artificial Sequence
  Description of Artificial Sequence: Synthetic polypeptide
DEEEIRTTNPVATEQYGSVNGTLDDQGFNNEQ

SEQ ID NO: 73958 - protein, 33 aa, Artificial Sequence
  Description of Artificial Sequence: Synthetic polypeptide
DEEEIRTTNPVATEQYGSVNGTLDDQGFGNEGQ

SEQ ID NO: 73959 - protein, 33 aa, Artificial Sequence
  Description of Artificial Sequence: Synthetic polypeptide
DEEEIRTTNPVATEQYGSVNGTLDDQGFGNDND

SEQ ID NO: 73960 - protein, 31 aa, Artificial Sequence
  Description of Artificial Sequence: Synthetic polypeptide
DEDEIATTNPVAYEQYGSVATNLETHGDNEA

SEQ ID NO: 73961 - protein, 30 aa, Artificial Sequence
  Description of Artificial Sequence: Synthetic polypeptide
QEEEIACTNPVATEQYGCVATNLQSDDNID

SEQ ID NO: 73962 - protein, 30 aa, Artificial Sequence
  Description of Artificial Sequence: Synthetic polypeptide
QEEEIACTNPVATEQYGCVATNLQSDDNSH

SEQ ID NO: 73963 - protein, 33 aa, Artificial Sequence
  Description of Artificial Sequence: Synthetic polypeptide
DEEEIRTTNPVATEQYGSVNGTNELDGESGEDF

SEQ ID NO: 73964 - protein, 31 aa, Artificial Sequence
  Description of Artificial Sequence: Synthetic polypeptide
QEEEIACTNPVATEQYGCVATNLQEAEDNPR

SEQ ID NO: 73965 - protein, 35 aa, Artificial Sequence
  Description of Artificial Sequence: Synthetic polypeptide
DEEEIRTTNPVATEQYGSVSTENGDQPHGGNEEHM

SEQ ID NO: 73966 - protein, 31 aa, Artificial Sequence
  Description of Artificial Sequence: Synthetic polypeptide
DEDEIATTNPVAYEQYGSVATNLQDDGDGTM

SEQ ID NO: 73967 - protein, 32 aa, Artificial Sequence
  Description of Artificial Sequence: Synthetic polypeptide
DEEEIRTTNPVATEQYGSVNGTNSDDREQFDD

SEQ ID NO: 73968 - protein, 32 aa, Artificial Sequence
  Description of Artificial Sequence: Synthetic polypeptide
DEDEIATTNPVAYEQYGSVATNLQDTGADNTH

SEQ ID NO: 73969 - protein, 33 aa, Artificial Sequence
  Description of Artificial Sequence: Synthetic polypeptide
DEEEIRTTNPVATEQYGSVNGTNMTNGGGENTD

SEQ ID NO: 73970 - protein, 33 aa, Artificial Sequence
  Description of Artificial Sequence: Synthetic polypeptide
DEEEIRTTNPVATEQYGSVNGTNMTIGGGNQGT

SEQ ID NO: 73971 - protein, 32 aa, Artificial Sequence
  Description of Artificial Sequence: Synthetic polypeptide
DEEEIRTTNPVATEQYGSVNGTNMDESEQEVN

SEQ ID NO: 73972 - protein, 32 aa, Artificial Sequence
  Description of Artificial Sequence: Synthetic polypeptide
DEEEIATTNPVATECWGSVSTNLNGEEGNNEQ

SEQ ID NO: 73973 - protein, 30 aa, Artificial Sequence
  Description of Artificial Sequence: Synthetic polypeptide
DEDEIATTNPVAYEQYGSVATNLQDTADAH

SEQ ID NO: 73974 - protein, 32 aa, Artificial Sequence
  Description of Artificial Sequence: Synthetic polypeptide
DEDEIATTNPVAYEQYGSVATNLQDQGGQARE

SEQ ID NO: 73975 - protein, 32 aa, Artificial Sequence
  Description of Artificial Sequence: Synthetic polypeptide
DEDEIATTNPVAYEQYGSVATNLQDQGGNAES

SEQ ID NO: 73976 - protein, 30 aa, Artificial Sequence
  Description of Artificial Sequence: Synthetic polypeptide
QEEEIACTNPVATEQYGCVATNLQMDGSSH

SEQ ID NO: 73977 - protein, 31 aa, Artificial Sequence
  Description of Artificial Sequence: Synthetic polypeptide
QEEEIACTNPVATEQYGCVATNLQNDGNEFF

SEQ ID NO: 73978 - protein, 33 aa, Artificial Sequence
  Description of Artificial Sequence: Synthetic polypeptide
AEEEIRTTNPVATEQYGSVVVSTTDNQIGTNTG

SEQ ID NO: 73979 - protein, 31 aa, Artificial Sequence
  Description of Artificial Sequence: Synthetic polypeptide
DEDEIATTNPVAYEQYGSVATNLQDPGEGLH

SEQ ID NO: 73980 - protein, 31 aa, Artificial Sequence
  Description of Artificial Sequence: Synthetic polypeptide
DEEEIATTNPVATECYGDVSTPALQMREEPV

SEQ ID NO: 73981 - protein, 31 aa, Artificial Sequence
  Description of Artificial Sequence: Synthetic polypeptide
DEDEIATTNPVAYEQYGSVATNLQDDQNNSD

SEQ ID NO: 73982 - protein, 30 aa, Artificial Sequence
  Description of Artificial Sequence: Synthetic polypeptide
QEEEIACTNPVATEQYGCVATNLQQDGDFF

SEQ ID NO: 73983 - protein, 33 aa, Artificial Sequence
  Description of Artificial Sequence: Synthetic polypeptide
DEEEIRTTNPVATEQYGSVNGTFNQAGNGNGNG

SEQ ID NO: 73984 - protein, 34 aa, Artificial Sequence
  Description of Artificial Sequence: Synthetic polypeptide
DEEEIRTTNPVATEQYGSVNNDTNFGNQEFGNNT

SEQ ID NO: 73985 - protein, 31 aa, Artificial Sequence
  Description of Artificial Sequence: Synthetic polypeptide
DEDEIATTNPVAYEQYGSVATNLTRPQEQTR

SEQ ID NO: 73986 - protein, 33 aa, Artificial Sequence
  Description of Artificial Sequence: Synthetic polypeptide
DESEIRTTNPVATEQYGSVSTQNDNTLELGEQN

SEQ ID NO: 73987 - protein, 32 aa, Artificial Sequence
  Description of Artificial Sequence: Synthetic polypeptide
DEDEIATTNPVAYEQYGSVCSTADIPQDNGNR

SEQ ID NO: 73988 - protein, 34 aa, Artificial Sequence
  Description of Artificial Sequence: Synthetic polypeptide
DEEEIRTTNPVATEQYGSVSTEGQEGPAQASNDQ

SEQ ID NO: 73989 - protein, 31 aa, Artificial Sequence
  Description of Artificial Sequence: Synthetic polypeptide
DEEEIRTTNPVATEQYGSVNNSEDSEGNEQA

SEQ ID NO: 73990 - protein, 33 aa, Artificial Sequence
  Description of Artificial Sequence: Synthetic polypeptide
DEEEIATTNPVATEAYGSVVNCTNLSQITGLER

SEQ ID NO: 73991 - protein, 33 aa, Artificial Sequence
  Description of Artificial Sequence: Synthetic polypeptide
DEEEIRTTNPVATEQYGSVNNNTLEGGMGENEQ

SEQ ID NO: 73992 - protein, 33 aa, Artificial Sequence
  Description of Artificial Sequence: Synthetic polypeptide
DEEEIATTNPVATEAYGSVVSCTNFSQKTGERS

SEQ ID NO: 73993 - protein, 34 aa, Artificial Sequence
  Description of Artificial Sequence: Synthetic polypeptide
DESEIRTTNPVATEQYGSVSSTHNNLDARQENDY

SEQ ID NO: 73994 - protein, 34 aa, Artificial Sequence
  Description of Artificial Sequence: Synthetic polypeptide
DESEIRTTNPVATEQYGSVSPTNGEMRMGENNQE

SEQ ID NO: 73995 - protein, 31 aa, Artificial Sequence
  Description of Artificial Sequence: Synthetic polypeptide
DEDEIATTNPVAYEQYGSVCATNLETGDNDA

SEQ ID NO: 73996 - protein, 34 aa, Artificial Sequence
  Description of Artificial Sequence: Synthetic polypeptide
DESEIRTTNPVATEQYGSVSCTGNGSQWTGTKNP

SEQ ID NO: 73997 - protein, 33 aa, Artificial Sequence
  Description of Artificial Sequence: Synthetic polypeptide
DESEIRTTNPVATEQYGSVSCINEPQDREGEEG

SEQ ID NO: 73998 - protein, 34 aa, Artificial Sequence
  Description of Artificial Sequence: Synthetic polypeptide
AEEEIRTTNPVATEQYGSVVVSVTNLNQQEDEND

SEQ ID NO: 73999 - protein, 33 aa, Artificial Sequence
  Description of Artificial Sequence: Synthetic polypeptide
DESEIRTTNPVATEQYGSVSACINLEDHEGENG

SEQ ID NO: 74000 - protein, 34 aa, Artificial Sequence
  Description of Artificial Sequence: Synthetic polypeptide
DESEIRTTNPVATEQYGSVSACINEPQDREGENG

SEQ ID NO: 74001 - protein, 34 aa, Artificial Sequence
  Description of Artificial Sequence: Synthetic polypeptide
DESEIRTTNPVATEQYGSVSTTIAGPQMREGMNG

SEQ ID NO: 74002 - protein, 34 aa, Artificial Sequence
  Description of Artificial Sequence: Synthetic polypeptide
AEEEIRTTNPVATEQYGSVVVSVTNLNQEQENDE

SEQ ID NO: 74003 - protein, 33 aa, Artificial Sequence
  Description of Artificial Sequence: Synthetic polypeptide
DEEEIRTTNPVATEQYGSVSTEGDMQQSGSQEI

SEQ ID NO: 74004 - protein, 34 aa, Artificial Sequence
  Description of Artificial Sequence: Synthetic polypeptide
DEEEIATTNPVATEAYGSVSCTLNLPVRTGGNNT

SEQ ID NO: 74005 - protein, 32 aa, Artificial Sequence
  Description of Artificial Sequence: Synthetic polypeptide
DEEEIATTNPVATEAYGKVPSCTNLSQKGELY

SEQ ID NO: 74006 - protein, 33 aa, Artificial Sequence
  Description of Artificial Sequence: Synthetic polypeptide
DEEEIRTTNPVATEQYGSVNNTLDDQRIENENG

SEQ ID NO: 74007 - protein, 32 aa, Artificial Sequence
  Description of Artificial Sequence: Synthetic polypeptide
DEEEIATTNPVATEAYGKVPSCTNLSQNNGEL

SEQ ID NO: 74008 - protein, 32 aa, Artificial Sequence
  Description of Artificial Sequence: Synthetic polypeptide
DEEEIATTNPVATEAYGKVPSCTNLSQPGEYT

SEQ ID NO: 74009 - protein, 32 aa, Artificial Sequence
  Description of Artificial Sequence: Synthetic polypeptide
DEEEIRTTNPVATEQYGSVNNTENDDTALMER

SEQ ID NO: 74010 - protein, 31 aa, Artificial Sequence
  Description of Artificial Sequence: Synthetic polypeptide
DEEEIATTNPVATEAYGKVPSCTNQSQKGEG

SEQ ID NO: 74011 - protein, 31 aa, Artificial Sequence
  Description of Artificial Sequence: Synthetic polypeptide
DEEEIATTNPVATEAYGKVPSCTNSSHLGER

SEQ ID NO: 74012 - protein, 35 aa, Artificial Sequence
  Description of Artificial Sequence: Synthetic polypeptide
DESEIRTTNPVATEQYGSVSTTINGPQMRNGMNPV

SEQ ID NO: 74013 - protein, 32 aa, Artificial Sequence
  Description of Artificial Sequence: Synthetic polypeptide
DEEEIATTNPVATEAYGKVSCTNHSQQKGGER

SEQ ID NO: 74014 - protein, 34 aa, Artificial Sequence
  Description of Artificial Sequence: Synthetic polypeptide
DESEIRTTNPVATEQYGSVSTTIAGPQMRNGMNV

SEQ ID NO: 74015 - protein, 33 aa, Artificial Sequence
  Description of Artificial Sequence: Synthetic polypeptide
DEEEIATTNPVATEAYGQSVVTCTNLSQHTGER

SEQ ID NO: 74016 - protein, 32 aa, Artificial Sequence
  Description of Artificial Sequence: Synthetic polypeptide
DEDEIATTNPVAYEQYGSVCSTNPLQEAGTDQ

SEQ ID NO: 74017 - protein, 33 aa, Artificial Sequence
  Description of Artificial Sequence: Synthetic polypeptide
DEEEIRTTNPVATEQYGSVSTEGDLQQSVAQEE

SEQ ID NO: 74018 - protein, 32 aa, Artificial Sequence
  Description of Artificial Sequence: Synthetic polypeptide
DEEEIRTTNPVATEQYGSVNNSNDSEGNEVQS

SEQ ID NO: 74019 - protein, 34 aa, Artificial Sequence
  Description of Artificial Sequence: Synthetic polypeptide
DESEIRTTNPVATEQYGSVSTTIAGPQMREGMNV

SEQ ID NO: 74020 - protein, 34 aa, Artificial Sequence
  Description of Artificial Sequence: Synthetic polypeptide
DEEEIRTTNPVATEQYGSVSTEGDMQQSGNQEFN

SEQ ID NO: 74021 - protein, 28 aa, Artificial Sequence
  Description of Artificial Sequence: Synthetic peptide
QEEEIACTNPVATEGYGVMASNLQHGDR

SEQ ID NO: 74022 - protein, 34 aa, Artificial Sequence
  Description of Artificial Sequence: Synthetic polypeptide
AEEEIRTTNPVATEQYGSVVVSVTNLGGNETGNT

SEQ ID NO: 74023 - protein, 32 aa, Artificial Sequence
  Description of Artificial Sequence: Synthetic polypeptide
DESEIRTTNPVATEQYGSVSACDLEDHEGNDG

SEQ ID NO: 74024 - protein, 33 aa, Artificial Sequence
  Description of Artificial Sequence: Synthetic polypeptide
DEEEIRTTNPVATEQYGSVNNGQTEIQQGGGNI

SEQ ID NO: 74025 - protein, 34 aa, Artificial Sequence
  Description of Artificial Sequence: Synthetic polypeptide
DEEEIATTNPVATEAYGSVVSCTNGLSQKTGAER

SEQ ID NO: 74026 - protein, 32 aa, Artificial Sequence
  Description of Artificial Sequence: Synthetic polypeptide
DEEEIATTNPVATEAYGSVVSCTRLSQKTGEM

SEQ ID NO: 74027 - protein, 33 aa, Artificial Sequence
  Description of Artificial Sequence: Synthetic polypeptide
DEEEIRTTNPVATEQYGSVNNFNEQLEGENEDL

SEQ ID NO: 74028 - protein, 32 aa, Artificial Sequence
  Description of Artificial Sequence: Synthetic polypeptide
DESEIRTTNPVATEQYGSVCVTNMLERNDLDG

SEQ ID NO: 74029 - protein, 33 aa, Artificial Sequence
  Description of Artificial Sequence: Synthetic polypeptide
DEEEIRTTNPVATEQYGSVNNETVNDERGSDHI

SEQ ID NO: 74030 - protein, 32 aa, Artificial Sequence
  Description of Artificial Sequence: Synthetic polypeptide
DEEEIRTTNPVATEQYGSVNNETPDNGEGNNA

SEQ ID NO: 74031 - protein, 34 aa, Artificial Sequence
  Description of Artificial Sequence: Synthetic polypeptide
DEEEIRTTNPVATEQYGSVNNETNLDQGNMMMEE

SEQ ID NO: 74032 - protein, 30 aa, Artificial Sequence
  Description of Artificial Sequence: Synthetic polypeptide
QEEEIACTNPVATEAYGSVATNLARPDQRE

SEQ ID NO: 74033 - protein, 34 aa, Artificial Sequence
  Description of Artificial Sequence: Synthetic polypeptide
DESEIRTTNPVATEQYGSVCSTNDHQERDMDIMR

SEQ ID NO: 74034 - protein, 31 aa, Artificial Sequence
  Description of Artificial Sequence: Synthetic polypeptide
DEDEIATTNPVAYEQYGSVATNPEQNAGERQ

SEQ ID NO: 74035 - protein, 32 aa, Artificial Sequence
  Description of Artificial Sequence: Synthetic polypeptide
DESEIRTTNPVATEQYGSVCSTEHQNFNSDQG

SEQ ID NO: 74036 - protein, 32 aa, Artificial Sequence
  Description of Artificial Sequence: Synthetic polypeptide
DEEEIRTTNPVATEQYGSVNNENELDQSVDEL

SEQ ID NO: 74037 - protein, 32 aa, Artificial Sequence
  Description of Artificial Sequence: Synthetic polypeptide
DEEEIRTTNPVATEQYGSVNNENDEREENIDD

SEQ ID NO: 74038 - protein, 30 aa, Artificial Sequence
  Description of Artificial Sequence: Synthetic polypeptide
QEEEIACTNPVATEGYGSVATNLQGGAEEA

SEQ ID NO: 74039 - protein, 32 aa, Artificial Sequence
  Description of Artificial Sequence: Synthetic polypeptide
DEEEIRTTNPVATEQYGSVNNIEDLDRNENFE

SEQ ID NO: 74040 - protein, 33 aa, Artificial Sequence
  Description of Artificial Sequence: Synthetic polypeptide
DEEEIRTTNPVATEQYGSVNNNANDDERGSERI

SEQ ID NO: 74041 - protein, 31 aa, Artificial Sequence
  Description of Artificial Sequence: Synthetic polypeptide
DESEIRTTNPVATEQYGSVETWTLQESEDHQ

SEQ ID NO: 74042 - protein, 32 aa, Artificial Sequence
  Description of Artificial Sequence: Synthetic polypeptide
DEDEIATTNPVAYEQYGSVATPLQNRDGNTLM

SEQ ID NO: 74043 - protein, 31 aa, Artificial Sequence
  Description of Artificial Sequence: Synthetic polypeptide
DEEEIRTTNPVATEQYGSVNNMNDDLNGDDV

SEQ ID NO: 74044 - protein, 31 aa, Artificial Sequence
  Description of Artificial Sequence: Synthetic polypeptide
QEEAINPTNPEATEQYGSVSTNSLYQVRGEF

SEQ ID NO: 74045 - protein, 33 aa, Artificial Sequence
  Description of Artificial Sequence: Synthetic polypeptide
DESEIRTTNPVATEQYGSVNNENLQEREEDNFE

SEQ ID NO: 74046 - protein, 30 aa, Artificial Sequence
  Description of Artificial Sequence: Synthetic polypeptide
QEECIACTNPVAYEQYGSVSANFQRGNDLN

SEQ ID NO: 74047 - protein, 32 aa, Artificial Sequence
  Description of Artificial Sequence: Synthetic polypeptide
DESEIRTTNPVATEQYGSVNMGPLQQSGNDEK

SEQ ID NO: 74048 - protein, 32 aa, Artificial Sequence
  Description of Artificial Sequence: Synthetic polypeptide
DESEIRTTNPVATEQYGSVMGLLFQENGNGDD

SEQ ID NO: 74049 - protein, 34 aa, Artificial Sequence
  Description of Artificial Sequence: Synthetic polypeptide
DESEIRTTNPVATEQYGSVLSAVLTQEVGEDNRQ

SEQ ID NO: 74050 - protein, 33 aa, Artificial Sequence
  Description of Artificial Sequence: Synthetic polypeptide
DEEEIRTTNPVATEQYGSVNNLTNPNEGIENDQ

SEQ ID NO: 74051 - protein, 34 aa, Artificial Sequence
  Description of Artificial Sequence: Synthetic polypeptide
AEEEIRTTNPVATEQYGSVVVSVTLNNQEQGEND

SEQ ID NO: 74052 - protein, 34 aa, Artificial Sequence
  Description of Artificial Sequence: Synthetic polypeptide
DESEIRTTNPVATEQYGSVISTGNTGQGEGNGGT

SEQ ID NO: 74053 - protein, 28 aa, Artificial Sequence
  Description of Artificial Sequence: Synthetic peptide
QEEEIAATNPVATETYGVVSTALQQETY

SEQ ID NO: 74054 - protein, 32 aa, Artificial Sequence
  Description of Artificial Sequence: Synthetic polypeptide
DESEIRTTNPVATEQYGSVIDTNNGQGEGGQE

SEQ ID NO: 74055 - protein, 33 aa, Artificial Sequence
  Description of Artificial Sequence: Synthetic polypeptide
AEEEIRTTNPVATEQYGSVVVSVTDTNQIGNNG

SEQ ID NO: 74056 - protein, 31 aa, Artificial Sequence
  Description of Artificial Sequence: Synthetic polypeptide
DEDEIATTNPVAYEQYGSVATPNLETGDNDQ

SEQ ID NO: 74057 - protein, 28 aa, Artificial Sequence
  Description of Artificial Sequence: Synthetic peptide
QEEEIACTNPIATEGYGVMASNLQRGDR

SEQ ID NO: 74058 - protein, 32 aa, Artificial Sequence
  Description of Artificial Sequence: Synthetic polypeptide
DEDEIATTNPVAYEQYGSVATPLQNRDGDPRM

SEQ ID NO: 74059 - protein, 33 aa, Artificial Sequence
  Description of Artificial Sequence: Synthetic polypeptide
DEDEIKTTNPVATEPYGSVQWCTNLSQRTSGNS

SEQ ID NO: 74060 - protein, 32 aa, Artificial Sequence
  Description of Artificial Sequence: Synthetic polypeptide
DESEIRTTNPVATEGWGSVSCNEPQDREGENG

SEQ ID NO: 74061 - protein, 32 aa, Artificial Sequence
  Description of Artificial Sequence: Synthetic polypeptide
DESEIRTTNPVATEGWGSVSCINEQSRVGEQR

SEQ ID NO: 74062 - protein, 33 aa, Artificial Sequence
  Description of Artificial Sequence: Synthetic polypeptide
DEEEIRTTNPVATEQYGSVSTNADWNTGDSQQY

SEQ ID NO: 74063 - protein, 33 aa, Artificial Sequence
  Description of Artificial Sequence: Synthetic polypeptide
DEEEIRTTNPVATEQYGSVSTNAETNQQLVVDQ

SEQ ID NO: 74064 - protein, 35 aa, Artificial Sequence
  Description of Artificial Sequence: Synthetic polypeptide
DEEEIRTTNPVATEQYGSVSTNAIDYTTFEGNQRQ

SEQ ID NO: 74065 - protein, 31 aa, Artificial Sequence
  Description of Artificial Sequence: Synthetic polypeptide
QEEEIATTNPVATEQYGNVAANVCQSRVGER

SEQ ID NO: 74066 - protein, 30 aa, Artificial Sequence
  Description of Artificial Sequence: Synthetic polypeptide
DEDEIATTNPVATAQWGCVATNLERDGNDS

SEQ ID NO: 74067 - protein, 30 aa, Artificial Sequence
  Description of Artificial Sequence: Synthetic polypeptide
DEDEIATTNPVATAQWGCVATNALADRGNQ

SEQ ID NO: 74068 - protein, 34 aa, Artificial Sequence
  Description of Artificial Sequence: Synthetic polypeptide
DEEEIRTTNPVATEQYGSVSTMTTQQTVQGNGGG

SEQ ID NO: 74069 - protein, 29 aa, Artificial Sequence
  Description of Artificial Sequence: Synthetic peptide
DEDEIATTNPVATAQWGCVATAPEQRGNQ

SEQ ID NO: 74070 - protein, 29 aa, Artificial Sequence
  Description of Artificial Sequence: Synthetic peptide
DEDEIATTNPVATAQWGCVATALQDSGNQ

SEQ ID NO: 74071 - protein, 33 aa, Artificial Sequence
  Description of Artificial Sequence: Synthetic polypeptide
DEEEIRTTNPVATEQYGSVIGPTVNGIRGEIEQ

SEQ ID NO: 74072 - protein, 28 aa, Artificial Sequence
  Description of Artificial Sequence: Synthetic peptide
QEEEIATTNPVATEQYGSAPEACQREEK

SEQ ID NO: 74073 - protein, 28 aa, Artificial Sequence
  Description of Artificial Sequence: Synthetic peptide
QEEEIATTNPVATEQYGSAPENEQHEEK

SEQ ID NO: 74074 - protein, 33 aa, Artificial Sequence
  Description of Artificial Sequence: Synthetic polypeptide
DESEIRTTNPVATECWGSVSCINELQDREGENG

SEQ ID NO: 74075 - protein, 28 aa, Artificial Sequence
  Description of Artificial Sequence: Synthetic peptide
QEEEIATTNPVATEQYGSAPTVCQHEEK

SEQ ID NO: 74076 - protein, 30 aa, Artificial Sequence
  Description of Artificial Sequence: Synthetic polypeptide
DEDEIATTNPVATAQWGCVATALQTRGDNQ

SEQ ID NO: 74077 - protein, 34 aa, Artificial Sequence
  Description of Artificial Sequence: Synthetic polypeptide
DEEEIRTTNPVATEQYGSVSTMTTLSDNGGGNET

SEQ ID NO: 74078 - protein, 34 aa, Artificial Sequence
  Description of Artificial Sequence: Synthetic polypeptide
DEEEIRTTNPVATEQYGSVSTMTLLSDNEGNNGD

SEQ ID NO: 74079 - protein, 34 aa, Artificial Sequence
  Description of Artificial Sequence: Synthetic polypeptide
DEEEIRTTNPVATEQYGSVSTMTGMQEGGENEGE

SEQ ID NO: 74080 - protein, 34 aa, Artificial Sequence
  Description of Artificial Sequence: Synthetic polypeptide
DEEEIRTTNPVATEQYGSVILTNMLGQQGEEEWI

SEQ ID NO: 74081 - protein, 30 aa, Artificial Sequence
  Description of Artificial Sequence: Synthetic polypeptide
DEDEIATTNPVATASWGCVSTALQGRGNDQ

SEQ ID NO: 74082 - protein, 29 aa, Artificial Sequence
  Description of Artificial Sequence: Synthetic peptide
DEDEIATTNPVATASWGCVSTALQEQGNQ

SEQ ID NO: 74083 - protein, 33 aa, Artificial Sequence
  Description of Artificial Sequence: Synthetic polypeptide
DEEEIRTTNPVATEQYGSVSTMNNGGGDGETGE

SEQ ID NO: 74084 - protein, 35 aa, Artificial Sequence
  Description of Artificial Sequence: Synthetic polypeptide
DEEEIRTTNPVATEQYGSVSTMNNTQAGDNPEEPI

SEQ ID NO: 74085 - protein, 30 aa, Artificial Sequence
  Description of Artificial Sequence: Synthetic polypeptide
DEEEIATTNPVATEQYGEASSEVCNRGMNK

SEQ ID NO: 74086 - protein, 29 aa, Artificial Sequence
  Description of Artificial Sequence: Synthetic peptide
QEEEIATTNPVATEQYGEVSTVPQHEEEK

SEQ ID NO: 74087 - protein, 34 aa, Artificial Sequence
  Description of Artificial Sequence: Synthetic polypeptide
DEEEIRTTNPVATEQYGSVILANMLEQEREPNMD

SEQ ID NO: 74088 - protein, 34 aa, Artificial Sequence
  Description of Artificial Sequence: Synthetic polypeptide
DEEEIRTTNPVATEQYGSVSTMNTGQGQNGEDGI

SEQ ID NO: 74089 - protein, 34 aa, Artificial Sequence
  Description of Artificial Sequence: Synthetic polypeptide
DEEEIRTTNPVATEQYGSVSTMNTGQQDTLGELF

SEQ ID NO: 74090 - protein, 34 aa, Artificial Sequence
  Description of Artificial Sequence: Synthetic polypeptide
DEEEIRTTNPVATEQYGSVSTMNVLPMVAGFELA

SEQ ID NO: 74091 - protein, 31 aa, Artificial Sequence
  Description of Artificial Sequence: Synthetic polypeptide
DESEIRTTNPVATECWGSVSCINEPQDHGNG

SEQ ID NO: 74092 - protein, 30 aa, Artificial Sequence
  Description of Artificial Sequence: Synthetic polypeptide
DEDEIATTNPVATAQYGCVATNLERDSNPM

SEQ ID NO: 74093 - protein, 30 aa, Artificial Sequence
  Description of Artificial Sequence: Synthetic polypeptide
DEDEIATTNPVATAQWGSVATNADQQGNDD

SEQ ID NO: 74094 - protein, 33 aa, Artificial Sequence
  Description of Artificial Sequence: Synthetic polypeptide
DEEEIRTTNPVATEQYGSVSTMTDQGGMGETTT

SEQ ID NO: 74095 - protein, 29 aa, Artificial Sequence
  Description of Artificial Sequence: Synthetic peptide
QEEEIATTNPVATEQYGSAPTVLQHEEDK

SEQ ID NO: 74096 - protein, 34 aa, Artificial Sequence
  Description of Artificial Sequence: Synthetic polypeptide
DEEEIRTTNPVATEQYGSVSTNANTNQQEMVNVQ

SEQ ID NO: 74097 - protein, 31 aa, Artificial Sequence
  Description of Artificial Sequence: Synthetic polypeptide
DEDEIACTNPVAYEQYGSVATNLQRDDNPDE

SEQ ID NO: 74098 - protein, 29 aa, Artificial Sequence
  Description of Artificial Sequence: Synthetic peptide
QEEEIATTNPVATEQYGSASTDCEHEGEK

SEQ ID NO: 74099 - protein, 34 aa, Artificial Sequence
  Description of Artificial Sequence: Synthetic polypeptide
AEEEIRTTNPVATEQYGSVVTTTNGNLQQGNNID

SEQ ID NO: 74100 - protein, 33 aa, Artificial Sequence
  Description of Artificial Sequence: Synthetic polypeptide
AEEEIRTTNPVATEQYGSVVTTTGNLQNQENNT

SEQ ID NO: 74101 - protein, 32 aa, Artificial Sequence
  Description of Artificial Sequence: Synthetic polypeptide
QEEEIATTNPVATEQYGSVATNLQGAEEPTRD

SEQ ID NO: 74102 - protein, 32 aa, Artificial Sequence
  Description of Artificial Sequence: Synthetic polypeptide
QEEEIATTNPVATEQYGSVATNLQGDEEDTRM

SEQ ID NO: 74103 - protein, 31 aa, Artificial Sequence
  Description of Artificial Sequence: Synthetic polypeptide
QEEEIATTNPVATEQYGSVATNLQGEEPTDM

SEQ ID NO: 74104 - protein, 30 aa, Artificial Sequence
  Description of Artificial Sequence: Synthetic polypeptide
DEDEIACTNPVATESYGSVATNLQGLEGAN

SEQ ID NO: 74105 - protein, 33 aa, Artificial Sequence
  Description of Artificial Sequence: Synthetic polypeptide
DEDEIACTNPVATEQYGSVSTNPLQAEMGNPLH

SEQ ID NO: 74106 - protein, 33 aa, Artificial Sequence
  Description of Artificial Sequence: Synthetic polypeptide
DEDEIACTNPVATEQYGSVSTNLQEHQDGNAEE

SEQ ID NO: 74107 - protein, 34 aa, Artificial Sequence
  Description of Artificial Sequence: Synthetic polypeptide
AEEEIRTTNPVATEQYGSVVTTNNQLQQQGNNTD

SEQ ID NO: 74108 - protein, 31 aa, Artificial Sequence
  Description of Artificial Sequence: Synthetic polypeptide
QEEEIATTNPVATEQYGSVATNLQSEEDTAE

SEQ ID NO: 74109 - protein, 31 aa, Artificial Sequence
  Description of Artificial Sequence: Synthetic polypeptide
DESEIRTTNPVATECWGSVSCIIEQNREGNG

SEQ ID NO: 74110 - protein, 30 aa, Artificial Sequence
  Description of Artificial Sequence: Synthetic polypeptide
DEDEIACTNPVATEQYGSVSANNDRGTPEE

SEQ ID NO: 74111 - protein, 34 aa, Artificial Sequence
  Description of Artificial Sequence: Synthetic polypeptide
AEEEIRTTNPVATEQYGSVVTTNNNLQQGEGNGD

SEQ ID NO: 74112 - protein, 34 aa, Artificial Sequence
  Description of Artificial Sequence: Synthetic polypeptide
QEEEIATTNPVATEQYGSVATTGNLQEAPGENRE

SEQ ID NO: 74113 - protein, 33 aa, Artificial Sequence
  Description of Artificial Sequence: Synthetic polypeptide
QEEEIATTNPVATEQYGSVATTNLPQEAGENEE

SEQ ID NO: 74114 - protein, 34 aa, Artificial Sequence
  Description of Artificial Sequence: Synthetic polypeptide
AEEEIRTTNPVATEQYGSVVTTTNGNLQQGTNII

SEQ ID NO: 74115 - protein, 31 aa, Artificial Sequence
  Description of Artificial Sequence: Synthetic polypeptide
DEEEIATTNPVATEQYGEASPTAGNRNGMNV

SEQ ID NO: 74116 - protein, 33 aa, Artificial Sequence
  Description of Artificial Sequence: Synthetic polypeptide
QEEEIATTNPVATEQYGSVATNLQDNPGENAEN

SEQ ID NO: 74117 - protein, 34 aa, Artificial Sequence
  Description of Artificial Sequence: Synthetic polypeptide
DEEEIRTTNPVATEQYGSVIGPTANLPIRGEIEV

SEQ ID NO: 74118 - protein, 34 aa, Artificial Sequence
  Description of Artificial Sequence: Synthetic polypeptide
AEEEIRTTNPVATEQYGSVVTTVNNLQGNDTGNG

SEQ ID NO: 74119 - protein, 31 aa, Artificial Sequence
  Description of Artificial Sequence: Synthetic polypeptide
QEEEIATTNPVATEQYGSASTEPVCQRGMEV

SEQ ID NO: 74120 - protein, 29 aa, Artificial Sequence
  Description of Artificial Sequence: Synthetic peptide
QEEEIATTNPVATEQYGSASTVCQDHEEK

SEQ ID NO: 74121 - protein, 32 aa, Artificial Sequence
  Description of Artificial Sequence: Synthetic polypeptide
QEEEIATTNPVATEQYGSVAANLQDTGGNEEN

SEQ ID NO: 74122 - protein, 33 aa, Artificial Sequence
  Description of Artificial Sequence: Synthetic polypeptide
AEEEIRTTNPVATEQYGSVVTTVNLLQVTENSE

SEQ ID NO: 74123 - protein, 34 aa, Artificial Sequence
  Description of Artificial Sequence: Synthetic polypeptide
AEEEIRTTNPVATEQYGSVVTTVNGNLQQGTNDI

SEQ ID NO: 74124 - protein, 32 aa, Artificial Sequence
  Description of Artificial Sequence: Synthetic polypeptide
QEEEIATTNPVATEQYGSVAITNDQGSEGNDQ

SEQ ID NO: 74125 - protein, 33 aa, Artificial Sequence
  Description of Artificial Sequence: Synthetic polypeptide
AEEEIRTTNPVATEQYGSVVTTTNNQQQGENGQ

SEQ ID NO: 74126 - protein, 32 aa, Artificial Sequence
  Description of Artificial Sequence: Synthetic polypeptide
AEEEIRTTNPVATEQYGSVVTTTNNQEEEENS

SEQ ID NO: 74127 - protein, 32 aa, Artificial Sequence
  Description of Artificial Sequence: Synthetic polypeptide
QEEEIATTNPVATEQYGSVAITNLQVDDNPDA

SEQ ID NO: 74128 - protein, 33 aa, Artificial Sequence
  Description of Artificial Sequence: Synthetic polypeptide
AEEEIRTTNPVATEQYGSVVTTTNNNQQQGNGQ

SEQ ID NO: 74129 - protein, 33 aa, Artificial Sequence
  Description of Artificial Sequence: Synthetic polypeptide
AEEEIRTTNPVATEQYGSVVTTTNNNQQGQNGE

SEQ ID NO: 74130 - protein, 34 aa, Artificial Sequence
  Description of Artificial Sequence: Synthetic polypeptide
DEEEIRTTNPVATEQYGSVIGPTNLIREGEIEDD

SEQ ID NO: 74131 - protein, 34 aa, Artificial Sequence
  Description of Artificial Sequence: Synthetic polypeptide
AEEEIRTTNPVATEQYGSVVTTTNLQQGNGGNDN

SEQ ID NO: 74132 - protein, 33 aa, Artificial Sequence
  Description of Artificial Sequence: Synthetic polypeptide
AEEEIRTTNPVATEQYGSVVTTTNLLQNQENNA

SEQ ID NO: 74133 - protein, 33 aa, Artificial Sequence
  Description of Artificial Sequence: Synthetic polypeptide
AEEEIRTTNPVATEQYGSVVTTTNLGGNEGGND

SEQ ID NO: 74134 - protein, 31 aa, Artificial Sequence
  Description of Artificial Sequence: Synthetic polypeptide
DEEEIATTNPVATEQYGEASPEAGQRNGMNV

SEQ ID NO: 74135 - protein, 34 aa, Artificial Sequence
  Description of Artificial Sequence: Synthetic polypeptide
DEEEIRTTNPVATEQYGSVSTMNLVINEMTNGGD

SEQ ID NO: 74136 - protein, 29 aa, Artificial Sequence
  Description of Artificial Sequence: Synthetic peptide
DEDEIATTNPVATASYGCVATNLERDSNS

SEQ ID NO: 74137 - protein, 32 aa, Artificial Sequence
  Description of Artificial Sequence: Synthetic polypeptide
DESEIRTTNPVATECWGSVSCINEPQNREGNG

SEQ ID NO: 74138 - protein, 34 aa, Artificial Sequence
  Description of Artificial Sequence: Synthetic polypeptide
DEEEIRTTNPVATEQYGSVISEANLQPNINSPDI

SEQ ID NO: 74139 - protein, 29 aa, Artificial Sequence
  Description of Artificial Sequence: Synthetic peptide
DEEEIATTNPVATEQYGEAPEACQRNGEK

SEQ ID NO: 74140 - protein, 35 aa, Artificial Sequence
  Description of Artificial Sequence: Synthetic polypeptide
DEEEIRTTNPVATEQYGSVISDTDNEGQGNDGNNL

SEQ ID NO: 74141 - protein, 32 aa, Artificial Sequence
  Description of Artificial Sequence: Synthetic polypeptide
DESEIRTTNPVATECWGSVSCINEPQKRGENG

SEQ ID NO: 74142 - protein, 33 aa, Artificial Sequence
  Description of Artificial Sequence: Synthetic polypeptide
DEEEIRTTNPVATEQYGSVISDGSNMQGGGGET

SEQ ID NO: 74143 - protein, 29 aa, Artificial Sequence
  Description of Artificial Sequence: Synthetic peptide
DEEEIATTNPVATEQYGEAPEAGQRNGEV

SEQ ID NO: 74144 - protein, 34 aa, Artificial Sequence
  Description of Artificial Sequence: Synthetic polypeptide
DEEEIRTTNPVATEQYGSVISCSPNMLSDHDGNH

SEQ ID NO: 74145 - protein, 34 aa, Artificial Sequence
  Description of Artificial Sequence: Synthetic polypeptide
DEEEIRTTNPVATEQYGSVISCLPNMLSQHDGPD

SEQ ID NO: 74146 - protein, 35 aa, Artificial Sequence
  Description of Artificial Sequence: Synthetic polypeptide
DEEEIRTTNPVATEQYGSVSTMNLDQSNMNLNDQV

SEQ ID NO: 74147 - protein, 31 aa, Artificial Sequence
  Description of Artificial Sequence: Synthetic polypeptide
DEEEIRTTNPVATEQYGSVIQETVPLETVVV

SEQ ID NO: 74148 - protein, 32 aa, Artificial Sequence
  Description of Artificial Sequence: Synthetic polypeptide
DESEIRTTNPVATECWGSVSCINEPQDRGENG

SEQ ID NO: 74149 - protein, 29 aa, Artificial Sequence
  Description of Artificial Sequence: Synthetic peptide
DEDEIATTNPVATEQWGCTATNLQGNSDS

SEQ ID NO: 74150 - protein, 33 aa, Artificial Sequence
  Description of Artificial Sequence: Synthetic polypeptide
DEEEIRTTNPVATEQYGSVIPTVMQPVPGSQDR

SEQ ID NO: 74151 - protein, 34 aa, Artificial Sequence
  Description of Artificial Sequence: Synthetic polypeptide
DEEEIRTTNPVATEQYGSVIPTNPLQQTQNVNVE

SEQ ID NO: 74152 - protein, 33 aa, Artificial Sequence
  Description of Artificial Sequence: Synthetic polypeptide
DEEEIRTTNPVATEQYGSVISEELEQVRNVTEQ

SEQ ID NO: 74153 - protein, 28 aa, Artificial Sequence
  Description of Artificial Sequence: Synthetic peptide
QEEEIATTNPVATEQYGEVPEVCQHEER

SEQ ID NO: 74154 - protein, 31 aa, Artificial Sequence
  Description of Artificial Sequence: Synthetic polypeptide
DEEEIATTNPVATEQYGDVSTEPAGNRENPL

SEQ ID NO: 74155 - protein, 32 aa, Artificial Sequence
  Description of Artificial Sequence: Synthetic polypeptide
DESEIRTTNPVATECWGSVSCINEPQREGENG

SEQ ID NO: 74156 - protein, 32 aa, Artificial Sequence
  Description of Artificial Sequence: Synthetic polypeptide
DEEEIATTNPVATEQYGCVCSTELQNFNSNQM

SEQ ID NO: 74157 - protein, 32 aa, Artificial Sequence
  Description of Artificial Sequence: Synthetic polypeptide
DEDEIATTNPVATEQWGSVSTDLQNHDGNDTA

SEQ ID NO: 74158 - protein, 34 aa, Artificial Sequence
  Description of Artificial Sequence: Synthetic polypeptide
DEEEIRTTNPVATEQYGSVISNANNTQVLGNGVN

SEQ ID NO: 74159 - protein, 34 aa, Artificial Sequence
  Description of Artificial Sequence: Synthetic polypeptide
DEEEIATTNPVATEQYGCVCSTNSLFQERFGSEQ

SEQ ID NO: 74160 - protein, 35 aa, Artificial Sequence
  Description of Artificial Sequence: Synthetic polypeptide
DEEEIRTTNPVATEQYGSVISLTPNMEPRGESQRI

SEQ ID NO: 74161 - protein, 32 aa, Artificial Sequence
  Description of Artificial Sequence: Synthetic polypeptide
DEDEIATTNPVATEQWGSVSEGNLQDQGGQDR

SEQ ID NO: 74162 - protein, 33 aa, Artificial Sequence
  Description of Artificial Sequence: Synthetic polypeptide
DEEEIRTTNPVATEQYGSVISLNGEPRLGLVFE

SEQ ID NO: 74163 - protein, 34 aa, Artificial Sequence
  Description of Artificial Sequence: Synthetic polypeptide
DEEEIRTTNPVATEQYGSVSTMNGQQGTGGEEEF

SEQ ID NO: 74164 - protein, 34 aa, Artificial Sequence
  Description of Artificial Sequence: Synthetic polypeptide
DEEEIRTTNPVATEQYGSVSTMNGQQGTGGIELI

SEQ ID NO: 74165 - protein, 35 aa, Artificial Sequence
  Description of Artificial Sequence: Synthetic polypeptide
DEEEIRTTNPVATEQYGSVSTMNGTGGQEDGGNEF

SEQ ID NO: 74166 - protein, 35 aa, Artificial Sequence
  Description of Artificial Sequence: Synthetic polypeptide
DEEEIRTTNPVATEQYGSVSTMNGVQQEGGENDQQ

SEQ ID NO: 74167 - protein, 31 aa, Artificial Sequence
  Description of Artificial Sequence: Synthetic polypeptide
DEDEIATTNPVATEQWGSVATNLQREQPEDM

SEQ ID NO: 74168 - protein, 33 aa, Artificial Sequence
  Description of Artificial Sequence: Synthetic polypeptide
DEEEIRTTNPVATEQYGSVSTMNHVQQDVDEVE

SEQ ID NO: 74169 - protein, 33 aa, Artificial Sequence
  Description of Artificial Sequence: Synthetic polypeptide
DEEEIATTNPVATEQYGCVVSGDNGNERNGENR

SEQ ID NO: 74170 - protein, 32 aa, Artificial Sequence
  Description of Artificial Sequence: Synthetic polypeptide
DESEIRTTNPVATECWGSVSCINEPQREGENL

SEQ ID NO: 74171 - protein, 28 aa, Artificial Sequence
  Description of Artificial Sequence: Synthetic peptide
QEEEIATTNPVATEQYGEISEVCQHGEK

SEQ ID NO: 74172 - protein, 31 aa, Artificial Sequence
  Description of Artificial Sequence: Synthetic polypeptide
DESEIRTTNPVATECWGSVSCIIEQNRAGNG

SEQ ID NO: 74173 - protein, 33 aa, Artificial Sequence
  Description of Artificial Sequence: Synthetic polypeptide
DEEEIRTTNPVATEQYGSVIPTLQQEEPETNRF

SEQ ID NO: 74174 - protein, 33 aa, Artificial Sequence
  Description of Artificial Sequence: Synthetic polypeptide
DEEEIRTTNPVATEQYGSVIPTLQIQEPENERF

SEQ ID NO: 74175 - protein, 34 aa, Artificial Sequence
  Description of Artificial Sequence: Synthetic polypeptide
DEEEIRTTNPVATEQYGSVINMTDLQNQEGGNIG

SEQ ID NO: 74176 - protein, 28 aa, Artificial Sequence
  Description of Artificial Sequence: Synthetic peptide
QEEEIATTNPVATEQYGEVSEICQHEEA

SEQ ID NO: 74177 - protein, 28 aa, Artificial Sequence
  Description of Artificial Sequence: Synthetic peptide
DEEEIATTNPVATEQYGEAPTVCQHEEK

SEQ ID NO: 74178 - protein, 28 aa, Artificial Sequence
  Description of Artificial Sequence: Synthetic peptide
DEEEIATTNPVATEQYGEAPTVPQHEEK

SEQ ID NO: 74179 - protein, 32 aa, Artificial Sequence
  Description of Artificial Sequence: Synthetic polypeptide
DEEEIRTTNPVATEQYGSVINEDEQHIRGEVV

SEQ ID NO: 74180 - protein, 28 aa, Artificial Sequence
  Description of Artificial Sequence: Synthetic peptide
QEEEIATTNPVATEQYGEVSEVCQHEEA

SEQ ID NO: 74181 - protein, 28 aa, Artificial Sequence
  Description of Artificial Sequence: Synthetic peptide
QEEEIATTNPVATEQYGEVSEVCQHEEK

SEQ ID NO: 74182 - protein, 33 aa, Artificial Sequence
  Description of Artificial Sequence: Synthetic polypeptide
DESEIRTTNPVATECWGSVSCINEPQDREGENR

SEQ ID NO: 74183 - protein, 32 aa, Artificial Sequence
  Description of Artificial Sequence: Synthetic polypeptide
DEDEIATTNPVATEAYGSVVSCCNLSQKTGER

SEQ ID NO: 74184 - protein, 28 aa, Artificial Sequence
  Description of Artificial Sequence: Synthetic peptide
QEEEIATTNPVATEQYGEVSEVCQHEEV

SEQ ID NO: 74185 - protein, 28 aa, Artificial Sequence
  Description of Artificial Sequence: Synthetic peptide
DEEEIATTNPVATEQYGEASEVCQHEEV

SEQ ID NO: 74186 - protein, 29 aa, Artificial Sequence
  Description of Artificial Sequence: Synthetic peptide
QEEEIATTNPVATEQYGEVSEVCQHEGEK

SEQ ID NO: 74187 - protein, 34 aa, Artificial Sequence
  Description of Artificial Sequence: Synthetic polypeptide
AEEEIRTTNPVATEQYGSVVTVANLENQETGTNV

SEQ ID NO: 74188 - protein, 32 aa, Artificial Sequence
  Description of Artificial Sequence: Synthetic polypeptide
DEEEIRTTNPVATEQYGSVILTPLQQPEQDLY

SEQ ID NO: 74189 - protein, 35 aa, Artificial Sequence
  Description of Artificial Sequence: Synthetic polypeptide
DEEEIRTTNPVATEQYGSVILTNNMLGQAGEEERL

SEQ ID NO: 74190 - protein, 34 aa, Artificial Sequence
  Description of Artificial Sequence: Synthetic polypeptide
DEEEIRTTNPVATEQYGSVINNTLQEGRDELTVR

SEQ ID NO: 74191 - protein, 28 aa, Artificial Sequence
  Description of Artificial Sequence: Synthetic peptide
QEEEIATTNPVATEQYGEVPEVCQHENK

SEQ ID NO: 74192 - protein, 32 aa, Artificial Sequence
  Description of Artificial Sequence: Synthetic polypeptide
DEEEIRTTNPVATEQYGSVINTDDGDVRMLNM

SEQ ID NO: 74193 - protein, 33 aa, Artificial Sequence
  Description of Artificial Sequence: Synthetic polypeptide
DEEEIRTTNPVATEQYGSVINTFDHLYGRETQR

SEQ ID NO: 74194 - protein, 28 aa, Artificial Sequence
  Description of Artificial Sequence: Synthetic peptide
QEEEIATTNPVATEQYGEVPEVLQHEEK

SEQ ID NO: 74195 - protein, 32 aa, Artificial Sequence
  Description of Artificial Sequence: Synthetic polypeptide
DESEIRTTNPVATECWGSVSCINEPQDREGNH

SEQ ID NO: 74196 - protein, 32 aa, Artificial Sequence
  Description of Artificial Sequence: Synthetic polypeptide
DESEIRTTNPVATECWGSVSCINEPQDREGNG

SEQ ID NO: 74197 - protein, 31 aa, Artificial Sequence
  Description of Artificial Sequence: Synthetic polypeptide
DEDEIATTNPVATEPYGVVCATNLTRGGNGD

SEQ ID NO: 74198 - protein, 30 aa, Artificial Sequence
  Description of Artificial Sequence: Synthetic polypeptide
QEEEIATTNPVATEQYGEVPTPVCNRGMNV

SEQ ID NO: 74199 - protein, 29 aa, Artificial Sequence
  Description of Artificial Sequence: Synthetic peptide
DEDEIATTNPVATEPYGSVSANNDQGTDQ

SEQ ID NO: 74200 - protein, 31 aa, Artificial Sequence
  Description of Artificial Sequence: Synthetic polypeptide
DEDEIATTNPVATEPYGSVCATNLADGGGER

SEQ ID NO: 74201 - protein, 28 aa, Artificial Sequence
  Description of Artificial Sequence: Synthetic peptide
DEEEIATTNPVATEQYGEAPEVCQHGEV

SEQ ID NO: 74202 - protein, 28 aa, Artificial Sequence
  Description of Artificial Sequence: Synthetic peptide
QEEEIATTNPVATEQYGEVPTVLEHEEL

SEQ ID NO: 74203 - protein, 28 aa, Artificial Sequence
  Description of Artificial Sequence: Synthetic peptide
QEEEIATTNPVATEQYGEVPTVPQHEEK

SEQ ID NO: 74204 - protein, 29 aa, Artificial Sequence
  Description of Artificial Sequence: Synthetic peptide
DEDEIATTNPVATEPYGSVANNNLVDGTH

SEQ ID NO: 74205 - protein, 29 aa, Artificial Sequence
  Description of Artificial Sequence: Synthetic peptide
QEEEIATTNPVATEQYGEVSEACNRNENK

SEQ ID NO: 74206 - protein, 32 aa, Artificial Sequence
  Description of Artificial Sequence: Synthetic polypeptide
DEEEIRTTNPVATEQYGSVINTQDLERDSQMD

SEQ ID NO: 74207 - protein, 33 aa, Artificial Sequence
  Description of Artificial Sequence: Synthetic polypeptide
DEEEIRTTNPVATEQYGSVINTNTEQENGQEED

SEQ ID NO: 74208 - protein, 29 aa, Artificial Sequence
  Description of Artificial Sequence: Synthetic peptide
QEEEIATTNPVATEQYGEVSEACNRNENV

SEQ ID NO: 74209 - protein, 29 aa, Artificial Sequence
  Description of Artificial Sequence: Synthetic peptide
QEEEIATTNPVATEQYGEVSEACQRNEEK

SEQ ID NO: 74210 - protein, 31 aa, Artificial Sequence
  Description of Artificial Sequence: Synthetic polypeptide
DESEIRTTNPVATECWGSVSCIIEQDREGNG

SEQ ID NO: 74211 - protein, 35 aa, Artificial Sequence
  Description of Artificial Sequence: Synthetic polypeptide
DEEEIRTTNPVATEQYGSVSTNDGYHQEYGILERQ

SEQ ID NO: 74212 - protein, 29 aa, Artificial Sequence
  Description of Artificial Sequence: Synthetic peptide
DEEEIATTNPVATEQYGEVPAEGCQHENK

SEQ ID NO: 74213 - protein, 34 aa, Artificial Sequence
  Description of Artificial Sequence: Synthetic polypeptide
AEEEIRTTNPVATEQYGSVVTSTNNNNQNDNGNL

SEQ ID NO: 74214 - protein, 31 aa, Artificial Sequence
  Description of Artificial Sequence: Synthetic polypeptide
QEEEIATTNPVAYEQYGSVATNLQADGAWEN

SEQ ID NO: 74215 - protein, 32 aa, Artificial Sequence
  Description of Artificial Sequence: Synthetic polypeptide
QEEEIATTNPVAYEQYGSVATNLQDAGPDNNN

SEQ ID NO: 74216 - protein, 30 aa, Artificial Sequence
  Description of Artificial Sequence: Synthetic polypeptide
DEDEIACTNPVATEQYGCVATNLQAEAHND

SEQ ID NO: 74217 - protein, 33 aa, Artificial Sequence
  Description of Artificial Sequence: Synthetic polypeptide
DESEIRTTNPVATECWGSVSANINEPQDREGNR

SEQ ID NO: 74218 - protein, 28 aa, Artificial Sequence
  Description of Artificial Sequence: Synthetic peptide
QEEEIATTNPVCTECYGDVSENLQSEEL

SEQ ID NO: 74219 - protein, 33 aa, Artificial Sequence
  Description of Artificial Sequence: Synthetic polypeptide
AEEEIRTTNPVATEQYGSVVTNTNLGGNEQGNN

SEQ ID NO: 74220 - protein, 28 aa, Artificial Sequence
  Description of Artificial Sequence: Synthetic peptide
QEEEIATTNPVCTECYGVVSECLQHENL

SEQ ID NO: 74221 - protein, 33 aa, Artificial Sequence
  Description of Artificial Sequence: Synthetic polypeptide
AEEEIRTTNPVATEQYGSVVTNSDNGNQSGNND

SEQ ID NO: 74222 - protein, 30 aa, Artificial Sequence
  Description of Artificial Sequence: Synthetic polypeptide
DEDEIACTNPVATEQYGCVATNLQAEAENH

SEQ ID NO: 74223 - protein, 28 aa, Artificial Sequence
  Description of Artificial Sequence: Synthetic peptide
QEEEIATTNPVCTEQYGEASEVLQHENK

SEQ ID NO: 74224 - protein, 32 aa, Artificial Sequence
  Description of Artificial Sequence: Synthetic polypeptide
AEEEIRTTNPVATEQYGSVVTNNNQGIGTDQS

SEQ ID NO: 74225 - protein, 30 aa, Artificial Sequence
  Description of Artificial Sequence: Synthetic polypeptide
DEDEIACTNPVATEQYGCVATNLQADEDNN

SEQ ID NO: 74226 - protein, 33 aa, Artificial Sequence
  Description of Artificial Sequence: Synthetic polypeptide
AEEEIRTTNPVATEQYGSVVTNNNEQLGGNNAS

SEQ ID NO: 74227 - protein, 33 aa, Artificial Sequence
  Description of Artificial Sequence: Synthetic polypeptide
AEEEIRTTNPVATEQYGSVVTNNNEQAGTNEQS

SEQ ID NO: 74228 - protein, 32 aa, Artificial Sequence
  Description of Artificial Sequence: Synthetic polypeptide
AEEEIRTTNPVATEQYGSVVTSTNNSEAGTIF

SEQ ID NO: 74229 - protein, 32 aa, Artificial Sequence
  Description of Artificial Sequence: Synthetic polypeptide
DEEEIRTTNPVATEQYGSVGVSFKENQQVVVP

SEQ ID NO: 74230 - protein, 33 aa, Artificial Sequence
  Description of Artificial Sequence: Synthetic polypeptide
DEEEIRTTNPVATEQYGSVHMWNLQRVTEAQVV

SEQ ID NO: 74231 - protein, 31 aa, Artificial Sequence
  Description of Artificial Sequence: Synthetic polypeptide
DEDEIACTNPVATEQYGCVATNLQAGEDNDV

SEQ ID NO: 74232 - protein, 34 aa, Artificial Sequence
  Description of Artificial Sequence: Synthetic polypeptide
DEEEIRTTNPVATEQYGSVHTNEVLEQMLNVETN

SEQ ID NO: 74233 - protein, 30 aa, Artificial Sequence
  Description of Artificial Sequence: Synthetic polypeptide
DEDEIACTNPVATEQYGCVATNLQDGGEME

SEQ ID NO: 74234 - protein, 28 aa, Artificial Sequence
  Description of Artificial Sequence: Synthetic peptide
QEEEIATTNPVATEQYGVVPDVLQHEEK

SEQ ID NO: 74235 - protein, 28 aa, Artificial Sequence
  Description of Artificial Sequence: Synthetic peptide
QEEEIATTNPVATEQYGVVPDVLQSEEQ

SEQ ID NO: 74236 - protein, 28 aa, Artificial Sequence
  Description of Artificial Sequence: Synthetic peptide
QEEEIATTNPVATEQYGVVPEVCQHENK

SEQ ID NO: 74237 - protein, 28 aa, Artificial Sequence
  Description of Artificial Sequence: Synthetic peptide
QEEEIATTNPVATEQYGVVPEVLQHEEK

SEQ ID NO: 74238 - protein, 29 aa, Artificial Sequence
  Description of Artificial Sequence: Synthetic peptide
DEDEIACTNPVATEQYGCVATNLQAPPEH

SEQ ID NO: 74239 - protein, 31 aa, Artificial Sequence
  Description of Artificial Sequence: Synthetic polypeptide
DEDEIACTNPVATEQYGCVATNLQAGPNDND

SEQ ID NO: 74240 - protein, 33 aa, Artificial Sequence
  Description of Artificial Sequence: Synthetic polypeptide
DEEEIRTTNPVATEQYGSVHPVVVLQRGQEQDD

SEQ ID NO: 74241 - protein, 33 aa, Artificial Sequence
  Description of Artificial Sequence: Synthetic polypeptide
AEEEIRTTNPVATEQYGSVVTTNGNLEQGNNIE

SEQ ID NO: 74242 - protein, 31 aa, Artificial Sequence
  Description of Artificial Sequence: Synthetic polypeptide
QEEEIATTNPVATESYGSVAGTNLARPDQRQ

SEQ ID NO: 74243 - protein, 32 aa, Artificial Sequence
  Description of Artificial Sequence: Synthetic polypeptide
AEEEIRTTNPVATEQYGSVVTTNDESGVNNTT

SEQ ID NO: 74244 - protein, 31 aa, Artificial Sequence
  Description of Artificial Sequence: Synthetic polypeptide
DEDEIACTNPVATEQYGCVATNLQAGEENTV

SEQ ID NO: 74245 - protein, 32 aa, Artificial Sequence
  Description of Artificial Sequence: Synthetic polypeptide
DEDEIACTNPVATEQYGCVATNLQAGEENDRH

SEQ ID NO: 74246 - protein, 34 aa, Artificial Sequence
  Description of Artificial Sequence: Synthetic polypeptide
AEEEIRTTNPVATEQYGSVVTTANLNNQEGNNVD

SEQ ID NO: 74247 - protein, 31 aa, Artificial Sequence
  Description of Artificial Sequence: Synthetic polypeptide
DEDEIACTNPVATEQYGCVATNLQAEIGNED

SEQ ID NO: 74248 - protein, 30 aa, Artificial Sequence
  Description of Artificial Sequence: Synthetic polypeptide
DEDEIACTNPVATEQYGCVATNLQDGPQMN

SEQ ID NO: 74249 - protein, 30 aa, Artificial Sequence
  Description of Artificial Sequence: Synthetic polypeptide
DEDEIACTNPVATEQYGCVATNLQAANDEQ

SEQ ID NO: 74250 - protein, 32 aa, Artificial Sequence
  Description of Artificial Sequence: Synthetic polypeptide
DEEEIRTTNPVATEQYGSVGTYAMQNAGSQQD

SEQ ID NO: 74251 - protein, 28 aa, Artificial Sequence
  Description of Artificial Sequence: Synthetic peptide
QEEEIATTNPVSTEQYGIVPCVLQSETR

SEQ ID NO: 74252 - protein, 32 aa, Artificial Sequence
  Description of Artificial Sequence: Synthetic polypeptide
AEEEIRTTNPVATEQYGSVVTNENNLQANTTT

SEQ ID NO: 74253 - protein, 32 aa, Artificial Sequence
  Description of Artificial Sequence: Synthetic polypeptide
QEEEIATTNPVSTEQYGIVSTNLPNMRNGTPR

SEQ ID NO: 74254 - protein, 34 aa, Artificial Sequence
  Description of Artificial Sequence: Synthetic polypeptide
AEEEIRTTNPVATEQYGSVVTNANLQNQETGNNV

SEQ ID NO: 74255 - protein, 28 aa, Artificial Sequence
  Description of Artificial Sequence: Synthetic peptide
QEEEIATVNPVATECYGDVSDCLQHGEQ

SEQ ID NO: 74256 - protein, 31 aa, Artificial Sequence
  Description of Artificial Sequence: Synthetic polypeptide
DEDCIACTNPVAYEQYDYSVSVNLQRGDNRM

SEQ ID NO: 74257 - protein, 33 aa, Artificial Sequence
  Description of Artificial Sequence: Synthetic polypeptide
DEEEIRTTNPVATEQYGSVGTNGILAQQEIEEG

SEQ ID NO: 74258 - protein, 28 aa, Artificial Sequence
  Description of Artificial Sequence: Synthetic peptide
QEEEIATVNPVATECYGDVSECLQSENL

SEQ ID NO: 74259 - protein, 28 aa, Artificial Sequence
  Description of Artificial Sequence: Synthetic peptide
QEEEIATVNPVATECYGDVSENLQHEEQ

SEQ ID NO: 74260 - protein, 34 aa, Artificial Sequence
  Description of Artificial Sequence: Synthetic polypeptide
AEEEIRTTNPVATEQYGSVVTNANLQNNQEGNVE

SEQ ID NO: 74261 - protein, 32 aa, Artificial Sequence
  Description of Artificial Sequence: Synthetic polypeptide
AEEEIRTTNPVATEQYGSVVNTTNNQNEGGVG

SEQ ID NO: 74262 - protein, 30 aa, Artificial Sequence
  Description of Artificial Sequence: Synthetic polypeptide
DEDCIACTNPVAYEPYDISVSANLQRGDNR

SEQ ID NO: 74263 - protein, 28 aa, Artificial Sequence
  Description of Artificial Sequence: Synthetic peptide
QEEEIATVNPVATEQYGDVSECLQHEEL

SEQ ID NO: 74264 - protein, 33 aa, Artificial Sequence
  Description of Artificial Sequence: Synthetic polypeptide
DEEEIRTTNPVATEQYGSVSTNGGQSETEEEVD

SEQ ID NO: 74265 - protein, 33 aa, Artificial Sequence
  Description of Artificial Sequence: Synthetic polypeptide
DEEEIRTTNPVATEQYGSVGTDNGLGGGETEQE

SEQ ID NO: 74266 - protein, 29 aa, Artificial Sequence
  Description of Artificial Sequence: Synthetic peptide
DEDCIACTNPVAYEQYGSVASNDQRGNEL

SEQ ID NO: 74267 - protein, 30 aa, Artificial Sequence
  Description of Artificial Sequence: Synthetic polypeptide
DEDEIACTNPVATEQYGCVATNLQAAENHN

SEQ ID NO: 74268 - protein, 30 aa, Artificial Sequence
  Description of Artificial Sequence: Synthetic polypeptide
DEDCIATTNPVAYEQWGQVSTGNVQRGNEN

SEQ ID NO: 74269 - protein, 28 aa, Artificial Sequence
  Description of Artificial Sequence: Synthetic peptide
QEEEIATTNPVSTEQYGIVPCNCQSGEK

SEQ ID NO: 74270 - protein, 28 aa, Artificial Sequence
  Description of Artificial Sequence: Synthetic peptide
QEEEIATTNPVSSEQYGIVPCNLQSGEK

SEQ ID NO: 74271 - protein, 32 aa, Artificial Sequence
  Description of Artificial Sequence: Synthetic polypeptide
DEEEIRTTNPVATEQYGSVGTSNMNIGIGGEV

SEQ ID NO: 74272 - protein, 31 aa, Artificial Sequence
  Description of Artificial Sequence: Synthetic polypeptide
DESEIRTTNPVATECWGSVSACDEQDREGNG

SEQ ID NO: 74273 - protein, 29 aa, Artificial Sequence
  Description of Artificial Sequence: Synthetic peptide
QEEEIATTNPVSSEQYGIVSCNLPNSGTR

SEQ ID NO: 74274 - protein, 28 aa, Artificial Sequence
  Description of Artificial Sequence: Synthetic peptide
QEEEIATTNPVSTEQYGEAPCNLQHEER

SEQ ID NO: 74275 - protein, 34 aa, Artificial Sequence
  Description of Artificial Sequence: Synthetic polypeptide
DEEEIRTTNPVATEQYGSVSTNEAPQVRASSDQE

SEQ ID NO: 74276 - protein, 32 aa, Artificial Sequence
  Description of Artificial Sequence: Synthetic polypeptide
DEEEIRTTNPVATEQYGSVSTNEPGVTMETQQ

SEQ ID NO: 74277 - protein, 33 aa, Artificial Sequence
  Description of Artificial Sequence: Synthetic polypeptide
DESEIRTTNPVATECWGSVCSTINPPQDREGNG

SEQ ID NO: 74278 - protein, 32 aa, Artificial Sequence
  Description of Artificial Sequence: Synthetic polypeptide
DESEIRTTNPVATECWGSVCSTINPPEREGNG

SEQ ID NO: 74279 - protein, 30 aa, Artificial Sequence
  Description of Artificial Sequence: Synthetic polypeptide
DEDCIRTTNPVAYEQWGQVSTIAVQRGNQD

SEQ ID NO: 74280 - protein, 33 aa, Artificial Sequence
  Description of Artificial Sequence: Synthetic polypeptide
DEDCIRTTNPVATEQWGSVATTNMLSQNGGNNR

SEQ ID NO: 74281 - protein, 28 aa, Artificial Sequence
  Description of Artificial Sequence: Synthetic peptide
QEEEIATTNPVSTEQYGIAPCNLQHEER

SEQ ID NO: 74282 - protein, 28 aa, Artificial Sequence
  Description of Artificial Sequence: Synthetic peptide
QEEEIATTNPVSTEQYGIASCNCQHETR

SEQ ID NO: 74283 - protein, 33 aa, Artificial Sequence
  Description of Artificial Sequence: Synthetic polypeptide
AEEEIRTTNPVATEQYGSVVTNGDNGNQSGNQN

SEQ ID NO: 74284 - protein, 32 aa, Artificial Sequence
  Description of Artificial Sequence: Synthetic polypeptide
AEEEIRTTNPVATEQYGSVVTNETNLQANTTT

SEQ ID NO: 74285 - protein, 30 aa, Artificial Sequence
  Description of Artificial Sequence: Synthetic polypeptide
DEDCIATTNPVAYEQWGQVSTNNVQDRGNN

SEQ ID NO: 74286 - protein, 33 aa, Artificial Sequence
  Description of Artificial Sequence: Synthetic polypeptide
DEEEIRTTNPVATEQYGSVISNLPQEQAIVNDD

SEQ ID NO: 74287 - protein, 34 aa, Artificial Sequence
  Description of Artificial Sequence: Synthetic polypeptide
DEEEIRTTNPVATEQYGSVSTNDPPQTVEDEQRQ

SEQ ID NO: 74288 - protein, 33 aa, Artificial Sequence
  Description of Artificial Sequence: Synthetic polypeptide
DEEEIRTTNPVATEQYGSVSTNDPMMDGSDQQY

SEQ ID NO: 74289 - protein, 31 aa, Artificial Sequence
  Description of Artificial Sequence: Synthetic polypeptide
DEEEIATTNPVATEQYGEVSTDLEDHEGEDL

SEQ ID NO: 74290 - protein, 31 aa, Artificial Sequence
  Description of Artificial Sequence: Synthetic polypeptide
DEDEIACTNPVATEQYGSVATNLQRNPTPDH

SEQ ID NO: 74291 - protein, 34 aa, Artificial Sequence
  Description of Artificial Sequence: Synthetic polypeptide
AEEEIRTTNPVATEQYGSVVTTNNLLQEIGNNTN

SEQ ID NO: 74292 - protein, 30 aa, Artificial Sequence
  Description of Artificial Sequence: Synthetic polypeptide
QEEEIATTNPVATEQYGSVSENCPQDHEEK

SEQ ID NO: 74293 - protein, 33 aa, Artificial Sequence
  Description of Artificial Sequence: Synthetic polypeptide
DEEEIRTTNPVATEQYGSVIENNGLQTQQIMER

SEQ ID NO: 74294 - protein, 32 aa, Artificial Sequence
  Description of Artificial Sequence: Synthetic polypeptide
DEDEIACTNPVATEQYGSVATNLQPRPGDHVN

SEQ ID NO: 74295 - protein, 32 aa, Artificial Sequence
  Description of Artificial Sequence: Synthetic polypeptide
DEDEIACTNPVATEQYGSVATNLQMAEGDGNE

SEQ ID NO: 74296 - protein, 32 aa, Artificial Sequence
  Description of Artificial Sequence: Synthetic polypeptide
DEDEIACTNPVATEQYGSVATNLQETGNNVEV

SEQ ID NO: 74297 - protein, 32 aa, Artificial Sequence
  Description of Artificial Sequence: Synthetic polypeptide
DEDEIACTNPVATEQYGSVATNLQATGGNGEE

SEQ ID NO: 74298 - protein, 32 aa, Artificial Sequence
  Description of Artificial Sequence: Synthetic polypeptide
QEEEIATTNPVATEQYGSVSSTTPAGNRGMNV

SEQ ID NO: 74299 - protein, 31 aa, Artificial Sequence
  Description of Artificial Sequence: Synthetic polypeptide
DEDEIACTNPVATEQYGSVATNLERGGLDEL

SEQ ID NO: 74300 - protein, 33 aa, Artificial Sequence
  Description of Artificial Sequence: Synthetic polypeptide
DEDEIACTNPVATEQYGSVATNLEDRPGENARE

SEQ ID NO: 74301 - protein, 31 aa, Artificial Sequence
  Description of Artificial Sequence: Synthetic polypeptide
DEDEIACTNPVATEQYGSVATNLDTGGNPDE

SEQ ID NO: 74302 - protein, 30 aa, Artificial Sequence
  Description of Artificial Sequence: Synthetic polypeptide
DEDEIACTNPVATEQYGSVATNLADPEGAE

SEQ ID NO: 74303 - protein, 29 aa, Artificial Sequence
  Description of Artificial Sequence: Synthetic peptide
DEDEIACTNPVATEQYGSVATNDQDSPDD

SEQ ID NO: 74304 - protein, 34 aa, Artificial Sequence
  Description of Artificial Sequence: Synthetic polypeptide
AEEEIRTTNPVATEQYGSVVTTNNLQGSTGTNGT

SEQ ID NO: 74305 - protein, 31 aa, Artificial Sequence
  Description of Artificial Sequence: Synthetic polypeptide
QEEEIATTNPVATEQYGSVSTEPAGNRNENV

SEQ ID NO: 74306 - protein, 34 aa, Artificial Sequence
  Description of Artificial Sequence: Synthetic polypeptide
AEEEIRTTNPVATEQYGSVVTTNNLQNQEGNNTE

SEQ ID NO: 74307 - protein, 34 aa, Artificial Sequence
  Description of Artificial Sequence: Synthetic polypeptide
DEEEIRTTNPVATEQYGSVIEPTNIGQPRMLLER

SEQ ID NO: 74308 - protein, 33 aa, Artificial Sequence
  Description of Artificial Sequence: Synthetic polypeptide
DEEEIRTTNPVATEQYGSVSTNDHNQEYFMSEQ

SEQ ID NO: 74309 - protein, 30 aa, Artificial Sequence
  Description of Artificial Sequence: Synthetic polypeptide
QEEEIATTNPVATEQYGSVPATVLEDHGEL

SEQ ID NO: 74310 - protein, 30 aa, Artificial Sequence
  Description of Artificial Sequence: Synthetic polypeptide
QEEEIATTNPVATEQYGSVPATVLQDHEEL

SEQ ID NO: 74311 - protein, 29 aa, Artificial Sequence
  Description of Artificial Sequence: Synthetic peptide
DEEEIATTNPVATEQYGEVPTVLEDHEEL

SEQ ID NO: 74312 - protein, 30 aa, Artificial Sequence
  Description of Artificial Sequence: Synthetic polypeptide
DEEEIATTNPVATEQYGEVSAEVCQHEGEL

SEQ ID NO: 74313 - protein, 32 aa, Artificial Sequence
  Description of Artificial Sequence: Synthetic polypeptide
DEDEIACTNPVATEQYGSVATNQLQEQMGNSL

SEQ ID NO: 74314 - protein, 35 aa, Artificial Sequence
  Description of Artificial Sequence: Synthetic polypeptide
DEEEIRTTNPVATEQYGSVIEPWGNLQTRVGEVNE

SEQ ID NO: 74315 - protein, 34 aa, Artificial Sequence
  Description of Artificial Sequence: Synthetic polypeptide
AEEEIRTTNPVATEQYGSVVTTNNNLQANEGTND

SEQ ID NO: 74316 - protein, 29 aa, Artificial Sequence
  Description of Artificial Sequence: Synthetic peptide
QEEEIATTNPVATEQYGSVPTVCQDHEEK

SEQ ID NO: 74317 - protein, 34 aa, Artificial Sequence
  Description of Artificial Sequence: Synthetic polypeptide
AEEEIRTTNPVATEQYGSVVTTNNLQQQGEGNND

SEQ ID NO: 74318 - protein, 34 aa, Artificial Sequence
  Description of Artificial Sequence: Synthetic polypeptide
AEEEIRTTNPVATEQYGSVVTTNNLQQQEGTNVT

SEQ ID NO: 74319 - protein, 32 aa, Artificial Sequence
  Description of Artificial Sequence: Synthetic polypeptide
DEDEIACTNPVATEQYGSVATNLQVADGNEND

SEQ ID NO: 74320 - protein, 34 aa, Artificial Sequence
  Description of Artificial Sequence: Synthetic polypeptide
AEEEIRTTNPVATEQYGSVVTTNNLQQGEEGNTQ

SEQ ID NO: 74321 - protein, 30 aa, Artificial Sequence
  Description of Artificial Sequence: Synthetic polypeptide
DEEEIATTNPVATEQYGEVSPEPACQREEK

SEQ ID NO: 74322 - protein, 31 aa, Artificial Sequence
  Description of Artificial Sequence: Synthetic polypeptide
DEDEIACTNPVATEQYGSVATNLQTENNTPE

SEQ ID NO: 74323 - protein, 33 aa, Artificial Sequence
  Description of Artificial Sequence: Synthetic polypeptide
DEEEIRTTNPVATEQYGSVIEPTNGQTHNQVVD

SEQ ID NO: 74324 - protein, 28 aa, Artificial Sequence
  Description of Artificial Sequence: Synthetic peptide
QEEEIATTNPVATEQYGVMPSTCQHGDI

SEQ ID NO: 74325 - protein, 33 aa, Artificial Sequence
  Description of Artificial Sequence: Synthetic polypeptide
DEEEIRTTNPVATEQYGSVIDEPTNLQITVVDY

SEQ ID NO: 74326 - protein, 34 aa, Artificial Sequence
  Description of Artificial Sequence: Synthetic polypeptide
AEEEIRTTNPVATEQYGSVVTTNNLEQGEEGNNT

SEQ ID NO: 74327 - protein, 32 aa, Artificial Sequence
  Description of Artificial Sequence: Synthetic polypeptide
DESEIRTTNPVATECWGSVSCDNEPQREGENG

SEQ ID NO: 74328 - protein, 34 aa, Artificial Sequence
  Description of Artificial Sequence: Synthetic polypeptide
DEEEIRTTNPVATEQYGSVHWTIMLTQRQSSNED

SEQ ID NO: 74329 - protein, 30 aa, Artificial Sequence
  Description of Artificial Sequence: Synthetic polypeptide
DEDEIACTNPVATEQYGCVATNLQRESTAV

SEQ ID NO: 74330 - protein, 32 aa, Artificial Sequence
  Description of Artificial Sequence: Synthetic polypeptide
DEEEIRTTNPVATEQYGSVHVVNTDLETRVVE

SEQ ID NO: 74331 - protein, 31 aa, Artificial Sequence
  Description of Artificial Sequence: Synthetic polypeptide
DEDEIACTNPVATEQYGCVATNLQREADNNS

SEQ ID NO: 74332 - protein, 31 aa, Artificial Sequence
  Description of Artificial Sequence: Synthetic polypeptide
DEDEIACTNPVATEQYGCVATNLQRANDQDE

SEQ ID NO: 74333 - protein, 31 aa, Artificial Sequence
  Description of Artificial Sequence: Synthetic polypeptide
DEDEIACTNPVATEQYGCVATNLQRAEDNES

SEQ ID NO: 74334 - protein, 29 aa, Artificial Sequence
  Description of Artificial Sequence: Synthetic peptide
QEEEIATTNPVATEQYGTVPATVCQHGEK

SEQ ID NO: 74335 - protein, 29 aa, Artificial Sequence
  Description of Artificial Sequence: Synthetic peptide
QEEEIATTNPVATEQYGTVPATVPQHGEK

SEQ ID NO: 74336 - protein, 31 aa, Artificial Sequence
  Description of Artificial Sequence: Synthetic polypeptide
DEDEIACTNPVATEQYGCVATNLQQGDNEAD

SEQ ID NO: 74337 - protein, 28 aa, Artificial Sequence
  Description of Artificial Sequence: Synthetic peptide
QEEEIATTNPVATEQYGTVPEVCQHGEK

SEQ ID NO: 74338 - protein, 30 aa, Artificial Sequence
  Description of Artificial Sequence: Synthetic polypeptide
DEDEIACTNPVATEQYGCVATNLQNDDNPE

SEQ ID NO: 74339 - protein, 33 aa, Artificial Sequence
  Description of Artificial Sequence: Synthetic polypeptide
DEEEIRTTNPVATEQYGSVSTNDNQTVSLEDTS

SEQ ID NO: 74340 - protein, 28 aa, Artificial Sequence
  Description of Artificial Sequence: Synthetic peptide
QEEEIATTNPVATEQYGVASDNCQHEEQ

SEQ ID NO: 74341 - protein, 28 aa, Artificial Sequence
  Description of Artificial Sequence: Synthetic peptide
QEEEIATTNPVATEQYGVASEVCQHGEK

SEQ ID NO: 74342 - protein, 30 aa, Artificial Sequence
  Description of Artificial Sequence: Synthetic polypeptide
DEDEIACTNPVATEQYGCVATNLTAGEDNE

SEQ ID NO: 74343 - protein, 32 aa, Artificial Sequence
  Description of Artificial Sequence: Synthetic polypeptide
QEEEIATTNPVATEQYGSVSTEPAGNRNGMNV

SEQ ID NO: 74344 - protein, 33 aa, Artificial Sequence
  Description of Artificial Sequence: Synthetic polypeptide
AEEEIRTTNPVATEQYGSVVTTNLGGNEEGNTN

SEQ ID NO: 74345 - protein, 35 aa, Artificial Sequence
  Description of Artificial Sequence: Synthetic polypeptide
DEEEIATTNPVATEQYGQSVSCTQNLPVRTGGNNL

SEQ ID NO: 74346 - protein, 34 aa, Artificial Sequence
  Description of Artificial Sequence: Synthetic polypeptide
AEEEIRTTNPVATEQYGSVVTTNNGNLQSGTNQI

SEQ ID NO: 74347 - protein, 34 aa, Artificial Sequence
  Description of Artificial Sequence: Synthetic polypeptide
DEEEIRTTNPVATEQYGSVICTSLQVQEGELLRN

SEQ ID NO: 74348 - protein, 30 aa, Artificial Sequence
  Description of Artificial Sequence: Synthetic polypeptide
DEDEIACTNPVATEQYGSVAATANGNMGNT

SEQ ID NO: 74349 - protein, 34 aa, Artificial Sequence
  Description of Artificial Sequence: Synthetic polypeptide
AEEEIRTTNPVATEQYGSVVTTNNGNLQQGTNIN

SEQ ID NO: 74350 - protein, 33 aa, Artificial Sequence
  Description of Artificial Sequence: Synthetic polypeptide
DEEEIRTTNPVATEQYGSVICPVPMQQRGLFRE

SEQ ID NO: 74351 - protein, 33 aa, Artificial Sequence
  Description of Artificial Sequence: Synthetic polypeptide
AEEEIRTTNPVATEQYGSVVTTNNENQNGNNPS

SEQ ID NO: 74352 - protein, 32 aa, Artificial Sequence
  Description of Artificial Sequence: Synthetic polypeptide
DESEIRTTNPVATECWGSVSCENIPQDREGNG

SEQ ID NO: 74353 - protein, 34 aa, Artificial Sequence
  Description of Artificial Sequence: Synthetic polypeptide
DEEEIRTTNPVATEQYGSVIATNTLNQENGTEED

SEQ ID NO: 74354 - protein, 34 aa, Artificial Sequence
  Description of Artificial Sequence: Synthetic polypeptide
AEEEIRTTNPVATEQYGSVVTTNLQSNEEGTNNQ

SEQ ID NO: 74355 - protein, 33 aa, Artificial Sequence
  Description of Artificial Sequence: Synthetic polypeptide
AEEEIRTTNPVATEQYGSVVTTNLQQQQGIGVQ

SEQ ID NO: 74356 - protein, 34 aa, Artificial Sequence
  Description of Artificial Sequence: Synthetic polypeptide
DEEEIRTTNPVATEQYGSVIAPTTNLGRGEIEDT

SEQ ID NO: 74357 - protein, 32 aa, Artificial Sequence
  Description of Artificial Sequence: Synthetic polypeptide
DEEEIRTTNPVATEQYGSVIAPTPLAREIEDQ

SEQ ID NO: 74358 - protein, 34 aa, Artificial Sequence
  Description of Artificial Sequence: Synthetic polypeptide
AEEEIRTTNPVATEQYGSVVTTNLQQGTEGTNTG

SEQ ID NO: 74359 - protein, 32 aa, Artificial Sequence
  Description of Artificial Sequence: Synthetic polypeptide
QEEEIATTNPVATEQYGSVSTTPVGPNRGMNV

SEQ ID NO: 74360 - protein, 36 aa, Artificial Sequence
  Description of Artificial Sequence: Synthetic polypeptide
DEEEIATTNPVATEQYGQSVSCTLNMLPVRTGGNNR

SEQ ID NO: 74361 - protein, 34 aa, Artificial Sequence
  Description of Artificial Sequence: Synthetic polypeptide
DEEEIRTTNPVATEQYGSVIAEVGLQVLGPENRT

SEQ ID NO: 74362 - protein, 33 aa, Artificial Sequence
  Description of Artificial Sequence: Synthetic polypeptide
DESEIRTTNPVATEGWGSVSCINLPQDREGENG

SEQ ID NO: 74363 - protein, 32 aa, Artificial Sequence
  Description of Artificial Sequence: Synthetic polypeptide
DEEEIATTNPVATEQYGCVCSTEGHQNFGSND

SEQ ID NO: 74364 - protein, 31 aa, Artificial Sequence
  Description of Artificial Sequence: Synthetic polypeptide
DESEIRTTNPVATECWGSVSCINEQDHEGNG

SEQ ID NO: 74365 - protein, 33 aa, Artificial Sequence
  Description of Artificial Sequence: Synthetic polypeptide
DEEEIRTTNPVATEQYGSVSTLGFEGEGGNDED

SEQ ID NO: 74366 - protein, 31 aa, Artificial Sequence
  Description of Artificial Sequence: Synthetic polypeptide
DEEEIRTTNPVATEQYGSVIYVPDLDGGGEF

SEQ ID NO: 74367 - protein, 35 aa, Artificial Sequence
  Description of Artificial Sequence: Synthetic polypeptide
DEEEIRTTNPVATEQYGSVIYTTNVGQPRGVLERT

SEQ ID NO: 74368 - protein, 33 aa, Artificial Sequence
  Description of Artificial Sequence: Synthetic polypeptide
DEEEIRTTNPVATEQYGSVSTLGLELEGGGGEN

SEQ ID NO: 74369 - protein, 35 aa, Artificial Sequence
  Description of Artificial Sequence: Synthetic polypeptide
DEEEIRTTNPVATEQYGSVIYTPNLQQRENVELLA

SEQ ID NO: 74370 - protein, 34 aa, Artificial Sequence
  Description of Artificial Sequence: Synthetic polypeptide
DEEEIRTTNPVATEQYGSVIYTPNIQIRENVEDG

SEQ ID NO: 74371 - protein, 32 aa, Artificial Sequence
  Description of Artificial Sequence: Synthetic polypeptide
DEEEIRTTNPVATEQYGSVSTLEYMERVVVHD

SEQ ID NO: 74372 - protein, 34 aa, Artificial Sequence
  Description of Artificial Sequence: Synthetic polypeptide
DEEEIRTTNPVATEQYGSVSTLLLAIVDGDNEET

SEQ ID NO: 74373 - protein, 33 aa, Artificial Sequence
  Description of Artificial Sequence: Synthetic polypeptide
DEEEIRTTNPVATEQYGSVSTLLLYPQNELPVD

SEQ ID NO: 74374 - protein, 34 aa, Artificial Sequence
  Description of Artificial Sequence: Synthetic polypeptide
DEEEIRTTNPVATEQYGSVIYPTNSGQPRQLERE

SEQ ID NO: 74375 - protein, 33 aa, Artificial Sequence
  Description of Artificial Sequence: Synthetic polypeptide
DESEIRTTNPVATECWGSVSTINEPQDREGGNG

SEQ ID NO: 74376 - protein, 33 aa, Artificial Sequence
  Description of Artificial Sequence: Synthetic polypeptide
DESEIRTTNPVATECWGSVSTINEPQDREGENH

SEQ ID NO: 74377 - protein, 33 aa, Artificial Sequence
  Description of Artificial Sequence: Synthetic polypeptide
DESEIRTTNPVATECWGSVSTINEPQDREGENG

SEQ ID NO: 74378 - protein, 33 aa, Artificial Sequence
  Description of Artificial Sequence: Synthetic polypeptide
DESEIRTTNPVATECWGSVSTHNEPQDREGENG

SEQ ID NO: 74379 - protein, 35 aa, Artificial Sequence
  Description of Artificial Sequence: Synthetic polypeptide
DEEEIRTTNPVATEQYGSVSTLLLLQAEGEGNNED

SEQ ID NO: 74380 - protein, 34 aa, Artificial Sequence
  Description of Artificial Sequence: Synthetic polypeptide
DEEEIRTTNPVATEQYGSVSTLDNEQTEGGQDHI

SEQ ID NO: 74381 - protein, 30 aa, Artificial Sequence
  Description of Artificial Sequence: Synthetic polypeptide
DEDEIATTNPVAYEGWGSVATNLQGGNDEN

SEQ ID NO: 74382 - protein, 32 aa, Artificial Sequence
  Description of Artificial Sequence: Synthetic polypeptide
DEEEIRTTNPVATEQYGSVSTLDIQAQSSDEE

SEQ ID NO: 74383 - protein, 31 aa, Artificial Sequence
  Description of Artificial Sequence: Synthetic polypeptide
DESEIRTTNPVATECWGVVSCNEPQDREGNG

SEQ ID NO: 74384 - protein, 30 aa, Artificial Sequence
  Description of Artificial Sequence: Synthetic polypeptide
DESEIRTTNPVATECWGVVASITEQREGNG

SEQ ID NO: 74385 - protein, 31 aa, Artificial Sequence
  Description of Artificial Sequence: Synthetic polypeptide
DESEIRTTNPVATECWGVVASINEPQREGNG

SEQ ID NO: 74386 - protein, 33 aa, Artificial Sequence
  Description of Artificial Sequence: Synthetic polypeptide
DEEEIATTNPVATEQWGESTVSTNSLSGRGGTE

SEQ ID NO: 74387 - protein, 30 aa, Artificial Sequence
  Description of Artificial Sequence: Synthetic polypeptide
DESEIRTTNPVATECWGVVACNEPQDRGNG

SEQ ID NO: 74388 - protein, 30 aa, Artificial Sequence
  Description of Artificial Sequence: Synthetic polypeptide
DESEIRTTNPVATECWGVMASTEPQDRGNG

SEQ ID NO: 74389 - protein, 32 aa, Artificial Sequence
  Description of Artificial Sequence: Synthetic polypeptide
DEEEIRTTNPVATEQYGSVSTISDHTRVLDDN

SEQ ID NO: 74390 - protein, 32 aa, Artificial Sequence
  Description of Artificial Sequence: Synthetic polypeptide
DEEEIRTTNPVATEQYGSVSTISHTTRVEDDN

SEQ ID NO: 74391 - protein, 32 aa, Artificial Sequence
  Description of Artificial Sequence: Synthetic polypeptide
DEEEIRTTNPVATEQYGSVLDTTEVYRPEVRI

SEQ ID NO: 74392 - protein, 32 aa, Artificial Sequence
  Description of Artificial Sequence: Synthetic polypeptide
DEEEIATTNPVATEQWGEVSTNLNGGQGPNTA

SEQ ID NO: 74393 - protein, 34 aa, Artificial Sequence
  Description of Artificial Sequence: Synthetic polypeptide
DEEEIRTTNPVATEQYGSVLATSNLVQVSNVVDF

SEQ ID NO: 74394 - protein, 29 aa, Artificial Sequence
  Description of Artificial Sequence: Synthetic peptide
DEDEIATTNPVAYEKWGETSTNLQRGGDS

SEQ ID NO: 74395 - protein, 29 aa, Artificial Sequence
  Description of Artificial Sequence: Synthetic peptide
DEDEIATTNPVAYEHYGSVVNNEQRMEWR

SEQ ID NO: 74396 - protein, 33 aa, Artificial Sequence
  Description of Artificial Sequence: Synthetic polypeptide
DEEEIRTTNPVATEQYGSVSTLDESGQSNNGGD

SEQ ID NO: 74397 - protein, 32 aa, Artificial Sequence
  Description of Artificial Sequence: Synthetic polypeptide
DEEEIRTTNPVATEQYGSVSTLDHQHDSMDQD

SEQ ID NO: 74398 - protein, 34 aa, Artificial Sequence
  Description of Artificial Sequence: Synthetic polypeptide
DEEEIRTTNPVATEQYGSVIYNTNGNEQRELENV

SEQ ID NO: 74399 - protein, 33 aa, Artificial Sequence
  Description of Artificial Sequence: Synthetic polypeptide
DESEIRTTNPVATECWGSVSSINLPQDREGENG

SEQ ID NO: 74400 - protein, 32 aa, Artificial Sequence
  Description of Artificial Sequence: Synthetic polypeptide
DEDEIATTNPVATETWGTVSTNLQGNDGQNTR

SEQ ID NO: 74401 - protein, 34 aa, Artificial Sequence
  Description of Artificial Sequence: Synthetic polypeptide
DEEEIRTTNPVATEQYGSVIYMPNLQIRENVEDW

SEQ ID NO: 74402 - protein, 33 aa, Artificial Sequence
  Description of Artificial Sequence: Synthetic polypeptide
DEEEIRTTNPVATEQYGSVSTMDDEAEGGNEEI

SEQ ID NO: 74403 - protein, 32 aa, Artificial Sequence
  Description of Artificial Sequence: Synthetic polypeptide
DEEEIRTTNPVATEQYGSVSTMDDHQDTQIDD

SEQ ID NO: 74404 - protein, 30 aa, Artificial Sequence
  Description of Artificial Sequence: Synthetic polypeptide
DEEEIATTNPVATEQWGSVANNPDNNGNQD

SEQ ID NO: 74405 - protein, 34 aa, Artificial Sequence
  Description of Artificial Sequence: Synthetic polypeptide
DEEEIRTTNPVATEQYGSVSTMDFEQGEQGENGE

SEQ ID NO: 74406 - protein, 34 aa, Artificial Sequence
  Description of Artificial Sequence: Synthetic polypeptide
DEEEIRTTNPVATEQYGSVSTMDFQQEEGGNGET

SEQ ID NO: 74407 - protein, 33 aa, Artificial Sequence
  Description of Artificial Sequence: Synthetic polypeptide
DEEEIRTTNPVATEQYGSVSTMDGIGQGEGGEI

SEQ ID NO: 74408 - protein, 33 aa, Artificial Sequence
  Description of Artificial Sequence: Synthetic polypeptide
DESEIRTTNPVATECWGSVSFINELQDREGENG

SEQ ID NO: 74409 - protein, 31 aa, Artificial Sequence
  Description of Artificial Sequence: Synthetic polypeptide
DESEIRTTNPVATECWGSVSENEPQHEGENG

SEQ ID NO: 74410 - protein, 32 aa, Artificial Sequence
  Description of Artificial Sequence: Synthetic polypeptide
DESEIRTTNPVATECWGSVSENEPQDREGENG

SEQ ID NO: 74411 - protein, 34 aa, Artificial Sequence
  Description of Artificial Sequence: Synthetic polypeptide
DEEEIRTTNPVATEQYGSVSTMDGQDEGGENGNT

SEQ ID NO: 74412 - protein, 33 aa, Artificial Sequence
  Description of Artificial Sequence: Synthetic polypeptide
DEEEIRTTNPVATEQYGSVSTMDHHQDSTQNDD

SEQ ID NO: 74413 - protein, 32 aa, Artificial Sequence
  Description of Artificial Sequence: Synthetic polypeptide
DESEIRTTNPVATECWGSVSEINLPMREGENG

SEQ ID NO: 74414 - protein, 31 aa, Artificial Sequence
  Description of Artificial Sequence: Synthetic polypeptide
DEEEIATTNPVATEQWGSVSATGNGGDPGAF

SEQ ID NO: 74415 - protein, 28 aa, Artificial Sequence
  Description of Artificial Sequence: Synthetic peptide
QEEEIATTNPVATEQYGEAPEVCQRENK

SEQ ID NO: 74416 - protein, 32 aa, Artificial Sequence
  Description of Artificial Sequence: Synthetic polypeptide
DESEIRTTNPVATECWGSVSEINEQDREGENG

SEQ ID NO: 74417 - protein, 34 aa, Artificial Sequence
  Description of Artificial Sequence: Synthetic polypeptide
DEEEIRTTNPVATEQYGSVSTMDDDQYTIGPNNQ

SEQ ID NO: 74418 - protein, 32 aa, Artificial Sequence
  Description of Artificial Sequence: Synthetic polypeptide
DESEIRTTNPVATECWGYVSCTNEPQDREGNG

SEQ ID NO: 74419 - protein, 33 aa, Artificial Sequence
  Description of Artificial Sequence: Synthetic polypeptide
DEEEIRTTNPVATEQYGSVSTLQSLPQQIVEEE

SEQ ID NO: 74420 - protein, 33 aa, Artificial Sequence
  Description of Artificial Sequence: Synthetic polypeptide
DEDEIATTNPVATEQYGSVCATNPLQESDNMRQ

SEQ ID NO: 74421 - protein, 35 aa, Artificial Sequence
  Description of Artificial Sequence: Synthetic polypeptide
DEEEIRTTNPVATEQYGSVIYETVNVGQPRGELER

SEQ ID NO: 74422 - protein, 29 aa, Artificial Sequence
  Description of Artificial Sequence: Synthetic peptide
DEDEIATTNPVATESYGCIAATNEQRDNF

SEQ ID NO: 74423 - protein, 32 aa, Artificial Sequence
  Description of Artificial Sequence: Synthetic polypeptide
DEEEIRTTNPVATEQYGSVIWPPVLQRVEEEQ

SEQ ID NO: 74424 - protein, 32 aa, Artificial Sequence
  Description of Artificial Sequence: Synthetic polypeptide
DEEEIRTTNPVATEQYGSVSTLMTLEDTEEVD

SEQ ID NO: 74425 - protein, 33 aa, Artificial Sequence
  Description of Artificial Sequence: Synthetic polypeptide
DEEEIRTTNPVATEQYGSVSTLMTQESTQNHFA

SEQ ID NO: 74426 - protein, 33 aa, Artificial Sequence
  Description of Artificial Sequence: Synthetic polypeptide
DEEEIRTTNPVATEQYGSVSTLNDMQQSTIEPS

SEQ ID NO: 74427 - protein, 34 aa, Artificial Sequence
  Description of Artificial Sequence: Synthetic polypeptide
DEEEIRTTNPVATEQYGSVSTLNDTIGMGGNQGG

SEQ ID NO: 74428 - protein, 32 aa, Artificial Sequence
  Description of Artificial Sequence: Synthetic polypeptide
DESEIRTTNPVATECWGSVSNINEPQDREGNG

SEQ ID NO: 74429 - protein, 33 aa, Artificial Sequence
  Description of Artificial Sequence: Synthetic polypeptide
DEEEIRTTNPVATEQYGSVITTVNMGPGGGNDG

SEQ ID NO: 74430 - protein, 33 aa, Artificial Sequence
  Description of Artificial Sequence: Synthetic polypeptide
DEEEIRTTNPVATEQYGSVITTVEMQPYGSIDR

SEQ ID NO: 74431 - protein, 31 aa, Artificial Sequence
  Description of Artificial Sequence: Synthetic polypeptide
DEEEIATTNPVATEQWGNTTSTNEPQGMGNN

SEQ ID NO: 74432 - protein, 28 aa, Artificial Sequence
  Description of Artificial Sequence: Synthetic peptide
QEEEIATTNPVATEQYGEAPEVCQHGGR

SEQ ID NO: 74433 - protein, 28 aa, Artificial Sequence
  Description of Artificial Sequence: Synthetic peptide
QEEEIATTNPVATEQYGEAPEVCQHGNK

SEQ ID NO: 74434 - protein, 36 aa, Artificial Sequence
  Description of Artificial Sequence: Synthetic polypeptide
DEEEIRTTNPVATEQYGSVSTLNMMWQERDGEEERD

SEQ ID NO: 74435 - protein, 31 aa, Artificial Sequence
  Description of Artificial Sequence: Synthetic polypeptide
DEDEIATTNPVATEQYGSVCATNPQGGPPQH

SEQ ID NO: 74436 - protein, 34 aa, Artificial Sequence
  Description of Artificial Sequence: Synthetic polypeptide
DEEEIRTTNPVATEQYGSVITPTNLGMREGVIED

SEQ ID NO: 74437 - protein, 33 aa, Artificial Sequence
  Description of Artificial Sequence: Synthetic polypeptide
DEEEIRTTNPVATEQYGSVSTILGLIETGAQLE

SEQ ID NO: 74438 - protein, 33 aa, Artificial Sequence
  Description of Artificial Sequence: Synthetic polypeptide
DEEEIRTTNPVATEQYGSVSTIITDQTNVNEVE

SEQ ID NO: 74439 - protein, 34 aa, Artificial Sequence
  Description of Artificial Sequence: Synthetic polypeptide
DEEEIRTTNPVATEQYGSVSTIAGPNDRNGMNPV

SEQ ID NO: 74440 - protein, 33 aa, Artificial Sequence
  Description of Artificial Sequence: Synthetic polypeptide
DEEEIRTTNPVATEQYGSVLTPLHEQTMGLLMQ

SEQ ID NO: 74441 - protein, 28 aa, Artificial Sequence
  Description of Artificial Sequence: Synthetic peptide
QEEEIATTNPVATEQYGEAPCNCQHEER

SEQ ID NO: 74442 - protein, 33 aa, Artificial Sequence
  Description of Artificial Sequence: Synthetic polypeptide
DESEIRTTNPVATECYGSVSCINPPQDREGENG

SEQ ID NO: 74443 - protein, 32 aa, Artificial Sequence
  Description of Artificial Sequence: Synthetic polypeptide
AEEEIRTTNPVATEQYGSVVTVNNEQAGEQIG

SEQ ID NO: 74444 - protein, 34 aa, Artificial Sequence
  Description of Artificial Sequence: Synthetic polypeptide
AEEEIRTTNPVATEQYGSVVTVNLQSNEQGTNND

SEQ ID NO: 74445 - protein, 34 aa, Artificial Sequence
  Description of Artificial Sequence: Synthetic polypeptide
AEEEIRTTNPVATEQYGSVVTVNLQSNEQGENGN

SEQ ID NO: 74446 - protein, 33 aa, Artificial Sequence
  Description of Artificial Sequence: Synthetic polypeptide
DESEIRTTNPVATECYGSVSCINGPQDREGENV

SEQ ID NO: 74447 - protein, 33 aa, Artificial Sequence
  Description of Artificial Sequence: Synthetic polypeptide
DESEIRTTNPVATECYGSVSCINEPQSRVGENG

SEQ ID NO: 74448 - protein, 28 aa, Artificial Sequence
  Description of Artificial Sequence: Synthetic peptide
QEEEIATTNPVATEQYGEAPDVLQHGEK

SEQ ID NO: 74449 - protein, 28 aa, Artificial Sequence
  Description of Artificial Sequence: Synthetic peptide
QEEEIATTNPVATEQYGEAPDVLQSENK

SEQ ID NO: 74450 - protein, 33 aa, Artificial Sequence
  Description of Artificial Sequence: Synthetic polypeptide
DESEIRTTNPVATECYGSVSCINEPQDRVGENG

SEQ ID NO: 74451 - protein, 34 aa, Artificial Sequence
  Description of Artificial Sequence: Synthetic polypeptide
DEEEIRTTNPVATEQYGSVLSYTELQDMLGGWID

SEQ ID NO: 74452 - protein, 33 aa, Artificial Sequence
  Description of Artificial Sequence: Synthetic polypeptide
DESEIRTTNPVATECYGSVSCINEPQDRNGENG

SEQ ID NO: 74453 - protein, 33 aa, Artificial Sequence
  Description of Artificial Sequence: Synthetic polypeptide
DESEIRTTNPVATECYGSVSCINEPQDREGENY

SEQ ID NO: 74454 - protein, 33 aa, Artificial Sequence
  Description of Artificial Sequence: Synthetic polypeptide
DESEIRTTNPVATECYGSVSCINEPQDREGENV

SEQ ID NO: 74455 - protein, 33 aa, Artificial Sequence
  Description of Artificial Sequence: Synthetic polypeptide
DESEIRTTNPVATECYGSVSSINEPQDREGENG

SEQ ID NO: 74456 - protein, 33 aa, Artificial Sequence
  Description of Artificial Sequence: Synthetic polypeptide
DESEIRTTNPVATECYGSVSCINEPQDREGENG

SEQ ID NO: 74457 - protein, 34 aa, Artificial Sequence
  Description of Artificial Sequence: Synthetic polypeptide
DESEIRTTNPVATECYGSVSSTINEPQMRNGENG

SEQ ID NO: 74458 - protein, 33 aa, Artificial Sequence
  Description of Artificial Sequence: Synthetic polypeptide
DEEEIRTTNPVATEQYGSVLVPNNEQAMGENLQ

SEQ ID NO: 74459 - protein, 28 aa, Artificial Sequence
  Description of Artificial Sequence: Synthetic peptide
QEEEIATTNPVATEQYGDASECLQHEEK

SEQ ID NO: 74460 - protein, 32 aa, Artificial Sequence
  Description of Artificial Sequence: Synthetic polypeptide
DESEIRTTNPVATEGWGSVSCINEQDREGENG

SEQ ID NO: 74461 - protein, 32 aa, Artificial Sequence
  Description of Artificial Sequence: Synthetic polypeptide
DESEIRTTNPVATEGWGSVSCINEPQDRGENG

SEQ ID NO: 74462 - protein, 28 aa, Artificial Sequence
  Description of Artificial Sequence: Synthetic peptide
QEEEIATTNPVATEQYGDVPECLQHEEL

SEQ ID NO: 74463 - protein, 32 aa, Artificial Sequence
  Description of Artificial Sequence: Synthetic polypeptide
DESEIRTTNPVATEGWGSVACNLPQDREGENI

SEQ ID NO: 74464 - protein, 31 aa, Artificial Sequence
  Description of Artificial Sequence: Synthetic polypeptide
DESEIRTTNPVATEFYGVVDTDLQRGEGGDN

SEQ ID NO: 74465 - protein, 33 aa, Artificial Sequence
  Description of Artificial Sequence: Synthetic polypeptide
QEEEIATTNPVATEQYGDVSTTCLPQMRNGMNV

SEQ ID NO: 74466 - protein, 32 aa, Artificial Sequence
  Description of Artificial Sequence: Synthetic polypeptide
DESEIRTTNPVATEFWGSVSCINEQDREGENG

SEQ ID NO: 74467 - protein, 33 aa, Artificial Sequence
  Description of Artificial Sequence: Synthetic polypeptide
DEEEIRTTNPVATEQYGSVMEPTNGLETRTPVV

SEQ ID NO: 74468 - protein, 31 aa, Artificial Sequence
  Description of Artificial Sequence: Synthetic polypeptide
DEEEIRTTNPVATEQYGSVMDDHQTDSQNEI

SEQ ID NO: 74469 - protein, 33 aa, Artificial Sequence
  Description of Artificial Sequence: Synthetic polypeptide
DEEEIRTTNPVATEQYGSVMCTPLQPTLVNVVT

SEQ ID NO: 74470 - protein, 32 aa, Artificial Sequence
  Description of Artificial Sequence: Synthetic polypeptide
DEEEIRTTNPVATEQYGSVLYNCNQNANMNPL

SEQ ID NO: 74471 - protein, 33 aa, Artificial Sequence
  Description of Artificial Sequence: Synthetic polypeptide
DESEIRTTNPVATECYGSVSTINEPEDREGENG

SEQ ID NO: 74472 - protein, 34 aa, Artificial Sequence
  Description of Artificial Sequence: Synthetic polypeptide
DESEIRTTNPVATECYGSVSTCINEPQDREGENV

SEQ ID NO: 74473 - protein, 35 aa, Artificial Sequence
  Description of Artificial Sequence: Synthetic polypeptide
DEEEIRTTNPVATEQYGSVLVSVNLQPRPMVDGLL

SEQ ID NO: 74474 - protein, 34 aa, Artificial Sequence
  Description of Artificial Sequence: Synthetic polypeptide
DESEIRTTNPVATECYGSVSSTPNEPQMRNGENG

SEQ ID NO: 74475 - protein, 32 aa, Artificial Sequence
  Description of Artificial Sequence: Synthetic polypeptide
DESEIRTTNPVATECWGSVSEINEPQREGENK

SEQ ID NO: 74476 - protein, 32 aa, Artificial Sequence
  Description of Artificial Sequence: Synthetic polypeptide
DESEIRTTNPVATECYGSVSCINEPQDREENG

SEQ ID NO: 74477 - protein, 31 aa, Artificial Sequence
  Description of Artificial Sequence: Synthetic polypeptide
DESEIRTTNPVATECYGSVSCICLQDHGEEG

SEQ ID NO: 74478 - protein, 34 aa, Artificial Sequence
  Description of Artificial Sequence: Synthetic polypeptide
AEEEIRTTNPVATEQYGSVVTVNLQQNQEGTNDG

SEQ ID NO: 74479 - protein, 32 aa, Artificial Sequence
  Description of Artificial Sequence: Synthetic polypeptide
DESEIRTTNPVATECYGNVSCINEPQDRVGNG

SEQ ID NO: 74480 - protein, 28 aa, Artificial Sequence
  Description of Artificial Sequence: Synthetic peptide
QEEEIATTNPVATEQYGEAPENLMHEER

SEQ ID NO: 74481 - protein, 33 aa, Artificial Sequence
  Description of Artificial Sequence: Synthetic polypeptide
DEEEIRTTNPVATEQYGSVSTGTMGDTGGNGNE

SEQ ID NO: 74482 - protein, 33 aa, Artificial Sequence
  Description of Artificial Sequence: Synthetic polypeptide
DEEEIRTTNPVATEQYGSVSTGVGDDEGGENNI

SEQ ID NO: 74483 - protein, 33 aa, Artificial Sequence
  Description of Artificial Sequence: Synthetic polypeptide
DESEIRTTNPVATECYGEVSCINLPQDREGEGR

SEQ ID NO: 74484 - protein, 32 aa, Artificial Sequence
  Description of Artificial Sequence: Synthetic polypeptide
DEEEIRTTNPVATEQYGSVSTHGGQSETELVD

SEQ ID NO: 74485 - protein, 32 aa, Artificial Sequence
  Description of Artificial Sequence: Synthetic polypeptide
DEEEIRTTNPVATEQYGSVLSADEQEGQEEIL

SEQ ID NO: 74486 - protein, 33 aa, Artificial Sequence
  Description of Artificial Sequence: Synthetic polypeptide
DEEEIRTTNPVATEQYGSVSTHLNVSDEEENNS

SEQ ID NO: 74487 - protein, 32 aa, Artificial Sequence
  Description of Artificial Sequence: Synthetic polypeptide
DEEEIRTTNPVATEQYGSVLPTNQIVGELSVL

SEQ ID NO: 74488 - protein, 30 aa, Artificial Sequence
  Description of Artificial Sequence: Synthetic polypeptide
DEDEIATTNPVAYEPYGSVATNLQDGGDDV

SEQ ID NO: 74489 - protein, 31 aa, Artificial Sequence
  Description of Artificial Sequence: Synthetic polypeptide
DEDEIATTNPVAYEPYGSVATNLQDDGNNDD

SEQ ID NO: 74490 - protein, 30 aa, Artificial Sequence
  Description of Artificial Sequence: Synthetic polypeptide
DEDEIATTNPVAYEPYGSVAAANDDRGNRP

SEQ ID NO: 74491 - protein, 28 aa, Artificial Sequence
  Description of Artificial Sequence: Synthetic peptide
QEEEIATTNPVATEQYGEAPETCQRGEK

SEQ ID NO: 74492 - protein, 34 aa, Artificial Sequence
  Description of Artificial Sequence: Synthetic polypeptide
AEEEIRTTNPVATEQYGSVVTVANLQNQETGTNM

SEQ ID NO: 74493 - protein, 28 aa, Artificial Sequence
  Description of Artificial Sequence: Synthetic peptide
QEEEIATTNPVATEQYGEAPENCQHEER

SEQ ID NO: 74494 - protein, 33 aa, Artificial Sequence
  Description of Artificial Sequence: Synthetic polypeptide
DEEEIRTTNPVATEQYGSVLSTPLQANSDQEEH

SEQ ID NO: 74495 - protein, 34 aa, Artificial Sequence
  Description of Artificial Sequence: Synthetic polypeptide
DEEEIRTTNPVATEQYGSVSTGTLNGQSNEGQGQ

SEQ ID NO: 74496 - protein, 32 aa, Artificial Sequence
  Description of Artificial Sequence: Synthetic polypeptide
DESEIRTTNPVATECYGNVSCITEPQSRVGNG

SEQ ID NO: 74497 - protein, 32 aa, Artificial Sequence
  Description of Artificial Sequence: Synthetic polypeptide
DESEIRTTNPVATECYGSVSCICEQDREGENG

SEQ ID NO: 74498 - protein, 31 aa, Artificial Sequence
  Description of Artificial Sequence: Synthetic polypeptide
DESEIRTTNPVATECYGSVSCICEQDHGENG

SEQ ID NO: 74499 - protein, 32 aa, Artificial Sequence
  Description of Artificial Sequence: Synthetic polypeptide
DESEIRTTNPVATECYGSVSCENIPQQQEGNH

SEQ ID NO: 74500 - protein, 32 aa, Artificial Sequence
  Description of Artificial Sequence: Synthetic polypeptide
DESEIRTTNPVATECYGSVSCENEPQQQEGNH

SEQ ID NO: 74501 - protein, 34 aa, Artificial Sequence
  Description of Artificial Sequence: Synthetic polypeptide
DEEEIRTTNPVATEQYGSVSTGNQGDDEGGEGNN

SEQ ID NO: 74502 - protein, 34 aa, Artificial Sequence
  Description of Artificial Sequence: Synthetic polypeptide
DEEEIRTTNPVATEQYGSVSTGNQGIDGQGNEQD

SEQ ID NO: 74503 - protein, 35 aa, Artificial Sequence
  Description of Artificial Sequence: Synthetic polypeptide
DESEIRTTNPVATECYGSVSATINLPQDREGENDG

SEQ ID NO: 74504 - protein, 30 aa, Artificial Sequence
  Description of Artificial Sequence: Synthetic polypeptide
DEDEIATTNPVAYEQWGETSTNLQRGDESE

SEQ ID NO: 74505 - protein, 30 aa, Artificial Sequence
  Description of Artificial Sequence: Synthetic polypeptide
DEDEIATTNPVAYEQWGETSTNLQGDGDNS

SEQ ID NO: 74506 - protein, 32 aa, Artificial Sequence
  Description of Artificial Sequence: Synthetic polypeptide
DEEEIRTTNPVATEQYGSVLSSNESEVTNLQD

SEQ ID NO: 74507 - protein, 33 aa, Artificial Sequence
  Description of Artificial Sequence: Synthetic polypeptide
DESEIRTTNPVATECYGSTVSCTNQSQEETGND

SEQ ID NO: 74508 - protein, 32 aa, Artificial Sequence
  Description of Artificial Sequence: Synthetic polypeptide
DESEIRTTNPVATECYGSISCENEPQDREGNH

SEQ ID NO: 74509 - protein, 32 aa, Artificial Sequence
  Description of Artificial Sequence: Synthetic polypeptide
DESEIRTTNPVATECYGNVSNITEPQSRVGNG

SEQ ID NO: 74510 - protein, 34 aa, Artificial Sequence
  Description of Artificial Sequence: Synthetic polypeptide
DEEEIRTTNPVATEQYGSVSTGTGQSDEGGGNQG

SEQ ID NO: 74511 - protein, 35 aa, Artificial Sequence
  Description of Artificial Sequence: Synthetic polypeptide
DEEEIRTTNPVATEQYGSVSTGTLNGQSNEGENQD

SEQ ID NO: 74512 - protein, 32 aa, Artificial Sequence
  Description of Artificial Sequence: Synthetic polypeptide
DESEIRTTNPVATECYGNVSCITEPQDRVGNG

SEQ ID NO: 74513 - protein, 32 aa, Artificial Sequence
  Description of Artificial Sequence: Synthetic polypeptide
DESEIRTTNPVATECWGSVSEINEPQREGENG

SEQ ID NO: 74514 - protein, 33 aa, Artificial Sequence
  Description of Artificial Sequence: Synthetic polypeptide
DESEIRTTNPVATECWGSVSEINEPQDREGENR

SEQ ID NO: 74515 - protein, 34 aa, Artificial Sequence
  Description of Artificial Sequence: Synthetic polypeptide
DEEEIRTTNPVATEQYGSVSTMDLIQQGEGGGQE

SEQ ID NO: 74516 - protein, 29 aa, Artificial Sequence
  Description of Artificial Sequence: Synthetic peptide
DEDEIATTNPVATEQYGCVATHLAQAPDD

SEQ ID NO: 74517 - protein, 36 aa, Artificial Sequence
  Description of Artificial Sequence: Synthetic polypeptide
DEEEIRTTNPVATEQYGSVISSTVCELEQRVVEINR

SEQ ID NO: 74518 - protein, 29 aa, Artificial Sequence
  Description of Artificial Sequence: Synthetic peptide
DEDEIATTNPVATEQYGCVATGLARPDSD

SEQ ID NO: 74519 - protein, 35 aa, Artificial Sequence
  Description of Artificial Sequence: Synthetic polypeptide
DEEEIRTTNPVATEQYGSVISSTGNGEQDEIGGNG

SEQ ID NO: 74520 - protein, 34 aa, Artificial Sequence
  Description of Artificial Sequence: Synthetic polypeptide
DEEEIRTTNPVATEQYGSVISSTDGDQDQGENIT

SEQ ID NO: 74521 - protein, 33 aa, Artificial Sequence
  Description of Artificial Sequence: Synthetic polypeptide
DEEEIRTTNPVATEQYGSVISSNNVNEGGNVGT

SEQ ID NO: 74522 - protein, 33 aa, Artificial Sequence
  Description of Artificial Sequence: Synthetic polypeptide
DEEEIATTNPVATEQYGCVAATNLQADPGENDH

SEQ ID NO: 74523 - protein, 34 aa, Artificial Sequence
  Description of Artificial Sequence: Synthetic polypeptide
DEEEIRTTNPVATEQYGSVISSEVLQQQQGPPNP

SEQ ID NO: 74524 - protein, 34 aa, Artificial Sequence
  Description of Artificial Sequence: Synthetic polypeptide
DEEEIRTTNPVATEQYGSVISSDNFQQGEGGENG

SEQ ID NO: 74525 - protein, 28 aa, Artificial Sequence
  Description of Artificial Sequence: Synthetic peptide
QEEEIATTNPVATEQYGEASEVCQHEER

SEQ ID NO: 74526 - protein, 32 aa, Artificial Sequence
  Description of Artificial Sequence: Synthetic polypeptide
DESEIRTTNPVATECWGSVSCINLQDHEGENG

SEQ ID NO: 74527 - protein, 33 aa, Artificial Sequence
  Description of Artificial Sequence: Synthetic polypeptide
DESEIRTTNPVATECWGSVSCINLPQDREGNDG

SEQ ID NO: 74528 - protein, 34 aa, Artificial Sequence
  Description of Artificial Sequence: Synthetic polypeptide
DEEEIRTTNPVATEQYGSVISPWNQEQDRELNLL

SEQ ID NO: 74529 - protein, 33 aa, Artificial Sequence
  Description of Artificial Sequence: Synthetic polypeptide
DESEIRTTNPVATECWGSVSCINLPQDREGENG

SEQ ID NO: 74530 - protein, 34 aa, Artificial Sequence
  Description of Artificial Sequence: Synthetic polypeptide
DEEEIRTTNPVATEQYGSVISPTVMGQRGMVQVL

SEQ ID NO: 74531 - protein, 29 aa, Artificial Sequence
  Description of Artificial Sequence: Synthetic peptide
DEDEIATTNPVATEQYGCVATHLEARTDD

SEQ ID NO: 74532 - protein, 28 aa, Artificial Sequence
  Description of Artificial Sequence: Synthetic peptide
QEEEIATTNPVATEQYGEASEVCQREEK

SEQ ID NO: 74533 - protein, 33 aa, Artificial Sequence
  Description of Artificial Sequence: Synthetic polypeptide
DEEEIRTTNPVATEQYGSVISTDDSGQGGDQVL

SEQ ID NO: 74534 - protein, 33 aa, Artificial Sequence
  Description of Artificial Sequence: Synthetic polypeptide
DEEEIATTNPVATEQYGCVAATANLQDGVDNAM

SEQ ID NO: 74535 - protein, 28 aa, Artificial Sequence
  Description of Artificial Sequence: Synthetic peptide
QEEEIATTNPVATEQYGEASDNCQSEEK

SEQ ID NO: 74536 - protein, 33 aa, Artificial Sequence
  Description of Artificial Sequence: Synthetic polypeptide
DEEEIATTNPVATEQYGCVAANGELQDNGDNRM

SEQ ID NO: 74537 - protein, 31 aa, Artificial Sequence
  Description of Artificial Sequence: Synthetic polypeptide
DEDEIATTNPVATEQYGCVATNLQMPDEGAD

SEQ ID NO: 74538 - protein, 29 aa, Artificial Sequence
  Description of Artificial Sequence: Synthetic peptide
QEEEIATTNPVATEQYGEASEEVCQQGNK

SEQ ID NO: 74539 - protein, 31 aa, Artificial Sequence
  Description of Artificial Sequence: Synthetic polypeptide
DEDEIATTNPVATEQYGCVATNLQGAGVDVQ

SEQ ID NO: 74540 - protein, 32 aa, Artificial Sequence
  Description of Artificial Sequence: Synthetic polypeptide
DEDEIATTNPVATEQYGCVATNLERGTPNDQD

SEQ ID NO: 74541 - protein, 28 aa, Artificial Sequence
  Description of Artificial Sequence: Synthetic peptide
QEEEIATTNPVATEQYGEASENCQHEEQ

SEQ ID NO: 74542 - protein, 34 aa, Artificial Sequence
  Description of Artificial Sequence: Synthetic polypeptide
DEEEIRTTNPVATEQYGSVISTGGNLVNEMNNGD

SEQ ID NO: 74543 - protein, 31 aa, Artificial Sequence
  Description of Artificial Sequence: Synthetic polypeptide
DEDEIATTNPVATEQYGCVATNLERGDDTLI

SEQ ID NO: 74544 - protein, 30 aa, Artificial Sequence
  Description of Artificial Sequence: Synthetic polypeptide
DEDEIATTNPVATEQYGCVATNLDRNDTLM

SEQ ID NO: 74545 - protein, 30 aa, Artificial Sequence
  Description of Artificial Sequence: Synthetic polypeptide
DEDEIATTNPVATEQYGCVATNLDPGDIDQ

SEQ ID NO: 74546 - protein, 35 aa, Artificial Sequence
  Description of Artificial Sequence: Synthetic polypeptide
DEEEIRTTNPVATEQYGSVISTDWLGPQRLGDQVE

SEQ ID NO: 74547 - protein, 29 aa, Artificial Sequence
  Description of Artificial Sequence: Synthetic peptide
QEEEIATTNPVATEQYGEASEVCPQRENK

SEQ ID NO: 74548 - protein, 34 aa, Artificial Sequence
  Description of Artificial Sequence: Synthetic polypeptide
DEEEIRTTNPVATEQYGSVISTDNMNIQGEGGFI

SEQ ID NO: 74549 - protein, 34 aa, Artificial Sequence
  Description of Artificial Sequence: Synthetic polypeptide
DEEEIRTTNPVATEQYGSVISTDNGPQDIGDQVL

SEQ ID NO: 74550 - protein, 29 aa, Artificial Sequence
  Description of Artificial Sequence: Synthetic peptide
DEDEIATTNPVATEQYGCVATHLQAPSDK

SEQ ID NO: 74551 - protein, 34 aa, Artificial Sequence
  Description of Artificial Sequence: Synthetic polypeptide
DEEEIRTTNPVATEQYGSVISTMNIGQEGGGGDE

SEQ ID NO: 74552 - protein, 32 aa, Artificial Sequence
  Description of Artificial Sequence: Synthetic polypeptide
DESEIRTTNPVATECWGSVSCINLPMREGENG

SEQ ID NO: 74553 - protein, 32 aa, Artificial Sequence
  Description of Artificial Sequence: Synthetic polypeptide
DEDEIATTNPVATEQYGCVAATNDQDMPGENR

SEQ ID NO: 74554 - protein, 28 aa, Artificial Sequence
  Description of Artificial Sequence: Synthetic peptide
QEEEIATTNPVATEQYGEASTVCQHEEK

SEQ ID NO: 74555 - protein, 34 aa, Artificial Sequence
  Description of Artificial Sequence: Synthetic polypeptide
DEEEIRTTNPVATEQYGSVSTMNGDQIGIGGEFE

SEQ ID NO: 74556 - protein, 35 aa, Artificial Sequence
  Description of Artificial Sequence: Synthetic polypeptide
DEEEIRTTNPVATEQYGSVSTMNGDQVIGIGNEEE

SEQ ID NO: 74557 - protein, 35 aa, Artificial Sequence
  Description of Artificial Sequence: Synthetic polypeptide
DEEEIRTTNPVATEQYGSVISPSNQLEQIPGNVIV

SEQ ID NO: 74558 - protein, 35 aa, Artificial Sequence
  Description of Artificial Sequence: Synthetic polypeptide
DEEEIRTTNPVATEQYGSVISPSNQLEQIGNVHVF

SEQ ID NO: 74559 - protein, 34 aa, Artificial Sequence
  Description of Artificial Sequence: Synthetic polypeptide
DEEEIRTTNPVATEQYGSVSTMNGFGQENIGGGF

SEQ ID NO: 74560 - protein, 34 aa, Artificial Sequence
  Description of Artificial Sequence: Synthetic polypeptide
DEEEIRTTNPVATEQYGSVSTMNGGQEGGEEQVD

SEQ ID NO: 74561 - protein, 33 aa, Artificial Sequence
  Description of Artificial Sequence: Synthetic polypeptide
DEEEIRTTNPVATEQYGSVISPIVLQRNTVDEM

SEQ ID NO: 74562 - protein, 34 aa, Artificial Sequence
  Description of Artificial Sequence: Synthetic polypeptide
DEEEIRTTNPVATEQYGSVSTMNGINQGQGGEGT

SEQ ID NO: 74563 - protein, 35 aa, Artificial Sequence
  Description of Artificial Sequence: Synthetic polypeptide
DEEEIRTTNPVATEQYGSVSTMNGLEDEGQGTNID

SEQ ID NO: 74564 - protein, 30 aa, Artificial Sequence
  Description of Artificial Sequence: Synthetic polypeptide
DESEIRTTNPVATECWGSVSCINEQREEEL

SEQ ID NO: 74565 - protein, 32 aa, Artificial Sequence
  Description of Artificial Sequence: Synthetic polypeptide
DESEIRTTNPVATECWGSVSCINEQNREGENG

SEQ ID NO: 74566 - protein, 31 aa, Artificial Sequence
  Description of Artificial Sequence: Synthetic polypeptide
DESEIRTTNPVATECWGSVSCINEQDREGGG

SEQ ID NO: 74567 - protein, 32 aa, Artificial Sequence
  Description of Artificial Sequence: Synthetic polypeptide
DESEIRTTNPVATECWGSVSCINEQDREGENL

SEQ ID NO: 74568 - protein, 32 aa, Artificial Sequence
  Description of Artificial Sequence: Synthetic polypeptide
DESEIRTTNPVATECWGSVSCINEQDREGENG

SEQ ID NO: 74569 - protein, 30 aa, Artificial Sequence
  Description of Artificial Sequence: Synthetic polypeptide
DEDEIATTNPVATEQYGCTATNLQGAGDTS

SEQ ID NO: 74570 - protein, 34 aa, Artificial Sequence
  Description of Artificial Sequence: Synthetic polypeptide
DEEEIRTTNPVATEQYGSVISPTTYLQPIGVSEQ

SEQ ID NO: 74571 - protein, 35 aa, Artificial Sequence
  Description of Artificial Sequence: Synthetic polypeptide
DEEEIRTTNPVATEQYGSVSTMNGDDQPENGINEQ

SEQ ID NO: 74572 - protein, 30 aa, Artificial Sequence
  Description of Artificial Sequence: Synthetic polypeptide
DEDEIATTNPVATEQYGCTATNLQMGDTSM

SEQ ID NO: 74573 - protein, 31 aa, Artificial Sequence
  Description of Artificial Sequence: Synthetic polypeptide
DEEEIATTNPVATEQYGCVADTWLAQNSDND

SEQ ID NO: 74574 - protein, 34 aa, Artificial Sequence
  Description of Artificial Sequence: Synthetic polypeptide
DEEEIRTTNPVATEQYGSVSTMNDLGVNGQETGD

SEQ ID NO: 74575 - protein, 34 aa, Artificial Sequence
  Description of Artificial Sequence: Synthetic polypeptide
DEEEIRTTNPVATEQYGSVSTMNDLIQFVTESGS

SEQ ID NO: 74576 - protein, 31 aa, Artificial Sequence
  Description of Artificial Sequence: Synthetic polypeptide
DEDEIATTNPVATEQYGCVAATANLMMDGNQ

SEQ ID NO: 74577 - protein, 28 aa, Artificial Sequence
  Description of Artificial Sequence: Synthetic peptide
QEEEIATTNPVATEQYGEASEVLQHEEL

SEQ ID NO: 74578 - protein, 35 aa, Artificial Sequence
  Description of Artificial Sequence: Synthetic polypeptide
DEEEIRTTNPVATEQYGSVISPTNNLGVQEVTNNV

SEQ ID NO: 74579 - protein, 34 aa, Artificial Sequence
  Description of Artificial Sequence: Synthetic polypeptide
AEEEIRTTNPVATEQYGSVVTVANLNNQEGENVE

SEQ ID NO: 74580 - protein, 32 aa, Artificial Sequence
  Description of Artificial Sequence: Synthetic polypeptide
DEEEIATTNPVATEQYGCVAGTNQLQNDMGGM

SEQ ID NO: 74581 - protein, 33 aa, Artificial Sequence
  Description of Artificial Sequence: Synthetic polypeptide
DEEEIATTNPVATEQYGCVAGTNQLQNRMTGLT

SEQ ID NO: 74582 - protein, 32 aa, Artificial Sequence
  Description of Artificial Sequence: Synthetic polypeptide
DEDEIATTNPVATEQYGCVAATALQREGNESD

SEQ ID NO: 74583 - protein, 33 aa, Artificial Sequence
  Description of Artificial Sequence: Synthetic polypeptide
DEEEIRTTNPVATEQYGSVSTMNDMQQSTIAPS

SEQ ID NO: 74584 - protein, 30 aa, Artificial Sequence
  Description of Artificial Sequence: Synthetic polypeptide
DEEEIATTNPVATEQYGCVAPNDQADDPNN

SEQ ID NO: 74585 - protein, 32 aa, Artificial Sequence
  Description of Artificial Sequence: Synthetic polypeptide
DEEEIATTNPVATEQYGCVATNLTRNGDTTSG

SEQ ID NO: 74586 - protein, 30 aa, Artificial Sequence
  Description of Artificial Sequence: Synthetic polypeptide
DEDEIATTNPVATEQYGCTATNLQQGHDSL

SEQ ID NO: 74587 - protein, 28 aa, Artificial Sequence
  Description of Artificial Sequence: Synthetic peptide
QEEEIATTNPVATEQYGEASTDCQHEEK

SEQ ID NO: 74588 - protein, 29 aa, Artificial Sequence
  Description of Artificial Sequence: Synthetic peptide
DEDEIATTNPVATEQYGCTATNLQGPDQM

SEQ ID NO: 74589 - protein, 35 aa, Artificial Sequence
  Description of Artificial Sequence: Synthetic polypeptide
DEEEIRTTNPVATEQYGSVSTMNGLGEGQGEQNIS

SEQ ID NO: 74590 - protein, 28 aa, Artificial Sequence
  Description of Artificial Sequence: Synthetic peptide
QEEEIATTNPVATEQYGEASDNCQHEEQ

SEQ ID NO: 74591 - protein, 33 aa, Artificial Sequence
  Description of Artificial Sequence: Synthetic polypeptide
DEEEIRTTNPVATEQYGSVISTMNSNSNGGTTQ

SEQ ID NO: 74592 - protein, 31 aa, Artificial Sequence
  Description of Artificial Sequence: Synthetic polypeptide
DESEIRTTNPVATECWGSVSCNEPQHEGENG

SEQ ID NO: 74593 - protein, 34 aa, Artificial Sequence
  Description of Artificial Sequence: Synthetic polypeptide
DEEEIRTTNPVATEQYGSVISVWNLEQEDGELTS

SEQ ID NO: 74594 - protein, 33 aa, Artificial Sequence
  Description of Artificial Sequence: Synthetic polypeptide
DEEEIRTTNPVATEQYGSVISVVELQSQQENPT

SEQ ID NO: 74595 - protein, 33 aa, Artificial Sequence
  Description of Artificial Sequence: Synthetic polypeptide
DEEEIRTTNPVATEQYGSVISVVELPRQGEVPT

SEQ ID NO: 74596 - protein, 32 aa, Artificial Sequence
  Description of Artificial Sequence: Synthetic polypeptide
DESEIRTTNPVATECWGSVSCNEPQDREGENL

SEQ ID NO: 74597 - protein, 32 aa, Artificial Sequence
  Description of Artificial Sequence: Synthetic polypeptide
DEDEIATTNPVATEQYGSVCAANLQDTDGNQN

SEQ ID NO: 74598 - protein, 32 aa, Artificial Sequence
  Description of Artificial Sequence: Synthetic polypeptide
DESEIRTTNPVATECWGSVSCNEPQDREGENG

SEQ ID NO: 74599 - protein, 32 aa, Artificial Sequence
  Description of Artificial Sequence: Synthetic polypeptide
DESEIRTTNPVATECWGSVSCNEPQDREGANG

SEQ ID NO: 74600 - protein, 31 aa, Artificial Sequence
  Description of Artificial Sequence: Synthetic polypeptide
DEEEIATTNPVATEQWGSVSHYNAQVPEGSV

SEQ ID NO: 74601 - protein, 34 aa, Artificial Sequence
  Description of Artificial Sequence: Synthetic polypeptide
DEEEIRTTNPVATEQYGSVSTMGLSDNGGGQNGT

SEQ ID NO: 74602 - protein, 31 aa, Artificial Sequence
  Description of Artificial Sequence: Synthetic polypeptide
DEEEIATTNPVATEQWGSVSMAGNGGQAGPF

SEQ ID NO: 74603 - protein, 33 aa, Artificial Sequence
  Description of Artificial Sequence: Synthetic polypeptide
DESEIRTTNPVATECWGSVSCKNEPQDREGENR

SEQ ID NO: 74604 - protein, 30 aa, Artificial Sequence
  Description of Artificial Sequence: Synthetic polypeptide
DEDEIATTNPVATEQYGSVATPDQRTPQEN

SEQ ID NO: 74605 - protein, 30 aa, Artificial Sequence
  Description of Artificial Sequence: Synthetic polypeptide
DEDEIATTNPVATEQYGSVATNNDEGTPEE

SEQ ID NO: 74606 - protein, 32 aa, Artificial Sequence
  Description of Artificial Sequence: Synthetic polypeptide
DEEEIRTTNPVATEQYGSVSTMGMEISGTTQV

SEQ ID NO: 74607 - protein, 32 aa, Artificial Sequence
  Description of Artificial Sequence: Synthetic polypeptide
DEEEIRTTNPVATEQYGSVISWDLEHNGSQFE

SEQ ID NO: 74608 - protein, 31 aa, Artificial Sequence
  Description of Artificial Sequence: Synthetic polypeptide
DEDEIATTNPVATEQYGSVATNLTETGGEEA

SEQ ID NO: 74609 - protein, 32 aa, Artificial Sequence
  Description of Artificial Sequence: Synthetic polypeptide
DEEEIATTNPVATEQWGSVSGTGPPQDDGNDH

SEQ ID NO: 74610 - protein, 34 aa, Artificial Sequence
  Description of Artificial Sequence: Synthetic polypeptide
DEEEIRTTNPVATEQYGSVSTMGIPDQDEGENQV

SEQ ID NO: 74611 - protein, 31 aa, Artificial Sequence
  Description of Artificial Sequence: Synthetic polypeptide
DESEIRTTNPVATECWGSVSEIIEQDRAGNA

SEQ ID NO: 74612 - protein, 33 aa, Artificial Sequence
  Description of Artificial Sequence: Synthetic polypeptide
DEEEIRTTNPVATEQYGSVSTMDMMHQQSGQIN

SEQ ID NO: 74613 - protein, 33 aa, Artificial Sequence
  Description of Artificial Sequence: Synthetic polypeptide
DEEEIRTTNPVATEQYGSVSTMDMMHQRSTQID

SEQ ID NO: 74614 - protein, 34 aa, Artificial Sequence
  Description of Artificial Sequence: Synthetic polypeptide
DEEEIRTTNPVATEQYGSVSTMDNLVNAEGQTGT

SEQ ID NO: 74615 - protein, 33 aa, Artificial Sequence
  Description of Artificial Sequence: Synthetic polypeptide
DESEIRTTNPVATECWGSVSCTNEPQDRHGENG

SEQ ID NO: 74616 - protein, 33 aa, Artificial Sequence
  Description of Artificial Sequence: Synthetic polypeptide
DESEIRTTNPVATECWGSVSCTNEPQDREGENG

SEQ ID NO: 74617 - protein, 33 aa, Artificial Sequence
  Description of Artificial Sequence: Synthetic polypeptide
DESEIRTTNPVATECWGSVSCTNEPQDRCGENG

SEQ ID NO: 74618 - protein, 33 aa, Artificial Sequence
  Description of Artificial Sequence: Synthetic polypeptide
DEEEIRTTNPVATEQYGSVSTMELDVNNDGGGT

SEQ ID NO: 74619 - protein, 32 aa, Artificial Sequence
  Description of Artificial Sequence: Synthetic polypeptide
DEEEIRTTNPVATEQYGSVITLVGMGNGNNGE

SEQ ID NO: 74620 - protein, 35 aa, Artificial Sequence
  Description of Artificial Sequence: Synthetic polypeptide
DEEEIRTTNPVATEQYGSVSTMELGQNGQGENDGE

SEQ ID NO: 74621 - protein, 28 aa, Artificial Sequence
  Description of Artificial Sequence: Synthetic peptide
QEEEIATTNPVATEQYGEAPEVLQHENK

SEQ ID NO: 74622 - protein, 28 aa, Artificial Sequence
  Description of Artificial Sequence: Synthetic peptide
QEEEIATTNPVATEQYGEAPEVLQHGEK

SEQ ID NO: 74623 - protein, 28 aa, Artificial Sequence
  Description of Artificial Sequence: Synthetic peptide
QEEEIATTNPVATEQYGEAPEVLQHGTK

SEQ ID NO: 74624 - protein, 28 aa, Artificial Sequence
  Description of Artificial Sequence: Synthetic peptide
QEEEIATTNPVATEQYGEAPEVLQSENK

SEQ ID NO: 74625 - protein, 31 aa, Artificial Sequence
  Description of Artificial Sequence: Synthetic polypeptide
DEDEIATTNPVATEQYGSVCAANNLQDSDNT

SEQ ID NO: 74626 - protein, 31 aa, Artificial Sequence
  Description of Artificial Sequence: Synthetic polypeptide
DESEIRTTNPVATECWGSVSCNEPQNREGDG

SEQ ID NO: 74627 - protein, 33 aa, Artificial Sequence
  Description of Artificial Sequence: Synthetic polypeptide
DEEEIRTTNPVATEQYGSVISTMNSNSNGGEGT

SEQ ID NO: 74628 - protein, 31 aa, Artificial Sequence
  Description of Artificial Sequence: Synthetic polypeptide
DEDEIATTNPVATEQYGSVATNLTEGGDGDL

SEQ ID NO: 74629 - protein, 32 aa, Artificial Sequence
  Description of Artificial Sequence: Synthetic polypeptide
DEEEIRTTNPVATEQYGSVISTVDIGSVMEER

SEQ ID NO: 74630 - protein, 33 aa, Artificial Sequence
  Description of Artificial Sequence: Synthetic polypeptide
DEEEIRTTNPVATEQYGSVSTMLGEIETPGQLE

SEQ ID NO: 74631 - protein, 32 aa, Artificial Sequence
  Description of Artificial Sequence: Synthetic polypeptide
DESEIRTTNPVATECWGSVSCITEPQREGENG

SEQ ID NO: 74632 - protein, 32 aa, Artificial Sequence
  Description of Artificial Sequence: Synthetic polypeptide
DEDEIATTNPVATEQYGSVAITNDETRNGNPS

SEQ ID NO: 74633 - protein, 30 aa, Artificial Sequence
  Description of Artificial Sequence: Synthetic polypeptide
DEEEIATTNPVATEQWGTNCSAALLARGNS

SEQ ID NO: 74634 - protein, 28 aa, Artificial Sequence
  Description of Artificial Sequence: Synthetic peptide
QEEEIATTNPVATEQYGEAPSTCQHGEK

SEQ ID NO: 74635 - protein, 30 aa, Artificial Sequence
  Description of Artificial Sequence: Synthetic polypeptide
DEEEIATTNPVATEQWGTSCSAALLNGNDS

SEQ ID NO: 74636 - protein, 32 aa, Artificial Sequence
  Description of Artificial Sequence: Synthetic polypeptide
DEDEIATTNPVATEQYGSVAATENLAGPGETR

SEQ ID NO: 74637 - protein, 30 aa, Artificial Sequence
  Description of Artificial Sequence: Synthetic polypeptide
DEDEIATTNPVATEQYGSVAATANLMDQGT

SEQ ID NO: 74638 - protein, 30 aa, Artificial Sequence
  Description of Artificial Sequence: Synthetic polypeptide
DEDEIATTNPVATEQYGSVAATANGNMPNN

SEQ ID NO: 74639 - protein, 31 aa, Artificial Sequence
  Description of Artificial Sequence: Synthetic polypeptide
DEDEIATTNPVATEQYGSVAANDQRGPPDQA

SEQ ID NO: 74640 - protein, 32 aa, Artificial Sequence
  Description of Artificial Sequence: Synthetic polypeptide
DEDEIATTNPVATEQYGSTVSPINPGRQGWNE

SEQ ID NO: 74641 - protein, 32 aa, Artificial Sequence
  Description of Artificial Sequence: Synthetic polypeptide
DEDEIATTNPVATEQYGSCSGTGNPQLEEGGR

SEQ ID NO: 74642 - protein, 34 aa, Artificial Sequence
  Description of Artificial Sequence: Synthetic polypeptide
DEEEIRTTNPVATEQYGSVSTMLQFQREEIEDEY

SEQ ID NO: 74643 - protein, 35 aa, Artificial Sequence
  Description of Artificial Sequence: Synthetic polypeptide
DEEEIRTTNPVATEQYGSVISTNDYLNQETQNDEQ

SEQ ID NO: 74644 - protein, 28 aa, Artificial Sequence
  Description of Artificial Sequence: Synthetic peptide
QEEEIATTNPVATEQYGEASCVCQHENK

SEQ ID NO: 74645 - protein, 34 aa, Artificial Sequence
  Description of Artificial Sequence: Synthetic polypeptide
DEEEIATTNPVATEQWGSVSVSGNLGQTRGVNEI

SEQ ID NO: 74646 - protein, 34 aa, Artificial Sequence
  Description of Artificial Sequence: Synthetic polypeptide
DEEEIRTTNPVATEQYGSVISTVDYLQETQNSVQ

SEQ ID NO: 74647 - protein, 32 aa, Artificial Sequence
  Description of Artificial Sequence: Synthetic polypeptide
DEDEIATTNPVATEQYGSVATGLTPGNQEGNN

SEQ ID NO: 74648 - protein, 31 aa, Artificial Sequence
  Description of Artificial Sequence: Synthetic polypeptide
DEDEIATTNPVATEQYGSVATNLEDNPEGAE

SEQ ID NO: 74649 - protein, 34 aa, Artificial Sequence
  Description of Artificial Sequence: Synthetic polypeptide
DEEEIRTTNPVATEQYGSVSTMHNLEHDSGQIDM

SEQ ID NO: 74650 - protein, 32 aa, Artificial Sequence
  Description of Artificial Sequence: Synthetic polypeptide
DEDEIATTNPVATEQYGSVATNLQAAATPGEN

SEQ ID NO: 74651 - protein, 31 aa, Artificial Sequence
  Description of Artificial Sequence: Synthetic polypeptide
DEEEIATTNPVATEQWGSVSMSGNLEQDVDM

SEQ ID NO: 74652 - protein, 32 aa, Artificial Sequence
  Description of Artificial Sequence: Synthetic polypeptide
DEEEIATTNPVATEQWGSVSMSGNLQEGVGEN

SEQ ID NO: 74653 - protein, 33 aa, Artificial Sequence
  Description of Artificial Sequence: Synthetic polypeptide
DEEEIATTNPVATEQWGSVSMSGNTQRGVNEIV

SEQ ID NO: 74654 - protein, 32 aa, Artificial Sequence
  Description of Artificial Sequence: Synthetic polypeptide
DEEEIATTNPVATEQWGSVSPGNPQEAGNDQT

SEQ ID NO: 74655 - protein, 34 aa, Artificial Sequence
  Description of Artificial Sequence: Synthetic polypeptide
DEEEIRTTNPVATEQYGSVISTTANQDGETGNGE

SEQ ID NO: 74656 - protein, 34 aa, Artificial Sequence
  Description of Artificial Sequence: Synthetic polypeptide
DEEEIRTTNPVATEQYGSVISTTANQDGEGNTGQ

SEQ ID NO: 74657 - protein, 34 aa, Artificial Sequence
  Description of Artificial Sequence: Synthetic polypeptide
DEEEIRTTNPVATEQYGSVISTTANQDGEGENEG

SEQ ID NO: 74658 - protein, 35 aa, Artificial Sequence
  Description of Artificial Sequence: Synthetic polypeptide
DEEEIRTTNPVATEQYGSVISTSNNLIIEDGDNID

SEQ ID NO: 74659 - protein, 33 aa, Artificial Sequence
  Description of Artificial Sequence: Synthetic polypeptide
DEEEIRTTNPVATEQYGSVISTSNENDTGGGGT

SEQ ID NO: 74660 - protein, 33 aa, Artificial Sequence
  Description of Artificial Sequence: Synthetic polypeptide
DEEEIRTTNPVATEQYGSVSTMLDSIESDQENF

SEQ ID NO: 74661 - protein, 35 aa, Artificial Sequence
  Description of Artificial Sequence: Synthetic polypeptide
DEEEIRTTNPVATEQYGSVISTQNIGQSGGGNQEE

SEQ ID NO: 74662 - protein, 30 aa, Artificial Sequence
  Description of Artificial Sequence: Synthetic polypeptide
DEEEIATTNPVATEQWGSVSTGNNDNQPDQ

SEQ ID NO: 74663 - protein, 32 aa, Artificial Sequence
  Description of Artificial Sequence: Synthetic polypeptide
DEDEIATTNPVATEQYGSVATNLENRDGDTLI

SEQ ID NO: 74664 - protein, 30 aa, Artificial Sequence
  Description of Artificial Sequence: Synthetic polypeptide
DEDEIATTNPVATEQYGSVATNDTAGDSDT

SEQ ID NO: 74665 - protein, 33 aa, Artificial Sequence
  Description of Artificial Sequence: Synthetic polypeptide
ATEEIRTTNPVATECYGSVSTKNDPQQRQGNLD

SEQ ID NO: 74666 - protein, 33 aa, Artificial Sequence
  Description of Artificial Sequence: Synthetic polypeptide
DEEEIATTNPCATEQYGCVCPTNLQERGSNNQA

SEQ ID NO: 74667 - protein, 35 aa, Artificial Sequence
  Description of Artificial Sequence: Synthetic polypeptide
DESEIRTTNPVAWEQYGKVPSCTGNLQRTGTNNRM

SEQ ID NO: 74668 - protein, 30 aa, Artificial Sequence
  Description of Artificial Sequence: Synthetic polypeptide
AEQEIATTNPVATEQYGSASAEDLEDRGER

SEQ ID NO: 74669 - protein, 30 aa, Artificial Sequence
  Description of Artificial Sequence: Synthetic polypeptide
NEEEIACTNPVATEPYGNVATNLQDGNELY

SEQ ID NO: 74670 - protein, 34 aa, Artificial Sequence
  Description of Artificial Sequence: Synthetic polypeptide
DEEEIRTTNPVATEQYGSVQPTDTLQETLMENRT

SEQ ID NO: 74671 - protein, 30 aa, Artificial Sequence
  Description of Artificial Sequence: Synthetic polypeptide
NEEEIACTNPVATEQWGSVATNLERGDTDI

SEQ ID NO: 74672 - protein, 33 aa, Artificial Sequence
  Description of Artificial Sequence: Synthetic polypeptide
DETEIRTTNPVATEQYGMSISTNTQPREGLLDE

SEQ ID NO: 74673 - protein, 32 aa, Artificial Sequence
  Description of Artificial Sequence: Synthetic polypeptide
DETEIRTTNPVATEQYGMSIISTNTEREGLDE

SEQ ID NO: 74674 - protein, 30 aa, Artificial Sequence
  Description of Artificial Sequence: Synthetic polypeptide
AEQEIATTNPVATEQYGEASENLQDHGGDR

SEQ ID NO: 74675 - protein, 34 aa, Artificial Sequence
  Description of Artificial Sequence: Synthetic polypeptide
DEEEIRTTNPVATEQYGSVSSTTPAGPNMHNGNV

SEQ ID NO: 74676 - protein, 30 aa, Artificial Sequence
  Description of Artificial Sequence: Synthetic polypeptide
NEEEIACTNPVATEQYGCVATNLQVDGDHE

SEQ ID NO: 74677 - protein, 31 aa, Artificial Sequence
  Description of Artificial Sequence: Synthetic polypeptide
AEQEIATTNPVATEQYGSVSATDLEDREGEL

SEQ ID NO: 74678 - protein, 31 aa, Artificial Sequence
  Description of Artificial Sequence: Synthetic polypeptide
NEEEIACTNPVATEQYGSVAANLQEAGNEEG

SEQ ID NO: 74679 - protein, 31 aa, Artificial Sequence
  Description of Artificial Sequence: Synthetic polypeptide
NEEEIACTNPVATEQYGSVATNLQAEDDTRT

SEQ ID NO: 74680 - protein, 34 aa, Artificial Sequence
  Description of Artificial Sequence: Synthetic polypeptide
DETEIRTTNPVATEQYGCHIVNTNSLDRMGINRI

SEQ ID NO: 74681 - protein, 34 aa, Artificial Sequence
  Description of Artificial Sequence: Synthetic polypeptide
AEEEIRTTNPVATEQYGVVSTNNNLGQEQGTNSN

SEQ ID NO: 74682 - protein, 31 aa, Artificial Sequence
  Description of Artificial Sequence: Synthetic polypeptide
NEEEIACTNPVATEQYGCVATNLQAEAEGNH

SEQ ID NO: 74683 - protein, 31 aa, Artificial Sequence
  Description of Artificial Sequence: Synthetic polypeptide
NEEEIACTNPVATEMYGSVATNLQEAGNMPA

SEQ ID NO: 74684 - protein, 32 aa, Artificial Sequence
  Description of Artificial Sequence: Synthetic polypeptide
DEEEIRTTNPVATEQYGSVQPTMLEVEDGLIN

SEQ ID NO: 74685 - protein, 31 aa, Artificial Sequence
  Description of Artificial Sequence: Synthetic polypeptide
NEEEIACTNPVATEMYGSVATNLQEAGNDPE

SEQ ID NO: 74686 - protein, 29 aa, Artificial Sequence
  Description of Artificial Sequence: Synthetic peptide
AEQEIACTNPVATEQYGSASTNLEHGGDL

SEQ ID NO: 74687 - protein, 29 aa, Artificial Sequence
  Description of Artificial Sequence: Synthetic peptide
AEQEIACTNPVATEQYGSVSTDLEDHGEL

SEQ ID NO: 74688 - protein, 32 aa, Artificial Sequence
  Description of Artificial Sequence: Synthetic polypeptide
DEEEIACTNPVATEQYGCVSMTNDFQGFGSNQ

SEQ ID NO: 74689 - protein, 34 aa, Artificial Sequence
  Description of Artificial Sequence: Synthetic polypeptide
DEEEIRTTNPVATEQYGSVQPTVLDQEIEQGNIL

SEQ ID NO: 74690 - protein, 32 aa, Artificial Sequence
  Description of Artificial Sequence: Synthetic polypeptide
DEEEIACTNPVATEQYGCVSTNLQAEDPNESE

SEQ ID NO: 74691 - protein, 34 aa, Artificial Sequence
  Description of Artificial Sequence: Synthetic polypeptide
AEEEIRTTNPVATEQYGVVSTSTNLQQIGNNNGE

SEQ ID NO: 74692 - protein, 29 aa, Artificial Sequence
  Description of Artificial Sequence: Synthetic peptide
AEQEIACTNPVATEQYGSVSTDLEHGGDL

SEQ ID NO: 74693 - protein, 33 aa, Artificial Sequence
  Description of Artificial Sequence: Synthetic polypeptide
NEDEIRTTNPVAYEQWGSVFKTDNLDQRGENYR

SEQ ID NO: 74694 - protein, 34 aa, Artificial Sequence
  Description of Artificial Sequence: Synthetic polypeptide
DEEEIRTTNPVATEQYGSVQPTNNEQNRVTEMER

SEQ ID NO: 74695 - protein, 33 aa, Artificial Sequence
  Description of Artificial Sequence: Synthetic polypeptide
NEEAEIATTNPVAYEQWGSVSTNLQGEDGDNER

SEQ ID NO: 74696 - protein, 30 aa, Artificial Sequence
  Description of Artificial Sequence: Synthetic polypeptide
AEQEIACTNPVATEQYGVASANLQRMGGDR

SEQ ID NO: 74697 - protein, 28 aa, Artificial Sequence
  Description of Artificial Sequence: Synthetic peptide
AEQEIACTNPVAYEQWGEASENLQRGGR

SEQ ID NO: 74698 - protein, 34 aa, Artificial Sequence
  Description of Artificial Sequence: Synthetic polypeptide
DEEEIRTTNPVATEQYGSVQPTNLPELRGQVVET

SEQ ID NO: 74699 - protein, 34 aa, Artificial Sequence
  Description of Artificial Sequence: Synthetic polypeptide
DEEEIRTTNPVATEQYGSVSSTTPAGPNMANGNV

SEQ ID NO: 74700 - protein, 31 aa, Artificial Sequence
  Description of Artificial Sequence: Synthetic polypeptide
NEEEIACTNPVATEGYGSVATNLQEAGNDFL

SEQ ID NO: 74701 - protein, 33 aa, Artificial Sequence
  Description of Artificial Sequence: Synthetic polypeptide
AEEEIRTTNPVATEQYGVVSTNNLQQDTTNVAT

SEQ ID NO: 74702 - protein, 35 aa, Artificial Sequence
  Description of Artificial Sequence: Synthetic polypeptide
DETEIRTTNPVATEQWGSVSCTGENSSQDRAGNNR

SEQ ID NO: 74703 - protein, 31 aa, Artificial Sequence
  Description of Artificial Sequence: Synthetic polypeptide
NEEEIACTNPVATEQYGSVATNLQDGAGSAV

SEQ ID NO: 74704 - protein, 31 aa, Artificial Sequence
  Description of Artificial Sequence: Synthetic polypeptide
NEEEIACTNPVATEQYGSVATNLQDSDGEGN

SEQ ID NO: 74705 - protein, 32 aa, Artificial Sequence
  Description of Artificial Sequence: Synthetic polypeptide
NEEEIATTNPVATEMWGSVAANLQERPGENRN

SEQ ID NO: 74706 - protein, 28 aa, Artificial Sequence
  Description of Artificial Sequence: Synthetic peptide
AEREIASVNPVCTEQYGVVSDNLQSGNQ

SEQ ID NO: 74707 - protein, 31 aa, Artificial Sequence
  Description of Artificial Sequence: Synthetic polypeptide
DETEIRTTNPVATECYGSVATNPQGNGQDDA

SEQ ID NO: 74708 - protein, 29 aa, Artificial Sequence
  Description of Artificial Sequence: Synthetic peptide
DETEIRTTNPVATECYGDVAECLQEHGPL

SEQ ID NO: 74709 - protein, 31 aa, Artificial Sequence
  Description of Artificial Sequence: Synthetic polypeptide
NEEEIATTNPVATEQWGSVSQGNPQTAGNEN

SEQ ID NO: 74710 - protein, 32 aa, Artificial Sequence
  Description of Artificial Sequence: Synthetic polypeptide
DETEIRTTNPVATECWGSVSCINEPQDREGNG

SEQ ID NO: 74711 - protein, 33 aa, Artificial Sequence
  Description of Artificial Sequence: Synthetic polypeptide
DETEIRTTNPVATECWGSVSCINELQDREGENG

SEQ ID NO: 74712 - protein, 31 aa, Artificial Sequence
  Description of Artificial Sequence: Synthetic polypeptide
DETEIRTTNPVATECWGSVACINEQDRKGNG

SEQ ID NO: 74713 - protein, 31 aa, Artificial Sequence
  Description of Artificial Sequence: Synthetic polypeptide
DETEIRTTNPVATECWGSVACINEQDREGNG

SEQ ID NO: 74714 - protein, 28 aa, Artificial Sequence
  Description of Artificial Sequence: Synthetic peptide
DETEIRTTNPVATECWGAVSACLAPGEL

SEQ ID NO: 74715 - protein, 34 aa, Artificial Sequence
  Description of Artificial Sequence: Synthetic polypeptide
DEEEIRTTNPVATEQYGSVQLTNSLDQTANPAAN

SEQ ID NO: 74716 - protein, 28 aa, Artificial Sequence
  Description of Artificial Sequence: Synthetic peptide
DETEIRTTNPVATECWGAVSACLAPGEI

SEQ ID NO: 74717 - protein, 33 aa, Artificial Sequence
  Description of Artificial Sequence: Synthetic polypeptide
NEEEIATTNPVATEQYGNVSHTMNDTQGNGGNR

SEQ ID NO: 74718 - protein, 33 aa, Artificial Sequence
  Description of Artificial Sequence: Synthetic polypeptide
DETEIRTTNPVATDQYGSVNTMQLQRQGQNADE

SEQ ID NO: 74719 - protein, 31 aa, Artificial Sequence
  Description of Artificial Sequence: Synthetic polypeptide
NEEEIATTNPVATEQYGSCATHLQPDQGDRT

SEQ ID NO: 74720 - protein, 31 aa, Artificial Sequence
  Description of Artificial Sequence: Synthetic polypeptide
NEEEIATTNPVATEAYGKVPSCTNLSQEGEL

SEQ ID NO: 74721 - protein, 32 aa, Artificial Sequence
  Description of Artificial Sequence: Synthetic polypeptide
NEDEIRTTNPVATEQYGSVDTNLQNIGGQGGI

SEQ ID NO: 74722 - protein, 34 aa, Artificial Sequence
  Description of Artificial Sequence: Synthetic polypeptide
DEEEIRTTNPVATEQYGSVSSTTPAGPNMRGNPV

SEQ ID NO: 74723 - protein, 35 aa, Artificial Sequence
  Description of Artificial Sequence: Synthetic polypeptide
DEEEIRTTNPVATEQYGSVSSTTPAGPNMRGMNPR

SEQ ID NO: 74724 - protein, 34 aa, Artificial Sequence
  Description of Artificial Sequence: Synthetic polypeptide
DETEIRTTNPVATEPYGSVCSTNEISQRTGGSRE

SEQ ID NO: 74725 - protein, 32 aa, Artificial Sequence
  Description of Artificial Sequence: Synthetic polypeptide
NEEEIACTNPVATEQYGSVATNLQEAPGNPEE

SEQ ID NO: 74726 - protein, 31 aa, Artificial Sequence
  Description of Artificial Sequence: Synthetic polypeptide
AEEEIRTTNPVATEQYGVVCSSELQNFGSEQ

SEQ ID NO: 74727 - protein, 34 aa, Artificial Sequence
  Description of Artificial Sequence: Synthetic polypeptide
AEEEIRTTNPVATEQYGVSVSCDNLSQNRFTNAM

SEQ ID NO: 74728 - protein, 30 aa, Artificial Sequence
  Description of Artificial Sequence: Synthetic polypeptide
NEEEIACTNPVATESYGSVATNLQENDNED

SEQ ID NO: 74729 - protein, 31 aa, Artificial Sequence
  Description of Artificial Sequence: Synthetic polypeptide
NEEEIACTNPVAYEQYGSVATNLQGNPEEGR

SEQ ID NO: 74730 - protein, 28 aa, Artificial Sequence
  Description of Artificial Sequence: Synthetic peptide
AEREIACTNPVATEQYGEAAENEQRGGR

SEQ ID NO: 74731 - protein, 32 aa, Artificial Sequence
  Description of Artificial Sequence: Synthetic polypeptide
DEEEIRTTNPVATEQYGSVQNTLLINTSMERN

SEQ ID NO: 74732 - protein, 31 aa, Artificial Sequence
  Description of Artificial Sequence: Synthetic polypeptide
NEEEIACTNPVAYEQYGSVATNLQRNPQEPR

SEQ ID NO: 74733 - protein, 33 aa, Artificial Sequence
  Description of Artificial Sequence: Synthetic polypeptide
DEEEIRTTNPVATEQYGSVQNTFNLEDGGDGTT

SEQ ID NO: 74734 - protein, 28 aa, Artificial Sequence
  Description of Artificial Sequence: Synthetic peptide
NEEEIASVNPVCTEQYGVVSDGLQSGNQ

SEQ ID NO: 74735 - protein, 29 aa, Artificial Sequence
  Description of Artificial Sequence: Synthetic peptide
NEEEIASVNPVCTEQYGVVSDNLQGSGNQ

SEQ ID NO: 74736 - protein, 29 aa, Artificial Sequence
  Description of Artificial Sequence: Synthetic peptide
NEEEIASVNPVCTEQYGVVSDNLQSGNHQ

SEQ ID NO: 74737 - protein, 29 aa, Artificial Sequence
  Description of Artificial Sequence: Synthetic peptide
NEEEIASVNPVCTEQYGVVSDNLQSGNQN

SEQ ID NO: 74738 - protein, 29 aa, Artificial Sequence
  Description of Artificial Sequence: Synthetic peptide
NEEEIASVNPVCTEQYGVVSDNLQSQGNQ

SEQ ID NO: 74739 - protein, 33 aa, Artificial Sequence
  Description of Artificial Sequence: Synthetic polypeptide
DEEEIRTTNPVATEQYGSVQNMNLQVVNNNDQS

SEQ ID NO: 74740 - protein, 31 aa, Artificial Sequence
  Description of Artificial Sequence: Synthetic polypeptide
NEDEIRTTNPVATEQYGSVDTNDQNIQGGQG

SEQ ID NO: 74741 - protein, 30 aa, Artificial Sequence
  Description of Artificial Sequence: Synthetic polypeptide
AEQEIACTNPVATEQYGMASENFLQRGDGR

SEQ ID NO: 74742 - protein, 31 aa, Artificial Sequence
  Description of Artificial Sequence: Synthetic polypeptide
NEDEIRTTNPVATEQYGSVDTANGQGEGQGG

SEQ ID NO: 74743 - protein, 36 aa, Artificial Sequence
  Description of Artificial Sequence: Synthetic polypeptide
DEEEIRTTNPVATEQYGSVSSTTPAGLNQRNGMNPV

SEQ ID NO: 74744 - protein, 31 aa, Artificial Sequence
  Description of Artificial Sequence: Synthetic polypeptide
NEAEIRTTNPVAYEQWGSVTTNQQGNEGTNR

SEQ ID NO: 74745 - protein, 32 aa, Artificial Sequence
  Description of Artificial Sequence: Synthetic polypeptide
DEEEIACTNPVATEQYGCVATNLQPDGDNAQE

SEQ ID NO: 74746 - protein, 35 aa, Artificial Sequence
  Description of Artificial Sequence: Synthetic polypeptide
DEEEIRTTNPVATEQYGSVSSTTPAGNMRNGMNPR

SEQ ID NO: 74747 - protein, 30 aa, Artificial Sequence
  Description of Artificial Sequence: Synthetic polypeptide
DEDEIRTTNPVATENWGCVSPTIPMQSGNI

SEQ ID NO: 74748 - protein, 34 aa, Artificial Sequence
  Description of Artificial Sequence: Synthetic polypeptide
DEEEIRTTNPVATEQYGSVSSTTPAGNMRNGMNV

SEQ ID NO: 74749 - protein, 30 aa, Artificial Sequence
  Description of Artificial Sequence: Synthetic polypeptide
NEAEIRTTNPVAYEQWGSVTTNQQGNNGDR

SEQ ID NO: 74750 - protein, 30 aa, Artificial Sequence
  Description of Artificial Sequence: Synthetic polypeptide
NEAEIRTTNPVAYEQWGSVTTNQQNDGAER

SEQ ID NO: 74751 - protein, 34 aa, Artificial Sequence
  Description of Artificial Sequence: Synthetic polypeptide
DEEEIRTTNPVATEQYGSVSSTTPAGNMRNGNPV

SEQ ID NO: 74752 - protein, 31 aa, Artificial Sequence
  Description of Artificial Sequence: Synthetic polypeptide
NEAEIRTTNPVAYEQYGSVWTNMHSQIGGSR

SEQ ID NO: 74753 - protein, 32 aa, Artificial Sequence
  Description of Artificial Sequence: Synthetic polypeptide
DEEEIRTTNPVATEQYGSVQSPNNLELEVVEE

SEQ ID NO: 74754 - protein, 32 aa, Artificial Sequence
  Description of Artificial Sequence: Synthetic polypeptide
NEAEIRTTNPVAYEQYGVVSCTNNSQRGGMNS

SEQ ID NO: 74755 - protein, 33 aa, Artificial Sequence
  Description of Artificial Sequence: Synthetic polypeptide
DEEEIRTTNPVATEQYGSVSSTTPAGNRNENPV

SEQ ID NO: 74756 - protein, 34 aa, Artificial Sequence
  Description of Artificial Sequence: Synthetic polypeptide
DEEEIRTTNPVATEQYGSVSSTTPAGNRNGMNPV

SEQ ID NO: 74757 - protein, 33 aa, Artificial Sequence
  Description of Artificial Sequence: Synthetic polypeptide
DEEEIRTTNPVATEQYGSVQSPIMNLNRNDDVS

SEQ ID NO: 74758 - protein, 30 aa, Artificial Sequence
  Description of Artificial Sequence: Synthetic polypeptide
NEAEIRTTNPVAYEQWGSVTTNQQGNDANR

SEQ ID NO: 74759 - protein, 29 aa, Artificial Sequence
  Description of Artificial Sequence: Synthetic peptide
AEQEIACTNPVATEQWGTASENLQRGDGR

SEQ ID NO: 74760 - protein, 30 aa, Artificial Sequence
  Description of Artificial Sequence: Synthetic polypeptide
NEAEIRTTNPVAYEQWGSVTTGNQQNGADR

SEQ ID NO: 74761 - protein, 29 aa, Artificial Sequence
  Description of Artificial Sequence: Synthetic peptide
AENVIACTNPVATEQYGEASENLQRGDGR

SEQ ID NO: 74762 - protein, 28 aa, Artificial Sequence
  Description of Artificial Sequence: Synthetic peptide
AENLIACTNPTATEQYGEASENLQRGGR

SEQ ID NO: 74763 - protein, 29 aa, Artificial Sequence
  Description of Artificial Sequence: Synthetic peptide
AENMIACTNPVATEQYGEASENLQARGGR

SEQ ID NO: 74764 - protein, 32 aa, Artificial Sequence
  Description of Artificial Sequence: Synthetic polypeptide
DEEEIACTNPVATEQYGCVATNLQEAEGGNDN

SEQ ID NO: 74765 - protein, 31 aa, Artificial Sequence
  Description of Artificial Sequence: Synthetic polypeptide
DEEEIACTNPVATEQYGCVATNLQEAGEDGE

SEQ ID NO: 74766 - protein, 29 aa, Artificial Sequence
  Description of Artificial Sequence: Synthetic peptide
AENMIACTNPVATEQYGEASENLQRHGGR

SEQ ID NO: 74767 - protein, 31 aa, Artificial Sequence
  Description of Artificial Sequence: Synthetic polypeptide
DEEEIACTNPVATEQYGCVATNLQEAGTEEE

SEQ ID NO: 74768 - protein, 34 aa, Artificial Sequence
  Description of Artificial Sequence: Synthetic polypeptide
DEEEIRTTNPVATEQYGSVQSTMLQEMLEGVEED

SEQ ID NO: 74769 - protein, 31 aa, Artificial Sequence
  Description of Artificial Sequence: Synthetic polypeptide
DEEEIACTNPVATEQYGCVATNLQENGTDDT

SEQ ID NO: 74770 - protein, 31 aa, Artificial Sequence
  Description of Artificial Sequence: Synthetic polypeptide
DEEEIACTNPVATEQYGCVATNLQENPGEQQ

SEQ ID NO: 74771 - protein, 31 aa, Artificial Sequence
  Description of Artificial Sequence: Synthetic polypeptide
DEEEIACTNPVATEQYGCVATNLQENQGGDD

SEQ ID NO: 74772 - protein, 28 aa, Artificial Sequence
  Description of Artificial Sequence: Synthetic peptide
AENSIACTNPVATEQYGEASENLQGGGR

SEQ ID NO: 74773 - protein, 32 aa, Artificial Sequence
  Description of Artificial Sequence: Synthetic polypeptide
DEEEIACTNPVATEQYGCVATNLQGRGGEIQN

SEQ ID NO: 74774 - protein, 29 aa, Artificial Sequence
  Description of Artificial Sequence: Synthetic peptide
AENSICCTNPVATEQYGETSENLQRGGRE

SEQ ID NO: 74775 - protein, 30 aa, Artificial Sequence
  Description of Artificial Sequence: Synthetic polypeptide
NEAEIRTTNPVAYEQWGSVTTDNGQGNGAR

SEQ ID NO: 74776 - protein, 32 aa, Artificial Sequence
  Description of Artificial Sequence: Synthetic polypeptide
DEEEIACTNPVATEQYGCVATNLQMQMGNDEF

SEQ ID NO: 74777 - protein, 28 aa, Artificial Sequence
  Description of Artificial Sequence: Synthetic peptide
AENYIACTNPVATEQYGEASENLQRGGP

SEQ ID NO: 74778 - protein, 32 aa, Artificial Sequence
  Description of Artificial Sequence: Synthetic polypeptide
DETEIRTTNPVATDQYGSVNTMQLQRQAQNDL

SEQ ID NO: 74779 - protein, 29 aa, Artificial Sequence
  Description of Artificial Sequence: Synthetic peptide
AEQEIACTNPVATEQYGCASENLQNAGGR

SEQ ID NO: 74780 - protein, 29 aa, Artificial Sequence
  Description of Artificial Sequence: Synthetic peptide
NEDEIACTNPVATEQYGCVATNLQDGEEN

SEQ ID NO: 74781 - protein, 29 aa, Artificial Sequence
  Description of Artificial Sequence: Synthetic peptide
AEQEIACTNPVATEQYGEASENLQMGGTR

SEQ ID NO: 74782 - protein, 30 aa, Artificial Sequence
  Description of Artificial Sequence: Synthetic polypeptide
AEQEIACTNPVATEQYGEASENLQQRGGDR

SEQ ID NO: 74783 - protein, 31 aa, Artificial Sequence
  Description of Artificial Sequence: Synthetic polypeptide
NEDEIATTNPVAYEQYGSVATNLQRNPEGRN

SEQ ID NO: 74784 - protein, 31 aa, Artificial Sequence
  Description of Artificial Sequence: Synthetic polypeptide
DEEEIACTNPVATEQYGCVATNLQVAGEDPM

SEQ ID NO: 74785 - protein, 31 aa, Artificial Sequence
  Description of Artificial Sequence: Synthetic polypeptide
DEEEIACTNPVATEQYGCVATNLTADQGNND

SEQ ID NO: 74786 - protein, 34 aa, Artificial Sequence
  Description of Artificial Sequence: Synthetic polypeptide
DEEEIRTTNPVATEQYGSVQSDTDMLEERQEENI

SEQ ID NO: 74787 - protein, 35 aa, Artificial Sequence
  Description of Artificial Sequence: Synthetic polypeptide
DEEEIRTTNPVATEQYGSVQSDTDMLEEQRQEMNY

SEQ ID NO: 74788 - protein, 33 aa, Artificial Sequence
  Description of Artificial Sequence: Synthetic polypeptide
DEEEIRTTNPVATEQYGSVQSCWGHGDTVGNNR

SEQ ID NO: 74789 - protein, 30 aa, Artificial Sequence
  Description of Artificial Sequence: Synthetic polypeptide
AEQEIACTNPVATEQYGEASENLQRGGGGR

SEQ ID NO: 74790 - protein, 29 aa, Artificial Sequence
  Description of Artificial Sequence: Synthetic peptide
AEQEIACTNPVATEQYGEASENLQRGGGP

SEQ ID NO: 74791 - protein, 29 aa, Artificial Sequence
  Description of Artificial Sequence: Synthetic peptide
AEQEIACTNPVATEQYGEASENLQRGGLP

SEQ ID NO: 74792 - protein, 32 aa, Artificial Sequence
  Description of Artificial Sequence: Synthetic polypeptide
NEDEIRTTNPVATEQYGSLSTHLQERDIGMQE

SEQ ID NO: 74793 - protein, 33 aa, Artificial Sequence
  Description of Artificial Sequence: Synthetic polypeptide
DETEIRTTNPVATEQYGSVPENTPRQERNNQRE

SEQ ID NO: 74794 - protein, 34 aa, Artificial Sequence
  Description of Artificial Sequence: Synthetic polypeptide
DETEIRTTNPVATEQYGSVNSITCTLGSDGQNHR

SEQ ID NO: 74795 - protein, 32 aa, Artificial Sequence
  Description of Artificial Sequence: Synthetic polypeptide
DETEIRTTNPVATEQYGSVMGNLFMGNGNGDD

SEQ ID NO: 74796 - protein, 29 aa, Artificial Sequence
  Description of Artificial Sequence: Synthetic peptide
AEQEIACTNPVATEQYGEASENLQHGGDR

SEQ ID NO: 74797 - protein, 30 aa, Artificial Sequence
  Description of Artificial Sequence: Synthetic polypeptide
NEDEIACTNPVATEQYGCASANLQRPGQRA

SEQ ID NO: 74798 - protein, 30 aa, Artificial Sequence
  Description of Artificial Sequence: Synthetic polypeptide
NEDEIATTNPVAYEQYGSVATNLQDDTGDN

SEQ ID NO: 74799 - protein, 34 aa, Artificial Sequence
  Description of Artificial Sequence: Synthetic polypeptide
AEEEIRTTNPVATEQYGVVSTTNLQENDNGNQTN

SEQ ID NO: 74800 - protein, 33 aa, Artificial Sequence
  Description of Artificial Sequence: Synthetic polypeptide
DETEIRTTNPVATEQYGSVSPANLEQGMMVNVV

SEQ ID NO: 74801 - protein, 33 aa, Artificial Sequence
  Description of Artificial Sequence: Synthetic polypeptide
AEEEIRTTNPVATEQYGVVSTTNLQNQNEENAD

SEQ ID NO: 74802 - protein, 31 aa, Artificial Sequence
  Description of Artificial Sequence: Synthetic polypeptide
DEEEIACTNPVATEQYGCVATNLQQDGGTDE

SEQ ID NO: 74803 - protein, 33 aa, Artificial Sequence
  Description of Artificial Sequence: Synthetic polypeptide
DEEEIRTTNPVATEQYGSVQSNTIGLQVISPDQ

SEQ ID NO: 74804 - protein, 31 aa, Artificial Sequence
  Description of Artificial Sequence: Synthetic polypeptide
DEEEIACTNPVATEQYGCVATNLQQMGEEAY

SEQ ID NO: 74805 - protein, 31 aa, Artificial Sequence
  Description of Artificial Sequence: Synthetic polypeptide
DEEEIACTNPVATEQYGCVATNLQQNDNPDD

SEQ ID NO: 74806 - protein, 32 aa, Artificial Sequence
  Description of Artificial Sequence: Synthetic polypeptide
DEEEIACTNPVATEQYGCVATNLQRDQGEEDI

SEQ ID NO: 74807 - protein, 30 aa, Artificial Sequence
  Description of Artificial Sequence: Synthetic polypeptide
AEQEIACTNPVATEQYGCVATNLQQGNNQM

SEQ ID NO: 74808 - protein, 31 aa, Artificial Sequence
  Description of Artificial Sequence: Synthetic polypeptide
DEEEIACTNPVATEQYGCVATNLQRNATPEH

SEQ ID NO: 74809 - protein, 29 aa, Artificial Sequence
  Description of Artificial Sequence: Synthetic peptide
AEQEIACTNPVATEQYGEASENLERGGDR

SEQ ID NO: 74810 - protein, 34 aa, Artificial Sequence
  Description of Artificial Sequence: Synthetic polypeptide
DEEEIRTTNPVATEQYGSVQSMTELQDTGPELQI

SEQ ID NO: 74811 - protein, 32 aa, Artificial Sequence
  Description of Artificial Sequence: Synthetic polypeptide
DEEEIACTNPVATEQYGCVATNLQTADPGENT

SEQ ID NO: 74812 - protein, 32 aa, Artificial Sequence
  Description of Artificial Sequence: Synthetic polypeptide
DEEEIACTNPVATEQYGCVATNLQTAEDGTNV

SEQ ID NO: 74813 - protein, 33 aa, Artificial Sequence
  Description of Artificial Sequence: Synthetic polypeptide
DEEEIRTTNPVATEQYGSVQSMNDQVPGMEEEQ

SEQ ID NO: 74814 - protein, 34 aa, Artificial Sequence
  Description of Artificial Sequence: Synthetic polypeptide
DEEEIRTTNPVATEQYGSVQSMNDDQVGGMEERQ

SEQ ID NO: 74815 - protein, 29 aa, Artificial Sequence
  Description of Artificial Sequence: Synthetic peptide
AEQEIACTNPVATEQYGEASENLQHEGGR

SEQ ID NO: 74816 - protein, 33 aa, Artificial Sequence
  Description of Artificial Sequence: Synthetic polypeptide
DEEEIRTTNPVATEQYGSVQLTNGDPRIEVARI

SEQ ID NO: 74817 - protein, 32 aa, Artificial Sequence
  Description of Artificial Sequence: Synthetic polypeptide
DETEIRTTNPVAFEQYGSVIDTNGGERGNGNG

SEQ ID NO: 74818 - protein, 33 aa, Artificial Sequence
  Description of Artificial Sequence: Synthetic polypeptide
DEEEIRTTNPVATEQYGSVQLTMLVQMSEGVVE

SEQ ID NO: 74819 - protein, 33 aa, Artificial Sequence
  Description of Artificial Sequence: Synthetic polypeptide
DEEEIRTTNPVATEQYGSVQCTPNLPLLLEGIN

SEQ ID NO: 74820 - protein, 34 aa, Artificial Sequence
  Description of Artificial Sequence: Synthetic polypeptide
DEEEIRTTNPVATEQYGSVQCTPNLPERLLEGDN

SEQ ID NO: 74821 - protein, 34 aa, Artificial Sequence
  Description of Artificial Sequence: Synthetic polypeptide
AEEEIRTTNPVATEQYGSVVVVVTNLQENGNVDE

SEQ ID NO: 74822 - protein, 34 aa, Artificial Sequence
  Description of Artificial Sequence: Synthetic polypeptide
AEEEIRTTNPVATEQYGSVVVVVTNLEQGGNNQS

SEQ ID NO: 74823 - protein, 31 aa, Artificial Sequence
  Description of Artificial Sequence: Synthetic polypeptide
DETEIATTNPVAYEQWGSVSTNLNGGPNNEM

SEQ ID NO: 74824 - protein, 33 aa, Artificial Sequence
  Description of Artificial Sequence: Synthetic polypeptide
DEEEIRTTNPVATEQYGSVQCTNLEQVVLPEDL

SEQ ID NO: 74825 - protein, 31 aa, Artificial Sequence
  Description of Artificial Sequence: Synthetic polypeptide
DETEIATTNPVAYEQWGSVSTNLNGGGNLGM

SEQ ID NO: 74826 - protein, 31 aa, Artificial Sequence
  Description of Artificial Sequence: Synthetic polypeptide
NEEEIRTTNPVATEQYGSCLTIVENQMQGND

SEQ ID NO: 74827 - protein, 31 aa, Artificial Sequence
  Description of Artificial Sequence: Synthetic polypeptide
NEEEIRTTNPVATEQYGSCSPTFEVQSQGRD

SEQ ID NO: 74828 - protein, 31 aa, Artificial Sequence
  Description of Artificial Sequence: Synthetic polypeptide
NEEEIRTTNPVATEQYGSCSPTHEVQEQGRI

SEQ ID NO: 74829 - protein, 34 aa, Artificial Sequence
  Description of Artificial Sequence: Synthetic polypeptide
DEEEIRTTNPVATEQYGSVQCTENNELRGELNVG

SEQ ID NO: 74830 - protein, 33 aa, Artificial Sequence
  Description of Artificial Sequence: Synthetic polypeptide
NEEEIRTTNPVATEQYGSCVSTNLDVPGIPHQI

SEQ ID NO: 74831 - protein, 33 aa, Artificial Sequence
  Description of Artificial Sequence: Synthetic polypeptide
DEEEIRTTNPVATEQYGSVQCPTSLQVMLVPVR

SEQ ID NO: 74832 - protein, 30 aa, Artificial Sequence
  Description of Artificial Sequence: Synthetic polypeptide
DETEIATTNPVAYEQWGSVATNLNGGNLDM

SEQ ID NO: 74833 - protein, 33 aa, Artificial Sequence
  Description of Artificial Sequence: Synthetic polypeptide
DEEEIRTTNPVATEQYGSVQCNTNEQALMGPEA

SEQ ID NO: 74834 - protein, 31 aa, Artificial Sequence
  Description of Artificial Sequence: Synthetic polypeptide
DETEIATTNPVAYEQWGSVSTNLQEGGQGEA

SEQ ID NO: 74835 - protein, 33 aa, Artificial Sequence
  Description of Artificial Sequence: Synthetic polypeptide
DEEEIRTTNPVATEQYGSVQCNAMGEQPEGSNS

SEQ ID NO: 74836 - protein, 33 aa, Artificial Sequence
  Description of Artificial Sequence: Synthetic polypeptide
DEEEIRTTNPVATEQYGSVQCTPNLPRLLEDVN

SEQ ID NO: 74837 - protein, 34 aa, Artificial Sequence
  Description of Artificial Sequence: Synthetic polypeptide
DEEEIRTTNPVATEQYGSVQCTPNLVPRLLEGLD

SEQ ID NO: 74838 - protein, 31 aa, Artificial Sequence
  Description of Artificial Sequence: Synthetic polypeptide
DETEIATTNPVAYEQYGSVATNLQDDSDGDD

SEQ ID NO: 74839 - protein, 33 aa, Artificial Sequence
  Description of Artificial Sequence: Synthetic polypeptide
NEEEIRTTNPVATEQYGCVCSAGNLDEFGSNRQ

SEQ ID NO: 74840 - protein, 32 aa, Artificial Sequence
  Description of Artificial Sequence: Synthetic polypeptide
DETEIATTNPVAYEQYGSVAITDNDQQGNDRP

SEQ ID NO: 74841 - protein, 33 aa, Artificial Sequence
  Description of Artificial Sequence: Synthetic polypeptide
DEEEIRTTNPVATEQYGSVQCVNNEARGELNVA

SEQ ID NO: 74842 - protein, 33 aa, Artificial Sequence
  Description of Artificial Sequence: Synthetic polypeptide
DETEIATTNPVAYEQWGSVSTTNLQSGPNEGMR

SEQ ID NO: 74843 - protein, 32 aa, Artificial Sequence
  Description of Artificial Sequence: Synthetic polypeptide
DETEIATTNPVAYEQWGSVSTTNLQGGPNEME

SEQ ID NO: 74844 - protein, 31 aa, Artificial Sequence
  Description of Artificial Sequence: Synthetic polypeptide
DETEIATTNPVAYEQWGSVSTTNLGDSGNFG

SEQ ID NO: 74845 - protein, 33 aa, Artificial Sequence
  Description of Artificial Sequence: Synthetic polypeptide
DETEIATTNPVAYEQWGSVSTPNPLGQGDGGNR

SEQ ID NO: 74846 - protein, 31 aa, Artificial Sequence
  Description of Artificial Sequence: Synthetic polypeptide
NEEEIRTTNPVATEQYGCVSSGNLDEFGSDA

SEQ ID NO: 74847 - protein, 33 aa, Artificial Sequence
  Description of Artificial Sequence: Synthetic polypeptide
DEEEIRTTNPVATEQYGSVQCTTELQNGDDEGI

SEQ ID NO: 74848 - protein, 30 aa, Artificial Sequence
  Description of Artificial Sequence: Synthetic polypeptide
DETEIATTNPVAYEQWGSVSTNPQDHQGMQ

SEQ ID NO: 74849 - protein, 32 aa, Artificial Sequence
  Description of Artificial Sequence: Synthetic polypeptide
DETEIATTNPVAYEQWGSVSTNLQHDQGGNTI

SEQ ID NO: 74850 - protein, 31 aa, Artificial Sequence
  Description of Artificial Sequence: Synthetic polypeptide
DETEIATTNPVAYEQWGSVSTNLQGEHNGGQ

SEQ ID NO: 74851 - protein, 34 aa, Artificial Sequence
  Description of Artificial Sequence: Synthetic polypeptide
DEEEIRTTNPVATEQYGSVQCTPNMLPRLEEGIN

SEQ ID NO: 74852 - protein, 32 aa, Artificial Sequence
  Description of Artificial Sequence: Synthetic polypeptide
DETEIATTNPVAYEQWGSVSTNLQGDTGGNDA

SEQ ID NO: 74853 - protein, 31 aa, Artificial Sequence
  Description of Artificial Sequence: Synthetic polypeptide
NEEEIRTTNPVATEQYGCVSWMNLDEFGSDQ

SEQ ID NO: 74854 - protein, 30 aa, Artificial Sequence
  Description of Artificial Sequence: Synthetic polypeptide
DETEIATTNPVAYEQYGSVATNLQDTPDTN

SEQ ID NO: 74855 - protein, 33 aa, Artificial Sequence
  Description of Artificial Sequence: Synthetic polypeptide
AEEEIRTTNPVATEQYGSVVVVTTNQQEGENDN

SEQ ID NO: 74856 - protein, 31 aa, Artificial Sequence
  Description of Artificial Sequence: Synthetic polypeptide
DETEIATTNPVAYEKWGSVSTNLQGDLGNAN

SEQ ID NO: 74857 - protein, 32 aa, Artificial Sequence
  Description of Artificial Sequence: Synthetic polypeptide
DETEIATTNPVATETWGSVSTNLQGDLGNGGA

SEQ ID NO: 74858 - protein, 34 aa, Artificial Sequence
  Description of Artificial Sequence: Synthetic polypeptide
NEEEIRTTNPVATEQYGSTVSCAGNLSDEEGGNR

SEQ ID NO: 74859 - protein, 32 aa, Artificial Sequence
  Description of Artificial Sequence: Synthetic polypeptide
NEEEIRTTNPVATEQYGSVAPAELLQEGQFSR

SEQ ID NO: 74860 - protein, 31 aa, Artificial Sequence
  Description of Artificial Sequence: Synthetic polypeptide
NEEEIRTTNPVATEQYGSVAPAEQHEGQFSR

SEQ ID NO: 74861 - protein, 33 aa, Artificial Sequence
  Description of Artificial Sequence: Synthetic polypeptide
DEEEIRTTNPVATEQYGSVPVSYHVQRVVNEIT

SEQ ID NO: 74862 - protein, 33 aa, Artificial Sequence
  Description of Artificial Sequence: Synthetic polypeptide
AEEEIRTTNPVATEQYGSVVVVTTNLQEGVEDE

SEQ ID NO: 74863 - protein, 33 aa, Artificial Sequence
  Description of Artificial Sequence: Synthetic polypeptide
AEEEIRTTNPVATEQYGSVVVVTTNLQEGTVDE

SEQ ID NO: 74864 - protein, 34 aa, Artificial Sequence
  Description of Artificial Sequence: Synthetic polypeptide
AEEEIRTTNPVATEQYGSVVVVTTNLQAGEENDG

SEQ ID NO: 74865 - protein, 33 aa, Artificial Sequence
  Description of Artificial Sequence: Synthetic polypeptide
DEEEIRTTNPVATEQYGSVPVSFMVQRVMNEIT

SEQ ID NO: 74866 - protein, 28 aa, Artificial Sequence
  Description of Artificial Sequence: Synthetic peptide
AESEIACTNPVGTEQYGEASSNLQRGDI

SEQ ID NO: 74867 - protein, 34 aa, Artificial Sequence
  Description of Artificial Sequence: Synthetic polypeptide
DEEEIRTTNPVATEQYGSVPVPPNGQPRLGLERN

SEQ ID NO: 74868 - protein, 32 aa, Artificial Sequence
  Description of Artificial Sequence: Synthetic polypeptide
DEEEIRTTNPVATEQYGSVPVMNEPQLFLENN

SEQ ID NO: 74869 - protein, 33 aa, Artificial Sequence
  Description of Artificial Sequence: Synthetic polypeptide
AEEEIRTTNPVATEQYGSVVVVTTNLGGNGNEE

SEQ ID NO: 74870 - protein, 33 aa, Artificial Sequence
  Description of Artificial Sequence: Synthetic polypeptide
NEEEIRTTNPVATEQYGSVCSAENLDEFGSDRA

SEQ ID NO: 74871 - protein, 34 aa, Artificial Sequence
  Description of Artificial Sequence: Synthetic polypeptide
AEEEIRTTNPVATEQYGSVVVVTTNLGEQGGNNQ

SEQ ID NO: 74872 - protein, 35 aa, Artificial Sequence
  Description of Artificial Sequence: Synthetic polypeptide
DEEEIRTTNPVATEQYGSVSSTTPAGPQRNGMNPV

SEQ ID NO: 74873 - protein, 31 aa, Artificial Sequence
  Description of Artificial Sequence: Synthetic polypeptide
DETEIATTNPVAYEKWGSVSTNLQGGGDNGH

SEQ ID NO: 74874 - protein, 34 aa, Artificial Sequence
  Description of Artificial Sequence: Synthetic polypeptide
AEEEIRTTNPVATEQYGSVVVVTTNLQNGNQNAQ

SEQ ID NO: 74875 - protein, 35 aa, Artificial Sequence
  Description of Artificial Sequence: Synthetic polypeptide
DEEEIRTTNPVATEQYGSVSSTTPAGPQMRNGNPV

SEQ ID NO: 74876 - protein, 35 aa, Artificial Sequence
  Description of Artificial Sequence: Synthetic polypeptide
DEEEIRTTNPVATEQYGSVSSTTPAGPNQQNGNPV

SEQ ID NO: 74877 - protein, 33 aa, Artificial Sequence
  Description of Artificial Sequence: Synthetic polypeptide
AEEEIRTTNPVATEQYGSVVVVTTNNQQEGNFT

SEQ ID NO: 74878 - protein, 33 aa, Artificial Sequence
  Description of Artificial Sequence: Synthetic polypeptide
AEEEIRTTNPVATEQYGSVVVVTTNNQQEGNFN

SEQ ID NO: 74879 - protein, 33 aa, Artificial Sequence
  Description of Artificial Sequence: Synthetic polypeptide
DEEEIRTTNPVATEQYGSVQCFTNMALTVGVLD

SEQ ID NO: 74880 - protein, 31 aa, Artificial Sequence
  Description of Artificial Sequence: Synthetic polypeptide
DETEIATTNPVAYEHWGEVSTNPQDRGENDR

SEQ ID NO: 74881 - protein, 34 aa, Artificial Sequence
  Description of Artificial Sequence: Synthetic polypeptide
DEEEIRTTNPVATEQYGSVSSTTPAGPNRNGMNV

SEQ ID NO: 74882 - protein, 34 aa, Artificial Sequence
  Description of Artificial Sequence: Synthetic polypeptide
AEEEIRTTNPVATEQYGSVVVVTTNNLEQGGNQT

SEQ ID NO: 74883 - protein, 31 aa, Artificial Sequence
  Description of Artificial Sequence: Synthetic polypeptide
DETEIATTNPVAYEEWGSVSTNLQNNGGDNH

SEQ ID NO: 74884 - protein, 34 aa, Artificial Sequence
  Description of Artificial Sequence: Synthetic polypeptide
AEEEIRTTNPVATEQYGSVVVVTTNLQQTGENDQ

SEQ ID NO: 74885 - protein, 34 aa, Artificial Sequence
  Description of Artificial Sequence: Synthetic polypeptide
AEEEIRTTNPVATEQYGSVVVVTTNLQQGNQNTE

SEQ ID NO: 74886 - protein, 30 aa, Artificial Sequence
  Description of Artificial Sequence: Synthetic polypeptide
DETEIATTNPVAYECWGSVSTNLNSGGDNH

SEQ ID NO: 74887 - protein, 30 aa, Artificial Sequence
  Description of Artificial Sequence: Synthetic polypeptide
NEEEIRTTNPVATEQYGSNAGVLQEGSDLA

SEQ ID NO: 74888 - protein, 30 aa, Artificial Sequence
  Description of Artificial Sequence: Synthetic polypeptide
DETEIATTNPVAYEAWGEVSTNLQDGDNQE

SEQ ID NO: 74889 - protein, 32 aa, Artificial Sequence
  Description of Artificial Sequence: Synthetic polypeptide
DETEIATTNPVATETWGSVSTNLQNSGGDNDH

SEQ ID NO: 74890 - protein, 34 aa, Artificial Sequence
  Description of Artificial Sequence: Synthetic polypeptide
AEEEIRTTNPVATEQYGSVVVVTTNLQQGGNNTE

SEQ ID NO: 74891 - protein, 34 aa, Artificial Sequence
  Description of Artificial Sequence: Synthetic polypeptide
AEEEIRTTNPVATEQYGSVVVVTTNLQQGEGNSE

SEQ ID NO: 74892 - protein, 32 aa, Artificial Sequence
  Description of Artificial Sequence: Synthetic polypeptide
DEEEIACTNPVATEQYGCVATNLQDRPQGEGE

SEQ ID NO: 74893 - protein, 33 aa, Artificial Sequence
  Description of Artificial Sequence: Synthetic polypeptide
DEEEIRTTNPVATEQYGSVQCYTPNLVVQNDFD

SEQ ID NO: 74894 - protein, 32 aa, Artificial Sequence
  Description of Artificial Sequence: Synthetic polypeptide
DETEIATTNPVAYEQYGTVSTNLQANGDNGDA

SEQ ID NO: 74895 - protein, 30 aa, Artificial Sequence
  Description of Artificial Sequence: Synthetic polypeptide
DETEIRCTNPIATECYGSVWSEDWAERGNR

SEQ ID NO: 74896 - protein, 32 aa, Artificial Sequence
  Description of Artificial Sequence: Synthetic polypeptide
NEEEIATTNPVATEQYGSVLAWEHLGQRQGDR

SEQ ID NO: 74897 - protein, 32 aa, Artificial Sequence
  Description of Artificial Sequence: Synthetic polypeptide
DETEIKTTNPVATEQYGSVTTGGQLQEEMGNT

SEQ ID NO: 74898 - protein, 32 aa, Artificial Sequence
  Description of Artificial Sequence: Synthetic polypeptide
NEEEIATTNPVATEQYGSVSNANNLDENGENQ

SEQ ID NO: 74899 - protein, 30 aa, Artificial Sequence
  Description of Artificial Sequence: Synthetic polypeptide
DETEIKTTNPVATEQYGSVPTPMLSIYNEG

SEQ ID NO: 74900 - protein, 32 aa, Artificial Sequence
  Description of Artificial Sequence: Synthetic polypeptide
DETEIGTTNPVATEQYGCVSVTINPPADGNGR

SEQ ID NO: 74901 - protein, 28 aa, Artificial Sequence
  Description of Artificial Sequence: Synthetic peptide
AESEIACTNPVATEGYGEASETLQRGGR

SEQ ID NO: 74902 - protein, 31 aa, Artificial Sequence
  Description of Artificial Sequence: Synthetic polypeptide
NEEEIATTNPVATESYGSVATNLQENDNNEN

SEQ ID NO: 74903 - protein, 28 aa, Artificial Sequence
  Description of Artificial Sequence: Synthetic peptide
AESEIACTNPVATEGYGVAAENLQRGGR

SEQ ID NO: 74904 - protein, 30 aa, Artificial Sequence
  Description of Artificial Sequence: Synthetic polypeptide
AESEIACTNPVATEQWGEASCNLQREGENR

SEQ ID NO: 74905 - protein, 32 aa, Artificial Sequence
  Description of Artificial Sequence: Synthetic polypeptide
DEEEIRTTNPVATEQYGSVQGPTMGEQPEGVV

SEQ ID NO: 74906 - protein, 30 aa, Artificial Sequence
  Description of Artificial Sequence: Synthetic polypeptide
AESEIACTNPVATEQWGEVSCINLQDRGNG

SEQ ID NO: 74907 - protein, 33 aa, Artificial Sequence
  Description of Artificial Sequence: Synthetic polypeptide
DETEICTTNPVAYEQYGSVSTNDLQGNHGGNDS

SEQ ID NO: 74908 - protein, 30 aa, Artificial Sequence
  Description of Artificial Sequence: Synthetic polypeptide
AESEIACTNPVATEQWGEVSEINLQDRGNG

SEQ ID NO: 74909 - protein, 32 aa, Artificial Sequence
  Description of Artificial Sequence: Synthetic polypeptide
NEEEIATTNPVAYEQYGSVAATNLQNPGNPVF

SEQ ID NO: 74910 - protein, 30 aa, Artificial Sequence
  Description of Artificial Sequence: Synthetic polypeptide
DETEIRCTNPIATEQWGSVWSEDLAERGPR

SEQ ID NO: 74911 - protein, 32 aa, Artificial Sequence
  Description of Artificial Sequence: Synthetic polypeptide
NEEEIATTNPVAYEQYGSVAITNLQGNPEGRP

SEQ ID NO: 74912 - protein, 32 aa, Artificial Sequence
  Description of Artificial Sequence: Synthetic polypeptide
NEEEIATTNPVATEQYGSVATTNPQENGNEHA

SEQ ID NO: 74913 - protein, 29 aa, Artificial Sequence
  Description of Artificial Sequence: Synthetic peptide
DETEIRCTNPVATECWGETTAENLQRGGR

SEQ ID NO: 74914 - protein, 30 aa, Artificial Sequence
  Description of Artificial Sequence: Synthetic polypeptide
DETEIRTTNPCATEQYGSVSVNIFERVVDD

SEQ ID NO: 74915 - protein, 34 aa, Artificial Sequence
  Description of Artificial Sequence: Synthetic polypeptide
DEEEIRTTNPVATEQYGSVQLTENGLQQLMMNDE

SEQ ID NO: 74916 - protein, 29 aa, Artificial Sequence
  Description of Artificial Sequence: Synthetic peptide
DETEIRSVNPVATEQWGVVSNDNLQSGPI

SEQ ID NO: 74917 - protein, 31 aa, Artificial Sequence
  Description of Artificial Sequence: Synthetic polypeptide
NEEEIATTNPVATEQYGSTATHLQPDDQGER

SEQ ID NO: 74918 - protein, 29 aa, Artificial Sequence
  Description of Artificial Sequence: Synthetic peptide
DETEIRSVNPVATEQWGAVSNDNLQSGPI

SEQ ID NO: 74919 - protein, 29 aa, Artificial Sequence
  Description of Artificial Sequence: Synthetic peptide
DETEIRSVNPVATEQWGAVSNANLQSGPI

SEQ ID NO: 74920 - protein, 29 aa, Artificial Sequence
  Description of Artificial Sequence: Synthetic peptide
DETEIRSVNPVATEQWGAVSNANLQPGPI

SEQ ID NO: 74921 - protein, 28 aa, Artificial Sequence
  Description of Artificial Sequence: Synthetic peptide
DETEIRSVNPVATECYGATAANLQPGNQ

SEQ ID NO: 74922 - protein, 31 aa, Artificial Sequence
  Description of Artificial Sequence: Synthetic polypeptide
NEEEIATTNPVATEQYGSVAAGNPQEAGNEE

SEQ ID NO: 74923 - protein, 30 aa, Artificial Sequence
  Description of Artificial Sequence: Synthetic polypeptide
NEEEIATTNPVATEQYGSVAANPGRGPPEE

SEQ ID NO: 74924 - protein, 34 aa, Artificial Sequence
  Description of Artificial Sequence: Synthetic polypeptide
NEEEIATTNPVATEQYGSVAGTNNLPQEAGENER

SEQ ID NO: 74925 - protein, 31 aa, Artificial Sequence
  Description of Artificial Sequence: Synthetic polypeptide
NEEEIATTNPVATEQYGSVAITNDTENGNPQ

SEQ ID NO: 74926 - protein, 32 aa, Artificial Sequence
  Description of Artificial Sequence: Synthetic polypeptide
NEEEIATTNPVATEQYGSVAITNPQENGNQEA

SEQ ID NO: 74927 - protein, 30 aa, Artificial Sequence
  Description of Artificial Sequence: Synthetic polypeptide
NEEEIATTNPVATEQYGSVANNLENNGDQM

SEQ ID NO: 74928 - protein, 31 aa, Artificial Sequence
  Description of Artificial Sequence: Synthetic polypeptide
NEEEIATTNPVATEQYGSVATNDQRDVDTVM

SEQ ID NO: 74929 - protein, 32 aa, Artificial Sequence
  Description of Artificial Sequence: Synthetic polypeptide
NEEEIATTNPVATEQYGSVATNNLENMGENDA

SEQ ID NO: 74930 - protein, 33 aa, Artificial Sequence
  Description of Artificial Sequence: Synthetic polypeptide
DETEIATTNPVAYEQYGSVSAANLQDRGPNDSE

SEQ ID NO: 74931 - protein, 32 aa, Artificial Sequence
  Description of Artificial Sequence: Synthetic polypeptide
DETEICTTNPVAYEQWGSVSTNLQQGDDGMTR

SEQ ID NO: 74932 - protein, 31 aa, Artificial Sequence
  Description of Artificial Sequence: Synthetic polypeptide
AESEIACTNPVATEQWGSVSCINLPQDRGNG

SEQ ID NO: 74933 - protein, 34 aa, Artificial Sequence
  Description of Artificial Sequence: Synthetic polypeptide
NEEEIRTTNPVATEQYGAVALNTNDLQCYGNDRY

SEQ ID NO: 74934 - protein, 34 aa, Artificial Sequence
  Description of Artificial Sequence: Synthetic polypeptide
DEEEIRTTNPVATEQYGSVSSTTPAGPNMRNGNV

SEQ ID NO: 74935 - protein, 33 aa, Artificial Sequence
  Description of Artificial Sequence: Synthetic polypeptide
DEEEIRTTNPVATEQYGSVQETGLEQVMLTARQ

SEQ ID NO: 74936 - protein, 31 aa, Artificial Sequence
  Description of Artificial Sequence: Synthetic polypeptide
NEEEIRTTNPVATEQYGCFCSTELQRQSQQA

SEQ ID NO: 74937 - protein, 31 aa, Artificial Sequence
  Description of Artificial Sequence: Synthetic polypeptide
NEEEIRTTNPVATEQYGCFCSTGELQRQSDQ

SEQ ID NO: 74938 - protein, 30 aa, Artificial Sequence
  Description of Artificial Sequence: Synthetic polypeptide
DETEIATTNPVAYESWGVVSTNLQGGGDNH

SEQ ID NO: 74939 - protein, 31 aa, Artificial Sequence
  Description of Artificial Sequence: Synthetic polypeptide
NEEEIRTTNPVATEQYGCSCSSELQRFQSDQ

SEQ ID NO: 74940 - protein, 31 aa, Artificial Sequence
  Description of Artificial Sequence: Synthetic polypeptide
DETEIATTNPVAYERWGSVSTNLQADGNNDS

SEQ ID NO: 74941 - protein, 33 aa, Artificial Sequence
  Description of Artificial Sequence: Synthetic polypeptide
DEEEIRTTNPVATEQYGSVQEENLGARGVEVLI

SEQ ID NO: 74942 - protein, 31 aa, Artificial Sequence
  Description of Artificial Sequence: Synthetic polypeptide
DETEIATTNPVAYERWGEVSTTNLQDGENDR

SEQ ID NO: 74943 - protein, 30 aa, Artificial Sequence
  Description of Artificial Sequence: Synthetic polypeptide
DETEIATTNPVAYERWGEVSTNLQRGEDDS

SEQ ID NO: 74944 - protein, 31 aa, Artificial Sequence
  Description of Artificial Sequence: Synthetic polypeptide
DETEIATTNPVAYEQYGTVSTTNGQGMGGSR

SEQ ID NO: 74945 - protein, 31 aa, Artificial Sequence
  Description of Artificial Sequence: Synthetic polypeptide
NEEEIRTTNPVATEQYGCSCSTELQNQSDQG

SEQ ID NO: 74946 - protein, 31 aa, Artificial Sequence
  Description of Artificial Sequence: Synthetic polypeptide
NEEEIRTTNPVATEQYGCSCSTELQYSQSDQ

SEQ ID NO: 74947 - protein, 30 aa, Artificial Sequence
  Description of Artificial Sequence: Synthetic polypeptide
DETEIATTNPVAYEQYGTVSTTNGDGGTSR

SEQ ID NO: 74948 - protein, 31 aa, Artificial Sequence
  Description of Artificial Sequence: Synthetic polypeptide
DEEEIRTTNPVATEQYGSVQETPGQTVVHVV

SEQ ID NO: 74949 - protein, 31 aa, Artificial Sequence
  Description of Artificial Sequence: Synthetic polypeptide
DETEICTTNPVAYEQWGSVSTNLQGNDGMGM

SEQ ID NO: 74950 - protein, 32 aa, Artificial Sequence
  Description of Artificial Sequence: Synthetic polypeptide
DEEEIRTTNPVATEQYGSVQETPLQTIVAVFD

SEQ ID NO: 74951 - protein, 30 aa, Artificial Sequence
  Description of Artificial Sequence: Synthetic polypeptide
AESEIACTNPVATEQYGETISENLQRGGGR

SEQ ID NO: 74952 - protein, 32 aa, Artificial Sequence
  Description of Artificial Sequence: Synthetic polypeptide
DETEICTTNPVAYEQWGSVSTNLNQGADGMGR

SEQ ID NO: 74953 - protein, 31 aa, Artificial Sequence
  Description of Artificial Sequence: Synthetic polypeptide
DETEICTTNPVAYEQWGSVATNLQGEDGMDR

SEQ ID NO: 74954 - protein, 30 aa, Artificial Sequence
  Description of Artificial Sequence: Synthetic polypeptide
NEEEIATTNPVAYEQYGSVATNLQDNPEGT

SEQ ID NO: 74955 - protein, 33 aa, Artificial Sequence
  Description of Artificial Sequence: Synthetic polypeptide
NEEEIATTNPVAYEQYGSVATNLQDRPGPEGRN

SEQ ID NO: 74956 - protein, 31 aa, Artificial Sequence
  Description of Artificial Sequence: Synthetic polypeptide
NEEEIATTNPVAYEQYGSVATNLQGNPEGDD

SEQ ID NO: 74957 - protein, 31 aa, Artificial Sequence
  Description of Artificial Sequence: Synthetic polypeptide
NEEEIATTNPVAYEQYGSVATNLQMNPEGVH

SEQ ID NO: 74958 - protein, 32 aa, Artificial Sequence
  Description of Artificial Sequence: Synthetic polypeptide
NEEEIATTNPVAYEQYGSVATNLQQAGENGVE

SEQ ID NO: 74959 - protein, 32 aa, Artificial Sequence
  Description of Artificial Sequence: Synthetic polypeptide
NEEEIATTNPVAYEQYGSVATNLQTRNPDPRP

SEQ ID NO: 74960 - protein, 31 aa, Artificial Sequence
  Description of Artificial Sequence: Synthetic polypeptide
NEEEIATTNPVAYEQYGSVATNLQVPGPEPE

SEQ ID NO: 74961 - protein, 31 aa, Artificial Sequence
  Description of Artificial Sequence: Synthetic polypeptide
NEEEIATTNPVAYEQYGSVSAANLDEAGNNH

SEQ ID NO: 74962 - protein, 32 aa, Artificial Sequence
  Description of Artificial Sequence: Synthetic polypeptide
NEEEIATTNPVAYEQYGSVSAGNLDEAGNMRS

SEQ ID NO: 74963 - protein, 30 aa, Artificial Sequence
  Description of Artificial Sequence: Synthetic polypeptide
AESEIACTNPVATEQYGEASENLDQRGGGR

SEQ ID NO: 74964 - protein, 30 aa, Artificial Sequence
  Description of Artificial Sequence: Synthetic polypeptide
NEEEIRSTNPVATEPYGFVSTNQQNIGDGP

SEQ ID NO: 74965 - protein, 31 aa, Artificial Sequence
  Description of Artificial Sequence: Synthetic polypeptide
AESEIACTNPVATEQYGEISENELQRGGGNR

SEQ ID NO: 74966 - protein, 33 aa, Artificial Sequence
  Description of Artificial Sequence: Synthetic polypeptide
DEEEIRTTNPVATEQYGSVQETSLIDVGELERQ

SEQ ID NO: 74967 - protein, 33 aa, Artificial Sequence
  Description of Artificial Sequence: Synthetic polypeptide
DETEICTTNPVATEQYGSVSTNLNGNAGENDDM

SEQ ID NO: 74968 - protein, 29 aa, Artificial Sequence
  Description of Artificial Sequence: Synthetic peptide
AESEIACTNPVSTEQYGNASAENLQRGGR

SEQ ID NO: 74969 - protein, 31 aa, Artificial Sequence
  Description of Artificial Sequence: Synthetic polypeptide
DEEEIACTNPVATEQYGCVATNLQDNQDNDE

SEQ ID NO: 74970 - protein, 31 aa, Artificial Sequence
  Description of Artificial Sequence: Synthetic polypeptide
DEEEIACTNPVATEQYGCVATNLQDEAGEED

SEQ ID NO: 74971 - protein, 30 aa, Artificial Sequence
  Description of Artificial Sequence: Synthetic polypeptide
DEEDIRTTNPVAWEQYGQCCTINVQGGNYV

SEQ ID NO: 74972 - protein, 28 aa, Artificial Sequence
  Description of Artificial Sequence: Synthetic peptide
DETEIRTTNPVGTEGYGATASTLQHGDI

SEQ ID NO: 74973 - protein, 34 aa, Artificial Sequence
  Description of Artificial Sequence: Synthetic polypeptide
DEEEIRTTNPVATEQYGSVSAEAVGLQVLGEVRT

SEQ ID NO: 74974 - protein, 28 aa, Artificial Sequence
  Description of Artificial Sequence: Synthetic peptide
AENEIRTTNPVATEPYGTISMDLQQGGH

SEQ ID NO: 74975 - protein, 33 aa, Artificial Sequence
  Description of Artificial Sequence: Synthetic polypeptide
MEEEIRTTNPVATEQYGSVSTYGMGQENGGGNE

SEQ ID NO: 74976 - protein, 31 aa, Artificial Sequence
  Description of Artificial Sequence: Synthetic polypeptide
DETEIRTTNPVAYEQYGTVSTTNQDGDGDSR

SEQ ID NO: 74977 - protein, 28 aa, Artificial Sequence
  Description of Artificial Sequence: Synthetic peptide
DETEIRTTNPVGTEGYGATASTLQHGPI

SEQ ID NO: 74978 - protein, 32 aa, Artificial Sequence
  Description of Artificial Sequence: Synthetic polypeptide
MEEEIRTTNPVATEQYGSVSYPEQTDGNQGEM

SEQ ID NO: 74979 - protein, 33 aa, Artificial Sequence
  Description of Artificial Sequence: Synthetic polypeptide
DEEEIRTTNPVATEQYGSVSADELQEGQESVFQ

SEQ ID NO: 74980 - protein, 28 aa, Artificial Sequence
  Description of Artificial Sequence: Synthetic peptide
AENEIRTTNPVATEQWGDASENEQREDA

SEQ ID NO: 74981 - protein, 32 aa, Artificial Sequence
  Description of Artificial Sequence: Synthetic polypeptide
DEEEIAATNPVAYEQYGCVQSCTNASQGVGNR

SEQ ID NO: 74982 - protein, 31 aa, Artificial Sequence
  Description of Artificial Sequence: Synthetic polypeptide
DEEEIAATNPVAYEQYGFVVCTNQSQGVGNR

SEQ ID NO: 74983 - protein, 29 aa, Artificial Sequence
  Description of Artificial Sequence: Synthetic peptide
AENEIRTTNPVATEQWGEVSENEQAAGDA

SEQ ID NO: 74984 - protein, 31 aa, Artificial Sequence
  Description of Artificial Sequence: Synthetic polypeptide
MEEEIRTTNPVATEQYGSYVYNTWEQRESQE

SEQ ID NO: 74985 - protein, 31 aa, Artificial Sequence
  Description of Artificial Sequence: Synthetic polypeptide
DETEIRTTNPVAYEQYGTVSTTDNQGGMGSR

SEQ ID NO: 74986 - protein, 30 aa, Artificial Sequence
  Description of Artificial Sequence: Synthetic polypeptide
AENEIRTTNPVATEPYGEISMENIQRNGNH

SEQ ID NO: 74987 - protein, 28 aa, Artificial Sequence
  Description of Artificial Sequence: Synthetic peptide
AENEIRTTNPVATEPYGEISMDIQQGNH

SEQ ID NO: 74988 - protein, 32 aa, Artificial Sequence
  Description of Artificial Sequence: Synthetic polypeptide
AENEIRTTNPVATECYGEVSCINLPQDRGEGR

SEQ ID NO: 74989 - protein, 29 aa, Artificial Sequence
  Description of Artificial Sequence: Synthetic peptide
DETSIATTNPTAYEQFGVVSFNLQDSGNR

SEQ ID NO: 74990 - protein, 31 aa, Artificial Sequence
  Description of Artificial Sequence: Synthetic polypeptide
MEEEIRTTNPVATEQYGSVSDDNGGNGGEGD

SEQ ID NO: 74991 - protein, 33 aa, Artificial Sequence
  Description of Artificial Sequence: Synthetic polypeptide
DEEEIRTTNPVATEQYGSVSAINSLQMTISQEE

SEQ ID NO: 74992 - protein, 29 aa, Artificial Sequence
  Description of Artificial Sequence: Synthetic peptide
AENEIRCTNPVSTEPYGEASMNLQQRGGR

SEQ ID NO: 74993 - protein, 29 aa, Artificial Sequence
  Description of Artificial Sequence: Synthetic peptide
DETGIRTTNPCATEQWGSVSVNEVVSGTR

SEQ ID NO: 74994 - protein, 33 aa, Artificial Sequence
  Description of Artificial Sequence: Synthetic polypeptide
DEECVRTTNPIAYEQYGEVPSCTNALSQRGNNR

SEQ ID NO: 74995 - protein, 32 aa, Artificial Sequence
  Description of Artificial Sequence: Synthetic polypeptide
DEEEIRTTNPVATEQYGSVSAGMGGNQNENGI

SEQ ID NO: 74996 - protein, 30 aa, Artificial Sequence
  Description of Artificial Sequence: Synthetic polypeptide
DETGIRTTNPCATEQWGSVSVNEHPSTGNR

SEQ ID NO: 74997 - protein, 33 aa, Artificial Sequence
  Description of Artificial Sequence: Synthetic polypeptide
DEEEIRTTNPVATEQYGSVSAEVGLMQLVENQM

SEQ ID NO: 74998 - protein, 30 aa, Artificial Sequence
  Description of Artificial Sequence: Synthetic polypeptide
DETGIRTTNPCATEQWGSRSVNEQVGNNRV

SEQ ID NO: 74999 - protein, 33 aa, Artificial Sequence
  Description of Artificial Sequence: Synthetic polypeptide
MEEEIRTTNPVATEQYGSVSTGNGGGDGEGNEF

SEQ ID NO: 75000 - protein, 32 aa, Artificial Sequence
  Description of Artificial Sequence: Synthetic polypeptide
DEEEIRTTNPVATEQYGSVSAENMQELLPLPT

SEQ ID NO: 75001 - protein, 32 aa, Artificial Sequence
  Description of Artificial Sequence: Synthetic polypeptide
MEEEIRTTNPVATEQYGSVSTLANGQESEDHP

SEQ ID NO: 75002 - protein, 34 aa, Artificial Sequence
  Description of Artificial Sequence: Synthetic polypeptide
AEEEIRTTNPVATEQYGVVSTVTNLQQQNIGNTE

SEQ ID NO: 75003 - protein, 31 aa, Artificial Sequence
  Description of Artificial Sequence: Synthetic polypeptide
DETEVIATTNPVATEQYGCVAATNDQDGNNS

SEQ ID NO: 75004 - protein, 32 aa, Artificial Sequence
  Description of Artificial Sequence: Synthetic polypeptide
AENEIRTTNPVATEQYGEASSTENLNMRGMNV

SEQ ID NO: 75005 - protein, 34 aa, Artificial Sequence
  Description of Artificial Sequence: Synthetic polypeptide
AEEEIRTTNPVATEQYGVVSTVNNLQQGTEAGNQ

SEQ ID NO: 75006 - protein, 32 aa, Artificial Sequence
  Description of Artificial Sequence: Synthetic polypeptide
AENEIRTTNPVATEQYGEASSTTNLNMRGMNV

SEQ ID NO: 75007 - protein, 31 aa, Artificial Sequence
  Description of Artificial Sequence: Synthetic polypeptide
DETEIRTTNPVAYEQYGTVATTNGQDGDGSR

SEQ ID NO: 75008 - protein, 32 aa, Artificial Sequence
  Description of Artificial Sequence: Synthetic polypeptide
MEEEISTTNPVATEQYGCVTSNTELQGGSNQS

SEQ ID NO: 75009 - protein, 32 aa, Artificial Sequence
  Description of Artificial Sequence: Synthetic polypeptide
DETEIRTTNPVAYEQWGSVSTTLNLGDSGNFG

SEQ ID NO: 75010 - protein, 33 aa, Artificial Sequence
  Description of Artificial Sequence: Synthetic polypeptide
AEEEIRTTNPVATEQYGVVSTTVNSNQQGNGNS

SEQ ID NO: 75011 - protein, 32 aa, Artificial Sequence
  Description of Artificial Sequence: Synthetic polypeptide
DETEIRTTNPVAYEQWGSVSTTGNPQNDGNAP

SEQ ID NO: 75012 - protein, 33 aa, Artificial Sequence
  Description of Artificial Sequence: Synthetic polypeptide
AEEEIRTTNPVATEQYGVVSTTVNSNQEGGNQD

SEQ ID NO: 75013 - protein, 35 aa, Artificial Sequence
  Description of Artificial Sequence: Synthetic polypeptide
DEEEIRTTNPVATEQYGSVSSTNPAGPNMRNGMNV

SEQ ID NO: 75014 - protein, 32 aa, Artificial Sequence
  Description of Artificial Sequence: Synthetic polypeptide
MEEEITTTNPVATEQYGNVSVTDLQEGGGNET

SEQ ID NO: 75015 - protein, 28 aa, Artificial Sequence
  Description of Artificial Sequence: Synthetic peptide
AENEIRTTNPVSTEPYGTISENIQRGGH

SEQ ID NO: 75016 - protein, 31 aa, Artificial Sequence
  Description of Artificial Sequence: Synthetic polypeptide
MEEEITTTNPVATEQYGNVSVTGGGQGGNQE

SEQ ID NO: 75017 - protein, 31 aa, Artificial Sequence
  Description of Artificial Sequence: Synthetic polypeptide
MEEEITTTNPVATEQYGNVSVTGGQGGGNNG

SEQ ID NO: 75018 - protein, 31 aa, Artificial Sequence
  Description of Artificial Sequence: Synthetic polypeptide
MEEEITTTNPVATEQYGQVSVTGGQGGGNQE

SEQ ID NO: 75019 - protein, 33 aa, Artificial Sequence
  Description of Artificial Sequence: Synthetic polypeptide
DETEIRTTNPVAYEQWGSVSTNNQGDRGGEGRR

SEQ ID NO: 75020 - protein, 32 aa, Artificial Sequence
  Description of Artificial Sequence: Synthetic polypeptide
DETEIRTTNPVAYEQWGSVSTNLNNGGPNLDM

SEQ ID NO: 75021 - protein, 32 aa, Artificial Sequence
  Description of Artificial Sequence: Synthetic polypeptide
MEEGIRTTNPVATEQYGAVVPSTNLETLGQFR

SEQ ID NO: 75022 - protein, 32 aa, Artificial Sequence
  Description of Artificial Sequence: Synthetic polypeptide
DETEIRTTNPVAYEQWGSVSTNLNMGGGDNND

SEQ ID NO: 75023 - protein, 33 aa, Artificial Sequence
  Description of Artificial Sequence: Synthetic polypeptide
AEEEIRTTNPVATEQYGVVSTVDNGNQQGNNQE

SEQ ID NO: 75024 - protein, 29 aa, Artificial Sequence
  Description of Artificial Sequence: Synthetic peptide
DETSIATTNPTAYEQWGSVSFNWQSGNDR

SEQ ID NO: 75025 - protein, 31 aa, Artificial Sequence
  Description of Artificial Sequence: Synthetic polypeptide
MEEEISTTNPVATEQYGCVSVTEDQGFGNQM

SEQ ID NO: 75026 - protein, 33 aa, Artificial Sequence
  Description of Artificial Sequence: Synthetic polypeptide
DETEIRTTNPVAYEQWGSVSTTNPLQQGPNEDE

SEQ ID NO: 75027 - protein, 32 aa, Artificial Sequence
  Description of Artificial Sequence: Synthetic polypeptide
DETEIRTTNPVAYEQYGTVATNLQGDLGGNQS

SEQ ID NO: 75028 - protein, 30 aa, Artificial Sequence
  Description of Artificial Sequence: Synthetic polypeptide
AENEIRTTNPVATEQYGETANEDLQRKGGR

SEQ ID NO: 75029 - protein, 34 aa, Artificial Sequence
  Description of Artificial Sequence: Synthetic polypeptide
DEEEIRTTNPVATEQYGSVQWVSNLQRSLENEIE

SEQ ID NO: 75030 - protein, 29 aa, Artificial Sequence
  Description of Artificial Sequence: Synthetic peptide
AENEIRTTNPVATEQYGEVSENEQNAEGA

SEQ ID NO: 75031 - protein, 31 aa, Artificial Sequence
  Description of Artificial Sequence: Synthetic polypeptide
AENEIRTTNPVATEQYGEVSSEPAGPNRGNR

SEQ ID NO: 75032 - protein, 32 aa, Artificial Sequence
  Description of Artificial Sequence: Synthetic polypeptide
AENEIRTTNPVATEQYGEVSSTPAGPNRGMNR

SEQ ID NO: 75033 - protein, 33 aa, Artificial Sequence
  Description of Artificial Sequence: Synthetic polypeptide
MEEEIRTTNPVAYEQYGQSVSVNDLLQPEGQIR

SEQ ID NO: 75034 - protein, 34 aa, Artificial Sequence
  Description of Artificial Sequence: Synthetic polypeptide
DETEIRTTNPVAYEQYGSVCCTGNLSYNRSGTNR

SEQ ID NO: 75035 - protein, 32 aa, Artificial Sequence
  Description of Artificial Sequence: Synthetic polypeptide
MEEEIRTTNPVGTEQYGSVSVTNGLGEGGFQT

SEQ ID NO: 75036 - protein, 34 aa, Artificial Sequence
  Description of Artificial Sequence: Synthetic polypeptide
AENEIRTTNPVATEQYGSVSSTTNLPNMRNGMNV

SEQ ID NO: 75037 - protein, 31 aa, Artificial Sequence
  Description of Artificial Sequence: Synthetic polypeptide
DETEIRTTNPVAYEQWGTVSTTNQDGNGGSR

SEQ ID NO: 75038 - protein, 31 aa, Artificial Sequence
  Description of Artificial Sequence: Synthetic polypeptide
DETEIRTTNPVAYEQWGTVSTNLQSNGDGDA

SEQ ID NO: 75039 - protein, 32 aa, Artificial Sequence
  Description of Artificial Sequence: Synthetic polypeptide
DETEIRTTNPVAYEQWGTVSTNLQGDQGGNQS

SEQ ID NO: 75040 - protein, 33 aa, Artificial Sequence
  Description of Artificial Sequence: Synthetic polypeptide
DETEIRTTNPVAYEQWGSVSTTNPQGDRGQEGR

SEQ ID NO: 75041 - protein, 35 aa, Artificial Sequence
  Description of Artificial Sequence: Synthetic polypeptide
DEEEIRTTNPVATEQYGSVSSTNNGLGNFEGGNGI

SEQ ID NO: 75042 - protein, 32 aa, Artificial Sequence
  Description of Artificial Sequence: Synthetic polypeptide
MEEEISTTNPVATEQYGCVSVTEDLQGGSNQM

SEQ ID NO: 75043 - protein, 30 aa, Artificial Sequence
  Description of Artificial Sequence: Synthetic polypeptide
DETSICTTNPCATEQWGSVSNNLQSGNNGQ

SEQ ID NO: 75044 - protein, 33 aa, Artificial Sequence
  Description of Artificial Sequence: Synthetic polypeptide
DEDEIRTTNPVATEQYGASVSTNSDNQLAQDRQ

SEQ ID NO: 75045 - protein, 31 aa, Artificial Sequence
  Description of Artificial Sequence: Synthetic polypeptide
DEDEIRTTNPVATEQYGCCATNNHQEAEGPR

SEQ ID NO: 75046 - protein, 33 aa, Artificial Sequence
  Description of Artificial Sequence: Synthetic polypeptide
DEEEIRTTNPVATEQYGSVSASNLVMNHENEAV

SEQ ID NO: 75047 - protein, 31 aa, Artificial Sequence
  Description of Artificial Sequence: Synthetic polypeptide
DETSICTTNPCATEQWGSVSTVNLQSGNNVS

SEQ ID NO: 75048 - protein, 32 aa, Artificial Sequence
  Description of Artificial Sequence: Synthetic polypeptide
DEEEIRTTNPVATEQYGSVSAPNMQELLIPDT

SEQ ID NO: 75049 - protein, 31 aa, Artificial Sequence
  Description of Artificial Sequence: Synthetic polypeptide
MEEEIMTTNPVATEQYGNVSVTAMLEGGNIM

SEQ ID NO: 75050 - protein, 33 aa, Artificial Sequence
  Description of Artificial Sequence: Synthetic polypeptide
DEEEIRTTNPVATEQYGSVSAPNIQERAQTQLI

SEQ ID NO: 75051 - protein, 30 aa, Artificial Sequence
  Description of Artificial Sequence: Synthetic polypeptide
MEEEIMTTNPVATEQYGNVSVTMSFGGENQ

SEQ ID NO: 75052 - protein, 30 aa, Artificial Sequence
  Description of Artificial Sequence: Synthetic polypeptide
DETSICTTNPCATEQWGSVSTNNTQSGNNV

SEQ ID NO: 75053 - protein, 34 aa, Artificial Sequence
  Description of Artificial Sequence: Synthetic polypeptide
DEEEIRTTNPVATEQYGSVSSTLNGESNENGGNG

SEQ ID NO: 75054 - protein, 31 aa, Artificial Sequence
  Description of Artificial Sequence: Synthetic polypeptide
MEEEIRGTNPVATEQWGTSVSTLLIDGGGNG

SEQ ID NO: 75055 - protein, 31 aa, Artificial Sequence
  Description of Artificial Sequence: Synthetic polypeptide
DEEEIRTTNPVATEQYGSVSAPLATTSIEQY

SEQ ID NO: 75056 - protein, 32 aa, Artificial Sequence
  Description of Artificial Sequence: Synthetic polypeptide
DEDEIRTTNPVATEQYGELSTLNLMQEGQDSV

SEQ ID NO: 75057 - protein, 32 aa, Artificial Sequence
  Description of Artificial Sequence: Synthetic polypeptide
DEDEIRTTNPVATEQYGELSSTNLNQEGGEDS

SEQ ID NO: 75058 - protein, 30 aa, Artificial Sequence
  Description of Artificial Sequence: Synthetic polypeptide
MEEEIRTTNPEATRQYGCVPNTDLQRGEFN

SEQ ID NO: 75059 - protein, 31 aa, Artificial Sequence
  Description of Artificial Sequence: Synthetic polypeptide
MEEEIRTTNPVATEAYGTVSVPLSQRSTERE

SEQ ID NO: 75060 - protein, 31 aa, Artificial Sequence
  Description of Artificial Sequence: Synthetic polypeptide
MEEEIRTTNPVATEGYGCTSIMNLGQGGGNG

SEQ ID NO: 75061 - protein, 29 aa, Artificial Sequence
  Description of Artificial Sequence: Synthetic peptide
DETSICTTNPTAYEQWGSVSFNWQSDGNR

SEQ ID NO: 75062 - protein, 31 aa, Artificial Sequence
  Description of Artificial Sequence: Synthetic polypeptide
DETSICTTNPCATEQWGSVSTNNNLQSGTNE

SEQ ID NO: 75063 - protein, 32 aa, Artificial Sequence
  Description of Artificial Sequence: Synthetic polypeptide
DEECLRTTNPLAYEQYGEVSCTNLSQAGGNNR

SEQ ID NO: 75064 - protein, 30 aa, Artificial Sequence
  Description of Artificial Sequence: Synthetic polypeptide
MEEEIMTTNPVATEQYGAVTVTMLQGNNNQ

SEQ ID NO: 75065 - protein, 30 aa, Artificial Sequence
  Description of Artificial Sequence: Synthetic polypeptide
DEECLRTTNPIAYEQYGCVCSTELQYGSNA

SEQ ID NO: 75066 - protein, 33 aa, Artificial Sequence
  Description of Artificial Sequence: Synthetic polypeptide
AEEEIRTTNPVATEQYGVVSVTSTTNLQDEQGV

SEQ ID NO: 75067 - protein, 33 aa, Artificial Sequence
  Description of Artificial Sequence: Synthetic polypeptide
DEEEIRTTNPVATEQYGSVSATNGVQQEVVEPE

SEQ ID NO: 75068 - protein, 33 aa, Artificial Sequence
  Description of Artificial Sequence: Synthetic polypeptide
AEEEIRTTNPVATEQYGVVSVTNQQQTQGTINE

SEQ ID NO: 75069 - protein, 31 aa, Artificial Sequence
  Description of Artificial Sequence: Synthetic polypeptide
MEEEIKTTNPVATEQYGNVSVTDGGQGGNEG

SEQ ID NO: 75070 - protein, 34 aa, Artificial Sequence
  Description of Artificial Sequence: Synthetic polypeptide
DEEEIRTTNPVATEQYGSVSATNAVLMPVGSEEY

SEQ ID NO: 75071 - protein, 31 aa, Artificial Sequence
  Description of Artificial Sequence: Synthetic polypeptide
AENEIRCTNPVATEQYGSASSTPAGQRNGNV

SEQ ID NO: 75072 - protein, 33 aa, Artificial Sequence
  Description of Artificial Sequence: Synthetic polypeptide
DEDEIRTTNPVATEQYGETTSCTNLSQRPGDPS

SEQ ID NO: 75073 - protein, 30 aa, Artificial Sequence
  Description of Artificial Sequence: Synthetic polypeptide
DEECLRTTNPIAYEQYGCVSTNHQHFGSNQ

SEQ ID NO: 75074 - protein, 29 aa, Artificial Sequence
  Description of Artificial Sequence: Synthetic peptide
DETSIRCTNPTATAQWGSVSQNLQSGDND

SEQ ID NO: 75075 - protein, 30 aa, Artificial Sequence
  Description of Artificial Sequence: Synthetic polypeptide
DETSIRCTNPLATEQWGSVSQNLQHGDNDQ

SEQ ID NO: 75076 - protein, 32 aa, Artificial Sequence
  Description of Artificial Sequence: Synthetic polypeptide
MEEEIKTTNPVATEQYGNVSVTNGGQGQGNNE

SEQ ID NO: 75077 - protein, 34 aa, Artificial Sequence
  Description of Artificial Sequence: Synthetic polypeptide
DEEEIRTTNPVATEQYGSVSATGVIQDRFNQSHQ

SEQ ID NO: 75078 - protein, 32 aa, Artificial Sequence
  Description of Artificial Sequence: Synthetic polypeptide
DEECLRTTNPIAYEQYGEVSCTNLSDRGGNNR

SEQ ID NO: 75079 - protein, 34 aa, Artificial Sequence
  Description of Artificial Sequence: Synthetic polypeptide
AEEEIRTTNPVATEQYGVVSVTNLQQQNEGTNVN

SEQ ID NO: 75080 - protein, 28 aa, Artificial Sequence
  Description of Artificial Sequence: Synthetic peptide
AENEIRCTNPVATEQYGTASMDLQQGGH

SEQ ID NO: 75081 - protein, 32 aa, Artificial Sequence
  Description of Artificial Sequence: Synthetic polypeptide
DETEIRTTNPVAYEQWGSVSTNLNGNGGNGDM

SEQ ID NO: 75082 - protein, 33 aa, Artificial Sequence
  Description of Artificial Sequence: Synthetic polypeptide
MEEEIRTTNPVATEQYGAVPATLNYEQRGNVGG

SEQ ID NO: 75083 - protein, 33 aa, Artificial Sequence
  Description of Artificial Sequence: Synthetic polypeptide
MEEEIRTTNPVATEQYGAVVEPTNANQCEGNRF

SEQ ID NO: 75084 - protein, 32 aa, Artificial Sequence
  Description of Artificial Sequence: Synthetic polypeptide
MEEEIRTTNPVATEQYGGVCCTTILVENGNFR

SEQ ID NO: 75085 - protein, 31 aa, Artificial Sequence
  Description of Artificial Sequence: Synthetic polypeptide
DETSICTTNPCATEQWGSVSTNNLQSGSNDI

SEQ ID NO: 75086 - protein, 30 aa, Artificial Sequence
  Description of Artificial Sequence: Synthetic polypeptide
DETSICTTNPCATEQWGSVSNNNLQSGSNG

SEQ ID NO: 75087 - protein, 33 aa, Artificial Sequence
  Description of Artificial Sequence: Synthetic polypeptide
MEEEIRTTNPVATEQYGSCSTTNELETQPGEQE

SEQ ID NO: 75088 - protein, 32 aa, Artificial Sequence
  Description of Artificial Sequence: Synthetic polypeptide
MEEEIRTTNPVATEQYGSCSTTNIETQPGEQI

SEQ ID NO: 75089 - protein, 33 aa, Artificial Sequence
  Description of Artificial Sequence: Synthetic polypeptide
MEEEIRTTNPVATEQYGSCSTTNLETQPGEIQG

SEQ ID NO: 75090 - protein, 30 aa, Artificial Sequence
  Description of Artificial Sequence: Synthetic polypeptide
DETSICTTNPCATEQWGSVSNNNLQSGNGT

SEQ ID NO: 75091 - protein, 31 aa, Artificial Sequence
  Description of Artificial Sequence: Synthetic polypeptide
DEECTRTTNPIAYEQYGCVSTNLQHFGSNQA

SEQ ID NO: 75092 - protein, 32 aa, Artificial Sequence
  Description of Artificial Sequence: Synthetic polypeptide
MEEEIRTTNPVATEQYGSCSTTVNNETQPGEQ

SEQ ID NO: 75093 - protein, 31 aa, Artificial Sequence
  Description of Artificial Sequence: Synthetic polypeptide
MEEEIRTTNPVATEQYGSCVINLHQGFGEAS

SEQ ID NO: 75094 - protein, 31 aa, Artificial Sequence
  Description of Artificial Sequence: Synthetic polypeptide
DEDEIRTTNPVATEQYGCSSTNHQHFGSDQS

SEQ ID NO: 75095 - protein, 31 aa, Artificial Sequence
  Description of Artificial Sequence: Synthetic polypeptide
DEDEIRTTNPVATEQYGCFAGTNHQEAEGPR

SEQ ID NO: 75096 - protein, 33 aa, Artificial Sequence
  Description of Artificial Sequence: Synthetic polypeptide
DEEEIRTTNPVATEQYGSVSALVNEEQLLVNSV

SEQ ID NO: 75097 - protein, 32 aa, Artificial Sequence
  Description of Artificial Sequence: Synthetic polypeptide
DEECVRTTNPIAYEQWGEVSCTNLSQRGGNNR

SEQ ID NO: 75098 - protein, 33 aa, Artificial Sequence
  Description of Artificial Sequence: Synthetic polypeptide
DEEEIRTTNPVATEQYGSVSALNVENAGQTLRD

SEQ ID NO: 75099 - protein, 31 aa, Artificial Sequence
  Description of Artificial Sequence: Synthetic polypeptide
DEDEIRTTNPVATEQYGCTSTELQEHFGSDQ

SEQ ID NO: 75100 - protein, 34 aa, Artificial Sequence
  Description of Artificial Sequence: Synthetic polypeptide
DEEEIRTTNPVATEQYGSVSANNMTNGEGQGNIE

SEQ ID NO: 75101 - protein, 31 aa, Artificial Sequence
  Description of Artificial Sequence: Synthetic polypeptide
MEEEIRTTNPVATEQYGCVSTVLQDMLEDEI

SEQ ID NO: 75102 - protein, 32 aa, Artificial Sequence
  Description of Artificial Sequence: Synthetic polypeptide
MEEEIRTTNPVATEQYGCVSTENHQNFNSNQS

SEQ ID NO: 75103 - protein, 33 aa, Artificial Sequence
  Description of Artificial Sequence: Synthetic polypeptide
DEEEIRTTNPVATEQYGSVSANNLQMTISQEEG

SEQ ID NO: 75104 - protein, 33 aa, Artificial Sequence
  Description of Artificial Sequence: Synthetic polypeptide
MEEEIRTTNPVATEQYGCVCSNTEHQRFGSENQ

SEQ ID NO: 75105 - protein, 34 aa, Artificial Sequence
  Description of Artificial Sequence: Synthetic polypeptide
DEEEIRTTNPVATEQYGSVSANNDEQDEGGNDGD

SEQ ID NO: 75106 - protein, 33 aa, Artificial Sequence
  Description of Artificial Sequence: Synthetic polypeptide
DEEEIRTTNPVATEQYGSVSSTNADRIDSEQQM

SEQ ID NO: 75107 - protein, 31 aa, Artificial Sequence
  Description of Artificial Sequence: Synthetic polypeptide
DEDEIRTTNPVATEQYGCWSTINPLEREPQN

SEQ ID NO: 75108 - protein, 31 aa, Artificial Sequence
  Description of Artificial Sequence: Synthetic polypeptide
DETSICTTNPCATEQWGSVSTNNNLQLSGNG

SEQ ID NO: 75109 - protein, 30 aa, Artificial Sequence
  Description of Artificial Sequence: Synthetic polypeptide
DEECNATTNPIAYEQWGEVSTNLQGAGNTR

SEQ ID NO: 75110 - protein, 29 aa, Artificial Sequence
  Description of Artificial Sequence: Synthetic peptide
DEECNATTNPIAYEQWGEVSTNLQHAGNE

SEQ ID NO: 75111 - protein, 30 aa, Artificial Sequence
  Description of Artificial Sequence: Synthetic polypeptide
DEDEIRTTNPVATEQYGCVSPNMQELDDEI

SEQ ID NO: 75112 - protein, 30 aa, Artificial Sequence
  Description of Artificial Sequence: Synthetic polypeptide
DEECNATTNPTAYEQWGEVSTNLQHAGENR

SEQ ID NO: 75113 - protein, 32 aa, Artificial Sequence
  Description of Artificial Sequence: Synthetic polypeptide
MEEEIRTTNPVATEQYGCVCSTEDHQNGSNQA

SEQ ID NO: 75114 - protein, 31 aa, Artificial Sequence
  Description of Artificial Sequence: Synthetic polypeptide
DEECSRTTNPIAYEQYGEVTSTNLLRGDETR

SEQ ID NO: 75115 - protein, 31 aa, Artificial Sequence
  Description of Artificial Sequence: Synthetic polypeptide
MEEEIRTTNPVATEQYGCVCSTEDQNFGSDQ

SEQ ID NO: 75116 - protein, 34 aa, Artificial Sequence
  Description of Artificial Sequence: Synthetic polypeptide
DEDEIRTTNPVATEQYGCVCSTDNLGDHNGDNER

SEQ ID NO: 75117 - protein, 31 aa, Artificial Sequence
  Description of Artificial Sequence: Synthetic polypeptide
DEDEIRTTNPVATEQYGCVAANLQAEPSGDE

SEQ ID NO: 75118 - protein, 35 aa, Artificial Sequence
  Description of Artificial Sequence: Synthetic polypeptide
DEEEIRTTNPVATEQYGSVSSTNGFGQGNQGTNIF

SEQ ID NO: 75119 - protein, 31 aa, Artificial Sequence
  Description of Artificial Sequence: Synthetic polypeptide
DETEIRTTNPVAYEQWGSVSTNLNGEDGDEM

SEQ ID NO: 75120 - protein, 31 aa, Artificial Sequence
  Description of Artificial Sequence: Synthetic polypeptide
DETEIRTTNPVAYEQWGSVSTNLNGDPNGDM

SEQ ID NO: 75121 - protein, 31 aa, Artificial Sequence
  Description of Artificial Sequence: Synthetic polypeptide
DETEIRTTNPVAYEQWGSVSTNLNGDGGTEM

SEQ ID NO: 75122 - protein, 35 aa, Artificial Sequence
  Description of Artificial Sequence: Synthetic polypeptide
DEEEIRTTNPVATEQYGSVQSVTNLPQNVNFDIDP

SEQ ID NO: 75123 - protein, 34 aa, Artificial Sequence
  Description of Artificial Sequence: Synthetic polypeptide
DEEEIRTTNPVATEQYGSVQSVTLNEQELINDQM

SEQ ID NO: 75124 - protein, 32 aa, Artificial Sequence
  Description of Artificial Sequence: Synthetic polypeptide
NEAEIATTNPVATEQYGSVCWTDNHHQGGNSR

SEQ ID NO: 75125 - protein, 30 aa, Artificial Sequence
  Description of Artificial Sequence: Synthetic polypeptide
NEAEIATTNPVATEQYGSVCWTDNHQIGSA

SEQ ID NO: 75126 - protein, 31 aa, Artificial Sequence
  Description of Artificial Sequence: Synthetic polypeptide
NEAEIATTNPVATEQYGSVCWTDNHQVGSER

SEQ ID NO: 75127 - protein, 32 aa, Artificial Sequence
  Description of Artificial Sequence: Synthetic polypeptide
AENEIVTTNPVATEQYGTVCSAEDGLVQRGNR

SEQ ID NO: 75128 - protein, 28 aa, Artificial Sequence
  Description of Artificial Sequence: Synthetic peptide
AENELACTNPVATEQYGEASENLQAGGR

SEQ ID NO: 75129 - protein, 36 aa, Artificial Sequence
  Description of Artificial Sequence: Synthetic polypeptide
DEEEIRTTNPVATEQYGSVQSTYSLEVSRMGMNERD

SEQ ID NO: 75130 - protein, 29 aa, Artificial Sequence
  Description of Artificial Sequence: Synthetic peptide
AENELACTNPVATEQYGEASENLQRGGQR

SEQ ID NO: 75131 - protein, 28 aa, Artificial Sequence
  Description of Artificial Sequence: Synthetic peptide
AENELACTNPVATEQYGEASENTQRGGR

SEQ ID NO: 75132 - protein, 28 aa, Artificial Sequence
  Description of Artificial Sequence: Synthetic peptide
AENEVACTNPVATEGYGEASENLQRGGR

SEQ ID NO: 75133 - protein, 29 aa, Artificial Sequence
  Description of Artificial Sequence: Synthetic peptide
AENEVACTNPVATEQYGEASDENLQRGGR

SEQ ID NO: 75134 - protein, 31 aa, Artificial Sequence
  Description of Artificial Sequence: Synthetic polypeptide
NEAEIRTTNPVATEMWGAVSTNLQHAGGNDA

SEQ ID NO: 75135 - protein, 29 aa, Artificial Sequence
  Description of Artificial Sequence: Synthetic peptide
AENEVACTNPVATEQYGEASNNLQRVGGR

SEQ ID NO: 75136 - protein, 35 aa, Artificial Sequence
  Description of Artificial Sequence: Synthetic polypeptide
DEEEIRTTNPVATEQYGSVQSTTNLQATIGEEEML

SEQ ID NO: 75137 - protein, 34 aa, Artificial Sequence
  Description of Artificial Sequence: Synthetic polypeptide
DEEEIRTTNPVATEQYGSVQSVTPGLQVHVQARE

SEQ ID NO: 75138 - protein, 34 aa, Artificial Sequence
  Description of Artificial Sequence: Synthetic polypeptide
DEEEIRTTNPVATEQYGSVQSTTNGEQALSVENT

SEQ ID NO: 75139 - protein, 34 aa, Artificial Sequence
  Description of Artificial Sequence: Synthetic polypeptide
AEEEIRTTNPVATEQYGVVSTTNNQLQTGINNVT

SEQ ID NO: 75140 - protein, 32 aa, Artificial Sequence
  Description of Artificial Sequence: Synthetic polypeptide
DEEEIRTTNPVATEQYGSVQSWMEDDGRNEEA

SEQ ID NO: 75141 - protein, 32 aa, Artificial Sequence
  Description of Artificial Sequence: Synthetic polypeptide
NDEEIRTTNPVATEQYGCVCSTNDNQNGSNQS

SEQ ID NO: 75142 - protein, 32 aa, Artificial Sequence
  Description of Artificial Sequence: Synthetic polypeptide
NDEEIRTTNPVATEQYGCVSTNLNQNFGSDQS

SEQ ID NO: 75143 - protein, 30 aa, Artificial Sequence
  Description of Artificial Sequence: Synthetic polypeptide
AENEIVTTNPVATEQYGEASTDGPVQRGGR

SEQ ID NO: 75144 - protein, 31 aa, Artificial Sequence
  Description of Artificial Sequence: Synthetic polypeptide
DETEIRTTNPVATEQYGVVSSTVLLQFPEMD

SEQ ID NO: 75145 - protein, 30 aa, Artificial Sequence
  Description of Artificial Sequence: Synthetic polypeptide
AENEIVTTNPVATEQYGEASTDGPVQRGND

SEQ ID NO: 75146 - protein, 34 aa, Artificial Sequence
  Description of Artificial Sequence: Synthetic polypeptide
DEEEIRTTNPVATEQYGSVSSTTGDQGGDGNQQG

SEQ ID NO: 75147 - protein, 31 aa, Artificial Sequence
  Description of Artificial Sequence: Synthetic polypeptide
NDEEIRTTNPVATEQYGVVCSTELQENGSQQ

SEQ ID NO: 75148 - protein, 32 aa, Artificial Sequence
  Description of Artificial Sequence: Synthetic polypeptide
NDEEIRTTNPVATEQYGVVCSTGNLQNGSEQS

SEQ ID NO: 75149 - protein, 35 aa, Artificial Sequence
  Description of Artificial Sequence: Synthetic polypeptide
DEEEIRTTNPVATEQYGSVSSTTIAEPQMRNGENV

SEQ ID NO: 75150 - protein, 30 aa, Artificial Sequence
  Description of Artificial Sequence: Synthetic polypeptide
AENEIVTTNPVATEQYGEASTNPVEFEGNR

SEQ ID NO: 75151 - protein, 32 aa, Artificial Sequence
  Description of Artificial Sequence: Synthetic polypeptide
AENEIVTTNPVATEQYGEVCSAEDGLVQRGNR

SEQ ID NO: 75152 - protein, 35 aa, Artificial Sequence
  Description of Artificial Sequence: Synthetic polypeptide
DEEEIRTTNPVATEQYGSVSSTTIAGPQMRNGMNG

SEQ ID NO: 75153 - protein, 34 aa, Artificial Sequence
  Description of Artificial Sequence: Synthetic polypeptide
DEEEIRTTNPVATEQYGSVSSTTIENMAAGMNPA

SEQ ID NO: 75154 - protein, 34 aa, Artificial Sequence
  Description of Artificial Sequence: Synthetic polypeptide
DEEEIRTTNPVATEQYGSVSSTTIGNMRAGMNPV

SEQ ID NO: 75155 - protein, 33 aa, Artificial Sequence
  Description of Artificial Sequence: Synthetic polypeptide
DEEEIRTTNPVATEQYGSVQSWMLDEQRNEEHN

SEQ ID NO: 75156 - protein, 33 aa, Artificial Sequence
  Description of Artificial Sequence: Synthetic polypeptide
DEEEIRTTNPVATEQYGSVQSWMEDDGRGEEER

SEQ ID NO: 75157 - protein, 32 aa, Artificial Sequence
  Description of Artificial Sequence: Synthetic polypeptide
DETEIRTTNPVATETWGSVSTNLNGDTGGNGS

SEQ ID NO: 75158 - protein, 33 aa, Artificial Sequence
  Description of Artificial Sequence: Synthetic polypeptide
DEEEIRTTNPVATEQYGSVQSTTLQDTEVPIIQ

SEQ ID NO: 75159 - protein, 32 aa, Artificial Sequence
  Description of Artificial Sequence: Synthetic polypeptide
NEAEIRTTNPVATEMYGEVSTNLQGNEGNNDS

SEQ ID NO: 75160 - protein, 31 aa, Artificial Sequence
  Description of Artificial Sequence: Synthetic polypeptide
DEEEIACTNPVATEQYGCVATNLQAEAEANE

SEQ ID NO: 75161 - protein, 31 aa, Artificial Sequence
  Description of Artificial Sequence: Synthetic polypeptide
DEEEIACTNPVATEQYGCVATNLQAEAENGY

SEQ ID NO: 75162 - protein, 30 aa, Artificial Sequence
  Description of Artificial Sequence: Synthetic polypeptide
DEEEIACTNPVATEQYGCVATNLQAEAMMN

SEQ ID NO: 75163 - protein, 31 aa, Artificial Sequence
  Description of Artificial Sequence: Synthetic polypeptide
DEEEIACTNPVATEQYGCVATNLQAEDDGDQ

SEQ ID NO: 75164 - protein, 31 aa, Artificial Sequence
  Description of Artificial Sequence: Synthetic polypeptide
DEEEIACTNPVATEQYGCVATNLQAEDDQNH

SEQ ID NO: 75165 - protein, 32 aa, Artificial Sequence
  Description of Artificial Sequence: Synthetic polypeptide
DEEEIACTNPVATEQYGCVATNLQAEDDTNRG

SEQ ID NO: 75166 - protein, 34 aa, Artificial Sequence
  Description of Artificial Sequence: Synthetic polypeptide
DEEEIRTTNPVATEQYGSVQSTNLPMNEGMEVLD

SEQ ID NO: 75167 - protein, 31 aa, Artificial Sequence
  Description of Artificial Sequence: Synthetic polypeptide
DEEEIACTNPVATEQYGCVATNLQANDDTRV

SEQ ID NO: 75168 - protein, 31 aa, Artificial Sequence
  Description of Artificial Sequence: Synthetic polypeptide
DEEEIACTNPVATEQYGCVATNLQANNPNVD

SEQ ID NO: 75169 - protein, 35 aa, Artificial Sequence
  Description of Artificial Sequence: Synthetic polypeptide
DEEEIRTTNPVATEQYGSVSSTTPAEPQMRNGENV

SEQ ID NO: 75170 - protein, 31 aa, Artificial Sequence
  Description of Artificial Sequence: Synthetic polypeptide
DEEEIACTNPVATEQYGCVATNLQAPAEAGN

SEQ ID NO: 75171 - protein, 35 aa, Artificial Sequence
  Description of Artificial Sequence: Synthetic polypeptide
DEEEIRTTNPVATEQYGSVSSTTPAEPQMRNGMNV

SEQ ID NO: 75172 - protein, 29 aa, Artificial Sequence
  Description of Artificial Sequence: Synthetic peptide
AENIIACTNPVATEQYGEASENLQRIGGR

SEQ ID NO: 75173 - protein, 28 aa, Artificial Sequence
  Description of Artificial Sequence: Synthetic peptide
AENIIACTNPVATFQYGEASENLQRGGR

SEQ ID NO: 75174 - protein, 28 aa, Artificial Sequence
  Description of Artificial Sequence: Synthetic peptide
AENIIACTNPVSTEQYGEASENLQRGGR

SEQ ID NO: 75175 - protein, 31 aa, Artificial Sequence
  Description of Artificial Sequence: Synthetic polypeptide
DEEEIACTNPVATEQYGCVATNLQADDPNEN

SEQ ID NO: 75176 - protein, 34 aa, Artificial Sequence
  Description of Artificial Sequence: Synthetic polypeptide
DEEEIRTTNPVATEQYGSVSSTTNGNMSNGMNPV

SEQ ID NO: 75177 - protein, 32 aa, Artificial Sequence
  Description of Artificial Sequence: Synthetic polypeptide
DEEEIACTNPVATEQYGCVATNLQAAPGENNH

SEQ ID NO: 75178 - protein, 28 aa, Artificial Sequence
  Description of Artificial Sequence: Synthetic peptide
AENIIACTNPVATEQYGEASENLQRGGL

SEQ ID NO: 75179 - protein, 30 aa, Artificial Sequence
  Description of Artificial Sequence: Synthetic polypeptide
AENEVACTNPVATEQYGEVSNNLQSRVGQR

SEQ ID NO: 75180 - protein, 34 aa, Artificial Sequence
  Description of Artificial Sequence: Synthetic polypeptide
DEEEIRTTNPVATEQYGSVQSTPNLQTQEVEVQQ

SEQ ID NO: 75181 - protein, 29 aa, Artificial Sequence
  Description of Artificial Sequence: Synthetic peptide
AENEVACTNPVATEQYGNVAAENLQRGQR

SEQ ID NO: 75182 - protein, 30 aa, Artificial Sequence
  Description of Artificial Sequence: Synthetic polypeptide
NEAEIRTTNPVATEQYGSVSAWDLDEFQER

SEQ ID NO: 75183 - protein, 33 aa, Artificial Sequence
  Description of Artificial Sequence: Synthetic polypeptide
DETEIRTTNPVATEQYGSVSYPNYLQLVIENVD

SEQ ID NO: 75184 - protein, 34 aa, Artificial Sequence
  Description of Artificial Sequence: Synthetic polypeptide
AEEEIRTTNPVATEQYGVVSTTNNLTNQNGNNNG

SEQ ID NO: 75185 - protein, 34 aa, Artificial Sequence
  Description of Artificial Sequence: Synthetic polypeptide
AEEEIRTTNPVATEQYGVVSTTNNLQQQQTGNVE

SEQ ID NO: 75186 - protein, 33 aa, Artificial Sequence
  Description of Artificial Sequence: Synthetic polypeptide
DETEIRTTNPVATEQYGSVSTTSNPGNHGDNGP

SEQ ID NO: 75187 - protein, 33 aa, Artificial Sequence
  Description of Artificial Sequence: Synthetic polypeptide
DETEIRTTNPVATEQYGSVSTTSNPGGNHGNDP

SEQ ID NO: 75188 - protein, 29 aa, Artificial Sequence
  Description of Artificial Sequence: Synthetic peptide
AENEVASTNPVATEQYGNASENLQSRGGR

SEQ ID NO: 75189 - protein, 35 aa, Artificial Sequence
  Description of Artificial Sequence: Synthetic polypeptide
DEEEIRTTNPVATEQYGSVQSTNVLVQNNENLEQP

SEQ ID NO: 75190 - protein, 31 aa, Artificial Sequence
  Description of Artificial Sequence: Synthetic polypeptide
NEAEIRTTNPVAYEAYGSVWTNELSQIGGSR

SEQ ID NO: 75191 - protein, 34 aa, Artificial Sequence
  Description of Artificial Sequence: Synthetic polypeptide
AEEEIRTTNPVATEQYGVVSTTNLQQQQIGNNNA

SEQ ID NO: 75192 - protein, 30 aa, Artificial Sequence
  Description of Artificial Sequence: Synthetic polypeptide
DEEEIACTNPVATEQYGCVATNLDDQNEEA

SEQ ID NO: 75193 - protein, 31 aa, Artificial Sequence
  Description of Artificial Sequence: Synthetic polypeptide
DEEEIACTNPVATEQYGCVATNLQAAAEENN

SEQ ID NO: 75194 - protein, 31 aa, Artificial Sequence
  Description of Artificial Sequence: Synthetic polypeptide
DEEEIACTNPVATEQYGCVATNLQAAENDGN

SEQ ID NO: 75195 - protein, 29 aa, Artificial Sequence
  Description of Artificial Sequence: Synthetic peptide
AENKIACTNPVATEQYGEAHSENLQRGGR

SEQ ID NO: 75196 - protein, 33 aa, Artificial Sequence
  Description of Artificial Sequence: Synthetic polypeptide
AEEEIRTTNPVATEQYGVVSTTNNSNQEGGNQT

SEQ ID NO: 75197 - protein, 32 aa, Artificial Sequence
  Description of Artificial Sequence: Synthetic polypeptide
DEEEIRTTNPVATEQYGSVQTDWVQEEEHDRE

SEQ ID NO: 75198 - protein, 34 aa, Artificial Sequence
  Description of Artificial Sequence: Synthetic polypeptide
DEEEIRTTNPVATEQYGSVSSTPALPNMSGMNPV

SEQ ID NO: 75199 - protein, 32 aa, Artificial Sequence
  Description of Artificial Sequence: Synthetic polypeptide
MEHEIVTVNPVATEQYGSVSTNLQFGEGGNTT

SEQ ID NO: 75200 - protein, 35 aa, Artificial Sequence
  Description of Artificial Sequence: Synthetic polypeptide
DEEEIRTTNPVATEQYGSVQTTENLEERQNPEGRL

SEQ ID NO: 75201 - protein, 34 aa, Artificial Sequence
  Description of Artificial Sequence: Synthetic polypeptide
DEEEIRTTNPVATEQYGSVQTTELQPEFNEQVRL

SEQ ID NO: 75202 - protein, 32 aa, Artificial Sequence
  Description of Artificial Sequence: Synthetic polypeptide
DETEIRTTNPVAYEQWGSVATNNQGDRGGEGR

SEQ ID NO: 75203 - protein, 34 aa, Artificial Sequence
  Description of Artificial Sequence: Synthetic polypeptide
DEEEIRTTNPVATEQYGSVSSTPEMNQGTGENSV

SEQ ID NO: 75204 - protein, 29 aa, Artificial Sequence
  Description of Artificial Sequence: Synthetic peptide
MENEIACTNPVATEQYGELASENAQRGGR

SEQ ID NO: 75205 - protein, 33 aa, Artificial Sequence
  Description of Artificial Sequence: Synthetic polypeptide
DEEEIRTTNPVATEQYGSVSSTPNADRIDSEDM

SEQ ID NO: 75206 - protein, 33 aa, Artificial Sequence
  Description of Artificial Sequence: Synthetic polypeptide
AEEEIRTTNPVATEQYGVVSTTQNSNQGNGNNQ

SEQ ID NO: 75207 - protein, 31 aa, Artificial Sequence
  Description of Artificial Sequence: Synthetic polypeptide
DETEIRTTNPVAYEQWGNVSTNLQGNDDNQS

SEQ ID NO: 75208 - protein, 33 aa, Artificial Sequence
  Description of Artificial Sequence: Synthetic polypeptide
MENEIRTTNPVATEQYGSVFDTANLEDRGENQQ

SEQ ID NO: 75209 - protein, 33 aa, Artificial Sequence
  Description of Artificial Sequence: Synthetic polypeptide
AEEEIRTTNPVATEQYGVVSTTQNLQIGTTEES

SEQ ID NO: 75210 - protein, 35 aa, Artificial Sequence
  Description of Artificial Sequence: Synthetic polypeptide
DEEEIRTTNPVATEQYGSVSSTPPAQPNMRNGMNV

SEQ ID NO: 75211 - protein, 30 aa, Artificial Sequence
  Description of Artificial Sequence: Synthetic polypeptide
DETEIRTTNPVAYEQWGNVSTNGDGNGNQS

SEQ ID NO: 75212 - protein, 30 aa, Artificial Sequence
  Description of Artificial Sequence: Synthetic polypeptide
DETEIRTTNPVAYEQWGNVSTNDGNGHNQS

SEQ ID NO: 75213 - protein, 35 aa, Artificial Sequence
  Description of Artificial Sequence: Synthetic polypeptide
DEEEIRTTNPVATEQYGSVSSTPAGPQQRNGMNPV

SEQ ID NO: 75214 - protein, 31 aa, Artificial Sequence
  Description of Artificial Sequence: Synthetic polypeptide
MENEIRTTNPVATEQYGVVSAELQRSQNIDG

SEQ ID NO: 75215 - protein, 35 aa, Artificial Sequence
  Description of Artificial Sequence: Synthetic polypeptide
DEEEIRTTNPVATEQYGSVSSTPAGPQMRNGMNPV

SEQ ID NO: 75216 - protein, 32 aa, Artificial Sequence
  Description of Artificial Sequence: Synthetic polypeptide
DEEEIACTNPVATEAYGSVVNCTNLSQSTGER

SEQ ID NO: 75217 - protein, 32 aa, Artificial Sequence
  Description of Artificial Sequence: Synthetic polypeptide
DETEIRTTNPVAYEQWGSVSTNLNGDGDNEEM

SEQ ID NO: 75218 - protein, 32 aa, Artificial Sequence
  Description of Artificial Sequence: Synthetic polypeptide
DETEIRTTNPVAYEQWGSVSTNLNDGQGNDEM

SEQ ID NO: 75219 - protein, 32 aa, Artificial Sequence
  Description of Artificial Sequence: Synthetic polypeptide
DETEIRTTNPVAYEQWGSVSTNLNAGGGNDEM

SEQ ID NO: 75220 - protein, 29 aa, Artificial Sequence
  Description of Artificial Sequence: Synthetic peptide
AENEIRTTNPVSTEQYGTASMNLQQQGGH

SEQ ID NO: 75221 - protein, 34 aa, Artificial Sequence
  Description of Artificial Sequence: Synthetic polypeptide
DEEEIRTTNPVATEQYGSVSSTPAENMRNGMNPV

SEQ ID NO: 75222 - protein, 31 aa, Artificial Sequence
  Description of Artificial Sequence: Synthetic polypeptide
DETEIRTTNPVAYEQWGSVSTDQGDRGGEGR

SEQ ID NO: 75223 - protein, 34 aa, Artificial Sequence
  Description of Artificial Sequence: Synthetic polypeptide
DEEEIRTTNPVATEQYGSVSSTPAGNMRAGMNPV

SEQ ID NO: 75224 - protein, 34 aa, Artificial Sequence
  Description of Artificial Sequence: Synthetic polypeptide
AEEEIRTTNPVATEQYGVVSTTTNLQQGTEAGNQ

SEQ ID NO: 75225 - protein, 32 aa, Artificial Sequence
  Description of Artificial Sequence: Synthetic polypeptide
DEEEIRTTNPVATEQYGSVQTVTQQRDASEVV

SEQ ID NO: 75226 - protein, 33 aa, Artificial Sequence
  Description of Artificial Sequence: Synthetic polypeptide
DETEIRTTNPVAYEQWGSVSTANPEQGQMGNER

SEQ ID NO: 75227 - protein, 31 aa, Artificial Sequence
  Description of Artificial Sequence: Synthetic polypeptide
DETEIRTTNPVAYEQWGSVSTANPEQGMDQR

SEQ ID NO: 75228 - protein, 34 aa, Artificial Sequence
  Description of Artificial Sequence: Synthetic polypeptide
DEEEIRTTNPVATEQYGSVSSTPAGNMRNGMNPV

SEQ ID NO: 75229 - protein, 33 aa, Artificial Sequence
  Description of Artificial Sequence: Synthetic polypeptide
DEEEIRTTNPVATEQYGSVQTTSNLIQGELKVL

SEQ ID NO: 75230 - protein, 35 aa, Artificial Sequence
  Description of Artificial Sequence: Synthetic polypeptide
MEGEIRTTNPVATEQYGSVSPTSNLDQRIGENYQI

SEQ ID NO: 75231 - protein, 33 aa, Artificial Sequence
  Description of Artificial Sequence: Synthetic polypeptide
DEEEIRTTNPVATEQYGSVQTTNLQTPLPAETQ

SEQ ID NO: 75232 - protein, 34 aa, Artificial Sequence
  Description of Artificial Sequence: Synthetic polypeptide
DEEEIRTTNPVATEQYGSVSSTPAGPNRNGMNPV

SEQ ID NO: 75233 - protein, 33 aa, Artificial Sequence
  Description of Artificial Sequence: Synthetic polypeptide
AEEEIRTTNPVATEQYGVVSTTNNSNQGGNQQG

SEQ ID NO: 75234 - protein, 31 aa, Artificial Sequence
  Description of Artificial Sequence: Synthetic polypeptide
DETEIRTTNPVAYEQWGEVATNLQHNGDNGS

SEQ ID NO: 75235 - protein, 31 aa, Artificial Sequence
  Description of Artificial Sequence: Synthetic polypeptide
MEQEIRTTNPVATEQYGCVSPTNLENGEQSD

SEQ ID NO: 75236 - protein, 32 aa, Artificial Sequence
  Description of Artificial Sequence: Synthetic polypeptide
MESEIRTTNPVATEQYGSVSTNLLENSENGQD

SEQ ID NO: 75237 - protein, 32 aa, Artificial Sequence
  Description of Artificial Sequence: Synthetic polypeptide
AEEEIRTTNPVATEQYGVVSTTNSGTNPGNNT

SEQ ID NO: 75238 - protein, 35 aa, Artificial Sequence
  Description of Artificial Sequence: Synthetic polypeptide
DEEEIRTTNPVATEQYGSVSSTTAGPNMRNGMNPR

SEQ ID NO: 75239 - protein, 33 aa, Artificial Sequence
  Description of Artificial Sequence: Synthetic polypeptide
AEEEIRTTNPVATEQYGVVSTTNQSNQEGGNTQ

SEQ ID NO: 75240 - protein, 34 aa, Artificial Sequence
  Description of Artificial Sequence: Synthetic polypeptide
DEEEIRTTNPVATEQYGSVSSTTAGPNRNGMNPV

SEQ ID NO: 75241 - protein, 33 aa, Artificial Sequence
  Description of Artificial Sequence: Synthetic polypeptide
DETEIRTTNPVAVEQYGSVISTQNGLERNNEGE

SEQ ID NO: 75242 - protein, 33 aa, Artificial Sequence
  Description of Artificial Sequence: Synthetic polypeptide
DETEIRTTNPVAVEQYGSVISTQNGLEEGGNNG

SEQ ID NO: 75243 - protein, 34 aa, Artificial Sequence
  Description of Artificial Sequence: Synthetic polypeptide
DEEEIRTTNPVATEQYGSVSSTTCGPNMRGMNPV

SEQ ID NO: 75244 - protein, 33 aa, Artificial Sequence
  Description of Artificial Sequence: Synthetic polypeptide
DETEIRTTNPVAVEQYGSVISTNGGQEGGNGNG

SEQ ID NO: 75245 - protein, 30 aa, Artificial Sequence
  Description of Artificial Sequence: Synthetic polypeptide
NAEEIATTNPVATEQYGCVATNLQADTPND

SEQ ID NO: 75246 - protein, 33 aa, Artificial Sequence
  Description of Artificial Sequence: Synthetic polypeptide
DEEEIACTNPVATEQWGSVATNLEVQEGGNPRE

SEQ ID NO: 75247 - protein, 33 aa, Artificial Sequence
  Description of Artificial Sequence: Synthetic polypeptide
DEDEIRTTNPVATEPYGSVCATNLDTDRGGNDA

SEQ ID NO: 75248 - protein, 33 aa, Artificial Sequence
  Description of Artificial Sequence: Synthetic polypeptide
DEEEIRTTNPVATEQYGSVQTGNGEMRDGEEMM

SEQ ID NO: 75249 - protein, 29 aa, Artificial Sequence
  Description of Artificial Sequence: Synthetic peptide
AENEITCTNPVATEQYGEASENGQDRGGR

SEQ ID NO: 75250 - protein, 33 aa, Artificial Sequence
  Description of Artificial Sequence: Synthetic polypeptide
DEEEIRTTNPVATEQYGSVQTELEVQQDGLVGT

SEQ ID NO: 75251 - protein, 35 aa, Artificial Sequence
  Description of Artificial Sequence: Synthetic polypeptide
MESEIRTTNPVATEQYGSVSPTVNWLDQRIGENYQ

SEQ ID NO: 75252 - protein, 29 aa, Artificial Sequence
  Description of Artificial Sequence: Synthetic peptide
AENEISCTNPVATEQYGEASMNLQVGGDR

SEQ ID NO: 75253 - protein, 34 aa, Artificial Sequence
  Description of Artificial Sequence: Synthetic polypeptide
DEEEIRTTNPVATEQYGSVSSTTAGPEDREGNPL

SEQ ID NO: 75254 - protein, 33 aa, Artificial Sequence
  Description of Artificial Sequence: Synthetic polypeptide
DEEEIRTTNPVATEQYGSVSSTTAGNMRNGMGV

SEQ ID NO: 75255 - protein, 32 aa, Artificial Sequence
  Description of Artificial Sequence: Synthetic polypeptide
DETEIRTTNPVAYEHWGSVSTNLQGDLGNNGV

SEQ ID NO: 75256 - protein, 32 aa, Artificial Sequence
  Description of Artificial Sequence: Synthetic polypeptide
DETEIRTTNPVAYEHWGSVSTNLQGDLGNEGE

SEQ ID NO: 75257 - protein, 33 aa, Artificial Sequence
  Description of Artificial Sequence: Synthetic polypeptide
DEEEIRTTNPVATEQYGSVSSTQVIQPRPVEET

SEQ ID NO: 75258 - protein, 31 aa, Artificial Sequence
  Description of Artificial Sequence: Synthetic polypeptide
MEREIRTTNPVATEAYGSVTTGEQLGGFNTR

SEQ ID NO: 75259 - protein, 31 aa, Artificial Sequence
  Description of Artificial Sequence: Synthetic polypeptide
DETEIRTTNPVAYEHWGSVATNLQGDAGNGS

SEQ ID NO: 75260 - protein, 31 aa, Artificial Sequence
  Description of Artificial Sequence: Synthetic polypeptide
DETEIRTTNPVAYEHWGEVSTNLQGDLGNGG

SEQ ID NO: 75261 - protein, 30 aa, Artificial Sequence
  Description of Artificial Sequence: Synthetic polypeptide
DEDEIRTTNPVATEQWGCCATNHQAEGPRE

SEQ ID NO: 75262 - protein, 31 aa, Artificial Sequence
  Description of Artificial Sequence: Synthetic polypeptide
DETEIRTTNPVAYEEWGVVTTNLQGDGDTNR

SEQ ID NO: 75263 - protein, 32 aa, Artificial Sequence
  Description of Artificial Sequence: Synthetic polypeptide
DETEIRTTNPVAYEEWGSVSTNLQGDLGGNGS

SEQ ID NO: 75264 - protein, 32 aa, Artificial Sequence
  Description of Artificial Sequence: Synthetic polypeptide
DETEIRTTNPVAYECWGSVSTNLQGDHGNDGS

SEQ ID NO: 75265 - protein, 34 aa, Artificial Sequence
  Description of Artificial Sequence: Synthetic polypeptide
MESEIRTTNPVATEQYGSVSPTINLDQRIDENFQ

SEQ ID NO: 75266 - protein, 34 aa, Artificial Sequence
  Description of Artificial Sequence: Synthetic polypeptide
MESEIRTTNPVATEQYGSVSPTKNLDQRIGEDYQ

SEQ ID NO: 75267 - protein, 31 aa, Artificial Sequence
  Description of Artificial Sequence: Synthetic polypeptide
DETEIRTTNPVAYEAWGVVTTNLQGDGDNRD

SEQ ID NO: 75268 - protein, 31 aa, Artificial Sequence
  Description of Artificial Sequence: Synthetic polypeptide
DETEIRTTNPVAYEAWGVVTTNLQADGDNDR

SEQ ID NO: 75269 - protein, 33 aa, Artificial Sequence
  Description of Artificial Sequence: Synthetic polypeptide
DEEEIRTTNPVATEQYGSVQTNLNVPDMGPSEG

SEQ ID NO: 75270 - protein, 34 aa, Artificial Sequence
  Description of Artificial Sequence: Synthetic polypeptide
DEEEIRTTNPVATEQYGSVSSTTAGNMRNGMNPV

SEQ ID NO: 75271 - protein, 35 aa, Artificial Sequence
  Description of Artificial Sequence: Synthetic polypeptide
DEEEIRTTNPVATEQYGSVSSTTPAGQMRNGMNPV

SEQ ID NO: 75272 - protein, 33 aa, Artificial Sequence
  Description of Artificial Sequence: Synthetic polypeptide
DEDEIRTTNPVATEIYGSVSTNQNLQQGTTTTE

SEQ ID NO: 75273 - protein, 32 aa, Artificial Sequence
  Description of Artificial Sequence: Synthetic polypeptide
NEEEIRTTNPVATEQYGSVCSTGDLGQGEQGE

SEQ ID NO: 75274 - protein, 32 aa, Artificial Sequence
  Description of Artificial Sequence: Synthetic polypeptide
DEDEIRTTNPCATEQYGSVSTNLNGDAGGDTD

SEQ ID NO: 75275 - protein, 33 aa, Artificial Sequence
  Description of Artificial Sequence: Synthetic polypeptide
DEEEIRTTNPVATEQYGSVNTDTGNLIGEFNIN

SEQ ID NO: 75276 - protein, 34 aa, Artificial Sequence
  Description of Artificial Sequence: Synthetic polypeptide
AEEEIRTTNPVATEQYGSVVVTTNLLGNQAGNND

SEQ ID NO: 75277 - protein, 33 aa, Artificial Sequence
  Description of Artificial Sequence: Synthetic polypeptide
AEEEIRTTNPVATEQYGSVVVTTNLGGNNGNED

SEQ ID NO: 75278 - protein, 31 aa, Artificial Sequence
  Description of Artificial Sequence: Synthetic polypeptide
DEEEIRTTNPVATEQYGSVNTDMEQDNDIMH

SEQ ID NO: 75279 - protein, 31 aa, Artificial Sequence
  Description of Artificial Sequence: Synthetic polypeptide
DEEEIACTNPVATESYGSVATNLQANTNTDE

SEQ ID NO: 75280 - protein, 30 aa, Artificial Sequence
  Description of Artificial Sequence: Synthetic polypeptide
NEYEIRTTNPVATEQYGEAVETANLEIGST

SEQ ID NO: 75281 - protein, 33 aa, Artificial Sequence
  Description of Artificial Sequence: Synthetic polypeptide
AEEEIRTTNPVATEQYGSVVVTTNLGGNGNNDD

SEQ ID NO: 75282 - protein, 34 aa, Artificial Sequence
  Description of Artificial Sequence: Synthetic polypeptide
DEEEIRTTNPVATEQYGSVNTANMNNQGTGGENI

SEQ ID NO: 75283 - protein, 34 aa, Artificial Sequence
  Description of Artificial Sequence: Synthetic polypeptide
AEEEIRTTNPVATEQYGSVVVTTNGNLQQGTNIE

SEQ ID NO: 75284 - protein, 33 aa, Artificial Sequence
  Description of Artificial Sequence: Synthetic polypeptide
DEDEIRTTNPCATEQYGSVATNLNQGDQGQNQE

SEQ ID NO: 75285 - protein, 33 aa, Artificial Sequence
  Description of Artificial Sequence: Synthetic polypeptide
AEEEIRTTNPVATEQYGSVVVTTDQNQQIGTNL

SEQ ID NO: 75286 - protein, 32 aa, Artificial Sequence
  Description of Artificial Sequence: Synthetic polypeptide
NNEEIRTTNPVATEQYGCVTVSTLNLQEMPNK

SEQ ID NO: 75287 - protein, 34 aa, Artificial Sequence
  Description of Artificial Sequence: Synthetic polypeptide
DEEEIRTTNPVATEQYGSVNSVTMTQGQEGGGNQ

SEQ ID NO: 75288 - protein, 34 aa, Artificial Sequence
  Description of Artificial Sequence: Synthetic polypeptide
DEEEIRTTNPVATEQYGSVNTDDGNLTEGNNEDN

SEQ ID NO: 75289 - protein, 31 aa, Artificial Sequence
  Description of Artificial Sequence: Synthetic polypeptide
NEYEIRCTNPVATEQYGSVEWNLTQEHGNQQ

SEQ ID NO: 75290 - protein, 35 aa, Artificial Sequence
  Description of Artificial Sequence: Synthetic polypeptide
DEEEIRTTNPVATEQYGSVNTDTNFNLQEGSGQNQ

SEQ ID NO: 75291 - protein, 32 aa, Artificial Sequence
  Description of Artificial Sequence: Synthetic polypeptide
DEEEIRTTNPVATEQYGSVSTDIDNFIDNLQE

SEQ ID NO: 75292 - protein, 33 aa, Artificial Sequence
  Description of Artificial Sequence: Synthetic polypeptide
DEEEIRTTNPVATEQYGSVNTIQSLWQMVGETC

SEQ ID NO: 75293 - protein, 32 aa, Artificial Sequence
  Description of Artificial Sequence: Synthetic polypeptide
NETEIRTTNPVATEYYGEVSTNLQGQDGDNNE

SEQ ID NO: 75294 - protein, 32 aa, Artificial Sequence
  Description of Artificial Sequence: Synthetic polypeptide
NETEIRTTNPVATEYYGEVSTNLQGQQGGNEQ

SEQ ID NO: 75295 - protein, 33 aa, Artificial Sequence
  Description of Artificial Sequence: Synthetic polypeptide
DEEEIRTTNPVATEQYGSVNTGDEQNEGEGNQG

SEQ ID NO: 75296 - protein, 33 aa, Artificial Sequence
  Description of Artificial Sequence: Synthetic polypeptide
DEEEIRTTNPVATEQYGSVNTFNIGQEEGEQEA

SEQ ID NO: 75297 - protein, 33 aa, Artificial Sequence
  Description of Artificial Sequence: Synthetic polypeptide
DEDEIRTTNPCATEQYGSVSTVNGPGNAGENRE

SEQ ID NO: 75298 - protein, 29 aa, Artificial Sequence
  Description of Artificial Sequence: Synthetic peptide
DESEIRTTNPVSTEPYGVISSDLQQQGNI

SEQ ID NO: 75299 - protein, 32 aa, Artificial Sequence
  Description of Artificial Sequence: Synthetic polypeptide
NETEIRTTNPVATEYYGVVSTNLQPQGDNNEE

SEQ ID NO: 75300 - protein, 32 aa, Artificial Sequence
  Description of Artificial Sequence: Synthetic polypeptide
DEEEIACTNPVATEQYGSVSPTNNHQENDMQR

SEQ ID NO: 75301 - protein, 34 aa, Artificial Sequence
  Description of Artificial Sequence: Synthetic polypeptide
DEEEIRTTNPVATEQYGSVSTDHLTNPRSTQNDP

SEQ ID NO: 75302 - protein, 31 aa, Artificial Sequence
  Description of Artificial Sequence: Synthetic polypeptide
NETEIRTTNPVAYEQWGNVSTNLQHNEGNQS

SEQ ID NO: 75303 - protein, 32 aa, Artificial Sequence
  Description of Artificial Sequence: Synthetic polypeptide
DEEEIRTTNPVATEQYGSVSTDHMHDVSLNSE

SEQ ID NO: 75304 - protein, 33 aa, Artificial Sequence
  Description of Artificial Sequence: Synthetic polypeptide
DEEEIACTNPVATEQYGSVSTTNGPNMRNGGPR

SEQ ID NO: 75305 - protein, 33 aa, Artificial Sequence
  Description of Artificial Sequence: Synthetic polypeptide
AEEEIRTTNPVATEQYGSVVVTTNLMGTNGNNE

SEQ ID NO: 75306 - protein, 33 aa, Artificial Sequence
  Description of Artificial Sequence: Synthetic polypeptide
DEEEIRTTNPVATEQYGSVNTDTNMVGEGGNEQ

SEQ ID NO: 75307 - protein, 29 aa, Artificial Sequence
  Description of Artificial Sequence: Synthetic peptide
DESEIRTTNPVSTEGYGTIASTLQQHGNH

SEQ ID NO: 75308 - protein, 34 aa, Artificial Sequence
  Description of Artificial Sequence: Synthetic polypeptide
DEEEIRTTNPVATEQYGSVNSVTGIQEQGDGGNG

SEQ ID NO: 75309 - protein, 33 aa, Artificial Sequence
  Description of Artificial Sequence: Synthetic polypeptide
AEEEIRTTNPVATEQYGSVVVTSNLNNTTGNNV

SEQ ID NO: 75310 - protein, 33 aa, Artificial Sequence
  Description of Artificial Sequence: Synthetic polypeptide
DEDEIRTTNPCATECYGSVSTNLQGDAGGNNTD

SEQ ID NO: 75311 - protein, 34 aa, Artificial Sequence
  Description of Artificial Sequence: Synthetic polypeptide
AEEEIRTTNPVATEQYGSVVVTNNNLQQQGNNVD

SEQ ID NO: 75312 - protein, 34 aa, Artificial Sequence
  Description of Artificial Sequence: Synthetic polypeptide
AEEEIRTTNPVATEQYGSVVVTNNNLQQGEGNTD

SEQ ID NO: 75313 - protein, 35 aa, Artificial Sequence
  Description of Artificial Sequence: Synthetic polypeptide
DEEEIRTTNPVATEQYGSVNSTTNYEDQEGEEERQ

SEQ ID NO: 75314 - protein, 33 aa, Artificial Sequence
  Description of Artificial Sequence: Synthetic polypeptide
AEEEIRTTNPVATEQYGSVVVTNNLSNTAGNNT

SEQ ID NO: 75315 - protein, 32 aa, Artificial Sequence
  Description of Artificial Sequence: Synthetic polypeptide
NNEEIRTTNPVATEQYGVVSTNGNEDMGPNLR

SEQ ID NO: 75316 - protein, 31 aa, Artificial Sequence
  Description of Artificial Sequence: Synthetic polypeptide
DESEIRTTNPVGTECWGSVSSITLQDRGENG

SEQ ID NO: 75317 - protein, 34 aa, Artificial Sequence
  Description of Artificial Sequence: Synthetic polypeptide
DEEEIRTTNPVATEQYGSVNSTTNDDHRENNDEN

SEQ ID NO: 75318 - protein, 36 aa, Artificial Sequence
  Description of Artificial Sequence: Synthetic polypeptide
DEEEIRTTNPVATEQYGSVNSTTNDDEQRSGNEEIS

SEQ ID NO: 75319 - protein, 29 aa, Artificial Sequence
  Description of Artificial Sequence: Synthetic peptide
AETEIRCTNPVATEQWGEAWSEDLQRGGR

SEQ ID NO: 75320 - protein, 32 aa, Artificial Sequence
  Description of Artificial Sequence: Synthetic polypeptide
DESEIRTTNPVGTECWGSVSSINLQDREGENG

SEQ ID NO: 75321 - protein, 33 aa, Artificial Sequence
  Description of Artificial Sequence: Synthetic polypeptide
DESEIRTTNPVCTEQWGSVSDINLPQDREGENG

SEQ ID NO: 75322 - protein, 33 aa, Artificial Sequence
  Description of Artificial Sequence: Synthetic polypeptide
DESEIRTTNPVCTEQWGSVSCINLPQDREGENG

SEQ ID NO: 75323 - protein, 33 aa, Artificial Sequence
  Description of Artificial Sequence: Synthetic polypeptide
DEEEIRTTNPVATEQYGSVNSTTEDQQYGIEFL

SEQ ID NO: 75324 - protein, 34 aa, Artificial Sequence
  Description of Artificial Sequence: Synthetic polypeptide
AEEEIRTTNPVATEQYGSVVVTNLQQGTEGTNGG

SEQ ID NO: 75325 - protein, 33 aa, Artificial Sequence
  Description of Artificial Sequence: Synthetic polypeptide
AEEEIRTTNPVATEQYGSVVVTNLQGNLQNEGI

SEQ ID NO: 75326 - protein, 31 aa, Artificial Sequence
  Description of Artificial Sequence: Synthetic polypeptide
NNEEIRTTNPVATEQYGVVSTLSLPEGFNEK

SEQ ID NO: 75327 - protein, 31 aa, Artificial Sequence
  Description of Artificial Sequence: Synthetic polypeptide
NETEIRTTNPVATEYWGNVSTNLQPQGGNES

SEQ ID NO: 75328 - protein, 33 aa, Artificial Sequence
  Description of Artificial Sequence: Synthetic polypeptide
AEEEIRTTNPVATEQYGSVVVTNNQEQDEGTNQ

SEQ ID NO: 75329 - protein, 34 aa, Artificial Sequence
  Description of Artificial Sequence: Synthetic polypeptide
DEEEIRTTNPVATEQYGSVNSTTVDDERGNEEIS

SEQ ID NO: 75330 - protein, 32 aa, Artificial Sequence
  Description of Artificial Sequence: Synthetic polypeptide
DEDEIRTTNPCATECYGSVSTNEGNQGDGSNS

SEQ ID NO: 75331 - protein, 33 aa, Artificial Sequence
  Description of Artificial Sequence: Synthetic polypeptide
NNEEIRTTNPVATEQYGSVVSTNLEQQQAPERH

SEQ ID NO: 75332 - protein, 33 aa, Artificial Sequence
  Description of Artificial Sequence: Synthetic polypeptide
AEEEIRTTNPVATEQYGSVVVTSNLNNTAGTND

SEQ ID NO: 75333 - protein, 35 aa, Artificial Sequence
  Description of Artificial Sequence: Synthetic polypeptide
DEEEIRTTNPVATEQYGSVNSVETNELDNRDENID

SEQ ID NO: 75334 - protein, 33 aa, Artificial Sequence
  Description of Artificial Sequence: Synthetic polypeptide
DEEEIRTTNPVATEQYGSVNSVEPLDDRTENDN

SEQ ID NO: 75335 - protein, 31 aa, Artificial Sequence
  Description of Artificial Sequence: Synthetic polypeptide
DEEEIRTTNPVATEQYGSVNSVEPLDDETED

SEQ ID NO: 75336 - protein, 33 aa, Artificial Sequence
  Description of Artificial Sequence: Synthetic polypeptide
NNEEIRTTNPVATEQYGTVSTNLNELDFGPNLR

SEQ ID NO: 75337 - protein, 33 aa, Artificial Sequence
  Description of Artificial Sequence: Synthetic polypeptide
NNEEIRTTNPVATEQYGTVVSTNLEQPNNGPNE

SEQ ID NO: 75338 - protein, 34 aa, Artificial Sequence
  Description of Artificial Sequence: Synthetic polypeptide
DEEEIRTTNPVATEQYGSVNSTVTMSQEGGNFDI

SEQ ID NO: 75339 - protein, 33 aa, Artificial Sequence
  Description of Artificial Sequence: Synthetic polypeptide
AEEEIRTTNPVATEQYGSVVVTNQLGGNNGNDE

SEQ ID NO: 75340 - protein, 34 aa, Artificial Sequence
  Description of Artificial Sequence: Synthetic polypeptide
DEEEIRTTNPVATEQYGSVNSTVQDDQRGGEEYM

SEQ ID NO: 75341 - protein, 33 aa, Artificial Sequence
  Description of Artificial Sequence: Synthetic polypeptide
AEEEIRTTNPVATEQYGSVVVTNNQNNTAGNNE

SEQ ID NO: 75342 - protein, 34 aa, Artificial Sequence
  Description of Artificial Sequence: Synthetic polypeptide
DEEEIRTTNPVATEQYGSVNSTVDDERSGNEEIL

SEQ ID NO: 75343 - protein, 33 aa, Artificial Sequence
  Description of Artificial Sequence: Synthetic polypeptide
DEEEIRTTNPVATEQYGSVNSTVDDDRNGEDHV

SEQ ID NO: 75344 - protein, 34 aa, Artificial Sequence
  Description of Artificial Sequence: Synthetic polypeptide
DEEEIRTTNPVATEQYGSVNSTTVEHERGEAERM

SEQ ID NO: 75345 - protein, 31 aa, Artificial Sequence
  Description of Artificial Sequence: Synthetic polypeptide
NNEEIRTTNPVATEQYGVVSTIVLPEDGPNI

SEQ ID NO: 75346 - protein, 31 aa, Artificial Sequence
  Description of Artificial Sequence: Synthetic polypeptide
DEEEIACTNPVATEQYGSVSGNNHQENDMGR

SEQ ID NO: 75347 - protein, 32 aa, Artificial Sequence
  Description of Artificial Sequence: Synthetic polypeptide
NETEIRTTNPVATEYWGNVSTNLQHQEGNNER

SEQ ID NO: 75348 - protein, 32 aa, Artificial Sequence
  Description of Artificial Sequence: Synthetic polypeptide
NETEIRTTNPVATEYWGNVSTNLQGQNGENER

SEQ ID NO: 75349 - protein, 34 aa, Artificial Sequence
  Description of Artificial Sequence: Synthetic polypeptide
AEEEIRTTNPVATEQYGSVVVTTNNLQNQEGNTT

SEQ ID NO: 75350 - protein, 33 aa, Artificial Sequence
  Description of Artificial Sequence: Synthetic polypeptide
DEDEIRTTNPTATEQYGVVSTGNGLGQDGGNQQ

SEQ ID NO: 75351 - protein, 34 aa, Artificial Sequence
  Description of Artificial Sequence: Synthetic polypeptide
DEEEIRTTNPVATEQYGSVSTDDLEAPYVNQDRF

SEQ ID NO: 75352 - protein, 34 aa, Artificial Sequence
  Description of Artificial Sequence: Synthetic polypeptide
DEEEIRTTNPVATEQYGSVSTDDLTNWREHQNDG

SEQ ID NO: 75353 - protein, 34 aa, Artificial Sequence
  Description of Artificial Sequence: Synthetic polypeptide
DEEEIRTTNPVATEQYGSVSTDDMQNDVINSGRF

SEQ ID NO: 75354 - protein, 32 aa, Artificial Sequence
  Description of Artificial Sequence: Synthetic polypeptide
DEEEIRTTNPVATEQYGSVNVDMEQARMNIME

SEQ ID NO: 75355 - protein, 33 aa, Artificial Sequence
  Description of Artificial Sequence: Synthetic polypeptide
NETEIRTTNPVATEHYGNVSTNLNQGQAGENDR

SEQ ID NO: 75356 - protein, 34 aa, Artificial Sequence
  Description of Artificial Sequence: Synthetic polypeptide
AEEEIRTTNPVATEQYGSVVVTTNNLLQEIGNEE

SEQ ID NO: 75357 - protein, 31 aa, Artificial Sequence
  Description of Artificial Sequence: Synthetic polypeptide
NETEIRTTNPVATEMWGCVSTNLQGNEGNND

SEQ ID NO: 75358 - protein, 33 aa, Artificial Sequence
  Description of Artificial Sequence: Synthetic polypeptide
DEEEIRTTNPVATEQYGSVNTTTNVEERVLVER

SEQ ID NO: 75359 - protein, 33 aa, Artificial Sequence
  Description of Artificial Sequence: Synthetic polypeptide
DESEIRTTNPVSTEQYGSVSTTTGPQMRNGNPV

SEQ ID NO: 75360 - protein, 33 aa, Artificial Sequence
  Description of Artificial Sequence: Synthetic polypeptide
DEEEIRTTNPVATEQYGSVNTTSVVEQRDLVER

SEQ ID NO: 75361 - protein, 34 aa, Artificial Sequence
  Description of Artificial Sequence: Synthetic polypeptide
DEEEIRTTNPVATEQYGSVNTTNNVEQRVLVELR

SEQ ID NO: 75362 - protein, 34 aa, Artificial Sequence
  Description of Artificial Sequence: Synthetic polypeptide
DEEEIRTTNPVATEQYGSVSTDEMLNSNGGTNGD

SEQ ID NO: 75363 - protein, 32 aa, Artificial Sequence
  Description of Artificial Sequence: Synthetic polypeptide
NETEIRTTNPVATEMWGSVSTNLQGNMGGNDS

SEQ ID NO: 75364 - protein, 34 aa, Artificial Sequence
  Description of Artificial Sequence: Synthetic polypeptide
AEEEIRTTNPVATEQYGSVVVTTNNLQQGDEGND

SEQ ID NO: 75365 - protein, 34 aa, Artificial Sequence
  Description of Artificial Sequence: Synthetic polypeptide
AEEEIRTTNPVATEQYGSVVVTTNLQQNQEGTNG

SEQ ID NO: 75366 - protein, 32 aa, Artificial Sequence
  Description of Artificial Sequence: Synthetic polypeptide
DESEISTTNPVATEPYGSTVSCTNQSQETGNF

SEQ ID NO: 75367 - protein, 31 aa, Artificial Sequence
  Description of Artificial Sequence: Synthetic polypeptide
DEEEIRTTNPVATEQYGSVSTDAPEVSSSQG

SEQ ID NO: 75368 - protein, 32 aa, Artificial Sequence
  Description of Artificial Sequence: Synthetic polypeptide
NETEIRTTNPVATECYGSVSTNIQGNEGGDDR

SEQ ID NO: 75369 - protein, 30 aa, Artificial Sequence
  Description of Artificial Sequence: Synthetic polypeptide
DESEISTTNPVAYDPHYGEVSTNLQRTNDM

SEQ ID NO: 75370 - protein, 32 aa, Artificial Sequence
  Description of Artificial Sequence: Synthetic polypeptide
DESEISTTNPVATEQYGMVSTEINNLIRDNTC

SEQ ID NO: 75371 - protein, 32 aa, Artificial Sequence
  Description of Artificial Sequence: Synthetic polypeptide
DEEEIRTTNPVATEQYGSVNYTSLDDYGEEFN

SEQ ID NO: 75372 - protein, 33 aa, Artificial Sequence
  Description of Artificial Sequence: Synthetic polypeptide
NETEIRTTNPVATECYGSVSTNLNQGNEGTNDE

SEQ ID NO: 75373 - protein, 32 aa, Artificial Sequence
  Description of Artificial Sequence: Synthetic polypeptide
NETEIRTTNPVATECYGSVSTNLQGNDGGGTD

SEQ ID NO: 75374 - protein, 32 aa, Artificial Sequence
  Description of Artificial Sequence: Synthetic polypeptide
DEEEIRTTNPVATEQYGSVNYPDEDRYGNVEI

SEQ ID NO: 75375 - protein, 33 aa, Artificial Sequence
  Description of Artificial Sequence: Synthetic polypeptide
DEEEIRTTNPVATEQYGSVNYDTLEQLMGEELR

SEQ ID NO: 75376 - protein, 33 aa, Artificial Sequence
  Description of Artificial Sequence: Synthetic polypeptide
AEEEIRTTNPVATEQYGSVVVTTNNQQQEGNIP

SEQ ID NO: 75377 - protein, 33 aa, Artificial Sequence
  Description of Artificial Sequence: Synthetic polypeptide
AEEEIRTTNPVATEQYGSVVVTTNNQQLGNNGQ

SEQ ID NO: 75378 - protein, 33 aa, Artificial Sequence
  Description of Artificial Sequence: Synthetic polypeptide
AEEEIRTTNPVATEQYGSVVVTTNNQQGQNGQE

SEQ ID NO: 75379 - protein, 33 aa, Artificial Sequence
  Description of Artificial Sequence: Synthetic polypeptide
NETEIRTTNPVATECYGSVSTNLQGNEGTNNDT

SEQ ID NO: 75380 - protein, 34 aa, Artificial Sequence
  Description of Artificial Sequence: Synthetic polypeptide
DEEEIRTTNPVATEQYGSVSTDALVNFRSTQNDG

SEQ ID NO: 75381 - protein, 33 aa, Artificial Sequence
  Description of Artificial Sequence: Synthetic polypeptide
AEEEIRTTNPVATEQYGSVVVTTNNNQQQGNGQ

SEQ ID NO: 75382 - protein, 33 aa, Artificial Sequence
  Description of Artificial Sequence: Synthetic polypeptide
AEEEIRTTNPVATEQYGSVVVTTNNNQQAGNGQ

SEQ ID NO: 75383 - protein, 33 aa, Artificial Sequence
  Description of Artificial Sequence: Synthetic polypeptide
DEEEIRTTNPVATEQYGSVSTDCINQHLNEDFG

SEQ ID NO: 75384 - protein, 34 aa, Artificial Sequence
  Description of Artificial Sequence: Synthetic polypeptide
DEEEIRTTNPVATEQYGSVNSTSPELQQDSGEEG

SEQ ID NO: 75385 - protein, 34 aa, Artificial Sequence
  Description of Artificial Sequence: Synthetic polypeptide
DEEEIRTTNPVATEQYGSVNTQNIGQQNGENEGS

SEQ ID NO: 75386 - protein, 34 aa, Artificial Sequence
  Description of Artificial Sequence: Synthetic polypeptide
AEEEIRTTNPVATEQYGSVVVTTNLQQGNGTNQT

SEQ ID NO: 75387 - protein, 34 aa, Artificial Sequence
  Description of Artificial Sequence: Synthetic polypeptide
AEEEIRTTNPVATEQYGSVVVTTNLQGSTGNGGN

SEQ ID NO: 75388 - protein, 32 aa, Artificial Sequence
  Description of Artificial Sequence: Synthetic polypeptide
NETEIRTTNPVATESWGSVSTNLQGNEGNGDA

SEQ ID NO: 75389 - protein, 33 aa, Artificial Sequence
  Description of Artificial Sequence: Synthetic polypeptide
NETEIRTTNPVATESYGSVSTNLNQGNEGNGDH

SEQ ID NO: 75390 - protein, 33 aa, Artificial Sequence
  Description of Artificial Sequence: Synthetic polypeptide
DEEEIRTTNPVATEQYGSVNTNIDENWRENNED

SEQ ID NO: 75391 - protein, 34 aa, Artificial Sequence
  Description of Artificial Sequence: Synthetic polypeptide
AEEEIRTTNPVATEQYGSVVVTTNLNQQGNGNGT

SEQ ID NO: 75392 - protein, 33 aa, Artificial Sequence
  Description of Artificial Sequence: Synthetic polypeptide
NETEIRTTNPVATESYGSVSTNLQGNEGTNGDS

SEQ ID NO: 75393 - protein, 33 aa, Artificial Sequence
  Description of Artificial Sequence: Synthetic polypeptide
DEEEIRTTNPVATEQYGSVSTDGGEDEGQGNEN

SEQ ID NO: 75394 - protein, 31 aa, Artificial Sequence
  Description of Artificial Sequence: Synthetic polypeptide
DEDEIRTTNPCATEQYGSVSWNDNNAPRGSD

SEQ ID NO: 75395 - protein, 33 aa, Artificial Sequence
  Description of Artificial Sequence: Synthetic polypeptide
AEEEIRTTNPVATEQYGSVVVTTNLNNTQGNNL

SEQ ID NO: 75396 - protein, 32 aa, Artificial Sequence
  Description of Artificial Sequence: Synthetic polypeptide
NETEIRTTNPVATEYWGCVSTNLQGQEGQNNR

SEQ ID NO: 75397 - protein, 33 aa, Artificial Sequence
  Description of Artificial Sequence: Synthetic polypeptide
DEEEIRTTNPVATEQYGSVSTDGNMNNEQGETT

SEQ ID NO: 75398 - protein, 32 aa, Artificial Sequence
  Description of Artificial Sequence: Synthetic polypeptide
NETEIRTTNPVATEYWGNVSTNLQGQDGNNDR

SEQ ID NO: 75399 - protein, 32 aa, Artificial Sequence
  Description of Artificial Sequence: Synthetic polypeptide
NETEIRTTNPVATEYWGNVSTNLQGQDNGNTR

SEQ ID NO: 75400 - protein, 33 aa, Artificial Sequence
  Description of Artificial Sequence: Synthetic polypeptide
DEEEIRTTNPVATEQYGSVNTNDENGSEENNED

SEQ ID NO: 75401 - protein, 32 aa, Artificial Sequence
  Description of Artificial Sequence: Synthetic polypeptide
NETEIRTTNPVATEYWGNVSTNLQGQEGGDNR

SEQ ID NO: 75402 - protein, 32 aa, Artificial Sequence
  Description of Artificial Sequence: Synthetic polypeptide
NETEIRTTNPVATEQYGSVSTTQMGNDGDNDR

SEQ ID NO: 75403 - protein, 32 aa, Artificial Sequence
  Description of Artificial Sequence: Synthetic polypeptide
NETEIRTTNPVATEMYGEVSTNLQGNEGNGDM

SEQ ID NO: 75404 - protein, 31 aa, Artificial Sequence
  Description of Artificial Sequence: Synthetic polypeptide
NETEIRTTNPVATEQYGSVSTTQMGNDEGND

SEQ ID NO: 75405 - protein, 33 aa, Artificial Sequence
  Description of Artificial Sequence: Synthetic polypeptide
NETEIRTTNPVATEQYGSVSTTQMDGERQGNDR

SEQ ID NO: 75406 - protein, 34 aa, Artificial Sequence
  Description of Artificial Sequence: Synthetic polypeptide
AEEEIRTTNPVATEQYGSVVVTTNLQQGNGNNTD

SEQ ID NO: 75407 - protein, 34 aa, Artificial Sequence
  Description of Artificial Sequence: Synthetic polypeptide
AEEEIRTTNPVATEQYGSVVVTTNLQQGNGNNSE

SEQ ID NO: 75408 - protein, 34 aa, Artificial Sequence
  Description of Artificial Sequence: Synthetic polypeptide
AEEEIRTTNPVATEQYGSVVVTTNLQQGNGNNGT

SEQ ID NO: 75409 - protein, 34 aa, Artificial Sequence
  Description of Artificial Sequence: Synthetic polypeptide
AEEEIRTTNPVATEQYGSVVVTTNLQQGNGNETA

SEQ ID NO: 75410 - protein, 34 aa, Artificial Sequence
  Description of Artificial Sequence: Synthetic polypeptide
AEEEIRTTNPVATEQYGSVVVTTNLQQGIGNNTD

SEQ ID NO: 75411 - protein, 34 aa, Artificial Sequence
  Description of Artificial Sequence: Synthetic polypeptide
DEEEIRTTNPVATEQYGSVSTDFLTNARSTQNDG

SEQ ID NO: 75412 - protein, 34 aa, Artificial Sequence
  Description of Artificial Sequence: Synthetic polypeptide
DEEEIRTTNPVATEQYGSVSTDGDGQEEEGNDDG

SEQ ID NO: 75413 - protein, 33 aa, Artificial Sequence
  Description of Artificial Sequence: Synthetic polypeptide
DEEEIACTNPVATEQYGSVCATNLQGAPDGNDG

SEQ ID NO: 75414 - protein, 31 aa, Artificial Sequence
  Description of Artificial Sequence: Synthetic polypeptide
NETEIRTTNPVATEQYGEVSTTQMGDRGDND

SEQ ID NO: 75415 - protein, 31 aa, Artificial Sequence
  Description of Artificial Sequence: Synthetic polypeptide
NETEIRTTNPVATEQYGNVSTTQMGDRGNED

SEQ ID NO: 75416 - protein, 34 aa, Artificial Sequence
  Description of Artificial Sequence: Synthetic polypeptide
AEEEIRTTNPVATEQYGSVVVTTNLQNGNNNQAD

SEQ ID NO: 75417 - protein, 34 aa, Artificial Sequence
  Description of Artificial Sequence: Synthetic polypeptide
DEEEIRTTNPVATEQYGSVSTDGDGQEEEGNNGQ

SEQ ID NO: 75418 - protein, 34 aa, Artificial Sequence
  Description of Artificial Sequence: Synthetic polypeptide
AEEEIRTTNPVATEQYGSVVVTTNLQLNGNQNAD

SEQ ID NO: 75419 - protein, 34 aa, Artificial Sequence
  Description of Artificial Sequence: Synthetic polypeptide
AEEEIRTTNPVATEQYGSVVVTTNLQLEGNVEDE

SEQ ID NO: 75420 - protein, 32 aa, Artificial Sequence
  Description of Artificial Sequence: Synthetic polypeptide
NETEIRTTNPVATEQYGSVSTTQMDGERGNED

SEQ ID NO: 75421 - protein, 31 aa, Artificial Sequence
  Description of Artificial Sequence: Synthetic polypeptide
NETEIRTTNPVATEQYGSVSTTQMDGNGNDM

SEQ ID NO: 75422 - protein, 34 aa, Artificial Sequence
  Description of Artificial Sequence: Synthetic polypeptide
AEEEIRTTNPVATEQYGSVVVTNLNQQGNGNETE

SEQ ID NO: 75423 - protein, 34 aa, Artificial Sequence
  Description of Artificial Sequence: Synthetic polypeptide
DEEEIRTTNPVATEQYGSVNSTSLDQQYEGEEDI

SEQ ID NO: 75424 - protein, 33 aa, Artificial Sequence
  Description of Artificial Sequence: Synthetic polypeptide
AEEEIRTTNPVATEQYGSVVVTNLLGGNEGNED

SEQ ID NO: 75425 - protein, 28 aa, Artificial Sequence
  Description of Artificial Sequence: Synthetic peptide
DEEEIASVNPVCTEQWGVVSDNLQSGDQ

SEQ ID NO: 75426 - protein, 35 aa, Artificial Sequence
  Description of Artificial Sequence: Synthetic polypeptide
DEEEIRTTNPVATEQYGSVNSTNDDDQRMGEEEIN

SEQ ID NO: 75427 - protein, 35 aa, Artificial Sequence
  Description of Artificial Sequence: Synthetic polypeptide
DEEEIRTTNPVATEQYGSVNSTNDDDQRGGEEPVN

SEQ ID NO: 75428 - protein, 35 aa, Artificial Sequence
  Description of Artificial Sequence: Synthetic polypeptide
DEEEIRTTNPVATEQYGSVNSTNDDDQRGGEEDDY

SEQ ID NO: 75429 - protein, 33 aa, Artificial Sequence
  Description of Artificial Sequence: Synthetic polypeptide
DESEIRTTNPVAYEPYGKVCSTGGLQRTGGNRE

SEQ ID NO: 75430 - protein, 34 aa, Artificial Sequence
  Description of Artificial Sequence: Synthetic polypeptide
DEEEIRTTNPVATEQYGSVNSTNDDDQEGGEEII

SEQ ID NO: 75431 - protein, 30 aa, Artificial Sequence
  Description of Artificial Sequence: Synthetic polypeptide
QAEEIATTNPVATAQWGSVSAGNPDRGNRS

SEQ ID NO: 75432 - protein, 29 aa, Artificial Sequence
  Description of Artificial Sequence: Synthetic peptide
DEEEIASVNPVCTEQYGSVSADNLESGEQ

SEQ ID NO: 75433 - protein, 33 aa, Artificial Sequence
  Description of Artificial Sequence: Synthetic polypeptide
DEEEIRTTNPVATEQYGSVNSTMNQDGGMETEG

SEQ ID NO: 75434 - protein, 31 aa, Artificial Sequence
  Description of Artificial Sequence: Synthetic polypeptide
DESEIRTTNPVAYEPWGISVVYTNLSQSGNM

SEQ ID NO: 75435 - protein, 32 aa, Artificial Sequence
  Description of Artificial Sequence: Synthetic polypeptide
DESEIRTTNPVAYEPWGISVSTNALSQSGNQM

SEQ ID NO: 75436 - protein, 31 aa, Artificial Sequence
  Description of Artificial Sequence: Synthetic polypeptide
DESEIRTTNPVAYEPWGISVSTALSQSGTNP

SEQ ID NO: 75437 - protein, 32 aa, Artificial Sequence
  Description of Artificial Sequence: Synthetic polypeptide
DESEIRTTNPVAYEPWGISVSCTNLSQSAGNM

SEQ ID NO: 75438 - protein, 34 aa, Artificial Sequence
  Description of Artificial Sequence: Synthetic polypeptide
DEEEIRTTNPVATEQYGSVNSTMNFELQQTDVGD

SEQ ID NO: 75439 - protein, 34 aa, Artificial Sequence
  Description of Artificial Sequence: Synthetic polypeptide
DEEEIRTTNPVATEQYGSVNSTMNFELQGTEDVD

SEQ ID NO: 75440 - protein, 34 aa, Artificial Sequence
  Description of Artificial Sequence: Synthetic polypeptide
DEEEIRTTNPVATEQYGSVNSTNDDDQVGGEEQN

SEQ ID NO: 75441 - protein, 30 aa, Artificial Sequence
  Description of Artificial Sequence: Synthetic polypeptide
QAEEIATTNPVATAQWGSVSTGNPDRGNDD

SEQ ID NO: 75442 - protein, 34 aa, Artificial Sequence
  Description of Artificial Sequence: Synthetic polypeptide
DEEEIRTTNPVATEQYGSVNSTNDDEDSGNEEFM

SEQ ID NO: 75443 - protein, 30 aa, Artificial Sequence
  Description of Artificial Sequence: Synthetic polypeptide
DESEIRTTNPVAYEPYGSVNCTNESQGVNQ

SEQ ID NO: 75444 - protein, 28 aa, Artificial Sequence
  Description of Artificial Sequence: Synthetic peptide
AMNEIACTNPVATEQYGEASENLQRSGR

SEQ ID NO: 75445 - protein, 32 aa, Artificial Sequence
  Description of Artificial Sequence: Synthetic polypeptide
DESEIRTTNPVAYEPYGSVSTGGLSQTLQGSR

SEQ ID NO: 75446 - protein, 29 aa, Artificial Sequence
  Description of Artificial Sequence: Synthetic peptide
DEEEIASVNPVATEQWGVVSNDNLQSGPQ

SEQ ID NO: 75447 - protein, 32 aa, Artificial Sequence
  Description of Artificial Sequence: Synthetic polypeptide
DEEEIRTTNPVATEQYGSVSTDMTQESLQEQA

SEQ ID NO: 75448 - protein, 30 aa, Artificial Sequence
  Description of Artificial Sequence: Synthetic polypeptide
DEEEIASVNPVATEQYGSVSDDLQDSEGEL

SEQ ID NO: 75449 - protein, 28 aa, Artificial Sequence
  Description of Artificial Sequence: Synthetic peptide
DEEEIASVNPVATEQYGVVSEIEQAGDQ

SEQ ID NO: 75450 - protein, 33 aa, Artificial Sequence
  Description of Artificial Sequence: Synthetic polypeptide
DEEEIRTTNPVATEQYGSVNSTNDDLYENEIDG

SEQ ID NO: 75451 - protein, 34 aa, Artificial Sequence
  Description of Artificial Sequence: Synthetic polypeptide
DEEEIRTTNPVATEQYGSVNSTNDDLNSGQEEAS

SEQ ID NO: 75452 - protein, 28 aa, Artificial Sequence
  Description of Artificial Sequence: Synthetic peptide
DEEEIASVNPVCTEGYGVVSNNLQSGQQ

SEQ ID NO: 75453 - protein, 29 aa, Artificial Sequence
  Description of Artificial Sequence: Synthetic peptide
DEEEIASVNPVCTEPYGVVSDNLQQSGNQ

SEQ ID NO: 75454 - protein, 34 aa, Artificial Sequence
  Description of Artificial Sequence: Synthetic polypeptide
DEEEIRTTNPVATEQYGSVNSTNDDERYSNEEFN

SEQ ID NO: 75455 - protein, 29 aa, Artificial Sequence
  Description of Artificial Sequence: Synthetic peptide
DEEEIASVNPVCTEQWGVVSDNEQREGNQ

SEQ ID NO: 75456 - protein, 34 aa, Artificial Sequence
  Description of Artificial Sequence: Synthetic polypeptide
DEEEIRTTNPVATEQYGSVNSTNDDERSPNEETS

SEQ ID NO: 75457 - protein, 34 aa, Artificial Sequence
  Description of Artificial Sequence: Synthetic polypeptide
DEEEIRTTNPVATEQYGSVNSTNDDERSLNEEIE

SEQ ID NO: 75458 - protein, 34 aa, Artificial Sequence
  Description of Artificial Sequence: Synthetic polypeptide
DEEEIRTTNPVATEQYGSVNSTNDDERSGQEEQN

SEQ ID NO: 75459 - protein, 33 aa, Artificial Sequence
  Description of Artificial Sequence: Synthetic polypeptide
DEEEIRTTNPVATEQYGSVSTDNDLYAEELEEE

SEQ ID NO: 75460 - protein, 33 aa, Artificial Sequence
  Description of Artificial Sequence: Synthetic polypeptide
NTEEIRYTNPVAYEQYGSVVSCTNLSQNVGTNR

SEQ ID NO: 75461 - protein, 30 aa, Artificial Sequence
  Description of Artificial Sequence: Synthetic polypeptide
QAEEIATTNPVATAQWGSVSTNPDNRGNDQ

SEQ ID NO: 75462 - protein, 30 aa, Artificial Sequence
  Description of Artificial Sequence: Synthetic polypeptide
DEEEIASVNPVCTEQYGVVSADNLQDSGNQ

SEQ ID NO: 75463 - protein, 32 aa, Artificial Sequence
  Description of Artificial Sequence: Synthetic polypeptide
DESEIRTTNPVAYEAYGISTVSTNQTETGNRG

SEQ ID NO: 75464 - protein, 28 aa, Artificial Sequence
  Description of Artificial Sequence: Synthetic peptide
DEEEIASVNPVSTEQYGVVADNIQSGNQ

SEQ ID NO: 75465 - protein, 28 aa, Artificial Sequence
  Description of Artificial Sequence: Synthetic peptide
APNEIACTNPVATEQYGEASENLQDGGR

SEQ ID NO: 75466 - protein, 33 aa, Artificial Sequence
  Description of Artificial Sequence: Synthetic polypeptide
DEEEIATTNPAATEQYGSVPTVLQAHRQAVNGR

SEQ ID NO: 75467 - protein, 31 aa, Artificial Sequence
  Description of Artificial Sequence: Synthetic polypeptide
DEEEIATTNPCASEQYGIVSSTTALNRGMNV

SEQ ID NO: 75468 - protein, 31 aa, Artificial Sequence
  Description of Artificial Sequence: Synthetic polypeptide
DEEEIATTNPCASEQYGSVSSTTAGNRGMNV

SEQ ID NO: 75469 - protein, 31 aa, Artificial Sequence
  Description of Artificial Sequence: Synthetic polypeptide
DEEEIATTNPCASEQYGSVSTTAGPNRGNPV

SEQ ID NO: 75470 - protein, 32 aa, Artificial Sequence
  Description of Artificial Sequence: Synthetic polypeptide
DEEEIATTNPCATECYGSVCSKTENDARDGNW

SEQ ID NO: 75471 - protein, 34 aa, Artificial Sequence
  Description of Artificial Sequence: Synthetic polypeptide
DEEEIRTTNPVATEQYGSVNSTDGQGQEEGGGNT

SEQ ID NO: 75472 - protein, 34 aa, Artificial Sequence
  Description of Artificial Sequence: Synthetic polypeptide
DEEEIRTTNPVATEQYGSVNSTDDDDQRGGEETL

SEQ ID NO: 75473 - protein, 34 aa, Artificial Sequence
  Description of Artificial Sequence: Synthetic polypeptide
DEEEIRTTNPVATEQYGSVSTDNGLIEVGGETGT

SEQ ID NO: 75474 - protein, 28 aa, Artificial Sequence
  Description of Artificial Sequence: Synthetic peptide
AQQEIACTNPVATEQYGEASENLQRGGD

SEQ ID NO: 75475 - protein, 32 aa, Artificial Sequence
  Description of Artificial Sequence: Synthetic polypeptide
DESEIRTTNPVAYDHYGSTVPSCTNLSQRTNE

SEQ ID NO: 75476 - protein, 29 aa, Artificial Sequence
  Description of Artificial Sequence: Synthetic peptide
ASDEIACTNPVATEQYGCASANLQRPGQR

SEQ ID NO: 75477 - protein, 32 aa, Artificial Sequence
  Description of Artificial Sequence: Synthetic polypeptide
DESEIRTTNPVAWEQYGSTVSCTNQSQETGSI

SEQ ID NO: 75478 - protein, 34 aa, Artificial Sequence
  Description of Artificial Sequence: Synthetic polypeptide
DEEEIRTTNPVATEQYGSVSTDNGLELEGGEVGD

SEQ ID NO: 75479 - protein, 34 aa, Artificial Sequence
  Description of Artificial Sequence: Synthetic polypeptide
DEEEIRTTNPVATEQYGSVNSTMDGLEQGGGETI

SEQ ID NO: 75480 - protein, 33 aa, Artificial Sequence
  Description of Artificial Sequence: Synthetic polypeptide
DEEEIRTTNPVATEQYGSVNSTDTPDQGREQEE

SEQ ID NO: 75481 - protein, 30 aa, Artificial Sequence
  Description of Artificial Sequence: Synthetic polypeptide
DEEEIASVNPVCTEQYGVVSTDNLVEFGND

SEQ ID NO: 75482 - protein, 35 aa, Artificial Sequence
  Description of Artificial Sequence: Synthetic polypeptide
AEEEIRTTNPVATEQYGSVVVSVTNQLQNNNGNNL

SEQ ID NO: 75483 - protein, 34 aa, Artificial Sequence
  Description of Artificial Sequence: Synthetic polypeptide
DEEEIRTTNPVATEQYGSVNSTLNGPEQIQGEED

SEQ ID NO: 75484 - protein, 29 aa, Artificial Sequence
  Description of Artificial Sequence: Synthetic peptide
DEEEIASVNPVCTEQYGVVSADNLQSGEQ

SEQ ID NO: 75485 - protein, 35 aa, Artificial Sequence
  Description of Artificial Sequence: Synthetic polypeptide
DEEEIRTTNPVATEQYGSVNSTLNGLEQDIGGEGQ

SEQ ID NO: 75486 - protein, 33 aa, Artificial Sequence
  Description of Artificial Sequence: Synthetic polypeptide
DEEEIRTTNPVATEQYGSVNSTLDDQGMNNDGS

SEQ ID NO: 75487 - protein, 33 aa, Artificial Sequence
  Description of Artificial Sequence: Synthetic polypeptide
DEEEIRTTNPVATEQYGSVNSTITPDQGGEQEI

SEQ ID NO: 75488 - protein, 35 aa, Artificial Sequence
  Description of Artificial Sequence: Synthetic polypeptide
DEEEIRTTNPVATEQYGSVSTDNGFGQEGNQGNGG

SEQ ID NO: 75489 - protein, 28 aa, Artificial Sequence
  Description of Artificial Sequence: Synthetic peptide
DEEEIASVNPVCTEQYGVVSDAGQSGNQ

SEQ ID NO: 75490 - protein, 28 aa, Artificial Sequence
  Description of Artificial Sequence: Synthetic peptide
DEEEIASVNPVCTEQYGVVSDDLQSGEQ

SEQ ID NO: 75491 - protein, 35 aa, Artificial Sequence
  Description of Artificial Sequence: Synthetic polypeptide
DEEEIRTTNPVATEQYGSVSTDNGFGQENQGNNGD

SEQ ID NO: 75492 - protein, 36 aa, Artificial Sequence
  Description of Artificial Sequence: Synthetic polypeptide
DEEEIRTTNPVATEQYGSVSTDNGLDQGGQEENVGD

SEQ ID NO: 75493 - protein, 35 aa, Artificial Sequence
  Description of Artificial Sequence: Synthetic polypeptide
DEEEIRTTNPVATEQYGSVNSTGNDDERSGNEEIF

SEQ ID NO: 75494 - protein, 32 aa, Artificial Sequence
  Description of Artificial Sequence: Synthetic polypeptide
QAEEIATTNPVATEQWGSVSTNLQNNGDNMQM

SEQ ID NO: 75495 - protein, 35 aa, Artificial Sequence
  Description of Artificial Sequence: Synthetic polypeptide
DEEEIRTTNPVATEQYGSVNSTFNLDGFEGNNEGD

SEQ ID NO: 75496 - protein, 31 aa, Artificial Sequence
  Description of Artificial Sequence: Synthetic polypeptide
DESEIRTTNPVAYEAYGKTVSTNQTETGNRD

SEQ ID NO: 75497 - protein, 34 aa, Artificial Sequence
  Description of Artificial Sequence: Synthetic polypeptide
DEEEIRTTNPVATEQYGSVNSTEDSDQRGGEETI

SEQ ID NO: 75498 - protein, 30 aa, Artificial Sequence
  Description of Artificial Sequence: Synthetic polypeptide
DESEISTTNPVAYEPWGISVSTNLSQSVNM

SEQ ID NO: 75499 - protein, 33 aa, Artificial Sequence
  Description of Artificial Sequence: Synthetic polypeptide
DEEEIRTTNPVATEQYGSVNSTNDHNQESFEHS

SEQ ID NO: 75500 - protein, 31 aa, Artificial Sequence
  Description of Artificial Sequence: Synthetic polypeptide
DESEIRTTNPVAYEQWGSVQTALPREMNNDR

SEQ ID NO: 75501 - protein, 29 aa, Artificial Sequence
  Description of Artificial Sequence: Synthetic peptide
DESEIRTTNPVAYMHYGSVSYNEHQDTNM

SEQ ID NO: 75502 - protein, 31 aa, Artificial Sequence
  Description of Artificial Sequence: Synthetic polypeptide
NNEEIRTTNPVATEQYGVVWTLNLQDGPEEK

SEQ ID NO: 75503 - protein, 30 aa, Artificial Sequence
  Description of Artificial Sequence: Synthetic polypeptide
NNEEIRTTNPVATEQYGVVWTNHQDGGPLE

SEQ ID NO: 75504 - protein, 29 aa, Artificial Sequence
  Description of Artificial Sequence: Synthetic peptide
DESEIRTTNPVAYMHYGSVSYNEGQDTNM

SEQ ID NO: 75505 - protein, 31 aa, Artificial Sequence
  Description of Artificial Sequence: Synthetic polypeptide
NNEEIRTTNPVATEQYGVVWTVLQDGGPNML

SEQ ID NO: 75506 - protein, 35 aa, Artificial Sequence
  Description of Artificial Sequence: Synthetic polypeptide
DEEEIRTTNPVATEQYGSVNSTNNDDERSGNEEHS

SEQ ID NO: 75507 - protein, 33 aa, Artificial Sequence
  Description of Artificial Sequence: Synthetic polypeptide
DEEEIACTNPVAYEQYGSVSTNLQPAAEPGNDD

SEQ ID NO: 75508 - protein, 31 aa, Artificial Sequence
  Description of Artificial Sequence: Synthetic polypeptide
AEEEIRTTNPVATEQYGSVVVTNDTGVNNTD

SEQ ID NO: 75509 - protein, 32 aa, Artificial Sequence
  Description of Artificial Sequence: Synthetic polypeptide
DESEIRTTNPVAYEQYGTVSTTNTLGNGEDNA

SEQ ID NO: 75510 - protein, 29 aa, Artificial Sequence
  Description of Artificial Sequence: Synthetic peptide
DEEEIAPTNPCSSEQYGIVSCNLQSNGTR

SEQ ID NO: 75511 - protein, 30 aa, Artificial Sequence
  Description of Artificial Sequence: Synthetic polypeptide
DEEEIAPTNPCSSEQYGIVSTCNLQSNGTR

SEQ ID NO: 75512 - protein, 32 aa, Artificial Sequence
  Description of Artificial Sequence: Synthetic polypeptide
NNEEISTTNPVATEQYGGVVSTNLNEDFGPNR

SEQ ID NO: 75513 - protein, 31 aa, Artificial Sequence
  Description of Artificial Sequence: Synthetic polypeptide
NNEEISTTNPVATWQYGSVSLTPLPVRTGNN

SEQ ID NO: 75514 - protein, 32 aa, Artificial Sequence
  Description of Artificial Sequence: Synthetic polypeptide
DESEIRTTNPVAYEQYGTVATNDGNQGGGNGR

SEQ ID NO: 75515 - protein, 28 aa, Artificial Sequence
  Description of Artificial Sequence: Synthetic peptide
AEVEIACTNPVATEQYGEACENLQKGGR

SEQ ID NO: 75516 - protein, 30 aa, Artificial Sequence
  Description of Artificial Sequence: Synthetic polypeptide
DESEIRTTNPVAYMHYGTVSYNEQDRGTNM

SEQ ID NO: 75517 - protein, 28 aa, Artificial Sequence
  Description of Artificial Sequence: Synthetic peptide
NQEEIASVNPVCTEQYGVVSDNLQSGNQ

SEQ ID NO: 75518 - protein, 31 aa, Artificial Sequence
  Description of Artificial Sequence: Synthetic polypeptide
AEEEIRTTNPVATEQYGSVVVTNGAGNETTE

SEQ ID NO: 75519 - protein, 34 aa, Artificial Sequence
  Description of Artificial Sequence: Synthetic polypeptide
AEEEIRTTNPVATEQYGSVVVTNLEQGTEGINTG

SEQ ID NO: 75520 - protein, 33 aa, Artificial Sequence
  Description of Artificial Sequence: Synthetic polypeptide
AEEEIRTTNPVATEQYGSVVVTNLGGNQGNDEE

SEQ ID NO: 75521 - protein, 33 aa, Artificial Sequence
  Description of Artificial Sequence: Synthetic polypeptide
DEEEIRTTNPVATEQYGSVNSTSDFDQAGGEEI

SEQ ID NO: 75522 - protein, 33 aa, Artificial Sequence
  Description of Artificial Sequence: Synthetic polypeptide
AEEEIRTTNPVATEQYGSVVVTNLGGNNGNQDT

SEQ ID NO: 75523 - protein, 30 aa, Artificial Sequence
  Description of Artificial Sequence: Synthetic polypeptide
DESEIRTTNPVCTECWGSVSDNEPQDSGNG

SEQ ID NO: 75524 - protein, 34 aa, Artificial Sequence
  Description of Artificial Sequence: Synthetic polypeptide
DEEEIRTTNPVATEQYGSVNSTSDDQQREGEIVY

SEQ ID NO: 75525 - protein, 33 aa, Artificial Sequence
  Description of Artificial Sequence: Synthetic polypeptide
AEEEIRTTNPVATEQYGSVVVTNLGGNNAGNDD

SEQ ID NO: 75526 - protein, 32 aa, Artificial Sequence
  Description of Artificial Sequence: Synthetic polypeptide
NNEEIRTTNPVATEQYGVVSTNSNEDFGQNGR

SEQ ID NO: 75527 - protein, 33 aa, Artificial Sequence
  Description of Artificial Sequence: Synthetic polypeptide
NNEEIRTTNPVATEQYGVVSTNTLEQQMGPNMV

SEQ ID NO: 75528 - protein, 31 aa, Artificial Sequence
  Description of Artificial Sequence: Synthetic polypeptide
DEEEIACTNPVAYEQYGSVATNLQANPVGED

SEQ ID NO: 75529 - protein, 32 aa, Artificial Sequence
  Description of Artificial Sequence: Synthetic polypeptide
DEEEIACTNPVAYEQYGSVATNLQDAGGNAEM

SEQ ID NO: 75530 - protein, 33 aa, Artificial Sequence
  Description of Artificial Sequence: Synthetic polypeptide
DEEEIRTTNPVATEQYGSVNSTPDHNQEGFESA

SEQ ID NO: 75531 - protein, 32 aa, Artificial Sequence
  Description of Artificial Sequence: Synthetic polypeptide
DESEIRTTNPVAYQQYGQKVSTNLSERGGNNP

SEQ ID NO: 75532 - protein, 31 aa, Artificial Sequence
  Description of Artificial Sequence: Synthetic polypeptide
DESEIRTTNPVAYQQYGKVSTNELSESGGNP

SEQ ID NO: 75533 - protein, 31 aa, Artificial Sequence
  Description of Artificial Sequence: Synthetic polypeptide
DESEIRTTNPVAYQQYGCVSTNDENRGGNPS

SEQ ID NO: 75534 - protein, 31 aa, Artificial Sequence
  Description of Artificial Sequence: Synthetic polypeptide
DESEIRTTNPVAYQQYGCVSTNDENRGENMS

SEQ ID NO: 75535 - protein, 32 aa, Artificial Sequence
  Description of Artificial Sequence: Synthetic polypeptide
AEEEIRTTNPVATEQYGSVVVTNGLGGTNFTE

SEQ ID NO: 75536 - protein, 34 aa, Artificial Sequence
  Description of Artificial Sequence: Synthetic polypeptide
DEEEIRTTNPVATEQYGSVNSTNDLHNSGQEEKS

SEQ ID NO: 75537 - protein, 34 aa, Artificial Sequence
  Description of Artificial Sequence: Synthetic polypeptide
AEEEIRTTNPVATEQYGSVVVTIGTNLQQGTTNM

SEQ ID NO: 75538 - protein, 34 aa, Artificial Sequence
  Description of Artificial Sequence: Synthetic polypeptide
AEEEIRTTNPVATEQYGSVVVSVVNLNNQQGNGN

SEQ ID NO: 75539 - protein, 30 aa, Artificial Sequence
  Description of Artificial Sequence: Synthetic polypeptide
DEEEIASTNPVCTECYGSVSCNEPQSEGNQ

SEQ ID NO: 75540 - protein, 29 aa, Artificial Sequence
  Description of Artificial Sequence: Synthetic peptide
DEEEIASTNPVCTEPYGVVSDEDLQSGNQ

SEQ ID NO: 75541 - protein, 31 aa, Artificial Sequence
  Description of Artificial Sequence: Synthetic polypeptide
NSEEIRTTNPVAYEAYGVVPSTNLQDGGNNP

SEQ ID NO: 75542 - protein, 33 aa, Artificial Sequence
  Description of Artificial Sequence: Synthetic polypeptide
NSEEIRTTNPVAYEQYGVTVSYTNLSQDGTNRN

SEQ ID NO: 75543 - protein, 33 aa, Artificial Sequence
  Description of Artificial Sequence: Synthetic polypeptide
NSEEIRTTNPVAYEQYGVVPSTNLEQDTGGNNR

SEQ ID NO: 75544 - protein, 31 aa, Artificial Sequence
  Description of Artificial Sequence: Synthetic polypeptide
DEEEIASTNPVCTEQYGSVSDINEPQSEGNQ

SEQ ID NO: 75545 - protein, 35 aa, Artificial Sequence
  Description of Artificial Sequence: Synthetic polypeptide
AEEEIRTTNPVATEQYGSVVVSVTTNLQLGNANGD

SEQ ID NO: 75546 - protein, 35 aa, Artificial Sequence
  Description of Artificial Sequence: Synthetic polypeptide
AEEEIRTTNPVATEQYGSVVVSVTTNLQEGNANTE

SEQ ID NO: 75547 - protein, 30 aa, Artificial Sequence
  Description of Artificial Sequence: Synthetic polypeptide
DEEEIASTNPVCTEQYGVVSADNPQSEGNQ

SEQ ID NO: 75548 - protein, 29 aa, Artificial Sequence
  Description of Artificial Sequence: Synthetic peptide
ALNEIACTNPVATEQYGEASENLQGRGGR

SEQ ID NO: 75549 - protein, 28 aa, Artificial Sequence
  Description of Artificial Sequence: Synthetic peptide
ALNEIACTNPVATEQYGEASENLQWGGR

SEQ ID NO: 75550 - protein, 29 aa, Artificial Sequence
  Description of Artificial Sequence: Synthetic peptide
AMNEIACTNPVATEQYGEASENLQRGGLR

SEQ ID NO: 75551 - protein, 28 aa, Artificial Sequence
  Description of Artificial Sequence: Synthetic peptide
DEEEIASTNPVCTEQYGVVSDIEMAGNQ

SEQ ID NO: 75552 - protein, 31 aa, Artificial Sequence
  Description of Artificial Sequence: Synthetic polypeptide
DEEEIASTNPVCTEQYGVVSDNLQMSNGMNQ

SEQ ID NO: 75553 - protein, 29 aa, Artificial Sequence
  Description of Artificial Sequence: Synthetic peptide
AMNEIACTNPVATEQYGEASENLQRGGPR

SEQ ID NO: 75554 - protein, 32 aa, Artificial Sequence
  Description of Artificial Sequence: Synthetic polypeptide
DESEIRTTNPVAYEQWGSVSTNMGGQGQGDSR

SEQ ID NO: 75555 - protein, 33 aa, Artificial Sequence
  Description of Artificial Sequence: Synthetic polypeptide
AEEEIRTTNPVATEQYGSVVVTANLGNTEGNNT

SEQ ID NO: 75556 - protein, 34 aa, Artificial Sequence
  Description of Artificial Sequence: Synthetic polypeptide
NSEEIRTTNPVATEQYGVVVSCTNMLSQDGGNRC

SEQ ID NO: 75557 - protein, 33 aa, Artificial Sequence
  Description of Artificial Sequence: Synthetic polypeptide
DESEIRTTNPVAYEQWGSVSTTNNLQHDGGNAD

SEQ ID NO: 75558 - protein, 29 aa, Artificial Sequence
  Description of Artificial Sequence: Synthetic peptide
AEVEIACTNPVATEQYGEASESNLQSGGR

SEQ ID NO: 75559 - protein, 29 aa, Artificial Sequence
  Description of Artificial Sequence: Synthetic peptide
DEEEIASTNPVATEGYGNVAENIMSRGQR

SEQ ID NO: 75560 - protein, 33 aa, Artificial Sequence
  Description of Artificial Sequence: Synthetic polypeptide
DESEIRTTNPVAYEQYGSTVSCTNQSQETGANN

SEQ ID NO: 75561 - protein, 34 aa, Artificial Sequence
  Description of Artificial Sequence: Synthetic polypeptide
DESEIRTTNPVAYEQYGMTVPSTTNLSQQNGGNR

SEQ ID NO: 75562 - protein, 33 aa, Artificial Sequence
  Description of Artificial Sequence: Synthetic polypeptide
DESEIRTTNPVAYEQYGKVSCWTNELSNRGTNP

SEQ ID NO: 75563 - protein, 34 aa, Artificial Sequence
  Description of Artificial Sequence: Synthetic polypeptide
DESEIRTTNPVAYEQYGKVSCTGNLLRTGTNNRE

SEQ ID NO: 75564 - protein, 35 aa, Artificial Sequence
  Description of Artificial Sequence: Synthetic polypeptide
DESEIRTTNPVAYEQYGKVPSCTMNLQRTGTNNRN

SEQ ID NO: 75565 - protein, 34 aa, Artificial Sequence
  Description of Artificial Sequence: Synthetic polypeptide
DESEIRTTNPVAYEQYGKLVSTTGNLQRTGGNEE

SEQ ID NO: 75566 - protein, 31 aa, Artificial Sequence
  Description of Artificial Sequence: Synthetic polypeptide
DEEEIASTNPVATEQYGSVSATDLESEGEDQ

SEQ ID NO: 75567 - protein, 33 aa, Artificial Sequence
  Description of Artificial Sequence: Synthetic polypeptide
DESEIRTTNPVAYEQYGCKVSTGNLQRTGGPEE

SEQ ID NO: 75568 - protein, 33 aa, Artificial Sequence
  Description of Artificial Sequence: Synthetic polypeptide
NSEEIRTTNPVATEQYGVTVSCTNMLSNDAGNR

SEQ ID NO: 75569 - protein, 33 aa, Artificial Sequence
  Description of Artificial Sequence: Synthetic polypeptide
NSEEIRTTNPVATEQYGVTVSCTRMLSQDGGNR

SEQ ID NO: 75570 - protein, 28 aa, Artificial Sequence
  Description of Artificial Sequence: Synthetic peptide
AGNEIACTNPCATEQYGEASENLQRGGR

SEQ ID NO: 75571 - protein, 33 aa, Artificial Sequence
  Description of Artificial Sequence: Synthetic polypeptide
DESEIRTTNPVAYEQWGSVWSLDNDLTQRDNER

SEQ ID NO: 75572 - protein, 35 aa, Artificial Sequence
  Description of Artificial Sequence: Synthetic polypeptide
DEEEIRTTNPVATEQYGSVNSTNIDDDQRGGEEFN

SEQ ID NO: 75573 - protein, 35 aa, Artificial Sequence
  Description of Artificial Sequence: Synthetic polypeptide
AEEEIRTTNPVATEQYGSVVVSVTTNLQQGNANVN

SEQ ID NO: 75574 - protein, 33 aa, Artificial Sequence
  Description of Artificial Sequence: Synthetic polypeptide
NETEIRTTNPVATECYGNVSTNLQGQMGGNNDR

SEQ ID NO: 75575 - protein, 32 aa, Artificial Sequence
  Description of Artificial Sequence: Synthetic polypeptide
NETEIRTTNPVATECYGNVSTNLQGQDGGNTQ

SEQ ID NO: 75576 - protein, 34 aa, Artificial Sequence
  Description of Artificial Sequence: Synthetic polypeptide
AEEEIRTTNPVATEQYGSVVVTTNQLQGSTGNGE

SEQ ID NO: 75577 - protein, 33 aa, Artificial Sequence
  Description of Artificial Sequence: Synthetic polypeptide
DEEEIRTTNPVATEQYGSVPSTPGYQNVNVNLF

SEQ ID NO: 75578 - protein, 29 aa, Artificial Sequence
  Description of Artificial Sequence: Synthetic peptide
DETEIACTNPVATEQWGETTAENLQRGGR

SEQ ID NO: 75579 - protein, 35 aa, Artificial Sequence
  Description of Artificial Sequence: Synthetic polypeptide
DEEEIRTTNPVATEQYGSVPSTNNLEIERVLPSRQ

SEQ ID NO: 75580 - protein, 31 aa, Artificial Sequence
  Description of Artificial Sequence: Synthetic polypeptide
NEEEIRTTNPVAYEEWGSISTHLSQGQGGNR

SEQ ID NO: 75581 - protein, 30 aa, Artificial Sequence
  Description of Artificial Sequence: Synthetic polypeptide
NEEEIRTTNPVAYEHWGCFSINDMQRGDNR

SEQ ID NO: 75582 - protein, 31 aa, Artificial Sequence
  Description of Artificial Sequence: Synthetic polypeptide
DEEEIACTNPVATEQYGSVATADQRDMNPED

SEQ ID NO: 75583 - protein, 31 aa, Artificial Sequence
  Description of Artificial Sequence: Synthetic polypeptide
AESEIATTNPVATEQYGEVSENEPQDRGENG

SEQ ID NO: 75584 - protein, 32 aa, Artificial Sequence
  Description of Artificial Sequence: Synthetic polypeptide
NEEEIRTTNPVAYEQWGCSYSRNDLDQRGSDR

SEQ ID NO: 75585 - protein, 34 aa, Artificial Sequence
  Description of Artificial Sequence: Synthetic polypeptide
NEEEIRTTNPVAYEQWGQSVISTHLSQRAGGNRA

SEQ ID NO: 75586 - protein, 31 aa, Artificial Sequence
  Description of Artificial Sequence: Synthetic polypeptide
DEEEIACTNPVATEQYGSVATNDQAGMEMTE

SEQ ID NO: 75587 - protein, 32 aa, Artificial Sequence
  Description of Artificial Sequence: Synthetic polypeptide
DEEEIACTNPVATEQYGSVATNDQASENNDRE

SEQ ID NO: 75588 - protein, 32 aa, Artificial Sequence
  Description of Artificial Sequence: Synthetic polypeptide
DEEEIACTNPVATEQYGSVATNDQDSGENDVY

SEQ ID NO: 75589 - protein, 32 aa, Artificial Sequence
  Description of Artificial Sequence: Synthetic polypeptide
NEEEIRTTNPVAYEQWGSISTHLSQDQGSNRA

SEQ ID NO: 75590 - protein, 32 aa, Artificial Sequence
  Description of Artificial Sequence: Synthetic polypeptide
DEEEIACTNPVATEQYGSVATNGLFQPAPGEF

SEQ ID NO: 75591 - protein, 32 aa, Artificial Sequence
  Description of Artificial Sequence: Synthetic polypeptide
DEEEIACTNPVATEQYGSVATNLADAPGDNNN

SEQ ID NO: 75592 - protein, 31 aa, Artificial Sequence
  Description of Artificial Sequence: Synthetic polypeptide
DETEIACTNPVATEQYGSVATNLQADEMGME

SEQ ID NO: 75593 - protein, 30 aa, Artificial Sequence
  Description of Artificial Sequence: Synthetic polypeptide
DEEEIACTNPVATEQYGSVATNLEDPMEAD

SEQ ID NO: 75594 - protein, 33 aa, Artificial Sequence
  Description of Artificial Sequence: Synthetic polypeptide
DEEEIRTTNPVATEQYGSVPSTTLLVPTVNENQ

SEQ ID NO: 75595 - protein, 31 aa, Artificial Sequence
  Description of Artificial Sequence: Synthetic polypeptide
DETEIACTNPVATEQYGSVATNLQAEDPNNN

SEQ ID NO: 75596 - protein, 33 aa, Artificial Sequence
  Description of Artificial Sequence: Synthetic polypeptide
DEEEIRTTNPVATEQYGSVPSWMNGEETGNIDT

SEQ ID NO: 75597 - protein, 33 aa, Artificial Sequence
  Description of Artificial Sequence: Synthetic polypeptide
NEEEIRTTNPVATEQYGSVSPWWNSPEFGMNRQ

SEQ ID NO: 75598 - protein, 32 aa, Artificial Sequence
  Description of Artificial Sequence: Synthetic polypeptide
AEEEIRTTNPVATEQYGSVVVVNTNDEQIDNT

SEQ ID NO: 75599 - protein, 35 aa, Artificial Sequence
  Description of Artificial Sequence: Synthetic polypeptide
DEEEIRTTNPVATEQYGSVPSVTPGLEVVGVNVRE

SEQ ID NO: 75600 - protein, 31 aa, Artificial Sequence
  Description of Artificial Sequence: Synthetic polypeptide
DEEEIACTNPVATEQYGSVAITNDTGEGVRS

SEQ ID NO: 75601 - protein, 34 aa, Artificial Sequence
  Description of Artificial Sequence: Synthetic polypeptide
AEEEIRTTNPVATEQYGSVVVTVTTNNNQEGENR

SEQ ID NO: 75602 - protein, 34 aa, Artificial Sequence
  Description of Artificial Sequence: Synthetic polypeptide
DEEEIRTTNPVATEQYGSVPSVSGNLSQTVGMQW

SEQ ID NO: 75603 - protein, 34 aa, Artificial Sequence
  Description of Artificial Sequence: Synthetic polypeptide
NEEEIRTTNPVATEQYGSVVTSTGDLGQRNANEQ

SEQ ID NO: 75604 - protein, 31 aa, Artificial Sequence
  Description of Artificial Sequence: Synthetic polypeptide
DETEIACTNPVATEQYGSVATNLQREDDTTV

SEQ ID NO: 75605 - protein, 32 aa, Artificial Sequence
  Description of Artificial Sequence: Synthetic polypeptide
DETEIACTNPVATEQYGSVATNLQGALAEGNN

SEQ ID NO: 75606 - protein, 34 aa, Artificial Sequence
  Description of Artificial Sequence: Synthetic polypeptide
DEEEIRTTNPVATEQYGSVPSTTQVQVHGVTENQ

SEQ ID NO: 75607 - protein, 31 aa, Artificial Sequence
  Description of Artificial Sequence: Synthetic polypeptide
DETEIACTNPVATEQYGSVATNLQGAGEGAN

SEQ ID NO: 75608 - protein, 31 aa, Artificial Sequence
  Description of Artificial Sequence: Synthetic polypeptide
DETEIACTNPVATEQYGSVATNLQDTDGTEA

SEQ ID NO: 75609 - protein, 32 aa, Artificial Sequence
  Description of Artificial Sequence: Synthetic polypeptide
DETEIACTNPVATEQYGSVATNLQAEGPNENL

SEQ ID NO: 75610 - protein, 31 aa, Artificial Sequence
  Description of Artificial Sequence: Synthetic polypeptide
NEEEIRTTNPVATEQYGSYTTMELNQREQGG

SEQ ID NO: 75611 - protein, 31 aa, Artificial Sequence
  Description of Artificial Sequence: Synthetic polypeptide
AESEIATTNPVATEQYGEASENLPQDRGENG

SEQ ID NO: 75612 - protein, 33 aa, Artificial Sequence
  Description of Artificial Sequence: Synthetic polypeptide
NEEEIRTTNPVATEQYGSVSPTNHVMREENQNE

SEQ ID NO: 75613 - protein, 31 aa, Artificial Sequence
  Description of Artificial Sequence: Synthetic polypeptide
NEEEIRTTNPVAYEQWGSISTHLSQLQGGNS

SEQ ID NO: 75614 - protein, 31 aa, Artificial Sequence
  Description of Artificial Sequence: Synthetic polypeptide
DEEEIACTNPVATEQYGSVATNLQAAEAEEN

SEQ ID NO: 75615 - protein, 32 aa, Artificial Sequence
  Description of Artificial Sequence: Synthetic polypeptide
DEEEIACTNPVATEQYGSVATNLQAPDEKANE

SEQ ID NO: 75616 - protein, 31 aa, Artificial Sequence
  Description of Artificial Sequence: Synthetic polypeptide
NEEEIRTTNPVAYEQWGSVRAENDLDEDGNR

SEQ ID NO: 75617 - protein, 30 aa, Artificial Sequence
  Description of Artificial Sequence: Synthetic polypeptide
NEEEIRTTNPVAYEQWGSVRAWNLDEDGNH

SEQ ID NO: 75618 - protein, 32 aa, Artificial Sequence
  Description of Artificial Sequence: Synthetic polypeptide
DEEEIACTNPVATEQYGSVATNLQDADENTNE

SEQ ID NO: 75619 - protein, 31 aa, Artificial Sequence
  Description of Artificial Sequence: Synthetic polypeptide
NEEEIRTTNPVAYEQWGSVSKGWNLDEGGER

SEQ ID NO: 75620 - protein, 32 aa, Artificial Sequence
  Description of Artificial Sequence: Synthetic polypeptide
DEEEIACTNPVATEQYGSVATNLQDAHGVDVQ

SEQ ID NO: 75621 - protein, 32 aa, Artificial Sequence
  Description of Artificial Sequence: Synthetic polypeptide
DEEEIACTNPVATEQYGSVATNLQDGPGGEGE

SEQ ID NO: 75622 - protein, 32 aa, Artificial Sequence
  Description of Artificial Sequence: Synthetic polypeptide
NEEEIRTTNPVAYEQWGSVSRAWNLDEDNGNR

SEQ ID NO: 75623 - protein, 36 aa, Artificial Sequence
  Description of Artificial Sequence: Synthetic polypeptide
DEEEIRTTNPVATEQYGSVSSTTPNEPQDREGENPG

SEQ ID NO: 75624 - protein, 36 aa, Artificial Sequence
  Description of Artificial Sequence: Synthetic polypeptide
DEEEIRTTNPVATEQYGSVSSTTPNEPQDREGENPV

SEQ ID NO: 75625 - protein, 32 aa, Artificial Sequence
  Description of Artificial Sequence: Synthetic polypeptide
NEEEIRTTNPVAYEQWGTISTTHLSQRQGGNR

SEQ ID NO: 75626 - protein, 35 aa, Artificial Sequence
  Description of Artificial Sequence: Synthetic polypeptide
DEEEIRTTNPVATEQYGSVSSTTPNGNMRNGMNPV

SEQ ID NO: 75627 - protein, 34 aa, Artificial Sequence
  Description of Artificial Sequence: Synthetic polypeptide
DEEEIRTTNPVATEQYGSVPSGTNSSGFGGSNTI

SEQ ID NO: 75628 - protein, 35 aa, Artificial Sequence
  Description of Artificial Sequence: Synthetic polypeptide
DEEEIRTTNPVATEQYGSVSSTTPNGPNMRGMNPV

SEQ ID NO: 75629 - protein, 33 aa, Artificial Sequence
  Description of Artificial Sequence: Synthetic polypeptide
AEEEIRTTNPVATEQYGSVVVTVTNNQQQGNGQ

SEQ ID NO: 75630 - protein, 34 aa, Artificial Sequence
  Description of Artificial Sequence: Synthetic polypeptide
DEEEIRTTNPVATEQYGSVPSPPNLNQVHIVNDF

SEQ ID NO: 75631 - protein, 34 aa, Artificial Sequence
  Description of Artificial Sequence: Synthetic polypeptide
DEEEIACTNPVATEQYGSVATNLPQEQGEGNPRD

SEQ ID NO: 75632 - protein, 30 aa, Artificial Sequence
  Description of Artificial Sequence: Synthetic polypeptide
NEEEIRTTNPVAYEQWGSVAWALEQTNGAR

SEQ ID NO: 75633 - protein, 33 aa, Artificial Sequence
  Description of Artificial Sequence: Synthetic polypeptide
DEEEIRTTNPVATEQYGSVPSPPPPARVGVNLI

SEQ ID NO: 75634 - protein, 32 aa, Artificial Sequence
  Description of Artificial Sequence: Synthetic polypeptide
DEEEIACTNPVATEQYGSVATNLQADAPNNNL

SEQ ID NO: 75635 - protein, 32 aa, Artificial Sequence
  Description of Artificial Sequence: Synthetic polypeptide
DEEEIACTNPVATEQYGSVATNLQADPQNNNN

SEQ ID NO: 75636 - protein, 31 aa, Artificial Sequence
  Description of Artificial Sequence: Synthetic polypeptide
DEEEIACTNPVATEQYGSVATNLQAEDDQTV

SEQ ID NO: 75637 - protein, 31 aa, Artificial Sequence
  Description of Artificial Sequence: Synthetic polypeptide
DEEEIACTNPVATEQYGSVATNLQAEDDSEN

SEQ ID NO: 75638 - protein, 32 aa, Artificial Sequence
  Description of Artificial Sequence: Synthetic polypeptide
DETCIRTTNPLATEQWGSVSCFNALQSGGNNR

SEQ ID NO: 75639 - protein, 32 aa, Artificial Sequence
  Description of Artificial Sequence: Synthetic polypeptide
DEEEIACTNPVATEQYGSVATNLQAEDDTHNN

SEQ ID NO: 75640 - protein, 34 aa, Artificial Sequence
  Description of Artificial Sequence: Synthetic polypeptide
DEEEIRTTNPVATEQYGSVPSPYPGLIRVGVNQP

SEQ ID NO: 75641 - protein, 30 aa, Artificial Sequence
  Description of Artificial Sequence: Synthetic polypeptide
AESEIRCTNPVATECWGSASCNLPQDRGNG

SEQ ID NO: 75642 - protein, 30 aa, Artificial Sequence
  Description of Artificial Sequence: Synthetic polypeptide
NEEEIRTTNPVAYEQWGSVAKALEQMGDGR

SEQ ID NO: 75643 - protein, 30 aa, Artificial Sequence
  Description of Artificial Sequence: Synthetic polypeptide
AESEIRCTNPVATECYGEASCNLPQDRGNG

SEQ ID NO: 75644 - protein, 35 aa, Artificial Sequence
  Description of Artificial Sequence: Synthetic polypeptide
DEEEIRTTNPVATEQYGSVPSPVTNGLQGISVENT

SEQ ID NO: 75645 - protein, 30 aa, Artificial Sequence
  Description of Artificial Sequence: Synthetic polypeptide
NEEEIRTTNPVAYEQWGSVAKELEQNGDER

SEQ ID NO: 75646 - protein, 31 aa, Artificial Sequence
  Description of Artificial Sequence: Synthetic polypeptide
DEEEIACTNPVATEQYGSVATNLQAEDDTPA

SEQ ID NO: 75647 - protein, 30 aa, Artificial Sequence
  Description of Artificial Sequence: Synthetic polypeptide
NEEEIRTTNPVAYEQWGSVAKSLEQNGDFR

SEQ ID NO: 75648 - protein, 30 aa, Artificial Sequence
  Description of Artificial Sequence: Synthetic polypeptide
AESEIRCTNPVATECYGEASENLQDRGEGR

SEQ ID NO: 75649 - protein, 30 aa, Artificial Sequence
  Description of Artificial Sequence: Synthetic polypeptide
DETCIRTTNPLATEQFGSVCSWNHQSGSNA

SEQ ID NO: 75650 - protein, 30 aa, Artificial Sequence
  Description of Artificial Sequence: Synthetic polypeptide
NEEEIRTTNPVAYHQYGAVICSTNETGGNA

SEQ ID NO: 75651 - protein, 34 aa, Artificial Sequence
  Description of Artificial Sequence: Synthetic polypeptide
AEEEIRTTNPVATEQYGSVVVVSTDNNQQIGNLG

SEQ ID NO: 75652 - protein, 34 aa, Artificial Sequence
  Description of Artificial Sequence: Synthetic polypeptide
NEEEIRTTNPVATEQYGSVSPAINQLDEFAGNPR

SEQ ID NO: 75653 - protein, 33 aa, Artificial Sequence
  Description of Artificial Sequence: Synthetic polypeptide
AEEEIRTTNPVATEQYGSVVVVTNQLGGNGNED

SEQ ID NO: 75654 - protein, 33 aa, Artificial Sequence
  Description of Artificial Sequence: Synthetic polypeptide
AEEEIRTTNPVATEQYGSVVVVTNQEQGDEGNQ

SEQ ID NO: 75655 - protein, 35 aa, Artificial Sequence
  Description of Artificial Sequence: Synthetic polypeptide
DEEEIRTTNPVATEQYGSVPTNNGPLNRQGNELLI

SEQ ID NO: 75656 - protein, 33 aa, Artificial Sequence
  Description of Artificial Sequence: Synthetic polypeptide
DETEIATTNPVATEQYGSVAITNLERAGENGEH

SEQ ID NO: 75657 - protein, 31 aa, Artificial Sequence
  Description of Artificial Sequence: Synthetic polypeptide
DETEIATTNPVATEQYGSVAITNDQDSGEQE

SEQ ID NO: 75658 - protein, 32 aa, Artificial Sequence
  Description of Artificial Sequence: Synthetic polypeptide
DETEIATTNPVATEQYGSVAANLIQESGDNEE

SEQ ID NO: 75659 - protein, 32 aa, Artificial Sequence
  Description of Artificial Sequence: Synthetic polypeptide
DETEIATTNPVATEQYGCVSHTDNQNQGGSNS

SEQ ID NO: 75660 - protein, 31 aa, Artificial Sequence
  Description of Artificial Sequence: Synthetic polypeptide
NEEEIRTTNPVATEQYGSVSADVLDEFENQI

SEQ ID NO: 75661 - protein, 31 aa, Artificial Sequence
  Description of Artificial Sequence: Synthetic polypeptide
DETEIATTNPVATEQYGCVAATNDQDGNNDD

SEQ ID NO: 75662 - protein, 31 aa, Artificial Sequence
  Description of Artificial Sequence: Synthetic polypeptide
NEEEIRTTNPVATEQYGSVSADVQDEFFNQD

SEQ ID NO: 75663 - protein, 34 aa, Artificial Sequence
  Description of Artificial Sequence: Synthetic polypeptide
DEEEIRTTNPVATEQYGSVSSTTPALEDHEGNDV

SEQ ID NO: 75664 - protein, 33 aa, Artificial Sequence
  Description of Artificial Sequence: Synthetic polypeptide
AEEEIRTTNPVATEQYGSVVVVTNNLQELQNGI

SEQ ID NO: 75665 - protein, 31 aa, Artificial Sequence
  Description of Artificial Sequence: Synthetic polypeptide
DETEIATTNPVATEQWGSVSMSGNGERGVNQ

SEQ ID NO: 75666 - protein, 33 aa, Artificial Sequence
  Description of Artificial Sequence: Synthetic polypeptide
NEEEIRTTNPVATEQYGSVSAGNLDDEFGNNGE

SEQ ID NO: 75667 - protein, 34 aa, Artificial Sequence
  Description of Artificial Sequence: Synthetic polypeptide
DEEEIRTTNPVATEQYGSVSSTTPALNMHEGNPL

SEQ ID NO: 75668 - protein, 34 aa, Artificial Sequence
  Description of Artificial Sequence: Synthetic polypeptide
AEEEIRTTNPVATEQYGSVVVVTSNLGNQAGNNT

SEQ ID NO: 75669 - protein, 32 aa, Artificial Sequence
  Description of Artificial Sequence: Synthetic polypeptide
NEEEIRTTNPVATEQYGSVSAGNLDEFFGSDA

SEQ ID NO: 75670 - protein, 34 aa, Artificial Sequence
  Description of Artificial Sequence: Synthetic polypeptide
NEEEIRTTNPVATEQYGSVNLTSNGNQRGENEGG

SEQ ID NO: 75671 - protein, 34 aa, Artificial Sequence
  Description of Artificial Sequence: Synthetic polypeptide
DEEEIRTTNPVATEQYGSVPTNVEQARIGLEEMD

SEQ ID NO: 75672 - protein, 34 aa, Artificial Sequence
  Description of Artificial Sequence: Synthetic polypeptide
AEEEIRTTNPVATEQYGSVVVVTTNLEQGGNQQE

SEQ ID NO: 75673 - protein, 34 aa, Artificial Sequence
  Description of Artificial Sequence: Synthetic polypeptide
AEEEIRTTNPVATEQYGSVVVVTTNLENQGGNQQ

SEQ ID NO: 75674 - protein, 32 aa, Artificial Sequence
  Description of Artificial Sequence: Synthetic polypeptide
DEEEIACTNPVATEQYGSASTEPNGPNRGMNV

SEQ ID NO: 75675 - protein, 33 aa, Artificial Sequence
  Description of Artificial Sequence: Synthetic polypeptide
NEEEIRTTNPVATEQYGSVCYAWNLDEHGGNDR

SEQ ID NO: 75676 - protein, 28 aa, Artificial Sequence
  Description of Artificial Sequence: Synthetic peptide
AESEIASTNPVATEGYGVAAENLQRGGR

SEQ ID NO: 75677 - protein, 33 aa, Artificial Sequence
  Description of Artificial Sequence: Synthetic polypeptide
DEEEIRTTNPVATEQYGSVPTTPVGIQVMENQR

SEQ ID NO: 75678 - protein, 28 aa, Artificial Sequence
  Description of Artificial Sequence: Synthetic peptide
AESEIASTNPVATEQYGEAAENLQRGGI

SEQ ID NO: 75679 - protein, 33 aa, Artificial Sequence
  Description of Artificial Sequence: Synthetic polypeptide
DETEIATTNPVATEQYGSVSTNLNQGAEGGDMS

SEQ ID NO: 75680 - protein, 34 aa, Artificial Sequence
  Description of Artificial Sequence: Synthetic polypeptide
DEEEIRTTNPVATEQYGSVPTTNLEQLVGLEEMD

SEQ ID NO: 75681 - protein, 35 aa, Artificial Sequence
  Description of Artificial Sequence: Synthetic polypeptide
DEEEIRTTNPVATEQYGSVPTTNLEQERMGLVEED

SEQ ID NO: 75682 - protein, 33 aa, Artificial Sequence
  Description of Artificial Sequence: Synthetic polypeptide
NEEEIRTTNPVATEQYGSVISWEHGQQRQMGGR

SEQ ID NO: 75683 - protein, 34 aa, Artificial Sequence
  Description of Artificial Sequence: Synthetic polypeptide
DEEEIRTTNPVATEQYGSVPTSFLEQERGLEEED

SEQ ID NO: 75684 - protein, 32 aa, Artificial Sequence
  Description of Artificial Sequence: Synthetic polypeptide
NEEEIRTTNPVATEQYGSVLSWEHGQRQGGQD

SEQ ID NO: 75685 - protein, 32 aa, Artificial Sequence
  Description of Artificial Sequence: Synthetic polypeptide
NEEEIRTTNPVATEQYGSVLSWEHGQRQGGSH

SEQ ID NO: 75686 - protein, 32 aa, Artificial Sequence
  Description of Artificial Sequence: Synthetic polypeptide
DEEEIRTTNPVATEQYGSVPTPACPQMRNEEV

SEQ ID NO: 75687 - protein, 34 aa, Artificial Sequence
  Description of Artificial Sequence: Synthetic polypeptide
DEEEIRTTNPVATEQYGSVPTNSLEQATGPEEMD

SEQ ID NO: 75688 - protein, 34 aa, Artificial Sequence
  Description of Artificial Sequence: Synthetic polypeptide
AEEEIRTTNPVATEQYGSVVVVSTDNQQGIGNLE

SEQ ID NO: 75689 - protein, 34 aa, Artificial Sequence
  Description of Artificial Sequence: Synthetic polypeptide
DEEEIRTTNPVATEQYGSVSSTTPALNMHEGNPV

SEQ ID NO: 75690 - protein, 32 aa, Artificial Sequence
  Description of Artificial Sequence: Synthetic polypeptide
AEEEIRTTNPVATEQYGSVVVVTNNDQENENE

SEQ ID NO: 75691 - protein, 32 aa, Artificial Sequence
  Description of Artificial Sequence: Synthetic polypeptide
DETEIATTNPVATEQWGSVSAENLQQGDNPSF

SEQ ID NO: 75692 - protein, 33 aa, Artificial Sequence
  Description of Artificial Sequence: Synthetic polypeptide
DEEEIRTTNPVATEQYGSVPTLLEQLNGLEEMD

SEQ ID NO: 75693 - protein, 33 aa, Artificial Sequence
  Description of Artificial Sequence: Synthetic polypeptide
NEEEIRTTNPVATEQYGSVSEAWNQQDEFGSVR

SEQ ID NO: 75694 - protein, 31 aa, Artificial Sequence
  Description of Artificial Sequence: Synthetic polypeptide
DETEIATTNPVATEMWGSVATNLETRGNEYT

SEQ ID NO: 75695 - protein, 31 aa, Artificial Sequence
  Description of Artificial Sequence: Synthetic polypeptide
DETEIATTNPVATEIWGSVSTNLQGNGMDGK

SEQ ID NO: 75696 - protein, 32 aa, Artificial Sequence
  Description of Artificial Sequence: Synthetic polypeptide
DEEEIRTTNPVATEQYGSVPTEGQQQRETVQL

SEQ ID NO: 75697 - protein, 35 aa, Artificial Sequence
  Description of Artificial Sequence: Synthetic polypeptide
AEEEIRTTNPVATEQYGSVVVVSTNNLQQGEGNTD

SEQ ID NO: 75698 - protein, 32 aa, Artificial Sequence
  Description of Artificial Sequence: Synthetic polypeptide
DETEIATTNPVATEFWGSVSTNLQGDLGGNGS

SEQ ID NO: 75699 - protein, 31 aa, Artificial Sequence
  Description of Artificial Sequence: Synthetic polypeptide
NEEEIRTTNPVATEQYGSVSMDVLDEFFHNQ

SEQ ID NO: 75700 - protein, 33 aa, Artificial Sequence
  Description of Artificial Sequence: Synthetic polypeptide
NEEEIRTTNPVATEQYGSVSMTENIFEKGGNKN

SEQ ID NO: 75701 - protein, 33 aa, Artificial Sequence
  Description of Artificial Sequence: Synthetic polypeptide
NEEEIRTTNPVATEQYGSVSNAWNLDEFGSQNE

SEQ ID NO: 75702 - protein, 32 aa, Artificial Sequence
  Description of Artificial Sequence: Synthetic polypeptide
NEEEIRTTNPVATEQYGSVSNLWNLDEFGSQI

SEQ ID NO: 75703 - protein, 34 aa, Artificial Sequence
  Description of Artificial Sequence: Synthetic polypeptide
AEEEIRTTNPVATEQYGSVVVVSTDNQQIGTNLD

SEQ ID NO: 75704 - protein, 35 aa, Artificial Sequence
  Description of Artificial Sequence: Synthetic polypeptide
DEEEIRTTNPVATEQYGSVPSYTNSSGTRVGNMTI

SEQ ID NO: 75705 - protein, 32 aa, Artificial Sequence
  Description of Artificial Sequence: Synthetic polypeptide
NEEEIRTTNPVATEQYGSVSPAINAENEFGLR

SEQ ID NO: 75706 - protein, 33 aa, Artificial Sequence
  Description of Artificial Sequence: Synthetic polypeptide
AEEEIRTTNPVATEQYGSVVVVTNDQSGVDNGT

SEQ ID NO: 75707 - protein, 33 aa, Artificial Sequence
  Description of Artificial Sequence: Synthetic polypeptide
AEEEIRTTNPVATEQYGSVVVVTNNLGGNNGND

SEQ ID NO: 75708 - protein, 33 aa, Artificial Sequence
  Description of Artificial Sequence: Synthetic polypeptide
AEEEIRTTNPVATEQYGSVVVVTNLGGGNNGND

SEQ ID NO: 75709 - protein, 32 aa, Artificial Sequence
  Description of Artificial Sequence: Synthetic polypeptide
DEEEIRTTNPVATEQYGSVPTMLQQAMELVHE

SEQ ID NO: 75710 - protein, 35 aa, Artificial Sequence
  Description of Artificial Sequence: Synthetic polypeptide
DEEEIRTTNPVATEQYGSVSSTTPALNMRNGMNPV

SEQ ID NO: 75711 - protein, 34 aa, Artificial Sequence
  Description of Artificial Sequence: Synthetic polypeptide
AEEEIRTTNPVATEQYGSVVVVTNLQQGIGNTTE

SEQ ID NO: 75712 - protein, 32 aa, Artificial Sequence
  Description of Artificial Sequence: Synthetic polypeptide
NEEEIRTTNPVATEQYGSVSAGNMEDEFGNGT

SEQ ID NO: 75713 - protein, 34 aa, Artificial Sequence
  Description of Artificial Sequence: Synthetic polypeptide
AEEEIRTTNPVATEQYGSVVVVTNLQNNEAGQNE

SEQ ID NO: 75714 - protein, 33 aa, Artificial Sequence
  Description of Artificial Sequence: Synthetic polypeptide
AEEEIRTTNPVATEQYGSVVVVTNLQELQNNGI

SEQ ID NO: 75715 - protein, 34 aa, Artificial Sequence
  Description of Artificial Sequence: Synthetic polypeptide
AEEEIRTTNPVATEQYGSVVVVTNLNQQGGNQTE

SEQ ID NO: 75716 - protein, 34 aa, Artificial Sequence
  Description of Artificial Sequence: Synthetic polypeptide
AEEEIRTTNPVATEQYGSVVVVTNLNQDQGENGT

SEQ ID NO: 75717 - protein, 35 aa, Artificial Sequence
  Description of Artificial Sequence: Synthetic polypeptide
DEEEIRTTNPVATEQYGSVSSTTPALPNMRNGMNV

SEQ ID NO: 75718 - protein, 35 aa, Artificial Sequence
  Description of Artificial Sequence: Synthetic polypeptide
DEEEIRTTNPVATEQYGSVSSTTPALPNMRNGNPV

SEQ ID NO: 75719 - protein, 31 aa, Artificial Sequence
  Description of Artificial Sequence: Synthetic polypeptide
DEEEIACTNPVATEQYGSCATNLQAEDDTNH

SEQ ID NO: 75720 - protein, 33 aa, Artificial Sequence
  Description of Artificial Sequence: Synthetic polypeptide
AEEEIRTTNPVATEQYGSVVVVTNLGGTNGNEE

SEQ ID NO: 75721 - protein, 35 aa, Artificial Sequence
  Description of Artificial Sequence: Synthetic polypeptide
DEEEIRTTNPVATEQYGSVSSTTPALPNRNGMNPV

SEQ ID NO: 75722 - protein, 33 aa, Artificial Sequence
  Description of Artificial Sequence: Synthetic polypeptide
DEEEIRTTNPVATEQYGSVPTNGMTQESTQNDA

SEQ ID NO: 75723 - protein, 33 aa, Artificial Sequence
  Description of Artificial Sequence: Synthetic polypeptide
AEEEIRTTNPVATEQYGSVVVVTNLGGNGNQED

SEQ ID NO: 75724 - protein, 33 aa, Artificial Sequence
  Description of Artificial Sequence: Synthetic polypeptide
DEEEIACTNPVATEQYGSCSTNVLQEQMGNSLH

SEQ ID NO: 75725 - protein, 32 aa, Artificial Sequence
  Description of Artificial Sequence: Synthetic polypeptide
DEEEIRTTNPVATEQYGSVPTLQIEQEMNLNI

SEQ ID NO: 75726 - protein, 28 aa, Artificial Sequence
  Description of Artificial Sequence: Synthetic peptide
QEEEIATVNPVATEQYGEVPEVLQHENK

SEQ ID NO: 75727 - protein, 35 aa, Artificial Sequence
  Description of Artificial Sequence: Synthetic polypeptide
DEEEIRTTNPVATEQYGSVSSTTPNGPNMRNGMNV

SEQ ID NO: 75728 - protein, 31 aa, Artificial Sequence
  Description of Artificial Sequence: Synthetic polypeptide
NEEEIYTTNPVATEQYGHVSAWNLDETFGNQ

SEQ ID NO: 75729 - protein, 32 aa, Artificial Sequence
  Description of Artificial Sequence: Synthetic polypeptide
NEREIRTTNPVAYEQYGSVVWTNHSQIGGSNR

SEQ ID NO: 75730 - protein, 35 aa, Artificial Sequence
  Description of Artificial Sequence: Synthetic polypeptide
DEEEIRTTNPVATEQYGSVSTAEPDQHRSGQNVEV

SEQ ID NO: 75731 - protein, 34 aa, Artificial Sequence
  Description of Artificial Sequence: Synthetic polypeptide
AEEEIRTTNPVATEQYGSVVVTTVNNLQGSTGNG

SEQ ID NO: 75732 - protein, 32 aa, Artificial Sequence
  Description of Artificial Sequence: Synthetic polypeptide
DEEEIRTTNPVATEQYGSVPMNLMERAMPEID

SEQ ID NO: 75733 - protein, 34 aa, Artificial Sequence
  Description of Artificial Sequence: Synthetic polypeptide
AEEEIRTTNPVATEQYGSVVVTTVNLQSNEQGNN

SEQ ID NO: 75734 - protein, 34 aa, Artificial Sequence
  Description of Artificial Sequence: Synthetic polypeptide
AEEEIRTTNPVATEQYGSVVVTTVNLQEGNVEDE

SEQ ID NO: 75735 - protein, 33 aa, Artificial Sequence
  Description of Artificial Sequence: Synthetic polypeptide
DEEEIRTTNPVATEQYGSVSTALNPDNLDVEQT

SEQ ID NO: 75736 - protein, 33 aa, Artificial Sequence
  Description of Artificial Sequence: Synthetic polypeptide
NESEIRTTNPVATEQYGSVSWTDNHQQQDHGSR

SEQ ID NO: 75737 - protein, 30 aa, Artificial Sequence
  Description of Artificial Sequence: Synthetic polypeptide
AETEIACTNPVATEQYGEASENLQRGGGYR

SEQ ID NO: 75738 - protein, 33 aa, Artificial Sequence
  Description of Artificial Sequence: Synthetic polypeptide
DEEEIRTTNPVATEQYGSVPIPTELQIRQTEED

SEQ ID NO: 75739 - protein, 33 aa, Artificial Sequence
  Description of Artificial Sequence: Synthetic polypeptide
DEEEIRTTNPVATEQYGSVPILNEEQLLVNQRE

SEQ ID NO: 75740 - protein, 32 aa, Artificial Sequence
  Description of Artificial Sequence: Synthetic polypeptide
DESEVRTTNPVATECWGSVSCINEQDREGENR

SEQ ID NO: 75741 - protein, 31 aa, Artificial Sequence
  Description of Artificial Sequence: Synthetic polypeptide
NESEIRTTNPVAYEAYGSVVWTNESQIGSNR

SEQ ID NO: 75742 - protein, 32 aa, Artificial Sequence
  Description of Artificial Sequence: Synthetic polypeptide
NESEIRTTNPVAYECWGSVSTNLQQGNDGDSR

SEQ ID NO: 75743 - protein, 32 aa, Artificial Sequence
  Description of Artificial Sequence: Synthetic polypeptide
DEDEIRTTNPVATEAYGSVSTNGAGEHGNNSD

SEQ ID NO: 75744 - protein, 31 aa, Artificial Sequence
  Description of Artificial Sequence: Synthetic polypeptide
NEREIRTTNPVATEQYGSVWVNMHEVIGNSR

SEQ ID NO: 75745 - protein, 34 aa, Artificial Sequence
  Description of Artificial Sequence: Synthetic polypeptide
DEDEIRTTNPVATEAYGSVSTGNLAQGETGNNSD

SEQ ID NO: 75746 - protein, 33 aa, Artificial Sequence
  Description of Artificial Sequence: Synthetic polypeptide
AEEEIRTTNPVATEQYGSVVVTVNLGNEAGNNF

SEQ ID NO: 75747 - protein, 30 aa, Artificial Sequence
  Description of Artificial Sequence: Synthetic polypeptide
DESSIRTTNPCATEQFGSVSFNLTQEGQQK

SEQ ID NO: 75748 - protein, 30 aa, Artificial Sequence
  Description of Artificial Sequence: Synthetic polypeptide
NEREIRTTNPVATEQYGCVWTNDQNFGSDA

SEQ ID NO: 75749 - protein, 30 aa, Artificial Sequence
  Description of Artificial Sequence: Synthetic polypeptide
NEREIRTTNPVATEQYGCVWWNLQNSGSQQ

SEQ ID NO: 75750 - protein, 30 aa, Artificial Sequence
  Description of Artificial Sequence: Synthetic polypeptide
NEREIRTTNPVATEQYGEAVETNLEIGMSE

SEQ ID NO: 75751 - protein, 33 aa, Artificial Sequence
  Description of Artificial Sequence: Synthetic polypeptide
AEEEIRTTNPVATEQYGSVVVTVNNNNTQGNNR

SEQ ID NO: 75752 - protein, 32 aa, Artificial Sequence
  Description of Artificial Sequence: Synthetic polypeptide
DESTIRTTNPVATEQYGCVETNGPGQRGNTEI

SEQ ID NO: 75753 - protein, 31 aa, Artificial Sequence
  Description of Artificial Sequence: Synthetic polypeptide
NEREIRTTNPVATEQYGSVCWTNLANFGSDA

SEQ ID NO: 75754 - protein, 32 aa, Artificial Sequence
  Description of Artificial Sequence: Synthetic polypeptide
DESTIRTTNPVATEQYGCVETDNGDQRGANGQ

SEQ ID NO: 75755 - protein, 31 aa, Artificial Sequence
  Description of Artificial Sequence: Synthetic polypeptide
DESTIRTTNPVATEQYGCVENNGPGQRGNTV

SEQ ID NO: 75756 - protein, 31 aa, Artificial Sequence
  Description of Artificial Sequence: Synthetic polypeptide
DESTICTTNPVATEQWGSVSTTDGLQQGNMD

SEQ ID NO: 75757 - protein, 33 aa, Artificial Sequence
  Description of Artificial Sequence: Synthetic polypeptide
AEEEIRTTNPVATEQYGSVVVTVNNEQNGNNPS

SEQ ID NO: 75758 - protein, 28 aa, Artificial Sequence
  Description of Artificial Sequence: Synthetic peptide
AETEIACTNPVATEQWGAASENLARGGR

SEQ ID NO: 75759 - protein, 34 aa, Artificial Sequence
  Description of Artificial Sequence: Synthetic polypeptide
AEEEIRTTNPVATEQYGSVVVTVNLQQGNGNNTE

SEQ ID NO: 75760 - protein, 28 aa, Artificial Sequence
  Description of Artificial Sequence: Synthetic peptide
AETEIACTNPVATEQWGEASANWQRGPR

SEQ ID NO: 75761 - protein, 30 aa, Artificial Sequence
  Description of Artificial Sequence: Synthetic polypeptide
DESSIRTTNPIATEQFGSVSFNLTQEGEKN

SEQ ID NO: 75762 - protein, 33 aa, Artificial Sequence
  Description of Artificial Sequence: Synthetic polypeptide
NEREIRTTNPVATEQYGSVPWVTMELQIEGNSR

SEQ ID NO: 75763 - protein, 33 aa, Artificial Sequence
  Description of Artificial Sequence: Synthetic polypeptide
AEEEIRTTNPVATEQYGSVVVTVNLNGTQGNNT

SEQ ID NO: 75764 - protein, 31 aa, Artificial Sequence
  Description of Artificial Sequence: Synthetic polypeptide
NEREIRTTNPVATEQYGCVTQTNLQIIGSEQ

SEQ ID NO: 75765 - protein, 33 aa, Artificial Sequence
  Description of Artificial Sequence: Synthetic polypeptide
DEEEIRTTNPVATEQYGSVPHPPVGLQRVGGLI

SEQ ID NO: 75766 - protein, 34 aa, Artificial Sequence
  Description of Artificial Sequence: Synthetic polypeptide
DEEEIRTTNPVATEQYGSVSTANDMTQESTQNFA

SEQ ID NO: 75767 - protein, 31 aa, Artificial Sequence
  Description of Artificial Sequence: Synthetic polypeptide
NETEIATTNPVATEYYGEVSTNLQGQGGDNE

SEQ ID NO: 75768 - protein, 32 aa, Artificial Sequence
  Description of Artificial Sequence: Synthetic polypeptide
DESEIVTTNPVATEQYGSVSNNGLFQEGGGEQ

SEQ ID NO: 75769 - protein, 33 aa, Artificial Sequence
  Description of Artificial Sequence: Synthetic polypeptide
DEEEIRTTNPVATEQYGSVPCWDNHGGQRGEAN

SEQ ID NO: 75770 - protein, 33 aa, Artificial Sequence
  Description of Artificial Sequence: Synthetic polypeptide
DESEIVTTNPVATEQYGSVCSATINPVQFEGND

SEQ ID NO: 75771 - protein, 32 aa, Artificial Sequence
  Description of Artificial Sequence: Synthetic polypeptide
DESEIVTTNPVATEQWGSVSTINPVQDFEGND

SEQ ID NO: 75772 - protein, 32 aa, Artificial Sequence
  Description of Artificial Sequence: Synthetic polypeptide
DESEIVTTNPVATEQWGSVSTINEVQDFEGND

SEQ ID NO: 75773 - protein, 34 aa, Artificial Sequence
  Description of Artificial Sequence: Synthetic polypeptide
DEEEIRTTNPVATEQYGSVSTCPAGPNMRNGNPV

SEQ ID NO: 75774 - protein, 34 aa, Artificial Sequence
  Description of Artificial Sequence: Synthetic polypeptide
AEEEIRTTNPVATEQYGSVVVTTNQLQQGNGNTE

SEQ ID NO: 75775 - protein, 34 aa, Artificial Sequence
  Description of Artificial Sequence: Synthetic polypeptide
AEEEIRTTNPVATEQYGSVVVTTNQLQNQEGTNG

SEQ ID NO: 75776 - protein, 32 aa, Artificial Sequence
  Description of Artificial Sequence: Synthetic polypeptide
NETEIRTTNPVATECWGNVSTNLQGQEGNGNR

SEQ ID NO: 75777 - protein, 31 aa, Artificial Sequence
  Description of Artificial Sequence: Synthetic polypeptide
DEEEIRTTNPVATEQYGSVPAVVGIRIMQND

SEQ ID NO: 75778 - protein, 34 aa, Artificial Sequence
  Description of Artificial Sequence: Synthetic polypeptide
DEEEIRTTNPVATEQYGSVSTCPAGPNRNGMNPV

SEQ ID NO: 75779 - protein, 32 aa, Artificial Sequence
  Description of Artificial Sequence: Synthetic polypeptide
NETEIRTTNPVATECWGSVSTNLQGNDGNTDN

SEQ ID NO: 75780 - protein, 32 aa, Artificial Sequence
  Description of Artificial Sequence: Synthetic polypeptide
NETEIRTTNPVATECWGSVSTNLQGNEGTNDN

SEQ ID NO: 75781 - protein, 32 aa, Artificial Sequence
  Description of Artificial Sequence: Synthetic polypeptide
NETEIRTTNPVATECYGNVSTNLNQGQDGGNL

SEQ ID NO: 75782 - protein, 34 aa, Artificial Sequence
  Description of Artificial Sequence: Synthetic polypeptide
DEEEIRTTNPVATEQYGSVSTAPPLDVRIDGSQY

SEQ ID NO: 75783 - protein, 34 aa, Artificial Sequence
  Description of Artificial Sequence: Synthetic polypeptide
AEEEIRTTNPVATEQYGSVVVTTTNLGQQGNGNT

SEQ ID NO: 75784 - protein, 30 aa, Artificial Sequence
  Description of Artificial Sequence: Synthetic polypeptide
NETEIATTNPVATEQYGVVWTDNHQIGDSR

SEQ ID NO: 75785 - protein, 31 aa, Artificial Sequence
  Description of Artificial Sequence: Synthetic polypeptide
NETEIATTNPVATEQYGEVSKAWNLDEGGNR

SEQ ID NO: 75786 - protein, 36 aa, Artificial Sequence
  Description of Artificial Sequence: Synthetic polypeptide
DEEEIRTTNPVATEQYGSVPFCTNEHSQERDMGINR

SEQ ID NO: 75787 - protein, 32 aa, Artificial Sequence
  Description of Artificial Sequence: Synthetic polypeptide
NETEIATTNPVATECYGSVSTNLQGNDGQNDH

SEQ ID NO: 75788 - protein, 34 aa, Artificial Sequence
  Description of Artificial Sequence: Synthetic polypeptide
DEEEIRTTNPVATEQYGSVPETTNVLQRQELVLF

SEQ ID NO: 75789 - protein, 32 aa, Artificial Sequence
  Description of Artificial Sequence: Synthetic polypeptide
NETEIATTNPVATECYGSVSTNLQGNEGNNED

SEQ ID NO: 75790 - protein, 31 aa, Artificial Sequence
  Description of Artificial Sequence: Synthetic polypeptide
DESEVATTNPVATEGYGSVAANDLQSRVGER

SEQ ID NO: 75791 - protein, 33 aa, Artificial Sequence
  Description of Artificial Sequence: Synthetic polypeptide
DEEEIRTTNPVATEQYGSVPETFTLVQMVGVED

SEQ ID NO: 75792 - protein, 28 aa, Artificial Sequence
  Description of Artificial Sequence: Synthetic peptide
DESEVASTNPVCTEQYGVVSDNIQSGNQ

SEQ ID NO: 75793 - protein, 29 aa, Artificial Sequence
  Description of Artificial Sequence: Synthetic peptide
DESEVASTNPVATEGYGSVAANTIQRGQR

SEQ ID NO: 75794 - protein, 29 aa, Artificial Sequence
  Description of Artificial Sequence: Synthetic peptide
AETEIACTNPVATEQYGEAWSEDLQRGGR

SEQ ID NO: 75795 - protein, 31 aa, Artificial Sequence
  Description of Artificial Sequence: Synthetic polypeptide
NETEIATTNPVATEMWGSVSTNLQANGDNDS

SEQ ID NO: 75796 - protein, 34 aa, Artificial Sequence
  Description of Artificial Sequence: Synthetic polypeptide
DEEEIRTTNPVATEQYGSVSTANNGTRIVENQFD

SEQ ID NO: 75797 - protein, 32 aa, Artificial Sequence
  Description of Artificial Sequence: Synthetic polypeptide
DEEEIRTTNPVATEQYGSVSTAPMAIAGSEQF

SEQ ID NO: 75798 - protein, 33 aa, Artificial Sequence
  Description of Artificial Sequence: Synthetic polypeptide
AEEEIRTTNPVATEQYGSVVVTTQNGNLEQGNI

SEQ ID NO: 75799 - protein, 32 aa, Artificial Sequence
  Description of Artificial Sequence: Synthetic polypeptide
DEEEIRTTNPVATEQYGSVSTAPMANASSNQQ

SEQ ID NO: 75800 - protein, 32 aa, Artificial Sequence
  Description of Artificial Sequence: Synthetic polypeptide
NETEIATTNPVATEPYGVVSTNLQGNAGENDR

SEQ ID NO: 75801 - protein, 33 aa, Artificial Sequence
  Description of Artificial Sequence: Synthetic polypeptide
DEEEIRTTNPVATEQYGSVSTAPMGEGIGEIMR

SEQ ID NO: 75802 - protein, 33 aa, Artificial Sequence
  Description of Artificial Sequence: Synthetic polypeptide
NEEEISTTNPVAYEQWGSVYKTDNLDQRGENFR

SEQ ID NO: 75803 - protein, 29 aa, Artificial Sequence
  Description of Artificial Sequence: Synthetic peptide
AESVIACTNPVATEQYGEASENLQRFGGR

SEQ ID NO: 75804 - protein, 30 aa, Artificial Sequence
  Description of Artificial Sequence: Synthetic polypeptide
NEREIRTTNPVATEQYGCVCWWNLQNFGDA

SEQ ID NO: 75805 - protein, 32 aa, Artificial Sequence
  Description of Artificial Sequence: Synthetic polypeptide
NEGEIRTTNPVATEQYGSVFWVPNLDQIGFSR

SEQ ID NO: 75806 - protein, 32 aa, Artificial Sequence
  Description of Artificial Sequence: Synthetic polypeptide
DETAEIATTNPVAYEQYGSVATNLQRAEMNDN

SEQ ID NO: 75807 - protein, 34 aa, Artificial Sequence
  Description of Artificial Sequence: Synthetic polypeptide
AEEEIRTTNPVATEQYGSVVVTVTNLQGSTGNQG

SEQ ID NO: 75808 - protein, 31 aa, Artificial Sequence
  Description of Artificial Sequence: Synthetic polypeptide
DETAEIATTNPVAYEQYGSVATNDQRHNDTA

SEQ ID NO: 75809 - protein, 33 aa, Artificial Sequence
  Description of Artificial Sequence: Synthetic polypeptide
NEGEIRTTNPVATEQYGSVWSTWPLQEIGDSER

SEQ ID NO: 75810 - protein, 32 aa, Artificial Sequence
  Description of Artificial Sequence: Synthetic polypeptide
DEEEIACTNPVATEQYGSVATNLQTENNTPQL

SEQ ID NO: 75811 - protein, 32 aa, Artificial Sequence
  Description of Artificial Sequence: Synthetic polypeptide
DETAEIATTNPVAYEQYGSVATHLQDRGDNQM

SEQ ID NO: 75812 - protein, 32 aa, Artificial Sequence
  Description of Artificial Sequence: Synthetic polypeptide
NEGEIRTTNPVATEQYGSVWTWPNLQEIGFSL

SEQ ID NO: 75813 - protein, 31 aa, Artificial Sequence
  Description of Artificial Sequence: Synthetic polypeptide
NEGEIRTTNPVATEQYGSVWTWPQQEIGASR

SEQ ID NO: 75814 - protein, 31 aa, Artificial Sequence
  Description of Artificial Sequence: Synthetic polypeptide
DETAEIATTNPVAYEPYGVVAATNLQNAGNR

SEQ ID NO: 75815 - protein, 30 aa, Artificial Sequence
  Description of Artificial Sequence: Synthetic polypeptide
DETAEIATTNPVAYEPYGVTAATNLQEGNR

SEQ ID NO: 75816 - protein, 31 aa, Artificial Sequence
  Description of Artificial Sequence: Synthetic polypeptide
NEHEIRTTNPVATEQYGSLSTHLQNIMVGQE

SEQ ID NO: 75817 - protein, 32 aa, Artificial Sequence
  Description of Artificial Sequence: Synthetic polypeptide
NEHEIRTTNPVATEQYGSLSTHLQRIDVGGQE

SEQ ID NO: 75818 - protein, 32 aa, Artificial Sequence
  Description of Artificial Sequence: Synthetic polypeptide
DETAEIATTNPVATEPYGSVAATNLQQGNDQN

SEQ ID NO: 75819 - protein, 31 aa, Artificial Sequence
  Description of Artificial Sequence: Synthetic polypeptide
AESEIRTTNPVATECWGEVSCNEPQDRGENR

SEQ ID NO: 75820 - protein, 30 aa, Artificial Sequence
  Description of Artificial Sequence: Synthetic polypeptide
DETAIRTTNPLATEQFGCVCSWNLQSGSNV

SEQ ID NO: 75821 - protein, 32 aa, Artificial Sequence
  Description of Artificial Sequence: Synthetic polypeptide
DETAEIACTNPVATEQYGSVATNLQEAGNPEE

SEQ ID NO: 75822 - protein, 33 aa, Artificial Sequence
  Description of Artificial Sequence: Synthetic polypeptide
NEEPIRTTNPVATEWYGSVCYTNLQERDGSNWP

SEQ ID NO: 75823 - protein, 32 aa, Artificial Sequence
  Description of Artificial Sequence: Synthetic polypeptide
NEEIISTTNPVATEQYGSVSTQNPPMPGGNRP

SEQ ID NO: 75824 - protein, 35 aa, Artificial Sequence
  Description of Artificial Sequence: Synthetic polypeptide
DEEEIRTTNPVATEQYGSVSSTTPNGPNMRNGNPV

SEQ ID NO: 75825 - protein, 32 aa, Artificial Sequence
  Description of Artificial Sequence: Synthetic polypeptide
DEEEIACTNPVATEQYGSVATNLQENPGEDEA

SEQ ID NO: 75826 - protein, 32 aa, Artificial Sequence
  Description of Artificial Sequence: Synthetic polypeptide
DEEEIACTNPVATEQYGSVATNLQGAGATEHH

SEQ ID NO: 75827 - protein, 35 aa, Artificial Sequence
  Description of Artificial Sequence: Synthetic polypeptide
DEEEIRTTNPVATEQYGSVSSTTPNGPNRNGMNPV

SEQ ID NO: 75828 - protein, 36 aa, Artificial Sequence
  Description of Artificial Sequence: Synthetic polypeptide
DEEEIRTTNPVATEQYGSVSSTTPNGPQDREGENPV

SEQ ID NO: 75829 - protein, 32 aa, Artificial Sequence
  Description of Artificial Sequence: Synthetic polypeptide
DEEEIACTNPVATEQYGSVATNLQPADANPES

SEQ ID NO: 75830 - protein, 36 aa, Artificial Sequence
  Description of Artificial Sequence: Synthetic polypeptide
DEEEIRTTNPVATEQYGSVSSTTPNGPQMREGENPV

SEQ ID NO: 75831 - protein, 32 aa, Artificial Sequence
  Description of Artificial Sequence: Synthetic polypeptide
DEEEIACTNPVATEQYGSVATNLQPDNQGGEM

SEQ ID NO: 75832 - protein, 35 aa, Artificial Sequence
  Description of Artificial Sequence: Synthetic polypeptide
DEEEIRTTNPVATEQYGSVPSCTNAIDQNGTGGNM

SEQ ID NO: 75833 - protein, 35 aa, Artificial Sequence
  Description of Artificial Sequence: Synthetic polypeptide
DEEEIRTTNPVATEQYGSVPSCTNAIDQNGGGNYL

SEQ ID NO: 75834 - protein, 33 aa, Artificial Sequence
  Description of Artificial Sequence: Synthetic polypeptide
DEEEIACTNPVATEQYGSVATNLQPRAEMQNND

SEQ ID NO: 75835 - protein, 32 aa, Artificial Sequence
  Description of Artificial Sequence: Synthetic polypeptide
DEEEIACTNPVATEQYGSVATNLQQDSGGEDA

SEQ ID NO: 75836 - protein, 32 aa, Artificial Sequence
  Description of Artificial Sequence: Synthetic polypeptide
DEEEIACTNPVATEQYGSVATNLQQGEGMDQD

SEQ ID NO: 75837 - protein, 32 aa, Artificial Sequence
  Description of Artificial Sequence: Synthetic polypeptide
DEEEIACTNPVATEQYGSVATNLQTDDQGAEG

SEQ ID NO: 75838 - protein, 29 aa, Artificial Sequence
  Description of Artificial Sequence: Synthetic peptide
DETAIRTTNPLATEQFGSVVFNEQSGQNE

SEQ ID NO: 75839 - protein, 31 aa, Artificial Sequence
  Description of Artificial Sequence: Synthetic polypeptide
NEEPIRTTNPVATEQYGSLSTHLTRIQGDQH

SEQ ID NO: 75840 - protein, 33 aa, Artificial Sequence
  Description of Artificial Sequence: Synthetic polypeptide
AEEEIRTTNPVATEQYGSVVVTVNQLGGNDGND

SEQ ID NO: 75841 - protein, 34 aa, Artificial Sequence
  Description of Artificial Sequence: Synthetic polypeptide
AEEEIRTTNPVATEQYGSVVVTVTNGNLQQGNIG

SEQ ID NO: 75842 - protein, 31 aa, Artificial Sequence
  Description of Artificial Sequence: Synthetic polypeptide
DEEEIACTNPVATEQYGSVATNLTTEGGEED

SEQ ID NO: 75843 - protein, 33 aa, Artificial Sequence
  Description of Artificial Sequence: Synthetic polypeptide
AEEEIRTTNPVATEQYGSVVVTVQLQNTGNNEG

SEQ ID NO: 75844 - protein, 32 aa, Artificial Sequence
  Description of Artificial Sequence: Synthetic polypeptide
NEQEIRTTNPVATEQYGSLSTHLQRIQVGDQE

SEQ ID NO: 75845 - protein, 29 aa, Artificial Sequence
  Description of Artificial Sequence: Synthetic peptide
DESVIATTNPVAYEQWGCVETNPDQRGNV

SEQ ID NO: 75846 - protein, 32 aa, Artificial Sequence
  Description of Artificial Sequence: Synthetic polypeptide
NEQEIRTTNPVATEQYGSVSAWNLDEFGSQRD

SEQ ID NO: 75847 - protein, 30 aa, Artificial Sequence
  Description of Artificial Sequence: Synthetic polypeptide
DESVIATTNPVAYEQWGCVETNMQRGENNR

SEQ ID NO: 75848 - protein, 29 aa, Artificial Sequence
  Description of Artificial Sequence: Synthetic peptide
DESVIATTNPVAYEQWGCVETNDQREGNH

SEQ ID NO: 75849 - protein, 29 aa, Artificial Sequence
  Description of Artificial Sequence: Synthetic peptide
DESVIATTNPVAYEQWGCVETNDHQRGNS

SEQ ID NO: 75850 - protein, 32 aa, Artificial Sequence
  Description of Artificial Sequence: Synthetic polypeptide
NEREIATTNPVATEAYGSVWTNELSQIGGSNR

SEQ ID NO: 75851 - protein, 31 aa, Artificial Sequence
  Description of Artificial Sequence: Synthetic polypeptide
DESVIATTNPVATEQWGSVSVDDLQTRGNDF

SEQ ID NO: 75852 - protein, 29 aa, Artificial Sequence
  Description of Artificial Sequence: Synthetic peptide
AESEVASTNPVATEQYGNASENLQSRGGR

SEQ ID NO: 75853 - protein, 30 aa, Artificial Sequence
  Description of Artificial Sequence: Synthetic polypeptide
DESVIATTNPVATEPYSEEVSTNLQNGNDM

SEQ ID NO: 75854 - protein, 31 aa, Artificial Sequence
  Description of Artificial Sequence: Synthetic polypeptide
NEREIRTTNPVATEQYGCVCWTELQNGSQNQ

SEQ ID NO: 75855 - protein, 30 aa, Artificial Sequence
  Description of Artificial Sequence: Synthetic polypeptide
DESVIATTNPVATEGPYSEEVSTNLQNGNS

SEQ ID NO: 75856 - protein, 31 aa, Artificial Sequence
  Description of Artificial Sequence: Synthetic polypeptide
DESVIATTNPVATEADGSVSCTDELSQRVNR

SEQ ID NO: 75857 - protein, 29 aa, Artificial Sequence
  Description of Artificial Sequence: Synthetic peptide
DESVIATTNPLTTAQWGSVSENLQSGDNR

SEQ ID NO: 75858 - protein, 30 aa, Artificial Sequence
  Description of Artificial Sequence: Synthetic polypeptide
DESVIATTNPVAYEQWGCVYTNPQREGMNR

SEQ ID NO: 75859 - protein, 33 aa, Artificial Sequence
  Description of Artificial Sequence: Synthetic polypeptide
DEEEIACTNPVATEQYGSVATNLTQDPGEGTRE

SEQ ID NO: 75860 - protein, 30 aa, Artificial Sequence
  Description of Artificial Sequence: Synthetic polypeptide
DESVIATVNPVATEPYSSEVSTNLQNGNES

SEQ ID NO: 75861 - protein, 33 aa, Artificial Sequence
  Description of Artificial Sequence: Synthetic polypeptide
DEEEIRTTNPVATEQYGSVPPPNGQPRLQEPRV

SEQ ID NO: 75862 - protein, 32 aa, Artificial Sequence
  Description of Artificial Sequence: Synthetic polypeptide
DEEEIACTNPVATEQYGSVATNSLDQTAPGEF

SEQ ID NO: 75863 - protein, 35 aa, Artificial Sequence
  Description of Artificial Sequence: Synthetic polypeptide
DEEEIRTTNPVATEQYGSVPPTNGPQNRQGNELLY

SEQ ID NO: 75864 - protein, 34 aa, Artificial Sequence
  Description of Artificial Sequence: Synthetic polypeptide
DEEEIRTTNPVATEQYGSVPPTLNEQRMQVLERN

SEQ ID NO: 75865 - protein, 34 aa, Artificial Sequence
  Description of Artificial Sequence: Synthetic polypeptide
DEEEIRTTNPVATEQYGSVPPTLMLQQRGVPQLQ

SEQ ID NO: 75866 - protein, 31 aa, Artificial Sequence
  Description of Artificial Sequence: Synthetic polypeptide
AESEIRTTNPVATECWGSASCNLPQDRGENG

SEQ ID NO: 75867 - protein, 32 aa, Artificial Sequence
  Description of Artificial Sequence: Synthetic polypeptide
AESEIRTTNPVATECWGSVSCINEPQREGENR

SEQ ID NO: 75868 - protein, 32 aa, Artificial Sequence
  Description of Artificial Sequence: Synthetic polypeptide
AESEIRTTNPVATECWGSVSCINLPQDRGENG

SEQ ID NO: 75869 - protein, 33 aa, Artificial Sequence
  Description of Artificial Sequence: Synthetic polypeptide
DEEEIRTTNPVATEQYGSVPPTENLEELGAELD

SEQ ID NO: 75870 - protein, 33 aa, Artificial Sequence
  Description of Artificial Sequence: Synthetic polypeptide
AESEIRTTNPVATECYGSVSCINEPQDREGENR

SEQ ID NO: 75871 - protein, 33 aa, Artificial Sequence
  Description of Artificial Sequence: Synthetic polypeptide
AESEIRTTNPVATEHYGSVGSTNEMSQYAGNRL

SEQ ID NO: 75872 - protein, 32 aa, Artificial Sequence
  Description of Artificial Sequence: Synthetic polypeptide
AESEIRTTNPVATEQYGCVSTNTLQEGTEDQP

SEQ ID NO: 75873 - protein, 33 aa, Artificial Sequence
  Description of Artificial Sequence: Synthetic polypeptide
AESEIRTTNPVAYEQYGIKVSTGNLQRTGGNEE

SEQ ID NO: 75874 - protein, 33 aa, Artificial Sequence
  Description of Artificial Sequence: Synthetic polypeptide
DEEEIACTNPVATEQYGSVATNVLQEQMGNNSL

SEQ ID NO: 75875 - protein, 29 aa, Artificial Sequence
  Description of Artificial Sequence: Synthetic peptide
AESEVACTNPVATEQYGNVAAENLQRGQR

SEQ ID NO: 75876 - protein, 33 aa, Artificial Sequence
  Description of Artificial Sequence: Synthetic polypeptide
DEEEIRTTNPVATEQYGSVPPPNGQPVLGEVRD

SEQ ID NO: 75877 - protein, 31 aa, Artificial Sequence
  Description of Artificial Sequence: Synthetic polypeptide
DESVICTTNPVATEQWGSVSTTDELQQGNQM

SEQ ID NO: 75878 - protein, 35 aa, Artificial Sequence
  Description of Artificial Sequence: Synthetic polypeptide
DENEIRTTNPVATEQYGSVSTLLNLEDTRGQNEEN

SEQ ID NO: 75879 - protein, 35 aa, Artificial Sequence
  Description of Artificial Sequence: Synthetic polypeptide
DEEEIRTTNPVATEQYGSVSTVTNGNNQEIGTNNQ

SEQ ID NO: 75880 - protein, 33 aa, Artificial Sequence
  Description of Artificial Sequence: Synthetic polypeptide
DMEEIRGTNPVATEQYGSISLTVSNEQRGNQNF

SEQ ID NO: 75881 - protein, 33 aa, Artificial Sequence
  Description of Artificial Sequence: Synthetic polypeptide
SEEEIRTTNPVATEQYGSVFCTDNHGQRGGKDF

SEQ ID NO: 75882 - protein, 31 aa, Artificial Sequence
  Description of Artificial Sequence: Synthetic polypeptide
DEMEIRTTNPVATEQYGSVSTLNDIETHPEQ

SEQ ID NO: 75883 - protein, 32 aa, Artificial Sequence
  Description of Artificial Sequence: Synthetic polypeptide
DEEEIRTTNPVATEQYGVVCSYEHQGFGSNQS

SEQ ID NO: 75884 - protein, 33 aa, Artificial Sequence
  Description of Artificial Sequence: Synthetic polypeptide
AEEEIRTTNPVATEQYGSVSTTNDNQQLEENTT

SEQ ID NO: 75885 - protein, 30 aa, Artificial Sequence
  Description of Artificial Sequence: Synthetic polypeptide
DEEQIRTTNPVATEQYGCVCSTEETNGDQS

SEQ ID NO: 75886 - protein, 32 aa, Artificial Sequence
  Description of Artificial Sequence: Synthetic polypeptide
DEMEIRTTNPVATEQYGSVSTLNGNDNEGQDQ

SEQ ID NO: 75887 - protein, 35 aa, Artificial Sequence
  Description of Artificial Sequence: Synthetic polypeptide
DEEEIRTTNPVAVEQYGSVSTVNNNQQLQNGNGGD

SEQ ID NO: 75888 - protein, 31 aa, Artificial Sequence
  Description of Artificial Sequence: Synthetic polypeptide
DEEQIRTTNPVATEQYGCVCSTEELRISNQS

SEQ ID NO: 75889 - protein, 33 aa, Artificial Sequence
  Description of Artificial Sequence: Synthetic polypeptide
DEMEIRTTNPVATEQYGSVSTLYLQDIDNNQMG

SEQ ID NO: 75890 - protein, 35 aa, Artificial Sequence
  Description of Artificial Sequence: Synthetic polypeptide
DEEEIRTTNPCATEQYGSVSVVTNNQLQQQGTNSA

SEQ ID NO: 75891 - protein, 29 aa, Artificial Sequence
  Description of Artificial Sequence: Synthetic peptide
DEAEIATTNPVATESYGCSATANEQRDNF

SEQ ID NO: 75892 - protein, 33 aa, Artificial Sequence
  Description of Artificial Sequence: Synthetic polypeptide
DEEEIRTTNPVATEQYGVVCSWEELQRFGSEQN

SEQ ID NO: 75893 - protein, 31 aa, Artificial Sequence
  Description of Artificial Sequence: Synthetic polypeptide
DAAEIATTNPVATEQWGSVTSAGLQRMGTDR

SEQ ID NO: 75894 - protein, 33 aa, Artificial Sequence
  Description of Artificial Sequence: Synthetic polypeptide
DEEEIRTTNPVATEQYGVVCSTVEHQNFGSNQN

SEQ ID NO: 75895 - protein, 31 aa, Artificial Sequence
  Description of Artificial Sequence: Synthetic polypeptide
DEEEIRTTNPCATEQYGSVSVVEEISRVNDI

SEQ ID NO: 75896 - protein, 32 aa, Artificial Sequence
  Description of Artificial Sequence: Synthetic polypeptide
DEMEIRTTNPVATEQYGSVSTNDEDNTSQEDR

SEQ ID NO: 75897 - protein, 35 aa, Artificial Sequence
  Description of Artificial Sequence: Synthetic polypeptide
DEEEIRTTNPCATEQYGSVSVTTNLEQLQQGTNVA

SEQ ID NO: 75898 - protein, 31 aa, Artificial Sequence
  Description of Artificial Sequence: Synthetic polypeptide
DEAEIATTNPVATESYGSVATNLQQDGDTLA

SEQ ID NO: 75899 - protein, 34 aa, Artificial Sequence
  Description of Artificial Sequence: Synthetic polypeptide
AEEEIRTTNPVATEQYGSVSTTNDQQGEEGNIAG

SEQ ID NO: 75900 - protein, 33 aa, Artificial Sequence
  Description of Artificial Sequence: Synthetic polypeptide
DEEEIRTTNPCATEQYGSVSVTNDIGFNGDNSD

SEQ ID NO: 75901 - protein, 33 aa, Artificial Sequence
  Description of Artificial Sequence: Synthetic polypeptide
DEEEIRTTNPCATEQYGSVSVTNDIGFHGDNDE

SEQ ID NO: 75902 - protein, 34 aa, Artificial Sequence
  Description of Artificial Sequence: Synthetic polypeptide
DEMEIRTTNPVATEQYGSVSTNDLDFASGNEMPE

SEQ ID NO: 75903 - protein, 34 aa, Artificial Sequence
  Description of Artificial Sequence: Synthetic polypeptide
AEEEIRTTNPVATEQYGSVSTTNDQQGNEGNIES

SEQ ID NO: 75904 - protein, 34 aa, Artificial Sequence
  Description of Artificial Sequence: Synthetic polypeptide
AEEEIRTTNPVATEQYGSVSTTNDQQGNQGNIAN

SEQ ID NO: 75905 - protein, 34 aa, Artificial Sequence
  Description of Artificial Sequence: Synthetic polypeptide
DEMEIRTTNPVATEQYGSVSTNDMLQQEGEDDKA

SEQ ID NO: 75906 - protein, 34 aa, Artificial Sequence
  Description of Artificial Sequence: Synthetic polypeptide
DEEEIRTTNPCATEQYGSVSTVTNNIQEQGTNSD

SEQ ID NO: 75907 - protein, 34 aa, Artificial Sequence
  Description of Artificial Sequence: Synthetic polypeptide
DEEEIRTTNPCATEQYGSVSTVTNIQEQGTNTDD

SEQ ID NO: 75908 - protein, 32 aa, Artificial Sequence
  Description of Artificial Sequence: Synthetic polypeptide
DEEQIRTTNPVATEQYGCVCSTEHLYFGSNQS

SEQ ID NO: 75909 - protein, 33 aa, Artificial Sequence
  Description of Artificial Sequence: Synthetic polypeptide
SEEEIRTTNPVATEQYGSVFESPLIQRGENNED

SEQ ID NO: 75910 - protein, 34 aa, Artificial Sequence
  Description of Artificial Sequence: Synthetic polypeptide
DEEEIRTTNPCATEQYGSVTVTTNNLQQGTNSAT

SEQ ID NO: 75911 - protein, 34 aa, Artificial Sequence
  Description of Artificial Sequence: Synthetic polypeptide
DEEEIRTTNPVATEQYGCVSTNNLGETAEDNNRI

SEQ ID NO: 75912 - protein, 33 aa, Artificial Sequence
  Description of Artificial Sequence: Synthetic polypeptide
AEEEIRTTNPVATEQYGSVSTTNDANQQNEEND

SEQ ID NO: 75913 - protein, 32 aa, Artificial Sequence
  Description of Artificial Sequence: Synthetic polypeptide
DEESEIRTTNPVAYEMWGCVSTNEGSQSGGNR

SEQ ID NO: 75914 - protein, 33 aa, Artificial Sequence
  Description of Artificial Sequence: Synthetic polypeptide
DEESEIATTNPVAYEQWGSVSTNAQHDEGGDNR

SEQ ID NO: 75915 - protein, 32 aa, Artificial Sequence
  Description of Artificial Sequence: Synthetic polypeptide
DEESEIATTNPVAYEQWGCVSCTNGSQPEGNR

SEQ ID NO: 75916 - protein, 32 aa, Artificial Sequence
  Description of Artificial Sequence: Synthetic polypeptide
DEEQIRTTNPVAYEQYGSVVSCTHESTRTGNT

SEQ ID NO: 75917 - protein, 31 aa, Artificial Sequence
  Description of Artificial Sequence: Synthetic polypeptide
DEEQIRTTNPVAYEQYGSVSTHESTVGGNNT

SEQ ID NO: 75918 - protein, 34 aa, Artificial Sequence
  Description of Artificial Sequence: Synthetic polypeptide
SEEEIRTTNPVATEQYGSVISTGDLGQREQGGGG

SEQ ID NO: 75919 - protein, 30 aa, Artificial Sequence
  Description of Artificial Sequence: Synthetic polypeptide
VEDEIATTNPVAYEQYGSVAATNDQNGNDN

SEQ ID NO: 75920 - protein, 32 aa, Artificial Sequence
  Description of Artificial Sequence: Synthetic polypeptide
DEMEIRTTNPVATEQYGSVSTLDLIPGDEDGN

SEQ ID NO: 75921 - protein, 35 aa, Artificial Sequence
  Description of Artificial Sequence: Synthetic polypeptide
DEEQIRTTNPVAYEQYGSTVYSCTNEGSQRGDNNR

SEQ ID NO: 75922 - protein, 32 aa, Artificial Sequence
  Description of Artificial Sequence: Synthetic polypeptide
DEEQIRTTNPVAYEQYGSLVSTHISTRGGNNT

SEQ ID NO: 75923 - protein, 32 aa, Artificial Sequence
  Description of Artificial Sequence: Synthetic polypeptide
DEMEIRTTNPVATEQYGSVSTLDLNPIGDEDG

SEQ ID NO: 75924 - protein, 34 aa, Artificial Sequence
  Description of Artificial Sequence: Synthetic polypeptide
AEEEIRTTNPVATEQYGSVSTTNDGQQNDEGNIN

SEQ ID NO: 75925 - protein, 34 aa, Artificial Sequence
  Description of Artificial Sequence: Synthetic polypeptide
DEEEIRTTNPCATEQYGSVSTVSNQIQEQGTNTD

SEQ ID NO: 75926 - protein, 32 aa, Artificial Sequence
  Description of Artificial Sequence: Synthetic polypeptide
DEEEIRTTNPCATEQYGVSVNAENSLERGEID

SEQ ID NO: 75927 - protein, 33 aa, Artificial Sequence
  Description of Artificial Sequence: Synthetic polypeptide
AEEEIRTTNPVATEQYGSVSTTNDNGTGGNEAN

SEQ ID NO: 75928 - protein, 33 aa, Artificial Sequence
  Description of Artificial Sequence: Synthetic polypeptide
AEEEIRTTNPVATEQYGSVSTTNDNGTVGGNAE

SEQ ID NO: 75929 - protein, 33 aa, Artificial Sequence
  Description of Artificial Sequence: Synthetic polypeptide
AEEEIRTTNPVATEQYGSVSTTNDNGTVGNNGA

SEQ ID NO: 75930 - protein, 29 aa, Artificial Sequence
  Description of Artificial Sequence: Synthetic peptide
DEEQIRTTNPVAYEQWGSVSWHEIDNGNT

SEQ ID NO: 75931 - protein, 30 aa, Artificial Sequence
  Description of Artificial Sequence: Synthetic polypeptide
DEEQIRTTNPVAYEQWGSVATHESTRGGNT

SEQ ID NO: 75932 - protein, 33 aa, Artificial Sequence
  Description of Artificial Sequence: Synthetic polypeptide
DEMEIRTTNPVATEQYGSVSTLEDNETERGDKQ

SEQ ID NO: 75933 - protein, 30 aa, Artificial Sequence
  Description of Artificial Sequence: Synthetic polypeptide
SEEEIRTTNPVATEQYGSVFPALQETQFDQ

SEQ ID NO: 75934 - protein, 35 aa, Artificial Sequence
  Description of Artificial Sequence: Synthetic polypeptide
DEEEIRTTNPVAVEQYGSVSTVNNNQNLQNGGNED

SEQ ID NO: 75935 - protein, 34 aa, Artificial Sequence
  Description of Artificial Sequence: Synthetic polypeptide
DEEQIRTTNPVATEQYGSTVPSTTNEGSGRGGNH

SEQ ID NO: 75936 - protein, 31 aa, Artificial Sequence
  Description of Artificial Sequence: Synthetic polypeptide
DEEQIRTTNPVATEQYGCVCSWEETRFGNQS

SEQ ID NO: 75937 - protein, 33 aa, Artificial Sequence
  Description of Artificial Sequence: Synthetic polypeptide
AEEEIRTTNPVATEQYGSVSTTNDNGTVGTNEA

SEQ ID NO: 75938 - protein, 35 aa, Artificial Sequence
  Description of Artificial Sequence: Synthetic polypeptide
DEEEIRTTNPCATEQYGSVVACTLNALSQRGGNYA

SEQ ID NO: 75939 - protein, 31 aa, Artificial Sequence
  Description of Artificial Sequence: Synthetic polypeptide
VEDEIATTNPVAYEQYGSVATNLQAGPPENN

SEQ ID NO: 75940 - protein, 30 aa, Artificial Sequence
  Description of Artificial Sequence: Synthetic polypeptide
DEEQIRTTNPVAYEQWGSVSWHEIEDRGNT

SEQ ID NO: 75941 - protein, 32 aa, Artificial Sequence
  Description of Artificial Sequence: Synthetic polypeptide
DEEEIRTTNPVATEQYGCVSTPYELDTGDEKM

SEQ ID NO: 75942 - protein, 34 aa, Artificial Sequence
  Description of Artificial Sequence: Synthetic polypeptide
DEEEIRTTNPCATEQYGSVSTVNNIQEQGTNTDQ

SEQ ID NO: 75943 - protein, 33 aa, Artificial Sequence
  Description of Artificial Sequence: Synthetic polypeptide
DEMEIRTTNPVATEQYGSVSTNDNNMEMGENEE

SEQ ID NO: 75944 - protein, 34 aa, Artificial Sequence
  Description of Artificial Sequence: Synthetic polypeptide
DEEEIRTTNPVATEQYGVVCSTGNHQEYFGSNQP

SEQ ID NO: 75945 - protein, 34 aa, Artificial Sequence
  Description of Artificial Sequence: Synthetic polypeptide
DEEEIRTTNPVATEQYGVVCSTGNDTQNFGSNQS

SEQ ID NO: 75946 - protein, 33 aa, Artificial Sequence
  Description of Artificial Sequence: Synthetic polypeptide
DEMEIRTTNPVATEQYGSVSTPDDLQNFPSNIE

SEQ ID NO: 75947 - protein, 32 aa, Artificial Sequence
  Description of Artificial Sequence: Synthetic polypeptide
DEEEIRTTNPVATEQYGVVCSTGEPQNGSDQS

SEQ ID NO: 75948 - protein, 33 aa, Artificial Sequence
  Description of Artificial Sequence: Synthetic polypeptide
SEEEIRTTNPVATEQYGSVCSNNLERSQEEARQ

SEQ ID NO: 75949 - protein, 34 aa, Artificial Sequence
  Description of Artificial Sequence: Synthetic polypeptide
AEEEIRTTNPVATEQYGSVSTTNGEQGNQGGNTD

SEQ ID NO: 75950 - protein, 29 aa, Artificial Sequence
  Description of Artificial Sequence: Synthetic peptide
VEDEIATVNPVATEQYGCVATNLTMGNEH

SEQ ID NO: 75951 - protein, 31 aa, Artificial Sequence
  Description of Artificial Sequence: Synthetic polypeptide
DEEEIRTTNPVATEQYGCVSTVPQPMLEDEI

SEQ ID NO: 75952 - protein, 33 aa, Artificial Sequence
  Description of Artificial Sequence: Synthetic polypeptide
DEEEIRTTNPVATEQYGVVCSTGEHQEGFGSNQ

SEQ ID NO: 75953 - protein, 28 aa, Artificial Sequence
  Description of Artificial Sequence: Synthetic peptide
AEEEIACTNPVATEQYGEASENLQHEEK

SEQ ID NO: 75954 - protein, 31 aa, Artificial Sequence
  Description of Artificial Sequence: Synthetic polypeptide
DEAEIATTNPVAYDAYGMVSCTAELSQRGNR

SEQ ID NO: 75955 - protein, 33 aa, Artificial Sequence
  Description of Artificial Sequence: Synthetic polypeptide
SEEEIRTTNPVATEQYGSVCGTALQNFGSDNQA

SEQ ID NO: 75956 - protein, 31 aa, Artificial Sequence
  Description of Artificial Sequence: Synthetic polypeptide
DEAEIATTNPVAYDHYGKVSCTAELQRGGNR

SEQ ID NO: 75957 - protein, 33 aa, Artificial Sequence
  Description of Artificial Sequence: Synthetic polypeptide
SEEEIRTTNPVATEQYGSVCSPTNDELEDPNQY

SEQ ID NO: 75958 - protein, 32 aa, Artificial Sequence
  Description of Artificial Sequence: Synthetic polypeptide
DEEEIRTTNPCATEQYGSVSGNIPFHGDNSDE

SEQ ID NO: 75959 - protein, 33 aa, Artificial Sequence
  Description of Artificial Sequence: Synthetic polypeptide
DEEEIRTTNPCATEQYGSVSCLNISFRTGGNND

SEQ ID NO: 75960 - protein, 32 aa, Artificial Sequence
  Description of Artificial Sequence: Synthetic polypeptide
DEEEIRTTNPVATEQYGVVCSTEPQYFGSDQE

SEQ ID NO: 75961 - protein, 32 aa, Artificial Sequence
  Description of Artificial Sequence: Synthetic polypeptide
DEEEIRTTNPCATEQYGSVPVTTLQATGLDAE

SEQ ID NO: 75962 - protein, 33 aa, Artificial Sequence
  Description of Artificial Sequence: Synthetic polypeptide
DEMEIRTTNPVATEQYGSVSTPDQNQETQDGEG

SEQ ID NO: 75963 - protein, 30 aa, Artificial Sequence
  Description of Artificial Sequence: Synthetic polypeptide
DEEQIRCTNPVATEQYGSVSTLEELTGQTN

SEQ ID NO: 75964 - protein, 30 aa, Artificial Sequence
  Description of Artificial Sequence: Synthetic polypeptide
DEEQIRCTNPVATEQYGSVSTLEELRTQEP

SEQ ID NO: 75965 - protein, 32 aa, Artificial Sequence
  Description of Artificial Sequence: Synthetic polypeptide
DEEEIRTTNPVATEQYGVVCSTEPQGFNSNAS

SEQ ID NO: 75966 - protein, 32 aa, Artificial Sequence
  Description of Artificial Sequence: Synthetic polypeptide
VEDEVACTNPVATEQYGSVSTGNLDQPDDGNR

SEQ ID NO: 75967 - protein, 34 aa, Artificial Sequence
  Description of Artificial Sequence: Synthetic polypeptide
DEEEIRTTNPVATEQYGCVSVSGELNQRFISNIS

SEQ ID NO: 75968 - protein, 35 aa, Artificial Sequence
  Description of Artificial Sequence: Synthetic polypeptide
DEEEIRTTNPVAVEQYGSVSTVTNNLQAGNNQSND

SEQ ID NO: 75969 - protein, 33 aa, Artificial Sequence
  Description of Artificial Sequence: Synthetic polypeptide
DEEEIRTTNPVATEQYGCVATANSHQERDMLIR

SEQ ID NO: 75970 - protein, 32 aa, Artificial Sequence
  Description of Artificial Sequence: Synthetic polypeptide
DEEEIRTTNPCATEQYGSVPVTALQAPGQDIE

SEQ ID NO: 75971 - protein, 32 aa, Artificial Sequence
  Description of Artificial Sequence: Synthetic polypeptide
DEEEIRTTNPCATEQYGSVPVTALLVARGMVE

SEQ ID NO: 75972 - protein, 33 aa, Artificial Sequence
  Description of Artificial Sequence: Synthetic polypeptide
DEEEIRTTNPCATEQYGSVSGENNEQSTMVNRY

SEQ ID NO: 75973 - protein, 33 aa, Artificial Sequence
  Description of Artificial Sequence: Synthetic polypeptide
SEEEIRTTNPVATEQYGSVNATSVLEQRTENYE

SEQ ID NO: 75974 - protein, 33 aa, Artificial Sequence
  Description of Artificial Sequence: Synthetic polypeptide
DEEEIRTTNPVATEQYGCVSTVNLDETRPSDQQ

SEQ ID NO: 75975 - protein, 33 aa, Artificial Sequence
  Description of Artificial Sequence: Synthetic polypeptide
SEEEIRTTNPVATEQYGSVCSTGELQNNSNFAS

SEQ ID NO: 75976 - protein, 33 aa, Artificial Sequence
  Description of Artificial Sequence: Synthetic polypeptide
DEAEIATTNPVATETYGTVSTNLNQGQDGDNGR

SEQ ID NO: 75977 - protein, 32 aa, Artificial Sequence
  Description of Artificial Sequence: Synthetic polypeptide
DEEEIRTTNPCATEQYGSVSTTQGVPGVNEED

SEQ ID NO: 75978 - protein, 35 aa, Artificial Sequence
  Description of Artificial Sequence: Synthetic polypeptide
DEEEIRTTNPCATEQYGSVSTTNLQQLQQGTNSAN

SEQ ID NO: 75979 - protein, 32 aa, Artificial Sequence
  Description of Artificial Sequence: Synthetic polypeptide
VEDEIATTNPVAYEQYGSVATNLQDRGPNDQM

SEQ ID NO: 75980 - protein, 34 aa, Artificial Sequence
  Description of Artificial Sequence: Synthetic polypeptide
DEEEIRTTNPCATEQYGSVSTPNTQTEIQGGNTN

SEQ ID NO: 75981 - protein, 34 aa, Artificial Sequence
  Description of Artificial Sequence: Synthetic polypeptide
DEMEIRTTNPVATEQYGSVSTNGNNQDEGINNMN

SEQ ID NO: 75982 - protein, 33 aa, Artificial Sequence
  Description of Artificial Sequence: Synthetic polypeptide
AEEEIRTTNPVATEQYGSVSTTNGDNNIGTNIM

SEQ ID NO: 75983 - protein, 31 aa, Artificial Sequence
  Description of Artificial Sequence: Synthetic polypeptide
DEEQIRTTNPVATEQYGCVCSTEEIHGSNTS

SEQ ID NO: 75984 - protein, 34 aa, Artificial Sequence
  Description of Artificial Sequence: Synthetic polypeptide
AEEEIRTTNPVATEQYGSVSTTNGDQNGNIGNNE

SEQ ID NO: 75985 - protein, 30 aa, Artificial Sequence
  Description of Artificial Sequence: Synthetic polypeptide
DAAEIATTNPVATEPYGSVATNLQQDNEDI

SEQ ID NO: 75986 - protein, 32 aa, Artificial Sequence
  Description of Artificial Sequence: Synthetic polypeptide
DEMEIRTTNPVATEQYGSVSTNMTEITLNDFP

SEQ ID NO: 75987 - protein, 30 aa, Artificial Sequence
  Description of Artificial Sequence: Synthetic polypeptide
DEEQIRTTNPVATEQWGSVFHHEDLRGNTM

SEQ ID NO: 75988 - protein, 34 aa, Artificial Sequence
  Description of Artificial Sequence: Synthetic polypeptide
AEEEIRTTNPVATEQYGSVSTTNGDQNNNIGTNM

SEQ ID NO: 75989 - protein, 33 aa, Artificial Sequence
  Description of Artificial Sequence: Synthetic polypeptide
DEEEIRTTNPVATEQYGVVCSTGNHQGFGSQQG

SEQ ID NO: 75990 - protein, 36 aa, Artificial Sequence
  Description of Artificial Sequence: Synthetic polypeptide
DEEQIRTTNPVATEQWGSTVPSTDNALSQRPGGNQR

SEQ ID NO: 75991 - protein, 33 aa, Artificial Sequence
  Description of Artificial Sequence: Synthetic polypeptide
DEEEIRTTNPVATEQYGVVCSTNEHQYFGSDQS

SEQ ID NO: 75992 - protein, 32 aa, Artificial Sequence
  Description of Artificial Sequence: Synthetic polypeptide
DEAEIATTNPVATEWYGTVSTNLQDHDGGGER

SEQ ID NO: 75993 - protein, 31 aa, Artificial Sequence
  Description of Artificial Sequence: Synthetic polypeptide
DEEEIRTTNPCATEQYGSVSPVNIVTVHNDE

SEQ ID NO: 75994 - protein, 33 aa, Artificial Sequence
  Description of Artificial Sequence: Synthetic polypeptide
DEEEIRTTNPCATEQYGSVSPVNGEQRGFEQVE

SEQ ID NO: 75995 - protein, 31 aa, Artificial Sequence
  Description of Artificial Sequence: Synthetic polypeptide
DEEEIRTTNPVATEQYGCVSTVDPDQEVEDI

SEQ ID NO: 75996 - protein, 33 aa, Artificial Sequence
  Description of Artificial Sequence: Synthetic polypeptide
DEEEIRTTNPVATEQYGVVCSTMELQNFGSDQA

SEQ ID NO: 75997 - protein, 31 aa, Artificial Sequence
  Description of Artificial Sequence: Synthetic polypeptide
DEEEIRTTNPCATEQYGSVSPVNEPITVSND

SEQ ID NO: 75998 - protein, 30 aa, Artificial Sequence
  Description of Artificial Sequence: Synthetic polypeptide
DEEEIRTTNPCATEQYGSVSPVMIPIVNND

SEQ ID NO: 75999 - protein, 33 aa, Artificial Sequence
  Description of Artificial Sequence: Synthetic polypeptide
DEEEIRTTNPVATEQYGVVCSTGNHQYFGSDQA

SEQ ID NO: 76000 - protein, 33 aa, Artificial Sequence
  Description of Artificial Sequence: Synthetic polypeptide
DEEEIRTTNPVATEQYGCVSTVLLQGGGIDDFF

SEQ ID NO: 76001 - protein, 34 aa, Artificial Sequence
  Description of Artificial Sequence: Synthetic polypeptide
AEEEIRTTNPVATEQYGSVSTTNGEQGNEGGNTD

SEQ ID NO: 76002 - protein, 33 aa, Artificial Sequence
  Description of Artificial Sequence: Synthetic polypeptide
SEEEIRTTNPVATEQYGSVCSTGNLQNNSEFAA

SEQ ID NO: 76003 - protein, 34 aa, Artificial Sequence
  Description of Artificial Sequence: Synthetic polypeptide
AEEEIRTTNPVATEQYGSVSTTNGEQGNQEGNTN

SEQ ID NO: 76004 - protein, 28 aa, Artificial Sequence
  Description of Artificial Sequence: Synthetic peptide
DAAEIATTNPCAYEPYGNVSANLQRDNN

SEQ ID NO: 76005 - protein, 31 aa, Artificial Sequence
  Description of Artificial Sequence: Synthetic polypeptide
DEEEIRTTNPCATEQYGSVPVSALVARGQIE

SEQ ID NO: 76006 - protein, 32 aa, Artificial Sequence
  Description of Artificial Sequence: Synthetic polypeptide
DEMEIRTTNPVATEQYGSVSTDNNDNEWGQDQ

SEQ ID NO: 76007 - protein, 33 aa, Artificial Sequence
  Description of Artificial Sequence: Synthetic polypeptide
DEEEIRTTNPVATEQYGCVAVWTTLNDGMNDRH

SEQ ID NO: 76008 - protein, 30 aa, Artificial Sequence
  Description of Artificial Sequence: Synthetic polypeptide
DEEEIRTTNPCATESYGSVVATLHPRQVNQ

SEQ ID NO: 76009 - protein, 31 aa, Artificial Sequence
  Description of Artificial Sequence: Synthetic polypeptide
DEESIACTNPVATESYGCVATNLQAVPGDNR

SEQ ID NO: 76010 - protein, 30 aa, Artificial Sequence
  Description of Artificial Sequence: Synthetic polypeptide
DEESIACTNPVATESYGCVATNGLQNSGNM

SEQ ID NO: 76011 - protein, 33 aa, Artificial Sequence
  Description of Artificial Sequence: Synthetic polypeptide
SEEEIRTTNPVATEQYGSVSPWNWQEGQGENEI

SEQ ID NO: 76012 - protein, 34 aa, Artificial Sequence
  Description of Artificial Sequence: Synthetic polypeptide
DEEEIRTTNPVAVEQYGSVSTNQNQNLQAGIGTD

SEQ ID NO: 76013 - protein, 30 aa, Artificial Sequence
  Description of Artificial Sequence: Synthetic polypeptide
DEESIACTNPVATESYGCVATNGLQNGNMT

SEQ ID NO: 76014 - protein, 31 aa, Artificial Sequence
  Description of Artificial Sequence: Synthetic polypeptide
DEESIACTNPVATEQYGSVATVNLPDNEQNR

SEQ ID NO: 76015 - protein, 30 aa, Artificial Sequence
  Description of Artificial Sequence: Synthetic polypeptide
DEESIACTNPVATEQYGSVAMNDGQPGNPL

SEQ ID NO: 76016 - protein, 31 aa, Artificial Sequence
  Description of Artificial Sequence: Synthetic polypeptide
DEEEIRTTNPCATESYGSVALTNHEVRVGVQ

SEQ ID NO: 76017 - protein, 31 aa, Artificial Sequence
  Description of Artificial Sequence: Synthetic polypeptide
DEEEIRTTNPCATESYGSVALTNHEVRGVEV

SEQ ID NO: 76018 - protein, 33 aa, Artificial Sequence
  Description of Artificial Sequence: Synthetic polypeptide
DEMEIRTTNPVATEQYGSVSPTNDEQNSSEDRS

SEQ ID NO: 76019 - protein, 34 aa, Artificial Sequence
  Description of Artificial Sequence: Synthetic polypeptide
DEEEIRTTNPVAVEQYGSVSTTNDQLQNGQEGEG

SEQ ID NO: 76020 - protein, 33 aa, Artificial Sequence
  Description of Artificial Sequence: Synthetic polypeptide
DEEEIRTTNPVAVEQYGSVSTTNDQLQNNQEAE

SEQ ID NO: 76021 - protein, 33 aa, Artificial Sequence
  Description of Artificial Sequence: Synthetic polypeptide
SEEEIRTTNPVATEQYGSVSPTDLEDRDDSQRM

SEQ ID NO: 76022 - protein, 30 aa, Artificial Sequence
  Description of Artificial Sequence: Synthetic polypeptide
DEEEIRTTNPCATESYGSVALSNHEVRGQQ

SEQ ID NO: 76023 - protein, 31 aa, Artificial Sequence
  Description of Artificial Sequence: Synthetic polypeptide
SEEEIRTTNPVATEQYGSVSPFDLERDSQSM

SEQ ID NO: 76024 - protein, 34 aa, Artificial Sequence
  Description of Artificial Sequence: Synthetic polypeptide
DEMEIRTTNPVATEQYGSVSPTNLDETRTEEQNK

SEQ ID NO: 76025 - protein, 31 aa, Artificial Sequence
  Description of Artificial Sequence: Synthetic polypeptide
DEAEIACTNPVATEQYGCVATNLQEAGNVDD

SEQ ID NO: 76026 - protein, 33 aa, Artificial Sequence
  Description of Artificial Sequence: Synthetic polypeptide
DEMEIRTTNPVATEQYGSVSPTNLEFTSPNPQF

SEQ ID NO: 76027 - protein, 31 aa, Artificial Sequence
  Description of Artificial Sequence: Synthetic polypeptide
DEAEIACTNPVATEQYGCVATNLQEAGNDPD

SEQ ID NO: 76028 - protein, 30 aa, Artificial Sequence
  Description of Artificial Sequence: Synthetic polypeptide
VEDEIACTNPVATEQYGCVATNLQMAGERN

SEQ ID NO: 76029 - protein, 33 aa, Artificial Sequence
  Description of Artificial Sequence: Synthetic polypeptide
DEMEIRTTNPVATEQYGSVSPTNLETDTEEQNP

SEQ ID NO: 76030 - protein, 32 aa, Artificial Sequence
  Description of Artificial Sequence: Synthetic polypeptide
DEMEIRTTNPVATEQYGSVSPTNLETHMEEQN

SEQ ID NO: 76031 - protein, 34 aa, Artificial Sequence
  Description of Artificial Sequence: Synthetic polypeptide
DEMEIRTTNPVATEQYGSVSPTNLETRSEGEQEM

SEQ ID NO: 76032 - protein, 32 aa, Artificial Sequence
  Description of Artificial Sequence: Synthetic polypeptide
SEEEIRTTNPVATEQYGSVSMVLLQRSDEDYE

SEQ ID NO: 76033 - protein, 34 aa, Artificial Sequence
  Description of Artificial Sequence: Synthetic polypeptide
SEEEIRTTNPVATEQYGSVSITVPLTQEGNDEKN

SEQ ID NO: 76034 - protein, 30 aa, Artificial Sequence
  Description of Artificial Sequence: Synthetic polypeptide
VEDEIACTNPVATEQYGCVATNLQMGDEER

SEQ ID NO: 76035 - protein, 30 aa, Artificial Sequence
  Description of Artificial Sequence: Synthetic polypeptide
DEESIACTNPVATESYGSVATHGLQNPGNM

SEQ ID NO: 76036 - protein, 31 aa, Artificial Sequence
  Description of Artificial Sequence: Synthetic polypeptide
DEEEIRTTNPCATETYGSVALTNHEVRVNVA

SEQ ID NO: 76037 - protein, 32 aa, Artificial Sequence
  Description of Artificial Sequence: Synthetic polypeptide
DEEEIRTTNPCATEVYGSVATGNDHGGRGQNA

SEQ ID NO: 76038 - protein, 33 aa, Artificial Sequence
  Description of Artificial Sequence: Synthetic polypeptide
DEMEIRTTNPVATEQYGSVSPTINLETGTEEQN

SEQ ID NO: 76039 - protein, 32 aa, Artificial Sequence
  Description of Artificial Sequence: Synthetic polypeptide
DEESIATTNPVATECYGSVCTNTQQRDGGNTM

SEQ ID NO: 76040 - protein, 33 aa, Artificial Sequence
  Description of Artificial Sequence: Synthetic polypeptide
DEEEIRTTNPVATEQYGVVSGTNGEGEMGNGGT

SEQ ID NO: 76041 - protein, 31 aa, Artificial Sequence
  Description of Artificial Sequence: Synthetic polypeptide
DEAEIATTNPVATEQYGSVSTDGTAEHGDRE

SEQ ID NO: 76042 - protein, 34 aa, Artificial Sequence
  Description of Artificial Sequence: Synthetic polypeptide
AEEEIRTTNPVATEQYGSVSTTDGNNLQGNNDEG

SEQ ID NO: 76043 - protein, 32 aa, Artificial Sequence
  Description of Artificial Sequence: Synthetic polypeptide
DEESIATTNPVATECYGSVCTNHQQRDGSNDM

SEQ ID NO: 76044 - protein, 32 aa, Artificial Sequence
  Description of Artificial Sequence: Synthetic polypeptide
DEEEIRTTNPVATEQYGVVSGTLGTSGNGNAT

SEQ ID NO: 76045 - protein, 33 aa, Artificial Sequence
  Description of Artificial Sequence: Synthetic polypeptide
DEEEIRTTNPVATEQYGVVSGTGLDELGQGGGD

SEQ ID NO: 76046 - protein, 29 aa, Artificial Sequence
  Description of Artificial Sequence: Synthetic peptide
DEEEIRTTNPCATTQYGTVATTQQGTNTE

SEQ ID NO: 76047 - protein, 29 aa, Artificial Sequence
  Description of Artificial Sequence: Synthetic peptide
DEEEIRTTNPCATTQYGTVATTQQGTNNS

SEQ ID NO: 76048 - protein, 32 aa, Artificial Sequence
  Description of Artificial Sequence: Synthetic polypeptide
DEEEIRTTNPVATEQYGVVSGTDGGGNDGNDE

SEQ ID NO: 76049 - protein, 29 aa, Artificial Sequence
  Description of Artificial Sequence: Synthetic peptide
DEEEIRTTNPCATTQYGTVATTQQGTNAD

SEQ ID NO: 76050 - protein, 28 aa, Artificial Sequence
  Description of Artificial Sequence: Synthetic peptide
DEEEIRTTNPCATTQYGTVATTQQGTEN

SEQ ID NO: 76051 - protein, 32 aa, Artificial Sequence
  Description of Artificial Sequence: Synthetic polypeptide
DEESIACTNPVATESYGSVATNSLQERGNQEE

SEQ ID NO: 76052 - protein, 35 aa, Artificial Sequence
  Description of Artificial Sequence: Synthetic polypeptide
AEEEIRTTNPVATEQYGSVSTTGNNNLQGDENGNE

SEQ ID NO: 76053 - protein, 31 aa, Artificial Sequence
  Description of Artificial Sequence: Synthetic polypeptide
DEEEIRTTNPCATTQYGTVATTNLEQGTNGG

SEQ ID NO: 76054 - protein, 32 aa, Artificial Sequence
  Description of Artificial Sequence: Synthetic polypeptide
DEAEIATTNPVATEQYGSVSTPNLQDDAEDEA

SEQ ID NO: 76055 - protein, 34 aa, Artificial Sequence
  Description of Artificial Sequence: Synthetic polypeptide
AEEEIRTTNPVATEQYGSVSTTDNQQQEEGNNQI

SEQ ID NO: 76056 - protein, 31 aa, Artificial Sequence
  Description of Artificial Sequence: Synthetic polypeptide
DEEEIRTTNPVATEQYGVVSGGNGGNGGEED

SEQ ID NO: 76057 - protein, 34 aa, Artificial Sequence
  Description of Artificial Sequence: Synthetic polypeptide
SEEEIRTTNPVATEQYGSVSSTEPNGNMRNGNPV

SEQ ID NO: 76058 - protein, 34 aa, Artificial Sequence
  Description of Artificial Sequence: Synthetic polypeptide
SEEEIRTTNPVATEQYGSVSSTEPALPNRNGMNV

SEQ ID NO: 76059 - protein, 34 aa, Artificial Sequence
  Description of Artificial Sequence: Synthetic polypeptide
SEEEIRTTNPVATEQYGSVSSTEPALPMRNGMNV

SEQ ID NO: 76060 - protein, 34 aa, Artificial Sequence
  Description of Artificial Sequence: Synthetic polypeptide
DEEEIRTTNPVAVEQYGSVSTNLQLLQAGIGTDA

SEQ ID NO: 76061 - protein, 30 aa, Artificial Sequence
  Description of Artificial Sequence: Synthetic polypeptide
DEESIACTNPVATESYGSVATNELADSGNM

SEQ ID NO: 76062 - protein, 33 aa, Artificial Sequence
  Description of Artificial Sequence: Synthetic polypeptide
DEAEIATTNPVATEQYGSVSVANLQDSDGNAQN

SEQ ID NO: 76063 - protein, 33 aa, Artificial Sequence
  Description of Artificial Sequence: Synthetic polypeptide
AEEEIRTTNPVATEQYGSVSTTDQQQQQNGTNL

SEQ ID NO: 76064 - protein, 34 aa, Artificial Sequence
  Description of Artificial Sequence: Synthetic polypeptide
DEEEIRTTNPVATEQYGVVSDTNGGQEGGENEDQ

SEQ ID NO: 76065 - protein, 34 aa, Artificial Sequence
  Description of Artificial Sequence: Synthetic polypeptide
DEMEIRTTNPVATEQYGSVSPTFTLERQGDNTQD

SEQ ID NO: 76066 - protein, 33 aa, Artificial Sequence
  Description of Artificial Sequence: Synthetic polypeptide
DEMEIRTTNPVATEQYGSVSPTHYLERSDQGEE

SEQ ID NO: 76067 - protein, 34 aa, Artificial Sequence
  Description of Artificial Sequence: Synthetic polypeptide
AEEEIRTTNPVATEQYGSVSTTDNNQEEGNNQIG

SEQ ID NO: 76068 - protein, 34 aa, Artificial Sequence
  Description of Artificial Sequence: Synthetic polypeptide
DEMEIRTTNPVATEQYGSVSPTNLETRTEAEQNI

SEQ ID NO: 76069 - protein, 33 aa, Artificial Sequence
  Description of Artificial Sequence: Synthetic polypeptide
DEMEIRTTNPVATEQYGSVSPTNLETTSPNMQH

SEQ ID NO: 76070 - protein, 34 aa, Artificial Sequence
  Description of Artificial Sequence: Synthetic polypeptide
SEEEIRTTNPVATEQYGSVSGSNGNMQRGEDDRR

SEQ ID NO: 76071 - protein, 28 aa, Artificial Sequence
  Description of Artificial Sequence: Synthetic peptide
VEDEIASVNPVCTEQYGVVSDNLQSGNQ

SEQ ID NO: 76072 - protein, 35 aa, Artificial Sequence
  Description of Artificial Sequence: Synthetic polypeptide
DEEEIRTTNPVATEQYGVVGSDTNLQTPNGGNGDE

SEQ ID NO: 76073 - protein, 32 aa, Artificial Sequence
  Description of Artificial Sequence: Synthetic polypeptide
SEEEIRTTNPVATEQYGSVNTSVLEQRSEEKV

SEQ ID NO: 76074 - protein, 30 aa, Artificial Sequence
  Description of Artificial Sequence: Synthetic polypeptide
VEDEIATTNPVATAQYGCVATNLERGDNPM

SEQ ID NO: 76075 - protein, 33 aa, Artificial Sequence
  Description of Artificial Sequence: Synthetic polypeptide
DEEEIRTTNPVATEQYGCVCFTELQNFGSENQS

SEQ ID NO: 76076 - protein, 34 aa, Artificial Sequence
  Description of Artificial Sequence: Synthetic polypeptide
AEEEIRTTNPVATEQYGSVSTTLQQQANGNNETT

SEQ ID NO: 76077 - protein, 33 aa, Artificial Sequence
  Description of Artificial Sequence: Synthetic polypeptide
AEEEIRTTNPVATEQYGSVSTTLVENGNEEGTD

SEQ ID NO: 76078 - protein, 33 aa, Artificial Sequence
  Description of Artificial Sequence: Synthetic polypeptide
DEEEIRTTNPVATEQYGVVGSDDNDQNEGGGNE

SEQ ID NO: 76079 - protein, 32 aa, Artificial Sequence
  Description of Artificial Sequence: Synthetic polypeptide
AEEEIRTTNPVATEQYGSVSTTLVNDTEEGTD

SEQ ID NO: 76080 - protein, 31 aa, Artificial Sequence
  Description of Artificial Sequence: Synthetic polypeptide
DDEEISTTNPVATEQYGCVCSTELQEHGSEQ

SEQ ID NO: 76081 - protein, 32 aa, Artificial Sequence
  Description of Artificial Sequence: Synthetic polypeptide
DEEEIRTTNPVATEQYGVVGSDDNDQEGGGEE

SEQ ID NO: 76082 - protein, 33 aa, Artificial Sequence
  Description of Artificial Sequence: Synthetic polypeptide
AEEEIRTTNPVATEQYGSVSTTLVNQNEEEGTD

SEQ ID NO: 76083 - protein, 32 aa, Artificial Sequence
  Description of Artificial Sequence: Synthetic polypeptide
DEEEIRTTNPVATEQYGVVGNGNDQDEGGGNQ

SEQ ID NO: 76084 - protein, 33 aa, Artificial Sequence
  Description of Artificial Sequence: Synthetic polypeptide
DEEEIRTTNPVAVEQYGSVSTTNQLLQNEEEED

SEQ ID NO: 76085 - protein, 33 aa, Artificial Sequence
  Description of Artificial Sequence: Synthetic polypeptide
AEEEIRTTNPVATEQYGSVSTTNANQQQTTNVD

SEQ ID NO: 76086 - protein, 28 aa, Artificial Sequence
  Description of Artificial Sequence: Synthetic peptide
DEESIACTNPVATAQWGSVAMNDQPGNL

SEQ ID NO: 76087 - protein, 34 aa, Artificial Sequence
  Description of Artificial Sequence: Synthetic polypeptide
SEEEIRTTNPVATEQYGSVNNTSNDLDFRGENYE

SEQ ID NO: 76088 - protein, 33 aa, Artificial Sequence
  Description of Artificial Sequence: Synthetic polypeptide
DEESEIRTTNPVAYEQWGICVSTNEGSQEGGNR

SEQ ID NO: 76089 - protein, 33 aa, Artificial Sequence
  Description of Artificial Sequence: Synthetic polypeptide
DEESEIRTTNPVAYEQWGCVSTNEGSQDGGNNR

SEQ ID NO: 76090 - protein, 33 aa, Artificial Sequence
  Description of Artificial Sequence: Synthetic polypeptide
DEMEIRTTNPVATEQYGSVSSTTPAPPNREGNV

SEQ ID NO: 76091 - protein, 32 aa, Artificial Sequence
  Description of Artificial Sequence: Synthetic polypeptide
DEEEIRTTNPVATEQYGCVCENTGNLIENGDQ

SEQ ID NO: 76092 - protein, 31 aa, Artificial Sequence
  Description of Artificial Sequence: Synthetic polypeptide
VEDEIATTNPVATEQYGCVATNLQRENAGME

SEQ ID NO: 76093 - protein, 32 aa, Artificial Sequence
  Description of Artificial Sequence: Synthetic polypeptide
SEEEIRTTNPVATEQYGSVNLSNLDFRGETIE

SEQ ID NO: 76094 - protein, 33 aa, Artificial Sequence
  Description of Artificial Sequence: Synthetic polypeptide
DEEEIRTTNPVATEQYGVVFCTDNGGQHRGKDF

SEQ ID NO: 76095 - protein, 31 aa, Artificial Sequence
  Description of Artificial Sequence: Synthetic polypeptide
VEDEIATTNPVATEQYGCVATNLQRNANMES

SEQ ID NO: 76096 - protein, 28 aa, Artificial Sequence
  Description of Artificial Sequence: Synthetic peptide
AEEEIACTNPVATEQYGEASEVLQHEGR

SEQ ID NO: 76097 - protein, 32 aa, Artificial Sequence
  Description of Artificial Sequence: Synthetic polypeptide
DEMEIRTTNPVATEQYGSVSTDLWNEEGQEVT

SEQ ID NO: 76098 - protein, 32 aa, Artificial Sequence
  Description of Artificial Sequence: Synthetic polypeptide
DEESEIRTTNPVAYEQWGCVNTNEGSQQGGNR

SEQ ID NO: 76099 - protein, 33 aa, Artificial Sequence
  Description of Artificial Sequence: Synthetic polypeptide
DEMEIRTTNPVATEQYGSVSSTTPAPPNREGND

SEQ ID NO: 76100 - protein, 32 aa, Artificial Sequence
  Description of Artificial Sequence: Synthetic polypeptide
DEESEIRTTNPVAYEQWGCTVSYTNGSDRGND

SEQ ID NO: 76101 - protein, 31 aa, Artificial Sequence
  Description of Artificial Sequence: Synthetic polypeptide
DEESIACTNPVATEIYGCVATNLQAEGDNRA

SEQ ID NO: 76102 - protein, 34 aa, Artificial Sequence
  Description of Artificial Sequence: Synthetic polypeptide
DEEEIRTTNPVATEQYGVVGVDTNLQNSGMENFG

SEQ ID NO: 76103 - protein, 33 aa, Artificial Sequence
  Description of Artificial Sequence: Synthetic polypeptide
AEEEIRTTNPVATEQYGSVSTTGNNQNQENQED

SEQ ID NO: 76104 - protein, 33 aa, Artificial Sequence
  Description of Artificial Sequence: Synthetic polypeptide
DEEEIRTTNPVATEQYGVVNTMTNFGQGEQGNQ

SEQ ID NO: 76105 - protein, 29 aa, Artificial Sequence
  Description of Artificial Sequence: Synthetic peptide
VEDEIACTNPVATEQYGCVATNLQMGESQ

SEQ ID NO: 76106 - protein, 30 aa, Artificial Sequence
  Description of Artificial Sequence: Synthetic polypeptide
VEDEIACTNPVATEQYGCVATNLQMGGENN

SEQ ID NO: 76107 - protein, 34 aa, Artificial Sequence
  Description of Artificial Sequence: Synthetic polypeptide
AEEEIRTTNPVATEQYGSVSTTGNQNQTAGTNNV

SEQ ID NO: 76108 - protein, 33 aa, Artificial Sequence
  Description of Artificial Sequence: Synthetic polypeptide
AEEEIRTTNPVATEQYGSVSTTGNQQGNPNNDD

SEQ ID NO: 76109 - protein, 32 aa, Artificial Sequence
  Description of Artificial Sequence: Synthetic polypeptide
DEEEIRTTNPVATEQYGVVNTMGDTGQGGGNI

SEQ ID NO: 76110 - protein, 34 aa, Artificial Sequence
  Description of Artificial Sequence: Synthetic polypeptide
DEEEIRTTNPVATEQYGVVNTFNLIDEQGGVNED

SEQ ID NO: 76111 - protein, 29 aa, Artificial Sequence
  Description of Artificial Sequence: Synthetic peptide
VEDEIACTNPVATEQYGCVATNLQMPEGR

SEQ ID NO: 76112 - protein, 34 aa, Artificial Sequence
  Description of Artificial Sequence: Synthetic polypeptide
DEEEIRTTNPCATEQYGVVSVTNLQQLQQGTNSA

SEQ ID NO: 76113 - protein, 33 aa, Artificial Sequence
  Description of Artificial Sequence: Synthetic polypeptide
DEMEIRTTNPVATEQYGSVSPTNLMPNSENDDG

SEQ ID NO: 76114 - protein, 34 aa, Artificial Sequence
  Description of Artificial Sequence: Synthetic polypeptide
DEMEIRTTNPVATEQYGSVSPTNLQEFNTEEQEM

SEQ ID NO: 76115 - protein, 29 aa, Artificial Sequence
  Description of Artificial Sequence: Synthetic peptide
VEDEIACTNPVATEQYGCVATNLQMPGEN

SEQ ID NO: 76116 - protein, 33 aa, Artificial Sequence
  Description of Artificial Sequence: Synthetic polypeptide
AEEEIRTTNPVATEQYGSVSTTLQNDNEEGTDG

SEQ ID NO: 76117 - protein, 34 aa, Artificial Sequence
  Description of Artificial Sequence: Synthetic polypeptide
DEMEIRTTNPVATEQYGSVSPTNSDQEGPEDNIE

SEQ ID NO: 76118 - protein, 32 aa, Artificial Sequence
  Description of Artificial Sequence: Synthetic polypeptide
DEMEIRTTNPVATEQYGSVSPTTLEDFGSLDG

SEQ ID NO: 76119 - protein, 34 aa, Artificial Sequence
  Description of Artificial Sequence: Synthetic polypeptide
AEEEIRTTNPVATEQYGSVSTTLNQQANNGNETT

SEQ ID NO: 76120 - protein, 31 aa, Artificial Sequence
  Description of Artificial Sequence: Synthetic polypeptide
DEMEIRTTNPVATEQYGSVSSMDLNRESDQT

SEQ ID NO: 76121 - protein, 34 aa, Artificial Sequence
  Description of Artificial Sequence: Synthetic polypeptide
AEEEIRTTNPVATEQYGSVSTTLNQQQNDEGNEG

SEQ ID NO: 76122 - protein, 34 aa, Artificial Sequence
  Description of Artificial Sequence: Synthetic polypeptide
SEEEIRTTNPVATEQYGSVSDTNGGQGQGNEGFV

SEQ ID NO: 76123 - protein, 33 aa, Artificial Sequence
  Description of Artificial Sequence: Synthetic polypeptide
SEEEIRTTNPVATEQYGSVSDTGNGGQGEGAEF

SEQ ID NO: 76124 - protein, 30 aa, Artificial Sequence
  Description of Artificial Sequence: Synthetic polypeptide
DEESIACTNPVATEIYGCVATNLQSGDNVM

SEQ ID NO: 76125 - protein, 30 aa, Artificial Sequence
  Description of Artificial Sequence: Synthetic polypeptide
DEESIACTNPVATEIYGCVATNLQRSDNDA

SEQ ID NO: 76126 - protein, 32 aa, Artificial Sequence
  Description of Artificial Sequence: Synthetic polypeptide
SEEEIRTTNPVATEQYGSVSDGGGGQGGNEGD

SEQ ID NO: 76127 - protein, 34 aa, Artificial Sequence
  Description of Artificial Sequence: Synthetic polypeptide
DEAEIATTNPVATEQYGSVVSTNNMLGEHGDNAR

SEQ ID NO: 76128 - protein, 33 aa, Artificial Sequence
  Description of Artificial Sequence: Synthetic polypeptide
DEEEIRTTNPVATEQYGVVIWTNLNEREGMGET

SEQ ID NO: 76129 - protein, 32 aa, Artificial Sequence
  Description of Artificial Sequence: Synthetic polypeptide
DEEEIRTTNPVATEQYGVVHMTDNVQGHSNEW

SEQ ID NO: 76130 - protein, 35 aa, Artificial Sequence
  Description of Artificial Sequence: Synthetic polypeptide
DEEEIRTTNPVATEQYGVVGVSTVNLQNSGMENFE

SEQ ID NO: 76131 - protein, 32 aa, Artificial Sequence
  Description of Artificial Sequence: Synthetic polypeptide
DEMEIRTTNPVATEQYGSVSPTPLENRDDDVE

SEQ ID NO: 76132 - protein, 32 aa, Artificial Sequence
  Description of Artificial Sequence: Synthetic polypeptide
DEESIATTNPVATECYGSVNHTDGLQDRNGNM

SEQ ID NO: 76133 - protein, 31 aa, Artificial Sequence
  Description of Artificial Sequence: Synthetic polypeptide
DEEEIRTTNPCATEQYGSVPVMALVARGVAE

SEQ ID NO: 76134 - protein, 32 aa, Artificial Sequence
  Description of Artificial Sequence: Synthetic polypeptide
DEEEIRTTNPCATEQYGSVPTWDLDDRNGKED

SEQ ID NO: 76135 - protein, 31 aa, Artificial Sequence
  Description of Artificial Sequence: Synthetic polypeptide
DEAEIATTNPVAYEPYGVVAATANLVQDGNR

SEQ ID NO: 76136 - protein, 31 aa, Artificial Sequence
  Description of Artificial Sequence: Synthetic polypeptide
VEEEIATTNPVATEQYGSVAMNLQEGEGGDQ

SEQ ID NO: 76137 - protein, 35 aa, Artificial Sequence
  Description of Artificial Sequence: Synthetic polypeptide
AEEEIRTTNPVATEQYGSVSTTNLLQQGNQGENEE

SEQ ID NO: 76138 - protein, 33 aa, Artificial Sequence
  Description of Artificial Sequence: Synthetic polypeptide
DEEEIRTTNPCATEQYGSVATVNLQALQGTEEE

SEQ ID NO: 76139 - protein, 33 aa, Artificial Sequence
  Description of Artificial Sequence: Synthetic polypeptide
SEEEIRTTNPVATEQYGCVCSTNDLQFFGSEQS

SEQ ID NO: 76140 - protein, 34 aa, Artificial Sequence
  Description of Artificial Sequence: Synthetic polypeptide
SEEEIRTTNPVATEQYGCVCSTMNLNQNFGSNTQ

SEQ ID NO: 76141 - protein, 32 aa, Artificial Sequence
  Description of Artificial Sequence: Synthetic polypeptide
DEEEIRTTNPVATEQYGDTVITTNVYGPGNTA

SEQ ID NO: 76142 - protein, 30 aa, Artificial Sequence
  Description of Artificial Sequence: Synthetic polypeptide
DEAEIATTNPVAYEPYGVVAGATNLQADNR

SEQ ID NO: 76143 - protein, 32 aa, Artificial Sequence
  Description of Artificial Sequence: Synthetic polypeptide
SEEEIRTTNPVATEQYGCVCSTMNHQFFGSEQ

SEQ ID NO: 76144 - protein, 33 aa, Artificial Sequence
  Description of Artificial Sequence: Synthetic polypeptide
DEEEIRTTNPVATEQYGVSGTIGHNLTDSGNML

SEQ ID NO: 76145 - protein, 30 aa, Artificial Sequence
  Description of Artificial Sequence: Synthetic polypeptide
DEAEIATTNPVAYEPYGVVAGATNLQEGNY

SEQ ID NO: 76146 - protein, 31 aa, Artificial Sequence
  Description of Artificial Sequence: Synthetic polypeptide
AEEEIACTNPVATEQYGCVATNLQEPGNDVS

SEQ ID NO: 76147 - protein, 33 aa, Artificial Sequence
  Description of Artificial Sequence: Synthetic polypeptide
SEEEIRTTNPVATEQYGCVCSTGNLQNFNSDQD

SEQ ID NO: 76148 - protein, 32 aa, Artificial Sequence
  Description of Artificial Sequence: Synthetic polypeptide
VEEEIATTNPVATEQYGSVATNLQNPGEEAEE

SEQ ID NO: 76149 - protein, 35 aa, Artificial Sequence
  Description of Artificial Sequence: Synthetic polypeptide
SEEEIRTTNPVATEQYGCVCSTGNLDQRFGSNTQI

SEQ ID NO: 76150 - protein, 34 aa, Artificial Sequence
  Description of Artificial Sequence: Synthetic polypeptide
SEEEIRTTNPVATEQYGCVCSTGNLDQNSGSDNQ

SEQ ID NO: 76151 - protein, 34 aa, Artificial Sequence
  Description of Artificial Sequence: Synthetic polypeptide
DEEEIRTTNPVATEQYGDVDGSNNLQNNEGGNIN

SEQ ID NO: 76152 - protein, 33 aa, Artificial Sequence
  Description of Artificial Sequence: Synthetic polypeptide
VEEEIATTNPVATEQYGSVATNNLPQEAGETER

SEQ ID NO: 76153 - protein, 32 aa, Artificial Sequence
  Description of Artificial Sequence: Synthetic polypeptide
DEAEIATTNPVAYEPYGVVASATNLQAGPNDR

SEQ ID NO: 76154 - protein, 32 aa, Artificial Sequence
  Description of Artificial Sequence: Synthetic polypeptide
DEEEIRTTNPVATEQYGDVDTGTQGGGNGNGD

SEQ ID NO: 76155 - protein, 34 aa, Artificial Sequence
  Description of Artificial Sequence: Synthetic polypeptide
DEEEIRTTNPVAVEQYGSVSTVVNNNNQQGNTDE

SEQ ID NO: 76156 - protein, 32 aa, Artificial Sequence
  Description of Artificial Sequence: Synthetic polypeptide
DEMEIRTTNPVATEQYGSVSVVNLMEGVEDYI

SEQ ID NO: 76157 - protein, 32 aa, Artificial Sequence
  Description of Artificial Sequence: Synthetic polypeptide
DEMEIRTTNPVATEQYGSVSVWNLDEYGDDFQ

SEQ ID NO: 76158 - protein, 33 aa, Artificial Sequence
  Description of Artificial Sequence: Synthetic polypeptide
SEEEIRTTNPVATEQYGCVCSTGELDQNGSNNQ

SEQ ID NO: 76159 - protein, 31 aa, Artificial Sequence
  Description of Artificial Sequence: Synthetic polypeptide
DEAEIATTNPVAYEPYGVVASATNLQDGNDD

SEQ ID NO: 76160 - protein, 33 aa, Artificial Sequence
  Description of Artificial Sequence: Synthetic polypeptide
DEEEIRTTNPVATEQYGVIVCSTNHQNFGSEQS

SEQ ID NO: 76161 - protein, 31 aa, Artificial Sequence
  Description of Artificial Sequence: Synthetic polypeptide
DEAEIATTNPVAYEPYGVVASATNLQDGNHQ

SEQ ID NO: 76162 - protein, 33 aa, Artificial Sequence
  Description of Artificial Sequence: Synthetic polypeptide
DEEEIRTTNPCATEQYGSVATVNQALQQGQEED

SEQ ID NO: 76163 - protein, 34 aa, Artificial Sequence
  Description of Artificial Sequence: Synthetic polypeptide
DEEEIRTTNPVAVEQYGSVSTVVNNNNQETGNTD

SEQ ID NO: 76164 - protein, 33 aa, Artificial Sequence
  Description of Artificial Sequence: Synthetic polypeptide
DEEQIATTNPVATEPYGSVSTGNADSQRNGGSR

SEQ ID NO: 76165 - protein, 32 aa, Artificial Sequence
  Description of Artificial Sequence: Synthetic polypeptide
DEEEIRTTNPCATEQYGSVATVQQALQAGQED

SEQ ID NO: 76166 - protein, 32 aa, Artificial Sequence
  Description of Artificial Sequence: Synthetic polypeptide
DEEEIRTTNPCATEQYGSVCYNIEDRGHNNDP

SEQ ID NO: 76167 - protein, 32 aa, Artificial Sequence
  Description of Artificial Sequence: Synthetic polypeptide
DEEEIRTTNPCATEQYGSVCYNIEDRDGHNED

SEQ ID NO: 76168 - protein, 31 aa, Artificial Sequence
  Description of Artificial Sequence: Synthetic polypeptide
DEEEIRTTNPCATEQYGSVCYNIEDQGHNAD

SEQ ID NO: 76169 - protein, 31 aa, Artificial Sequence
  Description of Artificial Sequence: Synthetic polypeptide
DEEQIATTNPVATEQYGSVCSTHGLNSDENT

SEQ ID NO: 76170 - protein, 31 aa, Artificial Sequence
  Description of Artificial Sequence: Synthetic polypeptide
DEEEIRTTNPCATEQYGSVCSVDIFAGDNQD

SEQ ID NO: 76171 - protein, 32 aa, Artificial Sequence
  Description of Artificial Sequence: Synthetic polypeptide
VEEEIATTNPVATEQYGCVSGTMNLQHDDNPG

SEQ ID NO: 76172 - protein, 33 aa, Artificial Sequence
  Description of Artificial Sequence: Synthetic polypeptide
DEMEIRTTNPVATEQYGSVSVTNNATENGNEMV

SEQ ID NO: 76173 - protein, 29 aa, Artificial Sequence
  Description of Artificial Sequence: Synthetic peptide
DEEQIATTNPVATEQWGSVSGEHGLHGNT

SEQ ID NO: 76174 - protein, 34 aa, Artificial Sequence
  Description of Artificial Sequence: Synthetic polypeptide
DEMEIRTTNPVATEQYGSVSVTNNMNRQMGSNQE

SEQ ID NO: 76175 - protein, 32 aa, Artificial Sequence
  Description of Artificial Sequence: Synthetic polypeptide
DEMEIRTTNPVATEQYGSVSVTNNNDNEGQDQ

SEQ ID NO: 76176 - protein, 32 aa, Artificial Sequence
  Description of Artificial Sequence: Synthetic polypeptide
DEEQIATTNPVATEQWGSVATNNLENMGVNRP

SEQ ID NO: 76177 - protein, 33 aa, Artificial Sequence
  Description of Artificial Sequence: Synthetic polypeptide
DEMEIRTTNPVATEQYGSVSVTNNSDEHGSERG

SEQ ID NO: 76178 - protein, 33 aa, Artificial Sequence
  Description of Artificial Sequence: Synthetic polypeptide
DEMEIRTTNPVATEQYGSVSVTNWDEYSGDDRQ

SEQ ID NO: 76179 - protein, 31 aa, Artificial Sequence
  Description of Artificial Sequence: Synthetic polypeptide
AEEEIACTNPVATEQYGCVATNLQDDQGNNN

SEQ ID NO: 76180 - protein, 33 aa, Artificial Sequence
  Description of Artificial Sequence: Synthetic polypeptide
DEEEIRTTNPCATEQYGSVATVVNLAQGNQQED

SEQ ID NO: 76181 - protein, 33 aa, Artificial Sequence
  Description of Artificial Sequence: Synthetic polypeptide
DEEEIRTTNPCATEQYGSVATVTLAQQGNQDEE

SEQ ID NO: 76182 - protein, 32 aa, Artificial Sequence
  Description of Artificial Sequence: Synthetic polypeptide
DEEEIRTTNPCATEQYGSVATVTLAQGNQQEA

SEQ ID NO: 76183 - protein, 34 aa, Artificial Sequence
  Description of Artificial Sequence: Synthetic polypeptide
DEEEIRTTNPVATEQYGCTVMTENGLSQEIGNTT

SEQ ID NO: 76184 - protein, 35 aa, Artificial Sequence
  Description of Artificial Sequence: Synthetic polypeptide
AEEEIRTTNPVATEQYGSVSTTNLLQNNNGTNQQG

SEQ ID NO: 76185 - protein, 34 aa, Artificial Sequence
  Description of Artificial Sequence: Synthetic polypeptide
DEEEIRTTNPVATEQYGCTVMTENGLGQEIGGNT

SEQ ID NO: 76186 - protein, 34 aa, Artificial Sequence
  Description of Artificial Sequence: Synthetic polypeptide
DEEEIRTTNPVATEQYGCTVMTENGLDQEIGNDT

SEQ ID NO: 76187 - protein, 30 aa, Artificial Sequence
  Description of Artificial Sequence: Synthetic polypeptide
DEEQIATTNPVATEQWGSVAANNDQPGVNS

SEQ ID NO: 76188 - protein, 32 aa, Artificial Sequence
  Description of Artificial Sequence: Synthetic polypeptide
VEEEIATTNPVATEQYGSCSTHLQPDDQGQRD

SEQ ID NO: 76189 - protein, 33 aa, Artificial Sequence
  Description of Artificial Sequence: Synthetic polypeptide
SEEEIRTTNPVATEQYGCVCSTNHQNFGSENQL

SEQ ID NO: 76190 - protein, 32 aa, Artificial Sequence
  Description of Artificial Sequence: Synthetic polypeptide
SEEEIRTTNPVATEQYGCVCSTNHQNFGSDQS

SEQ ID NO: 76191 - protein, 33 aa, Artificial Sequence
  Description of Artificial Sequence: Synthetic polypeptide
DEMEIRTTNPVATEQYGSVSVTPTHQEYGDNDF

SEQ ID NO: 76192 - protein, 33 aa, Artificial Sequence
  Description of Artificial Sequence: Synthetic polypeptide
SEEEIRTTNPVATEQYGCVCSTNHQFFGSENQS

SEQ ID NO: 76193 - protein, 31 aa, Artificial Sequence
  Description of Artificial Sequence: Synthetic polypeptide
DEEEIRTTNPCATEQYGSVATVTAQAGQEED

SEQ ID NO: 76194 - protein, 33 aa, Artificial Sequence
  Description of Artificial Sequence: Synthetic polypeptide
DEEEIRTTNPVATEQYGCYVCDTNYLGRADPRM

SEQ ID NO: 76195 - protein, 31 aa, Artificial Sequence
  Description of Artificial Sequence: Synthetic polypeptide
AEEEIACTNPVATEQYGCVATNLQDDPGERH

SEQ ID NO: 76196 - protein, 33 aa, Artificial Sequence
  Description of Artificial Sequence: Synthetic polypeptide
DEEEIRTTNPVATEQYGDVGSNLNLEGGNGNGD

SEQ ID NO: 76197 - protein, 31 aa, Artificial Sequence
  Description of Artificial Sequence: Synthetic polypeptide
DEEQIACTNPVATEQYGSVSANLQDNNPQNH

SEQ ID NO: 76198 - protein, 32 aa, Artificial Sequence
  Description of Artificial Sequence: Synthetic polypeptide
VEEEIATTNPVAYEQYGSVSAANNLPDENGNR

SEQ ID NO: 76199 - protein, 31 aa, Artificial Sequence
  Description of Artificial Sequence: Synthetic polypeptide
DEMEIRTTNPVATEQYGSVTTEVSERIGEEI

SEQ ID NO: 76200 - protein, 32 aa, Artificial Sequence
  Description of Artificial Sequence: Synthetic polypeptide
DEMEIRTTNPVATEQYGSVTTLEDLQERSEVA

SEQ ID NO: 76201 - protein, 32 aa, Artificial Sequence
  Description of Artificial Sequence: Synthetic polypeptide
DEMEIRTTNPVATEQYGSVTTNDEQPMPNEMG

SEQ ID NO: 76202 - protein, 30 aa, Artificial Sequence
  Description of Artificial Sequence: Synthetic polypeptide
DEEQIACTNPVATEQYGSVATHELEAGENT

SEQ ID NO: 76203 - protein, 32 aa, Artificial Sequence
  Description of Artificial Sequence: Synthetic polypeptide
SEEEIRTTNPVATEQYGAIVSTLFPIQIGNGG

SEQ ID NO: 76204 - protein, 31 aa, Artificial Sequence
  Description of Artificial Sequence: Synthetic polypeptide
VEEEIATTNPVAYERYGSVSTGDNHQNGNDP

SEQ ID NO: 76205 - protein, 31 aa, Artificial Sequence
  Description of Artificial Sequence: Synthetic polypeptide
DEMEIRTTNPVATEQYGSVTWDLERNGDISG

SEQ ID NO: 76206 - protein, 31 aa, Artificial Sequence
  Description of Artificial Sequence: Synthetic polypeptide
DEMEIRTTNPVATEQYGSVTWNLETDENNMQ

SEQ ID NO: 76207 - protein, 33 aa, Artificial Sequence
  Description of Artificial Sequence: Synthetic polypeptide
SEEEIRTTNPVATEQWGSVYHWTNDIQKTGSNR

SEQ ID NO: 76208 - protein, 34 aa, Artificial Sequence
  Description of Artificial Sequence: Synthetic polypeptide
AEEEIRTTNPVATEQYGSVSTTNLNNEQGNAQGE

SEQ ID NO: 76209 - protein, 35 aa, Artificial Sequence
  Description of Artificial Sequence: Synthetic polypeptide
AEEEIRTTNPVATEQYGSVSTTNLNNQQIGTNQES

SEQ ID NO: 76210 - protein, 34 aa, Artificial Sequence
  Description of Artificial Sequence: Synthetic polypeptide
AEEEIRTTNPVATEQYGSVSTTNLNQGNQDENDE

SEQ ID NO: 76211 - protein, 32 aa, Artificial Sequence
  Description of Artificial Sequence: Synthetic polypeptide
DEMEIRTTNPVATEQYGSVTTEPWLLDGEEIR

SEQ ID NO: 76212 - protein, 31 aa, Artificial Sequence
  Description of Artificial Sequence: Synthetic polypeptide
DEMEIRTTNPVATEQYGSVVDNNQEHNEFKN

SEQ ID NO: 76213 - protein, 35 aa, Artificial Sequence
  Description of Artificial Sequence: Synthetic polypeptide
AEEEIRTTNPVATEQYGSVSTTNLNQGTQGNNQAE

SEQ ID NO: 76214 - protein, 34 aa, Artificial Sequence
  Description of Artificial Sequence: Synthetic polypeptide
AEEEIRTTNPVATEQYGSVSTTNLNQNQTEGTED

SEQ ID NO: 76215 - protein, 31 aa, Artificial Sequence
  Description of Artificial Sequence: Synthetic polypeptide
SEEEIRTTNPVATEQWGIVSPTNNLQESSHV

SEQ ID NO: 76216 - protein, 33 aa, Artificial Sequence
  Description of Artificial Sequence: Synthetic polypeptide
DEEEIRTTNPVATEQYGDVNDDTNLIREGQGGQ

SEQ ID NO: 76217 - protein, 33 aa, Artificial Sequence
  Description of Artificial Sequence: Synthetic polypeptide
DEEEIRTTNPVATEQYGCTCSTNEHQEGFGSNQ

SEQ ID NO: 76218 - protein, 32 aa, Artificial Sequence
  Description of Artificial Sequence: Synthetic polypeptide
DEEEIRTTNPVATEQYGDVNGQTDIQMEGENI

SEQ ID NO: 76219 - protein, 34 aa, Artificial Sequence
  Description of Artificial Sequence: Synthetic polypeptide
DEEEIRTTNPVAVEQYGSVSTVVTNNNNQQGNTD

SEQ ID NO: 76220 - protein, 30 aa, Artificial Sequence
  Description of Artificial Sequence: Synthetic polypeptide
AEEEIACTNPVATEQYGCVATNDQDSGNQE

SEQ ID NO: 76221 - protein, 32 aa, Artificial Sequence
  Description of Artificial Sequence: Synthetic polypeptide
DEEEIRTTNPCATEQYGSVATVLANQGNQQEN

SEQ ID NO: 76222 - protein, 29 aa, Artificial Sequence
  Description of Artificial Sequence: Synthetic peptide
SEEEIRTTNPVATEQWGDVSEILMAAGDA

SEQ ID NO: 76223 - protein, 31 aa, Artificial Sequence
  Description of Artificial Sequence: Synthetic polypeptide
DEAEIATTNPVAYEPYGVVASATNLQEGNDP

SEQ ID NO: 76224 - protein, 32 aa, Artificial Sequence
  Description of Artificial Sequence: Synthetic polypeptide
SEEEIRTTNPVATEQWGAVSNNNLWQRHNASV

SEQ ID NO: 76225 - protein, 31 aa, Artificial Sequence
  Description of Artificial Sequence: Synthetic polypeptide
DEEQIAATNPVAYEAYGFVSCTNLSQGVGNR

SEQ ID NO: 76226 - protein, 34 aa, Artificial Sequence
  Description of Artificial Sequence: Synthetic polypeptide
AEEEIRTTNPVATEQYGSVSTTNLNQGTNNNELQ

SEQ ID NO: 76227 - protein, 33 aa, Artificial Sequence
  Description of Artificial Sequence: Synthetic polypeptide
DEMEIRTTNPVATEQYGSVSVTNLNDTRSMDGV

SEQ ID NO: 76228 - protein, 33 aa, Artificial Sequence
  Description of Artificial Sequence: Synthetic polypeptide
SEEEIRTTNPVATEQYGCVASTKNELQRSTEFL

SEQ ID NO: 76229 - protein, 30 aa, Artificial Sequence
  Description of Artificial Sequence: Synthetic polypeptide
DEEQIACTNPVATEQYGSVATHGLEAGGNH

SEQ ID NO: 76230 - protein, 33 aa, Artificial Sequence
  Description of Artificial Sequence: Synthetic polypeptide
DEEEIRTTNPVATEQYGDVGSNMNLEQGEFNEQ

SEQ ID NO: 76231 - protein, 32 aa, Artificial Sequence
  Description of Artificial Sequence: Synthetic polypeptide
DEMEIRTTNPVATEQYGSVSWGMEQREGEGQI

SEQ ID NO: 76232 - protein, 31 aa, Artificial Sequence
  Description of Artificial Sequence: Synthetic polypeptide
DEMEIRTTNPVATEQYGSVSWHQEREGTQME

SEQ ID NO: 76233 - protein, 33 aa, Artificial Sequence
  Description of Artificial Sequence: Synthetic polypeptide
DEEEIRTTNPVATEQYGDVGSTDLNVGVGNNGE

SEQ ID NO: 76234 - protein, 33 aa, Artificial Sequence
  Description of Artificial Sequence: Synthetic polypeptide
DEEEIRTTNPVATEQYGDVGSTDLVGVGNNGEE

SEQ ID NO: 76235 - protein, 32 aa, Artificial Sequence
  Description of Artificial Sequence: Synthetic polypeptide
VEEEIATTNPVAYEQYGSVAATNLQNPGENPV

SEQ ID NO: 76236 - protein, 34 aa, Artificial Sequence
  Description of Artificial Sequence: Synthetic polypeptide
DEEEIRTTNPVATEQYGDVGSTMNLNEGGNGNGQ

SEQ ID NO: 76237 - protein, 35 aa, Artificial Sequence
  Description of Artificial Sequence: Synthetic polypeptide
DEEEIRTTNPVATEQYGDVGSTMNLNQGGNGGEQF

SEQ ID NO: 76238 - protein, 31 aa, Artificial Sequence
  Description of Artificial Sequence: Synthetic polypeptide
CTEEIRYTNPVATEQYGSGVSLNQQQGMTRW

SEQ ID NO: 76239 - protein, 35 aa, Artificial Sequence
  Description of Artificial Sequence: Synthetic polypeptide
DEEEIRTTNPVATEQYGDVGSTMNLNQGGNGNDED

SEQ ID NO: 76240 - protein, 32 aa, Artificial Sequence
  Description of Artificial Sequence: Synthetic polypeptide
DEEEIRTTNPCATEQYGSVATVNLGLQGQQED

SEQ ID NO: 76241 - protein, 34 aa, Artificial Sequence
  Description of Artificial Sequence: Synthetic polypeptide
DEEEIRTTNPVATEQYGDVGSTMNVDQTGQGNED

SEQ ID NO: 76242 - protein, 34 aa, Artificial Sequence
  Description of Artificial Sequence: Synthetic polypeptide
DEEEIRTTNPVATEQYGDVGSTNGLGEEDEGGNG

SEQ ID NO: 76243 - protein, 32 aa, Artificial Sequence
  Description of Artificial Sequence: Synthetic polypeptide
SEEEIRTTNPVATEQYGCVASTQLGETQEDNE

SEQ ID NO: 76244 - protein, 32 aa, Artificial Sequence
  Description of Artificial Sequence: Synthetic polypeptide
DEMEIRTTNPVATEQYGSVSWTLDEYRGEDQI

SEQ ID NO: 76245 - protein, 35 aa, Artificial Sequence
  Description of Artificial Sequence: Synthetic polypeptide
DEMEIRTTNPVATEQYGSVSYTNLEHQEGLNEDDP

SEQ ID NO: 76246 - protein, 31 aa, Artificial Sequence
  Description of Artificial Sequence: Synthetic polypeptide
DEAEIATTNPVAYEPYGVVASATNLQEGMDR

SEQ ID NO: 76247 - protein, 31 aa, Artificial Sequence
  Description of Artificial Sequence: Synthetic polypeptide
DEMEIRTTNPVATEQYGSVTPTNSERETYQI

SEQ ID NO: 76248 - protein, 31 aa, Artificial Sequence
  Description of Artificial Sequence: Synthetic polypeptide
DEEEIRTTNPCATEQYGSVATVLGAAGEEET

SEQ ID NO: 76249 - protein, 34 aa, Artificial Sequence
  Description of Artificial Sequence: Synthetic polypeptide
DEEEIRTTNPVATEQYGDVMGETNMLEREGMNGD

SEQ ID NO: 76250 - protein, 30 aa, Artificial Sequence
  Description of Artificial Sequence: Synthetic polypeptide
VEEEIATTNPVAYEQYGSVATNLNDGSIDQ

SEQ ID NO: 76251 - protein, 33 aa, Artificial Sequence
  Description of Artificial Sequence: Synthetic polypeptide
AEEEIRTTNPVATEQYGSVSTTNLMGQTNVTED

SEQ ID NO: 76252 - protein, 31 aa, Artificial Sequence
  Description of Artificial Sequence: Synthetic polypeptide
SEEEIRTTNPVATEQYGCVCFTALQNGSEQF

SEQ ID NO: 76253 - protein, 33 aa, Artificial Sequence
  Description of Artificial Sequence: Synthetic polypeptide
DEMEIRTTNPVATEQYGSVTSTDLQEYGEEEIP

SEQ ID NO: 76254 - protein, 33 aa, Artificial Sequence
  Description of Artificial Sequence: Synthetic polypeptide
DEMEIRTTNPVATEQYGSVTSTDNEQEGGEEKV

SEQ ID NO: 76255 - protein, 34 aa, Artificial Sequence
  Description of Artificial Sequence: Synthetic polypeptide
AEEEIRTTNPVATEQYGSVSTTNLNEDNGNNNTN

SEQ ID NO: 76256 - protein, 34 aa, Artificial Sequence
  Description of Artificial Sequence: Synthetic polypeptide
AEEEIRTTNPVATEQYGSVSTTNLNLQGTNNEEF

SEQ ID NO: 76257 - protein, 30 aa, Artificial Sequence
  Description of Artificial Sequence: Synthetic polypeptide
DEEQIACTNPVATEQYGSVATHGLNSGENT

SEQ ID NO: 76258 - protein, 33 aa, Artificial Sequence
  Description of Artificial Sequence: Synthetic polypeptide
DEMEIRTTNPVATEQYGSVSYDNLEQEGLEDDP

SEQ ID NO: 76259 - protein, 31 aa, Artificial Sequence
  Description of Artificial Sequence: Synthetic polypeptide
DEEEIRTTNPVATEQYGCVSWEDQNFGSEQS

SEQ ID NO: 76260 - protein, 34 aa, Artificial Sequence
  Description of Artificial Sequence: Synthetic polypeptide
SEEEIRTTNPVATEQYGCVSTGNLDQNFGSNNQA

SEQ ID NO: 76261 - protein, 31 aa, Artificial Sequence
  Description of Artificial Sequence: Synthetic polypeptide
DEEEIRTTNPCATEQYGSVCYNIEDSGHNDT

SEQ ID NO: 76262 - protein, 35 aa, Artificial Sequence
  Description of Artificial Sequence: Synthetic polypeptide
DEEEIRTTNPVAVEQYGSVSTVTNNNQLQNGNQDG

SEQ ID NO: 76263 - protein, 34 aa, Artificial Sequence
  Description of Artificial Sequence: Synthetic polypeptide
DEMEIRTTNPVATEQYGSVSTTNLDQTFNSNNID

SEQ ID NO: 76264 - protein, 33 aa, Artificial Sequence
  Description of Artificial Sequence: Synthetic polypeptide
DEEEIRTTNPVATEQYGVVCSTEHNQHFGSNQS

SEQ ID NO: 76265 - protein, 33 aa, Artificial Sequence
  Description of Artificial Sequence: Synthetic polypeptide
AEEEIRTTNPVATEQYGSVSTTNGNQNNDTTNF

SEQ ID NO: 76266 - protein, 33 aa, Artificial Sequence
  Description of Artificial Sequence: Synthetic polypeptide
DEMEIRTTNPVATEQYGSVSTTPNLQMESEEQI

SEQ ID NO: 76267 - protein, 35 aa, Artificial Sequence
  Description of Artificial Sequence: Synthetic polypeptide
DEEEIRTTNPVAVEQYGSVSTVTNNNQLQNQGNED

SEQ ID NO: 76268 - protein, 32 aa, Artificial Sequence
  Description of Artificial Sequence: Synthetic polypeptide
DEAEIACTNPVATEPYGSVATNLQDAPGPSNR

SEQ ID NO: 76269 - protein, 34 aa, Artificial Sequence
  Description of Artificial Sequence: Synthetic polypeptide
DEEEIRTTNPVATEQYGVVCSTEEHQRFGSNFQL

SEQ ID NO: 76270 - protein, 32 aa, Artificial Sequence
  Description of Artificial Sequence: Synthetic polypeptide
DEEEIRTTNPVATEQYGVVCSTEDQYFGSEQA

SEQ ID NO: 76271 - protein, 32 aa, Artificial Sequence
  Description of Artificial Sequence: Synthetic polypeptide
DEEEIRTTNPVATEQYGVVCSTEDQNFGSEQE

SEQ ID NO: 76272 - protein, 34 aa, Artificial Sequence
  Description of Artificial Sequence: Synthetic polypeptide
AEEEIRTTNPVATEQYGSVSTTNGNQQGNQNQDD

SEQ ID NO: 76273 - protein, 35 aa, Artificial Sequence
  Description of Artificial Sequence: Synthetic polypeptide
DEEEIRTTNPVAVEQYGSVSTVTNNQNLQNGNVDE

SEQ ID NO: 76274 - protein, 33 aa, Artificial Sequence
  Description of Artificial Sequence: Synthetic polypeptide
DEEEIRTTNPCATEQYGSVIEPTTQTQRGVNPL

SEQ ID NO: 76275 - protein, 32 aa, Artificial Sequence
  Description of Artificial Sequence: Synthetic polypeptide
VEEEIACTNPVATEQYGSVATNLQQGEGNNQD

SEQ ID NO: 76276 - protein, 33 aa, Artificial Sequence
  Description of Artificial Sequence: Synthetic polypeptide
DEEEIRTTNPVATEQYGVVCSSGNHQGFGSNQA

SEQ ID NO: 76277 - protein, 30 aa, Artificial Sequence
  Description of Artificial Sequence: Synthetic polypeptide
AEEEIACTNPVATEQYGCVATNLTDSGNQM

SEQ ID NO: 76278 - protein, 33 aa, Artificial Sequence
  Description of Artificial Sequence: Synthetic polypeptide
DEEEIRTTNPCATEQYGSVIEPTTQLQRNVNPN

SEQ ID NO: 76279 - protein, 34 aa, Artificial Sequence
  Description of Artificial Sequence: Synthetic polypeptide
DEEEIRTTNPCATEQYGSVIEPTTQLQIRGVNPF

SEQ ID NO: 76280 - protein, 32 aa, Artificial Sequence
  Description of Artificial Sequence: Synthetic polypeptide
DEEEIRTTNPVATEQYGVVCSSGELQYFGSEQ

SEQ ID NO: 76281 - protein, 34 aa, Artificial Sequence
  Description of Artificial Sequence: Synthetic polypeptide
DEEEIRTTNPVAVEQYGSVSTVTNNQQGGNNSDE

SEQ ID NO: 76282 - protein, 29 aa, Artificial Sequence
  Description of Artificial Sequence: Synthetic peptide
VEEEIASVNPVCTEQYGVVSDNLQQSGNQ

SEQ ID NO: 76283 - protein, 32 aa, Artificial Sequence
  Description of Artificial Sequence: Synthetic polypeptide
DEMEIRTTNPVATEQYGSVSTTVALEMGQDDN

SEQ ID NO: 76284 - protein, 32 aa, Artificial Sequence
  Description of Artificial Sequence: Synthetic polypeptide
DEEEIRTTNPVATEQYGCVADTWLAQSSDNAD

SEQ ID NO: 76285 - protein, 32 aa, Artificial Sequence
  Description of Artificial Sequence: Synthetic polypeptide
DEEEIRTTNPVATEQYGCVTSTEHQNFGSDQI

SEQ ID NO: 76286 - protein, 32 aa, Artificial Sequence
  Description of Artificial Sequence: Synthetic polypeptide
DEEEIRTTNPVATEQYGCVTSTEHQNFNSDQS

SEQ ID NO: 76287 - protein, 32 aa, Artificial Sequence
  Description of Artificial Sequence: Synthetic polypeptide
DEEEIRTTNPVATEQYGVVCSSEHQNFGSERA

SEQ ID NO: 76288 - protein, 29 aa, Artificial Sequence
  Description of Artificial Sequence: Synthetic peptide
VEEEIASVNPVCTEQYGVVSDNLQSCGNQ

SEQ ID NO: 76289 - protein, 33 aa, Artificial Sequence
  Description of Artificial Sequence: Synthetic polypeptide
DEEEIRTTNPVATEQYGCVAGTNGHQERDMERN

SEQ ID NO: 76290 - protein, 32 aa, Artificial Sequence
  Description of Artificial Sequence: Synthetic polypeptide
DEEEIRTTNPVATEQYGCVAGTNLQDHLDIDE

SEQ ID NO: 76291 - protein, 34 aa, Artificial Sequence
  Description of Artificial Sequence: Synthetic polypeptide
DEEEIRTTNPVAVEQYGSVSTVTNNNNQQGNEED

SEQ ID NO: 76292 - protein, 33 aa, Artificial Sequence
  Description of Artificial Sequence: Synthetic polypeptide
AEEEIRTTNPVATEQYGSVSTTNGNNNQGDNGS

SEQ ID NO: 76293 - protein, 31 aa, Artificial Sequence
  Description of Artificial Sequence: Synthetic polypeptide
DEEEIRTTNPVATEQYGCVSWEHQNFGSQDG

SEQ ID NO: 76294 - protein, 31 aa, Artificial Sequence
  Description of Artificial Sequence: Synthetic polypeptide
DEEEIRTTNPVATEQYGCVSWEHQNFNSNAT

SEQ ID NO: 76295 - protein, 32 aa, Artificial Sequence
  Description of Artificial Sequence: Synthetic polypeptide
DEEEIRTTNPCATEQYGSVPTWDLADRGGGEE

SEQ ID NO: 76296 - protein, 28 aa, Artificial Sequence
  Description of Artificial Sequence: Synthetic peptide
AEEEIACTNPVATEQYGEAPEVLQHGGR

SEQ ID NO: 76297 - protein, 32 aa, Artificial Sequence
  Description of Artificial Sequence: Synthetic polypeptide
DEEEIRTTNPCATEQYGSVPTWDLADRGGDEH

SEQ ID NO: 76298 - protein, 29 aa, Artificial Sequence
  Description of Artificial Sequence: Synthetic peptide
DAAEIACTNPVATEQYGSTVATNLQNMTE

SEQ ID NO: 76299 - protein, 34 aa, Artificial Sequence
  Description of Artificial Sequence: Synthetic polypeptide
AEEEIRTTNPVATEQYGSVSTTNGEQQGEQGNNN

SEQ ID NO: 76300 - protein, 35 aa, Artificial Sequence
  Description of Artificial Sequence: Synthetic polypeptide
DEEEIRTTNPVAVEQYGSVSTVTNNLQGGNNISED

SEQ ID NO: 76301 - protein, 33 aa, Artificial Sequence
  Description of Artificial Sequence: Synthetic polypeptide
DEEEIRTTNPVATEQYGCVAMTNLNTGAGMGDR

SEQ ID NO: 76302 - protein, 32 aa, Artificial Sequence
  Description of Artificial Sequence: Synthetic polypeptide
DEEEIRTTNPVATEQYGCVSWENLAHFGSQQA

SEQ ID NO: 76303 - protein, 30 aa, Artificial Sequence
  Description of Artificial Sequence: Synthetic polypeptide
DAAEIACTNPVATEQYGSTVATNLQAPGRN

SEQ ID NO: 76304 - protein, 34 aa, Artificial Sequence
  Description of Artificial Sequence: Synthetic polypeptide
AEEEIRTTNPVATEQYGSVSTTNGEQQNNEGGNT

SEQ ID NO: 76305 - protein, 35 aa, Artificial Sequence
  Description of Artificial Sequence: Synthetic polypeptide
DEEEIRTTNPVAVEQYGSVSTVTNNLQGGNNQEDT

SEQ ID NO: 76306 - protein, 33 aa, Artificial Sequence
  Description of Artificial Sequence: Synthetic polypeptide
DEEEIRTTNPVATEQYGCVADTWLAQRNSDNAV

SEQ ID NO: 76307 - protein, 31 aa, Artificial Sequence
  Description of Artificial Sequence: Synthetic polypeptide
DEAEIACTNPVATEPYGSVATNLQGAGMENN

SEQ ID NO: 76308 - protein, 34 aa, Artificial Sequence
  Description of Artificial Sequence: Synthetic polypeptide
AEEEIRTTNPVATEQYGSVSTTNGLQQNATNSEE

SEQ ID NO: 76309 - protein, 35 aa, Artificial Sequence
  Description of Artificial Sequence: Synthetic polypeptide
DEEEIRTTNPVAVEQYGSVSTVTNNLQGGNNTEDN

SEQ ID NO: 76310 - protein, 29 aa, Artificial Sequence
  Description of Artificial Sequence: Synthetic peptide
DAAEIACTNPVATEQYGATVATNLQNGTM

SEQ ID NO: 76311 - protein, 32 aa, Artificial Sequence
  Description of Artificial Sequence: Synthetic polypeptide
DEEQIRCTNPVATEQYGSVSTDHELGIGSNNT

SEQ ID NO: 76312 - protein, 34 aa, Artificial Sequence
  Description of Artificial Sequence: Synthetic polypeptide
DEMEIRTTNPVATEQYGSVSTPMDLQERTENIEE

SEQ ID NO: 76313 - protein, 35 aa, Artificial Sequence
  Description of Artificial Sequence: Synthetic polypeptide
DEEEIRTTNPVAVEQYGSVSTVTNNNNLQNGNEDV

SEQ ID NO: 76314 - protein, 30 aa, Artificial Sequence
  Description of Artificial Sequence: Synthetic polypeptide
VEEEIACTNPVATEQYGSCATHLQPDQGDR

SEQ ID NO: 76315 - protein, 33 aa, Artificial Sequence
  Description of Artificial Sequence: Synthetic polypeptide
DEEEIRTTNPVATEQYGVVCSTELQEHFNSNQL

SEQ ID NO: 76316 - protein, 31 aa, Artificial Sequence
  Description of Artificial Sequence: Synthetic polypeptide
DEMEIRTTNPVATEQYGSVSTPNEDEEFEIV

SEQ ID NO: 76317 - protein, 29 aa, Artificial Sequence
  Description of Artificial Sequence: Synthetic peptide
DAAEIACTNPVATEQWGCCSTVLQHGNRQ

SEQ ID NO: 76318 - protein, 34 aa, Artificial Sequence
  Description of Artificial Sequence: Synthetic polypeptide
DEMEIRTTNPVATEQYGSVSTSNDIQDGGNMEIN

SEQ ID NO: 76319 - protein, 35 aa, Artificial Sequence
  Description of Artificial Sequence: Synthetic polypeptide
AEEEIRTTNPVATEQYGSVSTTNGNNLQQGNNNSE

SEQ ID NO: 76320 - protein, 32 aa, Artificial Sequence
  Description of Artificial Sequence: Synthetic polypeptide
DEMEIRTTNPVATEQYGSVSTTDLERNPSQQD

SEQ ID NO: 76321 - protein, 33 aa, Artificial Sequence
  Description of Artificial Sequence: Synthetic polypeptide
DEEEIRTTNPVATEQYGVVCSTELQNFGSDFQP

SEQ ID NO: 76322 - protein, 32 aa, Artificial Sequence
  Description of Artificial Sequence: Synthetic polypeptide
DEEEIRTTNPVATEQYGCVADTWLAQNSENGN

SEQ ID NO: 76323 - protein, 32 aa, Artificial Sequence
  Description of Artificial Sequence: Synthetic polypeptide
DEEEIRTTNPVATEQYGCVADTWLAQNSDNLA

SEQ ID NO: 76324 - protein, 32 aa, Artificial Sequence
  Description of Artificial Sequence: Synthetic polypeptide
DEMEIRTTNPVATEQYGSVSTVNNDNEGEDQM

SEQ ID NO: 76325 - protein, 33 aa, Artificial Sequence
  Description of Artificial Sequence: Synthetic polypeptide
SEEEIRTTNPVATEQYGQCVCSTELQHFGSNQL

SEQ ID NO: 76326 - protein, 35 aa, Artificial Sequence
  Description of Artificial Sequence: Synthetic polypeptide
AEEEIRTTNPVATEQYGSVSTTNLENQEEGTNNNN

SEQ ID NO: 76327 - protein, 35 aa, Artificial Sequence
  Description of Artificial Sequence: Synthetic polypeptide
AEEEIRTTNPVATEQYGSVSTTNLENQEEIGNNNN

SEQ ID NO: 76328 - protein, 32 aa, Artificial Sequence
  Description of Artificial Sequence: Synthetic polypeptide
SEEEIRTTNPVATEQYGEIVTGTNLEQHDEIR

SEQ ID NO: 76329 - protein, 34 aa, Artificial Sequence
  Description of Artificial Sequence: Synthetic polypeptide
AEEEIRTTNPVATEQYGSVSTTNLGGNDGGNQEM

SEQ ID NO: 76330 - protein, 35 aa, Artificial Sequence
  Description of Artificial Sequence: Synthetic polypeptide
DEEEIRTTNPVATEQYGVTVSCTANGSGERGGNMR

SEQ ID NO: 76331 - protein, 31 aa, Artificial Sequence
  Description of Artificial Sequence: Synthetic polypeptide
DEAEIATTNPVAYEHWGSVSTNLQGDLGNGS

SEQ ID NO: 76332 - protein, 32 aa, Artificial Sequence
  Description of Artificial Sequence: Synthetic polypeptide
SEEEIRTTNPVATEQYGCWSTINPLERIEDNN

SEQ ID NO: 76333 - protein, 34 aa, Artificial Sequence
  Description of Artificial Sequence: Synthetic polypeptide
DEEEIRTTNPVATEQYGVTNMTDNGLSQRIINRN

SEQ ID NO: 76334 - protein, 32 aa, Artificial Sequence
  Description of Artificial Sequence: Synthetic polypeptide
DEMEIRTTNPVATEQYGSVSVTMETQRSQIPL

SEQ ID NO: 76335 - protein, 31 aa, Artificial Sequence
  Description of Artificial Sequence: Synthetic polypeptide
AEEEIACTNPVATEQYGCVATNLQNDGNNQD

SEQ ID NO: 76336 - protein, 30 aa, Artificial Sequence
  Description of Artificial Sequence: Synthetic polypeptide
DEEQIATTNPVATEQYGSVSTVHEPLNENT

SEQ ID NO: 76337 - protein, 33 aa, Artificial Sequence
  Description of Artificial Sequence: Synthetic polypeptide
DEMEIRTTNPVATEQYGSVSVTNLDELNSNNQD

SEQ ID NO: 76338 - protein, 33 aa, Artificial Sequence
  Description of Artificial Sequence: Synthetic polypeptide
DEMEIRTTNPVATEQYGSVSVTDQQNRMGSIQE

SEQ ID NO: 76339 - protein, 32 aa, Artificial Sequence
  Description of Artificial Sequence: Synthetic polypeptide
DEMEIRTTNPVATEQYGSVSVTNLDEYPDDMQ

SEQ ID NO: 76340 - protein, 34 aa, Artificial Sequence
  Description of Artificial Sequence: Synthetic polypeptide
AEEEIRTTNPVATEQYGSVSTTNLLGNQEQGEDE

SEQ ID NO: 76341 - protein, 34 aa, Artificial Sequence
  Description of Artificial Sequence: Synthetic polypeptide
AEEEIRTTNPVATEQYGSVSTTNLLGSNGTENTG

SEQ ID NO: 76342 - protein, 33 aa, Artificial Sequence
  Description of Artificial Sequence: Synthetic polypeptide
AEEEIRTTNPVATEQYGSVSTTNLLGSNGTETG

SEQ ID NO: 76343 - protein, 33 aa, Artificial Sequence
  Description of Artificial Sequence: Synthetic polypeptide
SEEEIRTTNPVATEQYGCVSTGNLQNFNSNFAF

SEQ ID NO: 76344 - protein, 34 aa, Artificial Sequence
  Description of Artificial Sequence: Synthetic polypeptide
DEEEIRTTNPVAVEQYGSVSTVTTNNLQGNNNSD

SEQ ID NO: 76345 - protein, 33 aa, Artificial Sequence
  Description of Artificial Sequence: Synthetic polypeptide
AEEEIRTTNPVATEQYGSVSTTNLLIGETGGGG

SEQ ID NO: 76346 - protein, 34 aa, Artificial Sequence
  Description of Artificial Sequence: Synthetic polypeptide
DEEEIRTTNPVATEQYGCVYKTNDIQKNGGNNER

SEQ ID NO: 76347 - protein, 33 aa, Artificial Sequence
  Description of Artificial Sequence: Synthetic polypeptide
DEEEIRTTNPVATEQYGCVYSTEDIQESFGSNQ

SEQ ID NO: 76348 - protein, 32 aa, Artificial Sequence
  Description of Artificial Sequence: Synthetic polypeptide
DEEEIRTTNPCATEQYGSVIAIEQDDQRGNHA

SEQ ID NO: 76349 - protein, 31 aa, Artificial Sequence
  Description of Artificial Sequence: Synthetic polypeptide
DEEEIRTTNPCATEQYGSVETTQGLGVNEEN

SEQ ID NO: 76350 - protein, 33 aa, Artificial Sequence
  Description of Artificial Sequence: Synthetic polypeptide
DEMEIRTTNPVATEQYGSVSVTNLMETSSDQRP

SEQ ID NO: 76351 - protein, 31 aa, Artificial Sequence
  Description of Artificial Sequence: Synthetic polypeptide
DEEQIATTNPVATEQYGSVSTHEPLNAEENT

SEQ ID NO: 76352 - protein, 32 aa, Artificial Sequence
  Description of Artificial Sequence: Synthetic polypeptide
DEEEIRTTNPVATEQYGCWCSSPNDLQGDSNQ

SEQ ID NO: 76353 - protein, 35 aa, Artificial Sequence
  Description of Artificial Sequence: Synthetic polypeptide
AEEEIRTTNPVATEQYGSVSTTNLGQNNNGNNQDT

SEQ ID NO: 76354 - protein, 34 aa, Artificial Sequence
  Description of Artificial Sequence: Synthetic polypeptide
AEEEIRTTNPVATEQYGSVSTTNLLIGNEGGGGD

SEQ ID NO: 76355 - protein, 32 aa, Artificial Sequence
  Description of Artificial Sequence: Synthetic polypeptide
CTGEIRTTNPVATEQYGSVSTENNLQDLGMGG

SEQ ID NO: 76356 - protein, 31 aa, Artificial Sequence
  Description of Artificial Sequence: Synthetic polypeptide
DEEQIATTNPVATESYGCVATNLQDPGGERH

SEQ ID NO: 76357 - protein, 34 aa, Artificial Sequence
  Description of Artificial Sequence: Synthetic polypeptide
DEEEIRTTNPCATEQYGSVIEPTNNLQRGVWPDE

SEQ ID NO: 76358 - protein, 34 aa, Artificial Sequence
  Description of Artificial Sequence: Synthetic polypeptide
DEEEIRTTNPCATEQYGSVIEPTNHQRNGVNLAV

SEQ ID NO: 76359 - protein, 33 aa, Artificial Sequence
  Description of Artificial Sequence: Synthetic polypeptide
DEEEIRTTNPVATEQYGVVCSNTGEHQYFGSNQ

SEQ ID NO: 76360 - protein, 34 aa, Artificial Sequence
  Description of Artificial Sequence: Synthetic polypeptide
DEEEIRTTNPVATEQYGVVCSNTENLQHFGSEQT

SEQ ID NO: 76361 - protein, 33 aa, Artificial Sequence
  Description of Artificial Sequence: Synthetic polypeptide
DEEEIRTTNPVATEQYGVVCSNTELQGSNSNQA

SEQ ID NO: 76362 - protein, 32 aa, Artificial Sequence
  Description of Artificial Sequence: Synthetic polypeptide
DEMEIRTTNPVATEQYGSVSTVTEFEGENDFD

SEQ ID NO: 76363 - protein, 34 aa, Artificial Sequence
  Description of Artificial Sequence: Synthetic polypeptide
DEMEIRTTNPVATEQYGSVSTWNLMETGNTSDPQ

SEQ ID NO: 76364 - protein, 34 aa, Artificial Sequence
  Description of Artificial Sequence: Synthetic polypeptide
DEEEIRTTNPVATEQYGVVCSNTEHQRFGSENQI

SEQ ID NO: 76365 - protein, 28 aa, Artificial Sequence
  Description of Artificial Sequence: Synthetic peptide
VEEEIASVNPVGTEQWGVVSSNLQSGNQ

SEQ ID NO: 76366 - protein, 29 aa, Artificial Sequence
  Description of Artificial Sequence: Synthetic peptide
VEEEIASVNPVSTEQYGVVSCNLQSGMNQ

SEQ ID NO: 76367 - protein, 29 aa, Artificial Sequence
  Description of Artificial Sequence: Synthetic peptide
VEEEIASVNPVSTEQYGVVSGDNLQSGNQ

SEQ ID NO: 76368 - protein, 31 aa, Artificial Sequence
  Description of Artificial Sequence: Synthetic polypeptide
DEAEIATTNPVAYEEWGSVSTNLQLGGDNDG

SEQ ID NO: 76369 - protein, 34 aa, Artificial Sequence
  Description of Artificial Sequence: Synthetic polypeptide
AEEEIRTTNPVATEQYGSVSTTNGQDNNNIGTNM

SEQ ID NO: 76370 - protein, 33 aa, Artificial Sequence
  Description of Artificial Sequence: Synthetic polypeptide
SEEEIRTTNPVATEQYGQVSCTNEGSQQSGSNF

SEQ ID NO: 76371 - protein, 30 aa, Artificial Sequence
  Description of Artificial Sequence: Synthetic polypeptide
DEAEIATTNPVAYEEWGSVSTNLQSGGDEH

SEQ ID NO: 76372 - protein, 33 aa, Artificial Sequence
  Description of Artificial Sequence: Synthetic polypeptide
DEEEIRTTNPVATEQYGVVCSNSELQRFGSEQG

SEQ ID NO: 76373 - protein, 33 aa, Artificial Sequence
  Description of Artificial Sequence: Synthetic polypeptide
AEEEIRTTNPVATEQYGSVSTTNGQEQQGEVET

SEQ ID NO: 76374 - protein, 33 aa, Artificial Sequence
  Description of Artificial Sequence: Synthetic polypeptide
DEMEIRTTNPVATEQYGSVSVDNLNQFEENEQL

SEQ ID NO: 76375 - protein, 36 aa, Artificial Sequence
  Description of Artificial Sequence: Synthetic polypeptide
SEEEIRTTNPVATEQYGSTVPSTENALSQAEGGNQR

SEQ ID NO: 76376 - protein, 33 aa, Artificial Sequence
  Description of Artificial Sequence: Synthetic polypeptide
DEMEIRTTNPVATEQYGSVSVEDLNQQSGFERQ

SEQ ID NO: 76377 - protein, 31 aa, Artificial Sequence
  Description of Artificial Sequence: Synthetic polypeptide
AEEEIACTNPVATEQYGCVATNLQNSGNDSS

SEQ ID NO: 76378 - protein, 31 aa, Artificial Sequence
  Description of Artificial Sequence: Synthetic polypeptide
DEEEIRTTNPVATEQYGCVAATNDQQPEDSM

SEQ ID NO: 76379 - protein, 34 aa, Artificial Sequence
  Description of Artificial Sequence: Synthetic polypeptide
SEEEIRTTNPVATEQYGSTFFHTENLTQNRVGTR

SEQ ID NO: 76380 - protein, 32 aa, Artificial Sequence
  Description of Artificial Sequence: Synthetic polypeptide
DEMEIRTTNPVATEQYGSVSVELQMENNNSQN

SEQ ID NO: 76381 - protein, 31 aa, Artificial Sequence
  Description of Artificial Sequence: Synthetic polypeptide
AEEEIACTNPVATEQYGCVATNLQNQGNEQH

SEQ ID NO: 76382 - protein, 33 aa, Artificial Sequence
  Description of Artificial Sequence: Synthetic polypeptide
DEMEIRTTNPVATEQYGSVSVENLDEYGNDDAQ

SEQ ID NO: 76383 - protein, 32 aa, Artificial Sequence
  Description of Artificial Sequence: Synthetic polypeptide
DEMEIRTTNPVATEQYGSVSVENNNQQSLERG

SEQ ID NO: 76384 - protein, 31 aa, Artificial Sequence
  Description of Artificial Sequence: Synthetic polypeptide
CTGEIRTTNPVATEQYGSVSTGNNGQEGGGG

SEQ ID NO: 76385 - protein, 32 aa, Artificial Sequence
  Description of Artificial Sequence: Synthetic polypeptide
DEMEIRTTNPVATEQYGSVSVAELQEGVEDYI

SEQ ID NO: 76386 - protein, 33 aa, Artificial Sequence
  Description of Artificial Sequence: Synthetic polypeptide
AEEEIRTTNPVATEQYGSVSTTANTNDEGGNNE

SEQ ID NO: 76387 - protein, 31 aa, Artificial Sequence
  Description of Artificial Sequence: Synthetic polypeptide
DEEEIRTTNPCAYDQYGQVPCTDELSQRGNQ

SEQ ID NO: 76388 - protein, 31 aa, Artificial Sequence
  Description of Artificial Sequence: Synthetic polypeptide
DEESIATTNPVATECYGSVNTGDGQNREGNM

SEQ ID NO: 76389 - protein, 34 aa, Artificial Sequence
  Description of Artificial Sequence: Synthetic polypeptide
DEEEIRTTNPVATEQYGCVCSMTNLDQNFGSDQS

SEQ ID NO: 76390 - protein, 33 aa, Artificial Sequence
  Description of Artificial Sequence: Synthetic polypeptide
DEEEIRTTNPVATEQYGCVCSMTNHQNSGSDQA

SEQ ID NO: 76391 - protein, 33 aa, Artificial Sequence
  Description of Artificial Sequence: Synthetic polypeptide
DEMEIRTTNPVATEQYGSVCSVTNLDEYGDDAQ

SEQ ID NO: 76392 - protein, 32 aa, Artificial Sequence
  Description of Artificial Sequence: Synthetic polypeptide
TNEEIRTTNPVATEQYGCVSTTNLADSGQGER

SEQ ID NO: 76393 - protein, 32 aa, Artificial Sequence
  Description of Artificial Sequence: Synthetic polypeptide
SEEEIRTTNPVATESYGCVSNTNDHERGGDQR

SEQ ID NO: 76394 - protein, 32 aa, Artificial Sequence
  Description of Artificial Sequence: Synthetic polypeptide
DEEEIRTTNPVATEQYGCVSDWELNQYFSSNQ

SEQ ID NO: 76395 - protein, 34 aa, Artificial Sequence
  Description of Artificial Sequence: Synthetic polypeptide
DEETIRATNPVATEQYGSVSTVNQELQPGNNQES

SEQ ID NO: 76396 - protein, 31 aa, Artificial Sequence
  Description of Artificial Sequence: Synthetic polypeptide
SEEEIRTTNPVATESYGCVSNTELARFGDTQ

SEQ ID NO: 76397 - protein, 34 aa, Artificial Sequence
  Description of Artificial Sequence: Synthetic polypeptide
DEETIRATNPVATEQYGSVSTVNNQQLQQGNNQA

SEQ ID NO: 76398 - protein, 32 aa, Artificial Sequence
  Description of Artificial Sequence: Synthetic polypeptide
SEEEIRTTNPVATESYGCVCSNTNLAHGSDTR

SEQ ID NO: 76399 - protein, 32 aa, Artificial Sequence
  Description of Artificial Sequence: Synthetic polypeptide
TNEEIRTTNPVATEQYGEVSTQGLNDRGGNDQ

SEQ ID NO: 76400 - protein, 33 aa, Artificial Sequence
  Description of Artificial Sequence: Synthetic polypeptide
DEAEIACTNPVATEQYGSVSTPNLQENPNEDVR

SEQ ID NO: 76401 - protein, 32 aa, Artificial Sequence
  Description of Artificial Sequence: Synthetic polypeptide
TNEEIRTTNPVATEQYGVVAWNELQQDGQNGR

SEQ ID NO: 76402 - protein, 33 aa, Artificial Sequence
  Description of Artificial Sequence: Synthetic polypeptide
DEEEIRTTNPVATEQYGCVCSMTGNHQYFGSDQ

SEQ ID NO: 76403 - protein, 33 aa, Artificial Sequence
  Description of Artificial Sequence: Synthetic polypeptide
DEETIRATNPVATEQYGSVSTVNNEQYGNNQLS

SEQ ID NO: 76404 - protein, 34 aa, Artificial Sequence
  Description of Artificial Sequence: Synthetic polypeptide
DEEEIRTTNPVATEQYGCVCSMTGNHQGGGSNQG

SEQ ID NO: 76405 - protein, 33 aa, Artificial Sequence
  Description of Artificial Sequence: Synthetic polypeptide
DEETIRATNPVATEQYGSVSTMNQQQLGNNNLE

SEQ ID NO: 76406 - protein, 35 aa, Artificial Sequence
  Description of Artificial Sequence: Synthetic polypeptide
AEEEIRTTNPVATEQYGSVSTSNLNQQAGNGNIGT

SEQ ID NO: 76407 - protein, 35 aa, Artificial Sequence
  Description of Artificial Sequence: Synthetic polypeptide
SEEEIRTTNPVATEQYGVVLSYITNREDVQRGDNR

SEQ ID NO: 76408 - protein, 34 aa, Artificial Sequence
  Description of Artificial Sequence: Synthetic polypeptide
DEEEIRTTNPVATEQYGCVCSMTGNHARFGSNQA

SEQ ID NO: 76409 - protein, 33 aa, Artificial Sequence
  Description of Artificial Sequence: Synthetic polypeptide
DEMEIRTTNPVATEQYGSVFSVNVQEEGNNEQI

SEQ ID NO: 76410 - protein, 34 aa, Artificial Sequence
  Description of Artificial Sequence: Synthetic polypeptide
AEEEIRTTNPVATEQYGSVSTSNLQQQGTEQGEQ

SEQ ID NO: 76411 - protein, 35 aa, Artificial Sequence
  Description of Artificial Sequence: Synthetic polypeptide
AEEEIRTTNPVATEQYGSVSTSNLQQQLGNQNIGT

SEQ ID NO: 76412 - protein, 35 aa, Artificial Sequence
  Description of Artificial Sequence: Synthetic polypeptide
AEEEIRTTNPVATEQYGSVSTSNLQQQNGNGNIGS

SEQ ID NO: 76413 - protein, 28 aa, Artificial Sequence
  Description of Artificial Sequence: Synthetic peptide
AEEEIASVNPVCTEQYGCVSDNLQSGQQ

SEQ ID NO: 76414 - protein, 35 aa, Artificial Sequence
  Description of Artificial Sequence: Synthetic polypeptide
AEEEIRTTNPVATEQYGSVSTSNLQQQNGNGNQGG

SEQ ID NO: 76415 - protein, 34 aa, Artificial Sequence
  Description of Artificial Sequence: Synthetic polypeptide
AEEEIRTTNPVATEQYGSVSTSNNENQQTGNNNN

SEQ ID NO: 76416 - protein, 33 aa, Artificial Sequence
  Description of Artificial Sequence: Synthetic polypeptide
DEEEIRTTNPVATEQYGCVCSMTNPHQNGSEQS

SEQ ID NO: 76417 - protein, 33 aa, Artificial Sequence
  Description of Artificial Sequence: Synthetic polypeptide
TNEEIRTTNPVATEQYGCVSTGNLGADSGNVNR

SEQ ID NO: 76418 - protein, 31 aa, Artificial Sequence
  Description of Artificial Sequence: Synthetic polypeptide
DEMEIRTTNPVATEQYGSVCSVTDLETNPQE

SEQ ID NO: 76419 - protein, 33 aa, Artificial Sequence
  Description of Artificial Sequence: Synthetic polypeptide
DEEEIRTTNPVATEQYGCVCSMTPLQNFGSDQP

SEQ ID NO: 76420 - protein, 30 aa, Artificial Sequence
  Description of Artificial Sequence: Synthetic polypeptide
DEETIRTTNPVATEQWGAVETESLTLGVND

SEQ ID NO: 76421 - protein, 31 aa, Artificial Sequence
  Description of Artificial Sequence: Synthetic polypeptide
DEETIRTTNPVATEQWGAVCEVENLQLGVNA

SEQ ID NO: 76422 - protein, 33 aa, Artificial Sequence
  Description of Artificial Sequence: Synthetic polypeptide
AEEEIRTTNPVATEQYGSVSTSLQQQNEGEAGN

SEQ ID NO: 76423 - protein, 31 aa, Artificial Sequence
  Description of Artificial Sequence: Synthetic polypeptide
SEEEIRTTNPVATESYGSVANTNLAAPGDQH

SEQ ID NO: 76424 - protein, 32 aa, Artificial Sequence
  Description of Artificial Sequence: Synthetic polypeptide
SEEEIRTTNPVATESYGSVAATNLARPGDDQD

SEQ ID NO: 76425 - protein, 29 aa, Artificial Sequence
  Description of Artificial Sequence: Synthetic peptide
AEEEIASVNPVCTEQYGVVSMNLQSGNEQ

SEQ ID NO: 76426 - protein, 33 aa, Artificial Sequence
  Description of Artificial Sequence: Synthetic polypeptide
SEEEIRTTNPVATESYGSCSNTNLHWRGSDQRD

SEQ ID NO: 76427 - protein, 31 aa, Artificial Sequence
  Description of Artificial Sequence: Synthetic polypeptide
TEVEIATTNPVAYDQYGVVSCTALSQRGNNR

SEQ ID NO: 76428 - protein, 32 aa, Artificial Sequence
  Description of Artificial Sequence: Synthetic polypeptide
SEEEIRTTNPVATESYGSCSNTNLHRQGDQTD

SEQ ID NO: 76429 - protein, 32 aa, Artificial Sequence
  Description of Artificial Sequence: Synthetic polypeptide
DEETIRTTNPVATEFYGQVSVSINGQGGGDND

SEQ ID NO: 76430 - protein, 32 aa, Artificial Sequence
  Description of Artificial Sequence: Synthetic polypeptide
SEEEIRTTNPVATESYGSCSNTNLHRNSDQND

SEQ ID NO: 76431 - protein, 35 aa, Artificial Sequence
  Description of Artificial Sequence: Synthetic polypeptide
TEWEIRTTNPVATEQYGETVSCTNLSQREGGNERA

SEQ ID NO: 76432 - protein, 29 aa, Artificial Sequence
  Description of Artificial Sequence: Synthetic peptide
AEEEIASVNPVCTEQYGVVSGDNLQSGNQ

SEQ ID NO: 76433 - protein, 34 aa, Artificial Sequence
  Description of Artificial Sequence: Synthetic polypeptide
AEEEIRTTNPVATEQYGSVSTSNNGDNQQGTNVA

SEQ ID NO: 76434 - protein, 31 aa, Artificial Sequence
  Description of Artificial Sequence: Synthetic polypeptide
DEETIRTTNPVAGEQYGVVSTIEVQRNVNNN

SEQ ID NO: 76435 - protein, 31 aa, Artificial Sequence
  Description of Artificial Sequence: Synthetic polypeptide
DEETIRGTNPVATEQYGSVSINNGQGGGGEE

SEQ ID NO: 76436 - protein, 31 aa, Artificial Sequence
  Description of Artificial Sequence: Synthetic polypeptide
DEETIRATNPVATEQYGVVVSINGQGGGGNE

SEQ ID NO: 76437 - protein, 32 aa, Artificial Sequence
  Description of Artificial Sequence: Synthetic polypeptide
DEETIRATNPVATEQYGSVVSINNGQGGGGND

SEQ ID NO: 76438 - protein, 29 aa, Artificial Sequence
  Description of Artificial Sequence: Synthetic peptide
TGEEIATTNPVAYEQWGSVTKTDDQRGTR

SEQ ID NO: 76439 - protein, 31 aa, Artificial Sequence
  Description of Artificial Sequence: Synthetic polypeptide
TGEEIATTNPVAYEQWGSVTSTLLQREGTQR

SEQ ID NO: 76440 - protein, 29 aa, Artificial Sequence
  Description of Artificial Sequence: Synthetic peptide
AEEEIASVNPVCTEQYGVVSDNLQQSGNQ

SEQ ID NO: 76441 - protein, 29 aa, Artificial Sequence
  Description of Artificial Sequence: Synthetic peptide
AEEEIASVNPVCTEQYGVVSDFNLQSGNQ

SEQ ID NO: 76442 - protein, 34 aa, Artificial Sequence
  Description of Artificial Sequence: Synthetic polypeptide
DEETIRATNPVATEQYGSVSTVNQELQQGNNQLG

SEQ ID NO: 76443 - protein, 30 aa, Artificial Sequence
  Description of Artificial Sequence: Synthetic polypeptide
DEAEIACTNPVAYEPYGSVATNLQAGPQNN

SEQ ID NO: 76444 - protein, 33 aa, Artificial Sequence
  Description of Artificial Sequence: Synthetic polypeptide
DEAEIATTNPVATEQYGSVCAMANDGLTRGDNR

SEQ ID NO: 76445 - protein, 32 aa, Artificial Sequence
  Description of Artificial Sequence: Synthetic polypeptide
TNEEIRTTNPVATEQWGCVSTTNLADSGNTNR

SEQ ID NO: 76446 - protein, 32 aa, Artificial Sequence
  Description of Artificial Sequence: Synthetic polypeptide
TNEEIRTTNPVATEQYGCVSGGNLADSGNGNR

SEQ ID NO: 76447 - protein, 33 aa, Artificial Sequence
  Description of Artificial Sequence: Synthetic polypeptide
DEMEIRTTNPVATEQYGSVCSTWVNLEERSEQI

SEQ ID NO: 76448 - protein, 31 aa, Artificial Sequence
  Description of Artificial Sequence: Synthetic polypeptide
DEETIRGTNPVATEQYGSVVGINGQGGGGNE

SEQ ID NO: 76449 - protein, 34 aa, Artificial Sequence
  Description of Artificial Sequence: Synthetic polypeptide
AEEEIRTTNPVATEQYGSVSTSNNGNQQGNNQVE

SEQ ID NO: 76450 - protein, 35 aa, Artificial Sequence
  Description of Artificial Sequence: Synthetic polypeptide
AEEEIRTTNPVATEQYGSVSTSNNLNQQGNGNIGV

SEQ ID NO: 76451 - protein, 31 aa, Artificial Sequence
  Description of Artificial Sequence: Synthetic polypeptide
DDEEISTTNPVATCQYGCVSTGNPTERGSNQ

SEQ ID NO: 76452 - protein, 33 aa, Artificial Sequence
  Description of Artificial Sequence: Synthetic polypeptide
DEEEIRTTNPVATEQYGCVSNTNHNQYFGSDFS

SEQ ID NO: 76453 - protein, 32 aa, Artificial Sequence
  Description of Artificial Sequence: Synthetic polypeptide
DEETICTTNPVATECYGSVNTNNMGQRGQNMN

SEQ ID NO: 76454 - protein, 32 aa, Artificial Sequence
  Description of Artificial Sequence: Synthetic polypeptide
DEETICTTNPVATECYGSVNTNNMGQRGGNGG

SEQ ID NO: 76455 - protein, 35 aa, Artificial Sequence
  Description of Artificial Sequence: Synthetic polypeptide
AEEEIRTTNPVATEQYGSVSTSNNLQQQGNGNEGG

SEQ ID NO: 76456 - protein, 31 aa, Artificial Sequence
  Description of Artificial Sequence: Synthetic polypeptide
DEEEIRTTNPFATEAYGSVSYNIFPSWGNDP

SEQ ID NO: 76457 - protein, 32 aa, Artificial Sequence
  Description of Artificial Sequence: Synthetic polypeptide
DEETICTTNPVATECYGSVNTNNMGQRGFNTM

SEQ ID NO: 76458 - protein, 34 aa, Artificial Sequence
  Description of Artificial Sequence: Synthetic polypeptide
AEEEIRTTNPVATEQYGSVSTSNNLQQQGTGQIG

SEQ ID NO: 76459 - protein, 30 aa, Artificial Sequence
  Description of Artificial Sequence: Synthetic polypeptide
TQEEIRTTNPVAYEQWGTTVVTNLSQNGNS

SEQ ID NO: 76460 - protein, 33 aa, Artificial Sequence
  Description of Artificial Sequence: Synthetic polypeptide
DEMEIRTTNPVATEQYGSVNTLNLNQEGEDEKN

SEQ ID NO: 76461 - protein, 32 aa, Artificial Sequence
  Description of Artificial Sequence: Synthetic polypeptide
DEETICTTNPVATECYGSVNDTNNMGQRGNIM

SEQ ID NO: 76462 - protein, 31 aa, Artificial Sequence
  Description of Artificial Sequence: Synthetic polypeptide
DEETIATTNPVATETYGMVTTLLQRGSTTRI

SEQ ID NO: 76463 - protein, 32 aa, Artificial Sequence
  Description of Artificial Sequence: Synthetic polypeptide
DEETEIATTNPVAYESWGSVSTNLQSGGDNDH

SEQ ID NO: 76464 - protein, 33 aa, Artificial Sequence
  Description of Artificial Sequence: Synthetic polypeptide
TQSEIRTTNPVATEQYGSTVSSGNLSQPVVGNR

SEQ ID NO: 76465 - protein, 35 aa, Artificial Sequence
  Description of Artificial Sequence: Synthetic polypeptide
AEEEIRTTNPVATEQYGSVSTSNNLQQQGEGNIGN

SEQ ID NO: 76466 - protein, 32 aa, Artificial Sequence
  Description of Artificial Sequence: Synthetic polypeptide
DEETEIATTNPVAYEQWGTVSTNLQGDAGNDA

SEQ ID NO: 76467 - protein, 32 aa, Artificial Sequence
  Description of Artificial Sequence: Synthetic polypeptide
TSEEIASTNPVAYEQYGSTVSTNLQARNGGSR

SEQ ID NO: 76468 - protein, 34 aa, Artificial Sequence
  Description of Artificial Sequence: Synthetic polypeptide
DEETEIATTNPVAYEQWGSVSTTNLQDGPNEGRE

SEQ ID NO: 76469 - protein, 31 aa, Artificial Sequence
  Description of Artificial Sequence: Synthetic polypeptide
DEEEIRTTNPEATQQYGEVCTIDTGQRGMNF

SEQ ID NO: 76470 - protein, 32 aa, Artificial Sequence
  Description of Artificial Sequence: Synthetic polypeptide
DEMEIRTTNPVATEQYGSVNTNDENGRENNEP

SEQ ID NO: 76471 - protein, 32 aa, Artificial Sequence
  Description of Artificial Sequence: Synthetic polypeptide
DEAEIATTNPVATEQYGSVCATNLARDGDTGA

SEQ ID NO: 76472 - protein, 31 aa, Artificial Sequence
  Description of Artificial Sequence: Synthetic polypeptide
DEAEIACTNPVATEQYGSVATPNLTQREEAM

SEQ ID NO: 76473 - protein, 31 aa, Artificial Sequence
  Description of Artificial Sequence: Synthetic polypeptide
TSEEIRCTNPVAYEQYGSTVSVNLQNTGGTR

SEQ ID NO: 76474 - protein, 31 aa, Artificial Sequence
  Description of Artificial Sequence: Synthetic polypeptide
DEEEIRTTNPEATQQYGEVCTIDQGQREGNF

SEQ ID NO: 76475 - protein, 33 aa, Artificial Sequence
  Description of Artificial Sequence: Synthetic polypeptide
DEEEIRTTNPVATEQYGCVCSMTEHQRFNSETQ

SEQ ID NO: 76476 - protein, 33 aa, Artificial Sequence
  Description of Artificial Sequence: Synthetic polypeptide
DEETEIATTNPVAYEKWGSVSTNLQGNMGDNER

SEQ ID NO: 76477 - protein, 32 aa, Artificial Sequence
  Description of Artificial Sequence: Synthetic polypeptide
DEEEIRTTNPVATEQYGCVSNWNHQNFGSEQG

SEQ ID NO: 76478 - protein, 32 aa, Artificial Sequence
  Description of Artificial Sequence: Synthetic polypeptide
DEEEIRTTNPVATEQYGCVSPLLMDRTEGSEI

SEQ ID NO: 76479 - protein, 31 aa, Artificial Sequence
  Description of Artificial Sequence: Synthetic polypeptide
DEMEIRTTNPVATEQYGSVNVPNLQEVQDTN

SEQ ID NO: 76480 - protein, 30 aa, Artificial Sequence
  Description of Artificial Sequence: Synthetic polypeptide
DEEEIRTTNPEATRQYGCVPNIDLQRGETF

SEQ ID NO: 76481 - protein, 31 aa, Artificial Sequence
  Description of Artificial Sequence: Synthetic polypeptide
TEVEIATTNPVAYDQYGCVSCTALQRGGSNR

SEQ ID NO: 76482 - protein, 32 aa, Artificial Sequence
  Description of Artificial Sequence: Synthetic polypeptide
DEAEIATTNPVATEQYGSVCAPMNDGLTRDNR

SEQ ID NO: 76483 - protein, 33 aa, Artificial Sequence
  Description of Artificial Sequence: Synthetic polypeptide
TQEEIRTTNPVATHQYGSVSYTNEVSQNGGNNR

SEQ ID NO: 76484 - protein, 34 aa, Artificial Sequence
  Description of Artificial Sequence: Synthetic polypeptide
SEEEIRTTNPVATEQYGSVYSWTYPLESGGENRD

SEQ ID NO: 76485 - protein, 33 aa, Artificial Sequence
  Description of Artificial Sequence: Synthetic polypeptide
DEEEIRTTNPVATEQYGVVSTMTNFGQGEGGQQ

SEQ ID NO: 76486 - protein, 34 aa, Artificial Sequence
  Description of Artificial Sequence: Synthetic polypeptide
DEEEIRTTNPVATEQYGVVSTMTNFGQEEGGENQ

SEQ ID NO: 76487 - protein, 34 aa, Artificial Sequence
  Description of Artificial Sequence: Synthetic polypeptide
DEEEIRTTNPVATEQYGVVSTMNTGQTGGGNEGI

SEQ ID NO: 76488 - protein, 35 aa, Artificial Sequence
  Description of Artificial Sequence: Synthetic polypeptide
DEEEIRTTNPVATEQYGVVSTMNTGLQGGGGNEEI

SEQ ID NO: 76489 - protein, 34 aa, Artificial Sequence
  Description of Artificial Sequence: Synthetic polypeptide
DEEEIRTTNPVATEQYGCVSNSGNLNQRFVSNIA

SEQ ID NO: 76490 - protein, 34 aa, Artificial Sequence
  Description of Artificial Sequence: Synthetic polypeptide
DEEEIRTTNPVATEQYGVVSTMNTGLEGGGDNDE

SEQ ID NO: 76491 - protein, 31 aa, Artificial Sequence
  Description of Artificial Sequence: Synthetic polypeptide
DDEEISTTNPVATCQYGCVSTNDPIRFGSNQ

SEQ ID NO: 76492 - protein, 33 aa, Artificial Sequence
  Description of Artificial Sequence: Synthetic polypeptide
DEETIRATNPVATEQYGSVSTMNNQQLGNNNLD

SEQ ID NO: 76493 - protein, 33 aa, Artificial Sequence
  Description of Artificial Sequence: Synthetic polypeptide
SEEEIRTTNPVATEQYGSVWYSTQLGETQEDNE

SEQ ID NO: 76494 - protein, 31 aa, Artificial Sequence
  Description of Artificial Sequence: Synthetic polypeptide
TNEEISTTNPVATTQYGSVSTNPMGNQGNDR

SEQ ID NO: 76495 - protein, 33 aa, Artificial Sequence
  Description of Artificial Sequence: Synthetic polypeptide
DEEEIRTTNPVATEQYGCVSNTEDQENFGSNQT

SEQ ID NO: 76496 - protein, 34 aa, Artificial Sequence
  Description of Artificial Sequence: Synthetic polypeptide
DEEEIRTTNPVATEQYGCVCSMTGELQFGSNTQS

SEQ ID NO: 76497 - protein, 35 aa, Artificial Sequence
  Description of Artificial Sequence: Synthetic polypeptide
AEEEIRTTNPVATEQYGSVSTSNNLQQGSNVQETE

SEQ ID NO: 76498 - protein, 35 aa, Artificial Sequence
  Description of Artificial Sequence: Synthetic polypeptide
AEEEIRTTNPVATEQYGSVSTSNNLQLQNGNGNIG

SEQ ID NO: 76499 - protein, 31 aa, Artificial Sequence
  Description of Artificial Sequence: Synthetic polypeptide
DDEEISTTNPVATCQYGSVSTGNPANFGSNQ

SEQ ID NO: 76500 - protein, 31 aa, Artificial Sequence
  Description of Artificial Sequence: Synthetic polypeptide
DDEEISTTNPVATCQYGSVSTNPIHFGSNQS

SEQ ID NO: 76501 - protein, 30 aa, Artificial Sequence
  Description of Artificial Sequence: Synthetic polypeptide
DDEEISTTNPVATCQYGSVSTNPINFGSQQ

SEQ ID NO: 76502 - protein, 35 aa, Artificial Sequence
  Description of Artificial Sequence: Synthetic polypeptide
AEEEIRTTNPVATEQYGSVSTSNNLQQGDEGNNND

SEQ ID NO: 76503 - protein, 30 aa, Artificial Sequence
  Description of Artificial Sequence: Synthetic polypeptide
TQEEIATTNPVAYEQYGSVPSLNLQFGGSE

SEQ ID NO: 76504 - protein, 32 aa, Artificial Sequence
  Description of Artificial Sequence: Synthetic polypeptide
DEMEIRTTNPVATEQYGSVMTTTLESGTENQG

SEQ ID NO: 76505 - protein, 31 aa, Artificial Sequence
  Description of Artificial Sequence: Synthetic polypeptide
DEMEIRTTNPVATEQYGSVNCPNEQEVEDNQ

SEQ ID NO: 76506 - protein, 32 aa, Artificial Sequence
  Description of Artificial Sequence: Synthetic polypeptide
DEEEIRTTNPVATEQYGCVSNTELENFNSEQA

SEQ ID NO: 76507 - protein, 31 aa, Artificial Sequence
  Description of Artificial Sequence: Synthetic polypeptide
SEEEIRTTNPVATEQYGSVWPTDLELDSVRM

SEQ ID NO: 76508 - protein, 33 aa, Artificial Sequence
  Description of Artificial Sequence: Synthetic polypeptide
DEEEIRTTNPVATEQYGCVSNTELQNFGSETQS

SEQ ID NO: 76509 - protein, 34 aa, Artificial Sequence
  Description of Artificial Sequence: Synthetic polypeptide
DEMEIRTTNPVATEQYGSVNSTNIGVERSNNNRG

SEQ ID NO: 76510 - protein, 32 aa, Artificial Sequence
  Description of Artificial Sequence: Synthetic polypeptide
DEEEIRTTNPVATEQYGCVSNTGEHQNGSEQF

SEQ ID NO: 76511 - protein, 32 aa, Artificial Sequence
  Description of Artificial Sequence: Synthetic polypeptide
DEETICTTNPVATEFYGSVNTNTGQTRGGGNI

SEQ ID NO: 76512 - protein, 32 aa, Artificial Sequence
  Description of Artificial Sequence: Synthetic polypeptide
DEEEIRTTNPVATEQYGCVSNTEDQYFGSEQT

SEQ ID NO: 76513 - protein, 32 aa, Artificial Sequence
  Description of Artificial Sequence: Synthetic polypeptide
DEEEIRTTNPEATQQYGEVCTIDLQDREGNTF

SEQ ID NO: 76514 - protein, 31 aa, Artificial Sequence
  Description of Artificial Sequence: Synthetic polypeptide
DEETIRTTNPVATEQWGAVEVENLQLGVNED

SEQ ID NO: 76515 - protein, 31 aa, Artificial Sequence
  Description of Artificial Sequence: Synthetic polypeptide
DEETIRTTNPVATEQWGAVEVENLQLVGVNV

SEQ ID NO: 76516 - protein, 33 aa, Artificial Sequence
  Description of Artificial Sequence: Synthetic polypeptide
DEETIRTTNPVATEQYGSVSLTVTELMFQGNTN

SEQ ID NO: 76517 - protein, 33 aa, Artificial Sequence
  Description of Artificial Sequence: Synthetic polypeptide
SEEEIRTTNPVATESYGSVSNTNNDHERNGDQR

SEQ ID NO: 76518 - protein, 32 aa, Artificial Sequence
  Description of Artificial Sequence: Synthetic polypeptide
DEEEIRTTNPVATEQYGCVDSTEEHQYFNSNQ

SEQ ID NO: 76519 - protein, 33 aa, Artificial Sequence
  Description of Artificial Sequence: Synthetic polypeptide
DEEEIRTTNPVATEQYGCVDSTEHQNFGSDNQP

SEQ ID NO: 76520 - protein, 32 aa, Artificial Sequence
  Description of Artificial Sequence: Synthetic polypeptide
SEEEIRTTNPVATESYGSVSNTNLVGEGGQGE

SEQ ID NO: 76521 - protein, 33 aa, Artificial Sequence
  Description of Artificial Sequence: Synthetic polypeptide
DEEEIRTTNPVATEQYGCVDSTELQNFNSNNQS

SEQ ID NO: 76522 - protein, 34 aa, Artificial Sequence
  Description of Artificial Sequence: Synthetic polypeptide
DEEEIRTTNPIATEQYGSVSSTPALPNMRGMNPV

SEQ ID NO: 76523 - protein, 34 aa, Artificial Sequence
  Description of Artificial Sequence: Synthetic polypeptide
DEEEIRTTNPIATEQYGSVSSTPALPMMRGMNPV

SEQ ID NO: 76524 - protein, 31 aa, Artificial Sequence
  Description of Artificial Sequence: Synthetic polypeptide
DAEEIACTNPVATEQYGCVATNLQARPGQSQ

SEQ ID NO: 76525 - protein, 34 aa, Artificial Sequence
  Description of Artificial Sequence: Synthetic polypeptide
AEEEIRTTNPVATEQYGSVSTNTNNNNQDTGNSE

SEQ ID NO: 76526 - protein, 34 aa, Artificial Sequence
  Description of Artificial Sequence: Synthetic polypeptide
DEEEIRTTNPIATEQYGSVCSYNIDGDRDGQNDR

SEQ ID NO: 76527 - protein, 33 aa, Artificial Sequence
  Description of Artificial Sequence: Synthetic polypeptide
SEEEIRTTNPVATESYGSVSNTNLTRGGDDQDD

SEQ ID NO: 76528 - protein, 33 aa, Artificial Sequence
  Description of Artificial Sequence: Synthetic polypeptide
DEEEIRTTNPVATEQYGCVGNTGNLIERFGSEQ

SEQ ID NO: 76529 - protein, 32 aa, Artificial Sequence
  Description of Artificial Sequence: Synthetic polypeptide
DEAEIATTNPVATEQYGSVCAAMNQGLTRGND

SEQ ID NO: 76530 - protein, 31 aa, Artificial Sequence
  Description of Artificial Sequence: Synthetic polypeptide
DEMEIRTTNPVATEQYGSSSGNIDQDELDNE

SEQ ID NO: 76531 - protein, 35 aa, Artificial Sequence
  Description of Artificial Sequence: Synthetic polypeptide
AEEEIRTTNPVATEQYGSVSTNTNQLGNNQQGNAN

SEQ ID NO: 76532 - protein, 32 aa, Artificial Sequence
  Description of Artificial Sequence: Synthetic polypeptide
DEEEIRTTNPVATEQYGCVCSNSELQHFNSNQ

SEQ ID NO: 76533 - protein, 34 aa, Artificial Sequence
  Description of Artificial Sequence: Synthetic polypeptide
DEEEIRTTNPVATEWYGTTPSMTENLSQRIGERT

SEQ ID NO: 76534 - protein, 34 aa, Artificial Sequence
  Description of Artificial Sequence: Synthetic polypeptide
AEEEIRTTNPVATEQYGSVSTNTNQQQNGNQEND

SEQ ID NO: 76535 - protein, 33 aa, Artificial Sequence
  Description of Artificial Sequence: Synthetic polypeptide
AEEEIRTTNPVATEQYGSVSTNTNQQQTEGEIS

SEQ ID NO: 76536 - protein, 34 aa, Artificial Sequence
  Description of Artificial Sequence: Synthetic polypeptide
DEMEIRTTNPVATEQYGSTSMTENNLSHRIGNQE

SEQ ID NO: 76537 - protein, 33 aa, Artificial Sequence
  Description of Artificial Sequence: Synthetic polypeptide
DEEEIRTTNPVATEQYGCVHWHPTTLDRNGSLR

SEQ ID NO: 76538 - protein, 32 aa, Artificial Sequence
  Description of Artificial Sequence: Synthetic polypeptide
DEETIRTTNPVATEQYGSVSEVATLRQGPENT

SEQ ID NO: 76539 - protein, 32 aa, Artificial Sequence
  Description of Artificial Sequence: Synthetic polypeptide
DEMEIRTTNPVATEQYGSVCPTNDLEGGESET

SEQ ID NO: 76540 - protein, 32 aa, Artificial Sequence
  Description of Artificial Sequence: Synthetic polypeptide
DEEEIRTTNPIATEQWGSVYAVDNDQDRGNHA

SEQ ID NO: 76541 - protein, 30 aa, Artificial Sequence
  Description of Artificial Sequence: Synthetic polypeptide
TESEIACTNPVATEQYGEAPSENLQRGGGR

SEQ ID NO: 76542 - protein, 34 aa, Artificial Sequence
  Description of Artificial Sequence: Synthetic polypeptide
DEEEIRTTNPVATEQYGCVITNDILQLGSEEERQ

SEQ ID NO: 76543 - protein, 33 aa, Artificial Sequence
  Description of Artificial Sequence: Synthetic polypeptide
DEEEIRTTNPVATEQYGCVDSTEEHQNSGSNDA

SEQ ID NO: 76544 - protein, 32 aa, Artificial Sequence
  Description of Artificial Sequence: Synthetic polypeptide
DEEEIRTTNPVATEQYGCVDSTEEHQNGSDDS

SEQ ID NO: 76545 - protein, 33 aa, Artificial Sequence
  Description of Artificial Sequence: Synthetic polypeptide
DEETIRTTNPVATEQYGSVSMTVATLRQGEANT

SEQ ID NO: 76546 - protein, 33 aa, Artificial Sequence
  Description of Artificial Sequence: Synthetic polypeptide
DEEEIRTTNPIATEQYGSVSSTTPAGPNRNGNV

SEQ ID NO: 76547 - protein, 33 aa, Artificial Sequence
  Description of Artificial Sequence: Synthetic polypeptide
DEEEIRTTNPVATEQYGCVCSWNLQNFGSETQG

SEQ ID NO: 76548 - protein, 32 aa, Artificial Sequence
  Description of Artificial Sequence: Synthetic polypeptide
DAEEIASTNPVATEQYGSVSWNEDQERNGGQR

SEQ ID NO: 76549 - protein, 32 aa, Artificial Sequence
  Description of Artificial Sequence: Synthetic polypeptide
DEMEIRTTNPVATEQYGSCSTLNVQESTDEDR

SEQ ID NO: 76550 - protein, 33 aa, Artificial Sequence
  Description of Artificial Sequence: Synthetic polypeptide
DEEEIRTTNPIATEQYGTVCSATDNPVEREGND

SEQ ID NO: 76551 - protein, 31 aa, Artificial Sequence
  Description of Artificial Sequence: Synthetic polypeptide
DAEEIASTNPVATEQYGSVATNLQAAPGQMH

SEQ ID NO: 76552 - protein, 32 aa, Artificial Sequence
  Description of Artificial Sequence: Synthetic polypeptide
SEEEIRTTNPVATESYGSVSNTWNLHDGDQDD

SEQ ID NO: 76553 - protein, 32 aa, Artificial Sequence
  Description of Artificial Sequence: Synthetic polypeptide
DEEEIRTTNPVATEQYGCVCSWNPQNFGSDQF

SEQ ID NO: 76554 - protein, 32 aa, Artificial Sequence
  Description of Artificial Sequence: Synthetic polypeptide
DEEEIRTTNPVATEQYGCVCSWNPQNFGSEAQ

SEQ ID NO: 76555 - protein, 32 aa, Artificial Sequence
  Description of Artificial Sequence: Synthetic polypeptide
DEEEIRTTNPVATEVYGSVVGFGNLTEGGDND

SEQ ID NO: 76556 - protein, 33 aa, Artificial Sequence
  Description of Artificial Sequence: Synthetic polypeptide
DEETIRTTNPVATEQYGSVSTTNQELGGNNDTD

SEQ ID NO: 76557 - protein, 32 aa, Artificial Sequence
  Description of Artificial Sequence: Synthetic polypeptide
SEEEIRTTNPVATESYGSVSNTPNGNHDGDQR

SEQ ID NO: 76558 - protein, 33 aa, Artificial Sequence
  Description of Artificial Sequence: Synthetic polypeptide
DEEEIRTTNPVATEQYGCVCSWPHQNFGSNNRS

SEQ ID NO: 76559 - protein, 32 aa, Artificial Sequence
  Description of Artificial Sequence: Synthetic polypeptide
DEEEIRTTNPVATEQYGCVCSWPLQNFGSEAM

SEQ ID NO: 76560 - protein, 33 aa, Artificial Sequence
  Description of Artificial Sequence: Synthetic polypeptide
DEEEIRTTNPVATEYYGCVCSTEDLQRFGSEQS

SEQ ID NO: 76561 - protein, 32 aa, Artificial Sequence
  Description of Artificial Sequence: Synthetic polypeptide
DEEEIRTTNPVATEWYGDVVNTTNLAPGQMNV

SEQ ID NO: 76562 - protein, 32 aa, Artificial Sequence
  Description of Artificial Sequence: Synthetic polypeptide
DEMEIRTTNPVATEQYGSCSTNNLETGGGQEM

SEQ ID NO: 76563 - protein, 35 aa, Artificial Sequence
  Description of Artificial Sequence: Synthetic polypeptide
DEETIRTTNPVATEQYGSVSTTNNLQGNNGNNEQD

SEQ ID NO: 76564 - protein, 34 aa, Artificial Sequence
  Description of Artificial Sequence: Synthetic polypeptide
DEETIRTTNPVATEQYGSVSTTNNLNDNLGQNTE

SEQ ID NO: 76565 - protein, 33 aa, Artificial Sequence
  Description of Artificial Sequence: Synthetic polypeptide
DEEEIRTTNPVATEWYGSVQNTVNLQAGSYVPY

SEQ ID NO: 76566 - protein, 32 aa, Artificial Sequence
  Description of Artificial Sequence: Synthetic polypeptide
DEEEIRTTNPVATEQYGCVCSYELQGFNSNQN

SEQ ID NO: 76567 - protein, 32 aa, Artificial Sequence
  Description of Artificial Sequence: Synthetic polypeptide
DAEEIACTNPVATEQYGSVSWNENQERNGQDR

SEQ ID NO: 76568 - protein, 34 aa, Artificial Sequence
  Description of Artificial Sequence: Synthetic polypeptide
AEEEIRTTNPVATEQYGSVSTNTNLQQGTEVGTT

SEQ ID NO: 76569 - protein, 35 aa, Artificial Sequence
  Description of Artificial Sequence: Synthetic polypeptide
DEEEIRTTNPVATEQYGVVSTNTNNLQNQAGTNQD

SEQ ID NO: 76570 - protein, 33 aa, Artificial Sequence
  Description of Artificial Sequence: Synthetic polypeptide
DDEEIRTTNPVATEQYGYIVGSANDLQQGDNVV

SEQ ID NO: 76571 - protein, 33 aa, Artificial Sequence
  Description of Artificial Sequence: Synthetic polypeptide
DEEEIRTTNPVATEQYGVVSTNTGMGQGNFNIG

SEQ ID NO: 76572 - protein, 31 aa, Artificial Sequence
  Description of Artificial Sequence: Synthetic polypeptide
DEMEIRTTNPVATEQYGSICSQVYIQGEGLR

SEQ ID NO: 76573 - protein, 31 aa, Artificial Sequence
  Description of Artificial Sequence: Synthetic polypeptide
DDEEIRTTNPVATWQYGSVSTVGVQNGETQV

SEQ ID NO: 76574 - protein, 33 aa, Artificial Sequence
  Description of Artificial Sequence: Synthetic polypeptide
DEEEIRTTNPVATEQYGCVDSNTELQGFGSDQS

SEQ ID NO: 76575 - protein, 33 aa, Artificial Sequence
  Description of Artificial Sequence: Synthetic polypeptide
DEEEIRTTNPVATEQYGCVCSWPLQNFGSNFQS

SEQ ID NO: 76576 - protein, 33 aa, Artificial Sequence
  Description of Artificial Sequence: Synthetic polypeptide
DEETIRTTNPVATEQYGQYSVSINGGQGGGDND

SEQ ID NO: 76577 - protein, 31 aa, Artificial Sequence
  Description of Artificial Sequence: Synthetic polypeptide
TESEIATTNPVAYEQYGSVSTPNLSMYGGNT

SEQ ID NO: 76578 - protein, 32 aa, Artificial Sequence
  Description of Artificial Sequence: Synthetic polypeptide
DEETIRTTNPVATEQYGQYSVNIMNGQGGDND

SEQ ID NO: 76579 - protein, 32 aa, Artificial Sequence
  Description of Artificial Sequence: Synthetic polypeptide
DEEEIRTTNPVATEQYGCVQSTEHQNFNSQQS

SEQ ID NO: 76580 - protein, 30 aa, Artificial Sequence
  Description of Artificial Sequence: Synthetic polypeptide
AEEEIATTNPVATASYGCIAANLQDRGNDR

SEQ ID NO: 76581 - protein, 34 aa, Artificial Sequence
  Description of Artificial Sequence: Synthetic polypeptide
AEEEIRTTNPVATEQYGSVSTQNNNQQIGNNNGQ

SEQ ID NO: 76582 - protein, 32 aa, Artificial Sequence
  Description of Artificial Sequence: Synthetic polypeptide
SEEEIRTTNPVATESYGSVSNNNLHDEGGDQR

SEQ ID NO: 76583 - protein, 34 aa, Artificial Sequence
  Description of Artificial Sequence: Synthetic polypeptide
AEEEIRTTNPVATEQYGSVSTQNNQNNNAGTNTD

SEQ ID NO: 76584 - protein, 34 aa, Artificial Sequence
  Description of Artificial Sequence: Synthetic polypeptide
AEEEIRTTNPVATEQYGSVSTQNNQNNQEGNNED

SEQ ID NO: 76585 - protein, 32 aa, Artificial Sequence
  Description of Artificial Sequence: Synthetic polypeptide
DEEEIRTTNPVATEYYGSVSTDTEGGNNGNEE

SEQ ID NO: 76586 - protein, 30 aa, Artificial Sequence
  Description of Artificial Sequence: Synthetic polypeptide
DAAEIATTNPVAYEQYGSVATNLQGVGEDD

SEQ ID NO: 76587 - protein, 33 aa, Artificial Sequence
  Description of Artificial Sequence: Synthetic polypeptide
TESEIRTTNPVATEQYGSVLETSNIDQRGENYQ

SEQ ID NO: 76588 - protein, 34 aa, Artificial Sequence
  Description of Artificial Sequence: Synthetic polypeptide
DEMEIRTTNPVATEQYGSVCSPTMLERIGNSQDG

SEQ ID NO: 76589 - protein, 33 aa, Artificial Sequence
  Description of Artificial Sequence: Synthetic polypeptide
DEEEIRTTNPIATEPYGSTCSCTNELSARGGNE

SEQ ID NO: 76590 - protein, 32 aa, Artificial Sequence
  Description of Artificial Sequence: Synthetic polypeptide
SEEEIRTTNPVATESYGSVDNTNLTRGGDQDG

SEQ ID NO: 76591 - protein, 33 aa, Artificial Sequence
  Description of Artificial Sequence: Synthetic polypeptide
DEETIRTTNPVATEQWGSVATTNNLQLGNNTDD

SEQ ID NO: 76592 - protein, 32 aa, Artificial Sequence
  Description of Artificial Sequence: Synthetic polypeptide
DEEEIRTTNPVATEYYGSVIITNPRFFSGNND

SEQ ID NO: 76593 - protein, 33 aa, Artificial Sequence
  Description of Artificial Sequence: Synthetic polypeptide
DEETIRTTNPVATEQWGSVATTNNLQLGGNNDA

SEQ ID NO: 76594 - protein, 28 aa, Artificial Sequence
  Description of Artificial Sequence: Synthetic peptide
AEEEIASVNPVGTEQYGVVSDNLQSGAQ

SEQ ID NO: 76595 - protein, 32 aa, Artificial Sequence
  Description of Artificial Sequence: Synthetic polypeptide
TESEIRTTNPVAYEQWGISVPSTNLSQYPGNM

SEQ ID NO: 76596 - protein, 28 aa, Artificial Sequence
  Description of Artificial Sequence: Synthetic peptide
AEEEIASVNPVCTLQYGVVSDNLQSGNQ

SEQ ID NO: 76597 - protein, 33 aa, Artificial Sequence
  Description of Artificial Sequence: Synthetic polypeptide
DEETIRTTNPVATEQWGSVATNNNLQQGVNNNQ

SEQ ID NO: 76598 - protein, 31 aa, Artificial Sequence
  Description of Artificial Sequence: Synthetic polypeptide
DEAEIACTNPVAYEQYGSVATNLQRAEMGDN

SEQ ID NO: 76599 - protein, 29 aa, Artificial Sequence
  Description of Artificial Sequence: Synthetic peptide
AEEEIASVNPVCTEQYGVVSVNLQSGNQA

SEQ ID NO: 76600 - protein, 32 aa, Artificial Sequence
  Description of Artificial Sequence: Synthetic polypeptide
DEMEIRTTNPVATEQYGSVCSTGLQMLEDKSV

SEQ ID NO: 76601 - protein, 33 aa, Artificial Sequence
  Description of Artificial Sequence: Synthetic polypeptide
DEMEIRTTNPVATEQYGSVCSTTDAGVNREGND

SEQ ID NO: 76602 - protein, 30 aa, Artificial Sequence
  Description of Artificial Sequence: Synthetic polypeptide
AEEEIASVNPVCTEQYGVVSTDNLQSGNQT

SEQ ID NO: 76603 - protein, 33 aa, Artificial Sequence
  Description of Artificial Sequence: Synthetic polypeptide
DEETIRTTNPVATEQWGAVNALTVNLQNVGVNR

SEQ ID NO: 76604 - protein, 33 aa, Artificial Sequence
  Description of Artificial Sequence: Synthetic polypeptide
DEMEIRTTNPVATEQYGSVCSTTDGGVNREGND

SEQ ID NO: 76605 - protein, 34 aa, Artificial Sequence
  Description of Artificial Sequence: Synthetic polypeptide
TESEIRTTNPVSTEQYGQSVSTNLSDRTGGNNRY

SEQ ID NO: 76606 - protein, 34 aa, Artificial Sequence
  Description of Artificial Sequence: Synthetic polypeptide
DEMEIRTTNPVATEQYGSVCSTTNLQTEGQDGEG

SEQ ID NO: 76607 - protein, 29 aa, Artificial Sequence
  Description of Artificial Sequence: Synthetic peptide
AEEEIASVNPVGTEQYGVVSDNLQSGNHY

SEQ ID NO: 76608 - protein, 30 aa, Artificial Sequence
  Description of Artificial Sequence: Synthetic polypeptide
DEEEIRTTNPIATECWGSTSEEDLARGNYI

SEQ ID NO: 76609 - protein, 32 aa, Artificial Sequence
  Description of Artificial Sequence: Synthetic polypeptide
DEEEIRTTNPVATEQYGCVQNTGNLIEYGSQQ

SEQ ID NO: 76610 - protein, 34 aa, Artificial Sequence
  Description of Artificial Sequence: Synthetic polypeptide
AEEEIRTTNPVATEQYGSVSTQNNGQIGTTTNEQ

SEQ ID NO: 76611 - protein, 33 aa, Artificial Sequence
  Description of Artificial Sequence: Synthetic polypeptide
DEETIRTTNPVATEQYGCVSTTNQQQFGNNTEQ

SEQ ID NO: 76612 - protein, 32 aa, Artificial Sequence
  Description of Artificial Sequence: Synthetic polypeptide
DEEEIRTTNPVATEYYGCVCSTELQSSGSEQS

SEQ ID NO: 76613 - protein, 30 aa, Artificial Sequence
  Description of Artificial Sequence: Synthetic polypeptide
TESEICTVNPVAYEQYGSVSTNELSTEGNH

SEQ ID NO: 76614 - protein, 31 aa, Artificial Sequence
  Description of Artificial Sequence: Synthetic polypeptide
DEMEIRTTNPVATEQYGSVCQTALINMSNAF

SEQ ID NO: 76615 - protein, 31 aa, Artificial Sequence
  Description of Artificial Sequence: Synthetic polypeptide
TESEIRCTNPIAYEQYGSVSENLSTRGGNNR

SEQ ID NO: 76616 - protein, 33 aa, Artificial Sequence
  Description of Artificial Sequence: Synthetic polypeptide
DEETIRTTNPVATEQYGCVSTTNQNQQFGNNEE

SEQ ID NO: 76617 - protein, 31 aa, Artificial Sequence
  Description of Artificial Sequence: Synthetic polypeptide
DEMEIRTTNPVATEQYGSVCQTALIRMSEQF

SEQ ID NO: 76618 - protein, 32 aa, Artificial Sequence
  Description of Artificial Sequence: Synthetic polypeptide
TESEIRSTNPVATEQYGSTVSCTNQSQETGND

SEQ ID NO: 76619 - protein, 33 aa, Artificial Sequence
  Description of Artificial Sequence: Synthetic polypeptide
DEEEIRTTNPVATEQYGCVITNLDFGNSEEEEG

SEQ ID NO: 76620 - protein, 31 aa, Artificial Sequence
  Description of Artificial Sequence: Synthetic polypeptide
DEMEIRTTNPVATEQYGSVCQTAPIRMSNQA

SEQ ID NO: 76621 - protein, 31 aa, Artificial Sequence
  Description of Artificial Sequence: Synthetic polypeptide
DEMEIRTTNPVATEQYGSVCQTTALINMSNQ

SEQ ID NO: 76622 - protein, 33 aa, Artificial Sequence
  Description of Artificial Sequence: Synthetic polypeptide
DEMEIRTTNPVATEQYGSVCSATDGPVEREGNG

SEQ ID NO: 76623 - protein, 31 aa, Artificial Sequence
  Description of Artificial Sequence: Synthetic polypeptide
DEAEIATTNPVATEQYGSVCAATPDQDRPNY

SEQ ID NO: 76624 - protein, 32 aa, Artificial Sequence
  Description of Artificial Sequence: Synthetic polypeptide
DEETIRTTNPVATEQWGVVATTNNLQLGNNDE

SEQ ID NO: 76625 - protein, 32 aa, Artificial Sequence
  Description of Artificial Sequence: Synthetic polypeptide
SEEEIRTTNPVATESYGSVSNTNLAGFGSDQQ

SEQ ID NO: 76626 - protein, 32 aa, Artificial Sequence
  Description of Artificial Sequence: Synthetic polypeptide
DEEEIRTTNPVATEYYGCVSNTELQNFGSEDS

SEQ ID NO: 76627 - protein, 32 aa, Artificial Sequence
  Description of Artificial Sequence: Synthetic polypeptide
DEAEIATTNPCATEQYGSVPTNEIDHRGNNGR

SEQ ID NO: 76628 - protein, 33 aa, Artificial Sequence
  Description of Artificial Sequence: Synthetic polypeptide
DEMEIRTTNPVATEQYGSVCSCIGPVQREGENG

SEQ ID NO: 76629 - protein, 34 aa, Artificial Sequence
  Description of Artificial Sequence: Synthetic polypeptide
DEMEIRTTNPVATEQYGSVCSCINEPQDREGENG

SEQ ID NO: 76630 - protein, 32 aa, Artificial Sequence
  Description of Artificial Sequence: Synthetic polypeptide
DEEEIRTTNPVATEQYGCVNTNLDFGDEEEEG

SEQ ID NO: 76631 - protein, 32 aa, Artificial Sequence
  Description of Artificial Sequence: Synthetic polypeptide
AEEEIATTNPVATEAYGSVVSCTNLSQKTGET

SEQ ID NO: 76632 - protein, 30 aa, Artificial Sequence
  Description of Artificial Sequence: Synthetic polypeptide
DEEEIRTTNPIATEQWGDVSEILMNRAEDR

SEQ ID NO: 76633 - protein, 33 aa, Artificial Sequence
  Description of Artificial Sequence: Synthetic polypeptide
DEEEIRTTNPVATEQYGCVCSNSEEHQRGSNQS

SEQ ID NO: 76634 - protein, 32 aa, Artificial Sequence
  Description of Artificial Sequence: Synthetic polypeptide
DEEEIRTTNPVATEYYGCVSTGELQNFGSEQS

SEQ ID NO: 76635 - protein, 32 aa, Artificial Sequence
  Description of Artificial Sequence: Synthetic polypeptide
DEETIRTTNPVATEQYGAVTMTNQQHFQGNPC

SEQ ID NO: 76636 - protein, 34 aa, Artificial Sequence
  Description of Artificial Sequence: Synthetic polypeptide
DEMEIRTTNPVATEQYGSVCSCINPPQDREGENG

SEQ ID NO: 76637 - protein, 33 aa, Artificial Sequence
  Description of Artificial Sequence: Synthetic polypeptide
DEETIRTTNPVATEQYGAVSTNQVQVFQGNPCH

SEQ ID NO: 76638 - protein, 32 aa, Artificial Sequence
  Description of Artificial Sequence: Synthetic polypeptide
DEEEIRTTNPVATEQYGCVQNTGNHIERGSEQ

SEQ ID NO: 76639 - protein, 32 aa, Artificial Sequence
  Description of Artificial Sequence: Synthetic polypeptide
DEEEIRTTNPVATEYYGCVCSTNHQNSGSDQP

SEQ ID NO: 76640 - protein, 32 aa, Artificial Sequence
  Description of Artificial Sequence: Synthetic polypeptide
DEEEIRTTNPEATQQYGEVCTIDLGQREGNTT

SEQ ID NO: 76641 - protein, 31 aa, Artificial Sequence
  Description of Artificial Sequence: Synthetic polypeptide
DEEEIRTTNPVATEQYGCVSSEHANFGSNQP

SEQ ID NO: 76642 - protein, 32 aa, Artificial Sequence
  Description of Artificial Sequence: Synthetic polypeptide
DEEEIRTTNPVATEQYGCVSSEHQEGFGSNQM

SEQ ID NO: 76643 - protein, 33 aa, Artificial Sequence
  Description of Artificial Sequence: Synthetic polypeptide
DEEEIRTTNPCAYEQYGSVSVTNIGFRGDNQDD

SEQ ID NO: 76644 - protein, 31 aa, Artificial Sequence
  Description of Artificial Sequence: Synthetic polypeptide
DEEEIRTTNPVATEQYGCVSTEPINFGSEQA

SEQ ID NO: 76645 - protein, 31 aa, Artificial Sequence
  Description of Artificial Sequence: Synthetic polypeptide
DEEEIRTTNPVATEQYGCVSTEPQENFISEQ

SEQ ID NO: 76646 - protein, 32 aa, Artificial Sequence
  Description of Artificial Sequence: Synthetic polypeptide
DEEEIRTTNPCAYEQYGSVPSCYNISGRGGND

SEQ ID NO: 76647 - protein, 32 aa, Artificial Sequence
  Description of Artificial Sequence: Synthetic polypeptide
DEEEIRTTNPCAYEQYGSVPSCQNISFRGGNT

SEQ ID NO: 76648 - protein, 31 aa, Artificial Sequence
  Description of Artificial Sequence: Synthetic polypeptide
DEEEIRTTNPCAYEQYGSVPCTHLSVRGGME

SEQ ID NO: 76649 - protein, 33 aa, Artificial Sequence
  Description of Artificial Sequence: Synthetic polypeptide
DEEEIRTTNPVATEQYGCVCSDTALNQNSSNQA

SEQ ID NO: 76650 - protein, 33 aa, Artificial Sequence
  Description of Artificial Sequence: Synthetic polypeptide
DEEEIRTTNPVATEQYGVVSTDTGMGQGNGNID

SEQ ID NO: 76651 - protein, 32 aa, Artificial Sequence
  Description of Artificial Sequence: Synthetic polypeptide
DAAEIATTNPVATYQYGSVSTNNGVQENGNER

SEQ ID NO: 76652 - protein, 34 aa, Artificial Sequence
  Description of Artificial Sequence: Synthetic polypeptide
AEEEIRTTNPVATEQYGSVSTSQNNGNQQGNNVE

SEQ ID NO: 76653 - protein, 32 aa, Artificial Sequence
  Description of Artificial Sequence: Synthetic polypeptide
DEEEIRTTNPVATEQYGCVSTGEDQGFNSNQM

SEQ ID NO: 76654 - protein, 34 aa, Artificial Sequence
  Description of Artificial Sequence: Synthetic polypeptide
AEEEIRTTNPVATEQYGSVSTSQNNQQEGEAGND

SEQ ID NO: 76655 - protein, 30 aa, Artificial Sequence
  Description of Artificial Sequence: Synthetic polypeptide
TTEEIRTTNPVATEQWGAVSTDGQGEEGNG

SEQ ID NO: 76656 - protein, 30 aa, Artificial Sequence
  Description of Artificial Sequence: Synthetic polypeptide
DEESIATVNPVATEPYGSVSANLGERDNNQ

SEQ ID NO: 76657 - protein, 31 aa, Artificial Sequence
  Description of Artificial Sequence: Synthetic polypeptide
TTEEIRTTNPVATEQWGAVSTNGQQEEGGNG

SEQ ID NO: 76658 - protein, 31 aa, Artificial Sequence
  Description of Artificial Sequence: Synthetic polypeptide
DEMEIRTTNPVATEQYGSVSMDNDNEGEDQV

SEQ ID NO: 76659 - protein, 31 aa, Artificial Sequence
  Description of Artificial Sequence: Synthetic polypeptide
TTEEIRTTNPVATEQWGAVSTNGQQGEEGNG

SEQ ID NO: 76660 - protein, 30 aa, Artificial Sequence
  Description of Artificial Sequence: Synthetic polypeptide
DEESIATVNPVATEPYGSVSAGNLGERDNH

SEQ ID NO: 76661 - protein, 30 aa, Artificial Sequence
  Description of Artificial Sequence: Synthetic polypeptide
DEMEIRTTNPVATEQYGSVSMDNNRESDQI

SEQ ID NO: 76662 - protein, 32 aa, Artificial Sequence
  Description of Artificial Sequence: Synthetic polypeptide
DEEEIRTTNPVATEQYGCVSTGELQNFMSDQS

SEQ ID NO: 76663 - protein, 32 aa, Artificial Sequence
  Description of Artificial Sequence: Synthetic polypeptide
DEEEIRTTNPVATEQYGCVSTGELQNFSSDQS

SEQ ID NO: 76664 - protein, 32 aa, Artificial Sequence
  Description of Artificial Sequence: Synthetic polypeptide
DEMEIRTTNPVATEQYGSVSMNIQNRSDEDYE

SEQ ID NO: 76665 - protein, 32 aa, Artificial Sequence
  Description of Artificial Sequence: Synthetic polypeptide
DEEEIRTTNPVATEQYGCVSTGEPQFFGSEQA

SEQ ID NO: 76666 - protein, 32 aa, Artificial Sequence
  Description of Artificial Sequence: Synthetic polypeptide
DAAEIATTNPVATEQYGSVSTNPLTHQDGMQN

SEQ ID NO: 76667 - protein, 31 aa, Artificial Sequence
  Description of Artificial Sequence: Synthetic polypeptide
DEAEIACTNPVATEQYGSCSTNLQAEDGEPP

SEQ ID NO: 76668 - protein, 32 aa, Artificial Sequence
  Description of Artificial Sequence: Synthetic polypeptide
DEEEIRTTNPVATEQYGCVSTGETQHFGSEQS

SEQ ID NO: 76669 - protein, 34 aa, Artificial Sequence
  Description of Artificial Sequence: Synthetic polypeptide
AEEEIRTTNPVATEQYGSVSTSTNLLESGNNNGN

SEQ ID NO: 76670 - protein, 33 aa, Artificial Sequence
  Description of Artificial Sequence: Synthetic polypeptide
DEEEIRTTNPVATEQYGCVSTEPHQNFGSNTQS

SEQ ID NO: 76671 - protein, 29 aa, Artificial Sequence
  Description of Artificial Sequence: Synthetic peptide
AEEEIACTNPVATEQYGSVATADTQAPNH

SEQ ID NO: 76672 - protein, 31 aa, Artificial Sequence
  Description of Artificial Sequence: Synthetic polypeptide
AEEEIACTNPVATEQYGSVATNDADRGNEQG

SEQ ID NO: 76673 - protein, 31 aa, Artificial Sequence
  Description of Artificial Sequence: Synthetic polypeptide
TTEEIRSTNPVATEQYGSVVGTNGLQNGTAT

SEQ ID NO: 76674 - protein, 34 aa, Artificial Sequence
  Description of Artificial Sequence: Synthetic polypeptide
AEEEIRTTNPVATEQYGSVSTSNQNQETGTNVNN

SEQ ID NO: 76675 - protein, 33 aa, Artificial Sequence
  Description of Artificial Sequence: Synthetic polypeptide
AEEEIRTTNPVATEQYGSVSTSNQNSETGVNVN

SEQ ID NO: 76676 - protein, 33 aa, Artificial Sequence
  Description of Artificial Sequence: Synthetic polypeptide
SEEEIRTTNPVATEQYGSVSTQMDNTLEGGEFS

SEQ ID NO: 76677 - protein, 33 aa, Artificial Sequence
  Description of Artificial Sequence: Synthetic polypeptide
DEESICTTNPVATEAYGSVSNTNNTLQQGNNMT

SEQ ID NO: 76678 - protein, 34 aa, Artificial Sequence
  Description of Artificial Sequence: Synthetic polypeptide
AEEEIRTTNPVATEQYGSVSTSNQQANEEGNTGG

SEQ ID NO: 76679 - protein, 31 aa, Artificial Sequence
  Description of Artificial Sequence: Synthetic polypeptide
DAAEIATTNPVAYEPYGVVASATNLQEGNRF

SEQ ID NO: 76680 - protein, 34 aa, Artificial Sequence
  Description of Artificial Sequence: Synthetic polypeptide
AEEEIRTTNPVATEQYGSVSTSNQQQGDEGTNNE

SEQ ID NO: 76681 - protein, 32 aa, Artificial Sequence
  Description of Artificial Sequence: Synthetic polypeptide
DEEEIRTTNPVATEQYGVVSTGDTGEGGGNEG

SEQ ID NO: 76682 - protein, 32 aa, Artificial Sequence
  Description of Artificial Sequence: Synthetic polypeptide
DEESICTTNPVATEAYGSVNVTNTNLQAGNME

SEQ ID NO: 76683 - protein, 29 aa, Artificial Sequence
  Description of Artificial Sequence: Synthetic peptide
DAAEIATTNPVAYEPYGVVAATNDQEGNR

SEQ ID NO: 76684 - protein, 35 aa, Artificial Sequence
  Description of Artificial Sequence: Synthetic polypeptide
DEEEIRTTNPVATEQYGVVSTFNNLIQDEQGGVNE

SEQ ID NO: 76685 - protein, 33 aa, Artificial Sequence
  Description of Artificial Sequence: Synthetic polypeptide
AEEEIRTTNPVATEQYGSVSTSNTNQQQANEED

SEQ ID NO: 76686 - protein, 33 aa, Artificial Sequence
  Description of Artificial Sequence: Synthetic polypeptide
DEAEIATTNPVATEQYGSVCSPVNLQEAGNDPE

SEQ ID NO: 76687 - protein, 32 aa, Artificial Sequence
  Description of Artificial Sequence: Synthetic polypeptide
DEEEIRTTNPVATEQYGCVSTGNDENFGSEQP

SEQ ID NO: 76688 - protein, 32 aa, Artificial Sequence
  Description of Artificial Sequence: Synthetic polypeptide
DEMEIRTTNPVATEQYGSVSDVVDPLERGSQQ

SEQ ID NO: 76689 - protein, 31 aa, Artificial Sequence
  Description of Artificial Sequence: Synthetic polypeptide
TTEEIRGTNPVATEQYGSVVSGNLQGNGGGQ

SEQ ID NO: 76690 - protein, 29 aa, Artificial Sequence
  Description of Artificial Sequence: Synthetic peptide
DEEEIRTTNPCAYMQYGQVPTDLQRDATM

SEQ ID NO: 76691 - protein, 29 aa, Artificial Sequence
  Description of Artificial Sequence: Synthetic peptide
DEEEIRTTNPCAYMQYGQVPTDLQRDAIM

SEQ ID NO: 76692 - protein, 32 aa, Artificial Sequence
  Description of Artificial Sequence: Synthetic polypeptide
DEESICTTNPVATEAYGSVNVTNTLQDEGNNM

SEQ ID NO: 76693 - protein, 30 aa, Artificial Sequence
  Description of Artificial Sequence: Synthetic polypeptide
DEEEIRTTNPCAYMQYGQVPTADLQRGGAF

SEQ ID NO: 76694 - protein, 29 aa, Artificial Sequence
  Description of Artificial Sequence: Synthetic peptide
DEEEIRTTNPCAYMQYGQVPTADLQRDAD

SEQ ID NO: 76695 - protein, 29 aa, Artificial Sequence
  Description of Artificial Sequence: Synthetic peptide
DEEEIRTTNPCAYMQYGQVPADLQRGAEF

SEQ ID NO: 76696 - protein, 31 aa, Artificial Sequence
  Description of Artificial Sequence: Synthetic polypeptide
TTEEIRSTNPVATEQYGSVVDQTNGLQNGTT

SEQ ID NO: 76697 - protein, 35 aa, Artificial Sequence
  Description of Artificial Sequence: Synthetic polypeptide
AEEEIRTTNPVATEQYGSVSTSQNLQQQGNNNEGT

SEQ ID NO: 76698 - protein, 32 aa, Artificial Sequence
  Description of Artificial Sequence: Synthetic polypeptide
DEESICTTNPVATEAYGSVNTTNTLQEGNNMD

SEQ ID NO: 76699 - protein, 31 aa, Artificial Sequence
  Description of Artificial Sequence: Synthetic polypeptide
DEESICTTNPVATEAYGSVNTNTNQQQGNMT

SEQ ID NO: 76700 - protein, 29 aa, Artificial Sequence
  Description of Artificial Sequence: Synthetic peptide
DEESIATVNPVAYEPYGSVSAGNLEMGNN

SEQ ID NO: 76701 - protein, 31 aa, Artificial Sequence
  Description of Artificial Sequence: Synthetic polypeptide
TTEEIRSTNPVATEQYGSVVGTNGLQNGGGG

SEQ ID NO: 76702 - protein, 33 aa, Artificial Sequence
  Description of Artificial Sequence: Synthetic polypeptide
DEEEIRTTNPVATEQYGCVSTENDLGAREESEE

SEQ ID NO: 76703 - protein, 35 aa, Artificial Sequence
  Description of Artificial Sequence: Synthetic polypeptide
DEEEIRTTNPVATEQYGVVSSTTPNLQMSNGMNPQ

SEQ ID NO: 76704 - protein, 32 aa, Artificial Sequence
  Description of Artificial Sequence: Synthetic polypeptide
DEESIATTNPVAYEQYGTVSTGNDLNDNGQNR

SEQ ID NO: 76705 - protein, 34 aa, Artificial Sequence
  Description of Artificial Sequence: Synthetic polypeptide
AEEEIRTTNPVATEQYGSVSTSTNLSQGTTNTTT

SEQ ID NO: 76706 - protein, 33 aa, Artificial Sequence
  Description of Artificial Sequence: Synthetic polypeptide
DEEEIRTTNPVATEQYGCVCQTEHQERFGSNQP

SEQ ID NO: 76707 - protein, 32 aa, Artificial Sequence
  Description of Artificial Sequence: Synthetic polypeptide
AEEEIRTTNPVATEQYGSVSTSTQLQQTIDTG

SEQ ID NO: 76708 - protein, 33 aa, Artificial Sequence
  Description of Artificial Sequence: Synthetic polypeptide
DAAEIATTNPVATEQYGSVSTNPLGQAEMGDMR

SEQ ID NO: 76709 - protein, 33 aa, Artificial Sequence
  Description of Artificial Sequence: Synthetic polypeptide
DAAEIATTNPVATEQYGSVSATNPLQAQMGGER

SEQ ID NO: 76710 - protein, 32 aa, Artificial Sequence
  Description of Artificial Sequence: Synthetic polypeptide
TTTEIRTTNPVATEQYGSVSTGNSQDAGNGKD

SEQ ID NO: 76711 - protein, 31 aa, Artificial Sequence
  Description of Artificial Sequence: Synthetic polypeptide
DEESIATTNPVATEQWGSVAMNNLQDDGVNA

SEQ ID NO: 76712 - protein, 31 aa, Artificial Sequence
  Description of Artificial Sequence: Synthetic polypeptide
DEESIATTNPVATEMWGSVATANELQDGNDM

SEQ ID NO: 76713 - protein, 33 aa, Artificial Sequence
  Description of Artificial Sequence: Synthetic polypeptide
DEMEIRTTNPVATEQYGSVSPDNGLERFNEDNA

SEQ ID NO: 76714 - protein, 32 aa, Artificial Sequence
  Description of Artificial Sequence: Synthetic polypeptide
DEEEIRTTNPVATEQYGCVCQTEEHQENGSND

SEQ ID NO: 76715 - protein, 32 aa, Artificial Sequence
  Description of Artificial Sequence: Synthetic polypeptide
DEEEIRTTNPVATEQYGCVSTNDHQENFMSIV

SEQ ID NO: 76716 - protein, 29 aa, Artificial Sequence
  Description of Artificial Sequence: Synthetic peptide
DEEEIRTTNPVAVEQYGSCSLALTHIEEM

SEQ ID NO: 76717 - protein, 32 aa, Artificial Sequence
  Description of Artificial Sequence: Synthetic polypeptide
DEEEIRTTNPCAYEGYGSVCSCTNLSARGGEP

SEQ ID NO: 76718 - protein, 30 aa, Artificial Sequence
  Description of Artificial Sequence: Synthetic polypeptide
VEDEIACTNPVATEQYGCASANLQAPGNRM

SEQ ID NO: 76719 - protein, 31 aa, Artificial Sequence
  Description of Artificial Sequence: Synthetic polypeptide
DEESIATTNPVATEQYGCVAATNDTQDGNNS

SEQ ID NO: 76720 - protein, 33 aa, Artificial Sequence
  Description of Artificial Sequence: Synthetic polypeptide
DEAEIATTNPVATEQYGSVSGTNPQNNMDNTRN

SEQ ID NO: 76721 - protein, 35 aa, Artificial Sequence
  Description of Artificial Sequence: Synthetic polypeptide
AEEEIRTTNPVATEQYGSVSTTANLGNQEGTNNVD

SEQ ID NO: 76722 - protein, 32 aa, Artificial Sequence
  Description of Artificial Sequence: Synthetic polypeptide
DEEEIRTTNPVATEQYGVVSNMTGMGQGNNGI

SEQ ID NO: 76723 - protein, 32 aa, Artificial Sequence
  Description of Artificial Sequence: Synthetic polypeptide
SEEEIRTTNPVATEQYGSVSTNAPQNTESQQY

SEQ ID NO: 76724 - protein, 33 aa, Artificial Sequence
  Description of Artificial Sequence: Synthetic polypeptide
AEEEIRTTNPVATEQYGSVSTTANNNEEGGNQD

SEQ ID NO: 76725 - protein, 33 aa, Artificial Sequence
  Description of Artificial Sequence: Synthetic polypeptide
AEEEIRTTNPVATEQYGSVSTTANNNVEGGNNQ

SEQ ID NO: 76726 - protein, 33 aa, Artificial Sequence
  Description of Artificial Sequence: Synthetic polypeptide
DEEEIRTTNPVATEQYGVVSNMNLVEGQGINND

SEQ ID NO: 76727 - protein, 33 aa, Artificial Sequence
  Description of Artificial Sequence: Synthetic polypeptide
AEEEIRTTNPVATEQYGSVSTTANQNDEGGNNE

SEQ ID NO: 76728 - protein, 30 aa, Artificial Sequence
  Description of Artificial Sequence: Synthetic polypeptide
DEEEIRTTNPCAYEAYGTVACTNHGRGGNF

SEQ ID NO: 76729 - protein, 31 aa, Artificial Sequence
  Description of Artificial Sequence: Synthetic polypeptide
DEEEIRTTNPCAYEAYGSVCACTNGGRGGNA

SEQ ID NO: 76730 - protein, 34 aa, Artificial Sequence
  Description of Artificial Sequence: Synthetic polypeptide
AEEEIRTTNPVATEQYGSVSTTANQNNQEGNNEQ

SEQ ID NO: 76731 - protein, 32 aa, Artificial Sequence
  Description of Artificial Sequence: Synthetic polypeptide
DEEEIRTTNPCAYEAYGSCSCTNLSARTGGNS

SEQ ID NO: 76732 - protein, 32 aa, Artificial Sequence
  Description of Artificial Sequence: Synthetic polypeptide
DEEEIRTTNPVATEQYGCVSTNHENFGSETQP

SEQ ID NO: 76733 - protein, 32 aa, Artificial Sequence
  Description of Artificial Sequence: Synthetic polypeptide
DEESIATTNPVATECYGSVYNWTNDHQEGNRM

SEQ ID NO: 76734 - protein, 34 aa, Artificial Sequence
  Description of Artificial Sequence: Synthetic polypeptide
AEEEIRTTNPVATEQYGSVSTTANLGNEQNNNIG

SEQ ID NO: 76735 - protein, 33 aa, Artificial Sequence
  Description of Artificial Sequence: Synthetic polypeptide
DEMEIRTTNPVATEQYGSVSDANDLELGQEDGN

SEQ ID NO: 76736 - protein, 34 aa, Artificial Sequence
  Description of Artificial Sequence: Synthetic polypeptide
AEEEIRTTNPVATEQYGSVSTSTNQQQTENGNIA

SEQ ID NO: 76737 - protein, 32 aa, Artificial Sequence
  Description of Artificial Sequence: Synthetic polypeptide
DEEEIRTTNPCAYEPYGSCSCTNLSARGGNNS

SEQ ID NO: 76738 - protein, 31 aa, Artificial Sequence
  Description of Artificial Sequence: Synthetic polypeptide
DEMEIRTTNPVATEQYGSVSNADLEGGSDQE

SEQ ID NO: 76739 - protein, 33 aa, Artificial Sequence
  Description of Artificial Sequence: Synthetic polypeptide
DEMEIRTTNPVATEQYGSVSNAEDNNQTGEMRQ

SEQ ID NO: 76740 - protein, 34 aa, Artificial Sequence
  Description of Artificial Sequence: Synthetic polypeptide
AEEEIRTTNPVATEQYGSVSTSTNNLGQNSTNTQ

SEQ ID NO: 76741 - protein, 33 aa, Artificial Sequence
  Description of Artificial Sequence: Synthetic polypeptide
DEMEIRTTNPVATEQYGSVSNMVSLQRGSDSQD

SEQ ID NO: 76742 - protein, 33 aa, Artificial Sequence
  Description of Artificial Sequence: Synthetic polypeptide
DAAEIATTNPVATEQYGSVSTNPLQHQGGMNNL

SEQ ID NO: 76743 - protein, 32 aa, Artificial Sequence
  Description of Artificial Sequence: Synthetic polypeptide
AEEEIACTNPVATEQYGSVAITNDQDRGNDQL

SEQ ID NO: 76744 - protein, 32 aa, Artificial Sequence
  Description of Artificial Sequence: Synthetic polypeptide
DEMEIRTTNPVATEQYGSVSNTDLEGIGSDQV

SEQ ID NO: 76745 - protein, 33 aa, Artificial Sequence
  Description of Artificial Sequence: Synthetic polypeptide
DEMEIRTTNPVATEQYGSVSNTEDNLTDGEMQI

SEQ ID NO: 76746 - protein, 32 aa, Artificial Sequence
  Description of Artificial Sequence: Synthetic polypeptide
DEEEIRTTNPVATEQYGVVSSTQGTGGNGNIQ

SEQ ID NO: 76747 - protein, 33 aa, Artificial Sequence
  Description of Artificial Sequence: Synthetic polypeptide
DEMEIRTTNPVATEQYGSVSNTEDNLTTGEEHF

SEQ ID NO: 76748 - protein, 32 aa, Artificial Sequence
  Description of Artificial Sequence: Synthetic polypeptide
DEESIATTNPVAYEPYGSVNCTNSLSQRGGNM

SEQ ID NO: 76749 - protein, 33 aa, Artificial Sequence
  Description of Artificial Sequence: Synthetic polypeptide
DAAEIATTNPVATEQYGSVSTNPLQDHQGGMRL

SEQ ID NO: 76750 - protein, 32 aa, Artificial Sequence
  Description of Artificial Sequence: Synthetic polypeptide
DEESIATTNPVAYECYGSVPNCTNELQRGNNE

SEQ ID NO: 76751 - protein, 33 aa, Artificial Sequence
  Description of Artificial Sequence: Synthetic polypeptide
DEEEIRTTNPVATEQYGCVCQTELQERFNSEQT

SEQ ID NO: 76752 - protein, 34 aa, Artificial Sequence
  Description of Artificial Sequence: Synthetic polypeptide
DEEEIRTTNPVATEQYGVVSSTNNGQIGEGENED

SEQ ID NO: 76753 - protein, 31 aa, Artificial Sequence
  Description of Artificial Sequence: Synthetic polypeptide
AEEEIACTNPVATEQYGSASSEPALQRGGPR

SEQ ID NO: 76754 - protein, 31 aa, Artificial Sequence
  Description of Artificial Sequence: Synthetic polypeptide
DEESIATTNPVAYECYGSVATNELSQVGGNM

SEQ ID NO: 76755 - protein, 30 aa, Artificial Sequence
  Description of Artificial Sequence: Synthetic polypeptide
DEAEIATTNPVATEQYGSVSAGPEQDDPNN

SEQ ID NO: 76756 - protein, 34 aa, Artificial Sequence
  Description of Artificial Sequence: Synthetic polypeptide
AEEEIRTTNPVATEQYGSVSTSTNNQLQNSTNQE

SEQ ID NO: 76757 - protein, 33 aa, Artificial Sequence
  Description of Artificial Sequence: Synthetic polypeptide
DAAEIATTNPVATEQYGSVSTNPLQAQAGGMRA

SEQ ID NO: 76758 - protein, 32 aa, Artificial Sequence
  Description of Artificial Sequence: Synthetic polypeptide
DEAEIATTNPVATEQYGSVSANHQEAEDGTNH

SEQ ID NO: 76759 - protein, 34 aa, Artificial Sequence
  Description of Artificial Sequence: Synthetic polypeptide
DEEEIRTTNPVATEQYGCVSTLDALQLGSEEERQ

SEQ ID NO: 76760 - protein, 33 aa, Artificial Sequence
  Description of Artificial Sequence: Synthetic polypeptide
AEEEIRTTNPVATEQYGSVSTSTNQQQGEGEID

SEQ ID NO: 76761 - protein, 34 aa, Artificial Sequence
  Description of Artificial Sequence: Synthetic polypeptide
AEEEIRTTNPVATEQYGSVSTSTNQQQGTEGNIA

SEQ ID NO: 76762 - protein, 30 aa, Artificial Sequence
  Description of Artificial Sequence: Synthetic polypeptide
TTEEIRTTNPVATEQWGTVVTDNGQEGGNG

SEQ ID NO: 76763 - protein, 31 aa, Artificial Sequence
  Description of Artificial Sequence: Synthetic polypeptide
DEESIATTNPVAYEAWGSTVNCTNELQRGNM

SEQ ID NO: 76764 - protein, 33 aa, Artificial Sequence
  Description of Artificial Sequence: Synthetic polypeptide
AEEEIACTNPVATEQYGEASSTTPNLPQRNGNR

SEQ ID NO: 76765 - protein, 31 aa, Artificial Sequence
  Description of Artificial Sequence: Synthetic polypeptide
DEAEIACTNPVATEQYGSCATNLQAEAENRE

SEQ ID NO: 76766 - protein, 30 aa, Artificial Sequence
  Description of Artificial Sequence: Synthetic polypeptide
TTEEIRTTNPVATEQWGTVSTDQQDEGGNG

SEQ ID NO: 76767 - protein, 30 aa, Artificial Sequence
  Description of Artificial Sequence: Synthetic polypeptide
DEEEIRTTNPDATEGYGSCSTPLARTQEDP

SEQ ID NO: 76768 - protein, 30 aa, Artificial Sequence
  Description of Artificial Sequence: Synthetic polypeptide
DEEEIRTTNPDATEGYGSCSTPLARVTQDG

SEQ ID NO: 76769 - protein, 31 aa, Artificial Sequence
  Description of Artificial Sequence: Synthetic polypeptide
DEEEIRTTNPVATEQYGCVSTEHQYFTSEQA

SEQ ID NO: 76770 - protein, 32 aa, Artificial Sequence
  Description of Artificial Sequence: Synthetic polypeptide
AEEEIACTNPVATEQYGSVATNLQGQGGDNEM

SEQ ID NO: 76771 - protein, 34 aa, Artificial Sequence
  Description of Artificial Sequence: Synthetic polypeptide
AEEEIRTTNPVATEQYGSVSTSNNNDQQGNNNVA

SEQ ID NO: 76772 - protein, 31 aa, Artificial Sequence
  Description of Artificial Sequence: Synthetic polypeptide
AEEEIACTNPVATEQYGSVATNLQGQEDNTV

SEQ ID NO: 76773 - protein, 30 aa, Artificial Sequence
  Description of Artificial Sequence: Synthetic polypeptide
TSEEIRTTNPVAYEQYGKVPSLNLQFGGSE

SEQ ID NO: 76774 - protein, 31 aa, Artificial Sequence
  Description of Artificial Sequence: Synthetic polypeptide
DEAEIACTNPVATEQYGSVATNLQPDGHTDD

SEQ ID NO: 76775 - protein, 32 aa, Artificial Sequence
  Description of Artificial Sequence: Synthetic polypeptide
TSEEIRTTNPVAYHQYGSVSTVALSQRGGNNF

SEQ ID NO: 76776 - protein, 34 aa, Artificial Sequence
  Description of Artificial Sequence: Synthetic polypeptide
SEEEIRTTNPVATEQYGSVTSTMNVPQDSGELRE

SEQ ID NO: 76777 - protein, 34 aa, Artificial Sequence
  Description of Artificial Sequence: Synthetic polypeptide
SEEEIRTTNPVATEQYGSVTPTNSLENRDETNRS

SEQ ID NO: 76778 - protein, 34 aa, Artificial Sequence
  Description of Artificial Sequence: Synthetic polypeptide
SEEEIRTTNPVATEQYGSVSWVDQQDDRQGMNKR

SEQ ID NO: 76779 - protein, 33 aa, Artificial Sequence
  Description of Artificial Sequence: Synthetic polypeptide
SEEEIRTTNPVATEQYGSVSWVDQDQRQGMNMQ

SEQ ID NO: 76780 - protein, 32 aa, Artificial Sequence
  Description of Artificial Sequence: Synthetic polypeptide
DEEEIRTTNPEATEQYGSVPPTWLEARGGIIE

SEQ ID NO: 76781 - protein, 31 aa, Artificial Sequence
  Description of Artificial Sequence: Synthetic polypeptide
AEEEIACTNPVATEQYGSVATNLQDQGQDEE

SEQ ID NO: 76782 - protein, 31 aa, Artificial Sequence
  Description of Artificial Sequence: Synthetic polypeptide
DEAEIACTNPVATEQYGSVATNLQNSNNTLH

SEQ ID NO: 76783 - protein, 31 aa, Artificial Sequence
  Description of Artificial Sequence: Synthetic polypeptide
DEESIMTTNPVATECYGSVNENTLQRFDNQM

SEQ ID NO: 76784 - protein, 31 aa, Artificial Sequence
  Description of Artificial Sequence: Synthetic polypeptide
DEAEIACTNPVATEQYGSVATNLQNSDEGEQ

SEQ ID NO: 76785 - protein, 32 aa, Artificial Sequence
  Description of Artificial Sequence: Synthetic polypeptide
DEAEIACTNPVATEQYGSVATNLQNRNNHPTP

SEQ ID NO: 76786 - protein, 34 aa, Artificial Sequence
  Description of Artificial Sequence: Synthetic polypeptide
AEEEIRTTNPVATEQYGSVSTSNNNNQQIGNNGD

SEQ ID NO: 76787 - protein, 31 aa, Artificial Sequence
  Description of Artificial Sequence: Synthetic polypeptide
DEMEIRTTNPVATEQYGSVSADNTEREVQGI

SEQ ID NO: 76788 - protein, 31 aa, Artificial Sequence
  Description of Artificial Sequence: Synthetic polypeptide
DEESIMTTNPVATECYGCVNTNTLTQEGQNM

SEQ ID NO: 76789 - protein, 31 aa, Artificial Sequence
  Description of Artificial Sequence: Synthetic polypeptide
DEAEIACTNPVATEQYGSVATNLQNINNDTL

SEQ ID NO: 76790 - protein, 31 aa, Artificial Sequence
  Description of Artificial Sequence: Synthetic polypeptide
DEESIMTTNPVATECYGCVNTNTLQRGSQME

SEQ ID NO: 76791 - protein, 31 aa, Artificial Sequence
  Description of Artificial Sequence: Synthetic polypeptide
DEAEIATTNPVATEQYGSVCSMNNDDGENDD

SEQ ID NO: 76792 - protein, 32 aa, Artificial Sequence
  Description of Artificial Sequence: Synthetic polypeptide
DEESICTTNPVATEAYGSVTNTNTLQQGVNMT

SEQ ID NO: 76793 - protein, 32 aa, Artificial Sequence
  Description of Artificial Sequence: Synthetic polypeptide
DEMEIRTTNPVATEQYGSVSAENYDQRTDSAQ

SEQ ID NO: 76794 - protein, 32 aa, Artificial Sequence
  Description of Artificial Sequence: Synthetic polypeptide
SEEEIRTTNPVATEQYGSVSVTQWGETQEDNE

SEQ ID NO: 76795 - protein, 34 aa, Artificial Sequence
  Description of Artificial Sequence: Synthetic polypeptide
DEEEIRTTNPVATEQYGCVCSDTNLQSFGSETQS

SEQ ID NO: 76796 - protein, 31 aa, Artificial Sequence
  Description of Artificial Sequence: Synthetic polypeptide
DEEEIRTTNPEATEQYGCVPTALARFGSEQA

SEQ ID NO: 76797 - protein, 34 aa, Artificial Sequence
  Description of Artificial Sequence: Synthetic polypeptide
AEEEIRTTNPVATEQYGSVSTSNNNQQIGTNEGE

SEQ ID NO: 76798 - protein, 30 aa, Artificial Sequence
  Description of Artificial Sequence: Synthetic polypeptide
DEEEIRTTNPEATEQYGSVCPTEDAHGSEQ

SEQ ID NO: 76799 - protein, 33 aa, Artificial Sequence
  Description of Artificial Sequence: Synthetic polypeptide
DEEEIRTTNPEATEQYGCVCQTNLQHFGSNTAA

SEQ ID NO: 76800 - protein, 31 aa, Artificial Sequence
  Description of Artificial Sequence: Synthetic polypeptide
AEEEIACTNPVATEQYGSVATNLQGQPDVTR

SEQ ID NO: 76801 - protein, 31 aa, Artificial Sequence
  Description of Artificial Sequence: Synthetic polypeptide
DEEEIRTTNPVATEQYGCVSSNWDEPNGEDQ

SEQ ID NO: 76802 - protein, 32 aa, Artificial Sequence
  Description of Artificial Sequence: Synthetic polypeptide
DEEEIRTTNPVATEQYGCVSSEHQHFGSENQS

SEQ ID NO: 76803 - protein, 31 aa, Artificial Sequence
  Description of Artificial Sequence: Synthetic polypeptide
DEEEIRTTNPEATLQYGSVPTIWLARGEKIE

SEQ ID NO: 76804 - protein, 33 aa, Artificial Sequence
  Description of Artificial Sequence: Synthetic polypeptide
DEESIRTTNPVATEQYGSVCNTVNSHRGANDIT

SEQ ID NO: 76805 - protein, 32 aa, Artificial Sequence
  Description of Artificial Sequence: Synthetic polypeptide
DEEEIRTTNPVATEQYGCVSSELQEFFGSDQS

SEQ ID NO: 76806 - protein, 28 aa, Artificial Sequence
  Description of Artificial Sequence: Synthetic peptide
AEEEIASVNPECTEQYGVVSDNLQSGNQ

SEQ ID NO: 76807 - protein, 28 aa, Artificial Sequence
  Description of Artificial Sequence: Synthetic peptide
AEEEIASVNPCCTEQYGVVSDNLQVGNQ

SEQ ID NO: 76808 - protein, 30 aa, Artificial Sequence
  Description of Artificial Sequence: Synthetic polypeptide
AEEEIACTNPVAYEQYGSVATNLQRNPEGE

SEQ ID NO: 76809 - protein, 30 aa, Artificial Sequence
  Description of Artificial Sequence: Synthetic polypeptide
AEEEIACTNPVAYEQYGSTTATNLQHGNDA

SEQ ID NO: 76810 - protein, 32 aa, Artificial Sequence
  Description of Artificial Sequence: Synthetic polypeptide
DEEEIRTTNPVATEQYGCVSSELQEGFGSDQS

SEQ ID NO: 76811 - protein, 29 aa, Artificial Sequence
  Description of Artificial Sequence: Synthetic peptide
AEEEIACTNPVAYEPYGSTATNLQDGNDS

SEQ ID NO: 76812 - protein, 30 aa, Artificial Sequence
  Description of Artificial Sequence: Synthetic polypeptide
DEAEIACTNPVATEQYGSVATNLTEAGDDP

SEQ ID NO: 76813 - protein, 34 aa, Artificial Sequence
  Description of Artificial Sequence: Synthetic polypeptide
DEEEIRTTNPVATEQYGCVCSMTEDLQNMGSNQS

SEQ ID NO: 76814 - protein, 34 aa, Artificial Sequence
  Description of Artificial Sequence: Synthetic polypeptide
DEEEIRTTNPVATEQYGVVSTMNLNDQLEGEGGD

SEQ ID NO: 76815 - protein, 34 aa, Artificial Sequence
  Description of Artificial Sequence: Synthetic polypeptide
SEEEIRTTNPVATEQYGSVTSTSNDPQDSGEERQ

SEQ ID NO: 76816 - protein, 28 aa, Artificial Sequence
  Description of Artificial Sequence: Synthetic peptide
AEEEIACTNPVATESYGCIAANDQRGND

SEQ ID NO: 76817 - protein, 31 aa, Artificial Sequence
  Description of Artificial Sequence: Synthetic polypeptide
AEEEIACTNPVATEQYGSVSTNLQGAEDVTG

SEQ ID NO: 76818 - protein, 33 aa, Artificial Sequence
  Description of Artificial Sequence: Synthetic polypeptide
TSEEIRTTNPVATEQYGSTVSTNLSDRVANNDM

SEQ ID NO: 76819 - protein, 31 aa, Artificial Sequence
  Description of Artificial Sequence: Synthetic polypeptide
DEEEIRTTNPEATEQYGSVPTWLEATTGFIE

SEQ ID NO: 76820 - protein, 31 aa, Artificial Sequence
  Description of Artificial Sequence: Synthetic polypeptide
AEEEIACTNPVATEQYGSVSTALPNRNGMGV

SEQ ID NO: 76821 - protein, 32 aa, Artificial Sequence
  Description of Artificial Sequence: Synthetic polypeptide
DEEEIRTTNPVATEQYGCVSSNHQENFGSEQD

SEQ ID NO: 76822 - protein, 34 aa, Artificial Sequence
  Description of Artificial Sequence: Synthetic polypeptide
DEEEIRTTNPVATEQYGVVSTMNLGQIGEGEGGD

SEQ ID NO: 76823 - protein, 31 aa, Artificial Sequence
  Description of Artificial Sequence: Synthetic polypeptide
DEEEIRTTNPEATEQYGSVPTELANSGSDQS

SEQ ID NO: 76824 - protein, 30 aa, Artificial Sequence
  Description of Artificial Sequence: Synthetic polypeptide
DEEEIRTTNPEATEQYGSVPSWLFSGEKIE

SEQ ID NO: 76825 - protein, 33 aa, Artificial Sequence
  Description of Artificial Sequence: Synthetic polypeptide
TSEEIRTTNPVATEQYGTVSCNNGLSQRVNNRC

SEQ ID NO: 76826 - protein, 31 aa, Artificial Sequence
  Description of Artificial Sequence: Synthetic polypeptide
AEEEIACTNPVATEQYGSVATNLQSMSNENY

SEQ ID NO: 76827 - protein, 32 aa, Artificial Sequence
  Description of Artificial Sequence: Synthetic polypeptide
DEESIMTTNPVATECYGSVNTNTLQTFDGNQM

SEQ ID NO: 76828 - protein, 31 aa, Artificial Sequence
  Description of Artificial Sequence: Synthetic polypeptide
AEEEIACTNPVATEQYGSVATNLQNQPESRD

SEQ ID NO: 76829 - protein, 32 aa, Artificial Sequence
  Description of Artificial Sequence: Synthetic polypeptide
AEEEIACTNPVATEQYGSVATNLQMRGDDPIS

SEQ ID NO: 76830 - protein, 35 aa, Artificial Sequence
  Description of Artificial Sequence: Synthetic polypeptide
DEEEIRTTNPVATEQYGVVSTMNLIVQQDGENEDE

SEQ ID NO: 76831 - protein, 32 aa, Artificial Sequence
  Description of Artificial Sequence: Synthetic polypeptide
DEEEIRTTNPVATEQYGDVNSGNGDGQGENND

SEQ ID NO: 76832 - protein, 35 aa, Artificial Sequence
  Description of Artificial Sequence: Synthetic polypeptide
DEEEIRTTNPVATEQYGVVSTMNGLQEFEGGNEDD

SEQ ID NO: 76833 - protein, 33 aa, Artificial Sequence
  Description of Artificial Sequence: Synthetic polypeptide
DEEEIRTTNPVATEQYGCVSTDDLQQRTIEDQI

SEQ ID NO: 76834 - protein, 33 aa, Artificial Sequence
  Description of Artificial Sequence: Synthetic polypeptide
DEEEIRTTNPVATEQYGVVSTMDGLGQGEQGEE

SEQ ID NO: 76835 - protein, 33 aa, Artificial Sequence
  Description of Artificial Sequence: Synthetic polypeptide
AEEEIRTTNPVATEQYGSVSTSNNTNLNGNEEV

SEQ ID NO: 76836 - protein, 30 aa, Artificial Sequence
  Description of Artificial Sequence: Synthetic polypeptide
DEEEIRTTNPEATDQYGQVCCDDDQRGNDS

SEQ ID NO: 76837 - protein, 32 aa, Artificial Sequence
  Description of Artificial Sequence: Synthetic polypeptide
DEEEIRTTNPVATEQYGVVSTLPTSGNEGGNA

SEQ ID NO: 76838 - protein, 32 aa, Artificial Sequence
  Description of Artificial Sequence: Synthetic polypeptide
DEEEIRTTNPVATEQYGVVSTLPTGSGNGENI

SEQ ID NO: 76839 - protein, 31 aa, Artificial Sequence
  Description of Artificial Sequence: Synthetic polypeptide
DEMEIRTTNPVATEQYGSVSCSLDLQMSEDI

SEQ ID NO: 76840 - protein, 32 aa, Artificial Sequence
  Description of Artificial Sequence: Synthetic polypeptide
DEEEIRTTNPEATCQYGCVPTGDLQRFGSNQS

SEQ ID NO: 76841 - protein, 31 aa, Artificial Sequence
  Description of Artificial Sequence: Synthetic polypeptide
DEEEIRTTNPEATCQYGCVPTELNQHFGSNF

SEQ ID NO: 76842 - protein, 31 aa, Artificial Sequence
  Description of Artificial Sequence: Synthetic polypeptide
DEEEIRTTNPEATCQYGCVPTDLQRFGSEFS

SEQ ID NO: 76843 - protein, 31 aa, Artificial Sequence
  Description of Artificial Sequence: Synthetic polypeptide
DEEEIRTTNPEATCQYGCVPTDDQRFGSNQA

SEQ ID NO: 76844 - protein, 34 aa, Artificial Sequence
  Description of Artificial Sequence: Synthetic polypeptide
DEEEIRTTNPVATEQYGCVCSDTENLQGFGSDQT

SEQ ID NO: 76845 - protein, 32 aa, Artificial Sequence
  Description of Artificial Sequence: Synthetic polypeptide
DEEEIRTTNPVATEQYGVVSTLGTSGMGNEGT

SEQ ID NO: 76846 - protein, 32 aa, Artificial Sequence
  Description of Artificial Sequence: Synthetic polypeptide
DEEEIRTTNPVATEQYGVVSTLDTSGNTGNNA

SEQ ID NO: 76847 - protein, 33 aa, Artificial Sequence
  Description of Artificial Sequence: Synthetic polypeptide
AEEEIRTTNPVATEQYGSVSTSNNQQQTTNMIV

SEQ ID NO: 76848 - protein, 32 aa, Artificial Sequence
  Description of Artificial Sequence: Synthetic polypeptide
DEEEIRTTNPVATEQYGVVSTLDISEGNGNGQ

SEQ ID NO: 76849 - protein, 32 aa, Artificial Sequence
  Description of Artificial Sequence: Synthetic polypeptide
DEEEIRTTNPVATEQYGVVSTGVGQENGGGEF

SEQ ID NO: 76850 - protein, 33 aa, Artificial Sequence
  Description of Artificial Sequence: Synthetic polypeptide
DEEEIRTTNPVATEQYGCVCSDTELNQRSSDTQ

SEQ ID NO: 76851 - protein, 30 aa, Artificial Sequence
  Description of Artificial Sequence: Synthetic polypeptide
TTEEIRGTNPVATEQYGSVVETNGQGGGGT

SEQ ID NO: 76852 - protein, 33 aa, Artificial Sequence
  Description of Artificial Sequence: Synthetic polypeptide
AEEEIRTTNPVATEQYGSVSTSNQGQQGEIATE

SEQ ID NO: 76853 - protein, 35 aa, Artificial Sequence
  Description of Artificial Sequence: Synthetic polypeptide
AEEEIRTTNPVATEQYGSVSTSNQLQQQGNNNIGE

SEQ ID NO: 76854 - protein, 34 aa, Artificial Sequence
  Description of Artificial Sequence: Synthetic polypeptide
DEEEIRTTNPVATEQYGCVCSDTELNQNRFSSNQ

SEQ ID NO: 76855 - protein, 31 aa, Artificial Sequence
  Description of Artificial Sequence: Synthetic polypeptide
DEEEIRTTNPVATEQYGCVSTEHANFGSEAA

SEQ ID NO: 76856 - protein, 33 aa, Artificial Sequence
  Description of Artificial Sequence: Synthetic polypeptide
DEEEIRTTNPVATEQYGCVSTEHNQFFGSENQY

SEQ ID NO: 76857 - protein, 33 aa, Artificial Sequence
  Description of Artificial Sequence: Synthetic polypeptide
SEEEIRTTNPVATEQYGSVSTSNLHGSGEEDIM

SEQ ID NO: 76858 - protein, 32 aa, Artificial Sequence
  Description of Artificial Sequence: Synthetic polypeptide
DEEEIRTTNPVATEQYGCVSTEHQNFGSQTQS

SEQ ID NO: 76859 - protein, 31 aa, Artificial Sequence
  Description of Artificial Sequence: Synthetic polypeptide
DEEEIRTTNPVATEQYGCVSTEHQNFISQQV

SEQ ID NO: 76860 - protein, 32 aa, Artificial Sequence
  Description of Artificial Sequence: Synthetic polypeptide
DEAEIATTNPVATEQYGSVCSPNGEERGDNQD

SEQ ID NO: 76861 - protein, 33 aa, Artificial Sequence
  Description of Artificial Sequence: Synthetic polypeptide
DEAEIATTNPVATEQYGSVCSPTDGPQRGDNAE

SEQ ID NO: 76862 - protein, 30 aa, Artificial Sequence
  Description of Artificial Sequence: Synthetic polypeptide
DEAEIACTNPVATEQYGSVATNLQAAEAAE

SEQ ID NO: 76863 - protein, 34 aa, Artificial Sequence
  Description of Artificial Sequence: Synthetic polypeptide
DEEEIRTTNPVATEQYGCVSTDDLQQRQGDEETS

SEQ ID NO: 76864 - protein, 29 aa, Artificial Sequence
  Description of Artificial Sequence: Synthetic peptide
DEEEIRTTNPEATEQWGTVPTDLAGGDEM

SEQ ID NO: 76865 - protein, 34 aa, Artificial Sequence
  Description of Artificial Sequence: Synthetic polypeptide
AEEEIRTTNPVATEQYGSVSTSNNQQQTTNGNIV

SEQ ID NO: 76866 - protein, 32 aa, Artificial Sequence
  Description of Artificial Sequence: Synthetic polypeptide
DEAEIACTNPVATEQYGSVATNLQNGNNEGEH

SEQ ID NO: 76867 - protein, 28 aa, Artificial Sequence
  Description of Artificial Sequence: Synthetic peptide
TTAEIRTTNPVATEQYGQCSTVDQEGDD

SEQ ID NO: 76868 - protein, 31 aa, Artificial Sequence
  Description of Artificial Sequence: Synthetic polypeptide
AEEEIACTNPVATEQYGSVATNLQANANMYY

SEQ ID NO: 76869 - protein, 31 aa, Artificial Sequence
  Description of Artificial Sequence: Synthetic polypeptide
DEAEIACTNPVATEQYGSVATNLQGSEENDW

SEQ ID NO: 76870 - protein, 33 aa, Artificial Sequence
  Description of Artificial Sequence: Synthetic polypeptide
SEEEIRTTNPVATEQYGSVSVTNLLDENPIDQE

SEQ ID NO: 76871 - protein, 31 aa, Artificial Sequence
  Description of Artificial Sequence: Synthetic polypeptide
DEAEIACTNPVATEQYGSVATNLQGAGGEGT

SEQ ID NO: 76872 - protein, 34 aa, Artificial Sequence
  Description of Artificial Sequence: Synthetic polypeptide
SEEEIRTTNPVATEQYGSVSVTNIDEQREGEDKV

SEQ ID NO: 76873 - protein, 31 aa, Artificial Sequence
  Description of Artificial Sequence: Synthetic polypeptide
DEAEIACTNPVATEQYGSVATNLQAPSENDE

SEQ ID NO: 76874 - protein, 33 aa, Artificial Sequence
  Description of Artificial Sequence: Synthetic polypeptide
SEEEIRTTNPVATEQYGSVSVTLLQEPNQNEDQ

SEQ ID NO: 76875 - protein, 35 aa, Artificial Sequence
  Description of Artificial Sequence: Synthetic polypeptide
AEEEIRTTNPVATEQYGSVSTSNNQLQNDEGNNND

SEQ ID NO: 76876 - protein, 34 aa, Artificial Sequence
  Description of Artificial Sequence: Synthetic polypeptide
AEEEIRTTNPVATEQYGSVSTSNNQQGQTNGTIA

SEQ ID NO: 76877 - protein, 30 aa, Artificial Sequence
  Description of Artificial Sequence: Synthetic polypeptide
DEEEIRTTNPEATEQYGCVCPTELAFGSVQ

SEQ ID NO: 76878 - protein, 31 aa, Artificial Sequence
  Description of Artificial Sequence: Synthetic polypeptide
DEEEIRTTNPVATTCYGIVSTTGNGAGNFRS

SEQ ID NO: 76879 - protein, 34 aa, Artificial Sequence
  Description of Artificial Sequence: Synthetic polypeptide
DEEEIRTTNPVATEQYGVVSTMDGLGQTEQGNEQ

SEQ ID NO: 76880 - protein, 32 aa, Artificial Sequence
  Description of Artificial Sequence: Synthetic polypeptide
DEMEIRTTNPVATEQYGSVSANEDQTESENDG

SEQ ID NO: 76881 - protein, 34 aa, Artificial Sequence
  Description of Artificial Sequence: Synthetic polypeptide
DEEEIRTTNPVATEQYGVVSTMGLVQQDGENEDI

SEQ ID NO: 76882 - protein, 34 aa, Artificial Sequence
  Description of Artificial Sequence: Synthetic polypeptide
AEEEIRTTNPVATEQYGSVSTSNNQQGTTGNIGT

SEQ ID NO: 76883 - protein, 32 aa, Artificial Sequence
  Description of Artificial Sequence: Synthetic polypeptide
DEEEIRTTNPVATEQYGVVSTMGFTGQGDENI

SEQ ID NO: 76884 - protein, 31 aa, Artificial Sequence
  Description of Artificial Sequence: Synthetic polypeptide
DEEEIRTTNPEATEQYGCVCPTALAERGSEQ

SEQ ID NO: 76885 - protein, 34 aa, Artificial Sequence
  Description of Artificial Sequence: Synthetic polypeptide
AEEEIRTTNPVATEQYGSVSTSNNQQQGNGNIGD

SEQ ID NO: 76886 - protein, 29 aa, Artificial Sequence
  Description of Artificial Sequence: Synthetic peptide
AEEEIACTNPVATEQYGSVATNLADPEAE

SEQ ID NO: 76887 - protein, 33 aa, Artificial Sequence
  Description of Artificial Sequence: Synthetic polypeptide
DEEEIRTTNPVATEQYGVVSTMGFMGQGEGNGI

SEQ ID NO: 76888 - protein, 32 aa, Artificial Sequence
  Description of Artificial Sequence: Synthetic polypeptide
DEEEIRTTNPVATEQYGVVSTMGDTGQGGGGT

SEQ ID NO: 76889 - protein, 33 aa, Artificial Sequence
  Description of Artificial Sequence: Synthetic polypeptide
DEESICTTNPVATEAYGSVSNTNTLQQGSNQMT

SEQ ID NO: 76890 - protein, 32 aa, Artificial Sequence
  Description of Artificial Sequence: Synthetic polypeptide
DEAEIACTNPVATEQYGSVATNLQADTPGNNE

SEQ ID NO: 76891 - protein, 31 aa, Artificial Sequence
  Description of Artificial Sequence: Synthetic polypeptide
DEEEIRTTNPVATEQYGCVSTEAHQENFMDQ

SEQ ID NO: 76892 - protein, 30 aa, Artificial Sequence
  Description of Artificial Sequence: Synthetic polypeptide
DEEEIRTTNPEATEQWGTVPTDLARGGDQM

SEQ ID NO: 76893 - protein, 33 aa, Artificial Sequence
  Description of Artificial Sequence: Synthetic polypeptide
AEEEIRTTNPVATEQYGSVSTSNNQQQTTGEII

SEQ ID NO: 76894 - protein, 31 aa, Artificial Sequence
  Description of Artificial Sequence: Synthetic polypeptide
DEAEIACTNPVATEQYGSVATNLQAEENTDE

SEQ ID NO: 76895 - protein, 31 aa, Artificial Sequence
  Description of Artificial Sequence: Synthetic polypeptide
DAEEIASTNPVATEQYGSVSWNEGDRNGQSR

SEQ ID NO: 76896 - protein, 33 aa, Artificial Sequence
  Description of Artificial Sequence: Synthetic polypeptide
SEEEIRTTNPVATEQWGAVSGGNGEMQRGENDR

SEQ ID NO: 76897 - protein, 32 aa, Artificial Sequence
  Description of Artificial Sequence: Synthetic polypeptide
DEEEIRTTNPVATEQYGDVNSNGDQGGGENIQ

SEQ ID NO: 76898 - protein, 31 aa, Artificial Sequence
  Description of Artificial Sequence: Synthetic polypeptide
DEMEIVTTNPVATEQYGTVSTDDIVQFEGND

SEQ ID NO: 76899 - protein, 34 aa, Artificial Sequence
  Description of Artificial Sequence: Synthetic polypeptide
DEEEIRTTNPVATEQYGEVVVSCTNLSQAQSGPT

SEQ ID NO: 76900 - protein, 31 aa, Artificial Sequence
  Description of Artificial Sequence: Synthetic polypeptide
SEEEIRCTNPISTEQYGTVSEENLQQRNGNH

SEQ ID NO: 76901 - protein, 28 aa, Artificial Sequence
  Description of Artificial Sequence: Synthetic peptide
DDNEIATTNPVATECYGDVANCLQRGQL

SEQ ID NO: 76902 - protein, 32 aa, Artificial Sequence
  Description of Artificial Sequence: Synthetic polypeptide
DEEEIRTTNPVAYEAYGYTVSTGNLTMVGNNA

SEQ ID NO: 76903 - protein, 28 aa, Artificial Sequence
  Description of Artificial Sequence: Synthetic peptide
YAEEIASVNPVCTEQYGVVSDNLQSGNQ

SEQ ID NO: 76904 - protein, 34 aa, Artificial Sequence
  Description of Artificial Sequence: Synthetic polypeptide
AEEEIRTTNPVATEQYGSVSTTNNNNQQQIGNVG

SEQ ID NO: 76905 - protein, 32 aa, Artificial Sequence
  Description of Artificial Sequence: Synthetic polypeptide
DEEEMRTTNPVAYEAYGSTVSTGNLSTMVGNA

SEQ ID NO: 76906 - protein, 30 aa, Artificial Sequence
  Description of Artificial Sequence: Synthetic polypeptide
DEAEIATTNPVAYERWGSVSNNLQHGGDND

SEQ ID NO: 76907 - protein, 31 aa, Artificial Sequence
  Description of Artificial Sequence: Synthetic polypeptide
DEMEIVTTNPVATEQYGTVSTDGPVEFEGNR

SEQ ID NO: 76908 - protein, 35 aa, Artificial Sequence
  Description of Artificial Sequence: Synthetic polypeptide
AEEEIRTTNPVATEQYGSVSTTNNNQLQAGTNQEN

SEQ ID NO: 76909 - protein, 35 aa, Artificial Sequence
  Description of Artificial Sequence: Synthetic polypeptide
AEEEIRTTNPVATEQYGSVSTTNNNQLQIGTNEGT

SEQ ID NO: 76910 - protein, 34 aa, Artificial Sequence
  Description of Artificial Sequence: Synthetic polypeptide
AEEEIRTTNPVATEQYGSVSTTNNNQNNIGENDE

SEQ ID NO: 76911 - protein, 34 aa, Artificial Sequence
  Description of Artificial Sequence: Synthetic polypeptide
AEEEIRTTNPVATEQYGSVSTTNNNQQEIGNNQD

SEQ ID NO: 76912 - protein, 31 aa, Artificial Sequence
  Description of Artificial Sequence: Synthetic polypeptide
DEEEIRTTNPVAYECYGKISCTNEGSQRVNF

SEQ ID NO: 76913 - protein, 36 aa, Artificial Sequence
  Description of Artificial Sequence: Synthetic polypeptide
DEEEIRTTNPVATEQYGSYVYSQTNLPAVRGVNELD

SEQ ID NO: 76914 - protein, 28 aa, Artificial Sequence
  Description of Artificial Sequence: Synthetic peptide
YCEEIASVNPVCTEQYGRVSDNLQSGNQ

SEQ ID NO: 76915 - protein, 28 aa, Artificial Sequence
  Description of Artificial Sequence: Synthetic peptide
YCEEIASVNPVCTEQYGVVSDNLQSGNQ

SEQ ID NO: 76916 - protein, 33 aa, Artificial Sequence
  Description of Artificial Sequence: Synthetic polypeptide
DEEEIRTTNPVATEQYGSYVYENLDDDRNGDEN

SEQ ID NO: 76917 - protein, 30 aa, Artificial Sequence
  Description of Artificial Sequence: Synthetic polypeptide
DEEEIRTTNPVAYECYGKISCTNESTRVNF

SEQ ID NO: 76918 - protein, 34 aa, Artificial Sequence
  Description of Artificial Sequence: Synthetic polypeptide
AEEEIRTTNPVATEQYGSVSTTNNNQQLQGNQTE

SEQ ID NO: 76919 - protein, 28 aa, Artificial Sequence
  Description of Artificial Sequence: Synthetic peptide
YCEEIASVNPVCTEQYGVVSWNLQSGNQ

SEQ ID NO: 76920 - protein, 31 aa, Artificial Sequence
  Description of Artificial Sequence: Synthetic polypeptide
DEMEIVTTNPVSTEQYGTVSATGLVQFEGND

SEQ ID NO: 76921 - protein, 34 aa, Artificial Sequence
  Description of Artificial Sequence: Synthetic polypeptide
DEEEIRTTNPVATEQYGSYVTPTMNDLQPVLENN

SEQ ID NO: 76922 - protein, 29 aa, Artificial Sequence
  Description of Artificial Sequence: Synthetic peptide
YDEEIASTNPVCTEQYGVVSADTLQRGNQ

SEQ ID NO: 76923 - protein, 34 aa, Artificial Sequence
  Description of Artificial Sequence: Synthetic polypeptide
DEEEMRTTNPVATEQYGSVSTMTLQHRSGSFEVA

SEQ ID NO: 76924 - protein, 29 aa, Artificial Sequence
  Description of Artificial Sequence: Synthetic peptide
YDEEIASTNPVSTEGYGVVSNNIQSRGNR

SEQ ID NO: 76925 - protein, 32 aa, Artificial Sequence
  Description of Artificial Sequence: Synthetic polypeptide
DEEEIRTTNPVAYEAYGTLVNWNLSQRTGGNV

SEQ ID NO: 76926 - protein, 31 aa, Artificial Sequence
  Description of Artificial Sequence: Synthetic polypeptide
DEEEIRTTNPCATEEYGSVCGTNHGRGSDAA

SEQ ID NO: 76927 - protein, 33 aa, Artificial Sequence
  Description of Artificial Sequence: Synthetic polypeptide
DEEEIRTTNPVATEQYGEVVGTNNTGQGGGNEG

SEQ ID NO: 76928 - protein, 33 aa, Artificial Sequence
  Description of Artificial Sequence: Synthetic polypeptide
DEEEIRTTNPVATEQYGAVVGDTNDGTEQGGNE

SEQ ID NO: 76929 - protein, 31 aa, Artificial Sequence
  Description of Artificial Sequence: Synthetic polypeptide
DEAEIATTNPVAYEQYGSVSTNLDNHGAEAE

SEQ ID NO: 76930 - protein, 35 aa, Artificial Sequence
  Description of Artificial Sequence: Synthetic polypeptide
AEEEIRTTNPVATEQYGSVSTTNNNLQSGNGNQED

SEQ ID NO: 76931 - protein, 32 aa, Artificial Sequence
  Description of Artificial Sequence: Synthetic polypeptide
DEAEIATTNPVAYEQYGSVSTNLQEHGDAEAH

SEQ ID NO: 76932 - protein, 33 aa, Artificial Sequence
  Description of Artificial Sequence: Synthetic polypeptide
DEAEIATTNPVAYEQYGSVSTNLQERGGDDEAA

SEQ ID NO: 76933 - protein, 35 aa, Artificial Sequence
  Description of Artificial Sequence: Synthetic polypeptide
AEEEIRTTNPVATEQYGSVSTTNNNLQTGNNNELF

SEQ ID NO: 76934 - protein, 33 aa, Artificial Sequence
  Description of Artificial Sequence: Synthetic polypeptide
WEEEIATTNPVATEQYGCVATNNLTQDGENGRE

SEQ ID NO: 76935 - protein, 28 aa, Artificial Sequence
  Description of Artificial Sequence: Synthetic peptide
DDNEIASTNPVATECYGDVANCLQRGQR

SEQ ID NO: 76936 - protein, 34 aa, Artificial Sequence
  Description of Artificial Sequence: Synthetic polypeptide
AEEEIRTTNPVATEQYGSVSTTNNNLQTNNNELF

SEQ ID NO: 76937 - protein, 31 aa, Artificial Sequence
  Description of Artificial Sequence: Synthetic polypeptide
DEMEIVTTNPVATEQYGTVSATDGLEFEGND

SEQ ID NO: 76938 - protein, 30 aa, Artificial Sequence
  Description of Artificial Sequence: Synthetic polypeptide
DEEEVRSTNPVATEGYGNVANNIQSRVGQR

SEQ ID NO: 76939 - protein, 31 aa, Artificial Sequence
  Description of Artificial Sequence: Synthetic polypeptide
DEEEIRTTNPCATEGYGCCCSTNLASIGSNQ

SEQ ID NO: 76940 - protein, 28 aa, Artificial Sequence
  Description of Artificial Sequence: Synthetic peptide
DDNEIASTNPVSTEGYGEASENLQRGGR

SEQ ID NO: 76941 - protein, 30 aa, Artificial Sequence
  Description of Artificial Sequence: Synthetic polypeptide
DEEEIRTTNPCATEGYGCCCSTNLASFGDQ

SEQ ID NO: 76942 - protein, 33 aa, Artificial Sequence
  Description of Artificial Sequence: Synthetic polypeptide
DEEEIRTTNPVATEQYGAVVDGGTNLDEGFGNT

SEQ ID NO: 76943 - protein, 33 aa, Artificial Sequence
  Description of Artificial Sequence: Synthetic polypeptide
DEEEIRTTNPVATEQYGAVVGSTNNLGTEQGGG

SEQ ID NO: 76944 - protein, 30 aa, Artificial Sequence
  Description of Artificial Sequence: Synthetic polypeptide
DEMEIVTTNPVATEQYGTVSATGPEFEGND

SEQ ID NO: 76945 - protein, 32 aa, Artificial Sequence
  Description of Artificial Sequence: Synthetic polypeptide
WEEEIATTNPVATEQYGSVATNNLENAGENDN

SEQ ID NO: 76946 - protein, 30 aa, Artificial Sequence
  Description of Artificial Sequence: Synthetic polypeptide
DEMEIVTTNPVATEQYGTVSATGPEHEGND

SEQ ID NO: 76947 - protein, 32 aa, Artificial Sequence
  Description of Artificial Sequence: Synthetic polypeptide
DEAEIATTNPVAYEQYGTVSTNLQSDGGNGNK

SEQ ID NO: 76948 - protein, 30 aa, Artificial Sequence
  Description of Artificial Sequence: Synthetic polypeptide
DEMEIVTTNPVATEQYGTVSATIPEFEGND

SEQ ID NO: 76949 - protein, 34 aa, Artificial Sequence
  Description of Artificial Sequence: Synthetic polypeptide
WEEEIATTNPVATEQYGSVCATNNLPQEAGENDR

SEQ ID NO: 76950 - protein, 31 aa, Artificial Sequence
  Description of Artificial Sequence: Synthetic polypeptide
AEEAIRTTNPAATEQYGSQVYTPNPTRGENV

SEQ ID NO: 76951 - protein, 32 aa, Artificial Sequence
  Description of Artificial Sequence: Synthetic polypeptide
DEEEIRTTNPVAYEAYGSVVSYTAGLGVVGNV

SEQ ID NO: 76952 - protein, 34 aa, Artificial Sequence
  Description of Artificial Sequence: Synthetic polypeptide
AEEEIRTTNPVATEQYGSVSTTNNNNQQGIGNQE

SEQ ID NO: 76953 - protein, 34 aa, Artificial Sequence
  Description of Artificial Sequence: Synthetic polypeptide
AEEEIRTTNPVATEQYGSVSTTNNNNQQIGNDGD

SEQ ID NO: 76954 - protein, 34 aa, Artificial Sequence
  Description of Artificial Sequence: Synthetic polypeptide
AEEEIRTTNPVATEQYGSVSTTNNNNQQIGNDGN

SEQ ID NO: 76955 - protein, 32 aa, Artificial Sequence
  Description of Artificial Sequence: Synthetic polypeptide
DEEEIRTTNPVATEQYGEVVATHKPTQDGKQR

SEQ ID NO: 76956 - protein, 29 aa, Artificial Sequence
  Description of Artificial Sequence: Synthetic peptide
DEMEIVTTNPVATEQYGTVSEDCPEFGND

SEQ ID NO: 76957 - protein, 33 aa, Artificial Sequence
  Description of Artificial Sequence: Synthetic polypeptide
DEEEIRTTNPVATEQYGTCSTINPLQTAGEPGN

SEQ ID NO: 76958 - protein, 28 aa, Artificial Sequence
  Description of Artificial Sequence: Synthetic peptide
YDEEIASVNPVCTEQYGVVSDNLQSGNQ

SEQ ID NO: 76959 - protein, 32 aa, Artificial Sequence
  Description of Artificial Sequence: Synthetic polypeptide
SEEEIRCTNPIAYEQYGSVVSENLSMRTVGNR

SEQ ID NO: 76960 - protein, 34 aa, Artificial Sequence
  Description of Artificial Sequence: Synthetic polypeptide
AEEEIRTTNPVATEQYGSVSTTNNNQQQGTNEGQ

SEQ ID NO: 76961 - protein, 32 aa, Artificial Sequence
  Description of Artificial Sequence: Synthetic polypeptide
DENEAEIATTNPVAYEHWGSVSTNLQGEDGNA

SEQ ID NO: 76962 - protein, 29 aa, Artificial Sequence
  Description of Artificial Sequence: Synthetic peptide
DDPDIRCTNPVATEQYGKVSTNHQLDNQE

SEQ ID NO: 76963 - protein, 32 aa, Artificial Sequence
  Description of Artificial Sequence: Synthetic polypeptide
DEEEIRTTNPVAYEEYGSVAYTNASQDTGGNK

SEQ ID NO: 76964 - protein, 34 aa, Artificial Sequence
  Description of Artificial Sequence: Synthetic polypeptide
DEEEIRTTNPVAYEEYGSVYSCTNAISQNKGSNR

SEQ ID NO: 76965 - protein, 33 aa, Artificial Sequence
  Description of Artificial Sequence: Synthetic polypeptide
DENEAEIATTNPVAYEHWGSVSTNLQGEGGNAR

SEQ ID NO: 76966 - protein, 33 aa, Artificial Sequence
  Description of Artificial Sequence: Synthetic polypeptide
DENEAEIATTNPVAYEQWGSVSTNLQGDAGNDA

SEQ ID NO: 76967 - protein, 33 aa, Artificial Sequence
  Description of Artificial Sequence: Synthetic polypeptide
DEEEIRTTNPVAYEEYGVVSSCTNNSQRGGMNS

SEQ ID NO: 76968 - protein, 33 aa, Artificial Sequence
  Description of Artificial Sequence: Synthetic polypeptide
DEEEIRTTNPVAYEFYGQVQSCTNNSQRGGMNS

SEQ ID NO: 76969 - protein, 34 aa, Artificial Sequence
  Description of Artificial Sequence: Synthetic polypeptide
DENEAEIRTTNPVAYECWGSVSTNLQGEDGNQRR

SEQ ID NO: 76970 - protein, 34 aa, Artificial Sequence
  Description of Artificial Sequence: Synthetic polypeptide
DENEAEIRTTNPVAYECWGSVSTNLQGEHGGNGR

SEQ ID NO: 76971 - protein, 31 aa, Artificial Sequence
  Description of Artificial Sequence: Synthetic polypeptide
DEEEIVTTNPVATEQYGTVSATDGPEFEGND

SEQ ID NO: 76972 - protein, 33 aa, Artificial Sequence
  Description of Artificial Sequence: Synthetic polypeptide
DENEAEIRTTNPVAYECWGSVSTNNQGEDGNAR

SEQ ID NO: 76973 - protein, 33 aa, Artificial Sequence
  Description of Artificial Sequence: Synthetic polypeptide
DENEAEIRTTNPVAYEGWGSVVTNLQGEDGNDR

SEQ ID NO: 76974 - protein, 28 aa, Artificial Sequence
  Description of Artificial Sequence: Synthetic peptide
YEDEIASVNPVCTEQYGYVSDNLQSGNQ

SEQ ID NO: 76975 - protein, 34 aa, Artificial Sequence
  Description of Artificial Sequence: Synthetic polypeptide
AEEEIRTTNPVATEQYGSVSTTNNNQQQTGNQVD

SEQ ID NO: 76976 - protein, 33 aa, Artificial Sequence
  Description of Artificial Sequence: Synthetic polypeptide
DENEAEIRTTNPVAYEHWGEVSTNLQGEGQNNR

SEQ ID NO: 76977 - protein, 34 aa, Artificial Sequence
  Description of Artificial Sequence: Synthetic polypeptide
AEEEIRTTNPVATEQYGSVSTTNNNQQQTQGNVD

SEQ ID NO: 76978 - protein, 28 aa, Artificial Sequence
  Description of Artificial Sequence: Synthetic peptide
YEEAIASVNPVCTEQYGVVSDNLQAGNQ

SEQ ID NO: 76979 - protein, 33 aa, Artificial Sequence
  Description of Artificial Sequence: Synthetic polypeptide
AEEEIRTTNPVATEQYGSVSTTNNNSEQGENSE

SEQ ID NO: 76980 - protein, 28 aa, Artificial Sequence
  Description of Artificial Sequence: Synthetic peptide
YEEAIASVNPVCTEQYGVVSDNLQSGNQ

SEQ ID NO: 76981 - protein, 32 aa, Artificial Sequence
  Description of Artificial Sequence: Synthetic polypeptide
DEEEIVTTNPVATEQYGTVCSTDNPVEFEGND

SEQ ID NO: 76982 - protein, 34 aa, Artificial Sequence
  Description of Artificial Sequence: Synthetic polypeptide
DEEEIRTTNPVATEAYGVVSTVTNLNTQGGNNTD

SEQ ID NO: 76983 - protein, 31 aa, Artificial Sequence
  Description of Artificial Sequence: Synthetic polypeptide
YEEAIGTTNPYATESYGSVSPTGNVQGFGNR

SEQ ID NO: 76984 - protein, 33 aa, Artificial Sequence
  Description of Artificial Sequence: Synthetic polypeptide
DENEAEIRTTNPVAYEHWGSVSTNIQGEDGNNR

SEQ ID NO: 76985 - protein, 34 aa, Artificial Sequence
  Description of Artificial Sequence: Synthetic polypeptide
DENEAEIRTTNPVAYEHWGSVSTNLNQGEDGNQR

SEQ ID NO: 76986 - protein, 28 aa, Artificial Sequence
  Description of Artificial Sequence: Synthetic peptide
YEECIASVNPVCTEQYGVVSDNLQSGNQ

SEQ ID NO: 76987 - protein, 28 aa, Artificial Sequence
  Description of Artificial Sequence: Synthetic peptide
YEECIASVNPVCTEQYGVVSDNLQSGNV

SEQ ID NO: 76988 - protein, 33 aa, Artificial Sequence
  Description of Artificial Sequence: Synthetic polypeptide
DEEEIRTTNPVATEQYGAVSTSNLDLFGGEQIT

SEQ ID NO: 76989 - protein, 33 aa, Artificial Sequence
  Description of Artificial Sequence: Synthetic polypeptide
DEEEIRTTNPVATEQYGSYVEPTPWLEDVGVNV

SEQ ID NO: 76990 - protein, 33 aa, Artificial Sequence
  Description of Artificial Sequence: Synthetic polypeptide
DEEEIRTTNPVATEQYGTISCTPNELSQSTVNN

SEQ ID NO: 76991 - protein, 33 aa, Artificial Sequence
  Description of Artificial Sequence: Synthetic polypeptide
DEEEIVTTNPVAYEQYGVVSCTNNSQRGGMNSQ

SEQ ID NO: 76992 - protein, 33 aa, Artificial Sequence
  Description of Artificial Sequence: Synthetic polypeptide
DENEAEIATTNPVAYECWGSVSTNLQGEGQNQR

SEQ ID NO: 76993 - protein, 34 aa, Artificial Sequence
  Description of Artificial Sequence: Synthetic polypeptide
AEEEIRTTNPVATEQYGSVSTTNNNQQQIGNDGT

SEQ ID NO: 76994 - protein, 32 aa, Artificial Sequence
  Description of Artificial Sequence: Synthetic polypeptide
DEEEIRTTNPCATEEYGSVATNDDGRQGGNAM

SEQ ID NO: 76995 - protein, 34 aa, Artificial Sequence
  Description of Artificial Sequence: Synthetic polypeptide
DEEEIRTTNPVATEQYGFSVSTPIGVSMGGPNRA

SEQ ID NO: 76996 - protein, 31 aa, Artificial Sequence
  Description of Artificial Sequence: Synthetic polypeptide
DEACISTTNPVATEQYGCVCSTNLAYFGSNQ

SEQ ID NO: 76997 - protein, 33 aa, Artificial Sequence
  Description of Artificial Sequence: Synthetic polypeptide
DEEEIRTTNPVAYECYGKTVSTGNMASQHGNQR

SEQ ID NO: 76998 - protein, 31 aa, Artificial Sequence
  Description of Artificial Sequence: Synthetic polypeptide
SEEEIRCTNPIAYEQYGSVSCENLSMDGGNR

SEQ ID NO: 76999 - protein, 34 aa, Artificial Sequence
  Description of Artificial Sequence: Synthetic polypeptide
AEEEIRTTNPVATEQYGSVSTTNNNQQQIGNQEG

SEQ ID NO: 77000 - protein, 32 aa, Artificial Sequence
  Description of Artificial Sequence: Synthetic polypeptide
DEAEIATTNPVSTEQYGSVATNLQTAGPNEEA

SEQ ID NO: 77001 - protein, 32 aa, Artificial Sequence
  Description of Artificial Sequence: Synthetic polypeptide
SEEEIRCTNPIAYEQYGSTVSENLSTRGGPNR

SEQ ID NO: 77002 - protein, 28 aa, Artificial Sequence
  Description of Artificial Sequence: Synthetic peptide
YEAEIASVNPVCTEQYGVVSDNLQSGNQ

SEQ ID NO: 77003 - protein, 31 aa, Artificial Sequence
  Description of Artificial Sequence: Synthetic polypeptide
DEMVIGTTNPVATEQWGSVCSSDDLQRGSNQ

SEQ ID NO: 77004 - protein, 34 aa, Artificial Sequence
  Description of Artificial Sequence: Synthetic polypeptide
CESEIRTTNPVATEQYGKVSTGNALSQGTGTNRE

SEQ ID NO: 77005 - protein, 31 aa, Artificial Sequence
  Description of Artificial Sequence: Synthetic polypeptide
DEEEIRTTNPCATEEYGCVTQTNHGRSGSNA

SEQ ID NO: 77006 - protein, 28 aa, Artificial Sequence
  Description of Artificial Sequence: Synthetic peptide
YEDEIASVNPVCTEQYGVVSDNLQSGNQ

SEQ ID NO: 77007 - protein, 32 aa, Artificial Sequence
  Description of Artificial Sequence: Synthetic polypeptide
DEMVIGTTNPVATEQWGSVSTDLLQRFGSNQS

SEQ ID NO: 77008 - protein, 34 aa, Artificial Sequence
  Description of Artificial Sequence: Synthetic polypeptide
DEEEIRTTNPVATEQYGAVVDDTNLQGEGNQNGD

SEQ ID NO: 77009 - protein, 34 aa, Artificial Sequence
  Description of Artificial Sequence: Synthetic polypeptide
DEEEIRTTNPVATEQYGAVVDDTNLQDGNGNQGE

SEQ ID NO: 77010 - protein, 32 aa, Artificial Sequence
  Description of Artificial Sequence: Synthetic polypeptide
DEEEIRTTNPVAYECYGKVSNNMPSQHGGNQR

SEQ ID NO: 77011 - protein, 33 aa, Artificial Sequence
  Description of Artificial Sequence: Synthetic polypeptide
YEAEIRTTNPVATEQYGCAVSNSGLTQRNGNRF

SEQ ID NO: 77012 - protein, 34 aa, Artificial Sequence
  Description of Artificial Sequence: Synthetic polypeptide
DEEELRTTNPVATERYGSTVSVTGNAHSQFGGNR

SEQ ID NO: 77013 - protein, 31 aa, Artificial Sequence
  Description of Artificial Sequence: Synthetic polypeptide
DEMVIRYTNPVATEQYGSVSVNQNDRGSNSD

SEQ ID NO: 77014 - protein, 32 aa, Artificial Sequence
  Description of Artificial Sequence: Synthetic polypeptide
DEEEIRTTNPVAYECYGQSVSTNAQSQKGGDT

SEQ ID NO: 77015 - protein, 32 aa, Artificial Sequence
  Description of Artificial Sequence: Synthetic polypeptide
DEEEIYTTNPVATEQYGCVCSTEHQHFGSNQS

SEQ ID NO: 77016 - protein, 32 aa, Artificial Sequence
  Description of Artificial Sequence: Synthetic polypeptide
DENCIRTTNPVAYEPYGSTVSTHELSQRVNNR

SEQ ID NO: 77017 - protein, 34 aa, Artificial Sequence
  Description of Artificial Sequence: Synthetic polypeptide
DEEEIRTTNPVATEQYGSYVSATNGEIETVGNLE

SEQ ID NO: 77018 - protein, 28 aa, Artificial Sequence
  Description of Artificial Sequence: Synthetic peptide
YECEIASVNPVCTEQYGVVSDNLQSGNQ

SEQ ID NO: 77019 - protein, 34 aa, Artificial Sequence
  Description of Artificial Sequence: Synthetic polypeptide
DEEEIRTTNPVATEQYGAVTSTLNIENGQGGNQQ

SEQ ID NO: 77020 - protein, 32 aa, Artificial Sequence
  Description of Artificial Sequence: Synthetic polypeptide
YECEIGTTNPYATEQYGSVSTHNVQGPQGHNR

SEQ ID NO: 77021 - protein, 33 aa, Artificial Sequence
  Description of Artificial Sequence: Synthetic polypeptide
DEEEIRTTNPVAYECYGKVSCTNMQSQNHGNQR

SEQ ID NO: 77022 - protein, 28 aa, Artificial Sequence
  Description of Artificial Sequence: Synthetic peptide
YEECIASVNPVCTEQYGWVSDNLQSGNQ

SEQ ID NO: 77023 - protein, 28 aa, Artificial Sequence
  Description of Artificial Sequence: Synthetic peptide
DDNEIACTNPVSTEGYGEASENLQRGGR

SEQ ID NO: 77024 - protein, 32 aa, Artificial Sequence
  Description of Artificial Sequence: Synthetic polypeptide
WEEEIACTNPVATEQYGSVATNLQAPGENAEE

SEQ ID NO: 77025 - protein, 32 aa, Artificial Sequence
  Description of Artificial Sequence: Synthetic polypeptide
SEEEIRCTNPVATEQYGSVSATDLEDHEGEDR

SEQ ID NO: 77026 - protein, 32 aa, Artificial Sequence
  Description of Artificial Sequence: Synthetic polypeptide
VEEEVATTNPVATEQWGSVSTGNLDNDDGNRH

SEQ ID NO: 77027 - protein, 33 aa, Artificial Sequence
  Description of Artificial Sequence: Synthetic polypeptide
VEEEVCTTNPVAYEQWGSVCSTWNHLDQREGNR

SEQ ID NO: 77028 - protein, 34 aa, Artificial Sequence
  Description of Artificial Sequence: Synthetic polypeptide
DEEEIRTTNPVATEQYGAVWSLTINPGQGEGNQN

SEQ ID NO: 77029 - protein, 35 aa, Artificial Sequence
  Description of Artificial Sequence: Synthetic polypeptide
AEEEIRTTNPVATEQYGSVSTTNNNLQGTNGNQQF

SEQ ID NO: 77030 - protein, 34 aa, Artificial Sequence
  Description of Artificial Sequence: Synthetic polypeptide
DEEEIRTTNPVATEQYGAVWSLTINHGQGEGNNQ

SEQ ID NO: 77031 - protein, 35 aa, Artificial Sequence
  Description of Artificial Sequence: Synthetic polypeptide
AEEEIRTTNPVATEQYGSVSTTNNNLQLTIGTNSA

SEQ ID NO: 77032 - protein, 33 aa, Artificial Sequence
  Description of Artificial Sequence: Synthetic polypeptide
DEEEIRTTNPVAYEAYGSVPSYTARLGVVGNRF

SEQ ID NO: 77033 - protein, 33 aa, Artificial Sequence
  Description of Artificial Sequence: Synthetic polypeptide
DEEEIRTTNPVATEQYGAVWSLINPGQGEGNEN

SEQ ID NO: 77034 - protein, 35 aa, Artificial Sequence
  Description of Artificial Sequence: Synthetic polypeptide
AEEEIRTTNPVATEQYGSVSTTNNNLQNDEGNNEQ

SEQ ID NO: 77035 - protein, 34 aa, Artificial Sequence
  Description of Artificial Sequence: Synthetic polypeptide
AEEEIRTTNPVATEQYGSVSTTNNNLQNEDEAND

SEQ ID NO: 77036 - protein, 36 aa, Artificial Sequence
  Description of Artificial Sequence: Synthetic polypeptide
DEEEIRTTNPVATEQYGETVPSCTNLSEERGGNERQ

SEQ ID NO: 77037 - protein, 34 aa, Artificial Sequence
  Description of Artificial Sequence: Synthetic polypeptide
VEEEVRTTNPVATEQYGSVSCTGNNSQRTVGNNI

SEQ ID NO: 77038 - protein, 33 aa, Artificial Sequence
  Description of Artificial Sequence: Synthetic polypeptide
VEEEVRTTNPVATEQYGSVSSTWNLDETRIENQ

SEQ ID NO: 77039 - protein, 35 aa, Artificial Sequence
  Description of Artificial Sequence: Synthetic polypeptide
DEEEIRTTNPVATEQYGETVSCTENGSTERGGNPR

SEQ ID NO: 77040 - protein, 34 aa, Artificial Sequence
  Description of Artificial Sequence: Synthetic polypeptide
DEEEIRTTNPVATEQYGETVSCTNESEEGGGNER

SEQ ID NO: 77041 - protein, 34 aa, Artificial Sequence
  Description of Artificial Sequence: Synthetic polypeptide
DEEEIRTTNPVATEQYGETVSCTNGSGEAGTNER

SEQ ID NO: 77042 - protein, 35 aa, Artificial Sequence
  Description of Artificial Sequence: Synthetic polypeptide
DEEEIRTTNPVATEQYGETVSCTNGSGERVGGNYR

SEQ ID NO: 77043 - protein, 34 aa, Artificial Sequence
  Description of Artificial Sequence: Synthetic polypeptide
VEEEVRTTNPVATEQYGSVSTWNLDTTRIGSNQE

SEQ ID NO: 77044 - protein, 35 aa, Artificial Sequence
  Description of Artificial Sequence: Synthetic polypeptide
DEEEIRTTNPVATEQYGETVSCTNGSGLRGGNERD

SEQ ID NO: 77045 - protein, 34 aa, Artificial Sequence
  Description of Artificial Sequence: Synthetic polypeptide
DEEEIRTTNPVATEQYGETVSCTNGSGTRGGNES

SEQ ID NO: 77046 - protein, 34 aa, Artificial Sequence
  Description of Artificial Sequence: Synthetic polypeptide
DEEEIRTTNPVATEQYGETVSCTNGSGYRGGGER

SEQ ID NO: 77047 - protein, 35 aa, Artificial Sequence
  Description of Artificial Sequence: Synthetic polypeptide
DEEEIRTTNPVATEQYGETVSCTNLSEENGGNERV

SEQ ID NO: 77048 - protein, 33 aa, Artificial Sequence
  Description of Artificial Sequence: Synthetic polypeptide
VEEEVRTTNPVAYEQWGSVCSTWNHNDQRMGNR

SEQ ID NO: 77049 - protein, 35 aa, Artificial Sequence
  Description of Artificial Sequence: Synthetic polypeptide
DEEEIRTTNPVATEQYGETVSCTNLSEERGGSERS

SEQ ID NO: 77050 - protein, 36 aa, Artificial Sequence
  Description of Artificial Sequence: Synthetic polypeptide
DEEEIRTTNPVATEQYGETVSCTNLSEERTGGNERY

SEQ ID NO: 77051 - protein, 35 aa, Artificial Sequence
  Description of Artificial Sequence: Synthetic polypeptide
DEEEIRTTNPVATEQYGETVSCTVNGSGNRGGNER

SEQ ID NO: 77052 - protein, 31 aa, Artificial Sequence
  Description of Artificial Sequence: Synthetic polypeptide
DEAEIATTNPVAYEQYGSVATHLQDRVGDDE

SEQ ID NO: 77053 - protein, 30 aa, Artificial Sequence
  Description of Artificial Sequence: Synthetic polypeptide
DEAEIATTNPVAYEQYGSVATHDQDRGDEM

SEQ ID NO: 77054 - protein, 35 aa, Artificial Sequence
  Description of Artificial Sequence: Synthetic polypeptide
AEEEIRTTNPVATEQYGSVSTTNNNLQGEEGGNDD

SEQ ID NO: 77055 - protein, 32 aa, Artificial Sequence
  Description of Artificial Sequence: Synthetic polypeptide
VEEEVATTNPVATEQWGSVSQGNLDQDDGNNR

SEQ ID NO: 77056 - protein, 32 aa, Artificial Sequence
  Description of Artificial Sequence: Synthetic polypeptide
SEEEIRCTNPVATEQYGSVSSEPNGMMRGNPV

SEQ ID NO: 77057 - protein, 31 aa, Artificial Sequence
  Description of Artificial Sequence: Synthetic polypeptide
DEEEIRTTNPCATEPYGSCATNLATATGDNH

SEQ ID NO: 77058 - protein, 32 aa, Artificial Sequence
  Description of Artificial Sequence: Synthetic polypeptide
DEEEIRTTNPVAYEAYGSVPSDTGFHGVVGNR

SEQ ID NO: 77059 - protein, 31 aa, Artificial Sequence
  Description of Artificial Sequence: Synthetic polypeptide
DDGEIRTTNPVATEQYGSVSTVLLEEGMQQT

SEQ ID NO: 77060 - protein, 33 aa, Artificial Sequence
  Description of Artificial Sequence: Synthetic polypeptide
DEEEIRTTNPVAYEAYGSVPSTTAGGLGVVGNR

SEQ ID NO: 77061 - protein, 33 aa, Artificial Sequence
  Description of Artificial Sequence: Synthetic polypeptide
VEEEIRTTNPVAYEQYGSCSTNATQDRHGFGER

SEQ ID NO: 77062 - protein, 33 aa, Artificial Sequence
  Description of Artificial Sequence: Synthetic polypeptide
DEEHIRTTNPVAYERYGSTVSCTNATQRPGGPR

SEQ ID NO: 77063 - protein, 31 aa, Artificial Sequence
  Description of Artificial Sequence: Synthetic polypeptide
DEEEIRTTNPCATEPYGSCATNLAAGDNMAW

SEQ ID NO: 77064 - protein, 30 aa, Artificial Sequence
  Description of Artificial Sequence: Synthetic polypeptide
DEEEIRTTNPCATEPYGSCATNLAAGDGQA

SEQ ID NO: 77065 - protein, 30 aa, Artificial Sequence
  Description of Artificial Sequence: Synthetic polypeptide
DEEEIRTTNPCATEPYGSCATNHMPGNAAM

SEQ ID NO: 77066 - protein, 33 aa, Artificial Sequence
  Description of Artificial Sequence: Synthetic polypeptide
DEEEIRTTNPVATEQYGESVSQNVNSQTVGEPF

SEQ ID NO: 77067 - protein, 33 aa, Artificial Sequence
  Description of Artificial Sequence: Synthetic polypeptide
DEEEIRTTNPVATEQYGTVCSATDAPPEREGNV

SEQ ID NO: 77068 - protein, 34 aa, Artificial Sequence
  Description of Artificial Sequence: Synthetic polypeptide
AEEEIRTTNPVATEQYGSVSTTNNNLESGENETD

SEQ ID NO: 77069 - protein, 36 aa, Artificial Sequence
  Description of Artificial Sequence: Synthetic polypeptide
DEEEIRTTNPVATEQYGETVVCTNMLSQREGGNERA

SEQ ID NO: 77070 - protein, 31 aa, Artificial Sequence
  Description of Artificial Sequence: Synthetic polypeptide
VEEEIRTTNPVAYEWYGSVGSLNGEQRPVSR

SEQ ID NO: 77071 - protein, 32 aa, Artificial Sequence
  Description of Artificial Sequence: Synthetic polypeptide
DEEEIRTTNPVATEQYGAVYTNGIEGGNNEVI

SEQ ID NO: 77072 - protein, 33 aa, Artificial Sequence
  Description of Artificial Sequence: Synthetic polypeptide
VEEELATTNPVATEQWGSVCSTWELDQREGNSR

SEQ ID NO: 77073 - protein, 33 aa, Artificial Sequence
  Description of Artificial Sequence: Synthetic polypeptide
DEEEIRTTNPVATEQYGTVCSATDAGPEREGNV

SEQ ID NO: 77074 - protein, 31 aa, Artificial Sequence
  Description of Artificial Sequence: Synthetic polypeptide
DEMEIVTTNPVATEQYGTVCSATGPVQFGND

SEQ ID NO: 77075 - protein, 32 aa, Artificial Sequence
  Description of Artificial Sequence: Synthetic polypeptide
DEMEIVTTNPVATEQYGTVCSATGPVQREGND

SEQ ID NO: 77076 - protein, 32 aa, Artificial Sequence
  Description of Artificial Sequence: Synthetic polypeptide
VEEELATTNPVAYEQWGSCSTWNHLDQRIGNR

SEQ ID NO: 77077 - protein, 32 aa, Artificial Sequence
  Description of Artificial Sequence: Synthetic polypeptide
DEEHIRTTNPVATEQYGSVMTNNSERVDNHVV

SEQ ID NO: 77078 - protein, 33 aa, Artificial Sequence
  Description of Artificial Sequence: Synthetic polypeptide
DEEHIRTTNPVATEQYGQSVSIGNAHQNVGSER

SEQ ID NO: 77079 - protein, 32 aa, Artificial Sequence
  Description of Artificial Sequence: Synthetic polypeptide
DEMEIVTTNPVATEQYGTVCSATNLVEFEGNQ

SEQ ID NO: 77080 - protein, 32 aa, Artificial Sequence
  Description of Artificial Sequence: Synthetic polypeptide
DEEEIRTTNPVAYEAYGSVPSYTAALGVVGSR

SEQ ID NO: 77081 - protein, 32 aa, Artificial Sequence
  Description of Artificial Sequence: Synthetic polypeptide
DEEEIRTTNPVAYEAYGSVPSYTAGGGVVGNR

SEQ ID NO: 77082 - protein, 33 aa, Artificial Sequence
  Description of Artificial Sequence: Synthetic polypeptide
DEEEIRTTNPVAYEAYGSVPSYTAGLSVVVGNR

SEQ ID NO: 77083 - protein, 34 aa, Artificial Sequence
  Description of Artificial Sequence: Synthetic polypeptide
AEEEIRTTNPVATEQYGSVSTTNNNLQEGETQED

SEQ ID NO: 77084 - protein, 31 aa, Artificial Sequence
  Description of Artificial Sequence: Synthetic polypeptide
DEEEIRTTNPCATEPYGSCATNHMNRGDNAM

SEQ ID NO: 77085 - protein, 33 aa, Artificial Sequence
  Description of Artificial Sequence: Synthetic polypeptide
VEEEVRTTNPVAYEQWGSVCSTWNNDDQRIGNR

SEQ ID NO: 77086 - protein, 32 aa, Artificial Sequence
  Description of Artificial Sequence: Synthetic polypeptide
DEAEIATTNPVAYEQYGSVATNLQAAGIAERE

SEQ ID NO: 77087 - protein, 32 aa, Artificial Sequence
  Description of Artificial Sequence: Synthetic polypeptide
DEEHIRTTNPVATEGWGSAVKATNNLQLGVER

SEQ ID NO: 77088 - protein, 33 aa, Artificial Sequence
  Description of Artificial Sequence: Synthetic polypeptide
DEEGIRTTNPVATEQYGSVSTGGLGDENGGNGD

SEQ ID NO: 77089 - protein, 31 aa, Artificial Sequence
  Description of Artificial Sequence: Synthetic polypeptide
DEMEIVTTNPVATEQYGTVCSTGPVEREGND

SEQ ID NO: 77090 - protein, 30 aa, Artificial Sequence
  Description of Artificial Sequence: Synthetic polypeptide
DEEEIRTTNPVATEQYGEVSPEPACNREEK

SEQ ID NO: 77091 - protein, 31 aa, Artificial Sequence
  Description of Artificial Sequence: Synthetic polypeptide
DEMEIVTTNPVATEQYGTVCSTGPVMREGND

SEQ ID NO: 77092 - protein, 33 aa, Artificial Sequence
  Description of Artificial Sequence: Synthetic polypeptide
DEEGIRTTNPVATEQYGSVCSNYLQINTIGIRD

SEQ ID NO: 77093 - protein, 31 aa, Artificial Sequence
  Description of Artificial Sequence: Synthetic polypeptide
DEEEIRTTNPVATEQYGEVSSEPACNMRGEK

SEQ ID NO: 77094 - protein, 28 aa, Artificial Sequence
  Description of Artificial Sequence: Synthetic peptide
VENEIITTNPVATECYGDVSTCLQHEEL

SEQ ID NO: 77095 - protein, 31 aa, Artificial Sequence
  Description of Artificial Sequence: Synthetic polypeptide
VENEIRTTNPVATEQYGCVSQTNQMQHAGHE

SEQ ID NO: 77096 - protein, 31 aa, Artificial Sequence
  Description of Artificial Sequence: Synthetic polypeptide
DEEEIRTTNPVATEQYGEVSSEPAGNMRGEK

SEQ ID NO: 77097 - protein, 32 aa, Artificial Sequence
  Description of Artificial Sequence: Synthetic polypeptide
DEEGIRTTNPAATEQYGSVSTGGQEDGGEGNT

SEQ ID NO: 77098 - protein, 33 aa, Artificial Sequence
  Description of Artificial Sequence: Synthetic polypeptide
DEEEIRTTNPCATEGYGSTCSCTNLSARGGDND

SEQ ID NO: 77099 - protein, 32 aa, Artificial Sequence
  Description of Artificial Sequence: Synthetic polypeptide
DEEEIRTTNPVATEQYGEVSSNVWQQALLQER

SEQ ID NO: 77100 - protein, 33 aa, Artificial Sequence
  Description of Artificial Sequence: Synthetic polypeptide
DEEEIRTTNPVATEQYGEVSSTDGIQEEGGGND

SEQ ID NO: 77101 - protein, 33 aa, Artificial Sequence
  Description of Artificial Sequence: Synthetic polypeptide
DEEEIRTTNPVATEQYGTSCSTENPHQNFISNQ

SEQ ID NO: 77102 - protein, 33 aa, Artificial Sequence
  Description of Artificial Sequence: Synthetic polypeptide
VENEVRTTNPVATEQYGSVSTWNLDETQIGNQE

SEQ ID NO: 77103 - protein, 28 aa, Artificial Sequence
  Description of Artificial Sequence: Synthetic peptide
VETEIASVNPVCTEQYGVVSDNLQSGNQ

SEQ ID NO: 77104 - protein, 33 aa, Artificial Sequence
  Description of Artificial Sequence: Synthetic polypeptide
DEEEIRTTNPVATEQYGEVSSTTDGQGEGGNNT

SEQ ID NO: 77105 - protein, 32 aa, Artificial Sequence
  Description of Artificial Sequence: Synthetic polypeptide
DEEEIRTTNPCATEGYGSCCSTNLAYGSNTQA

SEQ ID NO: 77106 - protein, 33 aa, Artificial Sequence
  Description of Artificial Sequence: Synthetic polypeptide
DEEEIRTTNPVATEQYGTIYESHINPLQRENNI

SEQ ID NO: 77107 - protein, 29 aa, Artificial Sequence
  Description of Artificial Sequence: Synthetic peptide
DDNEIACTNPVATEQYGEVSAETIQRGGR

SEQ ID NO: 77108 - protein, 34 aa, Artificial Sequence
  Description of Artificial Sequence: Synthetic polypeptide
DEEEIRTTNPVATEQYGEVSSTTNGPNRNGMNPV

SEQ ID NO: 77109 - protein, 29 aa, Artificial Sequence
  Description of Artificial Sequence: Synthetic peptide
DDNEIACTNPVATEQYGNVSAETIQRGGR

SEQ ID NO: 77110 - protein, 32 aa, Artificial Sequence
  Description of Artificial Sequence: Synthetic polypeptide
VSEEIRTTNPVAYEPYGSVISTNLSQEVTNRR

SEQ ID NO: 77111 - protein, 32 aa, Artificial Sequence
  Description of Artificial Sequence: Synthetic polypeptide
DEAEIATTNPVAYEQYGSVSANLQERGGDAEA

SEQ ID NO: 77112 - protein, 33 aa, Artificial Sequence
  Description of Artificial Sequence: Synthetic polypeptide
DEEEIRTTNPVATEQYGEVSSTTPAGNMRGNPK

SEQ ID NO: 77113 - protein, 30 aa, Artificial Sequence
  Description of Artificial Sequence: Synthetic polypeptide
VTEEIRTTNPCATETYGSVSVNTAQAPENR

SEQ ID NO: 77114 - protein, 33 aa, Artificial Sequence
  Description of Artificial Sequence: Synthetic polypeptide
DEAEIATTNPVAYEQYGSVSTDNSLFTVRGNEF

SEQ ID NO: 77115 - protein, 28 aa, Artificial Sequence
  Description of Artificial Sequence: Synthetic peptide
WEECIASVNPVCTEQYGVVSDNLQSGNQ

SEQ ID NO: 77116 - protein, 28 aa, Artificial Sequence
  Description of Artificial Sequence: Synthetic peptide
DDNEIACTNPVATEGYGEASENIQRGGR

SEQ ID NO: 77117 - protein, 33 aa, Artificial Sequence
  Description of Artificial Sequence: Synthetic polypeptide
DEEEIRTTNPVATEQYGEVSSTVTDGQGEGGNP

SEQ ID NO: 77118 - protein, 33 aa, Artificial Sequence
  Description of Artificial Sequence: Synthetic polypeptide
DEEGIRTTNPVATEQYGSVSTGGLGDNEGQNGQ

SEQ ID NO: 77119 - protein, 35 aa, Artificial Sequence
  Description of Artificial Sequence: Synthetic polypeptide
AEEEIRTTNPVATEQYGSVSTTNNNLQQNQGNEQS

SEQ ID NO: 77120 - protein, 32 aa, Artificial Sequence
  Description of Artificial Sequence: Synthetic polypeptide
DEMEIVTTNPVATEQYGTVCSTDGLVMFEGNR

SEQ ID NO: 77121 - protein, 30 aa, Artificial Sequence
  Description of Artificial Sequence: Synthetic polypeptide
DEMEIVTTNPVATEQYGTVCSTDGPEFGND

SEQ ID NO: 77122 - protein, 28 aa, Artificial Sequence
  Description of Artificial Sequence: Synthetic peptide
SEEEIRCTNPVATEQYGEASEVLQHEEK

SEQ ID NO: 77123 - protein, 28 aa, Artificial Sequence
  Description of Artificial Sequence: Synthetic peptide
SEEEIRCTNPVATEQYGEASEVLMHEER

SEQ ID NO: 77124 - protein, 34 aa, Artificial Sequence
  Description of Artificial Sequence: Synthetic polypeptide
AEEEIRTTNPVATEQYGSVSTTNNNLQQEGETSE

SEQ ID NO: 77125 - protein, 33 aa, Artificial Sequence
  Description of Artificial Sequence: Synthetic polypeptide
DEEEIRTTNPVATEQYGAVVTDTNLFGGGTNGQ

SEQ ID NO: 77126 - protein, 31 aa, Artificial Sequence
  Description of Artificial Sequence: Synthetic polypeptide
DEAEIATTNPVAYEQYGSVATNLQAGDQAAE

SEQ ID NO: 77127 - protein, 32 aa, Artificial Sequence
  Description of Artificial Sequence: Synthetic polypeptide
DEAEIATTNPVAYEQYGSVATNLQAGEPNSFD

SEQ ID NO: 77128 - protein, 28 aa, Artificial Sequence
  Description of Artificial Sequence: Synthetic peptide
SEEEIRCTNPVATEQYGEAPEVLMRGEK

SEQ ID NO: 77129 - protein, 32 aa, Artificial Sequence
  Description of Artificial Sequence: Synthetic polypeptide
DEAEIATTNPVAYEQYGSVATNLQATPDGSRN

SEQ ID NO: 77130 - protein, 31 aa, Artificial Sequence
  Description of Artificial Sequence: Synthetic polypeptide
DEAEIATTNPVAYEQYGSVATNLQGGVGQDD

SEQ ID NO: 77131 - protein, 31 aa, Artificial Sequence
  Description of Artificial Sequence: Synthetic polypeptide
DEAEIATTNPVAYEQYGSVATNLQGTENNDD

SEQ ID NO: 77132 - protein, 32 aa, Artificial Sequence
  Description of Artificial Sequence: Synthetic polypeptide
DEEEIRTTNPVATEQYGEVGATILNQPSSNIW

SEQ ID NO: 77133 - protein, 32 aa, Artificial Sequence
  Description of Artificial Sequence: Synthetic polypeptide
SEEEIRCTNPVATECWGSVSCINLPQREGENG

SEQ ID NO: 77134 - protein, 31 aa, Artificial Sequence
  Description of Artificial Sequence: Synthetic polypeptide
DEMEIVTTNPVATEQYGTVCSTDGPQFEGTR

SEQ ID NO: 77135 - protein, 31 aa, Artificial Sequence
  Description of Artificial Sequence: Synthetic polypeptide
DEAEIATTNPVAYEQYGSVATNLQNPGAEAE

SEQ ID NO: 77136 - protein, 35 aa, Artificial Sequence
  Description of Artificial Sequence: Synthetic polypeptide
AEEEIRTTNPVATEQYGSVSTTNNNLQQIGTNEGQ

SEQ ID NO: 77137 - protein, 35 aa, Artificial Sequence
  Description of Artificial Sequence: Synthetic polypeptide
AEEEIRTTNPVATEQYGSVSTTNNNLQQIGTNEGT

SEQ ID NO: 77138 - protein, 30 aa, Artificial Sequence
  Description of Artificial Sequence: Synthetic polypeptide
DEEEIRTTNPCATEPYGNCATNLATAGDNA

SEQ ID NO: 77139 - protein, 30 aa, Artificial Sequence
  Description of Artificial Sequence: Synthetic polypeptide
DEAEIATTNPVAYEQYGSVATNLQSDAEAE

SEQ ID NO: 77140 - protein, 33 aa, Artificial Sequence
  Description of Artificial Sequence: Synthetic polypeptide
DEEGIRTTNPVATEQYGVVSTNGEGQGGGGNIT

SEQ ID NO: 77141 - protein, 33 aa, Artificial Sequence
  Description of Artificial Sequence: Synthetic polypeptide
DEEGIRTTNPVATEQYGVVSTDNGEGQGGGNQI

SEQ ID NO: 77142 - protein, 33 aa, Artificial Sequence
  Description of Artificial Sequence: Synthetic polypeptide
DEEGIRTTNPVATEQYGSVSVTGLGDNEGQNEQ

SEQ ID NO: 77143 - protein, 33 aa, Artificial Sequence
  Description of Artificial Sequence: Synthetic polypeptide
DDMEIRTTNPVATEQYGSVCSTGNDLQSFGSDQ

SEQ ID NO: 77144 - protein, 34 aa, Artificial Sequence
  Description of Artificial Sequence: Synthetic polypeptide
AEEEIRTTNPVATEQYGSVSTTNNNLQQNENEQV

SEQ ID NO: 77145 - protein, 33 aa, Artificial Sequence
  Description of Artificial Sequence: Synthetic polypeptide
DEEGIRTTNPVATEQYGSVSTGNADDGNGQNEG

SEQ ID NO: 77146 - protein, 32 aa, Artificial Sequence
  Description of Artificial Sequence: Synthetic polypeptide
DEAEIATTNPVAYEQYGSVATTNLQTANPGER

SEQ ID NO: 77147 - protein, 33 aa, Artificial Sequence
  Description of Artificial Sequence: Synthetic polypeptide
DEEGIRTTNPVATEQYGSVSTGLGDGEGQNGQG

SEQ ID NO: 77148 - protein, 32 aa, Artificial Sequence
  Description of Artificial Sequence: Synthetic polypeptide
SEEEIRCTNPVATEQWGSVSCINLPMDRGENG

SEQ ID NO: 77149 - protein, 34 aa, Artificial Sequence
  Description of Artificial Sequence: Synthetic polypeptide
AEEEIRTTNPVATEQYGSVSTTNNNLANTETGNG

SEQ ID NO: 77150 - protein, 28 aa, Artificial Sequence
  Description of Artificial Sequence: Synthetic peptide
YEECIASVNPVSTEQYGVVSDNLQSGNQ

SEQ ID NO: 77151 - protein, 34 aa, Artificial Sequence
  Description of Artificial Sequence: Synthetic polypeptide
DENEAEIRTTNPVAYEHWGSVSTNLNQGEGQNGR

SEQ ID NO: 77152 - protein, 32 aa, Artificial Sequence
  Description of Artificial Sequence: Synthetic polypeptide
DEEEIRTTNPVATEQYGSYSITEQEQLGELEE

SEQ ID NO: 77153 - protein, 28 aa, Artificial Sequence
  Description of Artificial Sequence: Synthetic peptide
YEEEIASVNPCCTEQYGVVSDNLQSGNQ

SEQ ID NO: 77154 - protein, 34 aa, Artificial Sequence
  Description of Artificial Sequence: Synthetic polypeptide
DEEEIRTTNPVATEQYGIVSTMTNGQEGGGENGD

SEQ ID NO: 77155 - protein, 34 aa, Artificial Sequence
  Description of Artificial Sequence: Synthetic polypeptide
AEEEIRTTNPVATEQYGSVSTTNNQQLQNNNTDN

SEQ ID NO: 77156 - protein, 28 aa, Artificial Sequence
  Description of Artificial Sequence: Synthetic peptide
YEEEIASVNPCCTEQYGVVSDNLQSGTR

SEQ ID NO: 77157 - protein, 33 aa, Artificial Sequence
  Description of Artificial Sequence: Synthetic polypeptide
DEEEIRTTNPVATEQYGSYSGVNDQVRGDEDQI

SEQ ID NO: 77158 - protein, 32 aa, Artificial Sequence
  Description of Artificial Sequence: Synthetic polypeptide
DEEEIRTTNPCATEAYGSVATTNQDGQQGNNA

SEQ ID NO: 77159 - protein, 28 aa, Artificial Sequence
  Description of Artificial Sequence: Synthetic peptide
YEEEIASVNPCCTEQYGYVSDNLQSGNQ

SEQ ID NO: 77160 - protein, 28 aa, Artificial Sequence
  Description of Artificial Sequence: Synthetic peptide
YEEEIASVNPCSTEQYGVVSCNLQSGNQ

SEQ ID NO: 77161 - protein, 30 aa, Artificial Sequence
  Description of Artificial Sequence: Synthetic polypeptide
DDSEIASTNPVATEGWGSVSCNEQDRVGNR

SEQ ID NO: 77162 - protein, 31 aa, Artificial Sequence
  Description of Artificial Sequence: Synthetic polypeptide
DENEIACTNPVATEQYGTASATDNPVQRGGR

SEQ ID NO: 77163 - protein, 34 aa, Artificial Sequence
  Description of Artificial Sequence: Synthetic polypeptide
AEEEIRTTNPVATEQYGSVSTTNNQQQANGNNVD

SEQ ID NO: 77164 - protein, 31 aa, Artificial Sequence
  Description of Artificial Sequence: Synthetic polypeptide
DEEEIRTTNPVAYEPYGSLVNCTNTSQGVND

SEQ ID NO: 77165 - protein, 34 aa, Artificial Sequence
  Description of Artificial Sequence: Synthetic polypeptide
DEEEIRTTNPVAYEPYGSLVNWNLSQRTGGNNRG

SEQ ID NO: 77166 - protein, 35 aa, Artificial Sequence
  Description of Artificial Sequence: Synthetic polypeptide
DEEEIRTTNPVATEQYGIVTVSCTNANQRGGMNSF

SEQ ID NO: 77167 - protein, 28 aa, Artificial Sequence
  Description of Artificial Sequence: Synthetic peptide
YEEEIASVNPDCTEQYGVVSDNLQSGNQ

SEQ ID NO: 77168 - protein, 33 aa, Artificial Sequence
  Description of Artificial Sequence: Synthetic polypeptide
DEEEIRTTNPVATEQYGKISCTNNEPSQRTVNQ

SEQ ID NO: 77169 - protein, 30 aa, Artificial Sequence
  Description of Artificial Sequence: Synthetic polypeptide
DEEEISTTNPVAYEQYGCVWTNLQYFDSDQ

SEQ ID NO: 77170 - protein, 33 aa, Artificial Sequence
  Description of Artificial Sequence: Synthetic polypeptide
DEEEIRTTNPVATEQYGAVMGTNLIVGGNGNGD

SEQ ID NO: 77171 - protein, 34 aa, Artificial Sequence
  Description of Artificial Sequence: Synthetic polypeptide
AEEEIRTTNPVATEQYGSVSTTNNQQQDEEGNNE

SEQ ID NO: 77172 - protein, 28 aa, Artificial Sequence
  Description of Artificial Sequence: Synthetic peptide
YEEEIASVNPDLTEQYGVVSDNLQSGNQ

SEQ ID NO: 77173 - protein, 34 aa, Artificial Sequence
  Description of Artificial Sequence: Synthetic polypeptide
AEEEIRTTNPVATEQYGSVSTTNNQQQGNDENEF

SEQ ID NO: 77174 - protein, 30 aa, Artificial Sequence
  Description of Artificial Sequence: Synthetic polypeptide
DENEIACTNPVATEQYGTISMNLQQRNGGH

SEQ ID NO: 77175 - protein, 33 aa, Artificial Sequence
  Description of Artificial Sequence: Synthetic polypeptide
DEEEIRTTNPVATEQYGAVMGTDQNEQGGNNQT

SEQ ID NO: 77176 - protein, 30 aa, Artificial Sequence
  Description of Artificial Sequence: Synthetic polypeptide
DENEIACTNPVATEQYGTVCSENPQFEGGR

SEQ ID NO: 77177 - protein, 32 aa, Artificial Sequence
  Description of Artificial Sequence: Synthetic polypeptide
DEEEIRTTNPCATEAYGSVATTNNDGQQQGNA

SEQ ID NO: 77178 - protein, 31 aa, Artificial Sequence
  Description of Artificial Sequence: Synthetic polypeptide
DEEEIRTTNPCATEAYGSVATTNNDGQGTNA

SEQ ID NO: 77179 - protein, 32 aa, Artificial Sequence
  Description of Artificial Sequence: Synthetic polypeptide
DENEIACTNPVATEQYGSVSTNGPNMRNGGPR

SEQ ID NO: 77180 - protein, 31 aa, Artificial Sequence
  Description of Artificial Sequence: Synthetic polypeptide
DENEIACTNPVATEQYGSVSEPNGQMRGGPV

SEQ ID NO: 77181 - protein, 29 aa, Artificial Sequence
  Description of Artificial Sequence: Synthetic peptide
DENEIACTNPVATEQYGSVSEDLEDHGGL

SEQ ID NO: 77182 - protein, 28 aa, Artificial Sequence
  Description of Artificial Sequence: Synthetic peptide
YEEEIASVNPCCTEQYGIVSDNLQSGTR

SEQ ID NO: 77183 - protein, 32 aa, Artificial Sequence
  Description of Artificial Sequence: Synthetic polypeptide
AEDEIRATNPVATEQYGSVETTNLQSGNNNQG

SEQ ID NO: 77184 - protein, 29 aa, Artificial Sequence
  Description of Artificial Sequence: Synthetic peptide
YEEEIASTNPVCTEQYGVVSDNPQSEGNQ

SEQ ID NO: 77185 - protein, 32 aa, Artificial Sequence
  Description of Artificial Sequence: Synthetic polypeptide
AEDEIRATNPVATEQYGSVETTNLQQSGNNNQ

SEQ ID NO: 77186 - protein, 30 aa, Artificial Sequence
  Description of Artificial Sequence: Synthetic polypeptide
DDSEIACTNPVATEQYGNVAAETLQSRGNR

SEQ ID NO: 77187 - protein, 29 aa, Artificial Sequence
  Description of Artificial Sequence: Synthetic peptide
DDSEIACTNPVATEQYGNVSAETIQRGGR

SEQ ID NO: 77188 - protein, 31 aa, Artificial Sequence
  Description of Artificial Sequence: Synthetic polypeptide
DENEIACTNPVATEQYGSVSATNLEDHEGEL

SEQ ID NO: 77189 - protein, 36 aa, Artificial Sequence
  Description of Artificial Sequence: Synthetic polypeptide
DEEEIRTTNPVATEQYGISVTSCTENELSQPTGGMR

SEQ ID NO: 77190 - protein, 30 aa, Artificial Sequence
  Description of Artificial Sequence: Synthetic polypeptide
YEEEIASTNPVCTEQYGVVSSDNLPQSGNQ

SEQ ID NO: 77191 - protein, 33 aa, Artificial Sequence
  Description of Artificial Sequence: Synthetic polypeptide
DEEEIRTTNPVAYEPYGKVSYTNEWSQQAGNPR

SEQ ID NO: 77192 - protein, 31 aa, Artificial Sequence
  Description of Artificial Sequence: Synthetic polypeptide
DEEEIRTTNPVAYEPYGNVNCTLNSSQRVNK

SEQ ID NO: 77193 - protein, 29 aa, Artificial Sequence
  Description of Artificial Sequence: Synthetic peptide
YEEEIASTNPVSTEGYGVVSNNIQSRGNQ

SEQ ID NO: 77194 - protein, 33 aa, Artificial Sequence
  Description of Artificial Sequence: Synthetic polypeptide
DEEEIRTTNPVAYEPYGNVSVTNLSTRDGGNQA

SEQ ID NO: 77195 - protein, 33 aa, Artificial Sequence
  Description of Artificial Sequence: Synthetic polypeptide
DEEEIRTTNPVAYEPYGQSCSQNELSQRTGGSR

SEQ ID NO: 77196 - protein, 33 aa, Artificial Sequence
  Description of Artificial Sequence: Synthetic polypeptide
DEEEIRTTNPVATEQYGKTVPNYTGNISQRVNK

SEQ ID NO: 77197 - protein, 32 aa, Artificial Sequence
  Description of Artificial Sequence: Synthetic polypeptide
DEEEIRTTNPCATEAYGSVTNSTNLAGTNNTD

SEQ ID NO: 77198 - protein, 34 aa, Artificial Sequence
  Description of Artificial Sequence: Synthetic polypeptide
AEEEIRTTNPVATEQYGSVSTTNNQNSEGGNNEQ

SEQ ID NO: 77199 - protein, 34 aa, Artificial Sequence
  Description of Artificial Sequence: Synthetic polypeptide
AEEEIRTTNPVATEQYGSVSTTNNQNSEGGNTQG

SEQ ID NO: 77200 - protein, 28 aa, Artificial Sequence
  Description of Artificial Sequence: Synthetic peptide
YEEEIASVCPVCTEQYGEVSDNLQSGNQ

SEQ ID NO: 77201 - protein, 28 aa, Artificial Sequence
  Description of Artificial Sequence: Synthetic peptide
YEEEIASVCPVCTEQYGVVSDNLQSGNQ

SEQ ID NO: 77202 - protein, 34 aa, Artificial Sequence
  Description of Artificial Sequence: Synthetic polypeptide
DEEEIRTTNPVATEQYGIVGNTDNLQQGEGNGGE

SEQ ID NO: 77203 - protein, 34 aa, Artificial Sequence
  Description of Artificial Sequence: Synthetic polypeptide
DEEEITTTNPVATEQYGSVSQTNSLQQVRDPEVG

SEQ ID NO: 77204 - protein, 34 aa, Artificial Sequence
  Description of Artificial Sequence: Synthetic polypeptide
AEEEIRTTNPVATEQYGSVSTTNNQNSEQGTNSQ

SEQ ID NO: 77205 - protein, 33 aa, Artificial Sequence
  Description of Artificial Sequence: Synthetic polypeptide
DEEEIRTTNPCATEAYGSVSVSNTNLEAGNNAT

SEQ ID NO: 77206 - protein, 28 aa, Artificial Sequence
  Description of Artificial Sequence: Synthetic peptide
YEEEIASVNGVCTEQYGVVSDNLQSGNQ

SEQ ID NO: 77207 - protein, 28 aa, Artificial Sequence
  Description of Artificial Sequence: Synthetic peptide
YEEEIASVNPACTEQYGVVSDNLQSGNQ

SEQ ID NO: 77208 - protein, 32 aa, Artificial Sequence
  Description of Artificial Sequence: Synthetic polypeptide
DEEEIRTTNPCATEAYGSVATVNQDGQEGNNA

SEQ ID NO: 77209 - protein, 34 aa, Artificial Sequence
  Description of Artificial Sequence: Synthetic polypeptide
AEEEIRTTNPVATEQYGSVSTTNNQQGEDEENDG

SEQ ID NO: 77210 - protein, 33 aa, Artificial Sequence
  Description of Artificial Sequence: Synthetic polypeptide
DEEEIRTTNPVATEQYGSYSNTMIVQMERNRNW

SEQ ID NO: 77211 - protein, 33 aa, Artificial Sequence
  Description of Artificial Sequence: Synthetic polypeptide
DEEEIRTTNPVATEQYGAVMTGNDQGGFEGNNG

SEQ ID NO: 77212 - protein, 32 aa, Artificial Sequence
  Description of Artificial Sequence: Synthetic polypeptide
DEEEIRTTNPCATEAYGSVATTNDQGQQGNNT

SEQ ID NO: 77213 - protein, 33 aa, Artificial Sequence
  Description of Artificial Sequence: Synthetic polypeptide
DEEEIRTTNPVATEQYGAVMGTDENEQGGGNNQ

SEQ ID NO: 77214 - protein, 34 aa, Artificial Sequence
  Description of Artificial Sequence: Synthetic polypeptide
AEEEIRTTNPVATEQYGSVSTTNNQQQGNEENQD

SEQ ID NO: 77215 - protein, 28 aa, Artificial Sequence
  Description of Artificial Sequence: Synthetic peptide
YEEEIASVNPMCTEQYGVVSDNLQSGNQ

SEQ ID NO: 77216 - protein, 31 aa, Artificial Sequence
  Description of Artificial Sequence: Synthetic polypeptide
DEEEIRTTNPVAYEPYGSVNCTVNISQAVNQ

SEQ ID NO: 77217 - protein, 32 aa, Artificial Sequence
  Description of Artificial Sequence: Synthetic polypeptide
DEEEIRTTNPAATEQYGSVSGNIFDDGGNEDE

SEQ ID NO: 77218 - protein, 31 aa, Artificial Sequence
  Description of Artificial Sequence: Synthetic polypeptide
DEEEIRTTNPAATEQYGSVPTVTLADRTVVE

SEQ ID NO: 77219 - protein, 32 aa, Artificial Sequence
  Description of Artificial Sequence: Synthetic polypeptide
DEEEIRTTNPVATEQYGAVLCTDWSQRGGIKD

SEQ ID NO: 77220 - protein, 31 aa, Artificial Sequence
  Description of Artificial Sequence: Synthetic polypeptide
DEEEIRTTNPAATEQYGSVPGDLANGQGNEE

SEQ ID NO: 77221 - protein, 32 aa, Artificial Sequence
  Description of Artificial Sequence: Synthetic polypeptide
DEEEISTTNPVAYEAYGSVPSYTDGLGVVGNR

SEQ ID NO: 77222 - protein, 28 aa, Artificial Sequence
  Description of Artificial Sequence: Synthetic peptide
YEEEIASVNPNCTEQYGVVSDNLQSGNQ

SEQ ID NO: 77223 - protein, 29 aa, Artificial Sequence
  Description of Artificial Sequence: Synthetic peptide
DENEIASTNPVSTEQYGVVSDENIQQGNH

SEQ ID NO: 77224 - protein, 33 aa, Artificial Sequence
  Description of Artificial Sequence: Synthetic polypeptide
DEEEISTTNPVATGQYGSVSMTPAWNEQDGNTW

SEQ ID NO: 77225 - protein, 28 aa, Artificial Sequence
  Description of Artificial Sequence: Synthetic peptide
YEEEIASVNPPCTEQYGVVSDNLQSGNQ

SEQ ID NO: 77226 - protein, 32 aa, Artificial Sequence
  Description of Artificial Sequence: Synthetic polypeptide
DEEEIRTTNPVAYEPYGSVPSYTGLGVVGNPC

SEQ ID NO: 77227 - protein, 33 aa, Artificial Sequence
  Description of Artificial Sequence: Synthetic polypeptide
AEEEIRTTNPVATEQYGSVSTTNNQQQQGTDTQ

SEQ ID NO: 77228 - protein, 31 aa, Artificial Sequence
  Description of Artificial Sequence: Synthetic polypeptide
DEEEIRTTNPVAYEPYGSVNCTNSSQFEVNK

SEQ ID NO: 77229 - protein, 34 aa, Artificial Sequence
  Description of Artificial Sequence: Synthetic polypeptide
DEEEIRTTNPAATEQYGSVNMQTNGQERGQNGAV

SEQ ID NO: 77230 - protein, 35 aa, Artificial Sequence
  Description of Artificial Sequence: Synthetic polypeptide
DEEEIRTTNPVATEQYGAVISDTDNLQTNEGGNND

SEQ ID NO: 77231 - protein, 33 aa, Artificial Sequence
  Description of Artificial Sequence: Synthetic polypeptide
DEAEICTTNPVATECYGSVSTGNLQGGMGGNTD

SEQ ID NO: 77232 - protein, 31 aa, Artificial Sequence
  Description of Artificial Sequence: Synthetic polypeptide
DEEEIRTTNPAATEQYGSVNLNIFDDGNQDE

SEQ ID NO: 77233 - protein, 28 aa, Artificial Sequence
  Description of Artificial Sequence: Synthetic peptide
DENEIASVNPVCTEQYGDVSDNLQSGDA

SEQ ID NO: 77234 - protein, 31 aa, Artificial Sequence
  Description of Artificial Sequence: Synthetic polypeptide
DEEEIRTTNPAATEQYGSVNLNIFDDGGNGT

SEQ ID NO: 77235 - protein, 28 aa, Artificial Sequence
  Description of Artificial Sequence: Synthetic peptide
YEEEIASVNPQCTEQYGVVSDNLQSGNQ

SEQ ID NO: 77236 - protein, 33 aa, Artificial Sequence
  Description of Artificial Sequence: Synthetic polypeptide
DEEEISTTNPVATEQYGVVCSTGELQNFGSDRA

SEQ ID NO: 77237 - protein, 31 aa, Artificial Sequence
  Description of Artificial Sequence: Synthetic polypeptide
DEEEIRTTNPAATEQYGSVNLNIFDDGGNET

SEQ ID NO: 77238 - protein, 33 aa, Artificial Sequence
  Description of Artificial Sequence: Synthetic polypeptide
DEEEIRTTNPVATEQYGAVGSDDNGQQEGNGGE

SEQ ID NO: 77239 - protein, 31 aa, Artificial Sequence
  Description of Artificial Sequence: Synthetic polypeptide
DEEEIRTTNPAATEQYGSVNLNIDDNGGNGD

SEQ ID NO: 77240 - protein, 34 aa, Artificial Sequence
  Description of Artificial Sequence: Synthetic polypeptide
DEEEIRTTNPVAYEPYGSVSPTGNELSQETGNVG

SEQ ID NO: 77241 - protein, 28 aa, Artificial Sequence
  Description of Artificial Sequence: Synthetic peptide
YEEEIASVNPSCTEQYGVVSDNLQSGNQ

SEQ ID NO: 77242 - protein, 29 aa, Artificial Sequence
  Description of Artificial Sequence: Synthetic peptide
DENEIASVNPVCTEQYGVVSDNLQNSGNQ

SEQ ID NO: 77243 - protein, 35 aa, Artificial Sequence
  Description of Artificial Sequence: Synthetic polypeptide
DEEEIRTTNPVATEQYGAVISDTNLQTNEGGNEDT

SEQ ID NO: 77244 - protein, 33 aa, Artificial Sequence
  Description of Artificial Sequence: Synthetic polypeptide
AEDEIRATNPVATEQYGSVSNTTNLQSGTNQQD

SEQ ID NO: 77245 - protein, 29 aa, Artificial Sequence
  Description of Artificial Sequence: Synthetic peptide
DENEIASTNPVCTEQYGVVSDNLMNAGNQ

SEQ ID NO: 77246 - protein, 34 aa, Artificial Sequence
  Description of Artificial Sequence: Synthetic polypeptide
AEEEIRTTNPVATEQYGSVSTTNNQQQQDEGNAG

SEQ ID NO: 77247 - protein, 32 aa, Artificial Sequence
  Description of Artificial Sequence: Synthetic polypeptide
DEEEIRTTNPCATEAYGSVATTNDNGQQGTND

SEQ ID NO: 77248 - protein, 32 aa, Artificial Sequence
  Description of Artificial Sequence: Synthetic polypeptide
DEEEISTTNPVAYEQYGCVCSTNLQNFNSQQA

SEQ ID NO: 77249 - protein, 30 aa, Artificial Sequence
  Description of Artificial Sequence: Synthetic polypeptide
CENEINTTNPVATEQFGSVTTLDNLQQDNN

SEQ ID NO: 77250 - protein, 29 aa, Artificial Sequence
  Description of Artificial Sequence: Synthetic peptide
YEEEIASVNPDVCTEQYGVVSDNLQSGNQ

SEQ ID NO: 77251 - protein, 28 aa, Artificial Sequence
  Description of Artificial Sequence: Synthetic peptide
YEEEIASVNPECTEQYGVVSDNLQSGNQ

SEQ ID NO: 77252 - protein, 31 aa, Artificial Sequence
  Description of Artificial Sequence: Synthetic polypeptide
DEEEIRTTNPCATEAYGSVATNTDGNQGNEA

SEQ ID NO: 77253 - protein, 35 aa, Artificial Sequence
  Description of Artificial Sequence: Synthetic polypeptide
DEEEIRTTNPVATEQYGKTVSCTNPSAERGGNERQ

SEQ ID NO: 77254 - protein, 30 aa, Artificial Sequence
  Description of Artificial Sequence: Synthetic polypeptide
DEEEIRTTNPCATEAYGSVAPPLHEVRGQQ

SEQ ID NO: 77255 - protein, 29 aa, Artificial Sequence
  Description of Artificial Sequence: Synthetic peptide
DENEIACTNPVSTEGYGEASENLQRVGGR

SEQ ID NO: 77256 - protein, 33 aa, Artificial Sequence
  Description of Artificial Sequence: Synthetic polypeptide
DEEEISTTNPVAYEQYGCNVSCTNLSQSGGNLS

SEQ ID NO: 77257 - protein, 34 aa, Artificial Sequence
  Description of Artificial Sequence: Synthetic polypeptide
AEEEIRTTNPVATEQYGSVSTTNNQQQGNGNTNT

SEQ ID NO: 77258 - protein, 32 aa, Artificial Sequence
  Description of Artificial Sequence: Synthetic polypeptide
DEAEICTTNPVATECYGSVSTGNLQDEHNNEN

SEQ ID NO: 77259 - protein, 33 aa, Artificial Sequence
  Description of Artificial Sequence: Synthetic polypeptide
DEAEICTTNPVATECYGSVSTGNLQGDAGGNES

SEQ ID NO: 77260 - protein, 31 aa, Artificial Sequence
  Description of Artificial Sequence: Synthetic polypeptide
DEEEIRTTNPVAYEPYGSVNCTNSSPRVQNK

SEQ ID NO: 77261 - protein, 34 aa, Artificial Sequence
  Description of Artificial Sequence: Synthetic polypeptide
DEEEIRTTNPVATEQYGSYNSTNDDQRENEISDG

SEQ ID NO: 77262 - protein, 32 aa, Artificial Sequence
  Description of Artificial Sequence: Synthetic polypeptide
DEEEIRTTNPVATEQYGKVIPINTSQTGGNVN

SEQ ID NO: 77263 - protein, 28 aa, Artificial Sequence
  Description of Artificial Sequence: Synthetic peptide
YEEEIASVNPGCTEQYGVVSDNLQSGNQ

SEQ ID NO: 77264 - protein, 30 aa, Artificial Sequence
  Description of Artificial Sequence: Synthetic polypeptide
DENEIACTNPVSTEGYGNVSANTLQSRGGR

SEQ ID NO: 77265 - protein, 33 aa, Artificial Sequence
  Description of Artificial Sequence: Synthetic polypeptide
DEEEISTTNPVAYEHYGSVPSQNLSQSQGNDAR

SEQ ID NO: 77266 - protein, 33 aa, Artificial Sequence
  Description of Artificial Sequence: Synthetic polypeptide
DEEEIRTTNPVATEQYGKVSCTANLSADPVTNM

SEQ ID NO: 77267 - protein, 30 aa, Artificial Sequence
  Description of Artificial Sequence: Synthetic polypeptide
DEEEIRTTNPAATEQYGSVVPGDLANGQGE

SEQ ID NO: 77268 - protein, 29 aa, Artificial Sequence
  Description of Artificial Sequence: Synthetic peptide
DENEIACTNPVSTEQYGEASENLQQQGGR

SEQ ID NO: 77269 - protein, 28 aa, Artificial Sequence
  Description of Artificial Sequence: Synthetic peptide
YEEEIASVNPHCTEQYGVVSDNLQSGNQ

SEQ ID NO: 77270 - protein, 30 aa, Artificial Sequence
  Description of Artificial Sequence: Synthetic polypeptide
DEEEIRTTNPVAYEPYGSVNCTNISQPVQQ

SEQ ID NO: 77271 - protein, 28 aa, Artificial Sequence
  Description of Artificial Sequence: Synthetic peptide
YEEEIASVNPICTEQYGVVSDNLQSGNQ

SEQ ID NO: 77272 - protein, 30 aa, Artificial Sequence
  Description of Artificial Sequence: Synthetic polypeptide
DEEEIRTTNPVAYEPYGSVNCTNISQQVSK

SEQ ID NO: 77273 - protein, 28 aa, Artificial Sequence
  Description of Artificial Sequence: Synthetic peptide
YEEEIASVNPICTEQYGVVSENLQSGNQ

SEQ ID NO: 77274 - protein, 28 aa, Artificial Sequence
  Description of Artificial Sequence: Synthetic peptide
YEEEIASVNPLCTEQYGVVSDNLQSGNQ

SEQ ID NO: 77275 - protein, 33 aa, Artificial Sequence
  Description of Artificial Sequence: Synthetic polypeptide
DEEEIRTTNPCATEAYGSTCSCTNLSARGGNNW

SEQ ID NO: 77276 - protein, 32 aa, Artificial Sequence
  Description of Artificial Sequence: Synthetic polypeptide
YEEDEIGTTNPYATESYGSVSPTGNVQGYGNR

SEQ ID NO: 77277 - protein, 33 aa, Artificial Sequence
  Description of Artificial Sequence: Synthetic polypeptide
DEEEIRTTNPCATEAYGSVTVSTNLEAGNNNTG

SEQ ID NO: 77278 - protein, 31 aa, Artificial Sequence
  Description of Artificial Sequence: Synthetic polypeptide
DENEIACTNPVATEQYGSVSAEDLQDRGEDL

SEQ ID NO: 77279 - protein, 33 aa, Artificial Sequence
  Description of Artificial Sequence: Synthetic polypeptide
DEEEIRTTNPVATEQYGAVSTGNGDDEGGEGNI

SEQ ID NO: 77280 - protein, 32 aa, Artificial Sequence
  Description of Artificial Sequence: Synthetic polypeptide
DENEIACTNPVATECYGEVSENLPQDREGENR

SEQ ID NO: 77281 - protein, 33 aa, Artificial Sequence
  Description of Artificial Sequence: Synthetic polypeptide
DEEEIRTTNPVAYEHYGSVPSQNLSDNSQGNAR

SEQ ID NO: 77282 - protein, 29 aa, Artificial Sequence
  Description of Artificial Sequence: Synthetic peptide
DENEIACTNPVATEGYGEASENIQSRGGR

SEQ ID NO: 77283 - protein, 32 aa, Artificial Sequence
  Description of Artificial Sequence: Synthetic polypeptide
DEEEIRTTNPCATECYGSVCSKTNDAHQGNQW

SEQ ID NO: 77284 - protein, 28 aa, Artificial Sequence
  Description of Artificial Sequence: Synthetic peptide
YEEEIASCNPVCTEIYGVVSDNLQSGNQ

SEQ ID NO: 77285 - protein, 33 aa, Artificial Sequence
  Description of Artificial Sequence: Synthetic polypeptide
DEEEIRTTNPVATEQYGSYTIMTDEGQERGNGE

SEQ ID NO: 77286 - protein, 28 aa, Artificial Sequence
  Description of Artificial Sequence: Synthetic peptide
YEEEIASCNPVCTEQYGVVSDNLQSANQ

SEQ ID NO: 77287 - protein, 35 aa, Artificial Sequence
  Description of Artificial Sequence: Synthetic polypeptide
AEEEIRTTNPVATEQYGSVSTTNNQLQGDEQGGND

SEQ ID NO: 77288 - protein, 33 aa, Artificial Sequence
  Description of Artificial Sequence: Synthetic polypeptide
DEEEIRTTNPVATEQYGSYSVTNELQAETEEEQ

SEQ ID NO: 77289 - protein, 29 aa, Artificial Sequence
  Description of Artificial Sequence: Synthetic peptide
YEEEIASTNPICTEQYGVVSDNLQSKGNQ

SEQ ID NO: 77290 - protein, 32 aa, Artificial Sequence
  Description of Artificial Sequence: Synthetic polypeptide
DEEEIRTTNPVATEQYGAVSSTQGMGGNGNGD

SEQ ID NO: 77291 - protein, 30 aa, Artificial Sequence
  Description of Artificial Sequence: Synthetic polypeptide
DENEIACTNPVATEQYGDVSENEQNAAGGR

SEQ ID NO: 77292 - protein, 33 aa, Artificial Sequence
  Description of Artificial Sequence: Synthetic polypeptide
DEEEIRTTNPVAYEKYGQSVNETNDLLQRGGEQ

SEQ ID NO: 77293 - protein, 32 aa, Artificial Sequence
  Description of Artificial Sequence: Synthetic polypeptide
YEEEIASTNPVATEQYGSVSADNLQDHEGNDQ

SEQ ID NO: 77294 - protein, 32 aa, Artificial Sequence
  Description of Artificial Sequence: Synthetic polypeptide
DEAEICTTNPVATECYGSVSTDNGLGNGMDDR

SEQ ID NO: 77295 - protein, 33 aa, Artificial Sequence
  Description of Artificial Sequence: Synthetic polypeptide
DEEEIVTTNPVATEQYGSVSTNEINQDENNVLW

SEQ ID NO: 77296 - protein, 30 aa, Artificial Sequence
  Description of Artificial Sequence: Synthetic polypeptide
YEEEIASTNPVATEQYGSVSDDLQDSEGEQ

SEQ ID NO: 77297 - protein, 33 aa, Artificial Sequence
  Description of Artificial Sequence: Synthetic polypeptide
DEAEICTTNPVATECYGSVSTDNGLQDDGDNEN

SEQ ID NO: 77298 - protein, 28 aa, Artificial Sequence
  Description of Artificial Sequence: Synthetic peptide
YEEEIASTNPVATEQYGVVPDVLQSENK

SEQ ID NO: 77299 - protein, 30 aa, Artificial Sequence
  Description of Artificial Sequence: Synthetic polypeptide
DENEIACTNPVATEQYGEASEENLQQRGGH

SEQ ID NO: 77300 - protein, 33 aa, Artificial Sequence
  Description of Artificial Sequence: Synthetic polypeptide
DEAEICTTNPVATECYGSVSTGGLQGDTGGNER

SEQ ID NO: 77301 - protein, 33 aa, Artificial Sequence
  Description of Artificial Sequence: Synthetic polypeptide
DEEEIRTTNPVATEQYGAVSSTDDQGQEGGNDG

SEQ ID NO: 77302 - protein, 30 aa, Artificial Sequence
  Description of Artificial Sequence: Synthetic polypeptide
YEEEIASTNPVATEQYGVVSDDLQDSEGNQ

SEQ ID NO: 77303 - protein, 30 aa, Artificial Sequence
  Description of Artificial Sequence: Synthetic polypeptide
YEEEIASTNPVATEQYGVVSTALPNSGMNQ

SEQ ID NO: 77304 - protein, 31 aa, Artificial Sequence
  Description of Artificial Sequence: Synthetic polypeptide
YEEEIASTNPVATEQYGVVSTTNGQSGMNPQ

SEQ ID NO: 77305 - protein, 30 aa, Artificial Sequence
  Description of Artificial Sequence: Synthetic polypeptide
YEEEIASTNPVCTECYGSVSCNLPQSEGNQ

SEQ ID NO: 77306 - protein, 32 aa, Artificial Sequence
  Description of Artificial Sequence: Synthetic polypeptide
AEDEIRATNPVATEQYGSVTTTNLQSGTNDQL

SEQ ID NO: 77307 - protein, 35 aa, Artificial Sequence
  Description of Artificial Sequence: Synthetic polypeptide
DEEEIRTTNPVATEQYGHTVSCTGNELGREGGNMQ

SEQ ID NO: 77308 - protein, 35 aa, Artificial Sequence
  Description of Artificial Sequence: Synthetic polypeptide
AEEEIRTTNPVATEQYGSVSTTNNQLNGTEQGGND

SEQ ID NO: 77309 - protein, 34 aa, Artificial Sequence
  Description of Artificial Sequence: Synthetic polypeptide
DEEEIRTTNPVATEQYGSYTQIMTNEGQERGNGG

SEQ ID NO: 77310 - protein, 28 aa, Artificial Sequence
  Description of Artificial Sequence: Synthetic peptide
YEEDIASVNPVCTEQYGVVSDNLQSGNQ

SEQ ID NO: 77311 - protein, 31 aa, Artificial Sequence
  Description of Artificial Sequence: Synthetic polypeptide
DEEEIVTTNPVATEQYGTVCPATGPVQFGND

SEQ ID NO: 77312 - protein, 33 aa, Artificial Sequence
  Description of Artificial Sequence: Synthetic polypeptide
DENEAEIRTTNPVAYEHWGSVSTNLQGEDGDDR

SEQ ID NO: 77313 - protein, 28 aa, Artificial Sequence
  Description of Artificial Sequence: Synthetic peptide
YEEECASVNPVCTEQYGVVSDNLQSGNQ

SEQ ID NO: 77314 - protein, 34 aa, Artificial Sequence
  Description of Artificial Sequence: Synthetic polypeptide
DENEAEIRTTNPVAYEHWGSVSTNLQGEDGDNAR

SEQ ID NO: 77315 - protein, 33 aa, Artificial Sequence
  Description of Artificial Sequence: Synthetic polypeptide
DENEAEIRTTNPVAYEHWGSVSTNLQGEDGNAM

SEQ ID NO: 77316 - protein, 34 aa, Artificial Sequence
  Description of Artificial Sequence: Synthetic polypeptide
AEEEIRTTNPVATEQYGSVSTTNNQLEQGTNTNE

SEQ ID NO: 77317 - protein, 32 aa, Artificial Sequence
  Description of Artificial Sequence: Synthetic polypeptide
SEEEIRCTNPIATERYGSTVSCENLSTRGGNR

SEQ ID NO: 77318 - protein, 34 aa, Artificial Sequence
  Description of Artificial Sequence: Synthetic polypeptide
DENEAEIRTTNPVAYEHWGSVSTNLQGEDHGNNR

SEQ ID NO: 77319 - protein, 28 aa, Artificial Sequence
  Description of Artificial Sequence: Synthetic peptide
YEEEIAAVNPVCTEQYGAVSDNLQSGEQ

SEQ ID NO: 77320 - protein, 28 aa, Artificial Sequence
  Description of Artificial Sequence: Synthetic peptide
YEEEIAAVNPVCTEQYGVVSDNLQSFNQ

SEQ ID NO: 77321 - protein, 28 aa, Artificial Sequence
  Description of Artificial Sequence: Synthetic peptide
YEEEIAAVNPVCTEQYGVVSDNLQSWNQ

SEQ ID NO: 77322 - protein, 31 aa, Artificial Sequence
  Description of Artificial Sequence: Synthetic polypeptide
DEEEIRTTNPVAYEHYGKCPSTNEESQRVNM

SEQ ID NO: 77323 - protein, 33 aa, Artificial Sequence
  Description of Artificial Sequence: Synthetic polypeptide
DEEEIVTTNPVATEQYGSVSSATPGGVNREGND

SEQ ID NO: 77324 - protein, 33 aa, Artificial Sequence
  Description of Artificial Sequence: Synthetic polypeptide
AEDEIRTTNPVATEQYGSVSTTQNNLQIGTSTV

SEQ ID NO: 77325 - protein, 34 aa, Artificial Sequence
  Description of Artificial Sequence: Synthetic polypeptide
AEDEIRTTNPVATEQYGSVSTTNNLQQQIGSNVE

SEQ ID NO: 77326 - protein, 33 aa, Artificial Sequence
  Description of Artificial Sequence: Synthetic polypeptide
AEDEIRTTNPVATEQYGSVSTTLNNLQIGSTVE

SEQ ID NO: 77327 - protein, 34 aa, Artificial Sequence
  Description of Artificial Sequence: Synthetic polypeptide
DEEEIRTTNPVAYEHYGQSVHCTNELSIRFGSNR

SEQ ID NO: 77328 - protein, 33 aa, Artificial Sequence
  Description of Artificial Sequence: Synthetic polypeptide
DENEAEIRTTNPVAYEHWGTVSTNLQGEDGNGR

SEQ ID NO: 77329 - protein, 28 aa, Artificial Sequence
  Description of Artificial Sequence: Synthetic peptide
YEEEIACVNPICTEQYGVVSENLQSGNQ

SEQ ID NO: 77330 - protein, 34 aa, Artificial Sequence
  Description of Artificial Sequence: Synthetic polypeptide
DENEAEIRTTNPVAYEHYGEVSTNLQGEDGNNER

SEQ ID NO: 77331 - protein, 32 aa, Artificial Sequence
  Description of Artificial Sequence: Synthetic polypeptide
DEEEIRTTNPVAYEHYGSTPQQNLSQSVGNSR

SEQ ID NO: 77332 - protein, 32 aa, Artificial Sequence
  Description of Artificial Sequence: Synthetic polypeptide
DEEEIRTTNPVAYEHYGSTPSDGLSQSVGNSR

SEQ ID NO: 77333 - protein, 29 aa, Artificial Sequence
  Description of Artificial Sequence: Synthetic peptide
DENEIAATNGCAYMQYGSVSTNLQRADRE

SEQ ID NO: 77334 - protein, 31 aa, Artificial Sequence
  Description of Artificial Sequence: Synthetic polypeptide
DEEEIRTTNPCATEEYGCVATNHGRFGSNAM

SEQ ID NO: 77335 - protein, 32 aa, Artificial Sequence
  Description of Artificial Sequence: Synthetic polypeptide
AEDEIRATNPVATEQYGSVVTTNLQSGNNQQD

SEQ ID NO: 77336 - protein, 32 aa, Artificial Sequence
  Description of Artificial Sequence: Synthetic polypeptide
DEEEIRTTNPCATEEWGSVATGNDHGQRNGNA

SEQ ID NO: 77337 - protein, 28 aa, Artificial Sequence
  Description of Artificial Sequence: Synthetic peptide
YEEEIAPTNPCSSEQYGIVSCNLQSGTR

SEQ ID NO: 77338 - protein, 34 aa, Artificial Sequence
  Description of Artificial Sequence: Synthetic polypeptide
AEDEIRTTNPVATEQYGSVSTTNNQLQQIGSNVQ

SEQ ID NO: 77339 - protein, 33 aa, Artificial Sequence
  Description of Artificial Sequence: Synthetic polypeptide
DEEEIVTTNPVATEQYGSVSNNGLFQEGGGEGG

SEQ ID NO: 77340 - protein, 33 aa, Artificial Sequence
  Description of Artificial Sequence: Synthetic polypeptide
DEEEIVTTNPVATEQYGSVSNNGLFQEGGGEDT

SEQ ID NO: 77341 - protein, 32 aa, Artificial Sequence
  Description of Artificial Sequence: Synthetic polypeptide
DEEEIVTTNPVATEQYGSVSNNGEFQEGGEFN

SEQ ID NO: 77342 - protein, 33 aa, Artificial Sequence
  Description of Artificial Sequence: Synthetic polypeptide
DEAEICTTNPVATECYGSVSTGNGLNQDDGKER

SEQ ID NO: 77343 - protein, 34 aa, Artificial Sequence
  Description of Artificial Sequence: Synthetic polypeptide
DEEEIRTTNPVATEQYGAVSGDGNLQEEGGQNDD

SEQ ID NO: 77344 - protein, 33 aa, Artificial Sequence
  Description of Artificial Sequence: Synthetic polypeptide
DEAEICTTNPVATECYGSVSTGNGLQDGQNGEN

SEQ ID NO: 77345 - protein, 30 aa, Artificial Sequence
  Description of Artificial Sequence: Synthetic polypeptide
YEEEIASTNPVCTEQYGVVSADNLQHGNDL

SEQ ID NO: 77346 - protein, 33 aa, Artificial Sequence
  Description of Artificial Sequence: Synthetic polypeptide
DEAEICTTNPVATECYGSVSTGNGLQGDTGNEN

SEQ ID NO: 77347 - protein, 34 aa, Artificial Sequence
  Description of Artificial Sequence: Synthetic polypeptide
AEEEIRTTNPVATEQYGSVSTTNNQNNQDTGNSE

SEQ ID NO: 77348 - protein, 30 aa, Artificial Sequence
  Description of Artificial Sequence: Synthetic polypeptide
YEEEIASTNPVCTEQYGVVSADNLQHGNDQ

SEQ ID NO: 77349 - protein, 32 aa, Artificial Sequence
  Description of Artificial Sequence: Synthetic polypeptide
DENEIACTNPVATEQYGEVSSTEPNGPQRGNV

SEQ ID NO: 77350 - protein, 30 aa, Artificial Sequence
  Description of Artificial Sequence: Synthetic polypeptide
YEEEIASTNPVCTEQYGVVSADNLVQSGNQ

SEQ ID NO: 77351 - protein, 36 aa, Artificial Sequence
  Description of Artificial Sequence: Synthetic polypeptide
DEEEIRTTNPVATEQYGISVISCTAELSHRDVGNNR

SEQ ID NO: 77352 - protein, 33 aa, Artificial Sequence
  Description of Artificial Sequence: Synthetic polypeptide
DEEEIRTTNPVATEQYGAVSENYDDRGEENEHT

SEQ ID NO: 77353 - protein, 29 aa, Artificial Sequence
  Description of Artificial Sequence: Synthetic peptide
YEEEIASTNPVCTEQYGVVSDEDLQSGNQ

SEQ ID NO: 77354 - protein, 33 aa, Artificial Sequence
  Description of Artificial Sequence: Synthetic polypeptide
DEEEIRTTNPVATEQYGAVSDTDVGQTGNNGGN

SEQ ID NO: 77355 - protein, 33 aa, Artificial Sequence
  Description of Artificial Sequence: Synthetic polypeptide
DEEEIRTTNPVAYEPYGISVSTNQSQDPGGNYM

SEQ ID NO: 77356 - protein, 33 aa, Artificial Sequence
  Description of Artificial Sequence: Synthetic polypeptide
DEEEIRTTNPVATEQYGAVSDNGLEDEGGNGNG

SEQ ID NO: 77357 - protein, 30 aa, Artificial Sequence
  Description of Artificial Sequence: Synthetic polypeptide
DENEIACTNPVATEQYGSASATDLERGEDL

SEQ ID NO: 77358 - protein, 30 aa, Artificial Sequence
  Description of Artificial Sequence: Synthetic polypeptide
DENEIACTNPVATEQYGSASATDLERGGDL

SEQ ID NO: 77359 - protein, 30 aa, Artificial Sequence
  Description of Artificial Sequence: Synthetic polypeptide
YEEEIASTNPVCTEQYGVVSDNLQQSNGNH

SEQ ID NO: 77360 - protein, 32 aa, Artificial Sequence
  Description of Artificial Sequence: Synthetic polypeptide
DEAEICTTNPVATECYGSVSTGNGQGGHGNNM

SEQ ID NO: 77361 - protein, 32 aa, Artificial Sequence
  Description of Artificial Sequence: Synthetic polypeptide
DEEEITTTNPVAYEPYGVVSCTNNSQRGGMNS

SEQ ID NO: 77362 - protein, 30 aa, Artificial Sequence
  Description of Artificial Sequence: Synthetic polypeptide
DENEIACTNPVATEQYGSASSEALQMRGGV

SEQ ID NO: 77363 - protein, 32 aa, Artificial Sequence
  Description of Artificial Sequence: Synthetic polypeptide
DEEEIRTTNPVAYEPYGIVANTNDSQNTGGNR

SEQ ID NO: 77364 - protein, 31 aa, Artificial Sequence
  Description of Artificial Sequence: Synthetic polypeptide
DEEEIRTTNPVATEQYGAVQSPNNVEREPTT

SEQ ID NO: 77365 - protein, 31 aa, Artificial Sequence
  Description of Artificial Sequence: Synthetic polypeptide
CENVIRTTNPVATEQYGMCVEATNPEIRGNR

SEQ ID NO: 77366 - protein, 33 aa, Artificial Sequence
  Description of Artificial Sequence: Synthetic polypeptide
AEEEIRTTNPVATEQYGSVSTTNNQNQQQANED

SEQ ID NO: 77367 - protein, 33 aa, Artificial Sequence
  Description of Artificial Sequence: Synthetic polypeptide
DEEEIRTTNPVATEQYGSYSQTTYDLVQRPEFV

SEQ ID NO: 77368 - protein, 33 aa, Artificial Sequence
  Description of Artificial Sequence: Synthetic polypeptide
DEEEIRTTNPCATEAYGSVTVSTNNLLAGGNTD

SEQ ID NO: 77369 - protein, 33 aa, Artificial Sequence
  Description of Artificial Sequence: Synthetic polypeptide
DEEEIRTTNPCATEAYGSVTVSTNNLEAGNNQT

SEQ ID NO: 77370 - protein, 32 aa, Artificial Sequence
  Description of Artificial Sequence: Synthetic polypeptide
DEEEIRTTNPVATEQYGAVSDDVGQTGNGNGN

SEQ ID NO: 77371 - protein, 31 aa, Artificial Sequence
  Description of Artificial Sequence: Synthetic polypeptide
DENEIACTNPVATEQYGSVSAEDLQDRGGDL

SEQ ID NO: 77372 - protein, 31 aa, Artificial Sequence
  Description of Artificial Sequence: Synthetic polypeptide
SEEEIRCTNPIATEQYGSVYCLENNDMRGNR

SEQ ID NO: 77373 - protein, 30 aa, Artificial Sequence
  Description of Artificial Sequence: Synthetic polypeptide
DEEEIVCTNPIATEQYGSVCSEGPMFEGNR

SEQ ID NO: 77374 - protein, 31 aa, Artificial Sequence
  Description of Artificial Sequence: Synthetic polypeptide
SEEEIRCTNPIATEQYGTVCSAENLEREGND

SEQ ID NO: 77375 - protein, 31 aa, Artificial Sequence
  Description of Artificial Sequence: Synthetic polypeptide
DEAEICTTNPVATECYGSVSTGLIGDGDQGR

SEQ ID NO: 77376 - protein, 33 aa, Artificial Sequence
  Description of Artificial Sequence: Synthetic polypeptide
DEAEICTTNPVATECYGSVSTGNDLQDEGNTEN

SEQ ID NO: 77377 - protein, 33 aa, Artificial Sequence
  Description of Artificial Sequence: Synthetic polypeptide
DEAEICTTNPVATECYGSVSTGNDLRQDEGNEN

SEQ ID NO: 77378 - protein, 34 aa, Artificial Sequence
  Description of Artificial Sequence: Synthetic polypeptide
DDQEIRTTNPVATEQYGQVSTTNLPQGRDFENNR

SEQ ID NO: 77379 - protein, 35 aa, Artificial Sequence
  Description of Artificial Sequence: Synthetic polypeptide
AEEEIRTTNPVATEQYGSVSTTNNQLQQGNNNQNQ

SEQ ID NO: 77380 - protein, 30 aa, Artificial Sequence
  Description of Artificial Sequence: Synthetic polypeptide
DENEIACTNPVATEQYGEASENLQQQNGGR

SEQ ID NO: 77381 - protein, 29 aa, Artificial Sequence
  Description of Artificial Sequence: Synthetic peptide
YEEEIASTNPVCTEPYGVVSMENLQSGNQ

SEQ ID NO: 77382 - protein, 29 aa, Artificial Sequence
  Description of Artificial Sequence: Synthetic peptide
DEEEIVTTNPVATEQYGEVPAEGPQFENK

SEQ ID NO: 77383 - protein, 35 aa, Artificial Sequence
  Description of Artificial Sequence: Synthetic polypeptide
AEEEIRTTNPVATEQYGSVSTTNNQLQQGTDTGNT

SEQ ID NO: 77384 - protein, 30 aa, Artificial Sequence
  Description of Artificial Sequence: Synthetic polypeptide
YEEEIASTNPVCTEQWGSVSDNEPQREGNQ

SEQ ID NO: 77385 - protein, 29 aa, Artificial Sequence
  Description of Artificial Sequence: Synthetic peptide
DEEEIVTTNPVATEQYGEVPAEGCQHENK

SEQ ID NO: 77386 - protein, 33 aa, Artificial Sequence
  Description of Artificial Sequence: Synthetic polypeptide
DEEEIRTTNPVATEQYGICVCSNTELQNFGSEQ

SEQ ID NO: 77387 - protein, 34 aa, Artificial Sequence
  Description of Artificial Sequence: Synthetic polypeptide
AEEEIRTTNPVATEQYGSVSTTNNQNDEQGNVDE

SEQ ID NO: 77388 - protein, 32 aa, Artificial Sequence
  Description of Artificial Sequence: Synthetic polypeptide
DEEEIVTTNPIATEQYGTVCSEDGLVEREGNR

SEQ ID NO: 77389 - protein, 33 aa, Artificial Sequence
  Description of Artificial Sequence: Synthetic polypeptide
DEEEIRTTNPVATEQYGICVCSTEHQSFGSNQA

SEQ ID NO: 77390 - protein, 28 aa, Artificial Sequence
  Description of Artificial Sequence: Synthetic peptide
YEEEIASTNPVCTEQYGEVSDVLQHENK

SEQ ID NO: 77391 - protein, 28 aa, Artificial Sequence
  Description of Artificial Sequence: Synthetic peptide
YEEEIASTNPVCTEQYGEVSEVLQHENK

SEQ ID NO: 77392 - protein, 29 aa, Artificial Sequence
  Description of Artificial Sequence: Synthetic peptide
YEEEIASTNPVCTEQYGSVSDDLQDHGEL

SEQ ID NO: 77393 - protein, 33 aa, Artificial Sequence
  Description of Artificial Sequence: Synthetic polypeptide
DEEEIVTTNPIATEQYGTVCSATDGLVEREGNR

SEQ ID NO: 77394 - protein, 28 aa, Artificial Sequence
  Description of Artificial Sequence: Synthetic peptide
YEEEIASTNPVCTEQYGVTSDDLQPGNQ

SEQ ID NO: 77395 - protein, 34 aa, Artificial Sequence
  Description of Artificial Sequence: Synthetic polypeptide
DEEEIRTTNPVATEQYGAVSGSNNDLEQGGGGNL

SEQ ID NO: 77396 - protein, 29 aa, Artificial Sequence
  Description of Artificial Sequence: Synthetic peptide
YEEEIASTNPVCTEQYGVTSDENLQSGNQ

SEQ ID NO: 77397 - protein, 30 aa, Artificial Sequence
  Description of Artificial Sequence: Synthetic polypeptide
DENEIACTNPVATEQYGEASETLQSRVGGR

SEQ ID NO: 77398 - protein, 29 aa, Artificial Sequence
  Description of Artificial Sequence: Synthetic peptide
DENEIACTNPVATEQYGEASTNLEHEGGL

SEQ ID NO: 77399 - protein, 29 aa, Artificial Sequence
  Description of Artificial Sequence: Synthetic peptide
YEEEIASTNPVCTEQYGVVADNIQSRGQR

SEQ ID NO: 77400 - protein, 31 aa, Artificial Sequence
  Description of Artificial Sequence: Synthetic polypeptide
DEEEIVCTNPIATEQYGTVSEDGLVEREGNR

SEQ ID NO: 77401 - protein, 34 aa, Artificial Sequence
  Description of Artificial Sequence: Synthetic polypeptide
AEEEIRTTNPVATEQYGSVSTTNNQLQQIGTEQG

SEQ ID NO: 77402 - protein, 29 aa, Artificial Sequence
  Description of Artificial Sequence: Synthetic peptide
YEEEIASTNPVCTEQYGDVSENLQSAENQ

SEQ ID NO: 77403 - protein, 35 aa, Artificial Sequence
  Description of Artificial Sequence: Synthetic polypeptide
VEEEIRTTNPVAYEQYGQHVVPSTANLSQRSGNDR

SEQ ID NO: 77404 - protein, 34 aa, Artificial Sequence
  Description of Artificial Sequence: Synthetic polypeptide
VEEEIRTTNPVAYEQYGQHVVPPTNLSQRSGNPR

SEQ ID NO: 77405 - protein, 34 aa, Artificial Sequence
  Description of Artificial Sequence: Synthetic polypeptide
AEEEIRTTNPVATEQYGSVSTTNNNEQQIGENEE

SEQ ID NO: 77406 - protein, 32 aa, Artificial Sequence
  Description of Artificial Sequence: Synthetic polypeptide
DDETIRTTNPVATEQYGAVSTNAQQVRVNGTT

SEQ ID NO: 77407 - protein, 33 aa, Artificial Sequence
  Description of Artificial Sequence: Synthetic polypeptide
DEEEIRTTNPVATEQYGTVTVTNNQLEQGTENN

SEQ ID NO: 77408 - protein, 34 aa, Artificial Sequence
  Description of Artificial Sequence: Synthetic polypeptide
DEEEIRTTNPVATEQYGDVSTNGMGQTGGNTENT

SEQ ID NO: 77409 - protein, 34 aa, Artificial Sequence
  Description of Artificial Sequence: Synthetic polypeptide
DEENIRTTNPVATEQYGSVGSPTGNFHQERDMIR

SEQ ID NO: 77410 - protein, 35 aa, Artificial Sequence
  Description of Artificial Sequence: Synthetic polypeptide
DEEEIRTTNPVATEQYGTVTVSVTNLLQAGTNDEG

SEQ ID NO: 77411 - protein, 35 aa, Artificial Sequence
  Description of Artificial Sequence: Synthetic polypeptide
DEEEIRTTNPVATEQYGTVTVSTTNLLQQGTNEES

SEQ ID NO: 77412 - protein, 33 aa, Artificial Sequence
  Description of Artificial Sequence: Synthetic polypeptide
SEEEIRTTNPVATEFYGSVSNTNLVREGEDEQD

SEQ ID NO: 77413 - protein, 32 aa, Artificial Sequence
  Description of Artificial Sequence: Synthetic polypeptide
DEEEIRTTNPCATEQYGCVCSWNTNFRFGSNQ

SEQ ID NO: 77414 - protein, 33 aa, Artificial Sequence
  Description of Artificial Sequence: Synthetic polypeptide
DEEEIRTTNPVAYCQYGKVQSCTNNSQRGGMNS

SEQ ID NO: 77415 - protein, 31 aa, Artificial Sequence
  Description of Artificial Sequence: Synthetic polypeptide
DDETIRTTNPVATEQYGAVSTNHQFVRVQLP

SEQ ID NO: 77416 - protein, 31 aa, Artificial Sequence
  Description of Artificial Sequence: Synthetic polypeptide
DEEEIRTTNPCATEQYGCVCSWNDAYFGSND

SEQ ID NO: 77417 - protein, 32 aa, Artificial Sequence
  Description of Artificial Sequence: Synthetic polypeptide
DEEEIRTTNPVAYDAYGSVPSYTAGLGLVGNR

SEQ ID NO: 77418 - protein, 34 aa, Artificial Sequence
  Description of Artificial Sequence: Synthetic polypeptide
AEEEIRTTNPVATEQYGSVSTTNLQQQNATNATD

SEQ ID NO: 77419 - protein, 32 aa, Artificial Sequence
  Description of Artificial Sequence: Synthetic polypeptide
DEEEIRTTNPCATEQYGCVCSWENIFRFGSND

SEQ ID NO: 77420 - protein, 32 aa, Artificial Sequence
  Description of Artificial Sequence: Synthetic polypeptide
DEEEIRTTNPVATEQYGCSCSSPNMLQGDSEQ

SEQ ID NO: 77421 - protein, 34 aa, Artificial Sequence
  Description of Artificial Sequence: Synthetic polypeptide
AEEEIRTTNPVATEQYGSVSTTNLQQQNENNDDT

SEQ ID NO: 77422 - protein, 30 aa, Artificial Sequence
  Description of Artificial Sequence: Synthetic polypeptide
DEEEIRTTNPCATEQYGCVCSWEIAYGSND

SEQ ID NO: 77423 - protein, 33 aa, Artificial Sequence
  Description of Artificial Sequence: Synthetic polypeptide
DEEEIRTTNPVATEQYGCSCSSPNLLQHFDSNQ

SEQ ID NO: 77424 - protein, 30 aa, Artificial Sequence
  Description of Artificial Sequence: Synthetic polypeptide
DEAEIATTNPVAYEQWGSISRTNDERPNAR

SEQ ID NO: 77425 - protein, 34 aa, Artificial Sequence
  Description of Artificial Sequence: Synthetic polypeptide
DEEEIRTTNPVATEQYGCSCSSPNDLQERFDSNQ

SEQ ID NO: 77426 - protein, 33 aa, Artificial Sequence
  Description of Artificial Sequence: Synthetic polypeptide
DEEEIRTTNPVATEQYGCSCSSPEMLQRDSNQS

SEQ ID NO: 77427 - protein, 32 aa, Artificial Sequence
  Description of Artificial Sequence: Synthetic polypeptide
SEEEIRTTNPVATEEYGCVCSNTNLANFGDNQ

SEQ ID NO: 77428 - protein, 34 aa, Artificial Sequence
  Description of Artificial Sequence: Synthetic polypeptide
AEEEIRTTNPVATEQYGSVSTTNLQQQNNENATD

SEQ ID NO: 77429 - protein, 31 aa, Artificial Sequence
  Description of Artificial Sequence: Synthetic polypeptide
SEEEIRTTNPVATEEYGAVSTGGLHRDMYAR

SEQ ID NO: 77430 - protein, 32 aa, Artificial Sequence
  Description of Artificial Sequence: Synthetic polypeptide
DEMEIRTTNPVATQQYGCVCSTELEERFGSNQ

SEQ ID NO: 77431 - protein, 35 aa, Artificial Sequence
  Description of Artificial Sequence: Synthetic polypeptide
AEEEIRTTNPVATEQYGSVSTTNLQQQNNGNEQDT

SEQ ID NO: 77432 - protein, 31 aa, Artificial Sequence
  Description of Artificial Sequence: Synthetic polypeptide
DEEEIRTTNPCATEQYGCVCSTEHQYFGSDQ

SEQ ID NO: 77433 - protein, 33 aa, Artificial Sequence
  Description of Artificial Sequence: Synthetic polypeptide
DEEEIRTTNPVATEQYGCSCSTGNPHQNFESNQ

SEQ ID NO: 77434 - protein, 33 aa, Artificial Sequence
  Description of Artificial Sequence: Synthetic polypeptide
DEEEIRTTNPVATEQYGDVSTMTNFGQEGGGQT

SEQ ID NO: 77435 - protein, 33 aa, Artificial Sequence
  Description of Artificial Sequence: Synthetic polypeptide
DEEEIRTTNPVATEQYGTVTVTNTNNNLQQENN

SEQ ID NO: 77436 - protein, 35 aa, Artificial Sequence
  Description of Artificial Sequence: Synthetic polypeptide
AEEEIRTTNPVATEQYGSVSTTNLQQNQQGNNEED

SEQ ID NO: 77437 - protein, 33 aa, Artificial Sequence
  Description of Artificial Sequence: Synthetic polypeptide
DEEEIRTTNPVATEQYGDVSTDNGGETDGNGGE

SEQ ID NO: 77438 - protein, 32 aa, Artificial Sequence
  Description of Artificial Sequence: Synthetic polypeptide
DEENIRTTNPVAYEPYGQVPNCTNLQRGGPNG

SEQ ID NO: 77439 - protein, 34 aa, Artificial Sequence
  Description of Artificial Sequence: Synthetic polypeptide
AEEEIRTTNPVATEQYGSVSTTNLQQNEDEQNTD

SEQ ID NO: 77440 - protein, 31 aa, Artificial Sequence
  Description of Artificial Sequence: Synthetic polypeptide
DEENIRTTNPVAYEAWGQVACTNLSQVGTNR

SEQ ID NO: 77441 - protein, 32 aa, Artificial Sequence
  Description of Artificial Sequence: Synthetic polypeptide
DEMEIRTTNPVATEQYGTVSATDDIQEFEGNH

SEQ ID NO: 77442 - protein, 32 aa, Artificial Sequence
  Description of Artificial Sequence: Synthetic polypeptide
DEMEIRTTNPVATEQYGTVSATDDIQEFNGNH

SEQ ID NO: 77443 - protein, 33 aa, Artificial Sequence
  Description of Artificial Sequence: Synthetic polypeptide
DEEEIRTTNPVATEQYGDVSTDTTQEGIENGGQ

SEQ ID NO: 77444 - protein, 32 aa, Artificial Sequence
  Description of Artificial Sequence: Synthetic polypeptide
DEMEIRTTNPVATEQYGTVSATDDPQEQNGNH

SEQ ID NO: 77445 - protein, 32 aa, Artificial Sequence
  Description of Artificial Sequence: Synthetic polypeptide
DEMEIRTTNPVATEQYGTVSATDDPVEQEGND

SEQ ID NO: 77446 - protein, 32 aa, Artificial Sequence
  Description of Artificial Sequence: Synthetic polypeptide
DEMEIRTTNPVATEQYGTVSATDDPVEQEGNH

SEQ ID NO: 77447 - protein, 32 aa, Artificial Sequence
  Description of Artificial Sequence: Synthetic polypeptide
DEMEIRTTNPVATEQYGTVSATDDPVEQNGNH

SEQ ID NO: 77448 - protein, 34 aa, Artificial Sequence
  Description of Artificial Sequence: Synthetic polypeptide
DEEEIRTTNPVATEQYGCSCSTGNPLQNFQSNQS

SEQ ID NO: 77449 - protein, 34 aa, Artificial Sequence
  Description of Artificial Sequence: Synthetic polypeptide
DEEEIRTTNPVATEQYGCSCSTGNPLQHFNSNQA

SEQ ID NO: 77450 - protein, 31 aa, Artificial Sequence
  Description of Artificial Sequence: Synthetic polypeptide
DEEEIRTTNPCATEQYGCVCSSNIFRFGSDQ

SEQ ID NO: 77451 - protein, 34 aa, Artificial Sequence
  Description of Artificial Sequence: Synthetic polypeptide
DEEEIRTTNPVATEQYGDVSTGGLGQNEGEGNGQ

SEQ ID NO: 77452 - protein, 34 aa, Artificial Sequence
  Description of Artificial Sequence: Synthetic polypeptide
DEEEIRTTNPVATEQYGDVSTGGLGQNEGGGNEP

SEQ ID NO: 77453 - protein, 32 aa, Artificial Sequence
  Description of Artificial Sequence: Synthetic polypeptide
DEMEIRTTNPVATEQYGTVSATDGIQEFEGND

SEQ ID NO: 77454 - protein, 32 aa, Artificial Sequence
  Description of Artificial Sequence: Synthetic polypeptide
DEMEIRTTNPVATEQYGTVSATDGIQEFEGNH

SEQ ID NO: 77455 - protein, 30 aa, Artificial Sequence
  Description of Artificial Sequence: Synthetic polypeptide
SEEEIRTTNPVATEGYGCTSIMNLGQGENI

SEQ ID NO: 77456 - protein, 32 aa, Artificial Sequence
  Description of Artificial Sequence: Synthetic polypeptide
DEEEIRTTNPVATEQYGDVSTGMGQQGGEGEQ

SEQ ID NO: 77457 - protein, 31 aa, Artificial Sequence
  Description of Artificial Sequence: Synthetic polypeptide
DEMEIRTTNPVATEQYGTVSTEGPVEFEGNH

SEQ ID NO: 77458 - protein, 34 aa, Artificial Sequence
  Description of Artificial Sequence: Synthetic polypeptide
DEEEIRTTNPVATEQYGTVTVTVTNNNLQRENNT

SEQ ID NO: 77459 - protein, 31 aa, Artificial Sequence
  Description of Artificial Sequence: Synthetic polypeptide
SEEEIRTTNPVATEGYGCTSILNLQREGGGI

SEQ ID NO: 77460 - protein, 34 aa, Artificial Sequence
  Description of Artificial Sequence: Synthetic polypeptide
VEEEIRTTNPVATEQYGSVNITDNEGQERGENGE

SEQ ID NO: 77461 - protein, 34 aa, Artificial Sequence
  Description of Artificial Sequence: Synthetic polypeptide
DEEEIRTTNPVATEQYGDVSTLDQLQQEFGNGQG

SEQ ID NO: 77462 - protein, 33 aa, Artificial Sequence
  Description of Artificial Sequence: Synthetic polypeptide
DEEEIRTTNPVATEQYGDVSTLGLDEFGGGNNG

SEQ ID NO: 77463 - protein, 33 aa, Artificial Sequence
  Description of Artificial Sequence: Synthetic polypeptide
DEEEIRTTNPVATEQYGDVSTLGLDEFGGNNQG

SEQ ID NO: 77464 - protein, 33 aa, Artificial Sequence
  Description of Artificial Sequence: Synthetic polypeptide
AEEEIRTTNPVATEQYGSVSTTNLQQNQDTDED

SEQ ID NO: 77465 - protein, 34 aa, Artificial Sequence
  Description of Artificial Sequence: Synthetic polypeptide
DEEEIRTTNPVATEQYGDVSTGGLGQNEGGEGNN

SEQ ID NO: 77466 - protein, 34 aa, Artificial Sequence
  Description of Artificial Sequence: Synthetic polypeptide
AEEEIRTTNPVATEQYGSVSTTNLQQQNNNDQDT

SEQ ID NO: 77467 - protein, 34 aa, Artificial Sequence
  Description of Artificial Sequence: Synthetic polypeptide
VEEEIRTTNPVATEQYGSVNNMTSNNDQRGENGD

SEQ ID NO: 77468 - protein, 35 aa, Artificial Sequence
  Description of Artificial Sequence: Synthetic polypeptide
VEEEIRTTNPVATEQYGSVNSDSTNLQNDGMGNDD

SEQ ID NO: 77469 - protein, 34 aa, Artificial Sequence
  Description of Artificial Sequence: Synthetic polypeptide
VEEEIRTTNPVATEQYGSVSGDTNGQDEGQTNIT

SEQ ID NO: 77470 - protein, 34 aa, Artificial Sequence
  Description of Artificial Sequence: Synthetic polypeptide
DEEEIRTTNPVATEQYGDVSTTPALPNMRNGMNV

SEQ ID NO: 77471 - protein, 31 aa, Artificial Sequence
  Description of Artificial Sequence: Synthetic polypeptide
DEEEIRTTNPVAYEAFGSVPATYLSQPGGNQ

SEQ ID NO: 77472 - protein, 32 aa, Artificial Sequence
  Description of Artificial Sequence: Synthetic polypeptide
DEEEIRTTNPVATEQYGDVSTTSVGDGGGNGQ

SEQ ID NO: 77473 - protein, 33 aa, Artificial Sequence
  Description of Artificial Sequence: Synthetic polypeptide
DEEEIRTTNPVAYEAWGCSVVSTADSQRGGNLR

SEQ ID NO: 77474 - protein, 33 aa, Artificial Sequence
  Description of Artificial Sequence: Synthetic polypeptide
DEEEIRTTNPVATEQYGDVSTVNGFGQENINEG

SEQ ID NO: 77475 - protein, 34 aa, Artificial Sequence
  Description of Artificial Sequence: Synthetic polypeptide
DEEEIRTTNPVATEQYGDVSTVNGQQGEQTGNGN

SEQ ID NO: 77476 - protein, 34 aa, Artificial Sequence
  Description of Artificial Sequence: Synthetic polypeptide
DEEEIRTTNPVATEQYGDVSTVNVQSQGMEGGNE

SEQ ID NO: 77477 - protein, 32 aa, Artificial Sequence
  Description of Artificial Sequence: Synthetic polypeptide
DEEEIRTTNPVAYEAWGESVSTNLSEERGGTE

SEQ ID NO: 77478 - protein, 34 aa, Artificial Sequence
  Description of Artificial Sequence: Synthetic polypeptide
VEEEIRTTNPVATEQYGSVSGTVNEGQTGGGGNG

SEQ ID NO: 77479 - protein, 34 aa, Artificial Sequence
  Description of Artificial Sequence: Synthetic polypeptide
DEEEIRTTNPVAYEAWGGVVSTNMLQRTSGNYRE

SEQ ID NO: 77480 - protein, 28 aa, Artificial Sequence
  Description of Artificial Sequence: Synthetic peptide
CETEIASVNPVCTEQYGVVSDNLQSGNQ

SEQ ID NO: 77481 - protein, 31 aa, Artificial Sequence
  Description of Artificial Sequence: Synthetic polypeptide
DEMEIRYTNPVATEQYGSVSVEQDRIGSNSD

SEQ ID NO: 77482 - protein, 29 aa, Artificial Sequence
  Description of Artificial Sequence: Synthetic peptide
DEAEIATTNPVAYEQWGSTVTNLQSGGDA

SEQ ID NO: 77483 - protein, 33 aa, Artificial Sequence
  Description of Artificial Sequence: Synthetic polypeptide
VEEEIRTTNPVATEQYGSVSIDNDQNEMGNGNG

SEQ ID NO: 77484 - protein, 32 aa, Artificial Sequence
  Description of Artificial Sequence: Synthetic polypeptide
DEEEIRTTNPVATEQYGDVSVGNMETGGGNQG

SEQ ID NO: 77485 - protein, 30 aa, Artificial Sequence
  Description of Artificial Sequence: Synthetic polypeptide
DEMEISTTNPVATEQYGCISTNTQNEGSDQ

SEQ ID NO: 77486 - protein, 30 aa, Artificial Sequence
  Description of Artificial Sequence: Synthetic polypeptide
SEEEIRTTNPISTEQYGTISEDIMQRNGNR

SEQ ID NO: 77487 - protein, 31 aa, Artificial Sequence
  Description of Artificial Sequence: Synthetic polypeptide
DEMEISTTNPVATEQYGCVSTELQNFNSNQS

SEQ ID NO: 77488 - protein, 33 aa, Artificial Sequence
  Description of Artificial Sequence: Synthetic polypeptide
AEEEIRTTNPVATEQYGSVSTTNNDGGTVGNAN

SEQ ID NO: 77489 - protein, 34 aa, Artificial Sequence
  Description of Artificial Sequence: Synthetic polypeptide
DEEEIRTTNPVAYEAWGSLCSTDNELSQRPGGNR

SEQ ID NO: 77490 - protein, 32 aa, Artificial Sequence
  Description of Artificial Sequence: Synthetic polypeptide
DDETIRTTNPVATEQYGAVSVNGGQRGVGNNG

SEQ ID NO: 77491 - protein, 30 aa, Artificial Sequence
  Description of Artificial Sequence: Synthetic polypeptide
DEMEIVCTNPIATEQYGTVCSEDNLEFGNR

SEQ ID NO: 77492 - protein, 30 aa, Artificial Sequence
  Description of Artificial Sequence: Synthetic polypeptide
SEEEIRTTNPIATEQYGTISEDIQQQQGNR

SEQ ID NO: 77493 - protein, 33 aa, Artificial Sequence
  Description of Artificial Sequence: Synthetic polypeptide
DEEEIRTTNPVATEQYGCQVSTELQENFGSEQS

SEQ ID NO: 77494 - protein, 32 aa, Artificial Sequence
  Description of Artificial Sequence: Synthetic polypeptide
DEEEIRTTNPCATEQYGCVCETELQNFGSNTA

SEQ ID NO: 77495 - protein, 34 aa, Artificial Sequence
  Description of Artificial Sequence: Synthetic polypeptide
AEEEIRTTNPVATEQYGSVSTTNNDNQEEGTNGG

SEQ ID NO: 77496 - protein, 30 aa, Artificial Sequence
  Description of Artificial Sequence: Synthetic polypeptide
DEMEIVCTNPVATEQYGEASEDGLQFEGNR

SEQ ID NO: 77497 - protein, 32 aa, Artificial Sequence
  Description of Artificial Sequence: Synthetic polypeptide
DDETIRTTNPVATEQYGAVSTTNHQQVRVNQT

SEQ ID NO: 77498 - protein, 32 aa, Artificial Sequence
  Description of Artificial Sequence: Synthetic polypeptide
VEEEIRTTNPVATEQYGSVITNLGQNEVTVEE

SEQ ID NO: 77499 - protein, 34 aa, Artificial Sequence
  Description of Artificial Sequence: Synthetic polypeptide
AEEEIRTTNPVATEQYGSVSTTNMQQGENEGNEG

SEQ ID NO: 77500 - protein, 32 aa, Artificial Sequence
  Description of Artificial Sequence: Synthetic polypeptide
DDETIRTTNPVATEQYGAVSTNHVQVRVNNTT

SEQ ID NO: 77501 - protein, 35 aa, Artificial Sequence
  Description of Artificial Sequence: Synthetic polypeptide
AEEEIRTTNPVATEQYGSVSTTNLQQQQGGNNNDT

SEQ ID NO: 77502 - protein, 31 aa, Artificial Sequence
  Description of Artificial Sequence: Synthetic polypeptide
DEEEIRTTNPVATEQYGDVSTPIEMMANENA

SEQ ID NO: 77503 - protein, 30 aa, Artificial Sequence
  Description of Artificial Sequence: Synthetic polypeptide
DEMEIRTTNPVATQQYGCVCSTELENGSQQ

SEQ ID NO: 77504 - protein, 31 aa, Artificial Sequence
  Description of Artificial Sequence: Synthetic polypeptide
DEMEIRTTNPVATQQYGCVCSTELERNSNQA

SEQ ID NO: 77505 - protein, 33 aa, Artificial Sequence
  Description of Artificial Sequence: Synthetic polypeptide
DEEEIRTTNPVATEQYGTVTTVTNNQLQNENND

SEQ ID NO: 77506 - protein, 33 aa, Artificial Sequence
  Description of Artificial Sequence: Synthetic polypeptide
DEEEIRTTNPVAYDQWGSVSTVNWSQSTVGNNR

SEQ ID NO: 77507 - protein, 34 aa, Artificial Sequence
  Description of Artificial Sequence: Synthetic polypeptide
VEEEIRTTNPVATEQYGSVNTSNLNQDEGENDDT

SEQ ID NO: 77508 - protein, 32 aa, Artificial Sequence
  Description of Artificial Sequence: Synthetic polypeptide
SEEEIRTTNPVATECWGSVSCINEPQDRGENG

SEQ ID NO: 77509 - protein, 32 aa, Artificial Sequence
  Description of Artificial Sequence: Synthetic polypeptide
DDETIRTTNPVATEQYGAVSTNHQQHRVNNTD

SEQ ID NO: 77510 - protein, 32 aa, Artificial Sequence
  Description of Artificial Sequence: Synthetic polypeptide
DDETIRTTNPVATEQYGAVSTNHQQMRVNVTT

SEQ ID NO: 77511 - protein, 33 aa, Artificial Sequence
  Description of Artificial Sequence: Synthetic polypeptide
VEEEIRTTNPVATEQYGSVSDGITNEDNGGGNG

SEQ ID NO: 77512 - protein, 32 aa, Artificial Sequence
  Description of Artificial Sequence: Synthetic polypeptide
DEEEIRTTNPCATEQYGCVCQTNPQRGSDTAA

SEQ ID NO: 77513 - protein, 32 aa, Artificial Sequence
  Description of Artificial Sequence: Synthetic polypeptide
DEEEIRTTNPVAYDQYGVVPSTEQLQNLPNVR

SEQ ID NO: 77514 - protein, 33 aa, Artificial Sequence
  Description of Artificial Sequence: Synthetic polypeptide
VEEEIRTTNPVATEQYGSVSEVNGLQVVINELD

SEQ ID NO: 77515 - protein, 31 aa, Artificial Sequence
  Description of Artificial Sequence: Synthetic polypeptide
DEMEIRTTNPVATQQYGCVCSTNHESGSNQS

SEQ ID NO: 77516 - protein, 31 aa, Artificial Sequence
  Description of Artificial Sequence: Synthetic polypeptide
DEMEIRTTNPVATQQYGCVCSTNLEFGSEQS

SEQ ID NO: 77517 - protein, 35 aa, Artificial Sequence
  Description of Artificial Sequence: Synthetic polypeptide
AEEEIRTTNPVATEQYGSVSTTNLQYGNNGTNQVE

SEQ ID NO: 77518 - protein, 34 aa, Artificial Sequence
  Description of Artificial Sequence: Synthetic polypeptide
AEEEIRTTNPVATEQYGSVSTTNLSQGNNNNNNF

SEQ ID NO: 77519 - protein, 35 aa, Artificial Sequence
  Description of Artificial Sequence: Synthetic polypeptide
AEEEIRTTNPVATEQYGSVSTTNLTNNQLGNNEEV

SEQ ID NO: 77520 - protein, 33 aa, Artificial Sequence
  Description of Artificial Sequence: Synthetic polypeptide
SEEEIRTTNPVATEAYGSCSNTNELHRGSDQRD

SEQ ID NO: 77521 - protein, 32 aa, Artificial Sequence
  Description of Artificial Sequence: Synthetic polypeptide
CEYEIRATNPVATEQYGSVVEQTNLQHGGNGQ

SEQ ID NO: 77522 - protein, 32 aa, Artificial Sequence
  Description of Artificial Sequence: Synthetic polypeptide
AEEEIRTTNPVATEQYGSVSTTNMGQTNVTEE

SEQ ID NO: 77523 - protein, 34 aa, Artificial Sequence
  Description of Artificial Sequence: Synthetic polypeptide
VEEEIRTTNPVATEQYGSVSDTDNMGQDEGGGNT

SEQ ID NO: 77524 - protein, 32 aa, Artificial Sequence
  Description of Artificial Sequence: Synthetic polypeptide
CEYEIRATNPVATEQYGSVVENTNLQHGGNGQ

SEQ ID NO: 77525 - protein, 33 aa, Artificial Sequence
  Description of Artificial Sequence: Synthetic polypeptide
SEEEIRTTNPTATESYGSVSNTVNLERGFDQRQ

SEQ ID NO: 77526 - protein, 33 aa, Artificial Sequence
  Description of Artificial Sequence: Synthetic polypeptide
DEEEIRTTNPVATEQYGDVSTTDDGQGGNTLNT

SEQ ID NO: 77527 - protein, 32 aa, Artificial Sequence
  Description of Artificial Sequence: Synthetic polypeptide
DEEEIRTTNPCATEQYGCVCGSNLQNFGSNTA

SEQ ID NO: 77528 - protein, 34 aa, Artificial Sequence
  Description of Artificial Sequence: Synthetic polypeptide
DEEEIRTTNPVATEQYGDVSTTNLQNGGEFTGQG

SEQ ID NO: 77529 - protein, 34 aa, Artificial Sequence
  Description of Artificial Sequence: Synthetic polypeptide
DEEEIRTTNPVATEQYGTVTTTGNQLQQGEENND

SEQ ID NO: 77530 - protein, 33 aa, Artificial Sequence
  Description of Artificial Sequence: Synthetic polypeptide
AEEEIRTTNPVATEQYGSVSTTNNDNQQEDEND

SEQ ID NO: 77531 - protein, 35 aa, Artificial Sequence
  Description of Artificial Sequence: Synthetic polypeptide
AEEEIRTTNPVATEQYGSVSTTNLQQLGNQNNQDE

SEQ ID NO: 77532 - protein, 31 aa, Artificial Sequence
  Description of Artificial Sequence: Synthetic polypeptide
DDENIRTTNPVATEQYGSVSTGDEGGGAGNT

SEQ ID NO: 77533 - protein, 31 aa, Artificial Sequence
  Description of Artificial Sequence: Synthetic polypeptide
VEEEIRTTNPVATEGYGCTSIMNLGQGNGNI

SEQ ID NO: 77534 - protein, 32 aa, Artificial Sequence
  Description of Artificial Sequence: Synthetic polypeptide
DEMEIRTTNPVATEQYGSVYSANADRIDSENQ

SEQ ID NO: 77535 - protein, 31 aa, Artificial Sequence
  Description of Artificial Sequence: Synthetic polypeptide
DEEEIRTTNPVATEQYGDVSEAENMAAENPV

SEQ ID NO: 77536 - protein, 35 aa, Artificial Sequence
  Description of Artificial Sequence: Synthetic polypeptide
DEEEIRTTNPVATEQYGCTCSMTENLNQGIGSNRA

SEQ ID NO: 77537 - protein, 30 aa, Artificial Sequence
  Description of Artificial Sequence: Synthetic polypeptide
DEAEIAATNGCAYMQYGSVSTNLQRGPDDR

SEQ ID NO: 77538 - protein, 35 aa, Artificial Sequence
  Description of Artificial Sequence: Synthetic polypeptide
AEEEIRTTNPVATEQYGSVSTTNLQEQGIGTNEED

SEQ ID NO: 77539 - protein, 32 aa, Artificial Sequence
  Description of Artificial Sequence: Synthetic polypeptide
DEEEIRTTNPVATEQYGTYEITTNLLQPENNE

SEQ ID NO: 77540 - protein, 32 aa, Artificial Sequence
  Description of Artificial Sequence: Synthetic polypeptide
DEEEIRTTNPVATEQYGTYEITTLPLQRENNP

SEQ ID NO: 77541 - protein, 31 aa, Artificial Sequence
  Description of Artificial Sequence: Synthetic polypeptide
DEEEIRTTNPVATEQYGDVSEIENMAAENPA

SEQ ID NO: 77542 - protein, 30 aa, Artificial Sequence
  Description of Artificial Sequence: Synthetic polypeptide
DEEEIRTTNPVATEQYGDVSEIENMRAEDA

SEQ ID NO: 77543 - protein, 30 aa, Artificial Sequence
  Description of Artificial Sequence: Synthetic polypeptide
DEEEIRTTNPVATEQYGDVSEILMNAAEDA

SEQ ID NO: 77544 - protein, 33 aa, Artificial Sequence
  Description of Artificial Sequence: Synthetic polypeptide
DEEEIRTTNPVATEQYGTYEIPMTNPLQRENNQ

SEQ ID NO: 77545 - protein, 33 aa, Artificial Sequence
  Description of Artificial Sequence: Synthetic polypeptide
DEEEIRTTNPVAVEQYGSVVTNTNDLLQIGIAS

SEQ ID NO: 77546 - protein, 33 aa, Artificial Sequence
  Description of Artificial Sequence: Synthetic polypeptide
DEEEIRTTNPCATEQYGSCAATNLQTMGDNSAD

SEQ ID NO: 77547 - protein, 33 aa, Artificial Sequence
  Description of Artificial Sequence: Synthetic polypeptide
DEEEIRTTNPVATEQYGTYCSTGNPLQHFNSNQ

SEQ ID NO: 77548 - protein, 32 aa, Artificial Sequence
  Description of Artificial Sequence: Synthetic polypeptide
DEEEIRTTNPCATEQYGSCAATNLQMLDNAAE

SEQ ID NO: 77549 - protein, 33 aa, Artificial Sequence
  Description of Artificial Sequence: Synthetic polypeptide
VEEEIRTTNPVATEQYGAVSGTNDDQGGGGENE

SEQ ID NO: 77550 - protein, 33 aa, Artificial Sequence
  Description of Artificial Sequence: Synthetic polypeptide
DEEEIRTTNPCATEQYGSCAATNLQMHGDNEAD

SEQ ID NO: 77551 - protein, 33 aa, Artificial Sequence
  Description of Artificial Sequence: Synthetic polypeptide
DEEEIRTTNPVATEQYGTYCSTGNPHQRFISNQ

SEQ ID NO: 77552 - protein, 33 aa, Artificial Sequence
  Description of Artificial Sequence: Synthetic polypeptide
VEEEIRTTNPVATEQYGAVSGTNDQGGGGNEEI

SEQ ID NO: 77553 - protein, 31 aa, Artificial Sequence
  Description of Artificial Sequence: Synthetic polypeptide
DEAEIATTNPVAYEQWGAVSTNLQGNEGGER

SEQ ID NO: 77554 - protein, 34 aa, Artificial Sequence
  Description of Artificial Sequence: Synthetic polypeptide
AEEEIRTTNPVATEQYGSVSTTNLQGNNNNNQNE

SEQ ID NO: 77555 - protein, 32 aa, Artificial Sequence
  Description of Artificial Sequence: Synthetic polypeptide
DEEEIRTTNPVATEQYGDVSGGNGGNGGNEDD

SEQ ID NO: 77556 - protein, 31 aa, Artificial Sequence
  Description of Artificial Sequence: Synthetic polypeptide
DEAEIATTNPVAYEQWGAVSTNLQGNGGPQR

SEQ ID NO: 77557 - protein, 32 aa, Artificial Sequence
  Description of Artificial Sequence: Synthetic polypeptide
DEEEIRTTNPCATEQYGSCAATNLQMGDLTAA

SEQ ID NO: 77558 - protein, 30 aa, Artificial Sequence
  Description of Artificial Sequence: Synthetic polypeptide
DEAEIATTNPVAYEQWGAVSTNLQGNGPDH

SEQ ID NO: 77559 - protein, 31 aa, Artificial Sequence
  Description of Artificial Sequence: Synthetic polypeptide
DEAEIATTNPVAYEQWGAVSTNLQHNGGGDR

SEQ ID NO: 77560 - protein, 34 aa, Artificial Sequence
  Description of Artificial Sequence: Synthetic polypeptide
DEEPIRTTNPVAYEQYGSVSTAMHSQRTGGNNRM

SEQ ID NO: 77561 - protein, 30 aa, Artificial Sequence
  Description of Artificial Sequence: Synthetic polypeptide
AEEEIACTNPVATEMYGSVATNLTEAGENT

SEQ ID NO: 77562 - protein, 34 aa, Artificial Sequence
  Description of Artificial Sequence: Synthetic polypeptide
VEEEIRTTNPVATDQYGSVSTDNEGQERGENGEQ

SEQ ID NO: 77563 - protein, 30 aa, Artificial Sequence
  Description of Artificial Sequence: Synthetic polypeptide
DEEEIRTTNPVATEQYGDVSDIEMNAAGDA

SEQ ID NO: 77564 - protein, 30 aa, Artificial Sequence
  Description of Artificial Sequence: Synthetic polypeptide
VEEEINCTNPIATEQYGAVSEMNGMRGNDR

SEQ ID NO: 77565 - protein, 32 aa, Artificial Sequence
  Description of Artificial Sequence: Synthetic polypeptide
DEEEIRTTNPCATEQYGSVAPTWDLADRGGEE

SEQ ID NO: 77566 - protein, 32 aa, Artificial Sequence
  Description of Artificial Sequence: Synthetic polypeptide
DEEEIRTTNPVATEQYGCTCSTMEHQYFGSNQ

SEQ ID NO: 77567 - protein, 32 aa, Artificial Sequence
  Description of Artificial Sequence: Synthetic polypeptide
DEEPIRTTNPVAYERYGSVSCTNAIQPPGGPR

SEQ ID NO: 77568 - protein, 34 aa, Artificial Sequence
  Description of Artificial Sequence: Synthetic polypeptide
DEEEIRTTNPVATEQYGDVNSNTQNNGQSEGGNG

SEQ ID NO: 77569 - protein, 33 aa, Artificial Sequence
  Description of Artificial Sequence: Synthetic polypeptide
DEEPIRTTNPVAYEQYRWEVSTNELSQTTGGNR

SEQ ID NO: 77570 - protein, 34 aa, Artificial Sequence
  Description of Artificial Sequence: Synthetic polypeptide
DEEEIRTTNPVATEQYGDVNSTMNVDQTGFENED

SEQ ID NO: 77571 - protein, 33 aa, Artificial Sequence
  Description of Artificial Sequence: Synthetic polypeptide
DEEEIRTTNPVATEQYGCTCSTGEDQRFGSNQS

SEQ ID NO: 77572 - protein, 35 aa, Artificial Sequence
  Description of Artificial Sequence: Synthetic polypeptide
AEEEIRTTNPVATEQYGSVSTTNLNQQGTNNNELF

SEQ ID NO: 77573 - protein, 32 aa, Artificial Sequence
  Description of Artificial Sequence: Synthetic polypeptide
DEEEIRTTNPVATEQYGDVNSVGNMTGGGNEG

SEQ ID NO: 77574 - protein, 28 aa, Artificial Sequence
  Description of Artificial Sequence: Synthetic peptide
DEEEIRTTNPVATEQYGDVPEICMAEEA

SEQ ID NO: 77575 - protein, 33 aa, Artificial Sequence
  Description of Artificial Sequence: Synthetic polypeptide
DEEEIRTTNPVATEQYGVCVCSTEDHQGFGSNQ

SEQ ID NO: 77576 - protein, 31 aa, Artificial Sequence
  Description of Artificial Sequence: Synthetic polypeptide
VEEEIRCTNPVAWEQYGTVSTMNEMQDSGNN

SEQ ID NO: 77577 - protein, 33 aa, Artificial Sequence
  Description of Artificial Sequence: Synthetic polypeptide
DEEEIRTTNPCATEQYGSCAATNLQEHGDNEAD

SEQ ID NO: 77578 - protein, 32 aa, Artificial Sequence
  Description of Artificial Sequence: Synthetic polypeptide
DEAEIATTNPVAYEPYGVVASATNLQEGNQRA

SEQ ID NO: 77579 - protein, 29 aa, Artificial Sequence
  Description of Artificial Sequence: Synthetic peptide
DEEEIRTTNPVATEQYGDVPEIEQAAEDK

SEQ ID NO: 77580 - protein, 32 aa, Artificial Sequence
  Description of Artificial Sequence: Synthetic polypeptide
DEAEIATTNPVAYEPYGVVASATNLQTEGNRN

SEQ ID NO: 77581 - protein, 34 aa, Artificial Sequence
  Description of Artificial Sequence: Synthetic polypeptide
DEEEIRTTNPVATEQYGCTCSNTNELQENFGSNQ

SEQ ID NO: 77582 - protein, 35 aa, Artificial Sequence
  Description of Artificial Sequence: Synthetic polypeptide
AEEEIRTTNPVATEQYGSVSTTNLNQQQTGENNEQ

SEQ ID NO: 77583 - protein, 34 aa, Artificial Sequence
  Description of Artificial Sequence: Synthetic polypeptide
AEEEIRTTNPVATEQYGSVSTTNLNQSNNANNQT

SEQ ID NO: 77584 - protein, 30 aa, Artificial Sequence
  Description of Artificial Sequence: Synthetic polypeptide
DEAEIATTNPVAYEQWGAVSTELQGNGPAR

SEQ ID NO: 77585 - protein, 33 aa, Artificial Sequence
  Description of Artificial Sequence: Synthetic polypeptide
DEEEIRTTNPVATEQYGTYYESTIIPLQRENNE

SEQ ID NO: 77586 - protein, 33 aa, Artificial Sequence
  Description of Artificial Sequence: Synthetic polypeptide
DEEEIRTTNPVATEQYGDVSDDNNGQGEGGNNT

SEQ ID NO: 77587 - protein, 34 aa, Artificial Sequence
  Description of Artificial Sequence: Synthetic polypeptide
DEMEIRTTNPVATEQYGSVWTNINNQRDGSINQQ

SEQ ID NO: 77588 - protein, 34 aa, Artificial Sequence
  Description of Artificial Sequence: Synthetic polypeptide
DEMEIRTTNPVATEQYGSVWVTNENQNRMGSNQE

SEQ ID NO: 77589 - protein, 31 aa, Artificial Sequence
  Description of Artificial Sequence: Synthetic polypeptide
DEAEIATTNPVAYEQWGAVSTNLQGNAGDAR

SEQ ID NO: 77590 - protein, 30 aa, Artificial Sequence
  Description of Artificial Sequence: Synthetic polypeptide
DEAEIATTNPVAYEQWGAVSTNLQGNAGEA

SEQ ID NO: 77591 - protein, 30 aa, Artificial Sequence
  Description of Artificial Sequence: Synthetic polypeptide
AEEEIACTNPVATEQWGCVATNLQAEDGER

SEQ ID NO: 77592 - protein, 29 aa, Artificial Sequence
  Description of Artificial Sequence: Synthetic peptide
DEEEIRTTNPVATEQYGDVPEIEQAAEDA

SEQ ID NO: 77593 - protein, 33 aa, Artificial Sequence
  Description of Artificial Sequence: Synthetic polypeptide
VEEEIRTTNPVATEQYGAVSGTNDQGGGNNEQG

SEQ ID NO: 77594 - protein, 34 aa, Artificial Sequence
  Description of Artificial Sequence: Synthetic polypeptide
DEMEIRTTNPVATEQYGSVYTTNNQDRIAGEMNN

SEQ ID NO: 77595 - protein, 34 aa, Artificial Sequence
  Description of Artificial Sequence: Synthetic polypeptide
AEEEIRTTNPVATEQYGSVSTTNLQGNPNNTNQN

SEQ ID NO: 77596 - protein, 33 aa, Artificial Sequence
  Description of Artificial Sequence: Synthetic polypeptide
DEEEIRTTNPVATEQYGDVSSTAGPMMRNGNPV

SEQ ID NO: 77597 - protein, 33 aa, Artificial Sequence
  Description of Artificial Sequence: Synthetic polypeptide
DEEEIRTTNPVATEQYGDVSSTAGPNMRNGNPV

SEQ ID NO: 77598 - protein, 30 aa, Artificial Sequence
  Description of Artificial Sequence: Synthetic polypeptide
DEEPIATTNPVAYEPYSEEVSTNLQHGNVK

SEQ ID NO: 77599 - protein, 30 aa, Artificial Sequence
  Description of Artificial Sequence: Synthetic polypeptide
DEEPIATTNPVAYEHPWSEEVSTNLQHGNV

SEQ ID NO: 77600 - protein, 32 aa, Artificial Sequence
  Description of Artificial Sequence: Synthetic polypeptide
DEMEIRTTNPVATEQYGTVCSATDNPVEFGND

SEQ ID NO: 77601 - protein, 33 aa, Artificial Sequence
  Description of Artificial Sequence: Synthetic polypeptide
VEEEIRTTNPVATEQYGSVGETNVQRMIENVID

SEQ ID NO: 77602 - protein, 33 aa, Artificial Sequence
  Description of Artificial Sequence: Synthetic polypeptide
VEEEIRTTNPVATEQYGSVGNTNDGQEEGGNNQ

SEQ ID NO: 77603 - protein, 33 aa, Artificial Sequence
  Description of Artificial Sequence: Synthetic polypeptide
VEEEIRTTNPVATEQYGSVGNTNGQIEEGGNNN

SEQ ID NO: 77604 - protein, 34 aa, Artificial Sequence
  Description of Artificial Sequence: Synthetic polypeptide
VEEEIRTTNPVATEQYGSVGNTVNGLDQEGENGD

SEQ ID NO: 77605 - protein, 32 aa, Artificial Sequence
  Description of Artificial Sequence: Synthetic polypeptide
SEEEIRTTNPVATEGYGSVSNTNLHHFGSDTQ

SEQ ID NO: 77606 - protein, 34 aa, Artificial Sequence
  Description of Artificial Sequence: Synthetic polypeptide
VEEEIRTTNPVATEQYGSVGSTDLDQDGGENVED

SEQ ID NO: 77607 - protein, 32 aa, Artificial Sequence
  Description of Artificial Sequence: Synthetic polypeptide
DEEEIRTTNPVATEQYGDVSSTINGNGQGEFT

SEQ ID NO: 77608 - protein, 34 aa, Artificial Sequence
  Description of Artificial Sequence: Synthetic polypeptide
VEEEIRTTNPVATEQYGSVGSTDLQQGGEGNEDE

SEQ ID NO: 77609 - protein, 32 aa, Artificial Sequence
  Description of Artificial Sequence: Synthetic polypeptide
DEEEIRTTNPVATEQYGDVSSGQGLGGNGNGD

SEQ ID NO: 77610 - protein, 33 aa, Artificial Sequence
  Description of Artificial Sequence: Synthetic polypeptide
DEEEIRTTNPVATEQYGDVSSTMDLNEGGENDE

SEQ ID NO: 77611 - protein, 35 aa, Artificial Sequence
  Description of Artificial Sequence: Synthetic polypeptide
VEEEIRTTNPVATEQYGSVGSTVNLQFNGNGNEQG

SEQ ID NO: 77612 - protein, 35 aa, Artificial Sequence
  Description of Artificial Sequence: Synthetic polypeptide
VEEEIRTTNPVATEQYGSVIASTTNLQRIENDGAA

SEQ ID NO: 77613 - protein, 33 aa, Artificial Sequence
  Description of Artificial Sequence: Synthetic polypeptide
DDENIRTTNPVATEQYGAVSTNTGGQRGNGNGL

SEQ ID NO: 77614 - protein, 33 aa, Artificial Sequence
  Description of Artificial Sequence: Synthetic polypeptide
DEEEIRTTNPVATEQYGDVSSTPAENMANGNPV

SEQ ID NO: 77615 - protein, 33 aa, Artificial Sequence
  Description of Artificial Sequence: Synthetic polypeptide
DEEEIRTTNPVATEQYGDVSSTPAGPNMRGNPV

SEQ ID NO: 77616 - protein, 35 aa, Artificial Sequence
  Description of Artificial Sequence: Synthetic polypeptide
VEEEIRTTNPVATEQYGSVISGNTNGLQEEGGGNE

SEQ ID NO: 77617 - protein, 34 aa, Artificial Sequence
  Description of Artificial Sequence: Synthetic polypeptide
VEEEIRTTNPVATEQYGSVISTGDLGQREQDGGG

SEQ ID NO: 77618 - protein, 34 aa, Artificial Sequence
  Description of Artificial Sequence: Synthetic polypeptide
DEEEIRTTNPVATEQYGTVVSTMNPQQIEGGNDE

SEQ ID NO: 77619 - protein, 33 aa, Artificial Sequence
  Description of Artificial Sequence: Synthetic polypeptide
DEEEIRTTNPVATEQYGDVSSTTPAGNMANGNV

SEQ ID NO: 77620 - protein, 34 aa, Artificial Sequence
  Description of Artificial Sequence: Synthetic polypeptide
DEEEIRTTNPVATEQYGTVVSTMNPQNIEGNNEE

SEQ ID NO: 77621 - protein, 33 aa, Artificial Sequence
  Description of Artificial Sequence: Synthetic polypeptide
DEEPIATTNPVATEPYGSVSCTNADSQRNGGSR

SEQ ID NO: 77622 - protein, 32 aa, Artificial Sequence
  Description of Artificial Sequence: Synthetic polypeptide
DEMEIRTTNPVATEQYGTVCSTDGEVEREGND

SEQ ID NO: 77623 - protein, 33 aa, Artificial Sequence
  Description of Artificial Sequence: Synthetic polypeptide
DEENIRTTNPVAYERYGSVCSCTNISQRPGGTR

SEQ ID NO: 77624 - protein, 31 aa, Artificial Sequence
  Description of Artificial Sequence: Synthetic polypeptide
DEAEIATTNPVAYEQWGEVSTNLQLGGMNDE

SEQ ID NO: 77625 - protein, 32 aa, Artificial Sequence
  Description of Artificial Sequence: Synthetic polypeptide
DEMEIRTTNPVATEQYGTVCSTDGPVEREGND

SEQ ID NO: 77626 - protein, 34 aa, Artificial Sequence
  Description of Artificial Sequence: Synthetic polypeptide
DEEEIRTTNPVATEQYGTVWEQTINMGQREGGND

SEQ ID NO: 77627 - protein, 34 aa, Artificial Sequence
  Description of Artificial Sequence: Synthetic polypeptide
DEEEIRTTNPVATEQYGTVWETNNPGQREGNGNG

SEQ ID NO: 77628 - protein, 34 aa, Artificial Sequence
  Description of Artificial Sequence: Synthetic polypeptide
AEEEIRTTNPVATEQYGSVSTTNLQGNPTNNQNS

SEQ ID NO: 77629 - protein, 31 aa, Artificial Sequence
  Description of Artificial Sequence: Synthetic polypeptide
VEEEIRTTNPVATEQYGAVSTTQGGGNGNGD

SEQ ID NO: 77630 - protein, 33 aa, Artificial Sequence
  Description of Artificial Sequence: Synthetic polypeptide
DEEEIRTTNPVAVEQYGSVVTQTNNLLQEGIIS

SEQ ID NO: 77631 - protein, 34 aa, Artificial Sequence
  Description of Artificial Sequence: Synthetic polypeptide
AEEEIRTTNPVATEQYGSVSTTNLQGNQNQNQND

SEQ ID NO: 77632 - protein, 30 aa, Artificial Sequence
  Description of Artificial Sequence: Synthetic polypeptide
DEEPIRTTNPVAYEQYGSVSMKAGNLRVAE

SEQ ID NO: 77633 - protein, 29 aa, Artificial Sequence
  Description of Artificial Sequence: Synthetic peptide
CSEEVATTNPVGTEQWGMVSITNLQGGGR

SEQ ID NO: 77634 - protein, 32 aa, Artificial Sequence
  Description of Artificial Sequence: Synthetic polypeptide
DEMEIRTTNPVATEQYGSWSVPNMLQEDFNPQ

SEQ ID NO: 77635 - protein, 35 aa, Artificial Sequence
  Description of Artificial Sequence: Synthetic polypeptide
DEEPIRTTNPVATEQYGSTVSTLMLSGRTGGNNRM

SEQ ID NO: 77636 - protein, 32 aa, Artificial Sequence
  Description of Artificial Sequence: Synthetic polypeptide
DEMEIRTTNPVATEQYGSYRSTNYPIQGEGVP

SEQ ID NO: 77637 - protein, 33 aa, Artificial Sequence
  Description of Artificial Sequence: Synthetic polypeptide
AEEEIRTTNPVATEQYGSVSTTNLQLQQATEEN

SEQ ID NO: 77638 - protein, 33 aa, Artificial Sequence
  Description of Artificial Sequence: Synthetic polypeptide
DEEEIRTTNPVAVEQYGVVVTNTNDLLQGGIIR

SEQ ID NO: 77639 - protein, 33 aa, Artificial Sequence
  Description of Artificial Sequence: Synthetic polypeptide
DEEEIRTTNPVATEQYGDVSNDTLDQQGINEGQ

SEQ ID NO: 77640 - protein, 32 aa, Artificial Sequence
  Description of Artificial Sequence: Synthetic polypeptide
DEEPIRTTNPVATEQYGCVSLTNSQTFPENQI

SEQ ID NO: 77641 - protein, 31 aa, Artificial Sequence
  Description of Artificial Sequence: Synthetic polypeptide
DEEPIATTNPVAYEQYSEEVTTNLQQGGENR

SEQ ID NO: 77642 - protein, 34 aa, Artificial Sequence
  Description of Artificial Sequence: Synthetic polypeptide
DEEPIRTTNPVATEPYGSVCFTNALSTRTGGNNR

SEQ ID NO: 77643 - protein, 33 aa, Artificial Sequence
  Description of Artificial Sequence: Synthetic polypeptide
DEEEIRTTNPVATEQYGDVSNNLEGSGENNEGG

SEQ ID NO: 77644 - protein, 29 aa, Artificial Sequence
  Description of Artificial Sequence: Synthetic peptide
DEAEIATTNPVAYEQWGCVSTNLQGEDHE

SEQ ID NO: 77645 - protein, 34 aa, Artificial Sequence
  Description of Artificial Sequence: Synthetic polypeptide
DEEEIRTTNPVATEQYGDVSNTELTLGQEGGNGQ

SEQ ID NO: 77646 - protein, 31 aa, Artificial Sequence
  Description of Artificial Sequence: Synthetic polypeptide
DDEEVASTNPVATEQYGSVATNTIQSRVGNV

SEQ ID NO: 77647 - protein, 35 aa, Artificial Sequence
  Description of Artificial Sequence: Synthetic polypeptide
AEEEIRTTNPVATEQYGSVSTTNLQNQENGNAQGE

SEQ ID NO: 77648 - protein, 33 aa, Artificial Sequence
  Description of Artificial Sequence: Synthetic polypeptide
DEEEIRTTNPVAWEQYGCVCSTGNHQRFGSEQS

SEQ ID NO: 77649 - protein, 33 aa, Artificial Sequence
  Description of Artificial Sequence: Synthetic polypeptide
DEEEIRTTNPVATEQYGDVSSDTQGLGGNGNGE

SEQ ID NO: 77650 - protein, 32 aa, Artificial Sequence
  Description of Artificial Sequence: Synthetic polypeptide
DEEPIRTTNPMATWEQYNSEVSTMNLQGLNDT

SEQ ID NO: 77651 - protein, 31 aa, Artificial Sequence
  Description of Artificial Sequence: Synthetic polypeptide
DDENIATTNPVATEQYGEVSTGNHQERVDNL

SEQ ID NO: 77652 - protein, 32 aa, Artificial Sequence
  Description of Artificial Sequence: Synthetic polypeptide
DEEEIRTTNPVATEQYGDVSSECLNMRNGEPL

SEQ ID NO: 77653 - protein, 29 aa, Artificial Sequence
  Description of Artificial Sequence: Synthetic peptide
AEEEIACTNPVATEAYGNVATNIQRGDEM

SEQ ID NO: 77654 - protein, 32 aa, Artificial Sequence
  Description of Artificial Sequence: Synthetic polypeptide
DDENIRTTNPVATEQYGAVCTNGGQRGNGNGQ

SEQ ID NO: 77655 - protein, 35 aa, Artificial Sequence
  Description of Artificial Sequence: Synthetic polypeptide
AEEEIRTTNPVATEQYGSVSTTNLQQGAEGGNNNI

SEQ ID NO: 77656 - protein, 33 aa, Artificial Sequence
  Description of Artificial Sequence: Synthetic polypeptide
DEEEIRTTNPVATEQYGDVSNNDLEQSENNEGG

SEQ ID NO: 77657 - protein, 29 aa, Artificial Sequence
  Description of Artificial Sequence: Synthetic peptide
DEMEIVCTNPVATEQYGEASEDGLQFGGR

SEQ ID NO: 77658 - protein, 31 aa, Artificial Sequence
  Description of Artificial Sequence: Synthetic polypeptide
DEENIRTTNPVATEIYGQVTTDLQRFESNQF

SEQ ID NO: 77659 - protein, 34 aa, Artificial Sequence
  Description of Artificial Sequence: Synthetic polypeptide
VEEEIRTTNPVATEQYGSVSITDNGEQEGGGNGT

SEQ ID NO: 77660 - protein, 34 aa, Artificial Sequence
  Description of Artificial Sequence: Synthetic polypeptide
AEEEIRTTNPVATEQYGSVSTTNNLQQNQTGGTN

SEQ ID NO: 77661 - protein, 34 aa, Artificial Sequence
  Description of Artificial Sequence: Synthetic polypeptide
DEEEIRTTNPVATEQYGDVVSTLDQLQEFGGNGQ

SEQ ID NO: 77662 - protein, 31 aa, Artificial Sequence
  Description of Artificial Sequence: Synthetic polypeptide
VEEEIRTTNPVATEQYGSVSTTLGFTEVLQN

SEQ ID NO: 77663 - protein, 32 aa, Artificial Sequence
  Description of Artificial Sequence: Synthetic polypeptide
DEEEIRTTNPVATEQYGCFCSWGNMLQNDSNQ

SEQ ID NO: 77664 - protein, 33 aa, Artificial Sequence
  Description of Artificial Sequence: Synthetic polypeptide
DEEEIRTTNPVATEQYGDVVSTLDQNIEGGNDD

SEQ ID NO: 77665 - protein, 34 aa, Artificial Sequence
  Description of Artificial Sequence: Synthetic polypeptide
VEEEIRTTNPVATEQYGSVSTVNEGQETGGNGNI

SEQ ID NO: 77666 - protein, 33 aa, Artificial Sequence
  Description of Artificial Sequence: Synthetic polypeptide
DEEEIRTTNPVATEQYGDVVSTMDGSNQGGENT

SEQ ID NO: 77667 - protein, 34 aa, Artificial Sequence
  Description of Artificial Sequence: Synthetic polypeptide
VEEEIRTTNPVATEQYGSVSTVNGFGQENIGNSD

SEQ ID NO: 77668 - protein, 33 aa, Artificial Sequence
  Description of Artificial Sequence: Synthetic polypeptide
DEEEIRTTNPVAYEAYGSLVNWNLSQSTGGNMR

SEQ ID NO: 77669 - protein, 33 aa, Artificial Sequence
  Description of Artificial Sequence: Synthetic polypeptide
VEEEIRTTNPVATEQYGSVSVTNALEEENEELD

SEQ ID NO: 77670 - protein, 34 aa, Artificial Sequence
  Description of Artificial Sequence: Synthetic polypeptide
DEEEIRTTNPVATEQYGDVVSTMNEGQTGGGNEE

SEQ ID NO: 77671 - protein, 32 aa, Artificial Sequence
  Description of Artificial Sequence: Synthetic polypeptide
DEEEIRTTNPCATEPYGSVATNHGNRGSNEAE

SEQ ID NO: 77672 - protein, 34 aa, Artificial Sequence
  Description of Artificial Sequence: Synthetic polypeptide
DEEEIRTTNPVATEQYGDVVSTMNIGQNEGDGNT

SEQ ID NO: 77673 - protein, 35 aa, Artificial Sequence
  Description of Artificial Sequence: Synthetic polypeptide
DEEEIRTTNPVATEQYGDVVSTMNLPQNEFGNGNT

SEQ ID NO: 77674 - protein, 33 aa, Artificial Sequence
  Description of Artificial Sequence: Synthetic polypeptide
DEEEIRTTNPVATEQYGDVVSTMQGTNEFTGNN

SEQ ID NO: 77675 - protein, 31 aa, Artificial Sequence
  Description of Artificial Sequence: Synthetic polypeptide
DEEEIRTTNPCATEPYGSVATNHGNHGGNEA

SEQ ID NO: 77676 - protein, 34 aa, Artificial Sequence
  Description of Artificial Sequence: Synthetic polypeptide
DEEEIRTTNPVATEQYGDVVSTNNTDQENIGGNN

SEQ ID NO: 77677 - protein, 32 aa, Artificial Sequence
  Description of Artificial Sequence: Synthetic polypeptide
DEEEIRTTNPVAYEAYGSTVATGNLTPMVGNA

SEQ ID NO: 77678 - protein, 33 aa, Artificial Sequence
  Description of Artificial Sequence: Synthetic polypeptide
VEEEIRTTNPVATEQYGSVSWTPTVINNGEANR

SEQ ID NO: 77679 - protein, 31 aa, Artificial Sequence
  Description of Artificial Sequence: Synthetic polypeptide
DEAEIATTNPVAYEQYGSCSTNLEIANPNER

SEQ ID NO: 77680 - protein, 33 aa, Artificial Sequence
  Description of Artificial Sequence: Synthetic polypeptide
DEEEIRTTNPVAYEAYGSTVQSTGNLFTMVGNA

SEQ ID NO: 77681 - protein, 34 aa, Artificial Sequence
  Description of Artificial Sequence: Synthetic polypeptide
AEEEIRTTNPVATEQYGSVSTTNNLQQQANNETD

SEQ ID NO: 77682 - protein, 32 aa, Artificial Sequence
  Description of Artificial Sequence: Synthetic polypeptide
DEEEIRTTNPVAYEAYGSTVSCGNLTPIVGNA

SEQ ID NO: 77683 - protein, 34 aa, Artificial Sequence
  Description of Artificial Sequence: Synthetic polypeptide
DEEEIRTTNPVATEQYGDVVSTTLPQNEMGQGNT

SEQ ID NO: 77684 - protein, 35 aa, Artificial Sequence
  Description of Artificial Sequence: Synthetic polypeptide
AEEEIRTTNPVATEQYGSVSTTNNLQQQGEGNATE

SEQ ID NO: 77685 - protein, 35 aa, Artificial Sequence
  Description of Artificial Sequence: Synthetic polypeptide
DEEEIRTTNPVATEQYGDVVSTVNLPQNEFGGNGD

SEQ ID NO: 77686 - protein, 34 aa, Artificial Sequence
  Description of Artificial Sequence: Synthetic polypeptide
DEEEIRTTNPVATEQYGTVSNLNLDQGTFGENIQ

SEQ ID NO: 77687 - protein, 35 aa, Artificial Sequence
  Description of Artificial Sequence: Synthetic polypeptide
AEEEIRTTNPVATEQYGSVSTTNNLQQNQQGNITE

SEQ ID NO: 77688 - protein, 33 aa, Artificial Sequence
  Description of Artificial Sequence: Synthetic polypeptide
DEEEIRTTNPVATEQYGDVVSTDTGMGQGNGNT

SEQ ID NO: 77689 - protein, 32 aa, Artificial Sequence
  Description of Artificial Sequence: Synthetic polypeptide
DEEEIRTTNPVATEQYGCFCSWPNMHQRDNQS

SEQ ID NO: 77690 - protein, 34 aa, Artificial Sequence
  Description of Artificial Sequence: Synthetic polypeptide
DEEEIRTTNPVATEQYGDVVSTDNGQGEGGNQGT

SEQ ID NO: 77691 - protein, 34 aa, Artificial Sequence
  Description of Artificial Sequence: Synthetic polypeptide
AEEEIRTTNPVATEQYGSVSTTNNLQQEEGETAE

SEQ ID NO: 77692 - protein, 34 aa, Artificial Sequence
  Description of Artificial Sequence: Synthetic polypeptide
AEEEIRTTNPVATEQYGSVSTTNNLQQEEGETEE

SEQ ID NO: 77693 - protein, 34 aa, Artificial Sequence
  Description of Artificial Sequence: Synthetic polypeptide
DEEEIRTTNPVATEQYGTVSTGGLGQNEGGNGNT

SEQ ID NO: 77694 - protein, 33 aa, Artificial Sequence
  Description of Artificial Sequence: Synthetic polypeptide
DEEEIRTTNPVATEQYGCICSTGNHQRFGSEQP

SEQ ID NO: 77695 - protein, 32 aa, Artificial Sequence
  Description of Artificial Sequence: Synthetic polypeptide
DEAEIATTNPVAYEQWGTVSTNLQRGGGNDGS

SEQ ID NO: 77696 - protein, 32 aa, Artificial Sequence
  Description of Artificial Sequence: Synthetic polypeptide
DEEEIRTTNPVAYEAYGQSVSQNELSQPGISE

SEQ ID NO: 77697 - protein, 35 aa, Artificial Sequence
  Description of Artificial Sequence: Synthetic polypeptide
AEEEIRTTNPVATEQYGSVSTTNNLQQGNEGGNTA

SEQ ID NO: 77698 - protein, 35 aa, Artificial Sequence
  Description of Artificial Sequence: Synthetic polypeptide
AEEEIRTTNPVATEQYGSVSTTNNLQQGNEGTNVN

SEQ ID NO: 77699 - protein, 29 aa, Artificial Sequence
  Description of Artificial Sequence: Synthetic peptide
DEAEIATTNPVAYEQWGVSIATNLERPNP

SEQ ID NO: 77700 - protein, 33 aa, Artificial Sequence
  Description of Artificial Sequence: Synthetic polypeptide
VEEEIRTTNPVATEQYGSVSTNLQGFVTPADVP

SEQ ID NO: 77701 - protein, 32 aa, Artificial Sequence
  Description of Artificial Sequence: Synthetic polypeptide
DEEEIRTTNPVATEQYGTVSTDGQGNDGTGEG

SEQ ID NO: 77702 - protein, 35 aa, Artificial Sequence
  Description of Artificial Sequence: Synthetic polypeptide
AEEEIRTTNPVATEQYGSVSTTNNLQQGTDEENEG

SEQ ID NO: 77703 - protein, 35 aa, Artificial Sequence
  Description of Artificial Sequence: Synthetic polypeptide
AEEEIRTTNPVATEQYGSVSTTNNLQQGTEENNDE

SEQ ID NO: 77704 - protein, 34 aa, Artificial Sequence
  Description of Artificial Sequence: Synthetic polypeptide
VEEEIRTTNPVATEQYGSVTSTDNGQGEGGNQGG

SEQ ID NO: 77705 - protein, 32 aa, Artificial Sequence
  Description of Artificial Sequence: Synthetic polypeptide
DEENICTTNPVATEAYGVVSTTANLQQGSNED

SEQ ID NO: 77706 - protein, 35 aa, Artificial Sequence
  Description of Artificial Sequence: Synthetic polypeptide
AEEEIRTTNPVATEQYGSVSTTNNLQQGTESGNNQ

SEQ ID NO: 77707 - protein, 33 aa, Artificial Sequence
  Description of Artificial Sequence: Synthetic polypeptide
VEEEIRTTNPVATEQYGSVSTQNMDGTGEGENI

SEQ ID NO: 77708 - protein, 35 aa, Artificial Sequence
  Description of Artificial Sequence: Synthetic polypeptide
DEEEIRTTNPVAYEAYGQSVVSTAELSQRGGNMRI

SEQ ID NO: 77709 - protein, 33 aa, Artificial Sequence
  Description of Artificial Sequence: Synthetic polypeptide
DEEEIRTTNPVAYEAYGQVCNTNESQRGGNQRA

SEQ ID NO: 77710 - protein, 33 aa, Artificial Sequence
  Description of Artificial Sequence: Synthetic polypeptide
VEEEIRTTNPVATEQYGSVSTTDLSDNGGNGQE

SEQ ID NO: 77711 - protein, 34 aa, Artificial Sequence
  Description of Artificial Sequence: Synthetic polypeptide
VEEEIRTTNPVATEQYGSVSTTDNGQGEGQGNIT

SEQ ID NO: 77712 - protein, 33 aa, Artificial Sequence
  Description of Artificial Sequence: Synthetic polypeptide
DEEEIRTTNPVATEQYGCFSSPNMLQRFDSNQA

SEQ ID NO: 77713 - protein, 31 aa, Artificial Sequence
  Description of Artificial Sequence: Synthetic polypeptide
DEAEIATTNPVAYEQYGCVATEGLQDAGDNR

SEQ ID NO: 77714 - protein, 32 aa, Artificial Sequence
  Description of Artificial Sequence: Synthetic polypeptide
DEAEIATTNPVAYEQYGQSVSTNDLAQHGIAP

SEQ ID NO: 77715 - protein, 34 aa, Artificial Sequence
  Description of Artificial Sequence: Synthetic polypeptide
AEEEIRTTNPVATEQYGSVSTTNNLQQNQENNDT

SEQ ID NO: 77716 - protein, 29 aa, Artificial Sequence
  Description of Artificial Sequence: Synthetic peptide
DEAEIATTNPVAYEQYGSCAATNLAAPNN

SEQ ID NO: 77717 - protein, 28 aa, Artificial Sequence
  Description of Artificial Sequence: Synthetic peptide
DEAEIATTNPVAYEQYGSCATNLAAPGT

SEQ ID NO: 77718 - protein, 34 aa, Artificial Sequence
  Description of Artificial Sequence: Synthetic polypeptide
DEEEIRTTNPVAYEAYGSCSTDNELSQRPGGNEY

SEQ ID NO: 77719 - protein, 31 aa, Artificial Sequence
  Description of Artificial Sequence: Synthetic polypeptide
AEECISTTNPVATEQYGCVCSNWNHQRGNQS

SEQ ID NO: 77720 - protein, 35 aa, Artificial Sequence
  Description of Artificial Sequence: Synthetic polypeptide
AEEEIRTTNPVATEQYGSVSTTNNLQQQGNGNNDE

SEQ ID NO: 77721 - protein, 34 aa, Artificial Sequence
  Description of Artificial Sequence: Synthetic polypeptide
VEEEIRTTNPVATEQYGSVTSTLNIENGQGGNQG

SEQ ID NO: 77722 - protein, 30 aa, Artificial Sequence
  Description of Artificial Sequence: Synthetic polypeptide
DEAEIATTNPVAYEQYGSISAGALERPNRP

SEQ ID NO: 77723 - protein, 34 aa, Artificial Sequence
  Description of Artificial Sequence: Synthetic polypeptide
AEEEIRTTNPVATEQYGSVSTTNNLQVTEEQGEG

SEQ ID NO: 77724 - protein, 29 aa, Artificial Sequence
  Description of Artificial Sequence: Synthetic peptide
DEEEIRTTNPVATEQYGEAPMDCQQHENK

SEQ ID NO: 77725 - protein, 29 aa, Artificial Sequence
  Description of Artificial Sequence: Synthetic peptide
DEEEIRTTNPVATEQYGEASEVEQNAEEA

SEQ ID NO: 77726 - protein, 32 aa, Artificial Sequence
  Description of Artificial Sequence: Synthetic polypeptide
DEAEIATTNPVAYEQYGSVAGTNDQREDGNND

SEQ ID NO: 77727 - protein, 34 aa, Artificial Sequence
  Description of Artificial Sequence: Synthetic polypeptide
DEEEIRTTNPVAYEAYGSVISTPSLSGRTGNERI

SEQ ID NO: 77728 - protein, 33 aa, Artificial Sequence
  Description of Artificial Sequence: Synthetic polypeptide
VEEEIRTTNPVATERYGTVVSTNELSQASGNND

SEQ ID NO: 77729 - protein, 33 aa, Artificial Sequence
  Description of Artificial Sequence: Synthetic polypeptide
AEEEIRTTNPVATEQYGSVSTTNNMGQNTNVTE

SEQ ID NO: 77730 - protein, 33 aa, Artificial Sequence
  Description of Artificial Sequence: Synthetic polypeptide
DEELIRTTNPVATEAYGISVCSTNLENAGSVRY

SEQ ID NO: 77731 - protein, 32 aa, Artificial Sequence
  Description of Artificial Sequence: Synthetic polypeptide
DEMEIVTTNPVATEQYGTVCSATDNLMFEGND

SEQ ID NO: 77732 - protein, 33 aa, Artificial Sequence
  Description of Artificial Sequence: Synthetic polypeptide
VEEEIRTTNPVATESYGSVTSNTNPLEWGDQRQ

SEQ ID NO: 77733 - protein, 33 aa, Artificial Sequence
  Description of Artificial Sequence: Synthetic polypeptide
DEAEIATTNPVAYEQYGSVAITANLQDRGGNDT

SEQ ID NO: 77734 - protein, 33 aa, Artificial Sequence
  Description of Artificial Sequence: Synthetic polypeptide
DEAEIATTNPVAYEQYGSVAITNLQGTPGNDRH

SEQ ID NO: 77735 - protein, 30 aa, Artificial Sequence
  Description of Artificial Sequence: Synthetic polypeptide
DEEEIRTTNPVATEQYGEASTVCQHEMEPV

SEQ ID NO: 77736 - protein, 35 aa, Artificial Sequence
  Description of Artificial Sequence: Synthetic polypeptide
AEEEIRTTNPVATEQYGSVSTTNNLQTGNNDTNTD

SEQ ID NO: 77737 - protein, 33 aa, Artificial Sequence
  Description of Artificial Sequence: Synthetic polypeptide
DEEEIRTTNPVATEQYGTVCSTGPLQNFGSEQM

SEQ ID NO: 77738 - protein, 33 aa, Artificial Sequence
  Description of Artificial Sequence: Synthetic polypeptide
AEEEIRTTNPVATEQYGSVSTTNNNAITEQGNQ

SEQ ID NO: 77739 - protein, 34 aa, Artificial Sequence
  Description of Artificial Sequence: Synthetic polypeptide
DEEEIRTTNPVATEQYGEAVSDLNTLPNGGNFRT

SEQ ID NO: 77740 - protein, 31 aa, Artificial Sequence
  Description of Artificial Sequence: Synthetic polypeptide
SEEEIRCTNPVATEQYGTVSAEDNPMREGND

SEQ ID NO: 77741 - protein, 32 aa, Artificial Sequence
  Description of Artificial Sequence: Synthetic polypeptide
DEAEIATTNPVAYEQYGSVAITNNDQQGNDRQ

SEQ ID NO: 77742 - protein, 29 aa, Artificial Sequence
  Description of Artificial Sequence: Synthetic peptide
DEELIRCTNPVATEQYGSQSWNTFEGGDI

SEQ ID NO: 77743 - protein, 33 aa, Artificial Sequence
  Description of Artificial Sequence: Synthetic polypeptide
AEEEIRTTNPVATEQYGSVSTTNNNAITNGNNG

SEQ ID NO: 77744 - protein, 32 aa, Artificial Sequence
  Description of Artificial Sequence: Synthetic polypeptide
DEEEIRTTNPCATEPYGSTVANTNDGRGDNEA

SEQ ID NO: 77745 - protein, 33 aa, Artificial Sequence
  Description of Artificial Sequence: Synthetic polypeptide
DEEEIRTTNPVATEQYGTVCSTEHQYFGSNNQA

SEQ ID NO: 77746 - protein, 33 aa, Artificial Sequence
  Description of Artificial Sequence: Synthetic polypeptide
DEEEIRTTNPVATEQYGEDAVSNTNMINGNMQF

SEQ ID NO: 77747 - protein, 33 aa, Artificial Sequence
  Description of Artificial Sequence: Synthetic polypeptide
DEEEIRTTNPVATEQYGEFSTDLVYSAGNDTRQ

SEQ ID NO: 77748 - protein, 33 aa, Artificial Sequence
  Description of Artificial Sequence: Synthetic polypeptide
DEMEIVTTNPVATEQYGTVCSATDNPVQREGND

SEQ ID NO: 77749 - protein, 34 aa, Artificial Sequence
  Description of Artificial Sequence: Synthetic polypeptide
AEEEIRTTNPVATEQYGSVSTTNNNDQQIGNEGG

SEQ ID NO: 77750 - protein, 34 aa, Artificial Sequence
  Description of Artificial Sequence: Synthetic polypeptide
VEEEIRTTNPVAYEQYGQEVVPSTNLSQRSGKMR

SEQ ID NO: 77751 - protein, 33 aa, Artificial Sequence
  Description of Artificial Sequence: Synthetic polypeptide
TEEEIATTNPVATEQYGSVSVTGNNISQIGGSR

SEQ ID NO: 77752 - protein, 33 aa, Artificial Sequence
  Description of Artificial Sequence: Synthetic polypeptide
DEEEIRTTNPVATEQYGDVVSGNSGDEQNEGNI

SEQ ID NO: 77753 - protein, 33 aa, Artificial Sequence
  Description of Artificial Sequence: Synthetic polypeptide
DEEEIRTTNPVATEQYGEAGVCGGNLVQEVGNE

SEQ ID NO: 77754 - protein, 33 aa, Artificial Sequence
  Description of Artificial Sequence: Synthetic polypeptide
VEEEIRTTNPVATEQYGVVSSTGNGQTQGGGNI

SEQ ID NO: 77755 - protein, 32 aa, Artificial Sequence
  Description of Artificial Sequence: Synthetic polypeptide
DEEEIRTTNPVAYEAYGSTVSTGNHTMMVGNA

SEQ ID NO: 77756 - protein, 34 aa, Artificial Sequence
  Description of Artificial Sequence: Synthetic polypeptide
DEEEIRTTNPVATEQYGTVSDTNLVGVGGNNNGD

SEQ ID NO: 77757 - protein, 31 aa, Artificial Sequence
  Description of Artificial Sequence: Synthetic polypeptide
DEEEIRTTNPVAYEAYGSTVSTGPLTMVGLA

SEQ ID NO: 77758 - protein, 32 aa, Artificial Sequence
  Description of Artificial Sequence: Synthetic polypeptide
DEEEIRTTNPVATEQYGTVSDNMGMGNGNGTP

SEQ ID NO: 77759 - protein, 32 aa, Artificial Sequence
  Description of Artificial Sequence: Synthetic polypeptide
DEEEIRTTNPVATEQYGTVSDNMGMGGEGNIN

SEQ ID NO: 77760 - protein, 32 aa, Artificial Sequence
  Description of Artificial Sequence: Synthetic polypeptide
DEEEIRTTNPVATEQYGTVPFTALQGHDMNIW

SEQ ID NO: 77761 - protein, 31 aa, Artificial Sequence
  Description of Artificial Sequence: Synthetic polypeptide
DEENIATTNPVATEIYGQVTTGNMQQDGSNR

SEQ ID NO: 77762 - protein, 32 aa, Artificial Sequence
  Description of Artificial Sequence: Synthetic polypeptide
DEENIATTNPVATEIYGQVTTGNGLQDGDNQR

SEQ ID NO: 77763 - protein, 34 aa, Artificial Sequence
  Description of Artificial Sequence: Synthetic polypeptide
DEEEIRTTNPVAYEAYGSTVSTPSLSAQTGNERI

SEQ ID NO: 77764 - protein, 33 aa, Artificial Sequence
  Description of Artificial Sequence: Synthetic polypeptide
VEEEIRTTNPVATEQYGSVVNSLFTQNRGNDMY

SEQ ID NO: 77765 - protein, 34 aa, Artificial Sequence
  Description of Artificial Sequence: Synthetic polypeptide
DEEEIRTTNPVATEQYGCAVCSTNLQENFGSEQS

SEQ ID NO: 77766 - protein, 35 aa, Artificial Sequence
  Description of Artificial Sequence: Synthetic polypeptide
AEEEIRTTNPVATEQYGSVSTTNNLQQQIGTNEES

SEQ ID NO: 77767 - protein, 33 aa, Artificial Sequence
  Description of Artificial Sequence: Synthetic polypeptide
DEEEIRTTNPVATEQYGCAVCSTNHQHFGSEQS

SEQ ID NO: 77768 - protein, 35 aa, Artificial Sequence
  Description of Artificial Sequence: Synthetic polypeptide
AEEEIRTTNPVATEQYGSVSTTNNLQTGNGETGTD

SEQ ID NO: 77769 - protein, 34 aa, Artificial Sequence
  Description of Artificial Sequence: Synthetic polypeptide
AEEEIRTTNPVATEQYGSVSTTNNLQQQNNDGED

SEQ ID NO: 77770 - protein, 31 aa, Artificial Sequence
  Description of Artificial Sequence: Synthetic polypeptide
DDGEIRTTNPVATEQYGSCVSTVLLELGDQQ

SEQ ID NO: 77771 - protein, 35 aa, Artificial Sequence
  Description of Artificial Sequence: Synthetic polypeptide
AEEEIRTTNPVATEQYGSVSTTNNLQQQQGENGEG

SEQ ID NO: 77772 - protein, 36 aa, Artificial Sequence
  Description of Artificial Sequence: Synthetic polypeptide
DEEEIRTTNPVATEQYGTVISCTINPLSQPRVGNNN

SEQ ID NO: 77773 - protein, 32 aa, Artificial Sequence
  Description of Artificial Sequence: Synthetic polypeptide
DEEEIRTTNPCATEPYGSVAGTNHGNRGMNAM

SEQ ID NO: 77774 - protein, 35 aa, Artificial Sequence
  Description of Artificial Sequence: Synthetic polypeptide
DEEEIRTTNPVATEQYGTVISCTINGLSQRVLNNE

SEQ ID NO: 77775 - protein, 35 aa, Artificial Sequence
  Description of Artificial Sequence: Synthetic polypeptide
AEEEIRTTNPVATEQYGSVSTTNNLQQQQGNNNVE

SEQ ID NO: 77776 - protein, 35 aa, Artificial Sequence
  Description of Artificial Sequence: Synthetic polypeptide
DEEEIRTTNPVATEQYGTVIPSCTINALSQRVNNN

SEQ ID NO: 77777 - protein, 32 aa, Artificial Sequence
  Description of Artificial Sequence: Synthetic polypeptide
DEEEIRTTNPVATEQYGDVYGTDEGQGEGGNQ

SEQ ID NO: 77778 - protein, 33 aa, Artificial Sequence
  Description of Artificial Sequence: Synthetic polypeptide
VEEEIRTTNPVATEQYGTVVSTTGNGQGGNNQG

SEQ ID NO: 77779 - protein, 32 aa, Artificial Sequence
  Description of Artificial Sequence: Synthetic polypeptide
VEEEIRTTNPVATEQYGVVSSGFGNEGQGGNA

SEQ ID NO: 77780 - protein, 34 aa, Artificial Sequence
  Description of Artificial Sequence: Synthetic polypeptide
AEEEIRTTNPVATEQYGSVSTTNNLQQQTNGIDT

SEQ ID NO: 77781 - protein, 34 aa, Artificial Sequence
  Description of Artificial Sequence: Synthetic polypeptide
DEAEIATTNPVAYEQYGSVACSTNPLQDSDGNRD

SEQ ID NO: 77782 - protein, 34 aa, Artificial Sequence
  Description of Artificial Sequence: Synthetic polypeptide
DEEEIRTTNPVATEQYGTVDSGTLNIGQGGGNEN

SEQ ID NO: 77783 - protein, 35 aa, Artificial Sequence
  Description of Artificial Sequence: Synthetic polypeptide
AEEEIRTTNPVATEQYGSVSTTNNLQQQNNGNNTE

SEQ ID NO: 77784 - protein, 35 aa, Artificial Sequence
  Description of Artificial Sequence: Synthetic polypeptide
AEEEIRTTNPVATEQYGSVSTTNNLQQEDEGTNNE

SEQ ID NO: 77785 - protein, 34 aa, Artificial Sequence
  Description of Artificial Sequence: Synthetic polypeptide
DEEEIRTTNPVATEQYGTVSTMTNGQEGGENDIF

SEQ ID NO: 77786 - protein, 33 aa, Artificial Sequence
  Description of Artificial Sequence: Synthetic polypeptide
VEEEIRTTNPVATEQYGSVSTMTDQGGMGENTG

SEQ ID NO: 77787 - protein, 34 aa, Artificial Sequence
  Description of Artificial Sequence: Synthetic polypeptide
AEEEIRTTNPVATEQYGSVSTTNNLLEQGNDETS

SEQ ID NO: 77788 - protein, 34 aa, Artificial Sequence
  Description of Artificial Sequence: Synthetic polypeptide
DEEEIRTTNPVATEQYGDVVDGTNLQNIGGNGNF

SEQ ID NO: 77789 - protein, 28 aa, Artificial Sequence
  Description of Artificial Sequence: Synthetic peptide
DEMEIVTTNPVATEGYGTMASTLQHGDD

SEQ ID NO: 77790 - protein, 34 aa, Artificial Sequence
  Description of Artificial Sequence: Synthetic polypeptide
AEEEIRTTNPVATEQYGSVSTTNNLLQEGETTEE

SEQ ID NO: 77791 - protein, 35 aa, Artificial Sequence
  Description of Artificial Sequence: Synthetic polypeptide
AEEEIRTTNPVATEQYGSVSTTNNLLQENGNNQQG

SEQ ID NO: 77792 - protein, 31 aa, Artificial Sequence
  Description of Artificial Sequence: Synthetic polypeptide
DDETIRTTNPVATEQYGSVSTGGEGGGQENT

SEQ ID NO: 77793 - protein, 34 aa, Artificial Sequence
  Description of Artificial Sequence: Synthetic polypeptide
AEEEIRTTNPVATEQYGSVSTTNNLLQNEDENEG

SEQ ID NO: 77794 - protein, 33 aa, Artificial Sequence
  Description of Artificial Sequence: Synthetic polypeptide
VEEEIRTTNPVATEQYGSVSNNNIGQSEGGNNV

SEQ ID NO: 77795 - protein, 31 aa, Artificial Sequence
  Description of Artificial Sequence: Synthetic polypeptide
DEMEIVTTNPVATEGYGTVCSANTIEREGNR

SEQ ID NO: 77796 - protein, 31 aa, Artificial Sequence
  Description of Artificial Sequence: Synthetic polypeptide
DEMEIVTTNPVATEGYGTVCSANTIERVGNR

SEQ ID NO: 77797 - protein, 32 aa, Artificial Sequence
  Description of Artificial Sequence: Synthetic polypeptide
DEEEIRTTNPVAYEAYGISVATPYLSQPGGNQ

SEQ ID NO: 77798 - protein, 35 aa, Artificial Sequence
  Description of Artificial Sequence: Synthetic polypeptide
AEEEIRTTNPVATEQYGSVSTTNNLLQQGNQGNEG

SEQ ID NO: 77799 - protein, 33 aa, Artificial Sequence
  Description of Artificial Sequence: Synthetic polypeptide
DEEEIRTTNPCATEQWGSVYCTDNMDQRGTNHA

SEQ ID NO: 77800 - protein, 32 aa, Artificial Sequence
  Description of Artificial Sequence: Synthetic polypeptide
DEEEIRTTNPVAYEAYGETVSTGNLTMEVGNA

SEQ ID NO: 77801 - protein, 33 aa, Artificial Sequence
  Description of Artificial Sequence: Synthetic polypeptide
DEEEIRTTNPVAYEAYGISVCSTNQSQGGGNLV

SEQ ID NO: 77802 - protein, 34 aa, Artificial Sequence
  Description of Artificial Sequence: Synthetic polypeptide
AEEEIRTTNPVATEQYGSVSTTNNLNENAGGNQE

SEQ ID NO: 77803 - protein, 34 aa, Artificial Sequence
  Description of Artificial Sequence: Synthetic polypeptide
VEEEIRTTNPVATEQYGSVSNTNFGQIQGGGNEE

SEQ ID NO: 77804 - protein, 35 aa, Artificial Sequence
  Description of Artificial Sequence: Synthetic polypeptide
DEEEIRTTNPVATEQYGTVSTTTNNTLEQRTEENN

SEQ ID NO: 77805 - protein, 31 aa, Artificial Sequence
  Description of Artificial Sequence: Synthetic polypeptide
DDETIRTTNPVATEQYGSVSTGGEGGGQNET

SEQ ID NO: 77806 - protein, 32 aa, Artificial Sequence
  Description of Artificial Sequence: Synthetic polypeptide
VEEEIRTTNPVATEQYGSVSPTNLINAIEVTD

SEQ ID NO: 77807 - protein, 31 aa, Artificial Sequence
  Description of Artificial Sequence: Synthetic polypeptide
DDETIRTTNPVATEQYGSVSTQGGEGGGGNT

SEQ ID NO: 77808 - protein, 31 aa, Artificial Sequence
  Description of Artificial Sequence: Synthetic polypeptide
DEENICTVNPVATEQYGSVSTALQQQNNQDE

SEQ ID NO: 77809 - protein, 32 aa, Artificial Sequence
  Description of Artificial Sequence: Synthetic polypeptide
DEEEIRTTNPVAYEAYGKTVSTGNLTPMVGNH

SEQ ID NO: 77810 - protein, 33 aa, Artificial Sequence
  Description of Artificial Sequence: Synthetic polypeptide
VEEEIRTTNPVATEQYGSVSQTNLQVTESQAIG

SEQ ID NO: 77811 - protein, 33 aa, Artificial Sequence
  Description of Artificial Sequence: Synthetic polypeptide
VEEEIRTTNPVATEQYGSVSSDNDQQNEGGEND

SEQ ID NO: 77812 - protein, 30 aa, Artificial Sequence
  Description of Artificial Sequence: Synthetic polypeptide
DDETIRTTNPVATEQYGSVVTGDEGGGNDT

SEQ ID NO: 77813 - protein, 32 aa, Artificial Sequence
  Description of Artificial Sequence: Synthetic polypeptide
DDEVIRTTNPVATEQYGKVSTNHTEGRVGNAL

SEQ ID NO: 77814 - protein, 31 aa, Artificial Sequence
  Description of Artificial Sequence: Synthetic polypeptide
DEENICTTNPVATEIYGVVVTTNLQQGSNIE

SEQ ID NO: 77815 - protein, 33 aa, Artificial Sequence
  Description of Artificial Sequence: Synthetic polypeptide
VEEEIRTTNPVATEQYGSVSNTDEQGQENEGNT

SEQ ID NO: 77816 - protein, 31 aa, Artificial Sequence
  Description of Artificial Sequence: Synthetic polypeptide
DEENICTTNPVATEIYGVVTVTNQLQQGSNI

SEQ ID NO: 77817 - protein, 33 aa, Artificial Sequence
  Description of Artificial Sequence: Synthetic polypeptide
DEENIRTTNPVATAQYGSVSTENGLYNSNGNGT

SEQ ID NO: 77818 - protein, 35 aa, Artificial Sequence
  Description of Artificial Sequence: Synthetic polypeptide
AEEEIRTTNPVATEQYGSVSTTNNLGQTNQGTNAT

SEQ ID NO: 77819 - protein, 33 aa, Artificial Sequence
  Description of Artificial Sequence: Synthetic polypeptide
VEEEIRTTNPVATEQYGSVSITNMGMGGENTGQ

SEQ ID NO: 77820 - protein, 32 aa, Artificial Sequence
  Description of Artificial Sequence: Synthetic polypeptide
DEMEIVCTNPVATEQYGSVCSATDGPVERGNR

SEQ ID NO: 77821 - protein, 33 aa, Artificial Sequence
  Description of Artificial Sequence: Synthetic polypeptide
DEEEIRTTNPVATEQYGCQVCSTNHQRFISEQS

SEQ ID NO: 77822 - protein, 33 aa, Artificial Sequence
  Description of Artificial Sequence: Synthetic polypeptide
DEEEIRTTNPVATEQYGDVTSTDNLNNMNELGM

SEQ ID NO: 77823 - protein, 32 aa, Artificial Sequence
  Description of Artificial Sequence: Synthetic polypeptide
DEEEIRTTNPVATEQYGDVTSTGNLNNMDEGG

SEQ ID NO: 77824 - protein, 29 aa, Artificial Sequence
  Description of Artificial Sequence: Synthetic peptide
DEMEIVCTNPVATEQYGTVCSEGPMFGNR

SEQ ID NO: 77825 - protein, 30 aa, Artificial Sequence
  Description of Artificial Sequence: Synthetic polypeptide
DEEEIRTTNPCATEQYGCVATWLAPDGDEM

SEQ ID NO: 77826 - protein, 33 aa, Artificial Sequence
  Description of Artificial Sequence: Synthetic polypeptide
DEEEIRTTNPVATEQYGDVTSTNLDNNMNMEGM

SEQ ID NO: 77827 - protein, 33 aa, Artificial Sequence
  Description of Artificial Sequence: Synthetic polypeptide
DEEEIRTTNPVATEQYGDVTSTNNLNNMNVEGM

SEQ ID NO: 77828 - protein, 30 aa, Artificial Sequence
  Description of Artificial Sequence: Synthetic polypeptide
DEEEIRTTNPCATEQYGCVATWLADHGDEL

SEQ ID NO: 77829 - protein, 32 aa, Artificial Sequence
  Description of Artificial Sequence: Synthetic polypeptide
DEEEIRTTNPVATEQYGDVTSVDNDTTGGNQG

SEQ ID NO: 77830 - protein, 29 aa, Artificial Sequence
  Description of Artificial Sequence: Synthetic peptide
DEMEIVPTNPVATEQYGTVSCGLESEGND

SEQ ID NO: 77831 - protein, 34 aa, Artificial Sequence
  Description of Artificial Sequence: Synthetic polypeptide
AEEEIRTTNPVATEQYGSVSTTNNEQQGEEENDG

SEQ ID NO: 77832 - protein, 33 aa, Artificial Sequence
  Description of Artificial Sequence: Synthetic polypeptide
DEEEIRTTNPVATEQYGDVVDGQTNEIQGGGNI

SEQ ID NO: 77833 - protein, 34 aa, Artificial Sequence
  Description of Artificial Sequence: Synthetic polypeptide
DEEEIRTTNPVATEQYGDVVDDTNLNREGENFGE

SEQ ID NO: 77834 - protein, 34 aa, Artificial Sequence
  Description of Artificial Sequence: Synthetic polypeptide
VEEEIRTTNPVATEQYGSVSLTNLQVTESQNAID

SEQ ID NO: 77835 - protein, 33 aa, Artificial Sequence
  Description of Artificial Sequence: Synthetic polypeptide
AEEEIRTTNPVATEQYGSVSTTNNINDEQGNDG

SEQ ID NO: 77836 - protein, 34 aa, Artificial Sequence
  Description of Artificial Sequence: Synthetic polypeptide
DEEEIRTTNPVAYEAWGSVVSTNPLGRTQGNYRQ

SEQ ID NO: 77837 - protein, 33 aa, Artificial Sequence
  Description of Artificial Sequence: Synthetic polypeptide
DEEEIRTTNPVATEQYGTVSTYVDLIGGGNGNN

SEQ ID NO: 77838 - protein, 35 aa, Artificial Sequence
  Description of Artificial Sequence: Synthetic polypeptide
VEEEIRTTNPVATEQYGSVSLTPNLEQERPENQIA

SEQ ID NO: 77839 - protein, 31 aa, Artificial Sequence
  Description of Artificial Sequence: Synthetic polypeptide
DEEEIRTTNPVAYEAYGATVSTGNVTMVGNA

SEQ ID NO: 77840 - protein, 33 aa, Artificial Sequence
  Description of Artificial Sequence: Synthetic polypeptide
DEEEIRTTNPVAYEAYGCSVPSYTGGLGVVGNR

SEQ ID NO: 77841 - protein, 31 aa, Artificial Sequence
  Description of Artificial Sequence: Synthetic polypeptide
DEMEIVSTNPVATEQYGTVSATDGPERVGNR

SEQ ID NO: 77842 - protein, 34 aa, Artificial Sequence
  Description of Artificial Sequence: Synthetic polypeptide
DEEEIRTTNPVAYEAYGCSVVATALSQRGGNLRL

SEQ ID NO: 77843 - protein, 34 aa, Artificial Sequence
  Description of Artificial Sequence: Synthetic polypeptide
DEEEIRTTNPVAYEAYGCSVVSTAEQSQRGGNLR

SEQ ID NO: 77844 - protein, 30 aa, Artificial Sequence
  Description of Artificial Sequence: Synthetic polypeptide
DEMEIVTTNPIATEQYGTVCSEDNLEFGND

SEQ ID NO: 77845 - protein, 30 aa, Artificial Sequence
  Description of Artificial Sequence: Synthetic polypeptide
DEMEIVTTNPIATEQYGTVCSTDNPEFGND

SEQ ID NO: 77846 - protein, 32 aa, Artificial Sequence
  Description of Artificial Sequence: Synthetic polypeptide
VEEEIRTTNPVATEQYGSVSNNDGQGNEFGQG

SEQ ID NO: 77847 - protein, 31 aa, Artificial Sequence
  Description of Artificial Sequence: Synthetic polypeptide
DEEEIRTTNPCATEQYGCNVATWLAQDGDEQ

SEQ ID NO: 77848 - protein, 32 aa, Artificial Sequence
  Description of Artificial Sequence: Synthetic polypeptide
DEEEIRTTNPVATEQYGCTCSTNEHINFGSNQ

SEQ ID NO: 77849 - protein, 34 aa, Artificial Sequence
  Description of Artificial Sequence: Synthetic polypeptide
VEEEIRTTNPVATEQYGSVSSTGNDQGEEGNNGN

SEQ ID NO: 77850 - protein, 35 aa, Artificial Sequence
  Description of Artificial Sequence: Synthetic polypeptide
AEEEIRTTNPVATEQYGSVSTTNNLNQNIGTNSEV

SEQ ID NO: 77851 - protein, 32 aa, Artificial Sequence
  Description of Artificial Sequence: Synthetic polypeptide
DEENICTTNPVATEIYGQVATGNLQDRDGSND

SEQ ID NO: 77852 - protein, 31 aa, Artificial Sequence
  Description of Artificial Sequence: Synthetic polypeptide
DEEEIRTTNPVAYEAYGNTVSTGNLTMVGQA

SEQ ID NO: 77853 - protein, 35 aa, Artificial Sequence
  Description of Artificial Sequence: Synthetic polypeptide
AEEEIRTTNPVATEQYGSVSTTNNLQEGTTENSEN

SEQ ID NO: 77854 - protein, 35 aa, Artificial Sequence
  Description of Artificial Sequence: Synthetic polypeptide
AEEEIRTTNPVATEQYGSVSTTNNLQENDEGNNTN

SEQ ID NO: 77855 - protein, 32 aa, Artificial Sequence
  Description of Artificial Sequence: Synthetic polypeptide
DEEEIRTTNPVAYEAYGNVPSYTAGLGAVGNR

SEQ ID NO: 77856 - protein, 33 aa, Artificial Sequence
  Description of Artificial Sequence: Synthetic polypeptide
DEEEIRTTNPVATEQYGCIVCSTEHQGFGSNQM

SEQ ID NO: 77857 - protein, 32 aa, Artificial Sequence
  Description of Artificial Sequence: Synthetic polypeptide
DEEEIRTTNPVAYEAYGNVSCTNQTRDGGSRA

SEQ ID NO: 77858 - protein, 34 aa, Artificial Sequence
  Description of Artificial Sequence: Synthetic polypeptide
DEEEIRTTNPVAYEAYGQSCSTDNELSQRPGGNQ

SEQ ID NO: 77859 - protein, 30 aa, Artificial Sequence
  Description of Artificial Sequence: Synthetic polypeptide
SEEEIRTTNPIATECYGSVANENWAEPGNR

SEQ ID NO: 77860 - protein, 34 aa, Artificial Sequence
  Description of Artificial Sequence: Synthetic polypeptide
VEEEIRTTNPVATEQYGSVSTGNLQMNIGGEEMN

SEQ ID NO: 77861 - protein, 33 aa, Artificial Sequence
  Description of Artificial Sequence: Synthetic polypeptide
DEMEIVTTNPVATEQYGSVCSTINPVEREGENG

SEQ ID NO: 77862 - protein, 31 aa, Artificial Sequence
  Description of Artificial Sequence: Synthetic polypeptide
SEEEIRTTNPIATECWGSTVSNANWMERGNR

SEQ ID NO: 77863 - protein, 31 aa, Artificial Sequence
  Description of Artificial Sequence: Synthetic polypeptide
DEAEIATTNPVAYEQWGSVSTNLNQNGGDEA

SEQ ID NO: 77864 - protein, 35 aa, Artificial Sequence
  Description of Artificial Sequence: Synthetic polypeptide
AEEEIRTTNPVATEQYGSVSTTNNLQEDEGNNNNN

SEQ ID NO: 77865 - protein, 32 aa, Artificial Sequence
  Description of Artificial Sequence: Synthetic polypeptide
DEAEIATTNPVAYEQWGSVSTNLQAQGGGNDS

SEQ ID NO: 77866 - protein, 31 aa, Artificial Sequence
  Description of Artificial Sequence: Synthetic polypeptide
DEAEIATTNPVAYEQWGSVSTNLQGAGGDTS

SEQ ID NO: 77867 - protein, 31 aa, Artificial Sequence
  Description of Artificial Sequence: Synthetic polypeptide
DEAEIATTNPVAYEQWGSVSTNLQGNEDDHE

SEQ ID NO: 77868 - protein, 32 aa, Artificial Sequence
  Description of Artificial Sequence: Synthetic polypeptide
SEEEIRTTNPAATEQYGSVSDTNGGQGGEEFT

SEQ ID NO: 77869 - protein, 33 aa, Artificial Sequence
  Description of Artificial Sequence: Synthetic polypeptide
SEEEIRTTNPAATEQYGSVIADGNLQREGGNGG

SEQ ID NO: 77870 - protein, 31 aa, Artificial Sequence
  Description of Artificial Sequence: Synthetic polypeptide
DEAEIATTNPVAYEQWGSVSTNLQLSGGGEA

SEQ ID NO: 77871 - protein, 28 aa, Artificial Sequence
  Description of Artificial Sequence: Synthetic peptide
SEEEIRSTNPVSTEQWGSVSTAEEVGDY

SEQ ID NO: 77872 - protein, 35 aa, Artificial Sequence
  Description of Artificial Sequence: Synthetic polypeptide
AEEEIRTTNPVATEQYGSVSTTNNLQLGGGNNDET

SEQ ID NO: 77873 - protein, 34 aa, Artificial Sequence
  Description of Artificial Sequence: Synthetic polypeptide
AEEEIRTTNPVATEQYGSVSTTNNLQNANNQGDE

SEQ ID NO: 77874 - protein, 30 aa, Artificial Sequence
  Description of Artificial Sequence: Synthetic polypeptide
DEAEIATTNPVAYEQWGSVSTNSQGDGDVS

SEQ ID NO: 77875 - protein, 35 aa, Artificial Sequence
  Description of Artificial Sequence: Synthetic polypeptide
AEEEIRTTNPVATEQYGSVSTTNNLQNNEQGNNSN

SEQ ID NO: 77876 - protein, 32 aa, Artificial Sequence
  Description of Artificial Sequence: Synthetic polypeptide
DEENICTTNPVATEAYGVVSTTTNLQQGSNAS

SEQ ID NO: 77877 - protein, 33 aa, Artificial Sequence
  Description of Artificial Sequence: Synthetic polypeptide
DEEEIRTTNPVATEQYGDVVSDNSGDQGNGGND

SEQ ID NO: 77878 - protein, 35 aa, Artificial Sequence
  Description of Artificial Sequence: Synthetic polypeptide
AEEEIRTTNPVATEQYGSVSTTNNLQNQQGNNDTE

SEQ ID NO: 77879 - protein, 35 aa, Artificial Sequence
  Description of Artificial Sequence: Synthetic polypeptide
AEEEIRTTNPVATEQYGSVSTTNNLQGNEQGGNDD

SEQ ID NO: 77880 - protein, 35 aa, Artificial Sequence
  Description of Artificial Sequence: Synthetic polypeptide
AEEEIRTTNPVATEQYGSVSTTNNLNQNGEEANDD

SEQ ID NO: 77881 - protein, 35 aa, Artificial Sequence
  Description of Artificial Sequence: Synthetic polypeptide
AEEEIRTTNPVATEQYGSVSTTNNLQEDEGENGTN

SEQ ID NO: 77882 - protein, 34 aa, Artificial Sequence
  Description of Artificial Sequence: Synthetic polypeptide
AEEEIRTTNPVATEQYGSVSTTNNLQDEQGETEE

SEQ ID NO: 77883 - protein, 33 aa, Artificial Sequence
  Description of Artificial Sequence: Synthetic polypeptide
VEEEIRTTNPVATEQYGSVSSTLNQNNEGGNIG

SEQ ID NO: 77884 - protein, 31 aa, Artificial Sequence
  Description of Artificial Sequence: Synthetic polypeptide
SEEEIRTTNPIATEQYGSTWSNENLMERGPI

SEQ ID NO: 77885 - protein, 31 aa, Artificial Sequence
  Description of Artificial Sequence: Synthetic polypeptide
SEEEIRTTNPIATEQYGSTWSNENLAERGPI

SEQ ID NO: 77886 - protein, 31 aa, Artificial Sequence
  Description of Artificial Sequence: Synthetic polypeptide
DEMEIVTTNPVATEQYGEASEDGLVQFEGNR

SEQ ID NO: 77887 - protein, 35 aa, Artificial Sequence
  Description of Artificial Sequence: Synthetic polypeptide
AEEEIRTTNPVATEQYGSVSTTNNLNQNQGENATE

SEQ ID NO: 77888 - protein, 32 aa, Artificial Sequence
  Description of Artificial Sequence: Synthetic polypeptide
DEEEIRTTNPVATEQYGDVVGNSGDQNGGGND

SEQ ID NO: 77889 - protein, 31 aa, Artificial Sequence
  Description of Artificial Sequence: Synthetic polypeptide
DEMEIVTTNPVATEQYGEVSAEDGLEFEGNR

SEQ ID NO: 77890 - protein, 35 aa, Artificial Sequence
  Description of Artificial Sequence: Synthetic polypeptide
AEEEIRTTNPVATEQYGSVSTTNNLNQNQQGNDTE

SEQ ID NO: 77891 - protein, 35 aa, Artificial Sequence
  Description of Artificial Sequence: Synthetic polypeptide
AEEEIRTTNPVATEQYGSVSTTNNLNQNQQGNEED

SEQ ID NO: 77892 - protein, 34 aa, Artificial Sequence
  Description of Artificial Sequence: Synthetic polypeptide
AEEEIRTTNPVATEQYGSVSTTNNLNQQEGETEE

SEQ ID NO: 77893 - protein, 34 aa, Artificial Sequence
  Description of Artificial Sequence: Synthetic polypeptide
VEEEIRTTNPVATEQYGSVSSTNGFGQGEGNNNN

SEQ ID NO: 77894 - protein, 35 aa, Artificial Sequence
  Description of Artificial Sequence: Synthetic polypeptide
AEEEIRTTNPVATEQYGSVSTTNNLNQQGNEQNND

SEQ ID NO: 77895 - protein, 35 aa, Artificial Sequence
  Description of Artificial Sequence: Synthetic polypeptide
AEEEIRTTNPVATEQYGSVSTTNNLNQQGNGENND

SEQ ID NO: 77896 - protein, 32 aa, Artificial Sequence
  Description of Artificial Sequence: Synthetic polypeptide
DEENICTTNPVATEIYGVVSTTTNLQQGSNID

SEQ ID NO: 77897 - protein, 35 aa, Artificial Sequence
  Description of Artificial Sequence: Synthetic polypeptide
AEEEIRTTNPVATEQYGSVSTTNNLNQQNGENGSE

SEQ ID NO: 77898 - protein, 35 aa, Artificial Sequence
  Description of Artificial Sequence: Synthetic polypeptide
AEEEIRTTNPVATEQYGSVSTTNNLNQQQGNEQGE

SEQ ID NO: 77899 - protein, 32 aa, Artificial Sequence
  Description of Artificial Sequence: Synthetic polypeptide
DEMEIVTTNPVATEQYGSVCSATDDLEHEGNL

SEQ ID NO: 77900 - protein, 28 aa, Artificial Sequence
  Description of Artificial Sequence: Synthetic peptide
SEEEIRTTNPIATEQYGEAPEVCQHENR

SEQ ID NO: 77901 - protein, 34 aa, Artificial Sequence
  Description of Artificial Sequence: Synthetic polypeptide
DEEEIRTTNPVATEQYGTVSTPDIPNMQNGMNPV

SEQ ID NO: 77902 - protein, 35 aa, Artificial Sequence
  Description of Artificial Sequence: Synthetic polypeptide
AEEEIRTTNPVATEQYGSVSTTNNLQAGQEGTNQD

SEQ ID NO: 77903 - protein, 34 aa, Artificial Sequence
  Description of Artificial Sequence: Synthetic polypeptide
VEEEIRTTNPVATEQYGSVSSTQNGQQGEGNNNT

SEQ ID NO: 77904 - protein, 31 aa, Artificial Sequence
  Description of Artificial Sequence: Synthetic polypeptide
DEENICTTNPVATEIYGVVTTVTNLQQGSER

SEQ ID NO: 77905 - protein, 32 aa, Artificial Sequence
  Description of Artificial Sequence: Synthetic polypeptide
DEMEIVTTNPVATEQYGSVCSATDLEDHEGNL

SEQ ID NO: 77906 - protein, 30 aa, Artificial Sequence
  Description of Artificial Sequence: Synthetic polypeptide
DEAEIATTNPVAYEQWGSVSTDNHGAAGNS

SEQ ID NO: 77907 - protein, 34 aa, Artificial Sequence
  Description of Artificial Sequence: Synthetic polypeptide
DEEEIRTTNPVATEQYGDVVGTGNLNQDGGNGNE

SEQ ID NO: 77908 - protein, 31 aa, Artificial Sequence
  Description of Artificial Sequence: Synthetic polypeptide
DEEEIRTTNPCATEQWGSVSQNIPFHGDNQD

SEQ ID NO: 77909 - protein, 31 aa, Artificial Sequence
  Description of Artificial Sequence: Synthetic polypeptide
DEENICTTNPVATEIYGVVTTTNNLQQGSNI

SEQ ID NO: 77910 - protein, 34 aa, Artificial Sequence
  Description of Artificial Sequence: Synthetic polypeptide
AEEEIRTTNPVATEQYGSVSTTNNLQDENGETTE

SEQ ID NO: 77911 - protein, 34 aa, Artificial Sequence
  Description of Artificial Sequence: Synthetic polypeptide
VEEEIRTTNPVATEQYGSVSSTQGLGQNGGNGGT

SEQ ID NO: 77912 - protein, 31 aa, Artificial Sequence
  Description of Artificial Sequence: Synthetic polypeptide
DEAEIATTNPVATEQYGSVCAAGNEQGEGNN

SEQ ID NO: 77913 - protein, 34 aa, Artificial Sequence
  Description of Artificial Sequence: Synthetic polypeptide
DEETIRTTNPVATEQYGSVSTTNQEQLGNGNQTE

SEQ ID NO: 77914 - protein, 32 aa, Artificial Sequence
  Description of Artificial Sequence: Synthetic polypeptide
DAEEIASTNPVATEQYGSVSWNEQDRNGDQMR

SEQ ID NO: 77915 - protein, 33 aa, Artificial Sequence
  Description of Artificial Sequence: Synthetic polypeptide
DEEEIRTTNPVATEQYGCVCSTGAHQRFNSQQS

SEQ ID NO: 77916 - protein, 32 aa, Artificial Sequence
  Description of Artificial Sequence: Synthetic polypeptide
DEHEIATTNPVATEQYGCVTSTNLGDNDGNTV

SEQ ID NO: 77917 - protein, 34 aa, Artificial Sequence
  Description of Artificial Sequence: Synthetic polypeptide
TEEEIRTTNPVATEQYGKTVSYTNWSQQAGGNPR

SEQ ID NO: 77918 - protein, 34 aa, Artificial Sequence
  Description of Artificial Sequence: Synthetic polypeptide
DEEEIRTTNPVATEQYGCVCSTGALQGFGSNNDA

SEQ ID NO: 77919 - protein, 33 aa, Artificial Sequence
  Description of Artificial Sequence: Synthetic polypeptide
TEEEIRTTNPVATEQYGKVSCTANLSMREVNNM

SEQ ID NO: 77920 - protein, 31 aa, Artificial Sequence
  Description of Artificial Sequence: Synthetic polypeptide
DEAEIATTNPVATEQYGSVAATALQAEPNDN

SEQ ID NO: 77921 - protein, 28 aa, Artificial Sequence
  Description of Artificial Sequence: Synthetic peptide
DEGEIAPTNPCSSEQYGIVSCNLQSGTR

SEQ ID NO: 77922 - protein, 33 aa, Artificial Sequence
  Description of Artificial Sequence: Synthetic polypeptide
TEEEIRTTNPVATEQYGQSVVSTHHTAVGNNRE

SEQ ID NO: 77923 - protein, 33 aa, Artificial Sequence
  Description of Artificial Sequence: Synthetic polypeptide
AEEEIRTTNPVATEQYGCVCSTENHQNGSENQS

SEQ ID NO: 77924 - protein, 32 aa, Artificial Sequence
  Description of Artificial Sequence: Synthetic polypeptide
DEHEIATTNPVATEQYGSVAATNLERGGPLES

SEQ ID NO: 77925 - protein, 32 aa, Artificial Sequence
  Description of Artificial Sequence: Synthetic polypeptide
SSEEIRTTNPVAYAQYGSVVSTSLSQRGGNNF

SEQ ID NO: 77926 - protein, 32 aa, Artificial Sequence
  Description of Artificial Sequence: Synthetic polypeptide
AEEEIRTTNPVATEQYGCVCSTEPLENFGSNQ

SEQ ID NO: 77927 - protein, 32 aa, Artificial Sequence
  Description of Artificial Sequence: Synthetic polypeptide
AEEEIRTTNPVATEQYGCVCSTEPQRFGSEQQ

SEQ ID NO: 77928 - protein, 33 aa, Artificial Sequence
  Description of Artificial Sequence: Synthetic polypeptide
TEEEIRTTNPVATEQYGQTVVSTGHLTAVGNNR

SEQ ID NO: 77929 - protein, 33 aa, Artificial Sequence
  Description of Artificial Sequence: Synthetic polypeptide
SSEEIRTTNPVATHQYGSVVSCTGLSQRGGNNY

SEQ ID NO: 77930 - protein, 32 aa, Artificial Sequence
  Description of Artificial Sequence: Synthetic polypeptide
DEHEIATTNPVATEQYGSVAGTNDQNGENGEN

SEQ ID NO: 77931 - protein, 31 aa, Artificial Sequence
  Description of Artificial Sequence: Synthetic polypeptide
DDEEIKTTNPVATEQYGSVSNNSGFQNEGEF

SEQ ID NO: 77932 - protein, 29 aa, Artificial Sequence
  Description of Artificial Sequence: Synthetic peptide
DEHEIATTNPVATEQYGSVATGVPDGTDS

SEQ ID NO: 77933 - protein, 34 aa, Artificial Sequence
  Description of Artificial Sequence: Synthetic polypeptide
DEHEIATTNPVATEQYGSVCADTNLQMDGDDNRA

SEQ ID NO: 77934 - protein, 34 aa, Artificial Sequence
  Description of Artificial Sequence: Synthetic polypeptide
DEHEIATTNPVATEQYGSVCADTNNLQDSGDNRA

SEQ ID NO: 77935 - protein, 32 aa, Artificial Sequence
  Description of Artificial Sequence: Synthetic polypeptide
AEEEIRTTNPAATEQYGSVTTNPLAVSVGNLN

SEQ ID NO: 77936 - protein, 32 aa, Artificial Sequence
  Description of Artificial Sequence: Synthetic polypeptide
DEAEIATTNPVATEQYGSVAANLQTPDDNARE

SEQ ID NO: 77937 - protein, 32 aa, Artificial Sequence
  Description of Artificial Sequence: Synthetic polypeptide
DEHEIATTNPVATEQYGSVSAGNLFANNMNQR

SEQ ID NO: 77938 - protein, 32 aa, Artificial Sequence
  Description of Artificial Sequence: Synthetic polypeptide
DEHEIATTNPVATEQYGSVSAGNLFARNEEGR

SEQ ID NO: 77939 - protein, 33 aa, Artificial Sequence
  Description of Artificial Sequence: Synthetic polypeptide
AEEEIRCTNPVATEQYGSVSSTPAGPQMRNGNV

SEQ ID NO: 77940 - protein, 32 aa, Artificial Sequence
  Description of Artificial Sequence: Synthetic polypeptide
DEHEIATTNPVATEQYGSVSAGNLFNNNMNRN

SEQ ID NO: 77941 - protein, 32 aa, Artificial Sequence
  Description of Artificial Sequence: Synthetic polypeptide
AEEEIRTTNPVATEQYGCVCSTNLAYFNSEFA

SEQ ID NO: 77942 - protein, 33 aa, Artificial Sequence
  Description of Artificial Sequence: Synthetic polypeptide
DEEEIRTTNPVATEQYGCVCSTGAHQNSGSNAA

SEQ ID NO: 77943 - protein, 33 aa, Artificial Sequence
  Description of Artificial Sequence: Synthetic polypeptide
DEEEIRTTNPVATEAYGSMTSMTELLSQGIGNQ

SEQ ID NO: 77944 - protein, 35 aa, Artificial Sequence
  Description of Artificial Sequence: Synthetic polypeptide
TEEEIRTTNPVATEQYGKTVPSYTANQSQRGDNRM

SEQ ID NO: 77945 - protein, 31 aa, Artificial Sequence
  Description of Artificial Sequence: Synthetic polypeptide
DEHEIATTNPVATEQYGCVAATNLERGEPLS

SEQ ID NO: 77946 - protein, 34 aa, Artificial Sequence
  Description of Artificial Sequence: Synthetic polypeptide
DEEEIRTTNPVATEAYGSTVSVTYMLSQPGGNAL

SEQ ID NO: 77947 - protein, 28 aa, Artificial Sequence
  Description of Artificial Sequence: Synthetic peptide
DEHEIATTNPVATAQWGSVATADAQGND

SEQ ID NO: 77948 - protein, 29 aa, Artificial Sequence
  Description of Artificial Sequence: Synthetic peptide
DEHEIATTNPVATAQWGSVATADDRGNDS

SEQ ID NO: 77949 - protein, 32 aa, Artificial Sequence
  Description of Artificial Sequence: Synthetic polypeptide
DEEEIRTTNPVATEQYGCVCSTETQEHFNSEQ

SEQ ID NO: 77950 - protein, 34 aa, Artificial Sequence
  Description of Artificial Sequence: Synthetic polypeptide
DEEEIRTTNPVATEAYGSTVPSVTYLSQPGGNAD

SEQ ID NO: 77951 - protein, 32 aa, Artificial Sequence
  Description of Artificial Sequence: Synthetic polypeptide
DDEEIRATNPVATEQYGSVDTNLQAENGQEGE

SEQ ID NO: 77952 - protein, 34 aa, Artificial Sequence
  Description of Artificial Sequence: Synthetic polypeptide
DDEEIRATNPVATEQYGSVDNTNLQARNGNQEGE

SEQ ID NO: 77953 - protein, 29 aa, Artificial Sequence
  Description of Artificial Sequence: Synthetic peptide
DEGEIAPTNPCSSEQYGSVSCINLQSGTR

SEQ ID NO: 77954 - protein, 33 aa, Artificial Sequence
  Description of Artificial Sequence: Synthetic polypeptide
DEEEIRTTNPVATEQYGCVCSTETQRFGSETQS

SEQ ID NO: 77955 - protein, 30 aa, Artificial Sequence
  Description of Artificial Sequence: Synthetic polypeptide
DEHEIATTNPVATAQWGSVATALQQDGNDN

SEQ ID NO: 77956 - protein, 30 aa, Artificial Sequence
  Description of Artificial Sequence: Synthetic polypeptide
DEHEIATTNPVATAQWGSVATALTQDNGND

SEQ ID NO: 77957 - protein, 30 aa, Artificial Sequence
  Description of Artificial Sequence: Synthetic polypeptide
DEHEIATTNPVATAQWGSVATGALQNNGND

SEQ ID NO: 77958 - protein, 33 aa, Artificial Sequence
  Description of Artificial Sequence: Synthetic polypeptide
DEEEIRTTNPVATEQYGCVCSTEVQNFGSNNQI

SEQ ID NO: 77959 - protein, 32 aa, Artificial Sequence
  Description of Artificial Sequence: Synthetic polypeptide
DEHEIATTNPVATEQYGSVSANNQNRPDNSAE

SEQ ID NO: 77960 - protein, 33 aa, Artificial Sequence
  Description of Artificial Sequence: Synthetic polypeptide
DEEEIRTTNPVATEQYGCVCSTEWLQNFGSEAN

SEQ ID NO: 77961 - protein, 31 aa, Artificial Sequence
  Description of Artificial Sequence: Synthetic polypeptide
SSEEIRTTNPVAYHQYGSVSCTHPSQRGNNQ

SEQ ID NO: 77962 - protein, 32 aa, Artificial Sequence
  Description of Artificial Sequence: Synthetic polypeptide
DEHEIATTNPVATECWGTVSTNLQGNTGDNQR

SEQ ID NO: 77963 - protein, 34 aa, Artificial Sequence
  Description of Artificial Sequence: Synthetic polypeptide
TEEEIRTTNPVATEQYGCVCQTMNLNQRFGSNNQ

SEQ ID NO: 77964 - protein, 34 aa, Artificial Sequence
  Description of Artificial Sequence: Synthetic polypeptide
DEEEIRTTNPVATEQYGCVCSTGAHQERFGSNQS

SEQ ID NO: 77965 - protein, 33 aa, Artificial Sequence
  Description of Artificial Sequence: Synthetic polypeptide
TEEEIRTTNPVATEQYGCVGTGNLNQNFGSNNQ

SEQ ID NO: 77966 - protein, 29 aa, Artificial Sequence
  Description of Artificial Sequence: Synthetic peptide
DEGEIAPTNPCSSEQYGIVSTTNLQSGTR

SEQ ID NO: 77967 - protein, 34 aa, Artificial Sequence
  Description of Artificial Sequence: Synthetic polypeptide
TEEEIRTTNPVATEQYGCVNTGNLSQRTVENYRP

SEQ ID NO: 77968 - protein, 32 aa, Artificial Sequence
  Description of Artificial Sequence: Synthetic polypeptide
DEEEIRTTNPVATEQYGCVCSTGAHQGFGSQD

SEQ ID NO: 77969 - protein, 32 aa, Artificial Sequence
  Description of Artificial Sequence: Synthetic polypeptide
DEHEIATTNPVATENYGSVSTGNPAGQNDNQR

SEQ ID NO: 77970 - protein, 31 aa, Artificial Sequence
  Description of Artificial Sequence: Synthetic polypeptide
DEHEIATTNPVATENYGSVSTTNPAGNDDQR

SEQ ID NO: 77971 - protein, 32 aa, Artificial Sequence
  Description of Artificial Sequence: Synthetic polypeptide
DEHEIATTNPVATENYGSVSTTNPGAGNDNQR

SEQ ID NO: 77972 - protein, 34 aa, Artificial Sequence
  Description of Artificial Sequence: Synthetic polypeptide
DEAEIATTNPVATEQYGSVAATGNLDQSRDTNDR

SEQ ID NO: 77973 - protein, 33 aa, Artificial Sequence
  Description of Artificial Sequence: Synthetic polypeptide
DEEEIRTTNPVATEQYGCVCSTGAHQNFGSNQM

SEQ ID NO: 77974 - protein, 32 aa, Artificial Sequence
  Description of Artificial Sequence: Synthetic polypeptide
DEHEIATTNPVATEAWGSVSTNLNRGEGQNGS

SEQ ID NO: 77975 - protein, 31 aa, Artificial Sequence
  Description of Artificial Sequence: Synthetic polypeptide
DEHEIATTNPVATEQYGSVSATDLEDHGEDL

SEQ ID NO: 77976 - protein, 32 aa, Artificial Sequence
  Description of Artificial Sequence: Synthetic polypeptide
SSEEIRTTNPVATHQYGSVSPTWLEQEGQNDK

SEQ ID NO: 77977 - protein, 33 aa, Artificial Sequence
  Description of Artificial Sequence: Synthetic polypeptide
SSEEIRTTNPVATHQYGSVSCTYELSQRGGNNF

SEQ ID NO: 77978 - protein, 32 aa, Artificial Sequence
  Description of Artificial Sequence: Synthetic polypeptide
DEHEIATTNPVAYEQWGCVSTNLQGNDMGNNR

SEQ ID NO: 77979 - protein, 33 aa, Artificial Sequence
  Description of Artificial Sequence: Synthetic polypeptide
DEEEIRTTNPVATEQYGYVGSTTDGQGEGGNQG

SEQ ID NO: 77980 - protein, 32 aa, Artificial Sequence
  Description of Artificial Sequence: Synthetic polypeptide
DEHEIATTNPVAYEQWGSVSTALQPDQGNNDR

SEQ ID NO: 77981 - protein, 32 aa, Artificial Sequence
  Description of Artificial Sequence: Synthetic polypeptide
SSEEIRTTNPVATDQYGSVSTNGGERGQGNFQ

SEQ ID NO: 77982 - protein, 31 aa, Artificial Sequence
  Description of Artificial Sequence: Synthetic polypeptide
SSEEIRTTNPVATDQYGSVSTGGQRGEGAFE

SEQ ID NO: 77983 - protein, 33 aa, Artificial Sequence
  Description of Artificial Sequence: Synthetic polypeptide
TEEEIRTTNPVATEQYGSTVSTNLSDNVLNNDQ

SEQ ID NO: 77984 - protein, 32 aa, Artificial Sequence
  Description of Artificial Sequence: Synthetic polypeptide
DEEEIRTTNPVATEQYGCVCSTGEDQNFGSDQ

SEQ ID NO: 77985 - protein, 32 aa, Artificial Sequence
  Description of Artificial Sequence: Synthetic polypeptide
SSEEIRTTNPVATDQYGSVSTGGQQRGQGNMQ

SEQ ID NO: 77986 - protein, 31 aa, Artificial Sequence
  Description of Artificial Sequence: Synthetic polypeptide
DEEEIRTTNPVATEQYGCVCSTGEDQNISEQ

SEQ ID NO: 77987 - protein, 32 aa, Artificial Sequence
  Description of Artificial Sequence: Synthetic polypeptide
SSEEIRTTNPVATDQYGSVSTGGQQRGQGNFQ

SEQ ID NO: 77988 - protein, 32 aa, Artificial Sequence
  Description of Artificial Sequence: Synthetic polypeptide
DEHEIATTNPVAYEQWGSVSTNLQNPGGDNNS

SEQ ID NO: 77989 - protein, 34 aa, Artificial Sequence
  Description of Artificial Sequence: Synthetic polypeptide
DEEEIRTTNPVATEQYGCVCSTGEEHQERFGSNQ

SEQ ID NO: 77990 - protein, 32 aa, Artificial Sequence
  Description of Artificial Sequence: Synthetic polypeptide
SSEEIRTTNPVATDQYGSVSPTWLPQRGEDFD

SEQ ID NO: 77991 - protein, 32 aa, Artificial Sequence
  Description of Artificial Sequence: Synthetic polypeptide
DEEEIRTTNPVATEQYGYVGDGTQGQNIGGND

SEQ ID NO: 77992 - protein, 31 aa, Artificial Sequence
  Description of Artificial Sequence: Synthetic polypeptide
SSEEIRTTNPVATDQYGSVSPTWLPQGGEIF

SEQ ID NO: 77993 - protein, 32 aa, Artificial Sequence
  Description of Artificial Sequence: Synthetic polypeptide
DEAEIATTNPVATEQYGSVAAATNLETVTGNE

SEQ ID NO: 77994 - protein, 34 aa, Artificial Sequence
  Description of Artificial Sequence: Synthetic polypeptide
DEEEIRTTNPVATEQYGYVGSTVNMDQGGGNEDG

SEQ ID NO: 77995 - protein, 34 aa, Artificial Sequence
  Description of Artificial Sequence: Synthetic polypeptide
SSEEIRTTNPVATDQYGSVSPTNWLPQRGNEPFD

SEQ ID NO: 77996 - protein, 32 aa, Artificial Sequence
  Description of Artificial Sequence: Synthetic polypeptide
DEEEIRTTNPVATEQYGYVPQDASLDERGNLI

SEQ ID NO: 77997 - protein, 32 aa, Artificial Sequence
  Description of Artificial Sequence: Synthetic polypeptide
DEHEIATTNPVAYEQYGSVSTNPQNGMDNLAE

SEQ ID NO: 77998 - protein, 33 aa, Artificial Sequence
  Description of Artificial Sequence: Synthetic polypeptide
DEHEIATTNPVAYEQYGTVSTNLNQGQMGDNER

SEQ ID NO: 77999 - protein, 33 aa, Artificial Sequence
  Description of Artificial Sequence: Synthetic polypeptide
TEEEIRTTNPVATEQYGSVAWTDNQQDRNANQY

SEQ ID NO: 78000 - protein, 31 aa, Artificial Sequence
  Description of Artificial Sequence: Synthetic polypeptide
SSEEIRTTNPVATDQWGSVSTWDGGQRQGNS

SEQ ID NO: 78001 - protein, 32 aa, Artificial Sequence
  Description of Artificial Sequence: Synthetic polypeptide
TEEEIRTTNPVATEQYGSVCGTALQNFGSQQN

SEQ ID NO: 78002 - protein, 34 aa, Artificial Sequence
  Description of Artificial Sequence: Synthetic polypeptide
TEEEIRTTNPVATEQYGSVCNTENLNQNGSNNQL

SEQ ID NO: 78003 - protein, 33 aa, Artificial Sequence
  Description of Artificial Sequence: Synthetic polypeptide
TEEEIRTTNPVATEQYGSVCNTGNHNQNGSNNQ

SEQ ID NO: 78004 - protein, 31 aa, Artificial Sequence
  Description of Artificial Sequence: Synthetic polypeptide
DEAEIATTNPVATEQYGSVAAATNDQRNPSD

SEQ ID NO: 78005 - protein, 35 aa, Artificial Sequence
  Description of Artificial Sequence: Synthetic polypeptide
TEEEIRTTNPVATEQYGSVCSKTNDDLQQRNANDA

SEQ ID NO: 78006 - protein, 32 aa, Artificial Sequence
  Description of Artificial Sequence: Synthetic polypeptide
SSEEIRTTNPVATDQYGSVSPTVWLEQRSNFD

SEQ ID NO: 78007 - protein, 33 aa, Artificial Sequence
  Description of Artificial Sequence: Synthetic polypeptide
AEEEIRTTNPVATEQYGCVCSTELQYFGSENQS

SEQ ID NO: 78008 - protein, 32 aa, Artificial Sequence
  Description of Artificial Sequence: Synthetic polypeptide
SSEEIRTTNPVATDQYGSVSTTGGQRGENAFG

SEQ ID NO: 78009 - protein, 28 aa, Artificial Sequence
  Description of Artificial Sequence: Synthetic peptide
DEGEIAPTNPCSSEQYGAVSCNLQSGTR

SEQ ID NO: 78010 - protein, 32 aa, Artificial Sequence
  Description of Artificial Sequence: Synthetic polypeptide
AEEEIRCTNPVATEQYGSASTENGPQMRNGGV

SEQ ID NO: 78011 - protein, 31 aa, Artificial Sequence
  Description of Artificial Sequence: Synthetic polypeptide
AEEEIRCTNPVATEQYGSASSENGNMRGGPR

SEQ ID NO: 78012 - protein, 32 aa, Artificial Sequence
  Description of Artificial Sequence: Synthetic polypeptide
TEEEIRTTNPVATEQYGSTVNAGNISQRVTNK

SEQ ID NO: 78013 - protein, 31 aa, Artificial Sequence
  Description of Artificial Sequence: Synthetic polypeptide
AEEEIRTTNPVATEQYGCVETALQENFGSEQ

SEQ ID NO: 78014 - protein, 30 aa, Artificial Sequence
  Description of Artificial Sequence: Synthetic polypeptide
AEEEIRTTNPVATEQYGCVFWALQNFGSEQ

SEQ ID NO: 78015 - protein, 31 aa, Artificial Sequence
  Description of Artificial Sequence: Synthetic polypeptide
SSEEIRTTNPVATHQYGCVSTELQNFGSNQA

SEQ ID NO: 78016 - protein, 31 aa, Artificial Sequence
  Description of Artificial Sequence: Synthetic polypeptide
SSEEIRTTNPVATHQYGCVSTELQNFGSNNF

SEQ ID NO: 78017 - protein, 30 aa, Artificial Sequence
  Description of Artificial Sequence: Synthetic polypeptide
AEEEIRTTNPVATEQYGCVGTAHQNFGSEQ

SEQ ID NO: 78018 - protein, 33 aa, Artificial Sequence
  Description of Artificial Sequence: Synthetic polypeptide
DEHEIATTNPVATEQYGSVSGNNTGEDRGNDGR

SEQ ID NO: 78019 - protein, 33 aa, Artificial Sequence
  Description of Artificial Sequence: Synthetic polypeptide
DEHEIATTNPVATEQYGSVSTMNGLDDGGDNSS

SEQ ID NO: 78020 - protein, 34 aa, Artificial Sequence
  Description of Artificial Sequence: Synthetic polypeptide
TEEEIRTTNPVATEQYGSTVPSTNLSDRVANNVS

SEQ ID NO: 78021 - protein, 30 aa, Artificial Sequence
  Description of Artificial Sequence: Synthetic polypeptide
SSEEIRTTNPVATHQYGCVCSTEHQNFGNQ

SEQ ID NO: 78022 - protein, 33 aa, Artificial Sequence
  Description of Artificial Sequence: Synthetic polypeptide
DEHEIATTNPVATEQYGSVSTTNLGDNHGQNQD

SEQ ID NO: 78023 - protein, 32 aa, Artificial Sequence
  Description of Artificial Sequence: Synthetic polypeptide
SSEEIRTTNPVATDQYGSVSTTGGQRGQGNII

SEQ ID NO: 78024 - protein, 29 aa, Artificial Sequence
  Description of Artificial Sequence: Synthetic peptide
DDEEICSTNPVAYEPYGSSATNDQRGNDT

SEQ ID NO: 78025 - protein, 34 aa, Artificial Sequence
  Description of Artificial Sequence: Synthetic polypeptide
TEEEIRTTNPVATEQYGSTVSAGNLSDEFTGTNR

SEQ ID NO: 78026 - protein, 30 aa, Artificial Sequence
  Description of Artificial Sequence: Synthetic polypeptide
SSEEIRTTNPVATHIYGSVSWWNEPRMGNF

SEQ ID NO: 78027 - protein, 32 aa, Artificial Sequence
  Description of Artificial Sequence: Synthetic polypeptide
DEHEIATTNPVATEQYGSVVTALTMGGGDNGR

SEQ ID NO: 78028 - protein, 34 aa, Artificial Sequence
  Description of Artificial Sequence: Synthetic polypeptide
TEEEIRTTNPVATEQYGSTVSAGNMLSDEFGGNR

SEQ ID NO: 78029 - protein, 32 aa, Artificial Sequence
  Description of Artificial Sequence: Synthetic polypeptide
DEHEIATTNPVATETWGAVSTNLQGDVGDNER

SEQ ID NO: 78030 - protein, 30 aa, Artificial Sequence
  Description of Artificial Sequence: Synthetic polypeptide
AEEEIRTTNPVATEQYGCYSTATLTQDQPQ

SEQ ID NO: 78031 - protein, 33 aa, Artificial Sequence
  Description of Artificial Sequence: Synthetic polypeptide
DEEEIRTTNPVATEQYGYTWSDTQIPLQRENNM

SEQ ID NO: 78032 - protein, 33 aa, Artificial Sequence
  Description of Artificial Sequence: Synthetic polypeptide
AEEEIRATNPVATEQYGSVSTGDLGQHDENGRQ

SEQ ID NO: 78033 - protein, 31 aa, Artificial Sequence
  Description of Artificial Sequence: Synthetic polypeptide
DEAEIATTNPVATEQYGSVAAGNLFNNNMNR

SEQ ID NO: 78034 - protein, 34 aa, Artificial Sequence
  Description of Artificial Sequence: Synthetic polypeptide
DEEEIRTTNPVATEQYGCVCSTGEDLQHFGSNQI

SEQ ID NO: 78035 - protein, 32 aa, Artificial Sequence
  Description of Artificial Sequence: Synthetic polypeptide
AEEEIRATNPVATEQYGSVATNLQQGTEQPEE

SEQ ID NO: 78036 - protein, 33 aa, Artificial Sequence
  Description of Artificial Sequence: Synthetic polypeptide
AEEEIRATNPVATEQYGSVATGDLGQHGGENGR

SEQ ID NO: 78037 - protein, 31 aa, Artificial Sequence
  Description of Artificial Sequence: Synthetic polypeptide
SSEEIRTTNPVATDQYGVVSTGGQRGQGNFN

SEQ ID NO: 78038 - protein, 31 aa, Artificial Sequence
  Description of Artificial Sequence: Synthetic polypeptide
SSEEIRTTNPVATHQWGSVSTWDGQRQGDNS

SEQ ID NO: 78039 - protein, 33 aa, Artificial Sequence
  Description of Artificial Sequence: Synthetic polypeptide
DEEEIRTTNPVATEQYGYVSGNMNFGQGGNEGD

SEQ ID NO: 78040 - protein, 32 aa, Artificial Sequence
  Description of Artificial Sequence: Synthetic polypeptide
DEEEIRTTNPVATEQYGCVCSTEPQNFNSNTQ

SEQ ID NO: 78041 - protein, 32 aa, Artificial Sequence
  Description of Artificial Sequence: Synthetic polypeptide
DEAEIATTNPVATEQYGSVAATNLEMMGGENP

SEQ ID NO: 78042 - protein, 31 aa, Artificial Sequence
  Description of Artificial Sequence: Synthetic polypeptide
DEGEIRTTNPVSTEQYGSVAANLQGPGGQTM

SEQ ID NO: 78043 - protein, 34 aa, Artificial Sequence
  Description of Artificial Sequence: Synthetic polypeptide
AEEEIRTTNPVATEAYGSVSTTNNLDNQQGDGNL

SEQ ID NO: 78044 - protein, 29 aa, Artificial Sequence
  Description of Artificial Sequence: Synthetic peptide
DEGEIVTTNPCASEQYGIVSTDNPQSGTD

SEQ ID NO: 78045 - protein, 32 aa, Artificial Sequence
  Description of Artificial Sequence: Synthetic polypeptide
TEEEIRTTNPVATEPYGSVVACTALSQNGGFR

SEQ ID NO: 78046 - protein, 30 aa, Artificial Sequence
  Description of Artificial Sequence: Synthetic polypeptide
DEGEIVTTNPVATEQYGTVSTDGPQFEGTD

SEQ ID NO: 78047 - protein, 30 aa, Artificial Sequence
  Description of Artificial Sequence: Synthetic polypeptide
TDEEIRTTNPVATEQWGYAVSTNLEEEGVD

SEQ ID NO: 78048 - protein, 34 aa, Artificial Sequence
  Description of Artificial Sequence: Synthetic polypeptide
DEEEIRTTNPVATEQYGCVCSTENHQGFGSDNQV

SEQ ID NO: 78049 - protein, 28 aa, Artificial Sequence
  Description of Artificial Sequence: Synthetic peptide
DEGEVASTNPVSTEGYGNVSCNIQRGQR

SEQ ID NO: 78050 - protein, 30 aa, Artificial Sequence
  Description of Artificial Sequence: Synthetic polypeptide
TDEEIRTTNPVATEQWGAVSTNLEEETNPD

SEQ ID NO: 78051 - protein, 32 aa, Artificial Sequence
  Description of Artificial Sequence: Synthetic polypeptide
DEEEIRTTNPVATEQYGCVCSTENHQHNSDQS

SEQ ID NO: 78052 - protein, 33 aa, Artificial Sequence
  Description of Artificial Sequence: Synthetic polypeptide
DEEEIRTTNPVATEQYGCVCSTENHQHSNSNQL

SEQ ID NO: 78053 - protein, 30 aa, Artificial Sequence
  Description of Artificial Sequence: Synthetic polypeptide
TDEEIRTTNPVATDQYGSVSTTLQTVEQLV

SEQ ID NO: 78054 - protein, 31 aa, Artificial Sequence
  Description of Artificial Sequence: Synthetic polypeptide
DDEEIRCTNPVATEQYGCVSTNPQANSGSQQ

SEQ ID NO: 78055 - protein, 30 aa, Artificial Sequence
  Description of Artificial Sequence: Synthetic polypeptide
TDEEIRTTNPVATDQYGSVSTTGQTVNIAV

SEQ ID NO: 78056 - protein, 30 aa, Artificial Sequence
  Description of Artificial Sequence: Synthetic polypeptide
DEGMIRTTNPVATEQYGSISLSNEINGNNT

SEQ ID NO: 78057 - protein, 33 aa, Artificial Sequence
  Description of Artificial Sequence: Synthetic polypeptide
DEEEIRTTNPVATEQYGCVCSTENHQRFISDQA

SEQ ID NO: 78058 - protein, 32 aa, Artificial Sequence
  Description of Artificial Sequence: Synthetic polypeptide
TDECIRTTNPVATEQYGKVSTNHQRTVGNNLH

SEQ ID NO: 78059 - protein, 34 aa, Artificial Sequence
  Description of Artificial Sequence: Synthetic polypeptide
DEEEIRTTNPVATEQYGCVCSTENHQSFGSDNQN

SEQ ID NO: 78060 - protein, 31 aa, Artificial Sequence
  Description of Artificial Sequence: Synthetic polypeptide
DEGEIAPTNPVASEQYGIVCSTNLVQFEGTR

SEQ ID NO: 78061 - protein, 33 aa, Artificial Sequence
  Description of Artificial Sequence: Synthetic polypeptide
DEEEIRTTNPVATEQYGCVCSTENHQSFNSDQV

SEQ ID NO: 78062 - protein, 34 aa, Artificial Sequence
  Description of Artificial Sequence: Synthetic polypeptide
DEEEIRTTNPVATEQYGCVCSTENHQYFGSDNQA

SEQ ID NO: 78063 - protein, 28 aa, Artificial Sequence
  Description of Artificial Sequence: Synthetic peptide
DEGEIAPTNPISSEQYGIVSCNLQSGTR

SEQ ID NO: 78064 - protein, 33 aa, Artificial Sequence
  Description of Artificial Sequence: Synthetic polypeptide
TEEEIRTTNPVATEQFGQSVVSCTYLSTRGGNS

SEQ ID NO: 78065 - protein, 31 aa, Artificial Sequence
  Description of Artificial Sequence: Synthetic polypeptide
DEGQIRCTNPVATEQYGSVSTLEELQNQNMD

SEQ ID NO: 78066 - protein, 34 aa, Artificial Sequence
  Description of Artificial Sequence: Synthetic polypeptide
DEEEIRTTNPVATEQYGCVCSTENHQYFGSNNAA

SEQ ID NO: 78067 - protein, 33 aa, Artificial Sequence
  Description of Artificial Sequence: Synthetic polypeptide
DEEEIRTTNPVATEQYGCVCSTENHTGFGSNQY

SEQ ID NO: 78068 - protein, 29 aa, Artificial Sequence
  Description of Artificial Sequence: Synthetic peptide
DEGEIAPTNPCSTEQYGNVSCNLQSSGTR

SEQ ID NO: 78069 - protein, 32 aa, Artificial Sequence
  Description of Artificial Sequence: Synthetic polypeptide
DEGEIRTTNPVSTECWGSVSCINEQDREGENR

SEQ ID NO: 78070 - protein, 34 aa, Artificial Sequence
  Description of Artificial Sequence: Synthetic polypeptide
DEGEIAPTNPVSTEQYGSVSSTTNLPQMRNGNPR

SEQ ID NO: 78071 - protein, 32 aa, Artificial Sequence
  Description of Artificial Sequence: Synthetic polypeptide
DEAEIATTNPVATEQYGSVAAVANLQEAGNDP

SEQ ID NO: 78072 - protein, 31 aa, Artificial Sequence
  Description of Artificial Sequence: Synthetic polypeptide
DEGEIRTTNPVSSEQYGIVSMENLQQQNGNH

SEQ ID NO: 78073 - protein, 30 aa, Artificial Sequence
  Description of Artificial Sequence: Synthetic polypeptide
DEGEIRTTNPVAYEQWGSVTTALIGEMNNR

SEQ ID NO: 78074 - protein, 30 aa, Artificial Sequence
  Description of Artificial Sequence: Synthetic polypeptide
DEGEIRTTNPVAYEQWGSVTTGLIGEMNSR

SEQ ID NO: 78075 - protein, 31 aa, Artificial Sequence
  Description of Artificial Sequence: Synthetic polypeptide
DEGEIRTTNPVAYEQWGYTISPNEDGQRGNR

SEQ ID NO: 78076 - protein, 32 aa, Artificial Sequence
  Description of Artificial Sequence: Synthetic polypeptide
DEEEIRTTNPVATEQYGCVCSTELQGSTSDQS

SEQ ID NO: 78077 - protein, 32 aa, Artificial Sequence
  Description of Artificial Sequence: Synthetic polypeptide
DEGEIRTTNPVAYEQWGYTISPNEDLQDRGNR

SEQ ID NO: 78078 - protein, 32 aa, Artificial Sequence
  Description of Artificial Sequence: Synthetic polypeptide
DEEEIRTTNPVATEQYGCVCSTELQHFISDTQ

SEQ ID NO: 78079 - protein, 33 aa, Artificial Sequence
  Description of Artificial Sequence: Synthetic polypeptide
DEEEIRTTNPVATEQYGCVCSTELQHFNSETQA

SEQ ID NO: 78080 - protein, 33 aa, Artificial Sequence
  Description of Artificial Sequence: Synthetic polypeptide
AEEEIRTTNPVATEAYGSVSTTNQNGNQEGNTA

SEQ ID NO: 78081 - protein, 31 aa, Artificial Sequence
  Description of Artificial Sequence: Synthetic polypeptide
DEGEIRTTNPVAYEQWGYTISPNELQDGENR

SEQ ID NO: 78082 - protein, 34 aa, Artificial Sequence
  Description of Artificial Sequence: Synthetic polypeptide
DEEEIRTTNPVATEAYGSVSTTQNLTQGSTNNTD

SEQ ID NO: 78083 - protein, 33 aa, Artificial Sequence
  Description of Artificial Sequence: Synthetic polypeptide
DEEEIRTTNPVATEQYGCVCSTELQNFGSETQA

SEQ ID NO: 78084 - protein, 32 aa, Artificial Sequence
  Description of Artificial Sequence: Synthetic polypeptide
DEGEIRTTNPVAYEQYGSIACTNLTPTPGNYR

SEQ ID NO: 78085 - protein, 33 aa, Artificial Sequence
  Description of Artificial Sequence: Synthetic polypeptide
DEEEIRTTNPVATEQYGCVCSTELQNFGSVTQF

SEQ ID NO: 78086 - protein, 33 aa, Artificial Sequence
  Description of Artificial Sequence: Synthetic polypeptide
TEEEIRTTNPVATEQWGESTVSTNLSGRGGTEH

SEQ ID NO: 78087 - protein, 33 aa, Artificial Sequence
  Description of Artificial Sequence: Synthetic polypeptide
AEEEIRTTNPVATEAYGSVSTTNNQQQQEGNNT

SEQ ID NO: 78088 - protein, 31 aa, Artificial Sequence
  Description of Artificial Sequence: Synthetic polypeptide
DEAEIATTNPVATEQYGSVAGGLTNANNNNR

SEQ ID NO: 78089 - protein, 31 aa, Artificial Sequence
  Description of Artificial Sequence: Synthetic polypeptide
DEAEIATTNPVATEQYGSVAGENDQAGNQDQ

SEQ ID NO: 78090 - protein, 33 aa, Artificial Sequence
  Description of Artificial Sequence: Synthetic polypeptide
AEEEIRTTNPVATEAYGSVSTTNNNTNQNGTNT

SEQ ID NO: 78091 - protein, 33 aa, Artificial Sequence
  Description of Artificial Sequence: Synthetic polypeptide
DEEEIRTTNPVATEQYGCVCSTELQSSGSETQG

SEQ ID NO: 78092 - protein, 35 aa, Artificial Sequence
  Description of Artificial Sequence: Synthetic polypeptide
DEEEIRTTNPVATEAYGSVSTTNNNLQLQGGNNTD

SEQ ID NO: 78093 - protein, 33 aa, Artificial Sequence
  Description of Artificial Sequence: Synthetic polypeptide
DEEEIRTTNPVATEQYGCVCSTELQYSNSNNQM

SEQ ID NO: 78094 - protein, 32 aa, Artificial Sequence
  Description of Artificial Sequence: Synthetic polypeptide
DEGEIRTTNPVAYEQYGSVQCTGALSIRVNNR

SEQ ID NO: 78095 - protein, 31 aa, Artificial Sequence
  Description of Artificial Sequence: Synthetic polypeptide
DEGEIRTTNPVAYEQYGTHVSHTNNQRPTPS

SEQ ID NO: 78096 - protein, 34 aa, Artificial Sequence
  Description of Artificial Sequence: Synthetic polypeptide
DEGEIRTTNPVAYERYGSTVSTNALPQNFGGNPR

SEQ ID NO: 78097 - protein, 29 aa, Artificial Sequence
  Description of Artificial Sequence: Synthetic peptide
DEGEIRTTNPVSSEQWGIVSENLQAAGDA

SEQ ID NO: 78098 - protein, 35 aa, Artificial Sequence
  Description of Artificial Sequence: Synthetic polypeptide
DEEEIRTTNPVATEQYGCVCSTENDLQGFGSNFQP

SEQ ID NO: 78099 - protein, 33 aa, Artificial Sequence
  Description of Artificial Sequence: Synthetic polypeptide
DEEEIRTTNPVATEQYGCVCSTENDQNGGSEQQ

SEQ ID NO: 78100 - protein, 35 aa, Artificial Sequence
  Description of Artificial Sequence: Synthetic polypeptide
DEEEIRTTNPVATEAYGSVSTTNNLDQLGNNNNNQ

SEQ ID NO: 78101 - protein, 32 aa, Artificial Sequence
  Description of Artificial Sequence: Synthetic polypeptide
DEGEIRTTNPVAYEQYGSVATNLQRPQEQTHQ

SEQ ID NO: 78102 - protein, 33 aa, Artificial Sequence
  Description of Artificial Sequence: Synthetic polypeptide
DEEEIRTTNPVATEQYGCVCSTENLAFFGSQQE

SEQ ID NO: 78103 - protein, 31 aa, Artificial Sequence
  Description of Artificial Sequence: Synthetic polypeptide
TAEEEIATTNPVAYEQWGSVSTNTQGGGDAR

SEQ ID NO: 78104 - protein, 29 aa, Artificial Sequence
  Description of Artificial Sequence: Synthetic peptide
DEGEIAPTNPCSTEQYGNVSCNLQSSGQR

SEQ ID NO: 78105 - protein, 35 aa, Artificial Sequence
  Description of Artificial Sequence: Synthetic polypeptide
DEEEIRTTNPVATEAYGSVSCEPNMLQDTEGNNRC

SEQ ID NO: 78106 - protein, 33 aa, Artificial Sequence
  Description of Artificial Sequence: Synthetic polypeptide
TEEEIRTTNPVATEQWGVVPSYTNHSSRTGDNR

SEQ ID NO: 78107 - protein, 33 aa, Artificial Sequence
  Description of Artificial Sequence: Synthetic polypeptide
TEEEIRTTNPVATEQWGVVPSYTNLSQKTGDNG

SEQ ID NO: 78108 - protein, 34 aa, Artificial Sequence
  Description of Artificial Sequence: Synthetic polypeptide
DEEEIRTTNPVATEQYGCVCSTENPQSFGSNNQG

SEQ ID NO: 78109 - protein, 32 aa, Artificial Sequence
  Description of Artificial Sequence: Synthetic polypeptide
DEEEIRTTNPVATEQYGCVCSTENQNSNSEQQ

SEQ ID NO: 78110 - protein, 33 aa, Artificial Sequence
  Description of Artificial Sequence: Synthetic polypeptide
DEEEIRTTNPVATEQYGCVCSTENTIGFGSNQT

SEQ ID NO: 78111 - protein, 33 aa, Artificial Sequence
  Description of Artificial Sequence: Synthetic polypeptide
TEEEIRTTNPVATEQWGVVPSYTNVSQFTGDNR

SEQ ID NO: 78112 - protein, 32 aa, Artificial Sequence
  Description of Artificial Sequence: Synthetic polypeptide
DEEEIRTTNPVATEQYGCVCSTEPDENFGSND

SEQ ID NO: 78113 - protein, 32 aa, Artificial Sequence
  Description of Artificial Sequence: Synthetic polypeptide
DEEEIRTTNPVATEQYGCVCSTEPEYFGSNNQ

SEQ ID NO: 78114 - protein, 32 aa, Artificial Sequence
  Description of Artificial Sequence: Synthetic polypeptide
DEEEIRTTNPVATEQYGYTISSNANEQTLQNR

SEQ ID NO: 78115 - protein, 32 aa, Artificial Sequence
  Description of Artificial Sequence: Synthetic polypeptide
DEEEIRTTNPVATEQYGYTISSNEEEQRQSNE

SEQ ID NO: 78116 - protein, 34 aa, Artificial Sequence
  Description of Artificial Sequence: Synthetic polypeptide
DEEEIRTTNPVATEQYGCVCSTEPHQERSGSNQS

SEQ ID NO: 78117 - protein, 34 aa, Artificial Sequence
  Description of Artificial Sequence: Synthetic polypeptide
TEEEIRTTNPVATEQYGCVACTVNNLSQRGGNYK

SEQ ID NO: 78118 - protein, 33 aa, Artificial Sequence
  Description of Artificial Sequence: Synthetic polypeptide
DEEEIRTTNPVATEQYGCVCSTENPQNFGSDQP

SEQ ID NO: 78119 - protein, 32 aa, Artificial Sequence
  Description of Artificial Sequence: Synthetic polypeptide
DEAEIATTNPVATEQYGSVAATNLPQEAGHGH

SEQ ID NO: 78120 - protein, 30 aa, Artificial Sequence
  Description of Artificial Sequence: Synthetic polypeptide
DEHCISTTNPVAYEQWGTVSKTDNLQRQDR

SEQ ID NO: 78121 - protein, 33 aa, Artificial Sequence
  Description of Artificial Sequence: Synthetic polypeptide
AEEEIRTTNPVATEQYGCVCSTELQERFGSEDP

SEQ ID NO: 78122 - protein, 34 aa, Artificial Sequence
  Description of Artificial Sequence: Synthetic polypeptide
DEHEAEIRTTNPVAYEHWGSVSTNLQGEDGGNER

SEQ ID NO: 78123 - protein, 32 aa, Artificial Sequence
  Description of Artificial Sequence: Synthetic polypeptide
AEEEIRTTNPVATEQYGCVCSTELQHFGSDQE

SEQ ID NO: 78124 - protein, 31 aa, Artificial Sequence
  Description of Artificial Sequence: Synthetic polypeptide
DEEEIRTTNPVATEQYGYTISTDGGQGGGEG

SEQ ID NO: 78125 - protein, 33 aa, Artificial Sequence
  Description of Artificial Sequence: Synthetic polypeptide
DEEEIRTTNPVATEQYGCVCSTEPLQYFGSQQS

SEQ ID NO: 78126 - protein, 33 aa, Artificial Sequence
  Description of Artificial Sequence: Synthetic polypeptide
DEEEIRTTNPVATEQYGCVCSTEPNQHFGSNQE

SEQ ID NO: 78127 - protein, 33 aa, Artificial Sequence
  Description of Artificial Sequence: Synthetic polypeptide
DDEEIRATNPVATEQYGSVSNTNLQAENGQGGT

SEQ ID NO: 78128 - protein, 34 aa, Artificial Sequence
  Description of Artificial Sequence: Synthetic polypeptide
TEEEIRTTNPVATEQYGCVCGTGNLNQRFGSNTQ

SEQ ID NO: 78129 - protein, 33 aa, Artificial Sequence
  Description of Artificial Sequence: Synthetic polypeptide
DEEEIRTTNPVATEQYGCVCSTEPQENSGSNQQ

SEQ ID NO: 78130 - protein, 32 aa, Artificial Sequence
  Description of Artificial Sequence: Synthetic polypeptide
DEEEIRTTNPVATEQYGCVCSTEPQERNSEQQ

SEQ ID NO: 78131 - protein, 33 aa, Artificial Sequence
  Description of Artificial Sequence: Synthetic polypeptide
DDEEIRATNPVATEQYGSVDTNLQARNGDGQGE

SEQ ID NO: 78132 - protein, 32 aa, Artificial Sequence
  Description of Artificial Sequence: Synthetic polypeptide
DEEEIRTTNPVATEQYGCVCSTEPQGFGSEQI

SEQ ID NO: 78133 - protein, 33 aa, Artificial Sequence
  Description of Artificial Sequence: Synthetic polypeptide
DEAEIATTNPVATEQYGSVAATNLLQRETPVRP

SEQ ID NO: 78134 - protein, 32 aa, Artificial Sequence
  Description of Artificial Sequence: Synthetic polypeptide
DEAEIATTNPVATEQYGSVAATNLADPGGENN

SEQ ID NO: 78135 - protein, 33 aa, Artificial Sequence
  Description of Artificial Sequence: Synthetic polypeptide
DEEEIRTTNPVATEAYGSVSDTDGDQGEGGNQG

SEQ ID NO: 78136 - protein, 31 aa, Artificial Sequence
  Description of Artificial Sequence: Synthetic polypeptide
DEGVICTTNPVATEQYGSCATNLIDIGNDRQ

SEQ ID NO: 78137 - protein, 33 aa, Artificial Sequence
  Description of Artificial Sequence: Synthetic polypeptide
DEEEIRTTNPVATEQYGCVCSTENLIENGSEQS

SEQ ID NO: 78138 - protein, 33 aa, Artificial Sequence
  Description of Artificial Sequence: Synthetic polypeptide
DEEEIRTTNPVATEQYGCVCSTENLINFGSQQS

SEQ ID NO: 78139 - protein, 31 aa, Artificial Sequence
  Description of Artificial Sequence: Synthetic polypeptide
TAEEEIATTNPVAYEQWGSVSTNTQGDGDSR

SEQ ID NO: 78140 - protein, 33 aa, Artificial Sequence
  Description of Artificial Sequence: Synthetic polypeptide
TEEEIRTTNPVATEQWGQSTVVSTNLSTQAVNQ

SEQ ID NO: 78141 - protein, 33 aa, Artificial Sequence
  Description of Artificial Sequence: Synthetic polypeptide
DEAEIATTNPVATEQYGSVAATPHLQNRMPGER

SEQ ID NO: 78142 - protein, 33 aa, Artificial Sequence
  Description of Artificial Sequence: Synthetic polypeptide
TEEEIRTTNPVATEQWGQVPSYTNLSQHTEDNR

SEQ ID NO: 78143 - protein, 31 aa, Artificial Sequence
  Description of Artificial Sequence: Synthetic polypeptide
TAEEEIATTNPVAYEQWGSVSTNLQGEGDTD

SEQ ID NO: 78144 - protein, 29 aa, Artificial Sequence
  Description of Artificial Sequence: Synthetic peptide
DEGVIACTNPVATEQYGCVATNHQRDSER

SEQ ID NO: 78145 - protein, 32 aa, Artificial Sequence
  Description of Artificial Sequence: Synthetic polypeptide
TAEEEIATTNPVAYEQWGSVSTNLEQGMGDAR

SEQ ID NO: 78146 - protein, 31 aa, Artificial Sequence
  Description of Artificial Sequence: Synthetic polypeptide
TAEEEIATTNPVAYEQWGSVSTNAQGNGDTR

SEQ ID NO: 78147 - protein, 31 aa, Artificial Sequence
  Description of Artificial Sequence: Synthetic polypeptide
DEGVIACTNPVATEQYGSCSTNLIDIGENRM

SEQ ID NO: 78148 - protein, 31 aa, Artificial Sequence
  Description of Artificial Sequence: Synthetic polypeptide
DEGVIATTNPVATEQYGCVAGTNPQADGNDR

SEQ ID NO: 78149 - protein, 31 aa, Artificial Sequence
  Description of Artificial Sequence: Synthetic polypeptide
DEEEIRTTNPVATEQYGYTISMSFEEVRGEE

SEQ ID NO: 78150 - protein, 34 aa, Artificial Sequence
  Description of Artificial Sequence: Synthetic polypeptide
TEEEIRTTNPVATEQWGVVPAYTNLSQRTGDNRT

SEQ ID NO: 78151 - protein, 31 aa, Artificial Sequence
  Description of Artificial Sequence: Synthetic polypeptide
DEGVIATTNPVATEQYGCVAGTNPQDGMNRP

SEQ ID NO: 78152 - protein, 34 aa, Artificial Sequence
  Description of Artificial Sequence: Synthetic polypeptide
TEEEIRTTNPVATEQWGSVNTGNLSQRTVENYRN

SEQ ID NO: 78153 - protein, 29 aa, Artificial Sequence
  Description of Artificial Sequence: Synthetic peptide
DEGEIAPTNPCSSEQYGTVCSTNLQSGTR

SEQ ID NO: 78154 - protein, 34 aa, Artificial Sequence
  Description of Artificial Sequence: Synthetic polypeptide
DEEEIRTTNPVATEQYGCVCSTENLQHFNSNNQL

SEQ ID NO: 78155 - protein, 30 aa, Artificial Sequence
  Description of Artificial Sequence: Synthetic polypeptide
DEGVIATTNPVATEQYGCVAGTNPQDGQRQ

SEQ ID NO: 78156 - protein, 33 aa, Artificial Sequence
  Description of Artificial Sequence: Synthetic polypeptide
DEEEIRTTNPVATEQYGCVCSTENLQNFQSDFQ

SEQ ID NO: 78157 - protein, 30 aa, Artificial Sequence
  Description of Artificial Sequence: Synthetic polypeptide
DEGVIATTNPVATEQYGCVATNPQGMDGNN

SEQ ID NO: 78158 - protein, 32 aa, Artificial Sequence
  Description of Artificial Sequence: Synthetic polypeptide
DDEEIRCTNPVATEQYGCIVCSTNLQNFGQQS

SEQ ID NO: 78159 - protein, 28 aa, Artificial Sequence
  Description of Artificial Sequence: Synthetic peptide
DDEEIRCTNPDATEQYGVVATCPIRPNS

SEQ ID NO: 78160 - protein, 32 aa, Artificial Sequence
  Description of Artificial Sequence: Synthetic polypeptide
DEGVIATTNPVATEQYGSVSTPNLQDNNPQNH

SEQ ID NO: 78161 - protein, 33 aa, Artificial Sequence
  Description of Artificial Sequence: Synthetic polypeptide
AEEEIRTTNPVATEAYGSVSTNLQQQANNQNVE

SEQ ID NO: 78162 - protein, 32 aa, Artificial Sequence
  Description of Artificial Sequence: Synthetic polypeptide
DEEEIRTTNPVATEQYGYTISPSNSLVRGSEE

SEQ ID NO: 78163 - protein, 34 aa, Artificial Sequence
  Description of Artificial Sequence: Synthetic polypeptide
TEEEIRTTNPVATEQWGTVSNPNGLSQRGGNNRC

SEQ ID NO: 78164 - protein, 34 aa, Artificial Sequence
  Description of Artificial Sequence: Synthetic polypeptide
TEEEIRTTNPVATEQWGVTVPSYTNLSQRTGDVR

SEQ ID NO: 78165 - protein, 28 aa, Artificial Sequence
  Description of Artificial Sequence: Synthetic peptide
DEGEIAPTNPCSSEQYGTVSCNLQSGTR

SEQ ID NO: 78166 - protein, 31 aa, Artificial Sequence
  Description of Artificial Sequence: Synthetic polypeptide
DEGEIRTTNPVAYEQWGSVCTQLIREDNNRE

SEQ ID NO: 78167 - protein, 30 aa, Artificial Sequence
  Description of Artificial Sequence: Synthetic polypeptide
SSEEIRTTNPVATCQYGCVSTELQNGSDFA

SEQ ID NO: 78168 - protein, 33 aa, Artificial Sequence
  Description of Artificial Sequence: Synthetic polypeptide
DEHEIATTNPVAYEQYGVSVSANGLLQRGMGRP

SEQ ID NO: 78169 - protein, 33 aa, Artificial Sequence
  Description of Artificial Sequence: Synthetic polypeptide
DEEEIRTTNPVATEQYGCVCSTGETQHFGSERA

SEQ ID NO: 78170 - protein, 32 aa, Artificial Sequence
  Description of Artificial Sequence: Synthetic polypeptide
DEHEIRTTNPVATEQWGVISHTDNTQNREGLR

SEQ ID NO: 78171 - protein, 33 aa, Artificial Sequence
  Description of Artificial Sequence: Synthetic polypeptide
AEEEIRTTNPVATEQYGSVSNNLLGGNNQGNQN

SEQ ID NO: 78172 - protein, 29 aa, Artificial Sequence
  Description of Artificial Sequence: Synthetic peptide
DEGEIACTNPVATAQWGCVATNLERGDNA

SEQ ID NO: 78173 - protein, 31 aa, Artificial Sequence
  Description of Artificial Sequence: Synthetic polypeptide
DDCEIRTTNPVATEQYGVVSTKLENSHGNND

SEQ ID NO: 78174 - protein, 34 aa, Artificial Sequence
  Description of Artificial Sequence: Synthetic polypeptide
DEEEIRTTNPVATEQYGCVCSTGNDLQGFGSQDS

SEQ ID NO: 78175 - protein, 34 aa, Artificial Sequence
  Description of Artificial Sequence: Synthetic polypeptide
DEEEIRTTNPVATEQYGCVCSTGNDLQYFGSDQE

SEQ ID NO: 78176 - protein, 32 aa, Artificial Sequence
  Description of Artificial Sequence: Synthetic polypeptide
AEEEIRTTNPVATEQYGSVSNNNLQLNQEETQ

SEQ ID NO: 78177 - protein, 32 aa, Artificial Sequence
  Description of Artificial Sequence: Synthetic polypeptide
DEHEIRTTNPVATEQYGCVSTDNDMTEDNERF

SEQ ID NO: 78178 - protein, 34 aa, Artificial Sequence
  Description of Artificial Sequence: Synthetic polypeptide
DEEEIRTTNPVATEQYGCVCSTGNDQFFGSNNAE

SEQ ID NO: 78179 - protein, 33 aa, Artificial Sequence
  Description of Artificial Sequence: Synthetic polypeptide
DEEEIRTTNPVATEQYGCVCSTGNDQFFPSNQY

SEQ ID NO: 78180 - protein, 33 aa, Artificial Sequence
  Description of Artificial Sequence: Synthetic polypeptide
DEGCIRTTNPVATEQYGSISYTNELSIPTGGNR

SEQ ID NO: 78181 - protein, 29 aa, Artificial Sequence
  Description of Artificial Sequence: Synthetic peptide
DEGCIACTNPVAYEQYGQVSTGNVQRDNN

SEQ ID NO: 78182 - protein, 34 aa, Artificial Sequence
  Description of Artificial Sequence: Synthetic polypeptide
DEEEIRTTNPVATEAYGKVPSCINMLSQREGMRL

SEQ ID NO: 78183 - protein, 31 aa, Artificial Sequence
  Description of Artificial Sequence: Synthetic polypeptide
DDCEIRTTNPVATEQYGVVSTKLEENRPLND

SEQ ID NO: 78184 - protein, 32 aa, Artificial Sequence
  Description of Artificial Sequence: Synthetic polypeptide
DEGCEIATTNPVAYEQWGSVSTNLQGEHGNGQ

SEQ ID NO: 78185 - protein, 32 aa, Artificial Sequence
  Description of Artificial Sequence: Synthetic polypeptide
DEHEIRTTNPVATEQYGCVSWPLDQEGNEDHF

SEQ ID NO: 78186 - protein, 33 aa, Artificial Sequence
  Description of Artificial Sequence: Synthetic polypeptide
AEEEIRTTNPVATEQYGSVSNNNQLGGNNQGNL

SEQ ID NO: 78187 - protein, 34 aa, Artificial Sequence
  Description of Artificial Sequence: Synthetic polypeptide
AEEEIRTTNPVATEQYGSVSNNNQLGNNQQGNNN

SEQ ID NO: 78188 - protein, 33 aa, Artificial Sequence
  Description of Artificial Sequence: Synthetic polypeptide
DEHEIRTTNPVATEQYGSIVSTNQSQEGQEDIG

SEQ ID NO: 78189 - protein, 33 aa, Artificial Sequence
  Description of Artificial Sequence: Synthetic polypeptide
DEHEIRTTNPVATEQYGSVCSPTNLERNDDEES

SEQ ID NO: 78190 - protein, 34 aa, Artificial Sequence
  Description of Artificial Sequence: Synthetic polypeptide
DEHEIRTTNPVATEQYGSVCVTGDGNMGQGGNGR

SEQ ID NO: 78191 - protein, 32 aa, Artificial Sequence
  Description of Artificial Sequence: Synthetic polypeptide
DEAEIATTNPVATEQYGCVCSTNLAYSGSNQS

SEQ ID NO: 78192 - protein, 34 aa, Artificial Sequence
  Description of Artificial Sequence: Synthetic polypeptide
DEEEIRTTNPVATEQYGCVCSTGNHNQNFGSNIG

SEQ ID NO: 78193 - protein, 34 aa, Artificial Sequence
  Description of Artificial Sequence: Synthetic polypeptide
AEEEIRTTNPVATEQYGSVSNNNQLGNQQGNTNQ

SEQ ID NO: 78194 - protein, 32 aa, Artificial Sequence
  Description of Artificial Sequence: Synthetic polypeptide
DEGAIRTTNPVAYEQYGSTISCTNELSIPGNR

SEQ ID NO: 78195 - protein, 31 aa, Artificial Sequence
  Description of Artificial Sequence: Synthetic polypeptide
DEGAIRTTNPVAYEQWGSFSTNLIDGDGNER

SEQ ID NO: 78196 - protein, 32 aa, Artificial Sequence
  Description of Artificial Sequence: Synthetic polypeptide
DEHEIRTTNPVATEQWGSISHTDNHQREGQDL

SEQ ID NO: 78197 - protein, 33 aa, Artificial Sequence
  Description of Artificial Sequence: Synthetic polypeptide
DEEEIRTTNPVATEQYGCVCSTGETQFFGSENQ

SEQ ID NO: 78198 - protein, 33 aa, Artificial Sequence
  Description of Artificial Sequence: Synthetic polypeptide
DEHEIRTTNPVATEQWGSISHTDNDTQREGMER

SEQ ID NO: 78199 - protein, 34 aa, Artificial Sequence
  Description of Artificial Sequence: Synthetic polypeptide
DDEEIRTTNPVATEQYGCVCSNTGNHQRFGSNQA

SEQ ID NO: 78200 - protein, 32 aa, Artificial Sequence
  Description of Artificial Sequence: Synthetic polypeptide
DEHEIRTTNPVATEFWGSVSTTNQGEDGNNER

SEQ ID NO: 78201 - protein, 33 aa, Artificial Sequence
  Description of Artificial Sequence: Synthetic polypeptide
DEEEIRTTNPVATEQYGCVCSTGELQYFGSEQE

SEQ ID NO: 78202 - protein, 32 aa, Artificial Sequence
  Description of Artificial Sequence: Synthetic polypeptide
DEHEIRTTNPVATEFWGSVSTTNQGQDNGGER

SEQ ID NO: 78203 - protein, 32 aa, Artificial Sequence
  Description of Artificial Sequence: Synthetic polypeptide
TEEEIRTTNPVATEQYGSVSETQDLLNNENTY

SEQ ID NO: 78204 - protein, 32 aa, Artificial Sequence
  Description of Artificial Sequence: Synthetic polypeptide
DEEEIRTTNPVATEQYGCVCSTGENQNGSEQS

SEQ ID NO: 78205 - protein, 30 aa, Artificial Sequence
  Description of Artificial Sequence: Synthetic polypeptide
DDECIRTTNPVATEQYGCVCSTNHQSNSDL

SEQ ID NO: 78206 - protein, 31 aa, Artificial Sequence
  Description of Artificial Sequence: Synthetic polypeptide
DDECIRTTNPVATEQYGCVCSTNHQRVSDQN

SEQ ID NO: 78207 - protein, 31 aa, Artificial Sequence
  Description of Artificial Sequence: Synthetic polypeptide
DDECIRTTNPVATEQYGCVCSTNHQRFVSDA

SEQ ID NO: 78208 - protein, 32 aa, Artificial Sequence
  Description of Artificial Sequence: Synthetic polypeptide
TEEEIRTTNPVATEQYGSVSGDNGQGEQGGEG

SEQ ID NO: 78209 - protein, 30 aa, Artificial Sequence
  Description of Artificial Sequence: Synthetic polypeptide
DDECIRTTNPVATEQYGCVCSTEHQRVSQQ

SEQ ID NO: 78210 - protein, 33 aa, Artificial Sequence
  Description of Artificial Sequence: Synthetic polypeptide
TEEEIRTTNPVATEQYGSVSGNFGEGQGGGNNE

SEQ ID NO: 78211 - protein, 30 aa, Artificial Sequence
  Description of Artificial Sequence: Synthetic polypeptide
DDECIRTTNPVATEQYGCVCSTEHQRSSDL

SEQ ID NO: 78212 - protein, 34 aa, Artificial Sequence
  Description of Artificial Sequence: Synthetic polypeptide
DEEEIRTTNPVATEQYGYVSTVNLDQGEGGETGN

SEQ ID NO: 78213 - protein, 34 aa, Artificial Sequence
  Description of Artificial Sequence: Synthetic polypeptide
DEEEIRTTNPVATEQYGCVCSTGNHNQYFGSNQA

SEQ ID NO: 78214 - protein, 34 aa, Artificial Sequence
  Description of Artificial Sequence: Synthetic polypeptide
DEAEIATTNPVATEQYGCVSCTLNLPVRTGGNNR

SEQ ID NO: 78215 - protein, 32 aa, Artificial Sequence
  Description of Artificial Sequence: Synthetic polypeptide
SNEEIRTTNPVATEQYGSVVSTNLEQDQAPED

SEQ ID NO: 78216 - protein, 33 aa, Artificial Sequence
  Description of Artificial Sequence: Synthetic polypeptide
DEEEIRTTNPVATEQYGYVTDTGNQDQVNGGNG

SEQ ID NO: 78217 - protein, 34 aa, Artificial Sequence
  Description of Artificial Sequence: Synthetic polypeptide
DEEEIRTTNPVATEQYGCVCSTGEPNQRFGSNQA

SEQ ID NO: 78218 - protein, 32 aa, Artificial Sequence
  Description of Artificial Sequence: Synthetic polypeptide
DDECIRSTNPVATEQYGCVCSTNLQERSGSQQ

SEQ ID NO: 78219 - protein, 33 aa, Artificial Sequence
  Description of Artificial Sequence: Synthetic polypeptide
DEHEIRTTNPVATEPYGSISINATSQREGGSNR

SEQ ID NO: 78220 - protein, 33 aa, Artificial Sequence
  Description of Artificial Sequence: Synthetic polypeptide
DEEEIRTTNPVATEQYGCVCSTGEPQERSGSEQ

SEQ ID NO: 78221 - protein, 31 aa, Artificial Sequence
  Description of Artificial Sequence: Synthetic polypeptide
SNEEIRTTNPVATEQWGCVSTPDLQEGMEMR

SEQ ID NO: 78222 - protein, 34 aa, Artificial Sequence
  Description of Artificial Sequence: Synthetic polypeptide
DEEEIRTTNPVATEQYGCVCSTGEPQESFGSNRE

SEQ ID NO: 78223 - protein, 34 aa, Artificial Sequence
  Description of Artificial Sequence: Synthetic polypeptide
TEEEIRTTNPVATEQYGSVSGTNGQGEGGGNEFE

SEQ ID NO: 78224 - protein, 31 aa, Artificial Sequence
  Description of Artificial Sequence: Synthetic polypeptide
DEHEIRTTNPVATEPYGSVTGTHLEPDGPGR

SEQ ID NO: 78225 - protein, 32 aa, Artificial Sequence
  Description of Artificial Sequence: Synthetic polypeptide
DEEEIRTTNPVATEQYGCVCSTGEPQNGSEQA

SEQ ID NO: 78226 - protein, 32 aa, Artificial Sequence
  Description of Artificial Sequence: Synthetic polypeptide
DEHEIRTTNPVATEQWGAVSTNLQGNDQNNEM

SEQ ID NO: 78227 - protein, 31 aa, Artificial Sequence
  Description of Artificial Sequence: Synthetic polypeptide
DEHEIRTTNPVATEQWGAVSTNMQGNDQNNH

SEQ ID NO: 78228 - protein, 30 aa, Artificial Sequence
  Description of Artificial Sequence: Synthetic polypeptide
SQAEIRTTNPVATEQWGCVSTNLQEGFDSD

SEQ ID NO: 78229 - protein, 31 aa, Artificial Sequence
  Description of Artificial Sequence: Synthetic polypeptide
DEGAIRTTNPVAYEQWGSFSTNDLIIDGNER

SEQ ID NO: 78230 - protein, 34 aa, Artificial Sequence
  Description of Artificial Sequence: Synthetic polypeptide
DEEEIRTTNPVATEQYGCVCSTGNHNQYFGSNQE

SEQ ID NO: 78231 - protein, 33 aa, Artificial Sequence
  Description of Artificial Sequence: Synthetic polypeptide
DEEEIRTTNPVATEQYGCVCSTGNHQEGFGSQQ

SEQ ID NO: 78232 - protein, 33 aa, Artificial Sequence
  Description of Artificial Sequence: Synthetic polypeptide
DEEEIRTTNPVATEAYGICVSTVNLQENISNQS

SEQ ID NO: 78233 - protein, 30 aa, Artificial Sequence
  Description of Artificial Sequence: Synthetic polypeptide
DEAEIATTNPVATEQYGCVAPNLQEADNDP

SEQ ID NO: 78234 - protein, 34 aa, Artificial Sequence
  Description of Artificial Sequence: Synthetic polypeptide
DEEEIRTTNPVATEQYGCVCSTGNLDQENFGSDQ

SEQ ID NO: 78235 - protein, 33 aa, Artificial Sequence
  Description of Artificial Sequence: Synthetic polypeptide
AEEEIRTTNPVATEQYGSVSNNQLGNTEQGNNN

SEQ ID NO: 78236 - protein, 34 aa, Artificial Sequence
  Description of Artificial Sequence: Synthetic polypeptide
DEEEIRTTNPVATEQYGCVCSTGNLEQNSGSDQT

SEQ ID NO: 78237 - protein, 32 aa, Artificial Sequence
  Description of Artificial Sequence: Synthetic polypeptide
DDEEIRTTNPVATEQYGCVCSTALQNFGSDQA

SEQ ID NO: 78238 - protein, 33 aa, Artificial Sequence
  Description of Artificial Sequence: Synthetic polypeptide
AEEEIRATNPCATEQYGSVSTELNLQMEIGTNM

SEQ ID NO: 78239 - protein, 33 aa, Artificial Sequence
  Description of Artificial Sequence: Synthetic polypeptide
DEEEIRTTNPVATEQYGCVCSTGNLEYFGSDQA

SEQ ID NO: 78240 - protein, 34 aa, Artificial Sequence
  Description of Artificial Sequence: Synthetic polypeptide
DEEEIRTTNPVATEQYGCVCSTGNLNQGFNSDQS

SEQ ID NO: 78241 - protein, 34 aa, Artificial Sequence
  Description of Artificial Sequence: Synthetic polypeptide
DEEEIRTTNPVATEQYGCVCSTGNLNQHFGSEQE

SEQ ID NO: 78242 - protein, 34 aa, Artificial Sequence
  Description of Artificial Sequence: Synthetic polypeptide
DEEEIRTTNPVATEQYGCVCSTGNLQEFFQSNDY

SEQ ID NO: 78243 - protein, 33 aa, Artificial Sequence
  Description of Artificial Sequence: Synthetic polypeptide
DEEEIRTTNPVATEAYGETVSVTYELSQPGGNA

SEQ ID NO: 78244 - protein, 34 aa, Artificial Sequence
  Description of Artificial Sequence: Synthetic polypeptide
DEEEIRTTNPVATEQYGCVCSTGNLQENFNSEQA

SEQ ID NO: 78245 - protein, 32 aa, Artificial Sequence
  Description of Artificial Sequence: Synthetic polypeptide
DDEEIRTTNPVATEQYGCVCSSEPQRFGSNQS

SEQ ID NO: 78246 - protein, 32 aa, Artificial Sequence
  Description of Artificial Sequence: Synthetic polypeptide
DDEEIRTTNPVATEQYGCVCSTEELQFFGSEQ

SEQ ID NO: 78247 - protein, 34 aa, Artificial Sequence
  Description of Artificial Sequence: Synthetic polypeptide
AEEEIRTTNPVATEQYGSVSNNQQLGNQQGNNNE

SEQ ID NO: 78248 - protein, 33 aa, Artificial Sequence
  Description of Artificial Sequence: Synthetic polypeptide
TEEEIRTTNPVATEQYGSVSTMNEGQGGGEEGD

SEQ ID NO: 78249 - protein, 30 aa, Artificial Sequence
  Description of Artificial Sequence: Synthetic polypeptide
SEYEIRCTNPVATEQYGSVETEDQHGSNQA

SEQ ID NO: 78250 - protein, 34 aa, Artificial Sequence
  Description of Artificial Sequence: Synthetic polypeptide
DEEEIRTTNPVATEQYGCVCSTGNLQEYFGSDQT

SEQ ID NO: 78251 - protein, 34 aa, Artificial Sequence
  Description of Artificial Sequence: Synthetic polypeptide
TEEEIRTTNPVATEQYGSVSTMNNEGQGGQENGD

SEQ ID NO: 78252 - protein, 34 aa, Artificial Sequence
  Description of Artificial Sequence: Synthetic polypeptide
DEEEIRTTNPVATEAYGCSVVSTNALQPPGGSQL

SEQ ID NO: 78253 - protein, 35 aa, Artificial Sequence
  Description of Artificial Sequence: Synthetic polypeptide
DEEEIRTTNPVATEAYGCSVVSTNALAQRPGGSEQ

SEQ ID NO: 78254 - protein, 34 aa, Artificial Sequence
  Description of Artificial Sequence: Synthetic polypeptide
DEEEIRTTNPVATEAYGCSVVASTNALQDPGGSQ

SEQ ID NO: 78255 - protein, 32 aa, Artificial Sequence
  Description of Artificial Sequence: Synthetic polypeptide
AEEEIRATNPCATEQYGSVSTEGNLLEIGTNM

SEQ ID NO: 78256 - protein, 35 aa, Artificial Sequence
  Description of Artificial Sequence: Synthetic polypeptide
DEEEIRTTNPVATEAYGCSTVVSTGALSQDGGNLR

SEQ ID NO: 78257 - protein, 35 aa, Artificial Sequence
  Description of Artificial Sequence: Synthetic polypeptide
DEEEIRTTNPVATEAYGCSSVSCTNALSQEPGGNQ

SEQ ID NO: 78258 - protein, 34 aa, Artificial Sequence
  Description of Artificial Sequence: Synthetic polypeptide
DEEEIRTTNPVATEAYGCSLVFCTNLQTPGGNNQ

SEQ ID NO: 78259 - protein, 34 aa, Artificial Sequence
  Description of Artificial Sequence: Synthetic polypeptide
DEEEIRTTNPVATEAYGCSIVSCTNLGTPGGNNQ

SEQ ID NO: 78260 - protein, 32 aa, Artificial Sequence
  Description of Artificial Sequence: Synthetic polypeptide
DDAEIRTTNPVATEQYGSVSTVLLELGEMQQR

SEQ ID NO: 78261 - protein, 32 aa, Artificial Sequence
  Description of Artificial Sequence: Synthetic polypeptide
DEEEIRTTNPVATEQYGCVCSTGELQNISEQA

SEQ ID NO: 78262 - protein, 31 aa, Artificial Sequence
  Description of Artificial Sequence: Synthetic polypeptide
DEAEIATTNPVATEQYGCVATNLADDGGENQ

SEQ ID NO: 78263 - protein, 32 aa, Artificial Sequence
  Description of Artificial Sequence: Synthetic polypeptide
DEEEIRTTNPVATEAYGISTVSERLSQSGGSA

SEQ ID NO: 78264 - protein, 31 aa, Artificial Sequence
  Description of Artificial Sequence: Synthetic polypeptide
DEGAIRTTNPVATESYGSFSTGNLSNINGER

SEQ ID NO: 78265 - protein, 32 aa, Artificial Sequence
  Description of Artificial Sequence: Synthetic polypeptide
DEGAIRTTNPVATEQYGYSFSTGNLIMINGER

SEQ ID NO: 78266 - protein, 33 aa, Artificial Sequence
  Description of Artificial Sequence: Synthetic polypeptide
AEEEIRATNPCATEQYGSVSTENLLNQIGTNQV

SEQ ID NO: 78267 - protein, 33 aa, Artificial Sequence
  Description of Artificial Sequence: Synthetic polypeptide
DEHEIRTTNPVATEQYGSVISTNETDQMQQQSR

SEQ ID NO: 78268 - protein, 31 aa, Artificial Sequence
  Description of Artificial Sequence: Synthetic polypeptide
SEYEIRMTNPVATESYGQSVRETNNLQHGNQ

SEQ ID NO: 78269 - protein, 33 aa, Artificial Sequence
  Description of Artificial Sequence: Synthetic polypeptide
DEHEIRTTNPVATEQYGSVNSTNNQNMNDNIQE

SEQ ID NO: 78270 - protein, 34 aa, Artificial Sequence
  Description of Artificial Sequence: Synthetic polypeptide
DEHEIRTTNPVATEQYGSVNSTNVSQMRYQGDVF

SEQ ID NO: 78271 - protein, 34 aa, Artificial Sequence
  Description of Artificial Sequence: Synthetic polypeptide
DEHEIRTTNPVATEQYGSVNSTVNDLQQNPQEDR

SEQ ID NO: 78272 - protein, 33 aa, Artificial Sequence
  Description of Artificial Sequence: Synthetic polypeptide
DEEEIRTTNPVATEQYGCVCSTGNHQFFGSDQS

SEQ ID NO: 78273 - protein, 33 aa, Artificial Sequence
  Description of Artificial Sequence: Synthetic polypeptide
AEEEIRTTNPVATEQYGSVSNNQGGNQQGNQNA

SEQ ID NO: 78274 - protein, 34 aa, Artificial Sequence
  Description of Artificial Sequence: Synthetic polypeptide
DEEEIRTTNPVATEQYGCVCSTGNHQFFGSNTQS

SEQ ID NO: 78275 - protein, 34 aa, Artificial Sequence
  Description of Artificial Sequence: Synthetic polypeptide
DEEEIRTTNPVATEQYGCVCSTGNHQGFGSNNDS

SEQ ID NO: 78276 - protein, 32 aa, Artificial Sequence
  Description of Artificial Sequence: Synthetic polypeptide
DEEEIRTTNPVATEAYGITTVSTRSSQPGGNA

SEQ ID NO: 78277 - protein, 34 aa, Artificial Sequence
  Description of Artificial Sequence: Synthetic polypeptide
DEEEIRTTNPVATEAYGISTVSCTYLSQPGGNAV

SEQ ID NO: 78278 - protein, 33 aa, Artificial Sequence
  Description of Artificial Sequence: Synthetic polypeptide
AEEEIRATNPCATEQYGSVSTENLLMQIGTNSV

SEQ ID NO: 78279 - protein, 34 aa, Artificial Sequence
  Description of Artificial Sequence: Synthetic polypeptide
DEHEIRTTNPVATEQYGSVSEAPNLQERGEDGQM

SEQ ID NO: 78280 - protein, 33 aa, Artificial Sequence
  Description of Artificial Sequence: Synthetic polypeptide
DEEEIRTTNPVATEQYGCVCSTGNHQGIGSDQA

SEQ ID NO: 78281 - protein, 33 aa, Artificial Sequence
  Description of Artificial Sequence: Synthetic polypeptide
TEEEIRTTNPVATEQYGSVSSTLGLELEGGNGE

SEQ ID NO: 78282 - protein, 34 aa, Artificial Sequence
  Description of Artificial Sequence: Synthetic polypeptide
DEEEIRTTNPVATEQYGCVCSTGNHQHFGSDNQI

SEQ ID NO: 78283 - protein, 34 aa, Artificial Sequence
  Description of Artificial Sequence: Synthetic polypeptide
DEEEIRTTNPVATEAYGISTVSTYWLSQPTGGNA

SEQ ID NO: 78284 - protein, 33 aa, Artificial Sequence
  Description of Artificial Sequence: Synthetic polypeptide
DEEEIRTTNPVATEAYGISTVSTYLSQPNGGSM

SEQ ID NO: 78285 - protein, 32 aa, Artificial Sequence
  Description of Artificial Sequence: Synthetic polypeptide
AEEEIRATNPCATEQYGSVSTENLAGEIGTNM

SEQ ID NO: 78286 - protein, 33 aa, Artificial Sequence
  Description of Artificial Sequence: Synthetic polypeptide
DEEEIRTTNPVATEQYGCVCSTGNHQNFISNAM

SEQ ID NO: 78287 - protein, 33 aa, Artificial Sequence
  Description of Artificial Sequence: Synthetic polypeptide
TEEEIRTTNPVATEQYGSVSTGDDQEGETGNTV

SEQ ID NO: 78288 - protein, 34 aa, Artificial Sequence
  Description of Artificial Sequence: Synthetic polypeptide
DEHEIRTTNPVATEQYGSVSGNNAGEERGNDDGR

SEQ ID NO: 78289 - protein, 33 aa, Artificial Sequence
  Description of Artificial Sequence: Synthetic polypeptide
DEHEIRTTNPVATEQYGSVSMTNTTQESTQNFA

SEQ ID NO: 78290 - protein, 34 aa, Artificial Sequence
  Description of Artificial Sequence: Synthetic polypeptide
DEEEIRTTNPVATEAYGISTVSTYLSQPGGNNAH

SEQ ID NO: 78291 - protein, 33 aa, Artificial Sequence
  Description of Artificial Sequence: Synthetic polypeptide
DEEEIRTTNPVATEAYGISTVSTPLSMPNGGNA

SEQ ID NO: 78292 - protein, 33 aa, Artificial Sequence
  Description of Artificial Sequence: Synthetic polypeptide
DEEEIRTTNPVATEAYGISVVSTGYPSQPGGNA

SEQ ID NO: 78293 - protein, 34 aa, Artificial Sequence
  Description of Artificial Sequence: Synthetic polypeptide
DEEEIRTTNPVATEQYGYVSGTMNNQPEIGQNDD

SEQ ID NO: 78294 - protein, 33 aa, Artificial Sequence
  Description of Artificial Sequence: Synthetic polypeptide
AEEEIRATNPCATEQYGSVSTENLMQIGTNTTD

SEQ ID NO: 78295 - protein, 33 aa, Artificial Sequence
  Description of Artificial Sequence: Synthetic polypeptide
DEEEIRTTNPVATEQYGCVCSTGELQNIGSETQ

SEQ ID NO: 78296 - protein, 29 aa, Artificial Sequence
  Description of Artificial Sequence: Synthetic peptide
SQEEIRTTNPVATEQWGTVSWSNSEEINR

SEQ ID NO: 78297 - protein, 29 aa, Artificial Sequence
  Description of Artificial Sequence: Synthetic peptide
SQEEIRTTNPVATEQWGTVSWNMGEEINR

SEQ ID NO: 78298 - protein, 31 aa, Artificial Sequence
  Description of Artificial Sequence: Synthetic polypeptide
AEEEIRTTNPVATEQYGSCSPEHEQVQGYRI

SEQ ID NO: 78299 - protein, 32 aa, Artificial Sequence
  Description of Artificial Sequence: Synthetic polypeptide
DDEEIASTNPVATEQYGNVSANTIQSRVGNPR

SEQ ID NO: 78300 - protein, 31 aa, Artificial Sequence
  Description of Artificial Sequence: Synthetic polypeptide
DEGEIACTNPVAYEQYGSVSPNDQDAGSNSR

SEQ ID NO: 78301 - protein, 32 aa, Artificial Sequence
  Description of Artificial Sequence: Synthetic polypeptide
DEHEIRTTNPCATEHYGSVSTGNGQERDGDAN

SEQ ID NO: 78302 - protein, 34 aa, Artificial Sequence
  Description of Artificial Sequence: Synthetic polypeptide
DEEEIRTTNPVATEQYGYVSTMNNQPEIDQGNGQ

SEQ ID NO: 78303 - protein, 34 aa, Artificial Sequence
  Description of Artificial Sequence: Synthetic polypeptide
DEEEIRTTNPVATEQYGYVSTNDQQGEIQGNGEG

SEQ ID NO: 78304 - protein, 30 aa, Artificial Sequence
  Description of Artificial Sequence: Synthetic polypeptide
DDEEIACTNPVSTEQYGNVAANTIQRVGNR

SEQ ID NO: 78305 - protein, 32 aa, Artificial Sequence
  Description of Artificial Sequence: Synthetic polypeptide
SQEEIRTTNPVATEQWGTVSTGNLQNFGSNTQ

SEQ ID NO: 78306 - protein, 32 aa, Artificial Sequence
  Description of Artificial Sequence: Synthetic polypeptide
DEHEIRTTNPCATEMWGSVSTNLQGDAGNDSE

SEQ ID NO: 78307 - protein, 31 aa, Artificial Sequence
  Description of Artificial Sequence: Synthetic polypeptide
SQEEIRTTNPVATEQWGTVSTELQYFGSNAA

SEQ ID NO: 78308 - protein, 32 aa, Artificial Sequence
  Description of Artificial Sequence: Synthetic polypeptide
SQEEIRTTNPVATEQWGTVSCTNLSQSTGGNI

SEQ ID NO: 78309 - protein, 33 aa, Artificial Sequence
  Description of Artificial Sequence: Synthetic polypeptide
SQEEIRTTNPVATEQWGTVPSCTNELSQETGNR

SEQ ID NO: 78310 - protein, 32 aa, Artificial Sequence
  Description of Artificial Sequence: Synthetic polypeptide
DEHEIRTTNPCATEPYGNVSTNLQGDAGNDSD

SEQ ID NO: 78311 - protein, 33 aa, Artificial Sequence
  Description of Artificial Sequence: Synthetic polypeptide
DEEEIRTTNPVATEQYGCVCSTGEHNQSGSNQA

SEQ ID NO: 78312 - protein, 32 aa, Artificial Sequence
  Description of Artificial Sequence: Synthetic polypeptide
SQEEIRTTNPVATEQWGTVCSTNLQYFGSNAM

SEQ ID NO: 78313 - protein, 31 aa, Artificial Sequence
  Description of Artificial Sequence: Synthetic polypeptide
SQEEIRTTNPVATEQWGTVCSTNHQYGSNAA

SEQ ID NO: 78314 - protein, 33 aa, Artificial Sequence
  Description of Artificial Sequence: Synthetic polypeptide
DEHEIRTTNPCATEQYGSVSTGANLNDPNDNQR

SEQ ID NO: 78315 - protein, 33 aa, Artificial Sequence
  Description of Artificial Sequence: Synthetic polypeptide
SQEEIRTTNPVATEQWGTTVSTNMLSQETGNNR

SEQ ID NO: 78316 - protein, 31 aa, Artificial Sequence
  Description of Artificial Sequence: Synthetic polypeptide
AEEEIRTTNPVATEQYGSVATTNQSNEETNS

SEQ ID NO: 78317 - protein, 33 aa, Artificial Sequence
  Description of Artificial Sequence: Synthetic polypeptide
AEEEIRTTNPVATEQYGSVATTTNLQTTTEENT

SEQ ID NO: 78318 - protein, 34 aa, Artificial Sequence
  Description of Artificial Sequence: Synthetic polypeptide
DEHEIRTTNPCATEQYGSVSTGANLQDDPNDNNR

SEQ ID NO: 78319 - protein, 33 aa, Artificial Sequence
  Description of Artificial Sequence: Synthetic polypeptide
DEHEIRTTNPCATEQYGSVSTMNDGDGRGGDRR

SEQ ID NO: 78320 - protein, 33 aa, Artificial Sequence
  Description of Artificial Sequence: Synthetic polypeptide
DEHEIRTTNPCATEQYGTVSTNLQQGDAGNDSD

SEQ ID NO: 78321 - protein, 34 aa, Artificial Sequence
  Description of Artificial Sequence: Synthetic polypeptide
DEHEIRTTNPCATEQYGVVSTGNDLQDNQGNNIR

SEQ ID NO: 78322 - protein, 33 aa, Artificial Sequence
  Description of Artificial Sequence: Synthetic polypeptide
AEEEIRATNPCATEQYGSVSTENQLMQIGTNVD

SEQ ID NO: 78323 - protein, 31 aa, Artificial Sequence
  Description of Artificial Sequence: Synthetic polypeptide
DEHEIRTTNPCATEEYGSVATNHGDRGGNDA

SEQ ID NO: 78324 - protein, 34 aa, Artificial Sequence
  Description of Artificial Sequence: Synthetic polypeptide
DEEEIRTTNPVATEQYGYVSTMNLGQDIEGEGGD

SEQ ID NO: 78325 - protein, 33 aa, Artificial Sequence
  Description of Artificial Sequence: Synthetic polypeptide
DEHEIRTTNPCATECYGSVSTNLQGNAGEGNGS

SEQ ID NO: 78326 - protein, 29 aa, Artificial Sequence
  Description of Artificial Sequence: Synthetic peptide
SQEEIRTTNPVATEQWGTYSWNLEEINGR

SEQ ID NO: 78327 - protein, 33 aa, Artificial Sequence
  Description of Artificial Sequence: Synthetic polypeptide
TEEEIRTTNPVATEQYGSVGSTDDIQETGNGGE

SEQ ID NO: 78328 - protein, 32 aa, Artificial Sequence
  Description of Artificial Sequence: Synthetic polypeptide
DEHEIATTNPVGTEQYGSVSWNENEGQRGNAP

SEQ ID NO: 78329 - protein, 29 aa, Artificial Sequence
  Description of Artificial Sequence: Synthetic peptide
DEGEIAPTNPCATEQYGIVSCNLMSAGDR

SEQ ID NO: 78330 - protein, 30 aa, Artificial Sequence
  Description of Artificial Sequence: Synthetic polypeptide
SSEEIRGTNPVATWQYGSVSTVLQQNGQPF

SEQ ID NO: 78331 - protein, 31 aa, Artificial Sequence
  Description of Artificial Sequence: Synthetic polypeptide
AEEEIRATNPCATEQYGSVSVENNLMQGNVG

SEQ ID NO: 78332 - protein, 31 aa, Artificial Sequence
  Description of Artificial Sequence: Synthetic polypeptide
AEEEIRATNPCATEQYGSVSVENLMEIGTNM

SEQ ID NO: 78333 - protein, 32 aa, Artificial Sequence
  Description of Artificial Sequence: Synthetic polypeptide
DEHEIATTNPVSTEQYGSVATNLQTRPGGEVQ

SEQ ID NO: 78334 - protein, 34 aa, Artificial Sequence
  Description of Artificial Sequence: Synthetic polypeptide
TEEEIRTTNPVATEQYGSVNETFNIDQRNGENYQ

SEQ ID NO: 78335 - protein, 31 aa, Artificial Sequence
  Description of Artificial Sequence: Synthetic polypeptide
SSEEIATTNPVATTQYGQVSTWDLDQRGNDF

SEQ ID NO: 78336 - protein, 31 aa, Artificial Sequence
  Description of Artificial Sequence: Synthetic polypeptide
DEHEIGTTNPVATEQYGSVSACNNILPGNNQ

SEQ ID NO: 78337 - protein, 34 aa, Artificial Sequence
  Description of Artificial Sequence: Synthetic polypeptide
DEEEIRTTNPVATEQYGYVSTANEMGQGEAGNGE

SEQ ID NO: 78338 - protein, 30 aa, Artificial Sequence
  Description of Artificial Sequence: Synthetic polypeptide
DEHEIRATNPVAYEQWGVVSGWNDHQGGNR

SEQ ID NO: 78339 - protein, 33 aa, Artificial Sequence
  Description of Artificial Sequence: Synthetic polypeptide
DEEEIRTTNPVATEQYGYVSTDEMDLNNEGENI

SEQ ID NO: 78340 - protein, 32 aa, Artificial Sequence
  Description of Artificial Sequence: Synthetic polypeptide
DEAEIATTNPVATEQYGSCAAATNDQRGTTRQ

SEQ ID NO: 78341 - protein, 32 aa, Artificial Sequence
  Description of Artificial Sequence: Synthetic polypeptide
TEEEIRTTNPVATEQYGSVNNTNDERSEENGD

SEQ ID NO: 78342 - protein, 34 aa, Artificial Sequence
  Description of Artificial Sequence: Synthetic polypeptide
DEEEIRTTNPVATEQYGYVSTDNLNLIDEGGNNV

SEQ ID NO: 78343 - protein, 30 aa, Artificial Sequence
  Description of Artificial Sequence: Synthetic polypeptide
DEAEIATTNPVATEQYGSTATNLDNNHNEE

SEQ ID NO: 78344 - protein, 32 aa, Artificial Sequence
  Description of Artificial Sequence: Synthetic polypeptide
DEHEIRTTNPCATECYGSVSTGNDDGQKGSNM

SEQ ID NO: 78345 - protein, 34 aa, Artificial Sequence
  Description of Artificial Sequence: Synthetic polypeptide
DEEEIRTTNPVATEQYGYVSTGDLDQIGGENTGN

SEQ ID NO: 78346 - protein, 32 aa, Artificial Sequence
  Description of Artificial Sequence: Synthetic polypeptide
DEHEIRTTNPCATECYGSVSTGNDDHGGGSNR

SEQ ID NO: 78347 - protein, 29 aa, Artificial Sequence
  Description of Artificial Sequence: Synthetic peptide
DEGEIAPTNPCASEQYGIVSCNLPQSGTR

SEQ ID NO: 78348 - protein, 33 aa, Artificial Sequence
  Description of Artificial Sequence: Synthetic polypeptide
AEEEIRATNPCATEQYGSVSTVNNLMQQGTNVD

SEQ ID NO: 78349 - protein, 32 aa, Artificial Sequence
  Description of Artificial Sequence: Synthetic polypeptide
DEHEIRTTNPCATECYGSVSTGNDEMQGGSDR

SEQ ID NO: 78350 - protein, 34 aa, Artificial Sequence
  Description of Artificial Sequence: Synthetic polypeptide
DEEEIRTTNPVATEQYGYVSTGTDQLIQGGGNEG

SEQ ID NO: 78351 - protein, 33 aa, Artificial Sequence
  Description of Artificial Sequence: Synthetic polypeptide
AEEEIRATNPCATEQYGSVSTETNLMQIGTNVS

SEQ ID NO: 78352 - protein, 32 aa, Artificial Sequence
  Description of Artificial Sequence: Synthetic polypeptide
TEEEIRTTNPVATEQYGSVPVTELQQVGPFPE

SEQ ID NO: 78353 - protein, 32 aa, Artificial Sequence
  Description of Artificial Sequence: Synthetic polypeptide
DEHEIRTTNPCATECYGSVSTGNLGNDGQNDA

SEQ ID NO: 78354 - protein, 32 aa, Artificial Sequence
  Description of Artificial Sequence: Synthetic polypeptide
DDEEIASTNPVATEQYGSVATNPTIQSRVGNV

SEQ ID NO: 78355 - protein, 33 aa, Artificial Sequence
  Description of Artificial Sequence: Synthetic polypeptide
DEEEIRTTNPVATEQYGYVSTDGDQGGGENTGN

SEQ ID NO: 78356 - protein, 30 aa, Artificial Sequence
  Description of Artificial Sequence: Synthetic polypeptide
DEHEIRTTNPCCTDQYGSVNTQDLEQRGED

SEQ ID NO: 78357 - protein, 30 aa, Artificial Sequence
  Description of Artificial Sequence: Synthetic polypeptide
DEHEIRTTNPVATDMYGSVNTQDLEQFGED

SEQ ID NO: 78358 - protein, 33 aa, Artificial Sequence
  Description of Artificial Sequence: Synthetic polypeptide
DEEEIRTTNPVATEQYGCVCSTGEHQNFGSNQG

SEQ ID NO: 78359 - protein, 32 aa, Artificial Sequence
  Description of Artificial Sequence: Synthetic polypeptide
DEEEIRTTNPVATEQYGCVCSTGELINGSEQS

SEQ ID NO: 78360 - protein, 33 aa, Artificial Sequence
  Description of Artificial Sequence: Synthetic polypeptide
DEHEIRTTNPVATEAWGSVCSTDNGDQRDGNTM

SEQ ID NO: 78361 - protein, 32 aa, Artificial Sequence
  Description of Artificial Sequence: Synthetic polypeptide
AEEEIRATNPCATEQYGSVSTENNLMLGNNMG

SEQ ID NO: 78362 - protein, 30 aa, Artificial Sequence
  Description of Artificial Sequence: Synthetic polypeptide
SQEEIATTNPVAYEQWGTVSTNLQHEDGNT

SEQ ID NO: 78363 - protein, 33 aa, Artificial Sequence
  Description of Artificial Sequence: Synthetic polypeptide
DEEEIRTTNPVATEQYGCVCSTGELNQGFGSQQ

SEQ ID NO: 78364 - protein, 33 aa, Artificial Sequence
  Description of Artificial Sequence: Synthetic polypeptide
DEEEIRTTNPVATEQYGCVCSNWELQYFGSNQV

SEQ ID NO: 78365 - protein, 29 aa, Artificial Sequence
  Description of Artificial Sequence: Synthetic peptide
DEGEIACTNPVATEQYGSVATALIGMNDQ

SEQ ID NO: 78366 - protein, 33 aa, Artificial Sequence
  Description of Artificial Sequence: Synthetic polypeptide
DEEEIRTTNPVATEQYGCVCSTGELNQNFGSDA

SEQ ID NO: 78367 - protein, 30 aa, Artificial Sequence
  Description of Artificial Sequence: Synthetic polypeptide
SQEEIATTNPVAYEQWGTVSTNLQGENGNA

SEQ ID NO: 78368 - protein, 35 aa, Artificial Sequence
  Description of Artificial Sequence: Synthetic polypeptide
DEEEIRTTNPVATEQYGCVCSTGELNQRFGSENQA

SEQ ID NO: 78369 - protein, 33 aa, Artificial Sequence
  Description of Artificial Sequence: Synthetic polypeptide
DEEEIRTTNPVATEAYGMVYSSTVNFDQPGNLW

SEQ ID NO: 78370 - protein, 34 aa, Artificial Sequence
  Description of Artificial Sequence: Synthetic polypeptide
DEEEIRTTNPVATEQYGCVCSTGELNQRSGSEQS

SEQ ID NO: 78371 - protein, 33 aa, Artificial Sequence
  Description of Artificial Sequence: Synthetic polypeptide
DDECIRTTNPVATEQYGKVPSTNHAQRTVGENL

SEQ ID NO: 78372 - protein, 31 aa, Artificial Sequence
  Description of Artificial Sequence: Synthetic polypeptide
DEGEIACTNPVATEQYGSVATNLERDGDTLA

SEQ ID NO: 78373 - protein, 34 aa, Artificial Sequence
  Description of Artificial Sequence: Synthetic polypeptide
DEEEIRTTNPVATEQYGCVCSTGELQEFFGSNAE

SEQ ID NO: 78374 - protein, 32 aa, Artificial Sequence
  Description of Artificial Sequence: Synthetic polypeptide
DEAEIATTNPVATEQYGCVSTNLQGAGEPTGE

SEQ ID NO: 78375 - protein, 32 aa, Artificial Sequence
  Description of Artificial Sequence: Synthetic polypeptide
DDECIRTTNPVATEQYGKVPATNHQRTVGDNL

SEQ ID NO: 78376 - protein, 33 aa, Artificial Sequence
  Description of Artificial Sequence: Synthetic polypeptide
AEEEIRATNPCATEQYGSVSTENLQMTIGTNMQ

SEQ ID NO: 78377 - protein, 32 aa, Artificial Sequence
  Description of Artificial Sequence: Synthetic polypeptide
DEEEIRTTNPVATEQYGCVCSNWEHQNFGNQS

SEQ ID NO: 78378 - protein, 31 aa, Artificial Sequence
  Description of Artificial Sequence: Synthetic polypeptide
SQEEIATTNPVAYEQWGTVSTNLQEGGDNDR

SEQ ID NO: 78379 - protein, 34 aa, Artificial Sequence
  Description of Artificial Sequence: Synthetic polypeptide
DEEEIRTTNPVATEQYGCVCSTGELQFFGSNNQV

SEQ ID NO: 78380 - protein, 33 aa, Artificial Sequence
  Description of Artificial Sequence: Synthetic polypeptide
DEEEIRTTNPVATEQYGCVCSTGELQFFNSDQG

SEQ ID NO: 78381 - protein, 34 aa, Artificial Sequence
  Description of Artificial Sequence: Synthetic polypeptide
DEEEIRTTNPVATEQYGCVCSTGELQGFGSDNQS

SEQ ID NO: 78382 - protein, 33 aa, Artificial Sequence
  Description of Artificial Sequence: Synthetic polypeptide
DEEEIRTTNPVATEQYGCVCSTGELQGFISNAA

SEQ ID NO: 78383 - protein, 32 aa, Artificial Sequence
  Description of Artificial Sequence: Synthetic polypeptide
DEEEIRTTNPVATEAYGMVGSILNLEGNGNGQ

SEQ ID NO: 78384 - protein, 33 aa, Artificial Sequence
  Description of Artificial Sequence: Synthetic polypeptide
DEEEIRTTNPVATEQYGCVCSTGELQNFGSVDA

SEQ ID NO: 78385 - protein, 33 aa, Artificial Sequence
  Description of Artificial Sequence: Synthetic polypeptide
DEHEIRTTNPVATEFWGSVSTTNGNGQDNGNTR

SEQ ID NO: 78386 - protein, 33 aa, Artificial Sequence
  Description of Artificial Sequence: Synthetic polypeptide
DEEEIRTTNPVATEQYGCVCSTGELQNFNSEQS

SEQ ID NO: 78387 - protein, 31 aa, Artificial Sequence
  Description of Artificial Sequence: Synthetic polypeptide
SQEEIATTNPVAYEQWGTVSTNLQGEMGGNR

SEQ ID NO: 78388 - protein, 34 aa, Artificial Sequence
  Description of Artificial Sequence: Synthetic polypeptide
DEEEIRTTNPVATEQYGYVSTTDLDLGQGGNGNE

SEQ ID NO: 78389 - protein, 31 aa, Artificial Sequence
  Description of Artificial Sequence: Synthetic polypeptide
DEGEIACTNPVATEQYGSVATNLQAEDDTNV

SEQ ID NO: 78390 - protein, 32 aa, Artificial Sequence
  Description of Artificial Sequence: Synthetic polypeptide
DEEEIRTTNPVATEAYGNVPSTNNVDLDGVNW

SEQ ID NO: 78391 - protein, 30 aa, Artificial Sequence
  Description of Artificial Sequence: Synthetic polypeptide
SQEEIRTTNPVATEQWGCVSTNPMQEGFDS

SEQ ID NO: 78392 - protein, 32 aa, Artificial Sequence
  Description of Artificial Sequence: Synthetic polypeptide
AEEEIRATNPCATEQYGSVSTENQLEAGNNMD

SEQ ID NO: 78393 - protein, 31 aa, Artificial Sequence
  Description of Artificial Sequence: Synthetic polypeptide
DEGEIACTNPVATEQYGSVATNLVQDGDTEA

SEQ ID NO: 78394 - protein, 30 aa, Artificial Sequence
  Description of Artificial Sequence: Synthetic polypeptide
SQEEIRTTNPVATEQWGCVSTNNLQELFDE

SEQ ID NO: 78395 - protein, 31 aa, Artificial Sequence
  Description of Artificial Sequence: Synthetic polypeptide
DEGEIACTNPVATEQYGSVATNLTDTGGNPE

SEQ ID NO: 78396 - protein, 31 aa, Artificial Sequence
  Description of Artificial Sequence: Synthetic polypeptide
DEHEIRTTNPVATDQWGSVNTDDGGQRGNDH

SEQ ID NO: 78397 - protein, 31 aa, Artificial Sequence
  Description of Artificial Sequence: Synthetic polypeptide
DEHEIRTTNPVATDQWGSVNTGQDGQRGGND

SEQ ID NO: 78398 - protein, 30 aa, Artificial Sequence
  Description of Artificial Sequence: Synthetic polypeptide
DEHEIRTTNPVATDQWGSVNTQDQRGGDDA

SEQ ID NO: 78399 - protein, 34 aa, Artificial Sequence
  Description of Artificial Sequence: Synthetic polypeptide
DEEEIRTTNPVATEQYGCVCSTGEHQRFGSNNQI

SEQ ID NO: 78400 - protein, 31 aa, Artificial Sequence
  Description of Artificial Sequence: Synthetic polypeptide
DEHEIRTTNPVATDQYGSVCTDDIEQRGSED

SEQ ID NO: 78401 - protein, 33 aa, Artificial Sequence
  Description of Artificial Sequence: Synthetic polypeptide
DEHEIRTTNPVATDQYGSVNCTRELSQRTGGNE

SEQ ID NO: 78402 - protein, 31 aa, Artificial Sequence
  Description of Artificial Sequence: Synthetic polypeptide
DEGEIACTNPVATEQYGSVATNLQESPGQEE

SEQ ID NO: 78403 - protein, 33 aa, Artificial Sequence
  Description of Artificial Sequence: Synthetic polypeptide
DDEEIRTTNPVATEQYGCVCSNTELQRFGSEQF

SEQ ID NO: 78404 - protein, 34 aa, Artificial Sequence
  Description of Artificial Sequence: Synthetic polypeptide
DEEEIRTTNPVATEQYGCVCSTGELFQYFGSNQA

SEQ ID NO: 78405 - protein, 30 aa, Artificial Sequence
  Description of Artificial Sequence: Synthetic polypeptide
DEHEIRTTNPVATDQYGSVNMQLQRSIFDM

SEQ ID NO: 78406 - protein, 32 aa, Artificial Sequence
  Description of Artificial Sequence: Synthetic polypeptide
DEGEIACTNPVATEQYGSVATNLQDSGDGNDA

SEQ ID NO: 78407 - protein, 31 aa, Artificial Sequence
  Description of Artificial Sequence: Synthetic polypeptide
SQEEIRTTNPVATEQWGCVCSSNLQYGSNQS

SEQ ID NO: 78408 - protein, 33 aa, Artificial Sequence
  Description of Artificial Sequence: Synthetic polypeptide
DEEEIRTTNPVATEQYGCVCSTGELAGFGSNND

SEQ ID NO: 78409 - protein, 32 aa, Artificial Sequence
  Description of Artificial Sequence: Synthetic polypeptide
SQEEIRTTNPVATECWGITVSCTNLSQEGGNR

SEQ ID NO: 78410 - protein, 33 aa, Artificial Sequence
  Description of Artificial Sequence: Synthetic polypeptide
AEEEIRATNPCATEQYGSVSTENNLQLEIGTNM

SEQ ID NO: 78411 - protein, 29 aa, Artificial Sequence
  Description of Artificial Sequence: Synthetic peptide
SQEEIRTTNPVATEAWGTVSWNLEEINRI

SEQ ID NO: 78412 - protein, 32 aa, Artificial Sequence
  Description of Artificial Sequence: Synthetic polypeptide
AEEEIRTTNPVATEQYGSVCSTNHANNSNFQA

SEQ ID NO: 78413 - protein, 33 aa, Artificial Sequence
  Description of Artificial Sequence: Synthetic polypeptide
AEEEIRTTNPVATEQYGSVCSTNLAEHFNSNFQ

SEQ ID NO: 78414 - protein, 33 aa, Artificial Sequence
  Description of Artificial Sequence: Synthetic polypeptide
DEEEIRTTNPVATEQYGCVCSTGELEGFGSNQG

SEQ ID NO: 78415 - protein, 30 aa, Artificial Sequence
  Description of Artificial Sequence: Synthetic polypeptide
DEHEIRTTNPVATDQYGSVNMSQLQRSIQD

SEQ ID NO: 78416 - protein, 30 aa, Artificial Sequence
  Description of Artificial Sequence: Synthetic polypeptide
DEHEIRTTNPVATDQYGSVTTQDLEQPEED

SEQ ID NO: 78417 - protein, 33 aa, Artificial Sequence
  Description of Artificial Sequence: Synthetic polypeptide
DEEEIRTTNPVATEQYGCVCSNWEPQRFGSNQA

SEQ ID NO: 78418 - protein, 33 aa, Artificial Sequence
  Description of Artificial Sequence: Synthetic polypeptide
DEEEIRTTNPVATEQYGCVCSTGELEQGGSEQG

SEQ ID NO: 78419 - protein, 30 aa, Artificial Sequence
  Description of Artificial Sequence: Synthetic polypeptide
DEHEIRTTNPVATDQYGSVNMQLQRSIQFD

SEQ ID NO: 78420 - protein, 34 aa, Artificial Sequence
  Description of Artificial Sequence: Synthetic polypeptide
AEEEIRTTNPVATEAYGSVSTTNQNLGNQQGDNL

SEQ ID NO: 78421 - protein, 33 aa, Artificial Sequence
  Description of Artificial Sequence: Synthetic polypeptide
DEEEIRTTNPVATEQYGCVCSTELQGFGSETVA

SEQ ID NO: 78422 - protein, 33 aa, Artificial Sequence
  Description of Artificial Sequence: Synthetic polypeptide
DEEEIRTTNPVATEQYGCVCSTELQGFGSDPQI

SEQ ID NO: 78423 - protein, 32 aa, Artificial Sequence
  Description of Artificial Sequence: Synthetic polypeptide
DEEEIRTTNPVATEQYGCVCSTEDQSFGSQDA

SEQ ID NO: 78424 - protein, 32 aa, Artificial Sequence
  Description of Artificial Sequence: Synthetic polypeptide
DEEEIRTTNPVATEQYGCVCSTEDQSFNSEQA

SEQ ID NO: 78425 - protein, 32 aa, Artificial Sequence
  Description of Artificial Sequence: Synthetic polypeptide
DEEEIRTTNPVATEQYGCVCSTEDQYFGSDQA

SEQ ID NO: 78426 - protein, 33 aa, Artificial Sequence
  Description of Artificial Sequence: Synthetic polypeptide
DEEEIRTTNPVATEQYGCVCSTEDQYFGSNFQN

SEQ ID NO: 78427 - protein, 34 aa, Artificial Sequence
  Description of Artificial Sequence: Synthetic polypeptide
TEEEIKTTNPVATEHYGSVSTGNMLSQQRGGNQP

SEQ ID NO: 78428 - protein, 34 aa, Artificial Sequence
  Description of Artificial Sequence: Synthetic polypeptide
DEGEIATTNPVSTEQYGSVSSTTALPQMRNGNPR

SEQ ID NO: 78429 - protein, 34 aa, Artificial Sequence
  Description of Artificial Sequence: Synthetic polypeptide
TEEEIKTTNPVATEPYGSVSCTMNLSQQRGGNQP

SEQ ID NO: 78430 - protein, 31 aa, Artificial Sequence
  Description of Artificial Sequence: Synthetic polypeptide
DEGEIATVNPVAYEQYGSVSTNLPAEMGNHN

SEQ ID NO: 78431 - protein, 33 aa, Artificial Sequence
  Description of Artificial Sequence: Synthetic polypeptide
DEEEIRTTNPVATEQYGCVCSTEEAHQENGSNQ

SEQ ID NO: 78432 - protein, 32 aa, Artificial Sequence
  Description of Artificial Sequence: Synthetic polypeptide
DEGEIATTNPVATEQYGSVAMNLQNENPTVRK

SEQ ID NO: 78433 - protein, 33 aa, Artificial Sequence
  Description of Artificial Sequence: Synthetic polypeptide
TEEEINTTNPVAYEHYGSTVPSCTINLDRGGNR

SEQ ID NO: 78434 - protein, 29 aa, Artificial Sequence
  Description of Artificial Sequence: Synthetic peptide
DEGEIRPTNPVSTEQYGDVSCIEQNAGDR

SEQ ID NO: 78435 - protein, 31 aa, Artificial Sequence
  Description of Artificial Sequence: Synthetic polypeptide
TEEEIACTNPVATEQYGSVATNLQEAGHDDH

SEQ ID NO: 78436 - protein, 34 aa, Artificial Sequence
  Description of Artificial Sequence: Synthetic polypeptide
TEEEINTTNPVAYEQYGSTVPSCTGNLRDRGGNR

SEQ ID NO: 78437 - protein, 30 aa, Artificial Sequence
  Description of Artificial Sequence: Synthetic polypeptide
TEEEIACTNPVATEQYGSVATNLQAEAHHH

SEQ ID NO: 78438 - protein, 30 aa, Artificial Sequence
  Description of Artificial Sequence: Synthetic polypeptide
TEEEIACTNPVATEQYGSVATNLQAAHTDH

SEQ ID NO: 78439 - protein, 28 aa, Artificial Sequence
  Description of Artificial Sequence: Synthetic peptide
DEGEIRPTNPVSTEQYGTISMNIQQGTH

SEQ ID NO: 78440 - protein, 30 aa, Artificial Sequence
  Description of Artificial Sequence: Synthetic polypeptide
DEGEIRTTNPCATEPYGSCATNLAATGDNW

SEQ ID NO: 78441 - protein, 30 aa, Artificial Sequence
  Description of Artificial Sequence: Synthetic polypeptide
DEGEIRTTNPCATEQYGCVATGLAQDGDEQ

SEQ ID NO: 78442 - protein, 31 aa, Artificial Sequence
  Description of Artificial Sequence: Synthetic polypeptide
DEGEIATTNPVATEQYGSVAITNLNDAGTSM

SEQ ID NO: 78443 - protein, 28 aa, Artificial Sequence
  Description of Artificial Sequence: Synthetic peptide
DEGEIRTTNPCSSEQWGIVSENEQSGDR

SEQ ID NO: 78444 - protein, 28 aa, Artificial Sequence
  Description of Artificial Sequence: Synthetic peptide
DEGEIRTTNPCSSEQWGIVSENEQSGTR

SEQ ID NO: 78445 - protein, 29 aa, Artificial Sequence
  Description of Artificial Sequence: Synthetic peptide
DEGEIRTTNPCSSEQYGIVSCNIQQNGTR

SEQ ID NO: 78446 - protein, 34 aa, Artificial Sequence
  Description of Artificial Sequence: Synthetic polypeptide
DEEEIRTTNPVATEQYGCVCSTEEDHQRFGSNQN

SEQ ID NO: 78447 - protein, 28 aa, Artificial Sequence
  Description of Artificial Sequence: Synthetic peptide
DEGEIRTTNPCSTEQYGIVSENLMSETA

SEQ ID NO: 78448 - protein, 31 aa, Artificial Sequence
  Description of Artificial Sequence: Synthetic polypeptide
AEEEIRTTNPVATEEYGCSSSGELQNFGSNQ

SEQ ID NO: 78449 - protein, 30 aa, Artificial Sequence
  Description of Artificial Sequence: Synthetic polypeptide
DEGEIRTTNPVASECWGIVSCINEQREGNG

SEQ ID NO: 78450 - protein, 31 aa, Artificial Sequence
  Description of Artificial Sequence: Synthetic polypeptide
DEGEIATTNPVSTEQYGSVAATNDQDDGNDQ

SEQ ID NO: 78451 - protein, 30 aa, Artificial Sequence
  Description of Artificial Sequence: Synthetic polypeptide
DEGEIATTNPVSTEQYGIVSACNLQDSGTL

SEQ ID NO: 78452 - protein, 31 aa, Artificial Sequence
  Description of Artificial Sequence: Synthetic polypeptide
DEEEIRTTNPVATEQYGCVCSTEDQNNSQQM

SEQ ID NO: 78453 - protein, 32 aa, Artificial Sequence
  Description of Artificial Sequence: Synthetic polypeptide
DEEEIRTTNPVATEQYGCVCSTEDQNFNSQQI

SEQ ID NO: 78454 - protein, 29 aa, Artificial Sequence
  Description of Artificial Sequence: Synthetic peptide
TEEEIASVNPVCTEQYGVVSDNELQSGNS

SEQ ID NO: 78455 - protein, 35 aa, Artificial Sequence
  Description of Artificial Sequence: Synthetic polypeptide
DEEEIRTTNPVATEQYGVVSVVTNQLNNQQGQNQE

SEQ ID NO: 78456 - protein, 32 aa, Artificial Sequence
  Description of Artificial Sequence: Synthetic polypeptide
DEEEIRTTNPVATEQYGCVCSTEDLQHNSEQL

SEQ ID NO: 78457 - protein, 35 aa, Artificial Sequence
  Description of Artificial Sequence: Synthetic polypeptide
DEEEIRTTNPVATEQYGVVTVSVTNLLQYGNNTEG

SEQ ID NO: 78458 - protein, 35 aa, Artificial Sequence
  Description of Artificial Sequence: Synthetic polypeptide
DEEEIRTTNPVATEQYGVVTVSVTNLLQYGTNNET

SEQ ID NO: 78459 - protein, 33 aa, Artificial Sequence
  Description of Artificial Sequence: Synthetic polypeptide
DEEEIRTTNPVATEQYGCVCSTEDLQNISNNQL

SEQ ID NO: 78460 - protein, 29 aa, Artificial Sequence
  Description of Artificial Sequence: Synthetic peptide
DEGEIATTNPVATEQYGSVATALINQMMM

SEQ ID NO: 78461 - protein, 30 aa, Artificial Sequence
  Description of Artificial Sequence: Synthetic polypeptide
DEGEIATTNPVSSEQYGIISCNLQQSNGNR

SEQ ID NO: 78462 - protein, 31 aa, Artificial Sequence
  Description of Artificial Sequence: Synthetic polypeptide
DDEEIRTTNPVATEQWGSCTTTLLQRGTQFM

SEQ ID NO: 78463 - protein, 30 aa, Artificial Sequence
  Description of Artificial Sequence: Synthetic polypeptide
DEGEIATTNPVSSEQYGTISCNLQQSNGNR

SEQ ID NO: 78464 - protein, 35 aa, Artificial Sequence
  Description of Artificial Sequence: Synthetic polypeptide
DEEEIRTTNPVATEQYGVVSVVTNNLNNQQNGQNM

SEQ ID NO: 78465 - protein, 31 aa, Artificial Sequence
  Description of Artificial Sequence: Synthetic polypeptide
DEGEIATTNPVATEQYGSVATALIGGMNDSW

SEQ ID NO: 78466 - protein, 33 aa, Artificial Sequence
  Description of Artificial Sequence: Synthetic polypeptide
TEEEICTTNPVAYEQYGNVSYNNELSQRGNNRQ

SEQ ID NO: 78467 - protein, 32 aa, Artificial Sequence
  Description of Artificial Sequence: Synthetic polypeptide
TEEEIRCTNPIATEAYGSVSCENMLSMRGGNR

SEQ ID NO: 78468 - protein, 31 aa, Artificial Sequence
  Description of Artificial Sequence: Synthetic polypeptide
DEGEIATTNPVATEQYGSVANTNALIGMNDS

SEQ ID NO: 78469 - protein, 32 aa, Artificial Sequence
  Description of Artificial Sequence: Synthetic polypeptide
TEEEIGTTNPVAYEQYGKVSTNELSQEDTGNL

SEQ ID NO: 78470 - protein, 35 aa, Artificial Sequence
  Description of Artificial Sequence: Synthetic polypeptide
DEEEIRTTNPVATEQYGVVSVVTNLNNNQQGQNNM

SEQ ID NO: 78471 - protein, 33 aa, Artificial Sequence
  Description of Artificial Sequence: Synthetic polypeptide
DEEEIRTTNPVATEQYGCVCSTEDQAFGSENQE

SEQ ID NO: 78472 - protein, 33 aa, Artificial Sequence
  Description of Artificial Sequence: Synthetic polypeptide
DEEEIRTTNPVATEQYGCVCSTEDQEAFGSNQA

SEQ ID NO: 78473 - protein, 34 aa, Artificial Sequence
  Description of Artificial Sequence: Synthetic polypeptide
TEEEIKTTNPVATEAYGSVVSTNNLSQQRGGNQP

SEQ ID NO: 78474 - protein, 31 aa, Artificial Sequence
  Description of Artificial Sequence: Synthetic polypeptide
DEAEIATTNPVATEQYGSVASGNLQTADPTD

SEQ ID NO: 78475 - protein, 31 aa, Artificial Sequence
  Description of Artificial Sequence: Synthetic polypeptide
DEGEIATTNPVSTECYGSVSCNEQDREGENG

SEQ ID NO: 78476 - protein, 32 aa, Artificial Sequence
  Description of Artificial Sequence: Synthetic polypeptide
DEGEIATTNPVSTEQWGSVSCINEQDREGENR

SEQ ID NO: 78477 - protein, 28 aa, Artificial Sequence
  Description of Artificial Sequence: Synthetic peptide
TEEEIASVNPVCTEMYGVVSDNLQSGNQ

SEQ ID NO: 78478 - protein, 32 aa, Artificial Sequence
  Description of Artificial Sequence: Synthetic polypeptide
DEEEIRTTNPVATEQYGCVCSTEDQGFNSNQM

SEQ ID NO: 78479 - protein, 28 aa, Artificial Sequence
  Description of Artificial Sequence: Synthetic peptide
TEEEIASVNPVCTEAYGVVSDNLQSGNQ

SEQ ID NO: 78480 - protein, 33 aa, Artificial Sequence
  Description of Artificial Sequence: Synthetic polypeptide
DEEEIRTTNPVATEQYGCVCSTEDQNFGSNTQP

SEQ ID NO: 78481 - protein, 32 aa, Artificial Sequence
  Description of Artificial Sequence: Synthetic polypeptide
DEEEIRTTNPVATEQYGCVCSTEDQNFNSEQF

SEQ ID NO: 78482 - protein, 35 aa, Artificial Sequence
  Description of Artificial Sequence: Synthetic polypeptide
DEEEIRTTNPVATEQYGVVSVVTNNLLNQQGQNNT

SEQ ID NO: 78483 - protein, 31 aa, Artificial Sequence
  Description of Artificial Sequence: Synthetic polypeptide
DEGEIATTNPVATEQYGSVAGTALIHMDNGR

SEQ ID NO: 78484 - protein, 32 aa, Artificial Sequence
  Description of Artificial Sequence: Synthetic polypeptide
DEGEIATTNPVATEQYGSVAANLQDAGPNESM

SEQ ID NO: 78485 - protein, 33 aa, Artificial Sequence
  Description of Artificial Sequence: Synthetic polypeptide
TEEEIRCTNPIATEQYGSTVSCENELSMRGTNR

SEQ ID NO: 78486 - protein, 33 aa, Artificial Sequence
  Description of Artificial Sequence: Synthetic polypeptide
DEEEIRTTNPVATEQYGCVCSSENPQHFGSNQS

SEQ ID NO: 78487 - protein, 31 aa, Artificial Sequence
  Description of Artificial Sequence: Synthetic polypeptide
DEGEIRTTNPVATEQYGCWSTINPLEREVIN

SEQ ID NO: 78488 - protein, 34 aa, Artificial Sequence
  Description of Artificial Sequence: Synthetic polypeptide
DEEEIRTTNPVATEQYGCVCSSENLQFFGSNTQS

SEQ ID NO: 78489 - protein, 32 aa, Artificial Sequence
  Description of Artificial Sequence: Synthetic polypeptide
DEGEIRTTNPVATEQYGCWTSTINPLERENQD

SEQ ID NO: 78490 - protein, 30 aa, Artificial Sequence
  Description of Artificial Sequence: Synthetic polypeptide
DEGEIRTTNPVATEQYGDVSCIEQNAAGDA

SEQ ID NO: 78491 - protein, 30 aa, Artificial Sequence
  Description of Artificial Sequence: Synthetic polypeptide
DEGEIRTTNPVATEQYGIVSCIEQNAAGDA

SEQ ID NO: 78492 - protein, 34 aa, Artificial Sequence
  Description of Artificial Sequence: Synthetic polypeptide
DEGEIRTTNPVATEQYGSACNTVNLLQFREGDHR

SEQ ID NO: 78493 - protein, 32 aa, Artificial Sequence
  Description of Artificial Sequence: Synthetic polypeptide
DEEEIRTTNPVATEQYGCVCSTEEHQHLSNQT

SEQ ID NO: 78494 - protein, 33 aa, Artificial Sequence
  Description of Artificial Sequence: Synthetic polypeptide
DEEEIRTTNPVATEQYGCVCSTEEHQNFGSNTA

SEQ ID NO: 78495 - protein, 32 aa, Artificial Sequence
  Description of Artificial Sequence: Synthetic polypeptide
DEGEIATTNPVATEQYGCVATNLQENQGPERM

SEQ ID NO: 78496 - protein, 31 aa, Artificial Sequence
  Description of Artificial Sequence: Synthetic polypeptide
DEGEIATTNPVATEQYGCVATNLQENGDEHQ

SEQ ID NO: 78497 - protein, 31 aa, Artificial Sequence
  Description of Artificial Sequence: Synthetic polypeptide
DEGEIATTNPVATEQYGCVATNLERGPMQSM

SEQ ID NO: 78498 - protein, 32 aa, Artificial Sequence
  Description of Artificial Sequence: Synthetic polypeptide
DEEEIRTTNPVATEQYGCVCSTEEHQNFGSQV

SEQ ID NO: 78499 - protein, 33 aa, Artificial Sequence
  Description of Artificial Sequence: Synthetic polypeptide
DEGEIRTTNPVATEQYGCVSTVNLENRYDGDQQ

SEQ ID NO: 78500 - protein, 32 aa, Artificial Sequence
  Description of Artificial Sequence: Synthetic polypeptide
DEEEIRTTNPVATEQYGCVCSSELQYFGSEAA

SEQ ID NO: 78501 - protein, 31 aa, Artificial Sequence
  Description of Artificial Sequence: Synthetic polypeptide
DEEEIRTTNPVATEQYGCVCSSELQNNSEQV

SEQ ID NO: 78502 - protein, 30 aa, Artificial Sequence
  Description of Artificial Sequence: Synthetic polypeptide
DEGEIATTNPVATEQYGCVATNLEAAENHN

SEQ ID NO: 78503 - protein, 32 aa, Artificial Sequence
  Description of Artificial Sequence: Synthetic polypeptide
DEGEIRTTNPVATEQYGSCSPDNLQEGDEDQQ

SEQ ID NO: 78504 - protein, 33 aa, Artificial Sequence
  Description of Artificial Sequence: Synthetic polypeptide
DEEEIRTTNPVATEQYGCVCSSELQGFGSNNQA

SEQ ID NO: 78505 - protein, 32 aa, Artificial Sequence
  Description of Artificial Sequence: Synthetic polypeptide
DEEEIRTTNPVATEQYGCVCSTEEHQNGSDAS

SEQ ID NO: 78506 - protein, 32 aa, Artificial Sequence
  Description of Artificial Sequence: Synthetic polypeptide
DEEEIRTTNPVATEQYGCVCSSELQGFGSEQS

SEQ ID NO: 78507 - protein, 32 aa, Artificial Sequence
  Description of Artificial Sequence: Synthetic polypeptide
DEEEIRTTNPVATEQYGCVCSTEEHQNGSEQN

SEQ ID NO: 78508 - protein, 33 aa, Artificial Sequence
  Description of Artificial Sequence: Synthetic polypeptide
DEEEIRTTNPVATEAYGSVVSTGYISQPGGNAN

SEQ ID NO: 78509 - protein, 30 aa, Artificial Sequence
  Description of Artificial Sequence: Synthetic polypeptide
AEEEIRTTNPVATEFYGSVYCETNMNHGDL

SEQ ID NO: 78510 - protein, 33 aa, Artificial Sequence
  Description of Artificial Sequence: Synthetic polypeptide
DEEEIRTTNPVATEAYGSVVITDNHLNGMGSTR

SEQ ID NO: 78511 - protein, 33 aa, Artificial Sequence
  Description of Artificial Sequence: Synthetic polypeptide
DEEEIRTTNPVATEQYGCVCSTEEHQRGSQTQS

SEQ ID NO: 78512 - protein, 32 aa, Artificial Sequence
  Description of Artificial Sequence: Synthetic polypeptide
DEEEIRTTNPVATEQYGVVVGGTNQGEDGGNG

SEQ ID NO: 78513 - protein, 32 aa, Artificial Sequence
  Description of Artificial Sequence: Synthetic polypeptide
DEGEIRTTNPVATEQYGSCWTNAEQEGQDERL

SEQ ID NO: 78514 - protein, 33 aa, Artificial Sequence
  Description of Artificial Sequence: Synthetic polypeptide
TEEEIRCTNPIATEQYGSVVPSENLSMRGGNNR

SEQ ID NO: 78515 - protein, 29 aa, Artificial Sequence
  Description of Artificial Sequence: Synthetic peptide
DEGEIATTNPVSSEQWGIVSCNLQSEGTR

SEQ ID NO: 78516 - protein, 31 aa, Artificial Sequence
  Description of Artificial Sequence: Synthetic polypeptide
AEEEIRTTNPVATEEYGCYCSSGNLQRGSDQ

SEQ ID NO: 78517 - protein, 31 aa, Artificial Sequence
  Description of Artificial Sequence: Synthetic polypeptide
DEAEIATTNPVATEQYGSVATNLEETEGGGH

SEQ ID NO: 78518 - protein, 32 aa, Artificial Sequence
  Description of Artificial Sequence: Synthetic polypeptide
DEGEIRTTNPVATEQFGTSVSTYLLRGGEDHN

SEQ ID NO: 78519 - protein, 33 aa, Artificial Sequence
  Description of Artificial Sequence: Synthetic polypeptide
DEEEIRTTNPVATEQYGCVCSSGALQSFGSNQS

SEQ ID NO: 78520 - protein, 32 aa, Artificial Sequence
  Description of Artificial Sequence: Synthetic polypeptide
DEGEIRTTNPVATEQYGCVSANENQMEGEDRG

SEQ ID NO: 78521 - protein, 33 aa, Artificial Sequence
  Description of Artificial Sequence: Synthetic polypeptide
DEEEIRTTNPVATEQYGCVCSSGALQFFGSNDG

SEQ ID NO: 78522 - protein, 33 aa, Artificial Sequence
  Description of Artificial Sequence: Synthetic polypeptide
DEEEIRTTNPVATEQYGCVCSTEEEQSFGSNQM

SEQ ID NO: 78523 - protein, 32 aa, Artificial Sequence
  Description of Artificial Sequence: Synthetic polypeptide
DEGEIATTNPVATEQYGSCSATENLEADITNR

SEQ ID NO: 78524 - protein, 31 aa, Artificial Sequence
  Description of Artificial Sequence: Synthetic polypeptide
DEGEIATTNPVATEQYGIVSATDLEHEGEDR

SEQ ID NO: 78525 - protein, 33 aa, Artificial Sequence
  Description of Artificial Sequence: Synthetic polypeptide
DEEEIRTTNPVATEQYGCVCSTEEHARFGSNQV

SEQ ID NO: 78526 - protein, 31 aa, Artificial Sequence
  Description of Artificial Sequence: Synthetic polypeptide
DEAEIATTNPVATEQYGSVASNLAQTSGSDE

SEQ ID NO: 78527 - protein, 33 aa, Artificial Sequence
  Description of Artificial Sequence: Synthetic polypeptide
DEEEIRTTNPVATEQYGVVSVTGDPEQNIGGNQ

SEQ ID NO: 78528 - protein, 36 aa, Artificial Sequence
  Description of Artificial Sequence: Synthetic polypeptide
DEEEIRTTNPVATEQYGVVSVSVTNLLLQYGNNEES

SEQ ID NO: 78529 - protein, 32 aa, Artificial Sequence
  Description of Artificial Sequence: Synthetic polypeptide
TEECIRTTNPVAYEQYGQTVSTQNSQRTGGNN

SEQ ID NO: 78530 - protein, 32 aa, Artificial Sequence
  Description of Artificial Sequence: Synthetic polypeptide
TEEEIRCTNPIATEQYGSTVSCENHSMRGGNR

SEQ ID NO: 78531 - protein, 32 aa, Artificial Sequence
  Description of Artificial Sequence: Synthetic polypeptide
DEGEIRTTNPVATEQYGCVSTNNTNFGGDNDM

SEQ ID NO: 78532 - protein, 36 aa, Artificial Sequence
  Description of Artificial Sequence: Synthetic polypeptide
DEEEIRTTNPVATEQYGVVSVSTNNLQQGNNNEQIQ

SEQ ID NO: 78533 - protein, 36 aa, Artificial Sequence
  Description of Artificial Sequence: Synthetic polypeptide
DEEEIRTTNPVATEQYGVVSVSTNNLNQQGNNNNVD

SEQ ID NO: 78534 - protein, 32 aa, Artificial Sequence
  Description of Artificial Sequence: Synthetic polypeptide
TEECIRTTNPVAYEQYGQQVSTGNVSQRGNNN

SEQ ID NO: 78535 - protein, 30 aa, Artificial Sequence
  Description of Artificial Sequence: Synthetic polypeptide
DEAEIATTNPVATEQYGSVATGPPQDGTDS

SEQ ID NO: 78536 - protein, 32 aa, Artificial Sequence
  Description of Artificial Sequence: Synthetic polypeptide
TEECIRTTNPVAYEQYGKVVSATELAQRTVNR

SEQ ID NO: 78537 - protein, 32 aa, Artificial Sequence
  Description of Artificial Sequence: Synthetic polypeptide
DEAEIATTNPVATEQYGSVATNDQRGMALAEA

SEQ ID NO: 78538 - protein, 32 aa, Artificial Sequence
  Description of Artificial Sequence: Synthetic polypeptide
TEECIRTTNPVAYEQYGKVSTINELQRTVNAQ

SEQ ID NO: 78539 - protein, 32 aa, Artificial Sequence
  Description of Artificial Sequence: Synthetic polypeptide
TEECIRTTNPVAYEQYGKVSINELQRTVNQHR

SEQ ID NO: 78540 - protein, 33 aa, Artificial Sequence
  Description of Artificial Sequence: Synthetic polypeptide
DEEEIRTTNPVATEQYGCVCSTEEHNQGFGSNQ

SEQ ID NO: 78541 - protein, 31 aa, Artificial Sequence
  Description of Artificial Sequence: Synthetic polypeptide
TEECIRTTNPVAYEQYGKTVATNLFMVGNDR

SEQ ID NO: 78542 - protein, 32 aa, Artificial Sequence
  Description of Artificial Sequence: Synthetic polypeptide
DEAEIATTNPVATEQYGSVATNLADAGGNMEM

SEQ ID NO: 78543 - protein, 31 aa, Artificial Sequence
  Description of Artificial Sequence: Synthetic polypeptide
DEGEIRTTNPVATEQYGCVSTNNNDIDNTQE

SEQ ID NO: 78544 - protein, 33 aa, Artificial Sequence
  Description of Artificial Sequence: Synthetic polypeptide
DEAEIATTNPVATEQYGSVATNLDQNSNDQTRQ

SEQ ID NO: 78545 - protein, 33 aa, Artificial Sequence
  Description of Artificial Sequence: Synthetic polypeptide
DEEEIRTTNPVATEQYGCVCSTEEHNQRFGSDD

SEQ ID NO: 78546 - protein, 32 aa, Artificial Sequence
  Description of Artificial Sequence: Synthetic polypeptide
DEAEIATTNPVATEQYGSVATGNLQDPGGEGH

SEQ ID NO: 78547 - protein, 33 aa, Artificial Sequence
  Description of Artificial Sequence: Synthetic polypeptide
DEGEIRTTNPVATEQYGSSSTEVTEQQIEGNSR

SEQ ID NO: 78548 - protein, 35 aa, Artificial Sequence
  Description of Artificial Sequence: Synthetic polypeptide
DEEEIRTTNPVATEQYGVVTVSVTENLLQGIGNTE

SEQ ID NO: 78549 - protein, 31 aa, Artificial Sequence
  Description of Artificial Sequence: Synthetic polypeptide
DEGEIATTNPVATEQYGSVATALMIGGMNDA

SEQ ID NO: 78550 - protein, 32 aa, Artificial Sequence
  Description of Artificial Sequence: Synthetic polypeptide
DEAEIATTNPVATEQYGSVAMSNNDQEEGNGQ

SEQ ID NO: 78551 - protein, 32 aa, Artificial Sequence
  Description of Artificial Sequence: Synthetic polypeptide
DEEEIRTTNPVATEQYGCVCSTAHQYFGSQQA

SEQ ID NO: 78552 - protein, 34 aa, Artificial Sequence
  Description of Artificial Sequence: Synthetic polypeptide
AEEEIRTTNPVATEAYGVVSVSVTNLQNQGNNDQ

SEQ ID NO: 78553 - protein, 30 aa, Artificial Sequence
  Description of Artificial Sequence: Synthetic polypeptide
DEAEIATTNPVATEQYGSVAMNLTNANNEM

SEQ ID NO: 78554 - protein, 33 aa, Artificial Sequence
  Description of Artificial Sequence: Synthetic polypeptide
DDEEIRTTNPVATEQWGCVTSNTGLLDQREGTR

SEQ ID NO: 78555 - protein, 31 aa, Artificial Sequence
  Description of Artificial Sequence: Synthetic polypeptide
AEEEIRTTNPVATEEYGCFCSSELQRGSNQG

SEQ ID NO: 78556 - protein, 31 aa, Artificial Sequence
  Description of Artificial Sequence: Synthetic polypeptide
AEEEIRTTNPVATEEYGCICSSNLNQRGSDQ

SEQ ID NO: 78557 - protein, 33 aa, Artificial Sequence
  Description of Artificial Sequence: Synthetic polypeptide
AEEEIRTTNPVATEEYGCIPVCINLSQRGGNNR

SEQ ID NO: 78558 - protein, 33 aa, Artificial Sequence
  Description of Artificial Sequence: Synthetic polypeptide
TEEEIATTNPVATEQYGNVPSVTGLQGTGGNNR

SEQ ID NO: 78559 - protein, 31 aa, Artificial Sequence
  Description of Artificial Sequence: Synthetic polypeptide
DEAEIATTNPVATEQYGSVAMNLQNPMNGDI

SEQ ID NO: 78560 - protein, 33 aa, Artificial Sequence
  Description of Artificial Sequence: Synthetic polypeptide
DEEEIRTTNPVATEQYGCVCSTALQNSGSETQS

SEQ ID NO: 78561 - protein, 32 aa, Artificial Sequence
  Description of Artificial Sequence: Synthetic polypeptide
TEEEIATTNPVATEQYGKVSTNNISQIGGSQR

SEQ ID NO: 78562 - protein, 32 aa, Artificial Sequence
  Description of Artificial Sequence: Synthetic polypeptide
DDEEIRTTNPVATEQWGAVTSVALLQRGLTRD

SEQ ID NO: 78563 - protein, 33 aa, Artificial Sequence
  Description of Artificial Sequence: Synthetic polypeptide
DEEEIRTTNPVATEQYGCVCSTALQYFGSETQS

SEQ ID NO: 78564 - protein, 31 aa, Artificial Sequence
  Description of Artificial Sequence: Synthetic polypeptide
DDEEIRTTNPVATEQWGAQTSVLLQRGPTNE

SEQ ID NO: 78565 - protein, 32 aa, Artificial Sequence
  Description of Artificial Sequence: Synthetic polypeptide
DEAEIATTNPVATEQYGSVAMNLQDQGNNTEH

SEQ ID NO: 78566 - protein, 33 aa, Artificial Sequence
  Description of Artificial Sequence: Synthetic polypeptide
DEEEIRTTNPVATEQYGCVCSSGNLQFFISNQS

SEQ ID NO: 78567 - protein, 32 aa, Artificial Sequence
  Description of Artificial Sequence: Synthetic polypeptide
DEEEIRTTNPVATEQYGCVCSTDLENFNSEQG

SEQ ID NO: 78568 - protein, 32 aa, Artificial Sequence
  Description of Artificial Sequence: Synthetic polypeptide
DEGEIATTNPVAYEQYGQSVSTNDLMQDGIGM

SEQ ID NO: 78569 - protein, 33 aa, Artificial Sequence
  Description of Artificial Sequence: Synthetic polypeptide
DEGEIATTNPVAYEQYGQSVSTNDLMQDMIGDR

SEQ ID NO: 78570 - protein, 34 aa, Artificial Sequence
  Description of Artificial Sequence: Synthetic polypeptide
DEEEIRTTNPVATEQYGCVCSTEAHNQRFGSNQS

SEQ ID NO: 78571 - protein, 34 aa, Artificial Sequence
  Description of Artificial Sequence: Synthetic polypeptide
DEEEIRTTNPVATEQYGCVCSTEALQEFFGSNQT

SEQ ID NO: 78572 - protein, 30 aa, Artificial Sequence
  Description of Artificial Sequence: Synthetic polypeptide
DEGEIATTNPVAYEQYGSTTATNLQGENDS

SEQ ID NO: 78573 - protein, 32 aa, Artificial Sequence
  Description of Artificial Sequence: Synthetic polypeptide
TEEEIATTNPVATEPYGSTVSTNQSQRSQSRS

SEQ ID NO: 78574 - protein, 34 aa, Artificial Sequence
  Description of Artificial Sequence: Synthetic polypeptide
DEEEIRTTNPVATEQYGCVCSSGNHQNFGSNTRL

SEQ ID NO: 78575 - protein, 34 aa, Artificial Sequence
  Description of Artificial Sequence: Synthetic polypeptide
DEEEIRTTNPVATEQYGCVCSTEDDLQRFGSEQS

SEQ ID NO: 78576 - protein, 30 aa, Artificial Sequence
  Description of Artificial Sequence: Synthetic polypeptide
DDEEIRTTNPVATEQWGCVTSTLHQHGSEA

SEQ ID NO: 78577 - protein, 32 aa, Artificial Sequence
  Description of Artificial Sequence: Synthetic polypeptide
DEEEIRTTNPVATEQYGCVCSTAHQSSGSEQD

SEQ ID NO: 78578 - protein, 31 aa, Artificial Sequence
  Description of Artificial Sequence: Synthetic polypeptide
DEAEIATTNPVATEQYGSVANHLQENPGENH

SEQ ID NO: 78579 - protein, 31 aa, Artificial Sequence
  Description of Artificial Sequence: Synthetic polypeptide
DEGEIATTNPVATEQYGSVSATDLEHEGEDL

SEQ ID NO: 78580 - protein, 32 aa, Artificial Sequence
  Description of Artificial Sequence: Synthetic polypeptide
DEEEIRTTNPVATEQYGCVCSTAHQNFNSNQM

SEQ ID NO: 78581 - protein, 33 aa, Artificial Sequence
  Description of Artificial Sequence: Synthetic polypeptide
DEEEIRTTNPVATEQYGCVCSSNPEQFFGSNQS

SEQ ID NO: 78582 - protein, 32 aa, Artificial Sequence
  Description of Artificial Sequence: Synthetic polypeptide
DEEEIRTTNPVATEQYGCVCSSNPQFFGSEAQ

SEQ ID NO: 78583 - protein, 31 aa, Artificial Sequence
  Description of Artificial Sequence: Synthetic polypeptide
TEEEIATTNPVATEQYGSVSQNMISQIGGST

SEQ ID NO: 78584 - protein, 33 aa, Artificial Sequence
  Description of Artificial Sequence: Synthetic polypeptide
TEEEIATTNPVATEQYGSVSCTNNISQKGGSRG

SEQ ID NO: 78585 - protein, 32 aa, Artificial Sequence
  Description of Artificial Sequence: Synthetic polypeptide
TEEEIATTNPVATEQYGSVSCTNNISQIGGPV

SEQ ID NO: 78586 - protein, 32 aa, Artificial Sequence
  Description of Artificial Sequence: Synthetic polypeptide
TEEEIATTNPVATEQYGSVSCTNMISQIGGSP

SEQ ID NO: 78587 - protein, 32 aa, Artificial Sequence
  Description of Artificial Sequence: Synthetic polypeptide
DEEEIRTTNPVATEQYGCVCSSPLQHFGSEQI

SEQ ID NO: 78588 - protein, 33 aa, Artificial Sequence
  Description of Artificial Sequence: Synthetic polypeptide
DEGEIATTNPVATEQYGSVCAAANNLQEAGENR

SEQ ID NO: 78589 - protein, 31 aa, Artificial Sequence
  Description of Artificial Sequence: Synthetic polypeptide
DDEEIRTTNPVATEQWGCVTSTEDQRGSQQQ

SEQ ID NO: 78590 - protein, 32 aa, Artificial Sequence
  Description of Artificial Sequence: Synthetic polypeptide
DEEEIRTTNPVATEQYGCVCSSYLQNFNSDQS

SEQ ID NO: 78591 - protein, 33 aa, Artificial Sequence
  Description of Artificial Sequence: Synthetic polypeptide
DEEEIRTTNPVATEQYGCVCSSNLNQNFGSEQE

SEQ ID NO: 78592 - protein, 34 aa, Artificial Sequence
  Description of Artificial Sequence: Synthetic polypeptide
AEEEIRTTNPVATEAYGVVSVSVVTNLQNGTNTQ

SEQ ID NO: 78593 - protein, 32 aa, Artificial Sequence
  Description of Artificial Sequence: Synthetic polypeptide
TEEEIATTNPVATEQYGYVSCTNNISQGGGSR

SEQ ID NO: 78594 - protein, 31 aa, Artificial Sequence
  Description of Artificial Sequence: Synthetic polypeptide
DEGEIATTNPVAYEQYGSVAANDQRGPNDQL

SEQ ID NO: 78595 - protein, 31 aa, Artificial Sequence
  Description of Artificial Sequence: Synthetic polypeptide
DEGEIATTNPVATEQYGSVATPNLDQGTPES

SEQ ID NO: 78596 - protein, 32 aa, Artificial Sequence
  Description of Artificial Sequence: Synthetic polypeptide
DEEEIRTTNPVATEQYGCVCSTADHINFGSNQ

SEQ ID NO: 78597 - protein, 32 aa, Artificial Sequence
  Description of Artificial Sequence: Synthetic polypeptide
TEEEIATTNPVATERYGSVSCTNNISQPGGSR

SEQ ID NO: 78598 - protein, 34 aa, Artificial Sequence
  Description of Artificial Sequence: Synthetic polypeptide
DEEEIRTTNPVATEQYGCVCSTADLQNFGSNTQS

SEQ ID NO: 78599 - protein, 30 aa, Artificial Sequence
  Description of Artificial Sequence: Synthetic polypeptide
TEEEIATTNPVAYEAYGSVPSLNLQFGGEE

SEQ ID NO: 78600 - protein, 31 aa, Artificial Sequence
  Description of Artificial Sequence: Synthetic polypeptide
DEGEIATTNPVATEQYGSVATNNDRNGTPEE

SEQ ID NO: 78601 - protein, 33 aa, Artificial Sequence
  Description of Artificial Sequence: Synthetic polypeptide
DEGEIATTNPVATEQYGSVCATNLTAMPGENRE

SEQ ID NO: 78602 - protein, 33 aa, Artificial Sequence
  Description of Artificial Sequence: Synthetic polypeptide
DEEEIRTTNPVATEQYGCVCSTAHNQGFGSNQE

SEQ ID NO: 78603 - protein, 34 aa, Artificial Sequence
  Description of Artificial Sequence: Synthetic polypeptide
AEEEIRTTNPVATEAYGVVSVSVTNLQQQNGNQD

SEQ ID NO: 78604 - protein, 32 aa, Artificial Sequence
  Description of Artificial Sequence: Synthetic polypeptide
DDEEIRTTNPVATEQWGCVTSTELQNGSENAA

SEQ ID NO: 78605 - protein, 31 aa, Artificial Sequence
  Description of Artificial Sequence: Synthetic polypeptide
DEEEIRTTNPVATEQYGVVSWEHQNFGSEQN

SEQ ID NO: 78606 - protein, 32 aa, Artificial Sequence
  Description of Artificial Sequence: Synthetic polypeptide
DEEEIRTTNPVATEQYGCVCSTAHQAFGSQQS

SEQ ID NO: 78607 - protein, 33 aa, Artificial Sequence
  Description of Artificial Sequence: Synthetic polypeptide
DEEEIRTTNPVATEQYGCVCSSNDLQNFGSDDE

SEQ ID NO: 78608 - protein, 30 aa, Artificial Sequence
  Description of Artificial Sequence: Synthetic polypeptide
DDEEIRTTNPVATEQWGCVTSTEPQNGSEA

SEQ ID NO: 78609 - protein, 32 aa, Artificial Sequence
  Description of Artificial Sequence: Synthetic polypeptide
DEEEIRTTNPVATEQYGCVCSSNHQYFNSEQA

SEQ ID NO: 78610 - protein, 33 aa, Artificial Sequence
  Description of Artificial Sequence: Synthetic polypeptide
TEEEIATTNPVATENYGSVVACTNLDQRGGSRY

SEQ ID NO: 78611 - protein, 32 aa, Artificial Sequence
  Description of Artificial Sequence: Synthetic polypeptide
DEEEIRTTNPVATEQYGCVCSSGNHQGGSDDS

SEQ ID NO: 78612 - protein, 29 aa, Artificial Sequence
  Description of Artificial Sequence: Synthetic peptide
TEEEIASVNPVSTEQYGVVSWNLQDSGNQ

SEQ ID NO: 78613 - protein, 30 aa, Artificial Sequence
  Description of Artificial Sequence: Synthetic polypeptide
DEGEIATTNPVATEQYGSVATNLEAAEMEN

SEQ ID NO: 78614 - protein, 32 aa, Artificial Sequence
  Description of Artificial Sequence: Synthetic polypeptide
DEGEIATTNPVAYEQYGSVATNLQPRPQDQTR

SEQ ID NO: 78615 - protein, 33 aa, Artificial Sequence
  Description of Artificial Sequence: Synthetic polypeptide
AEEEIRTTNPVATEAYGVVSVSVSNNLQNGNQT

SEQ ID NO: 78616 - protein, 33 aa, Artificial Sequence
  Description of Artificial Sequence: Synthetic polypeptide
DEEEIRTTNPVATEQYGCVCSTEDHQNFGSNVA

SEQ ID NO: 78617 - protein, 32 aa, Artificial Sequence
  Description of Artificial Sequence: Synthetic polypeptide
DEGEIATTNPVAYEQYGSVATNLQRPQEEGRW

SEQ ID NO: 78618 - protein, 31 aa, Artificial Sequence
  Description of Artificial Sequence: Synthetic polypeptide
TEEEIATTNPVAYEQYGSVPSLNGLQHGGEE

SEQ ID NO: 78619 - protein, 28 aa, Artificial Sequence
  Description of Artificial Sequence: Synthetic peptide
TEEEIASVNPVCTEQYGVVSDNLVSGNQ

SEQ ID NO: 78620 - protein, 33 aa, Artificial Sequence
  Description of Artificial Sequence: Synthetic polypeptide
DEEEIRTTNPVATEQYGCVCSTEDHQRFTSNQS

SEQ ID NO: 78621 - protein, 31 aa, Artificial Sequence
  Description of Artificial Sequence: Synthetic polypeptide
DEGEIATTNPVAYEQYGSVATNLQRQDQTAQ

SEQ ID NO: 78622 - protein, 31 aa, Artificial Sequence
  Description of Artificial Sequence: Synthetic polypeptide
DEGEIATTNPVAYEQYGSVATNLQRQEQTFE

SEQ ID NO: 78623 - protein, 31 aa, Artificial Sequence
  Description of Artificial Sequence: Synthetic polypeptide
TEEEIATTNPVAYEQYGSVPSQLNLQSGGEE

SEQ ID NO: 78624 - protein, 33 aa, Artificial Sequence
  Description of Artificial Sequence: Synthetic polypeptide
AEEEIRTTNPVATEAYGVVSVSVNNLQNGTNQQ

SEQ ID NO: 78625 - protein, 32 aa, Artificial Sequence
  Description of Artificial Sequence: Synthetic polypeptide
AEEEIRTTNPVATEEYGCSCSSGNLQRFGSEQ

SEQ ID NO: 78626 - protein, 32 aa, Artificial Sequence
  Description of Artificial Sequence: Synthetic polypeptide
DEGEIATTNPVAYEQYGSVATNLQGAPDGSRN

SEQ ID NO: 78627 - protein, 31 aa, Artificial Sequence
  Description of Artificial Sequence: Synthetic polypeptide
DEGEIATTNPVAYEQYGSVCAMNLARDGDRD

SEQ ID NO: 78628 - protein, 34 aa, Artificial Sequence
  Description of Artificial Sequence: Synthetic polypeptide
DEEEIRTTNPVATEQYGVVTSSTPNIGQGIEGND

SEQ ID NO: 78629 - protein, 33 aa, Artificial Sequence
  Description of Artificial Sequence: Synthetic polypeptide
DEEEIRTTNPVATEQYGVVTSTMEFNQGNGNGN

SEQ ID NO: 78630 - protein, 34 aa, Artificial Sequence
  Description of Artificial Sequence: Synthetic polypeptide
TEEEIATTNPVAYEQYGSVSTANELSQNGENYRQ

SEQ ID NO: 78631 - protein, 35 aa, Artificial Sequence
  Description of Artificial Sequence: Synthetic polypeptide
DEEEIRTTNPVATEQYGVVTSTMNLSQDEGQGNGG

SEQ ID NO: 78632 - protein, 33 aa, Artificial Sequence
  Description of Artificial Sequence: Synthetic polypeptide
DEGEIATTNPVAYEQYGVSVSANDLEQRMGIGR

SEQ ID NO: 78633 - protein, 31 aa, Artificial Sequence
  Description of Artificial Sequence: Synthetic polypeptide
TEEEIATTNPVAYERYGSVSTGDNHQGNGNP

SEQ ID NO: 78634 - protein, 29 aa, Artificial Sequence
  Description of Artificial Sequence: Synthetic peptide
TEEEIASVNPVCTEQYGVVSDNLQSGGNQ

SEQ ID NO: 78635 - protein, 30 aa, Artificial Sequence
  Description of Artificial Sequence: Synthetic polypeptide
DEAEIATTNPVATEQYGSVAMNETNRNNED

SEQ ID NO: 78636 - protein, 29 aa, Artificial Sequence
  Description of Artificial Sequence: Synthetic peptide
TEEEIASVNPVCTEQYGVVSDNLQASGNQ

SEQ ID NO: 78637 - protein, 33 aa, Artificial Sequence
  Description of Artificial Sequence: Synthetic polypeptide
DEEEIRTTNPVATEQYGVVTSTNLSGEANNGGE

SEQ ID NO: 78638 - protein, 34 aa, Artificial Sequence
  Description of Artificial Sequence: Synthetic polypeptide
DEEEIRTTNPVATEQYGVVTSTNLSGEAQGNGGT

SEQ ID NO: 78639 - protein, 35 aa, Artificial Sequence
  Description of Artificial Sequence: Synthetic polypeptide
DEEEIRTTNPVATEQYGVVTVSSTNLLQYGTNDEQ

SEQ ID NO: 78640 - protein, 31 aa, Artificial Sequence
  Description of Artificial Sequence: Synthetic polypeptide
DEAEIATTNPVATEQYGSVAMHEQDRDGNTE

SEQ ID NO: 78641 - protein, 33 aa, Artificial Sequence
  Description of Artificial Sequence: Synthetic polypeptide
DEGEIATTNPVAYEQYGSVCSTNDIQDNGDNRK

SEQ ID NO: 78642 - protein, 34 aa, Artificial Sequence
  Description of Artificial Sequence: Synthetic polypeptide
DEEEIRTTNPVATEQYGCVCSTEDLQERFGSEQF

SEQ ID NO: 78643 - protein, 30 aa, Artificial Sequence
  Description of Artificial Sequence: Synthetic polypeptide
DDEEIRTTNPVATEQWGDVMSVLLVRGTTE

SEQ ID NO: 78644 - protein, 32 aa, Artificial Sequence
  Description of Artificial Sequence: Synthetic polypeptide
DEEEIRTTNPVATEQYGCVCSSGELQFFISNQ

SEQ ID NO: 78645 - protein, 32 aa, Artificial Sequence
  Description of Artificial Sequence: Synthetic polypeptide
DEEEIRTTNPVATEQYGCVCSTEDDQFGSDQT

SEQ ID NO: 78646 - protein, 30 aa, Artificial Sequence
  Description of Artificial Sequence: Synthetic polypeptide
TEEEIASVNPVSTEQYGVVSVVTNLQQGNQ

SEQ ID NO: 78647 - protein, 32 aa, Artificial Sequence
  Description of Artificial Sequence: Synthetic polypeptide
DEEEIRTTNPVATEQYGCVCSTEDDQNFGSQQ

SEQ ID NO: 78648 - protein, 35 aa, Artificial Sequence
  Description of Artificial Sequence: Synthetic polypeptide
DEEEIRTTNPVATEQYGVVSVVVTNLEQYGNNEES

SEQ ID NO: 78649 - protein, 30 aa, Artificial Sequence
  Description of Artificial Sequence: Synthetic polypeptide
TEEEIASVNPVSTEQYGVVSTDNLQSGGNQ

SEQ ID NO: 78650 - protein, 31 aa, Artificial Sequence
  Description of Artificial Sequence: Synthetic polypeptide
DEGEIATTNPVAYEQYGSVAATNLAAGNNDD

SEQ ID NO: 78651 - protein, 31 aa, Artificial Sequence
  Description of Artificial Sequence: Synthetic polypeptide
DEGEIATTNPVAYEQYGSVAITNLQVTENQE

SEQ ID NO: 78652 - protein, 32 aa, Artificial Sequence
  Description of Artificial Sequence: Synthetic polypeptide
DEEEIRTTNPVATEQYGCVCSSGNHQENGSEQ

SEQ ID NO: 78653 - protein, 29 aa, Artificial Sequence
  Description of Artificial Sequence: Synthetic peptide
TEEEIASVNPVSTEQYGVVSDNLQSGNEQ

SEQ ID NO: 78654 - protein, 30 aa, Artificial Sequence
  Description of Artificial Sequence: Synthetic polypeptide
DDEEIRTTNPVATEQWGCVTSTLHQRNSQQ

SEQ ID NO: 78655 - protein, 30 aa, Artificial Sequence
  Description of Artificial Sequence: Synthetic polypeptide
DEGEIATTNPVAYEQYGSVAMNLARDGDEM

SEQ ID NO: 78656 - protein, 34 aa, Artificial Sequence
  Description of Artificial Sequence: Synthetic polypeptide
AEEEIRTTNPVATEAYGVVSVSVTNLQLNGNNTQ

SEQ ID NO: 78657 - protein, 33 aa, Artificial Sequence
  Description of Artificial Sequence: Synthetic polypeptide
DEEEIRTTNPVATEQYGVVTFTNDQGQGNEGNI

SEQ ID NO: 78658 - protein, 32 aa, Artificial Sequence
  Description of Artificial Sequence: Synthetic polypeptide
DEEEIRTTNPVATEQYGCVCSTEDHQFGSDAS

SEQ ID NO: 78659 - protein, 29 aa, Artificial Sequence
  Description of Artificial Sequence: Synthetic peptide
TEEEIASVNPVSTEQYGTVVSVNLQQGNG

SEQ ID NO: 78660 - protein, 31 aa, Artificial Sequence
  Description of Artificial Sequence: Synthetic polypeptide
TEEEIATTNPVAYEQYGNVSVTTLSQGGTDR

SEQ ID NO: 78661 - protein, 30 aa, Artificial Sequence
  Description of Artificial Sequence: Synthetic polypeptide
DEGEIATTNPVAYEQYGSVATNGTAEIGNE

SEQ ID NO: 78662 - protein, 31 aa, Artificial Sequence
  Description of Artificial Sequence: Synthetic polypeptide
DEGEIATTNPVAYEQYGSVATNLADAPGERH

SEQ ID NO: 78663 - protein, 32 aa, Artificial Sequence
  Description of Artificial Sequence: Synthetic polypeptide
TEEEIATTNPVAYEQYGNVSVTTMLSQNGTNR

SEQ ID NO: 78664 - protein, 28 aa, Artificial Sequence
  Description of Artificial Sequence: Synthetic peptide
TEEEIASVNPVCTERYGVVSDNLQSGNQ

SEQ ID NO: 78665 - protein, 32 aa, Artificial Sequence
  Description of Artificial Sequence: Synthetic polypeptide
DEGEIATTNPVAYEQYGSVATNLQANPVGERP

SEQ ID NO: 78666 - protein, 34 aa, Artificial Sequence
  Description of Artificial Sequence: Synthetic polypeptide
AEEEIRTTNPVATEAYGVVSVSVTNLGQNGNNQD

SEQ ID NO: 78667 - protein, 32 aa, Artificial Sequence
  Description of Artificial Sequence: Synthetic polypeptide
TEEEIATTNPVAYEQYGNVVSVTPLSQGGNRD

SEQ ID NO: 78668 - protein, 32 aa, Artificial Sequence
  Description of Artificial Sequence: Synthetic polypeptide
DEGEIATTNPVAYEQYGSVATNLQDADGNENH

SEQ ID NO: 78669 - protein, 32 aa, Artificial Sequence
  Description of Artificial Sequence: Synthetic polypeptide
DEGEIATTNPVAYEQYGSVATNLQDAGDNANM

SEQ ID NO: 78670 - protein, 30 aa, Artificial Sequence
  Description of Artificial Sequence: Synthetic polypeptide
DEAEIATTNPVATEQYGSVAMNGNGNPPVR

SEQ ID NO: 78671 - protein, 36 aa, Artificial Sequence
  Description of Artificial Sequence: Synthetic polypeptide
DEEEIRTTNPVATEQYGVVSVVVSTNLQAGNQTNQD

SEQ ID NO: 78672 - protein, 31 aa, Artificial Sequence
  Description of Artificial Sequence: Synthetic polypeptide
DEGEIATTNPVAYEQYGSVATNLQDDPGGTH

SEQ ID NO: 78673 - protein, 31 aa, Artificial Sequence
  Description of Artificial Sequence: Synthetic polypeptide
DEGEIATTNPVAYEQYGSVANTNLQTADNPY

SEQ ID NO: 78674 - protein, 32 aa, Artificial Sequence
  Description of Artificial Sequence: Synthetic polypeptide
AEEEIRTTNPVATEGYGCTGSINGLGQDGNTR

SEQ ID NO: 78675 - protein, 29 aa, Artificial Sequence
  Description of Artificial Sequence: Synthetic peptide
DEGEIATTNPVATEQYGCVATHLARPDDD

SEQ ID NO: 78676 - protein, 34 aa, Artificial Sequence
  Description of Artificial Sequence: Synthetic polypeptide
DEGEIRTTNPVATEQYGSSSTNTEQQIEGNSMRM

SEQ ID NO: 78677 - protein, 33 aa, Artificial Sequence
  Description of Artificial Sequence: Synthetic polypeptide
TEEEIRTTNPVATEAYGSVVSITYLSQPGGNEQ

SEQ ID NO: 78678 - protein, 32 aa, Artificial Sequence
  Description of Artificial Sequence: Synthetic polypeptide
TEEEIRTTNPVATEAYGSVVSTVYLSTPGGNQ

SEQ ID NO: 78679 - protein, 31 aa, Artificial Sequence
  Description of Artificial Sequence: Synthetic polypeptide
TEEEIRTTNPVATEAYGSVVSTYGSQPGGEQ

SEQ ID NO: 78680 - protein, 33 aa, Artificial Sequence
  Description of Artificial Sequence: Synthetic polypeptide
DEGEIRTTNPVATEQYGSVWTLLEQGGGNDEDH

SEQ ID NO: 78681 - protein, 32 aa, Artificial Sequence
  Description of Artificial Sequence: Synthetic polypeptide
TEEEIRTTNPVATEAYGSVVSTYLSQPNGGDA

SEQ ID NO: 78682 - protein, 32 aa, Artificial Sequence
  Description of Artificial Sequence: Synthetic polypeptide
TEEEIRTTNPVATEAYGSVVSYTYLSQPGGTQ

SEQ ID NO: 78683 - protein, 32 aa, Artificial Sequence
  Description of Artificial Sequence: Synthetic polypeptide
TEEEIRTTNPVATEAYGSVVYSTYQSQPGGNQ

SEQ ID NO: 78684 - protein, 33 aa, Artificial Sequence
  Description of Artificial Sequence: Synthetic polypeptide
TEEEIRTTNPVATECYGATVSTNMPSQHGGNQR

SEQ ID NO: 78685 - protein, 33 aa, Artificial Sequence
  Description of Artificial Sequence: Synthetic polypeptide
TEEEIRTTNPVATECYGAVPSTNMHSQHGGNQR

SEQ ID NO: 78686 - protein, 33 aa, Artificial Sequence
  Description of Artificial Sequence: Synthetic polypeptide
DEEEIRTTNPVATEQYGCVCSNWGNHQNGSNQY

SEQ ID NO: 78687 - protein, 30 aa, Artificial Sequence
  Description of Artificial Sequence: Synthetic polypeptide
DEAEIATTNPVATEQYGSVAIGNDTNRNDR

SEQ ID NO: 78688 - protein, 32 aa, Artificial Sequence
  Description of Artificial Sequence: Synthetic polypeptide
DEEEIRTTNPVATEQYGCVCSTEHQNMGSEAI

SEQ ID NO: 78689 - protein, 32 aa, Artificial Sequence
  Description of Artificial Sequence: Synthetic polypeptide
DEEEIRTTNPVATEQYGCVCSTEHQRFTSDQI

SEQ ID NO: 78690 - protein, 32 aa, Artificial Sequence
  Description of Artificial Sequence: Synthetic polypeptide
DEGEIRTTNPVATEQYGSWSLDNMLQRDSQGP

SEQ ID NO: 78691 - protein, 34 aa, Artificial Sequence
  Description of Artificial Sequence: Synthetic polypeptide
TEDEIRTTNPVATEQYGSVVPSCTNDQHTGQNYR

SEQ ID NO: 78692 - protein, 32 aa, Artificial Sequence
  Description of Artificial Sequence: Synthetic polypeptide
TEDEIRTTNPVATEQYGSVVACTAELQNGGPR

SEQ ID NO: 78693 - protein, 34 aa, Artificial Sequence
  Description of Artificial Sequence: Synthetic polypeptide
DEGEIRTTNPVATEQYGSYISVTHNLEQRGEQED

SEQ ID NO: 78694 - protein, 31 aa, Artificial Sequence
  Description of Artificial Sequence: Synthetic polypeptide
DEGEIRTTNPVATEQYGSYSTLVIGGVDEDR

SEQ ID NO: 78695 - protein, 32 aa, Artificial Sequence
  Description of Artificial Sequence: Synthetic polypeptide
DEEEIRTTNPVATEQYGCVCSTEHTYSGSNQP

SEQ ID NO: 78696 - protein, 32 aa, Artificial Sequence
  Description of Artificial Sequence: Synthetic polypeptide
DEEEIRTTNPVATEQYGCVCSTELAFFNSNAE

SEQ ID NO: 78697 - protein, 31 aa, Artificial Sequence
  Description of Artificial Sequence: Synthetic polypeptide
DEEEIRTTNPVATEQYGCVCSTELAHNSEQA

SEQ ID NO: 78698 - protein, 32 aa, Artificial Sequence
  Description of Artificial Sequence: Synthetic polypeptide
DEEEIRTTNPVATEQYGCVCSTELANFNSDQS

SEQ ID NO: 78699 - protein, 34 aa, Artificial Sequence
  Description of Artificial Sequence: Synthetic polypeptide
DEEEIRTTNPVATEAYGSVSTVTNLTQGSNNNTD

SEQ ID NO: 78700 - protein, 32 aa, Artificial Sequence
  Description of Artificial Sequence: Synthetic polypeptide
DEEEIRTTNPVATEQYGCVCSTELAYFNSNQM

SEQ ID NO: 78701 - protein, 33 aa, Artificial Sequence
  Description of Artificial Sequence: Synthetic polypeptide
TEEEIRTTNPVATEFYGSVSTSNEGQGGGENGD

SEQ ID NO: 78702 - protein, 33 aa, Artificial Sequence
  Description of Artificial Sequence: Synthetic polypeptide
DEEEIRTTNPVATEQYGCVCSTELDQNFNSEQS

SEQ ID NO: 78703 - protein, 34 aa, Artificial Sequence
  Description of Artificial Sequence: Synthetic polypeptide
TEDEIRTTNPVATEQYGSVSCTNEDAQHTGQNNR

SEQ ID NO: 78704 - protein, 33 aa, Artificial Sequence
  Description of Artificial Sequence: Synthetic polypeptide
DEEEIRTTNPVATEQYGCVCSTEHQNFPSNFRS

SEQ ID NO: 78705 - protein, 32 aa, Artificial Sequence
  Description of Artificial Sequence: Synthetic polypeptide
DEGEIATTNPCSTEQYGSVSSTTNLPNSGMNR

SEQ ID NO: 78706 - protein, 33 aa, Artificial Sequence
  Description of Artificial Sequence: Synthetic polypeptide
DEGEIRTTNPVATEQYGSVWPTLLEQGGNNEDH

SEQ ID NO: 78707 - protein, 31 aa, Artificial Sequence
  Description of Artificial Sequence: Synthetic polypeptide
TEEEIRTTNPVATEAYGSVVSAYLSMPGGNQ

SEQ ID NO: 78708 - protein, 32 aa, Artificial Sequence
  Description of Artificial Sequence: Synthetic polypeptide
DEAEIATTNPVATEQYGSVAITNDQRPGTDHV

SEQ ID NO: 78709 - protein, 31 aa, Artificial Sequence
  Description of Artificial Sequence: Synthetic polypeptide
DEGEIATTNPVATEPYGSVCATNDTRGGDNL

SEQ ID NO: 78710 - protein, 32 aa, Artificial Sequence
  Description of Artificial Sequence: Synthetic polypeptide
DEGEIRTTNPVATEQYGSVSVMLDLDQQGDDQ

SEQ ID NO: 78711 - protein, 33 aa, Artificial Sequence
  Description of Artificial Sequence: Synthetic polypeptide
DEEEIRTTNPVATEQYGCVCSTEHQGFGSDNQI

SEQ ID NO: 78712 - protein, 32 aa, Artificial Sequence
  Description of Artificial Sequence: Synthetic polypeptide
DEEEIRTTNPVATEQYGCVCSSALQNFGSEQS

SEQ ID NO: 78713 - protein, 33 aa, Artificial Sequence
  Description of Artificial Sequence: Synthetic polypeptide
TEEAEIRTTNPVAYEQWGSVSTNLQGDTGGNNA

SEQ ID NO: 78714 - protein, 32 aa, Artificial Sequence
  Description of Artificial Sequence: Synthetic polypeptide
DEGEIRTTNPVATEQYGSVSVNLENPHGEDDG

SEQ ID NO: 78715 - protein, 32 aa, Artificial Sequence
  Description of Artificial Sequence: Synthetic polypeptide
DEGEIATTNPVATECYGSVSCINEQDREGENG

SEQ ID NO: 78716 - protein, 32 aa, Artificial Sequence
  Description of Artificial Sequence: Synthetic polypeptide
TEEAEIRTTNPVAYEQWGSVSTNEQDGGGEQR

SEQ ID NO: 78717 - protein, 33 aa, Artificial Sequence
  Description of Artificial Sequence: Synthetic polypeptide
DEGEIRTTNPVATEQYGSVSVSFNLEQRVQDIV

SEQ ID NO: 78718 - protein, 31 aa, Artificial Sequence
  Description of Artificial Sequence: Synthetic polypeptide
DEEEIRTTNPVATEQYGYCGTGLNDDLGNEH

SEQ ID NO: 78719 - protein, 33 aa, Artificial Sequence
  Description of Artificial Sequence: Synthetic polypeptide
DEEEIRTTNPVATEQYGYCQSTANEIQEQEGTR

SEQ ID NO: 78720 - protein, 33 aa, Artificial Sequence
  Description of Artificial Sequence: Synthetic polypeptide
DEEEIRTTNPVATEQYGCVCSNWNLQNFNSNQM

SEQ ID NO: 78721 - protein, 29 aa, Artificial Sequence
  Description of Artificial Sequence: Synthetic peptide
DEGEIATTNPCSTEQYGIVSCNLQDHGEL

SEQ ID NO: 78722 - protein, 32 aa, Artificial Sequence
  Description of Artificial Sequence: Synthetic polypeptide
DEEEIRTTNPVATEQYGCVCSTEHQGSNSNQS

SEQ ID NO: 78723 - protein, 33 aa, Artificial Sequence
  Description of Artificial Sequence: Synthetic polypeptide
DEEEIRTTNPVATEQYGCVCSTEHQHFGSENQD

SEQ ID NO: 78724 - protein, 35 aa, Artificial Sequence
  Description of Artificial Sequence: Synthetic polypeptide
DEGEIRTTNPVATEQYGSVSVTNDLTQIEGEEDGR

SEQ ID NO: 78725 - protein, 32 aa, Artificial Sequence
  Description of Artificial Sequence: Synthetic polypeptide
TEEEIRTTNPVATEAYGQSVVQTYLSQPGGNQ

SEQ ID NO: 78726 - protein, 32 aa, Artificial Sequence
  Description of Artificial Sequence: Synthetic polypeptide
DEEEIRTTNPVATEQYGCVCSTEHQHMNSDQE

SEQ ID NO: 78727 - protein, 33 aa, Artificial Sequence
  Description of Artificial Sequence: Synthetic polypeptide
TEEEIRTTNPVATEAYGSTVSVTYLSQPGGNAP

SEQ ID NO: 78728 - protein, 32 aa, Artificial Sequence
  Description of Artificial Sequence: Synthetic polypeptide
DEEEIRTTNPVATEQYGYFTISPSNELVRGEE

SEQ ID NO: 78729 - protein, 33 aa, Artificial Sequence
  Description of Artificial Sequence: Synthetic polypeptide
DEGEIRTTNPVATEQYGSVSWTWPLQDTNEEQG

SEQ ID NO: 78730 - protein, 31 aa, Artificial Sequence
  Description of Artificial Sequence: Synthetic polypeptide
DEGEIRTTNPVATEQYGSVTTMGMQEIGTQE

SEQ ID NO: 78731 - protein, 33 aa, Artificial Sequence
  Description of Artificial Sequence: Synthetic polypeptide
DDEEIRSTNPVATEQYGSVCSTGNLQEYSGSQQ

SEQ ID NO: 78732 - protein, 33 aa, Artificial Sequence
  Description of Artificial Sequence: Synthetic polypeptide
DEEEIRTTNPVATEQYGCVCSTEHQNFGSDNVS

SEQ ID NO: 78733 - protein, 33 aa, Artificial Sequence
  Description of Artificial Sequence: Synthetic polypeptide
DEEEIRTTNPVATEQYGCVCSTEHQNFGSNNQE

SEQ ID NO: 78734 - protein, 33 aa, Artificial Sequence
  Description of Artificial Sequence: Synthetic polypeptide
DEEEIRTTNPVATEQYGCVCSTEHQNFGSQNQI

SEQ ID NO: 78735 - protein, 30 aa, Artificial Sequence
  Description of Artificial Sequence: Synthetic polypeptide
DEGEIRTTNPVATEQYGSVTVWMMQEENDE

SEQ ID NO: 78736 - protein, 32 aa, Artificial Sequence
  Description of Artificial Sequence: Synthetic polypeptide
DEEEIRTTNPVATEQYGCVCSTEHQHFGSDVF

SEQ ID NO: 78737 - protein, 33 aa, Artificial Sequence
  Description of Artificial Sequence: Synthetic polypeptide
DEEEIRTTNPVATEQYGCVCSTELEGFGSNNQG

SEQ ID NO: 78738 - protein, 34 aa, Artificial Sequence
  Description of Artificial Sequence: Synthetic polypeptide
TEEEIRTTNPVATEHWGVLVPSYTNLSQRTGDNR

SEQ ID NO: 78739 - protein, 33 aa, Artificial Sequence
  Description of Artificial Sequence: Synthetic polypeptide
TEEEIRTTNPVATEHYGISTVPACTNELQRGSE

SEQ ID NO: 78740 - protein, 33 aa, Artificial Sequence
  Description of Artificial Sequence: Synthetic polypeptide
DEGEIRTTNPVAYEPYGSTVPSTGGSQNRGTNR

SEQ ID NO: 78741 - protein, 32 aa, Artificial Sequence
  Description of Artificial Sequence: Synthetic polypeptide
DEAEIATTNPVATEQYGSVAGTGLQDGDTDRE

SEQ ID NO: 78742 - protein, 34 aa, Artificial Sequence
  Description of Artificial Sequence: Synthetic polypeptide
DEEEIRTTNPVATEQYGCVCSTELNQERFNSNQS

SEQ ID NO: 78743 - protein, 34 aa, Artificial Sequence
  Description of Artificial Sequence: Synthetic polypeptide
TECEIRTTNPVAYEPYGSLVSTGNLSQDRGGSNR

SEQ ID NO: 78744 - protein, 33 aa, Artificial Sequence
  Description of Artificial Sequence: Synthetic polypeptide
DEEEIRTTNPVATEQYGCVCSTELNQGFGSEQE

SEQ ID NO: 78745 - protein, 33 aa, Artificial Sequence
  Description of Artificial Sequence: Synthetic polypeptide
DEEEIRTTNPVATEQYGCVCSTELNQHFGSDQA

SEQ ID NO: 78746 - protein, 33 aa, Artificial Sequence
  Description of Artificial Sequence: Synthetic polypeptide
DEEEIRTTNPVATEQYGCVCSTELNQHFGSDQS

SEQ ID NO: 78747 - protein, 33 aa, Artificial Sequence
  Description of Artificial Sequence: Synthetic polypeptide
DEGEIRTTNPVAYEPYGSTVPSTPTSQNRGSNR

SEQ ID NO: 78748 - protein, 33 aa, Artificial Sequence
  Description of Artificial Sequence: Synthetic polypeptide
DEEEIRTTNPVATEQYGCVCSTELNQNFGSQAA

SEQ ID NO: 78749 - protein, 33 aa, Artificial Sequence
  Description of Artificial Sequence: Synthetic polypeptide
DEEEIRTTNPVATEQYGCVCSTELNQNFNSNII

SEQ ID NO: 78750 - protein, 32 aa, Artificial Sequence
  Description of Artificial Sequence: Synthetic polypeptide
TEAEIRTTNSVAYDQYGSVSCTNMLSQRGGDR

SEQ ID NO: 78751 - protein, 33 aa, Artificial Sequence
  Description of Artificial Sequence: Synthetic polypeptide
DEEEIRTTNPVATEQYGCVCSTELNQYFGSDDY

SEQ ID NO: 78752 - protein, 30 aa, Artificial Sequence
  Description of Artificial Sequence: Synthetic polypeptide
TEAEIRTTNPVAYEPYGSISCTTLSERPNR

SEQ ID NO: 78753 - protein, 31 aa, Artificial Sequence
  Description of Artificial Sequence: Synthetic polypeptide
DEAEIATTNPVATEQYGSVAGTGPPNRGNEL

SEQ ID NO: 78754 - protein, 33 aa, Artificial Sequence
  Description of Artificial Sequence: Synthetic polypeptide
AEEEIRTTNPVATEQYGCVCSNTELQENGSNQA

SEQ ID NO: 78755 - protein, 34 aa, Artificial Sequence
  Description of Artificial Sequence: Synthetic polypeptide
DEEEIRTTNPVATEQYGCVCSTELQEGFGSENQS

SEQ ID NO: 78756 - protein, 32 aa, Artificial Sequence
  Description of Artificial Sequence: Synthetic polypeptide
AEEEIRTTNPVATEQYGCVCSNTELQNGSDQE

SEQ ID NO: 78757 - protein, 30 aa, Artificial Sequence
  Description of Artificial Sequence: Synthetic polypeptide
DEGEIRTTNPVAYEQWGSVCTAGIREENNR

SEQ ID NO: 78758 - protein, 31 aa, Artificial Sequence
  Description of Artificial Sequence: Synthetic polypeptide
DEGEIRTTNPVAYEQWGSVCTALIDREMNDR

SEQ ID NO: 78759 - protein, 33 aa, Artificial Sequence
  Description of Artificial Sequence: Synthetic polypeptide
DEEEIRTTNPVATEQYGCVCSTELQENFNSEQA

SEQ ID NO: 78760 - protein, 33 aa, Artificial Sequence
  Description of Artificial Sequence: Synthetic polypeptide
DEEEIRTTNPVATEQYGCVCSTELQENFNSQQM

SEQ ID NO: 78761 - protein, 34 aa, Artificial Sequence
  Description of Artificial Sequence: Synthetic polypeptide
DEEEIRTTNPVATEQYGCVCSTELQENSGSENQQ

SEQ ID NO: 78762 - protein, 33 aa, Artificial Sequence
  Description of Artificial Sequence: Synthetic polypeptide
DEEEIRTTNPVATEQYGCVCSTELQENSNSDQQ

SEQ ID NO: 78763 - protein, 34 aa, Artificial Sequence
  Description of Artificial Sequence: Synthetic polypeptide
TEAEIRTTNPVATEQYGISTVSTNLSQRVANNDS

SEQ ID NO: 78764 - protein, 31 aa, Artificial Sequence
  Description of Artificial Sequence: Synthetic polypeptide
DEGEIRTTNPVAYEQWGSVCTALIREMNNDR

SEQ ID NO: 78765 - protein, 33 aa, Artificial Sequence
  Description of Artificial Sequence: Synthetic polypeptide
DEEEIRTTNPVATEQYGCVCSTELQESFGSQQA

SEQ ID NO: 78766 - protein, 34 aa, Artificial Sequence
  Description of Artificial Sequence: Synthetic polypeptide
DEEEIRTTNPVATEQYGCVCSTELQEYFGSQNQS

SEQ ID NO: 78767 - protein, 31 aa, Artificial Sequence
  Description of Artificial Sequence: Synthetic polypeptide
DEGEIRTTNPVAYEQWGSVCTGLIREMNMDR

SEQ ID NO: 78768 - protein, 33 aa, Artificial Sequence
  Description of Artificial Sequence: Synthetic polypeptide
DEEEIRTTNPVATEQYGCVCSTELQEGFGSDQF

SEQ ID NO: 78769 - protein, 30 aa, Artificial Sequence
  Description of Artificial Sequence: Synthetic polypeptide
DEGEIATTNPVATEQWGCVATNALSREMNS

SEQ ID NO: 78770 - protein, 32 aa, Artificial Sequence
  Description of Artificial Sequence: Synthetic polypeptide
DDEEIRSTNPVATEQYGCSCSTMNDQNFGSNQ

SEQ ID NO: 78771 - protein, 32 aa, Artificial Sequence
  Description of Artificial Sequence: Synthetic polypeptide
DDEEIRSTNPVATEQYGCSCSTNDQEHFGSNQ

SEQ ID NO: 78772 - protein, 33 aa, Artificial Sequence
  Description of Artificial Sequence: Synthetic polypeptide
DEEEIRTTNPVATEQYGCVCSTELEGFGSNTQS

SEQ ID NO: 78773 - protein, 33 aa, Artificial Sequence
  Description of Artificial Sequence: Synthetic polypeptide
TEDEIRTTNPVATEQYGSVHCTNDSQHTGGNSR

SEQ ID NO: 78774 - protein, 34 aa, Artificial Sequence
  Description of Artificial Sequence: Synthetic polypeptide
AEEEIRTTNPVATEAYGSVSTTNTNLDQNQGTNL

SEQ ID NO: 78775 - protein, 32 aa, Artificial Sequence
  Description of Artificial Sequence: Synthetic polypeptide
DEEEIRTTNPVATEQYGCVCSTELENFGSQVA

SEQ ID NO: 78776 - protein, 33 aa, Artificial Sequence
  Description of Artificial Sequence: Synthetic polypeptide
TEEEIRTTNPVATEHYGTVSNNGHSQRGGNNRP

SEQ ID NO: 78777 - protein, 34 aa, Artificial Sequence
  Description of Artificial Sequence: Synthetic polypeptide
DEEEIRTTNPVATEQYGCVCSTELEQFFGSNNQI

SEQ ID NO: 78778 - protein, 34 aa, Artificial Sequence
  Description of Artificial Sequence: Synthetic polypeptide
TEDEIRTTNPVATEQYGSTVPSTNDSQHTGQNPR

SEQ ID NO: 78779 - protein, 33 aa, Artificial Sequence
  Description of Artificial Sequence: Synthetic polypeptide
TEDEIRTTNPVATEQWGSTVSTNDSQHTGQNQR

SEQ ID NO: 78780 - protein, 33 aa, Artificial Sequence
  Description of Artificial Sequence: Synthetic polypeptide
DEEEIRTTNPVATEQYGCVCSTELEYFGSDNDG

SEQ ID NO: 78781 - protein, 33 aa, Artificial Sequence
  Description of Artificial Sequence: Synthetic polypeptide
DEGEIRTTNPVATEQYGVVSVLDLQREGNEDGQ

SEQ ID NO: 78782 - protein, 28 aa, Artificial Sequence
  Description of Artificial Sequence: Synthetic peptide
DEGEIATTNPCSSEQYGIVSCNLQSGTD

SEQ ID NO: 78783 - protein, 32 aa, Artificial Sequence
  Description of Artificial Sequence: Synthetic polypeptide
TEDEIRTTNPVATEAYGSVVSTYLSQPGGNQC

SEQ ID NO: 78784 - protein, 34 aa, Artificial Sequence
  Description of Artificial Sequence: Synthetic polypeptide
DEEEIRTTNPVATEQYGCVCSTELHQGFGSNNQA

SEQ ID NO: 78785 - protein, 31 aa, Artificial Sequence
  Description of Artificial Sequence: Synthetic polypeptide
DEGEIATTNPCATECWGIVSCNLQDREGENR

SEQ ID NO: 78786 - protein, 33 aa, Artificial Sequence
  Description of Artificial Sequence: Synthetic polypeptide
DEEEIRTTNPVATEQYGCVCSTELHQNFGSDQS

SEQ ID NO: 78787 - protein, 33 aa, Artificial Sequence
  Description of Artificial Sequence: Synthetic polypeptide
DEEEIRTTNPVATEQYGCVCSTELHQNFGSQDM

SEQ ID NO: 78788 - protein, 34 aa, Artificial Sequence
  Description of Artificial Sequence: Synthetic polypeptide
TEDEIRTTNPVATEAYGSVVSCLGNLAQRGDNYR

SEQ ID NO: 78789 - protein, 31 aa, Artificial Sequence
  Description of Artificial Sequence: Synthetic polypeptide
DEGEIRTTNPVATYGYGSVSNTLNLTEGTDM

SEQ ID NO: 78790 - protein, 31 aa, Artificial Sequence
  Description of Artificial Sequence: Synthetic polypeptide
DEGEIATTNPCATEQYGSVSTNLEDHEGEDL

SEQ ID NO: 78791 - protein, 33 aa, Artificial Sequence
  Description of Artificial Sequence: Synthetic polypeptide
TEDEIRTTNPVATEAYGSTVSTNDSQHTGQNTR

SEQ ID NO: 78792 - protein, 32 aa, Artificial Sequence
  Description of Artificial Sequence: Synthetic polypeptide
DEEEIRTTNPVATEQYGCVCSTELIHFGSEQS

SEQ ID NO: 78793 - protein, 30 aa, Artificial Sequence
  Description of Artificial Sequence: Synthetic polypeptide
DEGEIATTNPCATEQYGSVSCNLEDHGEDL

SEQ ID NO: 78794 - protein, 32 aa, Artificial Sequence
  Description of Artificial Sequence: Synthetic polypeptide
DEGEIRTTNPVATYHYGSVSMTLNLTQEGTDM

SEQ ID NO: 78795 - protein, 30 aa, Artificial Sequence
  Description of Artificial Sequence: Synthetic polypeptide
DEGEIATTNPCATEQYGDVSENLQNSAGTA

SEQ ID NO: 78796 - protein, 31 aa, Artificial Sequence
  Description of Artificial Sequence: Synthetic polypeptide
DDEEIRSTNPVATEQYGCSCSTNPQYGSDQS

SEQ ID NO: 78797 - protein, 32 aa, Artificial Sequence
  Description of Artificial Sequence: Synthetic polypeptide
DEEEIRTTNPVATEQYGCVCSTELIHSNSNQL

SEQ ID NO: 78798 - protein, 31 aa, Artificial Sequence
  Description of Artificial Sequence: Synthetic polypeptide
DEGEIRTTNPVATYWYGSVSDTLNLTEGTDQ

SEQ ID NO: 78799 - protein, 33 aa, Artificial Sequence
  Description of Artificial Sequence: Synthetic polypeptide
DEEEIRTTNPVATEQYGCVCSTELNENFGSNFQ

SEQ ID NO: 78800 - protein, 33 aa, Artificial Sequence
  Description of Artificial Sequence: Synthetic polypeptide
DEEEIRTTNPVATEQYGCVCSTELHQNFGSDTD

SEQ ID NO: 78801 - protein, 32 aa, Artificial Sequence
  Description of Artificial Sequence: Synthetic polypeptide
DEGEIRTTNPVATEQYGSVSVELNQMEGESQN

SEQ ID NO: 78802 - protein, 33 aa, Artificial Sequence
  Description of Artificial Sequence: Synthetic polypeptide
DEEEIRTTNPVATEQYGCVCSTEHQFFGSENQS

SEQ ID NO: 78803 - protein, 32 aa, Artificial Sequence
  Description of Artificial Sequence: Synthetic polypeptide
DEGEIATTNPVATEQWGSVAITNLQNGENTEG

SEQ ID NO: 78804 - protein, 32 aa, Artificial Sequence
  Description of Artificial Sequence: Synthetic polypeptide
DEEEIRTTNPVATEQYGCVCSSEHQNFGSNTQ

SEQ ID NO: 78805 - protein, 33 aa, Artificial Sequence
  Description of Artificial Sequence: Synthetic polypeptide
DEGEIRTTNPVATEQYGSVNSTPTNLQHNIEDQ

SEQ ID NO: 78806 - protein, 31 aa, Artificial Sequence
  Description of Artificial Sequence: Synthetic polypeptide
DEEEIRTTNPVATEQYGCVCSSEHQNFGSDT

SEQ ID NO: 78807 - protein, 32 aa, Artificial Sequence
  Description of Artificial Sequence: Synthetic polypeptide
DEEEIRTTNPVATEQYGCVCSSEHQHSGSENQ

SEQ ID NO: 78808 - protein, 32 aa, Artificial Sequence
  Description of Artificial Sequence: Synthetic polypeptide
DEEEIRTTNPVATEQYGCVCSSEHQHGSNTQS

SEQ ID NO: 78809 - protein, 33 aa, Artificial Sequence
  Description of Artificial Sequence: Synthetic polypeptide
DEEEIRTTNPVATEQYGVVVTGTNFGQEGGGNE

SEQ ID NO: 78810 - protein, 32 aa, Artificial Sequence
  Description of Artificial Sequence: Synthetic polypeptide
TEEEIRCTNPIAYEQYGSVVSCNELSMRGNNR

SEQ ID NO: 78811 - protein, 31 aa, Artificial Sequence
  Description of Artificial Sequence: Synthetic polypeptide
TEEEIRCTNPIAYEQYGSVVSENELSMGGNR

SEQ ID NO: 78812 - protein, 35 aa, Artificial Sequence
  Description of Artificial Sequence: Synthetic polypeptide
DEGEIRTTNPVATEQYGSVPSCTNEHSQERDMSNR

SEQ ID NO: 78813 - protein, 31 aa, Artificial Sequence
  Description of Artificial Sequence: Synthetic polypeptide
DDEEIRTTNPVATDQYGSVITNGVGNNGNND

SEQ ID NO: 78814 - protein, 31 aa, Artificial Sequence
  Description of Artificial Sequence: Synthetic polypeptide
DDEEIRTTNPVATDQYGSVITNGNGNGNNDT

SEQ ID NO: 78815 - protein, 31 aa, Artificial Sequence
  Description of Artificial Sequence: Synthetic polypeptide
DEEEIRTTNPVATEQYGCVCSTEHANGSDQE

SEQ ID NO: 78816 - protein, 31 aa, Artificial Sequence
  Description of Artificial Sequence: Synthetic polypeptide
DEGEIRTTNPVATEQYGSVPTYAIIRFENQE

SEQ ID NO: 78817 - protein, 31 aa, Artificial Sequence
  Description of Artificial Sequence: Synthetic polypeptide
TEECIRTTNPVATEQYGCVCSTNLANLSNAS

SEQ ID NO: 78818 - protein, 33 aa, Artificial Sequence
  Description of Artificial Sequence: Synthetic polypeptide
DEGEIRTTNPVATEQYGSVQCTADSIRPVGNNR

SEQ ID NO: 78819 - protein, 32 aa, Artificial Sequence
  Description of Artificial Sequence: Synthetic polypeptide
TEEEIRCTNPVATEQYGKVVSVNQSDRGGNNR

SEQ ID NO: 78820 - protein, 30 aa, Artificial Sequence
  Description of Artificial Sequence: Synthetic polypeptide
TEEEIRPTNPIATEQYGAVCEMNGMRGNDR

SEQ ID NO: 78821 - protein, 31 aa, Artificial Sequence
  Description of Artificial Sequence: Synthetic polypeptide
TEECIRCTNPVAYEQYGSVVSCQNFSQRGNE

SEQ ID NO: 78822 - protein, 32 aa, Artificial Sequence
  Description of Artificial Sequence: Synthetic polypeptide
DEGEIRTTNPVATEQYGSVQTYALIRFENQQE

SEQ ID NO: 78823 - protein, 31 aa, Artificial Sequence
  Description of Artificial Sequence: Synthetic polypeptide
TEECIRCTNPVAYEQYGSVVSCANFQRGGNL

SEQ ID NO: 78824 - protein, 32 aa, Artificial Sequence
  Description of Artificial Sequence: Synthetic polypeptide
DEGEIRTTNPVATEQYGSVQTYDLIRFENQED

SEQ ID NO: 78825 - protein, 32 aa, Artificial Sequence
  Description of Artificial Sequence: Synthetic polypeptide
DEGEIRTTNPVATEQYGSVQTYFDSIRFENQR

SEQ ID NO: 78826 - protein, 31 aa, Artificial Sequence
  Description of Artificial Sequence: Synthetic polypeptide
DEGEIATTNPVATEQYGCVAATNLADPGNSM

SEQ ID NO: 78827 - protein, 32 aa, Artificial Sequence
  Description of Artificial Sequence: Synthetic polypeptide
TEEEIRSTNPVATEQWGESVSTNFAVERGNGL

SEQ ID NO: 78828 - protein, 32 aa, Artificial Sequence
  Description of Artificial Sequence: Synthetic polypeptide
TEEEIRSTNPVATEQYGSVVSVNQSDVGGNNR

SEQ ID NO: 78829 - protein, 33 aa, Artificial Sequence
  Description of Artificial Sequence: Synthetic polypeptide
DEGEIRTTNPVATEQYGSVSDANDSQLGQENGN

SEQ ID NO: 78830 - protein, 32 aa, Artificial Sequence
  Description of Artificial Sequence: Synthetic polypeptide
TEEEIRSTNPVAYEAYGIVSATNELSQRGGNL

SEQ ID NO: 78831 - protein, 33 aa, Artificial Sequence
  Description of Artificial Sequence: Synthetic polypeptide
AEEEIRTTNPVATEIYGSVSTTNNNNQEAGNTE

SEQ ID NO: 78832 - protein, 32 aa, Artificial Sequence
  Description of Artificial Sequence: Synthetic polypeptide
DDEEIRTTNPVATDQYGSVISTQNGVGNGNND

SEQ ID NO: 78833 - protein, 32 aa, Artificial Sequence
  Description of Artificial Sequence: Synthetic polypeptide
TEECIRCTNPVATEQYGSVSWNLFERAGSNNQ

SEQ ID NO: 78834 - protein, 31 aa, Artificial Sequence
  Description of Artificial Sequence: Synthetic polypeptide
TEECIRTTNPVATEQYGCVCSTNLAYFLSDR

SEQ ID NO: 78835 - protein, 33 aa, Artificial Sequence
  Description of Artificial Sequence: Synthetic polypeptide
DEGEIRTTNPVATEQYGSVGVMVNLEQHGNEDQ

SEQ ID NO: 78836 - protein, 33 aa, Artificial Sequence
  Description of Artificial Sequence: Synthetic polypeptide
DEGEIRTTNPVATEQYGSSSTNTNQQIEGNSML

SEQ ID NO: 78837 - protein, 33 aa, Artificial Sequence
  Description of Artificial Sequence: Synthetic polypeptide
DEEEIRTTNPVATEQYGCVCSTEEHQYFGSNQN

SEQ ID NO: 78838 - protein, 33 aa, Artificial Sequence
  Description of Artificial Sequence: Synthetic polypeptide
DEEEIRTTNPVATEQYGCVCSTEEHQYFGSNVS

SEQ ID NO: 78839 - protein, 29 aa, Artificial Sequence
  Description of Artificial Sequence: Synthetic peptide
DEGEIATTNPVATEQYGCVATALIGMNDS

SEQ ID NO: 78840 - protein, 33 aa, Artificial Sequence
  Description of Artificial Sequence: Synthetic polypeptide
DEGEIRTTNPVATEQYGSVAHTMNDESQTGVRN

SEQ ID NO: 78841 - protein, 33 aa, Artificial Sequence
  Description of Artificial Sequence: Synthetic polypeptide
DDEEIRTTNPVATDQYGSVSTNNGVEQGNGNDN

SEQ ID NO: 78842 - protein, 33 aa, Artificial Sequence
  Description of Artificial Sequence: Synthetic polypeptide
TEECIRTTNPVATEQYGQSVPTLNALSQQGGDR

SEQ ID NO: 78843 - protein, 33 aa, Artificial Sequence
  Description of Artificial Sequence: Synthetic polypeptide
TEECIRTTNPVATEQYGQSVPSLNALSQTQGPR

SEQ ID NO: 78844 - protein, 32 aa, Artificial Sequence
  Description of Artificial Sequence: Synthetic polypeptide
TEEEIRCTNPIAYEQYGISVSENELMRVGNNR

SEQ ID NO: 78845 - protein, 33 aa, Artificial Sequence
  Description of Artificial Sequence: Synthetic polypeptide
DEEEIRTTNPVATEQYGCVCSTEELEYFGSNDG

SEQ ID NO: 78846 - protein, 34 aa, Artificial Sequence
  Description of Artificial Sequence: Synthetic polypeptide
DEEEIRTTNPVATEQYGCVCSTEELFQFFGSNQI

SEQ ID NO: 78847 - protein, 32 aa, Artificial Sequence
  Description of Artificial Sequence: Synthetic polypeptide
DEEEIRTTNPVATEQYGCVCSSELHQGFGSEQ

SEQ ID NO: 78848 - protein, 33 aa, Artificial Sequence
  Description of Artificial Sequence: Synthetic polypeptide
DEEEIRTTNPVATEQYGCVCSTEELHQGFGSDQ

SEQ ID NO: 78849 - protein, 32 aa, Artificial Sequence
  Description of Artificial Sequence: Synthetic polypeptide
TEEEIRCTNPIAYEQYGSVSENMLSMRTGGNR

SEQ ID NO: 78850 - protein, 34 aa, Artificial Sequence
  Description of Artificial Sequence: Synthetic polypeptide
DEEEIRTTNPVATEQYGCVCSTEELNQRFGSDQT

SEQ ID NO: 78851 - protein, 33 aa, Artificial Sequence
  Description of Artificial Sequence: Synthetic polypeptide
DEEEIRTTNPVATEQYGCVCSTEELQYFGSDQY

SEQ ID NO: 78852 - protein, 33 aa, Artificial Sequence
  Description of Artificial Sequence: Synthetic polypeptide
DEEEIRTTNPVATEQYGCVCSTEELQYFISNTQ

SEQ ID NO: 78853 - protein, 33 aa, Artificial Sequence
  Description of Artificial Sequence: Synthetic polypeptide
DEEEIRTTNPVATEQYGCVCSTEELQYSNSNQA

SEQ ID NO: 78854 - protein, 33 aa, Artificial Sequence
  Description of Artificial Sequence: Synthetic polypeptide
TEECIRTTNPVATEQYGQSVPHLNALSAQGGNR

SEQ ID NO: 78855 - protein, 32 aa, Artificial Sequence
  Description of Artificial Sequence: Synthetic polypeptide
DEEEIRTTNPVATEQYGCVCSSELENFGSNNQ

SEQ ID NO: 78856 - protein, 31 aa, Artificial Sequence
  Description of Artificial Sequence: Synthetic polypeptide
TEECIRTTNPVATEQYGCVTSTNLTNFLSNQ

SEQ ID NO: 78857 - protein, 32 aa, Artificial Sequence
  Description of Artificial Sequence: Synthetic polypeptide
DEGEIRTTNPVATEQYGSVDTYANLITFENQE

SEQ ID NO: 78858 - protein, 30 aa, Artificial Sequence
  Description of Artificial Sequence: Synthetic polypeptide
TEECIRTTNPVATEQYGCVSTNTAYFLSNQ

SEQ ID NO: 78859 - protein, 33 aa, Artificial Sequence
  Description of Artificial Sequence: Synthetic polypeptide
DEEEIRTTNPVATEQYGCVCSTEEPQHGSENQG

SEQ ID NO: 78860 - protein, 33 aa, Artificial Sequence
  Description of Artificial Sequence: Synthetic polypeptide
DEEEIRTTNPVATEQYGCVCSTEEPQRSGSEAS

SEQ ID NO: 78861 - protein, 33 aa, Artificial Sequence
  Description of Artificial Sequence: Synthetic polypeptide
DDEEIRTTNPVATDQYGSVSTENGVEQGNGNGD

SEQ ID NO: 78862 - protein, 31 aa, Artificial Sequence
  Description of Artificial Sequence: Synthetic polypeptide
TEEEIRCTNPIAYEQYGSVSENELMRGGNND

SEQ ID NO: 78863 - protein, 31 aa, Artificial Sequence
  Description of Artificial Sequence: Synthetic polypeptide
TEEEIRCTNPIAYEQYGSVSENLSMLGGSNR

SEQ ID NO: 78864 - protein, 32 aa, Artificial Sequence
  Description of Artificial Sequence: Synthetic polypeptide
DEGEIRTTNPVATEQYGSVCSMVNSIPGQDNQ

SEQ ID NO: 78865 - protein, 31 aa, Artificial Sequence
  Description of Artificial Sequence: Synthetic polypeptide
DEEEIRTTNPVATEAYGCSCSTNEQNNSEFA

SEQ ID NO: 78866 - protein, 32 aa, Artificial Sequence
  Description of Artificial Sequence: Synthetic polypeptide
TEEEIRSTNPVAYEAYGSVSATNELSQNGGNN

SEQ ID NO: 78867 - protein, 30 aa, Artificial Sequence
  Description of Artificial Sequence: Synthetic polypeptide
TEEEIRTTNPAATEQYGSVPTDLANGQGET

SEQ ID NO: 78868 - protein, 31 aa, Artificial Sequence
  Description of Artificial Sequence: Synthetic polypeptide
DEGEIATTNPVATEQWGSVSENLQNHDDNAE

SEQ ID NO: 78869 - protein, 31 aa, Artificial Sequence
  Description of Artificial Sequence: Synthetic polypeptide
DEAEIATTNPVATEQYGSVAITNLTMGGPAF

SEQ ID NO: 78870 - protein, 31 aa, Artificial Sequence
  Description of Artificial Sequence: Synthetic polypeptide
DEAEIATTNPVATEQYGSVAITNLTMGGEHA

SEQ ID NO: 78871 - protein, 31 aa, Artificial Sequence
  Description of Artificial Sequence: Synthetic polypeptide
TEECIATVNPVATEAYGSVSCDNLSERTGNR

SEQ ID NO: 78872 - protein, 30 aa, Artificial Sequence
  Description of Artificial Sequence: Synthetic polypeptide
TEECIATTNPVAYEQYGTVSWTNDSGGDNR

SEQ ID NO: 78873 - protein, 33 aa, Artificial Sequence
  Description of Artificial Sequence: Synthetic polypeptide
DEEEIRTTNPVATEQYGCVCSTEHQEGFGSNFA

SEQ ID NO: 78874 - protein, 31 aa, Artificial Sequence
  Description of Artificial Sequence: Synthetic polypeptide
DEGEIATTNPVATEQWGSVATNLETGDNPQT

SEQ ID NO: 78875 - protein, 33 aa, Artificial Sequence
  Description of Artificial Sequence: Synthetic polypeptide
DEGEIRTTNPVATEQYGSVSTPNDNGEGNSEQP

SEQ ID NO: 78876 - protein, 33 aa, Artificial Sequence
  Description of Artificial Sequence: Synthetic polypeptide
DEEEIRTTNPVATEQYGCVCSTEHQEGSNSQQQ

SEQ ID NO: 78877 - protein, 31 aa, Artificial Sequence
  Description of Artificial Sequence: Synthetic polypeptide
TEEEIRTTNPVATEAWGSVVSTYLSQPGGLV

SEQ ID NO: 78878 - protein, 35 aa, Artificial Sequence
  Description of Artificial Sequence: Synthetic polypeptide
TEEEIRTTNPVATEAYGCSSVSCTNLQRPGGNNQS

SEQ ID NO: 78879 - protein, 33 aa, Artificial Sequence
  Description of Artificial Sequence: Synthetic polypeptide
DEEEIRTTNPVATEQYGCVCSTEHQEIFGSNQS

SEQ ID NO: 78880 - protein, 31 aa, Artificial Sequence
  Description of Artificial Sequence: Synthetic polypeptide
TEECIATTNPVATEQYGSVSWNEDLGLQNNR

SEQ ID NO: 78881 - protein, 31 aa, Artificial Sequence
  Description of Artificial Sequence: Synthetic polypeptide
TEECIATVNPVATEEYGCVSHDNLQERGGNR

SEQ ID NO: 78882 - protein, 33 aa, Artificial Sequence
  Description of Artificial Sequence: Synthetic polypeptide
DEAEIATTNPVATEQYGSVAITNLEQVGDNPAA

SEQ ID NO: 78883 - protein, 32 aa, Artificial Sequence
  Description of Artificial Sequence: Synthetic polypeptide
DEAEIATTNPVATEQYGSVAITNLENRGDTLA

SEQ ID NO: 78884 - protein, 33 aa, Artificial Sequence
  Description of Artificial Sequence: Synthetic polypeptide
DEGEIRTTNPVATEQYGSVSTTTNMLERESDQS

SEQ ID NO: 78885 - protein, 33 aa, Artificial Sequence
  Description of Artificial Sequence: Synthetic polypeptide
DEGEIRTTNPVATEQYGSVSTWDNSSEEGQNDL

SEQ ID NO: 78886 - protein, 33 aa, Artificial Sequence
  Description of Artificial Sequence: Synthetic polypeptide
TEEAINTTNPVAYEQYGSTVPSCTANLGRGGNR

SEQ ID NO: 78887 - protein, 32 aa, Artificial Sequence
  Description of Artificial Sequence: Synthetic polypeptide
DEEEIRTTNPVATEQYGCVCSTEHQENNSQQT

SEQ ID NO: 78888 - protein, 32 aa, Artificial Sequence
  Description of Artificial Sequence: Synthetic polypeptide
TEEEIRTTNPVATEAYGISTVCTYLSQPGGNA

SEQ ID NO: 78889 - protein, 33 aa, Artificial Sequence
  Description of Artificial Sequence: Synthetic polypeptide
DEEEIRTTNPVATEQYGCVCSTEHQERFTSNNQ

SEQ ID NO: 78890 - protein, 31 aa, Artificial Sequence
  Description of Artificial Sequence: Synthetic polypeptide
DEGEIATTNPVATEQWGSVAMNLQEAGNDPE

SEQ ID NO: 78891 - protein, 33 aa, Artificial Sequence
  Description of Artificial Sequence: Synthetic polypeptide
DDEEIRSTNPVATEQYGSVSPWNELQARNGSQE

SEQ ID NO: 78892 - protein, 32 aa, Artificial Sequence
  Description of Artificial Sequence: Synthetic polypeptide
TEEAICTTNPVATEQYGSVSTLNLSPELQNDR

SEQ ID NO: 78893 - protein, 32 aa, Artificial Sequence
  Description of Artificial Sequence: Synthetic polypeptide
TEEAEIRTTNPVAYEQWGSVTTNLQGDAGNNM

SEQ ID NO: 78894 - protein, 32 aa, Artificial Sequence
  Description of Artificial Sequence: Synthetic polypeptide
DEEEIRTTNPVATEQYGCVCSTEHQEYNSNAT

SEQ ID NO: 78895 - protein, 32 aa, Artificial Sequence
  Description of Artificial Sequence: Synthetic polypeptide
DEEEIRTTNPVATEQYGCVCSTEHQFFGSDTQ

SEQ ID NO: 78896 - protein, 32 aa, Artificial Sequence
  Description of Artificial Sequence: Synthetic polypeptide
DEGEIRTTNPVATEQYGSVSTTNDEQESQEDQ

SEQ ID NO: 78897 - protein, 31 aa, Artificial Sequence
  Description of Artificial Sequence: Synthetic polypeptide
TEEEIRSTNPVAYEQYGHVSVNQSDRGGNNR

SEQ ID NO: 78898 - protein, 33 aa, Artificial Sequence
  Description of Artificial Sequence: Synthetic polypeptide
TEEEIRTTNPVATEAWGCVQSYTNLSQRTEDNR

SEQ ID NO: 78899 - protein, 33 aa, Artificial Sequence
  Description of Artificial Sequence: Synthetic polypeptide
DEEEIRTTNPVATEQYGCVCSTEHNQRSGSEQS

SEQ ID NO: 78900 - protein, 33 aa, Artificial Sequence
  Description of Artificial Sequence: Synthetic polypeptide
DEGEIRTTNPVATEQYGSVSPTDLIERFGEQQS

SEQ ID NO: 78901 - protein, 32 aa, Artificial Sequence
  Description of Artificial Sequence: Synthetic polypeptide
TEECIRCTNPVATEQYGSVPSLNEFSQRGGNL

SEQ ID NO: 78902 - protein, 31 aa, Artificial Sequence
  Description of Artificial Sequence: Synthetic polypeptide
TEECIRCTNPVATEQYGSVAWNLMERGSNQQ

SEQ ID NO: 78903 - protein, 34 aa, Artificial Sequence
  Description of Artificial Sequence: Synthetic polypeptide
DEGEIRTTNPVATEQYGSVSPTDNGVDLINSNQR

SEQ ID NO: 78904 - protein, 34 aa, Artificial Sequence
  Description of Artificial Sequence: Synthetic polypeptide
TEEEIRTTNPCATEQWGVVPSYTNLSQRTGDNYR

SEQ ID NO: 78905 - protein, 33 aa, Artificial Sequence
  Description of Artificial Sequence: Synthetic polypeptide
TEEEIRTTNPCATEQYGSVSWTDNQQDRQANDY

SEQ ID NO: 78906 - protein, 31 aa, Artificial Sequence
  Description of Artificial Sequence: Synthetic polypeptide
DEGEIATTNPVATEQYGCVAATNLADGNNES

SEQ ID NO: 78907 - protein, 32 aa, Artificial Sequence
  Description of Artificial Sequence: Synthetic polypeptide
DEGEIRTTNPVATEQYGSVSSLDDDRGLNEHN

SEQ ID NO: 78908 - protein, 35 aa, Artificial Sequence
  Description of Artificial Sequence: Synthetic polypeptide
DEEEIRTTNPVATEQYGVVYSKTNDVQVREPDNDR

SEQ ID NO: 78909 - protein, 33 aa, Artificial Sequence
  Description of Artificial Sequence: Synthetic polypeptide
DEGEIRTTNPVATEQYGSVSSTDSNEAFRDNQI

SEQ ID NO: 78910 - protein, 33 aa, Artificial Sequence
  Description of Artificial Sequence: Synthetic polypeptide
AEEEIRTTNPVATEIYGSVSTTNNNQEAGNQTE

SEQ ID NO: 78911 - protein, 32 aa, Artificial Sequence
  Description of Artificial Sequence: Synthetic polypeptide
TEECICTTNPVATEQYGSVVSMNESSQRGGNS

SEQ ID NO: 78912 - protein, 33 aa, Artificial Sequence
  Description of Artificial Sequence: Synthetic polypeptide
AEEEIRTTNPVATEIYGSVSTTNNQQAGNNATE

SEQ ID NO: 78913 - protein, 31 aa, Artificial Sequence
  Description of Artificial Sequence: Synthetic polypeptide
DEGEIRTTNPVATEQYGSVSTNDTEIYLDMF

SEQ ID NO: 78914 - protein, 33 aa, Artificial Sequence
  Description of Artificial Sequence: Synthetic polypeptide
AEEEIRTTNPVATEIYGSVSVTNTNQEAGTNTE

SEQ ID NO: 78915 - protein, 30 aa, Artificial Sequence
  Description of Artificial Sequence: Synthetic polypeptide
DDEEIRTTNPCATEHYGCVCSWNLNQHNNQ

SEQ ID NO: 78916 - protein, 32 aa, Artificial Sequence
  Description of Artificial Sequence: Synthetic polypeptide
DDEEIRTTNPVATEQWGSVVTSGLLQREGQTG

SEQ ID NO: 78917 - protein, 31 aa, Artificial Sequence
  Description of Artificial Sequence: Synthetic polypeptide
DEGEIATTNPVATEQWGSVSTGNNDNRGDQD

SEQ ID NO: 78918 - protein, 33 aa, Artificial Sequence
  Description of Artificial Sequence: Synthetic polypeptide
DEGEIRTTNPVATEQYGSVSTLLISQENNNEIG

SEQ ID NO: 78919 - protein, 33 aa, Artificial Sequence
  Description of Artificial Sequence: Synthetic polypeptide
DDEEIRTTNPVATEQWGSVVTSGLRLQREGETR

SEQ ID NO: 78920 - protein, 33 aa, Artificial Sequence
  Description of Artificial Sequence: Synthetic polypeptide
DEGEIRTTNPVATEQYGSVSTNDLTLEDQNDGV

SEQ ID NO: 78921 - protein, 34 aa, Artificial Sequence
  Description of Artificial Sequence: Synthetic polypeptide
DEEEIRTTNPVATEQYGCVCSTEHNQNFGSNNRL

SEQ ID NO: 78922 - protein, 33 aa, Artificial Sequence
  Description of Artificial Sequence: Synthetic polypeptide
DEEEIRTTNPVATEQYGCVCSTEHNQNFGSNVN

SEQ ID NO: 78923 - protein, 31 aa, Artificial Sequence
  Description of Artificial Sequence: Synthetic polypeptide
TEECICTTNPVATEQYGCVSTNEFSQFGGND

SEQ ID NO: 78924 - protein, 33 aa, Artificial Sequence
  Description of Artificial Sequence: Synthetic polypeptide
TEEEIRTTNPMAYEQYGSVPACTNALQRGGNYA

SEQ ID NO: 78925 - protein, 32 aa, Artificial Sequence
  Description of Artificial Sequence: Synthetic polypeptide
DEEEIRTTNPVATEQYGCVCSTEHNQNFSSNQ

SEQ ID NO: 78926 - protein, 33 aa, Artificial Sequence
  Description of Artificial Sequence: Synthetic polypeptide
DEGEIRTTNPVATEQYGSVSTNDTEIFLQDIMQ

SEQ ID NO: 78927 - protein, 33 aa, Artificial Sequence
  Description of Artificial Sequence: Synthetic polypeptide
DEAEIATTNPVATEQYGSVAITNLVQVGDNPDE

SEQ ID NO: 78928 - protein, 32 aa, Artificial Sequence
  Description of Artificial Sequence: Synthetic polypeptide
DEEEIRTTNPVATEQYGCVCSTEHNQGNSNQF

SEQ ID NO: 78929 - protein, 34 aa, Artificial Sequence
  Description of Artificial Sequence: Synthetic polypeptide
DEEEIRTTNPVATEQYGCVCSTGNLQNFNSDFAA

SEQ ID NO: 78930 - protein, 33 aa, Artificial Sequence
  Description of Artificial Sequence: Synthetic polypeptide
AEEEIRTTNPVATEQYGSVSNSNNQQQTEGNIM

SEQ ID NO: 78931 - protein, 31 aa, Artificial Sequence
  Description of Artificial Sequence: Synthetic polypeptide
DEEEIRTTNPVATEAYGCISTNEQYFNSNFA

SEQ ID NO: 78932 - protein, 33 aa, Artificial Sequence
  Description of Artificial Sequence: Synthetic polypeptide
DEEEIRTTNPVATEQYGCVCSNTELQHNSNNQL

SEQ ID NO: 78933 - protein, 33 aa, Artificial Sequence
  Description of Artificial Sequence: Synthetic polypeptide
DEEEIRTTNPVATEAYGTVSVSVTNDEQGNNQF

SEQ ID NO: 78934 - protein, 33 aa, Artificial Sequence
  Description of Artificial Sequence: Synthetic polypeptide
DEMEIATTNPVATEQYGSVSWTEQHQERMGDNS

SEQ ID NO: 78935 - protein, 28 aa, Artificial Sequence
  Description of Artificial Sequence: Synthetic peptide
SEGEIAPTNPISSEQYGSVSCNLQSGTR

SEQ ID NO: 78936 - protein, 32 aa, Artificial Sequence
  Description of Artificial Sequence: Synthetic polypeptide
DEMEIATTNPVATEQYGTVCSATDCLVQFGNL

SEQ ID NO: 78937 - protein, 34 aa, Artificial Sequence
  Description of Artificial Sequence: Synthetic polypeptide
DEEEIRTTNPVATEQYGCVCSNTELQHFGSDNQS

SEQ ID NO: 78938 - protein, 32 aa, Artificial Sequence
  Description of Artificial Sequence: Synthetic polypeptide
DEEEIRTTNPVATEQYGCVCSWEEHQRNSNQN

SEQ ID NO: 78939 - protein, 34 aa, Artificial Sequence
  Description of Artificial Sequence: Synthetic polypeptide
DDEEIRTTNPVATEQYGSVSATNPAGPQMRNGQV

SEQ ID NO: 78940 - protein, 33 aa, Artificial Sequence
  Description of Artificial Sequence: Synthetic polypeptide
DEEEIRTTNPVATEQYGCVCSNTELQESGSDQA

SEQ ID NO: 78941 - protein, 32 aa, Artificial Sequence
  Description of Artificial Sequence: Synthetic polypeptide
DEMEIATTNPVATEQYGTVCSATDNPVERGND

SEQ ID NO: 78942 - protein, 28 aa, Artificial Sequence
  Description of Artificial Sequence: Synthetic peptide
SEGEIAPTNPCSTEQYGIVSCNLQSGTR

SEQ ID NO: 78943 - protein, 28 aa, Artificial Sequence
  Description of Artificial Sequence: Synthetic peptide
SEGEIAPTNPCSSEQYGSVSCNLQSGTR

SEQ ID NO: 78944 - protein, 29 aa, Artificial Sequence
  Description of Artificial Sequence: Synthetic peptide
AEEEIATTNPVATEQYGVVATNVTQHEEI

SEQ ID NO: 78945 - protein, 33 aa, Artificial Sequence
  Description of Artificial Sequence: Synthetic polypeptide
DEEVIRTTNPVATEQYGSVSTIPMEFPNSGQNR

SEQ ID NO: 78946 - protein, 31 aa, Artificial Sequence
  Description of Artificial Sequence: Synthetic polypeptide
DEMEIATTNPVATEQYGTVCSDDGLVQFGND

SEQ ID NO: 78947 - protein, 34 aa, Artificial Sequence
  Description of Artificial Sequence: Synthetic polypeptide
DEEEIRTTNPVATEQYGCVCSNTELQENGSENQF

SEQ ID NO: 78948 - protein, 33 aa, Artificial Sequence
  Description of Artificial Sequence: Synthetic polypeptide
DEEVIRTTNPVATEQYGSVSTINLTDNNLQNQG

SEQ ID NO: 78949 - protein, 32 aa, Artificial Sequence
  Description of Artificial Sequence: Synthetic polypeptide
DEMEIATTNPVATEQYGTVCSTDNPVQFEGND

SEQ ID NO: 78950 - protein, 33 aa, Artificial Sequence
  Description of Artificial Sequence: Synthetic polypeptide
DEEVIRTTNPVATEQYGSVSTIMLEFPNSGQNV

SEQ ID NO: 78951 - protein, 31 aa, Artificial Sequence
  Description of Artificial Sequence: Synthetic polypeptide
DEMEIATTNPVATEQYGTVCSTTLVEFEGNI

SEQ ID NO: 78952 - protein, 28 aa, Artificial Sequence
  Description of Artificial Sequence: Synthetic peptide
SEGEIAPTNPCATEQYGIVSENLMSGTR

SEQ ID NO: 78953 - protein, 33 aa, Artificial Sequence
  Description of Artificial Sequence: Synthetic polypeptide
DAEEIATTNPVATEQYGSVCATNDEQDNGNDRL

SEQ ID NO: 78954 - protein, 33 aa, Artificial Sequence
  Description of Artificial Sequence: Synthetic polypeptide
DEEEIRTTNPVATEQYGCVCSNTELNQYFSSNQ

SEQ ID NO: 78955 - protein, 33 aa, Artificial Sequence
  Description of Artificial Sequence: Synthetic polypeptide
DEEEIRTTNPVATEQYGCVCSNTELNQNGSEQI

SEQ ID NO: 78956 - protein, 31 aa, Artificial Sequence
  Description of Artificial Sequence: Synthetic polypeptide
SEGEIACTNPVATEQYGSVATNLQHQGNDQG

SEQ ID NO: 78957 - protein, 34 aa, Artificial Sequence
  Description of Artificial Sequence: Synthetic polypeptide
AEEEIRTTNPVATEQYGSVSTNLNPEEQGNNNGE

SEQ ID NO: 78958 - protein, 34 aa, Artificial Sequence
  Description of Artificial Sequence: Synthetic polypeptide
AEEEIRTTNPVATEQYGSVSTNLNPEEQGTNEGT

SEQ ID NO: 78959 - protein, 32 aa, Artificial Sequence
  Description of Artificial Sequence: Synthetic polypeptide
DDEEIRTTNPVATEQYGSVNWWNDERGSDQRD

SEQ ID NO: 78960 - protein, 34 aa, Artificial Sequence
  Description of Artificial Sequence: Synthetic polypeptide
DEEEIRTTNPVATEQYGCVCSNTELQNFGSENLI

SEQ ID NO: 78961 - protein, 34 aa, Artificial Sequence
  Description of Artificial Sequence: Synthetic polypeptide
DEEEIRTTNPVATEQYGCVCSNTELQNFGSQNQS

SEQ ID NO: 78962 - protein, 35 aa, Artificial Sequence
  Description of Artificial Sequence: Synthetic polypeptide
AEEEIRTTNPVATEQYGSVSTNLNNENQETGNNTD

SEQ ID NO: 78963 - protein, 29 aa, Artificial Sequence
  Description of Artificial Sequence: Synthetic peptide
AEEEIATTNPVATESYGCIAGNGLQDANR

SEQ ID NO: 78964 - protein, 32 aa, Artificial Sequence
  Description of Artificial Sequence: Synthetic polypeptide
DEEVIRTTNPVAYERYGSVSCDNISQRPGGTR

SEQ ID NO: 78965 - protein, 28 aa, Artificial Sequence
  Description of Artificial Sequence: Synthetic peptide
SEGEIRCTNPCSSEQYGIVSCNLQSGTR

SEQ ID NO: 78966 - protein, 33 aa, Artificial Sequence
  Description of Artificial Sequence: Synthetic polypeptide
DEEVIRTTNPVAYERYGSTVSCTGNIQRPGGPR

SEQ ID NO: 78967 - protein, 33 aa, Artificial Sequence
  Description of Artificial Sequence: Synthetic polypeptide
DEEVIRTTNPVAYERYGQSVSCTNMIQRPGGPR

SEQ ID NO: 78968 - protein, 31 aa, Artificial Sequence
  Description of Artificial Sequence: Synthetic polypeptide
DEMEIATTNPVATEQYGSVSATDLEDHEGEL

SEQ ID NO: 78969 - protein, 33 aa, Artificial Sequence
  Description of Artificial Sequence: Synthetic polypeptide
DEEEIRTTNPVATEQYGCVCSNTEPQRFGSIQS

SEQ ID NO: 78970 - protein, 32 aa, Artificial Sequence
  Description of Artificial Sequence: Synthetic polypeptide
DEEEIRTTNPVATEQYGCVCSNTEPQNGSDQA

SEQ ID NO: 78971 - protein, 31 aa, Artificial Sequence
  Description of Artificial Sequence: Synthetic polypeptide
DEEVIRTTNPVAYEQYGTVSTGDLNDHGQTR

SEQ ID NO: 78972 - protein, 33 aa, Artificial Sequence
  Description of Artificial Sequence: Synthetic polypeptide
DEEVIRTTNPVAYEQYGTVSCTNDLRDNGNNDR

SEQ ID NO: 78973 - protein, 32 aa, Artificial Sequence
  Description of Artificial Sequence: Synthetic polypeptide
DEEEIRTTNPVATEQYGCVCSNTEPQENGSEQ

SEQ ID NO: 78974 - protein, 31 aa, Artificial Sequence
  Description of Artificial Sequence: Synthetic polypeptide
SEGEIRCTNPCATEQYGSVCSPENLHRGSRD

SEQ ID NO: 78975 - protein, 32 aa, Artificial Sequence
  Description of Artificial Sequence: Synthetic polypeptide
TEEEIRTTNPVGTEQYGSVSCTNALSGVGGDP

SEQ ID NO: 78976 - protein, 33 aa, Artificial Sequence
  Description of Artificial Sequence: Synthetic polypeptide
DEEEIRTTNPVATEQYGCVCSNTELARFGSDQS

SEQ ID NO: 78977 - protein, 33 aa, Artificial Sequence
  Description of Artificial Sequence: Synthetic polypeptide
DDEEIRTTNPVATEQYGSVGSTQGQNGQGEGQE

SEQ ID NO: 78978 - protein, 32 aa, Artificial Sequence
  Description of Artificial Sequence: Synthetic polypeptide
TEEEIRTTNPVGTEQYGVVSTNELSGRPGGSP

SEQ ID NO: 78979 - protein, 34 aa, Artificial Sequence
  Description of Artificial Sequence: Synthetic polypeptide
DDEEIRTTNPVATEQYGSVGSTTDGDNEQTGNED

SEQ ID NO: 78980 - protein, 35 aa, Artificial Sequence
  Description of Artificial Sequence: Synthetic polypeptide
AEEEIRTTNPVATEQYGSVSTNLNNENQETGNNET

SEQ ID NO: 78981 - protein, 32 aa, Artificial Sequence
  Description of Artificial Sequence: Synthetic polypeptide
DEMEIATTNPVATEQYGSVSATDLEDHEGNDL

SEQ ID NO: 78982 - protein, 32 aa, Artificial Sequence
  Description of Artificial Sequence: Synthetic polypeptide
DEEVIRTTNPVAYEQYGSVVSCINLSDNGQNQ

SEQ ID NO: 78983 - protein, 32 aa, Artificial Sequence
  Description of Artificial Sequence: Synthetic polypeptide
TEEEIRTTNPVGTERYGSVSCTNELSGRVGGP

SEQ ID NO: 78984 - protein, 35 aa, Artificial Sequence
  Description of Artificial Sequence: Synthetic polypeptide
DEEEIRTTNPVATEQYGCVCSNTENLNQGFGSNQA

SEQ ID NO: 78985 - protein, 29 aa, Artificial Sequence
  Description of Artificial Sequence: Synthetic peptide
DEEVIRTTNPVAYEQWGCVTSNPQCGGNE

SEQ ID NO: 78986 - protein, 33 aa, Artificial Sequence
  Description of Artificial Sequence: Synthetic polypeptide
TEEEIRTTNPVGYEAYGSVSATNELSQRGGNNY

SEQ ID NO: 78987 - protein, 32 aa, Artificial Sequence
  Description of Artificial Sequence: Synthetic polypeptide
DEEVIRTTNPVATERYGSVACTNISQDPGGPR

SEQ ID NO: 78988 - protein, 31 aa, Artificial Sequence
  Description of Artificial Sequence: Synthetic polypeptide
TEEEIRTTNPVSTEQYGSVVAFNLSQGGGST

SEQ ID NO: 78989 - protein, 34 aa, Artificial Sequence
  Description of Artificial Sequence: Synthetic polypeptide
TEEEIRYTNPVATEQYGSTVSCVNMQSDRGGNNR

SEQ ID NO: 78990 - protein, 35 aa, Artificial Sequence
  Description of Artificial Sequence: Synthetic polypeptide
DDEEIRTTNPVATEQYGSVNSDSTNLQNDGMGNDD

SEQ ID NO: 78991 - protein, 34 aa, Artificial Sequence
  Description of Artificial Sequence: Synthetic polypeptide
DEEEIRTTNPVATEQYGCVCSNTENLQHFNSDQT

SEQ ID NO: 78992 - protein, 34 aa, Artificial Sequence
  Description of Artificial Sequence: Synthetic polypeptide
DDEEIRTTNPVATEQYGSVSITGNVGQGGNGNGD

SEQ ID NO: 78993 - protein, 31 aa, Artificial Sequence
  Description of Artificial Sequence: Synthetic polypeptide
DEMEIATTNPVATEQYGTVSCDNPVQSEGND

SEQ ID NO: 78994 - protein, 35 aa, Artificial Sequence
  Description of Artificial Sequence: Synthetic polypeptide
AEEEIRTTNPVATEQYGSVSTNLNQGEEQGTNNGT

SEQ ID NO: 78995 - protein, 34 aa, Artificial Sequence
  Description of Artificial Sequence: Synthetic polypeptide
DDEEIRTTNPVATEQYGSVSTGGNLQGEGGGQEN

SEQ ID NO: 78996 - protein, 31 aa, Artificial Sequence
  Description of Artificial Sequence: Synthetic polypeptide
DEMEIRTTNPVATCQYGQCVCNTELQNGSNQ

SEQ ID NO: 78997 - protein, 31 aa, Artificial Sequence
  Description of Artificial Sequence: Synthetic polypeptide
DEMEIRTTNPVATDQYGAVSTNAEVRQLNGP

SEQ ID NO: 78998 - protein, 32 aa, Artificial Sequence
  Description of Artificial Sequence: Synthetic polypeptide
DEEEIRTTNPVATEQYGCVCSWEHQNFGSNVG

SEQ ID NO: 78999 - protein, 31 aa, Artificial Sequence
  Description of Artificial Sequence: Synthetic polypeptide
SEESEIRTTNPVAYEPWGCVSCTNGSQPGNR

SEQ ID NO: 79000 - protein, 32 aa, Artificial Sequence
  Description of Artificial Sequence: Synthetic polypeptide
AEEEIATTNPVATEQYGSVCSTNPPQNHGTEM

SEQ ID NO: 79001 - protein, 32 aa, Artificial Sequence
  Description of Artificial Sequence: Synthetic polypeptide
DEEEIRTTNPVATEQYGCVCSWEHQNGSNTQA

SEQ ID NO: 79002 - protein, 34 aa, Artificial Sequence
  Description of Artificial Sequence: Synthetic polypeptide
AEEEIRTTNPVATEQYGSVSTNLQQGQEEGTEAL

SEQ ID NO: 79003 - protein, 32 aa, Artificial Sequence
  Description of Artificial Sequence: Synthetic polypeptide
DEEEIRTTNPVATEQYGCVCSWEHQRSGSEQG

SEQ ID NO: 79004 - protein, 32 aa, Artificial Sequence
  Description of Artificial Sequence: Synthetic polypeptide
DEEEIRTTNPVATEQYGCVCSWEHQYFGSNQS

SEQ ID NO: 79005 - protein, 35 aa, Artificial Sequence
  Description of Artificial Sequence: Synthetic polypeptide
TEEEVRTTNPVATEQWGISVSCTGNLDQRTGGNNR

SEQ ID NO: 79006 - protein, 31 aa, Artificial Sequence
  Description of Artificial Sequence: Synthetic polypeptide
DEMEIRTTNPVATDQYGCVCGTELQYFGSNQ

SEQ ID NO: 79007 - protein, 32 aa, Artificial Sequence
  Description of Artificial Sequence: Synthetic polypeptide
DEEVIRTTNPVATEQYGCVSTENLNDNFGSDQ

SEQ ID NO: 79008 - protein, 31 aa, Artificial Sequence
  Description of Artificial Sequence: Synthetic polypeptide
DEEEIRTTNPVATEQYGCVCSWEHQIFGSDQ

SEQ ID NO: 79009 - protein, 33 aa, Artificial Sequence
  Description of Artificial Sequence: Synthetic polypeptide
DEMEIRTTNPVATDQYGCVSKTNVLEHQVGNPF

SEQ ID NO: 79010 - protein, 33 aa, Artificial Sequence
  Description of Artificial Sequence: Synthetic polypeptide
TEEEVRTTNPVATEQYGSVCSTGNHDQHIGSNQ

SEQ ID NO: 79011 - protein, 33 aa, Artificial Sequence
  Description of Artificial Sequence: Synthetic polypeptide
DEMEIRTTNPVATDQYGCVSKTNVLERQTIGNP

SEQ ID NO: 79012 - protein, 33 aa, Artificial Sequence
  Description of Artificial Sequence: Synthetic polypeptide
DEEVIRTTNPVATEQYGCVSNTGNLNDNFGSNQ

SEQ ID NO: 79013 - protein, 32 aa, Artificial Sequence
  Description of Artificial Sequence: Synthetic polypeptide
DEEEIRTTNPVATEQYGCVCSWELERFGSEDG

SEQ ID NO: 79014 - protein, 34 aa, Artificial Sequence
  Description of Artificial Sequence: Synthetic polypeptide
TEEEVRTTNPVATEQYGSVSCTGNLDHRTGGNNV

SEQ ID NO: 79015 - protein, 31 aa, Artificial Sequence
  Description of Artificial Sequence: Synthetic polypeptide
AEEEIATTNPVATEQYGSVATNLTDPMENTP

SEQ ID NO: 79016 - protein, 32 aa, Artificial Sequence
  Description of Artificial Sequence: Synthetic polypeptide
DEEEIRTTNPVATEQYGCVCSWELNQNFGSEQ

SEQ ID NO: 79017 - protein, 32 aa, Artificial Sequence
  Description of Artificial Sequence: Synthetic polypeptide
AEEEIATTNPVATEQYGSVATNLQNGEGGIAE

SEQ ID NO: 79018 - protein, 30 aa, Artificial Sequence
  Description of Artificial Sequence: Synthetic polypeptide
DEMEIRTTNPVATDQYGCVSLSNLESGEDP

SEQ ID NO: 79019 - protein, 33 aa, Artificial Sequence
  Description of Artificial Sequence: Synthetic polypeptide
DEEEIRTTNPVATEQYGCVCSWELQENFGSNQS

SEQ ID NO: 79020 - protein, 32 aa, Artificial Sequence
  Description of Artificial Sequence: Synthetic polypeptide
DEMEIRTTNPVATDQYGCVSPTDNLERGEEPM

SEQ ID NO: 79021 - protein, 32 aa, Artificial Sequence
  Description of Artificial Sequence: Synthetic polypeptide
AEEEIATTNPVATEQYGSVATNLQGQEPDNTM

SEQ ID NO: 79022 - protein, 32 aa, Artificial Sequence
  Description of Artificial Sequence: Synthetic polypeptide
DEEEIRTTNPVATEQYGCVCSWELQFFNSEAY

SEQ ID NO: 79023 - protein, 34 aa, Artificial Sequence
  Description of Artificial Sequence: Synthetic polypeptide
AEEEIATTNPVATEQYGSVATTNPQPREGPNDRV

SEQ ID NO: 79024 - protein, 32 aa, Artificial Sequence
  Description of Artificial Sequence: Synthetic polypeptide
DEEVIRTTNPVAYERYGSVSCTNISGRPGGDR

SEQ ID NO: 79025 - protein, 33 aa, Artificial Sequence
  Description of Artificial Sequence: Synthetic polypeptide
TEEEISTTNPVSTEQYGQVVSTNLSDRTGGNNR

SEQ ID NO: 79026 - protein, 35 aa, Artificial Sequence
  Description of Artificial Sequence: Synthetic polypeptide
AEEEIRTTNPVATEQYGSVSTNLQLGSETGTNNAV

SEQ ID NO: 79027 - protein, 28 aa, Artificial Sequence
  Description of Artificial Sequence: Synthetic peptide
SEGEIACTNPISSEQYGSVSENLMSGNR

SEQ ID NO: 79028 - protein, 32 aa, Artificial Sequence
  Description of Artificial Sequence: Synthetic polypeptide
DEEEIRTTNPVATEQYGCVCSNTEHQSGSDAE

SEQ ID NO: 79029 - protein, 30 aa, Artificial Sequence
  Description of Artificial Sequence: Synthetic polypeptide
DEMEIATTNPVATEQYGTVSCNPVQSEGTD

SEQ ID NO: 79030 - protein, 29 aa, Artificial Sequence
  Description of Artificial Sequence: Synthetic peptide
DEMEIATTNPVATEQYGTVSEDCPEHGND

SEQ ID NO: 79031 - protein, 33 aa, Artificial Sequence
  Description of Artificial Sequence: Synthetic polypeptide
DDEEIRTTNPVATEQYGSVSITNTQVNMDIDRE

SEQ ID NO: 79032 - protein, 30 aa, Artificial Sequence
  Description of Artificial Sequence: Synthetic polypeptide
DEMEIATTNPVATEQYGTVSTDGPEFEGND

SEQ ID NO: 79033 - protein, 33 aa, Artificial Sequence
  Description of Artificial Sequence: Synthetic polypeptide
DEEEIRTTNPVATEQYGCVCSNTEHQHGSENQI

SEQ ID NO: 79034 - protein, 34 aa, Artificial Sequence
  Description of Artificial Sequence: Synthetic polypeptide
AEEEIRTTNPVATEQYGSVSTNLNQPEEQGTEGT

SEQ ID NO: 79035 - protein, 33 aa, Artificial Sequence
  Description of Artificial Sequence: Synthetic polypeptide
DEEEIRTTNPVATEQYGCVCSNTEHQHFGSNVA

SEQ ID NO: 79036 - protein, 33 aa, Artificial Sequence
  Description of Artificial Sequence: Synthetic polypeptide
DEEEIRTTNPVATEQYGCVCSNTEHQHFGSERF

SEQ ID NO: 79037 - protein, 34 aa, Artificial Sequence
  Description of Artificial Sequence: Synthetic polypeptide
AEEEIRTTNPVATEQYGSVSTNLNQQGEQGTEAG

SEQ ID NO: 79038 - protein, 32 aa, Artificial Sequence
  Description of Artificial Sequence: Synthetic polypeptide
DEMEIATTNPVAYEQYGSVSTNLQGAPAEGKD

SEQ ID NO: 79039 - protein, 29 aa, Artificial Sequence
  Description of Artificial Sequence: Synthetic peptide
SEEVICTTNPVAYEQYGSVAMNSQGSGNS

SEQ ID NO: 79040 - protein, 31 aa, Artificial Sequence
  Description of Artificial Sequence: Synthetic polypeptide
DEMEIRTTNPVATCQYGCVCQTELQNGSNQA

SEQ ID NO: 79041 - protein, 35 aa, Artificial Sequence
  Description of Artificial Sequence: Synthetic polypeptide
TEEEISTTNPVATEQYGVVPSCTTNALQRTGDNNR

SEQ ID NO: 79042 - protein, 33 aa, Artificial Sequence
  Description of Artificial Sequence: Synthetic polypeptide
DEEVIRTTNPVATEQYGSVCSWNLNDNFGSNQS

SEQ ID NO: 79043 - protein, 34 aa, Artificial Sequence
  Description of Artificial Sequence: Synthetic polypeptide
AEEEIRTTNPVATEQYGSVSTNLNQQQNEGTEQL

SEQ ID NO: 79044 - protein, 31 aa, Artificial Sequence
  Description of Artificial Sequence: Synthetic polypeptide
DEMEIRATNPVATEQYGCVSVNQDRIGSNSD

SEQ ID NO: 79045 - protein, 31 aa, Artificial Sequence
  Description of Artificial Sequence: Synthetic polypeptide
DEMEIRCTNPVATEQYGSVSAEDGPMFEGNR

SEQ ID NO: 79046 - protein, 33 aa, Artificial Sequence
  Description of Artificial Sequence: Synthetic polypeptide
DEEEIRTTNPVATEQYGCVCSNTEHQETFGSNQ

SEQ ID NO: 79047 - protein, 34 aa, Artificial Sequence
  Description of Artificial Sequence: Synthetic polypeptide
DDEEIRTTNPVATEQYGSVSSTNGDQGQGGNQGG

SEQ ID NO: 79048 - protein, 34 aa, Artificial Sequence
  Description of Artificial Sequence: Synthetic polypeptide
DDEEIRTTNPVATEQYGSVSSTNLDIGVEGGNDG

SEQ ID NO: 79049 - protein, 32 aa, Artificial Sequence
  Description of Artificial Sequence: Synthetic polypeptide
DEAEIATTNPVATEQWGAVSTNLNQGNTGDPR

SEQ ID NO: 79050 - protein, 34 aa, Artificial Sequence
  Description of Artificial Sequence: Synthetic polypeptide
DDEEIRTTNPVATEQYGSVSTDLDLEQGGGNEEG

SEQ ID NO: 79051 - protein, 34 aa, Artificial Sequence
  Description of Artificial Sequence: Synthetic polypeptide
DDEEIRTTNPVATEQYGSVSTDNGLDQEETQDNN

SEQ ID NO: 79052 - protein, 32 aa, Artificial Sequence
  Description of Artificial Sequence: Synthetic polypeptide
DEEEIRTTNPVATEQYGCVCSWEHQGFGSNVS

SEQ ID NO: 79053 - protein, 33 aa, Artificial Sequence
  Description of Artificial Sequence: Synthetic polypeptide
DEEEIRTTNPVATEQYGCVCSNTEHNQRGSEQT

SEQ ID NO: 79054 - protein, 31 aa, Artificial Sequence
  Description of Artificial Sequence: Synthetic polypeptide
DEMEIRTTNPVATCQYGCVCNTELQNGSNDI

SEQ ID NO: 79055 - protein, 31 aa, Artificial Sequence
  Description of Artificial Sequence: Synthetic polypeptide
DEMEIATVNPVATEQYGCVSTNLANFGSNNQ

SEQ ID NO: 79056 - protein, 32 aa, Artificial Sequence
  Description of Artificial Sequence: Synthetic polypeptide
AEEEIATTNPVATEQYGSVATNLQGAGEDVTG

SEQ ID NO: 79057 - protein, 32 aa, Artificial Sequence
  Description of Artificial Sequence: Synthetic polypeptide
DEEEIRTTNPVATEQYGCVCSNTETQNFGEQS

SEQ ID NO: 79058 - protein, 31 aa, Artificial Sequence
  Description of Artificial Sequence: Synthetic polypeptide
DEEVIRTTNPVAYERYGSVSCTNITGPGGPR

SEQ ID NO: 79059 - protein, 31 aa, Artificial Sequence
  Description of Artificial Sequence: Synthetic polypeptide
DEFEICTVNPVATEHYGSVPSTTMNLFEGNF

SEQ ID NO: 79060 - protein, 30 aa, Artificial Sequence
  Description of Artificial Sequence: Synthetic polypeptide
SEMEIRTTNPIATEQYGTVCSATGLMFGND

SEQ ID NO: 79061 - protein, 34 aa, Artificial Sequence
  Description of Artificial Sequence: Synthetic polypeptide
DEEEIRTTNPVATEQYGCVCSVSMNLQHFNSNIS

SEQ ID NO: 79062 - protein, 30 aa, Artificial Sequence
  Description of Artificial Sequence: Synthetic polypeptide
SEMEIRCTNPVATEQYGTVSENPVEFEGNR

SEQ ID NO: 79063 - protein, 32 aa, Artificial Sequence
  Description of Artificial Sequence: Synthetic polypeptide
DEEEIRTTNPVATEQYGCVCSWAHQFFGSNDG

SEQ ID NO: 79064 - protein, 32 aa, Artificial Sequence
  Description of Artificial Sequence: Synthetic polypeptide
DEFEIATVNPVATEQYGSVSWTNDLDENGGNH

SEQ ID NO: 79065 - protein, 33 aa, Artificial Sequence
  Description of Artificial Sequence: Synthetic polypeptide
AEEEICTTNPVATEQYGNVSVTTNLEQGNGTNA

SEQ ID NO: 79066 - protein, 31 aa, Artificial Sequence
  Description of Artificial Sequence: Synthetic polypeptide
DEEEIRTTNPVATEQYGCVCSWAHQNSGSEQ

SEQ ID NO: 79067 - protein, 33 aa, Artificial Sequence
  Description of Artificial Sequence: Synthetic polypeptide
DEEEIRTTNPVATEQYGCVCSWAHQRFGSNNQS

SEQ ID NO: 79068 - protein, 32 aa, Artificial Sequence
  Description of Artificial Sequence: Synthetic polypeptide
DEEEIRTTNPVATEQYGCVCSWALQFFNSNDS

SEQ ID NO: 79069 - protein, 31 aa, Artificial Sequence
  Description of Artificial Sequence: Synthetic polypeptide
DEAEIATTNPVATEQWGSVSATALQGEGMTH

SEQ ID NO: 79070 - protein, 32 aa, Artificial Sequence
  Description of Artificial Sequence: Synthetic polypeptide
DEEEIRTTNPVATEQYGCVCSWALQNFGSDQP

SEQ ID NO: 79071 - protein, 32 aa, Artificial Sequence
  Description of Artificial Sequence: Synthetic polypeptide
TEEEIRTTNPVAYEQYGSVPSVLNLQFGGSEI

SEQ ID NO: 79072 - protein, 30 aa, Artificial Sequence
  Description of Artificial Sequence: Synthetic polypeptide
AEEEIATTNPVAYEQYGSVAIENLTRDGDG

SEQ ID NO: 79073 - protein, 35 aa, Artificial Sequence
  Description of Artificial Sequence: Synthetic polypeptide
TEEEIRTTNPVAYEQYGSVSCTANELSQQGENYRE

SEQ ID NO: 79074 - protein, 34 aa, Artificial Sequence
  Description of Artificial Sequence: Synthetic polypeptide
DEEEIRTTNPVATESYGSVSTMNLDQELEGGGDE

SEQ ID NO: 79075 - protein, 32 aa, Artificial Sequence
  Description of Artificial Sequence: Synthetic polypeptide
DEFEIATVNPVATEQYGSVSWTNDLDEGGNKH

SEQ ID NO: 79076 - protein, 32 aa, Artificial Sequence
  Description of Artificial Sequence: Synthetic polypeptide
DEFEIATVNPVATEQYGSVSWTNDLDEGDNEH

SEQ ID NO: 79077 - protein, 32 aa, Artificial Sequence
  Description of Artificial Sequence: Synthetic polypeptide
AEEEIATTNPVAYEQWGSVSTNLQGNMGGGNN

SEQ ID NO: 79078 - protein, 31 aa, Artificial Sequence
  Description of Artificial Sequence: Synthetic polypeptide
AEEEIATTNPVAYEQWGSVSTNLNGMEGGNN

SEQ ID NO: 79079 - protein, 30 aa, Artificial Sequence
  Description of Artificial Sequence: Synthetic polypeptide
AEEEIATTNPVAYEQWGSVSTGMQLGDNGP

SEQ ID NO: 79080 - protein, 32 aa, Artificial Sequence
  Description of Artificial Sequence: Synthetic polypeptide
DEFEIATVNPVATEQYGSVSWTEDLDEHGNHR

SEQ ID NO: 79081 - protein, 31 aa, Artificial Sequence
  Description of Artificial Sequence: Synthetic polypeptide
DEAEIATTNPVATEQWGSVATNLETDGPNPQ

SEQ ID NO: 79082 - protein, 30 aa, Artificial Sequence
  Description of Artificial Sequence: Synthetic polypeptide
DEMAIRTTNPVATEQYGCFSTNHINFGSNQ

SEQ ID NO: 79083 - protein, 29 aa, Artificial Sequence
  Description of Artificial Sequence: Synthetic peptide
SEMEIRCTNPIATEQYGTVCSTGLMFGND

SEQ ID NO: 79084 - protein, 33 aa, Artificial Sequence
  Description of Artificial Sequence: Synthetic polypeptide
DEFEIATVNPVATEQYGSVSWTEDLDEGRGNHR

SEQ ID NO: 79085 - protein, 31 aa, Artificial Sequence
  Description of Artificial Sequence: Synthetic polypeptide
TEEEIRTTNPVAYEQYGSVVACTALQNTSPR

SEQ ID NO: 79086 - protein, 33 aa, Artificial Sequence
  Description of Artificial Sequence: Synthetic polypeptide
AEEEICTTNPVATEQYGNVSVTTNLQGGTNNAT

SEQ ID NO: 79087 - protein, 33 aa, Artificial Sequence
  Description of Artificial Sequence: Synthetic polypeptide
DEEEIRTTNPVATEQYGCVCSVSMNHQHFVSNQ

SEQ ID NO: 79088 - protein, 33 aa, Artificial Sequence
  Description of Artificial Sequence: Synthetic polypeptide
TEEEIRTTNPVAYEQYGSTVSCAGNLDEFGNNR

SEQ ID NO: 79089 - protein, 32 aa, Artificial Sequence
  Description of Artificial Sequence: Synthetic polypeptide
TEEEIRTTNPVAYEQYGSTVSAGNHSDEFGNR

SEQ ID NO: 79090 - protein, 31 aa, Artificial Sequence
  Description of Artificial Sequence: Synthetic polypeptide
TEEEIRTTNPVAYEQFGISVSTYPSTRGGNS

SEQ ID NO: 79091 - protein, 34 aa, Artificial Sequence
  Description of Artificial Sequence: Synthetic polypeptide
DEEEIRTTNPVATEQYGCVCSTYLQEFFGSNTQP

SEQ ID NO: 79092 - protein, 31 aa, Artificial Sequence
  Description of Artificial Sequence: Synthetic polypeptide
DEFEICTVNPVATEQYGSVSTLNLFEGIVHG

SEQ ID NO: 79093 - protein, 33 aa, Artificial Sequence
  Description of Artificial Sequence: Synthetic polypeptide
DEEEIRTTNPVATEQYGCVCSTYLQEYFNSNQP

SEQ ID NO: 79094 - protein, 34 aa, Artificial Sequence
  Description of Artificial Sequence: Synthetic polypeptide
AEEEIRTTNPVATEQYGSVSTNGEQGNEGGNQTT

SEQ ID NO: 79095 - protein, 33 aa, Artificial Sequence
  Description of Artificial Sequence: Synthetic polypeptide
AEEEIRTTNPVATEQYGSVSTNGNGNQQGTEED

SEQ ID NO: 79096 - protein, 33 aa, Artificial Sequence
  Description of Artificial Sequence: Synthetic polypeptide
DEEEIRTTNPVATESYGSVSGGNDDQIGGNVGD

SEQ ID NO: 79097 - protein, 32 aa, Artificial Sequence
  Description of Artificial Sequence: Synthetic polypeptide
DEFEICTVNPVATEQYGSVSTENVLVFEGVNE

SEQ ID NO: 79098 - protein, 30 aa, Artificial Sequence
  Description of Artificial Sequence: Synthetic polypeptide
TEEEIRTTNPVAYEQWGSVAKALEQDNGSR

SEQ ID NO: 79099 - protein, 33 aa, Artificial Sequence
  Description of Artificial Sequence: Synthetic polypeptide
TEEEIRTTNPVAYEQWGSVYKNDNLDQRGENIR

SEQ ID NO: 79100 - protein, 33 aa, Artificial Sequence
  Description of Artificial Sequence: Synthetic polypeptide
TEEEIRTTNPVAYEQWGSVYKTDNLDQRGEQRR

SEQ ID NO: 79101 - protein, 33 aa, Artificial Sequence
  Description of Artificial Sequence: Synthetic polypeptide
TEEEIRTTNPVAYEQWGVVPSYTNLSQRTEDNR

SEQ ID NO: 79102 - protein, 31 aa, Artificial Sequence
  Description of Artificial Sequence: Synthetic polypeptide
DEAEIATTNPVATEQYGSVATNLENGGDTDI

SEQ ID NO: 79103 - protein, 29 aa, Artificial Sequence
  Description of Artificial Sequence: Synthetic peptide
DEAEIATTNPVATEQWGSVAMNLTNANDD

SEQ ID NO: 79104 - protein, 34 aa, Artificial Sequence
  Description of Artificial Sequence: Synthetic polypeptide
DEEEIRTTNPVATESYGSVSNTNNMTQDQGNIQE

SEQ ID NO: 79105 - protein, 33 aa, Artificial Sequence
  Description of Artificial Sequence: Synthetic polypeptide
DEEEIRTTNPVATESYGSVSSDNLQNEMTDNNG

SEQ ID NO: 79106 - protein, 32 aa, Artificial Sequence
  Description of Artificial Sequence: Synthetic polypeptide
TEEEIRTTNPVAYEQYGISTSTPQSQDGGNYR

SEQ ID NO: 79107 - protein, 32 aa, Artificial Sequence
  Description of Artificial Sequence: Synthetic polypeptide
SEMEIRTTNPVATEQYGSVSNTNLETGSDQQN

SEQ ID NO: 79108 - protein, 33 aa, Artificial Sequence
  Description of Artificial Sequence: Synthetic polypeptide
DEEEIRTTNPVATESYGSVSSTDGFGQGNEGNT

SEQ ID NO: 79109 - protein, 34 aa, Artificial Sequence
  Description of Artificial Sequence: Synthetic polypeptide
DEEEIRTTNPVATEQYGCVCSVSGNLNQYISNQA

SEQ ID NO: 79110 - protein, 35 aa, Artificial Sequence
  Description of Artificial Sequence: Synthetic polypeptide
TEEEIRTTNPVAYEQYGQSVSCTSNELSQKGENYR

SEQ ID NO: 79111 - protein, 32 aa, Artificial Sequence
  Description of Artificial Sequence: Synthetic polypeptide
DDEEIRTTNPVATEQYGQVTITYADQRIDNRD

SEQ ID NO: 79112 - protein, 33 aa, Artificial Sequence
  Description of Artificial Sequence: Synthetic polypeptide
TEEEIRTTNPVAYEQYGQSVVSYQNALFAVGNR

SEQ ID NO: 79113 - protein, 31 aa, Artificial Sequence
  Description of Artificial Sequence: Synthetic polypeptide
DEFEICTVNPVATEQYGDVSTTMNLEFEGNH

SEQ ID NO: 79114 - protein, 34 aa, Artificial Sequence
  Description of Artificial Sequence: Synthetic polypeptide
TEEEIRTTNPVAYEQYGSCSTDNELSQTPGGNRG

SEQ ID NO: 79115 - protein, 31 aa, Artificial Sequence
  Description of Artificial Sequence: Synthetic polypeptide
DEFEICTVNPVATEQYGCVSTNLAHFGSNNQ

SEQ ID NO: 79116 - protein, 33 aa, Artificial Sequence
  Description of Artificial Sequence: Synthetic polypeptide
DEEEIRTTNPVATEQYGCVCSVSMNDQHVSNQS

SEQ ID NO: 79117 - protein, 31 aa, Artificial Sequence
  Description of Artificial Sequence: Synthetic polypeptide
TEEEIRTTNPVAYEQYGSNSNTPNGNYGGND

SEQ ID NO: 79118 - protein, 32 aa, Artificial Sequence
  Description of Artificial Sequence: Synthetic polypeptide
DEAEIATTNPVATEQWGSVSATDLQRDDTDRE

SEQ ID NO: 79119 - protein, 29 aa, Artificial Sequence
  Description of Artificial Sequence: Synthetic peptide
DEMEIAPTNPCASEQYGIVSCNLVQSGTR

SEQ ID NO: 79120 - protein, 31 aa, Artificial Sequence
  Description of Artificial Sequence: Synthetic polypeptide
DEAEIATTNPVATEQWGSVAITNLTAEGGNL

SEQ ID NO: 79121 - protein, 34 aa, Artificial Sequence
  Description of Artificial Sequence: Synthetic polypeptide
DDEEIRTTNPVATEQYGSVCSTENHQENFGSNQD

SEQ ID NO: 79122 - protein, 29 aa, Artificial Sequence
  Description of Artificial Sequence: Synthetic peptide
AEEEIATTNPVATESYGCIANNLQDEANR

SEQ ID NO: 79123 - protein, 33 aa, Artificial Sequence
  Description of Artificial Sequence: Synthetic polypeptide
DEFCIGTTNPVATEQWGSVSCTDELSQRGTNNR

SEQ ID NO: 79124 - protein, 30 aa, Artificial Sequence
  Description of Artificial Sequence: Synthetic polypeptide
DEMEIATTNPVATEAYGEVSTNSQHEPRNG

SEQ ID NO: 79125 - protein, 28 aa, Artificial Sequence
  Description of Artificial Sequence: Synthetic peptide
DEMEIATTNPVATECYGDVSEGLEHGEL

SEQ ID NO: 79126 - protein, 30 aa, Artificial Sequence
  Description of Artificial Sequence: Synthetic polypeptide
DEEYIGTTNPVATEQYGDVVNNGQGEGGNG

SEQ ID NO: 79127 - protein, 28 aa, Artificial Sequence
  Description of Artificial Sequence: Synthetic peptide
DEMEIATTNPVATECYGTVSEGLEFGEL

SEQ ID NO: 79128 - protein, 28 aa, Artificial Sequence
  Description of Artificial Sequence: Synthetic peptide
DEMEIATTNPVATECYGTVSEGLEHGEL

SEQ ID NO: 79129 - protein, 32 aa, Artificial Sequence
  Description of Artificial Sequence: Synthetic polypeptide
DEEYIGTTNPVATEQYGDVSTQNNGQGEGGNG

SEQ ID NO: 79130 - protein, 32 aa, Artificial Sequence
  Description of Artificial Sequence: Synthetic polypeptide
DEAEIATTNPVATEQWGAVSTNLQGNHGDPGR

SEQ ID NO: 79131 - protein, 30 aa, Artificial Sequence
  Description of Artificial Sequence: Synthetic polypeptide
SEGEIRTTNPVATEQYGCVSTNEQELEDEI

SEQ ID NO: 79132 - protein, 32 aa, Artificial Sequence
  Description of Artificial Sequence: Synthetic polypeptide
DEEYIGTTNPVATEQYGDVSTDNGQGEFGNGG

SEQ ID NO: 79133 - protein, 28 aa, Artificial Sequence
  Description of Artificial Sequence: Synthetic peptide
DEMEIATTNPVATECYGTVSTGPEFGEL

SEQ ID NO: 79134 - protein, 35 aa, Artificial Sequence
  Description of Artificial Sequence: Synthetic polypeptide
AEEEIRTTNPVATEQYGSVSTNLNGNQETGTNVED

SEQ ID NO: 79135 - protein, 30 aa, Artificial Sequence
  Description of Artificial Sequence: Synthetic polypeptide
DEMEIATTNPVATCQYGCVSTALQYFNSNQ

SEQ ID NO: 79136 - protein, 32 aa, Artificial Sequence
  Description of Artificial Sequence: Synthetic polypeptide
DEAEIATTNPVATEQWGAVSTNLQGNEGGPRA

SEQ ID NO: 79137 - protein, 31 aa, Artificial Sequence
  Description of Artificial Sequence: Synthetic polypeptide
DEMEIATTNPVATEQYGEASEDGLVQFEGNR

SEQ ID NO: 79138 - protein, 28 aa, Artificial Sequence
  Description of Artificial Sequence: Synthetic peptide
SEGEIRPTNPCSSEQYGSVSCNLMSGTR

SEQ ID NO: 79139 - protein, 31 aa, Artificial Sequence
  Description of Artificial Sequence: Synthetic polypeptide
TEEEIRTTNPVAYERYGSVVATALQNSGSRY

SEQ ID NO: 79140 - protein, 28 aa, Artificial Sequence
  Description of Artificial Sequence: Synthetic peptide
SEGEIRPTNPCSSEQYGIVSCNLQSGTR

SEQ ID NO: 79141 - protein, 35 aa, Artificial Sequence
  Description of Artificial Sequence: Synthetic polypeptide
AEEEIRTTNPVATEQYGSVSTNLNLENQETGTNVE

SEQ ID NO: 79142 - protein, 35 aa, Artificial Sequence
  Description of Artificial Sequence: Synthetic polypeptide
AEEEIRTTNPVATEQYGSVSTNLNLGQEQGNNTGT

SEQ ID NO: 79143 - protein, 32 aa, Artificial Sequence
  Description of Artificial Sequence: Synthetic polypeptide
DEMEIATTNPVATEQYGEVSATDGPVQREGGR

SEQ ID NO: 79144 - protein, 34 aa, Artificial Sequence
  Description of Artificial Sequence: Synthetic polypeptide
DEEEIRTTNPVATEQYGCVCSNTGALQNFGSNQA

SEQ ID NO: 79145 - protein, 32 aa, Artificial Sequence
  Description of Artificial Sequence: Synthetic polypeptide
DEMEIATTNPVATEQYGSVCSATDGLEHEGNL

SEQ ID NO: 79146 - protein, 32 aa, Artificial Sequence
  Description of Artificial Sequence: Synthetic polypeptide
DEEVIRTTNPVCTEIYGSVSTNLDDGGGQGRI

SEQ ID NO: 79147 - protein, 33 aa, Artificial Sequence
  Description of Artificial Sequence: Synthetic polypeptide
DEEVIRTTNPVAYERYGSVVSCTNAIQRPGGPR

SEQ ID NO: 79148 - protein, 31 aa, Artificial Sequence
  Description of Artificial Sequence: Synthetic polypeptide
DEMEIATTNPVATEQYGSVSATDLEDFEGEL

SEQ ID NO: 79149 - protein, 32 aa, Artificial Sequence
  Description of Artificial Sequence: Synthetic polypeptide
DEEEIRTTNPVATEQYGCVCSNTETQNSGSEF

SEQ ID NO: 79150 - protein, 32 aa, Artificial Sequence
  Description of Artificial Sequence: Synthetic polypeptide
DEEVISTTNPVAYEQYGTVSTNDLRDNGQNDR

SEQ ID NO: 79151 - protein, 32 aa, Artificial Sequence
  Description of Artificial Sequence: Synthetic polypeptide
DEEVIRTTNPVAYERYGSVSCTNISQRPGGPN

SEQ ID NO: 79152 - protein, 34 aa, Artificial Sequence
  Description of Artificial Sequence: Synthetic polypeptide
DEEEIRTTNPVATESYGSVYSTNCIMQKTLGNNN

SEQ ID NO: 79153 - protein, 34 aa, Artificial Sequence
  Description of Artificial Sequence: Synthetic polypeptide
DEEEIRTTNPVATESYGSVYSTNCIMQKCSGNPE

SEQ ID NO: 79154 - protein, 33 aa, Artificial Sequence
  Description of Artificial Sequence: Synthetic polypeptide
DEEEIRTTNPVATEQYGCVCSNTGEDQGFGSNQ

SEQ ID NO: 79155 - protein, 30 aa, Artificial Sequence
  Description of Artificial Sequence: Synthetic polypeptide
SEMEIRCTNPIATEQYGSVCSEGPEREGNR

SEQ ID NO: 79156 - protein, 34 aa, Artificial Sequence
  Description of Artificial Sequence: Synthetic polypeptide
AEEEIRTTNPVATEQYGSVSTNLDQQNNNNNNTE

SEQ ID NO: 79157 - protein, 32 aa, Artificial Sequence
  Description of Artificial Sequence: Synthetic polypeptide
TEEEIRTTNPVAYEQYGTIPSTGNELQPEGNN

SEQ ID NO: 79158 - protein, 33 aa, Artificial Sequence
  Description of Artificial Sequence: Synthetic polypeptide
TEEEIRTTNPVAYEQYGTTVSYNNGLSQSGNRC

SEQ ID NO: 79159 - protein, 32 aa, Artificial Sequence
  Description of Artificial Sequence: Synthetic polypeptide
TEEEIRTTNPVAYEQYGTVANNGLSQRVNNRN

SEQ ID NO: 79160 - protein, 33 aa, Artificial Sequence
  Description of Artificial Sequence: Synthetic polypeptide
DEEEIRTTNPVATEQYGCVCSWEDLQFFGSNQA

SEQ ID NO: 79161 - protein, 28 aa, Artificial Sequence
  Description of Artificial Sequence: Synthetic peptide
DEMEIASTNPVCTEQYGTVSDNPESGNQ

SEQ ID NO: 79162 - protein, 32 aa, Artificial Sequence
  Description of Artificial Sequence: Synthetic polypeptide
DEEEIRTTNPVATEQYGCVCSWEDQFFGSNQS

SEQ ID NO: 79163 - protein, 33 aa, Artificial Sequence
  Description of Artificial Sequence: Synthetic polypeptide
DEEEIRTTNPVATESYGSVVDFTNELTGGGENE

SEQ ID NO: 79164 - protein, 33 aa, Artificial Sequence
  Description of Artificial Sequence: Synthetic polypeptide
TEEEIRTTNPVAYEQYGTVQSNNGLSQRVNNRC

SEQ ID NO: 79165 - protein, 32 aa, Artificial Sequence
  Description of Artificial Sequence: Synthetic polypeptide
TEEEIRTTNPVAYEQYGTVSNNEFSGRGNNRC

SEQ ID NO: 79166 - protein, 28 aa, Artificial Sequence
  Description of Artificial Sequence: Synthetic peptide
DEMEIASVNPVATEQYGTVSDNPESGNQ

SEQ ID NO: 79167 - protein, 35 aa, Artificial Sequence
  Description of Artificial Sequence: Synthetic polypeptide
AEEEIRTTNPVATEQYGSVSTNLNGENQGETGNTD

SEQ ID NO: 79168 - protein, 32 aa, Artificial Sequence
  Description of Artificial Sequence: Synthetic polypeptide
TEEEIRTTNPVAYEQYGTVSNNELSDRGNNVC

SEQ ID NO: 79169 - protein, 29 aa, Artificial Sequence
  Description of Artificial Sequence: Synthetic peptide
AEEEIATTNPVATESYGCIANNLQVGDNE

SEQ ID NO: 79170 - protein, 29 aa, Artificial Sequence
  Description of Artificial Sequence: Synthetic peptide
DEMEIATTNPCATEQYGIVSCNPVQSGTD

SEQ ID NO: 79171 - protein, 31 aa, Artificial Sequence
  Description of Artificial Sequence: Synthetic polypeptide
QESEIRTTNPVATECWGSVSCNEPQREGENL

SEQ ID NO: 79172 - protein, 29 aa, Artificial Sequence
  Description of Artificial Sequence: Synthetic peptide
DEMEIATTNPCATEQYGTVSCNPVQSGTD

SEQ ID NO: 79173 - protein, 34 aa, Artificial Sequence
  Description of Artificial Sequence: Synthetic polypeptide
DEEEIRTTNPVATESYGSVVDFTNELTRGGNEEE

SEQ ID NO: 79174 - protein, 29 aa, Artificial Sequence
  Description of Artificial Sequence: Synthetic peptide
DEMEIATTNPCSSEQYGIVSCNLQSEGTR

SEQ ID NO: 79175 - protein, 29 aa, Artificial Sequence
  Description of Artificial Sequence: Synthetic peptide
DEMEIATTNPCSSEQYGIVSTGLQSEGTR

SEQ ID NO: 79176 - protein, 35 aa, Artificial Sequence
  Description of Artificial Sequence: Synthetic polypeptide
AEEEIRTTNPVATEQYGSVSTNLLQGTEQGNNQDE

SEQ ID NO: 79177 - protein, 35 aa, Artificial Sequence
  Description of Artificial Sequence: Synthetic polypeptide
AEEEIRTTNPVATEQYGSVSTNLNENQETGNNVEN

SEQ ID NO: 79178 - protein, 35 aa, Artificial Sequence
  Description of Artificial Sequence: Synthetic polypeptide
AEEEIRTTNPVATEQYGSVSTNLNENQETGTNQET

SEQ ID NO: 79179 - protein, 35 aa, Artificial Sequence
  Description of Artificial Sequence: Synthetic polypeptide
AEEEIRTTNPVATEQYGSVSTNLNENQGETGNTET

SEQ ID NO: 79180 - protein, 31 aa, Artificial Sequence
  Description of Artificial Sequence: Synthetic polypeptide
DEMEIATTNPCSTEQYGIVCSTDGLQSEGNR

SEQ ID NO: 79181 - protein, 30 aa, Artificial Sequence
  Description of Artificial Sequence: Synthetic polypeptide
DEMEIATTNPCSTEQYGIVCSTGLQSEGTR

SEQ ID NO: 79182 - protein, 33 aa, Artificial Sequence
  Description of Artificial Sequence: Synthetic polypeptide
TEEEIRTTNPVAYEQYGTVVSNNGLSQRGGNDC

SEQ ID NO: 79183 - protein, 32 aa, Artificial Sequence
  Description of Artificial Sequence: Synthetic polypeptide
DEEEIRTTNPVATEQYGCVCSWELQGFGSDQV

SEQ ID NO: 79184 - protein, 32 aa, Artificial Sequence
  Description of Artificial Sequence: Synthetic polypeptide
DEEEIRTTNPVATEQYGCVCSWELQGFGSEQN

SEQ ID NO: 79185 - protein, 31 aa, Artificial Sequence
  Description of Artificial Sequence: Synthetic polypeptide
DEMEIRTTNPVATDQYGCVSTVLERGDIFPL

SEQ ID NO: 79186 - protein, 35 aa, Artificial Sequence
  Description of Artificial Sequence: Synthetic polypeptide
AEEEIRTTNPVATEQYGSVSTNNQLQQGEQGTNSA

SEQ ID NO: 79187 - protein, 34 aa, Artificial Sequence
  Description of Artificial Sequence: Synthetic polypeptide
SEEEIRTTNPVAYEQYGSVCNCTNLDQPEGNNRH

SEQ ID NO: 79188 - protein, 35 aa, Artificial Sequence
  Description of Artificial Sequence: Synthetic polypeptide
AEEEIRTTNPVATEQYGSVSTNNQNLQAGNTTEDG

SEQ ID NO: 79189 - protein, 34 aa, Artificial Sequence
  Description of Artificial Sequence: Synthetic polypeptide
DEETIRTTNPVATEQYGVVSTTNQQLQLQGNNEE

SEQ ID NO: 79190 - protein, 32 aa, Artificial Sequence
  Description of Artificial Sequence: Synthetic polypeptide
DEMEIRTTNPVATEQYGCVSTVNLMERIDDQE

SEQ ID NO: 79191 - protein, 32 aa, Artificial Sequence
  Description of Artificial Sequence: Synthetic polypeptide
DEEEIRTTNPVATEQYGCVCSWGEHQNGSNQA

SEQ ID NO: 79192 - protein, 33 aa, Artificial Sequence
  Description of Artificial Sequence: Synthetic polypeptide
DEMEIRTTNPVATEQYGCVSTVNNLDQRDEDQQ

SEQ ID NO: 79193 - protein, 34 aa, Artificial Sequence
  Description of Artificial Sequence: Synthetic polypeptide
DEETIRTTNPVATEQYGVVSTTNQQLQFGNNEEE

SEQ ID NO: 79194 - protein, 33 aa, Artificial Sequence
  Description of Artificial Sequence: Synthetic polypeptide
DEMEIRTTNPVATEQYGCVSTVNNLHQRDDDQE

SEQ ID NO: 79195 - protein, 34 aa, Artificial Sequence
  Description of Artificial Sequence: Synthetic polypeptide
DEETIRTTNPVATEQYGVVSTTNQQLQEGGNNEE

SEQ ID NO: 79196 - protein, 34 aa, Artificial Sequence
  Description of Artificial Sequence: Synthetic polypeptide
AEEEIRTTNPVATEQYGSVSTNNQNQQTNGTNSA

SEQ ID NO: 79197 - protein, 32 aa, Artificial Sequence
  Description of Artificial Sequence: Synthetic polypeptide
SEEEIRTTNPVAYEQWGSVYSDTWDGQRSNNR

SEQ ID NO: 79198 - protein, 31 aa, Artificial Sequence
  Description of Artificial Sequence: Synthetic polypeptide
DEMEIRTTNPVATEQYGCVSTVWDIDMGENE

SEQ ID NO: 79199 - protein, 32 aa, Artificial Sequence
  Description of Artificial Sequence: Synthetic polypeptide
DEEEIRTTNPVATEQYGCVCSWGELQENGSEQ

SEQ ID NO: 79200 - protein, 33 aa, Artificial Sequence
  Description of Artificial Sequence: Synthetic polypeptide
DEAEIATTNPVATEQYGSVATNLQQDAGTGNDD

SEQ ID NO: 79201 - protein, 33 aa, Artificial Sequence
  Description of Artificial Sequence: Synthetic polypeptide
DEEEIRTTNPVATEQYGCVCSWGELQGFGSNQG

SEQ ID NO: 79202 - protein, 32 aa, Artificial Sequence
  Description of Artificial Sequence: Synthetic polypeptide
DEAEIATTNPVATEQYGSVATNLQQDDQNDEQ

SEQ ID NO: 79203 - protein, 32 aa, Artificial Sequence
  Description of Artificial Sequence: Synthetic polypeptide
SEEEIRTTNPVAYEQWGSVSWVDDEQRGMNQR

SEQ ID NO: 79204 - protein, 34 aa, Artificial Sequence
  Description of Artificial Sequence: Synthetic polypeptide
DEEEIRTTNPVATEQYGCVCSWGELQRFGSENQS

SEQ ID NO: 79205 - protein, 34 aa, Artificial Sequence
  Description of Artificial Sequence: Synthetic polypeptide
DEETIRTTNPVATEQYGTVVVVSTTNLQQIGNNQ

SEQ ID NO: 79206 - protein, 31 aa, Artificial Sequence
  Description of Artificial Sequence: Synthetic polypeptide
DEAEIATTNPVATCQYGCVSTALQRFGSDQG

SEQ ID NO: 79207 - protein, 31 aa, Artificial Sequence
  Description of Artificial Sequence: Synthetic polypeptide
DEMEIRTTNPVATEQYGCVSVTNNETNSDQR

SEQ ID NO: 79208 - protein, 34 aa, Artificial Sequence
  Description of Artificial Sequence: Synthetic polypeptide
DEETIRTTNPVATEQYGTVVTVVSTTNNLQIGNQ

SEQ ID NO: 79209 - protein, 33 aa, Artificial Sequence
  Description of Artificial Sequence: Synthetic polypeptide
TEGEIRTTNPVATEQWGSVSCTNLSQRPPNYPM

SEQ ID NO: 79210 - protein, 34 aa, Artificial Sequence
  Description of Artificial Sequence: Synthetic polypeptide
DEETIRTTNPVATEQYGTVVTVVSTNLQIGTNET

SEQ ID NO: 79211 - protein, 34 aa, Artificial Sequence
  Description of Artificial Sequence: Synthetic polypeptide
DEETIRTTNPVATEQYGTVVTVSTTNLQIGNQEE

SEQ ID NO: 79212 - protein, 31 aa, Artificial Sequence
  Description of Artificial Sequence: Synthetic polypeptide
DEMEIRTTNPVATEQYGDVCSTIEVEAAGND

SEQ ID NO: 79213 - protein, 31 aa, Artificial Sequence
  Description of Artificial Sequence: Synthetic polypeptide
TEGCIRTTNPVATEQYGSASCANYQRTGKNN

SEQ ID NO: 79214 - protein, 32 aa, Artificial Sequence
  Description of Artificial Sequence: Synthetic polypeptide
SEEEIRTTNPVAYERYGSCNCTNLDQQEGMNR

SEQ ID NO: 79215 - protein, 30 aa, Artificial Sequence
  Description of Artificial Sequence: Synthetic polypeptide
DEMEIRTTNPVATEQYGCVSTVDEDMFENE

SEQ ID NO: 79216 - protein, 33 aa, Artificial Sequence
  Description of Artificial Sequence: Synthetic polypeptide
DEMEIRTTNPVATEQYGCVSTTNNLDQRDDQQS

SEQ ID NO: 79217 - protein, 35 aa, Artificial Sequence
  Description of Artificial Sequence: Synthetic polypeptide
AEEEIRTTNPVATEQYGSVSTNNNQLQNDEGNNND

SEQ ID NO: 79218 - protein, 32 aa, Artificial Sequence
  Description of Artificial Sequence: Synthetic polypeptide
AEEEIATTNPVATEQYGCVAATNLQDRTGPPE

SEQ ID NO: 79219 - protein, 32 aa, Artificial Sequence
  Description of Artificial Sequence: Synthetic polypeptide
DEAEIATTNPVATECWGTVSTNLQGDVGDNSR

SEQ ID NO: 79220 - protein, 33 aa, Artificial Sequence
  Description of Artificial Sequence: Synthetic polypeptide
DEEEIRTTNPVATEQYGCVCSNSNLQFFNSDQE

SEQ ID NO: 79221 - protein, 33 aa, Artificial Sequence
  Description of Artificial Sequence: Synthetic polypeptide
DEEEIRTTNPVATEQYGCVCSNSNHQHFGSNDG

SEQ ID NO: 79222 - protein, 32 aa, Artificial Sequence
  Description of Artificial Sequence: Synthetic polypeptide
SEEEISTTNPVATEQYGCVCSTNLQFFGSDQA

SEQ ID NO: 79223 - protein, 32 aa, Artificial Sequence
  Description of Artificial Sequence: Synthetic polypeptide
DEMEIRTTNPVATEQYGCVSATNELQELEDEF

SEQ ID NO: 79224 - protein, 29 aa, Artificial Sequence
  Description of Artificial Sequence: Synthetic peptide
TEEVIACTNPVATEQYGCVATNLNMLNRN

SEQ ID NO: 79225 - protein, 32 aa, Artificial Sequence
  Description of Artificial Sequence: Synthetic polypeptide
DEMEIRTTNPVATEQYGCVSPTNLETLSDQRM

SEQ ID NO: 79226 - protein, 34 aa, Artificial Sequence
  Description of Artificial Sequence: Synthetic polypeptide
DEETIRTTNPVATEQYGVVSTTNQQLQQIGGNNE

SEQ ID NO: 79227 - protein, 32 aa, Artificial Sequence
  Description of Artificial Sequence: Synthetic polypeptide
DEMEIRTTNPVATEQYGCVSSVANLDQRDDQQ

SEQ ID NO: 79228 - protein, 31 aa, Artificial Sequence
  Description of Artificial Sequence: Synthetic polypeptide
DAEEIATTNPVATEQWGSVSENLQDQGDEQM

SEQ ID NO: 79229 - protein, 34 aa, Artificial Sequence
  Description of Artificial Sequence: Synthetic polypeptide
DEETIRTTNPVATEQYGVVSTTNQQLQQGNNDEV

SEQ ID NO: 79230 - protein, 30 aa, Artificial Sequence
  Description of Artificial Sequence: Synthetic polypeptide
SEEEIRTTNPVAYEHWGCFSINDLQDGNAR

SEQ ID NO: 79231 - protein, 31 aa, Artificial Sequence
  Description of Artificial Sequence: Synthetic polypeptide
DEMEIRTTNPVATEQYGCVSTLDLHPGDEDG

SEQ ID NO: 79232 - protein, 33 aa, Artificial Sequence
  Description of Artificial Sequence: Synthetic polypeptide
TEEVIRTTNPVATEQYGSVSTINLEFPNSGQNI

SEQ ID NO: 79233 - protein, 32 aa, Artificial Sequence
  Description of Artificial Sequence: Synthetic polypeptide
DEMEIRTTNPVATEQYGCVSTNLLQDVQDDDN

SEQ ID NO: 79234 - protein, 33 aa, Artificial Sequence
  Description of Artificial Sequence: Synthetic polypeptide
TEEVIRTTNPVATEQYGSVVHTNELSDNGGNRR

SEQ ID NO: 79235 - protein, 33 aa, Artificial Sequence
  Description of Artificial Sequence: Synthetic polypeptide
TEEVIRTTNPVATEQYGSVVSTNALSDNGGNHQ

SEQ ID NO: 79236 - protein, 31 aa, Artificial Sequence
  Description of Artificial Sequence: Synthetic polypeptide
DEAEIATTNPVATEQYGSVATNLQDPVEEGM

SEQ ID NO: 79237 - protein, 31 aa, Artificial Sequence
  Description of Artificial Sequence: Synthetic polypeptide
DAEEIATTNPVATECYGVVSTNLQNNPNEHQ

SEQ ID NO: 79238 - protein, 32 aa, Artificial Sequence
  Description of Artificial Sequence: Synthetic polypeptide
DEMEIRTTNPVATEQYGCVSTPDLQLSGEEKN

SEQ ID NO: 79239 - protein, 35 aa, Artificial Sequence
  Description of Artificial Sequence: Synthetic polypeptide
AEEEIRTTNPVATEQYGSVSTNNQLGNNQQGNLND

SEQ ID NO: 79240 - protein, 31 aa, Artificial Sequence
  Description of Artificial Sequence: Synthetic polypeptide
DEMEIRTTNPVATEQYGCVSTQLLIQTQDDD

SEQ ID NO: 79241 - protein, 35 aa, Artificial Sequence
  Description of Artificial Sequence: Synthetic polypeptide
AEEEIRTTNPVATEQYGSVSTNNQLGNQQGEEQNA

SEQ ID NO: 79242 - protein, 35 aa, Artificial Sequence
  Description of Artificial Sequence: Synthetic polypeptide
AEEEIRTTNPVATEQYGSVSTNNQLGNTQQGENND

SEQ ID NO: 79243 - protein, 31 aa, Artificial Sequence
  Description of Artificial Sequence: Synthetic polypeptide
TEEVIRTTNPVAYEQWGKTVSTNLSMVGNRF

SEQ ID NO: 79244 - protein, 31 aa, Artificial Sequence
  Description of Artificial Sequence: Synthetic polypeptide
DEMEIRTTNPVATEQYGCVSTQLLQSLQDDI

SEQ ID NO: 79245 - protein, 33 aa, Artificial Sequence
  Description of Artificial Sequence: Synthetic polypeptide
DEEEIRTTNPVATEQYGCVCSNSMELQGFGSNQ

SEQ ID NO: 79246 - protein, 34 aa, Artificial Sequence
  Description of Artificial Sequence: Synthetic polypeptide
DEEEIRTTNPVATEQYGVVSTSTNNLNLQGTNMT

SEQ ID NO: 79247 - protein, 35 aa, Artificial Sequence
  Description of Artificial Sequence: Synthetic polypeptide
AEEEIRTTNPVATEQYGSVSTNNQQLQQEGTNVTE

SEQ ID NO: 79248 - protein, 34 aa, Artificial Sequence
  Description of Artificial Sequence: Synthetic polypeptide
DEETIRTTNPVATEQYGTVVTVSTNLQQQIGTNE

SEQ ID NO: 79249 - protein, 31 aa, Artificial Sequence
  Description of Artificial Sequence: Synthetic polypeptide
DEAEIATTNPVATEQYGSVATNPAGNPNVRN

SEQ ID NO: 79250 - protein, 32 aa, Artificial Sequence
  Description of Artificial Sequence: Synthetic polypeptide
DEEEIRTTNPVATEQYGCVCSWMNLTSFGSQQ

SEQ ID NO: 79251 - protein, 32 aa, Artificial Sequence
  Description of Artificial Sequence: Synthetic polypeptide
DEEEIRTTNPVATEQYGCVCSWMNPINSGSNQ

SEQ ID NO: 79252 - protein, 32 aa, Artificial Sequence
  Description of Artificial Sequence: Synthetic polypeptide
DEEEIRTTNPVATEQYGCVCSWNDHQNFGSDQ

SEQ ID NO: 79253 - protein, 33 aa, Artificial Sequence
  Description of Artificial Sequence: Synthetic polypeptide
DEEEIRTTNPVATEQYGCVCSWNDPQESFGSNQ

SEQ ID NO: 79254 - protein, 33 aa, Artificial Sequence
  Description of Artificial Sequence: Synthetic polypeptide
DEEEIRTTNPLATEPYGSVFCTNLSQTTVTENR

SEQ ID NO: 79255 - protein, 34 aa, Artificial Sequence
  Description of Artificial Sequence: Synthetic polypeptide
AEEEIRTTNPVATEQYGSVSTNQNNENQETGNNT

SEQ ID NO: 79256 - protein, 32 aa, Artificial Sequence
  Description of Artificial Sequence: Synthetic polypeptide
DEEEIRTTNPVATEQYGCVCSWNHARFNSNQS

SEQ ID NO: 79257 - protein, 33 aa, Artificial Sequence
  Description of Artificial Sequence: Synthetic polypeptide
DEEEIRTTNPVATEQYGCVCSWNHNQNFGSNQA

SEQ ID NO: 79258 - protein, 30 aa, Artificial Sequence
  Description of Artificial Sequence: Synthetic polypeptide
DEAEIATTNPVATEQYGSVATPLENRQEDM

SEQ ID NO: 79259 - protein, 33 aa, Artificial Sequence
  Description of Artificial Sequence: Synthetic polypeptide
SEEEIRTTNPVATESYGSVTSNTNLESWGDERQ

SEQ ID NO: 79260 - protein, 30 aa, Artificial Sequence
  Description of Artificial Sequence: Synthetic polypeptide
DEAEIATTNPVATEQYGSVATPLGTDNNDV

SEQ ID NO: 79261 - protein, 31 aa, Artificial Sequence
  Description of Artificial Sequence: Synthetic polypeptide
DEAEIATTNPVATEQYGSVATPNLDNNYDER

SEQ ID NO: 79262 - protein, 33 aa, Artificial Sequence
  Description of Artificial Sequence: Synthetic polypeptide
DEEEIRTTNPVATEQYGCVCSWMNLINGSNNQS

SEQ ID NO: 79263 - protein, 33 aa, Artificial Sequence
  Description of Artificial Sequence: Synthetic polypeptide
DEETIRTTNPVATEQYGSVSTTTQEQLGGNTTE

SEQ ID NO: 79264 - protein, 34 aa, Artificial Sequence
  Description of Artificial Sequence: Synthetic polypeptide
DEETIRTTNPVATEQYGSVSTTQQEQLQGGNTTE

SEQ ID NO: 79265 - protein, 31 aa, Artificial Sequence
  Description of Artificial Sequence: Synthetic polypeptide
DEEEIRTTNPLATEGYGCCSTNLASFGSNQS

SEQ ID NO: 79266 - protein, 31 aa, Artificial Sequence
  Description of Artificial Sequence: Synthetic polypeptide
DEEEIRTTNPLATDAYGQVPCTDLSQRGGNE

SEQ ID NO: 79267 - protein, 33 aa, Artificial Sequence
  Description of Artificial Sequence: Synthetic polypeptide
DEEEIRTTNPVATEQYGCVCSWNHQSFGSNNAS

SEQ ID NO: 79268 - protein, 35 aa, Artificial Sequence
  Description of Artificial Sequence: Synthetic polypeptide
DEETIRTTNPVATEQYGSVSTTNQQQLQAGNNQSE

SEQ ID NO: 79269 - protein, 32 aa, Artificial Sequence
  Description of Artificial Sequence: Synthetic polypeptide
DEEEIRTTNPVATEQYGCVCSWNLANFGSEQS

SEQ ID NO: 79270 - protein, 30 aa, Artificial Sequence
  Description of Artificial Sequence: Synthetic polypeptide
DEEEIRTTNPISTEQYGTISEDIQQQQGNR

SEQ ID NO: 79271 - protein, 35 aa, Artificial Sequence
  Description of Artificial Sequence: Synthetic polypeptide
DEETIRTTNPVATEQYGSVSTTNQNQLQAGNNQTS

SEQ ID NO: 79272 - protein, 31 aa, Artificial Sequence
  Description of Artificial Sequence: Synthetic polypeptide
DEEEIRTTNPIAYEQYGSVQCTGLSNRGGSE

SEQ ID NO: 79273 - protein, 35 aa, Artificial Sequence
  Description of Artificial Sequence: Synthetic polypeptide
DEETIRTTNPVATEQYGSVSTTNQEQLQLGNNNTE

SEQ ID NO: 79274 - protein, 33 aa, Artificial Sequence
  Description of Artificial Sequence: Synthetic polypeptide
DEEEIRTTNPVATEQYGCVCSWNLQEGFGSEQG

SEQ ID NO: 79275 - protein, 32 aa, Artificial Sequence
  Description of Artificial Sequence: Synthetic polypeptide
DEAEIATTNPMATEQWGSVPTNLQHEHGGNGR

SEQ ID NO: 79276 - protein, 31 aa, Artificial Sequence
  Description of Artificial Sequence: Synthetic polypeptide
DEEEIRTTNPIAYEQYGSVPCTGLSPRGGSP

SEQ ID NO: 79277 - protein, 31 aa, Artificial Sequence
  Description of Artificial Sequence: Synthetic polypeptide
DEAEIATTNPVATEQYGSVATSLADRGDTSN

SEQ ID NO: 79278 - protein, 35 aa, Artificial Sequence
  Description of Artificial Sequence: Synthetic polypeptide
AEEEIRTTNPVATEQYGSVSTNNNQLNQTGEQGNE

SEQ ID NO: 79279 - protein, 31 aa, Artificial Sequence
  Description of Artificial Sequence: Synthetic polypeptide
SEEEIRTTNPVATESYGTVSNGNDHERGDQR

SEQ ID NO: 79280 - protein, 33 aa, Artificial Sequence
  Description of Artificial Sequence: Synthetic polypeptide
DEEEIRTTNPVATEQYGCVCSWMELQRFGSEQT

SEQ ID NO: 79281 - protein, 33 aa, Artificial Sequence
  Description of Artificial Sequence: Synthetic polypeptide
DEAEIATTNPVATEQYGSVATNLQQGQGTNNDV

SEQ ID NO: 79282 - protein, 33 aa, Artificial Sequence
  Description of Artificial Sequence: Synthetic polypeptide
DEEEIRTTNPVATEQYGCVCSWGNHDQNFGSNQ

SEQ ID NO: 79283 - protein, 33 aa, Artificial Sequence
  Description of Artificial Sequence: Synthetic polypeptide
DEAEIATTNPVATEQYGSVATNLQTADGPEENQ

SEQ ID NO: 79284 - protein, 32 aa, Artificial Sequence
  Description of Artificial Sequence: Synthetic polypeptide
DEEEIRTTNPVATEQYGCVCSWGNHQHFGSEA

SEQ ID NO: 79285 - protein, 34 aa, Artificial Sequence
  Description of Artificial Sequence: Synthetic polypeptide
DEETIRTTNPVATEQYGTVSVTSNNNNLQQGDER

SEQ ID NO: 79286 - protein, 33 aa, Artificial Sequence
  Description of Artificial Sequence: Synthetic polypeptide
DEAEIATTNPVATEQYGSVATNLQTAPGGEARN

SEQ ID NO: 79287 - protein, 31 aa, Artificial Sequence
  Description of Artificial Sequence: Synthetic polypeptide
DEMEIRTTNPVATEQYGDVCSTIEVEAEGND

SEQ ID NO: 79288 - protein, 34 aa, Artificial Sequence
  Description of Artificial Sequence: Synthetic polypeptide
DEETIRTTNPVATEQYGTVSVSNNNLQQGDEQRE

SEQ ID NO: 79289 - protein, 30 aa, Artificial Sequence
  Description of Artificial Sequence: Synthetic polypeptide
DEMEIRTTNPVATEQYGDVSATGPEFAGDD

SEQ ID NO: 79290 - protein, 34 aa, Artificial Sequence
  Description of Artificial Sequence: Synthetic polypeptide
DEETIRTTNPVATEQYGTVSTVNSNGNLQQGDER

SEQ ID NO: 79291 - protein, 33 aa, Artificial Sequence
  Description of Artificial Sequence: Synthetic polypeptide
DEEEIRTTNPVATEQYGCVCSWGNHQSFGSNQS

SEQ ID NO: 79292 - protein, 32 aa, Artificial Sequence
  Description of Artificial Sequence: Synthetic polypeptide
TEHEIRTTNPVATEAYGSVVSTYLSQPTGGNQ

SEQ ID NO: 79293 - protein, 33 aa, Artificial Sequence
  Description of Artificial Sequence: Synthetic polypeptide
DEEEIRTTNPVATEQYGCVCSWGNHQYFGSNQN

SEQ ID NO: 79294 - protein, 31 aa, Artificial Sequence
  Description of Artificial Sequence: Synthetic polypeptide
DEAEIATTNPVATCQYGCVCSTADQRGSNQG

SEQ ID NO: 79295 - protein, 32 aa, Artificial Sequence
  Description of Artificial Sequence: Synthetic polypeptide
DEAEIATTNPVATEQYGSVATNLTEAQGNNHN

SEQ ID NO: 79296 - protein, 34 aa, Artificial Sequence
  Description of Artificial Sequence: Synthetic polypeptide
DEEEIRTTNPVATEQYGCVCSWGNLQEGFGSNQA

SEQ ID NO: 79297 - protein, 32 aa, Artificial Sequence
  Description of Artificial Sequence: Synthetic polypeptide
AEEEIATTNPVATEQWGSVSTNLQGQGGDVTL

SEQ ID NO: 79298 - protein, 33 aa, Artificial Sequence
  Description of Artificial Sequence: Synthetic polypeptide
DEEEIRTTNPVATEQYGCVCSWGNLQFFGSEAE

SEQ ID NO: 79299 - protein, 31 aa, Artificial Sequence
  Description of Artificial Sequence: Synthetic polypeptide
TENEIACTNPVATEQYGEASENALQRGGGNR

SEQ ID NO: 79300 - protein, 35 aa, Artificial Sequence
  Description of Artificial Sequence: Synthetic polypeptide
DEETIRTTNPVATEQYGSVSTVNLQNNNNGQNQDE

SEQ ID NO: 79301 - protein, 30 aa, Artificial Sequence
  Description of Artificial Sequence: Synthetic polypeptide
TENEIACTNPVATEQYGEASENNLSQRGGR

SEQ ID NO: 79302 - protein, 33 aa, Artificial Sequence
  Description of Artificial Sequence: Synthetic polypeptide
DEETIRTTNPVATEQYGSVSTVATLGRQAENNT

SEQ ID NO: 79303 - protein, 33 aa, Artificial Sequence
  Description of Artificial Sequence: Synthetic polypeptide
DEEEIRTTNPVATEQYGCVCSWGNLQNSGSEQQ

SEQ ID NO: 79304 - protein, 30 aa, Artificial Sequence
  Description of Artificial Sequence: Synthetic polypeptide
DEAEIATTNPVATEQYGSVATNNDAMPNPV

SEQ ID NO: 79305 - protein, 33 aa, Artificial Sequence
  Description of Artificial Sequence: Synthetic polypeptide
AEEEIRTTNPVATEQYGSVSTNQNLLNNQEETQ

SEQ ID NO: 79306 - protein, 30 aa, Artificial Sequence
  Description of Artificial Sequence: Synthetic polypeptide
DAEEIATTNPCAYEPYGSVSANLQRDPNES

SEQ ID NO: 79307 - protein, 30 aa, Artificial Sequence
  Description of Artificial Sequence: Synthetic polypeptide
TENEIACTNPVATEQYGEISENELQRGGGR

SEQ ID NO: 79308 - protein, 32 aa, Artificial Sequence
  Description of Artificial Sequence: Synthetic polypeptide
DEAEIATTNPVATEQYGSVATNNLQGDNDPLN

SEQ ID NO: 79309 - protein, 33 aa, Artificial Sequence
  Description of Artificial Sequence: Synthetic polypeptide
DEETIRTTNPVATEQYGSVSTVTELMFQAMNTY

SEQ ID NO: 79310 - protein, 31 aa, Artificial Sequence
  Description of Artificial Sequence: Synthetic polypeptide
DAEEIATTNPVATEQWGSVTSADLQDDGPRM

SEQ ID NO: 79311 - protein, 32 aa, Artificial Sequence
  Description of Artificial Sequence: Synthetic polypeptide
TEESIRTTNPVATEQYGSVSPANMQATGGNYG

SEQ ID NO: 79312 - protein, 35 aa, Artificial Sequence
  Description of Artificial Sequence: Synthetic polypeptide
AEEEIRTTNPVATEQYGSVSTNNNQLGNTQQGNNE

SEQ ID NO: 79313 - protein, 31 aa, Artificial Sequence
  Description of Artificial Sequence: Synthetic polypeptide
DEEVIATTNPVAYEQYGTVSTMDLRDNGQNR

SEQ ID NO: 79314 - protein, 32 aa, Artificial Sequence
  Description of Artificial Sequence: Synthetic polypeptide
DEEEIRTTNPVATESYGVVSTVNGFEGEGGNI

SEQ ID NO: 79315 - protein, 33 aa, Artificial Sequence
  Description of Artificial Sequence: Synthetic polypeptide
DEEEIRTTNPVATEQYGCVCSWENLQNFGSDQI

SEQ ID NO: 79316 - protein, 32 aa, Artificial Sequence
  Description of Artificial Sequence: Synthetic polypeptide
SEEIIRTTNPVATEQYGCVSTNECEQFGNNSK

SEQ ID NO: 79317 - protein, 31 aa, Artificial Sequence
  Description of Artificial Sequence: Synthetic polypeptide
TEEGIRTTNPVATEQYGSVSTLNLSPEIQDE

SEQ ID NO: 79318 - protein, 32 aa, Artificial Sequence
  Description of Artificial Sequence: Synthetic polypeptide
DDEEIRTTNPVATEQYGSVTDDNLMPNTGVQR

SEQ ID NO: 79319 - protein, 32 aa, Artificial Sequence
  Description of Artificial Sequence: Synthetic polypeptide
DEEEIRTTNPVATEQYGCVCSWEPQGFGSNQN

SEQ ID NO: 79320 - protein, 33 aa, Artificial Sequence
  Description of Artificial Sequence: Synthetic polypeptide
DEEEIRTTNPVATESYGVVSTVNLNFNGGENGD

SEQ ID NO: 79321 - protein, 32 aa, Artificial Sequence
  Description of Artificial Sequence: Synthetic polypeptide
DEEVIATTNPVATEQYGSVATNLPDNEQNHRH

SEQ ID NO: 79322 - protein, 31 aa, Artificial Sequence
  Description of Artificial Sequence: Synthetic polypeptide
DEEVIATTNPVATEQYGSVATGLPDNEQNTR

SEQ ID NO: 79323 - protein, 32 aa, Artificial Sequence
  Description of Artificial Sequence: Synthetic polypeptide
DDEEIRTTNPVATEQYGSVTDTTWLETSSQNR

SEQ ID NO: 79324 - protein, 29 aa, Artificial Sequence
  Description of Artificial Sequence: Synthetic peptide
DEEVIATTNPVATEQYGCVAATNDTMGSS

SEQ ID NO: 79325 - protein, 32 aa, Artificial Sequence
  Description of Artificial Sequence: Synthetic polypeptide
DEMEIRTTNPVATEQWGSVSCIGPVQDREGNG

SEQ ID NO: 79326 - protein, 32 aa, Artificial Sequence
  Description of Artificial Sequence: Synthetic polypeptide
TEEGIRTTNPVATEQYGSTVSTNEVSSMVGNQ

SEQ ID NO: 79327 - protein, 32 aa, Artificial Sequence
  Description of Artificial Sequence: Synthetic polypeptide
DEMEIRTTNPVATEQWGTVSCINEPQREGENG

SEQ ID NO: 79328 - protein, 28 aa, Artificial Sequence
  Description of Artificial Sequence: Synthetic peptide
AEEEIATTNPVATEQYGEASEVLQHEEK

SEQ ID NO: 79329 - protein, 34 aa, Artificial Sequence
  Description of Artificial Sequence: Synthetic polypeptide
AEEEIRTTNPVATEQYGSVSTNNNDENQETGNSG

SEQ ID NO: 79330 - protein, 28 aa, Artificial Sequence
  Description of Artificial Sequence: Synthetic peptide
AEEEIATTNPVATEQYGEASEVCQREEK

SEQ ID NO: 79331 - protein, 28 aa, Artificial Sequence
  Description of Artificial Sequence: Synthetic peptide
AEEEIATTNPVATEQYGEASENCQHEEK

SEQ ID NO: 79332 - protein, 33 aa, Artificial Sequence
  Description of Artificial Sequence: Synthetic polypeptide
DDEEIRTTNPVATEQYGSVTSDTGDQGGNGNGD

SEQ ID NO: 79333 - protein, 34 aa, Artificial Sequence
  Description of Artificial Sequence: Synthetic polypeptide
AEEEIRTTNPVATEQYGSVSTNNNDENQETGNTE

SEQ ID NO: 79334 - protein, 32 aa, Artificial Sequence
  Description of Artificial Sequence: Synthetic polypeptide
DEEVIATTNPVATEQWGCVAATNNLDQPGVNR

SEQ ID NO: 79335 - protein, 28 aa, Artificial Sequence
  Description of Artificial Sequence: Synthetic peptide
AEEEIATTNPVATEQYGEAPEVCQREER

SEQ ID NO: 79336 - protein, 32 aa, Artificial Sequence
  Description of Artificial Sequence: Synthetic polypeptide
DEMEIRTTNPVATEQWGTVSTINPPQFEGENG

SEQ ID NO: 79337 - protein, 34 aa, Artificial Sequence
  Description of Artificial Sequence: Synthetic polypeptide
AEEEIRTTNPVATEQYGSVSTNNNDENQETGTNM

SEQ ID NO: 79338 - protein, 32 aa, Artificial Sequence
  Description of Artificial Sequence: Synthetic polypeptide
DEEVIATTNPVATEIYGSVSTCNLDDGGGQGR

SEQ ID NO: 79339 - protein, 32 aa, Artificial Sequence
  Description of Artificial Sequence: Synthetic polypeptide
DEMEIRTTNPVATEQYGCICSTNTNQGFGSDR

SEQ ID NO: 79340 - protein, 31 aa, Artificial Sequence
  Description of Artificial Sequence: Synthetic polypeptide
TEEGIRTTNPVATEQYGSVSTSLLSMQLEQE

SEQ ID NO: 79341 - protein, 32 aa, Artificial Sequence
  Description of Artificial Sequence: Synthetic polypeptide
DEMEIRTTNPVATEQWGTVSTINEPQFEGENG

SEQ ID NO: 79342 - protein, 31 aa, Artificial Sequence
  Description of Artificial Sequence: Synthetic polypeptide
TEEGIRTTNPVATEQYGSVSTSLLSMQTNET

SEQ ID NO: 79343 - protein, 34 aa, Artificial Sequence
  Description of Artificial Sequence: Synthetic polypeptide
DEEEIRTTNPVATEQYGCVCSWENLQEFFGSNDG

SEQ ID NO: 79344 - protein, 34 aa, Artificial Sequence
  Description of Artificial Sequence: Synthetic polypeptide
DEEEIRTTNPVATEQYGCVCSWENLARFGSQNQS

SEQ ID NO: 79345 - protein, 31 aa, Artificial Sequence
  Description of Artificial Sequence: Synthetic polypeptide
DEMEIRTTNPVATDQYGCVSTVLTFRGIEPM

SEQ ID NO: 79346 - protein, 32 aa, Artificial Sequence
  Description of Artificial Sequence: Synthetic polypeptide
DEEEIRTTNPVATEQYGCVCSWELQHFNSQQS

SEQ ID NO: 79347 - protein, 32 aa, Artificial Sequence
  Description of Artificial Sequence: Synthetic polypeptide
DEEEIRTTNPVATEQYGCVCSWELQNFGSEQA

SEQ ID NO: 79348 - protein, 31 aa, Artificial Sequence
  Description of Artificial Sequence: Synthetic polypeptide
DEMEIRTTNPVATDQYGCVSTVVLERGIEPM

SEQ ID NO: 79349 - protein, 33 aa, Artificial Sequence
  Description of Artificial Sequence: Synthetic polypeptide
AEEEIRTTNPVATEQYGSVSTNLQQNQEDTDED

SEQ ID NO: 79350 - protein, 32 aa, Artificial Sequence
  Description of Artificial Sequence: Synthetic polypeptide
DEEEIRTTNPVATEQYGCVCSWELQNSGSEAA

SEQ ID NO: 79351 - protein, 30 aa, Artificial Sequence
  Description of Artificial Sequence: Synthetic polypeptide
TEEGIATTNPVAYEQYGTVSTNDSGGDNTR

SEQ ID NO: 79352 - protein, 35 aa, Artificial Sequence
  Description of Artificial Sequence: Synthetic polypeptide
AEEEIRTTNPVATEQYGSVSTNLQQQQGNGNNQDE

SEQ ID NO: 79353 - protein, 29 aa, Artificial Sequence
  Description of Artificial Sequence: Synthetic peptide
TEEGIATTNPVAYEQYGTVSTNDSGHNER

SEQ ID NO: 79354 - protein, 32 aa, Artificial Sequence
  Description of Artificial Sequence: Synthetic polypeptide
TEEGICTTNPVATEQYGSVSCLNSSQRGTNNS

SEQ ID NO: 79355 - protein, 34 aa, Artificial Sequence
  Description of Artificial Sequence: Synthetic polypeptide
DEEEIRTTNPVATEQYGCVCSNTEELQNGSDNQG

SEQ ID NO: 79356 - protein, 34 aa, Artificial Sequence
  Description of Artificial Sequence: Synthetic polypeptide
DEEEIRTTNPVATEQYGCVCSNTEELQHFGSNII

SEQ ID NO: 79357 - protein, 31 aa, Artificial Sequence
  Description of Artificial Sequence: Synthetic polypeptide
DEEVIRATNPVATEQYGSVMYTELGIGNDGF

SEQ ID NO: 79358 - protein, 32 aa, Artificial Sequence
  Description of Artificial Sequence: Synthetic polypeptide
TEEGIRTTNPVATEHYGSVSCTNLSSMTVTNR

SEQ ID NO: 79359 - protein, 34 aa, Artificial Sequence
  Description of Artificial Sequence: Synthetic polypeptide
DEEEIRTTNPVATEQYGCVCSNTEEHQRFGSNQT

SEQ ID NO: 79360 - protein, 33 aa, Artificial Sequence
  Description of Artificial Sequence: Synthetic polypeptide
DEEVIQTTNPVATEIYGISVSTNLDDGGHGNIR

SEQ ID NO: 79361 - protein, 32 aa, Artificial Sequence
  Description of Artificial Sequence: Synthetic polypeptide
DEEEIRTTNPVATEQYGCVCSWENHQFFGSEV

SEQ ID NO: 79362 - protein, 31 aa, Artificial Sequence
  Description of Artificial Sequence: Synthetic polypeptide
DEMEIRTTNPVATECWGTVSTDNEPEREGNG

SEQ ID NO: 79363 - protein, 33 aa, Artificial Sequence
  Description of Artificial Sequence: Synthetic polypeptide
DDEEIRTTNPVATEQYGSVSTTGDQGGNGNQGD

SEQ ID NO: 79364 - protein, 33 aa, Artificial Sequence
  Description of Artificial Sequence: Synthetic polypeptide
AEEEIATTNPVATEQYGSNTSCNLPQVEGNGRE

SEQ ID NO: 79365 - protein, 32 aa, Artificial Sequence
  Description of Artificial Sequence: Synthetic polypeptide
DEEVIKTTNPVATEIYGWVVSTNLDDGNGQGR

SEQ ID NO: 79366 - protein, 30 aa, Artificial Sequence
  Description of Artificial Sequence: Synthetic polypeptide
TEEGICTTNPVAYEAYGSVSLNSSQRGNNS

SEQ ID NO: 79367 - protein, 31 aa, Artificial Sequence
  Description of Artificial Sequence: Synthetic polypeptide
TEEGICTTNPVAYEQYGSVSCANSSQRGGNS

SEQ ID NO: 79368 - protein, 32 aa, Artificial Sequence
  Description of Artificial Sequence: Synthetic polypeptide
DEMEIRTTNPVATEQFGTCVSTYLLRGGNESN

SEQ ID NO: 79369 - protein, 34 aa, Artificial Sequence
  Description of Artificial Sequence: Synthetic polypeptide
DDEEIRTTNPVATEQYGSVSTTMNQGGQNGEGNG

SEQ ID NO: 79370 - protein, 32 aa, Artificial Sequence
  Description of Artificial Sequence: Synthetic polypeptide
DEEEIRTTNPVATEQYGCVCSWENLANFNSQQ

SEQ ID NO: 79371 - protein, 33 aa, Artificial Sequence
  Description of Artificial Sequence: Synthetic polypeptide
DDEEIRTTNPVATEQYGSVSTVDNLNGNGDEQG

SEQ ID NO: 79372 - protein, 29 aa, Artificial Sequence
  Description of Artificial Sequence: Synthetic peptide
DEEVIATVNPVAYEPYGSVSAALDRGDNN

SEQ ID NO: 79373 - protein, 33 aa, Artificial Sequence
  Description of Artificial Sequence: Synthetic polypeptide
DEEEIRTTNPVATEQYGCVCSWENHQEYFGSNQ

SEQ ID NO: 79374 - protein, 28 aa, Artificial Sequence
  Description of Artificial Sequence: Synthetic peptide
SENEIACTNPVATECYGDVSECLQREER

SEQ ID NO: 79375 - protein, 33 aa, Artificial Sequence
  Description of Artificial Sequence: Synthetic polypeptide
DEEEIRTTNPVATEQYGCVCSNTEDQYFGSNQM

SEQ ID NO: 79376 - protein, 32 aa, Artificial Sequence
  Description of Artificial Sequence: Synthetic polypeptide
TEEGIRTTNPVATEQYGSVSTSLTESMQLNQR

SEQ ID NO: 79377 - protein, 31 aa, Artificial Sequence
  Description of Artificial Sequence: Synthetic polypeptide
DEETIRTTNPVATETYGQVTTENLQMAVNNP

SEQ ID NO: 79378 - protein, 29 aa, Artificial Sequence
  Description of Artificial Sequence: Synthetic peptide
TEENIATTNPVAYEQYGTVSWNDSGGDNR

SEQ ID NO: 79379 - protein, 31 aa, Artificial Sequence
  Description of Artificial Sequence: Synthetic polypeptide
TEENIRTTNPVAYEAYGQVACTNLSQRGTNV

SEQ ID NO: 79380 - protein, 30 aa, Artificial Sequence
  Description of Artificial Sequence: Synthetic polypeptide
TEEPIATTNPVATEQYGCVAATNLAMLGER

SEQ ID NO: 79381 - protein, 28 aa, Artificial Sequence
  Description of Artificial Sequence: Synthetic peptide
SEEEIYATNPEATEQYGSVSTGPQHETV

SEQ ID NO: 79382 - protein, 34 aa, Artificial Sequence
  Description of Artificial Sequence: Synthetic polypeptide
TEEPIRTTNPVATEQYGSVSTLMLSQHTGGNNRM

SEQ ID NO: 79383 - protein, 32 aa, Artificial Sequence
  Description of Artificial Sequence: Synthetic polypeptide
DDEEIRTTNPVATEQYGSVVPESNVLNRDGFF

SEQ ID NO: 79384 - protein, 34 aa, Artificial Sequence
  Description of Artificial Sequence: Synthetic polypeptide
DEETIRTTNPVATEQYGVVSVVSNNLQQGIGDNV

SEQ ID NO: 79385 - protein, 29 aa, Artificial Sequence
  Description of Artificial Sequence: Synthetic peptide
TEESIACTNPVATEQYGSVAMNLNMLNRN

SEQ ID NO: 79386 - protein, 28 aa, Artificial Sequence
  Description of Artificial Sequence: Synthetic peptide
TEESIACTNPVATEQYGSVAMNLNMPNH

SEQ ID NO: 79387 - protein, 29 aa, Artificial Sequence
  Description of Artificial Sequence: Synthetic peptide
TEESIACTNPVATEQYGSVATNLNMLGEN

SEQ ID NO: 79388 - protein, 32 aa, Artificial Sequence
  Description of Artificial Sequence: Synthetic polypeptide
DAEEIATTNPVATEQWGSVTSATGLQQGGGER

SEQ ID NO: 79389 - protein, 29 aa, Artificial Sequence
  Description of Artificial Sequence: Synthetic peptide
TEESIACTNPVATEQYGSVATNLNMSLER

SEQ ID NO: 79390 - protein, 31 aa, Artificial Sequence
  Description of Artificial Sequence: Synthetic polypeptide
DEETIRTTNPVATETYGSVTVYNLDSDGIMR

SEQ ID NO: 79391 - protein, 31 aa, Artificial Sequence
  Description of Artificial Sequence: Synthetic polypeptide
AEEEIATTNPVATEQYGCVATNLQDDQNGSM

SEQ ID NO: 79392 - protein, 32 aa, Artificial Sequence
  Description of Artificial Sequence: Synthetic polypeptide
TEESIATTNPVATEQYGSVSWNEGQDRQGNSS

SEQ ID NO: 79393 - protein, 34 aa, Artificial Sequence
  Description of Artificial Sequence: Synthetic polypeptide
DEEEIRTTNPVATEQYGCVCSNTALQNFGSNNQS

SEQ ID NO: 79394 - protein, 33 aa, Artificial Sequence
  Description of Artificial Sequence: Synthetic polypeptide
DEMEIRTTNPVATEQYGCVCSTELQENFGSNQA

SEQ ID NO: 79395 - protein, 35 aa, Artificial Sequence
  Description of Artificial Sequence: Synthetic polypeptide
DEETIRTTNPVATEQYGVVSTVSNTNLQQGIGDNV

SEQ ID NO: 79396 - protein, 30 aa, Artificial Sequence
  Description of Artificial Sequence: Synthetic polypeptide
SEEEIVCTNPVATEQYGSVSEGLVEFEGND

SEQ ID NO: 79397 - protein, 31 aa, Artificial Sequence
  Description of Artificial Sequence: Synthetic polypeptide
SEEEIVCTNPVATEQYGSVSATGLVEFEGND

SEQ ID NO: 79398 - protein, 30 aa, Artificial Sequence
  Description of Artificial Sequence: Synthetic polypeptide
SEEEIVCTNPIATEQYGTVSEGLVEREGNR

SEQ ID NO: 79399 - protein, 29 aa, Artificial Sequence
  Description of Artificial Sequence: Synthetic peptide
TEESIATTNPVAYEQYGTVSKNLEDLGNA

SEQ ID NO: 79400 - protein, 32 aa, Artificial Sequence
  Description of Artificial Sequence: Synthetic polypeptide
DEMEIRTTNPVATEQYGCVCSTELQFFNSDQE

SEQ ID NO: 79401 - protein, 33 aa, Artificial Sequence
  Description of Artificial Sequence: Synthetic polypeptide
TEESINTTNPVAYEQYGSTVPSCTPNLDRGGNR

SEQ ID NO: 79402 - protein, 35 aa, Artificial Sequence
  Description of Artificial Sequence: Synthetic polypeptide
AEEEIRTTNPVATEQYGSVSTNNNQLGNQQGNNND

SEQ ID NO: 79403 - protein, 30 aa, Artificial Sequence
  Description of Artificial Sequence: Synthetic polypeptide
SEEEIVCTNPIATEQYGSVSENLVEFEGND

SEQ ID NO: 79404 - protein, 33 aa, Artificial Sequence
  Description of Artificial Sequence: Synthetic polypeptide
DEMEIRTTNPVATEQYGCVCSTENHQNFGSNDA

SEQ ID NO: 79405 - protein, 32 aa, Artificial Sequence
  Description of Artificial Sequence: Synthetic polypeptide
DEMEIRTTNPVATEQYGCVCSSNLIRFNSNQS

SEQ ID NO: 79406 - protein, 32 aa, Artificial Sequence
  Description of Artificial Sequence: Synthetic polypeptide
TEEGIRTTNPVATEQYGSVSTSLLSSMQLMQR

SEQ ID NO: 79407 - protein, 31 aa, Artificial Sequence
  Description of Artificial Sequence: Synthetic polypeptide
DAEEIATTNPVATEQWGSVTSPGGQPRGEGR

SEQ ID NO: 79408 - protein, 28 aa, Artificial Sequence
  Description of Artificial Sequence: Synthetic peptide
SEEEVACTNPVATEGYGSVANTIQRGQR

SEQ ID NO: 79409 - protein, 33 aa, Artificial Sequence
  Description of Artificial Sequence: Synthetic polypeptide
AEEEIRTTNPVATEQYGSVSTNNNDQQEDENND

SEQ ID NO: 79410 - protein, 30 aa, Artificial Sequence
  Description of Artificial Sequence: Synthetic polypeptide
DEEVIACTNPVATEQYGCVATNLPDNSENR

SEQ ID NO: 79411 - protein, 30 aa, Artificial Sequence
  Description of Artificial Sequence: Synthetic polypeptide
DEMEIRTTNPVATEQYGCISSNTQSFGSDQ

SEQ ID NO: 79412 - protein, 34 aa, Artificial Sequence
  Description of Artificial Sequence: Synthetic polypeptide
AEEEIRTTNPVATEQYGSVSTNNNENQGETGTNT

SEQ ID NO: 79413 - protein, 31 aa, Artificial Sequence
  Description of Artificial Sequence: Synthetic polypeptide
TEEGIRTTNPVATEQYGSVWTANLEMESNQE

SEQ ID NO: 79414 - protein, 31 aa, Artificial Sequence
  Description of Artificial Sequence: Synthetic polypeptide
TEEGIRTTNPVATEQYGVVVSTTNLEMENQE

SEQ ID NO: 79415 - protein, 30 aa, Artificial Sequence
  Description of Artificial Sequence: Synthetic polypeptide
DEMEIRTTNPVATEQYGCISTETQNSGSQQ

SEQ ID NO: 79416 - protein, 35 aa, Artificial Sequence
  Description of Artificial Sequence: Synthetic polypeptide
AEEEIRTTNPVATEQYGSVSTNNNLENQETGNVEE

SEQ ID NO: 79417 - protein, 34 aa, Artificial Sequence
  Description of Artificial Sequence: Synthetic polypeptide
AEEEIRTTNPVATEQYGSVSTNNNLLGGNQGNDQ

SEQ ID NO: 79418 - protein, 33 aa, Artificial Sequence
  Description of Artificial Sequence: Synthetic polypeptide
DAEEIATTNPVATEQWGSVTSTNHLDQTRGGED

SEQ ID NO: 79419 - protein, 31 aa, Artificial Sequence
  Description of Artificial Sequence: Synthetic polypeptide
TEEGIRTTNPVAYEQYGKTVATNLESVGNDR

SEQ ID NO: 79420 - protein, 33 aa, Artificial Sequence
  Description of Artificial Sequence: Synthetic polypeptide
SEEEVRTTNPVATEQYGSVCSTWNHNQNIGSNQ

SEQ ID NO: 79421 - protein, 33 aa, Artificial Sequence
  Description of Artificial Sequence: Synthetic polypeptide
TEEGIRTTNPVAYEQYGKTVSCTNLSQMVGNRA

SEQ ID NO: 79422 - protein, 33 aa, Artificial Sequence
  Description of Artificial Sequence: Synthetic polypeptide
DEEEIRTTNPVATETYGSVSTDTEGQDEGGNGN

SEQ ID NO: 79423 - protein, 31 aa, Artificial Sequence
  Description of Artificial Sequence: Synthetic polypeptide
DEMEIRTTNPVATEQYGCISTNTQNSGSDQM

SEQ ID NO: 79424 - protein, 32 aa, Artificial Sequence
  Description of Artificial Sequence: Synthetic polypeptide
TEEGIRTTNPVAYEQYGSVSCTGNLSSMLGNG

SEQ ID NO: 79425 - protein, 33 aa, Artificial Sequence
  Description of Artificial Sequence: Synthetic polypeptide
AEEEIRTTNPVATEQYGSVSTNNNLLQNQEETQ

SEQ ID NO: 79426 - protein, 33 aa, Artificial Sequence
  Description of Artificial Sequence: Synthetic polypeptide
DAEEIATTNPVATEQWGSVTSTNHGQTRGVTDR

SEQ ID NO: 79427 - protein, 31 aa, Artificial Sequence
  Description of Artificial Sequence: Synthetic polypeptide
DAEEIATTNPVATEQWGSVTSTGLDRGGTPE

SEQ ID NO: 79428 - protein, 31 aa, Artificial Sequence
  Description of Artificial Sequence: Synthetic polypeptide
DEETITTTNPVATEQYGQVVSINGQGGGDND

SEQ ID NO: 79429 - protein, 34 aa, Artificial Sequence
  Description of Artificial Sequence: Synthetic polypeptide
AEEEIRTTNPVATEQYGSVSTNNNLQGISTNLQE

SEQ ID NO: 79430 - protein, 28 aa, Artificial Sequence
  Description of Artificial Sequence: Synthetic peptide
SEEEVASTNPVATEGYGSVANTIQRGQR

SEQ ID NO: 79431 - protein, 32 aa, Artificial Sequence
  Description of Artificial Sequence: Synthetic polypeptide
TEEHIRTTNPVATESYGSTVCTTNLQTTGMRE

SEQ ID NO: 79432 - protein, 35 aa, Artificial Sequence
  Description of Artificial Sequence: Synthetic polypeptide
AEEEIRTTNPVATEQYGSVSTNNNLQQQGNGNIGD

SEQ ID NO: 79433 - protein, 31 aa, Artificial Sequence
  Description of Artificial Sequence: Synthetic polypeptide
TEEIIRTTNPVATEQYGCVSTNGQATFPENE

SEQ ID NO: 79434 - protein, 34 aa, Artificial Sequence
  Description of Artificial Sequence: Synthetic polypeptide
AEEEIRTTNPVATEQYGSVSTNNNNENQETGNTN

SEQ ID NO: 79435 - protein, 32 aa, Artificial Sequence
  Description of Artificial Sequence: Synthetic polypeptide
DEMEIRTTNPVATEQYGCTCSTNHQNGSDNQS

SEQ ID NO: 79436 - protein, 30 aa, Artificial Sequence
  Description of Artificial Sequence: Synthetic polypeptide
SEEEVACTNPVATEQYGNVSANTIQSRGQR

SEQ ID NO: 79437 - protein, 33 aa, Artificial Sequence
  Description of Artificial Sequence: Synthetic polypeptide
SEEEVRTTNPVATEQYGSVCSTENHDQNIGNQA

SEQ ID NO: 79438 - protein, 33 aa, Artificial Sequence
  Description of Artificial Sequence: Synthetic polypeptide
DEAEICTTNPVATECYGSVSTGNLQQDGQNNEN

SEQ ID NO: 79439 - protein, 32 aa, Artificial Sequence
  Description of Artificial Sequence: Synthetic polypeptide
DEEEIRTTNPVATEQYGCVCSTYHQYFGSELA

SEQ ID NO: 79440 - protein, 33 aa, Artificial Sequence
  Description of Artificial Sequence: Synthetic polypeptide
DEEEIRTTNPVATEQYGCVCSTYHQNFGSQNQL

SEQ ID NO: 79441 - protein, 33 aa, Artificial Sequence
  Description of Artificial Sequence: Synthetic polypeptide
DEEEIRTTNPVATEQYGCVCSNTNTQNFGSIQS

SEQ ID NO: 79442 - protein, 34 aa, Artificial Sequence
  Description of Artificial Sequence: Synthetic polypeptide
DEEEIRTTNPVAMEQYGQVVTDQNDLNQRGIRGE

SEQ ID NO: 79443 - protein, 35 aa, Artificial Sequence
  Description of Artificial Sequence: Synthetic polypeptide
DEEEIRTTNPVATERYGSTVSVTGNAHPQFGGNDR

SEQ ID NO: 79444 - protein, 33 aa, Artificial Sequence
  Description of Artificial Sequence: Synthetic polypeptide
DEEEIRTTNPVATEQYGCVCSNTNPQNSGSDQS

SEQ ID NO: 79445 - protein, 31 aa, Artificial Sequence
  Description of Artificial Sequence: Synthetic polypeptide
DEHEIRTTNPVAYEAWGSVSTNNAQGDGNKS

SEQ ID NO: 79446 - protein, 34 aa, Artificial Sequence
  Description of Artificial Sequence: Synthetic polypeptide
DEEEIRTTNPVATEQYGCVCSTNHNQENFGSNQS

SEQ ID NO: 79447 - protein, 32 aa, Artificial Sequence
  Description of Artificial Sequence: Synthetic polypeptide
DDEEIRTTNPVATEQYGCVCSTENPQFFGSDQ

SEQ ID NO: 79448 - protein, 33 aa, Artificial Sequence
  Description of Artificial Sequence: Synthetic polypeptide
DEEEIRTTNPVATEQYGCVCSTNHNQNFGSDDA

SEQ ID NO: 79449 - protein, 34 aa, Artificial Sequence
  Description of Artificial Sequence: Synthetic polypeptide
DEEEIRTTNPVATEQYGCVCSTNHNQNFGSENQE

SEQ ID NO: 79450 - protein, 34 aa, Artificial Sequence
  Description of Artificial Sequence: Synthetic polypeptide
TEEEIRTTNPVATEQYGTVISCTINPLSQRVNNY

SEQ ID NO: 79451 - protein, 31 aa, Artificial Sequence
  Description of Artificial Sequence: Synthetic polypeptide
DEHEIRTTNPVAYEAYGSVSQSISLRVGNNR

SEQ ID NO: 79452 - protein, 32 aa, Artificial Sequence
  Description of Artificial Sequence: Synthetic polypeptide
TEEEIRTTNPVATEQYGTVMDTNDNRERGTNA

SEQ ID NO: 79453 - protein, 33 aa, Artificial Sequence
  Description of Artificial Sequence: Synthetic polypeptide
DEEEIRTTNPVAIEQYGQIVSQNDLTQRGTEEL

SEQ ID NO: 79454 - protein, 32 aa, Artificial Sequence
  Description of Artificial Sequence: Synthetic polypeptide
DEEEIRTTNPVATEQYGCVCSTNHNQNNSDQQ

SEQ ID NO: 79455 - protein, 35 aa, Artificial Sequence
  Description of Artificial Sequence: Synthetic polypeptide
DEEEIRTTNPVATEQYGCVCSNTNNLQFFGSNNQS

SEQ ID NO: 79456 - protein, 34 aa, Artificial Sequence
  Description of Artificial Sequence: Synthetic polypeptide
DEEEIRTTNPVATEQYGCVCSTNHNQYFGSNNQS

SEQ ID NO: 79457 - protein, 33 aa, Artificial Sequence
  Description of Artificial Sequence: Synthetic polypeptide
TEEEIRTTNPVATEQYGTVPSNNESSQRGNNEE

SEQ ID NO: 79458 - protein, 33 aa, Artificial Sequence
  Description of Artificial Sequence: Synthetic polypeptide
TEEEIRTTNPVATEQYGTVSNNGHSQQGGNNRV

SEQ ID NO: 79459 - protein, 32 aa, Artificial Sequence
  Description of Artificial Sequence: Synthetic polypeptide
DEHEIRTTNPVAYECWGSVSTTNLGGDVGNER

SEQ ID NO: 79460 - protein, 29 aa, Artificial Sequence
  Description of Artificial Sequence: Synthetic peptide
DEGAIATTNPVAYEQWGSFSWENLDIGNR

SEQ ID NO: 79461 - protein, 33 aa, Artificial Sequence
  Description of Artificial Sequence: Synthetic polypeptide
DEHEIRTTNPVAYECWGSVSTTNLQGQDAGNER

SEQ ID NO: 79462 - protein, 34 aa, Artificial Sequence
  Description of Artificial Sequence: Synthetic polypeptide
DEEEIRTTNPVATEQYGCVCSTNHQENFGSDTRL

SEQ ID NO: 79463 - protein, 33 aa, Artificial Sequence
  Description of Artificial Sequence: Synthetic polypeptide
DEEEIRTTNPVATEQYGCVCSTNHQENFSSNQE

SEQ ID NO: 79464 - protein, 34 aa, Artificial Sequence
  Description of Artificial Sequence: Synthetic polypeptide
TEEEIRTTNPVATEQYGVTVPSYTNLSHTGDNYR

SEQ ID NO: 79465 - protein, 34 aa, Artificial Sequence
  Description of Artificial Sequence: Synthetic polypeptide
DEEEIRTTNPVATEQYGCVCSTNHQERFQSNNQS

SEQ ID NO: 79466 - protein, 30 aa, Artificial Sequence
  Description of Artificial Sequence: Synthetic polypeptide
DEEEIRTTNPVAHEQYGSVVDTDFQAFDSM

SEQ ID NO: 79467 - protein, 35 aa, Artificial Sequence
  Description of Artificial Sequence: Synthetic polypeptide
AEEEIRTTNPVATEQYGSVSSTTPNLPNMRNGMNV

SEQ ID NO: 79468 - protein, 32 aa, Artificial Sequence
  Description of Artificial Sequence: Synthetic polypeptide
DEEEIRTTNPVATEQYGCVCSTNHEGGSETQP

SEQ ID NO: 79469 - protein, 30 aa, Artificial Sequence
  Description of Artificial Sequence: Synthetic polypeptide
DEHEIRTTNPVAYEAWGCVSTNLQGENNDT

SEQ ID NO: 79470 - protein, 33 aa, Artificial Sequence
  Description of Artificial Sequence: Synthetic polypeptide
DDEEIRTTNPVATEQYGCVCSTENLQFFGSQDA

SEQ ID NO: 79471 - protein, 32 aa, Artificial Sequence
  Description of Artificial Sequence: Synthetic polypeptide
TEEEIRTTNPVATEQYGSVYTVYMETTGNDDR

SEQ ID NO: 79472 - protein, 32 aa, Artificial Sequence
  Description of Artificial Sequence: Synthetic polypeptide
DEEEIRTTNPVATDQYGDVVDTNLDMEGENIE

SEQ ID NO: 79473 - protein, 35 aa, Artificial Sequence
  Description of Artificial Sequence: Synthetic polypeptide
DEEEIRTTNPVATDQWGSVSVTVNASSQRTPGNNR

SEQ ID NO: 79474 - protein, 35 aa, Artificial Sequence
  Description of Artificial Sequence: Synthetic polypeptide
DEEEIRTTNPVATDQWGSVSCTVNNSSQRDVGNNR

SEQ ID NO: 79475 - protein, 33 aa, Artificial Sequence
  Description of Artificial Sequence: Synthetic polypeptide
DEEEIRTTNPVATDPYGSVCFTNQTHNRGGNGR

SEQ ID NO: 79476 - protein, 31 aa, Artificial Sequence
  Description of Artificial Sequence: Synthetic polypeptide
DCEEIASTNPVATEQYGSVSWNEGERNGQDR

SEQ ID NO: 79477 - protein, 33 aa, Artificial Sequence
  Description of Artificial Sequence: Synthetic polypeptide
DEEEIRTTNPVATDAYGKVSCTNALSQSGTLYR

SEQ ID NO: 79478 - protein, 34 aa, Artificial Sequence
  Description of Artificial Sequence: Synthetic polypeptide
DEHEIRTTNPVATESYGSVPSCQNMLSFRNGNNR

SEQ ID NO: 79479 - protein, 34 aa, Artificial Sequence
  Description of Artificial Sequence: Synthetic polypeptide
DEEEIRTTNPVATEQYGCVCSTNDQESFGSENQT

SEQ ID NO: 79480 - protein, 33 aa, Artificial Sequence
  Description of Artificial Sequence: Synthetic polypeptide
DEHEIRTTNPVATESYGSVPSVTNHLEQGVNMV

SEQ ID NO: 79481 - protein, 33 aa, Artificial Sequence
  Description of Artificial Sequence: Synthetic polypeptide
DEEEIRTTNPVATERYGSTVPTGNAHSQFGGPR

SEQ ID NO: 79482 - protein, 32 aa, Artificial Sequence
  Description of Artificial Sequence: Synthetic polypeptide
SESEIRTTNPVATEQWGSVSEINEMDREGENR

SEQ ID NO: 79483 - protein, 31 aa, Artificial Sequence
  Description of Artificial Sequence: Synthetic polypeptide
DEHEIRTTNPVATETYGCVSTVDGNQHGGNE

SEQ ID NO: 79484 - protein, 31 aa, Artificial Sequence
  Description of Artificial Sequence: Synthetic polypeptide
SESEIRTTNPVATEIYGVVSTNAQGSEPNRR

SEQ ID NO: 79485 - protein, 33 aa, Artificial Sequence
  Description of Artificial Sequence: Synthetic polypeptide
AEEEIRTTNPVATEQYGSVSSTTQLGNEQGTNM

SEQ ID NO: 79486 - protein, 31 aa, Artificial Sequence
  Description of Artificial Sequence: Synthetic polypeptide
DEHEIRTTNPVATQQWGCVSTNDGERDGNPS

SEQ ID NO: 79487 - protein, 30 aa, Artificial Sequence
  Description of Artificial Sequence: Synthetic polypeptide
DEHEIRTTNPVATTQWGCVNTQDGQRGNVD

SEQ ID NO: 79488 - protein, 33 aa, Artificial Sequence
  Description of Artificial Sequence: Synthetic polypeptide
DEEEIRTTNPVATEQYGCVCSTNENEQETQNEN

SEQ ID NO: 79489 - protein, 31 aa, Artificial Sequence
  Description of Artificial Sequence: Synthetic polypeptide
DEHEIRTTNPVAYDPYGSVNCTPLSQRGGND

SEQ ID NO: 79490 - protein, 30 aa, Artificial Sequence
  Description of Artificial Sequence: Synthetic polypeptide
DEAEIATTNPVATEQYGCVAATNDADGNED

SEQ ID NO: 79491 - protein, 31 aa, Artificial Sequence
  Description of Artificial Sequence: Synthetic polypeptide
DEHEIRTTNPVAYDQWGSVCTQLQRPGDNDQ

SEQ ID NO: 79492 - protein, 31 aa, Artificial Sequence
  Description of Artificial Sequence: Synthetic polypeptide
DEHEIRTTNPVAYDQWGSVNCTPLSQRGGNS

SEQ ID NO: 79493 - protein, 33 aa, Artificial Sequence
  Description of Artificial Sequence: Synthetic polypeptide
DEEEIRTTNPVATEQYGCVCSTNGHQFFGSDAA

SEQ ID NO: 79494 - protein, 33 aa, Artificial Sequence
  Description of Artificial Sequence: Synthetic polypeptide
DEEEIRTTNPVATEQYGCVCSTNGIQENGSQQA

SEQ ID NO: 79495 - protein, 32 aa, Artificial Sequence
  Description of Artificial Sequence: Synthetic polypeptide
DEEEIRTTNPVASEQYGSVSCPALNMSNGNPV

SEQ ID NO: 79496 - protein, 31 aa, Artificial Sequence
  Description of Artificial Sequence: Synthetic polypeptide
SESEIRTTNPVATECWGSVSCINEPQRGENG

SEQ ID NO: 79497 - protein, 32 aa, Artificial Sequence
  Description of Artificial Sequence: Synthetic polypeptide
DEHEIRTTNPVAYDQYGSTVNCTPLQRTGGND

SEQ ID NO: 79498 - protein, 33 aa, Artificial Sequence
  Description of Artificial Sequence: Synthetic polypeptide
DDEEIRTTNPVATEQYGCVCSTENHQNFGSNQA

SEQ ID NO: 79499 - protein, 34 aa, Artificial Sequence
  Description of Artificial Sequence: Synthetic polypeptide
DEEEIRTTNPVATEQYGCVCSTNHDQNFGSNNQL

SEQ ID NO: 79500 - protein, 33 aa, Artificial Sequence
  Description of Artificial Sequence: Synthetic polypeptide
SESEIRTTNPVATECYGSVSCINLPQDREGENG

SEQ ID NO: 79501 - protein, 33 aa, Artificial Sequence
  Description of Artificial Sequence: Synthetic polypeptide
DEEEIRTTNPVATEQYGCVCSTNHQESSGSDQA

SEQ ID NO: 79502 - protein, 34 aa, Artificial Sequence
  Description of Artificial Sequence: Synthetic polypeptide
DEEEIRTTNPVATEQYGCVCSNTNLQNFNSDNQM

SEQ ID NO: 79503 - protein, 29 aa, Artificial Sequence
  Description of Artificial Sequence: Synthetic peptide
SESEIRSTNPVATEQYGNVAETIMRVGNR

SEQ ID NO: 79504 - protein, 31 aa, Artificial Sequence
  Description of Artificial Sequence: Synthetic polypeptide
DEHEIRTTNPVAYEKWGEVSTNLQHDQGNEQ

SEQ ID NO: 79505 - protein, 33 aa, Artificial Sequence
  Description of Artificial Sequence: Synthetic polypeptide
AEEEIRTTNPVATEQYGSVSSVNQQQTTNGNIA

SEQ ID NO: 79506 - protein, 31 aa, Artificial Sequence
  Description of Artificial Sequence: Synthetic polypeptide
SESEIRCTNPVATEQWGSVSEINEMDRGENR

SEQ ID NO: 79507 - protein, 33 aa, Artificial Sequence
  Description of Artificial Sequence: Synthetic polypeptide
DEEEIRTTNPVATEQYGCVCSNTNLQENFISDQ

SEQ ID NO: 79508 - protein, 35 aa, Artificial Sequence
  Description of Artificial Sequence: Synthetic polypeptide
AEEEIRTTNPVATEQYGSVSSVTNNNLQIGNNTTE

SEQ ID NO: 79509 - protein, 31 aa, Artificial Sequence
  Description of Artificial Sequence: Synthetic polypeptide
DEHEIRTTNPVAYEQWGEVVSTNDLGDQGER

SEQ ID NO: 79510 - protein, 32 aa, Artificial Sequence
  Description of Artificial Sequence: Synthetic polypeptide
DEHEIRTTNPVAYEQWGSISHTDNDHQREGLR

SEQ ID NO: 79511 - protein, 28 aa, Artificial Sequence
  Description of Artificial Sequence: Synthetic peptide
SESEIRCTNPIATEQYGVMSSNLMHGNI

SEQ ID NO: 79512 - protein, 33 aa, Artificial Sequence
  Description of Artificial Sequence: Synthetic polypeptide
DEEEIRTTNPVATEQYGCVCSTNLENFGSDTQM

SEQ ID NO: 79513 - protein, 33 aa, Artificial Sequence
  Description of Artificial Sequence: Synthetic polypeptide
DEHEIRTTNPVAYEQWGSISHTDNTQREGGGNR

SEQ ID NO: 79514 - protein, 32 aa, Artificial Sequence
  Description of Artificial Sequence: Synthetic polypeptide
DEHEIRTTNPVAYEQWGSISHTDNTQREGNDN

SEQ ID NO: 79515 - protein, 32 aa, Artificial Sequence
  Description of Artificial Sequence: Synthetic polypeptide
SESEIRCTNPIATEQYGSVSENLPMDREGENR

SEQ ID NO: 79516 - protein, 33 aa, Artificial Sequence
  Description of Artificial Sequence: Synthetic polypeptide
DEHEIRTTNPVAYEQWGSTSPTENQDGQREGNR

SEQ ID NO: 79517 - protein, 32 aa, Artificial Sequence
  Description of Artificial Sequence: Synthetic polypeptide
DEHEIRTTNPVAYEHWGSVSTNLQGEDTGNAN

SEQ ID NO: 79518 - protein, 33 aa, Artificial Sequence
  Description of Artificial Sequence: Synthetic polypeptide
DEEEIRTTNPVAFEQYGQVVSTGDLDQRGIQGT

SEQ ID NO: 79519 - protein, 34 aa, Artificial Sequence
  Description of Artificial Sequence: Synthetic polypeptide
DEEEIRTTNPVATEQYGCVCSTNLLQNFGSETDA

SEQ ID NO: 79520 - protein, 35 aa, Artificial Sequence
  Description of Artificial Sequence: Synthetic polypeptide
DEEEIRTTNPVAFEQYGQVVSGQTNDLHQRGIRGA

SEQ ID NO: 79521 - protein, 32 aa, Artificial Sequence
  Description of Artificial Sequence: Synthetic polypeptide
DEEEIRTTNPVAFEQYGQVVNQNDLLQEGDRD

SEQ ID NO: 79522 - protein, 35 aa, Artificial Sequence
  Description of Artificial Sequence: Synthetic polypeptide
DEEEIRTTNPVATEQYGCVCSNTNLQEFFGSNNAE

SEQ ID NO: 79523 - protein, 33 aa, Artificial Sequence
  Description of Artificial Sequence: Synthetic polypeptide
DAGEIATTNPVATEQYGSVSWTNDLQDTGGMQR

SEQ ID NO: 79524 - protein, 32 aa, Artificial Sequence
  Description of Artificial Sequence: Synthetic polypeptide
DEEEIRTTNPVAFEQYGQVVNQNDLDQRGQSD

SEQ ID NO: 79525 - protein, 33 aa, Artificial Sequence
  Description of Artificial Sequence: Synthetic polypeptide
DEEEIRTTNPVAFEQYGQVVNQNDLDQRGQRGQ

SEQ ID NO: 79526 - protein, 34 aa, Artificial Sequence
  Description of Artificial Sequence: Synthetic polypeptide
AEEEIRTTNPVATEQYGSVSSVTNNNQAIGNNTT

SEQ ID NO: 79527 - protein, 32 aa, Artificial Sequence
  Description of Artificial Sequence: Synthetic polypeptide
DEHEIRTTNPVAYEQWGSVATNLQNPGGDNDS

SEQ ID NO: 79528 - protein, 32 aa, Artificial Sequence
  Description of Artificial Sequence: Synthetic polypeptide
DEFVIRTTNPVAYEQYGCVACTNPSQRTGGNR

SEQ ID NO: 79529 - protein, 33 aa, Artificial Sequence
  Description of Artificial Sequence: Synthetic polypeptide
DEEEIRTTNPVAFEQYGQVVNGGNDLLQRGQRD

SEQ ID NO: 79530 - protein, 34 aa, Artificial Sequence
  Description of Artificial Sequence: Synthetic polypeptide
DEEEIRTTNPVATEQYGCVCSTNLQEHFNSNPQL

SEQ ID NO: 79531 - protein, 33 aa, Artificial Sequence
  Description of Artificial Sequence: Synthetic polypeptide
TEEEIRTTNPVATERYGSTVPSCTNAIPQFGNA

SEQ ID NO: 79532 - protein, 35 aa, Artificial Sequence
  Description of Artificial Sequence: Synthetic polypeptide
DEEEIRTTNPVAFEQYGQVVSIQTNDLNQRGDRGI

SEQ ID NO: 79533 - protein, 33 aa, Artificial Sequence
  Description of Artificial Sequence: Synthetic polypeptide
DEEEIRTTNPVATEQYGCVCSTNDHQYSGSEQD

SEQ ID NO: 79534 - protein, 34 aa, Artificial Sequence
  Description of Artificial Sequence: Synthetic polypeptide
DEEEIRTTNPVAFEQYGSVVNGQNDGLQRGQRDD

SEQ ID NO: 79535 - protein, 32 aa, Artificial Sequence
  Description of Artificial Sequence: Synthetic polypeptide
DEEEIRTTNPVAFEQYGSVVNTGLQGGDQDDD

SEQ ID NO: 79536 - protein, 33 aa, Artificial Sequence
  Description of Artificial Sequence: Synthetic polypeptide
DEEEIRTTNPVATEQYGCVCSTNHQFFNSDTQA

SEQ ID NO: 79537 - protein, 33 aa, Artificial Sequence
  Description of Artificial Sequence: Synthetic polypeptide
DEEEIRTTNPVATERYGSVNTTLAELQGQTNSR

SEQ ID NO: 79538 - protein, 32 aa, Artificial Sequence
  Description of Artificial Sequence: Synthetic polypeptide
DEEEIRTTNPVAHEQYGSVNTGLQEEDGQDGT

SEQ ID NO: 79539 - protein, 30 aa, Artificial Sequence
  Description of Artificial Sequence: Synthetic polypeptide
DEEEIRTTNPVAHEQYGSAWPTNQQVFDSG

SEQ ID NO: 79540 - protein, 32 aa, Artificial Sequence
  Description of Artificial Sequence: Synthetic polypeptide
DEEEIRTTNPVAHEQYGQVVDQNDLLQRGIGD

SEQ ID NO: 79541 - protein, 29 aa, Artificial Sequence
  Description of Artificial Sequence: Synthetic peptide
SESEIRSTNPIATEQYGNVSETIMRVGNR

SEQ ID NO: 79542 - protein, 29 aa, Artificial Sequence
  Description of Artificial Sequence: Synthetic peptide
SESEIRSTNPIATEGYGSVAETLQRVGQR

SEQ ID NO: 79543 - protein, 33 aa, Artificial Sequence
  Description of Artificial Sequence: Synthetic polypeptide
TEEEIRTTNPVATERWGVVPSYTNLSQRTGDNI

SEQ ID NO: 79544 - protein, 33 aa, Artificial Sequence
  Description of Artificial Sequence: Synthetic polypeptide
DEEEIRTTNPVAFEQYGVVVNQNDLDQRGDRDI

SEQ ID NO: 79545 - protein, 33 aa, Artificial Sequence
  Description of Artificial Sequence: Synthetic polypeptide
DEEEIRTTNPVATEQYGCVCSTNHQNFGSDTQS

SEQ ID NO: 79546 - protein, 32 aa, Artificial Sequence
  Description of Artificial Sequence: Synthetic polypeptide
AEEEIRTTNPVATEQYGSVSSVNQQGTNGTIA

SEQ ID NO: 79547 - protein, 33 aa, Artificial Sequence
  Description of Artificial Sequence: Synthetic polypeptide
DEEEIRTTNPVATEQYGCVCSTNHQNFGSQTQE

SEQ ID NO: 79548 - protein, 33 aa, Artificial Sequence
  Description of Artificial Sequence: Synthetic polypeptide
DEEEIRTTNPVATEQYGCVCSTNHQNFISNTQA

SEQ ID NO: 79549 - protein, 32 aa, Artificial Sequence
  Description of Artificial Sequence: Synthetic polypeptide
DEHEIRTTNPVAYEHWGSVSTNLQGDPGQNND

SEQ ID NO: 79550 - protein, 32 aa, Artificial Sequence
  Description of Artificial Sequence: Synthetic polypeptide
AEEEIRTTNPVATEQYGSVSSVNQQQNQGGIG

SEQ ID NO: 79551 - protein, 31 aa, Artificial Sequence
  Description of Artificial Sequence: Synthetic polypeptide
SESEIRCTNPVAYEQYGSVFTNALSQHGGNQ

SEQ ID NO: 79552 - protein, 32 aa, Artificial Sequence
  Description of Artificial Sequence: Synthetic polypeptide
DEEEIRTTNPVATEQYGCVCSTNHQNSFSDQT

SEQ ID NO: 79553 - protein, 31 aa, Artificial Sequence
  Description of Artificial Sequence: Synthetic polypeptide
SESEIRCTNPVAYEQYGSTVFTNLSQHGNNQ

SEQ ID NO: 79554 - protein, 30 aa, Artificial Sequence
  Description of Artificial Sequence: Synthetic polypeptide
DANEIATTNPCAYEPYGSVSANLQRGENDS

SEQ ID NO: 79555 - protein, 31 aa, Artificial Sequence
  Description of Artificial Sequence: Synthetic polypeptide
DEHEIRTTNPVAYEHWGSVSTNLNDDGNNDT

SEQ ID NO: 79556 - protein, 35 aa, Artificial Sequence
  Description of Artificial Sequence: Synthetic polypeptide
DEEEIRTTNPVAFEQYGSVVSTGGDLGQREGERGI

SEQ ID NO: 79557 - protein, 32 aa, Artificial Sequence
  Description of Artificial Sequence: Synthetic polypeptide
DEHEIRTTNPVAYEHWGSVSTNLQADHGNNDS

SEQ ID NO: 79558 - protein, 31 aa, Artificial Sequence
  Description of Artificial Sequence: Synthetic polypeptide
DAGEIATTNPVAYEQYGSVSTNPLQHQGGMN

SEQ ID NO: 79559 - protein, 32 aa, Artificial Sequence
  Description of Artificial Sequence: Synthetic polypeptide
SESEIRCTNPVATEQYGSVFCTNELSQHGGNQ

SEQ ID NO: 79560 - protein, 33 aa, Artificial Sequence
  Description of Artificial Sequence: Synthetic polypeptide
DEEEIRTTNPVATEQYGCVCSTNHQYFISNNQT

SEQ ID NO: 79561 - protein, 32 aa, Artificial Sequence
  Description of Artificial Sequence: Synthetic polypeptide
DEHEIRTTNPVAYEHWGSVSTNLQGDLGNGGS

SEQ ID NO: 79562 - protein, 30 aa, Artificial Sequence
  Description of Artificial Sequence: Synthetic polypeptide
SESEIRCTNPVATEQYGSVEMNLQEHGGQQ

SEQ ID NO: 79563 - protein, 32 aa, Artificial Sequence
  Description of Artificial Sequence: Synthetic polypeptide
DEHEIRTTNPVAYEHWGSVSTNLQGDLNGNGS

SEQ ID NO: 79564 - protein, 31 aa, Artificial Sequence
  Description of Artificial Sequence: Synthetic polypeptide
DEHEIRTTNPVAYEHWGSVATNLQADGNNDD

SEQ ID NO: 79565 - protein, 32 aa, Artificial Sequence
  Description of Artificial Sequence: Synthetic polypeptide
DEEEIRTTNPVATEAYGTVSTSNTNEEQGNNF

SEQ ID NO: 79566 - protein, 31 aa, Artificial Sequence
  Description of Artificial Sequence: Synthetic polypeptide
DEEEIRTTNPVATDQYGDVVTDGQGNETGNT

SEQ ID NO: 79567 - protein, 33 aa, Artificial Sequence
  Description of Artificial Sequence: Synthetic polypeptide
DEEEIRTTNPVATEQYGCVCSTNDHQNFGSDQP

SEQ ID NO: 79568 - protein, 33 aa, Artificial Sequence
  Description of Artificial Sequence: Synthetic polypeptide
DEEEIRTTNPVATEQYGCVCSTGPPQGFGSNDA

SEQ ID NO: 79569 - protein, 33 aa, Artificial Sequence
  Description of Artificial Sequence: Synthetic polypeptide
DEEEIRTTNPVATEQYGCVCSTGYDHQNSGSNQ

SEQ ID NO: 79570 - protein, 34 aa, Artificial Sequence
  Description of Artificial Sequence: Synthetic polypeptide
DEEEIRTTNPVATERYGKTVQSDQNLSQNGGKNR

SEQ ID NO: 79571 - protein, 34 aa, Artificial Sequence
  Description of Artificial Sequence: Synthetic polypeptide
DCEEIRTTNPVATERYGSTVSTGNAHSQYFGGNR

SEQ ID NO: 79572 - protein, 33 aa, Artificial Sequence
  Description of Artificial Sequence: Synthetic polypeptide
DEEEIRTTNPVATEQYGCVCSTIAHQFFGSNQE

SEQ ID NO: 79573 - protein, 32 aa, Artificial Sequence
  Description of Artificial Sequence: Synthetic polypeptide
DEEEIRTTNPVATEQYGCVCSTIEHQGGSDDS

SEQ ID NO: 79574 - protein, 31 aa, Artificial Sequence
  Description of Artificial Sequence: Synthetic polypeptide
SEYEIRCTNPVATEQYGCVCENTNLQHGNQA

SEQ ID NO: 79575 - protein, 33 aa, Artificial Sequence
  Description of Artificial Sequence: Synthetic polypeptide
AEEEIRTTNPVATEQYGSVSNTDNGNQTTTNVA

SEQ ID NO: 79576 - protein, 33 aa, Artificial Sequence
  Description of Artificial Sequence: Synthetic polypeptide
DCEEIRTTNPVATERYGKTVSCTNAIPQFGGNR

SEQ ID NO: 79577 - protein, 33 aa, Artificial Sequence
  Description of Artificial Sequence: Synthetic polypeptide
DCEEIRTTNPVATEQYGSWWSFTVNPNRGDERI

SEQ ID NO: 79578 - protein, 34 aa, Artificial Sequence
  Description of Artificial Sequence: Synthetic polypeptide
DEHEIRTTNPVATEQYGSVSTTGNPEQGLMGNGS

SEQ ID NO: 79579 - protein, 34 aa, Artificial Sequence
  Description of Artificial Sequence: Synthetic polypeptide
TEEEIRTTNPVATEQYGSVSTTDNIGQGEGNVGG

SEQ ID NO: 79580 - protein, 33 aa, Artificial Sequence
  Description of Artificial Sequence: Synthetic polypeptide
DEEEIRTTNPVATEQYGCVCSTMALQFFGSEQE

SEQ ID NO: 79581 - protein, 35 aa, Artificial Sequence
  Description of Artificial Sequence: Synthetic polypeptide
AEEEIRTTNPVATEQYGSVSNTNLQQGNNQAGNTD

SEQ ID NO: 79582 - protein, 33 aa, Artificial Sequence
  Description of Artificial Sequence: Synthetic polypeptide
DEHEIRTTNPVATEQYGSVSTTGPEQGLGNMGQ

SEQ ID NO: 79583 - protein, 33 aa, Artificial Sequence
  Description of Artificial Sequence: Synthetic polypeptide
DEEEIRTTNPVATEQYGCVCSTMEDQHFGSNQE

SEQ ID NO: 79584 - protein, 34 aa, Artificial Sequence
  Description of Artificial Sequence: Synthetic polypeptide
DEHEIRTTNPVATEQYGSVSTTGPNQGLMGGNEG

SEQ ID NO: 79585 - protein, 33 aa, Artificial Sequence
  Description of Artificial Sequence: Synthetic polypeptide
DEHEIRTTNPVATEQYGSVSTTGPQGNVGNDGS

SEQ ID NO: 79586 - protein, 33 aa, Artificial Sequence
  Description of Artificial Sequence: Synthetic polypeptide
DEEEIRTTNPVATERYGKTVQSQNLSQNGGHNH

SEQ ID NO: 79587 - protein, 33 aa, Artificial Sequence
  Description of Artificial Sequence: Synthetic polypeptide
AEEEIRTTNPVATEQYGSVSNVNGNQQTGNNDE

SEQ ID NO: 79588 - protein, 34 aa, Artificial Sequence
  Description of Artificial Sequence: Synthetic polypeptide
TEEEIRTTNPVATEQYGSVSTTLGFGTQTGNEGE

SEQ ID NO: 79589 - protein, 34 aa, Artificial Sequence
  Description of Artificial Sequence: Synthetic polypeptide
DCEEIRTTNPVATEQYGQSVSTNNSKQSMGDNQM

SEQ ID NO: 79590 - protein, 34 aa, Artificial Sequence
  Description of Artificial Sequence: Synthetic polypeptide
TEEEIRTTNPVATEQYGSVSTTMNFGGQGEGENT

SEQ ID NO: 79591 - protein, 34 aa, Artificial Sequence
  Description of Artificial Sequence: Synthetic polypeptide
AEEEIRTTNPVATEQYGSVSNVNQLGNNQQGNNA

SEQ ID NO: 79592 - protein, 28 aa, Artificial Sequence
  Description of Artificial Sequence: Synthetic peptide
SEVEIAATNPTATEQFGSVSENEQQGNF

SEQ ID NO: 79593 - protein, 34 aa, Artificial Sequence
  Description of Artificial Sequence: Synthetic polypeptide
AEEEIRTTNPVATEQYGSVSNVNQLGNQQGNNNN

SEQ ID NO: 79594 - protein, 30 aa, Artificial Sequence
  Description of Artificial Sequence: Synthetic polypeptide
DCEEIRTTNPVATECYGAAHSTNEPQPINF

SEQ ID NO: 79595 - protein, 35 aa, Artificial Sequence
  Description of Artificial Sequence: Synthetic polypeptide
DCEEIRTTNPVAYEQYGQSVSVQTNELSQRGGSYR

SEQ ID NO: 79596 - protein, 33 aa, Artificial Sequence
  Description of Artificial Sequence: Synthetic polypeptide
DEEEIRTTNPVATEAWGISVSTGNLSDTRGGTE

SEQ ID NO: 79597 - protein, 33 aa, Artificial Sequence
  Description of Artificial Sequence: Synthetic polypeptide
AEEEICTTNPVATEQYGVVSVTTNLQGGNNEAE

SEQ ID NO: 79598 - protein, 34 aa, Artificial Sequence
  Description of Artificial Sequence: Synthetic polypeptide
DEEEIRTTNPVATEQYGCVCSTGPLNQNFGSNQS

SEQ ID NO: 79599 - protein, 32 aa, Artificial Sequence
  Description of Artificial Sequence: Synthetic polypeptide
DDAEIRTTNPVATEQYGSVCSTNDTQSFGSDQ

SEQ ID NO: 79600 - protein, 33 aa, Artificial Sequence
  Description of Artificial Sequence: Synthetic polypeptide
DEEEIRTTNPVATEQYGCVCSTGNNQFSGSEQA

SEQ ID NO: 79601 - protein, 31 aa, Artificial Sequence
  Description of Artificial Sequence: Synthetic polypeptide
AEEEIRATNPCATEQYGSVSNENLMQGNTVG

SEQ ID NO: 79602 - protein, 31 aa, Artificial Sequence
  Description of Artificial Sequence: Synthetic polypeptide
SEYEIRCTNPVATEQYGCVETNLQEHFGNQA

SEQ ID NO: 79603 - protein, 33 aa, Artificial Sequence
  Description of Artificial Sequence: Synthetic polypeptide
DEEEIRTTNPVATEQYGCVCSTGNPQFFGSDQQ

SEQ ID NO: 79604 - protein, 30 aa, Artificial Sequence
  Description of Artificial Sequence: Synthetic polypeptide
SEYEIRCTNPVATEQYGCVETNHQHGSNQM

SEQ ID NO: 79605 - protein, 31 aa, Artificial Sequence
  Description of Artificial Sequence: Synthetic polypeptide
AEEEIRATNPCATEQYGSVSNENLMQGNNVE

SEQ ID NO: 79606 - protein, 33 aa, Artificial Sequence
  Description of Artificial Sequence: Synthetic polypeptide
TEEEIRTTNPVATEQYGSVSTNGLLAQQEDEEG

SEQ ID NO: 79607 - protein, 33 aa, Artificial Sequence
  Description of Artificial Sequence: Synthetic polypeptide
DEEEIRTTNPVATEQYGCVCSTGNPQNFGSDQA

SEQ ID NO: 79608 - protein, 33 aa, Artificial Sequence
  Description of Artificial Sequence: Synthetic polypeptide
DEEEIRTTNPVATEQYGCVCSTGNPQNFNSDPQ

SEQ ID NO: 79609 - protein, 31 aa, Artificial Sequence
  Description of Artificial Sequence: Synthetic polypeptide
AEEEIRATNPCATEQYGSVSNENLMQGENQV

SEQ ID NO: 79610 - protein, 31 aa, Artificial Sequence
  Description of Artificial Sequence: Synthetic polypeptide
DDAEIRTTNPVATEQYGSVCSTEDDQSGSDQ

SEQ ID NO: 79611 - protein, 33 aa, Artificial Sequence
  Description of Artificial Sequence: Synthetic polypeptide
DEEEIRTTNPVATEQYGCVCSTGNPQYFNSNQA

SEQ ID NO: 79612 - protein, 34 aa, Artificial Sequence
  Description of Artificial Sequence: Synthetic polypeptide
DEEEIRTTNPVATEQYGCVCSTMELEQHFGSNQS

SEQ ID NO: 79613 - protein, 31 aa, Artificial Sequence
  Description of Artificial Sequence: Synthetic polypeptide
DEAEIATTNPVATEQYGCVAATNLTDSGNND

SEQ ID NO: 79614 - protein, 33 aa, Artificial Sequence
  Description of Artificial Sequence: Synthetic polypeptide
DEEEIRTTNPVATEQYGCVCSTGNTQGFGSQDI

SEQ ID NO: 79615 - protein, 30 aa, Artificial Sequence
  Description of Artificial Sequence: Synthetic polypeptide
SEYEIRCTNPVATEQYGCVETGELQHFGNQ

SEQ ID NO: 79616 - protein, 32 aa, Artificial Sequence
  Description of Artificial Sequence: Synthetic polypeptide
DDAEIRTTNPVATEQYGCVCSTGNLLQSGSDQ

SEQ ID NO: 79617 - protein, 34 aa, Artificial Sequence
  Description of Artificial Sequence: Synthetic polypeptide
DEEEIRTTNPVATEQYGCVCSTGNTQNFGSDNQP

SEQ ID NO: 79618 - protein, 32 aa, Artificial Sequence
  Description of Artificial Sequence: Synthetic polypeptide
DDAEIRTTNPVATEQYGCVCSTELQNFGSNQS

SEQ ID NO: 79619 - protein, 32 aa, Artificial Sequence
  Description of Artificial Sequence: Synthetic polypeptide
AEEEIRATNPCATEQYGSVSENLMQIGTNNVE

SEQ ID NO: 79620 - protein, 34 aa, Artificial Sequence
  Description of Artificial Sequence: Synthetic polypeptide
AEEEIGTTNPVATEQYGSVSEGNGLLDRGTNMRS

SEQ ID NO: 79621 - protein, 34 aa, Artificial Sequence
  Description of Artificial Sequence: Synthetic polypeptide
TEEEIRTTNPVATEQYGSVSTNMNEGQGGQGNGD

SEQ ID NO: 79622 - protein, 33 aa, Artificial Sequence
  Description of Artificial Sequence: Synthetic polypeptide
DDEEIRTTNPVATEQYGCVCSTELQNFGSNNQA

SEQ ID NO: 79623 - protein, 32 aa, Artificial Sequence
  Description of Artificial Sequence: Synthetic polypeptide
DEEEIRTTNPVATEQYGCVCSTGPHENGSNQM

SEQ ID NO: 79624 - protein, 33 aa, Artificial Sequence
  Description of Artificial Sequence: Synthetic polypeptide
AEEEICTTNPVATEQYGVVSVTTNLQQLGGNDA

SEQ ID NO: 79625 - protein, 33 aa, Artificial Sequence
  Description of Artificial Sequence: Synthetic polypeptide
DEEEIRTTNPVATEAWGISVSTGNLSINRGGDE

SEQ ID NO: 79626 - protein, 30 aa, Artificial Sequence
  Description of Artificial Sequence: Synthetic polypeptide
DCEEIRVTNPVATEQYGAVSTNQIAHNGQF

SEQ ID NO: 79627 - protein, 32 aa, Artificial Sequence
  Description of Artificial Sequence: Synthetic polypeptide
DDAEIRTTNPVATEQYGCVCSTNALQEGGSDQ

SEQ ID NO: 79628 - protein, 34 aa, Artificial Sequence
  Description of Artificial Sequence: Synthetic polypeptide
DCEEIRTTNPVATDQYGSVSTTNGGQPNGGGNHR

SEQ ID NO: 79629 - protein, 34 aa, Artificial Sequence
  Description of Artificial Sequence: Synthetic polypeptide
DEEEIRTTNPVATEQYGCVCSTMELNQGFGSNQA

SEQ ID NO: 79630 - protein, 32 aa, Artificial Sequence
  Description of Artificial Sequence: Synthetic polypeptide
DEEEIRTTNPVATEAWGESTVSTNLSGPGGTE

SEQ ID NO: 79631 - protein, 33 aa, Artificial Sequence
  Description of Artificial Sequence: Synthetic polypeptide
DEEEIRTTNPVATEQYGCVCSTMNTQNFNSNQM

SEQ ID NO: 79632 - protein, 31 aa, Artificial Sequence
  Description of Artificial Sequence: Synthetic polypeptide
DCEEIRSTNPVATEQYGAVSTNQIAHNQQTR

SEQ ID NO: 79633 - protein, 33 aa, Artificial Sequence
  Description of Artificial Sequence: Synthetic polypeptide
DEAEIATTNPVATEQYGCVAATNLQATGGNERL

SEQ ID NO: 79634 - protein, 34 aa, Artificial Sequence
  Description of Artificial Sequence: Synthetic polypeptide
AEEEIRTTNPVATEQYGSVSSTNNNNNQIGNTEA

SEQ ID NO: 79635 - protein, 30 aa, Artificial Sequence
  Description of Artificial Sequence: Synthetic polypeptide
DCEEIRSTNPVATEQYGAVSTNQIAHNDQD

SEQ ID NO: 79636 - protein, 32 aa, Artificial Sequence
  Description of Artificial Sequence: Synthetic polypeptide
TEEEIRTTNPVATEQYGSVVACTALSQNGGME

SEQ ID NO: 79637 - protein, 33 aa, Artificial Sequence
  Description of Artificial Sequence: Synthetic polypeptide
DEEEIRTTNPVATEQYGCVCSTNAHQEFFGSEQ

SEQ ID NO: 79638 - protein, 33 aa, Artificial Sequence
  Description of Artificial Sequence: Synthetic polypeptide
DEHEIRTTNPVATEQYGSVSVTNELETQGEFQY

SEQ ID NO: 79639 - protein, 33 aa, Artificial Sequence
  Description of Artificial Sequence: Synthetic polypeptide
DEEEIRTTNPVATEQYGCVCSTNAHQERFMSDA

SEQ ID NO: 79640 - protein, 34 aa, Artificial Sequence
  Description of Artificial Sequence: Synthetic polypeptide
TEEEIRTTNPVATEQYGSVVACTNGLDQFGGSRY

SEQ ID NO: 79641 - protein, 32 aa, Artificial Sequence
  Description of Artificial Sequence: Synthetic polypeptide
DEHEIRTTNPVATEQYGSVSVTPMETGEGLER

SEQ ID NO: 79642 - protein, 33 aa, Artificial Sequence
  Description of Artificial Sequence: Synthetic polypeptide
DEEEIRTTNPVATDQYGSVSTMNLVEMTDDGEV

SEQ ID NO: 79643 - protein, 34 aa, Artificial Sequence
  Description of Artificial Sequence: Synthetic polypeptide
DEEEIRTTNPVATDQYGSVSTMNLQMEMTENGED

SEQ ID NO: 79644 - protein, 35 aa, Artificial Sequence
  Description of Artificial Sequence: Synthetic polypeptide
DEEEIRTTNPVATDQYGSVVSCTNALSQSGGTYRV

SEQ ID NO: 79645 - protein, 32 aa, Artificial Sequence
  Description of Artificial Sequence: Synthetic polypeptide
DCEEIRGTNPVATEQYGACVSTNLQQENGSTV

SEQ ID NO: 79646 - protein, 34 aa, Artificial Sequence
  Description of Artificial Sequence: Synthetic polypeptide
AEEEIRTTNPVATEQYGSVSSTNNNNQIGTNTED

SEQ ID NO: 79647 - protein, 30 aa, Artificial Sequence
  Description of Artificial Sequence: Synthetic polypeptide
SETEIRCTNPIATECYGSTVSENLMPGNYR

SEQ ID NO: 79648 - protein, 32 aa, Artificial Sequence
  Description of Artificial Sequence: Synthetic polypeptide
DEEEIRTTNPVATDQYGSVSNVNLDPDGEEQI

SEQ ID NO: 79649 - protein, 34 aa, Artificial Sequence
  Description of Artificial Sequence: Synthetic polypeptide
DEEEIRTTNPVATEQYGCVCSTNDDQNFGSNNQS

SEQ ID NO: 79650 - protein, 31 aa, Artificial Sequence
  Description of Artificial Sequence: Synthetic polypeptide
DEGAIRCTNPVATEQYGSFSETNLIIIGNQQ

SEQ ID NO: 79651 - protein, 34 aa, Artificial Sequence
  Description of Artificial Sequence: Synthetic polypeptide
AEEEIRTTNPVATEQYGSVSSTNNNNQIGTNTET

SEQ ID NO: 79652 - protein, 33 aa, Artificial Sequence
  Description of Artificial Sequence: Synthetic polypeptide
DEEEIRTTNPVATEQYGCVCSTNDENFGSNTQG

SEQ ID NO: 79653 - protein, 33 aa, Artificial Sequence
  Description of Artificial Sequence: Synthetic polypeptide
DEEEIRTTNPVATEQYGCVCSTNDHQEFFGSDA

SEQ ID NO: 79654 - protein, 31 aa, Artificial Sequence
  Description of Artificial Sequence: Synthetic polypeptide
DCEEIRATNPVAYEQWGSSSTNMQRDGTNNT

SEQ ID NO: 79655 - protein, 33 aa, Artificial Sequence
  Description of Artificial Sequence: Synthetic polypeptide
DEHEIRTTNPVATEQYGVSYVSMDSQPQSRGNE

SEQ ID NO: 79656 - protein, 30 aa, Artificial Sequence
  Description of Artificial Sequence: Synthetic polypeptide
DEGAIRCTNPVATEQYGSFSETNLIIHNQD

SEQ ID NO: 79657 - protein, 30 aa, Artificial Sequence
  Description of Artificial Sequence: Synthetic polypeptide
DCEEIRATNPVAYEQWGSSSTNMQHDGNNS

SEQ ID NO: 79658 - protein, 34 aa, Artificial Sequence
  Description of Artificial Sequence: Synthetic polypeptide
DEEEIRTTNPVATERYGSTVCSTGNAHPQFGGDR

SEQ ID NO: 79659 - protein, 32 aa, Artificial Sequence
  Description of Artificial Sequence: Synthetic polypeptide
DEHEIRTTNPVATEQYGSVTVTPNDQEGEEQI

SEQ ID NO: 79660 - protein, 31 aa, Artificial Sequence
  Description of Artificial Sequence: Synthetic polypeptide
DCEEIRATNPVATEQWGCSYHSDNLQNAGTR

SEQ ID NO: 79661 - protein, 32 aa, Artificial Sequence
  Description of Artificial Sequence: Synthetic polypeptide
DCEEIRSTNPVATEQYGSVSTMNQIAHNFIQR

SEQ ID NO: 79662 - protein, 30 aa, Artificial Sequence
  Description of Artificial Sequence: Synthetic polypeptide
DCEEIRSTNPVAYEQWGSSTSDNMGQRGNQ

SEQ ID NO: 79663 - protein, 34 aa, Artificial Sequence
  Description of Artificial Sequence: Synthetic polypeptide
DEEEIRTTNPVATEQYGCVCSTMELQHFGSNTQT

SEQ ID NO: 79664 - protein, 30 aa, Artificial Sequence
  Description of Artificial Sequence: Synthetic polypeptide
DCEEIRSTNPVAYEQWGSTSTNMQHQGNNS

SEQ ID NO: 79665 - protein, 33 aa, Artificial Sequence
  Description of Artificial Sequence: Synthetic polypeptide
DEEEIRTTNPVATEQYGCVCSTMELQNFNSDQT

SEQ ID NO: 79666 - protein, 33 aa, Artificial Sequence
  Description of Artificial Sequence: Synthetic polypeptide
DEEEIRTTNPVATEAFGQSVSCTYAQSLRGGNS

SEQ ID NO: 79667 - protein, 31 aa, Artificial Sequence
  Description of Artificial Sequence: Synthetic polypeptide
SETEIRCTNPVATEQYGSVYYTWNDQHGDNQ

SEQ ID NO: 79668 - protein, 31 aa, Artificial Sequence
  Description of Artificial Sequence: Synthetic polypeptide
SETEIRCTNPVATEQYGSVYTWNGDQHGNQQ

SEQ ID NO: 79669 - protein, 32 aa, Artificial Sequence
  Description of Artificial Sequence: Synthetic polypeptide
DEEEIRTTNPVATEQYGCVCSTMETQNSGSEQ

SEQ ID NO: 79670 - protein, 34 aa, Artificial Sequence
  Description of Artificial Sequence: Synthetic polypeptide
AEEEIRTTNPVATEQYGSVSSNNQLGNQQGNTNN

SEQ ID NO: 79671 - protein, 35 aa, Artificial Sequence
  Description of Artificial Sequence: Synthetic polypeptide
DEEEIRTTNPVATERYGKTVSCTVNALPQFGGNRT

SEQ ID NO: 79672 - protein, 34 aa, Artificial Sequence
  Description of Artificial Sequence: Synthetic polypeptide
DEEEIRTTNPVATEQYGCVCSNTYLQEGFNSDQY

SEQ ID NO: 79673 - protein, 32 aa, Artificial Sequence
  Description of Artificial Sequence: Synthetic polypeptide
AEEEIRTTNPVATEQYGSVSSNNQQQTNGTEM

SEQ ID NO: 79674 - protein, 31 aa, Artificial Sequence
  Description of Artificial Sequence: Synthetic polypeptide
SETEIRCTNPVATEQYGSVYHTDNDQHGGNQ

SEQ ID NO: 79675 - protein, 34 aa, Artificial Sequence
  Description of Artificial Sequence: Synthetic polypeptide
DEEEIRTTNPVATEQYGCVCSNTYHQRFGSDNQS

SEQ ID NO: 79676 - protein, 30 aa, Artificial Sequence
  Description of Artificial Sequence: Synthetic polypeptide
SETEIRCTNPIATEQWGSVWSENLAERGPR

SEQ ID NO: 79677 - protein, 34 aa, Artificial Sequence
  Description of Artificial Sequence: Synthetic polypeptide
TEEEIRTTNPVATEQYGSVSWTDNQQTQRNANDQ

SEQ ID NO: 79678 - protein, 33 aa, Artificial Sequence
  Description of Artificial Sequence: Synthetic polypeptide
DEAEIATTNPVATEQYGCVAATNLQATPGNTRD

SEQ ID NO: 79679 - protein, 33 aa, Artificial Sequence
  Description of Artificial Sequence: Synthetic polypeptide
DEEEIRTTNPVATEQYGCVCSTMNHQNFGSDQE

SEQ ID NO: 79680 - protein, 35 aa, Artificial Sequence
  Description of Artificial Sequence: Synthetic polypeptide
TEEEIRTTNPVATEQYGSVTSCTENEFSQPTGGNR

SEQ ID NO: 79681 - protein, 32 aa, Artificial Sequence
  Description of Artificial Sequence: Synthetic polypeptide
DDEEIRTTNPVATEQYGCVCSTELQNGSETQP

SEQ ID NO: 79682 - protein, 32 aa, Artificial Sequence
  Description of Artificial Sequence: Synthetic polypeptide
DEAEIATTNPVATEQYGCVAATNLQATGNTVE

SEQ ID NO: 79683 - protein, 33 aa, Artificial Sequence
  Description of Artificial Sequence: Synthetic polypeptide
DEEEIRTTNPVATEQYGCVCSTMNHQNFGSQQA

SEQ ID NO: 79684 - protein, 34 aa, Artificial Sequence
  Description of Artificial Sequence: Synthetic polypeptide
DEEEIRTTNPVATEQYGCVCSTMNHQNSGSENQD

SEQ ID NO: 79685 - protein, 33 aa, Artificial Sequence
  Description of Artificial Sequence: Synthetic polypeptide
DEEEIRTTNPVATEQYGCVCSTMNHQYFGSDQS

SEQ ID NO: 79686 - protein, 34 aa, Artificial Sequence
  Description of Artificial Sequence: Synthetic polypeptide
DEEEIRTTNPVATEQYGCVCSTMNHQYFGSENQS

SEQ ID NO: 79687 - protein, 34 aa, Artificial Sequence
  Description of Artificial Sequence: Synthetic polypeptide
DEEEIRTTNPVATEQYGCVCSTMNLQEGFGSDQS

SEQ ID NO: 79688 - protein, 34 aa, Artificial Sequence
  Description of Artificial Sequence: Synthetic polypeptide
DEEEIRTTNPVATEQYGCVCSTMNLQEGFGSDQT

SEQ ID NO: 79689 - protein, 33 aa, Artificial Sequence
  Description of Artificial Sequence: Synthetic polypeptide
AEEEIRTTNPVATEQYGSVSSTNNAEQGNQENI

SEQ ID NO: 79690 - protein, 35 aa, Artificial Sequence
  Description of Artificial Sequence: Synthetic polypeptide
DEEEIRTTNPVATEQYGCVCSTMNLQENFGSNFQP

SEQ ID NO: 79691 - protein, 30 aa, Artificial Sequence
  Description of Artificial Sequence: Synthetic polypeptide
DCEEIRSTNPVAYEQWGSSTSDNMQRDGNA

SEQ ID NO: 79692 - protein, 33 aa, Artificial Sequence
  Description of Artificial Sequence: Synthetic polypeptide
DEEEIRTTNPVATEAYGTVSTSNTNEQAGNNNF

SEQ ID NO: 79693 - protein, 34 aa, Artificial Sequence
  Description of Artificial Sequence: Synthetic polypeptide
DEEEIRTTNPVAFEQYGQVVISTGDLGQRGDRGI

SEQ ID NO: 79694 - protein, 33 aa, Artificial Sequence
  Description of Artificial Sequence: Synthetic polypeptide
DEEEIRTTNPVATEQYGCVCSNTNHQSFGSEFG

SEQ ID NO: 79695 - protein, 34 aa, Artificial Sequence
  Description of Artificial Sequence: Synthetic polypeptide
DEEEIRTTNPVATEQYGCVCSNTGNLQHFNSNQM

SEQ ID NO: 79696 - protein, 34 aa, Artificial Sequence
  Description of Artificial Sequence: Synthetic polypeptide
AEEEIRTTNPVATEQYGSVSTGNQQNDEGGNTNE

SEQ ID NO: 79697 - protein, 32 aa, Artificial Sequence
  Description of Artificial Sequence: Synthetic polypeptide
DDEEIRTTNPVATEQYGCVSTGNHQSFGSEQD

SEQ ID NO: 79698 - protein, 33 aa, Artificial Sequence
  Description of Artificial Sequence: Synthetic polypeptide
DEEEIRTTNPVATEQYGCVCSTTGELQHFGSEA

SEQ ID NO: 79699 - protein, 36 aa, Artificial Sequence
  Description of Artificial Sequence: Synthetic polypeptide
DEEEIRTTNPVATEQYGCVCSNTGNLQERFGSNNQA

SEQ ID NO: 79700 - protein, 33 aa, Artificial Sequence
  Description of Artificial Sequence: Synthetic polypeptide
AEEEIRTTNPVATEQYGSVSTGQQNQEQGNNDT

SEQ ID NO: 79701 - protein, 29 aa, Artificial Sequence
  Description of Artificial Sequence: Synthetic peptide
SENEIRTTNPIATEQYGSVSENEMNREDA

SEQ ID NO: 79702 - protein, 35 aa, Artificial Sequence
  Description of Artificial Sequence: Synthetic polypeptide
DEEEIRTTNPVATEQYGCVCSNTGNLQEFFGSNQS

SEQ ID NO: 79703 - protein, 30 aa, Artificial Sequence
  Description of Artificial Sequence: Synthetic polypeptide
SENEIRTTNPIATEQYGSVSENEMNRAEDR

SEQ ID NO: 79704 - protein, 30 aa, Artificial Sequence
  Description of Artificial Sequence: Synthetic polypeptide
DEFTIATTNPVATEQIGVVSTDTLQIGNNI

SEQ ID NO: 79705 - protein, 32 aa, Artificial Sequence
  Description of Artificial Sequence: Synthetic polypeptide
DEHEIRTTNPVAYEQYGTVSWTELDNRNGMNQ

SEQ ID NO: 79706 - protein, 34 aa, Artificial Sequence
  Description of Artificial Sequence: Synthetic polypeptide
DEEEIRTTNPVATEQYGCVCSTTGNLQENGSEQS

SEQ ID NO: 79707 - protein, 34 aa, Artificial Sequence
  Description of Artificial Sequence: Synthetic polypeptide
DEEEIRTTNPVATEQYGCVCSTTGNLQYFNSEQA

SEQ ID NO: 79708 - protein, 31 aa, Artificial Sequence
  Description of Artificial Sequence: Synthetic polypeptide
TEEEIRTTNPVAYEAYGKTVAYTDLQRNGNQ

SEQ ID NO: 79709 - protein, 31 aa, Artificial Sequence
  Description of Artificial Sequence: Synthetic polypeptide
TEEEIRTTNPVAYEAYGKTVAYTNDQRNENR

SEQ ID NO: 79710 - protein, 33 aa, Artificial Sequence
  Description of Artificial Sequence: Synthetic polypeptide
DDEEIRTTNPVATEQYGDVISTNDQNGGNGNIE

SEQ ID NO: 79711 - protein, 35 aa, Artificial Sequence
  Description of Artificial Sequence: Synthetic polypeptide
DEEEIRTTNPVATEQYGCVCSNTGNHQRFGSNTQS

SEQ ID NO: 79712 - protein, 33 aa, Artificial Sequence
  Description of Artificial Sequence: Synthetic polypeptide
DEHEIRTTNPVAYERWGSVSTNLNQGDAGGNTR

SEQ ID NO: 79713 - protein, 34 aa, Artificial Sequence
  Description of Artificial Sequence: Synthetic polypeptide
DEEEIRTTNPVATEQYGCVCSNTGNHQNGNSEQA

SEQ ID NO: 79714 - protein, 32 aa, Artificial Sequence
  Description of Artificial Sequence: Synthetic polypeptide
DEHEIRTTNPVAYERWGSVSTNLQGTGGGNTS

SEQ ID NO: 79715 - protein, 32 aa, Artificial Sequence
  Description of Artificial Sequence: Synthetic polypeptide
DEHEIRTTNPVAYERWGSVSTTNGLGGDGNER

SEQ ID NO: 79716 - protein, 30 aa, Artificial Sequence
  Description of Artificial Sequence: Synthetic polypeptide
DEHEIRTTNPVAYERYGEVTTNPNQGDNER

SEQ ID NO: 79717 - protein, 34 aa, Artificial Sequence
  Description of Artificial Sequence: Synthetic polypeptide
DEEEIRTTNPVATEQYGCVCSTTNLQENFNSNQM

SEQ ID NO: 79718 - protein, 32 aa, Artificial Sequence
  Description of Artificial Sequence: Synthetic polypeptide
DEEEIRTTNPLAYEQYGSVSCNISIRTVGNND

SEQ ID NO: 79719 - protein, 36 aa, Artificial Sequence
  Description of Artificial Sequence: Synthetic polypeptide
DEEEIRTTNPVATESYGNTVPSYTNALSQRPGGNQR

SEQ ID NO: 79720 - protein, 31 aa, Artificial Sequence
  Description of Artificial Sequence: Synthetic polypeptide
DEHEIRTTNPVAYERYGVVSTTNPMAGDNER

SEQ ID NO: 79721 - protein, 34 aa, Artificial Sequence
  Description of Artificial Sequence: Synthetic polypeptide
DEEEIRTTNPVATEQYGCVCSTTNNLQFFGSEQA

SEQ ID NO: 79722 - protein, 32 aa, Artificial Sequence
  Description of Artificial Sequence: Synthetic polypeptide
TEEEIRTTNPVAWEYYGSVTSTANHQMDEQNR

SEQ ID NO: 79723 - protein, 32 aa, Artificial Sequence
  Description of Artificial Sequence: Synthetic polypeptide
DEHEIRTTNPVAYEQYGTVATTNNLQDQGNEH

SEQ ID NO: 79724 - protein, 32 aa, Artificial Sequence
  Description of Artificial Sequence: Synthetic polypeptide
DEHEIRTTNPVAYEQYGSVSQNLSTSNGNNAL

SEQ ID NO: 79725 - protein, 32 aa, Artificial Sequence
  Description of Artificial Sequence: Synthetic polypeptide
DDEEIRTTNPVATEQYGCVSTDTLEQNGSEED

SEQ ID NO: 79726 - protein, 33 aa, Artificial Sequence
  Description of Artificial Sequence: Synthetic polypeptide
DEAEIATTNPVATEQYGAVSTNLNAGNAGESER

SEQ ID NO: 79727 - protein, 30 aa, Artificial Sequence
  Description of Artificial Sequence: Synthetic polypeptide
DEFVIGTTNPVATEQHGSVSTDFYQGGNIE

SEQ ID NO: 79728 - protein, 33 aa, Artificial Sequence
  Description of Artificial Sequence: Synthetic polypeptide
DEEEIRTTNPVATEQYGCVCSTTELQYFNSDQY

SEQ ID NO: 79729 - protein, 31 aa, Artificial Sequence
  Description of Artificial Sequence: Synthetic polypeptide
DEFVIGTTNPVATEQHGSVSTCFLQGIGNIA

SEQ ID NO: 79730 - protein, 32 aa, Artificial Sequence
  Description of Artificial Sequence: Synthetic polypeptide
DEHEIRTTNPVAYEQWGVVSTNLQDGQGMNPN

SEQ ID NO: 79731 - protein, 33 aa, Artificial Sequence
  Description of Artificial Sequence: Synthetic polypeptide
DEEEIRTTNPVATEQYGCVCSNTGYLQGGSEQT

SEQ ID NO: 79732 - protein, 31 aa, Artificial Sequence
  Description of Artificial Sequence: Synthetic polypeptide
DEHEIRTTNPVAYEQWGVVSTSLQRPDNGDA

SEQ ID NO: 79733 - protein, 33 aa, Artificial Sequence
  Description of Artificial Sequence: Synthetic polypeptide
DEEEIRTTNPVATEQYGCVCSTTGAHQNFGSNQ

SEQ ID NO: 79734 - protein, 33 aa, Artificial Sequence
  Description of Artificial Sequence: Synthetic polypeptide
AEEEIRTTNPVATEQYGSVSTEQNDTNNGTNNT

SEQ ID NO: 79735 - protein, 31 aa, Artificial Sequence
  Description of Artificial Sequence: Synthetic polypeptide
DEHEIRTTNPVAYEQWGVVTGGNLQGDGNGR

SEQ ID NO: 79736 - protein, 34 aa, Artificial Sequence
  Description of Artificial Sequence: Synthetic polypeptide
AEEEIRTTNPVATEQYGSVSTGNDNQEQGTNNDT

SEQ ID NO: 79737 - protein, 30 aa, Artificial Sequence
  Description of Artificial Sequence: Synthetic polypeptide
SENEIRTTNPVATEQYGSVSEIEMNAAGDR

SEQ ID NO: 79738 - protein, 32 aa, Artificial Sequence
  Description of Artificial Sequence: Synthetic polypeptide
DEHEIRTTNPVAYEQWGVVTSTNLQDGDGNGP

SEQ ID NO: 79739 - protein, 33 aa, Artificial Sequence
  Description of Artificial Sequence: Synthetic polypeptide
DEEEIRTTNPVATEQYGCVCSTTNPNQYFGSDF

SEQ ID NO: 79740 - protein, 29 aa, Artificial Sequence
  Description of Artificial Sequence: Synthetic peptide
SENEIRTTNPVATEQYGDVSENEMAAEDR

SEQ ID NO: 79741 - protein, 30 aa, Artificial Sequence
  Description of Artificial Sequence: Synthetic polypeptide
SENEIRTTNPVATEQYGDVSEILMNAAGDR

SEQ ID NO: 79742 - protein, 32 aa, Artificial Sequence
  Description of Artificial Sequence: Synthetic polypeptide
DEHEIRTTNPVAYEQYGEVVSTGNLGDDQGER

SEQ ID NO: 79743 - protein, 32 aa, Artificial Sequence
  Description of Artificial Sequence: Synthetic polypeptide
DEHEIRTTNPVAYEQYGEVVSTNGLGEDQGER

SEQ ID NO: 79744 - protein, 34 aa, Artificial Sequence
  Description of Artificial Sequence: Synthetic polypeptide
DEEEIRTTNPVATEQYGCVCSNTGPLERFGSNQA

SEQ ID NO: 79745 - protein, 32 aa, Artificial Sequence
  Description of Artificial Sequence: Synthetic polypeptide
DEHEIRTTNPVAYEQYGEVVSTNLNGDQGDER

SEQ ID NO: 79746 - protein, 30 aa, Artificial Sequence
  Description of Artificial Sequence: Synthetic polypeptide
SENEIRTTNPVATEQWGSVSENEMNRAEDR

SEQ ID NO: 79747 - protein, 32 aa, Artificial Sequence
  Description of Artificial Sequence: Synthetic polypeptide
DEFVIGTTNPVATEQDGSAVSETDFLEERGNR

SEQ ID NO: 79748 - protein, 33 aa, Artificial Sequence
  Description of Artificial Sequence: Synthetic polypeptide
DEEEIRTTNPVATEQYGCVCSNTGPHQGGGSNQ

SEQ ID NO: 79749 - protein, 33 aa, Artificial Sequence
  Description of Artificial Sequence: Synthetic polypeptide
DEHEIRTTNPVAYEQYGSISCTNTSQIAGGMNR

SEQ ID NO: 79750 - protein, 32 aa, Artificial Sequence
  Description of Artificial Sequence: Synthetic polypeptide
DAEEIATTNPVAYEQYGSVVATNLQNGDNAEM

SEQ ID NO: 79751 - protein, 33 aa, Artificial Sequence
  Description of Artificial Sequence: Synthetic polypeptide
DAEEIATTNPVAYEQYGSVVATNLQDRGPNTEI

SEQ ID NO: 79752 - protein, 30 aa, Artificial Sequence
  Description of Artificial Sequence: Synthetic polypeptide
SENEIRTTNPVATEPYGSISMDIQMRNGNH

SEQ ID NO: 79753 - protein, 34 aa, Artificial Sequence
  Description of Artificial Sequence: Synthetic polypeptide
DEEEIRTTNPVATEQYGCVCSNTGNLQYFNSDQG

SEQ ID NO: 79754 - protein, 32 aa, Artificial Sequence
  Description of Artificial Sequence: Synthetic polypeptide
DDEEIRTTNPVATEQYGCVCSWGNLQNFNSNQ

SEQ ID NO: 79755 - protein, 34 aa, Artificial Sequence
  Description of Artificial Sequence: Synthetic polypeptide
DEEEIRTTNPVATEQYGCVCSTTNTQENFGSERA

SEQ ID NO: 79756 - protein, 33 aa, Artificial Sequence
  Description of Artificial Sequence: Synthetic polypeptide
AEEEIRTTNPVATEQYGSVSTINNGNNDEGNTE

SEQ ID NO: 79757 - protein, 33 aa, Artificial Sequence
  Description of Artificial Sequence: Synthetic polypeptide
AEEEIRTTNPVATEQYGSVSTLNQQANNNNTTD

SEQ ID NO: 79758 - protein, 35 aa, Artificial Sequence
  Description of Artificial Sequence: Synthetic polypeptide
DEFEIRTTNPVATEQYGKVPSCTGNHQRTGTNNRE

SEQ ID NO: 79759 - protein, 34 aa, Artificial Sequence
  Description of Artificial Sequence: Synthetic polypeptide
DEEEIRTTNPVATEQYGCVCSNTGELQYFGSERF

SEQ ID NO: 79760 - protein, 32 aa, Artificial Sequence
  Description of Artificial Sequence: Synthetic polypeptide
DEIAIRTTNPVATEQYGYSDASTGNLIINGER

SEQ ID NO: 79761 - protein, 32 aa, Artificial Sequence
  Description of Artificial Sequence: Synthetic polypeptide
DEIEIATTNPVATEQYGSVSATDLEDHEGNDL

SEQ ID NO: 79762 - protein, 34 aa, Artificial Sequence
  Description of Artificial Sequence: Synthetic polypeptide
DEEEIRTTNPVATEQYGCVCSNTGELQNFGSVRG

SEQ ID NO: 79763 - protein, 32 aa, Artificial Sequence
  Description of Artificial Sequence: Synthetic polypeptide
DEFEIMTVNPVATEQYGSVSYTTMNLDFEGNH

SEQ ID NO: 79764 - protein, 32 aa, Artificial Sequence
  Description of Artificial Sequence: Synthetic polypeptide
DEIEICTVNPVATEQYGSISTNLEFPQMGVNE

SEQ ID NO: 79765 - protein, 28 aa, Artificial Sequence
  Description of Artificial Sequence: Synthetic peptide
SENEIATTNPVATECYGDVSECLQREEL

SEQ ID NO: 79766 - protein, 32 aa, Artificial Sequence
  Description of Artificial Sequence: Synthetic polypeptide
TEEEIRTTNPVAYEAYGTVSCTNLHRGTDQNN

SEQ ID NO: 79767 - protein, 28 aa, Artificial Sequence
  Description of Artificial Sequence: Synthetic peptide
SENEIATTNPVATECYGDVSECLMHENR

SEQ ID NO: 79768 - protein, 31 aa, Artificial Sequence
  Description of Artificial Sequence: Synthetic polypeptide
DEFEICTVNPVATESYGSVSDTMNLEFEGNH

SEQ ID NO: 79769 - protein, 34 aa, Artificial Sequence
  Description of Artificial Sequence: Synthetic polypeptide
DEIEIRTTNPVATEQYGVVSVSTNLVQDGGGMVH

SEQ ID NO: 79770 - protein, 31 aa, Artificial Sequence
  Description of Artificial Sequence: Synthetic polypeptide
DEFEICTVNPVATEQYGSVSTPLEFEGFNEH

SEQ ID NO: 79771 - protein, 34 aa, Artificial Sequence
  Description of Artificial Sequence: Synthetic polypeptide
TEEEIRTTNPVAYEAYGSVSTANELSQRGENYMN

SEQ ID NO: 79772 - protein, 32 aa, Artificial Sequence
  Description of Artificial Sequence: Synthetic polypeptide
TEEEIRTTNPVAYEHYGSVPSNGELIQQSGNR

SEQ ID NO: 79773 - protein, 33 aa, Artificial Sequence
  Description of Artificial Sequence: Synthetic polypeptide
DEISEIATTNPVAYEQWGSVSTNLQGNMGDNER

SEQ ID NO: 79774 - protein, 31 aa, Artificial Sequence
  Description of Artificial Sequence: Synthetic polypeptide
DEISEIATTNPVAYERWGSVSTNLQDGNDDS

SEQ ID NO: 79775 - protein, 35 aa, Artificial Sequence
  Description of Artificial Sequence: Synthetic polypeptide
DEEEIRTTNPLAYEQYGQSVSATGNALSQLRVGDR

SEQ ID NO: 79776 - protein, 31 aa, Artificial Sequence
  Description of Artificial Sequence: Synthetic polypeptide
DEIVIGTTNPVATEQWGTVSTGDFGQDRGNR

SEQ ID NO: 79777 - protein, 33 aa, Artificial Sequence
  Description of Artificial Sequence: Synthetic polypeptide
DDEEIRTTNPVATEQYGQCVCSTNDQNFGSNQA

SEQ ID NO: 79778 - protein, 32 aa, Artificial Sequence
  Description of Artificial Sequence: Synthetic polypeptide
DEIVIGTTNPVATEQWGTVSTGDFLDQRGNGR

SEQ ID NO: 79779 - protein, 33 aa, Artificial Sequence
  Description of Artificial Sequence: Synthetic polypeptide
DEEEIRTTNPVATEQYGCVCSTYDQENFGSNQS

SEQ ID NO: 79780 - protein, 32 aa, Artificial Sequence
  Description of Artificial Sequence: Synthetic polypeptide
DEEEIRTTNPVATEQYGCVCSTYDQGFGSDQS

SEQ ID NO: 79781 - protein, 31 aa, Artificial Sequence
  Description of Artificial Sequence: Synthetic polypeptide
DEIVIGTTNPVATEQWGTVSTMDFDQRGNER

SEQ ID NO: 79782 - protein, 32 aa, Artificial Sequence
  Description of Artificial Sequence: Synthetic polypeptide
TEEEIRTTNPVAYEPWGSVSCTNELQRSTNHT

SEQ ID NO: 79783 - protein, 30 aa, Artificial Sequence
  Description of Artificial Sequence: Synthetic polypeptide
TEEEIRTTNPVAYEPYGEVPSLNLQFGGSE

SEQ ID NO: 79784 - protein, 32 aa, Artificial Sequence
  Description of Artificial Sequence: Synthetic polypeptide
DEEEIRTTNPVATEQYGCVCSTYDQNFGSDQV

SEQ ID NO: 79785 - protein, 33 aa, Artificial Sequence
  Description of Artificial Sequence: Synthetic polypeptide
TEEEIRTTNPVAYEPYGISVSTVNLSQQRVTNQ

SEQ ID NO: 79786 - protein, 28 aa, Artificial Sequence
  Description of Artificial Sequence: Synthetic peptide
SENEIATTNPIATECYGSVSENLQHEEL

SEQ ID NO: 79787 - protein, 32 aa, Artificial Sequence
  Description of Artificial Sequence: Synthetic polypeptide
DEEEIRTTNPVATEQYGCVCSTTELQHNSDQL

SEQ ID NO: 79788 - protein, 32 aa, Artificial Sequence
  Description of Artificial Sequence: Synthetic polypeptide
TEEEIRTTNPVAYEAYGSVSCTNLHDGTDQRM

SEQ ID NO: 79789 - protein, 33 aa, Artificial Sequence
  Description of Artificial Sequence: Synthetic polypeptide
DEEEIRTTNPVATEQYGCVCSTWELQNFGSEQV

SEQ ID NO: 79790 - protein, 32 aa, Artificial Sequence
  Description of Artificial Sequence: Synthetic polypeptide
TEEEIRTTNPVAYEAYGQVSCTNLHRGTDQRH

SEQ ID NO: 79791 - protein, 30 aa, Artificial Sequence
  Description of Artificial Sequence: Synthetic polypeptide
DEHEIRTTNPVAYERYGVVTTNPDNGDNER

SEQ ID NO: 79792 - protein, 28 aa, Artificial Sequence
  Description of Artificial Sequence: Synthetic peptide
SENEIRCTNPVATEQWGSVSENEMAGDA

SEQ ID NO: 79793 - protein, 31 aa, Artificial Sequence
  Description of Artificial Sequence: Synthetic polypeptide
TEEEIRTTNPVAYEAYGSISCTNLHHGTDQR

SEQ ID NO: 79794 - protein, 29 aa, Artificial Sequence
  Description of Artificial Sequence: Synthetic peptide
SENEIRCTNPVATEPYGSISMDIQMRGNH

SEQ ID NO: 79795 - protein, 32 aa, Artificial Sequence
  Description of Artificial Sequence: Synthetic polypeptide
DEHEIRTTNPVAYESWGSVSTNLQLPGDNGDM

SEQ ID NO: 79796 - protein, 34 aa, Artificial Sequence
  Description of Artificial Sequence: Synthetic polypeptide
DEEEIRTTNPVATEQYGCVCSNTGNHQEYFGSNQ

SEQ ID NO: 79797 - protein, 33 aa, Artificial Sequence
  Description of Artificial Sequence: Synthetic polypeptide
TEEEIRTTNPVAYEAYGSLVSCTNMLHRGTDQR

SEQ ID NO: 79798 - protein, 33 aa, Artificial Sequence
  Description of Artificial Sequence: Synthetic polypeptide
DEEEIRTTNPVATESYGSSVAVEANLSGMGMNR

SEQ ID NO: 79799 - protein, 29 aa, Artificial Sequence
  Description of Artificial Sequence: Synthetic peptide
SENEIRCTNPIATEQYGTVSMDLMQNGNH

SEQ ID NO: 79800 - protein, 32 aa, Artificial Sequence
  Description of Artificial Sequence: Synthetic polypeptide
DEFEISTVNPVATEQYGSVCSTNLFNFGGNQS

SEQ ID NO: 79801 - protein, 33 aa, Artificial Sequence
  Description of Artificial Sequence: Synthetic polypeptide
TEEEIRTTNPVAYEAYGSVNATNELSQRGGNMN

SEQ ID NO: 79802 - protein, 32 aa, Artificial Sequence
  Description of Artificial Sequence: Synthetic polypeptide
TEEEIRTTNPVAYEAYGSVPCNGELFQIGGNR

SEQ ID NO: 79803 - protein, 32 aa, Artificial Sequence
  Description of Artificial Sequence: Synthetic polypeptide
TEEEIRTTNPVAYEAYGSVPSWGELFQSQGNR

SEQ ID NO: 79804 - protein, 32 aa, Artificial Sequence
  Description of Artificial Sequence: Synthetic polypeptide
DEEEIRTTNPLAYEQYGSVPCTWLSHRGGENE

SEQ ID NO: 79805 - protein, 31 aa, Artificial Sequence
  Description of Artificial Sequence: Synthetic polypeptide
DEAEIATTNPVATEQWGSVSTNPNADANNRA

SEQ ID NO: 79806 - protein, 31 aa, Artificial Sequence
  Description of Artificial Sequence: Synthetic polypeptide
DAEEIATTNPVAYEQYGSVATNLQTANPGET

SEQ ID NO: 79807 - protein, 33 aa, Artificial Sequence
  Description of Artificial Sequence: Synthetic polypeptide
DEAEIATTNPVATEQWGSVSTNLNQGDTGGNDA

SEQ ID NO: 79808 - protein, 33 aa, Artificial Sequence
  Description of Artificial Sequence: Synthetic polypeptide
DEEEIRTTNPVATEQYGCVCSTVPLQGFGSEQG

SEQ ID NO: 79809 - protein, 33 aa, Artificial Sequence
  Description of Artificial Sequence: Synthetic polypeptide
DEAEIATTNPVATEQWGSVSTNLNQGDAGQNDH

SEQ ID NO: 79810 - protein, 32 aa, Artificial Sequence
  Description of Artificial Sequence: Synthetic polypeptide
DAEEIATTNPVAYEQYGSVATNLQRPGDDTLA

SEQ ID NO: 79811 - protein, 30 aa, Artificial Sequence
  Description of Artificial Sequence: Synthetic polypeptide
SENEIRCTNPIATEQYGSVSENEMNAAGNR

SEQ ID NO: 79812 - protein, 31 aa, Artificial Sequence
  Description of Artificial Sequence: Synthetic polypeptide
DAEEIATTNPVAYEQYGSVATNLQQGDITDQ

SEQ ID NO: 79813 - protein, 32 aa, Artificial Sequence
  Description of Artificial Sequence: Synthetic polypeptide
DAEEIATTNPVAYEQYGSVATNLQGAPEEGNF

SEQ ID NO: 79814 - protein, 29 aa, Artificial Sequence
  Description of Artificial Sequence: Synthetic peptide
SENEIRCTNPIATEQYGSISEDIQMRGNH

SEQ ID NO: 79815 - protein, 32 aa, Artificial Sequence
  Description of Artificial Sequence: Synthetic polypeptide
DEHEISTTNPVAYEQWGSVSTNLQNEGGDNGQ

SEQ ID NO: 79816 - protein, 33 aa, Artificial Sequence
  Description of Artificial Sequence: Synthetic polypeptide
DEEEIRTTNPVATEQYGCVCSTWEHQNFGSNQA

SEQ ID NO: 79817 - protein, 31 aa, Artificial Sequence
  Description of Artificial Sequence: Synthetic polypeptide
DEAEIATTNPVATEQWGSVSTGIQHGDNQDY

SEQ ID NO: 79818 - protein, 31 aa, Artificial Sequence
  Description of Artificial Sequence: Synthetic polypeptide
DEFEISTVNPVATEQYGCVCSTNLFSFGNNQ

SEQ ID NO: 79819 - protein, 33 aa, Artificial Sequence
  Description of Artificial Sequence: Synthetic polypeptide
DEEEIRTTNPVATEQYGCVCSTTELNQGFGSEQ

SEQ ID NO: 79820 - protein, 31 aa, Artificial Sequence
  Description of Artificial Sequence: Synthetic polypeptide
DEFVIGTTNPVATEQHGSVSTTDFLQGGNEI

SEQ ID NO: 79821 - protein, 30 aa, Artificial Sequence
  Description of Artificial Sequence: Synthetic polypeptide
SENEIRTTNPVATEQYGTISEDLQQQNGNH

SEQ ID NO: 79822 - protein, 33 aa, Artificial Sequence
  Description of Artificial Sequence: Synthetic polypeptide
DEHEIRTTNPVAYEQWGSVSTNGGGQERNGNTQ

SEQ ID NO: 79823 - protein, 28 aa, Artificial Sequence
  Description of Artificial Sequence: Synthetic peptide
SESEIACTNPIGTEGYGSVASTLQRGDR

SEQ ID NO: 79824 - protein, 34 aa, Artificial Sequence
  Description of Artificial Sequence: Synthetic polypeptide
DEEEIRTTNPVATEQYGCVCSNTNHQFGNSNTQS

SEQ ID NO: 79825 - protein, 32 aa, Artificial Sequence
  Description of Artificial Sequence: Synthetic polypeptide
DEHEIRTTNPVAYEQWGSVSTNIQQNGDVQNG

SEQ ID NO: 79826 - protein, 32 aa, Artificial Sequence
  Description of Artificial Sequence: Synthetic polypeptide
DEEEIRTTNPTATEQYGSVSITDTVRFINIEQ

SEQ ID NO: 79827 - protein, 34 aa, Artificial Sequence
  Description of Artificial Sequence: Synthetic polypeptide
DEEEIRTTNPTATEQYGSVCSYTNIDDGRGNTDS

SEQ ID NO: 79828 - protein, 34 aa, Artificial Sequence
  Description of Artificial Sequence: Synthetic polypeptide
DEEEIRTTNPVATEQYGCVCSTNNPQERFGSEQE

SEQ ID NO: 79829 - protein, 33 aa, Artificial Sequence
  Description of Artificial Sequence: Synthetic polypeptide
DEEEIRTTNPTATEQWGSVSTNNAHQPDWGNSD

SEQ ID NO: 79830 - protein, 33 aa, Artificial Sequence
  Description of Artificial Sequence: Synthetic polypeptide
DEEEIRTTNPTATECYGSVCSKTENDAREGGNA

SEQ ID NO: 79831 - protein, 35 aa, Artificial Sequence
  Description of Artificial Sequence: Synthetic polypeptide
DEEEIRTTNPVATEQYGCVCSNTNHQERFGSNNQM

SEQ ID NO: 79832 - protein, 33 aa, Artificial Sequence
  Description of Artificial Sequence: Synthetic polypeptide
DEEEIRTTNPVATERYGSVSVSGNLSQTVGDQW

SEQ ID NO: 79833 - protein, 33 aa, Artificial Sequence
  Description of Artificial Sequence: Synthetic polypeptide
DEEEIRTTNPVATEQYGCVCSTNPNQNFNSEQM

SEQ ID NO: 79834 - protein, 33 aa, Artificial Sequence
  Description of Artificial Sequence: Synthetic polypeptide
DEEEIRTTNPVATEQYGCVCSTNPQEFFGSDQQ

SEQ ID NO: 79835 - protein, 33 aa, Artificial Sequence
  Description of Artificial Sequence: Synthetic polypeptide
DEEEIRTTNPVATEQYGCVCSNTNHQGFGSQQT

SEQ ID NO: 79836 - protein, 32 aa, Artificial Sequence
  Description of Artificial Sequence: Synthetic polypeptide
DEEEIRTTNPVATEQYGCVCSTNPQHFISEQA

SEQ ID NO: 79837 - protein, 33 aa, Artificial Sequence
  Description of Artificial Sequence: Synthetic polypeptide
DEEEIRTTNPVATEQYGCVCSTNPQNFGSQTQL

SEQ ID NO: 79838 - protein, 32 aa, Artificial Sequence
  Description of Artificial Sequence: Synthetic polypeptide
DEEEIRTTNPVATEQYGCVCSTNTAGFNSNQT

SEQ ID NO: 79839 - protein, 32 aa, Artificial Sequence
  Description of Artificial Sequence: Synthetic polypeptide
DEEEIRTTNPVATEQYGCVCSTNTIGFGSDQA

SEQ ID NO: 79840 - protein, 32 aa, Artificial Sequence
  Description of Artificial Sequence: Synthetic polypeptide
DDEEIRTTNPVATEQYGCVCSTNDQNFNSNQA

SEQ ID NO: 79841 - protein, 31 aa, Artificial Sequence
  Description of Artificial Sequence: Synthetic polypeptide
SEQEIRTTNPVATEQYGSVSAEDLMDHGNDL

SEQ ID NO: 79842 - protein, 33 aa, Artificial Sequence
  Description of Artificial Sequence: Synthetic polypeptide
DEEEIRTTNPSATDPYGSVCFTNSQHNRGGNVR

SEQ ID NO: 79843 - protein, 32 aa, Artificial Sequence
  Description of Artificial Sequence: Synthetic polypeptide
DAGEIATTNPVATEQYGSVSWNDLQDTDGTMR

SEQ ID NO: 79844 - protein, 33 aa, Artificial Sequence
  Description of Artificial Sequence: Synthetic polypeptide
DEEEIRTTNPVATEQYGCVCSTNTTEGFGSNQT

SEQ ID NO: 79845 - protein, 31 aa, Artificial Sequence
  Description of Artificial Sequence: Synthetic polypeptide
DEEEIRTTNPNATEEYGSVCETNHGNFGSNA

SEQ ID NO: 79846 - protein, 34 aa, Artificial Sequence
  Description of Artificial Sequence: Synthetic polypeptide
AEEEIRTTNPVATEQYGSVSTDNNENQQTGTNND

SEQ ID NO: 79847 - protein, 31 aa, Artificial Sequence
  Description of Artificial Sequence: Synthetic polypeptide
SEQEIRTTNPIATEQYGSVSAEDLMDHGNDR

SEQ ID NO: 79848 - protein, 33 aa, Artificial Sequence
  Description of Artificial Sequence: Synthetic polypeptide
DAGEIATTNPVATEQYGNVSWTENDLQDTGNMR

SEQ ID NO: 79849 - protein, 32 aa, Artificial Sequence
  Description of Artificial Sequence: Synthetic polypeptide
DEEEIRTTNPVATEQYGCVCSTPELEGFISNQ

SEQ ID NO: 79850 - protein, 31 aa, Artificial Sequence
  Description of Artificial Sequence: Synthetic polypeptide
DEEEIRTTNPSAYEQYGSVPCTGLSARGGSE

SEQ ID NO: 79851 - protein, 33 aa, Artificial Sequence
  Description of Artificial Sequence: Synthetic polypeptide
DEEEIRTTNPVATEQYGCVCSNTNHQEFGSDQA

SEQ ID NO: 79852 - protein, 28 aa, Artificial Sequence
  Description of Artificial Sequence: Synthetic peptide
SESEIACTNPIGTEQYGSVASNLQRGDI

SEQ ID NO: 79853 - protein, 31 aa, Artificial Sequence
  Description of Artificial Sequence: Synthetic polypeptide
DEEEIRTTNPVACEQYGCITSNCALERGNNQ

SEQ ID NO: 79854 - protein, 35 aa, Artificial Sequence
  Description of Artificial Sequence: Synthetic polypeptide
DEEEIRTTNPVAFEQYGQSGVSTDNDLLQRNIRGG

SEQ ID NO: 79855 - protein, 36 aa, Artificial Sequence
  Description of Artificial Sequence: Synthetic polypeptide
DEEEIRTTNPVAFEQYGQSGVSIQTNDLGQRGDRGQ

SEQ ID NO: 79856 - protein, 36 aa, Artificial Sequence
  Description of Artificial Sequence: Synthetic polypeptide
DEEEIRTTNPVAFEQYGQSGVSGQTNDELQRGIRGQ

SEQ ID NO: 79857 - protein, 33 aa, Artificial Sequence
  Description of Artificial Sequence: Synthetic polypeptide
DEEEIRTTNPVAFEQYGQIVSQNDLTQMGTERM

SEQ ID NO: 79858 - protein, 33 aa, Artificial Sequence
  Description of Artificial Sequence: Synthetic polypeptide
DEEEIRTTNPVAFEQYGDVVNTGDLGQRGDRGI

SEQ ID NO: 79859 - protein, 33 aa, Artificial Sequence
  Description of Artificial Sequence: Synthetic polypeptide
AEEEIRTTNPVATEQYGSVSTANQNGEEGGNNE

SEQ ID NO: 79860 - protein, 31 aa, Artificial Sequence
  Description of Artificial Sequence: Synthetic polypeptide
SESEIRCTNPCATEQYGSVNSLENLERGSNQ

SEQ ID NO: 79861 - protein, 31 aa, Artificial Sequence
  Description of Artificial Sequence: Synthetic polypeptide
SESEIRCTNPCATEQYGSVCSPENLHRGNQD

SEQ ID NO: 79862 - protein, 34 aa, Artificial Sequence
  Description of Artificial Sequence: Synthetic polypeptide
TEEEIRTTNPVATERYGSTVPSCTNAQPQFGNNR

SEQ ID NO: 79863 - protein, 33 aa, Artificial Sequence
  Description of Artificial Sequence: Synthetic polypeptide
DEEEIRTTNPVATEQYGCVCSNTNHQNSNSDQP

SEQ ID NO: 79864 - protein, 33 aa, Artificial Sequence
  Description of Artificial Sequence: Synthetic polypeptide
DAGEIATTNPVATEQYGSVSWTNDLEQDTGDMR

SEQ ID NO: 79865 - protein, 33 aa, Artificial Sequence
  Description of Artificial Sequence: Synthetic polypeptide
DEEEIRTTNPVATEQYGCVCSNTNHQNSGSEQD

SEQ ID NO: 79866 - protein, 31 aa, Artificial Sequence
  Description of Artificial Sequence: Synthetic polypeptide
DEHEIRTTNPVAYEQWGSVSHELDDRQNMER

SEQ ID NO: 79867 - protein, 28 aa, Artificial Sequence
  Description of Artificial Sequence: Synthetic peptide
SESEIACTNPISTEQYGNVSETLQRGQR

SEQ ID NO: 79868 - protein, 32 aa, Artificial Sequence
  Description of Artificial Sequence: Synthetic polypeptide
DEHEIRTTNPVAYEQWGSVSHNLDDQQNMNRV

SEQ ID NO: 79869 - protein, 33 aa, Artificial Sequence
  Description of Artificial Sequence: Synthetic polypeptide
DAGEIATTNPVATEQYGSVSWTENDLQDTGTER

SEQ ID NO: 79870 - protein, 28 aa, Artificial Sequence
  Description of Artificial Sequence: Synthetic peptide
SESEIASTNPVATEGYGVMAENLQRGNI

SEQ ID NO: 79871 - protein, 31 aa, Artificial Sequence
  Description of Artificial Sequence: Synthetic polypeptide
DEHEIRTTNPVAYEQWGSVSHPNLDDRNMNH

SEQ ID NO: 79872 - protein, 33 aa, Artificial Sequence
  Description of Artificial Sequence: Synthetic polypeptide
DEEEIRTTNPVADEQYGSVSCTNGTQNFGDQGE

SEQ ID NO: 79873 - protein, 32 aa, Artificial Sequence
  Description of Artificial Sequence: Synthetic polypeptide
DEEEIRTTNPVACEQYGVVVVTNDNLQQGIEE

SEQ ID NO: 79874 - protein, 32 aa, Artificial Sequence
  Description of Artificial Sequence: Synthetic polypeptide
DEEEIRTTNPVACEQYGVVVTTNNLLQAGITE

SEQ ID NO: 79875 - protein, 33 aa, Artificial Sequence
  Description of Artificial Sequence: Synthetic polypeptide
DEFVIRTTNPVATEQYGCVPACTNEPSQRPGNR

SEQ ID NO: 79876 - protein, 28 aa, Artificial Sequence
  Description of Artificial Sequence: Synthetic peptide
SESEIASTNPVATEGYGSMAENLMRGNI

SEQ ID NO: 79877 - protein, 33 aa, Artificial Sequence
  Description of Artificial Sequence: Synthetic polypeptide
DDEEIRTTNPVATEQYGCVCSTGELQRFGSEQM

SEQ ID NO: 79878 - protein, 33 aa, Artificial Sequence
  Description of Artificial Sequence: Synthetic polypeptide
DEEEIRTTNPVATEQYGCVCSTNNHQFFGSELV

SEQ ID NO: 79879 - protein, 33 aa, Artificial Sequence
  Description of Artificial Sequence: Synthetic polypeptide
DAGEIATTNPVATEQYGSVSWTENDLQDTDGSR

SEQ ID NO: 79880 - protein, 34 aa, Artificial Sequence
  Description of Artificial Sequence: Synthetic polypeptide
DEEEIRTTNPVATEQYGCVCSNTNHQGSGSDNQP

SEQ ID NO: 79881 - protein, 34 aa, Artificial Sequence
  Description of Artificial Sequence: Synthetic polypeptide
DEEEIRTTNPVATEQYGCVCSTNNHQGFGSNTQG

SEQ ID NO: 79882 - protein, 34 aa, Artificial Sequence
  Description of Artificial Sequence: Synthetic polypeptide
DAGEIATTNPVATEQYGSVSWTENDLQDTRGMER

SEQ ID NO: 79883 - protein, 32 aa, Artificial Sequence
  Description of Artificial Sequence: Synthetic polypeptide
DEFEICTVNPVATEQYGSVSTNGLMDEGGGNH

SEQ ID NO: 79884 - protein, 32 aa, Artificial Sequence
  Description of Artificial Sequence: Synthetic polypeptide
DEEEIRTTNPVATEQYGCVCSTPHANFGSNQM

SEQ ID NO: 79885 - protein, 32 aa, Artificial Sequence
  Description of Artificial Sequence: Synthetic polypeptide
DEEEIRTTNPVATEQYGCVCSTPHQHFGSEPQ

SEQ ID NO: 79886 - protein, 29 aa, Artificial Sequence
  Description of Artificial Sequence: Synthetic peptide
DAEEICSTNPVAYEPYGSSATNDQRGNTM

SEQ ID NO: 79887 - protein, 33 aa, Artificial Sequence
  Description of Artificial Sequence: Synthetic polypeptide
DEEEIRTTNPVATEQYGCVCSTSNHQNFGSDQE

SEQ ID NO: 79888 - protein, 33 aa, Artificial Sequence
  Description of Artificial Sequence: Synthetic polypeptide
DEHEIRTTNPVAYEQWGSVSTNLQQNGGDNGAA

SEQ ID NO: 79889 - protein, 32 aa, Artificial Sequence
  Description of Artificial Sequence: Synthetic polypeptide
DEEEIRTTNPVATEAYGTVSTSTNDEQGNTNF

SEQ ID NO: 79890 - protein, 33 aa, Artificial Sequence
  Description of Artificial Sequence: Synthetic polypeptide
DDEEIRTTNPVATEQYGCVCSTNLQENFGSQQA

SEQ ID NO: 79891 - protein, 30 aa, Artificial Sequence
  Description of Artificial Sequence: Synthetic polypeptide
DAEEIATTNPVGTEQWGTVSTNLQHDGMHN

SEQ ID NO: 79892 - protein, 33 aa, Artificial Sequence
  Description of Artificial Sequence: Synthetic polypeptide
DDEEIRTTNPVATEQYGCVCSTPLQNFGSNTQP

SEQ ID NO: 79893 - protein, 33 aa, Artificial Sequence
  Description of Artificial Sequence: Synthetic polypeptide
DEEEIRTTNPVATEQYGCVCSTTEEHQHGSNQN

SEQ ID NO: 79894 - protein, 32 aa, Artificial Sequence
  Description of Artificial Sequence: Synthetic polypeptide
DEHEIRTTNPVAYEQWGSVSTNMQPGGDNGSH

SEQ ID NO: 79895 - protein, 32 aa, Artificial Sequence
  Description of Artificial Sequence: Synthetic polypeptide
DEHEIRTTNPVAYEQWGSVSTNNQQNGDVQRG

SEQ ID NO: 79896 - protein, 32 aa, Artificial Sequence
  Description of Artificial Sequence: Synthetic polypeptide
DEHEIRTTNPVAYEQWGSVSTNPNGNGNGNVR

SEQ ID NO: 79897 - protein, 32 aa, Artificial Sequence
  Description of Artificial Sequence: Synthetic polypeptide
DEHEIRTTNPVAYEQWGSVSTTNDTNHGGNQR

SEQ ID NO: 79898 - protein, 35 aa, Artificial Sequence
  Description of Artificial Sequence: Synthetic polypeptide
AEEEIRTTNPVATEQYGSVSTENNNLQGNDNGNQT

SEQ ID NO: 79899 - protein, 33 aa, Artificial Sequence
  Description of Artificial Sequence: Synthetic polypeptide
TEEEIRTTNPVATERYGTVISTGELSQAGGNRF

SEQ ID NO: 79900 - protein, 31 aa, Artificial Sequence
  Description of Artificial Sequence: Synthetic polypeptide
DEHEIRTTNPVAYEQWGSVTSTNDNHEGNNH

SEQ ID NO: 79901 - protein, 34 aa, Artificial Sequence
  Description of Artificial Sequence: Synthetic polypeptide
AEEEIRTTNPVATEQYGSVSTENNQQGNDNGNVE

SEQ ID NO: 79902 - protein, 34 aa, Artificial Sequence
  Description of Artificial Sequence: Synthetic polypeptide
DEEEIRTTNPVATEQYGCVCSNTMNLQYFGSEQT

SEQ ID NO: 79903 - protein, 33 aa, Artificial Sequence
  Description of Artificial Sequence: Synthetic polypeptide
DEHEIRTTNPVAYEQWGSVTSTNLGQGDGNNGP

SEQ ID NO: 79904 - protein, 32 aa, Artificial Sequence
  Description of Artificial Sequence: Synthetic polypeptide
DEFVIGTTNPVATEQYHGNSVSTDFLQGGNFA

SEQ ID NO: 79905 - protein, 33 aa, Artificial Sequence
  Description of Artificial Sequence: Synthetic polypeptide
TEEEIRTTNPVATERYGTVVSTNELSQAMGSRF

SEQ ID NO: 79906 - protein, 30 aa, Artificial Sequence
  Description of Artificial Sequence: Synthetic polypeptide
SENEIRTTNPVATEQYGTISEENIMQNGNH

SEQ ID NO: 79907 - protein, 32 aa, Artificial Sequence
  Description of Artificial Sequence: Synthetic polypeptide
DDEEIRTTNPVATEQYGCVCSWELQRFNSNQS

SEQ ID NO: 79908 - protein, 33 aa, Artificial Sequence
  Description of Artificial Sequence: Synthetic polypeptide
TEEEIRTTNPVATERYGVTVPSCTNALPQFGND

SEQ ID NO: 79909 - protein, 32 aa, Artificial Sequence
  Description of Artificial Sequence: Synthetic polypeptide
DEHEIRTTNPVAYEQWGSVVTGNLTMGEGNER

SEQ ID NO: 79910 - protein, 30 aa, Artificial Sequence
  Description of Artificial Sequence: Synthetic polypeptide
DEEEIRTTNPVATESYGCIAATANEQTDNF

SEQ ID NO: 79911 - protein, 31 aa, Artificial Sequence
  Description of Artificial Sequence: Synthetic polypeptide
DEEEIRTTNPMATEQYGCVCGTEHQNGSNTA

SEQ ID NO: 79912 - protein, 31 aa, Artificial Sequence
  Description of Artificial Sequence: Synthetic polypeptide
DEHEIRTTNPVAYEQWGTVATNLQSNGDNGS

SEQ ID NO: 79913 - protein, 33 aa, Artificial Sequence
  Description of Artificial Sequence: Synthetic polypeptide
DEEEIRTTNPVATEQYGCVCSTTEHQRFNSDAS

SEQ ID NO: 79914 - protein, 31 aa, Artificial Sequence
  Description of Artificial Sequence: Synthetic polypeptide
DEFVIRTTNPVATEQYGCVCETEPQYFGSNR

SEQ ID NO: 79915 - protein, 32 aa, Artificial Sequence
  Description of Artificial Sequence: Synthetic polypeptide
DEEEIRTTNPVATEAYGTVSTSQTNEQGNNQT

SEQ ID NO: 79916 - protein, 30 aa, Artificial Sequence
  Description of Artificial Sequence: Synthetic polypeptide
SEQEIACTNPVATEQYGSVSAENLEREGEL

SEQ ID NO: 79917 - protein, 32 aa, Artificial Sequence
  Description of Artificial Sequence: Synthetic polypeptide
DAEEIRATNPVATEQYGSCSTNHQEADGGNDN

SEQ ID NO: 79918 - protein, 33 aa, Artificial Sequence
  Description of Artificial Sequence: Synthetic polypeptide
DEEEIRTTNPVATEQYGCVCSTPHQNFGSNNQS

SEQ ID NO: 79919 - protein, 32 aa, Artificial Sequence
  Description of Artificial Sequence: Synthetic polypeptide
DEEEIRTTNPVATEQYGCVCSTPHQNFTSNQI

SEQ ID NO: 79920 - protein, 34 aa, Artificial Sequence
  Description of Artificial Sequence: Synthetic polypeptide
AEEEIRTTNPVATEQYGSVSTDNNQQEEQGNNQI

SEQ ID NO: 79921 - protein, 32 aa, Artificial Sequence
  Description of Artificial Sequence: Synthetic polypeptide
DEEEIRTTNPMAYERYGCVPATNLSQRGGNQA

SEQ ID NO: 79922 - protein, 33 aa, Artificial Sequence
  Description of Artificial Sequence: Synthetic polypeptide
DEHEIRTTNPVAYEQWGSVSTNLQEGEGGNNAQ

SEQ ID NO: 79923 - protein, 34 aa, Artificial Sequence
  Description of Artificial Sequence: Synthetic polypeptide
DEEEIRTTNPMAYEQYGSVIATDNLLPQRGNIED

SEQ ID NO: 79924 - protein, 31 aa, Artificial Sequence
  Description of Artificial Sequence: Synthetic polypeptide
DEFVIRTTNPVATEQYGCVETKDPQRFGNQF

SEQ ID NO: 79925 - protein, 33 aa, Artificial Sequence
  Description of Artificial Sequence: Synthetic polypeptide
DEHEIRTTNPVAYEQWGSVSTNLQGNAGEDGAR

SEQ ID NO: 79926 - protein, 32 aa, Artificial Sequence
  Description of Artificial Sequence: Synthetic polypeptide
DEEEIRTTNPMAYEGYGSCSCTNLSARGGNNE

SEQ ID NO: 79927 - protein, 33 aa, Artificial Sequence
  Description of Artificial Sequence: Synthetic polypeptide
DEEEIRTTNPVATEQYGCVCSNTNHNQYFGQFA

SEQ ID NO: 79928 - protein, 34 aa, Artificial Sequence
  Description of Artificial Sequence: Synthetic polypeptide
AEEEIRTTNPVATEQYGSVSTDNQNNQEGTEENS

SEQ ID NO: 79929 - protein, 32 aa, Artificial Sequence
  Description of Artificial Sequence: Synthetic polypeptide
DEEEIRTTNPVATEQYGCVCSTPLQNFTSEQA

SEQ ID NO: 79930 - protein, 33 aa, Artificial Sequence
  Description of Artificial Sequence: Synthetic polypeptide
DEEEIRTTNPVATEQYGCVCSTPNHQFFISNQS

SEQ ID NO: 79931 - protein, 32 aa, Artificial Sequence
  Description of Artificial Sequence: Synthetic polypeptide
DEHEIRTTNPVAYEQWGSVSTNLQLGGDQGSM

SEQ ID NO: 79932 - protein, 34 aa, Artificial Sequence
  Description of Artificial Sequence: Synthetic polypeptide
DEEEIRTTNPVATEQYGCVCSTPNHQFSGSNNQS

SEQ ID NO: 79933 - protein, 33 aa, Artificial Sequence
  Description of Artificial Sequence: Synthetic polypeptide
AEEEIRTTNPVATEQYGSVSTDQLQQTNNNATT

SEQ ID NO: 79934 - protein, 34 aa, Artificial Sequence
  Description of Artificial Sequence: Synthetic polypeptide
DEEEIRTTNPVATEQYGCVCSNTNHDQNFGSNQF

SEQ ID NO: 79935 - protein, 32 aa, Artificial Sequence
  Description of Artificial Sequence: Synthetic polypeptide
DEHEIRTTNPVAYEQWGSVSTNLQGNMGGGEQ

SEQ ID NO: 79936 - protein, 32 aa, Artificial Sequence
  Description of Artificial Sequence: Synthetic polypeptide
DDEEIRTTNPVATEQYGCVCSTNHQNFISNIA

SEQ ID NO: 79937 - protein, 32 aa, Artificial Sequence
  Description of Artificial Sequence: Synthetic polypeptide
DEHEIRTTNPVAYEQWGSVSTNLQGNMGQDGQ

SEQ ID NO: 79938 - protein, 33 aa, Artificial Sequence
  Description of Artificial Sequence: Synthetic polypeptide
DAEEIRSTNPVATEQYGSVSPTNLETQNEQQNA

SEQ ID NO: 79939 - protein, 32 aa, Artificial Sequence
  Description of Artificial Sequence: Synthetic polypeptide
DEHEIRTTNPVAYEQWGSVSTNLQGNMNDGEE

SEQ ID NO: 79940 - protein, 34 aa, Artificial Sequence
  Description of Artificial Sequence: Synthetic polypeptide
AEEEIRTTNPVATEQYGSVSTEGGNNNQQGTNGV

SEQ ID NO: 79941 - protein, 32 aa, Artificial Sequence
  Description of Artificial Sequence: Synthetic polypeptide
DAEEIRSTNPVATEQYGSVSPTNLETDNETQQ

SEQ ID NO: 79942 - protein, 31 aa, Artificial Sequence
  Description of Artificial Sequence: Synthetic polypeptide
DEFVIRTTNPVATEQYGCVETCPQRIGNNDG

SEQ ID NO: 79943 - protein, 31 aa, Artificial Sequence
  Description of Artificial Sequence: Synthetic polypeptide
SEQEIATTNPVATEQYGSVSTDLEDHEGEDR

SEQ ID NO: 79944 - protein, 30 aa, Artificial Sequence
  Description of Artificial Sequence: Synthetic polypeptide
SEQEIATTNPVATEQYGSVSEDLEDHEGER

SEQ ID NO: 79945 - protein, 33 aa, Artificial Sequence
  Description of Artificial Sequence: Synthetic polypeptide
DEEEIRTTNPVATEQYGCVCSNTNGNQHGSEFA

SEQ ID NO: 79946 - protein, 32 aa, Artificial Sequence
  Description of Artificial Sequence: Synthetic polypeptide
DEHEIRTTNPVAYEQWGSVSTNLQGNMGGDQD

SEQ ID NO: 79947 - protein, 33 aa, Artificial Sequence
  Description of Artificial Sequence: Synthetic polypeptide
DEEEIRTTNPAATEQYGSVIADTMGQRGNNGAE

SEQ ID NO: 79948 - protein, 31 aa, Artificial Sequence
  Description of Artificial Sequence: Synthetic polypeptide
DDGEIRTTNPVATEQYGSVSTVLLEATGMQQ

SEQ ID NO: 79949 - protein, 31 aa, Artificial Sequence
  Description of Artificial Sequence: Synthetic polypeptide
DEEEIRTTNPVSTEQYGSVTGDNNQGGQGTH

SEQ ID NO: 79950 - protein, 32 aa, Artificial Sequence
  Description of Artificial Sequence: Synthetic polypeptide
DEEEIRTTNPVGTEQYGCVCSTNDLAENGSFQ

SEQ ID NO: 79951 - protein, 28 aa, Artificial Sequence
  Description of Artificial Sequence: Synthetic peptide
SEEEIACTNPIATECYGSVSENLMREEL

SEQ ID NO: 79952 - protein, 28 aa, Artificial Sequence
  Description of Artificial Sequence: Synthetic peptide
YEEEIASVNPVCTHQYGVVSDNLQSGNQ

SEQ ID NO: 79953 - protein, 28 aa, Artificial Sequence
  Description of Artificial Sequence: Synthetic peptide
YEEEIASVNPVCTKQYGVVSDNLQSGNQ

SEQ ID NO: 79954 - protein, 28 aa, Artificial Sequence
  Description of Artificial Sequence: Synthetic peptide
YEGEIASTNPCSTEQYGVVSDNLQSGTR

SEQ ID NO: 79955 - protein, 28 aa, Artificial Sequence
  Description of Artificial Sequence: Synthetic peptide
YEEEIASVNPVCTLQYGVVSDNLQSGNQ

SEQ ID NO: 79956 - protein, 34 aa, Artificial Sequence
  Description of Artificial Sequence: Synthetic polypeptide
DEEEIRTTNPVAYEQYGQSVSIENDALQTGVERQ

SEQ ID NO: 79957 - protein, 28 aa, Artificial Sequence
  Description of Artificial Sequence: Synthetic peptide
YEEEIASVNPVCTMQYGVVSDNLQSGNQ

SEQ ID NO: 79958 - protein, 33 aa, Artificial Sequence
  Description of Artificial Sequence: Synthetic polypeptide
DEEEIRTTNPVATECYGSVVGFGNLGNQGGGND

SEQ ID NO: 79959 - protein, 28 aa, Artificial Sequence
  Description of Artificial Sequence: Synthetic peptide
YEGEIASTNPCSSEQYGVVSDNLQSGNR

SEQ ID NO: 79960 - protein, 32 aa, Artificial Sequence
  Description of Artificial Sequence: Synthetic polypeptide
SEEEIACTNPVATEQYGSVATNLQNPGENAEG

SEQ ID NO: 79961 - protein, 34 aa, Artificial Sequence
  Description of Artificial Sequence: Synthetic polypeptide
AEEEIRTTNPVATEQYGSVSTVTNLNDENGNETE

SEQ ID NO: 79962 - protein, 32 aa, Artificial Sequence
  Description of Artificial Sequence: Synthetic polypeptide
DEEEIRTTNPVGTEQYGCVCSTNDLTYGSFQS

SEQ ID NO: 79963 - protein, 32 aa, Artificial Sequence
  Description of Artificial Sequence: Synthetic polypeptide
SAEEIATTNPVATYQYGSVSPTNGVQENGNER

SEQ ID NO: 79964 - protein, 35 aa, Artificial Sequence
  Description of Artificial Sequence: Synthetic polypeptide
DEEEIRTTNPVATEQWGISVSLNALSQERPPTNNR

SEQ ID NO: 79965 - protein, 32 aa, Artificial Sequence
  Description of Artificial Sequence: Synthetic polypeptide
DENEIRTTNPVATEQYGSASSTPAGNRNGMNV

SEQ ID NO: 79966 - protein, 30 aa, Artificial Sequence
  Description of Artificial Sequence: Synthetic polypeptide
SAEEIATTNPVAYEQYGSVATNLQAPPNDH

SEQ ID NO: 79967 - protein, 32 aa, Artificial Sequence
  Description of Artificial Sequence: Synthetic polypeptide
SEEEIACTNPVATEQYGSVATNLQPAPGPEDR

SEQ ID NO: 79968 - protein, 32 aa, Artificial Sequence
  Description of Artificial Sequence: Synthetic polypeptide
DENEIRTTNPVATEQYGSASSEPAGQRNGMNV

SEQ ID NO: 79969 - protein, 31 aa, Artificial Sequence
  Description of Artificial Sequence: Synthetic polypeptide
DEEEIRTTNPVSYEQYGSVNQNELSQGGGQT

SEQ ID NO: 79970 - protein, 34 aa, Artificial Sequence
  Description of Artificial Sequence: Synthetic polypeptide
DEEEIRTTNPVATEQWGISTVSLNALSQEEVTNR

SEQ ID NO: 79971 - protein, 32 aa, Artificial Sequence
  Description of Artificial Sequence: Synthetic polypeptide
DEEEISTTNPVATEQYGCVCSTENHQSGSDAS

SEQ ID NO: 79972 - protein, 33 aa, Artificial Sequence
  Description of Artificial Sequence: Synthetic polypeptide
YEEEIRTTNPGATEQYGCAVVNSNLTQRNGNRN

SEQ ID NO: 79973 - protein, 28 aa, Artificial Sequence
  Description of Artificial Sequence: Synthetic peptide
YEEEIASVNPVCTGQYGVVSDNLQSGNQ

SEQ ID NO: 79974 - protein, 34 aa, Artificial Sequence
  Description of Artificial Sequence: Synthetic polypeptide
DEEEIRTTNPVATECYGSVSTTPAEPQDRNGMNV

SEQ ID NO: 79975 - protein, 29 aa, Artificial Sequence
  Description of Artificial Sequence: Synthetic peptide
DENEIRTTNPCATEQYGDVSEIEQNSGDA

SEQ ID NO: 79976 - protein, 32 aa, Artificial Sequence
  Description of Artificial Sequence: Synthetic polypeptide
DEEEIRTTNPVGTEQWGSVSTNELGGRDPDME

SEQ ID NO: 79977 - protein, 35 aa, Artificial Sequence
  Description of Artificial Sequence: Synthetic polypeptide
DEEEIRTTNPVSYEQYGQSVSCTNLPPRTGGNNRA

SEQ ID NO: 79978 - protein, 29 aa, Artificial Sequence
  Description of Artificial Sequence: Synthetic peptide
SEEEIRCTNPCATEQYGACNSENLERGGQ

SEQ ID NO: 79979 - protein, 33 aa, Artificial Sequence
  Description of Artificial Sequence: Synthetic polypeptide
DEEEISTTNPVATEQYGCVCSTENLQNFGSDQI

SEQ ID NO: 79980 - protein, 31 aa, Artificial Sequence
  Description of Artificial Sequence: Synthetic polypeptide
DENEIRTTNPIATEPYGTVSEENIQMRNGNH

SEQ ID NO: 79981 - protein, 31 aa, Artificial Sequence
  Description of Artificial Sequence: Synthetic polypeptide
DENEIRTTNPIATEPYGTVSMENIQMRNGNH

SEQ ID NO: 79982 - protein, 29 aa, Artificial Sequence
  Description of Artificial Sequence: Synthetic peptide
DENEIRTTNPIATEQWGSVSEILMNAENA

SEQ ID NO: 79983 - protein, 32 aa, Artificial Sequence
  Description of Artificial Sequence: Synthetic polypeptide
DENEIRTTNPVATEQYGSCSTNNLEGYGDMEM

SEQ ID NO: 79984 - protein, 31 aa, Artificial Sequence
  Description of Artificial Sequence: Synthetic polypeptide
DENEIRTTNPVATEQYGSCSANAENNEGDDR

SEQ ID NO: 79985 - protein, 30 aa, Artificial Sequence
  Description of Artificial Sequence: Synthetic polypeptide
DENEIRTTNPVATDQYGSVNTGLEVRQLGD

SEQ ID NO: 79986 - protein, 31 aa, Artificial Sequence
  Description of Artificial Sequence: Synthetic polypeptide
DEEEIRTTNPVGTEQYGCVCSTEDLGNGSQA

SEQ ID NO: 79987 - protein, 32 aa, Artificial Sequence
  Description of Artificial Sequence: Synthetic polypeptide
DEAEIRTTNPVATEQYGCVCSTELQSFPSNDS

SEQ ID NO: 79988 - protein, 28 aa, Artificial Sequence
  Description of Artificial Sequence: Synthetic peptide
YEEEIASVNPVCTGQYGVVSDNLQSGNE

SEQ ID NO: 79989 - protein, 34 aa, Artificial Sequence
  Description of Artificial Sequence: Synthetic polypeptide
DENEIRTTNPVATEQYGSCPSTMNDMQEGLNERG

SEQ ID NO: 79990 - protein, 33 aa, Artificial Sequence
  Description of Artificial Sequence: Synthetic polypeptide
DEEEIRTTNPVATEQYGQCVCSTEDQNMGSNQL

SEQ ID NO: 79991 - protein, 33 aa, Artificial Sequence
  Description of Artificial Sequence: Synthetic polypeptide
DEEEIRTTNPVATEQYGQCVCSTEDQSFGSNQA

SEQ ID NO: 79992 - protein, 33 aa, Artificial Sequence
  Description of Artificial Sequence: Synthetic polypeptide
DEEEIRTTNPVATECYGSVSTPNQTGNVGNNGQ

SEQ ID NO: 79993 - protein, 32 aa, Artificial Sequence
  Description of Artificial Sequence: Synthetic polypeptide
DEEEIRTTNPVGTEQYGCVCSTGNDLGNGSDA

SEQ ID NO: 79994 - protein, 30 aa, Artificial Sequence
  Description of Artificial Sequence: Synthetic polypeptide
SEEEIRCTNPAATEQYGSVWENLMDGGNGD

SEQ ID NO: 79995 - protein, 33 aa, Artificial Sequence
  Description of Artificial Sequence: Synthetic polypeptide
DEEEIRTTNPVATECYGSVSTTCGPNMRGMNPV

SEQ ID NO: 79996 - protein, 33 aa, Artificial Sequence
  Description of Artificial Sequence: Synthetic polypeptide
DEAEIRTTNPVATEQYGCVCSTENHQNFGSENQ

SEQ ID NO: 79997 - protein, 28 aa, Artificial Sequence
  Description of Artificial Sequence: Synthetic peptide
YEEEIASVNPVCTFQYGVVSDNLQSGNQ

SEQ ID NO: 79998 - protein, 28 aa, Artificial Sequence
  Description of Artificial Sequence: Synthetic peptide
YEGEIASVNPVCTEQYGVVSDNLQSGNQ

SEQ ID NO: 79999 - protein, 30 aa, Artificial Sequence
  Description of Artificial Sequence: Synthetic polypeptide
SEEEIRCTNPAATEQYGSVVSANGMGGENG

SEQ ID NO: 80000 - protein, 36 aa, Artificial Sequence
  Description of Artificial Sequence: Synthetic polypeptide
DEEEIRTTNPVATEQWGISTVSCTGNELQREGGNMQ

SEQ ID NO: 80001 - protein, 28 aa, Artificial Sequence
  Description of Artificial Sequence: Synthetic peptide
YEGEIAPTNPVCTEQYGVVSCNLQSGTQ

SEQ ID NO: 80002 - protein, 28 aa, Artificial Sequence
  Description of Artificial Sequence: Synthetic peptide
YEGEIAPTNPVCTEQYGIVSCNLQSGTQ

SEQ ID NO: 80003 - protein, 33 aa, Artificial Sequence
  Description of Artificial Sequence: Synthetic polypeptide
DEEEIRTTNPVATEQYGSVVTVQHDRIGGNNDN

SEQ ID NO: 80004 - protein, 28 aa, Artificial Sequence
  Description of Artificial Sequence: Synthetic peptide
YEEEIASVNPVCYEQYGVVSDNLQSGNQ

SEQ ID NO: 80005 - protein, 31 aa, Artificial Sequence
  Description of Artificial Sequence: Synthetic polypeptide
SEEEIACTNPVATEQYGSVATNLQPDQEGAY

SEQ ID NO: 80006 - protein, 34 aa, Artificial Sequence
  Description of Artificial Sequence: Synthetic polypeptide
AEEEIRTTNPVATEQYGSVSTVNLQNDENEANTD

SEQ ID NO: 80007 - protein, 34 aa, Artificial Sequence
  Description of Artificial Sequence: Synthetic polypeptide
YEEEIRTTNPVATEQYGTAVQYNSNLTQRNGNRE

SEQ ID NO: 80008 - protein, 33 aa, Artificial Sequence
  Description of Artificial Sequence: Synthetic polypeptide
AEEEIRTTNPVATEQYGSVSTVTNQQQTEGEDE

SEQ ID NO: 80009 - protein, 33 aa, Artificial Sequence
  Description of Artificial Sequence: Synthetic polypeptide
DEEEIRTTNPVATEQYGQCVCSTEHDQHGSNQL

SEQ ID NO: 80010 - protein, 35 aa, Artificial Sequence
  Description of Artificial Sequence: Synthetic polypeptide
AEEEIRTTNPVATEQYGSVSTVNLQNGTEGGNNVD

SEQ ID NO: 80011 - protein, 32 aa, Artificial Sequence
  Description of Artificial Sequence: Synthetic polypeptide
DEEEIRTTNPVATEQYGSVVTVQDETDGQNDN

SEQ ID NO: 80012 - protein, 35 aa, Artificial Sequence
  Description of Artificial Sequence: Synthetic polypeptide
AEEEIRTTNPVATEQYGSVSTVNLQNNQQGTNPTE

SEQ ID NO: 80013 - protein, 32 aa, Artificial Sequence
  Description of Artificial Sequence: Synthetic polypeptide
DEEEIRTTNPVATEGYGMVGSGNMTQGGGENS

SEQ ID NO: 80014 - protein, 32 aa, Artificial Sequence
  Description of Artificial Sequence: Synthetic polypeptide
DEEEIRTTNPVATEGYGMVGSGNLNIEGGGNV

SEQ ID NO: 80015 - protein, 28 aa, Artificial Sequence
  Description of Artificial Sequence: Synthetic peptide
YEEEIASVNPVGTEGYGVVSDNLQHGNQ

SEQ ID NO: 80016 - protein, 32 aa, Artificial Sequence
  Description of Artificial Sequence: Synthetic polypeptide
DEEEIRTTNPVGTEQYGCVCSTNELGGFGSDQ

SEQ ID NO: 80017 - protein, 32 aa, Artificial Sequence
  Description of Artificial Sequence: Synthetic polypeptide
DEEEISTTNPVATEQYGCVCSTELQGFLSERS

SEQ ID NO: 80018 - protein, 35 aa, Artificial Sequence
  Description of Artificial Sequence: Synthetic polypeptide
AEEEIRTTNPVATEQYGSVSTVNLQNQENGNQQNE

SEQ ID NO: 80019 - protein, 32 aa, Artificial Sequence
  Description of Artificial Sequence: Synthetic polypeptide
DEEEISTTNPVATEQYGCVCSTELQESGSEQP

SEQ ID NO: 80020 - protein, 35 aa, Artificial Sequence
  Description of Artificial Sequence: Synthetic polypeptide
DEAEIRTTNPVATEQYGKVPSCTGNLQRTETNNRS

SEQ ID NO: 80021 - protein, 31 aa, Artificial Sequence
  Description of Artificial Sequence: Synthetic polypeptide
SEEEIACTNPVATEQYGSVATNLQPNGTPEQ

SEQ ID NO: 80022 - protein, 35 aa, Artificial Sequence
  Description of Artificial Sequence: Synthetic polypeptide
AEEEIRTTNPVATEQYGSVSTVTNLLQQGENQEND

SEQ ID NO: 80023 - protein, 35 aa, Artificial Sequence
  Description of Artificial Sequence: Synthetic polypeptide
YEEEIRTTNPVATEQYGTAVFSPSNWLTQRNGNRE

SEQ ID NO: 80024 - protein, 32 aa, Artificial Sequence
  Description of Artificial Sequence: Synthetic polypeptide
SEEEIRCTNPAATEQYGSVSIENMLMREGNNQ

SEQ ID NO: 80025 - protein, 28 aa, Artificial Sequence
  Description of Artificial Sequence: Synthetic peptide
YEEEIASVNPVCWEQYGVVSDNLQSGNQ

SEQ ID NO: 80026 - protein, 34 aa, Artificial Sequence
  Description of Artificial Sequence: Synthetic polypeptide
DEEEIRTTNPVATEQWGISLVSYTNNLSHRPGGF

SEQ ID NO: 80027 - protein, 31 aa, Artificial Sequence
  Description of Artificial Sequence: Synthetic polypeptide
DEEEISTTNPVATEQYGCVCSTELQNTSDQA

SEQ ID NO: 80028 - protein, 28 aa, Artificial Sequence
  Description of Artificial Sequence: Synthetic peptide
YEEEIASVNPVCTNQYGVVSDNLQSGNQ

SEQ ID NO: 80029 - protein, 31 aa, Artificial Sequence
  Description of Artificial Sequence: Synthetic polypeptide
DENEIRTTNPVATDQYGSVNTQLEVRQGTPD

SEQ ID NO: 80030 - protein, 32 aa, Artificial Sequence
  Description of Artificial Sequence: Synthetic polypeptide
DEEEISTTNPVATEQYGCVCSTELQNLGSDQG

SEQ ID NO: 80031 - protein, 28 aa, Artificial Sequence
  Description of Artificial Sequence: Synthetic peptide
YEEEIASVNPVCTQQYGVVSDNLQSGNQ

SEQ ID NO: 80032 - protein, 28 aa, Artificial Sequence
  Description of Artificial Sequence: Synthetic peptide
YEGEIASTNPCCSEQYGVVSDNLQSGNR

SEQ ID NO: 80033 - protein, 28 aa, Artificial Sequence
  Description of Artificial Sequence: Synthetic peptide
YEEEIASVNPVCTSQYGVVSDNLQSGNQ

SEQ ID NO: 80034 - protein, 34 aa, Artificial Sequence
  Description of Artificial Sequence: Synthetic polypeptide
DENEIRTTNPVATEQYGQSVCSNTELQNFGSNQS

SEQ ID NO: 80035 - protein, 28 aa, Artificial Sequence
  Description of Artificial Sequence: Synthetic peptide
YEEEIASVNPVCTTQYGVVSDNLQSGNQ

SEQ ID NO: 80036 - protein, 32 aa, Artificial Sequence
  Description of Artificial Sequence: Synthetic polypeptide
SAEEIATTNPVAYEQYGSVVATNLQRGPNDEA

SEQ ID NO: 80037 - protein, 28 aa, Artificial Sequence
  Description of Artificial Sequence: Synthetic peptide
YEEEIASVNPVCTWQYGVVSDNLQSGNI

SEQ ID NO: 80038 - protein, 35 aa, Artificial Sequence
  Description of Artificial Sequence: Synthetic polypeptide
YEEEIRTTNPVATEQYGTAVFSNSNLTQFRNGNRP

SEQ ID NO: 80039 - protein, 36 aa, Artificial Sequence
  Description of Artificial Sequence: Synthetic polypeptide
DEEEIRTTNPVATEQYGSVVTVSVTENLLQGIGNQT

SEQ ID NO: 80040 - protein, 28 aa, Artificial Sequence
  Description of Artificial Sequence: Synthetic peptide
YEEEIASVNPVCTWQYGVVSENLQSGNQ

SEQ ID NO: 80041 - protein, 28 aa, Artificial Sequence
  Description of Artificial Sequence: Synthetic peptide
YEEEIASVNPVCTWQYGVVSKNLQSGNQ

SEQ ID NO: 80042 - protein, 32 aa, Artificial Sequence
  Description of Artificial Sequence: Synthetic polypeptide
SEEEIRCTNPAATEQYGSVSIENMLMRGGNNE

SEQ ID NO: 80043 - protein, 28 aa, Artificial Sequence
  Description of Artificial Sequence: Synthetic peptide
YEEEIASVNPVCTYQYGVVSDNLQSGNQ

SEQ ID NO: 80044 - protein, 28 aa, Artificial Sequence
  Description of Artificial Sequence: Synthetic peptide
YEEEIASVNPVCVEQYGVVSANLQSGNQ

SEQ ID NO: 80045 - protein, 32 aa, Artificial Sequence
  Description of Artificial Sequence: Synthetic polypeptide
DEEEISTTNPVATEQYGCVCSTELQNFGSQTQ

SEQ ID NO: 80046 - protein, 31 aa, Artificial Sequence
  Description of Artificial Sequence: Synthetic polypeptide
DEEEIRTTNPVATEQYGSVVTVQHDSIGFDN

SEQ ID NO: 80047 - protein, 28 aa, Artificial Sequence
  Description of Artificial Sequence: Synthetic peptide
YEGEIAPTNPVSSEQYGIVSCNLQSGTR

SEQ ID NO: 80048 - protein, 28 aa, Artificial Sequence
  Description of Artificial Sequence: Synthetic peptide
YEEEIASVNPVCTWQYGVVSDNLQSGNQ

SEQ ID NO: 80049 - protein, 28 aa, Artificial Sequence
  Description of Artificial Sequence: Synthetic peptide
YEEEIASVNPVGTEQYGVVSDHLQSGNQ

SEQ ID NO: 80050 - protein, 30 aa, Artificial Sequence
  Description of Artificial Sequence: Synthetic polypeptide
DENEIRTTNPCATEQYGDVSCNLMNSAGDA

SEQ ID NO: 80051 - protein, 32 aa, Artificial Sequence
  Description of Artificial Sequence: Synthetic polypeptide
DEEEIRTTNPVATEQWGNTIATNEGLGARSNR

SEQ ID NO: 80052 - protein, 33 aa, Artificial Sequence
  Description of Artificial Sequence: Synthetic polypeptide
YEEEIRTTNPVATCQYGCVCSPTSNSLTQDWNR

SEQ ID NO: 80053 - protein, 33 aa, Artificial Sequence
  Description of Artificial Sequence: Synthetic polypeptide
DEEEIRTTNPVGTEIYGSVNMANGLQRFGNEGQ

SEQ ID NO: 80054 - protein, 33 aa, Artificial Sequence
  Description of Artificial Sequence: Synthetic polypeptide
DENEIRTTNPVATEQYGSCWSTTVLQRGDEDGY

SEQ ID NO: 80055 - protein, 35 aa, Artificial Sequence
  Description of Artificial Sequence: Synthetic polypeptide
AEEEIRTTNPVATEQYGSVSTVNLQENNQGNNNSE

SEQ ID NO: 80056 - protein, 34 aa, Artificial Sequence
  Description of Artificial Sequence: Synthetic polypeptide
DEEEIRTTNPVATEQYGSVVGSGNNIQGEGGNQG

SEQ ID NO: 80057 - protein, 31 aa, Artificial Sequence
  Description of Artificial Sequence: Synthetic polypeptide
YEEEIRTTNPVASEFYGYFVSDFNQQRGNTI

SEQ ID NO: 80058 - protein, 35 aa, Artificial Sequence
  Description of Artificial Sequence: Synthetic polypeptide
YEEEIRTTNPVATEQYGTAVFSNSNLQQARNGNRF

SEQ ID NO: 80059 - protein, 34 aa, Artificial Sequence
  Description of Artificial Sequence: Synthetic polypeptide
AEEEIRTTNPVATEQYGSVSTVTNTNNQDEGNVE

SEQ ID NO: 80060 - protein, 31 aa, Artificial Sequence
  Description of Artificial Sequence: Synthetic polypeptide
DEEEIRTTNPVGTEQWGSVATNELGGGPSDM

SEQ ID NO: 80061 - protein, 35 aa, Artificial Sequence
  Description of Artificial Sequence: Synthetic polypeptide
DEEEIRTTNPVATEQYGSVVGSGNNLQGEQGNQGD

SEQ ID NO: 80062 - protein, 31 aa, Artificial Sequence
  Description of Artificial Sequence: Synthetic polypeptide
SEEEIRCTNPCATEQYGSVLSNEDLERENQR

SEQ ID NO: 80063 - protein, 32 aa, Artificial Sequence
  Description of Artificial Sequence: Synthetic polypeptide
DEEEIRTTNPVGTEQWGSVSTANELGENGDQA

SEQ ID NO: 80064 - protein, 29 aa, Artificial Sequence
  Description of Artificial Sequence: Synthetic peptide
YEEEIASVNPVCTEQYGVVYSDNLQSGNP

SEQ ID NO: 80065 - protein, 29 aa, Artificial Sequence
  Description of Artificial Sequence: Synthetic peptide
YEEEIASVNPVCTEQYGVVYSDNLQSGNQ

SEQ ID NO: 80066 - protein, 31 aa, Artificial Sequence
  Description of Artificial Sequence: Synthetic polypeptide
SAEEIATTNPVATEQWGCVATNLQEEGNQRV

SEQ ID NO: 80067 - protein, 30 aa, Artificial Sequence
  Description of Artificial Sequence: Synthetic polypeptide
SAEEIATTNPVATEQWGCVATNLQEGNQLM

SEQ ID NO: 80068 - protein, 35 aa, Artificial Sequence
  Description of Artificial Sequence: Synthetic polypeptide
DEEEIRTTNPVAYEQYGQSVSMTNTLLQVRPIERV

SEQ ID NO: 80069 - protein, 32 aa, Artificial Sequence
  Description of Artificial Sequence: Synthetic polypeptide
YELEIRTTNPVATECQYGSVSTLTNTRFGTRN

SEQ ID NO: 80070 - protein, 33 aa, Artificial Sequence
  Description of Artificial Sequence: Synthetic polypeptide
YEEEIRTTNPVAHEQYGAVALNTNLQCRGNDNY

SEQ ID NO: 80071 - protein, 31 aa, Artificial Sequence
  Description of Artificial Sequence: Synthetic polypeptide
YEEEIRTTNPVAHEEYGAVCSTVNAQKIGER

SEQ ID NO: 80072 - protein, 32 aa, Artificial Sequence
  Description of Artificial Sequence: Synthetic polypeptide
SEEEIRCTNPCATEQYGSVCTPENLHIIGNRD

SEQ ID NO: 80073 - protein, 34 aa, Artificial Sequence
  Description of Artificial Sequence: Synthetic polypeptide
DEEEIRTTNPVGTEGYGSVNISDNLQREGGNDGD

SEQ ID NO: 80074 - protein, 34 aa, Artificial Sequence
  Description of Artificial Sequence: Synthetic polypeptide
YEEEIRTTNPVATEQYGTAVFSNSNLNQRNGNMF

SEQ ID NO: 80075 - protein, 31 aa, Artificial Sequence
  Description of Artificial Sequence: Synthetic polypeptide
YEEEIRTTNPVATCQYGSVSTLTNTRFGTTN

SEQ ID NO: 80076 - protein, 35 aa, Artificial Sequence
  Description of Artificial Sequence: Synthetic polypeptide
AEEEIRTTNPVATEQYGSVSTVNLQENNNGTNQQT

SEQ ID NO: 80077 - protein, 29 aa, Artificial Sequence
  Description of Artificial Sequence: Synthetic peptide
DENEIRPTNPVATEQYGIVSENEQNAETA

SEQ ID NO: 80078 - protein, 32 aa, Artificial Sequence
  Description of Artificial Sequence: Synthetic polypeptide
DEEEIRTTNPVGTEFYGSVNNMPNGLQDGGNG

SEQ ID NO: 80079 - protein, 29 aa, Artificial Sequence
  Description of Artificial Sequence: Synthetic peptide
YEEEIASVNPVCTEQYGVVWSDNLQYGNQ

SEQ ID NO: 80080 - protein, 34 aa, Artificial Sequence
  Description of Artificial Sequence: Synthetic polypeptide
DEEEIRTTNPVATEQWGQSIVSYTNMLSHRPGGF

SEQ ID NO: 80081 - protein, 32 aa, Artificial Sequence
  Description of Artificial Sequence: Synthetic polypeptide
DEEEIRTTNPVATEQYGSVVVTNLGEASVEFE

SEQ ID NO: 80082 - protein, 32 aa, Artificial Sequence
  Description of Artificial Sequence: Synthetic polypeptide
DEEEISTTNPVATEQYGCVCSTGELANFGSNQ

SEQ ID NO: 80083 - protein, 33 aa, Artificial Sequence
  Description of Artificial Sequence: Synthetic polypeptide
DEEEIRTTNPVATEQYGQCVCSSELQGFGSNQG

SEQ ID NO: 80084 - protein, 29 aa, Artificial Sequence
  Description of Artificial Sequence: Synthetic peptide
DENEIRSTNPVCTEPYGVVSDDLQQQGNQ

SEQ ID NO: 80085 - protein, 35 aa, Artificial Sequence
  Description of Artificial Sequence: Synthetic polypeptide
DEEEIRTTNPVATEQYGSVTDGTGNLNQNGGNDQI

SEQ ID NO: 80086 - protein, 35 aa, Artificial Sequence
  Description of Artificial Sequence: Synthetic polypeptide
DEEEIRTTNPVATEQYGSVTDGTGNLNQTEGGNQQ

SEQ ID NO: 80087 - protein, 31 aa, Artificial Sequence
  Description of Artificial Sequence: Synthetic polypeptide
YEEEIRTTNPVAFEQYGSVSTLTNTRFGTWN

SEQ ID NO: 80088 - protein, 29 aa, Artificial Sequence
  Description of Artificial Sequence: Synthetic peptide
YEEEIASVNPVCTEQYGVVYSDNLQGGNQ

SEQ ID NO: 80089 - protein, 31 aa, Artificial Sequence
  Description of Artificial Sequence: Synthetic polypeptide
SAEEIATTNPVATEQWGCVAGTNLQEGNDRN

SEQ ID NO: 80090 - protein, 33 aa, Artificial Sequence
  Description of Artificial Sequence: Synthetic polypeptide
SEEEIRCTNPCATEQYGSVRTNEAWLEQRENQR

SEQ ID NO: 80091 - protein, 34 aa, Artificial Sequence
  Description of Artificial Sequence: Synthetic polypeptide
YEEEIRTTNPVATDQYGGVPSTPNLIQLREGNYY

SEQ ID NO: 80092 - protein, 28 aa, Artificial Sequence
  Description of Artificial Sequence: Synthetic peptide
YEMEIASVNPVCTEQYGVVSDNLQSGNQ

SEQ ID NO: 80093 - protein, 29 aa, Artificial Sequence
  Description of Artificial Sequence: Synthetic peptide
DENEIRSTNPVCTEPYGVVSDDLQQSGNQ

SEQ ID NO: 80094 - protein, 32 aa, Artificial Sequence
  Description of Artificial Sequence: Synthetic polypeptide
SEEEIRCTNPCATEQYGSVRSNENTLERENQR

SEQ ID NO: 80095 - protein, 34 aa, Artificial Sequence
  Description of Artificial Sequence: Synthetic polypeptide
YEEEIRTTNPVATEQYGTAVFSNSILGQRNGNRF

SEQ ID NO: 80096 - protein, 33 aa, Artificial Sequence
  Description of Artificial Sequence: Synthetic polypeptide
DEAEIRTTNPVATEQYGCVCSTELQNFGSENQS

SEQ ID NO: 80097 - protein, 31 aa, Artificial Sequence
  Description of Artificial Sequence: Synthetic polypeptide
SEEEIRCTNPCATEQYGSVRSIEVLERENQR

SEQ ID NO: 80098 - protein, 29 aa, Artificial Sequence
  Description of Artificial Sequence: Synthetic peptide
YEEEIASVNPVCTEQYGVVYSDNLQMGNQ

SEQ ID NO: 80099 - protein, 33 aa, Artificial Sequence
  Description of Artificial Sequence: Synthetic polypeptide
DEEEIRTTNPVATEQYGSVVVTELTDGGNENYN

SEQ ID NO: 80100 - protein, 34 aa, Artificial Sequence
  Description of Artificial Sequence: Synthetic polypeptide
DEEEIRTTNPVAYEQYGQSVSMNDALQIRSGVEQ

SEQ ID NO: 80101 - protein, 28 aa, Artificial Sequence
  Description of Artificial Sequence: Synthetic peptide
YELEIASVNPVSTEQYGVVSDNLQSGNQ

SEQ ID NO: 80102 - protein, 28 aa, Artificial Sequence
  Description of Artificial Sequence: Synthetic peptide
YELEIASVNPVCTEQYGVVSDNLQSGNQ

SEQ ID NO: 80103 - protein, 35 aa, Artificial Sequence
  Description of Artificial Sequence: Synthetic polypeptide
AEEEIRTTNPVATEQYGSVSTVNLQLQGQNNNNAT

SEQ ID NO: 80104 - protein, 33 aa, Artificial Sequence
  Description of Artificial Sequence: Synthetic polypeptide
YEGEIHTTNPVATEQYGCVCSATSNSLTQDGNR

SEQ ID NO: 80105 - protein, 33 aa, Artificial Sequence
  Description of Artificial Sequence: Synthetic polypeptide
DEEEIRTTNPVATEQWGNTTTSTNELQGNGNAN

SEQ ID NO: 80106 - protein, 34 aa, Artificial Sequence
  Description of Artificial Sequence: Synthetic polypeptide
AEEEIRTTNPVATEQYGSVSTVTNSNNQQQGNVE

SEQ ID NO: 80107 - protein, 31 aa, Artificial Sequence
  Description of Artificial Sequence: Synthetic polypeptide
SEEEIRCTNPCATEQYGCVRTENLHRGNSQE

SEQ ID NO: 80108 - protein, 34 aa, Artificial Sequence
  Description of Artificial Sequence: Synthetic polypeptide
AEEEIRTTNPVATEQYGSVSTVTNSNLNQEATNM

SEQ ID NO: 80109 - protein, 31 aa, Artificial Sequence
  Description of Artificial Sequence: Synthetic polypeptide
SEEEIRCTNPCATEQYGCVRSENLHRGNAQD

SEQ ID NO: 80110 - protein, 28 aa, Artificial Sequence
  Description of Artificial Sequence: Synthetic peptide
YEEEIASVNPVCTEYYGVVSDNLQSGNQ

SEQ ID NO: 80111 - protein, 33 aa, Artificial Sequence
  Description of Artificial Sequence: Synthetic polypeptide
DEEEIRTTNPVATEQYGQCVCSSNHQHFGSNAS

SEQ ID NO: 80112 - protein, 31 aa, Artificial Sequence
  Description of Artificial Sequence: Synthetic polypeptide
SEEEIRCTNPCATEQYGCVCVPENLHRGNRD

SEQ ID NO: 80113 - protein, 34 aa, Artificial Sequence
  Description of Artificial Sequence: Synthetic polypeptide
DEEEIRTTNPVATEQYGQCVCSSNLQNFGSNTQA

SEQ ID NO: 80114 - protein, 29 aa, Artificial Sequence
  Description of Artificial Sequence: Synthetic peptide
DENEIRSVNPVCTEPYGVVSDNLQQSGNQ

SEQ ID NO: 80115 - protein, 35 aa, Artificial Sequence
  Description of Artificial Sequence: Synthetic polypeptide
DEEEIRTTNPVATECYGSVSTCPNGPQDRNGMNPG

SEQ ID NO: 80116 - protein, 35 aa, Artificial Sequence
  Description of Artificial Sequence: Synthetic polypeptide
DEEEIRTTNPVATECYGSVSTCPNGPQMRNGMNPG

SEQ ID NO: 80117 - protein, 28 aa, Artificial Sequence
  Description of Artificial Sequence: Synthetic peptide
YEGEIASVNPVSTEQYGVVSDNLQSGNQ

SEQ ID NO: 80118 - protein, 28 aa, Artificial Sequence
  Description of Artificial Sequence: Synthetic peptide
YEGEIASVNPVSTEQYGVVSCNLQSGTR

SEQ ID NO: 80119 - protein, 33 aa, Artificial Sequence
  Description of Artificial Sequence: Synthetic polypeptide
DEEEIRTTNPVATEQYGQCVCSSNPQFFGSNQG

SEQ ID NO: 80120 - protein, 33 aa, Artificial Sequence
  Description of Artificial Sequence: Synthetic polypeptide
DEEEIRTTNPVATEQYGQCVCSSPLQNFGSNAS

SEQ ID NO: 80121 - protein, 34 aa, Artificial Sequence
  Description of Artificial Sequence: Synthetic polypeptide
AEEEIRTTNPVATEQYGSVSTVNLQLQIGTESGG

SEQ ID NO: 80122 - protein, 32 aa, Artificial Sequence
  Description of Artificial Sequence: Synthetic polypeptide
DEEEIRTTNPVGTEQWGSVSTNELGGGMPDPM

SEQ ID NO: 80123 - protein, 28 aa, Artificial Sequence
  Description of Artificial Sequence: Synthetic peptide
YEGEIASVNPVSTEQYGIVSDNLQSGTR

SEQ ID NO: 80124 - protein, 32 aa, Artificial Sequence
  Description of Artificial Sequence: Synthetic polypeptide
SAEEIATTNPVATEQWGTVSGTANLQEGNQRN

SEQ ID NO: 80125 - protein, 30 aa, Artificial Sequence
  Description of Artificial Sequence: Synthetic polypeptide
DENEIRSTNPVSTEQYGVVSMENIQQNGNH

SEQ ID NO: 80126 - protein, 28 aa, Artificial Sequence
  Description of Artificial Sequence: Synthetic peptide
YEEEIASVNPVCTEWYGVVSDNLQSGNQ

SEQ ID NO: 80127 - protein, 31 aa, Artificial Sequence
  Description of Artificial Sequence: Synthetic polypeptide
SEEEIRCTNPCATEQYGCVSPETLHRGNQRD

SEQ ID NO: 80128 - protein, 28 aa, Artificial Sequence
  Description of Artificial Sequence: Synthetic peptide
YEKEIASVNPVCTEQYGVVSDNLQSGNQ

SEQ ID NO: 80129 - protein, 31 aa, Artificial Sequence
  Description of Artificial Sequence: Synthetic polypeptide
YEHEIVTTNPVATEQYGFVSSCNQQRGNDTI

SEQ ID NO: 80130 - protein, 34 aa, Artificial Sequence
  Description of Artificial Sequence: Synthetic polypeptide
AEEEIRTTNPVATEQYGSVSTVNLQENNQGTEGQ

SEQ ID NO: 80131 - protein, 32 aa, Artificial Sequence
  Description of Artificial Sequence: Synthetic polypeptide
DENEIRTTNPVATEQYGSCSVTLALQRDEDFQ

SEQ ID NO: 80132 - protein, 34 aa, Artificial Sequence
  Description of Artificial Sequence: Synthetic polypeptide
YEEEIRTTNPVACEQYGCVCSATSNSLTQNDGNR

SEQ ID NO: 80133 - protein, 28 aa, Artificial Sequence
  Description of Artificial Sequence: Synthetic peptide
DENEIRSTNPVGTEGYGTIASTLQHGNI

SEQ ID NO: 80134 - protein, 30 aa, Artificial Sequence
  Description of Artificial Sequence: Synthetic polypeptide
SEEEIRCTNPCATEQYGSCNSEVLERGSNQ

SEQ ID NO: 80135 - protein, 28 aa, Artificial Sequence
  Description of Artificial Sequence: Synthetic peptide
YEHEIASVNPVCTEQYGVVSDNLQSGNQ

SEQ ID NO: 80136 - protein, 35 aa, Artificial Sequence
  Description of Artificial Sequence: Synthetic polypeptide
AEEEIRTTNPVATEQYGSVSTVNLQLGNNQENDED

SEQ ID NO: 80137 - protein, 28 aa, Artificial Sequence
  Description of Artificial Sequence: Synthetic peptide
YEEEIASVNPVCTERYGVVSDNLQSGNQ

SEQ ID NO: 80138 - protein, 32 aa, Artificial Sequence
  Description of Artificial Sequence: Synthetic polypeptide
SEEEIRCTNPCATEQYGSVCSPENLHRIGNID

SEQ ID NO: 80139 - protein, 31 aa, Artificial Sequence
  Description of Artificial Sequence: Synthetic polypeptide
YEEEIRTTNPSATEQYGAWASTNLQEETNFD

SEQ ID NO: 80140 - protein, 31 aa, Artificial Sequence
  Description of Artificial Sequence: Synthetic polypeptide
SEEEIRCTNPCATEQYGHVCSPENLHIGNRD

SEQ ID NO: 80141 - protein, 29 aa, Artificial Sequence
  Description of Artificial Sequence: Synthetic peptide
SAEEIATTNPVATEQWGTVAGMNDQEGNR

SEQ ID NO: 80142 - protein, 31 aa, Artificial Sequence
  Description of Artificial Sequence: Synthetic polypeptide
DEEEISTTNPVATEQYGCVCSTETQEHGSDQ

SEQ ID NO: 80143 - protein, 28 aa, Artificial Sequence
  Description of Artificial Sequence: Synthetic peptide
YEEEIASVNPVCTESYGVVSDNLQSGNQ

SEQ ID NO: 80144 - protein, 28 aa, Artificial Sequence
  Description of Artificial Sequence: Synthetic peptide
YEEEIASVNPVCTETYGVVSDNLQSGNQ

SEQ ID NO: 80145 - protein, 32 aa, Artificial Sequence
  Description of Artificial Sequence: Synthetic polypeptide
DEEEIRTTNPVAYEQYGQSVSMQDAYQEGVER

SEQ ID NO: 80146 - protein, 28 aa, Artificial Sequence
  Description of Artificial Sequence: Synthetic peptide
YEEEIASVNPVCTEVYGVVSDNLQSGNQ

SEQ ID NO: 80147 - protein, 30 aa, Artificial Sequence
  Description of Artificial Sequence: Synthetic polypeptide
YEGGICTTNPVATEQYGSVSMNSPERGNSM

SEQ ID NO: 80148 - protein, 32 aa, Artificial Sequence
  Description of Artificial Sequence: Synthetic polypeptide
DEEEIRTTNPVATEQWGNTTTSTNEPQGMGNF

SEQ ID NO: 80149 - protein, 33 aa, Artificial Sequence
  Description of Artificial Sequence: Synthetic polypeptide
DEEEIRTTNPVAYEQYGQSVSMNQELVPRGQVV

SEQ ID NO: 80150 - protein, 33 aa, Artificial Sequence
  Description of Artificial Sequence: Synthetic polypeptide
DEEEIRTTNPVSYEQWGQSVSTNLSGTHGGNNR

SEQ ID NO: 80151 - protein, 32 aa, Artificial Sequence
  Description of Artificial Sequence: Synthetic polypeptide
DENEIRTTNPVATEQYGMVWSEGDLLQIGNVD

SEQ ID NO: 80152 - protein, 28 aa, Artificial Sequence
  Description of Artificial Sequence: Synthetic peptide
YEEEIASVNPVGTEQYGVVSDKLQSGNQ

SEQ ID NO: 80153 - protein, 32 aa, Artificial Sequence
  Description of Artificial Sequence: Synthetic polypeptide
DEEEIRTTNPVATEQYGSVTGDGENQGEGNND

SEQ ID NO: 80154 - protein, 30 aa, Artificial Sequence
  Description of Artificial Sequence: Synthetic polypeptide
DENEIRTTNPVATEQWGEVSENEQNAAGGA

SEQ ID NO: 80155 - protein, 30 aa, Artificial Sequence
  Description of Artificial Sequence: Synthetic polypeptide
DEEEIRTTNPVVYEQYGSVSNPPQNGETYT

SEQ ID NO: 80156 - protein, 32 aa, Artificial Sequence
  Description of Artificial Sequence: Synthetic polypeptide
DEEEISTTNPVATEQYGCVCSTEHQRFISNQA

SEQ ID NO: 80157 - protein, 32 aa, Artificial Sequence
  Description of Artificial Sequence: Synthetic polypeptide
YEETICTTNPVATEQYGSVSIMNEGGQRGNGI

SEQ ID NO: 80158 - protein, 30 aa, Artificial Sequence
  Description of Artificial Sequence: Synthetic polypeptide
SDEEIRTTNPVATHQYGCVCSTEPQNGSNF

SEQ ID NO: 80159 - protein, 30 aa, Artificial Sequence
  Description of Artificial Sequence: Synthetic polypeptide
SEEEIACTNPVATEQYGSVATNLQQPDLDL

SEQ ID NO: 80160 - protein, 31 aa, Artificial Sequence
  Description of Artificial Sequence: Synthetic polypeptide
DEEEIRTTNPVGTEQYGSVPPTNMGSVGQPQ

SEQ ID NO: 80161 - protein, 33 aa, Artificial Sequence
  Description of Artificial Sequence: Synthetic polypeptide
YEEEIATTNPVATEQYGCAVSNSNHTQRNGNRN

SEQ ID NO: 80162 - protein, 34 aa, Artificial Sequence
  Description of Artificial Sequence: Synthetic polypeptide
DEEEIRTTNPVATEQWGHSNVSGTNVLQHMEGGF

SEQ ID NO: 80163 - protein, 30 aa, Artificial Sequence
  Description of Artificial Sequence: Synthetic polypeptide
DENEIRTTNPVATECWGDVSENEMNRAGNA

SEQ ID NO: 80164 - protein, 35 aa, Artificial Sequence
  Description of Artificial Sequence: Synthetic polypeptide
YEEEIRTTNPVATEQYGVCAVSNSNLTQRNGNIRF

SEQ ID NO: 80165 - protein, 32 aa, Artificial Sequence
  Description of Artificial Sequence: Synthetic polypeptide
SEEEIRATNPAATEQYGSVSIENMLMRGGNEG

SEQ ID NO: 80166 - protein, 34 aa, Artificial Sequence
  Description of Artificial Sequence: Synthetic polypeptide
AEEEIRTTNPVATEQYGSVSTVTNNNQDGGNNVE

SEQ ID NO: 80167 - protein, 32 aa, Artificial Sequence
  Description of Artificial Sequence: Synthetic polypeptide
SEEEIRATNPAATEQYGSVSIENMLMREGGNG

SEQ ID NO: 80168 - protein, 29 aa, Artificial Sequence
  Description of Artificial Sequence: Synthetic peptide
DENEIRTTNPVATEQYGDVSENEMNAETA

SEQ ID NO: 80169 - protein, 30 aa, Artificial Sequence
  Description of Artificial Sequence: Synthetic polypeptide
DENEIRTTNPVATECWGDVSENLPQHGEEL

SEQ ID NO: 80170 - protein, 35 aa, Artificial Sequence
  Description of Artificial Sequence: Synthetic polypeptide
DEEEIRTTNPVATEQWGHSNVISFTNYLQERPGEF

SEQ ID NO: 80171 - protein, 33 aa, Artificial Sequence
  Description of Artificial Sequence: Synthetic polypeptide
DEEEIRTTNPVATEQYGQCVCSTGEHQHFGSNQ

SEQ ID NO: 80172 - protein, 31 aa, Artificial Sequence
  Description of Artificial Sequence: Synthetic polypeptide
YEETICTTNPVATEQYGSVSIMNDGQDEGNE

SEQ ID NO: 80173 - protein, 34 aa, Artificial Sequence
  Description of Artificial Sequence: Synthetic polypeptide
DEEEIRTTNPVAYEQYGQSVSCQNELDQITGGTR

SEQ ID NO: 80174 - protein, 33 aa, Artificial Sequence
  Description of Artificial Sequence: Synthetic polypeptide
DEEEIRTTNPVATEMWGSVSTQNWLGISGSQRT

SEQ ID NO: 80175 - protein, 34 aa, Artificial Sequence
  Description of Artificial Sequence: Synthetic polypeptide
DEEEIRTTNPVATEQWGHSNVSITNELQHAPGGF

SEQ ID NO: 80176 - protein, 32 aa, Artificial Sequence
  Description of Artificial Sequence: Synthetic polypeptide
DEEEIRTTNPVGTEQYGSVCTNGLGEGGQGET

SEQ ID NO: 80177 - protein, 34 aa, Artificial Sequence
  Description of Artificial Sequence: Synthetic polypeptide
AEEEIRTTNPVATEQYGSVSTVNNNDQTGNVTED

SEQ ID NO: 80178 - protein, 34 aa, Artificial Sequence
  Description of Artificial Sequence: Synthetic polypeptide
DEEEIRTTNPVATEQWGHSNVSITNMLQMGPGGF

SEQ ID NO: 80179 - protein, 32 aa, Artificial Sequence
  Description of Artificial Sequence: Synthetic polypeptide
YEEEIRTTNPVATEQYGTAWASTRNLQETNFS

SEQ ID NO: 80180 - protein, 35 aa, Artificial Sequence
  Description of Artificial Sequence: Synthetic polypeptide
AEEEIRTTNPVATEQYGSVSTVNNLGQQGNTNQND

SEQ ID NO: 80181 - protein, 32 aa, Artificial Sequence
  Description of Artificial Sequence: Synthetic polypeptide
CEEEVRTTNPVATEQYGCVCSTGNLDQNIGDQ

SEQ ID NO: 80182 - protein, 34 aa, Artificial Sequence
  Description of Artificial Sequence: Synthetic polypeptide
AEEEIRTTNPVATEQYGSVSTVNNLNENNQGNDQ

SEQ ID NO: 80183 - protein, 35 aa, Artificial Sequence
  Description of Artificial Sequence: Synthetic polypeptide
AEEEIRTTNPVATEQYGSVSTVNNLQEGTEAGNEA

SEQ ID NO: 80184 - protein, 35 aa, Artificial Sequence
  Description of Artificial Sequence: Synthetic polypeptide
AEEEIRTTNPVATEQYGSVSTVNNLQEGTEGGNAN

SEQ ID NO: 80185 - protein, 30 aa, Artificial Sequence
  Description of Artificial Sequence: Synthetic polypeptide
SDEEIRTTNPVATEQWGCVTSTELQNGSDA

SEQ ID NO: 80186 - protein, 29 aa, Artificial Sequence
  Description of Artificial Sequence: Synthetic peptide
DEAEIRTTNPVACEQYGSCMTNELETESE

SEQ ID NO: 80187 - protein, 28 aa, Artificial Sequence
  Description of Artificial Sequence: Synthetic peptide
YEEEIASVNPVVTEQYGVVSDNWQSGNQ

SEQ ID NO: 80188 - protein, 30 aa, Artificial Sequence
  Description of Artificial Sequence: Synthetic polypeptide
DEAEIRTTNPVACEQYGSCMTNLETPENEY

SEQ ID NO: 80189 - protein, 33 aa, Artificial Sequence
  Description of Artificial Sequence: Synthetic polypeptide
DEEEIRTTNPVSTEQYGSVSSTTTIPNSRVGNV

SEQ ID NO: 80190 - protein, 29 aa, Artificial Sequence
  Description of Artificial Sequence: Synthetic peptide
DEAEIRTTNPVACEQYGSCMTNTIETENE

SEQ ID NO: 80191 - protein, 28 aa, Artificial Sequence
  Description of Artificial Sequence: Synthetic peptide
YEEVIASVNPVCTEQYGVVSDNLQIGNQ

SEQ ID NO: 80192 - protein, 35 aa, Artificial Sequence
  Description of Artificial Sequence: Synthetic polypeptide
AEEEIRTTNPVATEQYGSVSTVNNLQQGNDNGNNE

SEQ ID NO: 80193 - protein, 35 aa, Artificial Sequence
  Description of Artificial Sequence: Synthetic polypeptide
YEEEIRTTNPVATEQYGTVAFNTNGLQCRVGNDRY

SEQ ID NO: 80194 - protein, 35 aa, Artificial Sequence
  Description of Artificial Sequence: Synthetic polypeptide
DEEEIRTTNPVAYEQYGQSVSCQTNETSQVRGGSR

SEQ ID NO: 80195 - protein, 31 aa, Artificial Sequence
  Description of Artificial Sequence: Synthetic polypeptide
YEETICTTNPVATEQYGSVSIMNNGQNGGNI

SEQ ID NO: 80196 - protein, 35 aa, Artificial Sequence
  Description of Artificial Sequence: Synthetic polypeptide
AEEEIRTTNPVATEQYGSVSTVNNLQTGNANTTTQ

SEQ ID NO: 80197 - protein, 35 aa, Artificial Sequence
  Description of Artificial Sequence: Synthetic polypeptide
AEEEIRTTNPVATEQYGSVSTVNNLQTGNGNGNTG

SEQ ID NO: 80198 - protein, 31 aa, Artificial Sequence
  Description of Artificial Sequence: Synthetic polypeptide
DEAEIRTTNPVAHEQYGSVWTTNLQVNDSEG

SEQ ID NO: 80199 - protein, 34 aa, Artificial Sequence
  Description of Artificial Sequence: Synthetic polypeptide
DEEEIRTTNPVATEQWGHSNVSLRNDLQHREGGD

SEQ ID NO: 80200 - protein, 33 aa, Artificial Sequence
  Description of Artificial Sequence: Synthetic polypeptide
DEEEIRTTNPVATEQYGSAYSTCNEDQMENDEQ

SEQ ID NO: 80201 - protein, 28 aa, Artificial Sequence
  Description of Artificial Sequence: Synthetic peptide
YEEEIASVNPYCTEQYGVVSDNLQSGNQ

SEQ ID NO: 80202 - protein, 28 aa, Artificial Sequence
  Description of Artificial Sequence: Synthetic peptide
YEEVIASVNPVCTEQYGVVSDNLQSGNQ

SEQ ID NO: 80203 - protein, 34 aa, Artificial Sequence
  Description of Artificial Sequence: Synthetic polypeptide
DEEEIRTTNPVATEQWGHSNVAYTNQLQTRPGGF

SEQ ID NO: 80204 - protein, 35 aa, Artificial Sequence
  Description of Artificial Sequence: Synthetic polypeptide
AEEEIRTTNPVATEQYGSVSTVNNNLNQEGNQEND

SEQ ID NO: 80205 - protein, 28 aa, Artificial Sequence
  Description of Artificial Sequence: Synthetic peptide
YEESIASVNPVCTEQYGVVSDNLQSGNQ

SEQ ID NO: 80206 - protein, 32 aa, Artificial Sequence
  Description of Artificial Sequence: Synthetic polypeptide
DEAEIRTTNPVATEQYGHVNENDQTRGDEDRA

SEQ ID NO: 80207 - protein, 33 aa, Artificial Sequence
  Description of Artificial Sequence: Synthetic polypeptide
DEEEIRTTNPVATEQYGSVVTGNNLERLESQDG

SEQ ID NO: 80208 - protein, 31 aa, Artificial Sequence
  Description of Artificial Sequence: Synthetic polypeptide
DENEIRTTNPVATECWGSVSCIIEQNRAGNG

SEQ ID NO: 80209 - protein, 30 aa, Artificial Sequence
  Description of Artificial Sequence: Synthetic polypeptide
SEEEIHCTNPIATEQYGSVSENIDMKRGPR

SEQ ID NO: 80210 - protein, 34 aa, Artificial Sequence
  Description of Artificial Sequence: Synthetic polypeptide
DEEEIRTTNPVATEQWGHCNVSYTNGLQAREGGF

SEQ ID NO: 80211 - protein, 33 aa, Artificial Sequence
  Description of Artificial Sequence: Synthetic polypeptide
DEEEISTTNPVATEQYGCVCSTEELQNFGSNQG

SEQ ID NO: 80212 - protein, 30 aa, Artificial Sequence
  Description of Artificial Sequence: Synthetic polypeptide
YEEEIATTNPVATEQYGSVSDDLEDSEGEQ

SEQ ID NO: 80213 - protein, 33 aa, Artificial Sequence
  Description of Artificial Sequence: Synthetic polypeptide
DEEEIRTTNPVSTEQYGSVSSTTTGPNSRVGNV

SEQ ID NO: 80214 - protein, 35 aa, Artificial Sequence
  Description of Artificial Sequence: Synthetic polypeptide
AEEEIRTTNPVATEQYGSVSTVNNNLQQGIGNNQE

SEQ ID NO: 80215 - protein, 32 aa, Artificial Sequence
  Description of Artificial Sequence: Synthetic polypeptide
YEEEIATTNPVATEQYGSVSMNLSQALEGELI

SEQ ID NO: 80216 - protein, 28 aa, Artificial Sequence
  Description of Artificial Sequence: Synthetic peptide
YEEQIASVNPVCTEQYGVVSDNLQSGNS

SEQ ID NO: 80217 - protein, 28 aa, Artificial Sequence
  Description of Artificial Sequence: Synthetic peptide
SEAEIACTNPTAYEQYGSVAENLMRGNQ

SEQ ID NO: 80218 - protein, 34 aa, Artificial Sequence
  Description of Artificial Sequence: Synthetic polypeptide
DEEEIRTTNPVATEQWGHCNVSATNGLQARPGEF

SEQ ID NO: 80219 - protein, 34 aa, Artificial Sequence
  Description of Artificial Sequence: Synthetic polypeptide
DEEEIRTTNPVATEQYGQCVCSTGNLQGFGSDDA

SEQ ID NO: 80220 - protein, 34 aa, Artificial Sequence
  Description of Artificial Sequence: Synthetic polypeptide
DEEEIRTTNPVATEQWGFSNVSNTNFLQMRPDGF

SEQ ID NO: 80221 - protein, 34 aa, Artificial Sequence
  Description of Artificial Sequence: Synthetic polypeptide
AEEEIRTTNPVATEQYGSVSTVTNQNNQDGNIVE

SEQ ID NO: 80222 - protein, 34 aa, Artificial Sequence
  Description of Artificial Sequence: Synthetic polypeptide
DEEEIRTTNPVATEPYGSVSTTEAGPQMRNGMNV

SEQ ID NO: 80223 - protein, 31 aa, Artificial Sequence
  Description of Artificial Sequence: Synthetic polypeptide
DEAEIRTTNPVATDQYGSVCTPNQNGDNDQE

SEQ ID NO: 80224 - protein, 32 aa, Artificial Sequence
  Description of Artificial Sequence: Synthetic polypeptide
DEEEIRTTNPVATEEYGCVCFTELTRGGSNQS

SEQ ID NO: 80225 - protein, 34 aa, Artificial Sequence
  Description of Artificial Sequence: Synthetic polypeptide
DEEEIRTTNPVATEQYGSVTMGTNGIQEDDGNFQ

SEQ ID NO: 80226 - protein, 32 aa, Artificial Sequence
  Description of Artificial Sequence: Synthetic polypeptide
DEEEIRTTNPVAYEQYGQSVPTNAQSQKSGDV

SEQ ID NO: 80227 - protein, 30 aa, Artificial Sequence
  Description of Artificial Sequence: Synthetic polypeptide
SDSEIRSTNPVATEQYGNVSETIMSRVGNR

SEQ ID NO: 80228 - protein, 31 aa, Artificial Sequence
  Description of Artificial Sequence: Synthetic polypeptide
DENEIRTTNPVATECWGSVSCIIEQDREGNG

SEQ ID NO: 80229 - protein, 28 aa, Artificial Sequence
  Description of Artificial Sequence: Synthetic peptide
YEEEIATTNPVATEQYGEAPEVLQHGEK

SEQ ID NO: 80230 - protein, 35 aa, Artificial Sequence
  Description of Artificial Sequence: Synthetic polypeptide
AEEEIRTTNPVATEQYGSVSTVNNNLNQIIGTNQN

SEQ ID NO: 80231 - protein, 31 aa, Artificial Sequence
  Description of Artificial Sequence: Synthetic polypeptide
DEEEIRTTNPVATEMWGTSCSAALLRDGNDS

SEQ ID NO: 80232 - protein, 30 aa, Artificial Sequence
  Description of Artificial Sequence: Synthetic polypeptide
DEAEIRTTNPVATCHYGCVCSTNLANTSNQ

SEQ ID NO: 80233 - protein, 31 aa, Artificial Sequence
  Description of Artificial Sequence: Synthetic polypeptide
DENEIRTTNPVATECWGEVSCINEPQREGGR

SEQ ID NO: 80234 - protein, 31 aa, Artificial Sequence
  Description of Artificial Sequence: Synthetic polypeptide
DENEIRTTNPVATECWGEVSCNEPQREGENG

SEQ ID NO: 80235 - protein, 35 aa, Artificial Sequence
  Description of Artificial Sequence: Synthetic polypeptide
DEEEIRTTNPVATEQYGSVVGSNMNLEFQGGGNID

SEQ ID NO: 80236 - protein, 33 aa, Artificial Sequence
  Description of Artificial Sequence: Synthetic polypeptide
DEEEIRTTNPVATEQYGSARSDTVLNGQMGEQI

SEQ ID NO: 80237 - protein, 34 aa, Artificial Sequence
  Description of Artificial Sequence: Synthetic polypeptide
DEEEIRTTNPVATEQWGHSDVSGTNVLQHSMGGF

SEQ ID NO: 80238 - protein, 32 aa, Artificial Sequence
  Description of Artificial Sequence: Synthetic polypeptide
YEETICTTNPVATEQYGSVSGMGNSEQDRGNS

SEQ ID NO: 80239 - protein, 29 aa, Artificial Sequence
  Description of Artificial Sequence: Synthetic peptide
DENEIRTTNPVATEQYGDVSENEMNAEDA

SEQ ID NO: 80240 - protein, 32 aa, Artificial Sequence
  Description of Artificial Sequence: Synthetic polypeptide
DENEIRTTNPVATECWGEVSCINEPQREGENR

SEQ ID NO: 80241 - protein, 30 aa, Artificial Sequence
  Description of Artificial Sequence: Synthetic polypeptide
DENEIRTTNPVATEQYGDVSEILMNAAEDR

SEQ ID NO: 80242 - protein, 37 aa, Artificial Sequence
  Description of Artificial Sequence: Synthetic polypeptide
DEEEIRTTYNPVATEQYGSTVPSTDNALSQSEGGNQR

SEQ ID NO: 80243 - protein, 35 aa, Artificial Sequence
  Description of Artificial Sequence: Synthetic polypeptide
AEEEIRTTNPVATEQYGSVSTVNNNLQEGTEGNEA

SEQ ID NO: 80244 - protein, 29 aa, Artificial Sequence
  Description of Artificial Sequence: Synthetic peptide
DENEIRTTNPVATEQYGDVSEIEQNHEEA

SEQ ID NO: 80245 - protein, 31 aa, Artificial Sequence
  Description of Artificial Sequence: Synthetic polypeptide
YEETICTTNPVATEQYGSVNIMNGQRGLNGE

SEQ ID NO: 80246 - protein, 33 aa, Artificial Sequence
  Description of Artificial Sequence: Synthetic polypeptide
DEEEIRTTNPVATEQYGSVVGSNNMQQEQENEI

SEQ ID NO: 80247 - protein, 34 aa, Artificial Sequence
  Description of Artificial Sequence: Synthetic polypeptide
DEEEIRTTNPVGTEQYGSVSCTNEHSGNRTVGQP

SEQ ID NO: 80248 - protein, 28 aa, Artificial Sequence
  Description of Artificial Sequence: Synthetic peptide
YEETIASVNPVCTEQYGVVSDNLQSGNQ

SEQ ID NO: 80249 - protein, 33 aa, Artificial Sequence
  Description of Artificial Sequence: Synthetic polypeptide
DEEEIRTTNPVATEQYGSAYPVPNPLQPRGVEN

SEQ ID NO: 80250 - protein, 33 aa, Artificial Sequence
  Description of Artificial Sequence: Synthetic polypeptide
DEEEIRTTNPVGTEQYGSVSGTNGQGEGGFGEE

SEQ ID NO: 80251 - protein, 32 aa, Artificial Sequence
  Description of Artificial Sequence: Synthetic polypeptide
DEEEIRTTNPVGTEQYGSVSINGLGEGGDDED

SEQ ID NO: 80252 - protein, 35 aa, Artificial Sequence
  Description of Artificial Sequence: Synthetic polypeptide
AEEEIRTTNPVATEQYGSVSTVNNNLQEGTEGGNQ

SEQ ID NO: 80253 - protein, 32 aa, Artificial Sequence
  Description of Artificial Sequence: Synthetic polypeptide
DEEEIRTTNPVATECYGVMSSTNGEQRNQNEF

SEQ ID NO: 80254 - protein, 33 aa, Artificial Sequence
  Description of Artificial Sequence: Synthetic polypeptide
DEEEIRTTNPVATEQYGSVVTNQEENGNNENEG

SEQ ID NO: 80255 - protein, 32 aa, Artificial Sequence
  Description of Artificial Sequence: Synthetic polypeptide
DEEEIRTTNPVATECYGVMGSTNEQRNQNEFE

SEQ ID NO: 80256 - protein, 31 aa, Artificial Sequence
  Description of Artificial Sequence: Synthetic polypeptide
DENEIRTTNPVATEQYGELCSTNLQPEIDSA

SEQ ID NO: 80257 - protein, 32 aa, Artificial Sequence
  Description of Artificial Sequence: Synthetic polypeptide
DEEEIRTTNPVATEQYGQCVCSTEHQGFGSQQ

SEQ ID NO: 80258 - protein, 28 aa, Artificial Sequence
  Description of Artificial Sequence: Synthetic peptide
YEGEIAPTNPCSSEQYGVVSDNLQSGNR

SEQ ID NO: 80259 - protein, 34 aa, Artificial Sequence
  Description of Artificial Sequence: Synthetic polypeptide
DEEEIRTTNPVATEQYGSVVTTNLLENPELQNRD

SEQ ID NO: 80260 - protein, 34 aa, Artificial Sequence
  Description of Artificial Sequence: Synthetic polypeptide
DEEEIRTTNPVATEQYGSVTGVGNLDQEGQENQE

SEQ ID NO: 80261 - protein, 32 aa, Artificial Sequence
  Description of Artificial Sequence: Synthetic polypeptide
DEEEIRTTNPVGTEQYGQWGDSGVNLQTSNGR

SEQ ID NO: 80262 - protein, 31 aa, Artificial Sequence
  Description of Artificial Sequence: Synthetic polypeptide
SEEEIACTNPVATEQYGSVATNLQQAPDLRE

SEQ ID NO: 80263 - protein, 35 aa, Artificial Sequence
  Description of Artificial Sequence: Synthetic polypeptide
AEEEIRTTNPVATEQYGSVSTVNLQQQEQGNQNQN

SEQ ID NO: 80264 - protein, 36 aa, Artificial Sequence
  Description of Artificial Sequence: Synthetic polypeptide
DEEEIRTTNPVATEQWGHSVSTAPNYQERTGMNQRP

SEQ ID NO: 80265 - protein, 28 aa, Artificial Sequence
  Description of Artificial Sequence: Synthetic peptide
YEEEIASVNPVSTEPYGVVSDNLQSGNQ

SEQ ID NO: 80266 - protein, 30 aa, Artificial Sequence
  Description of Artificial Sequence: Synthetic polypeptide
DENEIRTTNPVATECWGDVSCCEQDRGENG

SEQ ID NO: 80267 - protein, 30 aa, Artificial Sequence
  Description of Artificial Sequence: Synthetic polypeptide
DENEIRTTNPVATECWGDVSCCLQDREENG

SEQ ID NO: 80268 - protein, 33 aa, Artificial Sequence
  Description of Artificial Sequence: Synthetic polypeptide
DEEEIRTTNPVATEQYGQCVCSTEHQNFGSNTM

SEQ ID NO: 80269 - protein, 34 aa, Artificial Sequence
  Description of Artificial Sequence: Synthetic polypeptide
DEEEIRTTNPVATEQWGHSSVSPTNYLDHRPGGF

SEQ ID NO: 80270 - protein, 31 aa, Artificial Sequence
  Description of Artificial Sequence: Synthetic polypeptide
DENEIRTTNPVATEQYGEASSEPNGQRNGGV

SEQ ID NO: 80271 - protein, 34 aa, Artificial Sequence
  Description of Artificial Sequence: Synthetic polypeptide
DEEEIRTTNPVATEQWGHSNVSYTNYLEHRPGGI

SEQ ID NO: 80272 - protein, 28 aa, Artificial Sequence
  Description of Artificial Sequence: Synthetic peptide
YEGEIAPTNPCSSEQYGIVSCNLQSGNR

SEQ ID NO: 80273 - protein, 31 aa, Artificial Sequence
  Description of Artificial Sequence: Synthetic polypeptide
DENEIRTTNPVATECWGDVSCINLPQRGEEL

SEQ ID NO: 80274 - protein, 30 aa, Artificial Sequence
  Description of Artificial Sequence: Synthetic polypeptide
DEEEIRTTNPVGTEQYGSMATAGPQHNGDV

SEQ ID NO: 80275 - protein, 35 aa, Artificial Sequence
  Description of Artificial Sequence: Synthetic polypeptide
AEEEIRTTNPVATEQYGSVSTVNLQQQIGNNNNEE

SEQ ID NO: 80276 - protein, 35 aa, Artificial Sequence
  Description of Artificial Sequence: Synthetic polypeptide
AEEEIRTTNPVATEQYGSVSTVNLQQQIGNTNSTD

SEQ ID NO: 80277 - protein, 32 aa, Artificial Sequence
  Description of Artificial Sequence: Synthetic polypeptide
DEEEISTTNPVATEQYGCVCSTELQEHNSNAS

SEQ ID NO: 80278 - protein, 32 aa, Artificial Sequence
  Description of Artificial Sequence: Synthetic polypeptide
SCEEIRTTNPVATEQWGTQCSTNLEQETGNGR

SEQ ID NO: 80279 - protein, 34 aa, Artificial Sequence
  Description of Artificial Sequence: Synthetic polypeptide
YEEEIRTTNPVATEQYGTAVVSNSNLTQRNGVRF

SEQ ID NO: 80280 - protein, 28 aa, Artificial Sequence
  Description of Artificial Sequence: Synthetic peptide
YEEEIASVNPVSTEGYGVVSDNLQSGNQ

SEQ ID NO: 80281 - protein, 28 aa, Artificial Sequence
  Description of Artificial Sequence: Synthetic peptide
YEEEIASVNPVGTEQYGVVSDLLQSGNQ

SEQ ID NO: 80282 - protein, 35 aa, Artificial Sequence
  Description of Artificial Sequence: Synthetic polypeptide
AEEEIRTTNPVATEQYGSVSTVNLQNQEQGNQEDE

SEQ ID NO: 80283 - protein, 31 aa, Artificial Sequence
  Description of Artificial Sequence: Synthetic polypeptide
CEETIATTNPVATECYGSVQNTTNTLIRGNN

SEQ ID NO: 80284 - protein, 28 aa, Artificial Sequence
  Description of Artificial Sequence: Synthetic peptide
YEGEIAPTNPCSTEQYGIVSDNLQSGTR

SEQ ID NO: 80285 - protein, 34 aa, Artificial Sequence
  Description of Artificial Sequence: Synthetic polypeptide
AEEEIRTTNPVATEQYGSVSTVNLQQGGTEQGEG

SEQ ID NO: 80286 - protein, 35 aa, Artificial Sequence
  Description of Artificial Sequence: Synthetic polypeptide
AEEEIRTTNPVATEQYGSVSTVNLQQGNQGTENEE

SEQ ID NO: 80287 - protein, 28 aa, Artificial Sequence
  Description of Artificial Sequence: Synthetic peptide
YEEEIASVNPVGTEQYGVVSDNLQSGDQ

SEQ ID NO: 80288 - protein, 28 aa, Artificial Sequence
  Description of Artificial Sequence: Synthetic peptide
YEGEIAPTNPCSTEQYGIVSCNLQSGTR

SEQ ID NO: 80289 - protein, 33 aa, Artificial Sequence
  Description of Artificial Sequence: Synthetic polypeptide
YEEEIRTTNPVATEQYGTAVSNSNLTNRNGNEF

SEQ ID NO: 80290 - protein, 29 aa, Artificial Sequence
  Description of Artificial Sequence: Synthetic peptide
DENEIRTTNPVATEQYGIVSENEMNAETA

SEQ ID NO: 80291 - protein, 34 aa, Artificial Sequence
  Description of Artificial Sequence: Synthetic polypeptide
DEEEIRTTNPVATEQWGHSNVSYTNQLQHGPGSF

SEQ ID NO: 80292 - protein, 34 aa, Artificial Sequence
  Description of Artificial Sequence: Synthetic polypeptide
DEEEIRTTNPVAYEQYGQSVSETWADLLQRGIEQ

SEQ ID NO: 80293 - protein, 29 aa, Artificial Sequence
  Description of Artificial Sequence: Synthetic peptide
YEEEIASVNPVGTEQYGVVSSNLQSGNEQ

SEQ ID NO: 80294 - protein, 29 aa, Artificial Sequence
  Description of Artificial Sequence: Synthetic peptide
CEETIATTNPVATECYGSVEVIGLQRGVM

SEQ ID NO: 80295 - protein, 28 aa, Artificial Sequence
  Description of Artificial Sequence: Synthetic peptide
YEEEIASVNPVMTEQYGVVSDNLQSKNQ

SEQ ID NO: 80296 - protein, 34 aa, Artificial Sequence
  Description of Artificial Sequence: Synthetic polypeptide
AEEEIRTTNPVATEQYGSVSTVNLQQINNNNETE

SEQ ID NO: 80297 - protein, 34 aa, Artificial Sequence
  Description of Artificial Sequence: Synthetic polypeptide
AEEEIRTTNPVATEQYGSVSTVNLQQNDEGEIAE

SEQ ID NO: 80298 - protein, 34 aa, Artificial Sequence
  Description of Artificial Sequence: Synthetic polypeptide
AEEEIRTTNPVATEQYGSVSTVTNQQQGTVNNVD

SEQ ID NO: 80299 - protein, 34 aa, Artificial Sequence
  Description of Artificial Sequence: Synthetic polypeptide
AEEEIRTTNPVATEQYGSVSTVNLQQNEDENEGT

SEQ ID NO: 80300 - protein, 35 aa, Artificial Sequence
  Description of Artificial Sequence: Synthetic polypeptide
AEEEIRTTNPVATEQYGSVSTVNLQQNENGNINQG

SEQ ID NO: 80301 - protein, 35 aa, Artificial Sequence
  Description of Artificial Sequence: Synthetic polypeptide
AEEEIRTTNPVATEQYGSVSTVNLQQNQQGTNTTE

SEQ ID NO: 80302 - protein, 28 aa, Artificial Sequence
  Description of Artificial Sequence: Synthetic peptide
YEEEIASVNPVSSEQYGVVSDNLQSGTR

SEQ ID NO: 80303 - protein, 34 aa, Artificial Sequence
  Description of Artificial Sequence: Synthetic polypeptide
YEEEIRTTNPVATEQYGTAVTSNSYLTQRNGNRE

SEQ ID NO: 80304 - protein, 28 aa, Artificial Sequence
  Description of Artificial Sequence: Synthetic peptide
YEEEIASVNPVSTEQYGIVSDNLQSGTQ

SEQ ID NO: 80305 - protein, 33 aa, Artificial Sequence
  Description of Artificial Sequence: Synthetic polypeptide
DEEEIRTTNPVATEQYGQCVCSTEHQYGSNFQT

SEQ ID NO: 80306 - protein, 33 aa, Artificial Sequence
  Description of Artificial Sequence: Synthetic polypeptide
DEEEIRTTNPVATEQYGQCVCSTELASFGSNQL

SEQ ID NO: 80307 - protein, 30 aa, Artificial Sequence
  Description of Artificial Sequence: Synthetic polypeptide
DENEIRTTNPVATEQYGDVSTILMNAEEDA

SEQ ID NO: 80308 - protein, 34 aa, Artificial Sequence
  Description of Artificial Sequence: Synthetic polypeptide
AEEEIRTTNPVATEQYGSVSTVNLQTGTTTTDTD

SEQ ID NO: 80309 - protein, 33 aa, Artificial Sequence
  Description of Artificial Sequence: Synthetic polypeptide
DEEEIRTTNPVAYEQYGCVCSNTNLQNFGSEAF

SEQ ID NO: 80310 - protein, 30 aa, Artificial Sequence
  Description of Artificial Sequence: Synthetic polypeptide
DENEIRTTNPVATEQYGDVSTILMNAAEDA

SEQ ID NO: 80311 - protein, 29 aa, Artificial Sequence
  Description of Artificial Sequence: Synthetic peptide
DENEIRTTNPVATEQWGEVSENEQAAEDA

SEQ ID NO: 80312 - protein, 33 aa, Artificial Sequence
  Description of Artificial Sequence: Synthetic polypeptide
DEEEIRTTNPVAYEQYGCVCSNTNPQNFGSNQP

SEQ ID NO: 80313 - protein, 34 aa, Artificial Sequence
  Description of Artificial Sequence: Synthetic polypeptide
DEEEIRTTNPVATEQWGHSNVSYTNDLQHGPGGF

SEQ ID NO: 80314 - protein, 33 aa, Artificial Sequence
  Description of Artificial Sequence: Synthetic polypeptide
AEEEIRTTNPVATEQYGSVSTVNNDNQQEDEND

SEQ ID NO: 80315 - protein, 30 aa, Artificial Sequence
  Description of Artificial Sequence: Synthetic polypeptide
DENEIRTTNPVATEQYGDVSTIGMNAAENA

SEQ ID NO: 80316 - protein, 30 aa, Artificial Sequence
  Description of Artificial Sequence: Synthetic polypeptide
DENEIRTTNPVATEQYGDVSTIEMNANGDV

SEQ ID NO: 80317 - protein, 35 aa, Artificial Sequence
  Description of Artificial Sequence: Synthetic polypeptide
DEEEIRTTNPVATEQYGQCVCSTENPLQFFGSNQL

SEQ ID NO: 80318 - protein, 32 aa, Artificial Sequence
  Description of Artificial Sequence: Synthetic polypeptide
DEEEIRTTNPVAYEQYGQSVSEQDALQTGVEQ

SEQ ID NO: 80319 - protein, 32 aa, Artificial Sequence
  Description of Artificial Sequence: Synthetic polypeptide
DEEEISTTNPVATEQYGCVCSTEHQYFGSNQD

SEQ ID NO: 80320 - protein, 30 aa, Artificial Sequence
  Description of Artificial Sequence: Synthetic polypeptide
SDEEIRTTNPVATEQWGATVSTNLEEELND

SEQ ID NO: 80321 - protein, 30 aa, Artificial Sequence
  Description of Artificial Sequence: Synthetic polypeptide
DENEIRTTNPVATEQYGDVSTIEMMANEDA

SEQ ID NO: 80322 - protein, 29 aa, Artificial Sequence
  Description of Artificial Sequence: Synthetic peptide
YEEEIASVNPVSTEQYGVVSMNLQQSGNQ

SEQ ID NO: 80323 - protein, 34 aa, Artificial Sequence
  Description of Artificial Sequence: Synthetic polypeptide
AEEEIRTTNPVATEQYGSVSTVNNENQQEGNQNN

SEQ ID NO: 80324 - protein, 28 aa, Artificial Sequence
  Description of Artificial Sequence: Synthetic peptide
YEEEIASVNPVSTEQYGVVSNNIQSGNQ

SEQ ID NO: 80325 - protein, 28 aa, Artificial Sequence
  Description of Artificial Sequence: Synthetic peptide
YEEEIASVNPVSYEQYGVVSDNLQSGNQ

SEQ ID NO: 80326 - protein, 34 aa, Artificial Sequence
  Description of Artificial Sequence: Synthetic polypeptide
AEEEIRTTNPVATEQYGSVSTVNNENQQGTNDES

SEQ ID NO: 80327 - protein, 34 aa, Artificial Sequence
  Description of Artificial Sequence: Synthetic polypeptide
DEEEIRTTNPVAYEQYGQSVSENDALQTGVELRE

SEQ ID NO: 80328 - protein, 32 aa, Artificial Sequence
  Description of Artificial Sequence: Synthetic polypeptide
YEEEIRTTNPEATEQYGFVSSFNNQQRSGNTI

SEQ ID NO: 80329 - protein, 29 aa, Artificial Sequence
  Description of Artificial Sequence: Synthetic peptide
DEAEIRTTNPNATEGYGSVATNHGAGDAD

SEQ ID NO: 80330 - protein, 33 aa, Artificial Sequence
  Description of Artificial Sequence: Synthetic polypeptide
DEEEIRTTNPVGTEFYGSVNNMPNGLGQRGING

SEQ ID NO: 80331 - protein, 35 aa, Artificial Sequence
  Description of Artificial Sequence: Synthetic polypeptide
DEEEIRTTNPVATEQWGHSNVSYTNELQHRPGDGA

SEQ ID NO: 80332 - protein, 35 aa, Artificial Sequence
  Description of Artificial Sequence: Synthetic polypeptide
DEEEIRTTNPVATEQYGQCVCSTENHQRFGSNFQT

SEQ ID NO: 80333 - protein, 35 aa, Artificial Sequence
  Description of Artificial Sequence: Synthetic polypeptide
AEEEIRTTNPVATEQYGSVSTVNLQQQNDEGGNNE

SEQ ID NO: 80334 - protein, 29 aa, Artificial Sequence
  Description of Artificial Sequence: Synthetic peptide
YEEEIASVNPVSTEQYGTVSMNLQQSGNQ

SEQ ID NO: 80335 - protein, 34 aa, Artificial Sequence
  Description of Artificial Sequence: Synthetic polypeptide
DEEEIRTTNPVSYEQYGSVPFCTNPSQRNGGNMR

SEQ ID NO: 80336 - protein, 35 aa, Artificial Sequence
  Description of Artificial Sequence: Synthetic polypeptide
AEEEIRTTNPVATEQYGSVSTVNLQQQNGNDEIGS

SEQ ID NO: 80337 - protein, 32 aa, Artificial Sequence
  Description of Artificial Sequence: Synthetic polypeptide
SEEEIACTNPVATEQYGSVATNLQQDGMENDI

SEQ ID NO: 80338 - protein, 30 aa, Artificial Sequence
  Description of Artificial Sequence: Synthetic polypeptide
DEAEIRTTNPLATEEYGSVATNHGNLGNAD

SEQ ID NO: 80339 - protein, 28 aa, Artificial Sequence
  Description of Artificial Sequence: Synthetic peptide
YEEEIASVNPVSTEQYGVVSCNLQSGTQ

SEQ ID NO: 80340 - protein, 34 aa, Artificial Sequence
  Description of Artificial Sequence: Synthetic polypeptide
DEEEIRTTNPVATEQYGQCVCSTELNQHFGSNQN

SEQ ID NO: 80341 - protein, 34 aa, Artificial Sequence
  Description of Artificial Sequence: Synthetic polypeptide
AEEEIRTTNPVATEQYGSVSTVTNQQNQEGNNED

SEQ ID NO: 80342 - protein, 31 aa, Artificial Sequence
  Description of Artificial Sequence: Synthetic polypeptide
DENEIRTTNPVATECWGDVSCNEQDREGENG

SEQ ID NO: 80343 - protein, 35 aa, Artificial Sequence
  Description of Artificial Sequence: Synthetic polypeptide
AEEEIRTTNPVATEQYGSVSTVNLQQQQQGTNITD

SEQ ID NO: 80344 - protein, 35 aa, Artificial Sequence
  Description of Artificial Sequence: Synthetic polypeptide
DEEEIRTTNPVATEQWGHSNVSYTNMLQHRPGGFE

SEQ ID NO: 80345 - protein, 35 aa, Artificial Sequence
  Description of Artificial Sequence: Synthetic polypeptide
AEEEIRTTNPVATEQYGSVSTVNLQQQQGNGNQGE

SEQ ID NO: 80346 - protein, 30 aa, Artificial Sequence
  Description of Artificial Sequence: Synthetic polypeptide
DENEIRTTNPVATECWGDVSECLQDREENG

SEQ ID NO: 80347 - protein, 32 aa, Artificial Sequence
  Description of Artificial Sequence: Synthetic polypeptide
DEAEIRTTNPMATEQWGSVYATDNDDQRGNHA

SEQ ID NO: 80348 - protein, 34 aa, Artificial Sequence
  Description of Artificial Sequence: Synthetic polypeptide
DEEEIRTTNPVATEQWGHSNVSYTNLLQHINDGF

SEQ ID NO: 80349 - protein, 35 aa, Artificial Sequence
  Description of Artificial Sequence: Synthetic polypeptide
AEEEIRTTNPVATEQYGSVSTVNLQQQQGNTNIGD

SEQ ID NO: 80350 - protein, 30 aa, Artificial Sequence
  Description of Artificial Sequence: Synthetic polypeptide
DENEIRTTNPVATEQYGDVSTILMNAEEEA

SEQ ID NO: 80351 - protein, 28 aa, Artificial Sequence
  Description of Artificial Sequence: Synthetic peptide
YEEEIASVNPVSTEQYGVVSDDLQSGNQ

SEQ ID NO: 80352 - protein, 35 aa, Artificial Sequence
  Description of Artificial Sequence: Synthetic polypeptide
DEEEIRTTNPVATEQWGHSNVSYTNELQHRPGSGF

SEQ ID NO: 80353 - protein, 28 aa, Artificial Sequence
  Description of Artificial Sequence: Synthetic peptide
YEEEIASVNPVSTEQYGVVSDNLQSGTQ

SEQ ID NO: 80354 - protein, 34 aa, Artificial Sequence
  Description of Artificial Sequence: Synthetic polypeptide
DEEEIRTTNPVATEQYGQCVCSTENHQHFGSNQA

SEQ ID NO: 80355 - protein, 32 aa, Artificial Sequence
  Description of Artificial Sequence: Synthetic polypeptide
DEEEIRTTNPVSYEQYGSVYCCTNELGRVGSP

SEQ ID NO: 80356 - protein, 29 aa, Artificial Sequence
  Description of Artificial Sequence: Synthetic peptide
YEEEIASVNPVCTEQYGVVWSDNLQSGNQ

SEQ ID NO: 80357 - protein, 34 aa, Artificial Sequence
  Description of Artificial Sequence: Synthetic polypeptide
DEEEIRTTNPVATEQWGQSNVSYTEDLQARSGGF

SEQ ID NO: 80358 - protein, 34 aa, Artificial Sequence
  Description of Artificial Sequence: Synthetic polypeptide
DEEEIRTTNPVATEQYGQTVSCTNEGSQRPGSYF

SEQ ID NO: 80359 - protein, 33 aa, Artificial Sequence
  Description of Artificial Sequence: Synthetic polypeptide
AEEEIRTTNPVATEQYGSVSTVGNQQGNPNNTD

SEQ ID NO: 80360 - protein, 34 aa, Artificial Sequence
  Description of Artificial Sequence: Synthetic polypeptide
DEEEIRTTNPVATEQYGQVSTMTNEQEGEGENIF

SEQ ID NO: 80361 - protein, 33 aa, Artificial Sequence
  Description of Artificial Sequence: Synthetic polypeptide
DEEEIRTTNPVATEQWGSVSATGNGGQPHAGAH

SEQ ID NO: 80362 - protein, 30 aa, Artificial Sequence
  Description of Artificial Sequence: Synthetic polypeptide
SEEEIRCTNPIATEPYGTISEENLMRNGNR

SEQ ID NO: 80363 - protein, 29 aa, Artificial Sequence
  Description of Artificial Sequence: Synthetic peptide
YEEEIASVNPVCTEQYGVVSLNILQSGNQ

SEQ ID NO: 80364 - protein, 33 aa, Artificial Sequence
  Description of Artificial Sequence: Synthetic polypeptide
DEEEIRTTNPVATECYGEAQVSTNEIQRSEVNF

SEQ ID NO: 80365 - protein, 32 aa, Artificial Sequence
  Description of Artificial Sequence: Synthetic polypeptide
DEEEIRTTNPVATECYGEAQVSTNEQREVVVF

SEQ ID NO: 80366 - protein, 35 aa, Artificial Sequence
  Description of Artificial Sequence: Synthetic polypeptide
DEEEIRTTNPVAYEQYGCATVSCTNGLSQRGGNQS

SEQ ID NO: 80367 - protein, 33 aa, Artificial Sequence
  Description of Artificial Sequence: Synthetic polypeptide
DENEIRATNPVATEQYGSVMTGNLIRGMGQDNE

SEQ ID NO: 80368 - protein, 33 aa, Artificial Sequence
  Description of Artificial Sequence: Synthetic polypeptide
DEEEIRTTNPVATEQWGSVSAEGNGGQPPGANF

SEQ ID NO: 80369 - protein, 32 aa, Artificial Sequence
  Description of Artificial Sequence: Synthetic polypeptide
DEEEIRCTNPVATEQWGSVSCNEPMDREGENG

SEQ ID NO: 80370 - protein, 34 aa, Artificial Sequence
  Description of Artificial Sequence: Synthetic polypeptide
AEEEIRTTNPVATEQYGSVSTVLGQQIGNNNNTE

SEQ ID NO: 80371 - protein, 31 aa, Artificial Sequence
  Description of Artificial Sequence: Synthetic polypeptide
DEEEIRTTNPVATECYGEASTENEQMNVNFG

SEQ ID NO: 80372 - protein, 31 aa, Artificial Sequence
  Description of Artificial Sequence: Synthetic polypeptide
DENEIRTTNPVATEQYGSVCSPTFLEGEEFI

SEQ ID NO: 80373 - protein, 34 aa, Artificial Sequence
  Description of Artificial Sequence: Synthetic polypeptide
DEEEIRTTNPVAYEQYGCATVSCTNLSQAGGNLS

SEQ ID NO: 80374 - protein, 33 aa, Artificial Sequence
  Description of Artificial Sequence: Synthetic polypeptide
DEEEIRTTNPVATEQYGSVWPMNSLERNGEFEM

SEQ ID NO: 80375 - protein, 29 aa, Artificial Sequence
  Description of Artificial Sequence: Synthetic peptide
YEEEIASVNPVCTEQYGVVSLNLQESGNQ

SEQ ID NO: 80376 - protein, 33 aa, Artificial Sequence
  Description of Artificial Sequence: Synthetic polypeptide
DEEEIRTTNPVATEQWGSVPSTNMSSPATGNNA

SEQ ID NO: 80377 - protein, 34 aa, Artificial Sequence
  Description of Artificial Sequence: Synthetic polypeptide
DEEEIRTTNPVAYEQYGCAVCSCTNLSQEGGNLS

SEQ ID NO: 80378 - protein, 29 aa, Artificial Sequence
  Description of Artificial Sequence: Synthetic peptide
YEEEIASVNPVCTEQYGVVSMDNLQQGNQ

SEQ ID NO: 80379 - protein, 35 aa, Artificial Sequence
  Description of Artificial Sequence: Synthetic polypeptide
DEEEIRTTNPVAYEQYGCAVQSCTNMLSQRGGNQS

SEQ ID NO: 80380 - protein, 31 aa, Artificial Sequence
  Description of Artificial Sequence: Synthetic polypeptide
DENEIGTTNPVATEQYGQVIVNQLQERMGQL

SEQ ID NO: 80381 - protein, 32 aa, Artificial Sequence
  Description of Artificial Sequence: Synthetic polypeptide
DEEEIRTTNPVSTETYGSVSMVNEQRTLVNSQ

SEQ ID NO: 80382 - protein, 33 aa, Artificial Sequence
  Description of Artificial Sequence: Synthetic polypeptide
AEEEIRTTNPVATEQYGSVSTVGNQQGNPNNDE

SEQ ID NO: 80383 - protein, 30 aa, Artificial Sequence
  Description of Artificial Sequence: Synthetic polypeptide
YENEIRTTNPVATEQFGAIPSTFLERQGQR

SEQ ID NO: 80384 - protein, 31 aa, Artificial Sequence
  Description of Artificial Sequence: Synthetic polypeptide
SEEEIRCTNPIATEQWGSVSCNEPMDRGENR

SEQ ID NO: 80385 - protein, 29 aa, Artificial Sequence
  Description of Artificial Sequence: Synthetic peptide
YEEEIASVNPVCTEQYGVVSIDNLQSGNQ

SEQ ID NO: 80386 - protein, 34 aa, Artificial Sequence
  Description of Artificial Sequence: Synthetic polypeptide
YEEEIRTTNPVATEQFGCAVSNSNLTQRNGNMRF

SEQ ID NO: 80387 - protein, 33 aa, Artificial Sequence
  Description of Artificial Sequence: Synthetic polypeptide
DEEEIRTTNPVATEQWGSVSCIAEPQMREGENV

SEQ ID NO: 80388 - protein, 34 aa, Artificial Sequence
  Description of Artificial Sequence: Synthetic polypeptide
AEEEIRTTNPVATEQYGSVSTVGNNQQGNPNTEQ

SEQ ID NO: 80389 - protein, 32 aa, Artificial Sequence
  Description of Artificial Sequence: Synthetic polypeptide
SEEEIRCTNPIATEQWGSVSCENLSMRTGGNR

SEQ ID NO: 80390 - protein, 33 aa, Artificial Sequence
  Description of Artificial Sequence: Synthetic polypeptide
DEEEIRTTNPVATEQYGSCITVNELEVDSGQNE

SEQ ID NO: 80391 - protein, 30 aa, Artificial Sequence
  Description of Artificial Sequence: Synthetic polypeptide
SEEEIRCTNPIATEQWGSVGGENDMNRGNR

SEQ ID NO: 80392 - protein, 29 aa, Artificial Sequence
  Description of Artificial Sequence: Synthetic peptide
YEEEIASVNPVCTEQYGVVSKDNLQSGNQ

SEQ ID NO: 80393 - protein, 29 aa, Artificial Sequence
  Description of Artificial Sequence: Synthetic peptide
YEEEIASVNPVCTEQYGVVSKDNLQTGNQ

SEQ ID NO: 80394 - protein, 33 aa, Artificial Sequence
  Description of Artificial Sequence: Synthetic polypeptide
DEEEIRTTNPVAYEQYGCAVSCTNSSTRGGNLS

SEQ ID NO: 80395 - protein, 31 aa, Artificial Sequence
  Description of Artificial Sequence: Synthetic polypeptide
SEEEIRCTNPIATEQWGSVFSENDDMREGNR

SEQ ID NO: 80396 - protein, 34 aa, Artificial Sequence
  Description of Artificial Sequence: Synthetic polypeptide
DENEIRTTNPVATEQYGSVCSPTNLENGNNSDIE

SEQ ID NO: 80397 - protein, 29 aa, Artificial Sequence
  Description of Artificial Sequence: Synthetic peptide
YEEEIASVNPVCTEQYGVVSLDNLQSGNQ

SEQ ID NO: 80398 - protein, 30 aa, Artificial Sequence
  Description of Artificial Sequence: Synthetic polypeptide
DEEEIRCTNPVATEQWGDVSEIEMNRAGNA

SEQ ID NO: 80399 - protein, 34 aa, Artificial Sequence
  Description of Artificial Sequence: Synthetic polypeptide
DEEEIRTTNPVATEQYGQVSTMTNGIQEGGENGF

SEQ ID NO: 80400 - protein, 30 aa, Artificial Sequence
  Description of Artificial Sequence: Synthetic polypeptide
DEEEIRTTNPVSTEQYGSVTDEGQSGGGQT

SEQ ID NO: 80401 - protein, 33 aa, Artificial Sequence
  Description of Artificial Sequence: Synthetic polypeptide
DEAEIRTTNPCATEQYGEVSTSNGLNSGQGGER

SEQ ID NO: 80402 - protein, 32 aa, Artificial Sequence
  Description of Artificial Sequence: Synthetic polypeptide
DENEICTVNPVATEQYGSVSTTMNLEFEGNHY

SEQ ID NO: 80403 - protein, 32 aa, Artificial Sequence
  Description of Artificial Sequence: Synthetic polypeptide
AEEEIRTTNPVATEQYGSVSTVGNQGNQNNDE

SEQ ID NO: 80404 - protein, 33 aa, Artificial Sequence
  Description of Artificial Sequence: Synthetic polypeptide
DEEEIRTTNPVATECYGEAQVSATNEQREVNTF

SEQ ID NO: 80405 - protein, 34 aa, Artificial Sequence
  Description of Artificial Sequence: Synthetic polypeptide
YEEEIRTTNPVATEQFGCAVLSNSNLDQRNGNRF

SEQ ID NO: 80406 - protein, 33 aa, Artificial Sequence
  Description of Artificial Sequence: Synthetic polypeptide
DEEEIRTTNPVSTETYGSVSMVNEQRTGVNLYI

SEQ ID NO: 80407 - protein, 32 aa, Artificial Sequence
  Description of Artificial Sequence: Synthetic polypeptide
SEEEIRCTNPIATEQWGSVSEINLPMREGENR

SEQ ID NO: 80408 - protein, 34 aa, Artificial Sequence
  Description of Artificial Sequence: Synthetic polypeptide
DEEEIRTTNPVATEPYGSVSSTPAGPQMRNGMNV

SEQ ID NO: 80409 - protein, 34 aa, Artificial Sequence
  Description of Artificial Sequence: Synthetic polypeptide
DEEEIRTTNPVAYEQYGCAVSCTPNSSQRGGNQS

SEQ ID NO: 80410 - protein, 32 aa, Artificial Sequence
  Description of Artificial Sequence: Synthetic polypeptide
YEEEIRTTNPVATEPYGAVYSLNLQQVEGVPR

SEQ ID NO: 80411 - protein, 31 aa, Artificial Sequence
  Description of Artificial Sequence: Synthetic polypeptide
YEEEIRTTNPVATEHYGSVSTLTNARFGTHN

SEQ ID NO: 80412 - protein, 32 aa, Artificial Sequence
  Description of Artificial Sequence: Synthetic polypeptide
DEEEIRTTNPVATECYGMSSTNDEQRNQNEFN

SEQ ID NO: 80413 - protein, 28 aa, Artificial Sequence
  Description of Artificial Sequence: Synthetic peptide
YEEEIASVNPVCTEQYGVVSMNIQSGNQ

SEQ ID NO: 80414 - protein, 29 aa, Artificial Sequence
  Description of Artificial Sequence: Synthetic peptide
YENEIATVNPVCTEQYGTVSDNLQQSGNQ

SEQ ID NO: 80415 - protein, 32 aa, Artificial Sequence
  Description of Artificial Sequence: Synthetic polypeptide
DEEEIRTTNPVATEQYGSVWISNLDDAPENPQ

SEQ ID NO: 80416 - protein, 32 aa, Artificial Sequence
  Description of Artificial Sequence: Synthetic polypeptide
DEEEIRTTNPVATEQYGSVWICNLDDIAEEDR

SEQ ID NO: 80417 - protein, 33 aa, Artificial Sequence
  Description of Artificial Sequence: Synthetic polypeptide
DEEEISTTNPVATEQYGCVCSTGNPQNFGSNQM

SEQ ID NO: 80418 - protein, 29 aa, Artificial Sequence
  Description of Artificial Sequence: Synthetic peptide
YENEIATVNPVCTEQYGTVSDNLQQSGNH

SEQ ID NO: 80419 - protein, 32 aa, Artificial Sequence
  Description of Artificial Sequence: Synthetic polypeptide
DEEEIRTTNPVATEQYGSVVETYHNQEGEPGD

SEQ ID NO: 80420 - protein, 33 aa, Artificial Sequence
  Description of Artificial Sequence: Synthetic polypeptide
AEEEIRTTNPVATEQYGSVSTVNDNQQNANTED

SEQ ID NO: 80421 - protein, 28 aa, Artificial Sequence
  Description of Artificial Sequence: Synthetic peptide
YENEIATVNPVCTECYGVVSENLQSGNQ

SEQ ID NO: 80422 - protein, 34 aa, Artificial Sequence
  Description of Artificial Sequence: Synthetic polypeptide
DEEEIRTTNPVATEQYGSVSYTQNNDQHTGFSLF

SEQ ID NO: 80423 - protein, 32 aa, Artificial Sequence
  Description of Artificial Sequence: Synthetic polypeptide
SEEEIRCTNPIATEGYGQSVSEMNLSDRGNDR

SEQ ID NO: 80424 - protein, 29 aa, Artificial Sequence
  Description of Artificial Sequence: Synthetic peptide
DEEEIRTTNPVCTEPYGVISMEDIQSGNQ

SEQ ID NO: 80425 - protein, 32 aa, Artificial Sequence
  Description of Artificial Sequence: Synthetic polypeptide
AEEEIRTTNPVATEQYGSVSTVNFENGEGGGG

SEQ ID NO: 80426 - protein, 34 aa, Artificial Sequence
  Description of Artificial Sequence: Synthetic polypeptide
AEEEIRTTNPVATEQYGSVSTVNGEQGNEGGNGN

SEQ ID NO: 80427 - protein, 32 aa, Artificial Sequence
  Description of Artificial Sequence: Synthetic polypeptide
DEEEIRTTNPVATEQYGQVSTMDNQNEGGGEI

SEQ ID NO: 80428 - protein, 34 aa, Artificial Sequence
  Description of Artificial Sequence: Synthetic polypeptide
AEEEIRTTNPVATEQYGSVSTVNGEQGTNGENDE

SEQ ID NO: 80429 - protein, 32 aa, Artificial Sequence
  Description of Artificial Sequence: Synthetic polypeptide
DEEEIRTTNPVATEQYGSVWICNLDDAEDPRQ

SEQ ID NO: 80430 - protein, 33 aa, Artificial Sequence
  Description of Artificial Sequence: Synthetic polypeptide
DEEEIRTTNPVATEGYGQCVCFTNLTRFGSNQS

SEQ ID NO: 80431 - protein, 33 aa, Artificial Sequence
  Description of Artificial Sequence: Synthetic polypeptide
DEEEIRTTNPVATECYGMSSTGNGEQRNQGNEF

SEQ ID NO: 80432 - protein, 33 aa, Artificial Sequence
  Description of Artificial Sequence: Synthetic polypeptide
YEEEIRTTNPVATEPYGCAVSNSNLTQRNGNHN

SEQ ID NO: 80433 - protein, 30 aa, Artificial Sequence
  Description of Artificial Sequence: Synthetic polypeptide
DENEIRCTNPVATECWGEVSCINEQREGGR

SEQ ID NO: 80434 - protein, 33 aa, Artificial Sequence
  Description of Artificial Sequence: Synthetic polypeptide
DEEEIRTTNPVATEQWGSVCNTFNREGQGGDTR

SEQ ID NO: 80435 - protein, 35 aa, Artificial Sequence
  Description of Artificial Sequence: Synthetic polypeptide
DEEEIRTTNPVAYEQYGCAVVSCTNLSQNRGGNLS

SEQ ID NO: 80436 - protein, 34 aa, Artificial Sequence
  Description of Artificial Sequence: Synthetic polypeptide
DEEEIRTTNPVATEQYGQVSTMTGLQGEGGENGF

SEQ ID NO: 80437 - protein, 29 aa, Artificial Sequence
  Description of Artificial Sequence: Synthetic peptide
YEEEIASVNPVCTEQYGVVSMDNLQSGNQ

SEQ ID NO: 80438 - protein, 35 aa, Artificial Sequence
  Description of Artificial Sequence: Synthetic polypeptide
DEEEIRTTNPVAYEQYGCKVPSCTNELVQRGGNLS

SEQ ID NO: 80439 - protein, 33 aa, Artificial Sequence
  Description of Artificial Sequence: Synthetic polypeptide
AEEEIRTTNPVATEQYGSVSTVLQQQQNTNNND

SEQ ID NO: 80440 - protein, 30 aa, Artificial Sequence
  Description of Artificial Sequence: Synthetic polypeptide
SEEEIRCTNPIATEPYGSISEENLMRNGNH

SEQ ID NO: 80441 - protein, 30 aa, Artificial Sequence
  Description of Artificial Sequence: Synthetic polypeptide
DENEIRCTNPIATEPYGSISEDLQMRNGNH

SEQ ID NO: 80442 - protein, 35 aa, Artificial Sequence
  Description of Artificial Sequence: Synthetic polypeptide
DEEEIRTTNPVAYEQYGCKVSTDNELSQRGGNNES

SEQ ID NO: 80443 - protein, 33 aa, Artificial Sequence
  Description of Artificial Sequence: Synthetic polypeptide
DEEEIRTTNPVAYEQYGCNISCTNLSQHGGNAS

SEQ ID NO: 80444 - protein, 30 aa, Artificial Sequence
  Description of Artificial Sequence: Synthetic polypeptide
DEEEIRTTNPVATECYGKHSVNEDQTTDNF

SEQ ID NO: 80445 - protein, 33 aa, Artificial Sequence
  Description of Artificial Sequence: Synthetic polypeptide
AEEEIRTTNPVATEQYGSVSTVLQQQQATNNNE

SEQ ID NO: 80446 - protein, 29 aa, Artificial Sequence
  Description of Artificial Sequence: Synthetic peptide
YENEIATVNPVSTEQYGTVSDNLQQSGNH

SEQ ID NO: 80447 - protein, 33 aa, Artificial Sequence
  Description of Artificial Sequence: Synthetic polypeptide
DEEEIRTTNPVAYEQYGCNVSCTNLSDHGGNLI

SEQ ID NO: 80448 - protein, 33 aa, Artificial Sequence
  Description of Artificial Sequence: Synthetic polypeptide
DEEEIRTTNPVAYEQYGCNVSCTPLSQHGGNLA

SEQ ID NO: 80449 - protein, 30 aa, Artificial Sequence
  Description of Artificial Sequence: Synthetic polypeptide
DENEIRCTNPIATEPYGSISMDLQMRNGNH

SEQ ID NO: 80450 - protein, 28 aa, Artificial Sequence
  Description of Artificial Sequence: Synthetic peptide
YENEIATVNPVCTEQYGVVSDILQSGNQ

SEQ ID NO: 80451 - protein, 29 aa, Artificial Sequence
  Description of Artificial Sequence: Synthetic peptide
YEEEIASVNPVCTEQYGVVSMDNLQYGNQ

SEQ ID NO: 80452 - protein, 30 aa, Artificial Sequence
  Description of Artificial Sequence: Synthetic polypeptide
DDSEVRCTNPVATEQYGSVAAETLMRVGNR

SEQ ID NO: 80453 - protein, 30 aa, Artificial Sequence
  Description of Artificial Sequence: Synthetic polypeptide
DENEIRCTNPIATEPYGSISMDLQQRNGNH

SEQ ID NO: 80454 - protein, 32 aa, Artificial Sequence
  Description of Artificial Sequence: Synthetic polypeptide
DEEEISTTNPVATEQYGCVCSTGPHQHFGSNQ

SEQ ID NO: 80455 - protein, 32 aa, Artificial Sequence
  Description of Artificial Sequence: Synthetic polypeptide
DEEEIRTTNPVATECYGMSSTDDEQRNQGNGF

SEQ ID NO: 80456 - protein, 32 aa, Artificial Sequence
  Description of Artificial Sequence: Synthetic polypeptide
DEEEIRTTNPVATEQWGSVCSTEHQNFGSDQS

SEQ ID NO: 80457 - protein, 33 aa, Artificial Sequence
  Description of Artificial Sequence: Synthetic polypeptide
DEEEIRTTNPVATEQWGSVLAINLFQEMPDNGR

SEQ ID NO: 80458 - protein, 32 aa, Artificial Sequence
  Description of Artificial Sequence: Synthetic polypeptide
SEEEIRCTNPIATEQWGSVSEINLQDREGENG

SEQ ID NO: 80459 - protein, 33 aa, Artificial Sequence
  Description of Artificial Sequence: Synthetic polypeptide
DEEEIRTTNPVATECYGDVSSTPALPQMRGEPV

SEQ ID NO: 80460 - protein, 29 aa, Artificial Sequence
  Description of Artificial Sequence: Synthetic peptide
YEEEIASVNPVCTEQYGVVSIDNLQSGNE

SEQ ID NO: 80461 - protein, 33 aa, Artificial Sequence
  Description of Artificial Sequence: Synthetic polypeptide
REEEIRTTNPVATEQYGMVVPSTNLETLGQFRY

SEQ ID NO: 80462 - protein, 32 aa, Artificial Sequence
  Description of Artificial Sequence: Synthetic polypeptide
DEEEIRTTNPVATEQWGSVSEGPPDGTGGNPR

SEQ ID NO: 80463 - protein, 33 aa, Artificial Sequence
  Description of Artificial Sequence: Synthetic polypeptide
DEAEIRTTNPVATEQYGQSVCSTNHQNFGSEQL

SEQ ID NO: 80464 - protein, 33 aa, Artificial Sequence
  Description of Artificial Sequence: Synthetic polypeptide
DEEEIRTTNPVSTETYGSVSLVNEQRTGVNTSI

SEQ ID NO: 80465 - protein, 33 aa, Artificial Sequence
  Description of Artificial Sequence: Synthetic polypeptide
DEEEIRTTNPVAYEQYGQSVSQNDLLTPRGQIM

SEQ ID NO: 80466 - protein, 32 aa, Artificial Sequence
  Description of Artificial Sequence: Synthetic polypeptide
DEEEIRTTNPVATEPYGSVSMEDIPNMRNGNH

SEQ ID NO: 80467 - protein, 33 aa, Artificial Sequence
  Description of Artificial Sequence: Synthetic polypeptide
DEEEISTTNPVATEQYGCVCSTMNLQNFGSDQT

SEQ ID NO: 80468 - protein, 32 aa, Artificial Sequence
  Description of Artificial Sequence: Synthetic polypeptide
DEEEIRTTNPVCTEHYGSVCSWPNHQNGSNLS

SEQ ID NO: 80469 - protein, 31 aa, Artificial Sequence
  Description of Artificial Sequence: Synthetic polypeptide
SEEEIRCTNPIATEQYGCVCSTWNLANFGNQ

SEQ ID NO: 80470 - protein, 28 aa, Artificial Sequence
  Description of Artificial Sequence: Synthetic peptide
YEEEIASVNPVCTEQYGVVSENEQSGNQ

SEQ ID NO: 80471 - protein, 33 aa, Artificial Sequence
  Description of Artificial Sequence: Synthetic polypeptide
DEEEIRTTNPVCTEHYGSVCSWPNLQEGFGSNL

SEQ ID NO: 80472 - protein, 34 aa, Artificial Sequence
  Description of Artificial Sequence: Synthetic polypeptide
DEEEIRCTNPVAYEQYGSVPFCTNAPSQRNGTNR

SEQ ID NO: 80473 - protein, 28 aa, Artificial Sequence
  Description of Artificial Sequence: Synthetic peptide
YEEEIASVNPVCTEQYGVVSENLQHENL

SEQ ID NO: 80474 - protein, 28 aa, Artificial Sequence
  Description of Artificial Sequence: Synthetic peptide
YEEEIASVNPVCTEQYGVVSENLQHENQ

SEQ ID NO: 80475 - protein, 29 aa, Artificial Sequence
  Description of Artificial Sequence: Synthetic peptide
SEEEIRCTNPIATEQYGCVCSSNHAYGNQ

SEQ ID NO: 80476 - protein, 30 aa, Artificial Sequence
  Description of Artificial Sequence: Synthetic polypeptide
DEEEIRTTNPVATECYGAAHGTNEQPINFV

SEQ ID NO: 80477 - protein, 32 aa, Artificial Sequence
  Description of Artificial Sequence: Synthetic polypeptide
ADEEIRTTNPVATEQYGCVCSTELQNFGSNQA

SEQ ID NO: 80478 - protein, 31 aa, Artificial Sequence
  Description of Artificial Sequence: Synthetic polypeptide
SEEEIRCTNPIATEQYGCVCSGENDMREGNR

SEQ ID NO: 80479 - protein, 30 aa, Artificial Sequence
  Description of Artificial Sequence: Synthetic polypeptide
DEEEIRTTNPVAYEQWGVVWTELQHEDTSR

SEQ ID NO: 80480 - protein, 32 aa, Artificial Sequence
  Description of Artificial Sequence: Synthetic polypeptide
ADEEIRTTNPVATEQYGCVCSTELQSFGSNQS

SEQ ID NO: 80481 - protein, 33 aa, Artificial Sequence
  Description of Artificial Sequence: Synthetic polypeptide
AEEEIRTTNPVATEQYGSVSTVDQQQQIGEINE

SEQ ID NO: 80482 - protein, 33 aa, Artificial Sequence
  Description of Artificial Sequence: Synthetic polypeptide
REEEIRTTNPVATEQYGMAVVPSLTNLEELGQR

SEQ ID NO: 80483 - protein, 29 aa, Artificial Sequence
  Description of Artificial Sequence: Synthetic peptide
YENEIRTTNPVCTEQYGVVSEILQSAENA

SEQ ID NO: 80484 - protein, 34 aa, Artificial Sequence
  Description of Artificial Sequence: Synthetic polypeptide
AEEEIRTTNPVATEQYGSVSTVTNLNSNQGNNAE

SEQ ID NO: 80485 - protein, 33 aa, Artificial Sequence
  Description of Artificial Sequence: Synthetic polypeptide
YEEEIRTTNPVCTEQYGSVSSDPNLNMRNGMNV

SEQ ID NO: 80486 - protein, 31 aa, Artificial Sequence
  Description of Artificial Sequence: Synthetic polypeptide
DEAEIRTTNGVAYCQYGCVSTNLQNSGSDRM

SEQ ID NO: 80487 - protein, 31 aa, Artificial Sequence
  Description of Artificial Sequence: Synthetic polypeptide
SEEEIRCTNPIATEQYGCVCSWNLTRFGGNQ

SEQ ID NO: 80488 - protein, 30 aa, Artificial Sequence
  Description of Artificial Sequence: Synthetic polypeptide
SEEEIRCTNPIATEQYGCVCSWNLMRGSDV

SEQ ID NO: 80489 - protein, 33 aa, Artificial Sequence
  Description of Artificial Sequence: Synthetic polypeptide
DEEEIRTTNPVATEQYGSVWTNPLMFESNSQEK

SEQ ID NO: 80490 - protein, 31 aa, Artificial Sequence
  Description of Artificial Sequence: Synthetic polypeptide
DEAEIRTTNGVAYCQYGSVCSTNLQGSGSDA

SEQ ID NO: 80491 - protein, 31 aa, Artificial Sequence
  Description of Artificial Sequence: Synthetic polypeptide
SEEEIRCTNPIATEQYGCVCSWNLARFGNAS

SEQ ID NO: 80492 - protein, 31 aa, Artificial Sequence
  Description of Artificial Sequence: Synthetic polypeptide
DEAEIRTTNGVAYCQYGSVCSTYLQRGGQDE

SEQ ID NO: 80493 - protein, 34 aa, Artificial Sequence
  Description of Artificial Sequence: Synthetic polypeptide
YEEEIRTTNPVATEQYGAVALITNDPQCRGNDRY

SEQ ID NO: 80494 - protein, 30 aa, Artificial Sequence
  Description of Artificial Sequence: Synthetic polypeptide
SEEEIRCTNPIATEQYGCVCSWNLAHGNQN

SEQ ID NO: 80495 - protein, 31 aa, Artificial Sequence
  Description of Artificial Sequence: Synthetic polypeptide
REEEIRTTNPVATEQYGAVVPSTNLETLLQG

SEQ ID NO: 80496 - protein, 31 aa, Artificial Sequence
  Description of Artificial Sequence: Synthetic polypeptide
YENEIRTTNPVATEQYGQVSTLTNTRFGTRN

SEQ ID NO: 80497 - protein, 31 aa, Artificial Sequence
  Description of Artificial Sequence: Synthetic polypeptide
DENEIRTTNPVATEQYGSVLPTDEGERGSQQ

SEQ ID NO: 80498 - protein, 31 aa, Artificial Sequence
  Description of Artificial Sequence: Synthetic polypeptide
DEAEIRTTNGVAYCQYGSVSSNTHLQRGIDE

SEQ ID NO: 80499 - protein, 32 aa, Artificial Sequence
  Description of Artificial Sequence: Synthetic polypeptide
DEEEIRTTNPVATEQYGSVWTNHEDRPEDSID

SEQ ID NO: 80500 - protein, 32 aa, Artificial Sequence
  Description of Artificial Sequence: Synthetic polypeptide
REEEIRTTNPVATEQYGAVVPSWNLEELGQFR

SEQ ID NO: 80501 - protein, 32 aa, Artificial Sequence
  Description of Artificial Sequence: Synthetic polypeptide
REEEIRTTNPVATEQYGAVVPSYNLETLGQLR

SEQ ID NO: 80502 - protein, 32 aa, Artificial Sequence
  Description of Artificial Sequence: Synthetic polypeptide
REEEIRTTNPVATEQYGAVVPSYTNLETLGQF

SEQ ID NO: 80503 - protein, 32 aa, Artificial Sequence
  Description of Artificial Sequence: Synthetic polypeptide
DEAEIRTTNGVAYCQYGSVSSNTWLQRGIDRE

SEQ ID NO: 80504 - protein, 28 aa, Artificial Sequence
  Description of Artificial Sequence: Synthetic peptide
YEEEIASVNPVCTEQYGVVSECLQHGNQ

SEQ ID NO: 80505 - protein, 28 aa, Artificial Sequence
  Description of Artificial Sequence: Synthetic peptide
DEAEIRTTNGVAYCQYGSVSTDLVKCEQ

SEQ ID NO: 80506 - protein, 33 aa, Artificial Sequence
  Description of Artificial Sequence: Synthetic polypeptide
DEEEISTTNPVATEQYGCVCSTNDHQNFGSNQG

SEQ ID NO: 80507 - protein, 34 aa, Artificial Sequence
  Description of Artificial Sequence: Synthetic polypeptide
AEEEIRTTNPVATEQYGSVSTVTNLNSNQGTNGE

SEQ ID NO: 80508 - protein, 32 aa, Artificial Sequence
  Description of Artificial Sequence: Synthetic polypeptide
YEEEIRTTNPVATEQYGSVSTLTGNTRIGTHN

SEQ ID NO: 80509 - protein, 29 aa, Artificial Sequence
  Description of Artificial Sequence: Synthetic peptide
DEAEIRTTNGVAYHQYGSVSTNLVAFEQI

SEQ ID NO: 80510 - protein, 33 aa, Artificial Sequence
  Description of Artificial Sequence: Synthetic polypeptide
DEEEIRTTNPVATEQYGSVWTENDMTIGSVQNM

SEQ ID NO: 80511 - protein, 30 aa, Artificial Sequence
  Description of Artificial Sequence: Synthetic polypeptide
SEEEIRCTNPIATEQYGAVSSMNGMRPNDR

SEQ ID NO: 80512 - protein, 34 aa, Artificial Sequence
  Description of Artificial Sequence: Synthetic polypeptide
YEEEIRTTNPVATEQWGCAVSNSNLTQERNGNRN

SEQ ID NO: 80513 - protein, 32 aa, Artificial Sequence
  Description of Artificial Sequence: Synthetic polypeptide
DEEEIRTTNPVSTETYGSVSMVNELQTEVNEE

SEQ ID NO: 80514 - protein, 34 aa, Artificial Sequence
  Description of Artificial Sequence: Synthetic polypeptide
DENEIRTTNPVATEQYGSVCSPTNLERAGSDLIE

SEQ ID NO: 80515 - protein, 29 aa, Artificial Sequence
  Description of Artificial Sequence: Synthetic peptide
YEEEIASVNPVCTEQYGVVSFNLQSGNQF

SEQ ID NO: 80516 - protein, 33 aa, Artificial Sequence
  Description of Artificial Sequence: Synthetic polypeptide
DEEEIRTTNPVATEQYGSCITVNELEVRGDIFS

SEQ ID NO: 80517 - protein, 30 aa, Artificial Sequence
  Description of Artificial Sequence: Synthetic polypeptide
YENEIRTTNPVATEQYGAICSTFLERQGQA

SEQ ID NO: 80518 - protein, 28 aa, Artificial Sequence
  Description of Artificial Sequence: Synthetic peptide
YEEEIASVNPVCTEQYGVVSFNQQSGNQ

SEQ ID NO: 80519 - protein, 32 aa, Artificial Sequence
  Description of Artificial Sequence: Synthetic polypeptide
SEEEIRCTNPIATEQWGSVSGENDDMQRGGNR

SEQ ID NO: 80520 - protein, 30 aa, Artificial Sequence
  Description of Artificial Sequence: Synthetic polypeptide
DENEIATVNPVATEQYGDVSEILQNSAGNQ

SEQ ID NO: 80521 - protein, 29 aa, Artificial Sequence
  Description of Artificial Sequence: Synthetic peptide
DENEIATVNPVATEQYGDVSENLMNAGDA

SEQ ID NO: 80522 - protein, 32 aa, Artificial Sequence
  Description of Artificial Sequence: Synthetic polypeptide
YENEIRTTNPVATEQYGAIVSTFLERQGQQSR

SEQ ID NO: 80523 - protein, 31 aa, Artificial Sequence
  Description of Artificial Sequence: Synthetic polypeptide
SEEEIRCTNPIATEQWGSVSGEGNDDMRGNR

SEQ ID NO: 80524 - protein, 32 aa, Artificial Sequence
  Description of Artificial Sequence: Synthetic polypeptide
DEAEIRTTNPCATEHYGSVSTNLNGNDGQNED

SEQ ID NO: 80525 - protein, 34 aa, Artificial Sequence
  Description of Artificial Sequence: Synthetic polypeptide
DEEEIRTTNPVATEPYGSVCFGTNQEHNRGGNVR

SEQ ID NO: 80526 - protein, 31 aa, Artificial Sequence
  Description of Artificial Sequence: Synthetic polypeptide
DEAEIRTTNPCATEQWGAVSTGNSQGGDNGS

SEQ ID NO: 80527 - protein, 28 aa, Artificial Sequence
  Description of Artificial Sequence: Synthetic peptide
YEEEIASVNPVCTEQYGVVSGNLQSGIQ

SEQ ID NO: 80528 - protein, 28 aa, Artificial Sequence
  Description of Artificial Sequence: Synthetic peptide
DENEIATVNPVCTEQYGVVSEIEQSGNQ

SEQ ID NO: 80529 - protein, 28 aa, Artificial Sequence
  Description of Artificial Sequence: Synthetic peptide
YEEEIASVNPVCTEQYGVVSGNLQSGKQ

SEQ ID NO: 80530 - protein, 34 aa, Artificial Sequence
  Description of Artificial Sequence: Synthetic polypeptide
DEEEIRTTNPVAYEQYGAVVDQTNDLLQRGIRNE

SEQ ID NO: 80531 - protein, 29 aa, Artificial Sequence
  Description of Artificial Sequence: Synthetic peptide
DENEIATVNPVCTEQYGVVSMNIQQQGNH

SEQ ID NO: 80532 - protein, 33 aa, Artificial Sequence
  Description of Artificial Sequence: Synthetic polypeptide
AEEEIRTTNPVATEQYGSVSTVGNNQGNENTDE

SEQ ID NO: 80533 - protein, 33 aa, Artificial Sequence
  Description of Artificial Sequence: Synthetic polypeptide
DEEEISTTNPVATEQYGCVCSTGVHQRFGSNQA

SEQ ID NO: 80534 - protein, 29 aa, Artificial Sequence
  Description of Artificial Sequence: Synthetic peptide
YEEEIASVNPVCTEQYGVVSGDNLQSGNQ

SEQ ID NO: 80535 - protein, 28 aa, Artificial Sequence
  Description of Artificial Sequence: Synthetic peptide
YENEIATVNPVCTECYGVVSDNLQSGNQ

SEQ ID NO: 80536 - protein, 30 aa, Artificial Sequence
  Description of Artificial Sequence: Synthetic polypeptide
SEEEIRCTNPIATEQWGSVSGENDMHQGNR

SEQ ID NO: 80537 - protein, 32 aa, Artificial Sequence
  Description of Artificial Sequence: Synthetic polypeptide
YEEEIRTTNPVATEQYGSVSTLTNTRFGGTCN

SEQ ID NO: 80538 - protein, 34 aa, Artificial Sequence
  Description of Artificial Sequence: Synthetic polypeptide
DEEEIRTTNPVAYEQWGYSNVSYTNELQDRPGGF

SEQ ID NO: 80539 - protein, 31 aa, Artificial Sequence
  Description of Artificial Sequence: Synthetic polypeptide
SEEEIRCTNPIATEQYGATVWSENLMERGPR

SEQ ID NO: 80540 - protein, 31 aa, Artificial Sequence
  Description of Artificial Sequence: Synthetic polypeptide
DEEEIRTTNPVATEQYGSVWTDSEDRTESQE

SEQ ID NO: 80541 - protein, 28 aa, Artificial Sequence
  Description of Artificial Sequence: Synthetic peptide
YEEEIASVNPVCTEQYGVVSENLQSENQ

SEQ ID NO: 80542 - protein, 34 aa, Artificial Sequence
  Description of Artificial Sequence: Synthetic polypeptide
AEEEIRTTNPVATEQYGSVSTVENLQQNNINNTD

SEQ ID NO: 80543 - protein, 32 aa, Artificial Sequence
  Description of Artificial Sequence: Synthetic polypeptide
DEEEIRTTNPVATEQYGSVWTDDMTQMEGEEY

SEQ ID NO: 80544 - protein, 35 aa, Artificial Sequence
  Description of Artificial Sequence: Synthetic polypeptide
DENEIRTTNPVATEQYGSVCSTNNLPQERSLEDDR

SEQ ID NO: 80545 - protein, 34 aa, Artificial Sequence
  Description of Artificial Sequence: Synthetic polypeptide
DENEIRTTNPVATEQYGSVCSTLVLQFEIGQQNE

SEQ ID NO: 80546 - protein, 32 aa, Artificial Sequence
  Description of Artificial Sequence: Synthetic polypeptide
DEEEIRTTNPVAYEQWGYTISPNELQDDDGNR

SEQ ID NO: 80547 - protein, 30 aa, Artificial Sequence
  Description of Artificial Sequence: Synthetic polypeptide
SEEEIRCTNPIATEQYGAASEMNAMRGNDR

SEQ ID NO: 80548 - protein, 29 aa, Artificial Sequence
  Description of Artificial Sequence: Synthetic peptide
YEEEIASVNPVCTEQYGVVSFDNLQSGNQ

SEQ ID NO: 80549 - protein, 28 aa, Artificial Sequence
  Description of Artificial Sequence: Synthetic peptide
YEEEIASVNPVCTEQYGVVSEVLQSGNQ

SEQ ID NO: 80550 - protein, 30 aa, Artificial Sequence
  Description of Artificial Sequence: Synthetic polypeptide
DENEIATTNPVSTEPYGTVSMNIQQQNGNR

SEQ ID NO: 80551 - protein, 31 aa, Artificial Sequence
  Description of Artificial Sequence: Synthetic polypeptide
YENEIRTTNPVATEQYGICGSTIELQRSERF

SEQ ID NO: 80552 - protein, 30 aa, Artificial Sequence
  Description of Artificial Sequence: Synthetic polypeptide
SEEEIRCTNPIATEQWGSVWGENDHRGTNR

SEQ ID NO: 80553 - protein, 33 aa, Artificial Sequence
  Description of Artificial Sequence: Synthetic polypeptide
DEAEIRTTNPCATECYGSVSTNPGLQDLGGNQS

SEQ ID NO: 80554 - protein, 33 aa, Artificial Sequence
  Description of Artificial Sequence: Synthetic polypeptide
DEEEISTTNPVATEQYGCVCSTMELQSFGSNQN

SEQ ID NO: 80555 - protein, 30 aa, Artificial Sequence
  Description of Artificial Sequence: Synthetic polypeptide
SEEEIRCTNPIATEQWGSVTWGENDMRGNR

SEQ ID NO: 80556 - protein, 35 aa, Artificial Sequence
  Description of Artificial Sequence: Synthetic polypeptide
AEEEIRTTNPVATEQYGSVSTVGNLQQGENGTEEE

SEQ ID NO: 80557 - protein, 32 aa, Artificial Sequence
  Description of Artificial Sequence: Synthetic polypeptide
DEAEIRTTNPCATECYGSVSTSNGNSGQGNER

SEQ ID NO: 80558 - protein, 30 aa, Artificial Sequence
  Description of Artificial Sequence: Synthetic polypeptide
SEEEIRCTNPIATEQWGSVSGENDMRAGAR

SEQ ID NO: 80559 - protein, 31 aa, Artificial Sequence
  Description of Artificial Sequence: Synthetic polypeptide
SEEEIRCTNPIATEQWGSVSGENDMMRGANR

SEQ ID NO: 80560 - protein, 34 aa, Artificial Sequence
  Description of Artificial Sequence: Synthetic polypeptide
DEAEIRTTNPCATECYGSVSTNPGLQDLGGGNTR

SEQ ID NO: 80561 - protein, 29 aa, Artificial Sequence
  Description of Artificial Sequence: Synthetic peptide
DENEIRTTNPVATEQYGDVSEIEMNAENA

SEQ ID NO: 80562 - protein, 31 aa, Artificial Sequence
  Description of Artificial Sequence: Synthetic polypeptide
DENEIRCTNPVATECWGSASCNEQDREGENR

SEQ ID NO: 80563 - protein, 33 aa, Artificial Sequence
  Description of Artificial Sequence: Synthetic polypeptide
DEEEIRTTNPVATEQYGSCISEPNEIQEQEANR

SEQ ID NO: 80564 - protein, 32 aa, Artificial Sequence
  Description of Artificial Sequence: Synthetic polypeptide
DEEEIRTTNPVATEQYGSVTATLGRQLETERQ

SEQ ID NO: 80565 - protein, 29 aa, Artificial Sequence
  Description of Artificial Sequence: Synthetic peptide
YEEEIASVNPVCTEQYGVVSSVNLQSGNQ

SEQ ID NO: 80566 - protein, 30 aa, Artificial Sequence
  Description of Artificial Sequence: Synthetic polypeptide
SAEEIATTNPVATAQWGSVSTGLQDDGNEM

SEQ ID NO: 80567 - protein, 33 aa, Artificial Sequence
  Description of Artificial Sequence: Synthetic polypeptide
DEEEIRTTNPVATEGYGMVSTNNIGNQEGGGNI

SEQ ID NO: 80568 - protein, 30 aa, Artificial Sequence
  Description of Artificial Sequence: Synthetic polypeptide
SAEEIATTNPVATAQWGSVSTGLQDGNGDV

SEQ ID NO: 80569 - protein, 30 aa, Artificial Sequence
  Description of Artificial Sequence: Synthetic polypeptide
DEEEIRCTNPVATEQYGSVSEILMNAAEDA

SEQ ID NO: 80570 - protein, 32 aa, Artificial Sequence
  Description of Artificial Sequence: Synthetic polypeptide
SEEEIRCTNPCATEQYGVSVNSENLERGSNQE

SEQ ID NO: 80571 - protein, 30 aa, Artificial Sequence
  Description of Artificial Sequence: Synthetic polypeptide
YEEEIASVNPVCTEQYGVVSTDNLQMSGNQ

SEQ ID NO: 80572 - protein, 34 aa, Artificial Sequence
  Description of Artificial Sequence: Synthetic polypeptide
DENEIRTTNPVATEQYGSISLTFNETLEREGLRG

SEQ ID NO: 80573 - protein, 33 aa, Artificial Sequence
  Description of Artificial Sequence: Synthetic polypeptide
DEEEIRTTNPVATEGYGMVSTGNNGEQTGGNGT

SEQ ID NO: 80574 - protein, 33 aa, Artificial Sequence
  Description of Artificial Sequence: Synthetic polypeptide
DEEEIRTTNPVATEQYGSCFVTNWLQSSQENVE

SEQ ID NO: 80575 - protein, 29 aa, Artificial Sequence
  Description of Artificial Sequence: Synthetic peptide
YEEEIASVNPVCTEQYGVVSTDNLQSGSQ

SEQ ID NO: 80576 - protein, 32 aa, Artificial Sequence
  Description of Artificial Sequence: Synthetic polypeptide
SEEEIRCTNPCATEQYGSVVSCENHSMRVGNR

SEQ ID NO: 80577 - protein, 29 aa, Artificial Sequence
  Description of Artificial Sequence: Synthetic peptide
YEEEIASVNPVCTEQYGVVSTDNPQSGND

SEQ ID NO: 80578 - protein, 31 aa, Artificial Sequence
  Description of Artificial Sequence: Synthetic polypeptide
SEEEIRCTNPCATEQYGSVVNENSLERENQR

SEQ ID NO: 80579 - protein, 32 aa, Artificial Sequence
  Description of Artificial Sequence: Synthetic polypeptide
DEEEIRTTNPVATEQYGSCFVTNSLESNENVE

SEQ ID NO: 80580 - protein, 33 aa, Artificial Sequence
  Description of Artificial Sequence: Synthetic polypeptide
DEEEISTTNPVATEQYGCVCSTGELQYGSNTDS

SEQ ID NO: 80581 - protein, 29 aa, Artificial Sequence
  Description of Artificial Sequence: Synthetic peptide
YEEEIASVNPVCTEQYGVVSTTNGQSGNQ

SEQ ID NO: 80582 - protein, 29 aa, Artificial Sequence
  Description of Artificial Sequence: Synthetic peptide
YEEEIASVNPVCTEQYGVVSVDNLQSGNQ

SEQ ID NO: 80583 - protein, 31 aa, Artificial Sequence
  Description of Artificial Sequence: Synthetic polypeptide
YEEEIRTTNPVATEQYGSYSTLTNTRFGTDN

SEQ ID NO: 80584 - protein, 28 aa, Artificial Sequence
  Description of Artificial Sequence: Synthetic peptide
YENEIASVNPVATEQYGVASDNLQSGNQ

SEQ ID NO: 80585 - protein, 33 aa, Artificial Sequence
  Description of Artificial Sequence: Synthetic polypeptide
DENEIRTTNPVATEQYGSISLTFNETNREGLFR

SEQ ID NO: 80586 - protein, 33 aa, Artificial Sequence
  Description of Artificial Sequence: Synthetic polypeptide
DEEEIRTTNPVCYEPYGSVSQANLSQRTGGNNL

SEQ ID NO: 80587 - protein, 34 aa, Artificial Sequence
  Description of Artificial Sequence: Synthetic polypeptide
DEEEIRTTNPVATEQYGSVSYYDNLFQEQVGEVS

SEQ ID NO: 80588 - protein, 32 aa, Artificial Sequence
  Description of Artificial Sequence: Synthetic polypeptide
DEEEIRTTNPVATECYGSVSECGPNMRGMNPV

SEQ ID NO: 80589 - protein, 31 aa, Artificial Sequence
  Description of Artificial Sequence: Synthetic polypeptide
DENEIRCTNPVATEQYGEASEINLQDREGGG

SEQ ID NO: 80590 - protein, 35 aa, Artificial Sequence
  Description of Artificial Sequence: Synthetic polypeptide
AEEEIRTTNPVATEQYGSVSTVNLNDNQQGTNTTE

SEQ ID NO: 80591 - protein, 33 aa, Artificial Sequence
  Description of Artificial Sequence: Synthetic polypeptide
DEEEIRTTNPVATECYGSVSCINEPNMREGENG

SEQ ID NO: 80592 - protein, 29 aa, Artificial Sequence
  Description of Artificial Sequence: Synthetic peptide
DENEIRCTNPVATEQYGEVSEIEQNREGA

SEQ ID NO: 80593 - protein, 33 aa, Artificial Sequence
  Description of Artificial Sequence: Synthetic polypeptide
DEEEIRTTNPVATECYGSVSCINGPNMREGENG

SEQ ID NO: 80594 - protein, 33 aa, Artificial Sequence
  Description of Artificial Sequence: Synthetic polypeptide
DEEEIRTTNPVATEPYGSVSTEAGPNMRNGMNH

SEQ ID NO: 80595 - protein, 33 aa, Artificial Sequence
  Description of Artificial Sequence: Synthetic polypeptide
DENEIRTTNPVATEQYGSSCSVYDALQRGNEDQ

SEQ ID NO: 80596 - protein, 29 aa, Artificial Sequence
  Description of Artificial Sequence: Synthetic peptide
SAEEIATTNPVATAQWGSVSPNPDDDGNR

SEQ ID NO: 80597 - protein, 28 aa, Artificial Sequence
  Description of Artificial Sequence: Synthetic peptide
DENEIRTTNPVATEQWGDVSEIEMAGDA

SEQ ID NO: 80598 - protein, 34 aa, Artificial Sequence
  Description of Artificial Sequence: Synthetic polypeptide
AEEEIRTTNPVATEQYGSVSTVNLNENNNGTNQQ

SEQ ID NO: 80599 - protein, 31 aa, Artificial Sequence
  Description of Artificial Sequence: Synthetic polypeptide
DEEEIRTTNPVGTEAYGSVNDPNGQEEGGNE

SEQ ID NO: 80600 - protein, 29 aa, Artificial Sequence
  Description of Artificial Sequence: Synthetic peptide
YEEEIASVNPVCTEQYGVVSSNLQSGSNQ

SEQ ID NO: 80601 - protein, 34 aa, Artificial Sequence
  Description of Artificial Sequence: Synthetic polypeptide
DEEEIRTTNPVATECYGSVSCINGPQDRNGMNPG

SEQ ID NO: 80602 - protein, 31 aa, Artificial Sequence
  Description of Artificial Sequence: Synthetic polypeptide
DEEEIRTTNPVATECYGSVSECGPNHGMNPL

SEQ ID NO: 80603 - protein, 28 aa, Artificial Sequence
  Description of Artificial Sequence: Synthetic peptide
DENEIRTTNPVATEQWGDVSEIEMAEDR

SEQ ID NO: 80604 - protein, 32 aa, Artificial Sequence
  Description of Artificial Sequence: Synthetic polypeptide
SEEEIACTNPVATEQYGSVATNLQEAEEGTRQ

SEQ ID NO: 80605 - protein, 34 aa, Artificial Sequence
  Description of Artificial Sequence: Synthetic polypeptide
AEEEIRTTNPVATEQYGSVSTVNLNENNQGNNEQ

SEQ ID NO: 80606 - protein, 33 aa, Artificial Sequence
  Description of Artificial Sequence: Synthetic polypeptide
AEEEIRTTNPVATEQYGSVSTVNLNENNQNNQQ

SEQ ID NO: 80607 - protein, 34 aa, Artificial Sequence
  Description of Artificial Sequence: Synthetic polypeptide
AEEEIRTTNPVATEQYGSVSTVNLNIQNNEGTTE

SEQ ID NO: 80608 - protein, 28 aa, Artificial Sequence
  Description of Artificial Sequence: Synthetic peptide
SEEEIRCTNPCSSEQYGIVSCNLMSGTR

SEQ ID NO: 80609 - protein, 30 aa, Artificial Sequence
  Description of Artificial Sequence: Synthetic polypeptide
SAEEIATTNPVATAQWGSVSQGNPDRDGNR

SEQ ID NO: 80610 - protein, 31 aa, Artificial Sequence
  Description of Artificial Sequence: Synthetic polypeptide
DEEEIRTTNPVATECYGSVSECGPNHGMNPV

SEQ ID NO: 80611 - protein, 34 aa, Artificial Sequence
  Description of Artificial Sequence: Synthetic polypeptide
DEEEIRTTNPVATEQYGSVVGGTNNDIQTEGGNE

SEQ ID NO: 80612 - protein, 33 aa, Artificial Sequence
  Description of Artificial Sequence: Synthetic polypeptide
DEEEIRTTNPVCYEPYGSVSCVPNLSQRGGGNL

SEQ ID NO: 80613 - protein, 32 aa, Artificial Sequence
  Description of Artificial Sequence: Synthetic polypeptide
DEEEIRTTNPVGTEAYGSVVNDPNEGQERGNE

SEQ ID NO: 80614 - protein, 28 aa, Artificial Sequence
  Description of Artificial Sequence: Synthetic peptide
YENEIASVNPVATEQYGEASENLQSGNQ

SEQ ID NO: 80615 - protein, 28 aa, Artificial Sequence
  Description of Artificial Sequence: Synthetic peptide
YENEIACVNPVATEQYGVASDNLQSGGR

SEQ ID NO: 80616 - protein, 33 aa, Artificial Sequence
  Description of Artificial Sequence: Synthetic polypeptide
DEEEIRGTNPVAFEQYGSVVDTGDLGQRGDRGI

SEQ ID NO: 80617 - protein, 34 aa, Artificial Sequence
  Description of Artificial Sequence: Synthetic polypeptide
YEEEIRTTNPVATEQYGTACFSNSNLTQRNGNRG

SEQ ID NO: 80618 - protein, 34 aa, Artificial Sequence
  Description of Artificial Sequence: Synthetic polypeptide
DEEEIRTTNPVATEQWGQSVVSCTNALSHRPGGM

SEQ ID NO: 80619 - protein, 28 aa, Artificial Sequence
  Description of Artificial Sequence: Synthetic peptide
YENEIACTNPVCTEQYGEASENLQRGGQ

SEQ ID NO: 80620 - protein, 31 aa, Artificial Sequence
  Description of Artificial Sequence: Synthetic polypeptide
DENEIRTTNPVATEQYGSFVPSAEFQDFNEE

SEQ ID NO: 80621 - protein, 30 aa, Artificial Sequence
  Description of Artificial Sequence: Synthetic polypeptide
SEEEIRCTNPCATEQYGSVSNEVLMRENQY

SEQ ID NO: 80622 - protein, 29 aa, Artificial Sequence
  Description of Artificial Sequence: Synthetic peptide
YEEEIASVNPVCTEQYGVVSYDNLQSGNQ

SEQ ID NO: 80623 - protein, 35 aa, Artificial Sequence
  Description of Artificial Sequence: Synthetic polypeptide
DEEEIRTTNPVATECYGSVSSTTINGPQMRNGENG

SEQ ID NO: 80624 - protein, 28 aa, Artificial Sequence
  Description of Artificial Sequence: Synthetic peptide
YENEIACTNPVCTEQYGEASDNLQRGGQ

SEQ ID NO: 80625 - protein, 35 aa, Artificial Sequence
  Description of Artificial Sequence: Synthetic polypeptide
YEEEIRTTNPVATEQYGTAVCSNSNLTQNRNGNRF

SEQ ID NO: 80626 - protein, 33 aa, Artificial Sequence
  Description of Artificial Sequence: Synthetic polypeptide
YEEEIRTTNPVATECYGCVCSAASNSLTQDGNR

SEQ ID NO: 80627 - protein, 29 aa, Artificial Sequence
  Description of Artificial Sequence: Synthetic peptide
DENEIRPTNPVASEQYGIVSCNEQNAGTA

SEQ ID NO: 80628 - protein, 31 aa, Artificial Sequence
  Description of Artificial Sequence: Synthetic polypeptide
SEEEIACTNPVATEQYGSVATNLQEEEDTRE

SEQ ID NO: 80629 - protein, 34 aa, Artificial Sequence
  Description of Artificial Sequence: Synthetic polypeptide
YEEEIRTTNPVATEAYGCVCSATSNSLTQDGDNR

SEQ ID NO: 80630 - protein, 35 aa, Artificial Sequence
  Description of Artificial Sequence: Synthetic polypeptide
DEEEIRTTNPVATEQWGQSQVCSYTNDLQHRFGGQ

SEQ ID NO: 80631 - protein, 28 aa, Artificial Sequence
  Description of Artificial Sequence: Synthetic peptide
YEEEIASVNPVCTEQYGVVVDNLQSGNQ

SEQ ID NO: 80632 - protein, 34 aa, Artificial Sequence
  Description of Artificial Sequence: Synthetic polypeptide
DEEEIRTTNPVATEQWGQSNVSYTNDLQHYSGDF

SEQ ID NO: 80633 - protein, 31 aa, Artificial Sequence
  Description of Artificial Sequence: Synthetic polypeptide
YEMEIATTNPVATEQYGTVSATDNLESEGNQ

SEQ ID NO: 80634 - protein, 33 aa, Artificial Sequence
  Description of Artificial Sequence: Synthetic polypeptide
DEEEIRCTNPVATEQYGSVSDNGQDEGGQNSTG

SEQ ID NO: 80635 - protein, 35 aa, Artificial Sequence
  Description of Artificial Sequence: Synthetic polypeptide
AEEEIRTTNPVATEQYGSVSTVNLNQQQNGNNNNN

SEQ ID NO: 80636 - protein, 33 aa, Artificial Sequence
  Description of Artificial Sequence: Synthetic polypeptide
DEEEISTTNPVATEQYGCVCSTGELQHFGSNND

SEQ ID NO: 80637 - protein, 34 aa, Artificial Sequence
  Description of Artificial Sequence: Synthetic polypeptide
DEEEIRTTNPVATEQWGQSVVSYTNALSTRPGGN

SEQ ID NO: 80638 - protein, 35 aa, Artificial Sequence
  Description of Artificial Sequence: Synthetic polypeptide
DEEEIRTTNPVATEQYGSVTDETNLLEQVDGNDNE

SEQ ID NO: 80639 - protein, 35 aa, Artificial Sequence
  Description of Artificial Sequence: Synthetic polypeptide
DEEEIRTTNPVATEQYGSVTDDTMNLNQNGGNGQE

SEQ ID NO: 80640 - protein, 34 aa, Artificial Sequence
  Description of Artificial Sequence: Synthetic polypeptide
DEEEIRTTNPVATECYGSVSSCINEPQDREGENG

SEQ ID NO: 80641 - protein, 32 aa, Artificial Sequence
  Description of Artificial Sequence: Synthetic polypeptide
DEEEISTTNPVATEQYGCVCSTGELQSNSNQQ

SEQ ID NO: 80642 - protein, 33 aa, Artificial Sequence
  Description of Artificial Sequence: Synthetic polypeptide
DEEEIRTTNPVATEPYGSVSTEDGPNMRNGMNH

SEQ ID NO: 80643 - protein, 35 aa, Artificial Sequence
  Description of Artificial Sequence: Synthetic polypeptide
DEEEIRTTNPVATECYGSVSSTCINEPQDREGMNG

SEQ ID NO: 80644 - protein, 35 aa, Artificial Sequence
  Description of Artificial Sequence: Synthetic polypeptide
DEEEIRTTNPVATECYGSVSSTCINEPQDREGMNV

SEQ ID NO: 80645 - protein, 32 aa, Artificial Sequence
  Description of Artificial Sequence: Synthetic polypeptide
DENEIRGTNPVATEQYGSVMTGLIRGMGEGNE

SEQ ID NO: 80646 - protein, 32 aa, Artificial Sequence
  Description of Artificial Sequence: Synthetic polypeptide
SEEEIRCTNPCATEQYGSVTSNENWLMRENQR

SEQ ID NO: 80647 - protein, 31 aa, Artificial Sequence
  Description of Artificial Sequence: Synthetic polypeptide
DENEIRGTNPVATEQYGSVMTGLIRGMGGGG

SEQ ID NO: 80648 - protein, 34 aa, Artificial Sequence
  Description of Artificial Sequence: Synthetic polypeptide
AEEEIRTTNPVATEQYGSVSTVTNVNQNGEQNQE

SEQ ID NO: 80649 - protein, 32 aa, Artificial Sequence
  Description of Artificial Sequence: Synthetic polypeptide
DENEIRTTNPVATEQYGSISATDIEQHNGNDH

SEQ ID NO: 80650 - protein, 33 aa, Artificial Sequence
  Description of Artificial Sequence: Synthetic polypeptide
DEEEIRTTNPVATECYGSVSNNDEMQGEGNVGG

SEQ ID NO: 80651 - protein, 32 aa, Artificial Sequence
  Description of Artificial Sequence: Synthetic polypeptide
DENEIRGTNPVATEQYGSVMTGLIRGMGNQGQ

SEQ ID NO: 80652 - protein, 28 aa, Artificial Sequence
  Description of Artificial Sequence: Synthetic peptide
YENEIASVNPVATEQYGEASENLQSGGR

SEQ ID NO: 80653 - protein, 31 aa, Artificial Sequence
  Description of Artificial Sequence: Synthetic polypeptide
SEEEIRCTNPCATEQYGSVTNMDLERENQRD

SEQ ID NO: 80654 - protein, 30 aa, Artificial Sequence
  Description of Artificial Sequence: Synthetic polypeptide
SEEEIRCTNPCATEQYGSVTNENLERENQF

SEQ ID NO: 80655 - protein, 33 aa, Artificial Sequence
  Description of Artificial Sequence: Synthetic polypeptide
DEEEISTTNPVATEQYGCVCSTGELQNFGSDNQ

SEQ ID NO: 80656 - protein, 28 aa, Artificial Sequence
  Description of Artificial Sequence: Synthetic peptide
YENEIASVNPVATEQYGEASDNLQSGNQ

SEQ ID NO: 80657 - protein, 34 aa, Artificial Sequence
  Description of Artificial Sequence: Synthetic polypeptide
DEEEIRTTNPVAYEQYGQSVSPQNDALQTGAERW

SEQ ID NO: 80658 - protein, 35 aa, Artificial Sequence
  Description of Artificial Sequence: Synthetic polypeptide
DEEEIRTTNPVATECYGSVSSTEPCLPQRNGMNPV

SEQ ID NO: 80659 - protein, 34 aa, Artificial Sequence
  Description of Artificial Sequence: Synthetic polypeptide
DEEEIRTTNPVATECYGSVSSTINGPNMREGENG

SEQ ID NO: 80660 - protein, 31 aa, Artificial Sequence
  Description of Artificial Sequence: Synthetic polypeptide
DEEEIRTTNPVATEQWGSASEINEQHEGEEG

SEQ ID NO: 80661 - protein, 33 aa, Artificial Sequence
  Description of Artificial Sequence: Synthetic polypeptide
DEEEIRTTNPVATEQWGQYCSPANETQMRGNNR

SEQ ID NO: 80662 - protein, 28 aa, Artificial Sequence
  Description of Artificial Sequence: Synthetic peptide
YEEEIASVNPVCTEQYGVVSWVLQSGNQ

SEQ ID NO: 80663 - protein, 33 aa, Artificial Sequence
  Description of Artificial Sequence: Synthetic polypeptide
DEEEIRTTNPVATECYGSVSCINEPNDREGENG

SEQ ID NO: 80664 - protein, 33 aa, Artificial Sequence
  Description of Artificial Sequence: Synthetic polypeptide
DEEEIRTTNPVATECYGSVSCIAEPQDREGENV

SEQ ID NO: 80665 - protein, 31 aa, Artificial Sequence
  Description of Artificial Sequence: Synthetic polypeptide
DENEIRCTNPVATEQYGEASCINLQDREGGG

SEQ ID NO: 80666 - protein, 34 aa, Artificial Sequence
  Description of Artificial Sequence: Synthetic polypeptide
DEEEISTTNPVATEQYGCVCSTGNLQHFGSNFDS

SEQ ID NO: 80667 - protein, 29 aa, Artificial Sequence
  Description of Artificial Sequence: Synthetic peptide
YEEEIASVNPVCTEQYGVVSPDNLQSGNQ

SEQ ID NO: 80668 - protein, 33 aa, Artificial Sequence
  Description of Artificial Sequence: Synthetic polypeptide
DEEEISTTNPVATEQYGCVCSTGNLQGFGSQQA

SEQ ID NO: 80669 - protein, 32 aa, Artificial Sequence
  Description of Artificial Sequence: Synthetic polypeptide
DEEEIRTTNPVATEQYGSVWELPQMLQEDNEG

SEQ ID NO: 80670 - protein, 33 aa, Artificial Sequence
  Description of Artificial Sequence: Synthetic polypeptide
DEEEISTTNPVATEQYGCVCSTGNLQENFGSDQ

SEQ ID NO: 80671 - protein, 33 aa, Artificial Sequence
  Description of Artificial Sequence: Synthetic polypeptide
DEEEIRTTNPVAYEQYGQSVSQMLDLLQLGQIR

SEQ ID NO: 80672 - protein, 31 aa, Artificial Sequence
  Description of Artificial Sequence: Synthetic polypeptide
SEEEIACTNPVATEQYGSVATNLQAHPGEQP

SEQ ID NO: 80673 - protein, 28 aa, Artificial Sequence
  Description of Artificial Sequence: Synthetic peptide
SEEEIRCTNPIATECWGATAENLMRGNR

SEQ ID NO: 80674 - protein, 29 aa, Artificial Sequence
  Description of Artificial Sequence: Synthetic peptide
YEEEIASVNPVCTEQYGVVSQDNLQSGNQ

SEQ ID NO: 80675 - protein, 31 aa, Artificial Sequence
  Description of Artificial Sequence: Synthetic polypeptide
DEAEIRTTNPCAYEQWGSVSTNSQGNNGGNH

SEQ ID NO: 80676 - protein, 30 aa, Artificial Sequence
  Description of Artificial Sequence: Synthetic polypeptide
YENEIATTNPVATEQYGGIQSTFLERQGQR

SEQ ID NO: 80677 - protein, 29 aa, Artificial Sequence
  Description of Artificial Sequence: Synthetic peptide
SAEEIATTNPVATAQWGSVSGEGLQHGNP

SEQ ID NO: 80678 - protein, 29 aa, Artificial Sequence
  Description of Artificial Sequence: Synthetic peptide
YEEEIASVNPVCTEQYGVVSQNLPQSGNQ

SEQ ID NO: 80679 - protein, 28 aa, Artificial Sequence
  Description of Artificial Sequence: Synthetic peptide
YEEEIASVNPVCTEQYGVVSQNLQSGMQ

SEQ ID NO: 80680 - protein, 31 aa, Artificial Sequence
  Description of Artificial Sequence: Synthetic polypeptide
DEEEIRTTNPVATEQWGSVAANPTQGEPNDS

SEQ ID NO: 80681 - protein, 34 aa, Artificial Sequence
  Description of Artificial Sequence: Synthetic polypeptide
AEEEIRTTNPVATEQYGSVSTVNGNQQDGTNIGT

SEQ ID NO: 80682 - protein, 34 aa, Artificial Sequence
  Description of Artificial Sequence: Synthetic polypeptide
DEEEIRTTNPVATEPYGSVCFFTVLTQRGGQNEV

SEQ ID NO: 80683 - protein, 29 aa, Artificial Sequence
  Description of Artificial Sequence: Synthetic peptide
YEEEIASVNPVCTEQYGVVSQNLQSGNNQ

SEQ ID NO: 80684 - protein, 33 aa, Artificial Sequence
  Description of Artificial Sequence: Synthetic polypeptide
DEEEIRTTNPVATEQYGSVWELMQMLQRDQNEE

SEQ ID NO: 80685 - protein, 30 aa, Artificial Sequence
  Description of Artificial Sequence: Synthetic polypeptide
SAEEIATTNPVATAQWGSVSGNGLQHGNEA

SEQ ID NO: 80686 - protein, 29 aa, Artificial Sequence
  Description of Artificial Sequence: Synthetic peptide
YEEEIASVNPVCTEQYGVVSRDNLQSGNQ

SEQ ID NO: 80687 - protein, 29 aa, Artificial Sequence
  Description of Artificial Sequence: Synthetic peptide
DENEIRCTNPVATEQWGDASENEMRAGGR

SEQ ID NO: 80688 - protein, 32 aa, Artificial Sequence
  Description of Artificial Sequence: Synthetic polypeptide
DEEEIRTTNPVATEQYGSVWELPQMLQRDQEE

SEQ ID NO: 80689 - protein, 33 aa, Artificial Sequence
  Description of Artificial Sequence: Synthetic polypeptide
DEEEIRTTNPVAYEQYGCTCSTNELQNFGSNQS

SEQ ID NO: 80690 - protein, 34 aa, Artificial Sequence
  Description of Artificial Sequence: Synthetic polypeptide
DEEEIRTTNPVATEQWGSVAPTWNDHQEQGMNER

SEQ ID NO: 80691 - protein, 29 aa, Artificial Sequence
  Description of Artificial Sequence: Synthetic peptide
DENEIRCTNPVATEPYGEASMDIQQQGNR

SEQ ID NO: 80692 - protein, 33 aa, Artificial Sequence
  Description of Artificial Sequence: Synthetic polypeptide
DEEEISTTNPVATEQYGCVCSTGNLQSSGSEQP

SEQ ID NO: 80693 - protein, 35 aa, Artificial Sequence
  Description of Artificial Sequence: Synthetic polypeptide
DEEEIRTTNPVATEQYGSVSYTSNALMQNTGSQQD

SEQ ID NO: 80694 - protein, 33 aa, Artificial Sequence
  Description of Artificial Sequence: Synthetic polypeptide
AEEEIRTTNPVATEQYGSVSTVNGNGNDNGNIG

SEQ ID NO: 80695 - protein, 33 aa, Artificial Sequence
  Description of Artificial Sequence: Synthetic polypeptide
DENEIRTTNPVATEQYGSVCSPEDLERQGDERG

SEQ ID NO: 80696 - protein, 32 aa, Artificial Sequence
  Description of Artificial Sequence: Synthetic polypeptide
DEEEIRTTNPVATEQYGQVSTMDGQGEGGGEG

SEQ ID NO: 80697 - protein, 34 aa, Artificial Sequence
  Description of Artificial Sequence: Synthetic polypeptide
DEEEISTTNPVATEQYGCVCSTGNLQRFGSDTDL

SEQ ID NO: 80698 - protein, 34 aa, Artificial Sequence
  Description of Artificial Sequence: Synthetic polypeptide
YEEEIRTTNPVATEHYGCAVSNSNLTQRNGNFRN

SEQ ID NO: 80699 - protein, 34 aa, Artificial Sequence
  Description of Artificial Sequence: Synthetic polypeptide
DEEEIRTTNPVATECYGSVCFTNEDQDQHGGNAR

SEQ ID NO: 80700 - protein, 33 aa, Artificial Sequence
  Description of Artificial Sequence: Synthetic polypeptide
DEEEIRTTNPVATEQYGQVSTGNGNQGNGFTED

SEQ ID NO: 80701 - protein, 29 aa, Artificial Sequence
  Description of Artificial Sequence: Synthetic peptide
SAEEIATTNPVATAQWGSVSGTGLINGNA

SEQ ID NO: 80702 - protein, 30 aa, Artificial Sequence
  Description of Artificial Sequence: Synthetic polypeptide
SEEEIRCTNPIATECYGSVANENWMERGNR

SEQ ID NO: 80703 - protein, 31 aa, Artificial Sequence
  Description of Artificial Sequence: Synthetic polypeptide
SEEEIRCTNPIATECYGSTVSNANWMERGNR

SEQ ID NO: 80704 - protein, 32 aa, Artificial Sequence
  Description of Artificial Sequence: Synthetic polypeptide
DEEEIRTTNPVATEQWGSVATADPQANGNPHN

SEQ ID NO: 80705 - protein, 32 aa, Artificial Sequence
  Description of Artificial Sequence: Synthetic polypeptide
DEEEIRTTNPVATEQWGSVATADNPQANNNPP

SEQ ID NO: 80706 - protein, 33 aa, Artificial Sequence
  Description of Artificial Sequence: Synthetic polypeptide
DEEEIRTTNPVATEQYGSVWESLPNMLQHMDQG

SEQ ID NO: 80707 - protein, 34 aa, Artificial Sequence
  Description of Artificial Sequence: Synthetic polypeptide
AEEEIRTTNPVATEQYGSVSTVTNLNSNNEGNQG

SEQ ID NO: 80708 - protein, 31 aa, Artificial Sequence
  Description of Artificial Sequence: Synthetic polypeptide
DEEEIRTTNPVSTETYGSVSMVTTLQEMVEL

SEQ ID NO: 80709 - protein, 30 aa, Artificial Sequence
  Description of Artificial Sequence: Synthetic polypeptide
SEEEIRCTNPIATECYGSTTWSENLARGNI

SEQ ID NO: 80710 - protein, 32 aa, Artificial Sequence
  Description of Artificial Sequence: Synthetic polypeptide
DEAEIRTTNPVATEQYGCVCSTELQHFGSETQ

SEQ ID NO: 80711 - protein, 28 aa, Artificial Sequence
  Description of Artificial Sequence: Synthetic peptide
YEEEIASVNPVCTEQYGVVSNTLQSGNQ

SEQ ID NO: 80712 - protein, 33 aa, Artificial Sequence
  Description of Artificial Sequence: Synthetic polypeptide
DEEEISTTNPVATEQYGCVCSTGNLQHFNSNQF

SEQ ID NO: 80713 - protein, 34 aa, Artificial Sequence
  Description of Artificial Sequence: Synthetic polypeptide
DEEEIRTTNPVATECYGSVCQTFEDLDGRGNTER

SEQ ID NO: 80714 - protein, 34 aa, Artificial Sequence
  Description of Artificial Sequence: Synthetic polypeptide
DEEEIRTTNPVAYEQYGQSVSQLNDLLQEGQIRF

SEQ ID NO: 80715 - protein, 31 aa, Artificial Sequence
  Description of Artificial Sequence: Synthetic polypeptide
SEEEIACTNPVATEQYGSVATNLQAPDNAEE

SEQ ID NO: 80716 - protein, 33 aa, Artificial Sequence
  Description of Artificial Sequence: Synthetic polypeptide
DENEIRTTNPVATEQYGSSSVYDMLEQRGNEEM

SEQ ID NO: 80717 - protein, 32 aa, Artificial Sequence
  Description of Artificial Sequence: Synthetic polypeptide
SEEEIACTNPVATEQYGSVATNLQDADNNDRN

SEQ ID NO: 80718 - protein, 34 aa, Artificial Sequence
  Description of Artificial Sequence: Synthetic polypeptide
AEEEIRTTNPVATEQYGSVSTVNLLQGQEDTNAT

SEQ ID NO: 80719 - protein, 30 aa, Artificial Sequence
  Description of Artificial Sequence: Synthetic polypeptide
SAEEIATTNPVATAQWGSVSGTGLQHGNSN

SEQ ID NO: 80720 - protein, 30 aa, Artificial Sequence
  Description of Artificial Sequence: Synthetic polypeptide
SEEEIRCTNPIACEQYGAVSGMNGMRGNDR

SEQ ID NO: 80721 - protein, 34 aa, Artificial Sequence
  Description of Artificial Sequence: Synthetic polypeptide
DEEEIRTTNPVATEQYGSVVGGTNDIQTGGGNNT

SEQ ID NO: 80722 - protein, 28 aa, Artificial Sequence
  Description of Artificial Sequence: Synthetic peptide
YENEIASVNPVCTEQYGVVSDNLQRGGQ

SEQ ID NO: 80723 - protein, 32 aa, Artificial Sequence
  Description of Artificial Sequence: Synthetic polypeptide
DEEEISTTNPVATEQYGCVCSTGNHTNGSNQS

SEQ ID NO: 80724 - protein, 31 aa, Artificial Sequence
  Description of Artificial Sequence: Synthetic polypeptide
DEEEIRTTNPVATEGYGCISTNEQSFSSNFA

SEQ ID NO: 80725 - protein, 32 aa, Artificial Sequence
  Description of Artificial Sequence: Synthetic polypeptide
DEEEISTTNPVATEQYGCVCSTGNHQSFGEQG

SEQ ID NO: 80726 - protein, 33 aa, Artificial Sequence
  Description of Artificial Sequence: Synthetic polypeptide
DEEEIRTTNPVCYEPYGSTVPSCPNLSQRGGNL

SEQ ID NO: 80727 - protein, 31 aa, Artificial Sequence
  Description of Artificial Sequence: Synthetic polypeptide
DEEEIRTTNPVCYEHYGSVSMPDLQEGSNNL

SEQ ID NO: 80728 - protein, 32 aa, Artificial Sequence
  Description of Artificial Sequence: Synthetic polypeptide
DENEIRCTNPVATEQYGCVSWTTLTRFGENQD

SEQ ID NO: 80729 - protein, 28 aa, Artificial Sequence
  Description of Artificial Sequence: Synthetic peptide
YEEEIASVNPVCTEQYGVVSSNCQSGNQ

SEQ ID NO: 80730 - protein, 33 aa, Artificial Sequence
  Description of Artificial Sequence: Synthetic polypeptide
DEEEIRTTNPVATEQYGSVVYPTNEQDVTNVQQ

SEQ ID NO: 80731 - protein, 33 aa, Artificial Sequence
  Description of Artificial Sequence: Synthetic polypeptide
DEEEIRTTNPVSTEQYGSVSTGDNGQGGGEQGT

SEQ ID NO: 80732 - protein, 28 aa, Artificial Sequence
  Description of Artificial Sequence: Synthetic peptide
YEEEIASVNPVCTEQYGVVSSNLQSGDI

SEQ ID NO: 80733 - protein, 28 aa, Artificial Sequence
  Description of Artificial Sequence: Synthetic peptide
YENEIASVNPVCTEQYGTVSDNLQSGNQ

SEQ ID NO: 80734 - protein, 28 aa, Artificial Sequence
  Description of Artificial Sequence: Synthetic peptide
YENEIASVNPVCTEQYGEASDNLQSGNR

SEQ ID NO: 80735 - protein, 33 aa, Artificial Sequence
  Description of Artificial Sequence: Synthetic polypeptide
DEEEIRTTNPVCYEPYGSVSCMPNLSQRGGNNV

SEQ ID NO: 80736 - protein, 33 aa, Artificial Sequence
  Description of Artificial Sequence: Synthetic polypeptide
DEEEIRTTNPVATEPYGSVSTDGNMTDEGGNTS

SEQ ID NO: 80737 - protein, 32 aa, Artificial Sequence
  Description of Artificial Sequence: Synthetic polypeptide
DENEIRTTNPVATEQYGSSSTVSQRSGPEDGQ

SEQ ID NO: 80738 - protein, 32 aa, Artificial Sequence
  Description of Artificial Sequence: Synthetic polypeptide
SEEEIACTNPVATEQYGSVATNLQDAPGENHH

SEQ ID NO: 80739 - protein, 33 aa, Artificial Sequence
  Description of Artificial Sequence: Synthetic polypeptide
DEEEISTTNPVATEQYGCVCSTGNHQQFGSNQD

SEQ ID NO: 80740 - protein, 28 aa, Artificial Sequence
  Description of Artificial Sequence: Synthetic peptide
YEEEIASVNPVCTEQYGVVSNNLQSGQQ

SEQ ID NO: 80741 - protein, 29 aa, Artificial Sequence
  Description of Artificial Sequence: Synthetic peptide
YEEEIASVNPVCTEQYGVVSSDNLQSGNQ

SEQ ID NO: 80742 - protein, 30 aa, Artificial Sequence
  Description of Artificial Sequence: Synthetic polypeptide
DEEEIRTTNPVATEQYGSVWAPDPQMTSEQ

SEQ ID NO: 80743 - protein, 34 aa, Artificial Sequence
  Description of Artificial Sequence: Synthetic polypeptide
DEEEIRTTNPVATEGYGNVVSTTVTLGQDRIINR

SEQ ID NO: 80744 - protein, 30 aa, Artificial Sequence
  Description of Artificial Sequence: Synthetic polypeptide
DENEIRCTNPVATEQYGAASEDWQRKGGYR

SEQ ID NO: 80745 - protein, 34 aa, Artificial Sequence
  Description of Artificial Sequence: Synthetic polypeptide
DEEEIRTTNPVATEQYGQVSSTNDQLNIIEGNIG

SEQ ID NO: 80746 - protein, 31 aa, Artificial Sequence
  Description of Artificial Sequence: Synthetic polypeptide
DEEEIRCTNPVSTEPYGTISMEDLQMRNGNR

SEQ ID NO: 80747 - protein, 34 aa, Artificial Sequence
  Description of Artificial Sequence: Synthetic polypeptide
AEEEIRTTNPVATEQYGSVSTVNGQGTNGNNQDE

SEQ ID NO: 80748 - protein, 28 aa, Artificial Sequence
  Description of Artificial Sequence: Synthetic peptide
YEEEIASVNPVCTEQYGVVSRNLQSGGQ

SEQ ID NO: 80749 - protein, 33 aa, Artificial Sequence
  Description of Artificial Sequence: Synthetic polypeptide
DEEEIRTTNPVAYEQYGQSVSQLNDALQIGIAQ

SEQ ID NO: 80750 - protein, 30 aa, Artificial Sequence
  Description of Artificial Sequence: Synthetic polypeptide
DEEEIRCTNPVSTEPYGTISMENLQMQGNH

SEQ ID NO: 80751 - protein, 31 aa, Artificial Sequence
  Description of Artificial Sequence: Synthetic polypeptide
DENEIRCTNPVATEQYGCVSVATLTRGENQQ

SEQ ID NO: 80752 - protein, 31 aa, Artificial Sequence
  Description of Artificial Sequence: Synthetic polypeptide
YEEEIRTTNPVATEEYGAVSTVCAQKIGTER

SEQ ID NO: 80753 - protein, 30 aa, Artificial Sequence
  Description of Artificial Sequence: Synthetic polypeptide
DENEIRCTNPVATEQYGCVSWMDLTRQENQ

SEQ ID NO: 80754 - protein, 33 aa, Artificial Sequence
  Description of Artificial Sequence: Synthetic polypeptide
DEEEIRTTNPVAYEQYGQSVSQGNDLLQEGITG

SEQ ID NO: 80755 - protein, 30 aa, Artificial Sequence
  Description of Artificial Sequence: Synthetic polypeptide
DEEEIRTTNPVSYEAYGSVAFNLSQGVGQT

SEQ ID NO: 80756 - protein, 29 aa, Artificial Sequence
  Description of Artificial Sequence: Synthetic peptide
YEEEIASVNPVCTEQYGVVSRNLQSGNQM

SEQ ID NO: 80757 - protein, 34 aa, Artificial Sequence
  Description of Artificial Sequence: Synthetic polypeptide
DEEEISTTNPVATEQYGCVCSTGNLNQNSGSNQS

SEQ ID NO: 80758 - protein, 28 aa, Artificial Sequence
  Description of Artificial Sequence: Synthetic peptide
YENEIASVNPVCTEQYGVVSENLQRGGQ

SEQ ID NO: 80759 - protein, 30 aa, Artificial Sequence
  Description of Artificial Sequence: Synthetic polypeptide
DEEEIRCTNPVSTEPYGTISMNIQQRNGNH

SEQ ID NO: 80760 - protein, 28 aa, Artificial Sequence
  Description of Artificial Sequence: Synthetic peptide
YENEIASVNPVCTEQYGVVSDNLQSGNQ

SEQ ID NO: 80761 - protein, 35 aa, Artificial Sequence
  Description of Artificial Sequence: Synthetic polypeptide
AEEEIRTTNPVATEQYGSVSTVNLGQTGNGTTTTE

SEQ ID NO: 80762 - protein, 35 aa, Artificial Sequence
  Description of Artificial Sequence: Synthetic polypeptide
AEEEIRTTNPVATEQYGSVSTVNLLGQNIGTTNTE

SEQ ID NO: 80763 - protein, 30 aa, Artificial Sequence
  Description of Artificial Sequence: Synthetic polypeptide
DEEEIRTTNPVATEQYGSVWAPPAGGSTQN

SEQ ID NO: 80764 - protein, 33 aa, Artificial Sequence
  Description of Artificial Sequence: Synthetic polypeptide
DEEEIRTTNPVAYEQYGQSVSQENDHLQRSIET

SEQ ID NO: 80765 - protein, 34 aa, Artificial Sequence
  Description of Artificial Sequence: Synthetic polypeptide
AEEEIRTTNPVATEQYGSVSTVNGTNQQNGTNQE

SEQ ID NO: 80766 - protein, 30 aa, Artificial Sequence
  Description of Artificial Sequence: Synthetic polypeptide
DEAEIRTTNGVAYCQYGCVSTNHQRSGSDA

SEQ ID NO: 80767 - protein, 32 aa, Artificial Sequence
  Description of Artificial Sequence: Synthetic polypeptide
DEEEIRTTNPVATEEYGCVCFTGNLTGGGSNQ

SEQ ID NO: 80768 - protein, 35 aa, Artificial Sequence
  Description of Artificial Sequence: Synthetic polypeptide
AEEEIRTTNPVATEQYGSVSTVNNNLQQQGNQEND

SEQ ID NO: 80769 - protein, 32 aa, Artificial Sequence
  Description of Artificial Sequence: Synthetic polypeptide
SEEEIATTNPVATEQYGSVATNLTEAEGGNEK

SEQ ID NO: 80770 - protein, 32 aa, Artificial Sequence
  Description of Artificial Sequence: Synthetic polypeptide
DEAEIRTTNPVATEQYGCVSTDDLQQHTEDRI

SEQ ID NO: 80771 - protein, 33 aa, Artificial Sequence
  Description of Artificial Sequence: Synthetic polypeptide
DEEEIRTTNPVATEFYGSVGDTGNDDEQGTGNI

SEQ ID NO: 80772 - protein, 28 aa, Artificial Sequence
  Description of Artificial Sequence: Synthetic peptide
SEECIACTNPEATAQWGSVSVNLDRGND

SEQ ID NO: 80773 - protein, 32 aa, Artificial Sequence
  Description of Artificial Sequence: Synthetic polypeptide
SEEEIATTNPVATEQYGSVATNLTAEGGNENQ

SEQ ID NO: 80774 - protein, 33 aa, Artificial Sequence
  Description of Artificial Sequence: Synthetic polypeptide
AEEEIRTTNPVATEQYGSVSTVQDQQIGNNNTE

SEQ ID NO: 80775 - protein, 34 aa, Artificial Sequence
  Description of Artificial Sequence: Synthetic polypeptide
DEEEISTTNPVATEQYGCTVSCTNGSGERGGNER

SEQ ID NO: 80776 - protein, 33 aa, Artificial Sequence
  Description of Artificial Sequence: Synthetic polypeptide
DEEEIRTTNPVATEFYGSVISGNDQEEGGNGDE

SEQ ID NO: 80777 - protein, 33 aa, Artificial Sequence
  Description of Artificial Sequence: Synthetic polypeptide
DEEEIRTTNPVATEQYGSVTSTLGLENEGGEGQ

SEQ ID NO: 80778 - protein, 33 aa, Artificial Sequence
  Description of Artificial Sequence: Synthetic polypeptide
SEEEIATTNPVATEQYGSVATNLQNNSGMENNE

SEQ ID NO: 80779 - protein, 32 aa, Artificial Sequence
  Description of Artificial Sequence: Synthetic polypeptide
SEEEIATTNPVATEQYGSVATNLQNGEQEGAD

SEQ ID NO: 80780 - protein, 33 aa, Artificial Sequence
  Description of Artificial Sequence: Synthetic polypeptide
DEEEIRTTNPVATEQYGSASSTPVCNMRNGMNV

SEQ ID NO: 80781 - protein, 34 aa, Artificial Sequence
  Description of Artificial Sequence: Synthetic polypeptide
DEEEISTTNPVATEQYGCQVCSTNLQNFGSENQS

SEQ ID NO: 80782 - protein, 33 aa, Artificial Sequence
  Description of Artificial Sequence: Synthetic polypeptide
DEEEISTTNPVATEQYGCQVCSTNLQHFGSEQS

SEQ ID NO: 80783 - protein, 33 aa, Artificial Sequence
  Description of Artificial Sequence: Synthetic polypeptide
DEEEIRTTNPVATEQYGSASSTPVCNMRNGMNK

SEQ ID NO: 80784 - protein, 34 aa, Artificial Sequence
  Description of Artificial Sequence: Synthetic polypeptide
DEEEIRTTNPVATEFYGSVLTGTPNLETRSVNPR

SEQ ID NO: 80785 - protein, 34 aa, Artificial Sequence
  Description of Artificial Sequence: Synthetic polypeptide
DEEEIRTTNPVATEQYGSVTSTLGLENIGGNGQG

SEQ ID NO: 80786 - protein, 33 aa, Artificial Sequence
  Description of Artificial Sequence: Synthetic polypeptide
YEEEIKTTNPVAFEQYGSVSTDETLQRQGHSRL

SEQ ID NO: 80787 - protein, 34 aa, Artificial Sequence
  Description of Artificial Sequence: Synthetic polypeptide
DEAEIRTTNPVATEQYGCVSTALNLQIGPNQQEI

SEQ ID NO: 80788 - protein, 32 aa, Artificial Sequence
  Description of Artificial Sequence: Synthetic polypeptide
DEEEIRGTNPVATEQWGTSVVTLLIRGGNGGT

SEQ ID NO: 80789 - protein, 32 aa, Artificial Sequence
  Description of Artificial Sequence: Synthetic polypeptide
SEEEIATTNPVATEQYGSVATNLQNGEGEPAM

SEQ ID NO: 80790 - protein, 35 aa, Artificial Sequence
  Description of Artificial Sequence: Synthetic polypeptide
DEEEIRTTNPVAYEQYGIMTVPAITNLSQRGGNRI

SEQ ID NO: 80791 - protein, 30 aa, Artificial Sequence
  Description of Artificial Sequence: Synthetic polypeptide
DENEIRTTNPVATEQWGDVSCIEMNRAGNG

SEQ ID NO: 80792 - protein, 34 aa, Artificial Sequence
  Description of Artificial Sequence: Synthetic polypeptide
DEEEIRTTNPVATEPYGISVQSTVLLEQPRIVND

SEQ ID NO: 80793 - protein, 31 aa, Artificial Sequence
  Description of Artificial Sequence: Synthetic polypeptide
DEEEIRTTNPVSTEQYGSVITFYDLQGEQTD

SEQ ID NO: 80794 - protein, 28 aa, Artificial Sequence
  Description of Artificial Sequence: Synthetic peptide
AEDEIACTNPVAYEQYGEASENLQRGGA

SEQ ID NO: 80795 - protein, 32 aa, Artificial Sequence
  Description of Artificial Sequence: Synthetic polypeptide
YEEEIRSTNPVCTEQYGVVSSTPNLPNRNGNQ

SEQ ID NO: 80796 - protein, 32 aa, Artificial Sequence
  Description of Artificial Sequence: Synthetic polypeptide
DEEEIRTTNPVATEQYGSASSTVCNMRNEMNK

SEQ ID NO: 80797 - protein, 30 aa, Artificial Sequence
  Description of Artificial Sequence: Synthetic polypeptide
SEECISTTNPVATEQYGCVCSSNHQRFGDQ

SEQ ID NO: 80798 - protein, 32 aa, Artificial Sequence
  Description of Artificial Sequence: Synthetic polypeptide
DEEEIRTTNPVATEQFGTCVCSTYLTHGSNAS

SEQ ID NO: 80799 - protein, 34 aa, Artificial Sequence
  Description of Artificial Sequence: Synthetic polypeptide
SEEEIATTNPVATEQYGSVATNNLPQEAGGENDR

SEQ ID NO: 80800 - protein, 31 aa, Artificial Sequence
  Description of Artificial Sequence: Synthetic polypeptide
DEAEIRTTNPVATEQYGCVSTLLEIHGDFDD

SEQ ID NO: 80801 - protein, 31 aa, Artificial Sequence
  Description of Artificial Sequence: Synthetic polypeptide
YEEEIKTTNPSATDQYGSVVTNLQSIQGNQG

SEQ ID NO: 80802 - protein, 30 aa, Artificial Sequence
  Description of Artificial Sequence: Synthetic polypeptide
SEEAICTTNPVATEQYGCVCSSNHQNGSNQ

SEQ ID NO: 80803 - protein, 30 aa, Artificial Sequence
  Description of Artificial Sequence: Synthetic polypeptide
SEECISTTNPVATEQYGCVCSSNHQNGNQS

SEQ ID NO: 80804 - protein, 32 aa, Artificial Sequence
  Description of Artificial Sequence: Synthetic polypeptide
DEEEIRTTNPVATEGYGCVCSTALQNFGSDQS

SEQ ID NO: 80805 - protein, 33 aa, Artificial Sequence
  Description of Artificial Sequence: Synthetic polypeptide
DEAEIRTTNPVATEQYGCVSTIDLTPRNGEEDR

SEQ ID NO: 80806 - protein, 31 aa, Artificial Sequence
  Description of Artificial Sequence: Synthetic polypeptide
DEEEIRTTNPVSTEPYGTISMEDIMQRNGNR

SEQ ID NO: 80807 - protein, 33 aa, Artificial Sequence
  Description of Artificial Sequence: Synthetic polypeptide
DEEEIRTTNPVATEQYGSASSTTPAGPNMRGNV

SEQ ID NO: 80808 - protein, 33 aa, Artificial Sequence
  Description of Artificial Sequence: Synthetic polypeptide
DEEEIRTTNPVATEQYGQSVCSWEHQNFGSNNQ

SEQ ID NO: 80809 - protein, 34 aa, Artificial Sequence
  Description of Artificial Sequence: Synthetic polypeptide
DEEEIRTTNPVAYEQYGHTVPSCTNLSNPVGNSR

SEQ ID NO: 80810 - protein, 35 aa, Artificial Sequence
  Description of Artificial Sequence: Synthetic polypeptide
DEEEIRTTNPVAYEQYGHTVSCWTNLSNYRTGGNR

SEQ ID NO: 80811 - protein, 33 aa, Artificial Sequence
  Description of Artificial Sequence: Synthetic polypeptide
YEEEIVTTNPVATEQYGAVVEPTNLNQCFGENR

SEQ ID NO: 80812 - protein, 33 aa, Artificial Sequence
  Description of Artificial Sequence: Synthetic polypeptide
DEEEISTTNPVATEQYGCVCQNTNLQRFGSEQT

SEQ ID NO: 80813 - protein, 34 aa, Artificial Sequence
  Description of Artificial Sequence: Synthetic polypeptide
DEEEIRTTNPVATEQYGSVVSPMPPLQRGVEELQ

SEQ ID NO: 80814 - protein, 31 aa, Artificial Sequence
  Description of Artificial Sequence: Synthetic polypeptide
DEEEIRTTNPVATEGYGCVCSTEDQNGSEQS

SEQ ID NO: 80815 - protein, 32 aa, Artificial Sequence
  Description of Artificial Sequence: Synthetic polypeptide
SEEEIATTNPVATEQYGSVATNLTTEGGNEYD

SEQ ID NO: 80816 - protein, 33 aa, Artificial Sequence
  Description of Artificial Sequence: Synthetic polypeptide
DENEIRTTNPVATEQWGSVYHWTNDHQKTAGNR

SEQ ID NO: 80817 - protein, 34 aa, Artificial Sequence
  Description of Artificial Sequence: Synthetic polypeptide
DEAEIRTTNPVATEQYGCVSTNYELQGIGNEDQA

SEQ ID NO: 80818 - protein, 34 aa, Artificial Sequence
  Description of Artificial Sequence: Synthetic polypeptide
DEEEIRTTNPVAYEQYGISVSIANSQSQGGGNYR

SEQ ID NO: 80819 - protein, 31 aa, Artificial Sequence
  Description of Artificial Sequence: Synthetic polypeptide
DEAEIRTTNPVATEQYGCVSSNNLEYDDNDQ

SEQ ID NO: 80820 - protein, 30 aa, Artificial Sequence
  Description of Artificial Sequence: Synthetic polypeptide
DENEIRTTNPVATEQWGSVSCIEQNAAENA

SEQ ID NO: 80821 - protein, 34 aa, Artificial Sequence
  Description of Artificial Sequence: Synthetic polypeptide
YEEEIKTTNPVATEQYGAVALNTNDLQPRGNDRY

SEQ ID NO: 80822 - protein, 31 aa, Artificial Sequence
  Description of Artificial Sequence: Synthetic polypeptide
DENEIRTTNPVATEPYGEISMENIQQRNGNH

SEQ ID NO: 80823 - protein, 29 aa, Artificial Sequence
  Description of Artificial Sequence: Synthetic peptide
YEEEIVSTNPVCTEQYGTVSTDNPESGND

SEQ ID NO: 80824 - protein, 34 aa, Artificial Sequence
  Description of Artificial Sequence: Synthetic polypeptide
AEEEIRTTNPVATEQYGSVSTVTNNNQQGIGNQE

SEQ ID NO: 80825 - protein, 30 aa, Artificial Sequence
  Description of Artificial Sequence: Synthetic polypeptide
SEECIACTNPTATEQYGSVSENLMDRGNEH

SEQ ID NO: 80826 - protein, 30 aa, Artificial Sequence
  Description of Artificial Sequence: Synthetic polypeptide
SEECIACTNPTATEQYGSVSENLMRGNESF

SEQ ID NO: 80827 - protein, 30 aa, Artificial Sequence
  Description of Artificial Sequence: Synthetic polypeptide
SEECIACTNPTATEQYGSVSENLMRHGNEQ

SEQ ID NO: 80828 - protein, 33 aa, Artificial Sequence
  Description of Artificial Sequence: Synthetic polypeptide
DEEEIRTTNPVATEQYGSASQTNVNQRQLVSQD

SEQ ID NO: 80829 - protein, 34 aa, Artificial Sequence
  Description of Artificial Sequence: Synthetic polypeptide
AEEEIRTTNPVATEQYGSVSTVTNNNQQDGTNVE

SEQ ID NO: 80830 - protein, 30 aa, Artificial Sequence
  Description of Artificial Sequence: Synthetic polypeptide
DENEIRTTNPVATEQWGSVSCIEQNAEGDG

SEQ ID NO: 80831 - protein, 34 aa, Artificial Sequence
  Description of Artificial Sequence: Synthetic polypeptide
AEEEIRTTNPVATEQYGSVSTVTNNNQNDQGNVE

SEQ ID NO: 80832 - protein, 30 aa, Artificial Sequence
  Description of Artificial Sequence: Synthetic polypeptide
DEEEIRTTNPVSTEPYGTVSMEDIQSNGNH

SEQ ID NO: 80833 - protein, 28 aa, Artificial Sequence
  Description of Artificial Sequence: Synthetic peptide
SEECIACTNPTAYEQYGSVAANLMRGNQ

SEQ ID NO: 80834 - protein, 30 aa, Artificial Sequence
  Description of Artificial Sequence: Synthetic polypeptide
DENEIRTTNPVATEQWGDVSCIEMNRAGNA

SEQ ID NO: 80835 - protein, 34 aa, Artificial Sequence
  Description of Artificial Sequence: Synthetic polypeptide
YEEEIKTTNPVATEQYGCAVSNSSNLTQRNGNRF

SEQ ID NO: 80836 - protein, 32 aa, Artificial Sequence
  Description of Artificial Sequence: Synthetic polypeptide
DEAEIRTTNPVATEQYGCVSFTNHTQNGDDEL

SEQ ID NO: 80837 - protein, 32 aa, Artificial Sequence
  Description of Artificial Sequence: Synthetic polypeptide
DEEEISTTNPVATEGYGCVCSTELQRSGSEDS

SEQ ID NO: 80838 - protein, 34 aa, Artificial Sequence
  Description of Artificial Sequence: Synthetic polypeptide
AEEEIRTTNPVATEQYGSVSTVQNLQQIATTNDE

SEQ ID NO: 80839 - protein, 31 aa, Artificial Sequence
  Description of Artificial Sequence: Synthetic polypeptide
YEEEIKTTNPVATEQYGSVSTLTNTRFGTEN

SEQ ID NO: 80840 - protein, 30 aa, Artificial Sequence
  Description of Artificial Sequence: Synthetic polypeptide
DEAEIRTTNPVATEQYGCVSEPLFRNEEEW

SEQ ID NO: 80841 - protein, 35 aa, Artificial Sequence
  Description of Artificial Sequence: Synthetic polypeptide
DEEEIRTVNPVATEQYGSVSSTTPALPQMRNGMNQ

SEQ ID NO: 80842 - protein, 31 aa, Artificial Sequence
  Description of Artificial Sequence: Synthetic polypeptide
DEEEIRTTNPVSTEPYGTISMENLQQQQGNH

SEQ ID NO: 80843 - protein, 28 aa, Artificial Sequence
  Description of Artificial Sequence: Synthetic peptide
SEECIACTNPIAYEQYGSVSENLMRGAD

SEQ ID NO: 80844 - protein, 31 aa, Artificial Sequence
  Description of Artificial Sequence: Synthetic polypeptide
DENEIRTTNPVATEPYGEISEENIQQRNGNH

SEQ ID NO: 80845 - protein, 33 aa, Artificial Sequence
  Description of Artificial Sequence: Synthetic polypeptide
AEEEIRTTNPVATEQYGSVSTVQNDGTEQGNNN

SEQ ID NO: 80846 - protein, 34 aa, Artificial Sequence
  Description of Artificial Sequence: Synthetic polypeptide
YEEEIKTTNPVAFEQYGSVSTTENLKQRQGHSRL

SEQ ID NO: 80847 - protein, 31 aa, Artificial Sequence
  Description of Artificial Sequence: Synthetic polypeptide
DEEEIRTTNPVSTEPYGTISMEDLQQQQGNR

SEQ ID NO: 80848 - protein, 29 aa, Artificial Sequence
  Description of Artificial Sequence: Synthetic peptide
YEEEIVSVNPVCTEQYGVVSTDNPQSGND

SEQ ID NO: 80849 - protein, 32 aa, Artificial Sequence
  Description of Artificial Sequence: Synthetic polypeptide
DEEEIRTTNPVSTEQYGSVDTDNGQEGGGQTT

SEQ ID NO: 80850 - protein, 34 aa, Artificial Sequence
  Description of Artificial Sequence: Synthetic polypeptide
YEEEIKTTNPVAFEQYGSVSTTENLLERQGHNRF

SEQ ID NO: 80851 - protein, 33 aa, Artificial Sequence
  Description of Artificial Sequence: Synthetic polypeptide
DEEEISTTNPVATEQYGCQVCSTELQNFGSNQQ

SEQ ID NO: 80852 - protein, 34 aa, Artificial Sequence
  Description of Artificial Sequence: Synthetic polypeptide
AEEEIRTTNPVATEQYGSVSTVQNGNQQGENDEE

SEQ ID NO: 80853 - protein, 28 aa, Artificial Sequence
  Description of Artificial Sequence: Synthetic peptide
YEEEIVSVNPVCTEQYGVVSDGLQSGNQ

SEQ ID NO: 80854 - protein, 34 aa, Artificial Sequence
  Description of Artificial Sequence: Synthetic polypeptide
DEEEISTTNPVATEQYGCAVCSTENLQNFGSNTQ

SEQ ID NO: 80855 - protein, 32 aa, Artificial Sequence
  Description of Artificial Sequence: Synthetic polypeptide
DEEEISTTNPVATEQYGCQVCSTNDQNFGSEQ

SEQ ID NO: 80856 - protein, 29 aa, Artificial Sequence
  Description of Artificial Sequence: Synthetic peptide
YEEEIVSVNPVCTEQYGTVSTDNPQSGND

SEQ ID NO: 80857 - protein, 33 aa, Artificial Sequence
  Description of Artificial Sequence: Synthetic polypeptide
DEEEISTTNPVATEQWGSVSTWNQLQEKPTNEE

SEQ ID NO: 80858 - protein, 28 aa, Artificial Sequence
  Description of Artificial Sequence: Synthetic peptide
SEECIACTNPIAYEQYGSVAENLMRGDR

SEQ ID NO: 80859 - protein, 34 aa, Artificial Sequence
  Description of Artificial Sequence: Synthetic polypeptide
AEEEIRTTNPVATEQYGSVSTVQNGNQQGNNVQE

SEQ ID NO: 80860 - protein, 31 aa, Artificial Sequence
  Description of Artificial Sequence: Synthetic polypeptide
DEEEIRTTNPVSTEPYGTISMENLQMQQGNH

SEQ ID NO: 80861 - protein, 34 aa, Artificial Sequence
  Description of Artificial Sequence: Synthetic polypeptide
AEEEIRTTNPVATEQYGSVSTVQNGTQGGNNETE

SEQ ID NO: 80862 - protein, 32 aa, Artificial Sequence
  Description of Artificial Sequence: Synthetic polypeptide
DEEEIRTTNPVATEQYGSVVSNLEDNPELENE

SEQ ID NO: 80863 - protein, 31 aa, Artificial Sequence
  Description of Artificial Sequence: Synthetic polypeptide
DENEIRTTNPVATEPYGEASEENIQQRNGNH

SEQ ID NO: 80864 - protein, 32 aa, Artificial Sequence
  Description of Artificial Sequence: Synthetic polypeptide
DEEEIRTTNPVAYEQYGIVVSINQSIGGGNYR

SEQ ID NO: 80865 - protein, 32 aa, Artificial Sequence
  Description of Artificial Sequence: Synthetic polypeptide
DEEEIRTTNPVSTEQYGSTVAINELSQGGGQT

SEQ ID NO: 80866 - protein, 28 aa, Artificial Sequence
  Description of Artificial Sequence: Synthetic peptide
SEEEIASVNPCITEQYGVVSDNLQSGNQ

SEQ ID NO: 80867 - protein, 32 aa, Artificial Sequence
  Description of Artificial Sequence: Synthetic polypeptide
DEAEIRTTNPVATEQYGCVSPDNLENRGSQSQ

SEQ ID NO: 80868 - protein, 31 aa, Artificial Sequence
  Description of Artificial Sequence: Synthetic polypeptide
SEEEIATTNPVATEQYGSVATALQANPGGLN

SEQ ID NO: 80869 - protein, 32 aa, Artificial Sequence
  Description of Artificial Sequence: Synthetic polypeptide
SEEEIATTNPVATEQYGSVCAANNLQEAGNEH

SEQ ID NO: 80870 - protein, 31 aa, Artificial Sequence
  Description of Artificial Sequence: Synthetic polypeptide
DEEEIRTTNPVATEQFGTCVSTYTAHFGSNQ

SEQ ID NO: 80871 - protein, 31 aa, Artificial Sequence
  Description of Artificial Sequence: Synthetic polypeptide
YEEEIGTTNPVATEQYSGPSTHNHEQRTGFR

SEQ ID NO: 80872 - protein, 33 aa, Artificial Sequence
  Description of Artificial Sequence: Synthetic polypeptide
DEEEISTTNPVATEQYGCVCSNTEDQRFGSNQT

SEQ ID NO: 80873 - protein, 30 aa, Artificial Sequence
  Description of Artificial Sequence: Synthetic polypeptide
DEEEIRTTNPVSTEIYGTVTFNLQQGAGQT

SEQ ID NO: 80874 - protein, 32 aa, Artificial Sequence
  Description of Artificial Sequence: Synthetic polypeptide
DENEIRTTNPVATEPWGSVSMENEPQDRNGNG

SEQ ID NO: 80875 - protein, 31 aa, Artificial Sequence
  Description of Artificial Sequence: Synthetic polypeptide
SEEEIATTNPVATEQYGSVSEDLEDHEGNDL

SEQ ID NO: 80876 - protein, 33 aa, Artificial Sequence
  Description of Artificial Sequence: Synthetic polypeptide
DEEEIRTTNPVATEPYGFVCFTNQHNRGGNVRS

SEQ ID NO: 80877 - protein, 33 aa, Artificial Sequence
  Description of Artificial Sequence: Synthetic polypeptide
DEEEIRCTNPVATEQYGSVCCVDNQDDRGSNSR

SEQ ID NO: 80878 - protein, 30 aa, Artificial Sequence
  Description of Artificial Sequence: Synthetic polypeptide
DEEEIRTTNPVSTEPYGSISMDIQQQNGNH

SEQ ID NO: 80879 - protein, 34 aa, Artificial Sequence
  Description of Artificial Sequence: Synthetic polypeptide
DEEEIRTTNPVAYEQYGQSCSPTNDELERGVVER

SEQ ID NO: 80880 - protein, 31 aa, Artificial Sequence
  Description of Artificial Sequence: Synthetic polypeptide
SEEEIATTNPVATEQYGSVSATDLEDHGEDL

SEQ ID NO: 80881 - protein, 31 aa, Artificial Sequence
  Description of Artificial Sequence: Synthetic polypeptide
SEEEIATTNPVATEQYGSVSAPPDANGNNRD

SEQ ID NO: 80882 - protein, 28 aa, Artificial Sequence
  Description of Artificial Sequence: Synthetic peptide
ADNEVASTNPVATEQYGEASENLQRGGR

SEQ ID NO: 80883 - protein, 30 aa, Artificial Sequence
  Description of Artificial Sequence: Synthetic polypeptide
DENEIRTTNPVATEQWGDVSCNEMNRAENG

SEQ ID NO: 80884 - protein, 33 aa, Artificial Sequence
  Description of Artificial Sequence: Synthetic polypeptide
DEEEIRTTNPVATEPYGICVCSTVYLQERISNQ

SEQ ID NO: 80885 - protein, 34 aa, Artificial Sequence
  Description of Artificial Sequence: Synthetic polypeptide
AEEEIRTTNPVATEQYGSVSTVNTNQQSGVDNGT

SEQ ID NO: 80886 - protein, 31 aa, Artificial Sequence
  Description of Artificial Sequence: Synthetic polypeptide
DEEEIRCTNPVATEQYGCVCSWNTDGGSNNA

SEQ ID NO: 80887 - protein, 28 aa, Artificial Sequence
  Description of Artificial Sequence: Synthetic peptide
SEEEIAPTNPCSSEQYGIVSCNLQSGTR

SEQ ID NO: 80888 - protein, 34 aa, Artificial Sequence
  Description of Artificial Sequence: Synthetic polypeptide
DEEEIRTTNPVATEQYGSVTSNVNTLGMGGENGV

SEQ ID NO: 80889 - protein, 35 aa, Artificial Sequence
  Description of Artificial Sequence: Synthetic polypeptide
AEEEIRTTNPVATEQYGSVSTVTGNLQQGTNEEDD

SEQ ID NO: 80890 - protein, 32 aa, Artificial Sequence
  Description of Artificial Sequence: Synthetic polypeptide
DEEEISTTNPVATEQYGCVCSNSNLQNFGSDQ

SEQ ID NO: 80891 - protein, 32 aa, Artificial Sequence
  Description of Artificial Sequence: Synthetic polypeptide
SEEEIATTNPVATEQYGSVCSTPPDNRDGDTR

SEQ ID NO: 80892 - protein, 35 aa, Artificial Sequence
  Description of Artificial Sequence: Synthetic polypeptide
DEEEIRTTNPVATEQYGQSVPSCTPNAGQPTGNNQ

SEQ ID NO: 80893 - protein, 34 aa, Artificial Sequence
  Description of Artificial Sequence: Synthetic polypeptide
YEEEIGTTNPVATEQYGTAVFSNSNLTQRNGNRF

SEQ ID NO: 80894 - protein, 33 aa, Artificial Sequence
  Description of Artificial Sequence: Synthetic polypeptide
DEEEISTTNPVATEQYGCVCSNTEELQYGSNQG

SEQ ID NO: 80895 - protein, 30 aa, Artificial Sequence
  Description of Artificial Sequence: Synthetic polypeptide
DEEEIRTTNPVSTEIYGTVTFENLQGLGMT

SEQ ID NO: 80896 - protein, 31 aa, Artificial Sequence
  Description of Artificial Sequence: Synthetic polypeptide
DEEEIRTTNPVAYEQYGCVWTNLQGFDSDQP

SEQ ID NO: 80897 - protein, 31 aa, Artificial Sequence
  Description of Artificial Sequence: Synthetic polypeptide
YEEELRTTNPVATEQYGNVSELGQIQRTGER

SEQ ID NO: 80898 - protein, 33 aa, Artificial Sequence
  Description of Artificial Sequence: Synthetic polypeptide
YEEELRTTNPVATEFYGCVCSATSNSLTQDGNR

SEQ ID NO: 80899 - protein, 33 aa, Artificial Sequence
  Description of Artificial Sequence: Synthetic polypeptide
DEEEIRTTNPVSTEGYGSVSRTNFLENRVGFPM

SEQ ID NO: 80900 - protein, 33 aa, Artificial Sequence
  Description of Artificial Sequence: Synthetic polypeptide
DEEEIRTTNPVATEFYGIVVSGTVNFDDRIDNR

SEQ ID NO: 80901 - protein, 34 aa, Artificial Sequence
  Description of Artificial Sequence: Synthetic polypeptide
DEEEIRTTNPVATEQYGSASTTAGPNMRNGMNPR

SEQ ID NO: 80902 - protein, 28 aa, Artificial Sequence
  Description of Artificial Sequence: Synthetic peptide
YEEELASVNPVCTEQYGVVSDNLQSGNQ

SEQ ID NO: 80903 - protein, 33 aa, Artificial Sequence
  Description of Artificial Sequence: Synthetic polypeptide
DEEEIRTTNPVATEFYGSVSTGGLGEMGGNEGT

SEQ ID NO: 80904 - protein, 29 aa, Artificial Sequence
  Description of Artificial Sequence: Synthetic peptide
DENEIRTTNPVATEPWGSVITPIENRGEL

SEQ ID NO: 80905 - protein, 32 aa, Artificial Sequence
  Description of Artificial Sequence: Synthetic polypeptide
YEEEIGTTNPNYATESYGSVSPTGNGQGQGNR

SEQ ID NO: 80906 - protein, 33 aa, Artificial Sequence
  Description of Artificial Sequence: Synthetic polypeptide
DEEEIRTTNPVSTEPYGSVSSTPDGQQQRNGNH

SEQ ID NO: 80907 - protein, 30 aa, Artificial Sequence
  Description of Artificial Sequence: Synthetic polypeptide
YEEEIWTTNPVATEEYGAVSTVIAQKIGER

SEQ ID NO: 80908 - protein, 31 aa, Artificial Sequence
  Description of Artificial Sequence: Synthetic polypeptide
DEEEIRTTNPVAYEQYGCVWTNLQYFDSEQL

SEQ ID NO: 80909 - protein, 33 aa, Artificial Sequence
  Description of Artificial Sequence: Synthetic polypeptide
DEEEIRTTNPVSTEGYGSVSRTNFLERVTGQPE

SEQ ID NO: 80910 - protein, 28 aa, Artificial Sequence
  Description of Artificial Sequence: Synthetic peptide
SEEEIACVNPICTEQYGVVSENLQSGNQ

SEQ ID NO: 80911 - protein, 35 aa, Artificial Sequence
  Description of Artificial Sequence: Synthetic polypeptide
DEEEIRTTNPVAYEQYGQSTVSVTNELAQNTGGER

SEQ ID NO: 80912 - protein, 33 aa, Artificial Sequence
  Description of Artificial Sequence: Synthetic polypeptide
DEEEIRTTNPVATEGYGCVCSTGELQNFGSENQ

SEQ ID NO: 80913 - protein, 34 aa, Artificial Sequence
  Description of Artificial Sequence: Synthetic polypeptide
DEEEIRTTNPVSTEQYGSVSSTTPAGNMRNGMNR

SEQ ID NO: 80914 - protein, 31 aa, Artificial Sequence
  Description of Artificial Sequence: Synthetic polypeptide
YEEEIGTTNPVATEQYGEVETGNARQRGHEI

SEQ ID NO: 80915 - protein, 34 aa, Artificial Sequence
  Description of Artificial Sequence: Synthetic polypeptide
DEEEIRTVNPVATEQYGSTVSCTRMLSQRTVGDE

SEQ ID NO: 80916 - protein, 36 aa, Artificial Sequence
  Description of Artificial Sequence: Synthetic polypeptide
DEEEIRTTNPVATEQYGQSVPSCTPNAPQPTGNNRV

SEQ ID NO: 80917 - protein, 33 aa, Artificial Sequence
  Description of Artificial Sequence: Synthetic polypeptide
DEEEIRTTNPVATEQYGSVVSSQLTQSEFFNWG

SEQ ID NO: 80918 - protein, 32 aa, Artificial Sequence
  Description of Artificial Sequence: Synthetic polypeptide
DEEEIRTTNPVATEGYGCVCSTNDIQENGSDQ

SEQ ID NO: 80919 - protein, 31 aa, Artificial Sequence
  Description of Artificial Sequence: Synthetic polypeptide
DEEEIRCTNPVATEQYGEVSSEPAGNRNGNV

SEQ ID NO: 80920 - protein, 31 aa, Artificial Sequence
  Description of Artificial Sequence: Synthetic polypeptide
YEEEIGTTNPYADESYGSVSETHNVQGQGNR

SEQ ID NO: 80921 - protein, 32 aa, Artificial Sequence
  Description of Artificial Sequence: Synthetic polypeptide
YEEEIGTTNPYAFEQYGSVSTHNVQGPQGFNR

SEQ ID NO: 80922 - protein, 32 aa, Artificial Sequence
  Description of Artificial Sequence: Synthetic polypeptide
DEEEIRTTNPVATEPYGISCSTVNMQDLIKND

SEQ ID NO: 80923 - protein, 31 aa, Artificial Sequence
  Description of Artificial Sequence: Synthetic polypeptide
YEEEIITTNPIATEQYGSRGSTNQAQGENRT

SEQ ID NO: 80924 - protein, 29 aa, Artificial Sequence
  Description of Artificial Sequence: Synthetic peptide
SEEEIASTNPVATEQYGNVAENIMSRGQR

SEQ ID NO: 80925 - protein, 31 aa, Artificial Sequence
  Description of Artificial Sequence: Synthetic polypeptide
YEEEIVTTNPVCTEQYGVVCSTNLVESEGNQ

SEQ ID NO: 80926 - protein, 30 aa, Artificial Sequence
  Description of Artificial Sequence: Synthetic polypeptide
DEEEIRTTNPVSTEPYGTISMDIQQRNGNH

SEQ ID NO: 80927 - protein, 31 aa, Artificial Sequence
  Description of Artificial Sequence: Synthetic polypeptide
YEEEIITTNPIATEQYGSRTTNLAGNGENRT

SEQ ID NO: 80928 - protein, 31 aa, Artificial Sequence
  Description of Artificial Sequence: Synthetic polypeptide
YEEEIITTNPIATEQYGSRTTNLEAEGENRT

SEQ ID NO: 80929 - protein, 31 aa, Artificial Sequence
  Description of Artificial Sequence: Synthetic polypeptide
SEDEIRTTNPVAYEQWGEVSTNLGLGENDHR

SEQ ID NO: 80930 - protein, 32 aa, Artificial Sequence
  Description of Artificial Sequence: Synthetic polypeptide
DEAEIRTTNPVATEQYGCVSTWPLQRVEEEHM

SEQ ID NO: 80931 - protein, 33 aa, Artificial Sequence
  Description of Artificial Sequence: Synthetic polypeptide
DEEEIRTTNPVATEQYGSASMTNLDERELVLLQ

SEQ ID NO: 80932 - protein, 32 aa, Artificial Sequence
  Description of Artificial Sequence: Synthetic polypeptide
DEEEIRGTNPVATEQWGSSVSTLLIDGGNEGT

SEQ ID NO: 80933 - protein, 32 aa, Artificial Sequence
  Description of Artificial Sequence: Synthetic polypeptide
YEEEIVTTNPVATEQYGFVSSCNQYQVRGNTI

SEQ ID NO: 80934 - protein, 35 aa, Artificial Sequence
  Description of Artificial Sequence: Synthetic polypeptide
DEEEIRTTNPVAYEQYGETVSCTNLSERNGGNERH

SEQ ID NO: 80935 - protein, 34 aa, Artificial Sequence
  Description of Artificial Sequence: Synthetic polypeptide
DEEEIRTVNPVATEQYGSVSPTLLLQSGIMQNDQ

SEQ ID NO: 80936 - protein, 33 aa, Artificial Sequence
  Description of Artificial Sequence: Synthetic polypeptide
DEEEIRTTNPVATEPYGISVCFTEDLTRGGNEH

SEQ ID NO: 80937 - protein, 34 aa, Artificial Sequence
  Description of Artificial Sequence: Synthetic polypeptide
DEEEIRTTNPVATEPYGISVCSQVNLQPIIVNGR

SEQ ID NO: 80938 - protein, 32 aa, Artificial Sequence
  Description of Artificial Sequence: Synthetic polypeptide
DEAEIRTTNPVATEQYGCVSTVMLNNQGLNQE

SEQ ID NO: 80939 - protein, 34 aa, Artificial Sequence
  Description of Artificial Sequence: Synthetic polypeptide
DEEEIRTTNPVATEFYGSVSSTGLQVIEGGNEGE

SEQ ID NO: 80940 - protein, 30 aa, Artificial Sequence
  Description of Artificial Sequence: Synthetic polypeptide
AEDEIACTNPVAYEQYGEASENLQRGNGDR

SEQ ID NO: 80941 - protein, 32 aa, Artificial Sequence
  Description of Artificial Sequence: Synthetic polypeptide
YEEEIVTTNPVATEQYGFVSSCNQNQRGSNTI

SEQ ID NO: 80942 - protein, 33 aa, Artificial Sequence
  Description of Artificial Sequence: Synthetic polypeptide
DEEEIRCTNPVATEQYGSASTEPNGPNMRGMNV

SEQ ID NO: 80943 - protein, 32 aa, Artificial Sequence
  Description of Artificial Sequence: Synthetic polypeptide
DEEEIRTTNPVATEGYGCVCSTEHQSFGSNQI

SEQ ID NO: 80944 - protein, 33 aa, Artificial Sequence
  Description of Artificial Sequence: Synthetic polypeptide
DEEEIRTTNPVATEGYGCVCSTELNQNFGSNQS

SEQ ID NO: 80945 - protein, 34 aa, Artificial Sequence
  Description of Artificial Sequence: Synthetic polypeptide
AEEEIRTTNPVATEQYGSVSTVNTQGQEQGNNEN

SEQ ID NO: 80946 - protein, 33 aa, Artificial Sequence
  Description of Artificial Sequence: Synthetic polypeptide
DEEEIRTTNPVATEGYGCVCSTELQGFGSENQS

SEQ ID NO: 80947 - protein, 33 aa, Artificial Sequence
  Description of Artificial Sequence: Synthetic polypeptide
DEEEIRCTNPVATEQYGCVSMTNDNQEGFGNQS

SEQ ID NO: 80948 - protein, 33 aa, Artificial Sequence
  Description of Artificial Sequence: Synthetic polypeptide
DEEEIRCTNPVATEQYGCVSMTNDNQGGSNNQS

SEQ ID NO: 80949 - protein, 33 aa, Artificial Sequence
  Description of Artificial Sequence: Synthetic polypeptide
YEEEIGTTNPYATEQYGSVASPTHNDVQGQGNR

SEQ ID NO: 80950 - protein, 33 aa, Artificial Sequence
  Description of Artificial Sequence: Synthetic polypeptide
YEEEIGTTNPYATEQYGTSVSPTHNVQGNQGNR

SEQ ID NO: 80951 - protein, 33 aa, Artificial Sequence
  Description of Artificial Sequence: Synthetic polypeptide
DEEEIRTTNPVATEQYGSVVSPTTLDQLEIEEL

SEQ ID NO: 80952 - protein, 34 aa, Artificial Sequence
  Description of Artificial Sequence: Synthetic polypeptide
DEEEISTTNPVATEQYGCVCSMTNLQSFGSNTQV

SEQ ID NO: 80953 - protein, 31 aa, Artificial Sequence
  Description of Artificial Sequence: Synthetic polypeptide
YEEEIGTTNPYATESSGSVSPTHNTQGQGNR

SEQ ID NO: 80954 - protein, 31 aa, Artificial Sequence
  Description of Artificial Sequence: Synthetic polypeptide
DEEEIRTTNPVATEGYGCVCSTEPQSFNSNQ

SEQ ID NO: 80955 - protein, 32 aa, Artificial Sequence
  Description of Artificial Sequence: Synthetic polypeptide
YEEEIGTTNPYATESYGSVSPTGNFVQGDGNR

SEQ ID NO: 80956 - protein, 33 aa, Artificial Sequence
  Description of Artificial Sequence: Synthetic polypeptide
DEEEIRTTNPVATEPYGISCSAVNLEQDRIKND

SEQ ID NO: 80957 - protein, 34 aa, Artificial Sequence
  Description of Artificial Sequence: Synthetic polypeptide
DEEEIRTTNPVATEPYGICVSTVNLQERSISNQA

SEQ ID NO: 80958 - protein, 31 aa, Artificial Sequence
  Description of Artificial Sequence: Synthetic polypeptide
DEEEIRCTNPVATEQYGCVSWNHDNGSNNAM

SEQ ID NO: 80959 - protein, 32 aa, Artificial Sequence
  Description of Artificial Sequence: Synthetic polypeptide
YEEEIRSVNPVATEQYGSVSSTPALQMSGMNV

SEQ ID NO: 80960 - protein, 32 aa, Artificial Sequence
  Description of Artificial Sequence: Synthetic polypeptide
YEEEIGTTNPYATESYGSVWSPTHNCQGQGNR

SEQ ID NO: 80961 - protein, 32 aa, Artificial Sequence
  Description of Artificial Sequence: Synthetic polypeptide
YEEEIGYTNPYATEQYGSVSTHNVQGPQGNRV

SEQ ID NO: 80962 - protein, 33 aa, Artificial Sequence
  Description of Artificial Sequence: Synthetic polypeptide
YEEEIHNTNPVATEQYGTAVSNSNLTQRNGNRF

SEQ ID NO: 80963 - protein, 32 aa, Artificial Sequence
  Description of Artificial Sequence: Synthetic polypeptide
YEEEIHTTNPAVATEQYRGSVGSTNQVRGSTD

SEQ ID NO: 80964 - protein, 31 aa, Artificial Sequence
  Description of Artificial Sequence: Synthetic polypeptide
YEEEIHTTNPCATEGYRGSVGSTNQMRGSND

SEQ ID NO: 80965 - protein, 28 aa, Artificial Sequence
  Description of Artificial Sequence: Synthetic peptide
YEEEIISVNPVCTEQYGVVSDNLQSTNQ

SEQ ID NO: 80966 - protein, 32 aa, Artificial Sequence
  Description of Artificial Sequence: Synthetic polypeptide
DEAEIRTTNPVATEMYGISVVSTESLSDRGML

SEQ ID NO: 80967 - protein, 32 aa, Artificial Sequence
  Description of Artificial Sequence: Synthetic polypeptide
SEDEIRTTNPVATEQYGAVTCGTGNDQRAGND

SEQ ID NO: 80968 - protein, 33 aa, Artificial Sequence
  Description of Artificial Sequence: Synthetic polypeptide
DEEEISTTNPVATEQYGCVCSMTELQRFGSELS

SEQ ID NO: 80969 - protein, 30 aa, Artificial Sequence
  Description of Artificial Sequence: Synthetic polypeptide
SEDEIRSTNPVATEQYGSVFCELQHDGGNQ

SEQ ID NO: 80970 - protein, 33 aa, Artificial Sequence
  Description of Artificial Sequence: Synthetic polypeptide
DEEEIRTTNPVATEQYGSVVITMNQGEIRQGPD

SEQ ID NO: 80971 - protein, 28 aa, Artificial Sequence
  Description of Artificial Sequence: Synthetic peptide
AEDEIACTNPVAYEQYGEASENLQKGER

SEQ ID NO: 80972 - protein, 31 aa, Artificial Sequence
  Description of Artificial Sequence: Synthetic polypeptide
SEEEIATTNPVATEQYGSVATALQADGEGTN

SEQ ID NO: 80973 - protein, 30 aa, Artificial Sequence
  Description of Artificial Sequence: Synthetic polypeptide
SEEEIATTNPVATEPYGSVSGNLQHDDTSE

SEQ ID NO: 80974 - protein, 30 aa, Artificial Sequence
  Description of Artificial Sequence: Synthetic polypeptide
YEEEIRTVNPVATECWGVVSDINLPQSGNQ

SEQ ID NO: 80975 - protein, 29 aa, Artificial Sequence
  Description of Artificial Sequence: Synthetic peptide
SEECIACTNPTAYMQYGSVSENLNRGNER

SEQ ID NO: 80976 - protein, 33 aa, Artificial Sequence
  Description of Artificial Sequence: Synthetic polypeptide
DEEEIRTTNPVAYEQYGPQVSATNMLINEGDNG

SEQ ID NO: 80977 - protein, 29 aa, Artificial Sequence
  Description of Artificial Sequence: Synthetic peptide
SEEEIASVNPVCTEQYGVVSDNLQESGNQ

SEQ ID NO: 80978 - protein, 31 aa, Artificial Sequence
  Description of Artificial Sequence: Synthetic polypeptide
DENEIRTTNPVATEQWGSVSCNEPQNAEGDG

SEQ ID NO: 80979 - protein, 32 aa, Artificial Sequence
  Description of Artificial Sequence: Synthetic polypeptide
DEEEIRTTNPVATEPYGSISMEDIPQMRNGNH

SEQ ID NO: 80980 - protein, 30 aa, Artificial Sequence
  Description of Artificial Sequence: Synthetic polypeptide
DEEEIRTVNPVCTEPYGTVSMENIQSNGNH

SEQ ID NO: 80981 - protein, 32 aa, Artificial Sequence
  Description of Artificial Sequence: Synthetic polypeptide
SEEEIATTNPVATEPYGSVAATNLVDRDGNND

SEQ ID NO: 80982 - protein, 29 aa, Artificial Sequence
  Description of Artificial Sequence: Synthetic peptide
SEECIRCTNPIAYEQWGSVSENLMRGAER

SEQ ID NO: 80983 - protein, 31 aa, Artificial Sequence
  Description of Artificial Sequence: Synthetic polypeptide
SEEEIATTNPVATEPYGSVAATGLQDIDGND

SEQ ID NO: 80984 - protein, 31 aa, Artificial Sequence
  Description of Artificial Sequence: Synthetic polypeptide
YEEEIRTTNPVSTEQYGAVSLNLEGGEGVPR

SEQ ID NO: 80985 - protein, 33 aa, Artificial Sequence
  Description of Artificial Sequence: Synthetic polypeptide
DEEEIRTTNPVATEFYGSVSNNDEMQGEGGNDG

SEQ ID NO: 80986 - protein, 32 aa, Artificial Sequence
  Description of Artificial Sequence: Synthetic polypeptide
DEEEIRYTNPVATEQYGSVSSNQDDVLTLNSR

SEQ ID NO: 80987 - protein, 32 aa, Artificial Sequence
  Description of Artificial Sequence: Synthetic polypeptide
AEEEIRTTNPVATEQYGSVSTVQQQQQTNNNM

SEQ ID NO: 80988 - protein, 31 aa, Artificial Sequence
  Description of Artificial Sequence: Synthetic polypeptide
YEEEIRQTNPVATEEYGAVSTVNAQKIGSER

SEQ ID NO: 80989 - protein, 32 aa, Artificial Sequence
  Description of Artificial Sequence: Synthetic polypeptide
DEEEIRYTNPVATEQYGSVSLVNQIDLTSNSR

SEQ ID NO: 80990 - protein, 35 aa, Artificial Sequence
  Description of Artificial Sequence: Synthetic polypeptide
AEEEIRTTNPVATEQYGSVSTVSGTNLQQGTNQSQ

SEQ ID NO: 80991 - protein, 32 aa, Artificial Sequence
  Description of Artificial Sequence: Synthetic polypeptide
DEEEIRTTNPVATEPYGVVVVTVNLQQETENS

SEQ ID NO: 80992 - protein, 32 aa, Artificial Sequence
  Description of Artificial Sequence: Synthetic polypeptide
DEEEIRYTNPVATEQYGSVSEVNQDTVTSNSR

SEQ ID NO: 80993 - protein, 33 aa, Artificial Sequence
  Description of Artificial Sequence: Synthetic polypeptide
DEEEIRTTNPVATEQYGSVVPEAVEIQRPENRL

SEQ ID NO: 80994 - protein, 35 aa, Artificial Sequence
  Description of Artificial Sequence: Synthetic polypeptide
DEEEIRTTNPVATEQYGSVTSTMNTLGMEGGNGGT

SEQ ID NO: 80995 - protein, 32 aa, Artificial Sequence
  Description of Artificial Sequence: Synthetic polypeptide
AEEEIRTTNPVATEQYGSVSTVQQQQQTNANE

SEQ ID NO: 80996 - protein, 33 aa, Artificial Sequence
  Description of Artificial Sequence: Synthetic polypeptide
DEEEIRTTNPVSTEQYGIVSSTTPAGNMRNGNR

SEQ ID NO: 80997 - protein, 30 aa, Artificial Sequence
  Description of Artificial Sequence: Synthetic polypeptide
SEEEIATTNPVATEQWGSVAAAPLQQGNEH

SEQ ID NO: 80998 - protein, 32 aa, Artificial Sequence
  Description of Artificial Sequence: Synthetic polypeptide
SEEEIATTNPVATEQYGCVSGTMNLQHQDDNP

SEQ ID NO: 80999 - protein, 32 aa, Artificial Sequence
  Description of Artificial Sequence: Synthetic polypeptide
DEEEIRTTNPVAYEQYGQCVSSEDLEQRGSQQ

SEQ ID NO: 81000 - protein, 34 aa, Artificial Sequence
  Description of Artificial Sequence: Synthetic polypeptide
DEEEIRTTNPVAYEQYGNVPSTNEISQTTTGNYR

SEQ ID NO: 81001 - protein, 31 aa, Artificial Sequence
  Description of Artificial Sequence: Synthetic polypeptide
DENEIRTTNPVATEQWGDVSANIEQNRVEQR

SEQ ID NO: 81002 - protein, 31 aa, Artificial Sequence
  Description of Artificial Sequence: Synthetic polypeptide
YEEEIRATNPVATEQYGNAWASTNLQETNFD

SEQ ID NO: 81003 - protein, 32 aa, Artificial Sequence
  Description of Artificial Sequence: Synthetic polypeptide
YEEEIRWTTNPVATEEYGMAVSTMNAQKYGER

SEQ ID NO: 81004 - protein, 28 aa, Artificial Sequence
  Description of Artificial Sequence: Synthetic peptide
SEEEIASVNPVCTEQYGVVSDHLQSGNQ

SEQ ID NO: 81005 - protein, 32 aa, Artificial Sequence
  Description of Artificial Sequence: Synthetic polypeptide
YEEEIRATNPVATEQYGSVMTTNIIALGEINR

SEQ ID NO: 81006 - protein, 34 aa, Artificial Sequence
  Description of Artificial Sequence: Synthetic polypeptide
DEEEIRTTNPVATEQYGSASPTENHIQMRYANTE

SEQ ID NO: 81007 - protein, 34 aa, Artificial Sequence
  Description of Artificial Sequence: Synthetic polypeptide
DEEEIRTTNPVATEQYGSASPTENHIQIVYGNVE

SEQ ID NO: 81008 - protein, 33 aa, Artificial Sequence
  Description of Artificial Sequence: Synthetic polypeptide
SEEEIATTNPVATEAYGSVVSCTNLSQKTGQER

SEQ ID NO: 81009 - protein, 33 aa, Artificial Sequence
  Description of Artificial Sequence: Synthetic polypeptide
DEEEIRTTNPVATEQYGSVVLTNQQDRLTVLQL

SEQ ID NO: 81010 - protein, 31 aa, Artificial Sequence
  Description of Artificial Sequence: Synthetic polypeptide
YEEEIRTVNPVATEQYGSVSTLTNTRFGTSN

SEQ ID NO: 81011 - protein, 32 aa, Artificial Sequence
  Description of Artificial Sequence: Synthetic polypeptide
SEEEIATTNPVATEQYGCVAAATNLQEAGNVN

SEQ ID NO: 81012 - protein, 32 aa, Artificial Sequence
  Description of Artificial Sequence: Synthetic polypeptide
DEAEIRTTNPVATEQWGAVSTNLNGNAGENEA

SEQ ID NO: 81013 - protein, 33 aa, Artificial Sequence
  Description of Artificial Sequence: Synthetic polypeptide
DEAEIRTTNPVATEQWGAVSTNLNGNAGENSSR

SEQ ID NO: 81014 - protein, 30 aa, Artificial Sequence
  Description of Artificial Sequence: Synthetic polypeptide
DEAEIRTTNPVATEQYGCVCSWNHINNSNQ

SEQ ID NO: 81015 - protein, 30 aa, Artificial Sequence
  Description of Artificial Sequence: Synthetic polypeptide
DEEEIRTTNPVSTEQWGSVTGDNHQGGGQT

SEQ ID NO: 81016 - protein, 33 aa, Artificial Sequence
  Description of Artificial Sequence: Synthetic polypeptide
YEEEIRATNPVATEQYGTAVSNSNLTQRNGYRF

SEQ ID NO: 81017 - protein, 30 aa, Artificial Sequence
  Description of Artificial Sequence: Synthetic polypeptide
DENEIRTTNPVATEQWGSVSEIEMNAAGNA

SEQ ID NO: 81018 - protein, 31 aa, Artificial Sequence
  Description of Artificial Sequence: Synthetic polypeptide
DENEIRTTNPVATEQWGSVSCINEMNRAENG

SEQ ID NO: 81019 - protein, 30 aa, Artificial Sequence
  Description of Artificial Sequence: Synthetic polypeptide
SEEEIATTNPVATEQWGSVAITNDQGEGPQ

SEQ ID NO: 81020 - protein, 33 aa, Artificial Sequence
  Description of Artificial Sequence: Synthetic polypeptide
DEEEIRCTNPVATEQYGSASSTENGPNMRGGPR

SEQ ID NO: 81021 - protein, 35 aa, Artificial Sequence
  Description of Artificial Sequence: Synthetic polypeptide
DEEEIRTTNPVAYEQYGNTVPSTNAQSQRPGGNQR

SEQ ID NO: 81022 - protein, 32 aa, Artificial Sequence
  Description of Artificial Sequence: Synthetic polypeptide
DENEIRTTNPVATEPYGTVSMENIQMQRNGNH

SEQ ID NO: 81023 - protein, 32 aa, Artificial Sequence
  Description of Artificial Sequence: Synthetic polypeptide
DENEIRTTNPVATEPYGTVSMENIQQQRNGNH

SEQ ID NO: 81024 - protein, 30 aa, Artificial Sequence
  Description of Artificial Sequence: Synthetic polypeptide
DEEEIRTVNPVSTEPYGTVSMENIQSNGNH

SEQ ID NO: 81025 - protein, 31 aa, Artificial Sequence
  Description of Artificial Sequence: Synthetic polypeptide
DEEEIRTTNPVSTEQYGCVCQSNLQGGSQQG

SEQ ID NO: 81026 - protein, 34 aa, Artificial Sequence
  Description of Artificial Sequence: Synthetic polypeptide
DEEEIRTTNPVATEQYGSASPMDNPLQPRVENNE

SEQ ID NO: 81027 - protein, 34 aa, Artificial Sequence
  Description of Artificial Sequence: Synthetic polypeptide
YEEEIRTTNPVGTEQYGAVALNTNLQCRGVNDRY

SEQ ID NO: 81028 - protein, 33 aa, Artificial Sequence
  Description of Artificial Sequence: Synthetic polypeptide
DEEEIRTTNPVATEQYGQSVCSTEHQNSGSDQP

SEQ ID NO: 81029 - protein, 34 aa, Artificial Sequence
  Description of Artificial Sequence: Synthetic polypeptide
DEAEIRTTNPVATEQWGHSNVSYTNELQHRGGEF

SEQ ID NO: 81030 - protein, 33 aa, Artificial Sequence
  Description of Artificial Sequence: Synthetic polypeptide
DEEEIRTTNPVATEQYGQSVCSTEHQSMGSEQL

SEQ ID NO: 81031 - protein, 34 aa, Artificial Sequence
  Description of Artificial Sequence: Synthetic polypeptide
DEEEIRTTNPVATEFYGSVSDTDLIQRGIQEGGQ

SEQ ID NO: 81032 - protein, 33 aa, Artificial Sequence
  Description of Artificial Sequence: Synthetic polypeptide
DEEEIRTTNPVATEQYGSASPDVLVQEGQEDNS

SEQ ID NO: 81033 - protein, 28 aa, Artificial Sequence
  Description of Artificial Sequence: Synthetic peptide
YEEEIRSTNPVATEQYGVVSDNEMAEDQ

SEQ ID NO: 81034 - protein, 34 aa, Artificial Sequence
  Description of Artificial Sequence: Synthetic polypeptide
AEEEIRTTNPVATEQYGSVSTVSNQQQQNGEINT

SEQ ID NO: 81035 - protein, 33 aa, Artificial Sequence
  Description of Artificial Sequence: Synthetic polypeptide
DEEEIRTTNPVATEFYGSVSGTNGQQGEGGGGE

SEQ ID NO: 81036 - protein, 35 aa, Artificial Sequence
  Description of Artificial Sequence: Synthetic polypeptide
DEEEIRTTNPVATEQYGSASPMDNPLIQPRLGENN

SEQ ID NO: 81037 - protein, 33 aa, Artificial Sequence
  Description of Artificial Sequence: Synthetic polypeptide
AEEEIRTTNPVATEQYGSVSTVSNVNQNEENEE

SEQ ID NO: 81038 - protein, 30 aa, Artificial Sequence
  Description of Artificial Sequence: Synthetic polypeptide
YEEEIRSTNPVATEQWGVVWSNDNLQSGPQ

SEQ ID NO: 81039 - protein, 29 aa, Artificial Sequence
  Description of Artificial Sequence: Synthetic peptide
DENEIRTTNPVATEQWGDASENEMRAEGR

SEQ ID NO: 81040 - protein, 31 aa, Artificial Sequence
  Description of Artificial Sequence: Synthetic polypeptide
DENEIRTTNPVATEQWGSVSEAGNMRNGMNA

SEQ ID NO: 81041 - protein, 32 aa, Artificial Sequence
  Description of Artificial Sequence: Synthetic polypeptide
YEEEIRSTNPVATEQYGSVSTLTGNTRFGTRN

SEQ ID NO: 81042 - protein, 30 aa, Artificial Sequence
  Description of Artificial Sequence: Synthetic polypeptide
DENEIRTTNPVATEQWGSVSEAGMNAAGNV

SEQ ID NO: 81043 - protein, 32 aa, Artificial Sequence
  Description of Artificial Sequence: Synthetic polypeptide
DEEEIRGTNPVATEQYGNVLMTVEVQVGENRI

SEQ ID NO: 81044 - protein, 30 aa, Artificial Sequence
  Description of Artificial Sequence: Synthetic polypeptide
DENEIRTTNPVATEQWGSVSEAGMNAAGNA

SEQ ID NO: 81045 - protein, 31 aa, Artificial Sequence
  Description of Artificial Sequence: Synthetic polypeptide
DEEEIRTTNPVSTEQYGCVCQSMELQGGSQQ

SEQ ID NO: 81046 - protein, 28 aa, Artificial Sequence
  Description of Artificial Sequence: Synthetic peptide
SEEEIATTNPIATEQYGEASEVLQHENK

SEQ ID NO: 81047 - protein, 28 aa, Artificial Sequence
  Description of Artificial Sequence: Synthetic peptide
SEEEIATTNPIATEQYGEVPEVCMRGER

SEQ ID NO: 81048 - protein, 28 aa, Artificial Sequence
  Description of Artificial Sequence: Synthetic peptide
YEEEIRSTNPVATEQYGVVSDNEMSEDQ

SEQ ID NO: 81049 - protein, 29 aa, Artificial Sequence
  Description of Artificial Sequence: Synthetic peptide
SEEEIASVNPVCTEQYGVVSDNLQSIGNQ

SEQ ID NO: 81050 - protein, 35 aa, Artificial Sequence
  Description of Artificial Sequence: Synthetic polypeptide
DEEEIRTTNPVATEPYGVSAVNTNQLNQAANGNRR

SEQ ID NO: 81051 - protein, 31 aa, Artificial Sequence
  Description of Artificial Sequence: Synthetic polypeptide
DEEEIRTVNPVCTEQYGVVSDINEQSEGENG

SEQ ID NO: 81052 - protein, 31 aa, Artificial Sequence
  Description of Artificial Sequence: Synthetic polypeptide
DEEEIRTVNPVCTEQYGVVSDINEQSEGENQ

SEQ ID NO: 81053 - protein, 28 aa, Artificial Sequence
  Description of Artificial Sequence: Synthetic peptide
SEEEIASVNPVCTEQYGVVSDRLQSGNQ

SEQ ID NO: 81054 - protein, 34 aa, Artificial Sequence
  Description of Artificial Sequence: Synthetic polypeptide
DEEEIRTTNPVATEQYGSASPMVLSQRDGEEDNI

SEQ ID NO: 81055 - protein, 34 aa, Artificial Sequence
  Description of Artificial Sequence: Synthetic polypeptide
DEEEIRVTNPVATEQYGSVCSGVNDQDRQGSGSR

SEQ ID NO: 81056 - protein, 34 aa, Artificial Sequence
  Description of Artificial Sequence: Synthetic polypeptide
DEEEIRTTNPVATEQYGSVVNTFNLIGGGEGQTR

SEQ ID NO: 81057 - protein, 33 aa, Artificial Sequence
  Description of Artificial Sequence: Synthetic polypeptide
DEEEIRTTNPVATEQYGSVVNTFNLEGGGGQTS

SEQ ID NO: 81058 - protein, 33 aa, Artificial Sequence
  Description of Artificial Sequence: Synthetic polypeptide
DEEEIRTTNPVATEQYGSVVNTFDLGGGGQTER

SEQ ID NO: 81059 - protein, 32 aa, Artificial Sequence
  Description of Artificial Sequence: Synthetic polypeptide
DEEEIRTTNPVATEQYGSASPMVVSVRGEDNY

SEQ ID NO: 81060 - protein, 31 aa, Artificial Sequence
  Description of Artificial Sequence: Synthetic polypeptide
SEEEIATTNPIATEQYGSVSATDLEDRGEDL

SEQ ID NO: 81061 - protein, 33 aa, Artificial Sequence
  Description of Artificial Sequence: Synthetic polypeptide
DEEEIRTTNPVATEQYGSASPMVLIVRDGEDND

SEQ ID NO: 81062 - protein, 31 aa, Artificial Sequence
  Description of Artificial Sequence: Synthetic polypeptide
SEEEIATTNPIATEQYGSVSAEDLMDHEGNR

SEQ ID NO: 81063 - protein, 35 aa, Artificial Sequence
  Description of Artificial Sequence: Synthetic polypeptide
DEEEIRTTNPVATEQYGQSVCSDTNHQNFGSNNQP

SEQ ID NO: 81064 - protein, 31 aa, Artificial Sequence
  Description of Artificial Sequence: Synthetic polypeptide
SEEEIATTNPIATEQYGSVSAEDLEDHEGNR

SEQ ID NO: 81065 - protein, 32 aa, Artificial Sequence
  Description of Artificial Sequence: Synthetic polypeptide
DEEEIRTTNPVATEPYGVVVTTVNLQDEINNE

SEQ ID NO: 81066 - protein, 28 aa, Artificial Sequence
  Description of Artificial Sequence: Synthetic peptide
SEEEIATTNPIATEQYGEVSEVCQHEER

SEQ ID NO: 81067 - protein, 35 aa, Artificial Sequence
  Description of Artificial Sequence: Synthetic polypeptide
DEEEIRGTNPVATEQYGSVISDTDLIQRGIQNGGQ

SEQ ID NO: 81068 - protein, 33 aa, Artificial Sequence
  Description of Artificial Sequence: Synthetic polypeptide
DEEEIRTTNPVATEPYGVVVTTVNLQDEIGNNL

SEQ ID NO: 81069 - protein, 28 aa, Artificial Sequence
  Description of Artificial Sequence: Synthetic peptide
SEEEIATTNPIATEQYGEVSENCMHEER

SEQ ID NO: 81070 - protein, 28 aa, Artificial Sequence
  Description of Artificial Sequence: Synthetic peptide
SEEEIATTNPIATEQYGEVPEVCQHGER

SEQ ID NO: 81071 - protein, 32 aa, Artificial Sequence
  Description of Artificial Sequence: Synthetic polypeptide
DEEEIRTTNPVATEPYGVVVVTVNLQDEEENA

SEQ ID NO: 81072 - protein, 33 aa, Artificial Sequence
  Description of Artificial Sequence: Synthetic polypeptide
DEEEISCTNPVATEQYGCVCSTNLQENFGSNQS

SEQ ID NO: 81073 - protein, 32 aa, Artificial Sequence
  Description of Artificial Sequence: Synthetic polypeptide
DEEEISCTNPVATEQYGCVSMTNDFQGGSNQS

SEQ ID NO: 81074 - protein, 32 aa, Artificial Sequence
  Description of Artificial Sequence: Synthetic polypeptide
DEEEIRCTNPVATEQYGSASSENGPNMRGGPR

SEQ ID NO: 81075 - protein, 33 aa, Artificial Sequence
  Description of Artificial Sequence: Synthetic polypeptide
DEEEIRTVNPVAYEQYGSTVSCTPLSQRTNGEE

SEQ ID NO: 81076 - protein, 30 aa, Artificial Sequence
  Description of Artificial Sequence: Synthetic polypeptide
DENEIRTTNPVATEQWGSVSEILMNAAENA

SEQ ID NO: 81077 - protein, 32 aa, Artificial Sequence
  Description of Artificial Sequence: Synthetic polypeptide
SEEEIATTNPVATEQYGSVAITNDQREGPEQV

SEQ ID NO: 81078 - protein, 32 aa, Artificial Sequence
  Description of Artificial Sequence: Synthetic polypeptide
SEEEIATTNPVATEQYGSVAITNDQGEGNDQL

SEQ ID NO: 81079 - protein, 33 aa, Artificial Sequence
  Description of Artificial Sequence: Synthetic polypeptide
DEEEIRTTNPVATEQYGSVVITMNQQNRQVPLN

SEQ ID NO: 81080 - protein, 28 aa, Artificial Sequence
  Description of Artificial Sequence: Synthetic peptide
YEEEINSVNPVCTDQYGVVSDNLQSGNQ

SEQ ID NO: 81081 - protein, 35 aa, Artificial Sequence
  Description of Artificial Sequence: Synthetic polypeptide
DEEEIRTTNPVATEPYGISVSTVNEFSQDRVTNNR

SEQ ID NO: 81082 - protein, 32 aa, Artificial Sequence
  Description of Artificial Sequence: Synthetic polypeptide
DEAEIRTTNPVATEQFGTIVSTYLLREGNEIN

SEQ ID NO: 81083 - protein, 29 aa, Artificial Sequence
  Description of Artificial Sequence: Synthetic peptide
DENEIRTTNPVATEQWGSVSEILMAAEDA

SEQ ID NO: 81084 - protein, 28 aa, Artificial Sequence
  Description of Artificial Sequence: Synthetic peptide
AEAEIACTNPVATEQYGEACENLQRGGD

SEQ ID NO: 81085 - protein, 29 aa, Artificial Sequence
  Description of Artificial Sequence: Synthetic peptide
AEAEIACTNPVATEQYGEASENSQRGGGR

SEQ ID NO: 81086 - protein, 28 aa, Artificial Sequence
  Description of Artificial Sequence: Synthetic peptide
YEEEINSVNPVCTEQYGVISDNLQSGNQ

SEQ ID NO: 81087 - protein, 29 aa, Artificial Sequence
  Description of Artificial Sequence: Synthetic peptide
SEECIACTNPTAYEQYGSVSANLMRGAER

SEQ ID NO: 81088 - protein, 32 aa, Artificial Sequence
  Description of Artificial Sequence: Synthetic polypeptide
DEEEIRTTNPVATEQYGSVVITMSGQRQVPDN

SEQ ID NO: 81089 - protein, 34 aa, Artificial Sequence
  Description of Artificial Sequence: Synthetic polypeptide
DEEEIRTTNPVAYEQYGKVASCITNEWSNRGTNR

SEQ ID NO: 81090 - protein, 32 aa, Artificial Sequence
  Description of Artificial Sequence: Synthetic polypeptide
DEEEIRGTNPVATEQYGSVSVVQDTHGSNSRN

SEQ ID NO: 81091 - protein, 31 aa, Artificial Sequence
  Description of Artificial Sequence: Synthetic polypeptide
DENEIRTTNPVATEPYGTASEENLQQQNGGR

SEQ ID NO: 81092 - protein, 32 aa, Artificial Sequence
  Description of Artificial Sequence: Synthetic polypeptide
DEEEIRGTNPVATEQYGSVSVVGDRQVSNNRV

SEQ ID NO: 81093 - protein, 32 aa, Artificial Sequence
  Description of Artificial Sequence: Synthetic polypeptide
DEEEIRGTNPVATEQYGSVSVVGDRQISNARN

SEQ ID NO: 81094 - protein, 32 aa, Artificial Sequence
  Description of Artificial Sequence: Synthetic polypeptide
YEEEIRSTNPVCTEQYGVVSSDPNLPQRNGNQ

SEQ ID NO: 81095 - protein, 34 aa, Artificial Sequence
  Description of Artificial Sequence: Synthetic polypeptide
DEEEIRTTNPVAYEQYGKVCSYTNPSQQAGGNPR

SEQ ID NO: 81096 - protein, 32 aa, Artificial Sequence
  Description of Artificial Sequence: Synthetic polypeptide
DEEEISTTNPVATEAWGISVSTGNLSGRGGTE

SEQ ID NO: 81097 - protein, 32 aa, Artificial Sequence
  Description of Artificial Sequence: Synthetic polypeptide
SEEEIATTNPVATEQYGSVAITNLTAEGGNEE

SEQ ID NO: 81098 - protein, 32 aa, Artificial Sequence
  Description of Artificial Sequence: Synthetic polypeptide
DEEEIRTTNPVSTEQYGSTVACQNLSQGGGQT

SEQ ID NO: 81099 - protein, 30 aa, Artificial Sequence
  Description of Artificial Sequence: Synthetic polypeptide
DENEIRTTNPVATEQWGSVSENEMNAAEDR

SEQ ID NO: 81100 - protein, 30 aa, Artificial Sequence
  Description of Artificial Sequence: Synthetic polypeptide
SEEEIATTNPVATEQYGSVATALIGNDMND

SEQ ID NO: 81101 - protein, 28 aa, Artificial Sequence
  Description of Artificial Sequence: Synthetic peptide
YEEEITSVNPVCTEQYGVVSDNQQSGNQ

SEQ ID NO: 81102 - protein, 30 aa, Artificial Sequence
  Description of Artificial Sequence: Synthetic polypeptide
YEEEILTTNPVATEEYGAVSTVNAQKIGEE

SEQ ID NO: 81103 - protein, 31 aa, Artificial Sequence
  Description of Artificial Sequence: Synthetic polypeptide
SEEEIATTNPVATEQYGSVATADQAGEPTRH

SEQ ID NO: 81104 - protein, 32 aa, Artificial Sequence
  Description of Artificial Sequence: Synthetic polypeptide
DEEEISTTNPVATEAYGSVVDTSNSQNTNGPR

SEQ ID NO: 81105 - protein, 34 aa, Artificial Sequence
  Description of Artificial Sequence: Synthetic polypeptide
DEEEIRTTNPVATEFYGSVSNTDNGEQNEGGNGG

SEQ ID NO: 81106 - protein, 34 aa, Artificial Sequence
  Description of Artificial Sequence: Synthetic polypeptide
DEEEISTTNPVATEAYGSVSVTNAGQPPGGDNRA

SEQ ID NO: 81107 - protein, 32 aa, Artificial Sequence
  Description of Artificial Sequence: Synthetic polypeptide
DENEIRTTNPVATEPYGSVCFTLNLTLGGENQ

SEQ ID NO: 81108 - protein, 32 aa, Artificial Sequence
  Description of Artificial Sequence: Synthetic polypeptide
SEEEIATTNPVATEQYGSVAMNLNDRNLNERN

SEQ ID NO: 81109 - protein, 31 aa, Artificial Sequence
  Description of Artificial Sequence: Synthetic polypeptide
SEEEIATTNPVATEQYGSVAMNLNDNNNGRP

SEQ ID NO: 81110 - protein, 33 aa, Artificial Sequence
  Description of Artificial Sequence: Synthetic polypeptide
AEEEIRTTNPVATEQYGSVSTVQQGNNDNGNSD

SEQ ID NO: 81111 - protein, 32 aa, Artificial Sequence
  Description of Artificial Sequence: Synthetic polypeptide
DEEEIRTTNPVATEQYGQCVCSWMELINGSNQ

SEQ ID NO: 81112 - protein, 34 aa, Artificial Sequence
  Description of Artificial Sequence: Synthetic polypeptide
YEEEISTTNPVATEQYGTAVSNSNLTQHRNGNRF

SEQ ID NO: 81113 - protein, 32 aa, Artificial Sequence
  Description of Artificial Sequence: Synthetic polypeptide
YEEEIMTTNPVATEQYDSDVLHTNLQENAGWR

SEQ ID NO: 81114 - protein, 31 aa, Artificial Sequence
  Description of Artificial Sequence: Synthetic polypeptide
SEEEIATTNPVATEQYGSVAMNLNDNGGERP

SEQ ID NO: 81115 - protein, 33 aa, Artificial Sequence
  Description of Artificial Sequence: Synthetic polypeptide
DEEEIRTTNPVATEQYGQCVCSWNHQFFGSENQ

SEQ ID NO: 81116 - protein, 33 aa, Artificial Sequence
  Description of Artificial Sequence: Synthetic polypeptide
YEEEIMTTNPVATEQYGCVCSANSNSLTQDGNR

SEQ ID NO: 81117 - protein, 35 aa, Artificial Sequence
  Description of Artificial Sequence: Synthetic polypeptide
DEEEIRTVNPVATEQYGSVSSTTPALPQMRNGMNV

SEQ ID NO: 81118 - protein, 33 aa, Artificial Sequence
  Description of Artificial Sequence: Synthetic polypeptide
DEEEIRTTNPVATEQYGSVVSAVDLQRFEEQFT

SEQ ID NO: 81119 - protein, 33 aa, Artificial Sequence
  Description of Artificial Sequence: Synthetic polypeptide
DEEEIRTTNPVATEQYGQCVCSWNHQRFGSEQL

SEQ ID NO: 81120 - protein, 33 aa, Artificial Sequence
  Description of Artificial Sequence: Synthetic polypeptide
DEEEIRTTNPVATEQYGQCVCSWNLQFFNSEDY

SEQ ID NO: 81121 - protein, 32 aa, Artificial Sequence
  Description of Artificial Sequence: Synthetic polypeptide
DEEEIRTVNPVATEQYGSVSTGGQGGDDEQGE

SEQ ID NO: 81122 - protein, 32 aa, Artificial Sequence
  Description of Artificial Sequence: Synthetic polypeptide
YEEEIMTTNPVATECQYGSVTPSWILIRNNPR

SEQ ID NO: 81123 - protein, 32 aa, Artificial Sequence
  Description of Artificial Sequence: Synthetic polypeptide
DEEEISTTNPCATEQYGSVITNPLDFNGNNVI

SEQ ID NO: 81124 - protein, 31 aa, Artificial Sequence
  Description of Artificial Sequence: Synthetic polypeptide
YEEEISTTNPVATEQYGFVSELGNEQRWGEF

SEQ ID NO: 81125 - protein, 30 aa, Artificial Sequence
  Description of Artificial Sequence: Synthetic polypeptide
SEECIACTNPTAYEQYGSVSENLARGNERP

SEQ ID NO: 81126 - protein, 31 aa, Artificial Sequence
  Description of Artificial Sequence: Synthetic polypeptide
DEAEIRTTNPVATEQFGTSVSTYLLGGQIDS

SEQ ID NO: 81127 - protein, 31 aa, Artificial Sequence
  Description of Artificial Sequence: Synthetic polypeptide
DENEIRTTNPVATEQWGSVSCIIEQNRAENA

SEQ ID NO: 81128 - protein, 29 aa, Artificial Sequence
  Description of Artificial Sequence: Synthetic peptide
SEECIACTNPTAYEQYGSVSQNLMAGNER

SEQ ID NO: 81129 - protein, 34 aa, Artificial Sequence
  Description of Artificial Sequence: Synthetic polypeptide
DEEEIRTTNPVAYEQYGKVSYTNPSQYAGGNPRC

SEQ ID NO: 81130 - protein, 28 aa, Artificial Sequence
  Description of Artificial Sequence: Synthetic peptide
SEEEIATTNPVATEQYGEAPEVCQRENK

SEQ ID NO: 81131 - protein, 33 aa, Artificial Sequence
  Description of Artificial Sequence: Synthetic polypeptide
DEEEIRTTNPVAYEQYGKVSYTNQSQQTGGNPM

SEQ ID NO: 81132 - protein, 31 aa, Artificial Sequence
  Description of Artificial Sequence: Synthetic polypeptide
DEAEIRTTNPVATEQFGTSVSTYLTLGGQES

SEQ ID NO: 81133 - protein, 32 aa, Artificial Sequence
  Description of Artificial Sequence: Synthetic polypeptide
DEEEIRGTNPVATEQYGSVSGVNQDGGGENST

SEQ ID NO: 81134 - protein, 33 aa, Artificial Sequence
  Description of Artificial Sequence: Synthetic polypeptide
DEEEIRGTNPVATEQYGSVSGVNGQDGEGQNST

SEQ ID NO: 81135 - protein, 32 aa, Artificial Sequence
  Description of Artificial Sequence: Synthetic polypeptide
DEEEIRTTNPVSTEQWGSVPTIDNLQDGGQTE

SEQ ID NO: 81136 - protein, 29 aa, Artificial Sequence
  Description of Artificial Sequence: Synthetic peptide
SEECIACTNPTAYEQYGSVSPNLMRGNEM

SEQ ID NO: 81137 - protein, 35 aa, Artificial Sequence
  Description of Artificial Sequence: Synthetic polypeptide
DEEEIRTTNPVATEQYGSASPTFNHIEPRHGNAQR

SEQ ID NO: 81138 - protein, 34 aa, Artificial Sequence
  Description of Artificial Sequence: Synthetic polypeptide
DEEEIRTTNPVAYEQYGQCVSSGNDLDQRFGSQR

SEQ ID NO: 81139 - protein, 29 aa, Artificial Sequence
  Description of Artificial Sequence: Synthetic peptide
YEEEIRTTNPVCTEQWGVVSENEQAAGDA

SEQ ID NO: 81140 - protein, 31 aa, Artificial Sequence
  Description of Artificial Sequence: Synthetic polypeptide
DEEEIRTVNPVCTECWGSVSCNLPQDSGENG

SEQ ID NO: 81141 - protein, 34 aa, Artificial Sequence
  Description of Artificial Sequence: Synthetic polypeptide
DEEEIRTTNPVAYEQYGKVVSYTNHDQQAGGNPR

SEQ ID NO: 81142 - protein, 30 aa, Artificial Sequence
  Description of Artificial Sequence: Synthetic polypeptide
SEECIACTNPTAYEQYGSVSVNLMRGNERF

SEQ ID NO: 81143 - protein, 28 aa, Artificial Sequence
  Description of Artificial Sequence: Synthetic peptide
YEEEISSVNPVCTAQYGVVSDNLQSGNQ

SEQ ID NO: 81144 - protein, 33 aa, Artificial Sequence
  Description of Artificial Sequence: Synthetic polypeptide
AEAEIRTTNPVATEQYGSVPSCTNMLSTNGGPR

SEQ ID NO: 81145 - protein, 31 aa, Artificial Sequence
  Description of Artificial Sequence: Synthetic polypeptide
DEAEIRTTNPVATEQYGCVCSWNLTNFNSDQ

SEQ ID NO: 81146 - protein, 31 aa, Artificial Sequence
  Description of Artificial Sequence: Synthetic polypeptide
DEEEISSTNPVATEQYGDVASMELCVDGENR

SEQ ID NO: 81147 - protein, 32 aa, Artificial Sequence
  Description of Artificial Sequence: Synthetic polypeptide
AEAEIRTTNPVATEQYGSVSSTMLPFNEQNRP

SEQ ID NO: 81148 - protein, 33 aa, Artificial Sequence
  Description of Artificial Sequence: Synthetic polypeptide
DEEEIRTTNPVAYEQYGKVSYTNWSQQAGGNPV

SEQ ID NO: 81149 - protein, 29 aa, Artificial Sequence
  Description of Artificial Sequence: Synthetic peptide
DENEIRTTNPVATEQWGDVSCNEMSAGTA

SEQ ID NO: 81150 - protein, 33 aa, Artificial Sequence
  Description of Artificial Sequence: Synthetic polypeptide
DEEEISTTNPCATEQYGCVCPTNLNQERGSNPQ

SEQ ID NO: 81151 - protein, 29 aa, Artificial Sequence
  Description of Artificial Sequence: Synthetic peptide
SEEEIASVNPVCTEQYGKVSDNLQSTGNQ

SEQ ID NO: 81152 - protein, 31 aa, Artificial Sequence
  Description of Artificial Sequence: Synthetic polypeptide
YEEEIRSTNPVCTEQYGVVSSDNLPQSNGNQ

SEQ ID NO: 81153 - protein, 29 aa, Artificial Sequence
  Description of Artificial Sequence: Synthetic peptide
SEECIACTNPTAYEQYGSVSENLMRGNDS

SEQ ID NO: 81154 - protein, 31 aa, Artificial Sequence
  Description of Artificial Sequence: Synthetic polypeptide
DENEIRTTNPVATEQWGSVSEIIEMNRAGNA

SEQ ID NO: 81155 - protein, 33 aa, Artificial Sequence
  Description of Artificial Sequence: Synthetic polypeptide
DEEEIRTTNPVATEGYGCVCSNTGELQSFGSNQ

SEQ ID NO: 81156 - protein, 34 aa, Artificial Sequence
  Description of Artificial Sequence: Synthetic polypeptide
DEEEIRTTNPVATEQYGSASPTNLIQMIEDEDRQ

SEQ ID NO: 81157 - protein, 32 aa, Artificial Sequence
  Description of Artificial Sequence: Synthetic polypeptide
YEEEISTTNPVATEQYGAVVEPTNANQCVGNR

SEQ ID NO: 81158 - protein, 33 aa, Artificial Sequence
  Description of Artificial Sequence: Synthetic polypeptide
DEEEIRTTNPVAYEQYGQCVSTTEDLNQRGSEQ

SEQ ID NO: 81159 - protein, 31 aa, Artificial Sequence
  Description of Artificial Sequence: Synthetic polypeptide
DENEIRTTNPVATEQWGSVSEIGNMRNGMNA

SEQ ID NO: 81160 - protein, 34 aa, Artificial Sequence
  Description of Artificial Sequence: Synthetic polypeptide
DEEEIRTTNPVATEQYGQCVSTEYVLLQARLNPD

SEQ ID NO: 81161 - protein, 28 aa, Artificial Sequence
  Description of Artificial Sequence: Synthetic peptide
SEEEIATTNPVATEQYGEASEVCQHEER

SEQ ID NO: 81162 - protein, 33 aa, Artificial Sequence
  Description of Artificial Sequence: Synthetic polypeptide
DEEEIRTTNPVATEPYGISVSTVVLQDLTIKND

SEQ ID NO: 81163 - protein, 33 aa, Artificial Sequence
  Description of Artificial Sequence: Synthetic polypeptide
DEEEISTTNPCATEQYGCVCPTNLQERIGSNGQ

SEQ ID NO: 81164 - protein, 31 aa, Artificial Sequence
  Description of Artificial Sequence: Synthetic polypeptide
DENEIRTTNPVATEQWGDVSANTIQNRVEDR

SEQ ID NO: 81165 - protein, 33 aa, Artificial Sequence
  Description of Artificial Sequence: Synthetic polypeptide
DEEEISTTNPCATEQYGCVCPTNLQERGSDNQG

SEQ ID NO: 81166 - protein, 33 aa, Artificial Sequence
  Description of Artificial Sequence: Synthetic polypeptide
DEEEISTTNPCATEQYGCVCPTNLQERFGNNQA

SEQ ID NO: 81167 - protein, 34 aa, Artificial Sequence
  Description of Artificial Sequence: Synthetic polypeptide
YEEEINTTNPVATEQYGCCCSATSNSLTQRIGNR

SEQ ID NO: 81168 - protein, 32 aa, Artificial Sequence
  Description of Artificial Sequence: Synthetic polypeptide
DEAEIRTTNPVATEQFGTIVSTYLLRGGNESF

SEQ ID NO: 81169 - protein, 35 aa, Artificial Sequence
  Description of Artificial Sequence: Synthetic polypeptide
DEEEIRTTNPVSTEQWGQSVSCTNMLSPRHGGNNR

SEQ ID NO: 81170 - protein, 34 aa, Artificial Sequence
  Description of Artificial Sequence: Synthetic polypeptide
DEEEIRTTNPVSTEQYGQSVVSTNHSGSTGGNNR

SEQ ID NO: 81171 - protein, 35 aa, Artificial Sequence
  Description of Artificial Sequence: Synthetic polypeptide
DEEEIRTTNPVATEPYGISVSTVNLSQDRPVTNNQ

SEQ ID NO: 81172 - protein, 28 aa, Artificial Sequence
  Description of Artificial Sequence: Synthetic peptide
YEEEIQSVNPVCTEQYGVVCDNLQSGNQ

SEQ ID NO: 81173 - protein, 33 aa, Artificial Sequence
  Description of Artificial Sequence: Synthetic polypeptide
DEEEIRGTNPVATEQYGSVSPVVQDREVSNLRN

SEQ ID NO: 81174 - protein, 33 aa, Artificial Sequence
  Description of Artificial Sequence: Synthetic polypeptide
DEEEIRTTNPVATEQYGQCVSTMELQNFGSDQL

SEQ ID NO: 81175 - protein, 32 aa, Artificial Sequence
  Description of Artificial Sequence: Synthetic polypeptide
DEEEIRTTNPVATEFYGSVSTMGFGQEGEGGG

SEQ ID NO: 81176 - protein, 33 aa, Artificial Sequence
  Description of Artificial Sequence: Synthetic polypeptide
DEEEISTTNPVATEQYGCVCSNTELQSSGSNQS

SEQ ID NO: 81177 - protein, 31 aa, Artificial Sequence
  Description of Artificial Sequence: Synthetic polypeptide
YEEEIGTTNPDATEQYSVPSTHNHEQRDNFR

SEQ ID NO: 81178 - protein, 31 aa, Artificial Sequence
  Description of Artificial Sequence: Synthetic polypeptide
YEEKIRTTNPVATEQYGAWASTMNLQETNFD

SEQ ID NO: 81179 - protein, 29 aa, Artificial Sequence
  Description of Artificial Sequence: Synthetic peptide
YEEEIATTNPVCTEQYGVVSEILMNAGNQ

SEQ ID NO: 81180 - protein, 29 aa, Artificial Sequence
  Description of Artificial Sequence: Synthetic peptide
YEEEIATTNPVCTEQYGVVSENEQAAGDA

SEQ ID NO: 81181 - protein, 31 aa, Artificial Sequence
  Description of Artificial Sequence: Synthetic polypeptide
SEAEIATTNPVATEQYGSCAAATNLQDGPRE

SEQ ID NO: 81182 - protein, 28 aa, Artificial Sequence
  Description of Artificial Sequence: Synthetic peptide
YEEKIASVNPVCTEQYGVVSDNLQSGNQ

SEQ ID NO: 81183 - protein, 32 aa, Artificial Sequence
  Description of Artificial Sequence: Synthetic polypeptide
DEEEIRTTNPVATEQYGSVTPNNTNQLNMEVE

SEQ ID NO: 81184 - protein, 31 aa, Artificial Sequence
  Description of Artificial Sequence: Synthetic polypeptide
DENEIRTTNPVATECWGSVSENEPMDREGNG

SEQ ID NO: 81185 - protein, 31 aa, Artificial Sequence
  Description of Artificial Sequence: Synthetic polypeptide
DENEIRTTNPVATECWGSVSENEPMNRAGNA

SEQ ID NO: 81186 - protein, 31 aa, Artificial Sequence
  Description of Artificial Sequence: Synthetic polypeptide
SEEEIACTNPVATEQYGSVATPLEDRGGNEY

SEQ ID NO: 81187 - protein, 34 aa, Artificial Sequence
  Description of Artificial Sequence: Synthetic polypeptide
DEEEIRTTNPVATEQYGSVTPPTTVLQTLGNDQV

SEQ ID NO: 81188 - protein, 28 aa, Artificial Sequence
  Description of Artificial Sequence: Synthetic peptide
DENEIRTTNPVATEQYGDVPEICQHEDA

SEQ ID NO: 81189 - protein, 31 aa, Artificial Sequence
  Description of Artificial Sequence: Synthetic polypeptide
DENEIRTTNPVATECWGSVSENEPMNRAGNG

SEQ ID NO: 81190 - protein, 35 aa, Artificial Sequence
  Description of Artificial Sequence: Synthetic polypeptide
AEEEIRTTNPVATEQYGSVSTVNNQLQGDEGTNNE

SEQ ID NO: 81191 - protein, 33 aa, Artificial Sequence
  Description of Artificial Sequence: Synthetic polypeptide
DEEEIRTTNPVATEQYGQCVCSTPTQNFGSNQT

SEQ ID NO: 81192 - protein, 32 aa, Artificial Sequence
  Description of Artificial Sequence: Synthetic polypeptide
YEEEIATTNPYATESYGSVCSPTGNVQGQGNR

SEQ ID NO: 81193 - protein, 34 aa, Artificial Sequence
  Description of Artificial Sequence: Synthetic polypeptide
AEEEIRTTNPVATEQYGSVSTVNNQNDNQQGNTE

SEQ ID NO: 81194 - protein, 28 aa, Artificial Sequence
  Description of Artificial Sequence: Synthetic peptide
YEEEIATVNPVATECYGDVSENLQHEEQ

SEQ ID NO: 81195 - protein, 28 aa, Artificial Sequence
  Description of Artificial Sequence: Synthetic peptide
YEEEIATVNPVATECYGVVSDCLQSENQ

SEQ ID NO: 81196 - protein, 32 aa, Artificial Sequence
  Description of Artificial Sequence: Synthetic polypeptide
DENEIRTTNPVATEQYGDVMTGLIRGMGNDGG

SEQ ID NO: 81197 - protein, 28 aa, Artificial Sequence
  Description of Artificial Sequence: Synthetic peptide
YEEEIATVNPVATECYGVVSECLQHENQ

SEQ ID NO: 81198 - protein, 31 aa, Artificial Sequence
  Description of Artificial Sequence: Synthetic polypeptide
DENEIRTTNPVATEQYGDVCSTIEVEAAGND

SEQ ID NO: 81199 - protein, 33 aa, Artificial Sequence
  Description of Artificial Sequence: Synthetic polypeptide
DEEEISTTNPVATEQYGCVCSTADLQHFGSNQG

SEQ ID NO: 81200 - protein, 33 aa, Artificial Sequence
  Description of Artificial Sequence: Synthetic polypeptide
DEEEISTTNPVATEQYGCVCSTAHNQRFGSNQS

SEQ ID NO: 81201 - protein, 31 aa, Artificial Sequence
  Description of Artificial Sequence: Synthetic polypeptide
DENEIRTTNPVATEQYGDVSATDLENHAGDA

SEQ ID NO: 81202 - protein, 28 aa, Artificial Sequence
  Description of Artificial Sequence: Synthetic peptide
YEELIASVNPVCTEQYGEVSDNLQSGNQ

SEQ ID NO: 81203 - protein, 32 aa, Artificial Sequence
  Description of Artificial Sequence: Synthetic polypeptide
DENEIRTTNPVATECWGSVSEINLPQDREGEL

SEQ ID NO: 81204 - protein, 35 aa, Artificial Sequence
  Description of Artificial Sequence: Synthetic polypeptide
DEEEIRTTNPVATEQYGQCVCSTNLQEYFGSENQS

SEQ ID NO: 81205 - protein, 33 aa, Artificial Sequence
  Description of Artificial Sequence: Synthetic polypeptide
DEEEIRCTNPVATEQYGCVCSMWGNDFQGGSNR

SEQ ID NO: 81206 - protein, 28 aa, Artificial Sequence
  Description of Artificial Sequence: Synthetic peptide
YEENIASVNPVCTEQYGVVSDNLQSGNK

SEQ ID NO: 81207 - protein, 33 aa, Artificial Sequence
  Description of Artificial Sequence: Synthetic polypeptide
DEAEIRTTNPVATEAYGSVISYANMQNRGPNGT

SEQ ID NO: 81208 - protein, 34 aa, Artificial Sequence
  Description of Artificial Sequence: Synthetic polypeptide
DEEEIRTTNPVATEQYGSVVSTVPNFDEGNDNEY

SEQ ID NO: 81209 - protein, 33 aa, Artificial Sequence
  Description of Artificial Sequence: Synthetic polypeptide
DEEEIRTTNPVATEQYGSVVSTVPNFDEGGDGE

SEQ ID NO: 81210 - protein, 32 aa, Artificial Sequence
  Description of Artificial Sequence: Synthetic polypeptide
DEEEISTTNPVATEQYGCVCSTALQNFGSDQS

SEQ ID NO: 81211 - protein, 29 aa, Artificial Sequence
  Description of Artificial Sequence: Synthetic peptide
AEDEIACTNPVATEQYGEASEHNLQVGGR

SEQ ID NO: 81212 - protein, 34 aa, Artificial Sequence
  Description of Artificial Sequence: Synthetic polypeptide
AEEEIRTTNPVATEQYGSVSTVNNNQQTQGNNDD

SEQ ID NO: 81213 - protein, 30 aa, Artificial Sequence
  Description of Artificial Sequence: Synthetic polypeptide
DENEIRTTNPVATECYGATSNEDLARGGYR

SEQ ID NO: 81214 - protein, 32 aa, Artificial Sequence
  Description of Artificial Sequence: Synthetic polypeptide
DEEEISTTNPVATEQYGCVCSTALQHFGSEQF

SEQ ID NO: 81215 - protein, 33 aa, Artificial Sequence
  Description of Artificial Sequence: Synthetic polypeptide
DEEEIRTTNPVAYEQYGQSVGETNDLLQSGIEQ

SEQ ID NO: 81216 - protein, 33 aa, Artificial Sequence
  Description of Artificial Sequence: Synthetic polypeptide
DEEEISTTNPVATEQYGCVCSTAHQRFGSNTQQ

SEQ ID NO: 81217 - protein, 28 aa, Artificial Sequence
  Description of Artificial Sequence: Synthetic peptide
YEEMIASVNPVCTEQYGVVSDNLQSGNT

SEQ ID NO: 81218 - protein, 32 aa, Artificial Sequence
  Description of Artificial Sequence: Synthetic polypeptide
DEEEIRTTNPVAYEQYGCVCSTEHQHFGSNQE

SEQ ID NO: 81219 - protein, 35 aa, Artificial Sequence
  Description of Artificial Sequence: Synthetic polypeptide
DEEEIRTTNPVATEQYGQCVCSTNNLQFFGSNNQA

SEQ ID NO: 81220 - protein, 28 aa, Artificial Sequence
  Description of Artificial Sequence: Synthetic peptide
YEEMIASVNPVCTEQYGVVSDNLQSGNQ

SEQ ID NO: 81221 - protein, 31 aa, Artificial Sequence
  Description of Artificial Sequence: Synthetic polypeptide
DENEIRTTNPVATECWGSVSENEPMDRAGNG

SEQ ID NO: 81222 - protein, 33 aa, Artificial Sequence
  Description of Artificial Sequence: Synthetic polypeptide
DEEEIRTTNPVGTEQYGSVWCTNELSGRTVGGP

SEQ ID NO: 81223 - protein, 31 aa, Artificial Sequence
  Description of Artificial Sequence: Synthetic polypeptide
YEEEIRTTNPVATSQYGEAWASTNLQEINFD

SEQ ID NO: 81224 - protein, 28 aa, Artificial Sequence
  Description of Artificial Sequence: Synthetic peptide
YEELIASVNPVCTEQYGVVSDNLQSGNQ

SEQ ID NO: 81225 - protein, 34 aa, Artificial Sequence
  Description of Artificial Sequence: Synthetic polypeptide
DEEEIRTTNPVATEQYGSVVSTVPNFDDGGDNQE

SEQ ID NO: 81226 - protein, 28 aa, Artificial Sequence
  Description of Artificial Sequence: Synthetic peptide
YEENIASVNPVCTEQYGVVSDNLQSGNQ

SEQ ID NO: 81227 - protein, 34 aa, Artificial Sequence
  Description of Artificial Sequence: Synthetic polypeptide
YEEEIRTTNPVATTQYGCVCSATSNSLTQDGLNR

SEQ ID NO: 81228 - protein, 36 aa, Artificial Sequence
  Description of Artificial Sequence: Synthetic polypeptide
DEEEIRTTNPVATEQYGSAVSTNEDEQQRGNDEEVY

SEQ ID NO: 81229 - protein, 31 aa, Artificial Sequence
  Description of Artificial Sequence: Synthetic polypeptide
SEEEICTTNPVATEQYGSVQANDNLHAGNFS

SEQ ID NO: 81230 - protein, 30 aa, Artificial Sequence
  Description of Artificial Sequence: Synthetic polypeptide
DENEIRTTNPVATEQYGDASENEMNAAGGR

SEQ ID NO: 81231 - protein, 34 aa, Artificial Sequence
  Description of Artificial Sequence: Synthetic polypeptide
DEEEIRTTNPVATEPYGSVSTTPAGPQMRNGMNV

SEQ ID NO: 81232 - protein, 28 aa, Artificial Sequence
  Description of Artificial Sequence: Synthetic peptide
DEEEIRTTNPVATEQWGDVSEICMAEEA

SEQ ID NO: 81233 - protein, 31 aa, Artificial Sequence
  Description of Artificial Sequence: Synthetic polypeptide
SEECISTTNPVATEQYGSVCSWNHQNGSNQA

SEQ ID NO: 81234 - protein, 31 aa, Artificial Sequence
  Description of Artificial Sequence: Synthetic polypeptide
DEEEIRTTNPVATENYGNVSTGNMEENMNPQ

SEQ ID NO: 81235 - protein, 31 aa, Artificial Sequence
  Description of Artificial Sequence: Synthetic polypeptide
SEAEIATTNPVAYEPYGVVASATNLQNAGNR

SEQ ID NO: 81236 - protein, 32 aa, Artificial Sequence
  Description of Artificial Sequence: Synthetic polypeptide
DEEEIRTVNPVATEQYGCVCSTETQRFNSQQG

SEQ ID NO: 81237 - protein, 34 aa, Artificial Sequence
  Description of Artificial Sequence: Synthetic polypeptide
DEEEIRTTNPVATENYGQSVSTGNWPGQEHGERY

SEQ ID NO: 81238 - protein, 34 aa, Artificial Sequence
  Description of Artificial Sequence: Synthetic polypeptide
YEEEIRTTNPVATWQYGACAVSNSNLTQRNGNRF

SEQ ID NO: 81239 - protein, 28 aa, Artificial Sequence
  Description of Artificial Sequence: Synthetic peptide
YEEGIMSVNPVCTEQYGVVSDNLQSGNQ

SEQ ID NO: 81240 - protein, 33 aa, Artificial Sequence
  Description of Artificial Sequence: Synthetic polypeptide
DEEEIRTTNPVATEQYGSVVGSTVDIQGEIQNI

SEQ ID NO: 81241 - protein, 29 aa, Artificial Sequence
  Description of Artificial Sequence: Synthetic peptide
DENEIRTTNPVATECYGDVAECLQHKGEL

SEQ ID NO: 81242 - protein, 33 aa, Artificial Sequence
  Description of Artificial Sequence: Synthetic polypeptide
AEEEIRTTNPVATEQYGSVSTVTNEQAGTEDEQ

SEQ ID NO: 81243 - protein, 29 aa, Artificial Sequence
  Description of Artificial Sequence: Synthetic peptide
ADNEIACTNPVATEGYGEVSAENLQRGGR

SEQ ID NO: 81244 - protein, 32 aa, Artificial Sequence
  Description of Artificial Sequence: Synthetic polypeptide
DEEEIRTTNPVAYEQYGCVCSTGELQNGSEQN

SEQ ID NO: 81245 - protein, 30 aa, Artificial Sequence
  Description of Artificial Sequence: Synthetic polypeptide
DENEIRTTNPVATECYGDVSCICLQHGEEG

SEQ ID NO: 81246 - protein, 30 aa, Artificial Sequence
  Description of Artificial Sequence: Synthetic polypeptide
DENEIRTTNPVATECYGDVSEALQHEMNPV

SEQ ID NO: 81247 - protein, 31 aa, Artificial Sequence
  Description of Artificial Sequence: Synthetic polypeptide
SEEEIACTNPVATEQYGSVSENLEDHEGNDL

SEQ ID NO: 81248 - protein, 29 aa, Artificial Sequence
  Description of Artificial Sequence: Synthetic peptide
DENEIRTTNPVATECYGDVWSECLQHEEL

SEQ ID NO: 81249 - protein, 30 aa, Artificial Sequence
  Description of Artificial Sequence: Synthetic polypeptide
DEEEIRTTNPVATENYGSVNTYDFVEFVNL

SEQ ID NO: 81250 - protein, 28 aa, Artificial Sequence
  Description of Artificial Sequence: Synthetic peptide
YEEHIASVNPVCTEQYGVVSDNLQSGNQ

SEQ ID NO: 81251 - protein, 33 aa, Artificial Sequence
  Description of Artificial Sequence: Synthetic polypeptide
DEEEIRTTNPVAYEQYGQSVCSWEDLNQRGSEV

SEQ ID NO: 81252 - protein, 33 aa, Artificial Sequence
  Description of Artificial Sequence: Synthetic polypeptide
DEAEIRTTNPVATEQYGCVCSTNDHQGFGSNQS

SEQ ID NO: 81253 - protein, 33 aa, Artificial Sequence
  Description of Artificial Sequence: Synthetic polypeptide
DEEEIRTTNPVATEQYGSVTPTGNEQRMQVQED

SEQ ID NO: 81254 - protein, 34 aa, Artificial Sequence
  Description of Artificial Sequence: Synthetic polypeptide
AEEEIRTTNPVATEQYGSVSTVNNQQANDEGNNE

SEQ ID NO: 81255 - protein, 31 aa, Artificial Sequence
  Description of Artificial Sequence: Synthetic polypeptide
SEEEIACTNPVATEQYGSVATPLQANGNDEY

SEQ ID NO: 81256 - protein, 28 aa, Artificial Sequence
  Description of Artificial Sequence: Synthetic peptide
YEEIIASVNPVCTEQYGVVSDNLQSGNQ

SEQ ID NO: 81257 - protein, 28 aa, Artificial Sequence
  Description of Artificial Sequence: Synthetic peptide
YEEEIATVNPVATECYGVVSECLQSENQ

SEQ ID NO: 81258 - protein, 29 aa, Artificial Sequence
  Description of Artificial Sequence: Synthetic peptide
DENEIRTTNPVATECYGDVAECLQEHGPL

SEQ ID NO: 81259 - protein, 28 aa, Artificial Sequence
  Description of Artificial Sequence: Synthetic peptide
DENEIRTTNPVATECYGDVAECLQHEEL

SEQ ID NO: 81260 - protein, 33 aa, Artificial Sequence
  Description of Artificial Sequence: Synthetic polypeptide
DEAEIRTTNPVATEQYGCVCSTGNLQNFGSDQL

SEQ ID NO: 81261 - protein, 32 aa, Artificial Sequence
  Description of Artificial Sequence: Synthetic polypeptide
DEEEISTTNPVATEQYGCVCSSPHQRFGSNQG

SEQ ID NO: 81262 - protein, 32 aa, Artificial Sequence
  Description of Artificial Sequence: Synthetic polypeptide
YEEEIRTCNPVATEQYGELVETNLIQRGHIET

SEQ ID NO: 81263 - protein, 34 aa, Artificial Sequence
  Description of Artificial Sequence: Synthetic polypeptide
DEEEIRTTNPVATEQYGSVTPTGAEQRMQVNERF

SEQ ID NO: 81264 - protein, 29 aa, Artificial Sequence
  Description of Artificial Sequence: Synthetic peptide
DENEIRTTNPVATECYGAVSECLQEHEEL

SEQ ID NO: 81265 - protein, 34 aa, Artificial Sequence
  Description of Artificial Sequence: Synthetic polypeptide
YEEEIRTCNPVATEQYGCVCSTTSNSLNQDGNRG

SEQ ID NO: 81266 - protein, 31 aa, Artificial Sequence
  Description of Artificial Sequence: Synthetic polypeptide
SEEEIACTNPVATEQYGSVATPLQDAGGNEE

SEQ ID NO: 81267 - protein, 34 aa, Artificial Sequence
  Description of Artificial Sequence: Synthetic polypeptide
AEEEIRTTNPVATEQYGSVSTVNNQQQDEGTNND

SEQ ID NO: 81268 - protein, 33 aa, Artificial Sequence
  Description of Artificial Sequence: Synthetic polypeptide
DEEEISTTNPVATEQYGCVCSSNLQNFGSNTQS

SEQ ID NO: 81269 - protein, 33 aa, Artificial Sequence
  Description of Artificial Sequence: Synthetic polypeptide
DEEEIRTTNPVATEQYGSVTPTGLEQQGQDDPQ

SEQ ID NO: 81270 - protein, 30 aa, Artificial Sequence
  Description of Artificial Sequence: Synthetic polypeptide
DEEEIRTTNPVATEQWGDVSEIEMNAAGNA

SEQ ID NO: 81271 - protein, 32 aa, Artificial Sequence
  Description of Artificial Sequence: Synthetic polypeptide
DEEEISTTNPVATEQYGCVCSSNLQNFGSDDG

SEQ ID NO: 81272 - protein, 34 aa, Artificial Sequence
  Description of Artificial Sequence: Synthetic polypeptide
DEEEIRTTNPVATEFYGSVSTVNGFGQENIGNDE

SEQ ID NO: 81273 - protein, 32 aa, Artificial Sequence
  Description of Artificial Sequence: Synthetic polypeptide
DEEEISTTNPVATEQYGCVCSSNHQYFGSNQA

SEQ ID NO: 81274 - protein, 31 aa, Artificial Sequence
  Description of Artificial Sequence: Synthetic polypeptide
SEEEICTTNPVATEQYGSVSANNDTGMPNEQ

SEQ ID NO: 81275 - protein, 31 aa, Artificial Sequence
  Description of Artificial Sequence: Synthetic polypeptide
DEEEIRTVNPVATEQYGCVCSTELQHNSQAG

SEQ ID NO: 81276 - protein, 34 aa, Artificial Sequence
  Description of Artificial Sequence: Synthetic polypeptide
AEEEIRTTNPVATEQYGSVSTVNNQQNDEGTNND

SEQ ID NO: 81277 - protein, 34 aa, Artificial Sequence
  Description of Artificial Sequence: Synthetic polypeptide
DEEEIRTTNPVATEQYGQCVCSTNLNQNFNSDQA

SEQ ID NO: 81278 - protein, 34 aa, Artificial Sequence
  Description of Artificial Sequence: Synthetic polypeptide
DEEEIRTTNPVATEQYGQCVCSTNLHQGFGSDQS

SEQ ID NO: 81279 - protein, 29 aa, Artificial Sequence
  Description of Artificial Sequence: Synthetic peptide
DENEIRTTNPVATEQYGDVSECEQNAEDL

SEQ ID NO: 81280 - protein, 34 aa, Artificial Sequence
  Description of Artificial Sequence: Synthetic polypeptide
DEEEIRTTNPVATEQYGSVTMTGNGIGQEDGNEG

SEQ ID NO: 81281 - protein, 34 aa, Artificial Sequence
  Description of Artificial Sequence: Synthetic polypeptide
YEEEIRTTNPAATEQYGTAVSNSNLTQRNGDNRF

SEQ ID NO: 81282 - protein, 34 aa, Artificial Sequence
  Description of Artificial Sequence: Synthetic polypeptide
DEEEIRTTNPVATEQYGSVTMTNGGGQEDGINGG

SEQ ID NO: 81283 - protein, 33 aa, Artificial Sequence
  Description of Artificial Sequence: Synthetic polypeptide
DEEEIRTTNPVATEQWGESTVPSTNLSIHGGSE

SEQ ID NO: 81284 - protein, 32 aa, Artificial Sequence
  Description of Artificial Sequence: Synthetic polypeptide
SEEEIACTNPVATEQYGSVATNLQVGQEDNQM

SEQ ID NO: 81285 - protein, 32 aa, Artificial Sequence
  Description of Artificial Sequence: Synthetic polypeptide
YEEEIRTTNPVATETYGSVSTLTNTRFAGTRN

SEQ ID NO: 81286 - protein, 33 aa, Artificial Sequence
  Description of Artificial Sequence: Synthetic polypeptide
DEEEIRTTNPVATEQYGQCVCSTNHDQGGSEQL

SEQ ID NO: 81287 - protein, 34 aa, Artificial Sequence
  Description of Artificial Sequence: Synthetic polypeptide
DEEEIRTTNPVATEMYGSVSTDGDEGNGQTGNEG

SEQ ID NO: 81288 - protein, 34 aa, Artificial Sequence
  Description of Artificial Sequence: Synthetic polypeptide
DEEEIRTTNPVATEQYGQCVCSTNHDQNSGSNQT

SEQ ID NO: 81289 - protein, 33 aa, Artificial Sequence
  Description of Artificial Sequence: Synthetic polypeptide
DEEEIRTTNPVATEQWGESTVPSLNLSGRGGTE

SEQ ID NO: 81290 - protein, 29 aa, Artificial Sequence
  Description of Artificial Sequence: Synthetic peptide
DENEIRTTNPVATEQYGDVSEICQHAEDA

SEQ ID NO: 81291 - protein, 33 aa, Artificial Sequence
  Description of Artificial Sequence: Synthetic polypeptide
DEEEIRTTNPVATEQWGESTVHCTNLSERGGTE

SEQ ID NO: 81292 - protein, 32 aa, Artificial Sequence
  Description of Artificial Sequence: Synthetic polypeptide
YEEPIRTTNPVATEQYGAVVTPNLQQVEGVPR

SEQ ID NO: 81293 - protein, 31 aa, Artificial Sequence
  Description of Artificial Sequence: Synthetic polypeptide
SEEEICTTNPVAYEQYGSVATNELQPVNPEA

SEQ ID NO: 81294 - protein, 32 aa, Artificial Sequence
  Description of Artificial Sequence: Synthetic polypeptide
SEEEIACTNPVATEQYGSVATNLTAEGGNLRQ

SEQ ID NO: 81295 - protein, 31 aa, Artificial Sequence
  Description of Artificial Sequence: Synthetic polypeptide
SEEEIACTNPVATEQYGSVATNLTAEPSNER

SEQ ID NO: 81296 - protein, 28 aa, Artificial Sequence
  Description of Artificial Sequence: Synthetic peptide
YEEEIATTNPVATEQYGVAPEVLQHGEK

SEQ ID NO: 81297 - protein, 28 aa, Artificial Sequence
  Description of Artificial Sequence: Synthetic peptide
YEEEIATTNPVATEQYGVASEVCQHGEK

SEQ ID NO: 81298 - protein, 30 aa, Artificial Sequence
  Description of Artificial Sequence: Synthetic polypeptide
DENEIRTTNPVATECWGSVSEIEQNRAENA

SEQ ID NO: 81299 - protein, 32 aa, Artificial Sequence
  Description of Artificial Sequence: Synthetic polypeptide
DEEEISTTNPVATEQYGCVCSTEDQENFGSNQ

SEQ ID NO: 81300 - protein, 33 aa, Artificial Sequence
  Description of Artificial Sequence: Synthetic polypeptide
DEEEIRTTNPVATEQYGSVVSVVPNGLQTTQLE

SEQ ID NO: 81301 - protein, 34 aa, Artificial Sequence
  Description of Artificial Sequence: Synthetic polypeptide
DEEEIRTTNPVATEQYGSVTMTDNGIQEDGGNED

SEQ ID NO: 81302 - protein, 34 aa, Artificial Sequence
  Description of Artificial Sequence: Synthetic polypeptide
DEEEIRTTNPVATEQYGSVVGSTMDIQGEGQGNI

SEQ ID NO: 81303 - protein, 33 aa, Artificial Sequence
  Description of Artificial Sequence: Synthetic polypeptide
DEEEIRTTNPVATEQWGESTVSCTNGSLRGGTE

SEQ ID NO: 81304 - protein, 31 aa, Artificial Sequence
  Description of Artificial Sequence: Synthetic polypeptide
DENEIRTTNPVATECWGSVSCNEPMDREGNG

SEQ ID NO: 81305 - protein, 28 aa, Artificial Sequence
  Description of Artificial Sequence: Synthetic peptide
DEEEIRTTNPVATEQWGEVPEIEQHEEK

SEQ ID NO: 81306 - protein, 30 aa, Artificial Sequence
  Description of Artificial Sequence: Synthetic polypeptide
SEAEIACTNPVATEPYGSVVTNLQHGDNEQ

SEQ ID NO: 81307 - protein, 28 aa, Artificial Sequence
  Description of Artificial Sequence: Synthetic peptide
DEEEIRTTNPVATEQWGEVPEICQHEEK

SEQ ID NO: 81308 - protein, 31 aa, Artificial Sequence
  Description of Artificial Sequence: Synthetic polypeptide
DEAEIRTTNPVATDQYGSVNMQLQPNGLNDD

SEQ ID NO: 81309 - protein, 31 aa, Artificial Sequence
  Description of Artificial Sequence: Synthetic polypeptide
DEEEIRTTNPVAYEQYGCVCSSEPQFFGSNQ

SEQ ID NO: 81310 - protein, 29 aa, Artificial Sequence
  Description of Artificial Sequence: Synthetic peptide
SEAEIACTNPVATEQWGSVATNLETGNDQ

SEQ ID NO: 81311 - protein, 33 aa, Artificial Sequence
  Description of Artificial Sequence: Synthetic polypeptide
DENEIRTTNPVATECWGSVSCINEPQDREGENR

SEQ ID NO: 81312 - protein, 28 aa, Artificial Sequence
  Description of Artificial Sequence: Synthetic peptide
YEEQIASVNPVCTEQYGVVSDNLQSGNQ

SEQ ID NO: 81313 - protein, 31 aa, Artificial Sequence
  Description of Artificial Sequence: Synthetic polypeptide
SEEEIACTNPVATEQYGSVATNLQSEENNID

SEQ ID NO: 81314 - protein, 31 aa, Artificial Sequence
  Description of Artificial Sequence: Synthetic polypeptide
DEEEIRTTNPVATEEYGCVCFTNLTNGGSQQ

SEQ ID NO: 81315 - protein, 34 aa, Artificial Sequence
  Description of Artificial Sequence: Synthetic polypeptide
DEEEIRTTNPVATEQYGQCVCSTNHQEYFGSNQG

SEQ ID NO: 81316 - protein, 34 aa, Artificial Sequence
  Description of Artificial Sequence: Synthetic polypeptide
YEEEIRTTNPVATEQYGYVPVTPNLPQLRHGANY

SEQ ID NO: 81317 - protein, 32 aa, Artificial Sequence
  Description of Artificial Sequence: Synthetic polypeptide
DEEEIRTTNPVATEEYGCVCFTNLTSGGSNQA

SEQ ID NO: 81318 - protein, 31 aa, Artificial Sequence
  Description of Artificial Sequence: Synthetic polypeptide
DENEIRTTNPVATECWGSVSCINEQHEGENG

SEQ ID NO: 81319 - protein, 28 aa, Artificial Sequence
  Description of Artificial Sequence: Synthetic peptide
YEEEIATTNPVATEQYGVAPDVLQHGEK

SEQ ID NO: 81320 - protein, 34 aa, Artificial Sequence
  Description of Artificial Sequence: Synthetic polypeptide
DEEEIRTTNPVATEQWGESTVSCTNLSSRTGGTE

SEQ ID NO: 81321 - protein, 32 aa, Artificial Sequence
  Description of Artificial Sequence: Synthetic polypeptide
SEEEICTTNPVAYEQYGSVSTNLQGAPAEGKD

SEQ ID NO: 81322 - protein, 31 aa, Artificial Sequence
  Description of Artificial Sequence: Synthetic polypeptide
SEEEICTTNPVAYEQYGSVSANNDREGNEEM

SEQ ID NO: 81323 - protein, 32 aa, Artificial Sequence
  Description of Artificial Sequence: Synthetic polypeptide
DEAEIRTTNPVATEAWGISVSTGNLSIRGGTE

SEQ ID NO: 81324 - protein, 33 aa, Artificial Sequence
  Description of Artificial Sequence: Synthetic polypeptide
DEEEIRTTNPVATEQYGSVVTANLDEFMGPLEL

SEQ ID NO: 81325 - protein, 31 aa, Artificial Sequence
  Description of Artificial Sequence: Synthetic polypeptide
SEEEICTTNPVAYEQYGSVATNLQEGDFGVM

SEQ ID NO: 81326 - protein, 33 aa, Artificial Sequence
  Description of Artificial Sequence: Synthetic polypeptide
AEEEIRTTNPVATEQYGSVSTVNNNQQEDEAND

SEQ ID NO: 81327 - protein, 34 aa, Artificial Sequence
  Description of Artificial Sequence: Synthetic polypeptide
YEEEIRTTNPVATEQYGYVVCSATSNSLTQDWNR

SEQ ID NO: 81328 - protein, 28 aa, Artificial Sequence
  Description of Artificial Sequence: Synthetic peptide
DEEEIRTTNPVATEQWGEASEICQAEEA

SEQ ID NO: 81329 - protein, 33 aa, Artificial Sequence
  Description of Artificial Sequence: Synthetic polypeptide
DEEEIRTTNPVATEQYGQCVCSTNHQHFGSQQM

SEQ ID NO: 81330 - protein, 34 aa, Artificial Sequence
  Description of Artificial Sequence: Synthetic polypeptide
DEEEIRTTNPVATEQYGSVVSVTNVQTPFVNVDD

SEQ ID NO: 81331 - protein, 28 aa, Artificial Sequence
  Description of Artificial Sequence: Synthetic peptide
YEEPIASVNPVCTEQYGVVSDNLQSGNQ

SEQ ID NO: 81332 - protein, 33 aa, Artificial Sequence
  Description of Artificial Sequence: Synthetic polypeptide
DEEEIRTTNPVAYEQYGQSVIEQNDLLQRGIEL

SEQ ID NO: 81333 - protein, 34 aa, Artificial Sequence
  Description of Artificial Sequence: Synthetic polypeptide
DEEEIRTTNPVATEQYGSVVSVMGLQREGSLEQT

SEQ ID NO: 81334 - protein, 29 aa, Artificial Sequence
  Description of Artificial Sequence: Synthetic peptide
YEEEIATTNPVCTECYGVVSDEDLQSGNI

SEQ ID NO: 81335 - protein, 33 aa, Artificial Sequence
  Description of Artificial Sequence: Synthetic polypeptide
DEEEIRTTNPVATEQYGQCVCSTNHQSFGSEQQ

SEQ ID NO: 81336 - protein, 33 aa, Artificial Sequence
  Description of Artificial Sequence: Synthetic polypeptide
DEEEIRTTNPVAYEQYGCVCSTEEHQRSGSNQS

SEQ ID NO: 81337 - protein, 28 aa, Artificial Sequence
  Description of Artificial Sequence: Synthetic peptide
YEEEIATTNPVCTEQYGEVPEVLQHGEK

SEQ ID NO: 81338 - protein, 28 aa, Artificial Sequence
  Description of Artificial Sequence: Synthetic peptide
YEEEIATTNPVCTEQYGEVPEVLQSGEK

SEQ ID NO: 81339 - protein, 29 aa, Artificial Sequence
  Description of Artificial Sequence: Synthetic peptide
DENEIRTTNPVATEQYGDVSECLNHNEEL

SEQ ID NO: 81340 - protein, 29 aa, Artificial Sequence
  Description of Artificial Sequence: Synthetic peptide
DENEIRTTNPVATEQYGDVSECGNHNENV

SEQ ID NO: 81341 - protein, 32 aa, Artificial Sequence
  Description of Artificial Sequence: Synthetic polypeptide
DEEEISTTNPVATEQYGCVCSTEDHQNGSNNQ

SEQ ID NO: 81342 - protein, 30 aa, Artificial Sequence
  Description of Artificial Sequence: Synthetic polypeptide
DEEEIRTTNPVATEQWGDVSTAEMMANEDA

SEQ ID NO: 81343 - protein, 33 aa, Artificial Sequence
  Description of Artificial Sequence: Synthetic polypeptide
DEEEIRTTNPVATEQYGQCVCSTNHQYFGSQDS

SEQ ID NO: 81344 - protein, 34 aa, Artificial Sequence
  Description of Artificial Sequence: Synthetic polypeptide
DEEEIRTTNPVATEQYGSVVGSTMNLEDPEDVNE

SEQ ID NO: 81345 - protein, 32 aa, Artificial Sequence
  Description of Artificial Sequence: Synthetic polypeptide
DEEEIRTTNPVGTEQYGSVSTNGLGEDEFQDE

SEQ ID NO: 81346 - protein, 30 aa, Artificial Sequence
  Description of Artificial Sequence: Synthetic polypeptide
DENEIRTTNPVATECWGSVSEINEQHEGEL

SEQ ID NO: 81347 - protein, 28 aa, Artificial Sequence
  Description of Artificial Sequence: Synthetic peptide
YEEEIATTNPVCTEQYGEVPEVLQSGEQ

SEQ ID NO: 81348 - protein, 29 aa, Artificial Sequence
  Description of Artificial Sequence: Synthetic peptide
DENEIRTTNPVATEQYGDVSECGNHNENL

SEQ ID NO: 81349 - protein, 32 aa, Artificial Sequence
  Description of Artificial Sequence: Synthetic polypeptide
DENEIRTTNPVATECWGSVSEINLPQDREGEG

SEQ ID NO: 81350 - protein, 29 aa, Artificial Sequence
  Description of Artificial Sequence: Synthetic peptide
DENEIRTTNPVATEQYGDVSECEQNHEDL

SEQ ID NO: 81351 - protein, 29 aa, Artificial Sequence
  Description of Artificial Sequence: Synthetic peptide
SEEEICTTNPVAYEPYGNVATNLQIDGDN

SEQ ID NO: 81352 - protein, 30 aa, Artificial Sequence
  Description of Artificial Sequence: Synthetic polypeptide
SEAEIASTNPVAYEPYGVVASATNLQEGNR

SEQ ID NO: 81353 - protein, 33 aa, Artificial Sequence
  Description of Artificial Sequence: Synthetic polypeptide
DEEEIRTTNPVATEQYGQCVCSTNHQSSGSEQG

SEQ ID NO: 81354 - protein, 31 aa, Artificial Sequence
  Description of Artificial Sequence: Synthetic polypeptide
DENEIRTTNPVATEQYGCVSTVPLTNNLDNS

SEQ ID NO: 81355 - protein, 36 aa, Artificial Sequence
  Description of Artificial Sequence: Synthetic polypeptide
DEEEIRTTNPVAYEQYGQSVISPTNSELQRVGVVRI

SEQ ID NO: 81356 - protein, 32 aa, Artificial Sequence
  Description of Artificial Sequence: Synthetic polypeptide
DEEEIRGTNPVATEQYGSVYSTDVLNQNNVDD

SEQ ID NO: 81357 - protein, 28 aa, Artificial Sequence
  Description of Artificial Sequence: Synthetic peptide
YEEEIATTNPVATEQYGVASEVCQHGEQ

SEQ ID NO: 81358 - protein, 33 aa, Artificial Sequence
  Description of Artificial Sequence: Synthetic polypeptide
DEEEIRTTNPVATEQYGSVVSVTNVQTPFSEDD

SEQ ID NO: 81359 - protein, 34 aa, Artificial Sequence
  Description of Artificial Sequence: Synthetic polypeptide
DEEEIRTTNPVATEQYGQCVCSTNHQNFGSNFQS

SEQ ID NO: 81360 - protein, 32 aa, Artificial Sequence
  Description of Artificial Sequence: Synthetic polypeptide
DEEEIRTTNPVAYEQYGCVCSSNEHQNFGSNQ

SEQ ID NO: 81361 - protein, 33 aa, Artificial Sequence
  Description of Artificial Sequence: Synthetic polypeptide
DEEEIRTTNPVATEQYGSVTNNTTNLYGNEGTT

SEQ ID NO: 81362 - protein, 30 aa, Artificial Sequence
  Description of Artificial Sequence: Synthetic polypeptide
SEAEIACTNPVATEQYGSVATNLQAPNNNH

SEQ ID NO: 81363 - protein, 28 aa, Artificial Sequence
  Description of Artificial Sequence: Synthetic peptide
YEEEIATTNPVATEQYGVVPDVLQHEEK

SEQ ID NO: 81364 - protein, 32 aa, Artificial Sequence
  Description of Artificial Sequence: Synthetic polypeptide
DEEEIRTTNPVATEGYGICVSTVNDQEHISNQ

SEQ ID NO: 81365 - protein, 33 aa, Artificial Sequence
  Description of Artificial Sequence: Synthetic polypeptide
DEEEIRTTNPVATEGYGICVSTTVNLQENISNQ

SEQ ID NO: 81366 - protein, 28 aa, Artificial Sequence
  Description of Artificial Sequence: Synthetic peptide
YEEEIATTNPVATEQYGVVPDVLQSEEK

SEQ ID NO: 81367 - protein, 30 aa, Artificial Sequence
  Description of Artificial Sequence: Synthetic polypeptide
SEEEICTTNPVAYEPYGSVATNLQTGGDSL

SEQ ID NO: 81368 - protein, 31 aa, Artificial Sequence
  Description of Artificial Sequence: Synthetic polypeptide
SEAEIACTNPVATEQYGSVATNLQDGDGNDA

SEQ ID NO: 81369 - protein, 32 aa, Artificial Sequence
  Description of Artificial Sequence: Synthetic polypeptide
SEEEIACTNPVATEQYGSVATNLTREGGNEYQ

SEQ ID NO: 81370 - protein, 32 aa, Artificial Sequence
  Description of Artificial Sequence: Synthetic polypeptide
DEEEIRCTNPVATEQYGSVNGNGQTEGGQNDT

SEQ ID NO: 81371 - protein, 30 aa, Artificial Sequence
  Description of Artificial Sequence: Synthetic polypeptide
SEAEIACTNPVATEQYGSVATNLQGAENMD

SEQ ID NO: 81372 - protein, 32 aa, Artificial Sequence
  Description of Artificial Sequence: Synthetic polypeptide
DEEEIRTTNPVAYEQYGCVCSTEDQFFGSNQP

SEQ ID NO: 81373 - protein, 34 aa, Artificial Sequence
  Description of Artificial Sequence: Synthetic polypeptide
DEEEIRTTNPVATEPYGSVSTTNLNTNLGGNNND

SEQ ID NO: 81374 - protein, 35 aa, Artificial Sequence
  Description of Artificial Sequence: Synthetic polypeptide
AEEEIRTTNPVATEQYGSVSTVTNQNLQVNGNINE

SEQ ID NO: 81375 - protein, 33 aa, Artificial Sequence
  Description of Artificial Sequence: Synthetic polypeptide
DEEEIRTTNPVATEQYGQCVCSTNHQNFLSNQA

SEQ ID NO: 81376 - protein, 34 aa, Artificial Sequence
  Description of Artificial Sequence: Synthetic polypeptide
DEEEIRTTNPVAYEQYGQSVLSQMNDLLSRGSTR

SEQ ID NO: 81377 - protein, 28 aa, Artificial Sequence
  Description of Artificial Sequence: Synthetic peptide
YEEPIASVNPVCTEQYGVVSRNLQSGNQ

SEQ ID NO: 81378 - protein, 33 aa, Artificial Sequence
  Description of Artificial Sequence: Synthetic polypeptide
DEEEIRTTNPVATEQYGQCVCSTNHQNSGSDAP

SEQ ID NO: 81379 - protein, 29 aa, Artificial Sequence
  Description of Artificial Sequence: Synthetic peptide
YEEEIATTNPVATEQYGVVSEILMNAENQ

SEQ ID NO: 81380 - protein, 34 aa, Artificial Sequence
  Description of Artificial Sequence: Synthetic polypeptide
AEEEIRTTNPVATEQYGSVSTVNNNLQQNDTNQQ

SEQ ID NO: 81381 - protein, 31 aa, Artificial Sequence
  Description of Artificial Sequence: Synthetic polypeptide
DENEIRTTNPVATEQYGCVSTNWDDERFEQS

SEQ ID NO: 81382 - protein, 33 aa, Artificial Sequence
  Description of Artificial Sequence: Synthetic polypeptide
DEEEIRTTNPVAYEQYGCVCSTNDIQENFGSNQ

SEQ ID NO: 81383 - protein, 28 aa, Artificial Sequence
  Description of Artificial Sequence: Synthetic peptide
ADNEIASTNPVATEQYGNVAETLQRGGR

SEQ ID NO: 81384 - protein, 34 aa, Artificial Sequence
  Description of Artificial Sequence: Synthetic polypeptide
DEEEIRTTNPVATEEYGSTVACTNASQFTGGNTR

SEQ ID NO: 81385 - protein, 34 aa, Artificial Sequence
  Description of Artificial Sequence: Synthetic polypeptide
DEEEIRTTNPVATEPWGISVRTWNDLDDQRNTNR

SEQ ID NO: 81386 - protein, 31 aa, Artificial Sequence
  Description of Artificial Sequence: Synthetic polypeptide
DEEEIRTTNPVAYEQYGCVQTNLQYFDSDQS

SEQ ID NO: 81387 - protein, 33 aa, Artificial Sequence
  Description of Artificial Sequence: Synthetic polypeptide
DEEEIRTTNPVATEEYGSVMNNGQLLQEGSNDF

SEQ ID NO: 81388 - protein, 35 aa, Artificial Sequence
  Description of Artificial Sequence: Synthetic polypeptide
DEEEIRTTNPVATEPWGISVRTWNDLDQDRNGNDR

SEQ ID NO: 81389 - protein, 33 aa, Artificial Sequence
  Description of Artificial Sequence: Synthetic polypeptide
DEEEIRTTNPVATEQYGSAVCSTNEDEQENDEQ

SEQ ID NO: 81390 - protein, 33 aa, Artificial Sequence
  Description of Artificial Sequence: Synthetic polypeptide
DENEIRTTNPVATEIYGSVFSNTNLVERVGTVP

SEQ ID NO: 81391 - protein, 36 aa, Artificial Sequence
  Description of Artificial Sequence: Synthetic polypeptide
DEEEIRTTNPVATEQYGSVTSCCGNELSQIPTGGNR

SEQ ID NO: 81392 - protein, 30 aa, Artificial Sequence
  Description of Artificial Sequence: Synthetic polypeptide
SEDEIACTNPVATEQYGSVATNLQAAENNN

SEQ ID NO: 81393 - protein, 30 aa, Artificial Sequence
  Description of Artificial Sequence: Synthetic polypeptide
SEEEIACTNPVATESYGCVATNLQEAGNDN

SEQ ID NO: 81394 - protein, 33 aa, Artificial Sequence
  Description of Artificial Sequence: Synthetic polypeptide
AEEEIRTTNPVATEQYGSVSTVNQQQAQNTNND

SEQ ID NO: 81395 - protein, 34 aa, Artificial Sequence
  Description of Artificial Sequence: Synthetic polypeptide
YEEEVRTTNPVATEQYGCVCSATSNSLTQDGVNR

SEQ ID NO: 81396 - protein, 34 aa, Artificial Sequence
  Description of Artificial Sequence: Synthetic polypeptide
AEEEIRTTNPVATEQYGSVSTVNQQQGTDEENDD

SEQ ID NO: 81397 - protein, 33 aa, Artificial Sequence
  Description of Artificial Sequence: Synthetic polypeptide
AEEEIRTTNPVATEQYGSVSTVNQQQGTEGESE

SEQ ID NO: 81398 - protein, 32 aa, Artificial Sequence
  Description of Artificial Sequence: Synthetic polypeptide
DEEEIRTTNPVATEQYGQCVCSWEHQGGSNQY

SEQ ID NO: 81399 - protein, 34 aa, Artificial Sequence
  Description of Artificial Sequence: Synthetic polypeptide
DEEEIRTTNPVATEEYGSVSVSGNLSQTTVGNQW

SEQ ID NO: 81400 - protein, 30 aa, Artificial Sequence
  Description of Artificial Sequence: Synthetic polypeptide
DEAAIRTTNPVATEQYGCFSTNHISGSNQA

SEQ ID NO: 81401 - protein, 31 aa, Artificial Sequence
  Description of Artificial Sequence: Synthetic polypeptide
DEEEIRTTNPVATEGYGCVSTEHQFFGSEQS

SEQ ID NO: 81402 - protein, 31 aa, Artificial Sequence
  Description of Artificial Sequence: Synthetic polypeptide
DEEEIRTTNPVATEEYGVVSTPNESDWQNSE

SEQ ID NO: 81403 - protein, 30 aa, Artificial Sequence
  Description of Artificial Sequence: Synthetic polypeptide
DEEEIRTVNPVATEQYGCVSTEHQHNSQQL

SEQ ID NO: 81404 - protein, 30 aa, Artificial Sequence
  Description of Artificial Sequence: Synthetic polypeptide
DEEEIRTTNPVAYEQYGCVGWNLQYFDSDQ

SEQ ID NO: 81405 - protein, 31 aa, Artificial Sequence
  Description of Artificial Sequence: Synthetic polypeptide
DENEIRTTNPVATEIYGSVCSWNHQGFGSDQ

SEQ ID NO: 81406 - protein, 34 aa, Artificial Sequence
  Description of Artificial Sequence: Synthetic polypeptide
DENEIRTTNPVATEIYGSVAYSTNVLLQEGNEEK

SEQ ID NO: 81407 - protein, 31 aa, Artificial Sequence
  Description of Artificial Sequence: Synthetic polypeptide
DEAEIRTTNPVATEQYGCVYTLNDLEGNMEF

SEQ ID NO: 81408 - protein, 30 aa, Artificial Sequence
  Description of Artificial Sequence: Synthetic polypeptide
AEDEIACTNPVATEQYGEASENLQRGGGER

SEQ ID NO: 81409 - protein, 30 aa, Artificial Sequence
  Description of Artificial Sequence: Synthetic polypeptide
AEDEICATNPVATEQYGSVASENLQQGEGE

SEQ ID NO: 81410 - protein, 31 aa, Artificial Sequence
  Description of Artificial Sequence: Synthetic polypeptide
SEEEICTTNPTAYEQYGSVATNLQHRNDSRM

SEQ ID NO: 81411 - protein, 31 aa, Artificial Sequence
  Description of Artificial Sequence: Synthetic polypeptide
DENEIRTTNPVATEIYGMVVDYNVLQEGNEW

SEQ ID NO: 81412 - protein, 33 aa, Artificial Sequence
  Description of Artificial Sequence: Synthetic polypeptide
DEEEIRTTNPVATEPWGISVGRVNDLQDRIDNR

SEQ ID NO: 81413 - protein, 32 aa, Artificial Sequence
  Description of Artificial Sequence: Synthetic polypeptide
SEEEICTTNPTAYEQYGSVATNLQHRGDNDLM

SEQ ID NO: 81414 - protein, 28 aa, Artificial Sequence
  Description of Artificial Sequence: Synthetic peptide
YEEEIATVNPVCTEQYGVVSDILQSENQ

SEQ ID NO: 81415 - protein, 29 aa, Artificial Sequence
  Description of Artificial Sequence: Synthetic peptide
YEEEIATVNPVCTEQYGVVSDNEPQSGNQ

SEQ ID NO: 81416 - protein, 34 aa, Artificial Sequence
  Description of Artificial Sequence: Synthetic polypeptide
DEEEIRTTNPVATEQYGSVTQTGNSLQQQNEEPL

SEQ ID NO: 81417 - protein, 32 aa, Artificial Sequence
  Description of Artificial Sequence: Synthetic polypeptide
SECEIATTNPVATEGYGSVSTNLQGGNGGNEQ

SEQ ID NO: 81418 - protein, 30 aa, Artificial Sequence
  Description of Artificial Sequence: Synthetic polypeptide
SEEEIACTNPVATESYGCVATNLQQDGNLN

SEQ ID NO: 81419 - protein, 34 aa, Artificial Sequence
  Description of Artificial Sequence: Synthetic polypeptide
DEEEIRTTNPVATEPWGISVRTVNDLQDDGIKNR

SEQ ID NO: 81420 - protein, 32 aa, Artificial Sequence
  Description of Artificial Sequence: Synthetic polypeptide
DEEEISTTNPVATEQYGCVCSNTNHQHFNSNQ

SEQ ID NO: 81421 - protein, 35 aa, Artificial Sequence
  Description of Artificial Sequence: Synthetic polypeptide
DEEEIRTTNPVSTEAYGQSVSCTNALSPRHGGNNR

SEQ ID NO: 81422 - protein, 33 aa, Artificial Sequence
  Description of Artificial Sequence: Synthetic polypeptide
DENEIRTTNPVATEQYGCSNVLTNNLTHEDGNP

SEQ ID NO: 81423 - protein, 32 aa, Artificial Sequence
  Description of Artificial Sequence: Synthetic polypeptide
SECEIATTNPVATEHYGSVSTNLQGDTGGNDP

SEQ ID NO: 81424 - protein, 32 aa, Artificial Sequence
  Description of Artificial Sequence: Synthetic polypeptide
DEAEIRTTNPVATEQYGCWSTINPLERIENIN

SEQ ID NO: 81425 - protein, 28 aa, Artificial Sequence
  Description of Artificial Sequence: Synthetic peptide
YEEEIATVNPVCTEQYGVVSECLQHENL

SEQ ID NO: 81426 - protein, 31 aa, Artificial Sequence
  Description of Artificial Sequence: Synthetic polypeptide
SEEEICTTNPTAYEQYGSVATNLQHAIGNDM

SEQ ID NO: 81427 - protein, 30 aa, Artificial Sequence
  Description of Artificial Sequence: Synthetic polypeptide
DENEIRTTNPVATEQYGATTSENWARKGPI

SEQ ID NO: 81428 - protein, 33 aa, Artificial Sequence
  Description of Artificial Sequence: Synthetic polypeptide
DEEEISTTNPVATEQYGCVCSNTNHQENFGSNQ

SEQ ID NO: 81429 - protein, 33 aa, Artificial Sequence
  Description of Artificial Sequence: Synthetic polypeptide
DEEEIRTTNPVATEPWGISVRTWNDDQDDRKNR

SEQ ID NO: 81430 - protein, 33 aa, Artificial Sequence
  Description of Artificial Sequence: Synthetic polypeptide
DEEEIRTTNPVATEPWGISVRTVNGLQDHEKNR

SEQ ID NO: 81431 - protein, 34 aa, Artificial Sequence
  Description of Artificial Sequence: Synthetic polypeptide
AEEEIRTTNPVATEQYGSVSTVNQQAGTEDGGND

SEQ ID NO: 81432 - protein, 29 aa, Artificial Sequence
  Description of Artificial Sequence: Synthetic peptide
DEAAIRTTNPVATEQYGCFSTELINGSQQ

SEQ ID NO: 81433 - protein, 33 aa, Artificial Sequence
  Description of Artificial Sequence: Synthetic polypeptide
DEEEIRTTNPVATEPYGSVVGFGNLNIQGGGND

SEQ ID NO: 81434 - protein, 31 aa, Artificial Sequence
  Description of Artificial Sequence: Synthetic polypeptide
DEEEIRTVNPVATEQYGCVSTGELQSNSQQG

SEQ ID NO: 81435 - protein, 28 aa, Artificial Sequence
  Description of Artificial Sequence: Synthetic peptide
YEEETASVNPVCTEQYGVVSDNLQSGNQ

SEQ ID NO: 81436 - protein, 31 aa, Artificial Sequence
  Description of Artificial Sequence: Synthetic polypeptide
YEEEIFTTNPVATEEYGAVSTVNAQYKIGER

SEQ ID NO: 81437 - protein, 32 aa, Artificial Sequence
  Description of Artificial Sequence: Synthetic polypeptide
DEEEIRTTNPVATEQYGSASTTVCPNREMNPV

SEQ ID NO: 81438 - protein, 33 aa, Artificial Sequence
  Description of Artificial Sequence: Synthetic polypeptide
AEEEIRTTNPVATEQYGSVSTVNQQQQTDNNND

SEQ ID NO: 81439 - protein, 34 aa, Artificial Sequence
  Description of Artificial Sequence: Synthetic polypeptide
YEEEIFTTNPVATEQYGCVCSATSNGLTQDGNRY

SEQ ID NO: 81440 - protein, 34 aa, Artificial Sequence
  Description of Artificial Sequence: Synthetic polypeptide
DEEEIRTTNPVAYEQYGCVSYTNAWSQQAGGNPR

SEQ ID NO: 81441 - protein, 33 aa, Artificial Sequence
  Description of Artificial Sequence: Synthetic polypeptide
DENEIRTTNPVATEIYGSVSNTNQLQQGTTETN

SEQ ID NO: 81442 - protein, 33 aa, Artificial Sequence
  Description of Artificial Sequence: Synthetic polypeptide
DENEIRTTNPVATEIYGSVSTNVNNLQQGTDTE

SEQ ID NO: 81443 - protein, 28 aa, Artificial Sequence
  Description of Artificial Sequence: Synthetic peptide
YEEEMASVNPVCTEQYGVVSDNLQSGNQ

SEQ ID NO: 81444 - protein, 30 aa, Artificial Sequence
  Description of Artificial Sequence: Synthetic polypeptide
SEDEIRATNPVATEQYGSVFCELMQGHGNQ

SEQ ID NO: 81445 - protein, 32 aa, Artificial Sequence
  Description of Artificial Sequence: Synthetic polypeptide
DENEIRTTNPVATEIYGSVVDNGVWLQEGNEW

SEQ ID NO: 81446 - protein, 32 aa, Artificial Sequence
  Description of Artificial Sequence: Synthetic polypeptide
DENEIRTTNPVATEIYGSVVSNVDLQEGNEWM

SEQ ID NO: 81447 - protein, 32 aa, Artificial Sequence
  Description of Artificial Sequence: Synthetic polypeptide
DENEIRTTNPVATEIYGSVVWNMVTLQEGNEW

SEQ ID NO: 81448 - protein, 35 aa, Artificial Sequence
  Description of Artificial Sequence: Synthetic polypeptide
DEEEIRTTNPVAYEQYGQCVCSWENDLNQRGSQNR

SEQ ID NO: 81449 - protein, 31 aa, Artificial Sequence
  Description of Artificial Sequence: Synthetic polypeptide
YEEEIGCTNPYATEQYGSVSSHNVQGPQGNR

SEQ ID NO: 81450 - protein, 31 aa, Artificial Sequence
  Description of Artificial Sequence: Synthetic polypeptide
YEEEIGCTNPYATEYYGSVSPTGNVQGQGNR

SEQ ID NO: 81451 - protein, 33 aa, Artificial Sequence
  Description of Artificial Sequence: Synthetic polypeptide
DEEEIRTTNPVATEFYGSVSTMNLINEFTDGGD

SEQ ID NO: 81452 - protein, 33 aa, Artificial Sequence
  Description of Artificial Sequence: Synthetic polypeptide
DENEIRTTNPVATEIYGTVVASTNVLQEGNEEK

SEQ ID NO: 81453 - protein, 33 aa, Artificial Sequence
  Description of Artificial Sequence: Synthetic polypeptide
DENEIRTTNPVATEIYGVSVCSNYVLQRGNEIA

SEQ ID NO: 81454 - protein, 33 aa, Artificial Sequence
  Description of Artificial Sequence: Synthetic polypeptide
DEEEIRTTNPVATEFYGSVSTMNDGETGQGNGD

SEQ ID NO: 81455 - protein, 33 aa, Artificial Sequence
  Description of Artificial Sequence: Synthetic polypeptide
AEEEIRTTNPVATEQYGSVSTVNQQQQQTENND

SEQ ID NO: 81456 - protein, 31 aa, Artificial Sequence
  Description of Artificial Sequence: Synthetic polypeptide
DEEEIRTTNPVSTEGYGSVCSTPNFLETTFP

SEQ ID NO: 81457 - protein, 33 aa, Artificial Sequence
  Description of Artificial Sequence: Synthetic polypeptide
DEEEIRTTNPVATEQYGSASTTVGPNRNGMNPV

SEQ ID NO: 81458 - protein, 33 aa, Artificial Sequence
  Description of Artificial Sequence: Synthetic polypeptide
YEEETRTTNPCATEQYGCDVSTNLNQRVGENHG

SEQ ID NO: 81459 - protein, 30 aa, Artificial Sequence
  Description of Artificial Sequence: Synthetic polypeptide
YEEEICTTNPSATDHYGSVVTNLQIIGNQG

SEQ ID NO: 81460 - protein, 34 aa, Artificial Sequence
  Description of Artificial Sequence: Synthetic polypeptide
AEEEIRTTNPVATEQYGSVSTVNQQQLEGEETNE

SEQ ID NO: 81461 - protein, 28 aa, Artificial Sequence
  Description of Artificial Sequence: Synthetic peptide
YEEEVASVNPVCTEQYGVVSDNLQSGNQ

SEQ ID NO: 81462 - protein, 30 aa, Artificial Sequence
  Description of Artificial Sequence: Synthetic polypeptide
DEAAIRTTNPVATEQYGCFSTEHIIFGSNR

SEQ ID NO: 81463 - protein, 32 aa, Artificial Sequence
  Description of Artificial Sequence: Synthetic polypeptide
DEEEIRTTNPVATEQYGQCVCSWELQGFGSDQ

SEQ ID NO: 81464 - protein, 32 aa, Artificial Sequence
  Description of Artificial Sequence: Synthetic polypeptide
DEEEIRTVNPVATEQYGCVSTELQNFNSQTQL

SEQ ID NO: 81465 - protein, 32 aa, Artificial Sequence
  Description of Artificial Sequence: Synthetic polypeptide
DENEIRTTNPVATEIYGSVSNNLDQSGGDTDQ

SEQ ID NO: 81466 - protein, 28 aa, Artificial Sequence
  Description of Artificial Sequence: Synthetic peptide
YEEEIRSVNPVCTECWGVVSDNLQSGNQ

SEQ ID NO: 81467 - protein, 34 aa, Artificial Sequence
  Description of Artificial Sequence: Synthetic polypeptide
AEEEIRTTNPVATEQYGSVSTVNQQQLEQGNTNN

SEQ ID NO: 81468 - protein, 32 aa, Artificial Sequence
  Description of Artificial Sequence: Synthetic polypeptide
DENEIRTTNPVATEIYGSVSNNNLQQGTTETN

SEQ ID NO: 81469 - protein, 28 aa, Artificial Sequence
  Description of Artificial Sequence: Synthetic peptide
YEEEICSVNPVCTEQYGVVSDSLQSGNQ

SEQ ID NO: 81470 - protein, 28 aa, Artificial Sequence
  Description of Artificial Sequence: Synthetic peptide
YEEEVASVNPVCTEQYGVVSDNIQSGNR

SEQ ID NO: 81471 - protein, 34 aa, Artificial Sequence
  Description of Artificial Sequence: Synthetic polypeptide
AEEEIRTTNPVATEQYGSVSTVNQQQNDEGNQND

SEQ ID NO: 81472 - protein, 30 aa, Artificial Sequence
  Description of Artificial Sequence: Synthetic polypeptide
DEAEIRTTNPVATEQYGCVWSDHLNREDTE

SEQ ID NO: 81473 - protein, 31 aa, Artificial Sequence
  Description of Artificial Sequence: Synthetic polypeptide
SEDEIATTNPVATEQYGSVATNLTEAGNTEE

SEQ ID NO: 81474 - protein, 32 aa, Artificial Sequence
  Description of Artificial Sequence: Synthetic polypeptide
DENEIRTTNPVATEQWGDVSCNEPQDREGENA

SEQ ID NO: 81475 - protein, 32 aa, Artificial Sequence
  Description of Artificial Sequence: Synthetic polypeptide
DEEEIRTTNPVATEQYGSVTSENDNREEEQMD

SEQ ID NO: 81476 - protein, 29 aa, Artificial Sequence
  Description of Artificial Sequence: Synthetic peptide
SEEEICCTNPTATAQWGSVSENLMRGDRM

SEQ ID NO: 81477 - protein, 32 aa, Artificial Sequence
  Description of Artificial Sequence: Synthetic polypeptide
DEEEIRTTNPVATEFYGSVSTPGFGTNVGGNT

SEQ ID NO: 81478 - protein, 31 aa, Artificial Sequence
  Description of Artificial Sequence: Synthetic polypeptide
DEEEIRTTNPVSTECYGSVSTENDLGDSSFP

SEQ ID NO: 81479 - protein, 29 aa, Artificial Sequence
  Description of Artificial Sequence: Synthetic peptide
SEDEIATTNPVAYEQWGEVSTNLQHNGEH

SEQ ID NO: 81480 - protein, 32 aa, Artificial Sequence
  Description of Artificial Sequence: Synthetic polypeptide
DEEEIRTTNPVSTEGYGSVCSTNFLETGEFHE

SEQ ID NO: 81481 - protein, 30 aa, Artificial Sequence
  Description of Artificial Sequence: Synthetic polypeptide
YEEEICTTNPVATESYGSVSINLGSLDNGE

SEQ ID NO: 81482 - protein, 32 aa, Artificial Sequence
  Description of Artificial Sequence: Synthetic polypeptide
DEEEIRTTNPVATEPWGISTVSTFLSGRGGTE

SEQ ID NO: 81483 - protein, 32 aa, Artificial Sequence
  Description of Artificial Sequence: Synthetic polypeptide
DEEEIRTTNPVGYEQYGSVVVCTNELGRVGTP

SEQ ID NO: 81484 - protein, 34 aa, Artificial Sequence
  Description of Artificial Sequence: Synthetic polypeptide
DEEEIRTTNPVATEPWGESVRTWNDLDQDREKNR

SEQ ID NO: 81485 - protein, 33 aa, Artificial Sequence
  Description of Artificial Sequence: Synthetic polypeptide
DEEEIRTTNPVAYEQYGQSVCSTEDLFQSGSDQ

SEQ ID NO: 81486 - protein, 34 aa, Artificial Sequence
  Description of Artificial Sequence: Synthetic polypeptide
DEEEIRTTNPVAYEQYGQSVCSSNDLNQRFGSIQ

SEQ ID NO: 81487 - protein, 33 aa, Artificial Sequence
  Description of Artificial Sequence: Synthetic polypeptide
DEEEIRTTNPVATEQWGCVCSTGELQHFGSNQP

SEQ ID NO: 81488 - protein, 32 aa, Artificial Sequence
  Description of Artificial Sequence: Synthetic polypeptide
DEEEISTTNPVATEQYGCVCSSELQYFGSNDG

SEQ ID NO: 81489 - protein, 33 aa, Artificial Sequence
  Description of Artificial Sequence: Synthetic polypeptide
DEEEIRTTNPVATEQYGSVTPTNNHQQRDDEDL

SEQ ID NO: 81490 - protein, 33 aa, Artificial Sequence
  Description of Artificial Sequence: Synthetic polypeptide
DEEEIRTTNPVATEFYGSVSTPNFGMTGEGQNG

SEQ ID NO: 81491 - protein, 34 aa, Artificial Sequence
  Description of Artificial Sequence: Synthetic polypeptide
DEEEIRTTNPVAYEQYGQSVCSSNDLEQRGSQQA

SEQ ID NO: 81492 - protein, 29 aa, Artificial Sequence
  Description of Artificial Sequence: Synthetic peptide
DEAAIRTTNPVAYEQYGCFSTNHINGSNQ

SEQ ID NO: 81493 - protein, 34 aa, Artificial Sequence
  Description of Artificial Sequence: Synthetic polypeptide
AEEEIRTTNPVATEQYGSVSTVTNDNQQQGNEDE

SEQ ID NO: 81494 - protein, 32 aa, Artificial Sequence
  Description of Artificial Sequence: Synthetic polypeptide
DEEEIRCTNPVATEQYGCVCSSNHDRSGSNNA

SEQ ID NO: 81495 - protein, 35 aa, Artificial Sequence
  Description of Artificial Sequence: Synthetic polypeptide
AEEEIRTTNPVATEQYGSVSTVNQLNQETTEQGNQ

SEQ ID NO: 81496 - protein, 35 aa, Artificial Sequence
  Description of Artificial Sequence: Synthetic polypeptide
AEEEIRTTNPVATEQYGSVSTVNQLQAGNQNTTTE

SEQ ID NO: 81497 - protein, 28 aa, Artificial Sequence
  Description of Artificial Sequence: Synthetic peptide
YEEGIASVNPVCTEQYGVVSDNLQSGNQ

SEQ ID NO: 81498 - protein, 35 aa, Artificial Sequence
  Description of Artificial Sequence: Synthetic polypeptide
AEEEIRTTNPVATEQYGSVSTVNQLQENNQGNNGE

SEQ ID NO: 81499 - protein, 34 aa, Artificial Sequence
  Description of Artificial Sequence: Synthetic polypeptide
AEEEIRTTNPVATEQYGSVSTVNQLQGNVETNNE

SEQ ID NO: 81500 - protein, 34 aa, Artificial Sequence
  Description of Artificial Sequence: Synthetic polypeptide
DEEEIRTTNPVAYEQYGQSVCSSMNDLNQSGSQR

SEQ ID NO: 81501 - protein, 31 aa, Artificial Sequence
  Description of Artificial Sequence: Synthetic polypeptide
DENEIRTTNPVATEQYGCVSFDNQQIGDGQQ

SEQ ID NO: 81502 - protein, 34 aa, Artificial Sequence
  Description of Artificial Sequence: Synthetic polypeptide
AEEEIRTTNPVATEQYGSVSTVNQLQQQNSTNAE

SEQ ID NO: 81503 - protein, 35 aa, Artificial Sequence
  Description of Artificial Sequence: Synthetic polypeptide
AEEEIRTTNPVATEQYGSVSTVNQLQSGTVNTNAT

SEQ ID NO: 81504 - protein, 28 aa, Artificial Sequence
  Description of Artificial Sequence: Synthetic peptide
YEEGIACVNPVCTEQYGVVSDNLQSGNQ

SEQ ID NO: 81505 - protein, 30 aa, Artificial Sequence
  Description of Artificial Sequence: Synthetic polypeptide
AEDEICATNPVATEQYGTVATENLQEGNGD

SEQ ID NO: 81506 - protein, 34 aa, Artificial Sequence
  Description of Artificial Sequence: Synthetic polypeptide
AEEEIRTTNPVATEQYGSVSTVNQLNENNNGENQ

SEQ ID NO: 81507 - protein, 34 aa, Artificial Sequence
  Description of Artificial Sequence: Synthetic polypeptide
AEEEIRTTNPVATEQYGSVSTVNQLNENNGNNVE

SEQ ID NO: 81508 - protein, 34 aa, Artificial Sequence
  Description of Artificial Sequence: Synthetic polypeptide
DEEEIRTTNPVATEQYGSVVGSTVDIQGEQGNIQ

SEQ ID NO: 81509 - protein, 28 aa, Artificial Sequence
  Description of Artificial Sequence: Synthetic peptide
ADNEIACTNPVATEQYGNVAETLQRGGR

SEQ ID NO: 81510 - protein, 30 aa, Artificial Sequence
  Description of Artificial Sequence: Synthetic polypeptide
DENEIRTTNPVATECYGSVSCCEPQDHGEL

SEQ ID NO: 81511 - protein, 30 aa, Artificial Sequence
  Description of Artificial Sequence: Synthetic polypeptide
DENEIRTTNPVATECYGSVSEAGNHGMNPV

SEQ ID NO: 81512 - protein, 32 aa, Artificial Sequence
  Description of Artificial Sequence: Synthetic polypeptide
YEEEIRTTNPVATYEEYGAVNSTVNAQKIGER

SEQ ID NO: 81513 - protein, 34 aa, Artificial Sequence
  Description of Artificial Sequence: Synthetic polypeptide
AEEEIRTTNPVATEQYGSVSTVNNQQQTNGNNVD

SEQ ID NO: 81514 - protein, 35 aa, Artificial Sequence
  Description of Artificial Sequence: Synthetic polypeptide
DEEEIRTTNPVAYEQYGQSVCSTNDLFQERFGSDQ

SEQ ID NO: 81515 - protein, 32 aa, Artificial Sequence
  Description of Artificial Sequence: Synthetic polypeptide
CEEEISTTNPVATEQYGSVCSTNLANFGSEQS

SEQ ID NO: 81516 - protein, 32 aa, Artificial Sequence
  Description of Artificial Sequence: Synthetic polypeptide
DEEEIRTTNPVAYEQYGCVCSTNHQGFGSDFQ

SEQ ID NO: 81517 - protein, 34 aa, Artificial Sequence
  Description of Artificial Sequence: Synthetic polypeptide
DEEEIRTTNPVATEQWGCVVAMTNLNRDGMNDRQ

SEQ ID NO: 81518 - protein, 32 aa, Artificial Sequence
  Description of Artificial Sequence: Synthetic polypeptide
DEEEIRTTNPVATEQYGSVTPTNLINDELSGL

SEQ ID NO: 81519 - protein, 33 aa, Artificial Sequence
  Description of Artificial Sequence: Synthetic polypeptide
DEEEIRTTNPVATEFYGSVSTPNMGTIVGNNED

SEQ ID NO: 81520 - protein, 32 aa, Artificial Sequence
  Description of Artificial Sequence: Synthetic polypeptide
DEEEIRTTNPVAYEQYGCVCSTNTQYFGSEQS

SEQ ID NO: 81521 - protein, 31 aa, Artificial Sequence
  Description of Artificial Sequence: Synthetic polypeptide
DEEEIRCTNPVATEQYGCVCSSNHDGGSNSA

SEQ ID NO: 81522 - protein, 34 aa, Artificial Sequence
  Description of Artificial Sequence: Synthetic polypeptide
AEEEIRTTNPVATEQYGSVSTVNNVNQQGENEQE

SEQ ID NO: 81523 - protein, 34 aa, Artificial Sequence
  Description of Artificial Sequence: Synthetic polypeptide
AEEEIRTTNPVATEQYGSVSTVNNVNQQGNENQD

SEQ ID NO: 81524 - protein, 34 aa, Artificial Sequence
  Description of Artificial Sequence: Synthetic polypeptide
AEEEIRTTNPVATEQYGSVSTVNQEQGEQEGNQG

SEQ ID NO: 81525 - protein, 28 aa, Artificial Sequence
  Description of Artificial Sequence: Synthetic peptide
ADNEIACTNPVATEQYGEAAENLQRGGR

SEQ ID NO: 81526 - protein, 33 aa, Artificial Sequence
  Description of Artificial Sequence: Synthetic polypeptide
DEEEIRTTNPVAYEQYGCVCSTNHQNFGSNPQL

SEQ ID NO: 81527 - protein, 32 aa, Artificial Sequence
  Description of Artificial Sequence: Synthetic polypeptide
DEEEIRTTNPVATEEYGCVCSTEHQNFGSNQS

SEQ ID NO: 81528 - protein, 32 aa, Artificial Sequence
  Description of Artificial Sequence: Synthetic polypeptide
DENEIRTTNPVATEQYGCVSTMNNQNQSLNDS

SEQ ID NO: 81529 - protein, 28 aa, Artificial Sequence
  Description of Artificial Sequence: Synthetic peptide
ADNEIACTNPVATEQYGEAYENLQRGGR

SEQ ID NO: 81530 - protein, 34 aa, Artificial Sequence
  Description of Artificial Sequence: Synthetic polypeptide
AEEEIRTTNPVATEQYGSVSTVNQLAGTEGGGND

SEQ ID NO: 81531 - protein, 32 aa, Artificial Sequence
  Description of Artificial Sequence: Synthetic polypeptide
DEEEISTTNPVATEQYGCVCSSEPLQNFGSNQ

SEQ ID NO: 81532 - protein, 28 aa, Artificial Sequence
  Description of Artificial Sequence: Synthetic peptide
YEEEIATVNPVATEQYGVASDVLQHGEK

SEQ ID NO: 81533 - protein, 33 aa, Artificial Sequence
  Description of Artificial Sequence: Synthetic polypeptide
DEEEIRTTNPVATEQYGQCVCSTYHQRFGSEQG

SEQ ID NO: 81534 - protein, 32 aa, Artificial Sequence
  Description of Artificial Sequence: Synthetic polypeptide
DEEEISTTNPVATEQYGCVCSSELQNFGSNNQ

SEQ ID NO: 81535 - protein, 29 aa, Artificial Sequence
  Description of Artificial Sequence: Synthetic peptide
YEEEIATVNPVATEQYGVVSDNLEDSGEL

SEQ ID NO: 81536 - protein, 29 aa, Artificial Sequence
  Description of Artificial Sequence: Synthetic peptide
YEEEIATVNPVCTEQWGVVSDNLQDSGNQ

SEQ ID NO: 81537 - protein, 28 aa, Artificial Sequence
  Description of Artificial Sequence: Synthetic peptide
ADNEIASTNPVATEQYGNVAENIQRGQR

SEQ ID NO: 81538 - protein, 32 aa, Artificial Sequence
  Description of Artificial Sequence: Synthetic polypeptide
DENEIRTTNPVATEQYGCVCSTGELQNFGSEQ

SEQ ID NO: 81539 - protein, 35 aa, Artificial Sequence
  Description of Artificial Sequence: Synthetic polypeptide
DEEEIRTTNPVATEQYGSAVPSETNPLTQHPPNLH

SEQ ID NO: 81540 - protein, 31 aa, Artificial Sequence
  Description of Artificial Sequence: Synthetic polypeptide
DENEIRTTNPVATEQWGDVSCNEPQNAEGNA

SEQ ID NO: 81541 - protein, 31 aa, Artificial Sequence
  Description of Artificial Sequence: Synthetic polypeptide
DENEIRTTNPVATEQYGCVCSTGEHQNNSNQ

SEQ ID NO: 81542 - protein, 28 aa, Artificial Sequence
  Description of Artificial Sequence: Synthetic peptide
YEEEIATVNPVCTEQYGEVSEVLQSGEQ

SEQ ID NO: 81543 - protein, 30 aa, Artificial Sequence
  Description of Artificial Sequence: Synthetic polypeptide
YEEEIATVNPVCTEQYGSVSDPNGQSNGNV

SEQ ID NO: 81544 - protein, 33 aa, Artificial Sequence
  Description of Artificial Sequence: Synthetic polypeptide
DEEEIRTTNPVATEPWGESTVSCTNLSIRGGTQ

SEQ ID NO: 81545 - protein, 33 aa, Artificial Sequence
  Description of Artificial Sequence: Synthetic polypeptide
DENEIRTTNPVATEGYGSVSNNDLGQRGQTGQT

SEQ ID NO: 81546 - protein, 33 aa, Artificial Sequence
  Description of Artificial Sequence: Synthetic polypeptide
DENEIRTTNPVATEQYGCVCSTGNHQSFGSNQP

SEQ ID NO: 81547 - protein, 32 aa, Artificial Sequence
  Description of Artificial Sequence: Synthetic polypeptide
DENEIRTTNPVATEQYGCVCSTGEHQGGSNQM

SEQ ID NO: 81548 - protein, 33 aa, Artificial Sequence
  Description of Artificial Sequence: Synthetic polypeptide
DEEEIRTTNPVATEQYGSAVISAENHQMAHDRA

SEQ ID NO: 81549 - protein, 33 aa, Artificial Sequence
  Description of Artificial Sequence: Synthetic polypeptide
DEEEIRTTNPVATEPWGESTVSTNGLSGRGGTE

SEQ ID NO: 81550 - protein, 31 aa, Artificial Sequence
  Description of Artificial Sequence: Synthetic polypeptide
DENEIRTTNPVATEIYGCVCSSNLQYGSEQS

SEQ ID NO: 81551 - protein, 30 aa, Artificial Sequence
  Description of Artificial Sequence: Synthetic polypeptide
YEEEIRSVNPVCTEQYGVVSTNLNMSGNPQ

SEQ ID NO: 81552 - protein, 32 aa, Artificial Sequence
  Description of Artificial Sequence: Synthetic polypeptide
DEEEISTTNPVATEQYGCVCSNTNHQSGSEQP

SEQ ID NO: 81553 - protein, 32 aa, Artificial Sequence
  Description of Artificial Sequence: Synthetic polypeptide
DEEEIRCTNPVATEQYGCVCSTELQHFNSNQL

SEQ ID NO: 81554 - protein, 31 aa, Artificial Sequence
  Description of Artificial Sequence: Synthetic polypeptide
DENEIRTTNPVATEIYGCVCSWGNLQNGSEQ

SEQ ID NO: 81555 - protein, 33 aa, Artificial Sequence
  Description of Artificial Sequence: Synthetic polypeptide
DEEEIRTTNPVATEPYGSVVDFENNELTRGGNE

SEQ ID NO: 81556 - protein, 31 aa, Artificial Sequence
  Description of Artificial Sequence: Synthetic polypeptide
DENEIRTTNPVATEIYGCVCSWNTQRFGSEQ

SEQ ID NO: 81557 - protein, 31 aa, Artificial Sequence
  Description of Artificial Sequence: Synthetic polypeptide
DENEIRTTNPVATEIYGCVSNNLQGDLGDTS

SEQ ID NO: 81558 - protein, 31 aa, Artificial Sequence
  Description of Artificial Sequence: Synthetic polypeptide
DEEEIRCTNPVATEQYGCVCSTEHQNFTSNQ

SEQ ID NO: 81559 - protein, 33 aa, Artificial Sequence
  Description of Artificial Sequence: Synthetic polypeptide
DENEIRTTNPVATEQYGCVSTNLLQRSVQDDEN

SEQ ID NO: 81560 - protein, 32 aa, Artificial Sequence
  Description of Artificial Sequence: Synthetic polypeptide
DENEIRTTNPVATEQYGCVCSTNDQNFGSEQM

SEQ ID NO: 81561 - protein, 31 aa, Artificial Sequence
  Description of Artificial Sequence: Synthetic polypeptide
SEEEICTTNPVATEPYGSVATNLQIDGDDLE

SEQ ID NO: 81562 - protein, 34 aa, Artificial Sequence
  Description of Artificial Sequence: Synthetic polypeptide
AEEEIRTTNPVATEQYGSVSTVTNNQQSGNQQND

SEQ ID NO: 81563 - protein, 32 aa, Artificial Sequence
  Description of Artificial Sequence: Synthetic polypeptide
DEEEIRTTNPVATEFYGSVSTPGFGTTGGNDD

SEQ ID NO: 81564 - protein, 34 aa, Artificial Sequence
  Description of Artificial Sequence: Synthetic polypeptide
DEEEIRTTNPVATEQWGCVADMTNLNRDGMNDRH

SEQ ID NO: 81565 - protein, 33 aa, Artificial Sequence
  Description of Artificial Sequence: Synthetic polypeptide
DEEEIRTTNPVATEEYGCVCSTGYLQNFGSNQS

SEQ ID NO: 81566 - protein, 34 aa, Artificial Sequence
  Description of Artificial Sequence: Synthetic polypeptide
DEEEIRTTNPVATEQYGSVVSTNQDDQLGGDEDI

SEQ ID NO: 81567 - protein, 33 aa, Artificial Sequence
  Description of Artificial Sequence: Synthetic polypeptide
DEEEIRTTNPVATEEYGCVCSTMELQNFGSNQA

SEQ ID NO: 81568 - protein, 33 aa, Artificial Sequence
  Description of Artificial Sequence: Synthetic polypeptide
DEEEIRTTNPVATEQYGSVTPTVEDLNVRIERQ

SEQ ID NO: 81569 - protein, 33 aa, Artificial Sequence
  Description of Artificial Sequence: Synthetic polypeptide
YEEFIRTTNPVATEQYGCFVSTTINLNERQNQR

SEQ ID NO: 81570 - protein, 29 aa, Artificial Sequence
  Description of Artificial Sequence: Synthetic peptide
DENEIASVNPVCTEQYGVVSDNLQQSGNH

SEQ ID NO: 81571 - protein, 34 aa, Artificial Sequence
  Description of Artificial Sequence: Synthetic polypeptide
DEEEIRTTNPVATEQYGSVVGTMNGDQNEGENPG

SEQ ID NO: 81572 - protein, 33 aa, Artificial Sequence
  Description of Artificial Sequence: Synthetic polypeptide
DEAEIRTTNPVATECWGSVSCTNEPQVRDGENG

SEQ ID NO: 81573 - protein, 31 aa, Artificial Sequence
  Description of Artificial Sequence: Synthetic polypeptide
SEEEICTTNPVATEPYGSVATNLTIDGNMIM

SEQ ID NO: 81574 - protein, 32 aa, Artificial Sequence
  Description of Artificial Sequence: Synthetic polypeptide
DEEEIRTTNPVATEFYGSVSTPGFGTNVGNGQ

SEQ ID NO: 81575 - protein, 28 aa, Artificial Sequence
  Description of Artificial Sequence: Synthetic peptide
SEEEIACTNPVATEQYGVVAETLMHGDR

SEQ ID NO: 81576 - protein, 34 aa, Artificial Sequence
  Description of Artificial Sequence: Synthetic polypeptide
AEEEIRTTNPVATEQYGSVSTVTLQNDNEEGNTD

SEQ ID NO: 81577 - protein, 31 aa, Artificial Sequence
  Description of Artificial Sequence: Synthetic polypeptide
DENEIRTTNPVATEGYGCVCSWNLQNGSDQM

SEQ ID NO: 81578 - protein, 34 aa, Artificial Sequence
  Description of Artificial Sequence: Synthetic polypeptide
DEEEIRTTNPVATEQYGSVTPTVNTEQRGLQSDD

SEQ ID NO: 81579 - protein, 32 aa, Artificial Sequence
  Description of Artificial Sequence: Synthetic polypeptide
DENEIRTTNPVATEQYGCVCSTNHQENFGSEQ

SEQ ID NO: 81580 - protein, 32 aa, Artificial Sequence
  Description of Artificial Sequence: Synthetic polypeptide
DENEIRTTNPVATEGYGSQVSDTNNSTSMGNL

SEQ ID NO: 81581 - protein, 31 aa, Artificial Sequence
  Description of Artificial Sequence: Synthetic polypeptide
YEEEIATVNPVATEQYGVVSSDNLQMSNGNQ

SEQ ID NO: 81582 - protein, 28 aa, Artificial Sequence
  Description of Artificial Sequence: Synthetic peptide
YEEEIATVNPVCTEPYGVISDNLQQGNQ

SEQ ID NO: 81583 - protein, 31 aa, Artificial Sequence
  Description of Artificial Sequence: Synthetic polypeptide
SEEEICTTNPVATEPYGSVATNLQNIDGDEN

SEQ ID NO: 81584 - protein, 31 aa, Artificial Sequence
  Description of Artificial Sequence: Synthetic polypeptide
DEEEISTTNPVATEQYGCVCSSEDQYFGSNQ

SEQ ID NO: 81585 - protein, 32 aa, Artificial Sequence
  Description of Artificial Sequence: Synthetic polypeptide
REEEIRTTNPVATEQYGAVVPSTNLETLGTFK

SEQ ID NO: 81586 - protein, 31 aa, Artificial Sequence
  Description of Artificial Sequence: Synthetic polypeptide
SEEEIRCTNPIATEQYGCVCSWELNARGSNR

SEQ ID NO: 81587 - protein, 28 aa, Artificial Sequence
  Description of Artificial Sequence: Synthetic peptide
YEEEIASVNPVCTEQYGVVSDVLQSGNQ

SEQ ID NO: 81588 - protein, 34 aa, Artificial Sequence
  Description of Artificial Sequence: Synthetic polypeptide
AEEEIRTTNPVATEQYGSVSTTNTLLGNNGNGNG

SEQ ID NO: 81589 - protein, 33 aa, Artificial Sequence
  Description of Artificial Sequence: Synthetic polypeptide
DEAEICTTNPVATEQYGSVSTTNGDQNQQGDER

SEQ ID NO: 81590 - protein, 29 aa, Artificial Sequence
  Description of Artificial Sequence: Synthetic peptide
YEEEIASVNPVCTEQYGCVSDNLQSAGNQ

SEQ ID NO: 81591 - protein, 31 aa, Artificial Sequence
  Description of Artificial Sequence: Synthetic polypeptide
SEEEIACTNPVATEQWGSVATNLEGNGNPRQ

SEQ ID NO: 81592 - protein, 32 aa, Artificial Sequence
  Description of Artificial Sequence: Synthetic polypeptide
DEEEIRTTNPVATEQYGACSTENNDNGSGENS

SEQ ID NO: 81593 - protein, 28 aa, Artificial Sequence
  Description of Artificial Sequence: Synthetic peptide
SEEEIACTNPIGTEQYGSVAENLMRGDI

SEQ ID NO: 81594 - protein, 29 aa, Artificial Sequence
  Description of Artificial Sequence: Synthetic peptide
YEEEIASVNPVCTEQYGCVVSDNLQSGNQ

SEQ ID NO: 81595 - protein, 33 aa, Artificial Sequence
  Description of Artificial Sequence: Synthetic polypeptide
DENEIRTTNPVATEQYGSVSPDNHLDQEGIEDG

SEQ ID NO: 81596 - protein, 33 aa, Artificial Sequence
  Description of Artificial Sequence: Synthetic polypeptide
DEAEICTTNPVATEQYGSVSTTNGGQPNQGDER

SEQ ID NO: 81597 - protein, 35 aa, Artificial Sequence
  Description of Artificial Sequence: Synthetic polypeptide
AEEEIRTTNPVATEQYGSVSTVTNLQNEQQGENSE

SEQ ID NO: 81598 - protein, 33 aa, Artificial Sequence
  Description of Artificial Sequence: Synthetic polypeptide
DEAEICTTNPVATEQYGSVSTTNGGTQNQGDER

SEQ ID NO: 81599 - protein, 32 aa, Artificial Sequence
  Description of Artificial Sequence: Synthetic polypeptide
DEEEIRTTNPVATEQYGSVTTTTTLEREQQGM

SEQ ID NO: 81600 - protein, 32 aa, Artificial Sequence
  Description of Artificial Sequence: Synthetic polypeptide
DEAEICTTNPVATEQYGSVSTTNGQNDDDDER

SEQ ID NO: 81601 - protein, 33 aa, Artificial Sequence
  Description of Artificial Sequence: Synthetic polypeptide
DEEEIRTTNPVATEQYGMVSIQTVGQDGNGNQN

SEQ ID NO: 81602 - protein, 32 aa, Artificial Sequence
  Description of Artificial Sequence: Synthetic polypeptide
DEEEIRTTNPVATEQYGMVSITGQGTGNNQGN

SEQ ID NO: 81603 - protein, 32 aa, Artificial Sequence
  Description of Artificial Sequence: Synthetic polypeptide
DEEEIRTTNPVATEQYGAAVSTNEDQMNDEDE

SEQ ID NO: 81604 - protein, 34 aa, Artificial Sequence
  Description of Artificial Sequence: Synthetic polypeptide
DEEEIRCTNPAATEQYGSVIANTGNLQREGGNGG

SEQ ID NO: 81605 - protein, 33 aa, Artificial Sequence
  Description of Artificial Sequence: Synthetic polypeptide
DEEEIRTTNPVATEQYGMVSITGVGGQGEDGNM

SEQ ID NO: 81606 - protein, 28 aa, Artificial Sequence
  Description of Artificial Sequence: Synthetic peptide
YEEEIASVNPVCTEQYGEASDNLQSGNQ

SEQ ID NO: 81607 - protein, 35 aa, Artificial Sequence
  Description of Artificial Sequence: Synthetic polypeptide
AEEEIRTTNPVATEQYGSVSTTNTNLQAIGTNNNI

SEQ ID NO: 81608 - protein, 33 aa, Artificial Sequence
  Description of Artificial Sequence: Synthetic polypeptide
DEEEIRTTNPVAYEQYGSTVVVCTNALQHTDSR

SEQ ID NO: 81609 - protein, 34 aa, Artificial Sequence
  Description of Artificial Sequence: Synthetic polypeptide
AEEEIRTTNPVATEQYGSVSTTNSQSGNTTNQEE

SEQ ID NO: 81610 - protein, 34 aa, Artificial Sequence
  Description of Artificial Sequence: Synthetic polypeptide
AEEEIRTTNPVATEQYGSVSTTNSQSGNNENQET

SEQ ID NO: 81611 - protein, 33 aa, Artificial Sequence
  Description of Artificial Sequence: Synthetic polypeptide
DEEEIRTTNPVATEQYGMVSIGNGGQGGNDNVS

SEQ ID NO: 81612 - protein, 33 aa, Artificial Sequence
  Description of Artificial Sequence: Synthetic polypeptide
DEAEICTTNPVATEQYGSVSTSNGLDSGQGEGR

SEQ ID NO: 81613 - protein, 28 aa, Artificial Sequence
  Description of Artificial Sequence: Synthetic peptide
YETEIASVNPVCTEQYGAVSANLQSGNQ

SEQ ID NO: 81614 - protein, 35 aa, Artificial Sequence
  Description of Artificial Sequence: Synthetic polypeptide
DEEEIRTTNPVAYEQYGQSVTSTNDLLQRSIEKRP

SEQ ID NO: 81615 - protein, 28 aa, Artificial Sequence
  Description of Artificial Sequence: Synthetic peptide
YEEEIASVNPVCTEQYGAVSDDLQSGNQ

SEQ ID NO: 81616 - protein, 33 aa, Artificial Sequence
  Description of Artificial Sequence: Synthetic polypeptide
DEAEICTTNPVATEQYGSVSTNGLQGDHGQGDA

SEQ ID NO: 81617 - protein, 34 aa, Artificial Sequence
  Description of Artificial Sequence: Synthetic polypeptide
AEEEIRTTNPVATEQYGSVSTTNQQQQTQGNNEE

SEQ ID NO: 81618 - protein, 34 aa, Artificial Sequence
  Description of Artificial Sequence: Synthetic polypeptide
AEEEIRTTNPVATEQYGSVSTTNQQQQTQGTNTE

SEQ ID NO: 81619 - protein, 32 aa, Artificial Sequence
  Description of Artificial Sequence: Synthetic polypeptide
DEEEIRATNPVTTEQYGSVSTNVATEIGTTNG

SEQ ID NO: 81620 - protein, 32 aa, Artificial Sequence
  Description of Artificial Sequence: Synthetic polypeptide
DEEEIRTTNPVATEQYGMVSIFGVGQGGNNQN

SEQ ID NO: 81621 - protein, 32 aa, Artificial Sequence
  Description of Artificial Sequence: Synthetic polypeptide
DEAEICTTNPVATEQYGSVSTNLNGNDGMDEA

SEQ ID NO: 81622 - protein, 32 aa, Artificial Sequence
  Description of Artificial Sequence: Synthetic polypeptide
DEAEICTTNPVATEQYGSVSTNLNGNDGMDGQ

SEQ ID NO: 81623 - protein, 33 aa, Artificial Sequence
  Description of Artificial Sequence: Synthetic polypeptide
DEEEIRTTNPVATEQYGMVSITNNGMEEGGGNI

SEQ ID NO: 81624 - protein, 29 aa, Artificial Sequence
  Description of Artificial Sequence: Synthetic peptide
YEEEIASVNPVCTEQYGAVSDNLQSGTNQ

SEQ ID NO: 81625 - protein, 29 aa, Artificial Sequence
  Description of Artificial Sequence: Synthetic peptide
YEEEIASVNPVCTEQYGAVSVDNLQSGNQ

SEQ ID NO: 81626 - protein, 28 aa, Artificial Sequence
  Description of Artificial Sequence: Synthetic peptide
SEEEIACTNPIGTEQYGSVASNLMRGDI

SEQ ID NO: 81627 - protein, 33 aa, Artificial Sequence
  Description of Artificial Sequence: Synthetic polypeptide
AEEEIRTTNPVATEQYGSVSTTNSNLNEATNVE

SEQ ID NO: 81628 - protein, 33 aa, Artificial Sequence
  Description of Artificial Sequence: Synthetic polypeptide
DEEEIRTTNPVATEQYGMVSIFTGVGQTGNEQG

SEQ ID NO: 81629 - protein, 33 aa, Artificial Sequence
  Description of Artificial Sequence: Synthetic polypeptide
AEEEIRTTNPVATEQYGSVSTTNSNLNNEQANV

SEQ ID NO: 81630 - protein, 35 aa, Artificial Sequence
  Description of Artificial Sequence: Synthetic polypeptide
YEEEIRTTNPVATEQYGEVPSTPNLIQLRDGANYI

SEQ ID NO: 81631 - protein, 29 aa, Artificial Sequence
  Description of Artificial Sequence: Synthetic peptide
YEEEIASVNPVCTEQYGCVSDNLQMSGNQ

SEQ ID NO: 81632 - protein, 29 aa, Artificial Sequence
  Description of Artificial Sequence: Synthetic peptide
SEEEIACTNPVATEQWGSVATELERADRN

SEQ ID NO: 81633 - protein, 34 aa, Artificial Sequence
  Description of Artificial Sequence: Synthetic polypeptide
DEEEIRTTNPVATEQYGMVSIFTNDQNEIADGNT

SEQ ID NO: 81634 - protein, 33 aa, Artificial Sequence
  Description of Artificial Sequence: Synthetic polypeptide
DEEEIRTTNPVATEQYGMVSIFTVGQGNGNEQN

SEQ ID NO: 81635 - protein, 33 aa, Artificial Sequence
  Description of Artificial Sequence: Synthetic polypeptide
DEAEICTTNPVATEQYGSVSTNLNQGDHGQGDA

SEQ ID NO: 81636 - protein, 30 aa, Artificial Sequence
  Description of Artificial Sequence: Synthetic polypeptide
DEEEIRTTNPVSTEQYGSVTFYDLQGDSQT

SEQ ID NO: 81637 - protein, 33 aa, Artificial Sequence
  Description of Artificial Sequence: Synthetic polypeptide
DEEEIRTTNPVATEQYGMVSITVGQGTNGNGQN

SEQ ID NO: 81638 - protein, 28 aa, Artificial Sequence
  Description of Artificial Sequence: Synthetic peptide
YEEEIASVNPVCTEQYGEASENLQSGNQ

SEQ ID NO: 81639 - protein, 34 aa, Artificial Sequence
  Description of Artificial Sequence: Synthetic polypeptide
AEEEIRTTNPVATEQYGSVSTTNTTNLQGNNEEV

SEQ ID NO: 81640 - protein, 28 aa, Artificial Sequence
  Description of Artificial Sequence: Synthetic peptide
QESEIVSTNPVATEGYGTVSSGLQHGND

SEQ ID NO: 81641 - protein, 32 aa, Artificial Sequence
  Description of Artificial Sequence: Synthetic polypeptide
DEEEIRSTNPVATEQYGYVNTNFFQYTDPNIR

SEQ ID NO: 81642 - protein, 32 aa, Artificial Sequence
  Description of Artificial Sequence: Synthetic polypeptide
DEAEICTTNPVATEYWGSVSTNLQGANGDNDD

SEQ ID NO: 81643 - protein, 29 aa, Artificial Sequence
  Description of Artificial Sequence: Synthetic peptide
DENEIATTNPVATECYGTVSECLQQHENL

SEQ ID NO: 81644 - protein, 28 aa, Artificial Sequence
  Description of Artificial Sequence: Synthetic peptide
SEEEIACTNPIGTEGYGSVASNLMRGDR

SEQ ID NO: 81645 - protein, 35 aa, Artificial Sequence
  Description of Artificial Sequence: Synthetic polypeptide
AEEEIRTTNPVATEQYGSVSTVTNNLNQNIGENED

SEQ ID NO: 81646 - protein, 32 aa, Artificial Sequence
  Description of Artificial Sequence: Synthetic polypeptide
DEEEIRTTNPVAYEQYGSVATNLQANPHPEHQ

SEQ ID NO: 81647 - protein, 34 aa, Artificial Sequence
  Description of Artificial Sequence: Synthetic polypeptide
AEEEIRTTNPVATEQYGSVSTTNVNNQDTGNNSE

SEQ ID NO: 81648 - protein, 34 aa, Artificial Sequence
  Description of Artificial Sequence: Synthetic polypeptide
AEEEIRTTNPVATEQYGSVSTTNVNQNNTGGNEE

SEQ ID NO: 81649 - protein, 28 aa, Artificial Sequence
  Description of Artificial Sequence: Synthetic peptide
QESEIVSTNPVATEGYGTVSSTLQHGND

SEQ ID NO: 81650 - protein, 31 aa, Artificial Sequence
  Description of Artificial Sequence: Synthetic polypeptide
YESEIRTVNPVATECYGSVSCNLPQSEGENQ

SEQ ID NO: 81651 - protein, 32 aa, Artificial Sequence
  Description of Artificial Sequence: Synthetic polypeptide
DEEEIRTTNPVAYEQYGSVATNLQGPDDSMHN

SEQ ID NO: 81652 - protein, 34 aa, Artificial Sequence
  Description of Artificial Sequence: Synthetic polypeptide
DEEEIRTTNPVATEQYGMVSTDDLGQSEGGNDEE

SEQ ID NO: 81653 - protein, 34 aa, Artificial Sequence
  Description of Artificial Sequence: Synthetic polypeptide
DENEIRTTNPVATEQYGSVSITWNTQEEGQQENI

SEQ ID NO: 81654 - protein, 32 aa, Artificial Sequence
  Description of Artificial Sequence: Synthetic polypeptide
DEAEICTTNPVAVEQYGSVSTSTNLEQETNVG

SEQ ID NO: 81655 - protein, 33 aa, Artificial Sequence
  Description of Artificial Sequence: Synthetic polypeptide
DEEEIRTTNPVATEQYGMVSTDIMQGNGGENID

SEQ ID NO: 81656 - protein, 29 aa, Artificial Sequence
  Description of Artificial Sequence: Synthetic peptide
DEEEIRSTNPVATEQYGVVSDIEMNAENA

SEQ ID NO: 81657 - protein, 32 aa, Artificial Sequence
  Description of Artificial Sequence: Synthetic polypeptide
DEAEICTTNPVAVEQYGSVSTTNLEQGTTNGE

SEQ ID NO: 81658 - protein, 32 aa, Artificial Sequence
  Description of Artificial Sequence: Synthetic polypeptide
DEAEICTTNPVAVEQYGSVSTTNNLDEQGTNG

SEQ ID NO: 81659 - protein, 29 aa, Artificial Sequence
  Description of Artificial Sequence: Synthetic peptide
DEEEIRCTNPIATECWGSVAAENWMPGNR

SEQ ID NO: 81660 - protein, 33 aa, Artificial Sequence
  Description of Artificial Sequence: Synthetic polypeptide
DEEEIRTTNPVATEQYGMVSNTNDTTGMGENGA

SEQ ID NO: 81661 - protein, 32 aa, Artificial Sequence
  Description of Artificial Sequence: Synthetic polypeptide
DEEEIRTTNPVAYEQWGSSYSLPNDLQQDNDR

SEQ ID NO: 81662 - protein, 28 aa, Artificial Sequence
  Description of Artificial Sequence: Synthetic peptide
QESEIVSTNPVATEGYGTVASTLQHGND

SEQ ID NO: 81663 - protein, 32 aa, Artificial Sequence
  Description of Artificial Sequence: Synthetic polypeptide
DEEEIRTTNPVATEQYGMVSNTDDEMQEGGED

SEQ ID NO: 81664 - protein, 34 aa, Artificial Sequence
  Description of Artificial Sequence: Synthetic polypeptide
DEEEIRTTNPVATEQYGMVSITVNFEQGGGGNQT

SEQ ID NO: 81665 - protein, 32 aa, Artificial Sequence
  Description of Artificial Sequence: Synthetic polypeptide
DEEEIRTTNPVATEQYGMVSITVQTDNGNEGN

SEQ ID NO: 81666 - protein, 33 aa, Artificial Sequence
  Description of Artificial Sequence: Synthetic polypeptide
DEAEICTTNPVATEQYGSVSWTEQHQERMGQNL

SEQ ID NO: 81667 - protein, 34 aa, Artificial Sequence
  Description of Artificial Sequence: Synthetic polypeptide
AEEEIRTTNPVATEQYGSVSTTNTNNQAIGNNNI

SEQ ID NO: 81668 - protein, 34 aa, Artificial Sequence
  Description of Artificial Sequence: Synthetic polypeptide
AEEEIRTTNPVATEQYGSVSTTNTNQAIGTNTNI

SEQ ID NO: 81669 - protein, 33 aa, Artificial Sequence
  Description of Artificial Sequence: Synthetic polypeptide
DEEEIRTTNPVATEQYGMVSNENFEQGDGGNEG

SEQ ID NO: 81670 - protein, 28 aa, Artificial Sequence
  Description of Artificial Sequence: Synthetic peptide
YEEEIASVNPVCTEQYGEVPDNLQSGNQ

SEQ ID NO: 81671 - protein, 29 aa, Artificial Sequence
  Description of Artificial Sequence: Synthetic peptide
YESEVASTNPVCTEQYGVVSADNLQSGNR

SEQ ID NO: 81672 - protein, 30 aa, Artificial Sequence
  Description of Artificial Sequence: Synthetic polypeptide
DENEIATTNPVATECYGTVSATCLVQFGEL

SEQ ID NO: 81673 - protein, 35 aa, Artificial Sequence
  Description of Artificial Sequence: Synthetic polypeptide
AEEEIRTTNPVATEQYGSVSTVTNNLNQEIGTNTD

SEQ ID NO: 81674 - protein, 33 aa, Artificial Sequence
  Description of Artificial Sequence: Synthetic polypeptide
DENEIRTTNPVATEQYGSVSNTWALQNRTQDDQ

SEQ ID NO: 81675 - protein, 35 aa, Artificial Sequence
  Description of Artificial Sequence: Synthetic polypeptide
DEEEIRTTNPVAYEQYGSTYSCTPPALSQRPGNNR

SEQ ID NO: 81676 - protein, 34 aa, Artificial Sequence
  Description of Artificial Sequence: Synthetic polypeptide
AEEEIRTTNPVATEQYGSVSTTNTQNLGGNNEEV

SEQ ID NO: 81677 - protein, 33 aa, Artificial Sequence
  Description of Artificial Sequence: Synthetic polypeptide
DEEEIRTTNPVAYEQWGSSVIQTNDHNQRGIRN

SEQ ID NO: 81678 - protein, 31 aa, Artificial Sequence
  Description of Artificial Sequence: Synthetic polypeptide
SEEEIACTNPVATEQWGSVATNLQTPGNAEE

SEQ ID NO: 81679 - protein, 33 aa, Artificial Sequence
  Description of Artificial Sequence: Synthetic polypeptide
DEEEIRTTNPVATEQYGMVSNMNLEQSEMNDED

SEQ ID NO: 81680 - protein, 31 aa, Artificial Sequence
  Description of Artificial Sequence: Synthetic polypeptide
DEEEISTTNPVATEQYGCVSTNHANFNSNQS

SEQ ID NO: 81681 - protein, 33 aa, Artificial Sequence
  Description of Artificial Sequence: Synthetic polypeptide
DEAEICTTNPVATEQYGVVSTNLGAGNAGEDSR

SEQ ID NO: 81682 - protein, 31 aa, Artificial Sequence
  Description of Artificial Sequence: Synthetic polypeptide
YESEIRTVNPVATEQYGVVSCNLPQSEGENQ

SEQ ID NO: 81683 - protein, 28 aa, Artificial Sequence
  Description of Artificial Sequence: Synthetic peptide
YEEEIASVNPVCTEQYGEVSDNCQSGNQ

SEQ ID NO: 81684 - protein, 33 aa, Artificial Sequence
  Description of Artificial Sequence: Synthetic polypeptide
DEEEIRTTNPVATEQYGMVSNNGTQGMEGGNEQ

SEQ ID NO: 81685 - protein, 34 aa, Artificial Sequence
  Description of Artificial Sequence: Synthetic polypeptide
YEEEIRTTNPVATEQYGEVPDTPNLIQLRAGANY

SEQ ID NO: 81686 - protein, 31 aa, Artificial Sequence
  Description of Artificial Sequence: Synthetic polypeptide
DEAEICTTNPVATEQYGTVSTNEGNDGMDQR

SEQ ID NO: 81687 - protein, 32 aa, Artificial Sequence
  Description of Artificial Sequence: Synthetic polypeptide
DEEEIRATNPVTTEQYGSVSTNVATEDGTTND

SEQ ID NO: 81688 - protein, 33 aa, Artificial Sequence
  Description of Artificial Sequence: Synthetic polypeptide
DEEEIRATNPVTTEQYGSVSTNNNNQQGSTNVA

SEQ ID NO: 81689 - protein, 28 aa, Artificial Sequence
  Description of Artificial Sequence: Synthetic peptide
YEEEIASVNPVCTEQYGAVGDNLQSGNQ

SEQ ID NO: 81690 - protein, 28 aa, Artificial Sequence
  Description of Artificial Sequence: Synthetic peptide
YEEEIASVNPVCTENYGVVSDNLQSGNQ

SEQ ID NO: 81691 - protein, 32 aa, Artificial Sequence
  Description of Artificial Sequence: Synthetic polypeptide
DEEEIRATNPVTTEQYGSVATNQNNQQGTNTF

SEQ ID NO: 81692 - protein, 34 aa, Artificial Sequence
  Description of Artificial Sequence: Synthetic polypeptide
AEEEIRTTNPVATEQYGSVSTTNQQQGNQGTELG

SEQ ID NO: 81693 - protein, 34 aa, Artificial Sequence
  Description of Artificial Sequence: Synthetic polypeptide
YEEEIRTTNPVATEQYGGCAVENSNLTQRNGNRF

SEQ ID NO: 81694 - protein, 32 aa, Artificial Sequence
  Description of Artificial Sequence: Synthetic polypeptide
DEEEIRTTNPVATEQYGMVNFENGQDEGNEQE

SEQ ID NO: 81695 - protein, 34 aa, Artificial Sequence
  Description of Artificial Sequence: Synthetic polypeptide
DEAEICTTNPVATEQYGEVSTPNGLQDERNGNTT

SEQ ID NO: 81696 - protein, 32 aa, Artificial Sequence
  Description of Artificial Sequence: Synthetic polypeptide
DEEEIRTTNPVAYEQWGQVVAVTGNMLQRVER

SEQ ID NO: 81697 - protein, 32 aa, Artificial Sequence
  Description of Artificial Sequence: Synthetic polypeptide
DEEEIRTTNPVATEQYGMVNFENGQGEMGNLQ

SEQ ID NO: 81698 - protein, 32 aa, Artificial Sequence
  Description of Artificial Sequence: Synthetic polypeptide
DEEEIRTTNPVATEQYGMVNFENNGQDEGNGQ

SEQ ID NO: 81699 - protein, 31 aa, Artificial Sequence
  Description of Artificial Sequence: Synthetic polypeptide
DENEIATTNPVATECYGSVSTEALQMREMEV

SEQ ID NO: 81700 - protein, 32 aa, Artificial Sequence
  Description of Artificial Sequence: Synthetic polypeptide
DEEEIRTTNPVATEFYGYVSGTMDQNEIGEND

SEQ ID NO: 81701 - protein, 32 aa, Artificial Sequence
  Description of Artificial Sequence: Synthetic polypeptide
DDSEIRTTNPVATECWGSVSCINEPQDRVGNR

SEQ ID NO: 81702 - protein, 33 aa, Artificial Sequence
  Description of Artificial Sequence: Synthetic polypeptide
DEEEISTTNPVATEQYGCVSTNSLFQVNGSEQS

SEQ ID NO: 81703 - protein, 28 aa, Artificial Sequence
  Description of Artificial Sequence: Synthetic peptide
YEEEIASVNPVCTEPYGVVSDNLQQGNQ

SEQ ID NO: 81704 - protein, 33 aa, Artificial Sequence
  Description of Artificial Sequence: Synthetic polypeptide
DEEEISTTNPVATEQYGCVSTNSLFQEYGSEFS

SEQ ID NO: 81705 - protein, 28 aa, Artificial Sequence
  Description of Artificial Sequence: Synthetic peptide
YEEEIASVNPVCTEPYGVVSDNLQSGNQ

SEQ ID NO: 81706 - protein, 34 aa, Artificial Sequence
  Description of Artificial Sequence: Synthetic polypeptide
AEEEIRTTNPVATEQYGSVSTTNQQQQGNGNDEQ

SEQ ID NO: 81707 - protein, 32 aa, Artificial Sequence
  Description of Artificial Sequence: Synthetic polypeptide
DENEIATTNPVATECYGSVSTEPCLQRNEMNV

SEQ ID NO: 81708 - protein, 32 aa, Artificial Sequence
  Description of Artificial Sequence: Synthetic polypeptide
DEEEIRTTNPVATEQYGSVYTTHEEGNGPNEI

SEQ ID NO: 81709 - protein, 32 aa, Artificial Sequence
  Description of Artificial Sequence: Synthetic polypeptide
DEEEIRTTNPVATEQYGSACSTNEDQMNDEDG

SEQ ID NO: 81710 - protein, 28 aa, Artificial Sequence
  Description of Artificial Sequence: Synthetic peptide
YETEIRSVNPVATECYGAVAANLQPGNQ

SEQ ID NO: 81711 - protein, 34 aa, Artificial Sequence
  Description of Artificial Sequence: Synthetic polypeptide
DENEIRTTNPVATEQYGSVSPWNLGEPQNGQNEQ

SEQ ID NO: 81712 - protein, 31 aa, Artificial Sequence
  Description of Artificial Sequence: Synthetic polypeptide
DEEEIRTTNPVSTEQYGSVTGDNNQGGGQET

SEQ ID NO: 81713 - protein, 33 aa, Artificial Sequence
  Description of Artificial Sequence: Synthetic polypeptide
DEAEICTTNPVATEQYGEVSTGNEGNERGENGR

SEQ ID NO: 81714 - protein, 34 aa, Artificial Sequence
  Description of Artificial Sequence: Synthetic polypeptide
AEEEIRTTNPVATEQYGSVSTTNQQQGGNDENQD

SEQ ID NO: 81715 - protein, 33 aa, Artificial Sequence
  Description of Artificial Sequence: Synthetic polypeptide
DEEEISTTNPVATEQYGCVSTTNHQNFGSENQS

SEQ ID NO: 81716 - protein, 33 aa, Artificial Sequence
  Description of Artificial Sequence: Synthetic polypeptide
DEEEIRTTNPVAYEQWGQSVTTNDLLQDQGIRR

SEQ ID NO: 81717 - protein, 34 aa, Artificial Sequence
  Description of Artificial Sequence: Synthetic polypeptide
DEEEIRTTNPVSTEQYGSVTPITNLQEVGPQNTD

SEQ ID NO: 81718 - protein, 28 aa, Artificial Sequence
  Description of Artificial Sequence: Synthetic peptide
YEEEIASVNPVCTEMYGQVSDNLQSGNQ

SEQ ID NO: 81719 - protein, 31 aa, Artificial Sequence
  Description of Artificial Sequence: Synthetic polypeptide
DENEIATTNPVATECYGSVSTEALQMREMEL

SEQ ID NO: 81720 - protein, 31 aa, Artificial Sequence
  Description of Artificial Sequence: Synthetic polypeptide
DEEEIRTTNPVSTEQYGSVTPWPLQQGMQQS

SEQ ID NO: 81721 - protein, 28 aa, Artificial Sequence
  Description of Artificial Sequence: Synthetic peptide
YEEEIASVNPVCTEMYGVVSDNLQSGNQ

SEQ ID NO: 81722 - protein, 34 aa, Artificial Sequence
  Description of Artificial Sequence: Synthetic polypeptide
AEEEIRTTNPVATEQYGSVSTTNQQQANGNNNTD

SEQ ID NO: 81723 - protein, 33 aa, Artificial Sequence
  Description of Artificial Sequence: Synthetic polypeptide
DEEEIRTTNPVATEQYGMVGSTNMDNGEGGNNV

SEQ ID NO: 81724 - protein, 34 aa, Artificial Sequence
  Description of Artificial Sequence: Synthetic polypeptide
DEEEIRTTNPVATEQYGMVGSTVNLNFNEGENDD

SEQ ID NO: 81725 - protein, 31 aa, Artificial Sequence
  Description of Artificial Sequence: Synthetic polypeptide
DEEEIRTTNPVATEGYGSVMGTGFGGGNNGG

SEQ ID NO: 81726 - protein, 32 aa, Artificial Sequence
  Description of Artificial Sequence: Synthetic polypeptide
DEAEIRTTNPVATEQYGSHSTDLNNGNENNFE

SEQ ID NO: 81727 - protein, 33 aa, Artificial Sequence
  Description of Artificial Sequence: Synthetic polypeptide
DEEEIRTTNPVATEQYGALSTTTNLPAQTFNSI

SEQ ID NO: 81728 - protein, 34 aa, Artificial Sequence
  Description of Artificial Sequence: Synthetic polypeptide
AEEEIRTTNPVATEQYGSVSTTNQQQANQGNQGE

SEQ ID NO: 81729 - protein, 33 aa, Artificial Sequence
  Description of Artificial Sequence: Synthetic polypeptide
DEEEIRTTNPVATEQYGMVGSVGNLVTEGFNGG

SEQ ID NO: 81730 - protein, 33 aa, Artificial Sequence
  Description of Artificial Sequence: Synthetic polypeptide
DEEEIRTTNPVATEQYGMVGSVTGGQGEGEGND

SEQ ID NO: 81731 - protein, 32 aa, Artificial Sequence
  Description of Artificial Sequence: Synthetic polypeptide
DENEIRTTNPVATEQYGSVSSEPAGNMHNGNL

SEQ ID NO: 81732 - protein, 28 aa, Artificial Sequence
  Description of Artificial Sequence: Synthetic peptide
YETEIRSVNPVCTEQYGAVAANLQSGNQ

SEQ ID NO: 81733 - protein, 31 aa, Artificial Sequence
  Description of Artificial Sequence: Synthetic polypeptide
DENEIRTTNPVATEQYGSVSSEPAGNHNGNL

SEQ ID NO: 81734 - protein, 34 aa, Artificial Sequence
  Description of Artificial Sequence: Synthetic polypeptide
AEEEIRTTNPVATEQYGSVSTTNQQQGDEGNIEA

SEQ ID NO: 81735 - protein, 34 aa, Artificial Sequence
  Description of Artificial Sequence: Synthetic polypeptide
DEEEIRTTNPVATEQYGMVGSVTGNGGQGEGNTF

SEQ ID NO: 81736 - protein, 32 aa, Artificial Sequence
  Description of Artificial Sequence: Synthetic polypeptide
SEEEIRCTNPIATEQYGSVSENLPMMRGMNPV

SEQ ID NO: 81737 - protein, 33 aa, Artificial Sequence
  Description of Artificial Sequence: Synthetic polypeptide
DEEEIRTTNPVATEQYGMVGSTVNLNLNGEFDD

SEQ ID NO: 81738 - protein, 33 aa, Artificial Sequence
  Description of Artificial Sequence: Synthetic polypeptide
DEEEIRTTNPVATEQYGSVTTTLQVREVVSDGG

SEQ ID NO: 81739 - protein, 34 aa, Artificial Sequence
  Description of Artificial Sequence: Synthetic polypeptide
AEEEIRTTNPVATEQYGSVSTTNQQQQNGNNQEQ

SEQ ID NO: 81740 - protein, 35 aa, Artificial Sequence
  Description of Artificial Sequence: Synthetic polypeptide
YEEEIRTTNPVATEQYGFCVCSATSNSLTQDGNAR

SEQ ID NO: 81741 - protein, 29 aa, Artificial Sequence
  Description of Artificial Sequence: Synthetic peptide
DENEIATTNPVATECYGTISEDLQQQGNL

SEQ ID NO: 81742 - protein, 34 aa, Artificial Sequence
  Description of Artificial Sequence: Synthetic polypeptide
DEEEIRTTNPVAYEQWGSSVIQTNDHLQRNGDER

SEQ ID NO: 81743 - protein, 33 aa, Artificial Sequence
  Description of Artificial Sequence: Synthetic polypeptide
DEAEICTTNPVATEQYGSVSTGNDEGDRGGELR

SEQ ID NO: 81744 - protein, 32 aa, Artificial Sequence
  Description of Artificial Sequence: Synthetic polypeptide
DEAEICTTNPVATEQYGSVSTGNEGNTGMDMR

SEQ ID NO: 81745 - protein, 32 aa, Artificial Sequence
  Description of Artificial Sequence: Synthetic polypeptide
DEEEIRATNPVTTEQYGSVSTNNATEQGTTND

SEQ ID NO: 81746 - protein, 34 aa, Artificial Sequence
  Description of Artificial Sequence: Synthetic polypeptide
AEEEIRTTNPVATEQYGSVSTTNQQQQQTGTNDE

SEQ ID NO: 81747 - protein, 32 aa, Artificial Sequence
  Description of Artificial Sequence: Synthetic polypeptide
DEAEICTTNPVATEQYGSVSTGNPGNDGMDDR

SEQ ID NO: 81748 - protein, 28 aa, Artificial Sequence
  Description of Artificial Sequence: Synthetic peptide
YEEEIASVNPVCTEQWGVVSDNLQSGNG

SEQ ID NO: 81749 - protein, 32 aa, Artificial Sequence
  Description of Artificial Sequence: Synthetic polypeptide
DEEEIRTTNPVATEPYGSVCFTQLTEGTQNEW

SEQ ID NO: 81750 - protein, 31 aa, Artificial Sequence
  Description of Artificial Sequence: Synthetic polypeptide
DEEEIRATNPVTTEQYGSVSTNNATTIGTTD

SEQ ID NO: 81751 - protein, 33 aa, Artificial Sequence
  Description of Artificial Sequence: Synthetic polypeptide
DEEEIRTTNPVAYEQWGSSVIQTNDHLQRDDRR

SEQ ID NO: 81752 - protein, 30 aa, Artificial Sequence
  Description of Artificial Sequence: Synthetic polypeptide
DENEIRTTNPVATEQWGDVSTDLMNAAGEA

SEQ ID NO: 81753 - protein, 32 aa, Artificial Sequence
  Description of Artificial Sequence: Synthetic polypeptide
DEEEIRTTNPVATEQYGSVYTNQEMTEVEVRT

SEQ ID NO: 81754 - protein, 34 aa, Artificial Sequence
  Description of Artificial Sequence: Synthetic polypeptide
DEEEIRTTNPVAYEQYGSTVSCTDLSGQSGTNSA

SEQ ID NO: 81755 - protein, 28 aa, Artificial Sequence
  Description of Artificial Sequence: Synthetic peptide
YETEIASVNPVCTEQYGVVSANLQSGNQ

SEQ ID NO: 81756 - protein, 34 aa, Artificial Sequence
  Description of Artificial Sequence: Synthetic polypeptide
DEEEIRTTNPVATEQYGSACHMTNLQREVVNEGQ

SEQ ID NO: 81757 - protein, 34 aa, Artificial Sequence
  Description of Artificial Sequence: Synthetic polypeptide
AEEEIRTTNPVATEQYGSVSTTNQQQQTNGNDEE

SEQ ID NO: 81758 - protein, 29 aa, Artificial Sequence
  Description of Artificial Sequence: Synthetic peptide
DENEIRTTNPVATEQWGDVSEILMNSGTA

SEQ ID NO: 81759 - protein, 28 aa, Artificial Sequence
  Description of Artificial Sequence: Synthetic peptide
YEEEIASVNPVCTEQWGVVSDNLQSGNI

SEQ ID NO: 81760 - protein, 32 aa, Artificial Sequence
  Description of Artificial Sequence: Synthetic polypeptide
DENEIRTTNPVATEQYGSVSPNDQIPGSEEHG

SEQ ID NO: 81761 - protein, 28 aa, Artificial Sequence
  Description of Artificial Sequence: Synthetic peptide
YEEEIASVNPVCTEQWGVVSDNLQSGNQ

SEQ ID NO: 81762 - protein, 28 aa, Artificial Sequence
  Description of Artificial Sequence: Synthetic peptide
YEEEIASVNPVCTEQYEVVSDNLQSGNQ

SEQ ID NO: 81763 - protein, 31 aa, Artificial Sequence
  Description of Artificial Sequence: Synthetic polypeptide
DEEEIRSTNPVAYEPYGSVNCTNISQRVNEV

SEQ ID NO: 81764 - protein, 34 aa, Artificial Sequence
  Description of Artificial Sequence: Synthetic polypeptide
AEEEIRTTNPVATEQYGSVSTTQENQQIGNQTED

SEQ ID NO: 81765 - protein, 28 aa, Artificial Sequence
  Description of Artificial Sequence: Synthetic peptide
YETEIASVNPVCTEQYGVVSDNLQSGNQ

SEQ ID NO: 81766 - protein, 32 aa, Artificial Sequence
  Description of Artificial Sequence: Synthetic polypeptide
DEEEIRTTNPVATEQYGMVPSDINDMMRFNPE

SEQ ID NO: 81767 - protein, 34 aa, Artificial Sequence
  Description of Artificial Sequence: Synthetic polypeptide
AEEEIRTTNPVATEQYGSVSTTNQQQQNGNQQTQ

SEQ ID NO: 81768 - protein, 34 aa, Artificial Sequence
  Description of Artificial Sequence: Synthetic polypeptide
DEEEIRTTNPVATEGYGSVSTMNLFQEGGGQGDE

SEQ ID NO: 81769 - protein, 34 aa, Artificial Sequence
  Description of Artificial Sequence: Synthetic polypeptide
DEEEIRTTNPVATEQYGSCSPTLNTVEQPRTEND

SEQ ID NO: 81770 - protein, 33 aa, Artificial Sequence
  Description of Artificial Sequence: Synthetic polypeptide
AEEEIRTTNPVATEQYGSVSTTNQQQQNNNQTQ

SEQ ID NO: 81771 - protein, 33 aa, Artificial Sequence
  Description of Artificial Sequence: Synthetic polypeptide
DEEEIRTTNPVAYEQWGSCVYSDTWDGQRQDNR

SEQ ID NO: 81772 - protein, 32 aa, Artificial Sequence
  Description of Artificial Sequence: Synthetic polypeptide
CEEEIRTTNPVAYEAYGISVSTNEQQRPGGSV

SEQ ID NO: 81773 - protein, 31 aa, Artificial Sequence
  Description of Artificial Sequence: Synthetic polypeptide
DEEEIRTTNPVATEQYGSVSWTPITIDTQEQ

SEQ ID NO: 81774 - protein, 30 aa, Artificial Sequence
  Description of Artificial Sequence: Synthetic polypeptide
DENEIATTNPVATECYGSVSWNEQEDGGTA

SEQ ID NO: 81775 - protein, 31 aa, Artificial Sequence
  Description of Artificial Sequence: Synthetic polypeptide
DEEEIRATNPVTTEQYGSVSTNNAEIGTTTQ

SEQ ID NO: 81776 - protein, 33 aa, Artificial Sequence
  Description of Artificial Sequence: Synthetic polypeptide
YEEEIRTTNPVATEQYGEVVEPTNANQCFGNLR

SEQ ID NO: 81777 - protein, 35 aa, Artificial Sequence
  Description of Artificial Sequence: Synthetic polypeptide
DEEEIRTTNPVAYEQWGSCVYSDTWNDGQRGQQNR

SEQ ID NO: 81778 - protein, 34 aa, Artificial Sequence
  Description of Artificial Sequence: Synthetic polypeptide
DEEEIRTTNPVAYEQYGQSVVSQNDLTQNGIERM

SEQ ID NO: 81779 - protein, 28 aa, Artificial Sequence
  Description of Artificial Sequence: Synthetic peptide
YEEEIASVNPVCTEQFGVVSDNLQSGNQ

SEQ ID NO: 81780 - protein, 34 aa, Artificial Sequence
  Description of Artificial Sequence: Synthetic polypeptide
DEEEIRTTNPVAYEQYGSTVPSVSGNLSQRVNIY

SEQ ID NO: 81781 - protein, 35 aa, Artificial Sequence
  Description of Artificial Sequence: Synthetic polypeptide
AEEEIRTTNPVATEQYGSVSTVTNLQQGDEGNNDE

SEQ ID NO: 81782 - protein, 32 aa, Artificial Sequence
  Description of Artificial Sequence: Synthetic polypeptide
DEEEIRTTNPVATEQYGSVSWTPTLNNMIVEP

SEQ ID NO: 81783 - protein, 33 aa, Artificial Sequence
  Description of Artificial Sequence: Synthetic polypeptide
YEEEIRTTNPVATEQYGEVTLTGNLRQRGHGEI

SEQ ID NO: 81784 - protein, 28 aa, Artificial Sequence
  Description of Artificial Sequence: Synthetic peptide
YEEEIASVNPVCTEQVGVVSDNLQSGNT

SEQ ID NO: 81785 - protein, 33 aa, Artificial Sequence
  Description of Artificial Sequence: Synthetic polypeptide
DEEEIRTTNPVAYEQYGSTVQACSHLSQRSDNR

SEQ ID NO: 81786 - protein, 32 aa, Artificial Sequence
  Description of Artificial Sequence: Synthetic polypeptide
DEEEIRTTNPVATEPYGSVCFTQLETDGGQNE

SEQ ID NO: 81787 - protein, 29 aa, Artificial Sequence
  Description of Artificial Sequence: Synthetic peptide
YEEEIASVNPVCTEQWGSVSDNLQSEGNQ

SEQ ID NO: 81788 - protein, 32 aa, Artificial Sequence
  Description of Artificial Sequence: Synthetic polypeptide
DEEEIRTTNPVATEPYGSVCFTQLLTSGGENE

SEQ ID NO: 81789 - protein, 33 aa, Artificial Sequence
  Description of Artificial Sequence: Synthetic polypeptide
DEAEICTTNPVATEQYGSVSTDNLNGNDGMDRR

SEQ ID NO: 81790 - protein, 32 aa, Artificial Sequence
  Description of Artificial Sequence: Synthetic polypeptide
DEAEICTTNPVAVEQYGSVSTVTNLEQGTNGT

SEQ ID NO: 81791 - protein, 29 aa, Artificial Sequence
  Description of Artificial Sequence: Synthetic peptide
DEEEIRCTNPIATECWGSVAEENWMPGNR

SEQ ID NO: 81792 - protein, 28 aa, Artificial Sequence
  Description of Artificial Sequence: Synthetic peptide
YEEEIASVNPVCTEQYGEVSENCQSGNQ

SEQ ID NO: 81793 - protein, 33 aa, Artificial Sequence
  Description of Artificial Sequence: Synthetic polypeptide
DENEIATTNPVATEQWGSVSMSGNLGQRGVNQD

SEQ ID NO: 81794 - protein, 34 aa, Artificial Sequence
  Description of Artificial Sequence: Synthetic polypeptide
DEEEIRTTNPVATEGYGSVSTSTLTQTEMGNNDA

SEQ ID NO: 81795 - protein, 32 aa, Artificial Sequence
  Description of Artificial Sequence: Synthetic polypeptide
AEEEIRTTNPVATEQYGSVSTTQQQLNQENVT

SEQ ID NO: 81796 - protein, 29 aa, Artificial Sequence
  Description of Artificial Sequence: Synthetic peptide
DEEEIRCTNPIATEQYGAVSNEDWMPGNI

SEQ ID NO: 81797 - protein, 31 aa, Artificial Sequence
  Description of Artificial Sequence: Synthetic polypeptide
YESEIRSTNPVCTEQWGSVSCINLPQDRGNG

SEQ ID NO: 81798 - protein, 33 aa, Artificial Sequence
  Description of Artificial Sequence: Synthetic polypeptide
CEEEIRTTNPVAYEQYGKVSYTNPSQQAGGNQR

SEQ ID NO: 81799 - protein, 33 aa, Artificial Sequence
  Description of Artificial Sequence: Synthetic polypeptide
DEEEIRTTNPVATEGYGSVSTTGNMTDEGGNTT

SEQ ID NO: 81800 - protein, 35 aa, Artificial Sequence
  Description of Artificial Sequence: Synthetic polypeptide
DEEEIRTTNPVATEQWGYSNVSYTNELQERPGGFD

SEQ ID NO: 81801 - protein, 29 aa, Artificial Sequence
  Description of Artificial Sequence: Synthetic peptide
YEEEIASVNPVCTEQYGTVSDENLQSGNQ

SEQ ID NO: 81802 - protein, 34 aa, Artificial Sequence
  Description of Artificial Sequence: Synthetic polypeptide
DEEEIRTTNPVATEQWGYSNVSPTNYLQHVPGGE

SEQ ID NO: 81803 - protein, 35 aa, Artificial Sequence
  Description of Artificial Sequence: Synthetic polypeptide
DEEEIRTTNPVATEQWGYSNVSPTNPLQHRPGGFQ

SEQ ID NO: 81804 - protein, 33 aa, Artificial Sequence
  Description of Artificial Sequence: Synthetic polypeptide
AEEEIRTTNPVATEQYGSVSTTQQQQGNIENQD

SEQ ID NO: 81805 - protein, 32 aa, Artificial Sequence
  Description of Artificial Sequence: Synthetic polypeptide
DEEEISTTNPVATEQYGCVSTGELQFFGSDQE

SEQ ID NO: 81806 - protein, 34 aa, Artificial Sequence
  Description of Artificial Sequence: Synthetic polypeptide
DEEEIRTTNPVATEQWGYSNVSMTNELQHRPTGF

SEQ ID NO: 81807 - protein, 31 aa, Artificial Sequence
  Description of Artificial Sequence: Synthetic polypeptide
DENEIATTNPVATEQYGCVAATNLNMGNEHL

SEQ ID NO: 81808 - protein, 32 aa, Artificial Sequence
  Description of Artificial Sequence: Synthetic polypeptide
DEEEISTTNPVATEQYGCVSTGEHQNFGSENQ

SEQ ID NO: 81809 - protein, 30 aa, Artificial Sequence
  Description of Artificial Sequence: Synthetic polypeptide
DENEIRTTNPVATEQWGDVSTIENNAAENA

SEQ ID NO: 81810 - protein, 32 aa, Artificial Sequence
  Description of Artificial Sequence: Synthetic polypeptide
AEEEIRTTNPVATEQYGSVSTTQQQQNNIENQ

SEQ ID NO: 81811 - protein, 28 aa, Artificial Sequence
  Description of Artificial Sequence: Synthetic peptide
YEEEIASVNPVCTEQYGTVSDNLQSDNQ

SEQ ID NO: 81812 - protein, 31 aa, Artificial Sequence
  Description of Artificial Sequence: Synthetic polypeptide
DENEIRTTNPVATEQYGSVSEAGNMHNEMNV

SEQ ID NO: 81813 - protein, 34 aa, Artificial Sequence
  Description of Artificial Sequence: Synthetic polypeptide
YEEEIRTTNPVATEQYGCVCSATSNSLTQRIMNL

SEQ ID NO: 81814 - protein, 33 aa, Artificial Sequence
  Description of Artificial Sequence: Synthetic polypeptide
AEEEIRTTNPVATEQYGSVSTTQQQGNIENNQE

SEQ ID NO: 81815 - protein, 34 aa, Artificial Sequence
  Description of Artificial Sequence: Synthetic polypeptide
AEEEIRTTNPVATEQYGSVSTTQQNNQQIGNNAV

SEQ ID NO: 81816 - protein, 32 aa, Artificial Sequence
  Description of Artificial Sequence: Synthetic polypeptide
DENEIATTNPVATEQWGSVSMNPLQDQGNNME

SEQ ID NO: 81817 - protein, 31 aa, Artificial Sequence
  Description of Artificial Sequence: Synthetic polypeptide
DENEIRTTNPVATEQYGSVSECGNMHNEMNV

SEQ ID NO: 81818 - protein, 30 aa, Artificial Sequence
  Description of Artificial Sequence: Synthetic polypeptide
DENEIATTNPVATEQWGDVSENLQNAAGTA

SEQ ID NO: 81819 - protein, 34 aa, Artificial Sequence
  Description of Artificial Sequence: Synthetic polypeptide
AEEEIRTTNPVATEQYGSVSTTQNQQNNNGNNAD

SEQ ID NO: 81820 - protein, 32 aa, Artificial Sequence
  Description of Artificial Sequence: Synthetic polypeptide
DENEIRTTNPVATEQYGSVSEPAGMNRAGMNV

SEQ ID NO: 81821 - protein, 34 aa, Artificial Sequence
  Description of Artificial Sequence: Synthetic polypeptide
DEEEIRTTNPVAYEQYGSVPCCTVNALGREGNAP

SEQ ID NO: 81822 - protein, 32 aa, Artificial Sequence
  Description of Artificial Sequence: Synthetic polypeptide
DEEEIRTTNPVATEQYGMVSTVNVVGFEGGGT

SEQ ID NO: 81823 - protein, 31 aa, Artificial Sequence
  Description of Artificial Sequence: Synthetic polypeptide
DEEEISTTNPVATEQYGCVSTGNHTNFGSDQ

SEQ ID NO: 81824 - protein, 30 aa, Artificial Sequence
  Description of Artificial Sequence: Synthetic polypeptide
DENEIRTTNPVATEQYGSVSEILENAEEDA

SEQ ID NO: 81825 - protein, 31 aa, Artificial Sequence
  Description of Artificial Sequence: Synthetic polypeptide
DEAEICTTNPVAYEQYGTVSTTNLDNDGDER

SEQ ID NO: 81826 - protein, 33 aa, Artificial Sequence
  Description of Artificial Sequence: Synthetic polypeptide
DEEEIRTTNPVAYEQYGSVPFCINPSQRNGTNH

SEQ ID NO: 81827 - protein, 31 aa, Artificial Sequence
  Description of Artificial Sequence: Synthetic polypeptide
DEEEIRCTNPIATEQWGSVSCNEPMDRGENG

SEQ ID NO: 81828 - protein, 33 aa, Artificial Sequence
  Description of Artificial Sequence: Synthetic polypeptide
AEEEIRTTNPVATEQYGSVSTTQTNQQGNQQED

SEQ ID NO: 81829 - protein, 32 aa, Artificial Sequence
  Description of Artificial Sequence: Synthetic polypeptide
DEEEIRCTNPIATEQWGSVSENEPQDREGENG

SEQ ID NO: 81830 - protein, 30 aa, Artificial Sequence
  Description of Artificial Sequence: Synthetic polypeptide
YESEIRSVNPVCTEQWGSVSCNLPQDRGNG

SEQ ID NO: 81831 - protein, 31 aa, Artificial Sequence
  Description of Artificial Sequence: Synthetic polypeptide
DEAEICTVNPVAYEQYGSVSCTNELSGEGNH

SEQ ID NO: 81832 - protein, 32 aa, Artificial Sequence
  Description of Artificial Sequence: Synthetic polypeptide
DEEEISTTNPVATEQYGCVSTGELQNSNSNQS

SEQ ID NO: 81833 - protein, 34 aa, Artificial Sequence
  Description of Artificial Sequence: Synthetic polypeptide
DEEEIRTTNPVATEQYGSVYTDVDLPQTFEGNQI

SEQ ID NO: 81834 - protein, 33 aa, Artificial Sequence
  Description of Artificial Sequence: Synthetic polypeptide
DEEEIRTTNPVAYEQYGSVPFCTNPSQREGTPH

SEQ ID NO: 81835 - protein, 33 aa, Artificial Sequence
  Description of Artificial Sequence: Synthetic polypeptide
AEEEIRTTNPVATEQYGSVSTTQQLQQENDEEV

SEQ ID NO: 81836 - protein, 34 aa, Artificial Sequence
  Description of Artificial Sequence: Synthetic polypeptide
DEEEIRTTNPVAYEQYGSVPFCTNPSQRNGTNAV

SEQ ID NO: 81837 - protein, 34 aa, Artificial Sequence
  Description of Artificial Sequence: Synthetic polypeptide
AEEEIRTTNPVATEQYGSVSTTQQLQSNEGNISE

SEQ ID NO: 81838 - protein, 31 aa, Artificial Sequence
  Description of Artificial Sequence: Synthetic polypeptide
SEEEIACTNPVATEQYGCVATNLQDADGMNN

SEQ ID NO: 81839 - protein, 34 aa, Artificial Sequence
  Description of Artificial Sequence: Synthetic polypeptide
DEEEIRTTNPVATEPYGSVCFVANLTQIGGNMRI

SEQ ID NO: 81840 - protein, 28 aa, Artificial Sequence
  Description of Artificial Sequence: Synthetic peptide
YESEIRSVNPVCTEQWGVVSDNLQSGNG

SEQ ID NO: 81841 - protein, 28 aa, Artificial Sequence
  Description of Artificial Sequence: Synthetic peptide
YEEEIASVNPVCTEQYGTVSDNLQSNNQ

SEQ ID NO: 81842 - protein, 33 aa, Artificial Sequence
  Description of Artificial Sequence: Synthetic polypeptide
AEEEIRTTNPVATEQYGSVSTTSELGNETGNTE

SEQ ID NO: 81843 - protein, 33 aa, Artificial Sequence
  Description of Artificial Sequence: Synthetic polypeptide
DEEEIRSTNPVATEQYGNVATNPAIQMRVGNPV

SEQ ID NO: 81844 - protein, 34 aa, Artificial Sequence
  Description of Artificial Sequence: Synthetic polypeptide
AEEEIRTTNPVATEQYGSVSTTSNLEEQGTNNND

SEQ ID NO: 81845 - protein, 34 aa, Artificial Sequence
  Description of Artificial Sequence: Synthetic polypeptide
AEEEIRTTNPVATEQYGSVSTVDNNNQQGENNQN

SEQ ID NO: 81846 - protein, 30 aa, Artificial Sequence
  Description of Artificial Sequence: Synthetic polypeptide
YESEIATVNPVATEQYGVVSDNLQDSEGNQ

SEQ ID NO: 81847 - protein, 31 aa, Artificial Sequence
  Description of Artificial Sequence: Synthetic polypeptide
DDSEIRTTNPVATEQYGVVSYDNLQTFDDQR

SEQ ID NO: 81848 - protein, 29 aa, Artificial Sequence
  Description of Artificial Sequence: Synthetic peptide
DENEIATTNPVATEQYGDVCSEGLEHENL

SEQ ID NO: 81849 - protein, 35 aa, Artificial Sequence
  Description of Artificial Sequence: Synthetic polypeptide
DEEEIRTTNPVATEQYGSVTVVTENLLQIIGNNTG

SEQ ID NO: 81850 - protein, 32 aa, Artificial Sequence
  Description of Artificial Sequence: Synthetic polypeptide
DENEIRTTNPVATEQYGSVSDVWDVLERGSQQ

SEQ ID NO: 81851 - protein, 34 aa, Artificial Sequence
  Description of Artificial Sequence: Synthetic polypeptide
DEEEIRTTNPVATEQYGSVYSTQDELQAEGSATP

SEQ ID NO: 81852 - protein, 33 aa, Artificial Sequence
  Description of Artificial Sequence: Synthetic polypeptide
AEEEIRTTNPVATEQYGSVSTTSNLGNEEAENM

SEQ ID NO: 81853 - protein, 35 aa, Artificial Sequence
  Description of Artificial Sequence: Synthetic polypeptide
AEEEIRTTNPVATEQYGSVSTTSNLGQQEGEEGNG

SEQ ID NO: 81854 - protein, 30 aa, Artificial Sequence
  Description of Artificial Sequence: Synthetic polypeptide
SEEEIACTNPVATEQYGCVATNLQGAENID

SEQ ID NO: 81855 - protein, 35 aa, Artificial Sequence
  Description of Artificial Sequence: Synthetic polypeptide
AEEEIRTTNPVATEQYGSVSTTSNLGQQGNNNQEQ

SEQ ID NO: 81856 - protein, 30 aa, Artificial Sequence
  Description of Artificial Sequence: Synthetic polypeptide
YESEIATVNPVATEQYGVVSDNLPQSEGNQ

SEQ ID NO: 81857 - protein, 30 aa, Artificial Sequence
  Description of Artificial Sequence: Synthetic polypeptide
YESEIATVNPVATEQYGVVSCNLPQSEGNQ

SEQ ID NO: 81858 - protein, 34 aa, Artificial Sequence
  Description of Artificial Sequence: Synthetic polypeptide
AEEEIRTTNPVATEQYGSVSTTSNLNQEQANNVT

SEQ ID NO: 81859 - protein, 36 aa, Artificial Sequence
  Description of Artificial Sequence: Synthetic polypeptide
DEEEIRTTNPVATEGYGSVTSCTENELSQPTGGNRA

SEQ ID NO: 81860 - protein, 34 aa, Artificial Sequence
  Description of Artificial Sequence: Synthetic polypeptide
DEEEIRTTNPVATEQYGSVSYEGDLQQIMMNVRD

SEQ ID NO: 81861 - protein, 32 aa, Artificial Sequence
  Description of Artificial Sequence: Synthetic polypeptide
AEEEIRTTNPVATEQYGSVSTTSNNANEQANV

SEQ ID NO: 81862 - protein, 34 aa, Artificial Sequence
  Description of Artificial Sequence: Synthetic polypeptide
AEEEIRTTNPVATEQYGSVSTTSNNENQEGTNVE

SEQ ID NO: 81863 - protein, 34 aa, Artificial Sequence
  Description of Artificial Sequence: Synthetic polypeptide
AEEEIRTTNPVATEQYGSVSTTSNNEQEEGTNVT

SEQ ID NO: 81864 - protein, 29 aa, Artificial Sequence
  Description of Artificial Sequence: Synthetic peptide
YEEEIASVNPVCTEQYGVVASDNLQSGNQ

SEQ ID NO: 81865 - protein, 32 aa, Artificial Sequence
  Description of Artificial Sequence: Synthetic polypeptide
DEEEIRSTNPVATEQYGMGSTQVLQVGGNIAE

SEQ ID NO: 81866 - protein, 35 aa, Artificial Sequence
  Description of Artificial Sequence: Synthetic polypeptide
AEEEIRTTNPVATEQYGSVSTTSNLNEQQGTNNNA

SEQ ID NO: 81867 - protein, 30 aa, Artificial Sequence
  Description of Artificial Sequence: Synthetic polypeptide
DENEIRTTNPVATEQWGDVSEILMNAAGDR

SEQ ID NO: 81868 - protein, 32 aa, Artificial Sequence
  Description of Artificial Sequence: Synthetic polypeptide
DEEEIRTTNPVAYEQWGSVAWTELQDVQDGSR

SEQ ID NO: 81869 - protein, 34 aa, Artificial Sequence
  Description of Artificial Sequence: Synthetic polypeptide
AEEEIRTTNPVATEQYGSVSTTSNLEENEQGNNA

SEQ ID NO: 81870 - protein, 33 aa, Artificial Sequence
  Description of Artificial Sequence: Synthetic polypeptide
DDSEIRTTNPVATEQYGSVSSATAGNMRNGNPR

SEQ ID NO: 81871 - protein, 33 aa, Artificial Sequence
  Description of Artificial Sequence: Synthetic polypeptide
DEEEIRTTNPVATEQYGMYTIMTNEGQERGNGD

SEQ ID NO: 81872 - protein, 34 aa, Artificial Sequence
  Description of Artificial Sequence: Synthetic polypeptide
DEEEIRTTNPVATEGYGSVSTVNGFGQENIGNGD

SEQ ID NO: 81873 - protein, 28 aa, Artificial Sequence
  Description of Artificial Sequence: Synthetic peptide
YEEEIASVNPVCTEQYGVASDNLQSGNK

SEQ ID NO: 81874 - protein, 28 aa, Artificial Sequence
  Description of Artificial Sequence: Synthetic peptide
YEEEIASVNPVCTEQYGVASDNLQSGNQ

SEQ ID NO: 81875 - protein, 28 aa, Artificial Sequence
  Description of Artificial Sequence: Synthetic peptide
YEEEIASVNPVCTEQYGVCSDNLQSGNQ

SEQ ID NO: 81876 - protein, 33 aa, Artificial Sequence
  Description of Artificial Sequence: Synthetic polypeptide
DEEEIRTTNPVAYEQYGSVPGCTNPSQHNGTNH

SEQ ID NO: 81877 - protein, 31 aa, Artificial Sequence
  Description of Artificial Sequence: Synthetic polypeptide
DENEIATTNPVATEQYGCVATNLQQDDNDAQ

SEQ ID NO: 81878 - protein, 33 aa, Artificial Sequence
  Description of Artificial Sequence: Synthetic polypeptide
DEEEIRTTNPVAYEQYGSVPNNNLQQSFPGSGR

SEQ ID NO: 81879 - protein, 32 aa, Artificial Sequence
  Description of Artificial Sequence: Synthetic polypeptide
DEEEIRTTNPVATEQYGSVTVTVNEEDTNQQD

SEQ ID NO: 81880 - protein, 31 aa, Artificial Sequence
  Description of Artificial Sequence: Synthetic polypeptide
SEEEIACTNPVATEQYGCVATNLQESNENMR

SEQ ID NO: 81881 - protein, 32 aa, Artificial Sequence
  Description of Artificial Sequence: Synthetic polypeptide
DEEEIRTTNPVSTEQYGSVTFNDLQVGEQVTD

SEQ ID NO: 81882 - protein, 28 aa, Artificial Sequence
  Description of Artificial Sequence: Synthetic peptide
YEEEIASVNPVCTEQYGVSSDNLQSGNQ

SEQ ID NO: 81883 - protein, 32 aa, Artificial Sequence
  Description of Artificial Sequence: Synthetic polypeptide
DEEEIRTTNPVATEQYGMYTIMTNGGQGGNGE

SEQ ID NO: 81884 - protein, 28 aa, Artificial Sequence
  Description of Artificial Sequence: Synthetic peptide
YEEEIASVNPVCTEQYGVTSDNLQSGNQ

SEQ ID NO: 81885 - protein, 34 aa, Artificial Sequence
  Description of Artificial Sequence: Synthetic polypeptide
AEEEIRTTNPVATEQYGSVSTTSNENQEQGNNVE

SEQ ID NO: 81886 - protein, 29 aa, Artificial Sequence
  Description of Artificial Sequence: Synthetic peptide
YESEIATVNPVCTEQYGVVSDNLQSEGNQ

SEQ ID NO: 81887 - protein, 28 aa, Artificial Sequence
  Description of Artificial Sequence: Synthetic peptide
YEEEIASVNPVCTEQYGVTSMNLQSGNQ

SEQ ID NO: 81888 - protein, 32 aa, Artificial Sequence
  Description of Artificial Sequence: Synthetic polypeptide
DEEEIRSTNPVATEQYGNVAANPAIQMRVGNV

SEQ ID NO: 81889 - protein, 29 aa, Artificial Sequence
  Description of Artificial Sequence: Synthetic peptide
YESEIATVNPVCTEQYGVVSDNLQDSGNQ

SEQ ID NO: 81890 - protein, 28 aa, Artificial Sequence
  Description of Artificial Sequence: Synthetic peptide
YEEEIASVNPVCTEQYGVVADNLQRGQQ

SEQ ID NO: 81891 - protein, 28 aa, Artificial Sequence
  Description of Artificial Sequence: Synthetic peptide
YEEEIASVNPVCTEQYGVVADNLQSGNQ

SEQ ID NO: 81892 - protein, 28 aa, Artificial Sequence
  Description of Artificial Sequence: Synthetic peptide
YEEEIASVNPVCTEQYGVISDNLQSGNQ

SEQ ID NO: 81893 - protein, 34 aa, Artificial Sequence
  Description of Artificial Sequence: Synthetic polypeptide
AEEEIRTTNPVATEQYGSVSTTNQQNQQTGTNED

SEQ ID NO: 81894 - protein, 31 aa, Artificial Sequence
  Description of Artificial Sequence: Synthetic polypeptide
YESEIRTTNPVATECWGSVSCNEPQREGENG

SEQ ID NO: 81895 - protein, 34 aa, Artificial Sequence
  Description of Artificial Sequence: Synthetic polypeptide
DEEEIRSTNPVATEQYGSVCMVNDQHDERGSNSR

SEQ ID NO: 81896 - protein, 34 aa, Artificial Sequence
  Description of Artificial Sequence: Synthetic polypeptide
DEEEIRTTNPVATEQYGMVSTGNGGQEGNDNNVS

SEQ ID NO: 81897 - protein, 33 aa, Artificial Sequence
  Description of Artificial Sequence: Synthetic polypeptide
DEEEIRSTNPVATEQYGSVSTTPAGNMRVGNPV

SEQ ID NO: 81898 - protein, 28 aa, Artificial Sequence
  Description of Artificial Sequence: Synthetic peptide
YEEEIASVNPVCTEQYGIVSDNLQSGTQ

SEQ ID NO: 81899 - protein, 33 aa, Artificial Sequence
  Description of Artificial Sequence: Synthetic polypeptide
DEEEIRSTNPVATEQYGSVSTTPAGNMRNGNPV

SEQ ID NO: 81900 - protein, 31 aa, Artificial Sequence
  Description of Artificial Sequence: Synthetic polypeptide
DENEIATTNPVATEPYGSVSANNNLNRGTEQ

SEQ ID NO: 81901 - protein, 28 aa, Artificial Sequence
  Description of Artificial Sequence: Synthetic peptide
YEEEIASVNPVCTEQYGMVSDNLQSNNQ

SEQ ID NO: 81902 - protein, 33 aa, Artificial Sequence
  Description of Artificial Sequence: Synthetic polypeptide
DEEEIRTTNPVATEQYGMVSTINDNLNGENGGN

SEQ ID NO: 81903 - protein, 28 aa, Artificial Sequence
  Description of Artificial Sequence: Synthetic peptide
YEEEIASVNPVCTEQYGNVADNLQSGNQ

SEQ ID NO: 81904 - protein, 34 aa, Artificial Sequence
  Description of Artificial Sequence: Synthetic polypeptide
YEEEIRTTNPVATEQYGEAVFSNSNLTGRNGNRF

SEQ ID NO: 81905 - protein, 34 aa, Artificial Sequence
  Description of Artificial Sequence: Synthetic polypeptide
DEEEIRTTNPVATEQYGMVSTINNMNLNIGENEG

SEQ ID NO: 81906 - protein, 33 aa, Artificial Sequence
  Description of Artificial Sequence: Synthetic polypeptide
DEEEIRTTNPVATEQYGMVSTMQTNEFGTGNGN

SEQ ID NO: 81907 - protein, 32 aa, Artificial Sequence
  Description of Artificial Sequence: Synthetic polypeptide
DEAEICTTNPVAYEQWGSVSTNLQGEDGGNAM

SEQ ID NO: 81908 - protein, 33 aa, Artificial Sequence
  Description of Artificial Sequence: Synthetic polypeptide
DEEEIRTTNPVATEQYGSVTSVMNEGVGGGGNT

SEQ ID NO: 81909 - protein, 28 aa, Artificial Sequence
  Description of Artificial Sequence: Synthetic peptide
YEEEIASVNPVCTEQYGNVSDNSQSGNQ

SEQ ID NO: 81910 - protein, 31 aa, Artificial Sequence
  Description of Artificial Sequence: Synthetic polypeptide
YESEIRTVNPVATECWGSVSCNLPQREGENQ

SEQ ID NO: 81911 - protein, 29 aa, Artificial Sequence
  Description of Artificial Sequence: Synthetic peptide
YEEEIASVNPVCTEQYGQVSDGNLQSGNQ

SEQ ID NO: 81912 - protein, 30 aa, Artificial Sequence
  Description of Artificial Sequence: Synthetic polypeptide
SEEEIACTNPVATEQYGCVATNLQAAENGM

SEQ ID NO: 81913 - protein, 28 aa, Artificial Sequence
  Description of Artificial Sequence: Synthetic peptide
YEEEIASVNPVCTEQYGQVSDSLQSGNQ

SEQ ID NO: 81914 - protein, 33 aa, Artificial Sequence
  Description of Artificial Sequence: Synthetic polypeptide
DEEEIRTTNPVATEQYGMVSTNGTTGMEGGNEG

SEQ ID NO: 81915 - protein, 30 aa, Artificial Sequence
  Description of Artificial Sequence: Synthetic polypeptide
DENEIRTTNPVATEQWGDVSTIEMNRAENV

SEQ ID NO: 81916 - protein, 29 aa, Artificial Sequence
  Description of Artificial Sequence: Synthetic peptide
DEEEIRCTNPIATECYGATVSENWMPGNI

SEQ ID NO: 81917 - protein, 32 aa, Artificial Sequence
  Description of Artificial Sequence: Synthetic polypeptide
DEEEIRTTNPVATEQYGMVSTGIVGQGGGQGD

SEQ ID NO: 81918 - protein, 30 aa, Artificial Sequence
  Description of Artificial Sequence: Synthetic polypeptide
DENEIATTNPVATEPYGSVANNNLQDMGTH

SEQ ID NO: 81919 - protein, 32 aa, Artificial Sequence
  Description of Artificial Sequence: Synthetic polypeptide
DEEEIRTTNPVAYEQYGSVATNNQAETEGAEE

SEQ ID NO: 81920 - protein, 31 aa, Artificial Sequence
  Description of Artificial Sequence: Synthetic polypeptide
DENEIATTNPVATEPYGSVAATNDQDQGNNQ

SEQ ID NO: 81921 - protein, 33 aa, Artificial Sequence
  Description of Artificial Sequence: Synthetic polypeptide
AEEEIRTTNPVATEQYGSVSTTQEQQNGNQQED

SEQ ID NO: 81922 - protein, 32 aa, Artificial Sequence
  Description of Artificial Sequence: Synthetic polypeptide
DEEEIRCTNPIATECWGSVSCNEPQDREGENR

SEQ ID NO: 81923 - protein, 32 aa, Artificial Sequence
  Description of Artificial Sequence: Synthetic polypeptide
DEEEIRTTNPVAYEQWGSSYSLPNMLDQDANR

SEQ ID NO: 81924 - protein, 32 aa, Artificial Sequence
  Description of Artificial Sequence: Synthetic polypeptide
DEEEIRTTNPVAYEQWGSSYSLPNMLDQQDNR

SEQ ID NO: 81925 - protein, 35 aa, Artificial Sequence
  Description of Artificial Sequence: Synthetic polypeptide
DEEEIRTTNPVAYEQYGQSVSVTNELLQVTGIERV

SEQ ID NO: 81926 - protein, 28 aa, Artificial Sequence
  Description of Artificial Sequence: Synthetic peptide
YEEEIASVNPVCTEQYGEVSEVLQSGNQ

SEQ ID NO: 81927 - protein, 33 aa, Artificial Sequence
  Description of Artificial Sequence: Synthetic polypeptide
DEEEIRTTNPVAYEQYGSVATNLTDNPGPNDQV

SEQ ID NO: 81928 - protein, 29 aa, Artificial Sequence
  Description of Artificial Sequence: Synthetic peptide
DENEIATTNPVATECYGTVSEDLQQHENL

SEQ ID NO: 81929 - protein, 31 aa, Artificial Sequence
  Description of Artificial Sequence: Synthetic polypeptide
DENEIRTTNPVATEQWGDVSTEIENMRNGNA

SEQ ID NO: 81930 - protein, 33 aa, Artificial Sequence
  Description of Artificial Sequence: Synthetic polypeptide
CEEEIRTTNPVAYEQWGSVFKTDNLDQRGEGDR

SEQ ID NO: 81931 - protein, 33 aa, Artificial Sequence
  Description of Artificial Sequence: Synthetic polypeptide
DEEEIRSTNPVATEQYGSVSTLNVDGNNGENTD

SEQ ID NO: 81932 - protein, 31 aa, Artificial Sequence
  Description of Artificial Sequence: Synthetic polypeptide
DDSEIRTTNPVATEQYGDVSANTIQSRVEDR

SEQ ID NO: 81933 - protein, 34 aa, Artificial Sequence
  Description of Artificial Sequence: Synthetic polypeptide
AEEEIRTTNPVATEQYGSVSTTQLEQGTQTGNGT

SEQ ID NO: 81934 - protein, 34 aa, Artificial Sequence
  Description of Artificial Sequence: Synthetic polypeptide
AEEEIRTTNPVATEQYGSVSTTQLGNQQGNNEEE

SEQ ID NO: 81935 - protein, 33 aa, Artificial Sequence
  Description of Artificial Sequence: Synthetic polypeptide
AEEEIRTTNPVATEQYGSVSTTQLGQTQIGTGT

SEQ ID NO: 81936 - protein, 32 aa, Artificial Sequence
  Description of Artificial Sequence: Synthetic polypeptide
AEEEIRTTNPVATEQYGSVSTTQLQENDTEEV

SEQ ID NO: 81937 - protein, 36 aa, Artificial Sequence
  Description of Artificial Sequence: Synthetic polypeptide
DEEEIRTTNPVAYEQYGQSVSVTNDLLQVRPGAEVR

SEQ ID NO: 81938 - protein, 30 aa, Artificial Sequence
  Description of Artificial Sequence: Synthetic polypeptide
DENEIATTNPVATEIYGSVANPNLQNGDTD

SEQ ID NO: 81939 - protein, 32 aa, Artificial Sequence
  Description of Artificial Sequence: Synthetic polypeptide
DEEEISTTNPVATEQYGCVSTMELQNFGSDQS

SEQ ID NO: 81940 - protein, 31 aa, Artificial Sequence
  Description of Artificial Sequence: Synthetic polypeptide
DENEIATTNPVATEPYGSVAASNLQDQGSNQ

SEQ ID NO: 81941 - protein, 31 aa, Artificial Sequence
  Description of Artificial Sequence: Synthetic polypeptide
DEAEICTTNPVAYEQWGEVSTNLQSNGDNGA

SEQ ID NO: 81942 - protein, 32 aa, Artificial Sequence
  Description of Artificial Sequence: Synthetic polypeptide
DEEEIRTTNPVATEQYGMVSTGIGGQGNDEVS

SEQ ID NO: 81943 - protein, 28 aa, Artificial Sequence
  Description of Artificial Sequence: Synthetic peptide
DENEIATTNPVATEGYGDVSECIQREEL

SEQ ID NO: 81944 - protein, 33 aa, Artificial Sequence
  Description of Artificial Sequence: Synthetic polypeptide
DEEEIRSTNPVATEQYGSVSTLNIGGNNEGNTV

SEQ ID NO: 81945 - protein, 32 aa, Artificial Sequence
  Description of Artificial Sequence: Synthetic polypeptide
DEEEIRSTNPVATEQYGSVSTGTMGQGGGEEQ

SEQ ID NO: 81946 - protein, 34 aa, Artificial Sequence
  Description of Artificial Sequence: Synthetic polypeptide
YEEEIRTTNPVATEQYGCVNSATSNSLTQDDNRY

SEQ ID NO: 81947 - protein, 32 aa, Artificial Sequence
  Description of Artificial Sequence: Synthetic polypeptide
DEAEICTTNPVAYEQYGSIACTNLERTPGNRQ

SEQ ID NO: 81948 - protein, 34 aa, Artificial Sequence
  Description of Artificial Sequence: Synthetic polypeptide
AEEEIRTTNPVATEQYGSVSTTQNNNNQQTGNNE

SEQ ID NO: 81949 - protein, 34 aa, Artificial Sequence
  Description of Artificial Sequence: Synthetic polypeptide
AEEEIRTTNPVATEQYGSVSTTQNNNQQQGNNNE

SEQ ID NO: 81950 - protein, 33 aa, Artificial Sequence
  Description of Artificial Sequence: Synthetic polypeptide
DEEEIRTTNPVAYEQYGQSVSVLNDLWQEGIEF

SEQ ID NO: 81951 - protein, 34 aa, Artificial Sequence
  Description of Artificial Sequence: Synthetic polypeptide
AEEEIRTTNPVATEQYGSVSTVTNNLNSNGTNTT

SEQ ID NO: 81952 - protein, 29 aa, Artificial Sequence
  Description of Artificial Sequence: Synthetic peptide
DENEIATTNPVATEQWGDVSEIEMRAGDR

SEQ ID NO: 81953 - protein, 33 aa, Artificial Sequence
  Description of Artificial Sequence: Synthetic polypeptide
DEEEIRTTNPVAYEQYGQSVSVGVDLLQRSQIR

SEQ ID NO: 81954 - protein, 34 aa, Artificial Sequence
  Description of Artificial Sequence: Synthetic polypeptide
DEEEIRTTNPVATEQYGMVSTTNGIQTGGGNQGE

SEQ ID NO: 81955 - protein, 35 aa, Artificial Sequence
  Description of Artificial Sequence: Synthetic polypeptide
DEEEIRTTNPVATEQWGYSNVSYTNYLQERPGPQF

SEQ ID NO: 81956 - protein, 33 aa, Artificial Sequence
  Description of Artificial Sequence: Synthetic polypeptide
DEEEIRTTNPVATEQYGSVTVGVSNEQGIEGNG

SEQ ID NO: 81957 - protein, 35 aa, Artificial Sequence
  Description of Artificial Sequence: Synthetic polypeptide
DEEEIRTTNPVATEQWGYSNVSYTNYLQHRPGGDF

SEQ ID NO: 81958 - protein, 32 aa, Artificial Sequence
  Description of Artificial Sequence: Synthetic polypeptide
DEEEIRSTNPVATEQYGSVIDDIFLLQVNSNR

SEQ ID NO: 81959 - protein, 33 aa, Artificial Sequence
  Description of Artificial Sequence: Synthetic polypeptide
DEEEIRTTNPVATEQYGMVSTTNMTGGMGNDDE

SEQ ID NO: 81960 - protein, 33 aa, Artificial Sequence
  Description of Artificial Sequence: Synthetic polypeptide
DEEEIRTTNPVATEQYGSVSWYEMQDTYGSNEN

SEQ ID NO: 81961 - protein, 34 aa, Artificial Sequence
  Description of Artificial Sequence: Synthetic polypeptide
DEEEIRTTNPVATEQYGMVSTTQNIGQGEGGNQG

SEQ ID NO: 81962 - protein, 33 aa, Artificial Sequence
  Description of Artificial Sequence: Synthetic polypeptide
DEEEIRTTNPVATEQYGMVSTVGFEQGIGDNQG

SEQ ID NO: 81963 - protein, 33 aa, Artificial Sequence
  Description of Artificial Sequence: Synthetic polypeptide
DEEEIRTTNPVATEQYGMVSTVGFTGQGGGNQD

SEQ ID NO: 81964 - protein, 33 aa, Artificial Sequence
  Description of Artificial Sequence: Synthetic polypeptide
DEEEIRTTNPVATEQYGMVSTVNDTTGMGGNGD

SEQ ID NO: 81965 - protein, 33 aa, Artificial Sequence
  Description of Artificial Sequence: Synthetic polypeptide
DEEEIRTTNPVAYEQYGSVENTNHQNYFQNIRQ

SEQ ID NO: 81966 - protein, 34 aa, Artificial Sequence
  Description of Artificial Sequence: Synthetic polypeptide
AEEEIRTTNPVATEQYGSVSTTQNQNGQEGNNEE

SEQ ID NO: 81967 - protein, 34 aa, Artificial Sequence
  Description of Artificial Sequence: Synthetic polypeptide
DEEEIRTTNPVATEQYGMVSTVNLNLNIGENEQG

SEQ ID NO: 81968 - protein, 30 aa, Artificial Sequence
  Description of Artificial Sequence: Synthetic polypeptide
SEEEIACTNPVATEQYGCVATNLQAEDNND

SEQ ID NO: 81969 - protein, 34 aa, Artificial Sequence
  Description of Artificial Sequence: Synthetic polypeptide
DEEEIRTTNPVATEQYGMVSTTNLQNGMEDTGQG

SEQ ID NO: 81970 - protein, 31 aa, Artificial Sequence
  Description of Artificial Sequence: Synthetic polypeptide
DEEEIRTTNPVAYEQYGSVNCTNISTNVNPK

SEQ ID NO: 81971 - protein, 33 aa, Artificial Sequence
  Description of Artificial Sequence: Synthetic polypeptide
DEEEIRTTNPVATEQYGSVYTMMMLEQPINEIE

SEQ ID NO: 81972 - protein, 29 aa, Artificial Sequence
  Description of Artificial Sequence: Synthetic peptide
YEEEIASVNPVCTEQYGTVSATNLESGNQ

SEQ ID NO: 81973 - protein, 31 aa, Artificial Sequence
  Description of Artificial Sequence: Synthetic polypeptide
DEAEICTTNPVAYEQWGSVSTNLQGNDGDAM

SEQ ID NO: 81974 - protein, 29 aa, Artificial Sequence
  Description of Artificial Sequence: Synthetic peptide
YEEEIASVNPVCTEQYGQVVSDNLQTGNQ

SEQ ID NO: 81975 - protein, 31 aa, Artificial Sequence
  Description of Artificial Sequence: Synthetic polypeptide
DENEIATTNPVATEPYGSVSATDLEDQEGEL

SEQ ID NO: 81976 - protein, 31 aa, Artificial Sequence
  Description of Artificial Sequence: Synthetic polypeptide
DENEIATTNPVATEPYGSVSATDLQDQEGEL

SEQ ID NO: 81977 - protein, 33 aa, Artificial Sequence
  Description of Artificial Sequence: Synthetic polypeptide
AEEEIRTTNPVATEQYGSVSTTQLQQTQIGTGG

SEQ ID NO: 81978 - protein, 33 aa, Artificial Sequence
  Description of Artificial Sequence: Synthetic polypeptide
AEEEIRTTNPVATEQYGSVSTTQLQQTTIGEGN

SEQ ID NO: 81979 - protein, 34 aa, Artificial Sequence
  Description of Artificial Sequence: Synthetic polypeptide
DEEEIRSTNPVATEQYGSVSSTTNGPNMRGMNPV

SEQ ID NO: 81980 - protein, 34 aa, Artificial Sequence
  Description of Artificial Sequence: Synthetic polypeptide
DEEEIRCTNPVATEQYGSVSTEPAGPNMRGMNPR

SEQ ID NO: 81981 - protein, 34 aa, Artificial Sequence
  Description of Artificial Sequence: Synthetic polypeptide
AEEEIRTTNPVATEQYGSVSTTQNGNQQTGNNNE

SEQ ID NO: 81982 - protein, 33 aa, Artificial Sequence
  Description of Artificial Sequence: Synthetic polypeptide
DEEEIRTTNPVAYEQWGSTSPTDNQDNQREGAR

SEQ ID NO: 81983 - protein, 34 aa, Artificial Sequence
  Description of Artificial Sequence: Synthetic polypeptide
YEEEIRTTNPVATEQYGCVCSNTSNSLTQPDWNR

SEQ ID NO: 81984 - protein, 33 aa, Artificial Sequence
  Description of Artificial Sequence: Synthetic polypeptide
DEEEIRTTNPVAYEQWGSTSPTDNQDSQREGNL

SEQ ID NO: 81985 - protein, 33 aa, Artificial Sequence
  Description of Artificial Sequence: Synthetic polypeptide
DEEEIRTTNPVAYEQWGSTSPTENDDDQRGGNE

SEQ ID NO: 81986 - protein, 31 aa, Artificial Sequence
  Description of Artificial Sequence: Synthetic polypeptide
AEDEICATNPVATEQYGVVSTSENLQSGNGD

SEQ ID NO: 81987 - protein, 29 aa, Artificial Sequence
  Description of Artificial Sequence: Synthetic peptide
DENEIATTNPVATEPYGTISEDLQQQGNH

SEQ ID NO: 81988 - protein, 33 aa, Artificial Sequence
  Description of Artificial Sequence: Synthetic polypeptide
AEEEIRTTNPVATEQYGSVSTTQNLQQDEDEEV

SEQ ID NO: 81989 - protein, 28 aa, Artificial Sequence
  Description of Artificial Sequence: Synthetic peptide
YEEEIASVNPVCTEQYGTVCDNLQSGNQ

SEQ ID NO: 81990 - protein, 33 aa, Artificial Sequence
  Description of Artificial Sequence: Synthetic polypeptide
DEEEIRSTNPVATEQYGSVSGNNDQGGGEGNEG

SEQ ID NO: 81991 - protein, 30 aa, Artificial Sequence
  Description of Artificial Sequence: Synthetic polypeptide
DEACIRTTNPLATEQFGSVSWELQSFGSNQ

SEQ ID NO: 81992 - protein, 35 aa, Artificial Sequence
  Description of Artificial Sequence: Synthetic polypeptide
DEEEIRSTNPVATEQYGSVSDTPASLHQRSGENTV

SEQ ID NO: 81993 - protein, 33 aa, Artificial Sequence
  Description of Artificial Sequence: Synthetic polypeptide
AEEEIRTTNPVATEQYGSVSTTQNNIDEEGTND

SEQ ID NO: 81994 - protein, 35 aa, Artificial Sequence
  Description of Artificial Sequence: Synthetic polypeptide
AEEEIRTTNPVATEQYGSVSTVTNNLNQQQIGNTD

SEQ ID NO: 81995 - protein, 33 aa, Artificial Sequence
  Description of Artificial Sequence: Synthetic polypeptide
DEEEIRTTNPVATEQYGSVYTNADQENTGSQQY

SEQ ID NO: 81996 - protein, 33 aa, Artificial Sequence
  Description of Artificial Sequence: Synthetic polypeptide
DEEEIRTTNPVAYEQWGQSVRQTNDHEQRGDGR

SEQ ID NO: 81997 - protein, 30 aa, Artificial Sequence
  Description of Artificial Sequence: Synthetic polypeptide
DENEIRTTNPVATEQWGDVSEILQNAAGTA

SEQ ID NO: 81998 - protein, 30 aa, Artificial Sequence
  Description of Artificial Sequence: Synthetic polypeptide
DENEIATTNPVATECYGSVSENLQDHEEEL

SEQ ID NO: 81999 - protein, 33 aa, Artificial Sequence
  Description of Artificial Sequence: Synthetic polypeptide
DEEEIRTTNPVATEQYGSVSWPGVNIQRVELDQ

SEQ ID NO: 82000 - protein, 34 aa, Artificial Sequence
  Description of Artificial Sequence: Synthetic polypeptide
AEEEIRTTNPVATEQYGSVSTTNQLQGNPNNQNE

SEQ ID NO: 82001 - protein, 31 aa, Artificial Sequence
  Description of Artificial Sequence: Synthetic polypeptide
DEEEIRATNPVAYEQWGMVSGGNDMQGQGNR

SEQ ID NO: 82002 - protein, 35 aa, Artificial Sequence
  Description of Artificial Sequence: Synthetic polypeptide
AEEEIRTTNPVATEQYGSVSTTNQLQLGNQGGNGN

SEQ ID NO: 82003 - protein, 34 aa, Artificial Sequence
  Description of Artificial Sequence: Synthetic polypeptide
YEEEIRTTNPVATEQYGIVPCTPNLPQLRAGANY

SEQ ID NO: 82004 - protein, 28 aa, Artificial Sequence
  Description of Artificial Sequence: Synthetic peptide
ACNEIACTNPVATEQYGEASENLQWGGR

SEQ ID NO: 82005 - protein, 34 aa, Artificial Sequence
  Description of Artificial Sequence: Synthetic polypeptide
DEEEIRTTNPVATEQYGSVSWPGVNLQRDPELEQ

SEQ ID NO: 82006 - protein, 32 aa, Artificial Sequence
  Description of Artificial Sequence: Synthetic polypeptide
DEAEICTTNPVATECYGSVSTQNGLGNAGMDR

SEQ ID NO: 82007 - protein, 33 aa, Artificial Sequence
  Description of Artificial Sequence: Synthetic polypeptide
DEEEIRTTNPVATEQYGSWSLPNMLEKRDDNQQ

SEQ ID NO: 82008 - protein, 33 aa, Artificial Sequence
  Description of Artificial Sequence: Synthetic polypeptide
DEEEIRTTNPVATEPYGSVCFTNEDHTNGGDNR

SEQ ID NO: 82009 - protein, 32 aa, Artificial Sequence
  Description of Artificial Sequence: Synthetic polypeptide
DEEEIRTTNPVAYEQWGEQVPSTNLSERGGTE

SEQ ID NO: 82010 - protein, 29 aa, Artificial Sequence
  Description of Artificial Sequence: Synthetic peptide
QESEIRTTNPVATECYGSVPENEQHEENK

SEQ ID NO: 82011 - protein, 30 aa, Artificial Sequence
  Description of Artificial Sequence: Synthetic polypeptide
QESEIRTTNPVATECYGSVPENEQHEGENK

SEQ ID NO: 82012 - protein, 34 aa, Artificial Sequence
  Description of Artificial Sequence: Synthetic polypeptide
AEEEIRTTNPVATEQYGSVSTTNQLQQTGEEGTE

SEQ ID NO: 82013 - protein, 32 aa, Artificial Sequence
  Description of Artificial Sequence: Synthetic polypeptide
DEEEIRTTNPVATEQYGSWSLPEMLEVRDNNL

SEQ ID NO: 82014 - protein, 28 aa, Artificial Sequence
  Description of Artificial Sequence: Synthetic peptide
YEEEIASVNPVATEQYGVASDVLQSGNK

SEQ ID NO: 82015 - protein, 32 aa, Artificial Sequence
  Description of Artificial Sequence: Synthetic polypeptide
DEEEIRTTNPVAYEQWGESISTNLSERTGGTE

SEQ ID NO: 82016 - protein, 33 aa, Artificial Sequence
  Description of Artificial Sequence: Synthetic polypeptide
DEEEIRTTNPVATEQYGSWSITENLEASAGETD

SEQ ID NO: 82017 - protein, 33 aa, Artificial Sequence
  Description of Artificial Sequence: Synthetic polypeptide
DEEEIRTTNPVAYEQWGESMSQRNDDLQRGDVR

SEQ ID NO: 82018 - protein, 28 aa, Artificial Sequence
  Description of Artificial Sequence: Synthetic peptide
DENEIATTNPVATECYGDVSCCLQHEEL

SEQ ID NO: 82019 - protein, 29 aa, Artificial Sequence
  Description of Artificial Sequence: Synthetic peptide
DENEIATTNPVATECYGDVSCCLQHEGEL

SEQ ID NO: 82020 - protein, 35 aa, Artificial Sequence
  Description of Artificial Sequence: Synthetic polypeptide
AEEEIRTTNPVATEQYGSVSTTNQLQGEEGGGNDD

SEQ ID NO: 82021 - protein, 32 aa, Artificial Sequence
  Description of Artificial Sequence: Synthetic polypeptide
DEAEICTTNPVATECYGSVSTNLNMNGDGNND

SEQ ID NO: 82022 - protein, 34 aa, Artificial Sequence
  Description of Artificial Sequence: Synthetic polypeptide
YEEEIRTTNPVATEQYGIVPSTPNDPQLRHGANL

SEQ ID NO: 82023 - protein, 34 aa, Artificial Sequence
  Description of Artificial Sequence: Synthetic polypeptide
DEEEIRTTNPVATEGYGSVSTDNGNEQINEGGNG

SEQ ID NO: 82024 - protein, 32 aa, Artificial Sequence
  Description of Artificial Sequence: Synthetic polypeptide
DENEIATTNPVATECWGSVSCINLQDREGENL

SEQ ID NO: 82025 - protein, 33 aa, Artificial Sequence
  Description of Artificial Sequence: Synthetic polypeptide
DEEEIRTTNPVATEQYGSVSWNTHAERDMPLER

SEQ ID NO: 82026 - protein, 30 aa, Artificial Sequence
  Description of Artificial Sequence: Synthetic polypeptide
QESEIRTTNPVATECYGIVSCINLPQSGTG

SEQ ID NO: 82027 - protein, 28 aa, Artificial Sequence
  Description of Artificial Sequence: Synthetic peptide
YEEEIASVNPVATEQYGEVSEVLQSENK

SEQ ID NO: 82028 - protein, 34 aa, Artificial Sequence
  Description of Artificial Sequence: Synthetic polypeptide
AEEEIRTTNPVATEQYGSVSTTNQLIQTNNNNND

SEQ ID NO: 82029 - protein, 31 aa, Artificial Sequence
  Description of Artificial Sequence: Synthetic polypeptide
DEEEIRATNPVAYEQWGCVSGWNDGQGGNKR

SEQ ID NO: 82030 - protein, 31 aa, Artificial Sequence
  Description of Artificial Sequence: Synthetic polypeptide
YEEEIASVNPVATEQYGSVSADNLQDHEGNQ

SEQ ID NO: 82031 - protein, 33 aa, Artificial Sequence
  Description of Artificial Sequence: Synthetic polypeptide
DEEEIRTTNCVATEQYGSVSTNNDTGMGGNEQG

SEQ ID NO: 82032 - protein, 34 aa, Artificial Sequence
  Description of Artificial Sequence: Synthetic polypeptide
AEEEIRTTNPVATEQYGSVSTTNQLLGNEGGNGV

SEQ ID NO: 82033 - protein, 31 aa, Artificial Sequence
  Description of Artificial Sequence: Synthetic polypeptide
DEEEIRATNPVAYEQWGCVSGWNDHQGMGNR

SEQ ID NO: 82034 - protein, 33 aa, Artificial Sequence
  Description of Artificial Sequence: Synthetic polypeptide
AEEEIRTTNPVATEQYGSVSTTNQNLQEDTEEV

SEQ ID NO: 82035 - protein, 31 aa, Artificial Sequence
  Description of Artificial Sequence: Synthetic polypeptide
DENEIATTNPVATECWGSVSCINLQDRGEEL

SEQ ID NO: 82036 - protein, 34 aa, Artificial Sequence
  Description of Artificial Sequence: Synthetic polypeptide
DEEEIRTTNPVATEQYGMSTTSTNLLGSGGNGNI

SEQ ID NO: 82037 - protein, 31 aa, Artificial Sequence
  Description of Artificial Sequence: Synthetic polypeptide
DENEIATTNPVATECWGSVSEINLQDRGEEL

SEQ ID NO: 82038 - protein, 34 aa, Artificial Sequence
  Description of Artificial Sequence: Synthetic polypeptide
DEEEIRTTNPVATEQYGSCSTLDGLQAQSSNDER

SEQ ID NO: 82039 - protein, 33 aa, Artificial Sequence
  Description of Artificial Sequence: Synthetic polypeptide
DEEEIRTTNPVATEQYGSVTTNLLPLSFEQDYR

SEQ ID NO: 82040 - protein, 28 aa, Artificial Sequence
  Description of Artificial Sequence: Synthetic peptide
DENEIATTNPVATECYGAVSECLAHGEL

SEQ ID NO: 82041 - protein, 35 aa, Artificial Sequence
  Description of Artificial Sequence: Synthetic polypeptide
AEEEIRTTNPVATEQYGSVSTTNQLNEQQGNNNNQ

SEQ ID NO: 82042 - protein, 28 aa, Artificial Sequence
  Description of Artificial Sequence: Synthetic peptide
DENEIATTNPVATECYGAVSECLAPGEL

SEQ ID NO: 82043 - protein, 32 aa, Artificial Sequence
  Description of Artificial Sequence: Synthetic polypeptide
DEEEIRTTNPVAYEQWGCTMSRNDLDQRGIRN

SEQ ID NO: 82044 - protein, 34 aa, Artificial Sequence
  Description of Artificial Sequence: Synthetic polypeptide
DEEEIRTTNPVATEQYGAVDSTNLDQGEGQEEDD

SEQ ID NO: 82045 - protein, 34 aa, Artificial Sequence
  Description of Artificial Sequence: Synthetic polypeptide
AEEEIRTTNPVATEQYGSVSTTNQLNQGTEQGEA

SEQ ID NO: 82046 - protein, 29 aa, Artificial Sequence
  Description of Artificial Sequence: Synthetic peptide
YEEEIASVNPVATEQYGSVSDDLQDSGEL

SEQ ID NO: 82047 - protein, 35 aa, Artificial Sequence
  Description of Artificial Sequence: Synthetic polypeptide
DEEEIRTTNPVATEGYGSVSDTDNDLQGEGGNNGN

SEQ ID NO: 82048 - protein, 34 aa, Artificial Sequence
  Description of Artificial Sequence: Synthetic polypeptide
AEEEIRTTNPVATEQYGSVSTTNQNLQEIGETED

SEQ ID NO: 82049 - protein, 34 aa, Artificial Sequence
  Description of Artificial Sequence: Synthetic polypeptide
DEEEIRTTNPVATEQYGSVSWPGVNLQRQVELEL

SEQ ID NO: 82050 - protein, 31 aa, Artificial Sequence
  Description of Artificial Sequence: Synthetic polypeptide
DEEEIRTTNPVSTEQYGSVTPFTNENEVGQT

SEQ ID NO: 82051 - protein, 34 aa, Artificial Sequence
  Description of Artificial Sequence: Synthetic polypeptide
AEEEIRTTNPVATEQYGSVSTTNQNNQQGNNTED

SEQ ID NO: 82052 - protein, 30 aa, Artificial Sequence
  Description of Artificial Sequence: Synthetic polypeptide
QESEIRTTNPVATECYGSVSEICEPQHGNG

SEQ ID NO: 82053 - protein, 34 aa, Artificial Sequence
  Description of Artificial Sequence: Synthetic polypeptide
AEEEIRTTNPVATEQYGSVSTTNQNQDEQGNNNG

SEQ ID NO: 82054 - protein, 28 aa, Artificial Sequence
  Description of Artificial Sequence: Synthetic peptide
DENEIATTNPVATECYGDVSECLQHECL

SEQ ID NO: 82055 - protein, 33 aa, Artificial Sequence
  Description of Artificial Sequence: Synthetic polypeptide
DEEEIRTTNPVAYEQWGESVSQRNDDLQGGMRR

SEQ ID NO: 82056 - protein, 33 aa, Artificial Sequence
  Description of Artificial Sequence: Synthetic polypeptide
DEEEIRTTNPVATEQYGMVGDQTNGQVEITGNG

SEQ ID NO: 82057 - protein, 31 aa, Artificial Sequence
  Description of Artificial Sequence: Synthetic polypeptide
QESEIRTTNPVATECYGSVSEINEPQDHGNG

SEQ ID NO: 82058 - protein, 33 aa, Artificial Sequence
  Description of Artificial Sequence: Synthetic polypeptide
DEEEIRTTNPVATEQYGAVDSDTNMGEGGGNDQ

SEQ ID NO: 82059 - protein, 28 aa, Artificial Sequence
  Description of Artificial Sequence: Synthetic peptide
YQEEIASVNPVCTEQYGVVSDNLQSGNQ

SEQ ID NO: 82060 - protein, 32 aa, Artificial Sequence
  Description of Artificial Sequence: Synthetic polypeptide
DEEEIRTTNPVATEQYGSVSWPLARFDSIQDQ

SEQ ID NO: 82061 - protein, 28 aa, Artificial Sequence
  Description of Artificial Sequence: Synthetic peptide
DENEIATTNPVATECYGDVSECLQHEDL

SEQ ID NO: 82062 - protein, 34 aa, Artificial Sequence
  Description of Artificial Sequence: Synthetic polypeptide
AEEEIRTTNPVATEQYGSVSTTNQNQQEGGNNET

SEQ ID NO: 82063 - protein, 28 aa, Artificial Sequence
  Description of Artificial Sequence: Synthetic peptide
DENEIATTNPVATECYGDVSECLQHEEG

SEQ ID NO: 82064 - protein, 30 aa, Artificial Sequence
  Description of Artificial Sequence: Synthetic polypeptide
YEEEIASVNPVATEQYGVVSDNLQDSEGNQ

SEQ ID NO: 82065 - protein, 28 aa, Artificial Sequence
  Description of Artificial Sequence: Synthetic peptide
DENEIATTNPVATECYGDVSECLQHEEI

SEQ ID NO: 82066 - protein, 28 aa, Artificial Sequence
  Description of Artificial Sequence: Synthetic peptide
YEEEIASVNPVATEQYGVVSEIEQSGNQ

SEQ ID NO: 82067 - protein, 31 aa, Artificial Sequence
  Description of Artificial Sequence: Synthetic polypeptide
DEEEIRTTNPVATEQYGSVSWPMTGASSDRF

SEQ ID NO: 82068 - protein, 28 aa, Artificial Sequence
  Description of Artificial Sequence: Synthetic peptide
DENEIATTNPVATECYGDVSECLQHEEL

SEQ ID NO: 82069 - protein, 34 aa, Artificial Sequence
  Description of Artificial Sequence: Synthetic polypeptide
AEEEIRTTNPVATEQYGSVSTTNQNQQIGTNEGG

SEQ ID NO: 82070 - protein, 28 aa, Artificial Sequence
  Description of Artificial Sequence: Synthetic peptide
DENEIATTNPVATECYGDVSECLQHEEV

SEQ ID NO: 82071 - protein, 29 aa, Artificial Sequence
  Description of Artificial Sequence: Synthetic peptide
YEEEIASVNPVATEQYGVVSNDNLQSGPQ

SEQ ID NO: 82072 - protein, 28 aa, Artificial Sequence
  Description of Artificial Sequence: Synthetic peptide
DENEIATTNPVATECYGDVSECLQHEEA

SEQ ID NO: 82073 - protein, 32 aa, Artificial Sequence
  Description of Artificial Sequence: Synthetic polypeptide
AEEEIRTTNPVATEQYGSVSTTNQENDEANED

SEQ ID NO: 82074 - protein, 35 aa, Artificial Sequence
  Description of Artificial Sequence: Synthetic polypeptide
DEEEISTTNPVATEQYGSVCSTNSLFQERFGSEFS

SEQ ID NO: 82075 - protein, 34 aa, Artificial Sequence
  Description of Artificial Sequence: Synthetic polypeptide
YEEEIRTTNPVATEQYGIVCSAASNSLTQDGNRY

SEQ ID NO: 82076 - protein, 33 aa, Artificial Sequence
  Description of Artificial Sequence: Synthetic polypeptide
DEEEIRTTNPVATEGYGSVSATGMGGQGGNNGD

SEQ ID NO: 82077 - protein, 30 aa, Artificial Sequence
  Description of Artificial Sequence: Synthetic polypeptide
DENEIRTTNPVATEQWGDVSENLMNAAGDA

SEQ ID NO: 82078 - protein, 34 aa, Artificial Sequence
  Description of Artificial Sequence: Synthetic polypeptide
DEEEIRTTNPVATEQYGMTVSCTNGSGEDGGNER

SEQ ID NO: 82079 - protein, 34 aa, Artificial Sequence
  Description of Artificial Sequence: Synthetic polypeptide
AEEEIRTTNPVATEQYGSVSTTNQNLQQQNNNTE

SEQ ID NO: 82080 - protein, 32 aa, Artificial Sequence
  Description of Artificial Sequence: Synthetic polypeptide
DEEEIRTTNPVATEQYGSVSWPGVNQRVEEEQ

SEQ ID NO: 82081 - protein, 30 aa, Artificial Sequence
  Description of Artificial Sequence: Synthetic polypeptide
DENEIATTNPVATECYGDVSCICLQDRGEL

SEQ ID NO: 82082 - protein, 33 aa, Artificial Sequence
  Description of Artificial Sequence: Synthetic polypeptide
DEEEIRTTNPVATEPYGSVCFTNEDKTNGGNER

SEQ ID NO: 82083 - protein, 34 aa, Artificial Sequence
  Description of Artificial Sequence: Synthetic polypeptide
AEEEIRTTNPVATEQYGSVSTTNQNNQEGNNSNI

SEQ ID NO: 82084 - protein, 30 aa, Artificial Sequence
  Description of Artificial Sequence: Synthetic polypeptide
SEEEIACTNPVATEAYGSVATNLQDDTNDE

SEQ ID NO: 82085 - protein, 34 aa, Artificial Sequence
  Description of Artificial Sequence: Synthetic polypeptide
AEEEIRTTNPVATEQYGSVSTTNQNNQEGNNVEE

SEQ ID NO: 82086 - protein, 32 aa, Artificial Sequence
  Description of Artificial Sequence: Synthetic polypeptide
DEEEIRTTNPVAYEQWGESVSCTNFSIRGGTE

SEQ ID NO: 82087 - protein, 28 aa, Artificial Sequence
  Description of Artificial Sequence: Synthetic peptide
YEEEIASVNPVATEQYGVVPDVLQSGNQ

SEQ ID NO: 82088 - protein, 32 aa, Artificial Sequence
  Description of Artificial Sequence: Synthetic polypeptide
DEEEIRTTNPVATEQYGSWPLPVTLQMTADNR

SEQ ID NO: 82089 - protein, 33 aa, Artificial Sequence
  Description of Artificial Sequence: Synthetic polypeptide
DEEEIRTTNPVAYEQWGESVIDRNDDLQRGDRR

SEQ ID NO: 82090 - protein, 34 aa, Artificial Sequence
  Description of Artificial Sequence: Synthetic polypeptide
DEEEIRTTNPVATEQYGAVDSDTNNNEQDEGNTN

SEQ ID NO: 82091 - protein, 34 aa, Artificial Sequence
  Description of Artificial Sequence: Synthetic polypeptide
AEEEIRTTNPVATEQYGSVSTTNQNNQETGNNED

SEQ ID NO: 82092 - protein, 28 aa, Artificial Sequence
  Description of Artificial Sequence: Synthetic peptide
YSEEIASVNPVCTEQYGVVSDNLQSGNQ

SEQ ID NO: 82093 - protein, 33 aa, Artificial Sequence
  Description of Artificial Sequence: Synthetic polypeptide
DEEEIRTTNPVAYEQYGSLVNVGNLSQITGGNS

SEQ ID NO: 82094 - protein, 34 aa, Artificial Sequence
  Description of Artificial Sequence: Synthetic polypeptide
DEEEIRTTNPVATEQYGMVESTGNNGIQTGGGNI

SEQ ID NO: 82095 - protein, 32 aa, Artificial Sequence
  Description of Artificial Sequence: Synthetic polypeptide
DEEEISTTNPVATEQYGSVCSTPHQSFGSDQG

SEQ ID NO: 82096 - protein, 34 aa, Artificial Sequence
  Description of Artificial Sequence: Synthetic polypeptide
DEEEIRTTNPVATEQYGAVDSDTNMQEGGGNVTT

SEQ ID NO: 82097 - protein, 34 aa, Artificial Sequence
  Description of Artificial Sequence: Synthetic polypeptide
DEEEIRTTNPVATEQYGAVDSDTNMQEGGGNEGT

SEQ ID NO: 82098 - protein, 33 aa, Artificial Sequence
  Description of Artificial Sequence: Synthetic polypeptide
DEEEIRTCNPVATEQYGSVVSTEGGQGGNQEEE

SEQ ID NO: 82099 - protein, 34 aa, Artificial Sequence
  Description of Artificial Sequence: Synthetic polypeptide
DEEEIRTTNPVATEQYGAVDSDTNLQGEEQEGDE

SEQ ID NO: 82100 - protein, 34 aa, Artificial Sequence
  Description of Artificial Sequence: Synthetic polypeptide
DEEEIRATNPVATESYGSVCSVNDQHDRQGSNDR

SEQ ID NO: 82101 - protein, 34 aa, Artificial Sequence
  Description of Artificial Sequence: Synthetic polypeptide
DEEEIRATNPVATERYGTTVSCTNSLSQGGGNRL

SEQ ID NO: 82102 - protein, 28 aa, Artificial Sequence
  Description of Artificial Sequence: Synthetic peptide
YEEEIASVNPTCTEQYGYVSDNLQSGNQ

SEQ ID NO: 82103 - protein, 30 aa, Artificial Sequence
  Description of Artificial Sequence: Synthetic polypeptide
CENEIAVTNPVATEQYGEASENLEQRGEGR

SEQ ID NO: 82104 - protein, 32 aa, Artificial Sequence
  Description of Artificial Sequence: Synthetic polypeptide
CEEEIRTTNPVATEQYGVVCSTEDTQNFGSNQ

SEQ ID NO: 82105 - protein, 34 aa, Artificial Sequence
  Description of Artificial Sequence: Synthetic polypeptide
DENEIRTTNPVATEQYGSVSTGNDPLQQEGEEDK

SEQ ID NO: 82106 - protein, 29 aa, Artificial Sequence
  Description of Artificial Sequence: Synthetic peptide
DENEIATTNPCATEQYGIVSCNLQNAEDA

SEQ ID NO: 82107 - protein, 31 aa, Artificial Sequence
  Description of Artificial Sequence: Synthetic polypeptide
DENEIATTNPCAYEPWGSVVSTNLQRGNEAP

SEQ ID NO: 82108 - protein, 31 aa, Artificial Sequence
  Description of Artificial Sequence: Synthetic polypeptide
DEEEIRTTNPVATEQYGAVFGDNGQTQGGEQ

SEQ ID NO: 82109 - protein, 32 aa, Artificial Sequence
  Description of Artificial Sequence: Synthetic polypeptide
DEEEIRTTNPVATEQYGAVFGDNGQTGGGNGD

SEQ ID NO: 82110 - protein, 33 aa, Artificial Sequence
  Description of Artificial Sequence: Synthetic polypeptide
AEEEIRTTNPVATEQYGSVSTTNNQQQQSTNVT

SEQ ID NO: 82111 - protein, 35 aa, Artificial Sequence
  Description of Artificial Sequence: Synthetic polypeptide
DEEEIRTTNPVATEGYGSVSSTTAGPQMRVGMNPR

SEQ ID NO: 82112 - protein, 34 aa, Artificial Sequence
  Description of Artificial Sequence: Synthetic polypeptide
AEEEIRTTNPVATEQYGSVSTTNNQQQQTGNNED

SEQ ID NO: 82113 - protein, 30 aa, Artificial Sequence
  Description of Artificial Sequence: Synthetic polypeptide
DDSEIASTNPVCTEQYGVVSDNLQSRVGNQ

SEQ ID NO: 82114 - protein, 34 aa, Artificial Sequence
  Description of Artificial Sequence: Synthetic polypeptide
AEEEIRTTNPVATEQYGSVSTTNNQQQQTGTNNE

SEQ ID NO: 82115 - protein, 34 aa, Artificial Sequence
  Description of Artificial Sequence: Synthetic polypeptide
DENEIRTTNPVATEQYGSVSTENALTTRGQEPQN

SEQ ID NO: 82116 - protein, 32 aa, Artificial Sequence
  Description of Artificial Sequence: Synthetic polypeptide
DEEEIRTTNPVATEQYGMITVNTVQHLERGGI

SEQ ID NO: 82117 - protein, 31 aa, Artificial Sequence
  Description of Artificial Sequence: Synthetic polypeptide
DEEEIRTTNPVATEQYGAVFGDMETGNQGNN

SEQ ID NO: 82118 - protein, 28 aa, Artificial Sequence
  Description of Artificial Sequence: Synthetic peptide
DENEIATTNPIATECYGDVSECLQHGEI

SEQ ID NO: 82119 - protein, 33 aa, Artificial Sequence
  Description of Artificial Sequence: Synthetic polypeptide
DEEEIRTTNPVAYEQYGQVVSTNDLLAIRLVPR

SEQ ID NO: 82120 - protein, 34 aa, Artificial Sequence
  Description of Artificial Sequence: Synthetic polypeptide
AEEEIRTTNPVATEQYGSVSTTNNQQQQTNGNDE

SEQ ID NO: 82121 - protein, 33 aa, Artificial Sequence
  Description of Artificial Sequence: Synthetic polypeptide
DEEEIRTTNPVAYEPYGVVCNTNPSQRGGNQRA

SEQ ID NO: 82122 - protein, 33 aa, Artificial Sequence
  Description of Artificial Sequence: Synthetic polypeptide
DEEEIRTTNPVATEQYGMIVSGTNLQHDQIFPW

SEQ ID NO: 82123 - protein, 31 aa, Artificial Sequence
  Description of Artificial Sequence: Synthetic polypeptide
QESEIRTTNPVATECWGSVSCNLPQDHGENL

SEQ ID NO: 82124 - protein, 31 aa, Artificial Sequence
  Description of Artificial Sequence: Synthetic polypeptide
DEEEIRTTNPVATEGYGCISTNEQRFSSDFS

SEQ ID NO: 82125 - protein, 28 aa, Artificial Sequence
  Description of Artificial Sequence: Synthetic peptide
YEEEIASVNPTCTEQYGVVSDNLQSGNQ

SEQ ID NO: 82126 - protein, 32 aa, Artificial Sequence
  Description of Artificial Sequence: Synthetic polypeptide
DEEEIRTTNPVATEQYGAVFGDSNGQTGGNID

SEQ ID NO: 82127 - protein, 33 aa, Artificial Sequence
  Description of Artificial Sequence: Synthetic polypeptide
DEEEIRTTNPAATEGYGSVCSTNLAREGGGDDG

SEQ ID NO: 82128 - protein, 33 aa, Artificial Sequence
  Description of Artificial Sequence: Synthetic polypeptide
DEEEIRTTNPVATEGYGSVSNNDEMQGEEGNQG

SEQ ID NO: 82129 - protein, 33 aa, Artificial Sequence
  Description of Artificial Sequence: Synthetic polypeptide
DEEEISTTNPVATEQYGSVYSTINLEPAVVNAP

SEQ ID NO: 82130 - protein, 32 aa, Artificial Sequence
  Description of Artificial Sequence: Synthetic polypeptide
DEEEIRTTNPVATEGYGSVSNNDEMQGEFNGG

SEQ ID NO: 82131 - protein, 30 aa, Artificial Sequence
  Description of Artificial Sequence: Synthetic polypeptide
DEEEIRTTNPAATEFYGSVADDNNEGQGNA

SEQ ID NO: 82132 - protein, 34 aa, Artificial Sequence
  Description of Artificial Sequence: Synthetic polypeptide
DEEEISTTNPVATEQYGSVVSTNSHSQEQGGNNT

SEQ ID NO: 82133 - protein, 29 aa, Artificial Sequence
  Description of Artificial Sequence: Synthetic peptide
AANEIACTNPVATEQYGEASENLQRGMGR

SEQ ID NO: 82134 - protein, 34 aa, Artificial Sequence
  Description of Artificial Sequence: Synthetic polypeptide
DEEEIRTTNPVATEGYGSVSGTTNDTQEDGTNGD

SEQ ID NO: 82135 - protein, 34 aa, Artificial Sequence
  Description of Artificial Sequence: Synthetic polypeptide
DEEEIRTTNPVATEQYGSYASPTENPLQREDTTI

SEQ ID NO: 82136 - protein, 31 aa, Artificial Sequence
  Description of Artificial Sequence: Synthetic polypeptide
DENEIRTTNPVATEQYGSVSTIEENAEEDDA

SEQ ID NO: 82137 - protein, 34 aa, Artificial Sequence
  Description of Artificial Sequence: Synthetic polypeptide
DEEEIRTTNPVATEGYGSVSGTTNDTQDGTNEGQ

SEQ ID NO: 82138 - protein, 34 aa, Artificial Sequence
  Description of Artificial Sequence: Synthetic polypeptide
DEEEIRTTNPVATEQYGSYASPTENPLQEMVNDE

SEQ ID NO: 82139 - protein, 34 aa, Artificial Sequence
  Description of Artificial Sequence: Synthetic polypeptide
DEEEIRTTNPVAYEQYGQVCVSCTNNSQRGGMNS

SEQ ID NO: 82140 - protein, 34 aa, Artificial Sequence
  Description of Artificial Sequence: Synthetic polypeptide
DEEEIRTTNPVATEPYGSVCFTNEDDHHRGGGNR

SEQ ID NO: 82141 - protein, 34 aa, Artificial Sequence
  Description of Artificial Sequence: Synthetic polypeptide
DEEEIRTTNPVAYEQYGQVVSQLNDLLQRGQIRG

SEQ ID NO: 82142 - protein, 29 aa, Artificial Sequence
  Description of Artificial Sequence: Synthetic peptide
DENEIASVNPVCTEQYGVVSDNLQQSGNQ

SEQ ID NO: 82143 - protein, 34 aa, Artificial Sequence
  Description of Artificial Sequence: Synthetic polypeptide
DEEEIRTTNPVATEQYGAVFGDTNLQINEGDNGD

SEQ ID NO: 82144 - protein, 34 aa, Artificial Sequence
  Description of Artificial Sequence: Synthetic polypeptide
DEEEISTTNPVATEQYGSVSWTEQHQERQGGNDL

SEQ ID NO: 82145 - protein, 31 aa, Artificial Sequence
  Description of Artificial Sequence: Synthetic polypeptide
YEEEIRTTNPVATEQYGMVSTLTNTRWGTHN

SEQ ID NO: 82146 - protein, 32 aa, Artificial Sequence
  Description of Artificial Sequence: Synthetic polypeptide
DEEEIRTTNPVATEQYGAVFGDSNGQTQGENG

SEQ ID NO: 82147 - protein, 35 aa, Artificial Sequence
  Description of Artificial Sequence: Synthetic polypeptide
YEEEIRTTNPVATEQYGNTAVSSNSNLTQRNGNRF

SEQ ID NO: 82148 - protein, 30 aa, Artificial Sequence
  Description of Artificial Sequence: Synthetic polypeptide
QESEIRTTNPVATECWGSVSCNLPQDHGEL

SEQ ID NO: 82149 - protein, 34 aa, Artificial Sequence
  Description of Artificial Sequence: Synthetic polypeptide
DEEEIRTTNPVATEQYGAVFGDTNLQINEGNGGT

SEQ ID NO: 82150 - protein, 30 aa, Artificial Sequence
  Description of Artificial Sequence: Synthetic polypeptide
DEEEIRTTNPVAYEPYGVVNCTNISQSVNQ

SEQ ID NO: 82151 - protein, 32 aa, Artificial Sequence
  Description of Artificial Sequence: Synthetic polypeptide
DEAEICTTNPVATECYGSVSTGNMQDAGNNEN

SEQ ID NO: 82152 - protein, 35 aa, Artificial Sequence
  Description of Artificial Sequence: Synthetic polypeptide
YEEEIRTTNPVATEQYGIVPSTTPNLEQLRHGANY

SEQ ID NO: 82153 - protein, 32 aa, Artificial Sequence
  Description of Artificial Sequence: Synthetic polypeptide
DEEEIRTTNPVATEQYGAVFGDENGQTGGGNQ

SEQ ID NO: 82154 - protein, 33 aa, Artificial Sequence
  Description of Artificial Sequence: Synthetic polypeptide
DEEEISTTNPVATEQYGSVSNTGELQNFGSEQF

SEQ ID NO: 82155 - protein, 31 aa, Artificial Sequence
  Description of Artificial Sequence: Synthetic polypeptide
DENEIATTNPVATECWGSASEINLQREGENG

SEQ ID NO: 82156 - protein, 29 aa, Artificial Sequence
  Description of Artificial Sequence: Synthetic peptide
QESEIRTTNPVATECWGSVSENLQDHEEL

SEQ ID NO: 82157 - protein, 33 aa, Artificial Sequence
  Description of Artificial Sequence: Synthetic polypeptide
DEEEIRTTNPVAYEQWGCSVSRNDPDQRQGIER

SEQ ID NO: 82158 - protein, 34 aa, Artificial Sequence
  Description of Artificial Sequence: Synthetic polypeptide
AEEEIRTTNPVATEQYGSVSTTNNTNQAIGNNNI

SEQ ID NO: 82159 - protein, 32 aa, Artificial Sequence
  Description of Artificial Sequence: Synthetic polypeptide
SEEEIRCTNPIATEQYGSVSGENQDMDRGNER

SEQ ID NO: 82160 - protein, 34 aa, Artificial Sequence
  Description of Artificial Sequence: Synthetic polypeptide
DEEEIRTTNPVATEPYGSVCFTNEDHHQHGGNHR

SEQ ID NO: 82161 - protein, 32 aa, Artificial Sequence
  Description of Artificial Sequence: Synthetic polypeptide
DENEIRTTNPVATEQYGSVSTDMLNTEGEDVE

SEQ ID NO: 82162 - protein, 32 aa, Artificial Sequence
  Description of Artificial Sequence: Synthetic polypeptide
DEEEIRTTNPVSTEQYGSVTPANQLWQQGVQG

SEQ ID NO: 82163 - protein, 31 aa, Artificial Sequence
  Description of Artificial Sequence: Synthetic polypeptide
SEEEIACTNPVATEAYGSVATNLQESGNSEE

SEQ ID NO: 82164 - protein, 33 aa, Artificial Sequence
  Description of Artificial Sequence: Synthetic polypeptide
DEAEICTTNPVATECYGSVSTGNQLQMDDGNEN

SEQ ID NO: 82165 - protein, 29 aa, Artificial Sequence
  Description of Artificial Sequence: Synthetic peptide
QESEIRTTNPVATECYGDVSCCEPQHGNL

SEQ ID NO: 82166 - protein, 34 aa, Artificial Sequence
  Description of Artificial Sequence: Synthetic polypeptide
AEEEIRTTNPVATEQYGSVSTTNNVNQQGEEQND

SEQ ID NO: 82167 - protein, 30 aa, Artificial Sequence
  Description of Artificial Sequence: Synthetic polypeptide
QESEIRTTNPVATECYGDVSCCEPQREGNL

SEQ ID NO: 82168 - protein, 34 aa, Artificial Sequence
  Description of Artificial Sequence: Synthetic polypeptide
DENEIRTTNPVATEQYGSVSTDMLNQFEGMNIEQ

SEQ ID NO: 82169 - protein, 34 aa, Artificial Sequence
  Description of Artificial Sequence: Synthetic polypeptide
DEEEIRTTNPVATEGYGSVSGTMELDQNEFGQNT

SEQ ID NO: 82170 - protein, 34 aa, Artificial Sequence
  Description of Artificial Sequence: Synthetic polypeptide
YEEEIRTTNPVATEQYGQCAVSNSNMTQRNGNRF

SEQ ID NO: 82171 - protein, 32 aa, Artificial Sequence
  Description of Artificial Sequence: Synthetic polypeptide
SEEEIRCTNPIATEQYGSVSGENDMNRQGDNR

SEQ ID NO: 82172 - protein, 30 aa, Artificial Sequence
  Description of Artificial Sequence: Synthetic polypeptide
YEEEIASVNPVATEQYGAVSDNLQSKGNYQ

SEQ ID NO: 82173 - protein, 33 aa, Artificial Sequence
  Description of Artificial Sequence: Synthetic polypeptide
DEEEIRTTNPVATEPYGSVCFTNEDHRGGQNQE

SEQ ID NO: 82174 - protein, 31 aa, Artificial Sequence
  Description of Artificial Sequence: Synthetic polypeptide
QESEIRTTNPVATECYGIVSCINEPQRGENG

SEQ ID NO: 82175 - protein, 29 aa, Artificial Sequence
  Description of Artificial Sequence: Synthetic peptide
ACNEIACTNPVATEQYGEASENLQRGGPR

SEQ ID NO: 82176 - protein, 30 aa, Artificial Sequence
  Description of Artificial Sequence: Synthetic polypeptide
DENEIRTTNPVATEQWGDVSENLMNRAEGA

SEQ ID NO: 82177 - protein, 33 aa, Artificial Sequence
  Description of Artificial Sequence: Synthetic polypeptide
AEEEIRTTNPVATEQYGSVSTTNNSNEQGTNFE

SEQ ID NO: 82178 - protein, 32 aa, Artificial Sequence
  Description of Artificial Sequence: Synthetic polypeptide
DEEEISTTNPVATEQYGSVSTEHNQNFNSNQS

SEQ ID NO: 82179 - protein, 32 aa, Artificial Sequence
  Description of Artificial Sequence: Synthetic polypeptide
DEEEIRTTNPVATEQYGSWVTNGIFGAQDSNC

SEQ ID NO: 82180 - protein, 32 aa, Artificial Sequence
  Description of Artificial Sequence: Synthetic polypeptide
AEEEIRTTNPVATEQYGSVSTTNNQQQSQEDN

SEQ ID NO: 82181 - protein, 34 aa, Artificial Sequence
  Description of Artificial Sequence: Synthetic polypeptide
AEEEIRTTNPVATEQYGSVSTTNNQQQTEGTNVD

SEQ ID NO: 82182 - protein, 31 aa, Artificial Sequence
  Description of Artificial Sequence: Synthetic polypeptide
DEEEIRTTNPVAYEPYGVVVNCTNSSQRVNK

SEQ ID NO: 82183 - protein, 34 aa, Artificial Sequence
  Description of Artificial Sequence: Synthetic polypeptide
DEEEIRTTNPVATEGYGSVSSTTAGQMRVGMQPR

SEQ ID NO: 82184 - protein, 34 aa, Artificial Sequence
  Description of Artificial Sequence: Synthetic polypeptide
DEEEIRTTNPVATEQYGSVTTDYSLEQRGQQDHQ

SEQ ID NO: 82185 - protein, 29 aa, Artificial Sequence
  Description of Artificial Sequence: Synthetic peptide
YEEEIASVNPTVCTEQYGVVSDNLQSGNQ

SEQ ID NO: 82186 - protein, 33 aa, Artificial Sequence
  Description of Artificial Sequence: Synthetic polypeptide
DENEIRTTNPVATEQYGSVSTEDDETNLQNNSG

SEQ ID NO: 82187 - protein, 31 aa, Artificial Sequence
  Description of Artificial Sequence: Synthetic polypeptide
DEEEIRTTNPVATEQYGAVFGDGNGNQGNDS

SEQ ID NO: 82188 - protein, 30 aa, Artificial Sequence
  Description of Artificial Sequence: Synthetic polypeptide
YEEEIASVNPVATECYGVVSCINLQRGENG

SEQ ID NO: 82189 - protein, 34 aa, Artificial Sequence
  Description of Artificial Sequence: Synthetic polypeptide
DEAEICTTNPVATECYGSVSTGNQLQGDRGNGEN

SEQ ID NO: 82190 - protein, 31 aa, Artificial Sequence
  Description of Artificial Sequence: Synthetic polypeptide
DENEIATTNPVATEAYGSVTTTQPHQRGDRP

SEQ ID NO: 82191 - protein, 33 aa, Artificial Sequence
  Description of Artificial Sequence: Synthetic polypeptide
DEEEIRTTNPVAYEQYGQVVSVVNDMLQRGQIE

SEQ ID NO: 82192 - protein, 33 aa, Artificial Sequence
  Description of Artificial Sequence: Synthetic polypeptide
DEEEIRTTNPVAYEQFGQSVSCTGYLSLRGGNG

SEQ ID NO: 82193 - protein, 31 aa, Artificial Sequence
  Description of Artificial Sequence: Synthetic polypeptide
SEEEIACTNPVATEAYGSVATNLQEEGNQDE

SEQ ID NO: 82194 - protein, 28 aa, Artificial Sequence
  Description of Artificial Sequence: Synthetic peptide
YTEEIASVNPVCTEQYGVVSDNLQSGNQ

SEQ ID NO: 82195 - protein, 32 aa, Artificial Sequence
  Description of Artificial Sequence: Synthetic polypeptide
DEEEIRTTNPVATEQYGSALMTNLDERELIGQ

SEQ ID NO: 82196 - protein, 34 aa, Artificial Sequence
  Description of Artificial Sequence: Synthetic polypeptide
AEEEIRTTNPVATEQYGSVSTTNNQQQTQGTNSE

SEQ ID NO: 82197 - protein, 31 aa, Artificial Sequence
  Description of Artificial Sequence: Synthetic polypeptide
DEEEIRTTNPVATEQYGAVFGDGEGNQGGNG

SEQ ID NO: 82198 - protein, 35 aa, Artificial Sequence
  Description of Artificial Sequence: Synthetic polypeptide
YEEEIRTTNPVATEQYGNVPSTPNLIQLRHGANYN

SEQ ID NO: 82199 - protein, 33 aa, Artificial Sequence
  Description of Artificial Sequence: Synthetic polypeptide
DEEEIRCTNPVATEQYGSVSGNIQDEGGQNSTV

SEQ ID NO: 82200 - protein, 32 aa, Artificial Sequence
  Description of Artificial Sequence: Synthetic polypeptide
DEEEIRTTNPVATEQYGAVFGDFNGQEQGNDI

SEQ ID NO: 82201 - protein, 30 aa, Artificial Sequence
  Description of Artificial Sequence: Synthetic polypeptide
QESEIRTTNPVATECWGSVSENEQHEGENG

SEQ ID NO: 82202 - protein, 34 aa, Artificial Sequence
  Description of Artificial Sequence: Synthetic polypeptide
YEEEIRTTNPVATEQYGCVCSATSNSLTQCIGND

SEQ ID NO: 82203 - protein, 31 aa, Artificial Sequence
  Description of Artificial Sequence: Synthetic polypeptide
DEEEIRTTNPVATEGYGCICSTNEQRFSSDQ

SEQ ID NO: 82204 - protein, 32 aa, Artificial Sequence
  Description of Artificial Sequence: Synthetic polypeptide
YEEEIRTTNPVATEQYGICGSSTIELQRESER

SEQ ID NO: 82205 - protein, 33 aa, Artificial Sequence
  Description of Artificial Sequence: Synthetic polypeptide
DEEEIRTTNPVATEPYGSVCFTMSLTQEGGQIR

SEQ ID NO: 82206 - protein, 32 aa, Artificial Sequence
  Description of Artificial Sequence: Synthetic polypeptide
DEAEIRTTNPVATEQYGCTSTNLQHFGSDTQS

SEQ ID NO: 82207 - protein, 30 aa, Artificial Sequence
  Description of Artificial Sequence: Synthetic polypeptide
SEEEIACTNPVATEMYGSVATNLQEAGSPE

SEQ ID NO: 82208 - protein, 28 aa, Artificial Sequence
  Description of Artificial Sequence: Synthetic peptide
YEEEIASVNPVCTEEYGTVSDNLQSGNQ

SEQ ID NO: 82209 - protein, 28 aa, Artificial Sequence
  Description of Artificial Sequence: Synthetic peptide
YEEEIASVNPVCTEEYGVVSDNLQSGNQ

SEQ ID NO: 82210 - protein, 28 aa, Artificial Sequence
  Description of Artificial Sequence: Synthetic peptide
YEEEIASVNPVCTEFYGVVSDNLQSGNQ

SEQ ID NO: 82211 - protein, 28 aa, Artificial Sequence
  Description of Artificial Sequence: Synthetic peptide
YEYEIASVNPVCTEQYGVVSDNLQSGNQ

SEQ ID NO: 82212 - protein, 29 aa, Artificial Sequence
  Description of Artificial Sequence: Synthetic peptide
DENEIATTNPVATECYGSVSCCLQDHEEL

SEQ ID NO: 82213 - protein, 33 aa, Artificial Sequence
  Description of Artificial Sequence: Synthetic polypeptide
DEEEIRTTNPVAYEQWGKTPSCTNEALPRGGNR

SEQ ID NO: 82214 - protein, 33 aa, Artificial Sequence
  Description of Artificial Sequence: Synthetic polypeptide
DEEEISTTNPVATEQYGQCVCSTNHQHGGSNQS

SEQ ID NO: 82215 - protein, 33 aa, Artificial Sequence
  Description of Artificial Sequence: Synthetic polypeptide
DEEEIRTTNPVATEGYGSVSTMNGGQTGEGEVT

SEQ ID NO: 82216 - protein, 32 aa, Artificial Sequence
  Description of Artificial Sequence: Synthetic polypeptide
QESEIRTTNPVATEQWGSVSCINEPQDREGNG

SEQ ID NO: 82217 - protein, 33 aa, Artificial Sequence
  Description of Artificial Sequence: Synthetic polypeptide
DEEEIRTTNPVATEQYGSVYTVYMEQTGNSNQE

SEQ ID NO: 82218 - protein, 31 aa, Artificial Sequence
  Description of Artificial Sequence: Synthetic polypeptide
DEAEIRTTNPVATEQYGCTSTNHQHFGSDQA

SEQ ID NO: 82219 - protein, 34 aa, Artificial Sequence
  Description of Artificial Sequence: Synthetic polypeptide
YEEEIRTTNPVATEQYGGVPSTPNLIQLEGANYM

SEQ ID NO: 82220 - protein, 34 aa, Artificial Sequence
  Description of Artificial Sequence: Synthetic polypeptide
DEEEIRTTNPVATEQYGSVYTVTNGNQEQGNNQG

SEQ ID NO: 82221 - protein, 34 aa, Artificial Sequence
  Description of Artificial Sequence: Synthetic polypeptide
AEEEIRTTNPVATEQYGSVSTTNQQLNNEAGNNM

SEQ ID NO: 82222 - protein, 35 aa, Artificial Sequence
  Description of Artificial Sequence: Synthetic polypeptide
AEEEIRTTNPVATEQYGSVSTTNQQLQEGTNTNVD

SEQ ID NO: 82223 - protein, 33 aa, Artificial Sequence
  Description of Artificial Sequence: Synthetic polypeptide
DEEEIRTTNPVATEQYGMVGSITNGGQGQGEED

SEQ ID NO: 82224 - protein, 31 aa, Artificial Sequence
  Description of Artificial Sequence: Synthetic polypeptide
YEEEIRTTNPVATEQYGSCSTLTNTRFGTHL

SEQ ID NO: 82225 - protein, 34 aa, Artificial Sequence
  Description of Artificial Sequence: Synthetic polypeptide
YEEEIRTTNPVATEQYGGVPSTPNLEQMRHGADY

SEQ ID NO: 82226 - protein, 31 aa, Artificial Sequence
  Description of Artificial Sequence: Synthetic polypeptide
DEAEIRTTNPVATEQYGCTTSTNHQNGSDQS

SEQ ID NO: 82227 - protein, 34 aa, Artificial Sequence
  Description of Artificial Sequence: Synthetic polypeptide
YEEEIRTTNPVATEQYGGVPSTPNLIQLGEGENY

SEQ ID NO: 82228 - protein, 33 aa, Artificial Sequence
  Description of Artificial Sequence: Synthetic polypeptide
YEEEIRTTNPVATEQYGGVPYTPNDIQLRGANY

SEQ ID NO: 82229 - protein, 33 aa, Artificial Sequence
  Description of Artificial Sequence: Synthetic polypeptide
DEEEISTTNPVATEQYGQCVCSTNLQHSNSNQS

SEQ ID NO: 82230 - protein, 35 aa, Artificial Sequence
  Description of Artificial Sequence: Synthetic polypeptide
AEEEIRTTNPVATEQYGSVSTTNQQLEQQGTNQEE

SEQ ID NO: 82231 - protein, 34 aa, Artificial Sequence
  Description of Artificial Sequence: Synthetic polypeptide
DENEIRTTNPVATEQYGSVSSTEPNGPNMRNGNV

SEQ ID NO: 82232 - protein, 33 aa, Artificial Sequence
  Description of Artificial Sequence: Synthetic polypeptide
DEEEIRTTNPVATEQYGMVGSIDNLEGNGNGET

SEQ ID NO: 82233 - protein, 30 aa, Artificial Sequence
  Description of Artificial Sequence: Synthetic polypeptide
DDSEIRSTNPVATEQYGNVSNTIQSRVGDR

SEQ ID NO: 82234 - protein, 34 aa, Artificial Sequence
  Description of Artificial Sequence: Synthetic polypeptide
DEEEIRTTNPVATEPYGSVCFTMSLTQIGGQNRI

SEQ ID NO: 82235 - protein, 35 aa, Artificial Sequence
  Description of Artificial Sequence: Synthetic polypeptide
DEEEIRTTNPVAYEQYGSTTSCTDVALSQRPGNNR

SEQ ID NO: 82236 - protein, 33 aa, Artificial Sequence
  Description of Artificial Sequence: Synthetic polypeptide
DEEEIRTTNPVATEQYGMVGSIDNLENGNGNGD

SEQ ID NO: 82237 - protein, 33 aa, Artificial Sequence
  Description of Artificial Sequence: Synthetic polypeptide
DEEEISTTNPVATEQYGQCVSTELQNFGSENQA

SEQ ID NO: 82238 - protein, 29 aa, Artificial Sequence
  Description of Artificial Sequence: Synthetic peptide
DENEIATTNPVATECYGDVSMCLQQQENH

SEQ ID NO: 82239 - protein, 33 aa, Artificial Sequence
  Description of Artificial Sequence: Synthetic polypeptide
DEEEISTTNPVATEQYGQCVSTELNQFFGSNQP

SEQ ID NO: 82240 - protein, 32 aa, Artificial Sequence
  Description of Artificial Sequence: Synthetic polypeptide
DEEEIRTTNPVATEQYGSVTTPDLQNDVEEET

SEQ ID NO: 82241 - protein, 34 aa, Artificial Sequence
  Description of Artificial Sequence: Synthetic polypeptide
DEEEISTTNPVATEQYGQCVCSTNSLQNFGSNQG

SEQ ID NO: 82242 - protein, 35 aa, Artificial Sequence
  Description of Artificial Sequence: Synthetic polypeptide
AEEEIRTTNPVATEQYGSVSTVTNLQQQGTNGEDD

SEQ ID NO: 82243 - protein, 33 aa, Artificial Sequence
  Description of Artificial Sequence: Synthetic polypeptide
DEEEISTTNPVATEQYGQCVCSTNLQNSNSNNQ

SEQ ID NO: 82244 - protein, 28 aa, Artificial Sequence
  Description of Artificial Sequence: Synthetic peptide
DENEIATTNPVATECYGDVSNCIQHEQR

SEQ ID NO: 82245 - protein, 34 aa, Artificial Sequence
  Description of Artificial Sequence: Synthetic polypeptide
DEEEIRTTNPVATEGYGSVSTMGDLEQTDIGNDG

SEQ ID NO: 82246 - protein, 28 aa, Artificial Sequence
  Description of Artificial Sequence: Synthetic peptide
YEEEIASVNPVCTECYGVVSDNLQSGNA

SEQ ID NO: 82247 - protein, 31 aa, Artificial Sequence
  Description of Artificial Sequence: Synthetic polypeptide
SEEEIACTNPVATEMYGSVATNLERPGDNTP

SEQ ID NO: 82248 - protein, 32 aa, Artificial Sequence
  Description of Artificial Sequence: Synthetic polypeptide
DEEEIRATNPVTTEQYGSVATNLNNNQQGTTE

SEQ ID NO: 82249 - protein, 28 aa, Artificial Sequence
  Description of Artificial Sequence: Synthetic peptide
YEEEIASVNPVCTECYGVVSDNLQSGNQ

SEQ ID NO: 82250 - protein, 34 aa, Artificial Sequence
  Description of Artificial Sequence: Synthetic polypeptide
DEEEIRTTNPVATEQYGMVGSILNLDEQGNGNGV

SEQ ID NO: 82251 - protein, 34 aa, Artificial Sequence
  Description of Artificial Sequence: Synthetic polypeptide
DEEEIRTTNPVATEGYGSVSTMGDLEQTEGGNNT

SEQ ID NO: 82252 - protein, 33 aa, Artificial Sequence
  Description of Artificial Sequence: Synthetic polypeptide
DEEEIRTTNPVATEQYGMVGSIGNLDEGNGNED

SEQ ID NO: 82253 - protein, 35 aa, Artificial Sequence
  Description of Artificial Sequence: Synthetic polypeptide
YEEEIRTTNPVATEQYGGVPSTPNGLPQLRHGDNY

SEQ ID NO: 82254 - protein, 31 aa, Artificial Sequence
  Description of Artificial Sequence: Synthetic polypeptide
QESEIRTTNPVATEQWGSVSCINEPQREENG

SEQ ID NO: 82255 - protein, 31 aa, Artificial Sequence
  Description of Artificial Sequence: Synthetic polypeptide
QESEIRTTNPVATEQWGSVSEIVEPQDRGNG

SEQ ID NO: 82256 - protein, 33 aa, Artificial Sequence
  Description of Artificial Sequence: Synthetic polypeptide
DENEIATTNPVATECYGSVSEINEPQDREGENR

SEQ ID NO: 82257 - protein, 28 aa, Artificial Sequence
  Description of Artificial Sequence: Synthetic peptide
YEEEIASVNPVCTEHYGVVSMNLQSGNQ

SEQ ID NO: 82258 - protein, 28 aa, Artificial Sequence
  Description of Artificial Sequence: Synthetic peptide
YEEEIASVNPVCTEIYGVVSDNLQSGNQ

SEQ ID NO: 82259 - protein, 30 aa, Artificial Sequence
  Description of Artificial Sequence: Synthetic polypeptide
DENEIRTTNPVATEQWGDVSTDLMDAAGEA

SEQ ID NO: 82260 - protein, 31 aa, Artificial Sequence
  Description of Artificial Sequence: Synthetic polypeptide
YETEIRTTNPVATEEYGMVSQTNGVQRAGEN

SEQ ID NO: 82261 - protein, 34 aa, Artificial Sequence
  Description of Artificial Sequence: Synthetic polypeptide
DEEEIRTTNPVATEGYGSVSTMNLDQLEGGGDDE

SEQ ID NO: 82262 - protein, 31 aa, Artificial Sequence
  Description of Artificial Sequence: Synthetic polypeptide
DEEEISTTNPVATEQYGCVSWNHQSFGSEQG

SEQ ID NO: 82263 - protein, 34 aa, Artificial Sequence
  Description of Artificial Sequence: Synthetic polypeptide
DEEEIRTTNPVATEQYGMVGSTLNGLEEGNGNGV

SEQ ID NO: 82264 - protein, 32 aa, Artificial Sequence
  Description of Artificial Sequence: Synthetic polypeptide
DEEEISTTNPVATEQYGCVSWGNHQNFGSNDG

SEQ ID NO: 82265 - protein, 34 aa, Artificial Sequence
  Description of Artificial Sequence: Synthetic polypeptide
DEEEIRTTNPVATEQYGSVSWTMTELRQGMNEDN

SEQ ID NO: 82266 - protein, 33 aa, Artificial Sequence
  Description of Artificial Sequence: Synthetic polypeptide
DEEEIRTTNPVSTEQYGSVTPFTNLQEVMGQTS

SEQ ID NO: 82267 - protein, 34 aa, Artificial Sequence
  Description of Artificial Sequence: Synthetic polypeptide
DEEEIRTTNPVATEQYGMVGSTLNGMEQGNGNGV

SEQ ID NO: 82268 - protein, 32 aa, Artificial Sequence
  Description of Artificial Sequence: Synthetic polypeptide
CEEEIRTTNPVATETYGVCVISTNLDQFPLNQ

SEQ ID NO: 82269 - protein, 33 aa, Artificial Sequence
  Description of Artificial Sequence: Synthetic polypeptide
DEAEICTTNPVATEQWGEVSTNLQAGNAGENDR

SEQ ID NO: 82270 - protein, 28 aa, Artificial Sequence
  Description of Artificial Sequence: Synthetic peptide
YEEEIASVNPVCTEKYGVVSDNLQSGNQ

SEQ ID NO: 82271 - protein, 34 aa, Artificial Sequence
  Description of Artificial Sequence: Synthetic polypeptide
AEEEIRTTNPVATEQYGSVSTTNQQLQQNNEQGN

SEQ ID NO: 82272 - protein, 31 aa, Artificial Sequence
  Description of Artificial Sequence: Synthetic polypeptide
DEEEIRTTNPVATEQYGSCSPWDNQESENPQ

SEQ ID NO: 82273 - protein, 34 aa, Artificial Sequence
  Description of Artificial Sequence: Synthetic polypeptide
AEEEIRTTNPVATEQYGSVSTTNQQLQSNENISE

SEQ ID NO: 82274 - protein, 34 aa, Artificial Sequence
  Description of Artificial Sequence: Synthetic polypeptide
AEEEIRTTNPVATEQYGSVSTTNQQNEQQGNQNE

SEQ ID NO: 82275 - protein, 34 aa, Artificial Sequence
  Description of Artificial Sequence: Synthetic polypeptide
DEEEIRTTNPVATEFYGYVSTVNLQDQGGEENDD

SEQ ID NO: 82276 - protein, 33 aa, Artificial Sequence
  Description of Artificial Sequence: Synthetic polypeptide
AEEEIRTTNPVATEQYGSVSTTNQQNNQTNDTD

SEQ ID NO: 82277 - protein, 32 aa, Artificial Sequence
  Description of Artificial Sequence: Synthetic polypeptide
CEEEIRTTNPVATEWYGHVSWTGLNREGQNDE

SEQ ID NO: 82278 - protein, 31 aa, Artificial Sequence
  Description of Artificial Sequence: Synthetic polypeptide
DENEIATTNPVATECYGSVSEINLQDREEEL

SEQ ID NO: 82279 - protein, 28 aa, Artificial Sequence
  Description of Artificial Sequence: Synthetic peptide
YGEEIASVNPVCTEQYGVVSDNLQSGNQ

SEQ ID NO: 82280 - protein, 34 aa, Artificial Sequence
  Description of Artificial Sequence: Synthetic polypeptide
DEEEIRTTNPVATEQYGSCSQTGNLEQQQNEEPL

SEQ ID NO: 82281 - protein, 32 aa, Artificial Sequence
  Description of Artificial Sequence: Synthetic polypeptide
QESEIRTTNPVATEQYGSVSASPTLQRNGDPV

SEQ ID NO: 82282 - protein, 32 aa, Artificial Sequence
  Description of Artificial Sequence: Synthetic polypeptide
DEEEIRTTNPVATEQYGSVSWTGVPEQEVTGS

SEQ ID NO: 82283 - protein, 33 aa, Artificial Sequence
  Description of Artificial Sequence: Synthetic polypeptide
DEEEIRTTNPVAYEQYGSTVHCTNALQITDSPR

SEQ ID NO: 82284 - protein, 34 aa, Artificial Sequence
  Description of Artificial Sequence: Synthetic polypeptide
DEEEIRTTNPVATEQYGSVYTVLMLEQADGDDRS

SEQ ID NO: 82285 - protein, 34 aa, Artificial Sequence
  Description of Artificial Sequence: Synthetic polypeptide
DEEEIRTTNPVATEQYGMVGSNTNGQGTGGENGN

SEQ ID NO: 82286 - protein, 33 aa, Artificial Sequence
  Description of Artificial Sequence: Synthetic polypeptide
DEEEIRTTNPVATEQYGSVYTVLMLEDADGDER

SEQ ID NO: 82287 - protein, 31 aa, Artificial Sequence
  Description of Artificial Sequence: Synthetic polypeptide
DEACIRTTNPVATEQYGCVCETNPQEYGSNQ

SEQ ID NO: 82288 - protein, 28 aa, Artificial Sequence
  Description of Artificial Sequence: Synthetic peptide
YEEEIASVNPVCTEGYGVVSDNLQSGNQ

SEQ ID NO: 82289 - protein, 28 aa, Artificial Sequence
  Description of Artificial Sequence: Synthetic peptide
YEVEIASVNPVCTEQYGVVSDNLQSGNQ

SEQ ID NO: 82290 - protein, 32 aa, Artificial Sequence
  Description of Artificial Sequence: Synthetic polypeptide
DEEEIRTTNPVATEQYGSVYTVDMVEQADGDE

SEQ ID NO: 82291 - protein, 33 aa, Artificial Sequence
  Description of Artificial Sequence: Synthetic polypeptide
DEEEIRTTNPVATEPYGSVCFTLNLTEIGGNPI

SEQ ID NO: 82292 - protein, 30 aa, Artificial Sequence
  Description of Artificial Sequence: Synthetic polypeptide
DEEEIRATNPVTTEQYGSVATNNNNQGIQT

SEQ ID NO: 82293 - protein, 33 aa, Artificial Sequence
  Description of Artificial Sequence: Synthetic polypeptide
DEEEIRTTNPVATEQYGMVGSTDLVGMGNGNED

SEQ ID NO: 82294 - protein, 32 aa, Artificial Sequence
  Description of Artificial Sequence: Synthetic polypeptide
DEEEIRTTNPVAYEQYGSTVHCTPALQTTDSR

SEQ ID NO: 82295 - protein, 33 aa, Artificial Sequence
  Description of Artificial Sequence: Synthetic polypeptide
DEEEIRTTNPVATEQYGSCSSTNIEQGEMIDNQ

SEQ ID NO: 82296 - protein, 31 aa, Artificial Sequence
  Description of Artificial Sequence: Synthetic polypeptide
YETEIRTTNPVATEQYGEVETGNLRQDGHEI

SEQ ID NO: 82297 - protein, 34 aa, Artificial Sequence
  Description of Artificial Sequence: Synthetic polypeptide
YEEEIRTTNPVATEQYGGVPSPPNLIQLREGNYG

SEQ ID NO: 82298 - protein, 28 aa, Artificial Sequence
  Description of Artificial Sequence: Synthetic peptide
YEEEIASVNPVCTEHYGVVSDNLQSGNQ

SEQ ID NO: 82299 - protein, 32 aa, Artificial Sequence
  Description of Artificial Sequence: Synthetic polypeptide
DEEEIRATNPVTTEQYGSVATNNNLQAGTTTT

SEQ ID NO: 82300 - protein, 28 aa, Artificial Sequence
  Description of Artificial Sequence: Synthetic peptide
YEEEIASVNPVCTEHYGVVSDNLQSGNV

SEQ ID NO: 82301 - protein, 32 aa, Artificial Sequence
  Description of Artificial Sequence: Synthetic polypeptide
DEEEIRSTNPVSTEQYGNVATTTIQSRNGNPR

SEQ ID NO: 82302 - protein, 35 aa, Artificial Sequence
  Description of Artificial Sequence: Synthetic polypeptide
AEEEIRTTNPVATEQYGSVSTTNQQLQQEGEQGNT

SEQ ID NO: 82303 - protein, 32 aa, Artificial Sequence
  Description of Artificial Sequence: Synthetic polypeptide
DEEEIRTTNPVAYEQWGMYTISPNEGQRDGNR

SEQ ID NO: 82304 - protein, 33 aa, Artificial Sequence
  Description of Artificial Sequence: Synthetic polypeptide
DEEEIRTTNPVAYEQWGKVSCTNWDQQAGGNPR

SEQ ID NO: 82305 - protein, 33 aa, Artificial Sequence
  Description of Artificial Sequence: Synthetic polypeptide
DENEIRTTNPVATEQYGSVSSTWNTQEEGSQEN

SEQ ID NO: 82306 - protein, 35 aa, Artificial Sequence
  Description of Artificial Sequence: Synthetic polypeptide
DEEEIRTTNPVAYEQYGSTCSCTSNALSQRPGNNE

SEQ ID NO: 82307 - protein, 28 aa, Artificial Sequence
  Description of Artificial Sequence: Synthetic peptide
YEEEIASVNPVCTDQYGVVSDNLQSGNQ

SEQ ID NO: 82308 - protein, 32 aa, Artificial Sequence
  Description of Artificial Sequence: Synthetic polypeptide
DEEEISTTNPVATEQYGSVCSTEHQNSGSDQP

SEQ ID NO: 82309 - protein, 32 aa, Artificial Sequence
  Description of Artificial Sequence: Synthetic polypeptide
DEEEIRTTNPVATEQYGMVGSGNGDGQEGGEQ

SEQ ID NO: 82310 - protein, 33 aa, Artificial Sequence
  Description of Artificial Sequence: Synthetic polypeptide
DEEEIRTTNPVATEQYGAVDSDDNNEQFEGNTN

SEQ ID NO: 82311 - protein, 33 aa, Artificial Sequence
  Description of Artificial Sequence: Synthetic polypeptide
DEEEIRTTNPVATEQYGMVGSGNLNGEDGGNEG

SEQ ID NO: 82312 - protein, 31 aa, Artificial Sequence
  Description of Artificial Sequence: Synthetic polypeptide
DEEEIRTTNPVATEGYGCFCSTNEQYFPSNQ

SEQ ID NO: 82313 - protein, 33 aa, Artificial Sequence
  Description of Artificial Sequence: Synthetic polypeptide
DEEEIRTCNPVATEQYGSVSTTGGQEGGNQEEI

SEQ ID NO: 82314 - protein, 33 aa, Artificial Sequence
  Description of Artificial Sequence: Synthetic polypeptide
DEEEIRTTNPVATEQYGSVSWPSVLQRVEEEEQ

SEQ ID NO: 82315 - protein, 33 aa, Artificial Sequence
  Description of Artificial Sequence: Synthetic polypeptide
DEEEIRTTNPVATEQYGMVGSGNLNINVGGNVF

SEQ ID NO: 82316 - protein, 33 aa, Artificial Sequence
  Description of Artificial Sequence: Synthetic polypeptide
DEEEIRTTNPVATEQYGMVGSGNLNIVGGGNVG

SEQ ID NO: 82317 - protein, 33 aa, Artificial Sequence
  Description of Artificial Sequence: Synthetic polypeptide
DEEEIRTTNPVATEQYGMVGSGNLNIVNGGNVQ

SEQ ID NO: 82318 - protein, 33 aa, Artificial Sequence
  Description of Artificial Sequence: Synthetic polypeptide
DEEEIRTTNPVATEQYGSVYYEVDLQHNISNQR

SEQ ID NO: 82319 - protein, 33 aa, Artificial Sequence
  Description of Artificial Sequence: Synthetic polypeptide
DEEEIRTTNPVATEQYGSVSWPYWNQLVENERD

SEQ ID NO: 82320 - protein, 32 aa, Artificial Sequence
  Description of Artificial Sequence: Synthetic polypeptide
DEEEIRTCNPVATEQYGSVSTGGQGGQDEQEE

SEQ ID NO: 82321 - protein, 32 aa, Artificial Sequence
  Description of Artificial Sequence: Synthetic polypeptide
DEEEIRTTNPVATEQYGMVGSGNMDQGGGEEQ

SEQ ID NO: 82322 - protein, 33 aa, Artificial Sequence
  Description of Artificial Sequence: Synthetic polypeptide
DEEEIRTTNPVATEGYGSVSTGGLGEMGGGNED

SEQ ID NO: 82323 - protein, 33 aa, Artificial Sequence
  Description of Artificial Sequence: Synthetic polypeptide
DEEEIRTTNPVATEQYGMVGSGNMDQGGGENTA

SEQ ID NO: 82324 - protein, 31 aa, Artificial Sequence
  Description of Artificial Sequence: Synthetic polypeptide
QESEIRTTNPVATEGWGSVSCNEPQREGENG

SEQ ID NO: 82325 - protein, 33 aa, Artificial Sequence
  Description of Artificial Sequence: Synthetic polypeptide
DEEEIRATNPVAYEQYGCTVSCTNTSQGGGNRL

SEQ ID NO: 82326 - protein, 33 aa, Artificial Sequence
  Description of Artificial Sequence: Synthetic polypeptide
DEEEIRTTNPVATEQYGMVGSGNMDQNEGGNDG

SEQ ID NO: 82327 - protein, 28 aa, Artificial Sequence
  Description of Artificial Sequence: Synthetic peptide
DENEIATTNPVATECYGDVSEDLQHEEL

SEQ ID NO: 82328 - protein, 32 aa, Artificial Sequence
  Description of Artificial Sequence: Synthetic polypeptide
QESEIRTTNPVATEGWGSVSCNLPQDREGENG

SEQ ID NO: 82329 - protein, 30 aa, Artificial Sequence
  Description of Artificial Sequence: Synthetic polypeptide
YEEEIRTTNPVATEQYGICGSHELQRMSES

SEQ ID NO: 82330 - protein, 33 aa, Artificial Sequence
  Description of Artificial Sequence: Synthetic polypeptide
DEEEIRTTNPVATEQYGAVDSDGGNQGQEGGNG

SEQ ID NO: 82331 - protein, 29 aa, Artificial Sequence
  Description of Artificial Sequence: Synthetic peptide
DENEIATTNPVATECYGDVSECLQSHEQR

SEQ ID NO: 82332 - protein, 30 aa, Artificial Sequence
  Description of Artificial Sequence: Synthetic polypeptide
YEEEIASVNPVATEQYGVVSTTNGQSGNPQ

SEQ ID NO: 82333 - protein, 34 aa, Artificial Sequence
  Description of Artificial Sequence: Synthetic polypeptide
AEEEIRTTNPVATEQYGSVSTTNQNQQNEGNNED

SEQ ID NO: 82334 - protein, 29 aa, Artificial Sequence
  Description of Artificial Sequence: Synthetic peptide
DENEIATTNPVATECYGDVSECLQHEGEL

SEQ ID NO: 82335 - protein, 31 aa, Artificial Sequence
  Description of Artificial Sequence: Synthetic polypeptide
QESEIRTTNPVATECYGSVSEINLQREEEEL

SEQ ID NO: 82336 - protein, 32 aa, Artificial Sequence
  Description of Artificial Sequence: Synthetic polypeptide
DEEEIRTTNPVAYEQYGSQSGNILSTDEEPNR

SEQ ID NO: 82337 - protein, 28 aa, Artificial Sequence
  Description of Artificial Sequence: Synthetic peptide
DENEIATTNPVATECYGDVSECLQHEQL

SEQ ID NO: 82338 - protein, 33 aa, Artificial Sequence
  Description of Artificial Sequence: Synthetic polypeptide
DEEEIRTTNPVATEQYGMVGSDNLNGEGNGNGE

SEQ ID NO: 82339 - protein, 28 aa, Artificial Sequence
  Description of Artificial Sequence: Synthetic peptide
DENEIATTNPVATECYGDVSECLQHERL

SEQ ID NO: 82340 - protein, 29 aa, Artificial Sequence
  Description of Artificial Sequence: Synthetic peptide
YEEEIASVNPVATEQYGVVSTALNSGMNQ

SEQ ID NO: 82341 - protein, 33 aa, Artificial Sequence
  Description of Artificial Sequence: Synthetic polypeptide
DEEEISTTNPVATEQYGSVCSTMELQSFGSDQV

SEQ ID NO: 82342 - protein, 30 aa, Artificial Sequence
  Description of Artificial Sequence: Synthetic polypeptide
YPEEIRCTNPVATEEYGAVSTVNAQKIGER

SEQ ID NO: 82343 - protein, 28 aa, Artificial Sequence
  Description of Artificial Sequence: Synthetic peptide
YEEEIASVNPVCCEQYGVVSDNLQSGNQ

SEQ ID NO: 82344 - protein, 36 aa, Artificial Sequence
  Description of Artificial Sequence: Synthetic polypeptide
DEEEIRTTNPVAYEQYGSTASCTDNALSQRPGNNRH

SEQ ID NO: 82345 - protein, 33 aa, Artificial Sequence
  Description of Artificial Sequence: Synthetic polypeptide
DEEEIRTTNPVAYEQWGEVVRQTNDHLQRGDRR

SEQ ID NO: 82346 - protein, 34 aa, Artificial Sequence
  Description of Artificial Sequence: Synthetic polypeptide
DEEEIRTTNPVATEQYGMVGSDTDNGQGEGEENG

SEQ ID NO: 82347 - protein, 33 aa, Artificial Sequence
  Description of Artificial Sequence: Synthetic polypeptide
DEEEIRTTNPVATEQYGMVGSDTDNGQGEGEGD

SEQ ID NO: 82348 - protein, 33 aa, Artificial Sequence
  Description of Artificial Sequence: Synthetic polypeptide
DEEEIRTTNPVATEQYGMVGSDTDNGQTEGGEQ

SEQ ID NO: 82349 - protein, 33 aa, Artificial Sequence
  Description of Artificial Sequence: Synthetic polypeptide
DEEEIRTTNPVATEQYGAVDSDLNMQEGGGNDG

SEQ ID NO: 82350 - protein, 33 aa, Artificial Sequence
  Description of Artificial Sequence: Synthetic polypeptide
DEEEIRTTNPVATEQYGSVSWPSVFLQRVELEQ

SEQ ID NO: 82351 - protein, 33 aa, Artificial Sequence
  Description of Artificial Sequence: Synthetic polypeptide
DEEEIRTTNPVATEPYGSVCFTNLETPEGGENE

SEQ ID NO: 82352 - protein, 35 aa, Artificial Sequence
  Description of Artificial Sequence: Synthetic polypeptide
DEEEIRTTNPVAYEQYGSTCPSTDNALSQRPSNNR

SEQ ID NO: 82353 - protein, 31 aa, Artificial Sequence
  Description of Artificial Sequence: Synthetic polypeptide
YNEEISTTNPEATEQYGNVCSTSVLQGGKNR

SEQ ID NO: 82354 - protein, 30 aa, Artificial Sequence
  Description of Artificial Sequence: Synthetic polypeptide
SEEEIACTNPVATEGYGSVATNLQDQDGDM

SEQ ID NO: 82355 - protein, 30 aa, Artificial Sequence
  Description of Artificial Sequence: Synthetic polypeptide
DDSEIATTNPVSTEGYGNVSANTLQSRGQR

SEQ ID NO: 82356 - protein, 34 aa, Artificial Sequence
  Description of Artificial Sequence: Synthetic polypeptide
YEEEIRTTNPVATEQYGHVPSTPNLPQLRHGAEY

SEQ ID NO: 82357 - protein, 35 aa, Artificial Sequence
  Description of Artificial Sequence: Synthetic polypeptide
DEEEIRTTNPVAYEQYGSTCSCTDNATSQRPGNYR

SEQ ID NO: 82358 - protein, 33 aa, Artificial Sequence
  Description of Artificial Sequence: Synthetic polypeptide
DEEEIRTTNPVATEQYGSVYWFNEDQDIENVRI

SEQ ID NO: 82359 - protein, 28 aa, Artificial Sequence
  Description of Artificial Sequence: Synthetic peptide
YEEEIASVNPVCSEQYGVVSDNLQSGND

SEQ ID NO: 82360 - protein, 33 aa, Artificial Sequence
  Description of Artificial Sequence: Synthetic polypeptide
SEEEIRCTNPIATEQYGSVSENMLSMRTGGNNR

SEQ ID NO: 82361 - protein, 28 aa, Artificial Sequence
  Description of Artificial Sequence: Synthetic peptide
YEEEIASVNPVCSEQYGVVSDNLQSGNQ

SEQ ID NO: 82362 - protein, 28 aa, Artificial Sequence
  Description of Artificial Sequence: Synthetic peptide
DENEIATTNPVATECYGDVSEILQHEDL

SEQ ID NO: 82363 - protein, 28 aa, Artificial Sequence
  Description of Artificial Sequence: Synthetic peptide
DENEIATTNPVATECYGDVSEILQHEEA

SEQ ID NO: 82364 - protein, 36 aa, Artificial Sequence
  Description of Artificial Sequence: Synthetic polypeptide
DEEEIRTTNPVAYEQYGSTCSCTFNALSQRPGTNNR

SEQ ID NO: 82365 - protein, 34 aa, Artificial Sequence
  Description of Artificial Sequence: Synthetic polypeptide
DEEEIRTTNPVATEPYGSVCFTNALSTETGGNLR

SEQ ID NO: 82366 - protein, 33 aa, Artificial Sequence
  Description of Artificial Sequence: Synthetic polypeptide
DEEEIRTTNPVATEQYGSVYVEWSNLERGEMGQ

SEQ ID NO: 82367 - protein, 28 aa, Artificial Sequence
  Description of Artificial Sequence: Synthetic peptide
YEEEIASVNPVCSEQYGVVSDNLQSGTR

SEQ ID NO: 82368 - protein, 32 aa, Artificial Sequence
  Description of Artificial Sequence: Synthetic polypeptide
YKEDIRTTNPVATMQWYGSVLTNWLQRMGMER

SEQ ID NO: 82369 - protein, 34 aa, Artificial Sequence
  Description of Artificial Sequence: Synthetic polypeptide
AEEEIRTTNPVATEQYGSVSTVTNNANNQIGNTE

SEQ ID NO: 82370 - protein, 32 aa, Artificial Sequence
  Description of Artificial Sequence: Synthetic polypeptide
YGEEIRTTNVVSTEQYGSVGSATNLEARGNVS

SEQ ID NO: 82371 - protein, 32 aa, Artificial Sequence
  Description of Artificial Sequence: Synthetic polypeptide
DEEEIRTTNPVSTEQYGSVTPFTNLQEVEMQT

SEQ ID NO: 82372 - protein, 29 aa, Artificial Sequence
  Description of Artificial Sequence: Synthetic peptide
YEEEIASVNPVCSEQYGVVSTDNLQSGNQ

SEQ ID NO: 82373 - protein, 28 aa, Artificial Sequence
  Description of Artificial Sequence: Synthetic peptide
DENEIATTNPVATECYGDVSMCLQHEEL

SEQ ID NO: 82374 - protein, 33 aa, Artificial Sequence
  Description of Artificial Sequence: Synthetic polypeptide
DEEEIRTTNPVATEQYGSAGTGEPVRMGLNPRD

SEQ ID NO: 82375 - protein, 33 aa, Artificial Sequence
  Description of Artificial Sequence: Synthetic polypeptide
DEEEIRTTNPVSTEQYGSVTPFTNLQEVGQMTG

SEQ ID NO: 82376 - protein, 28 aa, Artificial Sequence
  Description of Artificial Sequence: Synthetic peptide
YEEEIASVNPVCTAQYGVVSDNLQSGNQ

SEQ ID NO: 82377 - protein, 28 aa, Artificial Sequence
  Description of Artificial Sequence: Synthetic peptide
YEEEIASVNPVCTCQYGVVSDNLQSGNQ

SEQ ID NO: 82378 - protein, 34 aa, Artificial Sequence
  Description of Artificial Sequence: Synthetic polypeptide
DEEEIRTTNPVATEGWGVTVSCTNALSSYRGGNR

SEQ ID NO: 82379 - protein, 34 aa, Artificial Sequence
  Description of Artificial Sequence: Synthetic polypeptide
DEEEIRTTNPVATEPYGSVCFTMSLTQRGFQNPI

SEQ ID NO: 82380 - protein, 33 aa, Artificial Sequence
  Description of Artificial Sequence: Synthetic polypeptide
DEEEIRTTNPVATEQYGSAGPTGVEQRMQVNER

SEQ ID NO: 82381 - protein, 28 aa, Artificial Sequence
  Description of Artificial Sequence: Synthetic peptide
YGEEIASVNPVCTEQYGVVSKNLQSGNQ

SEQ ID NO: 82382 - protein, 28 aa, Artificial Sequence
  Description of Artificial Sequence: Synthetic peptide
YEEEIASVNPVCTEAYGVVSDNLQSGNQ

SEQ ID NO: 82383 - protein, 32 aa, Artificial Sequence
  Description of Artificial Sequence: Synthetic polypeptide
DEEEIRTTNPVATEGYGSVNGQTDIQTGEGNG

SEQ ID NO: 82384 - protein, 33 aa, Artificial Sequence
  Description of Artificial Sequence: Synthetic polypeptide
YEEEIRTTNPVATEQYGQVVEPTENANQVEGNR

SEQ ID NO: 82385 - protein, 32 aa, Artificial Sequence
  Description of Artificial Sequence: Synthetic polypeptide
DEEEIRATNPVAYEQYGSVATNLQGAPAEGGD

SEQ ID NO: 82386 - protein, 31 aa, Artificial Sequence
  Description of Artificial Sequence: Synthetic polypeptide
QESEIRTTNPVATEGWGSVSCNLPQREGEDG

SEQ ID NO: 82387 - protein, 33 aa, Artificial Sequence
  Description of Artificial Sequence: Synthetic polypeptide
YNEEIRTTNPVATEQYGCVCSATSNSGTQDGNR

SEQ ID NO: 82388 - protein, 34 aa, Artificial Sequence
  Description of Artificial Sequence: Synthetic polypeptide
DENEIRTTNPVATEQYGSVSSTMPAIQNQQNGNV

SEQ ID NO: 82389 - protein, 35 aa, Artificial Sequence
  Description of Artificial Sequence: Synthetic polypeptide
DEEEISTTNPVATEQYGSVCSNTGNLQNFGSENQF

SEQ ID NO: 82390 - protein, 33 aa, Artificial Sequence
  Description of Artificial Sequence: Synthetic polypeptide
DEEEIRTTNPVSTEQYGSVTPFTNLQEVEGGQT

SEQ ID NO: 82391 - protein, 28 aa, Artificial Sequence
  Description of Artificial Sequence: Synthetic peptide
YEEEIASVNPVCDEQYGVVSDNLQSGNQ

SEQ ID NO: 82392 - protein, 34 aa, Artificial Sequence
  Description of Artificial Sequence: Synthetic polypeptide
DENEIRTTNPVATEQYGSVSSTMPAIPNQQNGNV

SEQ ID NO: 82393 - protein, 33 aa, Artificial Sequence
  Description of Artificial Sequence: Synthetic polypeptide
AEEEIRTTNPVATEQYGSVSTTNQNQQQNDNED

SEQ ID NO: 82394 - protein, 33 aa, Artificial Sequence
  Description of Artificial Sequence: Synthetic polypeptide
DEEEIRTTNPVATEQYGMVGSGNMNQAEGGNVQ

SEQ ID NO: 82395 - protein, 32 aa, Artificial Sequence
  Description of Artificial Sequence: Synthetic polypeptide
DEAEICTTNPVATEHYGSVSTPNGLGNDGMDR

SEQ ID NO: 82396 - protein, 34 aa, Artificial Sequence
  Description of Artificial Sequence: Synthetic polypeptide
DENEIRTTNPVATEQYGSVSSTMPAGPNQQNGNV

SEQ ID NO: 82397 - protein, 33 aa, Artificial Sequence
  Description of Artificial Sequence: Synthetic polypeptide
DEEEIRTTNPVATEQYGMVGSGNMNQEEGGNTG

SEQ ID NO: 82398 - protein, 33 aa, Artificial Sequence
  Description of Artificial Sequence: Synthetic polypeptide
DEEEIRTTNPVATEQYGMVGSGNMNQEGGNDGD

SEQ ID NO: 82399 - protein, 30 aa, Artificial Sequence
  Description of Artificial Sequence: Synthetic polypeptide
DENEIATTNPVATECYGDVSEICLQDRGEL

SEQ ID NO: 82400 - protein, 28 aa, Artificial Sequence
  Description of Artificial Sequence: Synthetic peptide
YEEEIASVNPVCFEQYGVVSDNLQSGNQ

SEQ ID NO: 82401 - protein, 34 aa, Artificial Sequence
  Description of Artificial Sequence: Synthetic polypeptide
DEEEISTTNPVATEQYGSVCSNTENLQYFGSEQQ

SEQ ID NO: 82402 - protein, 34 aa, Artificial Sequence
  Description of Artificial Sequence: Synthetic polypeptide
DEEEISTTNPVATEQYGSVCSNTELQNFGSNFIP

SEQ ID NO: 82403 - protein, 28 aa, Artificial Sequence
  Description of Artificial Sequence: Synthetic peptide
YMEEIASVNPVCTEQYGVVSDNLQSGNQ

SEQ ID NO: 82404 - protein, 29 aa, Artificial Sequence
  Description of Artificial Sequence: Synthetic peptide
DDSEIRCTNPVSTEQYGSVANTIQRVGQR

SEQ ID NO: 82405 - protein, 28 aa, Artificial Sequence
  Description of Artificial Sequence: Synthetic peptide
YEEEIASVNPVCHEQYGVVSDNLQSGNQ

SEQ ID NO: 82406 - protein, 31 aa, Artificial Sequence
  Description of Artificial Sequence: Synthetic polypeptide
DEEEIRTTNPVATEQYGSCSTDDMMNRVVQD

SEQ ID NO: 82407 - protein, 28 aa, Artificial Sequence
  Description of Artificial Sequence: Synthetic peptide
YNEEIASVNPVCTEQYGVVSDNLQSGNQ

SEQ ID NO: 82408 - protein, 29 aa, Artificial Sequence
  Description of Artificial Sequence: Synthetic peptide
YESEIATTNPVCTEQWGVVSDNLQDSGNQ

SEQ ID NO: 82409 - protein, 32 aa, Artificial Sequence
  Description of Artificial Sequence: Synthetic polypeptide
DEEEISTTNPVATEQYGCVSTELTNFGSENQS

SEQ ID NO: 82410 - protein, 34 aa, Artificial Sequence
  Description of Artificial Sequence: Synthetic polypeptide
AEEEIRTTNPVATEQYGSVSTTSNNNQDTGNISE

SEQ ID NO: 82411 - protein, 32 aa, Artificial Sequence
  Description of Artificial Sequence: Synthetic polypeptide
DEEEIRTTNPVATEGYGCSCSTMNEQYNSNQA

SEQ ID NO: 82412 - protein, 31 aa, Artificial Sequence
  Description of Artificial Sequence: Synthetic polypeptide
DENEIATTNPVATEQYGSVSSEPAGQHNGNL

SEQ ID NO: 82413 - protein, 30 aa, Artificial Sequence
  Description of Artificial Sequence: Synthetic polypeptide
SEEEIRCTNPIATEQYGSVCCENDMRSGNA

SEQ ID NO: 82414 - protein, 28 aa, Artificial Sequence
  Description of Artificial Sequence: Synthetic peptide
YEEEIASVNPVCTEQYGVVSDNLQSGLQ

SEQ ID NO: 82415 - protein, 28 aa, Artificial Sequence
  Description of Artificial Sequence: Synthetic peptide
YEEEIASVNPVCTEQYGVVSDNLQSGMQ

SEQ ID NO: 82416 - protein, 31 aa, Artificial Sequence
  Description of Artificial Sequence: Synthetic polypeptide
DEEEIRTTNPVSTEQYGSVTDNGQNGQGGQT

SEQ ID NO: 82417 - protein, 31 aa, Artificial Sequence
  Description of Artificial Sequence: Synthetic polypeptide
SEEEIRCTNPIATEQYGSVCCENDMRGDNER

SEQ ID NO: 82418 - protein, 31 aa, Artificial Sequence
  Description of Artificial Sequence: Synthetic polypeptide
DEEEIRTTNPVATEHYGAAHSTNSFQPINAF

SEQ ID NO: 82419 - protein, 29 aa, Artificial Sequence
  Description of Artificial Sequence: Synthetic peptide
YEEEIASVNPVCTEQYGVVSDNLQSGNDQ

SEQ ID NO: 82420 - protein, 31 aa, Artificial Sequence
  Description of Artificial Sequence: Synthetic polypeptide
DENEIATTNPVATEQYGSVSSNPNRNPPGQP

SEQ ID NO: 82421 - protein, 35 aa, Artificial Sequence
  Description of Artificial Sequence: Synthetic polypeptide
AEEEIRTTNPVATEQYGSVSTTVNNLQVGTTENEE

SEQ ID NO: 82422 - protein, 29 aa, Artificial Sequence
  Description of Artificial Sequence: Synthetic peptide
YEEEIASVNPVCTEQYGVVSDNLQSGNGI

SEQ ID NO: 82423 - protein, 29 aa, Artificial Sequence
  Description of Artificial Sequence: Synthetic peptide
YEEEIASVNPVCTEQYGVVSDNLQSGNGQ

SEQ ID NO: 82424 - protein, 28 aa, Artificial Sequence
  Description of Artificial Sequence: Synthetic peptide
YEEEIASVNPVCTEQYGVVSDNLQSGPF

SEQ ID NO: 82425 - protein, 29 aa, Artificial Sequence
  Description of Artificial Sequence: Synthetic peptide
YEEEIASVNPVCTEQYGVVSDNLQSGPND

SEQ ID NO: 82426 - protein, 28 aa, Artificial Sequence
  Description of Artificial Sequence: Synthetic peptide
YEEEIASVNPVCTEQYGVVSDNLQSGPQ

SEQ ID NO: 82427 - protein, 28 aa, Artificial Sequence
  Description of Artificial Sequence: Synthetic peptide
YEEEIASVNPVCTEQYGVVSDNLQSGQQ

SEQ ID NO: 82428 - protein, 28 aa, Artificial Sequence
  Description of Artificial Sequence: Synthetic peptide
YEEEIASVNPVCTEQYGVVSDNLQSGRQ

SEQ ID NO: 82429 - protein, 31 aa, Artificial Sequence
  Description of Artificial Sequence: Synthetic polypeptide
DEEEIRTTNPVSTEQYGSVTDNGQGGGQGEV

SEQ ID NO: 82430 - protein, 34 aa, Artificial Sequence
  Description of Artificial Sequence: Synthetic polypeptide
YEEEIRTTNPVATEQYGSVSSTDALPNMRNGMNV

SEQ ID NO: 82431 - protein, 33 aa, Artificial Sequence
  Description of Artificial Sequence: Synthetic polypeptide
DENEIATTNPVATEQYGSVSSTEPNGPNMRGNV

SEQ ID NO: 82432 - protein, 30 aa, Artificial Sequence
  Description of Artificial Sequence: Synthetic polypeptide
DENEIATTNPVATEQYGSVSEILMNHAGEL

SEQ ID NO: 82433 - protein, 30 aa, Artificial Sequence
  Description of Artificial Sequence: Synthetic polypeptide
DENEIATTNPVATEQYGSVSTCLEDHEEDL

SEQ ID NO: 82434 - protein, 33 aa, Artificial Sequence
  Description of Artificial Sequence: Synthetic polypeptide
DEEEIRTTNPVAYEQYGQSVSSGNDLFQNGSQQ

SEQ ID NO: 82435 - protein, 28 aa, Artificial Sequence
  Description of Artificial Sequence: Synthetic peptide
YEEEIASVNPVCTEQYGVVSDNLQSGKQ

SEQ ID NO: 82436 - protein, 32 aa, Artificial Sequence
  Description of Artificial Sequence: Synthetic polypeptide
DEEEIRTTNPVATEQWGSVSTPAENMRAGDPV

SEQ ID NO: 82437 - protein, 32 aa, Artificial Sequence
  Description of Artificial Sequence: Synthetic polypeptide
DEEEIRTTNPVATEQWGSVSTPAENMAAGDPV

SEQ ID NO: 82438 - protein, 32 aa, Artificial Sequence
  Description of Artificial Sequence: Synthetic polypeptide
DEEEIRTTNPVSTEQYGTVSMPAGQNQQNGNV

SEQ ID NO: 82439 - protein, 30 aa, Artificial Sequence
  Description of Artificial Sequence: Synthetic polypeptide
DENEIATTNPVATEQYGSVSEDLMDAAGDL

SEQ ID NO: 82440 - protein, 29 aa, Artificial Sequence
  Description of Artificial Sequence: Synthetic peptide
YEEEIASVNPVCTEQYGVVSDNLQSFGNQ

SEQ ID NO: 82441 - protein, 28 aa, Artificial Sequence
  Description of Artificial Sequence: Synthetic peptide
YEEEIASVNPVCTEQYGVVSDNLQSFNQ

SEQ ID NO: 82442 - protein, 32 aa, Artificial Sequence
  Description of Artificial Sequence: Synthetic polypeptide
YEEEIRTTNPVATEQYGSVNSTLTNTRFGTAN

SEQ ID NO: 82443 - protein, 28 aa, Artificial Sequence
  Description of Artificial Sequence: Synthetic peptide
DEEEIRCTNPVATENYGNVATPDEEGTL

SEQ ID NO: 82444 - protein, 28 aa, Artificial Sequence
  Description of Artificial Sequence: Synthetic peptide
YEEEIASVNPVCTEQYGVVSDNLQSFNW

SEQ ID NO: 82445 - protein, 33 aa, Artificial Sequence
  Description of Artificial Sequence: Synthetic polypeptide
DEEEIRTTNPVATEAYGYAVYHTNHQERGSNET

SEQ ID NO: 82446 - protein, 28 aa, Artificial Sequence
  Description of Artificial Sequence: Synthetic peptide
YEEEIASVNPVCTEQYGVVSDNLQSGAQ

SEQ ID NO: 82447 - protein, 28 aa, Artificial Sequence
  Description of Artificial Sequence: Synthetic peptide
YEEEIASVNPVCTEQYGVVSDNLQSGDI

SEQ ID NO: 82448 - protein, 33 aa, Artificial Sequence
  Description of Artificial Sequence: Synthetic polypeptide
YEEEIRTTNPVATEQYGAVSLNLQQVEFGVPQR

SEQ ID NO: 82449 - protein, 29 aa, Artificial Sequence
  Description of Artificial Sequence: Synthetic peptide
YEEEIASVNPVCTEQYGVVSDNLQSGDNQ

SEQ ID NO: 82450 - protein, 28 aa, Artificial Sequence
  Description of Artificial Sequence: Synthetic peptide
YEEEIASVNPVCTEQYGVVSDNLQSGDQ

SEQ ID NO: 82451 - protein, 28 aa, Artificial Sequence
  Description of Artificial Sequence: Synthetic peptide
YEEEIASVNPVCTEQYGVVSDNLQSGEQ

SEQ ID NO: 82452 - protein, 28 aa, Artificial Sequence
  Description of Artificial Sequence: Synthetic peptide
YEEEIASVNPVCTEQYGVVSDNLQSGFQ

SEQ ID NO: 82453 - protein, 29 aa, Artificial Sequence
  Description of Artificial Sequence: Synthetic peptide
YEEEIASVNPVCTEQYGVVSDNLQSGGNV

SEQ ID NO: 82454 - protein, 28 aa, Artificial Sequence
  Description of Artificial Sequence: Synthetic peptide
YEEEIASVNPVCTEQYGVVSDNLQSGGQ

SEQ ID NO: 82455 - protein, 28 aa, Artificial Sequence
  Description of Artificial Sequence: Synthetic peptide
YEEEIASVNPVCTEQYGVVSDNLQSGHQ

SEQ ID NO: 82456 - protein, 28 aa, Artificial Sequence
  Description of Artificial Sequence: Synthetic peptide
YEEEIASVNPVCTEQYGVVSDNLQSGIQ

SEQ ID NO: 82457 - protein, 30 aa, Artificial Sequence
  Description of Artificial Sequence: Synthetic polypeptide
DEEEIRTTNPVATECWGKHSTNDEQDRNDF

SEQ ID NO: 82458 - protein, 29 aa, Artificial Sequence
  Description of Artificial Sequence: Synthetic peptide
YEEEIASVNPVCTEQYGVVSDNLQSGSNQ

SEQ ID NO: 82459 - protein, 33 aa, Artificial Sequence
  Description of Artificial Sequence: Synthetic polypeptide
AEEEIRTTNPVATEQYGSVSTTVNNLVTENSED

SEQ ID NO: 82460 - protein, 30 aa, Artificial Sequence
  Description of Artificial Sequence: Synthetic polypeptide
DENEIATTNPVATEQYGSVSTDLEDHEEDL

SEQ ID NO: 82461 - protein, 32 aa, Artificial Sequence
  Description of Artificial Sequence: Synthetic polypeptide
DEEEISTTNPVATEQYGCVCSTNHQNFGSDQA

SEQ ID NO: 82462 - protein, 33 aa, Artificial Sequence
  Description of Artificial Sequence: Synthetic polypeptide
DEAEIRTTNCVAYDQYGSVSCTNISQRTGGDNR

SEQ ID NO: 82463 - protein, 32 aa, Artificial Sequence
  Description of Artificial Sequence: Synthetic polypeptide
DEAEIRTTNCVAYDQYGVVSCTNELSQRVGDR

SEQ ID NO: 82464 - protein, 33 aa, Artificial Sequence
  Description of Artificial Sequence: Synthetic polypeptide
DEEEIRTTNPVATEQYGSVSYNYLLDTGDEDKQ

SEQ ID NO: 82465 - protein, 30 aa, Artificial Sequence
  Description of Artificial Sequence: Synthetic polypeptide
DENEIATTNPVATEQYGSVSTIEENAAGDA

SEQ ID NO: 82466 - protein, 33 aa, Artificial Sequence
  Description of Artificial Sequence: Synthetic polypeptide
DENEIATTNPVATEQYGSVSTPNPQPQRTEGMN

SEQ ID NO: 82467 - protein, 33 aa, Artificial Sequence
  Description of Artificial Sequence: Synthetic polypeptide
YEEEIRTTNPVATEQYGAVNSLINLQQVEGVPR

SEQ ID NO: 82468 - protein, 28 aa, Artificial Sequence
  Description of Artificial Sequence: Synthetic peptide
YEEEIASVNPVCTEQYGVVSDNLQSHNQ

SEQ ID NO: 82469 - protein, 29 aa, Artificial Sequence
  Description of Artificial Sequence: Synthetic peptide
DEAEIRTTNGVAYCCYGSVSMELQRGEDS

SEQ ID NO: 82470 - protein, 29 aa, Artificial Sequence
  Description of Artificial Sequence: Synthetic peptide
YEQEIASVNPVCTEQYGVVSTNLQHEGNQ

SEQ ID NO: 82471 - protein, 28 aa, Artificial Sequence
  Description of Artificial Sequence: Synthetic peptide
YEEEIASVNPVCTEQYGVVSDNLQSINQ

SEQ ID NO: 82472 - protein, 32 aa, Artificial Sequence
  Description of Artificial Sequence: Synthetic polypeptide
DEEEIRTTNPVAYEQWGSVYSDDWDDQRSQNR

SEQ ID NO: 82473 - protein, 28 aa, Artificial Sequence
  Description of Artificial Sequence: Synthetic peptide
YEEEIASVNPVCTEQYGVVSDNLQSKNQ

SEQ ID NO: 82474 - protein, 32 aa, Artificial Sequence
  Description of Artificial Sequence: Synthetic polypeptide
DEEEIRTTNPVSTEQYGSVTDNGLQGGGGQGT

SEQ ID NO: 82475 - protein, 29 aa, Artificial Sequence
  Description of Artificial Sequence: Synthetic peptide
YEEEIASVNPVCTEQYGVVSDNLQSLGNQ

SEQ ID NO: 82476 - protein, 34 aa, Artificial Sequence
  Description of Artificial Sequence: Synthetic polypeptide
DEEEIRTTNPVATEQYGSVSYPMNENTVGSNVRE

SEQ ID NO: 82477 - protein, 33 aa, Artificial Sequence
  Description of Artificial Sequence: Synthetic polypeptide
DENEIRTTNPVATEQYGSVNTWPLNQLDGNEEE

SEQ ID NO: 82478 - protein, 34 aa, Artificial Sequence
  Description of Artificial Sequence: Synthetic polypeptide
DENEIRTTNPVATEQYGSVNSTNDSDVIGNNERE

SEQ ID NO: 82479 - protein, 33 aa, Artificial Sequence
  Description of Artificial Sequence: Synthetic polypeptide
DEEEIRTTNPVATEQYGSCNNTNDDERGQEIRS

SEQ ID NO: 82480 - protein, 32 aa, Artificial Sequence
  Description of Artificial Sequence: Synthetic polypeptide
SEEEIRCTNPIATEQYGSTVSENELSTGGGNR

SEQ ID NO: 82481 - protein, 28 aa, Artificial Sequence
  Description of Artificial Sequence: Synthetic peptide
YEEEIASVNPVCTEQYGVVSDNLQSLNQ

SEQ ID NO: 82482 - protein, 34 aa, Artificial Sequence
  Description of Artificial Sequence: Synthetic polypeptide
YEEEIRTTNPVATEQYGAVPQTPNLIQLRHGANY

SEQ ID NO: 82483 - protein, 34 aa, Artificial Sequence
  Description of Artificial Sequence: Synthetic polypeptide
DEEEIRTTNPVAYEQWGSVWTLDNDLQQRNDDNR

SEQ ID NO: 82484 - protein, 33 aa, Artificial Sequence
  Description of Artificial Sequence: Synthetic polypeptide
DEAEIRTTNPVATEQYGAVSTNLGAGNAGEDNA

SEQ ID NO: 82485 - protein, 32 aa, Artificial Sequence
  Description of Artificial Sequence: Synthetic polypeptide
DEEEISTTNPVATEQYGCVCSTNHQNFGSDTQ

SEQ ID NO: 82486 - protein, 33 aa, Artificial Sequence
  Description of Artificial Sequence: Synthetic polypeptide
DEEEIRTTNPVATEQWGSVSTEAGNMRNGMNPA

SEQ ID NO: 82487 - protein, 28 aa, Artificial Sequence
  Description of Artificial Sequence: Synthetic peptide
YEEEIASVNPVCTEQYGVVSDNLQSGSQ

SEQ ID NO: 82488 - protein, 29 aa, Artificial Sequence
  Description of Artificial Sequence: Synthetic peptide
YEEEIASVNPVCTEQYGVVSDNLQSGTNQ

SEQ ID NO: 82489 - protein, 33 aa, Artificial Sequence
  Description of Artificial Sequence: Synthetic polypeptide
DEEEIRTTNPVATEPYGSVPSCTNQSQRSQSDS

SEQ ID NO: 82490 - protein, 28 aa, Artificial Sequence
  Description of Artificial Sequence: Synthetic peptide
YEEEIASVNPVCTEQYGVVSDNLQSGTQ

SEQ ID NO: 82491 - protein, 32 aa, Artificial Sequence
  Description of Artificial Sequence: Synthetic polypeptide
YEEEIRTTNPVATEQYGAVSLCLQQVEGVTPR

SEQ ID NO: 82492 - protein, 33 aa, Artificial Sequence
  Description of Artificial Sequence: Synthetic polypeptide
DEEEIRTTNPVATEQYGQVTGNPEGQSREGVRH

SEQ ID NO: 82493 - protein, 31 aa, Artificial Sequence
  Description of Artificial Sequence: Synthetic polypeptide
DEEEIRTTNPVATEHYGATHSTNEIQPMNAF

SEQ ID NO: 82494 - protein, 31 aa, Artificial Sequence
  Description of Artificial Sequence: Synthetic polypeptide
DEEEIRCTNPVATEPYGTISMEDLQQQQGNR

SEQ ID NO: 82495 - protein, 31 aa, Artificial Sequence
  Description of Artificial Sequence: Synthetic polypeptide
DENEIATTNPVATEQYGSVSTDLEDHEGEDL

SEQ ID NO: 82496 - protein, 32 aa, Artificial Sequence
  Description of Artificial Sequence: Synthetic polypeptide
SEEEIRCTNPIATEQYGSVCSGENDDMRMGNR

SEQ ID NO: 82497 - protein, 31 aa, Artificial Sequence
  Description of Artificial Sequence: Synthetic polypeptide
YEQEIATTNPVATEQYGSVSADNLEDHGNDL

SEQ ID NO: 82498 - protein, 31 aa, Artificial Sequence
  Description of Artificial Sequence: Synthetic polypeptide
DEAEIRTTNCVAYCQYGSVSVTELQRGVDVD

SEQ ID NO: 82499 - protein, 33 aa, Artificial Sequence
  Description of Artificial Sequence: Synthetic polypeptide
DEEEIRTTNPVAYEQYGQSVSSGNDHDQRGSQQ

SEQ ID NO: 82500 - protein, 31 aa, Artificial Sequence
  Description of Artificial Sequence: Synthetic polypeptide
SEEEIRCTNPIATEQYGSTWSNENLMERGNI

SEQ ID NO: 82501 - protein, 35 aa, Artificial Sequence
  Description of Artificial Sequence: Synthetic polypeptide
DEEEIRTTNPVATEQWGSVSTCPNEPQDREGENPG

SEQ ID NO: 82502 - protein, 28 aa, Artificial Sequence
  Description of Artificial Sequence: Synthetic peptide
YEEEIASVNPVCTEQYGVVSDNLQSGWQ

SEQ ID NO: 82503 - protein, 31 aa, Artificial Sequence
  Description of Artificial Sequence: Synthetic polypeptide
SEEEIACTNPVATEQYGSVATNDQAGGMNDM

SEQ ID NO: 82504 - protein, 28 aa, Artificial Sequence
  Description of Artificial Sequence: Synthetic peptide
YEEEIASVNPVCTEQYGVVSDNLQSGYQ

SEQ ID NO: 82505 - protein, 32 aa, Artificial Sequence
  Description of Artificial Sequence: Synthetic polypeptide
SEEEIRCTNPIATEQYGSTVWSNEENLMRGPR

SEQ ID NO: 82506 - protein, 29 aa, Artificial Sequence
  Description of Artificial Sequence: Synthetic peptide
YEEEIASVNPVCTEQYGVVSDNLQSHGNQ

SEQ ID NO: 82507 - protein, 30 aa, Artificial Sequence
  Description of Artificial Sequence: Synthetic polypeptide
DENEIRTTNPVATEQYGSVQTALILEVEQD

SEQ ID NO: 82508 - protein, 28 aa, Artificial Sequence
  Description of Artificial Sequence: Synthetic peptide
YEEEIASVNPVCTEQYGVVSDNLQSGVQ

SEQ ID NO: 82509 - protein, 28 aa, Artificial Sequence
  Description of Artificial Sequence: Synthetic peptide
YEEEIASVNPVCTEQYGVVSDNLQSENT

SEQ ID NO: 82510 - protein, 32 aa, Artificial Sequence
  Description of Artificial Sequence: Synthetic polypeptide
CEEEISTTNPVATEQYGCVCSNTELQNGSDRS

SEQ ID NO: 82511 - protein, 30 aa, Artificial Sequence
  Description of Artificial Sequence: Synthetic polypeptide
DEEEIRTTNPVATEGYGSISDLTSTWGVER

SEQ ID NO: 82512 - protein, 33 aa, Artificial Sequence
  Description of Artificial Sequence: Synthetic polypeptide
DEEEISTTNPVATEQYGCVCSTNLQENFGSQQA

SEQ ID NO: 82513 - protein, 33 aa, Artificial Sequence
  Description of Artificial Sequence: Synthetic polypeptide
DEEEIRTTNPVATEGYGVVSGTNNGQDINGNAT

SEQ ID NO: 82514 - protein, 34 aa, Artificial Sequence
  Description of Artificial Sequence: Synthetic polypeptide
DEEEIRTTNPVAYEQYGVVQSCTNQSQARGGMNN

SEQ ID NO: 82515 - protein, 33 aa, Artificial Sequence
  Description of Artificial Sequence: Synthetic polypeptide
DEEEIRTTNPVATEGYGVVSTMTNFGQGEGNQG

SEQ ID NO: 82516 - protein, 29 aa, Artificial Sequence
  Description of Artificial Sequence: Synthetic peptide
YEEEIASVNPVCTEQYGVVSDNLQNSGNQ

SEQ ID NO: 82517 - protein, 30 aa, Artificial Sequence
  Description of Artificial Sequence: Synthetic polypeptide
SEEEIACTNPVATEQYGSVATADQRGEPTA

SEQ ID NO: 82518 - protein, 33 aa, Artificial Sequence
  Description of Artificial Sequence: Synthetic polypeptide
DEEEIRTTNPVATEQYGSVYLTNLGGLGEVDQA

SEQ ID NO: 82519 - protein, 35 aa, Artificial Sequence
  Description of Artificial Sequence: Synthetic polypeptide
AEEEIRTTNPVATEQYGSVSTTVNLQAGTTENSEQ

SEQ ID NO: 82520 - protein, 29 aa, Artificial Sequence
  Description of Artificial Sequence: Synthetic peptide
YEEEIASVNPVCTEQYGVVSDNLQSAGNQ

SEQ ID NO: 82521 - protein, 35 aa, Artificial Sequence
  Description of Artificial Sequence: Synthetic polypeptide
AEEEIRTTNPVATEQYGSVSTTVNLQEGTTENNEA

SEQ ID NO: 82522 - protein, 35 aa, Artificial Sequence
  Description of Artificial Sequence: Synthetic polypeptide
AEEEIRTTNPVATEQYGSVSTTVNLQENNQGNNGQ

SEQ ID NO: 82523 - protein, 35 aa, Artificial Sequence
  Description of Artificial Sequence: Synthetic polypeptide
AEEEIRTTNPVATEQYGSVSTTVNLQNNSNGTNVE

SEQ ID NO: 82524 - protein, 35 aa, Artificial Sequence
  Description of Artificial Sequence: Synthetic polypeptide
AEEEIRTTNPVATEQYGSVSTTVNLQQIGNNNVTE

SEQ ID NO: 82525 - protein, 33 aa, Artificial Sequence
  Description of Artificial Sequence: Synthetic polypeptide
DEEEIRTTNPVAYEQYGWVPFCTNPSQRNGTND

SEQ ID NO: 82526 - protein, 28 aa, Artificial Sequence
  Description of Artificial Sequence: Synthetic peptide
SEEEIACTNPIATEQYGSAPENCQHGNK

SEQ ID NO: 82527 - protein, 31 aa, Artificial Sequence
  Description of Artificial Sequence: Synthetic polypeptide
DEAEIRTTNPVATEQYGSCSTDWMQHGSEDM

SEQ ID NO: 82528 - protein, 35 aa, Artificial Sequence
  Description of Artificial Sequence: Synthetic polypeptide
AEEEIRTTNPVATEQYGSVSTTVNLQSGTVNTTAG

SEQ ID NO: 82529 - protein, 33 aa, Artificial Sequence
  Description of Artificial Sequence: Synthetic polypeptide
DEEEIRTTNPVATEFYGVVSTMTNFGQGEGGNQ

SEQ ID NO: 82530 - protein, 34 aa, Artificial Sequence
  Description of Artificial Sequence: Synthetic polypeptide
DEEEIRTTNPVATEQWGSVSVTGNMLSQRVTEDM

SEQ ID NO: 82531 - protein, 33 aa, Artificial Sequence
  Description of Artificial Sequence: Synthetic polypeptide
AEEEIRTTNPVATEQYGSVSTTVNLVGNEENSE

SEQ ID NO: 82532 - protein, 28 aa, Artificial Sequence
  Description of Artificial Sequence: Synthetic peptide
YEEEIASVNPVCTEQYGVVSDNLQSANQ

SEQ ID NO: 82533 - protein, 33 aa, Artificial Sequence
  Description of Artificial Sequence: Synthetic polypeptide
DEEEIRTTNPVATEQYGQVVCSTGNHQGFGSDQ

SEQ ID NO: 82534 - protein, 33 aa, Artificial Sequence
  Description of Artificial Sequence: Synthetic polypeptide
DEEEIRTTNPVATEQYGSVYLTNQGQERDQVID

SEQ ID NO: 82535 - protein, 33 aa, Artificial Sequence
  Description of Artificial Sequence: Synthetic polypeptide
DEEEIRTTNPVAYEQWGSVCSCTNQSQRGTPAT

SEQ ID NO: 82536 - protein, 33 aa, Artificial Sequence
  Description of Artificial Sequence: Synthetic polypeptide
DEEEIRTTNPVATEQYGQVVCSTNHQYFGSDQT

SEQ ID NO: 82537 - protein, 32 aa, Artificial Sequence
  Description of Artificial Sequence: Synthetic polypeptide
YEEEIRTTNPVATEQYGAVSLVNEQQVEGVPR

SEQ ID NO: 82538 - protein, 31 aa, Artificial Sequence
  Description of Artificial Sequence: Synthetic polypeptide
DENEIATTNPVATEQYGSVSAEDLQDHGEDL

SEQ ID NO: 82539 - protein, 29 aa, Artificial Sequence
  Description of Artificial Sequence: Synthetic peptide
YEEEIASVNPVCTEQYGVVSDNLQGSGNG

SEQ ID NO: 82540 - protein, 32 aa, Artificial Sequence
  Description of Artificial Sequence: Synthetic polypeptide
DEEEIRTTNPVATEQYGSVYPANEQEVQVANN

SEQ ID NO: 82541 - protein, 32 aa, Artificial Sequence
  Description of Artificial Sequence: Synthetic polypeptide
SEEEIACTNPIATEQYGSTVSENLSTRGGNNR

SEQ ID NO: 82542 - protein, 29 aa, Artificial Sequence
  Description of Artificial Sequence: Synthetic peptide
YEEEIASVNPVCTEQYGVVSDNLQGSGNQ

SEQ ID NO: 82543 - protein, 28 aa, Artificial Sequence
  Description of Artificial Sequence: Synthetic peptide
YEEEIASVNPVCTEQYGVVSDNLQHNNQ

SEQ ID NO: 82544 - protein, 33 aa, Artificial Sequence
  Description of Artificial Sequence: Synthetic polypeptide
DEEEIRTTNPVAYEQYGVVQSCENNSQRGGMNA

SEQ ID NO: 82545 - protein, 34 aa, Artificial Sequence
  Description of Artificial Sequence: Synthetic polypeptide
DEEEIRTTNPVAYEQYGVVQSCTNNSQARGTMNS

SEQ ID NO: 82546 - protein, 34 aa, Artificial Sequence
  Description of Artificial Sequence: Synthetic polypeptide
DEEEIRTTNPVATEQYGSVYNTNDMNERNESNQR

SEQ ID NO: 82547 - protein, 30 aa, Artificial Sequence
  Description of Artificial Sequence: Synthetic polypeptide
YEQEIATTNPVATEQYGSVSTDLEDSEGEQ

SEQ ID NO: 82548 - protein, 33 aa, Artificial Sequence
  Description of Artificial Sequence: Synthetic polypeptide
DEEEIRTTNPVATEQWGSVTSTDLQNHDDGTGN

SEQ ID NO: 82549 - protein, 31 aa, Artificial Sequence
  Description of Artificial Sequence: Synthetic polypeptide
DENEIRTTNPVATEQYGSVSAEILENAEGDL

SEQ ID NO: 82550 - protein, 31 aa, Artificial Sequence
  Description of Artificial Sequence: Synthetic polypeptide
DENEIATTNPVATEQYGSVSANPDNRNPNPP

SEQ ID NO: 82551 - protein, 35 aa, Artificial Sequence
  Description of Artificial Sequence: Synthetic polypeptide
AEEEIRTTNPVATEQYGSVSTTVNLEEQGNGTNDE

SEQ ID NO: 82552 - protein, 34 aa, Artificial Sequence
  Description of Artificial Sequence: Synthetic polypeptide
AEEEIRTTNPVATEQYGSVSTVTTNNNQQGTNVE

SEQ ID NO: 82553 - protein, 30 aa, Artificial Sequence
  Description of Artificial Sequence: Synthetic polypeptide
YEQEIATVNPVCTEQYGSVSATNLQDHGEQ

SEQ ID NO: 82554 - protein, 31 aa, Artificial Sequence
  Description of Artificial Sequence: Synthetic polypeptide
DENEIATTNPVATEQYGSVSATCLEDHEGEL

SEQ ID NO: 82555 - protein, 30 aa, Artificial Sequence
  Description of Artificial Sequence: Synthetic polypeptide
YEQEIATVNPVCTEQYGSVSATNLQDHGEL

SEQ ID NO: 82556 - protein, 30 aa, Artificial Sequence
  Description of Artificial Sequence: Synthetic polypeptide
YEQEIATTNPVCTEQYGVVSTNLEHEGNDL

SEQ ID NO: 82557 - protein, 31 aa, Artificial Sequence
  Description of Artificial Sequence: Synthetic polypeptide
DENEIATTNPVATEQYGSVSATCLEDHGEDL

SEQ ID NO: 82558 - protein, 34 aa, Artificial Sequence
  Description of Artificial Sequence: Synthetic polypeptide
DEEEIRTTNPVATEQYGSVYLTPNQHQQRDEGDG

SEQ ID NO: 82559 - protein, 33 aa, Artificial Sequence
  Description of Artificial Sequence: Synthetic polypeptide
DEAEIRTTNPVATEQYGSCVTTNLEGRGDESFF

SEQ ID NO: 82560 - protein, 33 aa, Artificial Sequence
  Description of Artificial Sequence: Synthetic polypeptide
DEEEIRTTNPVAYEQWGSVYSDTHDGQRSQNTR

SEQ ID NO: 82561 - protein, 28 aa, Artificial Sequence
  Description of Artificial Sequence: Synthetic peptide
YEEEIASVNPVCTEQYGVVSDNLQSCNQ

SEQ ID NO: 82562 - protein, 31 aa, Artificial Sequence
  Description of Artificial Sequence: Synthetic polypeptide
DENEIATTNPVATEQYGSVSATDLEHEGEDL

SEQ ID NO: 82563 - protein, 33 aa, Artificial Sequence
  Description of Artificial Sequence: Synthetic polypeptide
DEEEIRTTNPVATEQWGSVSTTPAEPNMANGNV

SEQ ID NO: 82564 - protein, 33 aa, Artificial Sequence
  Description of Artificial Sequence: Synthetic polypeptide
DEEEIRTTNPVATEQYGSVSYNNLASNNLLEVQ

SEQ ID NO: 82565 - protein, 33 aa, Artificial Sequence
  Description of Artificial Sequence: Synthetic polypeptide
DEEEIRTTNPVATEQYGSVSYNNLASNQNILVT

SEQ ID NO: 82566 - protein, 33 aa, Artificial Sequence
  Description of Artificial Sequence: Synthetic polypeptide
YEEEIRTTNPVATEQYGAVSLQNLQQVEQGVPR

SEQ ID NO: 82567 - protein, 31 aa, Artificial Sequence
  Description of Artificial Sequence: Synthetic polypeptide
DENEIATTNPVATEQYGSVSATILEDHEGEL

SEQ ID NO: 82568 - protein, 32 aa, Artificial Sequence
  Description of Artificial Sequence: Synthetic polypeptide
SEEEIRCTNPIATEQYGSVCSGENHDMRGNTR

SEQ ID NO: 82569 - protein, 32 aa, Artificial Sequence
  Description of Artificial Sequence: Synthetic polypeptide
SEEEIRCTNPIATEQYGSVCSGENDMSRGNNR

SEQ ID NO: 82570 - protein, 32 aa, Artificial Sequence
  Description of Artificial Sequence: Synthetic polypeptide
DEEEIRTTNPVSTEQYGTVSMPAGQNQQNGNH

SEQ ID NO: 82571 - protein, 32 aa, Artificial Sequence
  Description of Artificial Sequence: Synthetic polypeptide
DEEEIRTTNPVAYERWGTSVSRNDDDQRGIRR

SEQ ID NO: 82572 - protein, 32 aa, Artificial Sequence
  Description of Artificial Sequence: Synthetic polypeptide
DEEEIRTTNPVATEFYGVVSGTDGGQNDGNED

SEQ ID NO: 82573 - protein, 32 aa, Artificial Sequence
  Description of Artificial Sequence: Synthetic polypeptide
SEEEIRCTNPIATEQYGSVCSGENDMRHGGNR

SEQ ID NO: 82574 - protein, 31 aa, Artificial Sequence
  Description of Artificial Sequence: Synthetic polypeptide
SEEEIRCTNPIATEQYGSVCSGENDMRDVNR

SEQ ID NO: 82575 - protein, 32 aa, Artificial Sequence
  Description of Artificial Sequence: Synthetic polypeptide
SEEEIRCTNPIATEQYGSVCSGENDMHRDGNR

SEQ ID NO: 82576 - protein, 33 aa, Artificial Sequence
  Description of Artificial Sequence: Synthetic polypeptide
DEEEIRTTNPVATEQWGSVSTTIENNAAGMNPA

SEQ ID NO: 82577 - protein, 33 aa, Artificial Sequence
  Description of Artificial Sequence: Synthetic polypeptide
DEAEIRTTNPVATEQYGAVSTNLGAGNAGENSQ

SEQ ID NO: 82578 - protein, 31 aa, Artificial Sequence
  Description of Artificial Sequence: Synthetic polypeptide
DEEEIRTTNPVATEQYGQVTQGLQDGSQLAT

SEQ ID NO: 82579 - protein, 32 aa, Artificial Sequence
  Description of Artificial Sequence: Synthetic polypeptide
DEEEIRTTNPVAYEQWGSVVSVTGNMLQNVEN

SEQ ID NO: 82580 - protein, 31 aa, Artificial Sequence
  Description of Artificial Sequence: Synthetic polypeptide
DEEEIRTTNPVSTEQYGSVTDNNGQEGGGQT

SEQ ID NO: 82581 - protein, 32 aa, Artificial Sequence
  Description of Artificial Sequence: Synthetic polypeptide
DEEEISTTNPVATEQYGCVCSTNHQSIGSEQG

SEQ ID NO: 82582 - protein, 28 aa, Artificial Sequence
  Description of Artificial Sequence: Synthetic peptide
YEEEIASVNPVCTEQYGVVSDNLQSENQ

SEQ ID NO: 82583 - protein, 34 aa, Artificial Sequence
  Description of Artificial Sequence: Synthetic polypeptide
DEEEIRTTNPVATEQYGSCNSTSDDQQREGENGQ

SEQ ID NO: 82584 - protein, 31 aa, Artificial Sequence
  Description of Artificial Sequence: Synthetic polypeptide
SEEEIACTNPVATEQYGSVATGLQTGNPSVH

SEQ ID NO: 82585 - protein, 35 aa, Artificial Sequence
  Description of Artificial Sequence: Synthetic polypeptide
DEEEIRTTNPVATEGYGVVVSTGNELSQYIGGNNR

SEQ ID NO: 82586 - protein, 34 aa, Artificial Sequence
  Description of Artificial Sequence: Synthetic polypeptide
DEEEIRTTNPVATEQYGSCNTPTNALEQQRGEVN

SEQ ID NO: 82587 - protein, 34 aa, Artificial Sequence
  Description of Artificial Sequence: Synthetic polypeptide
AEEEIRTTNPVATEQYGSVSTTVNNLQEEGETGE

SEQ ID NO: 82588 - protein, 30 aa, Artificial Sequence
  Description of Artificial Sequence: Synthetic polypeptide
YEQEIATTNPVATEQYGSVSTDLEDHEGEQ

SEQ ID NO: 82589 - protein, 34 aa, Artificial Sequence
  Description of Artificial Sequence: Synthetic polypeptide
DEEEISTTNPVATEQYGCVCSTNLQEHFGSENQL

SEQ ID NO: 82590 - protein, 31 aa, Artificial Sequence
  Description of Artificial Sequence: Synthetic polypeptide
DENEIATTNPVATEQYGSVSATDLMDAAGDL

SEQ ID NO: 82591 - protein, 31 aa, Artificial Sequence
  Description of Artificial Sequence: Synthetic polypeptide
SEEEIRCTNPIATEQYGSVCSSNLNAYGSNQ

SEQ ID NO: 82592 - protein, 29 aa, Artificial Sequence
  Description of Artificial Sequence: Synthetic peptide
YEEEIASVNPVCTEQYGVVSDNLQSDGNQ

SEQ ID NO: 82593 - protein, 35 aa, Artificial Sequence
  Description of Artificial Sequence: Synthetic polypeptide
DEEEIRTTNPVAYEQYGYSVSNTVGLEQRGIEQRD

SEQ ID NO: 82594 - protein, 35 aa, Artificial Sequence
  Description of Artificial Sequence: Synthetic polypeptide
DEEEIRTTNPVATEQWGSVSTTPNEPQDREGENPG

SEQ ID NO: 82595 - protein, 33 aa, Artificial Sequence
  Description of Artificial Sequence: Synthetic polypeptide
AEEEIRTTNPVATEQYGSVSTTVNNLEVNENSE

SEQ ID NO: 82596 - protein, 34 aa, Artificial Sequence
  Description of Artificial Sequence: Synthetic polypeptide
DEEEIRTTNPVAYEQYGYSVSPVTNGLLQITVER

SEQ ID NO: 82597 - protein, 31 aa, Artificial Sequence
  Description of Artificial Sequence: Synthetic polypeptide
DENEIATTNPVATEQYGSVSATDLMDHAGDL

SEQ ID NO: 82598 - protein, 31 aa, Artificial Sequence
  Description of Artificial Sequence: Synthetic polypeptide
DENEIATTNPVATEQYGSVSATDLEDHEGEL

SEQ ID NO: 82599 - protein, 34 aa, Artificial Sequence
  Description of Artificial Sequence: Synthetic polypeptide
DEEEIRTTNPVAYEQWGSVVPSVTGNLSQRTVAR

SEQ ID NO: 82600 - protein, 32 aa, Artificial Sequence
  Description of Artificial Sequence: Synthetic polypeptide
DEEEIRTTNPVAYERWGDVSTNMSSQHGGNQR

SEQ ID NO: 82601 - protein, 34 aa, Artificial Sequence
  Description of Artificial Sequence: Synthetic polypeptide
AEEEIRTTNPVATEQYGSVSTTVNNLNQEGETTE

SEQ ID NO: 82602 - protein, 36 aa, Artificial Sequence
  Description of Artificial Sequence: Synthetic polypeptide
AEEEIRTTNPVATEQYGSVSTTVNNLQAGTDENSER

SEQ ID NO: 82603 - protein, 31 aa, Artificial Sequence
  Description of Artificial Sequence: Synthetic polypeptide
SEEEIRCTNPIATEQYGSVCSSNHARGSNQA

SEQ ID NO: 82604 - protein, 33 aa, Artificial Sequence
  Description of Artificial Sequence: Synthetic polypeptide
DEEEIRTTNPVATEQYGSCNTPTSEDEQRGNVN

SEQ ID NO: 82605 - protein, 31 aa, Artificial Sequence
  Description of Artificial Sequence: Synthetic polypeptide
DENEIATTNPVATEQYGSVSATILEDHAGDA

SEQ ID NO: 82606 - protein, 28 aa, Artificial Sequence
  Description of Artificial Sequence: Synthetic peptide
YEEEIASVNPVCTEQYGVVSDNLQSDNQ

SEQ ID NO: 82607 - protein, 35 aa, Artificial Sequence
  Description of Artificial Sequence: Synthetic polypeptide
DEEEIRTTNPVAYEQYGQCVCSTGNDLNQRGSERL

SEQ ID NO: 82608 - protein, 34 aa, Artificial Sequence
  Description of Artificial Sequence: Synthetic polypeptide
DEEEIRTTNPVAYEQYGQSVSSNDLDQRFGSQQS

SEQ ID NO: 82609 - protein, 34 aa, Artificial Sequence
  Description of Artificial Sequence: Synthetic polypeptide
DEEEIRTTNPVATEQYGSVTSTPLLQNRIDEDGK

SEQ ID NO: 82610 - protein, 31 aa, Artificial Sequence
  Description of Artificial Sequence: Synthetic polypeptide
YEQEIATTNPVATEQYGSVSATNLEDHGEDL

SEQ ID NO: 82611 - protein, 34 aa, Artificial Sequence
  Description of Artificial Sequence: Synthetic polypeptide
AEEEIRTTNPVATEQYGSVSTTVNNQQQGNNQTQ

SEQ ID NO: 82612 - protein, 32 aa, Artificial Sequence
  Description of Artificial Sequence: Synthetic polypeptide
YEEEIRTTNPVATEQYGAVLNTNLNCVGTDRY

SEQ ID NO: 82613 - protein, 34 aa, Artificial Sequence
  Description of Artificial Sequence: Synthetic polypeptide
AEEEIRTTNPVATEQYGSVSTTVNNQQTGTNNVD

SEQ ID NO: 82614 - protein, 32 aa, Artificial Sequence
  Description of Artificial Sequence: Synthetic polypeptide
REEEIATTNPVATEQYGAVVDSTNLETLGQFR

SEQ ID NO: 82615 - protein, 33 aa, Artificial Sequence
  Description of Artificial Sequence: Synthetic polypeptide
DEEEIRTTNPVATEQYGSVYEPENGEIQRGFQQ

SEQ ID NO: 82616 - protein, 31 aa, Artificial Sequence
  Description of Artificial Sequence: Synthetic polypeptide
SEEEIACTNPVATEQYGSVATNLENMGGENH

SEQ ID NO: 82617 - protein, 28 aa, Artificial Sequence
  Description of Artificial Sequence: Synthetic peptide
YEEEIASVNPVCTEQYGVVSDQLQSGNQ

SEQ ID NO: 82618 - protein, 34 aa, Artificial Sequence
  Description of Artificial Sequence: Synthetic polypeptide
AEEEIRTTNPVATEQYGSVSTVTNLQLNQEVENL

SEQ ID NO: 82619 - protein, 34 aa, Artificial Sequence
  Description of Artificial Sequence: Synthetic polypeptide
DEEEIRTTNPVATEQWGSVSITANGGQDRGGIFM

SEQ ID NO: 82620 - protein, 28 aa, Artificial Sequence
  Description of Artificial Sequence: Synthetic peptide
YEEEIASVNPVCTEQYGVVSDRLQSGNQ

SEQ ID NO: 82621 - protein, 33 aa, Artificial Sequence
  Description of Artificial Sequence: Synthetic polypeptide
DEEEIRTTNPVATEQYGSVYEPENEVQRGTQQT

SEQ ID NO: 82622 - protein, 30 aa, Artificial Sequence
  Description of Artificial Sequence: Synthetic polypeptide
DENEIATTNPVAYEQYGSVATNDNDDGNDL

SEQ ID NO: 82623 - protein, 28 aa, Artificial Sequence
  Description of Artificial Sequence: Synthetic peptide
SEEEIACTNPIATEQYGEASEVLQHENR

SEQ ID NO: 82624 - protein, 31 aa, Artificial Sequence
  Description of Artificial Sequence: Synthetic polypeptide
DENEIRTTNPVATEQYGSVMGQNLFENMNGD

SEQ ID NO: 82625 - protein, 28 aa, Artificial Sequence
  Description of Artificial Sequence: Synthetic peptide
YEEEIASVNPVCTEQYGVVSDSLQSGNL

SEQ ID NO: 82626 - protein, 28 aa, Artificial Sequence
  Description of Artificial Sequence: Synthetic peptide
YEEEIASVNPVCTEQYGVVSDSLQSGNQ

SEQ ID NO: 82627 - protein, 35 aa, Artificial Sequence
  Description of Artificial Sequence: Synthetic polypeptide
AEEEIRTTNPVATEQYGSVSTVTNLQLGNNLVEEA

SEQ ID NO: 82628 - protein, 32 aa, Artificial Sequence
  Description of Artificial Sequence: Synthetic polypeptide
DENEIATTNPVAYEQYGSVATNLQNGDNELAW

SEQ ID NO: 82629 - protein, 29 aa, Artificial Sequence
  Description of Artificial Sequence: Synthetic peptide
YEEEIASVNPVCTEQYGVVSDSNLQSGNQ

SEQ ID NO: 82630 - protein, 33 aa, Artificial Sequence
  Description of Artificial Sequence: Synthetic polypeptide
DEEEIRTTNPVAYEQYGQSVSQPDHLQPRGQIM

SEQ ID NO: 82631 - protein, 33 aa, Artificial Sequence
  Description of Artificial Sequence: Synthetic polypeptide
DEEEIRTTNPVATEQYGSVYENLDKGGGNEEDQ

SEQ ID NO: 82632 - protein, 33 aa, Artificial Sequence
  Description of Artificial Sequence: Synthetic polypeptide
YEEEIRTTNPVATEQYGSVSSTPAGNMRNGMNV

SEQ ID NO: 82633 - protein, 33 aa, Artificial Sequence
  Description of Artificial Sequence: Synthetic polypeptide
DEAEIRTTNPVATEQYGQVVNCQNLSQRGGERC

SEQ ID NO: 82634 - protein, 32 aa, Artificial Sequence
  Description of Artificial Sequence: Synthetic polypeptide
DEEEIRTTNPVATEQYGSVYENDDVRVGQEIN

SEQ ID NO: 82635 - protein, 33 aa, Artificial Sequence
  Description of Artificial Sequence: Synthetic polypeptide
DEEEISTTNPVATEQYGCVCSTNDNQNFGSNQP

SEQ ID NO: 82636 - protein, 30 aa, Artificial Sequence
  Description of Artificial Sequence: Synthetic polypeptide
DENEIATTNPVAYEQYGSVATHLQDSNDEQ

SEQ ID NO: 82637 - protein, 29 aa, Artificial Sequence
  Description of Artificial Sequence: Synthetic peptide
YEEEIASVNPVCTEQYGVVSDPNLQSGNQ

SEQ ID NO: 82638 - protein, 33 aa, Artificial Sequence
  Description of Artificial Sequence: Synthetic polypeptide
DEEEISTTNPVATEQYGCVCSTNDQENFGSNQN

SEQ ID NO: 82639 - protein, 33 aa, Artificial Sequence
  Description of Artificial Sequence: Synthetic polypeptide
DEEEIRTTNPVATEQYGQVSTNTMNGSTTGGNF

SEQ ID NO: 82640 - protein, 31 aa, Artificial Sequence
  Description of Artificial Sequence: Synthetic polypeptide
DENEIATTNPVAYEQYGSVANTNLVDDGNDM

SEQ ID NO: 82641 - protein, 29 aa, Artificial Sequence
  Description of Artificial Sequence: Synthetic peptide
REEEIASVNPVCTEQYGVVSDNLQESGNQ

SEQ ID NO: 82642 - protein, 28 aa, Artificial Sequence
  Description of Artificial Sequence: Synthetic peptide
YEEEIASVNPVCTEQYGVVSDNWQSGNQ

SEQ ID NO: 82643 - protein, 31 aa, Artificial Sequence
  Description of Artificial Sequence: Synthetic polypeptide
DEEEIRTTNPVATECWGMHSWTNEDQRRNDF

SEQ ID NO: 82644 - protein, 32 aa, Artificial Sequence
  Description of Artificial Sequence: Synthetic polypeptide
SEEEIRCTNPIATEQYGQSVSEMNLMGRGHDR

SEQ ID NO: 82645 - protein, 32 aa, Artificial Sequence
  Description of Artificial Sequence: Synthetic polypeptide
SEEEIRCTNPIATEQYGQSAWSEMNLMRGNDR

SEQ ID NO: 82646 - protein, 30 aa, Artificial Sequence
  Description of Artificial Sequence: Synthetic polypeptide
DEAEIRTTNGVAYCQYGCVCSTELQNGDRA

SEQ ID NO: 82647 - protein, 30 aa, Artificial Sequence
  Description of Artificial Sequence: Synthetic polypeptide
DEEEIRTTNPVATECWGMHSWTNEQRERDF

SEQ ID NO: 82648 - protein, 34 aa, Artificial Sequence
  Description of Artificial Sequence: Synthetic polypeptide
DEEEIRTTNPVATEQYGSVYESNFLQQRTLENDG

SEQ ID NO: 82649 - protein, 28 aa, Artificial Sequence
  Description of Artificial Sequence: Synthetic peptide
YEEEIASVNPVCTEQYGVVSDTLQHGNQ

SEQ ID NO: 82650 - protein, 28 aa, Artificial Sequence
  Description of Artificial Sequence: Synthetic peptide
YEEEIASVNPVCTEQYGVVSDNYQSGNQ

SEQ ID NO: 82651 - protein, 34 aa, Artificial Sequence
  Description of Artificial Sequence: Synthetic polypeptide
YEEEIRTTNPVATEQYGAVALNTNLQCRGQNDIY

SEQ ID NO: 82652 - protein, 32 aa, Artificial Sequence
  Description of Artificial Sequence: Synthetic polypeptide
SEEEIACTNPVATEQYGSVATNLENAGENARD

SEQ ID NO: 82653 - protein, 31 aa, Artificial Sequence
  Description of Artificial Sequence: Synthetic polypeptide
DEEEIRTTNPVSTEQYGSVTDNDGQTGGGQT

SEQ ID NO: 82654 - protein, 31 aa, Artificial Sequence
  Description of Artificial Sequence: Synthetic polypeptide
DENEIATTNPVAYEQYGSVATGELQNGDNNS

SEQ ID NO: 82655 - protein, 33 aa, Artificial Sequence
  Description of Artificial Sequence: Synthetic polypeptide
YEEEIRTTNPVATEQYGAVALNTNLICRGTDRY

SEQ ID NO: 82656 - protein, 35 aa, Artificial Sequence
  Description of Artificial Sequence: Synthetic polypeptide
AEEEIRTTNPVATEQYGSVSTVANLNNNQEGNNVD

SEQ ID NO: 82657 - protein, 30 aa, Artificial Sequence
  Description of Artificial Sequence: Synthetic polypeptide
DENEIATTNPVAYEQYGSVATHLQDSMGDE

SEQ ID NO: 82658 - protein, 28 aa, Artificial Sequence
  Description of Artificial Sequence: Synthetic peptide
YEEEIASVNPVCTEQYGVVSDPLQSGNQ

SEQ ID NO: 82659 - protein, 29 aa, Artificial Sequence
  Description of Artificial Sequence: Synthetic peptide
YEQEIASTNPVATEQYGVVSDDLQSGNDQ

SEQ ID NO: 82660 - protein, 33 aa, Artificial Sequence
  Description of Artificial Sequence: Synthetic polypeptide
DEEEISTTNPVATEQYGCVCSTNDQGFGSDNQV

SEQ ID NO: 82661 - protein, 31 aa, Artificial Sequence
  Description of Artificial Sequence: Synthetic polypeptide
DEEEIRTTNPVCTEGYGCVCSWPNDQNGSNL

SEQ ID NO: 82662 - protein, 28 aa, Artificial Sequence
  Description of Artificial Sequence: Synthetic peptide
YEEEIASVNPVCTEQYGVVSDNVQSGNQ

SEQ ID NO: 82663 - protein, 33 aa, Artificial Sequence
  Description of Artificial Sequence: Synthetic polypeptide
REEEINTTNPVATEQYGAVVPSTVNLEQLGQVR

SEQ ID NO: 82664 - protein, 29 aa, Artificial Sequence
  Description of Artificial Sequence: Synthetic peptide
DENEIRTTNPVATEQWGDVSEIEMNRENA

SEQ ID NO: 82665 - protein, 31 aa, Artificial Sequence
  Description of Artificial Sequence: Synthetic polypeptide
DENEIATTNPVAYGAHYGSVSTNLQHGDNQM

SEQ ID NO: 82666 - protein, 32 aa, Artificial Sequence
  Description of Artificial Sequence: Synthetic polypeptide
REEEIRTTNPVATEQYGAVVPSTDLETLGQGR

SEQ ID NO: 82667 - protein, 31 aa, Artificial Sequence
  Description of Artificial Sequence: Synthetic polypeptide
DEEEIRTTNPVAYEQWGTYWSTDLLDRGNSS

SEQ ID NO: 82668 - protein, 33 aa, Artificial Sequence
  Description of Artificial Sequence: Synthetic polypeptide
REEEIRTTNPVATEQYGAVVPSTNFLETDGQFR

SEQ ID NO: 82669 - protein, 30 aa, Artificial Sequence
  Description of Artificial Sequence: Synthetic polypeptide
SEEEIRCTNPIATEQYGCVSWNLMRGSDQN

SEQ ID NO: 82670 - protein, 32 aa, Artificial Sequence
  Description of Artificial Sequence: Synthetic polypeptide
DEEEIRTTNPVATEQYGSVYAMNLEEMIPNEE

SEQ ID NO: 82671 - protein, 33 aa, Artificial Sequence
  Description of Artificial Sequence: Synthetic polypeptide
DEEEIRTTNPVATECWGSVSEINEPQDREGENG

SEQ ID NO: 82672 - protein, 30 aa, Artificial Sequence
  Description of Artificial Sequence: Synthetic polypeptide
SEEEIRCTNPIATEQYGCVSWNLMHGSNQP

SEQ ID NO: 82673 - protein, 33 aa, Artificial Sequence
  Description of Artificial Sequence: Synthetic polypeptide
DEEEIRTTNPVATECWGSVSEINEPQDREGENK

SEQ ID NO: 82674 - protein, 30 aa, Artificial Sequence
  Description of Artificial Sequence: Synthetic polypeptide
SEEEIRCTNPIATEQYGCVSWNLMGFGNQS

SEQ ID NO: 82675 - protein, 30 aa, Artificial Sequence
  Description of Artificial Sequence: Synthetic polypeptide
SEEEIRCTNPIATEQYGCVSWNLIRGSQQA

SEQ ID NO: 82676 - protein, 30 aa, Artificial Sequence
  Description of Artificial Sequence: Synthetic polypeptide
DDSEVACTNPVATEQYGNVAANTLQSRGNR

SEQ ID NO: 82677 - protein, 32 aa, Artificial Sequence
  Description of Artificial Sequence: Synthetic polypeptide
DEEEIRTTNPVATECWGSVSEINEPQREEENK

SEQ ID NO: 82678 - protein, 30 aa, Artificial Sequence
  Description of Artificial Sequence: Synthetic polypeptide
SEEEIRCTNPIATEQYGCVSWGNLMRFGEQ

SEQ ID NO: 82679 - protein, 32 aa, Artificial Sequence
  Description of Artificial Sequence: Synthetic polypeptide
DEEEIRTTNPVATEQYGSVWTVLAMPEVENFE

SEQ ID NO: 82680 - protein, 30 aa, Artificial Sequence
  Description of Artificial Sequence: Synthetic polypeptide
SEEEIRCTNPIATEQYGCVSWGNLASFGNQ

SEQ ID NO: 82681 - protein, 30 aa, Artificial Sequence
  Description of Artificial Sequence: Synthetic polypeptide
SEEEIRCTNPIATEQYGCVSSNLMSGSNTQ

SEQ ID NO: 82682 - protein, 28 aa, Artificial Sequence
  Description of Artificial Sequence: Synthetic peptide
YEEEIASVNPVCTEQYGVVSDVLQSGNE

SEQ ID NO: 82683 - protein, 28 aa, Artificial Sequence
  Description of Artificial Sequence: Synthetic peptide
YEEEIASVNPVCTEQYGVVSDVLQSGNK

SEQ ID NO: 82684 - protein, 33 aa, Artificial Sequence
  Description of Artificial Sequence: Synthetic polypeptide
YEEEIRTTNPVATEQYGSVSTLPTNTRFMGTRN

SEQ ID NO: 82685 - protein, 31 aa, Artificial Sequence
  Description of Artificial Sequence: Synthetic polypeptide
DEAEIRTTNGVAYCQYGCVSTGNLQENGSDR

SEQ ID NO: 82686 - protein, 32 aa, Artificial Sequence
  Description of Artificial Sequence: Synthetic polypeptide
REEEIRTTNPVATEQYGAVVPDTNLETLGQMR

SEQ ID NO: 82687 - protein, 34 aa, Artificial Sequence
  Description of Artificial Sequence: Synthetic polypeptide
REEEIRTTNPVATEQYGAVALNTNDLICRGNDRY

SEQ ID NO: 82688 - protein, 30 aa, Artificial Sequence
  Description of Artificial Sequence: Synthetic polypeptide
SEEEIRCTNPIATEQYGCVTSSNLINGSNQ

SEQ ID NO: 82689 - protein, 33 aa, Artificial Sequence
  Description of Artificial Sequence: Synthetic polypeptide
DEEEIRTTNPVATECWGSVSCINEPQGREGENG

SEQ ID NO: 82690 - protein, 34 aa, Artificial Sequence
  Description of Artificial Sequence: Synthetic polypeptide
AEEEIRTTNPVATEQYGSVSTVTTNLEAGNNNTQ

SEQ ID NO: 82691 - protein, 32 aa, Artificial Sequence
  Description of Artificial Sequence: Synthetic polypeptide
REEEIRCTNPVATEQYGAVVPSETNLETLGQR

SEQ ID NO: 82692 - protein, 34 aa, Artificial Sequence
  Description of Artificial Sequence: Synthetic polypeptide
AEEEIRTTNPVATEQYGSVSTVDNGNQEEGNNQI

SEQ ID NO: 82693 - protein, 32 aa, Artificial Sequence
  Description of Artificial Sequence: Synthetic polypeptide
DENEIATTNPVAYEQYGSVATNLQNGNNNLHW

SEQ ID NO: 82694 - protein, 34 aa, Artificial Sequence
  Description of Artificial Sequence: Synthetic polypeptide
YEEEIRTTNPVATEQYGAVALNTNDLQCGGNDRN

SEQ ID NO: 82695 - protein, 28 aa, Artificial Sequence
  Description of Artificial Sequence: Synthetic peptide
YEEEIASVNPVCTEQYGVVSDTLQSGNQ

SEQ ID NO: 82696 - protein, 34 aa, Artificial Sequence
  Description of Artificial Sequence: Synthetic polypeptide
AEEEIRTTNPVATEQYGSVSTVDNGNQQEGTNQE

SEQ ID NO: 82697 - protein, 31 aa, Artificial Sequence
  Description of Artificial Sequence: Synthetic polypeptide
DEEEIRTTNPVATEQYGSVYDTLEELSGEEW

SEQ ID NO: 82698 - protein, 31 aa, Artificial Sequence
  Description of Artificial Sequence: Synthetic polypeptide
DENEIATTNPVAYEQYGSVATNLQTANPGEE

SEQ ID NO: 82699 - protein, 31 aa, Artificial Sequence
  Description of Artificial Sequence: Synthetic polypeptide
DENEIATTNPVAYEQYGSVATNLVDDGNEDN

SEQ ID NO: 82700 - protein, 34 aa, Artificial Sequence
  Description of Artificial Sequence: Synthetic polypeptide
YEEEIRTTNPVATEQYGAVALNTNDLQIRGVDRY

SEQ ID NO: 82701 - protein, 31 aa, Artificial Sequence
  Description of Artificial Sequence: Synthetic polypeptide
DDSEVATTNPVSTEQYGSVSANDLQSRVGQR

SEQ ID NO: 82702 - protein, 28 aa, Artificial Sequence
  Description of Artificial Sequence: Synthetic peptide
YEPEIASVNPVCTEQYGVVSDNLQSGNQ

SEQ ID NO: 82703 - protein, 28 aa, Artificial Sequence
  Description of Artificial Sequence: Synthetic peptide
SEEEIRCTNPIATEQYGEAPEVLQHGER

SEQ ID NO: 82704 - protein, 33 aa, Artificial Sequence
  Description of Artificial Sequence: Synthetic polypeptide
DEEEIRTTNPVATECWGSVSCINEPQDREGENG

SEQ ID NO: 82705 - protein, 28 aa, Artificial Sequence
  Description of Artificial Sequence: Synthetic peptide
SEEEIRCTNPIATEQYGEAPEVLMHGNR

SEQ ID NO: 82706 - protein, 34 aa, Artificial Sequence
  Description of Artificial Sequence: Synthetic polypeptide
DEEEIRTTNPVATEHYGSVISCAPNMLSQHDGNL

SEQ ID NO: 82707 - protein, 33 aa, Artificial Sequence
  Description of Artificial Sequence: Synthetic polypeptide
DENEIATTNPVAYEQYGSVSAGNLDQDRGENQP

SEQ ID NO: 82708 - protein, 34 aa, Artificial Sequence
  Description of Artificial Sequence: Synthetic polypeptide
YEEEIRTTNPVATEQYGAVALNTGNLTCRGNDRY

SEQ ID NO: 82709 - protein, 34 aa, Artificial Sequence
  Description of Artificial Sequence: Synthetic polypeptide
YEEEIRTTNPVATEQYGAVALNTGDLQDRGNDRY

SEQ ID NO: 82710 - protein, 30 aa, Artificial Sequence
  Description of Artificial Sequence: Synthetic polypeptide
REEEIRTTNPVATEHYGNVYSFDDQGMTNR

SEQ ID NO: 82711 - protein, 34 aa, Artificial Sequence
  Description of Artificial Sequence: Synthetic polypeptide
DEEEIRTTNPVATEQYGSVYATNNLVEVRVGVTN

SEQ ID NO: 82712 - protein, 32 aa, Artificial Sequence
  Description of Artificial Sequence: Synthetic polypeptide
DEEEIRTTNPVAYEQWGTYVYTDLQLDRQGNS

SEQ ID NO: 82713 - protein, 34 aa, Artificial Sequence
  Description of Artificial Sequence: Synthetic polypeptide
YEQEIRTTNPVATEQYGCVCSATSNSLTQKGNRY

SEQ ID NO: 82714 - protein, 28 aa, Artificial Sequence
  Description of Artificial Sequence: Synthetic peptide
REEEIASVNPVCTENYGVVSDNLQSGNQ

SEQ ID NO: 82715 - protein, 28 aa, Artificial Sequence
  Description of Artificial Sequence: Synthetic peptide
YEEEIASVNPVCTEQYGVVSDNTQSGNQ

SEQ ID NO: 82716 - protein, 34 aa, Artificial Sequence
  Description of Artificial Sequence: Synthetic polypeptide
DEEEIRTTNPVATEQYGSVYGTDGNEQGQGNNEE

SEQ ID NO: 82717 - protein, 32 aa, Artificial Sequence
  Description of Artificial Sequence: Synthetic polypeptide
DENEIATTNPVATEQYGTVCSATDNPVQRGGD

SEQ ID NO: 82718 - protein, 34 aa, Artificial Sequence
  Description of Artificial Sequence: Synthetic polypeptide
DEEEIRTTNPVAYEQYGQSVSSEEDLNQRFGSQR

SEQ ID NO: 82719 - protein, 28 aa, Artificial Sequence
  Description of Artificial Sequence: Synthetic peptide
YEEEIASVNPVCTEQYGVVSDNLQSSNQ

SEQ ID NO: 82720 - protein, 34 aa, Artificial Sequence
  Description of Artificial Sequence: Synthetic polypeptide
AEEEIRTTNPVATEQYGSVSTTVNQNQQEGNNAI

SEQ ID NO: 82721 - protein, 34 aa, Artificial Sequence
  Description of Artificial Sequence: Synthetic polypeptide
AEEEIRTTNPVATEQYGSVSTTVNQQGNNGNIQE

SEQ ID NO: 82722 - protein, 31 aa, Artificial Sequence
  Description of Artificial Sequence: Synthetic polypeptide
DENEIATTNPVATEQYGTVCSTDGLQFEGGD

SEQ ID NO: 82723 - protein, 31 aa, Artificial Sequence
  Description of Artificial Sequence: Synthetic polypeptide
DEEEIRTTNPVAYEQWGSYWSTINENQDNNA

SEQ ID NO: 82724 - protein, 34 aa, Artificial Sequence
  Description of Artificial Sequence: Synthetic polypeptide
DEEEIRTTNPVATEHYGICVVPACTNELQRGNDE

SEQ ID NO: 82725 - protein, 28 aa, Artificial Sequence
  Description of Artificial Sequence: Synthetic peptide
YEEEIASVNPVCTEQYGVVSDNLQSTNQ

SEQ ID NO: 82726 - protein, 35 aa, Artificial Sequence
  Description of Artificial Sequence: Synthetic polypeptide
DEEEIRTTNPVATEHYGIETVSCTNLSERNGGNER

SEQ ID NO: 82727 - protein, 30 aa, Artificial Sequence
  Description of Artificial Sequence: Synthetic polypeptide
SEEEIRCTNPIATEQYGSISEENIMQNGNH

SEQ ID NO: 82728 - protein, 34 aa, Artificial Sequence
  Description of Artificial Sequence: Synthetic polypeptide
YEEEIRTTNPVATEQYGAVANNTNDLQCRLNDRY

SEQ ID NO: 82729 - protein, 31 aa, Artificial Sequence
  Description of Artificial Sequence: Synthetic polypeptide
QSEEIATTNPVATTQWGSVSTWDLDQRGNTF

SEQ ID NO: 82730 - protein, 29 aa, Artificial Sequence
  Description of Artificial Sequence: Synthetic peptide
YEEEIASVNPVCTEQYGVVSDNLQSVGNQ

SEQ ID NO: 82731 - protein, 29 aa, Artificial Sequence
  Description of Artificial Sequence: Synthetic peptide
QSEEIATTNPVGTEQWGMVSITNLQGGEY

SEQ ID NO: 82732 - protein, 28 aa, Artificial Sequence
  Description of Artificial Sequence: Synthetic peptide
YEQEIASVNPVCTEQYGVVSDNLQSGNQ

SEQ ID NO: 82733 - protein, 32 aa, Artificial Sequence
  Description of Artificial Sequence: Synthetic polypeptide
DENEIRTTNPVATEQYGSVMSQNNLFENMNGG

SEQ ID NO: 82734 - protein, 34 aa, Artificial Sequence
  Description of Artificial Sequence: Synthetic polypeptide
AEEEIRTTNPVATEQYGSVSTTVNQQQNEQGNNN

SEQ ID NO: 82735 - protein, 28 aa, Artificial Sequence
  Description of Artificial Sequence: Synthetic peptide
YEEEIASVNPVCTEQYGVVSDNLQSVNQ

SEQ ID NO: 82736 - protein, 31 aa, Artificial Sequence
  Description of Artificial Sequence: Synthetic polypeptide
QSEEIRTTNPVAYEAYGSTVSTGNLTMVGNA

SEQ ID NO: 82737 - protein, 29 aa, Artificial Sequence
  Description of Artificial Sequence: Synthetic peptide
YEEEIASVNPVCTEQYGVVSDNLQSSGNQ

SEQ ID NO: 82738 - protein, 32 aa, Artificial Sequence
  Description of Artificial Sequence: Synthetic polypeptide
DENEIRTTNPVATEQYGSVMTGLIRGMGDEGN

SEQ ID NO: 82739 - protein, 34 aa, Artificial Sequence
  Description of Artificial Sequence: Synthetic polypeptide
DEEEIRTTNPVAYERYGMTVPSITNLSQQQGGNR

SEQ ID NO: 82740 - protein, 33 aa, Artificial Sequence
  Description of Artificial Sequence: Synthetic polypeptide
DEEEIRTTNPVATEQYGSVYGTFNGQEEGGGGT

SEQ ID NO: 82741 - protein, 28 aa, Artificial Sequence
  Description of Artificial Sequence: Synthetic peptide
YEEEIASVNPVCTEQYGVVSDNLQSMNQ

SEQ ID NO: 82742 - protein, 33 aa, Artificial Sequence
  Description of Artificial Sequence: Synthetic polypeptide
AEEEIRTTNPVATEQYGSVSTTVNQAGDTENEE

SEQ ID NO: 82743 - protein, 34 aa, Artificial Sequence
  Description of Artificial Sequence: Synthetic polypeptide
DEEEIRTTNPVATEQYGSVVAPTNALSQDASGDD

SEQ ID NO: 82744 - protein, 29 aa, Artificial Sequence
  Description of Artificial Sequence: Synthetic peptide
YEEEIASVNPVCTEQYGVVSDNLQSNGNQ

SEQ ID NO: 82745 - protein, 33 aa, Artificial Sequence
  Description of Artificial Sequence: Synthetic polypeptide
DEEEIRTTNPVAYEQWGSVYSDTRHDGQRSQNR

SEQ ID NO: 82746 - protein, 28 aa, Artificial Sequence
  Description of Artificial Sequence: Synthetic peptide
YEEEIASVNPVCTEQYGVVSDNLQSNNQ

SEQ ID NO: 82747 - protein, 33 aa, Artificial Sequence
  Description of Artificial Sequence: Synthetic polypeptide
AEEEIRTTNPVATEQYGSVSTTVNQLEDEGTED

SEQ ID NO: 82748 - protein, 31 aa, Artificial Sequence
  Description of Artificial Sequence: Synthetic polypeptide
DENEIATTNPVATEQYGTASEENLQQQNGGR

SEQ ID NO: 82749 - protein, 34 aa, Artificial Sequence
  Description of Artificial Sequence: Synthetic polypeptide
YEEEIRTTNPVATEQYGSVSSTDNLPNMSNGMNV

SEQ ID NO: 82750 - protein, 29 aa, Artificial Sequence
  Description of Artificial Sequence: Synthetic peptide
YEEEIASVNPVCTEQYGVVSDNLQSPGNG

SEQ ID NO: 82751 - protein, 30 aa, Artificial Sequence
  Description of Artificial Sequence: Synthetic polypeptide
DENEIATTNPVATEQYGTVSEDGPEFEGNR

SEQ ID NO: 82752 - protein, 29 aa, Artificial Sequence
  Description of Artificial Sequence: Synthetic peptide
YEEEIASVNPVCTEQYGVVSDNLQSPGNQ

SEQ ID NO: 82753 - protein, 35 aa, Artificial Sequence
  Description of Artificial Sequence: Synthetic polypeptide
YEEEIRTTNPVATEQYGAVATNTINGLQCRGNDRY

SEQ ID NO: 82754 - protein, 32 aa, Artificial Sequence
  Description of Artificial Sequence: Synthetic polypeptide
SEEEIACTNPVATEQYGSVATNLAEAEGGNER

SEQ ID NO: 82755 - protein, 35 aa, Artificial Sequence
  Description of Artificial Sequence: Synthetic polypeptide
AEEEIRTTNPVATEQYGSVSTTVNQLQEGTTENSE

SEQ ID NO: 82756 - protein, 34 aa, Artificial Sequence
  Description of Artificial Sequence: Synthetic polypeptide
DEEEIRTTNPVATEQYGSVSYPVNENTRGEEERF

SEQ ID NO: 82757 - protein, 34 aa, Artificial Sequence
  Description of Artificial Sequence: Synthetic polypeptide
DEEEIRTTNPVATEQYGSVSYPVNENTRGENPLF

SEQ ID NO: 82758 - protein, 29 aa, Artificial Sequence
  Description of Artificial Sequence: Synthetic peptide
DENEIATTNPVATEQYGTISEDLQQNGGH

SEQ ID NO: 82759 - protein, 28 aa, Artificial Sequence
  Description of Artificial Sequence: Synthetic peptide
YEEEIASVNPVCTEQYGVVSDNLQSPNQ

SEQ ID NO: 82760 - protein, 28 aa, Artificial Sequence
  Description of Artificial Sequence: Synthetic peptide
YEEEIASVNPVCTEQYGVVSDNLQSQNQ

SEQ ID NO: 82761 - protein, 32 aa, Artificial Sequence
  Description of Artificial Sequence: Synthetic polypeptide
DENEIATTNPVATEQYGTVCSATDNPVERGND

SEQ ID NO: 82762 - protein, 28 aa, Artificial Sequence
  Description of Artificial Sequence: Synthetic peptide
YEEEIASVNPVCTEQYGVVSDNLQSRNQ

SEQ ID NO: 82763 - protein, 34 aa, Artificial Sequence
  Description of Artificial Sequence: Synthetic polypeptide
DENEIRTTNPVATEQYGSVNFTRNLEEIFGNFRE

SEQ ID NO: 82764 - protein, 33 aa, Artificial Sequence
  Description of Artificial Sequence: Synthetic polypeptide
DEEEIRTTNPVAYETYGSVASPTNLEPETGNWD

SEQ ID NO: 82765 - protein, 30 aa, Artificial Sequence
  Description of Artificial Sequence: Synthetic polypeptide
DENEIATTNPVATEQYGTVSEDGPQFEGGR

SEQ ID NO: 82766 - protein, 32 aa, Artificial Sequence
  Description of Artificial Sequence: Synthetic polypeptide
DEEEIRTTNPVATEHYGQSVDSTNNFGEGGVD

SEQ ID NO: 82767 - protein, 28 aa, Artificial Sequence
  Description of Artificial Sequence: Synthetic peptide
YEEEIASVNPVCTEQYGVVSDNNQSGNQ

SEQ ID NO: 82768 - protein, 33 aa, Artificial Sequence
  Description of Artificial Sequence: Synthetic polypeptide
DEEEISTTNPVATEQYGCVCSTNHNQNFGSNQE

SEQ ID NO: 82769 - protein, 32 aa, Artificial Sequence
  Description of Artificial Sequence: Synthetic polypeptide
DEEEIRTTNPVAYEQWGTSTSTGLLREGGNDS

SEQ ID NO: 82770 - protein, 35 aa, Artificial Sequence
  Description of Artificial Sequence: Synthetic polypeptide
AEEEIRTTNPVATEQYGSVSTTVTNLQQGTATNSD

SEQ ID NO: 82771 - protein, 35 aa, Artificial Sequence
  Description of Artificial Sequence: Synthetic polypeptide
YEEEIRTTNPVATEQYGAVALNTPNLQCRSGNDRY

SEQ ID NO: 82772 - protein, 28 aa, Artificial Sequence
  Description of Artificial Sequence: Synthetic peptide
YEEEIASVNPVCTEQYGVVSDNPQSGNQ

SEQ ID NO: 82773 - protein, 29 aa, Artificial Sequence
  Description of Artificial Sequence: Synthetic peptide
YEEEIASVNPVCTEQYGVVSDNQLQQGNQ

SEQ ID NO: 82774 - protein, 33 aa, Artificial Sequence
  Description of Artificial Sequence: Synthetic polypeptide
DEEEISTTNPVATEQYGCVCSTNHNQGFGSNQV

SEQ ID NO: 82775 - protein, 33 aa, Artificial Sequence
  Description of Artificial Sequence: Synthetic polypeptide
DEEEIRTTNPVAYEQWGTSVSATNDLGQSDDAR

SEQ ID NO: 82776 - protein, 34 aa, Artificial Sequence
  Description of Artificial Sequence: Synthetic polypeptide
DEEEIRTTNPVATEQYGQCVCSNTELQRFGSDQG

SEQ ID NO: 82777 - protein, 28 aa, Artificial Sequence
  Description of Artificial Sequence: Synthetic peptide
SEEEIRCTNPIATEQYGSAPENCQHEER

SEQ ID NO: 82778 - protein, 28 aa, Artificial Sequence
  Description of Artificial Sequence: Synthetic peptide
YEEEIASVNPVCTEQYGVVSDNQQSGNQ

SEQ ID NO: 82779 - protein, 35 aa, Artificial Sequence
  Description of Artificial Sequence: Synthetic polypeptide
AEEEIRTTNPVATEQYGSVSTTVTNLQQGTEAGNE

SEQ ID NO: 82780 - protein, 28 aa, Artificial Sequence
  Description of Artificial Sequence: Synthetic peptide
YEEEIASVNPVCTEQYGVVSDNRQSGNQ

SEQ ID NO: 82781 - protein, 34 aa, Artificial Sequence
  Description of Artificial Sequence: Synthetic polypeptide
DEEEIRTTNPVAYEQWGTSVSRQTNDLLQEGIRR

SEQ ID NO: 82782 - protein, 29 aa, Artificial Sequence
  Description of Artificial Sequence: Synthetic peptide
DENEIRTTNPVATEQWGDVSEIEMRAEDR

SEQ ID NO: 82783 - protein, 33 aa, Artificial Sequence
  Description of Artificial Sequence: Synthetic polypeptide
DEEEIRTTNPVAYEQWGTSVVSTPLLDRDGNDS

SEQ ID NO: 82784 - protein, 29 aa, Artificial Sequence
  Description of Artificial Sequence: Synthetic peptide
YEEEIASVNPVCTEQYGVVSDNSLQDGNQ

SEQ ID NO: 82785 - protein, 28 aa, Artificial Sequence
  Description of Artificial Sequence: Synthetic peptide
YEEEIASVNPVCTEQYGVVSDNSQCGNQ

SEQ ID NO: 82786 - protein, 28 aa, Artificial Sequence
  Description of Artificial Sequence: Synthetic peptide
YEEEIASVNPVCTEQYGVVSDNSQSGNQ

SEQ ID NO: 82787 - protein, 28 aa, Artificial Sequence
  Description of Artificial Sequence: Synthetic peptide
YEEEIASVNPVCTEQYGVVSDNTQFGNQ

SEQ ID NO: 82788 - protein, 33 aa, Artificial Sequence
  Description of Artificial Sequence: Synthetic polypeptide
DEEEIRTTNPVATEHYGSTVNYTGNISQRVTNK

SEQ ID NO: 82789 - protein, 37 aa, Artificial Sequence
  Description of Artificial Sequence: Synthetic polypeptide
DEEEIRTTNPVATEQYGSVVASPTNALSQDAGGDNRL

SEQ ID NO: 82790 - protein, 33 aa, Artificial Sequence
  Description of Artificial Sequence: Synthetic polypeptide
DEEEISTTNPVATEQYGCVCSTNHNQNFGSNQG

SEQ ID NO: 82791 - protein, 33 aa, Artificial Sequence
  Description of Artificial Sequence: Synthetic polypeptide
DEEEIRTTNPVATEQYGSVYGDVGNEQGQGNEE

SEQ ID NO: 82792 - protein, 33 aa, Artificial Sequence
  Description of Artificial Sequence: Synthetic polypeptide
AEEEIRTTNPVATEQYGSVSTTVNQVNGNNQTD

SEQ ID NO: 82793 - protein, 34 aa, Artificial Sequence
  Description of Artificial Sequence: Synthetic polypeptide
DEEEIRTTNPVAYERYGSTVPSTDNALPQFSNNR

SEQ ID NO: 82794 - protein, 28 aa, Artificial Sequence
  Description of Artificial Sequence: Synthetic peptide
YEEEIASVNPVCTEQYGVVSDNLQSWNF

SEQ ID NO: 82795 - protein, 32 aa, Artificial Sequence
  Description of Artificial Sequence: Synthetic polypeptide
DEEEISTTNPVATEQYGCVCSTNHQFFNNNQT

SEQ ID NO: 82796 - protein, 34 aa, Artificial Sequence
  Description of Artificial Sequence: Synthetic polypeptide
DEEEIRTTNPVATEQYGSVYGNTGNFDQETGNGG

SEQ ID NO: 82797 - protein, 28 aa, Artificial Sequence
  Description of Artificial Sequence: Synthetic peptide
YEEEIASVNPVCTEQYGVVSDNLQSWNQ

SEQ ID NO: 82798 - protein, 28 aa, Artificial Sequence
  Description of Artificial Sequence: Synthetic peptide
YEEEIASVNPVCTEQYGVVSDNLQSYNQ

SEQ ID NO: 82799 - protein, 33 aa, Artificial Sequence
  Description of Artificial Sequence: Synthetic polypeptide
DEEEISTTNPVATEQYGCVCSTNHQENGSNNQL

SEQ ID NO: 82800 - protein, 32 aa, Artificial Sequence
  Description of Artificial Sequence: Synthetic polypeptide
DENEIRTTNPVATEQYGSVMSQNLFENMNQEF

SEQ ID NO: 82801 - protein, 31 aa, Artificial Sequence
  Description of Artificial Sequence: Synthetic polypeptide
DEAEIRTTNPVATEQYGCVCSTEHQHFGSEQ

SEQ ID NO: 82802 - protein, 33 aa, Artificial Sequence
  Description of Artificial Sequence: Synthetic polypeptide
DEEEIRTTNPVAYERYGSTVPNTNAHPQFGNNR

SEQ ID NO: 82803 - protein, 30 aa, Artificial Sequence
  Description of Artificial Sequence: Synthetic polypeptide
DENEIATTNPVATESYGSVAANNLQDAGGH

SEQ ID NO: 82804 - protein, 32 aa, Artificial Sequence
  Description of Artificial Sequence: Synthetic polypeptide
DEEEIRTTNPVAYEQWGSYWSTINPNQDEGND

SEQ ID NO: 82805 - protein, 33 aa, Artificial Sequence
  Description of Artificial Sequence: Synthetic polypeptide
DEEEISTTNPVATEQYGCVCSTNHQEHFGSDNQ

SEQ ID NO: 82806 - protein, 32 aa, Artificial Sequence
  Description of Artificial Sequence: Synthetic polypeptide
DENEIRTTNPVATEQYGSVMSQNLFENEMNGD

SEQ ID NO: 82807 - protein, 29 aa, Artificial Sequence
  Description of Artificial Sequence: Synthetic peptide
YEEEIASVNPVCTEQYGVVSDNLYQSGNQ

SEQ ID NO: 82808 - protein, 33 aa, Artificial Sequence
  Description of Artificial Sequence: Synthetic polypeptide
DEEEISTTNPVATEQYGCVCSTNHQEGFGSNFV

SEQ ID NO: 82809 - protein, 28 aa, Artificial Sequence
  Description of Artificial Sequence: Synthetic peptide
YEEEIASVNPVCTEQYGVVSDNMQSGNQ

SEQ ID NO: 82810 - protein, 35 aa, Artificial Sequence
  Description of Artificial Sequence: Synthetic polypeptide
DEEEIRTTNPVATEHYGSTISCLPNMLSQRDGNRG

SEQ ID NO: 82811 - protein, 34 aa, Artificial Sequence
  Description of Artificial Sequence: Synthetic polypeptide
YEEEIRTTNPVATEQYGAVALVTNDLVCRGNDRY

SEQ ID NO: 82812 - protein, 34 aa, Artificial Sequence
  Description of Artificial Sequence: Synthetic polypeptide
DEEEIRTTNPVAYERYGSTVPSTNNALPQQVNNR

SEQ ID NO: 82813 - protein, 33 aa, Artificial Sequence
  Description of Artificial Sequence: Synthetic polypeptide
DEEEIRTTNPVAYEQWGTSCVSTPLLDRDGHNS

SEQ ID NO: 82814 - protein, 33 aa, Artificial Sequence
  Description of Artificial Sequence: Synthetic polypeptide
DEEEIRTTNPVAYERYGSTVPSTNMLPQFSNNL

SEQ ID NO: 82815 - protein, 31 aa, Artificial Sequence
  Description of Artificial Sequence: Synthetic polypeptide
YEQEIRTTNPVATEQYGICGSDTIELQRSER

SEQ ID NO: 82816 - protein, 34 aa, Artificial Sequence
  Description of Artificial Sequence: Synthetic polypeptide
AEEEIRTTNPVATEQYGSVSTTVNLLVGTTENSE

SEQ ID NO: 82817 - protein, 28 aa, Artificial Sequence
  Description of Artificial Sequence: Synthetic peptide
YESEIASTNPVATECWGVVSCNEQRGNG

SEQ ID NO: 82818 - protein, 32 aa, Artificial Sequence
  Description of Artificial Sequence: Synthetic polypeptide
DEEEISTTNPVATEQYGCVCSWNLQNFGSEQA

SEQ ID NO: 82819 - protein, 30 aa, Artificial Sequence
  Description of Artificial Sequence: Synthetic polypeptide
DENEIATTNPVATEQYGDVSTEPCLNHGEL

SEQ ID NO: 82820 - protein, 33 aa, Artificial Sequence
  Description of Artificial Sequence: Synthetic polypeptide
YEEEIRTTNPVATEQYGCAVSNSNQTIRNGNRF

SEQ ID NO: 82821 - protein, 31 aa, Artificial Sequence
  Description of Artificial Sequence: Synthetic polypeptide
DEEEIRSTNPTATEQYGTVSTMNISEGGMIR

SEQ ID NO: 82822 - protein, 34 aa, Artificial Sequence
  Description of Artificial Sequence: Synthetic polypeptide
AEEEIRTTNPVATEQYGSVSTTTNLQGNPNNNQN

SEQ ID NO: 82823 - protein, 33 aa, Artificial Sequence
  Description of Artificial Sequence: Synthetic polypeptide
DEEEISTTNPVATEQYGCVCSWNLQNFGSDNQS

SEQ ID NO: 82824 - protein, 31 aa, Artificial Sequence
  Description of Artificial Sequence: Synthetic polypeptide
DEEEIRTTNPVATEQWGTVSTNSEGSRLLES

SEQ ID NO: 82825 - protein, 35 aa, Artificial Sequence
  Description of Artificial Sequence: Synthetic polypeptide
AEEEIRTTNPVATEQYGSVSTTTNLQQGAEGGNNA

SEQ ID NO: 82826 - protein, 34 aa, Artificial Sequence
  Description of Artificial Sequence: Synthetic polypeptide
DEEEIRTTNPVATEQYGNVVDDTMNLGQGGTNDD

SEQ ID NO: 82827 - protein, 28 aa, Artificial Sequence
  Description of Artificial Sequence: Synthetic peptide
YESEIASVNPVCTEQYGVVSDNLQSGNQ

SEQ ID NO: 82828 - protein, 34 aa, Artificial Sequence
  Description of Artificial Sequence: Synthetic polypeptide
DENEIRTTNPVATEQYGSVSATEDLQEDHNGNDL

SEQ ID NO: 82829 - protein, 33 aa, Artificial Sequence
  Description of Artificial Sequence: Synthetic polypeptide
DEEEISTTNPVATEQYGCVCSWNLDQNFGSNQS

SEQ ID NO: 82830 - protein, 34 aa, Artificial Sequence
  Description of Artificial Sequence: Synthetic polypeptide
YEEEIRTTNPVATEQYGCAVSNSNLTQRNGSNVF

SEQ ID NO: 82831 - protein, 33 aa, Artificial Sequence
  Description of Artificial Sequence: Synthetic polypeptide
DEEEIRTTNPVAYEQYGQSVSTNDLLQPEFIIS

SEQ ID NO: 82832 - protein, 28 aa, Artificial Sequence
  Description of Artificial Sequence: Synthetic peptide
YESEIASVNPVCTEQYGVVSDNLQHGNQ

SEQ ID NO: 82833 - protein, 35 aa, Artificial Sequence
  Description of Artificial Sequence: Synthetic polypeptide
AEEEIRTTNPVATEQYGSVSTTTNLQQGDEGNGNE

SEQ ID NO: 82834 - protein, 29 aa, Artificial Sequence
  Description of Artificial Sequence: Synthetic peptide
YEEEIASVNPVCTEQYGVVSADTLQRGNQ

SEQ ID NO: 82835 - protein, 35 aa, Artificial Sequence
  Description of Artificial Sequence: Synthetic polypeptide
AEEEIRTTNPVATEQYGSVSTTTNLQQGNGEGEDE

SEQ ID NO: 82836 - protein, 34 aa, Artificial Sequence
  Description of Artificial Sequence: Synthetic polypeptide
YEEEIRTTNPVATEQYGCAVSNSNLTQLRNGVRF

SEQ ID NO: 82837 - protein, 32 aa, Artificial Sequence
  Description of Artificial Sequence: Synthetic polypeptide
DEEEIRCTNPISTEQYGTVSEENLQQQRNGNH

SEQ ID NO: 82838 - protein, 34 aa, Artificial Sequence
  Description of Artificial Sequence: Synthetic polypeptide
YEEEIRTTNPVATEQYGCAVSNSNLTQLNGNYRN

SEQ ID NO: 82839 - protein, 29 aa, Artificial Sequence
  Description of Artificial Sequence: Synthetic peptide
YEEEIASVNPVCTEQYGVVSADTLQSGNR

SEQ ID NO: 82840 - protein, 33 aa, Artificial Sequence
  Description of Artificial Sequence: Synthetic polypeptide
YEEEIRTTNPVATEQYGCAVSNSNLTSHNGNRN

SEQ ID NO: 82841 - protein, 32 aa, Artificial Sequence
  Description of Artificial Sequence: Synthetic polypeptide
DENEIRTTNPVATEQYGSVSATDIEQQEGEDH

SEQ ID NO: 82842 - protein, 35 aa, Artificial Sequence
  Description of Artificial Sequence: Synthetic polypeptide
DEEEIRTTNPVAYEQYGQSVSTNDLLQPENGIIRI

SEQ ID NO: 82843 - protein, 29 aa, Artificial Sequence
  Description of Artificial Sequence: Synthetic peptide
YEEEIASVNPVCTEQYGVVSADNLQSGNQ

SEQ ID NO: 82844 - protein, 29 aa, Artificial Sequence
  Description of Artificial Sequence: Synthetic peptide
YEEEIASVNPVCTEQYGVVHSDNLQSGNQ

SEQ ID NO: 82845 - protein, 32 aa, Artificial Sequence
  Description of Artificial Sequence: Synthetic polypeptide
DEEEISTTNPVATEQYGCVSNTEDQNFGSENQ

SEQ ID NO: 82846 - protein, 28 aa, Artificial Sequence
  Description of Artificial Sequence: Synthetic peptide
YESEIASVNPVCTEQYGVVSNNLQSGNQ

SEQ ID NO: 82847 - protein, 34 aa, Artificial Sequence
  Description of Artificial Sequence: Synthetic polypeptide
AEEEIRTTNPVATEQYGSVSTTTNLLQNEGETTG

SEQ ID NO: 82848 - protein, 34 aa, Artificial Sequence
  Description of Artificial Sequence: Synthetic polypeptide
AEEEIRTTNPVATEQYGSVSTTTNLLQNEGGTEG

SEQ ID NO: 82849 - protein, 30 aa, Artificial Sequence
  Description of Artificial Sequence: Synthetic polypeptide
DEEEIRSTNPVATEGYGSVSTAGNMHGMDV

SEQ ID NO: 82850 - protein, 34 aa, Artificial Sequence
  Description of Artificial Sequence: Synthetic polypeptide
AEEEIRTTNPVATEQYGSVSTTTNLLQNEIGEEG

SEQ ID NO: 82851 - protein, 33 aa, Artificial Sequence
  Description of Artificial Sequence: Synthetic polypeptide
DEEEIRTTNPVATEQYGSCSAGNALGQTDNNNK

SEQ ID NO: 82852 - protein, 35 aa, Artificial Sequence
  Description of Artificial Sequence: Synthetic polypeptide
AEEEIRTTNPVATEQYGSVSTTTNLLQNENGNETG

SEQ ID NO: 82853 - protein, 29 aa, Artificial Sequence
  Description of Artificial Sequence: Synthetic peptide
YEEEIASVNPVCTEQYGVVNSDNLQSGNQ

SEQ ID NO: 82854 - protein, 32 aa, Artificial Sequence
  Description of Artificial Sequence: Synthetic polypeptide
DEEEISTTNPVATEQYGCVCSWNLQNFNSNQM

SEQ ID NO: 82855 - protein, 33 aa, Artificial Sequence
  Description of Artificial Sequence: Synthetic polypeptide
AEEEIRTTNPVATEQYGSVSTTTNLNAGQTTTG

SEQ ID NO: 82856 - protein, 32 aa, Artificial Sequence
  Description of Artificial Sequence: Synthetic polypeptide
DEAEIRATNPVATDQYGFVSMTNLFQGIGENE

SEQ ID NO: 82857 - protein, 34 aa, Artificial Sequence
  Description of Artificial Sequence: Synthetic polypeptide
AEEEIRTTNPVATEQYGSVSTTTNLNQNEGTEGS

SEQ ID NO: 82858 - protein, 29 aa, Artificial Sequence
  Description of Artificial Sequence: Synthetic peptide
YEEEIASVNPVCTEQYGVVSADNLQEGNQ

SEQ ID NO: 82859 - protein, 29 aa, Artificial Sequence
  Description of Artificial Sequence: Synthetic peptide
YEEEIASVNPVCTEQYGVVSADNLQFGNQ

SEQ ID NO: 82860 - protein, 32 aa, Artificial Sequence
  Description of Artificial Sequence: Synthetic polypeptide
DEEEISTTNPVATEQYGCVCSWYLQNFGSENQ

SEQ ID NO: 82861 - protein, 32 aa, Artificial Sequence
  Description of Artificial Sequence: Synthetic polypeptide
DEEEISTTNPVATEQYGCVCSWNTQNFGSNQG

SEQ ID NO: 82862 - protein, 29 aa, Artificial Sequence
  Description of Artificial Sequence: Synthetic peptide
YEEEIASVNPVCTEQYGVVSADNLQHGNQ

SEQ ID NO: 82863 - protein, 33 aa, Artificial Sequence
  Description of Artificial Sequence: Synthetic polypeptide
DEEEISTTNPVATEQYGCVCSWNLQSFGSENQA

SEQ ID NO: 82864 - protein, 33 aa, Artificial Sequence
  Description of Artificial Sequence: Synthetic polypeptide
DEEEIRTTNPVAYEQYGSVVWCTNMLSQVPDSR

SEQ ID NO: 82865 - protein, 32 aa, Artificial Sequence
  Description of Artificial Sequence: Synthetic polypeptide
DEEEIRTTNPVATEQYGSVTWPGVLNQRVEEE

SEQ ID NO: 82866 - protein, 33 aa, Artificial Sequence
  Description of Artificial Sequence: Synthetic polypeptide
DEEEIRTTNPVATEFYGVVVMTDNLQARNIIND

SEQ ID NO: 82867 - protein, 32 aa, Artificial Sequence
  Description of Artificial Sequence: Synthetic polypeptide
DEEEIRCTNPVATECWGSVSCINEMDREGENR

SEQ ID NO: 82868 - protein, 29 aa, Artificial Sequence
  Description of Artificial Sequence: Synthetic peptide
YEEEIASVNPVCTEQYGVVSANLTQSGNQ

SEQ ID NO: 82869 - protein, 28 aa, Artificial Sequence
  Description of Artificial Sequence: Synthetic peptide
YESEIASVNPVCTEQYGVVSDNLQHGNI

SEQ ID NO: 82870 - protein, 28 aa, Artificial Sequence
  Description of Artificial Sequence: Synthetic peptide
YEEEIASVNPVCTEQYGVVSDCLQHGNQ

SEQ ID NO: 82871 - protein, 32 aa, Artificial Sequence
  Description of Artificial Sequence: Synthetic polypeptide
DEEEIRTTNPVATEQYGSVYSNVNTPLNMEVQ

SEQ ID NO: 82872 - protein, 33 aa, Artificial Sequence
  Description of Artificial Sequence: Synthetic polypeptide
YEEEIRTTNPVATEQYGAVVETTNANQCFGNRS

SEQ ID NO: 82873 - protein, 33 aa, Artificial Sequence
  Description of Artificial Sequence: Synthetic polypeptide
DEEEIRTTNPVATEQYGSVTSTTNDLDWASMEG

SEQ ID NO: 82874 - protein, 35 aa, Artificial Sequence
  Description of Artificial Sequence: Synthetic polypeptide
AEEEIRTTNPVATEQYGSVSTTTNLQQNDEGNNNE

SEQ ID NO: 82875 - protein, 33 aa, Artificial Sequence
  Description of Artificial Sequence: Synthetic polypeptide
DEEEIRTTNPVATEQYGSCQSPTTDGQRNVQRL

SEQ ID NO: 82876 - protein, 32 aa, Artificial Sequence
  Description of Artificial Sequence: Synthetic polypeptide
DEEEIRTTNPVATEQYGQYTISTDGGQDGGNG

SEQ ID NO: 82877 - protein, 32 aa, Artificial Sequence
  Description of Artificial Sequence: Synthetic polypeptide
DEEEIRTTNPVAYEQYGSVWTPLQVVFDSIRE

SEQ ID NO: 82878 - protein, 34 aa, Artificial Sequence
  Description of Artificial Sequence: Synthetic polypeptide
DEEEIRTTNPVATEQYGNVVSTFTNEQTGGGNEG

SEQ ID NO: 82879 - protein, 33 aa, Artificial Sequence
  Description of Artificial Sequence: Synthetic polypeptide
DEAEIRATNPVATEQYGFVMSMTNLFEGEGENR

SEQ ID NO: 82880 - protein, 34 aa, Artificial Sequence
  Description of Artificial Sequence: Synthetic polypeptide
DEEEIRTTNPVATEQYGSCQSQTPNCIQEQELNR

SEQ ID NO: 82881 - protein, 28 aa, Artificial Sequence
  Description of Artificial Sequence: Synthetic peptide
YEREIASVNPVCTEQYGVVSDNLQSGNQ

SEQ ID NO: 82882 - protein, 33 aa, Artificial Sequence
  Description of Artificial Sequence: Synthetic polypeptide
DEEEIRCTNPVATECWGSVSCINEPQDREGENR

SEQ ID NO: 82883 - protein, 35 aa, Artificial Sequence
  Description of Artificial Sequence: Synthetic polypeptide
AEEEIRTTNPVATEQYGSVSTTTNLQQNEQGNNNS

SEQ ID NO: 82884 - protein, 28 aa, Artificial Sequence
  Description of Artificial Sequence: Synthetic peptide
YEEEIASVNPVCTEQYGVVSDCLQSGNL

SEQ ID NO: 82885 - protein, 28 aa, Artificial Sequence
  Description of Artificial Sequence: Synthetic peptide
YEEEIASVNPVCTEQYGVVSDCLQSGNQ

SEQ ID NO: 82886 - protein, 33 aa, Artificial Sequence
  Description of Artificial Sequence: Synthetic polypeptide
DEEEIRTTNPVATEGYGSVYSSTDCIQKTYNRE

SEQ ID NO: 82887 - protein, 35 aa, Artificial Sequence
  Description of Artificial Sequence: Synthetic polypeptide
AEEEIRTTNPVATEQYGSVSTTTNLQQQNGTTNAD

SEQ ID NO: 82888 - protein, 35 aa, Artificial Sequence
  Description of Artificial Sequence: Synthetic polypeptide
AEEEIRTTNPVATEQYGSVSTTTNLQQQNNGNQQD

SEQ ID NO: 82889 - protein, 34 aa, Artificial Sequence
  Description of Artificial Sequence: Synthetic polypeptide
AEEEIRTTNPVATEQYGSVSTTTNLQQQNTAEND

SEQ ID NO: 82890 - protein, 34 aa, Artificial Sequence
  Description of Artificial Sequence: Synthetic polypeptide
AEEEIRTTNPVATEQYGSVSTTTNLQQQNTNDGE

SEQ ID NO: 82891 - protein, 28 aa, Artificial Sequence
  Description of Artificial Sequence: Synthetic peptide
YEEEIASVNPVCTEQYGVVSDCLQTGNQ

SEQ ID NO: 82892 - protein, 34 aa, Artificial Sequence
  Description of Artificial Sequence: Synthetic polypeptide
AEEEIRTTNPVATEQYGSVSTTTNLQQNEQGEQG

SEQ ID NO: 82893 - protein, 28 aa, Artificial Sequence
  Description of Artificial Sequence: Synthetic peptide
YEEEIASVNPVCTEQYGVVSDALQSGNV

SEQ ID NO: 82894 - protein, 35 aa, Artificial Sequence
  Description of Artificial Sequence: Synthetic polypeptide
AEEEIRTTNPVATEQYGSVSTTTNLQQGSTDGENQ

SEQ ID NO: 82895 - protein, 33 aa, Artificial Sequence
  Description of Artificial Sequence: Synthetic polypeptide
YEEEIRTTNPVATEQYGAVVEWTNANQLCEGNR

SEQ ID NO: 82896 - protein, 29 aa, Artificial Sequence
  Description of Artificial Sequence: Synthetic peptide
YEEEIASVNPVCTEQYGVVSATDLQSGNQ

SEQ ID NO: 82897 - protein, 32 aa, Artificial Sequence
  Description of Artificial Sequence: Synthetic polypeptide
DENEIRTTNPVATEQYGSVSATDIEDQEGEDH

SEQ ID NO: 82898 - protein, 34 aa, Artificial Sequence
  Description of Artificial Sequence: Synthetic polypeptide
YEEEIRTTNPVATEQYGCAVSNSNLTHRNGNPRF

SEQ ID NO: 82899 - protein, 34 aa, Artificial Sequence
  Description of Artificial Sequence: Synthetic polypeptide
YEEEIRTTNPVATEQYGCAVSNSGNLTPRNGNRF

SEQ ID NO: 82900 - protein, 35 aa, Artificial Sequence
  Description of Artificial Sequence: Synthetic polypeptide
AEEEIRTTNPVATEQYGSVSTTTNLQQGNVTNQVD

SEQ ID NO: 82901 - protein, 32 aa, Artificial Sequence
  Description of Artificial Sequence: Synthetic polypeptide
DEAEIRTTNPVATEQYGSFNSTNEQNSGQEIS

SEQ ID NO: 82902 - protein, 34 aa, Artificial Sequence
  Description of Artificial Sequence: Synthetic polypeptide
YEEEIRTTNPVATEQYGCAVSNSCLTQRNGDNRF

SEQ ID NO: 82903 - protein, 33 aa, Artificial Sequence
  Description of Artificial Sequence: Synthetic polypeptide
YEEEIRTTNPVATEQYGCAVRNSNLTQRNGGRF

SEQ ID NO: 82904 - protein, 33 aa, Artificial Sequence
  Description of Artificial Sequence: Synthetic polypeptide
DEEEISTTNPVATEQYGCVCSWMNLQNFGSNQS

SEQ ID NO: 82905 - protein, 35 aa, Artificial Sequence
  Description of Artificial Sequence: Synthetic polypeptide
YEEEIRTTNPVATEQYGCAVASNSNLTQRNGENRN

SEQ ID NO: 82906 - protein, 28 aa, Artificial Sequence
  Description of Artificial Sequence: Synthetic peptide
YEEEIASVNPVCTEQYGVVSCDLQSGNQ

SEQ ID NO: 82907 - protein, 34 aa, Artificial Sequence
  Description of Artificial Sequence: Synthetic polypeptide
YEEEIRTTNPVATEQYGCACSNSNLTQDRNGNRF

SEQ ID NO: 82908 - protein, 32 aa, Artificial Sequence
  Description of Artificial Sequence: Synthetic polypeptide
DEEEIRTTNPVATEQYGSVSYLNEEQLLVPQE

SEQ ID NO: 82909 - protein, 33 aa, Artificial Sequence
  Description of Artificial Sequence: Synthetic polypeptide
DEEEISTTNPVATEQYGCVCSWGNLQNFGSNTQ

SEQ ID NO: 82910 - protein, 32 aa, Artificial Sequence
  Description of Artificial Sequence: Synthetic polypeptide
DEEEIRTTNPVAYEQYGSVWDNDLQVFDSIRE

SEQ ID NO: 82911 - protein, 32 aa, Artificial Sequence
  Description of Artificial Sequence: Synthetic polypeptide
YEEEIRTTNPVATEQYGAYLNTNLYCRGTDRY

SEQ ID NO: 82912 - protein, 29 aa, Artificial Sequence
  Description of Artificial Sequence: Synthetic peptide
YEEEIASVNPVCTEQYGVVSCDNLQSGNQ

SEQ ID NO: 82913 - protein, 33 aa, Artificial Sequence
  Description of Artificial Sequence: Synthetic polypeptide
DEEEIRTTNPVATEQYGSCQSTPNEIPEQEANT

SEQ ID NO: 82914 - protein, 29 aa, Artificial Sequence
  Description of Artificial Sequence: Synthetic peptide
YEEEIASVNPVCTEQYGVVSCNLQGGHNQ

SEQ ID NO: 82915 - protein, 28 aa, Artificial Sequence
  Description of Artificial Sequence: Synthetic peptide
YEEEIASVNPVCTEQYGVVSCNLQSGTQ

SEQ ID NO: 82916 - protein, 35 aa, Artificial Sequence
  Description of Artificial Sequence: Synthetic polypeptide
AEEEIRTTNPVATEQYGSVSTTTNLQQGSNEQEDE

SEQ ID NO: 82917 - protein, 28 aa, Artificial Sequence
  Description of Artificial Sequence: Synthetic peptide
YEEEIASVNPVCTEQYGVVSDALQSGNQ

SEQ ID NO: 82918 - protein, 34 aa, Artificial Sequence
  Description of Artificial Sequence: Synthetic polypeptide
DEEEIRTTNPVATEQYGSCQSTGNEIAQEQEANR

SEQ ID NO: 82919 - protein, 31 aa, Artificial Sequence
  Description of Artificial Sequence: Synthetic polypeptide
DENEIRTTNPVATEQYGSVSCLLQINDSQEG

SEQ ID NO: 82920 - protein, 28 aa, Artificial Sequence
  Description of Artificial Sequence: Synthetic peptide
YEEEIASVNPVCTEQYGVVGDNLQSGNQ

SEQ ID NO: 82921 - protein, 29 aa, Artificial Sequence
  Description of Artificial Sequence: Synthetic peptide
YEEEIASVNPVCTEQYGVVFSDNLQSGNQ

SEQ ID NO: 82922 - protein, 28 aa, Artificial Sequence
  Description of Artificial Sequence: Synthetic peptide
DEEEIRSTNPVATEQWGDVSDNEMAEDQ

SEQ ID NO: 82923 - protein, 32 aa, Artificial Sequence
  Description of Artificial Sequence: Synthetic polypeptide
DEEEISTTNPVATEQYGCVSTEHQHFGSNNQF

SEQ ID NO: 82924 - protein, 28 aa, Artificial Sequence
  Description of Artificial Sequence: Synthetic peptide
YEEEIASVNPVCTEQYGVVCDNLQSGNS

SEQ ID NO: 82925 - protein, 35 aa, Artificial Sequence
  Description of Artificial Sequence: Synthetic polypeptide
YEEEIRTTNPVATEQYGCCVCSATVNSLTQDGNRY

SEQ ID NO: 82926 - protein, 30 aa, Artificial Sequence
  Description of Artificial Sequence: Synthetic polypeptide
DEEEIRTTNPVATEQWGVVSDILMNAAENQ

SEQ ID NO: 82927 - protein, 33 aa, Artificial Sequence
  Description of Artificial Sequence: Synthetic polypeptide
DEEEIRTTNPVAYEQYGSVPSYTGLGVVGNDQC

SEQ ID NO: 82928 - protein, 29 aa, Artificial Sequence
  Description of Artificial Sequence: Synthetic peptide
DENEIATTNPVATEQYGDVCSTGPEHENL

SEQ ID NO: 82929 - protein, 30 aa, Artificial Sequence
  Description of Artificial Sequence: Synthetic polypeptide
DEEEISTTNPVATEQYGCVSSELQNNSEQS

SEQ ID NO: 82930 - protein, 33 aa, Artificial Sequence
  Description of Artificial Sequence: Synthetic polypeptide
DEEEIRTTNPVAYEQYGSVPTTNLQPVFDVSGR

SEQ ID NO: 82931 - protein, 28 aa, Artificial Sequence
  Description of Artificial Sequence: Synthetic peptide
YESEIASVNPVGTEQYGVVSSNLQSGNQ

SEQ ID NO: 82932 - protein, 31 aa, Artificial Sequence
  Description of Artificial Sequence: Synthetic polypeptide
SEEEIACTNPVATEQYGCVATNLQRDDNSED

SEQ ID NO: 82933 - protein, 30 aa, Artificial Sequence
  Description of Artificial Sequence: Synthetic polypeptide
DENEIATTNPVATEQYGDVCSTDGPQHEND

SEQ ID NO: 82934 - protein, 32 aa, Artificial Sequence
  Description of Artificial Sequence: Synthetic polypeptide
DEEEISTTNPVATEQYGCVSNTPLQNFGSEQQ

SEQ ID NO: 82935 - protein, 30 aa, Artificial Sequence
  Description of Artificial Sequence: Synthetic polypeptide
DENEIATTNPVATEQYGDVSAECLQHEGEL

SEQ ID NO: 82936 - protein, 31 aa, Artificial Sequence
  Description of Artificial Sequence: Synthetic polypeptide
DENEIATTNPVATEQYGDVSATCLQHEGEDL

SEQ ID NO: 82937 - protein, 28 aa, Artificial Sequence
  Description of Artificial Sequence: Synthetic peptide
YESEIASVNPVGTEQYGVVSSNLQSGNI

SEQ ID NO: 82938 - protein, 31 aa, Artificial Sequence
  Description of Artificial Sequence: Synthetic polypeptide
SEEEIACTNPVATEQYGCVATNLQRNADLRV

SEQ ID NO: 82939 - protein, 33 aa, Artificial Sequence
  Description of Artificial Sequence: Synthetic polypeptide
AEEEIRTTNPVATEQYGSVSTTTGNQQGNPNTE

SEQ ID NO: 82940 - protein, 30 aa, Artificial Sequence
  Description of Artificial Sequence: Synthetic polypeptide
SEEEIACTNPVATEQYGCVATNLQTAEDNN

SEQ ID NO: 82941 - protein, 34 aa, Artificial Sequence
  Description of Artificial Sequence: Synthetic polypeptide
DEEEIRCTNPIATEQYGSVSSTTPNLPNMRNGNV

SEQ ID NO: 82942 - protein, 29 aa, Artificial Sequence
  Description of Artificial Sequence: Synthetic peptide
YEEEIASVNPVCTEQYGVVCSDNLQSGNK

SEQ ID NO: 82943 - protein, 32 aa, Artificial Sequence
  Description of Artificial Sequence: Synthetic polypeptide
DEEEIRTTNPVATEQYGNVSGNLDTNEMGDII

SEQ ID NO: 82944 - protein, 34 aa, Artificial Sequence
  Description of Artificial Sequence: Synthetic polypeptide
DEEEIRTTNPVATEQWGVSNVSYTNLLQGVSGGF

SEQ ID NO: 82945 - protein, 28 aa, Artificial Sequence
  Description of Artificial Sequence: Synthetic peptide
YEEEIASVNPVCTEQYGVVCNNLQSGNQ

SEQ ID NO: 82946 - protein, 35 aa, Artificial Sequence
  Description of Artificial Sequence: Synthetic polypeptide
DEEEIRTTNPVATEQYGSVTVVTENLNQNAIGENT

SEQ ID NO: 82947 - protein, 34 aa, Artificial Sequence
  Description of Artificial Sequence: Synthetic polypeptide
YEEEIRTTNPVATEQYGCVCSATSNSDTQDGNPR

SEQ ID NO: 82948 - protein, 33 aa, Artificial Sequence
  Description of Artificial Sequence: Synthetic polypeptide
AEEEIRTTNPVATEQYGSVSTTSTQLQTIGEGT

SEQ ID NO: 82949 - protein, 34 aa, Artificial Sequence
  Description of Artificial Sequence: Synthetic polypeptide
AEEEIRTTNPVATEQYGSVSTTSNNNQEEGTNVD

SEQ ID NO: 82950 - protein, 32 aa, Artificial Sequence
  Description of Artificial Sequence: Synthetic polypeptide
DEEEIRTTNPVATEQYGSVSYEGGQQIMMLRD

SEQ ID NO: 82951 - protein, 33 aa, Artificial Sequence
  Description of Artificial Sequence: Synthetic polypeptide
DEEEIRTTNPVAYEQYGSVPNYTPGLGVVGNRC

SEQ ID NO: 82952 - protein, 35 aa, Artificial Sequence
  Description of Artificial Sequence: Synthetic polypeptide
DEEEIRTTNPVATEQYGNTVPSTNALSPRPGGDDR

SEQ ID NO: 82953 - protein, 35 aa, Artificial Sequence
  Description of Artificial Sequence: Synthetic polypeptide
DEEEIRTTNPVATEQYGNTVPSTNAQSQFPGGNDR

SEQ ID NO: 82954 - protein, 34 aa, Artificial Sequence
  Description of Artificial Sequence: Synthetic polypeptide
DEEEIRTTNPVAYEQYGSVPSCFNAPSQDNGTNR

SEQ ID NO: 82955 - protein, 33 aa, Artificial Sequence
  Description of Artificial Sequence: Synthetic polypeptide
DEEEIRSTNPVATEQYGDVSTDNGTQGEGGNDD

SEQ ID NO: 82956 - protein, 31 aa, Artificial Sequence
  Description of Artificial Sequence: Synthetic polypeptide
DENEIRTTNPVATEQYGSVSDVWADQEGEID

SEQ ID NO: 82957 - protein, 31 aa, Artificial Sequence
  Description of Artificial Sequence: Synthetic polypeptide
DEEEIRTTNPVATEQYGNVFGDGNQTQGNGG

SEQ ID NO: 82958 - protein, 28 aa, Artificial Sequence
  Description of Artificial Sequence: Synthetic peptide
YEEEIASVNPVCTEQYGVVASNLQSGNQ

SEQ ID NO: 82959 - protein, 32 aa, Artificial Sequence
  Description of Artificial Sequence: Synthetic polypeptide
DEEEIRTTNPVATEQYGNVFGDLGQTEQGNGQ

SEQ ID NO: 82960 - protein, 33 aa, Artificial Sequence
  Description of Artificial Sequence: Synthetic polypeptide
DEEEIRTTNPVATEGYGSVVDTVNMFDRGISNG

SEQ ID NO: 82961 - protein, 31 aa, Artificial Sequence
  Description of Artificial Sequence: Synthetic polypeptide
SEEEIACTNPVATEQYGCVATNLQGEGNDID

SEQ ID NO: 82962 - protein, 35 aa, Artificial Sequence
  Description of Artificial Sequence: Synthetic polypeptide
DEEEIRTTNPVATEQYGSVTVVTENLNQAIGTNNT

SEQ ID NO: 82963 - protein, 30 aa, Artificial Sequence
  Description of Artificial Sequence: Synthetic polypeptide
DEEEIRSTNPVATEQYGDVSDILMNSAENA

SEQ ID NO: 82964 - protein, 28 aa, Artificial Sequence
  Description of Artificial Sequence: Synthetic peptide
YEEEIASVNPVCTEQYGVVCDNLQSGNQ

SEQ ID NO: 82965 - protein, 31 aa, Artificial Sequence
  Description of Artificial Sequence: Synthetic polypeptide
DEEEISTTNPVATEQYGCVSTEHQNFNSQQS

SEQ ID NO: 82966 - protein, 34 aa, Artificial Sequence
  Description of Artificial Sequence: Synthetic polypeptide
AEEEIRTTNPVATEQYGSVSTTSNQQQQEGNNET

SEQ ID NO: 82967 - protein, 32 aa, Artificial Sequence
  Description of Artificial Sequence: Synthetic polypeptide
DEEEIRCTNPIATEQYGSVSATDLEDHEGEDR

SEQ ID NO: 82968 - protein, 34 aa, Artificial Sequence
  Description of Artificial Sequence: Synthetic polypeptide
DEEEIRTTNPVAYEQYGSVPSTGNEHSQERDVIR

SEQ ID NO: 82969 - protein, 32 aa, Artificial Sequence
  Description of Artificial Sequence: Synthetic polypeptide
AEEEIRTTNPVATEQYGSVSTTSTQLNAGTTG

SEQ ID NO: 82970 - protein, 33 aa, Artificial Sequence
  Description of Artificial Sequence: Synthetic polypeptide
DEEEIRCTNPIATEQYGSVSSTTPALNRGMNPV

SEQ ID NO: 82971 - protein, 34 aa, Artificial Sequence
  Description of Artificial Sequence: Synthetic polypeptide
YEEEIRTTNPVATEQYGCVCSATSNSFTQDGNRY

SEQ ID NO: 82972 - protein, 34 aa, Artificial Sequence
  Description of Artificial Sequence: Synthetic polypeptide
AEEEIRTTNPVATEQYGSVSTTTNDNQDEGNNDE

SEQ ID NO: 82973 - protein, 28 aa, Artificial Sequence
  Description of Artificial Sequence: Synthetic peptide
SEEEIACTNPVATEQYGEAPENCQHGNK

SEQ ID NO: 82974 - protein, 34 aa, Artificial Sequence
  Description of Artificial Sequence: Synthetic polypeptide
DEEEIRTTNPVATEQWGVSNVSTTNYLQEDNGGF

SEQ ID NO: 82975 - protein, 34 aa, Artificial Sequence
  Description of Artificial Sequence: Synthetic polypeptide
DEEEIRTTNPVATEQYGSCSAVNPLDQHRSFERD

SEQ ID NO: 82976 - protein, 33 aa, Artificial Sequence
  Description of Artificial Sequence: Synthetic polypeptide
YEEEIRTTNPVATEQYGCAWSTPNLVQRGEQGL

SEQ ID NO: 82977 - protein, 32 aa, Artificial Sequence
  Description of Artificial Sequence: Synthetic polypeptide
DEEEISTTNPVATEQYGCVSNTELQNFNSEQS

SEQ ID NO: 82978 - protein, 33 aa, Artificial Sequence
  Description of Artificial Sequence: Synthetic polypeptide
DEEEIRTTNPVATEQYGNVSSTVNMQDQQGEGG

SEQ ID NO: 82979 - protein, 32 aa, Artificial Sequence
  Description of Artificial Sequence: Synthetic polypeptide
DEAEINTTNPVATEQYGSVSTDNSWFTVRGEF

SEQ ID NO: 82980 - protein, 29 aa, Artificial Sequence
  Description of Artificial Sequence: Synthetic peptide
DENEIATTNPVATEQYGDVSEIEMRAGGA

SEQ ID NO: 82981 - protein, 33 aa, Artificial Sequence
  Description of Artificial Sequence: Synthetic polypeptide
YEEEIRTTNPVATEQYGCAVSNSYLTQMNGNRF

SEQ ID NO: 82982 - protein, 32 aa, Artificial Sequence
  Description of Artificial Sequence: Synthetic polypeptide
DEEEIRTTNPVATEQWGTVVTTTTNLLGGNQS

SEQ ID NO: 82983 - protein, 33 aa, Artificial Sequence
  Description of Artificial Sequence: Synthetic polypeptide
YEEEIRTTNPVATEQYGCAVSNSQLTPRNGNRN

SEQ ID NO: 82984 - protein, 31 aa, Artificial Sequence
  Description of Artificial Sequence: Synthetic polypeptide
DEEEIRTTNPVATEQWGTVVTTTTLLGGNNS

SEQ ID NO: 82985 - protein, 35 aa, Artificial Sequence
  Description of Artificial Sequence: Synthetic polypeptide
AEEEIRTTNPVATEQYGSVSTTTNLGNQQGNNNVD

SEQ ID NO: 82986 - protein, 34 aa, Artificial Sequence
  Description of Artificial Sequence: Synthetic polypeptide
DEEEIRTTNPVATEQYGNVSSTVNMQDQGGETNA

SEQ ID NO: 82987 - protein, 33 aa, Artificial Sequence
  Description of Artificial Sequence: Synthetic polypeptide
DEEEIRTTNPVAYEQYGSVVCCTGNSTYRGGTR

SEQ ID NO: 82988 - protein, 35 aa, Artificial Sequence
  Description of Artificial Sequence: Synthetic polypeptide
AEEEIRTTNPVATEQYGSVSTTTNLGQNNNGNQND

SEQ ID NO: 82989 - protein, 35 aa, Artificial Sequence
  Description of Artificial Sequence: Synthetic polypeptide
YEEEIRTTNPVATEQYGCAVSNSNVLTQRNGNNRN

SEQ ID NO: 82990 - protein, 34 aa, Artificial Sequence
  Description of Artificial Sequence: Synthetic polypeptide
AEEEIRTTNPVATEQYGSVSTTTNLGQQEGEAGN

SEQ ID NO: 82991 - protein, 32 aa, Artificial Sequence
  Description of Artificial Sequence: Synthetic polypeptide
DEEEIRTTNPVATEQYGSVSYESMQQIMMARD

SEQ ID NO: 82992 - protein, 32 aa, Artificial Sequence
  Description of Artificial Sequence: Synthetic polypeptide
DEEEIRTTNPVATEQWGTVVTTTNLLGGNNSQ

SEQ ID NO: 82993 - protein, 29 aa, Artificial Sequence
  Description of Artificial Sequence: Synthetic peptide
YEEEIASVNPVCTEQYGVVFSDNLQGGNQ

SEQ ID NO: 82994 - protein, 31 aa, Artificial Sequence
  Description of Artificial Sequence: Synthetic polypeptide
DEEEIRTTNPVATEQWGTVVTTTELLGGNES

SEQ ID NO: 82995 - protein, 34 aa, Artificial Sequence
  Description of Artificial Sequence: Synthetic polypeptide
DEEEIRTTNPVAYEQYGSVVPSTNSSQELTEGSR

SEQ ID NO: 82996 - protein, 32 aa, Artificial Sequence
  Description of Artificial Sequence: Synthetic polypeptide
DENEIRTTNPVATEQYGSVSCNTFQGHYDGRQ

SEQ ID NO: 82997 - protein, 29 aa, Artificial Sequence
  Description of Artificial Sequence: Synthetic peptide
DENEIATTNPVATEQYGDVSEILMNAENA

SEQ ID NO: 82998 - protein, 28 aa, Artificial Sequence
  Description of Artificial Sequence: Synthetic peptide
DENEIATTNPVATEQYGDVSEILMHEDA

SEQ ID NO: 82999 - protein, 32 aa, Artificial Sequence
  Description of Artificial Sequence: Synthetic polypeptide
DEEEIRCTNPIATEQYGTVCSAEDNLEREGND

SEQ ID NO: 83000 - protein, 34 aa, Artificial Sequence
  Description of Artificial Sequence: Synthetic polypeptide
DEEEIRTTNPVATEQYGNVSSTVNMQDQGGENIT

SEQ ID NO: 83001 - protein, 31 aa, Artificial Sequence
  Description of Artificial Sequence: Synthetic polypeptide
DEEEIRTTNPVATEQWGTVVTTVTTLLGGNS

SEQ ID NO: 83002 - protein, 28 aa, Artificial Sequence
  Description of Artificial Sequence: Synthetic peptide
DEEEIRSTNPVATEQWGVVSDNEMAEDQ

SEQ ID NO: 83003 - protein, 34 aa, Artificial Sequence
  Description of Artificial Sequence: Synthetic polypeptide
DEEEIRTTNPVATEQWGVSNVSGTNNLQDIPGGF

SEQ ID NO: 83004 - protein, 34 aa, Artificial Sequence
  Description of Artificial Sequence: Synthetic polypeptide
DEEEIRCTNPIATEQYGSVSTEPALPNMRGMNPR

SEQ ID NO: 83005 - protein, 28 aa, Artificial Sequence
  Description of Artificial Sequence: Synthetic peptide
YESEIASVNPVGTEQYGVVSDNLQSGNQ

SEQ ID NO: 83006 - protein, 30 aa, Artificial Sequence
  Description of Artificial Sequence: Synthetic polypeptide
DEEEIRCTNPIATEQYGTISEENIQQQGNH

SEQ ID NO: 83007 - protein, 29 aa, Artificial Sequence
  Description of Artificial Sequence: Synthetic peptide
YEEEIASVNPVCTEQYGVVCSDNLQSGNQ

SEQ ID NO: 83008 - protein, 33 aa, Artificial Sequence
  Description of Artificial Sequence: Synthetic polypeptide
DEEEISTTNPVATEQYGCVSNTNLQNFGSEFQA

SEQ ID NO: 83009 - protein, 32 aa, Artificial Sequence
  Description of Artificial Sequence: Synthetic polypeptide
DEEEISTTNPVATEQYGCVSNTNHQNFLSNQS

SEQ ID NO: 83010 - protein, 33 aa, Artificial Sequence
  Description of Artificial Sequence: Synthetic polypeptide
DEAEIKTTNPVATEQYGSVQPCTNLSQRTSGES

SEQ ID NO: 83011 - protein, 31 aa, Artificial Sequence
  Description of Artificial Sequence: Synthetic polypeptide
DEEEIRTTNPVATEQWGTVVVTTVELLGGNS

SEQ ID NO: 83012 - protein, 31 aa, Artificial Sequence
  Description of Artificial Sequence: Synthetic polypeptide
DEEEIRTTNPVATEQWGTVVVTTTTLLGGNS

SEQ ID NO: 83013 - protein, 33 aa, Artificial Sequence
  Description of Artificial Sequence: Synthetic polypeptide
DEEEIRTTNPVATEQWGTVVVTTTNLQLGGNTS

SEQ ID NO: 83014 - protein, 34 aa, Artificial Sequence
  Description of Artificial Sequence: Synthetic polypeptide
DEEEIRTTNPVATEQYGNVSSTVNMQDGEGEEND

SEQ ID NO: 83015 - protein, 33 aa, Artificial Sequence
  Description of Artificial Sequence: Synthetic polypeptide
DEEEIRTTNPVATEQWGTVVVTTTNLQLGGNQS

SEQ ID NO: 83016 - protein, 34 aa, Artificial Sequence
  Description of Artificial Sequence: Synthetic polypeptide
DEEEIRTTNPVATEQYGNVSSTVNMQDQEGENGG

SEQ ID NO: 83017 - protein, 35 aa, Artificial Sequence
  Description of Artificial Sequence: Synthetic polypeptide
AEEEIRTTNPVATEQYGSVSTTTNLENQEEGTNND

SEQ ID NO: 83018 - protein, 32 aa, Artificial Sequence
  Description of Artificial Sequence: Synthetic polypeptide
DEEEIRTTNPVATEQWGTVVVTTTNLLGGNNS

SEQ ID NO: 83019 - protein, 35 aa, Artificial Sequence
  Description of Artificial Sequence: Synthetic polypeptide
DEEEIRTTNPVATEQYGSVTVVVTENLNQAIGNGT

SEQ ID NO: 83020 - protein, 29 aa, Artificial Sequence
  Description of Artificial Sequence: Synthetic peptide
DENEIRTTNPVATEQWGDVSEIEQNSGDA

SEQ ID NO: 83021 - protein, 30 aa, Artificial Sequence
  Description of Artificial Sequence: Synthetic polypeptide
DEACIRTTNPCAYEQWGSVSFNLDESGNKR

SEQ ID NO: 83022 - protein, 31 aa, Artificial Sequence
  Description of Artificial Sequence: Synthetic polypeptide
DENEIRTTNPVATEQYGSVSDQWADQEGEVM

SEQ ID NO: 83023 - protein, 29 aa, Artificial Sequence
  Description of Artificial Sequence: Synthetic peptide
DENEIATTNPVATEQYGDVSECLQHEEEL

SEQ ID NO: 83024 - protein, 29 aa, Artificial Sequence
  Description of Artificial Sequence: Synthetic peptide
YEEEIASVNPVCTEQYGVVCSPNLQSGNQ

SEQ ID NO: 83025 - protein, 29 aa, Artificial Sequence
  Description of Artificial Sequence: Synthetic peptide
DENEIATTNPVATEQYGDVSEALQHEEPL

SEQ ID NO: 83026 - protein, 34 aa, Artificial Sequence
  Description of Artificial Sequence: Synthetic polypeptide
DEAEIRATNPVATEQYGFVNSETTNLFQGGENRG

SEQ ID NO: 83027 - protein, 30 aa, Artificial Sequence
  Description of Artificial Sequence: Synthetic polypeptide
DENEIATTNPVATEQYGEASEDGLVQFGGR

SEQ ID NO: 83028 - protein, 31 aa, Artificial Sequence
  Description of Artificial Sequence: Synthetic polypeptide
DENEIATTNPVATEQYGSVATNLEPLDNHMN

SEQ ID NO: 83029 - protein, 31 aa, Artificial Sequence
  Description of Artificial Sequence: Synthetic polypeptide
DEEEISTTNPVATEQYGCVCSTPHQHFGSEF

SEQ ID NO: 83030 - protein, 34 aa, Artificial Sequence
  Description of Artificial Sequence: Synthetic polypeptide
DEEEIRTTNPVAYEQYGQSVSTGNDLNQGGSEQA

SEQ ID NO: 83031 - protein, 28 aa, Artificial Sequence
  Description of Artificial Sequence: Synthetic peptide
YEEEIASVNPVCTEQYGVVSDNEQSGNQ

SEQ ID NO: 83032 - protein, 34 aa, Artificial Sequence
  Description of Artificial Sequence: Synthetic polypeptide
DEEEIRCTNPVATEQYGSVSTTPNGPNMRNGGPR

SEQ ID NO: 83033 - protein, 34 aa, Artificial Sequence
  Description of Artificial Sequence: Synthetic polypeptide
AEEEIRTTNPVATEQYGSVSTTTNQQQGENGNTN

SEQ ID NO: 83034 - protein, 29 aa, Artificial Sequence
  Description of Artificial Sequence: Synthetic peptide
CEGVIATTNPVATAQWGSVSTDDLQNGNA

SEQ ID NO: 83035 - protein, 34 aa, Artificial Sequence
  Description of Artificial Sequence: Synthetic polypeptide
AEEEIRTTNPVATEQYGSVSTTTNQQQGNVTNVD

SEQ ID NO: 83036 - protein, 28 aa, Artificial Sequence
  Description of Artificial Sequence: Synthetic peptide
YEEEIASVNPVCTEQYGVVSDNFQSGNQ

SEQ ID NO: 83037 - protein, 33 aa, Artificial Sequence
  Description of Artificial Sequence: Synthetic polypeptide
DEEEIRTTNPVATEQYGSVYPTEVQQRMVENED

SEQ ID NO: 83038 - protein, 34 aa, Artificial Sequence
  Description of Artificial Sequence: Synthetic polypeptide
AEEEIRTTNPVATEQYGSVSTTTNQQQAGNIATE

SEQ ID NO: 83039 - protein, 32 aa, Artificial Sequence
  Description of Artificial Sequence: Synthetic polypeptide
DENEIATTNPVATEQYGSVCSAGNNLESEDNR

SEQ ID NO: 83040 - protein, 31 aa, Artificial Sequence
  Description of Artificial Sequence: Synthetic polypeptide
DEEEIRTTNPVATEQYGSCPTNNLEGIDQEM

SEQ ID NO: 83041 - protein, 30 aa, Artificial Sequence
  Description of Artificial Sequence: Synthetic polypeptide
YESEIASTNPVCTEQYGVVSDNLQSRVGNQ

SEQ ID NO: 83042 - protein, 33 aa, Artificial Sequence
  Description of Artificial Sequence: Synthetic polypeptide
YEEEIRTTNPVATEQYGAVVEPTNANQPFGYNR

SEQ ID NO: 83043 - protein, 33 aa, Artificial Sequence
  Description of Artificial Sequence: Synthetic polypeptide
DEEEIRTTNPVATEQYGSVSYMNQQRVAEEYST

SEQ ID NO: 83044 - protein, 28 aa, Artificial Sequence
  Description of Artificial Sequence: Synthetic peptide
YEEEIASVNPVCTEQYGVVSDNGQSGNQ

SEQ ID NO: 83045 - protein, 31 aa, Artificial Sequence
  Description of Artificial Sequence: Synthetic polypeptide
DEEEIRCTNPVATEFYGSVVTSGLEQPTGLT

SEQ ID NO: 83046 - protein, 28 aa, Artificial Sequence
  Description of Artificial Sequence: Synthetic peptide
YESEIASTNPVCTEQYGVVSDNLQSGDQ

SEQ ID NO: 83047 - protein, 28 aa, Artificial Sequence
  Description of Artificial Sequence: Synthetic peptide
YEEEIASVNPVCTEQYGVVSDNGQSGNV

SEQ ID NO: 83048 - protein, 28 aa, Artificial Sequence
  Description of Artificial Sequence: Synthetic peptide
YEEEIASVNPVCTEQYGVVSDNHQSGNQ

SEQ ID NO: 83049 - protein, 28 aa, Artificial Sequence
  Description of Artificial Sequence: Synthetic peptide
YESEIASTNPVCTEQYGVVSDTLQHGNQ

SEQ ID NO: 83050 - protein, 33 aa, Artificial Sequence
  Description of Artificial Sequence: Synthetic polypeptide
DENEIATTNPVATEQYGSVCAPTNGLQTDPGNS

SEQ ID NO: 83051 - protein, 31 aa, Artificial Sequence
  Description of Artificial Sequence: Synthetic polypeptide
SEEEIACTNPIATEQYGSVSATDLEDHEGNR

SEQ ID NO: 83052 - protein, 33 aa, Artificial Sequence
  Description of Artificial Sequence: Synthetic polypeptide
DEEEIRTTNPVAYEQYGTVCSTIDHLQRNENNN

SEQ ID NO: 83053 - protein, 33 aa, Artificial Sequence
  Description of Artificial Sequence: Synthetic polypeptide
DEEEIRTTNPVATEQYGSVSYMNLEESGQETDT

SEQ ID NO: 83054 - protein, 28 aa, Artificial Sequence
  Description of Artificial Sequence: Synthetic peptide
YEEEIASVNPVCTEQYGVVSDKLQSGNQ

SEQ ID NO: 83055 - protein, 35 aa, Artificial Sequence
  Description of Artificial Sequence: Synthetic polypeptide
DEEEIRTTNPVATEQYGSVSYMNLLAPRVGENEST

SEQ ID NO: 83056 - protein, 31 aa, Artificial Sequence
  Description of Artificial Sequence: Synthetic polypeptide
DENEIATTNPVATEQYGSVATNDQTGQGDQT

SEQ ID NO: 83057 - protein, 32 aa, Artificial Sequence
  Description of Artificial Sequence: Synthetic polypeptide
DENEIATTNPVATEQYGSVATNLEAPDNQERV

SEQ ID NO: 83058 - protein, 34 aa, Artificial Sequence
  Description of Artificial Sequence: Synthetic polypeptide
AEEEIRTTNPVATEQYGSVSTTTNQLQQGEIATE

SEQ ID NO: 83059 - protein, 35 aa, Artificial Sequence
  Description of Artificial Sequence: Synthetic polypeptide
AEEEIRTTNPVATEQYGSVSTTTNQLQQGNDENQD

SEQ ID NO: 83060 - protein, 33 aa, Artificial Sequence
  Description of Artificial Sequence: Synthetic polypeptide
DEEEIRTTNPVAYEQYGTVCSTIDHLMQREDNN

SEQ ID NO: 83061 - protein, 28 aa, Artificial Sequence
  Description of Artificial Sequence: Synthetic peptide
YEEEIASVNPVCTEQYGVVSDMLQSGNQ

SEQ ID NO: 83062 - protein, 31 aa, Artificial Sequence
  Description of Artificial Sequence: Synthetic polypeptide
SEEEIRCTNPIATEQYGSVSEDLEDREGEDR

SEQ ID NO: 83063 - protein, 34 aa, Artificial Sequence
  Description of Artificial Sequence: Synthetic polypeptide
CEHEIRTTNPVATEAYGSVSTCCNLSQRTGGNNM

SEQ ID NO: 83064 - protein, 33 aa, Artificial Sequence
  Description of Artificial Sequence: Synthetic polypeptide
DENEIATTNPVATEQYGSVATNLTDRPGPNDQA

SEQ ID NO: 83065 - protein, 33 aa, Artificial Sequence
  Description of Artificial Sequence: Synthetic polypeptide
DEEEIRTTNPVAYEQYGTVCSTIDHLQREMNQN

SEQ ID NO: 83066 - protein, 28 aa, Artificial Sequence
  Description of Artificial Sequence: Synthetic peptide
YEEEIASVNPVCTEQYGVVSDNAQSGNQ

SEQ ID NO: 83067 - protein, 33 aa, Artificial Sequence
  Description of Artificial Sequence: Synthetic polypeptide
DEEEISTTNPVATEQYGCVCSTPLQNFGSNNQF

SEQ ID NO: 83068 - protein, 32 aa, Artificial Sequence
  Description of Artificial Sequence: Synthetic polypeptide
DENEIATTNPVATEQYGSVCAANNLQPDDGND

SEQ ID NO: 83069 - protein, 32 aa, Artificial Sequence
  Description of Artificial Sequence: Synthetic polypeptide
DEEEISTTNPVATEQYGCVCSTPLQFFGSDFA

SEQ ID NO: 83070 - protein, 28 aa, Artificial Sequence
  Description of Artificial Sequence: Synthetic peptide
YEEEIASVNPVCTEQYGVVSDNCQSGNQ

SEQ ID NO: 83071 - protein, 29 aa, Artificial Sequence
  Description of Artificial Sequence: Synthetic peptide
YEEEIASVNPVCTEQYGVVSDNDLQSGNQ

SEQ ID NO: 83072 - protein, 34 aa, Artificial Sequence
  Description of Artificial Sequence: Synthetic polypeptide
DEEEIRTTNPVATEQYGSVYPTNLPETRGFDVET

SEQ ID NO: 83073 - protein, 28 aa, Artificial Sequence
  Description of Artificial Sequence: Synthetic peptide
YEEEIASVNPVCTEQYGVVSDNDQSGNQ

SEQ ID NO: 83074 - protein, 32 aa, Artificial Sequence
  Description of Artificial Sequence: Synthetic polypeptide
YEEEIRTTNPVATEQYGAVVEPTNANQAEGDR

SEQ ID NO: 83075 - protein, 31 aa, Artificial Sequence
  Description of Artificial Sequence: Synthetic polypeptide
DEEEIRTTNPVSTEQYGTISMDIQQQQNGNR

SEQ ID NO: 83076 - protein, 33 aa, Artificial Sequence
  Description of Artificial Sequence: Synthetic polypeptide
DEEEIRTTNPVATEQYGSVSYMPNQNDRGVPQI

SEQ ID NO: 83077 - protein, 28 aa, Artificial Sequence
  Description of Artificial Sequence: Synthetic peptide
YEEEIASVNPVCTEQYGVVSDNIQSGNQ

SEQ ID NO: 83078 - protein, 34 aa, Artificial Sequence
  Description of Artificial Sequence: Synthetic polypeptide
DEEEIRTTNPVATEQYGSVYPLNLPEPRGVNVET

SEQ ID NO: 83079 - protein, 31 aa, Artificial Sequence
  Description of Artificial Sequence: Synthetic polypeptide
DENEIRTTNPVATEQYGSVSANDTIEGSETH

SEQ ID NO: 83080 - protein, 35 aa, Artificial Sequence
  Description of Artificial Sequence: Synthetic polypeptide
DEEEIRTTNPVAYEQYGQSVSTENDLLQPEIGITR

SEQ ID NO: 83081 - protein, 33 aa, Artificial Sequence
  Description of Artificial Sequence: Synthetic polypeptide
DENEIRTTNPVATEQYGSVSANDQIEGSNEEHY

SEQ ID NO: 83082 - protein, 29 aa, Artificial Sequence
  Description of Artificial Sequence: Synthetic peptide
YEEEIASVNPVCTEQYGVVSDNLPQSGNQ

SEQ ID NO: 83083 - protein, 33 aa, Artificial Sequence
  Description of Artificial Sequence: Synthetic polypeptide
DEEEIRTTNPVATEQYGSVYPLANMLQSNNINH

SEQ ID NO: 83084 - protein, 34 aa, Artificial Sequence
  Description of Artificial Sequence: Synthetic polypeptide
DEEEIRTTNPVATEQYGSVYPIFNLQRVINNELP

SEQ ID NO: 83085 - protein, 34 aa, Artificial Sequence
  Description of Artificial Sequence: Synthetic polypeptide
DENEIATTNPVATEQYGSVCSPTNNLETRDGNSL

SEQ ID NO: 83086 - protein, 34 aa, Artificial Sequence
  Description of Artificial Sequence: Synthetic polypeptide
DEEEIRTTNPVATEQYGSVYPFGNEQSRMQVNER

SEQ ID NO: 83087 - protein, 28 aa, Artificial Sequence
  Description of Artificial Sequence: Synthetic peptide
YEEEIASVNPVCTEQYGVVSDNLQDGDQ

SEQ ID NO: 83088 - protein, 32 aa, Artificial Sequence
  Description of Artificial Sequence: Synthetic polypeptide
AEEEIRTTNPVATEQYGSVSTTTVLNQGTATG

SEQ ID NO: 83089 - protein, 29 aa, Artificial Sequence
  Description of Artificial Sequence: Synthetic peptide
YEEEIASVNPVCTEQYGVVSDNLQDGNMQ

SEQ ID NO: 83090 - protein, 28 aa, Artificial Sequence
  Description of Artificial Sequence: Synthetic peptide
YESEIASTNPVATECYGVVSDNEQSGNQ

SEQ ID NO: 83091 - protein, 33 aa, Artificial Sequence
  Description of Artificial Sequence: Synthetic polypeptide
DEEEIRTTNPVAYEQYGVVLCCTNNSQRGGMNS

SEQ ID NO: 83092 - protein, 33 aa, Artificial Sequence
  Description of Artificial Sequence: Synthetic polypeptide
AEEEIRTTNPVATEQYGSVSTTTVLQNNAGTTG

SEQ ID NO: 83093 - protein, 33 aa, Artificial Sequence
  Description of Artificial Sequence: Synthetic polypeptide
YEEEIRTTNPVATEQYGAVVELTENAIQCEGNR

SEQ ID NO: 83094 - protein, 29 aa, Artificial Sequence
  Description of Artificial Sequence: Synthetic peptide
YEEEIASVNPVCTEQYGVVSDNLQDSGNQ

SEQ ID NO: 83095 - protein, 33 aa, Artificial Sequence
  Description of Artificial Sequence: Synthetic polypeptide
DEEEISTTNPVATEQYGCVCSTNLQNSGSDTQS

SEQ ID NO: 83096 - protein, 28 aa, Artificial Sequence
  Description of Artificial Sequence: Synthetic peptide
YEEEIASVNPVCTEQYGVVSDNLQEPNQ

SEQ ID NO: 83097 - protein, 33 aa, Artificial Sequence
  Description of Artificial Sequence: Synthetic polypeptide
DEEEIRTTNPVAYEQYGVVQNCTNNSQRGGMNM

SEQ ID NO: 83098 - protein, 28 aa, Artificial Sequence
  Description of Artificial Sequence: Synthetic peptide
YEEEIASVNPVCTEQYGVVSDNLQGGIC

SEQ ID NO: 83099 - protein, 32 aa, Artificial Sequence
  Description of Artificial Sequence: Synthetic polypeptide
AEEEIRTTNPVATEQYGSVSTTTQQQQNIENS

SEQ ID NO: 83100 - protein, 31 aa, Artificial Sequence
  Description of Artificial Sequence: Synthetic polypeptide
DENEIATTNPVATEQYGSVASNPQRNPPGQE

SEQ ID NO: 83101 - protein, 28 aa, Artificial Sequence
  Description of Artificial Sequence: Synthetic peptide
YEEEIASVNPVCTEQYGVVSDNLMSGNQ

SEQ ID NO: 83102 - protein, 28 aa, Artificial Sequence
  Description of Artificial Sequence: Synthetic peptide
YEEEIASVNPVCTEQYGVVSDNLESGNQ

SEQ ID NO: 83103 - protein, 33 aa, Artificial Sequence
  Description of Artificial Sequence: Synthetic polypeptide
AEEEIRTTNPVATEQYGSVSTTTNQTNLGNEEV

SEQ ID NO: 83104 - protein, 33 aa, Artificial Sequence
  Description of Artificial Sequence: Synthetic polypeptide
SEEEIRCTNPIATEQYGSVSCENELSMRVGPNR

SEQ ID NO: 83105 - protein, 28 aa, Artificial Sequence
  Description of Artificial Sequence: Synthetic peptide
SEEEIACTNPIATEQYGSVPEVCMRGER

SEQ ID NO: 83106 - protein, 32 aa, Artificial Sequence
  Description of Artificial Sequence: Synthetic polypeptide
DENEIRTTNPVATEQYGSVSANMDQQEGSEEH

SEQ ID NO: 83107 - protein, 31 aa, Artificial Sequence
  Description of Artificial Sequence: Synthetic polypeptide
DEEEIRTTNPVATEQYGSVYPNTGEADNENE

SEQ ID NO: 83108 - protein, 34 aa, Artificial Sequence
  Description of Artificial Sequence: Synthetic polypeptide
DEEEIRTTNPVAYEQYGVSVSCTGNHAQRVTNQG

SEQ ID NO: 83109 - protein, 32 aa, Artificial Sequence
  Description of Artificial Sequence: Synthetic polypeptide
YEEEIRTTNPVATEQYGAVVEPTNANPYFGNR

SEQ ID NO: 83110 - protein, 34 aa, Artificial Sequence
  Description of Artificial Sequence: Synthetic polypeptide
DEEEIRTTNPVATEQWGSVVVSVTNNLQENEGGD

SEQ ID NO: 83111 - protein, 33 aa, Artificial Sequence
  Description of Artificial Sequence: Synthetic polypeptide
YEEEIRTTNPVATEQYGAVVEPTENANQWPGNR

SEQ ID NO: 83112 - protein, 33 aa, Artificial Sequence
  Description of Artificial Sequence: Synthetic polypeptide
AEEEIRTTNPVATEQYGSVSTTTQLGQTQIGGN

SEQ ID NO: 83113 - protein, 32 aa, Artificial Sequence
  Description of Artificial Sequence: Synthetic polypeptide
AEEEIRTTNPVATEQYGSVSTTTQLQGTIDTG

SEQ ID NO: 83114 - protein, 28 aa, Artificial Sequence
  Description of Artificial Sequence: Synthetic peptide
YEEEIASVNPVCTEQYGVVSDNKQSGNQ

SEQ ID NO: 83115 - protein, 34 aa, Artificial Sequence
  Description of Artificial Sequence: Synthetic polypeptide
AEEEIRTTNPVATEQYGSVSTTTQLQGTQIGNGG

SEQ ID NO: 83116 - protein, 34 aa, Artificial Sequence
  Description of Artificial Sequence: Synthetic polypeptide
DEEEISTTNPVATEQYGCVCSTNPLQEFFGSNQS

SEQ ID NO: 83117 - protein, 35 aa, Artificial Sequence
  Description of Artificial Sequence: Synthetic polypeptide
DEEEIRTTNPVATEQWGSVVSVTGNMLQFTGGERQ

SEQ ID NO: 83118 - protein, 28 aa, Artificial Sequence
  Description of Artificial Sequence: Synthetic peptide
YEEEIASVNPVCTEQYGVVSDNLEHGNQ

SEQ ID NO: 83119 - protein, 33 aa, Artificial Sequence
  Description of Artificial Sequence: Synthetic polypeptide
AEEEIRTTNPVATEQYGSVSTTTQLQTNEDEGN

SEQ ID NO: 83120 - protein, 34 aa, Artificial Sequence
  Description of Artificial Sequence: Synthetic polypeptide
DEEEIRTTNPVATEQYGSVYPMSLPQRMMPNERM

SEQ ID NO: 83121 - protein, 32 aa, Artificial Sequence
  Description of Artificial Sequence: Synthetic polypeptide
DEEEIRTTNPVATEQYGSVYPMPLQRSVEELQ

SEQ ID NO: 83122 - protein, 34 aa, Artificial Sequence
  Description of Artificial Sequence: Synthetic polypeptide
AEEEIRTTNPVATEQYGSVSTTTQQLQQGNIVTE

SEQ ID NO: 83123 - protein, 32 aa, Artificial Sequence
  Description of Artificial Sequence: Synthetic polypeptide
AEEEIRTTNPVATEQYGSVSTTTQQNNNIENQ

SEQ ID NO: 83124 - protein, 31 aa, Artificial Sequence
  Description of Artificial Sequence: Synthetic polypeptide
QEVEIATTNPVATEQYGSVATNDQDNGNENL

SEQ ID NO: 83125 - protein, 31 aa, Artificial Sequence
  Description of Artificial Sequence: Synthetic polypeptide
DEAEIRTTNPVATEQYGCVCSTAHQNFGSQQ

SEQ ID NO: 83126 - protein, 29 aa, Artificial Sequence
  Description of Artificial Sequence: Synthetic peptide
SEEEIASVNPVCTEQYGVVSSNLQSGDNQ

SEQ ID NO: 83127 - protein, 32 aa, Artificial Sequence
  Description of Artificial Sequence: Synthetic polypeptide
DEEEIRTTNPVAYEQYGTCSTINPLQDHENSN

SEQ ID NO: 83128 - protein, 32 aa, Artificial Sequence
  Description of Artificial Sequence: Synthetic polypeptide
DENEIATTNPVATEQYGSVAMNLQDQGNHNTE

SEQ ID NO: 83129 - protein, 29 aa, Artificial Sequence
  Description of Artificial Sequence: Synthetic peptide
SEEEIRCTNPIATEQYGSVSEILMNAENA

SEQ ID NO: 83130 - protein, 30 aa, Artificial Sequence
  Description of Artificial Sequence: Synthetic polypeptide
DEEEIRTTNPVATEQWGTNVSAADGLHGNS

SEQ ID NO: 83131 - protein, 28 aa, Artificial Sequence
  Description of Artificial Sequence: Synthetic peptide
YESEIASTNPVGTEQYGVVSDNLQSGDQ

SEQ ID NO: 83132 - protein, 32 aa, Artificial Sequence
  Description of Artificial Sequence: Synthetic polypeptide
DEEEIRTTNPVAYEQYGTSSVGPTAGQQEGGR

SEQ ID NO: 83133 - protein, 33 aa, Artificial Sequence
  Description of Artificial Sequence: Synthetic polypeptide
YEEEIRTTNPVATEQYGAVVEPTNDAPQCFGNR

SEQ ID NO: 83134 - protein, 33 aa, Artificial Sequence
  Description of Artificial Sequence: Synthetic polypeptide
DEEEISTTNPVATEQYGCVCSTTNHQGFGSNTQ

SEQ ID NO: 83135 - protein, 33 aa, Artificial Sequence
  Description of Artificial Sequence: Synthetic polypeptide
DENEIATTNPVATEQYGSVAATNLQEAGENMTE

SEQ ID NO: 83136 - protein, 29 aa, Artificial Sequence
  Description of Artificial Sequence: Synthetic peptide
YEEEIASVNPVCTEQYGVVSDGNLQSGNQ

SEQ ID NO: 83137 - protein, 28 aa, Artificial Sequence
  Description of Artificial Sequence: Synthetic peptide
YEEEIASVNPVCTEQYGVVSDGLQFGND

SEQ ID NO: 83138 - protein, 33 aa, Artificial Sequence
  Description of Artificial Sequence: Synthetic polypeptide
DEEEIRTTNPVATEQYGSVYSEAPNEIIRGETV

SEQ ID NO: 83139 - protein, 33 aa, Artificial Sequence
  Description of Artificial Sequence: Synthetic polypeptide
DEEEIRTTNPVAYEQYGQSVSTNDELVSEGQPV

SEQ ID NO: 83140 - protein, 28 aa, Artificial Sequence
  Description of Artificial Sequence: Synthetic peptide
SEEEIACTNPVATEQYGEAPENCQRENK

SEQ ID NO: 83141 - protein, 34 aa, Artificial Sequence
  Description of Artificial Sequence: Synthetic polypeptide
AEEEIRTTNPVATEQYGSVSTTTNNNQDTGENSE

SEQ ID NO: 83142 - protein, 33 aa, Artificial Sequence
  Description of Artificial Sequence: Synthetic polypeptide
DEEEIRTTNPVATEQWGTSSDINPLQPRGENDN

SEQ ID NO: 83143 - protein, 33 aa, Artificial Sequence
  Description of Artificial Sequence: Synthetic polypeptide
YEEEIRTTNPVATEQYGAVVEPTNNLNGCFGNR

SEQ ID NO: 83144 - protein, 31 aa, Artificial Sequence
  Description of Artificial Sequence: Synthetic polypeptide
DEEEIRTTNPVAYEQYGTCSTINPDQDEDNN

SEQ ID NO: 83145 - protein, 33 aa, Artificial Sequence
  Description of Artificial Sequence: Synthetic polypeptide
DEEEISTTNPVATEQYGCVCSTTNTQSFGSNQA

SEQ ID NO: 83146 - protein, 31 aa, Artificial Sequence
  Description of Artificial Sequence: Synthetic polypeptide
DDSEIRTTNPVSTEQYGDVSANTIQSRVGDR

SEQ ID NO: 83147 - protein, 33 aa, Artificial Sequence
  Description of Artificial Sequence: Synthetic polypeptide
DENEIATTNPVATEQYGSCSATENLEATRDGER

SEQ ID NO: 83148 - protein, 28 aa, Artificial Sequence
  Description of Artificial Sequence: Synthetic peptide
YEEEIASVNPVCTEQYGVVSDELQSGNQ

SEQ ID NO: 83149 - protein, 31 aa, Artificial Sequence
  Description of Artificial Sequence: Synthetic polypeptide
SEEEIRCTNPIATEQYGSVSEMNGPMRGNDN

SEQ ID NO: 83150 - protein, 33 aa, Artificial Sequence
  Description of Artificial Sequence: Synthetic polypeptide
DEEEISTTNPVATEQYGCVCSTTNLQNFGSDQM

SEQ ID NO: 83151 - protein, 28 aa, Artificial Sequence
  Description of Artificial Sequence: Synthetic peptide
YEEEIASVNPVCTEQYGVVSDGLQSGNQ

SEQ ID NO: 83152 - protein, 33 aa, Artificial Sequence
  Description of Artificial Sequence: Synthetic polypeptide
DEEEIRTTNPVATEQYGSCQSGPNEITEQEANR

SEQ ID NO: 83153 - protein, 33 aa, Artificial Sequence
  Description of Artificial Sequence: Synthetic polypeptide
DEEEIRTTNPVATEQYGSVSYLSNQDQEMEDRG

SEQ ID NO: 83154 - protein, 31 aa, Artificial Sequence
  Description of Artificial Sequence: Synthetic polypeptide
DEEEIRTTNPVAYEQYGTCSTINPGEQDENN

SEQ ID NO: 83155 - protein, 31 aa, Artificial Sequence
  Description of Artificial Sequence: Synthetic polypeptide
DEEEIRTTNPVATEQWGTNCSAALMRGNDSV

SEQ ID NO: 83156 - protein, 33 aa, Artificial Sequence
  Description of Artificial Sequence: Synthetic polypeptide
DEEEIRTTNPVATEQYGSVSYLVNEEQLLVNQD

SEQ ID NO: 83157 - protein, 33 aa, Artificial Sequence
  Description of Artificial Sequence: Synthetic polypeptide
DEEEIRTTNPVATEQYGQCSTNINQSTEGEREA

SEQ ID NO: 83158 - protein, 31 aa, Artificial Sequence
  Description of Artificial Sequence: Synthetic polypeptide
DENEIATTNPVATEQYGSASAEDLEDRGGDR

SEQ ID NO: 83159 - protein, 34 aa, Artificial Sequence
  Description of Artificial Sequence: Synthetic polypeptide
AEEEIRTTNPVATEQYGSVSTTTNNLQNEGETEE

SEQ ID NO: 83160 - protein, 31 aa, Artificial Sequence
  Description of Artificial Sequence: Synthetic polypeptide
DEAEIRATNPVATEQYGSCDTTSSQRGNNVG

SEQ ID NO: 83161 - protein, 35 aa, Artificial Sequence
  Description of Artificial Sequence: Synthetic polypeptide
DEEEIRTTNPVATEQYGSVYSETVNDLQENSDNEY

SEQ ID NO: 83162 - protein, 28 aa, Artificial Sequence
  Description of Artificial Sequence: Synthetic peptide
SEEEIACTNPVATEQYGEAPENLMHENR

SEQ ID NO: 83163 - protein, 29 aa, Artificial Sequence
  Description of Artificial Sequence: Synthetic peptide
YESEIASVNPVCTEQYGSVSDNLQSGNQT

SEQ ID NO: 83164 - protein, 32 aa, Artificial Sequence
  Description of Artificial Sequence: Synthetic polypeptide
DEEEISTTNPVATEQYGCVCSTPLQYFGSDQN

SEQ ID NO: 83165 - protein, 28 aa, Artificial Sequence
  Description of Artificial Sequence: Synthetic peptide
QETEIRTTNPCSTECWGIVSCNLQSGPR

SEQ ID NO: 83166 - protein, 31 aa, Artificial Sequence
  Description of Artificial Sequence: Synthetic polypeptide
DENEIATTNPVATEQYGEASEENIQQRNGNH

SEQ ID NO: 83167 - protein, 31 aa, Artificial Sequence
  Description of Artificial Sequence: Synthetic polypeptide
DENEIATTNPVATEQYGSVANNLENNGNEEQ

SEQ ID NO: 83168 - protein, 34 aa, Artificial Sequence
  Description of Artificial Sequence: Synthetic polypeptide
AEEEIRTTNPVATEQYGSVSTTTNNQQQTNGNVD

SEQ ID NO: 83169 - protein, 32 aa, Artificial Sequence
  Description of Artificial Sequence: Synthetic polypeptide
DEEEIRTTNPVAYEQYGTCSTINPLQDDENNM

SEQ ID NO: 83170 - protein, 31 aa, Artificial Sequence
  Description of Artificial Sequence: Synthetic polypeptide
DEEEIRTTNPVATEQYGSVYPTTLETAVSEQ

SEQ ID NO: 83171 - protein, 33 aa, Artificial Sequence
  Description of Artificial Sequence: Synthetic polypeptide
DEEEIRTTNPVATEGYGSVCSTELQEGFGSEDS

SEQ ID NO: 83172 - protein, 33 aa, Artificial Sequence
  Description of Artificial Sequence: Synthetic polypeptide
AEEEIRTTNPVATEQYGSVSTTTNNNAITEGNG

SEQ ID NO: 83173 - protein, 35 aa, Artificial Sequence
  Description of Artificial Sequence: Synthetic polypeptide
DEEEIRTTNPVATEQYGSVYSMTGPNLPPPGRERP

SEQ ID NO: 83174 - protein, 34 aa, Artificial Sequence
  Description of Artificial Sequence: Synthetic polypeptide
DEEEIRTTNPVATEQYGQCQVCSTNHQNFGSNAS

SEQ ID NO: 83175 - protein, 33 aa, Artificial Sequence
  Description of Artificial Sequence: Synthetic polypeptide
DEEEIRTTNPVATEQYGQCICSTNLQNFNSNQV

SEQ ID NO: 83176 - protein, 34 aa, Artificial Sequence
  Description of Artificial Sequence: Synthetic polypeptide
DEEEIRTTNPVATEQYGQCIVCSTNHQNFGSNQM

SEQ ID NO: 83177 - protein, 31 aa, Artificial Sequence
  Description of Artificial Sequence: Synthetic polypeptide
DENEIATTNPVATEQYGEVSAENLQDHGGDL

SEQ ID NO: 83178 - protein, 33 aa, Artificial Sequence
  Description of Artificial Sequence: Synthetic polypeptide
YEEEIRTTNPVATEQYGAVVEPTNAVQPCFGNR

SEQ ID NO: 83179 - protein, 33 aa, Artificial Sequence
  Description of Artificial Sequence: Synthetic polypeptide
DEEEIRTTNPVATEQYGSCQSNPNEIQENEANR

SEQ ID NO: 83180 - protein, 33 aa, Artificial Sequence
  Description of Artificial Sequence: Synthetic polypeptide
DEEEIRTTNPVATEQYGQCTCSTNELQNFGSDQ

SEQ ID NO: 83181 - protein, 33 aa, Artificial Sequence
  Description of Artificial Sequence: Synthetic polypeptide
DEEEISTTNPVATEQYGCVCSTYLQEHFGSNQI

SEQ ID NO: 83182 - protein, 32 aa, Artificial Sequence
  Description of Artificial Sequence: Synthetic polypeptide
DEEEIRTTNPVAYEQYGTTPSTGEHSQRGGSR

SEQ ID NO: 83183 - protein, 31 aa, Artificial Sequence
  Description of Artificial Sequence: Synthetic polypeptide
DENEIATTNPVATEQYGSVAMNLQDQNNVED

SEQ ID NO: 83184 - protein, 33 aa, Artificial Sequence
  Description of Artificial Sequence: Synthetic polypeptide
DENEIATTNPVATEQYGEVSSTEPNGPQMRGNV

SEQ ID NO: 83185 - protein, 28 aa, Artificial Sequence
  Description of Artificial Sequence: Synthetic peptide
YEEEIASVNPVCTEQYGVVSDILQSGNQ

SEQ ID NO: 83186 - protein, 33 aa, Artificial Sequence
  Description of Artificial Sequence: Synthetic polypeptide
DEEEIRTTNPVATEQYGSVYSEAPNEIQRIEDA

SEQ ID NO: 83187 - protein, 29 aa, Artificial Sequence
  Description of Artificial Sequence: Synthetic peptide
DENEIATTNPVATEQYGETSNEDWARGPR

SEQ ID NO: 83188 - protein, 28 aa, Artificial Sequence
  Description of Artificial Sequence: Synthetic peptide
YEEEIASVNPVCTEQYGVVSDHLQSGNQ

SEQ ID NO: 83189 - protein, 29 aa, Artificial Sequence
  Description of Artificial Sequence: Synthetic peptide
YEEEIASVNPVCTEQYGVVSDHNLQSGND

SEQ ID NO: 83190 - protein, 32 aa, Artificial Sequence
  Description of Artificial Sequence: Synthetic polypeptide
DEEEISTTNPVATEQYGCVCSTYLQSFGSDAA

SEQ ID NO: 83191 - protein, 32 aa, Artificial Sequence
  Description of Artificial Sequence: Synthetic polypeptide
DEAEIRATNPVATEQYGFVNSTTNLFQGEENE

SEQ ID NO: 83192 - protein, 33 aa, Artificial Sequence
  Description of Artificial Sequence: Synthetic polypeptide
DEAEIRATNPVATEQYGFVNSTTMNLFEGGENR

SEQ ID NO: 83193 - protein, 34 aa, Artificial Sequence
  Description of Artificial Sequence: Synthetic polypeptide
DETEIRTTNPVAYEQWGSVATTNPLQSGPNEGRE

SEQ ID NO: 83194 - protein, 31 aa, Artificial Sequence
  Description of Artificial Sequence: Synthetic polypeptide
DETEIRTTNPVAYEQWGNVSTTNDGNGGNQS

SEQ ID NO: 83195 - protein, 35 aa, Artificial Sequence
  Description of Artificial Sequence: Synthetic polypeptide
DEEEIRTTNPVATEQYGSVSSTPDGPNMRNGMNPV

SEQ ID NO: 83196 - protein, 31 aa, Artificial Sequence
  Description of Artificial Sequence: Synthetic polypeptide
DETEIRTTNPVAYEAWGVATTNLQGDGDNQR

SEQ ID NO: 83197 - protein, 34 aa, Artificial Sequence
  Description of Artificial Sequence: Synthetic polypeptide
DEEEIRTTNPVATEQYGSVSPQTQLPERLLQEMG

SEQ ID NO: 83198 - protein, 32 aa, Artificial Sequence
  Description of Artificial Sequence: Synthetic polypeptide
DETEIRTTNPVAYEAWGEVSTNLQGDLGNGGS

SEQ ID NO: 83199 - protein, 35 aa, Artificial Sequence
  Description of Artificial Sequence: Synthetic polypeptide
DEEEIRTTNPVATEQYGSVSSTTAGPNDHNGMNDV

SEQ ID NO: 83200 - protein, 30 aa, Artificial Sequence
  Description of Artificial Sequence: Synthetic polypeptide
DEAEIATTNPVATEQYGCVAATGLQAAEPG

SEQ ID NO: 83201 - protein, 34 aa, Artificial Sequence
  Description of Artificial Sequence: Synthetic polypeptide
DEEEIRTTNPVSTEQYGSVSTPAGPNMRNGMNPV

SEQ ID NO: 83202 - protein, 35 aa, Artificial Sequence
  Description of Artificial Sequence: Synthetic polypeptide
DEEEIRTTNPVATEQYGSVSPPNLGVIRNQVANPN

SEQ ID NO: 83203 - protein, 34 aa, Artificial Sequence
  Description of Artificial Sequence: Synthetic polypeptide
DEEEIRTTNPVSTEQYGSVSTTEDIPQMQNGMNH

SEQ ID NO: 83204 - protein, 29 aa, Artificial Sequence
  Description of Artificial Sequence: Synthetic peptide
DEEEIRTTNPVSTEQYGEAPMDCQQHENK

SEQ ID NO: 83205 - protein, 35 aa, Artificial Sequence
  Description of Artificial Sequence: Synthetic polypeptide
DEEEIRTTNPVATEQYGSVSSTTAGPNMRNGMNPV

SEQ ID NO: 83206 - protein, 31 aa, Artificial Sequence
  Description of Artificial Sequence: Synthetic polypeptide
DEEEIRTTNPVSTEQYGSVTDNGEGGGEEGT

SEQ ID NO: 83207 - protein, 32 aa, Artificial Sequence
  Description of Artificial Sequence: Synthetic polypeptide
DETEIRTTNPVAYEHWGSVSTNPNGNGMGNVR

SEQ ID NO: 83208 - protein, 31 aa, Artificial Sequence
  Description of Artificial Sequence: Synthetic polypeptide
DEEEIRTTNPVSTEQYGSVTFAYDLQGSQTF

SEQ ID NO: 83209 - protein, 32 aa, Artificial Sequence
  Description of Artificial Sequence: Synthetic polypeptide
DETEIRTTNPVAYEQWGNVSTNQQHNNGGNQS

SEQ ID NO: 83210 - protein, 35 aa, Artificial Sequence
  Description of Artificial Sequence: Synthetic polypeptide
DEEEIRTTNPVATEQYGSVSPQNPGQEVTGLNVIL

SEQ ID NO: 83211 - protein, 30 aa, Artificial Sequence
  Description of Artificial Sequence: Synthetic polypeptide
DETEIRTTNPVAYEAWGVATTNGQDGDGNR

SEQ ID NO: 83212 - protein, 34 aa, Artificial Sequence
  Description of Artificial Sequence: Synthetic polypeptide
DEEEIRTTNPVATEQYGSVSSTTAGEDHNGMNDV

SEQ ID NO: 83213 - protein, 29 aa, Artificial Sequence
  Description of Artificial Sequence: Synthetic peptide
AENEIACTNPVATEQYGEASENPVEFGNR

SEQ ID NO: 83214 - protein, 35 aa, Artificial Sequence
  Description of Artificial Sequence: Synthetic polypeptide
DEEEIRTTNPVATEQYGSVSSTPMGPNMRNGMNPV

SEQ ID NO: 83215 - protein, 30 aa, Artificial Sequence
  Description of Artificial Sequence: Synthetic polypeptide
AENEIACTNPVATEQYGEASENLTQRPLGR

SEQ ID NO: 83216 - protein, 36 aa, Artificial Sequence
  Description of Artificial Sequence: Synthetic polypeptide
DEEEIRTTNPVATEQYGSVSSTPPANPNMRNGNIPV

SEQ ID NO: 83217 - protein, 31 aa, Artificial Sequence
  Description of Artificial Sequence: Synthetic polypeptide
AENEIACTNPVATEQYGEASEPNLPQRGGPR

SEQ ID NO: 83218 - protein, 32 aa, Artificial Sequence
  Description of Artificial Sequence: Synthetic polypeptide
DETEIRTTNPVAYEHWGSVSTNPQGDLGGNGS

SEQ ID NO: 83219 - protein, 35 aa, Artificial Sequence
  Description of Artificial Sequence: Synthetic polypeptide
DEEEIRTTNPVATEQYGSVSSTTAGPNHRNGMNPV

SEQ ID NO: 83220 - protein, 34 aa, Artificial Sequence
  Description of Artificial Sequence: Synthetic polypeptide
DEEEIRTTNPVSTEQYGIVSSTTNLNMSNGMNPV

SEQ ID NO: 83221 - protein, 32 aa, Artificial Sequence
  Description of Artificial Sequence: Synthetic polypeptide
DETEIRTTNPVAYEHWGSVSTGNEQGDLGNGS

SEQ ID NO: 83222 - protein, 32 aa, Artificial Sequence
  Description of Artificial Sequence: Synthetic polypeptide
DETEIRTTNPVAYEHWGSVSTNLNQGDLNNGS

SEQ ID NO: 83223 - protein, 32 aa, Artificial Sequence
  Description of Artificial Sequence: Synthetic polypeptide
DETEIRTTNPVAYEHWGTVSTNLQGDLGNPGS

SEQ ID NO: 83224 - protein, 36 aa, Artificial Sequence
  Description of Artificial Sequence: Synthetic polypeptide
DEEEIRTTNPVATEQYGSVSSTPPAGPQMRNGMNPV

SEQ ID NO: 83225 - protein, 34 aa, Artificial Sequence
  Description of Artificial Sequence: Synthetic polypeptide
DEEEIRTTNPVSTEQYGSVSTTEDIQQMQNGMNH

SEQ ID NO: 83226 - protein, 33 aa, Artificial Sequence
  Description of Artificial Sequence: Synthetic polypeptide
DEAEIATTNPVATEQYGCVAATNLQATANGNPE

SEQ ID NO: 83227 - protein, 35 aa, Artificial Sequence
  Description of Artificial Sequence: Synthetic polypeptide
DEEEIRTTNPVATERYGKTVQSVNNLSQNDGGNNR

SEQ ID NO: 83228 - protein, 34 aa, Artificial Sequence
  Description of Artificial Sequence: Synthetic polypeptide
DEEEIRTTNPVATERYGKTVQSQNLSQNQGGNNL

SEQ ID NO: 83229 - protein, 34 aa, Artificial Sequence
  Description of Artificial Sequence: Synthetic polypeptide
DEEEIRTTNPVATERYGKTYQSQNLSQNGGNNRE

SEQ ID NO: 83230 - protein, 33 aa, Artificial Sequence
  Description of Artificial Sequence: Synthetic polypeptide
DEAEIATTNPVATEQYGCVAATNDQATPGGNRE

SEQ ID NO: 83231 - protein, 33 aa, Artificial Sequence
  Description of Artificial Sequence: Synthetic polypeptide
DEEEIRTTNPVSTEQYGSVTDNNGQAGGGQNTE

SEQ ID NO: 83232 - protein, 35 aa, Artificial Sequence
  Description of Artificial Sequence: Synthetic polypeptide
DEEEIRTTNPVATEQYGSVSSTTAGPEMREGMNPL

SEQ ID NO: 83233 - protein, 33 aa, Artificial Sequence
  Description of Artificial Sequence: Synthetic polypeptide
DEEEIRTTNPVATERYGKTVQSQNNSSNGGNNR

SEQ ID NO: 83234 - protein, 32 aa, Artificial Sequence
  Description of Artificial Sequence: Synthetic polypeptide
DETEIRTTNPVAYEQWGEVSTNLNGEDEGNTQ

SEQ ID NO: 83235 - protein, 31 aa, Artificial Sequence
  Description of Artificial Sequence: Synthetic polypeptide
DEGAIATTNPVAYEQWGCSFSTNLINDGNAR

SEQ ID NO: 83236 - protein, 33 aa, Artificial Sequence
  Description of Artificial Sequence: Synthetic polypeptide
DETEIRTTNPVAYEGWGSVSTDNGPQNDGDNNR

SEQ ID NO: 83237 - protein, 34 aa, Artificial Sequence
  Description of Artificial Sequence: Synthetic polypeptide
DEEEIRTTNPVSTEQYGSVSSMPAIPQQRNGNPH

SEQ ID NO: 83238 - protein, 32 aa, Artificial Sequence
  Description of Artificial Sequence: Synthetic polypeptide
DEEEIRTTNPVSTEQYGSVTFNDCQGNEQNTD

SEQ ID NO: 83239 - protein, 32 aa, Artificial Sequence
  Description of Artificial Sequence: Synthetic polypeptide
DETEIRTTNPVAYEGWGSVSTNNGPENDGNNR

SEQ ID NO: 83240 - protein, 34 aa, Artificial Sequence
  Description of Artificial Sequence: Synthetic polypeptide
DEEEIRTTNPVATERYGKTVQSQTLSQNGGNERE

SEQ ID NO: 83241 - protein, 34 aa, Artificial Sequence
  Description of Artificial Sequence: Synthetic polypeptide
DEEEIRTTNPVATERYGSAVCPITEDDQRGLNIT

SEQ ID NO: 83242 - protein, 35 aa, Artificial Sequence
  Description of Artificial Sequence: Synthetic polypeptide
DEEEIRTTNPVATEQYGSVSSTTAGPEMREGMNPV

SEQ ID NO: 83243 - protein, 32 aa, Artificial Sequence
  Description of Artificial Sequence: Synthetic polypeptide
DETEIRTTNPVAYEGWGEVSTPNGPQNDGNNR

SEQ ID NO: 83244 - protein, 36 aa, Artificial Sequence
  Description of Artificial Sequence: Synthetic polypeptide
DEEEIRTTNPVATEQYGSVSSTRPALPNMRNGMNPV

SEQ ID NO: 83245 - protein, 36 aa, Artificial Sequence
  Description of Artificial Sequence: Synthetic polypeptide
DEEEIRTTNPVATEQYGSVSPPINLEVIDNQVGNPN

SEQ ID NO: 83246 - protein, 33 aa, Artificial Sequence
  Description of Artificial Sequence: Synthetic polypeptide
DEEEIRTTNPVSTEQYGIVSTTNLNMSNGMTPV

SEQ ID NO: 83247 - protein, 31 aa, Artificial Sequence
  Description of Artificial Sequence: Synthetic polypeptide
DEAEIATTNPVATEQYGCVAATNLADSSGDQ

SEQ ID NO: 83248 - protein, 35 aa, Artificial Sequence
  Description of Artificial Sequence: Synthetic polypeptide
DEEEIRTTNPVATEQYGSVSSTTAGPEDREGMNPL

SEQ ID NO: 83249 - protein, 34 aa, Artificial Sequence
  Description of Artificial Sequence: Synthetic polypeptide
DEEEIRTTNPVATEQYGSVSSTTAGPNMRGMDPV

SEQ ID NO: 83250 - protein, 35 aa, Artificial Sequence
  Description of Artificial Sequence: Synthetic polypeptide
DEEEIRTTNPVATEQYGSVSPPYNNEQMRNVNEDH

SEQ ID NO: 83251 - protein, 33 aa, Artificial Sequence
  Description of Artificial Sequence: Synthetic polypeptide
DEEEIRTTNPVATEQYGSVSPPPLLPERMMVTM

SEQ ID NO: 83252 - protein, 35 aa, Artificial Sequence
  Description of Artificial Sequence: Synthetic polypeptide
DEEEIRTTNPVSTEQYGSVSSTTEAIPNMQNGMNV

SEQ ID NO: 83253 - protein, 33 aa, Artificial Sequence
  Description of Artificial Sequence: Synthetic polypeptide
DEEEIRTTNPVATEQYGSVSSTQGIQPTPVEEA

SEQ ID NO: 83254 - protein, 32 aa, Artificial Sequence
  Description of Artificial Sequence: Synthetic polypeptide
DEAEIATTNPVATEQYGCVAANNNLQAEGPNN

SEQ ID NO: 83255 - protein, 31 aa, Artificial Sequence
  Description of Artificial Sequence: Synthetic polypeptide
DEAEIATTNPVATEQYGCVAATNLQDPAEPP

SEQ ID NO: 83256 - protein, 35 aa, Artificial Sequence
  Description of Artificial Sequence: Synthetic polypeptide
DEEEIRTTNPVATEQYGSVSSTTAGPNMREGMNPV

SEQ ID NO: 83257 - protein, 34 aa, Artificial Sequence
  Description of Artificial Sequence: Synthetic polypeptide
DEEEIRTTNPVSTEQYGIVSSTTPAGNMRNGMNR

SEQ ID NO: 83258 - protein, 34 aa, Artificial Sequence
  Description of Artificial Sequence: Synthetic polypeptide
DEEEIRTTNPVSTEQYGSVSSTTTGPNSRVGMNV

SEQ ID NO: 83259 - protein, 33 aa, Artificial Sequence
  Description of Artificial Sequence: Synthetic polypeptide
DDEEIRTTNPVATEQYGCVCSTENHQNFGSDIA

SEQ ID NO: 83260 - protein, 30 aa, Artificial Sequence
  Description of Artificial Sequence: Synthetic polypeptide
AENEISCTNPVSTEQYGEAISGENLQRGGR

SEQ ID NO: 83261 - protein, 34 aa, Artificial Sequence
  Description of Artificial Sequence: Synthetic polypeptide
DEEEIRTTNPVATEQYGSVSPPVTNQEVQVLEQA

SEQ ID NO: 83262 - protein, 35 aa, Artificial Sequence
  Description of Artificial Sequence: Synthetic polypeptide
DEEEIRTTNPVATEQYGSVSPPNLGVIDNQVANLP

SEQ ID NO: 83263 - protein, 29 aa, Artificial Sequence
  Description of Artificial Sequence: Synthetic peptide
AENEIACTNPVATEQYGEASENNYRGGRV

SEQ ID NO: 83264 - protein, 30 aa, Artificial Sequence
  Description of Artificial Sequence: Synthetic polypeptide
DETEIRTTNPVAYEAWGVATTNPQDGDNNR

SEQ ID NO: 83265 - protein, 32 aa, Artificial Sequence
  Description of Artificial Sequence: Synthetic polypeptide
DEEEIRTTNPVSTEQYGSVTDNNGQGGGQGTI

SEQ ID NO: 83266 - protein, 31 aa, Artificial Sequence
  Description of Artificial Sequence: Synthetic polypeptide
DEEEIRTTNPVSTEQYGSVTFNDLPGEEQTD

SEQ ID NO: 83267 - protein, 35 aa, Artificial Sequence
  Description of Artificial Sequence: Synthetic polypeptide
DEEEIRTTNPVSTEQYGSVSSTPAGPQQRNGMNPH

SEQ ID NO: 83268 - protein, 32 aa, Artificial Sequence
  Description of Artificial Sequence: Synthetic polypeptide
DEEEIRTTNPVSTEQYGSVSPTLLLSVPELGP

SEQ ID NO: 83269 - protein, 32 aa, Artificial Sequence
  Description of Artificial Sequence: Synthetic polypeptide
DETEIRTTNPVAYEQWGSTSPTENDDQGQGQR

SEQ ID NO: 83270 - protein, 33 aa, Artificial Sequence
  Description of Artificial Sequence: Synthetic polypeptide
DEEEIRTTNPVATEQYGSVSPPVPMDIGENPLD

SEQ ID NO: 83271 - protein, 33 aa, Artificial Sequence
  Description of Artificial Sequence: Synthetic polypeptide
DEEEIRTTNPVSTEQYGSVSSTTTIPNSRVGQV

SEQ ID NO: 83272 - protein, 34 aa, Artificial Sequence
  Description of Artificial Sequence: Synthetic polypeptide
DDEEIRTTNPVATEQYGCVCSTENLQEGFGSEQA

SEQ ID NO: 83273 - protein, 31 aa, Artificial Sequence
  Description of Artificial Sequence: Synthetic polypeptide
DEAEIATTNPVATEQYGCVAATGDTATGNRE

SEQ ID NO: 83274 - protein, 35 aa, Artificial Sequence
  Description of Artificial Sequence: Synthetic polypeptide
DEEEIRTTNPVSTEQYGSVSSTPAGPQQRNGMNPV

SEQ ID NO: 83275 - protein, 30 aa, Artificial Sequence
  Description of Artificial Sequence: Synthetic polypeptide
DGEEIATTNPVAYEQWGSVTHTLDQTGGTR

SEQ ID NO: 83276 - protein, 33 aa, Artificial Sequence
  Description of Artificial Sequence: Synthetic polypeptide
DEEEISTTNPVATEQYGVVCSTEHQNFGSNNQI

SEQ ID NO: 83277 - protein, 32 aa, Artificial Sequence
  Description of Artificial Sequence: Synthetic polypeptide
DEEEIRTTNPVSTEQYGCVCYSNLQGSGSQQS

SEQ ID NO: 83278 - protein, 30 aa, Artificial Sequence
  Description of Artificial Sequence: Synthetic polypeptide
DETEIRCTNPIATEQWGSVWSEDWAERGPR

SEQ ID NO: 83279 - protein, 29 aa, Artificial Sequence
  Description of Artificial Sequence: Synthetic peptide
DETEIRCTNPVATECWGETTAEDLQRGGR

SEQ ID NO: 83280 - protein, 34 aa, Artificial Sequence
  Description of Artificial Sequence: Synthetic polypeptide
DETEIRGTNPVATEIYGSVVSTGDLGQRGEGENG

SEQ ID NO: 83281 - protein, 32 aa, Artificial Sequence
  Description of Artificial Sequence: Synthetic polypeptide
DEGEIATTNPVATEQYGCVAATNLADPGNNPL

SEQ ID NO: 83282 - protein, 28 aa, Artificial Sequence
  Description of Artificial Sequence: Synthetic peptide
DETEIRSTNPVGTEGYGATASTLQHGDI

SEQ ID NO: 83283 - protein, 32 aa, Artificial Sequence
  Description of Artificial Sequence: Synthetic polypeptide
DEGEIATTNPVATEQYGCVAATNLADPGNAED

SEQ ID NO: 83284 - protein, 32 aa, Artificial Sequence
  Description of Artificial Sequence: Synthetic polypeptide
DEDEIRTTNPVAYEQWGSVSVNPNQGDGNMDA

SEQ ID NO: 83285 - protein, 32 aa, Artificial Sequence
  Description of Artificial Sequence: Synthetic polypeptide
DEGEIATTNPVATEQYGCVAATNLADPGDNEE

SEQ ID NO: 83286 - protein, 33 aa, Artificial Sequence
  Description of Artificial Sequence: Synthetic polypeptide
DEEEIRTTNPVAYEQYGVKVSTGNHSHRVNNQG

SEQ ID NO: 83287 - protein, 31 aa, Artificial Sequence
  Description of Artificial Sequence: Synthetic polypeptide
DEGEIATTNPVATEQYGCVAATNLADGGEEL

SEQ ID NO: 83288 - protein, 33 aa, Artificial Sequence
  Description of Artificial Sequence: Synthetic polypeptide
DEGEIATTNPVATEQWGTSSTGNPLQARGENEN

SEQ ID NO: 83289 - protein, 35 aa, Artificial Sequence
  Description of Artificial Sequence: Synthetic polypeptide
DEEEIRTTNPVAYEQYGQSVSTENDVLQPHSIIRI

SEQ ID NO: 83290 - protein, 35 aa, Artificial Sequence
  Description of Artificial Sequence: Synthetic polypeptide
DEEEIRTTNPVAYEQYGQSVSTENDLLQPRSIIYF

SEQ ID NO: 83291 - protein, 33 aa, Artificial Sequence
  Description of Artificial Sequence: Synthetic polypeptide
DEEEIRTTNPVAYEQYGQSVSTEDLLIPEGQIP

SEQ ID NO: 83292 - protein, 34 aa, Artificial Sequence
  Description of Artificial Sequence: Synthetic polypeptide
DEEEIRTTNPVAYEQYGTISCDTNSLSQVTEGNP

SEQ ID NO: 83293 - protein, 34 aa, Artificial Sequence
  Description of Artificial Sequence: Synthetic polypeptide
DETEIRTTNPCATECYGSVSTPNNGDRQEGNGNR

SEQ ID NO: 83294 - protein, 30 aa, Artificial Sequence
  Description of Artificial Sequence: Synthetic polypeptide
DETEIRTTNPIATECYGSTTSEDLMPGPYR

SEQ ID NO: 83295 - protein, 32 aa, Artificial Sequence
  Description of Artificial Sequence: Synthetic polypeptide
DEGEIATTNPVATEQWGSVSGTGPQNNGENQD

SEQ ID NO: 83296 - protein, 33 aa, Artificial Sequence
  Description of Artificial Sequence: Synthetic polypeptide
DETEIRTTNPVATDQYGSVNMTSGLQREGGDED

SEQ ID NO: 83297 - protein, 33 aa, Artificial Sequence
  Description of Artificial Sequence: Synthetic polypeptide
DEEEIRTTNPVAYEQYGVVVSTEPDQNGGIGNH

SEQ ID NO: 83298 - protein, 33 aa, Artificial Sequence
  Description of Artificial Sequence: Synthetic polypeptide
DDEEIRTTNPVATEQWGSVVTSGLRLQREGQFQ

SEQ ID NO: 83299 - protein, 34 aa, Artificial Sequence
  Description of Artificial Sequence: Synthetic polypeptide
DETEIRTTNPVATEAWGSVSTNLNQGDLGGNGGS

SEQ ID NO: 83300 - protein, 33 aa, Artificial Sequence
  Description of Artificial Sequence: Synthetic polypeptide
DEEEIRTTNPVAYERWGQSVPSINFEQRTGGTR

SEQ ID NO: 83301 - protein, 29 aa, Artificial Sequence
  Description of Artificial Sequence: Synthetic peptide
DETEIRTTNPVATECWGAVSACLAPGEYI

SEQ ID NO: 83302 - protein, 33 aa, Artificial Sequence
  Description of Artificial Sequence: Synthetic polypeptide
DEDEIRTTNPVAYEQWGSVSTTNLGDHTGDNNS

SEQ ID NO: 83303 - protein, 34 aa, Artificial Sequence
  Description of Artificial Sequence: Synthetic polypeptide
DEEEIRTTNPVAYEQYGQSVSSNDELMRVGIPVV

SEQ ID NO: 83304 - protein, 32 aa, Artificial Sequence
  Description of Artificial Sequence: Synthetic polypeptide
DETEIRTTNPVATECWGSVANCINEQDRKGNG

SEQ ID NO: 83305 - protein, 32 aa, Artificial Sequence
  Description of Artificial Sequence: Synthetic polypeptide
DETEIRTTNPVATECWGSVANCINWQDRKGNG

SEQ ID NO: 83306 - protein, 35 aa, Artificial Sequence
  Description of Artificial Sequence: Synthetic polypeptide
DEEEIRTTNPVAYEQYGQSVSSMNDLNQRFGSQQS

SEQ ID NO: 83307 - protein, 32 aa, Artificial Sequence
  Description of Artificial Sequence: Synthetic polypeptide
DEDEIRTTNPVAYEQWGSVSTTNHNNDMGNEN

SEQ ID NO: 83308 - protein, 32 aa, Artificial Sequence
  Description of Artificial Sequence: Synthetic polypeptide
DETEIRTTNPCATETWGTVSTNLQGDLGNGGS

SEQ ID NO: 83309 - protein, 33 aa, Artificial Sequence
  Description of Artificial Sequence: Synthetic polypeptide
DEGEIATTNPVATEQYGCVAATNLPQNGENTEG

SEQ ID NO: 83310 - protein, 31 aa, Artificial Sequence
  Description of Artificial Sequence: Synthetic polypeptide
DEGEIATTNPVATEQYGCVAATNLQDAEPDE

SEQ ID NO: 83311 - protein, 30 aa, Artificial Sequence
  Description of Artificial Sequence: Synthetic polypeptide
DETEIRCTNPIATECYGSTTSENLMPGPYR

SEQ ID NO: 83312 - protein, 31 aa, Artificial Sequence
  Description of Artificial Sequence: Synthetic polypeptide
AESEIACTNPVATEQYGEASCENALQRGGGR

SEQ ID NO: 83313 - protein, 34 aa, Artificial Sequence
  Description of Artificial Sequence: Synthetic polypeptide
DEEEIRTTNPVAYEQYGSVSVSVNELSIHVGNDY

SEQ ID NO: 83314 - protein, 36 aa, Artificial Sequence
  Description of Artificial Sequence: Synthetic polypeptide
DEEEIRTTNPVAYEQYGSVSVSVNELSQYRTVGNED

SEQ ID NO: 83315 - protein, 36 aa, Artificial Sequence
  Description of Artificial Sequence: Synthetic polypeptide
DEEEIRTTNPVATEQYGSVSSTTPAGPNMRNGMNRV

SEQ ID NO: 83316 - protein, 33 aa, Artificial Sequence
  Description of Artificial Sequence: Synthetic polypeptide
DEEEIRTTNPVAYEQYGSVVGTTGLSQNVGMEV

SEQ ID NO: 83317 - protein, 32 aa, Artificial Sequence
  Description of Artificial Sequence: Synthetic polypeptide
DEAEIATTNPVATEQYGSVAMALTQDNGDTRM

SEQ ID NO: 83318 - protein, 31 aa, Artificial Sequence
  Description of Artificial Sequence: Synthetic polypeptide
DETEICTTNPVAYECWGSVATNLQGDHGNGS

SEQ ID NO: 83319 - protein, 32 aa, Artificial Sequence
  Description of Artificial Sequence: Synthetic polypeptide
DETEICTTNPVAYECWGSVSTNLQGDLGNGGS

SEQ ID NO: 83320 - protein, 34 aa, Artificial Sequence
  Description of Artificial Sequence: Synthetic polypeptide
DEEEIRTTNPVAYEQYGQSVSTNDLLQPEMIIQI

SEQ ID NO: 83321 - protein, 33 aa, Artificial Sequence
  Description of Artificial Sequence: Synthetic polypeptide
DEEEIRTTNPVATEQYGVVVGTGMGQNNIGGNQ

SEQ ID NO: 83322 - protein, 32 aa, Artificial Sequence
  Description of Artificial Sequence: Synthetic polypeptide
DETEICTTNPVAYEQWGSVATTNLQSGPNEDE

SEQ ID NO: 83323 - protein, 33 aa, Artificial Sequence
  Description of Artificial Sequence: Synthetic polypeptide
DEEEIRTTNPVATEQYGVVVGTINQSEDGGGNG

SEQ ID NO: 83324 - protein, 32 aa, Artificial Sequence
  Description of Artificial Sequence: Synthetic polypeptide
DETEICTTNPVAYEQWGSVSTNDLGNHGQNDS

SEQ ID NO: 83325 - protein, 31 aa, Artificial Sequence
  Description of Artificial Sequence: Synthetic polypeptide
DEGEIATTNPVATEQYGCVANNLTDPGENPE

SEQ ID NO: 83326 - protein, 32 aa, Artificial Sequence
  Description of Artificial Sequence: Synthetic polypeptide
DEGEIATTNPVATEQYGCVAITNLQQPGPQVQ

SEQ ID NO: 83327 - protein, 30 aa, Artificial Sequence
  Description of Artificial Sequence: Synthetic polypeptide
DEGEIATTNPVATEQYGCVAGTGLVIMMER

SEQ ID NO: 83328 - protein, 33 aa, Artificial Sequence
  Description of Artificial Sequence: Synthetic polypeptide
DEEEIRTTNPVAYEQYGSVVWTNASSAGFDGSR

SEQ ID NO: 83329 - protein, 33 aa, Artificial Sequence
  Description of Artificial Sequence: Synthetic polypeptide
DETEIKTTNPVATEQYGSVSINGLFLVREGEFT

SEQ ID NO: 83330 - protein, 32 aa, Artificial Sequence
  Description of Artificial Sequence: Synthetic polypeptide
DEGEIATTNPVATEQYGCVAATNLQPDNQEGA

SEQ ID NO: 83331 - protein, 33 aa, Artificial Sequence
  Description of Artificial Sequence: Synthetic polypeptide
DEAEIATTNPVATEQYGSVAIVANALQHGENDT

SEQ ID NO: 83332 - protein, 34 aa, Artificial Sequence
  Description of Artificial Sequence: Synthetic polypeptide
DEEEIRTTNPVAYEQYGSVYACTNAISQNKNSNR

SEQ ID NO: 83333 - protein, 32 aa, Artificial Sequence
  Description of Artificial Sequence: Synthetic polypeptide
DEGEIATTNPVATEQYGCVAATNLTDPGENAD

SEQ ID NO: 83334 - protein, 36 aa, Artificial Sequence
  Description of Artificial Sequence: Synthetic polypeptide
DEEEIRTTNPVATEQYGSVSSTTPAGPNMRNGMNPR

SEQ ID NO: 83335 - protein, 33 aa, Artificial Sequence
  Description of Artificial Sequence: Synthetic polypeptide
DETEIRTTNPVATECWGSVSCINEPQDREGENG

SEQ ID NO: 83336 - protein, 30 aa, Artificial Sequence
  Description of Artificial Sequence: Synthetic polypeptide
AESEIACTNPVATEQWGEASENLPQDRGGR

SEQ ID NO: 83337 - protein, 32 aa, Artificial Sequence
  Description of Artificial Sequence: Synthetic polypeptide
DEEEIRTTNPVAYEQYGSVWTNLMLVFDSIEE

SEQ ID NO: 83338 - protein, 33 aa, Artificial Sequence
  Description of Artificial Sequence: Synthetic polypeptide
DEEEIRTTNPVAYEQYGSVWTNELMQVFDSIGE

SEQ ID NO: 83339 - protein, 32 aa, Artificial Sequence
  Description of Artificial Sequence: Synthetic polypeptide
DETEICTTNPVAYEQYGSVSTGDLNGNHGNDS

SEQ ID NO: 83340 - protein, 34 aa, Artificial Sequence
  Description of Artificial Sequence: Synthetic polypeptide
DEEEIRTTNPVATEQYGVVVTDNGQPEMVGGNGQ

SEQ ID NO: 83341 - protein, 31 aa, Artificial Sequence
  Description of Artificial Sequence: Synthetic polypeptide
DETEICTTNPVAYEQWGTVSTNLNGNDGMTR

SEQ ID NO: 83342 - protein, 31 aa, Artificial Sequence
  Description of Artificial Sequence: Synthetic polypeptide
DETEICTTNPVAYEQWGSVTTNLNGEDGMTR

SEQ ID NO: 83343 - protein, 29 aa, Artificial Sequence
  Description of Artificial Sequence: Synthetic peptide
AESEIACTNPVATEQWGEASENLQDRGGG

SEQ ID NO: 83344 - protein, 35 aa, Artificial Sequence
  Description of Artificial Sequence: Synthetic polypeptide
DEEEIRTTNPVATEQYGSVSSTTPAGPNMRNGMNT

SEQ ID NO: 83345 - protein, 33 aa, Artificial Sequence
  Description of Artificial Sequence: Synthetic polypeptide
DETEIRTTNPVATECWGSVSCINEPQDREGENM

SEQ ID NO: 83346 - protein, 32 aa, Artificial Sequence
  Description of Artificial Sequence: Synthetic polypeptide
DEAEIATTNPVATEQYGSVAITNLDTPGGDFF

SEQ ID NO: 83347 - protein, 33 aa, Artificial Sequence
  Description of Artificial Sequence: Synthetic polypeptide
DEEEIRTTNPVCTEHWGSVSMPNQGQERNGNES

SEQ ID NO: 83348 - protein, 33 aa, Artificial Sequence
  Description of Artificial Sequence: Synthetic polypeptide
DEEEIRTTNPVAYEQYGQSVSQPDLLQEGQITP

SEQ ID NO: 83349 - protein, 36 aa, Artificial Sequence
  Description of Artificial Sequence: Synthetic polypeptide
DEEEIRTTNPVATEQYGSVSSTTPAGPNMQNGMNPV

SEQ ID NO: 83350 - protein, 35 aa, Artificial Sequence
  Description of Artificial Sequence: Synthetic polypeptide
DEAEIATTNPVATEQYGSVAGTNPPLPQTEAGDNR

SEQ ID NO: 83351 - protein, 36 aa, Artificial Sequence
  Description of Artificial Sequence: Synthetic polypeptide
DEEEIRTTNPVATEQYGSVSSTTPAGPNMQNGDNPV

SEQ ID NO: 83352 - protein, 31 aa, Artificial Sequence
  Description of Artificial Sequence: Synthetic polypeptide
DDSEVATTNPVSTEQYGSVAANDLQSRVGQR

SEQ ID NO: 83353 - protein, 33 aa, Artificial Sequence
  Description of Artificial Sequence: Synthetic polypeptide
DEEEIRTTNPVCTEHWGSVSMPNQGQERNGNNS

SEQ ID NO: 83354 - protein, 32 aa, Artificial Sequence
  Description of Artificial Sequence: Synthetic polypeptide
DDSEVATTNPVSTEQYGSVSANDLQSRVGQDR

SEQ ID NO: 83355 - protein, 33 aa, Artificial Sequence
  Description of Artificial Sequence: Synthetic polypeptide
DETEIRTTNPVATEQYGCVVEVINVDTRGFNRE

SEQ ID NO: 83356 - protein, 32 aa, Artificial Sequence
  Description of Artificial Sequence: Synthetic polypeptide
DEEEIRTTNPVCTEHYGCVCSWPELQNGSNQA

SEQ ID NO: 83357 - protein, 31 aa, Artificial Sequence
  Description of Artificial Sequence: Synthetic polypeptide
AEQEIATTNPVATEQYGSVSTDLEDHEGEDL

SEQ ID NO: 83358 - protein, 30 aa, Artificial Sequence
  Description of Artificial Sequence: Synthetic polypeptide
DEGEIATTNPCSTEQYGIVSCNLQDHGEDL

SEQ ID NO: 83359 - protein, 32 aa, Artificial Sequence
  Description of Artificial Sequence: Synthetic polypeptide
DEEEIRTTNPVCTEHYGCVSWPNHQNFGSNLG

SEQ ID NO: 83360 - protein, 32 aa, Artificial Sequence
  Description of Artificial Sequence: Synthetic polypeptide
AEQEIATTNPVATEQYGSVSATDLEDREGEDL

SEQ ID NO: 83361 - protein, 32 aa, Artificial Sequence
  Description of Artificial Sequence: Synthetic polypeptide
DEEEIRTTNPVCTEHWGSVSMPNQGQERNGDL

SEQ ID NO: 83362 - protein, 31 aa, Artificial Sequence
  Description of Artificial Sequence: Synthetic polypeptide
DEGEIATTNPCSSEQYGTVCSTDNLVQSGTR

SEQ ID NO: 83363 - protein, 32 aa, Artificial Sequence
  Description of Artificial Sequence: Synthetic polypeptide
DEAEIATTNPVATEQYGSVAGTNLDTDNPENP

SEQ ID NO: 83364 - protein, 32 aa, Artificial Sequence
  Description of Artificial Sequence: Synthetic polypeptide
AEQEIATTNPVATEQYGSVSAEDLQDHEGGDR

SEQ ID NO: 83365 - protein, 32 aa, Artificial Sequence
  Description of Artificial Sequence: Synthetic polypeptide
DEEEIRTTNPVCTEHYGSVCSWPEHQNFGSNL

SEQ ID NO: 83366 - protein, 31 aa, Artificial Sequence
  Description of Artificial Sequence: Synthetic polypeptide
AEQEIATTNPVATEQYGSASAEDLQDHGGDR

SEQ ID NO: 83367 - protein, 35 aa, Artificial Sequence
  Description of Artificial Sequence: Synthetic polypeptide
DETEIRTTNPVATEQYGQSVSVTTNSTLPHATVNR

SEQ ID NO: 83368 - protein, 29 aa, Artificial Sequence
  Description of Artificial Sequence: Synthetic peptide
DEEEIRTTNPVCTEIFGTVTFENLEGGQT

SEQ ID NO: 83369 - protein, 31 aa, Artificial Sequence
  Description of Artificial Sequence: Synthetic polypeptide
AEQEIATTNPVATEQYGSASAEDLEDREGER

SEQ ID NO: 83370 - protein, 34 aa, Artificial Sequence
  Description of Artificial Sequence: Synthetic polypeptide
DEEEIRTTNPVCTEPYGSVPSCMPNHSQRGGNNL

SEQ ID NO: 83371 - protein, 30 aa, Artificial Sequence
  Description of Artificial Sequence: Synthetic polypeptide
DEEEIRTTNPVCTEPYGTISMEDIQSNGNQ

SEQ ID NO: 83372 - protein, 32 aa, Artificial Sequence
  Description of Artificial Sequence: Synthetic polypeptide
DEGEIATTNPCATECWGIVSCINLQDREGENR

SEQ ID NO: 83373 - protein, 31 aa, Artificial Sequence
  Description of Artificial Sequence: Synthetic polypeptide
AEQEIATTNPVATEQYGEASAENLQDHGGDR

SEQ ID NO: 83374 - protein, 34 aa, Artificial Sequence
  Description of Artificial Sequence: Synthetic polypeptide
DEEEIRTTNPVAYEQYGQSVSQNDLLQPQGQIMG

SEQ ID NO: 83375 - protein, 30 aa, Artificial Sequence
  Description of Artificial Sequence: Synthetic polypeptide
DDSEVRCTNPIATEQYGSVAAETLMRVGNR

SEQ ID NO: 83376 - protein, 31 aa, Artificial Sequence
  Description of Artificial Sequence: Synthetic polypeptide
DEAEIATTNPVATEQYGSVAGTGLDTDTDRE

SEQ ID NO: 83377 - protein, 30 aa, Artificial Sequence
  Description of Artificial Sequence: Synthetic polypeptide
DEGEIATTNPCSSEQYGIISCNLQQSNGNR

SEQ ID NO: 83378 - protein, 34 aa, Artificial Sequence
  Description of Artificial Sequence: Synthetic polypeptide
DEEEIRTTNPVCTEHWGSVSMPNGLQDRDGDNEL

SEQ ID NO: 83379 - protein, 32 aa, Artificial Sequence
  Description of Artificial Sequence: Synthetic polypeptide
DEEEIRTTNPVCTEHWGSVAMPDLDQREGNAQ

SEQ ID NO: 83380 - protein, 33 aa, Artificial Sequence
  Description of Artificial Sequence: Synthetic polypeptide
DETEIRTTNPVATEQYGCAATRHNTTEPRGFNR

SEQ ID NO: 83381 - protein, 32 aa, Artificial Sequence
  Description of Artificial Sequence: Synthetic polypeptide
DEAEIATTNPVATEQYGSVAITNLADGEEGEH

SEQ ID NO: 83382 - protein, 33 aa, Artificial Sequence
  Description of Artificial Sequence: Synthetic polypeptide
DETEIRTTNPVATECWGSVSNAENEPQEREGNI

SEQ ID NO: 83383 - protein, 34 aa, Artificial Sequence
  Description of Artificial Sequence: Synthetic polypeptide
DEEEIRTTNPVAYEQYGQSVSSIDELQIRVGEPV

SEQ ID NO: 83384 - protein, 34 aa, Artificial Sequence
  Description of Artificial Sequence: Synthetic polypeptide
DEEEIRTTNPVAYEQYGQSVSSGNDLNQESGSQQ

SEQ ID NO: 83385 - protein, 33 aa, Artificial Sequence
  Description of Artificial Sequence: Synthetic polypeptide
DETEIRTTNPVATECWGSVSNAENEPQERKGNI

SEQ ID NO: 83386 - protein, 30 aa, Artificial Sequence
  Description of Artificial Sequence: Synthetic polypeptide
DETEIRTTNPVATECYGATANEDLARGGYR

SEQ ID NO: 83387 - protein, 30 aa, Artificial Sequence
  Description of Artificial Sequence: Synthetic polypeptide
DETEIRTTNPVATECYGDVANACLQEHGPI

SEQ ID NO: 83388 - protein, 31 aa, Artificial Sequence
  Description of Artificial Sequence: Synthetic polypeptide
DETEIRTTNPVATECYGDVWANECLQPGEYI

SEQ ID NO: 83389 - protein, 30 aa, Artificial Sequence
  Description of Artificial Sequence: Synthetic polypeptide
DETEIRTTNPVATECYGDVWSECLQPEEYI

SEQ ID NO: 83390 - protein, 32 aa, Artificial Sequence
  Description of Artificial Sequence: Synthetic polypeptide
DEAEIATTNPVATEQYGSVAITNGENMGDERV

SEQ ID NO: 83391 - protein, 33 aa, Artificial Sequence
  Description of Artificial Sequence: Synthetic polypeptide
DEEEIRTTNPVAYERYGKVQQVQNLQSGGNNRS

SEQ ID NO: 83392 - protein, 33 aa, Artificial Sequence
  Description of Artificial Sequence: Synthetic polypeptide
DEAEIATTNPVATEQYGSVAITENLAGPGETRE

SEQ ID NO: 83393 - protein, 35 aa, Artificial Sequence
  Description of Artificial Sequence: Synthetic polypeptide
DEDEIRTTNPVAYEQWGSVSTTNGLQGNAGENDAR

SEQ ID NO: 83394 - protein, 33 aa, Artificial Sequence
  Description of Artificial Sequence: Synthetic polypeptide
DEEEIRTTNPVAYERYGKVSSVNHQGAVGNNRM

SEQ ID NO: 83395 - protein, 35 aa, Artificial Sequence
  Description of Artificial Sequence: Synthetic polypeptide
DEEEIRTTNPVATEQYGSVSSTTPAGPNMRGMNPV

SEQ ID NO: 83396 - protein, 33 aa, Artificial Sequence
  Description of Artificial Sequence: Synthetic polypeptide
DEGEIATTNPVATECYGSVSCINEPQDREGENG

SEQ ID NO: 83397 - protein, 30 aa, Artificial Sequence
  Description of Artificial Sequence: Synthetic polypeptide
DEGEIATTNPVATASWGCVATNGLERGNPQ

SEQ ID NO: 83398 - protein, 33 aa, Artificial Sequence
  Description of Artificial Sequence: Synthetic polypeptide
DETEIRTTNPVATEQWGEVSCTGESSQLAGNNR

SEQ ID NO: 83399 - protein, 33 aa, Artificial Sequence
  Description of Artificial Sequence: Synthetic polypeptide
DEEEIRTTNPVAYESYGSVFCTGNHSETRGGTR

SEQ ID NO: 83400 - protein, 32 aa, Artificial Sequence
  Description of Artificial Sequence: Synthetic polypeptide
DEEEIRTTNPVAYERYGTVVSCISLQRGGEYG

SEQ ID NO: 83401 - protein, 33 aa, Artificial Sequence
  Description of Artificial Sequence: Synthetic polypeptide
DEEEIRTTNPVATEQYGSVSPMSNAPDDQNEQD

SEQ ID NO: 83402 - protein, 35 aa, Artificial Sequence
  Description of Artificial Sequence: Synthetic polypeptide
DEEEIRTTNPVATEQYGSVSSTTPAGPNMREGNPV

SEQ ID NO: 83403 - protein, 33 aa, Artificial Sequence
  Description of Artificial Sequence: Synthetic polypeptide
DEEEIRTTNPVAYEQYGQSVSSEDLNQSFGSQQ

SEQ ID NO: 83404 - protein, 31 aa, Artificial Sequence
  Description of Artificial Sequence: Synthetic polypeptide
DEEEIRTTNPVAYERYGKISTNMESQDVNNF

SEQ ID NO: 83405 - protein, 33 aa, Artificial Sequence
  Description of Artificial Sequence: Synthetic polypeptide
DEGEIATTNPCSTEQYGSVSSTTPNLPNSGMNR

SEQ ID NO: 83406 - protein, 29 aa, Artificial Sequence
  Description of Artificial Sequence: Synthetic peptide
DEGEIATTNPVASEQWGIVSENLMNSGTA

SEQ ID NO: 83407 - protein, 30 aa, Artificial Sequence
  Description of Artificial Sequence: Synthetic polypeptide
DETEIRTTNPVATEGYGATANSTLQPGPYI

SEQ ID NO: 83408 - protein, 31 aa, Artificial Sequence
  Description of Artificial Sequence: Synthetic polypeptide
DEGEIATTNPVATAQWGCVATALQQMGNNRN

SEQ ID NO: 83409 - protein, 33 aa, Artificial Sequence
  Description of Artificial Sequence: Synthetic polypeptide
DDEEIRTTNPVATEQYGAVSTSLGLGTGNGGQE

SEQ ID NO: 83410 - protein, 30 aa, Artificial Sequence
  Description of Artificial Sequence: Synthetic polypeptide
DEGEIATTNPVATASWGCVATALQQRGNDQ

SEQ ID NO: 83411 - protein, 35 aa, Artificial Sequence
  Description of Artificial Sequence: Synthetic polypeptide
DEEEIRTTNPVATEQYGSVSSTTPAGPNMRGHNPV

SEQ ID NO: 83412 - protein, 33 aa, Artificial Sequence
  Description of Artificial Sequence: Synthetic polypeptide
DETEIRTTNPVATEIWGSVSSINEPQDREGENG

SEQ ID NO: 83413 - protein, 36 aa, Artificial Sequence
  Description of Artificial Sequence: Synthetic polypeptide
DEEEIRTTNPVATEQYGYSVSPTNNGLEEIGAENED

SEQ ID NO: 83414 - protein, 35 aa, Artificial Sequence
  Description of Artificial Sequence: Synthetic polypeptide
DEEEIRTTNPVATEQYGSVSSTTPAGPNMRNGMNV

SEQ ID NO: 83415 - protein, 32 aa, Artificial Sequence
  Description of Artificial Sequence: Synthetic polypeptide
DEEEIRTTNPVAYEQYGSVSCTLGPPTFGDQF

SEQ ID NO: 83416 - protein, 32 aa, Artificial Sequence
  Description of Artificial Sequence: Synthetic polypeptide
DETEIATTNPVAYEEWGSVSTNLQSGGDNGSS

SEQ ID NO: 83417 - protein, 31 aa, Artificial Sequence
  Description of Artificial Sequence: Synthetic polypeptide
DETEIATTNPVAYEFWGSVSTNNQGDLGNGS

SEQ ID NO: 83418 - protein, 35 aa, Artificial Sequence
  Description of Artificial Sequence: Synthetic polypeptide
DEEEIRTTNPVATEQYGSVSSTTPAGPNRNGMNPV

SEQ ID NO: 83419 - protein, 35 aa, Artificial Sequence
  Description of Artificial Sequence: Synthetic polypeptide
DEEEIRTTNPVATEQYGSVSSTTPAGPNRNGMNPL

SEQ ID NO: 83420 - protein, 33 aa, Artificial Sequence
  Description of Artificial Sequence: Synthetic polypeptide
DEGEIATTNPVATEQYGSVATNLEDTPGENMEN

SEQ ID NO: 83421 - protein, 32 aa, Artificial Sequence
  Description of Artificial Sequence: Synthetic polypeptide
DEDEIRTTNPVAYEQWGTVSTNLNQGEHNGDT

SEQ ID NO: 83422 - protein, 36 aa, Artificial Sequence
  Description of Artificial Sequence: Synthetic polypeptide
DEEEIRTTNPVATEQYGSVSSTTPAGPNQRNGMNVN

SEQ ID NO: 83423 - protein, 36 aa, Artificial Sequence
  Description of Artificial Sequence: Synthetic polypeptide
DEEEIRTTNPVATEQYGSVSSTTPAGPNQRNGMNPV

SEQ ID NO: 83424 - protein, 36 aa, Artificial Sequence
  Description of Artificial Sequence: Synthetic polypeptide
DEEEIRTTNPVATEQYGSVSSTTPAGPNQRGGMNDV

SEQ ID NO: 83425 - protein, 34 aa, Artificial Sequence
  Description of Artificial Sequence: Synthetic polypeptide
DEEEIRTTNPVATEQYGVVTGTNLSGEGQGNGGG

SEQ ID NO: 83426 - protein, 33 aa, Artificial Sequence
  Description of Artificial Sequence: Synthetic polypeptide
DEDEIRTTNPVAYEQWGTVSTNLNQGEAGNEGV

SEQ ID NO: 83427 - protein, 32 aa, Artificial Sequence
  Description of Artificial Sequence: Synthetic polypeptide
DEAEIATTNPVATEQYGSVAMNGLTQDGPQDA

SEQ ID NO: 83428 - protein, 31 aa, Artificial Sequence
  Description of Artificial Sequence: Synthetic polypeptide
AESEIACTNPVAYEQYGEVISENELQRGGGR

SEQ ID NO: 83429 - protein, 29 aa, Artificial Sequence
  Description of Artificial Sequence: Synthetic peptide
AESEIACTNPVAYEQYGEASENHQRGGGR

SEQ ID NO: 83430 - protein, 32 aa, Artificial Sequence
  Description of Artificial Sequence: Synthetic polypeptide
DETEIATTNPVAYEEWGSVSTNLNQAGGDNGH

SEQ ID NO: 83431 - protein, 35 aa, Artificial Sequence
  Description of Artificial Sequence: Synthetic polypeptide
DEEEIRTTNPVAYEQYGSTVCCTPNWLTNRGGTTR

SEQ ID NO: 83432 - protein, 32 aa, Artificial Sequence
  Description of Artificial Sequence: Synthetic polypeptide
DEEEIRTTNPVAYEQYGSTVHCTNAAGITDSR

SEQ ID NO: 83433 - protein, 31 aa, Artificial Sequence
  Description of Artificial Sequence: Synthetic polypeptide
DETEIATTNPVAYEQWGEVSTNLNGDHGNEQ

SEQ ID NO: 83434 - protein, 31 aa, Artificial Sequence
  Description of Artificial Sequence: Synthetic polypeptide
DETEIATTNPVAYEQWGNVSTNIQGNDGNQS

SEQ ID NO: 83435 - protein, 33 aa, Artificial Sequence
  Description of Artificial Sequence: Synthetic polypeptide
DEEEIRTTNPVAYEQYGSTVHCTNALQITDSDT

SEQ ID NO: 83436 - protein, 32 aa, Artificial Sequence
  Description of Artificial Sequence: Synthetic polypeptide
DETEIATTNPVAYEQWGSVCSTNDQGEGQNAS

SEQ ID NO: 83437 - protein, 33 aa, Artificial Sequence
  Description of Artificial Sequence: Synthetic polypeptide
DETEIATTNPVAYEQWGSVCSTNLDQHDHGNTD

SEQ ID NO: 83438 - protein, 33 aa, Artificial Sequence
  Description of Artificial Sequence: Synthetic polypeptide
DEEEIRTTNPVAYEQYGQTVSCINFEQRTGGTP

SEQ ID NO: 83439 - protein, 32 aa, Artificial Sequence
  Description of Artificial Sequence: Synthetic polypeptide
DETEIATTNPVAYEQWGSVSTANPEQGMNNGR

SEQ ID NO: 83440 - protein, 32 aa, Artificial Sequence
  Description of Artificial Sequence: Synthetic polypeptide
DETEIATTNPVAYEQWGSVSTANPEQGNMNMR

SEQ ID NO: 83441 - protein, 32 aa, Artificial Sequence
  Description of Artificial Sequence: Synthetic polypeptide
DETEIATTNPVAYEQWGSVSTNLNDGNGNGTM

SEQ ID NO: 83442 - protein, 32 aa, Artificial Sequence
  Description of Artificial Sequence: Synthetic polypeptide
DETEIATTNPVAYEQWGSVSTNLNGDGGNTEM

SEQ ID NO: 83443 - protein, 35 aa, Artificial Sequence
  Description of Artificial Sequence: Synthetic polypeptide
DEEEIRTTNPVATEQYGVVTSDTDNGQDQGNEGNI

SEQ ID NO: 83444 - protein, 36 aa, Artificial Sequence
  Description of Artificial Sequence: Synthetic polypeptide
DEEEIRTTNPVATEQYGVVTSTMNLSQDEMQGNIGD

SEQ ID NO: 83445 - protein, 35 aa, Artificial Sequence
  Description of Artificial Sequence: Synthetic polypeptide
DEEEIRTTNPVATEQYGVVTSTMNLSQDEMQNEGG

SEQ ID NO: 83446 - protein, 32 aa, Artificial Sequence
  Description of Artificial Sequence: Synthetic polypeptide
DETEIATTNPVAYEQWGCVTTNLQGNDMGNTR

SEQ ID NO: 83447 - protein, 31 aa, Artificial Sequence
  Description of Artificial Sequence: Synthetic polypeptide
DETEIATTNPVAYEEWGSVSTNAQSGGDNDH

SEQ ID NO: 83448 - protein, 31 aa, Artificial Sequence
  Description of Artificial Sequence: Synthetic polypeptide
DETEIATTNPVAYEEWGSVATNLQSGGDNTH

SEQ ID NO: 83449 - protein, 35 aa, Artificial Sequence
  Description of Artificial Sequence: Synthetic polypeptide
DEEEIRTTNPVATEQYGVVTDGTGNLQQNEGGNQG

SEQ ID NO: 83450 - protein, 36 aa, Artificial Sequence
  Description of Artificial Sequence: Synthetic polypeptide
DEEEIRTTNPVATEQYGSVSSTTPAGQNMRNGMNPV

SEQ ID NO: 83451 - protein, 36 aa, Artificial Sequence
  Description of Artificial Sequence: Synthetic polypeptide
DEEEIRTTNPVATEQYGSVSSTTPAGQNGRNGMNPV

SEQ ID NO: 83452 - protein, 33 aa, Artificial Sequence
  Description of Artificial Sequence: Synthetic polypeptide
DEGEIATTNPVATEQYGSVCAANLQEAQDGTNH

SEQ ID NO: 83453 - protein, 33 aa, Artificial Sequence
  Description of Artificial Sequence: Synthetic polypeptide
DEEEIRTTNPVAYEQYGQVVSQVQDHLQRGQIE

SEQ ID NO: 83454 - protein, 32 aa, Artificial Sequence
  Description of Artificial Sequence: Synthetic polypeptide
DDEEIRTTNPVATEQWGCVTSTEELQNGSDAS

SEQ ID NO: 83455 - protein, 33 aa, Artificial Sequence
  Description of Artificial Sequence: Synthetic polypeptide
DEGEIATTNPVATEQYGSVATNQLDQTAPGGEF

SEQ ID NO: 83456 - protein, 33 aa, Artificial Sequence
  Description of Artificial Sequence: Synthetic polypeptide
DDEEIRTTNPVATEQWGCVTSTELQNFGSQNAS

SEQ ID NO: 83457 - protein, 32 aa, Artificial Sequence
  Description of Artificial Sequence: Synthetic polypeptide
DDEEIRTTNPVATEQWGCVTSTELQNFNSDAM

SEQ ID NO: 83458 - protein, 33 aa, Artificial Sequence
  Description of Artificial Sequence: Synthetic polypeptide
DETEIATTNPVATEQYGSVSTPNPQQDHQDGQN

SEQ ID NO: 83459 - protein, 33 aa, Artificial Sequence
  Description of Artificial Sequence: Synthetic polypeptide
DETEIATTNPVATEQYGSVSTTDNLEDTEGEDL

SEQ ID NO: 83460 - protein, 33 aa, Artificial Sequence
  Description of Artificial Sequence: Synthetic polypeptide
DETEIATTNPVATEQYGSVSTTSNPGNHGQNPP

SEQ ID NO: 83461 - protein, 33 aa, Artificial Sequence
  Description of Artificial Sequence: Synthetic polypeptide
DEGEIATTNPVATEQYGSVATNLQSNDNHNTDS

SEQ ID NO: 83462 - protein, 33 aa, Artificial Sequence
  Description of Artificial Sequence: Synthetic polypeptide
DETEIATTNPVATEQYGSVTGPNPGQERNGNDE

SEQ ID NO: 83463 - protein, 33 aa, Artificial Sequence
  Description of Artificial Sequence: Synthetic polypeptide
DETEIATTNPVATETWGSVSTNLNQGDLGNNGS

SEQ ID NO: 83464 - protein, 32 aa, Artificial Sequence
  Description of Artificial Sequence: Synthetic polypeptide
DDEEIRTTNPVATEQWGCVTSTGELQNFNSQQ

SEQ ID NO: 83465 - protein, 32 aa, Artificial Sequence
  Description of Artificial Sequence: Synthetic polypeptide
DEAEIATTNPVATEQYGSVANNLENRDGDTLA

SEQ ID NO: 83466 - protein, 32 aa, Artificial Sequence
  Description of Artificial Sequence: Synthetic polypeptide
DMEEIRCTNPVATEQYGCSCSTNDQNFGSEQA

SEQ ID NO: 83467 - protein, 32 aa, Artificial Sequence
  Description of Artificial Sequence: Synthetic polypeptide
DETEIATTNPVAYECWGEVSTNLQGDVGDNER

SEQ ID NO: 83468 - protein, 30 aa, Artificial Sequence
  Description of Artificial Sequence: Synthetic polypeptide
DETEIATTNPVAYEAWGVATTNLQDGDNDR

SEQ ID NO: 83469 - protein, 31 aa, Artificial Sequence
  Description of Artificial Sequence: Synthetic polypeptide
DETEIATTNPVAYEAWGSVATNLQQSGGDNH

SEQ ID NO: 83470 - protein, 33 aa, Artificial Sequence
  Description of Artificial Sequence: Synthetic polypeptide
DETEIATTNPVATETYGTVSTNLQGDLGGNNGS

SEQ ID NO: 83471 - protein, 36 aa, Artificial Sequence
  Description of Artificial Sequence: Synthetic polypeptide
DEEEIRTTNPVATEQYGSVSSTTPAGPPMRNGMNPR

SEQ ID NO: 83472 - protein, 32 aa, Artificial Sequence
  Description of Artificial Sequence: Synthetic polypeptide
DETEIATTNPVATETWGSVSTNLQGDLQNNGS

SEQ ID NO: 83473 - protein, 31 aa, Artificial Sequence
  Description of Artificial Sequence: Synthetic polypeptide
AESEIACTNPVAYEQYGEASCENLQRVGGNR

SEQ ID NO: 83474 - protein, 32 aa, Artificial Sequence
  Description of Artificial Sequence: Synthetic polypeptide
DEEEIRTTNPVATEQYGVVTDGNMDEGETNGI

SEQ ID NO: 83475 - protein, 36 aa, Artificial Sequence
  Description of Artificial Sequence: Synthetic polypeptide
DEEEIRTTNPVATEQYGSVSSTTPAGPQMRNGMNPH

SEQ ID NO: 83476 - protein, 36 aa, Artificial Sequence
  Description of Artificial Sequence: Synthetic polypeptide
DEEEIRTTNPVATEQYGSVSSTTPAGPQMRNGMNPV

SEQ ID NO: 83477 - protein, 36 aa, Artificial Sequence
  Description of Artificial Sequence: Synthetic polypeptide
DEEEIRTTNPVATEQYGSVSSTTPAGPQQRNGMNPV

SEQ ID NO: 83478 - protein, 35 aa, Artificial Sequence
  Description of Artificial Sequence: Synthetic polypeptide
DEEEIRTTNPVAYEQYGQVVVSMMNDLLQPRGQIR

SEQ ID NO: 83479 - protein, 31 aa, Artificial Sequence
  Description of Artificial Sequence: Synthetic polypeptide
DEAEIATTNPVATEQYGSVAMNLTEAGSDPE

SEQ ID NO: 83480 - protein, 33 aa, Artificial Sequence
  Description of Artificial Sequence: Synthetic polypeptide
DEDEIRTTNPVAYEQWGTVSTNLQAGEHGNEGN

SEQ ID NO: 83481 - protein, 32 aa, Artificial Sequence
  Description of Artificial Sequence: Synthetic polypeptide
DDEEIRTTNPVATEQWGCVTSTGELQNGSEQN

SEQ ID NO: 83482 - protein, 35 aa, Artificial Sequence
  Description of Artificial Sequence: Synthetic polypeptide
DEEEIRTTNPVAYEQYGSVSCTLLGPQTFGNKQFT

SEQ ID NO: 83483 - protein, 36 aa, Artificial Sequence
  Description of Artificial Sequence: Synthetic polypeptide
DEEEIRTTNPVATEQYGSVSSTTPAGPNMRRGMNPV

SEQ ID NO: 83484 - protein, 32 aa, Artificial Sequence
  Description of Artificial Sequence: Synthetic polypeptide
DETEIATTNPVAYEQWGSVSTNLNMGEGNGNE

SEQ ID NO: 83485 - protein, 29 aa, Artificial Sequence
  Description of Artificial Sequence: Synthetic peptide
DDSEVASTNPVSTEGYGVVAADNLQRGNR

SEQ ID NO: 83486 - protein, 30 aa, Artificial Sequence
  Description of Artificial Sequence: Synthetic polypeptide
DETEIATTNPVAYESWGCVSTNLQSGGDSH

SEQ ID NO: 83487 - protein, 32 aa, Artificial Sequence
  Description of Artificial Sequence: Synthetic polypeptide
DETEIATTNPVAYESWGSVSTTNLQQSGGDNH

SEQ ID NO: 83488 - protein, 31 aa, Artificial Sequence
  Description of Artificial Sequence: Synthetic polypeptide
DETEIATTNPVAYESWGTVSTNLNQSGGDNH

SEQ ID NO: 83489 - protein, 33 aa, Artificial Sequence
  Description of Artificial Sequence: Synthetic polypeptide
DMEEIGTTNPVATEQYGCVSWTNLLQENMFNQE

SEQ ID NO: 83490 - protein, 35 aa, Artificial Sequence
  Description of Artificial Sequence: Synthetic polypeptide
DEEEIRTTNPVAYEQYGQSVSVNDLLQPRSIIERI

SEQ ID NO: 83491 - protein, 35 aa, Artificial Sequence
  Description of Artificial Sequence: Synthetic polypeptide
DEEEIRTTNPVATEQYGSVSPLVMLDQREGQLVIS

SEQ ID NO: 83492 - protein, 31 aa, Artificial Sequence
  Description of Artificial Sequence: Synthetic polypeptide
DETEIATTNPVAYETWGVVSTNLQNSGGDNH

SEQ ID NO: 83493 - protein, 31 aa, Artificial Sequence
  Description of Artificial Sequence: Synthetic polypeptide
DEGEIATTNPVATEQYGIVSATDLEHEGEDL

SEQ ID NO: 83494 - protein, 34 aa, Artificial Sequence
  Description of Artificial Sequence: Synthetic polypeptide
DEEEIRTTNPVAYEQYGSVPCCCVNELPSGGNRP

SEQ ID NO: 83495 - protein, 32 aa, Artificial Sequence
  Description of Artificial Sequence: Synthetic polypeptide
DEGEIATTNPVATEQYGIVSATDGPVESEGNR

SEQ ID NO: 83496 - protein, 35 aa, Artificial Sequence
  Description of Artificial Sequence: Synthetic polypeptide
DEEEIRTTNPVATEQYGSVSSTTPAGPNMRNGNPV

SEQ ID NO: 83497 - protein, 33 aa, Artificial Sequence
  Description of Artificial Sequence: Synthetic polypeptide
DEDEIRTTNPVAYEQWGSVVPTDNDEGQAGGNR

SEQ ID NO: 83498 - protein, 32 aa, Artificial Sequence
  Description of Artificial Sequence: Synthetic polypeptide
DEGEIATTNPVATEQYGIVSATDGPVEFEGNR

SEQ ID NO: 83499 - protein, 31 aa, Artificial Sequence
  Description of Artificial Sequence: Synthetic polypeptide
DETEIATTNPVAYERWGSVSTNLNGSGGDNH

SEQ ID NO: 83500 - protein, 32 aa, Artificial Sequence
  Description of Artificial Sequence: Synthetic polypeptide
DETEIATVNPVATEQYGSVSWTEDLDEGGGNH

SEQ ID NO: 83501 - protein, 34 aa, Artificial Sequence
  Description of Artificial Sequence: Synthetic polypeptide
DDEEIRTTNPVATEQWGSVVNSGLRLQREGQTRD

SEQ ID NO: 83502 - protein, 31 aa, Artificial Sequence
  Description of Artificial Sequence: Synthetic polypeptide
DEGEIATTNPVATEQYGCVATNLTDPGEEPN

SEQ ID NO: 83503 - protein, 31 aa, Artificial Sequence
  Description of Artificial Sequence: Synthetic polypeptide
AESEIACTNPVATEQYGETASCENLQRVGGR

SEQ ID NO: 83504 - protein, 28 aa, Artificial Sequence
  Description of Artificial Sequence: Synthetic peptide
AESEIACTNPVATEQYGEMSETLQHGDI

SEQ ID NO: 83505 - protein, 32 aa, Artificial Sequence
  Description of Artificial Sequence: Synthetic polypeptide
DEGEIATTNPVATEQYGCVATNLQSNDNQNTE

SEQ ID NO: 83506 - protein, 35 aa, Artificial Sequence
  Description of Artificial Sequence: Synthetic polypeptide
DEEEIRTTNPVAYEQYGSVPSCTDNMLPSGTDNDH

SEQ ID NO: 83507 - protein, 33 aa, Artificial Sequence
  Description of Artificial Sequence: Synthetic polypeptide
DEEEIRTTNPVATEQYGVVVATPNELSQDTVSP

SEQ ID NO: 83508 - protein, 36 aa, Artificial Sequence
  Description of Artificial Sequence: Synthetic polypeptide
DEEEIRTTNPVAYEQYGSVPSCTGNEHSQERDMINR

SEQ ID NO: 83509 - protein, 33 aa, Artificial Sequence
  Description of Artificial Sequence: Synthetic polypeptide
DEEEIRTTNPVATEQYGVVVGDTNQSELSGNGQ

SEQ ID NO: 83510 - protein, 35 aa, Artificial Sequence
  Description of Artificial Sequence: Synthetic polypeptide
DEEEIRTTNPVATEQYGSVSPMENDLNEGRMENEE

SEQ ID NO: 83511 - protein, 36 aa, Artificial Sequence
  Description of Artificial Sequence: Synthetic polypeptide
DEEEIRTTNPVAYEQYGSVPSTTLAGSNQRNEGNPV

SEQ ID NO: 83512 - protein, 31 aa, Artificial Sequence
  Description of Artificial Sequence: Synthetic polypeptide
DEGEIATTNPVATEQYGCVATNDTGTEGNEN

SEQ ID NO: 83513 - protein, 33 aa, Artificial Sequence
  Description of Artificial Sequence: Synthetic polypeptide
DMEEIGTTNPVATEQYGCVSTNLLQEHMFENQE

SEQ ID NO: 83514 - protein, 34 aa, Artificial Sequence
  Description of Artificial Sequence: Synthetic polypeptide
DMEEIGTTNPVATEQYGCVSSTNLLQERMFNNQE

SEQ ID NO: 83515 - protein, 31 aa, Artificial Sequence
  Description of Artificial Sequence: Synthetic polypeptide
DEGEIATTNPVATEQYGIVSACDLEHEGEDR

SEQ ID NO: 83516 - protein, 32 aa, Artificial Sequence
  Description of Artificial Sequence: Synthetic polypeptide
DEGEIATTNPVATEQYGSVAAANNLQENNNNP

SEQ ID NO: 83517 - protein, 34 aa, Artificial Sequence
  Description of Artificial Sequence: Synthetic polypeptide
DDEEIRTTNPVATEQWGSVTVNTGLGLGQREGTR

SEQ ID NO: 83518 - protein, 35 aa, Artificial Sequence
  Description of Artificial Sequence: Synthetic polypeptide
DEEEIRTTNPVATEQYGVVTVVVTNLLQAGNNEEM

SEQ ID NO: 83519 - protein, 32 aa, Artificial Sequence
  Description of Artificial Sequence: Synthetic polypeptide
DETEIATTNPVAYEQWGSVSTNLNMNGEGNNM

SEQ ID NO: 83520 - protein, 35 aa, Artificial Sequence
  Description of Artificial Sequence: Synthetic polypeptide
DEEEIRTTNPVATEQYGSVSPLDDSHILFQEGVRE

SEQ ID NO: 83521 - protein, 34 aa, Artificial Sequence
  Description of Artificial Sequence: Synthetic polypeptide
DEEEIRTTNPVAYEQYGSTVPSCTDLSGRLTNSA

SEQ ID NO: 83522 - protein, 35 aa, Artificial Sequence
  Description of Artificial Sequence: Synthetic polypeptide
DEEEIRTTNPVATEQYGSVSPLDDVSINFQEGVRY

SEQ ID NO: 83523 - protein, 36 aa, Artificial Sequence
  Description of Artificial Sequence: Synthetic polypeptide
DEEEIRTTNPVATEQYGVVTVSVTENLLQGIGTNTT

SEQ ID NO: 83524 - protein, 35 aa, Artificial Sequence
  Description of Artificial Sequence: Synthetic polypeptide
DEEEIRTTNPVAYEQYGSTVPSEASLSGRTGNERI

SEQ ID NO: 83525 - protein, 35 aa, Artificial Sequence
  Description of Artificial Sequence: Synthetic polypeptide
DEEEIRTTNPVATEQYGSVSPLDNSYILFQEGVQE

SEQ ID NO: 83526 - protein, 36 aa, Artificial Sequence
  Description of Artificial Sequence: Synthetic polypeptide
DEEEIRTTNPVATEQYGVVTVSVTNLNLQIGNNQES

SEQ ID NO: 83527 - protein, 36 aa, Artificial Sequence
  Description of Artificial Sequence: Synthetic polypeptide
DEEEIRTTNPVATEQYGVVTVSVTTNLLQGIGNTTD

SEQ ID NO: 83528 - protein, 33 aa, Artificial Sequence
  Description of Artificial Sequence: Synthetic polypeptide
DEEEIRTTNPVAYEQYGQSVVSINQSQITGTTS

SEQ ID NO: 83529 - protein, 31 aa, Artificial Sequence
  Description of Artificial Sequence: Synthetic polypeptide
DEGEIATTNPVATEQYGSVANNLENDNNDDH

SEQ ID NO: 83530 - protein, 33 aa, Artificial Sequence
  Description of Artificial Sequence: Synthetic polypeptide
DETEIATTNPVAYEQWGSVSTTNMLQSGPNDAE

SEQ ID NO: 83531 - protein, 37 aa, Artificial Sequence
  Description of Artificial Sequence: Synthetic polypeptide
DEEEIRTTNPVAYEQYGQSVVPSQTNALSQMTGITNR

SEQ ID NO: 83532 - protein, 33 aa, Artificial Sequence
  Description of Artificial Sequence: Synthetic polypeptide
DETEIATTNPVAYEQWGSVSTTNNLQDGPNEAE

SEQ ID NO: 83533 - protein, 35 aa, Artificial Sequence
  Description of Artificial Sequence: Synthetic polypeptide
DEEEIRTTNPVATEQYGSVSPLENLHQPTNENDQQ

SEQ ID NO: 83534 - protein, 35 aa, Artificial Sequence
  Description of Artificial Sequence: Synthetic polypeptide
DEEEIRTTNPVAYEQYGSTVSCTGDLSGRVVTNSR

SEQ ID NO: 83535 - protein, 34 aa, Artificial Sequence
  Description of Artificial Sequence: Synthetic polypeptide
DETEIATTNPVAYEQWGSVSTTNQLQSGPNEQRE

SEQ ID NO: 83536 - protein, 33 aa, Artificial Sequence
  Description of Artificial Sequence: Synthetic polypeptide
DMEEIGTTNPVATEQYGSVFTNALQERMEVVQQ

SEQ ID NO: 83537 - protein, 33 aa, Artificial Sequence
  Description of Artificial Sequence: Synthetic polypeptide
DEGEIATTNPVATEQYGSVAITNLPQNNENTEG

SEQ ID NO: 83538 - protein, 32 aa, Artificial Sequence
  Description of Artificial Sequence: Synthetic polypeptide
DETEIATTNPVAYEQYGSVSNGNPGQRGGEDE

SEQ ID NO: 83539 - protein, 34 aa, Artificial Sequence
  Description of Artificial Sequence: Synthetic polypeptide
DEEEIRTTNPVAYEQYGQSVSWGNDLNQNFGSEQ

SEQ ID NO: 83540 - protein, 35 aa, Artificial Sequence
  Description of Artificial Sequence: Synthetic polypeptide
DEEEIRTTNPVAYEQYGSTVVWCTNALQVTDESNR

SEQ ID NO: 83541 - protein, 36 aa, Artificial Sequence
  Description of Artificial Sequence: Synthetic polypeptide
DEEEIRTTNPVATEQYGSVSPLMNQLQGTEGSNNEN

SEQ ID NO: 83542 - protein, 36 aa, Artificial Sequence
  Description of Artificial Sequence: Synthetic polypeptide
DEEEIRTTNPVATEQYGSVSSTTPAGPNMRRGFNPV

SEQ ID NO: 83543 - protein, 35 aa, Artificial Sequence
  Description of Artificial Sequence: Synthetic polypeptide
DEEEIRTTNPVAYEQYGSTVVFCTNALQVVTDSNR

SEQ ID NO: 83544 - protein, 32 aa, Artificial Sequence
  Description of Artificial Sequence: Synthetic polypeptide
DETEIATTNPVAYEQYGSVATNGTQTRNGDEQ

SEQ ID NO: 83545 - protein, 33 aa, Artificial Sequence
  Description of Artificial Sequence: Synthetic polypeptide
DEGEIATTNPVATEQYGSVAMNLTQDNNNDTRM

SEQ ID NO: 83546 - protein, 35 aa, Artificial Sequence
  Description of Artificial Sequence: Synthetic polypeptide
DEEEIRTTNPVAYEQYGSTVSTGASLSGRTGNEII

SEQ ID NO: 83547 - protein, 35 aa, Artificial Sequence
  Description of Artificial Sequence: Synthetic polypeptide
DEEEIRTTNPVAYEQYGSTVSTGASLSGMTGNERE

SEQ ID NO: 83548 - protein, 35 aa, Artificial Sequence
  Description of Artificial Sequence: Synthetic polypeptide
DEEEIRTTNPVAYEQYGQSVTSTNDLLQPRSIEKM

SEQ ID NO: 83549 - protein, 34 aa, Artificial Sequence
  Description of Artificial Sequence: Synthetic polypeptide
DEEEIRTTNPVAYEQYGQSVTSVQDALQRVAERI

SEQ ID NO: 83550 - protein, 31 aa, Artificial Sequence
  Description of Artificial Sequence: Synthetic polypeptide
DDSEVASTNPVSTEQYGNVSTNTGQSRVGNR

SEQ ID NO: 83551 - protein, 30 aa, Artificial Sequence
  Description of Artificial Sequence: Synthetic polypeptide
DEEEIRTTNPVSTEQYGCVTSEHQGFGSQQ

SEQ ID NO: 83552 - protein, 35 aa, Artificial Sequence
  Description of Artificial Sequence: Synthetic polypeptide
DEEEIRTTNPVATEQYGSVSSTTPAGPNMANGNPV

SEQ ID NO: 83553 - protein, 30 aa, Artificial Sequence
  Description of Artificial Sequence: Synthetic polypeptide
DDSEVRCTNPVATEQYGSVAAETIMRVGNR

SEQ ID NO: 83554 - protein, 33 aa, Artificial Sequence
  Description of Artificial Sequence: Synthetic polypeptide
DEEEIRTTNPVSTEAYGSVTYFANDLWQAGNQT

SEQ ID NO: 83555 - protein, 33 aa, Artificial Sequence
  Description of Artificial Sequence: Synthetic polypeptide
DEAEIATTNPVATEQYGCVSTNLGAGNAGENAD

SEQ ID NO: 83556 - protein, 34 aa, Artificial Sequence
  Description of Artificial Sequence: Synthetic polypeptide
DEEEIRTTNPVATEQYGSVSPNNQQLAQTVEDGE

SEQ ID NO: 83557 - protein, 32 aa, Artificial Sequence
  Description of Artificial Sequence: Synthetic polypeptide
DEEEIRTTNPVSTEGYGSVSRTNFLENMVTFP

SEQ ID NO: 83558 - protein, 30 aa, Artificial Sequence
  Description of Artificial Sequence: Synthetic polypeptide
AENEVACTNPVATEQYGEVSNTLQSRVGQR

SEQ ID NO: 83559 - protein, 31 aa, Artificial Sequence
  Description of Artificial Sequence: Synthetic polypeptide
DEGEIACTNPVATEQYGCVATNLQMDGSESH

SEQ ID NO: 83560 - protein, 33 aa, Artificial Sequence
  Description of Artificial Sequence: Synthetic polypeptide
DEEEIRTTNPVATEQYGSVSPNNQTDTIEDIFD

SEQ ID NO: 83561 - protein, 32 aa, Artificial Sequence
  Description of Artificial Sequence: Synthetic polypeptide
DEEEIRTTNPVSTEGYGSVSRTNFLEPVTFVP

SEQ ID NO: 83562 - protein, 28 aa, Artificial Sequence
  Description of Artificial Sequence: Synthetic peptide
AENEVACTNPVATEQYGEASNTIQRGQR

SEQ ID NO: 83563 - protein, 31 aa, Artificial Sequence
  Description of Artificial Sequence: Synthetic polypeptide
DEEEIRTTNPVSTEIFGTVTTFENLQGGLQT

SEQ ID NO: 83564 - protein, 31 aa, Artificial Sequence
  Description of Artificial Sequence: Synthetic polypeptide
DEEEIRTTNPVSTEIYGTQVTFENLQGEGTT

SEQ ID NO: 83565 - protein, 31 aa, Artificial Sequence
  Description of Artificial Sequence: Synthetic polypeptide
DEEEIRTTNPVSTEIYGTVTFENLQGGIQTV

SEQ ID NO: 83566 - protein, 36 aa, Artificial Sequence
  Description of Artificial Sequence: Synthetic polypeptide
DEEEIRTTNPVATEQYGSVSSTTNGGPNMRNGMNTA

SEQ ID NO: 83567 - protein, 28 aa, Artificial Sequence
  Description of Artificial Sequence: Synthetic peptide
AENEVACTNPVATEQYGEASNTIQRGGR

SEQ ID NO: 83568 - protein, 29 aa, Artificial Sequence
  Description of Artificial Sequence: Synthetic peptide
AENEVASTNPVATEQYGEASANTIQRGQR

SEQ ID NO: 83569 - protein, 36 aa, Artificial Sequence
  Description of Artificial Sequence: Synthetic polypeptide
DEEEIRTTNPVATEQYGSVSSTTNAGQNMENGVNNV

SEQ ID NO: 83570 - protein, 35 aa, Artificial Sequence
  Description of Artificial Sequence: Synthetic polypeptide
DEEEIRTTNPVATEQYGYVSTVNGDQGGQGENQGN

SEQ ID NO: 83571 - protein, 36 aa, Artificial Sequence
  Description of Artificial Sequence: Synthetic polypeptide
DEEEIRTTNPVATEQYGSVSSTTNAGPNMRNGWNPV

SEQ ID NO: 83572 - protein, 31 aa, Artificial Sequence
  Description of Artificial Sequence: Synthetic polypeptide
DEGEIACTNPVATEQYGCVATNLQAEGGEEA

SEQ ID NO: 83573 - protein, 36 aa, Artificial Sequence
  Description of Artificial Sequence: Synthetic polypeptide
DEEEIRTTNPVATEQYGSVSSTTNAGPNMRNGMNPV

SEQ ID NO: 83574 - protein, 32 aa, Artificial Sequence
  Description of Artificial Sequence: Synthetic polypeptide
DEGEIACTNPVATEQYGCVATNLQAEDDGVRN

SEQ ID NO: 83575 - protein, 29 aa, Artificial Sequence
  Description of Artificial Sequence: Synthetic peptide
AENEVACTNPVATEQYGEASANTIQRGQR

SEQ ID NO: 83576 - protein, 34 aa, Artificial Sequence
  Description of Artificial Sequence: Synthetic polypeptide
DEEEIRTTNPVSTEPYGSVSSTPDGQQQRNGMNH

SEQ ID NO: 83577 - protein, 34 aa, Artificial Sequence
  Description of Artificial Sequence: Synthetic polypeptide
DEDEIRTTNPVAYEQWGSVSTGNGNEQRDGPNES

SEQ ID NO: 83578 - protein, 31 aa, Artificial Sequence
  Description of Artificial Sequence: Synthetic polypeptide
DEGEIACTNPVATEQYGCVATNLQADNDNNY

SEQ ID NO: 83579 - protein, 32 aa, Artificial Sequence
  Description of Artificial Sequence: Synthetic polypeptide
DEEEIRTTNPVSTEPYGTISEEDLQQQQNGNR

SEQ ID NO: 83580 - protein, 33 aa, Artificial Sequence
  Description of Artificial Sequence: Synthetic polypeptide
DEEEIRTTNPVATEQYGYYTIMTNGDGQEGGNG

SEQ ID NO: 83581 - protein, 30 aa, Artificial Sequence
  Description of Artificial Sequence: Synthetic polypeptide
DEEEIRTTNPVSTEPYGTISMDIQQQNGNH

SEQ ID NO: 83582 - protein, 31 aa, Artificial Sequence
  Description of Artificial Sequence: Synthetic polypeptide
DEEEIRTTNPVSTEPYGTISMEDIMQRNGNH

SEQ ID NO: 83583 - protein, 32 aa, Artificial Sequence
  Description of Artificial Sequence: Synthetic polypeptide
DEGEIAATNPVATEQYGCVAITNLEQTGEGGR

SEQ ID NO: 83584 - protein, 34 aa, Artificial Sequence
  Description of Artificial Sequence: Synthetic polypeptide
DEEEIRTTNPVAYEQYGQSDSCTQDQLQQQGVPR

SEQ ID NO: 83585 - protein, 31 aa, Artificial Sequence
  Description of Artificial Sequence: Synthetic polypeptide
DEGEIACTNPVATEQYGCVATNLQTDNNTPE

SEQ ID NO: 83586 - protein, 31 aa, Artificial Sequence
  Description of Artificial Sequence: Synthetic polypeptide
DEGEIACTNPVATEQYGCVATNLTAPGEMRV

SEQ ID NO: 83587 - protein, 32 aa, Artificial Sequence
  Description of Artificial Sequence: Synthetic polypeptide
DEGEIACTNPVATEQYGSVAITNSLFQVDGEF

SEQ ID NO: 83588 - protein, 34 aa, Artificial Sequence
  Description of Artificial Sequence: Synthetic polypeptide
DEEEIRTTNPVAYEQYGQSVCSWMNDLEQNGSQQ

SEQ ID NO: 83589 - protein, 32 aa, Artificial Sequence
  Description of Artificial Sequence: Synthetic polypeptide
DEAEIATTNPVATEQYGSCTAATPLQNEENNR

SEQ ID NO: 83590 - protein, 33 aa, Artificial Sequence
  Description of Artificial Sequence: Synthetic polypeptide
DEEEIRTTNPVATEQYGYVSTMDNGPEIQNDDN

SEQ ID NO: 83591 - protein, 30 aa, Artificial Sequence
  Description of Artificial Sequence: Synthetic polypeptide
DEGEIAPTNPCASEQYGIVSCINLPQSGTR

SEQ ID NO: 83592 - protein, 35 aa, Artificial Sequence
  Description of Artificial Sequence: Synthetic polypeptide
DEEEIRTTNPVATEQYGSVSSTTPAEPNMRNGNPV

SEQ ID NO: 83593 - protein, 35 aa, Artificial Sequence
  Description of Artificial Sequence: Synthetic polypeptide
DEEEIRTTNPVATEQYGYVSTMNLGDQQGEGEGGD

SEQ ID NO: 83594 - protein, 32 aa, Artificial Sequence
  Description of Artificial Sequence: Synthetic polypeptide
DEEEIRTTNPVGTERYGSVSCTNEHSGKVGQP

SEQ ID NO: 83595 - protein, 34 aa, Artificial Sequence
  Description of Artificial Sequence: Synthetic polypeptide
DEEEIRTTNPVATEQYGSVSPNNLDELLEQVSEE

SEQ ID NO: 83596 - protein, 35 aa, Artificial Sequence
  Description of Artificial Sequence: Synthetic polypeptide
DEEEIRTTNPVATEQYGSVSSTTPAEPNMRNGMNV

SEQ ID NO: 83597 - protein, 35 aa, Artificial Sequence
  Description of Artificial Sequence: Synthetic polypeptide
DEEEIRTTNPVAYEQYGQSVCSTNDLFQYFGSDQA

SEQ ID NO: 83598 - protein, 35 aa, Artificial Sequence
  Description of Artificial Sequence: Synthetic polypeptide
DEEEIRTTNPVGYEAWGSVVSTGNPLQRTGGNYRQ

SEQ ID NO: 83599 - protein, 34 aa, Artificial Sequence
  Description of Artificial Sequence: Synthetic polypeptide
DEEEIRTTNPVAYEQYGQSVCSTGNDHNQGGSEQ

SEQ ID NO: 83600 - protein, 35 aa, Artificial Sequence
  Description of Artificial Sequence: Synthetic polypeptide
DEEEIRTTNPVGYEAWGSVVSTNMLTQRTGGNYRE

SEQ ID NO: 83601 - protein, 31 aa, Artificial Sequence
  Description of Artificial Sequence: Synthetic polypeptide
DEGEIACTNPVAYEQYGSVATNLQVGDQTDQ

SEQ ID NO: 83602 - protein, 34 aa, Artificial Sequence
  Description of Artificial Sequence: Synthetic polypeptide
DEEEIRTTNPVAYEQYGQSVCSSNDLDQHFGSQQ

SEQ ID NO: 83603 - protein, 31 aa, Artificial Sequence
  Description of Artificial Sequence: Synthetic polypeptide
DEGEIACTNPVAYEQYGSVATNLQTANPVEN

SEQ ID NO: 83604 - protein, 34 aa, Artificial Sequence
  Description of Artificial Sequence: Synthetic polypeptide
DEEEIRTTNPVAYEQYGQSVCSSENDHNQRGSQQ

SEQ ID NO: 83605 - protein, 31 aa, Artificial Sequence
  Description of Artificial Sequence: Synthetic polypeptide
DEEEIRTTNPVSTEAYGSVTFNDLTQGEQTD

SEQ ID NO: 83606 - protein, 33 aa, Artificial Sequence
  Description of Artificial Sequence: Synthetic polypeptide
DEEEIRTTNPVSTEAYGSVSRVNFLWTGINTDP

SEQ ID NO: 83607 - protein, 31 aa, Artificial Sequence
  Description of Artificial Sequence: Synthetic polypeptide
AENEVASTNPVATEQYGEVSANTLQSRVGQR

SEQ ID NO: 83608 - protein, 30 aa, Artificial Sequence
  Description of Artificial Sequence: Synthetic polypeptide
AENEVASTNPVATEQYGEVSNTLQSRVGQR

SEQ ID NO: 83609 - protein, 31 aa, Artificial Sequence
  Description of Artificial Sequence: Synthetic polypeptide
DEGEIACTNPVATEQYGSVATNLEAPAENEN

SEQ ID NO: 83610 - protein, 34 aa, Artificial Sequence
  Description of Artificial Sequence: Synthetic polypeptide
DDEEIRTTNPVATEQYGCVCSNTENLQFFGSDQA

SEQ ID NO: 83611 - protein, 29 aa, Artificial Sequence
  Description of Artificial Sequence: Synthetic peptide
DEGEIAATNGCAYMPYGSVSTNLQRADDR

SEQ ID NO: 83612 - protein, 34 aa, Artificial Sequence
  Description of Artificial Sequence: Synthetic polypeptide
DEEEIRTTNPVGYEQYGSVVPSCTNELIGRVGFP

SEQ ID NO: 83613 - protein, 34 aa, Artificial Sequence
  Description of Artificial Sequence: Synthetic polypeptide
DDEEIRTTNPVATEQYGCVCSNTELQNFGSNNDI

SEQ ID NO: 83614 - protein, 33 aa, Artificial Sequence
  Description of Artificial Sequence: Synthetic polypeptide
DEDEIRTTNPVAYEQWGSVSTNAQQGEGGNANI

SEQ ID NO: 83615 - protein, 32 aa, Artificial Sequence
  Description of Artificial Sequence: Synthetic polypeptide
DEGEIACTNPVAYEQYGSVAITNLQVTDNPRE

SEQ ID NO: 83616 - protein, 32 aa, Artificial Sequence
  Description of Artificial Sequence: Synthetic polypeptide
DEGEIACTNPVAYEQYGSVAITNLQVTEGGRE

SEQ ID NO: 83617 - protein, 31 aa, Artificial Sequence
  Description of Artificial Sequence: Synthetic polypeptide
DEGEIACTNPVAYEQYGSVATNLQGNVMQDD

SEQ ID NO: 83618 - protein, 35 aa, Artificial Sequence
  Description of Artificial Sequence: Synthetic polypeptide
DEEEIRTTNPVATEQYGSVSSTTPAEPNMRAGNPV

SEQ ID NO: 83619 - protein, 33 aa, Artificial Sequence
  Description of Artificial Sequence: Synthetic polypeptide
DEEEIRTTNPVGYEQYGSVVPCTNELSGRVGFP

SEQ ID NO: 83620 - protein, 32 aa, Artificial Sequence
  Description of Artificial Sequence: Synthetic polypeptide
DEAEIATTNPVATEQYGSTAATEVLEARDGDR

SEQ ID NO: 83621 - protein, 32 aa, Artificial Sequence
  Description of Artificial Sequence: Synthetic polypeptide
AENEIVTTNPVATEQYGTVCSAEDGLVQRGND

SEQ ID NO: 83622 - protein, 36 aa, Artificial Sequence
  Description of Artificial Sequence: Synthetic polypeptide
DEEEIRTTNPVATEQYGSVSSTTLAGPNMRNGMNPV

SEQ ID NO: 83623 - protein, 33 aa, Artificial Sequence
  Description of Artificial Sequence: Synthetic polypeptide
DEEEIRTTNPVAYEQYGQCVSTPDLNQNGSEQA

SEQ ID NO: 83624 - protein, 34 aa, Artificial Sequence
  Description of Artificial Sequence: Synthetic polypeptide
DEEEIRTTNPVATERWGHVSLTNELMSMATEGNR

SEQ ID NO: 83625 - protein, 30 aa, Artificial Sequence
  Description of Artificial Sequence: Synthetic polypeptide
AENEIVCTNPVATEQYGEASATGLVQFGGR

SEQ ID NO: 83626 - protein, 34 aa, Artificial Sequence
  Description of Artificial Sequence: Synthetic polypeptide
DEEEIRTTNPVAYEQYGQCVSTNDHNQNGSENQA

SEQ ID NO: 83627 - protein, 30 aa, Artificial Sequence
  Description of Artificial Sequence: Synthetic polypeptide
AENEIVCTNPVATEQYGEACSENPVQRGGR

SEQ ID NO: 83628 - protein, 32 aa, Artificial Sequence
  Description of Artificial Sequence: Synthetic polypeptide
DDEEIRTTNPVATEQYGCVCSTEHQGFGSDIA

SEQ ID NO: 83629 - protein, 32 aa, Artificial Sequence
  Description of Artificial Sequence: Synthetic polypeptide
DEAEIATTNPVATEQYGCVAATPNDQQAGPNE

SEQ ID NO: 83630 - protein, 33 aa, Artificial Sequence
  Description of Artificial Sequence: Synthetic polypeptide
DEEEIRTTNPVSTEQWGSVPTWDNDLQDGMGQT

SEQ ID NO: 83631 - protein, 31 aa, Artificial Sequence
  Description of Artificial Sequence: Synthetic polypeptide
DEEEIRTTNPVSTEQWGSVTGDNGNQGGDQT

SEQ ID NO: 83632 - protein, 32 aa, Artificial Sequence
  Description of Artificial Sequence: Synthetic polypeptide
DDEEIRTTNPVATEQYGCVCSTEHQSFGSQQS

SEQ ID NO: 83633 - protein, 36 aa, Artificial Sequence
  Description of Artificial Sequence: Synthetic polypeptide
DEEEIRTTNPVATEQYGSVSSTTEAGPNMQNGMNPV

SEQ ID NO: 83634 - protein, 32 aa, Artificial Sequence
  Description of Artificial Sequence: Synthetic polypeptide
DEEEIRTTNPVSTEQWGSVYIIDNLQDGGDQT

SEQ ID NO: 83635 - protein, 32 aa, Artificial Sequence
  Description of Artificial Sequence: Synthetic polypeptide
DEEEIRTTNPVSTEQYGCVAFNGLQGMGPQFT

SEQ ID NO: 83636 - protein, 31 aa, Artificial Sequence
  Description of Artificial Sequence: Synthetic polypeptide
DEEEIRTTNPVSTEQYGCVCFSELQGGSQQA

SEQ ID NO: 83637 - protein, 32 aa, Artificial Sequence
  Description of Artificial Sequence: Synthetic polypeptide
DDEEIRTTNPVATEQYGCVCSTEHQFFGSDIA

SEQ ID NO: 83638 - protein, 32 aa, Artificial Sequence
  Description of Artificial Sequence: Synthetic polypeptide
DEEEIRTTNPVSTEQYGCVCGSNLQEGGSQQA

SEQ ID NO: 83639 - protein, 34 aa, Artificial Sequence
  Description of Artificial Sequence: Synthetic polypeptide
DEDEIRTTNPVATEPYGSVCFTNEDQTQMGGNHR

SEQ ID NO: 83640 - protein, 35 aa, Artificial Sequence
  Description of Artificial Sequence: Synthetic polypeptide
DEEEIRTTNPVATERYGHTVQSQNMLSQNDGGNNR

SEQ ID NO: 83641 - protein, 35 aa, Artificial Sequence
  Description of Artificial Sequence: Synthetic polypeptide
DEEEIRTTNPVATEQYGSVSSTTDGGVNMREGMNV

SEQ ID NO: 83642 - protein, 32 aa, Artificial Sequence
  Description of Artificial Sequence: Synthetic polypeptide
DEEEIRTTNPVSTEQYGCVCQSELQGFGSQNQ

SEQ ID NO: 83643 - protein, 33 aa, Artificial Sequence
  Description of Artificial Sequence: Synthetic polypeptide
DETEIRTTNPVAVEQYGSVIITNGLEGGGNNQG

SEQ ID NO: 83644 - protein, 33 aa, Artificial Sequence
  Description of Artificial Sequence: Synthetic polypeptide
DETEIRTTNPVAVEQYGSVIITNGLEGGNGNNG

SEQ ID NO: 83645 - protein, 35 aa, Artificial Sequence
  Description of Artificial Sequence: Synthetic polypeptide
DEEEIRTTNPVATEQYGSVSSTTDAPVEREGMNPV

SEQ ID NO: 83646 - protein, 35 aa, Artificial Sequence
  Description of Artificial Sequence: Synthetic polypeptide
DEEEIRTTNPVATEQYGSVSSTTDAPPEREGMNPV

SEQ ID NO: 83647 - protein, 34 aa, Artificial Sequence
  Description of Artificial Sequence: Synthetic polypeptide
DETEIRTTNPVAVEQYGSVISTNGGERGNGNDGI

SEQ ID NO: 83648 - protein, 35 aa, Artificial Sequence
  Description of Artificial Sequence: Synthetic polypeptide
DEEEIRTTNPVATERYGKHVQSQNELSQNDGGNNR

SEQ ID NO: 83649 - protein, 35 aa, Artificial Sequence
  Description of Artificial Sequence: Synthetic polypeptide
DEEEIRTTNPVATERYGKTVCSQNELSQYDGGNNR

SEQ ID NO: 83650 - protein, 35 aa, Artificial Sequence
  Description of Artificial Sequence: Synthetic polypeptide
DEEEIRTTNPVATEQYGSVSSTTAGPNSRNGMNPV

SEQ ID NO: 83651 - protein, 32 aa, Artificial Sequence
  Description of Artificial Sequence: Synthetic polypeptide
DETEIRTTNPVAYEAWGCVSTNLQGNDMGGTR

SEQ ID NO: 83652 - protein, 35 aa, Artificial Sequence
  Description of Artificial Sequence: Synthetic polypeptide
DEEEIRTTNPVATERYGKTVQSQFNLSQENGGNNR

SEQ ID NO: 83653 - protein, 32 aa, Artificial Sequence
  Description of Artificial Sequence: Synthetic polypeptide
DEEEIRTTNPVSTEQYGCVCGTSELQGFGSQQ

SEQ ID NO: 83654 - protein, 33 aa, Artificial Sequence
  Description of Artificial Sequence: Synthetic polypeptide
DEEEIRTTNPVAYEQYGQCVSWNDHNQRFGSIQ

SEQ ID NO: 83655 - protein, 33 aa, Artificial Sequence
  Description of Artificial Sequence: Synthetic polypeptide
DDEEIRTTNPVATEQYGCVCSTEEHQFFGSNDA

SEQ ID NO: 83656 - protein, 32 aa, Artificial Sequence
  Description of Artificial Sequence: Synthetic polypeptide
DEDEIRTTNPVAYEQWGSVSTDNHGAAGDNSS

SEQ ID NO: 83657 - protein, 36 aa, Artificial Sequence
  Description of Artificial Sequence: Synthetic polypeptide
DEEEIRTTNPVATEQYGSVSSTTLAGPNMRNGMNEV

SEQ ID NO: 83658 - protein, 36 aa, Artificial Sequence
  Description of Artificial Sequence: Synthetic polypeptide
DEEEIRTTNPVATEQYGSVSSTTLAGPNMRIGMNPV

SEQ ID NO: 83659 - protein, 33 aa, Artificial Sequence
  Description of Artificial Sequence: Synthetic polypeptide
DEEEIRTTNPVATEQYGSVSPNSNIWIDGELIF

SEQ ID NO: 83660 - protein, 36 aa, Artificial Sequence
  Description of Artificial Sequence: Synthetic polypeptide
DEEEIRTTNPVATEQYGSVSSTTLAGNNQLNGNNTV

SEQ ID NO: 83661 - protein, 36 aa, Artificial Sequence
  Description of Artificial Sequence: Synthetic polypeptide
DEEEIRTTNPVATEQYGSVSSTTLAGMNMRNGMNPV

SEQ ID NO: 83662 - protein, 36 aa, Artificial Sequence
  Description of Artificial Sequence: Synthetic polypeptide
DEEEIRTTNPVATEQYGSVSSTTLAGGNMRNGMNPV

SEQ ID NO: 83663 - protein, 29 aa, Artificial Sequence
  Description of Artificial Sequence: Synthetic peptide
AENEIVTTNPVATEQYGEVCSEGPEFGGR

SEQ ID NO: 83664 - protein, 31 aa, Artificial Sequence
  Description of Artificial Sequence: Synthetic polypeptide
DEEEIRTTNPVSTEPYGTISMEDIQQRNGNH

SEQ ID NO: 83665 - protein, 32 aa, Artificial Sequence
  Description of Artificial Sequence: Synthetic polypeptide
DEGAVRTTNPVATEQYGYSFASTGNLIIDGER

SEQ ID NO: 83666 - protein, 35 aa, Artificial Sequence
  Description of Artificial Sequence: Synthetic polypeptide
DEEEIRTTNPVATEQYGSVSSTTIGPNMRAGMNPV

SEQ ID NO: 83667 - protein, 31 aa, Artificial Sequence
  Description of Artificial Sequence: Synthetic polypeptide
DEEEIRTTNPVSTEPYGTISMEDLQQQQGNH

SEQ ID NO: 83668 - protein, 33 aa, Artificial Sequence
  Description of Artificial Sequence: Synthetic polypeptide
DEGAIRTTNPVATEQYGYSFHSTGNLIINGEDR

SEQ ID NO: 83669 - protein, 33 aa, Artificial Sequence
  Description of Artificial Sequence: Synthetic polypeptide
DEGAIRTTNPVATEQYGSFVSTLTLIEGQISRG

SEQ ID NO: 83670 - protein, 32 aa, Artificial Sequence
  Description of Artificial Sequence: Synthetic polypeptide
AENEIVTTNPVATEQYGEVCSATDGLVQFGND

SEQ ID NO: 83671 - protein, 35 aa, Artificial Sequence
  Description of Artificial Sequence: Synthetic polypeptide
DEEEIRTTNPVATEQYGSVSPNTNDSQIRNFEVDH

SEQ ID NO: 83672 - protein, 32 aa, Artificial Sequence
  Description of Artificial Sequence: Synthetic polypeptide
DDEEIRTTNPVATEQYGCVCSSEHQNFGSNIA

SEQ ID NO: 83673 - protein, 32 aa, Artificial Sequence
  Description of Artificial Sequence: Synthetic polypeptide
DEEEIRTTNPVSTEPYGTVSMEAGQNQQNGNH

SEQ ID NO: 83674 - protein, 32 aa, Artificial Sequence
  Description of Artificial Sequence: Synthetic polypeptide
DEGAIRTTNPVATEQYGSFSETVLIEIPENQR

SEQ ID NO: 83675 - protein, 32 aa, Artificial Sequence
  Description of Artificial Sequence: Synthetic polypeptide
DEGAIRTTNPVATEQYGSFSTLHLIEGQISRV

SEQ ID NO: 83676 - protein, 31 aa, Artificial Sequence
  Description of Artificial Sequence: Synthetic polypeptide
AENEIVTTNPVATEQYGEASTDGPVQREGND

SEQ ID NO: 83677 - protein, 34 aa, Artificial Sequence
  Description of Artificial Sequence: Synthetic polypeptide
DDYEIRTTNPVATEQYGSCSTTNLHQDIGDNQQM

SEQ ID NO: 83678 - protein, 35 aa, Artificial Sequence
  Description of Artificial Sequence: Synthetic polypeptide
DEEEIRTTNPVATEQYGSVSPNTNLNILVGEILGE

SEQ ID NO: 83679 - protein, 31 aa, Artificial Sequence
  Description of Artificial Sequence: Synthetic polypeptide
DEAEIATTNPVATEQYGCVAATTEQMGQDRN

SEQ ID NO: 83680 - protein, 34 aa, Artificial Sequence
  Description of Artificial Sequence: Synthetic polypeptide
DEGECIRTTNPVAYEQWGSVATNNALSQLGGNRD

SEQ ID NO: 83681 - protein, 32 aa, Artificial Sequence
  Description of Artificial Sequence: Synthetic polypeptide
DETEIRTTNPVATEQYGVVSSVLLQFFPENDE

SEQ ID NO: 83682 - protein, 34 aa, Artificial Sequence
  Description of Artificial Sequence: Synthetic polypeptide
DEEEIRTTNPVAYEQYGQIFVSQYDLTQRGTERM

SEQ ID NO: 83683 - protein, 33 aa, Artificial Sequence
  Description of Artificial Sequence: Synthetic polypeptide
DEEEIRTTNPVAYEQYGQKTVSCEVNQTGTVNR

SEQ ID NO: 83684 - protein, 32 aa, Artificial Sequence
  Description of Artificial Sequence: Synthetic polypeptide
DEEEIRTTNPVSTEPYGTVSMPAGQNQQNGNH

SEQ ID NO: 83685 - protein, 31 aa, Artificial Sequence
  Description of Artificial Sequence: Synthetic polypeptide
DEAEIATTNPVATEQYGCVATNLQADDPPVQ

SEQ ID NO: 83686 - protein, 35 aa, Artificial Sequence
  Description of Artificial Sequence: Synthetic polypeptide
DEEEIRTTNPVAYEQYGQNTVVSCTNELQDTGNQD

SEQ ID NO: 83687 - protein, 35 aa, Artificial Sequence
  Description of Artificial Sequence: Synthetic polypeptide
DEEEIRTTNPVAYEQYGQQTVVSQTNELQDTGGNS

SEQ ID NO: 83688 - protein, 31 aa, Artificial Sequence
  Description of Artificial Sequence: Synthetic polypeptide
DEAEIATTNPVATEQYGCVAGTGLQADTNGE

SEQ ID NO: 83689 - protein, 35 aa, Artificial Sequence
  Description of Artificial Sequence: Synthetic polypeptide
DEEEIRTTNPVATEQYGSVSSTTPAGPNMANGMNV

SEQ ID NO: 83690 - protein, 34 aa, Artificial Sequence
  Description of Artificial Sequence: Synthetic polypeptide
DEEEIRTTNPVAYEQYGQSVCSWNDLNQHFGSEV

SEQ ID NO: 83691 - protein, 30 aa, Artificial Sequence
  Description of Artificial Sequence: Synthetic polypeptide
DEGEIAPTNPCASEQYGSVSSTCALNSGTR

SEQ ID NO: 83692 - protein, 29 aa, Artificial Sequence
  Description of Artificial Sequence: Synthetic peptide
AEQEIACTNPVATEQYGSASENLEHGGDL

SEQ ID NO: 83693 - protein, 32 aa, Artificial Sequence
  Description of Artificial Sequence: Synthetic polypeptide
DEAEIATTNPVATEQYGSVAATTNLADGPPQP

SEQ ID NO: 83694 - protein, 29 aa, Artificial Sequence
  Description of Artificial Sequence: Synthetic peptide
DEGEIAPTNPVSSEQWGIVSCNLQSEGTR

SEQ ID NO: 83695 - protein, 33 aa, Artificial Sequence
  Description of Artificial Sequence: Synthetic polypeptide
DETEIRTTNPVATEQYGSVIEPWPELQRIQNEL

SEQ ID NO: 83696 - protein, 29 aa, Artificial Sequence
  Description of Artificial Sequence: Synthetic peptide
DEGEIAPTNPVSSEQWGIVSCNLQSAGTR

SEQ ID NO: 83697 - protein, 31 aa, Artificial Sequence
  Description of Artificial Sequence: Synthetic polypeptide
AEQEIACTNPVATEQYGEVSENLQDHEGGDR

SEQ ID NO: 83698 - protein, 30 aa, Artificial Sequence
  Description of Artificial Sequence: Synthetic polypeptide
DGENLRTTNPVATEQWGSVTSTLLMGEGTG

SEQ ID NO: 83699 - protein, 34 aa, Artificial Sequence
  Description of Artificial Sequence: Synthetic polypeptide
DEEEIRTTNPVCYEPYGSVVSCHPNLSQRGGNNL

SEQ ID NO: 83700 - protein, 36 aa, Artificial Sequence
  Description of Artificial Sequence: Synthetic polypeptide
DEEEIRTTNPVATEQYGSVSSTTPAGPNELNGGNPV

SEQ ID NO: 83701 - protein, 31 aa, Artificial Sequence
  Description of Artificial Sequence: Synthetic polypeptide
DEGEIAPTNPVASEQYGIVCSTNLVQFEGTD

SEQ ID NO: 83702 - protein, 34 aa, Artificial Sequence
  Description of Artificial Sequence: Synthetic polypeptide
DEAEIATTNPVATEQYGSVAATPNNLDGRPSNRN

SEQ ID NO: 83703 - protein, 31 aa, Artificial Sequence
  Description of Artificial Sequence: Synthetic polypeptide
DDSEVRTTNPVATEQYGNVSANTEQSRVEDR

SEQ ID NO: 83704 - protein, 34 aa, Artificial Sequence
  Description of Artificial Sequence: Synthetic polypeptide
DEEEIRTTNPVGTEFYGSVNIMGNLQREGGNDGD

SEQ ID NO: 83705 - protein, 32 aa, Artificial Sequence
  Description of Artificial Sequence: Synthetic polypeptide
DEEEIRTTNPVATEQYGYTISESFEEVRGEQQ

SEQ ID NO: 83706 - protein, 29 aa, Artificial Sequence
  Description of Artificial Sequence: Synthetic peptide
DEGEIAPTNPVSSEQYGIVSATNLEHGTL

SEQ ID NO: 83707 - protein, 33 aa, Artificial Sequence
  Description of Artificial Sequence: Synthetic polypeptide
DEEEIRTTNPVGTEFYGSVNMPELQREGGNDGD

SEQ ID NO: 83708 - protein, 30 aa, Artificial Sequence
  Description of Artificial Sequence: Synthetic polypeptide
DEGEIAPTNPCSTEQYGIVSTNLEDHEGER

SEQ ID NO: 83709 - protein, 33 aa, Artificial Sequence
  Description of Artificial Sequence: Synthetic polypeptide
DEEEIRTTNPVGTEFYGSVNNMPDLGQREGGNG

SEQ ID NO: 83710 - protein, 34 aa, Artificial Sequence
  Description of Artificial Sequence: Synthetic polypeptide
DEEEIRTTNPVAYEQYGQSVSNTVGLLNIGAEQR

SEQ ID NO: 83711 - protein, 32 aa, Artificial Sequence
  Description of Artificial Sequence: Synthetic polypeptide
DEEEIRTTNPVATEQYGYTISPSFEEFRGGQN

SEQ ID NO: 83712 - protein, 29 aa, Artificial Sequence
  Description of Artificial Sequence: Synthetic peptide
DEGEIAPTNPCSTEQYGIVSCNLQDHGEL

SEQ ID NO: 83713 - protein, 29 aa, Artificial Sequence
  Description of Artificial Sequence: Synthetic peptide
DEGEIAPTNPCSTEQYGIVSCNLEDSGER

SEQ ID NO: 83714 - protein, 35 aa, Artificial Sequence
  Description of Artificial Sequence: Synthetic polypeptide
DEEEIRTTNPVATEQYGSVSSTTPAGPMMRNGNPA

SEQ ID NO: 83715 - protein, 32 aa, Artificial Sequence
  Description of Artificial Sequence: Synthetic polypeptide
DETEIRTTNPVATEQYGSVSAADLEDHEGEDL

SEQ ID NO: 83716 - protein, 34 aa, Artificial Sequence
  Description of Artificial Sequence: Synthetic polypeptide
DEEEIRTTNPVGTEIYGSVSTNNGLQGEGGQGET

SEQ ID NO: 83717 - protein, 34 aa, Artificial Sequence
  Description of Artificial Sequence: Synthetic polypeptide
DEEEIRTTNPVGTEQWGSVATANELGERGGDINA

SEQ ID NO: 83718 - protein, 36 aa, Artificial Sequence
  Description of Artificial Sequence: Synthetic polypeptide
DEEEIRTTNPVATEQYGSVSSTTPAGPLMRNGMNPV

SEQ ID NO: 83719 - protein, 36 aa, Artificial Sequence
  Description of Artificial Sequence: Synthetic polypeptide
DEEEIRTTNPVATEQYGSVSSTTPAGPLMRDGMNPV

SEQ ID NO: 83720 - protein, 33 aa, Artificial Sequence
  Description of Artificial Sequence: Synthetic polypeptide
DEAEIATTNPVATEQYGSVAATNVDQVGDGNPV

SEQ ID NO: 83721 - protein, 34 aa, Artificial Sequence
  Description of Artificial Sequence: Synthetic polypeptide
DEAEIATTNPVATEQYGSVAATNQLQDRPGPQVM

SEQ ID NO: 83722 - protein, 35 aa, Artificial Sequence
  Description of Artificial Sequence: Synthetic polypeptide
DEEEIRTTNPVAYEQYGQSVSNTVGLLQQGVSQNE

SEQ ID NO: 83723 - protein, 30 aa, Artificial Sequence
  Description of Artificial Sequence: Synthetic polypeptide
DEGEIAPTNPVSTEQYGNVSACNIQSSGQR

SEQ ID NO: 83724 - protein, 33 aa, Artificial Sequence
  Description of Artificial Sequence: Synthetic polypeptide
DEEEIRTTNPVCYEPYGSVSCDPNLSQYGGNNL

SEQ ID NO: 83725 - protein, 35 aa, Artificial Sequence
  Description of Artificial Sequence: Synthetic polypeptide
DEEEIRTTNPVAYEQYGQSVSPVTNNELQRTVEQT

SEQ ID NO: 83726 - protein, 36 aa, Artificial Sequence
  Description of Artificial Sequence: Synthetic polypeptide
DEEEIRTTNPVATEQYGSVSSTTPAGPNLRNGVNPV

SEQ ID NO: 83727 - protein, 35 aa, Artificial Sequence
  Description of Artificial Sequence: Synthetic polypeptide
DEEEIRTTNPVATEQYGYSVSPTNNHEAIGEENED

SEQ ID NO: 83728 - protein, 36 aa, Artificial Sequence
  Description of Artificial Sequence: Synthetic polypeptide
DEEEIRTTNPVATEQYGSVSSTTPAGPNLRNGMNPV

SEQ ID NO: 83729 - protein, 36 aa, Artificial Sequence
  Description of Artificial Sequence: Synthetic polypeptide
DEEEIRTTNPVATEQYGSVSSTTPAGPNLRNGMNPS

SEQ ID NO: 83730 - protein, 30 aa, Artificial Sequence
  Description of Artificial Sequence: Synthetic polypeptide
DEGEIATTNPCASEQYGSVSCNLEDHGEDL

SEQ ID NO: 83731 - protein, 33 aa, Artificial Sequence
  Description of Artificial Sequence: Synthetic polypeptide
DEDEIRTTNPVAYEQWGSVSTTNDGGFQGNNER

SEQ ID NO: 83732 - protein, 33 aa, Artificial Sequence
  Description of Artificial Sequence: Synthetic polypeptide
DEDEIRTTNPVAYEQWGSVSTTNAIQGNGNANI

SEQ ID NO: 83733 - protein, 32 aa, Artificial Sequence
  Description of Artificial Sequence: Synthetic polypeptide
DHQEIATTNPVATEQYGSVSATNLEDHEGEDL

SEQ ID NO: 83734 - protein, 31 aa, Artificial Sequence
  Description of Artificial Sequence: Synthetic polypeptide
DDSEVRCTNPVATEQYGSVAANTIMSRVGNR

SEQ ID NO: 83735 - protein, 30 aa, Artificial Sequence
  Description of Artificial Sequence: Synthetic polypeptide
DEEEIRTTNPVCTEPYGVISMEDIQSNGNQ

SEQ ID NO: 83736 - protein, 30 aa, Artificial Sequence
  Description of Artificial Sequence: Synthetic polypeptide
DEEEIRTTNPVCTEQWGVVSDIEQNSAENQ

SEQ ID NO: 83737 - protein, 29 aa, Artificial Sequence
  Description of Artificial Sequence: Synthetic peptide
DEGEIATTNPCASEQYGIVSCNPVQSGTD

SEQ ID NO: 83738 - protein, 28 aa, Artificial Sequence
  Description of Artificial Sequence: Synthetic peptide
DEGEIATTNPCASEQWGIVSENLMSGTA

SEQ ID NO: 83739 - protein, 30 aa, Artificial Sequence
  Description of Artificial Sequence: Synthetic polypeptide
DEEEIRTTNPVCTEQWGVVSEIEQNSAENQ

SEQ ID NO: 83740 - protein, 31 aa, Artificial Sequence
  Description of Artificial Sequence: Synthetic polypeptide
DEEEIRTTNPVCTEQYGCVAFNLQGEMPPTD

SEQ ID NO: 83741 - protein, 30 aa, Artificial Sequence
  Description of Artificial Sequence: Synthetic polypeptide
DEGEIASTNPVSTEQYGNVSACNIQSSGQR

SEQ ID NO: 83742 - protein, 35 aa, Artificial Sequence
  Description of Artificial Sequence: Synthetic polypeptide
DEEEIRTTNPVCTEQYGSVGSPTGNGHQERDMIPR

SEQ ID NO: 83743 - protein, 34 aa, Artificial Sequence
  Description of Artificial Sequence: Synthetic polypeptide
DEEEIRTTNPVAYEQYGQSVSPVTQGLLQPGVEL

SEQ ID NO: 83744 - protein, 34 aa, Artificial Sequence
  Description of Artificial Sequence: Synthetic polypeptide
DEEEIRTTNPVCTEQYGVVSTDNLPNMSNGMNPV

SEQ ID NO: 83745 - protein, 32 aa, Artificial Sequence
  Description of Artificial Sequence: Synthetic polypeptide
DETEIRTTNPVATEQYGSVCTPDYDQEGGDED

SEQ ID NO: 83746 - protein, 34 aa, Artificial Sequence
  Description of Artificial Sequence: Synthetic polypeptide
DEEEIRTTNPVCTEQYGSVSTPNGPNMSNGMNPQ

SEQ ID NO: 83747 - protein, 35 aa, Artificial Sequence
  Description of Artificial Sequence: Synthetic polypeptide
DEEEIRTTNPVCTEQYGSVSSTTPALPNMRNGNPV

SEQ ID NO: 83748 - protein, 28 aa, Artificial Sequence
  Description of Artificial Sequence: Synthetic peptide
DEGEIASTNPCSTEGYGIVACNIQRGQR

SEQ ID NO: 83749 - protein, 33 aa, Artificial Sequence
  Description of Artificial Sequence: Synthetic polypeptide
DEEEIRTTNPVGTEQWGSVSTANELGERDDFAH

SEQ ID NO: 83750 - protein, 30 aa, Artificial Sequence
  Description of Artificial Sequence: Synthetic polypeptide
AEQEIACTNPVATEQYGSVSTDLEDHGGDL

SEQ ID NO: 83751 - protein, 34 aa, Artificial Sequence
  Description of Artificial Sequence: Synthetic polypeptide
DETEIRTTNPVATEQYGSVATTNPGMERNGQNGE

SEQ ID NO: 83752 - protein, 28 aa, Artificial Sequence
  Description of Artificial Sequence: Synthetic peptide
DEGEIASTNPCSTEGYGIVACNIQRGTR

SEQ ID NO: 83753 - protein, 30 aa, Artificial Sequence
  Description of Artificial Sequence: Synthetic polypeptide
AENEIACTNPVATEQYGEASENLQRYGSGD

SEQ ID NO: 83754 - protein, 31 aa, Artificial Sequence
  Description of Artificial Sequence: Synthetic polypeptide
AEQEIACTNPVATEQYGVASANLQRGDGQRV

SEQ ID NO: 83755 - protein, 35 aa, Artificial Sequence
  Description of Artificial Sequence: Synthetic polypeptide
DEEEIRTTNPVAYEQYGQSVSQMLDLLQPRIGQIR

SEQ ID NO: 83756 - protein, 34 aa, Artificial Sequence
  Description of Artificial Sequence: Synthetic polypeptide
DEEEIRTTNPVCTEQYGSVSSTPALPNMSGMNPV

SEQ ID NO: 83757 - protein, 34 aa, Artificial Sequence
  Description of Artificial Sequence: Synthetic polypeptide
DEEEIRTTNPVCTEQYGSVSSTTAGPNRNGMNPV

SEQ ID NO: 83758 - protein, 29 aa, Artificial Sequence
  Description of Artificial Sequence: Synthetic peptide
DEGEIAPTNPCASEQYGIVSSCNLNSGTR

SEQ ID NO: 83759 - protein, 34 aa, Artificial Sequence
  Description of Artificial Sequence: Synthetic polypeptide
DEEEIRTTNPVGTEQWGSVSTANELGERGDIMAE

SEQ ID NO: 83760 - protein, 30 aa, Artificial Sequence
  Description of Artificial Sequence: Synthetic polypeptide
AEQEIACTNPVATEQYGEASENLQDHEGGR

SEQ ID NO: 83761 - protein, 31 aa, Artificial Sequence
  Description of Artificial Sequence: Synthetic polypeptide
AEPEIRTTNPVATEEYGCTIEGVLQRGNQRG

SEQ ID NO: 83762 - protein, 33 aa, Artificial Sequence
  Description of Artificial Sequence: Synthetic polypeptide
DEDEIRTTNPVAYEQWGSVSTNLNAGNDGQNAY

SEQ ID NO: 83763 - protein, 34 aa, Artificial Sequence
  Description of Artificial Sequence: Synthetic polypeptide
DEEEIRTTNPVAYEQYGQSVSCINEFEQATGTTR

SEQ ID NO: 83764 - protein, 33 aa, Artificial Sequence
  Description of Artificial Sequence: Synthetic polypeptide
DEDEIRTTNPVAYEQWGSVSTNLNAGEDGMNAD

SEQ ID NO: 83765 - protein, 31 aa, Artificial Sequence
  Description of Artificial Sequence: Synthetic polypeptide
DEAEIATTNPVATEQYGSVAANGNTNMDGNN

SEQ ID NO: 83766 - protein, 36 aa, Artificial Sequence
  Description of Artificial Sequence: Synthetic polypeptide
DEEEIRTTNPVATEQYGSVSSTTPAGLNMRNGMNPV

SEQ ID NO: 83767 - protein, 29 aa, Artificial Sequence
  Description of Artificial Sequence: Synthetic peptide
AENYIACTNPVATEQYGETSENLQRGGQW

SEQ ID NO: 83768 - protein, 33 aa, Artificial Sequence
  Description of Artificial Sequence: Synthetic polypeptide
DEEEIRTTNPVGTEQYGSVSINNGLGEGGFEED

SEQ ID NO: 83769 - protein, 29 aa, Artificial Sequence
  Description of Artificial Sequence: Synthetic peptide
DEGEIAPTNPCSSEQYGIVSCNLQSGETR

SEQ ID NO: 83770 - protein, 29 aa, Artificial Sequence
  Description of Artificial Sequence: Synthetic peptide
DEGEIAPTNPCSSEQYGIVSCNLQNSGTR

SEQ ID NO: 83771 - protein, 29 aa, Artificial Sequence
  Description of Artificial Sequence: Synthetic peptide
DEGEIAPTNPCSSEQYGIVSATNLQHGTL

SEQ ID NO: 83772 - protein, 35 aa, Artificial Sequence
  Description of Artificial Sequence: Synthetic polypeptide
DEEEIRTTNPVAYEQYGQSVPSGTNSSGRGGNMEI

SEQ ID NO: 83773 - protein, 34 aa, Artificial Sequence
  Description of Artificial Sequence: Synthetic polypeptide
DEEEIRTTNPVAYEQYGQSVNCINFAQRTGGTRQ

SEQ ID NO: 83774 - protein, 33 aa, Artificial Sequence
  Description of Artificial Sequence: Synthetic polypeptide
DEAEIATTNPVATEQYGSVAAATNTGNRGPTRQ

SEQ ID NO: 83775 - protein, 35 aa, Artificial Sequence
  Description of Artificial Sequence: Synthetic polypeptide
DEEEIRTTNPVATEQYGSVSSTTPAGNMHNGMNPV

SEQ ID NO: 83776 - protein, 29 aa, Artificial Sequence
  Description of Artificial Sequence: Synthetic peptide
AENSIGCTNPVATEQYGETSENLQRGGQK

SEQ ID NO: 83777 - protein, 29 aa, Artificial Sequence
  Description of Artificial Sequence: Synthetic peptide
AENSIACTNPVATEQYGEVTSEPLQRGGQ

SEQ ID NO: 83778 - protein, 32 aa, Artificial Sequence
  Description of Artificial Sequence: Synthetic polypeptide
DEAEIATTNPVATEQYGSVAAATNQQRPSTVQ

SEQ ID NO: 83779 - protein, 32 aa, Artificial Sequence
  Description of Artificial Sequence: Synthetic polypeptide
DEAEIATTNPVATEQYGSVAAATNQQPGITDQ

SEQ ID NO: 83780 - protein, 29 aa, Artificial Sequence
  Description of Artificial Sequence: Synthetic peptide
DEGEIAPTNPCATEQYGTVSTDNPEFGTD

SEQ ID NO: 83781 - protein, 29 aa, Artificial Sequence
  Description of Artificial Sequence: Synthetic peptide
AENNIACTNPVATEQYGETSENLQRGGEE

SEQ ID NO: 83782 - protein, 29 aa, Artificial Sequence
  Description of Artificial Sequence: Synthetic peptide
DEGEIAPTNPCATEQYGTVSCDNPEFGTR

SEQ ID NO: 83783 - protein, 33 aa, Artificial Sequence
  Description of Artificial Sequence: Synthetic polypeptide
DEEEIRTTNPVGTEQYGSVVGTNGLGEGGFGET

SEQ ID NO: 83784 - protein, 30 aa, Artificial Sequence
  Description of Artificial Sequence: Synthetic polypeptide
AENMIACTNPVATEQYGEAVSIENLQRGGY

SEQ ID NO: 83785 - protein, 35 aa, Artificial Sequence
  Description of Artificial Sequence: Synthetic polypeptide
DEEEIRTTNPVATEQYGYVSNMNNLIGQGGGNDGD

SEQ ID NO: 83786 - protein, 29 aa, Artificial Sequence
  Description of Artificial Sequence: Synthetic peptide
DEGEIAPTNPCATEQWGIVSCNLMSAGDR

SEQ ID NO: 83787 - protein, 34 aa, Artificial Sequence
  Description of Artificial Sequence: Synthetic polypeptide
DEEEIRTTNPVAYEQYGQSVEAENDLLQDEGIER

SEQ ID NO: 83788 - protein, 34 aa, Artificial Sequence
  Description of Artificial Sequence: Synthetic polypeptide
DEEEIRTTNPVGTEQYGSVYSGTNGLGEGGFEET

SEQ ID NO: 83789 - protein, 29 aa, Artificial Sequence
  Description of Artificial Sequence: Synthetic peptide
DEGEIAPTNPCATECYGAVWSCNLQPGPI

SEQ ID NO: 83790 - protein, 32 aa, Artificial Sequence
  Description of Artificial Sequence: Synthetic polypeptide
DEEEIRTTNPVGTEQYGVVSSSAGPQRNGMDI

SEQ ID NO: 83791 - protein, 34 aa, Artificial Sequence
  Description of Artificial Sequence: Synthetic polypeptide
DEEEIRTTNPVAYEQYGQSVMEYNDLLQPRGIEQ

SEQ ID NO: 83792 - protein, 32 aa, Artificial Sequence
  Description of Artificial Sequence: Synthetic polypeptide
DEAEIATTNPVATEQYGSVAANLQDTDDNTNG

SEQ ID NO: 83793 - protein, 35 aa, Artificial Sequence
  Description of Artificial Sequence: Synthetic polypeptide
DEEEIRTTNPVATEQYGSVSSTTPAGNMRNGMNPV

SEQ ID NO: 83794 - protein, 34 aa, Artificial Sequence
  Description of Artificial Sequence: Synthetic polypeptide
DEEEIRTTNPVGTEQYGSVNSTMGLQGEGGFGET

SEQ ID NO: 83795 - protein, 34 aa, Artificial Sequence
  Description of Artificial Sequence: Synthetic polypeptide
DEEEIRTTNPVGTEQWGSVSTANELGERGDQTAK

SEQ ID NO: 83796 - protein, 34 aa, Artificial Sequence
  Description of Artificial Sequence: Synthetic polypeptide
DEEEIRTTNPVGTEQWGSVSTANELGERPGDIAQ

SEQ ID NO: 83797 - protein, 33 aa, Artificial Sequence
  Description of Artificial Sequence: Synthetic polypeptide
DEEEIRTTNPVGTEQWGSVSTPELGERGDQEAE

SEQ ID NO: 83798 - protein, 32 aa, Artificial Sequence
  Description of Artificial Sequence: Synthetic polypeptide
DEEEIRTTNPVGTEQYGCVAFNLQGEGGQDTG

SEQ ID NO: 83799 - protein, 33 aa, Artificial Sequence
  Description of Artificial Sequence: Synthetic polypeptide
DEEEIRTTNPVGTEQYGCVCSTGNALAYGSDQS

SEQ ID NO: 83800 - protein, 32 aa, Artificial Sequence
  Description of Artificial Sequence: Synthetic polypeptide
DEEEIRTTNPVGTEQYGCVCSTNDHAYGSQQS

SEQ ID NO: 83801 - protein, 29 aa, Artificial Sequence
  Description of Artificial Sequence: Synthetic peptide
AEQEIACTNPVATEQYGEASENLEHGGDR

SEQ ID NO: 83802 - protein, 33 aa, Artificial Sequence
  Description of Artificial Sequence: Synthetic polypeptide
DEEEIRTTNPVGTEQYGCVCSTNDLANFGSFQM

SEQ ID NO: 83803 - protein, 33 aa, Artificial Sequence
  Description of Artificial Sequence: Synthetic polypeptide
DEDEIRTTNPVAYEQWGSVSTNLPQGDTQGGGA

SEQ ID NO: 83804 - protein, 33 aa, Artificial Sequence
  Description of Artificial Sequence: Synthetic polypeptide
DEEEIRTTNPVGTEQYGCVCSTNDLGNFGSQAA

SEQ ID NO: 83805 - protein, 32 aa, Artificial Sequence
  Description of Artificial Sequence: Synthetic polypeptide
DEAEIATTNPVATEQYGSVAATNGASEIGNLV

SEQ ID NO: 83806 - protein, 29 aa, Artificial Sequence
  Description of Artificial Sequence: Synthetic peptide
DEGEIAPTNPCSSEQYGNVSCNLQSSGTR

SEQ ID NO: 83807 - protein, 32 aa, Artificial Sequence
  Description of Artificial Sequence: Synthetic polypeptide
DEEEIRTTNPVGTEQYGCVCSTNDPIYGSDQS

SEQ ID NO: 83808 - protein, 29 aa, Artificial Sequence
  Description of Artificial Sequence: Synthetic peptide
DEGEIAPTNPCSSEQYGIVSTTNLQSGTV

SEQ ID NO: 83809 - protein, 28 aa, Artificial Sequence
  Description of Artificial Sequence: Synthetic peptide
AEQEIACTNPVATEQYGCASQNLQADGP

SEQ ID NO: 83810 - protein, 34 aa, Artificial Sequence
  Description of Artificial Sequence: Synthetic polypeptide
DEEEIRTTNPVAYEQYGQSVSEVQDALQIGAERV

SEQ ID NO: 83811 - protein, 30 aa, Artificial Sequence
  Description of Artificial Sequence: Synthetic polypeptide
AEQEIACTNPVATEQYGCASGANLQMPGQR

SEQ ID NO: 83812 - protein, 33 aa, Artificial Sequence
  Description of Artificial Sequence: Synthetic polypeptide
DEAEIATTNPVATEQYGSVAANLQEIEGGNDMG

SEQ ID NO: 83813 - protein, 33 aa, Artificial Sequence
  Description of Artificial Sequence: Synthetic polypeptide
DEEEIRTTNPVGTEQYGSVCTDNNGQGGGQGTL

SEQ ID NO: 83814 - protein, 28 aa, Artificial Sequence
  Description of Artificial Sequence: Synthetic peptide
DEGEIAPTNPCSSEQYGIVSCNLQSGTH

SEQ ID NO: 83815 - protein, 35 aa, Artificial Sequence
  Description of Artificial Sequence: Synthetic polypeptide
DEEEIRTTNPVATEQYGSVSSTTPAGNMSNGMNPV

SEQ ID NO: 83816 - protein, 31 aa, Artificial Sequence
  Description of Artificial Sequence: Synthetic polypeptide
DEEEIRTTNPVGTEQYGSMATPAGPQHNGDV

SEQ ID NO: 83817 - protein, 36 aa, Artificial Sequence
  Description of Artificial Sequence: Synthetic polypeptide
DEEEIRTTNPVATEQYGSVSSTTPAGNNMRNGMNDV

SEQ ID NO: 83818 - protein, 30 aa, Artificial Sequence
  Description of Artificial Sequence: Synthetic polypeptide
AEQEIACTNPVATEQYGEASENLQDHGGDR

SEQ ID NO: 83819 - protein, 36 aa, Artificial Sequence
  Description of Artificial Sequence: Synthetic polypeptide
DEEEIRTTNPVATEQYGSVSSTTPAGNNMRNGMNPV

SEQ ID NO: 83820 - protein, 33 aa, Artificial Sequence
  Description of Artificial Sequence: Synthetic polypeptide
DEAEIATTNPVATEQYGSVAATALQRENPNEST

SEQ ID NO: 83821 - protein, 30 aa, Artificial Sequence
  Description of Artificial Sequence: Synthetic polypeptide
AEQEIACTNPVATEQWGEASENLQRGMGDR

SEQ ID NO: 83822 - protein, 30 aa, Artificial Sequence
  Description of Artificial Sequence: Synthetic polypeptide
AEQEIACTNPVATEQYGCASANLQEAPGQR

SEQ ID NO: 83823 - protein, 29 aa, Artificial Sequence
  Description of Artificial Sequence: Synthetic peptide
AEQEIACTNPVATEQYGCASANLQGGGQD

SEQ ID NO: 83824 - protein, 32 aa, Artificial Sequence
  Description of Artificial Sequence: Synthetic polypeptide
DEAEIATTNPVATEQYGSVAATNDARQDNNEA

SEQ ID NO: 83825 - protein, 35 aa, Artificial Sequence
  Description of Artificial Sequence: Synthetic polypeptide
DEEEIRTTNPVAYEQYGQSVSEVNDELVERMGIER

SEQ ID NO: 83826 - protein, 34 aa, Artificial Sequence
  Description of Artificial Sequence: Synthetic polypeptide
DEEEIRTTNPVATEQYGSVSSTTPAGNRNEMNPV

SEQ ID NO: 83827 - protein, 33 aa, Artificial Sequence
  Description of Artificial Sequence: Synthetic polypeptide
DEAEIATTNPVATEQYGSVAGANLQEAEGGNDN

SEQ ID NO: 83828 - protein, 32 aa, Artificial Sequence
  Description of Artificial Sequence: Synthetic polypeptide
DEEEISTTNPVATEQYGCVCSSEHQNFGSNQA

SEQ ID NO: 83829 - protein, 32 aa, Artificial Sequence
  Description of Artificial Sequence: Synthetic polypeptide
DEDEIRTTNPVATEQWGGCCATNHQAAEGNPR

SEQ ID NO: 83830 - protein, 33 aa, Artificial Sequence
  Description of Artificial Sequence: Synthetic polypeptide
DEVEIATTNPVAYEQWGSVSKTDQQLQERQGNM

SEQ ID NO: 83831 - protein, 34 aa, Artificial Sequence
  Description of Artificial Sequence: Synthetic polypeptide
DEEEIRTTNPVATEQYGSVSPYNEATEGNMLDEN

SEQ ID NO: 83832 - protein, 34 aa, Artificial Sequence
  Description of Artificial Sequence: Synthetic polypeptide
DEEEIRTTNPVATEQYGSVSPYNECTEGNMVDQN

SEQ ID NO: 83833 - protein, 35 aa, Artificial Sequence
  Description of Artificial Sequence: Synthetic polypeptide
DEEEIRTTNPVATEQYGSVSPYNENTTEGNMNDRN

SEQ ID NO: 83834 - protein, 32 aa, Artificial Sequence
  Description of Artificial Sequence: Synthetic polypeptide
DEVEIATTNPVAYEQWGSVCSTNDQDGHGNSS

SEQ ID NO: 83835 - protein, 32 aa, Artificial Sequence
  Description of Artificial Sequence: Synthetic polypeptide
DEVEIATTNPVAYEQWGSVCSTDNDQSGGNES

SEQ ID NO: 83836 - protein, 32 aa, Artificial Sequence
  Description of Artificial Sequence: Synthetic polypeptide
DEEQIACTNPVATEQWGSVATNNLETLGVNDR

SEQ ID NO: 83837 - protein, 35 aa, Artificial Sequence
  Description of Artificial Sequence: Synthetic polypeptide
DEEEIRTTNPVAVEQYGSVSTVVNNQQNQNNGNED

SEQ ID NO: 83838 - protein, 31 aa, Artificial Sequence
  Description of Artificial Sequence: Synthetic polypeptide
DEEQIACTNPVATEQWGSVSATNHGLASENT

SEQ ID NO: 83839 - protein, 30 aa, Artificial Sequence
  Description of Artificial Sequence: Synthetic polypeptide
DEEQIACTNPVATEQYGCVSTHEPLNEENT

SEQ ID NO: 83840 - protein, 30 aa, Artificial Sequence
  Description of Artificial Sequence: Synthetic polypeptide
DEVEIATTNPVAYEQWGSVATNPGLGENNQ

SEQ ID NO: 83841 - protein, 30 aa, Artificial Sequence
  Description of Artificial Sequence: Synthetic polypeptide
DEVEIATTNPVAYEQWGEVVTNPGDLGENR

SEQ ID NO: 83842 - protein, 34 aa, Artificial Sequence
  Description of Artificial Sequence: Synthetic polypeptide
DEEEIRTTNPVATEQYGSVSQAVSGEQNRQDLNA

SEQ ID NO: 83843 - protein, 35 aa, Artificial Sequence
  Description of Artificial Sequence: Synthetic polypeptide
DEEEIRTTNPVATEQYGSVSQDVNGTQNQQDLNMA

SEQ ID NO: 83844 - protein, 31 aa, Artificial Sequence
  Description of Artificial Sequence: Synthetic polypeptide
DEVEIATTNPVAYEQWGEVSTNLQGTDTGDQ

SEQ ID NO: 83845 - protein, 32 aa, Artificial Sequence
  Description of Artificial Sequence: Synthetic polypeptide
DEVEIATTNPVAYEQWGAVSTNLQGNMGTNDQ

SEQ ID NO: 83846 - protein, 31 aa, Artificial Sequence
  Description of Artificial Sequence: Synthetic polypeptide
DEVEIATTNPVAYEQWGAVSTNLQGGGTDDQ

SEQ ID NO: 83847 - protein, 28 aa, Artificial Sequence
  Description of Artificial Sequence: Synthetic peptide
AENEIATTNPVATECYGCVSEELQHIEL

SEQ ID NO: 83848 - protein, 30 aa, Artificial Sequence
  Description of Artificial Sequence: Synthetic polypeptide
AENEIACTNPVATEQYGMASENLQNRGGVC

SEQ ID NO: 83849 - protein, 35 aa, Artificial Sequence
  Description of Artificial Sequence: Synthetic polypeptide
DEEEIRTTNPVATEQYGSVSPTNLLEDTFEINNDD

SEQ ID NO: 83850 - protein, 32 aa, Artificial Sequence
  Description of Artificial Sequence: Synthetic polypeptide
DEVEIATTNPVAYEKWGSVSTNLGQGNDNDGR

SEQ ID NO: 83851 - protein, 33 aa, Artificial Sequence
  Description of Artificial Sequence: Synthetic polypeptide
DEEPIRYTNPVATEQYGVSVSSNQDDVQTSNSR

SEQ ID NO: 83852 - protein, 32 aa, Artificial Sequence
  Description of Artificial Sequence: Synthetic polypeptide
DEVEIATTNPVAYEKWGEVSTNLQGDVGGNSR

SEQ ID NO: 83853 - protein, 34 aa, Artificial Sequence
  Description of Artificial Sequence: Synthetic polypeptide
DEEEIRTTNPVATEQYGSVSPWWTSTQQNGDEEL

SEQ ID NO: 83854 - protein, 33 aa, Artificial Sequence
  Description of Artificial Sequence: Synthetic polypeptide
DEEEISTTNPVATEQYGCVCSTNHQNFPSDNDG

SEQ ID NO: 83855 - protein, 32 aa, Artificial Sequence
  Description of Artificial Sequence: Synthetic polypeptide
DEEEIRTTNPVATEQYGSVSPWDMENRDTQEI

SEQ ID NO: 83856 - protein, 30 aa, Artificial Sequence
  Description of Artificial Sequence: Synthetic polypeptide
DEVEIATTNPVAYEQWGTVSTNLNMGDDAG

SEQ ID NO: 83857 - protein, 29 aa, Artificial Sequence
  Description of Artificial Sequence: Synthetic peptide
AENEIATTNPVATEAYGTVSTEELQHEEL

SEQ ID NO: 83858 - protein, 33 aa, Artificial Sequence
  Description of Artificial Sequence: Synthetic polypeptide
DEEEISTTNPVATEQYGCVCSTNLAENFGSDQL

SEQ ID NO: 83859 - protein, 34 aa, Artificial Sequence
  Description of Artificial Sequence: Synthetic polypeptide
DEVEIRTTNPVATEQYGSVSTGPDGGQQNGGGTR

SEQ ID NO: 83860 - protein, 30 aa, Artificial Sequence
  Description of Artificial Sequence: Synthetic polypeptide
DEAEIAATNGCAYMQYGSVSTNLQGGDNSM

SEQ ID NO: 83861 - protein, 31 aa, Artificial Sequence
  Description of Artificial Sequence: Synthetic polypeptide
DEVEIATTNPVAYEQWGSVVTNPGLGENERH

SEQ ID NO: 83862 - protein, 29 aa, Artificial Sequence
  Description of Artificial Sequence: Synthetic peptide
DEAEIAATNGCAYMQYGSVSTNLQQGDDL

SEQ ID NO: 83863 - protein, 30 aa, Artificial Sequence
  Description of Artificial Sequence: Synthetic polypeptide
DEVEIATTNPVAYEQWGSVTTNPGLGENNQ

SEQ ID NO: 83864 - protein, 28 aa, Artificial Sequence
  Description of Artificial Sequence: Synthetic peptide
DEAEIAATNGCPYMQYGSVSTNLQRADQ

SEQ ID NO: 83865 - protein, 32 aa, Artificial Sequence
  Description of Artificial Sequence: Synthetic polypeptide
DEVEIATTNPVAYEQWGSVSTPNGQTMGQNEH

SEQ ID NO: 83866 - protein, 30 aa, Artificial Sequence
  Description of Artificial Sequence: Synthetic polypeptide
AENEIATTNPVATECWGSASCINLQDRGGG

SEQ ID NO: 83867 - protein, 29 aa, Artificial Sequence
  Description of Artificial Sequence: Synthetic peptide
DEAEIACTNPVATAQWGCVATNLERDDNP

SEQ ID NO: 83868 - protein, 31 aa, Artificial Sequence
  Description of Artificial Sequence: Synthetic polypeptide
AENEIATTNPVATECWGSVSCINEQDRGENG

SEQ ID NO: 83869 - protein, 30 aa, Artificial Sequence
  Description of Artificial Sequence: Synthetic polypeptide
AENEIATTNPVATECWGSVSCINEQDRGGG

SEQ ID NO: 83870 - protein, 36 aa, Artificial Sequence
  Description of Artificial Sequence: Synthetic polypeptide
DEEEIRTTNPVATEQYGSVSPTNLMMMQEGGEETVN

SEQ ID NO: 83871 - protein, 28 aa, Artificial Sequence
  Description of Artificial Sequence: Synthetic peptide
AENEIATTNPVATECYGAVSEDLQNEEL

SEQ ID NO: 83872 - protein, 33 aa, Artificial Sequence
  Description of Artificial Sequence: Synthetic polypeptide
DEEEIRTTNPVATEQYGSVSPWNMMEGIETQEI

SEQ ID NO: 83873 - protein, 34 aa, Artificial Sequence
  Description of Artificial Sequence: Synthetic polypeptide
DEEEIRTTNPVATEQYGSVSPWNNLEELGEESLD

SEQ ID NO: 83874 - protein, 33 aa, Artificial Sequence
  Description of Artificial Sequence: Synthetic polypeptide
DEEEIRTTNPVATEQYGSVSPWNVDEDAPEPRS

SEQ ID NO: 83875 - protein, 33 aa, Artificial Sequence
  Description of Artificial Sequence: Synthetic polypeptide
DEEEIRTTNPVATEQYGSVSPWNYNQQLMEVEI

SEQ ID NO: 83876 - protein, 33 aa, Artificial Sequence
  Description of Artificial Sequence: Synthetic polypeptide
DEEEISTTNPVATEQYGCVCSTNHQNFNSNTQL

SEQ ID NO: 83877 - protein, 29 aa, Artificial Sequence
  Description of Artificial Sequence: Synthetic peptide
AENEIACTNPVATEQYGRASENLQKNLGR

SEQ ID NO: 83878 - protein, 32 aa, Artificial Sequence
  Description of Artificial Sequence: Synthetic polypeptide
DEVEIATTNPVAYEHWGVVSTNLQHDQGNNQR

SEQ ID NO: 83879 - protein, 30 aa, Artificial Sequence
  Description of Artificial Sequence: Synthetic polypeptide
AENEIACTNPVATEQYGMASENDHRQRGGR

SEQ ID NO: 83880 - protein, 32 aa, Artificial Sequence
  Description of Artificial Sequence: Synthetic polypeptide
DEVEIATTNPVAYEAWGSVSTNLQGNDNDGGR

SEQ ID NO: 83881 - protein, 32 aa, Artificial Sequence
  Description of Artificial Sequence: Synthetic polypeptide
DEVEIATTNPVAYEAWGSVSTNLNQGEDNDAR

SEQ ID NO: 83882 - protein, 33 aa, Artificial Sequence
  Description of Artificial Sequence: Synthetic polypeptide
DEEEISTTNPVATEQYGCVCSTNHNQSFGSDQV

SEQ ID NO: 83883 - protein, 33 aa, Artificial Sequence
  Description of Artificial Sequence: Synthetic polypeptide
DEEEISTTNPVATEQYGCVCSTNHNQNFNSDQA

SEQ ID NO: 83884 - protein, 32 aa, Artificial Sequence
  Description of Artificial Sequence: Synthetic polypeptide
DEVEIATTNPVAYEAWGSVSTNLNQGADNEGR

SEQ ID NO: 83885 - protein, 33 aa, Artificial Sequence
  Description of Artificial Sequence: Synthetic polypeptide
DEEQIATTNPVATEQWGCVATNNLEQMGVNPRM

SEQ ID NO: 83886 - protein, 31 aa, Artificial Sequence
  Description of Artificial Sequence: Synthetic polypeptide
DEEQIATTNPVATEQWGNVATNNLEQMQVND

SEQ ID NO: 83887 - protein, 34 aa, Artificial Sequence
  Description of Artificial Sequence: Synthetic polypeptide
DEDEIRTTNPVATEQYGVVSTSVTNLLQAGDTES

SEQ ID NO: 83888 - protein, 32 aa, Artificial Sequence
  Description of Artificial Sequence: Synthetic polypeptide
DEDEIRTTNPVAYEHYGEVSTGNLPGEDGNTI

SEQ ID NO: 83889 - protein, 36 aa, Artificial Sequence
  Description of Artificial Sequence: Synthetic polypeptide
DEEEIRTTNPVAVEQYGSVSTVVNNLQLGNNDNNED

SEQ ID NO: 83890 - protein, 33 aa, Artificial Sequence
  Description of Artificial Sequence: Synthetic polypeptide
DEDEIRTTNPVAYEHYGEVSTQNNLQGEDGNTP

SEQ ID NO: 83891 - protein, 34 aa, Artificial Sequence
  Description of Artificial Sequence: Synthetic polypeptide
DEDEIRTTNPVATEQYGVVSTSNTTNLQAGSTQS

SEQ ID NO: 83892 - protein, 33 aa, Artificial Sequence
  Description of Artificial Sequence: Synthetic polypeptide
DEEEIRTTNPVATEQYGSVSQPNQLGEEETEPI

SEQ ID NO: 83893 - protein, 33 aa, Artificial Sequence
  Description of Artificial Sequence: Synthetic polypeptide
DEDEIRTTNPVAYEHYGEVSTTQNLQGEDGNTE

SEQ ID NO: 83894 - protein, 33 aa, Artificial Sequence
  Description of Artificial Sequence: Synthetic polypeptide
DEEEIRTTNPVAYEQWGTSVVVTRLELDRNGNS

SEQ ID NO: 83895 - protein, 32 aa, Artificial Sequence
  Description of Artificial Sequence: Synthetic polypeptide
DEDEIRTTNPVAYEHYGEVSTVNQQGEDGNTI

SEQ ID NO: 83896 - protein, 32 aa, Artificial Sequence
  Description of Artificial Sequence: Synthetic polypeptide
DEEEIRTTNPVAYEQWGTTVCTYLEHDRGNSS

SEQ ID NO: 83897 - protein, 33 aa, Artificial Sequence
  Description of Artificial Sequence: Synthetic polypeptide
DEEEIRTTNPVATEQYGSVSQPPMTGPEADNES

SEQ ID NO: 83898 - protein, 32 aa, Artificial Sequence
  Description of Artificial Sequence: Synthetic polypeptide
DEVEIATTNPVAYEAWGEVSTNLNRGEDNDER

SEQ ID NO: 83899 - protein, 32 aa, Artificial Sequence
  Description of Artificial Sequence: Synthetic polypeptide
DEDEIRTTNPVAYEKWGEVATNLNQGDGNMDR

SEQ ID NO: 83900 - protein, 28 aa, Artificial Sequence
  Description of Artificial Sequence: Synthetic peptide
AENEIATTNPVATECYGCVSELLQAEEL

SEQ ID NO: 83901 - protein, 35 aa, Artificial Sequence
  Description of Artificial Sequence: Synthetic polypeptide
DEEEIRTTNPVAVEQYGSVSTVVNNNNQGIGNTDT

SEQ ID NO: 83902 - protein, 31 aa, Artificial Sequence
  Description of Artificial Sequence: Synthetic polypeptide
DEVEIATTNPVAYEHWGTVSTNLQGNDSGNW

SEQ ID NO: 83903 - protein, 33 aa, Artificial Sequence
  Description of Artificial Sequence: Synthetic polypeptide
DEEEISTTNPVATEQYGCVCSTNHQEHFGSQQF

SEQ ID NO: 83904 - protein, 31 aa, Artificial Sequence
  Description of Artificial Sequence: Synthetic polypeptide
DEVEIATTNPVAYECWGSVATNLQHQGTNDS

SEQ ID NO: 83905 - protein, 32 aa, Artificial Sequence
  Description of Artificial Sequence: Synthetic polypeptide
DEVEIATTNPVAYEHWGSVSTNLQGNDSGNTS

SEQ ID NO: 83906 - protein, 32 aa, Artificial Sequence
  Description of Artificial Sequence: Synthetic polypeptide
DEVEIATTNPVAYEHWGSVSTNLQGNDSGNDG

SEQ ID NO: 83907 - protein, 34 aa, Artificial Sequence
  Description of Artificial Sequence: Synthetic polypeptide
DEEEIRTTNPVATEQYGSVSQLMMQITRQDVNES

SEQ ID NO: 83908 - protein, 31 aa, Artificial Sequence
  Description of Artificial Sequence: Synthetic polypeptide
DEVEIATTNPVAYEHWGSVSTNLQGNDSGGP

SEQ ID NO: 83909 - protein, 33 aa, Artificial Sequence
  Description of Artificial Sequence: Synthetic polypeptide
DEVEIATTNPVAYEHWGSVSTNLQGNDEGGNQR

SEQ ID NO: 83910 - protein, 33 aa, Artificial Sequence
  Description of Artificial Sequence: Synthetic polypeptide
DEVEIATTNPVAYEHWGSVSNTNLQGNDSGNER

SEQ ID NO: 83911 - protein, 32 aa, Artificial Sequence
  Description of Artificial Sequence: Synthetic polypeptide
DEVEIATTNPVAYEHWGSVATNLQGNDEGNER

SEQ ID NO: 83912 - protein, 32 aa, Artificial Sequence
  Description of Artificial Sequence: Synthetic polypeptide
DEVEIATTNPVAYEHWGEVSTNLQGQDSGNDR

SEQ ID NO: 83913 - protein, 35 aa, Artificial Sequence
  Description of Artificial Sequence: Synthetic polypeptide
DEEEIRTTNPVATEQYGSVSQNGNLYQHQNEEPLS

SEQ ID NO: 83914 - protein, 31 aa, Artificial Sequence
  Description of Artificial Sequence: Synthetic polypeptide
DEVEIATTNPVAYEGWGSVSTNNQGADNDSR

SEQ ID NO: 83915 - protein, 30 aa, Artificial Sequence
  Description of Artificial Sequence: Synthetic polypeptide
DEVEIATTNPVAYEGWGSVSNNLQGGMDGA

SEQ ID NO: 83916 - protein, 35 aa, Artificial Sequence
  Description of Artificial Sequence: Synthetic polypeptide
DEEEIRTTNPVAVEQYGSVSTVVNNNQAGNNEDED

SEQ ID NO: 83917 - protein, 31 aa, Artificial Sequence
  Description of Artificial Sequence: Synthetic polypeptide
DEVEIATTNPVAYEGWGSVATNLQSGGDNEH

SEQ ID NO: 83918 - protein, 33 aa, Artificial Sequence
  Description of Artificial Sequence: Synthetic polypeptide
DEEEIRTTNPVAYEQWGSYWSTINEQQGDQNSE

SEQ ID NO: 83919 - protein, 32 aa, Artificial Sequence
  Description of Artificial Sequence: Synthetic polypeptide
DEVEIATTNPVAYEGWGSVATNLQGNDSGNDR

SEQ ID NO: 83920 - protein, 32 aa, Artificial Sequence
  Description of Artificial Sequence: Synthetic polypeptide
DEVEIATTNPVAYEGWGSVATNLQGNDMGQNR

SEQ ID NO: 83921 - protein, 31 aa, Artificial Sequence
  Description of Artificial Sequence: Synthetic polypeptide
DEVEIATTNPVAYEEWGSVATNLQLSGGDNH

SEQ ID NO: 83922 - protein, 34 aa, Artificial Sequence
  Description of Artificial Sequence: Synthetic polypeptide
DEEEIRTTNPVAVEQYGSVSTVVNNNNQNQQNTD

SEQ ID NO: 83923 - protein, 31 aa, Artificial Sequence
  Description of Artificial Sequence: Synthetic polypeptide
DEVEIATTNPVAYEEWGSVATNLQLGGDNGH

SEQ ID NO: 83924 - protein, 32 aa, Artificial Sequence
  Description of Artificial Sequence: Synthetic polypeptide
DEEQIACTNPVATEQYGSVSTHGPLGAPAGNN

SEQ ID NO: 83925 - protein, 32 aa, Artificial Sequence
  Description of Artificial Sequence: Synthetic polypeptide
DEEEIRTTNPVAYEQWGSYWSTINPGQDENNQ

SEQ ID NO: 83926 - protein, 35 aa, Artificial Sequence
  Description of Artificial Sequence: Synthetic polypeptide
DEEEIRTTNPVAVEQYGSVSTVVNNNNQGQGNTTD

SEQ ID NO: 83927 - protein, 31 aa, Artificial Sequence
  Description of Artificial Sequence: Synthetic polypeptide
DEVEIATTNPVAYEQWGTVSTNLNMGDMGRS

SEQ ID NO: 83928 - protein, 35 aa, Artificial Sequence
  Description of Artificial Sequence: Synthetic polypeptide
DEEEIRTTNPVATEQYGSVSPWANLIQQSMGFEEL

SEQ ID NO: 83929 - protein, 28 aa, Artificial Sequence
  Description of Artificial Sequence: Synthetic peptide
DEAEIAATNGCAYMPYGSVSTNLQRADM

SEQ ID NO: 83930 - protein, 33 aa, Artificial Sequence
  Description of Artificial Sequence: Synthetic polypeptide
DDSEIRTTNPVSTEQYGSVSSATAGNMRNGNPR

SEQ ID NO: 83931 - protein, 33 aa, Artificial Sequence
  Description of Artificial Sequence: Synthetic polypeptide
DEEEIRTTNPVAYDQWGSVSTVNMSSGRDVNNR

SEQ ID NO: 83932 - protein, 34 aa, Artificial Sequence
  Description of Artificial Sequence: Synthetic polypeptide
DEVEIRTTNPVATEQYGSVSTDGVEGQGGQTNIG

SEQ ID NO: 83933 - protein, 32 aa, Artificial Sequence
  Description of Artificial Sequence: Synthetic polypeptide
DEVEIATTNPVAYEQYGSVSTPGEDHERGEND

SEQ ID NO: 83934 - protein, 35 aa, Artificial Sequence
  Description of Artificial Sequence: Synthetic polypeptide
DEEEISTTNPVATEQYGCVCSTTGNLQNFGSNTQA

SEQ ID NO: 83935 - protein, 30 aa, Artificial Sequence
  Description of Artificial Sequence: Synthetic polypeptide
AENEIACTNPVATEQYGTASEGLVQREGGR

SEQ ID NO: 83936 - protein, 28 aa, Artificial Sequence
  Description of Artificial Sequence: Synthetic peptide
AENEIACTNPVATEQYGTASEDLQQGGH

SEQ ID NO: 83937 - protein, 33 aa, Artificial Sequence
  Description of Artificial Sequence: Synthetic polypeptide
DEEEIRTTNPVAYDQWGKVSCTGNWSQRDVNNR

SEQ ID NO: 83938 - protein, 32 aa, Artificial Sequence
  Description of Artificial Sequence: Synthetic polypeptide
DDETIRTTNPVATEQYGAVSTNHQDVRVQVLT

SEQ ID NO: 83939 - protein, 32 aa, Artificial Sequence
  Description of Artificial Sequence: Synthetic polypeptide
DEENIRTTNPVATEQYGSVSAPNDENQDTQEP

SEQ ID NO: 83940 - protein, 32 aa, Artificial Sequence
  Description of Artificial Sequence: Synthetic polypeptide
DEEEISTTNPVATEQYGCVCSTPHQYFGSQQS

SEQ ID NO: 83941 - protein, 32 aa, Artificial Sequence
  Description of Artificial Sequence: Synthetic polypeptide
DEEEISTTNPVATEQYGCVCSTPHQSFGSEFP

SEQ ID NO: 83942 - protein, 34 aa, Artificial Sequence
  Description of Artificial Sequence: Synthetic polypeptide
DEEEIRTTNPVAWEQYGVCVSCTGNHSQRVNNQG

SEQ ID NO: 83943 - protein, 33 aa, Artificial Sequence
  Description of Artificial Sequence: Synthetic polypeptide
DEEEISTTNPVATEQYGCVCSTPHQENFGSNQS

SEQ ID NO: 83944 - protein, 33 aa, Artificial Sequence
  Description of Artificial Sequence: Synthetic polypeptide
DEEEIRTTNPVAWEQYGSVYSAAKLDDRSINFL

SEQ ID NO: 83945 - protein, 28 aa, Artificial Sequence
  Description of Artificial Sequence: Synthetic peptide
AENEIASTNPVGTEGYGEMSSNLQHGGR

SEQ ID NO: 83946 - protein, 32 aa, Artificial Sequence
  Description of Artificial Sequence: Synthetic polypeptide
DEEEISTTNPVATEQYGCVCSTPHINFNSENQ

SEQ ID NO: 83947 - protein, 34 aa, Artificial Sequence
  Description of Artificial Sequence: Synthetic polypeptide
DDETIRTTNPVATEQYGAVISTNGGQRGVGNGNT

SEQ ID NO: 83948 - protein, 28 aa, Artificial Sequence
  Description of Artificial Sequence: Synthetic peptide
AENEIASTNPVGTEGYGEMSSNLQRGDI

SEQ ID NO: 83949 - protein, 28 aa, Artificial Sequence
  Description of Artificial Sequence: Synthetic peptide
AENEIASTNPVGTEGYGEMSSNLQRGGI

SEQ ID NO: 83950 - protein, 32 aa, Artificial Sequence
  Description of Artificial Sequence: Synthetic polypeptide
DDETIRTTNPVATEQYGAVCSTNHQQVRVHLT

SEQ ID NO: 83951 - protein, 28 aa, Artificial Sequence
  Description of Artificial Sequence: Synthetic peptide
AENEIASTNPVATEQYGEMSETLQHGDI

SEQ ID NO: 83952 - protein, 34 aa, Artificial Sequence
  Description of Artificial Sequence: Synthetic polypeptide
DEVEIRTTNPVATEQYGSVSTGDDQGNEGGGNQI

SEQ ID NO: 83953 - protein, 31 aa, Artificial Sequence
  Description of Artificial Sequence: Synthetic polypeptide
DEVEIATTNPVAYEQYGSVVTNPGLGEDMRE

SEQ ID NO: 83954 - protein, 34 aa, Artificial Sequence
  Description of Artificial Sequence: Synthetic polypeptide
DEEEIRTTNPVAYDQWGSVVSTVNASSQRDSNNR

SEQ ID NO: 83955 - protein, 32 aa, Artificial Sequence
  Description of Artificial Sequence: Synthetic polypeptide
DDETIRTTNPVATEQYGAVVINNGQRGQDNEG

SEQ ID NO: 83956 - protein, 31 aa, Artificial Sequence
  Description of Artificial Sequence: Synthetic polypeptide
DDSEIRTTNPVSTEQYGDVAANTIQSRVGQR

SEQ ID NO: 83957 - protein, 31 aa, Artificial Sequence
  Description of Artificial Sequence: Synthetic polypeptide
DEVEIATTNPVAYEQYGTVATNLQGDTNDEE

SEQ ID NO: 83958 - protein, 32 aa, Artificial Sequence
  Description of Artificial Sequence: Synthetic polypeptide
DEEEISTTNPVATEQYGCVCSWELQNFGSEQG

SEQ ID NO: 83959 - protein, 35 aa, Artificial Sequence
  Description of Artificial Sequence: Synthetic polypeptide
DEEEIRTTNPVAYEAWGKVVSCTNMLQRTGGNYRC

SEQ ID NO: 83960 - protein, 30 aa, Artificial Sequence
  Description of Artificial Sequence: Synthetic polypeptide
DEVEIATTNPVAYEQYGTVATNLNMGDDGQ

SEQ ID NO: 83961 - protein, 34 aa, Artificial Sequence
  Description of Artificial Sequence: Synthetic polypeptide
DDETIRTTNPVATEQYGAVSTTNGGQRGNGNEDD

SEQ ID NO: 83962 - protein, 34 aa, Artificial Sequence
  Description of Artificial Sequence: Synthetic polypeptide
DEVEIRTTNPVATEQYGSVSSTTNGQQEGEGGGT

SEQ ID NO: 83963 - protein, 32 aa, Artificial Sequence
  Description of Artificial Sequence: Synthetic polypeptide
DEEEISTTNPVATEQYGCVCSWELQEGFGSDQ

SEQ ID NO: 83964 - protein, 31 aa, Artificial Sequence
  Description of Artificial Sequence: Synthetic polypeptide
DEEEISTTNPVATEQYGCVCSWAHQNFGSDQ

SEQ ID NO: 83965 - protein, 31 aa, Artificial Sequence
  Description of Artificial Sequence: Synthetic polypeptide
DDSEIRTTNPVSTEQYGDVSANTIQSRVEDR

SEQ ID NO: 83966 - protein, 35 aa, Artificial Sequence
  Description of Artificial Sequence: Synthetic polypeptide
DEENIRTTNPVATEQWGHSNVSYTYNYLQERPGEF

SEQ ID NO: 83967 - protein, 31 aa, Artificial Sequence
  Description of Artificial Sequence: Synthetic polypeptide
DDETIRTTNPVATEQYGAVSTNPHQQQVQLT

SEQ ID NO: 83968 - protein, 35 aa, Artificial Sequence
  Description of Artificial Sequence: Synthetic polypeptide
DEEEIRTTNPVATEQYGSVSPVHNLMARDGVVQEI

SEQ ID NO: 83969 - protein, 30 aa, Artificial Sequence
  Description of Artificial Sequence: Synthetic polypeptide
AENEIACTNPVATEQYGTASTGLVQREGGD

SEQ ID NO: 83970 - protein, 28 aa, Artificial Sequence
  Description of Artificial Sequence: Synthetic peptide
AENEIACTNPVATEQYGTASMDLQQGGH

SEQ ID NO: 83971 - protein, 31 aa, Artificial Sequence
  Description of Artificial Sequence: Synthetic polypeptide
DEVEIATTNPVAYEQYGSVVTNPGLGENNES

SEQ ID NO: 83972 - protein, 34 aa, Artificial Sequence
  Description of Artificial Sequence: Synthetic polypeptide
DEEEISTTNPVATEQYGCVCSTYDLQNFGSENQA

SEQ ID NO: 83973 - protein, 32 aa, Artificial Sequence
  Description of Artificial Sequence: Synthetic polypeptide
DEEEISTTNPVATEQYGCVCSTVHQNFNSNQA

SEQ ID NO: 83974 - protein, 33 aa, Artificial Sequence
  Description of Artificial Sequence: Synthetic polypeptide
DEEEIRTTNPVAYEAFGQSVSTGYELSLRGGNS

SEQ ID NO: 83975 - protein, 34 aa, Artificial Sequence
  Description of Artificial Sequence: Synthetic polypeptide
DEVEIRTTNPVATEQYGSVSTDGDEMQGEGGNGG

SEQ ID NO: 83976 - protein, 34 aa, Artificial Sequence
  Description of Artificial Sequence: Synthetic polypeptide
DEEEIRTTNPVAYDQWGSVSYTVNESSQRDVNNR

SEQ ID NO: 83977 - protein, 33 aa, Artificial Sequence
  Description of Artificial Sequence: Synthetic polypeptide
DDETIRTTNPVATEQYGAVCSTNHQQVRVANLD

SEQ ID NO: 83978 - protein, 31 aa, Artificial Sequence
  Description of Artificial Sequence: Synthetic polypeptide
AENEIACTNPVATEQYGSVSAEDLQDRGGDL

SEQ ID NO: 83979 - protein, 33 aa, Artificial Sequence
  Description of Artificial Sequence: Synthetic polypeptide
DEEEISTTNPVATEQYGCVCSTNTQENFGSDQS

SEQ ID NO: 83980 - protein, 32 aa, Artificial Sequence
  Description of Artificial Sequence: Synthetic polypeptide
DEEEIRTTNPVAWEQYGCVSTGEHQNFGSEQY

SEQ ID NO: 83981 - protein, 32 aa, Artificial Sequence
  Description of Artificial Sequence: Synthetic polypeptide
AENEIACTNPVATEQYGSASENLPQMRGMGPR

SEQ ID NO: 83982 - protein, 33 aa, Artificial Sequence
  Description of Artificial Sequence: Synthetic polypeptide
DEDEIRTTNPVAYECWGSVSTNLNQGDLGGNGS

SEQ ID NO: 83983 - protein, 35 aa, Artificial Sequence
  Description of Artificial Sequence: Synthetic polypeptide
DEEPIRTTNPVATECYGSTVSCINMESQSRGGNER

SEQ ID NO: 83984 - protein, 32 aa, Artificial Sequence
  Description of Artificial Sequence: Synthetic polypeptide
DDEEVASTNPVATEQYGSVATNPTIQSRVGNV

SEQ ID NO: 83985 - protein, 34 aa, Artificial Sequence
  Description of Artificial Sequence: Synthetic polypeptide
DEEEIRTTNPVAYEQWGSVSTVNELSQMPGGLYS

SEQ ID NO: 83986 - protein, 34 aa, Artificial Sequence
  Description of Artificial Sequence: Synthetic polypeptide
DEEEISTTNPVATEQYGCVCSTNLQENFGSDTQM

SEQ ID NO: 83987 - protein, 33 aa, Artificial Sequence
  Description of Artificial Sequence: Synthetic polypeptide
DEEEIRTTNPVAWEEYGSVPCTDWLQRTDNDSI

SEQ ID NO: 83988 - protein, 34 aa, Artificial Sequence
  Description of Artificial Sequence: Synthetic polypeptide
DEEPIRTTNPVATEQWGSVVSTNAHSDNTGQNNR

SEQ ID NO: 83989 - protein, 34 aa, Artificial Sequence
  Description of Artificial Sequence: Synthetic polypeptide
DEEPIRTTNPVATEQYGQTVVSYTGELSGVGGNR

SEQ ID NO: 83990 - protein, 33 aa, Artificial Sequence
  Description of Artificial Sequence: Synthetic polypeptide
DEEPIRTTNPVATWEQYNSEGSPTMNLQGDNDW

SEQ ID NO: 83991 - protein, 30 aa, Artificial Sequence
  Description of Artificial Sequence: Synthetic polypeptide
AENEIACTNPVATEQYGSASENGNMRGGPR

SEQ ID NO: 83992 - protein, 29 aa, Artificial Sequence
  Description of Artificial Sequence: Synthetic peptide
DEAEIAATNGCAYMPYGSVSTNLQDGDNS

SEQ ID NO: 83993 - protein, 35 aa, Artificial Sequence
  Description of Artificial Sequence: Synthetic polypeptide
DEEEIRTTNPVATEQYGSVSPVTSYLQQPPQVGEC

SEQ ID NO: 83994 - protein, 34 aa, Artificial Sequence
  Description of Artificial Sequence: Synthetic polypeptide
DEEEIRTTNPVATEQYGSVSPVTTQPRDNFIQTI

SEQ ID NO: 83995 - protein, 36 aa, Artificial Sequence
  Description of Artificial Sequence: Synthetic polypeptide
DEEEIRTTNPVATEQYGSVSPVVSELMQPRMGGNLL

SEQ ID NO: 83996 - protein, 31 aa, Artificial Sequence
  Description of Artificial Sequence: Synthetic polypeptide
AENEIACTNPVATEQYGSASAENLQDRGGDL

SEQ ID NO: 83997 - protein, 35 aa, Artificial Sequence
  Description of Artificial Sequence: Synthetic polypeptide
DEEEIRTTNPVATEQYGSVSPVVSELQPRMGQELG

SEQ ID NO: 83998 - protein, 30 aa, Artificial Sequence
  Description of Artificial Sequence: Synthetic polypeptide
DEVEIATTNPVAYEQWGTVSTNLQGDIDEE

SEQ ID NO: 83999 - protein, 29 aa, Artificial Sequence
  Description of Artificial Sequence: Synthetic peptide
DEAEIAATNGCAYMPYGSVSTNLQQGDRQ

SEQ ID NO: 84000 - protein, 34 aa, Artificial Sequence
  Description of Artificial Sequence: Synthetic polypeptide
DEEEISTTNPVATEQYGCVCSTNLHFQVNFGSEF

SEQ ID NO: 84001 - protein, 32 aa, Artificial Sequence
  Description of Artificial Sequence: Synthetic polypeptide
DEVEIATTNPVAYEQWGTVSTNLQHEQGGNTG

SEQ ID NO: 84002 - protein, 32 aa, Artificial Sequence
  Description of Artificial Sequence: Synthetic polypeptide
DEVEIATTNPVAYEQWGTVSTNLQIGDINDGE

SEQ ID NO: 84003 - protein, 34 aa, Artificial Sequence
  Description of Artificial Sequence: Synthetic polypeptide
DEEEIRTTNPVAWEQYGICVSTGNEHSQRVNNQY

SEQ ID NO: 84004 - protein, 30 aa, Artificial Sequence
  Description of Artificial Sequence: Synthetic polypeptide
DEEPIATTNPVAYMPYSEEVSTNLQHGDNV

SEQ ID NO: 84005 - protein, 32 aa, Artificial Sequence
  Description of Artificial Sequence: Synthetic polypeptide
DDETIRTTNPVATEFYGSVSTGGQGEGQGNET

SEQ ID NO: 84006 - protein, 33 aa, Artificial Sequence
  Description of Artificial Sequence: Synthetic polypeptide
DEEEISTTNPVATEQYGCVCSTNSLFAEHGSEF

SEQ ID NO: 84007 - protein, 32 aa, Artificial Sequence
  Description of Artificial Sequence: Synthetic polypeptide
DDENIRTTNPVATEQYGSVSVTGDEGGGGNNT

SEQ ID NO: 84008 - protein, 35 aa, Artificial Sequence
  Description of Artificial Sequence: Synthetic polypeptide
DEEEISTTNPVATEQYGCVCSTNSHFQERFGSENF

SEQ ID NO: 84009 - protein, 33 aa, Artificial Sequence
  Description of Artificial Sequence: Synthetic polypeptide
DEENIRTTNPVAYEPYGQVPTCTNLSQRGGPNV

SEQ ID NO: 84010 - protein, 33 aa, Artificial Sequence
  Description of Artificial Sequence: Synthetic polypeptide
DEENIRTTNPVAYEPYGQVQCTNEHSQRGGNRV

SEQ ID NO: 84011 - protein, 33 aa, Artificial Sequence
  Description of Artificial Sequence: Synthetic polypeptide
DEENIRTTNPVAYEPYGQVWCTNEASQRGGNRH

SEQ ID NO: 84012 - protein, 33 aa, Artificial Sequence
  Description of Artificial Sequence: Synthetic polypeptide
DEEEISTTNPVATEQYGCVCSTNLTENFGSEQA

SEQ ID NO: 84013 - protein, 33 aa, Artificial Sequence
  Description of Artificial Sequence: Synthetic polypeptide
DDENIRTTNPVATEQYGAVSTDNGGQEGNGNGD

SEQ ID NO: 84014 - protein, 33 aa, Artificial Sequence
  Description of Artificial Sequence: Synthetic polypeptide
DEEEIRTTNPVAYEQWGSVSTTNGDNHGGTNDL

SEQ ID NO: 84015 - protein, 32 aa, Artificial Sequence
  Description of Artificial Sequence: Synthetic polypeptide
DEVEIATTNPVAYDQYGKVVSCTAELQRGGNL

SEQ ID NO: 84016 - protein, 28 aa, Artificial Sequence
  Description of Artificial Sequence: Synthetic peptide
AENEIASVNPVCTEQYGVASENLQRGGQ

SEQ ID NO: 84017 - protein, 35 aa, Artificial Sequence
  Description of Artificial Sequence: Synthetic polypeptide
DEEEIRTTNPVAWEQYGSTVVSQNAFSQNRLGDNQ

SEQ ID NO: 84018 - protein, 35 aa, Artificial Sequence
  Description of Artificial Sequence: Synthetic polypeptide
DEEEIRTTNPVAWEQYGSTVVQTPALSQRTVQNNR

SEQ ID NO: 84019 - protein, 31 aa, Artificial Sequence
  Description of Artificial Sequence: Synthetic polypeptide
DEVEIATTNPVAYEQYGSVASAANDLQNDPT

SEQ ID NO: 84020 - protein, 30 aa, Artificial Sequence
  Description of Artificial Sequence: Synthetic polypeptide
DEVEIATTNPVAYEQYGSTVTNPGLGENNQ

SEQ ID NO: 84021 - protein, 31 aa, Artificial Sequence
  Description of Artificial Sequence: Synthetic polypeptide
DEVEIATTNPVAYEQYGEVTVTNPGLGENER

SEQ ID NO: 84022 - protein, 32 aa, Artificial Sequence
  Description of Artificial Sequence: Synthetic polypeptide
DEEPIATTNPVAYEQWGSVAWTENLQEGMDER

SEQ ID NO: 84023 - protein, 31 aa, Artificial Sequence
  Description of Artificial Sequence: Synthetic polypeptide
DEEPIATTNPVAYEQYAEEVTTGNQQDGNNR

SEQ ID NO: 84024 - protein, 35 aa, Artificial Sequence
  Description of Artificial Sequence: Synthetic polypeptide
DEEEIRTTNPVATEQYGSVSPVPNLMSRDGVVQES

SEQ ID NO: 84025 - protein, 33 aa, Artificial Sequence
  Description of Artificial Sequence: Synthetic polypeptide
DEEEIRTTNPVAYEQWGSVSTVNELSNMPGGMS

SEQ ID NO: 84026 - protein, 31 aa, Artificial Sequence
  Description of Artificial Sequence: Synthetic polypeptide
DEEPIATTNPVAYEQYSEEVTTTNLQGGEND

SEQ ID NO: 84027 - protein, 33 aa, Artificial Sequence
  Description of Artificial Sequence: Synthetic polypeptide
DEVEIATTNPVAYEQYGSVATNLQAAGEDNNSD

SEQ ID NO: 84028 - protein, 33 aa, Artificial Sequence
  Description of Artificial Sequence: Synthetic polypeptide
DEEEIRTTNPVAYEQWGTVVVSTRLELDRGGNS

SEQ ID NO: 84029 - protein, 30 aa, Artificial Sequence
  Description of Artificial Sequence: Synthetic polypeptide
AENEIACTNPVATEQYGEYCSWNLQRGGQI

SEQ ID NO: 84030 - protein, 31 aa, Artificial Sequence
  Description of Artificial Sequence: Synthetic polypeptide
DEVEIATTNPVAYDQWGMVSTALQGEGQNNR

SEQ ID NO: 84031 - protein, 36 aa, Artificial Sequence
  Description of Artificial Sequence: Synthetic polypeptide
DEDEIRTTNPVATEQYGSVSTVVSNLQAGNNNDEDT

SEQ ID NO: 84032 - protein, 32 aa, Artificial Sequence
  Description of Artificial Sequence: Synthetic polypeptide
DEAEIACTNPVATEQYGCVAATNLQATGNDQA

SEQ ID NO: 84033 - protein, 31 aa, Artificial Sequence
  Description of Artificial Sequence: Synthetic polypeptide
DEAEIACTNPVATEQYGCVATNLENRGDTDI

SEQ ID NO: 84034 - protein, 28 aa, Artificial Sequence
  Description of Artificial Sequence: Synthetic peptide
AENEIATTNPVATEQYGEAPENLQHEEK

SEQ ID NO: 84035 - protein, 31 aa, Artificial Sequence
  Description of Artificial Sequence: Synthetic polypeptide
DEAEIACTNPVATEQYGCVATNLQAAAENHE

SEQ ID NO: 84036 - protein, 31 aa, Artificial Sequence
  Description of Artificial Sequence: Synthetic polypeptide
DEAEIACTNPVATEQYGCVATNLQADGEGMN

SEQ ID NO: 84037 - protein, 31 aa, Artificial Sequence
  Description of Artificial Sequence: Synthetic polypeptide
DEAEIACTNPVATEQYGCVATNLQADTPNNN

SEQ ID NO: 84038 - protein, 31 aa, Artificial Sequence
  Description of Artificial Sequence: Synthetic polypeptide
DEESIACTNPVATEQYGCVAGTNDQDNGNSF

SEQ ID NO: 84039 - protein, 36 aa, Artificial Sequence
  Description of Artificial Sequence: Synthetic polypeptide
DEDEIRTTNPVATEQYGSVSTVVNNLQAGNNTDEED

SEQ ID NO: 84040 - protein, 36 aa, Artificial Sequence
  Description of Artificial Sequence: Synthetic polypeptide
DEDEIRTTNPVATEQYGSVSTVVNNLQAGNNNNEDD

SEQ ID NO: 84041 - protein, 31 aa, Artificial Sequence
  Description of Artificial Sequence: Synthetic polypeptide
AENEIATTNPVATEQYGEASAENLQDRGGDL

SEQ ID NO: 84042 - protein, 34 aa, Artificial Sequence
  Description of Artificial Sequence: Synthetic polypeptide
DEEEISTTNPVATEQYGCVCSTGNHQNFGSNNQA

SEQ ID NO: 84043 - protein, 31 aa, Artificial Sequence
  Description of Artificial Sequence: Synthetic polypeptide
AENEIACTNPVATEQYGEVACENLQRHGGER

SEQ ID NO: 84044 - protein, 34 aa, Artificial Sequence
  Description of Artificial Sequence: Synthetic polypeptide
DEEEISTTNPVATEQYGCVCSTGNHQNFGSDNQS

SEQ ID NO: 84045 - protein, 31 aa, Artificial Sequence
  Description of Artificial Sequence: Synthetic polypeptide
AENEIACTNPVATEQYGETTSEENLQRKGGR

SEQ ID NO: 84046 - protein, 28 aa, Artificial Sequence
  Description of Artificial Sequence: Synthetic peptide
AENEIATTNPVATEQYGEASECLQHEGL

SEQ ID NO: 84047 - protein, 31 aa, Artificial Sequence
  Description of Artificial Sequence: Synthetic polypeptide
DEAEIACTNPVATEQYGCVATNLQDGAGAGN

SEQ ID NO: 84048 - protein, 34 aa, Artificial Sequence
  Description of Artificial Sequence: Synthetic polypeptide
DEEEISTTNPVATEQYGCVCSTGNHQGFGSNTAS

SEQ ID NO: 84049 - protein, 34 aa, Artificial Sequence
  Description of Artificial Sequence: Synthetic polypeptide
DEDEIRTTNPVATEQYGSVSTVTNTNQQEGETQT

SEQ ID NO: 84050 - protein, 34 aa, Artificial Sequence
  Description of Artificial Sequence: Synthetic polypeptide
DEEEISTTNPVATEQYGCVCSTGNDQNFGSENQF

SEQ ID NO: 84051 - protein, 34 aa, Artificial Sequence
  Description of Artificial Sequence: Synthetic polypeptide
DEEEISTTNPVATEQYGCVCSTGNDNQNFGSNQS

SEQ ID NO: 84052 - protein, 31 aa, Artificial Sequence
  Description of Artificial Sequence: Synthetic polypeptide
DEESIACTNPVATEIYGGCVATNLQRQDNEM

SEQ ID NO: 84053 - protein, 32 aa, Artificial Sequence
  Description of Artificial Sequence: Synthetic polypeptide
DEAEIACTNPVATEQYGCVATNLQEAGENDNS

SEQ ID NO: 84054 - protein, 34 aa, Artificial Sequence
  Description of Artificial Sequence: Synthetic polypeptide
DEEEISTTNPVATEQYGCVCSTGNLNQNFGSDQA

SEQ ID NO: 84055 - protein, 32 aa, Artificial Sequence
  Description of Artificial Sequence: Synthetic polypeptide
DEESIACTNPVATEIYGCVATNLQDRGDNNED

SEQ ID NO: 84056 - protein, 35 aa, Artificial Sequence
  Description of Artificial Sequence: Synthetic polypeptide
DEEEIRTTNPVAVEQYGSVSTVNNNNLNQDEIGTS

SEQ ID NO: 84057 - protein, 36 aa, Artificial Sequence
  Description of Artificial Sequence: Synthetic polypeptide
DEEEIRTTNPVAVEQYGSVSTVNNNLQQGNDEIGTD

SEQ ID NO: 84058 - protein, 35 aa, Artificial Sequence
  Description of Artificial Sequence: Synthetic polypeptide
DEEEISTTNPVATEQYGCVCSTGNLQENFGSDNQL

SEQ ID NO: 84059 - protein, 29 aa, Artificial Sequence
  Description of Artificial Sequence: Synthetic peptide
AENEIATTNPVATEQYGDVSEIEMRAGGA

SEQ ID NO: 84060 - protein, 34 aa, Artificial Sequence
  Description of Artificial Sequence: Synthetic polypeptide
DEEEIRTTNPVAVEQYGSVSTVNNNLLQSDEIGT

SEQ ID NO: 84061 - protein, 34 aa, Artificial Sequence
  Description of Artificial Sequence: Synthetic polypeptide
DEDEIRTTNPVATEQYGSVTVTQQQLQIRTTNVE

SEQ ID NO: 84062 - protein, 34 aa, Artificial Sequence
  Description of Artificial Sequence: Synthetic polypeptide
DEDEIRTTNPVATEQYGSVTTQAQLQIGTTNPNQ

SEQ ID NO: 84063 - protein, 35 aa, Artificial Sequence
  Description of Artificial Sequence: Synthetic polypeptide
DEEEIRTTNPVAVEQYGSVSTVNNDLLQGNGIGTT

SEQ ID NO: 84064 - protein, 31 aa, Artificial Sequence
  Description of Artificial Sequence: Synthetic polypeptide
DEESIACTNPVATEIYGCVAGTNLQAEADNR

SEQ ID NO: 84065 - protein, 31 aa, Artificial Sequence
  Description of Artificial Sequence: Synthetic polypeptide
AENEIACTNPVATEQYGEVSAENLQDHEGGR

SEQ ID NO: 84066 - protein, 34 aa, Artificial Sequence
  Description of Artificial Sequence: Synthetic polypeptide
DEEEISTTNPVATEQYGCVCSTGNLNQSFGSEQS

SEQ ID NO: 84067 - protein, 30 aa, Artificial Sequence
  Description of Artificial Sequence: Synthetic polypeptide
AENEIACTNPVATEQYGEVSAENLEREGEL

SEQ ID NO: 84068 - protein, 32 aa, Artificial Sequence
  Description of Artificial Sequence: Synthetic polypeptide
DEESIACTNPVATEIYGCVAGTNLQMGMDNRH

SEQ ID NO: 84069 - protein, 31 aa, Artificial Sequence
  Description of Artificial Sequence: Synthetic polypeptide
DEAEIACTNPVATEQWGSVATNLETHGGNPV

SEQ ID NO: 84070 - protein, 35 aa, Artificial Sequence
  Description of Artificial Sequence: Synthetic polypeptide
DEDEIRTTNPVATEQYGSVSVTVTNNTQQLQEGEQ

SEQ ID NO: 84071 - protein, 35 aa, Artificial Sequence
  Description of Artificial Sequence: Synthetic polypeptide
DEEEIRTTNPVAVEQYGSVSTTNNNNLLQVEIGTE

SEQ ID NO: 84072 - protein, 36 aa, Artificial Sequence
  Description of Artificial Sequence: Synthetic polypeptide
DEEEIRTTNPVAVEQYGSVSTTNNNNLLQRTEEGTD

SEQ ID NO: 84073 - protein, 30 aa, Artificial Sequence
  Description of Artificial Sequence: Synthetic polypeptide
AENEIATTNPVATEQYGDVSENLMNAAGGA

SEQ ID NO: 84074 - protein, 30 aa, Artificial Sequence
  Description of Artificial Sequence: Synthetic polypeptide
AENEIACTNPVATEQYGEVCSEDNLEFGGR

SEQ ID NO: 84075 - protein, 34 aa, Artificial Sequence
  Description of Artificial Sequence: Synthetic polypeptide
DEDEIRTTNPVATEQYGSVSTYVDDQIDGGNEHP

SEQ ID NO: 84076 - protein, 35 aa, Artificial Sequence
  Description of Artificial Sequence: Synthetic polypeptide
DEEEIRTTNPVAVEQYGSVSTTNNNLLQDEIGTTS

SEQ ID NO: 84077 - protein, 34 aa, Artificial Sequence
  Description of Artificial Sequence: Synthetic polypeptide
DEEEIRTTNPVAYEQYGCTVQLCTHLSQRPSGVR

SEQ ID NO: 84078 - protein, 30 aa, Artificial Sequence
  Description of Artificial Sequence: Synthetic polypeptide
AENEIATTNPVATEQYGEASEDGLVQFGGR

SEQ ID NO: 84079 - protein, 34 aa, Artificial Sequence
  Description of Artificial Sequence: Synthetic polypeptide
DEEEISTTNPVATEQYGCVCSTGNDLQNFGSDQA

SEQ ID NO: 84080 - protein, 36 aa, Artificial Sequence
  Description of Artificial Sequence: Synthetic polypeptide
DEDEIRTTNPVATEQYGSVSTVTNQQQLQEGTDENT

SEQ ID NO: 84081 - protein, 32 aa, Artificial Sequence
  Description of Artificial Sequence: Synthetic polypeptide
DEESIATTNPVATECYGSVCTIDGMQRNGNTM

SEQ ID NO: 84082 - protein, 31 aa, Artificial Sequence
  Description of Artificial Sequence: Synthetic polypeptide
DEDEIRTTNPVAYEQWGMTSTNLQQGGGDSD

SEQ ID NO: 84083 - protein, 32 aa, Artificial Sequence
  Description of Artificial Sequence: Synthetic polypeptide
DEVEIATTNPVATEQYGSVSATDLVDHEGEDL

SEQ ID NO: 84084 - protein, 30 aa, Artificial Sequence
  Description of Artificial Sequence: Synthetic polypeptide
AENEIACTNPVATEQYGETASEVLQRGDGR

SEQ ID NO: 84085 - protein, 35 aa, Artificial Sequence
  Description of Artificial Sequence: Synthetic polypeptide
DEEEIRTTNPVATEQYGSVSQTPNGLENSVFVDRT

SEQ ID NO: 84086 - protein, 34 aa, Artificial Sequence
  Description of Artificial Sequence: Synthetic polypeptide
DEEEISTTNPVATEQYGCVCSTGELQESFGSNQQ

SEQ ID NO: 84087 - protein, 34 aa, Artificial Sequence
  Description of Artificial Sequence: Synthetic polypeptide
DEEEIRTTNPVATEQYGSVSQTPNGPHQMVQAAD

SEQ ID NO: 84088 - protein, 34 aa, Artificial Sequence
  Description of Artificial Sequence: Synthetic polypeptide
DEEEIRTTNPVATEQYGSVSQTPNVPHQMVDAAQ

SEQ ID NO: 84089 - protein, 34 aa, Artificial Sequence
  Description of Artificial Sequence: Synthetic polypeptide
DEEEISTTNPVATEQYGCVCSTGELQENFGSNQA

SEQ ID NO: 84090 - protein, 32 aa, Artificial Sequence
  Description of Artificial Sequence: Synthetic polypeptide
DEESIATTNPVATECYGSVYNWTNDHQNMGNM

SEQ ID NO: 84091 - protein, 34 aa, Artificial Sequence
  Description of Artificial Sequence: Synthetic polypeptide
DEEEISTTNPVATEQYGCVCSTGELDQNFGSNQM

SEQ ID NO: 84092 - protein, 34 aa, Artificial Sequence
  Description of Artificial Sequence: Synthetic polypeptide
DEEEIRTTNPVAVEQYGSVATNNNDNLQQGIGET

SEQ ID NO: 84093 - protein, 32 aa, Artificial Sequence
  Description of Artificial Sequence: Synthetic polypeptide
DEVEIATTNPVATEQYGSVSATDLEDHEGYDL

SEQ ID NO: 84094 - protein, 34 aa, Artificial Sequence
  Description of Artificial Sequence: Synthetic polypeptide
DEDEIRTTNPVATEQYGSVSTTVTNTQQQEGEEQ

SEQ ID NO: 84095 - protein, 32 aa, Artificial Sequence
  Description of Artificial Sequence: Synthetic polypeptide
DEVEIATTNPVATEQYGSVSATDLEDHEGEEG

SEQ ID NO: 84096 - protein, 32 aa, Artificial Sequence
  Description of Artificial Sequence: Synthetic polypeptide
DEEEISTTNPVATEQYGCVCSTGEHQSGSQQG

SEQ ID NO: 84097 - protein, 32 aa, Artificial Sequence
  Description of Artificial Sequence: Synthetic polypeptide
DEVEIATTNPVATEQYGSVSATDLEDHEGEDL

SEQ ID NO: 84098 - protein, 36 aa, Artificial Sequence
  Description of Artificial Sequence: Synthetic polypeptide
DEEEIRTTNPVATEQYGSVSQTSSLSQEREIVTVRI

SEQ ID NO: 84099 - protein, 33 aa, Artificial Sequence
  Description of Artificial Sequence: Synthetic polypeptide
DEEEIRTTNPVATEQYGSVSQTTAETVVGVDGI

SEQ ID NO: 84100 - protein, 32 aa, Artificial Sequence
  Description of Artificial Sequence: Synthetic polypeptide
DEESIATTNPVATECYGSVYNWTNDHQQGNMV

SEQ ID NO: 84101 - protein, 36 aa, Artificial Sequence
  Description of Artificial Sequence: Synthetic polypeptide
DEEEIRTTNPVATEQYGSVSQTTNAGPNMRNGMNPV

SEQ ID NO: 84102 - protein, 31 aa, Artificial Sequence
  Description of Artificial Sequence: Synthetic polypeptide
DEDEIRTTNPVAYEQWGMTSTNLQGDQGDSD

SEQ ID NO: 84103 - protein, 30 aa, Artificial Sequence
  Description of Artificial Sequence: Synthetic polypeptide
AENEIACTNPVATEQYGETSENLQRGEGQD

SEQ ID NO: 84104 - protein, 33 aa, Artificial Sequence
  Description of Artificial Sequence: Synthetic polypeptide
DEEEISTTNPVATEQYGCVCSTGELQHFNSQQL

SEQ ID NO: 84105 - protein, 33 aa, Artificial Sequence
  Description of Artificial Sequence: Synthetic polypeptide
DEVEIATTNPVATEQYGSVSGTHPGQTREPGVH

SEQ ID NO: 84106 - protein, 31 aa, Artificial Sequence
  Description of Artificial Sequence: Synthetic polypeptide
DEAEIACTNPVATEQYGCVATNLQEAGTPED

SEQ ID NO: 84107 - protein, 30 aa, Artificial Sequence
  Description of Artificial Sequence: Synthetic polypeptide
DEESIACTNPVATEQYGCVAGTNDQDQNSL

SEQ ID NO: 84108 - protein, 33 aa, Artificial Sequence
  Description of Artificial Sequence: Synthetic polypeptide
DEEEISTTNPVATEQYGCVCSTGNDESFGSNQP

SEQ ID NO: 84109 - protein, 29 aa, Artificial Sequence
  Description of Artificial Sequence: Synthetic peptide
DEESIACTNPVATEQYGSVAMHDQPGDDL

SEQ ID NO: 84110 - protein, 33 aa, Artificial Sequence
  Description of Artificial Sequence: Synthetic polypeptide
DEEEISTTNPVATEQYGCVCSTGEPQHGSENQS

SEQ ID NO: 84111 - protein, 29 aa, Artificial Sequence
  Description of Artificial Sequence: Synthetic peptide
AENEIATTNPVATEQYGEASENLMNAGGA

SEQ ID NO: 84112 - protein, 31 aa, Artificial Sequence
  Description of Artificial Sequence: Synthetic polypeptide
DEAEIACTNPVATEQYGCVATNLQMGDIEAE

SEQ ID NO: 84113 - protein, 36 aa, Artificial Sequence
  Description of Artificial Sequence: Synthetic polypeptide
DEDEIRTTNPVATEQYGSVSTVTNNLQSGNNNEEDD

SEQ ID NO: 84114 - protein, 36 aa, Artificial Sequence
  Description of Artificial Sequence: Synthetic polypeptide
DEDEIRTTNPVATEQYGSVSTVTNNLQAGNNNVEGD

SEQ ID NO: 84115 - protein, 29 aa, Artificial Sequence
  Description of Artificial Sequence: Synthetic peptide
DEESIACTNPVATEQYGSVAMHDQPVNLH

SEQ ID NO: 84116 - protein, 35 aa, Artificial Sequence
  Description of Artificial Sequence: Synthetic polypeptide
DEEEIRTTNPVAVEQYGSVSTVNNNNLQEDEIGTE

SEQ ID NO: 84117 - protein, 35 aa, Artificial Sequence
  Description of Artificial Sequence: Synthetic polypeptide
DEEEIRTTNPVAVEQYGSVSTNNNQQLQAGIGTDT

SEQ ID NO: 84118 - protein, 36 aa, Artificial Sequence
  Description of Artificial Sequence: Synthetic polypeptide
DEDEIRTTNPVATEQYGSVSTVNQQLQAGNNNQNDD

SEQ ID NO: 84119 - protein, 31 aa, Artificial Sequence
  Description of Artificial Sequence: Synthetic polypeptide
DEESIACTNPVATESYGCVATNLQDVGDNDA

SEQ ID NO: 84120 - protein, 32 aa, Artificial Sequence
  Description of Artificial Sequence: Synthetic polypeptide
DEESIACTNPVATESYGGCVATNLQDSGDNRM

SEQ ID NO: 84121 - protein, 34 aa, Artificial Sequence
  Description of Artificial Sequence: Synthetic polypeptide
DEEEISTTNPVATEQYGCVCSTGELQYFGSNPQS

SEQ ID NO: 84122 - protein, 31 aa, Artificial Sequence
  Description of Artificial Sequence: Synthetic polypeptide
DEEEIRTTNPVAYEQYGCVCGSNLQVFDSDQ

SEQ ID NO: 84123 - protein, 32 aa, Artificial Sequence
  Description of Artificial Sequence: Synthetic polypeptide
DEEEISTTNPVATEQYGCVCSTGELQNSFSEQ

SEQ ID NO: 84124 - protein, 32 aa, Artificial Sequence
  Description of Artificial Sequence: Synthetic polypeptide
DEESIACTNPVATESYGSVATNGLQNPMGNMD

SEQ ID NO: 84125 - protein, 32 aa, Artificial Sequence
  Description of Artificial Sequence: Synthetic polypeptide
DEEEIRTTNPVAYEQYGCVCGTNLQSFDSDQS

SEQ ID NO: 84126 - protein, 33 aa, Artificial Sequence
  Description of Artificial Sequence: Synthetic polypeptide
DEVEIATTNPVATEQYGSVSPTDNQGNQGNGGV

SEQ ID NO: 84127 - protein, 31 aa, Artificial Sequence
  Description of Artificial Sequence: Synthetic polypeptide
DEESIACTNPVATESYGSVATNGLQSGGEGM

SEQ ID NO: 84128 - protein, 36 aa, Artificial Sequence
  Description of Artificial Sequence: Synthetic polypeptide
DEDEIRTTNPVATEQYGSVSTVQNLQAGGNNNNEDE

SEQ ID NO: 84129 - protein, 36 aa, Artificial Sequence
  Description of Artificial Sequence: Synthetic polypeptide
DEEEIRTTNPVATEQYGSVSPVENLVQEQQGPENNV

SEQ ID NO: 84130 - protein, 30 aa, Artificial Sequence
  Description of Artificial Sequence: Synthetic polypeptide
AENEIATTNPVATEQYGDASENLQNAAGGA

SEQ ID NO: 84131 - protein, 36 aa, Artificial Sequence
  Description of Artificial Sequence: Synthetic polypeptide
DEEEIRTTNPVAVEQYGSVSTVNNNNLQQGNNEDED

SEQ ID NO: 84132 - protein, 35 aa, Artificial Sequence
  Description of Artificial Sequence: Synthetic polypeptide
DEEEIRTTNPVAVEQYGSVSTVTNNQGGNNNSNDT

SEQ ID NO: 84133 - protein, 28 aa, Artificial Sequence
  Description of Artificial Sequence: Synthetic peptide
AENEIATTNPVATECYGEVSECLQHEEL

SEQ ID NO: 84134 - protein, 36 aa, Artificial Sequence
  Description of Artificial Sequence: Synthetic polypeptide
DEEEIRTTNPVATEQYGSVSQPTPDIPNMQNGMNPV

SEQ ID NO: 84135 - protein, 35 aa, Artificial Sequence
  Description of Artificial Sequence: Synthetic polypeptide
DEEEIRTTNPVAVEQYGSVSTVTNNNQQGNNQGED

SEQ ID NO: 84136 - protein, 34 aa, Artificial Sequence
  Description of Artificial Sequence: Synthetic polypeptide
DEEEISTTNPVATEQYGCVCSTNDHQERSGSEQA

SEQ ID NO: 84137 - protein, 28 aa, Artificial Sequence
  Description of Artificial Sequence: Synthetic peptide
AENEIATTNPVATECYGEVSECLQHEGL

SEQ ID NO: 84138 - protein, 35 aa, Artificial Sequence
  Description of Artificial Sequence: Synthetic polypeptide
DEEEIRTTNPVAVEQYGSVSTVTNNNNQQNGNQDE

SEQ ID NO: 84139 - protein, 32 aa, Artificial Sequence
  Description of Artificial Sequence: Synthetic polypeptide
DEEQIRCTNPVATEQYGSTVSTDHELRIENNT

SEQ ID NO: 84140 - protein, 35 aa, Artificial Sequence
  Description of Artificial Sequence: Synthetic polypeptide
DEEEISTTNPVATEQYGCVCSTMNSLFQVRFGSEQ

SEQ ID NO: 84141 - protein, 34 aa, Artificial Sequence
  Description of Artificial Sequence: Synthetic polypeptide
DEEEIRTTNPVAYEQWGVSVVSCTNALSHRPGGF

SEQ ID NO: 84142 - protein, 34 aa, Artificial Sequence
  Description of Artificial Sequence: Synthetic polypeptide
DEEEIRTTNPVATEQYGSVSQPVNYLTQVAMLEM

SEQ ID NO: 84143 - protein, 35 aa, Artificial Sequence
  Description of Artificial Sequence: Synthetic polypeptide
DEEEIRTTNPVAVEQYGSVSTVTNNNNQGQTGNTD

SEQ ID NO: 84144 - protein, 30 aa, Artificial Sequence
  Description of Artificial Sequence: Synthetic polypeptide
DDSEVACTNPVATEQYGNVSANTIQRVGQR

SEQ ID NO: 84145 - protein, 28 aa, Artificial Sequence
  Description of Artificial Sequence: Synthetic peptide
AENEIATTNPVATECYGEVSNDLQHEEL

SEQ ID NO: 84146 - protein, 31 aa, Artificial Sequence
  Description of Artificial Sequence: Synthetic polypeptide
DEEQIRCTNPVATEQYGSVSPDHELRIEDNT

SEQ ID NO: 84147 - protein, 33 aa, Artificial Sequence
  Description of Artificial Sequence: Synthetic polypeptide
DEEEIRTTNPVATEQYGSVSQSMLFRDVEEEVE

SEQ ID NO: 84148 - protein, 33 aa, Artificial Sequence
  Description of Artificial Sequence: Synthetic polypeptide
DEEEIRTTNPVATEQYGSVSQSMLMPRFEEEVE

SEQ ID NO: 84149 - protein, 33 aa, Artificial Sequence
  Description of Artificial Sequence: Synthetic polypeptide
DEEEISTTNPVATEQYGCVCSTMNHTNFGSNQA

SEQ ID NO: 84150 - protein, 28 aa, Artificial Sequence
  Description of Artificial Sequence: Synthetic peptide
AENEIATTNPVATECYGVVSEYLQTEEL

SEQ ID NO: 84151 - protein, 32 aa, Artificial Sequence
  Description of Artificial Sequence: Synthetic polypeptide
DEEQIRCTNPVATEQYGSVSTLEELRSGQETQ

SEQ ID NO: 84152 - protein, 34 aa, Artificial Sequence
  Description of Artificial Sequence: Synthetic polypeptide
DEEEIRTTNPVAYEQWGVYTISVRNEGLQRDGNR

SEQ ID NO: 84153 - protein, 35 aa, Artificial Sequence
  Description of Artificial Sequence: Synthetic polypeptide
DEEEIRTTNPVAVEQYGSVSTVTNNQNLQENNNED

SEQ ID NO: 84154 - protein, 31 aa, Artificial Sequence
  Description of Artificial Sequence: Synthetic polypeptide
DEVEIATTNPVATIGYGMVPSTPAFQGGNRP

SEQ ID NO: 84155 - protein, 33 aa, Artificial Sequence
  Description of Artificial Sequence: Synthetic polypeptide
DEEEIRTTNPVAYEQWGVSVKRQNDGDQRGDRR

SEQ ID NO: 84156 - protein, 37 aa, Artificial Sequence
  Description of Artificial Sequence: Synthetic polypeptide
DEEEIRTTNPVATEQYGSVSQPTPAQPNLQNGMNDVV

SEQ ID NO: 84157 - protein, 31 aa, Artificial Sequence
  Description of Artificial Sequence: Synthetic polypeptide
DEVEIATTNPVAYDQWGMVSTALQAGGDNQR

SEQ ID NO: 84158 - protein, 29 aa, Artificial Sequence
  Description of Artificial Sequence: Synthetic peptide
AENEIACTNPVATEQYGEYCSWNLQNGGA

SEQ ID NO: 84159 - protein, 31 aa, Artificial Sequence
  Description of Artificial Sequence: Synthetic polypeptide
DEEQIATTNPVAYEQYGSVSTHEPLGNENTL

SEQ ID NO: 84160 - protein, 28 aa, Artificial Sequence
  Description of Artificial Sequence: Synthetic peptide
AENEIATTNPVATECYGDASENLQHEEL

SEQ ID NO: 84161 - protein, 35 aa, Artificial Sequence
  Description of Artificial Sequence: Synthetic polypeptide
DEEEIRTTNPVAVEQYGSVSTVTNNQQLGNNNSEE

SEQ ID NO: 84162 - protein, 32 aa, Artificial Sequence
  Description of Artificial Sequence: Synthetic polypeptide
DEDEIRTTNPVAYEPWGEVSTNLNRGEGQNGS

SEQ ID NO: 84163 - protein, 31 aa, Artificial Sequence
  Description of Artificial Sequence: Synthetic polypeptide
DEEQIATTNPVAYEQYGSVSTHEPLNEHNTQ

SEQ ID NO: 84164 - protein, 30 aa, Artificial Sequence
  Description of Artificial Sequence: Synthetic polypeptide
DEVEIATTNPVAWIQYGMVSTEAPQVGTRF

SEQ ID NO: 84165 - protein, 28 aa, Artificial Sequence
  Description of Artificial Sequence: Synthetic peptide
AENEIATTNPVATECYGDVSEALQHSEL

SEQ ID NO: 84166 - protein, 34 aa, Artificial Sequence
  Description of Artificial Sequence: Synthetic polypeptide
DEEEISTTNPVATEQYGCVCSTNDLQNFNSENQS

SEQ ID NO: 84167 - protein, 28 aa, Artificial Sequence
  Description of Artificial Sequence: Synthetic peptide
AENEIATTNPVATECYGDVSECLQHEEL

SEQ ID NO: 84168 - protein, 28 aa, Artificial Sequence
  Description of Artificial Sequence: Synthetic peptide
AENEIATTNPVATECYGDVSECLQHEGL

SEQ ID NO: 84169 - protein, 30 aa, Artificial Sequence
  Description of Artificial Sequence: Synthetic polypeptide
DDSEVACTNPVATEQYGNVAANTIQSRGNR

SEQ ID NO: 84170 - protein, 35 aa, Artificial Sequence
  Description of Artificial Sequence: Synthetic polypeptide
DEEEISTTNPVATEQYGCVCSTNDLQEHFGSENQS

SEQ ID NO: 84171 - protein, 31 aa, Artificial Sequence
  Description of Artificial Sequence: Synthetic polypeptide
DEEEIRTTNPVAYEQWGTYVYTVDDLDGGNS

SEQ ID NO: 84172 - protein, 35 aa, Artificial Sequence
  Description of Artificial Sequence: Synthetic polypeptide
DEEEIRTTNPVAVEQYGSVSTVTNNQQIGNNTEDE

SEQ ID NO: 84173 - protein, 35 aa, Artificial Sequence
  Description of Artificial Sequence: Synthetic polypeptide
DEEEIRTTNPVAVEQYGSVSTVTNNQQGNNQGEGN

SEQ ID NO: 84174 - protein, 28 aa, Artificial Sequence
  Description of Artificial Sequence: Synthetic peptide
AENEIATTNPVATECYGDVSWTLQHEEL

SEQ ID NO: 84175 - protein, 28 aa, Artificial Sequence
  Description of Artificial Sequence: Synthetic peptide
AENEIATTNPVATECYGEASECLQREGL

SEQ ID NO: 84176 - protein, 28 aa, Artificial Sequence
  Description of Artificial Sequence: Synthetic peptide
AENEIATTNPVATECYGEASENLQHEEL

SEQ ID NO: 84177 - protein, 35 aa, Artificial Sequence
  Description of Artificial Sequence: Synthetic polypeptide
DEEEIRTTNPVAVEQYGSVSTVTNNQNNQNGNEDD

SEQ ID NO: 84178 - protein, 34 aa, Artificial Sequence
  Description of Artificial Sequence: Synthetic polypeptide
DEEEIRTTNPVAYEQWGVSNVSYTNELQHGPGGF

SEQ ID NO: 84179 - protein, 32 aa, Artificial Sequence
  Description of Artificial Sequence: Synthetic polypeptide
DEVEIATTNPVATIGYGMVPSGTPALQGGNRY

SEQ ID NO: 84180 - protein, 32 aa, Artificial Sequence
  Description of Artificial Sequence: Synthetic polypeptide
DEVEIATTNPVATEWYGVVSTNLQLGGDQGEE

SEQ ID NO: 84181 - protein, 35 aa, Artificial Sequence
  Description of Artificial Sequence: Synthetic polypeptide
DEEEIRTTNPVAYEQYGAAVSQMNDLLQPRGQISR

SEQ ID NO: 84182 - protein, 33 aa, Artificial Sequence
  Description of Artificial Sequence: Synthetic polypeptide
DEEEIRTTNPVAYEQYGCQVCSTELQNFNSNQS

SEQ ID NO: 84183 - protein, 33 aa, Artificial Sequence
  Description of Artificial Sequence: Synthetic polypeptide
DEEEISTTNPVATEQYGCVCSTGPHERFGSNQY

SEQ ID NO: 84184 - protein, 32 aa, Artificial Sequence
  Description of Artificial Sequence: Synthetic polypeptide
DEDEIRTTNPVAYEQWGCVSTNLNGDTGDNEQ

SEQ ID NO: 84185 - protein, 34 aa, Artificial Sequence
  Description of Artificial Sequence: Synthetic polypeptide
DEEEIRTTNPVATEQYGSVSQTINDFQQTISVEE

SEQ ID NO: 84186 - protein, 36 aa, Artificial Sequence
  Description of Artificial Sequence: Synthetic polypeptide
DEEEIRTTNPVATEQYGSVSQTINLSVQQQNEEPLE

SEQ ID NO: 84187 - protein, 34 aa, Artificial Sequence
  Description of Artificial Sequence: Synthetic polypeptide
DEEEISTTNPVATEQYGCVCSTGNTQNFGSNTDA

SEQ ID NO: 84188 - protein, 32 aa, Artificial Sequence
  Description of Artificial Sequence: Synthetic polypeptide
DEEQIRTTNPVAYEAYGSVSYTHEESLRVGNT

SEQ ID NO: 84189 - protein, 33 aa, Artificial Sequence
  Description of Artificial Sequence: Synthetic polypeptide
DEVEIATTNPVATEQYGVVSWNDEGLQNGSNQD

SEQ ID NO: 84190 - protein, 29 aa, Artificial Sequence
  Description of Artificial Sequence: Synthetic peptide
AENEIACTNPVATEQYGEVSENEQNREGA

SEQ ID NO: 84191 - protein, 33 aa, Artificial Sequence
  Description of Artificial Sequence: Synthetic polypeptide
DEEEISTTNPVATEQYGCVCSTGNPQNFGSDQG

SEQ ID NO: 84192 - protein, 34 aa, Artificial Sequence
  Description of Artificial Sequence: Synthetic polypeptide
DEEEIRTTNPVATEQYGSVSQTMFLLPQQNEEPL

SEQ ID NO: 84193 - protein, 32 aa, Artificial Sequence
  Description of Artificial Sequence: Synthetic polypeptide
DEVEIATTNPVATEQYGSVTGGNDGQRGAGGQ

SEQ ID NO: 84194 - protein, 30 aa, Artificial Sequence
  Description of Artificial Sequence: Synthetic polypeptide
AENEIACTNPVATEQYGEVSEDNLQFEGGD

SEQ ID NO: 84195 - protein, 33 aa, Artificial Sequence
  Description of Artificial Sequence: Synthetic polypeptide
DEEEISTTNPVATEQYGCVCSTGNPQHFGSQQE

SEQ ID NO: 84196 - protein, 35 aa, Artificial Sequence
  Description of Artificial Sequence: Synthetic polypeptide
DEVEIATTNPVATEQYGSVSWTELGDQDRQGMGNN

SEQ ID NO: 84197 - protein, 31 aa, Artificial Sequence
  Description of Artificial Sequence: Synthetic polypeptide
DEDEIRTTNPVAYEQWGETSTNLQGDGDDSD

SEQ ID NO: 84198 - protein, 32 aa, Artificial Sequence
  Description of Artificial Sequence: Synthetic polypeptide
DDEEISTTNPVATEQYGCVCSTNHQSFGSDQG

SEQ ID NO: 84199 - protein, 29 aa, Artificial Sequence
  Description of Artificial Sequence: Synthetic peptide
AENEIATTNPVATEPYGEISMDLQQQGGR

SEQ ID NO: 84200 - protein, 29 aa, Artificial Sequence
  Description of Artificial Sequence: Synthetic peptide
AENEIATTNPVATEQWGDVSEILQRAEDA

SEQ ID NO: 84201 - protein, 31 aa, Artificial Sequence
  Description of Artificial Sequence: Synthetic polypeptide
DEDEIRTTNPVAYEQWGETSTNLQGEGQDSD

SEQ ID NO: 84202 - protein, 29 aa, Artificial Sequence
  Description of Artificial Sequence: Synthetic peptide
AENEIATTNPVATEQYGDASEIEQRAGGA

SEQ ID NO: 84203 - protein, 35 aa, Artificial Sequence
  Description of Artificial Sequence: Synthetic polypeptide
DEEEIRTTNPVATEQYGSVSQTICNLVIDVGEVVA

SEQ ID NO: 84204 - protein, 35 aa, Artificial Sequence
  Description of Artificial Sequence: Synthetic polypeptide
DEEEIRTTNPVATEQYGSVSQTGSLLQHQNEEPLS

SEQ ID NO: 84205 - protein, 34 aa, Artificial Sequence
  Description of Artificial Sequence: Synthetic polypeptide
DEEEISTTNPVATEQYGCVCSTGPLQHFGSNNQP

SEQ ID NO: 84206 - protein, 35 aa, Artificial Sequence
  Description of Artificial Sequence: Synthetic polypeptide
DEEEIRTTNPVATEQYGSVSQTGNTSQQSNEEPLE

SEQ ID NO: 84207 - protein, 36 aa, Artificial Sequence
  Description of Artificial Sequence: Synthetic polypeptide
DEEEIRTTNPVAYEQYGASVTSNTNDELQPRSIEKR

SEQ ID NO: 84208 - protein, 34 aa, Artificial Sequence
  Description of Artificial Sequence: Synthetic polypeptide
DEEEISTTNPVATEQYGCVCSTMELQNFGSNTQA

SEQ ID NO: 84209 - protein, 33 aa, Artificial Sequence
  Description of Artificial Sequence: Synthetic polypeptide
DEEEISTTNPVATEQYGCVCSTGYHQNSGSNNQ

SEQ ID NO: 84210 - protein, 35 aa, Artificial Sequence
  Description of Artificial Sequence: Synthetic polypeptide
DEEEIRTTNPVATEQYGSVSQTGLLLEQPQNEEPL

SEQ ID NO: 84211 - protein, 33 aa, Artificial Sequence
  Description of Artificial Sequence: Synthetic polypeptide
DEVEIATTNPVATEWYGSVSTNLQGLGGDDGET

SEQ ID NO: 84212 - protein, 34 aa, Artificial Sequence
  Description of Artificial Sequence: Synthetic polypeptide
DEEEIRTTNPVATEQYGSVSPTNIMQMTSLEVDF

SEQ ID NO: 84213 - protein, 34 aa, Artificial Sequence
  Description of Artificial Sequence: Synthetic polypeptide
DEEQIRCTNPVAYESYGSVCSCTNESSQNRGSNR

SEQ ID NO: 84214 - protein, 36 aa, Artificial Sequence
  Description of Artificial Sequence: Synthetic polypeptide
DEEEIRTTNPVATEQYGSVSQTGNLSQQMQNEEDLE

SEQ ID NO: 84215 - protein, 32 aa, Artificial Sequence
  Description of Artificial Sequence: Synthetic polypeptide
DEEQIRTTNPCATEQYGSVSTTNMDNAANNWQ

SEQ ID NO: 84216 - protein, 32 aa, Artificial Sequence
  Description of Artificial Sequence: Synthetic polypeptide
DEEQIRTTNPVATEAYGSTVSCTHESLRGGST

SEQ ID NO: 84217 - protein, 29 aa, Artificial Sequence
  Description of Artificial Sequence: Synthetic peptide
AENEIATTNPVATEQYGDASEILQRAEGA

SEQ ID NO: 84218 - protein, 32 aa, Artificial Sequence
  Description of Artificial Sequence: Synthetic polypeptide
DEVEIATTNPVATEWYGCVSTNLQLGGDDGEA

SEQ ID NO: 84219 - protein, 36 aa, Artificial Sequence
  Description of Artificial Sequence: Synthetic polypeptide
DEEEIRTTNPVAYEQYGAVVSIQTNDLLQRGGQRNE

SEQ ID NO: 84220 - protein, 36 aa, Artificial Sequence
  Description of Artificial Sequence: Synthetic polypeptide
DEEEIRTTNPVATEQYGSVSQTGNLSQQQHNEEDLS

SEQ ID NO: 84221 - protein, 29 aa, Artificial Sequence
  Description of Artificial Sequence: Synthetic peptide
DEDEIRTTNPVAYEPYGSHFTGEQWIGST

SEQ ID NO: 84222 - protein, 31 aa, Artificial Sequence
  Description of Artificial Sequence: Synthetic polypeptide
DDEEISTTNPVAYCQYGCVCSTNPIRFGSNQ

SEQ ID NO: 84223 - protein, 32 aa, Artificial Sequence
  Description of Artificial Sequence: Synthetic polypeptide
DEVEIATTNPVATEWYGCVSTGNQQLGGDNGE

SEQ ID NO: 84224 - protein, 33 aa, Artificial Sequence
  Description of Artificial Sequence: Synthetic polypeptide
DEEEISTTNPVATEQYGCVCSTGPPQYFGSNQS

SEQ ID NO: 84225 - protein, 33 aa, Artificial Sequence
  Description of Artificial Sequence: Synthetic polypeptide
DEEEISTTNPVATEQYGCVCSTGPPQNFGSNQP

SEQ ID NO: 84226 - protein, 35 aa, Artificial Sequence
  Description of Artificial Sequence: Synthetic polypeptide
DEEEIRTTNPVATEQYGSVSQTGNNSQEQNEEPLT

SEQ ID NO: 84227 - protein, 32 aa, Artificial Sequence
  Description of Artificial Sequence: Synthetic polypeptide
DEVEIATTNPVATEWWGSVSTNLQLGEDDGEQ

SEQ ID NO: 84228 - protein, 31 aa, Artificial Sequence
  Description of Artificial Sequence: Synthetic polypeptide
DEDEIRTTNPVAYEQWGATSTNLQLGEGDSD

SEQ ID NO: 84229 - protein, 35 aa, Artificial Sequence
  Description of Artificial Sequence: Synthetic polypeptide
DEEEIRTTNPVAYEQYGAVVSIQNNDLLQRGIRNE

SEQ ID NO: 84230 - protein, 33 aa, Artificial Sequence
  Description of Artificial Sequence: Synthetic polypeptide
DEVEIATTNPVATEQYGSVSANDAQTAMGNAEF

SEQ ID NO: 84231 - protein, 33 aa, Artificial Sequence
  Description of Artificial Sequence: Synthetic polypeptide
DEEEISTTNPVATEQYGCVCSWENLQSFGSEQP

SEQ ID NO: 84232 - protein, 32 aa, Artificial Sequence
  Description of Artificial Sequence: Synthetic polypeptide
DEVEIATTNPVAYEQYGTVATNLQGEHGGNGE

SEQ ID NO: 84233 - protein, 34 aa, Artificial Sequence
  Description of Artificial Sequence: Synthetic polypeptide
DEEEIRTTNPVATEQYGSVSPTSNNQQFFEEEDI

SEQ ID NO: 84234 - protein, 30 aa, Artificial Sequence
  Description of Artificial Sequence: Synthetic polypeptide
AENEIACTNPVAYTEEYGEASEYNLQRGGR

SEQ ID NO: 84235 - protein, 33 aa, Artificial Sequence
  Description of Artificial Sequence: Synthetic polypeptide
DEEEIRTTNPVAYEHYGSTPSQNLSQTSVGNSW

SEQ ID NO: 84236 - protein, 30 aa, Artificial Sequence
  Description of Artificial Sequence: Synthetic polypeptide
DDSEIRSTNPVATEGYGNVSNTIQSRVGQR

SEQ ID NO: 84237 - protein, 34 aa, Artificial Sequence
  Description of Artificial Sequence: Synthetic polypeptide
DEEEISTTNPVATEQYGQSVCSNTELQHFGSQQS

SEQ ID NO: 84238 - protein, 31 aa, Artificial Sequence
  Description of Artificial Sequence: Synthetic polypeptide
DEEEIVTTNPVATEQYGTASATDGPQFEEND

SEQ ID NO: 84239 - protein, 34 aa, Artificial Sequence
  Description of Artificial Sequence: Synthetic polypeptide
DEEEISTTNPVATEQYGQCVCSTPLQEYFGSNQS

SEQ ID NO: 84240 - protein, 31 aa, Artificial Sequence
  Description of Artificial Sequence: Synthetic polypeptide
DEEEIVTTNPVATEQYGTASATGPVEHEGND

SEQ ID NO: 84241 - protein, 31 aa, Artificial Sequence
  Description of Artificial Sequence: Synthetic polypeptide
DEEEIVTTNPVATEQYGTASATGPVEHEGNK

SEQ ID NO: 84242 - protein, 34 aa, Artificial Sequence
  Description of Artificial Sequence: Synthetic polypeptide
DEVEIRTTNPVATECYGSVSTDGDEGNGQTGNVN

SEQ ID NO: 84243 - protein, 33 aa, Artificial Sequence
  Description of Artificial Sequence: Synthetic polypeptide
DEVEIRTTNPVATECYGSVSNGNGNHQDGEGHR

SEQ ID NO: 84244 - protein, 36 aa, Artificial Sequence
  Description of Artificial Sequence: Synthetic polypeptide
DEEEIRTTNPVATEQYGSVSPTNNPLLLREPEAGLF

SEQ ID NO: 84245 - protein, 33 aa, Artificial Sequence
  Description of Artificial Sequence: Synthetic polypeptide
DEEEIRTTNPVAYEHYGIEVGTTELSQMGGMNR

SEQ ID NO: 84246 - protein, 34 aa, Artificial Sequence
  Description of Artificial Sequence: Synthetic polypeptide
DEEEIRTTNPVATEQYGSVSPTSSQYRITEEMVD

SEQ ID NO: 84247 - protein, 35 aa, Artificial Sequence
  Description of Artificial Sequence: Synthetic polypeptide
DEEEIRTTNPVATEQYGSVSPTNNPLLLAEGVAQL

SEQ ID NO: 84248 - protein, 32 aa, Artificial Sequence
  Description of Artificial Sequence: Synthetic polypeptide
DEEEIVTTNPVATEQYGTVCPATGPVQFEGND

SEQ ID NO: 84249 - protein, 35 aa, Artificial Sequence
  Description of Artificial Sequence: Synthetic polypeptide
DEEEIRTTNPVATEQYGSVSPTNNPILLTEGVAGL

SEQ ID NO: 84250 - protein, 34 aa, Artificial Sequence
  Description of Artificial Sequence: Synthetic polypeptide
DEEEIRTTNPVATEQYGSVSPTSVNHDDRVVEEM

SEQ ID NO: 84251 - protein, 34 aa, Artificial Sequence
  Description of Artificial Sequence: Synthetic polypeptide
DEEEIRTTNPVATEQYGSVSPTNNNDEELGAELD

SEQ ID NO: 84252 - protein, 31 aa, Artificial Sequence
  Description of Artificial Sequence: Synthetic polypeptide
DEEEIVTTNPVATEQYGTVCSADDGPEFGND

SEQ ID NO: 84253 - protein, 34 aa, Artificial Sequence
  Description of Artificial Sequence: Synthetic polypeptide
DEEEIRTTNPVAYEGYGSVPSCLNESQTSTGNYR

SEQ ID NO: 84254 - protein, 34 aa, Artificial Sequence
  Description of Artificial Sequence: Synthetic polypeptide
DEEEIRTTNPVATEQYGSVSPTSNNINIDGELIQ

SEQ ID NO: 84255 - protein, 33 aa, Artificial Sequence
  Description of Artificial Sequence: Synthetic polypeptide
DEEEIRTTNPVAYEGYGSTVSCTDLSGQGTNSQ

SEQ ID NO: 84256 - protein, 32 aa, Artificial Sequence
  Description of Artificial Sequence: Synthetic polypeptide
DEEEIRTTNPVAYEHYGSTPSQTLSQSVGNNS

SEQ ID NO: 84257 - protein, 32 aa, Artificial Sequence
  Description of Artificial Sequence: Synthetic polypeptide
DDSEIRSTNPVATEGWGSVSCINEPQDRVGNR

SEQ ID NO: 84258 - protein, 34 aa, Artificial Sequence
  Description of Artificial Sequence: Synthetic polypeptide
DEEEIRTTNPVATEQYGSVSPTSLGLDTSNGEDM

SEQ ID NO: 84259 - protein, 34 aa, Artificial Sequence
  Description of Artificial Sequence: Synthetic polypeptide
DEEEIVTTNPVATEQYGSVSSTTDAGVNMFEGND

SEQ ID NO: 84260 - protein, 32 aa, Artificial Sequence
  Description of Artificial Sequence: Synthetic polypeptide
DEEEIRTTNPVAYEPWGQSVSQNELSQPGISQ

SEQ ID NO: 84261 - protein, 35 aa, Artificial Sequence
  Description of Artificial Sequence: Synthetic polypeptide
DEEEISTTNPVATEQYGSVCSNTNLQENFGSETQA

SEQ ID NO: 84262 - protein, 35 aa, Artificial Sequence
  Description of Artificial Sequence: Synthetic polypeptide
DEEEIRTTNPVATEQYGSVSPTSLVQPDVGAIDPD

SEQ ID NO: 84263 - protein, 33 aa, Artificial Sequence
  Description of Artificial Sequence: Synthetic polypeptide
DEVEIRTTNPVATECYGSVSTGNNNQQDEHNGA

SEQ ID NO: 84264 - protein, 31 aa, Artificial Sequence
  Description of Artificial Sequence: Synthetic polypeptide
DEEEIRTTNPVAYEPWGECPSTNEESQRVNF

SEQ ID NO: 84265 - protein, 34 aa, Artificial Sequence
  Description of Artificial Sequence: Synthetic polypeptide
DEVEIRTTNPVATECYGSVSTGNNGGNTAGENDR

SEQ ID NO: 84266 - protein, 34 aa, Artificial Sequence
  Description of Artificial Sequence: Synthetic polypeptide
DEEEIVTTNPVATEQYGSVSSTTPGGVNREGNPD

SEQ ID NO: 84267 - protein, 33 aa, Artificial Sequence
  Description of Artificial Sequence: Synthetic polypeptide
DEEEISTTNPVATEQYGSVCSNTETQNFGSEQA

SEQ ID NO: 84268 - protein, 32 aa, Artificial Sequence
  Description of Artificial Sequence: Synthetic polypeptide
DEEEIRTTNPVAYEHYGSVVGTTGLSQAVGME

SEQ ID NO: 84269 - protein, 33 aa, Artificial Sequence
  Description of Artificial Sequence: Synthetic polypeptide
DEEEIRTTNPVAYEHYGSVVATNALSQVTDSRT

SEQ ID NO: 84270 - protein, 30 aa, Artificial Sequence
  Description of Artificial Sequence: Synthetic polypeptide
DEEEIVTTNPVATEQYGTAPATGPVEHGNK

SEQ ID NO: 84271 - protein, 30 aa, Artificial Sequence
  Description of Artificial Sequence: Synthetic polypeptide
DDSEIRCTNPVSTEQYGSVANTIQSRVGQR

SEQ ID NO: 84272 - protein, 30 aa, Artificial Sequence
  Description of Artificial Sequence: Synthetic polypeptide
DEEEIVTTNPVATEQYGTAPTDGPQFEEND

SEQ ID NO: 84273 - protein, 30 aa, Artificial Sequence
  Description of Artificial Sequence: Synthetic polypeptide
DEEEIVTTNPVATEQYGTAPTDGPQHEEND

SEQ ID NO: 84274 - protein, 30 aa, Artificial Sequence
  Description of Artificial Sequence: Synthetic polypeptide
AENEIACTNPVAYEQYGKASENLAQRGGGR

SEQ ID NO: 84275 - protein, 29 aa, Artificial Sequence
  Description of Artificial Sequence: Synthetic peptide
DEEEIVTTNPVATEQYGTAPTGCQHEEEK

SEQ ID NO: 84276 - protein, 29 aa, Artificial Sequence
  Description of Artificial Sequence: Synthetic peptide
DEEEIVTTNPVATEQYGTAPTGPQFEEEK

SEQ ID NO: 84277 - protein, 29 aa, Artificial Sequence
  Description of Artificial Sequence: Synthetic peptide
DEEEIVTTNPVATEQYGTAPTGPQHEEED

SEQ ID NO: 84278 - protein, 29 aa, Artificial Sequence
  Description of Artificial Sequence: Synthetic peptide
DEEEIVTTNPVATEQYGTAPTGPQHEEEK

SEQ ID NO: 84279 - protein, 31 aa, Artificial Sequence
  Description of Artificial Sequence: Synthetic polypeptide
DEEEIVTTNPVATEQYGTASATDGPEFEGND

SEQ ID NO: 84280 - protein, 34 aa, Artificial Sequence
  Description of Artificial Sequence: Synthetic polypeptide
DEEEIVTTNPVATEQYGSVSSATPGGVNREGNPD

SEQ ID NO: 84281 - protein, 35 aa, Artificial Sequence
  Description of Artificial Sequence: Synthetic polypeptide
DEDEIRTTNPVATTQYGSVSTTNQELQQGTNNTDT

SEQ ID NO: 84282 - protein, 32 aa, Artificial Sequence
  Description of Artificial Sequence: Synthetic polypeptide
DEEEIVTTNPVATEQYGTVCSATDGPEFEGND

SEQ ID NO: 84283 - protein, 34 aa, Artificial Sequence
  Description of Artificial Sequence: Synthetic polypeptide
DEEEIWTTNPVATEQYGSVPSCTENPVGQFGGHQ

SEQ ID NO: 84284 - protein, 31 aa, Artificial Sequence
  Description of Artificial Sequence: Synthetic polypeptide
DDNEIRTTNPVSTEPYGNVAMETIQQRNGNR

SEQ ID NO: 84285 - protein, 32 aa, Artificial Sequence
  Description of Artificial Sequence: Synthetic polypeptide
DEEELSTTNPEATEQYGNVVCSTNNEQRDGSQ

SEQ ID NO: 84286 - protein, 34 aa, Artificial Sequence
  Description of Artificial Sequence: Synthetic polypeptide
DEVEIRTTNPVATEQYGSVDETNGNQEGGGNEGI

SEQ ID NO: 84287 - protein, 32 aa, Artificial Sequence
  Description of Artificial Sequence: Synthetic polypeptide
DDSEIRTTNPVATECWGSVSCINEPQDREGNG

SEQ ID NO: 84288 - protein, 31 aa, Artificial Sequence
  Description of Artificial Sequence: Synthetic polypeptide
DDNEIRTTNPVATEQWGDVSANTIQSRVEDR

SEQ ID NO: 84289 - protein, 28 aa, Artificial Sequence
  Description of Artificial Sequence: Synthetic peptide
AENEIACTNPVGTEGYGEMSSNLQRGGI

SEQ ID NO: 84290 - protein, 33 aa, Artificial Sequence
  Description of Artificial Sequence: Synthetic polypeptide
DEEEIRTTNPVAYECYGKVCPSTNEESQRVNYF

SEQ ID NO: 84291 - protein, 28 aa, Artificial Sequence
  Description of Artificial Sequence: Synthetic peptide
AENEIACTNPVGTEGYGVMSENLQHGDR

SEQ ID NO: 84292 - protein, 31 aa, Artificial Sequence
  Description of Artificial Sequence: Synthetic polypeptide
DEEEIRTTNPVAYECYGKISTNMESQSVNNG

SEQ ID NO: 84293 - protein, 28 aa, Artificial Sequence
  Description of Artificial Sequence: Synthetic peptide
AENEIACTNPVGTEGYGVMSENLQHGGR

SEQ ID NO: 84294 - protein, 32 aa, Artificial Sequence
  Description of Artificial Sequence: Synthetic polypeptide
DDSEIRTTNPVATECWGSVSCINEPQDRVGNG

SEQ ID NO: 84295 - protein, 35 aa, Artificial Sequence
  Description of Artificial Sequence: Synthetic polypeptide
DEEEIRTTNPVATEQYGSVSPTNNLWESELGEELS

SEQ ID NO: 84296 - protein, 34 aa, Artificial Sequence
  Description of Artificial Sequence: Synthetic polypeptide
DDSEIRTTNPVATEGYGSVSACINIPQSREGENR

SEQ ID NO: 84297 - protein, 35 aa, Artificial Sequence
  Description of Artificial Sequence: Synthetic polypeptide
DEEEIRTTNPVATEQYGSVSPTNNLSEEEIGEELD

SEQ ID NO: 84298 - protein, 31 aa, Artificial Sequence
  Description of Artificial Sequence: Synthetic polypeptide
DDNEIRTTNPVATEQWGDVSANTIQNRVEDR

SEQ ID NO: 84299 - protein, 34 aa, Artificial Sequence
  Description of Artificial Sequence: Synthetic polypeptide
DDSEIRTTNPVATEGYGSVSACINIPQSRVGENR

SEQ ID NO: 84300 - protein, 31 aa, Artificial Sequence
  Description of Artificial Sequence: Synthetic polypeptide
DDNEIRTTNPVATEQWGDVSANIEQNRVEQR

SEQ ID NO: 84301 - protein, 31 aa, Artificial Sequence
  Description of Artificial Sequence: Synthetic polypeptide
DDSEIRTTNPVATEQWGDVSANIEQNRVEQR

SEQ ID NO: 84302 - protein, 33 aa, Artificial Sequence
  Description of Artificial Sequence: Synthetic polypeptide
DEEEIRTTNPVAYECYGCTVQACGHLSQRSGNR

SEQ ID NO: 84303 - protein, 28 aa, Artificial Sequence
  Description of Artificial Sequence: Synthetic peptide
DDNEIATTNPVATEGYGDVSECIQREEL

SEQ ID NO: 84304 - protein, 30 aa, Artificial Sequence
  Description of Artificial Sequence: Synthetic polypeptide
DEEEIVTVNPVATEQYGTVCSADGPESGND

SEQ ID NO: 84305 - protein, 33 aa, Artificial Sequence
  Description of Artificial Sequence: Synthetic polypeptide
DEEEIVTTNPVATEQYGTVCSATDAPPEREGNV

SEQ ID NO: 84306 - protein, 35 aa, Artificial Sequence
  Description of Artificial Sequence: Synthetic polypeptide
DEEEIRTTNPVATEQYGSVSPTTLLHGSTPPEENQ

SEQ ID NO: 84307 - protein, 33 aa, Artificial Sequence
  Description of Artificial Sequence: Synthetic polypeptide
DEVEIRTTNPVATECWGSVSCGNEPQDREGENG

SEQ ID NO: 84308 - protein, 33 aa, Artificial Sequence
  Description of Artificial Sequence: Synthetic polypeptide
DEEEIVTTNPVATEQYGTVCSATDGPPEREGND

SEQ ID NO: 84309 - protein, 35 aa, Artificial Sequence
  Description of Artificial Sequence: Synthetic polypeptide
DEEEISTTNPVATEQYGQCVCSTMNLQNFGSENQA

SEQ ID NO: 84310 - protein, 33 aa, Artificial Sequence
  Description of Artificial Sequence: Synthetic polypeptide
DEEEIVTTNPVATEQYGTVCSATDGPPEREGNV

SEQ ID NO: 84311 - protein, 33 aa, Artificial Sequence
  Description of Artificial Sequence: Synthetic polypeptide
DEEEIVTTNPVATEQYGTVCSATDGPVEREGND

SEQ ID NO: 84312 - protein, 33 aa, Artificial Sequence
  Description of Artificial Sequence: Synthetic polypeptide
DEEEIVTTNPVATEQYGTVCSATPGGVNREGND

SEQ ID NO: 84313 - protein, 31 aa, Artificial Sequence
  Description of Artificial Sequence: Synthetic polypeptide
DDQEIASTNPVATEQYGSVSATTIEDRVGQR

SEQ ID NO: 84314 - protein, 32 aa, Artificial Sequence
  Description of Artificial Sequence: Synthetic polypeptide
DEEEIVTTNPVATEQYGTVCSTDVPVEHEGND

SEQ ID NO: 84315 - protein, 33 aa, Artificial Sequence
  Description of Artificial Sequence: Synthetic polypeptide
DEEEISTTNPVATEQYGQCVCSTEHNQHFGSNQ

SEQ ID NO: 84316 - protein, 29 aa, Artificial Sequence
  Description of Artificial Sequence: Synthetic peptide
DEEEIVTTNPVATEQYGTVPAEGPEFENK

SEQ ID NO: 84317 - protein, 34 aa, Artificial Sequence
  Description of Artificial Sequence: Synthetic polypeptide
DEEEISTTNPVATEQYGQCVCSNTNLQNFGSEAA

SEQ ID NO: 84318 - protein, 32 aa, Artificial Sequence
  Description of Artificial Sequence: Synthetic polypeptide
DEVEIRTTNPVATEQYGSVCSNNLPEVSDEDM

SEQ ID NO: 84319 - protein, 35 aa, Artificial Sequence
  Description of Artificial Sequence: Synthetic polypeptide
DEEEIRTTNPVATEQYGSVSPTTDTMQPRPAMNEM

SEQ ID NO: 84320 - protein, 30 aa, Artificial Sequence
  Description of Artificial Sequence: Synthetic polypeptide
DEEEIVTTNPVATEQYGTVPTGPVQFEEEK

SEQ ID NO: 84321 - protein, 33 aa, Artificial Sequence
  Description of Artificial Sequence: Synthetic polypeptide
DEVEIRTTNPVATECWGSVSCINHPQDREGENG

SEQ ID NO: 84322 - protein, 35 aa, Artificial Sequence
  Description of Artificial Sequence: Synthetic polypeptide
DEEEIRTTNPVATEQYGSVSPTTEPQSLMTNPERN

SEQ ID NO: 84323 - protein, 34 aa, Artificial Sequence
  Description of Artificial Sequence: Synthetic polypeptide
DEEEIRTTNPVAYEFWGSVVSTNMLQETGGNYEE

SEQ ID NO: 84324 - protein, 30 aa, Artificial Sequence
  Description of Artificial Sequence: Synthetic polypeptide
DDSEIRSTNPVSTEQYGNVSNTIQSRVGDR

SEQ ID NO: 84325 - protein, 33 aa, Artificial Sequence
  Description of Artificial Sequence: Synthetic polypeptide
DEVEIRTTNPVATECWGSVSCINEPQDREGENG

SEQ ID NO: 84326 - protein, 33 aa, Artificial Sequence
  Description of Artificial Sequence: Synthetic polypeptide
DEEEIVTTNPVATEQYGTVSSATPGPVNREGNV

SEQ ID NO: 84327 - protein, 32 aa, Artificial Sequence
  Description of Artificial Sequence: Synthetic polypeptide
DEEEISTTNPVATEQYGCVTSTEHQSFGSEQP

SEQ ID NO: 84328 - protein, 34 aa, Artificial Sequence
  Description of Artificial Sequence: Synthetic polypeptide
DEEEIRTTNPVAYEEYGSVAYINELSQNRTGNQV

SEQ ID NO: 84329 - protein, 34 aa, Artificial Sequence
  Description of Artificial Sequence: Synthetic polypeptide
DEEEIVTTNPVAYERYGSVVPSLTGNLSQAGGNS

SEQ ID NO: 84330 - protein, 34 aa, Artificial Sequence
  Description of Artificial Sequence: Synthetic polypeptide
DEEEIRTTNPVATEQYGSVSPTSDIQIEMENINM

SEQ ID NO: 84331 - protein, 35 aa, Artificial Sequence
  Description of Artificial Sequence: Synthetic polypeptide
DEEEIRTTNPVATEQYGSVSPTRNNHEEIGAENND

SEQ ID NO: 84332 - protein, 30 aa, Artificial Sequence
  Description of Artificial Sequence: Synthetic polypeptide
DDSEIATTNPVSTEQYGNVAATGIQREGQR

SEQ ID NO: 84333 - protein, 30 aa, Artificial Sequence
  Description of Artificial Sequence: Synthetic polypeptide
DEEEISTTNPVAYEQYGCVCSTEHQNFSEQ

SEQ ID NO: 84334 - protein, 36 aa, Artificial Sequence
  Description of Artificial Sequence: Synthetic polypeptide
DEEEIRTTNPVATEQYGSVSPTNSSEASQQGDNNEE

SEQ ID NO: 84335 - protein, 32 aa, Artificial Sequence
  Description of Artificial Sequence: Synthetic polypeptide
DEEEISTTNPVAYEQYGCVCSTELQNFNSNQS

SEQ ID NO: 84336 - protein, 33 aa, Artificial Sequence
  Description of Artificial Sequence: Synthetic polypeptide
DEEEISTTNPVAYEQYGCVCSTNDQNFGSENQS

SEQ ID NO: 84337 - protein, 28 aa, Artificial Sequence
  Description of Artificial Sequence: Synthetic peptide
DDSEIASTNPVSTEGYGVVASTIQRGQR

SEQ ID NO: 84338 - protein, 28 aa, Artificial Sequence
  Description of Artificial Sequence: Synthetic peptide
DDSEIASTNPVSTEGYGVVASTLQRGQI

SEQ ID NO: 84339 - protein, 33 aa, Artificial Sequence
  Description of Artificial Sequence: Synthetic polypeptide
DEEEIRTTNPVAYEQWGATISKNEGQKRDGDNR

SEQ ID NO: 84340 - protein, 33 aa, Artificial Sequence
  Description of Artificial Sequence: Synthetic polypeptide
DEDEIRTTNPVATTAYGSVSTNLQQGSTTEDEE

SEQ ID NO: 84341 - protein, 34 aa, Artificial Sequence
  Description of Artificial Sequence: Synthetic polypeptide
DEDEIRTTNPVATTAYGSVSTNLQQGSTTTNEEE

SEQ ID NO: 84342 - protein, 34 aa, Artificial Sequence
  Description of Artificial Sequence: Synthetic polypeptide
DEEEISTTNPVATEQYGSVPSCQNEHSQERDVDR

SEQ ID NO: 84343 - protein, 32 aa, Artificial Sequence
  Description of Artificial Sequence: Synthetic polypeptide
DEEEISTTNPVAYEQYGCVCSTPHQHFGSNQA

SEQ ID NO: 84344 - protein, 36 aa, Artificial Sequence
  Description of Artificial Sequence: Synthetic polypeptide
DEEEIRTTNPVATEQYGSVSPTNPQLASIQNGVILD

SEQ ID NO: 84345 - protein, 35 aa, Artificial Sequence
  Description of Artificial Sequence: Synthetic polypeptide
DEEEIRTTNPVATEQYGSVSPTPGMPQRELNVALN

SEQ ID NO: 84346 - protein, 36 aa, Artificial Sequence
  Description of Artificial Sequence: Synthetic polypeptide
DEEEIRTTNPVATEQYGSVSPTNPPLLEMQNGVFLD

SEQ ID NO: 84347 - protein, 34 aa, Artificial Sequence
  Description of Artificial Sequence: Synthetic polypeptide
DEDEIRTTNPVATTAYGSVSTNLQSGSTNQQTNT

SEQ ID NO: 84348 - protein, 34 aa, Artificial Sequence
  Description of Artificial Sequence: Synthetic polypeptide
DEEEIRTTNPVAYEQWGCSYNSRNDLDQRGHREM

SEQ ID NO: 84349 - protein, 33 aa, Artificial Sequence
  Description of Artificial Sequence: Synthetic polypeptide
DEDEIRTTNPVATTAYGSVSTNLQSGSTTEEAE

SEQ ID NO: 84350 - protein, 34 aa, Artificial Sequence
  Description of Artificial Sequence: Synthetic polypeptide
DEDEIRTTNPVATTAYGSVSTNLQSGSTTNQEDD

SEQ ID NO: 84351 - protein, 34 aa, Artificial Sequence
  Description of Artificial Sequence: Synthetic polypeptide
DEVEIRTTNPVATEQYGDVVNSDTNLIREGMGGQ

SEQ ID NO: 84352 - protein, 32 aa, Artificial Sequence
  Description of Artificial Sequence: Synthetic polypeptide
DDSEIATTNPVATEQYGSVATNPAINSRNGQR

SEQ ID NO: 84353 - protein, 33 aa, Artificial Sequence
  Description of Artificial Sequence: Synthetic polypeptide
DEEEIRTTNPVAYEPYGQSVVQNELSQRTGISE

SEQ ID NO: 84354 - protein, 32 aa, Artificial Sequence
  Description of Artificial Sequence: Synthetic polypeptide
DEEEISTTNPVAYEQYGCVCSTEHQHFGSNQF

SEQ ID NO: 84355 - protein, 31 aa, Artificial Sequence
  Description of Artificial Sequence: Synthetic polypeptide
DDSEIASTNPVATEGWGSVSCINEQDRVGNR

SEQ ID NO: 84356 - protein, 33 aa, Artificial Sequence
  Description of Artificial Sequence: Synthetic polypeptide
DEDEIRTTNPVATETYGCVATGNGDVQRGENGA

SEQ ID NO: 84357 - protein, 33 aa, Artificial Sequence
  Description of Artificial Sequence: Synthetic polypeptide
DEVEIRTTNPVATEQYGDVSGDNEGQDEGGGNG

SEQ ID NO: 84358 - protein, 33 aa, Artificial Sequence
  Description of Artificial Sequence: Synthetic polypeptide
DEEEISTTNPVATEQYGTVCSTEDHQNFGSENQ

SEQ ID NO: 84359 - protein, 33 aa, Artificial Sequence
  Description of Artificial Sequence: Synthetic polypeptide
DEDEIRTTNPVATQQYGCVPSCTNLSESTGNNP

SEQ ID NO: 84360 - protein, 35 aa, Artificial Sequence
  Description of Artificial Sequence: Synthetic polypeptide
DEEEIRTTNPVATEQYGSVSPTNVIEVERGEMPEI

SEQ ID NO: 84361 - protein, 30 aa, Artificial Sequence
  Description of Artificial Sequence: Synthetic polypeptide
DDSEIASTNPVATEQYGEASNTLQSRVGGR

SEQ ID NO: 84362 - protein, 33 aa, Artificial Sequence
  Description of Artificial Sequence: Synthetic polypeptide
DEDEIRTTNPVATQQWGCVSCTNLSENRGGNNP

SEQ ID NO: 84363 - protein, 33 aa, Artificial Sequence
  Description of Artificial Sequence: Synthetic polypeptide
DEDEIRTTNPVATQQYGCVVSCTNPSGRGGNNP

SEQ ID NO: 84364 - protein, 33 aa, Artificial Sequence
  Description of Artificial Sequence: Synthetic polypeptide
DEEEISTTNPVATEQYGVVCSTNEHQGFNSDQS

SEQ ID NO: 84365 - protein, 29 aa, Artificial Sequence
  Description of Artificial Sequence: Synthetic peptide
AENEIACTNPVAVEQYGEASENLQMGGKR

SEQ ID NO: 84366 - protein, 30 aa, Artificial Sequence
  Description of Artificial Sequence: Synthetic polypeptide
DDSEIASTNPVCTEQYGVVADTLQSRVGNR

SEQ ID NO: 84367 - protein, 30 aa, Artificial Sequence
  Description of Artificial Sequence: Synthetic polypeptide
DDSEIASTNPVATEGYGSVAANTIQRVGQR

SEQ ID NO: 84368 - protein, 35 aa, Artificial Sequence
  Description of Artificial Sequence: Synthetic polypeptide
DEEEIRTTNPVATEQYGSVSPTNVTGETRGPTPEI

SEQ ID NO: 84369 - protein, 34 aa, Artificial Sequence
  Description of Artificial Sequence: Synthetic polypeptide
DEEEISTTNPVATERYGSVVPSLTGNLSQAGGAS

SEQ ID NO: 84370 - protein, 35 aa, Artificial Sequence
  Description of Artificial Sequence: Synthetic polypeptide
DEEEIRTTNPVATEQYGSVSPTNTQMMMVSQNQLD

SEQ ID NO: 84371 - protein, 32 aa, Artificial Sequence
  Description of Artificial Sequence: Synthetic polypeptide
DEEEISTTNPVAWEQYGCVCSTEHQSFGSNQM

SEQ ID NO: 84372 - protein, 35 aa, Artificial Sequence
  Description of Artificial Sequence: Synthetic polypeptide
DEEEIRTTNPVATEQYGSVSPTNTQMMDVDQNALL

SEQ ID NO: 84373 - protein, 32 aa, Artificial Sequence
  Description of Artificial Sequence: Synthetic polypeptide
DEEEISTTNPVAYEAYGSVVSLTGNSSQAGES

SEQ ID NO: 84374 - protein, 29 aa, Artificial Sequence
  Description of Artificial Sequence: Synthetic peptide
DDSEIASTNPVSTEGYGNVAANTLQRGGR

SEQ ID NO: 84375 - protein, 28 aa, Artificial Sequence
  Description of Artificial Sequence: Synthetic peptide
DDSEIASTNPVSTEGYGNVAETLQRGGR

SEQ ID NO: 84376 - protein, 35 aa, Artificial Sequence
  Description of Artificial Sequence: Synthetic polypeptide
DEEEIRTTNPVATEQYGSVSPTNTENQLSMEVNEF

SEQ ID NO: 84377 - protein, 32 aa, Artificial Sequence
  Description of Artificial Sequence: Synthetic polypeptide
DEDEIRTTNPVATETYGCVSGENGNHGNGNGR

SEQ ID NO: 84378 - protein, 37 aa, Artificial Sequence
  Description of Artificial Sequence: Synthetic polypeptide
DEEEIRTTNPVATEQYGSVSPTNSYLGAYQQGDNNEE

SEQ ID NO: 84379 - protein, 30 aa, Artificial Sequence
  Description of Artificial Sequence: Synthetic polypeptide
DDSEIASTNPVSTEGYGNVSANTLQSRGQR

SEQ ID NO: 84380 - protein, 30 aa, Artificial Sequence
  Description of Artificial Sequence: Synthetic polypeptide
DDSEIASTNPVATEGWGSVACNEQDRVGNR

SEQ ID NO: 84381 - protein, 33 aa, Artificial Sequence
  Description of Artificial Sequence: Synthetic polypeptide
DEEEIRTTNPVAYEPYGQSVSQNELSDRTGISL

SEQ ID NO: 84382 - protein, 34 aa, Artificial Sequence
  Description of Artificial Sequence: Synthetic polypeptide
DEDEIRTTNPVATERYGKTVQSQNELSQNGENNR

SEQ ID NO: 84383 - protein, 35 aa, Artificial Sequence
  Description of Artificial Sequence: Synthetic polypeptide
DEEEIRTTNPVATEQYGSVSPTQGQGVVTPTNVRS

SEQ ID NO: 84384 - protein, 35 aa, Artificial Sequence
  Description of Artificial Sequence: Synthetic polypeptide
DEEEIRTTNPVAYEPYGISVSTVNALSQDRVTSRN

SEQ ID NO: 84385 - protein, 35 aa, Artificial Sequence
  Description of Artificial Sequence: Synthetic polypeptide
DEEEIRTTNPVAYEQWGESVTSQRNDDLQRGISKR

SEQ ID NO: 84386 - protein, 31 aa, Artificial Sequence
  Description of Artificial Sequence: Synthetic polypeptide
DEEEIVCTNPIATEQYGSVCSEGPVMFEGNR

SEQ ID NO: 84387 - protein, 32 aa, Artificial Sequence
  Description of Artificial Sequence: Synthetic polypeptide
DEEEIRTTNPVAYEQWGESYTQNDLLQEGIRR

SEQ ID NO: 84388 - protein, 34 aa, Artificial Sequence
  Description of Artificial Sequence: Synthetic polypeptide
DEEEIRTTNPVAYEQWGETVRMTNDHLQRNGDRR

SEQ ID NO: 84389 - protein, 31 aa, Artificial Sequence
  Description of Artificial Sequence: Synthetic polypeptide
DEEEIVCTNPVATEQYGTVCSTGPVMFEGND

SEQ ID NO: 84390 - protein, 31 aa, Artificial Sequence
  Description of Artificial Sequence: Synthetic polypeptide
DEEEIVSTNPVCTEQYGVVSADNPVQFEGNQ

SEQ ID NO: 84391 - protein, 29 aa, Artificial Sequence
  Description of Artificial Sequence: Synthetic peptide
AENEIACTNPVAYEQYGEASENLQDMGGR

SEQ ID NO: 84392 - protein, 33 aa, Artificial Sequence
  Description of Artificial Sequence: Synthetic polypeptide
DEVEIRTTNPVATEDWGSVSCINEPQDREGENG

SEQ ID NO: 84393 - protein, 29 aa, Artificial Sequence
  Description of Artificial Sequence: Synthetic peptide
DEEEIVTTNPVATEQYGEAPTGPQFEEEK

SEQ ID NO: 84394 - protein, 29 aa, Artificial Sequence
  Description of Artificial Sequence: Synthetic peptide
DEEEIVTTNPVATEQYGEAPTGPQHEEEK

SEQ ID NO: 84395 - protein, 29 aa, Artificial Sequence
  Description of Artificial Sequence: Synthetic peptide
DEEEIVTTNPVATEQYGEAPTVPQHEEEK

SEQ ID NO: 84396 - protein, 28 aa, Artificial Sequence
  Description of Artificial Sequence: Synthetic peptide
AENEIACTNPVAYEQYGEASENLQGGGL

SEQ ID NO: 84397 - protein, 30 aa, Artificial Sequence
  Description of Artificial Sequence: Synthetic polypeptide
AENEIACTNPVAYEQYGEASENLQQREGGR

SEQ ID NO: 84398 - protein, 29 aa, Artificial Sequence
  Description of Artificial Sequence: Synthetic peptide
DEEEIVTTNPVATEQYGEVPAEGPEFENK

SEQ ID NO: 84399 - protein, 31 aa, Artificial Sequence
  Description of Artificial Sequence: Synthetic polypeptide
DDQEVASTNPVATEGYGSVSATDLQDRVGQR

SEQ ID NO: 84400 - protein, 32 aa, Artificial Sequence
  Description of Artificial Sequence: Synthetic polypeptide
DDQEIRTTNPVATEQYGSVSNTENGEDGTQES

SEQ ID NO: 84401 - protein, 34 aa, Artificial Sequence
  Description of Artificial Sequence: Synthetic polypeptide
DEEEIRTTNPVAYEPYGINVSTVNAQSDERVTNR

SEQ ID NO: 84402 - protein, 34 aa, Artificial Sequence
  Description of Artificial Sequence: Synthetic polypeptide
DEEEIVTTNPVATEQYGSVISNNGLFQEGGDEGF

SEQ ID NO: 84403 - protein, 29 aa, Artificial Sequence
  Description of Artificial Sequence: Synthetic peptide
AENEIACTNPVAYEQYGEASENLQTGGAR

SEQ ID NO: 84404 - protein, 34 aa, Artificial Sequence
  Description of Artificial Sequence: Synthetic polypeptide
DEEEIRTTNPVAYEPYGISVSTVPAQSQERVTNR

SEQ ID NO: 84405 - protein, 34 aa, Artificial Sequence
  Description of Artificial Sequence: Synthetic polypeptide
DEEEIRTTNPVAYEPYGISVSVIGNPQDRVTNNR

SEQ ID NO: 84406 - protein, 34 aa, Artificial Sequence
  Description of Artificial Sequence: Synthetic polypeptide
DEEEITTTNPVAYEQYGQSVNETNDLLQRGIEAQ

SEQ ID NO: 84407 - protein, 34 aa, Artificial Sequence
  Description of Artificial Sequence: Synthetic polypeptide
DEEEIRTTNPVATEQYGSVSPTPVGPNMHNEMNV

SEQ ID NO: 84408 - protein, 33 aa, Artificial Sequence
  Description of Artificial Sequence: Synthetic polypeptide
DEEEIRTTNPVAYEQWGCSYQRNDLDQQRGHRT

SEQ ID NO: 84409 - protein, 33 aa, Artificial Sequence
  Description of Artificial Sequence: Synthetic polypeptide
DEEEISTTNPVAYERYGSVVSLTGPLSQAGGNS

SEQ ID NO: 84410 - protein, 33 aa, Artificial Sequence
  Description of Artificial Sequence: Synthetic polypeptide
DEVEIRTTNPVATEQYGAVSTGNGAGNTAGDRS

SEQ ID NO: 84411 - protein, 35 aa, Artificial Sequence
  Description of Artificial Sequence: Synthetic polypeptide
DEEEIRTTNPVATEQYGSVSPTNPLPPTTGEQETL

SEQ ID NO: 84412 - protein, 30 aa, Artificial Sequence
  Description of Artificial Sequence: Synthetic polypeptide
DDSEIASTNPIATEGYGSVAANTIQRVGNR

SEQ ID NO: 84413 - protein, 28 aa, Artificial Sequence
  Description of Artificial Sequence: Synthetic peptide
DDSEIAPTNPCSSEQYGIVANNLQRGTR

SEQ ID NO: 84414 - protein, 34 aa, Artificial Sequence
  Description of Artificial Sequence: Synthetic polypeptide
DEDEIRTTNPVATEQYGVVTVSTTNLQAGSTDSE

SEQ ID NO: 84415 - protein, 33 aa, Artificial Sequence
  Description of Artificial Sequence: Synthetic polypeptide
DEEEIRTTNPVAYEPYGQSVSEGNEGSQPGISR

SEQ ID NO: 84416 - protein, 34 aa, Artificial Sequence
  Description of Artificial Sequence: Synthetic polypeptide
DEEEIRTTNPVATEQYGSVSPTPNMPVALEDALV

SEQ ID NO: 84417 - protein, 33 aa, Artificial Sequence
  Description of Artificial Sequence: Synthetic polypeptide
DEEEIRTTNPVAYEQWGCTVSRNDQDQRGGIRR

SEQ ID NO: 84418 - protein, 29 aa, Artificial Sequence
  Description of Artificial Sequence: Synthetic peptide
DDNEIATTNPVATECYGNVAECLQRVEER

SEQ ID NO: 84419 - protein, 30 aa, Artificial Sequence
  Description of Artificial Sequence: Synthetic polypeptide
DDSEIACTNPVSTEGYGNVSANTLQSRGGR

SEQ ID NO: 84420 - protein, 35 aa, Artificial Sequence
  Description of Artificial Sequence: Synthetic polypeptide
DEEEIRTTNPVAYEPYGQSVCSQNELSQRTGISRN

SEQ ID NO: 84421 - protein, 32 aa, Artificial Sequence
  Description of Artificial Sequence: Synthetic polypeptide
DEEEIRTTNPVAYEPYGKISENEESQNRVGNF

SEQ ID NO: 84422 - protein, 32 aa, Artificial Sequence
  Description of Artificial Sequence: Synthetic polypeptide
DEVEIRTTNPVATEQWGAVSTNGAGNDAGDRS

SEQ ID NO: 84423 - protein, 34 aa, Artificial Sequence
  Description of Artificial Sequence: Synthetic polypeptide
DEEEIRTTNPVATEQYGSVSPTPNWIQQTISVEE

SEQ ID NO: 84424 - protein, 34 aa, Artificial Sequence
  Description of Artificial Sequence: Synthetic polypeptide
DEEEIRTTNPVAYEQWGESTSQRNDDLQKRGITR

SEQ ID NO: 84425 - protein, 34 aa, Artificial Sequence
  Description of Artificial Sequence: Synthetic polypeptide
DEVEIRTTNPVATEPYGTVSTGNGLGGTAGENSR

SEQ ID NO: 84426 - protein, 35 aa, Artificial Sequence
  Description of Artificial Sequence: Synthetic polypeptide
DEEEIRTTNPVATEQYGSVSPTPTLSLTEGENPAA

SEQ ID NO: 84427 - protein, 35 aa, Artificial Sequence
  Description of Artificial Sequence: Synthetic polypeptide
DEEEIRTTNPVATEQYGSVSPTPTLSPVEGENPLA

SEQ ID NO: 84428 - protein, 34 aa, Artificial Sequence
  Description of Artificial Sequence: Synthetic polypeptide
DEEEIRTTNPVATEQYGSVSPTNPLINAVTQLHE

SEQ ID NO: 84429 - protein, 33 aa, Artificial Sequence
  Description of Artificial Sequence: Synthetic polypeptide
DDSEIATTNPVATEQYGSVSATNPAINSRNGQR

SEQ ID NO: 84430 - protein, 34 aa, Artificial Sequence
  Description of Artificial Sequence: Synthetic polypeptide
DEEEIRTTNPVATEQYGSVSPTPNMPVRLVSALE

SEQ ID NO: 84431 - protein, 31 aa, Artificial Sequence
  Description of Artificial Sequence: Synthetic polypeptide
DDSEIRTTNPVATEQWGDVSANIEQSRVEQR

SEQ ID NO: 84432 - protein, 28 aa, Artificial Sequence
  Description of Artificial Sequence: Synthetic peptide
DDNEIATTNPVATECYGDVAECLQREQL

SEQ ID NO: 84433 - protein, 31 aa, Artificial Sequence
  Description of Artificial Sequence: Synthetic polypeptide
DEVEIKTTNPVATDQYGVVSTDGQGEGENNE

SEQ ID NO: 84434 - protein, 34 aa, Artificial Sequence
  Description of Artificial Sequence: Synthetic polypeptide
DEEEIRTTNPVATEQYGSVSPTVQGIQRVTEEDM

SEQ ID NO: 84435 - protein, 34 aa, Artificial Sequence
  Description of Artificial Sequence: Synthetic polypeptide
DEVEIRTTNPVATEQYGSVSGTNNNMNDGGGNDG

SEQ ID NO: 84436 - protein, 33 aa, Artificial Sequence
  Description of Artificial Sequence: Synthetic polypeptide
DEVEIATTNPVAYERWGSVSTNLNQGDVGGNNR

SEQ ID NO: 84437 - protein, 32 aa, Artificial Sequence
  Description of Artificial Sequence: Synthetic polypeptide
DEEEISTTNPVATEQYGCVSTEHQNFISENQS

SEQ ID NO: 84438 - protein, 33 aa, Artificial Sequence
  Description of Artificial Sequence: Synthetic polypeptide
DEDEIRTTNPVATTQYGVVSTTNLEAGNTEQGS

SEQ ID NO: 84439 - protein, 32 aa, Artificial Sequence
  Description of Artificial Sequence: Synthetic polypeptide
DEVEIATTNPVAYERWGSVSTNLNQGADNDSR

SEQ ID NO: 84440 - protein, 32 aa, Artificial Sequence
  Description of Artificial Sequence: Synthetic polypeptide
DEVEIATTNPVAYERWGSVSTNLNQEGGPNMG

SEQ ID NO: 84441 - protein, 32 aa, Artificial Sequence
  Description of Artificial Sequence: Synthetic polypeptide
DEVEIATTNPVAYERWGSVSTNLGGNAGENAR

SEQ ID NO: 84442 - protein, 31 aa, Artificial Sequence
  Description of Artificial Sequence: Synthetic polypeptide
DEVEIATTNPVAYERWGSVATNLQEGGMNGE

SEQ ID NO: 84443 - protein, 35 aa, Artificial Sequence
  Description of Artificial Sequence: Synthetic polypeptide
DEEEIRTTNPVATEQYGSVSPTVTELFPTGENQTP

SEQ ID NO: 84444 - protein, 35 aa, Artificial Sequence
  Description of Artificial Sequence: Synthetic polypeptide
DEDEIRTTNPVATEQYGVVSTVSTTNLQAGTTTSD

SEQ ID NO: 84445 - protein, 32 aa, Artificial Sequence
  Description of Artificial Sequence: Synthetic polypeptide
DEDEIRTTNPVATTQYGVVSTTNNEEGTNEQL

SEQ ID NO: 84446 - protein, 33 aa, Artificial Sequence
  Description of Artificial Sequence: Synthetic polypeptide
DEDEIRTTNPVATTQYGVVSTTNNLEEGTNEQN

SEQ ID NO: 84447 - protein, 34 aa, Artificial Sequence
  Description of Artificial Sequence: Synthetic polypeptide
DEEEIRTTNPVAYEAYGQSVSCINVEQRTGGTRQ

SEQ ID NO: 84448 - protein, 33 aa, Artificial Sequence
  Description of Artificial Sequence: Synthetic polypeptide
DEDEIRTTNPVATTQYGVVSTTNNLEQGTTQNQ

SEQ ID NO: 84449 - protein, 32 aa, Artificial Sequence
  Description of Artificial Sequence: Synthetic polypeptide
DEDEIRTTNPVATTQYGVVSTTNVEEGTNTNN

SEQ ID NO: 84450 - protein, 33 aa, Artificial Sequence
  Description of Artificial Sequence: Synthetic polypeptide
DEENICTTNPVATEAYGVVSTTTNLQQGSNSED

SEQ ID NO: 84451 - protein, 32 aa, Artificial Sequence
  Description of Artificial Sequence: Synthetic polypeptide
DEVEIRTTNPVATEQYGSVSMNDQIMVLEDFI

SEQ ID NO: 84452 - protein, 34 aa, Artificial Sequence
  Description of Artificial Sequence: Synthetic polypeptide
DEEEIRTTNPVAYEAYGQSTVHCTNELSQAFGSR

SEQ ID NO: 84453 - protein, 33 aa, Artificial Sequence
  Description of Artificial Sequence: Synthetic polypeptide
DEEEISTTNPVATEQYGCVSNTPHQNFGSNNQL

SEQ ID NO: 84454 - protein, 36 aa, Artificial Sequence
  Description of Artificial Sequence: Synthetic polypeptide
DEDEIRTTNPVATEQYGVVSTVSTTGNLQAGNTESG

SEQ ID NO: 84455 - protein, 33 aa, Artificial Sequence
  Description of Artificial Sequence: Synthetic polypeptide
DEEEIRTTNPVAYEQWGSVCSTLDHQEQNMISR

SEQ ID NO: 84456 - protein, 35 aa, Artificial Sequence
  Description of Artificial Sequence: Synthetic polypeptide
DEDEIRTTNPVATEQYGVVSTVSTNNLNQAGTESG

SEQ ID NO: 84457 - protein, 34 aa, Artificial Sequence
  Description of Artificial Sequence: Synthetic polypeptide
DEEEIRTTNPVATEQYGSVSPTVPMDISGENGLQ

SEQ ID NO: 84458 - protein, 33 aa, Artificial Sequence
  Description of Artificial Sequence: Synthetic polypeptide
DEEEIRTTNPVATEQYGSVSPTVPLEMLDVWDG

SEQ ID NO: 84459 - protein, 34 aa, Artificial Sequence
  Description of Artificial Sequence: Synthetic polypeptide
DEEEIRTTNPVAYEQWGSTVYSDIWNDGQREQNR

SEQ ID NO: 84460 - protein, 31 aa, Artificial Sequence
  Description of Artificial Sequence: Synthetic polypeptide
DEEEIRTTNPVAYEQWGSVAWIEGLQVDDSR

SEQ ID NO: 84461 - protein, 33 aa, Artificial Sequence
  Description of Artificial Sequence: Synthetic polypeptide
DEENICTTNPVATEAYGQVSTTQNLQQGTNEEQ

SEQ ID NO: 84462 - protein, 32 aa, Artificial Sequence
  Description of Artificial Sequence: Synthetic polypeptide
DEEEIRTTNPVAYEQWGSVAWTEDQVDDGSGR

SEQ ID NO: 84463 - protein, 33 aa, Artificial Sequence
  Description of Artificial Sequence: Synthetic polypeptide
DEENICTTNPVATEAYGQVSTTTNLQQGSNEEQ

SEQ ID NO: 84464 - protein, 33 aa, Artificial Sequence
  Description of Artificial Sequence: Synthetic polypeptide
DEENICTTNPVATEAYGSVNTTNTNLQPGTNTM

SEQ ID NO: 84465 - protein, 33 aa, Artificial Sequence
  Description of Artificial Sequence: Synthetic polypeptide
DEEEIRTTNPVAYEQWGSVAWTELDQAVGDGSR

SEQ ID NO: 84466 - protein, 32 aa, Artificial Sequence
  Description of Artificial Sequence: Synthetic polypeptide
DEDEIRTTNPVATTQYGVVSTNNEQGGTEAGQ

SEQ ID NO: 84467 - protein, 32 aa, Artificial Sequence
  Description of Artificial Sequence: Synthetic polypeptide
DEEEIRTTNPVAYEQWGSVAWTELNQVQDSGR

SEQ ID NO: 84468 - protein, 33 aa, Artificial Sequence
  Description of Artificial Sequence: Synthetic polypeptide
DEENICTTNPVATEAYGTVSTNTNLQQGSNIED

SEQ ID NO: 84469 - protein, 31 aa, Artificial Sequence
  Description of Artificial Sequence: Synthetic polypeptide
DEVEIATTNPVAYERWGTVSTNLQGDLGNGS

SEQ ID NO: 84470 - protein, 33 aa, Artificial Sequence
  Description of Artificial Sequence: Synthetic polypeptide
DEDEIRTTNPVATTQYGVVSTNNNLEQGTNQEQ

SEQ ID NO: 84471 - protein, 33 aa, Artificial Sequence
  Description of Artificial Sequence: Synthetic polypeptide
DEEEIRTTNPVAYEQWGSVCNTFNREDQGNTDR

SEQ ID NO: 84472 - protein, 32 aa, Artificial Sequence
  Description of Artificial Sequence: Synthetic polypeptide
DEEEISTTNPVATEQYGCVSTELQENFFSEQA

SEQ ID NO: 84473 - protein, 34 aa, Artificial Sequence
  Description of Artificial Sequence: Synthetic polypeptide
DEVEIRTTNPVATEQYGSVSGTNENMNDGEGENT

SEQ ID NO: 84474 - protein, 32 aa, Artificial Sequence
  Description of Artificial Sequence: Synthetic polypeptide
DEVEIATTNPVAYERWGSVSTNLQQEGGNMGA

SEQ ID NO: 84475 - protein, 34 aa, Artificial Sequence
  Description of Artificial Sequence: Synthetic polypeptide
DEVEIRTTNPVATEQYGSVSGTNENMNEGGENGF

SEQ ID NO: 84476 - protein, 33 aa, Artificial Sequence
  Description of Artificial Sequence: Synthetic polypeptide
DEENICTTNPVATEAYGTVSTTTNLQQGSNEEQ

SEQ ID NO: 84477 - protein, 32 aa, Artificial Sequence
  Description of Artificial Sequence: Synthetic polypeptide
DEEEIRTTNPVAYEQWGSVCQTFEDGHRGGTR

SEQ ID NO: 84478 - protein, 32 aa, Artificial Sequence
  Description of Artificial Sequence: Synthetic polypeptide
DEVEIATTNPVAYERWGSVSTNLQGDVGGTER

SEQ ID NO: 84479 - protein, 33 aa, Artificial Sequence
  Description of Artificial Sequence: Synthetic polypeptide
DEVEIATTNPVAYERWGSVSTNLQGDVGGNQRS

SEQ ID NO: 84480 - protein, 33 aa, Artificial Sequence
  Description of Artificial Sequence: Synthetic polypeptide
DEEEISTTNPVATEQYGCVSTELNQNFNSENQS

SEQ ID NO: 84481 - protein, 36 aa, Artificial Sequence
  Description of Artificial Sequence: Synthetic polypeptide
DEDEIRTTNPVATEQYGVVSTVSTGNNLQAGNTETG

SEQ ID NO: 84482 - protein, 33 aa, Artificial Sequence
  Description of Artificial Sequence: Synthetic polypeptide
DEVEIRTTNPVATEQYGSVSMNDQQMVGLEDDI

SEQ ID NO: 84483 - protein, 33 aa, Artificial Sequence
  Description of Artificial Sequence: Synthetic polypeptide
DEEEISTTNPVATEQYGCVSNTNHQENFGSEQF

SEQ ID NO: 84484 - protein, 32 aa, Artificial Sequence
  Description of Artificial Sequence: Synthetic polypeptide
DEDEIRTTNPVAYEAWGTVSTNLQGEAGNEGF

SEQ ID NO: 84485 - protein, 33 aa, Artificial Sequence
  Description of Artificial Sequence: Synthetic polypeptide
DEVEIATTNPVAYEQYGTVSTNLNQGEGGGNGY

SEQ ID NO: 84486 - protein, 36 aa, Artificial Sequence
  Description of Artificial Sequence: Synthetic polypeptide
DEEEIRTTNPVATEQYGSVSPTYSPQQVARGVTVRD

SEQ ID NO: 84487 - protein, 34 aa, Artificial Sequence
  Description of Artificial Sequence: Synthetic polypeptide
DEVEIRTTNPVATEQYGSVSPLNSQMDSIGLNMN

SEQ ID NO: 84488 - protein, 35 aa, Artificial Sequence
  Description of Artificial Sequence: Synthetic polypeptide
DEEEIRTTNPVAYEAWGSVVSTTNMLGRTGGNYRE

SEQ ID NO: 84489 - protein, 32 aa, Artificial Sequence
  Description of Artificial Sequence: Synthetic polypeptide
DEEEISTTNPVATEQYGCVCSWNHQNSGSDQP

SEQ ID NO: 84490 - protein, 32 aa, Artificial Sequence
  Description of Artificial Sequence: Synthetic polypeptide
DEEEISTTNPVATEQYGCVCSWNHQFFNSNDY

SEQ ID NO: 84491 - protein, 33 aa, Artificial Sequence
  Description of Artificial Sequence: Synthetic polypeptide
DEVEIATTNPVAYEQYGTVSSTNTGLQNGEDNS

SEQ ID NO: 84492 - protein, 32 aa, Artificial Sequence
  Description of Artificial Sequence: Synthetic polypeptide
DEVEIATTNPVAYEQYGTVATTNLDQGDINRE

SEQ ID NO: 84493 - protein, 33 aa, Artificial Sequence
  Description of Artificial Sequence: Synthetic polypeptide
DEEEISTTNPVATEQYGCVCSWNHNQNFGSNDG

SEQ ID NO: 84494 - protein, 35 aa, Artificial Sequence
  Description of Artificial Sequence: Synthetic polypeptide
DEEEIRTTNPVAYEAWGSVVSTNMLTYRTGGNYRE

SEQ ID NO: 84495 - protein, 34 aa, Artificial Sequence
  Description of Artificial Sequence: Synthetic polypeptide
DEEEIRTTNPVAYEAWGSVVSTHMLQSTGGNYRE

SEQ ID NO: 84496 - protein, 34 aa, Artificial Sequence
  Description of Artificial Sequence: Synthetic polypeptide
DEEEIRTTNPVAYEAWGSVVSTGMMQRTGGNYRE

SEQ ID NO: 84497 - protein, 36 aa, Artificial Sequence
  Description of Artificial Sequence: Synthetic polypeptide
DEEEIRTTNPVAYEAWGSVVSCTNPLGQRTGGNYRQ

SEQ ID NO: 84498 - protein, 35 aa, Artificial Sequence
  Description of Artificial Sequence: Synthetic polypeptide
DEEEIRTTNPVAYEAWGSVVPSTNPLQSTGGNYRQ

SEQ ID NO: 84499 - protein, 33 aa, Artificial Sequence
  Description of Artificial Sequence: Synthetic polypeptide
DEEEISTTNPVATEQYGCVCSWGNLQNFNSNQQ

SEQ ID NO: 84500 - protein, 33 aa, Artificial Sequence
  Description of Artificial Sequence: Synthetic polypeptide
DEEEISTTNPVATEQYGCVCSWGELQNFGSNTD

SEQ ID NO: 84501 - protein, 28 aa, Artificial Sequence
  Description of Artificial Sequence: Synthetic peptide
AENEIACTNPVATEQYGVAAETLQHGDR

SEQ ID NO: 84502 - protein, 33 aa, Artificial Sequence
  Description of Artificial Sequence: Synthetic polypeptide
DEEEIRTTNPVATEQYGSVSPVENIGVQPQTIE

SEQ ID NO: 84503 - protein, 34 aa, Artificial Sequence
  Description of Artificial Sequence: Synthetic polypeptide
DEEEIRTTNPVAYEAWGSVVMTNMLQATGGNYRE

SEQ ID NO: 84504 - protein, 30 aa, Artificial Sequence
  Description of Artificial Sequence: Synthetic polypeptide
AENEIACTNPVATEQYGTVSEDNLQFEGGD

SEQ ID NO: 84505 - protein, 36 aa, Artificial Sequence
  Description of Artificial Sequence: Synthetic polypeptide
DEEEIRTTNPVATEQYGSVSPTYNMMHQESGEEENM

SEQ ID NO: 84506 - protein, 32 aa, Artificial Sequence
  Description of Artificial Sequence: Synthetic polypeptide
DDETIRTTNPVATEQYGAVVITNGQRGQEEGT

SEQ ID NO: 84507 - protein, 33 aa, Artificial Sequence
  Description of Artificial Sequence: Synthetic polypeptide
DDETIRTTNPVATEQYGSVSTEGGEDGGQGGNT

SEQ ID NO: 84508 - protein, 30 aa, Artificial Sequence
  Description of Artificial Sequence: Synthetic polypeptide
AENEIASTNPVATEGYGEASENLQSRVGGR

SEQ ID NO: 84509 - protein, 30 aa, Artificial Sequence
  Description of Artificial Sequence: Synthetic polypeptide
DEVEIATTNPVAYEQYGTVVTNPGLGENNT

SEQ ID NO: 84510 - protein, 31 aa, Artificial Sequence
  Description of Artificial Sequence: Synthetic polypeptide
DEVEIATTNPVAYEQYGTVVTNPGLGEHNRD

SEQ ID NO: 84511 - protein, 30 aa, Artificial Sequence
  Description of Artificial Sequence: Synthetic polypeptide
DEVEIATTNPVAYEQYGTVVTNPGLGEDHR

SEQ ID NO: 84512 - protein, 30 aa, Artificial Sequence
  Description of Artificial Sequence: Synthetic polypeptide
DEVEIATTNPVAYEQYGTVVTNPGDLGENS

SEQ ID NO: 84513 - protein, 30 aa, Artificial Sequence
  Description of Artificial Sequence: Synthetic polypeptide
DEVEIATTNPVAYEQYGTVVTNDGLGENEE

SEQ ID NO: 84514 - protein, 32 aa, Artificial Sequence
  Description of Artificial Sequence: Synthetic polypeptide
DEVEIATTNPVAYEQYGTVVSGDNMGQNGDNR

SEQ ID NO: 84515 - protein, 33 aa, Artificial Sequence
  Description of Artificial Sequence: Synthetic polypeptide
DEVEIATTNPVAYEQYGTVSWTELDNRNGMNDR

SEQ ID NO: 84516 - protein, 33 aa, Artificial Sequence
  Description of Artificial Sequence: Synthetic polypeptide
DEVEIATTNPVAYEQYGTVSWTELDNRNGDNRR

SEQ ID NO: 84517 - protein, 35 aa, Artificial Sequence
  Description of Artificial Sequence: Synthetic polypeptide
DEEEIRTTNPVATEQYGSVSPTWPNMPVALVDANY

SEQ ID NO: 84518 - protein, 28 aa, Artificial Sequence
  Description of Artificial Sequence: Synthetic peptide
AENEIAPTNPCASEQYGEASENLQSGTR

SEQ ID NO: 84519 - protein, 33 aa, Artificial Sequence
  Description of Artificial Sequence: Synthetic polypeptide
DEEEIRTTNPVAYEQWGSTVYSDDGDGQRSQNR

SEQ ID NO: 84520 - protein, 32 aa, Artificial Sequence
  Description of Artificial Sequence: Synthetic polypeptide
DEEEISTTNPVATEQYGCVSNTEHAFFGSNQP

SEQ ID NO: 84521 - protein, 34 aa, Artificial Sequence
  Description of Artificial Sequence: Synthetic polypeptide
DEVEIRTTNPVATEQYGSVSNTDNDNNEEGEGNQ

SEQ ID NO: 84522 - protein, 32 aa, Artificial Sequence
  Description of Artificial Sequence: Synthetic polypeptide
DDETIRTTNPVATEQYGSVSTGGQGGGQGDET

SEQ ID NO: 84523 - protein, 32 aa, Artificial Sequence
  Description of Artificial Sequence: Synthetic polypeptide
DEEEISTTNPVATEQYGCVCVTNHQNFGSEQS

SEQ ID NO: 84524 - protein, 32 aa, Artificial Sequence
  Description of Artificial Sequence: Synthetic polypeptide
DEEEISTTNPVATEQYGCVCSYELQGFGSDQG

SEQ ID NO: 84525 - protein, 32 aa, Artificial Sequence
  Description of Artificial Sequence: Synthetic polypeptide
DEVEIATTNPVAYEQYGTVSTNLQGEHGGGGA

SEQ ID NO: 84526 - protein, 35 aa, Artificial Sequence
  Description of Artificial Sequence: Synthetic polypeptide
DEEEIRTTNPVATEQYGSVSPTYNLGQSAEEEIEI

SEQ ID NO: 84527 - protein, 32 aa, Artificial Sequence
  Description of Artificial Sequence: Synthetic polypeptide
DEDEIRTTNPVAYEAWGSVSTGNLAGEHGNTD

SEQ ID NO: 84528 - protein, 32 aa, Artificial Sequence
  Description of Artificial Sequence: Synthetic polypeptide
DEEEIRTTNPVAYEAYGEVPSYTAGLGVVTNR

SEQ ID NO: 84529 - protein, 34 aa, Artificial Sequence
  Description of Artificial Sequence: Synthetic polypeptide
DEEEIRTTNPVAYEAYGETVSTPSLSGRTGNYRI

SEQ ID NO: 84530 - protein, 32 aa, Artificial Sequence
  Description of Artificial Sequence: Synthetic polypeptide
DEEEISTTNPVATEQYGCVCSWNLEHFGSEQA

SEQ ID NO: 84531 - protein, 32 aa, Artificial Sequence
  Description of Artificial Sequence: Synthetic polypeptide
DDETIRTTNPVATEQYGSVVTSTGGEGGGGNT

SEQ ID NO: 84532 - protein, 29 aa, Artificial Sequence
  Description of Artificial Sequence: Synthetic peptide
AENEIACTNPVATEQYGTISENLQQNGGH

SEQ ID NO: 84533 - protein, 28 aa, Artificial Sequence
  Description of Artificial Sequence: Synthetic peptide
DEVEICCTNPCATEQYGDVATDPNPGNY

SEQ ID NO: 84534 - protein, 34 aa, Artificial Sequence
  Description of Artificial Sequence: Synthetic polypeptide
DEEEIRTTNPVAYEAYGSTVSTPSLSDRTSNERT

SEQ ID NO: 84535 - protein, 34 aa, Artificial Sequence
  Description of Artificial Sequence: Synthetic polypeptide
DEEEVRTTNPVATEQYGSVSSTTAGPNMRNGMNV

SEQ ID NO: 84536 - protein, 30 aa, Artificial Sequence
  Description of Artificial Sequence: Synthetic polypeptide
AENEIACTNPVSTEQYGEASEENLQQRGNH

SEQ ID NO: 84537 - protein, 35 aa, Artificial Sequence
  Description of Artificial Sequence: Synthetic polypeptide
DEDEIRTTNPVATTQYGSVSTTNQQLQQGTNNNDG

SEQ ID NO: 84538 - protein, 28 aa, Artificial Sequence
  Description of Artificial Sequence: Synthetic peptide
DDNEIACTNPVATEGYGEASETIQRGGR

SEQ ID NO: 84539 - protein, 35 aa, Artificial Sequence
  Description of Artificial Sequence: Synthetic polypeptide
DEEEVRTTNPVATEQYGSVSTTPAGPQMRNGMNPV

SEQ ID NO: 84540 - protein, 35 aa, Artificial Sequence
  Description of Artificial Sequence: Synthetic polypeptide
DEDEIRTTNPVATTQYGSVSTTNQQLQQGTNVNTD

SEQ ID NO: 84541 - protein, 34 aa, Artificial Sequence
  Description of Artificial Sequence: Synthetic polypeptide
DEEEIRTTNPVATEQYGSVSPTNNLEEEAPEELD

SEQ ID NO: 84542 - protein, 28 aa, Artificial Sequence
  Description of Artificial Sequence: Synthetic peptide
AENEIACTNPVSTEQYGEASENLQRTGK

SEQ ID NO: 84543 - protein, 32 aa, Artificial Sequence
  Description of Artificial Sequence: Synthetic polypeptide
DEEGIRTTNPVATEQYGCVCSNMDFNQRIDRS

SEQ ID NO: 84544 - protein, 32 aa, Artificial Sequence
  Description of Artificial Sequence: Synthetic polypeptide
DEEGIRTTNPVATEQYGSVSTGGGDNQGQEEG

SEQ ID NO: 84545 - protein, 35 aa, Artificial Sequence
  Description of Artificial Sequence: Synthetic polypeptide
DEEEIRTTNPVATEQYGSVSPTTPAGNMRNGMNPV

SEQ ID NO: 84546 - protein, 33 aa, Artificial Sequence
  Description of Artificial Sequence: Synthetic polypeptide
DDMEIRTTNPVATEQYGSVCSTNDHQSFGSDQS

SEQ ID NO: 84547 - protein, 34 aa, Artificial Sequence
  Description of Artificial Sequence: Synthetic polypeptide
DEEEIRTTNPVATEQYGSVSPTNNLECELEAELD

SEQ ID NO: 84548 - protein, 35 aa, Artificial Sequence
  Description of Artificial Sequence: Synthetic polypeptide
DEVEIRTTNPVATEQYGSVGSNTQNLIFNGGNEGN

SEQ ID NO: 84549 - protein, 32 aa, Artificial Sequence
  Description of Artificial Sequence: Synthetic polypeptide
DDMEIRTTNPVATEQYGCVCSTNDHQESGSDQ

SEQ ID NO: 84550 - protein, 33 aa, Artificial Sequence
  Description of Artificial Sequence: Synthetic polypeptide
DEVEICTTNPVATENYGSVSTGNGNQQMGDNES

SEQ ID NO: 84551 - protein, 34 aa, Artificial Sequence
  Description of Artificial Sequence: Synthetic polypeptide
DEEEIRTTNPVATEQYGSVSPTTQNHEELGAEED

SEQ ID NO: 84552 - protein, 32 aa, Artificial Sequence
  Description of Artificial Sequence: Synthetic polypeptide
DEVEICTTNPVATEHYGSVSTGNGQDMGGSEV

SEQ ID NO: 84553 - protein, 34 aa, Artificial Sequence
  Description of Artificial Sequence: Synthetic polypeptide
DEEEIRTTNPVATEQYGSVSPTTTAQQPPQGEFL

SEQ ID NO: 84554 - protein, 35 aa, Artificial Sequence
  Description of Artificial Sequence: Synthetic polypeptide
DEEEIRTTNPVATEQYGSVSPTNNHQAMEIGAEEM

SEQ ID NO: 84555 - protein, 31 aa, Artificial Sequence
  Description of Artificial Sequence: Synthetic polypeptide
AENEIACTNPVSTEQYGEASMENLQQRNGNR

SEQ ID NO: 84556 - protein, 35 aa, Artificial Sequence
  Description of Artificial Sequence: Synthetic polypeptide
DEEEIRTTNPVATEQYGSVSPTNNLESELGEEELD

SEQ ID NO: 84557 - protein, 33 aa, Artificial Sequence
  Description of Artificial Sequence: Synthetic polypeptide
DEEHIRATNPVATDQYGFVSMTNLFQTGVENIG

SEQ ID NO: 84558 - protein, 30 aa, Artificial Sequence
  Description of Artificial Sequence: Synthetic polypeptide
DDNEIACTNPVSTEGYGNVSANTLQSRGGR

SEQ ID NO: 84559 - protein, 30 aa, Artificial Sequence
  Description of Artificial Sequence: Synthetic polypeptide
AENEIACTNPVSTEGYGNVSANTLQSRGGR

SEQ ID NO: 84560 - protein, 33 aa, Artificial Sequence
  Description of Artificial Sequence: Synthetic polypeptide
DEEETRTTNPVAYEQYGQSVGETNDLLGRGIEQ

SEQ ID NO: 84561 - protein, 32 aa, Artificial Sequence
  Description of Artificial Sequence: Synthetic polypeptide
DEEEIRTTNPVAYEAYGVSVSTGNHGEVNNQG

SEQ ID NO: 84562 - protein, 34 aa, Artificial Sequence
  Description of Artificial Sequence: Synthetic polypeptide
DEVEIRTTNPVATEQYGSVGNTNNGQGEGNVNEG

SEQ ID NO: 84563 - protein, 30 aa, Artificial Sequence
  Description of Artificial Sequence: Synthetic polypeptide
DEEEVASTNPVATEGYGNVANNIQSRVGQR

SEQ ID NO: 84564 - protein, 29 aa, Artificial Sequence
  Description of Artificial Sequence: Synthetic peptide
DEEEVASTNPVSTEGYGVVAANNLQRGQQ

SEQ ID NO: 84565 - protein, 30 aa, Artificial Sequence
  Description of Artificial Sequence: Synthetic polypeptide
DEEEVASVNPVCTEQYGNVSADNIQSSGNR

SEQ ID NO: 84566 - protein, 37 aa, Artificial Sequence
  Description of Artificial Sequence: Synthetic polypeptide
DEEEIRTTNPVATEQYGSVSPTNNLLVAPRQGDNNEE

SEQ ID NO: 84567 - protein, 28 aa, Artificial Sequence
  Description of Artificial Sequence: Synthetic peptide
DEEEVASVNPVSTEGYGVVANNLQRGQQ

SEQ ID NO: 84568 - protein, 31 aa, Artificial Sequence
  Description of Artificial Sequence: Synthetic polypeptide
DDSEIRTTNPVATEQWGDVSANTIQSRVEDR

SEQ ID NO: 84569 - protein, 31 aa, Artificial Sequence
  Description of Artificial Sequence: Synthetic polypeptide
DEVEIKTTNPVATDQYGVVSTDGDQGGGNET

SEQ ID NO: 84570 - protein, 33 aa, Artificial Sequence
  Description of Artificial Sequence: Synthetic polypeptide
DEVEIKTTNPVATDAWGSVSCTNLSQEPLGPNR

SEQ ID NO: 84571 - protein, 33 aa, Artificial Sequence
  Description of Artificial Sequence: Synthetic polypeptide
DEVEIHTTNPVATEQYGSVTTGGQLQEEMGNGE

SEQ ID NO: 84572 - protein, 30 aa, Artificial Sequence
  Description of Artificial Sequence: Synthetic polypeptide
DEEEVATTNPVATEGYGNVAANVIQSREQR

SEQ ID NO: 84573 - protein, 32 aa, Artificial Sequence
  Description of Artificial Sequence: Synthetic polypeptide
DEVEIGTTNPVATEQYGSVTTGGQAGEEGGNQ

SEQ ID NO: 84574 - protein, 32 aa, Artificial Sequence
  Description of Artificial Sequence: Synthetic polypeptide
DEEEVATTNPVATEGYGNVATTPTGQMRVGNR

SEQ ID NO: 84575 - protein, 34 aa, Artificial Sequence
  Description of Artificial Sequence: Synthetic polypeptide
DEEEIRTTNPVATEQYGSVSPTNNLHEELIEELD

SEQ ID NO: 84576 - protein, 33 aa, Artificial Sequence
  Description of Artificial Sequence: Synthetic polypeptide
DEEEVATTNPVATEQYGNVATTPTGPQMRNGNR

SEQ ID NO: 84577 - protein, 35 aa, Artificial Sequence
  Description of Artificial Sequence: Synthetic polypeptide
DEEEIRTTNPVATEQYGSVSPTNNLEWEGGEEILD

SEQ ID NO: 84578 - protein, 30 aa, Artificial Sequence
  Description of Artificial Sequence: Synthetic polypeptide
AENEIACTNPVSTEGYGNVSANNLQSRGGR

SEQ ID NO: 84579 - protein, 28 aa, Artificial Sequence
  Description of Artificial Sequence: Synthetic peptide
DDNEIASTNPVSTECYGDVANTLQRGQR

SEQ ID NO: 84580 - protein, 32 aa, Artificial Sequence
  Description of Artificial Sequence: Synthetic polypeptide
DEVEICTTNPVAYEQYGTVATNLQGEDGGNAG

SEQ ID NO: 84581 - protein, 28 aa, Artificial Sequence
  Description of Artificial Sequence: Synthetic peptide
DDNEIASTNPVSTECYGDVANCLQRGQR

SEQ ID NO: 84582 - protein, 35 aa, Artificial Sequence
  Description of Artificial Sequence: Synthetic polypeptide
DEEEIRTTNPVATEQYGSVSPTTTGQADQGELTRL

SEQ ID NO: 84583 - protein, 32 aa, Artificial Sequence
  Description of Artificial Sequence: Synthetic polypeptide
DEEHIRPTNPVATEGWGSGVYFTNNLQLGVER

SEQ ID NO: 84584 - protein, 33 aa, Artificial Sequence
  Description of Artificial Sequence: Synthetic polypeptide
DEEHIRTTNPVATEGWGFSGVYETNNLQLGVER

SEQ ID NO: 84585 - protein, 35 aa, Artificial Sequence
  Description of Artificial Sequence: Synthetic polypeptide
DEEEIRTTNPVATEQYGSVSPTNMMMNESGEENVY

SEQ ID NO: 84586 - protein, 33 aa, Artificial Sequence
  Description of Artificial Sequence: Synthetic polypeptide
DEEEIRTTNPVAYEAYGSVFYINELSQNRTYNQ

SEQ ID NO: 84587 - protein, 34 aa, Artificial Sequence
  Description of Artificial Sequence: Synthetic polypeptide
DEVEIRTTNPVATEQYGSVITVDNGNQGETGNGS

SEQ ID NO: 84588 - protein, 35 aa, Artificial Sequence
  Description of Artificial Sequence: Synthetic polypeptide
DEEEIRTTNPVATEQYGSVSPTNMMHQESGEEETI

SEQ ID NO: 84589 - protein, 33 aa, Artificial Sequence
  Description of Artificial Sequence: Synthetic polypeptide
DDGEIRTTNPVATEQYGSVSTTNLLETLGDMQQ

SEQ ID NO: 84590 - protein, 35 aa, Artificial Sequence
  Description of Artificial Sequence: Synthetic polypeptide
DEVEICTTNPVATECYGSVSTGNGNQQNDREGHNR

SEQ ID NO: 84591 - protein, 35 aa, Artificial Sequence
  Description of Artificial Sequence: Synthetic polypeptide
DEEEIRTTNPVATEQYGSVSPTNMMHQASGEEEVE

SEQ ID NO: 84592 - protein, 34 aa, Artificial Sequence
  Description of Artificial Sequence: Synthetic polypeptide
DEDEIRTTNPVATEQYGVVSTVTNTNLQAGSTES

SEQ ID NO: 84593 - protein, 33 aa, Artificial Sequence
  Description of Artificial Sequence: Synthetic polypeptide
DEVEICTTNPVATECYGSVSTGNANQDEGHGRP

SEQ ID NO: 84594 - protein, 35 aa, Artificial Sequence
  Description of Artificial Sequence: Synthetic polypeptide
DEEEIRTTNPVATEQYGSVSPTNMMGQESGEMEVN

SEQ ID NO: 84595 - protein, 33 aa, Artificial Sequence
  Description of Artificial Sequence: Synthetic polypeptide
DEVEIRTTNPVATEQYGSVNGTINQNTEGGNNN

SEQ ID NO: 84596 - protein, 32 aa, Artificial Sequence
  Description of Artificial Sequence: Synthetic polypeptide
DEVEICTTNPVATECYGSVSTGGNTGADGGRS

SEQ ID NO: 84597 - protein, 34 aa, Artificial Sequence
  Description of Artificial Sequence: Synthetic polypeptide
DEVEIRTTNPVATEQYGSVNSDSNLTIEGENNEQ

SEQ ID NO: 84598 - protein, 35 aa, Artificial Sequence
  Description of Artificial Sequence: Synthetic polypeptide
DEEEIRTTNPVATEQYGSVSPTNMFMQETGEEEVA

SEQ ID NO: 84599 - protein, 31 aa, Artificial Sequence
  Description of Artificial Sequence: Synthetic polypeptide
DDGEIRTTNPVATEQYGSVNSTVLLELEMQQ

SEQ ID NO: 84600 - protein, 28 aa, Artificial Sequence
  Description of Artificial Sequence: Synthetic peptide
DDGEIASTNPVSSEQYGNVSNNIQSGTR

SEQ ID NO: 84601 - protein, 32 aa, Artificial Sequence
  Description of Artificial Sequence: Synthetic polypeptide
DEVEICTTNPVATECYGSVSTGGNAGADGDMR

SEQ ID NO: 84602 - protein, 28 aa, Artificial Sequence
  Description of Artificial Sequence: Synthetic peptide
DDGEIASTNPVSSEQYGNVSCNIQSGTR

SEQ ID NO: 84603 - protein, 30 aa, Artificial Sequence
  Description of Artificial Sequence: Synthetic polypeptide
DEVEICTTNPVATDQYGVVSTDGEGGGNET

SEQ ID NO: 84604 - protein, 29 aa, Artificial Sequence
  Description of Artificial Sequence: Synthetic peptide
AENEIACTNPVSTEQYGTASMNLQQQGGR

SEQ ID NO: 84605 - protein, 34 aa, Artificial Sequence
  Description of Artificial Sequence: Synthetic polypeptide
DEEEIRTTNPVAYEAYGSTVSTPSLSGHTGNTRI

SEQ ID NO: 84606 - protein, 35 aa, Artificial Sequence
  Description of Artificial Sequence: Synthetic polypeptide
DEEEIRTTNPVATEQYGSVSPTNMMMQEDGEEEEM

SEQ ID NO: 84607 - protein, 35 aa, Artificial Sequence
  Description of Artificial Sequence: Synthetic polypeptide
DEEEIRTTNPVATEQYGSVSPTNMMMQEFGEAESS

SEQ ID NO: 84608 - protein, 34 aa, Artificial Sequence
  Description of Artificial Sequence: Synthetic polypeptide
DEVEIRTTNPVATEQYGSVITVDNGNQETGGNES

SEQ ID NO: 84609 - protein, 31 aa, Artificial Sequence
  Description of Artificial Sequence: Synthetic polypeptide
DEELIRCTNPVATEQYGSQSWNVFEGEGNML

SEQ ID NO: 84610 - protein, 34 aa, Artificial Sequence
  Description of Artificial Sequence: Synthetic polypeptide
DEEEIRTTNPVATEQYGSVSPTNNHEEIHAENSD

SEQ ID NO: 84611 - protein, 32 aa, Artificial Sequence
  Description of Artificial Sequence: Synthetic polypeptide
DEEEIRTTNPVAYEQWGSSYSLPNMDQTQDNR

SEQ ID NO: 84612 - protein, 34 aa, Artificial Sequence
  Description of Artificial Sequence: Synthetic polypeptide
DEEEISTTNPVATEQYGCVSTNDLFQVNFGSEFS

SEQ ID NO: 84613 - protein, 33 aa, Artificial Sequence
  Description of Artificial Sequence: Synthetic polypeptide
DEEHIRTTNPVATEGWGSGVYATNNLQDTGVER

SEQ ID NO: 84614 - protein, 34 aa, Artificial Sequence
  Description of Artificial Sequence: Synthetic polypeptide
DEEHIRTTNPVATEGWGSGVYTSTNNLVQLGVER

SEQ ID NO: 84615 - protein, 34 aa, Artificial Sequence
  Description of Artificial Sequence: Synthetic polypeptide
DEDEIRTTNPVATTQYGSVSTTQQLQQGTNQETD

SEQ ID NO: 84616 - protein, 34 aa, Artificial Sequence
  Description of Artificial Sequence: Synthetic polypeptide
DEEEIRTTNPVATEQYGSVSPTTTLQQPMQPEFY

SEQ ID NO: 84617 - protein, 34 aa, Artificial Sequence
  Description of Artificial Sequence: Synthetic polypeptide
DEDEIRTTNPVATTQYGSVSTTQTLQQGTTNNTD

SEQ ID NO: 84618 - protein, 33 aa, Artificial Sequence
  Description of Artificial Sequence: Synthetic polypeptide
DDMEIATTNPVATEQYGTVCSATDTIVQREGNR

SEQ ID NO: 84619 - protein, 33 aa, Artificial Sequence
  Description of Artificial Sequence: Synthetic polypeptide
DDMEIATTNPVATEQYGTVCSANDTIVQREGNR

SEQ ID NO: 84620 - protein, 34 aa, Artificial Sequence
  Description of Artificial Sequence: Synthetic polypeptide
DEEEIRTTNPVAYEAYGSTVSTPSLSDRTGNEII

SEQ ID NO: 84621 - protein, 34 aa, Artificial Sequence
  Description of Artificial Sequence: Synthetic polypeptide
DEDEIRTTNPVATTQYGSVSTTTQLQQGTNNTTD

SEQ ID NO: 84622 - protein, 35 aa, Artificial Sequence
  Description of Artificial Sequence: Synthetic polypeptide
DEEEIRTTNPVATEQYGSVSPTTTLQQPPQMGEFM

SEQ ID NO: 84623 - protein, 31 aa, Artificial Sequence
  Description of Artificial Sequence: Synthetic polypeptide
DEEHIRTTNPVATNGWGSVCATNNLVLGVER

SEQ ID NO: 84624 - protein, 33 aa, Artificial Sequence
  Description of Artificial Sequence: Synthetic polypeptide
DEVEICTTNPVATECYGSVSTGNPQGDTGGNEM

SEQ ID NO: 84625 - protein, 33 aa, Artificial Sequence
  Description of Artificial Sequence: Synthetic polypeptide
DEVEICTTNPVATECYGSVSTGNNQRDEGHGGN

SEQ ID NO: 84626 - protein, 33 aa, Artificial Sequence
  Description of Artificial Sequence: Synthetic polypeptide
DEVEICTTNPVATECYGSVSTGNNQRDDEGHGD

SEQ ID NO: 84627 - protein, 35 aa, Artificial Sequence
  Description of Artificial Sequence: Synthetic polypeptide
DEEEIRTTNPVATEQYGSVSPTNMVQQEHGEEEVN

SEQ ID NO: 84628 - protein, 35 aa, Artificial Sequence
  Description of Artificial Sequence: Synthetic polypeptide
DEEEIRTTNPVATEQYGSVSPTNMVMQEHGEEEPE

SEQ ID NO: 84629 - protein, 34 aa, Artificial Sequence
  Description of Artificial Sequence: Synthetic polypeptide
DEEEIRTTNPVATEQYGSVSPTVDWLEANGGLQE

SEQ ID NO: 84630 - protein, 35 aa, Artificial Sequence
  Description of Artificial Sequence: Synthetic polypeptide
DEEEIRTTNPVATEQYGSVSPTNMMMQETGEEESN

SEQ ID NO: 84631 - protein, 34 aa, Artificial Sequence
  Description of Artificial Sequence: Synthetic polypeptide
DEVEIRTTNPVATEQYGSVITVDNGNQEGGENIT

SEQ ID NO: 84632 - protein, 34 aa, Artificial Sequence
  Description of Artificial Sequence: Synthetic polypeptide
DEEEIRTTNPVATEQYGSVSPTTTLQQPMQQEVM

SEQ ID NO: 84633 - protein, 35 aa, Artificial Sequence
  Description of Artificial Sequence: Synthetic polypeptide
DEEEIRTTNPVATEQYGSVSSTPAGPQMRNGMGPV

SEQ ID NO: 84634 - protein, 34 aa, Artificial Sequence
  Description of Artificial Sequence: Synthetic polypeptide
DEDEIRTTNPVATEQYGSVSTTNTQQQQEGTEQQ

SEQ ID NO: 84635 - protein, 33 aa, Artificial Sequence
  Description of Artificial Sequence: Synthetic polypeptide
DEEEISTTNPVATEQYGCVCSTGEHQGGSNNQA

SEQ ID NO: 84636 - protein, 34 aa, Artificial Sequence
  Description of Artificial Sequence: Synthetic polypeptide
DDEEIRTTNPVATEQYGSVSSDDLDQNEGNEGNE

SEQ ID NO: 84637 - protein, 33 aa, Artificial Sequence
  Description of Artificial Sequence: Synthetic polypeptide
DEEEIRTTNPVATEQYGSVSPTDQDEGRDESIE

SEQ ID NO: 84638 - protein, 35 aa, Artificial Sequence
  Description of Artificial Sequence: Synthetic polypeptide
DEEEIRTTNPVATEQYGSVSSTEPALPNRNGMEPV

SEQ ID NO: 84639 - protein, 34 aa, Artificial Sequence
  Description of Artificial Sequence: Synthetic polypeptide
DDEEIRTTNPVATEQYGSVSNTDNMNIIGGNGQD

SEQ ID NO: 84640 - protein, 33 aa, Artificial Sequence
  Description of Artificial Sequence: Synthetic polypeptide
DEEEISTTNPCATEQYGCVCPTNLQEHGSNGQA

SEQ ID NO: 84641 - protein, 32 aa, Artificial Sequence
  Description of Artificial Sequence: Synthetic polypeptide
DEYEIGTTNPVATEQYGSVTVTNAGMEGGGNT

SEQ ID NO: 84642 - protein, 34 aa, Artificial Sequence
  Description of Artificial Sequence: Synthetic polypeptide
DDEEIRTTNPVATEQYGSVSNTDNMDNGGGQTNE

SEQ ID NO: 84643 - protein, 34 aa, Artificial Sequence
  Description of Artificial Sequence: Synthetic polypeptide
DDEEIRTTNPVATEQYGSVSNTDNDNNEMGEGNI

SEQ ID NO: 84644 - protein, 33 aa, Artificial Sequence
  Description of Artificial Sequence: Synthetic polypeptide
DDEEIRTTNPVATEQYGSVSNDQGQNGQGEGQE

SEQ ID NO: 84645 - protein, 33 aa, Artificial Sequence
  Description of Artificial Sequence: Synthetic polypeptide
DEEVIRTTNPVATEQYGSVSPTNKHSDERSMSN

SEQ ID NO: 84646 - protein, 31 aa, Artificial Sequence
  Description of Artificial Sequence: Synthetic polypeptide
AENEIRCTNPVATEQWGAAWSNENLQRGGYR

SEQ ID NO: 84647 - protein, 32 aa, Artificial Sequence
  Description of Artificial Sequence: Synthetic polypeptide
DEYEIGTTNPVATEQYGSVVSINAGMEGGNEG

SEQ ID NO: 84648 - protein, 35 aa, Artificial Sequence
  Description of Artificial Sequence: Synthetic polypeptide
DDEEIRTTNPVATEQYGSVSITDNNGQGIGEGENS

SEQ ID NO: 84649 - protein, 35 aa, Artificial Sequence
  Description of Artificial Sequence: Synthetic polypeptide
DDEEIRTTNPVATEQYGSVSINTNDLGNNGNGNVP

SEQ ID NO: 84650 - protein, 35 aa, Artificial Sequence
  Description of Artificial Sequence: Synthetic polypeptide
DEEEIRTTNPVAYEQYGKVVSCWTNEWSNRNGTNR

SEQ ID NO: 84651 - protein, 33 aa, Artificial Sequence
  Description of Artificial Sequence: Synthetic polypeptide
DDEEIRTTNPVATEQYGSVSIDNADQNEGEGGT

SEQ ID NO: 84652 - protein, 32 aa, Artificial Sequence
  Description of Artificial Sequence: Synthetic polypeptide
DEEEISTTNPCATEQYGCVCPTELQEYGSDNQ

SEQ ID NO: 84653 - protein, 35 aa, Artificial Sequence
  Description of Artificial Sequence: Synthetic polypeptide
DDEEIRTTNPVATEQYGSVSGVNGLQENGNGNGQG

SEQ ID NO: 84654 - protein, 33 aa, Artificial Sequence
  Description of Artificial Sequence: Synthetic polypeptide
DEEEISTTNPCATEQYGCVCGTNLQNFGSNTAS

SEQ ID NO: 84655 - protein, 35 aa, Artificial Sequence
  Description of Artificial Sequence: Synthetic polypeptide
DEEEIRTTNPVAYEQYGMSVSVTNDLLQDSQIERN

SEQ ID NO: 84656 - protein, 34 aa, Artificial Sequence
  Description of Artificial Sequence: Synthetic polypeptide
DDEEIRTTNPVATEQYGSVSGTTGDQGGGNGNED

SEQ ID NO: 84657 - protein, 33 aa, Artificial Sequence
  Description of Artificial Sequence: Synthetic polypeptide
DEEVIRTTNPVATEQYGSVCSTELNDNFGSDQS

SEQ ID NO: 84658 - protein, 33 aa, Artificial Sequence
  Description of Artificial Sequence: Synthetic polypeptide
DEEEISSTNPVAYEQYGSVSVSPNELSQQVGNI

SEQ ID NO: 84659 - protein, 34 aa, Artificial Sequence
  Description of Artificial Sequence: Synthetic polypeptide
DEEEIRTTNPVAYEQYGKVSSVNAHQGAVGNNRC

SEQ ID NO: 84660 - protein, 34 aa, Artificial Sequence
  Description of Artificial Sequence: Synthetic polypeptide
DDEEIRTTNPVATEQYGSVSSTGLQEGQGEEGGD

SEQ ID NO: 84661 - protein, 34 aa, Artificial Sequence
  Description of Artificial Sequence: Synthetic polypeptide
DDEEIRTTNPVATEQYGSVSTGQQNVGEGGGNEG

SEQ ID NO: 84662 - protein, 33 aa, Artificial Sequence
  Description of Artificial Sequence: Synthetic polypeptide
AENEIACTNPVATEQYGEASSTTPNLPQRNGNR

SEQ ID NO: 84663 - protein, 34 aa, Artificial Sequence
  Description of Artificial Sequence: Synthetic polypeptide
DEEEISTTNPVATEAYGSVSVTGNAGQPGGNNTA

SEQ ID NO: 84664 - protein, 33 aa, Artificial Sequence
  Description of Artificial Sequence: Synthetic polypeptide
DEEEISTTNPVATEAYGSVPSCTNAGQNVNNAG

SEQ ID NO: 84665 - protein, 29 aa, Artificial Sequence
  Description of Artificial Sequence: Synthetic peptide
DDSEVACTNPVSTEQYGSVAAETIQRGNR

SEQ ID NO: 84666 - protein, 33 aa, Artificial Sequence
  Description of Artificial Sequence: Synthetic polypeptide
DEDEIRTTNPVAYEQWGSVCSTNDGGQQEGNTS

SEQ ID NO: 84667 - protein, 34 aa, Artificial Sequence
  Description of Artificial Sequence: Synthetic polypeptide
DDEEIRTTNPVATEQYGSVSTGITNTGEGGGNEG

SEQ ID NO: 84668 - protein, 34 aa, Artificial Sequence
  Description of Artificial Sequence: Synthetic polypeptide
DEEEIRTTNPVATEQYGSVSPTEDLDEGRTESIE

SEQ ID NO: 84669 - protein, 33 aa, Artificial Sequence
  Description of Artificial Sequence: Synthetic polypeptide
DEDEIRTTNPVAYEQWGSVCSTNDGNENGGNAR

SEQ ID NO: 84670 - protein, 29 aa, Artificial Sequence
  Description of Artificial Sequence: Synthetic peptide
AENEIMCTNPVATEQYGEAISENLQVGGG

SEQ ID NO: 84671 - protein, 36 aa, Artificial Sequence
  Description of Artificial Sequence: Synthetic polypeptide
DEEEIRTTNPVATEQYGSVSSTEPAGPQMRNGMNPK

SEQ ID NO: 84672 - protein, 34 aa, Artificial Sequence
  Description of Artificial Sequence: Synthetic polypeptide
DDEEIRTTNPVATEQYGSVSTGITNGQGGGEGTE

SEQ ID NO: 84673 - protein, 36 aa, Artificial Sequence
  Description of Artificial Sequence: Synthetic polypeptide
DEEEIRTTNPVATEQYGSVSSTEPAGPQMRNGMNPV

SEQ ID NO: 84674 - protein, 34 aa, Artificial Sequence
  Description of Artificial Sequence: Synthetic polypeptide
DEEEIRTTNPVATEQYGSVSPTDTIEQIEMENNM

SEQ ID NO: 84675 - protein, 34 aa, Artificial Sequence
  Description of Artificial Sequence: Synthetic polypeptide
DDEEIRTTNPVATEQYGSVSTDTGDEQGGNGGND

SEQ ID NO: 84676 - protein, 34 aa, Artificial Sequence
  Description of Artificial Sequence: Synthetic polypeptide
DDEEIRTTNPVATEQYGSVSTDNGLEGGGETTGT

SEQ ID NO: 84677 - protein, 36 aa, Artificial Sequence
  Description of Artificial Sequence: Synthetic polypeptide
DEEEIRTTNPVATEQYGSVSSTEPALPNMRNGMNPL

SEQ ID NO: 84678 - protein, 35 aa, Artificial Sequence
  Description of Artificial Sequence: Synthetic polypeptide
DDEEIRTTNPVATEQYGSVSTAMNDGQGEEGENGG

SEQ ID NO: 84679 - protein, 34 aa, Artificial Sequence
  Description of Artificial Sequence: Synthetic polypeptide
DEEEIRTTNPVAYEQYGKVSCWGNEESNRGTNRV

SEQ ID NO: 84680 - protein, 34 aa, Artificial Sequence
  Description of Artificial Sequence: Synthetic polypeptide
DEDEIRTTNPVAYEQWGSVCSTNDGNHQEGNRNS

SEQ ID NO: 84681 - protein, 33 aa, Artificial Sequence
  Description of Artificial Sequence: Synthetic polypeptide
DEDEIRTTNPVAYEQWGSVCSTNDGQHQGENMQ

SEQ ID NO: 84682 - protein, 34 aa, Artificial Sequence
  Description of Artificial Sequence: Synthetic polypeptide
DDEEIRTTNPVATEQYGSVSSTGEGDQNIGGDNE

SEQ ID NO: 84683 - protein, 35 aa, Artificial Sequence
  Description of Artificial Sequence: Synthetic polypeptide
DEEEIRTTNPVATEQYGSVSSTEPAGPNRNGMNPV

SEQ ID NO: 84684 - protein, 34 aa, Artificial Sequence
  Description of Artificial Sequence: Synthetic polypeptide
DDEEIRTTNPVATEQYGSVSGTLGQPGGGNGNGD

SEQ ID NO: 84685 - protein, 32 aa, Artificial Sequence
  Description of Artificial Sequence: Synthetic polypeptide
DEDEIRTTNPVAYEQWGSVCSTNDQGEHTGGA

SEQ ID NO: 84686 - protein, 30 aa, Artificial Sequence
  Description of Artificial Sequence: Synthetic polypeptide
DDSEVASTNPVATEGYGNVSAETLQRVGNR

SEQ ID NO: 84687 - protein, 35 aa, Artificial Sequence
  Description of Artificial Sequence: Synthetic polypeptide
DEEVIRTTNPVAYEQYGSVVSVTGNLSDNGQNNRD

SEQ ID NO: 84688 - protein, 31 aa, Artificial Sequence
  Description of Artificial Sequence: Synthetic polypeptide
AENEIRCTNPVATEQYGSASSTPAGQRNGGV

SEQ ID NO: 84689 - protein, 32 aa, Artificial Sequence
  Description of Artificial Sequence: Synthetic polypeptide
DEEVIRTTNPVAYEQYGSVWYTHESTRGGNNT

SEQ ID NO: 84690 - protein, 34 aa, Artificial Sequence
  Description of Artificial Sequence: Synthetic polypeptide
DEDEIRTTNPVAYEQWGSVCSTNGLQQGDTNGGA

SEQ ID NO: 84691 - protein, 34 aa, Artificial Sequence
  Description of Artificial Sequence: Synthetic polypeptide
DEEVIRTTNPVAYEQYGTVCATNDLHDQNGQNDR

SEQ ID NO: 84692 - protein, 34 aa, Artificial Sequence
  Description of Artificial Sequence: Synthetic polypeptide
DEEVIRTTNPVAYEQYGTVCSTNDLHDQNGQNQP

SEQ ID NO: 84693 - protein, 34 aa, Artificial Sequence
  Description of Artificial Sequence: Synthetic polypeptide
DDEEIRTTNPVATEQYGSVGSTMELTDDQGENGQ

SEQ ID NO: 84694 - protein, 31 aa, Artificial Sequence
  Description of Artificial Sequence: Synthetic polypeptide
DDSEVASTNPVATEGYGSVSATDLQDRVGQR

SEQ ID NO: 84695 - protein, 36 aa, Artificial Sequence
  Description of Artificial Sequence: Synthetic polypeptide
DEEEIRTTNPVATEQYGSVSSTIPAGPNLRNGMNPV

SEQ ID NO: 84696 - protein, 34 aa, Artificial Sequence
  Description of Artificial Sequence: Synthetic polypeptide
DDEEIRTTNPVATEQYGSVGSTGGQGDGDNGNNG

SEQ ID NO: 84697 - protein, 33 aa, Artificial Sequence
  Description of Artificial Sequence: Synthetic polypeptide
AENEIRCTNPVATEQYGSVSSTPAGPQMRNGNV

SEQ ID NO: 84698 - protein, 35 aa, Artificial Sequence
  Description of Artificial Sequence: Synthetic polypeptide
DDEEIRTTNPVATEQYGSVGSNTDLIQNGGQGNDE

SEQ ID NO: 84699 - protein, 34 aa, Artificial Sequence
  Description of Artificial Sequence: Synthetic polypeptide
DEDEIRTTNPVAYEQWGSVCSTNLQEGDTQNGGA

SEQ ID NO: 84700 - protein, 32 aa, Artificial Sequence
  Description of Artificial Sequence: Synthetic polypeptide
DEEVIRVTNPVATEQYGAVSTNQQAQEVNPCH

SEQ ID NO: 84701 - protein, 31 aa, Artificial Sequence
  Description of Artificial Sequence: Synthetic polypeptide
DEEEIRTVNPVSTEPYGTVSMEDLQQQNGNQ

SEQ ID NO: 84702 - protein, 34 aa, Artificial Sequence
  Description of Artificial Sequence: Synthetic polypeptide
DEDEIRTTNPVAYEQWGSVCSTQNDDGHQGGNRS

SEQ ID NO: 84703 - protein, 31 aa, Artificial Sequence
  Description of Artificial Sequence: Synthetic polypeptide
DEEVIRVTNPVATEQYGAVSTNQQFQEVEPE

SEQ ID NO: 84704 - protein, 32 aa, Artificial Sequence
  Description of Artificial Sequence: Synthetic polypeptide
DEEVISTTNPVATEQYGCVCSTNLNDNFGSQQ

SEQ ID NO: 84705 - protein, 35 aa, Artificial Sequence
  Description of Artificial Sequence: Synthetic polypeptide
DDEEIRTTNPVATEQYGSVGNTDNLIQNVGQGGNT

SEQ ID NO: 84706 - protein, 32 aa, Artificial Sequence
  Description of Artificial Sequence: Synthetic polypeptide
DEEYIGTTNPVATEQYGDVSTDEGQGEGGNQG

SEQ ID NO: 84707 - protein, 32 aa, Artificial Sequence
  Description of Artificial Sequence: Synthetic polypeptide
AENEIRCTNPVATEQYGSASSTPAGPQRNGNV

SEQ ID NO: 84708 - protein, 32 aa, Artificial Sequence
  Description of Artificial Sequence: Synthetic polypeptide
DEDEIRTTNPVAYEQWGSVCSTNDNGQTNGGA

SEQ ID NO: 84709 - protein, 32 aa, Artificial Sequence
  Description of Artificial Sequence: Synthetic polypeptide
DEEVIRTTNPVAYEQDGKVATNPQQRTGGNNS

SEQ ID NO: 84710 - protein, 35 aa, Artificial Sequence
  Description of Artificial Sequence: Synthetic polypeptide
DEEEIRYTNPVAYEQYGSTVSCVNAQSDTRGGNSR

SEQ ID NO: 84711 - protein, 33 aa, Artificial Sequence
  Description of Artificial Sequence: Synthetic polypeptide
DDEEIRTTNPVATEQYGSVSGDQLIGGQGGEGT

SEQ ID NO: 84712 - protein, 33 aa, Artificial Sequence
  Description of Artificial Sequence: Synthetic polypeptide
DDEEIRTTNPVATEQYGSVSGDQGGQGEGGGNN

SEQ ID NO: 84713 - protein, 33 aa, Artificial Sequence
  Description of Artificial Sequence: Synthetic polypeptide
DEYEIRTTNPVATECWGSVSCINEPQDREGENG

SEQ ID NO: 84714 - protein, 31 aa, Artificial Sequence
  Description of Artificial Sequence: Synthetic polypeptide
DETSIRTTNPLATEQFGSVSCENNEYGPNGR

SEQ ID NO: 84715 - protein, 33 aa, Artificial Sequence
  Description of Artificial Sequence: Synthetic polypeptide
DEYEIRTTNPVATECWGSVSCINEPQDREGGNG

SEQ ID NO: 84716 - protein, 34 aa, Artificial Sequence
  Description of Artificial Sequence: Synthetic polypeptide
DDEEIRTTNPVATEQYGSVSGDNTGQGEGGNVNT

SEQ ID NO: 84717 - protein, 33 aa, Artificial Sequence
  Description of Artificial Sequence: Synthetic polypeptide
DEYEIRTTNPVATECWGSVSCINEPQDRGGENG

SEQ ID NO: 84718 - protein, 32 aa, Artificial Sequence
  Description of Artificial Sequence: Synthetic polypeptide
DEDEIRTTNPVATEQYGMTSTVNGQGGGGDQE

SEQ ID NO: 84719 - protein, 33 aa, Artificial Sequence
  Description of Artificial Sequence: Synthetic polypeptide
DEDEIRTTNPVAYEQWGSVCSTNDSGHQGGNHS

SEQ ID NO: 84720 - protein, 34 aa, Artificial Sequence
  Description of Artificial Sequence: Synthetic polypeptide
DDEEIRTTNPVATEQYGSVSAANPAGPQSRNGQV

SEQ ID NO: 84721 - protein, 34 aa, Artificial Sequence
  Description of Artificial Sequence: Synthetic polypeptide
DDEEIRTTNPVATEQYGSVSAANPAGPQMRNGQV

SEQ ID NO: 84722 - protein, 32 aa, Artificial Sequence
  Description of Artificial Sequence: Synthetic polypeptide
AENEIACTNPVATEQYGEASSTENLQRNGMNV

SEQ ID NO: 84723 - protein, 33 aa, Artificial Sequence
  Description of Artificial Sequence: Synthetic polypeptide
DEEEISCTNPVATEQYGCVCSTELQNFGSENQS

SEQ ID NO: 84724 - protein, 34 aa, Artificial Sequence
  Description of Artificial Sequence: Synthetic polypeptide
DDEEIRTTNPVATEQYGSVNSSDQNNGQGEGNDD

SEQ ID NO: 84725 - protein, 29 aa, Artificial Sequence
  Description of Artificial Sequence: Synthetic peptide
AENEIRCTNPVATEQYGEVSENEQNAEGA

SEQ ID NO: 84726 - protein, 33 aa, Artificial Sequence
  Description of Artificial Sequence: Synthetic polypeptide
DEEEISCTNPVATEQYGCVCSMTNDNQGFGSNQ

SEQ ID NO: 84727 - protein, 34 aa, Artificial Sequence
  Description of Artificial Sequence: Synthetic polypeptide
DDEEIRTTNPVATEQYGSVISTVGLGEDGGENGD

SEQ ID NO: 84728 - protein, 31 aa, Artificial Sequence
  Description of Artificial Sequence: Synthetic polypeptide
DEDEIRTTNPVATEQYGGCCATNHQAEGPPH

SEQ ID NO: 84729 - protein, 34 aa, Artificial Sequence
  Description of Artificial Sequence: Synthetic polypeptide
DEEVIRTTNPVATEQYGSVSVIPLEFPNSGQNHR

SEQ ID NO: 84730 - protein, 31 aa, Artificial Sequence
  Description of Artificial Sequence: Synthetic polypeptide
DEDEIRTTNPVATEQYGGCCATNHQAEGPDS

SEQ ID NO: 84731 - protein, 34 aa, Artificial Sequence
  Description of Artificial Sequence: Synthetic polypeptide
DDEEIRTTNPVATEQYGSVISTQGQGTGQGNEGN

SEQ ID NO: 84732 - protein, 33 aa, Artificial Sequence
  Description of Artificial Sequence: Synthetic polypeptide
DEEVIRTTNPVAYEAYGSVVSVTNDSDNGQNNR

SEQ ID NO: 84733 - protein, 34 aa, Artificial Sequence
  Description of Artificial Sequence: Synthetic polypeptide
DEYEIGTTNPVATEQYGSVSTLGQLGQEEMGNLF

SEQ ID NO: 84734 - protein, 33 aa, Artificial Sequence
  Description of Artificial Sequence: Synthetic polypeptide
DEEVIRTTNPVATEQYGCVCSTNLNDNFSSNQS

SEQ ID NO: 84735 - protein, 32 aa, Artificial Sequence
  Description of Artificial Sequence: Synthetic polypeptide
DEEEISTTNPVATEEYGCVCSTELQNFGSQQT

SEQ ID NO: 84736 - protein, 34 aa, Artificial Sequence
  Description of Artificial Sequence: Synthetic polypeptide
DEEEIRTTNPVAYEQYGETVSCTDLSGQGTNSRH

SEQ ID NO: 84737 - protein, 34 aa, Artificial Sequence
  Description of Artificial Sequence: Synthetic polypeptide
DEEEIRTTNPVAYEQYGETVSCTDLSGRNGTNSA

SEQ ID NO: 84738 - protein, 34 aa, Artificial Sequence
  Description of Artificial Sequence: Synthetic polypeptide
DEEEIRTTNPVATEQYGSVSPTENQGFEGLLIVT

SEQ ID NO: 84739 - protein, 35 aa, Artificial Sequence
  Description of Artificial Sequence: Synthetic polypeptide
DEEEIRTTNPVATEQYGSVSPTENPLFPPGEHETL

SEQ ID NO: 84740 - protein, 34 aa, Artificial Sequence
  Description of Artificial Sequence: Synthetic polypeptide
DEDEIRTTNPVATEQYGSVATTQALQIGTTNNNE

SEQ ID NO: 84741 - protein, 30 aa, Artificial Sequence
  Description of Artificial Sequence: Synthetic polypeptide
DEEVIACTNPVATEQYGCVATNLPDNEANT

SEQ ID NO: 84742 - protein, 33 aa, Artificial Sequence
  Description of Artificial Sequence: Synthetic polypeptide
DEEEISTTNPVATEQYGCVCSMTELQNFSSNQG

SEQ ID NO: 84743 - protein, 31 aa, Artificial Sequence
  Description of Artificial Sequence: Synthetic polypeptide
DEEVIACTNPVATEQYGCVATNLPDNEQNDR

SEQ ID NO: 84744 - protein, 31 aa, Artificial Sequence
  Description of Artificial Sequence: Synthetic polypeptide
DEEVIACTNPVATEQYGCVATNLPDNNEGNN

SEQ ID NO: 84745 - protein, 33 aa, Artificial Sequence
  Description of Artificial Sequence: Synthetic polypeptide
DEDEIRTTNPVATEQYGSVATQAQLQINTTNNE

SEQ ID NO: 84746 - protein, 32 aa, Artificial Sequence
  Description of Artificial Sequence: Synthetic polypeptide
DEYEIATTNPVATEQYGSVSITDLEDVEGEDL

SEQ ID NO: 84747 - protein, 32 aa, Artificial Sequence
  Description of Artificial Sequence: Synthetic polypeptide
DEYEICTTNPAATEQYGSVPGNLQEGGGNGDD

SEQ ID NO: 84748 - protein, 34 aa, Artificial Sequence
  Description of Artificial Sequence: Synthetic polypeptide
DEDEIRTTNPVATEQYGSVATEQLLQIGTTENNE

SEQ ID NO: 84749 - protein, 34 aa, Artificial Sequence
  Description of Artificial Sequence: Synthetic polypeptide
DEEEIRTTNPVATEQYGSVSSTDNGINGEFGEIG

SEQ ID NO: 84750 - protein, 34 aa, Artificial Sequence
  Description of Artificial Sequence: Synthetic polypeptide
DEDEIRTTNPVATEQYGSVAPTWNDHQERDMHDR

SEQ ID NO: 84751 - protein, 33 aa, Artificial Sequence
  Description of Artificial Sequence: Synthetic polypeptide
DEEEISTTNPVATEQYGCVCSMTEHQYFGSNLS

SEQ ID NO: 84752 - protein, 35 aa, Artificial Sequence
  Description of Artificial Sequence: Synthetic polypeptide
DEEEIRTTNPVATEQYGSVSSTDNGLEGGGETGGN

SEQ ID NO: 84753 - protein, 30 aa, Artificial Sequence
  Description of Artificial Sequence: Synthetic polypeptide
DEAAIRTTNPVATEQYGCFCSTEDINGSNQ

SEQ ID NO: 84754 - protein, 32 aa, Artificial Sequence
  Description of Artificial Sequence: Synthetic polypeptide
DEEVIACTNPVATEQYGSVATNLPDNEQNNNS

SEQ ID NO: 84755 - protein, 33 aa, Artificial Sequence
  Description of Artificial Sequence: Synthetic polypeptide
DEEEISTTNPVATEQYGCVCSMTEHQRFGSDLG

SEQ ID NO: 84756 - protein, 33 aa, Artificial Sequence
  Description of Artificial Sequence: Synthetic polypeptide
DEEEISTTNPVATEQYGCVCSDTELNQRFSSDQ

SEQ ID NO: 84757 - protein, 31 aa, Artificial Sequence
  Description of Artificial Sequence: Synthetic polypeptide
DEEVIACTNPVATEQYGCVAATNDQMQGNES

SEQ ID NO: 84758 - protein, 31 aa, Artificial Sequence
  Description of Artificial Sequence: Synthetic polypeptide
DEEVIACTNPVATEQYGSVATNLPDNEQNTT

SEQ ID NO: 84759 - protein, 33 aa, Artificial Sequence
  Description of Artificial Sequence: Synthetic polypeptide
DETTIRTTNPVATEQYGSVADFTNLIGGGNGDG

SEQ ID NO: 84760 - protein, 32 aa, Artificial Sequence
  Description of Artificial Sequence: Synthetic polypeptide
DEYEIATTNPVATEQYGSVSATDLEDHDGEDL

SEQ ID NO: 84761 - protein, 29 aa, Artificial Sequence
  Description of Artificial Sequence: Synthetic peptide
AENEICCTNPVATEQYGESSENLQGPEGR

SEQ ID NO: 84762 - protein, 33 aa, Artificial Sequence
  Description of Artificial Sequence: Synthetic polypeptide
DEEEISTTNPVATEQYGCVCSMWNLQNFGSDQA

SEQ ID NO: 84763 - protein, 31 aa, Artificial Sequence
  Description of Artificial Sequence: Synthetic polypeptide
AENEICCTNPVATEQYGESYSEVNLQRPEGR

SEQ ID NO: 84764 - protein, 36 aa, Artificial Sequence
  Description of Artificial Sequence: Synthetic polypeptide
DEEEIRTTNPVATEQYGSVSSTAPAGPLMRNGMNPV

SEQ ID NO: 84765 - protein, 29 aa, Artificial Sequence
  Description of Artificial Sequence: Synthetic peptide
AENEIACTNPVATEQYGEASWNLQYGSQQ

SEQ ID NO: 84766 - protein, 30 aa, Artificial Sequence
  Description of Artificial Sequence: Synthetic polypeptide
AENEICCTNPVATEQYGETSENLQRGGQQD

SEQ ID NO: 84767 - protein, 36 aa, Artificial Sequence
  Description of Artificial Sequence: Synthetic polypeptide
DEEEIRTTNPVATEQYGSVSSTCINEPNDRNGMNPV

SEQ ID NO: 84768 - protein, 34 aa, Artificial Sequence
  Description of Artificial Sequence: Synthetic polypeptide
DEETIRTTNPVAYEAWGSVVSTNMLQRTGGSYRE

SEQ ID NO: 84769 - protein, 36 aa, Artificial Sequence
  Description of Artificial Sequence: Synthetic polypeptide
DEEEIRTTNPVATEQYGSVSSTCINEPNMRNGMNPV

SEQ ID NO: 84770 - protein, 35 aa, Artificial Sequence
  Description of Artificial Sequence: Synthetic polypeptide
DEDEIRTTNPVATEQYGSVATTQGNLQIGTTEDNE

SEQ ID NO: 84771 - protein, 36 aa, Artificial Sequence
  Description of Artificial Sequence: Synthetic polypeptide
DEEEIRTTNPVATEQYGSVSSTCPAEPQMRNGMNPV

SEQ ID NO: 84772 - protein, 34 aa, Artificial Sequence
  Description of Artificial Sequence: Synthetic polypeptide
DEEEISTTNPVATEQYGCVCSMTELQYFGSNNQV

SEQ ID NO: 84773 - protein, 31 aa, Artificial Sequence
  Description of Artificial Sequence: Synthetic polypeptide
DETTIRTTNPVATEQYGSVSTGGGNNGQEEG

SEQ ID NO: 84774 - protein, 35 aa, Artificial Sequence
  Description of Artificial Sequence: Synthetic polypeptide
DEEEIRTTNPVATEQYGSVSSTCPAGPNMRNGENV

SEQ ID NO: 84775 - protein, 32 aa, Artificial Sequence
  Description of Artificial Sequence: Synthetic polypeptide
DEEVEIATTNPVAYEQWGTVSTNLNMGDDGRN

SEQ ID NO: 84776 - protein, 35 aa, Artificial Sequence
  Description of Artificial Sequence: Synthetic polypeptide
DEEEIRTTNPVATEQYGSVSSTCPAGPNRNGMNPV

SEQ ID NO: 84777 - protein, 36 aa, Artificial Sequence
  Description of Artificial Sequence: Synthetic polypeptide
DEEEIRTTNPVATEQYGSVSSTCPAGPQMRNGMNPV

SEQ ID NO: 84778 - protein, 36 aa, Artificial Sequence
  Description of Artificial Sequence: Synthetic polypeptide
DEEEIRTTNPVATEQYGSVSSTCPNEPNMRNGMNPV

SEQ ID NO: 84779 - protein, 33 aa, Artificial Sequence
  Description of Artificial Sequence: Synthetic polypeptide
DDEEIRTTNPVATEQYGSVTTTGDEQGGNGNDD

SEQ ID NO: 84780 - protein, 35 aa, Artificial Sequence
  Description of Artificial Sequence: Synthetic polypeptide
DEDEIRTTNPVATEQYGSVATTQANLQIGTTNDEE

SEQ ID NO: 84781 - protein, 34 aa, Artificial Sequence
  Description of Artificial Sequence: Synthetic polypeptide
DEEEIRTTNPVATEQYGSVSPTEVLPQVMMEIED

SEQ ID NO: 84782 - protein, 32 aa, Artificial Sequence
  Description of Artificial Sequence: Synthetic polypeptide
DEYEIATTNPVATEQYGSVSATDLEDHEGEDL

SEQ ID NO: 84783 - protein, 31 aa, Artificial Sequence
  Description of Artificial Sequence: Synthetic polypeptide
DEEVIACTNPVAYEQYGSVATNLQANPVENN

SEQ ID NO: 84784 - protein, 31 aa, Artificial Sequence
  Description of Artificial Sequence: Synthetic polypeptide
DEAEIATTNPVATEPYGSVAGNGLQTDTDRE

SEQ ID NO: 84785 - protein, 35 aa, Artificial Sequence
  Description of Artificial Sequence: Synthetic polypeptide
DEEEIRTTNPVATEQYGSVSSTDNMDNGGGETNGD

SEQ ID NO: 84786 - protein, 33 aa, Artificial Sequence
  Description of Artificial Sequence: Synthetic polypeptide
DEEVIQTTNPVATETYGSVSTNGLDDGGHGQVR

SEQ ID NO: 84787 - protein, 32 aa, Artificial Sequence
  Description of Artificial Sequence: Synthetic polypeptide
DEEEISTTNPVATEIYGCVCSTNHQNFGSDQS

SEQ ID NO: 84788 - protein, 34 aa, Artificial Sequence
  Description of Artificial Sequence: Synthetic polypeptide
DDEEIRTTNPVATEQYGSVSTMELTDPDQGEGGQ

SEQ ID NO: 84789 - protein, 33 aa, Artificial Sequence
  Description of Artificial Sequence: Synthetic polypeptide
DDEEIRTTNPVATEQYGSVSTMELNDNDQGEGQ

SEQ ID NO: 84790 - protein, 35 aa, Artificial Sequence
  Description of Artificial Sequence: Synthetic polypeptide
DEEEIRTTNPVATEQYGSVSSTEPAGNMRNGMNPV

SEQ ID NO: 84791 - protein, 32 aa, Artificial Sequence
  Description of Artificial Sequence: Synthetic polypeptide
DEEVIRTTNPVATEIFGSVSTNVDDNGHGQIR

SEQ ID NO: 84792 - protein, 34 aa, Artificial Sequence
  Description of Artificial Sequence: Synthetic polypeptide
DDEEIRTTNPVATEQYGSVSTMDIQGGGGNEEQV

SEQ ID NO: 84793 - protein, 33 aa, Artificial Sequence
  Description of Artificial Sequence: Synthetic polypeptide
DDEEIRTTNPVATEQYGSVSTMDIQGGGGEQEQ

SEQ ID NO: 84794 - protein, 31 aa, Artificial Sequence
  Description of Artificial Sequence: Synthetic polypeptide
AENEIACTNPVATEQYGEASSVENMLQRGGR

SEQ ID NO: 84795 - protein, 33 aa, Artificial Sequence
  Description of Artificial Sequence: Synthetic polypeptide
DDEEIRTTNPVATEQYGSVSTMDINGGGNEEGQ

SEQ ID NO: 84796 - protein, 33 aa, Artificial Sequence
  Description of Artificial Sequence: Synthetic polypeptide
DDEEIRTTNPVATEQYGSVSTMDIENGGGNEEQ

SEQ ID NO: 84797 - protein, 35 aa, Artificial Sequence
  Description of Artificial Sequence: Synthetic polypeptide
DEEVIRTTNPVATEQYGCSVVSTNAHSDGTDQNNR

SEQ ID NO: 84798 - protein, 34 aa, Artificial Sequence
  Description of Artificial Sequence: Synthetic polypeptide
DEEVIRTTNPVATEQYGCVCSTGNPLNDNFGSNQ

SEQ ID NO: 84799 - protein, 33 aa, Artificial Sequence
  Description of Artificial Sequence: Synthetic polypeptide
DDEEIRTTNPVATEQYGSVSTLDESGQSNDNGD

SEQ ID NO: 84800 - protein, 32 aa, Artificial Sequence
  Description of Artificial Sequence: Synthetic polypeptide
DETSIRTTNPLAYEQWGSVVSFNALSQSGGNR

SEQ ID NO: 84801 - protein, 33 aa, Artificial Sequence
  Description of Artificial Sequence: Synthetic polypeptide
DEEVIRTTNPVATEQYGCVCSTNLNDENGSQQS

SEQ ID NO: 84802 - protein, 35 aa, Artificial Sequence
  Description of Artificial Sequence: Synthetic polypeptide
DEEEIRTTNPVATEQYGSVSSTEPAGPNMHNGNPV

SEQ ID NO: 84803 - protein, 35 aa, Artificial Sequence
  Description of Artificial Sequence: Synthetic polypeptide
DEEEIRTTNPVATEQYGSVSSTEPAGPNMRAGMNV

SEQ ID NO: 84804 - protein, 35 aa, Artificial Sequence
  Description of Artificial Sequence: Synthetic polypeptide
DEEEIRTTNPVATEQYGSVSSTEPAGPNMRNGMNV

SEQ ID NO: 84805 - protein, 32 aa, Artificial Sequence
  Description of Artificial Sequence: Synthetic polypeptide
DEEEISTTNPVATEEYGCVCSTNHQHFGSDQS

SEQ ID NO: 84806 - protein, 31 aa, Artificial Sequence
  Description of Artificial Sequence: Synthetic polypeptide
DETSIRTTNPLAYEAWGSVPSFNLSQSGGNR

SEQ ID NO: 84807 - protein, 31 aa, Artificial Sequence
  Description of Artificial Sequence: Synthetic polypeptide
DEEEISTTNPVATEQFGTCVCSTYLLHGSDQ

SEQ ID NO: 84808 - protein, 29 aa, Artificial Sequence
  Description of Artificial Sequence: Synthetic peptide
DETSISTTNPLANEQFGSVSCENLEGGNN

SEQ ID NO: 84809 - protein, 33 aa, Artificial Sequence
  Description of Artificial Sequence: Synthetic polypeptide
DEEEISTTNPVATEQWGSVYHWTNDHQKTDGHR

SEQ ID NO: 84810 - protein, 34 aa, Artificial Sequence
  Description of Artificial Sequence: Synthetic polypeptide
DDEEIRTTNPVATEQYGSVSTTMDQNTGGGNEDT

SEQ ID NO: 84811 - protein, 31 aa, Artificial Sequence
  Description of Artificial Sequence: Synthetic polypeptide
DEEEIRTTNPVATETWGVVFSTPNGQQKTSH

SEQ ID NO: 84812 - protein, 32 aa, Artificial Sequence
  Description of Artificial Sequence: Synthetic polypeptide
DEEEISTTNPVATEQYGCVCQTNTQNFNSEQP

SEQ ID NO: 84813 - protein, 33 aa, Artificial Sequence
  Description of Artificial Sequence: Synthetic polypeptide
DDEEIRTTNPVATEQYGSVTTGDQTGGNGEQGD

SEQ ID NO: 84814 - protein, 33 aa, Artificial Sequence
  Description of Artificial Sequence: Synthetic polypeptide
DEEEISTTNPVATEQYGCVCGTNLQENFGSEQS

SEQ ID NO: 84815 - protein, 34 aa, Artificial Sequence
  Description of Artificial Sequence: Synthetic polypeptide
DEEVIATTNPVATEQWGSVAITNNLEQEAGHNPR

SEQ ID NO: 84816 - protein, 32 aa, Artificial Sequence
  Description of Artificial Sequence: Synthetic polypeptide
DDEEIRTTNPVATEQYGSVTPEWVEQRPEERL

SEQ ID NO: 84817 - protein, 32 aa, Artificial Sequence
  Description of Artificial Sequence: Synthetic polypeptide
DEEEISTTNPVATEQYGCVCGTELENFGSNAS

SEQ ID NO: 84818 - protein, 35 aa, Artificial Sequence
  Description of Artificial Sequence: Synthetic polypeptide
DEEEIRTTNPVAYEQYGISTVSCTDALSGRGTNSF

SEQ ID NO: 84819 - protein, 28 aa, Artificial Sequence
  Description of Artificial Sequence: Synthetic peptide
AENEICTTNPVATECYGVVSELLQHEEL

SEQ ID NO: 84820 - protein, 33 aa, Artificial Sequence
  Description of Artificial Sequence: Synthetic polypeptide
DDEEIRTTNPVATEQYGSVTDTGQEQGGNGNGD

SEQ ID NO: 84821 - protein, 32 aa, Artificial Sequence
  Description of Artificial Sequence: Synthetic polypeptide
DEDEIRTTNPVATEQYGETSTNTLQPELEDSV

SEQ ID NO: 84822 - protein, 34 aa, Artificial Sequence
  Description of Artificial Sequence: Synthetic polypeptide
DEEEIRTTNPVAYEQYGISVGTTGLSQRTVGMGH

SEQ ID NO: 84823 - protein, 33 aa, Artificial Sequence
  Description of Artificial Sequence: Synthetic polypeptide
DEEEISTTNPVATEQYGCQVCSTNHQNFGSDAS

SEQ ID NO: 84824 - protein, 29 aa, Artificial Sequence
  Description of Artificial Sequence: Synthetic peptide
AENEIACTNPVATEQYGEASTNLEHEGGL

SEQ ID NO: 84825 - protein, 33 aa, Artificial Sequence
  Description of Artificial Sequence: Synthetic polypeptide
DDEEIRTTNPVATEQYGSVSVPNLNPNSDEYGN

SEQ ID NO: 84826 - protein, 32 aa, Artificial Sequence
  Description of Artificial Sequence: Synthetic polypeptide
DEEVIATTNPVAYEQYGTVSTGDLNDPNGQNR

SEQ ID NO: 84827 - protein, 35 aa, Artificial Sequence
  Description of Artificial Sequence: Synthetic polypeptide
DEEEIRTTNPVATEQYGSVSSTEAGPNMRNGMNPV

SEQ ID NO: 84828 - protein, 34 aa, Artificial Sequence
  Description of Artificial Sequence: Synthetic polypeptide
DEEEISTTNPVATEQYGCQVCSTGELQNFGSNQY

SEQ ID NO: 84829 - protein, 35 aa, Artificial Sequence
  Description of Artificial Sequence: Synthetic polypeptide
DDEEIRTTNPVATEQYGSVSTVNGLFEENGNNGQG

SEQ ID NO: 84830 - protein, 35 aa, Artificial Sequence
  Description of Artificial Sequence: Synthetic polypeptide
DEEEIRTTNPVATEQYGSVSSTEAGPQQQNGMNPV

SEQ ID NO: 84831 - protein, 34 aa, Artificial Sequence
  Description of Artificial Sequence: Synthetic polypeptide
DDEEIRTTNPVATEQYGSVSTVNGFGQENIGGGG

SEQ ID NO: 84832 - protein, 32 aa, Artificial Sequence
  Description of Artificial Sequence: Synthetic polypeptide
AENEIACTNPVATEQYGEASTENLQRGGDGER

SEQ ID NO: 84833 - protein, 31 aa, Artificial Sequence
  Description of Artificial Sequence: Synthetic polypeptide
DEAEIATTNPVATEPYGTVSTNLNGEHNNEQ

SEQ ID NO: 84834 - protein, 34 aa, Artificial Sequence
  Description of Artificial Sequence: Synthetic polypeptide
DEYEIRTTNPVATEQYGSVATNNSLQFVGGMEFW

SEQ ID NO: 84835 - protein, 32 aa, Artificial Sequence
  Description of Artificial Sequence: Synthetic polypeptide
DEEYIGTTNPVATEQYGDVSTLGDGQGEGGNG

SEQ ID NO: 84836 - protein, 32 aa, Artificial Sequence
  Description of Artificial Sequence: Synthetic polypeptide
DEDEIRTTNPVATEQYGEMTSTGNGQGGGEDG

SEQ ID NO: 84837 - protein, 33 aa, Artificial Sequence
  Description of Artificial Sequence: Synthetic polypeptide
DETEIRTTNPVAYEQWGSVSTTSNGPQMNGNAP

SEQ ID NO: 84838 - protein, 33 aa, Artificial Sequence
  Description of Artificial Sequence: Synthetic polypeptide
DETEIRTTNPVAYEQWGSVSTTSNDPGQNGNAP

SEQ ID NO: 84839 - protein, 32 aa, Artificial Sequence
  Description of Artificial Sequence: Synthetic polypeptide
DEFVIGTTNPVATEQWGSVCSTDDLQNGSNTQ

SEQ ID NO: 84840 - protein, 35 aa, Artificial Sequence
  Description of Artificial Sequence: Synthetic polypeptide
DETEIRTTNPVAYEQWGSVSTTNLNQGDGPNEGRE

SEQ ID NO: 84841 - protein, 34 aa, Artificial Sequence
  Description of Artificial Sequence: Synthetic polypeptide
DETEIRTTNPVAYEQWGSVSTTNLGPDGPNEGRE

SEQ ID NO: 84842 - protein, 33 aa, Artificial Sequence
  Description of Artificial Sequence: Synthetic polypeptide
DEFVIRTTNPVATEQYGCVACTGNEPSQRGGNG

SEQ ID NO: 84843 - protein, 33 aa, Artificial Sequence
  Description of Artificial Sequence: Synthetic polypeptide
DETEIRTTNPVAYEQWGSVSTTNLGDHQNEGRE

SEQ ID NO: 84844 - protein, 30 aa, Artificial Sequence
  Description of Artificial Sequence: Synthetic polypeptide
AENEIACTNPVATEQYGEASHENLQRGGGH

SEQ ID NO: 84845 - protein, 32 aa, Artificial Sequence
  Description of Artificial Sequence: Synthetic polypeptide
DEEEIRTTNPVATESWGSVWGTNNLQEEMDKF

SEQ ID NO: 84846 - protein, 33 aa, Artificial Sequence
  Description of Artificial Sequence: Synthetic polypeptide
DEEEIRTTNPVSTEQYGTVSTEAGQQMQNGNPH

SEQ ID NO: 84847 - protein, 36 aa, Artificial Sequence
  Description of Artificial Sequence: Synthetic polypeptide
DEEEIRTTNPVATEQYGSVSSTNPAGPNDRNGMNDV

SEQ ID NO: 84848 - protein, 36 aa, Artificial Sequence
  Description of Artificial Sequence: Synthetic polypeptide
DEEEIRTTNPVATEQYGSVSSTNPAGPNMRNGDNPV

SEQ ID NO: 84849 - protein, 34 aa, Artificial Sequence
  Description of Artificial Sequence: Synthetic polypeptide
DEEEIRTTNPVATESWGSVPSYTNSSGRGGNMTI

SEQ ID NO: 84850 - protein, 36 aa, Artificial Sequence
  Description of Artificial Sequence: Synthetic polypeptide
DEEEIRTTNPVATEQYGSVSSTNPAGPNMRNGMNMV

SEQ ID NO: 84851 - protein, 32 aa, Artificial Sequence
  Description of Artificial Sequence: Synthetic polypeptide
DEEEIRTTNPVSTEQYGTISTEDIQQQQNGNH

SEQ ID NO: 84852 - protein, 36 aa, Artificial Sequence
  Description of Artificial Sequence: Synthetic polypeptide
DEEEIRTTNPVATEQYGSVSSTNPAGPNMRNGMNPV

SEQ ID NO: 84853 - protein, 33 aa, Artificial Sequence
  Description of Artificial Sequence: Synthetic polypeptide
DEDEIRTTNPVAYEQWGSVSGDNMEDQRGNEDS

SEQ ID NO: 84854 - protein, 35 aa, Artificial Sequence
  Description of Artificial Sequence: Synthetic polypeptide
DEEEIRTTNPVATEQYGSVSSTNPAGPNMRNGMQV

SEQ ID NO: 84855 - protein, 29 aa, Artificial Sequence
  Description of Artificial Sequence: Synthetic peptide
AENEIRTTNPVSTEPYGTISENIQQRGGH

SEQ ID NO: 84856 - protein, 33 aa, Artificial Sequence
  Description of Artificial Sequence: Synthetic polypeptide
DEYEIRTTNPVATERWGCVPSCTQNGSQLGSNR

SEQ ID NO: 84857 - protein, 36 aa, Artificial Sequence
  Description of Artificial Sequence: Synthetic polypeptide
DEEEIRTTNPVATEQYGSVSSTNPAGPNMRQGMNPQ

SEQ ID NO: 84858 - protein, 31 aa, Artificial Sequence
  Description of Artificial Sequence: Synthetic polypeptide
AENEIRTTNPVATEQYGTISENIQQQQNGNH

SEQ ID NO: 84859 - protein, 37 aa, Artificial Sequence
  Description of Artificial Sequence: Synthetic polypeptide
DEEEIRTTNPVATEQYGSVSSTNPAQGPNMRNGMNSV

SEQ ID NO: 84860 - protein, 32 aa, Artificial Sequence
  Description of Artificial Sequence: Synthetic polypeptide
DEAEIATTNPVATEQYGCTAMTNGLPQMIGNN

SEQ ID NO: 84861 - protein, 32 aa, Artificial Sequence
  Description of Artificial Sequence: Synthetic polypeptide
DEEEIRTTNPVATESYGCVCSTEEHQNFGSDQ

SEQ ID NO: 84862 - protein, 30 aa, Artificial Sequence
  Description of Artificial Sequence: Synthetic polypeptide
AENEIRTTNPVATEQWGETANEDLQRKGPR

SEQ ID NO: 84863 - protein, 34 aa, Artificial Sequence
  Description of Artificial Sequence: Synthetic polypeptide
DDEEIRTTNPVATEQYGDVISTVNLNGGNGENGE

SEQ ID NO: 84864 - protein, 29 aa, Artificial Sequence
  Description of Artificial Sequence: Synthetic peptide
AENEIRTTNPVATEQWGEVSENEQNAEGA

SEQ ID NO: 84865 - protein, 33 aa, Artificial Sequence
  Description of Artificial Sequence: Synthetic polypeptide
DEYEIRTTNPVATEQYGSVSTYMDLEQNSEDQI

SEQ ID NO: 84866 - protein, 34 aa, Artificial Sequence
  Description of Artificial Sequence: Synthetic polypeptide
DEEEIRTTNPVSTETYGSVSMVNTLDQRDNVNLY

SEQ ID NO: 84867 - protein, 33 aa, Artificial Sequence
  Description of Artificial Sequence: Synthetic polypeptide
DEYEIRTTNPVATEQYGSVSTYNDLETNSEQQI

SEQ ID NO: 84868 - protein, 34 aa, Artificial Sequence
  Description of Artificial Sequence: Synthetic polypeptide
DEEEIRTTNPVATEQYGSVSPTANMHIPQTLEPQ

SEQ ID NO: 84869 - protein, 35 aa, Artificial Sequence
  Description of Artificial Sequence: Synthetic polypeptide
DEEEIRTTNPVATEQYGSVSPTANLTQQQIVDEDL

SEQ ID NO: 84870 - protein, 34 aa, Artificial Sequence
  Description of Artificial Sequence: Synthetic polypeptide
DEYEIRTTNPVATEQYGSVSVTYNDLEQNSEDGL

SEQ ID NO: 84871 - protein, 30 aa, Artificial Sequence
  Description of Artificial Sequence: Synthetic polypeptide
DEFVIGATNPVATEQHGSVSTDFLFGGNIA

SEQ ID NO: 84872 - protein, 30 aa, Artificial Sequence
  Description of Artificial Sequence: Synthetic polypeptide
DEAEIATTNPVATEQWGTVSENLTAGTSTV

SEQ ID NO: 84873 - protein, 33 aa, Artificial Sequence
  Description of Artificial Sequence: Synthetic polypeptide
DEEEIRTTNPVSTETYGSVSMVNEQRTGVEMSI

SEQ ID NO: 84874 - protein, 32 aa, Artificial Sequence
  Description of Artificial Sequence: Synthetic polypeptide
AENEIRTTNPVATEQYGEVSSEPAGPNRGMNR

SEQ ID NO: 84875 - protein, 33 aa, Artificial Sequence
  Description of Artificial Sequence: Synthetic polypeptide
DEDEIRTTNPVATEQWGTVSTNQQLGNNVAEDQ

SEQ ID NO: 84876 - protein, 32 aa, Artificial Sequence
  Description of Artificial Sequence: Synthetic polypeptide
DEEEIRTTNPVSTETYGSVPMVNTLQTFEVNE

SEQ ID NO: 84877 - protein, 33 aa, Artificial Sequence
  Description of Artificial Sequence: Synthetic polypeptide
DEEEIRTTNPVSTEQYGTVSTPAGQQMQNGNPV

SEQ ID NO: 84878 - protein, 33 aa, Artificial Sequence
  Description of Artificial Sequence: Synthetic polypeptide
DEEEIRTTNPVATESYGIACATTNLQDRIDNEM

SEQ ID NO: 84879 - protein, 32 aa, Artificial Sequence
  Description of Artificial Sequence: Synthetic polypeptide
DEFVIGTTNPVATEQHGNSYVSTDFLQGGNQM

SEQ ID NO: 84880 - protein, 36 aa, Artificial Sequence
  Description of Artificial Sequence: Synthetic polypeptide
DEYEIRTTNPVATEQYGSVVSTIMLEEQRNGNEEIA

SEQ ID NO: 84881 - protein, 32 aa, Artificial Sequence
  Description of Artificial Sequence: Synthetic polypeptide
DEFVIGTTNPVATEQHGQSKVSTDFLQGGNNA

SEQ ID NO: 84882 - protein, 33 aa, Artificial Sequence
  Description of Artificial Sequence: Synthetic polypeptide
DEYEIRTTNPVATEQYGSVYDANDLQLGQEDGP

SEQ ID NO: 84883 - protein, 32 aa, Artificial Sequence
  Description of Artificial Sequence: Synthetic polypeptide
DDEEIRTTNPVATEQYGCVCSWELQSFGSEQS

SEQ ID NO: 84884 - protein, 33 aa, Artificial Sequence
  Description of Artificial Sequence: Synthetic polypeptide
DEEEIRTTNPVATEQYGSVSPTADSEVETELRN

SEQ ID NO: 84885 - protein, 36 aa, Artificial Sequence
  Description of Artificial Sequence: Synthetic polypeptide
DEEEIRTTNPVATEQYGSVSSTNPDGPNMRNGMNEV

SEQ ID NO: 84886 - protein, 33 aa, Artificial Sequence
  Description of Artificial Sequence: Synthetic polypeptide
DEEEIRTTNPVATERYGTVVSCCSELQRGGDYG

SEQ ID NO: 84887 - protein, 32 aa, Artificial Sequence
  Description of Artificial Sequence: Synthetic polypeptide
DEFVIRTTNPVAYEQWGCVACTNPSQRGGNRD

SEQ ID NO: 84888 - protein, 34 aa, Artificial Sequence
  Description of Artificial Sequence: Synthetic polypeptide
DEEEIRTTNPVATEQYGSVSPSNLDFLGGVEEEN

SEQ ID NO: 84889 - protein, 28 aa, Artificial Sequence
  Description of Artificial Sequence: Synthetic peptide
AENEIACTNPVATEQYGEASETLQHGGI

SEQ ID NO: 84890 - protein, 34 aa, Artificial Sequence
  Description of Artificial Sequence: Synthetic polypeptide
DEEEIRTTNPVATEQYGSVSSTPAGNMRNGMDPV

SEQ ID NO: 84891 - protein, 34 aa, Artificial Sequence
  Description of Artificial Sequence: Synthetic polypeptide
DEEEIRTTNPVSTEQYGSVTPFTNLQEVQGPQTE

SEQ ID NO: 84892 - protein, 33 aa, Artificial Sequence
  Description of Artificial Sequence: Synthetic polypeptide
DETEIRTTNPVAYEQWGSVCSTNLNDGNGNTDM

SEQ ID NO: 84893 - protein, 35 aa, Artificial Sequence
  Description of Artificial Sequence: Synthetic polypeptide
DEEEIRTTNPVATEQYGSVSSTPAGPMMRNGMNPV

SEQ ID NO: 84894 - protein, 30 aa, Artificial Sequence
  Description of Artificial Sequence: Synthetic polypeptide
DEGAIATTNPVATEQWGCSFSQNDIIDGNR

SEQ ID NO: 84895 - protein, 35 aa, Artificial Sequence
  Description of Artificial Sequence: Synthetic polypeptide
DEEEIRTTNPVATEQYGSVSSTPAGPNDRNGENPG

SEQ ID NO: 84896 - protein, 35 aa, Artificial Sequence
  Description of Artificial Sequence: Synthetic polypeptide
DEEEIRTTNPVATEQYGSVSSTPAGPNDRNGMNPG

SEQ ID NO: 84897 - protein, 33 aa, Artificial Sequence
  Description of Artificial Sequence: Synthetic polypeptide
DEEEIRTTNPVAYEQYGQCVCSSNDLEQHGSQQ

SEQ ID NO: 84898 - protein, 35 aa, Artificial Sequence
  Description of Artificial Sequence: Synthetic polypeptide
DEEEIRTTNPVATEQYGSVSSTPAGPNFRNGMNPV

SEQ ID NO: 84899 - protein, 35 aa, Artificial Sequence
  Description of Artificial Sequence: Synthetic polypeptide
DEEEIRTTNPVATEQYGSVSSTPAGPNGRNGMNPV

SEQ ID NO: 84900 - protein, 31 aa, Artificial Sequence
  Description of Artificial Sequence: Synthetic polypeptide
DEAEIATTNPVATEQYGCVAANNLQMAEGHE

SEQ ID NO: 84901 - protein, 34 aa, Artificial Sequence
  Description of Artificial Sequence: Synthetic polypeptide
DEEEIRTTNPVATEQYGSVSSTPAGPNHNGMNPV

SEQ ID NO: 84902 - protein, 33 aa, Artificial Sequence
  Description of Artificial Sequence: Synthetic polypeptide
DETEIRTTNPVAYEQWGSVCSTNDNDGHQGNNR

SEQ ID NO: 84903 - protein, 31 aa, Artificial Sequence
  Description of Artificial Sequence: Synthetic polypeptide
DGEEIATTNPVAYEQWGSVTHTDQDQRGTDR

SEQ ID NO: 84904 - protein, 34 aa, Artificial Sequence
  Description of Artificial Sequence: Synthetic polypeptide
DETEIRTTNPVAYEQWGSVCSTDNHLQDTGGNQT

SEQ ID NO: 84905 - protein, 35 aa, Artificial Sequence
  Description of Artificial Sequence: Synthetic polypeptide
DEEEIRTTNPVATEQYGSVSSTPAGPNMRNGMNPV

SEQ ID NO: 84906 - protein, 30 aa, Artificial Sequence
  Description of Artificial Sequence: Synthetic polypeptide
DGEEIATTNPVAYEQWGSVTHTLDQDGTDR

SEQ ID NO: 84907 - protein, 30 aa, Artificial Sequence
  Description of Artificial Sequence: Synthetic polypeptide
DEGAIATTNPVAYEQWGCSFSTNHPIDGNR

SEQ ID NO: 84908 - protein, 34 aa, Artificial Sequence
  Description of Artificial Sequence: Synthetic polypeptide
DEEEIRTTNPVATEQYGSVSSTPAGNMHNGMDPV

SEQ ID NO: 84909 - protein, 33 aa, Artificial Sequence
  Description of Artificial Sequence: Synthetic polypeptide
DEEEIRTTNPVATEQYGSVSPSNLEENASQEDI

SEQ ID NO: 84910 - protein, 30 aa, Artificial Sequence
  Description of Artificial Sequence: Synthetic polypeptide
AENEIACTNPVATEQYGEASETLQSRVGGR

SEQ ID NO: 84911 - protein, 33 aa, Artificial Sequence
  Description of Artificial Sequence: Synthetic polypeptide
DEEEIRTTNPVATEQYGSVSSTPAGNMHGMDPV

SEQ ID NO: 84912 - protein, 33 aa, Artificial Sequence
  Description of Artificial Sequence: Synthetic polypeptide
DEEEIRTTNPVATEQYGSVSPSWADTQGENNQE

SEQ ID NO: 84913 - protein, 36 aa, Artificial Sequence
  Description of Artificial Sequence: Synthetic polypeptide
DEEEIRTTNPVATEQYGSVSSTNPEGPNMRNGMNPV

SEQ ID NO: 84914 - protein, 36 aa, Artificial Sequence
  Description of Artificial Sequence: Synthetic polypeptide
DEEEIRTTNPVATEQYGSVSSTNPEGPNMRNGMNTS

SEQ ID NO: 84915 - protein, 33 aa, Artificial Sequence
  Description of Artificial Sequence: Synthetic polypeptide
DEAEIATTNPVATEQYGCVAANGDLQNDGNTRS

SEQ ID NO: 84916 - protein, 36 aa, Artificial Sequence
  Description of Artificial Sequence: Synthetic polypeptide
DEEEIRTTNPVATEQYGSVSSTNPMGPNMRNGMNPH

SEQ ID NO: 84917 - protein, 31 aa, Artificial Sequence
  Description of Artificial Sequence: Synthetic polypeptide
DEFVIRTTNPVATEQYGCVETDSPQTFGNQF

SEQ ID NO: 84918 - protein, 31 aa, Artificial Sequence
  Description of Artificial Sequence: Synthetic polypeptide
DEDEIRTTNPVAYEQWGSVSGENDGHEGGDR

SEQ ID NO: 84919 - protein, 32 aa, Artificial Sequence
  Description of Artificial Sequence: Synthetic polypeptide
DEDEIRTTNPVAYEQWGSVSGGDNLGQGGDEQ

SEQ ID NO: 84920 - protein, 33 aa, Artificial Sequence
  Description of Artificial Sequence: Synthetic polypeptide
DETEIRTTNPVAYEQWGSVSTNLNMEGEGNNND

SEQ ID NO: 84921 - protein, 30 aa, Artificial Sequence
  Description of Artificial Sequence: Synthetic polypeptide
AENEIRTTNPVSTEQYGEISMDIQQRNGGR

SEQ ID NO: 84922 - protein, 30 aa, Artificial Sequence
  Description of Artificial Sequence: Synthetic polypeptide
AENEIRTTNPVATEQWGDVSEILQNRAEDA

SEQ ID NO: 84923 - protein, 32 aa, Artificial Sequence
  Description of Artificial Sequence: Synthetic polypeptide
DEEEIRTTNPVSTEQYGSVVNGLEGQGGEQTT

SEQ ID NO: 84924 - protein, 31 aa, Artificial Sequence
  Description of Artificial Sequence: Synthetic polypeptide
DEAEIATTNPVATEQYGCVAANGVNDQDGND

SEQ ID NO: 84925 - protein, 33 aa, Artificial Sequence
  Description of Artificial Sequence: Synthetic polypeptide
DDEEIRTTNPVATEQYGCVCSTGNHQYFGSEQM

SEQ ID NO: 84926 - protein, 31 aa, Artificial Sequence
  Description of Artificial Sequence: Synthetic polypeptide
DEDEIRTTNPVATEQWGTNCSAALMNRGNDS

SEQ ID NO: 84927 - protein, 33 aa, Artificial Sequence
  Description of Artificial Sequence: Synthetic polypeptide
DDEEIRTTNPVATEQYGCVCSTGNHQNFGSQQS

SEQ ID NO: 84928 - protein, 29 aa, Artificial Sequence
  Description of Artificial Sequence: Synthetic peptide
AENEIRTTNPVSTEQYGTASMNIQQQGGH

SEQ ID NO: 84929 - protein, 34 aa, Artificial Sequence
  Description of Artificial Sequence: Synthetic polypeptide
DEEEIRTTNPVATEQYGSVSSTPACPNMRNGMEV

SEQ ID NO: 84930 - protein, 32 aa, Artificial Sequence
  Description of Artificial Sequence: Synthetic polypeptide
DEEEIRTTNPVSTEQYGSVVDGFNGQGQGEQT

SEQ ID NO: 84931 - protein, 33 aa, Artificial Sequence
  Description of Artificial Sequence: Synthetic polypeptide
DEEEIRTTNPVSTEQYGSVVASNALSQGTGGQT

SEQ ID NO: 84932 - protein, 28 aa, Artificial Sequence
  Description of Artificial Sequence: Synthetic peptide
AENEIACTNPVATEQYGEASEVCQRGEK

SEQ ID NO: 84933 - protein, 32 aa, Artificial Sequence
  Description of Artificial Sequence: Synthetic polypeptide
DEEEIRTTNPVSTEQYGSVTRFNDCQGEQNND

SEQ ID NO: 84934 - protein, 29 aa, Artificial Sequence
  Description of Artificial Sequence: Synthetic peptide
AENEIACTNPVATEQYGEASEVGLQVGGR

SEQ ID NO: 84935 - protein, 34 aa, Artificial Sequence
  Description of Artificial Sequence: Synthetic polypeptide
DEEEISTTNPVATEQYGCVCSNTAHQRFGSENQG

SEQ ID NO: 84936 - protein, 35 aa, Artificial Sequence
  Description of Artificial Sequence: Synthetic polypeptide
DEEEIRTTNPVATEQYGSVSPTATNQNLNMEVNEF

SEQ ID NO: 84937 - protein, 34 aa, Artificial Sequence
  Description of Artificial Sequence: Synthetic polypeptide
DEFEIWTTNPVATEQYGVMVCSTNLNQVGQGNAP

SEQ ID NO: 84938 - protein, 34 aa, Artificial Sequence
  Description of Artificial Sequence: Synthetic polypeptide
DEEEIRTVNPVATEQYGSVSPTLLVDSRNMQNDQ

SEQ ID NO: 84939 - protein, 34 aa, Artificial Sequence
  Description of Artificial Sequence: Synthetic polypeptide
DEEEIRTVNPVATEQYGSVSPTLLLVSRNEQNDW

SEQ ID NO: 84940 - protein, 32 aa, Artificial Sequence
  Description of Artificial Sequence: Synthetic polypeptide
DETSICTTNPCATEQWGSVSTNNNLQSGNNQD

SEQ ID NO: 84941 - protein, 32 aa, Artificial Sequence
  Description of Artificial Sequence: Synthetic polypeptide
DEDEIRTTNPVATEQYGCWSVIHPLERENQNN

SEQ ID NO: 84942 - protein, 31 aa, Artificial Sequence
  Description of Artificial Sequence: Synthetic polypeptide
DEAEIATTNPVATEQWGSVAMANALPAPGSR

SEQ ID NO: 84943 - protein, 30 aa, Artificial Sequence
  Description of Artificial Sequence: Synthetic polypeptide
DEAEIATTNPVATEQWGSVAMGNGDNNGND

SEQ ID NO: 84944 - protein, 33 aa, Artificial Sequence
  Description of Artificial Sequence: Synthetic polypeptide
DEEEIRTVNPVATEQYGSVSPTLLLVSRDAQDA

SEQ ID NO: 84945 - protein, 33 aa, Artificial Sequence
  Description of Artificial Sequence: Synthetic polypeptide
DEEEIRTVNPVATEQYGSVSPTLLIVNRNAQDN

SEQ ID NO: 84946 - protein, 33 aa, Artificial Sequence
  Description of Artificial Sequence: Synthetic polypeptide
DEDEIRTTNPVATEQYGCVSTVNLDERDSDQQS

SEQ ID NO: 84947 - protein, 33 aa, Artificial Sequence
  Description of Artificial Sequence: Synthetic polypeptide
DEEEIRTVNPVATEQYGSVSPTLLEVSRNAQQQ

SEQ ID NO: 84948 - protein, 35 aa, Artificial Sequence
  Description of Artificial Sequence: Synthetic polypeptide
DEEEIRTVNPVATEQYGSVHTDQTNELQYGNGNTI

SEQ ID NO: 84949 - protein, 33 aa, Artificial Sequence
  Description of Artificial Sequence: Synthetic polypeptide
DEYEIRTTNPVATEQYGSVSDANDAQLGQEDQN

SEQ ID NO: 84950 - protein, 32 aa, Artificial Sequence
  Description of Artificial Sequence: Synthetic polypeptide
DEFEIATVNPVATEQYGSVSWTEDLDIEGGNH

SEQ ID NO: 84951 - protein, 34 aa, Artificial Sequence
  Description of Artificial Sequence: Synthetic polypeptide
DEEEIRTVNPVATEQYGSTVVSCTRLSQITVGQE

SEQ ID NO: 84952 - protein, 32 aa, Artificial Sequence
  Description of Artificial Sequence: Synthetic polypeptide
DEEEIRTTNPVATESYGSVSTMEMTDGQGEGQ

SEQ ID NO: 84953 - protein, 32 aa, Artificial Sequence
  Description of Artificial Sequence: Synthetic polypeptide
DETSICTTNPCATEQWGSVSTNNNLQAGNNEG

SEQ ID NO: 84954 - protein, 32 aa, Artificial Sequence
  Description of Artificial Sequence: Synthetic polypeptide
DETSICTTNPCATEQWGSVSTNNNLNQSGNNV

SEQ ID NO: 84955 - protein, 34 aa, Artificial Sequence
  Description of Artificial Sequence: Synthetic polypeptide
DEEEIRTVNPVATEQYGSTVSCTTLSTRTVGQED

SEQ ID NO: 84956 - protein, 33 aa, Artificial Sequence
  Description of Artificial Sequence: Synthetic polypeptide
DEEEIRTTNPVATESYGSVSTDTEGMGNGNEEE

SEQ ID NO: 84957 - protein, 33 aa, Artificial Sequence
  Description of Artificial Sequence: Synthetic polypeptide
DEEEIRTVNPVATEQYGSTVSCTRDSQATVGQE

SEQ ID NO: 84958 - protein, 33 aa, Artificial Sequence
  Description of Artificial Sequence: Synthetic polypeptide
DEEEIRTVNPVATEQYGQCVCSTELQYFNSQQG

SEQ ID NO: 84959 - protein, 32 aa, Artificial Sequence
  Description of Artificial Sequence: Synthetic polypeptide
DEFEIATTNPVATEQYGSVSATDLEKHEGEDL

SEQ ID NO: 84960 - protein, 32 aa, Artificial Sequence
  Description of Artificial Sequence: Synthetic polypeptide
DEEEIRTVNPVATEQYGQCVCSTELQHNSQQA

SEQ ID NO: 84961 - protein, 32 aa, Artificial Sequence
  Description of Artificial Sequence: Synthetic polypeptide
DETSICTTNPCATEQWGSVSTNNNLQSGNTGG

SEQ ID NO: 84962 - protein, 32 aa, Artificial Sequence
  Description of Artificial Sequence: Synthetic polypeptide
DEFEIATTNPVATEQYGSVSATDLEDHEGEDL

SEQ ID NO: 84963 - protein, 34 aa, Artificial Sequence
  Description of Artificial Sequence: Synthetic polypeptide
DEEEIRTTNPVATESYGSVYTGNGQTGGNITGTG

SEQ ID NO: 84964 - protein, 32 aa, Artificial Sequence
  Description of Artificial Sequence: Synthetic polypeptide
DETSICTTNPCATEQWGSVSTNVNNLQSGNSG

SEQ ID NO: 84965 - protein, 31 aa, Artificial Sequence
  Description of Artificial Sequence: Synthetic polypeptide
DEEEIRTVNPVCTEQWGVVSDINEQSEGENG

SEQ ID NO: 84966 - protein, 33 aa, Artificial Sequence
  Description of Artificial Sequence: Synthetic polypeptide
DEYEIRTTNPVATEQYGSVIITETLQPEVVNFD

SEQ ID NO: 84967 - protein, 32 aa, Artificial Sequence
  Description of Artificial Sequence: Synthetic polypeptide
DEDEIRTTNPVATEQYGEMTSGNGGQGNGNDG

SEQ ID NO: 84968 - protein, 31 aa, Artificial Sequence
  Description of Artificial Sequence: Synthetic polypeptide
DEEEIRTVNPVCTECWGVVSDNLPQDSGENQ

SEQ ID NO: 84969 - protein, 30 aa, Artificial Sequence
  Description of Artificial Sequence: Synthetic polypeptide
AENEIACTNPVATEQYGEASSNLQRGSDQA

SEQ ID NO: 84970 - protein, 35 aa, Artificial Sequence
  Description of Artificial Sequence: Synthetic polypeptide
DEEEIRTTNPVATESYGSVYSTNCIMQKCIGNIEY

SEQ ID NO: 84971 - protein, 31 aa, Artificial Sequence
  Description of Artificial Sequence: Synthetic polypeptide
DEEEIRTVNPVCTECWGVVSDNLPQDSGENG

SEQ ID NO: 84972 - protein, 31 aa, Artificial Sequence
  Description of Artificial Sequence: Synthetic polypeptide
DEFCIGTTNPVAYEADGSVSCTDELSQRVNR

SEQ ID NO: 84973 - protein, 32 aa, Artificial Sequence
  Description of Artificial Sequence: Synthetic polypeptide
DEEEIRTVNPVCTECWGSVSCNLPQDSEGENG

SEQ ID NO: 84974 - protein, 30 aa, Artificial Sequence
  Description of Artificial Sequence: Synthetic polypeptide
DDSEVASTNPVATEQYGNVAANTIQSRGNR

SEQ ID NO: 84975 - protein, 31 aa, Artificial Sequence
  Description of Artificial Sequence: Synthetic polypeptide
DDSEVASTNPVATEQYGSVAANTIQSRVGNR

SEQ ID NO: 84976 - protein, 33 aa, Artificial Sequence
  Description of Artificial Sequence: Synthetic polypeptide
DEEEIRTVNPVAYEQYGSTVSCTRALSQRTVQE

SEQ ID NO: 84977 - protein, 33 aa, Artificial Sequence
  Description of Artificial Sequence: Synthetic polypeptide
DEDEIRTTNPVATEQYGELSATNTLWQEEGQDT

SEQ ID NO: 84978 - protein, 33 aa, Artificial Sequence
  Description of Artificial Sequence: Synthetic polypeptide
DEDEIRTTNPVATEQYGELCSTNLEPEGNDDIA

SEQ ID NO: 84979 - protein, 34 aa, Artificial Sequence
  Description of Artificial Sequence: Synthetic polypeptide
DDEEIRTTNPVATEQYGSVDSGTGDQGGNGNVGE

SEQ ID NO: 84980 - protein, 32 aa, Artificial Sequence
  Description of Artificial Sequence: Synthetic polypeptide
DEDEIRTTNPVATEQYGEFSTTNLNLEGGEDS

SEQ ID NO: 84981 - protein, 36 aa, Artificial Sequence
  Description of Artificial Sequence: Synthetic polypeptide
DEEEIRTTNPVATEQYGSVSSTMPAGPQMRNGMNPH

SEQ ID NO: 84982 - protein, 33 aa, Artificial Sequence
  Description of Artificial Sequence: Synthetic polypeptide
DEDEIRTTNPVATEQYGECTSTNTLQPEGEDSF

SEQ ID NO: 84983 - protein, 32 aa, Artificial Sequence
  Description of Artificial Sequence: Synthetic polypeptide
DEFEIATTNPVATEQYGSVSATDLEDHEGEDF

SEQ ID NO: 84984 - protein, 31 aa, Artificial Sequence
  Description of Artificial Sequence: Synthetic polypeptide
DEAEIATTNPVATEQWGCVADTWLDQRSQNS

SEQ ID NO: 84985 - protein, 32 aa, Artificial Sequence
  Description of Artificial Sequence: Synthetic polypeptide
DEFEICTVNPVATEQYGCVSTNELEFPEGFNH

SEQ ID NO: 84986 - protein, 33 aa, Artificial Sequence
  Description of Artificial Sequence: Synthetic polypeptide
DEEEIRTVNPVATEQYGCVCSTTELQHFNSQQA

SEQ ID NO: 84987 - protein, 32 aa, Artificial Sequence
  Description of Artificial Sequence: Synthetic polypeptide
DEDEIRTTNPVATEQYGCTCSTENHQNGSDQS

SEQ ID NO: 84988 - protein, 32 aa, Artificial Sequence
  Description of Artificial Sequence: Synthetic polypeptide
DEFEICTVNPVAYEQYGSVVSCTNLSTEVGNH

SEQ ID NO: 84989 - protein, 33 aa, Artificial Sequence
  Description of Artificial Sequence: Synthetic polypeptide
DEFEIRATNPVAYEQYGSVSTTLRIAQNDDNSR

SEQ ID NO: 84990 - protein, 33 aa, Artificial Sequence
  Description of Artificial Sequence: Synthetic polypeptide
DEFEIRTTNPVATECAGSVSCINEPQDREGENG

SEQ ID NO: 84991 - protein, 29 aa, Artificial Sequence
  Description of Artificial Sequence: Synthetic peptide
DETGIRTTNPCATEQWGSRSVNEQVENNV

SEQ ID NO: 84992 - protein, 33 aa, Artificial Sequence
  Description of Artificial Sequence: Synthetic polypeptide
DEFEIRTTNPVATECWGSVSCINEPQDREGENG

SEQ ID NO: 84993 - protein, 33 aa, Artificial Sequence
  Description of Artificial Sequence: Synthetic polypeptide
DEEEIRTTNPVATESYGSVMGENDQGGGEFNGG

SEQ ID NO: 84994 - protein, 31 aa, Artificial Sequence
  Description of Artificial Sequence: Synthetic polypeptide
DEFEISTVNPVATEQYGCVCSTNHFNFGGNQ

SEQ ID NO: 84995 - protein, 34 aa, Artificial Sequence
  Description of Artificial Sequence: Synthetic polypeptide
DEAEIATTNPVATEQWGSVSTDGPLGQHGDNSRP

SEQ ID NO: 84996 - protein, 32 aa, Artificial Sequence
  Description of Artificial Sequence: Synthetic polypeptide
DEEEIRTTNPVSYEQYGSVCFCFNLSQGVGQT

SEQ ID NO: 84997 - protein, 32 aa, Artificial Sequence
  Description of Artificial Sequence: Synthetic polypeptide
DEEEIRTTNPVSYEQYGSTVPAENLSQGGGQT

SEQ ID NO: 84998 - protein, 32 aa, Artificial Sequence
  Description of Artificial Sequence: Synthetic polypeptide
DEEEIRTTNPVSYEQYGSTVCFNALSQGGGMT

SEQ ID NO: 84999 - protein, 32 aa, Artificial Sequence
  Description of Artificial Sequence: Synthetic polypeptide
DEEEIRTTNPVSYEQYGCVCCFNLSQGGGQNT

SEQ ID NO: 85000 - protein, 33 aa, Artificial Sequence
  Description of Artificial Sequence: Synthetic polypeptide
DETEIRTTNPVSTEQYGSVSTDNGQGEGGQSGG

SEQ ID NO: 85001 - protein, 31 aa, Artificial Sequence
  Description of Artificial Sequence: Synthetic polypeptide
DEEEIRTTNPVSYEAYGSVCCQNLSQGGGQT

SEQ ID NO: 85002 - protein, 29 aa, Artificial Sequence
  Description of Artificial Sequence: Synthetic peptide
AENEIRTTNPVATEPYGTISMDIQQQGNH

SEQ ID NO: 85003 - protein, 32 aa, Artificial Sequence
  Description of Artificial Sequence: Synthetic polypeptide
DETEIRTTNPVAYERWGSVSTNLQGDLNNGGS

SEQ ID NO: 85004 - protein, 32 aa, Artificial Sequence
  Description of Artificial Sequence: Synthetic polypeptide
DETEIRTTNPVAYERWGSVATNLQGDHGNNGS

SEQ ID NO: 85005 - protein, 32 aa, Artificial Sequence
  Description of Artificial Sequence: Synthetic polypeptide
AENEIRTTNPVATEQWGATAWSNANLQRGGYR

SEQ ID NO: 85006 - protein, 33 aa, Artificial Sequence
  Description of Artificial Sequence: Synthetic polypeptide
DDEEIRTTNPVATEQYGDVSSTQGQGTGNGNGD

SEQ ID NO: 85007 - protein, 32 aa, Artificial Sequence
  Description of Artificial Sequence: Synthetic polypeptide
AENEIRTTNPVATEQWGATAWSNENLQRGGYR

SEQ ID NO: 85008 - protein, 34 aa, Artificial Sequence
  Description of Artificial Sequence: Synthetic polypeptide
DDEEIRTTNPVATEQYGDVSITDDNGQGIGEGNT

SEQ ID NO: 85009 - protein, 29 aa, Artificial Sequence
  Description of Artificial Sequence: Synthetic peptide
DETGIRTTNPCATEQWGSRSVNEVSGTRQ

SEQ ID NO: 85010 - protein, 32 aa, Artificial Sequence
  Description of Artificial Sequence: Synthetic polypeptide
DEFEICTVNPVAYEQYGSVPSTNELSTEGGNE

SEQ ID NO: 85011 - protein, 31 aa, Artificial Sequence
  Description of Artificial Sequence: Synthetic polypeptide
DETGIRTTNPCATEQWGSRVSVNPEQVENNR

SEQ ID NO: 85012 - protein, 34 aa, Artificial Sequence
  Description of Artificial Sequence: Synthetic polypeptide
DEEEIRTTNPVATESYGSVMGTNDQGGGEDNNGG

SEQ ID NO: 85013 - protein, 30 aa, Artificial Sequence
  Description of Artificial Sequence: Synthetic polypeptide
AENEIACTNPVATEQYGEASSEPNLQRGGV

SEQ ID NO: 85014 - protein, 31 aa, Artificial Sequence
  Description of Artificial Sequence: Synthetic polypeptide
DEFEICTVNPVATEQYGSVSTELEFPEDFNH

SEQ ID NO: 85015 - protein, 33 aa, Artificial Sequence
  Description of Artificial Sequence: Synthetic polypeptide
DEEEIRTVNPVATEQYGCVCSTGPLQNFNSQQS

SEQ ID NO: 85016 - protein, 32 aa, Artificial Sequence
  Description of Artificial Sequence: Synthetic polypeptide
DEEEIRTVNPVATEQYGCVCSTGEHQRNSQQG

SEQ ID NO: 85017 - protein, 32 aa, Artificial Sequence
  Description of Artificial Sequence: Synthetic polypeptide
DEFEICTVNPVATEQYGSVSTINLEFPEGEHN

SEQ ID NO: 85018 - protein, 32 aa, Artificial Sequence
  Description of Artificial Sequence: Synthetic polypeptide
DEEEIRTVNPVATEQYGCVCSTEPQNFNSQAA

SEQ ID NO: 85019 - protein, 32 aa, Artificial Sequence
  Description of Artificial Sequence: Synthetic polypeptide
DEFEICTVNPVATEQYGSVSTLNTLFEGFEHD

SEQ ID NO: 85020 - protein, 31 aa, Artificial Sequence
  Description of Artificial Sequence: Synthetic polypeptide
DEFEICTVNPVATEQYGSVSTNLEFEEPEHP

SEQ ID NO: 85021 - protein, 32 aa, Artificial Sequence
  Description of Artificial Sequence: Synthetic polypeptide
DEEEIRTVNPVATEQYGCVCSTEHQNSNSQQG

SEQ ID NO: 85022 - protein, 29 aa, Artificial Sequence
  Description of Artificial Sequence: Synthetic peptide
DETSIATTNPTAYEQWGSVSFNWDSGGNR

SEQ ID NO: 85023 - protein, 33 aa, Artificial Sequence
  Description of Artificial Sequence: Synthetic polypeptide
DEFETCTVNPVATEQYGSVSWNIDQDERDGNHR

SEQ ID NO: 85024 - protein, 30 aa, Artificial Sequence
  Description of Artificial Sequence: Synthetic polypeptide
DETSIATTNPTAYEQWGSVSFNGDHQSGNR

SEQ ID NO: 85025 - protein, 32 aa, Artificial Sequence
  Description of Artificial Sequence: Synthetic polypeptide
DEEEIRTVNPVATEQYGCVCSTEDLQNNSQQG

SEQ ID NO: 85026 - protein, 31 aa, Artificial Sequence
  Description of Artificial Sequence: Synthetic polypeptide
DETSIATTNPLTTEQWGSVSLANLQSGDNRM

SEQ ID NO: 85027 - protein, 28 aa, Artificial Sequence
  Description of Artificial Sequence: Synthetic peptide
DETSIACTNPLTTAQWGSVAANLQDGNR

SEQ ID NO: 85028 - protein, 34 aa, Artificial Sequence
  Description of Artificial Sequence: Synthetic polypeptide
DDEEIRTTNPVATEQYGQCVCSTGNHQNFGSNQD

SEQ ID NO: 85029 - protein, 33 aa, Artificial Sequence
  Description of Artificial Sequence: Synthetic polypeptide
DDEEIRTTNPVATEQYGQCVCSTELQYFGSDQS

SEQ ID NO: 85030 - protein, 29 aa, Artificial Sequence
  Description of Artificial Sequence: Synthetic peptide
AENEIRTTNPVATECWGEAAENLQPKGGR

SEQ ID NO: 85031 - protein, 32 aa, Artificial Sequence
  Description of Artificial Sequence: Synthetic polypeptide
DEFEICTVNPVATEQYGSVSWTNDLDEKGGDH

SEQ ID NO: 85032 - protein, 30 aa, Artificial Sequence
  Description of Artificial Sequence: Synthetic polypeptide
DETGIRTTNPCATEQWGSVSVNEVPSSGTR

SEQ ID NO: 85033 - protein, 31 aa, Artificial Sequence
  Description of Artificial Sequence: Synthetic polypeptide
DEFEICTVNPVAYEAYGSVSTNELSTEGGNS

SEQ ID NO: 85034 - protein, 29 aa, Artificial Sequence
  Description of Artificial Sequence: Synthetic peptide
AENEIRTTNPVATECWGETAENLQPKGGR

SEQ ID NO: 85035 - protein, 30 aa, Artificial Sequence
  Description of Artificial Sequence: Synthetic polypeptide
DETSIATTNPTAYEQWGSVSFNDQSNGGNR

SEQ ID NO: 85036 - protein, 34 aa, Artificial Sequence
  Description of Artificial Sequence: Synthetic polypeptide
DEDEIRTTNPVATEQYGSVSTTNTQQQEGEEEQQ

SEQ ID NO: 85037 - protein, 35 aa, Artificial Sequence
  Description of Artificial Sequence: Synthetic polypeptide
DEETIRTTNPVATEQYGVVSVTTNQQLQIGNNEEV

SEQ ID NO: 85038 - protein, 33 aa, Artificial Sequence
  Description of Artificial Sequence: Synthetic polypeptide
DEEEISTTNPVATEQYGCVCSNTALQNFGSDQA

SEQ ID NO: 85039 - protein, 32 aa, Artificial Sequence
  Description of Artificial Sequence: Synthetic polypeptide
DEAEIACTNPVATEQYGSVATPNLTQDGGDDD

SEQ ID NO: 85040 - protein, 31 aa, Artificial Sequence
  Description of Artificial Sequence: Synthetic polypeptide
AENEIACTNPVATEQYGEQAISENLQRGTMR

SEQ ID NO: 85041 - protein, 36 aa, Artificial Sequence
  Description of Artificial Sequence: Synthetic polypeptide
DEDEIRTTNPVATEQYGSVSTSNNNLQFGNNNNEDE

SEQ ID NO: 85042 - protein, 32 aa, Artificial Sequence
  Description of Artificial Sequence: Synthetic polypeptide
DEEEISTTNPVATEQYGCVCSTEHQNFSENQA

SEQ ID NO: 85043 - protein, 34 aa, Artificial Sequence
  Description of Artificial Sequence: Synthetic polypeptide
DEEEIRTTNPVATEQYGSVSSEPAGNMRAGMNPV

SEQ ID NO: 85044 - protein, 33 aa, Artificial Sequence
  Description of Artificial Sequence: Synthetic polypeptide
DEETEIATTNPVAYEQWGSVSTNLQAQGGMGDT

SEQ ID NO: 85045 - protein, 34 aa, Artificial Sequence
  Description of Artificial Sequence: Synthetic polypeptide
DEETEIATTNPVAYEQWGSVSTNLQGDAGNNEEE

SEQ ID NO: 85046 - protein, 32 aa, Artificial Sequence
  Description of Artificial Sequence: Synthetic polypeptide
DEEEISTTNPVATEQYGCVCSTEHQNFNNEQA

SEQ ID NO: 85047 - protein, 34 aa, Artificial Sequence
  Description of Artificial Sequence: Synthetic polypeptide
DEEEIRTTNPVATEQYGSVSSEPAGPNMRAGMNV

SEQ ID NO: 85048 - protein, 34 aa, Artificial Sequence
  Description of Artificial Sequence: Synthetic polypeptide
DEEEIRTTNPVATEQYGSVSSEPAGPNRNGMNPV

SEQ ID NO: 85049 - protein, 34 aa, Artificial Sequence
  Description of Artificial Sequence: Synthetic polypeptide
DEEEIRTTNPVATEQYGSVSSEPAGPQRNGMEPK

SEQ ID NO: 85050 - protein, 32 aa, Artificial Sequence
  Description of Artificial Sequence: Synthetic polypeptide
DEEEISTTNPVATEQYGCVCSTEHQHSNSNQQ

SEQ ID NO: 85051 - protein, 35 aa, Artificial Sequence
  Description of Artificial Sequence: Synthetic polypeptide
DEDEIRTTNPVATEQYGSVSTQNNQLAGNNNNNSE

SEQ ID NO: 85052 - protein, 29 aa, Artificial Sequence
  Description of Artificial Sequence: Synthetic peptide
AENEIATTNPVSTEPYGEASMNIQQRGNH

SEQ ID NO: 85053 - protein, 36 aa, Artificial Sequence
  Description of Artificial Sequence: Synthetic polypeptide
DEDEIRTTNPVATEQYGSVSTQNNNLQAGNNNNQDQ

SEQ ID NO: 85054 - protein, 32 aa, Artificial Sequence
  Description of Artificial Sequence: Synthetic polypeptide
DEEEISTTNPVATEQYGCVCSTEHQENNSQQS

SEQ ID NO: 85055 - protein, 33 aa, Artificial Sequence
  Description of Artificial Sequence: Synthetic polypeptide
DEEEISTTNPVATEQYGCVCSTEHNQNFGSDNQ

SEQ ID NO: 85056 - protein, 36 aa, Artificial Sequence
  Description of Artificial Sequence: Synthetic polypeptide
DEEEIRTTNPVATEQYGSVSSFTPAGPNLRVGMNPV

SEQ ID NO: 85057 - protein, 32 aa, Artificial Sequence
  Description of Artificial Sequence: Synthetic polypeptide
DEETICTTNPVATEFYGSVDNTNTGQGEGGND

SEQ ID NO: 85058 - protein, 32 aa, Artificial Sequence
  Description of Artificial Sequence: Synthetic polypeptide
DEEEISTTNPVATEQYGCVCSTEHFQNGSEQV

SEQ ID NO: 85059 - protein, 32 aa, Artificial Sequence
  Description of Artificial Sequence: Synthetic polypeptide
DEEEISTTNPVATEQYGCVCSTEHAGGSNNQS

SEQ ID NO: 85060 - protein, 32 aa, Artificial Sequence
  Description of Artificial Sequence: Synthetic polypeptide
DEESIRTVNPVATERYGCISLTNLEPSFGNRM

SEQ ID NO: 85061 - protein, 30 aa, Artificial Sequence
  Description of Artificial Sequence: Synthetic polypeptide
AENEIATTNPVSTEQYGEASEEDLQQRGNH

SEQ ID NO: 85062 - protein, 36 aa, Artificial Sequence
  Description of Artificial Sequence: Synthetic polypeptide
DEEEIRTTNPVATEQYGSVSPTMGLNQPQLGEIFRQ

SEQ ID NO: 85063 - protein, 34 aa, Artificial Sequence
  Description of Artificial Sequence: Synthetic polypeptide
DEEEIRTTNPVATEQYGSVSSENIQNSNEEVTSM

SEQ ID NO: 85064 - protein, 33 aa, Artificial Sequence
  Description of Artificial Sequence: Synthetic polypeptide
DEVEIRTTNPVATEQYGSVSTTANGMGNDGEQE

SEQ ID NO: 85065 - protein, 31 aa, Artificial Sequence
  Description of Artificial Sequence: Synthetic polypeptide
DEEEISTTNPVATEQYGCVCSTELANNSEQA

SEQ ID NO: 85066 - protein, 33 aa, Artificial Sequence
  Description of Artificial Sequence: Synthetic polypeptide
DEEEIRTTNPVAYEQYGCVCSNTNHQNFGSQQE

SEQ ID NO: 85067 - protein, 34 aa, Artificial Sequence
  Description of Artificial Sequence: Synthetic polypeptide
DEEEIRTTNPVATEQYGSVSPTMNEMQIHEFTEE

SEQ ID NO: 85068 - protein, 28 aa, Artificial Sequence
  Description of Artificial Sequence: Synthetic peptide
AENEIATTNPVATESYGCVSEDLQHEEL

SEQ ID NO: 85069 - protein, 32 aa, Artificial Sequence
  Description of Artificial Sequence: Synthetic polypeptide
DEVEIATTNPVATENYGCVSTNGNQGADGDSR

SEQ ID NO: 85070 - protein, 31 aa, Artificial Sequence
  Description of Artificial Sequence: Synthetic polypeptide
AENEIACTNPVATEQYGESCSENNLQRIGGQ

SEQ ID NO: 85071 - protein, 32 aa, Artificial Sequence
  Description of Artificial Sequence: Synthetic polypeptide
DEESIMTTNPVATECYGSVNTLNTLEQGGQFM

SEQ ID NO: 85072 - protein, 33 aa, Artificial Sequence
  Description of Artificial Sequence: Synthetic polypeptide
DEVEIRTTNPVATEQYGSVSTTGDQGNGGGEQG

SEQ ID NO: 85073 - protein, 34 aa, Artificial Sequence
  Description of Artificial Sequence: Synthetic polypeptide
DEDEIRTTNPVATEQYGSVSTTNAGNQNNDMNQP

SEQ ID NO: 85074 - protein, 34 aa, Artificial Sequence
  Description of Artificial Sequence: Synthetic polypeptide
DEDEIRTTNPVATEQYGSVSTTNAGNQNDTGGMP

SEQ ID NO: 85075 - protein, 34 aa, Artificial Sequence
  Description of Artificial Sequence: Synthetic polypeptide
DEDEIRTTNPVATEQYGSVSTTNAGNQNDMNGPD

SEQ ID NO: 85076 - protein, 32 aa, Artificial Sequence
  Description of Artificial Sequence: Synthetic polypeptide
DEAEIACTNPVATEQYGSVATNLTANPGDSRD

SEQ ID NO: 85077 - protein, 33 aa, Artificial Sequence
  Description of Artificial Sequence: Synthetic polypeptide
DEESIMTTNPVATECYGSVTNTNTLQEIGNNME

SEQ ID NO: 85078 - protein, 34 aa, Artificial Sequence
  Description of Artificial Sequence: Synthetic polypeptide
DEEEIRTTNPVATEQYGSVSSDVSPQTHIEGNQI

SEQ ID NO: 85079 - protein, 32 aa, Artificial Sequence
  Description of Artificial Sequence: Synthetic polypeptide
DEEEISTTNPVATEQYGCVCSTEHQSFGSDQF

SEQ ID NO: 85080 - protein, 32 aa, Artificial Sequence
  Description of Artificial Sequence: Synthetic polypeptide
DEDEIRTTNPVAYEQWGSVCSGDNDGHEGGNR

SEQ ID NO: 85081 - protein, 35 aa, Artificial Sequence
  Description of Artificial Sequence: Synthetic polypeptide
DEVEIRTTNPVATEQYGSVSTTNGNEGNHTGDNGR

SEQ ID NO: 85082 - protein, 32 aa, Artificial Sequence
  Description of Artificial Sequence: Synthetic polypeptide
DEESIRTTNPVATEGFGSVSTTNLAGITQGRD

SEQ ID NO: 85083 - protein, 34 aa, Artificial Sequence
  Description of Artificial Sequence: Synthetic polypeptide
DEESIRTTNPVATEQWGSVSIANHSHRTPGDNLR

SEQ ID NO: 85084 - protein, 28 aa, Artificial Sequence
  Description of Artificial Sequence: Synthetic peptide
AENEIATTNPVSTEPYGEASENIQRGGH

SEQ ID NO: 85085 - protein, 31 aa, Artificial Sequence
  Description of Artificial Sequence: Synthetic polypeptide
DEAEIACTNPVATEQYGSVATNLTENPNDSP

SEQ ID NO: 85086 - protein, 32 aa, Artificial Sequence
  Description of Artificial Sequence: Synthetic polypeptide
DEEEISTTNPVATEQYGCVCSTELINFNSDQV

SEQ ID NO: 85087 - protein, 31 aa, Artificial Sequence
  Description of Artificial Sequence: Synthetic polypeptide
DEETICTTNPVATEFYGSVNGFNTGQGEGNI

SEQ ID NO: 85088 - protein, 32 aa, Artificial Sequence
  Description of Artificial Sequence: Synthetic polypeptide
DEEEISTTNPVATEQYGCVCSTEHAFSGSNQP

SEQ ID NO: 85089 - protein, 30 aa, Artificial Sequence
  Description of Artificial Sequence: Synthetic polypeptide
AENEIAVTNPVATEQYGEASENLQRGEGGQ

SEQ ID NO: 85090 - protein, 34 aa, Artificial Sequence
  Description of Artificial Sequence: Synthetic polypeptide
DEETIRATNPVATEQYGSVSTVNNNQQLGNNNLE

SEQ ID NO: 85091 - protein, 35 aa, Artificial Sequence
  Description of Artificial Sequence: Synthetic polypeptide
DEETIRATNPVATEQYGSVSTVNNQQLQNEGNNQL

SEQ ID NO: 85092 - protein, 28 aa, Artificial Sequence
  Description of Artificial Sequence: Synthetic peptide
AENEIACTNPVATEQYGEMSENRQMGDG

SEQ ID NO: 85093 - protein, 29 aa, Artificial Sequence
  Description of Artificial Sequence: Synthetic peptide
AENEIAVTNPVATEQYGEASETEQRGEGR

SEQ ID NO: 85094 - protein, 32 aa, Artificial Sequence
  Description of Artificial Sequence: Synthetic polypeptide
DEEEISTTNPVATEQYGCVCSTEDQHFNSDQM

SEQ ID NO: 85095 - protein, 34 aa, Artificial Sequence
  Description of Artificial Sequence: Synthetic polypeptide
DEEEIRTTNPVATEQYGSVSSLANSSPSDENNRE

SEQ ID NO: 85096 - protein, 34 aa, Artificial Sequence
  Description of Artificial Sequence: Synthetic polypeptide
DEEEIRTTNPVATEQYGSVSPTLPDEQHIMSNEE

SEQ ID NO: 85097 - protein, 34 aa, Artificial Sequence
  Description of Artificial Sequence: Synthetic polypeptide
DEDEIRTTNPVATEQYGSVSTMLDSIESDQENRF

SEQ ID NO: 85098 - protein, 35 aa, Artificial Sequence
  Description of Artificial Sequence: Synthetic polypeptide
DEDEIRTTNPVATEQYGSVSTIMLEELRNGNEEVF

SEQ ID NO: 85099 - protein, 35 aa, Artificial Sequence
  Description of Artificial Sequence: Synthetic polypeptide
DEETIRATNPVATEQYGSVSTVNQNLQPGNNNQLG

SEQ ID NO: 85100 - protein, 35 aa, Artificial Sequence
  Description of Artificial Sequence: Synthetic polypeptide
DEEEIRTTNPVATEQYGSVSPTLPDAEQHGMNNQV

SEQ ID NO: 85101 - protein, 34 aa, Artificial Sequence
  Description of Artificial Sequence: Synthetic polypeptide
DEETIRATNPVATEQYGSVSTVTNNEQQGNNQLT

SEQ ID NO: 85102 - protein, 35 aa, Artificial Sequence
  Description of Artificial Sequence: Synthetic polypeptide
DEEEIRTTNPVATEQYGSVSPTLPAAEQLGMNNQE

SEQ ID NO: 85103 - protein, 31 aa, Artificial Sequence
  Description of Artificial Sequence: Synthetic polypeptide
DDEEISTTNPVATCQYGCVCSTGNPTRGSEQ

SEQ ID NO: 85104 - protein, 33 aa, Artificial Sequence
  Description of Artificial Sequence: Synthetic polypeptide
DEEEIRTTNPVAYEQYGCVCSTEDHQRFNSNQA

SEQ ID NO: 85105 - protein, 33 aa, Artificial Sequence
  Description of Artificial Sequence: Synthetic polypeptide
DEETIRTTNPVACEQYGQVPSVPINVVQRGVNN

SEQ ID NO: 85106 - protein, 29 aa, Artificial Sequence
  Description of Artificial Sequence: Synthetic peptide
AENEICATNPVATEQYGEVANENLQAGGT

SEQ ID NO: 85107 - protein, 29 aa, Artificial Sequence
  Description of Artificial Sequence: Synthetic peptide
AENEICATNPVATEQYGEVASELLQLGGT

SEQ ID NO: 85108 - protein, 30 aa, Artificial Sequence
  Description of Artificial Sequence: Synthetic polypeptide
AENEICATNPVATEQYGEVATSENLQDGGI

SEQ ID NO: 85109 - protein, 31 aa, Artificial Sequence
  Description of Artificial Sequence: Synthetic polypeptide
DEETIRTTNPVAGEQYGVVSTIEVVQANVNN

SEQ ID NO: 85110 - protein, 32 aa, Artificial Sequence
  Description of Artificial Sequence: Synthetic polypeptide
DEVEIATTNPVATECYGVVSWNDEGLQNGGND

SEQ ID NO: 85111 - protein, 32 aa, Artificial Sequence
  Description of Artificial Sequence: Synthetic polypeptide
DEETICTTNPVATEFYGSVNTDNTGQGEGGNI

SEQ ID NO: 85112 - protein, 28 aa, Artificial Sequence
  Description of Artificial Sequence: Synthetic peptide
AENEIACTNPVATEQYGEMSETLQHGDI

SEQ ID NO: 85113 - protein, 33 aa, Artificial Sequence
  Description of Artificial Sequence: Synthetic polypeptide
DEAEIACTNPVATEQYGSVCTNLQNIGNDTALH

SEQ ID NO: 85114 - protein, 32 aa, Artificial Sequence
  Description of Artificial Sequence: Synthetic polypeptide
DEETICTTNPVATEFYGSVNTQNTGQGEEGNI

SEQ ID NO: 85115 - protein, 35 aa, Artificial Sequence
  Description of Artificial Sequence: Synthetic polypeptide
DEEEIRTTNPVATEQYGSVSPTLVVMDQRMVENED

SEQ ID NO: 85116 - protein, 34 aa, Artificial Sequence
  Description of Artificial Sequence: Synthetic polypeptide
DEEEIRTTNPVATEQYGSVSPTLVLQQAVEEVDY

SEQ ID NO: 85117 - protein, 32 aa, Artificial Sequence
  Description of Artificial Sequence: Synthetic polypeptide
DEETICTTNPVATEQYGQSVNIMNGQGGDNGD

SEQ ID NO: 85118 - protein, 33 aa, Artificial Sequence
  Description of Artificial Sequence: Synthetic polypeptide
DEEEIRTTNPVATEQYGSVSSGDAMVGGGNENT

SEQ ID NO: 85119 - protein, 33 aa, Artificial Sequence
  Description of Artificial Sequence: Synthetic polypeptide
DEEEIRTTNPVATEQYGSVSSGGGQGGEGEQGQ

SEQ ID NO: 85120 - protein, 32 aa, Artificial Sequence
  Description of Artificial Sequence: Synthetic polypeptide
DEEEISTTNPVATEQYGCVCSTEELQNNSDAD

SEQ ID NO: 85121 - protein, 33 aa, Artificial Sequence
  Description of Artificial Sequence: Synthetic polypeptide
DEEEISTTNPVATEQYGCVCSTEELQNFNSEQS

SEQ ID NO: 85122 - protein, 32 aa, Artificial Sequence
  Description of Artificial Sequence: Synthetic polypeptide
DDEEISTTNPVATCQYGSVCSTNPINFGSNQG

SEQ ID NO: 85123 - protein, 35 aa, Artificial Sequence
  Description of Artificial Sequence: Synthetic polypeptide
DEEEIRTTNPVATEQYGSVSSGTGDEGQGGENDED

SEQ ID NO: 85124 - protein, 30 aa, Artificial Sequence
  Description of Artificial Sequence: Synthetic polypeptide
DDEEISTTNPVATCQYGCVSTNPINFISNQ

SEQ ID NO: 85125 - protein, 34 aa, Artificial Sequence
  Description of Artificial Sequence: Synthetic polypeptide
DEVEIRTTNPVATEQYGSVSTVGDGQGGQENEQG

SEQ ID NO: 85126 - protein, 34 aa, Artificial Sequence
  Description of Artificial Sequence: Synthetic polypeptide
DEEEISTTNPVATEQYGCVCSTEELNQNFGSNQV

SEQ ID NO: 85127 - protein, 29 aa, Artificial Sequence
  Description of Artificial Sequence: Synthetic peptide
AENEIATTNPVSTEQYGTASENLQQQGGH

SEQ ID NO: 85128 - protein, 33 aa, Artificial Sequence
  Description of Artificial Sequence: Synthetic polypeptide
DEEEISTTNPVATEQYGCVCSTEELNQNFGSDQ

SEQ ID NO: 85129 - protein, 32 aa, Artificial Sequence
  Description of Artificial Sequence: Synthetic polypeptide
DEEEIRTTNPVAYEQYGCVCSSELQNFNSNQF

SEQ ID NO: 85130 - protein, 34 aa, Artificial Sequence
  Description of Artificial Sequence: Synthetic polypeptide
DEEEIRTTNPVATEQYGSVSPTLTEELFGLANEI

SEQ ID NO: 85131 - protein, 29 aa, Artificial Sequence
  Description of Artificial Sequence: Synthetic peptide
AENEIATTNPVSTEQYGTASMNLQQQGGH

SEQ ID NO: 85132 - protein, 32 aa, Artificial Sequence
  Description of Artificial Sequence: Synthetic polypeptide
DEEEISTTNPVATEQYGCVCSTEDQNFGSDQI

SEQ ID NO: 85133 - protein, 30 aa, Artificial Sequence
  Description of Artificial Sequence: Synthetic polypeptide
AENEIAVTNPVATEQYGEASENELQVGEGR

SEQ ID NO: 85134 - protein, 30 aa, Artificial Sequence
  Description of Artificial Sequence: Synthetic polypeptide
DDEEISTTNPVATCQYGCVSTEPIGFGSNQ

SEQ ID NO: 85135 - protein, 33 aa, Artificial Sequence
  Description of Artificial Sequence: Synthetic polypeptide
DEAEIACTNPVATEQYGSVSTGNLQDVGDLGAV

SEQ ID NO: 85136 - protein, 34 aa, Artificial Sequence
  Description of Artificial Sequence: Synthetic polypeptide
DEEEISTTNPVATEQYGCVCSTELNQESFGSNQV

SEQ ID NO: 85137 - protein, 33 aa, Artificial Sequence
  Description of Artificial Sequence: Synthetic polypeptide
DEEEISTTNPVATEQYGCVCSTELNQNFGSEIA

SEQ ID NO: 85138 - protein, 34 aa, Artificial Sequence
  Description of Artificial Sequence: Synthetic polypeptide
DEEEISTTNPVATEQYGCVCSTELNQNFGSNNQG

SEQ ID NO: 85139 - protein, 34 aa, Artificial Sequence
  Description of Artificial Sequence: Synthetic polypeptide
DEEEISTTNPVATEQYGCVCSTEYLQNFGSENQS

SEQ ID NO: 85140 - protein, 31 aa, Artificial Sequence
  Description of Artificial Sequence: Synthetic polypeptide
AENEIATTNPVATEQYGEVSAENLQDHGGDL

SEQ ID NO: 85141 - protein, 32 aa, Artificial Sequence
  Description of Artificial Sequence: Synthetic polypeptide
DEEEISTTNPVATEQYGCVCSTETNQNGSEQA

SEQ ID NO: 85142 - protein, 33 aa, Artificial Sequence
  Description of Artificial Sequence: Synthetic polypeptide
DEEEISTTNPVATEQYGCVCSTESLQNFGSEQG

SEQ ID NO: 85143 - protein, 33 aa, Artificial Sequence
  Description of Artificial Sequence: Synthetic polypeptide
DEEEISTTNPVATEQYGCVCSTESLFQEYGSEF

SEQ ID NO: 85144 - protein, 30 aa, Artificial Sequence
  Description of Artificial Sequence: Synthetic polypeptide
AENEIATTNPVATEQYGEVSENLMNAAGGA

SEQ ID NO: 85145 - protein, 31 aa, Artificial Sequence
  Description of Artificial Sequence: Synthetic polypeptide
AENEIACTNPVATEQYGETASEGNLQRGGGR

SEQ ID NO: 85146 - protein, 31 aa, Artificial Sequence
  Description of Artificial Sequence: Synthetic polypeptide
AENEIATTNPVATEQYGEVSSEPAGPNRGNR

SEQ ID NO: 85147 - protein, 32 aa, Artificial Sequence
  Description of Artificial Sequence: Synthetic polypeptide
DEEEISTTNPVATEQYGCVCSTEPQSFGSDAP

SEQ ID NO: 85148 - protein, 32 aa, Artificial Sequence
  Description of Artificial Sequence: Synthetic polypeptide
DEAEIACTNPVATEQYGSVAANLQETDDNDRG

SEQ ID NO: 85149 - protein, 33 aa, Artificial Sequence
  Description of Artificial Sequence: Synthetic polypeptide
DEDEIRTTNPVAYEQWGSTSPTDNQDSQREGHR

SEQ ID NO: 85150 - protein, 34 aa, Artificial Sequence
  Description of Artificial Sequence: Synthetic polypeptide
DEEEIRTTNPVATEQYGSVSSATPAGPNFEGMNV

SEQ ID NO: 85151 - protein, 29 aa, Artificial Sequence
  Description of Artificial Sequence: Synthetic peptide
DEESIATVNPVATEPYGSVAAGNLEMMNN

SEQ ID NO: 85152 - protein, 33 aa, Artificial Sequence
  Description of Artificial Sequence: Synthetic polypeptide
DEEEISTTNPVATEQYGCVCSTEPQNFGSQNQN

SEQ ID NO: 85153 - protein, 34 aa, Artificial Sequence
  Description of Artificial Sequence: Synthetic polypeptide
DEEEIRTTNPVATEQYGSVSPTMVWTVNPQMEEE

SEQ ID NO: 85154 - protein, 35 aa, Artificial Sequence
  Description of Artificial Sequence: Synthetic polypeptide
DEEEIRTTNPVATEQYGSVSPTMVDMLRQDEGVTI

SEQ ID NO: 85155 - protein, 33 aa, Artificial Sequence
  Description of Artificial Sequence: Synthetic polypeptide
DEEEISTTNPVATEQYGCVCSTENQNFGSENQF

SEQ ID NO: 85156 - protein, 31 aa, Artificial Sequence
  Description of Artificial Sequence: Synthetic polypeptide
AENEIACTNPVATEQYGETASEENLQRKGGR

SEQ ID NO: 85157 - protein, 32 aa, Artificial Sequence
  Description of Artificial Sequence: Synthetic polypeptide
DEESIATVNPVATEPYGSVSANLGERSENDRE

SEQ ID NO: 85158 - protein, 32 aa, Artificial Sequence
  Description of Artificial Sequence: Synthetic polypeptide
DEDEIRTTNPVAYEQWGSTSPTENDDQRQDQR

SEQ ID NO: 85159 - protein, 32 aa, Artificial Sequence
  Description of Artificial Sequence: Synthetic polypeptide
DEVEIATTNPVATEQYGEVSTNLNGEDINDGE

SEQ ID NO: 85160 - protein, 31 aa, Artificial Sequence
  Description of Artificial Sequence: Synthetic polypeptide
DEESIATTNPVAYECYGSVADNELSQSGGNE

SEQ ID NO: 85161 - protein, 35 aa, Artificial Sequence
  Description of Artificial Sequence: Synthetic polypeptide
DEEEIRTTNPVATEQYGSVSPTMNQQQQDGFQIET

SEQ ID NO: 85162 - protein, 33 aa, Artificial Sequence
  Description of Artificial Sequence: Synthetic polypeptide
DEEEISTTNPVATEQYGCVCSTGAHQSFGSNQA

SEQ ID NO: 85163 - protein, 32 aa, Artificial Sequence
  Description of Artificial Sequence: Synthetic polypeptide
DEAEIACTNPVATEQYGSCATNLQDAGDNLAE

SEQ ID NO: 85164 - protein, 36 aa, Artificial Sequence
  Description of Artificial Sequence: Synthetic polypeptide
DEEEIRTTNPVATEQYGSVSQTTPAGPNEQNGMNPV

SEQ ID NO: 85165 - protein, 34 aa, Artificial Sequence
  Description of Artificial Sequence: Synthetic polypeptide
DEVEIATTNPVATEQYGSVCSTMDHEDQRGGNDS

SEQ ID NO: 85166 - protein, 34 aa, Artificial Sequence
  Description of Artificial Sequence: Synthetic polypeptide
DEVEIATTNPVATEQYGSVCSTDNLGDNGHNTVD

SEQ ID NO: 85167 - protein, 36 aa, Artificial Sequence
  Description of Artificial Sequence: Synthetic polypeptide
DEEEIRTTNPVATEQYGSVSPTNALTQTAFEGDQLD

SEQ ID NO: 85168 - protein, 36 aa, Artificial Sequence
  Description of Artificial Sequence: Synthetic polypeptide
DEEEIRTTNPVATEQYGSVSQTVMDLIEQRQGVGLL

SEQ ID NO: 85169 - protein, 33 aa, Artificial Sequence
  Description of Artificial Sequence: Synthetic polypeptide
DEDEIRTTNPVAYEQWGSATTNLQGNAGENSNR

SEQ ID NO: 85170 - protein, 33 aa, Artificial Sequence
  Description of Artificial Sequence: Synthetic polypeptide
DEESIATTNPVATEQWGSVAMNNLQEAGHNMRS

SEQ ID NO: 85171 - protein, 33 aa, Artificial Sequence
  Description of Artificial Sequence: Synthetic polypeptide
DEEEISTTNPVATEQYGCVCSTGEHNQYFGSNQ

SEQ ID NO: 85172 - protein, 34 aa, Artificial Sequence
  Description of Artificial Sequence: Synthetic polypeptide
DEEEIRTTNPVATEQYGSVSQVNLLYPQNELPVD

SEQ ID NO: 85173 - protein, 31 aa, Artificial Sequence
  Description of Artificial Sequence: Synthetic polypeptide
DEESIATTNPVATEQYGCVAGTGDQDGNESF

SEQ ID NO: 85174 - protein, 32 aa, Artificial Sequence
  Description of Artificial Sequence: Synthetic polypeptide
DEEEISTTNPVATEQYGCVCSTGEDQYFGSEQ

SEQ ID NO: 85175 - protein, 32 aa, Artificial Sequence
  Description of Artificial Sequence: Synthetic polypeptide
DEEEISTTNPVATEQYGCVCSTGEDQNFGSEQ

SEQ ID NO: 85176 - protein, 30 aa, Artificial Sequence
  Description of Artificial Sequence: Synthetic polypeptide
DEESIATTNPVATEQYGCVAGTNDADGTSD

SEQ ID NO: 85177 - protein, 32 aa, Artificial Sequence
  Description of Artificial Sequence: Synthetic polypeptide
DEDEIRTTNPVAYEQWGSSYSLDNDLQRNDAR

SEQ ID NO: 85178 - protein, 31 aa, Artificial Sequence
  Description of Artificial Sequence: Synthetic polypeptide
DEAEIACTNPVATEQYGSCATNLPAEDNERP

SEQ ID NO: 85179 - protein, 31 aa, Artificial Sequence
  Description of Artificial Sequence: Synthetic polypeptide
DEAEIACTNPVATEQYGSCATNLQAEDNGDP

SEQ ID NO: 85180 - protein, 28 aa, Artificial Sequence
  Description of Artificial Sequence: Synthetic peptide
AENEIATTNPVATEQYGEASEVCQHEGR

SEQ ID NO: 85181 - protein, 34 aa, Artificial Sequence
  Description of Artificial Sequence: Synthetic polypeptide
DEDEIRTTNPVATEQYGSVSTTNQGNQNNTDNMP

SEQ ID NO: 85182 - protein, 32 aa, Artificial Sequence
  Description of Artificial Sequence: Synthetic polypeptide
AENEIATTNPVATEQYGEVSAENLQDHEGGDR

SEQ ID NO: 85183 - protein, 33 aa, Artificial Sequence
  Description of Artificial Sequence: Synthetic polypeptide
DEEEISTTNPVATEQYGCVCSTGALQNFNSQQA

SEQ ID NO: 85184 - protein, 31 aa, Artificial Sequence
  Description of Artificial Sequence: Synthetic polypeptide
DEAEIACTNPVATEQYGSCATNLQAEPGEDP

SEQ ID NO: 85185 - protein, 31 aa, Artificial Sequence
  Description of Artificial Sequence: Synthetic polypeptide
DEESIATTNPVAYECWGSVNRTNDMQRGNDM

SEQ ID NO: 85186 - protein, 35 aa, Artificial Sequence
  Description of Artificial Sequence: Synthetic polypeptide
DEEEIRTTNPVATEQYGSVSPTMNQQQPEQGPEDF

SEQ ID NO: 85187 - protein, 36 aa, Artificial Sequence
  Description of Artificial Sequence: Synthetic polypeptide
DEEEIRTTNPVATEQYGSVSSATPAGPQMRNGMNPV

SEQ ID NO: 85188 - protein, 30 aa, Artificial Sequence
  Description of Artificial Sequence: Synthetic polypeptide
AENEIACTNPVATEQYGETASEENLQRGPI

SEQ ID NO: 85189 - protein, 35 aa, Artificial Sequence
  Description of Artificial Sequence: Synthetic polypeptide
DEEEIRTTNPVATEQYGSVSSCIAEPQMREGMNPV

SEQ ID NO: 85190 - protein, 35 aa, Artificial Sequence
  Description of Artificial Sequence: Synthetic polypeptide
DEEEIRTTNPVATEQYGSVSSCIAEPQMRNGMNPV

SEQ ID NO: 85191 - protein, 35 aa, Artificial Sequence
  Description of Artificial Sequence: Synthetic polypeptide
DEEEIRTTNPVATEQYGSVSSCPAEPQMRNGMNPV

SEQ ID NO: 85192 - protein, 33 aa, Artificial Sequence
  Description of Artificial Sequence: Synthetic polypeptide
DEEEIRTTNPVAYEQYGCVCSNTELQENFGSEA

SEQ ID NO: 85193 - protein, 36 aa, Artificial Sequence
  Description of Artificial Sequence: Synthetic polypeptide
DEEEIRTTNPVATEQYGSVSPTMNLNIPQAGEIITM

SEQ ID NO: 85194 - protein, 33 aa, Artificial Sequence
  Description of Artificial Sequence: Synthetic polypeptide
DEEEISTTNPVATEQYGCVCSTELQENNSNNQS

SEQ ID NO: 85195 - protein, 33 aa, Artificial Sequence
  Description of Artificial Sequence: Synthetic polypeptide
DEDEIRTTNPVAYEQWGSVATSNQLQGDVGNAQ

SEQ ID NO: 85196 - protein, 34 aa, Artificial Sequence
  Description of Artificial Sequence: Synthetic polypeptide
DEVEIATTNPVATEQYGCVCSTDNLGDLDGTNER

SEQ ID NO: 85197 - protein, 33 aa, Artificial Sequence
  Description of Artificial Sequence: Synthetic polypeptide
DEVEIATTNPVATEQYGCVCSTDNLGDHGQGER

SEQ ID NO: 85198 - protein, 34 aa, Artificial Sequence
  Description of Artificial Sequence: Synthetic polypeptide
DEVEIATTNPVATEQYGCVCSTDNLGDANGRGER

SEQ ID NO: 85199 - protein, 33 aa, Artificial Sequence
  Description of Artificial Sequence: Synthetic polypeptide
DEVEIATTNPVATEQYGCVCSTDNLGDAGGERP

SEQ ID NO: 85200 - protein, 34 aa, Artificial Sequence
  Description of Artificial Sequence: Synthetic polypeptide
DEVEIATTNPVATEQYGCVCSTDNLGDAGGDNER

SEQ ID NO: 85201 - protein, 36 aa, Artificial Sequence
  Description of Artificial Sequence: Synthetic polypeptide
DEEEIRTTNPVATEQYGSVSSCTPAGPNQRNGMNNV

SEQ ID NO: 85202 - protein, 31 aa, Artificial Sequence
  Description of Artificial Sequence: Synthetic polypeptide
AENEIACTNPVATEQYGESCSSNLQRGSDQM

SEQ ID NO: 85203 - protein, 33 aa, Artificial Sequence
  Description of Artificial Sequence: Synthetic polypeptide
DEVEIATTNPVATEQYGCVCSNDNLGDAGTNDR

SEQ ID NO: 85204 - protein, 34 aa, Artificial Sequence
  Description of Artificial Sequence: Synthetic polypeptide
DEESICTTNPVATEAYGSVSVTTNQLQAGSNQME

SEQ ID NO: 85205 - protein, 34 aa, Artificial Sequence
  Description of Artificial Sequence: Synthetic polypeptide
DEEEISTTNPVATEQYGCVCSTELQENFGSDNQS

SEQ ID NO: 85206 - protein, 30 aa, Artificial Sequence
  Description of Artificial Sequence: Synthetic polypeptide
AENEIACTNPVATEQYGESCSSNLQNGSEQ

SEQ ID NO: 85207 - protein, 29 aa, Artificial Sequence
  Description of Artificial Sequence: Synthetic peptide
AENEIATTNPVATEQYGTISEDLQQNGGH

SEQ ID NO: 85208 - protein, 34 aa, Artificial Sequence
  Description of Artificial Sequence: Synthetic polypeptide
DEEEIRTTNPVATEQYGSVSSDGMNQDTGENSEN

SEQ ID NO: 85209 - protein, 31 aa, Artificial Sequence
  Description of Artificial Sequence: Synthetic polypeptide
AENEIATTNPVATEQYGTVCSTGPVEREGND

SEQ ID NO: 85210 - protein, 35 aa, Artificial Sequence
  Description of Artificial Sequence: Synthetic polypeptide
DEEEIRTTNPVATEQYGSVSSCIAEPQDREGMNPV

SEQ ID NO: 85211 - protein, 33 aa, Artificial Sequence
  Description of Artificial Sequence: Synthetic polypeptide
DEEEIRTTNPVATEQYGSVSSAVNDMSNETQND

SEQ ID NO: 85212 - protein, 34 aa, Artificial Sequence
  Description of Artificial Sequence: Synthetic polypeptide
DEVEIATTNPVATEQYGCVCSTDNLGDMIGGNER

SEQ ID NO: 85213 - protein, 35 aa, Artificial Sequence
  Description of Artificial Sequence: Synthetic polypeptide
DEEEIRTTNPVATEQYGSVSPTMNLNQPQDEAITQ

SEQ ID NO: 85214 - protein, 35 aa, Artificial Sequence
  Description of Artificial Sequence: Synthetic polypeptide
DEEEIRTTNPVATEQYGSVSPTMNQNQMQGGAIVQ

SEQ ID NO: 85215 - protein, 34 aa, Artificial Sequence
  Description of Artificial Sequence: Synthetic polypeptide
DEEEISTTNPVATEQYGCVCSTENLFQNFGSEQV

SEQ ID NO: 85216 - protein, 33 aa, Artificial Sequence
  Description of Artificial Sequence: Synthetic polypeptide
DEESICTTNPVATEAYGSVNVTNNLQAGSNNMN

SEQ ID NO: 85217 - protein, 32 aa, Artificial Sequence
  Description of Artificial Sequence: Synthetic polypeptide
DEAEIACTNPVATEQYGSVAITNLPQNNNHNE

SEQ ID NO: 85218 - protein, 31 aa, Artificial Sequence
  Description of Artificial Sequence: Synthetic polypeptide
DEVEIATTNPVATEQYGEVCTNPDQPGDMDS

SEQ ID NO: 85219 - protein, 34 aa, Artificial Sequence
  Description of Artificial Sequence: Synthetic polypeptide
DEEEIRTTNPVATEQYGSVSSATPDGEMREGEDV

SEQ ID NO: 85220 - protein, 33 aa, Artificial Sequence
  Description of Artificial Sequence: Synthetic polypeptide
DEEEISTTNPVATEQYGCVCSTENHQNFGSQQV

SEQ ID NO: 85221 - protein, 33 aa, Artificial Sequence
  Description of Artificial Sequence: Synthetic polypeptide
DEEEISTTNPVATEQYGCVCSTENDQNFNSQQA

SEQ ID NO: 85222 - protein, 35 aa, Artificial Sequence
  Description of Artificial Sequence: Synthetic polypeptide
DEEEIRTTNPVATEQYGSVSSATPDGNMHEGMNPL

SEQ ID NO: 85223 - protein, 35 aa, Artificial Sequence
  Description of Artificial Sequence: Synthetic polypeptide
DEEEIRTTNPVATEQYGSVSSATPDGNMHNGMNPL

SEQ ID NO: 85224 - protein, 34 aa, Artificial Sequence
  Description of Artificial Sequence: Synthetic polypeptide
DEEEIRTTNPVAYEQYGCVCSTEEDLQGFGSNQA

SEQ ID NO: 85225 - protein, 35 aa, Artificial Sequence
  Description of Artificial Sequence: Synthetic polypeptide
DEEEIRTTNPVATEQYGSVSSATPDGNMHNGMNPV

SEQ ID NO: 85226 - protein, 35 aa, Artificial Sequence
  Description of Artificial Sequence: Synthetic polypeptide
DEEEISTTNPVATEQYGCVCSTENDLQERFGSEQA

SEQ ID NO: 85227 - protein, 33 aa, Artificial Sequence
  Description of Artificial Sequence: Synthetic polypeptide
DEEEISTTNPVATEQYGCVCSTELQYFGSETQS

SEQ ID NO: 85228 - protein, 31 aa, Artificial Sequence
  Description of Artificial Sequence: Synthetic polypeptide
AENEIATTNPVATEQYGTACSTGLVEREGND

SEQ ID NO: 85229 - protein, 33 aa, Artificial Sequence
  Description of Artificial Sequence: Synthetic polypeptide
DEESICTTNPVATEAYGSVNVTNTLQQGNNNMD

SEQ ID NO: 85230 - protein, 29 aa, Artificial Sequence
  Description of Artificial Sequence: Synthetic peptide
AENEIATTNPVATEQYGTASENIQQNGGH

SEQ ID NO: 85231 - protein, 30 aa, Artificial Sequence
  Description of Artificial Sequence: Synthetic polypeptide
AENEIATTNPVATEQYGTASTGLVEREGGD

SEQ ID NO: 85232 - protein, 33 aa, Artificial Sequence
  Description of Artificial Sequence: Synthetic polypeptide
DEEEISTTNPVATEQYGCVCSTELQNFISENQA

SEQ ID NO: 85233 - protein, 33 aa, Artificial Sequence
  Description of Artificial Sequence: Synthetic polypeptide
DEAEIACTNPVATEQYGSVATGNLQDVGDNDAQ

SEQ ID NO: 85234 - protein, 31 aa, Artificial Sequence
  Description of Artificial Sequence: Synthetic polypeptide
DEAEIACTNPVATEQYGSVATNLADNPNGAE

SEQ ID NO: 85235 - protein, 33 aa, Artificial Sequence
  Description of Artificial Sequence: Synthetic polypeptide
DEEEISTTNPVATEQYGCVCSTELQHFNSNTQL

SEQ ID NO: 85236 - protein, 35 aa, Artificial Sequence
  Description of Artificial Sequence: Synthetic polypeptide
DEEEISTTNPVATEQYGCVCSTENDLQNFGSNPQP

SEQ ID NO: 85237 - protein, 31 aa, Artificial Sequence
  Description of Artificial Sequence: Synthetic polypeptide
DEETIRTTNPVATEQWGAGMEVENLQLQVNR

SEQ ID NO: 85238 - protein, 33 aa, Artificial Sequence
  Description of Artificial Sequence: Synthetic polypeptide
DEETIRTTNPVATEQWGAVATTENLQVEGVNDV

SEQ ID NO: 85239 - protein, 34 aa, Artificial Sequence
  Description of Artificial Sequence: Synthetic polypeptide
DEEEIRTTNPVATEQYGSVSPTLNVHIPPGEEAD

SEQ ID NO: 85240 - protein, 35 aa, Artificial Sequence
  Description of Artificial Sequence: Synthetic polypeptide
DEDEIRTTNPVAYEQWGSVCSTDNLGDQDREGNTQ

SEQ ID NO: 85241 - protein, 31 aa, Artificial Sequence
  Description of Artificial Sequence: Synthetic polypeptide
DEEEIRTTNPVAYEQYGCVGTELQHFDSDQA

SEQ ID NO: 85242 - protein, 35 aa, Artificial Sequence
  Description of Artificial Sequence: Synthetic polypeptide
DEETIRTTNPVATEQYGTVSTVNSNNNLQIGDNGD

SEQ ID NO: 85243 - protein, 34 aa, Artificial Sequence
  Description of Artificial Sequence: Synthetic polypeptide
DEEEIRTTNPVATEQYGSVSPTIAEEQVMVNGLA

SEQ ID NO: 85244 - protein, 35 aa, Artificial Sequence
  Description of Artificial Sequence: Synthetic polypeptide
DEETIRTTNPVATEQYGTVSVVVSNNNLQQGDERE

SEQ ID NO: 85245 - protein, 33 aa, Artificial Sequence
  Description of Artificial Sequence: Synthetic polypeptide
DEEEIRTTNPVATEQYGSVSPTIADNMRELPHM

SEQ ID NO: 85246 - protein, 34 aa, Artificial Sequence
  Description of Artificial Sequence: Synthetic polypeptide
DEEEISTTNPVATEQYGCVCSNTNDLQNFGSDQA

SEQ ID NO: 85247 - protein, 35 aa, Artificial Sequence
  Description of Artificial Sequence: Synthetic polypeptide
DEEEISTTNPVATEQYGCVCSNTNDLQERFGSEQG

SEQ ID NO: 85248 - protein, 34 aa, Artificial Sequence
  Description of Artificial Sequence: Synthetic polypeptide
DEEEISTTNPVATEQYGCVCSNTMNLQNFGSDQS

SEQ ID NO: 85249 - protein, 34 aa, Artificial Sequence
  Description of Artificial Sequence: Synthetic polypeptide
DEEEISTTNPVATEQYGCVCSNTGPLQNSGSNQL

SEQ ID NO: 85250 - protein, 35 aa, Artificial Sequence
  Description of Artificial Sequence: Synthetic polypeptide
DEEEIRTTNPVATEVYGSVSNTDGNNQGEFGNNGT

SEQ ID NO: 85251 - protein, 35 aa, Artificial Sequence
  Description of Artificial Sequence: Synthetic polypeptide
DEETIRTTNPVATEQYGTVVTVVSTNLQQIGTNVE

SEQ ID NO: 85252 - protein, 35 aa, Artificial Sequence
  Description of Artificial Sequence: Synthetic polypeptide
DEETIRTTNPVATEQYGTVVVVSTNLEQIGTNQQG

SEQ ID NO: 85253 - protein, 29 aa, Artificial Sequence
  Description of Artificial Sequence: Synthetic peptide
AENEIACTNPVATEQYGEAWMENLTRGGR

SEQ ID NO: 85254 - protein, 35 aa, Artificial Sequence
  Description of Artificial Sequence: Synthetic polypeptide
DEETIRTTNPVATEQYGTVVVVSTTNLQQIGNNQD

SEQ ID NO: 85255 - protein, 33 aa, Artificial Sequence
  Description of Artificial Sequence: Synthetic polypeptide
DEETIRTTNPVATEQYGTVVYCNTGELQRTNDG

SEQ ID NO: 85256 - protein, 35 aa, Artificial Sequence
  Description of Artificial Sequence: Synthetic polypeptide
DEETIRTTNPVATEQYGVVSTTNNQQLQFGTNNEE

SEQ ID NO: 85257 - protein, 35 aa, Artificial Sequence
  Description of Artificial Sequence: Synthetic polypeptide
DEETIRTTNPVATEQYGVVSTTNQQLQAGNTDEED

SEQ ID NO: 85258 - protein, 32 aa, Artificial Sequence
  Description of Artificial Sequence: Synthetic polypeptide
DEVEIATTNPVATDQWGMVSTALQQGGGDNDR

SEQ ID NO: 85259 - protein, 33 aa, Artificial Sequence
  Description of Artificial Sequence: Synthetic polypeptide
DEEEIRTTNPVATEQYGSVSSPLNTPRSIIEDD

SEQ ID NO: 85260 - protein, 34 aa, Artificial Sequence
  Description of Artificial Sequence: Synthetic polypeptide
DEEEISTTNPVATEQYGCVCSNTGNLQHFGSEQF

SEQ ID NO: 85261 - protein, 34 aa, Artificial Sequence
  Description of Artificial Sequence: Synthetic polypeptide
DEDEIRTTNPVAYEQWGSVCSTDNGQQDGQGNVR

SEQ ID NO: 85262 - protein, 34 aa, Artificial Sequence
  Description of Artificial Sequence: Synthetic polypeptide
DEEEISTTNPVATEQYGCVCSNTGELQRFGSEQF

SEQ ID NO: 85263 - protein, 33 aa, Artificial Sequence
  Description of Artificial Sequence: Synthetic polypeptide
DEEEIRTTNPVATEVYGSVSTLGMGNGGQENED

SEQ ID NO: 85264 - protein, 33 aa, Artificial Sequence
  Description of Artificial Sequence: Synthetic polypeptide
DEAEIATTNPVATCQYGCVCSTEALQRFGSNQA

SEQ ID NO: 85265 - protein, 35 aa, Artificial Sequence
  Description of Artificial Sequence: Synthetic polypeptide
DEETIRTTNPVATEQYGSVSTTVNNQLLGGNNQTD

SEQ ID NO: 85266 - protein, 33 aa, Artificial Sequence
  Description of Artificial Sequence: Synthetic polypeptide
DEEEISTTNPVATEQYGCVCSNTNLQNFLSEQA

SEQ ID NO: 85267 - protein, 33 aa, Artificial Sequence
  Description of Artificial Sequence: Synthetic polypeptide
DEVEIRTTNPVAYEQWGCVSTNLNGDANGHNER

SEQ ID NO: 85268 - protein, 32 aa, Artificial Sequence
  Description of Artificial Sequence: Synthetic polypeptide
DEVEIRTTNPVAYEQWGSVSTDNHGAAGGNMS

SEQ ID NO: 85269 - protein, 34 aa, Artificial Sequence
  Description of Artificial Sequence: Synthetic polypeptide
DEEEISTTNPVATEQYGCVCSNTNLQENFNSQQA

SEQ ID NO: 85270 - protein, 34 aa, Artificial Sequence
  Description of Artificial Sequence: Synthetic polypeptide
DEEEIRTTNPVATEQYGSVSPTLALEELGEEELD

SEQ ID NO: 85271 - protein, 35 aa, Artificial Sequence
  Description of Artificial Sequence: Synthetic polypeptide
DEEEIRTTNPVATEQYGSVSPTKNLEEELGEEILD

SEQ ID NO: 85272 - protein, 35 aa, Artificial Sequence
  Description of Artificial Sequence: Synthetic polypeptide
DEEEISTTNPVATEQYGCVCSNTNLQEGFNSENAE

SEQ ID NO: 85273 - protein, 30 aa, Artificial Sequence
  Description of Artificial Sequence: Synthetic polypeptide
AENEIACTNPVATEQYGEAYSENGLQRIGR

SEQ ID NO: 85274 - protein, 34 aa, Artificial Sequence
  Description of Artificial Sequence: Synthetic polypeptide
DEEEISTTNPVATEQYGCVCSNTNLFQNFGSEQQ

SEQ ID NO: 85275 - protein, 34 aa, Artificial Sequence
  Description of Artificial Sequence: Synthetic polypeptide
DEETIRTTNPVATEQYGSVSTTVQQQLGGNNQTD

SEQ ID NO: 85276 - protein, 35 aa, Artificial Sequence
  Description of Artificial Sequence: Synthetic polypeptide
DEEEIRTTNPVATEQYGSVSPTIPAAEQLGMNMEV

SEQ ID NO: 85277 - protein, 35 aa, Artificial Sequence
  Description of Artificial Sequence: Synthetic polypeptide
DEEEIRTTNPVATEQYGSVSSNTPAGPNRNGMNPV

SEQ ID NO: 85278 - protein, 32 aa, Artificial Sequence
  Description of Artificial Sequence: Synthetic polypeptide
DEVEIATTNPVATDQYGEVSTADDHQRSGGDR

SEQ ID NO: 85279 - protein, 34 aa, Artificial Sequence
  Description of Artificial Sequence: Synthetic polypeptide
DEEEIRTTNPVATEQYGSVSPTINVMERQMPETP

SEQ ID NO: 85280 - protein, 35 aa, Artificial Sequence
  Description of Artificial Sequence: Synthetic polypeptide
DEEEIRTTNPVATEQYGSVSPTINNLEEELGEELD

SEQ ID NO: 85281 - protein, 32 aa, Artificial Sequence
  Description of Artificial Sequence: Synthetic polypeptide
DEEEIRTTNPVAYEQYGCVCSWNHQHFNSEQT

SEQ ID NO: 85282 - protein, 35 aa, Artificial Sequence
  Description of Artificial Sequence: Synthetic polypeptide
DEETIRTTNPVATEQYGSVSTVNNLNDNNQGQNSE

SEQ ID NO: 85283 - protein, 36 aa, Artificial Sequence
  Description of Artificial Sequence: Synthetic polypeptide
DEETIRTTNPVATEQYGSVSTVNNLQSGNNQQDEDD

SEQ ID NO: 85284 - protein, 32 aa, Artificial Sequence
  Description of Artificial Sequence: Synthetic polypeptide
DEAEIATTNPVATCQYGCVCSTALQSFGSNQG

SEQ ID NO: 85285 - protein, 32 aa, Artificial Sequence
  Description of Artificial Sequence: Synthetic polypeptide
DEEEIRTTNPVAYEQYGCVCWTELQYFDSDRS

SEQ ID NO: 85286 - protein, 32 aa, Artificial Sequence
  Description of Artificial Sequence: Synthetic polypeptide
DEEEIRTTNPVAYEQYGCVCWTNLQYFDSEAG

SEQ ID NO: 85287 - protein, 35 aa, Artificial Sequence
  Description of Artificial Sequence: Synthetic polypeptide
DEETIRTTNPVATEQYGVVSTTNQQLQFGNNNNEE

SEQ ID NO: 85288 - protein, 35 aa, Artificial Sequence
  Description of Artificial Sequence: Synthetic polypeptide
DEEEIRTTNPVATEQYGSVSPTGWLVQEDEGEIMD

SEQ ID NO: 85289 - protein, 33 aa, Artificial Sequence
  Description of Artificial Sequence: Synthetic polypeptide
DEVEISTTNPVAYEQYGSVSDTSSGLQRIQNVN

SEQ ID NO: 85290 - protein, 36 aa, Artificial Sequence
  Description of Artificial Sequence: Synthetic polypeptide
DEEEIRTTNPVATEQYGSVSSQTPAGPNMRRGMNPV

SEQ ID NO: 85291 - protein, 33 aa, Artificial Sequence
  Description of Artificial Sequence: Synthetic polypeptide
DEEEISTTNPVATEQYGCVCSNTELQENNSDQS

SEQ ID NO: 85292 - protein, 30 aa, Artificial Sequence
  Description of Artificial Sequence: Synthetic polypeptide
AENEICATNPVATEQYGVVASVENLQQGGE

SEQ ID NO: 85293 - protein, 34 aa, Artificial Sequence
  Description of Artificial Sequence: Synthetic polypeptide
DEEEISTTNPVATEQYGCVCSNTELQENFGSNQL

SEQ ID NO: 85294 - protein, 33 aa, Artificial Sequence
  Description of Artificial Sequence: Synthetic polypeptide
DEEEISTTNPVATEQYGCVCSNTEHQRFGSDQA

SEQ ID NO: 85295 - protein, 30 aa, Artificial Sequence
  Description of Artificial Sequence: Synthetic polypeptide
AENEICATNPVATEQYGVVATSENLQDGGI

SEQ ID NO: 85296 - protein, 30 aa, Artificial Sequence
  Description of Artificial Sequence: Synthetic polypeptide
AENEICATNPVATEQYGVVATSENLQREGD

SEQ ID NO: 85297 - protein, 30 aa, Artificial Sequence
  Description of Artificial Sequence: Synthetic polypeptide
AENEICATNPVATEQYGVVAVENLQRGTGD

SEQ ID NO: 85298 - protein, 31 aa, Artificial Sequence
  Description of Artificial Sequence: Synthetic polypeptide
DEVEIATTNPVATAQWGTVSTGAGGQHGDNR

SEQ ID NO: 85299 - protein, 35 aa, Artificial Sequence
  Description of Artificial Sequence: Synthetic polypeptide
DEETIRTTNPVATEQYGVVSTVSNNNLQQIGDNGV

SEQ ID NO: 85300 - protein, 34 aa, Artificial Sequence
  Description of Artificial Sequence: Synthetic polypeptide
DEEEIRTTNPVATEQYGSVSSSPEQDSIGSNGQE

SEQ ID NO: 85301 - protein, 29 aa, Artificial Sequence
  Description of Artificial Sequence: Synthetic peptide
AENEICCTNPVATEEYGEASENLQTGGRT

SEQ ID NO: 85302 - protein, 33 aa, Artificial Sequence
  Description of Artificial Sequence: Synthetic polypeptide
DEEEIRTTNPVATEQYGSVSSSQNQPRPVEEEA

SEQ ID NO: 85303 - protein, 33 aa, Artificial Sequence
  Description of Artificial Sequence: Synthetic polypeptide
DEVEIATTNPTATEQYGSVSTMNEQEIEGDNDE

SEQ ID NO: 85304 - protein, 34 aa, Artificial Sequence
  Description of Artificial Sequence: Synthetic polypeptide
DEEEISTTNPVATEQYGCVCSNTEDLQRFGSEQA

SEQ ID NO: 85305 - protein, 35 aa, Artificial Sequence
  Description of Artificial Sequence: Synthetic polypeptide
DEETIRTTNPVATEQYGVVSTVVSNNNLQQIGDNV

SEQ ID NO: 85306 - protein, 32 aa, Artificial Sequence
  Description of Artificial Sequence: Synthetic polypeptide
DEVEIATTNPCATEPYGSVSTNLNGNAGEDSR

SEQ ID NO: 85307 - protein, 36 aa, Artificial Sequence
  Description of Artificial Sequence: Synthetic polypeptide
DEETIRTTNPVATEQYGVVSTVVSTNLNQLQQGDER

SEQ ID NO: 85308 - protein, 36 aa, Artificial Sequence
  Description of Artificial Sequence: Synthetic polypeptide
DEETIRTTNPVATEQYGVVSTVVSTNTNLQQGDEQR

SEQ ID NO: 85309 - protein, 31 aa, Artificial Sequence
  Description of Artificial Sequence: Synthetic polypeptide
DEAAIRTTNPVATEQYGCFCSTGNHIYGSNQ

SEQ ID NO: 85310 - protein, 35 aa, Artificial Sequence
  Description of Artificial Sequence: Synthetic polypeptide
DEEEIRTTNPVAYEQYGESVSEVNLELQRVGEPVD

SEQ ID NO: 85311 - protein, 33 aa, Artificial Sequence
  Description of Artificial Sequence: Synthetic polypeptide
DEWEIRTTNPVATECWGSVSCINEPQDREGENG

SEQ ID NO: 85312 - protein, 33 aa, Artificial Sequence
  Description of Artificial Sequence: Synthetic polypeptide
DEDEIRTTNPVAYEQWGSVCSTENDGHQHGQRE

SEQ ID NO: 85313 - protein, 32 aa, Artificial Sequence
  Description of Artificial Sequence: Synthetic polypeptide
DEVEIATTNPVATCQYGCVCSTEALQSFGSNQ

SEQ ID NO: 85314 - protein, 35 aa, Artificial Sequence
  Description of Artificial Sequence: Synthetic polypeptide
DEEEIRTTNPVATEQYGSVSPTFTGLQAADGEELL

SEQ ID NO: 85315 - protein, 34 aa, Artificial Sequence
  Description of Artificial Sequence: Synthetic polypeptide
DEEEISTTNPVATEQYGCVCSNTGELQNMGSNQS

SEQ ID NO: 85316 - protein, 34 aa, Artificial Sequence
  Description of Artificial Sequence: Synthetic polypeptide
DEEEISTTNPVATEQYGCVCSNTGELQNFGSNAG

SEQ ID NO: 85317 - protein, 33 aa, Artificial Sequence
  Description of Artificial Sequence: Synthetic polypeptide
DEEEIRTTNPVATEVYGSVFGVNVTQGGGNGET

SEQ ID NO: 85318 - protein, 30 aa, Artificial Sequence
  Description of Artificial Sequence: Synthetic polypeptide
DEAAIRTTNPVATEQYGCFCSTNPINGSDQ

SEQ ID NO: 85319 - protein, 35 aa, Artificial Sequence
  Description of Artificial Sequence: Synthetic polypeptide
DEETIRTTNPVATEQYGVVSTTNQQLQLQGNNNTE

SEQ ID NO: 85320 - protein, 35 aa, Artificial Sequence
  Description of Artificial Sequence: Synthetic polypeptide
DEETIRTTNPVATEQYGVVSTTNQQLQLQGNTEEG

SEQ ID NO: 85321 - protein, 35 aa, Artificial Sequence
  Description of Artificial Sequence: Synthetic polypeptide
DEEEIRTTNPVATEQYGSVSPTGPNSQSDTGFILI

SEQ ID NO: 85322 - protein, 34 aa, Artificial Sequence
  Description of Artificial Sequence: Synthetic polypeptide
DEDEIRTTNPVAYEQWGSVCSTDNLQLGDTNGGA

SEQ ID NO: 85323 - protein, 32 aa, Artificial Sequence
  Description of Artificial Sequence: Synthetic polypeptide
DEVNEIATTNPVAYEGWGSVSTNLQGADNDGR

SEQ ID NO: 85324 - protein, 31 aa, Artificial Sequence
  Description of Artificial Sequence: Synthetic polypeptide
DEAAIRTTNPVATEQYGCFCSTNHINSGSNQ

SEQ ID NO: 85325 - protein, 33 aa, Artificial Sequence
  Description of Artificial Sequence: Synthetic polypeptide
DEEEISTTNPVATEQYGCVCSNTNTQNFGSEVA

SEQ ID NO: 85326 - protein, 32 aa, Artificial Sequence
  Description of Artificial Sequence: Synthetic polypeptide
DEVEIATTNPVATDQWGEVSTADDDQRGQNQR

SEQ ID NO: 85327 - protein, 30 aa, Artificial Sequence
  Description of Artificial Sequence: Synthetic polypeptide
AENEICATNPVATEQYGVVASENLQDEGGV

SEQ ID NO: 85328 - protein, 34 aa, Artificial Sequence
  Description of Artificial Sequence: Synthetic polypeptide
DEEEISTTNPVATEQYGCVCSNTEPLQRFGSDQT

SEQ ID NO: 85329 - protein, 34 aa, Artificial Sequence
  Description of Artificial Sequence: Synthetic polypeptide
DEEEISTTNPVATEQYGCVCSNTENHQGFGSNAF

SEQ ID NO: 85330 - protein, 32 aa, Artificial Sequence
  Description of Artificial Sequence: Synthetic polypeptide
DEWEIATTNPVATEQYGSVSATDLEDHEGEDL

SEQ ID NO: 85331 - protein, 34 aa, Artificial Sequence
  Description of Artificial Sequence: Synthetic polypeptide
DEDEIRTTNPVAYEQWGSVCSTENDEGHQGGNRS

SEQ ID NO: 85332 - protein, 35 aa, Artificial Sequence
  Description of Artificial Sequence: Synthetic polypeptide
DEETIRTTNPVATEQYGVVSTTNQQLQTNGNNEEA

SEQ ID NO: 85333 - protein, 31 aa, Artificial Sequence
  Description of Artificial Sequence: Synthetic polypeptide
AENEIACTNPVATEQYGEATSECNLKQRGGR

SEQ ID NO: 85334 - protein, 35 aa, Artificial Sequence
  Description of Artificial Sequence: Synthetic polypeptide
DEETIRTTNPVATEQYGVVSTTNQQQLQAGNNNEE

SEQ ID NO: 85335 - protein, 34 aa, Artificial Sequence
  Description of Artificial Sequence: Synthetic polypeptide
DEEEIRTTNPVATEQYGSVSPTFVLQQMMEIEDT

SEQ ID NO: 85336 - protein, 34 aa, Artificial Sequence
  Description of Artificial Sequence: Synthetic polypeptide
DEAEIATTNPVATECYGSVCFTNDNGQRDGGNER

SEQ ID NO: 85337 - protein, 29 aa, Artificial Sequence
  Description of Artificial Sequence: Synthetic peptide
AENEIACTNPVATEQYGEAWAENLQPGGR

SEQ ID NO: 85338 - protein, 31 aa, Artificial Sequence
  Description of Artificial Sequence: Synthetic polypeptide
DEAEIATTNPVATEIWGSVTGGNDQGDQGNR

SEQ ID NO: 85339 - protein, 33 aa, Artificial Sequence
  Description of Artificial Sequence: Synthetic polypeptide
DEEEISTTNPVATEQYGCVCSNTPLQENSNSNQ

SEQ ID NO: 85340 - protein, 36 aa, Artificial Sequence
  Description of Artificial Sequence: Synthetic polypeptide
DEETIRTTNPVATEQYGSVSTTNQQQLQQNGNNQTT

SEQ ID NO: 85341 - protein, 34 aa, Artificial Sequence
  Description of Artificial Sequence: Synthetic polypeptide
DEEEIRTTNPVAYEQYGCVCSTENPQENFGSNDS

SEQ ID NO: 85342 - protein, 33 aa, Artificial Sequence
  Description of Artificial Sequence: Synthetic polypeptide
DEVEIATTNPVATECYGCVSTNLNQGGADGDSR

SEQ ID NO: 85343 - protein, 33 aa, Artificial Sequence
  Description of Artificial Sequence: Synthetic polypeptide
DEEEIRTTNPVAYEQYGCVCSTEPQHFGSENQS

SEQ ID NO: 85344 - protein, 33 aa, Artificial Sequence
  Description of Artificial Sequence: Synthetic polypeptide
DEVEIRTTNPVATEQYGSVVGFGNLEDGENVGI

SEQ ID NO: 85345 - protein, 35 aa, Artificial Sequence
  Description of Artificial Sequence: Synthetic polypeptide
DEEEIRTTNPVATEQYGSVSPTLNEQQPRDTTETT

SEQ ID NO: 85346 - protein, 33 aa, Artificial Sequence
  Description of Artificial Sequence: Synthetic polypeptide
DEDEIRTTNPVAYEQWGSVCSTDNDGKQNGNNP

SEQ ID NO: 85347 - protein, 35 aa, Artificial Sequence
  Description of Artificial Sequence: Synthetic polypeptide
DEEEIRTTNPVATEQYGSVSPTLNDLTETMNQHKE

SEQ ID NO: 85348 - protein, 34 aa, Artificial Sequence
  Description of Artificial Sequence: Synthetic polypeptide
DEEEIRTTNPVATEQYGSVSPTLNANEELMEELD

SEQ ID NO: 85349 - protein, 32 aa, Artificial Sequence
  Description of Artificial Sequence: Synthetic polypeptide
DEEEIRTTNPVAYEQYGCVCSTEPQNFGSQQL

SEQ ID NO: 85350 - protein, 32 aa, Artificial Sequence
  Description of Artificial Sequence: Synthetic polypeptide
DDEEIRTTNPVGTEQWGCVCSTNHNQRFGSVQ

SEQ ID NO: 85351 - protein, 33 aa, Artificial Sequence
  Description of Artificial Sequence: Synthetic polypeptide
DEDEIRTTNPVATEQYGSVQTVAQLTIGTENGV

SEQ ID NO: 85352 - protein, 33 aa, Artificial Sequence
  Description of Artificial Sequence: Synthetic polypeptide
DEDEIRTTNPVATEQYGSVQTVAQLEIRTNNND

SEQ ID NO: 85353 - protein, 32 aa, Artificial Sequence
  Description of Artificial Sequence: Synthetic polypeptide
DEEEISTTNPVATEQYGCVCSSPHQNFGSNTQ

SEQ ID NO: 85354 - protein, 30 aa, Artificial Sequence
  Description of Artificial Sequence: Synthetic polypeptide
AENEIACTNPVATEQYGEIPSENHQRGGGR

SEQ ID NO: 85355 - protein, 33 aa, Artificial Sequence
  Description of Artificial Sequence: Synthetic polypeptide
DEEEISTTNPVATEQYGCVCSSNLQNFGSDTQA

SEQ ID NO: 85356 - protein, 32 aa, Artificial Sequence
  Description of Artificial Sequence: Synthetic polypeptide
DEEEISTTNPVATEQYGCVCSSNHQYFNSDQT

SEQ ID NO: 85357 - protein, 33 aa, Artificial Sequence
  Description of Artificial Sequence: Synthetic polypeptide
DEEEISTTNPVATEQYGCVCSSNHQNFGSENQF

SEQ ID NO: 85358 - protein, 34 aa, Artificial Sequence
  Description of Artificial Sequence: Synthetic polypeptide
DEETIRTTNPVATEQYGQYSVSINGQGEGGDNDQ

SEQ ID NO: 85359 - protein, 31 aa, Artificial Sequence
  Description of Artificial Sequence: Synthetic polypeptide
DEAEIATTNPCAYEPYGSVAATNLQNGDNTV

SEQ ID NO: 85360 - protein, 34 aa, Artificial Sequence
  Description of Artificial Sequence: Synthetic polypeptide
DEETIRTTNPVATEQYGSVILVLSTELSQGPNNT

SEQ ID NO: 85361 - protein, 34 aa, Artificial Sequence
  Description of Artificial Sequence: Synthetic polypeptide
DEDEIRTTNPVATEQYGSVQTQLQLQIGTTTNNQ

SEQ ID NO: 85362 - protein, 34 aa, Artificial Sequence
  Description of Artificial Sequence: Synthetic polypeptide
DEEEIRTTNPVAYEQYGCVCSTENHQNFGSDNQA

SEQ ID NO: 85363 - protein, 33 aa, Artificial Sequence
  Description of Artificial Sequence: Synthetic polypeptide
DEETIRTTNPVATEQYGSVPSTVTEAMFIGNTT

SEQ ID NO: 85364 - protein, 33 aa, Artificial Sequence
  Description of Artificial Sequence: Synthetic polypeptide
DEETIRTTNPVATEQWGTVATTNNNLQLGNNGD

SEQ ID NO: 85365 - protein, 33 aa, Artificial Sequence
  Description of Artificial Sequence: Synthetic polypeptide
DEEEIRTTNPVAYEQYGCVCSTENHQHFNSDQY

SEQ ID NO: 85366 - protein, 31 aa, Artificial Sequence
  Description of Artificial Sequence: Synthetic polypeptide
DEETIRTTNPVATEQWGAVEVENLQLMVNDD

SEQ ID NO: 85367 - protein, 32 aa, Artificial Sequence
  Description of Artificial Sequence: Synthetic polypeptide
DEAEIACTNPVAYEQYGSVATNLQEAGNADFE

SEQ ID NO: 85368 - protein, 33 aa, Artificial Sequence
  Description of Artificial Sequence: Synthetic polypeptide
DEEEIRTTNPVATFQWGSVASCTNFSIAGGMAR

SEQ ID NO: 85369 - protein, 36 aa, Artificial Sequence
  Description of Artificial Sequence: Synthetic polypeptide
DEEEIRTTNPVATEQYGSVSPTLNNLPAHLNEVERM

SEQ ID NO: 85370 - protein, 34 aa, Artificial Sequence
  Description of Artificial Sequence: Synthetic polypeptide
DEEEIRTTNPVATEYYGSVVWTYGLSQHTPGSNE

SEQ ID NO: 85371 - protein, 33 aa, Artificial Sequence
  Description of Artificial Sequence: Synthetic polypeptide
DEETIRTTNPVATEQWGAVMEVENYLQLGVNVR

SEQ ID NO: 85372 - protein, 33 aa, Artificial Sequence
  Description of Artificial Sequence: Synthetic polypeptide
DEEEIRTTNPVATEQYGSVSSMWHIERPVNVTS

SEQ ID NO: 85373 - protein, 32 aa, Artificial Sequence
  Description of Artificial Sequence: Synthetic polypeptide
DEAEIACTNPVAYEQYGSVATNLQNPMGNPTP

SEQ ID NO: 85374 - protein, 32 aa, Artificial Sequence
  Description of Artificial Sequence: Synthetic polypeptide
DEVEIRTTNPVATEQYGSVTPSWADTQGENQE

SEQ ID NO: 85375 - protein, 32 aa, Artificial Sequence
  Description of Artificial Sequence: Synthetic polypeptide
DEAEIACTNPVAYEQYGSVATNLQTPGEDQRG

SEQ ID NO: 85376 - protein, 30 aa, Artificial Sequence
  Description of Artificial Sequence: Synthetic polypeptide
DEAEIACTNPVAYEQYGSVATNLVDDGDGF

SEQ ID NO: 85377 - protein, 32 aa, Artificial Sequence
  Description of Artificial Sequence: Synthetic polypeptide
DEAEIACTNPVAYEQYGSVSTNLQGAPAEGKP

SEQ ID NO: 85378 - protein, 34 aa, Artificial Sequence
  Description of Artificial Sequence: Synthetic polypeptide
DEETIRTTNPVATEQWGSVATTNNNLQAGNNNDN

SEQ ID NO: 85379 - protein, 34 aa, Artificial Sequence
  Description of Artificial Sequence: Synthetic polypeptide
DEETIRTTNPVATEQWGSVATTNNNLQLGNNEDE

SEQ ID NO: 85380 - protein, 34 aa, Artificial Sequence
  Description of Artificial Sequence: Synthetic polypeptide
DEDEIRTTNPVATEQYGSVSPTVDWLENTGNLQE

SEQ ID NO: 85381 - protein, 34 aa, Artificial Sequence
  Description of Artificial Sequence: Synthetic polypeptide
DEETIRTTNPVATEQWGSVATTNNNLQLQGNNND

SEQ ID NO: 85382 - protein, 32 aa, Artificial Sequence
  Description of Artificial Sequence: Synthetic polypeptide
DEDEIRTTNPVATEQYGSVSPTLMAERETQEI

SEQ ID NO: 85383 - protein, 32 aa, Artificial Sequence
  Description of Artificial Sequence: Synthetic polypeptide
DEEEIRTTNPVAYEQYGCVCSTEHQNFTSNQA

SEQ ID NO: 85384 - protein, 30 aa, Artificial Sequence
  Description of Artificial Sequence: Synthetic polypeptide
AENEIACTNPVATEQYGEISENLQQQRGGH

SEQ ID NO: 85385 - protein, 34 aa, Artificial Sequence
  Description of Artificial Sequence: Synthetic polypeptide
DEETIRTTNPVATEQWGSVATTNNNLQQGNNQDQ

SEQ ID NO: 85386 - protein, 34 aa, Artificial Sequence
  Description of Artificial Sequence: Synthetic polypeptide
DEEEIRTTNPVATEQYGSVSSNDPLNDSGQFEEY

SEQ ID NO: 85387 - protein, 33 aa, Artificial Sequence
  Description of Artificial Sequence: Synthetic polypeptide
DEDEIRTTNPVAYEQWGSVCSTDLQNGDTNGDA

SEQ ID NO: 85388 - protein, 34 aa, Artificial Sequence
  Description of Artificial Sequence: Synthetic polypeptide
DEETIRTTNPVATEQYGSVPSTVTELMFIGNETY

SEQ ID NO: 85389 - protein, 34 aa, Artificial Sequence
  Description of Artificial Sequence: Synthetic polypeptide
DEETIRTTNPVATEQYGSVPTHEELPRQGENSVI

SEQ ID NO: 85390 - protein, 33 aa, Artificial Sequence
  Description of Artificial Sequence: Synthetic polypeptide
DEDEIRTTNPVATEQYGSVQTQAQLQISTTNVE

SEQ ID NO: 85391 - protein, 35 aa, Artificial Sequence
  Description of Artificial Sequence: Synthetic polypeptide
DEETIRTTNPVATEQYGSVSTTNNLNDNLGQNTEG

SEQ ID NO: 85392 - protein, 35 aa, Artificial Sequence
  Description of Artificial Sequence: Synthetic polypeptide
DEETIRTTNPVATEQYGSVSTTNNLNDNNQGQNTE

SEQ ID NO: 85393 - protein, 36 aa, Artificial Sequence
  Description of Artificial Sequence: Synthetic polypeptide
DEETIRTTNPVATEQYGSVSTTNNLQAGNNQQNEDD

SEQ ID NO: 85394 - protein, 36 aa, Artificial Sequence
  Description of Artificial Sequence: Synthetic polypeptide
DEETIRTTNPVATEQYGSVSTTNNLQDGNNGQGEQD

SEQ ID NO: 85395 - protein, 36 aa, Artificial Sequence
  Description of Artificial Sequence: Synthetic polypeptide
DEETIRTTNPVATEQYGSVSTTNNLQNNNNGQNEQD

SEQ ID NO: 85396 - protein, 33 aa, Artificial Sequence
  Description of Artificial Sequence: Synthetic polypeptide
DEEEISTTNPVATEQYGCVCSSELQNFGSNTQA

SEQ ID NO: 85397 - protein, 34 aa, Artificial Sequence
  Description of Artificial Sequence: Synthetic polypeptide
DEEEIRTTNPVATEQYGSVSSNLVPEAAAQVMSM

SEQ ID NO: 85398 - protein, 31 aa, Artificial Sequence
  Description of Artificial Sequence: Synthetic polypeptide
DEEEIRTTNPVATEWYGAAHLNTNEQPINDF

SEQ ID NO: 85399 - protein, 36 aa, Artificial Sequence
  Description of Artificial Sequence: Synthetic polypeptide
DEETIRTTNPVATEQYGSVSTTNNLQSGNNDQDETD

SEQ ID NO: 85400 - protein, 36 aa, Artificial Sequence
  Description of Artificial Sequence: Synthetic polypeptide
DEETIRTTNPVATEQYGSVSTTNNLQSGTNQQNEQD

SEQ ID NO: 85401 - protein, 33 aa, Artificial Sequence
  Description of Artificial Sequence: Synthetic polypeptide
DEEEIRTTNPVATEQYGSVSPTLIEQMTSEIDN

SEQ ID NO: 85402 - protein, 33 aa, Artificial Sequence
  Description of Artificial Sequence: Synthetic polypeptide
DEEEISTTNPVATEQYGCVCSSELQENFGSNQS

SEQ ID NO: 85403 - protein, 32 aa, Artificial Sequence
  Description of Artificial Sequence: Synthetic polypeptide
DEEEISTTNPVATEQYGCVCSSELQAFGSDQA

SEQ ID NO: 85404 - protein, 30 aa, Artificial Sequence
  Description of Artificial Sequence: Synthetic polypeptide
AENEIACTNPVATEQYGECSENLQRMGGLE

SEQ ID NO: 85405 - protein, 30 aa, Artificial Sequence
  Description of Artificial Sequence: Synthetic polypeptide
DEVEIATTNPVATDQYGVVSTDGFEGGGNT

SEQ ID NO: 85406 - protein, 31 aa, Artificial Sequence
  Description of Artificial Sequence: Synthetic polypeptide
DEVEIATTNPVATDQYGVVSTDGEQGNGNGT

SEQ ID NO: 85407 - protein, 33 aa, Artificial Sequence
  Description of Artificial Sequence: Synthetic polypeptide
DEEEISTTNPVATEQYGCVCSNTPLQNFGSDQS

SEQ ID NO: 85408 - protein, 35 aa, Artificial Sequence
  Description of Artificial Sequence: Synthetic polypeptide
DEEEIRTTNPVATEVYGSVTDGTGNLNQNEGGNIQ

SEQ ID NO: 85409 - protein, 36 aa, Artificial Sequence
  Description of Artificial Sequence: Synthetic polypeptide
DEETIRTTNPVATEQYGSVSTTNQLEQLGGNNNQTE

SEQ ID NO: 85410 - protein, 36 aa, Artificial Sequence
  Description of Artificial Sequence: Synthetic polypeptide
DEETIRTTNPVATEQYGSVSTTNQLEQLGNQGNQTE

SEQ ID NO: 85411 - protein, 36 aa, Artificial Sequence
  Description of Artificial Sequence: Synthetic polypeptide
DEETIRTTNPVATEQYGSVSTTNQLQAGNNQEDEED

SEQ ID NO: 85412 - protein, 32 aa, Artificial Sequence
  Description of Artificial Sequence: Synthetic polypeptide
DEDEIRTTNPVATEQYGSVCTTTVMMQEENEQ

SEQ ID NO: 85413 - protein, 34 aa, Artificial Sequence
  Description of Artificial Sequence: Synthetic polypeptide
DDEEIRTTNPVATEQYGVVISTNLVIGNEGQTGG

SEQ ID NO: 85414 - protein, 33 aa, Artificial Sequence
  Description of Artificial Sequence: Synthetic polypeptide
DDEEIRTTNPVATEQYGVVNDDQTNGQGEGGNG

SEQ ID NO: 85415 - protein, 33 aa, Artificial Sequence
  Description of Artificial Sequence: Synthetic polypeptide
DDEEIRTTNPVATEQYGVVSTQGQGTGQGNEGG

SEQ ID NO: 85416 - protein, 33 aa, Artificial Sequence
  Description of Artificial Sequence: Synthetic polypeptide
DEEEISTTNPVATEQYGCVCSSNHQHFGSNTQG

SEQ ID NO: 85417 - protein, 33 aa, Artificial Sequence
  Description of Artificial Sequence: Synthetic polypeptide
DEDEIRTTNPVATEQYGSVQTQAQLEIRTTNDN

SEQ ID NO: 85418 - protein, 33 aa, Artificial Sequence
  Description of Artificial Sequence: Synthetic polypeptide
DEDEIRTTNPVAYEQWGSVCSTDNGEQDNGNDP

SEQ ID NO: 85419 - protein, 32 aa, Artificial Sequence
  Description of Artificial Sequence: Synthetic polypeptide
DEEEISTTNPVATEQYGCVCSSNDQNFGSDQA

SEQ ID NO: 85420 - protein, 34 aa, Artificial Sequence
  Description of Artificial Sequence: Synthetic polypeptide
DEEEIRTTNPVATEQYGSVSPTLLPGSTPPAENN

SEQ ID NO: 85421 - protein, 33 aa, Artificial Sequence
  Description of Artificial Sequence: Synthetic polypeptide
DEDEIRTTNPVATEQYGSVQTQALLIGTTNNNE

SEQ ID NO: 85422 - protein, 34 aa, Artificial Sequence
  Description of Artificial Sequence: Synthetic polypeptide
DEEEIRTTNPVATEQYGSVSPTLLPGPTPPFENV

SEQ ID NO: 85423 - protein, 33 aa, Artificial Sequence
  Description of Artificial Sequence: Synthetic polypeptide
DEEEIRTTNPVAYEQYGCVCSTGELQNFGSDQM

SEQ ID NO: 85424 - protein, 35 aa, Artificial Sequence
  Description of Artificial Sequence: Synthetic polypeptide
DEEEIRTTNPVATEQYGSVSPTLLLIQSDPINQLI

SEQ ID NO: 85425 - protein, 34 aa, Artificial Sequence
  Description of Artificial Sequence: Synthetic polypeptide
DEEEIRTTNPVATEQYGSVSPTLLLIQEMPLPEI

SEQ ID NO: 85426 - protein, 32 aa, Artificial Sequence
  Description of Artificial Sequence: Synthetic polypeptide
DEEEIRTTNPVAYEQYGCVCSWELQNFGSDQS

SEQ ID NO: 85427 - protein, 33 aa, Artificial Sequence
  Description of Artificial Sequence: Synthetic polypeptide
DEEEISTTNPVATEQYGCVCSSGNLQNFGSDQS

SEQ ID NO: 85428 - protein, 33 aa, Artificial Sequence
  Description of Artificial Sequence: Synthetic polypeptide
DEEEISTTNPVATEQYGCVCSSGNHQHFGSNQF

SEQ ID NO: 85429 - protein, 32 aa, Artificial Sequence
  Description of Artificial Sequence: Synthetic polypeptide
DEEEISTTNPVATEQYGCVCSSGNDQFFNSEQ

SEQ ID NO: 85430 - protein, 32 aa, Artificial Sequence
  Description of Artificial Sequence: Synthetic polypeptide
DEEEISTTNPVATEQYGCVCSSEPQFFGSNQL

SEQ ID NO: 85431 - protein, 34 aa, Artificial Sequence
  Description of Artificial Sequence: Synthetic polypeptide
DEETIRTTNPVATEQYGSVSEVLSTLPRQGPNNT

SEQ ID NO: 85432 - protein, 35 aa, Artificial Sequence
  Description of Artificial Sequence: Synthetic polypeptide
DEETIRTTNPVATEQYGSVSLVLSTELIRQGPINT

SEQ ID NO: 85433 - protein, 34 aa, Artificial Sequence
  Description of Artificial Sequence: Synthetic polypeptide
DEETIRTTNPVATEQYGSVSLVLTGLRQGPNNTT

SEQ ID NO: 85434 - protein, 34 aa, Artificial Sequence
  Description of Artificial Sequence: Synthetic polypeptide
DEETIRTTNPVATEQYGSVSLVPSTELRQGPVNT

SEQ ID NO: 85435 - protein, 30 aa, Artificial Sequence
  Description of Artificial Sequence: Synthetic polypeptide
AENEIACTNPVATEQYGEFWSENLQRGDGQ

SEQ ID NO: 85436 - protein, 35 aa, Artificial Sequence
  Description of Artificial Sequence: Synthetic polypeptide
DEEEIRTTNPVATEQYGSVSPTLLIQAASGFFEQT

SEQ ID NO: 85437 - protein, 34 aa, Artificial Sequence
  Description of Artificial Sequence: Synthetic polypeptide
DEDEIRTTNPVATEQYGSVMDTGNLEEYGNQQEA

SEQ ID NO: 85438 - protein, 32 aa, Artificial Sequence
  Description of Artificial Sequence: Synthetic polypeptide
DEEEISTTNPVATEQYGCVCSSGNHQNFNSQQ

SEQ ID NO: 85439 - protein, 36 aa, Artificial Sequence
  Description of Artificial Sequence: Synthetic polypeptide
DEEEIRTTNPVATEQYGSVSSTTPAGQNMRNGMNVV

SEQ ID NO: 85440 - protein, 32 aa, Artificial Sequence
  Description of Artificial Sequence: Synthetic polypeptide
DENEIRTTNPVATEQYGSVSTLAQEVSQESIF

SEQ ID NO: 85441 - protein, 33 aa, Artificial Sequence
  Description of Artificial Sequence: Synthetic polypeptide
DEGEIATTNPVATEQYGSVCAANNLQEAPENRE

SEQ ID NO: 85442 - protein, 33 aa, Artificial Sequence
  Description of Artificial Sequence: Synthetic polypeptide
DENEIATTNPVAYEQYGSVSTNLQEHGDDLEAF

SEQ ID NO: 85443 - protein, 32 aa, Artificial Sequence
  Description of Artificial Sequence: Synthetic polypeptide
DENEIATTNPVAYEQYGSVSANPQRNPPNPLP

SEQ ID NO: 85444 - protein, 33 aa, Artificial Sequence
  Description of Artificial Sequence: Synthetic polypeptide
DEAEIRTTNPVAYEQWGSVSTNPNGNGMGGNER

SEQ ID NO: 85445 - protein, 32 aa, Artificial Sequence
  Description of Artificial Sequence: Synthetic polypeptide
DEAEIRTTNGVAYCQYGCVCSTNLQRGSDTQP

SEQ ID NO: 85446 - protein, 31 aa, Artificial Sequence
  Description of Artificial Sequence: Synthetic polypeptide
DEAEIRTTNGVAYCQYGCVCSTNLQHGSDAP

SEQ ID NO: 85447 - protein, 32 aa, Artificial Sequence
  Description of Artificial Sequence: Synthetic polypeptide
DENEIATTNPVAYEQYGSVCAANNLQEAGENN

SEQ ID NO: 85448 - protein, 33 aa, Artificial Sequence
  Description of Artificial Sequence: Synthetic polypeptide
DENEIATTNPVAYEQYGSVATNLQPRDQTEGRN

SEQ ID NO: 85449 - protein, 34 aa, Artificial Sequence
  Description of Artificial Sequence: Synthetic polypeptide
DENEIATTNPVAYEQYGVSVSANGLLQRAGMGDR

SEQ ID NO: 85450 - protein, 34 aa, Artificial Sequence
  Description of Artificial Sequence: Synthetic polypeptide
DEEEIRTTNPVATEQYGSVSTQMDMDEQSTQNKS

SEQ ID NO: 85451 - protein, 30 aa, Artificial Sequence
  Description of Artificial Sequence: Synthetic polypeptide
DEAEIRTTNGVAYCQYGCVCSTNHQNGDQQ

SEQ ID NO: 85452 - protein, 33 aa, Artificial Sequence
  Description of Artificial Sequence: Synthetic polypeptide
DENEIATTNPVAYEQYGSVATNLQNGENTEDAW

SEQ ID NO: 85453 - protein, 32 aa, Artificial Sequence
  Description of Artificial Sequence: Synthetic polypeptide
DENEIATTNPVAYEQYGSVATNLQGAPMEGTN

SEQ ID NO: 85454 - protein, 30 aa, Artificial Sequence
  Description of Artificial Sequence: Synthetic polypeptide
DENEIATTNPVAYEQYGSVATNGTAENPNP

SEQ ID NO: 85455 - protein, 31 aa, Artificial Sequence
  Description of Artificial Sequence: Synthetic polypeptide
DEAEIRTTNPVAYEQWGSVSTQPNGNGNDSD

SEQ ID NO: 85456 - protein, 33 aa, Artificial Sequence
  Description of Artificial Sequence: Synthetic polypeptide
DEAEIRTTNPVAYEQWGSVSTTNAGNQGEDANR

SEQ ID NO: 85457 - protein, 31 aa, Artificial Sequence
  Description of Artificial Sequence: Synthetic polypeptide
DENEIATTNPVAYEQYGSVATHLQIDGDDLH

SEQ ID NO: 85458 - protein, 32 aa, Artificial Sequence
  Description of Artificial Sequence: Synthetic polypeptide
DEAEIRTTNPVAYEQWGSVSTNVNGEHGNNSS

SEQ ID NO: 85459 - protein, 30 aa, Artificial Sequence
  Description of Artificial Sequence: Synthetic polypeptide
DENEIATTNPVSSEPYGTISCNLQQSNGNR

SEQ ID NO: 85460 - protein, 29 aa, Artificial Sequence
  Description of Artificial Sequence: Synthetic peptide
DENEIATTNPVSTECYGDVSMCLQQQENH

SEQ ID NO: 85461 - protein, 33 aa, Artificial Sequence
  Description of Artificial Sequence: Synthetic polypeptide
DEEEIRTTNPVATEQYGSVWVSPYLHEHSGEDQ

SEQ ID NO: 85462 - protein, 33 aa, Artificial Sequence
  Description of Artificial Sequence: Synthetic polypeptide
DEAEIRTTNPVAYEQWGSVSTNLNGEHQGNDSP

SEQ ID NO: 85463 - protein, 32 aa, Artificial Sequence
  Description of Artificial Sequence: Synthetic polypeptide
DEAEIRTTNPVAYEQWGSVSTNLNHNGEGDEA

SEQ ID NO: 85464 - protein, 33 aa, Artificial Sequence
  Description of Artificial Sequence: Synthetic polypeptide
DEAEIRTTNPVAYEQWGSVSTNLNMNGTGDNND

SEQ ID NO: 85465 - protein, 33 aa, Artificial Sequence
  Description of Artificial Sequence: Synthetic polypeptide
DEAEIRTTNPVAYEQWGSVSTNLNQGAMGGDGQ

SEQ ID NO: 85466 - protein, 33 aa, Artificial Sequence
  Description of Artificial Sequence: Synthetic polypeptide
DEAEIRTTNPVAYEQWGSVSTNLNQGGQGQDTM

SEQ ID NO: 85467 - protein, 33 aa, Artificial Sequence
  Description of Artificial Sequence: Synthetic polypeptide
DEAEIRTTNPVAYEQWGSVSTNLNQGNAGGDEA

SEQ ID NO: 85468 - protein, 32 aa, Artificial Sequence
  Description of Artificial Sequence: Synthetic polypeptide
DEAEIRTTNGVAYCQYGSVTSTNLQTRTIDPQ

SEQ ID NO: 85469 - protein, 35 aa, Artificial Sequence
  Description of Artificial Sequence: Synthetic polypeptide
DEEEIRTTNPVATEQYGSVSTQNGMGQGEEFNTIF

SEQ ID NO: 85470 - protein, 28 aa, Artificial Sequence
  Description of Artificial Sequence: Synthetic peptide
DEAEIRTTNGVAYCQYGSVSTDVVAFEQ

SEQ ID NO: 85471 - protein, 32 aa, Artificial Sequence
  Description of Artificial Sequence: Synthetic polypeptide
DEAEIRTTNGVAYCQYGSVSSNTWLQTGIDDR

SEQ ID NO: 85472 - protein, 31 aa, Artificial Sequence
  Description of Artificial Sequence: Synthetic polypeptide
DEAEIRTTNGVAYCQYGSVSELYLQRGTQDE

SEQ ID NO: 85473 - protein, 30 aa, Artificial Sequence
  Description of Artificial Sequence: Synthetic polypeptide
DEAEIRTTNGVAYCQYGSVSCTNLSVAFEQ

SEQ ID NO: 85474 - protein, 31 aa, Artificial Sequence
  Description of Artificial Sequence: Synthetic polypeptide
DEAEIRTTNGVAYCQYGCVSTNHQRFGSDVA

SEQ ID NO: 85475 - protein, 29 aa, Artificial Sequence
  Description of Artificial Sequence: Synthetic peptide
DENEIATTNPVSTECYGTVSMDLQQQENH

SEQ ID NO: 85476 - protein, 34 aa, Artificial Sequence
  Description of Artificial Sequence: Synthetic polypeptide
DEEEIRTTNPVATEQYGSVWTVDCQARNSLQERV

SEQ ID NO: 85477 - protein, 28 aa, Artificial Sequence
  Description of Artificial Sequence: Synthetic peptide
DENEIATTNPVSTECYGDVSNCIQHEQR

SEQ ID NO: 85478 - protein, 29 aa, Artificial Sequence
  Description of Artificial Sequence: Synthetic peptide
DENEIATTNPVSTECYGDVSMDLQQQENH

SEQ ID NO: 85479 - protein, 32 aa, Artificial Sequence
  Description of Artificial Sequence: Synthetic polypeptide
DEAEIRTTNPVAYEQWGSVSTTNGDNHGNNTL

SEQ ID NO: 85480 - protein, 30 aa, Artificial Sequence
  Description of Artificial Sequence: Synthetic polypeptide
DEAEIRTTNGVAYCQYGSYVSLTNNVAGEQ

SEQ ID NO: 85481 - protein, 32 aa, Artificial Sequence
  Description of Artificial Sequence: Synthetic polypeptide
DEQEIATTNPVATEQYGSVSATPLEDHEGEDH

SEQ ID NO: 85482 - protein, 34 aa, Artificial Sequence
  Description of Artificial Sequence: Synthetic polypeptide
DEEEIRTTNPVATEQYGSVYEPENLINRTNNIIL

SEQ ID NO: 85483 - protein, 32 aa, Artificial Sequence
  Description of Artificial Sequence: Synthetic polypeptide
DENEIATTNPVAYEQYGSVAITNLTDDQGNSL

SEQ ID NO: 85484 - protein, 32 aa, Artificial Sequence
  Description of Artificial Sequence: Synthetic polypeptide
DEQEIATTNPVATEQYGSVSATTLEWHEGEDL

SEQ ID NO: 85485 - protein, 32 aa, Artificial Sequence
  Description of Artificial Sequence: Synthetic polypeptide
DEQEIATTNPVATEQYGSVSATTLNDHEGEDL

SEQ ID NO: 85486 - protein, 31 aa, Artificial Sequence
  Description of Artificial Sequence: Synthetic polypeptide
DEQEIATTNPVATEQYGSVSATVCEDHGEDL

SEQ ID NO: 85487 - protein, 28 aa, Artificial Sequence
  Description of Artificial Sequence: Synthetic peptide
CEGEIAPTNPCSYEQYGTVSCNLQSGQR

SEQ ID NO: 85488 - protein, 31 aa, Artificial Sequence
  Description of Artificial Sequence: Synthetic polypeptide
DEAEIRTTNPVAYEQWGTVSNNTQGDGNGGS

SEQ ID NO: 85489 - protein, 33 aa, Artificial Sequence
  Description of Artificial Sequence: Synthetic polypeptide
DENEIATTNPVAYEQYGSVAATNLQPAEGNHHD

SEQ ID NO: 85490 - protein, 34 aa, Artificial Sequence
  Description of Artificial Sequence: Synthetic polypeptide
DEEEIRTTNPVATEQYGSVYEVTLTGLQLVGEIE

SEQ ID NO: 85491 - protein, 33 aa, Artificial Sequence
  Description of Artificial Sequence: Synthetic polypeptide
DEAEIRTTNPVAYEQWGTVSTNLNAGNAGEGSR

SEQ ID NO: 85492 - protein, 35 aa, Artificial Sequence
  Description of Artificial Sequence: Synthetic polypeptide
DEEEIRTTNPVATEQYGSVYGDGNNLQVGEGNNGQ

SEQ ID NO: 85493 - protein, 34 aa, Artificial Sequence
  Description of Artificial Sequence: Synthetic polypeptide
DEEEIRTTNPVATEQYGSVYGDNMSQGEGFGNGG

SEQ ID NO: 85494 - protein, 33 aa, Artificial Sequence
  Description of Artificial Sequence: Synthetic polypeptide
DEAEIRTTNPVAYEQWGTVSTNLQTGGGHNDGS

SEQ ID NO: 85495 - protein, 31 aa, Artificial Sequence
  Description of Artificial Sequence: Synthetic polypeptide
DENEIATTNPVATESYGSVANNNLQDAGGTH

SEQ ID NO: 85496 - protein, 32 aa, Artificial Sequence
  Description of Artificial Sequence: Synthetic polypeptide
DEQEIATTNPVATEQYGSVSATVLEDHEGEDH

SEQ ID NO: 85497 - protein, 31 aa, Artificial Sequence
  Description of Artificial Sequence: Synthetic polypeptide
DEAEIRTTNPVAYEQWGTYVYTDMLDRGNGS

SEQ ID NO: 85498 - protein, 32 aa, Artificial Sequence
  Description of Artificial Sequence: Synthetic polypeptide
DEQEIATTNPVATEQYGSVSATVLEDHEGEDK

SEQ ID NO: 85499 - protein, 31 aa, Artificial Sequence
  Description of Artificial Sequence: Synthetic polypeptide
DENEIATTNPVAYEIYGSVSNNLQNHGTEME

SEQ ID NO: 85500 - protein, 32 aa, Artificial Sequence
  Description of Artificial Sequence: Synthetic polypeptide
DEQEIATTNPVATEQYGSVSATTLEDHEGEDL

SEQ ID NO: 85501 - protein, 32 aa, Artificial Sequence
  Description of Artificial Sequence: Synthetic polypeptide
DEQEIATTNPVATEQYGSVSATTLEDHEGDDL

SEQ ID NO: 85502 - protein, 31 aa, Artificial Sequence
  Description of Artificial Sequence: Synthetic polypeptide
DENEIATTNPVAYEQYGSVAMHLQENPGENH

SEQ ID NO: 85503 - protein, 34 aa, Artificial Sequence
  Description of Artificial Sequence: Synthetic polypeptide
DEAEIRTTNPVAYEQWGSVSTVNNLPQGDGNNEE

SEQ ID NO: 85504 - protein, 32 aa, Artificial Sequence
  Description of Artificial Sequence: Synthetic polypeptide
DEQEIATTNPVATEQYGSVSATQLEDHEGEDL

SEQ ID NO: 85505 - protein, 32 aa, Artificial Sequence
  Description of Artificial Sequence: Synthetic polypeptide
DEQEIATTNPVATEQYGSVSATRDLEHEGEDL

SEQ ID NO: 85506 - protein, 32 aa, Artificial Sequence
  Description of Artificial Sequence: Synthetic polypeptide
DEQEIATTNPVATEQYGSVSATRLEDHEGEDL

SEQ ID NO: 85507 - protein, 31 aa, Artificial Sequence
  Description of Artificial Sequence: Synthetic polypeptide
DENEIATTNPVAYEQYGSVATHLQDSEDGEM

SEQ ID NO: 85508 - protein, 32 aa, Artificial Sequence
  Description of Artificial Sequence: Synthetic polypeptide
DEQEIATTNPVATEQYGSVSATSLEDHEGEDG

SEQ ID NO: 85509 - protein, 32 aa, Artificial Sequence
  Description of Artificial Sequence: Synthetic polypeptide
DEQEIATTNPVATEQYGSVSATSLEDHEGEDL

SEQ ID NO: 85510 - protein, 32 aa, Artificial Sequence
  Description of Artificial Sequence: Synthetic polypeptide
DEEEIRTTNPVATEQYGSVYESGLQVEAEDSS

SEQ ID NO: 85511 - protein, 32 aa, Artificial Sequence
  Description of Artificial Sequence: Synthetic polypeptide
DEQEIATTNPVATEQYGSVSATSLEDHEGWDL

SEQ ID NO: 85512 - protein, 32 aa, Artificial Sequence
  Description of Artificial Sequence: Synthetic polypeptide
DENEIATTNPVAYEQYGSVATAGTQTGNGDER

SEQ ID NO: 85513 - protein, 32 aa, Artificial Sequence
  Description of Artificial Sequence: Synthetic polypeptide
DEQEIATTNPVATEQYGSVSATSLHDHEGEDL

SEQ ID NO: 85514 - protein, 31 aa, Artificial Sequence
  Description of Artificial Sequence: Synthetic polypeptide
DENEIATTNPVAYEQYGSVASNDQRDDNPLD

SEQ ID NO: 85515 - protein, 32 aa, Artificial Sequence
  Description of Artificial Sequence: Synthetic polypeptide
DEAEIRTTNPVAYEQWGSVVITNDQGGGGNME

SEQ ID NO: 85516 - protein, 34 aa, Artificial Sequence
  Description of Artificial Sequence: Synthetic polypeptide
DEEEIRTTNPVATEQYGSVYETSLLIQVGEMELD

SEQ ID NO: 85517 - protein, 33 aa, Artificial Sequence
  Description of Artificial Sequence: Synthetic polypeptide
DENEIATTNPVAYEQYGSVANTNLQTANPGERD

SEQ ID NO: 85518 - protein, 32 aa, Artificial Sequence
  Description of Artificial Sequence: Synthetic polypeptide
DEQEIATTNPVATEQYGSVSATTLEDEIGEDL

SEQ ID NO: 85519 - protein, 33 aa, Artificial Sequence
  Description of Artificial Sequence: Synthetic polypeptide
DEAEIRTTNPVAYEQWGSVVSTNNIDGEDGGNR

SEQ ID NO: 85520 - protein, 32 aa, Artificial Sequence
  Description of Artificial Sequence: Synthetic polypeptide
DEQEIATTNPVATEQYGSVSATPLEDHEGEDL

SEQ ID NO: 85521 - protein, 33 aa, Artificial Sequence
  Description of Artificial Sequence: Synthetic polypeptide
DEAEIRTTNGVAYDQWGSTVSCTNLSQRTVGDR

SEQ ID NO: 85522 - protein, 33 aa, Artificial Sequence
  Description of Artificial Sequence: Synthetic polypeptide
DEAEIRTTNPVAYEQWGSVSTNLNGEHGGNNSH

SEQ ID NO: 85523 - protein, 34 aa, Artificial Sequence
  Description of Artificial Sequence: Synthetic polypeptide
DEAEIRTTNGVAYDQYGSVSCTNALSQRTGGDNE

SEQ ID NO: 85524 - protein, 32 aa, Artificial Sequence
  Description of Artificial Sequence: Synthetic polypeptide
DEQEIATTNPVATEQYGSVSATKLEDHEGEDA

SEQ ID NO: 85525 - protein, 32 aa, Artificial Sequence
  Description of Artificial Sequence: Synthetic polypeptide
DEQEIATTNPVATEQYGSVSATKLEDHEGEDL

SEQ ID NO: 85526 - protein, 33 aa, Artificial Sequence
  Description of Artificial Sequence: Synthetic polypeptide
DEAEIRTTNPVAYEQWGSVSGNNLNQGGMNGGS

SEQ ID NO: 85527 - protein, 32 aa, Artificial Sequence
  Description of Artificial Sequence: Synthetic polypeptide
DEQEIATTNPVATEQYGSVSATLLEDHEGEDL

SEQ ID NO: 85528 - protein, 30 aa, Artificial Sequence
  Description of Artificial Sequence: Synthetic polypeptide
DENEIRCTNPIATEPYGSISMDIQQRNGNH

SEQ ID NO: 85529 - protein, 32 aa, Artificial Sequence
  Description of Artificial Sequence: Synthetic polypeptide
DEQEIATTNPVATEQYGSVSATLLEDHEGWDL

SEQ ID NO: 85530 - protein, 34 aa, Artificial Sequence
  Description of Artificial Sequence: Synthetic polypeptide
DEAEIRTTNPVAYEQWGSVSHTMNDLNDRGGNDP

SEQ ID NO: 85531 - protein, 32 aa, Artificial Sequence
  Description of Artificial Sequence: Synthetic polypeptide
DEQEIATTNPVATEQYGSVSATKLEDHDGEDL

SEQ ID NO: 85532 - protein, 33 aa, Artificial Sequence
  Description of Artificial Sequence: Synthetic polypeptide
DEAEIRTTNPVAYEQWGSVSHTMNDQNGGGNQD

SEQ ID NO: 85533 - protein, 32 aa, Artificial Sequence
  Description of Artificial Sequence: Synthetic polypeptide
DEQEIATTNPVATEQYGSVSATMLEDHEGEDL

SEQ ID NO: 85534 - protein, 32 aa, Artificial Sequence
  Description of Artificial Sequence: Synthetic polypeptide
DEQEIATTNPVATEQYGSVSATMLEDHVGEDL

SEQ ID NO: 85535 - protein, 33 aa, Artificial Sequence
  Description of Artificial Sequence: Synthetic polypeptide
DEQEIATTNPVATEQYGSVSATNDLEDHEGEDL

SEQ ID NO: 85536 - protein, 33 aa, Artificial Sequence
  Description of Artificial Sequence: Synthetic polypeptide
DEQEIATTNPVATEQYGSVSATNDLEDHEGGDL

SEQ ID NO: 85537 - protein, 31 aa, Artificial Sequence
  Description of Artificial Sequence: Synthetic polypeptide
DEAEIRTTNPVAYEQWGSVSNDNGDNAGNTD

SEQ ID NO: 85538 - protein, 32 aa, Artificial Sequence
  Description of Artificial Sequence: Synthetic polypeptide
DENEIRCTNPCATEQYGVSVNAENSLERGNID

SEQ ID NO: 85539 - protein, 33 aa, Artificial Sequence
  Description of Artificial Sequence: Synthetic polypeptide
DEAEIRTTNPVAYEQWGSVSNENLGQGGMNGGH

SEQ ID NO: 85540 - protein, 32 aa, Artificial Sequence
  Description of Artificial Sequence: Synthetic polypeptide
DEQEIATTNPVATEQYGSVSATMLEDHEGEDC

SEQ ID NO: 85541 - protein, 32 aa, Artificial Sequence
  Description of Artificial Sequence: Synthetic polypeptide
DEQEIATTNPVATEQYGSVSATILEDTEGEDQ

SEQ ID NO: 85542 - protein, 32 aa, Artificial Sequence
  Description of Artificial Sequence: Synthetic polypeptide
DEQEIATTNPVATEQYGSVSATILEDKEGEDL

SEQ ID NO: 85543 - protein, 32 aa, Artificial Sequence
  Description of Artificial Sequence: Synthetic polypeptide
DEQEIATTNPVATEQYGSVSATILEDHEGEDL

SEQ ID NO: 85544 - protein, 30 aa, Artificial Sequence
  Description of Artificial Sequence: Synthetic polypeptide
DENEIRCTNPVATEPYGSISEEDIQMQGNH

SEQ ID NO: 85545 - protein, 34 aa, Artificial Sequence
  Description of Artificial Sequence: Synthetic polypeptide
DEEEIRTTNPVATEQYGSVSTSAPMVREIENNQD

SEQ ID NO: 85546 - protein, 30 aa, Artificial Sequence
  Description of Artificial Sequence: Synthetic polypeptide
DENEIRCTNPVATEPYGEASMDIQQQQGNR

SEQ ID NO: 85547 - protein, 34 aa, Artificial Sequence
  Description of Artificial Sequence: Synthetic polypeptide
DEEEIRTTNPVATEQYGSVSTRNPMADSGSDQEY

SEQ ID NO: 85548 - protein, 33 aa, Artificial Sequence
  Description of Artificial Sequence: Synthetic polypeptide
DEQEIATTNPVATEQYGSVSATIDLEDREGEDG

SEQ ID NO: 85549 - protein, 33 aa, Artificial Sequence
  Description of Artificial Sequence: Synthetic polypeptide
DEQEIATTNPVATEQYGSVSATIDLEDREGEDL

SEQ ID NO: 85550 - protein, 32 aa, Artificial Sequence
  Description of Artificial Sequence: Synthetic polypeptide
DENEIRCTNPVATECWGSASCNEPQDREGENR

SEQ ID NO: 85551 - protein, 34 aa, Artificial Sequence
  Description of Artificial Sequence: Synthetic polypeptide
DEQEIATTNPVATEQYGSVSATIDLEDREGENDG

SEQ ID NO: 85552 - protein, 32 aa, Artificial Sequence
  Description of Artificial Sequence: Synthetic polypeptide
DEAEIRTTNPVAYEQWGSVSGDNDNQQMGQNM

SEQ ID NO: 85553 - protein, 31 aa, Artificial Sequence
  Description of Artificial Sequence: Synthetic polypeptide
DENEIRCTNPVATECWGEVSCINLQDREGGG

SEQ ID NO: 85554 - protein, 33 aa, Artificial Sequence
  Description of Artificial Sequence: Synthetic polypeptide
DEQEIATTNPVATEQYGSVSATIDLQDHEGEDL

SEQ ID NO: 85555 - protein, 34 aa, Artificial Sequence
  Description of Artificial Sequence: Synthetic polypeptide
DEEEIRTTNPVATEQYGSVSTQSNQDGEMTEDEG

SEQ ID NO: 85556 - protein, 32 aa, Artificial Sequence
  Description of Artificial Sequence: Synthetic polypeptide
DEQEIATTNPVATEQYGSVSATILEDAEGEDA

SEQ ID NO: 85557 - protein, 32 aa, Artificial Sequence
  Description of Artificial Sequence: Synthetic polypeptide
DEQEIATTNPVATEQYGSVSATILEDAEGEDL

SEQ ID NO: 85558 - protein, 31 aa, Artificial Sequence
  Description of Artificial Sequence: Synthetic polypeptide
DEQEIATTNPVATEQYGSVSATILEDHEEEL

SEQ ID NO: 85559 - protein, 31 aa, Artificial Sequence
  Description of Artificial Sequence: Synthetic polypeptide
DENEIRCTNPVATECWGEVSCINEPQREGGR

SEQ ID NO: 85560 - protein, 32 aa, Artificial Sequence
  Description of Artificial Sequence: Synthetic polypeptide
DEQEIATTNPVATEQYGSVSATILEDHEGDDL

SEQ ID NO: 85561 - protein, 32 aa, Artificial Sequence
  Description of Artificial Sequence: Synthetic polypeptide
DEAEIRTTNPVAYEQWGSVSNGNGHQNAGNED

SEQ ID NO: 85562 - protein, 32 aa, Artificial Sequence
  Description of Artificial Sequence: Synthetic polypeptide
DEAEIRTTNPVAYEQWGSVSNLNDQGGMNGGH

SEQ ID NO: 85563 - protein, 32 aa, Artificial Sequence
  Description of Artificial Sequence: Synthetic polypeptide
DEAEIRTTNPVAYEQWGSVSNMNLQGNMNGGH

SEQ ID NO: 85564 - protein, 34 aa, Artificial Sequence
  Description of Artificial Sequence: Synthetic polypeptide
DEEEIRTTNPVATEQYGSVWPNNVEVQNVIENRL

SEQ ID NO: 85565 - protein, 30 aa, Artificial Sequence
  Description of Artificial Sequence: Synthetic polypeptide
DENEIATVNPVCTEQYGVVSMENIQQQGNH

SEQ ID NO: 85566 - protein, 31 aa, Artificial Sequence
  Description of Artificial Sequence: Synthetic polypeptide
DEAEIRTTNPVAYEQWGSVSTDNHGAAGDDS

SEQ ID NO: 85567 - protein, 28 aa, Artificial Sequence
  Description of Artificial Sequence: Synthetic peptide
CEGEIAPTNPCSSEQYGIVSCNLQSGTR

SEQ ID NO: 85568 - protein, 32 aa, Artificial Sequence
  Description of Artificial Sequence: Synthetic polypeptide
DEAEIRTTNPVAYEQWGSVSTDNHGAAGGNES

SEQ ID NO: 85569 - protein, 32 aa, Artificial Sequence
  Description of Artificial Sequence: Synthetic polypeptide
DEAEIRTTNPVAYEQWGSVSTDNHGAAGGNSP

SEQ ID NO: 85570 - protein, 32 aa, Artificial Sequence
  Description of Artificial Sequence: Synthetic polypeptide
DEAEIRTTNPVAYEQWGSVSTDNHGAAGNGSG

SEQ ID NO: 85571 - protein, 32 aa, Artificial Sequence
  Description of Artificial Sequence: Synthetic polypeptide
DEAEIRTTNPVAYEQWGSVSTDNHGADAGNAS

SEQ ID NO: 85572 - protein, 29 aa, Artificial Sequence
  Description of Artificial Sequence: Synthetic peptide
DENEIATVNPVATEQWGDVSENLMNAGDA

SEQ ID NO: 85573 - protein, 29 aa, Artificial Sequence
  Description of Artificial Sequence: Synthetic peptide
DENEIATTNPVSTEQYGTASMNIQQQGGH

SEQ ID NO: 85574 - protein, 32 aa, Artificial Sequence
  Description of Artificial Sequence: Synthetic polypeptide
DEAEIRTTNPVAYEQWGSVSTGNDAHQDSNQP

SEQ ID NO: 85575 - protein, 33 aa, Artificial Sequence
  Description of Artificial Sequence: Synthetic polypeptide
DEAEIRTTNPVAYEQWGSVSTGNMGQSGGGDKR

SEQ ID NO: 85576 - protein, 33 aa, Artificial Sequence
  Description of Artificial Sequence: Synthetic polypeptide
DEAEIRTTNPCATECYGSVSTSNGLNSDGQGER

SEQ ID NO: 85577 - protein, 31 aa, Artificial Sequence
  Description of Artificial Sequence: Synthetic polypeptide
DENEIATTNPVSTEPYGTVSMENIQQQNGNR

SEQ ID NO: 85578 - protein, 31 aa, Artificial Sequence
  Description of Artificial Sequence: Synthetic polypeptide
DENEIATTNPVSTEPYGTISCENLQQSNGNR

SEQ ID NO: 85579 - protein, 33 aa, Artificial Sequence
  Description of Artificial Sequence: Synthetic polypeptide
DEAEIRTTNPCATECYGSVSTGNLAGNAGENSE

SEQ ID NO: 85580 - protein, 32 aa, Artificial Sequence
  Description of Artificial Sequence: Synthetic polypeptide
DEAEIRTTNPCATECYGSVSTGNGNQGDGSDE

SEQ ID NO: 85581 - protein, 29 aa, Artificial Sequence
  Description of Artificial Sequence: Synthetic peptide
DENEIATTNPVSTEGYGVISMTLQQQGNH

SEQ ID NO: 85582 - protein, 33 aa, Artificial Sequence
  Description of Artificial Sequence: Synthetic polypeptide
DEQEIATTNPVATEQYGSVSATNLLEDEEGEDL

SEQ ID NO: 85583 - protein, 32 aa, Artificial Sequence
  Description of Artificial Sequence: Synthetic polypeptide
DEQEIATTNPVATEQYGSVSATVLEDHEGEDL

SEQ ID NO: 85584 - protein, 33 aa, Artificial Sequence
  Description of Artificial Sequence: Synthetic polypeptide
DEEEIRTTNPVATEQYGSVWQEGVILEGGNSDE

SEQ ID NO: 85585 - protein, 30 aa, Artificial Sequence
  Description of Artificial Sequence: Synthetic polypeptide
DENEIATVNPVSTEQYGVVSMENIQQQGNH

SEQ ID NO: 85586 - protein, 32 aa, Artificial Sequence
  Description of Artificial Sequence: Synthetic polypeptide
DEAEIRTTNPVAYEQWGSVSNNDGQNAGNGDM

SEQ ID NO: 85587 - protein, 32 aa, Artificial Sequence
  Description of Artificial Sequence: Synthetic polypeptide
DENEIKTTNPAATEQYGSVPTENLIMGGNGGT

SEQ ID NO: 85588 - protein, 35 aa, Artificial Sequence
  Description of Artificial Sequence: Synthetic polypeptide
DENEIGTTNPVATEQYGSVSWTYNANQERMGNQDH

SEQ ID NO: 85589 - protein, 32 aa, Artificial Sequence
  Description of Artificial Sequence: Synthetic polypeptide
DEAEIRTTNPVAYEQWGSVSNNDGTQNAGNSD

SEQ ID NO: 85590 - protein, 31 aa, Artificial Sequence
  Description of Artificial Sequence: Synthetic polypeptide
DEAEIRTTNPCAYEAYGSVACTNHFGRGGNA

SEQ ID NO: 85591 - protein, 30 aa, Artificial Sequence
  Description of Artificial Sequence: Synthetic polypeptide
DEAEIRTTNPCATRQYGCVPNIDLQRGEDF

SEQ ID NO: 85592 - protein, 33 aa, Artificial Sequence
  Description of Artificial Sequence: Synthetic polypeptide
DEAEIRTTNPVAYEQWGSVSNNGLQEGGMNGGH

SEQ ID NO: 85593 - protein, 32 aa, Artificial Sequence
  Description of Artificial Sequence: Synthetic polypeptide
DEAEIRTTNPVAYEQWGSVSNNLEQGQMNGGH

SEQ ID NO: 85594 - protein, 32 aa, Artificial Sequence
  Description of Artificial Sequence: Synthetic polypeptide
DEAEIRTTNPVAYEQWGSVSNNNGHQNAGDND

SEQ ID NO: 85595 - protein, 32 aa, Artificial Sequence
  Description of Artificial Sequence: Synthetic polypeptide
DEAEIRTTNPVAYEQWGSVSNNNGHQNAGNDS

SEQ ID NO: 85596 - protein, 33 aa, Artificial Sequence
  Description of Artificial Sequence: Synthetic polypeptide
DEAEIRTTNPCATEQYGEVSTSNGLNDNGQGER

SEQ ID NO: 85597 - protein, 32 aa, Artificial Sequence
  Description of Artificial Sequence: Synthetic polypeptide
DEEEIRTTNPVATEQYGSVWPTQLDESEYDDS

SEQ ID NO: 85598 - protein, 32 aa, Artificial Sequence
  Description of Artificial Sequence: Synthetic polypeptide
DEAEIRTTNPVAYEQWGSVSNNPQQGGMNGGH

SEQ ID NO: 85599 - protein, 33 aa, Artificial Sequence
  Description of Artificial Sequence: Synthetic polypeptide
DEEEIRTTNPVATEQYGSVWPTQNLDESDEYDT

SEQ ID NO: 85600 - protein, 33 aa, Artificial Sequence
  Description of Artificial Sequence: Synthetic polypeptide
DEQEIATTNPVATEQYGSVSATNLEDHEGEDLV

SEQ ID NO: 85601 - protein, 28 aa, Artificial Sequence
  Description of Artificial Sequence: Synthetic peptide
CEGEIAPTNPCSHEQYGIVSCNLQSGTR

SEQ ID NO: 85602 - protein, 32 aa, Artificial Sequence
  Description of Artificial Sequence: Synthetic polypeptide
DEAEIRTTNPCATEQYGEVSTGNAQGVENGDQ

SEQ ID NO: 85603 - protein, 32 aa, Artificial Sequence
  Description of Artificial Sequence: Synthetic polypeptide
DEAEIRTTNPVAYEQWGSVSNPNGQNAGQNED

SEQ ID NO: 85604 - protein, 33 aa, Artificial Sequence
  Description of Artificial Sequence: Synthetic polypeptide
DEQEIATTNPVATEQYGSVSATIDLEDHEGNDL

SEQ ID NO: 85605 - protein, 31 aa, Artificial Sequence
  Description of Artificial Sequence: Synthetic polypeptide
DEAEIRTTNPVAYEQWGVCSTQLQRPDNDDN

SEQ ID NO: 85606 - protein, 34 aa, Artificial Sequence
  Description of Artificial Sequence: Synthetic polypeptide
DEEEIRTTNPVATEQYGSVSTPVVQSQQEMNMVI

SEQ ID NO: 85607 - protein, 32 aa, Artificial Sequence
  Description of Artificial Sequence: Synthetic polypeptide
DEAEIRTCNPVATDQYGSVSMTRLQHPNMQDE

SEQ ID NO: 85608 - protein, 31 aa, Artificial Sequence
  Description of Artificial Sequence: Synthetic polypeptide
DENEIATTNPVATEQYGSVSAEILEDHEGEL

SEQ ID NO: 85609 - protein, 31 aa, Artificial Sequence
  Description of Artificial Sequence: Synthetic polypeptide
DENEIATTNPVATEQYGSVSAEILEDHAGEL

SEQ ID NO: 85610 - protein, 31 aa, Artificial Sequence
  Description of Artificial Sequence: Synthetic polypeptide
DENEIATTNPVATEQYGSVSAEDLMDAAGDL

SEQ ID NO: 85611 - protein, 31 aa, Artificial Sequence
  Description of Artificial Sequence: Synthetic polypeptide
DENEIATTNPVATEQYGSVSAEDLEDHGEDL

SEQ ID NO: 85612 - protein, 30 aa, Artificial Sequence
  Description of Artificial Sequence: Synthetic polypeptide
CEEEIATTNPVATESYGCIAGTNDQRDNFD

SEQ ID NO: 85613 - protein, 31 aa, Artificial Sequence
  Description of Artificial Sequence: Synthetic polypeptide
DENEIATTNPVATEQYGSVSAEDLEDHEGEL

SEQ ID NO: 85614 - protein, 33 aa, Artificial Sequence
  Description of Artificial Sequence: Synthetic polypeptide
DEEEIRTTNPVATEQYGSVYNNLDDIENVVVVI

SEQ ID NO: 85615 - protein, 31 aa, Artificial Sequence
  Description of Artificial Sequence: Synthetic polypeptide
DENEIATTNPVATEQYGSVSAECLEDHEGEL

SEQ ID NO: 85616 - protein, 31 aa, Artificial Sequence
  Description of Artificial Sequence: Synthetic polypeptide
CEGTIRTTNPVATEQYGSAGDTNLIIGGNGD

SEQ ID NO: 85617 - protein, 32 aa, Artificial Sequence
  Description of Artificial Sequence: Synthetic polypeptide
DEAEIRTTNPVAYEQYGSIPSTNMLSEATVNP

SEQ ID NO: 85618 - protein, 35 aa, Artificial Sequence
  Description of Artificial Sequence: Synthetic polypeptide
DENEIATTNPVATEQYGSVCSPTGNNNQTRAGPNL

SEQ ID NO: 85619 - protein, 36 aa, Artificial Sequence
  Description of Artificial Sequence: Synthetic polypeptide
DENEIATTNPVATEQYGSVCSPTGNNLDQTRAGNES

SEQ ID NO: 85620 - protein, 33 aa, Artificial Sequence
  Description of Artificial Sequence: Synthetic polypeptide
DEEEIRTTNPVATEQYGSVYPMNMVVTNLVEND

SEQ ID NO: 85621 - protein, 30 aa, Artificial Sequence
  Description of Artificial Sequence: Synthetic polypeptide
CEEEIATTNPVATESYGCIAGNNLQDGNDQ

SEQ ID NO: 85622 - protein, 29 aa, Artificial Sequence
  Description of Artificial Sequence: Synthetic peptide
CEEEIATTNPVATESYGCIAGANDQRDND

SEQ ID NO: 85623 - protein, 31 aa, Artificial Sequence
  Description of Artificial Sequence: Synthetic polypeptide
DEAEIRTTNPVAYEQYGSICSTNLENPSDAS

SEQ ID NO: 85624 - protein, 32 aa, Artificial Sequence
  Description of Artificial Sequence: Synthetic polypeptide
DENEIATTNPVATEQYGSVSATCLEDHEGEDL

SEQ ID NO: 85625 - protein, 33 aa, Artificial Sequence
  Description of Artificial Sequence: Synthetic polypeptide
DEAEIRTTNCVAYCAYGSTVPSTNELSQRVGDR

SEQ ID NO: 85626 - protein, 31 aa, Artificial Sequence
  Description of Artificial Sequence: Synthetic polypeptide
DENEIATTNPVATEQYGSVSATDEEDHAGEL

SEQ ID NO: 85627 - protein, 31 aa, Artificial Sequence
  Description of Artificial Sequence: Synthetic polypeptide
DEQEIATTNPVATEQYGSVSTDEEDHEGEDL

SEQ ID NO: 85628 - protein, 31 aa, Artificial Sequence
  Description of Artificial Sequence: Synthetic polypeptide
DEQEIATTNPVATEQYGSVSTDIEDHNGEDL

SEQ ID NO: 85629 - protein, 31 aa, Artificial Sequence
  Description of Artificial Sequence: Synthetic polypeptide
DENEIATTNPVATEQYGSVSATILEDHEEEA

SEQ ID NO: 85630 - protein, 33 aa, Artificial Sequence
  Description of Artificial Sequence: Synthetic polypeptide
DENEIATTNPVATEQYGSVSATDLQEDHEGEDL

SEQ ID NO: 85631 - protein, 33 aa, Artificial Sequence
  Description of Artificial Sequence: Synthetic polypeptide
DENEIATTNPVATEQYGSVSATDLQEDHEGEDH

SEQ ID NO: 85632 - protein, 32 aa, Artificial Sequence
  Description of Artificial Sequence: Synthetic polypeptide
DENEIATTNPVATEQYGSVSATDLMDHAGDDL

SEQ ID NO: 85633 - protein, 32 aa, Artificial Sequence
  Description of Artificial Sequence: Synthetic polypeptide
CEEEIATTNPVAYEQYGCVATNLQDAEGNHDD

SEQ ID NO: 85634 - protein, 32 aa, Artificial Sequence
  Description of Artificial Sequence: Synthetic polypeptide
DEQEIATTNPVATEQYGSVSTIDLEDHEGEDG

SEQ ID NO: 85635 - protein, 34 aa, Artificial Sequence
  Description of Artificial Sequence: Synthetic polypeptide
DEEEIRTTNPVATEQYGSVYLTENQHQQRDTIDD

SEQ ID NO: 85636 - protein, 33 aa, Artificial Sequence
  Description of Artificial Sequence: Synthetic polypeptide
DEQEIATTNPVATEQYGSVSTNEPEDREGEEDL

SEQ ID NO: 85637 - protein, 33 aa, Artificial Sequence
  Description of Artificial Sequence: Synthetic polypeptide
DEAEIRTTNPVAYEQYGQSVSDNELLTEGIERF

SEQ ID NO: 85638 - protein, 30 aa, Artificial Sequence
  Description of Artificial Sequence: Synthetic polypeptide
CEEEIATTNPVATESYGVVAGTNLARPDQD

SEQ ID NO: 85639 - protein, 32 aa, Artificial Sequence
  Description of Artificial Sequence: Synthetic polypeptide
DENEIATTNPVATEQYGSVSATDLEDHEGEDL

SEQ ID NO: 85640 - protein, 31 aa, Artificial Sequence
  Description of Artificial Sequence: Synthetic polypeptide
DENEIATTNPVATEQYGSVSATDLEDHEEDL

SEQ ID NO: 85641 - protein, 32 aa, Artificial Sequence
  Description of Artificial Sequence: Synthetic polypeptide
DENEIATTNPVATEQYGSVSATDLDDHEGEDL

SEQ ID NO: 85642 - protein, 34 aa, Artificial Sequence
  Description of Artificial Sequence: Synthetic polypeptide
DEAEIRTTNCVAYCAYGSVVSCTNELSQRGGDNR

SEQ ID NO: 85643 - protein, 33 aa, Artificial Sequence
  Description of Artificial Sequence: Synthetic polypeptide
DEAEIRTTNCVAYCAYGSTVSCTNLSQRGGDNS

SEQ ID NO: 85644 - protein, 35 aa, Artificial Sequence
  Description of Artificial Sequence: Synthetic polypeptide
DENEIATTNPVATEQYGSVCSPTGNNLDQTEAGNN

SEQ ID NO: 85645 - protein, 31 aa, Artificial Sequence
  Description of Artificial Sequence: Synthetic polypeptide
DENEIATTNPVATEQYGSVSATILEDHEEEL

SEQ ID NO: 85646 - protein, 33 aa, Artificial Sequence
  Description of Artificial Sequence: Synthetic polypeptide
DEEEIRTTNPVATEQYGSVYPNANEQNSNPINN

SEQ ID NO: 85647 - protein, 31 aa, Artificial Sequence
  Description of Artificial Sequence: Synthetic polypeptide
DEAEIRCTNPVAYEQYGEVSVNQSDNGGNNR

SEQ ID NO: 85648 - protein, 33 aa, Artificial Sequence
  Description of Artificial Sequence: Synthetic polypeptide
DENEIATTNPVATEQYGSVATNPEPLDDDHNRH

SEQ ID NO: 85649 - protein, 32 aa, Artificial Sequence
  Description of Artificial Sequence: Synthetic polypeptide
DENEIATTNPVATEQYGSVATNLEAPDNQHHS

SEQ ID NO: 85650 - protein, 35 aa, Artificial Sequence
  Description of Artificial Sequence: Synthetic polypeptide
DEEEIRTTNPVATEQYGSVYPTNMPETREGVNVIT

SEQ ID NO: 85651 - protein, 35 aa, Artificial Sequence
  Description of Artificial Sequence: Synthetic polypeptide
DEEEIRTTNPVATEQYGSVYPTNMPETRLGVNVEM

SEQ ID NO: 85652 - protein, 32 aa, Artificial Sequence
  Description of Artificial Sequence: Synthetic polypeptide
DENEIATTNPVATEQYGSVASNPQNRNQNGQP

SEQ ID NO: 85653 - protein, 34 aa, Artificial Sequence
  Description of Artificial Sequence: Synthetic polypeptide
DEEEIRTTNPVATEQYGSVYPTPLPETRGQSFET

SEQ ID NO: 85654 - protein, 35 aa, Artificial Sequence
  Description of Artificial Sequence: Synthetic polypeptide
DEEEIRTTNPVATEQYGSVYPTQNLPETRGQVVED

SEQ ID NO: 85655 - protein, 34 aa, Artificial Sequence
  Description of Artificial Sequence: Synthetic polypeptide
DEAEIRTTNPVAYEQYGVSVSTGNHAQRTVNNQG

SEQ ID NO: 85656 - protein, 35 aa, Artificial Sequence
  Description of Artificial Sequence: Synthetic polypeptide
DEEEIRTTNPVATEQYGSVYPTTNLPETRGVSVEE

SEQ ID NO: 85657 - protein, 32 aa, Artificial Sequence
  Description of Artificial Sequence: Synthetic polypeptide
DEQEIATTNPVATEQYGSVSTTDLEDHEGEDV

SEQ ID NO: 85658 - protein, 32 aa, Artificial Sequence
  Description of Artificial Sequence: Synthetic polypeptide
DEQEIATTNPVATEQYGSVSTTDLEDHEGEPL

SEQ ID NO: 85659 - protein, 33 aa, Artificial Sequence
  Description of Artificial Sequence: Synthetic polypeptide
DEEEIRTTNPVATEQYGSVYPWNDIQLMQELFE

SEQ ID NO: 85660 - protein, 32 aa, Artificial Sequence
  Description of Artificial Sequence: Synthetic polypeptide
DEQEIATTNPVATEQYGSVSTTDLEEHEGEPL

SEQ ID NO: 85661 - protein, 32 aa, Artificial Sequence
  Description of Artificial Sequence: Synthetic polypeptide
DEQEIATTNPVATEQYGSVSTTDLLDTEGEDT

SEQ ID NO: 85662 - protein, 33 aa, Artificial Sequence
  Description of Artificial Sequence: Synthetic polypeptide
DEQEIATTNPVATEQYGSVSTTDLPEDHEGNPL

SEQ ID NO: 85663 - protein, 35 aa, Artificial Sequence
  Description of Artificial Sequence: Synthetic polypeptide
DEEEIRTTNPVATEQYGSVYQENSLEQQPGVPERF

SEQ ID NO: 85664 - protein, 33 aa, Artificial Sequence
  Description of Artificial Sequence: Synthetic polypeptide
DENEIATTNPVATEQYGSVAMNLQTDPGGEPRN

SEQ ID NO: 85665 - protein, 30 aa, Artificial Sequence
  Description of Artificial Sequence: Synthetic polypeptide
DEAEIRTTNPVAYEQYGVCSTWDQDPNNDA

SEQ ID NO: 85666 - protein, 32 aa, Artificial Sequence
  Description of Artificial Sequence: Synthetic polypeptide
DEQEIATTNPVATEQYGSVSTTDLEDHEGEDL

SEQ ID NO: 85667 - protein, 32 aa, Artificial Sequence
  Description of Artificial Sequence: Synthetic polypeptide
DEQEIATTNPVATEQYGSVSTTDLEDEEGEDD

SEQ ID NO: 85668 - protein, 32 aa, Artificial Sequence
  Description of Artificial Sequence: Synthetic polypeptide
DEQEIATTNPVATEQYGSVSTTALEDHEGEDL

SEQ ID NO: 85669 - protein, 32 aa, Artificial Sequence
  Description of Artificial Sequence: Synthetic polypeptide
DEQEIATTNPVATEQYGSVSTTALEDHNGEDL

SEQ ID NO: 85670 - protein, 34 aa, Artificial Sequence
  Description of Artificial Sequence: Synthetic polypeptide
DEEEIRTTNPVATEQYGSVYPPNLPETRGVSVEI

SEQ ID NO: 85671 - protein, 32 aa, Artificial Sequence
  Description of Artificial Sequence: Synthetic polypeptide
DEQEIATTNPVATEQYGSVSTTALEDTEGEDE

SEQ ID NO: 85672 - protein, 32 aa, Artificial Sequence
  Description of Artificial Sequence: Synthetic polypeptide
DEQEIATTNPVATEQYGSVSTTALNDHEGEDL

SEQ ID NO: 85673 - protein, 34 aa, Artificial Sequence
  Description of Artificial Sequence: Synthetic polypeptide
DEEEIRTTNPVATEQYGSVYPPPLEHRENIINRI

SEQ ID NO: 85674 - protein, 32 aa, Artificial Sequence
  Description of Artificial Sequence: Synthetic polypeptide
DEQEIATTNPVATEQYGSVSTTDGEDREGEDL

SEQ ID NO: 85675 - protein, 31 aa, Artificial Sequence
  Description of Artificial Sequence: Synthetic polypeptide
DEAEIRTTNPVAYEQYGTVATNPNLGDHGAA

SEQ ID NO: 85676 - protein, 32 aa, Artificial Sequence
  Description of Artificial Sequence: Synthetic polypeptide
CEGTIRTTNPVATEQYGSVADTTNLIGIGNGD

SEQ ID NO: 85677 - protein, 32 aa, Artificial Sequence
  Description of Artificial Sequence: Synthetic polypeptide
DEQEIATTNPVATEQYGSVSTTDGEDREGEDV

SEQ ID NO: 85678 - protein, 33 aa, Artificial Sequence
  Description of Artificial Sequence: Synthetic polypeptide
DEEEIRTTNPVATEQYGSVYPTGADLEGNMEFD

SEQ ID NO: 85679 - protein, 34 aa, Artificial Sequence
  Description of Artificial Sequence: Synthetic polypeptide
DENEIATTNPVATEQYGSVCATNPLQDPGEQTRQ

SEQ ID NO: 85680 - protein, 34 aa, Artificial Sequence
  Description of Artificial Sequence: Synthetic polypeptide
DEEEIRTTNPVATEQYGSVYPTMNNQINGELSVL

SEQ ID NO: 85681 - protein, 33 aa, Artificial Sequence
  Description of Artificial Sequence: Synthetic polypeptide
DEEEIRTTNPVATEQYGSVYPTNAEEEEGEELD

SEQ ID NO: 85682 - protein, 33 aa, Artificial Sequence
  Description of Artificial Sequence: Synthetic polypeptide
DEAEIRTTNPVAYEQYGTVSWVELDNRQGMNER

SEQ ID NO: 85683 - protein, 33 aa, Artificial Sequence
  Description of Artificial Sequence: Synthetic polypeptide
DEAEIRTTNPVAYEQYGTVVSTTNGQDANNNQR

SEQ ID NO: 85684 - protein, 35 aa, Artificial Sequence
  Description of Artificial Sequence: Synthetic polypeptide
DEEEIRTTNPVATEQYGSVYPTNIMPETRGVNVEV

SEQ ID NO: 85685 - protein, 33 aa, Artificial Sequence
  Description of Artificial Sequence: Synthetic polypeptide
DENEIATTNPVATEQYGSVCSPMHNLQTDDLND

SEQ ID NO: 85686 - protein, 32 aa, Artificial Sequence
  Description of Artificial Sequence: Synthetic polypeptide
DENEIATTNPVATEQYGSVSATILEDHEGDDL

SEQ ID NO: 85687 - protein, 30 aa, Artificial Sequence
  Description of Artificial Sequence: Synthetic polypeptide
DENEIATTNPVATEQYGSVSEDEENHAGEL

SEQ ID NO: 85688 - protein, 32 aa, Artificial Sequence
  Description of Artificial Sequence: Synthetic polypeptide
DEQEIATTNPVATEQYGSVSSTDLGDHEGEDL

SEQ ID NO: 85689 - protein, 35 aa, Artificial Sequence
  Description of Artificial Sequence: Synthetic polypeptide
DEEEIRTTNPVATEQYGSVSTPPNKLEENGEEEAD

SEQ ID NO: 85690 - protein, 30 aa, Artificial Sequence
  Description of Artificial Sequence: Synthetic polypeptide
DENEIATTNPVATEQYGTASEDGPQFEGGR

SEQ ID NO: 85691 - protein, 35 aa, Artificial Sequence
  Description of Artificial Sequence: Synthetic polypeptide
DENEIATTNPVATEQYGSVSTTPALPQMRNGMNPV

SEQ ID NO: 85692 - protein, 31 aa, Artificial Sequence
  Description of Artificial Sequence: Synthetic polypeptide
DEAEIRTTNGVAYCGYGSVSSTLSLQRGEDY

SEQ ID NO: 85693 - protein, 30 aa, Artificial Sequence
  Description of Artificial Sequence: Synthetic polypeptide
DEAEIRTTNGVAYCGYGCVCSTNLQGGSDQ

SEQ ID NO: 85694 - protein, 32 aa, Artificial Sequence
  Description of Artificial Sequence: Synthetic polypeptide
DEQEIATTNPVATEQYGSVSCTMLEDHEGEDL

SEQ ID NO: 85695 - protein, 31 aa, Artificial Sequence
  Description of Artificial Sequence: Synthetic polypeptide
DEQEIATTNPVATEQYGSVSDDLEDHEGEDL

SEQ ID NO: 85696 - protein, 34 aa, Artificial Sequence
  Description of Artificial Sequence: Synthetic polypeptide
DEEEIRTTNPVATEQYGSVYIMPNHDQGEENNER

SEQ ID NO: 85697 - protein, 31 aa, Artificial Sequence
  Description of Artificial Sequence: Synthetic polypeptide
DEQEIATTNPVATEQYGSVSDDLEDSEGEDL

SEQ ID NO: 85698 - protein, 35 aa, Artificial Sequence
  Description of Artificial Sequence: Synthetic polypeptide
DEEEIRTTNPVATEQYGSVSTPNQMWQESGEEEVE

SEQ ID NO: 85699 - protein, 32 aa, Artificial Sequence
  Description of Artificial Sequence: Synthetic polypeptide
DEQEIATTNPVATEQYGSVSDTDLEDHEGEDL

SEQ ID NO: 85700 - protein, 32 aa, Artificial Sequence
  Description of Artificial Sequence: Synthetic polypeptide
DEQEIATTNPVATEQYGSVSDTDLEDHEGQDL

SEQ ID NO: 85701 - protein, 33 aa, Artificial Sequence
  Description of Artificial Sequence: Synthetic polypeptide
DENEIATTNPVATEQYGSVSTGNPPGQHDDNPD

SEQ ID NO: 85702 - protein, 32 aa, Artificial Sequence
  Description of Artificial Sequence: Synthetic polypeptide
DEQEIATTNPVATEQYGSVSDTGLHDHEGEDL

SEQ ID NO: 85703 - protein, 31 aa, Artificial Sequence
  Description of Artificial Sequence: Synthetic polypeptide
DEQEIATTNPVATEQYGSVSEDLEDHEGEDL

SEQ ID NO: 85704 - protein, 31 aa, Artificial Sequence
  Description of Artificial Sequence: Synthetic polypeptide
DEQEIATTNPVATEQYGSVSEILMDHEGEDL

SEQ ID NO: 85705 - protein, 32 aa, Artificial Sequence
  Description of Artificial Sequence: Synthetic polypeptide
DEQEIATTNPVATEQYGSVSDTDLEDGEGEDL

SEQ ID NO: 85706 - protein, 32 aa, Artificial Sequence
  Description of Artificial Sequence: Synthetic polypeptide
DEQEIATTNPVATEQYGSVSCTDLEDHEGEDL

SEQ ID NO: 85707 - protein, 32 aa, Artificial Sequence
  Description of Artificial Sequence: Synthetic polypeptide
DEQEIATTNPVATEQYGSVSCTDLEDDEGEDL

SEQ ID NO: 85708 - protein, 33 aa, Artificial Sequence
  Description of Artificial Sequence: Synthetic polypeptide
DEEEIRTTNPVATEQYGSVYIGEHERMGLVPRD

SEQ ID NO: 85709 - protein, 35 aa, Artificial Sequence
  Description of Artificial Sequence: Synthetic polypeptide
DEEEIRTTNPVATEQYGSVYGNDDDLEQEGEGENS

SEQ ID NO: 85710 - protein, 35 aa, Artificial Sequence
  Description of Artificial Sequence: Synthetic polypeptide
DEEEIRTTNPVATEQYGSVYGNDDDLEQGEGGNIS

SEQ ID NO: 85711 - protein, 32 aa, Artificial Sequence
  Description of Artificial Sequence: Synthetic polypeptide
DEQEIATTNPVATEQYGSVSATWLEDHEGEDL

SEQ ID NO: 85712 - protein, 30 aa, Artificial Sequence
  Description of Artificial Sequence: Synthetic polypeptide
DENEIATTNPVATESYGCVANNNLQDAGPS

SEQ ID NO: 85713 - protein, 32 aa, Artificial Sequence
  Description of Artificial Sequence: Synthetic polypeptide
DEQEIATTNPVATEQYGSVSATWNEDHEGEDL

SEQ ID NO: 85714 - protein, 32 aa, Artificial Sequence
  Description of Artificial Sequence: Synthetic polypeptide
DEEEIRTTNPVATEQYGSVYGPTVEAEVGSPE

SEQ ID NO: 85715 - protein, 32 aa, Artificial Sequence
  Description of Artificial Sequence: Synthetic polypeptide
DEQEIATTNPVATEQYGSVSATYLEDHEGEDL

SEQ ID NO: 85716 - protein, 32 aa, Artificial Sequence
  Description of Artificial Sequence: Synthetic polypeptide
DEQEIATTNPVATEQYGSVSATYLEHHEGEDL

SEQ ID NO: 85717 - protein, 30 aa, Artificial Sequence
  Description of Artificial Sequence: Synthetic polypeptide
DENEIATTNPVATEQYGTVSEDGPEFEGGR

SEQ ID NO: 85718 - protein, 32 aa, Artificial Sequence
  Description of Artificial Sequence: Synthetic polypeptide
DEQEIATTNPVATEQYGSVSATYLEVHEGEDL

SEQ ID NO: 85719 - protein, 31 aa, Artificial Sequence
  Description of Artificial Sequence: Synthetic polypeptide
DENEIATTNPVATEQYGTVCSTDGPEFEGND

SEQ ID NO: 85720 - protein, 34 aa, Artificial Sequence
  Description of Artificial Sequence: Synthetic polypeptide
DEEEIRTTNPVATEQYGSVYGQTTDDNNQGGEFV

SEQ ID NO: 85721 - protein, 34 aa, Artificial Sequence
  Description of Artificial Sequence: Synthetic polypeptide
DEEEIRTTNPVATEQYGSVSTPTLSQTEDEVPLA

SEQ ID NO: 85722 - protein, 35 aa, Artificial Sequence
  Description of Artificial Sequence: Synthetic polypeptide
DEEEIRTTNPVATEQYGSVYGTFNGQGEPGEGNEQ

SEQ ID NO: 85723 - protein, 33 aa, Artificial Sequence
  Description of Artificial Sequence: Synthetic polypeptide
DEEEIRTTNPVATEQYGSVYHTNAPQNTESQQY

SEQ ID NO: 85724 - protein, 33 aa, Artificial Sequence
  Description of Artificial Sequence: Synthetic polypeptide
DEEEIRTTNPVATEQYGSVSTPTLMANSDQEEH

SEQ ID NO: 85725 - protein, 30 aa, Artificial Sequence
  Description of Artificial Sequence: Synthetic polypeptide
DENEIATTNPVATEQYGTISEDCQQQQGNH

SEQ ID NO: 85726 - protein, 32 aa, Artificial Sequence
  Description of Artificial Sequence: Synthetic polypeptide
DEQEIATTNPVATEQYGSVSETDLEDHEGEDG

SEQ ID NO: 85727 - protein, 32 aa, Artificial Sequence
  Description of Artificial Sequence: Synthetic polypeptide
DEQEIATTNPVATEQYGSVSETDLEDHEGEDL

SEQ ID NO: 85728 - protein, 35 aa, Artificial Sequence
  Description of Artificial Sequence: Synthetic polypeptide
DEEEIRTTNPVATEQYGSVYKWTNDIQQKQGGDDR

SEQ ID NO: 85729 - protein, 34 aa, Artificial Sequence
  Description of Artificial Sequence: Synthetic polypeptide
DEEEIRTTNPVATEQYGSVSTPNNMPEVFGLEQA

SEQ ID NO: 85730 - protein, 32 aa, Artificial Sequence
  Description of Artificial Sequence: Synthetic polypeptide
DEQEIATTNPVATEQYGSVSNTYLEDHEGEDL

SEQ ID NO: 85731 - protein, 30 aa, Artificial Sequence
  Description of Artificial Sequence: Synthetic polypeptide
DENEIATTNPVATEQYGSVSEILMNHAEEL

SEQ ID NO: 85732 - protein, 32 aa, Artificial Sequence
  Description of Artificial Sequence: Synthetic polypeptide
DEQEIATTNPVATEQYGSVSPTDLEDHEGEDL

SEQ ID NO: 85733 - protein, 32 aa, Artificial Sequence
  Description of Artificial Sequence: Synthetic polypeptide
DEQEIATTNPVATEQYGSVSPTDLEIHEGEDL

SEQ ID NO: 85734 - protein, 32 aa, Artificial Sequence
  Description of Artificial Sequence: Synthetic polypeptide
DEQEIATTNPVATEQYGSVSQTDLEDHEGEDL

SEQ ID NO: 85735 - protein, 32 aa, Artificial Sequence
  Description of Artificial Sequence: Synthetic polypeptide
DEQEIATTNPVATEQYGSVSQTDLPDHEGEDL

SEQ ID NO: 85736 - protein, 32 aa, Artificial Sequence
  Description of Artificial Sequence: Synthetic polypeptide
DEQEIATTNPVATEQYGSVSQTPLEDHEGECL

SEQ ID NO: 85737 - protein, 30 aa, Artificial Sequence
  Description of Artificial Sequence: Synthetic polypeptide
DENEIATTNPVATEQYGSVSEILMNHAEEA

SEQ ID NO: 85738 - protein, 31 aa, Artificial Sequence
  Description of Artificial Sequence: Synthetic polypeptide
DEAEIRTTNPVAYEQYGCICSTNLENPSNVA

SEQ ID NO: 85739 - protein, 32 aa, Artificial Sequence
  Description of Artificial Sequence: Synthetic polypeptide
DEQEIATTNPVATEQYGSVSRTDLEDHEGEDL

SEQ ID NO: 85740 - protein, 32 aa, Artificial Sequence
  Description of Artificial Sequence: Synthetic polypeptide
DEQEIATTNPVATEQYGSVSRTDLEDHKGEDS

SEQ ID NO: 85741 - protein, 33 aa, Artificial Sequence
  Description of Artificial Sequence: Synthetic polypeptide
DEQEIATTNPVATEQYGSVSSATDLEDREGEPL

SEQ ID NO: 85742 - protein, 30 aa, Artificial Sequence
  Description of Artificial Sequence: Synthetic polypeptide
DENEIATTNPVATEQYGSVSEDEMDAAGDL

SEQ ID NO: 85743 - protein, 32 aa, Artificial Sequence
  Description of Artificial Sequence: Synthetic polypeptide
DEQEIATTNPVATEQYGSVSSTDLEDHEGEDL

SEQ ID NO: 85744 - protein, 32 aa, Artificial Sequence
  Description of Artificial Sequence: Synthetic polypeptide
DEQEIATTNPVATEQYGSVSSTDLEDHEGEDS

SEQ ID NO: 85745 - protein, 32 aa, Artificial Sequence
  Description of Artificial Sequence: Synthetic polypeptide
DEQEIATTNPVATEQYGSVSSTDLEDHEGEGL

SEQ ID NO: 85746 - protein, 32 aa, Artificial Sequence
  Description of Artificial Sequence: Synthetic polypeptide
DEQEIATTNPVATEQYGSVSSTDLEDTEGEDN

SEQ ID NO: 85747 - protein, 32 aa, Artificial Sequence
  Description of Artificial Sequence: Synthetic polypeptide
DEQEIATTNPVATEQYGSVSNTLLEDTEGEDL

SEQ ID NO: 85748 - protein, 33 aa, Artificial Sequence
  Description of Artificial Sequence: Synthetic polypeptide
DEQEIATTNPVATEQYGSVSATVLEDHEGNEDL

SEQ ID NO: 85749 - protein, 32 aa, Artificial Sequence
  Description of Artificial Sequence: Synthetic polypeptide
DEQEIATTNPVATEQYGSVSNTDLEDHEGEDL

SEQ ID NO: 85750 - protein, 32 aa, Artificial Sequence
  Description of Artificial Sequence: Synthetic polypeptide
DEQEIATTNPVATEQYGSVSMTDLEDHEGEDL

SEQ ID NO: 85751 - protein, 32 aa, Artificial Sequence
  Description of Artificial Sequence: Synthetic polypeptide
DEQEIATTNPVATEQYGSVSFTDLEDHEGEDH

SEQ ID NO: 85752 - protein, 32 aa, Artificial Sequence
  Description of Artificial Sequence: Synthetic polypeptide
DEQEIATTNPVATEQYGSVSFTDLEDHEGEDL

SEQ ID NO: 85753 - protein, 32 aa, Artificial Sequence
  Description of Artificial Sequence: Synthetic polypeptide
DEQEIATTNPVATEQYGSVSFTTLEDHQGEDL

SEQ ID NO: 85754 - protein, 32 aa, Artificial Sequence
  Description of Artificial Sequence: Synthetic polypeptide
DEQEIATTNPVATEQYGSVSGTDLEDHEGEDL

SEQ ID NO: 85755 - protein, 32 aa, Artificial Sequence
  Description of Artificial Sequence: Synthetic polypeptide
DEQEIATTNPVATEQYGSVSGTGLTDHQGEDL

SEQ ID NO: 85756 - protein, 32 aa, Artificial Sequence
  Description of Artificial Sequence: Synthetic polypeptide
DEQEIATTNPVATEQYGSVSHTDLEDHEGDDL

SEQ ID NO: 85757 - protein, 32 aa, Artificial Sequence
  Description of Artificial Sequence: Synthetic polypeptide
DEQEIATTNPVATEQYGSVSHTDLEDHEGEDL

SEQ ID NO: 85758 - protein, 32 aa, Artificial Sequence
  Description of Artificial Sequence: Synthetic polypeptide
DEQEIATTNPVATEQYGSVSHTVLEDHEGEDL

SEQ ID NO: 85759 - protein, 32 aa, Artificial Sequence
  Description of Artificial Sequence: Synthetic polypeptide
DEQEIATTNPVATEQYGSVSITDLEDHEGEDL

SEQ ID NO: 85760 - protein, 32 aa, Artificial Sequence
  Description of Artificial Sequence: Synthetic polypeptide
DEQEIATTNPVATEQYGSVSKTDLEDHEGEDH

SEQ ID NO: 85761 - protein, 32 aa, Artificial Sequence
  Description of Artificial Sequence: Synthetic polypeptide
DEQEIATTNPVATEQYGSVSKTDLEDHEGEDL

SEQ ID NO: 85762 - protein, 32 aa, Artificial Sequence
  Description of Artificial Sequence: Synthetic polypeptide
DEQEIATTNPVATEQYGSVSKTDLYDHEGEDL

SEQ ID NO: 85763 - protein, 32 aa, Artificial Sequence
  Description of Artificial Sequence: Synthetic polypeptide
DEQEIATTNPVATEQYGSVSLTDLADHEGEDL

SEQ ID NO: 85764 - protein, 32 aa, Artificial Sequence
  Description of Artificial Sequence: Synthetic polypeptide
DEQEIATTNPVATEQYGSVSLTDLEDHDGEDL

SEQ ID NO: 85765 - protein, 32 aa, Artificial Sequence
  Description of Artificial Sequence: Synthetic polypeptide
DEQEIATTNPVATEQYGSVSLTDLEDHEGEDI

SEQ ID NO: 85766 - protein, 32 aa, Artificial Sequence
  Description of Artificial Sequence: Synthetic polypeptide
DEQEIATTNPVATEQYGSVSLTDLEDHEGEDL

SEQ ID NO: 85767 - protein, 30 aa, Artificial Sequence
  Description of Artificial Sequence: Synthetic polypeptide
DEAEIRTTNPVAYEQYGCICSTEHENPSNR

SEQ ID NO: 85768 - protein, 32 aa, Artificial Sequence
  Description of Artificial Sequence: Synthetic polypeptide
DEQEIATTNPVATEQYGSVSMTWLEDHEGEDL

SEQ ID NO: 85769 - protein, 31 aa, Artificial Sequence
  Description of Artificial Sequence: Synthetic polypeptide
DENEIRCTNPVATEPYGSISMDIQQQRNGNH

SEQ ID NO: 85770 - protein, 32 aa, Artificial Sequence
  Description of Artificial Sequence: Synthetic polypeptide
DEAEIRTTNPVAYEQWGSVCYTDNDQGDGNMN

SEQ ID NO: 85771 - protein, 32 aa, Artificial Sequence
  Description of Artificial Sequence: Synthetic polypeptide
DEQEIATTNPVATEQYGSVSATHLELHKGEDL

SEQ ID NO: 85772 - protein, 29 aa, Artificial Sequence
  Description of Artificial Sequence: Synthetic peptide
DENEIRTTNPVATECWGDVSECLQHAEDL

SEQ ID NO: 85773 - protein, 35 aa, Artificial Sequence
  Description of Artificial Sequence: Synthetic polypeptide
DEEEIRTTNPVATEQYGSVVTNTANLQYGTEGGTT

SEQ ID NO: 85774 - protein, 32 aa, Artificial Sequence
  Description of Artificial Sequence: Synthetic polypeptide
DEQEIATTNPVATEQYGSVSATDLEDVEGEDL

SEQ ID NO: 85775 - protein, 32 aa, Artificial Sequence
  Description of Artificial Sequence: Synthetic polypeptide
DEAEIRTTNPVAYEHWGSVSTNIQGDLGNNGS

SEQ ID NO: 85776 - protein, 32 aa, Artificial Sequence
  Description of Artificial Sequence: Synthetic polypeptide
DEQEIATTNPVATEQYGSVSATDLEDVIGEDL

SEQ ID NO: 85777 - protein, 33 aa, Artificial Sequence
  Description of Artificial Sequence: Synthetic polypeptide
DEAEIRTTNPVAYEHYGSIWCTNALTRTPGNRV

SEQ ID NO: 85778 - protein, 32 aa, Artificial Sequence
  Description of Artificial Sequence: Synthetic polypeptide
DEAEIRTTNPVAYEHYGSIWCTNLTHTPGNQR

SEQ ID NO: 85779 - protein, 32 aa, Artificial Sequence
  Description of Artificial Sequence: Synthetic polypeptide
DEQEIATTNPVATEQYGSVSATDLEDTEGEYL

SEQ ID NO: 85780 - protein, 32 aa, Artificial Sequence
  Description of Artificial Sequence: Synthetic polypeptide
DEAEIRTTNPNATECYGSVANTNDHNGRGNNA

SEQ ID NO: 85781 - protein, 32 aa, Artificial Sequence
  Description of Artificial Sequence: Synthetic polypeptide
DEQEIATTNPVATEQYGSVSATDLEDYEGEDD

SEQ ID NO: 85782 - protein, 30 aa, Artificial Sequence
  Description of Artificial Sequence: Synthetic polypeptide
DENEIRTTNPVATECWGDVSECLQDHEENL

SEQ ID NO: 85783 - protein, 33 aa, Artificial Sequence
  Description of Artificial Sequence: Synthetic polypeptide
DEAEIRTTNPLATEQYGSVSCYNAISFRVGNND

SEQ ID NO: 85784 - protein, 32 aa, Artificial Sequence
  Description of Artificial Sequence: Synthetic polypeptide
DEAEIRTTNPVAYEKWGEVSTNLQGNSGGNTM

SEQ ID NO: 85785 - protein, 32 aa, Artificial Sequence
  Description of Artificial Sequence: Synthetic polypeptide
DEAEIRTTNPIAYEQWGSVYCTDNDQREGNHA

SEQ ID NO: 85786 - protein, 32 aa, Artificial Sequence
  Description of Artificial Sequence: Synthetic polypeptide
DEQEIATTNPVATEQYGSVSATDLEDYEGEDL

SEQ ID NO: 85787 - protein, 32 aa, Artificial Sequence
  Description of Artificial Sequence: Synthetic polypeptide
DENEIRTTNPVATECWGDVSCNEPQDREGENG

SEQ ID NO: 85788 - protein, 32 aa, Artificial Sequence
  Description of Artificial Sequence: Synthetic polypeptide
DEQEIATTNPVATEQYGSVSATDLEDWEGEDL

SEQ ID NO: 85789 - protein, 32 aa, Artificial Sequence
  Description of Artificial Sequence: Synthetic polypeptide
DEQEIATTNPVATEQYGSVSATDLEDTEGETA

SEQ ID NO: 85790 - protein, 32 aa, Artificial Sequence
  Description of Artificial Sequence: Synthetic polypeptide
DEQEIATTNPVATEQYGSVSATDLEDTEGEDL

SEQ ID NO: 85791 - protein, 32 aa, Artificial Sequence
  Description of Artificial Sequence: Synthetic polypeptide
DEQEIATTNPVATEQYGSVSATDLEDSMGEDE

SEQ ID NO: 85792 - protein, 31 aa, Artificial Sequence
  Description of Artificial Sequence: Synthetic polypeptide
DENEIRTTNPVATECWGDVSENEPMNRAGNA

SEQ ID NO: 85793 - protein, 32 aa, Artificial Sequence
  Description of Artificial Sequence: Synthetic polypeptide
DEQEIATTNPVATEQYGSVSATDLEDMENEDL

SEQ ID NO: 85794 - protein, 32 aa, Artificial Sequence
  Description of Artificial Sequence: Synthetic polypeptide
DEQEIATTNPVATEQYGSVSATDLEDNEGEDL

SEQ ID NO: 85795 - protein, 31 aa, Artificial Sequence
  Description of Artificial Sequence: Synthetic polypeptide
DENEIRTTNPVATECWGDVSEINLPQHGEEL

SEQ ID NO: 85796 - protein, 32 aa, Artificial Sequence
  Description of Artificial Sequence: Synthetic polypeptide
DEQEIATTNPVATEQYGSVSATDLEDPEGEDL

SEQ ID NO: 85797 - protein, 32 aa, Artificial Sequence
  Description of Artificial Sequence: Synthetic polypeptide
DEQEIATTNPVATEQYGSVSATDLEDPEGESL

SEQ ID NO: 85798 - protein, 29 aa, Artificial Sequence
  Description of Artificial Sequence: Synthetic peptide
DENEIRTTNPVATECWGDVSEILQHAEDL

SEQ ID NO: 85799 - protein, 32 aa, Artificial Sequence
  Description of Artificial Sequence: Synthetic polypeptide
DEAEIRTTNPVAYEGWGSVSTSNGAGNDGNNR

SEQ ID NO: 85800 - protein, 30 aa, Artificial Sequence
  Description of Artificial Sequence: Synthetic polypeptide
DENEIRTTNPVATECWGDVSEIEMNRAGNA

SEQ ID NO: 85801 - protein, 33 aa, Artificial Sequence
  Description of Artificial Sequence: Synthetic polypeptide
DEQEIATTNPVATEQYGSVSATDLEDQEGEEDL

SEQ ID NO: 85802 - protein, 32 aa, Artificial Sequence
  Description of Artificial Sequence: Synthetic polypeptide
DEQEIATTNPVATEQYGSVSATDLEDQEMEDT

SEQ ID NO: 85803 - protein, 32 aa, Artificial Sequence
  Description of Artificial Sequence: Synthetic polypeptide
DEAEIRTTNPVAYEHWGEVSTNLQGDLGGNGS

SEQ ID NO: 85804 - protein, 32 aa, Artificial Sequence
  Description of Artificial Sequence: Synthetic polypeptide
DEQEIATTNPVATEQYGSVSATDLEDREQEDL

SEQ ID NO: 85805 - protein, 29 aa, Artificial Sequence
  Description of Artificial Sequence: Synthetic peptide
DENEIRTTNPVATECWGDVSECLQHAEEL

SEQ ID NO: 85806 - protein, 32 aa, Artificial Sequence
  Description of Artificial Sequence: Synthetic polypeptide
DEQEIATTNPVATEQYGSVSATDLEDSEGEDL

SEQ ID NO: 85807 - protein, 33 aa, Artificial Sequence
  Description of Artificial Sequence: Synthetic polypeptide
DEQEIATTNPVATEQYGSVSATDLEDSEGNEDL

SEQ ID NO: 85808 - protein, 32 aa, Artificial Sequence
  Description of Artificial Sequence: Synthetic polypeptide
DEQEIATTNPVATEQYGSVSATDLEDSENEDL

SEQ ID NO: 85809 - protein, 33 aa, Artificial Sequence
  Description of Artificial Sequence: Synthetic polypeptide
DEQEIATTNPVATEQYGSVSATDLEEDQEGEDG

SEQ ID NO: 85810 - protein, 33 aa, Artificial Sequence
  Description of Artificial Sequence: Synthetic polypeptide
DENEIRTTNPVATECWGEVSCINEPQDREGENR

SEQ ID NO: 85811 - protein, 32 aa, Artificial Sequence
  Description of Artificial Sequence: Synthetic polypeptide
DEQEIATTNPVATEQYGSVSATDLEEFEGEDL

SEQ ID NO: 85812 - protein, 33 aa, Artificial Sequence
  Description of Artificial Sequence: Synthetic polypeptide
DEAEIRTTNPVAYEPYGVVSVTVLSQRPGNTDP

SEQ ID NO: 85813 - protein, 32 aa, Artificial Sequence
  Description of Artificial Sequence: Synthetic polypeptide
DEQEIATTNPVATEQYGSVSATDLENGEGEGL

SEQ ID NO: 85814 - protein, 32 aa, Artificial Sequence
  Description of Artificial Sequence: Synthetic polypeptide
DEQEIATTNPVATEQYGSVSATDLENHEGEDL

SEQ ID NO: 85815 - protein, 35 aa, Artificial Sequence
  Description of Artificial Sequence: Synthetic polypeptide
DEEEIRTTNPVATEQYGSVSTTLMMEQLLGEEEIQ

SEQ ID NO: 85816 - protein, 32 aa, Artificial Sequence
  Description of Artificial Sequence: Synthetic polypeptide
DEQEIATTNPVATEQYGSVSATDLENPNGEDL

SEQ ID NO: 85817 - protein, 32 aa, Artificial Sequence
  Description of Artificial Sequence: Synthetic polypeptide
DEQEIATTNPVATEQYGSVSATDLEPHEGEDL

SEQ ID NO: 85818 - protein, 32 aa, Artificial Sequence
  Description of Artificial Sequence: Synthetic polypeptide
DEQEIATTNPVATEQYGSVSATDLESHEGEDL

SEQ ID NO: 85819 - protein, 32 aa, Artificial Sequence
  Description of Artificial Sequence: Synthetic polypeptide
DEQEIATTNPVATEQYGSVSATDLESHEGQDL

SEQ ID NO: 85820 - protein, 32 aa, Artificial Sequence
  Description of Artificial Sequence: Synthetic polypeptide
DEQEIATTNPVATEQYGSVSATDLEMHEGEDL

SEQ ID NO: 85821 - protein, 32 aa, Artificial Sequence
  Description of Artificial Sequence: Synthetic polypeptide
DEQEIATTNPVATEQYGSVSATDLETHEGEDL

SEQ ID NO: 85822 - protein, 33 aa, Artificial Sequence
  Description of Artificial Sequence: Synthetic polypeptide
DEAEIRTTNPVAYEQWGCVSTNAGQGEDAGNGR

SEQ ID NO: 85823 - protein, 33 aa, Artificial Sequence
  Description of Artificial Sequence: Synthetic polypeptide
DEAEIRTTNPVAYEQWGCVSTNLGAGNAGEDDR

SEQ ID NO: 85824 - protein, 32 aa, Artificial Sequence
  Description of Artificial Sequence: Synthetic polypeptide
DEAEIRTTNPVAYEQWGCVSTNLNGNAGENSQ

SEQ ID NO: 85825 - protein, 32 aa, Artificial Sequence
  Description of Artificial Sequence: Synthetic polypeptide
DEAEIRTTNPVAYEQWGCVSTNMNGNDMGNTR

SEQ ID NO: 85826 - protein, 34 aa, Artificial Sequence
  Description of Artificial Sequence: Synthetic polypeptide
DEEEIRTTNPVATEQYGSVSTTLELITSLVEHRQ

SEQ ID NO: 85827 - protein, 37 aa, Artificial Sequence
  Description of Artificial Sequence: Synthetic polypeptide
DEEEIRTTNPVATEQYGSVVTVVSTNLQLQQGNNEEQ

SEQ ID NO: 85828 - protein, 32 aa, Artificial Sequence
  Description of Artificial Sequence: Synthetic polypeptide
DENEIRTTNPVATDQYGSVNTQLVEVRQGEGD

SEQ ID NO: 85829 - protein, 33 aa, Artificial Sequence
  Description of Artificial Sequence: Synthetic polypeptide
DEEEIRTTNPVATEQYGSVVTVQHDRIGQHMDN

SEQ ID NO: 85830 - protein, 32 aa, Artificial Sequence
  Description of Artificial Sequence: Synthetic polypeptide
DEQEIATTNPVATEQYGSVSATDLELHEGEDY

SEQ ID NO: 85831 - protein, 32 aa, Artificial Sequence
  Description of Artificial Sequence: Synthetic polypeptide
DEQEIATTNPVATEQYGSVSATDLELHEGEDL

SEQ ID NO: 85832 - protein, 32 aa, Artificial Sequence
  Description of Artificial Sequence: Synthetic polypeptide
DEQEIATTNPVATEQYGSVSATDLEKHEGEDL

SEQ ID NO: 85833 - protein, 32 aa, Artificial Sequence
  Description of Artificial Sequence: Synthetic polypeptide
DEAEIRTTNPVAYEPYGVVSVTVLSTRNGNDI

SEQ ID NO: 85834 - protein, 37 aa, Artificial Sequence
  Description of Artificial Sequence: Synthetic polypeptide
DEEEIRTTNPVATEQYGSVVTSVSTNLQAGTNNNTTD

SEQ ID NO: 85835 - protein, 31 aa, Artificial Sequence
  Description of Artificial Sequence: Synthetic polypeptide
DENEIRTTNPVATECWGDVSCINEPQRGEEL

SEQ ID NO: 85836 - protein, 29 aa, Artificial Sequence
  Description of Artificial Sequence: Synthetic peptide
DENEIRTTNPVATECWGAVSECLQEHEEL

SEQ ID NO: 85837 - protein, 34 aa, Artificial Sequence
  Description of Artificial Sequence: Synthetic polypeptide
CEEGIRTTNPVATEQWGQSVCSPTMNEQARNNMR

SEQ ID NO: 85838 - protein, 31 aa, Artificial Sequence
  Description of Artificial Sequence: Synthetic polypeptide
DEAEIRTTNPVAYEPYGVVSYMVQSQRPGND

SEQ ID NO: 85839 - protein, 32 aa, Artificial Sequence
  Description of Artificial Sequence: Synthetic polypeptide
DEQEIATTNPVATEQYGSVSATDLEEHEGPDL

SEQ ID NO: 85840 - protein, 33 aa, Artificial Sequence
  Description of Artificial Sequence: Synthetic polypeptide
DEAEIRTTNPVAYEQWGAVSTNLNEGNAGEESR

SEQ ID NO: 85841 - protein, 32 aa, Artificial Sequence
  Description of Artificial Sequence: Synthetic polypeptide
DEQEIATTNPVATEQYGSVSATDLEFHEGEDL

SEQ ID NO: 85842 - protein, 32 aa, Artificial Sequence
  Description of Artificial Sequence: Synthetic polypeptide
DEQEIATTNPVATEQYGSVSATDLEGHEGEDL

SEQ ID NO: 85843 - protein, 31 aa, Artificial Sequence
  Description of Artificial Sequence: Synthetic polypeptide
CEENIRTTNPVATEWYGHVSWTGLNRRSNDE

SEQ ID NO: 85844 - protein, 31 aa, Artificial Sequence
  Description of Artificial Sequence: Synthetic polypeptide
DEQEIATTNPVATEQYGSVSATDLEHEEEDL

SEQ ID NO: 85845 - protein, 32 aa, Artificial Sequence
  Description of Artificial Sequence: Synthetic polypeptide
DEQEIATTNPVATEQYGSVSATDLEHGEGQDL

SEQ ID NO: 85846 - protein, 32 aa, Artificial Sequence
  Description of Artificial Sequence: Synthetic polypeptide
DEQEIATTNPVATEQYGSVSATDLEHHEGEDL

SEQ ID NO: 85847 - protein, 36 aa, Artificial Sequence
  Description of Artificial Sequence: Synthetic polypeptide
DEEEIRTTNPVATEQYGSVSTTLQAGNNAENGTNPV

SEQ ID NO: 85848 - protein, 32 aa, Artificial Sequence
  Description of Artificial Sequence: Synthetic polypeptide
DEQEIATTNPVATEQYGSVSATDLEHHQGEAL

SEQ ID NO: 85849 - protein, 32 aa, Artificial Sequence
  Description of Artificial Sequence: Synthetic polypeptide
DEQEIATTNPVATEQYGSVSATDLEIHEGEDL

SEQ ID NO: 85850 - protein, 32 aa, Artificial Sequence
  Description of Artificial Sequence: Synthetic polypeptide
DEQEIATTNPVATEQYGSVSATDLEEHEGEDL

SEQ ID NO: 85851 - protein, 33 aa, Artificial Sequence
  Description of Artificial Sequence: Synthetic polypeptide
DEAEIRTTNPVATCHYGCVCSTGNLQERFTSNQ

SEQ ID NO: 85852 - protein, 32 aa, Artificial Sequence
  Description of Artificial Sequence: Synthetic polypeptide
DENEIRTTNPVATECWGEVSCINEPQREGEGR

SEQ ID NO: 85853 - protein, 35 aa, Artificial Sequence
  Description of Artificial Sequence: Synthetic polypeptide
DEEEIRTTNPVATEQYGSVSTTMNIDTSNPPGNIQ

SEQ ID NO: 85854 - protein, 32 aa, Artificial Sequence
  Description of Artificial Sequence: Synthetic polypeptide
DEQEIATTNPVATEQYGSVSATDLEDHENEDL

SEQ ID NO: 85855 - protein, 32 aa, Artificial Sequence
  Description of Artificial Sequence: Synthetic polypeptide
DEQEIATTNPVATEQYGSVSATDLEDHEREDL

SEQ ID NO: 85856 - protein, 31 aa, Artificial Sequence
  Description of Artificial Sequence: Synthetic polypeptide
DEQEIATTNPVATEQYGSVSATDLEDHETEL

SEQ ID NO: 85857 - protein, 32 aa, Artificial Sequence
  Description of Artificial Sequence: Synthetic polypeptide
DEQEIATTNPVATEQYGSVSATDLEDHFGEDL

SEQ ID NO: 85858 - protein, 32 aa, Artificial Sequence
  Description of Artificial Sequence: Synthetic polypeptide
DEQEIATTNPVATEQYGSVSATDLEDHGGEDL

SEQ ID NO: 85859 - protein, 32 aa, Artificial Sequence
  Description of Artificial Sequence: Synthetic polypeptide
DEQEIATTNPVATEQYGSVSATDLEDHGTEDL

SEQ ID NO: 85860 - protein, 31 aa, Artificial Sequence
  Description of Artificial Sequence: Synthetic polypeptide
DEAEIRTTNPVATEAWGTVSTNLNGDTQNED

SEQ ID NO: 85861 - protein, 32 aa, Artificial Sequence
  Description of Artificial Sequence: Synthetic polypeptide
DEAEIRTTNPVAYECWGSVSTTNHGPDGGNER

SEQ ID NO: 85862 - protein, 32 aa, Artificial Sequence
  Description of Artificial Sequence: Synthetic polypeptide
DEQEIATTNPVATEQYGSVSATDLEDHHGEDL

SEQ ID NO: 85863 - protein, 32 aa, Artificial Sequence
  Description of Artificial Sequence: Synthetic polypeptide
DEQEIATTNPVATEQYGSVSATDLEDHIGEML

SEQ ID NO: 85864 - protein, 32 aa, Artificial Sequence
  Description of Artificial Sequence: Synthetic polypeptide
DEQEIATTNPVATEQYGSVSATDLEDHKGEDL

SEQ ID NO: 85865 - protein, 32 aa, Artificial Sequence
  Description of Artificial Sequence: Synthetic polypeptide
DEQEIATTNPVATEQYGSVSATDLEDHKGEQL

SEQ ID NO: 85866 - protein, 32 aa, Artificial Sequence
  Description of Artificial Sequence: Synthetic polypeptide
DEQEIATTNPVATEQYGSVSATDLEDHLGEDL

SEQ ID NO: 85867 - protein, 36 aa, Artificial Sequence
  Description of Artificial Sequence: Synthetic polypeptide
DEEEIRTTNPVATEQYGSVSTTNDAGNNNQNGTNPQ

SEQ ID NO: 85868 - protein, 32 aa, Artificial Sequence
  Description of Artificial Sequence: Synthetic polypeptide
DEQEIATTNPVATEQYGSVSATDLEDHMGEDA

SEQ ID NO: 85869 - protein, 32 aa, Artificial Sequence
  Description of Artificial Sequence: Synthetic polypeptide
DEQEIATTNPVATEQYGSVSATDLEDHMGEDL

SEQ ID NO: 85870 - protein, 32 aa, Artificial Sequence
  Description of Artificial Sequence: Synthetic polypeptide
DEQEIATTNPVATEQYGSVSATDLEDHIGEDL

SEQ ID NO: 85871 - protein, 32 aa, Artificial Sequence
  Description of Artificial Sequence: Synthetic polypeptide
DENEIRTTNPVATECWGSVSEINEPQDREGEG

SEQ ID NO: 85872 - protein, 32 aa, Artificial Sequence
  Description of Artificial Sequence: Synthetic polypeptide
DEQEIATTNPVATEQYGSVSATDLEDHEGYDL

SEQ ID NO: 85873 - protein, 32 aa, Artificial Sequence
  Description of Artificial Sequence: Synthetic polypeptide
DEQEIATTNPVATEQYGSVSATDLEDHEGWDL

SEQ ID NO: 85874 - protein, 33 aa, Artificial Sequence
  Description of Artificial Sequence: Synthetic polypeptide
DENEIRTTNPVATECWGSVSMINEQQDREGENG

SEQ ID NO: 85875 - protein, 37 aa, Artificial Sequence
  Description of Artificial Sequence: Synthetic polypeptide
DEEEIRTTNPVATEQYGSVSTTNLANGNNNQNGTNTV

SEQ ID NO: 85876 - protein, 32 aa, Artificial Sequence
  Description of Artificial Sequence: Synthetic polypeptide
DEAEIRTTNPVATECWGAVSTNLNGNAGEGSR

SEQ ID NO: 85877 - protein, 37 aa, Artificial Sequence
  Description of Artificial Sequence: Synthetic polypeptide
DEEEIRTTNPVATEQYGSVSTTNLAGNNNQQGTNNVT

SEQ ID NO: 85878 - protein, 37 aa, Artificial Sequence
  Description of Artificial Sequence: Synthetic polypeptide
DEEEIRTTNPVATEQYGSVSTTNLAGNNNQQGNNQDT

SEQ ID NO: 85879 - protein, 37 aa, Artificial Sequence
  Description of Artificial Sequence: Synthetic polypeptide
DEEEIRTTNPVATEQYGSVSTTNLAGNNNQNGTNTTD

SEQ ID NO: 85880 - protein, 37 aa, Artificial Sequence
  Description of Artificial Sequence: Synthetic polypeptide
DEEEIRTTNPVATEQYGSVSTTNLAGNNNQNGTNPVE

SEQ ID NO: 85881 - protein, 32 aa, Artificial Sequence
  Description of Artificial Sequence: Synthetic polypeptide
DEQEIATTNPVATEQYGSVSATDLEDHEGRDL

SEQ ID NO: 85882 - protein, 32 aa, Artificial Sequence
  Description of Artificial Sequence: Synthetic polypeptide
DENEIRTTNPVATECWGSVSENEPMDREGENG

SEQ ID NO: 85883 - protein, 35 aa, Artificial Sequence
  Description of Artificial Sequence: Synthetic polypeptide
DEEEIRTTNPVATEQYGSVSTTNIMWQESGEEQVE

SEQ ID NO: 85884 - protein, 35 aa, Artificial Sequence
  Description of Artificial Sequence: Synthetic polypeptide
DEEEIRTTNPVATEQYGSVSTTNHLHENIENEIEQ

SEQ ID NO: 85885 - protein, 32 aa, Artificial Sequence
  Description of Artificial Sequence: Synthetic polypeptide
DEQEIATTNPVATEQYGSVSATDLEDHEGRYL

SEQ ID NO: 85886 - protein, 32 aa, Artificial Sequence
  Description of Artificial Sequence: Synthetic polypeptide
DEQEIATTNPVATEQYGSVSATDLEDHEGSDL

SEQ ID NO: 85887 - protein, 32 aa, Artificial Sequence
  Description of Artificial Sequence: Synthetic polypeptide
DEQEIATTNPVATEQYGSVSATDLEDHEGTDL

SEQ ID NO: 85888 - protein, 34 aa, Artificial Sequence
  Description of Artificial Sequence: Synthetic polypeptide
DEEEIRTTNPVATEQYGSVVSTVPNFDDGGDQEG

SEQ ID NO: 85889 - protein, 32 aa, Artificial Sequence
  Description of Artificial Sequence: Synthetic polypeptide
DEQEIATTNPVATEQYGSVSATDLEDHEGVDL

SEQ ID NO: 85890 - protein, 35 aa, Artificial Sequence
  Description of Artificial Sequence: Synthetic polypeptide
DEEEIRTTNPVATEQYGSVVSTVPYNFDEGGDNEE

SEQ ID NO: 85891 - protein, 32 aa, Artificial Sequence
  Description of Artificial Sequence: Synthetic polypeptide
DENEIRTTNPVATECWGSVSEINEPMDREGNA

SEQ ID NO: 85892 - protein, 30 aa, Artificial Sequence
  Description of Artificial Sequence: Synthetic polypeptide
DENEIRTTNPVATECWGSVSEIEMNRAENA

SEQ ID NO: 85893 - protein, 34 aa, Artificial Sequence
  Description of Artificial Sequence: Synthetic polypeptide
DEEEIRTTNPVATEQYGSVSTTNALEEELEEFLD

SEQ ID NO: 85894 - protein, 35 aa, Artificial Sequence
  Description of Artificial Sequence: Synthetic polypeptide
DEEEIRTTNPVATEQYGSVSTTNALDENEEGEELD

SEQ ID NO: 85895 - protein, 32 aa, Artificial Sequence
  Description of Artificial Sequence: Synthetic polypeptide
DEQEIATTNPVATEQYGSVSATDLEDIEGEDL

SEQ ID NO: 85896 - protein, 32 aa, Artificial Sequence
  Description of Artificial Sequence: Synthetic polypeptide
DEQEIATTNPVATEQYGSVSATDLEDKDGEDL

SEQ ID NO: 85897 - protein, 33 aa, Artificial Sequence
  Description of Artificial Sequence: Synthetic polypeptide
DENEIRTTNPVATECWGSVSCINENQDREGENG

SEQ ID NO: 85898 - protein, 31 aa, Artificial Sequence
  Description of Artificial Sequence: Synthetic polypeptide
DENEIRTTNPVATECWGSVSCINEMNRAENG

SEQ ID NO: 85899 - protein, 32 aa, Artificial Sequence
  Description of Artificial Sequence: Synthetic polypeptide
DEQEIATTNPVATEQYGSVSATDLEDKEGEDL

SEQ ID NO: 85900 - protein, 32 aa, Artificial Sequence
  Description of Artificial Sequence: Synthetic polypeptide
DEQEIATTNPVATEQYGSVSATDLEDLEGEDL

SEQ ID NO: 85901 - protein, 32 aa, Artificial Sequence
  Description of Artificial Sequence: Synthetic polypeptide
DEQEIATTNPVATEQYGSVSATDLEDLPGEDL

SEQ ID NO: 85902 - protein, 35 aa, Artificial Sequence
  Description of Artificial Sequence: Synthetic polypeptide
DEEEIRTTNPVATEQYGSVVTGQVNLFENGGENQG

SEQ ID NO: 85903 - protein, 36 aa, Artificial Sequence
  Description of Artificial Sequence: Synthetic polypeptide
DEEEIRTTNPVATEQYGSVVTGQVNNLFQNGGNNQG

SEQ ID NO: 85904 - protein, 32 aa, Artificial Sequence
  Description of Artificial Sequence: Synthetic polypeptide
DEEEIRTTNPVATEQYGSVVTLCNHFENSEEK

SEQ ID NO: 85905 - protein, 32 aa, Artificial Sequence
  Description of Artificial Sequence: Synthetic polypeptide
DEQEIATTNPVATEQYGSVSATDLEDMEGEDL

SEQ ID NO: 85906 - protein, 31 aa, Artificial Sequence
  Description of Artificial Sequence: Synthetic polypeptide
DEAEIRTTNPVAYEEWGVVSNNLQHGGDNDA

SEQ ID NO: 85907 - protein, 32 aa, Artificial Sequence
  Description of Artificial Sequence: Synthetic polypeptide
DENEIRTTNPVATECWGSVSCIDEQQQREGNG

SEQ ID NO: 85908 - protein, 32 aa, Artificial Sequence
  Description of Artificial Sequence: Synthetic polypeptide
DEEEIRTTNPVATEQYGSVVTLPSHFENSEDK

SEQ ID NO: 85909 - protein, 32 aa, Artificial Sequence
  Description of Artificial Sequence: Synthetic polypeptide
DENEIRTTNPVATECWGSVSCEDEQQQREGNG

SEQ ID NO: 85910 - protein, 34 aa, Artificial Sequence
  Description of Artificial Sequence: Synthetic polypeptide
DEEEIRTTNPVATEGYGSVSNDNDEMQGGETNGG

SEQ ID NO: 85911 - protein, 32 aa, Artificial Sequence
  Description of Artificial Sequence: Synthetic polypeptide
DEQEIATTNPVATEQYGSVSATDLEDMEGELL

SEQ ID NO: 85912 - protein, 32 aa, Artificial Sequence
  Description of Artificial Sequence: Synthetic polypeptide
DEQEIATTNPVATEQYGSVSATDLEDHYGSDL

SEQ ID NO: 85913 - protein, 32 aa, Artificial Sequence
  Description of Artificial Sequence: Synthetic polypeptide
DEQEIATTNPVATEQYGSVSATDLETHIGEDL

SEQ ID NO: 85914 - protein, 32 aa, Artificial Sequence
  Description of Artificial Sequence: Synthetic polypeptide
DEQEIATTNPVATEQYGSVSATDLEDHYGEDL

SEQ ID NO: 85915 - protein, 32 aa, Artificial Sequence
  Description of Artificial Sequence: Synthetic polypeptide
DEQEIATTNPVATEQYGSVSATDLEDHVGETL

SEQ ID NO: 85916 - protein, 34 aa, Artificial Sequence
  Description of Artificial Sequence: Synthetic polypeptide
DEEEIRTTNPVATEQYGSVSTTNADLEEEVEELD

SEQ ID NO: 85917 - protein, 32 aa, Artificial Sequence
  Description of Artificial Sequence: Synthetic polypeptide
DEQEIATTNPVATEQYGSVSATDLEDHNGEDL

SEQ ID NO: 85918 - protein, 32 aa, Artificial Sequence
  Description of Artificial Sequence: Synthetic polypeptide
DEQEIATTNPVATEQYGSVSATDLEDHPGADL

SEQ ID NO: 85919 - protein, 33 aa, Artificial Sequence
  Description of Artificial Sequence: Synthetic polypeptide
DENEIRTTNPVATECWGSVSDINEPQDREGENG

SEQ ID NO: 85920 - protein, 32 aa, Artificial Sequence
  Description of Artificial Sequence: Synthetic polypeptide
DEQEIATTNPVATEQYGSVSATDLEDHPGEDL

SEQ ID NO: 85921 - protein, 31 aa, Artificial Sequence
  Description of Artificial Sequence: Synthetic polypeptide
DENEIRTTNPVATECWGSVSCNEPQNAEGDG

SEQ ID NO: 85922 - protein, 32 aa, Artificial Sequence
  Description of Artificial Sequence: Synthetic polypeptide
DEQEIATTNPVATEQYGSVSATDLEDHQGEDL

SEQ ID NO: 85923 - protein, 33 aa, Artificial Sequence
  Description of Artificial Sequence: Synthetic polypeptide
DENEIRTTNPVATECWGSVSCINEQQQREGENG

SEQ ID NO: 85924 - protein, 33 aa, Artificial Sequence
  Description of Artificial Sequence: Synthetic polypeptide
DEQEIATTNPVATEQYGSVSATDLEDHRGKEDL

SEQ ID NO: 85925 - protein, 32 aa, Artificial Sequence
  Description of Artificial Sequence: Synthetic polypeptide
DEQEIATTNPVATEQYGSVSATDLEDHSGEDL

SEQ ID NO: 85926 - protein, 32 aa, Artificial Sequence
  Description of Artificial Sequence: Synthetic polypeptide
DENEIRTTNPVATECWGSVSCINEPQHEGENG

SEQ ID NO: 85927 - protein, 32 aa, Artificial Sequence
  Description of Artificial Sequence: Synthetic polypeptide
DEQEIATTNPVATEQYGSVSATDLEDHTGEDE

SEQ ID NO: 85928 - protein, 32 aa, Artificial Sequence
  Description of Artificial Sequence: Synthetic polypeptide
DEQEIATTNPVATEQYGSVSATDLEDHTGEDL

SEQ ID NO: 85929 - protein, 33 aa, Artificial Sequence
  Description of Artificial Sequence: Synthetic polypeptide
DENEIRTTNPVATECWGSVSCINEPQDREGENG

SEQ ID NO: 85930 - protein, 32 aa, Artificial Sequence
  Description of Artificial Sequence: Synthetic polypeptide
DEQEIATTNPVATEQYGSVSATDLEDHTGHDL

SEQ ID NO: 85931 - protein, 32 aa, Artificial Sequence
  Description of Artificial Sequence: Synthetic polypeptide
DEQEIATTNPVATEQYGSVSATDLEDHVGADL

SEQ ID NO: 85932 - protein, 32 aa, Artificial Sequence
  Description of Artificial Sequence: Synthetic polypeptide
DEQEIATTNPVATEQYGSVSATDLEDHVGEDL

SEQ ID NO: 85933 - protein, 32 aa, Artificial Sequence
  Description of Artificial Sequence: Synthetic polypeptide
DEQEIATTNPVATEQYGSVSATDLEDHWGEDL

SEQ ID NO: 85934 - protein, 30 aa, Artificial Sequence
  Description of Artificial Sequence: Synthetic polypeptide
DENEIRTTNPVATDQYGSVNTQLHVFQATD

SEQ ID NO: 85935 - protein, 32 aa, Artificial Sequence
  Description of Artificial Sequence: Synthetic polypeptide
DEQEIATTNPVATEQYGSVSATDLEVAEGESL

SEQ ID NO: 85936 - protein, 32 aa, Artificial Sequence
  Description of Artificial Sequence: Synthetic polypeptide
DEQEIATTNPVATEQYGSVSATDLEVHEGEDL

SEQ ID NO: 85937 - protein, 33 aa, Artificial Sequence
  Description of Artificial Sequence: Synthetic polypeptide
DEQEIATTNPVATEQYGSVSATDNLEDHEGEDL

SEQ ID NO: 85938 - protein, 35 aa, Artificial Sequence
  Description of Artificial Sequence: Synthetic polypeptide
DEEEIRTTNPVATEQYGSVSTSNMMVQEEGEEEVE

SEQ ID NO: 85939 - protein, 33 aa, Artificial Sequence
  Description of Artificial Sequence: Synthetic polypeptide
DEQEIATTNPVATEQYGSVSATDNLEDHVGEDL

SEQ ID NO: 85940 - protein, 33 aa, Artificial Sequence
  Description of Artificial Sequence: Synthetic polypeptide
DEQEIATTNPVATEQYGSVSATDNLMDHEGEDL

SEQ ID NO: 85941 - protein, 33 aa, Artificial Sequence
  Description of Artificial Sequence: Synthetic polypeptide
DENEIRGTNPVATEQYGSVMTGLIQRGMGGDGN

SEQ ID NO: 85942 - protein, 33 aa, Artificial Sequence
  Description of Artificial Sequence: Synthetic polypeptide
DENEIRGTNPVATEQYGSVMTGLIQRGMGFDTE

SEQ ID NO: 85943 - protein, 31 aa, Artificial Sequence
  Description of Artificial Sequence: Synthetic polypeptide
DENEIRGTNPVATEQYGSVMTGLIIGMGGGN

SEQ ID NO: 85944 - protein, 32 aa, Artificial Sequence
  Description of Artificial Sequence: Synthetic polypeptide
DENEIRGTNPVATEQYGSVMTGLIRGMEQDEG

SEQ ID NO: 85945 - protein, 32 aa, Artificial Sequence
  Description of Artificial Sequence: Synthetic polypeptide
DENEIRGTNPVATEQYGSVMTGLIIGMGADNE

SEQ ID NO: 85946 - protein, 33 aa, Artificial Sequence
  Description of Artificial Sequence: Synthetic polypeptide
DENEIRGTNPVATEIYGSVSNNQNLQREGTGGN

SEQ ID NO: 85947 - protein, 31 aa, Artificial Sequence
  Description of Artificial Sequence: Synthetic polypeptide
DEQEIATTNPVATEQYGSVSATDPVEFEGEL

SEQ ID NO: 85948 - protein, 33 aa, Artificial Sequence
  Description of Artificial Sequence: Synthetic polypeptide
DEAEIRTTNPVAYEQWGSVCSTELDTRDDGDDR

SEQ ID NO: 85949 - protein, 33 aa, Artificial Sequence
  Description of Artificial Sequence: Synthetic polypeptide
DEQEIATTNPVATEQYGSVSATDTLEDHRGEDL

SEQ ID NO: 85950 - protein, 33 aa, Artificial Sequence
  Description of Artificial Sequence: Synthetic polypeptide
DEAEIRTTNPVAYEQWGSVCSTGDGMQDGGDNR

SEQ ID NO: 85951 - protein, 34 aa, Artificial Sequence
  Description of Artificial Sequence: Synthetic polypeptide
DEAEIRTTNPVAYEQWGSVCSTGDLTRQDNGDNR

SEQ ID NO: 85952 - protein, 33 aa, Artificial Sequence
  Description of Artificial Sequence: Synthetic polypeptide
DEAEIRTTNPVAYEQWGSVCSTGLDRQEDGDAR

SEQ ID NO: 85953 - protein, 34 aa, Artificial Sequence
  Description of Artificial Sequence: Synthetic polypeptide
DEAEIRTTNPVAYEQWGSVCSTDNGLQNDGDNNM

SEQ ID NO: 85954 - protein, 32 aa, Artificial Sequence
  Description of Artificial Sequence: Synthetic polypeptide
DEQEIATTNPVATEQYGSVSATDNEDHEGEDL

SEQ ID NO: 85955 - protein, 32 aa, Artificial Sequence
  Description of Artificial Sequence: Synthetic polypeptide
DEAEIRTTNPVAYEQWGSVCSTDNDQGDLNMG

SEQ ID NO: 85956 - protein, 33 aa, Artificial Sequence
  Description of Artificial Sequence: Synthetic polypeptide
DEQEIATTNPVATEQYGSVSATDMLEDHEGEDR

SEQ ID NO: 85957 - protein, 33 aa, Artificial Sequence
  Description of Artificial Sequence: Synthetic polypeptide
DEQEIATTNPVATEQYGSVSATDLQQDHNGEDL

SEQ ID NO: 85958 - protein, 32 aa, Artificial Sequence
  Description of Artificial Sequence: Synthetic polypeptide
DEQEIATTNPVATEQYGSVSATDLRDHEGEDL

SEQ ID NO: 85959 - protein, 32 aa, Artificial Sequence
  Description of Artificial Sequence: Synthetic polypeptide
DEQEIATTNPVATEQYGSVSATDLSDHEGEDL

SEQ ID NO: 85960 - protein, 32 aa, Artificial Sequence
  Description of Artificial Sequence: Synthetic polypeptide
DEQEIATTNPVATEQYGSVSATDLSDHIGEDL

SEQ ID NO: 85961 - protein, 33 aa, Artificial Sequence
  Description of Artificial Sequence: Synthetic polypeptide
DEAEIRTTNPVAYEQWGSVATTNAGNQGEAGNR

SEQ ID NO: 85962 - protein, 34 aa, Artificial Sequence
  Description of Artificial Sequence: Synthetic polypeptide
DENEIRGTNPVATEQYGSVMTGMLIQRGMGGDNP

SEQ ID NO: 85963 - protein, 32 aa, Artificial Sequence
  Description of Artificial Sequence: Synthetic polypeptide
DEQEIATTNPVATEQYGSVSATDLTDHEGEDL

SEQ ID NO: 85964 - protein, 32 aa, Artificial Sequence
  Description of Artificial Sequence: Synthetic polypeptide
DEQEIATTNPVATEQYGSVSATDLTDHEGEDM

SEQ ID NO: 85965 - protein, 33 aa, Artificial Sequence
  Description of Artificial Sequence: Synthetic polypeptide
DEQEIATTNPVATEQYGSVSATDLTEDHEGEDR

SEQ ID NO: 85966 - protein, 32 aa, Artificial Sequence
  Description of Artificial Sequence: Synthetic polypeptide
DENEIRGTNPVATEQYGSVMTGLIRGQGFDEY

SEQ ID NO: 85967 - protein, 32 aa, Artificial Sequence
  Description of Artificial Sequence: Synthetic polypeptide
DEAEIRTTNPVAYEQWGSVCPNDLGQNGDNNQ

SEQ ID NO: 85968 - protein, 32 aa, Artificial Sequence
  Description of Artificial Sequence: Synthetic polypeptide
DEQEIATTNPVATEQYGSVSATDLTMHEGEDL

SEQ ID NO: 85969 - protein, 32 aa, Artificial Sequence
  Description of Artificial Sequence: Synthetic polypeptide
DEQEIATTNPVATEQYGSVSATDLVDHEGEDL

SEQ ID NO: 85970 - protein, 32 aa, Artificial Sequence
  Description of Artificial Sequence: Synthetic polypeptide
DEQEIATTNPVATEQYGSVSATDLWDHEGEDL

SEQ ID NO: 85971 - protein, 32 aa, Artificial Sequence
  Description of Artificial Sequence: Synthetic polypeptide
DENEIRGTNPVATEQYGSVMTGLIRGMGDEDI

SEQ ID NO: 85972 - protein, 32 aa, Artificial Sequence
  Description of Artificial Sequence: Synthetic polypeptide
DEQEIATTNPVATEQYGSVSATDLYDHEGEDL

SEQ ID NO: 85973 - protein, 33 aa, Artificial Sequence
  Description of Artificial Sequence: Synthetic polypeptide
DEAEIRTTNPVAYEQWGSVCSTDDDTRQDGNDR

SEQ ID NO: 85974 - protein, 33 aa, Artificial Sequence
  Description of Artificial Sequence: Synthetic polypeptide
DEAEIRTTNPVAYEQWGSVCSTGLTDQDQGDDR

SEQ ID NO: 85975 - protein, 33 aa, Artificial Sequence
  Description of Artificial Sequence: Synthetic polypeptide
DEAEIRTTNPVAYEQWGSVCSTGLTRDDDGDMR

SEQ ID NO: 85976 - protein, 31 aa, Artificial Sequence
  Description of Artificial Sequence: Synthetic polypeptide
DENEIRGTNPVATDQYGDVSANGQGEGGNEG

SEQ ID NO: 85977 - protein, 34 aa, Artificial Sequence
  Description of Artificial Sequence: Synthetic polypeptide
DEAEIRTTNPVAYEQWGSVCSTNDLNQNDGDNNM

SEQ ID NO: 85978 - protein, 31 aa, Artificial Sequence
  Description of Artificial Sequence: Synthetic polypeptide
DENEIRCTNPVATEQWGEASCINLQDREGGG

SEQ ID NO: 85979 - protein, 28 aa, Artificial Sequence
  Description of Artificial Sequence: Synthetic peptide
DENEIRCTNPVATEQWGDVSENEMAEDA

SEQ ID NO: 85980 - protein, 32 aa, Artificial Sequence
  Description of Artificial Sequence: Synthetic polypeptide
DEQEIATTNPVATEQYGSVSATGLENHQGEDL

SEQ ID NO: 85981 - protein, 32 aa, Artificial Sequence
  Description of Artificial Sequence: Synthetic polypeptide
DEQEIATTNPVATEQYGSVSATGLGDHQGEDA

SEQ ID NO: 85982 - protein, 33 aa, Artificial Sequence
  Description of Artificial Sequence: Synthetic polypeptide
DEQEIATTNPVATEQYGSVSATGLTDHQGGQDL

SEQ ID NO: 85983 - protein, 33 aa, Artificial Sequence
  Description of Artificial Sequence: Synthetic polypeptide
DEQEIATTNPVATEQYGSVSATGLVEDFEGNDD

SEQ ID NO: 85984 - protein, 33 aa, Artificial Sequence
  Description of Artificial Sequence: Synthetic polypeptide
DEQEIATTNPVATEQYGSVSATGLVEDHEGNDD

SEQ ID NO: 85985 - protein, 31 aa, Artificial Sequence
  Description of Artificial Sequence: Synthetic polypeptide
DEQEIATTNPVATEQYGSVSATGPVEFEGED

SEQ ID NO: 85986 - protein, 35 aa, Artificial Sequence
  Description of Artificial Sequence: Synthetic polypeptide
DEEEIRTTNPVATEQYGSVSTSLNLMQNHVEQADE

SEQ ID NO: 85987 - protein, 32 aa, Artificial Sequence
  Description of Artificial Sequence: Synthetic polypeptide
DEQEIATTNPVATEQYGSVSATHLADHEGEDA

SEQ ID NO: 85988 - protein, 32 aa, Artificial Sequence
  Description of Artificial Sequence: Synthetic polypeptide
DEQEIATTNPVATEQYGSVSATHLEDHEGEDL

SEQ ID NO: 85989 - protein, 32 aa, Artificial Sequence
  Description of Artificial Sequence: Synthetic polypeptide
DEQEIATTNPVATEQYGSVSATHLEDHQGDDL

SEQ ID NO: 85990 - protein, 34 aa, Artificial Sequence
  Description of Artificial Sequence: Synthetic polypeptide
DEEEIRTTNPVATEQYGSVWELPQMLQRDQNTEG

SEQ ID NO: 85991 - protein, 33 aa, Artificial Sequence
  Description of Artificial Sequence: Synthetic polypeptide
DEQEIATTNPVATEQYGSVSATHLEDHQGGEDT

SEQ ID NO: 85992 - protein, 33 aa, Artificial Sequence
  Description of Artificial Sequence: Synthetic polypeptide
DEEEIRTTNPVATEQYGSVWELPQMLQRFDEEI

SEQ ID NO: 85993 - protein, 30 aa, Artificial Sequence
  Description of Artificial Sequence: Synthetic polypeptide
DENEIRCTNPVATEQWGDASENEMNRAGGR

SEQ ID NO: 85994 - protein, 30 aa, Artificial Sequence
  Description of Artificial Sequence: Synthetic polypeptide
DENEIRCTNPVATEPYGTASMDIQQQQGNR

SEQ ID NO: 85995 - protein, 32 aa, Artificial Sequence
  Description of Artificial Sequence: Synthetic polypeptide
DEQEIATTNPVATEQYGSVSATGLEDHEGHDL

SEQ ID NO: 85996 - protein, 34 aa, Artificial Sequence
  Description of Artificial Sequence: Synthetic polypeptide
DEQEIATTNPVATEQYGSVSATDLQEDYEGENEQ

SEQ ID NO: 85997 - protein, 32 aa, Artificial Sequence
  Description of Artificial Sequence: Synthetic polypeptide
DEQEIATTNPVATEQYGSVSATGLEDHEGEQL

SEQ ID NO: 85998 - protein, 30 aa, Artificial Sequence
  Description of Artificial Sequence: Synthetic polypeptide
DENEIRCTNPVATEQYGCVSWAFLESQENQ

SEQ ID NO: 85999 - protein, 33 aa, Artificial Sequence
  Description of Artificial Sequence: Synthetic polypeptide
DEAEIRTTNPVAYEQWGSVCSTNDNHERGGDNA

SEQ ID NO: 86000 - protein, 33 aa, Artificial Sequence
  Description of Artificial Sequence: Synthetic polypeptide
DEAEIRTTNPVAYEQWGSVCSTNLNDGNGGDEA

SEQ ID NO: 86001 - protein, 33 aa, Artificial Sequence
  Description of Artificial Sequence: Synthetic polypeptide
DEAEIRTTNPVAYEQWGSVCSTQDLQNDGDNNS

SEQ ID NO: 86002 - protein, 32 aa, Artificial Sequence
  Description of Artificial Sequence: Synthetic polypeptide
DEQEIATTNPVATEQYGSVSATEDLEDDEGEL

SEQ ID NO: 86003 - protein, 30 aa, Artificial Sequence
  Description of Artificial Sequence: Synthetic polypeptide
CEEVIACTNPVATEQYGCVATNLPDNEGER

SEQ ID NO: 86004 - protein, 32 aa, Artificial Sequence
  Description of Artificial Sequence: Synthetic polypeptide
DEQEIATTNPVATEQYGSVSATELEDHEGEDL

SEQ ID NO: 86005 - protein, 32 aa, Artificial Sequence
  Description of Artificial Sequence: Synthetic polypeptide
DEQEIATTNPVATEQYGSVSATELEDHEGEDS

SEQ ID NO: 86006 - protein, 32 aa, Artificial Sequence
  Description of Artificial Sequence: Synthetic polypeptide
DEQEIATTNPVATEQYGSVSATFLEDHEGEDH

SEQ ID NO: 86007 - protein, 32 aa, Artificial Sequence
  Description of Artificial Sequence: Synthetic polypeptide
DEQEIATTNPVATEQYGSVSATFLEDHEGEDL

SEQ ID NO: 86008 - protein, 32 aa, Artificial Sequence
  Description of Artificial Sequence: Synthetic polypeptide
DEQEIATTNPVATEQYGSVSATFLEDHEGEQL

SEQ ID NO: 86009 - protein, 30 aa, Artificial Sequence
  Description of Artificial Sequence: Synthetic polypeptide
DENEIRCTNPVATEQYGCVSWPFNTRQENQ

SEQ ID NO: 86010 - protein, 32 aa, Artificial Sequence
  Description of Artificial Sequence: Synthetic polypeptide
DEQEIATTNPVATEQYGSVSATFLEDHHGEDT

SEQ ID NO: 86011 - protein, 32 aa, Artificial Sequence
  Description of Artificial Sequence: Synthetic polypeptide
DEQEIATTNPVATEQYGSVSATGLEDFEGEDL

SEQ ID NO: 86012 - protein, 32 aa, Artificial Sequence
  Description of Artificial Sequence: Synthetic polypeptide
DENEIRCTNPVATEQYGCVSWDFTLTRGENQN

SEQ ID NO: 86013 - protein, 32 aa, Artificial Sequence
  Description of Artificial Sequence: Synthetic polypeptide
DEQEIATTNPVATEQYGSVSATGLEDHEGEDL

SEQ ID NO: 86014 - protein, 32 aa, Artificial Sequence
  Description of Artificial Sequence: Synthetic polypeptide
DEQEIATTNPVATEQYGSVSATGLEDHEGEEN

SEQ ID NO: 86015 - protein, 32 aa, Artificial Sequence
  Description of Artificial Sequence: Synthetic polypeptide
DENEIRCTNPVATEQYGCVSWAQSLTERGENQ

SEQ ID NO: 86016 - protein, 31 aa, Artificial Sequence
  Description of Artificial Sequence: Synthetic polypeptide
DENEIRCTNPVATEQYGAASNEDWQRKGGYR

SEQ ID NO: 86017 - protein, 32 aa, Artificial Sequence
  Description of Artificial Sequence: Synthetic polypeptide
DENEIATTNPVATEQYGSVAATNDADDPGGER

SEQ ID NO: 86018 - protein, 33 aa, Artificial Sequence
  Description of Artificial Sequence: Synthetic polypeptide
DEQEIATTNPVATEQYGSVSATDLQEDHEGSDL

SEQ ID NO: 86019 - protein, 33 aa, Artificial Sequence
  Description of Artificial Sequence: Synthetic polypeptide
DEQEIATTNPVATEQYGSVSATDLQEDHEGEDV

SEQ ID NO: 86020 - protein, 30 aa, Artificial Sequence
  Description of Artificial Sequence: Synthetic polypeptide
DENEIRTTNPISTEPYGSISMEDLQQNGNH

SEQ ID NO: 86021 - protein, 35 aa, Artificial Sequence
  Description of Artificial Sequence: Synthetic polypeptide
DEEEIRTTNPVATEQYGSVSTTGMGDQEGGENQEI

SEQ ID NO: 86022 - protein, 34 aa, Artificial Sequence
  Description of Artificial Sequence: Synthetic polypeptide
DEEEIRTTNPVATEQYGSVSTTGMGDQEGGDEEE

SEQ ID NO: 86023 - protein, 32 aa, Artificial Sequence
  Description of Artificial Sequence: Synthetic polypeptide
DEQEIATTNPVATEQYGSVSATDLIDHEGEDL

SEQ ID NO: 86024 - protein, 32 aa, Artificial Sequence
  Description of Artificial Sequence: Synthetic polypeptide
DEQEIATTNPVATEQYGSVSATDLIDHEGFDL

SEQ ID NO: 86025 - protein, 32 aa, Artificial Sequence
  Description of Artificial Sequence: Synthetic polypeptide
DEQEIATTNPVATEQYGSVSATDLIDHEGQDL

SEQ ID NO: 86026 - protein, 31 aa, Artificial Sequence
  Description of Artificial Sequence: Synthetic polypeptide
DEAEIRTTNPVAYEQWGEVSTNLNGDEGMTQ

SEQ ID NO: 86027 - protein, 32 aa, Artificial Sequence
  Description of Artificial Sequence: Synthetic polypeptide
DEQEIATTNPVATEQYGSVSATDLHDHEGEGL

SEQ ID NO: 86028 - protein, 32 aa, Artificial Sequence
  Description of Artificial Sequence: Synthetic polypeptide
DEAEIRTTNPVAYEQWGEVSTNLNGDHGNTQV

SEQ ID NO: 86029 - protein, 29 aa, Artificial Sequence
  Description of Artificial Sequence: Synthetic peptide
DENEIRTTNPIATECYGAVAACLQHKGEL

SEQ ID NO: 86030 - protein, 29 aa, Artificial Sequence
  Description of Artificial Sequence: Synthetic peptide
DENEIRTTNPIATECYGATVSECLAHGEI

SEQ ID NO: 86031 - protein, 33 aa, Artificial Sequence
  Description of Artificial Sequence: Synthetic polypeptide
DENEIRTTNPCATEQYGQSVVQTQLQNNQENMR

SEQ ID NO: 86032 - protein, 32 aa, Artificial Sequence
  Description of Artificial Sequence: Synthetic polypeptide
DEQEIATTNPVATEQYGSVSATDLKDHEGEDL

SEQ ID NO: 86033 - protein, 35 aa, Artificial Sequence
  Description of Artificial Sequence: Synthetic polypeptide
DEEEIRTTNPVATEQYGSVSTTENNSDAAMNELRV

SEQ ID NO: 86034 - protein, 30 aa, Artificial Sequence
  Description of Artificial Sequence: Synthetic polypeptide
DENEIRTTNPCATEQYGDVSCNEMNSAGDA

SEQ ID NO: 86035 - protein, 30 aa, Artificial Sequence
  Description of Artificial Sequence: Synthetic polypeptide
DENEIRTTNPCATEQWGIVSENLQNAAEDA

SEQ ID NO: 86036 - protein, 30 aa, Artificial Sequence
  Description of Artificial Sequence: Synthetic polypeptide
DENEIRTTNPISTEPYGSISMEDLMQNGNH

SEQ ID NO: 86037 - protein, 32 aa, Artificial Sequence
  Description of Artificial Sequence: Synthetic polypeptide
DEQEIATTNPVATEQYGSVSATDLHDHEGEDL

SEQ ID NO: 86038 - protein, 32 aa, Artificial Sequence
  Description of Artificial Sequence: Synthetic polypeptide
DEAEIRTTNPVAYEQWGEVCSTDNGQDGDNEL

SEQ ID NO: 86039 - protein, 32 aa, Artificial Sequence
  Description of Artificial Sequence: Synthetic polypeptide
DEQEIATTNPVATEQYGSVSATDLGDHEGEDL

SEQ ID NO: 86040 - protein, 32 aa, Artificial Sequence
  Description of Artificial Sequence: Synthetic polypeptide
DEQEIATTNPVATEQYGSVSATDLEVHEGEPD

SEQ ID NO: 86041 - protein, 31 aa, Artificial Sequence
  Description of Artificial Sequence: Synthetic polypeptide
DENEIRTTNPVATDQYGSVNTQLEHVRQATQ

SEQ ID NO: 86042 - protein, 34 aa, Artificial Sequence
  Description of Artificial Sequence: Synthetic polypeptide
DEEEIRTTNPVATEQYGSVSTTINQNINGVLEQQ

SEQ ID NO: 86043 - protein, 31 aa, Artificial Sequence
  Description of Artificial Sequence: Synthetic polypeptide
DEAEIRTTNPVAYEQWGEVATNDDERGNDDH

SEQ ID NO: 86044 - protein, 35 aa, Artificial Sequence
  Description of Artificial Sequence: Synthetic polypeptide
DEEEIRTTNPVATEQYGSVSTTINEQNINSLLENQ

SEQ ID NO: 86045 - protein, 32 aa, Artificial Sequence
  Description of Artificial Sequence: Synthetic polypeptide
DEQEIATTNPVATEQYGSVSATDLEVHQNEDL

SEQ ID NO: 86046 - protein, 32 aa, Artificial Sequence
  Description of Artificial Sequence: Synthetic polypeptide
DEQEIATTNPVATEQYGSVSATDLEVSEGEDE

SEQ ID NO: 86047 - protein, 30 aa, Artificial Sequence
  Description of Artificial Sequence: Synthetic polypeptide
DENEIRTTNPVATDQYGSVNLQAQVHQLND

SEQ ID NO: 86048 - protein, 31 aa, Artificial Sequence
  Description of Artificial Sequence: Synthetic polypeptide
DENEIRTTNPVATDQYGSTNTQLEHPRQVND

SEQ ID NO: 86049 - protein, 35 aa, Artificial Sequence
  Description of Artificial Sequence: Synthetic polypeptide
DEEEIRTTNPVATEQYGSVSTTIAGPNMRNGMNPV

SEQ ID NO: 86050 - protein, 29 aa, Artificial Sequence
  Description of Artificial Sequence: Synthetic peptide
DENEIRTTNPVASEQWGIVSEILMNSGTA

SEQ ID NO: 86051 - protein, 32 aa, Artificial Sequence
  Description of Artificial Sequence: Synthetic polypeptide
DEQEIATTNPVATEQYGSVSATDLEWHEGEDL

SEQ ID NO: 86052 - protein, 32 aa, Artificial Sequence
  Description of Artificial Sequence: Synthetic polypeptide
DEQEIATTNPVATEQYGSVSATDLEWHEGEDT

SEQ ID NO: 86053 - protein, 32 aa, Artificial Sequence
  Description of Artificial Sequence: Synthetic polypeptide
DEQEIATTNPVATEQYGSVSATDLEYHEGEDL

SEQ ID NO: 86054 - protein, 29 aa, Artificial Sequence
  Description of Artificial Sequence: Synthetic peptide
DENEIRTTNPVASEQWGDVSEILMNSGTA

SEQ ID NO: 86055 - protein, 34 aa, Artificial Sequence
  Description of Artificial Sequence: Synthetic polypeptide
DEEEIRTTNPVATEQYGSVSTTGSLEVILANIYE

SEQ ID NO: 86056 - protein, 32 aa, Artificial Sequence
  Description of Artificial Sequence: Synthetic polypeptide
DEQEIATTNPVATEQYGSVSATDLFDHEGEDL

SEQ ID NO: 86057 - protein, 32 aa, Artificial Sequence
  Description of Artificial Sequence: Synthetic polypeptide
DEQEIATTNPVATEQYGSVSATDLLDHEGEDL

SEQ ID NO: 86058 - protein, 30 aa, Artificial Sequence
  Description of Artificial Sequence: Synthetic polypeptide
DENEIRTTNPCATEQWGIVSENEMNAAGDR

SEQ ID NO: 86059 - protein, 32 aa, Artificial Sequence
  Description of Artificial Sequence: Synthetic polypeptide
DEQEIATTNPVATEQYGSVSATDLLDPEGEDG

SEQ ID NO: 86060 - protein, 32 aa, Artificial Sequence
  Description of Artificial Sequence: Synthetic polypeptide
DEQEIATTNPVATEQYGSVSATDLLEDHEGEL

SEQ ID NO: 86061 - protein, 33 aa, Artificial Sequence
  Description of Artificial Sequence: Synthetic polypeptide
DEQEIATTNPVATEQYGSVSATDLPQDHEGEDG

SEQ ID NO: 86062 - protein, 32 aa, Artificial Sequence
  Description of Artificial Sequence: Synthetic polypeptide
DEQEIATTNPVATEQYGSVSATDLQDHEDEDL

SEQ ID NO: 86063 - protein, 34 aa, Artificial Sequence
  Description of Artificial Sequence: Synthetic polypeptide
DEEEIRTTNPVATEQYGSVSTTAGMGNTGQENDE

SEQ ID NO: 86064 - protein, 28 aa, Artificial Sequence
  Description of Artificial Sequence: Synthetic peptide
DENEIRSTNPVGTEGYGTIAMTLQHGNI

SEQ ID NO: 86065 - protein, 32 aa, Artificial Sequence
  Description of Artificial Sequence: Synthetic polypeptide
DEAEIRTTNPVAYEQWGSICSTNDHEERHPNR

SEQ ID NO: 86066 - protein, 37 aa, Artificial Sequence
  Description of Artificial Sequence: Synthetic polypeptide
DEEEIRTTNPVATEQYGSVSTSVNTNLQAGTTNTTTD

SEQ ID NO: 86067 - protein, 32 aa, Artificial Sequence
  Description of Artificial Sequence: Synthetic polypeptide
DEAEIRTTNPVAYEQWGSICSTNDHERPNDRS

SEQ ID NO: 86068 - protein, 30 aa, Artificial Sequence
  Description of Artificial Sequence: Synthetic polypeptide
DENEIRSTNPVATEQYGNVSNTIMSAVEDR

SEQ ID NO: 86069 - protein, 30 aa, Artificial Sequence
  Description of Artificial Sequence: Synthetic polypeptide
DENEIRPTNPVSTEQYGTVSCDIQQQQGTR

SEQ ID NO: 86070 - protein, 29 aa, Artificial Sequence
  Description of Artificial Sequence: Synthetic peptide
DENEIRPTNPVSTEQYGDVSCIEQNAGDA

SEQ ID NO: 86071 - protein, 29 aa, Artificial Sequence
  Description of Artificial Sequence: Synthetic peptide
DENEIRPTNPVATEQYGIVSENEMNAETA

SEQ ID NO: 86072 - protein, 29 aa, Artificial Sequence
  Description of Artificial Sequence: Synthetic peptide
DENEIRPTNPVATEQWGDVSEIEQNSGDA

SEQ ID NO: 86073 - protein, 32 aa, Artificial Sequence
  Description of Artificial Sequence: Synthetic polypeptide
DEAEIRTTNPVAYEQWGSISRTPNDERPDNSR

SEQ ID NO: 86074 - protein, 32 aa, Artificial Sequence
  Description of Artificial Sequence: Synthetic polypeptide
DEAEIRTTNPVAYEQWGSISRTPNDERPNERD

SEQ ID NO: 86075 - protein, 29 aa, Artificial Sequence
  Description of Artificial Sequence: Synthetic peptide
DENEIRPTNPVATEQWGDVSCNEMSAGTA

SEQ ID NO: 86076 - protein, 33 aa, Artificial Sequence
  Description of Artificial Sequence: Synthetic polypeptide
DEQEIATTNPVATEQYGSVSATDLQEDHEGEDL

SEQ ID NO: 86077 - protein, 33 aa, Artificial Sequence
  Description of Artificial Sequence: Synthetic polypeptide
DEQEIATTNPVATEQYGSVSATDLQEDHEGEDP

SEQ ID NO: 86078 - protein, 32 aa, Artificial Sequence
  Description of Artificial Sequence: Synthetic polypeptide
DEQEIATTNPVATEQYGSVSATDLPDHEGEDL

SEQ ID NO: 86079 - protein, 34 aa, Artificial Sequence
  Description of Artificial Sequence: Synthetic polypeptide
DENEIRGTNPVATEQYGSVTSTGDLGQRGLGEPG

SEQ ID NO: 86080 - protein, 32 aa, Artificial Sequence
  Description of Artificial Sequence: Synthetic polypeptide
DEQEIATTNPVATEQYGSVSATDLNNHEGEDL

SEQ ID NO: 86081 - protein, 35 aa, Artificial Sequence
  Description of Artificial Sequence: Synthetic polypeptide
DEEEIRTTNPVATEQYGSVSTTALQMTRVVEVKVD

SEQ ID NO: 86082 - protein, 33 aa, Artificial Sequence
  Description of Artificial Sequence: Synthetic polypeptide
DEQEIATTNPVATEQYGSVSATDLLEDREGEDL

SEQ ID NO: 86083 - protein, 29 aa, Artificial Sequence
  Description of Artificial Sequence: Synthetic peptide
DENEIRSVNPVATEQWGVVSENLQNSEDA

SEQ ID NO: 86084 - protein, 33 aa, Artificial Sequence
  Description of Artificial Sequence: Synthetic polypeptide
DEAEIRTTNPVAYEQWGEVVSTNNILGEDGNNR

SEQ ID NO: 86085 - protein, 36 aa, Artificial Sequence
  Description of Artificial Sequence: Synthetic polypeptide
DEEEIRTTNPVATEQYGSVSTTDNGLGLEINGNNDT

SEQ ID NO: 86086 - protein, 33 aa, Artificial Sequence
  Description of Artificial Sequence: Synthetic polypeptide
DEEEIRTTNPVATEQYGSVVVMTNMLEASVEFE

SEQ ID NO: 86087 - protein, 36 aa, Artificial Sequence
  Description of Artificial Sequence: Synthetic polypeptide
DEEEIRTTNPVATEQYGSVSTTDNGLGLEINGNEQQ

SEQ ID NO: 86088 - protein, 30 aa, Artificial Sequence
  Description of Artificial Sequence: Synthetic polypeptide
DENEIRSTNPVSTEQYGVVSMEDIQQNGNH

SEQ ID NO: 86089 - protein, 32 aa, Artificial Sequence
  Description of Artificial Sequence: Synthetic polypeptide
DEQEIATTNPVATEQYGSVSATDLMDHEGEDL

SEQ ID NO: 86090 - protein, 34 aa, Artificial Sequence
  Description of Artificial Sequence: Synthetic polypeptide
DEEEIRTTNPVATEQYGSVVVPSPNGLEAEVEFR

SEQ ID NO: 86091 - protein, 35 aa, Artificial Sequence
  Description of Artificial Sequence: Synthetic polypeptide
DEEEIRTTNPVATEQYGSVSTTDNGLEGGGETGET

SEQ ID NO: 86092 - protein, 33 aa, Artificial Sequence
  Description of Artificial Sequence: Synthetic polypeptide
DEAEIRTTNPVAYEQWGEVVSTNNMLGEDGNHR

SEQ ID NO: 86093 - protein, 32 aa, Artificial Sequence
  Description of Artificial Sequence: Synthetic polypeptide
DEAEIRTTNPVAYEQWGMTSHTDNHQREGTER

SEQ ID NO: 86094 - protein, 33 aa, Artificial Sequence
  Description of Artificial Sequence: Synthetic polypeptide
DEEEIRTTNPVATEQYGSVVVSGNLLEASVEFE

SEQ ID NO: 86095 - protein, 32 aa, Artificial Sequence
  Description of Artificial Sequence: Synthetic polypeptide
DEQEIATTNPVATEQYGSVSATDLMKHEGEDL

SEQ ID NO: 86096 - protein, 32 aa, Artificial Sequence
  Description of Artificial Sequence: Synthetic polypeptide
DEQEIATTNPVATEQYGSVSATDLNDHEGEDL

SEQ ID NO: 86097 - protein, 35 aa, Artificial Sequence
  Description of Artificial Sequence: Synthetic polypeptide
DEEEIRTTNPVATEQYGSVSTTDDGQTQGQGTNDD

SEQ ID NO: 86098 - protein, 31 aa, Artificial Sequence
  Description of Artificial Sequence: Synthetic polypeptide
DEAEIRTTNPVAYEQWGSAISRPNDERPDNR

SEQ ID NO: 86099 - protein, 32 aa, Artificial Sequence
  Description of Artificial Sequence: Synthetic polypeptide
DEQEIATTNPVATEQYGSVSATDLNDHHGEDN

SEQ ID NO: 86100 - protein, 31 aa, Artificial Sequence
  Description of Artificial Sequence: Synthetic polypeptide
DENEIATTNPVATEQYGSISATDIEQHNGEL

SEQ ID NO: 86101 - protein, 32 aa, Artificial Sequence
  Description of Artificial Sequence: Synthetic polypeptide
DEAEIRTTNPVAYERWGVVSTNLNGDAGNNRH

SEQ ID NO: 86102 - protein, 33 aa, Artificial Sequence
  Description of Artificial Sequence: Synthetic polypeptide
DEQEIATTNPVATEQYGSVSTTPDGNMRNGNPV

SEQ ID NO: 86103 - protein, 28 aa, Artificial Sequence
  Description of Artificial Sequence: Synthetic peptide
DENEIASTNPVATEQYGDVSEIEMHGDI

SEQ ID NO: 86104 - protein, 30 aa, Artificial Sequence
  Description of Artificial Sequence: Synthetic polypeptide
DENEIAPTNPVSTEQYGIVSCDLQQQQGTR

SEQ ID NO: 86105 - protein, 29 aa, Artificial Sequence
  Description of Artificial Sequence: Synthetic peptide
DENEIAPTNPVSSEQYGIVSCDLQQSGTR

SEQ ID NO: 86106 - protein, 34 aa, Artificial Sequence
  Description of Artificial Sequence: Synthetic polypeptide
DEEEIRTTNPVATEQYGSYLSPTTLDQVAENEEL

SEQ ID NO: 86107 - protein, 29 aa, Artificial Sequence
  Description of Artificial Sequence: Synthetic peptide
DENEIAPTNPVASEQWGDVSCNLMSAGTR

SEQ ID NO: 86108 - protein, 29 aa, Artificial Sequence
  Description of Artificial Sequence: Synthetic peptide
DENEIACTNPVSTEPYGTASENLQQQGGR

SEQ ID NO: 86109 - protein, 29 aa, Artificial Sequence
  Description of Artificial Sequence: Synthetic peptide
DENEIACTNPVSTEPYGEASENLQQQGGR

SEQ ID NO: 86110 - protein, 28 aa, Artificial Sequence
  Description of Artificial Sequence: Synthetic peptide
DENEIASTNPVATEQYGVVSSIEMHGDI

SEQ ID NO: 86111 - protein, 34 aa, Artificial Sequence
  Description of Artificial Sequence: Synthetic polypeptide
DEEEIRTTNPVATEQYGSYNSTNDDERDGQEEIG

SEQ ID NO: 86112 - protein, 30 aa, Artificial Sequence
  Description of Artificial Sequence: Synthetic polypeptide
DENEIACTNPVSTEGYGNASNNLQSRVGGR

SEQ ID NO: 86113 - protein, 30 aa, Artificial Sequence
  Description of Artificial Sequence: Synthetic polypeptide
DENEIACTNPVSTEGYGNASENLQSRVGGR

SEQ ID NO: 86114 - protein, 35 aa, Artificial Sequence
  Description of Artificial Sequence: Synthetic polypeptide
DEQEIRTTNPVATEQYGSVTSTTLNVLQDEGEDEQ

SEQ ID NO: 86115 - protein, 33 aa, Artificial Sequence
  Description of Artificial Sequence: Synthetic polypeptide
CEEEIACTNPVATEQYGSVATNLQGAPGENAAE

SEQ ID NO: 86116 - protein, 32 aa, Artificial Sequence
  Description of Artificial Sequence: Synthetic polypeptide
CEEEIACTNPVATEQYGSVATNLQGAGAEAAD

SEQ ID NO: 86117 - protein, 32 aa, Artificial Sequence
  Description of Artificial Sequence: Synthetic polypeptide
DEQEIRTTNPVATEQYGSVTVTPWDQEGETQI

SEQ ID NO: 86118 - protein, 33 aa, Artificial Sequence
  Description of Artificial Sequence: Synthetic polypeptide
CEEEIACTNPVATEQYGSVATNLQETGNGNVES

SEQ ID NO: 86119 - protein, 34 aa, Artificial Sequence
  Description of Artificial Sequence: Synthetic polypeptide
DEEEIRTTNPVATEQYGSYNSTNIDMPRQGEDGQ

SEQ ID NO: 86120 - protein, 29 aa, Artificial Sequence
  Description of Artificial Sequence: Synthetic peptide
DENEIASTNPVCTEQYGVVSDILMNAGNQ

SEQ ID NO: 86121 - protein, 28 aa, Artificial Sequence
  Description of Artificial Sequence: Synthetic peptide
DENEIASTNPVSTEGYGDVSNCLQREQL

SEQ ID NO: 86122 - protein, 34 aa, Artificial Sequence
  Description of Artificial Sequence: Synthetic polypeptide
DEQEIRTTNPVATEQYGSVSVVTATETQREGEDQ

SEQ ID NO: 86123 - protein, 32 aa, Artificial Sequence
  Description of Artificial Sequence: Synthetic polypeptide
DEQEIRTTNPVATEQYGSVSTTDGEDHEGEPL

SEQ ID NO: 86124 - protein, 34 aa, Artificial Sequence
  Description of Artificial Sequence: Synthetic polypeptide
DEQEIRTTNPVATEQYGSVSTTPDGNMRNGMNPV

SEQ ID NO: 86125 - protein, 33 aa, Artificial Sequence
  Description of Artificial Sequence: Synthetic polypeptide
DEQEIRTTNPVATEQYGSVSTTPDLNDHNGEDV

SEQ ID NO: 86126 - protein, 33 aa, Artificial Sequence
  Description of Artificial Sequence: Synthetic polypeptide
DEQEIRTTNPVATEQYGSVSVDNNQEEGMEDHD

SEQ ID NO: 86127 - protein, 29 aa, Artificial Sequence
  Description of Artificial Sequence: Synthetic peptide
DENEIASVNPVCTEPYGVVSDNLQQSGNQ

SEQ ID NO: 86128 - protein, 34 aa, Artificial Sequence
  Description of Artificial Sequence: Synthetic polypeptide
DEQEIRTTNPVATEQYGSVSVMLADQEGGQNEQN

SEQ ID NO: 86129 - protein, 34 aa, Artificial Sequence
  Description of Artificial Sequence: Synthetic polypeptide
DEAEICTTNPVATECYGSVSTGNLQGDRQMNNES

SEQ ID NO: 86130 - protein, 29 aa, Artificial Sequence
  Description of Artificial Sequence: Synthetic peptide
DENEIASVNPVATEQYGVVSDNLQNSEDA

SEQ ID NO: 86131 - protein, 33 aa, Artificial Sequence
  Description of Artificial Sequence: Synthetic polypeptide
DEQEIRTTNPVATEQYGSVSVMMGHDENPGNSR

SEQ ID NO: 86132 - protein, 30 aa, Artificial Sequence
  Description of Artificial Sequence: Synthetic polypeptide
DENEIASTNPVSTEQYGVVSMENIQQNGNH

SEQ ID NO: 86133 - protein, 30 aa, Artificial Sequence
  Description of Artificial Sequence: Synthetic polypeptide
DENEIASTNPVSTEQYGVVSDENIQQNGNH

SEQ ID NO: 86134 - protein, 30 aa, Artificial Sequence
  Description of Artificial Sequence: Synthetic polypeptide
DENEIASTNPVSTEGYGNASNNLQSRVGGR

SEQ ID NO: 86135 - protein, 34 aa, Artificial Sequence
  Description of Artificial Sequence: Synthetic polypeptide
DEAEICTTNPVATECYGSVSTGNLQGDRQMGGEN

SEQ ID NO: 86136 - protein, 33 aa, Artificial Sequence
  Description of Artificial Sequence: Synthetic polypeptide
CEEEIACTNPVATEQYGSVATNLQTAEDGNEDN

SEQ ID NO: 86137 - protein, 33 aa, Artificial Sequence
  Description of Artificial Sequence: Synthetic polypeptide
DEQEIRTTNPVATEQYGSVSVTPTHQEYQENDS

SEQ ID NO: 86138 - protein, 34 aa, Artificial Sequence
  Description of Artificial Sequence: Synthetic polypeptide
DEQEIRTTNPVATEQYGSVSVTVYVEQPGNNEVE

SEQ ID NO: 86139 - protein, 35 aa, Artificial Sequence
  Description of Artificial Sequence: Synthetic polypeptide
DEEEIRTTNPVATEQYGSYEVAGNLEIQVGEEVRE

SEQ ID NO: 86140 - protein, 32 aa, Artificial Sequence
  Description of Artificial Sequence: Synthetic polypeptide
CEEEIACTNPVATEQYGSVATNLQENPGEDLH

SEQ ID NO: 86141 - protein, 33 aa, Artificial Sequence
  Description of Artificial Sequence: Synthetic polypeptide
DEQEIRTTNPVATEQYGSVSTTALPNDHEGEDV

SEQ ID NO: 86142 - protein, 30 aa, Artificial Sequence
  Description of Artificial Sequence: Synthetic polypeptide
DENEIACTNPVATEQYGTVSEDGLQFEGGD

SEQ ID NO: 86143 - protein, 31 aa, Artificial Sequence
  Description of Artificial Sequence: Synthetic polypeptide
DENEIACTNPVATEQYGTISMENLQQRNGGH

SEQ ID NO: 86144 - protein, 32 aa, Artificial Sequence
  Description of Artificial Sequence: Synthetic polypeptide
DEQEIRTTNPVAYEQWGSVSTNPNGNDMGNVA

SEQ ID NO: 86145 - protein, 32 aa, Artificial Sequence
  Description of Artificial Sequence: Synthetic polypeptide
DEQEIRTTNPVAYEQWGSVSTNPNGNGMGNEM

SEQ ID NO: 86146 - protein, 33 aa, Artificial Sequence
  Description of Artificial Sequence: Synthetic polypeptide
DEQEIRTTNPVAYEQWGSVSTNPNGNGMGQNGR

SEQ ID NO: 86147 - protein, 33 aa, Artificial Sequence
  Description of Artificial Sequence: Synthetic polypeptide
DEQEIRTTNPVAYEQWGTVSTNLQGDAGGNSQG

SEQ ID NO: 86148 - protein, 32 aa, Artificial Sequence
  Description of Artificial Sequence: Synthetic polypeptide
DEQEIRTTNPVSTEPYGSISATDLQEQHNGNH

SEQ ID NO: 86149 - protein, 30 aa, Artificial Sequence
  Description of Artificial Sequence: Synthetic polypeptide
DEQEIRTTNPVSTEPYGSVSMDIEQQNGEH

SEQ ID NO: 86150 - protein, 30 aa, Artificial Sequence
  Description of Artificial Sequence: Synthetic polypeptide
DEQEIRTTNPVSTEPYGSVSMDIQQQNGEH

SEQ ID NO: 86151 - protein, 33 aa, Artificial Sequence
  Description of Artificial Sequence: Synthetic polypeptide
DEAEICTTNPVATECYGSVSTGNLGQDGQKGET

SEQ ID NO: 86152 - protein, 32 aa, Artificial Sequence
  Description of Artificial Sequence: Synthetic polypeptide
DEEEIRTTNPVATEQYGSYSPMTQHGTQEVEE

SEQ ID NO: 86153 - protein, 31 aa, Artificial Sequence
  Description of Artificial Sequence: Synthetic polypeptide
DEQEIRTTNPVSTEPYGSVSMEDIQQQNGNH

SEQ ID NO: 86154 - protein, 30 aa, Artificial Sequence
  Description of Artificial Sequence: Synthetic polypeptide
DENEIACTNPVATEQYGSVSEDLEDHEGGL

SEQ ID NO: 86155 - protein, 32 aa, Artificial Sequence
  Description of Artificial Sequence: Synthetic polypeptide
DEQEISTTNPVATEQYGSVSATDLEDHEGEDL

SEQ ID NO: 86156 - protein, 32 aa, Artificial Sequence
  Description of Artificial Sequence: Synthetic polypeptide
DEQEISTTNPVATEQYGSVSATDLEDHEGEKL

SEQ ID NO: 86157 - protein, 32 aa, Artificial Sequence
  Description of Artificial Sequence: Synthetic polypeptide
DEQEISTTNPVATEQYGSVSATFLEDHEGEDL

SEQ ID NO: 86158 - protein, 31 aa, Artificial Sequence
  Description of Artificial Sequence: Synthetic polypeptide
DEQEISTTNPVATEQYGTVSDLELMTERDNG

SEQ ID NO: 86159 - protein, 33 aa, Artificial Sequence
  Description of Artificial Sequence: Synthetic polypeptide
DEAEICTTNPVATECYGSVSTGNLGNVDGQNEN

SEQ ID NO: 86160 - protein, 31 aa, Artificial Sequence
  Description of Artificial Sequence: Synthetic polypeptide
DEQEIRTTNPVSTEPYGSVSMDLEQHEGEDH

SEQ ID NO: 86161 - protein, 32 aa, Artificial Sequence
  Description of Artificial Sequence: Synthetic polypeptide
DEQEIRTTNPVATEVYGSVSATDLEDHEGEDL

SEQ ID NO: 86162 - protein, 34 aa, Artificial Sequence
  Description of Artificial Sequence: Synthetic polypeptide
DEAEICTTNPVATECYGSVSTGNLGQDQGQNKEN

SEQ ID NO: 86163 - protein, 34 aa, Artificial Sequence
  Description of Artificial Sequence: Synthetic polypeptide
DEAEICTTNPVATECYGSVSTGNLGQLDGQNGEN

SEQ ID NO: 86164 - protein, 32 aa, Artificial Sequence
  Description of Artificial Sequence: Synthetic polypeptide
DEQEIRTTNPVATEQYGSVYVPDLDERPNEEM

SEQ ID NO: 86165 - protein, 32 aa, Artificial Sequence
  Description of Artificial Sequence: Synthetic polypeptide
DEQEIRTTNPVATEQYGTISATDLQEDHEGEL

SEQ ID NO: 86166 - protein, 32 aa, Artificial Sequence
  Description of Artificial Sequence: Synthetic polypeptide
DEQEIRTTNPVATEQYGTISTEDLQEDQNGEL

SEQ ID NO: 86167 - protein, 31 aa, Artificial Sequence
  Description of Artificial Sequence: Synthetic polypeptide
DENEIACTNPVATEQYGTASENLQQQQNGNH

SEQ ID NO: 86168 - protein, 31 aa, Artificial Sequence
  Description of Artificial Sequence: Synthetic polypeptide
DENEIACTNPVATEQYGTASEENLQQQNGGR

SEQ ID NO: 86169 - protein, 32 aa, Artificial Sequence
  Description of Artificial Sequence: Synthetic polypeptide
DEAEISTVNPVATEQYGCVCSTNLFEYFGGNQ

SEQ ID NO: 86170 - protein, 33 aa, Artificial Sequence
  Description of Artificial Sequence: Synthetic polypeptide
DEQEIRTTNPVATEQYGTVSAMEDLQQDQNGNH

SEQ ID NO: 86171 - protein, 31 aa, Artificial Sequence
  Description of Artificial Sequence: Synthetic polypeptide
DENEIACTNPVATEQYGTASATDNPVQRGGD

SEQ ID NO: 86172 - protein, 34 aa, Artificial Sequence
  Description of Artificial Sequence: Synthetic polypeptide
DEAEICTTNPVATECYGSVSTGNLNQGDTGGNEV

SEQ ID NO: 86173 - protein, 34 aa, Artificial Sequence
  Description of Artificial Sequence: Synthetic polypeptide
DEAEICTTNPVATECYGSVSTGNLNQGDTGGNDA

SEQ ID NO: 86174 - protein, 34 aa, Artificial Sequence
  Description of Artificial Sequence: Synthetic polypeptide
DEAEICTTNPVATECYGSVSTGNLNQDEGQNQEN

SEQ ID NO: 86175 - protein, 33 aa, Artificial Sequence
  Description of Artificial Sequence: Synthetic polypeptide
DEAEICTTNPVATECYGSVSTGNLNGNDGMDTR

SEQ ID NO: 86176 - protein, 31 aa, Artificial Sequence
  Description of Artificial Sequence: Synthetic polypeptide
CEEEIACTNPVATEQYGSVATNLQAEAPEED

SEQ ID NO: 86177 - protein, 34 aa, Artificial Sequence
  Description of Artificial Sequence: Synthetic polypeptide
DEAEICTTNPVATECYGSVSTGNLLQGDTGGNEK

SEQ ID NO: 86178 - protein, 32 aa, Artificial Sequence
  Description of Artificial Sequence: Synthetic polypeptide
DEAEISTVNPVATEQYGCVSTNLNFHFGSNNQ

SEQ ID NO: 86179 - protein, 33 aa, Artificial Sequence
  Description of Artificial Sequence: Synthetic polypeptide
CEEEIACTNPVATEQYGSVATNLPTREGPNENL

SEQ ID NO: 86180 - protein, 34 aa, Artificial Sequence
  Description of Artificial Sequence: Synthetic polypeptide
CENEIRTTNPVATEQYGSVFSTTNNLNMRSWNTT

SEQ ID NO: 86181 - protein, 32 aa, Artificial Sequence
  Description of Artificial Sequence: Synthetic polypeptide
DENEIACTNPVATEQYGTVCSATDNPVQRGGD

SEQ ID NO: 86182 - protein, 32 aa, Artificial Sequence
  Description of Artificial Sequence: Synthetic polypeptide
DEQEIRTTNPVATEQYGSVSTTAGEDHEGEPL

SEQ ID NO: 86183 - protein, 33 aa, Artificial Sequence
  Description of Artificial Sequence: Synthetic polypeptide
CEEEIACTNPVATEQYGSVCATNLQPIDGNLQL

SEQ ID NO: 86184 - protein, 29 aa, Artificial Sequence
  Description of Artificial Sequence: Synthetic peptide
CEEEIACTNPVATESYGCIATNNEQRDNF

SEQ ID NO: 86185 - protein, 33 aa, Artificial Sequence
  Description of Artificial Sequence: Synthetic polypeptide
DEQEIRTTNPVATEQYGSVSATEDLEDHNGEDL

SEQ ID NO: 86186 - protein, 34 aa, Artificial Sequence
  Description of Artificial Sequence: Synthetic polypeptide
DEQEIRTTNPVATEQYGSVSATEDLQEDHNGEDL

SEQ ID NO: 86187 - protein, 33 aa, Artificial Sequence
  Description of Artificial Sequence: Synthetic polypeptide
DEQEIRTTNPVATEQYGSVSATFDLEDHEGEDL

SEQ ID NO: 86188 - protein, 33 aa, Artificial Sequence
  Description of Artificial Sequence: Synthetic polypeptide
DENEIATTNPVATECWGSVSCINLPQDREGENG

SEQ ID NO: 86189 - protein, 32 aa, Artificial Sequence
  Description of Artificial Sequence: Synthetic polypeptide
DEQEIRTTNPVATEQYGSVSATIEEDAEGDDL

SEQ ID NO: 86190 - protein, 33 aa, Artificial Sequence
  Description of Artificial Sequence: Synthetic polypeptide
DEQEIRTTNPVATEQYGSVSATLNDNQELEPQI

SEQ ID NO: 86191 - protein, 33 aa, Artificial Sequence
  Description of Artificial Sequence: Synthetic polypeptide
DEQEIRTTNPVATEQYGSVSATPDLNDHNGEDV

SEQ ID NO: 86192 - protein, 33 aa, Artificial Sequence
  Description of Artificial Sequence: Synthetic polypeptide
DEQEIRTTNPVATEQYGSVSATEDLEDHEGEDL

SEQ ID NO: 86193 - protein, 31 aa, Artificial Sequence
  Description of Artificial Sequence: Synthetic polypeptide
DENEIATTNPVATECWGSVSCINEQDRGEEG

SEQ ID NO: 86194 - protein, 34 aa, Artificial Sequence
  Description of Artificial Sequence: Synthetic polypeptide
DEAEICTTNPVATECYGSVSTGNQLQGDTGGNTH

SEQ ID NO: 86195 - protein, 32 aa, Artificial Sequence
  Description of Artificial Sequence: Synthetic polypeptide
DEQEIRTTNPVATEQYGSVSAYDLEDHEGEDL

SEQ ID NO: 86196 - protein, 35 aa, Artificial Sequence
  Description of Artificial Sequence: Synthetic polypeptide
DEAEICTTNPVATECYGSVSTGNQLQGDTGGNKER

SEQ ID NO: 86197 - protein, 33 aa, Artificial Sequence
  Description of Artificial Sequence: Synthetic polypeptide
DEQEIRTTNPVATEQYGSVSCIDLEDHEGENDL

SEQ ID NO: 86198 - protein, 29 aa, Artificial Sequence
  Description of Artificial Sequence: Synthetic peptide
CEEEIASVNPVCTEQYGVVSWNLQSGQQG

SEQ ID NO: 86199 - protein, 35 aa, Artificial Sequence
  Description of Artificial Sequence: Synthetic polypeptide
DEQEIRTTNPVATEQYGSVSDTWNLNQIEHEEDGN

SEQ ID NO: 86200 - protein, 35 aa, Artificial Sequence
  Description of Artificial Sequence: Synthetic polypeptide
DEQEIRTTNPVATEQYGSVSDTWNLNQPEQFEDRN

SEQ ID NO: 86201 - protein, 34 aa, Artificial Sequence
  Description of Artificial Sequence: Synthetic polypeptide
DEAEICTTNPVATECYGSVSTGNQMQGDRGGNTS

SEQ ID NO: 86202 - protein, 33 aa, Artificial Sequence
  Description of Artificial Sequence: Synthetic polypeptide
DEQEIRTTNPVATEQYGSVSATEDLADHEGEDL

SEQ ID NO: 86203 - protein, 28 aa, Artificial Sequence
  Description of Artificial Sequence: Synthetic peptide
CEEEIASVNPVCTEQYGVVSWPLQSGEQ

SEQ ID NO: 86204 - protein, 31 aa, Artificial Sequence
  Description of Artificial Sequence: Synthetic polypeptide
DENEIATTNPVATECWGSVSEINLQDREEEL

SEQ ID NO: 86205 - protein, 31 aa, Artificial Sequence
  Description of Artificial Sequence: Synthetic polypeptide
DEQEIRTTNPVATEQYGSVSALDTIEGSEEH

SEQ ID NO: 86206 - protein, 29 aa, Artificial Sequence
  Description of Artificial Sequence: Synthetic peptide
DENEIATTNPVATECYGDVSECLQHAEEA

SEQ ID NO: 86207 - protein, 29 aa, Artificial Sequence
  Description of Artificial Sequence: Synthetic peptide
DENEIATTNPVATECYGDVSECLQHAEDL

SEQ ID NO: 86208 - protein, 32 aa, Artificial Sequence
  Description of Artificial Sequence: Synthetic polypeptide
DEQEIRTTNPVATEQYGSVSATDGEDHEGEDV

SEQ ID NO: 86209 - protein, 29 aa, Artificial Sequence
  Description of Artificial Sequence: Synthetic peptide
DENEIATTNPVATECYGDVSECLPQHEEG

SEQ ID NO: 86210 - protein, 28 aa, Artificial Sequence
  Description of Artificial Sequence: Synthetic peptide
DENEIATTNPVATECYGDVSECLMAEEL

SEQ ID NO: 86211 - protein, 33 aa, Artificial Sequence
  Description of Artificial Sequence: Synthetic polypeptide
DEQEIRTTNPVATEQYGSVSATDGPEDRNGEPV

SEQ ID NO: 86212 - protein, 28 aa, Artificial Sequence
  Description of Artificial Sequence: Synthetic peptide
DENEIATTNPVATECYGDVSECLEHEEL

SEQ ID NO: 86213 - protein, 31 aa, Artificial Sequence
  Description of Artificial Sequence: Synthetic polypeptide
DENEIATTNPVATECYGDVSCICLQDREGEL

SEQ ID NO: 86214 - protein, 29 aa, Artificial Sequence
  Description of Artificial Sequence: Synthetic peptide
DENEIATTNPVATECYGDVSCCLPQHEEG

SEQ ID NO: 86215 - protein, 32 aa, Artificial Sequence
  Description of Artificial Sequence: Synthetic polypeptide
DEQEIRTTNPVATEQYGSVSATDLEDHEEEDA

SEQ ID NO: 86216 - protein, 33 aa, Artificial Sequence
  Description of Artificial Sequence: Synthetic polypeptide
DEAEICTTNPVATECYGSVSTVGGGQNRGGNQV

SEQ ID NO: 86217 - protein, 28 aa, Artificial Sequence
  Description of Artificial Sequence: Synthetic peptide
CEEEIASVNPVGTEQYGVVSDHLQSMNS

SEQ ID NO: 86218 - protein, 33 aa, Artificial Sequence
  Description of Artificial Sequence: Synthetic polypeptide
DEAEICTTNPVATECYGSVSTPNGLQDDDGKEN

SEQ ID NO: 86219 - protein, 33 aa, Artificial Sequence
  Description of Artificial Sequence: Synthetic polypeptide
DEAEICTTNPVATECYGSVSTNDQGDRQMNGEN

SEQ ID NO: 86220 - protein, 32 aa, Artificial Sequence
  Description of Artificial Sequence: Synthetic polypeptide
DEQEIRTTNPVATEQYGSVSATDLMDHEEEDA

SEQ ID NO: 86221 - protein, 29 aa, Artificial Sequence
  Description of Artificial Sequence: Synthetic peptide
DENEIATTNPVATECYGDVAECLQRVEEL

SEQ ID NO: 86222 - protein, 30 aa, Artificial Sequence
  Description of Artificial Sequence: Synthetic polypeptide
CEEEIASVNPVCTEQYGVVSWNLQSGGNQS

SEQ ID NO: 86223 - protein, 29 aa, Artificial Sequence
  Description of Artificial Sequence: Synthetic peptide
CEEEIASVNPVCTEQYGVVSWNHQSGSNQ

SEQ ID NO: 86224 - protein, 30 aa, Artificial Sequence
  Description of Artificial Sequence: Synthetic polypeptide
CEEEIASVNPVCTEQYGVVSWGNLQSFGNQ

SEQ ID NO: 86225 - protein, 34 aa, Artificial Sequence
  Description of Artificial Sequence: Synthetic polypeptide
DEQEIRTTNPVATEQYGSVSESPEQDRIGGNGQE

SEQ ID NO: 86226 - protein, 29 aa, Artificial Sequence
  Description of Artificial Sequence: Synthetic peptide
DENEIATTNPCATEQWGIVSENLQNAEDA

SEQ ID NO: 86227 - protein, 31 aa, Artificial Sequence
  Description of Artificial Sequence: Synthetic polypeptide
DEAEISTTNPVAYEQYGKISTNELQFVGSYP

SEQ ID NO: 86228 - protein, 29 aa, Artificial Sequence
  Description of Artificial Sequence: Synthetic peptide
DENEIATTNPCATEQWGIVSCNLQNAEDA

SEQ ID NO: 86229 - protein, 29 aa, Artificial Sequence
  Description of Artificial Sequence: Synthetic peptide
CEEEIASVNPVCTEQYGCVSWELQSGSNQ

SEQ ID NO: 86230 - protein, 29 aa, Artificial Sequence
  Description of Artificial Sequence: Synthetic peptide
DENEIASVNPVSTEPYGVVSDENLQSGNH

SEQ ID NO: 86231 - protein, 29 aa, Artificial Sequence
  Description of Artificial Sequence: Synthetic peptide
DENEIASVNPVCTEQYGVVSMNIQQQGNH

SEQ ID NO: 86232 - protein, 28 aa, Artificial Sequence
  Description of Artificial Sequence: Synthetic peptide
CEEEIASVNPVCTEPYGVVSDNLQSTNQ

SEQ ID NO: 86233 - protein, 34 aa, Artificial Sequence
  Description of Artificial Sequence: Synthetic polypeptide
DEQEIRTTNPVATEQYGSVSSTTAGPEDREGNPL

SEQ ID NO: 86234 - protein, 34 aa, Artificial Sequence
  Description of Artificial Sequence: Synthetic polypeptide
DEQEIRTTNPVATEQYGSVSSTTAGPNMHEGNDV

SEQ ID NO: 86235 - protein, 33 aa, Artificial Sequence
  Description of Artificial Sequence: Synthetic polypeptide
DEEEIRTTNPVATEQYGSVSTNMPMEHALFDEE

SEQ ID NO: 86236 - protein, 35 aa, Artificial Sequence
  Description of Artificial Sequence: Synthetic polypeptide
DEEEIRTTNPVATEQYGSYASTENELQPDEVEFNA

SEQ ID NO: 86237 - protein, 32 aa, Artificial Sequence
  Description of Artificial Sequence: Synthetic polypeptide
DEAEICTTNPVATECYGSVSTGNMNDAGNTEN

SEQ ID NO: 86238 - protein, 30 aa, Artificial Sequence
  Description of Artificial Sequence: Synthetic polypeptide
CEEEIACVNPVGTEQYGVVSDNLQDSGNES

SEQ ID NO: 86239 - protein, 31 aa, Artificial Sequence
  Description of Artificial Sequence: Synthetic polypeptide
CEEEIACTNPVAYEQYGSVAITNLQVTEGRE

SEQ ID NO: 86240 - protein, 29 aa, Artificial Sequence
  Description of Artificial Sequence: Synthetic peptide
DENEIASVNPVCTEQYGVVSDNIQQSGNH

SEQ ID NO: 86241 - protein, 29 aa, Artificial Sequence
  Description of Artificial Sequence: Synthetic peptide
DENEIASVNPVCTEQYGVVSDNIQQQGNH

SEQ ID NO: 86242 - protein, 33 aa, Artificial Sequence
  Description of Artificial Sequence: Synthetic polypeptide
DEQEIRTTNPVATEQYGSVSTNDTEIDLIDAMI

SEQ ID NO: 86243 - protein, 30 aa, Artificial Sequence
  Description of Artificial Sequence: Synthetic polypeptide
CEEEIASVNPVCTEQYGVVCSWNLQSGNQM

SEQ ID NO: 86244 - protein, 32 aa, Artificial Sequence
  Description of Artificial Sequence: Synthetic polypeptide
DEQEITTTNPVATEQYGSVSATDLEDHEGEDL

SEQ ID NO: 86245 - protein, 34 aa, Artificial Sequence
  Description of Artificial Sequence: Synthetic polypeptide
DEQEIRTTNPVATEQYGSVSPVTTLQQPTQVGEF

SEQ ID NO: 86246 - protein, 29 aa, Artificial Sequence
  Description of Artificial Sequence: Synthetic peptide
DENEIATTNPIATECYGATVSECLQHGEI

SEQ ID NO: 86247 - protein, 35 aa, Artificial Sequence
  Description of Artificial Sequence: Synthetic polypeptide
DEAEICTTNPVATECYGSVSTGNQLMQGDRGGNES

SEQ ID NO: 86248 - protein, 29 aa, Artificial Sequence
  Description of Artificial Sequence: Synthetic peptide
CEEEIASVNPVCTEQYGVVSWELQSGNQQ

SEQ ID NO: 86249 - protein, 31 aa, Artificial Sequence
  Description of Artificial Sequence: Synthetic polypeptide
DENEIATTNPVATECWGDVSCICLQDREGNL

SEQ ID NO: 86250 - protein, 33 aa, Artificial Sequence
  Description of Artificial Sequence: Synthetic polypeptide
DEAEISTTNPVAYEQWGSVSTNLQQGDAGQNDH

SEQ ID NO: 86251 - protein, 33 aa, Artificial Sequence
  Description of Artificial Sequence: Synthetic polypeptide
DEAEICTTNPVATECYGSVSTGNMTGDRGGNES

SEQ ID NO: 86252 - protein, 29 aa, Artificial Sequence
  Description of Artificial Sequence: Synthetic peptide
CEEEIASVNPVCTEQYGVVSDPLQSGSNQ

SEQ ID NO: 86253 - protein, 29 aa, Artificial Sequence
  Description of Artificial Sequence: Synthetic peptide
CEEEIASVNPVCTEQYGVVSDNVLASGNQ

SEQ ID NO: 86254 - protein, 33 aa, Artificial Sequence
  Description of Artificial Sequence: Synthetic polypeptide
DEAEICTTNPVATECYGSVSTGNMQGDTGGNEN

SEQ ID NO: 86255 - protein, 33 aa, Artificial Sequence
  Description of Artificial Sequence: Synthetic polypeptide
DEQEIRTTNPVATEQYGSVSINLEQEPEFTTEE

SEQ ID NO: 86256 - protein, 31 aa, Artificial Sequence
  Description of Artificial Sequence: Synthetic polypeptide
DENEIATTNPVATEAYGSVSNNALNNHGTEM

SEQ ID NO: 86257 - protein, 33 aa, Artificial Sequence
  Description of Artificial Sequence: Synthetic polypeptide
DEQEIRTTNPVATEQYGSVSMPMLSIESDQENR

SEQ ID NO: 86258 - protein, 30 aa, Artificial Sequence
  Description of Artificial Sequence: Synthetic polypeptide
CEEEIASVNPVCTEQYGVVSDNLQMSGGNQ

SEQ ID NO: 86259 - protein, 32 aa, Artificial Sequence
  Description of Artificial Sequence: Synthetic polypeptide
DEQEIRTTNPVATEQYGSVSPDDLEDIENSQI

SEQ ID NO: 86260 - protein, 29 aa, Artificial Sequence
  Description of Artificial Sequence: Synthetic peptide
CEEEIASVNPVCTEQYGVVSDNLNPSGNQ

SEQ ID NO: 86261 - protein, 33 aa, Artificial Sequence
  Description of Artificial Sequence: Synthetic polypeptide
DEQEIRTTNPVATEQYGSVSPTNAMENQGTQEI

SEQ ID NO: 86262 - protein, 28 aa, Artificial Sequence
  Description of Artificial Sequence: Synthetic peptide
DENEIATTNPIATECYGDVSECLQHEEI

SEQ ID NO: 86263 - protein, 28 aa, Artificial Sequence
  Description of Artificial Sequence: Synthetic peptide
DENEIATTNPIATECYGDVSACLQHEEL

SEQ ID NO: 86264 - protein, 31 aa, Artificial Sequence
  Description of Artificial Sequence: Synthetic polypeptide
DENEIATTNPCAYEPYGSVVATNLQNGNENP

SEQ ID NO: 86265 - protein, 31 aa, Artificial Sequence
  Description of Artificial Sequence: Synthetic polypeptide
DEAPIACTNPVAYEQYGSVATNLQEAGADRE

SEQ ID NO: 86266 - protein, 32 aa, Artificial Sequence
  Description of Artificial Sequence: Synthetic polypeptide
DEQEIVTTNPVATEQYGSVSATDGEDQEGEDG

SEQ ID NO: 86267 - protein, 33 aa, Artificial Sequence
  Description of Artificial Sequence: Synthetic polypeptide
DEQEIVTTNPVATEQYGSVSATDGLEDHEGNDL

SEQ ID NO: 86268 - protein, 34 aa, Artificial Sequence
  Description of Artificial Sequence: Synthetic polypeptide
DEAEICTTNPVATECYGCVSTGNGLQGDTGGNER

SEQ ID NO: 86269 - protein, 32 aa, Artificial Sequence
  Description of Artificial Sequence: Synthetic polypeptide
DEAVIRTTNPVATEQYGSVSPNLEFPNYSQAV

SEQ ID NO: 86270 - protein, 31 aa, Artificial Sequence
  Description of Artificial Sequence: Synthetic polypeptide
DEEEIRTTNPVATEQYGSYTPTDLENFIDFT

SEQ ID NO: 86271 - protein, 28 aa, Artificial Sequence
  Description of Artificial Sequence: Synthetic peptide
DESEIAPTNPCSTEQYGIVSCTIQSGTR

SEQ ID NO: 86272 - protein, 33 aa, Artificial Sequence
  Description of Artificial Sequence: Synthetic polypeptide
DEAVIRTTNPVATEQYGSVTSWNLEFPNYSQNR

SEQ ID NO: 86273 - protein, 32 aa, Artificial Sequence
  Description of Artificial Sequence: Synthetic polypeptide
DESEIAPTNPVATEQWGSVSCINLPQDSGENG

SEQ ID NO: 86274 - protein, 31 aa, Artificial Sequence
  Description of Artificial Sequence: Synthetic polypeptide
DESEIAPTNPVATEQWGSVSCINLPQDSGTG

SEQ ID NO: 86275 - protein, 30 aa, Artificial Sequence
  Description of Artificial Sequence: Synthetic polypeptide
DESEIAPTNPCASEQYGIVSCINLPQSGTR

SEQ ID NO: 86276 - protein, 30 aa, Artificial Sequence
  Description of Artificial Sequence: Synthetic polypeptide
DESEIAPTNPVSTEQYGIVAANTIQRVGQR

SEQ ID NO: 86277 - protein, 31 aa, Artificial Sequence
  Description of Artificial Sequence: Synthetic polypeptide
DENEIACTNPVATECYGETSNANLQERKGPR

SEQ ID NO: 86278 - protein, 29 aa, Artificial Sequence
  Description of Artificial Sequence: Synthetic peptide
DESEIASTNPVATEGYGDVSSTLQNAGDA

SEQ ID NO: 86279 - protein, 29 aa, Artificial Sequence
  Description of Artificial Sequence: Synthetic peptide
DESEIASTNPVATEGYGDVSSTLQNHGDA

SEQ ID NO: 86280 - protein, 35 aa, Artificial Sequence
  Description of Artificial Sequence: Synthetic polypeptide
DENEAEIRTTNPVAYEKWGSVSTNLNQGEHGGNAR

SEQ ID NO: 86281 - protein, 29 aa, Artificial Sequence
  Description of Artificial Sequence: Synthetic peptide
DESEIASTNPVATEGYGNVAENIMSRGQR

SEQ ID NO: 86282 - protein, 30 aa, Artificial Sequence
  Description of Artificial Sequence: Synthetic polypeptide
DESEIASTNPVATEGYGSVACTLQDRGEDG

SEQ ID NO: 86283 - protein, 35 aa, Artificial Sequence
  Description of Artificial Sequence: Synthetic polypeptide
DENEAEIRTTNPVAYEHWGSVSTNPLQGEDGNNNR

SEQ ID NO: 86284 - protein, 30 aa, Artificial Sequence
  Description of Artificial Sequence: Synthetic polypeptide
DESEIAPTNPVSTEQYGIVAANTIQRVGTR

SEQ ID NO: 86285 - protein, 32 aa, Artificial Sequence
  Description of Artificial Sequence: Synthetic polypeptide
DEAVIRTTNPVATEQYGSVSPELEFPNDSQNR

SEQ ID NO: 86286 - protein, 30 aa, Artificial Sequence
  Description of Artificial Sequence: Synthetic polypeptide
DESEIACTNPVSTEQYGNVAAETIQRVGNR

SEQ ID NO: 86287 - protein, 33 aa, Artificial Sequence
  Description of Artificial Sequence: Synthetic polypeptide
DEAVIRTTNPVATEQYGSVISTNLEFPNYSQNH

SEQ ID NO: 86288 - protein, 32 aa, Artificial Sequence
  Description of Artificial Sequence: Synthetic polypeptide
DEAVIRTTNPVATEQYGCVCETNPQENIGSNQ

SEQ ID NO: 86289 - protein, 33 aa, Artificial Sequence
  Description of Artificial Sequence: Synthetic polypeptide
DESEAIRTTNPVATECWGSVSCINEPQDRGENG

SEQ ID NO: 86290 - protein, 32 aa, Artificial Sequence
  Description of Artificial Sequence: Synthetic polypeptide
DEAVIRTTNPVATEQYGCVCETNPQYSGSNNQ

SEQ ID NO: 86291 - protein, 31 aa, Artificial Sequence
  Description of Artificial Sequence: Synthetic polypeptide
DEAVIRTTNPVATEQYGCVCETYPQYGSNQP

SEQ ID NO: 86292 - protein, 31 aa, Artificial Sequence
  Description of Artificial Sequence: Synthetic polypeptide
DENEIACTNPVATEQYGEASEENLQQQNGGR

SEQ ID NO: 86293 - protein, 31 aa, Artificial Sequence
  Description of Artificial Sequence: Synthetic polypeptide
DEAVIRTTNPVATEQYGCVENTNPQVPNNED

SEQ ID NO: 86294 - protein, 30 aa, Artificial Sequence
  Description of Artificial Sequence: Synthetic polypeptide
DEAVIRTTNPVATEQYGCVETDPQTFGSQF

SEQ ID NO: 86295 - protein, 30 aa, Artificial Sequence
  Description of Artificial Sequence: Synthetic polypeptide
DENEIACTNPVATEQYGDVSENEMNAAGGR

SEQ ID NO: 86296 - protein, 33 aa, Artificial Sequence
  Description of Artificial Sequence: Synthetic polypeptide
DEAEICTTNPVATECYGSVATGNLMQGDGDNEN

SEQ ID NO: 86297 - protein, 29 aa, Artificial Sequence
  Description of Artificial Sequence: Synthetic peptide
DENEIACTNPVATEQWGEVSENLMNREGA

SEQ ID NO: 86298 - protein, 29 aa, Artificial Sequence
  Description of Artificial Sequence: Synthetic peptide
DENEIACTNPVATEQWGEASEENWQPGGR

SEQ ID NO: 86299 - protein, 33 aa, Artificial Sequence
  Description of Artificial Sequence: Synthetic polypeptide
DEEEIRTTNPVATEQYGSYSWPLDPRNSEEERG

SEQ ID NO: 86300 - protein, 31 aa, Artificial Sequence
  Description of Artificial Sequence: Synthetic polypeptide
DEAVIRTTNPVATEQYGCVYTHPQTIGNNQG

SEQ ID NO: 86301 - protein, 29 aa, Artificial Sequence
  Description of Artificial Sequence: Synthetic peptide
DENEIACTNPVATEPYGEASMDIQQQGNR

SEQ ID NO: 86302 - protein, 29 aa, Artificial Sequence
  Description of Artificial Sequence: Synthetic peptide
DENEIACTNPVATEGYGEAAENIQSRGGR

SEQ ID NO: 86303 - protein, 30 aa, Artificial Sequence
  Description of Artificial Sequence: Synthetic polypeptide
DESEIACTNPVATEQYGNVANTIMSRVGQR

SEQ ID NO: 86304 - protein, 32 aa, Artificial Sequence
  Description of Artificial Sequence: Synthetic polypeptide
DEAVIRTTNPVATEQYGQCVCETNPQYGSNQI

SEQ ID NO: 86305 - protein, 32 aa, Artificial Sequence
  Description of Artificial Sequence: Synthetic polypeptide
DECEIATTNPCATECWGSVSTNLQGDHGNDAD

SEQ ID NO: 86306 - protein, 30 aa, Artificial Sequence
  Description of Artificial Sequence: Synthetic polypeptide
DESEIASTNPVATEGYGVMSASTLPNRGNI

SEQ ID NO: 86307 - protein, 30 aa, Artificial Sequence
  Description of Artificial Sequence: Synthetic polypeptide
DESEIASTNPVATEGYGVMSASTLPNRGNV

SEQ ID NO: 86308 - protein, 29 aa, Artificial Sequence
  Description of Artificial Sequence: Synthetic peptide
DESEIASTNPVATEGYGVMSTDLQHEGDI

SEQ ID NO: 86309 - protein, 28 aa, Artificial Sequence
  Description of Artificial Sequence: Synthetic peptide
DESEIASTNPVGTEGYGVMASTLQRGDI

SEQ ID NO: 86310 - protein, 28 aa, Artificial Sequence
  Description of Artificial Sequence: Synthetic peptide
DESEIASTNPVGTEGYGVMASTLQRGQI

SEQ ID NO: 86311 - protein, 34 aa, Artificial Sequence
  Description of Artificial Sequence: Synthetic polypeptide
DENEAEIRTTNPVAYEHWGSVSTNLNGEDGNNDR

SEQ ID NO: 86312 - protein, 29 aa, Artificial Sequence
  Description of Artificial Sequence: Synthetic peptide
DESEIASTNPVGTEGYGVMSASTLNRGNI

SEQ ID NO: 86313 - protein, 32 aa, Artificial Sequence
  Description of Artificial Sequence: Synthetic polypeptide
DECEIATTNPVATEHYGSVSGGNGNAGNGNQR

SEQ ID NO: 86314 - protein, 30 aa, Artificial Sequence
  Description of Artificial Sequence: Synthetic polypeptide
DESEIASTNPVGTEGYGVVAASTLQRVGQR

SEQ ID NO: 86315 - protein, 31 aa, Artificial Sequence
  Description of Artificial Sequence: Synthetic polypeptide
DECEIATTNPVATEIYGTVATGNSGQDAGND

SEQ ID NO: 86316 - protein, 31 aa, Artificial Sequence
  Description of Artificial Sequence: Synthetic polypeptide
DECEIATTNPVATEIYGTVATTGLGQDAGNA

SEQ ID NO: 86317 - protein, 32 aa, Artificial Sequence
  Description of Artificial Sequence: Synthetic polypeptide
DECEIATTNPVATEIYGTVATTNDLGQDGGNW

SEQ ID NO: 86318 - protein, 28 aa, Artificial Sequence
  Description of Artificial Sequence: Synthetic peptide
DESEIASTNPVGTEGYGVVASTLQHGDI

SEQ ID NO: 86319 - protein, 29 aa, Artificial Sequence
  Description of Artificial Sequence: Synthetic peptide
DESEIASTNPVGTEGYGVVASTLQMHGNI

SEQ ID NO: 86320 - protein, 34 aa, Artificial Sequence
  Description of Artificial Sequence: Synthetic polypeptide
DENEAEIRTTNPVAYEHWGSVATNLQGEDGGNAR

SEQ ID NO: 86321 - protein, 33 aa, Artificial Sequence
  Description of Artificial Sequence: Synthetic polypeptide
DENEAEIRTTNPVAYEHWGEVTTNLQGEDGNDR

SEQ ID NO: 86322 - protein, 29 aa, Artificial Sequence
  Description of Artificial Sequence: Synthetic peptide
DESEIASTNPVGTEGYGVVASTLQRVGQI

SEQ ID NO: 86323 - protein, 33 aa, Artificial Sequence
  Description of Artificial Sequence: Synthetic polypeptide
DEEEIRTTNPVATEQYGSYVEPTPLEDVIVNEP

SEQ ID NO: 86324 - protein, 32 aa, Artificial Sequence
  Description of Artificial Sequence: Synthetic polypeptide
DECEIATTNPVATENYGCVSTNPNAQGNDNQR

SEQ ID NO: 86325 - protein, 32 aa, Artificial Sequence
  Description of Artificial Sequence: Synthetic polypeptide
DECEIATTNPVATENYGSVSTGNPAGNDNDRR

SEQ ID NO: 86326 - protein, 28 aa, Artificial Sequence
  Description of Artificial Sequence: Synthetic peptide
DESEIASTNPVGTEGYGVMASTLQHGQR

SEQ ID NO: 86327 - protein, 33 aa, Artificial Sequence
  Description of Artificial Sequence: Synthetic polypeptide
DEAEICTTNPVATECYGSVSTGGLQGDTGGNEQ

SEQ ID NO: 86328 - protein, 28 aa, Artificial Sequence
  Description of Artificial Sequence: Synthetic peptide
DESEIASTNPVGTEGYGVMASTLQHGDR

SEQ ID NO: 86329 - protein, 33 aa, Artificial Sequence
  Description of Artificial Sequence: Synthetic polypeptide
DECEIATTNPVATECYGSVSTTNLPGEDANGRE

SEQ ID NO: 86330 - protein, 29 aa, Artificial Sequence
  Description of Artificial Sequence: Synthetic peptide
DESEIASTNPVATEGYGVVAATDLQHGEI

SEQ ID NO: 86331 - protein, 34 aa, Artificial Sequence
  Description of Artificial Sequence: Synthetic polypeptide
DEEEIRTTNPVATEQYGSYTSVIPLDARIENDRQ

SEQ ID NO: 86332 - protein, 34 aa, Artificial Sequence
  Description of Artificial Sequence: Synthetic polypeptide
DENEAEIRTTNPVAYEHWGSVSTNLQGEHGGDSR

SEQ ID NO: 86333 - protein, 28 aa, Artificial Sequence
  Description of Artificial Sequence: Synthetic peptide
DESEIASTNPVATEQWGDMASTLQHGDI

SEQ ID NO: 86334 - protein, 32 aa, Artificial Sequence
  Description of Artificial Sequence: Synthetic polypeptide
DESEIASTNPVATEQWGSVSDINEPQREGENG

SEQ ID NO: 86335 - protein, 34 aa, Artificial Sequence
  Description of Artificial Sequence: Synthetic polypeptide
DENEAEIRTTNPVAYEHWGSVSTNLQGEDQNNHR

SEQ ID NO: 86336 - protein, 32 aa, Artificial Sequence
  Description of Artificial Sequence: Synthetic polypeptide
DECEIATTNPCAYEQWGSVSTNLQGDHGNGND

SEQ ID NO: 86337 - protein, 34 aa, Artificial Sequence
  Description of Artificial Sequence: Synthetic polypeptide
DENEAEIRTTNPVAYEHWGSVSTNLQGEDGTNGA

SEQ ID NO: 86338 - protein, 32 aa, Artificial Sequence
  Description of Artificial Sequence: Synthetic polypeptide
DESEIASTNPVATEQYGSMSTPTLPQMRNGDV

SEQ ID NO: 86339 - protein, 34 aa, Artificial Sequence
  Description of Artificial Sequence: Synthetic polypeptide
DENEAEIRTTNPVAYEHWGSVSTNLQGEDGNNAD

SEQ ID NO: 86340 - protein, 32 aa, Artificial Sequence
  Description of Artificial Sequence: Synthetic polypeptide
DECEIATTNPMATEQWGSVAPTDNDQHTGNGR

SEQ ID NO: 86341 - protein, 29 aa, Artificial Sequence
  Description of Artificial Sequence: Synthetic peptide
DESEIASTNPVATEQYGVMSTTLEHEGDI

SEQ ID NO: 86342 - protein, 35 aa, Artificial Sequence
  Description of Artificial Sequence: Synthetic polypeptide
DENEAEIRTTNPVAYEHWGSVSTNLNQGEHGDNSR

SEQ ID NO: 86343 - protein, 30 aa, Artificial Sequence
  Description of Artificial Sequence: Synthetic polypeptide
DESEIASTNPVCTECYGSVSDNEPQDSGNG

SEQ ID NO: 86344 - protein, 28 aa, Artificial Sequence
  Description of Artificial Sequence: Synthetic peptide
DESEIASTNPVGTECYGVVASTLQHGDI

SEQ ID NO: 86345 - protein, 28 aa, Artificial Sequence
  Description of Artificial Sequence: Synthetic peptide
DESEIASTNPVGTEGYGDVSSTLQHGDA

SEQ ID NO: 86346 - protein, 31 aa, Artificial Sequence
  Description of Artificial Sequence: Synthetic polypeptide
DECEIATTNPVATECYGSVATGPNAGNDNQR

SEQ ID NO: 86347 - protein, 28 aa, Artificial Sequence
  Description of Artificial Sequence: Synthetic peptide
DESEIASTNPVGTEGYGVMASNLQRGDI

SEQ ID NO: 86348 - protein, 30 aa, Artificial Sequence
  Description of Artificial Sequence: Synthetic polypeptide
CEEEIASVNPVGTEQYGVVSDNLQSGNDQM

SEQ ID NO: 86349 - protein, 32 aa, Artificial Sequence
  Description of Artificial Sequence: Synthetic polypeptide
DESCIRTTNPVATEQYGCVCSTEHQNFGSNQS

SEQ ID NO: 86350 - protein, 34 aa, Artificial Sequence
  Description of Artificial Sequence: Synthetic polypeptide
DEEEIRTTNPVATEQYGSYSTSLLEEDNESVVRY

SEQ ID NO: 86351 - protein, 32 aa, Artificial Sequence
  Description of Artificial Sequence: Synthetic polypeptide
DEATEIATTNPVAYEQWGSVATNLQSGGENEP

SEQ ID NO: 86352 - protein, 32 aa, Artificial Sequence
  Description of Artificial Sequence: Synthetic polypeptide
DEATEISTTNPVAYEQWGVVSTNLQGDAGNDA

SEQ ID NO: 86353 - protein, 32 aa, Artificial Sequence
  Description of Artificial Sequence: Synthetic polypeptide
DEQIIATTNPVATEQYGSVSATNLEDHEGEDL

SEQ ID NO: 86354 - protein, 32 aa, Artificial Sequence
  Description of Artificial Sequence: Synthetic polypeptide
DEAVEATTNPVATEQWGAVSTNLQHNDGNNER

SEQ ID NO: 86355 - protein, 34 aa, Artificial Sequence
  Description of Artificial Sequence: Synthetic polypeptide
DEAEICTTNPVATECYGSVSTGNGLQQDDGNNEN

SEQ ID NO: 86356 - protein, 31 aa, Artificial Sequence
  Description of Artificial Sequence: Synthetic polypeptide
DEQPIATTNPVATEQYGSVSTDLEDHEGEDL

SEQ ID NO: 86357 - protein, 32 aa, Artificial Sequence
  Description of Artificial Sequence: Synthetic polypeptide
DEQRIATTNPVATEQYGSVSATDLEDHEGENL

SEQ ID NO: 86358 - protein, 32 aa, Artificial Sequence
  Description of Artificial Sequence: Synthetic polypeptide
DEQEVATTNPVATEQYGSVSATDLEDHVGEDR

SEQ ID NO: 86359 - protein, 33 aa, Artificial Sequence
  Description of Artificial Sequence: Synthetic polypeptide
DENEIACTNPVATEQYGEVSSTEPNGPQMRGNV

SEQ ID NO: 86360 - protein, 31 aa, Artificial Sequence
  Description of Artificial Sequence: Synthetic polypeptide
DEAVEIACTNPVAYEQYGSVATNLQGVGEDD

SEQ ID NO: 86361 - protein, 34 aa, Artificial Sequence
  Description of Artificial Sequence: Synthetic polypeptide
DEAEICTTNPVATECYGSVSTGNGLLQDVGQNDA

SEQ ID NO: 86362 - protein, 31 aa, Artificial Sequence
  Description of Artificial Sequence: Synthetic polypeptide
DEQTIRGTNPVATEAYGSVSINNGQGGEGNE

SEQ ID NO: 86363 - protein, 29 aa, Artificial Sequence
  Description of Artificial Sequence: Synthetic peptide
DENEIACTNPVATEQYGEISMEDIQRGGH

SEQ ID NO: 86364 - protein, 31 aa, Artificial Sequence
  Description of Artificial Sequence: Synthetic polypeptide
DEQTIRGTNPVATEQYGSVSINNGQGGGDEG

SEQ ID NO: 86365 - protein, 32 aa, Artificial Sequence
  Description of Artificial Sequence: Synthetic polypeptide
DEQVEIATTNPVAYEQWGTVSTNLQGDAGNDA

SEQ ID NO: 86366 - protein, 30 aa, Artificial Sequence
  Description of Artificial Sequence: Synthetic polypeptide
DENEIACTNPVATEQYGEASTNLEHEGGDL

SEQ ID NO: 86367 - protein, 31 aa, Artificial Sequence
  Description of Artificial Sequence: Synthetic polypeptide
CEQEIATTNPVATEQYGSVSTDLEDHEGEDL

SEQ ID NO: 86368 - protein, 32 aa, Artificial Sequence
  Description of Artificial Sequence: Synthetic polypeptide
CEPEIATTNPVAYECYGSVATCQNFQRGNPRM

SEQ ID NO: 86369 - protein, 30 aa, Artificial Sequence
  Description of Artificial Sequence: Synthetic polypeptide
DENEIACTNPVATEQYGSASAEDLQHGEDL

SEQ ID NO: 86370 - protein, 30 aa, Artificial Sequence
  Description of Artificial Sequence: Synthetic polypeptide
DENEIACTNPVATEQYGSASATDLEHGEDL

SEQ ID NO: 86371 - protein, 33 aa, Artificial Sequence
  Description of Artificial Sequence: Synthetic polypeptide
DEAEICTTNPVATECYGSVSTGNLGGDTGGNEP

SEQ ID NO: 86372 - protein, 32 aa, Artificial Sequence
  Description of Artificial Sequence: Synthetic polypeptide
DEQEIVTTNPVATEQYGSVSATDGPEDHEGND

SEQ ID NO: 86373 - protein, 32 aa, Artificial Sequence
  Description of Artificial Sequence: Synthetic polypeptide
DEQEIVTTNPVATEQYGSVSATDLEDFEGEDL

SEQ ID NO: 86374 - protein, 32 aa, Artificial Sequence
  Description of Artificial Sequence: Synthetic polypeptide
DEQEIVTTNPVATEQYGSVSATDLEDHEGEDL

SEQ ID NO: 86375 - protein, 30 aa, Artificial Sequence
  Description of Artificial Sequence: Synthetic polypeptide
DEASIATTNPTAYEQWGSVSFNPDQSGNRR

SEQ ID NO: 86376 - protein, 32 aa, Artificial Sequence
  Description of Artificial Sequence: Synthetic polypeptide
DEQEIVTTNPVATEQYGTVSATDLEDHEGNDD

SEQ ID NO: 86377 - protein, 32 aa, Artificial Sequence
  Description of Artificial Sequence: Synthetic polypeptide
DEQEIWTTNPVATEQYGSVSATDLEDHEGEDL

SEQ ID NO: 86378 - protein, 32 aa, Artificial Sequence
  Description of Artificial Sequence: Synthetic polypeptide
DEQEIWTTNPVATEQYGSVSATDLEDHIGEDL

SEQ ID NO: 86379 - protein, 32 aa, Artificial Sequence
  Description of Artificial Sequence: Synthetic polypeptide
DEQEIYTTNPVATEQYGSVSATDLEDHEGEDL

SEQ ID NO: 86380 - protein, 32 aa, Artificial Sequence
  Description of Artificial Sequence: Synthetic polypeptide
DEQEIYTTNPVATEQYGSVSATDLEDWEGEDL

SEQ ID NO: 86381 - protein, 32 aa, Artificial Sequence
  Description of Artificial Sequence: Synthetic polypeptide
DEQEIYTTNPVATEQYGSVSATDLHDHEGEDL

SEQ ID NO: 86382 - protein, 31 aa, Artificial Sequence
  Description of Artificial Sequence: Synthetic polypeptide
DENEIACTNPVATEQYGSASTDLEDHEGGDR

SEQ ID NO: 86383 - protein, 31 aa, Artificial Sequence
  Description of Artificial Sequence: Synthetic polypeptide
DENEIACTNPVATEQYGSASTDLEDHEGEDR

SEQ ID NO: 86384 - protein, 34 aa, Artificial Sequence
  Description of Artificial Sequence: Synthetic polypeptide
DEAEICTTNPVATECYGSVSTGNGVQGDRGGNES

SEQ ID NO: 86385 - protein, 31 aa, Artificial Sequence
  Description of Artificial Sequence: Synthetic polypeptide
DEQEVASTNPVATEGYGSVSATDLEDRVGER

SEQ ID NO: 86386 - protein, 32 aa, Artificial Sequence
  Description of Artificial Sequence: Synthetic polypeptide
DEATDEIATTNPVAYERWGSVSTNLQSGGDNH

SEQ ID NO: 86387 - protein, 31 aa, Artificial Sequence
  Description of Artificial Sequence: Synthetic polypeptide
DEQEVATTNPVATEQYGNVSATDIQDHVGQR

SEQ ID NO: 86388 - protein, 29 aa, Artificial Sequence
  Description of Artificial Sequence: Synthetic peptide
DERCIETVNPVATEYYGSVSDPNMERVTR

SEQ ID NO: 86389 - protein, 32 aa, Artificial Sequence
  Description of Artificial Sequence: Synthetic polypeptide
DEREIATTNPVATCQYGCVCSTALQYFGSNQF

SEQ ID NO: 86390 - protein, 32 aa, Artificial Sequence
  Description of Artificial Sequence: Synthetic polypeptide
DEREIATTNPVATEQYGSVSATDLEDHEGEDL

SEQ ID NO: 86391 - protein, 32 aa, Artificial Sequence
  Description of Artificial Sequence: Synthetic polypeptide
DEREIATTNPVATEQYGSVSATDLEDHEGEDT

SEQ ID NO: 86392 - protein, 32 aa, Artificial Sequence
  Description of Artificial Sequence: Synthetic polypeptide
DEAVIRTTNPVATEQYGCVACTNAPSQSGGNK

SEQ ID NO: 86393 - protein, 37 aa, Artificial Sequence
  Description of Artificial Sequence: Synthetic polypeptide
DEEEIRTTNPVATEQYGSVSTNLQSGTNNQEQEEETA

SEQ ID NO: 86394 - protein, 37 aa, Artificial Sequence
  Description of Artificial Sequence: Synthetic polypeptide
DEEEIRTTNPVATEQYGSVSTNLQSGTNNQEQDEEED

SEQ ID NO: 86395 - protein, 32 aa, Artificial Sequence
  Description of Artificial Sequence: Synthetic polypeptide
DEAEICTTNPVATECYGSVSTGLGLQDDGKEN

SEQ ID NO: 86396 - protein, 32 aa, Artificial Sequence
  Description of Artificial Sequence: Synthetic polypeptide
DEAVIRTTNPVATEQYGCVCENTGNPQYGSNQ

SEQ ID NO: 86397 - protein, 37 aa, Artificial Sequence
  Description of Artificial Sequence: Synthetic polypeptide
DEEEIRTTNPVATEQYGSVSTNLQSGNNNTEQGEETE

SEQ ID NO: 86398 - protein, 37 aa, Artificial Sequence
  Description of Artificial Sequence: Synthetic polypeptide
DEEEIRTTNPVATEQYGSVSTNLQSGNNNQETAEEQD

SEQ ID NO: 86399 - protein, 37 aa, Artificial Sequence
  Description of Artificial Sequence: Synthetic polypeptide
DEEEIRTTNPVATEQYGSVSTNLQSGNNNQEQNEETQ

SEQ ID NO: 86400 - protein, 32 aa, Artificial Sequence
  Description of Artificial Sequence: Synthetic polypeptide
DEAEICTTNPVATECYGSVSTGGNTGADGGTR

SEQ ID NO: 86401 - protein, 37 aa, Artificial Sequence
  Description of Artificial Sequence: Synthetic polypeptide
DEEEIRTTNPVATEQYGSVSTNLQSGNNNQEQEEEDE

SEQ ID NO: 86402 - protein, 37 aa, Artificial Sequence
  Description of Artificial Sequence: Synthetic polypeptide
DEEEIRTTNPVATEQYGSVSTNLQSGNNNQEQEDEQD

SEQ ID NO: 86403 - protein, 37 aa, Artificial Sequence
  Description of Artificial Sequence: Synthetic polypeptide
DEEEIRTTNPVATEQYGSVSTNLQSGNNNNQQGEETQ

SEQ ID NO: 86404 - protein, 37 aa, Artificial Sequence
  Description of Artificial Sequence: Synthetic polypeptide
DEEEIRTTNPVATEQYGSVSTNLQSGNNNLEQGTEEE

SEQ ID NO: 86405 - protein, 37 aa, Artificial Sequence
  Description of Artificial Sequence: Synthetic polypeptide
DEEEIRTTNPVATEQYGSVSTNLQSGNNNGNQEEEQD

SEQ ID NO: 86406 - protein, 37 aa, Artificial Sequence
  Description of Artificial Sequence: Synthetic polypeptide
DEEEIRTTNPVATEQYGSVSTNLQSGNNNDEQEEETD

SEQ ID NO: 86407 - protein, 31 aa, Artificial Sequence
  Description of Artificial Sequence: Synthetic polypeptide
DENEIACTNPVATEQYGEASEENLQQRNGGH

SEQ ID NO: 86408 - protein, 32 aa, Artificial Sequence
  Description of Artificial Sequence: Synthetic polypeptide
DESCIRTTNPVATEIYGQVTTDLQRFGSGQRE

SEQ ID NO: 86409 - protein, 32 aa, Artificial Sequence
  Description of Artificial Sequence: Synthetic polypeptide
DESAIRTTNPCGTEQYGSVQSAWNHGQRMNRV

SEQ ID NO: 86410 - protein, 32 aa, Artificial Sequence
  Description of Artificial Sequence: Synthetic polypeptide
DESCIRTTNPVATEQWGSVATNNLQLYDVNNE

SEQ ID NO: 86411 - protein, 30 aa, Artificial Sequence
  Description of Artificial Sequence: Synthetic polypeptide
DENEIACTNPVATEQYGEASENLQQQNGGH

SEQ ID NO: 86412 - protein, 31 aa, Artificial Sequence
  Description of Artificial Sequence: Synthetic polypeptide
DEREIVTTNPIATEGYGYISTMNDPARGSNR

SEQ ID NO: 86413 - protein, 34 aa, Artificial Sequence
  Description of Artificial Sequence: Synthetic polypeptide
DEAEICTTNPVATECYGSVSTGNGLLQDDGNNEN

SEQ ID NO: 86414 - protein, 32 aa, Artificial Sequence
  Description of Artificial Sequence: Synthetic polypeptide
DEREICTVNPVATEQYGCVCSTNLFNFGSNNQ

SEQ ID NO: 86415 - protein, 33 aa, Artificial Sequence
  Description of Artificial Sequence: Synthetic polypeptide
DEREICTVNPVATEQYGSVSTNLEFWQTGVGEF

SEQ ID NO: 86416 - protein, 33 aa, Artificial Sequence
  Description of Artificial Sequence: Synthetic polypeptide
DEAEICTTNPVATECYGSVSTGNGLLQDAQNEN

SEQ ID NO: 86417 - protein, 31 aa, Artificial Sequence
  Description of Artificial Sequence: Synthetic polypeptide
DEREIMSTNPVATEQYGEIVSTGNMNQHQER

SEQ ID NO: 86418 - protein, 35 aa, Artificial Sequence
  Description of Artificial Sequence: Synthetic polypeptide
DEREIRTTNPVATEAYGSVSCINMLSHRTSGNNRD

SEQ ID NO: 86419 - protein, 33 aa, Artificial Sequence
  Description of Artificial Sequence: Synthetic polypeptide
DEREIRTTNPVATECWGSVSCINEPQAREGFNG

SEQ ID NO: 86420 - protein, 33 aa, Artificial Sequence
  Description of Artificial Sequence: Synthetic polypeptide
DEREIRTTNPVATECWGSVSCINEPQDREGENG

SEQ ID NO: 86421 - protein, 34 aa, Artificial Sequence
  Description of Artificial Sequence: Synthetic polypeptide
DEREIRTTNPVATEQWGSIVSNIDNDLQIGPNIF

SEQ ID NO: 86422 - protein, 34 aa, Artificial Sequence
  Description of Artificial Sequence: Synthetic polypeptide
DEREIRTTNPVATEQYGSVQSTTNDQNGSDEDTI

SEQ ID NO: 86423 - protein, 33 aa, Artificial Sequence
  Description of Artificial Sequence: Synthetic polypeptide
DEREIRTTNPVATEQYGSVSNYIPQGRIMANAE

SEQ ID NO: 86424 - protein, 31 aa, Artificial Sequence
  Description of Artificial Sequence: Synthetic polypeptide
DENEIACTNPVATEQYGEASEPNGPQRGGPR

SEQ ID NO: 86425 - protein, 30 aa, Artificial Sequence
  Description of Artificial Sequence: Synthetic polypeptide
DEAVIGTTNPVATEQWGCVSTDPHQYGSNQ

SEQ ID NO: 86426 - protein, 34 aa, Artificial Sequence
  Description of Artificial Sequence: Synthetic polypeptide
DEAEICTTNPVATECYGSVSTGNGLGQDDGNTET

SEQ ID NO: 86427 - protein, 30 aa, Artificial Sequence
  Description of Artificial Sequence: Synthetic polypeptide
CESECIACTNPVAYEQYGQVSTGNVQRDNN

SEQ ID NO: 86428 - protein, 33 aa, Artificial Sequence
  Description of Artificial Sequence: Synthetic polypeptide
DEAEICTTNPVATECYGSVSTGNGLGDDGNTEN

SEQ ID NO: 86429 - protein, 30 aa, Artificial Sequence
  Description of Artificial Sequence: Synthetic polypeptide
DEAVIGTTNPVATEQYGCVETEPQTRGTDE

SEQ ID NO: 86430 - protein, 33 aa, Artificial Sequence
  Description of Artificial Sequence: Synthetic polypeptide
DEREIYTVNPVATEQYGSVSTNLEFWQTGVVEE

SEQ ID NO: 86431 - protein, 33 aa, Artificial Sequence
  Description of Artificial Sequence: Synthetic polypeptide
DENEIRTTNPVATECWGSVSPINEPQSREGENG

SEQ ID NO: 86432 - protein, 32 aa, Artificial Sequence
  Description of Artificial Sequence: Synthetic polypeptide
DEQEIRTTNPVATEQYGSVSAEDLMNHEGEDL

SEQ ID NO: 86433 - protein, 32 aa, Artificial Sequence
  Description of Artificial Sequence: Synthetic polypeptide
DEQEIRTTNPVATEQYGSVSAEDLEDHEGEDL

SEQ ID NO: 86434 - protein, 30 aa, Artificial Sequence
  Description of Artificial Sequence: Synthetic polypeptide
DENEIATTNPVATEQYGDVCSTDGPQHEED

SEQ ID NO: 86435 - protein, 34 aa, Artificial Sequence
  Description of Artificial Sequence: Synthetic polypeptide
DEEEIRTTNPVATEQYGSVSTPDPLQANDPSFIE

SEQ ID NO: 86436 - protein, 34 aa, Artificial Sequence
  Description of Artificial Sequence: Synthetic polypeptide
DEEEIRTTNPVATEQYGSVSTPDPDQEDDGDEDE

SEQ ID NO: 86437 - protein, 31 aa, Artificial Sequence
  Description of Artificial Sequence: Synthetic polypeptide
DEQEIATTNPVATQQYGSVSATDLEDHEGEL

SEQ ID NO: 86438 - protein, 32 aa, Artificial Sequence
  Description of Artificial Sequence: Synthetic polypeptide
DEAEIGTTNPVATEQYGSVSTDDNYMYENQTN

SEQ ID NO: 86439 - protein, 32 aa, Artificial Sequence
  Description of Artificial Sequence: Synthetic polypeptide
DEAEIGTTNPVATEQYGSVSTDDLYPYENQTA

SEQ ID NO: 86440 - protein, 31 aa, Artificial Sequence
  Description of Artificial Sequence: Synthetic polypeptide
DEAEIGTTNPVATEQYGSVSADDLYMYENQQ

SEQ ID NO: 86441 - protein, 31 aa, Artificial Sequence
  Description of Artificial Sequence: Synthetic polypeptide
DENEIATTNPVATEQYGDVCSTDGPQHEEND

SEQ ID NO: 86442 - protein, 34 aa, Artificial Sequence
  Description of Artificial Sequence: Synthetic polypeptide
DEEEIRTTNPVATEQYGSVSTPDADQQAVEEVRD

SEQ ID NO: 86443 - protein, 34 aa, Artificial Sequence
  Description of Artificial Sequence: Synthetic polypeptide
DEEEIRTTNPVATEQYGSVSTPAGPNMRNEMNPV

SEQ ID NO: 86444 - protein, 33 aa, Artificial Sequence
  Description of Artificial Sequence: Synthetic polypeptide
DEEEIRTTNPVATEQYGSVSTPACPNMRNEMEV

SEQ ID NO: 86445 - protein, 31 aa, Artificial Sequence
  Description of Artificial Sequence: Synthetic polypeptide
DEQEIATTNPVAYEAWGSVTTNLQGADNDGR

SEQ ID NO: 86446 - protein, 31 aa, Artificial Sequence
  Description of Artificial Sequence: Synthetic polypeptide
DEQEIATTNPVAYEEWGSVSTNLQNGGMDGH

SEQ ID NO: 86447 - protein, 30 aa, Artificial Sequence
  Description of Artificial Sequence: Synthetic polypeptide
DENEIATTNPVATEQYGDVCSATGPEHENL

SEQ ID NO: 86448 - protein, 36 aa, Artificial Sequence
  Description of Artificial Sequence: Synthetic polypeptide
DEEEIRTTNPVATEQYGSVSTNYGLEHFDSGQNNDL

SEQ ID NO: 86449 - protein, 31 aa, Artificial Sequence
  Description of Artificial Sequence: Synthetic polypeptide
DEQEIATTNPVAYEPYGSTAAANNLQRGQRQ

SEQ ID NO: 86450 - protein, 28 aa, Artificial Sequence
  Description of Artificial Sequence: Synthetic peptide
CENEIATTNPVATECYGDVSETLQHEEL

SEQ ID NO: 86451 - protein, 34 aa, Artificial Sequence
  Description of Artificial Sequence: Synthetic polypeptide
DEEEIRTTNPVATEQYGSVSTPDTQAGDGPEEPI

SEQ ID NO: 86452 - protein, 31 aa, Artificial Sequence
  Description of Artificial Sequence: Synthetic polypeptide
DEAEIGTTNPVAYEQYGVVHSTTYTQMQGRR

SEQ ID NO: 86453 - protein, 32 aa, Artificial Sequence
  Description of Artificial Sequence: Synthetic polypeptide
DEQEIATTNPVATEYYGSVSATDLEDREGEDL

SEQ ID NO: 86454 - protein, 30 aa, Artificial Sequence
  Description of Artificial Sequence: Synthetic polypeptide
DENEIATTNPVATEQYGDVSECLEDHEGEL

SEQ ID NO: 86455 - protein, 31 aa, Artificial Sequence
  Description of Artificial Sequence: Synthetic polypeptide
DEQEIATTNPVATEQYGVVSATDLEDSEGEL

SEQ ID NO: 86456 - protein, 33 aa, Artificial Sequence
  Description of Artificial Sequence: Synthetic polypeptide
DEAEIKTTNPVATDAWGSVSITNLSQAPVGQNR

SEQ ID NO: 86457 - protein, 29 aa, Artificial Sequence
  Description of Artificial Sequence: Synthetic peptide
DENEIATTNPVATEQYGDVSECEQNHEDL

SEQ ID NO: 86458 - protein, 31 aa, Artificial Sequence
  Description of Artificial Sequence: Synthetic polypeptide
DEQEIATTNPVATEQYGVVSATTLEHEGEDL

SEQ ID NO: 86459 - protein, 31 aa, Artificial Sequence
  Description of Artificial Sequence: Synthetic polypeptide
DEQEIATTNPVATEQYGVVSTTLEDHEGDDL

SEQ ID NO: 86460 - protein, 28 aa, Artificial Sequence
  Description of Artificial Sequence: Synthetic peptide
CENEIATTNPVATECYGDVSECLQHEEL

SEQ ID NO: 86461 - protein, 35 aa, Artificial Sequence
  Description of Artificial Sequence: Synthetic polypeptide
DEEEIRTTNPVATEQYGSVSTPLEMEQDQAPNLEI

SEQ ID NO: 86462 - protein, 33 aa, Artificial Sequence
  Description of Artificial Sequence: Synthetic polypeptide
DEAEIKTTNPVATDAWGSVSCTNLSQELSGQNR

SEQ ID NO: 86463 - protein, 32 aa, Artificial Sequence
  Description of Artificial Sequence: Synthetic polypeptide
DEQEIATTNPVATERYGEVSTVNQGMGPNGNR

SEQ ID NO: 86464 - protein, 31 aa, Artificial Sequence
  Description of Artificial Sequence: Synthetic polypeptide
DENEIATTNPVATEQYGDVSAECLQHEGEDL

SEQ ID NO: 86465 - protein, 30 aa, Artificial Sequence
  Description of Artificial Sequence: Synthetic polypeptide
DENEIATTNPVATEQYGDVSAECLQHEEEL

SEQ ID NO: 86466 - protein, 33 aa, Artificial Sequence
  Description of Artificial Sequence: Synthetic polypeptide
DEQEIATTNPVATETWGSVSTNLQGDLGGNNGS

SEQ ID NO: 86467 - protein, 33 aa, Artificial Sequence
  Description of Artificial Sequence: Synthetic polypeptide
DEQEIATTNPVATETWGTVSTNLNQGDVGDNER

SEQ ID NO: 86468 - protein, 31 aa, Artificial Sequence
  Description of Artificial Sequence: Synthetic polypeptide
DENEIATTNPVATEQYGDVCSTGLVQFEEEL

SEQ ID NO: 86469 - protein, 33 aa, Artificial Sequence
  Description of Artificial Sequence: Synthetic polypeptide
DEAEIKTTNPVATDAFGSVSCTNLSQEPVGFNR

SEQ ID NO: 86470 - protein, 28 aa, Artificial Sequence
  Description of Artificial Sequence: Synthetic peptide
CENEIATTNPVATECYGDVSECLQHERL

SEQ ID NO: 86471 - protein, 32 aa, Artificial Sequence
  Description of Artificial Sequence: Synthetic polypeptide
DEQEIATTNPVAYEQWGCVSTNLQGEDGNNNS

SEQ ID NO: 86472 - protein, 34 aa, Artificial Sequence
  Description of Artificial Sequence: Synthetic polypeptide
DEEEIRTTNPVATEQYGSVSTPLMLNENGETEEN

SEQ ID NO: 86473 - protein, 32 aa, Artificial Sequence
  Description of Artificial Sequence: Synthetic polypeptide
DEQEIATTNPVAYEQWGSVAAANPLQEAGNRF

SEQ ID NO: 86474 - protein, 32 aa, Artificial Sequence
  Description of Artificial Sequence: Synthetic polypeptide
DEQEIATTNPVAYEQWGSVSTDPLQGEGNHMV

SEQ ID NO: 86475 - protein, 28 aa, Artificial Sequence
  Description of Artificial Sequence: Synthetic peptide
CENEIATTNPVATEEYGDVSEALQHEEL

SEQ ID NO: 86476 - protein, 32 aa, Artificial Sequence
  Description of Artificial Sequence: Synthetic polypeptide
DENEIATTNPVATEQWGSVAMNLQDQGNMTEN

SEQ ID NO: 86477 - protein, 32 aa, Artificial Sequence
  Description of Artificial Sequence: Synthetic polypeptide
DENEIATTNPVATEQWGSVAAGNLFRNNMGPR

SEQ ID NO: 86478 - protein, 32 aa, Artificial Sequence
  Description of Artificial Sequence: Synthetic polypeptide
DEQEIATTNPVAYEQYGSVANTNLQDTANPPY

SEQ ID NO: 86479 - protein, 30 aa, Artificial Sequence
  Description of Artificial Sequence: Synthetic polypeptide
DEQEIATTNPVAYEQYGSVANTNPQTAPPY

SEQ ID NO: 86480 - protein, 33 aa, Artificial Sequence
  Description of Artificial Sequence: Synthetic polypeptide
DEAEICTTNPVAYEQYGTVSTTNLNQGNDNDER

SEQ ID NO: 86481 - protein, 31 aa, Artificial Sequence
  Description of Artificial Sequence: Synthetic polypeptide
DEAEICTTNPVAYEQYGTVSTTNGQMNDDER

SEQ ID NO: 86482 - protein, 32 aa, Artificial Sequence
  Description of Artificial Sequence: Synthetic polypeptide
DENEIATTNPVATEQYGCVAATNLADPGGNHP

SEQ ID NO: 86483 - protein, 33 aa, Artificial Sequence
  Description of Artificial Sequence: Synthetic polypeptide
DEEEIRTTNPVATEQYGSVYTGALYTTDSDQRD

SEQ ID NO: 86484 - protein, 30 aa, Artificial Sequence
  Description of Artificial Sequence: Synthetic polypeptide
DENEIATTNPVATEQWGDVSEILQNAAENQ

SEQ ID NO: 86485 - protein, 33 aa, Artificial Sequence
  Description of Artificial Sequence: Synthetic polypeptide
DEEEIRTTNPVATEQYGSVYTGMTQFLSGQDFE

SEQ ID NO: 86486 - protein, 32 aa, Artificial Sequence
  Description of Artificial Sequence: Synthetic polypeptide
DEAEICTTNPVAYEQYGTVSTTNDLQNDDDER

SEQ ID NO: 86487 - protein, 31 aa, Artificial Sequence
  Description of Artificial Sequence: Synthetic polypeptide
DEQEIATTNPVAYEQYGSVATNLQVNDTAEE

SEQ ID NO: 86488 - protein, 32 aa, Artificial Sequence
  Description of Artificial Sequence: Synthetic polypeptide
DEQEIATTNPVAYEQYGSVCANTNLETGDNPY

SEQ ID NO: 86489 - protein, 34 aa, Artificial Sequence
  Description of Artificial Sequence: Synthetic polypeptide
DEEEIRTTNPVATEQYGSVYTGNGNLNTGGDGDE

SEQ ID NO: 86490 - protein, 29 aa, Artificial Sequence
  Description of Artificial Sequence: Synthetic peptide
DENEIATTNPVATEQWGDVSEIEMRAEDR

SEQ ID NO: 86491 - protein, 32 aa, Artificial Sequence
  Description of Artificial Sequence: Synthetic polypeptide
DEQEIATTNPVAYEQYGSVATNLQGAPAEGKH

SEQ ID NO: 86492 - protein, 35 aa, Artificial Sequence
  Description of Artificial Sequence: Synthetic polypeptide
DEQEIATTNPVAYEQYGQSVSATNDLGQMRAGIAR

SEQ ID NO: 86493 - protein, 33 aa, Artificial Sequence
  Description of Artificial Sequence: Synthetic polypeptide
DEQEIATTNPVAYEQYGHSIVNGESPLVQRGNR

SEQ ID NO: 86494 - protein, 33 aa, Artificial Sequence
  Description of Artificial Sequence: Synthetic polypeptide
DENEIATTNPVATEQYGCVAATNLADRDGNDNL

SEQ ID NO: 86495 - protein, 32 aa, Artificial Sequence
  Description of Artificial Sequence: Synthetic polypeptide
DEQEIATTNPVAYEQWGSVSTGNLLQGDVNDV

SEQ ID NO: 86496 - protein, 32 aa, Artificial Sequence
  Description of Artificial Sequence: Synthetic polypeptide
DEQEIATTNPVAYEQWGSVSTGNLPQDNQNDV

SEQ ID NO: 86497 - protein, 32 aa, Artificial Sequence
  Description of Artificial Sequence: Synthetic polypeptide
DEQEIATTNPVAYEQWGSVSTNLNGDHGDNKD

SEQ ID NO: 86498 - protein, 32 aa, Artificial Sequence
  Description of Artificial Sequence: Synthetic polypeptide
DEQEIATTNPVAYEQWGSVSTNLNGDTGDNNQ

SEQ ID NO: 86499 - protein, 32 aa, Artificial Sequence
  Description of Artificial Sequence: Synthetic polypeptide
DEQEIATTNPVAYEQWGSVSTNLNHDGDDNND

SEQ ID NO: 86500 - protein, 32 aa, Artificial Sequence
  Description of Artificial Sequence: Synthetic polypeptide
DEQEIATTNPVAYEQWGSVSTNLNMDGGDNTE

SEQ ID NO: 86501 - protein, 31 aa, Artificial Sequence
  Description of Artificial Sequence: Synthetic polypeptide
DEAEIGTTNPVATEQYGCVSTDCLYEYENQT

SEQ ID NO: 86502 - protein, 32 aa, Artificial Sequence
  Description of Artificial Sequence: Synthetic polypeptide
DEQEIATTNPVAYEQWGSVSTNLNMDGGTNNH

SEQ ID NO: 86503 - protein, 32 aa, Artificial Sequence
  Description of Artificial Sequence: Synthetic polypeptide
DEAEISTTNPVATEIYGSVCSNWNDGQRDGTE

SEQ ID NO: 86504 - protein, 32 aa, Artificial Sequence
  Description of Artificial Sequence: Synthetic polypeptide
DEQEIATTNPVAYEQWGSVSTNLNMEGGDDND

SEQ ID NO: 86505 - protein, 32 aa, Artificial Sequence
  Description of Artificial Sequence: Synthetic polypeptide
DEQEIATTNPVAYEQWGSVSTNLNMGTGDNNQ

SEQ ID NO: 86506 - protein, 28 aa, Artificial Sequence
  Description of Artificial Sequence: Synthetic peptide
CENEIATTNPVATECYGHVSECLQHEEL

SEQ ID NO: 86507 - protein, 28 aa, Artificial Sequence
  Description of Artificial Sequence: Synthetic peptide
YTHEIASVNPVCTEQYGVVSDNLQSGNQ

SEQ ID NO: 86508 - protein, 32 aa, Artificial Sequence
  Description of Artificial Sequence: Synthetic polypeptide
DENEIATTNPVATEQYGCVAATWLAQNDSGNH

SEQ ID NO: 86509 - protein, 32 aa, Artificial Sequence
  Description of Artificial Sequence: Synthetic polypeptide
DEAEIGTTNPVATEQYGCVCSTELAYFGSNQS

SEQ ID NO: 86510 - protein, 32 aa, Artificial Sequence
  Description of Artificial Sequence: Synthetic polypeptide
DEQEIATTNPVAYEQWGSVSTNPNGNTMGNDR

SEQ ID NO: 86511 - protein, 31 aa, Artificial Sequence
  Description of Artificial Sequence: Synthetic polypeptide
DEQEIATTNPVAYEQWGVVATNLQAGGQNDA

SEQ ID NO: 86512 - protein, 28 aa, Artificial Sequence
  Description of Artificial Sequence: Synthetic peptide
CENEIATTNPVATECYGDVSEVLQHEEL

SEQ ID NO: 86513 - protein, 30 aa, Artificial Sequence
  Description of Artificial Sequence: Synthetic polypeptide
DENEIATTNPVATEQYGDVSECLQDHEEEL

SEQ ID NO: 86514 - protein, 31 aa, Artificial Sequence
  Description of Artificial Sequence: Synthetic polypeptide
DEQEIATTNPVATEQYGVVSATDLEDHGEDL

SEQ ID NO: 86515 - protein, 34 aa, Artificial Sequence
  Description of Artificial Sequence: Synthetic polypeptide
DEEEIRTTNPVATEQYGSVSTPLNLESNAEEEFN

SEQ ID NO: 86516 - protein, 32 aa, Artificial Sequence
  Description of Artificial Sequence: Synthetic polypeptide
DEQEIATTNPVATEQYGSVSWTDLEDHEGEDL

SEQ ID NO: 86517 - protein, 32 aa, Artificial Sequence
  Description of Artificial Sequence: Synthetic polypeptide
DEQEIATTNPVATEQYGSVSWTDLEDHKGHDL

SEQ ID NO: 86518 - protein, 32 aa, Artificial Sequence
  Description of Artificial Sequence: Synthetic polypeptide
DEQEIATTNPVATEQYGSVSWTDLEFHEGEDL

SEQ ID NO: 86519 - protein, 32 aa, Artificial Sequence
  Description of Artificial Sequence: Synthetic polypeptide
DEQEIATTNPVATEQYGSVSWTDLIDHEGMDQ

SEQ ID NO: 86520 - protein, 34 aa, Artificial Sequence
  Description of Artificial Sequence: Synthetic polypeptide
DEEEIRTTNPVATEQYGSVSTPNDTIGMGGGEGT

SEQ ID NO: 86521 - protein, 33 aa, Artificial Sequence
  Description of Artificial Sequence: Synthetic polypeptide
DEQEIATTNPVATEQYGSVSWTDLPEDQNGEDL

SEQ ID NO: 86522 - protein, 32 aa, Artificial Sequence
  Description of Artificial Sequence: Synthetic polypeptide
DEQEIATTNPVATEQYGSVSWTDNEDHQGEDP

SEQ ID NO: 86523 - protein, 32 aa, Artificial Sequence
  Description of Artificial Sequence: Synthetic polypeptide
DEQEIATTNPVATEQYGSVSWNDLEDHQQEDH

SEQ ID NO: 86524 - protein, 32 aa, Artificial Sequence
  Description of Artificial Sequence: Synthetic polypeptide
DENEIATTNPVATEQYGDVSTPCLQMHNGMEV

SEQ ID NO: 86525 - protein, 32 aa, Artificial Sequence
  Description of Artificial Sequence: Synthetic polypeptide
DEQEIATTNPVATEQYGSVSWTELIDHQGEDL

SEQ ID NO: 86526 - protein, 33 aa, Artificial Sequence
  Description of Artificial Sequence: Synthetic polypeptide
DEQEIATTNPVATEQYGSVSWTELQEDHNGGDL

SEQ ID NO: 86527 - protein, 34 aa, Artificial Sequence
  Description of Artificial Sequence: Synthetic polypeptide
DEQEIATTNPVATEQYGSVSWTNDLEDHQQGEDL

SEQ ID NO: 86528 - protein, 34 aa, Artificial Sequence
  Description of Artificial Sequence: Synthetic polypeptide
DEQEIATTNPVATEQYGSVSWTNDLPEDQEGEDM

SEQ ID NO: 86529 - protein, 34 aa, Artificial Sequence
  Description of Artificial Sequence: Synthetic polypeptide
DEEEIRTTNPVATEQYGSVYSPASLLEQQLVLER

SEQ ID NO: 86530 - protein, 32 aa, Artificial Sequence
  Description of Artificial Sequence: Synthetic polypeptide
DEQEIATTNPVATEQYGSVSYTALEDHEGEDL

SEQ ID NO: 86531 - protein, 33 aa, Artificial Sequence
  Description of Artificial Sequence: Synthetic polypeptide
DEQEIATTNPVATEQYGSVSYTDELEDHTGENL

SEQ ID NO: 86532 - protein, 34 aa, Artificial Sequence
  Description of Artificial Sequence: Synthetic polypeptide
DENEIATTNPVATEQYGDVSTPCLPQMRNGMNPV

SEQ ID NO: 86533 - protein, 32 aa, Artificial Sequence
  Description of Artificial Sequence: Synthetic polypeptide
DEQEIATTNPVATEQYGSVSVTRLEDHEGEDL

SEQ ID NO: 86534 - protein, 33 aa, Artificial Sequence
  Description of Artificial Sequence: Synthetic polypeptide
DEQEIATTNPVATEQYGSVSVTGLQEDYEGEDQ

SEQ ID NO: 86535 - protein, 32 aa, Artificial Sequence
  Description of Artificial Sequence: Synthetic polypeptide
DEQEIATTNPVATEQYGSVSVTELEDHFGEDL

SEQ ID NO: 86536 - protein, 32 aa, Artificial Sequence
  Description of Artificial Sequence: Synthetic polypeptide
DENEIATTNPVATEQYGSASATDLQDHEGEDL

SEQ ID NO: 86537 - protein, 31 aa, Artificial Sequence
  Description of Artificial Sequence: Synthetic polypeptide
DENEIATTNPVATEQYGSASATDLEDHGEDL

SEQ ID NO: 86538 - protein, 33 aa, Artificial Sequence
  Description of Artificial Sequence: Synthetic polypeptide
DEEEIRTTNPVATEQYGSVYSEAPNEIQEFETN

SEQ ID NO: 86539 - protein, 33 aa, Artificial Sequence
  Description of Artificial Sequence: Synthetic polypeptide
DENEIATTNPVATEQYGEVSSTEPNGPNMRGNV

SEQ ID NO: 86540 - protein, 34 aa, Artificial Sequence
  Description of Artificial Sequence: Synthetic polypeptide
DEEEIRTTNPVATEQYGSVYSEAPNEIQTVGEDA

SEQ ID NO: 86541 - protein, 30 aa, Artificial Sequence
  Description of Artificial Sequence: Synthetic polypeptide
DENEIATTNPVATEQYGETWSNEDWARGPR

SEQ ID NO: 86542 - protein, 32 aa, Artificial Sequence
  Description of Artificial Sequence: Synthetic polypeptide
DEQEIATTNPVATEQYGSVSVTDLEDHEGEDL

SEQ ID NO: 86543 - protein, 30 aa, Artificial Sequence
  Description of Artificial Sequence: Synthetic polypeptide
DENEIATTNPVATEQYGEISMEDIQQRGGH

SEQ ID NO: 86544 - protein, 32 aa, Artificial Sequence
  Description of Artificial Sequence: Synthetic polypeptide
DEAEIRTTNPVAYESWGSVSTTNLPDSGGGNF

SEQ ID NO: 86545 - protein, 28 aa, Artificial Sequence
  Description of Artificial Sequence: Synthetic peptide
DENEIATTNPVATEQYGEASEVEQHEEK

SEQ ID NO: 86546 - protein, 32 aa, Artificial Sequence
  Description of Artificial Sequence: Synthetic polypeptide
DEQEIATTNPVATEQYGSVSVTDLENGEGEDL

SEQ ID NO: 86547 - protein, 35 aa, Artificial Sequence
  Description of Artificial Sequence: Synthetic polypeptide
DEEEIRTTNPVATEQYGSVSTPNLAQSVDQVDVGS

SEQ ID NO: 86548 - protein, 36 aa, Artificial Sequence
  Description of Artificial Sequence: Synthetic polypeptide
DEEEIRTTNPVATEQYGSVYSNLPLQEARNGVDVRI

SEQ ID NO: 86549 - protein, 36 aa, Artificial Sequence
  Description of Artificial Sequence: Synthetic polypeptide
DEEEIRTTNPVATEQYGSVYSNLPSQEARNVVGVRI

SEQ ID NO: 86550 - protein, 31 aa, Artificial Sequence
  Description of Artificial Sequence: Synthetic polypeptide
DENEIATTNPVATEQYGEASEENIQQRNGGH

SEQ ID NO: 86551 - protein, 32 aa, Artificial Sequence
  Description of Artificial Sequence: Synthetic polypeptide
DEQEIATTNPVATEQYGSVSVTDLEVHEGTPL

SEQ ID NO: 86552 - protein, 33 aa, Artificial Sequence
  Description of Artificial Sequence: Synthetic polypeptide
DEQEIATTNPVATEQYGSVSVTDLLEQYEGEDE

SEQ ID NO: 86553 - protein, 30 aa, Artificial Sequence
  Description of Artificial Sequence: Synthetic polypeptide
DENEIATTNPVATEQYGDVSTILMNAEEEA

SEQ ID NO: 86554 - protein, 32 aa, Artificial Sequence
  Description of Artificial Sequence: Synthetic polypeptide
DEQEIATTNPVATEQYGSVSYTDLEDHEGEDL

SEQ ID NO: 86555 - protein, 32 aa, Artificial Sequence
  Description of Artificial Sequence: Synthetic polypeptide
DEQEIATTNPVATEQYGSVSYTDLEFHEGEDL

SEQ ID NO: 86556 - protein, 30 aa, Artificial Sequence
  Description of Artificial Sequence: Synthetic polypeptide
DENEIATTNPVATEQYGDVSTILMDHEEEA

SEQ ID NO: 86557 - protein, 29 aa, Artificial Sequence
  Description of Artificial Sequence: Synthetic peptide
CENEIACTNPVAYEQYGEAAENLQRGGGR

SEQ ID NO: 86558 - protein, 30 aa, Artificial Sequence
  Description of Artificial Sequence: Synthetic polypeptide
DENEIATTNPVATEQYGDVSENEMNAAGGA

SEQ ID NO: 86559 - protein, 32 aa, Artificial Sequence
  Description of Artificial Sequence: Synthetic polypeptide
DEQEIATTNPVATEQYGTVCSATDLEDHEGNL

SEQ ID NO: 86560 - protein, 31 aa, Artificial Sequence
  Description of Artificial Sequence: Synthetic polypeptide
DEQEIATTNPVATEQYGTVCSATGPEFEGND

SEQ ID NO: 86561 - protein, 32 aa, Artificial Sequence
  Description of Artificial Sequence: Synthetic polypeptide
DEQEIATTNPVATEQYGTVSATDLEDHEGNDL

SEQ ID NO: 86562 - protein, 31 aa, Artificial Sequence
  Description of Artificial Sequence: Synthetic polypeptide
DEQEIATTNPVATEQYGTVSATDLEHEGEDD

SEQ ID NO: 86563 - protein, 31 aa, Artificial Sequence
  Description of Artificial Sequence: Synthetic polypeptide
DEQEIATTNPVATEQYGTVSATGLEHEGEDL

SEQ ID NO: 86564 - protein, 33 aa, Artificial Sequence
  Description of Artificial Sequence: Synthetic polypeptide
CEEEIATTNPVATEQYGSVCSTNPPQEDGTEMQ

SEQ ID NO: 86565 - protein, 29 aa, Artificial Sequence
  Description of Artificial Sequence: Synthetic peptide
DENEIATTNPVATEQYGDVSEILMAAEDL

SEQ ID NO: 86566 - protein, 31 aa, Artificial Sequence
  Description of Artificial Sequence: Synthetic polypeptide
DEAEINTTNPVATEAYGSVSTNSEFTVEGEF

SEQ ID NO: 86567 - protein, 33 aa, Artificial Sequence
  Description of Artificial Sequence: Synthetic polypeptide
DEAEINTTNPVATEAYGSVCSTNSEFTVRGENF

SEQ ID NO: 86568 - protein, 29 aa, Artificial Sequence
  Description of Artificial Sequence: Synthetic peptide
DENEIATTNPVATEQYGDVSEIEMAAGGA

SEQ ID NO: 86569 - protein, 31 aa, Artificial Sequence
  Description of Artificial Sequence: Synthetic polypeptide
DEQEIATTNPVATEQYGVVATDLQDHEGDDL

SEQ ID NO: 86570 - protein, 31 aa, Artificial Sequence
  Description of Artificial Sequence: Synthetic polypeptide
DEQEIATTNPVATEQYGVVATDLQDHEGEDL

SEQ ID NO: 86571 - protein, 31 aa, Artificial Sequence
  Description of Artificial Sequence: Synthetic polypeptide
DEQEIATTNPVATEQYGVVSADDLEDSGNDL

SEQ ID NO: 86572 - protein, 31 aa, Artificial Sequence
  Description of Artificial Sequence: Synthetic polypeptide
DEQEIATTNPVATEQYGVVSADDLEDSGNDQ

SEQ ID NO: 86573 - protein, 31 aa, Artificial Sequence
  Description of Artificial Sequence: Synthetic polypeptide
DEQEIATTNPVATEQYGVVSATDLEDHEGEL

SEQ ID NO: 86574 - protein, 32 aa, Artificial Sequence
  Description of Artificial Sequence: Synthetic polypeptide
DEQEIATTNPVATEQYGSYVSTDLEDHEGEDL

SEQ ID NO: 86575 - protein, 29 aa, Artificial Sequence
  Description of Artificial Sequence: Synthetic peptide
DENEIATTNPVATEQWGDASEIEQNREDR

SEQ ID NO: 86576 - protein, 32 aa, Artificial Sequence
  Description of Artificial Sequence: Synthetic polypeptide
DEQEIATTNPVATEQYGSVYATDLEDQEGQDL

SEQ ID NO: 86577 - protein, 30 aa, Artificial Sequence
  Description of Artificial Sequence: Synthetic polypeptide
DENEIATTNPVATEQYGDVSTCLEDHEEDL

SEQ ID NO: 86578 - protein, 32 aa, Artificial Sequence
  Description of Artificial Sequence: Synthetic polypeptide
DEQEIATTNPVATEQYGSVSYTSLEDHEGEDL

SEQ ID NO: 86579 - protein, 33 aa, Artificial Sequence
  Description of Artificial Sequence: Synthetic polypeptide
DEEEIRTTNPVATEQYGSVSTPMTDHGGEIPQS

SEQ ID NO: 86580 - protein, 32 aa, Artificial Sequence
  Description of Artificial Sequence: Synthetic polypeptide
DEAEIRTTNPVSTEQYGSVSWNEMDDRQGMDS

SEQ ID NO: 86581 - protein, 30 aa, Artificial Sequence
  Description of Artificial Sequence: Synthetic polypeptide
DENEIATTNPVATEQYGDVSTILMDAEEEA

SEQ ID NO: 86582 - protein, 30 aa, Artificial Sequence
  Description of Artificial Sequence: Synthetic polypeptide
DENEIATTNPVATEQYGDVSTILEDHEEEA

SEQ ID NO: 86583 - protein, 30 aa, Artificial Sequence
  Description of Artificial Sequence: Synthetic polypeptide
DENEIATTNPVATEQYGDVSTIEENAAGDA

SEQ ID NO: 86584 - protein, 30 aa, Artificial Sequence
  Description of Artificial Sequence: Synthetic polypeptide
DENEIATTNPVATEQYGDVSTEPCLNHEEL

SEQ ID NO: 86585 - protein, 33 aa, Artificial Sequence
  Description of Artificial Sequence: Synthetic polypeptide
DEQEIATTNPVATEQYGSVVSATDLEDHEGENE

SEQ ID NO: 86586 - protein, 31 aa, Artificial Sequence
  Description of Artificial Sequence: Synthetic polypeptide
DEAEIRATNPVATDQYGHVSMSNLFQGSENE

SEQ ID NO: 86587 - protein, 36 aa, Artificial Sequence
  Description of Artificial Sequence: Synthetic polypeptide
DEEEIRTTNPVATEQYGSVYSPTVNEIQERQEVENL

SEQ ID NO: 86588 - protein, 35 aa, Artificial Sequence
  Description of Artificial Sequence: Synthetic polypeptide
DEEEIRTTNPVATEQYGSVYSPTVVEIQRQEVENY

SEQ ID NO: 86589 - protein, 35 aa, Artificial Sequence
  Description of Artificial Sequence: Synthetic polypeptide
DEEEIRTTNPVATEQYGSVYSPVTTLQHPPQVGEF

SEQ ID NO: 86590 - protein, 30 aa, Artificial Sequence
  Description of Artificial Sequence: Synthetic polypeptide
DENEIATTNPVATEQYGDVSTEPCGNHGEL

SEQ ID NO: 86591 - protein, 32 aa, Artificial Sequence
  Description of Artificial Sequence: Synthetic polypeptide
DEAEIRATNPVATDQYGFVSMWNLFQTGGENI

SEQ ID NO: 86592 - protein, 33 aa, Artificial Sequence
  Description of Artificial Sequence: Synthetic polypeptide
DEAEIRATNPVATDQYGFVSMTVNLFQGGESRD

SEQ ID NO: 86593 - protein, 32 aa, Artificial Sequence
  Description of Artificial Sequence: Synthetic polypeptide
DEAEIRATNPVATDQYGFVSMTSNLFQGSENE

SEQ ID NO: 86594 - protein, 36 aa, Artificial Sequence
  Description of Artificial Sequence: Synthetic polypeptide
DEEEIRTTNPVATEQYGSVYSSPNLEDNYMGENFRI

SEQ ID NO: 86595 - protein, 34 aa, Artificial Sequence
  Description of Artificial Sequence: Synthetic polypeptide
DEEEIRTTNPVATEQYGSVYSTDVAPQVRSDSQD

SEQ ID NO: 86596 - protein, 32 aa, Artificial Sequence
  Description of Artificial Sequence: Synthetic polypeptide
DEQEIATTNPVAYEQYGTVVSGDNGEQNHGNR

SEQ ID NO: 86597 - protein, 33 aa, Artificial Sequence
  Description of Artificial Sequence: Synthetic polypeptide
DEEEIRTTNPVATEQYGSVYTMNIENHISNEVE

SEQ ID NO: 86598 - protein, 29 aa, Artificial Sequence
  Description of Artificial Sequence: Synthetic peptide
DENEIATTNPVATEPYGTISMDIQQQGNH

SEQ ID NO: 86599 - protein, 34 aa, Artificial Sequence
  Description of Artificial Sequence: Synthetic polypeptide
DEEEIRTTNPVATEQYGSVYTVYGETTGNDRQEE

SEQ ID NO: 86600 - protein, 32 aa, Artificial Sequence
  Description of Artificial Sequence: Synthetic polypeptide
DEQEIRTTNPVATEQWGSVSCIDEEDREGENL

SEQ ID NO: 86601 - protein, 33 aa, Artificial Sequence
  Description of Artificial Sequence: Synthetic polypeptide
DEEEIRTTNPVATEQYGSVYTVYNIDTIENEMI

SEQ ID NO: 86602 - protein, 31 aa, Artificial Sequence
  Description of Artificial Sequence: Synthetic polypeptide
DEQEIRTTNPVATEQWGSVSTDLEDHEEEDA

SEQ ID NO: 86603 - protein, 32 aa, Artificial Sequence
  Description of Artificial Sequence: Synthetic polypeptide
DEQEIRTTNPVATEQWGSVSTIDEQDHEGEDG

SEQ ID NO: 86604 - protein, 29 aa, Artificial Sequence
  Description of Artificial Sequence: Synthetic peptide
DENEIATTNPVATECYGSVSCCEQDHEEL

SEQ ID NO: 86605 - protein, 31 aa, Artificial Sequence
  Description of Artificial Sequence: Synthetic polypeptide
DENEIATTNPVATECYGSVSATCLEHEGEDL

SEQ ID NO: 86606 - protein, 34 aa, Artificial Sequence
  Description of Artificial Sequence: Synthetic polypeptide
DEEEIRTTNPVATEQYGSVYTVLMLEQADTDQRS

SEQ ID NO: 86607 - protein, 29 aa, Artificial Sequence
  Description of Artificial Sequence: Synthetic peptide
DENEIATTNPVATECYGNVAECLQRVEEL

SEQ ID NO: 86608 - protein, 30 aa, Artificial Sequence
  Description of Artificial Sequence: Synthetic polypeptide
DENEIATTNPVATECYGDVSTPCLQMHEEV

SEQ ID NO: 86609 - protein, 30 aa, Artificial Sequence
  Description of Artificial Sequence: Synthetic polypeptide
DENEIATTNPVATECYGDVSTPALQMHEEV

SEQ ID NO: 86610 - protein, 31 aa, Artificial Sequence
  Description of Artificial Sequence: Synthetic polypeptide
DEQEIRTTNPVATEQWGSVSTILEDAEEEDA

SEQ ID NO: 86611 - protein, 30 aa, Artificial Sequence
  Description of Artificial Sequence: Synthetic polypeptide
DENEIATTNPVATECYGDVSTCLQDHEEEL

SEQ ID NO: 86612 - protein, 28 aa, Artificial Sequence
  Description of Artificial Sequence: Synthetic peptide
DENEIATTNPVATECYGDVSNCIQHEQL

SEQ ID NO: 86613 - protein, 31 aa, Artificial Sequence
  Description of Artificial Sequence: Synthetic polypeptide
DEQEIRTTNPVATEQWGSVSTILEDHEEEDA

SEQ ID NO: 86614 - protein, 31 aa, Artificial Sequence
  Description of Artificial Sequence: Synthetic polypeptide
DEQEIRTTNPVATEQWGSVSTILMDAEEEDA

SEQ ID NO: 86615 - protein, 31 aa, Artificial Sequence
  Description of Artificial Sequence: Synthetic polypeptide
DENEIATTNPVATECYGEASENLPQDRGEGG

SEQ ID NO: 86616 - protein, 31 aa, Artificial Sequence
  Description of Artificial Sequence: Synthetic polypeptide
DENEIATTNPVATECYGSVSCICLPQHGEEG

SEQ ID NO: 86617 - protein, 33 aa, Artificial Sequence
  Description of Artificial Sequence: Synthetic polypeptide
DEQEIRTTNPVATEQFGSVATSNALQGSVDNAQ

SEQ ID NO: 86618 - protein, 32 aa, Artificial Sequence
  Description of Artificial Sequence: Synthetic polypeptide
DEQEIRTTNPVATEPYGTISATEDLQDHEGNL

SEQ ID NO: 86619 - protein, 32 aa, Artificial Sequence
  Description of Artificial Sequence: Synthetic polypeptide
DEQEIRTTNPIATEQYGSVSAEDLEDREGEDL

SEQ ID NO: 86620 - protein, 33 aa, Artificial Sequence
  Description of Artificial Sequence: Synthetic polypeptide
DEEEIRTTNPVATEQYGSVSTNPDMVESSSQEK

SEQ ID NO: 86621 - protein, 33 aa, Artificial Sequence
  Description of Artificial Sequence: Synthetic polypeptide
DEQEIRTTNPVATECWGSVSCINEPQDREGENG

SEQ ID NO: 86622 - protein, 33 aa, Artificial Sequence
  Description of Artificial Sequence: Synthetic polypeptide
DEQEIRTTNPVATECYGSVSACINEPQDREGEG

SEQ ID NO: 86623 - protein, 33 aa, Artificial Sequence
  Description of Artificial Sequence: Synthetic polypeptide
DEAEICTTNPVATEQYGAVSTNLGAGNAGENGA

SEQ ID NO: 86624 - protein, 33 aa, Artificial Sequence
  Description of Artificial Sequence: Synthetic polypeptide
DEQEIRTTNPVATECYGSVSATIDLPQDHEGEL

SEQ ID NO: 86625 - protein, 35 aa, Artificial Sequence
  Description of Artificial Sequence: Synthetic polypeptide
DEEEIRTTNPVATEQYGSVYTTNQNNQEIGTNNQE

SEQ ID NO: 86626 - protein, 31 aa, Artificial Sequence
  Description of Artificial Sequence: Synthetic polypeptide
DENEIATTNPVATECYGSVSEINLQDHEEEL

SEQ ID NO: 86627 - protein, 35 aa, Artificial Sequence
  Description of Artificial Sequence: Synthetic polypeptide
DEEEIRTTNPVATEQYGSVYTTTNGNQEIGTNNTE

SEQ ID NO: 86628 - protein, 33 aa, Artificial Sequence
  Description of Artificial Sequence: Synthetic polypeptide
DEQEIRTTNPVATECYGSVSATIDLQDHEGEDG

SEQ ID NO: 86629 - protein, 30 aa, Artificial Sequence
  Description of Artificial Sequence: Synthetic polypeptide
DENEIATTNPVATECYGSVSECLQDHEEEL

SEQ ID NO: 86630 - protein, 33 aa, Artificial Sequence
  Description of Artificial Sequence: Synthetic polypeptide
DEQEIRTTNPVATECYGSVSTIDLPQDHEGEDG

SEQ ID NO: 86631 - protein, 33 aa, Artificial Sequence
  Description of Artificial Sequence: Synthetic polypeptide
DEQEIRTTNPVATEIYGSVSNLNLVERVGTVPG

SEQ ID NO: 86632 - protein, 32 aa, Artificial Sequence
  Description of Artificial Sequence: Synthetic polypeptide
DEQEIRTTNPVATEPYGSVSATDLEDHEGEDL

SEQ ID NO: 86633 - protein, 33 aa, Artificial Sequence
  Description of Artificial Sequence: Synthetic polypeptide
DEQEIRTTNPVATEPYGSVSATDLQEDHEGEDL

SEQ ID NO: 86634 - protein, 33 aa, Artificial Sequence
  Description of Artificial Sequence: Synthetic polypeptide
DEEEIRTTNPVATEQYGSVYTVADQTPGSMQSP

SEQ ID NO: 86635 - protein, 32 aa, Artificial Sequence
  Description of Artificial Sequence: Synthetic polypeptide
DEQEIRTTNPVATEPYGTISATEDLQDHEGNH

SEQ ID NO: 86636 - protein, 32 aa, Artificial Sequence
  Description of Artificial Sequence: Synthetic polypeptide
DEQEIRTTNPVATEQYGAVSATDLEDHEGEDL

SEQ ID NO: 86637 - protein, 29 aa, Artificial Sequence
  Description of Artificial Sequence: Synthetic peptide
DENEIATTNPVATECYGDVSMCLQQQEEH

SEQ ID NO: 86638 - protein, 31 aa, Artificial Sequence
  Description of Artificial Sequence: Synthetic polypeptide
DEQEIRTTNPVATEQYGCVSEVNENQAEVEI

SEQ ID NO: 86639 - protein, 32 aa, Artificial Sequence
  Description of Artificial Sequence: Synthetic polypeptide
DEQEIRTTNPVATEQYGCVSTELLLEDGEESH

SEQ ID NO: 86640 - protein, 32 aa, Artificial Sequence
  Description of Artificial Sequence: Synthetic polypeptide
DEQEIRTTNPVATEQYGSISATDLEDHEGEDL

SEQ ID NO: 86641 - protein, 33 aa, Artificial Sequence
  Description of Artificial Sequence: Synthetic polypeptide
DEQEIRTTNPVATEQYGSISATEDLQDHNGEDL

SEQ ID NO: 86642 - protein, 29 aa, Artificial Sequence
  Description of Artificial Sequence: Synthetic peptide
DENEIATTNPVATECYGDVSECLVQHEEL

SEQ ID NO: 86643 - protein, 31 aa, Artificial Sequence
  Description of Artificial Sequence: Synthetic polypeptide
DEAEISTTNPVATEQYGSVHTDLYMYIENQT

SEQ ID NO: 86644 - protein, 29 aa, Artificial Sequence
  Description of Artificial Sequence: Synthetic peptide
DENEIATTNPVATECYGDVSECLQSHEQL

SEQ ID NO: 86645 - protein, 30 aa, Artificial Sequence
  Description of Artificial Sequence: Synthetic polypeptide
DENEIATTNPVATECYGDVSECLQQHNEEL

SEQ ID NO: 86646 - protein, 32 aa, Artificial Sequence
  Description of Artificial Sequence: Synthetic polypeptide
DEAEISTTNPVATEQYGVVCSTELQYFPSNDS

SEQ ID NO: 86647 - protein, 29 aa, Artificial Sequence
  Description of Artificial Sequence: Synthetic peptide
DENEIATTNPVATECYGDVSECLQQHEEL

SEQ ID NO: 86648 - protein, 29 aa, Artificial Sequence
  Description of Artificial Sequence: Synthetic peptide
DENEIATTNPVATECYGDVSECLQQHEEH

SEQ ID NO: 86649 - protein, 32 aa, Artificial Sequence
  Description of Artificial Sequence: Synthetic polypeptide
DEQEIRTTNPVATEQYGSSSTITSGQHEGETN

SEQ ID NO: 86650 - protein, 32 aa, Artificial Sequence
  Description of Artificial Sequence: Synthetic polypeptide
DEQEIRTTNPVATEQYGSVCSNDLEDIENSQI

SEQ ID NO: 86651 - protein, 33 aa, Artificial Sequence
  Description of Artificial Sequence: Synthetic polypeptide
DEQEIRTTNPVATEQYGSVCSPTLLETQMDIQP

SEQ ID NO: 86652 - protein, 34 aa, Artificial Sequence
  Description of Artificial Sequence: Synthetic polypeptide
DEQEIRTTNPVATEQYGSVCSPTVNLERNDDTES

SEQ ID NO: 86653 - protein, 34 aa, Artificial Sequence
  Description of Artificial Sequence: Synthetic polypeptide
DEQEIRTTNPVATEQYGSVCSTYVLTQTADGSQQ

SEQ ID NO: 86654 - protein, 32 aa, Artificial Sequence
  Description of Artificial Sequence: Synthetic polypeptide
DEQEIRTTNPVATEQYGSVFATDLEDHEGEDL

SEQ ID NO: 86655 - protein, 32 aa, Artificial Sequence
  Description of Artificial Sequence: Synthetic polypeptide
DEQEIRTTNPVATEQYGSVNSAPTLQENIEDG

SEQ ID NO: 86656 - protein, 32 aa, Artificial Sequence
  Description of Artificial Sequence: Synthetic polypeptide
DEQEIRTTNPVATEQYGSVSACDLEDHEGEEG

SEQ ID NO: 86657 - protein, 33 aa, Artificial Sequence
  Description of Artificial Sequence: Synthetic polypeptide
DEQEIRTTNPVATEQYGSFMWENDLLRDENPRP

SEQ ID NO: 86658 - protein, 32 aa, Artificial Sequence
  Description of Artificial Sequence: Synthetic polypeptide
CEEEIATTNPVATEQWGSVSMSGETGQRGVND

SEQ ID NO: 86659 - protein, 34 aa, Artificial Sequence
  Description of Artificial Sequence: Synthetic polypeptide
DEQEIRTTNPVATEQYGSCVCSPTLLERQGDHDE

SEQ ID NO: 86660 - protein, 35 aa, Artificial Sequence
  Description of Artificial Sequence: Synthetic polypeptide
DEEEIRTTNPVATEQYGSVYVTPLEQARNGVGVFI

SEQ ID NO: 86661 - protein, 33 aa, Artificial Sequence
  Description of Artificial Sequence: Synthetic polypeptide
DEQEIRTTNPVATEQYGCVSTNGGNQGPGDGPT

SEQ ID NO: 86662 - protein, 29 aa, Artificial Sequence
  Description of Artificial Sequence: Synthetic peptide
DENEIATTNPVATECYGDVSMCLQQHEEL

SEQ ID NO: 86663 - protein, 32 aa, Artificial Sequence
  Description of Artificial Sequence: Synthetic polypeptide
DEQEIRTTNPVATEQYGCVSTSNPIQETFEQD

SEQ ID NO: 86664 - protein, 32 aa, Artificial Sequence
  Description of Artificial Sequence: Synthetic polypeptide
DEQEIRTTNPVATEQYGCYSTNPNQMETFERP

SEQ ID NO: 86665 - protein, 29 aa, Artificial Sequence
  Description of Artificial Sequence: Synthetic peptide
DENEIATTNPVATECYGDVSMCLQQHEEH

SEQ ID NO: 86666 - protein, 31 aa, Artificial Sequence
  Description of Artificial Sequence: Synthetic polypeptide
DEQEIRTTNPVATEQYGDVSATDEEDHEGEL

SEQ ID NO: 86667 - protein, 32 aa, Artificial Sequence
  Description of Artificial Sequence: Synthetic polypeptide
DEAEISTTNPVATEQYGQCVCSTNLAYFGSDQ

SEQ ID NO: 86668 - protein, 32 aa, Artificial Sequence
  Description of Artificial Sequence: Synthetic polypeptide
DEQEIRTTNPVATEQYGDVSATDLEDHEGEDL

SEQ ID NO: 86669 - protein, 32 aa, Artificial Sequence
  Description of Artificial Sequence: Synthetic polypeptide
DEQEIRTTNPVATEQYGDVSATDLENHEGEDL

SEQ ID NO: 86670 - protein, 29 aa, Artificial Sequence
  Description of Artificial Sequence: Synthetic peptide
DENEIATTNPVATECYGDVSEILQHAEDL

SEQ ID NO: 86671 - protein, 32 aa, Artificial Sequence
  Description of Artificial Sequence: Synthetic polypeptide
DEAEICTTNPVATEHYGVVSTGQLGDIGGNQR

SEQ ID NO: 86672 - protein, 32 aa, Artificial Sequence
  Description of Artificial Sequence: Synthetic polypeptide
DEAEICTTNPVATEHYGSVSTNNGDNHGMDMR

SEQ ID NO: 86673 - protein, 30 aa, Artificial Sequence
  Description of Artificial Sequence: Synthetic polypeptide
DEQEIRTTNPVATEQYGDVSEIEENAEGDA

SEQ ID NO: 86674 - protein, 33 aa, Artificial Sequence
  Description of Artificial Sequence: Synthetic polypeptide
DEAEICTTNPVATEHYGSVSTGNNGGTAGENMR

SEQ ID NO: 86675 - protein, 31 aa, Artificial Sequence
  Description of Artificial Sequence: Synthetic polypeptide
DEQEIRTTNPVATEQYGDVSTDLMNHEEEDA

SEQ ID NO: 86676 - protein, 34 aa, Artificial Sequence
  Description of Artificial Sequence: Synthetic polypeptide
DEQEIRTTNPVATEQYGQSAPSTENLAPEENSRF

SEQ ID NO: 86677 - protein, 35 aa, Artificial Sequence
  Description of Artificial Sequence: Synthetic polypeptide
DEQEIRTTNPVATEQYGSAVSPTDNVTTQRQPERF

SEQ ID NO: 86678 - protein, 33 aa, Artificial Sequence
  Description of Artificial Sequence: Synthetic polypeptide
DEAEICTTNPVATEEYGSVSTGNNQPDEGHGRA

SEQ ID NO: 86679 - protein, 32 aa, Artificial Sequence
  Description of Artificial Sequence: Synthetic polypeptide
DEAEICTTNPVATECYGVVSTGNDLQDEGKED

SEQ ID NO: 86680 - protein, 34 aa, Artificial Sequence
  Description of Artificial Sequence: Synthetic polypeptide
DEEEIRTTNPVATEQYGSVSTNPIHVESNSQEKM

SEQ ID NO: 86681 - protein, 35 aa, Artificial Sequence
  Description of Artificial Sequence: Synthetic polypeptide
DEEEIRTTNPVATEQYGSVSTNPLMHVESNSQEKD

SEQ ID NO: 86682 - protein, 32 aa, Artificial Sequence
  Description of Artificial Sequence: Synthetic polypeptide
DEQEIATTNPVGTEQYGSVSWNELDNRAGDAD

SEQ ID NO: 86683 - protein, 29 aa, Artificial Sequence
  Description of Artificial Sequence: Synthetic peptide
DEQEIATTNPVGTEQYGVMSSTLQHEGDL

SEQ ID NO: 86684 - protein, 33 aa, Artificial Sequence
  Description of Artificial Sequence: Synthetic polypeptide
DEEEIRTTNPVATEQYGSVSTNTHANAIPVSEE

SEQ ID NO: 86685 - protein, 31 aa, Artificial Sequence
  Description of Artificial Sequence: Synthetic polypeptide
DEQEIATTNPVSSEQYGSVSATNLEHEGTDL

SEQ ID NO: 86686 - protein, 33 aa, Artificial Sequence
  Description of Artificial Sequence: Synthetic polypeptide
DEAEICTTNPVATEYYGSVSTGNQGQANGDNED

SEQ ID NO: 86687 - protein, 34 aa, Artificial Sequence
  Description of Artificial Sequence: Synthetic polypeptide
DEAEICTTNPVATEYYGSVSTGNGQEANGDNMRD

SEQ ID NO: 86688 - protein, 31 aa, Artificial Sequence
  Description of Artificial Sequence: Synthetic polypeptide
DEQEIATTNPVSSEQYGSVSTNLEDHEGEDL

SEQ ID NO: 86689 - protein, 32 aa, Artificial Sequence
  Description of Artificial Sequence: Synthetic polypeptide
DEAEICTTNPVAVEQYGSVSTVVTNLNEQTNG

SEQ ID NO: 86690 - protein, 33 aa, Artificial Sequence
  Description of Artificial Sequence: Synthetic polypeptide
DEAEICTTNPVATERYGKVVSLTGNLSQAGGNS

SEQ ID NO: 86691 - protein, 32 aa, Artificial Sequence
  Description of Artificial Sequence: Synthetic polypeptide
DEAEICTTNPVATEQYGTVSTNLNGDHGQGDA

SEQ ID NO: 86692 - protein, 29 aa, Artificial Sequence
  Description of Artificial Sequence: Synthetic peptide
DENEIATTNPVATECYGTVSECLQQHEEL

SEQ ID NO: 86693 - protein, 31 aa, Artificial Sequence
  Description of Artificial Sequence: Synthetic polypeptide
DENEIATTNPVATECYGTVSATDCLVQFGEL

SEQ ID NO: 86694 - protein, 29 aa, Artificial Sequence
  Description of Artificial Sequence: Synthetic peptide
DENEIATTNPVATECYGTVSAECLQFEEL

SEQ ID NO: 86695 - protein, 31 aa, Artificial Sequence
  Description of Artificial Sequence: Synthetic polypeptide
DEAEISTTNPVATEQYGCVCSTELAYFGSQQ

SEQ ID NO: 86696 - protein, 31 aa, Artificial Sequence
  Description of Artificial Sequence: Synthetic polypeptide
DEAEISTTNPVATEQYGCVCSTELAYGSDQS

SEQ ID NO: 86697 - protein, 31 aa, Artificial Sequence
  Description of Artificial Sequence: Synthetic polypeptide
DEQEIATTNPVSTEQYGNVAANDLQDREGQL

SEQ ID NO: 86698 - protein, 33 aa, Artificial Sequence
  Description of Artificial Sequence: Synthetic polypeptide
DEAEICTTNPVATEQYGTVSTVTDGNVEQEGND

SEQ ID NO: 86699 - protein, 31 aa, Artificial Sequence
  Description of Artificial Sequence: Synthetic polypeptide
DEQEIATTNPVGTEQYGSVSTDLEDHEGDDL

SEQ ID NO: 86700 - protein, 31 aa, Artificial Sequence
  Description of Artificial Sequence: Synthetic polypeptide
DEQEIATTNPVGTEQYGSVSATDLEHEGEDL

SEQ ID NO: 86701 - protein, 29 aa, Artificial Sequence
  Description of Artificial Sequence: Synthetic peptide
DEQEIATTNPVGTEQYGSMSSTLEHGEDL

SEQ ID NO: 86702 - protein, 33 aa, Artificial Sequence
  Description of Artificial Sequence: Synthetic polypeptide
DEQEIATTNPVAYEQYGVSVSANDLLNRMGIGR

SEQ ID NO: 86703 - protein, 32 aa, Artificial Sequence
  Description of Artificial Sequence: Synthetic polypeptide
DEEEIRTTNPVATEQYGSVYTMTLEDDMEEVD

SEQ ID NO: 86704 - protein, 33 aa, Artificial Sequence
  Description of Artificial Sequence: Synthetic polypeptide
DEQEIATTNPVAYEQYGVSVSANGLLQRAGMGL

SEQ ID NO: 86705 - protein, 29 aa, Artificial Sequence
  Description of Artificial Sequence: Synthetic peptide
DENEIATTNPVATEPYGTISEDLQQQGEL

SEQ ID NO: 86706 - protein, 31 aa, Artificial Sequence
  Description of Artificial Sequence: Synthetic polypeptide
DENEIATTNPVATEPYGSVSTEDIQDHNGEL

SEQ ID NO: 86707 - protein, 31 aa, Artificial Sequence
  Description of Artificial Sequence: Synthetic polypeptide
DEAEICTTNPVAYEQWGTVSTTNHQGNDDER

SEQ ID NO: 86708 - protein, 31 aa, Artificial Sequence
  Description of Artificial Sequence: Synthetic polypeptide
DEQEIATTNPVAYERWGCVSTGNSQGDGMNR

SEQ ID NO: 86709 - protein, 32 aa, Artificial Sequence
  Description of Artificial Sequence: Synthetic polypeptide
DEQEIATTNPVAYERWGSVSTNLQEGGVNDGE

SEQ ID NO: 86710 - protein, 36 aa, Artificial Sequence
  Description of Artificial Sequence: Synthetic polypeptide
DEEEIRTTNPVATEQYGSVSTNTQNGNQEIGTNNQL

SEQ ID NO: 86711 - protein, 34 aa, Artificial Sequence
  Description of Artificial Sequence: Synthetic polypeptide
DEEEIRTTNPVATEQYGSVYTNDQFDEEEEGGGQ

SEQ ID NO: 86712 - protein, 32 aa, Artificial Sequence
  Description of Artificial Sequence: Synthetic polypeptide
DEQEIATTNPVAYERWGTVSTNLQGNDGDNTR

SEQ ID NO: 86713 - protein, 32 aa, Artificial Sequence
  Description of Artificial Sequence: Synthetic polypeptide
DEAEICTTNPVAYEQWGSVSTNLNMNGDGNND

SEQ ID NO: 86714 - protein, 31 aa, Artificial Sequence
  Description of Artificial Sequence: Synthetic polypeptide
DENEIATTNPVATEPYGSVSATDLEDHEGEL

SEQ ID NO: 86715 - protein, 31 aa, Artificial Sequence
  Description of Artificial Sequence: Synthetic polypeptide
DEAEICTTNPVAYEQWGSVATNNQGADGNAM

SEQ ID NO: 86716 - protein, 31 aa, Artificial Sequence
  Description of Artificial Sequence: Synthetic polypeptide
DEQEIATTNPVAYERYGSVSTGNDPQMDNEV

SEQ ID NO: 86717 - protein, 31 aa, Artificial Sequence
  Description of Artificial Sequence: Synthetic polypeptide
DENEIATTNPVATEPYGEASEENIQQRNGNH

SEQ ID NO: 86718 - protein, 31 aa, Artificial Sequence
  Description of Artificial Sequence: Synthetic polypeptide
DEQEIATTNPVCTETYGSVANPNLQDGENLD

SEQ ID NO: 86719 - protein, 31 aa, Artificial Sequence
  Description of Artificial Sequence: Synthetic polypeptide
DEQEIATTNPVSTEQYGSVSATDLEDHEGEL

SEQ ID NO: 86720 - protein, 32 aa, Artificial Sequence
  Description of Artificial Sequence: Synthetic polypeptide
DEQEIATTNPVSTEQYGSVSATNLEDHEGEDL

SEQ ID NO: 86721 - protein, 31 aa, Artificial Sequence
  Description of Artificial Sequence: Synthetic polypeptide
DEQEIATTNPVSTEQYGSVSTDLEDHEGEDL

SEQ ID NO: 86722 - protein, 32 aa, Artificial Sequence
  Description of Artificial Sequence: Synthetic polypeptide
DEAEISTTNPVATEQYGCVCSTNDAYFGSNQA

SEQ ID NO: 86723 - protein, 32 aa, Artificial Sequence
  Description of Artificial Sequence: Synthetic polypeptide
DEQEIGTTNPVATEQYGSVSATDLEFHEGEDL

SEQ ID NO: 86724 - protein, 32 aa, Artificial Sequence
  Description of Artificial Sequence: Synthetic polypeptide
DEQEIGTTNPVATEQYGSVSATDLEHHEGEDL

SEQ ID NO: 86725 - protein, 32 aa, Artificial Sequence
  Description of Artificial Sequence: Synthetic polypeptide
DEQEIHTTNPVATEQYGSVSATDLEDHEGEDL

SEQ ID NO: 86726 - protein, 32 aa, Artificial Sequence
  Description of Artificial Sequence: Synthetic polypeptide
DEQEIITTNPVATEQYGSVSATDLEDHEGEDL

SEQ ID NO: 86727 - protein, 32 aa, Artificial Sequence
  Description of Artificial Sequence: Synthetic polypeptide
DEQEIITTNPVATEQYGSVSATDLEYHEGEDL

SEQ ID NO: 86728 - protein, 32 aa, Artificial Sequence
  Description of Artificial Sequence: Synthetic polypeptide
DEQEIKTTNPVATEQYGSVSATDLEDHEGEDL

SEQ ID NO: 86729 - protein, 32 aa, Artificial Sequence
  Description of Artificial Sequence: Synthetic polypeptide
DEQEIKTTNPVATEQYGSVSLTDLEDHEGEDL

SEQ ID NO: 86730 - protein, 33 aa, Artificial Sequence
  Description of Artificial Sequence: Synthetic polypeptide
DEEEIRTTNPVATEQYGSVYTTHEEGNGENENG

SEQ ID NO: 86731 - protein, 32 aa, Artificial Sequence
  Description of Artificial Sequence: Synthetic polypeptide
DEQEILTTNPVATEQYGSVSANDLEDHEGEDL

SEQ ID NO: 86732 - protein, 32 aa, Artificial Sequence
  Description of Artificial Sequence: Synthetic polypeptide
DENEIATTNPVATECYGSVSTEPCLQRNEMEV

SEQ ID NO: 86733 - protein, 32 aa, Artificial Sequence
  Description of Artificial Sequence: Synthetic polypeptide
DEQEILTTNPVATEQYGSVSATDLEDHEGEDL

SEQ ID NO: 86734 - protein, 32 aa, Artificial Sequence
  Description of Artificial Sequence: Synthetic polypeptide
DEQEIMTTNPVATEQYGSVSATDLEDHEGEDL

SEQ ID NO: 86735 - protein, 32 aa, Artificial Sequence
  Description of Artificial Sequence: Synthetic polypeptide
DEQEINTTNPVATEQYGSVSATDLEDHEGEDL

SEQ ID NO: 86736 - protein, 32 aa, Artificial Sequence
  Description of Artificial Sequence: Synthetic polypeptide
DENEIATTNPVATECYGSVSTEPCLQRNEMEL

SEQ ID NO: 86737 - protein, 32 aa, Artificial Sequence
  Description of Artificial Sequence: Synthetic polypeptide
DEQEIQTTNPVATEQYGSVSATDLEDHEGEDL

SEQ ID NO: 86738 - protein, 33 aa, Artificial Sequence
  Description of Artificial Sequence: Synthetic polypeptide
DEAEICTTNPVATEQYGEVSTGNTNQDQGPNMT

SEQ ID NO: 86739 - protein, 34 aa, Artificial Sequence
  Description of Artificial Sequence: Synthetic polypeptide
DEAEICTTNPVATEQYGEVSTGNLGNERSGENGS

SEQ ID NO: 86740 - protein, 32 aa, Artificial Sequence
  Description of Artificial Sequence: Synthetic polypeptide
DEQEIGTTNPVATEQYGSVSATDLEDHEGEDL

SEQ ID NO: 86741 - protein, 32 aa, Artificial Sequence
  Description of Artificial Sequence: Synthetic polypeptide
DEQEIRCTNPVATEQYGSVSATDLEDHEGEDL

SEQ ID NO: 86742 - protein, 29 aa, Artificial Sequence
  Description of Artificial Sequence: Synthetic peptide
DENEIATTNPVATECYGTISECLQQHENL

SEQ ID NO: 86743 - protein, 32 aa, Artificial Sequence
  Description of Artificial Sequence: Synthetic polypeptide
DEQEIFTTNPVATEQYGSVSATDLEWHEGEDL

SEQ ID NO: 86744 - protein, 33 aa, Artificial Sequence
  Description of Artificial Sequence: Synthetic polypeptide
DEAEISTTNPVATEQYGCVCSTNHQENFGSERS

SEQ ID NO: 86745 - protein, 32 aa, Artificial Sequence
  Description of Artificial Sequence: Synthetic polypeptide
DEAEISTTNPVATEQYGCVCSTNLAYFNSDQS

SEQ ID NO: 86746 - protein, 34 aa, Artificial Sequence
  Description of Artificial Sequence: Synthetic polypeptide
DEAEICTTNPVATEQYGSVSTPNGLNGNDGMDTR

SEQ ID NO: 86747 - protein, 30 aa, Artificial Sequence
  Description of Artificial Sequence: Synthetic polypeptide
DEQEIATVNPVATEQYGVVSATDLESEGEL

SEQ ID NO: 86748 - protein, 30 aa, Artificial Sequence
  Description of Artificial Sequence: Synthetic polypeptide
DEQEIATVNPVATEQYGVVSATDLESEGEQ

SEQ ID NO: 86749 - protein, 30 aa, Artificial Sequence
  Description of Artificial Sequence: Synthetic polypeptide
DEQEIATVNPVATEQYGVVSDNLEDSEGEL

SEQ ID NO: 86750 - protein, 32 aa, Artificial Sequence
  Description of Artificial Sequence: Synthetic polypeptide
DEQEICTTNPVATEQYGSVSATDLEDHEGEDL

SEQ ID NO: 86751 - protein, 32 aa, Artificial Sequence
  Description of Artificial Sequence: Synthetic polypeptide
DEQEICTTNPVATEQYGSVSSTLLEDTEGEAL

SEQ ID NO: 86752 - protein, 32 aa, Artificial Sequence
  Description of Artificial Sequence: Synthetic polypeptide
DEQEICTTNPVATEQYGSVSSTQLEDTEGEDE

SEQ ID NO: 86753 - protein, 32 aa, Artificial Sequence
  Description of Artificial Sequence: Synthetic polypeptide
DEQEICTTNPVATEQYGSVSTTDNENTEGEDL

SEQ ID NO: 86754 - protein, 32 aa, Artificial Sequence
  Description of Artificial Sequence: Synthetic polypeptide
DEQEICTTNPVATEQYGSVSVTDLENNEGEDE

SEQ ID NO: 86755 - protein, 32 aa, Artificial Sequence
  Description of Artificial Sequence: Synthetic polypeptide
DEQEICTTNPVATEQYGSVSVTTLEDTEGEDQ

SEQ ID NO: 86756 - protein, 32 aa, Artificial Sequence
  Description of Artificial Sequence: Synthetic polypeptide
DEQEICTVNPVATEQYGSVITNGLGGGEDNEQ

SEQ ID NO: 86757 - protein, 32 aa, Artificial Sequence
  Description of Artificial Sequence: Synthetic polypeptide
DEQEIDTTNPVATEQYGSVSATDLEDHEGEDL

SEQ ID NO: 86758 - protein, 32 aa, Artificial Sequence
  Description of Artificial Sequence: Synthetic polypeptide
DEQEIETTNPVATEQYGSVSATDLEDHEGEDL

SEQ ID NO: 86759 - protein, 32 aa, Artificial Sequence
  Description of Artificial Sequence: Synthetic polypeptide
DEQEIETTNPVATEQYGSVSATDLEIHEGEDL

SEQ ID NO: 86760 - protein, 32 aa, Artificial Sequence
  Description of Artificial Sequence: Synthetic polypeptide
DEQEIFTTNPVATEQYGSVSATDLEDHEGEDL

SEQ ID NO: 86761 - protein, 32 aa, Artificial Sequence
  Description of Artificial Sequence: Synthetic polypeptide
DEQEIGTTNPVATEQYGSVSATDLEDHEGEDF

SEQ ID NO: 86762 - protein, 32 aa, Artificial Sequence
  Description of Artificial Sequence: Synthetic polypeptide
DECEIATTNPVATENYGSVSTTGPMAGNDNQR

SEQ ID NO: 86763 - protein, 30 aa, Artificial Sequence
  Description of Artificial Sequence: Synthetic polypeptide
DENEIRTTNPVATECYGATANEDLARGGYR

SEQ ID NO: 86764 - protein, 32 aa, Artificial Sequence
  Description of Artificial Sequence: Synthetic polypeptide
DEQEIATTNPVATEQYGSVSATDLEDHEGQDL

SEQ ID NO: 86765 - protein, 34 aa, Artificial Sequence
  Description of Artificial Sequence: Synthetic polypeptide
DEAEIRTTNPVATEQYGSVPSDWNLEERQSDNQQ

SEQ ID NO: 86766 - protein, 30 aa, Artificial Sequence
  Description of Artificial Sequence: Synthetic polypeptide
DENEIRTTNPVATEQYGDVSEILMNAAEDA

SEQ ID NO: 86767 - protein, 33 aa, Artificial Sequence
  Description of Artificial Sequence: Synthetic polypeptide
DEPEIATTNPVATEQYGSVSATDLQEDYEGESE

SEQ ID NO: 86768 - protein, 32 aa, Artificial Sequence
  Description of Artificial Sequence: Synthetic polypeptide
DEAEIRTTNPVATEQYGSVPTDTLESTENMQQ

SEQ ID NO: 86769 - protein, 33 aa, Artificial Sequence
  Description of Artificial Sequence: Synthetic polypeptide
DEEEIRTTNPVATEQYGSVSTYSISVRDEVFSD

SEQ ID NO: 86770 - protein, 30 aa, Artificial Sequence
  Description of Artificial Sequence: Synthetic polypeptide
DENEIRTTNPVATEQYGDVSEIEQNAAEDA

SEQ ID NO: 86771 - protein, 31 aa, Artificial Sequence
  Description of Artificial Sequence: Synthetic polypeptide
DENEIRTTNPVATEQYGDVSEIENMAAENPA

SEQ ID NO: 86772 - protein, 35 aa, Artificial Sequence
  Description of Artificial Sequence: Synthetic polypeptide
DEAEIRTTNPVATEQYGSVPSCTNESSGRGQNMEI

SEQ ID NO: 86773 - protein, 29 aa, Artificial Sequence
  Description of Artificial Sequence: Synthetic peptide
DENEIRTTNPVATEQYGDVSEIEMNHEEA

SEQ ID NO: 86774 - protein, 30 aa, Artificial Sequence
  Description of Artificial Sequence: Synthetic polypeptide
DENEIRTTNPVATEQYGDVSEIEMNANEDV

SEQ ID NO: 86775 - protein, 30 aa, Artificial Sequence
  Description of Artificial Sequence: Synthetic polypeptide
DENEIRTTNPVATEQYGDVSEIEMNAEGDA

SEQ ID NO: 86776 - protein, 29 aa, Artificial Sequence
  Description of Artificial Sequence: Synthetic peptide
DENEIRTTNPVATEQYGDVSEIEMNAEDA

SEQ ID NO: 86777 - protein, 30 aa, Artificial Sequence
  Description of Artificial Sequence: Synthetic polypeptide
DENEIRTTNPVATEQYGDVSEIEMNAAEDR

SEQ ID NO: 86778 - protein, 33 aa, Artificial Sequence
  Description of Artificial Sequence: Synthetic polypeptide
DEPEIATTNPVAYEQYGSVSTGNQHQERGGGEA

SEQ ID NO: 86779 - protein, 30 aa, Artificial Sequence
  Description of Artificial Sequence: Synthetic polypeptide
DENEIRTTNPVATEQYGDVSEIEENAAGDA

SEQ ID NO: 86780 - protein, 33 aa, Artificial Sequence
  Description of Artificial Sequence: Synthetic polypeptide
CEEEIRTTNPVATEQYGCVCSTETNQNFGSNQE

SEQ ID NO: 86781 - protein, 30 aa, Artificial Sequence
  Description of Artificial Sequence: Synthetic polypeptide
DENEIRTTNPVATEQYGDVSEIEMNANGDV

SEQ ID NO: 86782 - protein, 32 aa, Artificial Sequence
  Description of Artificial Sequence: Synthetic polypeptide
DEPEIATTNPVATEQYGSVSATDLETHEGEDL

SEQ ID NO: 86783 - protein, 32 aa, Artificial Sequence
  Description of Artificial Sequence: Synthetic polypeptide
DEPEIATTNPVATEQYGSVSATDLEHHEGEDE

SEQ ID NO: 86784 - protein, 32 aa, Artificial Sequence
  Description of Artificial Sequence: Synthetic polypeptide
DEPEIATTNPVATEQYGSVSATDLEDYEGEDL

SEQ ID NO: 86785 - protein, 32 aa, Artificial Sequence
  Description of Artificial Sequence: Synthetic polypeptide
DEEEIRTTNPVATEQYGSVSVDPMPRVVQDFD

SEQ ID NO: 86786 - protein, 31 aa, Artificial Sequence
  Description of Artificial Sequence: Synthetic polypeptide
DENEIRTTNPVATEQYGEASSEPAGQRNGGV

SEQ ID NO: 86787 - protein, 31 aa, Artificial Sequence
  Description of Artificial Sequence: Synthetic polypeptide
DENEIRTTNPVATEQYGDVSTPIGMNAAENA

SEQ ID NO: 86788 - protein, 33 aa, Artificial Sequence
  Description of Artificial Sequence: Synthetic polypeptide
CEEEIRTTNPVATEQYGCVCSTGNDQFFGSDQG

SEQ ID NO: 86789 - protein, 31 aa, Artificial Sequence
  Description of Artificial Sequence: Synthetic polypeptide
DENEIRTTNPVATEQYGDVSTIEMMANEDPA

SEQ ID NO: 86790 - protein, 34 aa, Artificial Sequence
  Description of Artificial Sequence: Synthetic polypeptide
DEPEIATTNPVATAQYGSVVSTTLNLPERQGLNQ

SEQ ID NO: 86791 - protein, 31 aa, Artificial Sequence
  Description of Artificial Sequence: Synthetic polypeptide
DENEIRTTNPVATEQYGDVSTDLMNHEEEDA

SEQ ID NO: 86792 - protein, 31 aa, Artificial Sequence
  Description of Artificial Sequence: Synthetic polypeptide
DENEIRTTNPVATEQYGDVSTDEMNHEEEDA

SEQ ID NO: 86793 - protein, 35 aa, Artificial Sequence
  Description of Artificial Sequence: Synthetic polypeptide
DEEEIRTTNPVATEQYGSVSVCDDMQNDVGNSDRF

SEQ ID NO: 86794 - protein, 32 aa, Artificial Sequence
  Description of Artificial Sequence: Synthetic polypeptide
DENEIRTTNPVATEQYGDVSTAGPMNANGNPV

SEQ ID NO: 86795 - protein, 32 aa, Artificial Sequence
  Description of Artificial Sequence: Synthetic polypeptide
DEPEIATTNPVATEQYGSVPSNNQLEVGFEEF

SEQ ID NO: 86796 - protein, 32 aa, Artificial Sequence
  Description of Artificial Sequence: Synthetic polypeptide
DENEIRTTNPVATEQYGDVSMEIIQQQANGNA

SEQ ID NO: 86797 - protein, 32 aa, Artificial Sequence
  Description of Artificial Sequence: Synthetic polypeptide
DENEIRTTNPVATEQYGDVSMEIIQQNAAGNA

SEQ ID NO: 86798 - protein, 32 aa, Artificial Sequence
  Description of Artificial Sequence: Synthetic polypeptide
DENEIRTTNPVATEQYGDVSMEDIQQQANGNA

SEQ ID NO: 86799 - protein, 31 aa, Artificial Sequence
  Description of Artificial Sequence: Synthetic polypeptide
DEPEIATTNPVATEQYGSVPSNVEMEVGNTF

SEQ ID NO: 86800 - protein, 32 aa, Artificial Sequence
  Description of Artificial Sequence: Synthetic polypeptide
DEPEIATTNPVATEQYGSVSATDLEDHEGEDL

SEQ ID NO: 86801 - protein, 32 aa, Artificial Sequence
  Description of Artificial Sequence: Synthetic polypeptide
DEPEIATTNPVATEQYGSVSATDLEDHQGEDQ

SEQ ID NO: 86802 - protein, 32 aa, Artificial Sequence
  Description of Artificial Sequence: Synthetic polypeptide
DENEIRTTNPVATEQYGDVSEEIIQQNAAGNA

SEQ ID NO: 86803 - protein, 33 aa, Artificial Sequence
  Description of Artificial Sequence: Synthetic polypeptide
CEEEIRTTNPVATEQYGCVCSTNHQFFNSNNQE

SEQ ID NO: 86804 - protein, 30 aa, Artificial Sequence
  Description of Artificial Sequence: Synthetic polypeptide
DENEIRTTNPVATEQYGDVSEDLENAAEDA

SEQ ID NO: 86805 - protein, 30 aa, Artificial Sequence
  Description of Artificial Sequence: Synthetic polypeptide
DENEIRTTNPVATEQYGDVSEDIQNAAEDA

SEQ ID NO: 86806 - protein, 34 aa, Artificial Sequence
  Description of Artificial Sequence: Synthetic polypeptide
DEEEIRTTNPVATEQYGSVTPTHLAQQRIVDEDL

SEQ ID NO: 86807 - protein, 33 aa, Artificial Sequence
  Description of Artificial Sequence: Synthetic polypeptide
DEEEIRTTNPVATEQYGSVTPTLIQVTEVMNEL

SEQ ID NO: 86808 - protein, 32 aa, Artificial Sequence
  Description of Artificial Sequence: Synthetic polypeptide
DEPEIRTTNPVATDQYGDVSTQNGGEGEGNDQ

SEQ ID NO: 86809 - protein, 31 aa, Artificial Sequence
  Description of Artificial Sequence: Synthetic polypeptide
DEPEIRTTNPVATDQYGDVSVNGFEGGGENT

SEQ ID NO: 86810 - protein, 30 aa, Artificial Sequence
  Description of Artificial Sequence: Synthetic polypeptide
DENEIRTTNPVATEQYGDASENEMNAAEGR

SEQ ID NO: 86811 - protein, 28 aa, Artificial Sequence
  Description of Artificial Sequence: Synthetic peptide
DENEIRTTNPVATEQYGDAPEVCQHEDK

SEQ ID NO: 86812 - protein, 32 aa, Artificial Sequence
  Description of Artificial Sequence: Synthetic polypeptide
DEPEIRTTNPVATDQYGDVVTDNGLGEGDGNT

SEQ ID NO: 86813 - protein, 33 aa, Artificial Sequence
  Description of Artificial Sequence: Synthetic polypeptide
CEEEIRTTNPVATEQYGCVCSTEHNQNFGSNQF

SEQ ID NO: 86814 - protein, 28 aa, Artificial Sequence
  Description of Artificial Sequence: Synthetic peptide
DENEIRTTNPVATEQYGDAPEVCQHEDA

SEQ ID NO: 86815 - protein, 32 aa, Artificial Sequence
  Description of Artificial Sequence: Synthetic polypeptide
DENEIRTTNPVATEQYGCVSVLLLENQGTDER

SEQ ID NO: 86816 - protein, 32 aa, Artificial Sequence
  Description of Artificial Sequence: Synthetic polypeptide
CEEEIRTTNPVATEQYGCVCSTEDQHFGSEQN

SEQ ID NO: 86817 - protein, 31 aa, Artificial Sequence
  Description of Artificial Sequence: Synthetic polypeptide
DEAEIRTTNPVATEQYGSVSMDLNTPESDQQ

SEQ ID NO: 86818 - protein, 31 aa, Artificial Sequence
  Description of Artificial Sequence: Synthetic polypeptide
DEAEIRTTNPVATEQYGSVSMDMNRIESDQN

SEQ ID NO: 86819 - protein, 32 aa, Artificial Sequence
  Description of Artificial Sequence: Synthetic polypeptide
DENEIRTTNPVATEQYGCVSTNEDEMGPGQQS

SEQ ID NO: 86820 - protein, 33 aa, Artificial Sequence
  Description of Artificial Sequence: Synthetic polypeptide
DEPEIRTTNPVATECWGSVSCINEPQDREGENG

SEQ ID NO: 86821 - protein, 34 aa, Artificial Sequence
  Description of Artificial Sequence: Synthetic polypeptide
DEEEIRTTNPVATEQYGSVSTYNKHSDEGPMSPQ

SEQ ID NO: 86822 - protein, 28 aa, Artificial Sequence
  Description of Artificial Sequence: Synthetic peptide
DENEIRTTNPVATEQYGDAPEICQHEDA

SEQ ID NO: 86823 - protein, 32 aa, Artificial Sequence
  Description of Artificial Sequence: Synthetic polypeptide
DEPEIRTTNPVATDQYGDVSTNGEEEGGQGNI

SEQ ID NO: 86824 - protein, 31 aa, Artificial Sequence
  Description of Artificial Sequence: Synthetic polypeptide
DENEIRTTNPVATEQYGDVCSEIEVEAAGNA

SEQ ID NO: 86825 - protein, 33 aa, Artificial Sequence
  Description of Artificial Sequence: Synthetic polypeptide
CEEEIRTTNPVATEQYGCVCSTEHQGSGSNNQS

SEQ ID NO: 86826 - protein, 30 aa, Artificial Sequence
  Description of Artificial Sequence: Synthetic polypeptide
DENEIRTTNPVATEQYGDVSEDEQNAAEDA

SEQ ID NO: 86827 - protein, 33 aa, Artificial Sequence
  Description of Artificial Sequence: Synthetic polypeptide
DEEEIRTTNPVATEQYGSVTPEWVMEQRPENYL

SEQ ID NO: 86828 - protein, 33 aa, Artificial Sequence
  Description of Artificial Sequence: Synthetic polypeptide
DEAEIRTTNPVATEQYGSVSDAWDAQLGQEDGN

SEQ ID NO: 86829 - protein, 30 aa, Artificial Sequence
  Description of Artificial Sequence: Synthetic polypeptide
DENEIRTTNPVATEQYGDVSEDEMNAAGDL

SEQ ID NO: 86830 - protein, 31 aa, Artificial Sequence
  Description of Artificial Sequence: Synthetic polypeptide
DEAEIRTTNPVATEQYGSVSDDLNTIESDQT

SEQ ID NO: 86831 - protein, 30 aa, Artificial Sequence
  Description of Artificial Sequence: Synthetic polypeptide
DENEIRTTNPVATEQYGDVSECEQNAAEDL

SEQ ID NO: 86832 - protein, 32 aa, Artificial Sequence
  Description of Artificial Sequence: Synthetic polypeptide
DEAEIRTTNPVATEQYGSVSDTETDMHIRSEH

SEQ ID NO: 86833 - protein, 32 aa, Artificial Sequence
  Description of Artificial Sequence: Synthetic polypeptide
DEPEIGTTNPVATEQYGSVCTNAGMEGGNDGT

SEQ ID NO: 86834 - protein, 34 aa, Artificial Sequence
  Description of Artificial Sequence: Synthetic polypeptide
DEEEIRTTNPVATEQYGSVTPLDDLEQTQGQDRQ

SEQ ID NO: 86835 - protein, 34 aa, Artificial Sequence
  Description of Artificial Sequence: Synthetic polypeptide
DEAEIRTTNPVATEQYGSVSDTQLTQVELFENGL

SEQ ID NO: 86836 - protein, 34 aa, Artificial Sequence
  Description of Artificial Sequence: Synthetic polypeptide
DEPEIGTTNPVATEQYGSVSTLGQLGQEEMGNNL

SEQ ID NO: 86837 - protein, 30 aa, Artificial Sequence
  Description of Artificial Sequence: Synthetic polypeptide
DENEIRTTNPVATEQYGDVSECEQNAAEDA

SEQ ID NO: 86838 - protein, 33 aa, Artificial Sequence
  Description of Artificial Sequence: Synthetic polypeptide
DEEEIRTTNPVATEQYGSVTPMDGLEQQGQDDQ

SEQ ID NO: 86839 - protein, 34 aa, Artificial Sequence
  Description of Artificial Sequence: Synthetic polypeptide
DEEEIRTTNPVATEQYGSVTPMSNLEQREEEILQ

SEQ ID NO: 86840 - protein, 31 aa, Artificial Sequence
  Description of Artificial Sequence: Synthetic polypeptide
DENEIRTTNPVATEQYGDVSAEDLENHAGDA

SEQ ID NO: 86841 - protein, 33 aa, Artificial Sequence
  Description of Artificial Sequence: Synthetic polypeptide
CEEEIRTTNPVATEQYGCVCSTELQNFNSDTQS

SEQ ID NO: 86842 - protein, 31 aa, Artificial Sequence
  Description of Artificial Sequence: Synthetic polypeptide
DENEIRTTNPVATEQYGDVCSEIEVEAAGND

SEQ ID NO: 86843 - protein, 33 aa, Artificial Sequence
  Description of Artificial Sequence: Synthetic polypeptide
DEEEIRTTNPVATEQYGSVTPADNEIGRGVDQT

SEQ ID NO: 86844 - protein, 30 aa, Artificial Sequence
  Description of Artificial Sequence: Synthetic polypeptide
DENEIRTTNPVATEQYGEVSEIEQNAAEDA

SEQ ID NO: 86845 - protein, 35 aa, Artificial Sequence
  Description of Artificial Sequence: Synthetic polypeptide
DEEEIRTTNPVATEQYGSVTGDGNLDQEGEENNQQ

SEQ ID NO: 86846 - protein, 35 aa, Artificial Sequence
  Description of Artificial Sequence: Synthetic polypeptide
DENEIRTTNPVATEQYGMSCVSDTDEMLQVGGNIH

SEQ ID NO: 86847 - protein, 33 aa, Artificial Sequence
  Description of Artificial Sequence: Synthetic polypeptide
DENEIRTTNPVATEQYGSCWTSVNLQERSEFQD

SEQ ID NO: 86848 - protein, 32 aa, Artificial Sequence
  Description of Artificial Sequence: Synthetic polypeptide
DEAEIRTTNPVATEQYGSVIYTTHEEGNGNEF

SEQ ID NO: 86849 - protein, 34 aa, Artificial Sequence
  Description of Artificial Sequence: Synthetic polypeptide
DENEIRTTNPVATEQYGSCWSVTHNLQTGEEQQY

SEQ ID NO: 86850 - protein, 31 aa, Artificial Sequence
  Description of Artificial Sequence: Synthetic polypeptide
DENEIVTTNPVATEQYGDVSTDCLVEHEGEL

SEQ ID NO: 86851 - protein, 31 aa, Artificial Sequence
  Description of Artificial Sequence: Synthetic polypeptide
DENEIVTTNPVATEQYGDVSTDCPVEHEGNL

SEQ ID NO: 86852 - protein, 30 aa, Artificial Sequence
  Description of Artificial Sequence: Synthetic polypeptide
DENEIVTTNPVATEQYGDVSTGEVEFAGDA

SEQ ID NO: 86853 - protein, 36 aa, Artificial Sequence
  Description of Artificial Sequence: Synthetic polypeptide
DEEEIRTTNPVATEQYGSVTDGTMNLVQNGGGNGQA

SEQ ID NO: 86854 - protein, 30 aa, Artificial Sequence
  Description of Artificial Sequence: Synthetic polypeptide
DENEIVTTNPVATEQWGTVSTIPMNAEGNA

SEQ ID NO: 86855 - protein, 32 aa, Artificial Sequence
  Description of Artificial Sequence: Synthetic polypeptide
DENEIVTTNPVATEQYGEASATDGPVQREGND

SEQ ID NO: 86856 - protein, 32 aa, Artificial Sequence
  Description of Artificial Sequence: Synthetic polypeptide
DENEIVTTNPVATEQYGEVSATDGPVQFEGND

SEQ ID NO: 86857 - protein, 33 aa, Artificial Sequence
  Description of Artificial Sequence: Synthetic polypeptide
DENEIVTTNPVATEQYGSVSATLDLEQHEGEDT

SEQ ID NO: 86858 - protein, 32 aa, Artificial Sequence
  Description of Artificial Sequence: Synthetic polypeptide
DENEIVTTNPVATEQYGTVCSATDGLQFEGGD

SEQ ID NO: 86859 - protein, 32 aa, Artificial Sequence
  Description of Artificial Sequence: Synthetic polypeptide
DENEIVTTNPVATEQYGTVCSATDGPVQFGND

SEQ ID NO: 86860 - protein, 34 aa, Artificial Sequence
  Description of Artificial Sequence: Synthetic polypeptide
DEEEIRTTNPVATEQYGSVSVNLMNNTIEVDNGH

SEQ ID NO: 86861 - protein, 31 aa, Artificial Sequence
  Description of Artificial Sequence: Synthetic polypeptide
DENEIVTTNPVATEQYGTVCSEDGPEFEGNR

SEQ ID NO: 86862 - protein, 34 aa, Artificial Sequence
  Description of Artificial Sequence: Synthetic polypeptide
DENEIRTTNPVATEQYGSCWSTSVNLENRGEFQD

SEQ ID NO: 86863 - protein, 32 aa, Artificial Sequence
  Description of Artificial Sequence: Synthetic polypeptide
DENEIVTTNPVATEQYGEVCSATDGPVQFGND

SEQ ID NO: 86864 - protein, 35 aa, Artificial Sequence
  Description of Artificial Sequence: Synthetic polypeptide
DENEIRTTNPVATEQYGSFVCSYTNPQTRMVNQQE

SEQ ID NO: 86865 - protein, 33 aa, Artificial Sequence
  Description of Artificial Sequence: Synthetic polypeptide
DEEEIRTTNPVATEQYGSVSVNNLEETPLTEMD

SEQ ID NO: 86866 - protein, 30 aa, Artificial Sequence
  Description of Artificial Sequence: Synthetic polypeptide
DENEIVTTNPVATEQWGDVSTIEMNAEGNA

SEQ ID NO: 86867 - protein, 31 aa, Artificial Sequence
  Description of Artificial Sequence: Synthetic polypeptide
DENEIRTTNPVATEQYGSSSVPNDQLFSQEE

SEQ ID NO: 86868 - protein, 32 aa, Artificial Sequence
  Description of Artificial Sequence: Synthetic polypeptide
DENEIRTTNPVATEQYGSSSTVLPDNIDNGQE

SEQ ID NO: 86869 - protein, 34 aa, Artificial Sequence
  Description of Artificial Sequence: Synthetic polypeptide
DENEIRTTNPVATEQYGSISTTPDGQNMRNGMNV

SEQ ID NO: 86870 - protein, 32 aa, Artificial Sequence
  Description of Artificial Sequence: Synthetic polypeptide
DEEEIRTTNPVATEQYGSVSVPSVYRSMSEGF

SEQ ID NO: 86871 - protein, 31 aa, Artificial Sequence
  Description of Artificial Sequence: Synthetic polypeptide
DENEIRTVNPVSTEQYGTVSMENIQQQNGNH

SEQ ID NO: 86872 - protein, 33 aa, Artificial Sequence
  Description of Artificial Sequence: Synthetic polypeptide
DENEIRTTNPVATEQYGSISLTFNETIVHEGLR

SEQ ID NO: 86873 - protein, 34 aa, Artificial Sequence
  Description of Artificial Sequence: Synthetic polypeptide
DENEIRTTNPVATEQYGSISLTFNETIRPGLERG

SEQ ID NO: 86874 - protein, 34 aa, Artificial Sequence
  Description of Artificial Sequence: Synthetic polypeptide
DENEIRTTNPVATEQYGSISLTFNETIREGDLRG

SEQ ID NO: 86875 - protein, 33 aa, Artificial Sequence
  Description of Artificial Sequence: Synthetic polypeptide
CEEEIRTTNPVATEQYGCVCSWGNLQNFGSEQN

SEQ ID NO: 86876 - protein, 31 aa, Artificial Sequence
  Description of Artificial Sequence: Synthetic polypeptide
DENEIVCTNPVATEQYGTVSAEDNPVEFGNR

SEQ ID NO: 86877 - protein, 34 aa, Artificial Sequence
  Description of Artificial Sequence: Synthetic polypeptide
DENEIRTTNPVATEQYGSISLTFNEIIREGLTRG

SEQ ID NO: 86878 - protein, 33 aa, Artificial Sequence
  Description of Artificial Sequence: Synthetic polypeptide
DEEEIRTTNPVATEQYGSVTDDNMTMEFEGENG

SEQ ID NO: 86879 - protein, 32 aa, Artificial Sequence
  Description of Artificial Sequence: Synthetic polypeptide
DENEIRTTNPVATEQYGSISATDIEDQEGEDL

SEQ ID NO: 86880 - protein, 31 aa, Artificial Sequence
  Description of Artificial Sequence: Synthetic polypeptide
DENEIRTTNPVATEQYGSISAMDIEDQEGEL

SEQ ID NO: 86881 - protein, 35 aa, Artificial Sequence
  Description of Artificial Sequence: Synthetic polypeptide
DEAEIRTTNPVATEQYGSVISTTNDINQNGSNQQE

SEQ ID NO: 86882 - protein, 36 aa, Artificial Sequence
  Description of Artificial Sequence: Synthetic polypeptide
DEEEIRTTNPVATEQYGSVSVNNVALEQPNGQNDNV

SEQ ID NO: 86883 - protein, 35 aa, Artificial Sequence
  Description of Artificial Sequence: Synthetic polypeptide
DEAEIRTTNPVATEQYGSVISTTNDLNNNGSNNEE

SEQ ID NO: 86884 - protein, 31 aa, Artificial Sequence
  Description of Artificial Sequence: Synthetic polypeptide
DENEIVTTNPVATEQYGTVCSTDGPEFEGND

SEQ ID NO: 86885 - protein, 32 aa, Artificial Sequence
  Description of Artificial Sequence: Synthetic polypeptide
DENEIVTTNPVATEQYGTVCSTEGPVQQEGND

SEQ ID NO: 86886 - protein, 35 aa, Artificial Sequence
  Description of Artificial Sequence: Synthetic polypeptide
DEEEIRTTNPVATEQYGSVTDTMNNVQGNGGNGQD

SEQ ID NO: 86887 - protein, 29 aa, Artificial Sequence
  Description of Artificial Sequence: Synthetic peptide
DENEIVTTNPVATEQYGTVSEIPEFEGDD

SEQ ID NO: 86888 - protein, 33 aa, Artificial Sequence
  Description of Artificial Sequence: Synthetic polypeptide
DENEIRTTNPVATEQYGSCMDTDLEQFRGEGID

SEQ ID NO: 86889 - protein, 33 aa, Artificial Sequence
  Description of Artificial Sequence: Synthetic polypeptide
DEEEIRTTNPVATEQYGSVTEEMLMDERLLNLE

SEQ ID NO: 86890 - protein, 35 aa, Artificial Sequence
  Description of Artificial Sequence: Synthetic polypeptide
DEAEIRTTNPVATEQYGSVNSTNDDDQRGGEEVIN

SEQ ID NO: 86891 - protein, 35 aa, Artificial Sequence
  Description of Artificial Sequence: Synthetic polypeptide
DEEEIRTTNPVATEQYGSVTEENSLEQQPGVPERQ

SEQ ID NO: 86892 - protein, 34 aa, Artificial Sequence
  Description of Artificial Sequence: Synthetic polypeptide
DEAEIRTTNPVATEQYGSVNSTNDDSRSGQEEIS

SEQ ID NO: 86893 - protein, 34 aa, Artificial Sequence
  Description of Artificial Sequence: Synthetic polypeptide
DEAEIRTTNPVATEQYGSVNSTNNEDQEGQTDEN

SEQ ID NO: 86894 - protein, 34 aa, Artificial Sequence
  Description of Artificial Sequence: Synthetic polypeptide
DEAEIRTTNPVATEQYGSVNSTNNEQMEGQTEEN

SEQ ID NO: 86895 - protein, 33 aa, Artificial Sequence
  Description of Artificial Sequence: Synthetic polypeptide
DEAEIRTTNPVATEQYGSVNSVNDEQQQGIEQN

SEQ ID NO: 86896 - protein, 30 aa, Artificial Sequence
  Description of Artificial Sequence: Synthetic polypeptide
DENEIRTTNPVATEQYGNVSNTIMSAVEDA

SEQ ID NO: 86897 - protein, 30 aa, Artificial Sequence
  Description of Artificial Sequence: Synthetic polypeptide
DENEIRTTNPVATEQYGNVSNTIMNAVEDA

SEQ ID NO: 86898 - protein, 29 aa, Artificial Sequence
  Description of Artificial Sequence: Synthetic peptide
DENEVATTNPVSTEGYGNVSNTLQSHGQR

SEQ ID NO: 86899 - protein, 30 aa, Artificial Sequence
  Description of Artificial Sequence: Synthetic polypeptide
DENEVRTTNPVSTEPYGTVSMDIQQRNGNH

SEQ ID NO: 86900 - protein, 30 aa, Artificial Sequence
  Description of Artificial Sequence: Synthetic polypeptide
DENEIRTTNPVATEQYGNVSNTEMNAVEDA

SEQ ID NO: 86901 - protein, 33 aa, Artificial Sequence
  Description of Artificial Sequence: Synthetic polypeptide
DEAEIRTTNPVATEQYGSVNTNPDENGTEENEV

SEQ ID NO: 86902 - protein, 33 aa, Artificial Sequence
  Description of Artificial Sequence: Synthetic polypeptide
DEAEIRTTNPVATEQYGSVNTTWVNQRVTQNDN

SEQ ID NO: 86903 - protein, 34 aa, Artificial Sequence
  Description of Artificial Sequence: Synthetic polypeptide
DEEEIRTTNPVATEQYGSVSVENGVQRQMPEAQT

SEQ ID NO: 86904 - protein, 30 aa, Artificial Sequence
  Description of Artificial Sequence: Synthetic polypeptide
DENEIRTTNPVATEQYGNVSETEMNAVEDA

SEQ ID NO: 86905 - protein, 31 aa, Artificial Sequence
  Description of Artificial Sequence: Synthetic polypeptide
DENEVASTNPVATEGYGEVSANTLQSRVGQR

SEQ ID NO: 86906 - protein, 31 aa, Artificial Sequence
  Description of Artificial Sequence: Synthetic polypeptide
DENEIRTTNPVATEQYGCVSTLMDETDENIS

SEQ ID NO: 86907 - protein, 36 aa, Artificial Sequence
  Description of Artificial Sequence: Synthetic polypeptide
DEEEIRTTNPVATEQYGSVSVLMNNLQQTEGANNEE

SEQ ID NO: 86908 - protein, 29 aa, Artificial Sequence
  Description of Artificial Sequence: Synthetic peptide
DENEVACTNPVATEGYGEVAENIQSRGGR

SEQ ID NO: 86909 - protein, 32 aa, Artificial Sequence
  Description of Artificial Sequence: Synthetic polypeptide
DEAEIRTTNPVATEQYGSVNNSNDSEGNENQV

SEQ ID NO: 86910 - protein, 32 aa, Artificial Sequence
  Description of Artificial Sequence: Synthetic polypeptide
DENEIVTTNPVATEQYGTVSTDGIQEQFNGND

SEQ ID NO: 86911 - protein, 32 aa, Artificial Sequence
  Description of Artificial Sequence: Synthetic polypeptide
DENEIVTTNPVATEQYGTVSTDGIVQQFNGNH

SEQ ID NO: 86912 - protein, 31 aa, Artificial Sequence
  Description of Artificial Sequence: Synthetic polypeptide
DENEIVTTNPVATEQYGTVSTGPVMNAEGNA

SEQ ID NO: 86913 - protein, 32 aa, Artificial Sequence
  Description of Artificial Sequence: Synthetic polypeptide
CEEEIRTTNPVATEQYGCVCSWELQGFNSDQA

SEQ ID NO: 86914 - protein, 34 aa, Artificial Sequence
  Description of Artificial Sequence: Synthetic polypeptide
DEEEIRTTNPVATEQYGSVTDTMTGLQGEGQTGQ

SEQ ID NO: 86915 - protein, 31 aa, Artificial Sequence
  Description of Artificial Sequence: Synthetic polypeptide
DENEIVTTNPVSTEQYGTVSTDDIQQFEGND

SEQ ID NO: 86916 - protein, 31 aa, Artificial Sequence
  Description of Artificial Sequence: Synthetic polypeptide
DENEIVTTNPVSTEQYGTVSTDDIVQFEGND

SEQ ID NO: 86917 - protein, 31 aa, Artificial Sequence
  Description of Artificial Sequence: Synthetic polypeptide
DENEIVTTNPVSTEQYGTVSTDDPQEQNGNH

SEQ ID NO: 86918 - protein, 32 aa, Artificial Sequence
  Description of Artificial Sequence: Synthetic polypeptide
DEAEIRTTNPVATEQYGSVNSADQNRDENHPG

SEQ ID NO: 86919 - protein, 34 aa, Artificial Sequence
  Description of Artificial Sequence: Synthetic polypeptide
DEEEIRTTNPVATEQYGSVTDTMTGLQMEGQIGM

SEQ ID NO: 86920 - protein, 34 aa, Artificial Sequence
  Description of Artificial Sequence: Synthetic polypeptide
DEEEIRTTNPVATEQYGSVSVMMLNQIENENLED

SEQ ID NO: 86921 - protein, 33 aa, Artificial Sequence
  Description of Artificial Sequence: Synthetic polypeptide
DEEEIRTTNPVATEQYGSVSVMLPDIPMVVERE

SEQ ID NO: 86922 - protein, 31 aa, Artificial Sequence
  Description of Artificial Sequence: Synthetic polypeptide
DENEIVTTNPVSTEQYGTVSTDDPQQQNGNH

SEQ ID NO: 86923 - protein, 34 aa, Artificial Sequence
  Description of Artificial Sequence: Synthetic polypeptide
DEEEIRTTNPVATEQYGSVTDTMTGLQNEGQEGE

SEQ ID NO: 86924 - protein, 32 aa, Artificial Sequence
  Description of Artificial Sequence: Synthetic polypeptide
DEEEIRTTNPVATEQYGSVSVMDHMPRVVQDD

SEQ ID NO: 86925 - protein, 33 aa, Artificial Sequence
  Description of Artificial Sequence: Synthetic polypeptide
DENEIRTTNPVATEQYGSCPSTMNDMTEGNESM

SEQ ID NO: 86926 - protein, 29 aa, Artificial Sequence
  Description of Artificial Sequence: Synthetic peptide
DENEVACTNPVATEGYGEVANNIQSRGGR

SEQ ID NO: 86927 - protein, 30 aa, Artificial Sequence
  Description of Artificial Sequence: Synthetic polypeptide
DENEIRTVNPVATEQWGDVSENLQNSAEDA

SEQ ID NO: 86928 - protein, 34 aa, Artificial Sequence
  Description of Artificial Sequence: Synthetic polypeptide
DEEEIRTTNPVATEQYGSVSTYNGLLEMTAEELE

SEQ ID NO: 86929 - protein, 32 aa, Artificial Sequence
  Description of Artificial Sequence: Synthetic polypeptide
DENEIRTTNPVATEQYGCVSTEIDTTNGQNSV

SEQ ID NO: 86930 - protein, 35 aa, Artificial Sequence
  Description of Artificial Sequence: Synthetic polypeptide
DEPEIRTTNPVATEQYGSVSPADNLEIQPGQNVNV

SEQ ID NO: 86931 - protein, 33 aa, Artificial Sequence
  Description of Artificial Sequence: Synthetic polypeptide
DEAEIRTTNPVATEQYGCVSEDLEQPRTQVDNI

SEQ ID NO: 86932 - protein, 35 aa, Artificial Sequence
  Description of Artificial Sequence: Synthetic polypeptide
DEEEIRTTNPVATEQYGSVSTVYNLDDTIEFNEMI

SEQ ID NO: 86933 - protein, 30 aa, Artificial Sequence
  Description of Artificial Sequence: Synthetic polypeptide
DENEIRTTNPVATEQWGSVSEILMNAAEDA

SEQ ID NO: 86934 - protein, 30 aa, Artificial Sequence
  Description of Artificial Sequence: Synthetic polypeptide
DENEIRTTNPVATEQWGSVSEILENAEEDA

SEQ ID NO: 86935 - protein, 32 aa, Artificial Sequence
  Description of Artificial Sequence: Synthetic polypeptide
DEAEIRTTNPVATEQYGSVSTLDTTPGDEDQA

SEQ ID NO: 86936 - protein, 34 aa, Artificial Sequence
  Description of Artificial Sequence: Synthetic polypeptide
DEEEIRTTNPVATEQYGSVSTVYGTDVAIFGNNG

SEQ ID NO: 86937 - protein, 33 aa, Artificial Sequence
  Description of Artificial Sequence: Synthetic polypeptide
DEAEIRTTNPVATEQYGSVSTLDLSTPIGDEDQ

SEQ ID NO: 86938 - protein, 30 aa, Artificial Sequence
  Description of Artificial Sequence: Synthetic polypeptide
DENEIRTTNPVATEQWGSVSEILENAAEDA

SEQ ID NO: 86939 - protein, 34 aa, Artificial Sequence
  Description of Artificial Sequence: Synthetic polypeptide
DEPEIRTTNPVATEQYGSVSPVVGLSQIGSNEVP

SEQ ID NO: 86940 - protein, 35 aa, Artificial Sequence
  Description of Artificial Sequence: Synthetic polypeptide
DEPEIRTTNPVATEQYGSVSSTWNTEIEGNGEQRD

SEQ ID NO: 86941 - protein, 31 aa, Artificial Sequence
  Description of Artificial Sequence: Synthetic polypeptide
DENEIRTTNPVATEQWGSVSEIIEMNAAGNA

SEQ ID NO: 86942 - protein, 32 aa, Artificial Sequence
  Description of Artificial Sequence: Synthetic polypeptide
CEEEIRTTNPVATEQYGCVCPTEDQNFGSNQS

SEQ ID NO: 86943 - protein, 31 aa, Artificial Sequence
  Description of Artificial Sequence: Synthetic polypeptide
DENEIRTTNPVATEQWGSVSEIGNMRNEMNA

SEQ ID NO: 86944 - protein, 32 aa, Artificial Sequence
  Description of Artificial Sequence: Synthetic polypeptide
DEAEIRTTNPVATEQYGCVITNLDFEIGEEEI

SEQ ID NO: 86945 - protein, 33 aa, Artificial Sequence
  Description of Artificial Sequence: Synthetic polypeptide
DEAEIRTTNPVATEQYGCVISTNDEQQGGEEID

SEQ ID NO: 86946 - protein, 34 aa, Artificial Sequence
  Description of Artificial Sequence: Synthetic polypeptide
DEPEIRTTNPVATEQYGSVSPANLEIAPGNVNDV

SEQ ID NO: 86947 - protein, 31 aa, Artificial Sequence
  Description of Artificial Sequence: Synthetic polypeptide
DENEIRTTNPVATEQWGSVSENEMNAEEENA

SEQ ID NO: 86948 - protein, 30 aa, Artificial Sequence
  Description of Artificial Sequence: Synthetic polypeptide
DEAEIRTTNPVATEQYGCVSEVSENGGDIV

SEQ ID NO: 86949 - protein, 32 aa, Artificial Sequence
  Description of Artificial Sequence: Synthetic polypeptide
DEAEIRTTNPVATEQYGSVSTLDFLTPLDEDQ

SEQ ID NO: 86950 - protein, 32 aa, Artificial Sequence
  Description of Artificial Sequence: Synthetic polypeptide
DENEIRTTNPVATEQWGSVSTTIGNMRAGDPA

SEQ ID NO: 86951 - protein, 32 aa, Artificial Sequence
  Description of Artificial Sequence: Synthetic polypeptide
DENEIRTTNPVATEQWGSVSTTIGMMRAGDPA

SEQ ID NO: 86952 - protein, 34 aa, Artificial Sequence
  Description of Artificial Sequence: Synthetic polypeptide
DEPEIRTTNPVATEQYGSVSLMPLLEARNVNERM

SEQ ID NO: 86953 - protein, 33 aa, Artificial Sequence
  Description of Artificial Sequence: Synthetic polypeptide
DEAEIRTTNPVATEQYGSVSTDELHFYGGELDV

SEQ ID NO: 86954 - protein, 31 aa, Artificial Sequence
  Description of Artificial Sequence: Synthetic polypeptide
DENEIRTTNPVATEQWGSVSTILMNAEEEDA

SEQ ID NO: 86955 - protein, 36 aa, Artificial Sequence
  Description of Artificial Sequence: Synthetic polypeptide
DEAEIRTTNPVATEQYGSVSTHDNLEETRNGQEDRV

SEQ ID NO: 86956 - protein, 34 aa, Artificial Sequence
  Description of Artificial Sequence: Synthetic polypeptide
DEEEIRTTNPVATEQYGSVSTWLGLIETPGVQLE

SEQ ID NO: 86957 - protein, 34 aa, Artificial Sequence
  Description of Artificial Sequence: Synthetic polypeptide
DEAEIRTTNPVATEQYGCVSPTSNIQMRSLENDM

SEQ ID NO: 86958 - protein, 31 aa, Artificial Sequence
  Description of Artificial Sequence: Synthetic polypeptide
DEAEIRTTNPVATEQYGCVSPDVLERMDSQS

SEQ ID NO: 86959 - protein, 32 aa, Artificial Sequence
  Description of Artificial Sequence: Synthetic polypeptide
DEPEIRTTNPVATEQYGSVSMMPLARNVEESM

SEQ ID NO: 86960 - protein, 33 aa, Artificial Sequence
  Description of Artificial Sequence: Synthetic polypeptide
DEPEIRTTNPVATEQYGSVSMMPLAVRNVNENI

SEQ ID NO: 86961 - protein, 33 aa, Artificial Sequence
  Description of Artificial Sequence: Synthetic polypeptide
DEAEIRTTNPVATEQYGCVSMNNELQGGIEDFQ

SEQ ID NO: 86962 - protein, 33 aa, Artificial Sequence
  Description of Artificial Sequence: Synthetic polypeptide
DEEEIRTTNPVATEQYGSVSTWIVPQNMHSQEE

SEQ ID NO: 86963 - protein, 30 aa, Artificial Sequence
  Description of Artificial Sequence: Synthetic polypeptide
DEAEIRTTNPVATEQYGCVSMEVSENGIDP

SEQ ID NO: 86964 - protein, 33 aa, Artificial Sequence
  Description of Artificial Sequence: Synthetic polypeptide
DENEIRTTNPVATEQWGSVSLEINTHQEVPNHR

SEQ ID NO: 86965 - protein, 32 aa, Artificial Sequence
  Description of Artificial Sequence: Synthetic polypeptide
DENEIRTTNPVATEQWGSVSEPAGMNRAGMNV

SEQ ID NO: 86966 - protein, 31 aa, Artificial Sequence
  Description of Artificial Sequence: Synthetic polypeptide
DEAEIRTTNPVATEQYGCVSKVSENRGEDIQ

SEQ ID NO: 86967 - protein, 30 aa, Artificial Sequence
  Description of Artificial Sequence: Synthetic polypeptide
DENEIRTTNPVATEQWGSVSEIGMNAAENA

SEQ ID NO: 86968 - protein, 32 aa, Artificial Sequence
  Description of Artificial Sequence: Synthetic polypeptide
DEPEIRTTNPVATEQYGSVSFMNEAANVNENM

SEQ ID NO: 86969 - protein, 35 aa, Artificial Sequence
  Description of Artificial Sequence: Synthetic polypeptide
CEEEIRTTNPVATEQWGYSNVSATNELQHRPGQGT

SEQ ID NO: 86970 - protein, 32 aa, Artificial Sequence
  Description of Artificial Sequence: Synthetic polypeptide
DEPEIRTTNPVATEQYGSVSTPIGFQTVDILN

SEQ ID NO: 86971 - protein, 31 aa, Artificial Sequence
  Description of Artificial Sequence: Synthetic polypeptide
DENEIRTTNPVATEQWGSVSEAGMNAAGMNV

SEQ ID NO: 86972 - protein, 33 aa, Artificial Sequence
  Description of Artificial Sequence: Synthetic polypeptide
DEAEIRTTNPVATEQYGSVSTLLLTGMEIGEDI

SEQ ID NO: 86973 - protein, 31 aa, Artificial Sequence
  Description of Artificial Sequence: Synthetic polypeptide
DEQEIACTNPVATEQYGCVATNLQALDNVAE

SEQ ID NO: 86974 - protein, 31 aa, Artificial Sequence
  Description of Artificial Sequence: Synthetic polypeptide
DEQEIACTNPVATEQYGCVATNLQDPLDNDE

SEQ ID NO: 86975 - protein, 34 aa, Artificial Sequence
  Description of Artificial Sequence: Synthetic polypeptide
CEEEIRTTNPVATEAFGSVSSCHNLSQRTGGDNM

SEQ ID NO: 86976 - protein, 32 aa, Artificial Sequence
  Description of Artificial Sequence: Synthetic polypeptide
DEQEIACTNPVATEQYGEVSATDLQDREGEDL

SEQ ID NO: 86977 - protein, 37 aa, Artificial Sequence
  Description of Artificial Sequence: Synthetic polypeptide
DEEEIRTTNPVATEQYGSVSTVVNTNLQAGTTNENTD

SEQ ID NO: 86978 - protein, 33 aa, Artificial Sequence
  Description of Artificial Sequence: Synthetic polypeptide
DEQDEIATTNPVAYEQWGSVSTNLQGNAGENNA

SEQ ID NO: 86979 - protein, 37 aa, Artificial Sequence
  Description of Artificial Sequence: Synthetic polypeptide
DEEEIRTTNPVATEQYGSVSTVVNTNLQAGTNDEESD

SEQ ID NO: 86980 - protein, 31 aa, Artificial Sequence
  Description of Artificial Sequence: Synthetic polypeptide
DEQEIACTNPVATEQYGEVSENLQDHEGGDL

SEQ ID NO: 86981 - protein, 32 aa, Artificial Sequence
  Description of Artificial Sequence: Synthetic polypeptide
DENEIRTTNPVATEQWGSVSCIIEPQNRAENA

SEQ ID NO: 86982 - protein, 34 aa, Artificial Sequence
  Description of Artificial Sequence: Synthetic polypeptide
CEEEIRTTNPMATEQYGSVVACTNALSGQGGNYT

SEQ ID NO: 86983 - protein, 32 aa, Artificial Sequence
  Description of Artificial Sequence: Synthetic polypeptide
DEQEIACTNPVATEQYGSVSATDLEDHEGEDR

SEQ ID NO: 86984 - protein, 31 aa, Artificial Sequence
  Description of Artificial Sequence: Synthetic polypeptide
DEQEIACTNPVATEQYGSVSATDLEDHGEDL

SEQ ID NO: 86985 - protein, 31 aa, Artificial Sequence
  Description of Artificial Sequence: Synthetic polypeptide
DEQEIACTNPVATEQYGSVSATDLEDHGGDL

SEQ ID NO: 86986 - protein, 32 aa, Artificial Sequence
  Description of Artificial Sequence: Synthetic polypeptide
DEAEIRTTNPVATEQYGCVCSWEHQNFGSENQ

SEQ ID NO: 86987 - protein, 31 aa, Artificial Sequence
  Description of Artificial Sequence: Synthetic polypeptide
DEQEIACTNPVATEQYGEVSENLQDHEGEDL

SEQ ID NO: 86988 - protein, 32 aa, Artificial Sequence
  Description of Artificial Sequence: Synthetic polypeptide
DEQCIRTTNPVAYEQYGVTVSTNQSQFGGNQS

SEQ ID NO: 86989 - protein, 32 aa, Artificial Sequence
  Description of Artificial Sequence: Synthetic polypeptide
DEQAIRTTNPVATEQYGSFSTLTLIEGGQISR

SEQ ID NO: 86990 - protein, 31 aa, Artificial Sequence
  Description of Artificial Sequence: Synthetic polypeptide
DENEIRTTNPVATEQWGSVSEIEMNAAEENA

SEQ ID NO: 86991 - protein, 35 aa, Artificial Sequence
  Description of Artificial Sequence: Synthetic polypeptide
DEPEIRTTNPVATEQYGSVSTTNDDLQQLEGEEDK

SEQ ID NO: 86992 - protein, 31 aa, Artificial Sequence
  Description of Artificial Sequence: Synthetic polypeptide
DENEIRTTNPVATEQWGSVSEIENMANEMNA

SEQ ID NO: 86993 - protein, 33 aa, Artificial Sequence
  Description of Artificial Sequence: Synthetic polypeptide
DEPEIRTTNPVATEQYGSVSWDYGNDIVNNNRA

SEQ ID NO: 86994 - protein, 32 aa, Artificial Sequence
  Description of Artificial Sequence: Synthetic polypeptide
DEAEIRTTNPVATEQYGCVCSWNLINFNSNTQ

SEQ ID NO: 86995 - protein, 32 aa, Artificial Sequence
  Description of Artificial Sequence: Synthetic polypeptide
DEAEIRTTNPVATEQYGCVCSWNLANSNSNQA

SEQ ID NO: 86996 - protein, 32 aa, Artificial Sequence
  Description of Artificial Sequence: Synthetic polypeptide
DEPEIRTTNPVATEQYGSVSWYGNDINNGGVA

SEQ ID NO: 86997 - protein, 34 aa, Artificial Sequence
  Description of Artificial Sequence: Synthetic polypeptide
DEPEIRTTNPVAYEFYGSVSSQTDNDQREGENQS

SEQ ID NO: 86998 - protein, 32 aa, Artificial Sequence
  Description of Artificial Sequence: Synthetic polypeptide
DEPEISTTNPVATEQYGSVSLVNNLMHVGPIL

SEQ ID NO: 86999 - protein, 37 aa, Artificial Sequence
  Description of Artificial Sequence: Synthetic polypeptide
DEEEIRTTNPVATEQYGSVSTVVTNLQSGNQQGTTNE

SEQ ID NO: 87000 - protein, 36 aa, Artificial Sequence
  Description of Artificial Sequence: Synthetic polypeptide
DEEEIRTTNPVATEQYGSVTSTMNTIGQLGEGGGNE

SEQ ID NO: 87001 - protein, 30 aa, Artificial Sequence
  Description of Artificial Sequence: Synthetic polypeptide
DEQAEIATTNPVAYEQWGVCSTMDQHGNNR

SEQ ID NO: 87002 - protein, 30 aa, Artificial Sequence
  Description of Artificial Sequence: Synthetic polypeptide
DENEIRTTNPVATEQWGSVSEIEMNAAGDA

SEQ ID NO: 87003 - protein, 31 aa, Artificial Sequence
  Description of Artificial Sequence: Synthetic polypeptide
DEQAEIATTNPVAYEQWGVCSTVLQHDGDNR

SEQ ID NO: 87004 - protein, 35 aa, Artificial Sequence
  Description of Artificial Sequence: Synthetic polypeptide
DEEEIRTTNPVATEQYGSVSTVVTNLQENDEEDED

SEQ ID NO: 87005 - protein, 37 aa, Artificial Sequence
  Description of Artificial Sequence: Synthetic polypeptide
DEEEIRTTNPVATEQYGSVSTVVTNLNGNQQGNNEGT

SEQ ID NO: 87006 - protein, 35 aa, Artificial Sequence
  Description of Artificial Sequence: Synthetic polypeptide
CEEEIRTTNPVATEAYGSVSCCHNLSQRTGGNNMY

SEQ ID NO: 87007 - protein, 30 aa, Artificial Sequence
  Description of Artificial Sequence: Synthetic polypeptide
DENEIRTTNPVATEQWGSVSEIEMNAAENA

SEQ ID NO: 87008 - protein, 32 aa, Artificial Sequence
  Description of Artificial Sequence: Synthetic polypeptide
DENEIRTTNPVATEQWGSVSEIEPMDREGENG

SEQ ID NO: 87009 - protein, 33 aa, Artificial Sequence
  Description of Artificial Sequence: Synthetic polypeptide
DENEIRTTNPVATEQWGSVSTTPAEPNMANGNV

SEQ ID NO: 87010 - protein, 34 aa, Artificial Sequence
  Description of Artificial Sequence: Synthetic polypeptide
DEAEIRTTNPVATEQYGCVSTNYELQGIGVEDTE

SEQ ID NO: 87011 - protein, 34 aa, Artificial Sequence
  Description of Artificial Sequence: Synthetic polypeptide
DEAEIRTTNPVATEQYGCVSTNYNLQGIGIEDTQ

SEQ ID NO: 87012 - protein, 33 aa, Artificial Sequence
  Description of Artificial Sequence: Synthetic polypeptide
DEAEIRTTNPVATEQYGSVSPTDWLETFGELQG

SEQ ID NO: 87013 - protein, 35 aa, Artificial Sequence
  Description of Artificial Sequence: Synthetic polypeptide
DEEEIRTTNPVATEQYGSVTSADDLEQPGNSQFQV

SEQ ID NO: 87014 - protein, 31 aa, Artificial Sequence
  Description of Artificial Sequence: Synthetic polypeptide
DENEIRTTNPVATEQWGVVSVTNNNAAEDNA

SEQ ID NO: 87015 - protein, 33 aa, Artificial Sequence
  Description of Artificial Sequence: Synthetic polypeptide
DEAEIRTTNPVATEQYGSVSPTFLTQTFSEDFM

SEQ ID NO: 87016 - protein, 33 aa, Artificial Sequence
  Description of Artificial Sequence: Synthetic polypeptide
DEPEIRTTNPVATEQYGETSTSNLEQFRQDDSV

SEQ ID NO: 87017 - protein, 34 aa, Artificial Sequence
  Description of Artificial Sequence: Synthetic polypeptide
DEPEIRTTNPVATEQYGETSTTNLEQFRQGDAFV

SEQ ID NO: 87018 - protein, 32 aa, Artificial Sequence
  Description of Artificial Sequence: Synthetic polypeptide
DEAEIRTTNPVATEQYGCVWSDHPDEREDTNR

SEQ ID NO: 87019 - protein, 33 aa, Artificial Sequence
  Description of Artificial Sequence: Synthetic polypeptide
DEAEIRTTNPVATEQYGCVYVWENGIQKTGNDR

SEQ ID NO: 87020 - protein, 33 aa, Artificial Sequence
  Description of Artificial Sequence: Synthetic polypeptide
DEAEIRTTNPVATEQYGSVSPTMHDTDFGGTER

SEQ ID NO: 87021 - protein, 32 aa, Artificial Sequence
  Description of Artificial Sequence: Synthetic polypeptide
DENEIRTTNPVATEQWGTVSTNQQGTNAAEDA

SEQ ID NO: 87022 - protein, 32 aa, Artificial Sequence
  Description of Artificial Sequence: Synthetic polypeptide
DENEIRTTNPVATEQWGTVSTNQQENNAAEDE

SEQ ID NO: 87023 - protein, 32 aa, Artificial Sequence
  Description of Artificial Sequence: Synthetic polypeptide
DENEIRTTNPVATEQWGTVSTNQQENNAAEDA

SEQ ID NO: 87024 - protein, 33 aa, Artificial Sequence
  Description of Artificial Sequence: Synthetic polypeptide
DEAEIRTTNPVATEQYGSVSPTNDNTTTNEDNI

SEQ ID NO: 87025 - protein, 35 aa, Artificial Sequence
  Description of Artificial Sequence: Synthetic polypeptide
DEEEIRTTNPVATEQYGSVTSGTDQDIGQGEGGNG

SEQ ID NO: 87026 - protein, 33 aa, Artificial Sequence
  Description of Artificial Sequence: Synthetic polypeptide
DEAEIRTTNPVATEQYGSVSPTNHGETVTNEDN

SEQ ID NO: 87027 - protein, 32 aa, Artificial Sequence
  Description of Artificial Sequence: Synthetic polypeptide
DENEIRTTNPVATEQWGTVSTNQEGTNAAEDA

SEQ ID NO: 87028 - protein, 34 aa, Artificial Sequence
  Description of Artificial Sequence: Synthetic polypeptide
DEAEIRTTNPVATEQYGSVSPTMLESIESDQENR

SEQ ID NO: 87029 - protein, 34 aa, Artificial Sequence
  Description of Artificial Sequence: Synthetic polypeptide
DEAEIRTTNPVATEQYGSVSPTDNLTQTESPDDM

SEQ ID NO: 87030 - protein, 32 aa, Artificial Sequence
  Description of Artificial Sequence: Synthetic polypeptide
DEAEIRTTNPVATEQYGSVSPTDMANRFETEI

SEQ ID NO: 87031 - protein, 30 aa, Artificial Sequence
  Description of Artificial Sequence: Synthetic polypeptide
DENEIRTTNPVATEQYGCVAVDQQIGDGQQ

SEQ ID NO: 87032 - protein, 35 aa, Artificial Sequence
  Description of Artificial Sequence: Synthetic polypeptide
DEAEIRTTNPVATEQYGSVSNDPNNLQTSFGSDQR

SEQ ID NO: 87033 - protein, 33 aa, Artificial Sequence
  Description of Artificial Sequence: Synthetic polypeptide
DENEIRTTNPVATEQYGCVSPVNLEQRYDDQQY

SEQ ID NO: 87034 - protein, 32 aa, Artificial Sequence
  Description of Artificial Sequence: Synthetic polypeptide
DENEIRTTNPVATEQYGCVSPTLDEIRTENID

SEQ ID NO: 87035 - protein, 34 aa, Artificial Sequence
  Description of Artificial Sequence: Synthetic polypeptide
DEAEIRTTNPVATEQYGSVSNLTNHNTGPENNFY

SEQ ID NO: 87036 - protein, 32 aa, Artificial Sequence
  Description of Artificial Sequence: Synthetic polypeptide
DEAEIRTTNPVATEQYGSVSNLVLYMFGSEDE

SEQ ID NO: 87037 - protein, 31 aa, Artificial Sequence
  Description of Artificial Sequence: Synthetic polypeptide
DENEIRTTNPVATEQYGCVSEDQQNGDGQQQ

SEQ ID NO: 87038 - protein, 32 aa, Artificial Sequence
  Description of Artificial Sequence: Synthetic polypeptide
DENEIRTTNPVATEQYGCVSATLQDTFNNEQQ

SEQ ID NO: 87039 - protein, 33 aa, Artificial Sequence
  Description of Artificial Sequence: Synthetic polypeptide
DEPEIRTTNPVATECWGSVSWINEPQDREGENG

SEQ ID NO: 87040 - protein, 33 aa, Artificial Sequence
  Description of Artificial Sequence: Synthetic polypeptide
DEPEIRTTNPVATEDWGSVSCINEPQEREGENG

SEQ ID NO: 87041 - protein, 34 aa, Artificial Sequence
  Description of Artificial Sequence: Synthetic polypeptide
DEAEIRTTNPVATEQYGSVSPDVTLERQGDNFQV

SEQ ID NO: 87042 - protein, 32 aa, Artificial Sequence
  Description of Artificial Sequence: Synthetic polypeptide
DEAEIRTTNPVATEQYGSVSPLDLFPGGDEDG

SEQ ID NO: 87043 - protein, 33 aa, Artificial Sequence
  Description of Artificial Sequence: Synthetic polypeptide
DENEIRTTNPVATEQYGCVCSTEHQYFGSNTQS

SEQ ID NO: 87044 - protein, 33 aa, Artificial Sequence
  Description of Artificial Sequence: Synthetic polypeptide
DEPEIRTTNPVATEQYGCVSVYNLDNYFESNQR

SEQ ID NO: 87045 - protein, 32 aa, Artificial Sequence
  Description of Artificial Sequence: Synthetic polypeptide
DENEIRTTNPVATEQYGCVCSTEHQSFGSDQM

SEQ ID NO: 87046 - protein, 32 aa, Artificial Sequence
  Description of Artificial Sequence: Synthetic polypeptide
DENEIRTTNPVATEQYGCVCSSNHQNFGSEQA

SEQ ID NO: 87047 - protein, 34 aa, Artificial Sequence
  Description of Artificial Sequence: Synthetic polypeptide
DEAEIRTTNPVATEQYGSVSPPPQDITEGTENRM

SEQ ID NO: 87048 - protein, 34 aa, Artificial Sequence
  Description of Artificial Sequence: Synthetic polypeptide
DENEIRTTNPVATEQYGCVCSNTELQFFGSNTQS

SEQ ID NO: 87049 - protein, 34 aa, Artificial Sequence
  Description of Artificial Sequence: Synthetic polypeptide
DEAEIRTTNPVATEQYGSVSPTNLTQTFFSEDFI

SEQ ID NO: 87050 - protein, 31 aa, Artificial Sequence
  Description of Artificial Sequence: Synthetic polypeptide
DENEIRTTNPVATEQWGTVSTEQQNNNAEDA

SEQ ID NO: 87051 - protein, 34 aa, Artificial Sequence
  Description of Artificial Sequence: Synthetic polypeptide
DEAEIRTTNPVATEQYGSVSPTNNGESGTNEQDN

SEQ ID NO: 87052 - protein, 33 aa, Artificial Sequence
  Description of Artificial Sequence: Synthetic polypeptide
DENEIRTTNPVATEQWGTVSTELQAGNNANEDA

SEQ ID NO: 87053 - protein, 35 aa, Artificial Sequence
  Description of Artificial Sequence: Synthetic polypeptide
DEAEIRTTNPVATEQYGSVSPWQDNLEQRFGGSEV

SEQ ID NO: 87054 - protein, 30 aa, Artificial Sequence
  Description of Artificial Sequence: Synthetic polypeptide
DENEIRTTNPVATEQWGTVSEIGNNAGNDA

SEQ ID NO: 87055 - protein, 33 aa, Artificial Sequence
  Description of Artificial Sequence: Synthetic polypeptide
DEPEIRTTNPVATEQYGSVIDTNNGQGEGGGEE

SEQ ID NO: 87056 - protein, 30 aa, Artificial Sequence
  Description of Artificial Sequence: Synthetic polypeptide
DENEIRTTNPVATEQWGTVSEIEQQQNGDA

SEQ ID NO: 87057 - protein, 30 aa, Artificial Sequence
  Description of Artificial Sequence: Synthetic polypeptide
DENEIRTTNPVATEQWGTVSEIEQQQAGDA

SEQ ID NO: 87058 - protein, 30 aa, Artificial Sequence
  Description of Artificial Sequence: Synthetic polypeptide
DENEIRTTNPVATEQWGTVSEIEMQAAENA

SEQ ID NO: 87059 - protein, 30 aa, Artificial Sequence
  Description of Artificial Sequence: Synthetic polypeptide
DENEIRTTNPVATEQWGTVSEDEMQQAENA

SEQ ID NO: 87060 - protein, 32 aa, Artificial Sequence
  Description of Artificial Sequence: Synthetic polypeptide
DEAEIRTTNPVATEQYGSVSSEVPSERGSEDS

SEQ ID NO: 87061 - protein, 30 aa, Artificial Sequence
  Description of Artificial Sequence: Synthetic polypeptide
DENEIRTTNPVATEQWGTVSATIPMAEEND

SEQ ID NO: 87062 - protein, 34 aa, Artificial Sequence
  Description of Artificial Sequence: Synthetic polypeptide
DEPEIRTTNPVATEQYGSVISTGNTGQNGEGGGE

SEQ ID NO: 87063 - protein, 32 aa, Artificial Sequence
  Description of Artificial Sequence: Synthetic polypeptide
DEAEIRTTNPVATEQYGSVSSLLTEEPQEDRY

SEQ ID NO: 87064 - protein, 34 aa, Artificial Sequence
  Description of Artificial Sequence: Synthetic polypeptide
DEEEIRTTNPVATEQYGSVSTWNSNSQFNTEIVL

SEQ ID NO: 87065 - protein, 33 aa, Artificial Sequence
  Description of Artificial Sequence: Synthetic polypeptide
DEAEIRTTNPVATEQYGCVSTWVPLDQRNEDHT

SEQ ID NO: 87066 - protein, 33 aa, Artificial Sequence
  Description of Artificial Sequence: Synthetic polypeptide
CEEEIRTTNPVATEQYGCVCSNTGELQNFGSEQ

SEQ ID NO: 87067 - protein, 34 aa, Artificial Sequence
  Description of Artificial Sequence: Synthetic polypeptide
DEAEIRTTNPVATEQYGCVSTVPLDQRNGDEDHT

SEQ ID NO: 87068 - protein, 33 aa, Artificial Sequence
  Description of Artificial Sequence: Synthetic polypeptide
DEPEIRTTNPVATEQYGSVISVDNTGQGEGGQG

SEQ ID NO: 87069 - protein, 30 aa, Artificial Sequence
  Description of Artificial Sequence: Synthetic polypeptide
DENEIRTTNPVATEQWGTVSATGPMAEEND

SEQ ID NO: 87070 - protein, 33 aa, Artificial Sequence
  Description of Artificial Sequence: Synthetic polypeptide
DEAEIRTTNPVATEQYGSVSPWNGESGTNEHDN

SEQ ID NO: 87071 - protein, 34 aa, Artificial Sequence
  Description of Artificial Sequence: Synthetic polypeptide
DEEEIRTTNPVATEQYGSVSTYNGLGETAEELEL

SEQ ID NO: 87072 - protein, 30 aa, Artificial Sequence
  Description of Artificial Sequence: Synthetic polypeptide
DENEIRTTNPVATEQWGTVSEIIQNAAENH

SEQ ID NO: 87073 - protein, 30 aa, Artificial Sequence
  Description of Artificial Sequence: Synthetic polypeptide
DENEIRTTNPVATEQWGTVSEIIQNANENH

SEQ ID NO: 87074 - protein, 31 aa, Artificial Sequence
  Description of Artificial Sequence: Synthetic polypeptide
DENEIRTTNPVATEQWGTVSTDIEENFAGNA

SEQ ID NO: 87075 - protein, 31 aa, Artificial Sequence
  Description of Artificial Sequence: Synthetic polypeptide
DENEIRTTNPVATEQWGTVSTDIEENAAGNA

SEQ ID NO: 87076 - protein, 33 aa, Artificial Sequence
  Description of Artificial Sequence: Synthetic polypeptide
DEAEIRTTNPVATEQYGSVSPTSNHMVSSGEDH

SEQ ID NO: 87077 - protein, 34 aa, Artificial Sequence
  Description of Artificial Sequence: Synthetic polypeptide
DEAEIRTTNPVATEQYGSVSPTSNIDMRSLENDF

SEQ ID NO: 87078 - protein, 30 aa, Artificial Sequence
  Description of Artificial Sequence: Synthetic polypeptide
DENEIRTTNPVATEQWGTVSNVNNNAGEDA

SEQ ID NO: 87079 - protein, 30 aa, Artificial Sequence
  Description of Artificial Sequence: Synthetic polypeptide
DENEIRTTNPVATEQWGTVSNLQLNAAEDA

SEQ ID NO: 87080 - protein, 30 aa, Artificial Sequence
  Description of Artificial Sequence: Synthetic polypeptide
DENEIRTTNPVATEQWGTVSMIIQQQNGDA

SEQ ID NO: 87081 - protein, 30 aa, Artificial Sequence
  Description of Artificial Sequence: Synthetic polypeptide
DENEIRTTNPVATEQWGTVSMIEQNANEDA

SEQ ID NO: 87082 - protein, 30 aa, Artificial Sequence
  Description of Artificial Sequence: Synthetic polypeptide
DENEIRTTNPVATEQWGTVSEINNNIGEDA

SEQ ID NO: 87083 - protein, 30 aa, Artificial Sequence
  Description of Artificial Sequence: Synthetic polypeptide
DENEIRTTNPVATEQWGTVSEIIQQQNGDA

SEQ ID NO: 87084 - protein, 33 aa, Artificial Sequence
  Description of Artificial Sequence: Synthetic polypeptide
DEPEIRTTNPVATEQYGSVASPPEQEQDVNENR

SEQ ID NO: 87085 - protein, 35 aa, Artificial Sequence
  Description of Artificial Sequence: Synthetic polypeptide
DEEEIRTTNPVATEQYGSVSTYGLSNEFNGGNEQQ

SEQ ID NO: 87086 - protein, 31 aa, Artificial Sequence
  Description of Artificial Sequence: Synthetic polypeptide
DENEIRTTNPVATEQWGTVSEIIQQNQNGNH

SEQ ID NO: 87087 - protein, 34 aa, Artificial Sequence
  Description of Artificial Sequence: Synthetic polypeptide
DEAEIRTTNPVATEQYGSVSPTVTLERQGDQIQV

SEQ ID NO: 87088 - protein, 31 aa, Artificial Sequence
  Description of Artificial Sequence: Synthetic polypeptide
DENEIRTTNPVATEQWGTVSEIIQQNANGNH

SEQ ID NO: 87089 - protein, 34 aa, Artificial Sequence
  Description of Artificial Sequence: Synthetic polypeptide
DEAEIRTTNPVATEQYGSVSPTVTLERQTDNTQL

SEQ ID NO: 87090 - protein, 34 aa, Artificial Sequence
  Description of Artificial Sequence: Synthetic polypeptide
DEAEIRTTNPVATEQYGSVSPTVTMERQGDNTQI

SEQ ID NO: 87091 - protein, 34 aa, Artificial Sequence
  Description of Artificial Sequence: Synthetic polypeptide
DEPEIRTTNPVATEQYGSVDSPPEQEDDVGENTR

SEQ ID NO: 87092 - protein, 32 aa, Artificial Sequence
  Description of Artificial Sequence: Synthetic polypeptide
DENEIRTTNPVATEQYGSSSVYDLEQRSQEDQ

SEQ ID NO: 87093 - protein, 31 aa, Artificial Sequence
  Description of Artificial Sequence: Synthetic polypeptide
DEAEIRTTNPVATEQYGSVHTELNGEDEEQN

SEQ ID NO: 87094 - protein, 33 aa, Artificial Sequence
  Description of Artificial Sequence: Synthetic polypeptide
DENEIRTTNPVATEQYGSSSVYDMLEQQGNEFN

SEQ ID NO: 87095 - protein, 35 aa, Artificial Sequence
  Description of Artificial Sequence: Synthetic polypeptide
DEEEIRTTNPVATEQYGSVSVTYALNQEAVANNND

SEQ ID NO: 87096 - protein, 33 aa, Artificial Sequence
  Description of Artificial Sequence: Synthetic polypeptide
CEEEIRTTNPVAYEQYGATVSECNLQETVGNEK

SEQ ID NO: 87097 - protein, 33 aa, Artificial Sequence
  Description of Artificial Sequence: Synthetic polypeptide
DEEEIRTTNPVATEQYGSVSWYDMQTIDPNGFD

SEQ ID NO: 87098 - protein, 34 aa, Artificial Sequence
  Description of Artificial Sequence: Synthetic polypeptide
DENEIRTTNPVATEQYGSVWSTLPNEQHEDTQDR

SEQ ID NO: 87099 - protein, 33 aa, Artificial Sequence
  Description of Artificial Sequence: Synthetic polypeptide
DENEIRTTNPVATEQYGSVWTNINNQQDGSIEQ

SEQ ID NO: 87100 - protein, 34 aa, Artificial Sequence
  Description of Artificial Sequence: Synthetic polypeptide
DEEEIRTTNPVATEQYGSVSVTVVNEEDYTNQQM

SEQ ID NO: 87101 - protein, 33 aa, Artificial Sequence
  Description of Artificial Sequence: Synthetic polypeptide
DENEIRTTNPVATEQYGSVWVTVNNNAFEGQND

SEQ ID NO: 87102 - protein, 33 aa, Artificial Sequence
  Description of Artificial Sequence: Synthetic polypeptide
DENEIRTTNPVATEQYGSVWADNLTESFGGNVD

SEQ ID NO: 87103 - protein, 33 aa, Artificial Sequence
  Description of Artificial Sequence: Synthetic polypeptide
DENEIRTTNPVATEQYGSVYANDLTQEGFEDGD

SEQ ID NO: 87104 - protein, 32 aa, Artificial Sequence
  Description of Artificial Sequence: Synthetic polypeptide
DENEIRTTNPVATEQYGSVYLNSNQESGQESK

SEQ ID NO: 87105 - protein, 31 aa, Artificial Sequence
  Description of Artificial Sequence: Synthetic polypeptide
DENEIRTTNPVATEQYGSVSEIEENAEEDDA

SEQ ID NO: 87106 - protein, 32 aa, Artificial Sequence
  Description of Artificial Sequence: Synthetic polypeptide
DEEEIRTTNPVATEQYGSVSWYSVPVRVEVQD

SEQ ID NO: 87107 - protein, 37 aa, Artificial Sequence
  Description of Artificial Sequence: Synthetic polypeptide
DEEEIRTTNPVATEQYGSVSVTVTNLQAGNQAGTNVE

SEQ ID NO: 87108 - protein, 35 aa, Artificial Sequence
  Description of Artificial Sequence: Synthetic polypeptide
DEEEIRTTNPVATEQYGSVSVTVTLGQTDGEMESQ

SEQ ID NO: 87109 - protein, 33 aa, Artificial Sequence
  Description of Artificial Sequence: Synthetic polypeptide
DEEEIRTTNPVATEQYGSVSYDEMTQESTQNFA

SEQ ID NO: 87110 - protein, 31 aa, Artificial Sequence
  Description of Artificial Sequence: Synthetic polypeptide
DENEIRTTNPVATEQYGSVYPANLEGETQQW

SEQ ID NO: 87111 - protein, 32 aa, Artificial Sequence
  Description of Artificial Sequence: Synthetic polypeptide
DENEIRTTNPVATEQYGSVYAYEDLTRNGEMP

SEQ ID NO: 87112 - protein, 33 aa, Artificial Sequence
  Description of Artificial Sequence: Synthetic polypeptide
DEEEIRTTNPVATEQYGSVSWVVPVTRSENLQY

SEQ ID NO: 87113 - protein, 33 aa, Artificial Sequence
  Description of Artificial Sequence: Synthetic polypeptide
DENEIRTTNPVATEQYGSVVSDVSDPLERGSQQ

SEQ ID NO: 87114 - protein, 34 aa, Artificial Sequence
  Description of Artificial Sequence: Synthetic polypeptide
DEEEIRTTNPVATEQYGSVSWVVLLETREDMQRM

SEQ ID NO: 87115 - protein, 33 aa, Artificial Sequence
  Description of Artificial Sequence: Synthetic polypeptide
DENEIRTTNPVATEQYGSVSPDVDEQIDGFNQI

SEQ ID NO: 87116 - protein, 34 aa, Artificial Sequence
  Description of Artificial Sequence: Synthetic polypeptide
CEEEIRTTNPVATEQYGSVDNTGDLGQRNANFGL

SEQ ID NO: 87117 - protein, 33 aa, Artificial Sequence
  Description of Artificial Sequence: Synthetic polypeptide
DENEIRTTNPVATEQYGSVSWTDMEQVESEDRN

SEQ ID NO: 87118 - protein, 36 aa, Artificial Sequence
  Description of Artificial Sequence: Synthetic polypeptide
DEEEIRTTNPVATEQYGSVSWTTPAGPNMRNGMNRV

SEQ ID NO: 87119 - protein, 32 aa, Artificial Sequence
  Description of Artificial Sequence: Synthetic polypeptide
DENEIRTTNPVATEQYGSVSNVLPDNTIDNQE

SEQ ID NO: 87120 - protein, 35 aa, Artificial Sequence
  Description of Artificial Sequence: Synthetic polypeptide
DENEIRTTNPVATEQYGSVSNTNILENRIASSQRD

SEQ ID NO: 87121 - protein, 33 aa, Artificial Sequence
  Description of Artificial Sequence: Synthetic polypeptide
DENEIRTTNPVATEQYGSVSWYTLESIGDNNEI

SEQ ID NO: 87122 - protein, 35 aa, Artificial Sequence
  Description of Artificial Sequence: Synthetic polypeptide
CEEEIRTTNPVATEQYGSVCSNTGNHQENFGSNQA

SEQ ID NO: 87123 - protein, 34 aa, Artificial Sequence
  Description of Artificial Sequence: Synthetic polypeptide
DENEIRTTNPVATEQYGSVSYTYELENQDGQDEM

SEQ ID NO: 87124 - protein, 34 aa, Artificial Sequence
  Description of Artificial Sequence: Synthetic polypeptide
DEEEIRTTNPVATEQYGSVSVVTLDQLTGLELPQ

SEQ ID NO: 87125 - protein, 32 aa, Artificial Sequence
  Description of Artificial Sequence: Synthetic polypeptide
DENEIRTTNPVATEQYGSVTSDVDPSERGSQQ

SEQ ID NO: 87126 - protein, 34 aa, Artificial Sequence
  Description of Artificial Sequence: Synthetic polypeptide
DEEEIRTTNPVATEQYGSVSVVISEVTSLVHNRD

SEQ ID NO: 87127 - protein, 35 aa, Artificial Sequence
  Description of Artificial Sequence: Synthetic polypeptide
DENEIRTTNPVATEQYGSVSNTDDLENRHGSSQRD

SEQ ID NO: 87128 - protein, 33 aa, Artificial Sequence
  Description of Artificial Sequence: Synthetic polypeptide
DENEIRTTNPVATEQYGSVSMNDLTTENGQGDQ

SEQ ID NO: 87129 - protein, 33 aa, Artificial Sequence
  Description of Artificial Sequence: Synthetic polypeptide
DENEIRTTNPVATEQYGSVVPWLLERIGDNDQC

SEQ ID NO: 87130 - protein, 34 aa, Artificial Sequence
  Description of Artificial Sequence: Synthetic polypeptide
DENEIRTTNPVATEQYGSVSITNTQPEEPQQENT

SEQ ID NO: 87131 - protein, 35 aa, Artificial Sequence
  Description of Artificial Sequence: Synthetic polypeptide
DEEEIRTTNPVATEQYGSVSVTYNLMENAMPEIRD

SEQ ID NO: 87132 - protein, 32 aa, Artificial Sequence
  Description of Artificial Sequence: Synthetic polypeptide
DENEIRTTNPVATEQYGSVYSMILTTGESGQI

SEQ ID NO: 87133 - protein, 32 aa, Artificial Sequence
  Description of Artificial Sequence: Synthetic polypeptide
DENEIRTTNPVATEQYGSVSPNDEIEGLEEHS

SEQ ID NO: 87134 - protein, 31 aa, Artificial Sequence
  Description of Artificial Sequence: Synthetic polypeptide
CEEEIRTTNPVAYEQYGNTVGVGPLQNRDKR

SEQ ID NO: 87135 - protein, 34 aa, Artificial Sequence
  Description of Artificial Sequence: Synthetic polypeptide
DENEIRTTNPVATEQYGSVYTWNMILQESSEERE

SEQ ID NO: 87136 - protein, 31 aa, Artificial Sequence
  Description of Artificial Sequence: Synthetic polypeptide
DENEIRTTNPVATEQYGTVCSTIEMNAAENA

SEQ ID NO: 87137 - protein, 31 aa, Artificial Sequence
  Description of Artificial Sequence: Synthetic polypeptide
DENEIRTTNPVATEQYGTVCSTIPMNAAENA

SEQ ID NO: 87138 - protein, 32 aa, Artificial Sequence
  Description of Artificial Sequence: Synthetic polypeptide
DENEIRTTNPVATEQYGSVSDTVEMTDDQERQ

SEQ ID NO: 87139 - protein, 32 aa, Artificial Sequence
  Description of Artificial Sequence: Synthetic polypeptide
DENEIRTTNPVATEQYGTVSMDDIVQQFNGNH

SEQ ID NO: 87140 - protein, 32 aa, Artificial Sequence
  Description of Artificial Sequence: Synthetic polypeptide
DENEIRTTNPVATEQYGSVSDANGNQELDEYI

SEQ ID NO: 87141 - protein, 33 aa, Artificial Sequence
  Description of Artificial Sequence: Synthetic polypeptide
DEAEIRTTNPVATEQYGSFSWTTNNQEEGDQEN

SEQ ID NO: 87142 - protein, 36 aa, Artificial Sequence
  Description of Artificial Sequence: Synthetic polypeptide
DEEEIRTTNPVATEQYGSVSVTQNNMIIHRGENELI

SEQ ID NO: 87143 - protein, 32 aa, Artificial Sequence
  Description of Artificial Sequence: Synthetic polypeptide
DENEIRTTNPVATEQYGSVSDVDPLEREMSQQ

SEQ ID NO: 87144 - protein, 33 aa, Artificial Sequence
  Description of Artificial Sequence: Synthetic polypeptide
DENEIRTTNPVATEQYGSVSCWDNMPQGIGSID

SEQ ID NO: 87145 - protein, 34 aa, Artificial Sequence
  Description of Artificial Sequence: Synthetic polypeptide
DENEIRTTNPVATEQYGTVSTPDIPNMQNGMNPV

SEQ ID NO: 87146 - protein, 32 aa, Artificial Sequence
  Description of Artificial Sequence: Synthetic polypeptide
DENEIRTTNPVATEQYGSVSATIEEDAEGDDL

SEQ ID NO: 87147 - protein, 30 aa, Artificial Sequence
  Description of Artificial Sequence: Synthetic polypeptide
DENEIRTTNPVATEQYGVVSEIEMNSAGDA

SEQ ID NO: 87148 - protein, 36 aa, Artificial Sequence
  Description of Artificial Sequence: Synthetic polypeptide
DEEEIRTTNPVATEQYGSVSVTPTLSQSTEGENPLS

SEQ ID NO: 87149 - protein, 36 aa, Artificial Sequence
  Description of Artificial Sequence: Synthetic polypeptide
DEEEIRTTNPVATEQYGSVSVTPTLPQLTEGENPLY

SEQ ID NO: 87150 - protein, 34 aa, Artificial Sequence
  Description of Artificial Sequence: Synthetic polypeptide
DENEIRTTNPVATEQYGSVSATEDLQEDHNGEDL

SEQ ID NO: 87151 - protein, 34 aa, Artificial Sequence
  Description of Artificial Sequence: Synthetic polypeptide
DENEIRTTNPVATEQYGSVSATEDIQEDHNGNDL

SEQ ID NO: 87152 - protein, 34 aa, Artificial Sequence
  Description of Artificial Sequence: Synthetic polypeptide
DEEEIRTTNPVATEQYGSVSYEVGLQQIMMEHRD

SEQ ID NO: 87153 - protein, 33 aa, Artificial Sequence
  Description of Artificial Sequence: Synthetic polypeptide
DEAEIRTTNPVATEQYGSSSPTNLEFRTEEQEM

SEQ ID NO: 87154 - protein, 34 aa, Artificial Sequence
  Description of Artificial Sequence: Synthetic polypeptide
DEAEIRTTNPVATEQYGSSSPTDNVQEYFGEQRS

SEQ ID NO: 87155 - protein, 33 aa, Artificial Sequence
  Description of Artificial Sequence: Synthetic polypeptide
DENEIRTTNPVATEQYGSVSDVDPLERFGSQQV

SEQ ID NO: 87156 - protein, 34 aa, Artificial Sequence
  Description of Artificial Sequence: Synthetic polypeptide
DEEEIRTTNPVATEQYGSVSYDYLTNWESTQNDD

SEQ ID NO: 87157 - protein, 34 aa, Artificial Sequence
  Description of Artificial Sequence: Synthetic polypeptide
DEEEIRTTNPVATEQYGSVSVTVMTEHFGNNNIY

SEQ ID NO: 87158 - protein, 34 aa, Artificial Sequence
  Description of Artificial Sequence: Synthetic polypeptide
DEEEIRTTNPVATEQYGSVSVTVLVMQDNWEPEE

SEQ ID NO: 87159 - protein, 32 aa, Artificial Sequence
  Description of Artificial Sequence: Synthetic polypeptide
DENEIRTTNPVATEQYGTISATDIEQHNGNDH

SEQ ID NO: 87160 - protein, 31 aa, Artificial Sequence
  Description of Artificial Sequence: Synthetic polypeptide
DENEIRTTNPVATEQYGTISEDIQQQQNGNH

SEQ ID NO: 87161 - protein, 31 aa, Artificial Sequence
  Description of Artificial Sequence: Synthetic polypeptide
DENEIRTTNPVATEQYGTISEEDCQQQQGNH

SEQ ID NO: 87162 - protein, 33 aa, Artificial Sequence
  Description of Artificial Sequence: Synthetic polypeptide
DEEEIRTTNPVATEQYGSVSVTTTMIHENEPYH

SEQ ID NO: 87163 - protein, 30 aa, Artificial Sequence
  Description of Artificial Sequence: Synthetic polypeptide
DENEIRTTNPVATEQYGTISEIIQQANENA

SEQ ID NO: 87164 - protein, 34 aa, Artificial Sequence
  Description of Artificial Sequence: Synthetic polypeptide
DEEEIRTTNPVATEQYGSVSYENAAEETPLFNER

SEQ ID NO: 87165 - protein, 35 aa, Artificial Sequence
  Description of Artificial Sequence: Synthetic polypeptide
DEEEIRTTNPVATEQYGSVSVTTMQQGTNEEEPIV

SEQ ID NO: 87166 - protein, 33 aa, Artificial Sequence
  Description of Artificial Sequence: Synthetic polypeptide
DENEIRTTNPVATEQYGTVCSATDGPQEQEGND

SEQ ID NO: 87167 - protein, 33 aa, Artificial Sequence
  Description of Artificial Sequence: Synthetic polypeptide
DENEIRTTNPVATEQYGSVSDVNLSEIFPMFER

SEQ ID NO: 87168 - protein, 33 aa, Artificial Sequence
  Description of Artificial Sequence: Synthetic polypeptide
DENEIRTTNPVATEQYGTVCSATDGPQQQEGND

SEQ ID NO: 87169 - protein, 33 aa, Artificial Sequence
  Description of Artificial Sequence: Synthetic polypeptide
DENEIRTTNPVATEQYGSVSDVMDPLEVRGSQQ

SEQ ID NO: 87170 - protein, 33 aa, Artificial Sequence
  Description of Artificial Sequence: Synthetic polypeptide
DENEIRTTNPVATEQYGSVSDVDPTEQRGSQQD

SEQ ID NO: 87171 - protein, 33 aa, Artificial Sequence
  Description of Artificial Sequence: Synthetic polypeptide
DENEIRTTNPVATEQYGTVCSATDGPVEQEGND

SEQ ID NO: 87172 - protein, 33 aa, Artificial Sequence
  Description of Artificial Sequence: Synthetic polypeptide
DENEIRTTNPVATEQYGTVCSATEGPQQQEGND

SEQ ID NO: 87173 - protein, 33 aa, Artificial Sequence
  Description of Artificial Sequence: Synthetic polypeptide
DENEIRTTNPVATEQYGSVSEAELDERGEDFDM

SEQ ID NO: 87174 - protein, 32 aa, Artificial Sequence
  Description of Artificial Sequence: Synthetic polypeptide
DENEIRTTNPVATEQYGSVSWNNLDTEHEDQH

SEQ ID NO: 87175 - protein, 32 aa, Artificial Sequence
  Description of Artificial Sequence: Synthetic polypeptide
DENEIRTTNPVATEQYGSVSWMDLNRIESDQT

SEQ ID NO: 87176 - protein, 33 aa, Artificial Sequence
  Description of Artificial Sequence: Synthetic polypeptide
DEEEIRTTNPVATEQYGSVSVYNGLIETAEEVE

SEQ ID NO: 87177 - protein, 34 aa, Artificial Sequence
  Description of Artificial Sequence: Synthetic polypeptide
DEEEIRTTNPVATEQYGSVSWPGVNLSQEVELEQ

SEQ ID NO: 87178 - protein, 32 aa, Artificial Sequence
  Description of Artificial Sequence: Synthetic polypeptide
DENEIRTTNPVATEQYGSVSTAEPNMANEDPA

SEQ ID NO: 87179 - protein, 33 aa, Artificial Sequence
  Description of Artificial Sequence: Synthetic polypeptide
DENEIRTTNPVATEQYGSVSTNNDHTITQNDEN

SEQ ID NO: 87180 - protein, 33 aa, Artificial Sequence
  Description of Artificial Sequence: Synthetic polypeptide
DENEIRTTNPVATEQYGSVSSVLPENQIDNYQE

SEQ ID NO: 87181 - protein, 33 aa, Artificial Sequence
  Description of Artificial Sequence: Synthetic polypeptide
DENEIRTTNPVATEQYGSVSSTTIGNMRAGDPA

SEQ ID NO: 87182 - protein, 33 aa, Artificial Sequence
  Description of Artificial Sequence: Synthetic polypeptide
CEEEIRTTNPVATEQYGSVSPTMVENDRGQSIA

SEQ ID NO: 87183 - protein, 34 aa, Artificial Sequence
  Description of Artificial Sequence: Synthetic polypeptide
DENEIRTTNPVATEQYGSVSSTTAGPNRNGMNPV

SEQ ID NO: 87184 - protein, 35 aa, Artificial Sequence
  Description of Artificial Sequence: Synthetic polypeptide
DENEIRTTNPVATEQYGSVSTNMYDLSPEEQIDGR

SEQ ID NO: 87185 - protein, 34 aa, Artificial Sequence
  Description of Artificial Sequence: Synthetic polypeptide
DEEEIRTTNPVATEQYGSVSWMNMTEENRLPEHE

SEQ ID NO: 87186 - protein, 33 aa, Artificial Sequence
  Description of Artificial Sequence: Synthetic polypeptide
DENEIRTTNPVATEQYGSVSTTDVIQEGGEDSP

SEQ ID NO: 87187 - protein, 35 aa, Artificial Sequence
  Description of Artificial Sequence: Synthetic polypeptide
DENEIRTTNPVATEQYGSVSTTPALPNMRNGMNPV

SEQ ID NO: 87188 - protein, 34 aa, Artificial Sequence
  Description of Artificial Sequence: Synthetic polypeptide
DENEIRTTNPVATEQYGSVSSTTAGNMRNGMNPV

SEQ ID NO: 87189 - protein, 33 aa, Artificial Sequence
  Description of Artificial Sequence: Synthetic polypeptide
DEEEIRTTNPVATEQYGSVSWSTLQFVEMSQVN

SEQ ID NO: 87190 - protein, 32 aa, Artificial Sequence
  Description of Artificial Sequence: Synthetic polypeptide
DENEIRTTNPVATEQYGSVSSTIGMNANGDPV

SEQ ID NO: 87191 - protein, 33 aa, Artificial Sequence
  Description of Artificial Sequence: Synthetic polypeptide
DENEIRTTNPVATEQYGSVSTVELTDTDQEDRQ

SEQ ID NO: 87192 - protein, 32 aa, Artificial Sequence
  Description of Artificial Sequence: Synthetic polypeptide
DENEIRTTNPVATEQYGSVSSTIGMMANGDPV

SEQ ID NO: 87193 - protein, 34 aa, Artificial Sequence
  Description of Artificial Sequence: Synthetic polypeptide
CEEEIRTTNPVATEQYGSVSDTDPEGQGGENDNV

SEQ ID NO: 87194 - protein, 33 aa, Artificial Sequence
  Description of Artificial Sequence: Synthetic polypeptide
DEEEIRTTNPVATEQYGSVSWPGVNLEDVELEQ

SEQ ID NO: 87195 - protein, 35 aa, Artificial Sequence
  Description of Artificial Sequence: Synthetic polypeptide
DEEEIRTTNPVATEQYGSVSWPGVNLAQIRVELEQ

SEQ ID NO: 87196 - protein, 32 aa, Artificial Sequence
  Description of Artificial Sequence: Synthetic polypeptide
DENEIRTTNPVATEQYGSVSTAGPNMANEDPA

SEQ ID NO: 87197 - protein, 34 aa, Artificial Sequence
  Description of Artificial Sequence: Synthetic polypeptide
DENEIRTTNPVATEQYGSVSTLDTTTQEGGEERT

SEQ ID NO: 87198 - protein, 33 aa, Artificial Sequence
  Description of Artificial Sequence: Synthetic polypeptide
CEEEIRTTNPVATEQYGTVSMPASWQYRENNRL

SEQ ID NO: 87199 - protein, 33 aa, Artificial Sequence
  Description of Artificial Sequence: Synthetic polypeptide
DENEIRTTNPVATEQYGSVSTLLLTEPGQEAID

SEQ ID NO: 87200 - protein, 34 aa, Artificial Sequence
  Description of Artificial Sequence: Synthetic polypeptide
DENEIRTTNPVATEQYGSVSTILEELNNGNEEAF

SEQ ID NO: 87201 - protein, 35 aa, Artificial Sequence
  Description of Artificial Sequence: Synthetic polypeptide
DENEIRTTNPVATEQYGSVSTLPNLEQHEDTQDHR

SEQ ID NO: 87202 - protein, 35 aa, Artificial Sequence
  Description of Artificial Sequence: Synthetic polypeptide
DENEIRTTNPVATEQYGSVSTLPNLQHIDTQDERQ

SEQ ID NO: 87203 - protein, 34 aa, Artificial Sequence
  Description of Artificial Sequence: Synthetic polypeptide
DEAEIRTTNPVATEQYGSIVSGTNEDLGGSNEDQ

SEQ ID NO: 87204 - protein, 33 aa, Artificial Sequence
  Description of Artificial Sequence: Synthetic polypeptide
DENEIRTTNPVATEQYGSVSTENDVTTGGQGPQ

SEQ ID NO: 87205 - protein, 33 aa, Artificial Sequence
  Description of Artificial Sequence: Synthetic polypeptide
DENEIRTTNPVATEQYGSVSTMMDSAGRFGIED

SEQ ID NO: 87206 - protein, 34 aa, Artificial Sequence
  Description of Artificial Sequence: Synthetic polypeptide
DENEIRTTNPVATEQYGSVSTMWDLTQEEQNDHN

SEQ ID NO: 87207 - protein, 34 aa, Artificial Sequence
  Description of Artificial Sequence: Synthetic polypeptide
DENEIRTTNPVATEQYGSVSTMYDDSAGRFGNED

SEQ ID NO: 87208 - protein, 32 aa, Artificial Sequence
  Description of Artificial Sequence: Synthetic polypeptide
DENEIRTTNPVATEQYGSVSTDWQNDMSSQDH

SEQ ID NO: 87209 - protein, 35 aa, Artificial Sequence
  Description of Artificial Sequence: Synthetic polypeptide
DENEIRTTNPVATEQYGSVSTNGDNQTREGQEDTM

SEQ ID NO: 87210 - protein, 35 aa, Artificial Sequence
  Description of Artificial Sequence: Synthetic polypeptide
CEEEIRTTNPVATEQYGSVTSTDGDNGQRFNEAGQ

SEQ ID NO: 87211 - protein, 33 aa, Artificial Sequence
  Description of Artificial Sequence: Synthetic polypeptide
DENEIRTTNPVATEQYGSVSTDDMNTREGGFEE

SEQ ID NO: 87212 - protein, 32 aa, Artificial Sequence
  Description of Artificial Sequence: Synthetic polypeptide
DENEIRTTNPVATEQYGSVSTDDKTTEGGFEE

SEQ ID NO: 87213 - protein, 34 aa, Artificial Sequence
  Description of Artificial Sequence: Synthetic polypeptide
DENEIRTTNPVATEQYGSVSTAGSLVSENQEDRF

SEQ ID NO: 87214 - protein, 33 aa, Artificial Sequence
  Description of Artificial Sequence: Synthetic polypeptide
DENEIRTTNPVATEQYGSVSTVLPDFNIDNSQE

SEQ ID NO: 87215 - protein, 33 aa, Artificial Sequence
  Description of Artificial Sequence: Synthetic polypeptide
CEEEIRTTNPVATEQYGSVSATAMQGNGGEFTE

SEQ ID NO: 87216 - protein, 33 aa, Artificial Sequence
  Description of Artificial Sequence: Synthetic polypeptide
DENEIRTTNPVATEQYGSVSTVMNDEGTQNFQL

SEQ ID NO: 87217 - protein, 34 aa, Artificial Sequence
  Description of Artificial Sequence: Synthetic polypeptide
CEEEIRTTNPVATEQYGSVSAMGDLDQRNQGEGD

SEQ ID NO: 87218 - protein, 34 aa, Artificial Sequence
  Description of Artificial Sequence: Synthetic polypeptide
DENEIRTTNPVATEQYGSVSVTGNMDEGGGSIRM

SEQ ID NO: 87219 - protein, 32 aa, Artificial Sequence
  Description of Artificial Sequence: Synthetic polypeptide
DENEIRTTNPVATEQYGSVSPVDDELEEIENQ

SEQ ID NO: 87220 - protein, 33 aa, Artificial Sequence
  Description of Artificial Sequence: Synthetic polypeptide
DENEIRTTNPVATEQYGSVSPTVLPDNIDNYQE

SEQ ID NO: 87221 - protein, 34 aa, Artificial Sequence
  Description of Artificial Sequence: Synthetic polypeptide
DENEIRTTNPVATEQYGSVSPTVALMVHGSDQYR

SEQ ID NO: 87222 - protein, 34 aa, Artificial Sequence
  Description of Artificial Sequence: Synthetic polypeptide
DENEIRTTNPVATEQYGSVSPTNYNDTFGSLQRE

SEQ ID NO: 87223 - protein, 35 aa, Artificial Sequence
  Description of Artificial Sequence: Synthetic polypeptide
DENEIRTTNPVATEQYGSVSPTNSDQEGLPEDNIE

SEQ ID NO: 87224 - protein, 34 aa, Artificial Sequence
  Description of Artificial Sequence: Synthetic polypeptide
DENEIRTTNPVATEQYGSVSPTLVLEQQRSFETN

SEQ ID NO: 87225 - protein, 33 aa, Artificial Sequence
  Description of Artificial Sequence: Synthetic polypeptide
DENEIRTTNPVATEQYGSVSPTLIDTNASNVNE

SEQ ID NO: 87226 - protein, 34 aa, Artificial Sequence
  Description of Artificial Sequence: Synthetic polypeptide
DENEIRTTNPVATEQYGSVSVTNMLDDEYGDDAQ

SEQ ID NO: 87227 - protein, 33 aa, Artificial Sequence
  Description of Artificial Sequence: Synthetic polypeptide
DENEIRTTNPVATEQYGSVSPTETNHGIGVQGM

SEQ ID NO: 87228 - protein, 33 aa, Artificial Sequence
  Description of Artificial Sequence: Synthetic polypeptide
DENEIRTTNPVATEQYGSVSPNENQEILFEENN

SEQ ID NO: 87229 - protein, 34 aa, Artificial Sequence
  Description of Artificial Sequence: Synthetic polypeptide
DENEIRTTNPVATEQYGSVSVTVLLNEGGNTSFA

SEQ ID NO: 87230 - protein, 33 aa, Artificial Sequence
  Description of Artificial Sequence: Synthetic polypeptide
DENEIRTTNPVATEQYGSVSVVYVDLEIEGDRN

SEQ ID NO: 87231 - protein, 33 aa, Artificial Sequence
  Description of Artificial Sequence: Synthetic polypeptide
DEEEIRTTNPVATEQYGSVSWTTGNDDTISEEV

SEQ ID NO: 87232 - protein, 33 aa, Artificial Sequence
  Description of Artificial Sequence: Synthetic polypeptide
DENEIRTTNPVATEQYGSVSVWLLDEYSGDDRQ

SEQ ID NO: 87233 - protein, 32 aa, Artificial Sequence
  Description of Artificial Sequence: Synthetic polypeptide
DENEIRTTNPVATEQYGSVSPNDTIEGSEEHV

SEQ ID NO: 87234 - protein, 34 aa, Artificial Sequence
  Description of Artificial Sequence: Synthetic polypeptide
DENEIRTTNPVATEQYGSVSVYWPLNQLDGNEHE

SEQ ID NO: 87235 - protein, 33 aa, Artificial Sequence
  Description of Artificial Sequence: Synthetic polypeptide
DENEIRTTNPVATEQYGSVSPVNDQTEGSEEHS

SEQ ID NO: 87236 - protein, 32 aa, Artificial Sequence
  Description of Artificial Sequence: Synthetic polypeptide
DENEIRTTNPVATEQYGVVSSVLLQFTPENDG

SEQ ID NO: 87237 - protein, 32 aa, Artificial Sequence
  Description of Artificial Sequence: Synthetic polypeptide
DENEIRTTNPVATEQYGSVSPYDQEREDLLQK

SEQ ID NO: 87238 - protein, 34 aa, Artificial Sequence
  Description of Artificial Sequence: Synthetic polypeptide
DENEIRTTNPVATEQYGSVSSTAGPNMRNGMNPV

SEQ ID NO: 87239 - protein, 34 aa, Artificial Sequence
  Description of Artificial Sequence: Synthetic polypeptide
DENEIRTTNPVATEQYGSVSTWNSLEFGEFDMQD

SEQ ID NO: 87240 - protein, 34 aa, Artificial Sequence
  Description of Artificial Sequence: Synthetic polypeptide
DENEIRTTNPVATEQYGSVSTWPELNQLDGQEHE

SEQ ID NO: 87241 - protein, 32 aa, Artificial Sequence
  Description of Artificial Sequence: Synthetic polypeptide
DENEIRTTNPVATEQYGSVSTWWHNDESEDMV

SEQ ID NO: 87242 - protein, 33 aa, Artificial Sequence
  Description of Artificial Sequence: Synthetic polypeptide
DENEIRTTNPVATEQYGSVSVLDILDQEAFERD

SEQ ID NO: 87243 - protein, 34 aa, Artificial Sequence
  Description of Artificial Sequence: Synthetic polypeptide
DENEIRTTNPVATEQYGSVSVLPNLQHIDTFDAR

SEQ ID NO: 87244 - protein, 35 aa, Artificial Sequence
  Description of Artificial Sequence: Synthetic polypeptide
DENEIRTTNPVATEQYGSVSSTEPNGPNMRNGMNV

SEQ ID NO: 87245 - protein, 35 aa, Artificial Sequence
  Description of Artificial Sequence: Synthetic polypeptide
DENEIRTTNPVATEQYGSVSVLPNLQHRDTFDTRT

SEQ ID NO: 87246 - protein, 33 aa, Artificial Sequence
  Description of Artificial Sequence: Synthetic polypeptide
DENEIRTTNPVATEQYGSVSSTEPAGQMHNEEV

SEQ ID NO: 87247 - protein, 33 aa, Artificial Sequence
  Description of Artificial Sequence: Synthetic polypeptide
DENEIRTTNPVATEQYGSVSVNLNNSIGIADQE

SEQ ID NO: 87248 - protein, 33 aa, Artificial Sequence
  Description of Artificial Sequence: Synthetic polypeptide
DENEIRTTNPVATEQYGSVSVNNGQDQMGESQD

SEQ ID NO: 87249 - protein, 34 aa, Artificial Sequence
  Description of Artificial Sequence: Synthetic polypeptide
DENEIRTTNPVATEQYGSVSSTEPAGNMRNGMNV

SEQ ID NO: 87250 - protein, 34 aa, Artificial Sequence
  Description of Artificial Sequence: Synthetic polypeptide
DENEIRTTNPVATEQYGSVSSTEPAGNMHNGMNV

SEQ ID NO: 87251 - protein, 34 aa, Artificial Sequence
  Description of Artificial Sequence: Synthetic polypeptide
DENEIRTTNPVATEQYGSVSSTEPAGNMHNGMNL

SEQ ID NO: 87252 - protein, 34 aa, Artificial Sequence
  Description of Artificial Sequence: Synthetic polypeptide
DEEEIRTTNPVATEQYGSVSWTMMQGEHRQLDIL

SEQ ID NO: 87253 - protein, 32 aa, Artificial Sequence
  Description of Artificial Sequence: Synthetic polypeptide
DENEIRTTNPVATEQYGSVSVPNDQLFSQEDM

SEQ ID NO: 87254 - protein, 34 aa, Artificial Sequence
  Description of Artificial Sequence: Synthetic polypeptide
DEEEIRTTNPVATEQYGSVSWTMMQHEHRQLVEI

SEQ ID NO: 87255 - protein, 34 aa, Artificial Sequence
  Description of Artificial Sequence: Synthetic polypeptide
DENEIRTTNPVATEQYGSVSVSTLLGDRSGQQPP

SEQ ID NO: 87256 - protein, 33 aa, Artificial Sequence
  Description of Artificial Sequence: Synthetic polypeptide
DENEIRTTNPVATEQYGSVSSEPAGNMHNGMNL

SEQ ID NO: 87257 - protein, 36 aa, Artificial Sequence
  Description of Artificial Sequence: Synthetic polypeptide
DEEEIRTTNPVATEQYGSVSVTPLLHQPVEGENPLA

SEQ ID NO: 87258 - protein, 34 aa, Artificial Sequence
  Description of Artificial Sequence: Synthetic polypeptide
CEEEIRTTNPVATEQYGQCVCSTNHQRFGSETDS

SEQ ID NO: 87259 - protein, 34 aa, Artificial Sequence
  Description of Artificial Sequence: Synthetic polypeptide
DENEIRTTNPVATEQYGVVSTVLDMQRGEMTQSG

SEQ ID NO: 87260 - protein, 35 aa, Artificial Sequence
  Description of Artificial Sequence: Synthetic polypeptide
DEAEIRTTNPVATEQYGSVCSTLPNLYEGHESIRD

SEQ ID NO: 87261 - protein, 35 aa, Artificial Sequence
  Description of Artificial Sequence: Synthetic polypeptide
DEAEIRTTNPVATEQYGSVCSTNPELQEHDDNLAG

SEQ ID NO: 87262 - protein, 34 aa, Artificial Sequence
  Description of Artificial Sequence: Synthetic polypeptide
DENEIRTTNPVATEQYGSVIYANLNQESGQESRS

SEQ ID NO: 87263 - protein, 32 aa, Artificial Sequence
  Description of Artificial Sequence: Synthetic polypeptide
DENEIRTTNPVSTEPYGTVSATDLEQHNGNDH

SEQ ID NO: 87264 - protein, 33 aa, Artificial Sequence
  Description of Artificial Sequence: Synthetic polypeptide
DENEIRTTNPVATEQYGSVCYTGLAEQRVQDDV

SEQ ID NO: 87265 - protein, 34 aa, Artificial Sequence
  Description of Artificial Sequence: Synthetic polypeptide
DENEIRTTNPVATEQYGSVCWPNPLQGRDGSIQE

SEQ ID NO: 87266 - protein, 33 aa, Artificial Sequence
  Description of Artificial Sequence: Synthetic polypeptide
DENEIRTTNPVATEQYGSVCTPTNLERNDDTES

SEQ ID NO: 87267 - protein, 34 aa, Artificial Sequence
  Description of Artificial Sequence: Synthetic polypeptide
DEAEIRTTNPVATEQYGSVCSTLLQSEFGQDEDK

SEQ ID NO: 87268 - protein, 34 aa, Artificial Sequence
  Description of Artificial Sequence: Synthetic polypeptide
DENEIRTTNPVATEQYGSVCSVTWPLEDRGQEGE

SEQ ID NO: 87269 - protein, 33 aa, Artificial Sequence
  Description of Artificial Sequence: Synthetic polypeptide
DEAEIRTTNPVATEQYGSVCSVTGDLEGEENQE

SEQ ID NO: 87270 - protein, 35 aa, Artificial Sequence
  Description of Artificial Sequence: Synthetic polypeptide
DENEIRTTNPVATEQYGSVCSVTVLLNERGNFSEG

SEQ ID NO: 87271 - protein, 32 aa, Artificial Sequence
  Description of Artificial Sequence: Synthetic polypeptide
DEAEIRTTNPVATEQYGSVCSYNYEETTGVQQ

SEQ ID NO: 87272 - protein, 37 aa, Artificial Sequence
  Description of Artificial Sequence: Synthetic polypeptide
DEAEIRTTNPVATEQYGSVCSYTNMLWQPRSGENEDN

SEQ ID NO: 87273 - protein, 33 aa, Artificial Sequence
  Description of Artificial Sequence: Synthetic polypeptide
DENEIRTTNPVATEQYGSVCSTLVEQEIPNNEE

SEQ ID NO: 87274 - protein, 34 aa, Artificial Sequence
  Description of Artificial Sequence: Synthetic polypeptide
DENEIRTTNPVATEQYGSVCSPTVLENRNGTDID

SEQ ID NO: 87275 - protein, 33 aa, Artificial Sequence
  Description of Artificial Sequence: Synthetic polypeptide
DEAEIRTTNPVATEQYGSVCTETANPERQDNEM

SEQ ID NO: 87276 - protein, 30 aa, Artificial Sequence
  Description of Artificial Sequence: Synthetic polypeptide
DENEIRTTNPVSTEPYGTVSCDIQQQQGNH

SEQ ID NO: 87277 - protein, 34 aa, Artificial Sequence
  Description of Artificial Sequence: Synthetic polypeptide
DEAEIRTTNPVATEQYGSVCSTLLQLEIGQMEDH

SEQ ID NO: 87278 - protein, 33 aa, Artificial Sequence
  Description of Artificial Sequence: Synthetic polypeptide
DEAEIRTTNPVATEQYGSVCSTIYGLQSNMEDM

SEQ ID NO: 87279 - protein, 33 aa, Artificial Sequence
  Description of Artificial Sequence: Synthetic polypeptide
DENEIRTTNPVATEQYGSVMDQNLQFENMNIGG

SEQ ID NO: 87280 - protein, 33 aa, Artificial Sequence
  Description of Artificial Sequence: Synthetic polypeptide
DENEIRTTNPVATEQYGSVMSQNDIFNEGNMDD

SEQ ID NO: 87281 - protein, 31 aa, Artificial Sequence
  Description of Artificial Sequence: Synthetic polypeptide
DENEIRTTNPVSTEPYGTISMEDIQQQRGNR

SEQ ID NO: 87282 - protein, 33 aa, Artificial Sequence
  Description of Artificial Sequence: Synthetic polypeptide
DENEIRTTNPVATEQYGSVMSNQNLFENMNIID

SEQ ID NO: 87283 - protein, 33 aa, Artificial Sequence
  Description of Artificial Sequence: Synthetic polypeptide
DEEEIRTTNPVATEQYGSVSVTEVGPEVGMPES

SEQ ID NO: 87284 - protein, 35 aa, Artificial Sequence
  Description of Artificial Sequence: Synthetic polypeptide
DEAEIRTTNPVATEQYGSVCSPTNNLERNDDTQER

SEQ ID NO: 87285 - protein, 30 aa, Artificial Sequence
  Description of Artificial Sequence: Synthetic polypeptide
DENEIRTTNPVSTEPYGTISMENIQQQGNH

SEQ ID NO: 87286 - protein, 33 aa, Artificial Sequence
  Description of Artificial Sequence: Synthetic polypeptide
DEAEIRTTNPVATEQYGSVCSSQINLFMENMID

SEQ ID NO: 87287 - protein, 30 aa, Artificial Sequence
  Description of Artificial Sequence: Synthetic polypeptide
DENEIRTTNPVSTEPYGTISSEDLQQQGNH

SEQ ID NO: 87288 - protein, 35 aa, Artificial Sequence
  Description of Artificial Sequence: Synthetic polypeptide
DEEEIRTTNPVATEQYGSVSYTGSLLQQQNEEPLG

SEQ ID NO: 87289 - protein, 31 aa, Artificial Sequence
  Description of Artificial Sequence: Synthetic polypeptide
DENEIRTTNPVSTEPYGTISTEDLQDHNGNH

SEQ ID NO: 87290 - protein, 34 aa, Artificial Sequence
  Description of Artificial Sequence: Synthetic polypeptide
DENEIRTTNPVATEQYGSVMSDGTEGGQEDGNID

SEQ ID NO: 87291 - protein, 34 aa, Artificial Sequence
  Description of Artificial Sequence: Synthetic polypeptide
DEAEIRTTNPVATEQYGSVCSSVDLQERLGGSEV

SEQ ID NO: 87292 - protein, 34 aa, Artificial Sequence
  Description of Artificial Sequence: Synthetic polypeptide
DEAEIRTTNPVATEQYGSVCSSVLQSEIGQNEDH

SEQ ID NO: 87293 - protein, 34 aa, Artificial Sequence
  Description of Artificial Sequence: Synthetic polypeptide
DEEEIRTTNPVATEQYGSVSVTAPLTEVGGLDFE

SEQ ID NO: 87294 - protein, 33 aa, Artificial Sequence
  Description of Artificial Sequence: Synthetic polypeptide
DEEEIRTTNPVATEQYGSVSVTADALEENPQQE

SEQ ID NO: 87295 - protein, 32 aa, Artificial Sequence
  Description of Artificial Sequence: Synthetic polypeptide
DENEIRTTNPVATEQYGSVMDTVLPDNIDNQE

SEQ ID NO: 87296 - protein, 30 aa, Artificial Sequence
  Description of Artificial Sequence: Synthetic polypeptide
DENEIRTTNPVSTEPYGTMSMEDLQQQGNH

SEQ ID NO: 87297 - protein, 35 aa, Artificial Sequence
  Description of Artificial Sequence: Synthetic polypeptide
DEEEIRTTNPVATEQYGSVSVSSDELHQHGGGESR

SEQ ID NO: 87298 - protein, 30 aa, Artificial Sequence
  Description of Artificial Sequence: Synthetic polypeptide
DENEIRTTNPVSTEPYGTVSMEDIQQNGNH

SEQ ID NO: 87299 - protein, 35 aa, Artificial Sequence
  Description of Artificial Sequence: Synthetic polypeptide
DENEIRTTNPVATEQYGSVCSPTNAQGSFEEENRI

SEQ ID NO: 87300 - protein, 34 aa, Artificial Sequence
  Description of Artificial Sequence: Synthetic polypeptide
DENEIRTTNPVATEQYGSVCSPTLLENRNGSDIS

SEQ ID NO: 87301 - protein, 30 aa, Artificial Sequence
  Description of Artificial Sequence: Synthetic polypeptide
DENEIRTTNPVSTEPYGVVSMDIQQQQGNH

SEQ ID NO: 87302 - protein, 30 aa, Artificial Sequence
  Description of Artificial Sequence: Synthetic polypeptide
DENEIRTTNPVSTEQWGDVSEDEQQQAGNH

SEQ ID NO: 87303 - protein, 33 aa, Artificial Sequence
  Description of Artificial Sequence: Synthetic polypeptide
DEAEIRTTNPVATEQYGSVEWTDVEQRSNQNDN

SEQ ID NO: 87304 - protein, 30 aa, Artificial Sequence
  Description of Artificial Sequence: Synthetic polypeptide
DENEIRTTNPVSTEQYGEISEEVCQQQGNK

SEQ ID NO: 87305 - protein, 31 aa, Artificial Sequence
  Description of Artificial Sequence: Synthetic polypeptide
DENEIRTTNPVSTEQYGEISMEDIQQRNGGR

SEQ ID NO: 87306 - protein, 33 aa, Artificial Sequence
  Description of Artificial Sequence: Synthetic polypeptide
DEAEIRTTNPVATEQYGSVFSPTNHETVTNEDN

SEQ ID NO: 87307 - protein, 32 aa, Artificial Sequence
  Description of Artificial Sequence: Synthetic polypeptide
CEEEIRTTNPVATEQYGCVSNTEHQENFGSDQ

SEQ ID NO: 87308 - protein, 33 aa, Artificial Sequence
  Description of Artificial Sequence: Synthetic polypeptide
DEAEIRTTNPVATEQYGSVFSTLDYLTPGDEDG

SEQ ID NO: 87309 - protein, 33 aa, Artificial Sequence
  Description of Artificial Sequence: Synthetic polypeptide
DENEIRTTNPVSTEQYGSCSIAADLMQRGNADV

SEQ ID NO: 87310 - protein, 33 aa, Artificial Sequence
  Description of Artificial Sequence: Synthetic polypeptide
DEAEIRTTNPVATEQYGSVFVWINEQDRKNNDS

SEQ ID NO: 87311 - protein, 30 aa, Artificial Sequence
  Description of Artificial Sequence: Synthetic polypeptide
DENEIRTTNPVSTEQYGTISCDIQQQQGNH

SEQ ID NO: 87312 - protein, 33 aa, Artificial Sequence
  Description of Artificial Sequence: Synthetic polypeptide
DEAEIRTTNPVATEQYGSVGENLDFGGNENDDI

SEQ ID NO: 87313 - protein, 33 aa, Artificial Sequence
  Description of Artificial Sequence: Synthetic polypeptide
DEAEIRTTNPVATEQYGSVGENLDPGGNNENDQ

SEQ ID NO: 87314 - protein, 31 aa, Artificial Sequence
  Description of Artificial Sequence: Synthetic polypeptide
DENEIRTTNPVSTEQYGTISEDIQQQQNGNR

SEQ ID NO: 87315 - protein, 31 aa, Artificial Sequence
  Description of Artificial Sequence: Synthetic polypeptide
DENEIRTTNPVSTEQYGTISMEDIQQRNGGR

SEQ ID NO: 87316 - protein, 31 aa, Artificial Sequence
  Description of Artificial Sequence: Synthetic polypeptide
DENEIRTTNPVSTEQYGTVSTEGPVEFEGNH

SEQ ID NO: 87317 - protein, 32 aa, Artificial Sequence
  Description of Artificial Sequence: Synthetic polypeptide
DENEIRTTNPVSTEQYGTVSTEGPVEQFEGNH

SEQ ID NO: 87318 - protein, 33 aa, Artificial Sequence
  Description of Artificial Sequence: Synthetic polypeptide
DENEIRTTNPVATEQYGSSSVYDMLEQRVQNEF

SEQ ID NO: 87319 - protein, 29 aa, Artificial Sequence
  Description of Artificial Sequence: Synthetic peptide
DENEIRTTNPVSTEPYGTISMEDIQQGNH

SEQ ID NO: 87320 - protein, 32 aa, Artificial Sequence
  Description of Artificial Sequence: Synthetic polypeptide
DEAEIRTTNPVATEQYGSVETPNEQNSIEHTD

SEQ ID NO: 87321 - protein, 33 aa, Artificial Sequence
  Description of Artificial Sequence: Synthetic polypeptide
DENEIRTTNPVATEQYGSVCSENVNLLTRNEDH

SEQ ID NO: 87322 - protein, 32 aa, Artificial Sequence
  Description of Artificial Sequence: Synthetic polypeptide
DENEIRTTNPVSTEPYGTVSMENIQQQRNGNH

SEQ ID NO: 87323 - protein, 33 aa, Artificial Sequence
  Description of Artificial Sequence: Synthetic polypeptide
DEAEIRTTNPVATEQYGSVCTTNPNQEHGEFKN

SEQ ID NO: 87324 - protein, 34 aa, Artificial Sequence
  Description of Artificial Sequence: Synthetic polypeptide
DEEEIRTTNPVATEQYGSVSYTPNPIQQTIQVEE

SEQ ID NO: 87325 - protein, 31 aa, Artificial Sequence
  Description of Artificial Sequence: Synthetic polypeptide
DENEIRTTNPVSTEPYGTVSTDDIQQQNGNH

SEQ ID NO: 87326 - protein, 33 aa, Artificial Sequence
  Description of Artificial Sequence: Synthetic polypeptide
DENEIRTTNPVATEQYGSVCSPTADELFEDNNT

SEQ ID NO: 87327 - protein, 33 aa, Artificial Sequence
  Description of Artificial Sequence: Synthetic polypeptide
DEAEIRTTNPVATEQYGSVCWEGNLEGGNNEED

SEQ ID NO: 87328 - protein, 34 aa, Artificial Sequence
  Description of Artificial Sequence: Synthetic polypeptide
DEAEIRTTNPVATEQYGSVDTVNIDTTSGNESRQ

SEQ ID NO: 87329 - protein, 33 aa, Artificial Sequence
  Description of Artificial Sequence: Synthetic polypeptide
DEEEIRTTNPVATEQYGSVSVSNNLEVSYISID

SEQ ID NO: 87330 - protein, 34 aa, Artificial Sequence
  Description of Artificial Sequence: Synthetic polypeptide
DEEEIRTTNPVATEQYGSVSYTPVTDQRPDELLS

SEQ ID NO: 87331 - protein, 33 aa, Artificial Sequence
  Description of Artificial Sequence: Synthetic polypeptide
DEEEIRTTNPVATEQYGSVSVSNNLESYIEDID

SEQ ID NO: 87332 - protein, 33 aa, Artificial Sequence
  Description of Artificial Sequence: Synthetic polypeptide
DEEEIRTTNPVATEQYGSVSVSNNLESFILPID

SEQ ID NO: 87333 - protein, 32 aa, Artificial Sequence
  Description of Artificial Sequence: Synthetic polypeptide
DENEIRTTNPVSTEPYGTVSTPDIQNQQNGNH

SEQ ID NO: 87334 - protein, 32 aa, Artificial Sequence
  Description of Artificial Sequence: Synthetic polypeptide
DENEIRTTNPVATEQYGSVCSPTADELFEDAD

SEQ ID NO: 87335 - protein, 34 aa, Artificial Sequence
  Description of Artificial Sequence: Synthetic polypeptide
DEEEIRTTNPVATEQYGSVSVSNLNDTNESNNDI

SEQ ID NO: 87336 - protein, 32 aa, Artificial Sequence
  Description of Artificial Sequence: Synthetic polypeptide
DENEIRTTNPVSTEPYGTVSTPDIQNQQNGNV

SEQ ID NO: 87337 - protein, 30 aa, Artificial Sequence
  Description of Artificial Sequence: Synthetic polypeptide
DENEIRTTNPVSTEPYGVISMEDLQQQGNH

SEQ ID NO: 87338 - protein, 30 aa, Artificial Sequence
  Description of Artificial Sequence: Synthetic polypeptide
DENEIRTTNPVSTEPYGVISMETLQQQGNH

SEQ ID NO: 87339 - protein, 32 aa, Artificial Sequence
  Description of Artificial Sequence: Synthetic polypeptide
DENEIRTTNPVATEQYGSVCSEGAAQRVQDDV

SEQ ID NO: 87340 - protein, 30 aa, Artificial Sequence
  Description of Artificial Sequence: Synthetic polypeptide
DENEIRTTNPVATEQWGSVSCIEMNAEGDG

SEQ ID NO: 87341 - protein, 30 aa, Artificial Sequence
  Description of Artificial Sequence: Synthetic polypeptide
DENEIRTTNPVSTEPYGTISMDLQQQNGNH

SEQ ID NO: 87342 - protein, 33 aa, Artificial Sequence
  Description of Artificial Sequence: Synthetic polypeptide
DENEIRTTNPVATEQYGSVMSQNNLFEEMNEGE

SEQ ID NO: 87343 - protein, 34 aa, Artificial Sequence
  Description of Artificial Sequence: Synthetic polypeptide
DENEIRTTNPVATEQYGSVSAPNDENQEIGSERN

SEQ ID NO: 87344 - protein, 34 aa, Artificial Sequence
  Description of Artificial Sequence: Synthetic polypeptide
DENEIRTTNPVAYEQYGSVSVTDTLDKDRGMNLH

SEQ ID NO: 87345 - protein, 33 aa, Artificial Sequence
  Description of Artificial Sequence: Synthetic polypeptide
DENEIRTTNPVAYEQYGSVVATNALSQSTGMTH

SEQ ID NO: 87346 - protein, 33 aa, Artificial Sequence
  Description of Artificial Sequence: Synthetic polypeptide
CEEEIRTTNPVATEQYGCVSVNVWNTWRSGTER

SEQ ID NO: 87347 - protein, 33 aa, Artificial Sequence
  Description of Artificial Sequence: Synthetic polypeptide
DENEIRTTNPVATEQYGSVSANENQEILQEEDN

SEQ ID NO: 87348 - protein, 29 aa, Artificial Sequence
  Description of Artificial Sequence: Synthetic peptide
DENEIRTTNPVGTEPYGTMSMDLQQQGDI

SEQ ID NO: 87349 - protein, 30 aa, Artificial Sequence
  Description of Artificial Sequence: Synthetic polypeptide
DENEIRTTNPVGTEPYGTMSMDLQQQQGNH

SEQ ID NO: 87350 - protein, 32 aa, Artificial Sequence
  Description of Artificial Sequence: Synthetic polypeptide
DENEIRTTNPVATEQYGSVSAPWDEQELDDRI

SEQ ID NO: 87351 - protein, 34 aa, Artificial Sequence
  Description of Artificial Sequence: Synthetic polypeptide
DEAEIRTTNPVATEQYGSTSWSTNNQEEGNDQEK

SEQ ID NO: 87352 - protein, 34 aa, Artificial Sequence
  Description of Artificial Sequence: Synthetic polypeptide
DEAEIRTTNPVATEQYGSTVQSTGNALGSTGGMH

SEQ ID NO: 87353 - protein, 29 aa, Artificial Sequence
  Description of Artificial Sequence: Synthetic peptide
DENEIRTTNPVSTECYGTISMCLQQQGEL

SEQ ID NO: 87354 - protein, 35 aa, Artificial Sequence
  Description of Artificial Sequence: Synthetic polypeptide
DEEEIRTTNPVATEQYGSVSVTNLGLSQVPFQVQA

SEQ ID NO: 87355 - protein, 29 aa, Artificial Sequence
  Description of Artificial Sequence: Synthetic peptide
DENEIRTTNPVSTECYGTISMDLQQQGEL

SEQ ID NO: 87356 - protein, 33 aa, Artificial Sequence
  Description of Artificial Sequence: Synthetic polypeptide
DENEIRTTNPVATEQYGSVSANDQIEGIDEEHV

SEQ ID NO: 87357 - protein, 33 aa, Artificial Sequence
  Description of Artificial Sequence: Synthetic polypeptide
DENEIRTTNPVATEQYGSVSANDNQIEGSEEHT

SEQ ID NO: 87358 - protein, 32 aa, Artificial Sequence
  Description of Artificial Sequence: Synthetic polypeptide
DENEIRTTNPVATEQYGSVSANADMIEGSEEH

SEQ ID NO: 87359 - protein, 30 aa, Artificial Sequence
  Description of Artificial Sequence: Synthetic polypeptide
DENEIRTTNPVGTEPYGTMSMDLQQQQGNI

SEQ ID NO: 87360 - protein, 31 aa, Artificial Sequence
  Description of Artificial Sequence: Synthetic polypeptide
DENEIRTTNPVAYEAYGWVSNNELSQQGGSP

SEQ ID NO: 87361 - protein, 32 aa, Artificial Sequence
  Description of Artificial Sequence: Synthetic polypeptide
DENEIRTTNPVATEQYGSVSATDIEDHEGEDH

SEQ ID NO: 87362 - protein, 33 aa, Artificial Sequence
  Description of Artificial Sequence: Synthetic polypeptide
DENEIRTTNPVAYEAYGSVSNNLSQEVGGTNQD

SEQ ID NO: 87363 - protein, 34 aa, Artificial Sequence
  Description of Artificial Sequence: Synthetic polypeptide
DENEIRTTNPVATESYGSVNSNNDLDQRGQTGQT

SEQ ID NO: 87364 - protein, 33 aa, Artificial Sequence
  Description of Artificial Sequence: Synthetic polypeptide
DEEEIRTTNPVATEQYGSVSYLPEEQLLVNQNM

SEQ ID NO: 87365 - protein, 33 aa, Artificial Sequence
  Description of Artificial Sequence: Synthetic polypeptide
CEEEIRTTNPVATEQYGQCVCSTEHQNGSENQE

SEQ ID NO: 87366 - protein, 33 aa, Artificial Sequence
  Description of Artificial Sequence: Synthetic polypeptide
DENEIRTTNPVATEYYGVSSTTLNNLQRIENCT

SEQ ID NO: 87367 - protein, 34 aa, Artificial Sequence
  Description of Artificial Sequence: Synthetic polypeptide
DENEIRTTNPVATTAYGSVSTNLQQGSTTENIMT

SEQ ID NO: 87368 - protein, 31 aa, Artificial Sequence
  Description of Artificial Sequence: Synthetic polypeptide
DENEIRTTNPVATWHYGSVSTNLEEHHTEEI

SEQ ID NO: 87369 - protein, 32 aa, Artificial Sequence
  Description of Artificial Sequence: Synthetic polypeptide
DENEIRTTNPVATWHYGSVSTNLEEHRSTPSF

SEQ ID NO: 87370 - protein, 32 aa, Artificial Sequence
  Description of Artificial Sequence: Synthetic polypeptide
DENEIRTTNPVATWHYGSVSTNLEEHRTEEAN

SEQ ID NO: 87371 - protein, 32 aa, Artificial Sequence
  Description of Artificial Sequence: Synthetic polypeptide
DENEIRTTNPVATWPYGSVSTNLEEHRTEESQ

SEQ ID NO: 87372 - protein, 33 aa, Artificial Sequence
  Description of Artificial Sequence: Synthetic polypeptide
DENEIRTTNPVAVEQYGSCSTNLEVELLVNPRI

SEQ ID NO: 87373 - protein, 35 aa, Artificial Sequence
  Description of Artificial Sequence: Synthetic polypeptide
CEEEIRTTNPVATEQYGQCVCSNTENLQENFGSNQ

SEQ ID NO: 87374 - protein, 33 aa, Artificial Sequence
  Description of Artificial Sequence: Synthetic polypeptide
CEEEIRTTNPVATEQYGQCVCPTELQNFGSNQE

SEQ ID NO: 87375 - protein, 32 aa, Artificial Sequence
  Description of Artificial Sequence: Synthetic polypeptide
DENEIRTTNPVATEQYGSVSATDIEDHEGEDL

SEQ ID NO: 87376 - protein, 35 aa, Artificial Sequence
  Description of Artificial Sequence: Synthetic polypeptide
DEEEIRTTNPVATEQYGSVSYMNELQPRVAEEEST

SEQ ID NO: 87377 - protein, 33 aa, Artificial Sequence
  Description of Artificial Sequence: Synthetic polypeptide
DENEIRTTNPVAYEAYGSVFNLNLSQRGGTNQA

SEQ ID NO: 87378 - protein, 33 aa, Artificial Sequence
  Description of Artificial Sequence: Synthetic polypeptide
DENEIRTTNPVAYEAYGSVSNLNESQRGGTNQI

SEQ ID NO: 87379 - protein, 33 aa, Artificial Sequence
  Description of Artificial Sequence: Synthetic polypeptide
DENEIRTTNPVAYEAYGSVSNNELSQRDGGSYP

SEQ ID NO: 87380 - protein, 32 aa, Artificial Sequence
  Description of Artificial Sequence: Synthetic polypeptide
DENEIRTTNPVATEQYGSVSAMDIEQQEGEDH

SEQ ID NO: 87381 - protein, 33 aa, Artificial Sequence
  Description of Artificial Sequence: Synthetic polypeptide
DEAEIRTTNPVATEQYGSVASVTWEVDEGEERF

SEQ ID NO: 87382 - protein, 33 aa, Artificial Sequence
  Description of Artificial Sequence: Synthetic polypeptide
DENEIRTTNPVATEQYGSVSADENGEILQEERN

SEQ ID NO: 87383 - protein, 32 aa, Artificial Sequence
  Description of Artificial Sequence: Synthetic polypeptide
DEAEIRTTNPVATEQYGSVCETPDLPEGEEQI

SEQ ID NO: 87384 - protein, 33 aa, Artificial Sequence
  Description of Artificial Sequence: Synthetic polypeptide
DEAEIRTTNPVATEQYGSVCSHGMLEERGFDQD

SEQ ID NO: 87385 - protein, 34 aa, Artificial Sequence
  Description of Artificial Sequence: Synthetic polypeptide
DEAEIRTTNPVATEQYGSVCSHGMLEERGGENQD

SEQ ID NO: 87386 - protein, 33 aa, Artificial Sequence
  Description of Artificial Sequence: Synthetic polypeptide
DENEIRTTNPVSTEPYGSVSSTPDGQQQRNGNH

SEQ ID NO: 87387 - protein, 33 aa, Artificial Sequence
  Description of Artificial Sequence: Synthetic polypeptide
DENEIRTTNPVSTEPYGSVSSTPDIQNQQNGNV

SEQ ID NO: 87388 - protein, 31 aa, Artificial Sequence
  Description of Artificial Sequence: Synthetic polypeptide
DENEIRTTNPVATEQYGSVQTDDHDQEQIEM

SEQ ID NO: 87389 - protein, 32 aa, Artificial Sequence
  Description of Artificial Sequence: Synthetic polypeptide
DENEIRTTNPVATEQYGSVQTALILRIEPEMT

SEQ ID NO: 87390 - protein, 34 aa, Artificial Sequence
  Description of Artificial Sequence: Synthetic polypeptide
DEEEIRTTNPVATEQYGSVSVTLMTEVFGNNIDY

SEQ ID NO: 87391 - protein, 34 aa, Artificial Sequence
  Description of Artificial Sequence: Synthetic polypeptide
DEEEIRTTNPVATEQYGSVSVTLMTENFEGNNQY

SEQ ID NO: 87392 - protein, 32 aa, Artificial Sequence
  Description of Artificial Sequence: Synthetic polypeptide
DENEIRTTNPVATEQYGSVQTALILRIEEMEQ

SEQ ID NO: 87393 - protein, 31 aa, Artificial Sequence
  Description of Artificial Sequence: Synthetic polypeptide
DENEIRTTNPVSTEPYGTISATDLQQHNGNH

SEQ ID NO: 87394 - protein, 31 aa, Artificial Sequence
  Description of Artificial Sequence: Synthetic polypeptide
DENEIRTTNPVATEQYGSVQTAIEILEMQRV

SEQ ID NO: 87395 - protein, 34 aa, Artificial Sequence
  Description of Artificial Sequence: Synthetic polypeptide
DEEEIRTTNPVATEQYGSVSYPVNENTVEGSERA

SEQ ID NO: 87396 - protein, 35 aa, Artificial Sequence
  Description of Artificial Sequence: Synthetic polypeptide
DENEIRTTNPVATEQYGSVMSTYNWQDDNYGENND

SEQ ID NO: 87397 - protein, 34 aa, Artificial Sequence
  Description of Artificial Sequence: Synthetic polypeptide
DENEIRTTNPVATEQYGSVMSQNTIFNEGNGNDD

SEQ ID NO: 87398 - protein, 32 aa, Artificial Sequence
  Description of Artificial Sequence: Synthetic polypeptide
DEAEIRTTNPVATEQYGSVCSPDLEDIENSQQ

SEQ ID NO: 87399 - protein, 29 aa, Artificial Sequence
  Description of Artificial Sequence: Synthetic peptide
DENEIRTTNPVSTEPYGTISMDIQQQGNH

SEQ ID NO: 87400 - protein, 33 aa, Artificial Sequence
  Description of Artificial Sequence: Synthetic polypeptide
DENEIRTTNPVATEQYGSVMSQNNLFENMNDID

SEQ ID NO: 87401 - protein, 32 aa, Artificial Sequence
  Description of Artificial Sequence: Synthetic polypeptide
DEAEIRTTNPVATEQYGSVCSEDSLTGQNEME

SEQ ID NO: 87402 - protein, 32 aa, Artificial Sequence
  Description of Artificial Sequence: Synthetic polypeptide
DENEIRTTNPVATEQYGSVMSQNNIFENMNGE

SEQ ID NO: 87403 - protein, 35 aa, Artificial Sequence
  Description of Artificial Sequence: Synthetic polypeptide
DEEEIRTTNPVATEQYGSVSVTMMNGELVIAHNGQ

SEQ ID NO: 87404 - protein, 31 aa, Artificial Sequence
  Description of Artificial Sequence: Synthetic polypeptide
DENEIRTTNPVSTEPYGSVSMEDIQQQNGNH

SEQ ID NO: 87405 - protein, 32 aa, Artificial Sequence
  Description of Artificial Sequence: Synthetic polypeptide
DEAEIRTTNPVATEQYGSCSYDALQGGSEDMI

SEQ ID NO: 87406 - protein, 32 aa, Artificial Sequence
  Description of Artificial Sequence: Synthetic polypeptide
DENEIRTTNPVATEQYGSVQVTALILEMEGDD

SEQ ID NO: 87407 - protein, 34 aa, Artificial Sequence
  Description of Artificial Sequence: Synthetic polypeptide
DEAEIRTTNPVATEQYGSVCETWPWDEQRGNEKN

SEQ ID NO: 87408 - protein, 31 aa, Artificial Sequence
  Description of Artificial Sequence: Synthetic polypeptide
DENEIRTTNPVSTEGYGTVSMDIQQQRNGQR

SEQ ID NO: 87409 - protein, 32 aa, Artificial Sequence
  Description of Artificial Sequence: Synthetic polypeptide
DENEIRTTNPVSTEPWGSVSMENEPQDRNGNG

SEQ ID NO: 87410 - protein, 33 aa, Artificial Sequence
  Description of Artificial Sequence: Synthetic polypeptide
DENEIRTTNPVATEQYGSVQTVNALENIGSTEI

SEQ ID NO: 87411 - protein, 32 aa, Artificial Sequence
  Description of Artificial Sequence: Synthetic polypeptide
DEAEIRTTNPVATEQYGSCSTDALKHGSEDMM

SEQ ID NO: 87412 - protein, 31 aa, Artificial Sequence
  Description of Artificial Sequence: Synthetic polypeptide
DENEIRTTNPVSTEPYGEISMENIQQRNGNH

SEQ ID NO: 87413 - protein, 34 aa, Artificial Sequence
  Description of Artificial Sequence: Synthetic polypeptide
CEEEIRTTNPVAYEQYGQSVSQYNDLTFRGIERT

SEQ ID NO: 87414 - protein, 34 aa, Artificial Sequence
  Description of Artificial Sequence: Synthetic polypeptide
DEEEIRTTNPVATEQYGSVSYNNEHQLVTVDGGF

SEQ ID NO: 87415 - protein, 31 aa, Artificial Sequence
  Description of Artificial Sequence: Synthetic polypeptide
DENEIRTTNPVSTEPYGIVSCDLQQQQNGNH

SEQ ID NO: 87416 - protein, 36 aa, Artificial Sequence
  Description of Artificial Sequence: Synthetic polypeptide
DEEEIRTTNPVATEQYGSVSVTNGDLPEYRQMENGE

SEQ ID NO: 87417 - protein, 32 aa, Artificial Sequence
  Description of Artificial Sequence: Synthetic polypeptide
DENEIRTTNPVSTEPYGSISATDLQEQHNGNH

SEQ ID NO: 87418 - protein, 34 aa, Artificial Sequence
  Description of Artificial Sequence: Synthetic polypeptide
DEAEIRTTNPVATEQYGSVCMTDIQDNRNGNGES

SEQ ID NO: 87419 - protein, 33 aa, Artificial Sequence
  Description of Artificial Sequence: Synthetic polypeptide
DEAEIRTTNPVATEQYGSVCPTDLLQERQEDQG

SEQ ID NO: 87420 - protein, 34 aa, Artificial Sequence
  Description of Artificial Sequence: Synthetic polypeptide
DEEEIRTTNPVATEQYGSVSYNNEQQLVTVIGQE

SEQ ID NO: 87421 - protein, 32 aa, Artificial Sequence
  Description of Artificial Sequence: Synthetic polypeptide
DENEIRTTNPVSTEPYGSVSCENIPQQQNGNH

SEQ ID NO: 87422 - protein, 33 aa, Artificial Sequence
  Description of Artificial Sequence: Synthetic polypeptide
DEAEIRTTNPVATEQYGSCSSMNLDERQSDNQS

SEQ ID NO: 87423 - protein, 30 aa, Artificial Sequence
  Description of Artificial Sequence: Synthetic polypeptide
DEQEIAPTNPCATEQYGIVSATDLQDHGTL

SEQ ID NO: 87424 - protein, 31 aa, Artificial Sequence
  Description of Artificial Sequence: Synthetic polypeptide
CEEEIRTTNPCAYEQYGSVPCTGLSARGGSN

SEQ ID NO: 87425 - protein, 30 aa, Artificial Sequence
  Description of Artificial Sequence: Synthetic polypeptide
DENEIRTTNPVATEQWGSVSCIEMNAEGDA

SEQ ID NO: 87426 - protein, 32 aa, Artificial Sequence
  Description of Artificial Sequence: Synthetic polypeptide
DEQEIATTNPVATEQYGSVSANTLEDHEGQDL

SEQ ID NO: 87427 - protein, 37 aa, Artificial Sequence
  Description of Artificial Sequence: Synthetic polypeptide
DEEEIRTTNPVATEQYGSVSTTNQQQLQQNAEQGNND

SEQ ID NO: 87428 - protein, 32 aa, Artificial Sequence
  Description of Artificial Sequence: Synthetic polypeptide
DEQEIATTNPVATEQYGSVSASDLQDHEGEDL

SEQ ID NO: 87429 - protein, 34 aa, Artificial Sequence
  Description of Artificial Sequence: Synthetic polypeptide
DEEEIRTTNPVATEQYGSVVSPEDILERPNQEQA

SEQ ID NO: 87430 - protein, 32 aa, Artificial Sequence
  Description of Artificial Sequence: Synthetic polypeptide
DEQEIATTNPVATEQYGSVSATALEDEEGEDS

SEQ ID NO: 87431 - protein, 37 aa, Artificial Sequence
  Description of Artificial Sequence: Synthetic polypeptide
DEEEIRTTNPVATEQYGSVSTTNQQLQQGNNQQGVEE

SEQ ID NO: 87432 - protein, 32 aa, Artificial Sequence
  Description of Artificial Sequence: Synthetic polypeptide
DEQEIATTNPVATEQYGSVSATALEDHEGECL

SEQ ID NO: 87433 - protein, 32 aa, Artificial Sequence
  Description of Artificial Sequence: Synthetic polypeptide
DEQEIATTNPVATEQYGSVSANTLEDHEGEDL

SEQ ID NO: 87434 - protein, 32 aa, Artificial Sequence
  Description of Artificial Sequence: Synthetic polypeptide
DEQEIATTNPVATEQYGSVSATALEDHEGEDL

SEQ ID NO: 87435 - protein, 32 aa, Artificial Sequence
  Description of Artificial Sequence: Synthetic polypeptide
DEQEIATTNPVATEQYGSVSATALEDHEGEYL

SEQ ID NO: 87436 - protein, 36 aa, Artificial Sequence
  Description of Artificial Sequence: Synthetic polypeptide
DEEEIRTTNPVATEQYGSVSTTNQQLQGNNQQNEQE

SEQ ID NO: 87437 - protein, 37 aa, Artificial Sequence
  Description of Artificial Sequence: Synthetic polypeptide
DEEEIRTTNPVATEQYGSVSTTNQQLNQQGTEQGNTE

SEQ ID NO: 87438 - protein, 32 aa, Artificial Sequence
  Description of Artificial Sequence: Synthetic polypeptide
DEQEIATTNPVATEQYGSVSATALEDHTGEDL

SEQ ID NO: 87439 - protein, 32 aa, Artificial Sequence
  Description of Artificial Sequence: Synthetic polypeptide
DEQEIATTNPVATEQYGSVSATALEWHEGEDL

SEQ ID NO: 87440 - protein, 32 aa, Artificial Sequence
  Description of Artificial Sequence: Synthetic polypeptide
DEQEIATTNPVATEQYGSVSATALLDHEGEDL

SEQ ID NO: 87441 - protein, 32 aa, Artificial Sequence
  Description of Artificial Sequence: Synthetic polypeptide
DEQEIATTNPVATEQYGSVSATCLEDHEGEDL

SEQ ID NO: 87442 - protein, 32 aa, Artificial Sequence
  Description of Artificial Sequence: Synthetic polypeptide
DEQEIATTNPVATEQYGSVSATALEDHEGEPL

SEQ ID NO: 87443 - protein, 30 aa, Artificial Sequence
  Description of Artificial Sequence: Synthetic polypeptide
DENEIRTTNPVATEPYGDVSMIIQQQNEDA

SEQ ID NO: 87444 - protein, 32 aa, Artificial Sequence
  Description of Artificial Sequence: Synthetic polypeptide
DENEIRTTNPVATEPYGEISEENIQQQRNGNH

SEQ ID NO: 87445 - protein, 32 aa, Artificial Sequence
  Description of Artificial Sequence: Synthetic polypeptide
DEQEIATTNPVATEQYGSVSANDLEDHEGQDL

SEQ ID NO: 87446 - protein, 35 aa, Artificial Sequence
  Description of Artificial Sequence: Synthetic polypeptide
DEEEIRTTNPVATEQYGSVSTTPAGPNMHNGMNPV

SEQ ID NO: 87447 - protein, 31 aa, Artificial Sequence
  Description of Artificial Sequence: Synthetic polypeptide
DEQEIATTNPVATEQYGSVSAEVCQDHEGEL

SEQ ID NO: 87448 - protein, 35 aa, Artificial Sequence
  Description of Artificial Sequence: Synthetic polypeptide
DEEEIRTTNPVATEQYGSVSTTPAGPMMRNGMNPV

SEQ ID NO: 87449 - protein, 36 aa, Artificial Sequence
  Description of Artificial Sequence: Synthetic polypeptide
DEEEIRTTNPVATEQYGSVVSCTGNSLSMFQGNLEV

SEQ ID NO: 87450 - protein, 34 aa, Artificial Sequence
  Description of Artificial Sequence: Synthetic polypeptide
DEEEIRTTNPVATEQYGSVSTTPAGNDRNGMEDV

SEQ ID NO: 87451 - protein, 33 aa, Artificial Sequence
  Description of Artificial Sequence: Synthetic polypeptide
DENEIRTTNPVATEPYGSISTTPAGQNQRNGNV

SEQ ID NO: 87452 - protein, 33 aa, Artificial Sequence
  Description of Artificial Sequence: Synthetic polypeptide
DENEIRTTNPVATEPYGSISTTPAGQNQRNGNH

SEQ ID NO: 87453 - protein, 33 aa, Artificial Sequence
  Description of Artificial Sequence: Synthetic polypeptide
DEAEIRTTNPVATEPYGISVSWVVLADQIDNRS

SEQ ID NO: 87454 - protein, 31 aa, Artificial Sequence
  Description of Artificial Sequence: Synthetic polypeptide
DEQEIATTNPVATEQYGSVSAEVLEHEGEDL

SEQ ID NO: 87455 - protein, 35 aa, Artificial Sequence
  Description of Artificial Sequence: Synthetic polypeptide
DEEEIRTTNPVATEQYGSVSTTPAEPNDRNGMNPV

SEQ ID NO: 87456 - protein, 34 aa, Artificial Sequence
  Description of Artificial Sequence: Synthetic polypeptide
DEAEIRTTNPVATEQYGSVYVEENIQRSGQNDTQ

SEQ ID NO: 87457 - protein, 36 aa, Artificial Sequence
  Description of Artificial Sequence: Synthetic polypeptide
DEEEIRTTNPVATEQYGSVVSCTNSLSVVAVGNLEG

SEQ ID NO: 87458 - protein, 32 aa, Artificial Sequence
  Description of Artificial Sequence: Synthetic polypeptide
DENEIRTTNPVATEPYGSISMPAGQNQRNGNH

SEQ ID NO: 87459 - protein, 32 aa, Artificial Sequence
  Description of Artificial Sequence: Synthetic polypeptide
DENEIRTTNPVATEPYGSISMPAGQNQQNGNH

SEQ ID NO: 87460 - protein, 36 aa, Artificial Sequence
  Description of Artificial Sequence: Synthetic polypeptide
DEEEIRTTNPVATEQYGSVVSDDITNLDEEMGSGNQ

SEQ ID NO: 87461 - protein, 32 aa, Artificial Sequence
  Description of Artificial Sequence: Synthetic polypeptide
DENEIRTTNPVATEPYGSISMEDIPQMRNGNH

SEQ ID NO: 87462 - protein, 32 aa, Artificial Sequence
  Description of Artificial Sequence: Synthetic polypeptide
DEQEIATTNPVATEQYGSVSANDLEDHEGEDL

SEQ ID NO: 87463 - protein, 32 aa, Artificial Sequence
  Description of Artificial Sequence: Synthetic polypeptide
DEQEIATTNPVATEQYGSVSATCLEGHEGEDL

SEQ ID NO: 87464 - protein, 33 aa, Artificial Sequence
  Description of Artificial Sequence: Synthetic polypeptide
CEEEISTTNPVATEQYGCVCSNTYLQGFGSNQA

SEQ ID NO: 87465 - protein, 35 aa, Artificial Sequence
  Description of Artificial Sequence: Synthetic polypeptide
DEEEIRTTNPVATEQYGSVVSPENLLQQRIVDEDL

SEQ ID NO: 87466 - protein, 31 aa, Artificial Sequence
  Description of Artificial Sequence: Synthetic polypeptide
DEQEIATTNPVATEQYGSVSATDCEHEGEDL

SEQ ID NO: 87467 - protein, 34 aa, Artificial Sequence
  Description of Artificial Sequence: Synthetic polypeptide
DEEEIRTTNPVATEQYGSVVSPTDSLEGRTESIE

SEQ ID NO: 87468 - protein, 37 aa, Artificial Sequence
  Description of Artificial Sequence: Synthetic polypeptide
DEEEIRTTNPVATEQYGSVSTTNNNNQLQQNEEGNNE

SEQ ID NO: 87469 - protein, 32 aa, Artificial Sequence
  Description of Artificial Sequence: Synthetic polypeptide
DEQEIATTNPVATEQYGSVSATDIEDQEGEDL

SEQ ID NO: 87470 - protein, 32 aa, Artificial Sequence
  Description of Artificial Sequence: Synthetic polypeptide
DEQEIATTNPVATEQYGSVSATDIEDRVGQDL

SEQ ID NO: 87471 - protein, 32 aa, Artificial Sequence
  Description of Artificial Sequence: Synthetic polypeptide
DEQEIATTNPVATEQYGSVSATDIQDHVGQDL

SEQ ID NO: 87472 - protein, 32 aa, Artificial Sequence
  Description of Artificial Sequence: Synthetic polypeptide
DEQEIATTNPVATEQYGSVSATDIQEQHNGEL

SEQ ID NO: 87473 - protein, 32 aa, Artificial Sequence
  Description of Artificial Sequence: Synthetic polypeptide
DEQEIATTNPVATEQYGSVSATDLADHDGEDL

SEQ ID NO: 87474 - protein, 30 aa, Artificial Sequence
  Description of Artificial Sequence: Synthetic polypeptide
DENEIRTTNPVATEPWGTVSEIEQNQNGNA

SEQ ID NO: 87475 - protein, 32 aa, Artificial Sequence
  Description of Artificial Sequence: Synthetic polypeptide
DEQEIATTNPVATEQYGSVSATDLADHEGEDD

SEQ ID NO: 87476 - protein, 32 aa, Artificial Sequence
  Description of Artificial Sequence: Synthetic polypeptide
DEQEIATTNPVATEQYGSVSATDLADHEREDL

SEQ ID NO: 87477 - protein, 30 aa, Artificial Sequence
  Description of Artificial Sequence: Synthetic polypeptide
DENEIRTTNPVATEPWGTVSEIEQNQAGNA

SEQ ID NO: 87478 - protein, 32 aa, Artificial Sequence
  Description of Artificial Sequence: Synthetic polypeptide
DEQEIATTNPVATEQYGSVSATDLAEHEGEDL

SEQ ID NO: 87479 - protein, 32 aa, Artificial Sequence
  Description of Artificial Sequence: Synthetic polypeptide
DEQEIATTNPVATEQYGSVSATDLCDHEGEDL

SEQ ID NO: 87480 - protein, 35 aa, Artificial Sequence
  Description of Artificial Sequence: Synthetic polypeptide
DEAEIRTTNPVATEIYGSVVYSTNVLQTEGNEEKL

SEQ ID NO: 87481 - protein, 34 aa, Artificial Sequence
  Description of Artificial Sequence: Synthetic polypeptide
DEEEIRTTNPVATEQYGSVSTTNNGVISDGEIVE

SEQ ID NO: 87482 - protein, 30 aa, Artificial Sequence
  Description of Artificial Sequence: Synthetic polypeptide
DENEIRTTNPVATEPWGTVSEDIQNQNGNH

SEQ ID NO: 87483 - protein, 32 aa, Artificial Sequence
  Description of Artificial Sequence: Synthetic polypeptide
DEQEIATTNPVATEQYGSVSATDLADHEGEDL

SEQ ID NO: 87484 - protein, 33 aa, Artificial Sequence
  Description of Artificial Sequence: Synthetic polypeptide
DEQEIATTNPVATEQYGSVSATDHLEDHEGENL

SEQ ID NO: 87485 - protein, 35 aa, Artificial Sequence
  Description of Artificial Sequence: Synthetic polypeptide
DEEEIRTTNPVATEQYGSVSTTNNNQQQQNDEETD

SEQ ID NO: 87486 - protein, 32 aa, Artificial Sequence
  Description of Artificial Sequence: Synthetic polypeptide
DEQEIATTNPVATEQYGSVSATDGNDREGEPL

SEQ ID NO: 87487 - protein, 37 aa, Artificial Sequence
  Description of Artificial Sequence: Synthetic polypeptide
DEEEIRTTNPVATEQYGSVSTTNPNQLQQGENDEDEE

SEQ ID NO: 87488 - protein, 35 aa, Artificial Sequence
  Description of Artificial Sequence: Synthetic polypeptide
DEEEIRTTNPVATEQYGSVSTTNPNQLQQDEDEED

SEQ ID NO: 87489 - protein, 35 aa, Artificial Sequence
  Description of Artificial Sequence: Synthetic polypeptide
DEEEIRTTNPVATEQYGSVSTTNPLDFDGGGEEPI

SEQ ID NO: 87490 - protein, 36 aa, Artificial Sequence
  Description of Artificial Sequence: Synthetic polypeptide
DEEEIRTTNPVATEQYGSVSTTNPEGPNMRNGGNTV

SEQ ID NO: 87491 - protein, 36 aa, Artificial Sequence
  Description of Artificial Sequence: Synthetic polypeptide
DEEEIRTTNPVATEQYGSVSTTNNQQLNGNQENTED

SEQ ID NO: 87492 - protein, 36 aa, Artificial Sequence
  Description of Artificial Sequence: Synthetic polypeptide
DEEEIRTTNPVATEQYGSVSTTNNQQLNGNQEEEQD

SEQ ID NO: 87493 - protein, 36 aa, Artificial Sequence
  Description of Artificial Sequence: Synthetic polypeptide
DEEEIRTTNPVATEQYGSVSTTNNQQGQEQGTTGNE

SEQ ID NO: 87494 - protein, 32 aa, Artificial Sequence
  Description of Artificial Sequence: Synthetic polypeptide
DEQEIATTNPVATEQYGSVSATDGEQGEGEDL

SEQ ID NO: 87495 - protein, 32 aa, Artificial Sequence
  Description of Artificial Sequence: Synthetic polypeptide
DEQEIATTNPVATEQYGSVSATDGLEDHEGEL

SEQ ID NO: 87496 - protein, 33 aa, Artificial Sequence
  Description of Artificial Sequence: Synthetic polypeptide
DEQEIATTNPVATEQYGSVSATDGLEDHEGNDL

SEQ ID NO: 87497 - protein, 35 aa, Artificial Sequence
  Description of Artificial Sequence: Synthetic polypeptide
DEEEIRTTNPVATEQYGSVVSPNTNLHEMGFMETQ

SEQ ID NO: 87498 - protein, 30 aa, Artificial Sequence
  Description of Artificial Sequence: Synthetic polypeptide
DENEIRTTNPVATEPWGTVSEIIQNQNGNA

SEQ ID NO: 87499 - protein, 36 aa, Artificial Sequence
  Description of Artificial Sequence: Synthetic polypeptide
DEEEIRTTNPVATEQYGSVVSPSSNLEQRQGQEAEQ

SEQ ID NO: 87500 - protein, 33 aa, Artificial Sequence
  Description of Artificial Sequence: Synthetic polypeptide
DEQEIATTNPVATEQYGSVSATDGLVEFEGNDD

SEQ ID NO: 87501 - protein, 36 aa, Artificial Sequence
  Description of Artificial Sequence: Synthetic polypeptide
DEEEIRTTNPVATEQYGSVSTTNNQGGNEQGTQGNN

SEQ ID NO: 87502 - protein, 32 aa, Artificial Sequence
  Description of Artificial Sequence: Synthetic polypeptide
DEQEIATTNPVATEQYGSVSATDGNDHEGEDL

SEQ ID NO: 87503 - protein, 32 aa, Artificial Sequence
  Description of Artificial Sequence: Synthetic polypeptide
DEQEIATTNPVATEQYGSVSATDGNDREGEDL

SEQ ID NO: 87504 - protein, 32 aa, Artificial Sequence
  Description of Artificial Sequence: Synthetic polypeptide
DEQEIATTNPVATEQYGSVSATDALEDHEGEL

SEQ ID NO: 87505 - protein, 30 aa, Artificial Sequence
  Description of Artificial Sequence: Synthetic polypeptide
CEEEIATTNPVCTETYGSVANPNLQDAGGL

SEQ ID NO: 87506 - protein, 35 aa, Artificial Sequence
  Description of Artificial Sequence: Synthetic polypeptide
DEEEIRTTNPVATEQYGSVSTTPAGPNMRNGMNPI

SEQ ID NO: 87507 - protein, 34 aa, Artificial Sequence
  Description of Artificial Sequence: Synthetic polypeptide
DENEIRTTNPVATEPYGSVSTMEDGPQMRNGMNV

SEQ ID NO: 87508 - protein, 32 aa, Artificial Sequence
  Description of Artificial Sequence: Synthetic polypeptide
DENEIRTTNPVATEPYGTVSTEDIVEQQNGND

SEQ ID NO: 87509 - protein, 32 aa, Artificial Sequence
  Description of Artificial Sequence: Synthetic polypeptide
DENEIRTTNPVATEPYGTVSMPDIQNQQNGNV

SEQ ID NO: 87510 - protein, 35 aa, Artificial Sequence
  Description of Artificial Sequence: Synthetic polypeptide
DEEEIRTTNPVATEQYGSVVPAENGQLQRQQVENV

SEQ ID NO: 87511 - protein, 32 aa, Artificial Sequence
  Description of Artificial Sequence: Synthetic polypeptide
DENEIRTTNPVATEPYGTVSMEDIQNQQNGNV

SEQ ID NO: 87512 - protein, 32 aa, Artificial Sequence
  Description of Artificial Sequence: Synthetic polypeptide
DENEIRTTNPVATEPYGTVSMEAIQNQQNGNV

SEQ ID NO: 87513 - protein, 32 aa, Artificial Sequence
  Description of Artificial Sequence: Synthetic polypeptide
DENEIRTTNPVATEPYGTVSMEAIQNQQNGNH

SEQ ID NO: 87514 - protein, 32 aa, Artificial Sequence
  Description of Artificial Sequence: Synthetic polypeptide
DENEIRTTNPVATEPYGTVCSTEGPQQQNGNH

SEQ ID NO: 87515 - protein, 30 aa, Artificial Sequence
  Description of Artificial Sequence: Synthetic polypeptide
DENEIRTTNPVATEQWGATTSENWARKGPI

SEQ ID NO: 87516 - protein, 31 aa, Artificial Sequence
  Description of Artificial Sequence: Synthetic polypeptide
DEQEIATTNPVATEQYGSVSACDLEDHGEDL

SEQ ID NO: 87517 - protein, 35 aa, Artificial Sequence
  Description of Artificial Sequence: Synthetic polypeptide
DEEEIRTTNPVATEQYGSVSTTQQLLQGNNQQNQE

SEQ ID NO: 87518 - protein, 35 aa, Artificial Sequence
  Description of Artificial Sequence: Synthetic polypeptide
DEEEIRTTNPVATEQYGSVSTTQQLEQGTNQQNDE

SEQ ID NO: 87519 - protein, 34 aa, Artificial Sequence
  Description of Artificial Sequence: Synthetic polypeptide
DEEEIRTTNPVATEQYGSVVPPENYQVRPENDEG

SEQ ID NO: 87520 - protein, 32 aa, Artificial Sequence
  Description of Artificial Sequence: Synthetic polypeptide
DEQEIATTNPVATEQYGSVSADDLEDHEGNDL

SEQ ID NO: 87521 - protein, 31 aa, Artificial Sequence
  Description of Artificial Sequence: Synthetic polypeptide
DENEIRTTNPVATEPYGTISTDDPQQQEGNH

SEQ ID NO: 87522 - protein, 31 aa, Artificial Sequence
  Description of Artificial Sequence: Synthetic polypeptide
DEQEIATTNPVATEQYGSVSADDLEDHGEDL

SEQ ID NO: 87523 - protein, 32 aa, Artificial Sequence
  Description of Artificial Sequence: Synthetic polypeptide
DEAEIRTTNPVATEQWGAVSTNLNGNAGEGMT

SEQ ID NO: 87524 - protein, 32 aa, Artificial Sequence
  Description of Artificial Sequence: Synthetic polypeptide
DEQEIATTNPVATEQYGSVSACDLEDREGEDG

SEQ ID NO: 87525 - protein, 31 aa, Artificial Sequence
  Description of Artificial Sequence: Synthetic polypeptide
DENEIRTTNPVATEQWGAVSEIETNAAEGDA

SEQ ID NO: 87526 - protein, 30 aa, Artificial Sequence
  Description of Artificial Sequence: Synthetic polypeptide
DENEIRTTNPVATEQWGCVSETNENTAEDA

SEQ ID NO: 87527 - protein, 35 aa, Artificial Sequence
  Description of Artificial Sequence: Synthetic polypeptide
DEEEIRTTNPVATEQYGSVSTTQQQLQGNNQQNQE

SEQ ID NO: 87528 - protein, 33 aa, Artificial Sequence
  Description of Artificial Sequence: Synthetic polypeptide
DEAEIRTTNPVATEQYGSVWVTVEMEGIMNERE

SEQ ID NO: 87529 - protein, 33 aa, Artificial Sequence
  Description of Artificial Sequence: Synthetic polypeptide
DEAEIRTTNPVATEQYGSVWVTVEMEQGHNERE

SEQ ID NO: 87530 - protein, 33 aa, Artificial Sequence
  Description of Artificial Sequence: Synthetic polypeptide
DEAEIRTTNPVATEQYGSVWVTVEMESGNEDRE

SEQ ID NO: 87531 - protein, 33 aa, Artificial Sequence
  Description of Artificial Sequence: Synthetic polypeptide
DEAEIRTTNPVATEQYGSVWVTVEMMEFGNERE

SEQ ID NO: 87532 - protein, 33 aa, Artificial Sequence
  Description of Artificial Sequence: Synthetic polypeptide
DEAEIRTTNPVATEQYGSVWVTVEMYGQGNERE

SEQ ID NO: 87533 - protein, 33 aa, Artificial Sequence
  Description of Artificial Sequence: Synthetic polypeptide
DEAEIRTTNPVATEQYGSVWVTVESEPIGNERE

SEQ ID NO: 87534 - protein, 31 aa, Artificial Sequence
  Description of Artificial Sequence: Synthetic polypeptide
DENEIRTTNPVATEQWGDVSAETIQNRVEDR

SEQ ID NO: 87535 - protein, 31 aa, Artificial Sequence
  Description of Artificial Sequence: Synthetic polypeptide
DENEIRTTNPVATEQWGDVSAEIIMSRVGQR

SEQ ID NO: 87536 - protein, 32 aa, Artificial Sequence
  Description of Artificial Sequence: Synthetic polypeptide
DEAEIRTTNPVATEQYGSVWVTVLDHGMEHDM

SEQ ID NO: 87537 - protein, 28 aa, Artificial Sequence
  Description of Artificial Sequence: Synthetic peptide
DENEIRTTNPVATEQWGDMSSTLMAEDA

SEQ ID NO: 87538 - protein, 32 aa, Artificial Sequence
  Description of Artificial Sequence: Synthetic polypeptide
DEQEIATTNPVATEQYGSVQATDLERHEGEDL

SEQ ID NO: 87539 - protein, 32 aa, Artificial Sequence
  Description of Artificial Sequence: Synthetic polypeptide
DEAEIRTTNPVATEQYGSVWVTVMEEGMSERE

SEQ ID NO: 87540 - protein, 29 aa, Artificial Sequence
  Description of Artificial Sequence: Synthetic peptide
DENEIRTTNPVATEQWGDASENEMRAEGA

SEQ ID NO: 87541 - protein, 31 aa, Artificial Sequence
  Description of Artificial Sequence: Synthetic polypeptide
DEAEIRTTNPVATEQYGSVWVTVMEGINEFE

SEQ ID NO: 87542 - protein, 29 aa, Artificial Sequence
  Description of Artificial Sequence: Synthetic peptide
DENEIRTTNPVATEQWGDASENEMRAEDA

SEQ ID NO: 87543 - protein, 32 aa, Artificial Sequence
  Description of Artificial Sequence: Synthetic polypeptide
DEQEIATTNPVATEQYGSVRSATDLEHEGEDL

SEQ ID NO: 87544 - protein, 30 aa, Artificial Sequence
  Description of Artificial Sequence: Synthetic polypeptide
DENEIRTTNPVATEQWGDASENEMNRAEGR

SEQ ID NO: 87545 - protein, 31 aa, Artificial Sequence
  Description of Artificial Sequence: Synthetic polypeptide
DEQEIATTNPVATEQYGSVSADDLEDSGEDL

SEQ ID NO: 87546 - protein, 32 aa, Artificial Sequence
  Description of Artificial Sequence: Synthetic polypeptide
DEQEIATTNPVATEQYGSVSADDLQDHEGEDL

SEQ ID NO: 87547 - protein, 31 aa, Artificial Sequence
  Description of Artificial Sequence: Synthetic polypeptide
DENEIRTTNPVATEPYGTISMEDIQQQRGNH

SEQ ID NO: 87548 - protein, 36 aa, Artificial Sequence
  Description of Artificial Sequence: Synthetic polypeptide
DEEEIRTTNPVATEQYGSVVPSCTNMSSGRGQNMEP

SEQ ID NO: 87549 - protein, 32 aa, Artificial Sequence
  Description of Artificial Sequence: Synthetic polypeptide
DEQEIATTNPVATEQYGSVSAEDLQDHEGGDL

SEQ ID NO: 87550 - protein, 35 aa, Artificial Sequence
  Description of Artificial Sequence: Synthetic polypeptide
DEEEIRTTNPVATEQYGSVSTTPLLQVSRQMQEQA

SEQ ID NO: 87551 - protein, 35 aa, Artificial Sequence
  Description of Artificial Sequence: Synthetic polypeptide
DEEEIRTTNPVATEQYGSVSTTPLLDFTGGGNSIF

SEQ ID NO: 87552 - protein, 34 aa, Artificial Sequence
  Description of Artificial Sequence: Synthetic polypeptide
DEEEIRTTNPVATEQYGSVSTTPIGPNMANENPA

SEQ ID NO: 87553 - protein, 32 aa, Artificial Sequence
  Description of Artificial Sequence: Synthetic polypeptide
DEQEIATTNPVATEQYGSVSAENLEDHEGEDL

SEQ ID NO: 87554 - protein, 29 aa, Artificial Sequence
  Description of Artificial Sequence: Synthetic peptide
DENEIRTTNPVATEPYGTISEDIQQQGEL

SEQ ID NO: 87555 - protein, 32 aa, Artificial Sequence
  Description of Artificial Sequence: Synthetic polypeptide
DEQEIATTNPVATEQYGSVSAENLMDHEGEDL

SEQ ID NO: 87556 - protein, 32 aa, Artificial Sequence
  Description of Artificial Sequence: Synthetic polypeptide
DENEIRTTNPVATEPYGTISATEDLQDHEGNH

SEQ ID NO: 87557 - protein, 31 aa, Artificial Sequence
  Description of Artificial Sequence: Synthetic polypeptide
DENEIRTTNPVATEPYGTASMEDLQQQNGGR

SEQ ID NO: 87558 - protein, 34 aa, Artificial Sequence
  Description of Artificial Sequence: Synthetic polypeptide
DEEEIRTTNPVATEQYGSVSTTPALESEEGEELD

SEQ ID NO: 87559 - protein, 35 aa, Artificial Sequence
  Description of Artificial Sequence: Synthetic polypeptide
DEEEIRTTNPVATEQYGSVSTTPAIPNMRNGMNPV

SEQ ID NO: 87560 - protein, 31 aa, Artificial Sequence
  Description of Artificial Sequence: Synthetic polypeptide
DENEIRTTNPVATEPYGTASEEDLQQQNGGR

SEQ ID NO: 87561 - protein, 34 aa, Artificial Sequence
  Description of Artificial Sequence: Synthetic polypeptide
DEEEIRTTNPVATEQYGSVSTTPAGPNMSGMNPV

SEQ ID NO: 87562 - protein, 29 aa, Artificial Sequence
  Description of Artificial Sequence: Synthetic peptide
DENEIRTTNPVATEPYGTASEDIQQQGEK

SEQ ID NO: 87563 - protein, 34 aa, Artificial Sequence
  Description of Artificial Sequence: Synthetic polypeptide
DENEIRTTNPVATEPYGSVSTTEDGPQMRNGMNV

SEQ ID NO: 87564 - protein, 35 aa, Artificial Sequence
  Description of Artificial Sequence: Synthetic polypeptide
DEEEIRTTNPVATEQYGSVSTTPAGPNMRNGMNPV

SEQ ID NO: 87565 - protein, 34 aa, Artificial Sequence
  Description of Artificial Sequence: Synthetic polypeptide
DENEIRTTNPVATEPYGSVSTTEAGPQMRNGMNV

SEQ ID NO: 87566 - protein, 32 aa, Artificial Sequence
  Description of Artificial Sequence: Synthetic polypeptide
DEQEIATTNPVATEQYGSVSAEDLQDHEGEDL

SEQ ID NO: 87567 - protein, 32 aa, Artificial Sequence
  Description of Artificial Sequence: Synthetic polypeptide
DEQEIATTNPVATEQYGSVSATDLDDHEGEDL

SEQ ID NO: 87568 - protein, 33 aa, Artificial Sequence
  Description of Artificial Sequence: Synthetic polypeptide
DEAEIRTTNPVATEQFGTIVSTYPLLRGGNEMN

SEQ ID NO: 87569 - protein, 32 aa, Artificial Sequence
  Description of Artificial Sequence: Synthetic polypeptide
DEQEIATTNPVATEQYGSVSAEDLEDREGGDL

SEQ ID NO: 87570 - protein, 33 aa, Artificial Sequence
  Description of Artificial Sequence: Synthetic polypeptide
DEAEIRTTNPVATEQYGSVWYLLEQGGGNNEDH

SEQ ID NO: 87571 - protein, 36 aa, Artificial Sequence
  Description of Artificial Sequence: Synthetic polypeptide
DEEEIRTTNPVATEQYGSVSTTQNLLQGNNQQNIGE

SEQ ID NO: 87572 - protein, 35 aa, Artificial Sequence
  Description of Artificial Sequence: Synthetic polypeptide
DEEEIRTTNPVATEQYGSVVPSCTNSSGEGTNMEI

SEQ ID NO: 87573 - protein, 31 aa, Artificial Sequence
  Description of Artificial Sequence: Synthetic polypeptide
CEEEIATTNPVCTETYGSVANPNLQDGNKLM

SEQ ID NO: 87574 - protein, 32 aa, Artificial Sequence
  Description of Artificial Sequence: Synthetic polypeptide
DEQEIATTNPVATEQYGSVSAECLQDHEGEDL

SEQ ID NO: 87575 - protein, 31 aa, Artificial Sequence
  Description of Artificial Sequence: Synthetic polypeptide
DEQEIATTNPVATEQYGSVSAEDCQDHEGEL

SEQ ID NO: 87576 - protein, 34 aa, Artificial Sequence
  Description of Artificial Sequence: Synthetic polypeptide
DEAEIRTTNPVATEQYGSVYPTNVQETEDGNNEP

SEQ ID NO: 87577 - protein, 36 aa, Artificial Sequence
  Description of Artificial Sequence: Synthetic polypeptide
DEEEIRTTNPVATEQYGSVVPSCTNSSGNRGQNMED

SEQ ID NO: 87578 - protein, 36 aa, Artificial Sequence
  Description of Artificial Sequence: Synthetic polypeptide
DEEEIRTTNPVATEQYGSVVPSCTNSSGRPGQNMEI

SEQ ID NO: 87579 - protein, 33 aa, Artificial Sequence
  Description of Artificial Sequence: Synthetic polypeptide
DEEEIRTTNPVATEQYGSVVPSELTEGGTENYN

SEQ ID NO: 87580 - protein, 30 aa, Artificial Sequence
  Description of Artificial Sequence: Synthetic polypeptide
DENEIRTTNPVATEPYGTISMDIQQQNGNH

SEQ ID NO: 87581 - protein, 31 aa, Artificial Sequence
  Description of Artificial Sequence: Synthetic polypeptide
DEQEIATTNPVATEQYGSVSAEDLEDHEGEL

SEQ ID NO: 87582 - protein, 35 aa, Artificial Sequence
  Description of Artificial Sequence: Synthetic polypeptide
DEEEIRTTNPVATEQYGSVSTTPVGPNMRNGMNPV

SEQ ID NO: 87583 - protein, 35 aa, Artificial Sequence
  Description of Artificial Sequence: Synthetic polypeptide
DEEEIRTTNPVATEQYGSVVPSYTNSSGEGGNMTI

SEQ ID NO: 87584 - protein, 31 aa, Artificial Sequence
  Description of Artificial Sequence: Synthetic polypeptide
DEQEIATTNPVATEQYGSVSAEDLEDHGEDL

SEQ ID NO: 87585 - protein, 32 aa, Artificial Sequence
  Description of Artificial Sequence: Synthetic polypeptide
DEQEIATTNPVATEQYGSVSAEDLEDREGEDL

SEQ ID NO: 87586 - protein, 34 aa, Artificial Sequence
  Description of Artificial Sequence: Synthetic polypeptide
DEEEIRTTNPVATEQYGSVVPTEVLQRAVEEVDY

SEQ ID NO: 87587 - protein, 30 aa, Artificial Sequence
  Description of Artificial Sequence: Synthetic polypeptide
DEQEIATTNPVATEQYGSVSAEDLEHEEDK

SEQ ID NO: 87588 - protein, 33 aa, Artificial Sequence
  Description of Artificial Sequence: Synthetic polypeptide
DEAEIRTTNPVATEQYGSYWSLDNMLMRDNQQE

SEQ ID NO: 87589 - protein, 32 aa, Artificial Sequence
  Description of Artificial Sequence: Synthetic polypeptide
DEQEIATTNPVATEQYGSVSATDLDDHEGIDL

SEQ ID NO: 87590 - protein, 32 aa, Artificial Sequence
  Description of Artificial Sequence: Synthetic polypeptide
DEQEIATTNPVATEQYGSVSATDLDDHSGEDL

SEQ ID NO: 87591 - protein, 31 aa, Artificial Sequence
  Description of Artificial Sequence: Synthetic polypeptide
DENEIRTTNPVATEGYGCVCSWELQNFGSDQ

SEQ ID NO: 87592 - protein, 31 aa, Artificial Sequence
  Description of Artificial Sequence: Synthetic polypeptide
DENEIRTTNPVATEGWGDVSANIIMSRVGQR

SEQ ID NO: 87593 - protein, 33 aa, Artificial Sequence
  Description of Artificial Sequence: Synthetic polypeptide
DEAEIRTTNPVATECWGSVSCINEPQYREGENF

SEQ ID NO: 87594 - protein, 30 aa, Artificial Sequence
  Description of Artificial Sequence: Synthetic polypeptide
DEAEIRTTNPVAVEQYGSISWHLETESNNQ

SEQ ID NO: 87595 - protein, 30 aa, Artificial Sequence
  Description of Artificial Sequence: Synthetic polypeptide
DENEIRTTNPVATECYGTISMEDIQQNGNL

SEQ ID NO: 87596 - protein, 30 aa, Artificial Sequence
  Description of Artificial Sequence: Synthetic polypeptide
DEAEIRTTNPVAVEQYGSISWRNCETEQNQ

SEQ ID NO: 87597 - protein, 31 aa, Artificial Sequence
  Description of Artificial Sequence: Synthetic polypeptide
DEAEIRTTNPVAVEQYGSISWRNLETENNQQ

SEQ ID NO: 87598 - protein, 34 aa, Artificial Sequence
  Description of Artificial Sequence: Synthetic polypeptide
DENEIRTTNPVATEGYGSVMSNNNELQREGDTAQ

SEQ ID NO: 87599 - protein, 31 aa, Artificial Sequence
  Description of Artificial Sequence: Synthetic polypeptide
DEAEIRTTNPVAVEQYGSISWRNLHETELNQ

SEQ ID NO: 87600 - protein, 32 aa, Artificial Sequence
  Description of Artificial Sequence: Synthetic polypeptide
DEQEIATTNPVATEQYGSVSATDLEDHEGEIL

SEQ ID NO: 87601 - protein, 32 aa, Artificial Sequence
  Description of Artificial Sequence: Synthetic polypeptide
DEAEIRTTNPVAWEQYGCICSTNLERFPSNQS

SEQ ID NO: 87602 - protein, 32 aa, Artificial Sequence
  Description of Artificial Sequence: Synthetic polypeptide
DEQEIATTNPVATEQYGSVSATDLEDHEGEKL

SEQ ID NO: 87603 - protein, 32 aa, Artificial Sequence
  Description of Artificial Sequence: Synthetic polypeptide
DEQEIATTNPVATEQYGSVSATDLEDHEGEKV

SEQ ID NO: 87604 - protein, 33 aa, Artificial Sequence
  Description of Artificial Sequence: Synthetic polypeptide
DEAEIRTTNPVATECWGSVSCINEPQDREGENG

SEQ ID NO: 87605 - protein, 29 aa, Artificial Sequence
  Description of Artificial Sequence: Synthetic peptide
DENEIRTTNPVATECYGTISMECIQHENL

SEQ ID NO: 87606 - protein, 32 aa, Artificial Sequence
  Description of Artificial Sequence: Synthetic polypeptide
DEQEIATTNPVATEQYGSVSATDLEDHEGELC

SEQ ID NO: 87607 - protein, 33 aa, Artificial Sequence
  Description of Artificial Sequence: Synthetic polypeptide
DEAEIRTTNPVAVEQYGSTCSTNLERFEANQQE

SEQ ID NO: 87608 - protein, 32 aa, Artificial Sequence
  Description of Artificial Sequence: Synthetic polypeptide
DEAEIRTTNPVAVEQYGSCMSTNSERFENQQE

SEQ ID NO: 87609 - protein, 33 aa, Artificial Sequence
  Description of Artificial Sequence: Synthetic polypeptide
DEAEIRTTNPVATECWGSVSCYNEPQDREGENG

SEQ ID NO: 87610 - protein, 32 aa, Artificial Sequence
  Description of Artificial Sequence: Synthetic polypeptide
DEQEIATTNPVATEQYGSVSATDLEDHEGEHL

SEQ ID NO: 87611 - protein, 30 aa, Artificial Sequence
  Description of Artificial Sequence: Synthetic polypeptide
DEAEIRTTNPVATEFYGKHSTWNEQPPSEF

SEQ ID NO: 87612 - protein, 33 aa, Artificial Sequence
  Description of Artificial Sequence: Synthetic polypeptide
DENEIRTTNPVATEIYGCVVYSTNVLQEFNEEK

SEQ ID NO: 87613 - protein, 32 aa, Artificial Sequence
  Description of Artificial Sequence: Synthetic polypeptide
DENEIRTTNPVATEIYGCVCSWNHQRFGSDQI

SEQ ID NO: 87614 - protein, 30 aa, Artificial Sequence
  Description of Artificial Sequence: Synthetic polypeptide
DENEIRTTNPVATEIYGCVCSWEHQNGSDQ

SEQ ID NO: 87615 - protein, 32 aa, Artificial Sequence
  Description of Artificial Sequence: Synthetic polypeptide
DEQEIATTNPVATEQYGSVSATDLEDHEGEDS

SEQ ID NO: 87616 - protein, 32 aa, Artificial Sequence
  Description of Artificial Sequence: Synthetic polypeptide
DENEIRTTNPVATEIYGCVCSNWNLQHFGSEQ

SEQ ID NO: 87617 - protein, 37 aa, Artificial Sequence
  Description of Artificial Sequence: Synthetic polypeptide
DEEEIRTTNPVATEQYGSVSTTNLQGNNNQQGTNPDT

SEQ ID NO: 87618 - protein, 34 aa, Artificial Sequence
  Description of Artificial Sequence: Synthetic polypeptide
DENEIRTTNPVATEIYGAVVYSTNVLQEEGNEEK

SEQ ID NO: 87619 - protein, 32 aa, Artificial Sequence
  Description of Artificial Sequence: Synthetic polypeptide
DEQEIATTNPVATEQYGSVSATDLEDHEGEDT

SEQ ID NO: 87620 - protein, 32 aa, Artificial Sequence
  Description of Artificial Sequence: Synthetic polypeptide
DEQEIATTNPVATEQYGSVSATDLEDHEGEDV

SEQ ID NO: 87621 - protein, 32 aa, Artificial Sequence
  Description of Artificial Sequence: Synthetic polypeptide
DEQEIATTNPVATEQYGSVSATDLEDHEGEDW

SEQ ID NO: 87622 - protein, 32 aa, Artificial Sequence
  Description of Artificial Sequence: Synthetic polypeptide
DEQEIATTNPVATEQYGSVSATDLEDHEGEDY

SEQ ID NO: 87623 - protein, 32 aa, Artificial Sequence
  Description of Artificial Sequence: Synthetic polypeptide
DEQEIATTNPVATEQYGSVSATDLEDHEGEEL

SEQ ID NO: 87624 - protein, 32 aa, Artificial Sequence
  Description of Artificial Sequence: Synthetic polypeptide
DEQEIATTNPVATEQYGSVSATDLEDHEGEFL

SEQ ID NO: 87625 - protein, 32 aa, Artificial Sequence
  Description of Artificial Sequence: Synthetic polypeptide
DEQEIATTNPVATEQYGSVSATDLEDHEGEFY

SEQ ID NO: 87626 - protein, 33 aa, Artificial Sequence
  Description of Artificial Sequence: Synthetic polypeptide
DEAEIRTTNPVAVEQWGSVWSTTPNIQCSGNQQ

SEQ ID NO: 87627 - protein, 32 aa, Artificial Sequence
  Description of Artificial Sequence: Synthetic polypeptide
DEQEIATTNPVATEQYGSVSATDLEDHEGEGL

SEQ ID NO: 87628 - protein, 32 aa, Artificial Sequence
  Description of Artificial Sequence: Synthetic polypeptide
DEQEIATTNPVATEQYGSVSATDLEDHEGELL

SEQ ID NO: 87629 - protein, 32 aa, Artificial Sequence
  Description of Artificial Sequence: Synthetic polypeptide
DEQEIATTNPVATEQYGSVSATDLEDHEGEML

SEQ ID NO: 87630 - protein, 30 aa, Artificial Sequence
  Description of Artificial Sequence: Synthetic polypeptide
DENEIRTTNPVATECYGTISEECLQQHENL

SEQ ID NO: 87631 - protein, 30 aa, Artificial Sequence
  Description of Artificial Sequence: Synthetic polypeptide
DENEIRTTNPVATECYGTISEECIQQHGNL

SEQ ID NO: 87632 - protein, 32 aa, Artificial Sequence
  Description of Artificial Sequence: Synthetic polypeptide
DEQEIATTNPVATEQYGSVSATDLEDHEGGDY

SEQ ID NO: 87633 - protein, 32 aa, Artificial Sequence
  Description of Artificial Sequence: Synthetic polypeptide
DEQEIATTNPVATEQYGSVSATDLEDHEGHDL

SEQ ID NO: 87634 - protein, 29 aa, Artificial Sequence
  Description of Artificial Sequence: Synthetic peptide
DENEIRTTNPVATECYGDVAECLQHKEEL

SEQ ID NO: 87635 - protein, 32 aa, Artificial Sequence
  Description of Artificial Sequence: Synthetic polypeptide
DEQEIATTNPVATEQYGSVSATDLEDHEGIDD

SEQ ID NO: 87636 - protein, 33 aa, Artificial Sequence
  Description of Artificial Sequence: Synthetic polypeptide
DEAEIRTTNPVAYEAYGVSTVSTGNHQRVNNQG

SEQ ID NO: 87637 - protein, 33 aa, Artificial Sequence
  Description of Artificial Sequence: Synthetic polypeptide
DEAEIRTTNPVAYECWGAVSTNLQAGNAGENSR

SEQ ID NO: 87638 - protein, 32 aa, Artificial Sequence
  Description of Artificial Sequence: Synthetic polypeptide
DEQEIATTNPVATEQYGSVSATDLEDHEGIDL

SEQ ID NO: 87639 - protein, 32 aa, Artificial Sequence
  Description of Artificial Sequence: Synthetic polypeptide
DEQEIATTNPVATEQYGSVSATDLEDHEGKDL

SEQ ID NO: 87640 - protein, 35 aa, Artificial Sequence
  Description of Artificial Sequence: Synthetic polypeptide
DEEEIRTTNPVATEQYGSVSTTNLELENNINNFLL

SEQ ID NO: 87641 - protein, 31 aa, Artificial Sequence
  Description of Artificial Sequence: Synthetic polypeptide
DEAEIRTTNPVAYECWGSTATNNQRGDGNEG

SEQ ID NO: 87642 - protein, 32 aa, Artificial Sequence
  Description of Artificial Sequence: Synthetic polypeptide
DEQEIATTNPVATEQYGSVSATDLEDHEGLDL

SEQ ID NO: 87643 - protein, 32 aa, Artificial Sequence
  Description of Artificial Sequence: Synthetic polypeptide
DEQEIATTNPVATEQYGSVSATDLEDHEGMDL

SEQ ID NO: 87644 - protein, 36 aa, Artificial Sequence
  Description of Artificial Sequence: Synthetic polypeptide
DEEEIRTTNPVATEQYGSVVSTTPAGPNQRNGMNPV

SEQ ID NO: 87645 - protein, 29 aa, Artificial Sequence
  Description of Artificial Sequence: Synthetic peptide
DENEIRTTNPVATECYGDVAECLQEHEEL

SEQ ID NO: 87646 - protein, 33 aa, Artificial Sequence
  Description of Artificial Sequence: Synthetic polypeptide
DEQEIATTNPVATEQYGSVSATDLEDHEGNEDL

SEQ ID NO: 87647 - protein, 32 aa, Artificial Sequence
  Description of Artificial Sequence: Synthetic polypeptide
DEQEIATTNPVATEQYGSVSATDLEDHEGPDL

SEQ ID NO: 87648 - protein, 32 aa, Artificial Sequence
  Description of Artificial Sequence: Synthetic polypeptide
DEQEIATTNPVATEQYGSVSATDLEDHEGPDN

SEQ ID NO: 87649 - protein, 32 aa, Artificial Sequence
  Description of Artificial Sequence: Synthetic polypeptide
DEQEIATTNPVATEQYGSVSATDLEDHEGGDL

SEQ ID NO: 87650 - protein, 33 aa, Artificial Sequence
  Description of Artificial Sequence: Synthetic polypeptide
DENEIRTTNPVATEIYGCVVYSTNVPLQEGEEK

SEQ ID NO: 87651 - protein, 32 aa, Artificial Sequence
  Description of Artificial Sequence: Synthetic polypeptide
DEQEIATTNPVATEQYGSVSATDLEDHEGFDL

SEQ ID NO: 87652 - protein, 32 aa, Artificial Sequence
  Description of Artificial Sequence: Synthetic polypeptide
DEQEIATTNPVATEQYGSVSATDLEDHEGEYL

SEQ ID NO: 87653 - protein, 32 aa, Artificial Sequence
  Description of Artificial Sequence: Synthetic polypeptide
DEQEIATTNPVATEQYGSVSATDLEDHEGEPL

SEQ ID NO: 87654 - protein, 32 aa, Artificial Sequence
  Description of Artificial Sequence: Synthetic polypeptide
DEQEIATTNPVATEQYGSVSATDLEDHEGEQL

SEQ ID NO: 87655 - protein, 31 aa, Artificial Sequence
  Description of Artificial Sequence: Synthetic polypeptide
DEAEIRTTNPVAYEAWGCVSTNMNGADGENR

SEQ ID NO: 87656 - protein, 33 aa, Artificial Sequence
  Description of Artificial Sequence: Synthetic polypeptide
DEAEIRTTNPVATECWGSVSCINEMQDREGENG

SEQ ID NO: 87657 - protein, 32 aa, Artificial Sequence
  Description of Artificial Sequence: Synthetic polypeptide
DEAEIRTTNPVAYEAWGCVSTNSNQGNAGENR

SEQ ID NO: 87658 - protein, 32 aa, Artificial Sequence
  Description of Artificial Sequence: Synthetic polypeptide
DEQEIATTNPVATEQYGSVSATDLEDHEGEQQ

SEQ ID NO: 87659 - protein, 31 aa, Artificial Sequence
  Description of Artificial Sequence: Synthetic polypeptide
DENEIRTTNPVATECYGSVSECGPNHGMNPL

SEQ ID NO: 87660 - protein, 30 aa, Artificial Sequence
  Description of Artificial Sequence: Synthetic polypeptide
DENEIRTTNPVATECYGSVSCCEPQDHEEL

SEQ ID NO: 87661 - protein, 30 aa, Artificial Sequence
  Description of Artificial Sequence: Synthetic polypeptide
DENEIRTTNPVATECYGDVWSECLQPEEYI

SEQ ID NO: 87662 - protein, 32 aa, Artificial Sequence
  Description of Artificial Sequence: Synthetic polypeptide
DEQEIATTNPVATEQYGSVSATDLEDHEGESL

SEQ ID NO: 87663 - protein, 32 aa, Artificial Sequence
  Description of Artificial Sequence: Synthetic polypeptide
DEQEIATTNPVATEQYGSVSATDLEDHEGETL

SEQ ID NO: 87664 - protein, 30 aa, Artificial Sequence
  Description of Artificial Sequence: Synthetic polypeptide
DENEIRTTNPVATECYGDVWSECLQHEEYL

SEQ ID NO: 87665 - protein, 29 aa, Artificial Sequence
  Description of Artificial Sequence: Synthetic peptide
DENEIRTTNPVATECYGDVSECEQNAEDL

SEQ ID NO: 87666 - protein, 32 aa, Artificial Sequence
  Description of Artificial Sequence: Synthetic polypeptide
DEAEIRTTNPVAYEAWGSVSTNLNAGDTNDNS

SEQ ID NO: 87667 - protein, 32 aa, Artificial Sequence
  Description of Artificial Sequence: Synthetic polypeptide
DEQEIATTNPVATEQYGSVSATDLEDHEGEVL

SEQ ID NO: 87668 - protein, 32 aa, Artificial Sequence
  Description of Artificial Sequence: Synthetic polypeptide
DEQEIATTNPVATEQYGSVSATDLEDHEGEVQ

SEQ ID NO: 87669 - protein, 32 aa, Artificial Sequence
  Description of Artificial Sequence: Synthetic polypeptide
DEQEIATTNPVATEQYGSVSATDLEDHEGEWL

SEQ ID NO: 87670 - protein, 34 aa, Artificial Sequence
  Description of Artificial Sequence: Synthetic polypeptide
DEAEIRTTNPVAYEAWGSVVSTNPPQRTGGNYRQ

SEQ ID NO: 87671 - protein, 36 aa, Artificial Sequence
  Description of Artificial Sequence: Synthetic polypeptide
DEEEIRTTNPVATEQYGSVSTTTNAGNNDQNGTNPV

SEQ ID NO: 87672 - protein, 32 aa, Artificial Sequence
  Description of Artificial Sequence: Synthetic polypeptide
DEQEIATTNPVATEQYGSVSATDLEDHEGEDQ

SEQ ID NO: 87673 - protein, 32 aa, Artificial Sequence
  Description of Artificial Sequence: Synthetic polypeptide
DEQEIATTNPVATEQYGSVSATDLEDHEGEDN

SEQ ID NO: 87674 - protein, 33 aa, Artificial Sequence
  Description of Artificial Sequence: Synthetic polypeptide
DEAEIRTTNPVATEHYGSVCMTDGQDNRGNGEM

SEQ ID NO: 87675 - protein, 32 aa, Artificial Sequence
  Description of Artificial Sequence: Synthetic polypeptide
DEQEIATTNPVATEQYGSVSATDLEDDEGEDL

SEQ ID NO: 87676 - protein, 35 aa, Artificial Sequence
  Description of Artificial Sequence: Synthetic polypeptide
DEEEIRTTNPVATEQYGSVSTTNMMQQEEMGIEEL

SEQ ID NO: 87677 - protein, 34 aa, Artificial Sequence
  Description of Artificial Sequence: Synthetic polypeptide
DEEEIRTTNPVATEQYGSVVSTDMAEYRESNNQI

SEQ ID NO: 87678 - protein, 35 aa, Artificial Sequence
  Description of Artificial Sequence: Synthetic polypeptide
DEEEIRTTNPVATEQYGSVSTTNMMNQEEMGEELE

SEQ ID NO: 87679 - protein, 35 aa, Artificial Sequence
  Description of Artificial Sequence: Synthetic polypeptide
DEEEIRTTNPVATEQYGSVSTTNMMGQESGEEPVV

SEQ ID NO: 87680 - protein, 32 aa, Artificial Sequence
  Description of Artificial Sequence: Synthetic polypeptide
DEQEIATTNPVATEQYGSVSATDLEDEEGEDF

SEQ ID NO: 87681 - protein, 33 aa, Artificial Sequence
  Description of Artificial Sequence: Synthetic polypeptide
DENEIRTTNPVATEPWGSVSCENEPQDRNGENG

SEQ ID NO: 87682 - protein, 32 aa, Artificial Sequence
  Description of Artificial Sequence: Synthetic polypeptide
DEQEIATTNPVATEQYGSVSATDLEDEEGEDL

SEQ ID NO: 87683 - protein, 32 aa, Artificial Sequence
  Description of Artificial Sequence: Synthetic polypeptide
DEQEIATTNPVATEQYGSVSATDLEDEEGEIL

SEQ ID NO: 87684 - protein, 30 aa, Artificial Sequence
  Description of Artificial Sequence: Synthetic polypeptide
DENEIRTTNPVATEPWGDVSEIEQNAAGNA

SEQ ID NO: 87685 - protein, 32 aa, Artificial Sequence
  Description of Artificial Sequence: Synthetic polypeptide
DEQEIATTNPVATEQYGSVSATDLEDFEGEDL

SEQ ID NO: 87686 - protein, 34 aa, Artificial Sequence
  Description of Artificial Sequence: Synthetic polypeptide
DENEIRTTNPVATEMYGSTVSQNAFSQNRSGSNA

SEQ ID NO: 87687 - protein, 34 aa, Artificial Sequence
  Description of Artificial Sequence: Synthetic polypeptide
DENEIRTTNPVATEIYGSVVYSTNVTLQENNEEK

SEQ ID NO: 87688 - protein, 34 aa, Artificial Sequence
  Description of Artificial Sequence: Synthetic polypeptide
DENEIRTTNPVATEIYGSVVYSTNVDLQEGFESK

SEQ ID NO: 87689 - protein, 32 aa, Artificial Sequence
  Description of Artificial Sequence: Synthetic polypeptide
DEQEIATTNPVATEQYGSVSATDLEDGEGEDG

SEQ ID NO: 87690 - protein, 30 aa, Artificial Sequence
  Description of Artificial Sequence: Synthetic polypeptide
DENEIRTTNPVATEPWGDVSEIEQNQAGNA

SEQ ID NO: 87691 - protein, 33 aa, Artificial Sequence
  Description of Artificial Sequence: Synthetic polypeptide
DENEIRTTNPVATEPWGSVSCINEPQDREGENG

SEQ ID NO: 87692 - protein, 32 aa, Artificial Sequence
  Description of Artificial Sequence: Synthetic polypeptide
DEQEIATTNPVATEQYGSVSATDLEDCEGEDL

SEQ ID NO: 87693 - protein, 35 aa, Artificial Sequence
  Description of Artificial Sequence: Synthetic polypeptide
DEEEIRTTNPVATEQYGSVSTTNMMWQEGGEEEVA

SEQ ID NO: 87694 - protein, 36 aa, Artificial Sequence
  Description of Artificial Sequence: Synthetic polypeptide
DEEEIRTTNPVATEQYGSVVSPTTNLLEENDGSNQE

SEQ ID NO: 87695 - protein, 30 aa, Artificial Sequence
  Description of Artificial Sequence: Synthetic polypeptide
DENEIRTTNPVATEPWGTVSEDIQNQNGNA

SEQ ID NO: 87696 - protein, 35 aa, Artificial Sequence
  Description of Artificial Sequence: Synthetic polypeptide
DEEEIRTTNPVATEQYGSVVSPTVNEIQRMEVEPY

SEQ ID NO: 87697 - protein, 34 aa, Artificial Sequence
  Description of Artificial Sequence: Synthetic polypeptide
DEAEIRTTNPVATEQYGSYWSLPNMLQVRDNQIG

SEQ ID NO: 87698 - protein, 34 aa, Artificial Sequence
  Description of Artificial Sequence: Synthetic polypeptide
DEEEIRTTNPVATEQYGSVSTTNNEHQQVEEAQD

SEQ ID NO: 87699 - protein, 33 aa, Artificial Sequence
  Description of Artificial Sequence: Synthetic polypeptide
DENEIRTTNPVATEPWGSVSMINIQQDREGENG

SEQ ID NO: 87700 - protein, 34 aa, Artificial Sequence
  Description of Artificial Sequence: Synthetic polypeptide
DEEEIRTTNPVATEQYGSVSTTNNDNNQETDEIG

SEQ ID NO: 87701 - protein, 33 aa, Artificial Sequence
  Description of Artificial Sequence: Synthetic polypeptide
DENEIRTTNPVATEPWGSVSMINEQQDREGENG

SEQ ID NO: 87702 - protein, 32 aa, Artificial Sequence
  Description of Artificial Sequence: Synthetic polypeptide
DEQEIATTNPVATEQYGSVSATDLEAHEGEDL

SEQ ID NO: 87703 - protein, 32 aa, Artificial Sequence
  Description of Artificial Sequence: Synthetic polypeptide
DEQEIATTNPVATEQYGSVSATDLEAHHGEDL

SEQ ID NO: 87704 - protein, 32 aa, Artificial Sequence
  Description of Artificial Sequence: Synthetic polypeptide
DEQEIATTNPVATEQYGSVSATDLECHEGEDL

SEQ ID NO: 87705 - protein, 32 aa, Artificial Sequence
  Description of Artificial Sequence: Synthetic polypeptide
DEQEIATTNPVATEQYGSVSATDLECHEGEHL

SEQ ID NO: 87706 - protein, 35 aa, Artificial Sequence
  Description of Artificial Sequence: Synthetic polypeptide
DEEEIRTTNPVATEQYGSVSTTNMMWQESGEEETQ

SEQ ID NO: 87707 - protein, 32 aa, Artificial Sequence
  Description of Artificial Sequence: Synthetic polypeptide
DEQEIATTNPVATEQYGSVSATDLEDAEGEDA

SEQ ID NO: 87708 - protein, 33 aa, Artificial Sequence
  Description of Artificial Sequence: Synthetic polypeptide
DENEIRTTNPVATEPWGSVSMENEPQDRNGENG

SEQ ID NO: 87709 - protein, 32 aa, Artificial Sequence
  Description of Artificial Sequence: Synthetic polypeptide
DEQEIATTNPVATEQYGSVSATDLEDAEGEDL

SEQ ID NO: 87710 - protein, 33 aa, Artificial Sequence
  Description of Artificial Sequence: Synthetic polypeptide
DENEIRTTNPVATEPWGSVSCINEPQDRNGENG

SEQ ID NO: 87711 - protein, 34 aa, Artificial Sequence
  Description of Artificial Sequence: Synthetic polypeptide
DEAEIRTTNPVATEQYGVSVSWHNGQETEGTNSV

SEQ ID NO: 87712 - protein, 32 aa, Artificial Sequence
  Description of Artificial Sequence: Synthetic polypeptide
DEQEIATTNPVATEQYGSVSATDLEDGEGEDL

SEQ ID NO: 87713 - protein, 32 aa, Artificial Sequence
  Description of Artificial Sequence: Synthetic polypeptide
DEQEIATTNPVATEQYGSVSATDLEDHAGEAL

SEQ ID NO: 87714 - protein, 32 aa, Artificial Sequence
  Description of Artificial Sequence: Synthetic polypeptide
DEQEIATTNPVATEQYGSVSATDLEDHAGEDL

SEQ ID NO: 87715 - protein, 33 aa, Artificial Sequence
  Description of Artificial Sequence: Synthetic polypeptide
DENEIRTTNPVATEIYGSVSNMDLDQGGGNGGQ

SEQ ID NO: 87716 - protein, 32 aa, Artificial Sequence
  Description of Artificial Sequence: Synthetic polypeptide
DEQEIATTNPVATEQYGSVSATDLEDHEGEDA

SEQ ID NO: 87717 - protein, 32 aa, Artificial Sequence
  Description of Artificial Sequence: Synthetic polypeptide
DEQEIATTNPVATEQYGSVSATDLEDHEGEDC

SEQ ID NO: 87718 - protein, 32 aa, Artificial Sequence
  Description of Artificial Sequence: Synthetic polypeptide
DEQEIATTNPVATEQYGSVSATDLEDHEGEDD

SEQ ID NO: 87719 - protein, 37 aa, Artificial Sequence
  Description of Artificial Sequence: Synthetic polypeptide
DEEEIRTTNPVATEQYGSVSTTNLQQLQQGAEQGNTD

SEQ ID NO: 87720 - protein, 34 aa, Artificial Sequence
  Description of Artificial Sequence: Synthetic polypeptide
DEAEIRTTNPVATESYGSVCMTDNGQDNRGNGEM

SEQ ID NO: 87721 - protein, 32 aa, Artificial Sequence
  Description of Artificial Sequence: Synthetic polypeptide
DEQEIATTNPVATEQYGSVSATDLEDHEGEDE

SEQ ID NO: 87722 - protein, 32 aa, Artificial Sequence
  Description of Artificial Sequence: Synthetic polypeptide
DEQEIATTNPVATEQYGSVSATDLEDHEGEDF

SEQ ID NO: 87723 - protein, 32 aa, Artificial Sequence
  Description of Artificial Sequence: Synthetic polypeptide
DEQEIATTNPVATEQYGSVSATDLEDHEGEDG

SEQ ID NO: 87724 - protein, 32 aa, Artificial Sequence
  Description of Artificial Sequence: Synthetic polypeptide
DEQEIATTNPVATEQYGSVSATDLEDHEGEDH

SEQ ID NO: 87725 - protein, 32 aa, Artificial Sequence
  Description of Artificial Sequence: Synthetic polypeptide
DEQEIATTNPVATEQYGSVSATDLEDHEGEDI

SEQ ID NO: 87726 - protein, 32 aa, Artificial Sequence
  Description of Artificial Sequence: Synthetic polypeptide
DEQEIATTNPVATEQYGSVSATDLEDHEGEDK

SEQ ID NO: 87727 - protein, 33 aa, Artificial Sequence
  Description of Artificial Sequence: Synthetic polypeptide
DEAEIRTTNPVATEVYGSVCCTENNMGDGNNNR

SEQ ID NO: 87728 - protein, 33 aa, Artificial Sequence
  Description of Artificial Sequence: Synthetic polypeptide
DEAEIRTTNPVATEWWGSVSCINETQHRGGENM

SEQ ID NO: 87729 - protein, 33 aa, Artificial Sequence
  Description of Artificial Sequence: Synthetic polypeptide
DEQEIATTNPVATEQYGSVSATDLEDHEGEDLR

SEQ ID NO: 87730 - protein, 35 aa, Artificial Sequence
  Description of Artificial Sequence: Synthetic polypeptide
DEEEIRTTNPVATEQYGSVSTTNLQNAEEFEPIAD

SEQ ID NO: 87731 - protein, 32 aa, Artificial Sequence
  Description of Artificial Sequence: Synthetic polypeptide
DEQEIATTNPVATEQYGSVSATDLEDHEGEDM

SEQ ID NO: 87732 - protein, 32 aa, Artificial Sequence
  Description of Artificial Sequence: Synthetic polypeptide
DENEIRTTNPVATEIYGSVSNMNFDQGGGGQQ

SEQ ID NO: 87733 - protein, 32 aa, Artificial Sequence
  Description of Artificial Sequence: Synthetic polypeptide
DEQEIATTNPVATEQYGSVSATDLEDHEGEDP

SEQ ID NO: 87734 - protein, 32 aa, Artificial Sequence
  Description of Artificial Sequence: Synthetic polypeptide
DEQEIATTNPVATEQYGSVSATDLEDHEGECL

SEQ ID NO: 87735 - protein, 33 aa, Artificial Sequence
  Description of Artificial Sequence: Synthetic polypeptide
DENEIRTTNPVATEIYGSVSNMNLDQDGGQTGQ

SEQ ID NO: 87736 - protein, 32 aa, Artificial Sequence
  Description of Artificial Sequence: Synthetic polypeptide
DEQEIATTNPVATEQYGSVSATDLEDHAGSDL

SEQ ID NO: 87737 - protein, 32 aa, Artificial Sequence
  Description of Artificial Sequence: Synthetic polypeptide
DEQEIATTNPVATEQYGSVSATDLEDHAREDL

SEQ ID NO: 87738 - protein, 32 aa, Artificial Sequence
  Description of Artificial Sequence: Synthetic polypeptide
DEQEIATTNPVATEQYGSVSATDLEDHCGEDL

SEQ ID NO: 87739 - protein, 32 aa, Artificial Sequence
  Description of Artificial Sequence: Synthetic polypeptide
DEAEIRTTNPVATEQYGVVCSSEHQRFPSNDS

SEQ ID NO: 87740 - protein, 32 aa, Artificial Sequence
  Description of Artificial Sequence: Synthetic polypeptide
DEQEIATTNPVATEQYGSVSATDLEDHDGEDL

SEQ ID NO: 87741 - protein, 32 aa, Artificial Sequence
  Description of Artificial Sequence: Synthetic polypeptide
DEQEIATTNPVATEQYGSVSATDLEDHDGEPL

SEQ ID NO: 87742 - protein, 33 aa, Artificial Sequence
  Description of Artificial Sequence: Synthetic polypeptide
CEEEISTTNPVATEQYGCVCSTELFQNFGSNDE

SEQ ID NO: 87743 - protein, 32 aa, Artificial Sequence
  Description of Artificial Sequence: Synthetic polypeptide
DEQEIATTNPVATEQYGSVSATDLEDHDGESL

SEQ ID NO: 87744 - protein, 33 aa, Artificial Sequence
  Description of Artificial Sequence: Synthetic polypeptide
DENEIRTTNPVATEIYGSVSNNQNQLQQGTTTE

SEQ ID NO: 87745 - protein, 32 aa, Artificial Sequence
  Description of Artificial Sequence: Synthetic polypeptide
DEQEIATTNPVATEQYGSVSATDLEDHEAERL

SEQ ID NO: 87746 - protein, 32 aa, Artificial Sequence
  Description of Artificial Sequence: Synthetic polypeptide
DEAEIRTTNPVATEQYGVVCSTEPQNFPSNQS

SEQ ID NO: 87747 - protein, 33 aa, Artificial Sequence
  Description of Artificial Sequence: Synthetic polypeptide
DEAEIRTTNPVATEQYGVVCSTGEHQRFPSNQS

SEQ ID NO: 87748 - protein, 31 aa, Artificial Sequence
  Description of Artificial Sequence: Synthetic polypeptide
DEQEIATTNPVATEQYGSVSATDLEDHEEDK

SEQ ID NO: 87749 - protein, 32 aa, Artificial Sequence
  Description of Artificial Sequence: Synthetic polypeptide
DEQEIATTNPVATEQYGSVSATDLEDHEGADF

SEQ ID NO: 87750 - protein, 32 aa, Artificial Sequence
  Description of Artificial Sequence: Synthetic polypeptide
DEQEIATTNPVATEQYGSVSATDLEDHEGADL

SEQ ID NO: 87751 - protein, 32 aa, Artificial Sequence
  Description of Artificial Sequence: Synthetic polypeptide
DEQEIATTNPVATEQYGSVSATDLEDHEGCDL

SEQ ID NO: 87752 - protein, 32 aa, Artificial Sequence
  Description of Artificial Sequence: Synthetic polypeptide
DEQEIATTNPVATEQYGSVSATDLEDHEGDDL

SEQ ID NO: 87753 - protein, 32 aa, Artificial Sequence
  Description of Artificial Sequence: Synthetic polypeptide
DEQEIATTNPVATEQYGSVSATDLEDHEGEAL

SEQ ID NO: 87754 - protein, 32 aa, Artificial Sequence
  Description of Artificial Sequence: Synthetic polypeptide
DEQEIATTNPVATEQYGSVSATDLEDHEGQEL

SEQ ID NO: 87755 - protein, 36 aa, Artificial Sequence
  Description of Artificial Sequence: Synthetic polypeptide
DEEEIRTTNPVATEQYGSVSTTTNAGNNGQNGENAV

SEQ ID NO: 87756 - protein, 37 aa, Artificial Sequence
  Description of Artificial Sequence: Synthetic polypeptide
DEEEIRTTNPVATEQYGSVSTTTNLQAGNQAGVTNVE

SEQ ID NO: 87757 - protein, 30 aa, Artificial Sequence
  Description of Artificial Sequence: Synthetic polypeptide
DENEIRTTNPVATEQWGDVSENLMNAAEDA

SEQ ID NO: 87758 - protein, 30 aa, Artificial Sequence
  Description of Artificial Sequence: Synthetic polypeptide
DENEIRTTNPVATEQWGDVSENEQNSAEDA

SEQ ID NO: 87759 - protein, 30 aa, Artificial Sequence
  Description of Artificial Sequence: Synthetic polypeptide
DENEIRTTNPVATEQWGDVSENEQNAAEDA

SEQ ID NO: 87760 - protein, 37 aa, Artificial Sequence
  Description of Artificial Sequence: Synthetic polypeptide
DEEEIRTTNPVATEQYGSVSTVNQLQQGNQQSTTEES

SEQ ID NO: 87761 - protein, 30 aa, Artificial Sequence
  Description of Artificial Sequence: Synthetic polypeptide
DENEIRTTNPVATEQWGDVSENEMNAAEDR

SEQ ID NO: 87762 - protein, 34 aa, Artificial Sequence
  Description of Artificial Sequence: Synthetic polypeptide
DEAEIRTTNPVATEQYGCVAATDDLQIRGFDENL

SEQ ID NO: 87763 - protein, 34 aa, Artificial Sequence
  Description of Artificial Sequence: Synthetic polypeptide
DEEEIRTTNPVATEQYGSVSTVNNTIEDSTENST

SEQ ID NO: 87764 - protein, 36 aa, Artificial Sequence
  Description of Artificial Sequence: Synthetic polypeptide
DEEEIRTTNPVATEQYGSVSTVNQNGNQEQGTNNQE

SEQ ID NO: 87765 - protein, 35 aa, Artificial Sequence
  Description of Artificial Sequence: Synthetic polypeptide
DEEEIRTTNPVATEQYGSVSTVNNQQQQNDEETNQ

SEQ ID NO: 87766 - protein, 32 aa, Artificial Sequence
  Description of Artificial Sequence: Synthetic polypeptide
DEQEIATTNPVATEMQYGSVSATDLEDHEGEL

SEQ ID NO: 87767 - protein, 30 aa, Artificial Sequence
  Description of Artificial Sequence: Synthetic polypeptide
DENEIRTTNPVATEQWGDVSEIPMNAAGNA

SEQ ID NO: 87768 - protein, 30 aa, Artificial Sequence
  Description of Artificial Sequence: Synthetic polypeptide
DENEIRTTNPVATEQWGDVSEINMQSAEDA

SEQ ID NO: 87769 - protein, 35 aa, Artificial Sequence
  Description of Artificial Sequence: Synthetic polypeptide
DEEEIRTTNPVATEQYGSVTTSYMQQERPLMNMRV

SEQ ID NO: 87770 - protein, 32 aa, Artificial Sequence
  Description of Artificial Sequence: Synthetic polypeptide
DEQEIATTNPVATEPYGTVSATDLEQHEGNDH

SEQ ID NO: 87771 - protein, 30 aa, Artificial Sequence
  Description of Artificial Sequence: Synthetic polypeptide
DEQEIATTNPVATEPYGTVSTDIEDQNGEL

SEQ ID NO: 87772 - protein, 32 aa, Artificial Sequence
  Description of Artificial Sequence: Synthetic polypeptide
DEEEIRTTNPVATEQYGSVTTTEGVRETASDG

SEQ ID NO: 87773 - protein, 33 aa, Artificial Sequence
  Description of Artificial Sequence: Synthetic polypeptide
DEAEIRTTNPVATEQYGCTCSTGELNQRFNSDQ

SEQ ID NO: 87774 - protein, 37 aa, Artificial Sequence
  Description of Artificial Sequence: Synthetic polypeptide
DEEEIRTTNPVATEQYGSVSTVNQNLNGNQQGNNEEN

SEQ ID NO: 87775 - protein, 37 aa, Artificial Sequence
  Description of Artificial Sequence: Synthetic polypeptide
DEEEIRTTNPVATEQYGSVSTVNQNLQAGNNNEDEDD

SEQ ID NO: 87776 - protein, 37 aa, Artificial Sequence
  Description of Artificial Sequence: Synthetic polypeptide
DEEEIRTTNPVATEQYGSVSTVNQNLQQGNNQNDEED

SEQ ID NO: 87777 - protein, 36 aa, Artificial Sequence
  Description of Artificial Sequence: Synthetic polypeptide
DEEEIRTTNPVATEQYGSVSTVNQQQGNNNNQEDED

SEQ ID NO: 87778 - protein, 32 aa, Artificial Sequence
  Description of Artificial Sequence: Synthetic polypeptide
DEQEIATTNPVATECYGSVSATDLQDHEGEDG

SEQ ID NO: 87779 - protein, 36 aa, Artificial Sequence
  Description of Artificial Sequence: Synthetic polypeptide
DEEEIRTTNPVATEQYGSVSTVNQQQGNNNEEEEED

SEQ ID NO: 87780 - protein, 32 aa, Artificial Sequence
  Description of Artificial Sequence: Synthetic polypeptide
DEQEIATTNPVATECYGSVSATDLQDHEGEDL

SEQ ID NO: 87781 - protein, 35 aa, Artificial Sequence
  Description of Artificial Sequence: Synthetic polypeptide
DEEEIRTTNPVATEQYGSVTTGNVGQQEGNAGGQQ

SEQ ID NO: 87782 - protein, 37 aa, Artificial Sequence
  Description of Artificial Sequence: Synthetic polypeptide
DEEEIRTTNPVATEQYGSVSTVNQQLQQGNNQQNNEE

SEQ ID NO: 87783 - protein, 35 aa, Artificial Sequence
  Description of Artificial Sequence: Synthetic polypeptide
DEEEIRTTNPVATEQYGSVSTVNQQLQNNDEETGE

SEQ ID NO: 87784 - protein, 37 aa, Artificial Sequence
  Description of Artificial Sequence: Synthetic polypeptide
DEEEIRTTNPVATEQYGSVSTVNQQLQAGTEQGTNDE

SEQ ID NO: 87785 - protein, 34 aa, Artificial Sequence
  Description of Artificial Sequence: Synthetic polypeptide
DEAEIRTTNPVATEQYGSVSTNNMDDEIEQNERN

SEQ ID NO: 87786 - protein, 32 aa, Artificial Sequence
  Description of Artificial Sequence: Synthetic polypeptide
DEQEIATTNPVATECYGSVSTIDLEDREGEDG

SEQ ID NO: 87787 - protein, 33 aa, Artificial Sequence
  Description of Artificial Sequence: Synthetic polypeptide
CEEEIRCTNPVATEQYGSVATNLQDNPGEGAEE

SEQ ID NO: 87788 - protein, 33 aa, Artificial Sequence
  Description of Artificial Sequence: Synthetic polypeptide
CEEEIRCTNPVATEQYGSVATGNPDQTAPGNTE

SEQ ID NO: 87789 - protein, 31 aa, Artificial Sequence
  Description of Artificial Sequence: Synthetic polypeptide
DEAEIRTTNPVATEQYGCVCQTAHIRIMSNQ

SEQ ID NO: 87790 - protein, 31 aa, Artificial Sequence
  Description of Artificial Sequence: Synthetic polypeptide
DEQEIATTNPVATEGYGSVSATDLEDHEGEL

SEQ ID NO: 87791 - protein, 30 aa, Artificial Sequence
  Description of Artificial Sequence: Synthetic polypeptide
DENEIRTTNPVATEQWGDVSENLMNAAEGA

SEQ ID NO: 87792 - protein, 37 aa, Artificial Sequence
  Description of Artificial Sequence: Synthetic polypeptide
DEEEIRTTNPVATEQYGSVSTVNQNLQQGNNTEDEET

SEQ ID NO: 87793 - protein, 37 aa, Artificial Sequence
  Description of Artificial Sequence: Synthetic polypeptide
DEEEIRTTNPVATEQYGSVSTVNQNLQQGNNQQNEQE

SEQ ID NO: 87794 - protein, 33 aa, Artificial Sequence
  Description of Artificial Sequence: Synthetic polypeptide
DEQEIATTNPVATEQPYGSVSATDLEDHRGEDL

SEQ ID NO: 87795 - protein, 31 aa, Artificial Sequence
  Description of Artificial Sequence: Synthetic polypeptide
DEQEIATTNPVATECYGDVSATCLQDHEGEL

SEQ ID NO: 87796 - protein, 31 aa, Artificial Sequence
  Description of Artificial Sequence: Synthetic polypeptide
DEQEIATTNPVATEQWGSVSATDLEDAEGEL

SEQ ID NO: 87797 - protein, 30 aa, Artificial Sequence
  Description of Artificial Sequence: Synthetic polypeptide
DENEIRTTNPVATEQWGDVSEILQNAAEDA

SEQ ID NO: 87798 - protein, 37 aa, Artificial Sequence
  Description of Artificial Sequence: Synthetic polypeptide
DEEEIRTTNPVATEQYGSVSTVNLQSGNNNDEEEEDE

SEQ ID NO: 87799 - protein, 35 aa, Artificial Sequence
  Description of Artificial Sequence: Synthetic polypeptide
DEAEIRTTNPVATEQYGSVSTWNNLETRVNQEDEN

SEQ ID NO: 87800 - protein, 30 aa, Artificial Sequence
  Description of Artificial Sequence: Synthetic polypeptide
DENEIRTTNPVATEQWGDVSEIEQQQAGDA

SEQ ID NO: 87801 - protein, 29 aa, Artificial Sequence
  Description of Artificial Sequence: Synthetic peptide
DENEIRTTNPVATEQWGDVSEIEQNSEDA

SEQ ID NO: 87802 - protein, 36 aa, Artificial Sequence
  Description of Artificial Sequence: Synthetic polypeptide
DEEEIRTTNPVATEQYGSVSTVNLQQQQNDEETNDE

SEQ ID NO: 87803 - protein, 36 aa, Artificial Sequence
  Description of Artificial Sequence: Synthetic polypeptide
DEEEIRTTNPVATEQYGSVSTVNLQQQNNNDEEDED

SEQ ID NO: 87804 - protein, 37 aa, Artificial Sequence
  Description of Artificial Sequence: Synthetic polypeptide
DEEEIRTTNPVATEQYGSVSTVNLQQQLGNNGTDEDT

SEQ ID NO: 87805 - protein, 37 aa, Artificial Sequence
  Description of Artificial Sequence: Synthetic polypeptide
DEEEIRTTNPVATEQYGSVSTVNLQSGNNNNEEQEAE

SEQ ID NO: 87806 - protein, 37 aa, Artificial Sequence
  Description of Artificial Sequence: Synthetic polypeptide
DEEEIRTTNPVATEQYGSVSTVNLQQLQGNNNTDEDT

SEQ ID NO: 87807 - protein, 33 aa, Artificial Sequence
  Description of Artificial Sequence: Synthetic polypeptide
DEAEIRTTNPVATEQYGSVSVDDLLTRGGEQSS

SEQ ID NO: 87808 - protein, 37 aa, Artificial Sequence
  Description of Artificial Sequence: Synthetic polypeptide
DEEEIRTTNPVATEQYGSVSTVNLQQGNTNNNEEDED

SEQ ID NO: 87809 - protein, 37 aa, Artificial Sequence
  Description of Artificial Sequence: Synthetic polypeptide
DEEEIRTTNPVATEQYGSVSTVNLQQGNQQETTEEQD

SEQ ID NO: 87810 - protein, 37 aa, Artificial Sequence
  Description of Artificial Sequence: Synthetic polypeptide
DEEEIRTTNPVATEQYGSVSTVNLQQGNQNNEEEQED

SEQ ID NO: 87811 - protein, 34 aa, Artificial Sequence
  Description of Artificial Sequence: Synthetic polypeptide
DEQEIATTNPVATEQYGCVAANANLQDRGGDNRM

SEQ ID NO: 87812 - protein, 37 aa, Artificial Sequence
  Description of Artificial Sequence: Synthetic polypeptide
DEEEIRTTNPVATEQYGSVSTVNLQQGNNQNQSTEDE

SEQ ID NO: 87813 - protein, 37 aa, Artificial Sequence
  Description of Artificial Sequence: Synthetic polypeptide
DEEEIRTTNPVATEQYGSVSTVNLQQGNNQNQQGTTD

SEQ ID NO: 87814 - protein, 32 aa, Artificial Sequence
  Description of Artificial Sequence: Synthetic polypeptide
DEQEIATTNPVATEQYGASVSTDLEDHEGEDL

SEQ ID NO: 87815 - protein, 34 aa, Artificial Sequence
  Description of Artificial Sequence: Synthetic polypeptide
DEAEIRTTNPVATEQYGSVSTVPLQQNGIGQGKM

SEQ ID NO: 87816 - protein, 33 aa, Artificial Sequence
  Description of Artificial Sequence: Synthetic polypeptide
DEEEIRTTNPVATEQYGSVTVVNLQQPTPEEFG

SEQ ID NO: 87817 - protein, 30 aa, Artificial Sequence
  Description of Artificial Sequence: Synthetic polypeptide
DENEIRTTNPVATEQWGDVSEIIMQAAENA

SEQ ID NO: 87818 - protein, 30 aa, Artificial Sequence
  Description of Artificial Sequence: Synthetic polypeptide
DEQEIATTNPVATEQWGSVSTDEEDAEGDL

SEQ ID NO: 87819 - protein, 37 aa, Artificial Sequence
  Description of Artificial Sequence: Synthetic polypeptide
DEEEIRTTNPVATEQYGSVSTVNNNNLQSGTNQETTT

SEQ ID NO: 87820 - protein, 36 aa, Artificial Sequence
  Description of Artificial Sequence: Synthetic polypeptide
DEEEIRTTNPVATEQYGSVSTVNNNNLQQNNNQENE

SEQ ID NO: 87821 - protein, 36 aa, Artificial Sequence
  Description of Artificial Sequence: Synthetic polypeptide
DEEEIRTTNPVATEQYGSVSTVNNNNLQQGEDEEDE

SEQ ID NO: 87822 - protein, 35 aa, Artificial Sequence
  Description of Artificial Sequence: Synthetic polypeptide
DEEEIRTTNPVATEQYGSVTTTMNGGQSENGNGQY

SEQ ID NO: 87823 - protein, 29 aa, Artificial Sequence
  Description of Artificial Sequence: Synthetic peptide
DENEIRTTNPVATEQWGDVSEILMNSETA

SEQ ID NO: 87824 - protein, 30 aa, Artificial Sequence
  Description of Artificial Sequence: Synthetic polypeptide
DENEIRTTNPVATEQWGDVSEILMNRAEDA

SEQ ID NO: 87825 - protein, 30 aa, Artificial Sequence
  Description of Artificial Sequence: Synthetic polypeptide
DEQEIATTNPVATEQWGSVSTDEENAEGDL

SEQ ID NO: 87826 - protein, 31 aa, Artificial Sequence
  Description of Artificial Sequence: Synthetic polypeptide
DEQEIATTNPVATEQWGSVSTDLMDAEGEDA

SEQ ID NO: 87827 - protein, 33 aa, Artificial Sequence
  Description of Artificial Sequence: Synthetic polypeptide
DEEEIRTTNPVATEQYGSVTTVDEQTEGGAQHI

SEQ ID NO: 87828 - protein, 31 aa, Artificial Sequence
  Description of Artificial Sequence: Synthetic polypeptide
DEQEIATTNPVATEQWGSVSTDLMDAEGEDL

SEQ ID NO: 87829 - protein, 31 aa, Artificial Sequence
  Description of Artificial Sequence: Synthetic polypeptide
DEQEIATTNPVATEQWGSVSTDLMDHEGEDL

SEQ ID NO: 87830 - protein, 33 aa, Artificial Sequence
  Description of Artificial Sequence: Synthetic polypeptide
DEEEIRTTNPVATEQYGSVTTVELTQETPEDDQ

SEQ ID NO: 87831 - protein, 34 aa, Artificial Sequence
  Description of Artificial Sequence: Synthetic polypeptide
DEEEIRTTNPVATEQYGSVTTVNGMGQENIGGGE

SEQ ID NO: 87832 - protein, 33 aa, Artificial Sequence
  Description of Artificial Sequence: Synthetic polypeptide
DEAEIRTTNPVATEQYGSVSTTHLLDEYDEGQQ

SEQ ID NO: 87833 - protein, 34 aa, Artificial Sequence
  Description of Artificial Sequence: Synthetic polypeptide
DEEEIRTTNPVATEQYGSVSTVNNDIEDTENEST

SEQ ID NO: 87834 - protein, 30 aa, Artificial Sequence
  Description of Artificial Sequence: Synthetic polypeptide
DENEIRTTNPVATEQWGDVSEIIMSRAGQA

SEQ ID NO: 87835 - protein, 32 aa, Artificial Sequence
  Description of Artificial Sequence: Synthetic polypeptide
DEQEIATTNPVATEQWGSVSATGLADQEGEDL

SEQ ID NO: 87836 - protein, 31 aa, Artificial Sequence
  Description of Artificial Sequence: Synthetic polypeptide
DEQEIATTNPVATEAYGTVSTNLNGDTQNET

SEQ ID NO: 87837 - protein, 30 aa, Artificial Sequence
  Description of Artificial Sequence: Synthetic polypeptide
DENEIRTTNPVATEQWGDVSMIEQNANEDA

SEQ ID NO: 87838 - protein, 35 aa, Artificial Sequence
  Description of Artificial Sequence: Synthetic polypeptide
DEEEIRTTNPVATEQYGSVTTGMGNLNQVEGGEFI

SEQ ID NO: 87839 - protein, 31 aa, Artificial Sequence
  Description of Artificial Sequence: Synthetic polypeptide
DEQEIATTNPCATEQYGIVSCNLQDHEGEDL

SEQ ID NO: 87840 - protein, 33 aa, Artificial Sequence
  Description of Artificial Sequence: Synthetic polypeptide
DEAEIRTTNPVATEQYGCVCSTELQNFPSNNQS

SEQ ID NO: 87841 - protein, 37 aa, Artificial Sequence
  Description of Artificial Sequence: Synthetic polypeptide
DEEEIRTTNPVATEQYGSVSTVTTNLQAGNQAGTNVE

SEQ ID NO: 87842 - protein, 36 aa, Artificial Sequence
  Description of Artificial Sequence: Synthetic polypeptide
DEEEIRTTNPVATEQYGSVSTVTQNGNQELGNNNQT

SEQ ID NO: 87843 - protein, 36 aa, Artificial Sequence
  Description of Artificial Sequence: Synthetic polypeptide
DEEEIRTTNPVATEQYGSVSTVTQNGNQEIGTTNQE

SEQ ID NO: 87844 - protein, 30 aa, Artificial Sequence
  Description of Artificial Sequence: Synthetic polypeptide
DEQEIATTNPCSTEQYGIVSCNLQDHGEDL

SEQ ID NO: 87845 - protein, 29 aa, Artificial Sequence
  Description of Artificial Sequence: Synthetic peptide
DEQEIATTNPCSTEQYGIVSTDLEHEGEL

SEQ ID NO: 87846 - protein, 33 aa, Artificial Sequence
  Description of Artificial Sequence: Synthetic polypeptide
DEQEIATTNPAVATEQYGSVSATDLEQHEGEDL

SEQ ID NO: 87847 - protein, 29 aa, Artificial Sequence
  Description of Artificial Sequence: Synthetic peptide
DEQEIATTNPCSTEQYGIVSTDLEHEGTL

SEQ ID NO: 87848 - protein, 36 aa, Artificial Sequence
  Description of Artificial Sequence: Synthetic polypeptide
DEEEIRTTNPVATEQYGSVSTVTNQQQQGNNNNQEE

SEQ ID NO: 87849 - protein, 32 aa, Artificial Sequence
  Description of Artificial Sequence: Synthetic polypeptide
DEQEIATTNPIATEQYGSVSATDLEDREGEDL

SEQ ID NO: 87850 - protein, 32 aa, Artificial Sequence
  Description of Artificial Sequence: Synthetic polypeptide
DEQEIATTNPIATEQYGSVSATDLMDREGEDL

SEQ ID NO: 87851 - protein, 29 aa, Artificial Sequence
  Description of Artificial Sequence: Synthetic peptide
DENEIRTTNPVATEQWGEVSEIEMNREGA

SEQ ID NO: 87852 - protein, 32 aa, Artificial Sequence
  Description of Artificial Sequence: Synthetic polypeptide
DEQEIATTNPLATEQYGSVSATDLQDHEGEDL

SEQ ID NO: 87853 - protein, 32 aa, Artificial Sequence
  Description of Artificial Sequence: Synthetic polypeptide
DEQEIATTNPMATEQWGSVVPTELQHDGQNGR

SEQ ID NO: 87854 - protein, 32 aa, Artificial Sequence
  Description of Artificial Sequence: Synthetic polypeptide
DEQEIATTNPMATEQYGSVSATDLEDHEGEDR

SEQ ID NO: 87855 - protein, 29 aa, Artificial Sequence
  Description of Artificial Sequence: Synthetic peptide
DEQEIATTNPCSTEQYGIVSTDLESEGTL

SEQ ID NO: 87856 - protein, 31 aa, Artificial Sequence
  Description of Artificial Sequence: Synthetic polypeptide
DEQEIATTNCVATEQYGSVSATDLEDHEGEL

SEQ ID NO: 87857 - protein, 30 aa, Artificial Sequence
  Description of Artificial Sequence: Synthetic polypeptide
DEQEIASVNPVCTEQYGVVSADNLQDSGNQ

SEQ ID NO: 87858 - protein, 29 aa, Artificial Sequence
  Description of Artificial Sequence: Synthetic peptide
DEQEIASVNPVCTEQYGSVSDNLESEGEL

SEQ ID NO: 87859 - protein, 31 aa, Artificial Sequence
  Description of Artificial Sequence: Synthetic polypeptide
DEQEIAPTNPCATEQYGSVSATDLQDHGTDL

SEQ ID NO: 87860 - protein, 31 aa, Artificial Sequence
  Description of Artificial Sequence: Synthetic polypeptide
DENEIRTTNPVATEQWGNVSTVISTNVAEGA

SEQ ID NO: 87861 - protein, 32 aa, Artificial Sequence
  Description of Artificial Sequence: Synthetic polypeptide
DEAEIRTTNPVATEQYGCVCSTPHQNFGSEQL

SEQ ID NO: 87862 - protein, 29 aa, Artificial Sequence
  Description of Artificial Sequence: Synthetic peptide
DEQEIAPTNPVSSEQYGIVSATNLEHGTL

SEQ ID NO: 87863 - protein, 30 aa, Artificial Sequence
  Description of Artificial Sequence: Synthetic polypeptide
DEQEIAPTNPVSSEQYGSVSATNLEHGTDL

SEQ ID NO: 87864 - protein, 33 aa, Artificial Sequence
  Description of Artificial Sequence: Synthetic polypeptide
DEAEIRTTNPVATEQYGCVCSTGNHQHFGSDQS

SEQ ID NO: 87865 - protein, 32 aa, Artificial Sequence
  Description of Artificial Sequence: Synthetic polypeptide
DEQEIASTNPVATEQYGSVSADDLQDHEGNDQ

SEQ ID NO: 87866 - protein, 32 aa, Artificial Sequence
  Description of Artificial Sequence: Synthetic polypeptide
DENEIRTTNPVATEQWGKVSEVESTNAAEGDA

SEQ ID NO: 87867 - protein, 31 aa, Artificial Sequence
  Description of Artificial Sequence: Synthetic polypeptide
DEQEIASTNPVATEQYGSVSATDLEHEGEDQ

SEQ ID NO: 87868 - protein, 32 aa, Artificial Sequence
  Description of Artificial Sequence: Synthetic polypeptide
DEQEIASTNPVATEQYGSVSATDLQDHEGEDL

SEQ ID NO: 87869 - protein, 32 aa, Artificial Sequence
  Description of Artificial Sequence: Synthetic polypeptide
DEQEIASTNPVATEQYGSVSATDLQDHEGEDQ

SEQ ID NO: 87870 - protein, 32 aa, Artificial Sequence
  Description of Artificial Sequence: Synthetic polypeptide
DEQEIASTNPVATEQYGSVSATNLEDHEGEDQ

SEQ ID NO: 87871 - protein, 33 aa, Artificial Sequence
  Description of Artificial Sequence: Synthetic polypeptide
DEAEIRTTNPVATEQYGCVCSTGELQHFNSDQL

SEQ ID NO: 87872 - protein, 30 aa, Artificial Sequence
  Description of Artificial Sequence: Synthetic polypeptide
DENEIRTTNPVATEQWGEVSENEQNAAEDA

SEQ ID NO: 87873 - protein, 29 aa, Artificial Sequence
  Description of Artificial Sequence: Synthetic peptide
DEQEIASTNPVATEQYGVMSTTLEHEGDI

SEQ ID NO: 87874 - protein, 29 aa, Artificial Sequence
  Description of Artificial Sequence: Synthetic peptide
DEQEIASTNPVCTEQYGVVSDDLQDSGEQ

SEQ ID NO: 87875 - protein, 30 aa, Artificial Sequence
  Description of Artificial Sequence: Synthetic polypeptide
DENEIRTTNPVATEQWGEVSENEMNAAGGA

SEQ ID NO: 87876 - protein, 32 aa, Artificial Sequence
  Description of Artificial Sequence: Synthetic polypeptide
DEAEIRTTNPVATEQYGCVCSTELENFGSDQS

SEQ ID NO: 87877 - protein, 37 aa, Artificial Sequence
  Description of Artificial Sequence: Synthetic polypeptide
DEEEIRTTNPVATEQYGSVSTVTNLQQGNNQEEEEDE

SEQ ID NO: 87878 - protein, 37 aa, Artificial Sequence
  Description of Artificial Sequence: Synthetic polypeptide
DEEEIRTTNPVATEQYGSVSTVTNLQQGNNDEEDTEQ

SEQ ID NO: 87879 - protein, 35 aa, Artificial Sequence
  Description of Artificial Sequence: Synthetic polypeptide
DEEEIRTTNPVATEQYGSVSTVTNGPQADFEYNQI

SEQ ID NO: 87880 - protein, 30 aa, Artificial Sequence
  Description of Artificial Sequence: Synthetic polypeptide
DENEIRTTNPVATEQWGDVSTILMNAAEDA

SEQ ID NO: 87881 - protein, 30 aa, Artificial Sequence
  Description of Artificial Sequence: Synthetic polypeptide
DENEIRTTNPVATEQWGDVSTILMDAAEDA

SEQ ID NO: 87882 - protein, 30 aa, Artificial Sequence
  Description of Artificial Sequence: Synthetic polypeptide
DENEIRTTNPVATEQWGDVSTIGMNAAENA

SEQ ID NO: 87883 - protein, 31 aa, Artificial Sequence
  Description of Artificial Sequence: Synthetic polypeptide
DENEIRTTNPVATEQWGDVSTIEPMNRAENV

SEQ ID NO: 87884 - protein, 33 aa, Artificial Sequence
  Description of Artificial Sequence: Synthetic polypeptide
DEAEIRTTNPVATEQYGSVSTNNAMQQTVQIMD

SEQ ID NO: 87885 - protein, 32 aa, Artificial Sequence
  Description of Artificial Sequence: Synthetic polypeptide
DEQEIATTNPVATCQYGTVTSTNLDMRGSIEL

SEQ ID NO: 87886 - protein, 30 aa, Artificial Sequence
  Description of Artificial Sequence: Synthetic polypeptide
DENEIRTTNPVATEQWGDVSTDLMDAAEDA

SEQ ID NO: 87887 - protein, 30 aa, Artificial Sequence
  Description of Artificial Sequence: Synthetic polypeptide
DENEIRTTNPVATEQWGDVSTDLEDAAEDA

SEQ ID NO: 87888 - protein, 37 aa, Artificial Sequence
  Description of Artificial Sequence: Synthetic polypeptide
DEEEIRTTNPVATEQYGSVSTVNTNLQQGNNQEDTED

SEQ ID NO: 87889 - protein, 34 aa, Artificial Sequence
  Description of Artificial Sequence: Synthetic polypeptide
DEAEIRTTNPVATEQYGCVCSNTNHQNFGSENQL

SEQ ID NO: 87890 - protein, 35 aa, Artificial Sequence
  Description of Artificial Sequence: Synthetic polypeptide
DEEEIRTTNPVATEQYGSVSTVNTNLQNTDEEIQE

SEQ ID NO: 87891 - protein, 37 aa, Artificial Sequence
  Description of Artificial Sequence: Synthetic polypeptide
DEEEIRTTNPVATEQYGSVSTVNTNLQAGNQEEEEED

SEQ ID NO: 87892 - protein, 35 aa, Artificial Sequence
  Description of Artificial Sequence: Synthetic polypeptide
DEEEIRTTNPVATEQYGSVSTVNQQQQQNEEETND

SEQ ID NO: 87893 - protein, 28 aa, Artificial Sequence
  Description of Artificial Sequence: Synthetic peptide
DENEIRTTNPVATEQWGDVSSTEMAEDA

SEQ ID NO: 87894 - protein, 28 aa, Artificial Sequence
  Description of Artificial Sequence: Synthetic peptide
DENEIRTTNPVATEQWGDVSSIEMAEDA

SEQ ID NO: 87895 - protein, 36 aa, Artificial Sequence
  Description of Artificial Sequence: Synthetic polypeptide
DEEEIRTTNPVATEQYGSVSTVNQQQLQQNAEQGTE

SEQ ID NO: 87896 - protein, 37 aa, Artificial Sequence
  Description of Artificial Sequence: Synthetic polypeptide
DEEEIRTTNPVATEQYGSVSTVNQQQLQQGNTNVTND

SEQ ID NO: 87897 - protein, 32 aa, Artificial Sequence
  Description of Artificial Sequence: Synthetic polypeptide
DENEIRTTNPVATEQWGDVSTPAEPNMANGNV

SEQ ID NO: 87898 - protein, 37 aa, Artificial Sequence
  Description of Artificial Sequence: Synthetic polypeptide
DEEEIRTTNPVATEQYGSVSTVNLQQGNNQNQNEEDD

SEQ ID NO: 87899 - protein, 32 aa, Artificial Sequence
  Description of Artificial Sequence: Synthetic polypeptide
DEAEIRTTNPVATEQYGCVCSSNLFHFNSEQS

SEQ ID NO: 87900 - protein, 33 aa, Artificial Sequence
  Description of Artificial Sequence: Synthetic polypeptide
DEAEIRTTNPVATEQYGCVCSTAHQNFGSENQA

SEQ ID NO: 87901 - protein, 33 aa, Artificial Sequence
  Description of Artificial Sequence: Synthetic polypeptide
DEAEIRTTNPVATEQYGCVCSTEHQYFGSENQS

SEQ ID NO: 87902 - protein, 33 aa, Artificial Sequence
  Description of Artificial Sequence: Synthetic polypeptide
DEAEIRTTNPVATEQYGCVCSTEHQSFGSENQM

SEQ ID NO: 87903 - protein, 34 aa, Artificial Sequence
  Description of Artificial Sequence: Synthetic polypeptide
DEAEIRTTNPVATEQYGSVSTMLDSIAESDQENR

SEQ ID NO: 87904 - protein, 34 aa, Artificial Sequence
  Description of Artificial Sequence: Synthetic polypeptide
DEAEIRTTNPVATEQYGSVSTMLLSIESDQENRM

SEQ ID NO: 87905 - protein, 33 aa, Artificial Sequence
  Description of Artificial Sequence: Synthetic polypeptide
DEAEIRTTNPVATEQYGSVSTMLSIESDQENHD

SEQ ID NO: 87906 - protein, 36 aa, Artificial Sequence
  Description of Artificial Sequence: Synthetic polypeptide
DEEEIRTTNPVATEQYGSVSTVQQNGNQEQGTNNDQ

SEQ ID NO: 87907 - protein, 37 aa, Artificial Sequence
  Description of Artificial Sequence: Synthetic polypeptide
DEEEIRTTNPVATEQYGSVSTVQNLQAGNQQGTNEDE

SEQ ID NO: 87908 - protein, 33 aa, Artificial Sequence
  Description of Artificial Sequence: Synthetic polypeptide
DEEEIRTTNPVATEQYGSVSTVPVNASGELEIF

SEQ ID NO: 87909 - protein, 34 aa, Artificial Sequence
  Description of Artificial Sequence: Synthetic polypeptide
DEAEIRTTNPVATEQYGSVSTMNGDQPGGGEEHN

SEQ ID NO: 87910 - protein, 32 aa, Artificial Sequence
  Description of Artificial Sequence: Synthetic polypeptide
DEAEIRTTNPVATEQYGCVCSTEHQAFNSEQS

SEQ ID NO: 87911 - protein, 31 aa, Artificial Sequence
  Description of Artificial Sequence: Synthetic polypeptide
DEQEIATTNPVASEQYGSVSATDLEDHGEDL

SEQ ID NO: 87912 - protein, 33 aa, Artificial Sequence
  Description of Artificial Sequence: Synthetic polypeptide
CEEEISTTNPVATEQYGCVCSNTELQNFNSNRS

SEQ ID NO: 87913 - protein, 33 aa, Artificial Sequence
  Description of Artificial Sequence: Synthetic polypeptide
DEEEIRTTNPVATEQYGSVSTVPENASGFTDID

SEQ ID NO: 87914 - protein, 33 aa, Artificial Sequence
  Description of Artificial Sequence: Synthetic polypeptide
DEAEIRTTNPVATEQYGCVCSTEEHQRFGSDQA

SEQ ID NO: 87915 - protein, 34 aa, Artificial Sequence
  Description of Artificial Sequence: Synthetic polypeptide
DEEEIRTTNPVATEQYGSVTSTQNDNTLETESDN

SEQ ID NO: 87916 - protein, 32 aa, Artificial Sequence
  Description of Artificial Sequence: Synthetic polypeptide
DEAEIRTTNPVATEQYGCVCSTEDQSFGSEQA

SEQ ID NO: 87917 - protein, 30 aa, Artificial Sequence
  Description of Artificial Sequence: Synthetic polypeptide
DENEIRTTNPVATEQWGEASENEQNAAGGA

SEQ ID NO: 87918 - protein, 31 aa, Artificial Sequence
  Description of Artificial Sequence: Synthetic polypeptide
DEQEIATTNPVATAQWGCVATNGLERDGNPP

SEQ ID NO: 87919 - protein, 31 aa, Artificial Sequence
  Description of Artificial Sequence: Synthetic polypeptide
DEQEIATTNPVATEQYGCVAANGDQTTGNPL

SEQ ID NO: 87920 - protein, 37 aa, Artificial Sequence
  Description of Artificial Sequence: Synthetic polypeptide
DEEEIRTTNPVATEQYGSVSTVNLQQGNNNQEEDEDE

SEQ ID NO: 87921 - protein, 37 aa, Artificial Sequence
  Description of Artificial Sequence: Synthetic polypeptide
DEEEIRTTNPVATEQYGSVSTVNLQQGNNNNEEQDTE

SEQ ID NO: 87922 - protein, 35 aa, Artificial Sequence
  Description of Artificial Sequence: Synthetic polypeptide
DEEEIRTTNPVATEQYGSVVGSTMNLEDPEFVENI

SEQ ID NO: 87923 - protein, 34 aa, Artificial Sequence
  Description of Artificial Sequence: Synthetic polypeptide
DEAEIRTTNPVATEQYGSVVSTPLNFDEGGDNEM

SEQ ID NO: 87924 - protein, 33 aa, Artificial Sequence
  Description of Artificial Sequence: Synthetic polypeptide
DEQEIATTNPVATEQYGSNVSATNLEDHEGEDL

SEQ ID NO: 87925 - protein, 35 aa, Artificial Sequence
  Description of Artificial Sequence: Synthetic polypeptide
DEEEIRTTNPVATEQYGSVVGSTMNLEDPELVNIQ

SEQ ID NO: 87926 - protein, 35 aa, Artificial Sequence
  Description of Artificial Sequence: Synthetic polypeptide
DEEEIRTTNPVATEQYGSVVGSTMNLEDPEMENIQ

SEQ ID NO: 87927 - protein, 37 aa, Artificial Sequence
  Description of Artificial Sequence: Synthetic polypeptide
DEEEIRTTNPVATEQYGSVSTVANLQQGNNNNEEQED

SEQ ID NO: 87928 - protein, 35 aa, Artificial Sequence
  Description of Artificial Sequence: Synthetic polypeptide
DEEEIRTTNPVATEQYGSVVGSTMNLGDPEGQGDI

SEQ ID NO: 87929 - protein, 31 aa, Artificial Sequence
  Description of Artificial Sequence: Synthetic polypeptide
DEQEIATTNPVATEQYGSMSTTLEDHEGEDL

SEQ ID NO: 87930 - protein, 35 aa, Artificial Sequence
  Description of Artificial Sequence: Synthetic polypeptide
DEEEIRTTNPVATEQYGSVVGSTMNPDEENGNNAQ

SEQ ID NO: 87931 - protein, 33 aa, Artificial Sequence
  Description of Artificial Sequence: Synthetic polypeptide
DEEEIRTTNPVATEQYGSVSTVADITTGSMQSP

SEQ ID NO: 87932 - protein, 35 aa, Artificial Sequence
  Description of Artificial Sequence: Synthetic polypeptide
DEEEIRTTNPVATEQYGSVSTTYGTDEQTGGGNEE

SEQ ID NO: 87933 - protein, 33 aa, Artificial Sequence
  Description of Artificial Sequence: Synthetic polypeptide
DEAEIRTTNPVATEQWGSVAPTWNDHQERDMER

SEQ ID NO: 87934 - protein, 34 aa, Artificial Sequence
  Description of Artificial Sequence: Synthetic polypeptide
DEEEIRTTNPVATEQYGSVVGTANGMGNQGENIG

SEQ ID NO: 87935 - protein, 35 aa, Artificial Sequence
  Description of Artificial Sequence: Synthetic polypeptide
DEEEIRTTNPVATEQYGSVVGTANMSQDEFGNGGT

SEQ ID NO: 87936 - protein, 33 aa, Artificial Sequence
  Description of Artificial Sequence: Synthetic polypeptide
DEEEIRTTNPVATEQYGSVVGTNDNMDEGGGGQ

SEQ ID NO: 87937 - protein, 32 aa, Artificial Sequence
  Description of Artificial Sequence: Synthetic polypeptide
DENEIRTTNPVATEQWGDVSCNEPQNAEGENA

SEQ ID NO: 87938 - protein, 34 aa, Artificial Sequence
  Description of Artificial Sequence: Synthetic polypeptide
DEEEIRTTNPVATEQYGSVVGSTMNQDGGMEDEG

SEQ ID NO: 87939 - protein, 35 aa, Artificial Sequence
  Description of Artificial Sequence: Synthetic polypeptide
DEEEIRTTNPVATEQYGSVVGSTMNLEDPEEFNNI

SEQ ID NO: 87940 - protein, 31 aa, Artificial Sequence
  Description of Artificial Sequence: Synthetic polypeptide
DEQEIATTNPVATEQYGSMSTDLEDHEGEDL

SEQ ID NO: 87941 - protein, 30 aa, Artificial Sequence
  Description of Artificial Sequence: Synthetic polypeptide
DEQEIATTNPVATEQYGSMSSTLEDHGEDL

SEQ ID NO: 87942 - protein, 31 aa, Artificial Sequence
  Description of Artificial Sequence: Synthetic polypeptide
DEQEIATTNPVATEQYGSISTDIQQDHEGEL

SEQ ID NO: 87943 - protein, 31 aa, Artificial Sequence
  Description of Artificial Sequence: Synthetic polypeptide
DEQEIATTNPVATEQYGSISTDIQQQHNGEL

SEQ ID NO: 87944 - protein, 34 aa, Artificial Sequence
  Description of Artificial Sequence: Synthetic polypeptide
DEEEIRTTNPVATEQYGSVSTVLDAMPEVENFIQ

SEQ ID NO: 87945 - protein, 29 aa, Artificial Sequence
  Description of Artificial Sequence: Synthetic peptide
DENEIRTTNPVATEQWGDVSEICQHAEDA

SEQ ID NO: 87946 - protein, 29 aa, Artificial Sequence
  Description of Artificial Sequence: Synthetic peptide
DENEIRTTNPVATEQWGDVSEICQAAEDA

SEQ ID NO: 87947 - protein, 30 aa, Artificial Sequence
  Description of Artificial Sequence: Synthetic polypeptide
DENEIRTTNPVATEQWGDVSEDLMNAAGEA

SEQ ID NO: 87948 - protein, 31 aa, Artificial Sequence
  Description of Artificial Sequence: Synthetic polypeptide
DEQEIATTNPVATEQYGSISTDLEDHEGEDL

SEQ ID NO: 87949 - protein, 30 aa, Artificial Sequence
  Description of Artificial Sequence: Synthetic polypeptide
DENEIRTTNPVATEQWGDVSEDEMQQAENA

SEQ ID NO: 87950 - protein, 33 aa, Artificial Sequence
  Description of Artificial Sequence: Synthetic polypeptide
DEEEIRTTNPVATEQYGSVVGSNDLEDPEVNEF

SEQ ID NO: 87951 - protein, 33 aa, Artificial Sequence
  Description of Artificial Sequence: Synthetic polypeptide
DEEEIRTTNPVATEQYGSVSTVGSGFQGEEEGF

SEQ ID NO: 87952 - protein, 35 aa, Artificial Sequence
  Description of Artificial Sequence: Synthetic polypeptide
DEEEIRTTNPVATEQYGSVSTVGNFTGQGEENDGG

SEQ ID NO: 87953 - protein, 33 aa, Artificial Sequence
  Description of Artificial Sequence: Synthetic polypeptide
DEEEIRTTNPVATEQYGSVSTVENTDGDDQEEQ

SEQ ID NO: 87954 - protein, 35 aa, Artificial Sequence
  Description of Artificial Sequence: Synthetic polypeptide
DEEEIRTTNPVATEQYGSVSTVELTQPETPEEDRQ

SEQ ID NO: 87955 - protein, 34 aa, Artificial Sequence
  Description of Artificial Sequence: Synthetic polypeptide
DEEEIRTTNPVATEQYGSVVGSNMNLEDPEVNIN

SEQ ID NO: 87956 - protein, 35 aa, Artificial Sequence
  Description of Artificial Sequence: Synthetic polypeptide
DEEEIRTTNPVATEQYGSVVGSNMNLEFNEGGNED

SEQ ID NO: 87957 - protein, 35 aa, Artificial Sequence
  Description of Artificial Sequence: Synthetic polypeptide
DEEEIRTTNPVATEQYGSVVGSNMNMEFQSGENED

SEQ ID NO: 87958 - protein, 34 aa, Artificial Sequence
  Description of Artificial Sequence: Synthetic polypeptide
DEEEIRTTNPVATEQYGSVVGSTDLNMDEGEGGQ

SEQ ID NO: 87959 - protein, 33 aa, Artificial Sequence
  Description of Artificial Sequence: Synthetic polypeptide
CEEEIETTNPVATEWYGSVYSVNDLQIGGNPDP

SEQ ID NO: 87960 - protein, 31 aa, Artificial Sequence
  Description of Artificial Sequence: Synthetic polypeptide
DEQEIATTNPVATEQYGSVATAPQADPEGAE

SEQ ID NO: 87961 - protein, 33 aa, Artificial Sequence
  Description of Artificial Sequence: Synthetic polypeptide
DEAEIRTTNPVATEQYGSVWPMNLENRSEDNEM

SEQ ID NO: 87962 - protein, 34 aa, Artificial Sequence
  Description of Artificial Sequence: Synthetic polypeptide
DEEEIRTTNPVATEQYGSVVGTNMSDQEEFENGG

SEQ ID NO: 87963 - protein, 33 aa, Artificial Sequence
  Description of Artificial Sequence: Synthetic polypeptide
DEAEIRTTNPVATEQYGSVWVEVLNDFRGENDD

SEQ ID NO: 87964 - protein, 30 aa, Artificial Sequence
  Description of Artificial Sequence: Synthetic polypeptide
DENEIRTTNPVATEQWGDVSCIEQNAAENA

SEQ ID NO: 87965 - protein, 33 aa, Artificial Sequence
  Description of Artificial Sequence: Synthetic polypeptide
DEQEIATTNPVATEQYGSVCATNLTQPDQMGDA

SEQ ID NO: 87966 - protein, 35 aa, Artificial Sequence
  Description of Artificial Sequence: Synthetic polypeptide
DEEEIRTTNPVATEQYGSVVIQTPNLDMIQNVERN

SEQ ID NO: 87967 - protein, 34 aa, Artificial Sequence
  Description of Artificial Sequence: Synthetic polypeptide
DEEEIRTTNPVATEQYGSVVITMNGLNRQVVPLN

SEQ ID NO: 87968 - protein, 32 aa, Artificial Sequence
  Description of Artificial Sequence: Synthetic polypeptide
DEAEIRTTNPVATEQYGSVWVTLTDERGEHDM

SEQ ID NO: 87969 - protein, 34 aa, Artificial Sequence
  Description of Artificial Sequence: Synthetic polypeptide
DEEEIRTTNPVATEQYGSVSTTTVLQVDVIELKS

SEQ ID NO: 87970 - protein, 36 aa, Artificial Sequence
  Description of Artificial Sequence: Synthetic polypeptide
DEEEIRTTNPVATEQYGSVSTTTTAGTNNQNGTNPV

SEQ ID NO: 87971 - protein, 32 aa, Artificial Sequence
  Description of Artificial Sequence: Synthetic polypeptide
DEQEIATTNPVATEQYGSVCSATGLEHEGEDL

SEQ ID NO: 87972 - protein, 36 aa, Artificial Sequence
  Description of Artificial Sequence: Synthetic polypeptide
DEEEIRTTNPVATEQYGSVSTTTQNGNQEQGTNNNE

SEQ ID NO: 87973 - protein, 30 aa, Artificial Sequence
  Description of Artificial Sequence: Synthetic polypeptide
DENEIRTTNPVATEQWGDVSATIPMAEEND

SEQ ID NO: 87974 - protein, 30 aa, Artificial Sequence
  Description of Artificial Sequence: Synthetic polypeptide
DENEIRTTNPVATEQWGDVSATIPMAEENA

SEQ ID NO: 87975 - protein, 35 aa, Artificial Sequence
  Description of Artificial Sequence: Synthetic polypeptide
DEEEIRTTNPVATEQYGSVSTTTQLLQGNNSNNQE

SEQ ID NO: 87976 - protein, 36 aa, Artificial Sequence
  Description of Artificial Sequence: Synthetic polypeptide
DEEEIRTTNPVATEQYGSVSTTTNQQNQEQGTTNVE

SEQ ID NO: 87977 - protein, 35 aa, Artificial Sequence
  Description of Artificial Sequence: Synthetic polypeptide
DEEEIRTTNPVATEQYGSVSTTTNQNGQEQGTTEV

SEQ ID NO: 87978 - protein, 37 aa, Artificial Sequence
  Description of Artificial Sequence: Synthetic polypeptide
DEEEIRTTNPVATEQYGSVSTTTNLQAGNQQIGTTDE

SEQ ID NO: 87979 - protein, 37 aa, Artificial Sequence
  Description of Artificial Sequence: Synthetic polypeptide
DEEEIRTTNPVATEQYGSVSTTTNLQAGNQQGNTTVE

SEQ ID NO: 87980 - protein, 31 aa, Artificial Sequence
  Description of Artificial Sequence: Synthetic polypeptide
DEAEIRTTNPVATEQYGSVWVEMIEGLEVRE

SEQ ID NO: 87981 - protein, 31 aa, Artificial Sequence
  Description of Artificial Sequence: Synthetic polypeptide
DEQEIATTNPVATEQYGSISTDIQDHEGEDL

SEQ ID NO: 87982 - protein, 33 aa, Artificial Sequence
  Description of Artificial Sequence: Synthetic polypeptide
DEAEIRTTNPVATEQYGSVWTVENQIGNGQEFE

SEQ ID NO: 87983 - protein, 31 aa, Artificial Sequence
  Description of Artificial Sequence: Synthetic polypeptide
DENEIRTTNPVATEQWGDVSCINEMNRAENG

SEQ ID NO: 87984 - protein, 31 aa, Artificial Sequence
  Description of Artificial Sequence: Synthetic polypeptide
DEQEIATTNPVATEQYGSVATDLEDHEGEDL

SEQ ID NO: 87985 - protein, 34 aa, Artificial Sequence
  Description of Artificial Sequence: Synthetic polypeptide
DEEEIRTTNPVATEQYGSVVGTNMSGQGEFNGGN

SEQ ID NO: 87986 - protein, 34 aa, Artificial Sequence
  Description of Artificial Sequence: Synthetic polypeptide
CEEEICTTNPVATERYGSVVVSLTGNLSQAGGNS

SEQ ID NO: 87987 - protein, 35 aa, Artificial Sequence
  Description of Artificial Sequence: Synthetic polypeptide
DEEEIRTTNPVATEQYGSVVGTNMSQDEFTGNGGE

SEQ ID NO: 87988 - protein, 35 aa, Artificial Sequence
  Description of Artificial Sequence: Synthetic polypeptide
DEEEIRTTNPVATEQYGSVVGTNMSQDEGFENGGI

SEQ ID NO: 87989 - protein, 34 aa, Artificial Sequence
  Description of Artificial Sequence: Synthetic polypeptide
DEEEIRTTNPVATEQYGSVVGTNMSQEEFEAGGG

SEQ ID NO: 87990 - protein, 34 aa, Artificial Sequence
  Description of Artificial Sequence: Synthetic polypeptide
DEEEIRTTNPVATEQYGSVVGTNMSQGEFENGGQ

SEQ ID NO: 87991 - protein, 34 aa, Artificial Sequence
  Description of Artificial Sequence: Synthetic polypeptide
DEEEIRTTNPVATEQYGSVVGTNMSQQEEFEGGD

SEQ ID NO: 87992 - protein, 34 aa, Artificial Sequence
  Description of Artificial Sequence: Synthetic polypeptide
DEEEIRTTNPVATEQYGSVVGTPGLTGGGNGDNE

SEQ ID NO: 87993 - protein, 34 aa, Artificial Sequence
  Description of Artificial Sequence: Synthetic polypeptide
DEEEIRTTNPVATEQYGSVSTTVLVMQDWEVEEE

SEQ ID NO: 87994 - protein, 35 aa, Artificial Sequence
  Description of Artificial Sequence: Synthetic polypeptide
DEEEIRTTNPVATEQYGSVVGTTNGLELEAGNGQG

SEQ ID NO: 87995 - protein, 29 aa, Artificial Sequence
  Description of Artificial Sequence: Synthetic peptide
DENEIRTTNPVATEQWGDVSCNEMSAETA

SEQ ID NO: 87996 - protein, 33 aa, Artificial Sequence
  Description of Artificial Sequence: Synthetic polypeptide
DEQEIATTNPVATEQYGSVCAANNLQEAGENNS

SEQ ID NO: 87997 - protein, 33 aa, Artificial Sequence
  Description of Artificial Sequence: Synthetic polypeptide
DEQEIATTNPVATEQYGSVCAATNDQDLPGNMN

SEQ ID NO: 87998 - protein, 33 aa, Artificial Sequence
  Description of Artificial Sequence: Synthetic polypeptide
DEQEIATTNPVATEQYGSVCATANLEDIRGEDL

SEQ ID NO: 87999 - protein, 30 aa, Artificial Sequence
  Description of Artificial Sequence: Synthetic polypeptide
DENEIRTTNPVATEQWGDVSCNEMNRAEDG

SEQ ID NO: 88000 - protein, 33 aa, Artificial Sequence
  Description of Artificial Sequence: Synthetic polypeptide
DENEIRTTNPVATEQWGDVSCINEPQDREGENA

SEQ ID NO: 88001 - protein, 32 aa, Artificial Sequence
  Description of Artificial Sequence: Synthetic polypeptide
DEQEIATTNPVATEQYGSVCATNLAPDNPNQQ

SEQ ID NO: 88002 - protein, 36 aa, Artificial Sequence
  Description of Artificial Sequence: Synthetic polypeptide
DEEEIRTTNPVATEQYGSVSTTTNLGGNEQGTQGVG

SEQ ID NO: 88003 - protein, 32 aa, Artificial Sequence
  Description of Artificial Sequence: Synthetic polypeptide
DEQEIATTNPVATEQYGSISATDLEQHNGEDH

SEQ ID NO: 88004 - protein, 34 aa, Artificial Sequence
  Description of Artificial Sequence: Synthetic polypeptide
DEEEIRTTNPVATEQYGSVSTVLLAARVLDEDPM

SEQ ID NO: 88005 - protein, 32 aa, Artificial Sequence
  Description of Artificial Sequence: Synthetic polypeptide
DEQEIATTNPVATEQYGDVSATDLQDHEGEDL

SEQ ID NO: 88006 - protein, 37 aa, Artificial Sequence
  Description of Artificial Sequence: Synthetic polypeptide
DEEEIRTTNPVATEQYGSVSTVNLQAGNQQGTTEEND

SEQ ID NO: 88007 - protein, 31 aa, Artificial Sequence
  Description of Artificial Sequence: Synthetic polypeptide
DEQEIATTNPVATEQYGDVSTDLEDHEGEDL

SEQ ID NO: 88008 - protein, 37 aa, Artificial Sequence
  Description of Artificial Sequence: Synthetic polypeptide
DEEEIRTTNPVATEQYGSVSTVNLNNQQGNNNEDEDE

SEQ ID NO: 88009 - protein, 37 aa, Artificial Sequence
  Description of Artificial Sequence: Synthetic polypeptide
DEEEIRTTNPVATEQYGSVSTVNLNLQQGNNNEEEDT

SEQ ID NO: 88010 - protein, 34 aa, Artificial Sequence
  Description of Artificial Sequence: Synthetic polypeptide
DEAEIRTTNPVATEQYGSVSVTALLSTGNGDNIQ

SEQ ID NO: 88011 - protein, 30 aa, Artificial Sequence
  Description of Artificial Sequence: Synthetic polypeptide
DEQEIATTNPVATEQYGEVSAEVCQHEGEL

SEQ ID NO: 88012 - protein, 31 aa, Artificial Sequence
  Description of Artificial Sequence: Synthetic polypeptide
DEQEIATTNPVATEQYGDVSATDLEDHAGEL

SEQ ID NO: 88013 - protein, 33 aa, Artificial Sequence
  Description of Artificial Sequence: Synthetic polypeptide
CEEEIGTTNPVATEQYGSVVLTGNPTYEDGNVR

SEQ ID NO: 88014 - protein, 31 aa, Artificial Sequence
  Description of Artificial Sequence: Synthetic polypeptide
DEQEIATTNPVATEQYGEVSTDLEDHEGEDL

SEQ ID NO: 88015 - protein, 34 aa, Artificial Sequence
  Description of Artificial Sequence: Synthetic polypeptide
CEEEIGTTNPVATEQYGSVDSDPNSVQARTGERI

SEQ ID NO: 88016 - protein, 30 aa, Artificial Sequence
  Description of Artificial Sequence: Synthetic polypeptide
DENEIRTTNPVATEQWGDVSEIEMSRAGQA

SEQ ID NO: 88017 - protein, 33 aa, Artificial Sequence
  Description of Artificial Sequence: Synthetic polypeptide
DEQEIATTNPVATEQYGEVVSNTNGDHQNNGSR

SEQ ID NO: 88018 - protein, 34 aa, Artificial Sequence
  Description of Artificial Sequence: Synthetic polypeptide
DEQEIATTNPVATEQYGEVVSTDNMLDQNNGDSR

SEQ ID NO: 88019 - protein, 37 aa, Artificial Sequence
  Description of Artificial Sequence: Synthetic polypeptide
DEEEIRTTNPVATEQYGSVSTVNGNLQQGTEQGTNVQ

SEQ ID NO: 88020 - protein, 32 aa, Artificial Sequence
  Description of Artificial Sequence: Synthetic polypeptide
DEQEIATTNPVATEQYGIVSATNLEDHEGEDL

SEQ ID NO: 88021 - protein, 30 aa, Artificial Sequence
  Description of Artificial Sequence: Synthetic polypeptide
DENEIRTTNPVATEQWGDVSEIENMANENA

SEQ ID NO: 88022 - protein, 32 aa, Artificial Sequence
  Description of Artificial Sequence: Synthetic polypeptide
DEQEIATTNPVATEQYGDVSATCLQDHEGEDL

SEQ ID NO: 88023 - protein, 32 aa, Artificial Sequence
  Description of Artificial Sequence: Synthetic polypeptide
DEQEIATTNPVATEQYGCVSATDLEDHEGNDL

SEQ ID NO: 88024 - protein, 33 aa, Artificial Sequence
  Description of Artificial Sequence: Synthetic polypeptide
DEAEIRTTNPVATEQYGSVSVSLLTEQGQQERG

SEQ ID NO: 88025 - protein, 37 aa, Artificial Sequence
  Description of Artificial Sequence: Synthetic polypeptide
DEEEIRTTNPVATEQYGSVSTVNLQQGNNDENNEGEE

SEQ ID NO: 88026 - protein, 37 aa, Artificial Sequence
  Description of Artificial Sequence: Synthetic polypeptide
DEEEIRTTNPVATEQYGSVSTVNLQQGNNATEQGNTE

SEQ ID NO: 88027 - protein, 31 aa, Artificial Sequence
  Description of Artificial Sequence: Synthetic polypeptide
DEQEIATTNPVATEQYGCVAATNLDNDNNNE

SEQ ID NO: 88028 - protein, 30 aa, Artificial Sequence
  Description of Artificial Sequence: Synthetic polypeptide
DENEIRTTNPVATEQWGDVSEIEQNANEDA

SEQ ID NO: 88029 - protein, 32 aa, Artificial Sequence
  Description of Artificial Sequence: Synthetic polypeptide
DEQEIATTNPVATEQYGCVAATNVQDAGGERN

SEQ ID NO: 88030 - protein, 33 aa, Artificial Sequence
  Description of Artificial Sequence: Synthetic polypeptide
DEQEIATTNPVATEQYGCVAGTNPLQAEMGNEL

SEQ ID NO: 88031 - protein, 32 aa, Artificial Sequence
  Description of Artificial Sequence: Synthetic polypeptide
DEQEIATTNPVATEQYGCVATNLQAAMLDGDE

SEQ ID NO: 88032 - protein, 37 aa, Artificial Sequence
  Description of Artificial Sequence: Synthetic polypeptide
DEEEIRTTNPVATEQYGSVSTVNLQNQQQGTNDTTED

SEQ ID NO: 88033 - protein, 32 aa, Artificial Sequence
  Description of Artificial Sequence: Synthetic polypeptide
DEQEIATTNPVATEQYGCVATNLQATEEPTRD

SEQ ID NO: 88034 - protein, 30 aa, Artificial Sequence
  Description of Artificial Sequence: Synthetic polypeptide
DENEIRTTNPVATEQWGDVSEIEQNAAGTA

SEQ ID NO: 88035 - protein, 33 aa, Artificial Sequence
  Description of Artificial Sequence: Synthetic polypeptide
DEQEIATTNPVATEQYGCVATNLQTRNPENPDE

SEQ ID NO: 88036 - protein, 30 aa, Artificial Sequence
  Description of Artificial Sequence: Synthetic polypeptide
DENEIRTTNPVATEQWGDVSEIEQNAAENQ

SEQ ID NO: 88037 - protein, 37 aa, Artificial Sequence
  Description of Artificial Sequence: Synthetic polypeptide
DEEEIRTTNPVATEQYGSVSTVNLQLQAGNNNEDEDE

SEQ ID NO: 88038 - protein, 37 aa, Artificial Sequence
  Description of Artificial Sequence: Synthetic polypeptide
DEEEIRTTNPVATEQYGSVSTVNLQLQAGNNDEDETT

SEQ ID NO: 88039 - protein, 33 aa, Artificial Sequence
  Description of Artificial Sequence: Synthetic polypeptide
DEEEIRTTNPVATEQYGSVTYENNLEETPLIER

SEQ ID NO: 88040 - protein, 30 aa, Artificial Sequence
  Description of Artificial Sequence: Synthetic polypeptide
DENEIRTTNPVATEQWGDVSEIEQNAAENA

SEQ ID NO: 88041 - protein, 30 aa, Artificial Sequence
  Description of Artificial Sequence: Synthetic polypeptide
DENEIRTTNPVATEQWGDVSEIENNANENA

SEQ ID NO: 88042 - protein, 31 aa, Artificial Sequence
  Description of Artificial Sequence: Synthetic polypeptide
DEQEIATTNPVATEQYGIVSTDLEDHEGEDL

SEQ ID NO: 88043 - protein, 33 aa, Artificial Sequence
  Description of Artificial Sequence: Synthetic polypeptide
DEQEIATTNPVATEQYGKSVSATNLEDHEGEDL

SEQ ID NO: 88044 - protein, 30 aa, Artificial Sequence
  Description of Artificial Sequence: Synthetic polypeptide
DENEIRTTNPVATEQWGDVSEIEMNRVEQR

SEQ ID NO: 88045 - protein, 35 aa, Artificial Sequence
  Description of Artificial Sequence: Synthetic polypeptide
DEEEIRTTNPVATEQYGSVSTVNGFGQENIGGQDN

SEQ ID NO: 88046 - protein, 32 aa, Artificial Sequence
  Description of Artificial Sequence: Synthetic polypeptide
DEAEIRTTNPVATEQYGSVSWNYNDTFSLERA

SEQ ID NO: 88047 - protein, 33 aa, Artificial Sequence
  Description of Artificial Sequence: Synthetic polypeptide
DEAEIRTTNPVATEQYGSVSWPNDLEPFNGQIE

SEQ ID NO: 88048 - protein, 30 aa, Artificial Sequence
  Description of Artificial Sequence: Synthetic polypeptide
DENEIRTTNPVATEQWGDVSEIEMNAAGDR

SEQ ID NO: 88049 - protein, 34 aa, Artificial Sequence
  Description of Artificial Sequence: Synthetic polypeptide
DEAEIRTTNPVATEQYGSVSWSNDEQMSGQNDLI

SEQ ID NO: 88050 - protein, 32 aa, Artificial Sequence
  Description of Artificial Sequence: Synthetic polypeptide
DEEEIRTTNPVATEQYGSVVFTGTLEASTMEQ

SEQ ID NO: 88051 - protein, 34 aa, Artificial Sequence
  Description of Artificial Sequence: Synthetic polypeptide
DEEEIRTTNPVATEQYGSVVGDGNNDQEGGNDET

SEQ ID NO: 88052 - protein, 34 aa, Artificial Sequence
  Description of Artificial Sequence: Synthetic polypeptide
DEAEIRTTNPVATEQYGSVSYNMLEVAMGEVNQY

SEQ ID NO: 88053 - protein, 28 aa, Artificial Sequence
  Description of Artificial Sequence: Synthetic peptide
DENEIRTTNPVATEQWGDVSEIEMHEDA

SEQ ID NO: 88054 - protein, 34 aa, Artificial Sequence
  Description of Artificial Sequence: Synthetic polypeptide
DEAEIRTTNPVATEQYGSVTDTQWLQIEGFENGL

SEQ ID NO: 88055 - protein, 33 aa, Artificial Sequence
  Description of Artificial Sequence: Synthetic polypeptide
DEAEIRTTNPVATEQYGSVTGGTNQGNSGGENL

SEQ ID NO: 88056 - protein, 28 aa, Artificial Sequence
  Description of Artificial Sequence: Synthetic peptide
DENEIRTTNPVATEQWGDVSEIEMAEDA

SEQ ID NO: 88057 - protein, 32 aa, Artificial Sequence
  Description of Artificial Sequence: Synthetic polypeptide
DEAEIRTTNPVATEQYGSVTTPELQGSIEDQN

SEQ ID NO: 88058 - protein, 32 aa, Artificial Sequence
  Description of Artificial Sequence: Synthetic polypeptide
DEAEIRTTNPVATEQYGSVTVTPDDGQEGEQI

SEQ ID NO: 88059 - protein, 29 aa, Artificial Sequence
  Description of Artificial Sequence: Synthetic peptide
DENEIRTTNPVATEQWGDVSEIEMAAGDA

SEQ ID NO: 88060 - protein, 34 aa, Artificial Sequence
  Description of Artificial Sequence: Synthetic polypeptide
DEEEIRTTNPVATEQYGSVVGNTFNLEDPEVNEG

SEQ ID NO: 88061 - protein, 34 aa, Artificial Sequence
  Description of Artificial Sequence: Synthetic polypeptide
DEEEIRTTNPVATEQYGSVVGPTMNMIRPGEIEV

SEQ ID NO: 88062 - protein, 32 aa, Artificial Sequence
  Description of Artificial Sequence: Synthetic polypeptide
DEQEIATTNPVATEQYGSISATDIEQHNGNDH

SEQ ID NO: 88063 - protein, 32 aa, Artificial Sequence
  Description of Artificial Sequence: Synthetic polypeptide
DEAEIRTTNPVATEQYGSVSWMDTNRPESDQT

SEQ ID NO: 88064 - protein, 32 aa, Artificial Sequence
  Description of Artificial Sequence: Synthetic polypeptide
DEQEIATTNPVATEQYGSISATDLEQHEGEDH

SEQ ID NO: 88065 - protein, 36 aa, Artificial Sequence
  Description of Artificial Sequence: Synthetic polypeptide
DEAEIRTTNPVATEQYGSVSWLTNLEHTRNGQEDRN

SEQ ID NO: 88066 - protein, 34 aa, Artificial Sequence
  Description of Artificial Sequence: Synthetic polypeptide
DEEEIRTTNPVATEQYGSVVETNTLELNNQQHDY

SEQ ID NO: 88067 - protein, 30 aa, Artificial Sequence
  Description of Artificial Sequence: Synthetic polypeptide
DENEIRTTNPVATEQWGDVSEIEMNRAEQR

SEQ ID NO: 88068 - protein, 35 aa, Artificial Sequence
  Description of Artificial Sequence: Synthetic polypeptide
DEEEIRTTNPVATEQYGSVSTVNGFGQENDEGGGG

SEQ ID NO: 88069 - protein, 33 aa, Artificial Sequence
  Description of Artificial Sequence: Synthetic polypeptide
DEQEIATTNPVATEQYGLSVSATNLEDHEGMDL

SEQ ID NO: 88070 - protein, 35 aa, Artificial Sequence
  Description of Artificial Sequence: Synthetic polypeptide
DEAEIRTTNPVATEQYGSVSVTNELGDETFGSHRI

SEQ ID NO: 88071 - protein, 30 aa, Artificial Sequence
  Description of Artificial Sequence: Synthetic polypeptide
DENEIRTTNPVATEQWGDVSEIEMNRAENA

SEQ ID NO: 88072 - protein, 31 aa, Artificial Sequence
  Description of Artificial Sequence: Synthetic polypeptide
DEQEIATTNPVATEQYGNVSATDLEDHVGEL

SEQ ID NO: 88073 - protein, 30 aa, Artificial Sequence
  Description of Artificial Sequence: Synthetic polypeptide
DENEIRTTNPVATEQWGDVSEIEMNRAEDR

SEQ ID NO: 88074 - protein, 33 aa, Artificial Sequence
  Description of Artificial Sequence: Synthetic polypeptide
DEQEIATTNPVATEQYGRSVSATDLEDHEGERL

SEQ ID NO: 88075 - protein, 34 aa, Artificial Sequence
  Description of Artificial Sequence: Synthetic polypeptide
DEEEIRTTNPVATEQYGSVVDFGTNDQEQGGGED

SEQ ID NO: 88076 - protein, 32 aa, Artificial Sequence
  Description of Artificial Sequence: Synthetic polypeptide
DEAEIRTTNPVATEQYGSVSVTPYDQLFSEEH

SEQ ID NO: 88077 - protein, 29 aa, Artificial Sequence
  Description of Artificial Sequence: Synthetic peptide
DENEIRTTNPVATEQWGDVSEIEMNAENA

SEQ ID NO: 88078 - protein, 30 aa, Artificial Sequence
  Description of Artificial Sequence: Synthetic polypeptide
DEQEIATTNPVATEQYGSAPAEVLQHEGEL

SEQ ID NO: 88079 - protein, 35 aa, Artificial Sequence
  Description of Artificial Sequence: Synthetic polypeptide
DEAEIRTTNPVATEQYGSVSVTYLMTETFGNDNRH

SEQ ID NO: 88080 - protein, 30 aa, Artificial Sequence
  Description of Artificial Sequence: Synthetic polypeptide
DENEIRTTNPVATEQWGDVSEIEMNAAGNA

SEQ ID NO: 88081 - protein, 32 aa, Artificial Sequence
  Description of Artificial Sequence: Synthetic polypeptide
DEQEIATTNPVATEQYGSASATDLEDHEGERL

SEQ ID NO: 88082 - protein, 31 aa, Artificial Sequence
  Description of Artificial Sequence: Synthetic polypeptide
DEQEIATTNPVATEQYGSASATDLEHEGGDL

SEQ ID NO: 88083 - protein, 32 aa, Artificial Sequence
  Description of Artificial Sequence: Synthetic polypeptide
DEQEIATTNPVATEQYGSASATDLQDHEGEDL

SEQ ID NO: 88084 - protein, 32 aa, Artificial Sequence
  Description of Artificial Sequence: Synthetic polypeptide
DEAEIRTTNPVATEQYGSVSWEMEDGGGEERN

SEQ ID NO: 88085 - protein, 33 aa, Artificial Sequence
  Description of Artificial Sequence: Synthetic polypeptide
DEAEICTTNPVATECWGSVSTNLQGDRQENGES

SEQ ID NO: 88086 - protein, 36 aa, Artificial Sequence
  Description of Artificial Sequence: Synthetic polypeptide
DEEEIRTTNPVATEQYGSYVGSVPNLQMRPLVNIEE

SEQ ID NO: 88087 - protein, 34 aa, Artificial Sequence
  Description of Artificial Sequence: Synthetic polypeptide
DENEAEIRTTNPVAYEAWGEVSTNLQGEDGNNDR

SEQ ID NO: 88088 - protein, 35 aa, Artificial Sequence
  Description of Artificial Sequence: Synthetic polypeptide
DESEIRTTNPVATEQWGSVSSTCPNEPQMREGENG

SEQ ID NO: 88089 - protein, 33 aa, Artificial Sequence
  Description of Artificial Sequence: Synthetic polypeptide
DESEIRTTNPVATEQWGSVSTINEQDHEGEEDG

SEQ ID NO: 88090 - protein, 30 aa, Artificial Sequence
  Description of Artificial Sequence: Synthetic polypeptide
DEDEIATTNPVAYEQYGSVAATNDAPPNDN

SEQ ID NO: 88091 - protein, 32 aa, Artificial Sequence
  Description of Artificial Sequence: Synthetic polypeptide
DAEEIATTNPVAYEQYGSVSANNTQTRNGDEQ

SEQ ID NO: 88092 - protein, 31 aa, Artificial Sequence
  Description of Artificial Sequence: Synthetic polypeptide
DEDEIATTNPVAYEQYGSVAATNDDTANGNH

SEQ ID NO: 88093 - protein, 34 aa, Artificial Sequence
  Description of Artificial Sequence: Synthetic polypeptide
DEHEIRTTNPVAYEQYGSISCTQHTSQRTGGMNR

SEQ ID NO: 88094 - protein, 34 aa, Artificial Sequence
  Description of Artificial Sequence: Synthetic polypeptide
DEHEIRTTNPVAYEQYGSISCTNTSAREGGMNRS

SEQ ID NO: 88095 - protein, 35 aa, Artificial Sequence
  Description of Artificial Sequence: Synthetic polypeptide
DESEIRTTNPVATEQWGSVSSTCINEPQMREGENG

SEQ ID NO: 88096 - protein, 33 aa, Artificial Sequence
  Description of Artificial Sequence: Synthetic polypeptide
DEHEIRTTNPVAYEQYGSIPSCTNTSQREGGSS

SEQ ID NO: 88097 - protein, 31 aa, Artificial Sequence
  Description of Artificial Sequence: Synthetic polypeptide
DAEEIATTNPVAYMQYGSVSAGGVQENGNHR

SEQ ID NO: 88098 - protein, 34 aa, Artificial Sequence
  Description of Artificial Sequence: Synthetic polypeptide
DEEEIRTTNPVATEQYGSVSTFLNVEREEETSSF

SEQ ID NO: 88099 - protein, 34 aa, Artificial Sequence
  Description of Artificial Sequence: Synthetic polypeptide
DEEEIRTTNPVATEQYGSVSTFLNVEDEEENISD

SEQ ID NO: 88100 - protein, 33 aa, Artificial Sequence
  Description of Artificial Sequence: Synthetic polypeptide
DESEIRTTNPVATEQWGSVVCINEPQDREGENG

SEQ ID NO: 88101 - protein, 33 aa, Artificial Sequence
  Description of Artificial Sequence: Synthetic polypeptide
DEHEIRTTNPVAYEQWGVVTSTNNLQGDGNNGP

SEQ ID NO: 88102 - protein, 31 aa, Artificial Sequence
  Description of Artificial Sequence: Synthetic polypeptide
DEDEIATTNPVAYEQYGSVAATNDTANGTND

SEQ ID NO: 88103 - protein, 32 aa, Artificial Sequence
  Description of Artificial Sequence: Synthetic polypeptide
DAEEIATTNPVAYMQYGSVSTGNGVMNGQNHR

SEQ ID NO: 88104 - protein, 30 aa, Artificial Sequence
  Description of Artificial Sequence: Synthetic polypeptide
DAEEIATTNPVAYEQYGVVAASNLNDNNGR

SEQ ID NO: 88105 - protein, 33 aa, Artificial Sequence
  Description of Artificial Sequence: Synthetic polypeptide
DAEEIATTNPVAYEQYGSVCATNLQNSHGTDNQ

SEQ ID NO: 88106 - protein, 34 aa, Artificial Sequence
  Description of Artificial Sequence: Synthetic polypeptide
DESEIRTTNPVATEQWGSVSSCINEPQDREGENG

SEQ ID NO: 88107 - protein, 32 aa, Artificial Sequence
  Description of Artificial Sequence: Synthetic polypeptide
DAEEIATTNPVAYEQYGSVCATNDEQDNGNEH

SEQ ID NO: 88108 - protein, 33 aa, Artificial Sequence
  Description of Artificial Sequence: Synthetic polypeptide
DEHEIRTTNPVAYESWGSVSTNLNQGDAGQNQP

SEQ ID NO: 88109 - protein, 30 aa, Artificial Sequence
  Description of Artificial Sequence: Synthetic polypeptide
DEDEIATTNPVAYEQYGSVAAASNDTAGND

SEQ ID NO: 88110 - protein, 33 aa, Artificial Sequence
  Description of Artificial Sequence: Synthetic polypeptide
DESEIRTTNPVATEQWGSVSCINEPQDREGEEG

SEQ ID NO: 88111 - protein, 32 aa, Artificial Sequence
  Description of Artificial Sequence: Synthetic polypeptide
DEHEIRTTNPVAYESWGSVATNLQGDLGNNGS

SEQ ID NO: 88112 - protein, 30 aa, Artificial Sequence
  Description of Artificial Sequence: Synthetic polypeptide
DEHEIRTTNPVAYERYGVVTTTNPMGDNER

SEQ ID NO: 88113 - protein, 30 aa, Artificial Sequence
  Description of Artificial Sequence: Synthetic polypeptide
DEHEIRTTNPVAYERYGVVTTNPGGDNNER

SEQ ID NO: 88114 - protein, 31 aa, Artificial Sequence
  Description of Artificial Sequence: Synthetic polypeptide
DEHEIRTTNPVAYERYGVVTTNNPAGDTNER

SEQ ID NO: 88115 - protein, 33 aa, Artificial Sequence
  Description of Artificial Sequence: Synthetic polypeptide
DESEIRTTNPVATEQWGSVSCINEVQDFEGENG

SEQ ID NO: 88116 - protein, 30 aa, Artificial Sequence
  Description of Artificial Sequence: Synthetic polypeptide
DEHEIRTTNPVAYERYGVTTTNPGGGDNER

SEQ ID NO: 88117 - protein, 31 aa, Artificial Sequence
  Description of Artificial Sequence: Synthetic polypeptide
DEHEIRTTNPVAYERYGSVSQNISFPVGNNS

SEQ ID NO: 88118 - protein, 33 aa, Artificial Sequence
  Description of Artificial Sequence: Synthetic polypeptide
DESEIRTTNPVATEQWGSVSDINEPQDSEGENG

SEQ ID NO: 88119 - protein, 30 aa, Artificial Sequence
  Description of Artificial Sequence: Synthetic polypeptide
DEHEIRTTNPVAYERWGNVTTNPNDGDNER

SEQ ID NO: 88120 - protein, 32 aa, Artificial Sequence
  Description of Artificial Sequence: Synthetic polypeptide
DESEIRTTNPVATEQWGSVSENEPQDAEEENA

SEQ ID NO: 88121 - protein, 32 aa, Artificial Sequence
  Description of Artificial Sequence: Synthetic polypeptide
DEDEIATTNPVAYEQYGSVAANDQVREHGTRS

SEQ ID NO: 88122 - protein, 31 aa, Artificial Sequence
  Description of Artificial Sequence: Synthetic polypeptide
DEHEIRTTNPVAYERWGNVSTTNDPDGDNER

SEQ ID NO: 88123 - protein, 32 aa, Artificial Sequence
  Description of Artificial Sequence: Synthetic polypeptide
DEHEIRTTNPVAYEQYGTVSWVELDNRQGMNM

SEQ ID NO: 88124 - protein, 33 aa, Artificial Sequence
  Description of Artificial Sequence: Synthetic polypeptide
DEHEIRTTNPVAYEQYGTVSWVELDDRQGMNTR

SEQ ID NO: 88125 - protein, 30 aa, Artificial Sequence
  Description of Artificial Sequence: Synthetic polypeptide
DAEEIATTNPVAYMQYGSVSTNGVMNENHS

SEQ ID NO: 88126 - protein, 31 aa, Artificial Sequence
  Description of Artificial Sequence: Synthetic polypeptide
DEDEIATTNPVAYEQYGSVAAANNDDRGNDQ

SEQ ID NO: 88127 - protein, 32 aa, Artificial Sequence
  Description of Artificial Sequence: Synthetic polypeptide
DEHEIRTTNPVAYEQWGVVSTNLNQNGDVQMG

SEQ ID NO: 88128 - protein, 31 aa, Artificial Sequence
  Description of Artificial Sequence: Synthetic polypeptide
DEDEIATTNPVAYEQYGSVAATNDTDDGNDQ

SEQ ID NO: 88129 - protein, 32 aa, Artificial Sequence
  Description of Artificial Sequence: Synthetic polypeptide
DEHEIRTTNPVAYEQWGSVSTPGPQGNMGNGE

SEQ ID NO: 88130 - protein, 33 aa, Artificial Sequence
  Description of Artificial Sequence: Synthetic polypeptide
DESEIRTTNPVATEQYGCVSTLLVTQFNGLQDD

SEQ ID NO: 88131 - protein, 34 aa, Artificial Sequence
  Description of Artificial Sequence: Synthetic polypeptide
DESEIRTTNPVATEQYGCVSTNYELQGIGIEDTN

SEQ ID NO: 88132 - protein, 33 aa, Artificial Sequence
  Description of Artificial Sequence: Synthetic polypeptide
DESEIRTTNPVATEQYGCVSTVNLDERYDSDQQ

SEQ ID NO: 88133 - protein, 30 aa, Artificial Sequence
  Description of Artificial Sequence: Synthetic polypeptide
DEDEIATTNPVAYEQYGSVAINNDTDGNDE

SEQ ID NO: 88134 - protein, 32 aa, Artificial Sequence
  Description of Artificial Sequence: Synthetic polypeptide
DEHEIRTTNPVAYEQWGSVSTNMQGEGGDTQG

SEQ ID NO: 88135 - protein, 32 aa, Artificial Sequence
  Description of Artificial Sequence: Synthetic polypeptide
DAEEICTTNPTAYEQYGSVATNLQHSGDQDRM

SEQ ID NO: 88136 - protein, 32 aa, Artificial Sequence
  Description of Artificial Sequence: Synthetic polypeptide
DEDEIATTNPVAYEQYGSVAGTNDQRESNDSQ

SEQ ID NO: 88137 - protein, 30 aa, Artificial Sequence
  Description of Artificial Sequence: Synthetic polypeptide
DEDEIATTNPVAYEQYGSVAITNDTAHNEE

SEQ ID NO: 88138 - protein, 32 aa, Artificial Sequence
  Description of Artificial Sequence: Synthetic polypeptide
DAEEIRSTNPVATEQYGSVSPDNLETQNEEQH

SEQ ID NO: 88139 - protein, 36 aa, Artificial Sequence
  Description of Artificial Sequence: Synthetic polypeptide
DEEEIRTTNPVATEQYGVVSTVNTNLQAGNNQEQTT

SEQ ID NO: 88140 - protein, 35 aa, Artificial Sequence
  Description of Artificial Sequence: Synthetic polypeptide
DESEIRTTNPVATEQYGEVHSLTDNQLNQHGGARM

SEQ ID NO: 88141 - protein, 30 aa, Artificial Sequence
  Description of Artificial Sequence: Synthetic polypeptide
CEDEIACTNPVATEQYGCASANLQMAPGDR

SEQ ID NO: 88142 - protein, 31 aa, Artificial Sequence
  Description of Artificial Sequence: Synthetic polypeptide
DEDEIATTNPVAYEQYGSVANNLADDPGERH

SEQ ID NO: 88143 - protein, 33 aa, Artificial Sequence
  Description of Artificial Sequence: Synthetic polypeptide
DEDEIATTNPVAYEQYGSVANNLQDRPGGEGNH

SEQ ID NO: 88144 - protein, 33 aa, Artificial Sequence
  Description of Artificial Sequence: Synthetic polypeptide
DEHEIRTTNPVAYEQWGSVSTNLQGNMGGGGAT

SEQ ID NO: 88145 - protein, 32 aa, Artificial Sequence
  Description of Artificial Sequence: Synthetic polypeptide
DESEIRTTNPVATEQYGEMTSTNGQGEGDDEQ

SEQ ID NO: 88146 - protein, 32 aa, Artificial Sequence
  Description of Artificial Sequence: Synthetic polypeptide
DEHEIRTTNPVAYEQWGSVSTPNGNTMGMNEV

SEQ ID NO: 88147 - protein, 31 aa, Artificial Sequence
  Description of Artificial Sequence: Synthetic polypeptide
DEHEIRTTNPVAYEQWGSVTGGNTQGDGNGP

SEQ ID NO: 88148 - protein, 34 aa, Artificial Sequence
  Description of Artificial Sequence: Synthetic polypeptide
DEEEIRTTNPVATEQYGSVSTEPVGLIETPGQLV

SEQ ID NO: 88149 - protein, 34 aa, Artificial Sequence
  Description of Artificial Sequence: Synthetic polypeptide
DEEEIRTTNPVATEQYGSVSTFCNVEDEEENSSS

SEQ ID NO: 88150 - protein, 32 aa, Artificial Sequence
  Description of Artificial Sequence: Synthetic polypeptide
DEHEIRTTNPVAYEQWGTVSTALQADNGGNTG

SEQ ID NO: 88151 - protein, 31 aa, Artificial Sequence
  Description of Artificial Sequence: Synthetic polypeptide
DEDEIATTNPVAYEQYGSVAATNDTTAGNDT

SEQ ID NO: 88152 - protein, 35 aa, Artificial Sequence
  Description of Artificial Sequence: Synthetic polypeptide
DESEIRTTNPVATEQWYGSVSQTLNGAQERESEND

SEQ ID NO: 88153 - protein, 32 aa, Artificial Sequence
  Description of Artificial Sequence: Synthetic polypeptide
DEHEIRTTNPVAYEQWGSYWSTINELQDENNS

SEQ ID NO: 88154 - protein, 32 aa, Artificial Sequence
  Description of Artificial Sequence: Synthetic polypeptide
DEDEIATTNPVAYEQYGSVAATNLADDPGNHH

SEQ ID NO: 88155 - protein, 32 aa, Artificial Sequence
  Description of Artificial Sequence: Synthetic polypeptide
DEHEIRTTNPVAYEQWGSVVTGLNMGEGNGRE

SEQ ID NO: 88156 - protein, 34 aa, Artificial Sequence
  Description of Artificial Sequence: Synthetic polypeptide
DESEIRTTNPVATEQYGASFVSVTLLTQNTQEDR

SEQ ID NO: 88157 - protein, 35 aa, Artificial Sequence
  Description of Artificial Sequence: Synthetic polypeptide
DESEIRTTNPVATEQYGAVVGSTGDLGQRGEGNID

SEQ ID NO: 88158 - protein, 34 aa, Artificial Sequence
  Description of Artificial Sequence: Synthetic polypeptide
DESEIRTTNPVATEQYGAVVSTGDLGQEGEGNDD

SEQ ID NO: 88159 - protein, 32 aa, Artificial Sequence
  Description of Artificial Sequence: Synthetic polypeptide
DEHEIRTTNPVAYEQWGSVTTNLQGPGMDGDK

SEQ ID NO: 88160 - protein, 34 aa, Artificial Sequence
  Description of Artificial Sequence: Synthetic polypeptide
DEEEIRTTNPVATEQYGSVSTETNGEAWDMVENV

SEQ ID NO: 88161 - protein, 35 aa, Artificial Sequence
  Description of Artificial Sequence: Synthetic polypeptide
DEEEIRTTNPVATEQYGSVSTETDPQQLIGMEERW

SEQ ID NO: 88162 - protein, 34 aa, Artificial Sequence
  Description of Artificial Sequence: Synthetic polypeptide
DEEEIRTTNPVATEQYGSVSTETDLQDQSYLQEE

SEQ ID NO: 88163 - protein, 33 aa, Artificial Sequence
  Description of Artificial Sequence: Synthetic polypeptide
DESEIRTTNPVATEQYGCVCSNTENHQNFGSDQ

SEQ ID NO: 88164 - protein, 31 aa, Artificial Sequence
  Description of Artificial Sequence: Synthetic polypeptide
DEDEIATTNPVAYEQYGSVAGANLQDDSDGR

SEQ ID NO: 88165 - protein, 32 aa, Artificial Sequence
  Description of Artificial Sequence: Synthetic polypeptide
DEDEIATTNPVAYEQYGSVAGNGLQRAEGDTA

SEQ ID NO: 88166 - protein, 31 aa, Artificial Sequence
  Description of Artificial Sequence: Synthetic polypeptide
DEDEIATTNPVAYEQYGSVAATNDTAQGNND

SEQ ID NO: 88167 - protein, 31 aa, Artificial Sequence
  Description of Artificial Sequence: Synthetic polypeptide
DEHEIRTTNPVAYESWGSVSTTNGPHSGGNA

SEQ ID NO: 88168 - protein, 32 aa, Artificial Sequence
  Description of Artificial Sequence: Synthetic polypeptide
DEDEIATTNPVAYEQYGSVAAANNDDQRGNVS

SEQ ID NO: 88169 - protein, 30 aa, Artificial Sequence
  Description of Artificial Sequence: Synthetic polypeptide
DEDEIATTNPVAYEQYGSVAAANDVTDGND

SEQ ID NO: 88170 - protein, 33 aa, Artificial Sequence
  Description of Artificial Sequence: Synthetic polypeptide
DEKEIRTTNPVATEHWGSVSCINEPQDREGENG

SEQ ID NO: 88171 - protein, 33 aa, Artificial Sequence
  Description of Artificial Sequence: Synthetic polypeptide
DEKEIRTTNPVATEDWGSVSCINEPQDREGENG

SEQ ID NO: 88172 - protein, 31 aa, Artificial Sequence
  Description of Artificial Sequence: Synthetic polypeptide
DEDEIATTNPVAYEQYGCVATNLQDDGDDLH

SEQ ID NO: 88173 - protein, 32 aa, Artificial Sequence
  Description of Artificial Sequence: Synthetic polypeptide
DEDEIATTNPVAYEQYGCVATNLQGTPDGSRN

SEQ ID NO: 88174 - protein, 33 aa, Artificial Sequence
  Description of Artificial Sequence: Synthetic polypeptide
DEKEIRTTNPVATECWGSVSCINEPQDREGENG

SEQ ID NO: 88175 - protein, 32 aa, Artificial Sequence
  Description of Artificial Sequence: Synthetic polypeptide
DEKEIATTNPVATEQYGSVSATDLEDHEGEDL

SEQ ID NO: 88176 - protein, 32 aa, Artificial Sequence
  Description of Artificial Sequence: Synthetic polypeptide
DEKEIATTNPVATEQYGSVSATDLEDHEGEDD

SEQ ID NO: 88177 - protein, 31 aa, Artificial Sequence
  Description of Artificial Sequence: Synthetic polypeptide
DELAIRTTNPVATEQYGEVSPYSDLQFNVND

SEQ ID NO: 88178 - protein, 32 aa, Artificial Sequence
  Description of Artificial Sequence: Synthetic polypeptide
DEKEIATTNPVATEQYGSVSATDLEDFEGEDL

SEQ ID NO: 88179 - protein, 34 aa, Artificial Sequence
  Description of Artificial Sequence: Synthetic polypeptide
DEDEIATTNPVAYEQYGQSTSTNDLDQDRGIGRE

SEQ ID NO: 88180 - protein, 33 aa, Artificial Sequence
  Description of Artificial Sequence: Synthetic polypeptide
DESEIRTTNPVATEPYGSVSMEDIQQQRNGENG

SEQ ID NO: 88181 - protein, 33 aa, Artificial Sequence
  Description of Artificial Sequence: Synthetic polypeptide
DEDEIATTNPVAYEQYGQSVATNDLMQDGIGND

SEQ ID NO: 88182 - protein, 33 aa, Artificial Sequence
  Description of Artificial Sequence: Synthetic polypeptide
DEDEIATTNPVAYEQYGQSVATNDLTQNGMGRY

SEQ ID NO: 88183 - protein, 34 aa, Artificial Sequence
  Description of Artificial Sequence: Synthetic polypeptide
DEDEIATTNPVAYEQYGQSVATNNDLDQRGMGRP

SEQ ID NO: 88184 - protein, 28 aa, Artificial Sequence
  Description of Artificial Sequence: Synthetic peptide
DESEIRTTNPVATEQWGDMSSTLMAEDA

SEQ ID NO: 88185 - protein, 28 aa, Artificial Sequence
  Description of Artificial Sequence: Synthetic peptide
DESEIRTTNPVATEQWGDMSSTLMHEDA

SEQ ID NO: 88186 - protein, 33 aa, Artificial Sequence
  Description of Artificial Sequence: Synthetic polypeptide
DESEIRTTNPVATEPYGSVSMEDIQQDRNGENG

SEQ ID NO: 88187 - protein, 32 aa, Artificial Sequence
  Description of Artificial Sequence: Synthetic polypeptide
DELEIATTNPVATEQYGSVSATDLEDHEGEDL

SEQ ID NO: 88188 - protein, 32 aa, Artificial Sequence
  Description of Artificial Sequence: Synthetic polypeptide
DELEIATTNPVATEQYGSVSATDLEEHEGEDL

SEQ ID NO: 88189 - protein, 32 aa, Artificial Sequence
  Description of Artificial Sequence: Synthetic polypeptide
DESEIRTTNPVATEPYGSISCENIPQQQNGNH

SEQ ID NO: 88190 - protein, 33 aa, Artificial Sequence
  Description of Artificial Sequence: Synthetic polypeptide
DESEIRTTNPVATEPWGSVSCINEPQQREGENG

SEQ ID NO: 88191 - protein, 33 aa, Artificial Sequence
  Description of Artificial Sequence: Synthetic polypeptide
DESEIRTTNPVATEPWGSVSCINEQQDREGENG

SEQ ID NO: 88192 - protein, 33 aa, Artificial Sequence
  Description of Artificial Sequence: Synthetic polypeptide
DESEIRTTNPVATEPWGSVSCINEQQQRNGENG

SEQ ID NO: 88193 - protein, 33 aa, Artificial Sequence
  Description of Artificial Sequence: Synthetic polypeptide
DESEIRTTNPVATEPWGSVSCINHSQDREVGNG

SEQ ID NO: 88194 - protein, 33 aa, Artificial Sequence
  Description of Artificial Sequence: Synthetic polypeptide
DESEIRTTNPVATEPWGSVSMINEQQDREGENG

SEQ ID NO: 88195 - protein, 33 aa, Artificial Sequence
  Description of Artificial Sequence: Synthetic polypeptide
DESEIRTTNPVATEPWGSVSMINEQQQRNGENG

SEQ ID NO: 88196 - protein, 34 aa, Artificial Sequence
  Description of Artificial Sequence: Synthetic polypeptide
DELEIRTTNPVATEQYGSVSSDWNLEEIQSDNQS

SEQ ID NO: 88197 - protein, 33 aa, Artificial Sequence
  Description of Artificial Sequence: Synthetic polypeptide
DESEIRTTNPVATEPWGSVSVNNEPQDREGENG

SEQ ID NO: 88198 - protein, 36 aa, Artificial Sequence
  Description of Artificial Sequence: Synthetic polypeptide
DELEIRTTNPVATEQYGSVSSCTNMLSHRTSGNNDD

SEQ ID NO: 88199 - protein, 34 aa, Artificial Sequence
  Description of Artificial Sequence: Synthetic polypeptide
DELEIRTTNPVATEQYGSVCSPTNLERNDDTQED

SEQ ID NO: 88200 - protein, 35 aa, Artificial Sequence
  Description of Artificial Sequence: Synthetic polypeptide
DELEIRTTNPVATEQYGKVSCTNMLHNRTSGNNSD

SEQ ID NO: 88201 - protein, 35 aa, Artificial Sequence
  Description of Artificial Sequence: Synthetic polypeptide
DELEIRTTNPVATEQYGEVSCTNMLSHFTSGNNRD

SEQ ID NO: 88202 - protein, 36 aa, Artificial Sequence
  Description of Artificial Sequence: Synthetic polypeptide
DELEIRTTNPVATEPYGSVSCTGNMLSIRTSGNNRD

SEQ ID NO: 88203 - protein, 33 aa, Artificial Sequence
  Description of Artificial Sequence: Synthetic polypeptide
DELEIRTTNPVATECWGSVSCINEPQDREGENG

SEQ ID NO: 88204 - protein, 30 aa, Artificial Sequence
  Description of Artificial Sequence: Synthetic polypeptide
DEDEIATTNPVAYEQYGCTATNLQGGDSSM

SEQ ID NO: 88205 - protein, 32 aa, Artificial Sequence
  Description of Artificial Sequence: Synthetic polypeptide
DELEIATTNPVATEQYGSVSWTDLEDHNGEDM

SEQ ID NO: 88206 - protein, 32 aa, Artificial Sequence
  Description of Artificial Sequence: Synthetic polypeptide
DELEIATTNPVATEQYGSVSATDLETHEGEPL

SEQ ID NO: 88207 - protein, 34 aa, Artificial Sequence
  Description of Artificial Sequence: Synthetic polypeptide
DEEEIRTTNPVATEQYGSVSTGDGEGQGEEVNGE

SEQ ID NO: 88208 - protein, 34 aa, Artificial Sequence
  Description of Artificial Sequence: Synthetic polypeptide
DEEEIRTTNPVATEQYGSVSTGDGEGFGQENEDE

SEQ ID NO: 88209 - protein, 33 aa, Artificial Sequence
  Description of Artificial Sequence: Synthetic polypeptide
DEEEIRTTNPVATEQYGSVSTGALYTPDSDQLD

SEQ ID NO: 88210 - protein, 33 aa, Artificial Sequence
  Description of Artificial Sequence: Synthetic polypeptide
DEIEISTTNPVATEQYGSVSTKNEQLGPGEIPL

SEQ ID NO: 88211 - protein, 32 aa, Artificial Sequence
  Description of Artificial Sequence: Synthetic polypeptide
DEHEISTTNPVAYEQYGKISTNELQDTSGSLR

SEQ ID NO: 88212 - protein, 31 aa, Artificial Sequence
  Description of Artificial Sequence: Synthetic polypeptide
DEHEISTTNPVAYEQYGKISTNELQATSGSE

SEQ ID NO: 88213 - protein, 32 aa, Artificial Sequence
  Description of Artificial Sequence: Synthetic polypeptide
DEHEISTTNPVAYEQYGKISTGNELQATEGSR

SEQ ID NO: 88214 - protein, 33 aa, Artificial Sequence
  Description of Artificial Sequence: Synthetic polypeptide
DESEIRTTNPVATEQWGSVSACINLEDHEGENG

SEQ ID NO: 88215 - protein, 33 aa, Artificial Sequence
  Description of Artificial Sequence: Synthetic polypeptide
DESEIRTTNPVATEQWGSVSCIAEPQMREGENV

SEQ ID NO: 88216 - protein, 31 aa, Artificial Sequence
  Description of Artificial Sequence: Synthetic polypeptide
DEHEISTTNPVAYEQYGKCSTNELQFTVGSP

SEQ ID NO: 88217 - protein, 32 aa, Artificial Sequence
  Description of Artificial Sequence: Synthetic polypeptide
DEHEIRTTNPVSTEQYGSVSWNEMDRQGMDSE

SEQ ID NO: 88218 - protein, 30 aa, Artificial Sequence
  Description of Artificial Sequence: Synthetic polypeptide
DEDEIATTNPVAYEQYGSVAAAGDDRGNDL

SEQ ID NO: 88219 - protein, 32 aa, Artificial Sequence
  Description of Artificial Sequence: Synthetic polypeptide
DESEIRTTNPVATEQWGSVSCINCPQDREEEG

SEQ ID NO: 88220 - protein, 32 aa, Artificial Sequence
  Description of Artificial Sequence: Synthetic polypeptide
DEHEIRTTNPVAYQQYGCVSTTNDDEGRGNPS

SEQ ID NO: 88221 - protein, 31 aa, Artificial Sequence
  Description of Artificial Sequence: Synthetic polypeptide
DEDEIATTNPVAYEQYGSVAAANDDQDGNSD

SEQ ID NO: 88222 - protein, 30 aa, Artificial Sequence
  Description of Artificial Sequence: Synthetic polypeptide
DEDEIATTNPVAYEQYGSVAAANDDQGNDD

SEQ ID NO: 88223 - protein, 31 aa, Artificial Sequence
  Description of Artificial Sequence: Synthetic polypeptide
DEDEIATTNPVAYEQYGSVAAANDDRGNNHL

SEQ ID NO: 88224 - protein, 33 aa, Artificial Sequence
  Description of Artificial Sequence: Synthetic polypeptide
DAEEIATTNPVAYEQYGSVATNPTQTGNGDERG

SEQ ID NO: 88225 - protein, 31 aa, Artificial Sequence
  Description of Artificial Sequence: Synthetic polypeptide
DEDEIATTNPVAYEQYGSVAAANDDRGNVDV

SEQ ID NO: 88226 - protein, 31 aa, Artificial Sequence
  Description of Artificial Sequence: Synthetic polypeptide
DEHEIRTTNPVAYMQWGSVPTWENDQHQGND

SEQ ID NO: 88227 - protein, 33 aa, Artificial Sequence
  Description of Artificial Sequence: Synthetic polypeptide
DESEIRTTNPVATEQWGSVSCINEPQDREEENG

SEQ ID NO: 88228 - protein, 31 aa, Artificial Sequence
  Description of Artificial Sequence: Synthetic polypeptide
DEHEISTTNPVAYERWGEVSTNLQHQGNDEE

SEQ ID NO: 88229 - protein, 30 aa, Artificial Sequence
  Description of Artificial Sequence: Synthetic polypeptide
CEDEIACTNPVATEQYGCASANLQDHPGQR

SEQ ID NO: 88230 - protein, 33 aa, Artificial Sequence
  Description of Artificial Sequence: Synthetic polypeptide
DAEEIATTNPVAYEQYGSVAATNLQNPNGTDRP

SEQ ID NO: 88231 - protein, 34 aa, Artificial Sequence
  Description of Artificial Sequence: Synthetic polypeptide
DESEIRTTNPVATEQWGSVCSCINEPQDREGENG

SEQ ID NO: 88232 - protein, 34 aa, Artificial Sequence
  Description of Artificial Sequence: Synthetic polypeptide
DEIEIRTTNPVAYEAWGQVVSTNMLQRTGGNYRE

SEQ ID NO: 88233 - protein, 33 aa, Artificial Sequence
  Description of Artificial Sequence: Synthetic polypeptide
DESEIRTTNPVATEQWGDVSCINEPQDREGENA

SEQ ID NO: 88234 - protein, 33 aa, Artificial Sequence
  Description of Artificial Sequence: Synthetic polypeptide
DESEIRTTNPVATEQWGDVSCINEPQDREGENG

SEQ ID NO: 88235 - protein, 32 aa, Artificial Sequence
  Description of Artificial Sequence: Synthetic polypeptide
DESEIRTTNPVATEQWGDVSCNEPQNAAGENA

SEQ ID NO: 88236 - protein, 33 aa, Artificial Sequence
  Description of Artificial Sequence: Synthetic polypeptide
DEIEIRTTNPVATECWGSVSCINEPQDREGENG

SEQ ID NO: 88237 - protein, 32 aa, Artificial Sequence
  Description of Artificial Sequence: Synthetic polypeptide
DESEIRTTNPVATEQWGDVSCNEPQNAAGENG

SEQ ID NO: 88238 - protein, 32 aa, Artificial Sequence
  Description of Artificial Sequence: Synthetic polypeptide
DESEIRTTNPVATEQWGDVSENEPQNAAGENA

SEQ ID NO: 88239 - protein, 33 aa, Artificial Sequence
  Description of Artificial Sequence: Synthetic polypeptide
DEIEIRTTNPVATECWGSVSCINECQDREGENG

SEQ ID NO: 88240 - protein, 29 aa, Artificial Sequence
  Description of Artificial Sequence: Synthetic peptide
DESEIRTTNPVATEQWGDVSETEMAAEDI

SEQ ID NO: 88241 - protein, 33 aa, Artificial Sequence
  Description of Artificial Sequence: Synthetic polypeptide
DEIEIRTTNPVATECWGSVSAINEPQDREGENG

SEQ ID NO: 88242 - protein, 30 aa, Artificial Sequence
  Description of Artificial Sequence: Synthetic polypeptide
DESEIRTTNPVATEQWGDVSSTEMNAAGDA

SEQ ID NO: 88243 - protein, 32 aa, Artificial Sequence
  Description of Artificial Sequence: Synthetic polypeptide
DEIEIITTNPVATEQYGSVSATDLEDHEGEDL

SEQ ID NO: 88244 - protein, 32 aa, Artificial Sequence
  Description of Artificial Sequence: Synthetic polypeptide
DEIEIATTNPVATLQYGMVSTRACPQPGNDRE

SEQ ID NO: 88245 - protein, 32 aa, Artificial Sequence
  Description of Artificial Sequence: Synthetic polypeptide
DEIEIATTNPVATEQYGSVSWTDLEDHEGEDL

SEQ ID NO: 88246 - protein, 32 aa, Artificial Sequence
  Description of Artificial Sequence: Synthetic polypeptide
DEIEIATTNPVATEQYGSVSATDLEDHEGEHL

SEQ ID NO: 88247 - protein, 32 aa, Artificial Sequence
  Description of Artificial Sequence: Synthetic polypeptide
DEIEIATTNPVATEQYGSVSATDLEDHEGEDL

SEQ ID NO: 88248 - protein, 33 aa, Artificial Sequence
  Description of Artificial Sequence: Synthetic polypeptide
DESEIRTTNPVATEQWGSMSCINEPQDREGENG

SEQ ID NO: 88249 - protein, 33 aa, Artificial Sequence
  Description of Artificial Sequence: Synthetic polypeptide
DESEIRTTNPVATEQWGSVHCINEPQDREGENG

SEQ ID NO: 88250 - protein, 33 aa, Artificial Sequence
  Description of Artificial Sequence: Synthetic polypeptide
DESEIRTTNPVATEPWGSVSCINEPQFREGENG

SEQ ID NO: 88251 - protein, 35 aa, Artificial Sequence
  Description of Artificial Sequence: Synthetic polypeptide
DEEEIRTTNPVATEQYGSVSTENMMWQEEMGEELA

SEQ ID NO: 88252 - protein, 33 aa, Artificial Sequence
  Description of Artificial Sequence: Synthetic polypeptide
DEHEIRTTNPVAYEQWGSVSTNLQGNGGPQDES

SEQ ID NO: 88253 - protein, 34 aa, Artificial Sequence
  Description of Artificial Sequence: Synthetic polypeptide
DESEIRTTNPVATEQYGSVSATTPAINSRNGNPV

SEQ ID NO: 88254 - protein, 34 aa, Artificial Sequence
  Description of Artificial Sequence: Synthetic polypeptide
DESEIRTTNPVATEQYGSVSCAGNQSQWTGTSNF

SEQ ID NO: 88255 - protein, 34 aa, Artificial Sequence
  Description of Artificial Sequence: Synthetic polypeptide
DESEIRTTNPVATEQYGSVSCINEPQDREGEEDG

SEQ ID NO: 88256 - protein, 34 aa, Artificial Sequence
  Description of Artificial Sequence: Synthetic polypeptide
DESEIRTTNPVATEQYGSVSCINEPQDREGEEDL

SEQ ID NO: 88257 - protein, 32 aa, Artificial Sequence
  Description of Artificial Sequence: Synthetic polypeptide
DCEEIRSTNPVAYEQWGSSTSDNMQRDGGNNR

SEQ ID NO: 88258 - protein, 35 aa, Artificial Sequence
  Description of Artificial Sequence: Synthetic polypeptide
DESEIRTTNPVATEQYGSVSCTGNHSQWTGTKNFA

SEQ ID NO: 88259 - protein, 34 aa, Artificial Sequence
  Description of Artificial Sequence: Synthetic polypeptide
DESEIRTTNPVATEQYGSVSDWNLEDERDEVINQ

SEQ ID NO: 88260 - protein, 34 aa, Artificial Sequence
  Description of Artificial Sequence: Synthetic polypeptide
DESEIRTTNPVATEQYGSVSATPTGPQRNGMDPV

SEQ ID NO: 88261 - protein, 33 aa, Artificial Sequence
  Description of Artificial Sequence: Synthetic polypeptide
DESEIRTTNPVATEQYGSVSNWNLEDEWDEVIR

SEQ ID NO: 88262 - protein, 32 aa, Artificial Sequence
  Description of Artificial Sequence: Synthetic polypeptide
DEDEIATTNPVAYEQYGSVCAPTNLQGHNDND

SEQ ID NO: 88263 - protein, 32 aa, Artificial Sequence
  Description of Artificial Sequence: Synthetic polypeptide
DESEIRTTNPVATEQYGSVSPEDLTAEGMDKN

SEQ ID NO: 88264 - protein, 35 aa, Artificial Sequence
  Description of Artificial Sequence: Synthetic polypeptide
DEEEIRTTNPVATEQYGSVSTELMMWQEFGEEEVF

SEQ ID NO: 88265 - protein, 35 aa, Artificial Sequence
  Description of Artificial Sequence: Synthetic polypeptide
DESEIRTTNPVATEQYGSVSSATAGPNMRNGMNPR

SEQ ID NO: 88266 - protein, 35 aa, Artificial Sequence
  Description of Artificial Sequence: Synthetic polypeptide
DESEIRTTNPVATEQYGSVSSCINEPQDREGMNPV

SEQ ID NO: 88267 - protein, 35 aa, Artificial Sequence
  Description of Artificial Sequence: Synthetic polypeptide
DESEIRTTNPVATEQYGSVSSCINGPQMRNGENPV

SEQ ID NO: 88268 - protein, 36 aa, Artificial Sequence
  Description of Artificial Sequence: Synthetic polypeptide
DESEIRTTNPVATEQYGSVSSTCINGPQMRNGENPV

SEQ ID NO: 88269 - protein, 32 aa, Artificial Sequence
  Description of Artificial Sequence: Synthetic polypeptide
DESEIRTTNPVATEQYGSVSPDLEDIEDNSQI

SEQ ID NO: 88270 - protein, 31 aa, Artificial Sequence
  Description of Artificial Sequence: Synthetic polypeptide
DCEEIRSTNPVAYEQWGSSTSDNMQDRQGNN

SEQ ID NO: 88271 - protein, 31 aa, Artificial Sequence
  Description of Artificial Sequence: Synthetic polypeptide
DCEEIRSTNPVATEQYGAVSTNQIAHNQQKF

SEQ ID NO: 88272 - protein, 33 aa, Artificial Sequence
  Description of Artificial Sequence: Synthetic polypeptide
DESEIRTTNPVATEQYGSVIVGTNTGQGEGGEG

SEQ ID NO: 88273 - protein, 31 aa, Artificial Sequence
  Description of Artificial Sequence: Synthetic polypeptide
DASEEIATTNPVAYEPYGTVATNLQRGGMQQ

SEQ ID NO: 88274 - protein, 33 aa, Artificial Sequence
  Description of Artificial Sequence: Synthetic polypeptide
DEHEIRTTNPVATETYGSVSGENGNHGNGGNGR

SEQ ID NO: 88275 - protein, 33 aa, Artificial Sequence
  Description of Artificial Sequence: Synthetic polypeptide
DEHEIRTTNPVATETWGCVSTNLNRGEGQNGGS

SEQ ID NO: 88276 - protein, 30 aa, Artificial Sequence
  Description of Artificial Sequence: Synthetic polypeptide
DEHEIRTTNPVATETWGAVSYTKSEIQGDR

SEQ ID NO: 88277 - protein, 32 aa, Artificial Sequence
  Description of Artificial Sequence: Synthetic polypeptide
DCDEIRSTNPVAYEQYGSLVSTEMQEVRGQSR

SEQ ID NO: 88278 - protein, 33 aa, Artificial Sequence
  Description of Artificial Sequence: Synthetic polypeptide
DEDEIATTNPVAYEQYGSVATNLQVTPDGNAGN

SEQ ID NO: 88279 - protein, 32 aa, Artificial Sequence
  Description of Artificial Sequence: Synthetic polypeptide
DEDEIATTNPVAYEQYGSVATNNDPTADGNRQ

SEQ ID NO: 88280 - protein, 30 aa, Artificial Sequence
  Description of Artificial Sequence: Synthetic polypeptide
DCEEIRATNPVAYEQWGCSYQSDNLHNGTR

SEQ ID NO: 88281 - protein, 34 aa, Artificial Sequence
  Description of Artificial Sequence: Synthetic polypeptide
DEHEIRTTNPVATEQYGVVCYTQDNGDQGRGDVR

SEQ ID NO: 88282 - protein, 31 aa, Artificial Sequence
  Description of Artificial Sequence: Synthetic polypeptide
DCEEIRATNPVAYEQWGSSTSGDNMQREGNN

SEQ ID NO: 88283 - protein, 31 aa, Artificial Sequence
  Description of Artificial Sequence: Synthetic polypeptide
DCEEIRATNPVAYEQWGSSYYTNDGQRGGNN

SEQ ID NO: 88284 - protein, 31 aa, Artificial Sequence
  Description of Artificial Sequence: Synthetic polypeptide
DCEEIRCTNPVAYEQWGSSTGDTNMQRDGNN

SEQ ID NO: 88285 - protein, 31 aa, Artificial Sequence
  Description of Artificial Sequence: Synthetic polypeptide
DEHEIRTTNPVATEQYGSVSVTPSMETELEE

SEQ ID NO: 88286 - protein, 32 aa, Artificial Sequence
  Description of Artificial Sequence: Synthetic polypeptide
DEDEIATTNPVAYEQYGSVATPNLENNGGERH

SEQ ID NO: 88287 - protein, 32 aa, Artificial Sequence
  Description of Artificial Sequence: Synthetic polypeptide
DEDEIATTNPVAYEQYGSVATPNLENNRGEAD

SEQ ID NO: 88288 - protein, 34 aa, Artificial Sequence
  Description of Artificial Sequence: Synthetic polypeptide
DESEIRTTNPVATEQYGSVFSTHLESPNTGQEDR

SEQ ID NO: 88289 - protein, 34 aa, Artificial Sequence
  Description of Artificial Sequence: Synthetic polypeptide
DEHEIRTTNPVATEQYGSVSVLNDYNQFEGNDEM

SEQ ID NO: 88290 - protein, 35 aa, Artificial Sequence
  Description of Artificial Sequence: Synthetic polypeptide
DESEIRTTNPVATEQYGSVSSTTTGPQMRNGMNPV

SEQ ID NO: 88291 - protein, 33 aa, Artificial Sequence
  Description of Artificial Sequence: Synthetic polypeptide
DEHEIRTTNPVAWEQYGSASNTNNGFEHMGNNR

SEQ ID NO: 88292 - protein, 31 aa, Artificial Sequence
  Description of Artificial Sequence: Synthetic polypeptide
DCEEIRSTNPVAYEQWGSSTSGNDMQRGNDN

SEQ ID NO: 88293 - protein, 31 aa, Artificial Sequence
  Description of Artificial Sequence: Synthetic polypeptide
CEAEIATTNPVAYEQYGSVATNLQTEGGGPS

SEQ ID NO: 88294 - protein, 33 aa, Artificial Sequence
  Description of Artificial Sequence: Synthetic polypeptide
DEEEIRTTNPVATEQYGSVSTEDHQENFMSIQS

SEQ ID NO: 88295 - protein, 34 aa, Artificial Sequence
  Description of Artificial Sequence: Synthetic polypeptide
DESEIRTTNPVATEQYGTVSACINEPQDREGENG

SEQ ID NO: 88296 - protein, 33 aa, Artificial Sequence
  Description of Artificial Sequence: Synthetic polypeptide
DESEIRTTNPVATEQYGTVSACINEPQFEGENG

SEQ ID NO: 88297 - protein, 32 aa, Artificial Sequence
  Description of Artificial Sequence: Synthetic polypeptide
DEDEIATTNPVAYEQYGSVSAGNLDLNNMNPR

SEQ ID NO: 88298 - protein, 33 aa, Artificial Sequence
  Description of Artificial Sequence: Synthetic polypeptide
DESEIRTTNPVATEQYGTVSATDNEVEFEGEND

SEQ ID NO: 88299 - protein, 33 aa, Artificial Sequence
  Description of Artificial Sequence: Synthetic polypeptide
DESEIRTTNPVATEQYGTVSATINEPEFEGEND

SEQ ID NO: 88300 - protein, 35 aa, Artificial Sequence
  Description of Artificial Sequence: Synthetic polypeptide
DEEEIRTTNPVATEQYGSVSTDYVIQETIGGTQRE

SEQ ID NO: 88301 - protein, 33 aa, Artificial Sequence
  Description of Artificial Sequence: Synthetic polypeptide
DESEIRTTNPVATEQYGTVCSATIGPVEREGNG

SEQ ID NO: 88302 - protein, 34 aa, Artificial Sequence
  Description of Artificial Sequence: Synthetic polypeptide
DESEIRTTNPVATEQYGTVSATINEPQDFEGEND

SEQ ID NO: 88303 - protein, 32 aa, Artificial Sequence
  Description of Artificial Sequence: Synthetic polypeptide
DCQEIRTTNPVATEQYGSVSATDLEDHEGEDL

SEQ ID NO: 88304 - protein, 34 aa, Artificial Sequence
  Description of Artificial Sequence: Synthetic polypeptide
DESEIRTTNPVATEQYGTVSATINEPQDFEGENG

SEQ ID NO: 88305 - protein, 33 aa, Artificial Sequence
  Description of Artificial Sequence: Synthetic polypeptide
DDAEIRTTNPVATEQYGCVCSNTNALQGGSDQA

SEQ ID NO: 88306 - protein, 32 aa, Artificial Sequence
  Description of Artificial Sequence: Synthetic polypeptide
DDAEIRTTNPVATEQYGCVCSTNDHQSGSDQQ

SEQ ID NO: 88307 - protein, 32 aa, Artificial Sequence
  Description of Artificial Sequence: Synthetic polypeptide
DEDEIATTNPVAYEQYGSVSANLDENPGENHN

SEQ ID NO: 88308 - protein, 32 aa, Artificial Sequence
  Description of Artificial Sequence: Synthetic polypeptide
DEDEIATTNPVAYEQYGSVSANLQEHGDDAEA

SEQ ID NO: 88309 - protein, 33 aa, Artificial Sequence
  Description of Artificial Sequence: Synthetic polypeptide
DEEEIRTTNPVATEQYGSVSTDVYTQYISQQEP

SEQ ID NO: 88310 - protein, 34 aa, Artificial Sequence
  Description of Artificial Sequence: Synthetic polypeptide
DEEEIRTTNPVATEQYGSVSTDYMTNPEETQNDD

SEQ ID NO: 88311 - protein, 32 aa, Artificial Sequence
  Description of Artificial Sequence: Synthetic polypeptide
DEDEIATTNPVAYEQYGSVSAALQNNGDNTAD

SEQ ID NO: 88312 - protein, 33 aa, Artificial Sequence
  Description of Artificial Sequence: Synthetic polypeptide
DESEIRTTNPVATEQYGTVCSATIGPPEREGNG

SEQ ID NO: 88313 - protein, 32 aa, Artificial Sequence
  Description of Artificial Sequence: Synthetic polypeptide
DEDEIATTNPVAYEQYGSVSAAANLQADPNNN

SEQ ID NO: 88314 - protein, 34 aa, Artificial Sequence
  Description of Artificial Sequence: Synthetic polypeptide
DEEEIRTTNPVATEQYGSVSTEGQPQNVGPEQGD

SEQ ID NO: 88315 - protein, 31 aa, Artificial Sequence
  Description of Artificial Sequence: Synthetic polypeptide
DCEEIRSTNPVAYEQWGSSTSNDNMQRGNNE

SEQ ID NO: 88316 - protein, 34 aa, Artificial Sequence
  Description of Artificial Sequence: Synthetic polypeptide
DESEIRTTNPVATEQYGSVSTPAGPNMRNGMNPI

SEQ ID NO: 88317 - protein, 33 aa, Artificial Sequence
  Description of Artificial Sequence: Synthetic polypeptide
DCEEIRTTNPVATDQWGEVSTNGGQANGGGNHR

SEQ ID NO: 88318 - protein, 35 aa, Artificial Sequence
  Description of Artificial Sequence: Synthetic polypeptide
DEEEIRTTNPVATEQYGSVSTEGDLQFQSINQEFS

SEQ ID NO: 88319 - protein, 35 aa, Artificial Sequence
  Description of Artificial Sequence: Synthetic polypeptide
DESEIRTTNPVATEQYGSVSTTIAGPQMRNGMNPV

SEQ ID NO: 88320 - protein, 34 aa, Artificial Sequence
  Description of Artificial Sequence: Synthetic polypeptide
DEEEIRTTNPVATEQYGSVSTEGDHQPTVNDDNF

SEQ ID NO: 88321 - protein, 33 aa, Artificial Sequence
  Description of Artificial Sequence: Synthetic polypeptide
DEEEIRTTNPVATEQYGSVSTEGDDHADEGIDE

SEQ ID NO: 88322 - protein, 34 aa, Artificial Sequence
  Description of Artificial Sequence: Synthetic polypeptide
DEHEIRTTNPVATEQYGSVSTTNDTEIFLQDHMI

SEQ ID NO: 88323 - protein, 36 aa, Artificial Sequence
  Description of Artificial Sequence: Synthetic polypeptide
DEEEIRTTNPVATEQYGVVSTVVNNLQQGTEAGENQ

SEQ ID NO: 88324 - protein, 34 aa, Artificial Sequence
  Description of Artificial Sequence: Synthetic polypeptide
DCEEIRTTNPVATEQYGSVPSCTNSSGSGGNMTI

SEQ ID NO: 88325 - protein, 34 aa, Artificial Sequence
  Description of Artificial Sequence: Synthetic polypeptide
DESEIRTTNPVATEQYGSVSTTNLEQMEISIDSK

SEQ ID NO: 88326 - protein, 34 aa, Artificial Sequence
  Description of Artificial Sequence: Synthetic polypeptide
DEHEIRTTNPVATEQYGSVSTTGPEQGLGDNGGS

SEQ ID NO: 88327 - protein, 33 aa, Artificial Sequence
  Description of Artificial Sequence: Synthetic polypeptide
DEDEIATTNPVAYEQYGSVCTNLQPTGGDNQDT

SEQ ID NO: 88328 - protein, 32 aa, Artificial Sequence
  Description of Artificial Sequence: Synthetic polypeptide
DCEEIRTTNPVAYEQWGCVNCTNALDQPGTDR

SEQ ID NO: 88329 - protein, 34 aa, Artificial Sequence
  Description of Artificial Sequence: Synthetic polypeptide
DCEEIRTTNPVAYEQYGQSTSCQTNELSQKGGSR

SEQ ID NO: 88330 - protein, 31 aa, Artificial Sequence
  Description of Artificial Sequence: Synthetic polypeptide
DESEIRTTNPVATEQYGSVYDAYDLEGMEND

SEQ ID NO: 88331 - protein, 33 aa, Artificial Sequence
  Description of Artificial Sequence: Synthetic polypeptide
CEAEIRTTNPVATEQYGTMSTNQLTQHGDNHDV

SEQ ID NO: 88332 - protein, 34 aa, Artificial Sequence
  Description of Artificial Sequence: Synthetic polypeptide
DESEIRTTNPVATEQYGSVASAVLTQAVGEDNIQ

SEQ ID NO: 88333 - protein, 32 aa, Artificial Sequence
  Description of Artificial Sequence: Synthetic polypeptide
DEHEIRTTNPVAYDQYGCVNCTPLSQRGGNND

SEQ ID NO: 88334 - protein, 31 aa, Artificial Sequence
  Description of Artificial Sequence: Synthetic polypeptide
DEHEIRTTNPVAYDQYGSVCYTQDDQHGNDE

SEQ ID NO: 88335 - protein, 34 aa, Artificial Sequence
  Description of Artificial Sequence: Synthetic polypeptide
DESEIRTTNPVATEQYGKVSCTGNQSQWTGTKNF

SEQ ID NO: 88336 - protein, 32 aa, Artificial Sequence
  Description of Artificial Sequence: Synthetic polypeptide
DESEIRTTNPVATEQYGLVYMDDNNNQNGERA

SEQ ID NO: 88337 - protein, 33 aa, Artificial Sequence
  Description of Artificial Sequence: Synthetic polypeptide
DEHEIRTTNPVAYEQWGSVSHNLDDDRQNMNLR

SEQ ID NO: 88338 - protein, 32 aa, Artificial Sequence
  Description of Artificial Sequence: Synthetic polypeptide
DEDEIATTNPVAYEQYGSVATNGTPTRNGDER

SEQ ID NO: 88339 - protein, 32 aa, Artificial Sequence
  Description of Artificial Sequence: Synthetic polypeptide
DEHEIRTTNPVAYEQWGSVSGGGNQGAQNGNT

SEQ ID NO: 88340 - protein, 32 aa, Artificial Sequence
  Description of Artificial Sequence: Synthetic polypeptide
DEHEIRTTNPVAYEQWGSVIWFTELQHPDGSR

SEQ ID NO: 88341 - protein, 33 aa, Artificial Sequence
  Description of Artificial Sequence: Synthetic polypeptide
DEHEIRTTNPVAYEQWGSVCSTNDGNQGQGNAG

SEQ ID NO: 88342 - protein, 33 aa, Artificial Sequence
  Description of Artificial Sequence: Synthetic polypeptide
DEHEIRTTNPVAYEQWGSVSHPNLDDRQNMNRG

SEQ ID NO: 88343 - protein, 33 aa, Artificial Sequence
  Description of Artificial Sequence: Synthetic polypeptide
DEHEIRTTNPVAYEQWGSVCSTNDGNMRGDNDT

SEQ ID NO: 88344 - protein, 34 aa, Artificial Sequence
  Description of Artificial Sequence: Synthetic polypeptide
DEHEIRTTNPVAYEQWGSVCSTMDGNHQGGGNVR

SEQ ID NO: 88345 - protein, 33 aa, Artificial Sequence
  Description of Artificial Sequence: Synthetic polypeptide
DEHEIRTTNPVAYEQWGSVCSTDNDGNRGDNST

SEQ ID NO: 88346 - protein, 31 aa, Artificial Sequence
  Description of Artificial Sequence: Synthetic polypeptide
DEHEIRTTNPVAYEQWGSVAWTELQVDDQGR

SEQ ID NO: 88347 - protein, 32 aa, Artificial Sequence
  Description of Artificial Sequence: Synthetic polypeptide
DEDEIATTNPVAYEQYGSVATNLAQDSGGEDG

SEQ ID NO: 88348 - protein, 32 aa, Artificial Sequence
  Description of Artificial Sequence: Synthetic polypeptide
DEDEIATTNPVAYEQYGSVATNLARPQEEGRM

SEQ ID NO: 88349 - protein, 32 aa, Artificial Sequence
  Description of Artificial Sequence: Synthetic polypeptide
DEHEIRTTNPVAYEQWGSVATNLQGNMGDGAD

SEQ ID NO: 88350 - protein, 31 aa, Artificial Sequence
  Description of Artificial Sequence: Synthetic polypeptide
DEDEIATTNPVAYEQYGSVATNLENNGGEDQ

SEQ ID NO: 88351 - protein, 33 aa, Artificial Sequence
  Description of Artificial Sequence: Synthetic polypeptide
DEDEIATTNPVAYEQYGSVATNLADTGGGDNRM

SEQ ID NO: 88352 - protein, 31 aa, Artificial Sequence
  Description of Artificial Sequence: Synthetic polypeptide
DEDEIATTNPVAYEQYGSVATNGTAEGGNEE

SEQ ID NO: 88353 - protein, 32 aa, Artificial Sequence
  Description of Artificial Sequence: Synthetic polypeptide
DEHEIRTTNPVAYEQWGSVSNGGNQQDANNDR

SEQ ID NO: 88354 - protein, 32 aa, Artificial Sequence
  Description of Artificial Sequence: Synthetic polypeptide
DEDEIATTNPVAYEQYGSVATNGQAVQGDNEE

SEQ ID NO: 88355 - protein, 29 aa, Artificial Sequence
  Description of Artificial Sequence: Synthetic peptide
CEDEIACTNPVATEQYGCASANLQAPGQT

SEQ ID NO: 88356 - protein, 31 aa, Artificial Sequence
  Description of Artificial Sequence: Synthetic polypeptide
DEDEIATTNPVAYEQYGSVATADQDRTPNDA

SEQ ID NO: 88357 - protein, 30 aa, Artificial Sequence
  Description of Artificial Sequence: Synthetic polypeptide
DEDEIATTNPVAYEQYGSVATADQGGPSQM

SEQ ID NO: 88358 - protein, 32 aa, Artificial Sequence
  Description of Artificial Sequence: Synthetic polypeptide
DAEEISTTNPVATEPYGSVSCTTDAHHGGNRD

SEQ ID NO: 88359 - protein, 33 aa, Artificial Sequence
  Description of Artificial Sequence: Synthetic polypeptide
DAEEISTTNPVATERYGKTVQSQNLSQNGGNNR

SEQ ID NO: 88360 - protein, 33 aa, Artificial Sequence
  Description of Artificial Sequence: Synthetic polypeptide
DAGEIATTNPVATEQWGSVSATNPLQHQGGMRM

SEQ ID NO: 88361 - protein, 33 aa, Artificial Sequence
  Description of Artificial Sequence: Synthetic polypeptide
DEHEIRTTNPVAYEQWGSVSTNLNMDGGDNGND

SEQ ID NO: 88362 - protein, 31 aa, Artificial Sequence
  Description of Artificial Sequence: Synthetic polypeptide
DEDEIATTNPVAYEQYGSVATHLQDQGGDEH

SEQ ID NO: 88363 - protein, 31 aa, Artificial Sequence
  Description of Artificial Sequence: Synthetic polypeptide
DEDEIATTNPVAYEQYGSVATHLQDSHGDEK

SEQ ID NO: 88364 - protein, 30 aa, Artificial Sequence
  Description of Artificial Sequence: Synthetic polypeptide
DEDEIATTNPVAYEQYGSVATHLQDSIDEM

SEQ ID NO: 88365 - protein, 32 aa, Artificial Sequence
  Description of Artificial Sequence: Synthetic polypeptide
DEDEIATTNPVAYEQYGSVATHLQDSNGNAQL

SEQ ID NO: 88366 - protein, 34 aa, Artificial Sequence
  Description of Artificial Sequence: Synthetic polypeptide
DAGEIATTNPVATEQYGSVSWTDNDLQDTKGDMR

SEQ ID NO: 88367 - protein, 32 aa, Artificial Sequence
  Description of Artificial Sequence: Synthetic polypeptide
DAGEIATTNPVATEQYGSVSWTEDDQDTGGMR

SEQ ID NO: 88368 - protein, 33 aa, Artificial Sequence
  Description of Artificial Sequence: Synthetic polypeptide
DAGEIATTNPVATEQYGSVSWTEGDLQDTGDMR

SEQ ID NO: 88369 - protein, 33 aa, Artificial Sequence
  Description of Artificial Sequence: Synthetic polypeptide
DEHEIRTTNPVAYEQWGSVSTGNLNMGTGDNND

SEQ ID NO: 88370 - protein, 33 aa, Artificial Sequence
  Description of Artificial Sequence: Synthetic polypeptide
DEHEIRTTNPVAYEQWGSVSTGNGNQGNQGNTS

SEQ ID NO: 88371 - protein, 33 aa, Artificial Sequence
  Description of Artificial Sequence: Synthetic polypeptide
DEHEIRTTNPVAYEQWGSVSTGIGLNAGEDDNR

SEQ ID NO: 88372 - protein, 31 aa, Artificial Sequence
  Description of Artificial Sequence: Synthetic polypeptide
DEDEIATTNPVAYEQYGSVATNLENNGQEPE

SEQ ID NO: 88373 - protein, 31 aa, Artificial Sequence
  Description of Artificial Sequence: Synthetic polypeptide
DEHEIRTTNPVAYEQWGSTVTNLGGDGDNEE

SEQ ID NO: 88374 - protein, 31 aa, Artificial Sequence
  Description of Artificial Sequence: Synthetic polypeptide
DEHEIRTTNPVAYEQWGSSTNGGNAGEGNER

SEQ ID NO: 88375 - protein, 33 aa, Artificial Sequence
  Description of Artificial Sequence: Synthetic polypeptide
DEHEIRTTNPVAYEQWGSISHTDNDTQREGGER

SEQ ID NO: 88376 - protein, 32 aa, Artificial Sequence
  Description of Artificial Sequence: Synthetic polypeptide
DEHEIRTTNPVAYECWGSVATTNHGQDGGNSR

SEQ ID NO: 88377 - protein, 33 aa, Artificial Sequence
  Description of Artificial Sequence: Synthetic polypeptide
DESEIRTTNPVATEQYGSCTSPDNLQEGEEDQG

SEQ ID NO: 88378 - protein, 33 aa, Artificial Sequence
  Description of Artificial Sequence: Synthetic polypeptide
DEDEIATTNPVAYEQYGSVATNLQGRPGDETAH

SEQ ID NO: 88379 - protein, 36 aa, Artificial Sequence
  Description of Artificial Sequence: Synthetic polypeptide
DEEEIRTTNPVATEQYGVVSTVTNQLGNQAGTDENE

SEQ ID NO: 88380 - protein, 32 aa, Artificial Sequence
  Description of Artificial Sequence: Synthetic polypeptide
DEHEIRTTNPVAYEAYGSVSQNISFLVGNNRT

SEQ ID NO: 88381 - protein, 31 aa, Artificial Sequence
  Description of Artificial Sequence: Synthetic polypeptide
DEHEIRTTNPVAYEAYGSVSQDISFPVGQNR

SEQ ID NO: 88382 - protein, 32 aa, Artificial Sequence
  Description of Artificial Sequence: Synthetic polypeptide
DEHEIRTTNPVAYEAYGEVSLQNISFRVGNNR

SEQ ID NO: 88383 - protein, 32 aa, Artificial Sequence
  Description of Artificial Sequence: Synthetic polypeptide
DEHEIRTTNPVAYEAWGTVSTTNHGQDGGNER

SEQ ID NO: 88384 - protein, 35 aa, Artificial Sequence
  Description of Artificial Sequence: Synthetic polypeptide
DEEEIRTTNPVATEQYGSVSTENDLMWTTTISNQF

SEQ ID NO: 88385 - protein, 32 aa, Artificial Sequence
  Description of Artificial Sequence: Synthetic polypeptide
DEHEIRTTNPVAYEAWGEVSTNLQHDQGNNEE

SEQ ID NO: 88386 - protein, 32 aa, Artificial Sequence
  Description of Artificial Sequence: Synthetic polypeptide
DEHEIRTTNPVAYEAWGEVSTNLNRGEDDNGS

SEQ ID NO: 88387 - protein, 32 aa, Artificial Sequence
  Description of Artificial Sequence: Synthetic polypeptide
DEHEIRTTNPVAYEAWGEVSTGNLAQGDGNES

SEQ ID NO: 88388 - protein, 30 aa, Artificial Sequence
  Description of Artificial Sequence: Synthetic polypeptide
DEHEIRTTNPVAYEAWGEVATNDQDGDNQE

SEQ ID NO: 88389 - protein, 33 aa, Artificial Sequence
  Description of Artificial Sequence: Synthetic polypeptide
DEHEIRTTNPVAYDQYGSVVNCTPLSQERGGND

SEQ ID NO: 88390 - protein, 35 aa, Artificial Sequence
  Description of Artificial Sequence: Synthetic polypeptide
DESEIRTTNPVATEQYGSTVQSATNELSGGPGNHM

SEQ ID NO: 88391 - protein, 32 aa, Artificial Sequence
  Description of Artificial Sequence: Synthetic polypeptide
DEHEIRTTNPVAYDQYGSVNCTPLSSRTGGND

SEQ ID NO: 88392 - protein, 31 aa, Artificial Sequence
  Description of Artificial Sequence: Synthetic polypeptide
DEHEIRTTNPVAYDQYGSVCYTQDQGHGNSD

SEQ ID NO: 88393 - protein, 32 aa, Artificial Sequence
  Description of Artificial Sequence: Synthetic polypeptide
DEHEIRTTNPVAYECWGSVSTNVNQGNDGNQL

SEQ ID NO: 88394 - protein, 32 aa, Artificial Sequence
  Description of Artificial Sequence: Synthetic polypeptide
DEDEIATTNPVAYEQYGSVANTNLERGMQDEQ

SEQ ID NO: 88395 - protein, 32 aa, Artificial Sequence
  Description of Artificial Sequence: Synthetic polypeptide
DEHEIRTTNPVAYECWGSVSTPNQGGNQGNDR

SEQ ID NO: 88396 - protein, 33 aa, Artificial Sequence
  Description of Artificial Sequence: Synthetic polypeptide
DEHEIRTTNPVAYECWGSVSTTNLGGNDGNNER

SEQ ID NO: 88397 - protein, 32 aa, Artificial Sequence
  Description of Artificial Sequence: Synthetic polypeptide
DEHEIRTTNPVAYEQWGEVSTNLNGDHGNEQH

SEQ ID NO: 88398 - protein, 31 aa, Artificial Sequence
  Description of Artificial Sequence: Synthetic polypeptide
DEHEIRTTNPVAYEQWGCVSTNNPDSGGDER

SEQ ID NO: 88399 - protein, 34 aa, Artificial Sequence
  Description of Artificial Sequence: Synthetic polypeptide
DEHEIRTTNPVAYEPYGSVSTGNLSQTGGGDDRH

SEQ ID NO: 88400 - protein, 32 aa, Artificial Sequence
  Description of Artificial Sequence: Synthetic polypeptide
DEDEIATTNPVAYEQYGSVATNLETGGDEDRP

SEQ ID NO: 88401 - protein, 33 aa, Artificial Sequence
  Description of Artificial Sequence: Synthetic polypeptide
DEHEIRTTNPVAYEKWGTVSTTNLGQQDAGNER

SEQ ID NO: 88402 - protein, 29 aa, Artificial Sequence
  Description of Artificial Sequence: Synthetic peptide
DANEIATTNPCAYEPYGTVSGNLQRENDS

SEQ ID NO: 88403 - protein, 30 aa, Artificial Sequence
  Description of Artificial Sequence: Synthetic polypeptide
DEHEIRTTNPVAYEGWGNVTTNPDGGDNER

SEQ ID NO: 88404 - protein, 32 aa, Artificial Sequence
  Description of Artificial Sequence: Synthetic polypeptide
DEHEIRTTNPVAYEFWGSVATTNQGQDAGNER

SEQ ID NO: 88405 - protein, 32 aa, Artificial Sequence
  Description of Artificial Sequence: Synthetic polypeptide
DEHEIRTTNPVAYEEWGVVSTTNLGGNDGNER

SEQ ID NO: 88406 - protein, 32 aa, Artificial Sequence
  Description of Artificial Sequence: Synthetic polypeptide
DEHEIRTTNPVAYEEWGSVATNLQGDLGNNGS

SEQ ID NO: 88407 - protein, 33 aa, Artificial Sequence
  Description of Artificial Sequence: Synthetic polypeptide
DESEIRTTNPVATEQYGSAQSAFDLQHDGSQRF

SEQ ID NO: 88408 - protein, 34 aa, Artificial Sequence
  Description of Artificial Sequence: Synthetic polypeptide
DANEIATTNPVATEQYGSVSTGNPLQAEMGGMRN

SEQ ID NO: 88409 - protein, 33 aa, Artificial Sequence
  Description of Artificial Sequence: Synthetic polypeptide
DEHEIRTTNPVAYECYGSVSTPNQGGNQGNNER

SEQ ID NO: 88410 - protein, 33 aa, Artificial Sequence
  Description of Artificial Sequence: Synthetic polypeptide
DEHEIRTTNPVAYECWGSVSTTNQHEQDGGNER

SEQ ID NO: 88411 - protein, 33 aa, Artificial Sequence
  Description of Artificial Sequence: Synthetic polypeptide
DEHEIRTTNPVAYECWGSVSTTNQGQDAGDNNR

SEQ ID NO: 88412 - protein, 32 aa, Artificial Sequence
  Description of Artificial Sequence: Synthetic polypeptide
DEHEIRTTNPVAYECWGSVSTTNQGQDAGDGR

SEQ ID NO: 88413 - protein, 32 aa, Artificial Sequence
  Description of Artificial Sequence: Synthetic polypeptide
DEDEIATTNPVAYEQYGSVATNLQEHGGEEAP

SEQ ID NO: 88414 - protein, 32 aa, Artificial Sequence
  Description of Artificial Sequence: Synthetic polypeptide
DEDEIATTNPVAYEQYGSVATNLQGASAAGKD

SEQ ID NO: 88415 - protein, 33 aa, Artificial Sequence
  Description of Artificial Sequence: Synthetic polypeptide
DESEIRTTNPVATEPWGSVSCINEPQDREGENG

SEQ ID NO: 88416 - protein, 33 aa, Artificial Sequence
  Description of Artificial Sequence: Synthetic polypeptide
DESEIRTTNPVATEPWGSVSCANESQDREGENG

SEQ ID NO: 88417 - protein, 32 aa, Artificial Sequence
  Description of Artificial Sequence: Synthetic polypeptide
DESEIRTTNPVATEPWGSISMINIQQQRNGNG

SEQ ID NO: 88418 - protein, 33 aa, Artificial Sequence
  Description of Artificial Sequence: Synthetic polypeptide
DEMEIRTTNPVATECWGSVSCINIPQDREGENG

SEQ ID NO: 88419 - protein, 33 aa, Artificial Sequence
  Description of Artificial Sequence: Synthetic polypeptide
DESEIRTTNPVATECWGSVSVINEPQDRYGENG

SEQ ID NO: 88420 - protein, 33 aa, Artificial Sequence
  Description of Artificial Sequence: Synthetic polypeptide
DESEIRTTNPVATECWGSVSVINTPQDREGENG

SEQ ID NO: 88421 - protein, 33 aa, Artificial Sequence
  Description of Artificial Sequence: Synthetic polypeptide
DESEIRTTNPVATECWGSVSWENENQDREGENL

SEQ ID NO: 88422 - protein, 35 aa, Artificial Sequence
  Description of Artificial Sequence: Synthetic polypeptide
DEEEIRTTNPVATEQYGVVSTTQNLLQGNNQQNDE

SEQ ID NO: 88423 - protein, 33 aa, Artificial Sequence
  Description of Artificial Sequence: Synthetic polypeptide
DESEIRTTNPVATECWGSVSWGNEPQEREGSNA

SEQ ID NO: 88424 - protein, 33 aa, Artificial Sequence
  Description of Artificial Sequence: Synthetic polypeptide
DEMEIRTTNPVATECWGSVSCINEPQDREGENG

SEQ ID NO: 88425 - protein, 33 aa, Artificial Sequence
  Description of Artificial Sequence: Synthetic polypeptide
DESEIRTTNPVATECWGSVSVINEPQDREGENG

SEQ ID NO: 88426 - protein, 33 aa, Artificial Sequence
  Description of Artificial Sequence: Synthetic polypeptide
DESEIRTTNPVATECWGSVSWINEPQDREGENG

SEQ ID NO: 88427 - protein, 33 aa, Artificial Sequence
  Description of Artificial Sequence: Synthetic polypeptide
DESEIRTTNPVATECWGSVSWMNEPQDRSGSNG

SEQ ID NO: 88428 - protein, 33 aa, Artificial Sequence
  Description of Artificial Sequence: Synthetic polypeptide
DESEIRTTNPVATECWGSVSWNNENQDRFGENG

SEQ ID NO: 88429 - protein, 33 aa, Artificial Sequence
  Description of Artificial Sequence: Synthetic polypeptide
DESEIRTTNPVATECWGSVSWVNEPQDREGSNL

SEQ ID NO: 88430 - protein, 33 aa, Artificial Sequence
  Description of Artificial Sequence: Synthetic polypeptide
DESEIRTTNPVATECWGSVSYINEPQDREGENG

SEQ ID NO: 88431 - protein, 31 aa, Artificial Sequence
  Description of Artificial Sequence: Synthetic polypeptide
DEDEIATTNPVAYDQYGKVNCTQLSQRGGND

SEQ ID NO: 88432 - protein, 35 aa, Artificial Sequence
  Description of Artificial Sequence: Synthetic polypeptide
DEEEIRTTNPVATEQYGSVSTLGVLPIINGSNEPT

SEQ ID NO: 88433 - protein, 35 aa, Artificial Sequence
  Description of Artificial Sequence: Synthetic polypeptide
DEEEIRTTNPVATEQYGSVSTLGLELIGGGGNQGE

SEQ ID NO: 88434 - protein, 33 aa, Artificial Sequence
  Description of Artificial Sequence: Synthetic polypeptide
DESEIRTTNPVATECWGSVSWINEPQDRFGSNV

SEQ ID NO: 88435 - protein, 33 aa, Artificial Sequence
  Description of Artificial Sequence: Synthetic polypeptide
DEMEIRTTNPVATECWGSVSWMNEPQDREGSNA

SEQ ID NO: 88436 - protein, 34 aa, Artificial Sequence
  Description of Artificial Sequence: Synthetic polypeptide
DESEIRTTNPVATECWGSVSTTINEPQDRNGMNV

SEQ ID NO: 88437 - protein, 31 aa, Artificial Sequence
  Description of Artificial Sequence: Synthetic polypeptide
DEMEIRTTNPVATECWGTVSTDGEPEREGND

SEQ ID NO: 88438 - protein, 33 aa, Artificial Sequence
  Description of Artificial Sequence: Synthetic polypeptide
DESEIRTTNPVATECWGSVSRINEPQDREGENG

SEQ ID NO: 88439 - protein, 33 aa, Artificial Sequence
  Description of Artificial Sequence: Synthetic polypeptide
DESEIRTTNPVATECWGSVSRINEPQDREGENS

SEQ ID NO: 88440 - protein, 33 aa, Artificial Sequence
  Description of Artificial Sequence: Synthetic polypeptide
DESEIRTTNPVATECWGSVSRINYPQDREGENG

SEQ ID NO: 88441 - protein, 30 aa, Artificial Sequence
  Description of Artificial Sequence: Synthetic polypeptide
DEDEIATTNPVATESYGCIAGTNDQRADNN

SEQ ID NO: 88442 - protein, 30 aa, Artificial Sequence
  Description of Artificial Sequence: Synthetic polypeptide
DEDEIATTNPVATESYGCVANNNLQDAGTD

SEQ ID NO: 88443 - protein, 33 aa, Artificial Sequence
  Description of Artificial Sequence: Synthetic polypeptide
DESEIRTTNPVATECWGSVSSINEPQDREGENG

SEQ ID NO: 88444 - protein, 31 aa, Artificial Sequence
  Description of Artificial Sequence: Synthetic polypeptide
DEMEIRTTNPVATEPYGTISTDDPQQQEGNH

SEQ ID NO: 88445 - protein, 34 aa, Artificial Sequence
  Description of Artificial Sequence: Synthetic polypeptide
DESEIRTTNPVATECWGSVSTCINEPQDREGENG

SEQ ID NO: 88446 - protein, 31 aa, Artificial Sequence
  Description of Artificial Sequence: Synthetic polypeptide
DEMEIRTTNPVATEPYGTISTDDPQEQEGNH

SEQ ID NO: 88447 - protein, 34 aa, Artificial Sequence
  Description of Artificial Sequence: Synthetic polypeptide
DESEIRTTNPVATECWGSVSTCINEPQDRMGENG

SEQ ID NO: 88448 - protein, 34 aa, Artificial Sequence
  Description of Artificial Sequence: Synthetic polypeptide
DESEIRTTNPVATECWGSVSTCINEPQDRNGMNG

SEQ ID NO: 88449 - protein, 33 aa, Artificial Sequence
  Description of Artificial Sequence: Synthetic polypeptide
DEMEIRTTNPVATEHWGSVSWMNENQDREGSNQ

SEQ ID NO: 88450 - protein, 33 aa, Artificial Sequence
  Description of Artificial Sequence: Synthetic polypeptide
DESEIRTTNPVATECWGSVSTINEPEDREGENG

SEQ ID NO: 88451 - protein, 34 aa, Artificial Sequence
  Description of Artificial Sequence: Synthetic polypeptide
DESEIRTTNPVATECWGSVSTINEPQDREGENPG

SEQ ID NO: 88452 - protein, 31 aa, Artificial Sequence
  Description of Artificial Sequence: Synthetic polypeptide
DEMEIRTTNPVATECWGTVSTDGEPEREGNG

SEQ ID NO: 88453 - protein, 34 aa, Artificial Sequence
  Description of Artificial Sequence: Synthetic polypeptide
DESEIRTTNPVATECWGSVSTINEPQVREGENGG

SEQ ID NO: 88454 - protein, 34 aa, Artificial Sequence
  Description of Artificial Sequence: Synthetic polypeptide
DESEIRTTNPVATECWGSVSTINWEPQDREGENG

SEQ ID NO: 88455 - protein, 31 aa, Artificial Sequence
  Description of Artificial Sequence: Synthetic polypeptide
DEMEIRTTNPVATDQYGSVNMQLQGGSIQPD

SEQ ID NO: 88456 - protein, 33 aa, Artificial Sequence
  Description of Artificial Sequence: Synthetic polypeptide
DESEIRTTNPVATECWGSVSRINEPQDREGENE

SEQ ID NO: 88457 - protein, 32 aa, Artificial Sequence
  Description of Artificial Sequence: Synthetic polypeptide
DEMEIRTTNPVATDQYGCVSTWNVLESIGEKP

SEQ ID NO: 88458 - protein, 32 aa, Artificial Sequence
  Description of Artificial Sequence: Synthetic polypeptide
DEMEIRTTNPVATDQYGCVSSVVLERQGNNEK

SEQ ID NO: 88459 - protein, 30 aa, Artificial Sequence
  Description of Artificial Sequence: Synthetic polypeptide
DEMEIRTTNPVATCQYGCVCNTEHQNGSEQ

SEQ ID NO: 88460 - protein, 32 aa, Artificial Sequence
  Description of Artificial Sequence: Synthetic polypeptide
DEDEIATTNPVAYEPYGSVSAANNLTSGNSRD

SEQ ID NO: 88461 - protein, 32 aa, Artificial Sequence
  Description of Artificial Sequence: Synthetic polypeptide
DEMEIRTTNPVATCQYGAVSTNLEVEQLNQPI

SEQ ID NO: 88462 - protein, 31 aa, Artificial Sequence
  Description of Artificial Sequence: Synthetic polypeptide
DESEIRTTNPVATECYGDVSECLQDHEEENL

SEQ ID NO: 88463 - protein, 33 aa, Artificial Sequence
  Description of Artificial Sequence: Synthetic polypeptide
DEEEIRTTNPVATEQYGSVSTHGPTMTESPQRT

SEQ ID NO: 88464 - protein, 32 aa, Artificial Sequence
  Description of Artificial Sequence: Synthetic polypeptide
DEMEIRTTNPVACEQYGSVWQTNNQEIQNKNF

SEQ ID NO: 88465 - protein, 33 aa, Artificial Sequence
  Description of Artificial Sequence: Synthetic polypeptide
DESEIRTTNPVATECYGEVSCINEPQDREGEGR

SEQ ID NO: 88466 - protein, 31 aa, Artificial Sequence
  Description of Artificial Sequence: Synthetic polypeptide
DEMEIRTTNPVATCQYGCVCNTEHQNSGSND

SEQ ID NO: 88467 - protein, 32 aa, Artificial Sequence
  Description of Artificial Sequence: Synthetic polypeptide
DEMEIRCTNPVATEQYGSVSAEDGPVMFEGNR

SEQ ID NO: 88468 - protein, 33 aa, Artificial Sequence
  Description of Artificial Sequence: Synthetic polypeptide
DESEIRTTNPVATECYGNVSCINEPQDRVGENG

SEQ ID NO: 88469 - protein, 34 aa, Artificial Sequence
  Description of Artificial Sequence: Synthetic polypeptide
DEEEIRTTNPVATEQYGSVSTGVGDTGGGQGNEG

SEQ ID NO: 88470 - protein, 34 aa, Artificial Sequence
  Description of Artificial Sequence: Synthetic polypeptide
DEEEIRTTNPVATEQYGSVSTGVGDDEGGQENEL

SEQ ID NO: 88471 - protein, 34 aa, Artificial Sequence
  Description of Artificial Sequence: Synthetic polypeptide
DEEEIRTTNPVATEQYGSVSTGVGDDEGGNENIV

SEQ ID NO: 88472 - protein, 33 aa, Artificial Sequence
  Description of Artificial Sequence: Synthetic polypeptide
DEMEICTTNPVATEQYGTVCSTTDGNLEFEGND

SEQ ID NO: 88473 - protein, 31 aa, Artificial Sequence
  Description of Artificial Sequence: Synthetic polypeptide
DEMEIATVNPVATEQYGTVSATDNPEFEGND

SEQ ID NO: 88474 - protein, 32 aa, Artificial Sequence
  Description of Artificial Sequence: Synthetic polypeptide
DEMEIATTNPVAYERWGSVSTNLQGDHGNGGS

SEQ ID NO: 88475 - protein, 32 aa, Artificial Sequence
  Description of Artificial Sequence: Synthetic polypeptide
DEMEIRCTNPVATEQYGSVSAEDGPVEFEGNR

SEQ ID NO: 88476 - protein, 33 aa, Artificial Sequence
  Description of Artificial Sequence: Synthetic polypeptide
DEMEIRTTNPVATCQYGCVCSTNLNEHFGSNQM

SEQ ID NO: 88477 - protein, 34 aa, Artificial Sequence
  Description of Artificial Sequence: Synthetic polypeptide
DESEIRTTNPVATECWYGSVSNINEPQDREGENG

SEQ ID NO: 88478 - protein, 34 aa, Artificial Sequence
  Description of Artificial Sequence: Synthetic polypeptide
DESEIRTTNPVATECWYGSVSIINEPQDREGENG

SEQ ID NO: 88479 - protein, 31 aa, Artificial Sequence
  Description of Artificial Sequence: Synthetic polypeptide
DEDEIATTNPVAYEKWGEVSTNLQGDLGNGS

SEQ ID NO: 88480 - protein, 34 aa, Artificial Sequence
  Description of Artificial Sequence: Synthetic polypeptide
DEEEIRTTNPVATEQYGSVSTITITDQPTNVNPE

SEQ ID NO: 88481 - protein, 34 aa, Artificial Sequence
  Description of Artificial Sequence: Synthetic polypeptide
DEEEIRTTNPVATEQYGSVSTISDNTDGPMEDRG

SEQ ID NO: 88482 - protein, 34 aa, Artificial Sequence
  Description of Artificial Sequence: Synthetic polypeptide
DEEEIRTTNPVATEQYGSVSTIQLGVAVDPAERE

SEQ ID NO: 88483 - protein, 32 aa, Artificial Sequence
  Description of Artificial Sequence: Synthetic polypeptide
DESEIRTTNPVATECWGTVSCINEPQREGENG

SEQ ID NO: 88484 - protein, 30 aa, Artificial Sequence
  Description of Artificial Sequence: Synthetic polypeptide
DESEIRTTNPVATECWGVMASNEPQDRGNG

SEQ ID NO: 88485 - protein, 31 aa, Artificial Sequence
  Description of Artificial Sequence: Synthetic polypeptide
DESEIRTTNPVATECWGVVACNEPQDREGNG

SEQ ID NO: 88486 - protein, 32 aa, Artificial Sequence
  Description of Artificial Sequence: Synthetic polypeptide
DESEIRTTNPVATECWGVVASINEPQDREGNG

SEQ ID NO: 88487 - protein, 35 aa, Artificial Sequence
  Description of Artificial Sequence: Synthetic polypeptide
DEEEIRTTNPVATEQYGSVSTINKHSDETPMGSRN

SEQ ID NO: 88488 - protein, 32 aa, Artificial Sequence
  Description of Artificial Sequence: Synthetic polypeptide
DEMEIRTTNPVATDQYGCVNTNVLERKGDIPL

SEQ ID NO: 88489 - protein, 32 aa, Artificial Sequence
  Description of Artificial Sequence: Synthetic polypeptide
DESEIRTTNPVATECWGVVSCINEPQDREGNG

SEQ ID NO: 88490 - protein, 32 aa, Artificial Sequence
  Description of Artificial Sequence: Synthetic polypeptide
DEMEIRTTNPVATDQYGCCLSTNVLERIGEKP

SEQ ID NO: 88491 - protein, 34 aa, Artificial Sequence
  Description of Artificial Sequence: Synthetic polypeptide
DEEEIRTTNPVATEQYGSVSTIDPEQDTDGDDPE

SEQ ID NO: 88492 - protein, 34 aa, Artificial Sequence
  Description of Artificial Sequence: Synthetic polypeptide
DESEIRTTNPVATECWWGSVSCTNEPQDREGENG

SEQ ID NO: 88493 - protein, 34 aa, Artificial Sequence
  Description of Artificial Sequence: Synthetic polypeptide
DESEIRTTNPVATECWYGSVSCINEPQDREGENG

SEQ ID NO: 88494 - protein, 34 aa, Artificial Sequence
  Description of Artificial Sequence: Synthetic polypeptide
DESEIRTTNPVATECWYGSVSCINEPQDREGMNG

SEQ ID NO: 88495 - protein, 34 aa, Artificial Sequence
  Description of Artificial Sequence: Synthetic polypeptide
DESEIRTTNPVATECWYGSVSCINPPQDREGENG

SEQ ID NO: 88496 - protein, 34 aa, Artificial Sequence
  Description of Artificial Sequence: Synthetic polypeptide
DEEEIRTTNPVATEQYGSVSTLDGLQAQSSIDET

SEQ ID NO: 88497 - protein, 28 aa, Artificial Sequence
  Description of Artificial Sequence: Synthetic peptide
DEDEIATTNPVATESYGCIAANEQADNF

SEQ ID NO: 88498 - protein, 31 aa, Artificial Sequence
  Description of Artificial Sequence: Synthetic polypeptide
DEMEIRTTNPVATEQWGDVCSATGPMAEGNA

SEQ ID NO: 88499 - protein, 33 aa, Artificial Sequence
  Description of Artificial Sequence: Synthetic polypeptide
DESEIRTTNPVATECWGSVSQLNEPQDREGENG

SEQ ID NO: 88500 - protein, 33 aa, Artificial Sequence
  Description of Artificial Sequence: Synthetic polypeptide
DEMEIRTTNPVATEQYGCTCSTGNLQNSGSDQA

SEQ ID NO: 88501 - protein, 34 aa, Artificial Sequence
  Description of Artificial Sequence: Synthetic polypeptide
DEEEIRTTNPVATEQYGSVSTMDGTGEFTGENED

SEQ ID NO: 88502 - protein, 36 aa, Artificial Sequence
  Description of Artificial Sequence: Synthetic polypeptide
DEEEIRTTNPVATEQYGVVSTTNQQLQQGNNEQGEE

SEQ ID NO: 88503 - protein, 32 aa, Artificial Sequence
  Description of Artificial Sequence: Synthetic polypeptide
DESEIRTTNPVATECWGSVSENEPMDREGENG

SEQ ID NO: 88504 - protein, 32 aa, Artificial Sequence
  Description of Artificial Sequence: Synthetic polypeptide
DESEIRTTNPVATECWGSVSENEPQDREEENA

SEQ ID NO: 88505 - protein, 30 aa, Artificial Sequence
  Description of Artificial Sequence: Synthetic polypeptide
DEMEIRTTNPVATEQYGCISWETQNFGSDQ

SEQ ID NO: 88506 - protein, 31 aa, Artificial Sequence
  Description of Artificial Sequence: Synthetic polypeptide
DEMEIRTTNPVATEQYGCISTYTQNFGSDQF

SEQ ID NO: 88507 - protein, 33 aa, Artificial Sequence
  Description of Artificial Sequence: Synthetic polypeptide
DESEIRTTNPVATECWGSVSEINLPQDREEENG

SEQ ID NO: 88508 - protein, 34 aa, Artificial Sequence
  Description of Artificial Sequence: Synthetic polypeptide
DEEEIRTTNPVATEQYGSVSTMDFTQELEGIGGG

SEQ ID NO: 88509 - protein, 35 aa, Artificial Sequence
  Description of Artificial Sequence: Synthetic polypeptide
DEEEIRTTNPVATEQYGSVSTMDFEQGENGENQGT

SEQ ID NO: 88510 - protein, 33 aa, Artificial Sequence
  Description of Artificial Sequence: Synthetic polypeptide
DESEIRTTNPVATECWGSVSFINEPQDREGENG

SEQ ID NO: 88511 - protein, 33 aa, Artificial Sequence
  Description of Artificial Sequence: Synthetic polypeptide
DESEIRTTNPVATECWGSVSGINDPQDREGENG

SEQ ID NO: 88512 - protein, 33 aa, Artificial Sequence
  Description of Artificial Sequence: Synthetic polypeptide
DESEIRTTNPVATECWGSVSGINEPQDREGDNG

SEQ ID NO: 88513 - protein, 33 aa, Artificial Sequence
  Description of Artificial Sequence: Synthetic polypeptide
DESEIRTTNPVATECWGSVSGINEPQDREGENG

SEQ ID NO: 88514 - protein, 33 aa, Artificial Sequence
  Description of Artificial Sequence: Synthetic polypeptide
DESEIRTTNPVATECWGSVSGINEPQDREGHNG

SEQ ID NO: 88515 - protein, 32 aa, Artificial Sequence
  Description of Artificial Sequence: Synthetic polypeptide
DEMEIRTTNPVATEQYGCISTGNTQHFGSDQA

SEQ ID NO: 88516 - protein, 32 aa, Artificial Sequence
  Description of Artificial Sequence: Synthetic polypeptide
DEMEIRTTNPVATEQYGCISTNTQNFGSDTQA

SEQ ID NO: 88517 - protein, 32 aa, Artificial Sequence
  Description of Artificial Sequence: Synthetic polypeptide
DEMEIRTTNPVATEQYGCTCSTMELQHFGSDQ

SEQ ID NO: 88518 - protein, 33 aa, Artificial Sequence
  Description of Artificial Sequence: Synthetic polypeptide
DEEEIRTTNPVATEQYGSVSTMDIIGYESSFEQ

SEQ ID NO: 88519 - protein, 32 aa, Artificial Sequence
  Description of Artificial Sequence: Synthetic polypeptide
DESEIRTTNPVATECWGSVSEINEQDHEGENG

SEQ ID NO: 88520 - protein, 34 aa, Artificial Sequence
  Description of Artificial Sequence: Synthetic polypeptide
DESEIRTTNPVATECWGSVSCTNAEPQDREGENG

SEQ ID NO: 88521 - protein, 30 aa, Artificial Sequence
  Description of Artificial Sequence: Synthetic polypeptide
DEMEIRTTNPVATEQYGCVCQTALINMSDA

SEQ ID NO: 88522 - protein, 32 aa, Artificial Sequence
  Description of Artificial Sequence: Synthetic polypeptide
DAEEIATTNPVATEQWGSVTSATHLQQGGEGH

SEQ ID NO: 88523 - protein, 34 aa, Artificial Sequence
  Description of Artificial Sequence: Synthetic polypeptide
DESEIRTTNPVATECWGSVSCTNEPQDREGENNG

SEQ ID NO: 88524 - protein, 33 aa, Artificial Sequence
  Description of Artificial Sequence: Synthetic polypeptide
DESEIRTTNPVATECWGSVSCVNEPQDREGENG

SEQ ID NO: 88525 - protein, 32 aa, Artificial Sequence
  Description of Artificial Sequence: Synthetic polypeptide
DAEEIATTNPVATEQWGSVTSMNHLNTRGGTQ

SEQ ID NO: 88526 - protein, 33 aa, Artificial Sequence
  Description of Artificial Sequence: Synthetic polypeptide
DESEIRTTNPVATECWGSVSCWNEPQDREGENG

SEQ ID NO: 88527 - protein, 35 aa, Artificial Sequence
  Description of Artificial Sequence: Synthetic polypeptide
DEEEIRTTNPVATEQYGSVSTMDNLEHDSGQVDMQ

SEQ ID NO: 88528 - protein, 33 aa, Artificial Sequence
  Description of Artificial Sequence: Synthetic polypeptide
DESEIRTTNPVATECWGSVSCWTEPQDREGENG

SEQ ID NO: 88529 - protein, 33 aa, Artificial Sequence
  Description of Artificial Sequence: Synthetic polypeptide
DESEIRTTNPVATECWGSVSCYNEPQDREGENG

SEQ ID NO: 88530 - protein, 35 aa, Artificial Sequence
  Description of Artificial Sequence: Synthetic polypeptide
DEEEIRTTNPVATEQYGSVSTMDNAEHFDSGQNDM

SEQ ID NO: 88531 - protein, 32 aa, Artificial Sequence
  Description of Artificial Sequence: Synthetic polypeptide
DEMEIRTTNPVATEQYGCTCSTPLQHFGSDQS

SEQ ID NO: 88532 - protein, 33 aa, Artificial Sequence
  Description of Artificial Sequence: Synthetic polypeptide
DESEIRTTNPVATECWGSVSDINEPQDREGENG

SEQ ID NO: 88533 - protein, 32 aa, Artificial Sequence
  Description of Artificial Sequence: Synthetic polypeptide
DESEIRTTNPVATECWGSVSECLPQDREEENL

SEQ ID NO: 88534 - protein, 31 aa, Artificial Sequence
  Description of Artificial Sequence: Synthetic polypeptide
DESEIRTTNPVATECWGSVSEIEQNRAGEDA

SEQ ID NO: 88535 - protein, 31 aa, Artificial Sequence
  Description of Artificial Sequence: Synthetic polypeptide
DAEEIATTNPVATEQWGSVTSTGLDIGGTGM

SEQ ID NO: 88536 - protein, 33 aa, Artificial Sequence
  Description of Artificial Sequence: Synthetic polypeptide
DESEIRTTNPVATECWGSVSEINEPQDREGENG

SEQ ID NO: 88537 - protein, 33 aa, Artificial Sequence
  Description of Artificial Sequence: Synthetic polypeptide
DESEIRTTNPVATECWGSVSHINDVQDREGENG

SEQ ID NO: 88538 - protein, 33 aa, Artificial Sequence
  Description of Artificial Sequence: Synthetic polypeptide
DESEIRTTNPVATECWGSVSHINEKQDRKGENG

SEQ ID NO: 88539 - protein, 33 aa, Artificial Sequence
  Description of Artificial Sequence: Synthetic polypeptide
DESEIRTTNPVATECWGSVSHINEPQDREGENG

SEQ ID NO: 88540 - protein, 32 aa, Artificial Sequence
  Description of Artificial Sequence: Synthetic polypeptide
DEDEIATTNPVATEQYGSVCATNNLQEADTDG

SEQ ID NO: 88541 - protein, 32 aa, Artificial Sequence
  Description of Artificial Sequence: Synthetic polypeptide
DEDEIATTNPVATEQYGSVSATDLCDHEGEDL

SEQ ID NO: 88542 - protein, 32 aa, Artificial Sequence
  Description of Artificial Sequence: Synthetic polypeptide
DEDEIATTNPVATEQYGSVSATDLEDHEGEDL

SEQ ID NO: 88543 - protein, 32 aa, Artificial Sequence
  Description of Artificial Sequence: Synthetic polypeptide
DEDEIATTNPVATEQYGSVSATDLEDHEGMDL

SEQ ID NO: 88544 - protein, 32 aa, Artificial Sequence
  Description of Artificial Sequence: Synthetic polypeptide
DEDEIATTNPVATEQYGSVSATDLEDHVGEDL

SEQ ID NO: 88545 - protein, 33 aa, Artificial Sequence
  Description of Artificial Sequence: Synthetic polypeptide
DESEIRTTNPVATECWGSVSNINEPQDREGENG

SEQ ID NO: 88546 - protein, 33 aa, Artificial Sequence
  Description of Artificial Sequence: Synthetic polypeptide
DEMEIRTTNPVATEQWGSVSCIGPVQDREGENG

SEQ ID NO: 88547 - protein, 33 aa, Artificial Sequence
  Description of Artificial Sequence: Synthetic polypeptide
DESEIRTTNPVATECWGSVSNINEPQIREGENG

SEQ ID NO: 88548 - protein, 33 aa, Artificial Sequence
  Description of Artificial Sequence: Synthetic polypeptide
DESEIRTTNPVATECWGSVSNINEPQTREGENG

SEQ ID NO: 88549 - protein, 33 aa, Artificial Sequence
  Description of Artificial Sequence: Synthetic polypeptide
DESEIRTTNPVATECWGSVSNINETQDREGENG

SEQ ID NO: 88550 - protein, 34 aa, Artificial Sequence
  Description of Artificial Sequence: Synthetic polypeptide
DEMEIRTTNPVATEQWGSVCSCINEPQDREGENG

SEQ ID NO: 88551 - protein, 29 aa, Artificial Sequence
  Description of Artificial Sequence: Synthetic peptide
DEMEIRTTNPVATEQWGDVSTGPEFAEDA

SEQ ID NO: 88552 - protein, 33 aa, Artificial Sequence
  Description of Artificial Sequence: Synthetic polypeptide
DESEIRTTNPVATECWGSVSPINEPQDREGENG

SEQ ID NO: 88553 - protein, 33 aa, Artificial Sequence
  Description of Artificial Sequence: Synthetic polypeptide
DESEIRTTNPVATECWGSVSPINEWQDREGENG

SEQ ID NO: 88554 - protein, 30 aa, Artificial Sequence
  Description of Artificial Sequence: Synthetic polypeptide
DEMEIRTTNPVATEQWGDVCSEIEEAEGND

SEQ ID NO: 88555 - protein, 33 aa, Artificial Sequence
  Description of Artificial Sequence: Synthetic polypeptide
DESEIRTTNPVATECWGSVSQINEPQDREGENG

SEQ ID NO: 88556 - protein, 33 aa, Artificial Sequence
  Description of Artificial Sequence: Synthetic polypeptide
DESEIRTTNPVATECWGSVSQINEPQDREGING

SEQ ID NO: 88557 - protein, 33 aa, Artificial Sequence
  Description of Artificial Sequence: Synthetic polypeptide
DESEIRTTNPVATECWGSVSQINSPQDREGENG

SEQ ID NO: 88558 - protein, 33 aa, Artificial Sequence
  Description of Artificial Sequence: Synthetic polypeptide
DEDEIATTNPVATEQYGSVSATDELEDHEGENL

SEQ ID NO: 88559 - protein, 31 aa, Artificial Sequence
  Description of Artificial Sequence: Synthetic polypeptide
DEMEIATTNPVAYERWGSVSTNLGGADNDSR

SEQ ID NO: 88560 - protein, 33 aa, Artificial Sequence
  Description of Artificial Sequence: Synthetic polypeptide
DESEIRTTNPVATECWGSVSNFNEPQDREGENG

SEQ ID NO: 88561 - protein, 33 aa, Artificial Sequence
  Description of Artificial Sequence: Synthetic polypeptide
DESEIRTTNPVATECWGSVSMINIPQDREGENG

SEQ ID NO: 88562 - protein, 33 aa, Artificial Sequence
  Description of Artificial Sequence: Synthetic polypeptide
DEDEIATTNPVATEQYGSVCATNNLQEAGTDDH

SEQ ID NO: 88563 - protein, 32 aa, Artificial Sequence
  Description of Artificial Sequence: Synthetic polypeptide
DEDEIATTNPVATEQYGSVCATNNPQDSGPQH

SEQ ID NO: 88564 - protein, 33 aa, Artificial Sequence
  Description of Artificial Sequence: Synthetic polypeptide
DESEIRTTNPVATECWGSVSIINEPQAREGENG

SEQ ID NO: 88565 - protein, 33 aa, Artificial Sequence
  Description of Artificial Sequence: Synthetic polypeptide
DESEIRTTNPVATECWGSVSIINEPQDREGENG

SEQ ID NO: 88566 - protein, 33 aa, Artificial Sequence
  Description of Artificial Sequence: Synthetic polypeptide
DESEIRTTNPVATECWGSVSIINEPQDREGENN

SEQ ID NO: 88567 - protein, 33 aa, Artificial Sequence
  Description of Artificial Sequence: Synthetic polypeptide
DESEIRTTNPVATECWGSVSIINEPQDREGGNG

SEQ ID NO: 88568 - protein, 33 aa, Artificial Sequence
  Description of Artificial Sequence: Synthetic polypeptide
DEDEIATTNPVATEQYGSVCATNPLQDAGVPDQ

SEQ ID NO: 88569 - protein, 31 aa, Artificial Sequence
  Description of Artificial Sequence: Synthetic polypeptide
DEMEIRTTNPVATEQYGCICSWNTQAFGSDQ

SEQ ID NO: 88570 - protein, 34 aa, Artificial Sequence
  Description of Artificial Sequence: Synthetic polypeptide
DEEEIRTTNPVATEQYGSVSTLPDESGQSNNNGD

SEQ ID NO: 88571 - protein, 33 aa, Artificial Sequence
  Description of Artificial Sequence: Synthetic polypeptide
DESEIRTTNPVATECWGSVSKINEPQDREGENG

SEQ ID NO: 88572 - protein, 32 aa, Artificial Sequence
  Description of Artificial Sequence: Synthetic polypeptide
DEDEIATTNPVATEQYGSVCATNTPQDGPDQH

SEQ ID NO: 88573 - protein, 33 aa, Artificial Sequence
  Description of Artificial Sequence: Synthetic polypeptide
DESEIRTTNPVATECWGSVSLINEPQDREGENG

SEQ ID NO: 88574 - protein, 32 aa, Artificial Sequence
  Description of Artificial Sequence: Synthetic polypeptide
DEMEIRTTNPVATEQYGCICSTETQNFGSQNQ

SEQ ID NO: 88575 - protein, 33 aa, Artificial Sequence
  Description of Artificial Sequence: Synthetic polypeptide
DESEIRTTNPVATECWGSVSMENEPQQREGENG

SEQ ID NO: 88576 - protein, 33 aa, Artificial Sequence
  Description of Artificial Sequence: Synthetic polypeptide
DESEIRTTNPVATECWGSVSMENEPQQREGENH

SEQ ID NO: 88577 - protein, 33 aa, Artificial Sequence
  Description of Artificial Sequence: Synthetic polypeptide
DESEIRTTNPVATECWGSVSMENEQQQRNGENG

SEQ ID NO: 88578 - protein, 33 aa, Artificial Sequence
  Description of Artificial Sequence: Synthetic polypeptide
DESEIRTTNPVATECWGSVSMINEPQDREGENG

SEQ ID NO: 88579 - protein, 33 aa, Artificial Sequence
  Description of Artificial Sequence: Synthetic polypeptide
DESEIRTTNPVATECWGSVSMINIQQDREGENG

SEQ ID NO: 88580 - protein, 32 aa, Artificial Sequence
  Description of Artificial Sequence: Synthetic polypeptide
DEMEIATTNPVATTQWGCVSRTNDLERGGNEP

SEQ ID NO: 88581 - protein, 31 aa, Artificial Sequence
  Description of Artificial Sequence: Synthetic polypeptide
DEMEIATTNPVATQQWGCVSTNLEGGDGNGP

SEQ ID NO: 88582 - protein, 32 aa, Artificial Sequence
  Description of Artificial Sequence: Synthetic polypeptide
DEMEIATTNPVATQQWGCVSTNDGEQRDGNVP

SEQ ID NO: 88583 - protein, 32 aa, Artificial Sequence
  Description of Artificial Sequence: Synthetic polypeptide
DEMEIATTNPVATCQYGCVSTEALQNFGSNQA

SEQ ID NO: 88584 - protein, 32 aa, Artificial Sequence
  Description of Artificial Sequence: Synthetic polypeptide
DEDEIATTNPVAYEQWGSVSTNLNAGDAGNAE

SEQ ID NO: 88585 - protein, 36 aa, Artificial Sequence
  Description of Artificial Sequence: Synthetic polypeptide
DEEEIRTTNPVATEQYGVVSTVNLQAGNQQGNQTTD

SEQ ID NO: 88586 - protein, 32 aa, Artificial Sequence
  Description of Artificial Sequence: Synthetic polypeptide
DESEIRTTNPVATEGWGVVSCINEPQDRGENI

SEQ ID NO: 88587 - protein, 36 aa, Artificial Sequence
  Description of Artificial Sequence: Synthetic polypeptide
DEEEIRTTNPVATEQYGVVSTVNLQAGNQQNTEEEE

SEQ ID NO: 88588 - protein, 32 aa, Artificial Sequence
  Description of Artificial Sequence: Synthetic polypeptide
DEDEIATTNPVAYEQWGSVSTNLNMEGEGNND

SEQ ID NO: 88589 - protein, 32 aa, Artificial Sequence
  Description of Artificial Sequence: Synthetic polypeptide
DEMEIATTNPCSTEQYGIVCSATDGLQSEGNR

SEQ ID NO: 88590 - protein, 36 aa, Artificial Sequence
  Description of Artificial Sequence: Synthetic polypeptide
DEEEIRTTNPVATEQYGVVSTVNLQAGNQAGNDEED

SEQ ID NO: 88591 - protein, 32 aa, Artificial Sequence
  Description of Artificial Sequence: Synthetic polypeptide
DEDEIATTNPVAYEQWGSVSTNLQGQDSQGGS

SEQ ID NO: 88592 - protein, 29 aa, Artificial Sequence
  Description of Artificial Sequence: Synthetic peptide
DEMEIATTNPCASEQYGIVSCNPVQSGTD

SEQ ID NO: 88593 - protein, 32 aa, Artificial Sequence
  Description of Artificial Sequence: Synthetic polypeptide
DESEIRTTNPVATEGWGVVSSINEPQDRGENI

SEQ ID NO: 88594 - protein, 32 aa, Artificial Sequence
  Description of Artificial Sequence: Synthetic polypeptide
DESEIRTTNPVATEGWGVVSSINLPQDRGEDI

SEQ ID NO: 88595 - protein, 32 aa, Artificial Sequence
  Description of Artificial Sequence: Synthetic polypeptide
DESEIRTTNPVATEGYGNVSCITEQSRVGEQR

SEQ ID NO: 88596 - protein, 32 aa, Artificial Sequence
  Description of Artificial Sequence: Synthetic polypeptide
DESEIRTTNPVATEGYGNVSCITIQSRVGEQR

SEQ ID NO: 88597 - protein, 32 aa, Artificial Sequence
  Description of Artificial Sequence: Synthetic polypeptide
DEDEIATTNPVAYEQWGSVTTTNHGEQGGQNR

SEQ ID NO: 88598 - protein, 29 aa, Artificial Sequence
  Description of Artificial Sequence: Synthetic peptide
DEMEIASVNPVATEQYGTVSDDNPESGNQ

SEQ ID NO: 88599 - protein, 32 aa, Artificial Sequence
  Description of Artificial Sequence: Synthetic polypeptide
DEDEIATTNPVAYEQWGSVSTTNGDGFGGENR

SEQ ID NO: 88600 - protein, 32 aa, Artificial Sequence
  Description of Artificial Sequence: Synthetic polypeptide
DEDEIATTNPVAYEQWGSVSTADGNGNHGGNR

SEQ ID NO: 88601 - protein, 32 aa, Artificial Sequence
  Description of Artificial Sequence: Synthetic polypeptide
DESEIRTTNPVATEGWGVVSCINEPQDRGENG

SEQ ID NO: 88602 - protein, 35 aa, Artificial Sequence
  Description of Artificial Sequence: Synthetic polypeptide
DEEEIRTTNPVATEQYGSVSTGNGGGDGEGNENAA

SEQ ID NO: 88603 - protein, 31 aa, Artificial Sequence
  Description of Artificial Sequence: Synthetic polypeptide
DEMEIATTNPVATEQYGSVSATDDPEHEGED

SEQ ID NO: 88604 - protein, 32 aa, Artificial Sequence
  Description of Artificial Sequence: Synthetic polypeptide
DEMEIATTNPVATEQYGSVCSATGLEHEGEDL

SEQ ID NO: 88605 - protein, 33 aa, Artificial Sequence
  Description of Artificial Sequence: Synthetic polypeptide
DEMEIATTNPVATEQYGSVCSATDGLVEHEGNL

SEQ ID NO: 88606 - protein, 33 aa, Artificial Sequence
  Description of Artificial Sequence: Synthetic polypeptide
DESEIRTTNPVATEGWGSVSCINEQQDRKGENG

SEQ ID NO: 88607 - protein, 33 aa, Artificial Sequence
  Description of Artificial Sequence: Synthetic polypeptide
DEMEIATTNPVATEQYGSVCSATDGLEHEGNDL

SEQ ID NO: 88608 - protein, 33 aa, Artificial Sequence
  Description of Artificial Sequence: Synthetic polypeptide
DESEIRTTNPVATEGWGSVSCMNEEQDREGSNA

SEQ ID NO: 88609 - protein, 32 aa, Artificial Sequence
  Description of Artificial Sequence: Synthetic polypeptide
DESEIRTTNPVATEGWGSVSNITEQDREGENG

SEQ ID NO: 88610 - protein, 33 aa, Artificial Sequence
  Description of Artificial Sequence: Synthetic polypeptide
DESEIRTTNPVATEGWGSVSWINESQDREGENQ

SEQ ID NO: 88611 - protein, 33 aa, Artificial Sequence
  Description of Artificial Sequence: Synthetic polypeptide
DEMEIATTNPVATEQYGEVCSATDGPVQREGND

SEQ ID NO: 88612 - protein, 33 aa, Artificial Sequence
  Description of Artificial Sequence: Synthetic polypeptide
DESEIRTTNPVATEGWGSVSWMNEDQDREGSNG

SEQ ID NO: 88613 - protein, 33 aa, Artificial Sequence
  Description of Artificial Sequence: Synthetic polypeptide
DESEIRTTNPVATEGWGSVSWMNENQERFGSNQ

SEQ ID NO: 88614 - protein, 33 aa, Artificial Sequence
  Description of Artificial Sequence: Synthetic polypeptide
DESEIRTTNPVATEGWGSVSWMNEPQEREGENQ

SEQ ID NO: 88615 - protein, 31 aa, Artificial Sequence
  Description of Artificial Sequence: Synthetic polypeptide
DEMEIATTNPVATEQYGDVCSTGLVQFEEEL

SEQ ID NO: 88616 - protein, 33 aa, Artificial Sequence
  Description of Artificial Sequence: Synthetic polypeptide
DEDEIATTNPVAYEQWGSVSNTNGGQQDNGNVR

SEQ ID NO: 88617 - protein, 35 aa, Artificial Sequence
  Description of Artificial Sequence: Synthetic polypeptide
DEEEIRTTNPVATEQYGSVSTGNGGGDGEQGNEAE

SEQ ID NO: 88618 - protein, 32 aa, Artificial Sequence
  Description of Artificial Sequence: Synthetic polypeptide
DEAEIATTNPVATEQYGSVATNLETEPGGEVK

SEQ ID NO: 88619 - protein, 28 aa, Artificial Sequence
  Description of Artificial Sequence: Synthetic peptide
DEMEIATTNPVATECYGTVSEGPEFGEL

SEQ ID NO: 88620 - protein, 29 aa, Artificial Sequence
  Description of Artificial Sequence: Synthetic peptide
DEMEIASVNPVATEQYGTVSDDNPEFGNQ

SEQ ID NO: 88621 - protein, 30 aa, Artificial Sequence
  Description of Artificial Sequence: Synthetic polypeptide
DEMEIASVNPVATEQYGTVSATDNPEFGNQ

SEQ ID NO: 88622 - protein, 33 aa, Artificial Sequence
  Description of Artificial Sequence: Synthetic polypeptide
DESEIRTTNPVATEHWGSVSCINEFQDREGENG

SEQ ID NO: 88623 - protein, 33 aa, Artificial Sequence
  Description of Artificial Sequence: Synthetic polypeptide
DESEIRTTNPVATEHWGSVSCINEPQCREGENG

SEQ ID NO: 88624 - protein, 33 aa, Artificial Sequence
  Description of Artificial Sequence: Synthetic polypeptide
DESEIRTTNPVATEKWGSVSCINEPQDREGENG

SEQ ID NO: 88625 - protein, 33 aa, Artificial Sequence
  Description of Artificial Sequence: Synthetic polypeptide
DESEIRTTNPVATELWGSVSAINEPQEREGENG

SEQ ID NO: 88626 - protein, 33 aa, Artificial Sequence
  Description of Artificial Sequence: Synthetic polypeptide
DESEIRTTNPVATELWGSVSCINEPQDREGENG

SEQ ID NO: 88627 - protein, 35 aa, Artificial Sequence
  Description of Artificial Sequence: Synthetic polypeptide
DELEIVTTNPVATEAYGSVSCTNMLSHRTDGNNRD

SEQ ID NO: 88628 - protein, 36 aa, Artificial Sequence
  Description of Artificial Sequence: Synthetic polypeptide
DEEEIRTTNPVATEQYGVVSTVNLQQGNQQNEEETE

SEQ ID NO: 88629 - protein, 33 aa, Artificial Sequence
  Description of Artificial Sequence: Synthetic polypeptide
DESEIRTTNPVATELWGSVSCINEPQPREGENG

SEQ ID NO: 88630 - protein, 35 aa, Artificial Sequence
  Description of Artificial Sequence: Synthetic polypeptide
DELEISTTNPVATEAYGSVSCTNMLSHRTSGNLRD

SEQ ID NO: 88631 - protein, 33 aa, Artificial Sequence
  Description of Artificial Sequence: Synthetic polypeptide
DESEIRTTNPVATELWGSVSCINKPQDREGENG

SEQ ID NO: 88632 - protein, 33 aa, Artificial Sequence
  Description of Artificial Sequence: Synthetic polypeptide
DESEIRTTNPVATEMWGSVSCDNEPQDRVGENG

SEQ ID NO: 88633 - protein, 33 aa, Artificial Sequence
  Description of Artificial Sequence: Synthetic polypeptide
DESEIRTTNPVATEMWGSVSCINECQDREGENG

SEQ ID NO: 88634 - protein, 32 aa, Artificial Sequence
  Description of Artificial Sequence: Synthetic polypeptide
DAEEIATTNPVATEYWGTVVSEDNLLQTGNQR

SEQ ID NO: 88635 - protein, 33 aa, Artificial Sequence
  Description of Artificial Sequence: Synthetic polypeptide
DESEIRTTNPVATEMWGSVSCINEPQDREGENG

SEQ ID NO: 88636 - protein, 33 aa, Artificial Sequence
  Description of Artificial Sequence: Synthetic polypeptide
DESEIRTTNPVATEMWGSVSCINEPQDRTGANG

SEQ ID NO: 88637 - protein, 30 aa, Artificial Sequence
  Description of Artificial Sequence: Synthetic polypeptide
DEDEIATTNPVAYEQWGTVAIANLDRGNEH

SEQ ID NO: 88638 - protein, 33 aa, Artificial Sequence
  Description of Artificial Sequence: Synthetic polypeptide
DESEIRTTNPVATEMWGSVSVINEPQDRGGENG

SEQ ID NO: 88639 - protein, 34 aa, Artificial Sequence
  Description of Artificial Sequence: Synthetic polypeptide
DESEIRTTNPVATEMYGSTVSQNAFSQNRLGDNT

SEQ ID NO: 88640 - protein, 33 aa, Artificial Sequence
  Description of Artificial Sequence: Synthetic polypeptide
DESEIRTTNPVATENWGSVSCINEPQDREGENG

SEQ ID NO: 88641 - protein, 33 aa, Artificial Sequence
  Description of Artificial Sequence: Synthetic polypeptide
DESEIRTTNPVATEKWGSVSCINEPQDREGDNG

SEQ ID NO: 88642 - protein, 33 aa, Artificial Sequence
  Description of Artificial Sequence: Synthetic polypeptide
DESEIRTTNPVATEGWGSVSCINEPQDREGENG

SEQ ID NO: 88643 - protein, 31 aa, Artificial Sequence
  Description of Artificial Sequence: Synthetic polypeptide
DEMAIRTTNPVATEQYGCFCSTNHIHGSNQM

SEQ ID NO: 88644 - protein, 33 aa, Artificial Sequence
  Description of Artificial Sequence: Synthetic polypeptide
DESEIRTTNPVATEIYGSVCSNWNDGQERDGTE

SEQ ID NO: 88645 - protein, 33 aa, Artificial Sequence
  Description of Artificial Sequence: Synthetic polypeptide
DESEIRTTNPVATEHWGSVSCINEPQDREGENG

SEQ ID NO: 88646 - protein, 29 aa, Artificial Sequence
  Description of Artificial Sequence: Synthetic peptide
DEMEIASTNPVCTEQYGTVCSTGPESGNQ

SEQ ID NO: 88647 - protein, 33 aa, Artificial Sequence
  Description of Artificial Sequence: Synthetic polypeptide
DESEIRTTNPVATEHWGSVSCWNEPQDREGENG

SEQ ID NO: 88648 - protein, 29 aa, Artificial Sequence
  Description of Artificial Sequence: Synthetic peptide
DEMEIASTNPVCTEQYGTVCSDNPESGNQ

SEQ ID NO: 88649 - protein, 33 aa, Artificial Sequence
  Description of Artificial Sequence: Synthetic polypeptide
DESEIRTTNPVATEIWGSVSCINEPQDREGENG

SEQ ID NO: 88650 - protein, 33 aa, Artificial Sequence
  Description of Artificial Sequence: Synthetic polypeptide
DESEIRTTNPVATEIWGSVSCINETQEREGENG

SEQ ID NO: 88651 - protein, 33 aa, Artificial Sequence
  Description of Artificial Sequence: Synthetic polypeptide
DESEIRTTNPVATEIWGSVSCINNYQDREGENG

SEQ ID NO: 88652 - protein, 33 aa, Artificial Sequence
  Description of Artificial Sequence: Synthetic polypeptide
DESEIRTTNPVATEIWGSVSDINEPQLREGENG

SEQ ID NO: 88653 - protein, 31 aa, Artificial Sequence
  Description of Artificial Sequence: Synthetic polypeptide
DEMEIAPTNPVASEQYGTVCSTNLVQFEGTD

SEQ ID NO: 88654 - protein, 33 aa, Artificial Sequence
  Description of Artificial Sequence: Synthetic polypeptide
DESEIRTTNPVATEIWGSVSQINEQQIREGENG

SEQ ID NO: 88655 - protein, 33 aa, Artificial Sequence
  Description of Artificial Sequence: Synthetic polypeptide
DESEIRTTNPVATEIWGSVSVINEPQDREGTNG

SEQ ID NO: 88656 - protein, 30 aa, Artificial Sequence
  Description of Artificial Sequence: Synthetic polypeptide
DEMEIAPTNPCASEQYGTVSCDNLVQSGTR

SEQ ID NO: 88657 - protein, 36 aa, Artificial Sequence
  Description of Artificial Sequence: Synthetic polypeptide
DEEEIRTTNPVATEQYGVVSTVNLQQGNNQNQEEAE

SEQ ID NO: 88658 - protein, 33 aa, Artificial Sequence
  Description of Artificial Sequence: Synthetic polypeptide
DESEIRTTNPVATEIYGSVCCNENLQRDGMTQM

SEQ ID NO: 88659 - protein, 31 aa, Artificial Sequence
  Description of Artificial Sequence: Synthetic polypeptide
DEMCIRTTNPVAWEQYGTQVCTINVQGGNNV

SEQ ID NO: 88660 - protein, 33 aa, Artificial Sequence
  Description of Artificial Sequence: Synthetic polypeptide
DESEIRTTNPVATEIYGSVCSNWNDGQDRGGEE

SEQ ID NO: 88661 - protein, 36 aa, Artificial Sequence
  Description of Artificial Sequence: Synthetic polypeptide
DEEEIRTTNPVATEQYGVVSTVNLQQGNQNNTDEDE

SEQ ID NO: 88662 - protein, 33 aa, Artificial Sequence
  Description of Artificial Sequence: Synthetic polypeptide
DESEIRTTNPVATEKMGSVSCINEPQDREGENG

SEQ ID NO: 88663 - protein, 33 aa, Artificial Sequence
  Description of Artificial Sequence: Synthetic polypeptide
DEDEIATTNPVAYEQYGSVSANLQPREQMGGVE

SEQ ID NO: 88664 - protein, 33 aa, Artificial Sequence
  Description of Artificial Sequence: Synthetic polypeptide
DESEIRTTNPVATEGWGSVSCINEPQDRAGENG

SEQ ID NO: 88665 - protein, 33 aa, Artificial Sequence
  Description of Artificial Sequence: Synthetic polypeptide
DESEIRTTNPVATEGWGSVACINLPQDREGENG

SEQ ID NO: 88666 - protein, 33 aa, Artificial Sequence
  Description of Artificial Sequence: Synthetic polypeptide
DESEIRTTNPVATECYGSVSCINEPQQQEGENG

SEQ ID NO: 88667 - protein, 33 aa, Artificial Sequence
  Description of Artificial Sequence: Synthetic polypeptide
DESEIRTTNPVATECYGSVSCINEPQQQEGENH

SEQ ID NO: 88668 - protein, 32 aa, Artificial Sequence
  Description of Artificial Sequence: Synthetic polypeptide
DEMEIATTNPVATEQYGTVCSCDNPVQSEGND

SEQ ID NO: 88669 - protein, 31 aa, Artificial Sequence
  Description of Artificial Sequence: Synthetic polypeptide
DEMEIATTNPVATEQYGTVCSATGPEFEGND

SEQ ID NO: 88670 - protein, 32 aa, Artificial Sequence
  Description of Artificial Sequence: Synthetic polypeptide
DEMEIATTNPVATEQYGTVCSATDNPVEFGND

SEQ ID NO: 88671 - protein, 34 aa, Artificial Sequence
  Description of Artificial Sequence: Synthetic polypeptide
DESEIRTTNPVATECYGSVSCINGPQDRNGMNPG

SEQ ID NO: 88672 - protein, 32 aa, Artificial Sequence
  Description of Artificial Sequence: Synthetic polypeptide
DEMEIATTNPVATEQYGTVCSATDLEDHEGND

SEQ ID NO: 88673 - protein, 32 aa, Artificial Sequence
  Description of Artificial Sequence: Synthetic polypeptide
DEMEIATTNPVATEQYGTVCSDDGLVQFEGND

SEQ ID NO: 88674 - protein, 32 aa, Artificial Sequence
  Description of Artificial Sequence: Synthetic polypeptide
DEMEIATTNPVATEQYGTVCSATDGLEFEGND

SEQ ID NO: 88675 - protein, 33 aa, Artificial Sequence
  Description of Artificial Sequence: Synthetic polypeptide
DESEIRTTNPVATECYGSVSCIVEPQDREGENG

SEQ ID NO: 88676 - protein, 33 aa, Artificial Sequence
  Description of Artificial Sequence: Synthetic polypeptide
DEMEIATTNPVATEQYGTVCSATDCLVQFEGNL

SEQ ID NO: 88677 - protein, 33 aa, Artificial Sequence
  Description of Artificial Sequence: Synthetic polypeptide
DESEIRTTNPVATECYGSVSMEDIQQDREGENG

SEQ ID NO: 88678 - protein, 33 aa, Artificial Sequence
  Description of Artificial Sequence: Synthetic polypeptide
DESEIRTTNPVATECYGSVSMEDIQQDRNGENG

SEQ ID NO: 88679 - protein, 33 aa, Artificial Sequence
  Description of Artificial Sequence: Synthetic polypeptide
DESEIRTTNPVATECYGSVSMIDIQQDREGENG

SEQ ID NO: 88680 - protein, 34 aa, Artificial Sequence
  Description of Artificial Sequence: Synthetic polypeptide
DESEIRTTNPVATECYGSVSSCINEPQMRNGENG

SEQ ID NO: 88681 - protein, 34 aa, Artificial Sequence
  Description of Artificial Sequence: Synthetic polypeptide
DESEIRTTNPVATECYGSVSSCINEPQMRNGENV

SEQ ID NO: 88682 - protein, 32 aa, Artificial Sequence
  Description of Artificial Sequence: Synthetic polypeptide
DESEIRTTNPVATECYGSVSCINPPEFEGENG

SEQ ID NO: 88683 - protein, 34 aa, Artificial Sequence
  Description of Artificial Sequence: Synthetic polypeptide
DESEIRTTNPVATECYGSVSCINEPQDRNGMNPG

SEQ ID NO: 88684 - protein, 31 aa, Artificial Sequence
  Description of Artificial Sequence: Synthetic polypeptide
DEMEIATTNPVATEQYGTVCSTDGPEFEGND

SEQ ID NO: 88685 - protein, 31 aa, Artificial Sequence
  Description of Artificial Sequence: Synthetic polypeptide
DEMEIATTNPVATEQYGTVCSTNPVEFEGTD

SEQ ID NO: 88686 - protein, 30 aa, Artificial Sequence
  Description of Artificial Sequence: Synthetic polypeptide
DEMEIATTNPVATQQWGCVSTNDEHGDNEP

SEQ ID NO: 88687 - protein, 29 aa, Artificial Sequence
  Description of Artificial Sequence: Synthetic peptide
DEMEIATTNPVATEQYGVMATDGLEHGDD

SEQ ID NO: 88688 - protein, 34 aa, Artificial Sequence
  Description of Artificial Sequence: Synthetic polypeptide
DESEIRTTNPVATECYGSRVSCINEPQDREGENG

SEQ ID NO: 88689 - protein, 33 aa, Artificial Sequence
  Description of Artificial Sequence: Synthetic polypeptide
DESEIRTTNPVATECYGSVSACINEPQDREGEG

SEQ ID NO: 88690 - protein, 30 aa, Artificial Sequence
  Description of Artificial Sequence: Synthetic polypeptide
DEMEIATTNPVATEQYGTVSTDCPEFEGEL

SEQ ID NO: 88691 - protein, 34 aa, Artificial Sequence
  Description of Artificial Sequence: Synthetic polypeptide
DESEIRTTNPVATECYGSVSACINEPQDRVGENG

SEQ ID NO: 88692 - protein, 34 aa, Artificial Sequence
  Description of Artificial Sequence: Synthetic polypeptide
DESEIRTTNPVATECYGSVSATIDLEDREGENDG

SEQ ID NO: 88693 - protein, 32 aa, Artificial Sequence
  Description of Artificial Sequence: Synthetic polypeptide
DESEIRTTNPVATECYGSVSCDNPPEFEGENG

SEQ ID NO: 88694 - protein, 33 aa, Artificial Sequence
  Description of Artificial Sequence: Synthetic polypeptide
DEDEIATTNPVAYEQWGEVSTNLQRGNDDNGAS

SEQ ID NO: 88695 - protein, 33 aa, Artificial Sequence
  Description of Artificial Sequence: Synthetic polypeptide
DESEIRTTNPVATECYGSVSCENEPQQQEGENH

SEQ ID NO: 88696 - protein, 31 aa, Artificial Sequence
  Description of Artificial Sequence: Synthetic polypeptide
DEMEIATTNPVATEQYGTVSATGPEHEGNDD

SEQ ID NO: 88697 - protein, 33 aa, Artificial Sequence
  Description of Artificial Sequence: Synthetic polypeptide
DESEIRTTNPVATECYGSVSCICEPQDREGENG

SEQ ID NO: 88698 - protein, 31 aa, Artificial Sequence
  Description of Artificial Sequence: Synthetic polypeptide
DEMEIATTNPVATEQYGTVSATDPEHEGNDD

SEQ ID NO: 88699 - protein, 32 aa, Artificial Sequence
  Description of Artificial Sequence: Synthetic polypeptide
DESEIRTTNPVATECYGSVSCIDLEDHEGNDG

SEQ ID NO: 88700 - protein, 33 aa, Artificial Sequence
  Description of Artificial Sequence: Synthetic polypeptide
DESEIRTTNPVATECYGSVSCINEPNDREGENG

SEQ ID NO: 88701 - protein, 33 aa, Artificial Sequence
  Description of Artificial Sequence: Synthetic polypeptide
DESEIRTTNPVATECYGSVSCINEPQDHEGENG

SEQ ID NO: 88702 - protein, 33 aa, Artificial Sequence
  Description of Artificial Sequence: Synthetic polypeptide
DESEIRTTNPVATECYGSVSCINEPQDREGEEG

SEQ ID NO: 88703 - protein, 34 aa, Artificial Sequence
  Description of Artificial Sequence: Synthetic polypeptide
DESEIRTTNPVATECYGSVSSCINGPQMRNGENV

SEQ ID NO: 88704 - protein, 32 aa, Artificial Sequence
  Description of Artificial Sequence: Synthetic polypeptide
DEMEIATTNPVATEQYGSVSWTDLIDHEGEDL

SEQ ID NO: 88705 - protein, 32 aa, Artificial Sequence
  Description of Artificial Sequence: Synthetic polypeptide
DEMEIATTNPVATEQYGSVSTTDLEDHENEDL

SEQ ID NO: 88706 - protein, 32 aa, Artificial Sequence
  Description of Artificial Sequence: Synthetic polypeptide
DEMEIATTNPVATEQYGSVSNTDLENHEGEDL

SEQ ID NO: 88707 - protein, 34 aa, Artificial Sequence
  Description of Artificial Sequence: Synthetic polypeptide
DESEIRTTNPVATECYWGSVSCINEPQDREGENG

SEQ ID NO: 88708 - protein, 33 aa, Artificial Sequence
  Description of Artificial Sequence: Synthetic polypeptide
DESEIRTTNPVATEDWGSVSCINEPQDREGENG

SEQ ID NO: 88709 - protein, 33 aa, Artificial Sequence
  Description of Artificial Sequence: Synthetic polypeptide
DESEIRTTNPVATEEWGSVSCINEPQDREGENG

SEQ ID NO: 88710 - protein, 33 aa, Artificial Sequence
  Description of Artificial Sequence: Synthetic polypeptide
DESEIRTTNPVATEEWGSVSWINEPQDREGSNF

SEQ ID NO: 88711 - protein, 33 aa, Artificial Sequence
  Description of Artificial Sequence: Synthetic polypeptide
DESEIRTTNPVATEEWGSVSWMNEPQDRFGENQ

SEQ ID NO: 88712 - protein, 33 aa, Artificial Sequence
  Description of Artificial Sequence: Synthetic polypeptide
DESEIRTTNPVATEFWGSVSCINEAQDRTGENG

SEQ ID NO: 88713 - protein, 33 aa, Artificial Sequence
  Description of Artificial Sequence: Synthetic polypeptide
DESEIRTTNPVATEFWGSVSCINEPQDREGENG

SEQ ID NO: 88714 - protein, 33 aa, Artificial Sequence
  Description of Artificial Sequence: Synthetic polypeptide
DESEIRTTNPVATEFWGSVSCINEPQDRKGQNG

SEQ ID NO: 88715 - protein, 33 aa, Artificial Sequence
  Description of Artificial Sequence: Synthetic polypeptide
DESEIRTTNPVATEFWGSVSCINEPQSRDGENG

SEQ ID NO: 88716 - protein, 33 aa, Artificial Sequence
  Description of Artificial Sequence: Synthetic polypeptide
DESEIRTTNPVATEFWGSVSCINESQDRLGDNG

SEQ ID NO: 88717 - protein, 33 aa, Artificial Sequence
  Description of Artificial Sequence: Synthetic polypeptide
DESEIRTTNPVATEFWGSVSCINGPQDREGENG

SEQ ID NO: 88718 - protein, 33 aa, Artificial Sequence
  Description of Artificial Sequence: Synthetic polypeptide
DESEIRTTNPVATEFWGSVSCINQPQEREGENG

SEQ ID NO: 88719 - protein, 33 aa, Artificial Sequence
  Description of Artificial Sequence: Synthetic polypeptide
DESEIRTTNPVATEFWGSVSGNNEPQDRGGENG

SEQ ID NO: 88720 - protein, 34 aa, Artificial Sequence
  Description of Artificial Sequence: Synthetic polypeptide
DESEIRTTNPVATEFYGSVVITGDLGQRGAGNDN

SEQ ID NO: 88721 - protein, 33 aa, Artificial Sequence
  Description of Artificial Sequence: Synthetic polypeptide
DEDEIATTNPVAYEQWGSVCSTNLQNGDTNGGA

SEQ ID NO: 88722 - protein, 32 aa, Artificial Sequence
  Description of Artificial Sequence: Synthetic polypeptide
DEMEIATTNPVATEQYGSVSATDLEDHEGEDL

SEQ ID NO: 88723 - protein, 31 aa, Artificial Sequence
  Description of Artificial Sequence: Synthetic polypeptide
DESEIRTTNPVATEGWGDVSANIIMSRVGQR

SEQ ID NO: 88724 - protein, 33 aa, Artificial Sequence
  Description of Artificial Sequence: Synthetic polypeptide
DESEIRTTNPVATECYGVVSCINEPQDREGENG

SEQ ID NO: 88725 - protein, 33 aa, Artificial Sequence
  Description of Artificial Sequence: Synthetic polypeptide
DESEIRTTNPVATEGWGSVACINLPQDREGENI

SEQ ID NO: 88726 - protein, 32 aa, Artificial Sequence
  Description of Artificial Sequence: Synthetic polypeptide
DESEIRTTNPVATECYGTVSMINIQQQQNGNH

SEQ ID NO: 88727 - protein, 33 aa, Artificial Sequence
  Description of Artificial Sequence: Synthetic polypeptide
DESEIRTTNPVATECYGTVSCINEQQDREGENH

SEQ ID NO: 88728 - protein, 35 aa, Artificial Sequence
  Description of Artificial Sequence: Synthetic polypeptide
DESEIRTTNPVATECYGSVSSTPNEPQMRNGENPV

SEQ ID NO: 88729 - protein, 32 aa, Artificial Sequence
  Description of Artificial Sequence: Synthetic polypeptide
DEMEIATTNPVATEQYGSVSKTDLEDHTGEDV

SEQ ID NO: 88730 - protein, 33 aa, Artificial Sequence
  Description of Artificial Sequence: Synthetic polypeptide
DEDEIATTNPVAYEQWGSISHTDNQTQREGNDR

SEQ ID NO: 88731 - protein, 35 aa, Artificial Sequence
  Description of Artificial Sequence: Synthetic polypeptide
DESEIRTTNPVATECYGSVSTCINEPQDREGENPV

SEQ ID NO: 88732 - protein, 32 aa, Artificial Sequence
  Description of Artificial Sequence: Synthetic polypeptide
DEMEIATTNPVATEQYGSVSATSLEDHEGEDL

SEQ ID NO: 88733 - protein, 35 aa, Artificial Sequence
  Description of Artificial Sequence: Synthetic polypeptide
DESEIRTTNPVATECYGSVSTCINGPQDREGENPV

SEQ ID NO: 88734 - protein, 35 aa, Artificial Sequence
  Description of Artificial Sequence: Synthetic polypeptide
DESEIRTTNPVATECYGSVSTCINGPQDRNGENPV

SEQ ID NO: 88735 - protein, 35 aa, Artificial Sequence
  Description of Artificial Sequence: Synthetic polypeptide
DESEIRTTNPVATECYGSVSTCINGPQMRNGMNPV

SEQ ID NO: 88736 - protein, 33 aa, Artificial Sequence
  Description of Artificial Sequence: Synthetic polypeptide
DESEIRTTNPVATECYGSVSTIDLPQDHEGEDG

SEQ ID NO: 88737 - protein, 33 aa, Artificial Sequence
  Description of Artificial Sequence: Synthetic polypeptide
DESEIRTTNPVATECYGSVSTINEPEDREGEEG

SEQ ID NO: 88738 - protein, 31 aa, Artificial Sequence
  Description of Artificial Sequence: Synthetic polypeptide
DEMEIATTNPVATEQYGSVSATGPVEFEGED

SEQ ID NO: 88739 - protein, 32 aa, Artificial Sequence
  Description of Artificial Sequence: Synthetic polypeptide
DEMEIATTNPVATEQYGSVSATGLVEFEGEDD

SEQ ID NO: 88740 - protein, 34 aa, Artificial Sequence
  Description of Artificial Sequence: Synthetic polypeptide
DESEIRTTNPVATECYGSVSTTPAEPQDRNGMNV

SEQ ID NO: 88741 - protein, 32 aa, Artificial Sequence
  Description of Artificial Sequence: Synthetic polypeptide
DESEIRTTNPVATECYGTVSCINEQQDQNGNH

SEQ ID NO: 88742 - protein, 31 aa, Artificial Sequence
  Description of Artificial Sequence: Synthetic polypeptide
DEDEIATTNPVAYEQWGSVATNLETGDNDQE

SEQ ID NO: 88743 - protein, 31 aa, Artificial Sequence
  Description of Artificial Sequence: Synthetic polypeptide
DEDEIATTNPVAYEQWGSVATNLETGDNEAD

SEQ ID NO: 88744 - protein, 33 aa, Artificial Sequence
  Description of Artificial Sequence: Synthetic polypeptide
DESEIRTTNPVATECYGTVSCINEQQDREGENG

SEQ ID NO: 88745 - protein, 32 aa, Artificial Sequence
  Description of Artificial Sequence: Synthetic polypeptide
DESEIRTTNPVATECYGTVSCINEQQQQNGNH

SEQ ID NO: 88746 - protein, 34 aa, Artificial Sequence
  Description of Artificial Sequence: Synthetic polypeptide
DEEEIRTTNPVATEQYGSVSTDVSLETTFNDQAD

SEQ ID NO: 88747 - protein, 33 aa, Artificial Sequence
  Description of Artificial Sequence: Synthetic polypeptide
DDAEIRTTNPVATEQYGSVCSTEDLQSFGSDQS

SEQ ID NO: 88748 - protein, 33 aa, Artificial Sequence
  Description of Artificial Sequence: Synthetic polypeptide
DESEIRTTNPVATEQYGTVSATINEVEFEGEND

SEQ ID NO: 88749 - protein, 30 aa, Artificial Sequence
  Description of Artificial Sequence: Synthetic polypeptide
DESVIATTNPVAYDPHYGEVSTNLQRTGDM

SEQ ID NO: 88750 - protein, 36 aa, Artificial Sequence
  Description of Artificial Sequence: Synthetic polypeptide
DEEEIRTTNPVATEQYGSVSSTYPAGPNQRNGMNPV

SEQ ID NO: 88751 - protein, 30 aa, Artificial Sequence
  Description of Artificial Sequence: Synthetic polypeptide
DESVIATTNPVAYEQWGCVETNDHNRGGNR

SEQ ID NO: 88752 - protein, 30 aa, Artificial Sequence
  Description of Artificial Sequence: Synthetic polypeptide
DESVIATTNPVAYEQWGCVETNDQHTGNER

SEQ ID NO: 88753 - protein, 30 aa, Artificial Sequence
  Description of Artificial Sequence: Synthetic polypeptide
DESVIATTNPVAYEQWGCVETNPEQGEGNR

SEQ ID NO: 88754 - protein, 34 aa, Artificial Sequence
  Description of Artificial Sequence: Synthetic polypeptide
DEGEIRTTNPVATEQYGSVPPDNTQEDEGNDERI

SEQ ID NO: 88755 - protein, 30 aa, Artificial Sequence
  Description of Artificial Sequence: Synthetic polypeptide
DESVIATTNPVAYEQWGCVETNPQMDGNER

SEQ ID NO: 88756 - protein, 32 aa, Artificial Sequence
  Description of Artificial Sequence: Synthetic polypeptide
DDEEIRTTNPVATDAYGSVSTGNGGGNQGNDD

SEQ ID NO: 88757 - protein, 35 aa, Artificial Sequence
  Description of Artificial Sequence: Synthetic polypeptide
DEEEIRTTNPVATEQYGSVSSTWNMIERTSHDGFS

SEQ ID NO: 88758 - protein, 29 aa, Artificial Sequence
  Description of Artificial Sequence: Synthetic peptide
AESEVACTNPVATEQYGNVAAETLQRGQR

SEQ ID NO: 88759 - protein, 33 aa, Artificial Sequence
  Description of Artificial Sequence: Synthetic polypeptide
DEGEIRTTNPVATEQYGSVPCWDNHGGQRGEAA

SEQ ID NO: 88760 - protein, 31 aa, Artificial Sequence
  Description of Artificial Sequence: Synthetic polypeptide
DESVIATVNPVATEPYGSVSANLDRVGDNNM

SEQ ID NO: 88761 - protein, 34 aa, Artificial Sequence
  Description of Artificial Sequence: Synthetic polypeptide
DEGEIRTTNPVATEQYGSVNVTYANLDIRFENQE

SEQ ID NO: 88762 - protein, 33 aa, Artificial Sequence
  Description of Artificial Sequence: Synthetic polypeptide
DEGEIRTTNPVATEQYGSVNTNNGDQLSGSIVE

SEQ ID NO: 88763 - protein, 31 aa, Artificial Sequence
  Description of Artificial Sequence: Synthetic polypeptide
DEGEIRTTNPVATEQYGSVNNTDEDEYGEVH

SEQ ID NO: 88764 - protein, 35 aa, Artificial Sequence
  Description of Artificial Sequence: Synthetic polypeptide
DEEEIRTTNPVATEQYGSVSSTVNGFGQENIGDGD

SEQ ID NO: 88765 - protein, 31 aa, Artificial Sequence
  Description of Artificial Sequence: Synthetic polypeptide
DESVIATTNPVAYEQWGCVETNPQQRGENGR

SEQ ID NO: 88766 - protein, 32 aa, Artificial Sequence
  Description of Artificial Sequence: Synthetic polypeptide
DEGEIRTTNPVATEQYGSVQTYALIDSFENQE

SEQ ID NO: 88767 - protein, 29 aa, Artificial Sequence
  Description of Artificial Sequence: Synthetic peptide
AESEVASTNPVATEQYGNVAAETLQRGQR

SEQ ID NO: 88768 - protein, 30 aa, Artificial Sequence
  Description of Artificial Sequence: Synthetic polypeptide
AESEVASTNPVATEQYGNVAANTLQSRGQR

SEQ ID NO: 88769 - protein, 33 aa, Artificial Sequence
  Description of Artificial Sequence: Synthetic polypeptide
DEGEIRTTNPVATEQYGSVSPWDLERNEDNPSG

SEQ ID NO: 88770 - protein, 33 aa, Artificial Sequence
  Description of Artificial Sequence: Synthetic polypeptide
DEEEIRTTNPVATEQYGSVSSVVLASNNVGEEQ

SEQ ID NO: 88771 - protein, 28 aa, Artificial Sequence
  Description of Artificial Sequence: Synthetic peptide
AETEIACTNPVATEQWGAASANWARGGR

SEQ ID NO: 88772 - protein, 31 aa, Artificial Sequence
  Description of Artificial Sequence: Synthetic polypeptide
DEGEIRTTNPVATEQYGSVSPTEMAEHETEI

SEQ ID NO: 88773 - protein, 32 aa, Artificial Sequence
  Description of Artificial Sequence: Synthetic polypeptide
DEGEIRTTNPVATEQYGSVSIVLDLTEQLEDQ

SEQ ID NO: 88774 - protein, 33 aa, Artificial Sequence
  Description of Artificial Sequence: Synthetic polypeptide
DEGEIRTTNPVATEQYGSVSITLDLTEWQDEDQ

SEQ ID NO: 88775 - protein, 32 aa, Artificial Sequence
  Description of Artificial Sequence: Synthetic polypeptide
DEGEIRTTNPVATEQYGSVSINWLDLTEQEDQ

SEQ ID NO: 88776 - protein, 33 aa, Artificial Sequence
  Description of Artificial Sequence: Synthetic polypeptide
DEGEIRTTNPVATEQYGSVSETTNAEDQESEIS

SEQ ID NO: 88777 - protein, 34 aa, Artificial Sequence
  Description of Artificial Sequence: Synthetic polypeptide
DESTIRTTNPVATEQYGDSVSIMNLIQNGGDNDT

SEQ ID NO: 88778 - protein, 33 aa, Artificial Sequence
  Description of Artificial Sequence: Synthetic polypeptide
DESTIRTTNPVATEQYGDSVVVIMNLDQGGDND

SEQ ID NO: 88779 - protein, 32 aa, Artificial Sequence
  Description of Artificial Sequence: Synthetic polypeptide
DEGEIRTTNPVATEQYGSVSDWTQERESLIDG

SEQ ID NO: 88780 - protein, 33 aa, Artificial Sequence
  Description of Artificial Sequence: Synthetic polypeptide
DESTIRTTNPVATEQYGQYSIVSINNGQGGDND

SEQ ID NO: 88781 - protein, 33 aa, Artificial Sequence
  Description of Artificial Sequence: Synthetic polypeptide
DEGEIRTTNPVATEQYGSVSDANDLQLTQEDGE

SEQ ID NO: 88782 - protein, 34 aa, Artificial Sequence
  Description of Artificial Sequence: Synthetic polypeptide
DEGEIRTTNPVATEQYGSVSDANDLQLLGQEDIN

SEQ ID NO: 88783 - protein, 34 aa, Artificial Sequence
  Description of Artificial Sequence: Synthetic polypeptide
DEGEIRTTNPVATEQYGSVSDANDLQILGSEDGN

SEQ ID NO: 88784 - protein, 31 aa, Artificial Sequence
  Description of Artificial Sequence: Synthetic polypeptide
DESVEATTNPVAYEQWGAVSTNLQGDAGNNR

SEQ ID NO: 88785 - protein, 34 aa, Artificial Sequence
  Description of Artificial Sequence: Synthetic polypeptide
DEGEIRTTNPVATEQYGSVSDANDANQLGQEDGN

SEQ ID NO: 88786 - protein, 32 aa, Artificial Sequence
  Description of Artificial Sequence: Synthetic polypeptide
DESVIGTTNPVATEQWGTVSKTDFQDQRGGNR

SEQ ID NO: 88787 - protein, 33 aa, Artificial Sequence
  Description of Artificial Sequence: Synthetic polypeptide
DESTEIRTTNPVAYEQWGSVSTNGLGEDGNNGS

SEQ ID NO: 88788 - protein, 33 aa, Artificial Sequence
  Description of Artificial Sequence: Synthetic polypeptide
DEGEIRTTNPVATEQYGSVMWTYADLSRFENQE

SEQ ID NO: 88789 - protein, 32 aa, Artificial Sequence
  Description of Artificial Sequence: Synthetic polypeptide
DEGEIRTTNPVATEQYGSVLRPDPDLNREENQ

SEQ ID NO: 88790 - protein, 31 aa, Artificial Sequence
  Description of Artificial Sequence: Synthetic polypeptide
AESEIRTTNPVATECWGEVSCNEPQDRGENG

SEQ ID NO: 88791 - protein, 32 aa, Artificial Sequence
  Description of Artificial Sequence: Synthetic polypeptide
DETAEIATTNPVAYEQYGSVATNDQRHQNDQL

SEQ ID NO: 88792 - protein, 33 aa, Artificial Sequence
  Description of Artificial Sequence: Synthetic polypeptide
DETAEIATTNPVAYEQYGSVSAANNLGQNGNTE

SEQ ID NO: 88793 - protein, 34 aa, Artificial Sequence
  Description of Artificial Sequence: Synthetic polypeptide
DEGEIRTTNPVATEQYGSCSPTNSPENRSGSTQR

SEQ ID NO: 88794 - protein, 31 aa, Artificial Sequence
  Description of Artificial Sequence: Synthetic polypeptide
AESEIRCTNPVATEQWGSVSENEPQDREGGG

SEQ ID NO: 88795 - protein, 31 aa, Artificial Sequence
  Description of Artificial Sequence: Synthetic polypeptide
AESEIRCTNPVATEQWGSVSCNEPQDREGGG

SEQ ID NO: 88796 - protein, 30 aa, Artificial Sequence
  Description of Artificial Sequence: Synthetic polypeptide
AESEIRCTNPVATEQWGSASENEQDREGGG

SEQ ID NO: 88797 - protein, 33 aa, Artificial Sequence
  Description of Artificial Sequence: Synthetic polypeptide
DETAEIATTNPVAYEQWGSTSTNLQGDHGNGDR

SEQ ID NO: 88798 - protein, 33 aa, Artificial Sequence
  Description of Artificial Sequence: Synthetic polypeptide
DEGEIRTTNPVATEQYGSCQVDYDNLIRFENQE

SEQ ID NO: 88799 - protein, 33 aa, Artificial Sequence
  Description of Artificial Sequence: Synthetic polypeptide
DEGEIRTTNPVATEQYGSAVSTNEDEQENDEQN

SEQ ID NO: 88800 - protein, 36 aa, Artificial Sequence
  Description of Artificial Sequence: Synthetic polypeptide
DEEEIRTTNPVATEQYGSVSSTTPQGPNSRNGMNPV

SEQ ID NO: 88801 - protein, 36 aa, Artificial Sequence
  Description of Artificial Sequence: Synthetic polypeptide
DEEEIRTTNPVATEQYGSVSSTTPQGPNMRNGMNSQ

SEQ ID NO: 88802 - protein, 36 aa, Artificial Sequence
  Description of Artificial Sequence: Synthetic polypeptide
DEEEIRTTNPVATEQYGSVSSTTPQGPNMRNGMNPV

SEQ ID NO: 88803 - protein, 36 aa, Artificial Sequence
  Description of Artificial Sequence: Synthetic polypeptide
DEEEIRTTNPVATEQYGSVSSTTPQGPNMRKGMNPV

SEQ ID NO: 88804 - protein, 34 aa, Artificial Sequence
  Description of Artificial Sequence: Synthetic polypeptide
DEGEIRTTNPVATEQYGCWVSTINPLENRENNNP

SEQ ID NO: 88805 - protein, 31 aa, Artificial Sequence
  Description of Artificial Sequence: Synthetic polypeptide
DEGEIRTTNPVATEQYGCWTSTILPLETENN

SEQ ID NO: 88806 - protein, 31 aa, Artificial Sequence
  Description of Artificial Sequence: Synthetic polypeptide
DETAIRTTNPLATEQFGEVASFNLQSEGERE

SEQ ID NO: 88807 - protein, 36 aa, Artificial Sequence
  Description of Artificial Sequence: Synthetic polypeptide
DEEEIRTTNPVATEQYGSVSSTTPWNPNMRNGMNPF

SEQ ID NO: 88808 - protein, 33 aa, Artificial Sequence
  Description of Artificial Sequence: Synthetic polypeptide
DEGEIRTTNPVATEQYGSSSVPVNQIQNGNDGV

SEQ ID NO: 88809 - protein, 36 aa, Artificial Sequence
  Description of Artificial Sequence: Synthetic polypeptide
DEEEIRTTNPVATEQYGSVSSTTPWNPNMRNGMNPV

SEQ ID NO: 88810 - protein, 35 aa, Artificial Sequence
  Description of Artificial Sequence: Synthetic polypeptide
DEEEIRTTNPVATEQYGSVSSTVAGPNMRNGMNPV

SEQ ID NO: 88811 - protein, 32 aa, Artificial Sequence
  Description of Artificial Sequence: Synthetic polypeptide
AESEIRTTNPVATEQYGCVSTNTLTTETQNQQ

SEQ ID NO: 88812 - protein, 32 aa, Artificial Sequence
  Description of Artificial Sequence: Synthetic polypeptide
AESEIRTTNPVATEQYGCVSTNTLTQMETQEQ

SEQ ID NO: 88813 - protein, 33 aa, Artificial Sequence
  Description of Artificial Sequence: Synthetic polypeptide
DEGEIRTTNPVATEQYGSVGTPDPDLNREENNQ

SEQ ID NO: 88814 - protein, 34 aa, Artificial Sequence
  Description of Artificial Sequence: Synthetic polypeptide
DDEEIRTTNPVATDQYGSVSTGNGGQNGGGNDDG

SEQ ID NO: 88815 - protein, 33 aa, Artificial Sequence
  Description of Artificial Sequence: Synthetic polypeptide
AESEIRTTNPVATECYGSVSCINEPQDREGENG

SEQ ID NO: 88816 - protein, 35 aa, Artificial Sequence
  Description of Artificial Sequence: Synthetic polypeptide
DEEEIRTTNPVATEQYGSVSSTTTGPNSRNGMNPV

SEQ ID NO: 88817 - protein, 34 aa, Artificial Sequence
  Description of Artificial Sequence: Synthetic polypeptide
DDEEIRTTNPVATDQYGSVSTMNGGEQNEGGNNT

SEQ ID NO: 88818 - protein, 32 aa, Artificial Sequence
  Description of Artificial Sequence: Synthetic polypeptide
AESEIRTTNPVATECWGSVSCINEPQREGENG

SEQ ID NO: 88819 - protein, 34 aa, Artificial Sequence
  Description of Artificial Sequence: Synthetic polypeptide
DDEEIRTTNPVATDQYGSVSTNGGTQGQGNNGDA

SEQ ID NO: 88820 - protein, 36 aa, Artificial Sequence
  Description of Artificial Sequence: Synthetic polypeptide
DEEEIRTTNPVATEQYGSVSSTTQAGTNQLNGGNGV

SEQ ID NO: 88821 - protein, 32 aa, Artificial Sequence
  Description of Artificial Sequence: Synthetic polypeptide
DESVISTTNPVAYEQWGTVSKTDGLDQRGNTR

SEQ ID NO: 88822 - protein, 33 aa, Artificial Sequence
  Description of Artificial Sequence: Synthetic polypeptide
DEGEIRTTNPVATEQYGSVCSPTALERNDDTES

SEQ ID NO: 88823 - protein, 31 aa, Artificial Sequence
  Description of Artificial Sequence: Synthetic polypeptide
DETAEIACTNPVATEQYGSVAANLQESGDHQ

SEQ ID NO: 88824 - protein, 32 aa, Artificial Sequence
  Description of Artificial Sequence: Synthetic polypeptide
DETAEIACTNPVATEQYGSVATNLQASENADE

SEQ ID NO: 88825 - protein, 34 aa, Artificial Sequence
  Description of Artificial Sequence: Synthetic polypeptide
DDEEIRTTNPVATDQYGSVSTNNGVEQGNFGNGQ

SEQ ID NO: 88826 - protein, 32 aa, Artificial Sequence
  Description of Artificial Sequence: Synthetic polypeptide
DDEEIRTTNPVATDQYGVVSTGGGQGGENTEN

SEQ ID NO: 88827 - protein, 31 aa, Artificial Sequence
  Description of Artificial Sequence: Synthetic polypeptide
DESVIGTTNPVAYEQWGTCSKTDGLDQRGNR

SEQ ID NO: 88828 - protein, 33 aa, Artificial Sequence
  Description of Artificial Sequence: Synthetic polypeptide
DESTEIATTNPVAYEQWGSVSTNLQGEDGQNGS

SEQ ID NO: 88829 - protein, 32 aa, Artificial Sequence
  Description of Artificial Sequence: Synthetic polypeptide
DESTEIATTNPVAYEQWGSVSTNLNMDGNNGS

SEQ ID NO: 88830 - protein, 34 aa, Artificial Sequence
  Description of Artificial Sequence: Synthetic polypeptide
DEGEIRTTNPVATEQYGSVSTIAEELRNGNEEKF

SEQ ID NO: 88831 - protein, 32 aa, Artificial Sequence
  Description of Artificial Sequence: Synthetic polypeptide
DEGEIRTTNPVATEQYGSVSWTDIELRDTDTQ

SEQ ID NO: 88832 - protein, 33 aa, Artificial Sequence
  Description of Artificial Sequence: Synthetic polypeptide
DEGEIRTTNPVATEQYGSVSWNWPLQIDTEVQN

SEQ ID NO: 88833 - protein, 33 aa, Artificial Sequence
  Description of Artificial Sequence: Synthetic polypeptide
DESEIVTTNPVATEQYGTVCSATINPVQFEGNG

SEQ ID NO: 88834 - protein, 31 aa, Artificial Sequence
  Description of Artificial Sequence: Synthetic polypeptide
DESEIVTTNPVATEQYGTVSATDGLVEFGDD

SEQ ID NO: 88835 - protein, 31 aa, Artificial Sequence
  Description of Artificial Sequence: Synthetic polypeptide
DESEIVTTNPVATEQYGVVSATDGLVEFGDD

SEQ ID NO: 88836 - protein, 31 aa, Artificial Sequence
  Description of Artificial Sequence: Synthetic polypeptide
DESEIVTTNPVSTEGYGTVSATDGPQRVGND

SEQ ID NO: 88837 - protein, 33 aa, Artificial Sequence
  Description of Artificial Sequence: Synthetic polypeptide
DEGEIRTTNPVATEQYGSVSVSQNWNEQDVQNE

SEQ ID NO: 88838 - protein, 35 aa, Artificial Sequence
  Description of Artificial Sequence: Synthetic polypeptide
DEGEIRTTNPVATEQYGSVSWTTWNEEIPGNDNRA

SEQ ID NO: 88839 - protein, 29 aa, Artificial Sequence
  Description of Artificial Sequence: Synthetic peptide
AETEIACTNPVATEQYGEAWAENLQPGGR

SEQ ID NO: 88840 - protein, 33 aa, Artificial Sequence
  Description of Artificial Sequence: Synthetic polypeptide
DESENRTTNPVATECWGSVSCINELQDREGENG

SEQ ID NO: 88841 - protein, 29 aa, Artificial Sequence
  Description of Artificial Sequence: Synthetic peptide
DESEVASTNPVATEGYGNVAANTIQRGQR

SEQ ID NO: 88842 - protein, 31 aa, Artificial Sequence
  Description of Artificial Sequence: Synthetic polypeptide
DESEVASTNPVATEGYGNVSANTIQDRVGNR

SEQ ID NO: 88843 - protein, 29 aa, Artificial Sequence
  Description of Artificial Sequence: Synthetic peptide
DESEVASTNPVATEQYGNAAETLQSRGGR

SEQ ID NO: 88844 - protein, 28 aa, Artificial Sequence
  Description of Artificial Sequence: Synthetic peptide
DESEVASTNPVCTEQYGVVSDNIQSGQQ

SEQ ID NO: 88845 - protein, 33 aa, Artificial Sequence
  Description of Artificial Sequence: Synthetic polypeptide
DEGEIRTTNPVATEQYGSVSVPNNVDHEGEERG

SEQ ID NO: 88846 - protein, 32 aa, Artificial Sequence
  Description of Artificial Sequence: Synthetic polypeptide
DESEVATTNPVATEGYGSVAANDLQSRVGEDR

SEQ ID NO: 88847 - protein, 33 aa, Artificial Sequence
  Description of Artificial Sequence: Synthetic polypeptide
DESEMRTTNPVATEQYGSVCSDTNTLQWDAPPQ

SEQ ID NO: 88848 - protein, 34 aa, Artificial Sequence
  Description of Artificial Sequence: Synthetic polypeptide
DEGEIRTTNPVATEQYGSVSWTWPLTQIDTTENQ

SEQ ID NO: 88849 - protein, 33 aa, Artificial Sequence
  Description of Artificial Sequence: Synthetic polypeptide
DEEEIRTTNPVATEQYGSVSTAPVNASGETEIM

SEQ ID NO: 88850 - protein, 33 aa, Artificial Sequence
  Description of Artificial Sequence: Synthetic polypeptide
DESEIVTTNPVATEQYGSVSCINPPQDFEGENG

SEQ ID NO: 88851 - protein, 32 aa, Artificial Sequence
  Description of Artificial Sequence: Synthetic polypeptide
DEEEIRTTNPVATEQYGSVSTDADYTFSQVQM

SEQ ID NO: 88852 - protein, 33 aa, Artificial Sequence
  Description of Artificial Sequence: Synthetic polypeptide
DEEEIRTTNPVATEQYGSVSTDADYTFEHSQRP

SEQ ID NO: 88853 - protein, 33 aa, Artificial Sequence
  Description of Artificial Sequence: Synthetic polypeptide
DEGEIRTTNPVATEQYGSYVYTWDDQESGQDNS

SEQ ID NO: 88854 - protein, 34 aa, Artificial Sequence
  Description of Artificial Sequence: Synthetic polypeptide
DESEIVRTTNPVAYEPYGSVSTGNLSQTLGGDRF

SEQ ID NO: 88855 - protein, 31 aa, Artificial Sequence
  Description of Artificial Sequence: Synthetic polypeptide
DESEIVSTNPVATEGYGTVSANTIESRVGNR

SEQ ID NO: 88856 - protein, 31 aa, Artificial Sequence
  Description of Artificial Sequence: Synthetic polypeptide
DESEIVSTNPVSTEQYGTVAANDGPQRVGNR

SEQ ID NO: 88857 - protein, 33 aa, Artificial Sequence
  Description of Artificial Sequence: Synthetic polypeptide
DESEIVTTNPVATECYGSVSCINEPQDREGENG

SEQ ID NO: 88858 - protein, 33 aa, Artificial Sequence
  Description of Artificial Sequence: Synthetic polypeptide
DESEIVTTNPVATEQWGSVCSATINPVQFEGND

SEQ ID NO: 88859 - protein, 33 aa, Artificial Sequence
  Description of Artificial Sequence: Synthetic polypeptide
DESEIVTTNPVATEQWGSVCSTINPVQDFEGND

SEQ ID NO: 88860 - protein, 32 aa, Artificial Sequence
  Description of Artificial Sequence: Synthetic polypeptide
DESEIVTTNPVATEQWGSVSCINEVQDFEGNG

SEQ ID NO: 88861 - protein, 33 aa, Artificial Sequence
  Description of Artificial Sequence: Synthetic polypeptide
DESEIVTTNPVATEQWGSVSCINPPQDREGENG

SEQ ID NO: 88862 - protein, 33 aa, Artificial Sequence
  Description of Artificial Sequence: Synthetic polypeptide
DESEIVTTNPVATEQWGSVSCINPVQDREGENG

SEQ ID NO: 88863 - protein, 33 aa, Artificial Sequence
  Description of Artificial Sequence: Synthetic polypeptide
DEGEIRTTNPVATEQYGSWCSVEMLQEGNETKM

SEQ ID NO: 88864 - protein, 33 aa, Artificial Sequence
  Description of Artificial Sequence: Synthetic polypeptide
DESEIVTTNPVATEQYGSVCSATIGPVQFEGND

SEQ ID NO: 88865 - protein, 33 aa, Artificial Sequence
  Description of Artificial Sequence: Synthetic polypeptide
DEGEIRTTNPVATEQYGSVWSWTWPLQIDTEQG

SEQ ID NO: 88866 - protein, 34 aa, Artificial Sequence
  Description of Artificial Sequence: Synthetic polypeptide
DEEEIRTTNPVATEQYGSVSTAVNDMFPNETQND

SEQ ID NO: 88867 - protein, 34 aa, Artificial Sequence
  Description of Artificial Sequence: Synthetic polypeptide
DEEEIRTTNPVATEQYGSVSTASNTTGPNMEDDG

SEQ ID NO: 88868 - protein, 34 aa, Artificial Sequence
  Description of Artificial Sequence: Synthetic polypeptide
DEGEIRTTNPVATEQYGSVSVMNDLTQEGEEDGD

SEQ ID NO: 88869 - protein, 32 aa, Artificial Sequence
  Description of Artificial Sequence: Synthetic polypeptide
DESEVATTNPVATEQYGSVSATDLQSHEGQDL

SEQ ID NO: 88870 - protein, 28 aa, Artificial Sequence
  Description of Artificial Sequence: Synthetic peptide
DESEVATTNPVSTECYGDVANTIQRGQR

SEQ ID NO: 88871 - protein, 28 aa, Artificial Sequence
  Description of Artificial Sequence: Synthetic peptide
DESEVATTNPVSTECYGDVANTLQHGQR

SEQ ID NO: 88872 - protein, 32 aa, Artificial Sequence
  Description of Artificial Sequence: Synthetic polypeptide
DESNIATTNPVATEIYGQVATGNMQDRDGSNR

SEQ ID NO: 88873 - protein, 32 aa, Artificial Sequence
  Description of Artificial Sequence: Synthetic polypeptide
DESQIGTTNPVAYEQYGSTVSVTNPSGRPGSR

SEQ ID NO: 88874 - protein, 33 aa, Artificial Sequence
  Description of Artificial Sequence: Synthetic polypeptide
DEGEIRTTNPVATEQYGSVSTPHYQLSGQEVKN

SEQ ID NO: 88875 - protein, 33 aa, Artificial Sequence
  Description of Artificial Sequence: Synthetic polypeptide
DDEEIRSTNPVATEQYGSVSSTNPTGNMRNGQV

SEQ ID NO: 88876 - protein, 33 aa, Artificial Sequence
  Description of Artificial Sequence: Synthetic polypeptide
DEDEIRTTNPVATECWGSVSCINEPQDREGENG

SEQ ID NO: 88877 - protein, 33 aa, Artificial Sequence
  Description of Artificial Sequence: Synthetic polypeptide
DEDEIRTTNPVATECWGSVSCINEPQDREGPNG

SEQ ID NO: 88878 - protein, 33 aa, Artificial Sequence
  Description of Artificial Sequence: Synthetic polypeptide
DEDEIRTTNPVATECWGSVSCINNPQDREGENG

SEQ ID NO: 88879 - protein, 32 aa, Artificial Sequence
  Description of Artificial Sequence: Synthetic polypeptide
DEGEIRTTNPVATEQYGSVSTNDTYIDLEDMI

SEQ ID NO: 88880 - protein, 34 aa, Artificial Sequence
  Description of Artificial Sequence: Synthetic polypeptide
DEGEIRTTNPVATEQYGSVSTNDTHEIFLQDEMI

SEQ ID NO: 88881 - protein, 34 aa, Artificial Sequence
  Description of Artificial Sequence: Synthetic polypeptide
DEDEIRTTNPVATECYGSVCSTMNNDQDSGGNEH

SEQ ID NO: 88882 - protein, 34 aa, Artificial Sequence
  Description of Artificial Sequence: Synthetic polypeptide
DEEEIRTTNPVATEQYGSVSTAGMGNTGQENTEE

SEQ ID NO: 88883 - protein, 35 aa, Artificial Sequence
  Description of Artificial Sequence: Synthetic polypeptide
DEEEIRTTNPVATEQYGSVSTAENDMQNETQNTDL

SEQ ID NO: 88884 - protein, 34 aa, Artificial Sequence
  Description of Artificial Sequence: Synthetic polypeptide
DEEEIRTTNPVATEQYGSVSTAENDMQNETQDVD

SEQ ID NO: 88885 - protein, 33 aa, Artificial Sequence
  Description of Artificial Sequence: Synthetic polypeptide
DEGEIRTTNPVATEQYGSVSTNDLTTEMFEDGD

SEQ ID NO: 88886 - protein, 33 aa, Artificial Sequence
  Description of Artificial Sequence: Synthetic polypeptide
DEDEIRTTNPVATEFWGSVSGNNEPQDRAGGNG

SEQ ID NO: 88887 - protein, 34 aa, Artificial Sequence
  Description of Artificial Sequence: Synthetic polypeptide
DEGEIRTTNPVATEQYGSVSTNATEIFLLQDHMI

SEQ ID NO: 88888 - protein, 31 aa, Artificial Sequence
  Description of Artificial Sequence: Synthetic polypeptide
DESSIRATNPLATEQFGSVSFLNLQPEGQNK

SEQ ID NO: 88889 - protein, 33 aa, Artificial Sequence
  Description of Artificial Sequence: Synthetic polypeptide
DEGEIRTTNPVATEQYGSVSTSDLTQEYFEDGD

SEQ ID NO: 88890 - protein, 33 aa, Artificial Sequence
  Description of Artificial Sequence: Synthetic polypeptide
DEGEIRTTNPVATEQYGCWSTINVLENRFENNN

SEQ ID NO: 88891 - protein, 34 aa, Artificial Sequence
  Description of Artificial Sequence: Synthetic polypeptide
DEDEIRTTNPVATEAYGSVSVTNLNQLQIGTTTE

SEQ ID NO: 88892 - protein, 31 aa, Artificial Sequence
  Description of Artificial Sequence: Synthetic polypeptide
DESEVRTTNPVSTEGYGTVSMTIQQQRVGNH

SEQ ID NO: 88893 - protein, 29 aa, Artificial Sequence
  Description of Artificial Sequence: Synthetic peptide
DESEVATTNPVSTECYGNVAANTIQRGQR

SEQ ID NO: 88894 - protein, 28 aa, Artificial Sequence
  Description of Artificial Sequence: Synthetic peptide
DESEVATTNPVSTECYGNVANTIQRGQR

SEQ ID NO: 88895 - protein, 32 aa, Artificial Sequence
  Description of Artificial Sequence: Synthetic polypeptide
DESEVICTTNPVAYESYGSHSTNLQRGGSEAD

SEQ ID NO: 88896 - protein, 31 aa, Artificial Sequence
  Description of Artificial Sequence: Synthetic polypeptide
AETEIACTNPVATEQYGEASENLSQRTGGGR

SEQ ID NO: 88897 - protein, 31 aa, Artificial Sequence
  Description of Artificial Sequence: Synthetic polypeptide
DESEVRSTNPVATECWGNVSANNEQDREGNR

SEQ ID NO: 88898 - protein, 31 aa, Artificial Sequence
  Description of Artificial Sequence: Synthetic polypeptide
DESEVRSTNPVATECWGNVSANNEQDRVGNR

SEQ ID NO: 88899 - protein, 31 aa, Artificial Sequence
  Description of Artificial Sequence: Synthetic polypeptide
DESEVRSTNPVATEGWGNVSANNEQDRVGNR

SEQ ID NO: 88900 - protein, 33 aa, Artificial Sequence
  Description of Artificial Sequence: Synthetic polypeptide
DEDEIRTTNPVATEAYGETTSCTNELSQRGDYS

SEQ ID NO: 88901 - protein, 31 aa, Artificial Sequence
  Description of Artificial Sequence: Synthetic polypeptide
DESEVRSTNPVATEGWGNVSANNIQDRVGNR

SEQ ID NO: 88902 - protein, 33 aa, Artificial Sequence
  Description of Artificial Sequence: Synthetic polypeptide
DEDEIRTTNPVATEAYGSVSNNLNLNQQGTTTE

SEQ ID NO: 88903 - protein, 31 aa, Artificial Sequence
  Description of Artificial Sequence: Synthetic polypeptide
DESEVRSTNPVSTEGYGNVATNTIQSRNGNR

SEQ ID NO: 88904 - protein, 32 aa, Artificial Sequence
  Description of Artificial Sequence: Synthetic polypeptide
DESEVRTTNPVATECWGSVACINEQDREGENR

SEQ ID NO: 88905 - protein, 33 aa, Artificial Sequence
  Description of Artificial Sequence: Synthetic polypeptide
DDEEIRSTNPVATEQYGSVSPTNLETDNEQQHA

SEQ ID NO: 88906 - protein, 32 aa, Artificial Sequence
  Description of Artificial Sequence: Synthetic polypeptide
DESEVRTTNPVATECWGSVSCINEPQDREGNG

SEQ ID NO: 88907 - protein, 34 aa, Artificial Sequence
  Description of Artificial Sequence: Synthetic polypeptide
DEDEIRTTNPVATEAYGSVSTNNNLLQQGATTTE

SEQ ID NO: 88908 - protein, 34 aa, Artificial Sequence
  Description of Artificial Sequence: Synthetic polypeptide
DEGEIRTTNPVATEQYGSVSTWPNQELREGTQME

SEQ ID NO: 88909 - protein, 31 aa, Artificial Sequence
  Description of Artificial Sequence: Synthetic polypeptide
DESEVRTTNPVSTEGYGTVSMTIQQQRNGNH

SEQ ID NO: 88910 - protein, 30 aa, Artificial Sequence
  Description of Artificial Sequence: Synthetic polypeptide
DESEVRTTNPVSTEPYGTVSMDIQQRNGNH

SEQ ID NO: 88911 - protein, 34 aa, Artificial Sequence
  Description of Artificial Sequence: Synthetic polypeptide
DEGEIRTTNPVATEQYGCWSTINPLNENRENNNR

SEQ ID NO: 88912 - protein, 32 aa, Artificial Sequence
  Description of Artificial Sequence: Synthetic polypeptide
DEGEIRTTNPVATEQYGCWSPYINPLEREVND

SEQ ID NO: 88913 - protein, 31 aa, Artificial Sequence
  Description of Artificial Sequence: Synthetic polypeptide
DEGEIRTTNPVATEQYGCWSANESQEGEDFG

SEQ ID NO: 88914 - protein, 34 aa, Artificial Sequence
  Description of Artificial Sequence: Synthetic polypeptide
DETEIATTNPVATEQWGSVSATGELPEQTEGNRQ

SEQ ID NO: 88915 - protein, 31 aa, Artificial Sequence
  Description of Artificial Sequence: Synthetic polypeptide
DEGEIATTNPVAYEQYGSVAMNLAPDGDNQN

SEQ ID NO: 88916 - protein, 36 aa, Artificial Sequence
  Description of Artificial Sequence: Synthetic polypeptide
DEEEIRTTNPVATEQYGVVSVVVSTTNLQQIGTTEE

SEQ ID NO: 88917 - protein, 32 aa, Artificial Sequence
  Description of Artificial Sequence: Synthetic polypeptide
DEGEIATTNPVAYEQYGSVAITNLTDDGGNSL

SEQ ID NO: 88918 - protein, 35 aa, Artificial Sequence
  Description of Artificial Sequence: Synthetic polypeptide
DEEEIRTTNPVATEQYGVVSVVVTNLEQYGTDEQD

SEQ ID NO: 88919 - protein, 34 aa, Artificial Sequence
  Description of Artificial Sequence: Synthetic polypeptide
DETEIATTNPVATEQWGSVSATGELQQTEGNDRH

SEQ ID NO: 88920 - protein, 36 aa, Artificial Sequence
  Description of Artificial Sequence: Synthetic polypeptide
DEEEIRTTNPVATEQYGSVSSTTPAMNNMRNGMNPV

SEQ ID NO: 88921 - protein, 32 aa, Artificial Sequence
  Description of Artificial Sequence: Synthetic polypeptide
DEGEIATTNPVAYEQYGSVAMNLQPRPQEEGR

SEQ ID NO: 88922 - protein, 34 aa, Artificial Sequence
  Description of Artificial Sequence: Synthetic polypeptide
DETEIATTNPVATEQWGSVSATNNLQENGENMTE

SEQ ID NO: 88923 - protein, 33 aa, Artificial Sequence
  Description of Artificial Sequence: Synthetic polypeptide
DEGEIATTNPVAYEQYGSVAATANLQAEPGNDN

SEQ ID NO: 88924 - protein, 36 aa, Artificial Sequence
  Description of Artificial Sequence: Synthetic polypeptide
DEEEIRTTNPVATEQYGSVSSTTPALPNMRNGMNPV

SEQ ID NO: 88925 - protein, 36 aa, Artificial Sequence
  Description of Artificial Sequence: Synthetic polypeptide
DEEEIRTTNPVATEQYGSVSSTTPALPNMRNGMNPN

SEQ ID NO: 88926 - protein, 31 aa, Artificial Sequence
  Description of Artificial Sequence: Synthetic polypeptide
DEGEIATTNPVAYEQYGSVAAGNLQNADPNN

SEQ ID NO: 88927 - protein, 32 aa, Artificial Sequence
  Description of Artificial Sequence: Synthetic polypeptide
DETEIATTNPVATEQWGSVSGTGNPQNDNEPA

SEQ ID NO: 88928 - protein, 31 aa, Artificial Sequence
  Description of Artificial Sequence: Synthetic polypeptide
DEGEIATTNPVAYEQYGSTAAANNLQAGQRQ

SEQ ID NO: 88929 - protein, 33 aa, Artificial Sequence
  Description of Artificial Sequence: Synthetic polypeptide
DEGEIATTNPVAYEQYGSCSTNDTQGRPGDNPE

SEQ ID NO: 88930 - protein, 35 aa, Artificial Sequence
  Description of Artificial Sequence: Synthetic polypeptide
DEEEIRTTNPVATEQYGSVSSTTPALPNMSGMNPV

SEQ ID NO: 88931 - protein, 36 aa, Artificial Sequence
  Description of Artificial Sequence: Synthetic polypeptide
DEEEIRTTNPVATEQYGSVSSTTPANPNMRNGMNPV

SEQ ID NO: 88932 - protein, 36 aa, Artificial Sequence
  Description of Artificial Sequence: Synthetic polypeptide
DEEEIRTTNPVATEQYGSVSSTTPANPNVRNGMNPV

SEQ ID NO: 88933 - protein, 33 aa, Artificial Sequence
  Description of Artificial Sequence: Synthetic polypeptide
DEGEIATTNPVAYEQYGSVATNGQESPGDNVRG

SEQ ID NO: 88934 - protein, 28 aa, Artificial Sequence
  Description of Artificial Sequence: Synthetic peptide
AESEIASTNPVGTEQYGEAAENLQRGDI

SEQ ID NO: 88935 - protein, 36 aa, Artificial Sequence
  Description of Artificial Sequence: Synthetic polypeptide
DEEEIRTTNPVATEQYGSVSSTTPAQPNYRNGMNPV

SEQ ID NO: 88936 - protein, 33 aa, Artificial Sequence
  Description of Artificial Sequence: Synthetic polypeptide
DEGEIATTNPVAYEQYGSVATNLQDTPDGNDNN

SEQ ID NO: 88937 - protein, 33 aa, Artificial Sequence
  Description of Artificial Sequence: Synthetic polypeptide
DEGEIATTNPVAYEQYGSVATNLQDRPQEETRQ

SEQ ID NO: 88938 - protein, 32 aa, Artificial Sequence
  Description of Artificial Sequence: Synthetic polypeptide
DEGEIATTNPVAYEQYGSVATNLQDPNEQTNQ

SEQ ID NO: 88939 - protein, 28 aa, Artificial Sequence
  Description of Artificial Sequence: Synthetic peptide
DETEIATTNPVATECWGAVSACLAPGEL

SEQ ID NO: 88940 - protein, 36 aa, Artificial Sequence
  Description of Artificial Sequence: Synthetic polypeptide
DEEEIRTTNPVATEQYGSVSSTTPAQPNMRNGMNTV

SEQ ID NO: 88941 - protein, 37 aa, Artificial Sequence
  Description of Artificial Sequence: Synthetic polypeptide
DEEEIRTTNPVATEQYGVVSVVVSTNLQAGTNDEQED

SEQ ID NO: 88942 - protein, 36 aa, Artificial Sequence
  Description of Artificial Sequence: Synthetic polypeptide
DEEEIRTTNPVATEQYGSVSSTTPAQPNMRNGMNPV

SEQ ID NO: 88943 - protein, 36 aa, Artificial Sequence
  Description of Artificial Sequence: Synthetic polypeptide
DEEEIRTTNPVATEQYGSVSSTTPAQPNMRNGENPV

SEQ ID NO: 88944 - protein, 32 aa, Artificial Sequence
  Description of Artificial Sequence: Synthetic polypeptide
DETEIATTNPVATECYGSVSTNLNGEHNNGEQ

SEQ ID NO: 88945 - protein, 31 aa, Artificial Sequence
  Description of Artificial Sequence: Synthetic polypeptide
DETEIATTNPVATEEYGCVSTNLNGEHNNEQ

SEQ ID NO: 88946 - protein, 37 aa, Artificial Sequence
  Description of Artificial Sequence: Synthetic polypeptide
DEEEIRTTNPVATEQYGVVSVVVSTNLQAGTTNEESD

SEQ ID NO: 88947 - protein, 32 aa, Artificial Sequence
  Description of Artificial Sequence: Synthetic polypeptide
DEGEIATTNPVAYEQYGSVATNLQANPSVENN

SEQ ID NO: 88948 - protein, 33 aa, Artificial Sequence
  Description of Artificial Sequence: Synthetic polypeptide
DEGEIATTNPVAYEQYGSVATNLDQMPGDLTNM

SEQ ID NO: 88949 - protein, 32 aa, Artificial Sequence
  Description of Artificial Sequence: Synthetic polypeptide
DEGEIATTNPVAYEQYGSVATNLADPQEEGTM

SEQ ID NO: 88950 - protein, 35 aa, Artificial Sequence
  Description of Artificial Sequence: Synthetic polypeptide
DEEEIRTTNPVATEQYGSVSSTTPAPPEREGMNPV

SEQ ID NO: 88951 - protein, 31 aa, Artificial Sequence
  Description of Artificial Sequence: Synthetic polypeptide
DEGEIATTNPVAYEQYGCVATNLQRPQEEGD

SEQ ID NO: 88952 - protein, 32 aa, Artificial Sequence
  Description of Artificial Sequence: Synthetic polypeptide
DEGEIATTNPVAYEQWGSVCTELQIREMNNMR

SEQ ID NO: 88953 - protein, 35 aa, Artificial Sequence
  Description of Artificial Sequence: Synthetic polypeptide
DEEEIRTTNPVATEQYGSVSSTTPALNMRNGMTPV

SEQ ID NO: 88954 - protein, 32 aa, Artificial Sequence
  Description of Artificial Sequence: Synthetic polypeptide
DEGEIATTNPVAYEQWGSVCTELIQREMNNRR

SEQ ID NO: 88955 - protein, 33 aa, Artificial Sequence
  Description of Artificial Sequence: Synthetic polypeptide
DEGEIATTNPVATEQYGSVCAATNPLNMPGQRQ

SEQ ID NO: 88956 - protein, 31 aa, Artificial Sequence
  Description of Artificial Sequence: Synthetic polypeptide
DETEIATTNPVATEQYGSVATPLERPQEEDF

SEQ ID NO: 88957 - protein, 33 aa, Artificial Sequence
  Description of Artificial Sequence: Synthetic polypeptide
DETEIATTNPVATEQYGSVATPNLDTGMGNEHT

SEQ ID NO: 88958 - protein, 32 aa, Artificial Sequence
  Description of Artificial Sequence: Synthetic polypeptide
DETEIATTNPVATEQYGSVCAADNGDDGDINR

SEQ ID NO: 88959 - protein, 32 aa, Artificial Sequence
  Description of Artificial Sequence: Synthetic polypeptide
DEGEIATTNPVATEQYGSVCAATHLQAAENGQ

SEQ ID NO: 88960 - protein, 35 aa, Artificial Sequence
  Description of Artificial Sequence: Synthetic polypeptide
DEEEIRTTNPVATEQYGSVSSTTPAGVNMRNGNPV

SEQ ID NO: 88961 - protein, 34 aa, Artificial Sequence
  Description of Artificial Sequence: Synthetic polypeptide
DETEIATTNPVATEQYGSVCSGFNLDQGGENNHD

SEQ ID NO: 88962 - protein, 33 aa, Artificial Sequence
  Description of Artificial Sequence: Synthetic polypeptide
DEGEIATTNPVATEQYGSVCAATAQLQAAEGNQ

SEQ ID NO: 88963 - protein, 36 aa, Artificial Sequence
  Description of Artificial Sequence: Synthetic polypeptide
DEEEIRTTNPVATEQYGSVSSTTPAGTNNLNGGNPV

SEQ ID NO: 88964 - protein, 34 aa, Artificial Sequence
  Description of Artificial Sequence: Synthetic polypeptide
DETEIATTNPVATEQYGSVCSTNDDQHGQGNTDL

SEQ ID NO: 88965 - protein, 34 aa, Artificial Sequence
  Description of Artificial Sequence: Synthetic polypeptide
DETEIATTNPVATEQYGSVCSTNPLQDALAEGDN

SEQ ID NO: 88966 - protein, 33 aa, Artificial Sequence
  Description of Artificial Sequence: Synthetic polypeptide
DETEIATTNPVATEQYGSVCSTVDQQDHGGNES

SEQ ID NO: 88967 - protein, 32 aa, Artificial Sequence
  Description of Artificial Sequence: Synthetic polypeptide
DETEIATTNPVATEQYGSVSATDLEDHEGEDL

SEQ ID NO: 88968 - protein, 32 aa, Artificial Sequence
  Description of Artificial Sequence: Synthetic polypeptide
DETEIATTNPVATEQYGSVSATDLEDHEGEDY

SEQ ID NO: 88969 - protein, 32 aa, Artificial Sequence
  Description of Artificial Sequence: Synthetic polypeptide
DETEIATTNPVATEQYGSVSATDLEDHKGEDL

SEQ ID NO: 88970 - protein, 32 aa, Artificial Sequence
  Description of Artificial Sequence: Synthetic polypeptide
DEGEIATTNPVATEQYGSVCAANNPQDAGPNE

SEQ ID NO: 88971 - protein, 32 aa, Artificial Sequence
  Description of Artificial Sequence: Synthetic polypeptide
DEGEIATTNPVATEQYGSVCAANNLQESDDNH

SEQ ID NO: 88972 - protein, 33 aa, Artificial Sequence
  Description of Artificial Sequence: Synthetic polypeptide
DEGEIATTNPVATEQYGSVCATNLTQPDQEGAN

SEQ ID NO: 88973 - protein, 31 aa, Artificial Sequence
  Description of Artificial Sequence: Synthetic polypeptide
DEGEIATTNPVAYEQYGSVATNLQGPQEQTN

SEQ ID NO: 88974 - protein, 34 aa, Artificial Sequence
  Description of Artificial Sequence: Synthetic polypeptide
DEGEIATTNPVATEQYGSVCSPTGNNNDQTAGNQ

SEQ ID NO: 88975 - protein, 33 aa, Artificial Sequence
  Description of Artificial Sequence: Synthetic polypeptide
DETEIATTNPVATEQYGSVATNLQGAPGPEPAD

SEQ ID NO: 88976 - protein, 32 aa, Artificial Sequence
  Description of Artificial Sequence: Synthetic polypeptide
DEGEIATTNPVAYEQWGSITSAAGNLQRGQNQ

SEQ ID NO: 88977 - protein, 34 aa, Artificial Sequence
  Description of Artificial Sequence: Synthetic polypeptide
DEEEIRTTNPVATEQYGSVSSTTPALNMHNGEPV

SEQ ID NO: 88978 - protein, 32 aa, Artificial Sequence
  Description of Artificial Sequence: Synthetic polypeptide
DEGEIATTNPVATEQYGSVSTTDLEDHEGEDL

SEQ ID NO: 88979 - protein, 33 aa, Artificial Sequence
  Description of Artificial Sequence: Synthetic polypeptide
DETEIATTNPVATEQWGSVSMSGNGGQRGVNEM

SEQ ID NO: 88980 - protein, 35 aa, Artificial Sequence
  Description of Artificial Sequence: Synthetic polypeptide
DEEEIRTTNPVATEQYGSVSSTTPALEDHEGMNDV

SEQ ID NO: 88981 - protein, 31 aa, Artificial Sequence
  Description of Artificial Sequence: Synthetic polypeptide
DETEIATTNPVATEQWGSVSNGNPDNHGNHQ

SEQ ID NO: 88982 - protein, 32 aa, Artificial Sequence
  Description of Artificial Sequence: Synthetic polypeptide
DETEIATTNPVATEQYGAVCSTIDDGERNGNA

SEQ ID NO: 88983 - protein, 33 aa, Artificial Sequence
  Description of Artificial Sequence: Synthetic polypeptide
DEGEIATTNPVATEQYGSVSATDLEPHEGEDTR

SEQ ID NO: 88984 - protein, 28 aa, Artificial Sequence
  Description of Artificial Sequence: Synthetic peptide
AESEIASTNPVGTEGYGVAAENLQRGGR

SEQ ID NO: 88985 - protein, 33 aa, Artificial Sequence
  Description of Artificial Sequence: Synthetic polypeptide
DETEIATTNPVATEQYGCVSVTINPDADGDNGR

SEQ ID NO: 88986 - protein, 32 aa, Artificial Sequence
  Description of Artificial Sequence: Synthetic polypeptide
DEGEIATTNPVATEQYGSVSATDLEDHEGEHL

SEQ ID NO: 88987 - protein, 34 aa, Artificial Sequence
  Description of Artificial Sequence: Synthetic polypeptide
DETEIATTNPVATEQYGSVAATNNLQEAGENMGE

SEQ ID NO: 88988 - protein, 32 aa, Artificial Sequence
  Description of Artificial Sequence: Synthetic polypeptide
DEGEIATTNPVATEQYGSVSATDLEDHEGEDL

SEQ ID NO: 88989 - protein, 32 aa, Artificial Sequence
  Description of Artificial Sequence: Synthetic polypeptide
DEGEIATTNPVATEQYGSVSATDLEDHEGEDA

SEQ ID NO: 88990 - protein, 31 aa, Artificial Sequence
  Description of Artificial Sequence: Synthetic polypeptide
DETEIATTNPVATEQYGSVANNPEVGGGNEQ

SEQ ID NO: 88991 - protein, 31 aa, Artificial Sequence
  Description of Artificial Sequence: Synthetic polypeptide
DDEEIRTTNPVATEQWGCVTSSELQNFGSEA

SEQ ID NO: 88992 - protein, 32 aa, Artificial Sequence
  Description of Artificial Sequence: Synthetic polypeptide
DDEEIRTTNPVATEQWGCVTSTEDLQNGSEAS

SEQ ID NO: 88993 - protein, 32 aa, Artificial Sequence
  Description of Artificial Sequence: Synthetic polypeptide
DETEIATTNPVATEQYGSVATNLTDNPENDEE

SEQ ID NO: 88994 - protein, 34 aa, Artificial Sequence
  Description of Artificial Sequence: Synthetic polypeptide
DEGEIRTTNPVATEQYGSYWSLDNMLERDDNQRP

SEQ ID NO: 88995 - protein, 33 aa, Artificial Sequence
  Description of Artificial Sequence: Synthetic polypeptide
DETEIATTNPCATETYGSVSTNLNQGDLGGNGS

SEQ ID NO: 88996 - protein, 28 aa, Artificial Sequence
  Description of Artificial Sequence: Synthetic peptide
DETEIASVNPICTEQYGVVSDNWQSGNQ

SEQ ID NO: 88997 - protein, 29 aa, Artificial Sequence
  Description of Artificial Sequence: Synthetic peptide
DEGEIRTTNPVASEQWGIVSEILMNSGTA

SEQ ID NO: 88998 - protein, 36 aa, Artificial Sequence
  Description of Artificial Sequence: Synthetic polypeptide
DEEEIRTTNPVATEQYGSVSSTTPNEPNMRNGMNPV

SEQ ID NO: 88999 - protein, 28 aa, Artificial Sequence
  Description of Artificial Sequence: Synthetic peptide
DEGEIRTTNPCSSEQWGIVSENEQSEDR

SEQ ID NO: 89000 - protein, 33 aa, Artificial Sequence
  Description of Artificial Sequence: Synthetic polypeptide
DDEEIRTTNPVATEFYGSVSTANDDGNNGGNEG

SEQ ID NO: 89001 - protein, 33 aa, Artificial Sequence
  Description of Artificial Sequence: Synthetic polypeptide
DDEEIRTTNPVATEFYGSVSTGMGDQEEGGNNE

SEQ ID NO: 89002 - protein, 36 aa, Artificial Sequence
  Description of Artificial Sequence: Synthetic polypeptide
DEEEIRTTNPVATEQYGSVSSTTPLGPNMRNGMNPV

SEQ ID NO: 89003 - protein, 31 aa, Artificial Sequence
  Description of Artificial Sequence: Synthetic polypeptide
DEGEIRPTNPVASEQYGSVSSTTAGNSGMTR

SEQ ID NO: 89004 - protein, 33 aa, Artificial Sequence
  Description of Artificial Sequence: Synthetic polypeptide
DEGEIRTTNPVATECWGSVSCINEPQDREGENG

SEQ ID NO: 89005 - protein, 34 aa, Artificial Sequence
  Description of Artificial Sequence: Synthetic polypeptide
DDEEIRTTNPVATEFYGSVSTVNGFGQENQGNGG

SEQ ID NO: 89006 - protein, 34 aa, Artificial Sequence
  Description of Artificial Sequence: Synthetic polypeptide
DEGEIATTNPVSTEQYGSVSSTTALPNMRNGNPR

SEQ ID NO: 89007 - protein, 31 aa, Artificial Sequence
  Description of Artificial Sequence: Synthetic polypeptide
DETCIRTTNPLATEQFGSVSWGNLQSFGSEQ

SEQ ID NO: 89008 - protein, 31 aa, Artificial Sequence
  Description of Artificial Sequence: Synthetic polypeptide
DETCIRTTNPLATEQWGCVCSWNLQSFGGNQ

SEQ ID NO: 89009 - protein, 31 aa, Artificial Sequence
  Description of Artificial Sequence: Synthetic polypeptide
DEGEIATTNPVSTEQYGCVATNLQDDQGDQH

SEQ ID NO: 89010 - protein, 32 aa, Artificial Sequence
  Description of Artificial Sequence: Synthetic polypeptide
DEGEIATTNPVSTECYGSVSCINEQDREGENG

SEQ ID NO: 89011 - protein, 32 aa, Artificial Sequence
  Description of Artificial Sequence: Synthetic polypeptide
DEAEIATTNPVATEQYGSVAPPNPEEADGNRS

SEQ ID NO: 89012 - protein, 32 aa, Artificial Sequence
  Description of Artificial Sequence: Synthetic polypeptide
DEAEIATTNPVATEQYGSVANTNPLNASGPES

SEQ ID NO: 89013 - protein, 31 aa, Artificial Sequence
  Description of Artificial Sequence: Synthetic polypeptide
DEGEIATTNPVSTEQYGSVSTDLEDHEGEDL

SEQ ID NO: 89014 - protein, 37 aa, Artificial Sequence
  Description of Artificial Sequence: Synthetic polypeptide
DEEEIRTTNPVATEQYGVVSVTVSTNLQAGNTEEGSE

SEQ ID NO: 89015 - protein, 33 aa, Artificial Sequence
  Description of Artificial Sequence: Synthetic polypeptide
DEGEIRTTNPVATECWGSVSCINSPQDREGENG

SEQ ID NO: 89016 - protein, 33 aa, Artificial Sequence
  Description of Artificial Sequence: Synthetic polypeptide
DEGEIRTTNPVATECYGIVSCINEPQDREGENG

SEQ ID NO: 89017 - protein, 32 aa, Artificial Sequence
  Description of Artificial Sequence: Synthetic polypeptide
DEGEIRTTNPVATEQYGCWPTINPLENRENNN

SEQ ID NO: 89018 - protein, 32 aa, Artificial Sequence
  Description of Artificial Sequence: Synthetic polypeptide
DEGEIRTTNPVATEQYGCWCVTINPLERENIN

SEQ ID NO: 89019 - protein, 33 aa, Artificial Sequence
  Description of Artificial Sequence: Synthetic polypeptide
DEGEIRTTNPVATEQYGCVSTTNDLQELQEDEF

SEQ ID NO: 89020 - protein, 30 aa, Artificial Sequence
  Description of Artificial Sequence: Synthetic polypeptide
DETCIRTTNPLATEFFGSVSFNHLQEGQEK

SEQ ID NO: 89021 - protein, 33 aa, Artificial Sequence
  Description of Artificial Sequence: Synthetic polypeptide
DEAEIATTNPVATEQYGSVATNHEEQDSGTPRS

SEQ ID NO: 89022 - protein, 37 aa, Artificial Sequence
  Description of Artificial Sequence: Synthetic polypeptide
DEEEIRTTNPVATEQYGVVSVSVTENLLQQGIGNTTD

SEQ ID NO: 89023 - protein, 33 aa, Artificial Sequence
  Description of Artificial Sequence: Synthetic polypeptide
DEAEIATTNPVATEQYGSVATGNLEPTMNPEDR

SEQ ID NO: 89024 - protein, 30 aa, Artificial Sequence
  Description of Artificial Sequence: Synthetic polypeptide
DETCIRTTNPLATEQFGCVSSEELQSGSNQ

SEQ ID NO: 89025 - protein, 36 aa, Artificial Sequence
  Description of Artificial Sequence: Synthetic polypeptide
DEEEIRTTNPVATEQYGSVSSTTPNGPNMRNGMNPV

SEQ ID NO: 89026 - protein, 32 aa, Artificial Sequence
  Description of Artificial Sequence: Synthetic polypeptide
DEGEIRTTNPVATEQYGCVSANESQFEGEDQG

SEQ ID NO: 89027 - protein, 36 aa, Artificial Sequence
  Description of Artificial Sequence: Synthetic polypeptide
DEEEIRTTNPVATEQYGSVSSTTPNGPNMRNGMNDV

SEQ ID NO: 89028 - protein, 36 aa, Artificial Sequence
  Description of Artificial Sequence: Synthetic polypeptide
DEEEIRTTNPVATEQYGSVSSTTPNGPNMRNGENPV

SEQ ID NO: 89029 - protein, 31 aa, Artificial Sequence
  Description of Artificial Sequence: Synthetic polypeptide
DEGEIRTTNPVATEQYGCVCIDVLDQETNEQ

SEQ ID NO: 89030 - protein, 29 aa, Artificial Sequence
  Description of Artificial Sequence: Synthetic peptide
DEGEIRTTNPVATEQWGIVSEILMSAETA

SEQ ID NO: 89031 - protein, 35 aa, Artificial Sequence
  Description of Artificial Sequence: Synthetic polypeptide
DEEEIRTTNPVATEQYGSVSSTTPNGNMSNGMNPV

SEQ ID NO: 89032 - protein, 31 aa, Artificial Sequence
  Description of Artificial Sequence: Synthetic polypeptide
DEGEIRTTNPVATEQFGSVVGNTEILGPPVR

SEQ ID NO: 89033 - protein, 34 aa, Artificial Sequence
  Description of Artificial Sequence: Synthetic polypeptide
DEGEIRTTNPVATEGYGSTVSQNADSQNRLGDNQ

SEQ ID NO: 89034 - protein, 32 aa, Artificial Sequence
  Description of Artificial Sequence: Synthetic polypeptide
DETDEIATTNPVAYEEWGSVSTNLQSGGDNGH

SEQ ID NO: 89035 - protein, 31 aa, Artificial Sequence
  Description of Artificial Sequence: Synthetic polypeptide
DEGEIATTNPVSTECYGIVSCINEQDREGTR

SEQ ID NO: 89036 - protein, 36 aa, Artificial Sequence
  Description of Artificial Sequence: Synthetic polypeptide
DEEEIRTTNPVATEQYGVVSVVTNNLNGNQQGENQM

SEQ ID NO: 89037 - protein, 36 aa, Artificial Sequence
  Description of Artificial Sequence: Synthetic polypeptide
DEEEIRTTNPVATEQYGVVSVVTNNLNNNQQGNNIM

SEQ ID NO: 89038 - protein, 33 aa, Artificial Sequence
  Description of Artificial Sequence: Synthetic polypeptide
DETEIACTNPVATEQYGSVATNLQDHQGGNAEM

SEQ ID NO: 89039 - protein, 35 aa, Artificial Sequence
  Description of Artificial Sequence: Synthetic polypeptide
DEEEIRTTNPVATEQYGSVSSTTPDGNMHNGMNPV

SEQ ID NO: 89040 - protein, 32 aa, Artificial Sequence
  Description of Artificial Sequence: Synthetic polypeptide
DETEIACTNPVATEQYGSVATNLQDTDGMEDA

SEQ ID NO: 89041 - protein, 32 aa, Artificial Sequence
  Description of Artificial Sequence: Synthetic polypeptide
DEGEIATTNPVAYEQYGSVCSTNLEHGDLDQM

SEQ ID NO: 89042 - protein, 32 aa, Artificial Sequence
  Description of Artificial Sequence: Synthetic polypeptide
DETEIACTNPVATEQYGSVATNLQGAGAEGTP

SEQ ID NO: 89043 - protein, 35 aa, Artificial Sequence
  Description of Artificial Sequence: Synthetic polypeptide
DEEEIRTTNPVATEQYGSVSSTTPCGPNMRGMNPV

SEQ ID NO: 89044 - protein, 35 aa, Artificial Sequence
  Description of Artificial Sequence: Synthetic polypeptide
DEEEIRTTNPVATEQYGSVSSTTPCGPNMRGMNPL

SEQ ID NO: 89045 - protein, 32 aa, Artificial Sequence
  Description of Artificial Sequence: Synthetic polypeptide
DETEIACTNPVATEQYGSVATNLQGALTEGAH

SEQ ID NO: 89046 - protein, 32 aa, Artificial Sequence
  Description of Artificial Sequence: Synthetic polypeptide
DETEIACTNPVATEQYGSVATNLQNQPTNPTP

SEQ ID NO: 89047 - protein, 32 aa, Artificial Sequence
  Description of Artificial Sequence: Synthetic polypeptide
DETEIACTNPVATEQYGSVATNLQQDDQDGEM

SEQ ID NO: 89048 - protein, 35 aa, Artificial Sequence
  Description of Artificial Sequence: Synthetic polypeptide
DEEEIRTTNPVATEQYGSVSSTTPAWPNMRNGNPV

SEQ ID NO: 89049 - protein, 32 aa, Artificial Sequence
  Description of Artificial Sequence: Synthetic polypeptide
DEGEIATTNPVAYEQYGSVATNLQRPQEQTES

SEQ ID NO: 89050 - protein, 31 aa, Artificial Sequence
  Description of Artificial Sequence: Synthetic polypeptide
DETEIACTNPVATEQYGSVATNQLNNGMGGL

SEQ ID NO: 89051 - protein, 32 aa, Artificial Sequence
  Description of Artificial Sequence: Synthetic polypeptide
DETEIACTNPVAYEQYGSVATNLQANPVGENP

SEQ ID NO: 89052 - protein, 33 aa, Artificial Sequence
  Description of Artificial Sequence: Synthetic polypeptide
DETEIACTNPVAYEQYGSVATNLQGTPDGNDRN

SEQ ID NO: 89053 - protein, 31 aa, Artificial Sequence
  Description of Artificial Sequence: Synthetic polypeptide
DETEIACTNPVAYEQYGSVATNLQNANPGEN

SEQ ID NO: 89054 - protein, 36 aa, Artificial Sequence
  Description of Artificial Sequence: Synthetic polypeptide
DEEEIRTTNPVATEQYGSVSSTTPATQNMRNGMNPP

SEQ ID NO: 89055 - protein, 31 aa, Artificial Sequence
  Description of Artificial Sequence: Synthetic polypeptide
AESEIATTNPVATEQWGEVSENEPQDRGENG

SEQ ID NO: 89056 - protein, 28 aa, Artificial Sequence
  Description of Artificial Sequence: Synthetic peptide
AESEIASTNPVGTEQYGEAAENLQRGGI

SEQ ID NO: 89057 - protein, 30 aa, Artificial Sequence
  Description of Artificial Sequence: Synthetic polypeptide
DEGEIATTNPVSSEPYGTISCNLQQSNGNR

SEQ ID NO: 89058 - protein, 30 aa, Artificial Sequence
  Description of Artificial Sequence: Synthetic polypeptide
DEGEIATTNPVSSEQWGIVSCINLQSEGTR

SEQ ID NO: 89059 - protein, 35 aa, Artificial Sequence
  Description of Artificial Sequence: Synthetic polypeptide
DEEEIRTTNPVATEQYGVVSVVTNNLNNQNGQTEM

SEQ ID NO: 89060 - protein, 32 aa, Artificial Sequence
  Description of Artificial Sequence: Synthetic polypeptide
DETDEIATTNPVAYERWGSVSTNLQGNGGDNH

SEQ ID NO: 89061 - protein, 30 aa, Artificial Sequence
  Description of Artificial Sequence: Synthetic polypeptide
DETDIRTTNPCATEQWGSVSVNEVSGMVDR

SEQ ID NO: 89062 - protein, 29 aa, Artificial Sequence
  Description of Artificial Sequence: Synthetic peptide
DEGEIATTNPVSSEQYGDVSCIEQNSGTR

SEQ ID NO: 89063 - protein, 32 aa, Artificial Sequence
  Description of Artificial Sequence: Synthetic polypeptide
DETEIACTNPVATEAYGSVATNLQDAGENAEN

SEQ ID NO: 89064 - protein, 31 aa, Artificial Sequence
  Description of Artificial Sequence: Synthetic polypeptide
DEGEIATTNPVSSEQWGSVSCINEQDREGTR

SEQ ID NO: 89065 - protein, 35 aa, Artificial Sequence
  Description of Artificial Sequence: Synthetic polypeptide
DEEEIRTTNPVATEQYGVVSVVTNQLNNQNNQNEM

SEQ ID NO: 89066 - protein, 29 aa, Artificial Sequence
  Description of Artificial Sequence: Synthetic peptide
DETEIACTNPVATEQWGEASEENWQPGGR

SEQ ID NO: 89067 - protein, 31 aa, Artificial Sequence
  Description of Artificial Sequence: Synthetic polypeptide
DETEIACTNPVATEQYGCTATNLQQGGDNQM

SEQ ID NO: 89068 - protein, 30 aa, Artificial Sequence
  Description of Artificial Sequence: Synthetic polypeptide
DETEIACTNPVATEQYGCVATNLQAEAMAV

SEQ ID NO: 89069 - protein, 32 aa, Artificial Sequence
  Description of Artificial Sequence: Synthetic polypeptide
DETEIACTNPVATEQYGCVATNLQGAEGENTA

SEQ ID NO: 89070 - protein, 36 aa, Artificial Sequence
  Description of Artificial Sequence: Synthetic polypeptide
DEEEIRTTNPVATEQYGSVSSTTPDGPNMRNGMNRH

SEQ ID NO: 89071 - protein, 33 aa, Artificial Sequence
  Description of Artificial Sequence: Synthetic polypeptide
DETEIACTNPVATEQYGCVSTNHLQEQMGNSLH

SEQ ID NO: 89072 - protein, 33 aa, Artificial Sequence
  Description of Artificial Sequence: Synthetic polypeptide
DETEIACTNPVATEQYGCVSTNLQGQAGENDAN

SEQ ID NO: 89073 - protein, 31 aa, Artificial Sequence
  Description of Artificial Sequence: Synthetic polypeptide
DETEIACTNPVATEQYGETTSEENLQERGPI

SEQ ID NO: 89074 - protein, 31 aa, Artificial Sequence
  Description of Artificial Sequence: Synthetic polypeptide
DETEIACTNPVATEQYGSCATNLQPDQEGAE

SEQ ID NO: 89075 - protein, 31 aa, Artificial Sequence
  Description of Artificial Sequence: Synthetic polypeptide
DETEIACTNPVATEQYGSVATNLEANHNMEM

SEQ ID NO: 89076 - protein, 30 aa, Artificial Sequence
  Description of Artificial Sequence: Synthetic polypeptide
DEGEIATTNPVSSEQWGIVSCINEQREGTR

SEQ ID NO: 89077 - protein, 33 aa, Artificial Sequence
  Description of Artificial Sequence: Synthetic polypeptide
DESEIRTTNPVATECWGSVSCSNEPQDREGQNG

SEQ ID NO: 89078 - protein, 33 aa, Artificial Sequence
  Description of Artificial Sequence: Synthetic polypeptide
DEGEIRTTNPVATEQYGSYWSLDNMLERDTQRM

SEQ ID NO: 89079 - protein, 34 aa, Artificial Sequence
  Description of Artificial Sequence: Synthetic polypeptide
DEEEIRTTNPVATEQYGSVSTDALTNMEETQNDD

SEQ ID NO: 89080 - protein, 33 aa, Artificial Sequence
  Description of Artificial Sequence: Synthetic polypeptide
DEHEIRTTNPCAYEQWGSVSTNLNQGDTGQNDA

SEQ ID NO: 89081 - protein, 31 aa, Artificial Sequence
  Description of Artificial Sequence: Synthetic polypeptide
DEHEIRTTNPCAYEQWGSVATNSQGNTGENH

SEQ ID NO: 89082 - protein, 32 aa, Artificial Sequence
  Description of Artificial Sequence: Synthetic polypeptide
DEHEIRTTNPCAYEQWGEVSTNLQGDLGNNDH

SEQ ID NO: 89083 - protein, 31 aa, Artificial Sequence
  Description of Artificial Sequence: Synthetic polypeptide
DESEIRTTNPVAYEAYGVVSQRISLPVGGNR

SEQ ID NO: 89084 - protein, 30 aa, Artificial Sequence
  Description of Artificial Sequence: Synthetic polypeptide
DEHEIRTTNPCAYEEWGSVATNDHGGRGNA

SEQ ID NO: 89085 - protein, 32 aa, Artificial Sequence
  Description of Artificial Sequence: Synthetic polypeptide
DEHEIRTTNPCAYEAYGISCSCTNLSARGGNS

SEQ ID NO: 89086 - protein, 32 aa, Artificial Sequence
  Description of Artificial Sequence: Synthetic polypeptide
DESEIRTTNPVAYEGWGSVTTNLQGEDGNNTN

SEQ ID NO: 89087 - protein, 31 aa, Artificial Sequence
  Description of Artificial Sequence: Synthetic polypeptide
DEHEIRTTNPVATDQWGCVNTQDGGQRGNED

SEQ ID NO: 89088 - protein, 34 aa, Artificial Sequence
  Description of Artificial Sequence: Synthetic polypeptide
DEHEIRTTNPCATEPYGSVSTGGLQDRQNENGER

SEQ ID NO: 89089 - protein, 32 aa, Artificial Sequence
  Description of Artificial Sequence: Synthetic polypeptide
DDEEIASTNPVATEQYGNVSANTINSRVGNPR

SEQ ID NO: 89090 - protein, 32 aa, Artificial Sequence
  Description of Artificial Sequence: Synthetic polypeptide
DESEIRTTNPVAYEKWGEVSTNLQGNDGQNAN

SEQ ID NO: 89091 - protein, 35 aa, Artificial Sequence
  Description of Artificial Sequence: Synthetic polypeptide
DEEEIRTTNPVATEQYGSVSTDNEAPQVRIMSDQV

SEQ ID NO: 89092 - protein, 32 aa, Artificial Sequence
  Description of Artificial Sequence: Synthetic polypeptide
DEHEIRTTNPCATECYGTVATNLQGDAGNDSD

SEQ ID NO: 89093 - protein, 33 aa, Artificial Sequence
  Description of Artificial Sequence: Synthetic polypeptide
DEHEIRTTNPCATECYGSVSTGQNDQNRQNENE

SEQ ID NO: 89094 - protein, 33 aa, Artificial Sequence
  Description of Artificial Sequence: Synthetic polypeptide
DEHEIRTTNPCATECYGSVSTGPQNDDRQGAGR

SEQ ID NO: 89095 - protein, 33 aa, Artificial Sequence
  Description of Artificial Sequence: Synthetic polypeptide
DEHEIRTTNPCATECYGSVSTGNLGNAGENGQE

SEQ ID NO: 89096 - protein, 32 aa, Artificial Sequence
  Description of Artificial Sequence: Synthetic polypeptide
DEHEIRTTNPCATEHYGSVSTMNGQPDQNENE

SEQ ID NO: 89097 - protein, 31 aa, Artificial Sequence
  Description of Artificial Sequence: Synthetic polypeptide
DEHEIRTTNPVATDQWGCVNTQDGQDRNGND

SEQ ID NO: 89098 - protein, 30 aa, Artificial Sequence
  Description of Artificial Sequence: Synthetic polypeptide
DEHEIRTTNPVATDQWGCVNTQDGQQQGND

SEQ ID NO: 89099 - protein, 32 aa, Artificial Sequence
  Description of Artificial Sequence: Synthetic polypeptide
DESEIRTTNPVAYEAWGEVSTNLQHDQGNGEQ

SEQ ID NO: 89100 - protein, 34 aa, Artificial Sequence
  Description of Artificial Sequence: Synthetic polypeptide
DEHEIRTTNPVATECYGSVCFTNEDHERGGQNTR

SEQ ID NO: 89101 - protein, 33 aa, Artificial Sequence
  Description of Artificial Sequence: Synthetic polypeptide
DEHEIRTTNPVATECWGSVSWINEPQDREGENG

SEQ ID NO: 89102 - protein, 32 aa, Artificial Sequence
  Description of Artificial Sequence: Synthetic polypeptide
DEDEICTTNPVAYEQWGTVSTNLQEGGPNNDE

SEQ ID NO: 89103 - protein, 32 aa, Artificial Sequence
  Description of Artificial Sequence: Synthetic polypeptide
DEDEICTTNPVAYEQYGTVTTGEGNQQNGNDR

SEQ ID NO: 89104 - protein, 34 aa, Artificial Sequence
  Description of Artificial Sequence: Synthetic polypeptide
DEEEIRTTNPVATEQYGSVSTDNKHSDERPMSTI

SEQ ID NO: 89105 - protein, 33 aa, Artificial Sequence
  Description of Artificial Sequence: Synthetic polypeptide
DEHEIRTTNPVATECWGSVSCINSPQDREGENG

SEQ ID NO: 89106 - protein, 33 aa, Artificial Sequence
  Description of Artificial Sequence: Synthetic polypeptide
DEHEIRTTNPVATECWGSVSCINEPQDREGENG

SEQ ID NO: 89107 - protein, 34 aa, Artificial Sequence
  Description of Artificial Sequence: Synthetic polypeptide
DEHEIRTTNPVATEAWGSVCSTDNGQQRDGNNEM

SEQ ID NO: 89108 - protein, 34 aa, Artificial Sequence
  Description of Artificial Sequence: Synthetic polypeptide
DEHEIRTTNPVATEAWGSVCSTDNGEDQRDGGNM

SEQ ID NO: 89109 - protein, 31 aa, Artificial Sequence
  Description of Artificial Sequence: Synthetic polypeptide
DEHEIRTTNPVATDQYGTCVNTQDLEQPGED

SEQ ID NO: 89110 - protein, 31 aa, Artificial Sequence
  Description of Artificial Sequence: Synthetic polypeptide
DEDEIQTTNPVAYEAYGETTSCTNLSQRGDS

SEQ ID NO: 89111 - protein, 32 aa, Artificial Sequence
  Description of Artificial Sequence: Synthetic polypeptide
ASEEIRTTNPVATEQYGVVCVTNWYQLPGDER

SEQ ID NO: 89112 - protein, 29 aa, Artificial Sequence
  Description of Artificial Sequence: Synthetic peptide
AQQEIACTNPVATEQWGTASENLQRGGRV

SEQ ID NO: 89113 - protein, 30 aa, Artificial Sequence
  Description of Artificial Sequence: Synthetic polypeptide
DEHEIRTTNPVATDQYGSVNMQLWRSIEDN

SEQ ID NO: 89114 - protein, 30 aa, Artificial Sequence
  Description of Artificial Sequence: Synthetic polypeptide
AQEEIRTTNPVATEQWGQTYSWNLTEEINR

SEQ ID NO: 89115 - protein, 30 aa, Artificial Sequence
  Description of Artificial Sequence: Synthetic polypeptide
DEHEIRTTNPVATDQYGSVNMQLQGSIQMP

SEQ ID NO: 89116 - protein, 31 aa, Artificial Sequence
  Description of Artificial Sequence: Synthetic polypeptide
DEHEIRTTNPVATDQYGSVNMQLEQRSIFDD

SEQ ID NO: 89117 - protein, 34 aa, Artificial Sequence
  Description of Artificial Sequence: Synthetic polypeptide
DEHEIRTTNPCATECYGSVSTGNLDQDRQNGGEM

SEQ ID NO: 89118 - protein, 30 aa, Artificial Sequence
  Description of Artificial Sequence: Synthetic polypeptide
CAEEIACTNPVATEQWGGSSSTNDQQDGNN

SEQ ID NO: 89119 - protein, 33 aa, Artificial Sequence
  Description of Artificial Sequence: Synthetic polypeptide
DEHEIRTTNPCATECYGSVSTGNLDNDRQNEGE

SEQ ID NO: 89120 - protein, 33 aa, Artificial Sequence
  Description of Artificial Sequence: Synthetic polypeptide
DEHEIRTTNPCATECYGSVSTGNGQERQNENHG

SEQ ID NO: 89121 - protein, 35 aa, Artificial Sequence
  Description of Artificial Sequence: Synthetic polypeptide
DEHEIATTNPVAYTEAYGISTVQSCTDALQRAGNR

SEQ ID NO: 89122 - protein, 32 aa, Artificial Sequence
  Description of Artificial Sequence: Synthetic polypeptide
DESEIRTTNPVAYEPYGSVSTGGLSQTLGGPK

SEQ ID NO: 89123 - protein, 33 aa, Artificial Sequence
  Description of Artificial Sequence: Synthetic polypeptide
DESEIRTTNPVAYEPYGSVSTGNLSDTLGGDRS

SEQ ID NO: 89124 - protein, 33 aa, Artificial Sequence
  Description of Artificial Sequence: Synthetic polypeptide
DESEIRTTNPVAYEPYGSVSTGNLSQTLGGDPH

SEQ ID NO: 89125 - protein, 34 aa, Artificial Sequence
  Description of Artificial Sequence: Synthetic polypeptide
DESEIRTTNPVAYEPYGSVSTGNLSQTLNGGPRH

SEQ ID NO: 89126 - protein, 34 aa, Artificial Sequence
  Description of Artificial Sequence: Synthetic polypeptide
DESEIRTTNPVAYEPYGSVSTGNMLSQTLGGARQ

SEQ ID NO: 89127 - protein, 33 aa, Artificial Sequence
  Description of Artificial Sequence: Synthetic polypeptide
DESEIRTTNPVAYEPYGSVSTGYSLSQTLGGDR

SEQ ID NO: 89128 - protein, 34 aa, Artificial Sequence
  Description of Artificial Sequence: Synthetic polypeptide
DESEIRTTNPVAYEPYGSVSITGNLSQTDGGDRH

SEQ ID NO: 89129 - protein, 33 aa, Artificial Sequence
  Description of Artificial Sequence: Synthetic polypeptide
DESEIRTTNPVAYEPYGSVSVTGNLSQTLGGAQ

SEQ ID NO: 89130 - protein, 32 aa, Artificial Sequence
  Description of Artificial Sequence: Synthetic polypeptide
ANDEIRTTNPVATEQYGCVMVTNNLQGMGSTR

SEQ ID NO: 89131 - protein, 32 aa, Artificial Sequence
  Description of Artificial Sequence: Synthetic polypeptide
DESEIRTTNPVAYEQWGSSYSDNWDGQRSQNR

SEQ ID NO: 89132 - protein, 29 aa, Artificial Sequence
  Description of Artificial Sequence: Synthetic peptide
DDEEIASTNPVSTEQYGNVANTIQSRGNQ

SEQ ID NO: 89133 - protein, 32 aa, Artificial Sequence
  Description of Artificial Sequence: Synthetic polypeptide
DESEIRTTNPVAYEQWGSTTPTDNGGQRQGQR

SEQ ID NO: 89134 - protein, 32 aa, Artificial Sequence
  Description of Artificial Sequence: Synthetic polypeptide
DEHEIATTNPVAYEQYGSVSTNGQNHDDNIAE

SEQ ID NO: 89135 - protein, 32 aa, Artificial Sequence
  Description of Artificial Sequence: Synthetic polypeptide
DESEIRTTNPVAYEQWGSVSTGPGQDHQQNGR

SEQ ID NO: 89136 - protein, 32 aa, Artificial Sequence
  Description of Artificial Sequence: Synthetic polypeptide
DEHEIATTNPVAYEQYGSVATNLQGTPDGSMN

SEQ ID NO: 89137 - protein, 33 aa, Artificial Sequence
  Description of Artificial Sequence: Synthetic polypeptide
DESEIRTTNPVAYEPYGSVTTGNLSQTTGGDRH

SEQ ID NO: 89138 - protein, 33 aa, Artificial Sequence
  Description of Artificial Sequence: Synthetic polypeptide
DEHEIATTNPVCTEQYGSVSTGNGNGDRGGDAR

SEQ ID NO: 89139 - protein, 33 aa, Artificial Sequence
  Description of Artificial Sequence: Synthetic polypeptide
DESEIRTTNPVAYEPYGSVSIGNLSQTLGGDRQ

SEQ ID NO: 89140 - protein, 33 aa, Artificial Sequence
  Description of Artificial Sequence: Synthetic polypeptide
DESEIRTTNPVAYEPYGSVPSTGGLSQELGGAR

SEQ ID NO: 89141 - protein, 33 aa, Artificial Sequence
  Description of Artificial Sequence: Synthetic polypeptide
DEHEIRTTNPCATECYGSVSTGNDQERQNENQE

SEQ ID NO: 89142 - protein, 34 aa, Artificial Sequence
  Description of Artificial Sequence: Synthetic polypeptide
DEHEIRTTNPCATECYGSVSTGNDEMNGRGDNMR

SEQ ID NO: 89143 - protein, 32 aa, Artificial Sequence
  Description of Artificial Sequence: Synthetic polypeptide
DEHEIRTTNPCATECYGSVSTGNDEMNGGGNQ

SEQ ID NO: 89144 - protein, 33 aa, Artificial Sequence
  Description of Artificial Sequence: Synthetic polypeptide
DESEIRTTNPVAYEPYGNVSTGNLSQVGGGDRH

SEQ ID NO: 89145 - protein, 33 aa, Artificial Sequence
  Description of Artificial Sequence: Synthetic polypeptide
DESEIRTTNPVAYEPYGSTVPSTPGSQERDNNR

SEQ ID NO: 89146 - protein, 33 aa, Artificial Sequence
  Description of Artificial Sequence: Synthetic polypeptide
DEHEIRTTNPCATECYGSVSTGGNHDMGKGDNR

SEQ ID NO: 89147 - protein, 33 aa, Artificial Sequence
  Description of Artificial Sequence: Synthetic polypeptide
DEHEIRTTNPCATECYGSVSTGDLNDQQGSNDH

SEQ ID NO: 89148 - protein, 36 aa, Artificial Sequence
  Description of Artificial Sequence: Synthetic polypeptide
DEEEIRTTNPVATEQYGVVSTVVSNNNLQAGTEEND

SEQ ID NO: 89149 - protein, 33 aa, Artificial Sequence
  Description of Artificial Sequence: Synthetic polypeptide
DEHEIRTTNPCATECYGSVSTGDLNDQQGSDER

SEQ ID NO: 89150 - protein, 33 aa, Artificial Sequence
  Description of Artificial Sequence: Synthetic polypeptide
DEHEIRTTNPCATECYGSVSTGDLNDQKGSDNH

SEQ ID NO: 89151 - protein, 34 aa, Artificial Sequence
  Description of Artificial Sequence: Synthetic polypeptide
DEHEIRTTNPCATECYGSVSTGDLNDQKGGGNTR

SEQ ID NO: 89152 - protein, 32 aa, Artificial Sequence
  Description of Artificial Sequence: Synthetic polypeptide
DEHEIRTTNPCATECYGEVSTGDNHGGKGGNR

SEQ ID NO: 89153 - protein, 33 aa, Artificial Sequence
  Description of Artificial Sequence: Synthetic polypeptide
DEHEIRCTNPVATECYGSVSTDNGGQHQNGDNL

SEQ ID NO: 89154 - protein, 33 aa, Artificial Sequence
  Description of Artificial Sequence: Synthetic polypeptide
DEHEINTTNPVAYEHYGSISCTNTSQREGGMNR

SEQ ID NO: 89155 - protein, 33 aa, Artificial Sequence
  Description of Artificial Sequence: Synthetic polypeptide
DEHEICTTNPVATECYGSVSTGNGQGGHGDNND

SEQ ID NO: 89156 - protein, 37 aa, Artificial Sequence
  Description of Artificial Sequence: Synthetic polypeptide
DEEEIRTTNPVATEQYGVVSTVVSNTNLQQGTEEGNT

SEQ ID NO: 89157 - protein, 32 aa, Artificial Sequence
  Description of Artificial Sequence: Synthetic polypeptide
DEHEIATTNPVSTEQYGSVATNLQDAGPGEEA

SEQ ID NO: 89158 - protein, 32 aa, Artificial Sequence
  Description of Artificial Sequence: Synthetic polypeptide
DESEIRTTNPVAYEPYGMVSTGNLSQTLGGDS

SEQ ID NO: 89159 - protein, 34 aa, Artificial Sequence
  Description of Artificial Sequence: Synthetic polypeptide
DDECIRTTNPVATEQYGKVPSCTNHQRTVGNNLM

SEQ ID NO: 89160 - protein, 31 aa, Artificial Sequence
  Description of Artificial Sequence: Synthetic polypeptide
DESEIRTTNPVATTHWGSVCTWEDQRGTNNM

SEQ ID NO: 89161 - protein, 31 aa, Artificial Sequence
  Description of Artificial Sequence: Synthetic polypeptide
DDECIRTTNPVATEQYGCVCSWEHQRFNSDL

SEQ ID NO: 89162 - protein, 33 aa, Artificial Sequence
  Description of Artificial Sequence: Synthetic polypeptide
DESEIRTTNPVATERWGSVSYINEPQDREGENG

SEQ ID NO: 89163 - protein, 32 aa, Artificial Sequence
  Description of Artificial Sequence: Synthetic polypeptide
DEHEIRTTNPVATEQYGSVSEPTLEDFGSLDG

SEQ ID NO: 89164 - protein, 33 aa, Artificial Sequence
  Description of Artificial Sequence: Synthetic polypeptide
DEHEIRTTNPVATEQYGSVSEDMTNRQEVSEGD

SEQ ID NO: 89165 - protein, 33 aa, Artificial Sequence
  Description of Artificial Sequence: Synthetic polypeptide
DESEIRTTNPVATESWGSVSCINEEQSREGENG

SEQ ID NO: 89166 - protein, 33 aa, Artificial Sequence
  Description of Artificial Sequence: Synthetic polypeptide
DESEIRTTNPVATESWGSVSCINEPQDREGENG

SEQ ID NO: 89167 - protein, 33 aa, Artificial Sequence
  Description of Artificial Sequence: Synthetic polypeptide
DESEIRTTNPVATESWGSVSGINEPQIREGENG

SEQ ID NO: 89168 - protein, 34 aa, Artificial Sequence
  Description of Artificial Sequence: Synthetic polypeptide
DESEIRTTNPVATESYGKVQSTDNALSTAGGENR

SEQ ID NO: 89169 - protein, 33 aa, Artificial Sequence
  Description of Artificial Sequence: Synthetic polypeptide
DESEIRTTNPVATERWGSVSCINEPQDREGENG

SEQ ID NO: 89170 - protein, 34 aa, Artificial Sequence
  Description of Artificial Sequence: Synthetic polypeptide
DESEIRTTNPVATESYGQVQSTDNLSTAPGGENR

SEQ ID NO: 89171 - protein, 34 aa, Artificial Sequence
  Description of Artificial Sequence: Synthetic polypeptide
DESEIRTTNPVATESYGSVSTPEVLRQNVGQNDW

SEQ ID NO: 89172 - protein, 34 aa, Artificial Sequence
  Description of Artificial Sequence: Synthetic polypeptide
DEHEIRTTNPVATEQYGSVHFPVMPLQDRGTNVF

SEQ ID NO: 89173 - protein, 35 aa, Artificial Sequence
  Description of Artificial Sequence: Synthetic polypeptide
DEDEIATTNPVAYEQYGVSVPSATNDLDQTRGNQT

SEQ ID NO: 89174 - protein, 35 aa, Artificial Sequence
  Description of Artificial Sequence: Synthetic polypeptide
DEEEIRTTNPVATEQYGSVSTDPMPLAIRQGIEIE

SEQ ID NO: 89175 - protein, 33 aa, Artificial Sequence
  Description of Artificial Sequence: Synthetic polypeptide
DESEIRTTNPVATETWGSVSCINEPQDREGENG

SEQ ID NO: 89176 - protein, 30 aa, Artificial Sequence
  Description of Artificial Sequence: Synthetic polypeptide
CAEEIRTTNPVATETYGSVCMNEQFGGPES

SEQ ID NO: 89177 - protein, 35 aa, Artificial Sequence
  Description of Artificial Sequence: Synthetic polypeptide
DEEEIRTTNPVATEQYGSVSTDNYVQSPQNEEIVD

SEQ ID NO: 89178 - protein, 34 aa, Artificial Sequence
  Description of Artificial Sequence: Synthetic polypeptide
DEDEIATTNPVAYEQYGVSVPAATNDLDQSGNQR

SEQ ID NO: 89179 - protein, 33 aa, Artificial Sequence
  Description of Artificial Sequence: Synthetic polypeptide
DESEIRTTNPVATERAGSVSCINEPQDREGENG

SEQ ID NO: 89180 - protein, 33 aa, Artificial Sequence
  Description of Artificial Sequence: Synthetic polypeptide
DEHEIRTTNPVATEQYGSVSPTNDLELFELQQE

SEQ ID NO: 89181 - protein, 34 aa, Artificial Sequence
  Description of Artificial Sequence: Synthetic polypeptide
DEHEIRTTNPVATEQYGSVSPWNDLERNELNPQE

SEQ ID NO: 89182 - protein, 31 aa, Artificial Sequence
  Description of Artificial Sequence: Synthetic polypeptide
DEDEIATTNPVAYEQYGSVSANNDRGTTPEE

SEQ ID NO: 89183 - protein, 35 aa, Artificial Sequence
  Description of Artificial Sequence: Synthetic polypeptide
DEEEIRTTNPVATEQYGSVSTDVLPQFTSISQQRP

SEQ ID NO: 89184 - protein, 34 aa, Artificial Sequence
  Description of Artificial Sequence: Synthetic polypeptide
DESEIRTTNPVATEQYGVVDTGDLGQRGEGNGDD

SEQ ID NO: 89185 - protein, 35 aa, Artificial Sequence
  Description of Artificial Sequence: Synthetic polypeptide
DEEEIRTTNPVATEQYGSVSTDVGPQVRPFGSQDS

SEQ ID NO: 89186 - protein, 35 aa, Artificial Sequence
  Description of Artificial Sequence: Synthetic polypeptide
DEEEIRTTNPVATEQYGSVSTDVGPQVRKSNSQDI

SEQ ID NO: 89187 - protein, 33 aa, Artificial Sequence
  Description of Artificial Sequence: Synthetic polypeptide
DEEEIRTTNPVATEQYGSVSTDVGPQVITSSQD

SEQ ID NO: 89188 - protein, 33 aa, Artificial Sequence
  Description of Artificial Sequence: Synthetic polypeptide
DEEEIRTTNPVATEQYGSVSTDVDDTANEENQD

SEQ ID NO: 89189 - protein, 32 aa, Artificial Sequence
  Description of Artificial Sequence: Synthetic polypeptide
DEDEIATTNPVAYEQYGSVSTNDTQTDNNDEQ

SEQ ID NO: 89190 - protein, 33 aa, Artificial Sequence
  Description of Artificial Sequence: Synthetic polypeptide
DEEEIRTTNPVATEQYGSVSTDTMGDSNEFNSV

SEQ ID NO: 89191 - protein, 34 aa, Artificial Sequence
  Description of Artificial Sequence: Synthetic polypeptide
DEEEIRTTNPVATEQYGSVSTDTMDDSNFDNGGD

SEQ ID NO: 89192 - protein, 31 aa, Artificial Sequence
  Description of Artificial Sequence: Synthetic polypeptide
DEDEIATTNPVAYEQYGSVSTNNDPNGTPEE

SEQ ID NO: 89193 - protein, 34 aa, Artificial Sequence
  Description of Artificial Sequence: Synthetic polypeptide
DEEEIRTTNPVATEQYGSVSTDTLAARVLDQDPT

SEQ ID NO: 89194 - protein, 34 aa, Artificial Sequence
  Description of Artificial Sequence: Synthetic polypeptide
DESEIRTTNPVATEQYGVVSNTGDLGQEGEGNGD

SEQ ID NO: 89195 - protein, 32 aa, Artificial Sequence
  Description of Artificial Sequence: Synthetic polypeptide
DEHEIRTTNPVATEQYGSVSQDVLTEINMNQE

SEQ ID NO: 89196 - protein, 35 aa, Artificial Sequence
  Description of Artificial Sequence: Synthetic polypeptide
DESEIRTTNPVATEQYGVVSVTGILGQRGEGNEDD

SEQ ID NO: 89197 - protein, 35 aa, Artificial Sequence
  Description of Artificial Sequence: Synthetic polypeptide
DEEEIRTTNPVATEQYGSVSTDTGLLGSGGQNQGD

SEQ ID NO: 89198 - protein, 33 aa, Artificial Sequence
  Description of Artificial Sequence: Synthetic polypeptide
DESEIRTTNPVATEQYGVVVSTGNELSQHTVSP

SEQ ID NO: 89199 - protein, 34 aa, Artificial Sequence
  Description of Artificial Sequence: Synthetic polypeptide
DEHEIRTTNPVATEQYGSVCYTNDHEQERDMDIR

SEQ ID NO: 89200 - protein, 33 aa, Artificial Sequence
  Description of Artificial Sequence: Synthetic polypeptide
DESEIRTTNPVATEVWGSVSCINEPQDREGENG

SEQ ID NO: 89201 - protein, 33 aa, Artificial Sequence
  Description of Artificial Sequence: Synthetic polypeptide
DESEIRTTNPVATEVWGSVSCINEPQFREGENG

SEQ ID NO: 89202 - protein, 30 aa, Artificial Sequence
  Description of Artificial Sequence: Synthetic polypeptide
DEHEIRTTNPVATEQYGSCSVTPMETELED

SEQ ID NO: 89203 - protein, 30 aa, Artificial Sequence
  Description of Artificial Sequence: Synthetic polypeptide
DEDEIATVNPVATEQYGCVATGLAAIAGNH

SEQ ID NO: 89204 - protein, 31 aa, Artificial Sequence
  Description of Artificial Sequence: Synthetic polypeptide
DEDEIATVNPVATEQYGCVATNLAADGGNHA

SEQ ID NO: 89205 - protein, 30 aa, Artificial Sequence
  Description of Artificial Sequence: Synthetic polypeptide
DEDEIATVNPVATEQYGCVATNLAAGGEHK

SEQ ID NO: 89206 - protein, 33 aa, Artificial Sequence
  Description of Artificial Sequence: Synthetic polypeptide
DEHEIRTTNPVATEIYGSVCCNENLQRDGMTMD

SEQ ID NO: 89207 - protein, 32 aa, Artificial Sequence
  Description of Artificial Sequence: Synthetic polypeptide
DDECIRTTNPVATEQYGCVCSTEHNQRFNSNL

SEQ ID NO: 89208 - protein, 31 aa, Artificial Sequence
  Description of Artificial Sequence: Synthetic polypeptide
DEDEIATVNPVATEQYGCVATNLAAPGGNQH

SEQ ID NO: 89209 - protein, 31 aa, Artificial Sequence
  Description of Artificial Sequence: Synthetic polypeptide
DEDEIATVNPVATEQYGCVATNLADAGGNVH

SEQ ID NO: 89210 - protein, 31 aa, Artificial Sequence
  Description of Artificial Sequence: Synthetic polypeptide
DEDEIATVNPVATEQYGCVATNLADAGMGNH

SEQ ID NO: 89211 - protein, 31 aa, Artificial Sequence
  Description of Artificial Sequence: Synthetic polypeptide
DDECIRTTNPVATEQYGCVCSTEHQSFISNL

SEQ ID NO: 89212 - protein, 32 aa, Artificial Sequence
  Description of Artificial Sequence: Synthetic polypeptide
DDECIRTTNPVATEQYGCVCSTNHQHFVSNQG

SEQ ID NO: 89213 - protein, 31 aa, Artificial Sequence
  Description of Artificial Sequence: Synthetic polypeptide
DDECIRTTNPVATEQYGCVCSTNHQYFISDQ

SEQ ID NO: 89214 - protein, 32 aa, Artificial Sequence
  Description of Artificial Sequence: Synthetic polypeptide
DDECIRTTNPVATEQYGCVCSTNHQYFNSDLI

SEQ ID NO: 89215 - protein, 34 aa, Artificial Sequence
  Description of Artificial Sequence: Synthetic polypeptide
DEDEICTTNPVATECYGSVSTGGNMQGEQGGNTR

SEQ ID NO: 89216 - protein, 33 aa, Artificial Sequence
  Description of Artificial Sequence: Synthetic polypeptide
DEDEICTTNPVATEQYGSVAANLQANPGDNTAM

SEQ ID NO: 89217 - protein, 32 aa, Artificial Sequence
  Description of Artificial Sequence: Synthetic polypeptide
DESEIRTTNPVATTAWGSVAWTENDDQRTGNM

SEQ ID NO: 89218 - protein, 30 aa, Artificial Sequence
  Description of Artificial Sequence: Synthetic polypeptide
DDECIRTTNPVATEQYGCVCSWEHQNNSNL

SEQ ID NO: 89219 - protein, 34 aa, Artificial Sequence
  Description of Artificial Sequence: Synthetic polypeptide
DEDEICTTNPVATERYGSVVSLTGNALSQAGGNS

SEQ ID NO: 89220 - protein, 31 aa, Artificial Sequence
  Description of Artificial Sequence: Synthetic polypeptide
DESEIRTTNPVATNHYGTSVGTTNQNERTNN

SEQ ID NO: 89221 - protein, 32 aa, Artificial Sequence
  Description of Artificial Sequence: Synthetic polypeptide
DEHEIATTNPVAYEQWGSVSTNLQGNMGDGQQ

SEQ ID NO: 89222 - protein, 30 aa, Artificial Sequence
  Description of Artificial Sequence: Synthetic polypeptide
DEDEIATVNPVATEQYGCVAANGLAAGGNH

SEQ ID NO: 89223 - protein, 32 aa, Artificial Sequence
  Description of Artificial Sequence: Synthetic polypeptide
DESEIRTTNPVATMCWGSVSCINEPQDRGENG

SEQ ID NO: 89224 - protein, 31 aa, Artificial Sequence
  Description of Artificial Sequence: Synthetic polypeptide
DEHEIRTTNPVATEQYGCVSTVEDMQEDEQN

SEQ ID NO: 89225 - protein, 33 aa, Artificial Sequence
  Description of Artificial Sequence: Synthetic polypeptide
DESEIRTTNPVATEVWGSVSCINEPQIREGENG

SEQ ID NO: 89226 - protein, 33 aa, Artificial Sequence
  Description of Artificial Sequence: Synthetic polypeptide
DDCEIRTTNPVATEQYGSVSDTTWDLETRSQNI

SEQ ID NO: 89227 - protein, 32 aa, Artificial Sequence
  Description of Artificial Sequence: Synthetic polypeptide
DDCEIRTTNPVATEQYGVVSTKLENRIQSNND

SEQ ID NO: 89228 - protein, 32 aa, Artificial Sequence
  Description of Artificial Sequence: Synthetic polypeptide
DDCEIRTTNPVATEQYGVVSTKLENRMPSLNN

SEQ ID NO: 89229 - protein, 33 aa, Artificial Sequence
  Description of Artificial Sequence: Synthetic polypeptide
DESEIRTTNPVATEVWGSVSCINFPQDREGENG

SEQ ID NO: 89230 - protein, 32 aa, Artificial Sequence
  Description of Artificial Sequence: Synthetic polypeptide
DEHEIRTTNPVATEQYGCVSTDVDMQEDFERF

SEQ ID NO: 89231 - protein, 33 aa, Artificial Sequence
  Description of Artificial Sequence: Synthetic polypeptide
DESEIRTTNPVATEWWGSVSCFNEPQDREGENG

SEQ ID NO: 89232 - protein, 33 aa, Artificial Sequence
  Description of Artificial Sequence: Synthetic polypeptide
DESEIRTTNPVATEWWGSVSCINEPQDREGENG

SEQ ID NO: 89233 - protein, 32 aa, Artificial Sequence
  Description of Artificial Sequence: Synthetic polypeptide
DEHEIRTTNPVATEQYGCVSTDNDMQEDSEDF

SEQ ID NO: 89234 - protein, 33 aa, Artificial Sequence
  Description of Artificial Sequence: Synthetic polypeptide
DESEIRTTNPVATEYWGSVSCINEPQDREGENG

SEQ ID NO: 89235 - protein, 33 aa, Artificial Sequence
  Description of Artificial Sequence: Synthetic polypeptide
DDCEIRTTNPVATEQYGVVSTKLENRYPGNNDK

SEQ ID NO: 89236 - protein, 33 aa, Artificial Sequence
  Description of Artificial Sequence: Synthetic polypeptide
DESEIRTTNPVATEYWGSVSWPNENQDREGSNQ

SEQ ID NO: 89237 - protein, 31 aa, Artificial Sequence
  Description of Artificial Sequence: Synthetic polypeptide
DESEIRTTNPVATKHYGSVWTTNQCERTNNN

SEQ ID NO: 89238 - protein, 33 aa, Artificial Sequence
  Description of Artificial Sequence: Synthetic polypeptide
DEDEIATTNPVAYEVYGSVCATNLDTDRGGNDR

SEQ ID NO: 89239 - protein, 33 aa, Artificial Sequence
  Description of Artificial Sequence: Synthetic polypeptide
DEHEIRTTNPVATEQWGSISHTDNDTQNGEGLR

SEQ ID NO: 89240 - protein, 30 aa, Artificial Sequence
  Description of Artificial Sequence: Synthetic polypeptide
DEDEIATTNPVSTEQWGSVAMNLQGGQSTH

SEQ ID NO: 89241 - protein, 33 aa, Artificial Sequence
  Description of Artificial Sequence: Synthetic polypeptide
DESEIRTTNPVATMCWGSVSCINLPQDREGENG

SEQ ID NO: 89242 - protein, 37 aa, Artificial Sequence
  Description of Artificial Sequence: Synthetic polypeptide
DEEEIRTTNPVATEQYGVVSTVVSTTNLQQGNTEAGS

SEQ ID NO: 89243 - protein, 32 aa, Artificial Sequence
  Description of Artificial Sequence: Synthetic polypeptide
DEHEIATTNPVAYEQWGSVSTNLNGDHGNETG

SEQ ID NO: 89244 - protein, 33 aa, Artificial Sequence
  Description of Artificial Sequence: Synthetic polypeptide
DESEIRTTNPVAYEQWGSVSTNLQGMQGGGGGS

SEQ ID NO: 89245 - protein, 33 aa, Artificial Sequence
  Description of Artificial Sequence: Synthetic polypeptide
DEEEIRTTNPVATEQYGSVSTDIDTTASVEEGR

SEQ ID NO: 89246 - protein, 31 aa, Artificial Sequence
  Description of Artificial Sequence: Synthetic polypeptide
DEGEIVTTNPVATEQYGTVCSTDGPQFEGTD

SEQ ID NO: 89247 - protein, 31 aa, Artificial Sequence
  Description of Artificial Sequence: Synthetic polypeptide
DEGEIVTTNPVATEQYGTVCSTDGPEFEGND

SEQ ID NO: 89248 - protein, 33 aa, Artificial Sequence
  Description of Artificial Sequence: Synthetic polypeptide
DEGEIVTTNPVATEQYGTVCSATDGLVQSEGND

SEQ ID NO: 89249 - protein, 32 aa, Artificial Sequence
  Description of Artificial Sequence: Synthetic polypeptide
DEGEIVTTNPVATEQYGIVSATDGPVEFEGNR

SEQ ID NO: 89250 - protein, 30 aa, Artificial Sequence
  Description of Artificial Sequence: Synthetic polypeptide
DEGEIVTTNPCATEQYGTVSTDGPQFEGTD

SEQ ID NO: 89251 - protein, 30 aa, Artificial Sequence
  Description of Artificial Sequence: Synthetic polypeptide
DEGEIVTTNPCASEQYGIVSTDNPQSEGTD

SEQ ID NO: 89252 - protein, 34 aa, Artificial Sequence
  Description of Artificial Sequence: Synthetic polypeptide
DEDEIRTTNPCATEQYGSVSTGNLNGNAGENDKE

SEQ ID NO: 89253 - protein, 31 aa, Artificial Sequence
  Description of Artificial Sequence: Synthetic polypeptide
DEGEITTTNPVATECYGWVSTELQIVNGEDT

SEQ ID NO: 89254 - protein, 30 aa, Artificial Sequence
  Description of Artificial Sequence: Synthetic polypeptide
DESEIRTTNPVSTEPYGVISSEDLQQQGNI

SEQ ID NO: 89255 - protein, 33 aa, Artificial Sequence
  Description of Artificial Sequence: Synthetic polypeptide
DEGEIRTTNPVSTECWGSVSCINEPQDREGENR

SEQ ID NO: 89256 - protein, 35 aa, Artificial Sequence
  Description of Artificial Sequence: Synthetic polypeptide
DEDEIRTTNPCATEQYGSVSTVNNLQQGNAGENDE

SEQ ID NO: 89257 - protein, 31 aa, Artificial Sequence
  Description of Artificial Sequence: Synthetic polypeptide
DEGEIRTTNPVSSEQYGIVSCENLQQQNGTH

SEQ ID NO: 89258 - protein, 32 aa, Artificial Sequence
  Description of Artificial Sequence: Synthetic polypeptide
DEGEIRTTNPVAYEQYGSVDSLRNRQSGDTVG

SEQ ID NO: 89259 - protein, 35 aa, Artificial Sequence
  Description of Artificial Sequence: Synthetic polypeptide
DEEEIRTTNPVATEQYGSVSTDGTLIPNQEQNDEL

SEQ ID NO: 89260 - protein, 33 aa, Artificial Sequence
  Description of Artificial Sequence: Synthetic polypeptide
DEDEIRTTNPCATEQYGSVSTVNQGNAGENGNE

SEQ ID NO: 89261 - protein, 32 aa, Artificial Sequence
  Description of Artificial Sequence: Synthetic polypeptide
DEGEIRTTNPVSTECYGIVSCINEQDREGENG

SEQ ID NO: 89262 - protein, 33 aa, Artificial Sequence
  Description of Artificial Sequence: Synthetic polypeptide
DEGNEIATTNPVAYEQWGSVSTNAQHDEGGDNR

SEQ ID NO: 89263 - protein, 30 aa, Artificial Sequence
  Description of Artificial Sequence: Synthetic polypeptide
DEGQIATTNPVAYEQYGSVSTHEPLNEENT

SEQ ID NO: 89264 - protein, 32 aa, Artificial Sequence
  Description of Artificial Sequence: Synthetic polypeptide
DEGQIRCTNPVATEQYGCSVSTTLEELRGQDT

SEQ ID NO: 89265 - protein, 32 aa, Artificial Sequence
  Description of Artificial Sequence: Synthetic polypeptide
DESEIRTTNPVSSEQWGSVSCINEPQDREGTR

SEQ ID NO: 89266 - protein, 33 aa, Artificial Sequence
  Description of Artificial Sequence: Synthetic polypeptide
DESEIRTTNPVSTECWGSVSCINLPQDREGENG

SEQ ID NO: 89267 - protein, 33 aa, Artificial Sequence
  Description of Artificial Sequence: Synthetic polypeptide
DEDEIRTTNPCATECYGSVSTGNTGNAGEHNGR

SEQ ID NO: 89268 - protein, 32 aa, Artificial Sequence
  Description of Artificial Sequence: Synthetic polypeptide
DESEIRTTNPVSTECYGSVSCENIPQQQEGNH

SEQ ID NO: 89269 - protein, 33 aa, Artificial Sequence
  Description of Artificial Sequence: Synthetic polypeptide
DEDEIRTTNPCATECYGSVSTGNTGNAGENGRG

SEQ ID NO: 89270 - protein, 32 aa, Artificial Sequence
  Description of Artificial Sequence: Synthetic polypeptide
DESEIRTTNPVSTECYGSVSCENIPQQQNGNH

SEQ ID NO: 89271 - protein, 33 aa, Artificial Sequence
  Description of Artificial Sequence: Synthetic polypeptide
DEDEIRTTNPCATECYGSVSTGNTQGNAGENAE

SEQ ID NO: 89272 - protein, 30 aa, Artificial Sequence
  Description of Artificial Sequence: Synthetic polypeptide
DEGTIGTTNPVATEQYGVADTNLIGGGNGD

SEQ ID NO: 89273 - protein, 33 aa, Artificial Sequence
  Description of Artificial Sequence: Synthetic polypeptide
DEDEIRTTNPCATECYGTVSTGNGDDGRGGNTR

SEQ ID NO: 89274 - protein, 32 aa, Artificial Sequence
  Description of Artificial Sequence: Synthetic polypeptide
DEDEIRTTNPCATECYGVVSTGNTGNAGENRE

SEQ ID NO: 89275 - protein, 33 aa, Artificial Sequence
  Description of Artificial Sequence: Synthetic polypeptide
DEDEIRTTNPCATEGYGSVSTGNLGNAGENGNE

SEQ ID NO: 89276 - protein, 32 aa, Artificial Sequence
  Description of Artificial Sequence: Synthetic polypeptide
DESEIRTTNPVSTEPYGSVSCENIPQQQNGNH

SEQ ID NO: 89277 - protein, 33 aa, Artificial Sequence
  Description of Artificial Sequence: Synthetic polypeptide
DEDEIRTTNPCATEQYGEVSTGNLGNAGENGAE

SEQ ID NO: 89278 - protein, 33 aa, Artificial Sequence
  Description of Artificial Sequence: Synthetic polypeptide
DDEEIRCTNPVATEQYGCVCSTGNLQESSGSQQ

SEQ ID NO: 89279 - protein, 34 aa, Artificial Sequence
  Description of Artificial Sequence: Synthetic polypeptide
DEDEIRTTNPCATEQYGSVSTGNGLNGNAGENTE

SEQ ID NO: 89280 - protein, 32 aa, Artificial Sequence
  Description of Artificial Sequence: Synthetic polypeptide
DDEEIRCTNPVATEQYGCVCSTNLAENSGSQQ

SEQ ID NO: 89281 - protein, 31 aa, Artificial Sequence
  Description of Artificial Sequence: Synthetic polypeptide
DEGQIRCTNPVATEQYGMVSTLEDELRGNDT

SEQ ID NO: 89282 - protein, 34 aa, Artificial Sequence
  Description of Artificial Sequence: Synthetic polypeptide
DEGEIRTTNPVAYEQYGSVCCTGNLSITRGGTYR

SEQ ID NO: 89283 - protein, 31 aa, Artificial Sequence
  Description of Artificial Sequence: Synthetic polypeptide
DDEEIRCTNPVAYEQYGCQVSTNHQNFGSDQ

SEQ ID NO: 89284 - protein, 34 aa, Artificial Sequence
  Description of Artificial Sequence: Synthetic polypeptide
DEGEIRTTNPVAYEQYGSTVSCTDELSGQGTNSR

SEQ ID NO: 89285 - protein, 34 aa, Artificial Sequence
  Description of Artificial Sequence: Synthetic polypeptide
DEDEIRTTNPCATEQYGTVSTVNNLQGNAGENEE

SEQ ID NO: 89286 - protein, 34 aa, Artificial Sequence
  Description of Artificial Sequence: Synthetic polypeptide
DESEIRTTNPVSTEQYGSVSTTTGPQMRNGMNPV

SEQ ID NO: 89287 - protein, 33 aa, Artificial Sequence
  Description of Artificial Sequence: Synthetic polypeptide
DESEIRTTNPYATECWGSVSCINLPQDREGENG

SEQ ID NO: 89288 - protein, 33 aa, Artificial Sequence
  Description of Artificial Sequence: Synthetic polypeptide
DESEIRTTNQVATECWGSVSCINELQDREGENG

SEQ ID NO: 89289 - protein, 33 aa, Artificial Sequence
  Description of Artificial Sequence: Synthetic polypeptide
DEDEIRTTNPCAYEQWGSVSTNLNQGDTGQGNE

SEQ ID NO: 89290 - protein, 31 aa, Artificial Sequence
  Description of Artificial Sequence: Synthetic polypeptide
DEGEIRTTNPVATYHYGSVSDTLNETEGLDM

SEQ ID NO: 89291 - protein, 35 aa, Artificial Sequence
  Description of Artificial Sequence: Synthetic polypeptide
DESEIRVTNPVATEQYGSVCSGVNDQDDRQGSNSR

SEQ ID NO: 89292 - protein, 33 aa, Artificial Sequence
  Description of Artificial Sequence: Synthetic polypeptide
DEDEIRTTNPCSTEQYGSVSTGNLGNAGENHGE

SEQ ID NO: 89293 - protein, 33 aa, Artificial Sequence
  Description of Artificial Sequence: Synthetic polypeptide
DESEISTTNPVATECYGCSVVVITNLEQRDGEA

SEQ ID NO: 89294 - protein, 31 aa, Artificial Sequence
  Description of Artificial Sequence: Synthetic polypeptide
DEGEIRTTNPVATMHYGSCSDTLNLTEGTDM

SEQ ID NO: 89295 - protein, 33 aa, Artificial Sequence
  Description of Artificial Sequence: Synthetic polypeptide
DEGEIRTTNPVATGHYGSVSDTLNLTEGTNDDM

SEQ ID NO: 89296 - protein, 32 aa, Artificial Sequence
  Description of Artificial Sequence: Synthetic polypeptide
DDEEIRSTNPVATEQYGCVCSSELQERSGSQQ

SEQ ID NO: 89297 - protein, 35 aa, Artificial Sequence
  Description of Artificial Sequence: Synthetic polypeptide
DEEEIRTTNPVATEQYGSVSTDANVQSFQGEEIID

SEQ ID NO: 89298 - protein, 33 aa, Artificial Sequence
  Description of Artificial Sequence: Synthetic polypeptide
DDEEIRSTNPVATEQYGCVCSTNHQERSGSQQL

SEQ ID NO: 89299 - protein, 33 aa, Artificial Sequence
  Description of Artificial Sequence: Synthetic polypeptide
DEGEIRTTNPVATEQYGVCSVLDLQRSGNEDGF

SEQ ID NO: 89300 - protein, 34 aa, Artificial Sequence
  Description of Artificial Sequence: Synthetic polypeptide
DEEEIRTTNPVATEQYGSVSTDALTNWTETQNDG

SEQ ID NO: 89301 - protein, 33 aa, Artificial Sequence
  Description of Artificial Sequence: Synthetic polypeptide
DDEEIRSTNPVATEQYGCVCSTNLQESSGSQQG

SEQ ID NO: 89302 - protein, 34 aa, Artificial Sequence
  Description of Artificial Sequence: Synthetic polypeptide
DEEEIRTTNPVATEQYGSVSTDALTNTESTQNDG

SEQ ID NO: 89303 - protein, 34 aa, Artificial Sequence
  Description of Artificial Sequence: Synthetic polypeptide
DEEEIRTTNPVATEQYGSVSTDEDLQQDILVEHN

SEQ ID NO: 89304 - protein, 34 aa, Artificial Sequence
  Description of Artificial Sequence: Synthetic polypeptide
DEDEIRTTNPCATECYGSVSTGNNLQGNAGENTE

SEQ ID NO: 89305 - protein, 33 aa, Artificial Sequence
  Description of Artificial Sequence: Synthetic polypeptide
DEGEIRTTNPVAYEPDGSTVPSTPGSQRGNNRH

SEQ ID NO: 89306 - protein, 34 aa, Artificial Sequence
  Description of Artificial Sequence: Synthetic polypeptide
DEGEIRTTNPVAYEPYGSTVPSTPESQNRGGNNR

SEQ ID NO: 89307 - protein, 33 aa, Artificial Sequence
  Description of Artificial Sequence: Synthetic polypeptide
DEGEIRTTNPVAYEQYGCTVQTAELSITRVGNR

SEQ ID NO: 89308 - protein, 33 aa, Artificial Sequence
  Description of Artificial Sequence: Synthetic polypeptide
DEGEIRTTNPVAYEQWGYTISPNELQDRDGMNR

SEQ ID NO: 89309 - protein, 32 aa, Artificial Sequence
  Description of Artificial Sequence: Synthetic polypeptide
DEGEIRTTNPVAYEQWGYTISPNEGDQRGNDR

SEQ ID NO: 89310 - protein, 34 aa, Artificial Sequence
  Description of Artificial Sequence: Synthetic polypeptide
DEEEIRTTNPVATEQYGSVSTDGFGQNEEENFGE

SEQ ID NO: 89311 - protein, 34 aa, Artificial Sequence
  Description of Artificial Sequence: Synthetic polypeptide
DEEEIRTTNPVATEQYGSVSTDGDGQNEEENGQY

SEQ ID NO: 89312 - protein, 31 aa, Artificial Sequence
  Description of Artificial Sequence: Synthetic polypeptide
DEGEIRTTNPVAYEQWGSVCTGLIREMNNSE

SEQ ID NO: 89313 - protein, 35 aa, Artificial Sequence
  Description of Artificial Sequence: Synthetic polypeptide
DEEEIRTTNPVATEQYGSVSTDGDGQGEEEGNDGV

SEQ ID NO: 89314 - protein, 33 aa, Artificial Sequence
  Description of Artificial Sequence: Synthetic polypeptide
DEEEIRTTNPVATEQYGSVSTDGDGQGEEEEIV

SEQ ID NO: 89315 - protein, 30 aa, Artificial Sequence
  Description of Artificial Sequence: Synthetic polypeptide
DESEIRTTNPVSTEQWGSVTGDNHQGQGQT

SEQ ID NO: 89316 - protein, 32 aa, Artificial Sequence
  Description of Artificial Sequence: Synthetic polypeptide
DEGEIRTTNPVAYEQWGSVCQTDLIDREMNNR

SEQ ID NO: 89317 - protein, 31 aa, Artificial Sequence
  Description of Artificial Sequence: Synthetic polypeptide
DEGEIRTTNPVAYEQWGSVCCTGGIREMNNR

SEQ ID NO: 89318 - protein, 31 aa, Artificial Sequence
  Description of Artificial Sequence: Synthetic polypeptide
DEGEIRTTNPVAYEQWGSCCTALIREMNDER

SEQ ID NO: 89319 - protein, 34 aa, Artificial Sequence
  Description of Artificial Sequence: Synthetic polypeptide
DEGEIRTTNPVAYEPYGSTVSSYTPGSQNRGNNR

SEQ ID NO: 89320 - protein, 30 aa, Artificial Sequence
  Description of Artificial Sequence: Synthetic polypeptide
DESEIRTTNPVSTEQYGNVSNTEMNRAEDA

SEQ ID NO: 89321 - protein, 28 aa, Artificial Sequence
  Description of Artificial Sequence: Synthetic peptide
AETEICATNPISSEQYGVVSENLQSGTR

SEQ ID NO: 89322 - protein, 33 aa, Artificial Sequence
  Description of Artificial Sequence: Synthetic polypeptide
DEGEIRTTNPVAYEPYGSTVPSTPSSQNRGNNP

SEQ ID NO: 89323 - protein, 33 aa, Artificial Sequence
  Description of Artificial Sequence: Synthetic polypeptide
DEGEIRTTNPVAYEPYGSTVPSTPGSQNGNNRY

SEQ ID NO: 89324 - protein, 34 aa, Artificial Sequence
  Description of Artificial Sequence: Synthetic polypeptide
DEGEIRTTNPVAYEPYGSTVPSTGPGSQRGTNNR

SEQ ID NO: 89325 - protein, 33 aa, Artificial Sequence
  Description of Artificial Sequence: Synthetic polypeptide
DESEISTTNPVATEQYGFSWQSIGNLTGGGQNR

SEQ ID NO: 89326 - protein, 30 aa, Artificial Sequence
  Description of Artificial Sequence: Synthetic polypeptide
DEGVIATTNPVATEQYGCVAGTNPQDGPDM

SEQ ID NO: 89327 - protein, 33 aa, Artificial Sequence
  Description of Artificial Sequence: Synthetic polypeptide
DEDEIRTTNPCATECYGSVSTGNMGNQGDGSNE

SEQ ID NO: 89328 - protein, 33 aa, Artificial Sequence
  Description of Artificial Sequence: Synthetic polypeptide
DEHEIATTNPVATEQYGSVSATYCLQSGGYDAD

SEQ ID NO: 89329 - protein, 32 aa, Artificial Sequence
  Description of Artificial Sequence: Synthetic polypeptide
DEHEIATTNPVATEQYGSVSATDLEDHEGEDL

SEQ ID NO: 89330 - protein, 32 aa, Artificial Sequence
  Description of Artificial Sequence: Synthetic polypeptide
DEHEIATTNPVATEQYGSVSATDLEDHEGEDC

SEQ ID NO: 89331 - protein, 34 aa, Artificial Sequence
  Description of Artificial Sequence: Synthetic polypeptide
DEHEIATTNPVATEQYGSVSAGNPLDQTGNDNPD

SEQ ID NO: 89332 - protein, 32 aa, Artificial Sequence
  Description of Artificial Sequence: Synthetic polypeptide
DEHEIATTNPVATEQYGSVSAGNLFNNNDNNY

SEQ ID NO: 89333 - protein, 31 aa, Artificial Sequence
  Description of Artificial Sequence: Synthetic polypeptide
AETEIRTTNPVATEQWGETWANEDLQRKGPR

SEQ ID NO: 89334 - protein, 34 aa, Artificial Sequence
  Description of Artificial Sequence: Synthetic polypeptide
DEHEIATTNPVATEQYGSVCSNNEGDLDQHGNNN

SEQ ID NO: 89335 - protein, 33 aa, Artificial Sequence
  Description of Artificial Sequence: Synthetic polypeptide
DESEIRTTNPVAYEQYGSTVSCTDASGQGTNSR

SEQ ID NO: 89336 - protein, 33 aa, Artificial Sequence
  Description of Artificial Sequence: Synthetic polypeptide
DESEIRTTNPVAYEQYGTVATNDGNHQGNGNGR

SEQ ID NO: 89337 - protein, 33 aa, Artificial Sequence
  Description of Artificial Sequence: Synthetic polypeptide
DEHEIATTNPVATEQYGSVAITDNDTGDRQGNM

SEQ ID NO: 89338 - protein, 32 aa, Artificial Sequence
  Description of Artificial Sequence: Synthetic polypeptide
DEHEIATTNPVATEQYGSVAATNLTASPGDDD

SEQ ID NO: 89339 - protein, 33 aa, Artificial Sequence
  Description of Artificial Sequence: Synthetic polypeptide
DESEIRTTNPVAYEQYRSVSTMPLEQFGGDDRN

SEQ ID NO: 89340 - protein, 32 aa, Artificial Sequence
  Description of Artificial Sequence: Synthetic polypeptide
DESEIRTTNPVAYERWGSVSTNLNGEHGGNES

SEQ ID NO: 89341 - protein, 33 aa, Artificial Sequence
  Description of Artificial Sequence: Synthetic polypeptide
DESEIRTTNPVAYESYGKVQSCTDNALTAGENR

SEQ ID NO: 89342 - protein, 33 aa, Artificial Sequence
  Description of Artificial Sequence: Synthetic polypeptide
DESEIRTTNPVAYESYGKVQSTDNALTVGGENR

SEQ ID NO: 89343 - protein, 33 aa, Artificial Sequence
  Description of Artificial Sequence: Synthetic polypeptide
DESEIRTTNPVAYESYGQVQSCTQNLTAGGENR

SEQ ID NO: 89344 - protein, 33 aa, Artificial Sequence
  Description of Artificial Sequence: Synthetic polypeptide
DESEIRTTNPVAYEQYGTVATNDGNQGGGNGRR

SEQ ID NO: 89345 - protein, 33 aa, Artificial Sequence
  Description of Artificial Sequence: Synthetic polypeptide
AEVEIATTNPVAYEQWGSVNKTDNLDQRGGNDR

SEQ ID NO: 89346 - protein, 34 aa, Artificial Sequence
  Description of Artificial Sequence: Synthetic polypeptide
DEHEIATTNPVATEQYGSVSGAGNLFARMNMERN

SEQ ID NO: 89347 - protein, 33 aa, Artificial Sequence
  Description of Artificial Sequence: Synthetic polypeptide
DEHEIATTNPVATEQYGSVSTPNTPFDNRANST

SEQ ID NO: 89348 - protein, 30 aa, Artificial Sequence
  Description of Artificial Sequence: Synthetic polypeptide
DEHEIATTNPVAYEQWGSVSHPLDDRNMNH

SEQ ID NO: 89349 - protein, 32 aa, Artificial Sequence
  Description of Artificial Sequence: Synthetic polypeptide
DEHEIATTNPVAYEQWGSISHTDNHQREGNDL

SEQ ID NO: 89350 - protein, 30 aa, Artificial Sequence
  Description of Artificial Sequence: Synthetic polypeptide
DEHEIATTNPVAYEPYGSVASNLQNVPDNE

SEQ ID NO: 89351 - protein, 31 aa, Artificial Sequence
  Description of Artificial Sequence: Synthetic polypeptide
DEHEIATTNPVAYEGWGTVSTTNLGGDGNER

SEQ ID NO: 89352 - protein, 31 aa, Artificial Sequence
  Description of Artificial Sequence: Synthetic polypeptide
DEHEIATTNPVAYEEWGVVSTNLQLGEDNGS

SEQ ID NO: 89353 - protein, 31 aa, Artificial Sequence
  Description of Artificial Sequence: Synthetic polypeptide
DEHEIATTNPVAYEAWGTVSTNLQGADNDGR

SEQ ID NO: 89354 - protein, 31 aa, Artificial Sequence
  Description of Artificial Sequence: Synthetic polypeptide
DEHEIATTNPVAYDQYGSVNTQALSQRVGSD

SEQ ID NO: 89355 - protein, 31 aa, Artificial Sequence
  Description of Artificial Sequence: Synthetic polypeptide
DEHEIATTNPVAYDQWGSVPTWQNDQRNGND

SEQ ID NO: 89356 - protein, 29 aa, Artificial Sequence
  Description of Artificial Sequence: Synthetic peptide
DDEEIATTNPVSTEQYGEVPAEVCQHGER

SEQ ID NO: 89357 - protein, 32 aa, Artificial Sequence
  Description of Artificial Sequence: Synthetic polypeptide
DESEIRTTNPVAYEQWGSVSTTNGDNHGGNDQ

SEQ ID NO: 89358 - protein, 31 aa, Artificial Sequence
  Description of Artificial Sequence: Synthetic polypeptide
DEHEIATTNPVATTQWGCVSRTNDERQGNEP

SEQ ID NO: 89359 - protein, 32 aa, Artificial Sequence
  Description of Artificial Sequence: Synthetic polypeptide
DEHEIATTNPVATETWGTVSTNLQGDVGDGSR

SEQ ID NO: 89360 - protein, 32 aa, Artificial Sequence
  Description of Artificial Sequence: Synthetic polypeptide
DESEIRTTNPVAYEQWGSVSTVNQNGDTGPRP

SEQ ID NO: 89361 - protein, 31 aa, Artificial Sequence
  Description of Artificial Sequence: Synthetic polypeptide
DESEIRTTNPVAYEQWGTTVATYLLREGNDS

SEQ ID NO: 89362 - protein, 32 aa, Artificial Sequence
  Description of Artificial Sequence: Synthetic polypeptide
DESEIRTTNPVAYEQWGTVSTNLNGEHGNNSS

SEQ ID NO: 89363 - protein, 32 aa, Artificial Sequence
  Description of Artificial Sequence: Synthetic polypeptide
DESEIRTTNPVAYEQWGTVSWTEHDNRGGVNR

SEQ ID NO: 89364 - protein, 33 aa, Artificial Sequence
  Description of Artificial Sequence: Synthetic polypeptide
DEHEIATTNPVATEQYGSVSTTGPQGLTGNDDS

SEQ ID NO: 89365 - protein, 29 aa, Artificial Sequence
  Description of Artificial Sequence: Synthetic peptide
DESEIRTTNPVAYMHYGSVSYGEQDTNDM

SEQ ID NO: 89366 - protein, 29 aa, Artificial Sequence
  Description of Artificial Sequence: Synthetic peptide
DESEIRTTNPVAYMHYGSVSYIEQADTNM

SEQ ID NO: 89367 - protein, 30 aa, Artificial Sequence
  Description of Artificial Sequence: Synthetic polypeptide
DESEIRTTNPVAYMHYGSVSYNEDDRDTNM

SEQ ID NO: 89368 - protein, 33 aa, Artificial Sequence
  Description of Artificial Sequence: Synthetic polypeptide
DEHEIATTNPVATEQYGSVAANNGLEQDNGTDR

SEQ ID NO: 89369 - protein, 30 aa, Artificial Sequence
  Description of Artificial Sequence: Synthetic polypeptide
DESEIRTTNPVGTECWGVMASTLPQDRGNG

SEQ ID NO: 89370 - protein, 32 aa, Artificial Sequence
  Description of Artificial Sequence: Synthetic polypeptide
DEHCIRTTNPVAYEQWGSVATNNALSQTGGVR

SEQ ID NO: 89371 - protein, 31 aa, Artificial Sequence
  Description of Artificial Sequence: Synthetic polypeptide
DEGVVIATTNPVATEQYGCVAGTNPADDGNR

SEQ ID NO: 89372 - protein, 31 aa, Artificial Sequence
  Description of Artificial Sequence: Synthetic polypeptide
DESEIRTTNPVGTEGWGSMSCINLQDHGENG

SEQ ID NO: 89373 - protein, 30 aa, Artificial Sequence
  Description of Artificial Sequence: Synthetic polypeptide
DESEIRTTNPVGTEGWGVMASTLPQDRGNG

SEQ ID NO: 89374 - protein, 32 aa, Artificial Sequence
  Description of Artificial Sequence: Synthetic polypeptide
DEGVIRSTNPVATEQYGSVSVPNQNDRGSNSG

SEQ ID NO: 89375 - protein, 29 aa, Artificial Sequence
  Description of Artificial Sequence: Synthetic peptide
DESEIRTTNPVGTEPYGTMSMDLQQQGDI

SEQ ID NO: 89376 - protein, 28 aa, Artificial Sequence
  Description of Artificial Sequence: Synthetic peptide
DESEIRTTNPVGTEQWGDVSEIEQAEDA

SEQ ID NO: 89377 - protein, 32 aa, Artificial Sequence
  Description of Artificial Sequence: Synthetic polypeptide
DEDEIRTTNPCATECYGSVSTGGGNQTDGSNE

SEQ ID NO: 89378 - protein, 33 aa, Artificial Sequence
  Description of Artificial Sequence: Synthetic polypeptide
DEDEIRTTNPCATECYGSVSTGNGNQADHGSNE

SEQ ID NO: 89379 - protein, 34 aa, Artificial Sequence
  Description of Artificial Sequence: Synthetic polypeptide
DDEEIRATNPVATEQYGSVVDTNLQARNGGQEGE

SEQ ID NO: 89380 - protein, 33 aa, Artificial Sequence
  Description of Artificial Sequence: Synthetic polypeptide
DEDEIRTTNPCATECYGSVSTGNGNQGDGTNED

SEQ ID NO: 89381 - protein, 33 aa, Artificial Sequence
  Description of Artificial Sequence: Synthetic polypeptide
DEDEIRTTNPCATECYGSVSTGNLGNAGEERSE

SEQ ID NO: 89382 - protein, 33 aa, Artificial Sequence
  Description of Artificial Sequence: Synthetic polypeptide
DEDEIRTTNPCATECYGSVSTGNLGNAGENGGH

SEQ ID NO: 89383 - protein, 36 aa, Artificial Sequence
  Description of Artificial Sequence: Synthetic polypeptide
DEEEIRTTNPVATEQYGVVSTVVTNLQQGNNDEEQD

SEQ ID NO: 89384 - protein, 33 aa, Artificial Sequence
  Description of Artificial Sequence: Synthetic polypeptide
DEDEIRTTNPCATECYGSVSTGNLGNAGENHAE

SEQ ID NO: 89385 - protein, 30 aa, Artificial Sequence
  Description of Artificial Sequence: Synthetic polypeptide
DEGVIATVNPVATEPYGSVSANLDMVGDNN

SEQ ID NO: 89386 - protein, 30 aa, Artificial Sequence
  Description of Artificial Sequence: Synthetic polypeptide
DESEIRTTNPVGTECWGVMASTEPQDRGNG

SEQ ID NO: 89387 - protein, 33 aa, Artificial Sequence
  Description of Artificial Sequence: Synthetic polypeptide
DEDEIRTTNPCATECYGSVSTGNNLGNAGEERE

SEQ ID NO: 89388 - protein, 32 aa, Artificial Sequence
  Description of Artificial Sequence: Synthetic polypeptide
DEHEIATTNPCATECYGVVSTNLQGDAGNDSD

SEQ ID NO: 89389 - protein, 36 aa, Artificial Sequence
  Description of Artificial Sequence: Synthetic polypeptide
DEEEIRTTNPVATEQYGVVSTVVTNLQAGTNDEQND

SEQ ID NO: 89390 - protein, 31 aa, Artificial Sequence
  Description of Artificial Sequence: Synthetic polypeptide
DEHEIATTNPVATEQYGSVAAGNLFANNMGD

SEQ ID NO: 89391 - protein, 34 aa, Artificial Sequence
  Description of Artificial Sequence: Synthetic polypeptide
DEHEIATTNPVATEQYGCVCSTDNLGDAHGNNER

SEQ ID NO: 89392 - protein, 33 aa, Artificial Sequence
  Description of Artificial Sequence: Synthetic polypeptide
DESEIRTTNPVAYQPYGSVSTGNLSQTGGGSRR

SEQ ID NO: 89393 - protein, 33 aa, Artificial Sequence
  Description of Artificial Sequence: Synthetic polypeptide
DEHEIATTNPVATEQWGSVSATNGLEQDNGTDM

SEQ ID NO: 89394 - protein, 32 aa, Artificial Sequence
  Description of Artificial Sequence: Synthetic polypeptide
DEHEIATTNPVATEPYGSVSTNLNGEHNNNEQ

SEQ ID NO: 89395 - protein, 33 aa, Artificial Sequence
  Description of Artificial Sequence: Synthetic polypeptide
DESEIRTTNPVAYQQYGQCTVSCTNLSERGGNP

SEQ ID NO: 89396 - protein, 32 aa, Artificial Sequence
  Description of Artificial Sequence: Synthetic polypeptide
DESEIRTTNPVCTECWGSVSCINEPQDREGNG

SEQ ID NO: 89397 - protein, 33 aa, Artificial Sequence
  Description of Artificial Sequence: Synthetic polypeptide
DEHEIATTNPVATENYGSVATGDLQDRQGNGED

SEQ ID NO: 89398 - protein, 31 aa, Artificial Sequence
  Description of Artificial Sequence: Synthetic polypeptide
DEHEIATTNPVATEIYGTVSTNLNGEHNNES

SEQ ID NO: 89399 - protein, 31 aa, Artificial Sequence
  Description of Artificial Sequence: Synthetic polypeptide
DEHEIATTNPVATECYGNVSTNLNGEHNNEQ

SEQ ID NO: 89400 - protein, 34 aa, Artificial Sequence
  Description of Artificial Sequence: Synthetic polypeptide
DEHEIATTNPVATEAYGSVCQTNDLNQRGQEGND

SEQ ID NO: 89401 - protein, 32 aa, Artificial Sequence
  Description of Artificial Sequence: Synthetic polypeptide
DESEIRTTNPVCTECWGSVSCINEPQDREGNQ

SEQ ID NO: 89402 - protein, 31 aa, Artificial Sequence
  Description of Artificial Sequence: Synthetic polypeptide
DEHEIATTNPVATEAWGSVSTNLNGDTQNES

SEQ ID NO: 89403 - protein, 31 aa, Artificial Sequence
  Description of Artificial Sequence: Synthetic polypeptide
DESEIRTTNPVCTECWGVVSCINEPQDRGNQ

SEQ ID NO: 89404 - protein, 30 aa, Artificial Sequence
  Description of Artificial Sequence: Synthetic polypeptide
DESEIRTTNPVCTECWGVVSCINEPQSGNQ

SEQ ID NO: 89405 - protein, 30 aa, Artificial Sequence
  Description of Artificial Sequence: Synthetic polypeptide
AETEIRCTNPVATEQWGEAWSNEDLQRGGR

SEQ ID NO: 89406 - protein, 29 aa, Artificial Sequence
  Description of Artificial Sequence: Synthetic peptide
DEHEIATTNPVATAQWGSVASADQDGNDQ

SEQ ID NO: 89407 - protein, 29 aa, Artificial Sequence
  Description of Artificial Sequence: Synthetic peptide
DEHEIATTNPVATAQWGCVATALTDDGND

SEQ ID NO: 89408 - protein, 33 aa, Artificial Sequence
  Description of Artificial Sequence: Synthetic polypeptide
DEEEIRTTNPVATEQYGSVSTMEGLDELLMSGE

SEQ ID NO: 89409 - protein, 33 aa, Artificial Sequence
  Description of Artificial Sequence: Synthetic polypeptide
DESEIRTTNPVATECWGSVSCSNEPQDREGENG

SEQ ID NO: 89410 - protein, 33 aa, Artificial Sequence
  Description of Artificial Sequence: Synthetic polypeptide
DEEEIRTTNPVATEQYGSVSTMEGLTEVLESGE

SEQ ID NO: 89411 - protein, 33 aa, Artificial Sequence
  Description of Artificial Sequence: Synthetic polypeptide
DECEICTTNPVATEQYGTVCSVTDGNVEQEGND

SEQ ID NO: 89412 - protein, 34 aa, Artificial Sequence
  Description of Artificial Sequence: Synthetic polypeptide
DESEIKTTNPVATEQYGSVSINGLIGEDGQGGNE

SEQ ID NO: 89413 - protein, 32 aa, Artificial Sequence
  Description of Artificial Sequence: Synthetic polypeptide
DESEIRCTNPIATECYGSVSEINLPMREGENG

SEQ ID NO: 89414 - protein, 32 aa, Artificial Sequence
  Description of Artificial Sequence: Synthetic polypeptide
DESEIRCTNPIATEQWGSVSENEPQDREGENG

SEQ ID NO: 89415 - protein, 33 aa, Artificial Sequence
  Description of Artificial Sequence: Synthetic polypeptide
DEMEIRTTNPVATEQYGTVCSATDGPVEREGNG

SEQ ID NO: 89416 - protein, 33 aa, Artificial Sequence
  Description of Artificial Sequence: Synthetic polypeptide
DEMEIRTTNPVATEQYGTVCSATDGPVEREGND

SEQ ID NO: 89417 - protein, 33 aa, Artificial Sequence
  Description of Artificial Sequence: Synthetic polypeptide
DEMEIRTTNPVATEQYGTVCSATDGPVEFEGNR

SEQ ID NO: 89418 - protein, 33 aa, Artificial Sequence
  Description of Artificial Sequence: Synthetic polypeptide
DEMEIRTTNPVATEQYGTVCSATDNPPEFEGND

SEQ ID NO: 89419 - protein, 33 aa, Artificial Sequence
  Description of Artificial Sequence: Synthetic polypeptide
DEEEIRTTNPVATEQYGTVYGDEGLGQTNFGNQ

SEQ ID NO: 89420 - protein, 32 aa, Artificial Sequence
  Description of Artificial Sequence: Synthetic polypeptide
DESEIRCTNPVATECWGSASCNEPQDREGENR

SEQ ID NO: 89421 - protein, 31 aa, Artificial Sequence
  Description of Artificial Sequence: Synthetic polypeptide
DESEIRCTNPVATECWGSASENEPQDREGNG

SEQ ID NO: 89422 - protein, 32 aa, Artificial Sequence
  Description of Artificial Sequence: Synthetic polypeptide
DEMEIRTTNPVATEQYGTVCSATDGPMFEGNA

SEQ ID NO: 89423 - protein, 33 aa, Artificial Sequence
  Description of Artificial Sequence: Synthetic polypeptide
DESEIRCTNPVATECWGSVSCINEPQDREGENR

SEQ ID NO: 89424 - protein, 32 aa, Artificial Sequence
  Description of Artificial Sequence: Synthetic polypeptide
DESEIRCTNPVATECWGSVSCINEPQDREGNG

SEQ ID NO: 89425 - protein, 32 aa, Artificial Sequence
  Description of Artificial Sequence: Synthetic polypeptide
DESEIRCTNPVATECWGSVSCNEPQDREGENG

SEQ ID NO: 89426 - protein, 33 aa, Artificial Sequence
  Description of Artificial Sequence: Synthetic polypeptide
DEMEIRTTNPVATEQYGTVCSATDDPVEQEGND

SEQ ID NO: 89427 - protein, 33 aa, Artificial Sequence
  Description of Artificial Sequence: Synthetic polypeptide
DEEEIRTTNPVATEQYGTVYGTDEMGQEDGNQG

SEQ ID NO: 89428 - protein, 32 aa, Artificial Sequence
  Description of Artificial Sequence: Synthetic polypeptide
DESEIKTTNPVATECWGSVSCINEPQDREGNG

SEQ ID NO: 89429 - protein, 32 aa, Artificial Sequence
  Description of Artificial Sequence: Synthetic polypeptide
DESEIGTTNPVATEQYGSVPSLNAPSGDGGSR

SEQ ID NO: 89430 - protein, 32 aa, Artificial Sequence
  Description of Artificial Sequence: Synthetic polypeptide
DESEIGTTNPVATEQYGSTVSCTNPDGLVGSP

SEQ ID NO: 89431 - protein, 33 aa, Artificial Sequence
  Description of Artificial Sequence: Synthetic polypeptide
DESEICTTNPVATEQYGCVSTNLNGDAGGNTGS

SEQ ID NO: 89432 - protein, 32 aa, Artificial Sequence
  Description of Artificial Sequence: Synthetic polypeptide
DEMEIRTTNPVATEQYGTVCSATGEVEFEGND

SEQ ID NO: 89433 - protein, 33 aa, Artificial Sequence
  Description of Artificial Sequence: Synthetic polypeptide
DEMEIRTTNPVATEQYGTVCSATEDPVQFEGND

SEQ ID NO: 89434 - protein, 35 aa, Artificial Sequence
  Description of Artificial Sequence: Synthetic polypeptide
DESEICTTNPVATEQYGSVSFANLHQGRHGLDDRW

SEQ ID NO: 89435 - protein, 32 aa, Artificial Sequence
  Description of Artificial Sequence: Synthetic polypeptide
DESEICTTNPVAYEPYGSVSTGGLSQTLGGMR

SEQ ID NO: 89436 - protein, 32 aa, Artificial Sequence
  Description of Artificial Sequence: Synthetic polypeptide
DESEICTVNPVATEAYGSTVSTNELSTEGGNH

SEQ ID NO: 89437 - protein, 32 aa, Artificial Sequence
  Description of Artificial Sequence: Synthetic polypeptide
DESEICTVNPVATEQWGSTVSCTNELSTEGNH

SEQ ID NO: 89438 - protein, 34 aa, Artificial Sequence
  Description of Artificial Sequence: Synthetic polypeptide
DEEEIRTTNPVATEQYGTVVSYTPGELSGVGGER

SEQ ID NO: 89439 - protein, 33 aa, Artificial Sequence
  Description of Artificial Sequence: Synthetic polypeptide
DEMEIRTTNPVATEQYGTVCSATEDPQQFEGND

SEQ ID NO: 89440 - protein, 32 aa, Artificial Sequence
  Description of Artificial Sequence: Synthetic polypeptide
DESEIDTTNPVATECWGSVSCINEPQDREGNG

SEQ ID NO: 89441 - protein, 33 aa, Artificial Sequence
  Description of Artificial Sequence: Synthetic polypeptide
DESEIETTNPVATECWGSVSCINEPQDREGENR

SEQ ID NO: 89442 - protein, 32 aa, Artificial Sequence
  Description of Artificial Sequence: Synthetic polypeptide
DECEICTTNPVATEQYGSVSVTDLEDTEGEDL

SEQ ID NO: 89443 - protein, 34 aa, Artificial Sequence
  Description of Artificial Sequence: Synthetic polypeptide
DECEICTTNPVATEQYGSVSVTTNQQQEQQGNLI

SEQ ID NO: 89444 - protein, 33 aa, Artificial Sequence
  Description of Artificial Sequence: Synthetic polypeptide
DESEIGTTNPVATECYGQSTVSCTNPDGRVGSR

SEQ ID NO: 89445 - protein, 33 aa, Artificial Sequence
  Description of Artificial Sequence: Synthetic polypeptide
DESEIGTTNPVATEPYGSVSTTNEPSGRGGSQR

SEQ ID NO: 89446 - protein, 32 aa, Artificial Sequence
  Description of Artificial Sequence: Synthetic polypeptide
DESEIGTTNPVATEQYGSTVSCANPDGPVGSR

SEQ ID NO: 89447 - protein, 33 aa, Artificial Sequence
  Description of Artificial Sequence: Synthetic polypeptide
DESEIGTTNPVATEQYGSTVSCTNPDGKVGSRF

SEQ ID NO: 89448 - protein, 32 aa, Artificial Sequence
  Description of Artificial Sequence: Synthetic polypeptide
DESEIRCTNPVATECWGSVSEINLPMREGENG

SEQ ID NO: 89449 - protein, 34 aa, Artificial Sequence
  Description of Artificial Sequence: Synthetic polypeptide
DEEEIRTTNPVATEQYGTVVSTMGFGGQGEGNNI

SEQ ID NO: 89450 - protein, 32 aa, Artificial Sequence
  Description of Artificial Sequence: Synthetic polypeptide
DEMEIRTTNPVATEQYGTISATEDPQQFNGND

SEQ ID NO: 89451 - protein, 37 aa, Artificial Sequence
  Description of Artificial Sequence: Synthetic polypeptide
DEEEIRTTNPVATEQYGSVSTNLQAGNNNQEQGEETA

SEQ ID NO: 89452 - protein, 32 aa, Artificial Sequence
  Description of Artificial Sequence: Synthetic polypeptide
DESEIRPTNPVATECWGSVSCINEPQDREGNG

SEQ ID NO: 89453 - protein, 32 aa, Artificial Sequence
  Description of Artificial Sequence: Synthetic polypeptide
DESEIRPTNPVATECYGIVSCNEPQDREGENG

SEQ ID NO: 89454 - protein, 33 aa, Artificial Sequence
  Description of Artificial Sequence: Synthetic polypeptide
DESEIRPTNPVATEQWGSVSCINEPQDREGENG

SEQ ID NO: 89455 - protein, 32 aa, Artificial Sequence
  Description of Artificial Sequence: Synthetic polypeptide
DEMEIRTTNPVATEQYGSVYTPNVQIPSDEDQ

SEQ ID NO: 89456 - protein, 33 aa, Artificial Sequence
  Description of Artificial Sequence: Synthetic polypeptide
DEMEIRTTNPVATEQYGSVYSTTTLESTENQQG

SEQ ID NO: 89457 - protein, 30 aa, Artificial Sequence
  Description of Artificial Sequence: Synthetic polypeptide
DESEIRPTNPVATKHYGSVWTDTNQERTNN

SEQ ID NO: 89458 - protein, 33 aa, Artificial Sequence
  Description of Artificial Sequence: Synthetic polypeptide
DESEIRRTNPVATECYGSVSCINEPQDREGENG

SEQ ID NO: 89459 - protein, 32 aa, Artificial Sequence
  Description of Artificial Sequence: Synthetic polypeptide
DECEICTTNPVATEQYGVVSTTAQLQQQNNND

SEQ ID NO: 89460 - protein, 33 aa, Artificial Sequence
  Description of Artificial Sequence: Synthetic polypeptide
DECEICTTNPVATEQYGVVSTTQALQQGNPNDE

SEQ ID NO: 89461 - protein, 32 aa, Artificial Sequence
  Description of Artificial Sequence: Synthetic polypeptide
DESEIRSTNPVATECWGSVSCNEPQDREGENG

SEQ ID NO: 89462 - protein, 31 aa, Artificial Sequence
  Description of Artificial Sequence: Synthetic polypeptide
DESEIRSTNPVATECWGVVSCINEPQDRGNQ

SEQ ID NO: 89463 - protein, 30 aa, Artificial Sequence
  Description of Artificial Sequence: Synthetic polypeptide
DESEIRSTNPVATECWGVVSDINEQDSGNQ

SEQ ID NO: 89464 - protein, 32 aa, Artificial Sequence
  Description of Artificial Sequence: Synthetic polypeptide
DESEIRSTNPVATEGWGSVASITEPQDREGNG

SEQ ID NO: 89465 - protein, 34 aa, Artificial Sequence
  Description of Artificial Sequence: Synthetic polypeptide
DEMEIRTTNPVATEQYGSVYSAENTNNQQSTERQ

SEQ ID NO: 89466 - protein, 32 aa, Artificial Sequence
  Description of Artificial Sequence: Synthetic polypeptide
DESEIRSTNPVATEGWGSVASITEPQDREGNI

SEQ ID NO: 89467 - protein, 32 aa, Artificial Sequence
  Description of Artificial Sequence: Synthetic polypeptide
DESEIRSTNPVATEGYGNVSNITEPQSRVGNG

SEQ ID NO: 89468 - protein, 32 aa, Artificial Sequence
  Description of Artificial Sequence: Synthetic polypeptide
DESEIRSTNPVATECWGSVASINEPQDREGNG

SEQ ID NO: 89469 - protein, 33 aa, Artificial Sequence
  Description of Artificial Sequence: Synthetic polypeptide
DECEICTTNPVATEQYGVVSTTANLQQQNPNDD

SEQ ID NO: 89470 - protein, 32 aa, Artificial Sequence
  Description of Artificial Sequence: Synthetic polypeptide
DECEICTTNPVATEQYGVVSTQALQGNPNNDE

SEQ ID NO: 89471 - protein, 32 aa, Artificial Sequence
  Description of Artificial Sequence: Synthetic polypeptide
DECEICTTNPVATEQYGVVSTAQLQGNPNNDQ

SEQ ID NO: 89472 - protein, 37 aa, Artificial Sequence
  Description of Artificial Sequence: Synthetic polypeptide
DEEEIRTTNPVATEQYGSVSTNLQAGNNAGNQTEDET

SEQ ID NO: 89473 - protein, 32 aa, Artificial Sequence
  Description of Artificial Sequence: Synthetic polypeptide
CEECICTTNPVATEQYGSVSWNEGQDRQAGES

SEQ ID NO: 89474 - protein, 32 aa, Artificial Sequence
  Description of Artificial Sequence: Synthetic polypeptide
DEMEIRTTNPVATEQYGTISATDDIQQFNGNH

SEQ ID NO: 89475 - protein, 32 aa, Artificial Sequence
  Description of Artificial Sequence: Synthetic polypeptide
DEMEIRTTNPVATEQYGTISATDDIQEFNGNH

SEQ ID NO: 89476 - protein, 31 aa, Artificial Sequence
  Description of Artificial Sequence: Synthetic polypeptide
DESEIRCTNPVATEQWGSASENEPQDREGGG

SEQ ID NO: 89477 - protein, 32 aa, Artificial Sequence
  Description of Artificial Sequence: Synthetic polypeptide
CEECICTTNPVATEAYGSVSWNEGQDRQGGNS

SEQ ID NO: 89478 - protein, 35 aa, Artificial Sequence
  Description of Artificial Sequence: Synthetic polypeptide
DEMEIRTTNPVATEQYGSVYTTNNQEDRIGGNMVQ

SEQ ID NO: 89479 - protein, 32 aa, Artificial Sequence
  Description of Artificial Sequence: Synthetic polypeptide
CEECIATTNPVATEQYGSVSWNEGQDRQGGSS

SEQ ID NO: 89480 - protein, 31 aa, Artificial Sequence
  Description of Artificial Sequence: Synthetic polypeptide
DESEIRGTNPVATDAYGSVSINGQQGTGNGD

SEQ ID NO: 89481 - protein, 31 aa, Artificial Sequence
  Description of Artificial Sequence: Synthetic polypeptide
DESEIRGTNPVATDQYGDVADTNGQGEGGNE

SEQ ID NO: 89482 - protein, 32 aa, Artificial Sequence
  Description of Artificial Sequence: Synthetic polypeptide
DESEIRGTNPVATDQYGSVNTMGLQNEGGNDT

SEQ ID NO: 89483 - protein, 34 aa, Artificial Sequence
  Description of Artificial Sequence: Synthetic polypeptide
DESEIRGTNPVATEQYGSVCSTGDLGQRGLGEGG

SEQ ID NO: 89484 - protein, 31 aa, Artificial Sequence
  Description of Artificial Sequence: Synthetic polypeptide
DESEIRPTNPVASEQWGIVSCNLPQREGETG

SEQ ID NO: 89485 - protein, 32 aa, Artificial Sequence
  Description of Artificial Sequence: Synthetic polypeptide
DECEICTTNPVATEQYGVVSTALEQGNPTNDE

SEQ ID NO: 89486 - protein, 32 aa, Artificial Sequence
  Description of Artificial Sequence: Synthetic polypeptide
DECEICTTNPVATEQYGVVSTALQGNQPNNDN

SEQ ID NO: 89487 - protein, 33 aa, Artificial Sequence
  Description of Artificial Sequence: Synthetic polypeptide
DECEICTTNPVATEQYGVVSTALQQGNQPGNND

SEQ ID NO: 89488 - protein, 32 aa, Artificial Sequence
  Description of Artificial Sequence: Synthetic polypeptide
DEAEIATTNPVAYEQWGAVSTNLQGNDGDPDR

SEQ ID NO: 89489 - protein, 32 aa, Artificial Sequence
  Description of Artificial Sequence: Synthetic polypeptide
DEMEIRTTNPVATEQYGTISATEDPQQFEGND

SEQ ID NO: 89490 - protein, 34 aa, Artificial Sequence
  Description of Artificial Sequence: Synthetic polypeptide
DESEICTTNPVATEQWGEVSTPNGLQDERNGNHN

SEQ ID NO: 89491 - protein, 32 aa, Artificial Sequence
  Description of Artificial Sequence: Synthetic polypeptide
DEMEIRTTNPVATEQYGTVCSTDGPVEFEGND

SEQ ID NO: 89492 - protein, 32 aa, Artificial Sequence
  Description of Artificial Sequence: Synthetic polypeptide
CSEEIRTTNPVATEQYGYVWTPNLWQYETSNH

SEQ ID NO: 89493 - protein, 32 aa, Artificial Sequence
  Description of Artificial Sequence: Synthetic polypeptide
DEMEIRTTNPVATQQYGTVSTNLEVVSNNGDH

SEQ ID NO: 89494 - protein, 28 aa, Artificial Sequence
  Description of Artificial Sequence: Synthetic peptide
DESEIATTNPVGTEGYGVMASTLQHGDI

SEQ ID NO: 89495 - protein, 29 aa, Artificial Sequence
  Description of Artificial Sequence: Synthetic peptide
DESEIATTNPVGTEGYGVMSASTLNHGNI

SEQ ID NO: 89496 - protein, 35 aa, Artificial Sequence
  Description of Artificial Sequence: Synthetic polypeptide
DECEICTTNPVATEQYGSVSTTQNLNNQQGTNSTD

SEQ ID NO: 89497 - protein, 30 aa, Artificial Sequence
  Description of Artificial Sequence: Synthetic polypeptide
DESEIATTNPVGTEGYGVMSATTLNRGMNI

SEQ ID NO: 89498 - protein, 33 aa, Artificial Sequence
  Description of Artificial Sequence: Synthetic polypeptide
DECEICTTNPVATEQYGSVSTTSLEDTEGNEDE

SEQ ID NO: 89499 - protein, 32 aa, Artificial Sequence
  Description of Artificial Sequence: Synthetic polypeptide
DECEICTTNPVATEQYGSVSTTSLENTEGEDL

SEQ ID NO: 89500 - protein, 33 aa, Artificial Sequence
  Description of Artificial Sequence: Synthetic polypeptide
DECEICTTNPVATEQYGSVSTTNSLEDEEGEDL

SEQ ID NO: 89501 - protein, 33 aa, Artificial Sequence
  Description of Artificial Sequence: Synthetic polypeptide
DECEICTTNPVATEQYGSVSTTSNLEDTEGEDG

SEQ ID NO: 89502 - protein, 32 aa, Artificial Sequence
  Description of Artificial Sequence: Synthetic polypeptide
DECEICTTNPVATEQYGSVSTTSQEDTEGEDQ

SEQ ID NO: 89503 - protein, 33 aa, Artificial Sequence
  Description of Artificial Sequence: Synthetic polypeptide
CEYEIRATNPVATEQYGSVVDETNLQHGGNGQG

SEQ ID NO: 89504 - protein, 29 aa, Artificial Sequence
  Description of Artificial Sequence: Synthetic peptide
DESEIATTNPVGTEQYGSMATSTGNHGNI

SEQ ID NO: 89505 - protein, 29 aa, Artificial Sequence
  Description of Artificial Sequence: Synthetic peptide
DESEIATTNPVGTEQYGVMASTLQHEGDL

SEQ ID NO: 89506 - protein, 29 aa, Artificial Sequence
  Description of Artificial Sequence: Synthetic peptide
DESEIATTNPVGTEQYGVMATDLQHEGDL

SEQ ID NO: 89507 - protein, 31 aa, Artificial Sequence
  Description of Artificial Sequence: Synthetic polypeptide
DESEIATTNPVSSEQWGSVSCINEPQREGTR

SEQ ID NO: 89508 - protein, 34 aa, Artificial Sequence
  Description of Artificial Sequence: Synthetic polypeptide
DEEEIRTTNPVATEQYGTVTTTTNNNLLQSTENN

SEQ ID NO: 89509 - protein, 29 aa, Artificial Sequence
  Description of Artificial Sequence: Synthetic peptide
DESEIATTNPVGTEQYGSMATSAGNHGNI

SEQ ID NO: 89510 - protein, 31 aa, Artificial Sequence
  Description of Artificial Sequence: Synthetic polypeptide
DEMEIRTTNPVSTEQYGTVSTEGPVEFEGNH

SEQ ID NO: 89511 - protein, 31 aa, Artificial Sequence
  Description of Artificial Sequence: Synthetic polypeptide
DEMEISTTNPVATDQYGCVCNTELQNFGSNQ

SEQ ID NO: 89512 - protein, 29 aa, Artificial Sequence
  Description of Artificial Sequence: Synthetic peptide
DESEIATTNPVGTEGYGTMSSTLQQHGNH

SEQ ID NO: 89513 - protein, 35 aa, Artificial Sequence
  Description of Artificial Sequence: Synthetic polypeptide
DECEICTTNPVATEQYGSVSTTNQLNQNNGNETED

SEQ ID NO: 89514 - protein, 30 aa, Artificial Sequence
  Description of Artificial Sequence: Synthetic polypeptide
DEMEIVPTNPVATEQYGTVSCDGLESEGND

SEQ ID NO: 89515 - protein, 30 aa, Artificial Sequence
  Description of Artificial Sequence: Synthetic polypeptide
DEMEIVCTNPVATEQYGTVCSEGPVMFGNR

SEQ ID NO: 89516 - protein, 32 aa, Artificial Sequence
  Description of Artificial Sequence: Synthetic polypeptide
DEMEIVCTNPVATEQYGTACSATNPVQREGND

SEQ ID NO: 89517 - protein, 35 aa, Artificial Sequence
  Description of Artificial Sequence: Synthetic polypeptide
DECEICTTNPVATEQYGSVSTTNQLQGQQGTNETG

SEQ ID NO: 89518 - protein, 33 aa, Artificial Sequence
  Description of Artificial Sequence: Synthetic polypeptide
DEMEIVCTNPVATEQYGSVCSATDGPVEREGNR

SEQ ID NO: 89519 - protein, 31 aa, Artificial Sequence
  Description of Artificial Sequence: Synthetic polypeptide
DEMEIVCTNPVATEQYGEVSAEDGLEFEGNR

SEQ ID NO: 89520 - protein, 34 aa, Artificial Sequence
  Description of Artificial Sequence: Synthetic polypeptide
DECEICTTNPVATEQYGSVSTTNQQGQEQQGNEN

SEQ ID NO: 89521 - protein, 34 aa, Artificial Sequence
  Description of Artificial Sequence: Synthetic polypeptide
DECEICTTNPVATEQYGSVSTTNQQGQEQQGNGS

SEQ ID NO: 89522 - protein, 31 aa, Artificial Sequence
  Description of Artificial Sequence: Synthetic polypeptide
DEMEIVCTNPVATEQYGEASAEDGLQFEGNR

SEQ ID NO: 89523 - protein, 34 aa, Artificial Sequence
  Description of Artificial Sequence: Synthetic polypeptide
DECEICTTNPVATEQYGSVSTTNQQQEQQGNGNT

SEQ ID NO: 89524 - protein, 31 aa, Artificial Sequence
  Description of Artificial Sequence: Synthetic polypeptide
DEMEIVCTNPIATEQYGTVSEDGLVEREGNR

SEQ ID NO: 89525 - protein, 29 aa, Artificial Sequence
  Description of Artificial Sequence: Synthetic peptide
DESEIATTNPVGTECWGVMACNLQREGNI

SEQ ID NO: 89526 - protein, 28 aa, Artificial Sequence
  Description of Artificial Sequence: Synthetic peptide
DESEIATTNPVGTECWGVMACNLQRGDI

SEQ ID NO: 89527 - protein, 32 aa, Artificial Sequence
  Description of Artificial Sequence: Synthetic polypeptide
DEMEISTVNPVATEQYGCVCSTNLAYFGNNQA

SEQ ID NO: 89528 - protein, 31 aa, Artificial Sequence
  Description of Artificial Sequence: Synthetic polypeptide
DESEIATTNPVGTEGWGSVACNLQDREGENI

SEQ ID NO: 89529 - protein, 32 aa, Artificial Sequence
  Description of Artificial Sequence: Synthetic polypeptide
DEMEISTTNPVATEQYGCVCSTPHQNFGSNQS

SEQ ID NO: 89530 - protein, 35 aa, Artificial Sequence
  Description of Artificial Sequence: Synthetic polypeptide
DEEEIRTTNPVATEQYGTVTTTVNNLQQGTEENAN

SEQ ID NO: 89531 - protein, 32 aa, Artificial Sequence
  Description of Artificial Sequence: Synthetic polypeptide
DEMEIRTTNPVATQQYGCVCSTGELESFGSNQ

SEQ ID NO: 89532 - protein, 33 aa, Artificial Sequence
  Description of Artificial Sequence: Synthetic polypeptide
DESEIATTNPVSTECYGSVSCINEPQDREGENR

SEQ ID NO: 89533 - protein, 31 aa, Artificial Sequence
  Description of Artificial Sequence: Synthetic polypeptide
DESEIATTNPVSTEGYGSVSANDIQDHEGER

SEQ ID NO: 89534 - protein, 33 aa, Artificial Sequence
  Description of Artificial Sequence: Synthetic polypeptide
DEMEIRTTNPVATEQYGTVVSFSTTLQRPEDQD

SEQ ID NO: 89535 - protein, 35 aa, Artificial Sequence
  Description of Artificial Sequence: Synthetic polypeptide
DEEEIRTTNPVATEQYGTVTVVTNNNLQQGEENQN

SEQ ID NO: 89536 - protein, 35 aa, Artificial Sequence
  Description of Artificial Sequence: Synthetic polypeptide
DEEEIRTTNPVATEQYGTVTVVTNNNLQQGEEQNG

SEQ ID NO: 89537 - protein, 35 aa, Artificial Sequence
  Description of Artificial Sequence: Synthetic polypeptide
DECEICTTNPVATEQYGSVSTVNLNNQVNGNEEEE

SEQ ID NO: 89538 - protein, 35 aa, Artificial Sequence
  Description of Artificial Sequence: Synthetic polypeptide
DECEICTTNPVATEQYGSVSTVNLQNLQQGNNQTE

SEQ ID NO: 89539 - protein, 35 aa, Artificial Sequence
  Description of Artificial Sequence: Synthetic polypeptide
DEEEIRTTNPVATEQYGTVTVVTNNNLQQGNLENN

SEQ ID NO: 89540 - protein, 33 aa, Artificial Sequence
  Description of Artificial Sequence: Synthetic polypeptide
DESEICTTNPVATEPYGEVSTDNGLQDSGQNDI

SEQ ID NO: 89541 - protein, 32 aa, Artificial Sequence
  Description of Artificial Sequence: Synthetic polypeptide
DESEICTTNPVATEPYGEVSTPNQGQDSGGNI

SEQ ID NO: 89542 - protein, 34 aa, Artificial Sequence
  Description of Artificial Sequence: Synthetic polypeptide
DEEEIRTTNPVATEQYGTVTVVTNNQLEQRTEDN

SEQ ID NO: 89543 - protein, 35 aa, Artificial Sequence
  Description of Artificial Sequence: Synthetic polypeptide
DEEEIRTTNPVATEQYGTVTVVTTNNELQREEENN

SEQ ID NO: 89544 - protein, 33 aa, Artificial Sequence
  Description of Artificial Sequence: Synthetic polypeptide
DESEICTTNPVATEPYGSVSTGDNHQNGGGNTI

SEQ ID NO: 89545 - protein, 32 aa, Artificial Sequence
  Description of Artificial Sequence: Synthetic polypeptide
DEMEIRTTNPVATEQYGTVSAMEDPQQQNGNH

SEQ ID NO: 89546 - protein, 32 aa, Artificial Sequence
  Description of Artificial Sequence: Synthetic polypeptide
DEMEIRTTNPVATEQYGTVSAMEDIVEQNGNH

SEQ ID NO: 89547 - protein, 34 aa, Artificial Sequence
  Description of Artificial Sequence: Synthetic polypeptide
DEEEIRTTNPVATEQYGTVVDGMTNQENQDIGNN

SEQ ID NO: 89548 - protein, 34 aa, Artificial Sequence
  Description of Artificial Sequence: Synthetic polypeptide
DESEICTTNPVATEPYGSVSTGGNLGQSGGMNDI

SEQ ID NO: 89549 - protein, 34 aa, Artificial Sequence
  Description of Artificial Sequence: Synthetic polypeptide
DEEEIRTTNPVATEQYGTVVLTDKHGLNTRGNQT

SEQ ID NO: 89550 - protein, 35 aa, Artificial Sequence
  Description of Artificial Sequence: Synthetic polypeptide
DEEEIRTTNPVATEQYGTVVPSCTNSSGRGQNMEV

SEQ ID NO: 89551 - protein, 30 aa, Artificial Sequence
  Description of Artificial Sequence: Synthetic polypeptide
CSEEIATTNPVGTEQWGVMVSITNDQGGER

SEQ ID NO: 89552 - protein, 34 aa, Artificial Sequence
  Description of Artificial Sequence: Synthetic polypeptide
DECEICTTNPVATEQYGVVSTVANLQQGNNPNDT

SEQ ID NO: 89553 - protein, 33 aa, Artificial Sequence
  Description of Artificial Sequence: Synthetic polypeptide
DESEICTTNPVATEHYGSVSTGGLGDTGGQNQR

SEQ ID NO: 89554 - protein, 35 aa, Artificial Sequence
  Description of Artificial Sequence: Synthetic polypeptide
DEEEIRTTNPVATEQYGTVTVSVTNTEQYGTNNET

SEQ ID NO: 89555 - protein, 31 aa, Artificial Sequence
  Description of Artificial Sequence: Synthetic polypeptide
DESEIATTNPVSTEGYGSVSNITEQSRVGQR

SEQ ID NO: 89556 - protein, 29 aa, Artificial Sequence
  Description of Artificial Sequence: Synthetic peptide
DESEIATTNPVSTEGYGTMSSTIQQHGNH

SEQ ID NO: 89557 - protein, 29 aa, Artificial Sequence
  Description of Artificial Sequence: Synthetic peptide
DESEIATTNPVSTEPYGVISMTIQQQGNH

SEQ ID NO: 89558 - protein, 29 aa, Artificial Sequence
  Description of Artificial Sequence: Synthetic peptide
DESEIATTNPVSTEPYGVISSDLQQQGNI

SEQ ID NO: 89559 - protein, 32 aa, Artificial Sequence
  Description of Artificial Sequence: Synthetic polypeptide
DESEIATTNPVSTEQWGSVSCINEPQREGENG

SEQ ID NO: 89560 - protein, 32 aa, Artificial Sequence
  Description of Artificial Sequence: Synthetic polypeptide
DESEIATTNPVSTEQYGSVAATDLQDHEGQDR

SEQ ID NO: 89561 - protein, 32 aa, Artificial Sequence
  Description of Artificial Sequence: Synthetic polypeptide
DESEIATVNPVATEQYGSVSDINEPQDSEGNG

SEQ ID NO: 89562 - protein, 32 aa, Artificial Sequence
  Description of Artificial Sequence: Synthetic polypeptide
DESEIATVNPVATEQYGSVSDINEPQDSEGNQ

SEQ ID NO: 89563 - protein, 31 aa, Artificial Sequence
  Description of Artificial Sequence: Synthetic polypeptide
DESEIATVNPVATEQYGVVSDNEPQDSEGNQ

SEQ ID NO: 89564 - protein, 29 aa, Artificial Sequence
  Description of Artificial Sequence: Synthetic peptide
DESEIATVNPVCTECWGVVSDNEQREGNQ

SEQ ID NO: 89565 - protein, 30 aa, Artificial Sequence
  Description of Artificial Sequence: Synthetic polypeptide
DESEIATVNPVCTEQYGVVSCNEPQSEGNQ

SEQ ID NO: 89566 - protein, 30 aa, Artificial Sequence
  Description of Artificial Sequence: Synthetic polypeptide
DESEIATVNPVCTEQYGVVSDNEPQSEGNQ

SEQ ID NO: 89567 - protein, 30 aa, Artificial Sequence
  Description of Artificial Sequence: Synthetic polypeptide
DEAEIATTNPVAYEQWGSISATANLPAPMR

SEQ ID NO: 89568 - protein, 30 aa, Artificial Sequence
  Description of Artificial Sequence: Synthetic polypeptide
CSEEIATTNPVGTEDWGMVSITNLQGVGER

SEQ ID NO: 89569 - protein, 33 aa, Artificial Sequence
  Description of Artificial Sequence: Synthetic polypeptide
DEMEIRTTNPVATEYWGSVSWINENQDREGSNG

SEQ ID NO: 89570 - protein, 33 aa, Artificial Sequence
  Description of Artificial Sequence: Synthetic polypeptide
DEMEIRTTNPVATEQYGVVSTNNIQTRHSDQDM

SEQ ID NO: 89571 - protein, 35 aa, Artificial Sequence
  Description of Artificial Sequence: Synthetic polypeptide
DEEEIRTTNPVATEQYGTVTVSVTNLLQQGTTTEM

SEQ ID NO: 89572 - protein, 34 aa, Artificial Sequence
  Description of Artificial Sequence: Synthetic polypeptide
DESEICTTNPVATEHYGSVSTGGLAGDIQGGNQR

SEQ ID NO: 89573 - protein, 32 aa, Artificial Sequence
  Description of Artificial Sequence: Synthetic polypeptide
DESEIRSTNPVATEGYGNVSNITIPQSRVGNG

SEQ ID NO: 89574 - protein, 30 aa, Artificial Sequence
  Description of Artificial Sequence: Synthetic polypeptide
DEMEIRTTNPVATEQYGSVYMDLNGTEVFS

SEQ ID NO: 89575 - protein, 31 aa, Artificial Sequence
  Description of Artificial Sequence: Synthetic polypeptide
DESEIRSTNPVATEGYGNVSNTIPQSRVGQG

SEQ ID NO: 89576 - protein, 32 aa, Artificial Sequence
  Description of Artificial Sequence: Synthetic polypeptide
DESEIRTTNPVATCHYGCVSTNHQERFTSNQA

SEQ ID NO: 89577 - protein, 31 aa, Artificial Sequence
  Description of Artificial Sequence: Synthetic polypeptide
DESEIRTTNPVATCHYGCVSTNLQENFTSQQ

SEQ ID NO: 89578 - protein, 34 aa, Artificial Sequence
  Description of Artificial Sequence: Synthetic polypeptide
DEMEIRTTNPVATEQYGSVSVTNIDTRLGSDGDL

SEQ ID NO: 89579 - protein, 34 aa, Artificial Sequence
  Description of Artificial Sequence: Synthetic polypeptide
DEMEIRTTNPVATEQYGSVSVTLMTETFGNENRI

SEQ ID NO: 89580 - protein, 33 aa, Artificial Sequence
  Description of Artificial Sequence: Synthetic polypeptide
DECEICTVNPVATEQYGSVSTTNAQLQQQNQDE

SEQ ID NO: 89581 - protein, 33 aa, Artificial Sequence
  Description of Artificial Sequence: Synthetic polypeptide
CEDEIRTTNPVATEQYGSVDTNLQNIGGGQGGQ

SEQ ID NO: 89582 - protein, 34 aa, Artificial Sequence
  Description of Artificial Sequence: Synthetic polypeptide
DEEEIRTTNPVATEQYGVTVVSTPAELSQRTVSP

SEQ ID NO: 89583 - protein, 34 aa, Artificial Sequence
  Description of Artificial Sequence: Synthetic polypeptide
DECEICTVNPVATEQYGSVSTTANLQQQGNQDED

SEQ ID NO: 89584 - protein, 32 aa, Artificial Sequence
  Description of Artificial Sequence: Synthetic polypeptide
DEMEIRTTNPVATEQYGSVSVSPLPESEENII

SEQ ID NO: 89585 - protein, 33 aa, Artificial Sequence
  Description of Artificial Sequence: Synthetic polypeptide
DEMEIRTTNPVATEQYGSVSVSANSERFGDDQH

SEQ ID NO: 89586 - protein, 33 aa, Artificial Sequence
  Description of Artificial Sequence: Synthetic polypeptide
DECEICTVNPVATEQYGSVSTTNLGEEGTNNTD

SEQ ID NO: 89587 - protein, 32 aa, Artificial Sequence
  Description of Artificial Sequence: Synthetic polypeptide
CTGEIRTTNPVATEQYGSVSTQNNGQIGEGGD

SEQ ID NO: 89588 - protein, 32 aa, Artificial Sequence
  Description of Artificial Sequence: Synthetic polypeptide
CTGEIRTTNPVATEQYGSVSTQNNGQLGEEGG

SEQ ID NO: 89589 - protein, 31 aa, Artificial Sequence
  Description of Artificial Sequence: Synthetic polypeptide
DEAEIATTNPVAYEEYGVVSTNLQGEMNGEN

SEQ ID NO: 89590 - protein, 32 aa, Artificial Sequence
  Description of Artificial Sequence: Synthetic polypeptide
DESEIRTTNPVATDAYGSVASTGGQGETGNGD

SEQ ID NO: 89591 - protein, 33 aa, Artificial Sequence
  Description of Artificial Sequence: Synthetic polypeptide
DESEIRTTNPVATDAYGSVASVTNGQEGTGNGD

SEQ ID NO: 89592 - protein, 33 aa, Artificial Sequence
  Description of Artificial Sequence: Synthetic polypeptide
DEMEIRTTNPVATEQYGSVSVSNSLDEYGDDMQ

SEQ ID NO: 89593 - protein, 33 aa, Artificial Sequence
  Description of Artificial Sequence: Synthetic polypeptide
DECEICTVNPVATEQYGSVSTQNNLEEGTNTTE

SEQ ID NO: 89594 - protein, 33 aa, Artificial Sequence
  Description of Artificial Sequence: Synthetic polypeptide
DECEICTVNPVATEQYGSVSTQNNLEEGNNDTQ

SEQ ID NO: 89595 - protein, 34 aa, Artificial Sequence
  Description of Artificial Sequence: Synthetic polypeptide
DEMEIRTTNPVATEQYGSVSVTNLNDEYSGDDPQ

SEQ ID NO: 89596 - protein, 32 aa, Artificial Sequence
  Description of Artificial Sequence: Synthetic polypeptide
DESEIRTTNPVASECWGSVSCINEPQREGENG

SEQ ID NO: 89597 - protein, 31 aa, Artificial Sequence
  Description of Artificial Sequence: Synthetic polypeptide
CEDTIRTTNPVATEQYGDVDTNGQGGGNDQE

SEQ ID NO: 89598 - protein, 31 aa, Artificial Sequence
  Description of Artificial Sequence: Synthetic polypeptide
DEAEIATTNPVAYEPYGSVSANNDRGGTGRN

SEQ ID NO: 89599 - protein, 31 aa, Artificial Sequence
  Description of Artificial Sequence: Synthetic polypeptide
DEAEIATTNPVAYEPYGSVSAANDDRNNNRS

SEQ ID NO: 89600 - protein, 31 aa, Artificial Sequence
  Description of Artificial Sequence: Synthetic polypeptide
DEAEIATTNPVAYEPYGSVSAAGNDDRGNDS

SEQ ID NO: 89601 - protein, 32 aa, Artificial Sequence
  Description of Artificial Sequence: Synthetic polypeptide
DESEIRTTNPVATCGYGCVCSTNLQERFTSDQ

SEQ ID NO: 89602 - protein, 32 aa, Artificial Sequence
  Description of Artificial Sequence: Synthetic polypeptide
DESEIRTTNPVATCGYGCVCSTNLQYFTSNQM

SEQ ID NO: 89603 - protein, 32 aa, Artificial Sequence
  Description of Artificial Sequence: Synthetic polypeptide
DECEICTTNPVAYEQWGTVSTNLQGEHGNNNS

SEQ ID NO: 89604 - protein, 33 aa, Artificial Sequence
  Description of Artificial Sequence: Synthetic polypeptide
DEAEIATTNPVAYEPYGSVATNNLQSDGNNGRP

SEQ ID NO: 89605 - protein, 30 aa, Artificial Sequence
  Description of Artificial Sequence: Synthetic polypeptide
DEAEIATTNPVAYEPYGHVVAAANLQDGND

SEQ ID NO: 89606 - protein, 34 aa, Artificial Sequence
  Description of Artificial Sequence: Synthetic polypeptide
DEMEIRTTNPVATEQYGSVSVTNNNSDHGSNNDG

SEQ ID NO: 89607 - protein, 33 aa, Artificial Sequence
  Description of Artificial Sequence: Synthetic polypeptide
DECEICTVNPVATEQYGSVSTALQQQGNQQTED

SEQ ID NO: 89608 - protein, 32 aa, Artificial Sequence
  Description of Artificial Sequence: Synthetic polypeptide
DECEICTVNPVATEQYGSVSTALQQQNQQQEE

SEQ ID NO: 89609 - protein, 36 aa, Artificial Sequence
  Description of Artificial Sequence: Synthetic polypeptide
DEMEIRTTNPVATEQYGSVSVTNLNLEQNEGNEDVT

SEQ ID NO: 89610 - protein, 32 aa, Artificial Sequence
  Description of Artificial Sequence: Synthetic polypeptide
DECEICTVNPVATEQYGSVSTALQQQNTQDEQ

SEQ ID NO: 89611 - protein, 32 aa, Artificial Sequence
  Description of Artificial Sequence: Synthetic polypeptide
DECEICTVNPVATEQYGSVSTALQQQQNQDEE

SEQ ID NO: 89612 - protein, 32 aa, Artificial Sequence
  Description of Artificial Sequence: Synthetic polypeptide
DECEICTVNPVATEQYGSVSTALQQQTNDQED

SEQ ID NO: 89613 - protein, 32 aa, Artificial Sequence
  Description of Artificial Sequence: Synthetic polypeptide
DESEIRTTNPVATDAYGSVSIMNTGQGTGNGD

SEQ ID NO: 89614 - protein, 32 aa, Artificial Sequence
  Description of Artificial Sequence: Synthetic polypeptide
DESEIRTTNPVATDAYGSVSINNGQEGTGNGD

SEQ ID NO: 89615 - protein, 34 aa, Artificial Sequence
  Description of Artificial Sequence: Synthetic polypeptide
CEDEIRTTNPVATEAYGSVSSCHNLSQRTEGNNM

SEQ ID NO: 89616 - protein, 33 aa, Artificial Sequence
  Description of Artificial Sequence: Synthetic polypeptide
CEDEICTTNPVVYEQYGSVSACNSLDQRGSNRD

SEQ ID NO: 89617 - protein, 33 aa, Artificial Sequence
  Description of Artificial Sequence: Synthetic polypeptide
DESEIRTTNPVATEAWGSVSNINEPQDREGENE

SEQ ID NO: 89618 - protein, 33 aa, Artificial Sequence
  Description of Artificial Sequence: Synthetic polypeptide
DESEIRTTNPVATEAWGSVSSINEPQDREGNNQ

SEQ ID NO: 89619 - protein, 33 aa, Artificial Sequence
  Description of Artificial Sequence: Synthetic polypeptide
DECEICTVNPVATEQYGVVSTNLQFNEEGNNVE

SEQ ID NO: 89620 - protein, 34 aa, Artificial Sequence
  Description of Artificial Sequence: Synthetic polypeptide
DEEEIRTTNPVATEQYGVVCSTEELQGFNSNNQM

SEQ ID NO: 89621 - protein, 34 aa, Artificial Sequence
  Description of Artificial Sequence: Synthetic polypeptide
DESEIRTTNPVATEAWGSVSTVNNNLQDEEGENG

SEQ ID NO: 89622 - protein, 33 aa, Artificial Sequence
  Description of Artificial Sequence: Synthetic polypeptide
DESEIRTTNPVATEAWGSVSVINETLDREGENG

SEQ ID NO: 89623 - protein, 34 aa, Artificial Sequence
  Description of Artificial Sequence: Synthetic polypeptide
DEEEIRTTNPVATEQYGVVCSTEHQEHFGSDNQT

SEQ ID NO: 89624 - protein, 33 aa, Artificial Sequence
  Description of Artificial Sequence: Synthetic polypeptide
DESEIRTTNPVATEAWGSVSVVNTLQDEEGENG

SEQ ID NO: 89625 - protein, 33 aa, Artificial Sequence
  Description of Artificial Sequence: Synthetic polypeptide
DESEIRTTNPVATEAWGSVSWINENQDRFGSNG

SEQ ID NO: 89626 - protein, 34 aa, Artificial Sequence
  Description of Artificial Sequence: Synthetic polypeptide
DESEIRTTNPVATEAYGIVQSCTDNALTAGGENR

SEQ ID NO: 89627 - protein, 33 aa, Artificial Sequence
  Description of Artificial Sequence: Synthetic polypeptide
DECEIGTTNPVAWEQWGWVSYTNELEQVGNNRL

SEQ ID NO: 89628 - protein, 34 aa, Artificial Sequence
  Description of Artificial Sequence: Synthetic polypeptide
DEMEIRTTNPVATEQYGSVSTTNDELQQEQEEDK

SEQ ID NO: 89629 - protein, 30 aa, Artificial Sequence
  Description of Artificial Sequence: Synthetic polypeptide
CEDEIATTNPVAYEQYGSVAATNDTTGNQD

SEQ ID NO: 89630 - protein, 33 aa, Artificial Sequence
  Description of Artificial Sequence: Synthetic polypeptide
DESEIRTTNPVATECAGSVSCINEPQDREGENG

SEQ ID NO: 89631 - protein, 35 aa, Artificial Sequence
  Description of Artificial Sequence: Synthetic polypeptide
DEMEIRTTNPVATEQYGSVSTSWEQYDRIGSNQQE

SEQ ID NO: 89632 - protein, 33 aa, Artificial Sequence
  Description of Artificial Sequence: Synthetic polypeptide
DESEIRTTNPVATECAGSVSCINEPQDREGRNG

SEQ ID NO: 89633 - protein, 33 aa, Artificial Sequence
  Description of Artificial Sequence: Synthetic polypeptide
DEMEIRTTNPVATEQYGSVSTQSALGAAENVND

SEQ ID NO: 89634 - protein, 33 aa, Artificial Sequence
  Description of Artificial Sequence: Synthetic polypeptide
DESEIRTTNPVATEAWGSVSDINEPQDRTGENG

SEQ ID NO: 89635 - protein, 33 aa, Artificial Sequence
  Description of Artificial Sequence: Synthetic polypeptide
DEMEIRTTNPVATEQYGSVSVTPTHQEYQDNTM

SEQ ID NO: 89636 - protein, 33 aa, Artificial Sequence
  Description of Artificial Sequence: Synthetic polypeptide
DESEIRTTNPVATEAWGSVSCINESQDREGEND

SEQ ID NO: 89637 - protein, 32 aa, Artificial Sequence
  Description of Artificial Sequence: Synthetic polypeptide
CTGEIRTTNPVATEQYGSVSTQNNGQSGEQGG

SEQ ID NO: 89638 - protein, 33 aa, Artificial Sequence
  Description of Artificial Sequence: Synthetic polypeptide
DESEIRTTNPVATDQYGSVNTLGLQEEGGNEDT

SEQ ID NO: 89639 - protein, 34 aa, Artificial Sequence
  Description of Artificial Sequence: Synthetic polypeptide
DEMEIRTTNPVATEQYGSVSTYVLPSNLDDDNFG

SEQ ID NO: 89640 - protein, 33 aa, Artificial Sequence
  Description of Artificial Sequence: Synthetic polypeptide
DECEICTVNPVATEQYGSVSTTQALQQGNQDED

SEQ ID NO: 89641 - protein, 30 aa, Artificial Sequence
  Description of Artificial Sequence: Synthetic polypeptide
DEAEIATTNPVAYEEWGSVATNLQGGMDGH

SEQ ID NO: 89642 - protein, 33 aa, Artificial Sequence
  Description of Artificial Sequence: Synthetic polypeptide
DESEIRTTNPVATDSYGSVISTNGLGQIFTNGM

SEQ ID NO: 89643 - protein, 32 aa, Artificial Sequence
  Description of Artificial Sequence: Synthetic polypeptide
CTGEIRTTNPVATEQYGSVSTQNNGQSGEMGT

SEQ ID NO: 89644 - protein, 33 aa, Artificial Sequence
  Description of Artificial Sequence: Synthetic polypeptide
DEEEIRTTNPVATEQYGVVCSNWEHQNFGSNQQ

SEQ ID NO: 89645 - protein, 32 aa, Artificial Sequence
  Description of Artificial Sequence: Synthetic polypeptide
DEMEIRTTNPVATEQYGSVSTVHEDFEGEIDE

SEQ ID NO: 89646 - protein, 33 aa, Artificial Sequence
  Description of Artificial Sequence: Synthetic polypeptide
DEEEIRTTNPVATEQYGVVCSSEHQNFGSENQI

SEQ ID NO: 89647 - protein, 30 aa, Artificial Sequence
  Description of Artificial Sequence: Synthetic polypeptide
CEDEIATTNPVAYEQYGSVATNLQANPTEH

SEQ ID NO: 89648 - protein, 32 aa, Artificial Sequence
  Description of Artificial Sequence: Synthetic polypeptide
CEDEIATTNPVAYEQYGSVATNLETGGDNDRD

SEQ ID NO: 89649 - protein, 32 aa, Artificial Sequence
  Description of Artificial Sequence: Synthetic polypeptide
DESEIRTTNPVATDVYGSVNTGLQNEGGNEDT

SEQ ID NO: 89650 - protein, 33 aa, Artificial Sequence
  Description of Artificial Sequence: Synthetic polypeptide
DESEIRTTNPVATEAWGSVSCGNEPQDREGTNG

SEQ ID NO: 89651 - protein, 34 aa, Artificial Sequence
  Description of Artificial Sequence: Synthetic polypeptide
DECEICTVNPVATEQYGSVSTVANLQQGNQQTED

SEQ ID NO: 89652 - protein, 34 aa, Artificial Sequence
  Description of Artificial Sequence: Synthetic polypeptide
DECEICTVNPVATEQYGSVSTVNLQNSEEGNNSE

SEQ ID NO: 89653 - protein, 33 aa, Artificial Sequence
  Description of Artificial Sequence: Synthetic polypeptide
DEMEIRTTNPVATEQYGSVSTTTLESLTENSQG

SEQ ID NO: 89654 - protein, 33 aa, Artificial Sequence
  Description of Artificial Sequence: Synthetic polypeptide
DESEIRTTNPVATEAWGSVSCINENQDREGENM

SEQ ID NO: 89655 - protein, 33 aa, Artificial Sequence
  Description of Artificial Sequence: Synthetic polypeptide
DESEIRTTNPVATEAWGSVSCINEPQDREGENG

SEQ ID NO: 89656 - protein, 28 aa, Artificial Sequence
  Description of Artificial Sequence: Synthetic peptide
DEMEIVSTNPVATEGYGTMASTLQHGDD

SEQ ID NO: 89657 - protein, 33 aa, Artificial Sequence
  Description of Artificial Sequence: Synthetic polypeptide
DESEIRTTNPVALECYGSVSCINEPQDREGENG

SEQ ID NO: 89658 - protein, 34 aa, Artificial Sequence
  Description of Artificial Sequence: Synthetic polypeptide
DEEEIRTTNPVATEQYGSVSTNLGLSPVPFQVEA

SEQ ID NO: 89659 - protein, 35 aa, Artificial Sequence
  Description of Artificial Sequence: Synthetic polypeptide
DEMEIRTTNPVATEQYGSVWPTLNLEQNEGNVDVT

SEQ ID NO: 89660 - protein, 34 aa, Artificial Sequence
  Description of Artificial Sequence: Synthetic polypeptide
DEMEIRTTNPVATEQYGSVWDNINNQRDGSINEM

SEQ ID NO: 89661 - protein, 30 aa, Artificial Sequence
  Description of Artificial Sequence: Synthetic polypeptide
DESEIRSTNPVGTECWGVVSSITLQRGENG

SEQ ID NO: 89662 - protein, 33 aa, Artificial Sequence
  Description of Artificial Sequence: Synthetic polypeptide
DEMEIRTTNPVATEQYGSVWAEVDTQLGNDQRN

SEQ ID NO: 89663 - protein, 29 aa, Artificial Sequence
  Description of Artificial Sequence: Synthetic peptide
DESEIRSTNPVGTEGWGVMSCTLPQRGNG

SEQ ID NO: 89664 - protein, 29 aa, Artificial Sequence
  Description of Artificial Sequence: Synthetic peptide
DESEIRSTNPVGTEGYGDVASTLQAAGDI

SEQ ID NO: 89665 - protein, 30 aa, Artificial Sequence
  Description of Artificial Sequence: Synthetic polypeptide
DESEIRSTNPVGTEGYGVVASPTLQMHGNV

SEQ ID NO: 89666 - protein, 32 aa, Artificial Sequence
  Description of Artificial Sequence: Synthetic polypeptide
DESEIRSTNPVCTEQWGSVSCINEPQREGENG

SEQ ID NO: 89667 - protein, 30 aa, Artificial Sequence
  Description of Artificial Sequence: Synthetic polypeptide
DESEIRSTNPVGTEGYGVVSSPTLQRNGDV

SEQ ID NO: 89668 - protein, 35 aa, Artificial Sequence
  Description of Artificial Sequence: Synthetic polypeptide
DEMEIRTTNPVATEQYGSVTWTYVNLQSRDNDQMW

SEQ ID NO: 89669 - protein, 31 aa, Artificial Sequence
  Description of Artificial Sequence: Synthetic polypeptide
DESEIRSTNPVSTEQYGNVAANTIQSRVGQR

SEQ ID NO: 89670 - protein, 33 aa, Artificial Sequence
  Description of Artificial Sequence: Synthetic polypeptide
DEMEIRTTNPVATEQYGSVTTWVDLQERDDDQE

SEQ ID NO: 89671 - protein, 32 aa, Artificial Sequence
  Description of Artificial Sequence: Synthetic polypeptide
DESEIRSTNPVSTEQYGNVATTTIQSRNGNPR

SEQ ID NO: 89672 - protein, 32 aa, Artificial Sequence
  Description of Artificial Sequence: Synthetic polypeptide
DEMEIRTTNPVATEQYGSVTTTVDLEREDVQM

SEQ ID NO: 89673 - protein, 33 aa, Artificial Sequence
  Description of Artificial Sequence: Synthetic polypeptide
DESEIRTTNCVATECYGSVSCINEPQDREGENG

SEQ ID NO: 89674 - protein, 30 aa, Artificial Sequence
  Description of Artificial Sequence: Synthetic polypeptide
CEDVIATTNPVATAQWGTVSTDDLQNGNRN

SEQ ID NO: 89675 - protein, 32 aa, Artificial Sequence
  Description of Artificial Sequence: Synthetic polypeptide
DESEIRSTNPVSTEGYGNVATNTIQSRNGNPR

SEQ ID NO: 89676 - protein, 32 aa, Artificial Sequence
  Description of Artificial Sequence: Synthetic polypeptide
DESEIRSTNPVATEQYGVVSTPAGPQMRGDPI

SEQ ID NO: 89677 - protein, 31 aa, Artificial Sequence
  Description of Artificial Sequence: Synthetic polypeptide
DESEIRSTNPVATEQYGVVATPAGQMRGDPI

SEQ ID NO: 89678 - protein, 33 aa, Artificial Sequence
  Description of Artificial Sequence: Synthetic polypeptide
DEEEIRTTNPVATEQYGVCVCSTEHQGFGSDQG

SEQ ID NO: 89679 - protein, 32 aa, Artificial Sequence
  Description of Artificial Sequence: Synthetic polypeptide
DEAEIATTNPVAYEQWGAVSTNLQGNAGGDRQ

SEQ ID NO: 89680 - protein, 37 aa, Artificial Sequence
  Description of Artificial Sequence: Synthetic polypeptide
DEEEIRTTNPVATEQYGSVSTNLNQQGNTEEGTTQGQ

SEQ ID NO: 89681 - protein, 32 aa, Artificial Sequence
  Description of Artificial Sequence: Synthetic polypeptide
DEAEIATTNPVAYEQWGAVSTNLQGEHGTNDD

SEQ ID NO: 89682 - protein, 33 aa, Artificial Sequence
  Description of Artificial Sequence: Synthetic polypeptide
DESEIRSTNPVATEGYGSVSATSPALPQRGDPI

SEQ ID NO: 89683 - protein, 33 aa, Artificial Sequence
  Description of Artificial Sequence: Synthetic polypeptide
DESEIRSTNPVATEGYGSVSCINEPQSRVGENG

SEQ ID NO: 89684 - protein, 32 aa, Artificial Sequence
  Description of Artificial Sequence: Synthetic polypeptide
DEEEIRTTNPVATEQYGVAIVGPMYAIDRLNR

SEQ ID NO: 89685 - protein, 34 aa, Artificial Sequence
  Description of Artificial Sequence: Synthetic polypeptide
DEMEIRTTNPVATEQYGSVWTNDINNQRDGSIFE

SEQ ID NO: 89686 - protein, 33 aa, Artificial Sequence
  Description of Artificial Sequence: Synthetic polypeptide
DEMEIRTTNPVATEQYGSVWSWPNLDEYGDDAQ

SEQ ID NO: 89687 - protein, 35 aa, Artificial Sequence
  Description of Artificial Sequence: Synthetic polypeptide
DEMEIRTTNPVATEQYGSVWSTLNGVEQEEGQNEP

SEQ ID NO: 89688 - protein, 33 aa, Artificial Sequence
  Description of Artificial Sequence: Synthetic polypeptide
DESEIRSTNPVATEQWGSVSCINEPQDREGENG

SEQ ID NO: 89689 - protein, 32 aa, Artificial Sequence
  Description of Artificial Sequence: Synthetic polypeptide
DESEIRSTNPVATEQYGNVAANPAIQMRVGNV

SEQ ID NO: 89690 - protein, 32 aa, Artificial Sequence
  Description of Artificial Sequence: Synthetic polypeptide
DESEIRSTNPVATEQYGNVAANPTIQMRVGNV

SEQ ID NO: 89691 - protein, 32 aa, Artificial Sequence
  Description of Artificial Sequence: Synthetic polypeptide
DESEIRSTNPVATEQYGNVAANPTIQMRVGQR

SEQ ID NO: 89692 - protein, 34 aa, Artificial Sequence
  Description of Artificial Sequence: Synthetic polypeptide
DEEEIRTTNPVATEQYGVCVCSTEEHQNFGSNQF

SEQ ID NO: 89693 - protein, 30 aa, Artificial Sequence
  Description of Artificial Sequence: Synthetic polypeptide
DESEIRSTNPVATEQYGNVSNTIMSAVEDR

SEQ ID NO: 89694 - protein, 30 aa, Artificial Sequence
  Description of Artificial Sequence: Synthetic polypeptide
DESEIRSTNPVATEQYGNVSNTIQSAVEDR

SEQ ID NO: 89695 - protein, 34 aa, Artificial Sequence
  Description of Artificial Sequence: Synthetic polypeptide
DEEEIRTTNPVATEQYGVCVCSTEHQENFGSNQM

SEQ ID NO: 89696 - protein, 33 aa, Artificial Sequence
  Description of Artificial Sequence: Synthetic polypeptide
DESEIRTTNPCATECYGSVCSKTENQDDRGNAG

SEQ ID NO: 89697 - protein, 33 aa, Artificial Sequence
  Description of Artificial Sequence: Synthetic polypeptide
DESEIRTTNPCATECYGSVSTGNLGNDGQPGDA

SEQ ID NO: 89698 - protein, 33 aa, Artificial Sequence
  Description of Artificial Sequence: Synthetic polypeptide
DESEIRTTNPCATEQYGSVAQTGHSSQSVGNNR

SEQ ID NO: 89699 - protein, 30 aa, Artificial Sequence
  Description of Artificial Sequence: Synthetic polypeptide
CEDVIATTNPVATAQWGSVSTDDGQRGNGM

SEQ ID NO: 89700 - protein, 33 aa, Artificial Sequence
  Description of Artificial Sequence: Synthetic polypeptide
DEMEIRTTNPVATEQYGSVSWDDDLEQMDQNDL

SEQ ID NO: 89701 - protein, 33 aa, Artificial Sequence
  Description of Artificial Sequence: Synthetic polypeptide
DESEIRTTNPLATECYGSVSCINEPQDREGENG

SEQ ID NO: 89702 - protein, 31 aa, Artificial Sequence
  Description of Artificial Sequence: Synthetic polypeptide
DESEIRTTNPMAYEAWGQSTVSCTNGQPSNR

SEQ ID NO: 89703 - protein, 32 aa, Artificial Sequence
  Description of Artificial Sequence: Synthetic polypeptide
DESEIRTTNPMAYEQWGQSVVPSTNGSQPSNR

SEQ ID NO: 89704 - protein, 33 aa, Artificial Sequence
  Description of Artificial Sequence: Synthetic polypeptide
DESEIRTTNPMAYEQYGSVAATNLSQSTGENST

SEQ ID NO: 89705 - protein, 32 aa, Artificial Sequence
  Description of Artificial Sequence: Synthetic polypeptide
DECEICTTNPVATTQYGVVSTTQLQQGTNQDE

SEQ ID NO: 89706 - protein, 33 aa, Artificial Sequence
  Description of Artificial Sequence: Synthetic polypeptide
DEMEIRTTNPVATEQYGSVSVTYVQNSFQENQN

SEQ ID NO: 89707 - protein, 34 aa, Artificial Sequence
  Description of Artificial Sequence: Synthetic polypeptide
DEMEIRTTNPVATEQYGSVSVTYNLGEDFNVMEI

SEQ ID NO: 89708 - protein, 32 aa, Artificial Sequence
  Description of Artificial Sequence: Synthetic polypeptide
DEEEIRTTNPVATEQYGVMATSAGQRNGMDPI

SEQ ID NO: 89709 - protein, 32 aa, Artificial Sequence
  Description of Artificial Sequence: Synthetic polypeptide
DEEEIRTTNPVATEQYGVMGTVNGEIGGGQNQ

SEQ ID NO: 89710 - protein, 33 aa, Artificial Sequence
  Description of Artificial Sequence: Synthetic polypeptide
DESEIRTTNPTATECYGSVCSKTENQDDRNGNA

SEQ ID NO: 89711 - protein, 34 aa, Artificial Sequence
  Description of Artificial Sequence: Synthetic polypeptide
DEMEIRTTNPVATEQYGSVSVTTDDLQQEGEEDK

SEQ ID NO: 89712 - protein, 33 aa, Artificial Sequence
  Description of Artificial Sequence: Synthetic polypeptide
DECEICTTNPVAVEQYGSVSTNSTNLEQGTNGS

SEQ ID NO: 89713 - protein, 31 aa, Artificial Sequence
  Description of Artificial Sequence: Synthetic polypeptide
DECEICTTNPVAVEQYGSVSTSTNNEQTNEG

SEQ ID NO: 89714 - protein, 32 aa, Artificial Sequence
  Description of Artificial Sequence: Synthetic polypeptide
DECEICTTNPVAVEQYGSVSTSTNNNEQSTNG

SEQ ID NO: 89715 - protein, 35 aa, Artificial Sequence
  Description of Artificial Sequence: Synthetic polypeptide
DEEEIRTTNPVATEQYGSVSTNLGNSQLPFQVVDL

SEQ ID NO: 89716 - protein, 36 aa, Artificial Sequence
  Description of Artificial Sequence: Synthetic polypeptide
DEEEIRTTNPVATEQYGSVSTNLGLSQHVPFFVGEA

SEQ ID NO: 89717 - protein, 32 aa, Artificial Sequence
  Description of Artificial Sequence: Synthetic polypeptide
DEAEIATTNPVAYEPYGVVASATNLQEGDNQM

SEQ ID NO: 89718 - protein, 33 aa, Artificial Sequence
  Description of Artificial Sequence: Synthetic polypeptide
DESEIRTTNPVALECWGSVSCINLPQDREGENG

SEQ ID NO: 89719 - protein, 32 aa, Artificial Sequence
  Description of Artificial Sequence: Synthetic polypeptide
DEMEIRTTNPVATEQYGSVSWEHTTDESGQED

SEQ ID NO: 89720 - protein, 32 aa, Artificial Sequence
  Description of Artificial Sequence: Synthetic polypeptide
DESEIRTTNPIATECWGSVSENEPQDREGENG
